United States Patent 8,461,315 (MICRORNAS AND USES THEREOF) - sequence listing, part 24

SEQ ID NO: 692221 - RNA, 64 nt, Homo Sapiens
gcuuuuaaaguuaugaacucaacauuuuuaauauggcauguaaaaaauaguuauauaaaugaag

SEQ ID NO: 692222 - RNA, 64 nt, Homo Sapiens
ggugguuuuuccugccaguucaggagagauucuuggcauguaauauauaucacugcucaaguca

SEQ ID NO: 692223 - RNA, 64 nt, Homo Sapiens
uguaauucucuaugguuugaaauggaucauacgaggcauguaauaccaagaauuguuacuuuac

SEQ ID NO: 692224 - RNA, 64 nt, Homo Sapiens
ccagguaucuccccuccucucucuccccugcagaggcauguagggaacagcaggagauuauucu

SEQ ID NO: 692225 - RNA, 64 nt, Homo Sapiens
uuuaaccagaaaaguacauugcuaaccccaaacaggcauguaucaaaacaccuguggaguacuu

SEQ ID NO: 692226 - RNA, 64 nt, Homo Sapiens
ggacaggguacccuugggucgcacgggccuggcuggcauguaaacggucaguugcacugccuag

SEQ ID NO: 692227 - RNA, 64 nt, Homo Sapiens
accuaaaaugauugacucauucauaguaaauaugggcauguaaacuaauaaauaugcacuggau

SEQ ID NO: 692228 - RNA, 64 nt, Homo Sapiens
cuacgugaagauuaagcuuugcuuacugauacauggcauguauucuuuucagucuuuuguguuu

SEQ ID NO: 692229 - RNA, 64 nt, Homo Sapiens
uuaucuuagucuauagaaaugaucauugcauggaggcauguauagguaugaucuguguaaaauc

SEQ ID NO: 692230 - RNA, 64 nt, Homo Sapiens
uguugaauggaauaauaaugaggaaacuguguuaggcauguauuaaaacauuuaaauaaaauaa

SEQ ID NO: 692231 - RNA, 64 nt, Homo Sapiens
ugggggaggcgucugcaggucuccccuugcguggggcauguaggaggcaggccgggcuccaggg

SEQ ID NO: 692232 - RNA, 64 nt, Homo Sapiens
ucuuccucuauaaagaauagguaucuauagagcuggcauguaauuccaugucuuggauacauac

SEQ ID NO: 692233 - RNA, 64 nt, Homo Sapiens
agauuguccuauauuuuauggaauacauauguauggcauguacuauaucuccaauauuaggaug

SEQ ID NO: 692234 - RNA, 64 nt, Homo Sapiens
uagagaacuuaauguucaaaauuugcuuuguggaggcauguaauaagauaaacaucauacauua

SEQ ID NO: 692235 - RNA, 64 nt, Homo Sapiens
uccuccaggaaauauaaugauuucugggaacaugggcauguauauauauauauggagagagaau

SEQ ID NO: 692236 - RNA, 64 nt, Homo Sapiens
uuucuggaagaauguaaguugcuauauguggaggggcauguaggacagggguucuaauuacugu

SEQ ID NO: 692237 - RNA, 64 nt, Homo Sapiens
ugcuguucgaggcccugugguaugcagaaaucaaggcauguacuugaguaugacaggcacugag

SEQ ID NO: 692238 - RNA, 64 nt, Homo Sapiens
uacaaauauuaaaggaggaguuuuuuuccauauuggcauguagcaauacauaaaugaaaauaca

SEQ ID NO: 692239 - RNA, 64 nt, Homo Sapiens
ccuuuuuauuuucauucaaugguucuuuauuuuuggcauguauguagugugucggacacaaaua

SEQ ID NO: 692240 - RNA, 64 nt, Homo Sapiens
ugcaguuuuuauaaaacauuuuuaaaacacaaauggcauguaugcuaaugagauuuacccgugu

SEQ ID NO: 692241 - RNA, 64 nt, Homo Sapiens
uacacauguugaauuuauuauuguuuauuuccaaggcauguauuauucaauuucuaauuaaaau

SEQ ID NO: 692242 - RNA, 64 nt, Homo Sapiens
aucucuaauuuauggucuauauaccaauuuaaauggcauguaaaccugccuguuucuucuccuc

SEQ ID NO: 692243 - RNA, 64 nt, Homo Sapiens
ccuauuuuauccuaagauuuacuccugaccagugggcauguauuaaauauuugcucccaggaga

SEQ ID NO: 692244 - RNA, 64 nt, Homo Sapiens
accgcaccugccucacauuuguagccaggacuauggcauguacccuucaaccuuagccuccuga

SEQ ID NO: 692245 - RNA, 64 nt, Homo Sapiens
caagcaagagcacugccucuccacagagcacuuuggcauguaaaccacccuuucgucaccucuu

SEQ ID NO: 692246 - RNA, 64 nt, Homo Sapiens
gggagccauucugucccaggcuagcagaagacaaggcauguagguaaacaggaguucagcggag

SEQ ID NO: 692247 - RNA, 64 nt, Homo Sapiens
agucuagcucugcucaugaaugaacaaagaagcaggcauguaaaauggauccuuguccuaacgu

SEQ ID NO: 692248 - RNA, 64 nt, Homo Sapiens
agcaaagcaaacagcuacauuaucuuuaacauaaggcauguagccauauuuucauauaguggua

SEQ ID NO: 692249 - RNA, 64 nt, Homo Sapiens
gccuggccaacauggugaaaccccaucucuccugggcauguagucccagcuacucgggaggcug

SEQ ID NO: 692250 - RNA, 64 nt, Homo Sapiens
ucugcuccccacuuuguagagccuagcaugagguggcauguacuagaauuggauccuaggugcu

SEQ ID NO: 692251 - RNA, 50 nt, Homo Sapiens
augggugcaaaugaaugucaggcauguaugaaguggcgcaaaguuucuga

SEQ ID NO: 692252 - RNA, 64 nt, Homo Sapiens
agaaaaccacaggaagaaugcacggaguugccauggcauguaguaaucgacuuuauaucuuagu

SEQ ID NO: 692253 - RNA, 64 nt, Homo Sapiens
gacaggaaaggaaacaauggaugaagcaagggaaggcauguagguuuuuaaugcagaaguuuga

SEQ ID NO: 692254 - RNA, 64 nt, Homo Sapiens
uccauuucuuacacacacugccagagauacucuaggcauguaaagcacaaacauacauauaaaa

SEQ ID NO: 692255 - RNA, 64 nt, Homo Sapiens
cccucuagguccagggacuaucacagaagaagcaggcauguaagauuuuaaggacugguuucga

SEQ ID NO: 692256 - RNA, 64 nt, Homo Sapiens
uuccccccuaccgccucaccucacaggagggccaggcauguauuccucagaggcgaaacugcca

SEQ ID NO: 692257 - RNA, 64 nt, Homo Sapiens
agauuagacacuugaaguacucaggauagugccuggcauguaggaagcaccuggaaaauauucg

SEQ ID NO: 692258 - RNA, 64 nt, Homo Sapiens
ggccuggaggugggguuggggagccagucccaggggcauguauuugcaggguggugcugggacu

SEQ ID NO: 692259 - RNA, 64 nt, Homo Sapiens
aaaacaagggccuaucuccuaacauuaacauuucggcauguaaugcuuaugaacuaaaauuucu

SEQ ID NO: 692260 - RNA, 64 nt, Homo Sapiens
gucacggauuuucuggauaguaugcaaaguagcuggcauguaguguuuauuaaacaguuauaaa

SEQ ID NO: 692261 - RNA, 64 nt, Homo Sapiens
ccaaggccugauggccacugcucucuugccccuuggcauguaccacagaaggaaagccauagcg

SEQ ID NO: 692262 - RNA, 64 nt, Homo Sapiens
ccugcugggugaggacgagacuguuuccaucucaggcauguaucccaccaagugccucccucac

SEQ ID NO: 692263 - RNA, 64 nt, Homo Sapiens
auaccaucauuuuuuaacugagugaaauuauuaaggcauguaauacauuaaugaacauaauaua

SEQ ID NO: 692264 - RNA, 64 nt, Homo Sapiens
uuugccucauuacaucuaauaguucccauuugauggcauguauagggaagagugagagagugug

SEQ ID NO: 692265 - RNA, 64 nt, Homo Sapiens
uuuuuuugugccuugugcccuugaggugaccucuggcauguauccuggugguucuuacaucccc

SEQ ID NO: 692266 - RNA, 64 nt, Homo Sapiens
uuuccacauuggcacauucacuucucccacucuuggcauguaagaaauaagcauuuacauaauu

SEQ ID NO: 692267 - RNA, 64 nt, Homo Sapiens
gaauuugcugcuucucugggggaaaggugacaggggcauguaugcccuugacguuccgaggaug

SEQ ID NO: 692268 - RNA, 64 nt, Homo Sapiens
gaauuuaaauuuuuuauaacaauucucuacuauuggcauguaacauucuaacacauaauucuug

SEQ ID NO: 692269 - RNA, 64 nt, Homo Sapiens
acuucucuggccaguuugccucaugcauuccugcggcauguaugagugcgcaacacccucagcc

SEQ ID NO: 692270 - RNA, 64 nt, Homo Sapiens
cgcuggccaucuugaauccuuggcaggcagacccggcauguagcaaaaaugggaaguaaggucc

SEQ ID NO: 692271 - RNA, 64 nt, Homo Sapiens
uaucuaaucaagacaccucauguucuccuucaguggcauguaguaaauagcuccuuaaaaguac

SEQ ID NO: 692272 - RNA, 64 nt, Homo Sapiens
aagaucucugaagaauuucuuuuauaauagaaugggcauguauuguaacaguuuuaugucaaau

SEQ ID NO: 692273 - RNA, 64 nt, Homo Sapiens
guaccguguuuuuguuagguacagucuggaucauggcauguagaaauagaaauuuagaauuuua

SEQ ID NO: 692274 - RNA, 64 nt, Homo Sapiens
ggaguuuuuuuaacuuuaaauuuucuuucaauauggcauguagucaguuaaaaaaaaaacaacc

SEQ ID NO: 692275 - RNA, 64 nt, Homo Sapiens
uucaauuauguagcuuuguauuaauaaaugauauggcauguacuaaauuugacaacauaguuuc

SEQ ID NO: 692276 - RNA, 64 nt, Homo Sapiens
uauuugucuggagucacaguuuuuaacgcaugcaggcauguaaaucagaaagaugucuuucugg

SEQ ID NO: 692277 - RNA, 64 nt, Homo Sapiens
agugagucauaucuuaauauauuucuaaauguuuggcauguaaauguaaacucagcaucaaaau

SEQ ID NO: 692278 - RNA, 64 nt, Homo Sapiens
uauucauuucugcucaaucuguuaacaggcuucuggcauguagaucaguggucuccaagcuuuu

SEQ ID NO: 692279 - RNA, 64 nt, Homo Sapiens
aaaauauugguacguuggaauaaaaggaaaccaaggcauguagguuuacccuuuacuuauuagu

SEQ ID NO: 692280 - RNA, 64 nt, Homo Sapiens
gagguuaauuucugcucaagugguaccacuuaaaggcauguauucuuuuaguauguaaaaugaa

SEQ ID NO: 692281 - RNA, 64 nt, Homo Sapiens
cagagguauucaguuccuggcacaggggacuaggggcauguagaguauaugaggaggcaguaug

SEQ ID NO: 692282 - RNA, 64 nt, Homo Sapiens
accauacuuggcuaaauuaauagcugggacuacaggcauguaacuuccacuucagccucccaag

SEQ ID NO: 692283 - RNA, 64 nt, Homo Sapiens
uuacacuauuuauaaugacucacacuguagauauggcauguacuucccauguuuauacucuucc

SEQ ID NO: 692284 - RNA, 64 nt, Homo Sapiens
ccuguaacuaguaauuaacacuggggguaauuuuggcauguauaaugauugacuaugcccaucc

SEQ ID NO: 692285 - RNA, 64 nt, Homo Sapiens
guauagcagcuaaaagaguuuaguuuguuuauauggcauguauaaguuuucaauaaaugccuaa

SEQ ID NO: 692286 - RNA, 64 nt, Homo Sapiens
uguccacccaggaguggccuuguuaauuccaaguggcauguaucuucccucugagcuucauuuc

SEQ ID NO: 692287 - RNA, 64 nt, Homo Sapiens
ccaggaagauggaauacaccaaauggacaggccuggcauguacccacagagacugagaguuggu

SEQ ID NO: 692288 - RNA, 64 nt, Homo Sapiens
aggccaggccacgggcuugcccacguggaagcagggcauguagcugggugugucagcguggcag

SEQ ID NO: 692289 - RNA, 64 nt, Homo Sapiens
cuggcaccuugaagauucaccuggaggacuguugggcauguagaggugacuguggccuugaagc

SEQ ID NO: 692290 - RNA, 64 nt, Homo Sapiens
uccugccucagccuccugaguagcuggcacuguaggcauguaccaccaugcccagcuaauuuuu

SEQ ID NO: 692291 - RNA, 64 nt, Homo Sapiens
cuauauuuugucuuuuuuuaguucagacagcaaaggcauguacuacuauaaaauacaaagugau

SEQ ID NO: 692292 - RNA, 64 nt, Homo Sapiens
cagcagcucucgcauccacuucaggguggcguguggcauguaggaguccugcuucuuuguacau

SEQ ID NO: 692293 - RNA, 64 nt, Homo Sapiens
uugcauagagaagguccucuuuuuaagguguauuggcauguaauuucacuuuugucuuauuuuc

SEQ ID NO: 692294 - RNA, 64 nt, Homo Sapiens
agaugcucaauaaacacuugcuagaauagugucuggcauguaguaccccuccuuucccagguuu

SEQ ID NO: 692295 - RNA, 64 nt, Homo Sapiens
agacuguucccaaagcuuguugggcuccuuaaauggcauguacaauuuaagugcaaagacaggg

SEQ ID NO: 692296 - RNA, 64 nt, Homo Sapiens
uguaugaaugagcaaacauaauauauguaugaagggcauguauaugaacauacauuuccugcau

SEQ ID NO: 692297 - RNA, 64 nt, Homo Sapiens
gucaaacccaagaccagccccaaggccagaccaaggcauguaggccugggcagguggcucgggg

SEQ ID NO: 692298 - RNA, 64 nt, Homo Sapiens
uuagaagauauauuaagguguuccugguaaugaaggcauguaaguuauaauaauuguagcuuuc

SEQ ID NO: 692299 - RNA, 64 nt, Homo Sapiens
cuccagucucagcucccaaguagcugggauuacaggcauguacuaccaugccuggcuaauuuuc

SEQ ID NO: 692300 - RNA, 64 nt, Homo Sapiens
auuugauuaugcaccuaagaauaaaugguauuugggcauguauucccaauauguguauauuuau

SEQ ID NO: 692301 - RNA, 64 nt, Homo Sapiens
ugcccacuuccucauguuuuagagcucucuuccuggcauguaagagcauggucaaccucuagug

SEQ ID NO: 692302 - RNA, 64 nt, Homo Sapiens
cagcacagacaccguaacacuuguauaaaauauuggcauguaaacugacaccauaugagaaccu

SEQ ID NO: 692303 - RNA, 64 nt, Homo Sapiens
uauugacuguauccucaugccagacuuguaaccuggcauguaccuaucacacaggcuuucagga

SEQ ID NO: 692304 - RNA, 64 nt, Homo Sapiens
uacugcucuguguuuacagacgugugcaguuguaggcauguagcuacaggacauuuuuaagggc

SEQ ID NO: 692305 - RNA, 64 nt, Homo Sapiens
ucaaagggcuagaacucuccaaggucuugcccccggcauguagcaccaccugagccagaaacug

SEQ ID NO: 692306 - RNA, 64 nt, Homo Sapiens
aacaguuagacauugaggggcuucacuguuaccaggcauguaacagaaggaggaagacuaacac

SEQ ID NO: 692307 - RNA, 64 nt, Homo Sapiens
accacacccagcuaauuuuguagcugggauuacaggcauguaccuccugccucagccuccugag

SEQ ID NO: 692308 - RNA, 64 nt, Homo Sapiens
uguaguuccuugcugaguaaccuggccgcagugaggcauguaucgccuuugcugugcccugugg

SEQ ID NO: 692309 - RNA, 64 nt, Homo Sapiens
gaaucucauaaucuaugugacagauuuauuuuaaggcauguagaagauaugaguuaagagcugc

SEQ ID NO: 692310 - RNA, 64 nt, Homo Sapiens
uuugaaucuguaaauauuuuaaauguuuuauuaaggcauguaauaaacuauucuuugaaacuug

SEQ ID NO: 692311 - RNA, 64 nt, Homo Sapiens
caggaaaauuaaggcuucucuuaaacacuaaaaaggcauguaauugcuuguuagcaaaauggau

SEQ ID NO: 692312 - RNA, 64 nt, Homo Sapiens
agauguccccgcuucccuccagccccccauccuuggcauguauauuaguaggagggcuucacac

SEQ ID NO: 692313 - RNA, 64 nt, Homo Sapiens
cuguccagggacagcgaagcuggggguggcggggggcauguaccacaggguggcagcagggaaa

SEQ ID NO: 692314 - RNA, 64 nt, Homo Sapiens
uucucaggaaccuuucaagcagcucuguccucauggcauguacuaugccuguccucccucugca

SEQ ID NO: 692315 - RNA, 64 nt, Homo Sapiens
uaauuugugguacgauauugcuuauugugacuuuggcauguauuuuugcuagcaaaaugcugua

SEQ ID NO: 692316 - RNA, 64 nt, Homo Sapiens
augugcauuuugaaaacagaaaacaaauugcguuggcauguacgugggugggaagaaaaagaaa

SEQ ID NO: 692317 - RNA, 64 nt, Homo Sapiens
cuccuuauggagaacuauuuauuauacacuccaaggcauguagaacuguaauaagugaauuaca

SEQ ID NO: 692318 - RNA, 64 nt, Homo Sapiens
cauuccauuuauuuguaguggauuuccucuggagggcauguacccacacuaaauaccaacugcu

SEQ ID NO: 692319 - RNA, 64 nt, Homo Sapiens
uggcucuggccaggugcuagucaucgucauagcuggcauguaccuccuguugcaguugggcuca

SEQ ID NO: 692320 - RNA, 64 nt, Homo Sapiens; identical to SEQ ID NO: 76855

SEQ ID NO: 692321 - RNA, 64 nt, Homo Sapiens; identical to SEQ ID NO: 76856

SEQ ID NO: 692322 - RNA, 64 nt, Homo Sapiens; identical to SEQ ID NO: 76857

SEQ ID NO: 692323 - RNA, 64 nt, Homo Sapiens; identical to SEQ ID NO: 76858

SEQ ID NO: 692324 - RNA, 64 nt, Homo Sapiens; identical to SEQ ID NO: 76859

SEQ ID NO: 692325 - RNA, 64 nt, Homo Sapiens; identical to SEQ ID NO: 76860

SEQ ID NO: 692326 - RNA, 64 nt, Homo Sapiens; identical to SEQ ID NO: 76861

SEQ ID NO: 692327 - RNA, 64 nt, Homo Sapiens; identical to SEQ ID NO: 76862

SEQ ID NO: 692328 - RNA, 64 nt, Homo Sapiens; identical to SEQ ID NO: 76863

SEQ ID NO: 692329 - RNA, 64 nt, Homo Sapiens; identical to SEQ ID NO: 76864

SEQ ID NO: 692330 - RNA, 64 nt, Homo Sapiens; identical to SEQ ID NO: 76865

SEQ ID NO: 692331 - RNA, 64 nt, Homo Sapiens; identical to SEQ ID NO: 76866

SEQ ID NO: 692332 - RNA, 64 nt, Homo Sapiens; identical to SEQ ID NO: 76867

SEQ ID NO: 692333 - RNA, 64 nt, Homo Sapiens; identical to SEQ ID NO: 76868

SEQ ID NO: 692334 - RNA, 64 nt, Homo Sapiens; identical to SEQ ID NO: 76869

SEQ ID NO: 692335 - RNA, 64 nt, Homo Sapiens; identical to SEQ ID NO: 76870

SEQ ID NO: 692336 - RNA, 64 nt, Homo Sapiens
aauguuuuuaggcuuaauucauucaauugucaaguacacuuagucuuaauacacucagguuuga

SEQ ID NO: 692337 - RNA, 64 nt, Homo Sapiens
ggacugagugcugcuaucuugaaaugugcacagguacacuuaccuuuuuuuuuuuuuuuuuuaa

SEQ ID NO: 692338 - RNA, 64 nt, Homo Sapiens
uggagauggauagagggcaggggaugcagaagauugagaggauaagcccucagaaucagggcca

SEQ ID NO: 692339 - RNA, 64 nt, Homo Sapiens
cccuccccauugucaggcucaugccugccccuccugagaggacccccaggccaggguugcuggg

SEQ ID NO: 692340 - RNA, 64 nt, Homo Sapiens
aguuauacaauuuaaggaaguguagucagaaagaugagaggauugacuuucaaggaacauauaa

SEQ ID NO: 692341 - RNA, 64 nt, Homo Sapiens
ccugucaccucugcaauuguucuuacuuaagguuugagaggaaaaguuuuaugaucacagccua

SEQ ID NO: 692342 - RNA, 64 nt, Homo Sapiens
gaaagagagggacagagagauaaaagaaauugggugagaggagauagguagcuccauaaggcac

SEQ ID NO: 692343 - RNA, 64 nt, Homo Sapiens
auuuagaagaaugcuuuuugauccuccuggaauaugagaggaugggaggcccuuuagaaccugc

SEQ ID NO: 692344 - RNA, 64 nt, Homo Sapiens
cccagaguggaggaguuagacuugccucgugggaugagaggaguuguggcuuugugucugcugg

SEQ ID NO: 692345 - RNA, 64 nt, Homo Sapiens
gugcacauaugcauauauuuuguguucauucuacugagaggaccuaaacacaaugacaccucag

SEQ ID NO: 692346 - RNA, 64 nt, Homo Sapiens
gugaaugaugugcuaccaaguauaugccaggcugugagaggauuauacugaguaguagaaagaa

SEQ ID NO: 692347 - RNA, 64 nt, Homo Sapiens
gguauuagagauucaguguauguauuuauuuacaugagaggaaacuggaauauaaucccauaaa

SEQ ID NO: 692348 - RNA, 64 nt, Homo Sapiens
cucacuuaaaucuaggugcuucaauucacuuucuugagaggacaaaugaaaagcuguggagaaa

SEQ ID NO: 692349 - RNA, 64 nt, Homo Sapiens
uuuuacgcuuugcauauauaauuuauggagguguugagaggauagauuagacacuugaaguacu

SEQ ID NO: 692350 - RNA, 64 nt, Homo Sapiens
augaaaccaggaauggacuuggaguucaacaggcugagaggaugccuccaauggaccagagagc

SEQ ID NO: 692351 - RNA, 64 nt, Homo Sapiens
ccuacucccugcugugaaacaaucccucucccugugagaggaaacuguggagcguuucuuaucg

SEQ ID NO: 692352 - RNA, 64 nt, Homo Sapiens
caccccuggccaucacucauguguaguccagguuugagaggaacuggaaggggggugagggugg

SEQ ID NO: 692353 - RNA, 64 nt, Homo Sapiens
ccugugauucucccagcccuugcaguccgcuaggugagaggaaaagcucuuuacuuccgccccu

SEQ ID NO: 692354 - RNA, 64 nt, Homo Sapiens
agggggagggagccaacgccccucaggcauguggugagaggauggaggaugaggggagccuacg

SEQ ID NO: 692355 - RNA, 64 nt, Homo Sapiens
aggggagccuacgccucaggaaugccccaugcggugagaggaugggaaguagaggcugggagca

SEQ ID NO: 692356 - RNA, 64 nt, Homo Sapiens; identical to SEQ ID NO: 64767

SEQ ID NO: 692357 - RNA, 64 nt, Homo Sapiens; identical to SEQ ID NO: 64768

SEQ ID NO: 692358 - RNA, 64 nt, Homo Sapiens; identical to SEQ ID NO: 64769

SEQ ID NO: 692359 - RNA, 64 nt, Homo Sapiens; identical to SEQ ID NO: 64770

SEQ ID NO: 692360 - RNA, 64 nt, Homo Sapiens; identical to SEQ ID NO: 64771

SEQ ID NO: 692361 - RNA, 64 nt, Homo Sapiens; identical to SEQ ID NO: 64772

SEQ ID NO: 692362 - RNA, 64 nt, Homo Sapiens; identical to SEQ ID NO: 64773

SEQ ID NO: 692363 - RNA, 64 nt, Homo Sapiens; identical to SEQ ID NO: 64774

SEQ ID NO: 692364 - RNA, 64 nt, Homo Sapiens; identical to SEQ ID NO: 64775

SEQ ID NO: 692365 - RNA, 64 nt, Homo Sapiens; identical to SEQ ID NO: 64776

SEQ ID NO: 692366 - RNA, 64 nt, Homo Sapiens; identical to SEQ ID NO: 64777

SEQ ID NO: 692367 - RNA, 64 nt, Homo Sapiens; identical to SEQ ID NO: 64778

SEQ ID NO: 692368 - RNA, 64 nt, Homo Sapiens; identical to SEQ ID NO: 64779

SEQ ID NO: 692369 - RNA, 64 nt, Homo Sapiens; identical to SEQ ID NO: 64780

SEQ ID NO: 692370 - RNA, 64 nt, Homo Sapiens; identical to SEQ ID NO: 64781

SEQ ID NO: 692371 - RNA, 64 nt, Homo Sapiens; identical to SEQ ID NO: 64782

SEQ ID NO: 692372 - RNA, 64 nt, Homo Sapiens; identical to SEQ ID NO: 64783

SEQ ID NO: 692373 - RNA, 64 nt, Homo Sapiens; identical to SEQ ID NO: 64784

SEQ ID NO: 692374 - RNA, 64 nt, Homo Sapiens; identical to SEQ ID NO: 64785

SEQ ID NO: 692375 - RNA, 64 nt, Homo Sapiens; identical to SEQ ID NO: 64786

SEQ ID NO: 692376 - RNA, 64 nt, Homo Sapiens; identical to SEQ ID NO: 64787

SEQ ID NO: 692377 - RNA, 64 nt, Homo Sapiens; identical to SEQ ID NO: 64788

SEQ ID NO: 692378 - RNA, 64 nt, Homo Sapiens; identical to SEQ ID NO: 64789

SEQ ID NO: 692379 - RNA, 64 nt, Homo Sapiens; identical to SEQ ID NO: 64790

SEQ ID NO: 692380 - RNA, 64 nt, Homo Sapiens; identical to SEQ ID NO: 64791

SEQ ID NO: 692381 - RNA, 64 nt, Homo Sapiens; identical to SEQ ID NO: 64792

SEQ ID NO: 692382 - RNA, 64 nt, Homo Sapiens; identical to SEQ ID NO: 64793

SEQ ID NO: 692383 - RNA, 64 nt, Homo Sapiens; identical to SEQ ID NO: 64794

SEQ ID NO: 692384 - RNA, 64 nt, Homo Sapiens; identical to SEQ ID NO: 64795

SEQ ID NO: 692385 - RNA, 64 nt, Homo Sapiens; identical to SEQ ID NO: 64796

SEQ ID NO: 692386 - RNA, 64 nt, Homo Sapiens; identical to SEQ ID NO: 64797

SEQ ID NO: 692387 - RNA, 64 nt, Homo Sapiens; identical to SEQ ID NO: 64798

SEQ ID NO: 692388 - RNA, 64 nt, Homo Sapiens; identical to SEQ ID NO: 64799

SEQ ID NO: 692389 - RNA, 64 nt, Homo Sapiens; identical to SEQ ID NO: 64800

SEQ ID NO: 692390 - RNA, 64 nt, Homo Sapiens; identical to SEQ ID NO: 64801

SEQ ID NO: 692391 - RNA, 64 nt, Homo Sapiens; identical to SEQ ID NO: 64802

SEQ ID NO: 692392 - RNA, 64 nt, Homo Sapiens; identical to SEQ ID NO: 64803

SEQ ID NO: 692393 - RNA, 64 nt, Homo Sapiens; identical to SEQ ID NO: 45461

SEQ ID NO: 692394 - RNA, 64 nt, Homo Sapiens; identical to SEQ ID NO: 45462

SEQ ID NO: 692395 - RNA, 64 nt, Homo Sapiens
agggcucuagacccgagccccagacugaguccucuccccaaaucuccccugcagucuggguucc

SEQ ID NO: 692396 - RNA, 64 nt, Homo Sapiens
gguacucccugacccagggcuccccacuccagcauccccaaacuuucugggcuccaggauuguc

SEQ ID NO: 692397 - RNA, 64 nt, Homo Sapiens
ugugucccccacagcucaugcguuggaaacuuaauccccaaagcaacagcuuugagaggugaga

SEQ ID NO: 692398 - RNA, 64 nt, Homo Sapiens
guuccugauaaaaggaugaguucggccuucuucuuccccaaaaucuuuauccccacccccaccu

SEQ ID NO: 692399 - RNA, 64 nt, Homo Sapiens
augugaggcauugucaccuuuuccgaacugccucuccccaaagacagauugugcgcacacucgu

SEQ ID NO: 692400 - RNA, 64 nt, Homo Sapiens
cuagacgugaccuggcagaucaauucagucccucuccccaaagaaggaaauguucucaauugag

SEQ ID NO: 692401 - RNA, 64 nt, Homo Sapiens
uuucuucuaagccuguguguuauaauuuaccaguuccccaaaaugccauuuuuaacgccgaacu

SEQ ID NO: 692402 - RNA, 64 nt, Homo Sapiens
guaaauaaaauaaaaaauauuugucuccaccuuuuccccaaaagcaacagcaagacauauuuug

SEQ ID NO: 692403 - RNA, 64 nt, Homo Sapiens
cacacacacacacacacauacauccugcuuucccuccccaaacccaucagacagguaaaugggc

SEQ ID NO: 692404 - RNA, 64 nt, Homo Sapiens
cagucucucucucccuuuuaaauggugggaacccuccccaaaaccuuuccccagacacauucuc

SEQ ID NO: 692405 - RNA, 64 nt, Homo Sapiens
accauguggccuaagagcucuggggagcccacacuccccaaagcaguuagacuauggagagccg

SEQ ID NO: 692406 - RNA, 64 nt, Homo Sapiens
cauuauuaaagaucauauggggaaaaugaaacccuccccaaaauacaagaaguucugggaggag

SEQ ID NO: 692407 - RNA, 64 nt, Homo Sapiens
auggcauuucucuuugaaaucuuuaccuuugugguccccaaaugugaagcuuuuugagggcaaa

SEQ ID NO: 692408 - RNA, 64 nt, Homo Sapiens
uguucuguaaauaauauuauuuggguaguuacuauccccaaaucuuguuuacuucuaaacccac

SEQ ID NO: 692409 - RNA, 64 nt, Homo Sapiens
ggguaaccuagacuucagaguugccuauaauggguccccaaaauugcuuugggaacuguguuua

SEQ ID NO: 692410 - RNA, 64 nt, Homo Sapiens
uuuaucugucuugacuuuuuuuuuuuuuuccgucuccccaaagcagaucuggucuuuuuuuuuu

SEQ ID NO: 692411 - RNA, 64 nt, Homo Sapiens
acuugaagucaguuuuagauauaucagcagccucuccccaaaguccuucuuauuuuggcauucg

SEQ ID NO: 692412 - RNA, 64 nt, Homo Sapiens
guugcgcaucagcaccugggcagcucgccaguccuccccaaagacauggcugcugcuuucugcc

SEQ ID NO: 692413 - RNA, 64 nt, Homo Sapiens
cuuaauugcuuuauuuuggucuuguacuuugaauuccccaaaguguaauaaucguuuuuguuuu

SEQ ID NO: 692414 - RNA, 64 nt, Homo Sapiens
gacaauuuguuguacccaugauaauucuuggucuuccccaaagacuagccccaguuuugacaga

SEQ ID NO: 692415 - RNA, 64 nt, Homo Sapiens
auuauaagcauugcagucagaaggaggcccaggauccccaaaauauucaucccuuaauguucuc

SEQ ID NO: 692416 - RNA, 64 nt, Homo Sapiens
auccuuuauagcuguuuauuaaauucuccaguuguccccaaaauuaauauaugauccauauuca

SEQ ID NO: 692417 - RNA, 64 nt, Homo Sapiens
agagaauagcccgccaucccuguccucucuguguuccccaaaucuuacuuuccacuuugccccc

SEQ ID NO: 692418 - RNA, 64 nt, Homo Sapiens
aaggcuauuggacaucugcaccgggggcauuugguccccaaauuaagaucugucuuuccaaugg

SEQ ID NO: 692419 - RNA, 64 nt, Homo Sapiens
gaccagaauuuuuuaucuagagaccagcauguucuccccaaagaccaagauauucugccaaaau

SEQ ID NO: 692420 - RNA, 64 nt, Homo Sapiens
gaccagaauuuuuugucuagagaccagcauguucuccccaaagaccagaauauucuaccuaaau

SEQ ID NO: 692421 - RNA, 64 nt, Homo Sapiens
gaccaggacuuuuuaucuagagaccagcauguucuccccaaagacuggaauauucuacccaaau

SEQ ID NO: 692422 - RNA, 64 nt, Homo Sapiens
gcugcuauugaagaacuuccggcuacacgugauguccccaaacucauucaggaaauaucgacag

SEQ ID NO: 692423 - RNA, 64 nt, Homo Sapiens
gaggcucauggugggaggccacuaaagcauagauuccccaaaguuaaggcaagaauaugcccca

SEQ ID NO: 692424 - RNA, 64 nt, Homo Sapiens
agagacauaaucccgguccucuggguauaugguauccccaaacagccagucaccacacaaggca

SEQ ID NO: 692425 - RNA, 64 nt, Homo Sapiens
auuauauuuuuucuauaaaaagucauggucacucuccccaaaaugucuccuuuccacugcuauu

SEQ ID NO: 692426 - RNA, 64 nt, Homo Sapiens
agggggaagccaauggccugucuccccacuaccauccccaaacgcuccuuggggcgugguuccu

SEQ ID NO: 692427 - RNA, 64 nt, Homo Sapiens
gagaauguuuugaaaggccagaggguggccuuuuuccccaaacaguuugguuccuuuuauguuu

SEQ ID NO: 692428 - RNA, 64 nt, Homo Sapiens
gcuggccuugugcagacccuggacugcauccgguuccccaaagcccugcugcauucgagugucc

SEQ ID NO: 692429 - RNA, 64 nt, Homo Sapiens
ggccagggccccuguucuagggguuaggguucuuuccccaaaggaacuuaaaaagacaagcgug

SEQ ID NO: 692430 - RNA, 64 nt, Homo Sapiens
acccaagccccgugcuagcagcgcuccgugcucuuccccaaauacucacggcucuaauucccca

SEQ ID NO: 692431 - RNA, 64 nt, Homo Sapiens
uccgugcucuuccccaaauacucacggcucuaauuccccaaaccugaaacuucauacccuggga

SEQ ID NO: 692432 - RNA, 64 nt, Homo Sapiens
cugugcuacuucaacauagagauuggacaugcucuccccaaaugagccacuuuccucuccaggu

SEQ ID NO: 692433 - RNA, 64 nt, Homo Sapiens
ugaccucuugcacaagccuaaauuccaggaaucuuccccaaaucccagauccucugcaaucuac

SEQ ID NO: 692434 - RNA, 64 nt, Homo Sapiens; identical to SEQ ID NO: 156063

SEQ ID NO: 692435 - RNA, 64 nt, Homo Sapiens; identical to SEQ ID NO: 156064

SEQ ID NO: 692436 - RNA, 64 nt, Homo Sapiens; identical to SEQ ID NO: 156065

SEQ ID NO: 692437 - RNA, 64 nt, Homo Sapiens; identical to SEQ ID NO: 156066

SEQ ID NO: 692438 - RNA, 64 nt, Homo Sapiens; identical to SEQ ID NO: 156067

SEQ ID NO: 692439 - RNA, 64 nt, Homo Sapiens; identical to SEQ ID NO: 156068

SEQ ID NO: 692440 - RNA, 64 nt, Homo Sapiens; identical to SEQ ID NO: 156069

SEQ ID NO: 692441 - RNA, 64 nt, Homo Sapiens; identical to SEQ ID NO: 156070

SEQ ID NO: 692442 - RNA, 64 nt, Homo Sapiens; identical to SEQ ID NO: 156071

SEQ ID NO: 692443 - RNA, 64 nt, Homo Sapiens; identical to SEQ ID NO: 156072

SEQ ID NO: 692444 - RNA, 64 nt, Homo Sapiens; identical to SEQ ID NO: 156073

SEQ ID NO: 692445 - RNA, 64 nt, Homo Sapiens; identical to SEQ ID NO: 156074

SEQ ID NO: 692446 - RNA, 64 nt, Homo Sapiens; identical to SEQ ID NO: 156075

SEQ ID NO: 692447 - RNA, 64 nt, Homo Sapiens; identical to SEQ ID NO: 156076

SEQ ID NO: 692448 - RNA, 64 nt, Homo Sapiens; identical to SEQ ID NO: 156077

SEQ ID NO: 692449 - RNA, 64 nt, Homo Sapiens; identical to SEQ ID NO: 156078

SEQ ID NO: 692450 - RNA, 64 nt, Homo Sapiens; identical to SEQ ID NO: 156079

SEQ ID NO: 692451 - RNA, 64 nt, Homo Sapiens; identical to SEQ ID NO: 156080

SEQ ID NO: 692452 - RNA, 64 nt, Homo Sapiens; identical to SEQ ID NO: 156081

SEQ ID NO: 692453 - RNA, 64 nt, Homo Sapiens; identical to SEQ ID NO: 156082

SEQ ID NO: 692454 - RNA, 64 nt, Homo Sapiens; identical to SEQ ID NO: 156083

SEQ ID NO: 692455 - RNA, 64 nt, Homo Sapiens; identical to SEQ ID NO: 156084

SEQ ID NO: 692456 - RNA, 64 nt, Homo Sapiens; identical to SEQ ID NO: 156085

SEQ ID NO: 692457 - RNA, 64 nt, Homo Sapiens; identical to SEQ ID NO: 156086

SEQ ID NO: 692458 - RNA, 64 nt, Homo Sapiens; identical to SEQ ID NO: 156087

SEQ ID NO: 692459 - RNA, 64 nt, Homo Sapiens; identical to SEQ ID NO: 156088

SEQ ID NO: 692460 - RNA, 64 nt, Homo Sapiens; identical to SEQ ID NO: 156089

SEQ ID NO: 692461 - RNA, 64 nt, Homo Sapiens; identical to SEQ ID NO: 156090

SEQ ID NO: 692462 - RNA, 64 nt, Homo Sapiens; identical to SEQ ID NO: 156091

SEQ ID NO: 692463 - RNA, 64 nt, Homo Sapiens; identical to SEQ ID NO: 156092

SEQ ID NO: 692464 - RNA, 64 nt, Homo Sapiens; identical to SEQ ID NO: 156093

SEQ ID NO: 692465 - RNA, 64 nt, Homo Sapiens; identical to SEQ ID NO: 156094

SEQ ID NO: 692466 - RNA, 64 nt, Homo Sapiens; identical to SEQ ID NO: 156095

SEQ ID NO: 692467 - RNA, 64 nt, Homo Sapiens; identical to SEQ ID NO: 156096

SEQ ID NO: 692468 - RNA, 64 nt, Homo Sapiens; identical to SEQ ID NO: 156097

SEQ ID NO: 692469 - RNA, 64 nt, Homo Sapiens; identical to SEQ ID NO: 156098

SEQ ID NO: 692470 - RNA, 64 nt, Homo Sapiens; identical to SEQ ID NO: 156099

SEQ ID NO: 692471 - RNA, 64 nt, Homo Sapiens; identical to SEQ ID NO: 156100

SEQ ID NO: 692472 - RNA, 64 nt, Homo Sapiens; identical to SEQ ID NO: 156101

SEQ ID NO: 692473 - RNA, 64 nt, Homo Sapiens; identical to SEQ ID NO: 156102

SEQ ID NO: 692474 - RNA, 64 nt, Homo Sapiens; identical to SEQ ID NO: 156103

SEQ ID NO: 692475 - RNA, 64 nt, Homo Sapiens; identical to SEQ ID NO: 156104

SEQ ID NO: 692476 - RNA, 64 nt, Homo Sapiens; identical to SEQ ID NO: 156105

SEQ ID NO: 692477 - RNA, 64 nt, Homo Sapiens; identical to SEQ ID NO: 156106

SEQ ID NO: 692478 - RNA, 64 nt, Homo Sapiens; identical to SEQ ID NO: 156107

SEQ ID NO: 692479 - RNA, 64 nt, Homo Sapiens; identical to SEQ ID NO: 156108

SEQ ID NO: 692480 - RNA, 64 nt, Homo Sapiens; identical to SEQ ID NO: 156109

SEQ ID NO: 692481 - RNA, 64 nt, Homo Sapiens; identical to SEQ ID NO: 156110

SEQ ID NO: 692482 - RNA, 64 nt, Homo Sapiens; identical to SEQ ID NO: 156111

SEQ ID NO: 692483 - RNA, 64 nt, Homo Sapiens
uaaagccuuuuuuuaggccacauugacaguggugggcggggagaagauagggaacacucauccc

SEQ ID NO: 692484 - RNA, 64 nt, Homo Sapiens
ccucugggcagcgcuaucuagauagguaagugggggcggggaagggugcauagcuguuuuagcu

SEQ ID NO: 692485 - RNA, 64 nt, Homo Sapiens
cccaggccucaguguggcaggugacuaguucaggggcggggacuugggagucaggggaauagau

SEQ ID NO: 692486 - RNA, 64 nt, Homo Sapiens
ggggugggagucaggggaaucaagaccaaaguguggcggggaguccagccccagccccaguggg

SEQ ID NO: 692487 - RNA, 64 nt, Homo Sapiens
gcuugugggaggauuuggaaggagcugcauugugggcggggaguguguggguuggguucguacc

SEQ ID NO: 692488 - RNA, 64 nt, Homo Sapiens
ccuuucccacuugaggacccuggggagagaugggggcggggaaaauggagguaugaauuugggg

SEQ ID NO: 692489 - RNA, 64 nt, Homo Sapiens
agcagggucaggagacggggcugacggcacggguggcggggacagacguuugggacuuggccgc

SEQ ID NO: 692490 - RNA, 64 nt, Homo Sapiens
guugccaaagaguuggcuuuguuuauuugguuuuggcggggagaggagugguauuugaugcuuu

SEQ ID NO: 692491 - RNA, 64 nt, Homo Sapiens
cuccucccacucauccagagacggccggugggcaggcggggagagcagcuuuccuucccuggag

SEQ ID NO: 692492 - RNA, 64 nt, Homo Sapiens
cuaguauacauugaccucccguucccugcaugagggcggggaguucccccugcuccauccccca

SEQ ID NO: 692493 - RNA, 64 nt, Homo Sapiens
ucccaacuccgggagagccucgccuggaugcuggggcggggaaggcccaguccccggggcucug

SEQ ID NO: 692494 - RNA, 64 nt, Homo Sapiens
accgccccgguguuggcccucgccauggagcagaggcggggacagcuggccaccgugucccagg

SEQ ID NO: 692495 - RNA, 64 nt, Homo Sapiens
aagcaggggggaucucccgcgcaggggcggcggcggcggggaccggucgccuggcgcugggcuc

SEQ ID NO: 692496 - RNA, 64 nt, Homo Sapiens
ggcggucggaccccgccucccgagcccggggaggggcggggaggacaaggggcgggcccgcggc

SEQ ID NO: 692497 - RNA, 64 nt, Homo Sapiens
cuuccucagccuugcagauaugguugaggagaaaggcggggaaggccaugucccgucucuaugg

SEQ ID NO: 692498 - RNA, 64 nt, Homo Sapiens
gaggauccuguuucccaccuuguguguguguggcggcggggagguagcaacgaaaaccugugcu

SEQ ID NO: 692499 - RNA, 64 nt, Homo Sapiens; identical to SEQ ID NO: 84602

SEQ ID NO: 692500 - RNA, 64 nt, Homo Sapiens; identical to SEQ ID NO: 84603

SEQ ID NO: 692501 - RNA, 64 nt, Homo Sapiens; identical to SEQ ID NO: 84604

SEQ ID NO: 692502 - RNA, 64 nt, Homo Sapiens; identical to SEQ ID NO: 84605

SEQ ID NO: 692503 - RNA, 64 nt, Homo Sapiens; identical to SEQ ID NO: 84606

SEQ ID NO: 692504 - RNA, 64 nt, Homo Sapiens; identical to SEQ ID NO: 84607

SEQ ID NO: 692505 - RNA, 64 nt, Homo Sapiens; identical to SEQ ID NO: 84608

SEQ ID NO: 692506 - RNA, 64 nt, Homo Sapiens; identical to SEQ ID NO: 84609

SEQ ID NO: 692507 - RNA, 64 nt, Homo Sapiens; identical to SEQ ID NO: 84610

SEQ ID NO: 692508 - RNA, 64 nt, Homo Sapiens; identical to SEQ ID NO: 84611

SEQ ID NO: 692509 - RNA, 64 nt, Homo Sapiens; identical to SEQ ID NO: 84612

SEQ ID NO: 692510 - RNA, 64 nt, Homo Sapiens; identical to SEQ ID NO: 84613

SEQ ID NO: 692511 - RNA, 64 nt, Homo Sapiens; identical to SEQ ID NO: 84614

SEQ ID NO: 692512 - RNA, 64 nt, Homo Sapiens; identical to SEQ ID NO: 84615

SEQ ID NO: 692513 - RNA, 64 nt, Homo Sapiens; identical to SEQ ID NO: 84616

SEQ ID NO: 692514 - RNA, 64 nt, Homo Sapiens; identical to SEQ ID NO: 84617

SEQ ID NO: 692515 - RNA, 64 nt, Homo Sapiens; identical to SEQ ID NO: 84618

SEQ ID NO: 692516 - RNA, 64 nt, Homo Sapiens; identical to SEQ ID NO: 84619

SEQ ID NO: 692517 - RNA, 64 nt, Homo Sapiens; identical to SEQ ID NO: 84620

SEQ ID NO: 692518 - RNA, 64 nt, Homo Sapiens; identical to SEQ ID NO: 84621

SEQ ID NO: 692519 - RNA, 64 nt, Homo Sapiens; identical to SEQ ID NO: 84622

SEQ ID NO: 692520 - RNA, 64 nt, Homo Sapiens; identical to SEQ ID NO: 84623

SEQ ID NO: 692521 - RNA, 64 nt, Homo Sapiens; identical to SEQ ID NO: 84624

SEQ ID NO: 692522 - RNA, 64 nt, Homo Sapiens; identical to SEQ ID NO: 84625

SEQ ID NO: 692523 - RNA, 64 nt, Homo Sapiens; identical to SEQ ID NO: 84626

SEQ ID NO: 692524 - RNA, 64 nt, Homo Sapiens; identical to SEQ ID NO: 84627

SEQ ID NO: 692525 - RNA, 64 nt, Homo Sapiens; identical to SEQ ID NO: 84628

SEQ ID NO: 692526 - RNA, 64 nt, Homo Sapiens; identical to SEQ ID NO: 84629

SEQ ID NO: 692527 - RNA, 64 nt, Homo Sapiens; identical to SEQ ID NO: 84630

SEQ ID NO: 692528 - RNA, 64 nt, Homo Sapiens; identical to SEQ ID NO: 84631

SEQ ID NO: 692529 - RNA, 64 nt, Homo Sapiens; identical to SEQ ID NO: 578845

SEQ ID NO: 692530 - RNA, 64 nt, Homo Sapiens; identical to SEQ ID NO: 578846

SEQ ID NO: 692531 - RNA, 64 nt, Homo Sapiens; identical to SEQ ID NO: 84602

SEQ ID NO: 692532 - RNA, 64 nt, Homo Sapiens; identical to SEQ ID NO: 84603

SEQ ID NO: 692533 - RNA, 64 nt, Homo Sapiens; identical to SEQ ID NO: 84604

SEQ ID NO: 692534 - RNA, 64 nt, Homo Sapiens; identical to SEQ ID NO: 84605

SEQ ID NO: 692535 - RNA, 64 nt, Homo Sapiens; identical to SEQ ID NO: 84606

SEQ ID NO: 692536 - RNA, 64 nt, Homo Sapiens; identical to SEQ ID NO: 84607

SEQ ID NO: 692537 - RNA, 64 nt, Homo Sapiens; identical to SEQ ID NO: 84608

SEQ ID NO: 692538 - RNA, 64 nt, Homo Sapiens; identical to SEQ ID NO: 84609

SEQ ID NO: 692539 - RNA, 64 nt, Homo Sapiens; identical to SEQ ID NO: 84610

SEQ ID NO: 692540 - RNA, 64 nt, Homo Sapiens; identical to SEQ ID NO: 84611

SEQ ID NO: 692541 - RNA, 64 nt, Homo Sapiens; identical to SEQ ID NO: 84612

SEQ ID NO: 692542 - RNA, 64 nt, Homo Sapiens; identical to SEQ ID NO: 84613

SEQ ID NO: 692543 - RNA, 64 nt, Homo Sapiens; identical to SEQ ID NO: 84614

SEQ ID NO: 692544 - RNA, 64 nt, Homo Sapiens; identical to SEQ ID NO: 84615

SEQ ID NO: 692545 - RNA, 64 nt, Homo Sapiens; identical to SEQ ID NO: 84616

SEQ ID NO: 692546 - RNA, 64 nt, Homo Sapiens; identical to SEQ ID NO: 84617

SEQ ID NO: 692547 - RNA, 64 nt, Homo Sapiens; identical to SEQ ID NO: 84618

SEQ ID NO: 692548 - RNA, 64 nt, Homo Sapiens; identical to SEQ ID NO: 84619

SEQ ID NO: 692549 - RNA, 64 nt, Homo Sapiens; identical to SEQ ID NO: 84620

SEQ ID NO: 692550 - RNA, 64 nt, Homo Sapiens; identical to SEQ ID NO: 84621

SEQ ID NO: 692551 - RNA, 64 nt, Homo Sapiens; identical to SEQ ID NO: 84622

SEQ ID NO: 692552 - RNA, 64 nt, Homo Sapiens; identical to SEQ ID NO: 84623

SEQ ID NO: 692553 - RNA, 64 nt, Homo Sapiens; identical to SEQ ID NO: 84624

SEQ ID NO: 692554 - RNA, 64 nt, Homo Sapiens; identical to SEQ ID NO: 84625

SEQ ID NO: 692555 - RNA, 64 nt, Homo Sapiens; identical to SEQ ID NO: 84626

SEQ ID NO: 692556 - RNA, 64 nt, Homo Sapiens; identical to SEQ ID NO: 84627

SEQ ID NO: 692557 - RNA, 64 nt, Homo Sapiens; identical to SEQ ID NO: 84628

SEQ ID NO: 692558 - RNA, 64 nt, Homo Sapiens; identical to SEQ ID NO: 84629

SEQ ID NO: 692559 - RNA, 64 nt, Homo Sapiens; identical to SEQ ID NO: 84630

SEQ ID NO: 692560 - RNA, 64 nt, Homo Sapiens; identical to SEQ ID NO: 84631

SEQ ID NO: 692561 - RNA, 64 nt, Homo Sapiens; identical to SEQ ID NO: 578845

SEQ ID NO: 692562 - RNA, 64 nt, Homo Sapiens; identical to SEQ ID NO: 578846

SEQ ID NO: 692563 - RNA, 64 nt, Homo Sapiens; identical to SEQ ID NO: 84602

SEQ ID NO: 692564 - RNA, 64 nt, Homo Sapiens; identical to SEQ ID NO: 84603

SEQ ID NO: 692565 - RNA, 64 nt, Homo Sapiens; identical to SEQ ID NO: 84604

SEQ ID NO: 692566 - RNA, 64 nt, Homo Sapiens; identical to SEQ ID NO: 84605

SEQ ID NO: 692567 - RNA, 64 nt, Homo Sapiens; identical to SEQ ID NO: 84606

SEQ ID NO: 692568 - RNA, 64 nt, Homo Sapiens; identical to SEQ ID NO: 84607

SEQ ID NO: 692569 - RNA, 64 nt, Homo Sapiens; identical to SEQ ID NO: 84608

SEQ ID NO: 692570 - RNA, 64 nt, Homo Sapiens; identical to SEQ ID NO: 84609

SEQ ID NO: 692571 - RNA, 64 nt, Homo Sapiens; identical to SEQ ID NO: 84610

SEQ ID NO: 692572 - RNA, 64 nt, Homo Sapiens; identical to SEQ ID NO: 84611

SEQ ID NO: 692573 - RNA, 64 nt, Homo Sapiens; identical to SEQ ID NO: 84612

SEQ ID NO: 692574 - RNA, 64 nt, Homo Sapiens; identical to SEQ ID NO: 84613

SEQ ID NO: 692575 - RNA, 64 nt, Homo Sapiens; identical to SEQ ID NO: 84614

SEQ ID NO: 692576 - RNA, 64 nt, Homo Sapiens; identical to SEQ ID NO: 84615

SEQ ID NO: 692577 - RNA, 64 nt, Homo Sapiens; identical to SEQ ID NO: 84616

SEQ ID NO: 692578 - RNA, 64 nt, Homo Sapiens; identical to SEQ ID NO: 84617

SEQ ID NO: 692579 - RNA, 64 nt, Homo Sapiens; identical to SEQ ID NO: 84618

SEQ ID NO: 692580 - RNA, 64 nt, Homo Sapiens; identical to SEQ ID NO: 84619

SEQ ID NO: 692581 - RNA, 64 nt, Homo Sapiens; identical to SEQ ID NO: 84620

SEQ ID NO: 692582 - RNA, 64 nt, Homo Sapiens; identical to SEQ ID NO: 84621

SEQ ID NO: 692583 - RNA, 64 nt, Homo Sapiens; identical to SEQ ID NO: 84622

SEQ ID NO: 692584 - RNA, 64 nt, Homo Sapiens; identical to SEQ ID NO: 84623

SEQ ID NO: 692585 - RNA, 64 nt, Homo Sapiens; identical to SEQ ID NO: 84624

SEQ ID NO: 692586 - RNA, 64 nt, Homo Sapiens; identical to SEQ ID NO: 84625

SEQ ID NO: 692587 - RNA, 64 nt, Homo Sapiens; identical to SEQ ID NO: 84626

SEQ ID NO: 692588 - RNA, 64 nt, Homo Sapiens; identical to SEQ ID NO: 84627

SEQ ID NO: 692589 - RNA, 64 nt, Homo Sapiens; identical to SEQ ID NO: 84628

SEQ ID NO: 692590 - RNA, 64 nt, Homo Sapiens; identical to SEQ ID NO: 84629

SEQ ID NO: 692591 - RNA, 64 nt, Homo Sapiens; identical to SEQ ID NO: 84630

SEQ ID NO: 692592 - RNA, 64 nt, Homo Sapiens; identical to SEQ ID NO: 84631

SEQ ID NO: 692593 - RNA, 64 nt, Homo Sapiens; identical to SEQ ID NO: 578845

SEQ ID NO: 692594 - RNA, 64 nt, Homo Sapiens; identical to SEQ ID NO: 578846

SEQ ID NO: 692595 - RNA, 64 nt, Homo Sapiens; identical to SEQ ID NO: 84602

SEQ ID NO: 692596 - RNA, 64 nt, Homo Sapiens; identical to SEQ ID NO: 84603

SEQ ID NO: 692597 - RNA, 64 nt, Homo Sapiens; identical to SEQ ID NO: 84604

SEQ ID NO: 692598 - RNA, 64 nt, Homo Sapiens; identical to SEQ ID NO: 84605

SEQ ID NO: 692599 - RNA, 64 nt, Homo Sapiens; identical to SEQ ID NO: 84606

SEQ ID NO: 692600 - RNA, 64 nt, Homo Sapiens; identical to SEQ ID NO: 84607

SEQ ID NO: 692601 - RNA, 64 nt, Homo Sapiens; identical to SEQ ID NO: 84608

SEQ ID NO: 692602 - RNA, 64 nt, Homo Sapiens; identical to SEQ ID NO: 84609

SEQ ID NO: 692603 - RNA, 64 nt, Homo Sapiens; identical to SEQ ID NO: 84610

SEQ ID NO: 692604 - RNA, 64 nt, Homo Sapiens; identical to SEQ ID NO: 84611

SEQ ID NO: 692605 - RNA, 64 nt, Homo Sapiens; identical to SEQ ID NO: 84612

SEQ ID NO: 692606 - RNA, 64 nt, Homo Sapiens; identical to SEQ ID NO: 84613

SEQ ID NO: 692607 - RNA, 64 nt, Homo Sapiens; identical to SEQ ID NO: 84614

SEQ ID NO: 692608 - RNA, 64 nt, Homo Sapiens; identical to SEQ ID NO: 84615

SEQ ID NO: 692609 - RNA, 64 nt, Homo Sapiens; identical to SEQ ID NO: 84616

SEQ ID NO: 692610 - RNA, 64 nt, Homo Sapiens; identical to SEQ ID NO: 84617

SEQ ID NO: 692611 - RNA, 64 nt, Homo Sapiens; identical to SEQ ID NO: 84618

SEQ ID NO: 692612 - RNA, 64 nt, Homo Sapiens; identical to SEQ ID NO: 84619

SEQ ID NO: 692613 - RNA, 64 nt, Homo Sapiens; identical to SEQ ID NO: 84620

SEQ ID NO: 692614 - RNA, 64 nt, Homo Sapiens; identical to SEQ ID NO: 84621

SEQ ID NO: 692615 - RNA, 64 nt, Homo Sapiens; identical to SEQ ID NO: 84622

SEQ ID NO: 692616 - RNA, 64 nt, Homo Sapiens; identical to SEQ ID NO: 84623

SEQ ID NO: 692617 - RNA, 64 nt, Homo Sapiens; identical to SEQ ID NO: 84624

SEQ ID NO: 692618 - RNA, 64 nt, Homo Sapiens; identical to SEQ ID NO: 84625

SEQ ID NO: 692619 - RNA, 64 nt, Homo Sapiens; identical to SEQ ID NO: 84626

SEQ ID NO: 692620 - RNA, 64 nt, Homo Sapiens; identical to SEQ ID NO: 84627

SEQ ID NO: 692621 - RNA, 64 nt, Homo Sapiens; identical to SEQ ID NO: 84628

SEQ ID NO: 692622 - RNA, 64 nt, Homo Sapiens; identical to SEQ ID NO: 84629

SEQ ID NO: 692623 - RNA, 64 nt, Homo Sapiens; identical to SEQ ID NO: 84630

SEQ ID NO: 692624 - RNA, 64 nt, Homo Sapiens; identical to SEQ ID NO: 84631

SEQ ID NO: 692625 - RNA, 64 nt, Homo Sapiens; identical to SEQ ID NO: 578845

SEQ ID NO: 692626 - RNA, 64 nt, Homo Sapiens; identical to SEQ ID NO: 578846

SEQ ID NO: 692627 - RNA, 64 nt, Homo Sapiens; identical to SEQ ID NO: 84602

SEQ ID NO: 692628 - RNA, 64 nt, Homo Sapiens; identical to SEQ ID NO: 84603

SEQ ID NO: 692629 - RNA, 64 nt, Homo Sapiens; identical to SEQ ID NO: 84604

SEQ ID NO: 692630 - RNA, 64 nt, Homo Sapiens; identical to SEQ ID NO: 84605

SEQ ID NO: 692631 - RNA, 64 nt, Homo Sapiens; identical to SEQ ID NO: 84606

SEQ ID NO: 692632 - RNA, 64 nt, Homo Sapiens; identical to SEQ ID NO: 84607

SEQ ID NO: 692633 - RNA, 64 nt, Homo Sapiens; identical to SEQ ID NO: 84608

SEQ ID NO: 692634 - RNA, 64 nt, Homo Sapiens; identical to SEQ ID NO: 84609

SEQ ID NO: 692635 - RNA, 64 nt, Homo Sapiens; identical to SEQ ID NO: 84610

SEQ ID NO: 692636 - RNA, 64 nt, Homo Sapiens; identical to SEQ ID NO: 84611

SEQ ID NO: 692637 - RNA, 64 nt, Homo Sapiens; identical to SEQ ID NO: 84612

SEQ ID NO: 692638 - RNA, 64 nt, Homo Sapiens; identical to SEQ ID NO: 84613

SEQ ID NO: 692639 - RNA, 64 nt, Homo Sapiens; identical to SEQ ID NO: 84614

SEQ ID NO: 692640 - RNA, 64 nt, Homo Sapiens; identical to SEQ ID NO: 84615

SEQ ID NO: 692641 - RNA, 64 nt, Homo Sapiens; identical to SEQ ID NO: 84616

SEQ ID NO: 692642 - RNA, 64 nt, Homo Sapiens; identical to SEQ ID NO: 84617

SEQ ID NO: 692643 - RNA, 64 nt, Homo Sapiens; identical to SEQ ID NO: 84618

SEQ ID NO: 692644 - RNA, 64 nt, Homo Sapiens; identical to SEQ ID NO: 84619

SEQ ID NO: 692645 - RNA, 64 nt, Homo Sapiens; identical to SEQ ID NO: 84620

SEQ ID NO: 692646 - RNA, 64 nt, Homo Sapiens; identical to SEQ ID NO: 84621

SEQ ID NO: 692647 - RNA, 64 nt, Homo Sapiens; identical to SEQ ID NO: 84622

SEQ ID NO: 692648 - RNA, 64 nt, Homo Sapiens; identical to SEQ ID NO: 84623

SEQ ID NO: 692649 - RNA, 64 nt, Homo Sapiens; identical to SEQ ID NO: 84624

SEQ ID NO: 692650 - RNA, 64 nt, Homo Sapiens; identical to SEQ ID NO: 84625

SEQ ID NO: 692651 - RNA, 64 nt, Homo Sapiens; identical to SEQ ID NO: 84626

SEQ ID NO: 692652 - RNA, 64 nt, Homo Sapiens; identical to SEQ ID NO: 84627

SEQ ID NO: 692653 - RNA, 64 nt, Homo Sapiens; identical to SEQ ID NO: 84628

SEQ ID NO: 692654 - RNA, 64 nt, Homo Sapiens; identical to SEQ ID NO: 84629

SEQ ID NO: 692655 - RNA, 64 nt, Homo Sapiens; identical to SEQ ID NO: 84630

SEQ ID NO: 692656 - RNA, 64 nt, Homo Sapiens; identical to SEQ ID NO: 84631

SEQ ID NO: 692657 - RNA, 64 nt, Homo Sapiens; identical to SEQ ID NO: 578845

SEQ ID NO: 692658 - RNA, 64 nt, Homo Sapiens; identical to SEQ ID NO: 578846

SEQ ID NO: 692659 - RNA, 64 nt, Homo Sapiens; identical to SEQ ID NO: 410385

SEQ ID NO: 692660 - RNA, 64 nt, Homo Sapiens; identical to SEQ ID NO: 410386

SEQ ID NO: 692661 - RNA, 64 nt, Homo Sapiens; identical to SEQ ID NO: 410387

SEQ ID NO: 692662 - RNA, 64 nt, Homo Sapiens; identical to SEQ ID NO: 410388

SEQ ID NO: 692663 - RNA, 64 nt, Homo Sapiens; identical to SEQ ID NO: 410389

SEQ ID NO: 692664 - RNA, 64 nt, Homo Sapiens; identical to SEQ ID NO: 410390

SEQ ID NO: 692665 - RNA, 64 nt, Homo Sapiens; identical to SEQ ID NO: 410391

SEQ ID NO: 692666 - RNA, 64 nt, Homo Sapiens; identical to SEQ ID NO: 410392

SEQ ID NO: 692667 - RNA, 64 nt, Homo Sapiens; identical to SEQ ID NO: 410393

SEQ ID NO: 692668 - RNA, 64 nt, Homo Sapiens; identical to SEQ ID NO: 410394

SEQ ID NO: 692669 - RNA, 64 nt, Homo Sapiens; identical to SEQ ID NO: 410395

SEQ ID NO: 692670 - RNA, 64 nt, Homo Sapiens; identical to SEQ ID NO: 410396

SEQ ID NO: 692671 - RNA, 64 nt, Homo Sapiens; identical to SEQ ID NO: 410397

SEQ ID NO: 692672 - RNA, 64 nt, Homo Sapiens; identical to SEQ ID NO: 410398

SEQ ID NO: 692673 - RNA, 64 nt, Homo Sapiens; identical to SEQ ID NO: 410399

SEQ ID NO: 692674 - RNA, 64 nt, Homo Sapiens; identical to SEQ ID NO: 410400

SEQ ID NO: 692675 - RNA, 64 nt, Homo Sapiens; identical to SEQ ID NO: 410401

SEQ ID NO: 692676 - RNA, 64 nt, Homo Sapiens; identical to SEQ ID NO: 410402

SEQ ID NO: 692677 - RNA, 64 nt, Homo Sapiens
ugugcuuugaucguuaaugagguggucacaugagaaaugauaccuguuacuacuguauuguuuu

SEQ ID NO: 692678 - RNA, 64 nt, Homo Sapiens
cgaaucguuaauuuugacaguucuacugauccguaaaugauaaccacugcaaauuuuuucagua

SEQ ID NO: 692679 - RNA, 64 nt, Homo Sapiens
acuucagaaaauaaaaugucguuuuguuuuguaaaaaugauaaaccugcuuuuuguuucauuuu

SEQ ID NO: 692680 - RNA, 64 nt, Homo Sapiens
uauaaaaaauaugagagacucauugcuagucaggaaaugauauuuugaggccaguuuccuagcu

SEQ ID NO: 692681 - RNA, 64 nt, Homo Sapiens
gagaugcuaacuauuuuucaagcaagcuacagagaaaugauaaauguuuuuuguuuuauuauuu

SEQ ID NO: 692682 - RNA, 64 nt, Homo Sapiens
acacacacaaaaaauaccuaaauuuuggaugagaaaaugauaaaauaugcuaaguucuaggcug

SEQ ID NO: 692683 - RNA, 64 nt, Homo Sapiens
uaacucguuuugcugaauguuguugggugguagaaaaugauagaacaagggaauaaccgcgaau

SEQ ID NO: 692684 - RNA, 64 nt, Homo Sapiens
uuuuuucacaguaguccuuggcucugcacggaauaaaugauacccucaaaucuaauuggaugug

SEQ ID NO: 692685 - RNA, 64 nt, Homo Sapiens
guagaauucagcaauaugagaaaaccagccccuaaaaugauagccacaagagauuaauuguguu

SEQ ID NO: 692686 - RNA, 64 nt, Homo Sapiens
uucuuauauuuauguauuucuauucugauuucugaaaugauaaccuaguagugucugaugaagu

SEQ ID NO: 692687 - RNA, 64 nt, Homo Sapiens
auaaauaaauaaaauacuucugugauuguuuacaaaaugauauuuugaauaaaaaagugcacag

SEQ ID NO: 692688 - RNA, 64 nt, Homo Sapiens
uuuguuuacuuauaaauuuuuucuugguccuuauaaaugauaguaugucugcccuuuuguuuac

SEQ ID NO: 692689 - RNA, 64 nt, Homo Sapiens
aaccaaaggggcuuccuugucauauuuguggccaaaaugauacuugaguuaugggagaagggga

SEQ ID NO: 692690 - RNA, 64 nt, Homo Sapiens
aagaggauuauucucccguugcauuuaagugcacaaaugauaaccuuuuugauuuuuccgagug

SEQ ID NO: 692691 - RNA, 64 nt, Homo Sapiens
ggguugguucucauuucgugacugggaugucaggaaaugauacacauuuacagucagaaagcuu

SEQ ID NO: 692692 - RNA, 64 nt, Homo Sapiens
ccuguaacuguaccuaucaguaagacaccaacagaaaugauauauacaauuaugaaauguaaug

SEQ ID NO: 692693 - RNA, 64 nt, Homo Sapiens
ugaaaugaauauagacacuuauuuuuauagguuaaaaugauaggcugcacccagccaagugauc

SEQ ID NO: 692694 - RNA, 64 nt, Homo Sapiens
uuuguuaaucuagccucuuuaaagagaaacaaggaaaugauagcgaauuauuugaccagcuguc

SEQ ID NO: 692695 - RNA, 64 nt, Homo Sapiens
uaucuuauauguaucaaccaucacaaaacuuccaaaaugauauauauauuuuauuauauguaau

SEQ ID NO: 692696 - RNA, 64 nt, Homo Sapiens
cuaaggagaauugaaaaaaacuugauaugacugcaaaugauacuuaagcagaucuuuauuuuuu

SEQ ID NO: 692697 - RNA, 64 nt, Homo Sapiens
ugagaaaugauucuuguuuuaguaaucauucuauaaaugauacugcuggauugauugccguggg

SEQ ID NO: 692698 - RNA, 64 nt, Homo Sapiens
aaaaacaccugacaacuaaaaaauguuucagauuaaaugauaguaagacaaagaaagguugugg

SEQ ID NO: 692699 - RNA, 64 nt, Homo Sapiens
aaaaaggauauaauuucuuaacuuuguauacuugaaaugauaauaaaauucuaaucuauguuga

SEQ ID NO: 692700 - RNA, 64 nt, Homo Sapiens
uuaaaaaucuuuuccuauagucuugguaaauuuuaaaugauagcucuauaaaugauauuuauaa

SEQ ID NO: 692701 - RNA, 64 nt, Homo Sapiens
uauagucuugguaaauuuuaaaugauagcucuauaaaugauauuuauaaguuaugguuauuuuu

SEQ ID NO: 692702 - RNA, 64 nt, Homo Sapiens
uuauuuugguuuacuaagauaaugcaguugguggaaaugauaaacguuuuaaguguuaacaucc

SEQ ID NO: 692703 - RNA, 64 nt, Homo Sapiens
uuuccuugaucuguuggaggcuaaaaguagguauaaaugauauugaauguuggguauagugaua

SEQ ID NO: 692704 - RNA, 64 nt, Homo Sapiens
aucaguauugcaaugaaagaaaaacuaaaaacagaaaugauauucucaauuuugggcaauguga

SEQ ID NO: 692705 - RNA, 64 nt, Homo Sapiens
uuaguauaaaaucuaaacuuuuuccauuuaucagaaaugauaaaauccaguuaccacauaucac

SEQ ID NO: 692706 - RNA, 64 nt, Homo Sapiens
acauauuuguuuguuuaaaacuuuauaaaacuuuaaaugauaccucauucaguuacucuuaauu

SEQ ID NO: 692707 - RNA, 64 nt, Homo Sapiens
gcuuccaaacuguagcugucagagcugaaaagagaaaugauaauaacugaaaagauuaaaagug

SEQ ID NO: 692708 - RNA, 64 nt, Homo Sapiens
uuuagaugcaauaauuaaccaugaaaagguucuaaaaugauauaauuagguaaaaugagauuac

SEQ ID NO: 692709 - RNA, 64 nt, Homo Sapiens
gaucuguuuacaagguuuguuuauuuauguuuauaaaugauacauuggcuguuaauaauuugga

SEQ ID NO: 692710 - RNA, 64 nt, Homo Sapiens
acacuuagccuucugaagugcucaucucuugcuuaaaugauagucuauuuaguaguuuaaaaua

SEQ ID NO: 692711 - RNA, 64 nt, Homo Sapiens
ucagagaaaauaugugaaguuuacaaaggaaccaaaaugauaaugggagaauuuagucuuaaaa

SEQ ID NO: 692712 - RNA, 64 nt, Homo Sapiens
aucuuuacucagggaugggcuauuaaaaaauuacaaaugauagauaucaauguaaaauuuacgu

SEQ ID NO: 692713 - RNA, 64 nt, Homo Sapiens
ggguuuauuuuauauuuucauuuuuuuuuuacuaaaaugauauacaaagagcauuuauauuuuc

SEQ ID NO: 692714 - RNA, 64 nt, Homo Sapiens
ggcaauacaacugucacaucagaaacaagaaaacaaaugauaaaggaacucauuuaucaauaga

SEQ ID NO: 692715 - RNA, 64 nt, Homo Sapiens
cuauauugaaaaauaaagaugucaauaaaaggagaaaugauauuuuucuagaugaaauacucaa

SEQ ID NO: 692716 - RNA, 64 nt, Homo Sapiens
uuacugguauucgcuucaaaaaaauguacaggugaaaugauaugcuuuuagagaaguauacuga

SEQ ID NO: 692717 - RNA, 64 nt, Homo Sapiens
uaagacauuuuuuugcaaugaaaaauaaauuuuaaaaugauauaauaauguugugaguuuuuau

SEQ ID NO: 692718 - RNA, 63 nt, Homo Sapiens
gauuugauugugauuagagaaccuuggacauuuugcugcuaaagaaucuuuuuuccccucucc

SEQ ID NO: 692719 - RNA, 63 nt, Homo Sapiens
cggcucagucggccagacuuccucuaggaguggugcugcuaccuuguauguuuacauaaugcu

SEQ ID NO: 692720 - RNA, 63 nt, Homo Sapiens
aacagaaaagauauuuauuggccaggaaguuggugcugcuaagaccgagaaauuuaaagaauc

SEQ ID NO: 692721 - RNA, 63 nt, Homo Sapiens
uucuauucgggacaauaaaauguauuuugaaagugcugcuaacuauugaugcugacaguguuu

SEQ ID NO: 692722 - RNA, 63 nt, Homo Sapiens
agucaguuauuagauuuaaaucaccuucugaaaugcugcuauagggcugguaucuguaaaaga

SEQ ID NO: 692723 - RNA, 63 nt, Homo Sapiens
uuuaaaucaauggagagaaaaaacugaaaaagaugcugcuaaguaguucucuguauuaaagga

SEQ ID NO: 692724 - RNA, 63 nt, Homo Sapiens
aaauugcuaaauuccaaacagaaccagugacuuugcugcuacauauuuacuaaauugaccacu

SEQ ID NO: 692725 - RNA, 63 nt, Homo Sapiens
ucauagcaacauaaugugucccugaguagaggaugcugcuaugcgugaguucauggacacaag

SEQ ID NO: 692726 - RNA, 63 nt, Homo Sapiens
uauucagaugacugcagaaccuggaaaagcuguugcugcuauugaugcauaacauacugcuau

SEQ ID NO: 692727 - RNA, 63 nt, Homo Sapiens
guuuccucugcucagcaucauuucaugccaaagugcugcuaugggcugcuuugugugcacaaa

SEQ ID NO: 692728 - RNA, 63 nt, Homo Sapiens
aaacaaaaaaaacuguuaucgaacuuucuuuguugcugcuaguuaaaacuuguugcaacuuuu

SEQ ID NO: 692729 - RNA, 63 nt, Homo Sapiens
aggguucuguaugauggagacuauuauugcuauugcugcuaauuccaugagcugugaagaucc

SEQ ID NO: 692730 - RNA, 63 nt, Homo Sapiens
gauggaggagacagaauaggaggaaagugaugcugcugcuaagaauauucgaggucaagagcu

SEQ ID NO: 692731 - RNA, 63 nt, Homo Sapiens
auucugcguuuuugguuuuaauguuauaucugaugcugcuauauccacuguccaacggaguua

SEQ ID NO: 692732 - RNA, 63 nt, Homo Sapiens
gcccugggcuggacuggaggcgaugccacgcuuugcugcuaccauuuuuguaagaaaccgagg

SEQ ID NO: 692733 - RNA, 63 nt, Homo Sapiens
caaaauguccuguugaagagcagcaccaacaucugcugcuacuuggaucuuuccacauuucag

SEQ ID NO: 692734 - RNA, 63 nt, Homo Sapiens
uuucuacugagugaagccauuggcccagaaugaugcugcuagugaccccuggggaaugcccca

SEQ ID NO: 692735 - RNA, 63 nt, Homo Sapiens
aaacauauuuguaaaugguuuucuuuaaagaaaugcugcuauuugggcauuugaacuuuguuu

SEQ ID NO: 692736 - RNA, 63 nt, Homo Sapiens
uuuagccauuaugguuuuucagaaccguguuggugcugcuaagaugagcuacgccuugaugaa

SEQ ID NO: 692737 - RNA, 63 nt, Homo Sapiens
uaacaacccagaguaggccucuaagguggucucugcugcuauuaccugggcaauuccuguuuu

SEQ ID NO: 692738 - RNA, 63 nt, Homo Sapiens
gucaguaguaucguuuuuuucuuuguuugugauugcugcuaaauaucccucguuuaucauccc

SEQ ID NO: 692739 - RNA, 63 nt, Homo Sapiens
cuuugccugccccugggguugagcaagaugaguugcugcuauuuuacacacugcccacacuca

SEQ ID NO: 692740 - RNA, 63 nt, Homo Sapiens
caagcaccaaagaccuguuauguacauaagagaugcugcuaccuugcuggcuucagaagccuu

SEQ ID NO: 692741 - RNA, 63 nt, Homo Sapiens
uucuguuuuaaggugugaggguaauagugggucugcugcuacuuuaucccguuaguacaguau

SEQ ID NO: 692742 - RNA, 63 nt, Homo Sapiens
gcuucuacaauguaaaaugucugaguauaguacugcugcuacuuacugggacauauuuaaaua

SEQ ID NO: 692743 - RNA, 63 nt, Homo Sapiens
gcaagagaaacuuggagcugagaggccgcauuuugcugcuaaacuguugcuuugguagagaug

SEQ ID NO: 692744 - RNA, 63 nt, Homo Sapiens
uccagacacugugcaaauaaauauucauugaacugcugcuacaauaucuucuuuuaccuauca

SEQ ID NO: 692745 - RNA, 63 nt, Homo Sapiens
cuagacauuucauaguuacagggcauccauaauugcugcuaacacagauucugcccagucucu

SEQ ID NO: 692746 - RNA, 63 nt, Homo Sapiens
uuuuugcccccaguuccacaccuuaagugcuuuugcugcuauuagucccagcugaauucuugc

SEQ ID NO: 692747 - RNA, 63 nt, Homo Sapiens
cugugggucaaauguuuccaauaaauguauuuaugcugcuagagaucaacaaugaaguauuuu

SEQ ID NO: 692748 - RNA, 63 nt, Homo Sapiens
aucuaagucaggucaccagauaauagcuucuagugcugcuacacucaacugccccaaaucucu

SEQ ID NO: 692749 - RNA, 63 nt, Homo Sapiens
guuuugccauccuucuauuccagagcaucucuuugcugcuacucaggccaaucagacagggcc

SEQ ID NO: 692750 - RNA, 63 nt, Homo Sapiens
ggguaccucagucacacaccucugggagggcugugcugcuagucuguccuuaaggaauggucc

SEQ ID NO: 692751 - RNA, 63 nt, Homo Sapiens
aacacauuguuuguauugcuucuaacgacuggaugcugcuagucgagaagcagggugagagau

SEQ ID NO: 692752 - RNA, 63 nt, Homo Sapiens
gucuuacuauuauagcaacuggucucaugcuguugcugcuacugaaauuguaucucagucuaa

SEQ ID NO: 692753 - RNA, 63 nt, Homo Sapiens
uuaucauuaggauaggguaagugaaguuugcuaugcugcuagcauccuaagaugauaccuuug

SEQ ID NO: 692754 - RNA, 63 nt, Homo Sapiens
uaccacuggugagugcuccauaguuuccuuaccugcugcuacagaauguuauuuuacaucccu

SEQ ID NO: 692755 - RNA, 63 nt, Homo Sapiens
gaaaacauuuguuauuggcuauuucagguguuuugcugcuagaaauuauuaaaguuacacacu

SEQ ID NO: 692756 - RNA, 63 nt, Homo Sapiens
uauaggcuuccuauuuucacuuuacugcucuaaugcugcuagucguagucuuuagcacacuag

SEQ ID NO: 692757 - RNA, 63 nt, Homo Sapiens
gagguucuuuucuacaugaugaccuucagcuccugcugcuagucuccaauugccaagggaauu

SEQ ID NO: 692758 - RNA, 63 nt, Homo Sapiens
cuuauggaaaugaaauaugaaauuuuauuaaaaugcugcuauauuacauaaguugcuucauua

SEQ ID NO: 692759 - RNA, 63 nt, Homo Sapiens
ugguugaaaauuguacuugaauacauacaugcaugcugcuaaacuagaacuuuaauuuuuccc

SEQ ID NO: 692760 - RNA, 63 nt, Homo Sapiens
uucuuacaaaucuuuuaagagggcuguaacaguugcugcuaguauuaggguuccacaucauuc

SEQ ID NO: 692761 - RNA, 63 nt, Homo Sapiens
cuguuaauaaaagaauuuacaguuugguaaaauugcugcuaaacaaucauuggaucacaaucc

SEQ ID NO: 692762 - RNA, 63 nt, Homo Sapiens
uuuaauggcugccuuuucauuuucaucuuuucuugcugcuacccaucuauguauguagucauu

SEQ ID NO: 692763 - RNA, 63 nt, Homo Sapiens
agauaugguaguuaugaagaaaacaaugucauuugcugcuauuauuguaagagucuuauaauu

SEQ ID NO: 692764 - RNA, 63 nt, Homo Sapiens
ugaaggggagcaccgggcgagugcaugugcuacugcugcuacaggccugucuaucuguuuguc

SEQ ID NO: 692765 - RNA, 63 nt, Homo Sapiens
cacggugacaccaccuuccugaggcuucccuccugcugcuaccacugaugcgagggaaaggcc

SEQ ID NO: 692766 - RNA, 63 nt, Homo Sapiens
aagaacaaugccauuugagagugagguggucccugcugcuacgaggccauuguacuguuuuuu

SEQ ID NO: 692767 - RNA, 63 nt, Homo Sapiens
uuuauguuuguacacaacaccuaaaaccaguuuugcugcuauaauucuauacuguugauucgu

SEQ ID NO: 692768 - RNA, 63 nt, Homo Sapiens
uaugcauguucugacugacacauagcuccacucugcugcuaaaugcugaguuguaugucuuug

SEQ ID NO: 692769 - RNA, 63 nt, Homo Sapiens
uuugaaggacauuguaucgcgaaagugacuucuugcugcuaguaaguucaugagaggacagaa

SEQ ID NO: 692770 - RNA, 63 nt, Homo Sapiens
uguucuguccucugaccuugugaaauuaccuauugcugcuacuccucaccaguuuggacaauu

SEQ ID NO: 692771 - RNA, 63 nt, Homo Sapiens
aacauauuucuacaagauuucuacucugaaugaugcugcuauguguguguuuuuacuuuuugg

SEQ ID NO: 692772 - RNA, 63 nt, Homo Sapiens
ugauguugcuucuuugcuaaaaggcacucuaauugcugcuaaaauuuuuuuuaagucuucuug

SEQ ID NO: 692773 - RNA, 63 nt, Homo Sapiens
acugaauaagugauacuuuguaacgagacauagugcugcuaccguauuugcugauaaaaggca

SEQ ID NO: 692774 - RNA, 63 nt, Homo Sapiens
cugggagaauaaacuuguauuucaaguuuuauuugcugcuauuauuaggagcuguacauccaa

SEQ ID NO: 692775 - RNA, 63 nt, Homo Sapiens
cuggaauguguccauugaaacagggaaggugauugcugcuauuacuuuugguaggaaggaaaa

SEQ ID NO: 692776 - RNA, 63 nt, Homo Sapiens
uguacagcagacaugccgcuuucaucacguaugugcugcuacccauugagcucaguggccugu

SEQ ID NO: 692777 - RNA, 63 nt, Homo Sapiens
aagaaucaggagaaugcauuucaugucugauucugcugcuaauuaagucaaucauuuaauuuu

SEQ ID NO: 692778 - RNA, 63 nt, Homo Sapiens
uggauacacauggagcuguuugggaauuuuccuugcugcuaccgcgcugccaccaaauggaau

SEQ ID NO: 692779 - RNA, 63 nt, Homo Sapiens
cuaacucuguuguuuucaaccucuacguuauuuugcugcuaugugcauuuccagaucugauuu

SEQ ID NO: 692780 - RNA, 63 nt, Homo Sapiens
ccugaugaugugacaaugcauggucuuugugcaugcugcuagacacuuuucuuucccagccga

SEQ ID NO: 692781 - RNA, 63 nt, Homo Sapiens
gccucuuccaaaaggggacacagaagcacuggcugcugcuacagaccgcaaaagcagaaaguu

SEQ ID NO: 692782 - RNA, 63 nt, Homo Sapiens
agauaucaugcaaauuucaugaccaguaaaggcugcugcuacaauguccuaacugaaagauga

SEQ ID NO: 692783 - RNA, 63 nt, Homo Sapiens
uguuugucucuccuuuucuuuuguuacuguucuugcugcuagaacuuuuuuaaauaaacuuuu

SEQ ID NO: 692784 - RNA, 63 nt, Homo Sapiens
agcugggaucagccugcagccaucccccgacccugcugcuaggccacggucugcgcccugggg

SEQ ID NO: 692785 - RNA, 63 nt, Homo Sapiens
uugcuguugcuguugcuguugcuguuggcaucuugcugcuaauccugaggcugguagcagaau

SEQ ID NO: 692786 - RNA, 63 nt, Homo Sapiens
cauuaacagcgccucuuugauagguuacccugaugcugcuaaaguaaagccuuaaguguguuu

SEQ ID NO: 692787 - RNA, 63 nt, Homo Sapiens
ugaaaaccauaugauauuuugucuccuaccugcugcugcuauuauguaacauccagaagguuu

SEQ ID NO: 692788 - RNA, 63 nt, Homo Sapiens
acccacaugguucucccacugcccugucugcucugcugcuacagaggggcagggccuccccca

SEQ ID NO: 692789 - RNA, 63 nt, Homo Sapiens
aagggcaguggauucuggaggcucuacuucaggugcugcuauaaugccucaucuaaucaggac

SEQ ID NO: 692790 - RNA, 63 nt, Homo Sapiens
uuuuuuucuaaauuuuuagcauuaguccauuucugcugcuaacaauugaauccagaaaucuac

SEQ ID NO: 692791 - RNA, 63 nt, Homo Sapiens
cucuuccuuucuggccaaggaugaugucaguucugcugcuacuagccuggaguugcagaagcu

SEQ ID NO: 692792 - RNA, 63 nt, Homo Sapiens
uggggaagucucuuuuuugaaacacuucagaacugcugcuauaaagaaauucucuaauugguu

SEQ ID NO: 692793 - RNA, 63 nt, Homo Sapiens
gaccuucuagacugcucacauuuucagagaagcugcugcuaagcuccagaggcagaacacaug

SEQ ID NO: 692794 - RNA, 63 nt, Homo Sapiens
acuucugaggagcaaugggaccccuagucuggcugcugcuaggcccugugaaaacuuacuuug

SEQ ID NO: 692795 - RNA, 63 nt, Homo Sapiens
uuuaaaacuccccugauguaagaccccaguauuugcugcuauuagcagcauaauuauuuccaa

SEQ ID NO: 692796 - RNA, 63 nt, Homo Sapiens
uaagccaagaacugagguccgugguacuggggcugcugcuauuugucacccccaggaggcgcu

SEQ ID NO: 692797 - RNA, 63 nt, Homo Sapiens
agucacuugaccagacugcaguggcuccugaccugcugcuaagagucggcgacaagguugugc

SEQ ID NO: 692798 - RNA, 63 nt, Homo Sapiens
cuugcuuuuggaaguuaccauccuuuccucucuugcugcuacuaguccaaaguauaaacaugc

SEQ ID NO: 692799 - RNA, 63 nt, Homo Sapiens
uacagucuagguuuucuguuucacucuuaagguugcugcuauagugaaaaauugacagcuccc

SEQ ID NO: 692800 - RNA, 63 nt, Homo Sapiens; identical to SEQ ID NO: 423621

SEQ ID NO: 692801 - RNA, 63 nt, Homo Sapiens; identical to SEQ ID NO: 423622

SEQ ID NO: 692802 - RNA, 63 nt, Homo Sapiens
aaaaaaaaaaaagucggaaagaaugaaggguucugcugcuaaauccuggguaaggcuucauuu

SEQ ID NO: 692803 - RNA, 63 nt, Homo Sapiens
agcuuuuuuuuuuaaaaaaagcucauuuuuacaugcugcuacuuuuucugaguuucucguaau

SEQ ID NO: 692804 - RNA, 63 nt, Homo Sapiens
cauuaacccaaauauuuguauuauuguuaggcuugcugcuacuuucuaaaugcaagucaagcu

SEQ ID NO: 692805 - RNA, 63 nt, Homo Sapiens
gaaaggaacuaagucaggaucugcuguuuuuuuugcugcuaaagccugccaagaauuuuauuu

SEQ ID NO: 692806 - RNA, 63 nt, Homo Sapiens
uugaaauucuuauuuugacccucuucugucauuugcugcuaugauuaggagcucuuucucuca

SEQ ID NO: 692807 - RNA, 63 nt, Homo Sapiens
ccauuggcuugccaagaguacagaaauucauuaugcugcuaauuuaacguggaauuccuucau

SEQ ID NO: 692808 - RNA, 63 nt, Homo Sapiens; identical to SEQ ID NO: 423623

SEQ ID NO: 692809 - RNA, 63 nt, Homo Sapiens; identical to SEQ ID NO: 423624

SEQ ID NO: 692810 - RNA, 63 nt, Homo Sapiens
cucacuuauagagcucuccaggacuggaaaaagugcugcuauuuuaacuugcucuugcuugua

SEQ ID NO: 692811 - RNA, 63 nt, Homo Sapiens
acugucuggaugguucauuacucaaguuacugcugcugcuauugucuuuccuuuguugucgau

SEQ ID NO: 692812 - RNA, 63 nt, Homo Sapiens
gcacugccagugcagcccacuguuuuguugaguugcugcuauuccccgcuuguguaacagucc

SEQ ID NO: 692813 - RNA, 63 nt, Homo Sapiens
gaguaugcaaauauugaaguucaguaaaaauaaugcugcuaucuacauguaguugcacacggu

SEQ ID NO: 692814 - RNA, 63 nt, Homo Sapiens
uugugcaagaacuuugaaggaccucuaaagaauugcugcuacugcuuaaacuauugacucuau

SEQ ID NO: 692815 - RNA, 63 nt, Homo Sapiens
gggacuugcccagcugaguguugguugaacauuugcugcuaauguguguguguuuuuuuuaau

SEQ ID NO: 692816 - RNA, 63 nt, Homo Sapiens
aaaugguuuugcuuuguauucuuuucuagaggaugcugcuagauaugauugugacuucuaguu

SEQ ID NO: 692817 - RNA, 63 nt, Homo Sapiens
ugaaagaaagaaaaaagcaaccaaacuuauuuaugcugcuaaacuguacuguacucccagugg

SEQ ID NO: 692818 - RNA, 63 nt, Homo Sapiens
uguaauagauguuugauagauuuucugcuacuuugcugcuaugguuuucuccaagagcuacau

SEQ ID NO: 692819 - RNA, 59 nt, Homo Sapiens; identical to SEQ ID NO: 423748

SEQ ID NO: 692820 - RNA, 63 nt, Homo Sapiens
uugucaccaugagauagcauuagcugcccaggaugcugcuauauauauauauauauauauaua

SEQ ID NO: 692821 - RNA, 63 nt, Homo Sapiens
acuuuuaagauggauaauagggcauggacugagugcugcuaucuugaaaugugcacagguaca

SEQ ID NO: 692822 - RNA, 63 nt, Homo Sapiens
gagaauucagucuacagccauuuaaaugaucauugcugcuacagaagugcuuuaagagaauug

SEQ ID NO: 692823 - RNA, 63 nt, Homo Sapiens
cugagaagcagcuuuaugagguuuuacagaguaugcugcuaccucucuccuugaagggagcau

SEQ ID NO: 692824 - RNA, 63 nt, Homo Sapiens
gagcuuugguuuuuagaaauaaagugcaugaauugcugcuaugcuguauccuaguaucccagu

SEQ ID NO: 692825 - RNA, 63 nt, Homo Sapiens
gguugacucagagagucgcugucauucugucauugcugcuacucuaacacugagcaacacucu

SEQ ID NO: 692826 - RNA, 63 nt, Homo Sapiens
ucauucguucugaccuaauaggagagacccuuuugcugcuacuccagugaaagacagaucaua

SEQ ID NO: 692827 - RNA, 63 nt, Homo Sapiens
gggagagucaucauaaaaaacaaggugggauguugcugcuaauccccuggcaaacauugucac

SEQ ID NO: 692828 - RNA, 63 nt, Homo Sapiens
gauaugcacccagaaaccuugaaagcuuuguacugcugcuaauugugcaguuuuuuaacuagg

SEQ ID NO: 692829 - RNA, 63 nt, Homo Sapiens
ccucuuggaugcacacuuuguaaagacuucugcugcugcuaugcuuccugguguacaagccuu

SEQ ID NO: 692830 - RNA, 63 nt, Homo Sapiens
cuguagccacccccauggcucacaucacaauacugcugcuacuaaaacaauucuauuucauag

SEQ ID NO: 692831 - RNA, 63 nt, Homo Sapiens
uuaaaguguggucauuaugaccaaggaaugagcugcugcuacuauucuuuccuuacgcaaagc

SEQ ID NO: 692832 - RNA, 63 nt, Homo Sapiens
gccgucugcuaccucgagaauaagacaacaguaugcugcuauauuaaguuuucuuucuguuuc

SEQ ID NO: 692833 - RNA, 63 nt, Homo Sapiens
cugccacauaagaucuaguuuuuauuucuagagugcugcuaugaauaauuacuauagcugcug

SEQ ID NO: 692834 - RNA, 63 nt, Homo Sapiens
uuucugagguaacuggguaauagaauaucaaauugcugcuaucucggaccuauuguuaaagga

SEQ ID NO: 692835 - RNA, 63 nt, Homo Sapiens
acuaaguaugcagguuuccugguaccauugaguugcugcuauuaaagcucacacacgaaaugg

SEQ ID NO: 692836 - RNA, 63 nt, Homo Sapiens
ggcaauuaauuaauccugugaagguuacauugcugcugcuagagaggguggggauugcaccuu

SEQ ID NO: 692837 - RNA, 63 nt, Homo Sapiens
caggcucaugauaaauguauuagucuguucucaugcugcuauuaaagacauaccugacacugg

SEQ ID NO: 692838 - RNA, 63 nt, Homo Sapiens
aggaggacgaacagagauccugaaauucugacuugcugcuauuccagaacccagccuccuggg

SEQ ID NO: 692839 - RNA, 63 nt, Homo Sapiens
uucaauguuccauucuucgacauccgucauugcugcugcuaccagcgccaaauguucauccuc

SEQ ID NO: 692840 - RNA, 63 nt, Homo Sapiens
aaagacaguggagaauuuacggaaugacaugaaugcugcuaaaggacuggacucaaacaaaaa

SEQ ID NO: 692841 - RNA, 63 nt, Homo Sapiens
uccuguaguaggcuugcuggagcaaaggaaaugugcugcuaaaaaucaacuuaugccauuuua

SEQ ID NO: 692842 - RNA, 63 nt, Homo Sapiens
uuuuuuuaaucuuuuuaaaaacugcugugguuuugcugcuacacuaagaauugugauuugcau

SEQ ID NO: 692843 - RNA, 63 nt, Homo Sapiens
agaggguuccaugagauuauuguagacucaugaugcugcuaucucaaccagaugcccaggaca

SEQ ID NO: 692844 - RNA, 63 nt, Homo Sapiens; identical to SEQ ID NO: 423625

SEQ ID NO: 692845 - RNA, 63 nt, Homo Sapiens; identical to SEQ ID NO: 423626

SEQ ID NO: 692846 - RNA, 63 nt, Homo Sapiens
uuuuuuuagugcugcauuuuuuuaaaguuggauugcugcuauuuaaaaaaaaaaaaaggacac

SEQ ID NO: 692847 - RNA, 63 nt, Homo Sapiens
cuugccaaaauggauccuuugauuuuugucauuugcugcuaaaauauauuaucugaagguaaa

SEQ ID NO: 692848 - RNA, 63 nt, Homo Sapiens
accgcgcagcgugacugugaguugcucauaccgugcugcuaucugggcagcgcugcccauuua

SEQ ID NO: 692849 - RNA, 63 nt, Homo Sapiens
aauguuuguguaccuguauucuauugggaauagugcugcuaugggguuguuucugacuuuugg

SEQ ID NO: 692850 - RNA, 63 nt, Homo Sapiens
gucacugagggguuagcuuucuuccagaagacaugcugcuaugcucugggguaagaguaaagg

SEQ ID NO: 692851 - RNA, 63 nt, Homo Sapiens
gcugcugcugcugccgccgccaacccuuccugcugcugcuacuggugacagcuccgggaucag

SEQ ID NO: 692852 - RNA, 63 nt, Homo Sapiens
cuauagucuccccaccuguacaaguuaucuaaaugcugcuauggugagcugugggacuuuagg

SEQ ID NO: 692853 - RNA, 63 nt, Homo Sapiens
ucccuacauaaugucaauuuauuagccauucucugcugcuauuuugguucguuauuuuuuaag

SEQ ID NO: 692854 - RNA, 63 nt, Homo Sapiens
ugaucucuaaugaccaaugguaacaaacaggccugcugcuagaaagucagccugcucuacuac

SEQ ID NO: 692855 - RNA, 63 nt, Homo Sapiens
agacaagugauguccuggguuauaugcauagaaugcugcuagaagaacaguacuggccuucag

SEQ ID NO: 692856 - RNA, 63 nt, Homo Sapiens
guaugcuuauuugaguuuauuagguguuucgugugcugcuaagccugcaguuacauugaauug

SEQ ID NO: 692857 - RNA, 63 nt, Homo Sapiens
aguguguguaugucacccuccaccuuugcguuuugcugcuaacauuucauuuuaaucauugga

SEQ ID NO: 692858 - RNA, 63 nt, Homo Sapiens
ccugcuggaggaaugaauaguagaagaucuuggugcugcuauugcuuuauauguaaagaauuu

SEQ ID NO: 692859 - RNA, 63 nt, Homo Sapiens
gaacaaaaguggggagguauaauaacugaguguugcugcuaaaaccuggaaauaauuuaccaa

SEQ ID NO: 692860 - RNA, 63 nt, Homo Sapiens
aauauuucuauuuuuagaaauuaaagaaagcauugcugcuacaaaugacucguauucagaugc

SEQ ID NO: 692861 - RNA, 63 nt, Homo Sapiens
gagaacacuggcuucacagaggacuuugugcauugcugcuaugaacuuugaccugagucgggg

SEQ ID NO: 692862 - RNA, 63 nt, Homo Sapiens
cacauuuuuuaaaagggcaaguacaggagcaacugcugcuacccagaaaaauguguguauuau

SEQ ID NO: 692863 - RNA, 63 nt, Homo Sapiens
aaauagccacaguccuuaagccacacacauuguugcugcuaugacuuuuuaccuccuuuaaac

SEQ ID NO: 692864 - RNA, 63 nt, Homo Sapiens
gaagccaaauuuauauguccuaguagaaugaagugcugcuaguuuuuaugagaaguauauuau

SEQ ID NO: 692865 - RNA, 63 nt, Homo Sapiens
uaguuuaaggugguugauggauuuagccauauaugcugcuaaagaaauugucuaccuuuucuu

SEQ ID NO: 692866 - RNA, 63 nt, Homo Sapiens
ugaccuuuuccuaugucuaggcuccuccacaggugcugcuauuuugugagcuccggcuccugu

SEQ ID NO: 692867 - RNA, 63 nt, Homo Sapiens
cucagugccugagcccggcccagugcacgccgaugcugcuaaaaacaguagcuuguagagauc

SEQ ID NO: 692868 - RNA, 63 nt, Homo Sapiens
uccuugcuggcgcccauacccuugggggcagccugcugcuauggggugcgcagggaggccggg

SEQ ID NO: 692869 - RNA, 63 nt, Homo Sapiens
acguuauuauaaaacuuaccauuuacuaucaacugcugcuaaucaaaacaaaucuuauguugc

SEQ ID NO: 692870 - RNA, 63 nt, Homo Sapiens
uagaaucccgcaugucugcauuucagcaauuuaugcugcuaaaguguucuuuucugaauuuca

SEQ ID NO: 692871 - RNA, 63 nt, Homo Sapiens
cuuguuauccuucccacuguuguuuugaaguauugcugcuaucuaauuuauuuuguaaugucu

SEQ ID NO: 692872 - RNA, 63 nt, Homo Sapiens
gcacauuaaaaacaaauccuuuuuagaaucuacugcugcuaaagagaggacaagaagacacag

SEQ ID NO: 692873 - RNA, 63 nt, Homo Sapiens
aaccuuuuucuacuuacuaucaacagugcccucugcugcuagaagacuuuuuguuucuugcaa

SEQ ID NO: 692874 - RNA, 63 nt, Homo Sapiens
caaagaagaugauuuaaugguagaacggauaccugcugcuagaccugauggaauguuaccugu

SEQ ID NO: 692875 - RNA, 63 nt, Homo Sapiens
gucuuguuucuucuuuauguuucuuuuacuuauugcugcuaggauccuacauaggauuucuau

SEQ ID NO: 692876 - RNA, 63 nt, Homo Sapiens
uggccccauccucacuuccucuuuuuauuucacugcugcuaaaauuguguuuuuaccuacuac

SEQ ID NO: 692877 - RNA, 63 nt, Homo Sapiens
gcuuuuuaacaagaacugaugcuccuugggugcugcugcuacucagacuagcucuaaguaaug

SEQ ID NO: 692878 - RNA, 63 nt, Homo Sapiens
ggcuguugcauuuuuuuauuagggucuccacacugcugcuagguccaagacaggggccuaagg

SEQ ID NO: 692879 - RNA, 63 nt, Homo Sapiens
aacuuuuguguaugaguuuucuauuauacauaaugcugcuaggggaucguuucuacuucuuga

SEQ ID NO: 692880 - RNA, 63 nt, Homo Sapiens
accuggggugugugacucagguuuggagaugucugcugcuaggcaguguucacaaggauguug

SEQ ID NO: 692881 - RNA, 63 nt, Homo Sapiens
auuuuuauauugacaaacaugaaacuauggaaaugcugcuaaauacgacuaauguuggagccu

SEQ ID NO: 692882 - RNA, 63 nt, Homo Sapiens
auucauaguugcacauacugauauccacauuacugcugcuaggccaaagaaacccuauauuau

SEQ ID NO: 692883 - RNA, 63 nt, Homo Sapiens
ucacggcaaugagccuuuuuagagcccgaugccugcugcuauuaggaugugugaaaagcucac

SEQ ID NO: 692884 - RNA, 63 nt, Homo Sapiens
aaauuguccuuuuucuuucuguuuaaguugccaugcugcuagggcagaccuauuagaucugca

SEQ ID NO: 692885 - RNA, 63 nt, Homo Sapiens
aauagucauuugugaauuauugaaguuguguguugcugcuagaagagcuacuucauucuuuuc

SEQ ID NO: 692886 - RNA, 63 nt, Homo Sapiens; identical to SEQ ID NO: 423627

SEQ ID NO: 692887 - RNA, 63 nt, Homo Sapiens; identical to SEQ ID NO: 423628

SEQ ID NO: 692888 - RNA, 63 nt, Homo Sapiens
aguacugaaauguuuuguaaauuuuuuuuaaugugcugcuagguuuuuuguuuuguuuuguuc

SEQ ID NO: 692889 - RNA, 63 nt, Homo Sapiens
cuggaggaagaaugugccuucaggccacagucgugcugcuagaacagucucguagcugcaguu

SEQ ID NO: 692890 - RNA, 63 nt, Homo Sapiens
aguccacugaaagucucuaaggaaguauccucuugcugcuaaacuugguacaaguugacuacc

SEQ ID NO: 692891 - RNA, 63 nt, Homo Sapiens
guagaguuuuuaaacaucaaucuuuaaaccaauugcugcuacuuauauaauugccaaaaagug

SEQ ID NO: 692892 - RNA, 63 nt, Homo Sapiens
gcuuuucuaacaaauucccgcguauuuugccuuugcugcuacuuuuucuaguuagauuucaaa

SEQ ID NO: 692893 - RNA, 63 nt, Homo Sapiens
uaagucuguggaucugcugauguacagugccuuugcugcuauggaucaaaaucaaaagaaccg

SEQ ID NO: 692894 - RNA, 63 nt, Homo Sapiens
uuuuuaucacacagcuaaagucuguaguuaaguugcugcuacuuuugagucaauaacaucaag

SEQ ID NO: 692895 - RNA, 63 nt, Homo Sapiens
cuguucccccagaucuugccuugggaccacauuugcugcuacuuuuccugcugcucuauccua

SEQ ID NO: 692896 - RNA, 63 nt, Homo Sapiens; identical to SEQ ID NO: 423629

SEQ ID NO: 692897 - RNA, 63 nt, Homo Sapiens; identical to SEQ ID NO: 423630

SEQ ID NO: 692898 - RNA, 63 nt, Homo Sapiens
auuggauuggugugaucuuuaaaauucggagagugcugcuaaauuaugguuuucuuauucgug

SEQ ID NO: 692899 - RNA, 63 nt, Homo Sapiens
ugcuaucuuuaggugugugaugucugacuaacuugcugcuaaagaaaauauuuguguuuguuu

SEQ ID NO: 692900 - RNA, 63 nt, Homo Sapiens
aaugucuguaaaaaaaaaaacucuuauaaauagugcugcuauggaguuauaucuaauuuuuca

SEQ ID NO: 692901 - RNA, 63 nt, Homo Sapiens
ucaagcuccuccacuugaaacuccuacauguauugcugcuacuggaaucaccgacuacugaau

SEQ ID NO: 692902 - RNA, 63 nt, Homo Sapiens
aucccagcuccagccagcaccagauuuccacagugcugcuaauaggaggguccuggcacuacc

SEQ ID NO: 692903 - RNA, 63 nt, Homo Sapiens
ggccugccgccacgucagcaggagguggccgacugcugcuagcggccugugcugcccgccuca

SEQ ID NO: 692904 - RNA, 63 nt, Homo Sapiens
ucuagacaugaaaugucaccuuaacugagcacuugcugcuauuuucuccccuuuauugaccaa

SEQ ID NO: 692905 - RNA, 63 nt, Homo Sapiens
uacaguguaggcaccccggcuaguuaagcacuaugcugcuaguaagcagcauuucuuguuaac

SEQ ID NO: 692906 - RNA, 63 nt, Homo Sapiens
cauggaucagcucuuccuguguuuguaauuuaaugcugcuacaagauguuucuguuucuuaga

SEQ ID NO: 692907 - RNA, 63 nt, Homo Sapiens
agccaauccauucacaagcuuggcauugacaugugcugcuaguuuauaaacuggcauugacga

SEQ ID NO: 692908 - RNA, 63 nt, Homo Sapiens
ugugcuaccuggguccuuuucagaagugagcuuugcugcuacaggggaagguggccucugugg

SEQ ID NO: 692909 - RNA, 63 nt, Homo Sapiens
ucucaaguaacuaucaaauauuguaaaugcaauugcugcuaguucaguuacauuucugcugau

SEQ ID NO: 692910 - RNA, 63 nt, Homo Sapiens
cuuuauaaacuaugccuuccagacaauugauaaugcugcuauaauuaguauuauguugauaau

SEQ ID NO: 692911 - RNA, 63 nt, Homo Sapiens; identical to SEQ ID NO: 423631

SEQ ID NO: 692912 - RNA, 63 nt, Homo Sapiens; identical to SEQ ID NO: 423632

SEQ ID NO: 692913 - RNA, 63 nt, Homo Sapiens
caccacacccagcccggacagcuucuuugggagugcugcuaaccuugaaauuaucagacacuu

SEQ ID NO: 692914 - RNA, 63 nt, Homo Sapiens
accucccugguccuugcucuuguuaacccaagaugcugcuacacagaugccaaauggaaaucu

SEQ ID NO: 692915 - RNA, 63 nt, Homo Sapiens
auuugcuuuaagaaaacagucuugaauuucacaugcugcuauuuuuauauuuugccauuuuac

SEQ ID NO: 692916 - RNA, 63 nt, Homo Sapiens
ggcccgcugggcaccuggcaccuggccugcagaugcugcuacgagugaccagugcugugugga

SEQ ID NO: 692917 - RNA, 63 nt, Homo Sapiens
uguguucaugguuuccuuugucuggacaccuggugcugcuaauuacaaacaaaaaucuuugug

SEQ ID NO: 692918 - RNA, 63 nt, Homo Sapiens; identical to SEQ ID NO: 423633

SEQ ID NO: 692919 - RNA, 63 nt, Homo Sapiens; identical to SEQ ID NO: 423634

SEQ ID NO: 692920 - RNA, 63 nt, Homo Sapiens
auagauguuucauuuuucugccucacagccucuugcugcuaaagaugccuuuucuaccccauc

SEQ ID NO: 692921 - RNA, 63 nt, Homo Sapiens
aaaaugguauuauuaauacccugcaauagcuuuugcugcuauuuaguauuauguaaauuuaug

SEQ ID NO: 692922 - RNA, 63 nt, Homo Sapiens
uucugcauugagccuaguuuaaguauugcuuuuugcugcuaugcauucaugaaaaacguuuuu

SEQ ID NO: 692923 - RNA, 63 nt, Homo Sapiens
ugaugauucuguggagguauugccuugugaauuugcugcuauuuuaguuuugucuuugcugua

SEQ ID NO: 692924 - RNA, 63 nt, Homo Sapiens
augccuguauuuaugaagacagggccauugcacugcugcuaugcugaaaugaacuuuuauaaa

SEQ ID NO: 692925 - RNA, 63 nt, Homo Sapiens
gcuuuuuuuuaaaaggaaaagauaccaaaugccugcugcuaccacccuuuucaauugcuaucu

SEQ ID NO: 692926 - RNA, 63 nt, Homo Sapiens
acauuagccagggagguucuggcuaacguuaaaugcugcuauacaacugcuuugcaacaguug

SEQ ID NO: 692927 - RNA, 63 nt, Homo Sapiens
gggcagagcaucugugggguggggucuuccccuugcugcuauuguauggcuggggacuggucu

SEQ ID NO: 692928 - RNA, 63 nt, Homo Sapiens; identical to SEQ ID NO: 423635

SEQ ID NO: 692929 - RNA, 63 nt, Homo Sapiens; identical to SEQ ID NO: 423636

SEQ ID NO: 692930 - RNA, 63 nt, Homo Sapiens
gggcuuggcugagagaguggcauuggcagcaggugcugcuacccucccugcuguccccucuug

SEQ ID NO: 692931 - RNA, 63 nt, Homo Sapiens
aauccuauuaggcaagucaguugaaaaugcucgugcugcuaauggaauuagagugcguucauu

SEQ ID NO: 692932 - RNA, 63 nt, Homo Sapiens
cacaucgcuucuguguaucucuuucacauuguuugcugcuauuggaggaucaguuuuuuguuu

SEQ ID NO: 692933 - RNA, 63 nt, Homo Sapiens
aguuaagacuuguucuuugagugauguauuaaaugcugcuagaaaagccucauuacauuaaau

SEQ ID NO: 692934 - RNA, 63 nt, Homo Sapiens
uagauguacaacacugacucaucauaaauguggugcugcuauucgacaaaccaguuuuagcag

SEQ ID NO: 692935 - RNA, 63 nt, Homo Sapiens
ccuuaggcuauuccaccucucgaucacaagagcugcugcuauaacuuccaguuuuacaucuuu

SEQ ID NO: 692936 - RNA, 63 nt, Homo Sapiens
gccuuuuaauuuauugaaauguuucaugacuacugcugcuagcucuucaagccagguucaugc

SEQ ID NO: 692937 - RNA, 63 nt, Homo Sapiens
agcuccuugaaaauccaggcggguauggaaaggugcugcuacccauaucuuuuugacuuucuu

SEQ ID NO: 692938 - RNA, 63 nt, Homo Sapiens
agagggucaggguuggaggccugugcuuguguuugcugcuaauguccagcuacagacccagag

SEQ ID NO: 692939 - RNA, 63 nt, Homo Sapiens
cuugguagccccucgaggcagaugcaccugacuugcugcuauuaaaaagccgugugccuucua

SEQ ID NO: 692940 - RNA, 63 nt, Homo Sapiens
ggaggaacaaguaaaaaccaaaugguuacauugugcugcuagaaauaaugucauucucaauua

SEQ ID NO: 692941 - RNA, 63 nt, Homo Sapiens
accaucggcucuggggaauccuggugaauauagugcugcuauguugacauuauucuuccuaga

SEQ ID NO: 692942 - RNA, 63 nt, Homo Sapiens
cgcaagcucaagagaucccaaaggggacaccaaugcugcuaucacaggcacucauugcuacug

SEQ ID NO: 692943 - RNA, 63 nt, Homo Sapiens
uucccaauguauugauuaaacuugccauuaacuugcugcuaaaaauaggagauuuuguaacug

SEQ ID NO: 692944 - RNA, 63 nt, Homo Sapiens
ucaaagcucuauuaagauuugggcaacaauacaugcugcuaauguucugcucuagacagugua

SEQ ID NO: 692945 - RNA, 63 nt, Homo Sapiens
gcugaggccuggaucccggccaccucuuccagcugcugcuacaguauugugaccgugcggcuc

SEQ ID NO: 692946 - RNA, 63 nt, Homo Sapiens
gucuguugccaaggucaacccaggacaacugccugcugcuagggacagggaccgcccucuugu

SEQ ID NO: 692947 - RNA, 63 nt, Homo Sapiens
aguacuuuuuuccacauuuuuuguucuaugagcugcugcuaucgcuguaguuuaauggauaag

SEQ ID NO: 692948 - RNA, 63 nt, Homo Sapiens
uuuuaaaguuguuugguuuuuacuugcagaaacugcugcuaacguaauaaauguguauuuuug

SEQ ID NO: 692949 - RNA, 63 nt, Homo Sapiens
gugugauguugacgccuaacuguggcugcaucuugcugcuaauugucauucagaaaccugaag

SEQ ID NO: 692950 - RNA, 63 nt, Homo Sapiens
ucuuagccagaacuugaagucccgggcauccgcugcugcuacacuggcuuuccacuuuggaug

SEQ ID NO: 692951 - RNA, 63 nt, Homo Sapiens
ucuaauucugaugaugacucauugccuguuaauugcugcuaauccgccucacuguggcagugu

SEQ ID NO: 692952 - RNA, 63 nt, Homo Sapiens
guagcucaauauuuuacaggguaaugucauauuugcugcuacaaaauaaaauuuuguuuuucu

SEQ ID NO: 692953 - RNA, 63 nt, Homo Sapiens
ugacaguaccuagcuguaauguuucacagagugugcugcuauuuuauaaacauuuuuauaaua

SEQ ID NO: 692954 - RNA, 63 nt, Homo Sapiens
cguaaucucaagguuauuauucugacaccagcuugcugcuaugauuucagagcacauaaguaa

SEQ ID NO: 692955 - RNA, 63 nt, Homo Sapiens
ucucuuuguacucuguaucuauauaucaaaagcugcugcuaugucucucuucugucuuauucu

SEQ ID NO: 692956 - RNA, 63 nt, Homo Sapiens
uuacaacgaauuuacagucuaguacuuauuacaugcugcuauacacaagcaaugcaagaaaaa

SEQ ID NO: 692957 - RNA, 63 nt, Homo Sapiens
cagaaccuggaacagggacuuucacuugaaucuugcugcuaaauguaaaugccuucucaaaug

SEQ ID NO: 692958 - RNA, 63 nt, Homo Sapiens
gaagaacuucccaaaacuucgauguccccaaacugcugcuauuauaucgacagggcuacacgu

SEQ ID NO: 692959 - RNA, 63 nt, Homo Sapiens
ugauuucuuucucaucccacgacugcuucugaaugcugcuacucuuuaucaggaugaacccag

SEQ ID NO: 692960 - RNA, 63 nt, Homo Sapiens
uaauuccuuucucaucccacggacgcuucugaaugcugcuacuaccucaucaggaugaaccca

SEQ ID NO: 692961 - RNA, 63 nt, Homo Sapiens
aagacacaugcacacauaugggauuacaaaucaugcugcuauauuacuggguagauacccaaa

SEQ ID NO: 692962 - RNA, 63 nt, Homo Sapiens
auccauucccuuucauaccaguuauugaagcagugcugcuaacauuucauccagaauagauca

SEQ ID NO: 692963 - RNA, 63 nt, Homo Sapiens
guauaaaguagcacaugucauaaauauaguuuaugcugcuauuaguucauacuuaccuaaaau

SEQ ID NO: 692964 - RNA, 63 nt, Homo Sapiens
uauauuuuaaauauacuaugcuaauuuuuuauaugcugcuaaaaguauuuccuucccuuuuau

SEQ ID NO: 692965 - RNA, 63 nt, Homo Sapiens; identical to SEQ ID NO: 423637

SEQ ID NO: 692966 - RNA, 63 nt, Homo Sapiens; identical to SEQ ID NO: 423638

SEQ ID NO: 692967 - RNA, 63 nt, Homo Sapiens
gcuaacagccaauuuuauagggccaggacaugcugcugcuacuuggagaaaucuacuccccuu

SEQ ID NO: 692968 - RNA, 63 nt, Homo Sapiens
guugcaagugauugauaaugguuaccagaaucuugcugcuaaaaagugcuauuaccuuucuca

SEQ ID NO: 692969 - RNA, 63 nt, Homo Sapiens
uaacuacugucuguuuauuuauugcggaaucauugcugcuaaaagaaacacagugcauuauuu

SEQ ID NO: 692970 - RNA, 63 nt, Homo Sapiens
guauuuauggaaugaauguaggugggaagguuuugcugcuaaugggcuggaguagaggacucu

SEQ ID NO: 692971 - RNA, 63 nt, Homo Sapiens
acugcuaaaaaaaaaaaaaacaagagugauucuugcugcuauuucagcuagcaaaagaaguaa

SEQ ID NO: 692972 - RNA, 63 nt, Homo Sapiens
uuccaagagaacgggacuccgcaccuuugcugcugcugcuaucuaaagucuagagaggacauu

SEQ ID NO: 692973 - RNA, 63 nt, Homo Sapiens
aagcaaucgggauaaaacagcauuagauagucaugcugcuagaucuuuauuauggaaaacauu

SEQ ID NO: 692974 - RNA, 63 nt, Homo Sapiens
uuucugugaucucugaggucuauuuuauguuuuugcugcuacuucuguggaaguagcuuugaa

SEQ ID NO: 692975 - RNA, 63 nt, Homo Sapiens
uugucugaccacauucuuuuuguauccaaauagugcugcuagaaacugcacugaaguggcuga

SEQ ID NO: 692976 - RNA, 63 nt, Homo Sapiens
cauaguuagaagaauauauuuauaaagauuccuugcugcuaagucagaucagauuugcuaaca

SEQ ID NO: 692977 - RNA, 63 nt, Homo Sapiens
ucuucuggacagaccacaacucuaagaagcuagugcugcuaucucauauaugaguauuaaaua

SEQ ID NO: 692978 - RNA, 63 nt, Homo Sapiens
accaaggugugaacaugcccgcugugcagaaccugcugcuaacaucucuccacuguccuguaa

SEQ ID NO: 692979 - RNA, 63 nt, Homo Sapiens; identical to SEQ ID NO: 423639

SEQ ID NO: 692980 - RNA, 63 nt, Homo Sapiens; identical to SEQ ID NO: 423640

SEQ ID NO: 692981 - RNA, 63 nt, Homo Sapiens
gugggaggagaaagaugucuguccucuucuccuugcugcuagaaaggcucuuaaagagcaaau

SEQ ID NO: 692982 - RNA, 63 nt, Homo Sapiens
gugguuguauuagagaacugcuucuucuauuuuugcugcuauggauguggcuuaacaaucaga

SEQ ID NO: 692983 - RNA, 63 nt, Homo Sapiens
cuguucauugaugacaugggcaaguggaaaccuugcugcuaugucuaaauuaacuucuauuuu

SEQ ID NO: 692984 - RNA, 63 nt, Homo Sapiens
aauuuuguucuuguugcugcuucagcuuccauuugcugcuauagugcaaagccagcaugcgag

SEQ ID NO: 692985 - RNA, 63 nt, Homo Sapiens
aacaauagaauaugcauuuguuugacccuggacugcugcuauguuuuuauuauugcauuuuau

SEQ ID NO: 692986 - RNA, 63 nt, Homo Sapiens
agaauguccagcuaccaugguuuagauggaauuugcugcuauacuuguugaauucuuacaguu

SEQ ID NO: 692987 - RNA, 63 nt, Homo Sapiens
ccaguggggacccacacccuggcugggcagaggugcugcuagcaaccucucuuccucuauaag

SEQ ID NO: 692988 - RNA, 63 nt, Homo Sapiens
aauacagugucugaguuuucaucggucuucacaugcugcuauauauuccacagaguuccuugc

SEQ ID NO: 692989 - RNA, 63 nt, Homo Sapiens
ucuaauccccuaccaaugccaucccagccugacugcugcuacagaugucccccaggcaucuug

SEQ ID NO: 692990 - RNA, 63 nt, Homo Sapiens
auaccacgccuuaaaaauugucuuauuugcugaugcugcuauggguagaaaugaugucagcau

SEQ ID NO: 692991 - RNA, 63 nt, Homo Sapiens
acgaggacagccggcugcugggccgcccagcacugcugcuaugucuggggagagcagcacacu

SEQ ID NO: 692992 - RNA, 63 nt, Homo Sapiens
acugagguagcucucuucaugaccucgaagccuugcugcuaacggagugguuugaguaguaca

SEQ ID NO: 692993 - RNA, 63 nt, Homo Sapiens
uuagaacuuuuauagccuaauauaaacauccuuugcugcuacaucuuaaaaguauauuuuuuc

SEQ ID NO: 692994 - RNA, 63 nt, Homo Sapiens; identical to SEQ ID NO: 423641

SEQ ID NO: 692995 - RNA, 63 nt, Homo Sapiens; identical to SEQ ID NO: 423642

SEQ ID NO: 692996 - RNA, 63 nt, Homo Sapiens
aaugccagaauguaagaguugcaagugauuuugugcugcuauucauuaaaacuuguauuccag

SEQ ID NO: 692997 - RNA, 63 nt, Homo Sapiens
auccuucacaggcagugcaugugaagcaugcuuugcugcuaugaaaaugagcaucagagagug

SEQ ID NO: 692998 - RNA, 63 nt, Homo Sapiens
cuggucugaauuucuuaagguuuuauaaacaaaugcugcuauuuauuagcugcaagaaugcac

SEQ ID NO: 692999 - RNA, 63 nt, Homo Sapiens
uugauccccuaacucacugucugcggugcucauugcugcuaacagcauugccugugcucuccu

SEQ ID NO: 693000 - RNA, 63 nt, Homo Sapiens
uucuuaagcagaaaauauuguugagguuaccuuugcugcuaaagauccaaucuucuaacgcca

SEQ ID NO: 693001 - RNA, 63 nt, Homo Sapiens
uagaagacagauggaguucuccccugaacuccuugcugcuaagaagugcugagaaguuacucg

SEQ ID NO: 693002 - RNA, 63 nt, Homo Sapiens
cacguaguuccacuucguuuaauuauucagcucugcugcuaaauaguaauuguuuauauucau

SEQ ID NO: 693003 - RNA, 63 nt, Homo Sapiens
aaaguaaggcccauuacuguguaugcuuguuccugcugcuaaucacacuugcaauugugucug

SEQ ID NO: 693004 - RNA, 63 nt, Homo Sapiens
guggaauauacguguguagauagcaguagugugugcugcuauugagacugacagcuuugcagg

SEQ ID NO: 693005 - RNA, 63 nt, Homo Sapiens
ugaaguaauuaguacagcuguauuuuccuugucugcugcuauuaacuuaagcaagcaagcgug

SEQ ID NO: 693006 - RNA, 63 nt, Homo Sapiens
augcgagcaggaagaggcaugaaguacaacccaugcugcuaaguauuucucuuuucuguuuau

SEQ ID NO: 693007 - RNA, 63 nt, Homo Sapiens
agcgccucucacacagguaaugcccagcuuuucugcugcuaacacauuuggccaguuguugca

SEQ ID NO: 693008 - RNA, 63 nt, Homo Sapiens
agccuugucuguaucugggcagcagguguuccaugcugcuagguggcgggggucgggggucuu

SEQ ID NO: 693009 - RNA, 63 nt, Homo Sapiens
uucccaacugggggugguuaaagggagccccacugcugcuaccuggggaauggggcaccuggg

SEQ ID NO: 693010 - RNA, 63 nt, Homo Sapiens
uuguaaauuaaaaucuuacaaacuaaaucagugugcugcuagaggguucuuuuucacuugaca

SEQ ID NO: 693011 - RNA, 63 nt, Homo Sapiens
cccugccagaaaugacccgcccucaaugcuggcugcugcuaacauuaaugagaagguggccuu

SEQ ID NO: 693012 - RNA, 63 nt, Homo Sapiens
acagauuuaacauuuucuguuauauauaaauuaugcugcuauuuuucaaaaccagcuuuuuuc

SEQ ID NO: 693013 - RNA, 63 nt, Homo Sapiens
uggguucaggcuucacccacucuaggcuuugcgugcugcuagcgguaccaggaaagaggauau

SEQ ID NO: 693014 - RNA, 63 nt, Homo Sapiens
gauuuguccccgacagcaggggccccaaagcuuugcugcuauuguauguauggaguggguugg

SEQ ID NO: 693015 - RNA, 63 nt, Homo Sapiens
uuguuauuuuguuugcacuuaugcaacagauaaugcugcuagaagaauuggucuuuccuaaaa

SEQ ID NO: 693016 - RNA, 63 nt, Homo Sapiens
agaaauugauuugcauaguccccaguugcucagugcugcuaguggggugcguacuagcacgug

SEQ ID NO: 693017 - RNA, 63 nt, Homo Sapiens
gccccucuccgaaagaagacaccaauuagucacugcugcuacucgccugaccugggggagccg

SEQ ID NO: 693018 - RNA, 63 nt, Homo Sapiens
acaaaaacuauggaaaauaucuuuguucuuguuugcugcuauuuucuguccuauuuugagaaa

SEQ ID NO: 693019 - RNA, 63 nt, Homo Sapiens
ucuaucuugaauuucaugcuuuccuaaagucucugcugcuaaggcucuauuuccucccccagu

SEQ ID NO: 693020 - RNA, 63 nt, Homo Sapiens
acuugagugugcaagcaaagaacccauuugccaugcugcuaugaagacuacuuuuagaucaac

SEQ ID NO: 693021 - RNA, 63 nt, Homo Sapiens
ugcuucagucaccucccaccucuugccaccugcugcugcuaucuguccuuacuugugggcuuc

SEQ ID NO: 693022 - RNA, 63 nt, Homo Sapiens
gccacccgugggaaugcugcccgcucugcagacugcugcuagagccagcaacuccacuaaggu

SEQ ID NO: 693023 - RNA, 63 nt, Homo Sapiens
gccaggaaacaauaggaaccaaaagccucugccugcugcuauugcaauucccaggaucucucc

SEQ ID NO: 693024 - RNA, 63 nt, Homo Sapiens
aggagggauugaaaggcaucccaguucuaaggcugcugcuaauuacagcccccaaccuccaac

SEQ ID NO: 693025 - RNA, 63 nt, Homo Sapiens
auguuuuuuacucucaggggaaaguuggggacaugcugcuacaauacggcuaaucuuucauug

SEQ ID NO: 693026 - RNA, 63 nt, Homo Sapiens
ugaaguuuuccuugcuauuucaauaacagauggugcugcuaauucccaacauuucuuaaauua

SEQ ID NO: 693027 - RNA, 63 nt, Homo Sapiens
ggagcaaauguccuaacagagaaauagaggugaugcugcuaaagggagaaaugccaggcggac

SEQ ID NO: 693028 - RNA, 63 nt, Homo Sapiens
ucuugacagugagaggauauugagggcuucagcugcugcuauuaugauguuuugcaaaggaaa

SEQ ID NO: 693029 - RNA, 63 nt, Homo Sapiens
acuugucacaccugucuuaauaaacuggaguuuugcugcuaaagaacucuucucucugggggc

SEQ ID NO: 693030 - RNA, 63 nt, Homo Sapiens
gcugucuggugagguggccccuucgugugcugcugcugcuauuucucccccgcccugccccgc

SEQ ID NO: 693031 - RNA, 63 nt, Homo Sapiens
uuacugucuuaauuaaguaaaugucuugguacuugcugcuauuuuaaauaaaagaaaugcaca

SEQ ID NO: 693032 - RNA, 63 nt, Homo Sapiens
aguuugcuaaagugucaugaaguucuuucugcuugcugcuaagaaagaaaggauauuuuaaua

SEQ ID NO: 693033 - RNA, 63 nt, Homo Sapiens
aacucaaaaaucccaacagcagguggucucuucugcugcuagcucucugcaggcugucucuca

SEQ ID NO: 693034 - RNA, 63 nt, Homo Sapiens
gaagaagcauuagggguaugcaggcaagcauuaugcugcuauuaaguucuggcuuagcagcug

SEQ ID NO: 693035 - RNA, 63 nt, Homo Sapiens
cuucagggcacugcugcugccugcugcugcugcugcugcuaauccuccacuccuuccugccac

SEQ ID NO: 693036 - RNA, 63 nt, Homo Sapiens
cuugcaacuaauuuuuuuaacacuuaauugcuuugcugcuagauuuaauauuaaauauguucu

SEQ ID NO: 693037 - RNA, 53 nt, Homo Sapiens; identical to SEQ ID NO: 423966

SEQ ID NO: 693038 - RNA, 63 nt, Homo Sapiens
agaaaugucuaaacuauaaggcucucuagaaacugcugcuacuuuuguuaaaaggcuacacga

SEQ ID NO: 693039 - RNA, 63 nt, Homo Sapiens
aguacaagugugugauguuagaaccucccuaguugcugcuauaucaaacacugcacacuugac

SEQ ID NO: 693040 - RNA, 63 nt, Homo Sapiens
cgcacggccuuggagcaggaggugggucuggcaugcugcuaugucucaaaagaggucauccgg

SEQ ID NO: 693041 - RNA, 63 nt, Homo Sapiens
gaacauaaaagaaagagaaucucagaaguaguuugcugcuaauauauacauauauuguauaaa

SEQ ID NO: 693042 - RNA, 63 nt, Homo Sapiens
auuccauacagugaaggaaauuugagucuguauugcugcuacaaggguaaaaccaggaccaau

SEQ ID NO: 693043 - RNA, 63 nt, Homo Sapiens
gcaguccugggcuuagcuucugcccagcuuuauugcugcuauuggcaaagagcacaggacuca

SEQ ID NO: 693044 - RNA, 63 nt, Homo Sapiens
ugauugauaaagggaauguugcauuugggacuaugcugcuaacgaaaugguuugaaguauuuu

SEQ ID NO: 693045 - RNA, 63 nt, Homo Sapiens
aauucuccucaaugccccccccgcccaguccuuugcugcuauccacugugauuuuuaugcauu

SEQ ID NO: 693046 - RNA, 63 nt, Homo Sapiens
auuuuccuccugagugcuugcuucaaacuacuuugcugcuaaucgugagcugagcaggccaca

SEQ ID NO: 693047 - RNA, 63 nt, Homo Sapiens
cugccaaaaucauuuuaaugauauccaauccugugcugcuaucgucaaagugaugaauaugga

SEQ ID NO: 693048 - RNA, 63 nt, Homo Sapiens
ugggacccaauuuuuggccuaauuugaacagcuugcugcuaaagaagaagacuguuuccaaau

SEQ ID NO: 693049 - RNA, 63 nt, Homo Sapiens
ccccaccgcccaccaccuccuccccuucauuccugcugcuaccccuggucccgagggcuggga

SEQ ID NO: 693050 - RNA, 63 nt, Homo Sapiens
gguggccccguggggguagcucacucccccuccugcugcuaugccugugacccccgcggccca

SEQ ID NO: 693051 - RNA, 63 nt, Homo Sapiens
uacuccugacuuguaauaagaagacaucagagaugcugcuaagucggcuccagcacacaggag

SEQ ID NO: 693052 - RNA, 63 nt, Homo Sapiens; identical to SEQ ID NO: 423643

SEQ ID NO: 693053 - RNA, 63 nt, Homo Sapiens; identical to SEQ ID NO: 423644

SEQ ID NO: 693054 - RNA, 63 nt, Homo Sapiens
ucugucccacggcccacacgcucacuugacucaugcugcuaagaugcacaaccgcacacccau

SEQ ID NO: 693055 - RNA, 63 nt, Homo Sapiens
ugggcuacuuccaccuuuugccuauugaaauaaugcugcuaugaagaugaguguacaaguguc

SEQ ID NO: 693056 - RNA, 63 nt, Homo Sapiens
aagccccucccuucucccgggagggacccuuuuugcugcuagaaggggacagguagguggcug

SEQ ID NO: 693057 - RNA, 63 nt, Homo Sapiens
ggacccaaaaggaacguguccucagguugugagugcugcuauuagaucaaguguaucugaacu

SEQ ID NO: 693058 - RNA, 63 nt, Homo Sapiens
ugucaccuagagucacacacaggcaaccaguccugcugcuacccuugggucccacugucacca

SEQ ID NO: 693059 - RNA, 63 nt, Homo Sapiens
cagcuggggugggugaggccccuugacuggaauugcugcuaccgcucccauccucaucucucu

SEQ ID NO: 693060 - RNA, 63 nt, Homo Sapiens
gacgaccuccagcucucaguaacacucucacuaugcugcuaugcucugcauacccucaucaaa

SEQ ID NO: 693061 - RNA, 63 nt, Homo Sapiens
aacgccagaauaaacacacuguccccccacugcugcugcuauccacaccccugcgucuggccg

SEQ ID NO: 693062 - RNA, 63 nt, Homo Sapiens
ggaccugggauugccugggagaaccccaccagcugcugcuacacucugcacggcauggagugg

SEQ ID NO: 693063 - RNA, 63 nt, Homo Sapiens
agcugcucagugcaguggccacauggucaccacugcugcuaccgccaacccaccccccagucc

SEQ ID NO: 693064 - RNA, 63 nt, Homo Sapiens
ugacagggcuggggccacagucuacucugucucugcugcuagagaagccaccuguggaggacu

SEQ ID NO: 693065 - RNA, 63 nt, Homo Sapiens
ugaaagcaaacuucacaauaauggacguagacuugcugcuaugaaaacauauuuuuuuuauuu

SEQ ID NO: 693066 - RNA, 63 nt, Homo Sapiens
cauuuauacuucuccagacccccugccauccucugcugcuacccacacaggcagaauaaaagg

SEQ ID NO: 693067 - RNA, 63 nt, Homo Sapiens
gcugugcugauagugcugagggagauaggaauuugcugcuaagauuuuucuuugggguggagu

SEQ ID NO: 693068 - RNA, 63 nt, Homo Sapiens
aguggagccugccggcgcaucugaggggcagaaugcugcuagcacuugaaucugggaucucgc

SEQ ID NO: 693069 - RNA, 63 nt, Homo Sapiens
caaaucuuuuggaaagaauugaaaauguaaaauugcugcuaguacacucgggaaaugaguaaa

SEQ ID NO: 693070 - RNA, 63 nt, Homo Sapiens
acacuacaaaacaaucaaauugucaccaucaccugcugcuagggcugaacccucucaaagggc

SEQ ID NO: 693071 - RNA, 63 nt, Homo Sapiens
aggaauuaagcguuguaguauauagaagagaaaugcugcuagaaaaggcaguggcaaguaagu

SEQ ID NO: 693072 - RNA, 63 nt, Homo Sapiens
acuggaggcgguguuccuaagggcuccugccuuugcugcuaaccuccuggacgggcuggagcu

SEQ ID NO: 693073 - RNA, 63 nt, Homo Sapiens
aacccuugccuuccugucacaggguuugcuuguugcugcuauaguuuuuaacuuuuuuuuauu

SEQ ID NO: 693074 - RNA, 63 nt, Homo Sapiens
agcagaaacucaauuguuucuuccaguuuaguuugcugcuauuaacugccauaaauuuucuag

SEQ ID NO: 693075 - RNA, 63 nt, Homo Sapiens
cugcacagacaagacacucaguguccuuggcagugcugcuacuccucaggugcagcauacaua

SEQ ID NO: 693076 - RNA, 63 nt, Homo Sapiens
ucacucucuggcugcugggucugccgucgguccugcugcuaaccuggcaccagagccucugcc

SEQ ID NO: 693077 - RNA, 63 nt, Homo Sapiens
ccagagccugggcccaaagcauuguuucacgcaugcugcuaacggcgcucaugauuguuucug

SEQ ID NO: 693078 - RNA, 63 nt, Homo Sapiens
ggccaggggcccugaccaggaccaggauuggccugcugcuaggggcacagaacccugugcccc

SEQ ID NO: 693079 - RNA, 63 nt, Homo Sapiens
aacagcaaaccaucuagauuugaacaggugcucugcugcuagagggugcauauacguagaguc

SEQ ID NO: 693080 - RNA, 63 nt, Homo Sapiens
ggcuuccaaacauugccugccccacagugaugcugcugcuaagggauggagacaguggcagcu

SEQ ID NO: 693081 - RNA, 63 nt, Homo Sapiens
gauucagggucugucuuggaaauaugggaaaguugcugcuauucuccacauaucccuacauga

SEQ ID NO: 693082 - RNA, 63 nt, Homo Sapiens
gucagcguccuuauuuauugguucuugaaguuuugcugcuauguuacugaaucauacuaaaga

SEQ ID NO: 693083 - RNA, 63 nt, Homo Sapiens
cacucugaauucuuacuugauggagguuuuguuugcugcuacgguuuuaaucauccagggugc

SEQ ID NO: 693084 - RNA, 63 nt, Homo Sapiens
cuauuugcacacgacagauuucuagauacuuuuugcugcuaguuuuauguaauauuuauugaa

SEQ ID NO: 693085 - RNA, 63 nt, Homo Sapiens
uacucucucagauggcucaucauaggggaaaccugcugcuacaucaugagauagcccugugga

SEQ ID NO: 693086 - RNA, 63 nt, Homo Sapiens
ucuuuuggcccuccgcccccgcaggcuucugugugcugcuaacuguauuuauugugaugccuu

SEQ ID NO: 693087 - RNA, 63 nt, Homo Sapiens
ugagggaagcaauagguagcuggggagcccuauugcugcuaagucauuggcaaagugacaaag

SEQ ID NO: 693088 - RNA, 63 nt, Homo Sapiens; identical to SEQ ID NO: 423645

SEQ ID NO: 693089 - RNA, 63 nt, Homo Sapiens; identical to SEQ ID NO: 423646

SEQ ID NO: 693090 - RNA, 63 nt, Homo Sapiens
ucuuuaauucuugucauccaggucaacauaugaugcugcuauaagucuggggcucaaauugau

SEQ ID NO: 693091 - RNA, 63 nt, Homo Sapiens
agaaggcaaagcugccaguaaaugucucagcauugcugcuaauuuugguccugcuaguuucug

SEQ ID NO: 693092 - RNA, 63 nt, Homo Sapiens
aacauuuguguauaaguuuucuauuaugaauaaugcugcuauguuuggguuuccacucuuuag

SEQ ID NO: 693093 - RNA, 63 nt, Homo Sapiens
aaugccacgauuuagauuuaacauucagcuuccugcugcuagcugauugauugauugauugau

SEQ ID NO: 693094 - RNA, 63 nt, Homo Sapiens
gguuaccgauuucaaagucccuaagguugccauugcugcuaaauuuuaccuugucauuuuggu

SEQ ID NO: 693095 - RNA, 63 nt, Homo Sapiens
ugcagcuggauacucuucuuuuuuuuuuuuaacugcugcuaucccaucccccgccuuuuuuuu

SEQ ID NO: 693096 - RNA, 63 nt, Homo Sapiens
caagaaaucuaauggaaugagaauuuggaaccaugcugcuaccccaucacuaaaggccaauca

SEQ ID NO: 693097 - RNA, 63 nt, Homo Sapiens
ucuuugcaaaaauccaaauaacuuaagguugggugcugcuaauuuuagaaacacauaauuaac

SEQ ID NO: 693098 - RNA, 63 nt, Homo Sapiens
uuuacaaacaagcccauuguugaaaccucucgcugcugcuagguggggccccugacugcaaug

SEQ ID NO: 693099 - RNA, 63 nt, Homo Sapiens
gcugcugcugcugcugcugcccuuuaccuaugcugcugcuaaccuauccaccucccccaagcc

SEQ ID NO: 693100 - RNA, 63 nt, Homo Sapiens
uuugguccugcuaguuucugaaugucucagcauugcugcuaauagaaggcaaagcugccagua

SEQ ID NO: 693101 - RNA, 63 nt, Homo Sapiens
acccgagcccagcuacauucgcccgccccucgcugcugcuacucccgggcucuggccacccug

SEQ ID NO: 693102 - RNA, 63 nt, Homo Sapiens
cuccagaggaguacgccgacuucagcagcuuccugcugcuagucgaugcagcaguacaaacgg

SEQ ID NO: 693103 - RNA, 63 nt, Homo Sapiens
acuauuugcacacaacagauuuuagauacuuuuugcugcuaguuguguaauauuuauugaaca

SEQ ID NO: 693104 - RNA, 63 nt, Homo Sapiens
aagcugcaguggugauggcaggcuccuaaagacugcugcuaaaagacacaagaauuauacagu

SEQ ID NO: 693105 - RNA, 64 nt, Homo Sapiens; identical to SEQ ID NO: 223137

SEQ ID NO: 693106 - RNA, 64 nt, Homo Sapiens; identical to SEQ ID NO: 223138

SEQ ID NO: 693107 - RNA, 64 nt, Homo Sapiens; identical to SEQ ID NO: 223139

SEQ ID NO: 693108 - RNA, 64 nt, Homo Sapiens; identical to SEQ ID NO: 223140

SEQ ID NO: 693109 - RNA, 64 nt, Homo Sapiens; identical to SEQ ID NO: 223141

SEQ ID NO: 693110 - RNA, 64 nt, Homo Sapiens; identical to SEQ ID NO: 223142

SEQ ID NO: 693111 - RNA, 64 nt, Homo Sapiens; identical to SEQ ID NO: 223143

SEQ ID NO: 693112 - RNA, 64 nt, Homo Sapiens; identical to SEQ ID NO: 223144

SEQ ID NO: 693113 - RNA, 64 nt, Homo Sapiens; identical to SEQ ID NO: 208878

SEQ ID NO: 693114 - RNA, 64 nt, Homo Sapiens; identical to SEQ ID NO: 208879

SEQ ID NO: 693115 - RNA, 64 nt, Homo Sapiens; identical to SEQ ID NO: 208880

SEQ ID NO: 693116 - RNA, 64 nt, Homo Sapiens; identical to SEQ ID NO: 208881

SEQ ID NO: 693117 - RNA, 64 nt, Homo Sapiens
uauuugugcuugaagguguuuuugauauuuggaaacaguauaagccauuuggagucaugauugg

SEQ ID NO: 693118 - RNA, 64 nt, Homo Sapiens
auugcacugaaugauauauuauuagggcauguuaacaguauaccaguaacagcacuuuaucuca

SEQ ID NO: 693119 - RNA, 64 nt, Homo Sapiens
aacccuaaaaccuagauguuguacaguauaugaaacaguauauugggggcaaugaugaaacuuu

SEQ ID NO: 693120 - RNA, 64 nt, Homo Sapiens
aaacaguauauuaacccuaaugaugaaacuuuguacaguauaugaauuccaagguugggggcaa

SEQ ID NO: 693121 - RNA, 64 nt, Homo Sapiens
ucuguauaacuugugauuccagggcuguuugucaacaguauacaaaagaauugugccucuccca

SEQ ID NO: 693122 - RNA, 64 nt, Homo Sapiens
gggacaacucuguggccugggggacaucugugucacaguauaggauugccauucagguguuuug

SEQ ID NO: 693123 - RNA, 64 nt, Homo Sapiens
acuaacaaccaaagacuacacaucucacagguagacaguauauaucugugacccacuuaccuug

SEQ ID NO: 693124 - RNA, 64 nt, Homo Sapiens
ucccuguuucuuccacagugugagggcaagagccacaguauauucaaccagauugucagcuccu

SEQ ID NO: 693125 - RNA, 64 nt, Homo Sapiens
cuauugcacgucuacaauucucagaugagagggaacaguauauuuucuuuuuuuccuagagccu

SEQ ID NO: 693126 - RNA, 64 nt, Homo Sapiens
cuuuuuuuccuagagccuucaaauuuuuaaaagaacaguauauucccaugaccaccauucacuu

SEQ ID NO: 693127 - RNA, 64 nt, Homo Sapiens
uaaugagaacaccuuugcccugaagucaguucucacaguauagaagagaacuuaaagagggaaa

SEQ ID NO: 693128 - RNA, 64 nt, Homo Sapiens
agcaugauacuggcauaacaacagacacauaggaacaguauagacaacccagaaacaaauucau

SEQ ID NO: 693129 - RNA, 64 nt, Homo Sapiens
cauauauauauuuucacuugauauguguguauauacaguauauauauauuaaaacaguauauac

SEQ ID NO: 693130 - RNA, 64 nt, Homo Sapiens
cauauguguguauauacaguguuaauauauuaaaacaguauauaauauauauacauauauauuu

SEQ ID NO: 693131 - RNA, 64 nt, Homo Sapiens
ucuccauaguuuaaaaucgaauagugccaucaucacaguauauuagucaaauagaagcuucauc

SEQ ID NO: 693132 - RNA, 64 nt, Homo Sapiens
uaacuaaaacaugaaaaguaaaccuccagcuuccacaguauauuaccugccguugcaugcauuu

SEQ ID NO: 693133 - RNA, 64 nt, Homo Sapiens
auaaucacaucaggguaaauuuugauacaagaauacaguauauaucaugcaauauauggcauau

SEQ ID NO: 693134 - RNA, 64 nt, Homo Sapiens
auuugguaacauaauggauucguaaaacaugguaacaguauacuccaccuuacucaagggugua

SEQ ID NO: 693135 - RNA, 64 nt, Homo Sapiens
accuuaacucaccccucagcaaauaccuaugucaacaguauaaguuaccauuuacucuauaauc

SEQ ID NO: 693136 - RNA, 64 nt, Homo Sapiens
auauauaguuaugcauacauacacacacacacauacaguauauucuuuccucaaaaggguuaag

SEQ ID NO: 693137 - RNA, 64 nt, Homo Sapiens; identical to SEQ ID NO: 84807

SEQ ID NO: 693138 - RNA, 64 nt, Homo Sapiens; identical to SEQ ID NO: 84808

SEQ ID NO: 693139 - RNA, 64 nt, Homo Sapiens; identical to SEQ ID NO: 539759

SEQ ID NO: 693140 - RNA, 64 nt, Homo Sapiens; identical to SEQ ID NO: 539760

SEQ ID NO: 693141 - RNA, 64 nt, Homo Sapiens; identical to SEQ ID NO: 539761

SEQ ID NO: 693142 - RNA, 64 nt, Homo Sapiens; identical to SEQ ID NO: 539762

SEQ ID NO: 693143 - RNA, 64 nt, Homo Sapiens; identical to SEQ ID NO: 539763

SEQ ID NO: 693144 - RNA, 64 nt, Homo Sapiens; identical to SEQ ID NO: 539764

SEQ ID NO: 693145 - RNA, 64 nt, Homo Sapiens; identical to SEQ ID NO: 539765

SEQ ID NO: 693146 - RNA, 64 nt, Homo Sapiens; identical to SEQ ID NO: 539766

SEQ ID NO: 693147 - RNA, 64 nt, Homo Sapiens; identical to SEQ ID NO: 539767

SEQ ID NO: 693148 - RNA, 64 nt, Homo Sapiens; identical to SEQ ID NO: 539768

SEQ ID NO: 693149 - RNA, 64 nt, Homo Sapiens; identical to SEQ ID NO: 539769

SEQ ID NO: 693150 - RNA, 64 nt, Homo Sapiens; identical to SEQ ID NO: 539770

SEQ ID NO: 693151 - RNA, 64 nt, Homo Sapiens; identical to SEQ ID NO: 539771

SEQ ID NO: 693152 - RNA, 64 nt, Homo Sapiens; identical to SEQ ID NO: 539772

SEQ ID NO: 693153 - RNA, 64 nt, Homo Sapiens; identical to SEQ ID NO: 539773

SEQ ID NO: 693154 - RNA, 64 nt, Homo Sapiens; identical to SEQ ID NO: 539774

SEQ ID NO: 693155 - RNA, 64 nt, Homo Sapiens; identical to SEQ ID NO: 539775

SEQ ID NO: 693156 - RNA, 64 nt, Homo Sapiens; identical to SEQ ID NO: 539776

SEQ ID NO: 693157 - RNA, 64 nt, Homo Sapiens; identical to SEQ ID NO: 539777

SEQ ID NO: 693158 - RNA, 64 nt, Homo Sapiens; identical to SEQ ID NO: 539778

SEQ ID NO: 693159 - RNA, 64 nt, Homo Sapiens; identical to SEQ ID NO: 539779

SEQ ID NO: 693160 - RNA, 64 nt, Homo Sapiens; identical to SEQ ID NO: 539780

SEQ ID NO: 693161 - RNA, 64 nt, Homo Sapiens; identical to SEQ ID NO: 539781

SEQ ID NO: 693162 - RNA, 64 nt, Homo Sapiens; identical to SEQ ID NO: 539782

SEQ ID NO: 693163 - RNA, 64 nt, Homo Sapiens; identical to SEQ ID NO: 539783

SEQ ID NO: 693164 - RNA, 64 nt, Homo Sapiens; identical to SEQ ID NO: 539784

SEQ ID NO: 693165 - RNA, 64 nt, Homo Sapiens; identical to SEQ ID NO: 539785

SEQ ID NO: 693166 - RNA, 64 nt, Homo Sapiens; identical to SEQ ID NO: 539786

SEQ ID NO: 693167 - RNA, 64 nt, Homo Sapiens; identical to SEQ ID NO: 539787

SEQ ID NO: 693168 - RNA, 64 nt, Homo Sapiens; identical to SEQ ID NO: 539788

SEQ ID NO: 693169 - RNA, 64 nt, Homo Sapiens; identical to SEQ ID NO: 81719

SEQ ID NO: 693170 - RNA, 64 nt, Homo Sapiens; identical to SEQ ID NO: 81720

SEQ ID NO: 693171 - RNA, 64 nt, Homo Sapiens; identical to SEQ ID NO: 81721

SEQ ID NO: 693172 - RNA, 64 nt, Homo Sapiens; identical to SEQ ID NO: 81722

SEQ ID NO: 693173 - RNA, 64 nt, Homo Sapiens; identical to SEQ ID NO: 81723

SEQ ID NO: 693174 - RNA, 64 nt, Homo Sapiens; identical to SEQ ID NO: 81724

SEQ ID NO: 693175 - RNA, 64 nt, Homo Sapiens; identical to SEQ ID NO: 81725

SEQ ID NO: 693176 - RNA, 64 nt, Homo Sapiens; identical to SEQ ID NO: 81726

SEQ ID NO: 693177 - RNA, 64 nt, Homo Sapiens; identical to SEQ ID NO: 81727

SEQ ID NO: 693178 - RNA, 64 nt, Homo Sapiens; identical to SEQ ID NO: 81728

SEQ ID NO: 693179 - RNA, 64 nt, Homo Sapiens; identical to SEQ ID NO: 81729

SEQ ID NO: 693180 - RNA, 64 nt, Homo Sapiens; identical to SEQ ID NO: 81730

SEQ ID NO: 693181 - RNA, 64 nt, Homo Sapiens; identical to SEQ ID NO: 81731

SEQ ID NO: 693182 - RNA, 64 nt, Homo Sapiens; identical to SEQ ID NO: 81732

SEQ ID NO: 693183 - RNA, 64 nt, Homo Sapiens; identical to SEQ ID NO: 81733

SEQ ID NO: 693184 - RNA, 64 nt, Homo Sapiens; identical to SEQ ID NO: 81734

SEQ ID NO: 693185 - RNA, 64 nt, Homo Sapiens
cuuacaguauacacuugaaaucuccuaaugcagaggccuugaagguguuuucuuugaagugccc

SEQ ID NO: 693186 - RNA, 64 nt, Homo Sapiens
aauauauuuucuuggugaauugugucaccucaaaggccuugaaggauaaauuacagucaaagau

SEQ ID NO: 693187 - RNA, 64 nt, Homo Sapiens
uaaauuuugacuaagugauaucugaauguuuucaggccuugaaaaguaguaccauuuugauuag

SEQ ID NO: 693188 - RNA, 64 nt, Homo Sapiens
uuauauuccaaggcaaaucuuuuuuaauauuuaaggccuugaaaaugaaauaguuauaaaauua

SEQ ID NO: 693189 - RNA, 50 nt, Homo Sapiens
gccuggccagccuccugugaggccuugauggggccauccagcuccgcagg

SEQ ID NO: 693190 - RNA, 64 nt, Homo Sapiens
cccaggggcaccacgccugacucuccaucacccaggccuugaugccgagcgggaguagaguguu

SEQ ID NO: 693191 - RNA, 64 nt, Homo Sapiens
ggacccugcaggcagucagcguguccguauguaaggccuugagauggcaaacuggccuugauca

SEQ ID NO: 693192 - RNA, 64 nt, Homo Sapiens
aguguccguauguaaggccuugcuguggcaaacuggccuugaucgcauggcuggcaggggcagc

SEQ ID NO: 693193 - RNA, 64 nt, Homo Sapiens
agugcagugaugcaaucacagcucaccucagugcggccuugaacuccuggacucaaucgauccu

SEQ ID NO: 693194 - RNA, 64 nt, Homo Sapiens
agugcagugaugcaaucacagcucaccucagugcggccuugaacuccuggacucaauugauccu

SEQ ID NO: 693195 - RNA, 64 nt, Homo Sapiens; identical to SEQ ID NO: 106040

SEQ ID NO: 693196 - RNA, 64 nt, Homo Sapiens; identical to SEQ ID NO: 106041

SEQ ID NO: 693197 - RNA, 64 nt, Homo Sapiens; identical to SEQ ID NO: 106042

SEQ ID NO: 693198 - RNA, 64 nt, Homo Sapiens; identical to SEQ ID NO: 106043

SEQ ID NO: 693199 - RNA, 64 nt, Homo Sapiens; identical to SEQ ID NO: 106044

SEQ ID NO: 693200 - RNA, 64 nt, Homo Sapiens; identical to SEQ ID NO: 106045

SEQ ID NO: 693201 - RNA, 64 nt, Homo Sapiens; identical to SEQ ID NO: 106046

SEQ ID NO: 693202 - RNA, 64 nt, Homo Sapiens; identical to SEQ ID NO: 106047

SEQ ID NO: 693203 - RNA, 64 nt, Homo Sapiens; identical to SEQ ID NO: 106048

SEQ ID NO: 693204 - RNA, 64 nt, Homo Sapiens; identical to SEQ ID NO: 106049

SEQ ID NO: 693205 - RNA, 64 nt, Homo Sapiens; identical to SEQ ID NO: 106050

SEQ ID NO: 693206 - RNA, 64 nt, Homo Sapiens; identical to SEQ ID NO: 106051

SEQ ID NO: 693207 - RNA, 64 nt, Homo Sapiens; identical to SEQ ID NO: 106052

SEQ ID NO: 693208 - RNA, 64 nt, Homo Sapiens; identical to SEQ ID NO: 106053

SEQ ID NO: 693209 - RNA, 64 nt, Homo Sapiens; identical to SEQ ID NO: 106054

SEQ ID NO: 693210 - RNA, 64 nt, Homo Sapiens; identical to SEQ ID NO: 106055

SEQ ID NO: 693211 - RNA, 64 nt, Homo Sapiens; identical to SEQ ID NO: 106056

SEQ ID NO: 693212 - RNA, 64 nt, Homo Sapiens; identical to SEQ ID NO: 106057

SEQ ID NO: 693213 - RNA, 64 nt, Homo Sapiens; identical to SEQ ID NO: 106058

SEQ ID NO: 693214 - RNA, 64 nt, Homo Sapiens; identical to SEQ ID NO: 106059

SEQ ID NO: 693215 - RNA, 64 nt, Homo Sapiens; identical to SEQ ID NO: 106060

SEQ ID NO: 693216 - RNA, 64 nt, Homo Sapiens; identical to SEQ ID NO: 106061

SEQ ID NO: 693217 - RNA, 64 nt, Homo Sapiens; identical to SEQ ID NO: 106062

SEQ ID NO: 693218 - RNA, 64 nt, Homo Sapiens; identical to SEQ ID NO: 106063

SEQ ID NO: 693219 - RNA, 64 nt, Homo Sapiens; identical to SEQ ID NO: 106064

SEQ ID NO: 693220 - RNA, 64 nt, Homo Sapiens; identical to SEQ ID NO: 106065

SEQ ID NO: 693221 - RNA, 64 nt, Homo Sapiens; identical to SEQ ID NO: 106066

SEQ ID NO: 693222 - RNA, 64 nt, Homo Sapiens; identical to SEQ ID NO: 106067

SEQ ID NO: 693223 - RNA, 64 nt, Homo Sapiens; identical to SEQ ID NO: 106068

SEQ ID NO: 693224 - RNA, 64 nt, Homo Sapiens; identical to SEQ ID NO: 106069

SEQ ID NO: 693225 - RNA, 64 nt, Homo Sapiens; identical to SEQ ID NO: 106070

SEQ ID NO: 693226 - RNA, 64 nt, Homo Sapiens; identical to SEQ ID NO: 106071

SEQ ID NO: 693227 - RNA, 64 nt, Homo Sapiens; identical to SEQ ID NO: 106072

SEQ ID NO: 693228 - RNA, 64 nt, Homo Sapiens; identical to SEQ ID NO: 106073

SEQ ID NO: 693229 - RNA, 64 nt, Homo Sapiens; identical to SEQ ID NO: 106074

SEQ ID NO: 693230 - RNA, 64 nt, Homo Sapiens; identical to SEQ ID NO: 106075

SEQ ID NO: 693231 - RNA, 64 nt, Homo Sapiens; identical to SEQ ID NO: 106076

SEQ ID NO: 693232 - RNA, 64 nt, Homo Sapiens; identical to SEQ ID NO: 106077

SEQ ID NO: 693233 - RNA, 64 nt, Homo Sapiens; identical to SEQ ID NO: 106078

SEQ ID NO: 693234 - RNA, 64 nt, Homo Sapiens; identical to SEQ ID NO: 106079

SEQ ID NO: 693235 - RNA, 64 nt, Homo Sapiens; identical to SEQ ID NO: 106080

SEQ ID NO: 693236 - RNA, 64 nt, Homo Sapiens; identical to SEQ ID NO: 106081

SEQ ID NO: 693237 - RNA, 64 nt, Homo Sapiens; identical to SEQ ID NO: 106082

SEQ ID NO: 693238 - RNA, 64 nt, Homo Sapiens; identical to SEQ ID NO: 106083

SEQ ID NO: 693239 - RNA, 64 nt, Homo Sapiens; identical to SEQ ID NO: 106084

SEQ ID NO: 693240 - RNA, 64 nt, Homo Sapiens; identical to SEQ ID NO: 106085

SEQ ID NO: 693241 - RNA, 64 nt, Homo Sapiens; identical to SEQ ID NO: 106086

SEQ ID NO: 693242 - RNA, 64 nt, Homo Sapiens; identical to SEQ ID NO: 106087

SEQ ID NO: 693243 - RNA, 64 nt, Homo Sapiens; identical to SEQ ID NO: 106088

SEQ ID NO: 693244 - RNA, 64 nt, Homo Sapiens; identical to SEQ ID NO: 124377

SEQ ID NO: 693245 - RNA, 64 nt, Homo Sapiens; identical to SEQ ID NO: 124378

SEQ ID NO: 693246 - RNA, 64 nt, Homo Sapiens; identical to SEQ ID NO: 124379

SEQ ID NO: 693247 - RNA, 64 nt, Homo Sapiens; identical to SEQ ID NO: 124380

SEQ ID NO: 693248 - RNA, 64 nt, Homo Sapiens; identical to SEQ ID NO: 124381

SEQ ID NO: 693249 - RNA, 64 nt, Homo Sapiens; identical to SEQ ID NO: 124382

SEQ ID NO: 693250 - RNA, 64 nt, Homo Sapiens; identical to SEQ ID NO: 124383

SEQ ID NO: 693251 - RNA, 64 nt, Homo Sapiens; identical to SEQ ID NO: 124384

SEQ ID NO: 693252 - RNA, 55 nt, Homo Sapiens; identical to SEQ ID NO: 194635

SEQ ID NO: 693253 - RNA, 64 nt, Homo Sapiens; identical to SEQ ID NO: 417042

SEQ ID NO: 693254 - RNA, 64 nt, Homo Sapiens; identical to SEQ ID NO: 417043

SEQ ID NO: 693255 - RNA, 64 nt, Homo Sapiens; identical to SEQ ID NO: 417044

SEQ ID NO: 693256 - RNA, 64 nt, Homo Sapiens; identical to SEQ ID NO: 417045

SEQ ID NO: 693257 - RNA, 64 nt, Homo Sapiens; identical to SEQ ID NO: 417046

SEQ ID NO: 693258 - RNA, 64 nt, Homo Sapiens; identical to SEQ ID NO: 417047

SEQ ID NO: 693259 - RNA, 64 nt, Homo Sapiens; identical to SEQ ID NO: 417048

SEQ ID NO: 693260 - RNA, 64 nt, Homo Sapiens; identical to SEQ ID NO: 417049

SEQ ID NO: 693261 - RNA, 64 nt, Homo Sapiens; identical to SEQ ID NO: 417050

SEQ ID NO: 693262 - RNA, 64 nt, Homo Sapiens; identical to SEQ ID NO: 417051

SEQ ID NO: 693263 - RNA, 64 nt, Homo Sapiens; identical to SEQ ID NO: 417052

SEQ ID NO: 693264 - RNA, 64 nt, Homo Sapiens; identical to SEQ ID NO: 417053

SEQ ID NO: 693265 - RNA, 64 nt, Homo Sapiens; identical to SEQ ID NO: 417054

SEQ ID NO: 693266 - RNA, 64 nt, Homo Sapiens; identical to SEQ ID NO: 417055

SEQ ID NO: 693267 - RNA, 64 nt, Homo Sapiens; identical to SEQ ID NO: 417056

SEQ ID NO: 693268 - RNA, 64 nt, Homo Sapiens; identical to SEQ ID NO: 417057

SEQ ID NO: 693269 - RNA, 64 nt, Homo Sapiens; identical to SEQ ID NO: 417058

SEQ ID NO: 693270 - RNA, 64 nt, Homo Sapiens; identical to SEQ ID NO: 417059

SEQ ID NO: 693271 - RNA, 64 nt, Homo Sapiens; identical to SEQ ID NO: 417060

SEQ ID NO: 693272 - RNA, 64 nt, Homo Sapiens; identical to SEQ ID NO: 417061

SEQ ID NO: 693273 - RNA, 64 nt, Homo Sapiens; identical to SEQ ID NO: 417062

SEQ ID NO: 693274 - RNA, 64 nt, Homo Sapiens; identical to SEQ ID NO: 417063

SEQ ID NO: 693275 - RNA, 64 nt, Homo Sapiens; identical to SEQ ID NO: 417064

SEQ ID NO: 693276 - RNA, 64 nt, Homo Sapiens; identical to SEQ ID NO: 417065

SEQ ID NO: 693277 - RNA, 64 nt, Homo Sapiens; identical to SEQ ID NO: 417066

SEQ ID NO: 693278 - RNA, 64 nt, Homo Sapiens; identical to SEQ ID NO: 417067

SEQ ID NO: 693279 - RNA, 64 nt, Homo Sapiens; identical to SEQ ID NO: 417068

SEQ ID NO: 693280 - RNA, 64 nt, Homo Sapiens; identical to SEQ ID NO: 417069

SEQ ID NO: 693281 - RNA, 64 nt, Homo Sapiens; identical to SEQ ID NO: 417070

SEQ ID NO: 693282 - RNA, 64 nt, Homo Sapiens; identical to SEQ ID NO: 417071

SEQ ID NO: 693283 - RNA, 64 nt, Homo Sapiens; identical to SEQ ID NO: 417072

SEQ ID NO: 693284 - RNA, 64 nt, Homo Sapiens; identical to SEQ ID NO: 417073

SEQ ID NO: 693285 - RNA, 64 nt, Homo Sapiens; identical to SEQ ID NO: 417074

SEQ ID NO: 693286 - RNA, 64 nt, Homo Sapiens; identical to SEQ ID NO: 417075

SEQ ID NO: 693287 - RNA, 64 nt, Homo Sapiens; identical to SEQ ID NO: 417076

SEQ ID NO: 693288 - RNA, 64 nt, Homo Sapiens; identical to SEQ ID NO: 417077

SEQ ID NO: 693289 - RNA, 64 nt, Homo Sapiens; identical to SEQ ID NO: 417078

SEQ ID NO: 693290 - RNA, 64 nt, Homo Sapiens; identical to SEQ ID NO: 417079

SEQ ID NO: 693291 - RNA, 64 nt, Homo Sapiens; identical to SEQ ID NO: 417080

SEQ ID NO: 693292 - RNA, 64 nt, Homo Sapiens; identical to SEQ ID NO: 417081

SEQ ID NO: 693293 - RNA, 64 nt, Homo Sapiens
gaacccugcuccguuggucagcguuacuaucaucucggaucauauggagcucaugucagccgug

SEQ ID NO: 693294 - RNA, 64 nt, Homo Sapiens
uuggugcagcuccaggucauuccuggggugggaaucggaucaucccugacucagcuuuuaccuu

SEQ ID NO: 693295 - RNA, 64 nt, Homo Sapiens
ccaccaaauauggcauauccacaacuaaacuaccucggaucaagcuuucuaccuucuuuccagg

SEQ ID NO: 693296 - RNA, 64 nt, Homo Sapiens
uggaaagaaggcaacucuucgcgccaguaaaccaucggaucaauuuauguaauguguuuuaaaa

SEQ ID NO: 693297 - RNA, 64 nt, Homo Sapiens
guaagcagggcuggcuucgcccgcguucucgucgucggaucaaggagcgcggcggcguuuugga

SEQ ID NO: 693298 - RNA, 64 nt, Homo Sapiens
gccauucauugguauuuuaaagaaccacuugaaaucggaucauuuuauuuaaaaauaaaaaaug

SEQ ID NO: 693299 - RNA, 64 nt, Homo Sapiens
gcuugccaaggaacagcccacguggacaugccagucggaucaugaguucaccugauggcauucg

SEQ ID NO: 693300 - RNA, 64 nt, Homo Sapiens
aucuccuuggugcugauuaaagagagcggccaucucggaucauaccucauguggaugggcaaga

SEQ ID NO: 693301 - RNA, 64 nt, Homo Sapiens
gccuucuuccuccucuugccgugccccucacccaucggaucacucaaagcugcccaaccgggua

SEQ ID NO: 693302 - RNA, 64 nt, Homo Sapiens
gugauggaugcuggaaccucauaaucuccuucucucggaucauuccaauuugugcuucaggggg

SEQ ID NO: 693303 - RNA, 64 nt, Homo Sapiens
cguuuacaagccuuuucuaagcaaagagaaccuuucggaucacugccagcugaucagagaugcu

SEQ ID NO: 693304 - RNA, 64 nt, Homo Sapiens
ccuguaaucccagcacuuugggaggcugaggaggucggaucaugaggucaagaguucgagacca

SEQ ID NO: 693305 - RNA, 64 nt, Homo Sapiens
cuugagagaggccacacuacgugaacacaaagccucggaucagcgugagcuccggccccaccuc

SEQ ID NO: 693306 - RNA, 64 nt, Homo Sapiens
gagaguagccgagagccugcccucccuguccuccucggaucaccuccugcccaggagagccagc

SEQ ID NO: 693307 - RNA, 64 nt, Homo Sapiens
aucuguaugaugugguguggguuaacuuuuccauucggaucauugacaaauaucauuacagcac

SEQ ID NO: 693308 - RNA, 64 nt, Homo Sapiens
ggguugugcagaagcuuagcauaugcccuuguguucggaucaggcccacagggcugcucaaaga

SEQ ID NO: 693309 - RNA, 64 nt, Homo Sapiens
uuugggggaauaaaaaauauaaauacugauaaauucggaucaaagaaauuuuaaaaacuuuaaa

SEQ ID NO: 693310 - RNA, 64 nt, Homo Sapiens
gacccugcagggcaagucaggggccaggaugcccucggaucagggccgggaugggaggggucag

SEQ ID NO: 693311 - RNA, 64 nt, Homo Sapiens
agugaaaauccagaugaggucauguuauugcugcucggaucacuacguuccuuguccaaggggc

SEQ ID NO: 693312 - RNA, 64 nt, Homo Sapiens
aagaagacuaaguagccccagagauaagaccuccucggaucauugucccuucuuauguagugau

SEQ ID NO: 693313 - RNA, 64 nt, Homo Sapiens
gucuacgggaccgaggaccucauuuggcaaagucucggaucaggaaaaacaguaaaagcuuaug

SEQ ID NO: 693314 - RNA, 64 nt, Homo Sapiens
gcuacagcuugcucucugagaccuggggcuucacucggaucacgcccuccugggcacaggucac

SEQ ID NO: 693315 - RNA, 64 nt, Homo Sapiens
cuaaaauacauaccaagagaaaaauaccuugccaucggaucaucaacaagucuucuauuuacaa

SEQ ID NO: 693316 - RNA, 64 nt, Homo Sapiens
cucccaggagccugcccagccagccgacacggucucggaucaggccugguuguguguccccuug

SEQ ID NO: 693317 - RNA, 64 nt, Homo Sapiens
cacaucuuguuuccuauagaaauguucuguauucucggaucaauuuccaaaugcuuuacuuuuu

SEQ ID NO: 693318 - RNA, 64 nt, Homo Sapiens
uuggcacggccgccugcguguagcccuguuucacucggaucaggggaggaccauuuugcgagug

SEQ ID NO: 693319 - RNA, 64 nt, Homo Sapiens
acaaccguccccggccccugccccgcccccaagcucggaucacaugaaggagacagcagcaccc

SEQ ID NO: 693320 - RNA, 64 nt, Homo Sapiens; identical to SEQ ID NO: 139090

SEQ ID NO: 693321 - RNA, 64 nt, Homo Sapiens; identical to SEQ ID NO: 139091

SEQ ID NO: 693322 - RNA, 64 nt, Homo Sapiens; identical to SEQ ID NO: 139092

SEQ ID NO: 693323 - RNA, 64 nt, Homo Sapiens; identical to SEQ ID NO: 139093

SEQ ID NO: 693324 - RNA, 64 nt, Homo Sapiens; identical to SEQ ID NO: 139094

SEQ ID NO: 693325 - RNA, 64 nt, Homo Sapiens; identical to SEQ ID NO: 139095

SEQ ID NO: 693326 - RNA, 64 nt, Homo Sapiens; identical to SEQ ID NO: 139096

SEQ ID NO: 693327 - RNA, 64 nt, Homo Sapiens; identical to SEQ ID NO: 139097

SEQ ID NO: 693328 - RNA, 64 nt, Homo Sapiens; identical to SEQ ID NO: 139098

SEQ ID NO: 693329 - RNA, 64 nt, Homo Sapiens; identical to SEQ ID NO: 139099

SEQ ID NO: 693330 - RNA, 64 nt, Homo Sapiens; identical to SEQ ID NO: 139100

SEQ ID NO: 693331 - RNA, 64 nt, Homo Sapiens; identical to SEQ ID NO: 139101

SEQ ID NO: 693332 - RNA, 64 nt, Homo Sapiens; identical to SEQ ID NO: 139102

SEQ ID NO: 693333 - RNA, 64 nt, Homo Sapiens; identical to SEQ ID NO: 139103

SEQ ID NO: 693334 - RNA, 64 nt, Homo Sapiens; identical to SEQ ID NO: 139104

SEQ ID NO: 693335 - RNA, 64 nt, Homo Sapiens; identical to SEQ ID NO: 139105

SEQ ID NO: 693336 - RNA, 64 nt, Homo Sapiens; identical to SEQ ID NO: 139106

SEQ ID NO: 693337 - RNA, 64 nt, Homo Sapiens; identical to SEQ ID NO: 139107

SEQ ID NO: 693338 - RNA, 64 nt, Homo Sapiens; identical to SEQ ID NO: 139108

SEQ ID NO: 693339 - RNA, 64 nt, Homo Sapiens; identical to SEQ ID NO: 139109

SEQ ID NO: 693340 - RNA, 64 nt, Homo Sapiens; identical to SEQ ID NO: 139110

SEQ ID NO: 693341 - RNA, 64 nt, Homo Sapiens; identical to SEQ ID NO: 139111

SEQ ID NO: 693342 - RNA, 64 nt, Homo Sapiens; identical to SEQ ID NO: 139112

SEQ ID NO: 693343 - RNA, 64 nt, Homo Sapiens; identical to SEQ ID NO: 139113

SEQ ID NO: 693344 - RNA, 64 nt, Homo Sapiens; identical to SEQ ID NO: 139114

SEQ ID NO: 693345 - RNA, 64 nt, Homo Sapiens; identical to SEQ ID NO: 139115

SEQ ID NO: 693346 - RNA, 52 nt, Homo Sapiens; identical to SEQ ID NO: 112167

SEQ ID NO: 693347 - RNA, 64 nt, Homo Sapiens; identical to SEQ ID NO: 139117

SEQ ID NO: 693348 - RNA, 64 nt, Homo Sapiens; identical to SEQ ID NO: 139118

SEQ ID NO: 693349 - RNA, 64 nt, Homo Sapiens; identical to SEQ ID NO: 139119

SEQ ID NO: 693350 - RNA, 64 nt, Homo Sapiens; identical to SEQ ID NO: 139120

SEQ ID NO: 693351 - RNA, 64 nt, Homo Sapiens; identical to SEQ ID NO: 139121

SEQ ID NO: 693352 - RNA, 64 nt, Homo Sapiens; identical to SEQ ID NO: 139122

SEQ ID NO: 693353 - RNA, 64 nt, Homo Sapiens; identical to SEQ ID NO: 139123

SEQ ID NO: 693354 - RNA, 64 nt, Homo Sapiens; identical to SEQ ID NO: 139124

SEQ ID NO: 693355 - RNA, 64 nt, Homo Sapiens; identical to SEQ ID NO: 139125

SEQ ID NO: 693356 - RNA, 64 nt, Homo Sapiens; identical to SEQ ID NO: 139126

SEQ ID NO: 693357 - RNA, 64 nt, Homo Sapiens; identical to SEQ ID NO: 139127

SEQ ID NO: 693358 - RNA, 64 nt, Homo Sapiens; identical to SEQ ID NO: 139128

SEQ ID NO: 693359 - RNA, 64 nt, Homo Sapiens; identical to SEQ ID NO: 139129

SEQ ID NO: 693360 - RNA, 64 nt, Homo Sapiens; identical to SEQ ID NO: 139130

SEQ ID NO: 693361 - RNA, 64 nt, Homo Sapiens; identical to SEQ ID NO: 139131

SEQ ID NO: 693362 - RNA, 64 nt, Homo Sapiens
gcgucaguauagaggccuuuugaccuuugcagugucaugugagggacauuugaccuuugacauu

SEQ ID NO: 693363 - RNA, 64 nt, Homo Sapiens
cugauucccacauuaagguucuucaguucacuacucaugugauauguaauccagacaccuaauu

SEQ ID NO: 693364 - RNA, 64 nt, Homo Sapiens
cuucugagcauuccuaaauaucugcuuagaaauaucaugugauaaagagggaccuucuuaauac

SEQ ID NO: 693365 - RNA, 64 nt, Homo Sapiens
aaaugucuuaaauaauuuaaccauaaauuuucugucaugugauacuggaauaugggauacuuuu

SEQ ID NO: 693366 - RNA, 63 nt, Homo Sapiens
cguggaaucuguuuucucacauaaacaagaauaaucaugugaauggagaauaaagagaccuca

SEQ ID NO: 693367 - RNA, 64 nt, Homo Sapiens
uggccuuggcgagggcugguugucccgcaucuacucaugugaacccugccccucgagucgaugg

SEQ ID NO: 693368 - RNA, 64 nt, Homo Sapiens
guaaagccuucucucgaaucucaucccucacucuucaugugagaagucacacaggggagaaacc

SEQ ID NO: 693369 - RNA, 64 nt, Homo Sapiens
auuuucuaggaucuuucaaaaaugauuauaaaauucaugugaaauagaaguguaugaauugcug

SEQ ID NO: 693370 - RNA, 64 nt, Homo Sapiens
caaaauaucauucuucuuuuacuucauauaucagucaugugacauuuauggacacugagcuuga

SEQ ID NO: 693371 - RNA, 64 nt, Homo Sapiens
aauauugauuacucacacauguuugauuauuuagucaugugaaaguuguucucuaguucuacgg

SEQ ID NO: 693372 - RNA, 64 nt, Homo Sapiens
cagcugcauggguuuuuaguggcaggagcaagccccucacaaugugaaccugcuuauaccuaag

SEQ ID NO: 693373 - RNA, 64 nt, Homo Sapiens
ugguaaggauccaucucuucaacagucguucccgccucacaacccuccguuguagggguuacag

SEQ ID NO: 693374 - RNA, 64 nt, Homo Sapiens
ccggagggccugcucccggccccccugcacucugccucacaaaggucuauauuauauaaaucua

SEQ ID NO: 693375 - RNA, 64 nt, Homo Sapiens
ugagcugcugcugucacuccuccaccgagggaggccucacaaaccacaggacgcugcaacgggu

SEQ ID NO: 693376 - RNA, 64 nt, Homo Sapiens
cugaauggucugaagaaggaccucacaacagucaccucacaaacgccccuugcccuccccugcc

SEQ ID NO: 693377 - RNA, 64 nt, Homo Sapiens
gucaccucacaaaccugaauugcccuccccugccccucacaacagcaccugccacucugccccu

SEQ ID NO: 693378 - RNA, 64 nt, Homo Sapiens; identical to SEQ ID NO: 434003

SEQ ID NO: 693379 - RNA, 64 nt, Homo Sapiens; identical to SEQ ID NO: 434004

SEQ ID NO: 693380 - RNA, 64 nt, Homo Sapiens; identical to SEQ ID NO: 434005

SEQ ID NO: 693381 - RNA, 64 nt, Homo Sapiens; identical to SEQ ID NO: 434006

SEQ ID NO: 693382 - RNA, 64 nt, Homo Sapiens; identical to SEQ ID NO: 434007

SEQ ID NO: 693383 - RNA, 64 nt, Homo Sapiens; identical to SEQ ID NO: 434008

SEQ ID NO: 693384 - RNA, 64 nt, Homo Sapiens; identical to SEQ ID NO: 434009

SEQ ID NO: 693385 - RNA, 64 nt, Homo Sapiens; identical to SEQ ID NO: 434010

SEQ ID NO: 693386 - RNA, 64 nt, Homo Sapiens; identical to SEQ ID NO: 434011

SEQ ID NO: 693387 - RNA, 64 nt, Homo Sapiens; identical to SEQ ID NO: 434012

SEQ ID NO: 693388 - RNA, 64 nt, Homo Sapiens; identical to SEQ ID NO: 434013

SEQ ID NO: 693389 - RNA, 64 nt, Homo Sapiens; identical to SEQ ID NO: 434014

SEQ ID NO: 693390 - RNA, 64 nt, Homo Sapiens; identical to SEQ ID NO: 434015

SEQ ID NO: 693391 - RNA, 64 nt, Homo Sapiens; identical to SEQ ID NO: 434016

SEQ ID NO: 693392 - RNA, 64 nt, Homo Sapiens; identical to SEQ ID NO: 434017

SEQ ID NO: 693393 - RNA, 64 nt, Homo Sapiens; identical to SEQ ID NO: 434018

SEQ ID NO: 693394 - RNA, 64 nt, Homo Sapiens; identical to SEQ ID NO: 434019

SEQ ID NO: 693395 - RNA, 64 nt, Homo Sapiens; identical to SEQ ID NO: 434020

SEQ ID NO: 693396 - RNA, 64 nt, Homo Sapiens; identical to SEQ ID NO: 434021

SEQ ID NO: 693397 - RNA, 64 nt, Homo Sapiens; identical to SEQ ID NO: 434022

SEQ ID NO: 693398 - RNA, 64 nt, Homo Sapiens; identical to SEQ ID NO: 434023

SEQ ID NO: 693399 - RNA, 64 nt, Homo Sapiens; identical to SEQ ID NO: 434024

SEQ ID NO: 693400 - RNA, 64 nt, Homo Sapiens; identical to SEQ ID NO: 434025

SEQ ID NO: 693401 - RNA, 64 nt, Homo Sapiens; identical to SEQ ID NO: 434026

SEQ ID NO: 693402 - RNA, 64 nt, Homo Sapiens; identical to SEQ ID NO: 434027

SEQ ID NO: 693403 - RNA, 64 nt, Homo Sapiens; identical to SEQ ID NO: 434028

SEQ ID NO: 693404 - RNA, 64 nt, Homo Sapiens; identical to SEQ ID NO: 434029

SEQ ID NO: 693405 - RNA, 64 nt, Homo Sapiens; identical to SEQ ID NO: 434030

SEQ ID NO: 693406 - RNA, 64 nt, Homo Sapiens; identical to SEQ ID NO: 434031

SEQ ID NO: 693407 - RNA, 64 nt, Homo Sapiens; identical to SEQ ID NO: 434032

SEQ ID NO: 693408 - RNA, 64 nt, Homo Sapiens; identical to SEQ ID NO: 434033

SEQ ID NO: 693409 - RNA, 64 nt, Homo Sapiens; identical to SEQ ID NO: 434034

SEQ ID NO: 693410 - RNA, 64 nt, Homo Sapiens; identical to SEQ ID NO: 434035

SEQ ID NO: 693411 - RNA, 64 nt, Homo Sapiens; identical to SEQ ID NO: 434036

SEQ ID NO: 693412 - RNA, 64 nt, Homo Sapiens; identical to SEQ ID NO: 434037

SEQ ID NO: 693413 - RNA, 64 nt, Homo Sapiens; identical to SEQ ID NO: 434038

SEQ ID NO: 693414 - RNA, 64 nt, Homo Sapiens; identical to SEQ ID NO: 434039

SEQ ID NO: 693415 - RNA, 64 nt, Homo Sapiens; identical to SEQ ID NO: 434040

SEQ ID NO: 693416 - RNA, 64 nt, Homo Sapiens; identical to SEQ ID NO: 434041

SEQ ID NO: 693417 - RNA, 64 nt, Homo Sapiens; identical to SEQ ID NO: 434042

SEQ ID NO: 693418 - RNA, 64 nt, Homo Sapiens; identical to SEQ ID NO: 434043

SEQ ID NO: 693419 - RNA, 64 nt, Homo Sapiens; identical to SEQ ID NO: 434044

SEQ ID NO: 693420 - RNA, 64 nt, Homo Sapiens
agauauuuugggcauguggggauaguagagugauauggagcaagaaggcagagaaagggacaau

SEQ ID NO: 693421 - RNA, 64 nt, Homo Sapiens
gugguagguacuuuuugugaaggagaucagaaaaauggagcaaauuucuguuuccuguaccagu

SEQ ID NO: 693422 - RNA, 64 nt, Homo Sapiens
ggcgugcugggcauggggccugcucacagacagcauggagcagggaugggcugucugugcccau

SEQ ID NO: 693423 - RNA, 64 nt, Homo Sapiens
ucaguggagggagacccagcauagccaggccaguauggagcaccucacgcacagcucucagaag

SEQ ID NO: 693424 - RNA, 64 nt, Homo Sapiens
cggugacccagagcagggaccuguccaggucugcauggagcacucagcagcaggccaggccuuc

SEQ ID NO: 693425 - RNA, 64 nt, Homo Sapiens
ggcacccuauggggcuaugagcccaccagggaccauggagcagucaaggcccagugcucuuccu

SEQ ID NO: 693426 - RNA, 64 nt, Homo Sapiens
uuguuauaucugauuuucauaccacaaucuuuauauggagcagcauacuuuuuuaaaaguagga

SEQ ID NO: 693427 - RNA, 64 nt, Homo Sapiens
aaauuugggccuccaguauaugaggaauaauuacauggagcaugagcauuuuuuacacuaucau

SEQ ID NO: 693428 - RNA, 64 nt, Homo Sapiens
gucaaauaugagcugauggaggcuagagguauggauggagcaagaacacguggaauggaacagu

SEQ ID NO: 693429 - RNA, 64 nt, Homo Sapiens
gugccuggccaagauucuuucugggauuacaggcauggagcacccgccucggccucccaaagug

SEQ ID NO: 693430 - RNA, 64 nt, Homo Sapiens
ucuccgggaugaggcccuggcagaggugaaggacauggagcagcugcuggcccuugggaaggag

SEQ ID NO: 693431 - RNA, 64 nt, Homo Sapiens
caucuccguccugcccaccuucuuaagaggcgagauggagcaggcccaucugccucugcccuuu

SEQ ID NO: 693432 - RNA, 64 nt, Homo Sapiens
cugaacugugcuguuggaaaaugagagcgaucacauggagcaguaauggagcaaagaccagcca

SEQ ID NO: 693433 - RNA, 64 nt, Homo Sapiens
uguuggaaaaugagagcgaucacauggagcaguaauggagcaaagaccagccaucccaguugag

SEQ ID NO: 693434 - RNA, 64 nt, Homo Sapiens; identical to SEQ ID NO: 117299

SEQ ID NO: 693435 - RNA, 64 nt, Homo Sapiens; identical to SEQ ID NO: 117300

SEQ ID NO: 693436 - RNA, 64 nt, Homo Sapiens; identical to SEQ ID NO: 117301

SEQ ID NO: 693437 - RNA, 64 nt, Homo Sapiens; identical to SEQ ID NO: 117302

SEQ ID NO: 693438 - RNA, 64 nt, Homo Sapiens; identical to SEQ ID NO: 117303

SEQ ID NO: 693439 - RNA, 64 nt, Homo Sapiens; identical to SEQ ID NO: 117304

SEQ ID NO: 693440 - RNA, 64 nt, Homo Sapiens; identical to SEQ ID NO: 117305

SEQ ID NO: 693441 - RNA, 64 nt, Homo Sapiens; identical to SEQ ID NO: 117306

SEQ ID NO: 693442 - RNA, 64 nt, Homo Sapiens; identical to SEQ ID NO: 117307

SEQ ID NO: 693443 - RNA, 64 nt, Homo Sapiens; identical to SEQ ID NO: 117308

SEQ ID NO: 693444 - RNA, 64 nt, Homo Sapiens; identical to SEQ ID NO: 117309

SEQ ID NO: 693445 - RNA, 64 nt, Homo Sapiens; identical to SEQ ID NO: 117310

SEQ ID NO: 693446 - RNA, 64 nt, Homo Sapiens; identical to SEQ ID NO: 117311

SEQ ID NO: 693447 - RNA, 64 nt, Homo Sapiens; identical to SEQ ID NO: 117312

SEQ ID NO: 693448 - RNA, 64 nt, Homo Sapiens; identical to SEQ ID NO: 117313

SEQ ID NO: 693449 - RNA, 64 nt, Homo Sapiens; identical to SEQ ID NO: 117314

SEQ ID NO: 693450 - RNA, 64 nt, Homo Sapiens; identical to SEQ ID NO: 117315

SEQ ID NO: 693451 - RNA, 64 nt, Homo Sapiens; identical to SEQ ID NO: 117316

SEQ ID NO: 693452 - RNA, 64 nt, Homo Sapiens; identical to SEQ ID NO: 117317

SEQ ID NO: 693453 - RNA, 64 nt, Homo Sapiens; identical to SEQ ID NO: 117318

SEQ ID NO: 693454 - RNA, 64 nt, Homo Sapiens; identical to SEQ ID NO: 117319

SEQ ID NO: 693455 - RNA, 64 nt, Homo Sapiens; identical to SEQ ID NO: 117320

SEQ ID NO: 693456 - RNA, 64 nt, Homo Sapiens; identical to SEQ ID NO: 117321

SEQ ID NO: 693457 - RNA, 64 nt, Homo Sapiens; identical to SEQ ID NO: 117322

SEQ ID NO: 693458 - RNA, 64 nt, Homo Sapiens; identical to SEQ ID NO: 117323

SEQ ID NO: 693459 - RNA, 64 nt, Homo Sapiens; identical to SEQ ID NO: 117324

SEQ ID NO: 693460 - RNA, 64 nt, Homo Sapiens; identical to SEQ ID NO: 117325

SEQ ID NO: 693461 - RNA, 64 nt, Homo Sapiens; identical to SEQ ID NO: 117326

SEQ ID NO: 693462 - RNA, 64 nt, Homo Sapiens; identical to SEQ ID NO: 117327

SEQ ID NO: 693463 - RNA, 64 nt, Homo Sapiens; identical to SEQ ID NO: 117328

SEQ ID NO: 693464 - RNA, 64 nt, Homo Sapiens
ccucuacuguccucauugacuuguuugaaccuuagugccuuacccuguccucuucccaguucuc

SEQ ID NO: 693465 - RNA, 64 nt, Homo Sapiens
agugaguucuaaaaggcaugcccacaucucuuucgugccuuaaggauagugagaugcacacuua

SEQ ID NO: 693466 - RNA, 64 nt, Homo Sapiens
uuauaccaaagauuacuaaugggauuuuuuugaugugccuuaaaggucagauauuugagaauag

SEQ ID NO: 693467 - RNA, 58 nt, Homo Sapiens; identical to SEQ ID NO: 174552

SEQ ID NO: 693468 - RNA, 64 nt, Homo Sapiens
cguggaguguggggaagcugcugucucccaggaagugccuuacucaucccgcaaccagucagcg

SEQ ID NO: 693469 - RNA, 64 nt, Homo Sapiens
cuaaaguauuuguuuuuauuuguaccauccacuugugccuuacuguauccugugucauguccaa

SEQ ID NO: 693470 - RNA, 64 nt, Homo Sapiens
uguuuaaaaucucuggcuuccuuaauguuuucaagugccuuaaucuugcacauuuguacauaua

SEQ ID NO: 693471 - RNA, 64 nt, Homo Sapiens
agacagugaaagguaagcucgaauauaaagaacagugccuuagaaaagcaucuuaugucauuga

SEQ ID NO: 693472 - RNA, 64 nt, Homo Sapiens
cacccccuacacuucaguugagggaaaagcucaagugccuuaggcccguggaccacagucuugg

SEQ ID NO: 693473 - RNA, 64 nt, Homo Sapiens
gggacuucugccacagugacaauggaauuguguugugccuuacuucagagguggucucuucuuu

SEQ ID NO: 693474 - RNA, 64 nt, Homo Sapiens
ucugcuagucuguaagcuccuuaagaguaggguugugccuuauucaacugcauacauagcuccu

SEQ ID NO: 693475 - RNA, 64 nt, Homo Sapiens
gccuuauucaacugcauacauagcuccuagcacagugccuuauucgguaggcaucuaagcacau

SEQ ID NO: 693476 - RNA, 64 nt, Homo Sapiens
gcccuucuggcaccccugggguucaauacuggaagugccuuauuuaaccagaccaucagggcau

SEQ ID NO: 693477 - RNA, 64 nt, Homo Sapiens
gguuuauucauugaaacacgguugaccugaacucgugccuuaggaauuaaugcccccuuaugga

SEQ ID NO: 693478 - RNA, 64 nt, Homo Sapiens
uagacucuucauuuacuuuuagcuuucauaugaagugccuuaaguuuugugaaaauuuugaauu

SEQ ID NO: 693479 - RNA, 64 nt, Homo Sapiens
aagcaauccucugucaaaauaaagaagauguguagugccuuaacaaauaguuaaucauuuaacc

SEQ ID NO: 693480 - RNA, 63 nt, Homo Sapiens; identical to SEQ ID NO: 349836

SEQ ID NO: 693481 - RNA, 63 nt, Homo Sapiens; identical to SEQ ID NO: 349837

SEQ ID NO: 693482 - RNA, 63 nt, Homo Sapiens; identical to SEQ ID NO: 349838

SEQ ID NO: 693483 - RNA, 63 nt, Homo Sapiens; identical to SEQ ID NO: 349839

SEQ ID NO: 693484 - RNA, 63 nt, Homo Sapiens; identical to SEQ ID NO: 349840

SEQ ID NO: 693485 - RNA, 63 nt, Homo Sapiens; identical to SEQ ID NO: 349841

SEQ ID NO: 693486 - RNA, 63 nt, Homo Sapiens; identical to SEQ ID NO: 349842

SEQ ID NO: 693487 - RNA, 63 nt, Homo Sapiens; identical to SEQ ID NO: 349843

SEQ ID NO: 693488 - RNA, 63 nt, Homo Sapiens; identical to SEQ ID NO: 349844

SEQ ID NO: 693489 - RNA, 63 nt, Homo Sapiens; identical to SEQ ID NO: 349845

SEQ ID NO: 693490 - RNA, 63 nt, Homo Sapiens; identical to SEQ ID NO: 349846

SEQ ID NO: 693491 - RNA, 63 nt, Homo Sapiens; identical to SEQ ID NO: 349847

SEQ ID NO: 693492 - RNA, 63 nt, Homo Sapiens; identical to SEQ ID NO: 349848

SEQ ID NO: 693493 - RNA, 63 nt, Homo Sapiens; identical to SEQ ID NO: 349849

SEQ ID NO: 693494 - RNA, 63 nt, Homo Sapiens; identical to SEQ ID NO: 349850

SEQ ID NO: 693495 - RNA, 63 nt, Homo Sapiens; identical to SEQ ID NO: 349851

SEQ ID NO: 693496 - RNA, 63 nt, Homo Sapiens; identical to SEQ ID NO: 349852

SEQ ID NO: 693497 - RNA, 63 nt, Homo Sapiens; identical to SEQ ID NO: 349853

SEQ ID NO: 693498 - RNA, 63 nt, Homo Sapiens; identical to SEQ ID NO: 349854

SEQ ID NO: 693499 - RNA, 63 nt, Homo Sapiens; identical to SEQ ID NO: 349855

SEQ ID NO: 693500 - RNA, 63 nt, Homo Sapiens; identical to SEQ ID NO: 349856

SEQ ID NO: 693501 - RNA, 63 nt, Homo Sapiens; identical to SEQ ID NO: 349857

SEQ ID NO: 693502 - RNA, 63 nt, Homo Sapiens; identical to SEQ ID NO: 349858

SEQ ID NO: 693503 - RNA, 63 nt, Homo Sapiens; identical to SEQ ID NO: 349859

SEQ ID NO: 693504 - RNA, 63 nt, Homo Sapiens; identical to SEQ ID NO: 349860

SEQ ID NO: 693505 - RNA, 63 nt, Homo Sapiens; identical to SEQ ID NO: 349861

SEQ ID NO: 693506 - RNA, 63 nt, Homo Sapiens; identical to SEQ ID NO: 349862

SEQ ID NO: 693507 - RNA, 63 nt, Homo Sapiens; identical to SEQ ID NO: 349863

SEQ ID NO: 693508 - RNA, 63 nt, Homo Sapiens; identical to SEQ ID NO: 349864

SEQ ID NO: 693509 - RNA, 63 nt, Homo Sapiens; identical to SEQ ID NO: 349865

SEQ ID NO: 693510 - RNA, 63 nt, Homo Sapiens; identical to SEQ ID NO: 349866

SEQ ID NO: 693511 - RNA, 63 nt, Homo Sapiens; identical to SEQ ID NO: 349867

SEQ ID NO: 693512 - RNA, 63 nt, Homo Sapiens; identical to SEQ ID NO: 349868

SEQ ID NO: 693513 - RNA, 63 nt, Homo Sapiens; identical to SEQ ID NO: 349869

SEQ ID NO: 693514 - RNA, 63 nt, Homo Sapiens; identical to SEQ ID NO: 349870

SEQ ID NO: 693515 - RNA, 63 nt, Homo Sapiens; identical to SEQ ID NO: 349871

SEQ ID NO: 693516 - RNA, 63 nt, Homo Sapiens; identical to SEQ ID NO: 349872

SEQ ID NO: 693517 - RNA, 63 nt, Homo Sapiens; identical to SEQ ID NO: 349873

SEQ ID NO: 693518 - RNA, 63 nt, Homo Sapiens; identical to SEQ ID NO: 349874

SEQ ID NO: 693519 - RNA, 63 nt, Homo Sapiens; identical to SEQ ID NO: 349875

SEQ ID NO: 693520 - RNA, 63 nt, Homo Sapiens; identical to SEQ ID NO: 349876

SEQ ID NO: 693521 - RNA, 63 nt, Homo Sapiens; identical to SEQ ID NO: 349877

SEQ ID NO: 693522 - RNA, 63 nt, Homo Sapiens; identical to SEQ ID NO: 349878

SEQ ID NO: 693523 - RNA, 63 nt, Homo Sapiens; identical to SEQ ID NO: 349879

SEQ ID NO: 693524 - RNA, 63 nt, Homo Sapiens; identical to SEQ ID NO: 349880

SEQ ID NO: 693525 - RNA, 63 nt, Homo Sapiens; identical to SEQ ID NO: 349881

SEQ ID NO: 693526 - RNA, 63 nt, Homo Sapiens; identical to SEQ ID NO: 349882

SEQ ID NO: 693527 - RNA, 63 nt, Homo Sapiens; identical to SEQ ID NO: 349883

SEQ ID NO: 693528 - RNA, 63 nt, Homo Sapiens; identical to SEQ ID NO: 349884

SEQ ID NO: 693529 - RNA, 63 nt, Homo Sapiens; identical to SEQ ID NO: 349885

SEQ ID NO: 693530 - RNA, 63 nt, Homo Sapiens; identical to SEQ ID NO: 349886

SEQ ID NO: 693531 - RNA, 63 nt, Homo Sapiens; identical to SEQ ID NO: 349887

SEQ ID NO: 693532 - RNA, 63 nt, Homo Sapiens; identical to SEQ ID NO: 349888

SEQ ID NO: 693533 - RNA, 63 nt, Homo Sapiens; identical to SEQ ID NO: 349889

SEQ ID NO: 693534 - RNA, 63 nt, Homo Sapiens; identical to SEQ ID NO: 349890

SEQ ID NO: 693535 - RNA, 63 nt, Homo Sapiens; identical to SEQ ID NO: 349891

SEQ ID NO: 693536 - RNA, 63 nt, Homo Sapiens; identical to SEQ ID NO: 349892

SEQ ID NO: 693537 - RNA, 63 nt, Homo Sapiens; identical to SEQ ID NO: 349893

SEQ ID NO: 693538 - RNA, 63 nt, Homo Sapiens; identical to SEQ ID NO: 349894

SEQ ID NO: 693539 - RNA, 63 nt, Homo Sapiens; identical to SEQ ID NO: 349895

SEQ ID NO: 693540 - RNA, 63 nt, Homo Sapiens; identical to SEQ ID NO: 349896

SEQ ID NO: 693541 - RNA, 63 nt, Homo Sapiens; identical to SEQ ID NO: 349897

SEQ ID NO: 693542 - RNA, 63 nt, Homo Sapiens; identical to SEQ ID NO: 349898

SEQ ID NO: 693543 - RNA, 63 nt, Homo Sapiens; identical to SEQ ID NO: 349899

SEQ ID NO: 693544 - RNA, 63 nt, Homo Sapiens; identical to SEQ ID NO: 349900

SEQ ID NO: 693545 - RNA, 63 nt, Homo Sapiens; identical to SEQ ID NO: 349901

SEQ ID NO: 693546 - RNA, 63 nt, Homo Sapiens; identical to SEQ ID NO: 349902

SEQ ID NO: 693547 - RNA, 63 nt, Homo Sapiens; identical to SEQ ID NO: 349903

SEQ ID NO: 693548 - RNA, 63 nt, Homo Sapiens; identical to SEQ ID NO: 349904

SEQ ID NO: 693549 - RNA, 63 nt, Homo Sapiens; identical to SEQ ID NO: 349905

SEQ ID NO: 693550 - RNA, 63 nt, Homo Sapiens; identical to SEQ ID NO: 349906

SEQ ID NO: 693551 - RNA, 63 nt, Homo Sapiens; identical to SEQ ID NO: 349907

SEQ ID NO: 693552 - RNA, 63 nt, Homo Sapiens; identical to SEQ ID NO: 349908

SEQ ID NO: 693553 - RNA, 63 nt, Homo Sapiens; identical to SEQ ID NO: 349909

SEQ ID NO: 693554 - RNA, 63 nt, Homo Sapiens; identical to SEQ ID NO: 349910

SEQ ID NO: 693555 - RNA, 63 nt, Homo Sapiens; identical to SEQ ID NO: 349911

SEQ ID NO: 693556 - RNA, 63 nt, Homo Sapiens; identical to SEQ ID NO: 349912

SEQ ID NO: 693557 - RNA, 63 nt, Homo Sapiens; identical to SEQ ID NO: 349913

SEQ ID NO: 693558 - RNA, 63 nt, Homo Sapiens; identical to SEQ ID NO: 349914

SEQ ID NO: 693559 - RNA, 63 nt, Homo Sapiens; identical to SEQ ID NO: 349915

SEQ ID NO: 693560 - RNA, 63 nt, Homo Sapiens; identical to SEQ ID NO: 349916

SEQ ID NO: 693561 - RNA, 63 nt, Homo Sapiens; identical to SEQ ID NO: 349917

SEQ ID NO: 693562 - RNA, 63 nt, Homo Sapiens; identical to SEQ ID NO: 349918

SEQ ID NO: 693563 - RNA, 63 nt, Homo Sapiens; identical to SEQ ID NO: 349919

SEQ ID NO: 693564 - RNA, 63 nt, Homo Sapiens; identical to SEQ ID NO: 349920

SEQ ID NO: 693565 - RNA, 63 nt, Homo Sapiens; identical to SEQ ID NO: 349921

SEQ ID NO: 693566 - RNA, 63 nt, Homo Sapiens; identical to SEQ ID NO: 349922

SEQ ID NO: 693567 - RNA, 63 nt, Homo Sapiens; identical to SEQ ID NO: 349923

SEQ ID NO: 693568 - RNA, 63 nt, Homo Sapiens; identical to SEQ ID NO: 349924

SEQ ID NO: 693569 - RNA, 63 nt, Homo Sapiens; identical to SEQ ID NO: 349925

SEQ ID NO: 693570 - RNA, 63 nt, Homo Sapiens; identical to SEQ ID NO: 349926

SEQ ID NO: 693571 - RNA, 63 nt, Homo Sapiens; identical to SEQ ID NO: 349927

SEQ ID NO: 693572 - RNA, 63 nt, Homo Sapiens; identical to SEQ ID NO: 349928

SEQ ID NO: 693573 - RNA, 63 nt, Homo Sapiens; identical to SEQ ID NO: 349929

SEQ ID NO: 693574 - RNA, 63 nt, Homo Sapiens; identical to SEQ ID NO: 349930

SEQ ID NO: 693575 - RNA, 63 nt, Homo Sapiens; identical to SEQ ID NO: 349931

SEQ ID NO: 693576 - RNA, 63 nt, Homo Sapiens; identical to SEQ ID NO: 349932

SEQ ID NO: 693577 - RNA, 63 nt, Homo Sapiens; identical to SEQ ID NO: 349933

SEQ ID NO: 693578 - RNA, 63 nt, Homo Sapiens; identical to SEQ ID NO: 349934

SEQ ID NO: 693579 - RNA, 63 nt, Homo Sapiens; identical to SEQ ID NO: 349935

SEQ ID NO: 693580 - RNA, 63 nt, Homo Sapiens; identical to SEQ ID NO: 349936

SEQ ID NO: 693581 - RNA, 63 nt, Homo Sapiens; identical to SEQ ID NO: 349937

SEQ ID NO: 693582 - RNA, 63 nt, Homo Sapiens; identical to SEQ ID NO: 349938

SEQ ID NO: 693583 - RNA, 63 nt, Homo Sapiens; identical to SEQ ID NO: 349939

SEQ ID NO: 693584 - RNA, 63 nt, Homo Sapiens; identical to SEQ ID NO: 349940

SEQ ID NO: 693585 - RNA, 63 nt, Homo Sapiens; identical to SEQ ID NO: 349941

SEQ ID NO: 693586 - RNA, 63 nt, Homo Sapiens; identical to SEQ ID NO: 349942

SEQ ID NO: 693587 - RNA, 63 nt, Homo Sapiens; identical to SEQ ID NO: 349943

SEQ ID NO: 693588 - RNA, 63 nt, Homo Sapiens; identical to SEQ ID NO: 349944

SEQ ID NO: 693589 - RNA, 63 nt, Homo Sapiens; identical to SEQ ID NO: 349945

SEQ ID NO: 693590 - RNA, 63 nt, Homo Sapiens; identical to SEQ ID NO: 349946

SEQ ID NO: 693591 - RNA, 63 nt, Homo Sapiens; identical to SEQ ID NO: 349947

SEQ ID NO: 693592 - RNA, 63 nt, Homo Sapiens; identical to SEQ ID NO: 349948

SEQ ID NO: 693593 - RNA, 63 nt, Homo Sapiens; identical to SEQ ID NO: 349949

SEQ ID NO: 693594 - RNA, 63 nt, Homo Sapiens; identical to SEQ ID NO: 349950

SEQ ID NO: 693595 - RNA, 52 nt, Homo Sapiens; identical to SEQ ID NO: 349951

SEQ ID NO: 693596 - RNA, 63 nt, Homo Sapiens; identical to SEQ ID NO: 349952

SEQ ID NO: 693597 - RNA, 63 nt, Homo Sapiens; identical to SEQ ID NO: 349953

SEQ ID NO: 693598 - RNA, 63 nt, Homo Sapiens; identical to SEQ ID NO: 349954

SEQ ID NO: 693599 - RNA, 63 nt, Homo Sapiens; identical to SEQ ID NO: 349955

SEQ ID NO: 693600 - RNA, 63 nt, Homo Sapiens; identical to SEQ ID NO: 349956

SEQ ID NO: 693601 - RNA, 63 nt, Homo Sapiens; identical to SEQ ID NO: 349957

SEQ ID NO: 693602 - RNA, 63 nt, Homo Sapiens; identical to SEQ ID NO: 349958

SEQ ID NO: 693603 - RNA, 63 nt, Homo Sapiens; identical to SEQ ID NO: 349958

SEQ ID NO: 693604 - RNA, 63 nt, Homo Sapiens; identical to SEQ ID NO: 349960

SEQ ID NO: 693605 - RNA, 63 nt, Homo Sapiens; identical to SEQ ID NO: 349961

SEQ ID NO: 693606 - RNA, 63 nt, Homo Sapiens; identical to SEQ ID NO: 349962

SEQ ID NO: 693607 - RNA, 63 nt, Homo Sapiens; identical to SEQ ID NO: 349963

SEQ ID NO: 693608 - RNA, 63 nt, Homo Sapiens; identical to SEQ ID NO: 349964

SEQ ID NO: 693609 - RNA, 63 nt, Homo Sapiens; identical to SEQ ID NO: 349965

SEQ ID NO: 693610 - RNA, 63 nt, Homo Sapiens; identical to SEQ ID NO: 349966

SEQ ID NO: 693611 - RNA, 63 nt, Homo Sapiens; identical to SEQ ID NO: 349967

SEQ ID NO: 693612 - RNA, 63 nt, Homo Sapiens; identical to SEQ ID NO: 349968

SEQ ID NO: 693613 - RNA, 63 nt, Homo Sapiens; identical to SEQ ID NO: 349969

SEQ ID NO: 693614 - RNA, 63 nt, Homo Sapiens; identical to SEQ ID NO: 349970

SEQ ID NO: 693615 - RNA, 63 nt, Homo Sapiens; identical to SEQ ID NO: 349971

SEQ ID NO: 693616 - RNA, 63 nt, Homo Sapiens; identical to SEQ ID NO: 349972

SEQ ID NO: 693617 - RNA, 63 nt, Homo Sapiens; identical to SEQ ID NO: 349973

SEQ ID NO: 693618 - RNA, 63 nt, Homo Sapiens; identical to SEQ ID NO: 349974

SEQ ID NO: 693619 - RNA, 63 nt, Homo Sapiens; identical to SEQ ID NO: 349975

SEQ ID NO: 693620 - RNA, 63 nt, Homo Sapiens; identical to SEQ ID NO: 349976

SEQ ID NO: 693621 - RNA, 63 nt, Homo Sapiens; identical to SEQ ID NO: 349977

SEQ ID NO: 693622 - RNA, 63 nt, Homo Sapiens; identical to SEQ ID NO: 349978

SEQ ID NO: 693623 - RNA, 63 nt, Homo Sapiens; identical to SEQ ID NO: 349979

SEQ ID NO: 693624 - RNA, 63 nt, Homo Sapiens; identical to SEQ ID NO: 349980

SEQ ID NO: 693625 - RNA, 63 nt, Homo Sapiens; identical to SEQ ID NO: 349981

SEQ ID NO: 693626 - RNA, 63 nt, Homo Sapiens; identical to SEQ ID NO: 349982

SEQ ID NO: 693627 - RNA, 63 nt, Homo Sapiens; identical to SEQ ID NO: 349983

SEQ ID NO: 693628 - RNA, 63 nt, Homo Sapiens; identical to SEQ ID NO: 349984

SEQ ID NO: 693629 - RNA, 63 nt, Homo Sapiens; identical to SEQ ID NO: 349985

SEQ ID NO: 693630 - RNA, 63 nt, Homo Sapiens; identical to SEQ ID NO: 349986

SEQ ID NO: 693631 - RNA, 63 nt, Homo Sapiens; identical to SEQ ID NO: 349987

SEQ ID NO: 693632 - RNA, 63 nt, Homo Sapiens; identical to SEQ ID NO: 349988

SEQ ID NO: 693633 - RNA, 63 nt, Homo Sapiens; identical to SEQ ID NO: 349989

SEQ ID NO: 693634 - RNA, 63 nt, Homo Sapiens; identical to SEQ ID NO: 349990

SEQ ID NO: 693635 - RNA, 63 nt, Homo Sapiens; identical to SEQ ID NO: 349991

SEQ ID NO: 693636 - RNA, 63 nt, Homo Sapiens; identical to SEQ ID NO: 349992

SEQ ID NO: 693637 - RNA, 63 nt, Homo Sapiens; identical to SEQ ID NO: 349993

SEQ ID NO: 693638 - RNA, 63 nt, Homo Sapiens; identical to SEQ ID NO: 349994

SEQ ID NO: 693639 - RNA, 63 nt, Homo Sapiens; identical to SEQ ID NO: 349995

SEQ ID NO: 693640 - RNA, 63 nt, Homo Sapiens; identical to SEQ ID NO: 349996

SEQ ID NO: 693641 - RNA, 63 nt, Homo Sapiens; identical to SEQ ID NO: 349997

SEQ ID NO: 693642 - RNA, 63 nt, Homo Sapiens; identical to SEQ ID NO: 349998

SEQ ID NO: 693643 - RNA, 63 nt, Homo Sapiens; identical to SEQ ID NO: 349999

SEQ ID NO: 693644 - RNA, 63 nt, Homo Sapiens; identical to SEQ ID NO: 350000

SEQ ID NO: 693645 - RNA, 63 nt, Homo Sapiens; identical to SEQ ID NO: 350001

SEQ ID NO: 693646 - RNA, 63 nt, Homo Sapiens; identical to SEQ ID NO: 350002

SEQ ID NO: 693647 - RNA, 63 nt, Homo Sapiens; identical to SEQ ID NO: 350003

SEQ ID NO: 693648 - RNA, 63 nt, Homo Sapiens; identical to SEQ ID NO: 350004

SEQ ID NO: 693649 - RNA, 63 nt, Homo Sapiens; identical to SEQ ID NO: 350005

SEQ ID NO: 693650 - RNA, 63 nt, Homo Sapiens; identical to SEQ ID NO: 350006

SEQ ID NO: 693651 - RNA, 63 nt, Homo Sapiens; identical to SEQ ID NO: 350007

SEQ ID NO: 693652 - RNA, 63 nt, Homo Sapiens; identical to SEQ ID NO: 350008

SEQ ID NO: 693653 - RNA, 63 nt, Homo Sapiens; identical to SEQ ID NO: 350009

SEQ ID NO: 693654 - RNA, 63 nt, Homo Sapiens; identical to SEQ ID NO: 350010

SEQ ID NO: 693655 - RNA, 63 nt, Homo Sapiens; identical to SEQ ID NO: 350011

SEQ ID NO: 693656 - RNA, 63 nt, Homo Sapiens; identical to SEQ ID NO: 350012

SEQ ID NO: 693657 - RNA, 63 nt, Homo Sapiens; identical to SEQ ID NO: 350013

SEQ ID NO: 693658 - RNA, 63 nt, Homo Sapiens; identical to SEQ ID NO: 350014

SEQ ID NO: 693659 - RNA, 63 nt, Homo Sapiens; identical to SEQ ID NO: 350015

SEQ ID NO: 693660 - RNA, 63 nt, Homo Sapiens; identical to SEQ ID NO: 350016

SEQ ID NO: 693661 - RNA, 63 nt, Homo Sapiens; identical to SEQ ID NO: 350017

SEQ ID NO: 693662 - RNA, 63 nt, Homo Sapiens; identical to SEQ ID NO: 350018

SEQ ID NO: 693663 - RNA, 63 nt, Homo Sapiens; identical to SEQ ID NO: 350019

SEQ ID NO: 693664 - RNA, 63 nt, Homo Sapiens; identical to SEQ ID NO: 350020

SEQ ID NO: 693665 - RNA, 63 nt, Homo Sapiens; identical to SEQ ID NO: 350021

SEQ ID NO: 693666 - RNA, 63 nt, Homo Sapiens; identical to SEQ ID NO: 350022

SEQ ID NO: 693667 - RNA, 63 nt, Homo Sapiens; identical to SEQ ID NO: 350023

SEQ ID NO: 693668 - RNA, 63 nt, Homo Sapiens; identical to SEQ ID NO: 350024

SEQ ID NO: 693669 - RNA, 63 nt, Homo Sapiens; identical to SEQ ID NO: 350025

SEQ ID NO: 693670 - RNA, 63 nt, Homo Sapiens; identical to SEQ ID NO: 350026

SEQ ID NO: 693671 - RNA, 63 nt, Homo Sapiens; identical to SEQ ID NO: 350027

SEQ ID NO: 693672 - RNA, 63 nt, Homo Sapiens; identical to SEQ ID NO: 350028

SEQ ID NO: 693673 - RNA, 63 nt, Homo Sapiens; identical to SEQ ID NO: 350029

SEQ ID NO: 693674 - RNA, 63 nt, Homo Sapiens; identical to SEQ ID NO: 350030

SEQ ID NO: 693675 - RNA, 63 nt, Homo Sapiens; identical to SEQ ID NO: 350031

SEQ ID NO: 693676 - RNA, 63 nt, Homo Sapiens; identical to SEQ ID NO: 350032

SEQ ID NO: 693677 - RNA, 63 nt, Homo Sapiens; identical to SEQ ID NO: 350033

SEQ ID NO: 693678 - RNA, 63 nt, Homo Sapiens; identical to SEQ ID NO: 350034

SEQ ID NO: 693679 - RNA, 63 nt, Homo Sapiens; identical to SEQ ID NO: 350035

SEQ ID NO: 693680 - RNA, 63 nt, Homo Sapiens; identical to SEQ ID NO: 350036

SEQ ID NO: 693681 - RNA, 63 nt, Homo Sapiens; identical to SEQ ID NO: 350037

SEQ ID NO: 693682 - RNA, 63 nt, Homo Sapiens; identical to SEQ ID NO: 350038

SEQ ID NO: 693683 - RNA, 63 nt, Homo Sapiens; identical to SEQ ID NO: 350039

SEQ ID NO: 693684 - RNA, 63 nt, Homo Sapiens; identical to SEQ ID NO: 350040

SEQ ID NO: 693685 - RNA, 63 nt, Homo Sapiens; identical to SEQ ID NO: 350041

SEQ ID NO: 693686 - RNA, 63 nt, Homo Sapiens; identical to SEQ ID NO: 350042

SEQ ID NO: 693687 - RNA, 63 nt, Homo Sapiens; identical to SEQ ID NO: 350043

SEQ ID NO: 693688 - RNA, 63 nt, Homo Sapiens; identical to SEQ ID NO: 350044

SEQ ID NO: 693689 - RNA, 63 nt, Homo Sapiens; identical to SEQ ID NO: 350045

SEQ ID NO: 693690 - RNA, 63 nt, Homo Sapiens; identical to SEQ ID NO: 350046

SEQ ID NO: 693691 - RNA, 63 nt, Homo Sapiens; identical to SEQ ID NO: 350047

SEQ ID NO: 693692 - RNA, 63 nt, Homo Sapiens; identical to SEQ ID NO: 350048

SEQ ID NO: 693693 - RNA, 63 nt, Homo Sapiens; identical to SEQ ID NO: 350049

SEQ ID NO: 693694 - RNA, 63 nt, Homo Sapiens; identical to SEQ ID NO: 350050

SEQ ID NO: 693695 - RNA, 63 nt, Homo Sapiens; identical to SEQ ID NO: 350051

SEQ ID NO: 693696 - RNA, 63 nt, Homo Sapiens; identical to SEQ ID NO: 350052

SEQ ID NO: 693697 - RNA, 63 nt, Homo Sapiens; identical to SEQ ID NO: 350053

SEQ ID NO: 693698 - RNA, 63 nt, Homo Sapiens; identical to SEQ ID NO: 350054

SEQ ID NO: 693699 - RNA, 63 nt, Homo Sapiens; identical to SEQ ID NO: 350055

SEQ ID NO: 693700 - RNA, 63 nt, Homo Sapiens; identical to SEQ ID NO: 350056

SEQ ID NO: 693701 - RNA, 63 nt, Homo Sapiens; identical to SEQ ID NO: 350057

SEQ ID NO: 693702 - RNA, 63 nt, Homo Sapiens; identical to SEQ ID NO: 350058

SEQ ID NO: 693703 - RNA, 63 nt, Homo Sapiens; identical to SEQ ID NO: 350059

SEQ ID NO: 693704 - RNA, 63 nt, Homo Sapiens; identical to SEQ ID NO: 350060

SEQ ID NO: 693705 - RNA, 63 nt, Homo Sapiens; identical to SEQ ID NO: 350061

SEQ ID NO: 693706 - RNA, 63 nt, Homo Sapiens; identical to SEQ ID NO: 350062

SEQ ID NO: 693707 - RNA, 63 nt, Homo Sapiens; identical to SEQ ID NO: 350063

SEQ ID NO: 693708 - RNA, 63 nt, Homo Sapiens; identical to SEQ ID NO: 350064

SEQ ID NO: 693709 - RNA, 63 nt, Homo Sapiens; identical to SEQ ID NO: 350065

SEQ ID NO: 693710 - RNA, 63 nt, Homo Sapiens; identical to SEQ ID NO: 350066

SEQ ID NO: 693711 - RNA, 63 nt, Homo Sapiens; identical to SEQ ID NO: 350067

SEQ ID NO: 693712 - RNA, 63 nt, Homo Sapiens; identical to SEQ ID NO: 350068

SEQ ID NO: 693713 - RNA, 63 nt, Homo Sapiens; identical to SEQ ID NO: 350069

SEQ ID NO: 693714 - RNA, 63 nt, Homo Sapiens; identical to SEQ ID NO: 350070

SEQ ID NO: 693715 - RNA, 63 nt, Homo Sapiens; identical to SEQ ID NO: 350071

SEQ ID NO: 693716 - RNA, 63 nt, Homo Sapiens; identical to SEQ ID NO: 350072

SEQ ID NO: 693717 - RNA, 63 nt, Homo Sapiens; identical to SEQ ID NO: 350073

SEQ ID NO: 693718 - RNA, 63 nt, Homo Sapiens; identical to SEQ ID NO: 350074

SEQ ID NO: 693719 - RNA, 63 nt, Homo Sapiens; identical to SEQ ID NO: 350075

SEQ ID NO: 693720 - RNA, 62 nt, Homo Sapiens; identical to SEQ ID NO: 350076

SEQ ID NO: 693721 - RNA, 63 nt, Homo Sapiens; identical to SEQ ID NO: 350077

SEQ ID NO: 693722 - RNA, 63 nt, Homo Sapiens; identical to SEQ ID NO: 350078

SEQ ID NO: 693723 - RNA, 63 nt, Homo Sapiens; identical to SEQ ID NO: 350079

SEQ ID NO: 693724 - RNA, 63 nt, Homo Sapiens; identical to SEQ ID NO: 350080

SEQ ID NO: 693725 - RNA, 63 nt, Homo Sapiens; identical to SEQ ID NO: 350081

SEQ ID NO: 693726 - RNA, 63 nt, Homo Sapiens; identical to SEQ ID NO: 350082

SEQ ID NO: 693727 - RNA, 63 nt, Homo Sapiens; identical to SEQ ID NO: 350083

SEQ ID NO: 693728 - RNA, 63 nt, Homo Sapiens; identical to SEQ ID NO: 350084

SEQ ID NO: 693729 - RNA, 63 nt, Homo Sapiens; identical to SEQ ID NO: 350085

SEQ ID NO: 693730 - RNA, 63 nt, Homo Sapiens; identical to SEQ ID NO: 350086

SEQ ID NO: 693731 - RNA, 63 nt, Homo Sapiens; identical to SEQ ID NO: 350087

SEQ ID NO: 693732 - RNA, 63 nt, Homo Sapiens; identical to SEQ ID NO: 350088

SEQ ID NO: 693733 - RNA, 63 nt, Homo Sapiens; identical to SEQ ID NO: 350089

SEQ ID NO: 693734 - RNA, 63 nt, Homo Sapiens; identical to SEQ ID NO: 350090

SEQ ID NO: 693735 - RNA, 63 nt, Homo Sapiens; identical to SEQ ID NO: 350091

SEQ ID NO: 693736 - RNA, 63 nt, Homo Sapiens; identical to SEQ ID NO: 350092

SEQ ID NO: 693737 - RNA, 63 nt, Homo Sapiens; identical to SEQ ID NO: 350093

SEQ ID NO: 693738 - RNA, 63 nt, Homo Sapiens; identical to SEQ ID NO: 350094

SEQ ID NO: 693739 - RNA, 63 nt, Homo Sapiens; identical to SEQ ID NO: 350095

SEQ ID NO: 693740 - RNA, 63 nt, Homo Sapiens; identical to SEQ ID NO: 350096

SEQ ID NO: 693741 - RNA, 63 nt, Homo Sapiens; identical to SEQ ID NO: 350097

SEQ ID NO: 693742 - RNA, 63 nt, Homo Sapiens; identical to SEQ ID NO: 350098

SEQ ID NO: 693743 - RNA, 63 nt, Homo Sapiens; identical to SEQ ID NO: 350099

SEQ ID NO: 693744 - RNA, 63 nt, Homo Sapiens; identical to SEQ ID NO: 350100

SEQ ID NO: 693745 - RNA, 63 nt, Homo Sapiens; identical to SEQ ID NO: 350101

SEQ ID NO: 693746 - RNA, 63 nt, Homo Sapiens; identical to SEQ ID NO: 350102

SEQ ID NO: 693747 - RNA, 63 nt, Homo Sapiens; identical to SEQ ID NO: 350103

SEQ ID NO: 693748 - RNA, 63 nt, Homo Sapiens; identical to SEQ ID NO: 350104

SEQ ID NO: 693749 - RNA, 63 nt, Homo Sapiens; identical to SEQ ID NO: 350105

SEQ ID NO: 693750 - RNA, 63 nt, Homo Sapiens; identical to SEQ ID NO: 350106

SEQ ID NO: 693751 - RNA, 63 nt, Homo Sapiens; identical to SEQ ID NO: 350107

SEQ ID NO: 693752 - RNA, 63 nt, Homo Sapiens; identical to SEQ ID NO: 350108

SEQ ID NO: 693753 - RNA, 63 nt, Homo Sapiens; identical to SEQ ID NO: 350109

SEQ ID NO: 693754 - RNA, 63 nt, Homo Sapiens; identical to SEQ ID NO: 350110

SEQ ID NO: 693755 - RNA, 63 nt, Homo Sapiens; identical to SEQ ID NO: 350111

SEQ ID NO: 693756 - RNA, 63 nt, Homo Sapiens; identical to SEQ ID NO: 350112

SEQ ID NO: 693757 - RNA, 63 nt, Homo Sapiens; identical to SEQ ID NO: 350113

SEQ ID NO: 693758 - RNA, 63 nt, Homo Sapiens; identical to SEQ ID NO: 350114

SEQ ID NO: 693759 - RNA, 63 nt, Homo Sapiens; identical to SEQ ID NO: 350115

SEQ ID NO: 693760 - RNA, 63 nt, Homo Sapiens; identical to SEQ ID NO: 350116

SEQ ID NO: 693761 - RNA, 63 nt, Homo Sapiens; identical to SEQ ID NO: 350117

SEQ ID NO: 693762 - RNA, 63 nt, Homo Sapiens; identical to SEQ ID NO: 350118

SEQ ID NO: 693763 - RNA, 63 nt, Homo Sapiens; identical to SEQ ID NO: 350119

SEQ ID NO: 693764 - RNA, 63 nt, Homo Sapiens; identical to SEQ ID NO: 350120

SEQ ID NO: 693765 - RNA, 63 nt, Homo Sapiens; identical to SEQ ID NO: 350121

SEQ ID NO: 693766 - RNA, 63 nt, Homo Sapiens; identical to SEQ ID NO: 350122

SEQ ID NO: 693767 - RNA, 63 nt, Homo Sapiens; identical to SEQ ID NO: 350123

SEQ ID NO: 693768 - RNA, 63 nt, Homo Sapiens; identical to SEQ ID NO: 350124

SEQ ID NO: 693769 - RNA, 63 nt, Homo Sapiens; identical to SEQ ID NO: 350125

SEQ ID NO: 693770 - RNA, 63 nt, Homo Sapiens; identical to SEQ ID NO: 350126

SEQ ID NO: 693771 - RNA, 63 nt, Homo Sapiens; identical to SEQ ID NO: 350127

SEQ ID NO: 693772 - RNA, 63 nt, Homo Sapiens; identical to SEQ ID NO: 350128

SEQ ID NO: 693773 - RNA, 63 nt, Homo Sapiens; identical to SEQ ID NO: 350129

SEQ ID NO: 693774 - RNA, 63 nt, Homo Sapiens; identical to SEQ ID NO: 350130

SEQ ID NO: 693775 - RNA, 63 nt, Homo Sapiens; identical to SEQ ID NO: 350131

SEQ ID NO: 693776 - RNA, 63 nt, Homo Sapiens; identical to SEQ ID NO: 350132

SEQ ID NO: 693777 - RNA, 63 nt, Homo Sapiens; identical to SEQ ID NO: 350133

SEQ ID NO: 693778 - RNA, 63 nt, Homo Sapiens; identical to SEQ ID NO: 350134

SEQ ID NO: 693779 - RNA, 63 nt, Homo Sapiens; identical to SEQ ID NO: 350135

SEQ ID NO: 693780 - RNA, 63 nt, Homo Sapiens; identical to SEQ ID NO: 350136

SEQ ID NO: 693781 - RNA, 63 nt, Homo Sapiens; identical to SEQ ID NO: 350137

SEQ ID NO: 693782 - RNA, 63 nt, Homo Sapiens; identical to SEQ ID NO: 350138

SEQ ID NO: 693783 - RNA, 63 nt, Homo Sapiens; identical to SEQ ID NO: 350139

SEQ ID NO: 693784 - RNA, 63 nt, Homo Sapiens; identical to SEQ ID NO: 350140

SEQ ID NO: 693785 - RNA, 63 nt, Homo Sapiens; identical to SEQ ID NO: 350141

SEQ ID NO: 693786 - RNA, 63 nt, Homo Sapiens; identical to SEQ ID NO: 350142

SEQ ID NO: 693787 - RNA, 63 nt, Homo Sapiens; identical to SEQ ID NO: 350143

SEQ ID NO: 693788 - RNA, 63 nt, Homo Sapiens; identical to SEQ ID NO: 350144

SEQ ID NO: 693789 - RNA, 63 nt, Homo Sapiens; identical to SEQ ID NO: 350145

SEQ ID NO: 693790 - RNA, 63 nt, Homo Sapiens; identical to SEQ ID NO: 350146

SEQ ID NO: 693791 - RNA, 63 nt, Homo Sapiens; identical to SEQ ID NO: 350147

SEQ ID NO: 693792 - RNA, 63 nt, Homo Sapiens; identical to SEQ ID NO: 350148

SEQ ID NO: 693793 - RNA, 63 nt, Homo Sapiens; identical to SEQ ID NO: 350149

SEQ ID NO: 693794 - RNA, 63 nt, Homo Sapiens; identical to SEQ ID NO: 350150

SEQ ID NO: 693795 - RNA, 63 nt, Homo Sapiens; identical to SEQ ID NO: 350151

SEQ ID NO: 693796 - RNA, 63 nt, Homo Sapiens; identical to SEQ ID NO: 350152

SEQ ID NO: 693797 - RNA, 63 nt, Homo Sapiens; identical to SEQ ID NO: 350153

SEQ ID NO: 693798 - RNA, 60 nt, Homo Sapiens; identical to SEQ ID NO: 350154

SEQ ID NO: 693799 - RNA, 63 nt, Homo Sapiens; identical to SEQ ID NO: 350155

SEQ ID NO: 693800 - RNA, 63 nt, Homo Sapiens; identical to SEQ ID NO: 350156

SEQ ID NO: 693801 - RNA, 63 nt, Homo Sapiens; identical to SEQ ID NO: 350157

SEQ ID NO: 693802 - RNA, 63 nt, Homo Sapiens; identical to SEQ ID NO: 350158

SEQ ID NO: 693803 - RNA, 63 nt, Homo Sapiens; identical to SEQ ID NO: 350159

SEQ ID NO: 693804 - RNA, 63 nt, Homo Sapiens; identical to SEQ ID NO: 350160

SEQ ID NO: 693805 - RNA, 63 nt, Homo Sapiens; identical to SEQ ID NO: 350161

SEQ ID NO: 693806 - RNA, 63 nt, Homo Sapiens; identical to SEQ ID NO: 350162

SEQ ID NO: 693807 - RNA, 63 nt, Homo Sapiens; identical to SEQ ID NO: 350163

SEQ ID NO: 693808 - RNA, 63 nt, Homo Sapiens; identical to SEQ ID NO: 350164

SEQ ID NO: 693809 - RNA, 63 nt, Homo Sapiens; identical to SEQ ID NO: 350165

SEQ ID NO: 693810 - RNA, 63 nt, Homo Sapiens; identical to SEQ ID NO: 350166

SEQ ID NO: 693811 - RNA, 63 nt, Homo Sapiens; identical to SEQ ID NO: 350167

SEQ ID NO: 693812 - RNA, 63 nt, Homo Sapiens; identical to SEQ ID NO: 350168

SEQ ID NO: 693813 - RNA, 63 nt, Homo Sapiens; identical to SEQ ID NO: 350169

SEQ ID NO: 693814 - RNA, 63 nt, Homo Sapiens; identical to SEQ ID NO: 350170

SEQ ID NO: 693815 - RNA, 63 nt, Homo Sapiens; identical to SEQ ID NO: 350171

SEQ ID NO: 693816 - RNA, 63 nt, Homo Sapiens; identical to SEQ ID NO: 350172

SEQ ID NO: 693817 - RNA, 63 nt, Homo Sapiens; identical to SEQ ID NO: 350173

SEQ ID NO: 693818 - RNA, 63 nt, Homo Sapiens; identical to SEQ ID NO: 350174

SEQ ID NO: 693819 - RNA, 63 nt, Homo Sapiens; identical to SEQ ID NO: 350175

SEQ ID NO: 693820 - RNA, 63 nt, Homo Sapiens; identical to SEQ ID NO: 350176

SEQ ID NO: 693821 - RNA, 63 nt, Homo Sapiens; identical to SEQ ID NO: 350177

SEQ ID NO: 693822 - RNA, 63 nt, Homo Sapiens; identical to SEQ ID NO: 350178

SEQ ID NO: 693823 - RNA, 63 nt, Homo Sapiens; identical to SEQ ID NO: 350179

SEQ ID NO: 693824 - RNA, 63 nt, Homo Sapiens; identical to SEQ ID NO: 350180

SEQ ID NO: 693825 - RNA, 63 nt, Homo Sapiens; identical to SEQ ID NO: 350181

SEQ ID NO: 693826 - RNA, 63 nt, Homo Sapiens; identical to SEQ ID NO: 350182

SEQ ID NO: 693827 - RNA, 63 nt, Homo Sapiens; identical to SEQ ID NO: 350183

SEQ ID NO: 693828 - RNA, 63 nt, Homo Sapiens; identical to SEQ ID NO: 350184

SEQ ID NO: 693829 - RNA, 63 nt, Homo Sapiens; identical to SEQ ID NO: 350184

SEQ ID NO: 693830 - RNA, 63 nt, Homo Sapiens; identical to SEQ ID NO: 350186

SEQ ID NO: 693831 - RNA, 63 nt, Homo Sapiens; identical to SEQ ID NO: 350187

SEQ ID NO: 693832 - RNA, 63 nt, Homo Sapiens; identical to SEQ ID NO: 350188

SEQ ID NO: 693833 - RNA, 63 nt, Homo Sapiens; identical to SEQ ID NO: 350189

SEQ ID NO: 693834 - RNA, 63 nt, Homo Sapiens; identical to SEQ ID NO: 350190

SEQ ID NO: 693835 - RNA, 63 nt, Homo Sapiens; identical to SEQ ID NO: 350191

SEQ ID NO: 693836 - RNA, 63 nt, Homo Sapiens; identical to SEQ ID NO: 350192

SEQ ID NO: 693837 - RNA, 63 nt, Homo Sapiens; identical to SEQ ID NO: 350193

SEQ ID NO: 693838 - RNA, 63 nt, Homo Sapiens; identical to SEQ ID NO: 350194

SEQ ID NO: 693839 - RNA, 63 nt, Homo Sapiens; identical to SEQ ID NO: 350195

SEQ ID NO: 693840 - RNA, 63 nt, Homo Sapiens; identical to SEQ ID NO: 350196

SEQ ID NO: 693841 - RNA, 63 nt, Homo Sapiens; identical to SEQ ID NO: 350197

SEQ ID NO: 693842 - RNA, 63 nt, Homo Sapiens; identical to SEQ ID NO: 350198

SEQ ID NO: 693843 - RNA, 63 nt, Homo Sapiens; identical to SEQ ID NO: 350199

SEQ ID NO: 693844 - RNA, 63 nt, Homo Sapiens; identical to SEQ ID NO: 350200

SEQ ID NO: 693845 - RNA, 63 nt, Homo Sapiens; identical to SEQ ID NO: 350201

SEQ ID NO: 693846 - RNA, 63 nt, Homo Sapiens; identical to SEQ ID NO: 350202

SEQ ID NO: 693847 - RNA, 61 nt, Homo Sapiens; identical to SEQ ID NO: 350203

SEQ ID NO: 693848 - RNA, 63 nt, Homo Sapiens; identical to SEQ ID NO: 350204

SEQ ID NO: 693849 - RNA, 63 nt, Homo Sapiens; identical to SEQ ID NO: 350205

SEQ ID NO: 693850 - RNA, 63 nt, Homo Sapiens; identical to SEQ ID NO: 350206

SEQ ID NO: 693851 - RNA, 63 nt, Homo Sapiens; identical to SEQ ID NO: 350207

SEQ ID NO: 693852 - RNA, 63 nt, Homo Sapiens; identical to SEQ ID NO: 350208

SEQ ID NO: 693853 - RNA, 63 nt, Homo Sapiens; identical to SEQ ID NO: 350209

SEQ ID NO: 693854 - RNA, 63 nt, Homo Sapiens; identical to SEQ ID NO: 350210

SEQ ID NO: 693855 - RNA, 63 nt, Homo Sapiens; identical to SEQ ID NO: 350211

SEQ ID NO: 693856 - RNA, 63 nt, Homo Sapiens; identical to SEQ ID NO: 350212

SEQ ID NO: 693857 - RNA, 63 nt, Homo Sapiens; identical to SEQ ID NO: 350213

SEQ ID NO: 693858 - RNA, 63 nt, Homo Sapiens; identical to SEQ ID NO: 350214

SEQ ID NO: 693859 - RNA, 63 nt, Homo Sapiens; identical to SEQ ID NO: 350215

SEQ ID NO: 693860 - RNA, 63 nt, Homo Sapiens; identical to SEQ ID NO: 350216

SEQ ID NO: 693861 - RNA, 63 nt, Homo Sapiens; identical to SEQ ID NO: 350217

SEQ ID NO: 693862 - RNA, 63 nt, Homo Sapiens; identical to SEQ ID NO: 350218

SEQ ID NO: 693863 - RNA, 63 nt, Homo Sapiens; identical to SEQ ID NO: 350219

SEQ ID NO: 693864 - RNA, 63 nt, Homo Sapiens; identical to SEQ ID NO: 350220

SEQ ID NO: 693865 - RNA, 63 nt, Homo Sapiens; identical to SEQ ID NO: 350221

SEQ ID NO: 693866 - RNA, 63 nt, Homo Sapiens; identical to SEQ ID NO: 350222

SEQ ID NO: 693867 - RNA, 63 nt, Homo Sapiens; identical to SEQ ID NO: 350223

SEQ ID NO: 693868 - RNA, 63 nt, Homo Sapiens; identical to SEQ ID NO: 350224

SEQ ID NO: 693869 - RNA, 63 nt, Homo Sapiens; identical to SEQ ID NO: 350225

SEQ ID NO: 693870 - RNA, 63 nt, Homo Sapiens; identical to SEQ ID NO: 350226

SEQ ID NO: 693871 - RNA, 63 nt, Homo Sapiens; identical to SEQ ID NO: 350227

SEQ ID NO: 693872 - RNA, 63 nt, Homo Sapiens; identical to SEQ ID NO: 350228

SEQ ID NO: 693873 - RNA, 63 nt, Homo Sapiens; identical to SEQ ID NO: 350229

SEQ ID NO: 693874 - RNA, 63 nt, Homo Sapiens; identical to SEQ ID NO: 350230

SEQ ID NO: 693875 - RNA, 63 nt, Homo Sapiens; identical to SEQ ID NO: 350231

SEQ ID NO: 693876 - RNA, 63 nt, Homo Sapiens; identical to SEQ ID NO: 350232

SEQ ID NO: 693877 - RNA, 63 nt, Homo Sapiens; identical to SEQ ID NO: 350233

SEQ ID NO: 693878 - RNA, 63 nt, Homo Sapiens; identical to SEQ ID NO: 350234

SEQ ID NO: 693879 - RNA, 63 nt, Homo Sapiens; identical to SEQ ID NO: 350234

SEQ ID NO: 693880 - RNA, 63 nt, Homo Sapiens; identical to SEQ ID NO: 350236

SEQ ID NO: 693881 - RNA, 64 nt, Homo Sapiens
augccgagucgcggcccugcucagccggaagaggcucccggaccuggauguacagggcagucuc

SEQ ID NO: 693882 - RNA, 64 nt, Homo Sapiens
ucauggcccccugcuuccugcuccuuggagcuggcucccggaccuugcccaccauccaugcagu

SEQ ID NO: 693883 - RNA, 64 nt, Homo Sapiens
ccagggagguggccauugccccagaccccaccaucucccggaccccuuggguucccugagcugu

SEQ ID NO: 693884 - RNA, 64 nt, Homo Sapiens
cugcagccuccugugguugggagagccccagaggcucccggagacaaaccugcuguuggcccgg

SEQ ID NO: 693885 - RNA, 64 nt, Homo Sapiens
augugaggaugcaaaagaaaugaugauaacauuuugagauaaggccaaggagacguggaguagg

SEQ ID NO: 693886 - RNA, 64 nt, Homo Sapiens
aaaucugagguuucccguugguuguuaauuugguugagauaaacauuccuuuuuaaggaaaagu

SEQ ID NO: 693887 - RNA, 64 nt, Homo Sapiens
uuuuccacuacacaacugccuuccugacagguucugagauaaguguuauguuuguagauagagu

SEQ ID NO: 693888 - RNA, 64 nt, Homo Sapiens
auauguauuuucuucuugaauuucacuggccuaaugagauaauacucuuaucuuuggcucuacc

SEQ ID NO: 693889 - RNA, 64 nt, Homo Sapiens
uuauacuggugagaaauccuagaaaucugaagagugagauaaagccuuuaaaugguugucacac

SEQ ID NO: 693890 - RNA, 64 nt, Homo Sapiens
gcucacacuuuauugcuaggaaagcauuuauacuugagauaaauuauacaaauauaaagacugu

SEQ ID NO: 693891 - RNA, 64 nt, Homo Sapiens; identical to SEQ ID NO: 271308

SEQ ID NO: 693892 - RNA, 64 nt, Homo Sapiens; identical to SEQ ID NO: 271309

SEQ ID NO: 693893 - RNA, 64 nt, Homo Sapiens; identical to SEQ ID NO: 271310

SEQ ID NO: 693894 - RNA, 64 nt, Homo Sapiens; identical to SEQ ID NO: 271311

SEQ ID NO: 693895 - RNA, 64 nt, Homo Sapiens; identical to SEQ ID NO: 271312

SEQ ID NO: 693896 - RNA, 64 nt, Homo Sapiens; identical to SEQ ID NO: 271313

SEQ ID NO: 693897 - RNA, 64 nt, Homo Sapiens; identical to SEQ ID NO: 271314

SEQ ID NO: 693898 - RNA, 64 nt, Homo Sapiens; identical to SEQ ID NO: 271315

SEQ ID NO: 693899 - RNA, 64 nt, Homo Sapiens; identical to SEQ ID NO: 271316

SEQ ID NO: 693900 - RNA, 64 nt, Homo Sapiens; identical to SEQ ID NO: 271317

SEQ ID NO: 693901 - RNA, 64 nt, Homo Sapiens; identical to SEQ ID NO: 271318

SEQ ID NO: 693902 - RNA, 64 nt, Homo Sapiens; identical to SEQ ID NO: 271319

SEQ ID NO: 693903 - RNA, 64 nt, Homo Sapiens; identical to SEQ ID NO: 271320

SEQ ID NO: 693904 - RNA, 64 nt, Homo Sapiens; identical to SEQ ID NO: 271321

SEQ ID NO: 693905 - RNA, 64 nt, Homo Sapiens; identical to SEQ ID NO: 271322

SEQ ID NO: 693906 - RNA, 64 nt, Homo Sapiens; identical to SEQ ID NO: 271323

SEQ ID NO: 693907 - RNA, 64 nt, Homo Sapiens; identical to SEQ ID NO: 271324

SEQ ID NO: 693908 - RNA, 64 nt, Homo Sapiens; identical to SEQ ID NO: 271325

SEQ ID NO: 693909 - RNA, 64 nt, Homo Sapiens; identical to SEQ ID NO: 271326

SEQ ID NO: 693910 - RNA, 64 nt, Homo Sapiens; identical to SEQ ID NO: 271327

SEQ ID NO: 693911 - RNA, 64 nt, Homo Sapiens; identical to SEQ ID NO: 271328

SEQ ID NO: 693912 - RNA, 64 nt, Homo Sapiens; identical to SEQ ID NO: 271329

SEQ ID NO: 693913 - RNA, 64 nt, Homo Sapiens; identical to SEQ ID NO: 271330

SEQ ID NO: 693914 - RNA, 64 nt, Homo Sapiens; identical to SEQ ID NO: 271331

SEQ ID NO: 693915 - RNA, 64 nt, Homo Sapiens; identical to SEQ ID NO: 271332

SEQ ID NO: 693916 - RNA, 64 nt, Homo Sapiens; identical to SEQ ID NO: 271333

SEQ ID NO: 693917 - RNA, 64 nt, Homo Sapiens; identical to SEQ ID NO: 271334

SEQ ID NO: 693918 - RNA, 64 nt, Homo Sapiens; identical to SEQ ID NO: 271335

SEQ ID NO: 693919 - RNA, 59 nt, Homo Sapiens; identical to SEQ ID NO: 271336

SEQ ID NO: 693920 - RNA, 64 nt, Homo Sapiens; identical to SEQ ID NO: 271337

SEQ ID NO: 693921 - RNA, 64 nt, Homo Sapiens; identical to SEQ ID NO: 271338

SEQ ID NO: 693922 - RNA, 64 nt, Homo Sapiens; identical to SEQ ID NO: 271339

SEQ ID NO: 693923 - RNA, 64 nt, Homo Sapiens; identical to SEQ ID NO: 271340

SEQ ID NO: 693924 - RNA, 64 nt, Homo Sapiens; identical to SEQ ID NO: 221220

SEQ ID NO: 693925 - RNA, 64 nt, Homo Sapiens; identical to SEQ ID NO: 221221

SEQ ID NO: 693926 - RNA, 64 nt, Homo Sapiens; identical to SEQ ID NO: 221222

SEQ ID NO: 693927 - RNA, 64 nt, Homo Sapiens; identical to SEQ ID NO: 221223

SEQ ID NO: 693928 - RNA, 64 nt, Homo Sapiens; identical to SEQ ID NO: 221224

SEQ ID NO: 693929 - RNA, 64 nt, Homo Sapiens; identical to SEQ ID NO: 221225

SEQ ID NO: 693930 - RNA, 64 nt, Homo Sapiens; identical to SEQ ID NO: 221226

SEQ ID NO: 693931 - RNA, 64 nt, Homo Sapiens; identical to SEQ ID NO: 221227

SEQ ID NO: 693932 - RNA, 64 nt, Homo Sapiens; identical to SEQ ID NO: 221228

SEQ ID NO: 693933 - RNA, 64 nt, Homo Sapiens; identical to SEQ ID NO: 221229

SEQ ID NO: 693934 - RNA, 64 nt, Homo Sapiens; identical to SEQ ID NO: 221230

SEQ ID NO: 693935 - RNA, 64 nt, Homo Sapiens; identical to SEQ ID NO: 221231

SEQ ID NO: 693936 - RNA, 64 nt, Homo Sapiens; identical to SEQ ID NO: 221232

SEQ ID NO: 693937 - RNA, 64 nt, Homo Sapiens; identical to SEQ ID NO: 221233

SEQ ID NO: 693938 - RNA, 64 nt, Homo Sapiens; identical to SEQ ID NO: 221234

SEQ ID NO: 693939 - RNA, 64 nt, Homo Sapiens; identical to SEQ ID NO: 221235

SEQ ID NO: 693940 - RNA, 64 nt, Homo Sapiens; identical to SEQ ID NO: 221236

SEQ ID NO: 693941 - RNA, 64 nt, Homo Sapiens; identical to SEQ ID NO: 221237

SEQ ID NO: 693942 - RNA, 64 nt, Homo Sapiens; identical to SEQ ID NO: 221238

SEQ ID NO: 693943 - RNA, 64 nt, Homo Sapiens; identical to SEQ ID NO: 221239

SEQ ID NO: 693944 - RNA, 64 nt, Homo Sapiens; identical to SEQ ID NO: 221240

SEQ ID NO: 693945 - RNA, 64 nt, Homo Sapiens; identical to SEQ ID NO: 221241

SEQ ID NO: 693946 - RNA, 64 nt, Homo Sapiens; identical to SEQ ID NO: 221242

SEQ ID NO: 693947 - RNA, 64 nt, Homo Sapiens; identical to SEQ ID NO: 221243

SEQ ID NO: 693948 - RNA, 64 nt, Homo Sapiens; identical to SEQ ID NO: 221244

SEQ ID NO: 693949 - RNA, 64 nt, Homo Sapiens; identical to SEQ ID NO: 221245

SEQ ID NO: 693950 - RNA, 64 nt, Homo Sapiens; identical to SEQ ID NO: 221246

SEQ ID NO: 693951 - RNA, 64 nt, Homo Sapiens; identical to SEQ ID NO: 221247

SEQ ID NO: 693952 - RNA, 64 nt, Homo Sapiens; identical to SEQ ID NO: 221248

SEQ ID NO: 693953 - RNA, 64 nt, Homo Sapiens; identical to SEQ ID NO: 221249

SEQ ID NO: 693954 - RNA, 64 nt, Homo Sapiens; identical to SEQ ID NO: 221250

SEQ ID NO: 693955 - RNA, 64 nt, Homo Sapiens; identical to SEQ ID NO: 221251

SEQ ID NO: 693956 - RNA, 64 nt, Homo Sapiens; identical to SEQ ID NO: 221252

SEQ ID NO: 693957 - RNA, 64 nt, Homo Sapiens; identical to SEQ ID NO: 221253

SEQ ID NO: 693958 - RNA, 64 nt, Homo Sapiens; identical to SEQ ID NO: 221254

SEQ ID NO: 693959 - RNA, 64 nt, Homo Sapiens; identical to SEQ ID NO: 221255

SEQ ID NO: 693960 - RNA, 64 nt, Homo Sapiens; identical to SEQ ID NO: 221256

SEQ ID NO: 693961 - RNA, 64 nt, Homo Sapiens; identical to SEQ ID NO: 221257

SEQ ID NO: 693962 - RNA, 64 nt, Homo Sapiens; identical to SEQ ID NO: 221258

SEQ ID NO: 693963 - RNA, 64 nt, Homo Sapiens; identical to SEQ ID NO: 221259

SEQ ID NO: 693964 - RNA, 64 nt, Homo Sapiens; identical to SEQ ID NO: 221260

SEQ ID NO: 693965 - RNA, 64 nt, Homo Sapiens; identical to SEQ ID NO: 221261

SEQ ID NO: 693966 - RNA, 64 nt, Homo Sapiens; identical to SEQ ID NO: 221262

SEQ ID NO: 693967 - RNA, 64 nt, Homo Sapiens; identical to SEQ ID NO: 221263

SEQ ID NO: 693968 - RNA, 64 nt, Homo Sapiens; identical to SEQ ID NO: 221264

SEQ ID NO: 693969 - RNA, 64 nt, Homo Sapiens; identical to SEQ ID NO: 221265

SEQ ID NO: 693970 - RNA, 64 nt, Homo Sapiens; identical to SEQ ID NO: 221266

SEQ ID NO: 693971 - RNA, 54 nt, Homo Sapiens; identical to SEQ ID NO: 221267

SEQ ID NO: 693972 - RNA, 64 nt, Homo Sapiens; identical to SEQ ID NO: 221268

SEQ ID NO: 693973 - RNA, 64 nt, Homo Sapiens; identical to SEQ ID NO: 221269

SEQ ID NO: 693974 - RNA, 64 nt, Homo Sapiens; identical to SEQ ID NO: 221270

SEQ ID NO: 693975 - RNA, 64 nt, Homo Sapiens; identical to SEQ ID NO: 221271

SEQ ID NO: 693976 - RNA, 64 nt, Homo Sapiens; identical to SEQ ID NO: 221272

SEQ ID NO: 693977 - RNA, 64 nt, Homo Sapiens; identical to SEQ ID NO: 221273

SEQ ID NO: 693978 - RNA, 64 nt, Homo Sapiens; identical to SEQ ID NO: 312464

SEQ ID NO: 693979 - RNA, 64 nt, Homo Sapiens; identical to SEQ ID NO: 312465

SEQ ID NO: 693980 - RNA, 64 nt, Homo Sapiens; identical to SEQ ID NO: 312466

SEQ ID NO: 693981 - RNA, 64 nt, Homo Sapiens; identical to SEQ ID NO: 312467

SEQ ID NO: 693982 - RNA, 64 nt, Homo Sapiens; identical to SEQ ID NO: 312468

SEQ ID NO: 693983 - RNA, 64 nt, Homo Sapiens; identical to SEQ ID NO: 312469

SEQ ID NO: 693984 - RNA, 64 nt, Homo Sapiens; identical to SEQ ID NO: 312470

SEQ ID NO: 693985 - RNA, 64 nt, Homo Sapiens; identical to SEQ ID NO: 312471

SEQ ID NO: 693986 - RNA, 64 nt, Homo Sapiens; identical to SEQ ID NO: 312472

SEQ ID NO: 693987 - RNA, 64 nt, Homo Sapiens; identical to SEQ ID NO: 312473

SEQ ID NO: 693988 - RNA, 64 nt, Homo Sapiens; identical to SEQ ID NO: 312474

SEQ ID NO: 693989 - RNA, 64 nt, Homo Sapiens; identical to SEQ ID NO: 312475

SEQ ID NO: 693990 - RNA, 64 nt, Homo Sapiens; identical to SEQ ID NO: 312476

SEQ ID NO: 693991 - RNA, 64 nt, Homo Sapiens; identical to SEQ ID NO: 312477

SEQ ID NO: 693992 - RNA, 64 nt, Homo Sapiens; identical to SEQ ID NO: 312478

SEQ ID NO: 693993 - RNA, 64 nt, Homo Sapiens; identical to SEQ ID NO: 312479

SEQ ID NO: 693994 - RNA, 64 nt, Homo Sapiens; identical to SEQ ID NO: 312480

SEQ ID NO: 693995 - RNA, 64 nt, Homo Sapiens; identical to SEQ ID NO: 312481

SEQ ID NO: 693996 - RNA, 64 nt, Homo Sapiens; identical to SEQ ID NO: 312482

SEQ ID NO: 693997 - RNA, 64 nt, Homo Sapiens; identical to SEQ ID NO: 312483

SEQ ID NO: 693998 - RNA, 64 nt, Homo Sapiens; identical to SEQ ID NO: 312484

SEQ ID NO: 693999 - RNA, 64 nt, Homo Sapiens; identical to SEQ ID NO: 312485

SEQ ID NO: 694000 - RNA, 64 nt, Homo Sapiens; identical to SEQ ID NO: 312486

SEQ ID NO: 694001 - RNA, 64 nt, Homo Sapiens; identical to SEQ ID NO: 312487

SEQ ID NO: 694002 - RNA, 64 nt, Homo Sapiens; identical to SEQ ID NO: 312488

SEQ ID NO: 694003 - RNA, 64 nt, Homo Sapiens; identical to SEQ ID NO: 312489

SEQ ID NO: 694004 - RNA, 64 nt, Homo Sapiens; identical to SEQ ID NO: 312490

SEQ ID NO: 694005 - RNA, 64 nt, Homo Sapiens; identical to SEQ ID NO: 312491

SEQ ID NO: 694006 - RNA, 64 nt, Homo Sapiens; identical to SEQ ID NO: 312492

SEQ ID NO: 694007 - RNA, 64 nt, Homo Sapiens; identical to SEQ ID NO: 312493

SEQ ID NO: 694008 - RNA, 64 nt, Homo Sapiens; identical to SEQ ID NO: 312494

SEQ ID NO: 694009 - RNA, 64 nt, Homo Sapiens; identical to SEQ ID NO: 312495

SEQ ID NO: 694010 - RNA, 64 nt, Homo Sapiens; identical to SEQ ID NO: 312496

SEQ ID NO: 694011 - RNA, 64 nt, Homo Sapiens; identical to SEQ ID NO: 312497

SEQ ID NO: 694012 - RNA, 64 nt, Homo Sapiens; identical to SEQ ID NO: 312498

SEQ ID NO: 694013 - RNA, 64 nt, Homo Sapiens; identical to SEQ ID NO: 312499

SEQ ID NO: 694014 - RNA, 64 nt, Homo Sapiens; identical to SEQ ID NO: 312500

SEQ ID NO: 694015 - RNA, 64 nt, Homo Sapiens; identical to SEQ ID NO: 312501

SEQ ID NO: 694016 - RNA, 64 nt, Homo Sapiens; identical to SEQ ID NO: 312502

SEQ ID NO: 694017 - RNA, 64 nt, Homo Sapiens; identical to SEQ ID NO: 312503

SEQ ID NO: 694018 - RNA, 64 nt, Homo Sapiens; identical to SEQ ID NO: 312504

SEQ ID NO: 694019 - RNA, 64 nt, Homo Sapiens; identical to SEQ ID NO: 312505

SEQ ID NO: 694020 - RNA, 64 nt, Homo Sapiens; identical to SEQ ID NO: 312506

SEQ ID NO: 694021 - RNA, 64 nt, Homo Sapiens; identical to SEQ ID NO: 312507

SEQ ID NO: 694022 - RNA, 64 nt, Homo Sapiens; identical to SEQ ID NO: 312508

SEQ ID NO: 694023 - RNA, 64 nt, Homo Sapiens; identical to SEQ ID NO: 312509

SEQ ID NO: 694024 - RNA, 64 nt, Homo Sapiens; identical to SEQ ID NO: 312510

SEQ ID NO: 694025 - RNA, 64 nt, Homo Sapiens; identical to SEQ ID NO: 312511

SEQ ID NO: 694026 - RNA, 64 nt, Homo Sapiens; identical to SEQ ID NO: 312512

SEQ ID NO: 694027 - RNA, 64 nt, Homo Sapiens; identical to SEQ ID NO: 374631

SEQ ID NO: 694028 - RNA, 64 nt, Homo Sapiens; identical to SEQ ID NO: 374632

SEQ ID NO: 694029 - RNA, 64 nt, Homo Sapiens; identical to SEQ ID NO: 374633

SEQ ID NO: 694030 - RNA, 64 nt, Homo Sapiens; identical to SEQ ID NO: 374634

SEQ ID NO: 694031 - RNA, 64 nt, Homo Sapiens; identical to SEQ ID NO: 374635

SEQ ID NO: 694032 - RNA, 64 nt, Homo Sapiens; identical to SEQ ID NO: 374636

SEQ ID NO: 694033 - RNA, 64 nt, Homo Sapiens; identical to SEQ ID NO: 374637

SEQ ID NO: 694034 - RNA, 64 nt, Homo Sapiens; identical to SEQ ID NO: 374638

SEQ ID NO: 694035 - RNA, 64 nt, Homo Sapiens; identical to SEQ ID NO: 374639

SEQ ID NO: 694036 - RNA, 64 nt, Homo Sapiens; identical to SEQ ID NO: 374640

SEQ ID NO: 694037 - RNA, 64 nt, Homo Sapiens; identical to SEQ ID NO: 374641

SEQ ID NO: 694038 - RNA, 64 nt, Homo Sapiens; identical to SEQ ID NO: 374642

SEQ ID NO: 694039 - RNA, 64 nt, Homo Sapiens; identical to SEQ ID NO: 312464

SEQ ID NO: 694040 - RNA, 64 nt, Homo Sapiens; identical to SEQ ID NO: 312465

SEQ ID NO: 694041 - RNA, 64 nt, Homo Sapiens; identical to SEQ ID NO: 312466

SEQ ID NO: 694042 - RNA, 64 nt, Homo Sapiens; identical to SEQ ID NO: 312467

SEQ ID NO: 694043 - RNA, 64 nt, Homo Sapiens; identical to SEQ ID NO: 312468

SEQ ID NO: 694044 - RNA, 64 nt, Homo Sapiens; identical to SEQ ID NO: 312469

SEQ ID NO: 694045 - RNA, 64 nt, Homo Sapiens; identical to SEQ ID NO: 312470

SEQ ID NO: 694046 - RNA, 64 nt, Homo Sapiens; identical to SEQ ID NO: 312471

SEQ ID NO: 694047 - RNA, 64 nt, Homo Sapiens; identical to SEQ ID NO: 312472

SEQ ID NO: 694048 - RNA, 64 nt, Homo Sapiens; identical to SEQ ID NO: 312473

SEQ ID NO: 694049 - RNA, 64 nt, Homo Sapiens; identical to SEQ ID NO: 312474

SEQ ID NO: 694050 - RNA, 64 nt, Homo Sapiens; identical to SEQ ID NO: 312475

SEQ ID NO: 694051 - RNA, 64 nt, Homo Sapiens; identical to SEQ ID NO: 312476

SEQ ID NO: 694052 - RNA, 64 nt, Homo Sapiens; identical to SEQ ID NO: 312477

SEQ ID NO: 694053 - RNA, 64 nt, Homo Sapiens; identical to SEQ ID NO: 312478

SEQ ID NO: 694054 - RNA, 64 nt, Homo Sapiens; identical to SEQ ID NO: 312479

SEQ ID NO: 694055 - RNA, 64 nt, Homo Sapiens; identical to SEQ ID NO: 312480

SEQ ID NO: 694056 - RNA, 64 nt, Homo Sapiens; identical to SEQ ID NO: 312481

SEQ ID NO: 694057 - RNA, 64 nt, Homo Sapiens; identical to SEQ ID NO: 312482

SEQ ID NO: 694058 - RNA, 64 nt, Homo Sapiens; identical to SEQ ID NO: 312483

SEQ ID NO: 694059 - RNA, 64 nt, Homo Sapiens; identical to SEQ ID NO: 312484

SEQ ID NO: 694060 - RNA, 64 nt, Homo Sapiens; identical to SEQ ID NO: 312485

SEQ ID NO: 694061 - RNA, 64 nt, Homo Sapiens; identical to SEQ ID NO: 312486

SEQ ID NO: 694062 - RNA, 64 nt, Homo Sapiens; identical to SEQ ID NO: 312487

SEQ ID NO: 694063 - RNA, 64 nt, Homo Sapiens; identical to SEQ ID NO: 312488

SEQ ID NO: 694064 - RNA, 64 nt, Homo Sapiens; identical to SEQ ID NO: 312489

SEQ ID NO: 694065 - RNA, 64 nt, Homo Sapiens; identical to SEQ ID NO: 312490

SEQ ID NO: 694066 - RNA, 64 nt, Homo Sapiens; identical to SEQ ID NO: 312491

SEQ ID NO: 694067 - RNA, 64 nt, Homo Sapiens; identical to SEQ ID NO: 312492

SEQ ID NO: 694068 - RNA, 64 nt, Homo Sapiens; identical to SEQ ID NO: 312493

SEQ ID NO: 694069 - RNA, 64 nt, Homo Sapiens; identical to SEQ ID NO: 312494

SEQ ID NO: 694070 - RNA, 64 nt, Homo Sapiens; identical to SEQ ID NO: 312495

SEQ ID NO: 694071 - RNA, 64 nt, Homo Sapiens; identical to SEQ ID NO: 312496

SEQ ID NO: 694072 - RNA, 64 nt, Homo Sapiens; identical to SEQ ID NO: 312497

SEQ ID NO: 694073 - RNA, 64 nt, Homo Sapiens; identical to SEQ ID NO: 312498

SEQ ID NO: 694074 - RNA, 64 nt, Homo Sapiens; identical to SEQ ID NO: 312499

SEQ ID NO: 694075 - RNA, 64 nt, Homo Sapiens; identical to SEQ ID NO: 312500

SEQ ID NO: 694076 - RNA, 64 nt, Homo Sapiens; identical to SEQ ID NO: 312501

SEQ ID NO: 694077 - RNA, 64 nt, Homo Sapiens; identical to SEQ ID NO: 312502

SEQ ID NO: 694078 - RNA, 64 nt, Homo Sapiens; identical to SEQ ID NO: 312503

SEQ ID NO: 694079 - RNA, 64 nt, Homo Sapiens; identical to SEQ ID NO: 312504

SEQ ID NO: 694080 - RNA, 64 nt, Homo Sapiens; identical to SEQ ID NO: 312505

SEQ ID NO: 694081 - RNA, 64 nt, Homo Sapiens; identical to SEQ ID NO: 312506

SEQ ID NO: 694082 - RNA, 64 nt, Homo Sapiens; identical to SEQ ID NO: 312507

SEQ ID NO: 694083 - RNA, 64 nt, Homo Sapiens; identical to SEQ ID NO: 312508

SEQ ID NO: 694084 - RNA, 64 nt, Homo Sapiens; identical to SEQ ID NO: 312509

SEQ ID NO: 694085 - RNA, 64 nt, Homo Sapiens; identical to SEQ ID NO: 312510

SEQ ID NO: 694086 - RNA, 64 nt, Homo Sapiens; identical to SEQ ID NO: 312511

SEQ ID NO: 694087 - RNA, 64 nt, Homo Sapiens; identical to SEQ ID NO: 312512

SEQ ID NO: 694088 - RNA, 64 nt, Homo Sapiens; identical to SEQ ID NO: 374631

SEQ ID NO: 694089 - RNA, 64 nt, Homo Sapiens; identical to SEQ ID NO: 374632

SEQ ID NO: 694090 - RNA, 64 nt, Homo Sapiens; identical to SEQ ID NO: 374633

SEQ ID NO: 694091 - RNA, 64 nt, Homo Sapiens; identical to SEQ ID NO: 374634

SEQ ID NO: 694092 - RNA, 64 nt, Homo Sapiens; identical to SEQ ID NO: 374635

SEQ ID NO: 694093 - RNA, 64 nt, Homo Sapiens; identical to SEQ ID NO: 374636

SEQ ID NO: 694094 - RNA, 64 nt, Homo Sapiens; identical to SEQ ID NO: 374637

SEQ ID NO: 694095 - RNA, 64 nt, Homo Sapiens; identical to SEQ ID NO: 374638

SEQ ID NO: 694096 - RNA, 64 nt, Homo Sapiens; identical to SEQ ID NO: 374639

SEQ ID NO: 694097 - RNA, 64 nt, Homo Sapiens; identical to SEQ ID NO: 374640

SEQ ID NO: 694098 - RNA, 64 nt, Homo Sapiens; identical to SEQ ID NO: 374641

SEQ ID NO: 694099 - RNA, 64 nt, Homo Sapiens; identical to SEQ ID NO: 374642

SEQ ID NO: 694100 - RNA, 63 nt, Homo Sapiens
gcuacuccuuccuguagagcagaaauuguauuuugcacgaacaugcaguuauugaagauuagg

SEQ ID NO: 694101 - RNA, 63 nt, Homo Sapiens
gaggguguaaguauuccaccagcccgcugagugugcacgaaauguucgcagugcaacaaaaag

SEQ ID NO: 694102 - RNA, 63 nt, Homo Sapiens
ucuuuuuuuuuaaaacugucaugguggcuuaaaugcacgaauguauauuagagucagagacua

SEQ ID NO: 694103 - RNA, 63 nt, Homo Sapiens
cacaaugcaccauccaugagaauggccauggaaugcacgaaguuuccuuugguugccauaugg

SEQ ID NO: 694104 - RNA, 63 nt, Homo Sapiens
uggagaaccugacagggcugcacccagucucaaugcacgaagugaaacccguaggcacggaca

SEQ ID NO: 694105 - RNA, 63 nt, Homo Sapiens
cccgccgaaacugcugcgaggcagcacagcaccugcacgaacagcgugcugcagcgacaggcg

SEQ ID NO: 694106 - RNA, 63 nt, Homo Sapiens
guggcccaggagagaggaucgccuugcccucaaugcacgaaagcugggcugguacaggccuca

SEQ ID NO: 694107 - RNA, 63 nt, Homo Sapiens
ugucacuuuuuaugcuauuucuguauauaaaggugcacgaagguaaaaaguauuuuuucaagu

SEQ ID NO: 694108 - RNA, 63 nt, Homo Sapiens
uuucucucuugccuugaggacccaaagucugagugcacgaaaagugaaagacaugagugcccu

SEQ ID NO: 694109 - RNA, 63 nt, Homo Sapiens
aaaacugaaucaagaaaugaaugcuccaugaaaugcacgaagucuguuuuaaugacaagguga

SEQ ID NO: 694110 - RNA, 63 nt, Homo Sapiens
ccccgccuaccuguacucguuggccguaccugaugcacgaacagugcuggugccaaccucugg

SEQ ID NO: 694111 - RNA, 63 nt, Homo Sapiens
auggacauaaauccaaguugcuggauagcuauuugcacgaaucauuaggguggcuguccaucc

SEQ ID NO: 694112 - RNA, 63 nt, Homo Sapiens
uuaaaacauggcaauaaauggcuucagauauuuugcacgaauucuuuguauucucuguccagg

SEQ ID NO: 694113 - RNA, 63 nt, Homo Sapiens
gaugugaguugcacagcuaugaaggcuguacacugcacgaauggaagaggcaccugucccaga

SEQ ID NO: 694114 - RNA, 63 nt, Homo Sapiens
cccaacacaugccuucccuccccagccacaccgugcacgaagggggcacaggagaggagaggg

SEQ ID NO: 694115 - RNA, 63 nt, Homo Sapiens
guccagaaccuggaaccuagaggccuuucucucugcacgaaaaacagguaguuugcagucuga

SEQ ID NO: 694116 - RNA, 63 nt, Homo Sapiens
uguacuguaauuuugaauggaacugaaaaauuaugcacgaauaaaguacuuuucucaugccau

SEQ ID NO: 694117 - RNA, 63 nt, Homo Sapiens
ucagcugccaauaauaucuaauauuuuucaucaugcacgaauuaauaaucaucauacucuaga

SEQ ID NO: 694118 - RNA, 63 nt, Homo Sapiens
ugacagcccugaucuguauuaccuugaguggccugcacgaacaucuggaauccacuaugguuu

SEQ ID NO: 694119 - RNA, 63 nt, Homo Sapiens
uuacuauagauaauauauguaggccuuaugauaugcacgaauuuaguugaaguacaaauuaau

SEQ ID NO: 694120 - RNA, 63 nt, Homo Sapiens
cuggccucuugcuuggcgugugcugcccuucuuugcacgaagcuguuggcgcucggggcgaga

SEQ ID NO: 694121 - RNA, 63 nt, Homo Sapiens
gguagugcagcuguggguggaggcuggggugucugcacgaagucaggccagcguccuccucca

SEQ ID NO: 694122 - RNA, 63 nt, Homo Sapiens
augucuuuuaaauuaaaauacuaccaacaguuuugcacgaacagaagggauguuuuguaagaa

SEQ ID NO: 694123 - RNA, 63 nt, Homo Sapiens
ggcugaugggaaccauuucaccccuuggauuccugcacgaaguuguguguguauguuucuuag

SEQ ID NO: 694124 - RNA, 63 nt, Homo Sapiens
aggaacugggguugcuaacccagggaaccacaaugcacgaaaggggcuggguuaacguuuucu

SEQ ID NO: 694125 - RNA, 63 nt, Homo Sapiens
acagccuucagcacaggcaacuguuacugagucugcacgaacuuagauaaugaggugcagggu

SEQ ID NO: 694126 - RNA, 63 nt, Homo Sapiens
aucccauauuguuuggagacuuccagauggcucugcacgaaggagaaccacgcauuuaugaag

SEQ ID NO: 694127 - RNA, 63 nt, Homo Sapiens
caugaauguauuguaaauaaagggaugggcaguugcacgaagguggcucccuguuggcuacgc

SEQ ID NO: 694128 - RNA, 63 nt, Homo Sapiens
agacuuuccaaauauggaacuaacuggagaaggugcacgaaggagacaccacuuggggaccuc

SEQ ID NO: 694129 - RNA, 63 nt, Homo Sapiens
gaagauccaagcuucgaaagaagcacgaccuacugcacgaagguggucaaagugaggggaaaa

SEQ ID NO: 694130 - RNA, 63 nt, Homo Sapiens
uuaauuuacucauguccacgcguguagcugacaugcacgaagucugagaaaggagacgaugaa

SEQ ID NO: 694131 - RNA, 63 nt, Homo Sapiens
cccuucaggcucuguugcucccuccucugcagcugcacgaaggcgccaucuggugucugcaug

SEQ ID NO: 694132 - RNA, 63 nt, Homo Sapiens
ucccuggccuccagagguggcgugggcuggcuuugcacgaagguugugcugggagaccggacc

SEQ ID NO: 694133 - RNA, 63 nt, Homo Sapiens
gugaaguucuuugucacugugugaccaaagaaaugcacgaaauucauucuaaugaaagaaaau

SEQ ID NO: 694134 - RNA, 63 nt, Homo Sapiens
uugaacauucguuauggggaaacagcagagugaugcacgaacuuuucccgguuauguguaggg

SEQ ID NO: 694135 - RNA, 63 nt, Homo Sapiens
caagaaccaaacagcucagggagcuacgcucugugcacgaaguugugggucccugacaaagaa

SEQ ID NO: 694136 - RNA, 63 nt, Homo Sapiens
uuucauuguuaauguauauuauguuuuacucuuugcacgaaacuuguggcacaaaaagggaac

SEQ ID NO: 694137 - RNA, 63 nt, Homo Sapiens
ugaaaugccucuucuuuauguacaaagauuauuugcacgaacuggacugugugcaacgcuuuu

SEQ ID NO: 694138 - RNA, 63 nt, Homo Sapiens
gagccaacagaugugucagccaggauugaccuuugcacgaacaccaagugucugcaaguaaac

SEQ ID NO: 694139 - RNA, 63 nt, Homo Sapiens
cuacagcgagagugacgauguccaggaagggccugcacgaaccccaggccccgcgggccgggc

SEQ ID NO: 694140 - RNA, 63 nt, Homo Sapiens
gagcaccguggagaagacggagcugccaggucaugcacgaaggggaggucccgcagaagcuac

SEQ ID NO: 694141 - RNA, 64 nt, Homo Sapiens; identical to SEQ ID NO: 53883

SEQ ID NO: 694142 - RNA, 64 nt, Homo Sapiens; identical to SEQ ID NO: 53884

SEQ ID NO: 694143 - RNA, 64 nt, Homo Sapiens; identical to SEQ ID NO: 53885

SEQ ID NO: 694144 - RNA, 64 nt, Homo Sapiens; identical to SEQ ID NO: 53886

SEQ ID NO: 694145 - RNA, 64 nt, Homo Sapiens; identical to SEQ ID NO: 53887

SEQ ID NO: 694146 - RNA, 64 nt, Homo Sapiens; identical to SEQ ID NO: 53888

SEQ ID NO: 694147 - RNA, 64 nt, Homo Sapiens; identical to SEQ ID NO: 53889

SEQ ID NO: 694148 - RNA, 64 nt, Homo Sapiens; identical to SEQ ID NO: 53890

SEQ ID NO: 694149 - RNA, 64 nt, Homo Sapiens; identical to SEQ ID NO: 53891

SEQ ID NO: 694150 - RNA, 64 nt, Homo Sapiens; identical to SEQ ID NO: 53892

SEQ ID NO: 694151 - RNA, 64 nt, Homo Sapiens; identical to SEQ ID NO: 53893

SEQ ID NO: 694152 - RNA, 64 nt, Homo Sapiens; identical to SEQ ID NO: 53894

SEQ ID NO: 694153 - RNA, 64 nt, Homo Sapiens; identical to SEQ ID NO: 53895

SEQ ID NO: 694154 - RNA, 64 nt, Homo Sapiens; identical to SEQ ID NO: 53896

SEQ ID NO: 694155 - RNA, 64 nt, Homo Sapiens; identical to SEQ ID NO: 53897

SEQ ID NO: 694156 - RNA, 64 nt, Homo Sapiens; identical to SEQ ID NO: 53898

SEQ ID NO: 694157 - RNA, 64 nt, Homo Sapiens; identical to SEQ ID NO: 53899

SEQ ID NO: 694158 - RNA, 64 nt, Homo Sapiens; identical to SEQ ID NO: 53900

SEQ ID NO: 694159 - RNA, 64 nt, Homo Sapiens; identical to SEQ ID NO: 53901

SEQ ID NO: 694160 - RNA, 64 nt, Homo Sapiens; identical to SEQ ID NO: 53902

SEQ ID NO: 694161 - RNA, 64 nt, Homo Sapiens; identical to SEQ ID NO: 53903

SEQ ID NO: 694162 - RNA, 64 nt, Homo Sapiens; identical to SEQ ID NO: 53904

SEQ ID NO: 694163 - RNA, 64 nt, Homo Sapiens; identical to SEQ ID NO: 53905

SEQ ID NO: 694164 - RNA, 64 nt, Homo Sapiens; identical to SEQ ID NO: 53906

SEQ ID NO: 694165 - RNA, 64 nt, Homo Sapiens; identical to SEQ ID NO: 53907

SEQ ID NO: 694166 - RNA, 64 nt, Homo Sapiens; identical to SEQ ID NO: 53908

SEQ ID NO: 694167 - RNA, 64 nt, Homo Sapiens; identical to SEQ ID NO: 53909

SEQ ID NO: 694168 - RNA, 64 nt, Homo Sapiens; identical to SEQ ID NO: 53910

SEQ ID NO: 694169 - RNA, 64 nt, Homo Sapiens; identical to SEQ ID NO: 53911

SEQ ID NO: 694170 - RNA, 64 nt, Homo Sapiens; identical to SEQ ID NO: 53912

SEQ ID NO: 694171 - RNA, 64 nt, Homo Sapiens; identical to SEQ ID NO: 53913

SEQ ID NO: 694172 - RNA, 64 nt, Homo Sapiens; identical to SEQ ID NO: 53914

SEQ ID NO: 694173 - RNA, 64 nt, Homo Sapiens; identical to SEQ ID NO: 53915

SEQ ID NO: 694174 - RNA, 64 nt, Homo Sapiens; identical to SEQ ID NO: 53916

SEQ ID NO: 694175 - RNA, 64 nt, Homo Sapiens; identical to SEQ ID NO: 53917

SEQ ID NO: 694176 - RNA, 64 nt, Homo Sapiens; identical to SEQ ID NO: 53918

SEQ ID NO: 694177 - RNA, 64 nt, Homo Sapiens; identical to SEQ ID NO: 53919

SEQ ID NO: 694178 - RNA, 64 nt, Homo Sapiens; identical to SEQ ID NO: 53920

SEQ ID NO: 694179 - RNA, 64 nt, Homo Sapiens; identical to SEQ ID NO: 53921

SEQ ID NO: 694180 - RNA, 64 nt, Homo Sapiens; identical to SEQ ID NO: 53922

SEQ ID NO: 694181 - RNA, 64 nt, Homo Sapiens; identical to SEQ ID NO: 53923

SEQ ID NO: 694182 - RNA, 64 nt, Homo Sapiens; identical to SEQ ID NO: 53965

SEQ ID NO: 694183 - RNA, 64 nt, Homo Sapiens; identical to SEQ ID NO: 53966

SEQ ID NO: 694184 - RNA, 64 nt, Homo Sapiens; identical to SEQ ID NO: 53967

SEQ ID NO: 694185 - RNA, 64 nt, Homo Sapiens; identical to SEQ ID NO: 53968

SEQ ID NO: 694186 - RNA, 64 nt, Homo Sapiens; identical to SEQ ID NO: 53969

SEQ ID NO: 694187 - RNA, 64 nt, Homo Sapiens; identical to SEQ ID NO: 53970

SEQ ID NO: 694188 - RNA, 64 nt, Homo Sapiens; identical to SEQ ID NO: 53971

SEQ ID NO: 694189 - RNA, 64 nt, Homo Sapiens; identical to SEQ ID NO: 53972

SEQ ID NO: 694190 - RNA, 64 nt, Homo Sapiens; identical to SEQ ID NO: 53973

SEQ ID NO: 694191 - RNA, 64 nt, Homo Sapiens; identical to SEQ ID NO: 53974

SEQ ID NO: 694192 - RNA, 64 nt, Homo Sapiens; identical to SEQ ID NO: 53975

SEQ ID NO: 694193 - RNA, 64 nt, Homo Sapiens; identical to SEQ ID NO: 53976

SEQ ID NO: 694194 - RNA, 64 nt, Homo Sapiens; identical to SEQ ID NO: 53977

SEQ ID NO: 694195 - RNA, 64 nt, Homo Sapiens; identical to SEQ ID NO: 53978

SEQ ID NO: 694196 - RNA, 64 nt, Homo Sapiens; identical to SEQ ID NO: 53979

SEQ ID NO: 694197 - RNA, 64 nt, Homo Sapiens; identical to SEQ ID NO: 53980

SEQ ID NO: 694198 - RNA, 64 nt, Homo Sapiens; identical to SEQ ID NO: 53981

SEQ ID NO: 694199 - RNA, 64 nt, Homo Sapiens; identical to SEQ ID NO: 53982

SEQ ID NO: 694200 - RNA, 64 nt, Homo Sapiens; identical to SEQ ID NO: 53983

SEQ ID NO: 694201 - RNA, 64 nt, Homo Sapiens; identical to SEQ ID NO: 53984

SEQ ID NO: 694202 - RNA, 64 nt, Homo Sapiens; identical to SEQ ID NO: 53985

SEQ ID NO: 694203 - RNA, 64 nt, Homo Sapiens; identical to SEQ ID NO: 53986

SEQ ID NO: 694204 - RNA, 64 nt, Homo Sapiens; identical to SEQ ID NO: 53987

SEQ ID NO: 694205 - RNA, 64 nt, Homo Sapiens; identical to SEQ ID NO: 53988

SEQ ID NO: 694206 - RNA, 64 nt, Homo Sapiens; identical to SEQ ID NO: 53989

SEQ ID NO: 694207 - RNA, 64 nt, Homo Sapiens; identical to SEQ ID NO: 53990

SEQ ID NO: 694208 - RNA, 64 nt, Homo Sapiens; identical to SEQ ID NO: 53991

SEQ ID NO: 694209 - RNA, 64 nt, Homo Sapiens; identical to SEQ ID NO: 53992

SEQ ID NO: 694210 - RNA, 64 nt, Homo Sapiens; identical to SEQ ID NO: 53993

SEQ ID NO: 694211 - RNA, 64 nt, Homo Sapiens; identical to SEQ ID NO: 53994

SEQ ID NO: 694212 - RNA, 64 nt, Homo Sapiens; identical to SEQ ID NO: 53995

SEQ ID NO: 694213 - RNA, 64 nt, Homo Sapiens; identical to SEQ ID NO: 53996

SEQ ID NO: 694214 - RNA, 64 nt, Homo Sapiens; identical to SEQ ID NO: 53997

SEQ ID NO: 694215 - RNA, 64 nt, Homo Sapiens; identical to SEQ ID NO: 53998

SEQ ID NO: 694216 - RNA, 64 nt, Homo Sapiens; identical to SEQ ID NO: 53999

SEQ ID NO: 694217 - RNA, 64 nt, Homo Sapiens; identical to SEQ ID NO: 54000

SEQ ID NO: 694218 - RNA, 64 nt, Homo Sapiens; identical to SEQ ID NO: 54001

SEQ ID NO: 694219 - RNA, 64 nt, Homo Sapiens; identical to SEQ ID NO: 54002

SEQ ID NO: 694220 - RNA, 64 nt, Homo Sapiens; identical to SEQ ID NO: 54003

SEQ ID NO: 694221 - RNA, 64 nt, Homo Sapiens; identical to SEQ ID NO: 54004

SEQ ID NO: 694222 - RNA, 64 nt, Homo Sapiens; identical to SEQ ID NO: 54005

SEQ ID NO: 694223 - RNA, 64 nt, Homo Sapiens; identical to SEQ ID NO: 54006

SEQ ID NO: 694224 - RNA, 64 nt, Homo Sapiens; identical to SEQ ID NO: 54007

SEQ ID NO: 694225 - RNA, 64 nt, Homo Sapiens; identical to SEQ ID NO: 54008

SEQ ID NO: 694226 - RNA, 64 nt, Homo Sapiens; identical to SEQ ID NO: 54009

SEQ ID NO: 694227 - RNA, 64 nt, Homo Sapiens; identical to SEQ ID NO: 54010

SEQ ID NO: 694228 - RNA, 64 nt, Homo Sapiens; identical to SEQ ID NO: 54011

SEQ ID NO: 694229 - RNA, 64 nt, Homo Sapiens; identical to SEQ ID NO: 54012

SEQ ID NO: 694230 - RNA, 64 nt, Homo Sapiens; identical to SEQ ID NO: 54013

SEQ ID NO: 694231 - RNA, 64 nt, Homo Sapiens; identical to SEQ ID NO: 54014

SEQ ID NO: 694232 - RNA, 64 nt, Homo Sapiens; identical to SEQ ID NO: 54015

SEQ ID NO: 694233 - RNA, 64 nt, Homo Sapiens; identical to SEQ ID NO: 54016

SEQ ID NO: 694234 - RNA, 64 nt, Homo Sapiens; identical to SEQ ID NO: 54017

SEQ ID NO: 694235 - RNA, 64 nt, Homo Sapiens; identical to SEQ ID NO: 54018

SEQ ID NO: 694236 - RNA, 64 nt, Homo Sapiens; identical to SEQ ID NO: 54019

SEQ ID NO: 694237 - RNA, 64 nt, Homo Sapiens; identical to SEQ ID NO: 54020

SEQ ID NO: 694238 - RNA, 64 nt, Homo Sapiens; identical to SEQ ID NO: 54021

SEQ ID NO: 694239 - RNA, 64 nt, Homo Sapiens; identical to SEQ ID NO: 54022

SEQ ID NO: 694240 - RNA, 64 nt, Homo Sapiens; identical to SEQ ID NO: 54023

SEQ ID NO: 694241 - RNA, 64 nt, Homo Sapiens; identical to SEQ ID NO: 54024

SEQ ID NO: 694242 - RNA, 64 nt, Homo Sapiens; identical to SEQ ID NO: 54025

SEQ ID NO: 694243 - RNA, 64 nt, Homo Sapiens; identical to SEQ ID NO: 54026

SEQ ID NO: 694244 - RNA, 64 nt, Homo Sapiens; identical to SEQ ID NO: 54027

SEQ ID NO: 694245 - RNA, 64 nt, Homo Sapiens; identical to SEQ ID NO: 54028

SEQ ID NO: 694246 - RNA, 64 nt, Homo Sapiens; identical to SEQ ID NO: 54029

SEQ ID NO: 694247 - RNA, 64 nt, Homo Sapiens; identical to SEQ ID NO: 54030

SEQ ID NO: 694248 - RNA, 64 nt, Homo Sapiens; identical to SEQ ID NO: 54031

SEQ ID NO: 694249 - RNA, 64 nt, Homo Sapiens; identical to SEQ ID NO: 54032

SEQ ID NO: 694250 - RNA, 64 nt, Homo Sapiens; identical to SEQ ID NO: 54033

SEQ ID NO: 694251 - RNA, 64 nt, Homo Sapiens; identical to SEQ ID NO: 54034

SEQ ID NO: 694252 - RNA, 64 nt, Homo Sapiens; identical to SEQ ID NO: 54035

SEQ ID NO: 694253 - RNA, 64 nt, Homo Sapiens; identical to SEQ ID NO: 54036

SEQ ID NO: 694254 - RNA, 64 nt, Homo Sapiens; identical to SEQ ID NO: 54037

SEQ ID NO: 694255 - RNA, 64 nt, Homo Sapiens; identical to SEQ ID NO: 54038

SEQ ID NO: 694256 - RNA, 64 nt, Homo Sapiens; identical to SEQ ID NO: 54039

SEQ ID NO: 694257 - RNA, 64 nt, Homo Sapiens; identical to SEQ ID NO: 54040

SEQ ID NO: 694258 - RNA, 64 nt, Homo Sapiens; identical to SEQ ID NO: 54041

SEQ ID NO: 694259 - RNA, 64 nt, Homo Sapiens; identical to SEQ ID NO: 54042

SEQ ID NO: 694260 - RNA, 64 nt, Homo Sapiens; identical to SEQ ID NO: 54043

SEQ ID NO: 694261 - RNA, 64 nt, Homo Sapiens; identical to SEQ ID NO: 54044

SEQ ID NO: 694262 - RNA, 64 nt, Homo Sapiens; identical to SEQ ID NO: 54045

SEQ ID NO: 694263 - RNA, 64 nt, Homo Sapiens; identical to SEQ ID NO: 54046

SEQ ID NO: 694264 - RNA, 64 nt, Homo Sapiens; identical to SEQ ID NO: 54047

SEQ ID NO: 694265 - RNA, 64 nt, Homo Sapiens; identical to SEQ ID NO: 54048

SEQ ID NO: 694266 - RNA, 64 nt, Homo Sapiens; identical to SEQ ID NO: 54049

SEQ ID NO: 694267 - RNA, 64 nt, Homo Sapiens; identical to SEQ ID NO: 54050

SEQ ID NO: 694268 - RNA, 64 nt, Homo Sapiens; identical to SEQ ID NO: 54051

SEQ ID NO: 694269 - RNA, 64 nt, Homo Sapiens; identical to SEQ ID NO: 54052

SEQ ID NO: 694270 - RNA, 64 nt, Homo Sapiens; identical to SEQ ID NO: 54053

SEQ ID NO: 694271 - RNA, 64 nt, Homo Sapiens; identical to SEQ ID NO: 54054

SEQ ID NO: 694272 - RNA, 64 nt, Homo Sapiens; identical to SEQ ID NO: 54055

SEQ ID NO: 694273 - RNA, 64 nt, Homo Sapiens; identical to SEQ ID NO: 54056

SEQ ID NO: 694274 - RNA, 64 nt, Homo Sapiens; identical to SEQ ID NO: 54057

SEQ ID NO: 694275 - RNA, 64 nt, Homo Sapiens; identical to SEQ ID NO: 54058

SEQ ID NO: 694276 - RNA, 64 nt, Homo Sapiens; identical to SEQ ID NO: 54059

SEQ ID NO: 694277 - RNA, 64 nt, Homo Sapiens; identical to SEQ ID NO: 54060

SEQ ID NO: 694278 - RNA, 64 nt, Homo Sapiens; identical to SEQ ID NO: 54061

SEQ ID NO: 694279 - RNA, 64 nt, Homo Sapiens; identical to SEQ ID NO: 54062

SEQ ID NO: 694280 - RNA, 64 nt, Homo Sapiens; identical to SEQ ID NO: 54063

SEQ ID NO: 694281 - RNA, 64 nt, Homo Sapiens; identical to SEQ ID NO: 54064

SEQ ID NO: 694282 - RNA, 64 nt, Homo Sapiens; identical to SEQ ID NO: 54065

SEQ ID NO: 694283 - RNA, 64 nt, Homo Sapiens; identical to SEQ ID NO: 54066

SEQ ID NO: 694284 - RNA, 64 nt, Homo Sapiens; identical to SEQ ID NO: 54067

SEQ ID NO: 694285 - RNA, 64 nt, Homo Sapiens; identical to SEQ ID NO: 54068

SEQ ID NO: 694286 - RNA, 64 nt, Homo Sapiens; identical to SEQ ID NO: 54069

SEQ ID NO: 694287 - RNA, 64 nt, Homo Sapiens; identical to SEQ ID NO: 54070

SEQ ID NO: 694288 - RNA, 64 nt, Homo Sapiens; identical to SEQ ID NO: 54071

SEQ ID NO: 694289 - RNA, 64 nt, Homo Sapiens; identical to SEQ ID NO: 54072

SEQ ID NO: 694290 - RNA, 64 nt, Homo Sapiens; identical to SEQ ID NO: 54073

SEQ ID NO: 694291 - RNA, 64 nt, Homo Sapiens; identical to SEQ ID NO: 54074

SEQ ID NO: 694292 - RNA, 64 nt, Homo Sapiens; identical to SEQ ID NO: 54075

SEQ ID NO: 694293 - RNA, 64 nt, Homo Sapiens; identical to SEQ ID NO: 54076

SEQ ID NO: 694294 - RNA, 64 nt, Homo Sapiens; identical to SEQ ID NO: 54077

SEQ ID NO: 694295 - RNA, 64 nt, Homo Sapiens; identical to SEQ ID NO: 54078

SEQ ID NO: 694296 - RNA, 64 nt, Homo Sapiens; identical to SEQ ID NO: 54079

SEQ ID NO: 694297 - RNA, 64 nt, Homo Sapiens; identical to SEQ ID NO: 54080

SEQ ID NO: 694298 - RNA, 64 nt, Homo Sapiens; identical to SEQ ID NO: 54081

SEQ ID NO: 694299 - RNA, 64 nt, Homo Sapiens; identical to SEQ ID NO: 54082

SEQ ID NO: 694300 - RNA, 64 nt, Homo Sapiens; identical to SEQ ID NO: 54083

SEQ ID NO: 694301 - RNA, 64 nt, Homo Sapiens; identical to SEQ ID NO: 54084

SEQ ID NO: 694302 - RNA, 64 nt, Homo Sapiens; identical to SEQ ID NO: 54085

SEQ ID NO: 694303 - RNA, 64 nt, Homo Sapiens; identical to SEQ ID NO: 54086

SEQ ID NO: 694304 - RNA, 53 nt, Homo Sapiens; identical to SEQ ID NO: 54087

SEQ ID NO: 694305 - RNA, 64 nt, Homo Sapiens; identical to SEQ ID NO: 54088

SEQ ID NO: 694306 - RNA, 64 nt, Homo Sapiens; identical to SEQ ID NO: 54089

SEQ ID NO: 694307 - RNA, 64 nt, Homo Sapiens; identical to SEQ ID NO: 54090

SEQ ID NO: 694308 - RNA, 64 nt, Homo Sapiens; identical to SEQ ID NO: 54091

SEQ ID NO: 694309 - RNA, 64 nt, Homo Sapiens; identical to SEQ ID NO: 54092

SEQ ID NO: 694310 - RNA, 64 nt, Homo Sapiens; identical to SEQ ID NO: 54093

SEQ ID NO: 694311 - RNA, 64 nt, Homo Sapiens; identical to SEQ ID NO: 54094

SEQ ID NO: 694312 - RNA, 64 nt, Homo Sapiens; identical to SEQ ID NO: 54095

SEQ ID NO: 694313 - RNA, 64 nt, Homo Sapiens; identical to SEQ ID NO: 54096

SEQ ID NO: 694314 - RNA, 64 nt, Homo Sapiens; identical to SEQ ID NO: 54097

SEQ ID NO: 694315 - RNA, 64 nt, Homo Sapiens; identical to SEQ ID NO: 54098

SEQ ID NO: 694316 - RNA, 64 nt, Homo Sapiens; identical to SEQ ID NO: 54099

SEQ ID NO: 694317 - RNA, 64 nt, Homo Sapiens; identical to SEQ ID NO: 54100

SEQ ID NO: 694318 - RNA, 64 nt, Homo Sapiens; identical to SEQ ID NO: 54101

SEQ ID NO: 694319 - RNA, 64 nt, Homo Sapiens; identical to SEQ ID NO: 54102

SEQ ID NO: 694320 - RNA, 64 nt, Homo Sapiens; identical to SEQ ID NO: 54103

SEQ ID NO: 694321 - RNA, 64 nt, Homo Sapiens; identical to SEQ ID NO: 54104

SEQ ID NO: 694322 - RNA, 64 nt, Homo Sapiens; identical to SEQ ID NO: 54105

SEQ ID NO: 694323 - RNA, 64 nt, Homo Sapiens; identical to SEQ ID NO: 54106

SEQ ID NO: 694324 - RNA, 64 nt, Homo Sapiens; identical to SEQ ID NO: 54107

SEQ ID NO: 694325 - RNA, 64 nt, Homo Sapiens; identical to SEQ ID NO: 54108

SEQ ID NO: 694326 - RNA, 64 nt, Homo Sapiens; identical to SEQ ID NO: 54109

SEQ ID NO: 694327 - RNA, 64 nt, Homo Sapiens; identical to SEQ ID NO: 54110

SEQ ID NO: 694328 - RNA, 64 nt, Homo Sapiens; identical to SEQ ID NO: 54111

SEQ ID NO: 694329 - RNA, 64 nt, Homo Sapiens; identical to SEQ ID NO: 54112

SEQ ID NO: 694330 - RNA, 64 nt, Homo Sapiens; identical to SEQ ID NO: 54113

SEQ ID NO: 694331 - RNA, 64 nt, Homo Sapiens; identical to SEQ ID NO: 54114

SEQ ID NO: 694332 - RNA, 64 nt, Homo Sapiens; identical to SEQ ID NO: 54115

SEQ ID NO: 694333 - RNA, 64 nt, Homo Sapiens; identical to SEQ ID NO: 54116

SEQ ID NO: 694334 - RNA, 64 nt, Homo Sapiens; identical to SEQ ID NO: 54117

SEQ ID NO: 694335 - RNA, 64 nt, Homo Sapiens; identical to SEQ ID NO: 54118

SEQ ID NO: 694336 - RNA, 64 nt, Homo Sapiens; identical to SEQ ID NO: 54119

SEQ ID NO: 694337 - RNA, 64 nt, Homo Sapiens; identical to SEQ ID NO: 54120

SEQ ID NO: 694338 - RNA, 64 nt, Homo Sapiens; identical to SEQ ID NO: 54121

SEQ ID NO: 694339 - RNA, 64 nt, Homo Sapiens; identical to SEQ ID NO: 54122

SEQ ID NO: 694340 - RNA, 64 nt, Homo Sapiens; identical to SEQ ID NO: 54123

SEQ ID NO: 694341 - RNA, 64 nt, Homo Sapiens; identical to SEQ ID NO: 54124

SEQ ID NO: 694342 - RNA, 64 nt, Homo Sapiens; identical to SEQ ID NO: 54125

SEQ ID NO: 694343 - RNA, 64 nt, Homo Sapiens; identical to SEQ ID NO: 54126

SEQ ID NO: 694344 - RNA, 64 nt, Homo Sapiens; identical to SEQ ID NO: 54127

SEQ ID NO: 694345 - RNA, 64 nt, Homo Sapiens; identical to SEQ ID NO: 54128

SEQ ID NO: 694346 - RNA, 64 nt, Homo Sapiens; identical to SEQ ID NO: 54129

SEQ ID NO: 694347 - RNA, 64 nt, Homo Sapiens; identical to SEQ ID NO: 54130

SEQ ID NO: 694348 - RNA, 64 nt, Homo Sapiens; identical to SEQ ID NO: 54131

SEQ ID NO: 694349 - RNA, 64 nt, Homo Sapiens; identical to SEQ ID NO: 54132

SEQ ID NO: 694350 - RNA, 64 nt, Homo Sapiens; identical to SEQ ID NO: 54133

SEQ ID NO: 694351 - RNA, 64 nt, Homo Sapiens; identical to SEQ ID NO: 54134

SEQ ID NO: 694352 - RNA, 64 nt, Homo Sapiens; identical to SEQ ID NO: 54135

SEQ ID NO: 694353 - RNA, 64 nt, Homo Sapiens; identical to SEQ ID NO: 54136

SEQ ID NO: 694354 - RNA, 64 nt, Homo Sapiens; identical to SEQ ID NO: 54137

SEQ ID NO: 694355 - RNA, 64 nt, Homo Sapiens; identical to SEQ ID NO: 54138

SEQ ID NO: 694356 - RNA, 64 nt, Homo Sapiens; identical to SEQ ID NO: 54139

SEQ ID NO: 694357 - RNA, 64 nt, Homo Sapiens; identical to SEQ ID NO: 54140

SEQ ID NO: 694358 - RNA, 64 nt, Homo Sapiens; identical to SEQ ID NO: 54141

SEQ ID NO: 694359 - RNA, 64 nt, Homo Sapiens; identical to SEQ ID NO: 54142

SEQ ID NO: 694360 - RNA, 64 nt, Homo Sapiens; identical to SEQ ID NO: 54143

SEQ ID NO: 694361 - RNA, 64 nt, Homo Sapiens; identical to SEQ ID NO: 54144

SEQ ID NO: 694362 - RNA, 64 nt, Homo Sapiens; identical to SEQ ID NO: 54145

SEQ ID NO: 694363 - RNA, 64 nt, Homo Sapiens; identical to SEQ ID NO: 54146

SEQ ID NO: 694364 - RNA, 64 nt, Homo Sapiens; identical to SEQ ID NO: 54147

SEQ ID NO: 694365 - RNA, 64 nt, Homo Sapiens; identical to SEQ ID NO: 54148

SEQ ID NO: 694366 - RNA, 52 nt, Homo Sapiens; identical to SEQ ID NO: 54149

SEQ ID NO: 694367 - RNA, 64 nt, Homo Sapiens; identical to SEQ ID NO: 54150

SEQ ID NO: 694368 - RNA, 64 nt, Homo Sapiens; identical to SEQ ID NO: 54151

SEQ ID NO: 694369 - RNA, 64 nt, Homo Sapiens; identical to SEQ ID NO: 54152

SEQ ID NO: 694370 - RNA, 64 nt, Homo Sapiens; identical to SEQ ID NO: 54153

SEQ ID NO: 694371 - RNA, 64 nt, Homo Sapiens; identical to SEQ ID NO: 54154

SEQ ID NO: 694372 - RNA, 64 nt, Homo Sapiens; identical to SEQ ID NO: 54155

SEQ ID NO: 694373 - RNA, 64 nt, Homo Sapiens; identical to SEQ ID NO: 54156

SEQ ID NO: 694374 - RNA, 64 nt, Homo Sapiens; identical to SEQ ID NO: 54157

SEQ ID NO: 694375 - RNA, 64 nt, Homo Sapiens; identical to SEQ ID NO: 54158

SEQ ID NO: 694376 - RNA, 64 nt, Homo Sapiens; identical to SEQ ID NO: 54159

SEQ ID NO: 694377 - RNA, 64 nt, Homo Sapiens; identical to SEQ ID NO: 54160

SEQ ID NO: 694378 - RNA, 64 nt, Homo Sapiens; identical to SEQ ID NO: 54161

SEQ ID NO: 694379 - RNA, 64 nt, Homo Sapiens; identical to SEQ ID NO: 54162

SEQ ID NO: 694380 - RNA, 64 nt, Homo Sapiens; identical to SEQ ID NO: 54163

SEQ ID NO: 694381 - RNA, 64 nt, Homo Sapiens; identical to SEQ ID NO: 54164

SEQ ID NO: 694382 - RNA, 64 nt, Homo Sapiens; identical to SEQ ID NO: 54165

SEQ ID NO: 694383 - RNA, 64 nt, Homo Sapiens; identical to SEQ ID NO: 54166

SEQ ID NO: 694384 - RNA, 64 nt, Homo Sapiens; identical to SEQ ID NO: 54167

SEQ ID NO: 694385 - RNA, 64 nt, Homo Sapiens; identical to SEQ ID NO: 54168

SEQ ID NO: 694386 - RNA, 64 nt, Homo Sapiens; identical to SEQ ID NO: 54169

SEQ ID NO: 694387 - RNA, 64 nt, Homo Sapiens; identical to SEQ ID NO: 54170

SEQ ID NO: 694388 - RNA, 64 nt, Homo Sapiens; identical to SEQ ID NO: 54171

SEQ ID NO: 694389 - RNA, 64 nt, Homo Sapiens; identical to SEQ ID NO: 54172

SEQ ID NO: 694390 - RNA, 64 nt, Homo Sapiens; identical to SEQ ID NO: 54173

SEQ ID NO: 694391 - RNA, 64 nt, Homo Sapiens; identical to SEQ ID NO: 54174

SEQ ID NO: 694392 - RNA, 64 nt, Homo Sapiens; identical to SEQ ID NO: 54175

SEQ ID NO: 694393 - RNA, 64 nt, Homo Sapiens; identical to SEQ ID NO: 54176

SEQ ID NO: 694394 - RNA, 64 nt, Homo Sapiens; identical to SEQ ID NO: 54177

SEQ ID NO: 694395 - RNA, 64 nt, Homo Sapiens; identical to SEQ ID NO: 54178

SEQ ID NO: 694396 - RNA, 64 nt, Homo Sapiens; identical to SEQ ID NO: 54179

SEQ ID NO: 694397 - RNA, 64 nt, Homo Sapiens; identical to SEQ ID NO: 54180

SEQ ID NO: 694398 - RNA, 64 nt, Homo Sapiens; identical to SEQ ID NO: 54181

SEQ ID NO: 694399 - RNA, 64 nt, Homo Sapiens; identical to SEQ ID NO: 54182

SEQ ID NO: 694400 - RNA, 64 nt, Homo Sapiens; identical to SEQ ID NO: 54183

SEQ ID NO: 694401 - RNA, 64 nt, Homo Sapiens; identical to SEQ ID NO: 54184

SEQ ID NO: 694402 - RNA, 64 nt, Homo Sapiens; identical to SEQ ID NO: 54185

SEQ ID NO: 694403 - RNA, 64 nt, Homo Sapiens; identical to SEQ ID NO: 54186

SEQ ID NO: 694404 - RNA, 64 nt, Homo Sapiens; identical to SEQ ID NO: 54187

SEQ ID NO: 694405 - RNA, 64 nt, Homo Sapiens; identical to SEQ ID NO: 54188

SEQ ID NO: 694406 - RNA, 64 nt, Homo Sapiens; identical to SEQ ID NO: 54189

SEQ ID NO: 694407 - RNA, 64 nt, Homo Sapiens; identical to SEQ ID NO: 54190

SEQ ID NO: 694408 - RNA, 64 nt, Homo Sapiens; identical to SEQ ID NO: 54191

SEQ ID NO: 694409 - RNA, 64 nt, Homo Sapiens; identical to SEQ ID NO: 54192

SEQ ID NO: 694410 - RNA, 64 nt, Homo Sapiens; identical to SEQ ID NO: 54193

SEQ ID NO: 694411 - RNA, 64 nt, Homo Sapiens; identical to SEQ ID NO: 54194

SEQ ID NO: 694412 - RNA, 64 nt, Homo Sapiens; identical to SEQ ID NO: 54195

SEQ ID NO: 694413 - RNA, 64 nt, Homo Sapiens; identical to SEQ ID NO: 54196

SEQ ID NO: 694414 - RNA, 64 nt, Homo Sapiens; identical to SEQ ID NO: 54197

SEQ ID NO: 694415 - RNA, 64 nt, Homo Sapiens; identical to SEQ ID NO: 54198

SEQ ID NO: 694416 - RNA, 64 nt, Homo Sapiens; identical to SEQ ID NO: 54199

SEQ ID NO: 694417 - RNA, 64 nt, Homo Sapiens; identical to SEQ ID NO: 54200

SEQ ID NO: 694418 - RNA, 64 nt, Homo Sapiens; identical to SEQ ID NO: 54201

SEQ ID NO: 694419 - RNA, 64 nt, Homo Sapiens; identical to SEQ ID NO: 54202

SEQ ID NO: 694420 - RNA, 64 nt, Homo Sapiens; identical to SEQ ID NO: 54203

SEQ ID NO: 694421 - RNA, 64 nt, Homo Sapiens; identical to SEQ ID NO: 54204

SEQ ID NO: 694422 - RNA, 64 nt, Homo Sapiens; identical to SEQ ID NO: 54205

SEQ ID NO: 694423 - RNA, 64 nt, Homo Sapiens; identical to SEQ ID NO: 54206

SEQ ID NO: 694424 - RNA, 64 nt, Homo Sapiens; identical to SEQ ID NO: 54207

SEQ ID NO: 694425 - RNA, 64 nt, Homo Sapiens; identical to SEQ ID NO: 54208

SEQ ID NO: 694426 - RNA, 64 nt, Homo Sapiens; identical to SEQ ID NO: 54209

SEQ ID NO: 694427 - RNA, 64 nt, Homo Sapiens; identical to SEQ ID NO: 54210

SEQ ID NO: 694428 - RNA, 64 nt, Homo Sapiens; identical to SEQ ID NO: 54211

SEQ ID NO: 694429 - RNA, 64 nt, Homo Sapiens; identical to SEQ ID NO: 54212

SEQ ID NO: 694430 - RNA, 64 nt, Homo Sapiens; identical to SEQ ID NO: 54213

SEQ ID NO: 694431 - RNA, 64 nt, Homo Sapiens; identical to SEQ ID NO: 54214

SEQ ID NO: 694432 - RNA, 64 nt, Homo Sapiens; identical to SEQ ID NO: 54215

SEQ ID NO: 694433 - RNA, 64 nt, Homo Sapiens; identical to SEQ ID NO: 54216

SEQ ID NO: 694434 - RNA, 64 nt, Homo Sapiens; identical to SEQ ID NO: 54217

SEQ ID NO: 694435 - RNA, 64 nt, Homo Sapiens; identical to SEQ ID NO: 54218

SEQ ID NO: 694436 - RNA, 64 nt, Homo Sapiens; identical to SEQ ID NO: 54219

SEQ ID NO: 694437 - RNA, 64 nt, Homo Sapiens; identical to SEQ ID NO: 54220

SEQ ID NO: 694438 - RNA, 64 nt, Homo Sapiens; identical to SEQ ID NO: 54221

SEQ ID NO: 694439 - RNA, 64 nt, Homo Sapiens; identical to SEQ ID NO: 54222

SEQ ID NO: 694440 - RNA, 64 nt, Homo Sapiens; identical to SEQ ID NO: 54223

SEQ ID NO: 694441 - RNA, 64 nt, Homo Sapiens; identical to SEQ ID NO: 54224

SEQ ID NO: 694442 - RNA, 64 nt, Homo Sapiens; identical to SEQ ID NO: 54225

SEQ ID NO: 694443 - RNA, 64 nt, Homo Sapiens; identical to SEQ ID NO: 54226

SEQ ID NO: 694444 - RNA, 64 nt, Homo Sapiens; identical to SEQ ID NO: 54227

SEQ ID NO: 694445 - RNA, 64 nt, Homo Sapiens; identical to SEQ ID NO: 54228

SEQ ID NO: 694446 - RNA, 64 nt, Homo Sapiens; identical to SEQ ID NO: 54229

SEQ ID NO: 694447 - RNA, 64 nt, Homo Sapiens; identical to SEQ ID NO: 54230

SEQ ID NO: 694448 - RNA, 64 nt, Homo Sapiens; identical to SEQ ID NO: 54231

SEQ ID NO: 694449 - RNA, 64 nt, Homo Sapiens; identical to SEQ ID NO: 54232

SEQ ID NO: 694450 - RNA, 64 nt, Homo Sapiens; identical to SEQ ID NO: 54233

SEQ ID NO: 694451 - RNA, 64 nt, Homo Sapiens; identical to SEQ ID NO: 54234

SEQ ID NO: 694452 - RNA, 64 nt, Homo Sapiens; identical to SEQ ID NO: 54235

SEQ ID NO: 694453 - RNA, 64 nt, Homo Sapiens; identical to SEQ ID NO: 54236

SEQ ID NO: 694454 - RNA, 61 nt, Homo Sapiens
ugccucccaccgcuuuauuucuuucgguuucggaugcaaaacaaaaaauuuuaaaagaaaa

SEQ ID NO: 694455 - RNA, 61 nt, Homo Sapiens
agauauuaaguaugcaauuacuuguauuauaggaugcaaggucaucauauguaaaugccuu

SEQ ID NO: 694456 - RNA, 61 nt, Homo Sapiens
uaccacaugguggagggauggaggaacuacaggaugcaauucuucuucuaccaaugggcaa

SEQ ID NO: 694457 - RNA, 61 nt, Homo Sapiens
gaguguaggacacugagccauccgugggucaggaugcaauuauuuauaaaagucuccaggu

SEQ ID NO: 694458 - RNA, 61 nt, Homo Sapiens
gauauuacuucgcuauuaaauaaagaaaauuggaugcaagacaauggagaaacuuuaaaac

SEQ ID NO: 694459 - RNA, 61 nt, Homo Sapiens
aauuuucuuuuuaauuacuuuagagagcuagggaugcaaauguuuucaguuagaaagccuu

SEQ ID NO: 694460 - RNA, 61 nt, Homo Sapiens
acguggaagucaguuuaauugccagagagaaggaugcaaucacuagguaaaaugagguuuu

SEQ ID NO: 694461 - RNA, 61 nt, Homo Sapiens
uagauacuauauuaaacugugcaaggaagcuggaugcaagaaauuuuaaagucaguguacu

SEQ ID NO: 694462 - RNA, 61 nt, Homo Sapiens
aaguacugugacaguagccagauuauggccuggaugcaauagguuggggcuggguggucug

SEQ ID NO: 694463 - RNA, 61 nt, Homo Sapiens
cagggugggauuucuugagggcaauugacagggaugcaaucugaagcucagagggagaugg

SEQ ID NO: 694464 - RNA, 61 nt, Homo Sapiens
ggauauuaugccuugguuugccaggccuuuaggaugcaauauuagaagaguuuaaaaucuc

SEQ ID NO: 694465 - RNA, 61 nt, Homo Sapiens
aacuaaaugcuuuggugguuuuguuuugcugggaugcaaauuggaguaaagugugggauug

SEQ ID NO: 694466 - RNA, 61 nt, Homo Sapiens
gcuuuaaauugguagaaaagaaacuuuggcuggaugcaagagugauccuacuauaugacgg

SEQ ID NO: 694467 - RNA, 61 nt, Homo Sapiens
aggcuagugccucagagagaguaaccaagauggaugcaaagauagcuaauuuuagcuaucu

SEQ ID NO: 694468 - RNA, 61 nt, Homo Sapiens
uauguugugugccagucuggcauauuaucacggaugcaauucaauaguugaagggaaggug

SEQ ID NO: 694469 - RNA, 61 nt, Homo Sapiens
agcagcacacccugcaggcggaguuuucagaggaugcaauuuuggaucccgaauuuugaug

SEQ ID NO: 694470 - RNA, 61 nt, Homo Sapiens
aaaucacuguaauacuucauuguguuguacuggaugcaaagcuagaaaauauugcaauaaa

SEQ ID NO: 694471 - RNA, 61 nt, Homo Sapiens
cucucuaagauuuaguaagugaaaaaaaguaggaugcaagaguuuuuauaguugauuccau

SEQ ID NO: 694472 - RNA, 61 nt, Homo Sapiens
uuacuggccacaagcccuguauucucaacagggaugcaaauugguucuucaguaaggauaa

SEQ ID NO: 694473 - RNA, 61 nt, Homo Sapiens
uccuuugauuucccacugaagauaccccaaaggaugcaagugccuacaguauuaucaggag

SEQ ID NO: 694474 - RNA, 61 nt, Homo Sapiens
ucuauaaccaggcccuggcaaagugcaaacaggaugcaacugcaguggcacaaaggucacu

SEQ ID NO: 694475 - RNA, 61 nt, Homo Sapiens
gggaggccugccugcuagaauccuaaugugaggaugcaaaagaaaugaugauaacauuuug

SEQ ID NO: 694476 - RNA, 61 nt, Homo Sapiens
ggcaauaagauacccgcuacaaacugugauuggaugcaaaaucucuuagcuucuuucacga

SEQ ID NO: 694477 - RNA, 61 nt, Homo Sapiens
caaauucagaugauccucaaaaacuguucauggaugcaacuaaauaagaaaccaagggaua

SEQ ID NO: 694478 - RNA, 61 nt, Homo Sapiens
gacaggacccgucaucauaaccaauuuuacuggaugcaauuuagaugaguucucuauguga

SEQ ID NO: 694479 - RNA, 61 nt, Homo Sapiens
ugcauauucgcuccuaagggaggcucugaggggaugcaacaaaaugauccuuaugaugucc

SEQ ID NO: 694480 - RNA, 61 nt, Homo Sapiens
uuugaaccuguugugguaaagaucuuguacaggaugcaaacuaaaaaccuaaucccugcca

SEQ ID NO: 694481 - RNA, 61 nt, Homo Sapiens
agagugagcuacagagccgagcaauauuuauggaugcaacacgcauggucaacccucaggg

SEQ ID NO: 694482 - RNA, 61 nt, Homo Sapiens
aacaugccuccugcccugcuaaagacagugcggaugcaagagcaccuggccaagcgagagc

SEQ ID NO: 694483 - RNA, 61 nt, Homo Sapiens
cucuucauauuuauaugggggggagggcgcuggaugcaaaaguugaagaucgugaugcuau

SEQ ID NO: 694484 - RNA, 61 nt, Homo Sapiens
guauuuacccagaggauuuuccuaugguuggggaugcaaauauuagaaaacagauuguauu

SEQ ID NO: 694485 - RNA, 61 nt, Homo Sapiens
acugauguuuguguuacucaaaaaaacuacuggaugcaaacuguuauguaaaucugagauu

SEQ ID NO: 694486 - RNA, 61 nt, Homo Sapiens
ggagaugaaugaucaaagugaaacaauguuuggaugcaacgcagaauaaaagaauauaaga

SEQ ID NO: 694487 - RNA, 61 nt, Homo Sapiens
aguucuuaaguuucgguuuuuuuuaaaaacaggaugcaacuuaaacuuuucuuugcaucaa

SEQ ID NO: 694488 - RNA, 61 nt, Homo Sapiens
ccagccacagcagacaaucagcagcaucuauggaugcaaauuuggagcccuuuugcaguca

SEQ ID NO: 694489 - RNA, 61 nt, Homo Sapiens
aaagccugcucucccaagguucuguccugggggaugcaaaucccccgacucccuccccaga

SEQ ID NO: 694490 - RNA, 61 nt, Homo Sapiens
cuuaaaacaguccuuuaauagauuuuccuugggaugcaaauggaucauuuuuauguagcau

SEQ ID NO: 694491 - RNA, 61 nt, Homo Sapiens
aauauuuauauauuugaauauagaaaccugaggaugcaacaucauuuuuuuaacacauaac

SEQ ID NO: 694492 - RNA, 61 nt, Homo Sapiens
aaagauaagaauaucaggaagcuuuuucucuggaugcaaaauuggaaauacuguguuuaaa

SEQ ID NO: 694493 - RNA, 61 nt, Homo Sapiens
gccaagguguauguguuuaagggggugugauggaugcaaagggaaugaggaauucagcacu

SEQ ID NO: 694494 - RNA, 61 nt, Homo Sapiens
aaugaaguauuuuguguagaagguuaaauuaggaugcaaaacagaucugccauuccuuuuu

SEQ ID NO: 694495 - RNA, 61 nt, Homo Sapiens
guguaacaguacucucaugcaauuuuuuucaggaugcaaaggcaauuauucuuuguaagcg

SEQ ID NO: 694496 - RNA, 61 nt, Homo Sapiens
ucaaagcauaagguccauggugguggaaaauggaugcaagugauucuaaguuuguggauuu

SEQ ID NO: 694497 - RNA, 61 nt, Homo Sapiens
auguuucugaaacugcuaugguuucucugguggaugcaaugugaauaucaguuuuagaaua

SEQ ID NO: 694498 - RNA, 61 nt, Homo Sapiens
gccaaauaucaagaugugaaggacuaauucaggaugcaaaaacguuauugggggguuguaa

SEQ ID NO: 694499 - RNA, 61 nt, Homo Sapiens
ggguuguaaauaucaacuauucaacaguuuaggaugcaauuacgaguguaaacugugugcc

SEQ ID NO: 694500 - RNA, 61 nt, Homo Sapiens
augcuuuaccauauaucaggaauuauauccaggaugcaauacucagacacuagcuuuuuuc

SEQ ID NO: 694501 - RNA, 61 nt, Homo Sapiens
ucuauuaucccaacagaagaacuucuuuccaggaugcaaggcuaucaguagcaguauuguu

SEQ ID NO: 694502 - RNA, 61 nt, Homo Sapiens
caauucuuccuuuuuuauuauguccugcuacggaugcaauucuuuaacguaugaggaaggu

SEQ ID NO: 694503 - RNA, 61 nt, Homo Sapiens
auugcuaaauauguuagcccuuguaugucugggaugcaaguauuuaguguaucuuuuaaug

SEQ ID NO: 694504 - RNA, 61 nt, Homo Sapiens
uggaggaagggaggcccaugagcauaguccuggaugcaaccucacagcagacacgcuagac

SEQ ID NO: 694505 - RNA, 61 nt, Homo Sapiens
ugcauugcaaaaucaaacugggcaguuucaaggaugcaaauaccccgucccccuccagacu

SEQ ID NO: 694506 - RNA, 61 nt, Homo Sapiens
guuucuaguuucuuaaauagcccacaccccuggaugcaaaaaggcaggguuauuuuuaccc

SEQ ID NO: 694507 - RNA, 61 nt, Homo Sapiens
guggaaggaaaaugugaaugaaaguagugcuggaugcaauuacuccugaaccccaccuagg

SEQ ID NO: 694508 - RNA, 61 nt, Homo Sapiens
caccaggcagugugcuuccuuccuugcaugaggaugcaagaugcaacaguuugucuuucac

SEQ ID NO: 694509 - RNA, 61 nt, Homo Sapiens
ugugacuuuauuagcagcugacuuucaaaguggaugcaauuuuucuuucuuuuguugggga

SEQ ID NO: 694510 - RNA, 61 nt, Homo Sapiens
aaagaggcacagagccaaauugguagaggaaggaugcaaaguauaaauuuguguaauauua

SEQ ID NO: 694511 - RNA, 61 nt, Homo Sapiens
cacaagaaaaucauguccuuuucagcaacauggaugcaacuagaggcuauuauccuaagca

SEQ ID NO: 694512 - RNA, 61 nt, Homo Sapiens
uacuugcaugggguaacccaguaauacugugggaugcaacuucuagggcauggcugccucc

SEQ ID NO: 694513 - RNA, 61 nt, Homo Sapiens
cuaggaaguaaagugaagaaaacccuuucugggaugcaauagagccaauaucccuuacuuu

SEQ ID NO: 694514 - RNA, 61 nt, Homo Sapiens
uaggcugagggaaagacgucgccuggagcugggaugcaaugcucacccauggcccacccag

SEQ ID NO: 694515 - RNA, 61 nt, Homo Sapiens
acucaacaacuauccuauucuccauuaucugggaugcaacccuucgacugugacauacaag

SEQ ID NO: 694516 - RNA, 61 nt, Homo Sapiens
agaaacugaaugauguugaauuuccuaaaugggaugcaaaagucagccucagcaacaaaca

SEQ ID NO: 694517 - RNA, 61 nt, Homo Sapiens
cuacucagcccucuccugcggccacaucaacggaugcaagucacagucuuaacacagccug

SEQ ID NO: 694518 - RNA, 61 nt, Homo Sapiens
cgcggggagugaggaggggucagggggcuaaggaugcaaccucugacguucugcgccuucc

SEQ ID NO: 694519 - RNA, 61 nt, Homo Sapiens
ggacuugggcagaggaggucgaagccccuagggaugcaaguugcccuggcuacagaacaug

SEQ ID NO: 694520 - RNA, 61 nt, Homo Sapiens
aauggccgugcaagcuuaggcuggggauucuggaugcaacgucuuuacaaccuuaccuaga

SEQ ID NO: 694521 - RNA, 61 nt, Homo Sapiens
uagccauauacccaggcucugcaguaucgaaggaugcaaauguugacauagauggaagcuc

SEQ ID NO: 694522 - RNA, 61 nt, Homo Sapiens
aaaacuaugugcuaucacauguuaguacuuuggaugcaauuucuugauugcuagaguuuuu

SEQ ID NO: 694523 - RNA, 61 nt, Homo Sapiens
auaaaugcuuaaccaacacuuauuaggauuaggaugcaaaauccuaaauucauagagugga

SEQ ID NO: 694524 - RNA, 61 nt, Homo Sapiens
ccuuugcguuucauauguaguaaaccaugggggaugcaacccagcuaacauggguuagguu

SEQ ID NO: 694525 - RNA, 61 nt, Homo Sapiens
acaacacacggcuaugaucaaaaccaugacaggaugcaaccucuccuugaugucugugauc

SEQ ID NO: 694526 - RNA, 61 nt, Homo Sapiens
ccagaaugaccugaugaggaaaucuucaauaggaugcaaagaucaaugcaaaaauuguuau

SEQ ID NO: 694527 - RNA, 61 nt, Homo Sapiens
ucugaguguaaacuacaugguagguugugaaggaugcaaauaucgaaucaaucauuuuuua

SEQ ID NO: 694528 - RNA, 61 nt, Homo Sapiens
uagcuguuccucauggccaugacuggaacagggaugcaaccucuuucuacacaagcacagu

SEQ ID NO: 694529 - RNA, 61 nt, Homo Sapiens
ccugaaaccaggugcuuccuucuugggaaagggaugcaaucauuucugagugaagugcacg

SEQ ID NO: 694530 - RNA, 61 nt, Homo Sapiens
ccagacugaagaacacgguucugggaagagaggaugcaagacggggccucaggcuucucag

SEQ ID NO: 694531 - RNA, 61 nt, Homo Sapiens
caguuuauuuaaccauucccuuccauuuaauggaugcaacuauuuuaauggcuauauuaua

SEQ ID NO: 694532 - RNA, 61 nt, Homo Sapiens
ccauguggaugucaccaaaccagggcaccagggaugcaauugucagguccacaccuauguc

SEQ ID NO: 694533 - RNA, 61 nt, Homo Sapiens
gucagggccuugggcaagacauugggcucuaggaugcaauuggcaaauacguccccguuac

SEQ ID NO: 694534 - RNA, 61 nt, Homo Sapiens
uuuuguacaaaucuguauuguauuaauuucuggaugcaauuuuucaaauauuaaaauuaua

SEQ ID NO: 694535 - RNA, 61 nt, Homo Sapiens
aggugaugaaaaggagacaggaggguuguugggaugcaaggagcacaacaggaaagccugg

SEQ ID NO: 694536 - RNA, 61 nt, Homo Sapiens
cucgaggaaaauuagucgaucaggauucuaaggaugcaauccccagaagccuccggcggcc

SEQ ID NO: 694537 - RNA, 61 nt, Homo Sapiens
ucagcucagggauucauuuugugauguuuucggaugcaaaccacccaaaugaagugugaac

SEQ ID NO: 694538 - RNA, 61 nt, Homo Sapiens
cagagagccagcagccuugggauacuaaugaggaugcaacuggcuuauugguaugaaauag

SEQ ID NO: 694539 - RNA, 61 nt, Homo Sapiens
uuuuuguauuucagagaaaauucagguaccaggaugcaauggauuuauuugauucagggga

SEQ ID NO: 694540 - RNA, 61 nt, Homo Sapiens
uuuucuucuggucacaaaauaaagaaauuugggaugcaaaguaccuaaagaucucugaucc

SEQ ID NO: 694541 - RNA, 61 nt, Homo Sapiens
aagaauuuggcuuuuugaaagugggaaucauggaugcaaagagaugcagagaaagcuaaau

SEQ ID NO: 694542 - RNA, 61 nt, Homo Sapiens
aauugugguugugucacagucuggaauucgaggaugcaauugugggaggaucuauugagcc

SEQ ID NO: 694543 - RNA, 61 nt, Homo Sapiens
gcaaaucuaaaauuacgaagcgcaguuaggaggaugcaacuguggugcuucugccauuaga

SEQ ID NO: 694544 - RNA, 61 nt, Homo Sapiens
gucgaugcuuaagaaaaccgcuugaaccuuuggaugcaaauucuggaaccugaggcggcug

SEQ ID NO: 694545 - RNA, 61 nt, Homo Sapiens
agagacauaugggccauaccccuuaaccccgggaugcaagguagcauggguccaagagaca

SEQ ID NO: 694546 - RNA, 61 nt, Homo Sapiens
aagagaugaaauaaauuaagcaguagauccaggaugcaaaauccucccaauuccugugcau

SEQ ID NO: 694547 - RNA, 61 nt, Homo Sapiens
uuucaugaucaucauuaacaguuuguccuuaggaugcaaaugaaaaugugaauacauaccu

SEQ ID NO: 694548 - RNA, 61 nt, Homo Sapiens
guaacacacccucccugcuccaagugcaccaggaugcaaaugcacagaauucaccaggggc

SEQ ID NO: 694549 - RNA, 61 nt, Homo Sapiens
cgggcuggguguucacgugugucugugucauggaugcaaugcaggcccuggaggacugugc

SEQ ID NO: 694550 - RNA, 61 nt, Homo Sapiens
agcugccugugacaccuggcgagaagaaccgggaugcaagggccugggguugacuggguua

SEQ ID NO: 694551 - RNA, 61 nt, Homo Sapiens
gaagcagagugugggugcccggugggaggauggaugcaacugggucaggaguugaauuugg

SEQ ID NO: 694552 - RNA, 61 nt, Homo Sapiens
ugagaggauggcaugccagauccucuggguuggaugcaaugugcugagcauucauuuugcg

SEQ ID NO: 694553 - RNA, 61 nt, Homo Sapiens
uaucacauaagacaucaugaaaauagaauguggaugcaaaaugaauuguaaaugaacuuaa

SEQ ID NO: 694554 - RNA, 61 nt, Homo Sapiens
caucccguccugagcacggguguccgaggcgggaugcaaacaacgcccugagagucccgga

SEQ ID NO: 694555 - RNA, 61 nt, Homo Sapiens
guagaaagcuacuuauuuuauucucuucaaaggaugcaauagccaaaccagcagaacauuc

SEQ ID NO: 694556 - RNA, 61 nt, Homo Sapiens
acauguuucaagacgcuguguuagacacuagggaugcaaagaugaaugagauaaggccuca

SEQ ID NO: 694557 - RNA, 61 nt, Homo Sapiens
uaucgaccaucacccucccccgcgugaacugggaugcaaguugcuaaccgaugugaacgca

SEQ ID NO: 694558 - RNA, 61 nt, Homo Sapiens
uuuuguugucuaaaggugcugugguugaacaggaugcaaucaauguuauaauuuauauagu

SEQ ID NO: 694559 - RNA, 61 nt, Homo Sapiens
cuccaagcccacuugaaaagucacacugaaaggaugcaaauagccgucugcgauuuuggcg

SEQ ID NO: 694560 - RNA, 56 nt, Homo Sapiens
ucgauauugaugccauuuaaagggauggaugcaaccuagcuuaacaguauaaugcu

SEQ ID NO: 694561 - RNA, 61 nt, Homo Sapiens
uucaugguguuuucagggaacacagaaaugcggaugcaaaacaacuuuugacagaggccca

SEQ ID NO: 694562 - RNA, 61 nt, Homo Sapiens
agagacacggucuggacagcccaaggcgccaggaugcaaccugcuuucaccagacugcaga

SEQ ID NO: 694563 - RNA, 61 nt, Homo Sapiens
ccuguauccggagcugugcugggcacugaggggaugcaacaaaauuaggagaggauccuug

SEQ ID NO: 694564 - RNA, 61 nt, Homo Sapiens
gugagcaagcagcacccccagaccuagcuagggaugcaagaggcccagaggagcuggugcu

SEQ ID NO: 694565 - RNA, 61 nt, Homo Sapiens
guggaugguccagagccuccacccacagaggggaugcaaagggcaggugagucaagaaccg

SEQ ID NO: 694566 - RNA, 61 nt, Homo Sapiens
cugucuccaaggcccaggacacuugucagaaggaugcaaaaaaagaaaaaaguacauccac

SEQ ID NO: 694567 - RNA, 54 nt, Homo Sapiens
gcccggaaguccacggcugagccaggaugcaaggcuccugguccuguuugcagc

SEQ ID NO: 694568 - RNA, 61 nt, Homo Sapiens
ggguuucuucuugaagcagcuccugcaaaagggaugcaaagaggucccagggaccugcccc

SEQ ID NO: 694569 - RNA, 61 nt, Homo Sapiens
cuaacgaagcaugcgugucucuucaucuacaggaugcaauaggcugauuguauuuaaaaau

SEQ ID NO: 694570 - RNA, 61 nt, Homo Sapiens
ggagcucccagucgcauggagcgguguucauggaugcaacagacccuggcuucuggagucc

SEQ ID NO: 694571 - RNA, 61 nt, Homo Sapiens
guuuuauaaaauaaauuugccacauaauaugggaugcaauaaccaacaaagcugcuaagug

SEQ ID NO: 694572 - RNA, 61 nt, Homo Sapiens
uccgugucacuaaacuaguguuuauaaguagggaugcaaaauuaggcaguaucauuuccau

SEQ ID NO: 694573 - RNA, 61 nt, Homo Sapiens
gcgggguuuguuaggggcggcagaggcaucuggaugcaaacucucacaccguaucuaggga

SEQ ID NO: 694574 - RNA, 61 nt, Homo Sapiens
cgucccuguguuccccacgucgugccaucugggaugcaaacgugugauggagagucucugc

SEQ ID NO: 694575 - RNA, 61 nt, Homo Sapiens
gagaaaauaaaagacugcacaaucaagguuaggaugcaacuaggggcccguuucugguuga

SEQ ID NO: 694576 - RNA, 61 nt, Homo Sapiens
uaaugacccgcuuuucuagacuccuaugaaaggaugcaauauuucaggucgugauaaugag

SEQ ID NO: 694577 - RNA, 61 nt, Homo Sapiens
ggccucuacccacaccuggagccagcaggguggaugcaagguggagaccagggacaggaga

SEQ ID NO: 694578 - RNA, 61 nt, Homo Sapiens
cccagcuugcccaccgcgggcggacugcugcggaugcaacuggagaggagcuggguugaag

SEQ ID NO: 694579 - RNA, 61 nt, Homo Sapiens
guccugacuuugggcgcuggguauuggaaauggaugcaaaguacaauguguuuuucuccag

SEQ ID NO: 694580 - RNA, 61 nt, Homo Sapiens
cuuuucugugaagacaagucgaaauuuuugaggaugcaaagacuauuuuucaguugagaaa

SEQ ID NO: 694581 - RNA, 61 nt, Homo Sapiens
auuccauucauuagugugaucugauaauugaggaugcaaacugggauggcaccuauauugg

SEQ ID NO: 694582 - RNA, 61 nt, Homo Sapiens
auccaccaugaucaagugggcuucaucccugggaugcaaggcugguucaacauacgcaaau

SEQ ID NO: 694583 - RNA, 61 nt, Homo Sapiens
acuacaaaccacugcuuaacgaaauaaaagaggaugcaaagaaauggaagagcauuccaug

SEQ ID NO: 694584 - RNA, 61 nt, Homo Sapiens
gacauguucaaauguuugaauuuauacucugggaugcaaccgaaugagaagugagaagguu

SEQ ID NO: 694585 - RNA, 61 nt, Homo Sapiens
ccuaugaguauauuaauauuaacuucucccuggaugcaaaacuguguuagggaaaauaugg

SEQ ID NO: 694586 - RNA, 61 nt, Homo Sapiens
ugcugucucggggcucuccuuguuagcagcgggaugcaagacuguugcaggaagccccucc

SEQ ID NO: 694587 - RNA, 61 nt, Homo Sapiens
agaugaugcugagcgugaaccuaggaagcaaggaugcaacaaggaguuguugaacccacug

SEQ ID NO: 694588 - RNA, 61 nt, Homo Sapiens
guugcagugaguugagucauucaaagcccagggaugcaaagaggguucagagaaccagggu

SEQ ID NO: 694589 - RNA, 61 nt, Homo Sapiens
cagucacagagcuggaaacaugaaauaaaaaggaugcaaauaaaucuauagaaauacaaaa

SEQ ID NO: 694590 - RNA, 61 nt, Homo Sapiens
agcccacacaggaaagacaagaggagacaauggaugcaaacgugacacccccagaccucug

SEQ ID NO: 694591 - RNA, 61 nt, Homo Sapiens
gaauuaggacuauaauuuucuaccgugacugggaugcaagacaguauuuauuauaaauuac

SEQ ID NO: 694592 - RNA, 61 nt, Homo Sapiens
ggccucacugcugcgcaagggguggggccgaggaugcaaguccaggcagagcggcgcaggc

SEQ ID NO: 694593 - RNA, 61 nt, Homo Sapiens
guaccaggagcuagcuuuuaaaacugaguguggaugcaaaagucugguuuaaggcacaggu

SEQ ID NO: 694594 - RNA, 61 nt, Homo Sapiens
cauucaagaguuucagccugcuuauauaugaggaugcaaagcuuuaagcacugaugauuuu

SEQ ID NO: 694595 - RNA, 61 nt, Homo Sapiens
cgcccuguuuggcaucuaauggggagaggagggaugcaacuuggaauuuugguuggggugg

SEQ ID NO: 694596 - RNA, 61 nt, Homo Sapiens
aauaugccagaacuacagacaacagcccacaggaugcaaaagugcuuugccaucuuaaaaa

SEQ ID NO: 694597 - RNA, 61 nt, Homo Sapiens
guccugauggagcaagaggcccacgccuaggggaugcaagaacaacccguuucuuaaaugu

SEQ ID NO: 694598 - RNA, 61 nt, Homo Sapiens
uuacccuugagcugugugcccagaagggccuggaugcaaggucccucccauccuacucuca

SEQ ID NO: 694599 - RNA, 61 nt, Homo Sapiens
auucuaaaucuguuccauuaucuucucuguaggaugcaaaacauccaguuguaauguauaa

SEQ ID NO: 694600 - RNA, 61 nt, Homo Sapiens
gauuaggauuuuaacauaugaauuuugggggggaugcaaucauucagcccauaauacccuc

SEQ ID NO: 694601 - RNA, 61 nt, Homo Sapiens
uaugaguguauguguuuauguaacuuccuguggaugcaaauagauucagagaaauuuagag

SEQ ID NO: 694602 - RNA, 61 nt, Homo Sapiens
auucucccgggacucugcauaaggcaaaaaaggaugcaacaagacuggcaagaaaagaguu

SEQ ID NO: 694603 - RNA, 61 nt, Homo Sapiens
aauguggccaagccuaucaaaguaaagcagaggaugcaacagaggauguggccugguucaa

SEQ ID NO: 694604 - RNA, 61 nt, Homo Sapiens
ugugcuaguccaugaccuuucagcauuccagggaugcaaaauugauaaccauccuuugggg

SEQ ID NO: 694605 - RNA, 61 nt, Homo Sapiens
uauuaaaaauguuggccuggccucuuaauauggaugcaacugugaucauuugcacuuguua

SEQ ID NO: 694606 - RNA, 61 nt, Homo Sapiens
guugaaagcuuugaaauaaaauaagucaggaggaugcaauuuaauucugaccaauaaaaaa

SEQ ID NO: 694607 - RNA, 64 nt, Homo Sapiens
cccugccucccaccgcuuuauuucuuucgguuucggaugcaaaacaaaaaauuuuaaaagaaaa

SEQ ID NO: 694608 - RNA, 64 nt, Homo Sapiens
uacagauauuaaguaugcaauuacuuguauuauaggaugcaaggucaucauauguaaaugccuu

SEQ ID NO: 694609 - RNA, 64 nt, Homo Sapiens
ucuuaccacaugguggagggauggaggaacuacaggaugcaauucuucuucuaccaaugggcaa

SEQ ID NO: 694610 - RNA, 64 nt, Homo Sapiens
uaugaguguaggacacugagccauccgugggucaggaugcaauuauuuauaaaagucuccaggu

SEQ ID NO: 694611 - RNA, 64 nt, Homo Sapiens
ugugauauuacuucgcuauuaaauaaagaaaauuggaugcaagacaauggagaaacuuuaaaac

SEQ ID NO: 694612 - RNA, 64 nt, Homo Sapiens
uguaauuuucuuuuuaauuacuuuagagagcuagggaugcaaauguuuucaguuagaaagccuu

SEQ ID NO: 694613 - RNA, 64 nt, Homo Sapiens
gacacguggaagucaguuuaauugccagagagaaggaugcaaucacuagguaaaaugagguuuu

SEQ ID NO: 694614 - RNA, 64 nt, Homo Sapiens
uagauacuauauuaaacuguacugcaaggaagcuggaugcaagauuuaauuuuaaagucagugu

SEQ ID NO: 694615 - RNA, 64 nt, Homo Sapiens
aaguacugugacaguagccacuggauuauggccuggaugcaauaugggguuggggcuggguggu

SEQ ID NO: 694616 - RNA, 64 nt, Homo Sapiens
cagggugggauuucuugaggugggcaauugacagggaugcaaucguuugaagcucagagggaga

SEQ ID NO: 694617 - RNA, 64 nt, Homo Sapiens
ggauauuaugccuugguuugcucccaggccuuuaggaugcaauaaccuuagaagaguuuaaaau

SEQ ID NO: 694618 - RNA, 64 nt, Homo Sapiens
aacuaaaugcuuuggugguuuuguuguuuugcugggaugcaaauugauggaguaaaguguggga

SEQ ID NO: 694619 - RNA, 64 nt, Homo Sapiens
gcuuuaaauugguagaaaagcggaaacuuuggcuggaugcaagaagagugauccuacuauauga

SEQ ID NO: 694620 - RNA, 64 nt, Homo Sapiens
aggcuagugccucagagagaucuguaaccaagauggaugcaaaguuuauagcuaauuuuagcua

SEQ ID NO: 694621 - RNA, 64 nt, Homo Sapiens
uauguugugugccagucugggugcauauuaucacggaugcaauuaagcaauaguugaagggaag

SEQ ID NO: 694622 - RNA, 64 nt, Homo Sapiens; identical to SEQ ID NO: 461318

SEQ ID NO: 694623 - RNA, 64 nt, Homo Sapiens; identical to SEQ ID NO: 461319

SEQ ID NO: 694624 - RNA, 64 nt, Homo Sapiens
aaacucucuaagauuuaguaagugaaaaaaaguaggaugcaagaguuuuuauaguugauuccau

SEQ ID NO: 694625 - RNA, 64 nt, Homo Sapiens
uuauuacuggccacaagcccuguauucucaacagggaugcaaauugguucuucaguaaggauaa

SEQ ID NO: 694626 - RNA, 64 nt, Homo Sapiens
caguccuuugauuucccacugaagauaccccaaaggaugcaagugccuacaguauuaucaggag

SEQ ID NO: 694627 - RNA, 64 nt, Homo Sapiens
uugucuauaaccaggcccuggcaaagugcaaacaggaugcaacugcaguggcacaaaggucacu

SEQ ID NO: 694628 - RNA, 64 nt, Homo Sapiens
cuugggaggccugccugcuagaauccuaaugugaggaugcaaaagaaaugaugauaacauuuug

SEQ ID NO: 694629 - RNA, 64 nt, Homo Sapiens
auuggcaauaagauacccgcuacaaacugugauuggaugcaaaaucucuuagcuucuuucacga

SEQ ID NO: 694630 - RNA, 64 nt, Homo Sapiens
caaauucagaugauccucaaauaaaacuguucauggaugcaacucgcaaauaagaaaccaaggg

SEQ ID NO: 694631 - RNA, 64 nt, Homo Sapiens
gacaggacccgucaucauaaugaccaauuuuacuggaugcaauuuuuuagaugaguucucuaug

SEQ ID NO: 694632 - RNA, 64 nt, Homo Sapiens
uucugcauauucgcuccuaagggaggcucugaggggaugcaacaaaaugauccuuaugaugucc

SEQ ID NO: 694633 - RNA, 64 nt, Homo Sapiens
ugauuugaaccuguugugguaaagaucuuguacaggaugcaaacuaaaaaccuaaucccugcca

SEQ ID NO: 694634 - RNA, 64 nt, Homo Sapiens
uggagagugagcuacagagccgagcaauauuuauggaugcaacacgcauggucaacccucaggg

SEQ ID NO: 694635 - RNA, 64 nt, Homo Sapiens
cccaacaugccuccugcccugcuaaagacagugcggaugcaagagcaccuggccaagcgagagc

SEQ ID NO: 694636 - RNA, 64 nt, Homo Sapiens
uuucucuucauauuuauaugggggggagggcgcuggaugcaaaaguugaagaucgugaugcuau

SEQ ID NO: 694637 - RNA, 64 nt, Homo Sapiens
gagguauuuacccagaggauuuuccuaugguuggggaugcaaauauuagaaaacagauuguauu

SEQ ID NO: 694638 - RNA, 64 nt, Homo Sapiens
uauacugauguuuguguuacucaaaaaaacuacuggaugcaaacuguuauguaaaucugagauu

SEQ ID NO: 694639 - RNA, 64 nt, Homo Sapiens
uauggagaugaaugaucaaagugaaacaauguuuggaugcaacgcagaauaaaagaauauaaga

SEQ ID NO: 694640 - RNA, 64 nt, Homo Sapiens
uucaguucuuaaguuucgguuuuuuuuaaaaacaggaugcaacuuaaacuuuucuuugcaucaa

SEQ ID NO: 694641 - RNA, 64 nt, Homo Sapiens
ccagccacagcagacaaucaucagcagcaucuauggaugcaaauuucuuggagcccuuuugcag

SEQ ID NO: 694642 - RNA, 64 nt, Homo Sapiens
aaagccugcucucccaagguagaucuguccugggggaugcaaauaaucccccgacucccucccc

SEQ ID NO: 694643 - RNA, 64 nt, Homo Sapiens
cuuaaaacaguccuuuaauacaugauuuuccuugggaugcaaaucuuggaucauuuuuauguag

SEQ ID NO: 694644 - RNA, 64 nt, Homo Sapiens
aauauuuauauauuugaauaaacuagaaaccugaggaugcaacaauaucauuuuuuuaacacau

SEQ ID NO: 694645 - RNA, 62 nt, Homo Sapiens
aaagauaagaauaucaggaaagcuuuuucucuggaugcaaaauuuggaaauacuguguuuaa

SEQ ID NO: 694646 - RNA, 64 nt, Homo Sapiens
caugccaagguguauguguuuaagggggugugauggaugcaaagggaaugaggaauucagcacu

SEQ ID NO: 694647 - RNA, 64 nt, Homo Sapiens
uuuaaugaaguauuuuguguagaagguuaaauuaggaugcaaaacagaucugccauuccuuuuu

SEQ ID NO: 694648 - RNA, 64 nt, Homo Sapiens
acaguguaacaguacucucaugcaauuuuuuucaggaugcaaaggcaauuauucuuuguaagcg

SEQ ID NO: 694649 - RNA, 64 nt, Homo Sapiens
aguucaaagcauaagguccauggugguggaaaauggaugcaagugauucuaaguuuguggauuu

SEQ ID NO: 694650 - RNA, 64 nt, Homo Sapiens
auguuucugaaacugcuaugauaguuucucugguggaugcaauggugugaauaucaguuuuaga

SEQ ID NO: 694651 - RNA, 64 nt, Homo Sapiens; identical to SEQ ID NO: 461320

SEQ ID NO: 694652 - RNA, 64 nt, Homo Sapiens; identical to SEQ ID NO: 461321

SEQ ID NO: 694653 - RNA, 64 nt, Homo Sapiens
uuuaugcuuuaccauauaucaggaauuauauccaggaugcaauacucagacacuagcuuuuuuc

SEQ ID NO: 694654 - RNA, 64 nt, Homo Sapiens
ucuauuaucccaacagaagaguuacuucuuuccaggaugcaaggcuucuaucaguagcaguauu

SEQ ID NO: 694655 - RNA, 64 nt, Homo Sapiens
caauucuuccuuuuuuauuagguuguccugcuacggaugcaauuccucuuuaacguaugaggaa

SEQ ID NO: 694656 - RNA, 64 nt, Homo Sapiens
auugcuaaauauguuagcccauguuguaugucugggaugcaaguagaauuuaguguaucuuuua

SEQ ID NO: 694657 - RNA, 64 nt, Homo Sapiens
uggaggaagggaggcccauggacagcauaguccuggaugcaaccaagucacagcagacacgcua

SEQ ID NO: 694658 - RNA, 64 nt, Homo Sapiens
ugcauugcaaaaucaaacugacuggcaguuucaaggaugcaaaugcuaccccgucccccuccag

SEQ ID NO: 694659 - RNA, 64 nt, Homo Sapiens
gcuguuucuaguuucuuaaauagcccacaccccuggaugcaaaaaggcaggguuauuuuuaccc

SEQ ID NO: 694660 - RNA, 64 nt, Homo Sapiens
guuguggaaggaaaaugugaaugaaaguagugcuggaugcaauuacuccugaaccccaccuagg

SEQ ID NO: 694661 - RNA, 64 nt, Homo Sapiens
gcucaccaggcagugugcuuccuuccuugcaugaggaugcaagaugcaacaguuugucuuucac

SEQ ID NO: 694662 - RNA, 64 nt, Homo Sapiens
uacugugacuuuauuagcagcugacuuucaaaguggaugcaauuuuucuuucuuuuguugggga

SEQ ID NO: 694663 - RNA, 64 nt, Homo Sapiens
uucaaagaggcacagagccaaauugguagaggaaggaugcaaaguauaaauuuguguaauauua

SEQ ID NO: 694664 - RNA, 64 nt, Homo Sapiens
aaacacaagaaaaucauguccuuuucagcaacauggaugcaacuagaggcuauuauccuaagca

SEQ ID NO: 694665 - RNA, 64 nt, Homo Sapiens
aauuacuugcaugggguaacccaguaauacugugggaugcaacuucuagggcauggcugccucc

SEQ ID NO: 694666 - RNA, 64 nt, Homo Sapiens
cuaggaaguaaagugaagaauuuaacccuuucugggaugcaauacaggagccaauaucccuuac

SEQ ID NO: 694667 - RNA, 64 nt, Homo Sapiens
uaggcugagggaaagacguccaggccuggagcugggaugcaaugcuucucacccauggcccacc

SEQ ID NO: 694668 - RNA, 64 nt, Homo Sapiens
acucaacaacuauccuauucaaguccauuaucugggaugcaaccauacuucgacugugacauac

SEQ ID NO: 694669 - RNA, 64 nt, Homo Sapiens
agaaacugaaugauguugaaacauuuccuaaaugggaugcaaaauuugucagccucagcaacaa

SEQ ID NO: 694670 - RNA, 64 nt, Homo Sapiens
cuacuacucagcccucuccugcggccacaucaacggaugcaagucacagucuuaacacagccug

SEQ ID NO: 694671 - RNA, 64 nt, Homo Sapiens
cagcgcggggagugaggaggggucagggggcuaaggaugcaaccucugacguucugcgccuucc

SEQ ID NO: 694672 - RNA, 64 nt, Homo Sapiens
ggacuugggcagaggaggucauggaagccccuagggaugcaaguccuugcccuggcuacagaac

SEQ ID NO: 694673 - RNA, 64 nt, Homo Sapiens
caaaauggccgugcaagcuuaggcuggggauucuggaugcaacgucuuuacaaccuuaccuaga

SEQ ID NO: 694674 - RNA, 64 nt, Homo Sapiens
guguagccauauacccaggcucugcaguaucgaaggaugcaaauguugacauagauggaagcuc

SEQ ID NO: 694675 - RNA, 64 nt, Homo Sapiens
aaaacuaugugcuaucacauuuuguuaguacuuuggaugcaauucauucuugauugcuagaguu

SEQ ID NO: 694676 - RNA, 64 nt, Homo Sapiens
auaaaugcuuaaccaacacuggauauuaggauuaggaugcaaaaagguccuaaauucauagagu

SEQ ID NO: 694677 - RNA, 64 nt, Homo Sapiens
ccuuugcguuucauauguagguuuaaaccaugggggaugcaaccuugcagcuaacauggguuag

SEQ ID NO: 694678 - RNA, 64 nt, Homo Sapiens
acaacacacggcuaugaucaaucaaaccaugacaggaugcaaccacaucuccuugaugucugug

SEQ ID NO: 694679 - RNA, 64 nt, Homo Sapiens
ccaccagaaugaccugaugaggaaaucuucaauaggaugcaaagaucaaugcaaaaauuguuau

SEQ ID NO: 694680 - RNA, 64 nt, Homo Sapiens
ggcucugaguguaaacuacaugguagguugugaaggaugcaaauaucgaaucaaucauuuuuua

SEQ ID NO: 694681 - RNA, 64 nt, Homo Sapiens
ucauagcuguuccucauggccaugacuggaacagggaugcaaccucuuucuacacaagcacagu

SEQ ID NO: 694682 - RNA, 64 nt, Homo Sapiens
ccugaaaccaggugcuuccuacgucuugggaaagggaugcaaucugcauuucugagugaagugc

SEQ ID NO: 694683 - RNA, 64 nt, Homo Sapiens
ccagacugaagaacacgguucagcugggaagagaggaugcaagaacucggggccucaggcuucu

SEQ ID NO: 694684 - RNA, 64 nt, Homo Sapiens
caguuuauuuaaccauucccauauuccauuuaauggaugcaacuauaauuuuaauggcuauauu

SEQ ID NO: 694685 - RNA, 64 nt, Homo Sapiens
ccauguggaugucaccaaacguccagggcaccagggaugcaauugcagucagguccacaccuau

SEQ ID NO: 694686 - RNA, 64 nt, Homo Sapiens
cuagucagggccuugggcaagacauugggcucuaggaugcaauuggcaaauacguccccguuac

SEQ ID NO: 694687 - RNA, 64 nt, Homo Sapiens
cuuuuuuguacaaaucuguauuguauuaauuucuggaugcaauuuuucaaauauuaaaauuaua

SEQ ID NO: 694688 - RNA, 64 nt, Homo Sapiens
aggugaugaaaaggagacagugggaggguuguugggaugcaagguugagcacaacaggaaagcc

SEQ ID NO: 694689 - RNA, 64 nt, Homo Sapiens
cucgaggaaaauuagucgaugcccaggauucuaaggaugcaaucuagcccagaagccuccggcg

SEQ ID NO: 694690 - RNA, 64 nt, Homo Sapiens
ucagcucagggauucauuuuaacgugauguuuucggaugcaaacuuucacccaaaugaagugug

SEQ ID NO: 694691 - RNA, 64 nt, Homo Sapiens
gcccagagagccagcagccuugggauacuaaugaggaugcaacuggcuuauugguaugaaauag

SEQ ID NO: 694692 - RNA, 64 nt, Homo Sapiens
uuuuuuuuguauuucagagaaaauucagguaccaggaugcaauggauuuauuugauucagggga

SEQ ID NO: 694693 - RNA, 64 nt, Homo Sapiens
auauuuucuucuggucacaaaauaaagaaauuugggaugcaaaguaccuaaagaucucugaucc

SEQ ID NO: 694694 - RNA, 64 nt, Homo Sapiens
aagaauuuggcuuuuugaaaaaugugggaaucauggaugcaaaggccagaugcagagaaagcua

SEQ ID NO: 694695 - RNA, 64 nt, Homo Sapiens
aauugugguugugucacagugcccuggaauucgaggaugcaauugaggugggaggaucuauuga

SEQ ID NO: 694696 - RNA, 64 nt, Homo Sapiens
gcaaaucuaaaauuacgaagagacgcaguuaggaggaugcaacuaagguggugcuucugccauu

SEQ ID NO: 694697 - RNA, 64 nt, Homo Sapiens
gucgaugcuuaagaaaaccgcugcuugaaccuuuggaugcaaaugccucuggaaccugaggcgg

SEQ ID NO: 694698 - RNA, 64 nt, Homo Sapiens
gccagagacauaugggccauaccccuuaaccccgggaugcaagguagcauggguccaagagaca

SEQ ID NO: 694699 - RNA, 64 nt, Homo Sapiens
uuaaagagaugaaauaaauuaagcaguagauccaggaugcaaaauccucccaauuccugugcau

SEQ ID NO: 694700 - RNA, 64 nt, Homo Sapiens
guuuuucaugaucaucauuaacaguuuguccuuaggaugcaaaugaaaaugugaauacauaccu

SEQ ID NO: 694701 - RNA, 64 nt, Homo Sapiens
ucaguaacacacccucccugcuccaagugcaccaggaugcaaaugcacagaauucaccaggggc

SEQ ID NO: 694702 - RNA, 64 nt, Homo Sapiens
cggcgggcuggguguucacgugugucugugucauggaugcaaugcaggcccuggaggacugugc

SEQ ID NO: 694703 - RNA, 64 nt, Homo Sapiens
agcugccugugacaccuggcuuagagaagaaccgggaugcaaggugagccugggguugacuggg

SEQ ID NO: 694704 - RNA, 64 nt, Homo Sapiens
gaagcagagugugggugcccuggggugggaggauggaugcaacuauugggucaggaguugaauu

SEQ ID NO: 694705 - RNA, 64 nt, Homo Sapiens
ugagaggauggcaugccagagcguccucuggguuggaugcaaugacaugcugagcauucauuuu

SEQ ID NO: 694706 - RNA, 64 nt, Homo Sapiens
uaucacauaagacaucaugauaaaaauagaauguggaugcaaaauucugaauuguaaaugaacu

SEQ ID NO: 694707 - RNA, 64 nt, Homo Sapiens
caucccguccugagcacgggggauguccgaggcgggaugcaaacucaaacgcccugagaguccc

SEQ ID NO: 694708 - RNA, 64 nt, Homo Sapiens
guagaaagcuacuuauuuuauucuucucuucaaaggaugcaauaguggccaaaccagcagaaca

SEQ ID NO: 694709 - RNA, 64 nt, Homo Sapiens
ucaacauguuucaagacgcuguguuagacacuagggaugcaaagaugaaugagauaaggccuca

SEQ ID NO: 694710 - RNA, 64 nt, Homo Sapiens
aaauaucgaccaucacccucccccgcgugaacugggaugcaaguugcuaaccgaugugaacgca

SEQ ID NO: 694711 - RNA, 64 nt, Homo Sapiens
uuuuguugucuaaaggugcuagugugguugaacaggaugcaaucacaaauguuauaauuuauau

SEQ ID NO: 694712 - RNA, 64 nt, Homo Sapiens
agucuccaagcccacuugaaaagucacacugaaaggaugcaaauagccgucugcgauuuuggcg

SEQ ID NO: 694713 - RNA, 56 nt, Homo Sapiens; identical to SEQ ID NO: 694560

SEQ ID NO: 694714 - RNA, 64 nt, Homo Sapiens
uauuucaugguguuuucagggaacacagaaaugcggaugcaaaacaacuuuugacagaggccca

SEQ ID NO: 694715 - RNA, 64 nt, Homo Sapiens
ccgagagacacggucuggacagcccaaggcgccaggaugcaaccugcuuucaccagacugcaga

SEQ ID NO: 694716 - RNA, 64 nt, Homo Sapiens
ugcccuguauccggagcugugcugggcacugaggggaugcaacaaaauuaggagaggauccuug

SEQ ID NO: 694717 - RNA, 64 nt, Homo Sapiens
gugagcaagcagcacccccagcugaccuagcuagggaugcaagauggggcccagaggagcuggu

SEQ ID NO: 694718 - RNA, 64 nt, Homo Sapiens
uggguggaugguccagagccuccacccacagaggggaugcaaagggcaggugagucaagaaccg

SEQ ID NO: 694719 - RNA, 64 nt, Homo Sapiens
guucugucuccaaggcccaggacacuugucagaaggaugcaaaaaaagaaaaaaguacauccac

SEQ ID NO: 694720 - RNA, 54 nt, Homo Sapiens; identical to SEQ ID NO: 694567

SEQ ID NO: 694721 - RNA, 64 nt, Homo Sapiens
gccggguuucuucuugaagcagcuccugcaaaagggaugcaaagaggucccagggaccugcccc

SEQ ID NO: 694722 - RNA, 64 nt, Homo Sapiens
guucuaacgaagcaugcgugucucuucaucuacaggaugcaauaggcugauuguauuuaaaaau

SEQ ID NO: 694723 - RNA, 64 nt, Homo Sapiens
ggcggagcucccagucgcauggagcgguguucauggaugcaacagacccuggcuucuggagucc

SEQ ID NO: 694724 - RNA, 64 nt, Homo Sapiens
aauguuuuauaaaauaaauuugccacauaauaugggaugcaauaaccaacaaagcugcuaagug

SEQ ID NO: 694725 - RNA, 64 nt, Homo Sapiens
uccgugucacuaaacuagugcauuuuauaaguagggaugcaaaagauuuaggcaguaucauuuc

SEQ ID NO: 694726 - RNA, 64 nt, Homo Sapiens
gcgggguuuguuaggggcggggacagaggcaucuggaugcaaacaguucucacaccguaucuag

SEQ ID NO: 694727 - RNA, 64 nt, Homo Sapiens
cgucccuguguuccccacguugccgugccaucugggaugcaaacgcagugugauggagagucuc

SEQ ID NO: 694728 - RNA, 64 nt, Homo Sapiens
gagaaaauaaaagacugcacugaaaucaagguuaggaugcaacuaacaggggcccguuucuggu

SEQ ID NO: 694729 - RNA, 64 nt, Homo Sapiens
uaaugacccgcuuuucuagagagcuccuaugaaaggaugcaauaaucuuucaggucgugauaau

SEQ ID NO: 694730 - RNA, 64 nt, Homo Sapiens
ggccucuacccacaccuggaagagccagcaggguggaugcaaggugguggagaccagggacagg

SEQ ID NO: 694731 - RNA, 64 nt, Homo Sapiens
cccagcuugcccaccgcgggaagcggacugcugcggaugcaacugguggagaggagcuggguug

SEQ ID NO: 694732 - RNA, 64 nt, Homo Sapiens
augguccugacuuugggcgcuggguauuggaaauggaugcaaaguacaauguguuuuucuccag

SEQ ID NO: 694733 - RNA, 64 nt, Homo Sapiens
cuuuucugugaagacaagucaaagaaauuuuugaggaugcaaaggcuacuauuuuucaguugag

SEQ ID NO: 694734 - RNA, 64 nt, Homo Sapiens
auuccauucauuagugugauuggcugauaauugaggaugcaaaccuuugggauggcaccuauau

SEQ ID NO: 694735 - RNA, 64 nt, Homo Sapiens; identical to SEQ ID NO: 461322

SEQ ID NO: 694736 - RNA, 64 nt, Homo Sapiens; identical to SEQ ID NO: 461323

SEQ ID NO: 694737 - RNA, 64 nt, Homo Sapiens
gacauguucaaauguuugaaguuuuuauacucugggaugcaaccucugaaugagaagugagaag

SEQ ID NO: 694738 - RNA, 64 nt, Homo Sapiens
ccuaugaguauauuaauauuuggaacuucucccuggaugcaaaaccucuguguuagggaaaaua

SEQ ID NO: 694739 - RNA, 64 nt, Homo Sapiens
ugcugucucggggcucuccuuccuguuagcagcgggaugcaagaguccuguugcaggaagcccc

SEQ ID NO: 694740 - RNA, 64 nt, Homo Sapiens
agaugaugcugagcgugaaccugcuaggaagcaaggaugcaacaaugaggaguuguugaaccca

SEQ ID NO: 694741 - RNA, 64 nt, Homo Sapiens
guugcagugaguugagucaugguucaaagcccagggaugcaaagacuaggguucagagaaccag

SEQ ID NO: 694742 - RNA, 64 nt, Homo Sapiens
cagucacagagcuggaaacaaaaugaaauaaaaaggaugcaaauccuaaaucuauagaaauaca

SEQ ID NO: 694743 - RNA, 64 nt, Homo Sapiens
agcccacacaggaaagacaacuggaggagacaauggaugcaaacggagugacacccccagaccu

SEQ ID NO: 694744 - RNA, 64 nt, Homo Sapiens
gaauuaggacuauaauuuucuacuaccgugacugggaugcaagaaaacaguauuuauuauaaau

SEQ ID NO: 694745 - RNA, 64 nt, Homo Sapiens
gggggccucacugcugcgcaagggguggggccgaggaugcaaguccaggcagagcggcgcaggc

SEQ ID NO: 694746 - RNA, 64 nt, Homo Sapiens
guaccaggagcuagcuuuuagguaaacugaguguggaugcaaaagaagucugguuuaaggcaca

SEQ ID NO: 694747 - RNA, 64 nt, Homo Sapiens
cauucaagaguuucagccuguuucuuauauaugaggaugcaaaggaucuuuaagcacugaugau

SEQ ID NO: 694748 - RNA, 64 nt, Homo Sapiens
cgcccuguuuggcaucuaauuggggggagaggagggaugcaacuguguggaauuuugguugggg

SEQ ID NO: 694749 - RNA, 64 nt, Homo Sapiens
ugcaauaugccagaacuacagacaacagcccacaggaugcaaaagugcuuugccaucuuaaaaa

SEQ ID NO: 694750 - RNA, 64 nt, Homo Sapiens
caaguccugauggagcaagaggcccacgccuaggggaugcaagaacaacccguuucuuaaaugu

SEQ ID NO: 694751 - RNA, 64 nt, Homo Sapiens
uuacccuugagcugugugccucacagaagggccuggaugcaaggaacucccucccauccuacuc

SEQ ID NO: 694752 - RNA, 64 nt, Homo Sapiens
uugauucuaaaucuguuccauuaucuucucuguaggaugcaaaacauccaguuguaauguauaa

SEQ ID NO: 694753 - RNA, 64 nt, Homo Sapiens
gaggauuaggauuuuaacauaugaauuuugggggggaugcaaucauucagcccauaauacccuc

SEQ ID NO: 694754 - RNA, 64 nt, Homo Sapiens
auguaugaguguauguguuuauguaacuuccuguggaugcaaauagauucagagaaauuuagag

SEQ ID NO: 694755 - RNA, 64 nt, Homo Sapiens
auucucccgggacucugcauguuaaggcaaaaaaggaugcaacagaaagacuggcaagaaaaga

SEQ ID NO: 694756 - RNA, 64 nt, Homo Sapiens
aauguggccaagccuaucaacaaaguaaagcagaggaugcaacaacagaggauguggccugguu

SEQ ID NO: 694757 - RNA, 64 nt, Homo Sapiens
ugugcuaguccaugaccuuugggcagcauuccagggaugcaaaaagauugauaaccauccuuug

SEQ ID NO: 694758 - RNA, 64 nt, Homo Sapiens
uauuaaaaauguuggccugguuaccucuuaauauggaugcaacuuaugugaucauuugcacuug

SEQ ID NO: 694759 - RNA, 64 nt, Homo Sapiens
guugaaagcuuugaaauaaaaaaauaagucaggaggaugcaauuucuuaauucugaccaauaaa

SEQ ID NO: 694760 - RNA, 64 nt, Homo Sapiens; identical to SEQ ID NO: 570311

SEQ ID NO: 694761 - RNA, 64 nt, Homo Sapiens; identical to SEQ ID NO: 570312

SEQ ID NO: 694762 - RNA, 64 nt, Homo Sapiens; identical to SEQ ID NO: 570313

SEQ ID NO: 694763 - RNA, 64 nt, Homo Sapiens; identical to SEQ ID NO: 570314

SEQ ID NO: 694764 - RNA, 56 nt, Homo Sapiens; identical to SEQ ID NO: 570315

SEQ ID NO: 694765 - RNA, 64 nt, Homo Sapiens; identical to SEQ ID NO: 570316

SEQ ID NO: 694766 - RNA, 64 nt, Homo Sapiens; identical to SEQ ID NO: 570317

SEQ ID NO: 694767 - RNA, 64 nt, Homo Sapiens; identical to SEQ ID NO: 570318

SEQ ID NO: 694768 - RNA, 64 nt, Homo Sapiens; identical to SEQ ID NO: 570319

SEQ ID NO: 694769 - RNA, 64 nt, Homo Sapiens; identical to SEQ ID NO: 570320

SEQ ID NO: 694770 - RNA, 64 nt, Homo Sapiens; identical to SEQ ID NO: 570321

SEQ ID NO: 694771 - RNA, 64 nt, Homo Sapiens; identical to SEQ ID NO: 570322

SEQ ID NO: 694772 - RNA, 64 nt, Homo Sapiens; identical to SEQ ID NO: 570323

SEQ ID NO: 694773 - RNA, 64 nt, Homo Sapiens; identical to SEQ ID NO: 570324

SEQ ID NO: 694774 - RNA, 64 nt, Homo Sapiens; identical to SEQ ID NO: 311803

SEQ ID NO: 694775 - RNA, 64 nt, Homo Sapiens; identical to SEQ ID NO: 311804

SEQ ID NO: 694776 - RNA, 64 nt, Homo Sapiens; identical to SEQ ID NO: 311805

SEQ ID NO: 694777 - RNA, 64 nt, Homo Sapiens; identical to SEQ ID NO: 311806

SEQ ID NO: 694778 - RNA, 64 nt, Homo Sapiens; identical to SEQ ID NO: 311807

SEQ ID NO: 694779 - RNA, 64 nt, Homo Sapiens; identical to SEQ ID NO: 311808

SEQ ID NO: 694780 - RNA, 64 nt, Homo Sapiens; identical to SEQ ID NO: 311809

SEQ ID NO: 694781 - RNA, 64 nt, Homo Sapiens; identical to SEQ ID NO: 311810

SEQ ID NO: 694782 - RNA, 64 nt, Homo Sapiens; identical to SEQ ID NO: 311811

SEQ ID NO: 694783 - RNA, 64 nt, Homo Sapiens; identical to SEQ ID NO: 311812

SEQ ID NO: 694784 - RNA, 64 nt, Homo Sapiens; identical to SEQ ID NO: 311813

SEQ ID NO: 694785 - RNA, 64 nt, Homo Sapiens; identical to SEQ ID NO: 311814

SEQ ID NO: 694786 - RNA, 64 nt, Homo Sapiens; identical to SEQ ID NO: 311815

SEQ ID NO: 694787 - RNA, 64 nt, Homo Sapiens; identical to SEQ ID NO: 311816

SEQ ID NO: 694788 - RNA, 64 nt, Homo Sapiens; identical to SEQ ID NO: 311817

SEQ ID NO: 694789 - RNA, 64 nt, Homo Sapiens; identical to SEQ ID NO: 311818

SEQ ID NO: 694790 - RNA, 64 nt, Homo Sapiens; identical to SEQ ID NO: 311819

SEQ ID NO: 694791 - RNA, 64 nt, Homo Sapiens; identical to SEQ ID NO: 311820

SEQ ID NO: 694792 - RNA, 64 nt, Homo Sapiens; identical to SEQ ID NO: 311821

SEQ ID NO: 694793 - RNA, 64 nt, Homo Sapiens; identical to SEQ ID NO: 311822

SEQ ID NO: 694794 - RNA, 64 nt, Homo Sapiens; identical to SEQ ID NO: 311823

SEQ ID NO: 694795 - RNA, 64 nt, Homo Sapiens; identical to SEQ ID NO: 311824

SEQ ID NO: 694796 - RNA, 64 nt, Homo Sapiens; identical to SEQ ID NO: 311825

SEQ ID NO: 694797 - RNA, 64 nt, Homo Sapiens; identical to SEQ ID NO: 311824

SEQ ID NO: 694798 - RNA, 64 nt, Homo Sapiens; identical to SEQ ID NO: 311824

SEQ ID NO: 694799 - RNA, 64 nt, Homo Sapiens; identical to SEQ ID NO: 311828

SEQ ID NO: 694800 - RNA, 64 nt, Homo Sapiens; identical to SEQ ID NO: 311829

SEQ ID NO: 694801 - RNA, 64 nt, Homo Sapiens; identical to SEQ ID NO: 311830

SEQ ID NO: 694802 - RNA, 64 nt, Homo Sapiens; identical to SEQ ID NO: 311831

SEQ ID NO: 694803 - RNA, 64 nt, Homo Sapiens; identical to SEQ ID NO: 311832

SEQ ID NO: 694804 - RNA, 64 nt, Homo Sapiens; identical to SEQ ID NO: 311833

SEQ ID NO: 694805 - RNA, 64 nt, Homo Sapiens; identical to SEQ ID NO: 311834

SEQ ID NO: 694806 - RNA, 64 nt, Homo Sapiens; identical to SEQ ID NO: 311835

SEQ ID NO: 694807 - RNA, 64 nt, Homo Sapiens; identical to SEQ ID NO: 311836

SEQ ID NO: 694808 - RNA, 64 nt, Homo Sapiens; identical to SEQ ID NO: 311837

SEQ ID NO: 694809 - RNA, 64 nt, Homo Sapiens; identical to SEQ ID NO: 311838

SEQ ID NO: 694810 - RNA, 64 nt, Homo Sapiens; identical to SEQ ID NO: 311839

SEQ ID NO: 694811 - RNA, 64 nt, Homo Sapiens; identical to SEQ ID NO: 311840

SEQ ID NO: 694812 - RNA, 64 nt, Homo Sapiens; identical to SEQ ID NO: 311841

SEQ ID NO: 694813 - RNA, 64 nt, Homo Sapiens; identical to SEQ ID NO: 311842

SEQ ID NO: 694814 - RNA, 64 nt, Homo Sapiens; identical to SEQ ID NO: 311843

SEQ ID NO: 694815 - RNA, 64 nt, Homo Sapiens; identical to SEQ ID NO: 311844

SEQ ID NO: 694816 - RNA, 64 nt, Homo Sapiens; identical to SEQ ID NO: 311845

SEQ ID NO: 694817 - RNA, 64 nt, Homo Sapiens; identical to SEQ ID NO: 311846

SEQ ID NO: 694818 - RNA, 63 nt, Homo Sapiens
cuacccugucccaagccgagggggccgguggaaugacuugagcagcucugggaguggggaaaa

SEQ ID NO: 694819 - RNA, 63 nt, Homo Sapiens
ggcugccuuuuguuuacacugguuauuuauuuaugacuugaaauaguuuaaggagcuaaacag

SEQ ID NO: 694820 - RNA, 63 nt, Homo Sapiens
gagcuccaagugugccccagccacugagccuugugacuugagcagauguccgaagccguuucu

SEQ ID NO: 694821 - RNA, 63 nt, Homo Sapiens
uaugggagacuagguuuuaacuggguggccccaugacuugauugccuucuacuggaagauugg

SEQ ID NO: 694822 - RNA, 63 nt, Homo Sapiens
ucuguagcugccaucacagugaguuggcagaagugacuugagcauuucucugucugauuugag

SEQ ID NO: 694823 - RNA, 63 nt, Homo Sapiens
uguuggaaaaugauguauaagucuaaguccucuugacuugaccauaagaucauggaaaacaga

SEQ ID NO: 694824 - RNA, 63 nt, Homo Sapiens
gagggcuagggaaagggauauggaguucuuacuugacuugaaugugcaccugagggugcuuug

SEQ ID NO: 694825 - RNA, 63 nt, Homo Sapiens
cgccuuccgaaauaagguguaaaaacagauauuugacuugagaacaaaagccaaguguaaauu

SEQ ID NO: 694826 - RNA, 63 nt, Homo Sapiens
uaugauggccacagccuaaaguacacacggcugugacuugauucaaaagaaaauguuauaaga

SEQ ID NO: 694827 - RNA, 63 nt, Homo Sapiens
acacucugaaacaaugagaaaaauacuaaaaauugacuugaguuauuucaauuugccuucauu

SEQ ID NO: 694828 - RNA, 63 nt, Homo Sapiens
guauugccaugaugucacccuggccauguguacugacuugaggagaucuugcaacauggccau

SEQ ID NO: 694829 - RNA, 63 nt, Homo Sapiens
aggguuaaaaauuuaacugguuuuuacuacugaugacuugauuuaaaaaaaauacaaagaugc

SEQ ID NO: 694830 - RNA, 63 nt, Homo Sapiens
ugaaguuacccucugaaaaauauuuugucucucugacuugauuucuauaaaugcuuuuaaaaa

SEQ ID NO: 694831 - RNA, 63 nt, Homo Sapiens
ccgccucuggacuaucuccccagaccagcagccugacuugacuuuugaguccuagggaugcug

SEQ ID NO: 694832 - RNA, 63 nt, Homo Sapiens
cugggauacauuuggaaauguggucaucaaagaugacuugaaaugaggccuacucuaaagaau

SEQ ID NO: 694833 - RNA, 63 nt, Homo Sapiens
acaacgaagaaacagauaaaagauacccaauuuugacuugauuucaugcaucauuuggauuuu

SEQ ID NO: 694834 - RNA, 63 nt, Homo Sapiens
uugcuuuguuauauuuuauugcuacaaggggugugacuugauaaugauuuccucugaauuaua

SEQ ID NO: 694835 - RNA, 63 nt, Homo Sapiens
aauaaaaaccaucucaauaauuaaguuggcagaugacuugaucuccgacauuuucaccacuau

SEQ ID NO: 694836 - RNA, 63 nt, Homo Sapiens
gcagagcuucuaccaaacuucaacauggagggcugacuugaagcucccugucccccucacucu

SEQ ID NO: 694837 - RNA, 63 nt, Homo Sapiens
ugagugagauaauuaugggagugguaagaauuaugacuugaauucuucuuugauuguguugca

SEQ ID NO: 694838 - RNA, 63 nt, Homo Sapiens
guuuuguguuggaaaaaagaccugaauuucuaaugacuugauuuucuauuuucucccuaccca

SEQ ID NO: 694839 - RNA, 63 nt, Homo Sapiens
gccagcccuugcuccucugucccagggaccugcugacuugaauuccaggcaccaucuguucuc

SEQ ID NO: 694840 - RNA, 63 nt, Homo Sapiens
agaaagaaaccaagugcgcuuagucguuauauuugacuugaaagaaaacagggucugggacau

SEQ ID NO: 694841 - RNA, 63 nt, Homo Sapiens
uuggcuaaauuuccugaaggggaaggaaacuguugacuugagccucccuauuguagauagaag

SEQ ID NO: 694842 - RNA, 63 nt, Homo Sapiens
uguccaauuucauuucagaauuggggacaaaagugacuugacauauuucucugaaagaucguu

SEQ ID NO: 694843 - RNA, 63 nt, Homo Sapiens
gugccauuuagagggaacucuguaaacgaaggcugacuugauucuguguucaguagaaggaaa

SEQ ID NO: 694844 - RNA, 63 nt, Homo Sapiens
aguuuguauaguauauaaucaaaugguuuuguaugacuugaauucaguuugaaagacaaugaa

SEQ ID NO: 694845 - RNA, 63 nt, Homo Sapiens
ugacaacugggcccuguugggccacucaaacccugacuugauuucugguuggagcuucucaca

SEQ ID NO: 694846 - RNA, 63 nt, Homo Sapiens
uugcacaguguaacagcgcaccuacaagacaguugacuugauuuaacaagagacagccaagga

SEQ ID NO: 694847 - RNA, 63 nt, Homo Sapiens
aacuuucuuuugcacugggagauaaagguaaguugacuugaacuucuuccucuuacuccuuag

SEQ ID NO: 694848 - RNA, 63 nt, Homo Sapiens
agguuugagguacaaggggaccucugcagagcuugacuugaugaccucaggggcuguacuauu

SEQ ID NO: 694849 - RNA, 63 nt, Homo Sapiens
cuggagcucccucuguuaccccaugaaguuuggugacuugaggcccccuaccucccaccacca

SEQ ID NO: 694850 - RNA, 63 nt, Homo Sapiens
ugaacaaaacacccuuugccgaaucauuagucuugacuugaagggguucauuuaaauuugucu

SEQ ID NO: 694851 - RNA, 63 nt, Homo Sapiens
uugggcaucuggcucccuuucacauaucacuaaugacuugaacuauuucucugucagcccugc

SEQ ID NO: 694852 - RNA, 63 nt, Homo Sapiens
auaaauagguuccauguguaggaacccuacuguugacuugaaauguacaaggagguauugaga

SEQ ID NO: 694853 - RNA, 63 nt, Homo Sapiens
aaaagucacauccagcaaauauggacgugucaaugacuugaaaacaaaaagucaaaugagaca

SEQ ID NO: 694854 - RNA, 63 nt, Homo Sapiens
cuuucgugggcauguugccacaggcccacguucugacuugaaggagcccagaaaugucuuuug

SEQ ID NO: 694855 - RNA, 63 nt, Homo Sapiens
ugauaaaaucuccaccuggucauucauugugugugacuugauaccuguuaacuugccccuuag

SEQ ID NO: 694856 - RNA, 63 nt, Homo Sapiens
uugugcacuugcuuaguggauuguauuggauugugacuugauguacagcgcuaagaccuuacu

SEQ ID NO: 694857 - RNA, 63 nt, Homo Sapiens
uggauuucuuuguuggugccuugggaaacagucugacuugaacccuaagugccuuuggagagu

SEQ ID NO: 694858 - RNA, 63 nt, Homo Sapiens
uugggggugguaacuaaaaucaaaagaaaugauugacuugagggucucuguuugguaagaaua

SEQ ID NO: 694859 - RNA, 63 nt, Homo Sapiens
aaaaaaaaugagguaaacuguauuuaaaaccuuugacuugagucugcugguaaagcuucugaa

SEQ ID NO: 694860 - RNA, 63 nt, Homo Sapiens
uauaagguagcuuaauaaacuaaguaaaacguaugacuugaguacaaaaggauuguuuuaauc

SEQ ID NO: 694861 - RNA, 63 nt, Homo Sapiens
uugucuggauggcugguuuugagguuuuaaaccugacuugaaauaguaacaccaaacaugauu

SEQ ID NO: 694862 - RNA, 63 nt, Homo Sapiens
ugacagcuguaauauggucuucauguuuaucagugacuugacuacaaguaaagcagaaaacag

SEQ ID NO: 694863 - RNA, 63 nt, Homo Sapiens
ccugucugugcucagacauagagaaguacuaccugacuugagucaaugcacccaagaagaaaa

SEQ ID NO: 694864 - RNA, 63 nt, Homo Sapiens
cuaaauagaguaucauccaaauaauggggccuaugacuugaaugaauagaaaugaauaagcug

SEQ ID NO: 694865 - RNA, 63 nt, Homo Sapiens
gugacuaaaaugaaacaagacaguugaauugugugacuugaagauuaccaaugauuuugaggc

SEQ ID NO: 694866 - RNA, 63 nt, Homo Sapiens
uaguucuauuuuuaguuuuuacccuaacuacucugacuugaucauuuaacauucuguguaugu

SEQ ID NO: 694867 - RNA, 63 nt, Homo Sapiens
ugaaagggcucuaaagaaggaacuaccaaaaccugacuugaaaugccauuucuuuuaaccuuc

SEQ ID NO: 694868 - RNA, 63 nt, Homo Sapiens
auuuacauuagaguauaccuuuuaguaauaaaaugacuugaaaucauauuauuuuuaaaagcc

SEQ ID NO: 694869 - RNA, 63 nt, Homo Sapiens
cauggcccacauuccaacuuaccauguacuuagugacuugacugagaaguuaggguagaaaac

SEQ ID NO: 694870 - RNA, 63 nt, Homo Sapiens
uugcaaggaagccacagcuggugguaucugaguugacuugacagaacacugucuugaagacaa

SEQ ID NO: 694871 - RNA, 63 nt, Homo Sapiens
aaucuguccuguugauuuuguuuuccuugcccaugacuugaacaacuguguuuuaaaguacug

SEQ ID NO: 694872 - RNA, 63 nt, Homo Sapiens
ugaaaugucagcugugcugggcaucacagacaaugacuugacaccugugugccugggucagcc

SEQ ID NO: 694873 - RNA, 63 nt, Homo Sapiens
uccauuuaguagcaucucuuuguuuucugauguugacuugaguaguccuuugacgacguguug

SEQ ID NO: 694874 - RNA, 63 nt, Homo Sapiens
guggaagaugaugguugcauauauuugacauugugacuugacucaucugcagaggcaagaaaa

SEQ ID NO: 694875 - RNA, 63 nt, Homo Sapiens
gcucccccagucagaucucaccucuuuuucuucugacuugagacuaccguggucacugcguag

SEQ ID NO: 694876 - RNA, 63 nt, Homo Sapiens
auggaaaaauaucaaaauagagaugacaguaacugacuugaagacaacuuaacugaguacucc

SEQ ID NO: 694877 - RNA, 63 nt, Homo Sapiens
gcaguacuuauagaccuuauaucaagaauuuuuugacuugaagcaaugcaggacaacucugua

SEQ ID NO: 694878 - RNA, 63 nt, Homo Sapiens
accuucuacagcaaacucuucugagcaucuuccugacuugaaccacccucucaguggucauuu

SEQ ID NO: 694879 - RNA, 63 nt, Homo Sapiens
cuggggacguggaguggcggagcuugccuuuugugacuugacaagaacccauuugccuugaug

SEQ ID NO: 694880 - RNA, 63 nt, Homo Sapiens
ugcuuuuggaaaaagaaaugcaagaaaggagagugacuugauuuaagaaaaaguauaaauuag

SEQ ID NO: 694881 - RNA, 63 nt, Homo Sapiens
ccacaaguggaaaauuccccucuuuuugagcacugacuugacccagaagcuucaaaaucugaa

SEQ ID NO: 694882 - RNA, 63 nt, Homo Sapiens
aauaugccaaaaaaugagaggaguuuuuaagugugacuugaaaugagaagugaauacauggaa

SEQ ID NO: 694883 - RNA, 63 nt, Homo Sapiens
aagucacuuaacuucuacaauuauugacuggauugacuugaacuucuauccuuagcuuuggca

SEQ ID NO: 694884 - RNA, 63 nt, Homo Sapiens
gucauccuguucuuguuagcauuaaaaagcuacugacuugacugaugggauucugcucauuuu

SEQ ID NO: 694885 - RNA, 63 nt, Homo Sapiens
gaaaaggaauguugcacaagauguggucuggucugacuugagaggauagauaugcacugaaac

SEQ ID NO: 694886 - RNA, 63 nt, Homo Sapiens
auuuuuauauaccaaugagcgcuuagaggacugugacuugaaaaacuaacuuguauuuagucu

SEQ ID NO: 694887 - RNA, 63 nt, Homo Sapiens
cccaucucuccagccagccaacugggggauuucugacuugaggcucuguuugucuuaaguugc

SEQ ID NO: 694888 - RNA, 63 nt, Homo Sapiens
agcuguuuuguuguuguugucauuacugucaccugacuugagguucucuuugcaagagagggg

SEQ ID NO: 694889 - RNA, 63 nt, Homo Sapiens
auaagaaguggagccgaaggagcaaauagcaauugacuugaaauaaauuaauuuagacagaaa

SEQ ID NO: 694890 - RNA, 63 nt, Homo Sapiens
aaucugauucgccaaauaaagcuuuggaaaaaaugacuugauuacaggaggggcggacgguua

SEQ ID NO: 694891 - RNA, 63 nt, Homo Sapiens
ucauuauagaguccaguagcuuaauacugacacugacuugauacagcaugaaguuucuagugc

SEQ ID NO: 694892 - RNA, 63 nt, Homo Sapiens
uuacuauaacuuuguaaauuaacuuaauuuugcugacuugacuccuguggcuucuggaccccu

SEQ ID NO: 694893 - RNA, 63 nt, Homo Sapiens
caguagguguugggcaggaauuggugagauuccugacuugauaccuugcuaaauggacaugua

SEQ ID NO: 694894 - RNA, 63 nt, Homo Sapiens
ggggaauaugugcacgcuuguucagccuuaaugugacuugaagauguggaggacaucaacuuu

SEQ ID NO: 694895 - RNA, 63 nt, Homo Sapiens
uaauuuuagugagaagauuaauacucaaggaccugacuugauaauuacuuauuuguguuuuuc

SEQ ID NO: 694896 - RNA, 63 nt, Homo Sapiens
uuuggaacacuacucuuacauguauaaagugauugacuugacuuucuagcuucccuuguccgg

SEQ ID NO: 694897 - RNA, 63 nt, Homo Sapiens
guagaugggauuauaggcaugugccacggugccugacuugaguuucuuauucuagaacacuug

SEQ ID NO: 694898 - RNA, 63 nt, Homo Sapiens
uggaagccauugucuaaucaacucuaucauuagugacuugaugucucauaccuuaauuuugua

SEQ ID NO: 694899 - RNA, 63 nt, Homo Sapiens
uaauguuuugcuuugcauuuuagguucagauuaugacuugauugaaauaaaugugccuauaca

SEQ ID NO: 694900 - RNA, 63 nt, Homo Sapiens
uguuuuuguucugcauuaaggccuuuuuugcuuugacuugaaauaaguucuuugacagagcau

SEQ ID NO: 694901 - RNA, 63 nt, Homo Sapiens
guaccucacuuuauuucaguuaacaagauacuuugacuugaaguguuuuuaguguaucccuau

SEQ ID NO: 694902 - RNA, 63 nt, Homo Sapiens
ucgaaagaaaaugggcccuaggggucacuguacugacuugagggugauuaacagagagggcac

SEQ ID NO: 694903 - RNA, 63 nt, Homo Sapiens
uauuggagagugaauccccacaguugcuuuuugugacuugauucaaaugaggcacucauuauu

SEQ ID NO: 694904 - RNA, 63 nt, Homo Sapiens
guucccgguuuuuuccucuucccugcugauaagugacuugagauaauuugagcucguauuuac

SEQ ID NO: 694905 - RNA, 63 nt, Homo Sapiens
agccuucuguucugcccaggagagguggcccucugacuugacaucuggcagaauugaggagga

SEQ ID NO: 694906 - RNA, 63 nt, Homo Sapiens
aauuucagaacauuuuucaguugaaaacaacauugacuugaaauucugagcauuuuaauauac

SEQ ID NO: 694907 - RNA, 63 nt, Homo Sapiens
uuuuaucacuucucuaaguacaaaaauacuuguugacuugaugcuuauaaaaaaauucuccaa

SEQ ID NO: 694908 - RNA, 63 nt, Homo Sapiens
uuauauguagagauauauaugacuuaaugugcaugacuugaugagccuucaguagguaguaaa

SEQ ID NO: 694909 - RNA, 63 nt, Homo Sapiens
aaguuugggaagcucuuuagcuuguguaugccaugacuugaaauguauguacagauaucauuu

SEQ ID NO: 694910 - RNA, 63 nt, Homo Sapiens
augaucagucaauaggcccucucauuccucucuugacuugagaaaugggcaagaaggauucuc

SEQ ID NO: 694911 - RNA, 63 nt, Homo Sapiens
uuagucugcaaaaugaggaauaugcaaaaguucugacuugacuuauaugucaaagcaggggag

SEQ ID NO: 694912 - RNA, 63 nt, Homo Sapiens
uccuaacuaccgucuuuuugcuaggacuuaaacugacuugaguguggcaaaaaguuaacaaaa

SEQ ID NO: 694913 - RNA, 56 nt, Homo Sapiens; identical to SEQ ID NO: 570315

SEQ ID NO: 694914 - RNA, 63 nt, Homo Sapiens
auggguuuuuaaguagaaccuaggguuucuaauugacuugauuucuggaaaugaaaacccgcg

SEQ ID NO: 694915 - RNA, 63 nt, Homo Sapiens
uagcaguagauggugcuacuggcuuucauuugcugacuugauuauucccuuucucuuaaaaac

SEQ ID NO: 694916 - RNA, 63 nt, Homo Sapiens
guuauaugcaagcacuaugcccuuuuauauaagugacuugaacaucugugcccgauuuuagua

SEQ ID NO: 694917 - RNA, 63 nt, Homo Sapiens
agcucugauauauaucugguacauguuugauaaugacuugauuguuauuauaaguacuuauua

SEQ ID NO: 694918 - RNA, 63 nt, Homo Sapiens
acugaauuguaaagauaaaucccuuuugaagaaugacuugacacuuccacucuagguagaucc

SEQ ID NO: 694919 - RNA, 63 nt, Homo Sapiens
uggcacauagcugugagguacccuaugaguuguugacuugaaaacauggaacugcacagggca

SEQ ID NO: 694920 - RNA, 63 nt, Homo Sapiens
uuuuguucucugagccaaagaguacuuaacaguugacuugaaacuuucuuauguuggcuaaac

SEQ ID NO: 694921 - RNA, 63 nt, Homo Sapiens
uuuuuaugcaugcaaaucaucauguuuauaucuugacuugacuagaaccccagaggucaccaa

SEQ ID NO: 694922 - RNA, 63 nt, Homo Sapiens
ccaaaccuuuguuuauguaauagaaguuuaagaugacuugaccuuucuuguaacaucugagau

SEQ ID NO: 694923 - RNA, 63 nt, Homo Sapiens
ugggcuuauaucuaauaauagggauuugcauuaugacuugaacgugcaagaauggagaagcau

SEQ ID NO: 694924 - RNA, 63 nt, Homo Sapiens
ugagacaugguuauagauaaacaauuguagcauugacuugaaguccuuuucaaaauaaaagug

SEQ ID NO: 694925 - RNA, 63 nt, Homo Sapiens
gagggauaagugugauuuagaugauccagucacugacuugauuagcaggugaaaccuuaggag

SEQ ID NO: 694926 - RNA, 63 nt, Homo Sapiens
acuuuaagccuuguuuaaaauaaauuuuauaauugacuugagucaaguaaaaggcaaaagaua

SEQ ID NO: 694927 - RNA, 63 nt, Homo Sapiens
caauauaaaauaaucuuccuguugaaugcuucaugacuugaauucuacuuugauaaaaacauu

SEQ ID NO: 694928 - RNA, 63 nt, Homo Sapiens
cuagugauugaauucuacuuuugccaucugaauugacuugaaugucuuaaaacagguaaauac

SEQ ID NO: 694929 - RNA, 63 nt, Homo Sapiens
auugaacagcaaaguaggauucaucauuccauaugacuugaguuacaccagaccuguucugcc

SEQ ID NO: 694930 - RNA, 63 nt, Homo Sapiens
gaguacauaugguagacaauuugccuuaggaagugacuugaauguacaaagauacuugaugca

SEQ ID NO: 694931 - RNA, 63 nt, Homo Sapiens
uuaaagcuaaaaugccaguaaauaaaagugcuaugacuugagcuaagauauuugacuccaaug

SEQ ID NO: 694932 - RNA, 63 nt, Homo Sapiens
cuacaguuucauacauuuucuccagugacguguugacuugaaacuucaggcagauuaaaagaa

SEQ ID NO: 694933 - RNA, 63 nt, Homo Sapiens
uagauuaauggggguugcuacuguuuaauucagugacuugaucuuuuuaauguccaaaaucca

SEQ ID NO: 694934 - RNA, 63 nt, Homo Sapiens
ugcuugauaaucuugaacauugaacuuaauagaugacuugacaagguagagaucugauauuuu

SEQ ID NO: 694935 - RNA, 63 nt, Homo Sapiens
uauuuucaucuuaaugguauagugaaaagacauugacuugagaugauacuaaggaagcuuugg

SEQ ID NO: 694936 - RNA, 63 nt, Homo Sapiens
aauuuaggcuacaugagauuuugccuuuugugcugacuugacagcuucacuucugccuaagau

SEQ ID NO: 694937 - RNA, 63 nt, Homo Sapiens
uuuacucugaggauaaggucacaaaguagggugugacuugaaaguaucgugaccauguggccc

SEQ ID NO: 694938 - RNA, 63 nt, Homo Sapiens
ucuuggggggaggggugauaaggauuuuauuguugacuugaaacccccgaugacaaaagacuc

SEQ ID NO: 694939 - RNA, 63 nt, Homo Sapiens
gaaagaaagaggaaggcuggaacugcaaguuuuugacuugaaguuaaggaagauuuuucaaga

SEQ ID NO: 694940 - RNA, 63 nt, Homo Sapiens
ccaucauggugcucuuaaauuaaacagcauguuugacuugauuguaagguuaauacuuucagu

SEQ ID NO: 694941 - RNA, 63 nt, Homo Sapiens
uagaacauuaaauccgcccuuguauauacaggcugacuugaucuauagauucacauacacaua

SEQ ID NO: 694942 - RNA, 63 nt, Homo Sapiens
gauauaaacagaucuucuauuaauugccuuacaugacuugaaauauaucauaaaccaacacag

SEQ ID NO: 694943 - RNA, 63 nt, Homo Sapiens
uguagcaccaaugcaauguacuacacagagaugugacuugaucacagaggugauaugcuugau

SEQ ID NO: 694944 - RNA, 63 nt, Homo Sapiens
cagucacucguagcuuuauuugcuguucuuuacugacuugauuuuaacacuuuagugccugac

SEQ ID NO: 694945 - RNA, 63 nt, Homo Sapiens
ucaauuacuaaguauuuuguaaugagaauauuuugacuugacucaugaugauuuaaaagaacu

SEQ ID NO: 694946 - RNA, 63 nt, Homo Sapiens
uucugaugcuuuuauugcccauucuuccauaguugacuugaacaaagcugccagcuaacagua

SEQ ID NO: 694947 - RNA, 63 nt, Homo Sapiens
ucaagugacaguaaaaggauuuguucccuucagugacuugaguguuuuaguuaugcauaagua

SEQ ID NO: 694948 - RNA, 63 nt, Homo Sapiens
aaccuugcugaauuaaucugaauagcaacugucugacuugauaacuccagugccaguauagug

SEQ ID NO: 694949 - RNA, 63 nt, Homo Sapiens
gagaggcaagaguuguuccugcccuucccuuugugacuugaagaacccugacuuuguuucugc

SEQ ID NO: 694950 - RNA, 63 nt, Homo Sapiens
cuccuuggccuguccccagauuccuucccugguugacuugacucaugcuuguuucacuuucac

SEQ ID NO: 694951 - RNA, 63 nt, Homo Sapiens
cauguauauuaugaccuucuguguuuuuguuucugacuugaauaauuuaucaaugguguugaa

SEQ ID NO: 694952 - RNA, 63 nt, Homo Sapiens
ugagccauugcaccuggccaagaagagacaucuugacuugagccugaagacuauguacagaga

SEQ ID NO: 694953 - RNA, 63 nt, Homo Sapiens
guuuugcuguagcaauaaaaugaccaagugcaaugacuugauuuaauaaaaucauauuuuaaa

SEQ ID NO: 694954 - RNA, 63 nt, Homo Sapiens
ugauaaaauaauuucucaccuauuuugugugugugacuugaaauucaguaguaaaagaauuuc

SEQ ID NO: 694955 - RNA, 63 nt, Homo Sapiens
gccccaaaguagggugggaaguuuuccucuaaaugacuugaugguugccaaaucccuugcacc

SEQ ID NO: 694956 - RNA, 63 nt, Homo Sapiens
gacgcuuaaauacagcuuuuggauuggacaaaaugacuugaagacuuacagcaaauccuuugu

SEQ ID NO: 694957 - RNA, 63 nt, Homo Sapiens
ugucagaugaaaaaacugaagcucaaaaaggguugacuugaccauacagcuaaugcugacaga

SEQ ID NO: 694958 - RNA, 63 nt, Homo Sapiens
cuuuguucguaaacaauaucccaauagauuuguugacuugaggucugguuugguuuuguuuuu

SEQ ID NO: 694959 - RNA, 63 nt, Homo Sapiens
acagaagugaugucuguaggucacauuaaauacugacuugagcagugggugacacaacacagu

SEQ ID NO: 694960 - RNA, 63 nt, Homo Sapiens
uggggcauuggcaaucaacaaaugcaaugcuugugacuugacgugauaaaaguucauuuauug

SEQ ID NO: 694961 - RNA, 63 nt, Homo Sapiens
gaucuacgcuaaguggagaccuuaggagauggcugacuugauuucauuguauaauguguauuu

SEQ ID NO: 694962 - RNA, 63 nt, Homo Sapiens
auauagagaaaaaaaaaaccugguggccacuggugacuugaaauaacuaugaaccaagcagug

SEQ ID NO: 694963 - RNA, 63 nt, Homo Sapiens
cagccuugaagagugaguucgaggcagaaaacuugacuugaagcugcaguccgcacaagcugu

SEQ ID NO: 694964 - RNA, 63 nt, Homo Sapiens
gaagggcugaucucagagccuuuguuuaugaguugacuugagauaccuccuguaacuaaagca

SEQ ID NO: 694965 - RNA, 63 nt, Homo Sapiens
uuuuaagcuacccugaauuuucugugggucauuugacuugauuaagcugacucuucucaauca

SEQ ID NO: 694966 - RNA, 63 nt, Homo Sapiens
ggauuuaugacguaccguugcuccuucaaugcuugacuugaauaacucuaaaguagcacaagc

SEQ ID NO: 694967 - RNA, 63 nt, Homo Sapiens
cacaaaucacuguggggaaaccagagaucaccaugacuugaggguaaagucuugucuggugac

SEQ ID NO: 694968 - RNA, 60 nt, Homo Sapiens
guuaagaagaaagaggaauggaccugccugugacuugagggaccacgcccuuuaaccuaa

SEQ ID NO: 694969 - RNA, 63 nt, Homo Sapiens
gagcagcacuuugcaacuucaugguagcaucugugacuugaauuuacuguuucauugcauaac

SEQ ID NO: 694970 - RNA, 63 nt, Homo Sapiens
aauauucauguagaucaaguaauagauaaauuuugacuugaaaucuaauuauaugggaaccag

SEQ ID NO: 694971 - RNA, 63 nt, Homo Sapiens
acccaaaagaaaugucgugaaaaaaaaguuaaaugacuugagugagcgagacuccgucucaaa

SEQ ID NO: 694972 - RNA, 63 nt, Homo Sapiens
guacuuggaguaauugcacaaagccauguuaaaugacuugauucuguaacuacaaugauggua

SEQ ID NO: 694973 - RNA, 63 nt, Homo Sapiens
uuuuauuauaaauuuccauaauucuuuuuaaaaugacuugaaaaggagcaaacaaggcuucau

SEQ ID NO: 694974 - RNA, 63 nt, Homo Sapiens
uuuauauuucuuuaaaaaaucuauuucacuuuuugacuugacuuauuuaaauacucauuguug

SEQ ID NO: 694975 - RNA, 63 nt, Homo Sapiens
augaacuacugcaggaauccaguacccaaaugcugacuugaucgcacaguaggaccucagaaa

SEQ ID NO: 694976 - RNA, 63 nt, Homo Sapiens
gcguuucgcucuccuuguaggcugaagucagucugacuugaaggggccugguuuggaucuaag

SEQ ID NO: 694977 - RNA, 63 nt, Homo Sapiens
agacuuguuucugcucucauuuuugucaucgucugacuugaagauucagacaccuucucccca

SEQ ID NO: 694978 - RNA, 63 nt, Homo Sapiens
uugguucuucaacuaagcucuugcagagugagaugacuugaaauaaaaauguucuaugaauau

SEQ ID NO: 694979 - RNA, 63 nt, Homo Sapiens
gucuuuuuuaaauauuuucuuacugcuuuauagugacuugauuugguuucuguuguguuuuug

SEQ ID NO: 694980 - RNA, 63 nt, Homo Sapiens
ggaaauuuucugcuaaagcaaaccccuguucucugacuugacaacuuggccccggacuguggg

SEQ ID NO: 694981 - RNA, 63 nt, Homo Sapiens
uagauugaggcucauuugguacgggacuagauaugacuugaaaaaggaaggagaaugaggggu

SEQ ID NO: 694982 - RNA, 63 nt, Homo Sapiens
ccaguugaauaaaagugcaccuuaccuguacacugacuugagaguggguggaggcagccaggg

SEQ ID NO: 694983 - RNA, 63 nt, Homo Sapiens
agaaacuuuuaauucgaagauaucagugaccuaugacuugagguuucccuuuuagaaucagug

SEQ ID NO: 694984 - RNA, 63 nt, Homo Sapiens
ccaggaguuggagaccagccuaaggcgggaggaugacuugaggauuccagcacuuugggaggc

SEQ ID NO: 694985 - RNA, 63 nt, Homo Sapiens
ggcauccuugguacuaagugagaauguagaagcugacuugaaaucccauuauguacuuuauuc

SEQ ID NO: 694986 - RNA, 63 nt, Homo Sapiens
aauuagaagcuucuccuuaaccuguauugauacugacuugaauuauuuucuaaaauuaagagc

SEQ ID NO: 694987 - RNA, 63 nt, Homo Sapiens
gagcuuaggaggggcggagacgcucacaucgucugacuugagucgccacugauuguggcaaca

SEQ ID NO: 694988 - RNA, 63 nt, Homo Sapiens
aaucgacagugucucagaacugaauaacugcagugacuugaugcucuaaaacaguguaggauu

SEQ ID NO: 694989 - RNA, 63 nt, Homo Sapiens
aagcucuaucauauucugaaacaagaauuagaaugacuugagaacgggcaaauaacaaagcaa

SEQ ID NO: 694990 - RNA, 63 nt, Homo Sapiens
uuauaccaguccauuuuguuuauucuguggaauugacuugacaaagcaugaagauauucccag

SEQ ID NO: 694991 - RNA, 63 nt, Homo Sapiens
uaaauacuugcuagcuuaugugccauuaaaaaaugacuugauuuggcuuacagaccaguuugg

SEQ ID NO: 694992 - RNA, 63 nt, Homo Sapiens
cccccaggaagccuucccugcccaccccaucuaugacuugagccaggucugguccgugguguc

SEQ ID NO: 694993 - RNA, 63 nt, Homo Sapiens
uuuagucagcacccccaccaacauaaaagucugugacuugaagaaacccugcuccaaucuguc

SEQ ID NO: 694994 - RNA, 63 nt, Homo Sapiens
agguggauuugggcccaggcgagccagaguuccugacuugagcgacuuacaguggaguagaac

SEQ ID NO: 694995 - RNA, 63 nt, Homo Sapiens
uucuucuggggguuagggagcuacacuacuguuugacuugaucucauauuuugcguaacugcu

SEQ ID NO: 694996 - RNA, 63 nt, Homo Sapiens
guggaaccuccuauaucauuucaaacuucuaggugacuugagauuguaaguaacaauauguaa

SEQ ID NO: 694997 - RNA, 63 nt, Homo Sapiens
gucaggauucaagggcucagguuucuauuauugugacuugaauuguaagguacagcagcuccg

SEQ ID NO: 694998 - RNA, 63 nt, Homo Sapiens
cugcuguaauuggcagcagaagguuuuuauauaugacuugagugacuagacaugcuaaccucc

SEQ ID NO: 694999 - RNA, 63 nt, Homo Sapiens
cacuaugccuuaaugguuucguuucaaacuuggugacuugaucuuggcaagguagcaauacca

SEQ ID NO: 695000 - RNA, 63 nt, Homo Sapiens
aggcaaaacaugacaguggagcuauuugaguuuugacuugacagaauaauuuuaccaaaacaa

SEQ ID NO: 695001 - RNA, 63 nt, Homo Sapiens
auuaauggguaaacuaagaaguguuauaggcaaugacuugaaaugguuuuuaaauuguaugga

SEQ ID NO: 695002 - RNA, 63 nt, Homo Sapiens
uaaagcuggugggaccuaaugucaccuuaauucugacuugaacuggaagcauuuuaagaaauc

SEQ ID NO: 695003 - RNA, 63 nt, Homo Sapiens
guucuugucuaauccauguagcuuuuuguucaaugacuugaucaucugcuuccuuuuugaauu

SEQ ID NO: 695004 - RNA, 63 nt, Homo Sapiens
ugauaggaauauuugagaaagauugauccuguuugacuugaggacuuauuuuguucacaggca

SEQ ID NO: 695005 - RNA, 63 nt, Homo Sapiens
gcuggcaaaaggccuguacucaggcauuugcuuugacuugauguugccaagggacugaggcca

SEQ ID NO: 695006 - RNA, 63 nt, Homo Sapiens
agcugccaaaugacuucaaaaggcuggggugggugacuugacugugagacuggauuauaacau

SEQ ID NO: 695007 - RNA, 63 nt, Homo Sapiens
ucccuuuccaagccugccuggacggcuguucugugacuugacaguggcucccccagccccaaa

SEQ ID NO: 695008 - RNA, 63 nt, Homo Sapiens
augacacuuuuaaaauaaauucucuccuaaugaugacuugagcccugccacucaaugggagaa

SEQ ID NO: 695009 - RNA, 63 nt, Homo Sapiens
uuugcucugucucguucuuuacacagaguucacugacuugaaguauacucaguuaaaaucggg

SEQ ID NO: 695010 - RNA, 63 nt, Homo Sapiens
ugguucuuaguauuauuuauuggcauuaagguuugacuugaguauccuaauucacaauaacaa

SEQ ID NO: 695011 - RNA, 63 nt, Homo Sapiens
ggauggcuuacaaguccugcuuaagccagaauuugacuugacggucaucuaccuaaagacaca

SEQ ID NO: 695012 - RNA, 63 nt, Homo Sapiens
gacgaaagacaagcccggaucacgcaggaggacugacuugacaagcguggugcacccaucagu

SEQ ID NO: 695013 - RNA, 63 nt, Homo Sapiens
cucucagcuucaacaggugacaggcugcuuucgugacuugauauuggugucauagcauuuggc

SEQ ID NO: 695014 - RNA, 63 nt, Homo Sapiens
aguguguacauacuguaaauaugugugauugcuugacuugaaaagguuugaauucugaauguu

SEQ ID NO: 695015 - RNA, 63 nt, Homo Sapiens
aucuucaccugcccgccccugagucagccuccuugacuugauagcuugaagaauccuuuucca

SEQ ID NO: 695016 - RNA, 63 nt, Homo Sapiens
cuaggaaacaguggcaauaaauuuuucagauguugacuugaguaaauauaucaccacuauugc

SEQ ID NO: 695017 - RNA, 63 nt, Homo Sapiens
aaaggauaaaaaugugaacgaaguuuaacauucugacuugauaaagcuuuaauaauguacagu

SEQ ID NO: 695018 - RNA, 63 nt, Homo Sapiens
gaagcuuuuaaacauuacacuugagaucagucaugacuugauauucagguaaauuuucuuuuc

SEQ ID NO: 695019 - RNA, 63 nt, Homo Sapiens
ccuauaaaacacaugccaaucuguuagcaguccugacuugauuuaauaaaaaccaaggagagc

SEQ ID NO: 695020 - RNA, 63 nt, Homo Sapiens
uucuugugucuguuauuggagucuggccaggguugacuugagcugagacaccagaugcucacg

SEQ ID NO: 695021 - RNA, 63 nt, Homo Sapiens
gagccucuacuucugucucaugcaaugcaguauugacuugacagcuucuucaguggaccaagc

SEQ ID NO: 695022 - RNA, 63 nt, Homo Sapiens
uaaugcuuguaaucaggaaaccgcaaugaaaacugacuugaaaaaauagcacauuuauaagaa

SEQ ID NO: 695023 - RNA, 63 nt, Homo Sapiens
uuuuaaucuuucuguaaaauuuugaguuuugugugacuugaauuucaaacuuuuaauacaguu

SEQ ID NO: 695024 - RNA, 63 nt, Homo Sapiens
gaacaauacuuucaguuauguucucaagauucaugacuugauaaaauuggauaauguacuuuc

SEQ ID NO: 695025 - RNA, 63 nt, Homo Sapiens
ugagaugggcaagggaaaaggcagauucuucacugacuugaauaacuugccaugcuucugcau

SEQ ID NO: 695026 - RNA, 63 nt, Homo Sapiens
uaguaacauuaguaaacugucucucagaggacaugacuugacacuuuugcccuuacuggauga

SEQ ID NO: 695027 - RNA, 63 nt, Homo Sapiens
ugaugcaagaauggacaaguggaaagauguugaugacuugaagaguaauuugggcuaaaaaau

SEQ ID NO: 695028 - RNA, 63 nt, Homo Sapiens
uugccaucuguguucaagguguggacuuguaaaugacuugaccugggagauuuggauuugaau

SEQ ID NO: 695029 - RNA, 63 nt, Homo Sapiens
uuuuguuucccauguucucuguuuugagggcuaugacuugaguccuccuugcuuaucgucccu

SEQ ID NO: 695030 - RNA, 63 nt, Homo Sapiens
cccuuaagucuacaggggcuaauccccauccugugacuugaguaauaaaaaauauuaagagga

SEQ ID NO: 695031 - RNA, 63 nt, Homo Sapiens
cugagcaugcucuucuaggcugacucccagcccugacuugaaaccauuagcgcuaacuugcuc

SEQ ID NO: 695032 - RNA, 63 nt, Homo Sapiens
uugaaauauccagacuuguagggaagaaaacaaugacuugacgaccuuaaaaaggguuagauu

SEQ ID NO: 695033 - RNA, 63 nt, Homo Sapiens
ggagauuuaauaaccagggcuacccagaaaaagugacuugauaacaugguaccaauaaguaag

SEQ ID NO: 695034 - RNA, 63 nt, Homo Sapiens
gacagggcuccuccugcuugccucagggcugccugacuugaauggcguuggaccucggggauu

SEQ ID NO: 695035 - RNA, 63 nt, Homo Sapiens
ccagauguuuccuaaagaaguuuccagaaacuuugacuugaaauguuugcagaucaacuauaa

SEQ ID NO: 695036 - RNA, 63 nt, Homo Sapiens
uuucauuuuaaaccagagcaaguaacauauuagugacuugaaucuucauaaguuaaaguaaaa

SEQ ID NO: 695037 - RNA, 63 nt, Homo Sapiens
gugcuauggaaccaaucuugaacauacaugcauugacuugacaaguuacugaguaagcagcau

SEQ ID NO: 695038 - RNA, 63 nt, Homo Sapiens
cuucaacguugguaugauaaugauaacuuguuuugacuugaauaaaguacuacaucagugugg

SEQ ID NO: 695039 - RNA, 63 nt, Homo Sapiens
ggauugggggauccgggagggugggguugucucugacuugacauuaaaaaguguuccaugucc

SEQ ID NO: 695040 - RNA, 63 nt, Homo Sapiens
ucugggugacccugggcacccuuggcacagcccugacuugaacucuuugugggggcucucagg

SEQ ID NO: 695041 - RNA, 63 nt, Homo Sapiens
cccaacccuaccaugcuccaaaugcugugagcuugacuugacugcuuaucucccuaacccuga

SEQ ID NO: 695042 - RNA, 63 nt, Homo Sapiens
uucuuggaggaucaacaaaauauucauacacagugacuugaugcucggcacuucugugggagc

SEQ ID NO: 695043 - RNA, 63 nt, Homo Sapiens
aggaucuuagguguaguagaugaaacaaauauaugacuugaaacaagcaauguaugaucuguu

SEQ ID NO: 695044 - RNA, 63 nt, Homo Sapiens
uagauugcaugcuuccuccuagugaaguaggugugacuugaaccuugaaggaagaagucuaag

SEQ ID NO: 695045 - RNA, 63 nt, Homo Sapiens
gccucuccggcagcacaggcagcccucgugcauugacuugacagcugaagccgucccuggcag

SEQ ID NO: 695046 - RNA, 63 nt, Homo Sapiens
guaaguauguuacuuguauauguaauauuugacugacuugacccuuuccgcaugauaaauuua

SEQ ID NO: 695047 - RNA, 63 nt, Homo Sapiens
ccuaugaccaagucaaguugcagagggugcacaugacuugaucugucuccacagccacacaac

SEQ ID NO: 695048 - RNA, 63 nt, Homo Sapiens
aaaguaucuccgcuuucuugcuucucuggucuuugacuugauuuguaagcaggagcacccugu

SEQ ID NO: 695049 - RNA, 63 nt, Homo Sapiens
auguucuguaaggacuggaacaguguagccugcugacuugagauuuguacaaggacacuaaga

SEQ ID NO: 695050 - RNA, 63 nt, Homo Sapiens
gcaaaggaaacuaaggaaggcagaagagaggaaugacuugaagggguaagugaagguuaauuc

SEQ ID NO: 695051 - RNA, 63 nt, Homo Sapiens
aauuugaagggcaauugcgugugaaaauugaugugacuugauuuacacaauagucagaaaaca

SEQ ID NO: 695052 - RNA, 63 nt, Homo Sapiens
auuuaaaaaaucaaauuuuucucuucaccuuuaugacuugacauuuccuugaucuguuggagg

SEQ ID NO: 695053 - RNA, 63 nt, Homo Sapiens
auagggucauauugugaaugucucacuacaaaaugacuugaguccagugaaaucucauuaggg

SEQ ID NO: 695054 - RNA, 63 nt, Homo Sapiens
gaguaacguacaaguauauuuucuaucuucuggugacuugagcuugagcucugacaggcaugg

SEQ ID NO: 695055 - RNA, 63 nt, Homo Sapiens
uuccugagcaucuuauggaaauuaccccaccuuugacuugaagaaaccuucaucuaaagcaag

SEQ ID NO: 695056 - RNA, 63 nt, Homo Sapiens
accaaaauaggcauccuuacaaaucaggaagacugacuugacacguuuguaaaugguagaacg

SEQ ID NO: 695057 - RNA, 63 nt, Homo Sapiens
uugguaguggaauagugaauacuuacuauaauuugacuugaauauguagcucauccuuuacac

SEQ ID NO: 695058 - RNA, 63 nt, Homo Sapiens
cgacucauucuccauuuugcuuugguuuugucuugacuugacuugacuuuggggguaaagucu

SEQ ID NO: 695059 - RNA, 63 nt, Homo Sapiens
cauucuccauuuugcuuugguuuugucuugacuugacuugacuuuggggguaaagucuuucac

SEQ ID NO: 695060 - RNA, 63 nt, Homo Sapiens
cuuugagcuuuagcuguuagaaaggaacccccgugacuugacacagcuuucacagcuggcugc

SEQ ID NO: 695061 - RNA, 63 nt, Homo Sapiens
uuucauucugccacuccaucccucugcaucuacugacuugauuguuuaccauugaugacuucg

SEQ ID NO: 695062 - RNA, 63 nt, Homo Sapiens
ccagagugaacacucuuggucucccugggaaugugacuugagccaccaccucuuugggccugg

SEQ ID NO: 695063 - RNA, 63 nt, Homo Sapiens
caguuuuaauacuuguaauuuccacaugccccaugacuugauggucaucuugccucccuaccu

SEQ ID NO: 695064 - RNA, 63 nt, Homo Sapiens
cuaucauauagauccuguaucguguauuuuuugugacuugaagugacauguauuuuuuuguga

SEQ ID NO: 695065 - RNA, 63 nt, Homo Sapiens
uuauuuuacuuuuauuaaucaaaugaauuaaguugacuugaaaugugcacuaugagauuggag

SEQ ID NO: 695066 - RNA, 63 nt, Homo Sapiens
uuuuguuuuauuuggcuauuuauauguaaucugugacuugauagacauuugaauuaauguaaa

SEQ ID NO: 695067 - RNA, 63 nt, Homo Sapiens
uguugggaugggugagggagaucuucaugagugugacuugaggucucccaaaugacugucucu

SEQ ID NO: 695068 - RNA, 63 nt, Homo Sapiens
aucuuuuucaugaaugauuugagguguuaauucugacuugagauuccugaugcuugacuaauu

SEQ ID NO: 695069 - RNA, 63 nt, Homo Sapiens
auuaagauuuaauacuuuaaacacauauauauaugacuugaaaauauauacauauauauauau

SEQ ID NO: 695070 - RNA, 63 nt, Homo Sapiens
aauugaucaaacugauggauacccuaaguacccugacuugaucauuacaccuucuaugcaugc

SEQ ID NO: 695071 - RNA, 63 nt, Homo Sapiens
uuuagcuuugcuuuugaaauacauuguaagauuugacuugagguuuuugacacuuaaguacau

SEQ ID NO: 695072 - RNA, 63 nt, Homo Sapiens
cuuguccuauuccucaguucaauugcugaaaguugacuugaguccuuucugcaaagugcacug

SEQ ID NO: 695073 - RNA, 63 nt, Homo Sapiens
cuuuuucccuaauuugcuagaugcgguaacuugugacuugaguggacuuggcuuucuuacaug

SEQ ID NO: 695074 - RNA, 63 nt, Homo Sapiens
ucaaaagcaacaaccuuaaaaucacaaacugaaugacuugacuuuucaggguuuuaaacacua

SEQ ID NO: 695075 - RNA, 63 nt, Homo Sapiens
aauuuuaaucagcucccucauuuauuaacucucugacuugaugcaaguuacuuaaccucucug

SEQ ID NO: 695076 - RNA, 63 nt, Homo Sapiens
aaucaaaucacaaauguuuaaccacuuugcugcugacuugaguuauuuauccaaauauauuaa

SEQ ID NO: 695077 - RNA, 63 nt, Homo Sapiens
aguaugugcuauaaguagaggagcgcuaacuccugacuugagcuaauuaugaaaaugcagccc

SEQ ID NO: 695078 - RNA, 63 nt, Homo Sapiens
gagguuucucuuuaaugcauuuugcguguuugcugacuugagcauuuuugauuaguucgugca

SEQ ID NO: 695079 - RNA, 63 nt, Homo Sapiens
uguaagguucagcagcucugguuucuauuacggugacuugaaugucagauucaagggcccggc

SEQ ID NO: 695080 - RNA, 63 nt, Homo Sapiens
agccuccuccuccuuuuuuuuuuuuucccaaguugacuugacuuugcuuuuuuccccccaagu

SEQ ID NO: 695081 - RNA, 63 nt, Homo Sapiens
gauggcuucuccucaagcuguuuugcuauugacugacuugaacugaggaggagagagugaggg

SEQ ID NO: 695082 - RNA, 63 nt, Homo Sapiens
ucuuucccacaucucccaagaugaaaaaugcugugacuugaaaaccauuguuuauaaacaguu

SEQ ID NO: 695083 - RNA, 63 nt, Homo Sapiens
uagcauagacauuaaagauaacucucuggaaaaugacuugacuaaggcucucaugaaauucaa

SEQ ID NO: 695084 - RNA, 63 nt, Homo Sapiens
cauucuucugacucuagaugggacacuugacagugacuugaaacauuugcauauucaggaaug

SEQ ID NO: 695085 - RNA, 63 nt, Homo Sapiens
gcacagccagcuucucugaccaguaauccggggugacuugagggucugcaaaggcauagaacu

SEQ ID NO: 695086 - RNA, 63 nt, Homo Sapiens
uacaaaauucuugagcaucugcaaacuaaaaauugacuugagguuuuuuuuuuccuagucauu

SEQ ID NO: 695087 - RNA, 63 nt, Homo Sapiens
cuggaaaguugggucuuuuucccuuacauugggugacuugauuggcccccucucaugauuccu

SEQ ID NO: 695088 - RNA, 63 nt, Homo Sapiens
ggcaccugccuguuuuuguuggugcacagagauugacuugauucagagagacaauucacucca

SEQ ID NO: 695089 - RNA, 63 nt, Homo Sapiens
uucauaaacaaguuguccaaucugguaccagacugacuugaaauagcuuccaugccuauaaag

SEQ ID NO: 695090 - RNA, 63 nt, Homo Sapiens
uucucagaaauuucaggagcucauuuaaaauaaugacuugaauaugggauuccuauugugaag

SEQ ID NO: 695091 - RNA, 63 nt, Homo Sapiens
aaaugguuuaauuuuuaucuaacgugaucacuuugacuugagccaaauggaacauuucauuau

SEQ ID NO: 695092 - RNA, 63 nt, Homo Sapiens
cauuucugaauaaguaaaucaaaauaaacuguuugacuugaauaaaauauuauaaaucuauag

SEQ ID NO: 695093 - RNA, 63 nt, Homo Sapiens
cacccaagaggaacagucaugguugccuuguuuugacuugagaggaacuauaaaucacuaggc

SEQ ID NO: 695094 - RNA, 63 nt, Homo Sapiens
uggauuggggaugacaggaaacccugugaggcuugacuugaucaguucagggaggcccuuccc

SEQ ID NO: 695095 - RNA, 63 nt, Homo Sapiens
uaaugguacagacuggcuccgaagacagucccuugacuugaagugaauauucugacucugaaa

SEQ ID NO: 695096 - RNA, 63 nt, Homo Sapiens
cuuaauaaaacugcugcugccccacaugccaacugacuugaugcauuaccaggcacuccgcca

SEQ ID NO: 695097 - RNA, 63 nt, Homo Sapiens
aauuauauuucauauugcaauuuuauucuuuuuugacuugaaacauuaauacagauugaagua

SEQ ID NO: 695098 - RNA, 63 nt, Homo Sapiens
uguaccugaugaacaaaacuaccugcuuaacuuugacuugaaaugcugaacauuauguagcag

SEQ ID NO: 695099 - RNA, 63 nt, Homo Sapiens
cuaauuggaaauuuucccaauaccccaccgugaugacuugaaauauaaucagcgcuggcaauu

SEQ ID NO: 695100 - RNA, 63 nt, Homo Sapiens
auauuaaauaugugagugacaauaaaacaauuuugacuugaaucuuacucuguucuucuuugu

SEQ ID NO: 695101 - RNA, 63 nt, Homo Sapiens
cagccccuuuuuacuggggcaguuucguuauuuugacuugaugccuuuugaauaacuuucaau

SEQ ID NO: 695102 - RNA, 63 nt, Homo Sapiens
aauuuucccugaauguuuaaagaucaugacauaugacuugaucuucugggagcaggaacaaug

SEQ ID NO: 695103 - RNA, 63 nt, Homo Sapiens
uuuaaaacucaaucagucuuuccuuugagcuagugacuugaaaagaaagagagaaggaaaaga

SEQ ID NO: 695104 - RNA, 63 nt, Homo Sapiens
uuuugcacugaagauagagaccaccuuuuugagugacuugagcccaaaggcaagcguauauca

SEQ ID NO: 695105 - RNA, 56 nt, Homo Sapiens
ugcucuuuugcacaaggaaacuaccuugacuugaaaacucgcccaagugugacuga

SEQ ID NO: 695106 - RNA, 63 nt, Homo Sapiens
cacuccuuccuucaggacucuggacccagggccugacuugagcgguccuucccugauggccuu

SEQ ID NO: 695107 - RNA, 63 nt, Homo Sapiens
acugcuggaacaauagugauaagauuauuaauuugacuugaaaaauugaauuuucucccuaau

SEQ ID NO: 695108 - RNA, 63 nt, Homo Sapiens
ugaucaauagaauguggaagugggcuggcacugugacuugauucuuuccccaccauuugaauc

SEQ ID NO: 695109 - RNA, 63 nt, Homo Sapiens
cuuggggcagcccgaugcugagcugcggcucggugacuugauauggcaccuagguaagagcag

SEQ ID NO: 695110 - RNA, 63 nt, Homo Sapiens
uuccuguuuuucuuucugcuaucuguuggugccugacuugauggccucauuuggggaaaagug

SEQ ID NO: 695111 - RNA, 63 nt, Homo Sapiens
gaggggugggggucccaggacgugccucauacaugacuugagcuugucaguccacugaguuuc

SEQ ID NO: 695112 - RNA, 63 nt, Homo Sapiens
guuucaugaauagaauauccaauagagauaagcugacuugaaucauuuugagcaauuuugccc

SEQ ID NO: 695113 - RNA, 63 nt, Homo Sapiens
uugaacauucaugacugaacugaaaacaagccaugacuugagaaacaaauaauuuguauaccc

SEQ ID NO: 695114 - RNA, 63 nt, Homo Sapiens
aaaccuuucuggccuguuaugauucugaacauuugacuugaaccacaagugaaucuuucuccu

SEQ ID NO: 695115 - RNA, 63 nt, Homo Sapiens
aauaugcauuuaagguuccuccaugucuuuuugugacuugauagcucauuuuuuauugcugaa

SEQ ID NO: 695116 - RNA, 63 nt, Homo Sapiens
ggauggagccaaccuggguauucacaacaggccugacuugauacuaagugauuaguuuuccaa

SEQ ID NO: 695117 - RNA, 63 nt, Homo Sapiens
guagagcugagagaaacaggcucucaggguaccugacuugaggggaaucguuucaugaagcug

SEQ ID NO: 695118 - RNA, 63 nt, Homo Sapiens
guuaucaguacuaccacagauggugccuaagaaugacuugaauugacuucauauacguaagac

SEQ ID NO: 695119 - RNA, 63 nt, Homo Sapiens
aauguuaucaacguuuuuguuguuauaugugugugacuugaguuuguuaagaccugucuacau

SEQ ID NO: 695120 - RNA, 63 nt, Homo Sapiens
ggaaaauguuaggauggacccaaagauaguauuugacuugauuccaucaacagcuaauuaauc

SEQ ID NO: 695121 - RNA, 63 nt, Homo Sapiens
gaccuggcugucuucccugucccugguucuuguugacuugagggcccaugcuaaugguagcca

SEQ ID NO: 695122 - RNA, 63 nt, Homo Sapiens
gccaaggaauguaaauuaccuugccuauaacagugacuugauuagauggaacaauaaaagacg

SEQ ID NO: 695123 - RNA, 63 nt, Homo Sapiens
cuuguggucuucaggaaaacaggauacuuuccuugacuugagaccuuuuuuuccccuagauua

SEQ ID NO: 695124 - RNA, 63 nt, Homo Sapiens
ccauugaaacugaucuugagccugcccacgccuugacuugagcagccuccaaaagaaaccagc

SEQ ID NO: 695125 - RNA, 63 nt, Homo Sapiens
uggccauaugcugucagggguuaucuaccugugugacuugaaggccccuaaaaggaccuguuu

SEQ ID NO: 695126 - RNA, 63 nt, Homo Sapiens
caaguguuuaacaauuggggauaaaacugguuaugacuugaucguguacaggguccuuuugca

SEQ ID NO: 695127 - RNA, 63 nt, Homo Sapiens
uuuuuauucccugccuagggagacuucugugaaugacuugaauagaaauccucaugccuuuca

SEQ ID NO: 695128 - RNA, 63 nt, Homo Sapiens
agaaacagaaaagaaagacguucuugauuuuggugacuugacuuauggaggcuggaaagcccu

SEQ ID NO: 695129 - RNA, 63 nt, Homo Sapiens
gccucuaugaucuuagcucauaaaaauauaauaugacuugauaaagcaacuaaacucuuucca

SEQ ID NO: 695130 - RNA, 63 nt, Homo Sapiens
uugucagcugccaauagcaaaugaaguuaugggugacuugaaauaccaaaaccugaggagugg

SEQ ID NO: 695131 - RNA, 63 nt, Homo Sapiens
uaaauuacuccagugaauaauagcaguauaauaugacuugauaauauuuuuguaaacuuguag

SEQ ID NO: 695132 - RNA, 63 nt, Homo Sapiens
ggucuguaguugacuccaagucucugugagcagugacuugaaccaaacacaccaggaauaauc

SEQ ID NO: 695133 - RNA, 63 nt, Homo Sapiens
guuccagcuacuugggaggcugaggugggaaaaugacuugagcccaggaggaggaggcugcag

SEQ ID NO: 695134 - RNA, 63 nt, Homo Sapiens
aauuuauugaauuuuacuguuacacauaguuuuugacuugaauuaaaauacuagacaaagcag

SEQ ID NO: 695135 - RNA, 63 nt, Homo Sapiens
aaauucauagagaagagaauagaguggaugaugugacuugaaguuuuugcagcuuauuuuuuc

SEQ ID NO: 695136 - RNA, 63 nt, Homo Sapiens
gagaauuguaacauagcaugacaaauuuuguguugacuugaaaggaaucacaccauuauuccu

SEQ ID NO: 695137 - RNA, 63 nt, Homo Sapiens
cuugugugcuagauuaaaagugagacagagacuugacuugauccucugagcucaagcuauuga

SEQ ID NO: 695138 - RNA, 63 nt, Homo Sapiens
uucuuccuaacauuggucagcagaugacacuggugacuugacccuuccuagacaccugguuga

SEQ ID NO: 695139 - RNA, 63 nt, Homo Sapiens
guuccagcuacucaggaggcugaggugggaggaugacuugaacgcaggaggcugaggcugcag

SEQ ID NO: 695140 - RNA, 63 nt, Homo Sapiens
ccugcccugagcggggaugcaguguugcacugaugacuugaccagccccucccccaauaaacu

SEQ ID NO: 695141 - RNA, 63 nt, Homo Sapiens
ucccugccaccccuccuaguggggacuagugaaugacuugaccugugaccucaauacaauaaa

SEQ ID NO: 695142 - RNA, 63 nt, Homo Sapiens
acuggcaggaagcacaccgggguuaacacugguugacuugaauaggauuauucgauuuuuaaa

SEQ ID NO: 695143 - RNA, 63 nt, Homo Sapiens
uccuuuguuccaaagggaaaaaauugacagcagugacuugaaaaugauucugcucccuuugaa

SEQ ID NO: 695144 - RNA, 63 nt, Homo Sapiens
cuagguccggugccaauaaauccuuguggaaucugacuugaggggcagugaaggcagucuugg

SEQ ID NO: 695145 - RNA, 63 nt, Homo Sapiens
aagcauuaauugacauuggagucaauucagcauugacuugaguuuguguugacuuaacauuga

SEQ ID NO: 695146 - RNA, 63 nt, Homo Sapiens
aagcuuuaauugacauuagagccaaauaggcauugacuugagauugaguugacuuaaccuuga

SEQ ID NO: 695147 - RNA, 63 nt, Homo Sapiens
gcuguguucccuuguuggugaggaaauuaauuaugacuugauaaauagaacauguuuuaagaa

SEQ ID NO: 695148 - RNA, 63 nt, Homo Sapiens
gaccuuguuggugagaaaauuaaacuuuacauuugacuugauuuguuuuagaaagucuaggga

SEQ ID NO: 695149 - RNA, 63 nt, Homo Sapiens
aaguuaauuccucucucuguuggcucugcugcgugacuugagcgacugcuugggcucaagucc

SEQ ID NO: 695150 - RNA, 63 nt, Homo Sapiens
ugcgaagugaagcaggguuuaaacacaaaacuuugacuugacugcccgcggauugaaaaacag

SEQ ID NO: 695151 - RNA, 63 nt, Homo Sapiens
cuuaguaucuggcuuccuuaucguacucaucacugacuugaagcaguugccuuuuuuuuuuuu

SEQ ID NO: 695152 - RNA, 63 nt, Homo Sapiens
agaauugacccgugggggaccaguuccuguucuugacuugaaggcacaucuccccuucccuaa

SEQ ID NO: 695153 - RNA, 63 nt, Homo Sapiens
ucaggaguucgagaccagcccaaggcgggcagaugacuugaggaucucagcacuuuggguggc

SEQ ID NO: 695154 - RNA, 63 nt, Homo Sapiens
uuguguugacuuaacauugagucaguccagcauugacuugaguaagcauuaauugacacuaga

SEQ ID NO: 695155 - RNA, 63 nt, Homo Sapiens
cccccagguuggggcuggguccacccuguccuaugacuugaucacuuuugcacauucccuggc

SEQ ID NO: 695156 - RNA, 63 nt, Homo Sapiens
acacagaguauuauuacuuuugccagguuuuucugacuugauuucuguaauuuccagaaaccc

SEQ ID NO: 695157 - RNA, 63 nt, Homo Sapiens
auucgggcuuguguucucccucucauuuuagucugacuugacuauuguuuuuccuuucuggcg

SEQ ID NO: 695158 - RNA, 63 nt, Homo Sapiens
uucacagaaaaagcaugaugggaaaauauuuccugacuugaguguuccuuuuuaaaugugaau

SEQ ID NO: 695159 - RNA, 63 nt, Homo Sapiens
ccgacuucaucccaaaggacagccgccuggagaugacuugaggccuuacuuaaacccagcucc

SEQ ID NO: 695160 - RNA, 63 nt, Homo Sapiens
ugaguuucuggagaauuuuuggauggugauuaaugacuugacuggcugcucuucccagagcug

SEQ ID NO: 695161 - RNA, 63 nt, Homo Sapiens
cgucaacugcuggucucucccguuuuuugggucugacuugacucccacucacuaccuuggcgu

SEQ ID NO: 695162 - RNA, 63 nt, Homo Sapiens
gugguagugcuccauuuaaucuacuuguuuaaaugacuugacagucagaacugaagaguaaau

SEQ ID NO: 695163 - RNA, 63 nt, Homo Sapiens
gagagggaggaagggcgcgcgccuugaccuguuugacuugagccugucccugccgcggcccca

SEQ ID NO: 695164 - RNA, 63 nt, Homo Sapiens
acacacuugacccucaggcaggucugcugaaguugacuugaaaaacaaaaaaugguuaaauga

SEQ ID NO: 695165 - RNA, 63 nt, Homo Sapiens
gcaucucuauaucuagauauggacauaguaaaaugacuugaaacauuucuauaauaucuaccu

SEQ ID NO: 695166 - RNA, 63 nt, Homo Sapiens
aucgagcacugucagaaucuggugggcagccccugacuugaaccacucccacgugcugccucc

SEQ ID NO: 695167 - RNA, 63 nt, Homo Sapiens
uaacccaucggcaucuuccaggaauccgccgagugacuugaggaagaugcuaacgcaguaagg

SEQ ID NO: 695168 - RNA, 63 nt, Homo Sapiens
aauuuggucugccucugagcaggaaaagguccuugacuugaugccucuccgcaaggugguagc

SEQ ID NO: 695169 - RNA, 63 nt, Homo Sapiens
ugaaaaaggagagacauggacucagcugcuggaugacuugagaugagcauggagcugucaccu

SEQ ID NO: 695170 - RNA, 63 nt, Homo Sapiens
gugaguggggacccaugauguaugggucucaccugacuugaggugaauuuuggagugaagggc

SEQ ID NO: 695171 - RNA, 63 nt, Homo Sapiens
aggauagguggcagggcagaaacugggcagcccugacuugauagcagcagggggagcucccaa

SEQ ID NO: 695172 - RNA, 63 nt, Homo Sapiens
aguuaaugugaucuuugggggauaggcagauguugacuugagggaaaaaaaggggaaguuggg

SEQ ID NO: 695173 - RNA, 63 nt, Homo Sapiens
guaaugguaccauauauuuuuuaaaauacauauugacuugaauugugaggcaauaagauaccu

SEQ ID NO: 695174 - RNA, 63 nt, Homo Sapiens
aucugacaaaacuggcaacaucuuacagacuacugacuugaagacaaccucuuuuauauuucu

SEQ ID NO: 695175 - RNA, 63 nt, Homo Sapiens
uucauuuuauugucuuaguuuguauauuuucugugacuugaaauaaacuuugaacacaauuuu

SEQ ID NO: 695176 - RNA, 63 nt, Homo Sapiens
ggguuuuuguguguaugugauuuucaaaauucaugacuugaagugcaaggacagaucuagaug

SEQ ID NO: 695177 - RNA, 63 nt, Homo Sapiens
guugagacaaaaaauacaguuguugauaaaaugugacuugacgugguuugucccagucuaacg

SEQ ID NO: 695178 - RNA, 63 nt, Homo Sapiens
gaggcaggcuuuuccagcauuuaacuuaugugaugacuugauccaaauacagguuuucugaca

SEQ ID NO: 695179 - RNA, 63 nt, Homo Sapiens
uuuuucuuaucaauauuuucauagcuguuaaacugacuugauugaaacuaauaaugaaaaagc

SEQ ID NO: 695180 - RNA, 63 nt, Homo Sapiens
uuauccaccaaagacuucaucuauuauuuguuuugacuugaauauuaugaauggccuacuguu

SEQ ID NO: 695181 - RNA, 63 nt, Homo Sapiens
ucacuuaggaucgcaggaauucagcagcaaauuugacuugaauaguguucauugucauugacc

SEQ ID NO: 695182 - RNA, 64 nt, Homo Sapiens
aggccagugucuuccucaccugggugggucccacacuugugaccucaguuuuaggaccaagauc

SEQ ID NO: 695183 - RNA, 64 nt, Homo Sapiens
gauucuuuaccaggcugugagccaguguuagauaacuugugaauggauauaaguuacuuuuaac

SEQ ID NO: 695184 - RNA, 64 nt, Homo Sapiens
cuugacuugaccauaagaucauggaaaacagaugacuugugaaccccacaguguggaugugcaa

SEQ ID NO: 695185 - RNA, 64 nt, Homo Sapiens
uuugaccugccagccucucauuucuucucccuccacuugugagcgcccccagcuuugcggcgcc

SEQ ID NO: 695186 - RNA, 64 nt, Homo Sapiens
uuugcauuuccucugcccuuuuaacuaaacuaaaacuugugaauuuuaaauuauuaaggggggg

SEQ ID NO: 695187 - RNA, 64 nt, Homo Sapiens
aucggauucccagaggugaaucagcuccucuccuacuugugacuagagggugguggagguaagg

SEQ ID NO: 695188 - RNA, 64 nt, Homo Sapiens
ugagacugaaaauaauauagaaaaucucauugcuacuugugauuaucaaaaaaaguauguauuu

SEQ ID NO: 695189 - RNA, 64 nt, Homo Sapiens
uuguaagcugcuaugcaaaugggcauuuauauaaacuugugauguuucuugucagaauucugag

SEQ ID NO: 695190 - RNA, 64 nt, Homo Sapiens
cccugccacuguaauaucuauaaguacuuaagagacuugugagcaaaacauacuauuuauaaca

SEQ ID NO: 695191 - RNA, 64 nt, Homo Sapiens
cugacucuguacugcucaguuucacucacaggaaacuugugacuuguguauuaucgucauugag

SEQ ID NO: 695192 - RNA, 64 nt, Homo Sapiens
uggaauuugccuacugaaauaguuauagaugauuacuugugaugugaaacugaauugagcauga

SEQ ID NO: 695193 - RNA, 64 nt, Homo Sapiens
ggcugcaggaagaaacuuuugcuuaaagggauggacuugugauucaguggugcguuuauaauug

SEQ ID NO: 695194 - RNA, 64 nt, Homo Sapiens
gaaggggcacaccacugcccgcugggccccaccuacuugugacuccaccuccuagaggugggca

SEQ ID NO: 695195 - RNA, 64 nt, Homo Sapiens
ccacagaguggcagacagcacaguaguaaguuauacuugugagccauaguacuacuuauacuua

SEQ ID NO: 695196 - RNA, 64 nt, Homo Sapiens
acacagagcagcaucugaugauaagacagggaacacuugugagcugcucccuucgaaggcccag

SEQ ID NO: 695197 - RNA, 64 nt, Homo Sapiens
agaaauuaccuuugacgugcggucuuucuccuguacuugugaucuuaaucuugcuucuucauca

SEQ ID NO: 695198 - RNA, 64 nt, Homo Sapiens
aaucuauucuguugucuuugacuuuggugccguuacuugugaaacuuacaaauuccagcaugug

SEQ ID NO: 695199 - RNA, 64 nt, Homo Sapiens
ucgaugguacgugacccucugugggucuggccguacuugugauuacuauuucggccuuuugggg

SEQ ID NO: 695200 - RNA, 64 nt, Homo Sapiens
auaugguguuaugggaaaacagaauuguucauagacuugugauaacugccuaccuuagcuaacc

SEQ ID NO: 695201 - RNA, 64 nt, Homo Sapiens
cccaggaaaaccuuuagucuaaggaacuugggaaacuugugaaaacucccucccgcucucucaa

SEQ ID NO: 695202 - RNA, 64 nt, Homo Sapiens
uggggagagcaacuucaggguuuucuugaaucagacuugugauuuuuucaucauuuuuguuucc

SEQ ID NO: 695203 - RNA, 64 nt, Homo Sapiens
cuuggccccuuuccccauucacaauauuuuuugcacuugugauccccuccaaaacaugacauaa

SEQ ID NO: 695204 - RNA, 64 nt, Homo Sapiens
uagucauggggcuucaguguaaaaauacagguauacuugugauaucuguucugccagagaugga

SEQ ID NO: 695205 - RNA, 64 nt, Homo Sapiens
aauaugagucaguuauugccuuauugucuaggccacuugugaagaauuugaggugaaugguucc

SEQ ID NO: 695206 - RNA, 64 nt, Homo Sapiens
aaagaggguggguggguauaguuaguagagguacacuugugaauggcuuagugauguaauuaug

SEQ ID NO: 695207 - RNA, 64 nt, Homo Sapiens
acuuuuaugucacuacucuagagaaaggagucauacuugugaagaagucaguacuccuguugcg

SEQ ID NO: 695208 - RNA, 64 nt, Homo Sapiens
ucccagacucugccuccuggugucuugagaggagacuugugaauagagguccggguuuaguaua

SEQ ID NO: 695209 - RNA, 64 nt, Homo Sapiens
acgaauaaaugggauaaagauuaacuauuuguuaacuugugaauccacuucaccuacaauauug

SEQ ID NO: 695210 - RNA, 64 nt, Homo Sapiens
guuaauaccauaauuuuuccuuguggaggcucaaacuugugaagguaaaacuugguugcauuau

SEQ ID NO: 695211 - RNA, 64 nt, Homo Sapiens
cugucaagaguaucaaaugccaugcagcacuuaaacuugugauaaggaagaugaagggucuuca

SEQ ID NO: 695212 - RNA, 64 nt, Homo Sapiens
gugggguuaugaaauuguagauguuuuuagaaaaacuugugaaugaaaaugaauccaaguguuu

SEQ ID NO: 695213 - RNA, 64 nt, Homo Sapiens
cacguggauuucccagcugccccuaaauauauauacuugugaguggcaaaguggcacuaaugaa

SEQ ID NO: 695214 - RNA, 64 nt, Homo Sapiens
aaguaccaaauaauaauaaugcuauacuuaaauuacuugugaaaaacaacacauuuuaaagauu

SEQ ID NO: 695215 - RNA, 64 nt, Homo Sapiens
auguuaccucaucuucuuuuuuaaacuguacccaacuugugaggguacucugucuaauguauau

SEQ ID NO: 695216 - RNA, 64 nt, Homo Sapiens
ucauuuuuccaggacaguuggauauugucaggccacuugugaccccagccauguagugagggug

SEQ ID NO: 695217 - RNA, 64 nt, Homo Sapiens
auuccauuauguuuuaauguugucucugaagaugacuugugauuuuuuuuucuuuuuuuuaaac

SEQ ID NO: 695218 - RNA, 64 nt, Homo Sapiens
gcaagcugacuuuuguaaugugcucaauacaaauacuugugaacuuuuaauauguugagugcuu

SEQ ID NO: 695219 - RNA, 64 nt, Homo Sapiens
ugccccaugcuuaugguccccagcauuuacaguaacuugugaauguuaaguaucaucucuuauc

SEQ ID NO: 695220 - RNA, 64 nt, Homo Sapiens
uuugagauugcuuacaccgugacaagaugccaucacuugugauguuaugaacuguuauaaacuc

SEQ ID NO: 695221 - RNA, 64 nt, Homo Sapiens
cugguacaguguucugcuugauuuacaacauguaacuugugacuguacaauaaacauaagcaua

SEQ ID NO: 695222 - RNA, 64 nt, Homo Sapiens
uggaagaaaggaucccccgugacggcucugccccacuugugaacgccaacccucagugcuuagc

SEQ ID NO: 695223 - RNA, 64 nt, Homo Sapiens
aggguauccagcuguagauguucuuaucccccauacuugugaguucuugggguugcucacaaau

SEQ ID NO: 695224 - RNA, 64 nt, Homo Sapiens
cuuaauccguuucuggaggaagaguaugacacccacuugugaugggguccuugugcggugggga

SEQ ID NO: 695225 - RNA, 64 nt, Homo Sapiens
gagaaaaguuuaaugccggcauuaauguucuacuacuugugacuauguauuacuuugaauucag

SEQ ID NO: 695226 - RNA, 64 nt, Homo Sapiens
ggguguauggagaacugaaaguguuuuugugaccacuugugaauaagccaaguaaagguacugg

SEQ ID NO: 695227 - RNA, 64 nt, Homo Sapiens
gguuuuuauuuuuacucauuacugaguaaacuugacuugugagguucauuuuaggcuauuggcu

SEQ ID NO: 695228 - RNA, 64 nt, Homo Sapiens
aucaggaaaauuccuucaacuuaacuucagauuaacuugugagaaauagacugagaauugagcc

SEQ ID NO: 695229 - RNA, 64 nt, Homo Sapiens
ggaguucaguggcccuggcaucauacuuuugaccacuugugacucugcauccaguuguucucgg

SEQ ID NO: 695230 - RNA, 64 nt, Homo Sapiens
ugcguguguuuauguacagauucuuucugacuagacuugugauauaucuuguuuuucuauguau

SEQ ID NO: 695231 - RNA, 64 nt, Homo Sapiens
cacugguaugaagaauuuuucuguugcagugaggacuugugauuaggaguuggauuuguuaugu

SEQ ID NO: 695232 - RNA, 64 nt, Homo Sapiens
acauggaauauuugguuuccguuauuucacucccacuugugagauguuauuccuuuguguccau

SEQ ID NO: 695233 - RNA, 64 nt, Homo Sapiens
ucuuucaagucuaaaugauuacuuaaguguguuaacuugugacuguuggugguguacagaacac

SEQ ID NO: 695234 - RNA, 64 nt, Homo Sapiens
agugugccauuccaggauaaagacugcaaaugucacuugugauggagugagucuccccuuaauu

SEQ ID NO: 695235 - RNA, 64 nt, Homo Sapiens
aaaauuauuuuaauugguaugguuauugaaagguacuugugaagcuuuucuuuauguaauugau

SEQ ID NO: 695236 - RNA, 64 nt, Homo Sapiens
gagaccuacaugcaugucuuguuuaaaauguuuaacuugugaucagauugucaauuaaaaauga

SEQ ID NO: 695237 - RNA, 64 nt, Homo Sapiens
guuuuguuuuacaaaucacuuguagaaagcccacacuugugaagcuucagccuggcaaguuaca

SEQ ID NO: 695238 - RNA, 64 nt, Homo Sapiens
ucuagaacuagggcucuuaggguuacuaacaucaacuugugacaguacagaauuaguacuuggu

SEQ ID NO: 695239 - RNA, 64 nt, Homo Sapiens
uaccaauaauagaguuuauuaaaguuuaucuagcacuugugacacauuugucauauuaagaaaa

SEQ ID NO: 695240 - RNA, 64 nt, Homo Sapiens
ugcuuguaaugcucacuuauguuuucucuguauaacuugugauuccagggcuguuugucaacag

SEQ ID NO: 695241 - RNA, 64 nt, Homo Sapiens
aaaauggggccgcugaugugcaauaucaaagugaacuugugaguauuuuguguguguugaucuc

SEQ ID NO: 695242 - RNA, 64 nt, Homo Sapiens
caaucuacuuuguuuaaaaaaggucugaaucaggacuugugaaaaccuguagugaaauaccuua

SEQ ID NO: 695243 - RNA, 64 nt, Homo Sapiens
aagaagaaaacaaauaugacaguaugguagcuauacuugugaugucugacgcaugauggccuau

SEQ ID NO: 695244 - RNA, 64 nt, Homo Sapiens
uggauauauaagagcaugaaauuuuuaaaaauacacuugugauuauaaaauuaaucacaaauuu

SEQ ID NO: 695245 - RNA, 64 nt, Homo Sapiens
aaaggguaugaaagugccugccuuguuuauagccacuugugaguaaaaauuuuuuugcauuuuc

SEQ ID NO: 695246 - RNA, 64 nt, Homo Sapiens
ugcggcuccuuagggcagaacagcugcauguggcacuugugacacucacucacccuucagggga

SEQ ID NO: 695247 - RNA, 64 nt, Homo Sapiens
auaaaaguuccuaccucaugcuuuaccucucuggacuugugauaguguggcauugggcaaguaa

SEQ ID NO: 695248 - RNA, 64 nt, Homo Sapiens
acaguaaaauaguuuggauaguuauuuauguuguacuugugaaaucuuugaaauuagcaccuuu

SEQ ID NO: 695249 - RNA, 64 nt, Homo Sapiens
uucucuugucuaaucugaaucagaaggcuaucacacuugugaaaccaaacuuuuauauaauaua

SEQ ID NO: 695250 - RNA, 64 nt, Homo Sapiens
gugccaaacaaaaaaugugcaccuguaaagucuuacuugugauuaaugugaauagccacaucuu

SEQ ID NO: 695251 - RNA, 64 nt, Homo Sapiens
guuuuuuuuuguuuuguuuuucuaauguaauccaacuugugacuaagucaacuguggcaccaau

SEQ ID NO: 695252 - RNA, 64 nt, Homo Sapiens
gucuugccaucaauaaaauaaauauugucaaauaacuugugauuuguugaaauaagaaauacuu

SEQ ID NO: 695253 - RNA, 64 nt, Homo Sapiens
caaacaauuuugugguuaaagacauuguauuaccacuugugauuaacuuuagaaaaauauugaa

SEQ ID NO: 695254 - RNA, 64 nt, Homo Sapiens
uauuagucaggcccuucaaagacuggaggguuacacuugugauucaugaaaaacccagacugga

SEQ ID NO: 695255 - RNA, 64 nt, Homo Sapiens
acguuuuuucaaauauagauucugcauuugugguacuugugacucuucuuccugcugcucugau

SEQ ID NO: 695256 - RNA, 64 nt, Homo Sapiens
aaagacagacauugcuuaaaaugcacauauauuaacuugugacuauaguuugggccauuggugc

SEQ ID NO: 695257 - RNA, 64 nt, Homo Sapiens
ggguacagaggcacuugcucugccgccucuacccacuugugaugcagcaccccugcgguaggag

SEQ ID NO: 695258 - RNA, 64 nt, Homo Sapiens
uuuaucuggaaaaggaagaagucaucagugucucacuugugauuuuccuggagacagaagagcc

SEQ ID NO: 695259 - RNA, 64 nt, Homo Sapiens
auauacccccccaugcagucuaaaaugcuucaguacuugugaaacacagcuguucuucuguucu

SEQ ID NO: 695260 - RNA, 64 nt, Homo Sapiens
uuuguuuuaaaccaaacuacccaguauuccuugcacuugugaauguguugcacucugcuggaug

SEQ ID NO: 695261 - RNA, 64 nt, Homo Sapiens
ugcuguuuuuauuauacaucaguuucuuuguauaacuugugaguuccauguguuuuguuuuuau

SEQ ID NO: 695262 - RNA, 64 nt, Homo Sapiens
cgcaaaauggacuuuucauuugucaaguauugggacuugugauuuuuaauuauccagcauauag

SEQ ID NO: 695263 - RNA, 64 nt, Homo Sapiens
acacuuugagcgcuuuaagaaucccuccccuugcacuugugaaaguaaauguuggcugagaaca

SEQ ID NO: 695264 - RNA, 64 nt, Homo Sapiens
uuuaaaugaugcaauaaaaggacacuuaagaccuacuugugauaacagaaagaagaugccagau

SEQ ID NO: 695265 - RNA, 64 nt, Homo Sapiens
uuuuaaaauaaaaauuuuauuugucuuuguaauuacuugugaugaguuuguauaguuggaauau

SEQ ID NO: 695266 - RNA, 64 nt, Homo Sapiens
aggcuuguaggaaagcuccuagagaaaaugugacacuugugaaauggaaauccuucccuuuuaa

SEQ ID NO: 695267 - RNA, 64 nt, Homo Sapiens
ugaaauaaagaaaauacguucaugaaaacccuagacuugugaccaaaccacuugcuacaugacc

SEQ ID NO: 695268 - RNA, 64 nt, Homo Sapiens
uggaaauguucuaaaggugggaagcaaaucagaaacuugugaagccaucgccaaguaagaaagu

SEQ ID NO: 695269 - RNA, 64 nt, Homo Sapiens
aaagaaguugaaggcagcauuccucagcucugugacuugugacccuauuugaaguuucaggauu

SEQ ID NO: 695270 - RNA, 64 nt, Homo Sapiens
aguauguaagaaguuuuaacauuuacuucacaggacuugugauuguguuaaauucucacuauug

SEQ ID NO: 695271 - RNA, 64 nt, Homo Sapiens
acagauaaauauuaauuuuauuauaguuuuaaguacuugugaucauguacuuuuugauucuaaa

SEQ ID NO: 695272 - RNA, 64 nt, Homo Sapiens
acuaauguaagaaauuguuauucuacuaauauuuacuugugauugugugacaaguguguuuaca

SEQ ID NO: 695273 - RNA, 64 nt, Homo Sapiens
caaggagcuccgcucuacaacugguuuuuuuaggacuugugaggaacacagcaacggaaaucca

SEQ ID NO: 695274 - RNA, 64 nt, Homo Sapiens
gcaccuucagaggacagccuugauucacuuguaaacuugugaaaaucugaacauaggggaguga

SEQ ID NO: 695275 - RNA, 64 nt, Homo Sapiens
gcaguuuucugccgcaacccugaagcuuuggagcacuugugauugccuuuuucuacuugccugc

SEQ ID NO: 695276 - RNA, 64 nt, Homo Sapiens
acacauuucuguuaaagaagugcaugcacacacaacuugugaacuguacacacagaggcacaug

SEQ ID NO: 695277 - RNA, 64 nt, Homo Sapiens
uugcuauuuauuuuucccuggaaacaaaacccuaacuugugaaguaucuuucacaguagaacua

SEQ ID NO: 695278 - RNA, 64 nt, Homo Sapiens
uaagaacugagaaggucaaaguuuuucauaauaaacuugugaaccugcacaagagcacugcagu

SEQ ID NO: 695279 - RNA, 64 nt, Homo Sapiens
uuugaaauuguucuuuuuauaaggccucccuucuacuugugagucauuuuuaaaaauaauuacc

SEQ ID NO: 695280 - RNA, 64 nt, Homo Sapiens
ucauuuugaaacccuucaaugaucuuucccaugaacuugugauaagguguuuauuaggcuucag

SEQ ID NO: 695281 - RNA, 64 nt, Homo Sapiens
gaugggaacgcaagagauaccagugccaucauacacuugugaugagaaugcaguguucugauac

SEQ ID NO: 695282 - RNA, 64 nt, Homo Sapiens
uugccuuugugugugauuuuaguuccacaugaugacuugugaacauuagggauuuaaaggaaaa

SEQ ID NO: 695283 - RNA, 64 nt, Homo Sapiens
uaguuuuuaggugguuuuauauaacauuuuaauuacuugugauuuagauguauccauccuuuuu

SEQ ID NO: 695284 - RNA, 64 nt, Homo Sapiens
aggacaggagccuuauaggcaaugccccagacugacuugugagugggguuuauggggaaaggga

SEQ ID NO: 695285 - RNA, 64 nt, Homo Sapiens
ccccauggagccagcucccucuauuuauguuugcacuugugauuauuuauuauuuauuuauuau

SEQ ID NO: 695286 - RNA, 64 nt, Homo Sapiens
ccgcccuaggcuuccugacuccauuaguuccgacacuugugaaacuccgagaagugcugugguc

SEQ ID NO: 695287 - RNA, 64 nt, Homo Sapiens
gcagaaaugugugaaaccaaaaugaucacugccuacuugugauucaaaucuucagaguuuuccu

SEQ ID NO: 695288 - RNA, 64 nt, Homo Sapiens
agaaaaaaccuuuuacuauaugaaacuuuacaacacuugugaaagcaacucaauuugguuuaug

SEQ ID NO: 695289 - RNA, 64 nt, Homo Sapiens
caauaggaugauuuacuauaaauuucauccaacuacuugugaucucucucaccuacaucaauua

SEQ ID NO: 695290 - RNA, 64 nt, Homo Sapiens
auuuuacaguguuucaauccagccauaaaaauuaacuugugauuuuuuuuuucccaaagucaug

SEQ ID NO: 695291 - RNA, 64 nt, Homo Sapiens
uuccuuuuaccuuuuuuggaccuuugcgugccaaacuugugaaacuuucuuuagaucugugcag

SEQ ID NO: 695292 - RNA, 64 nt, Homo Sapiens
auuaccucagauaccuguuguuuuuugugagccuacuugugaauggcacugaauucgucaacuc

SEQ ID NO: 695293 - RNA, 64 nt, Homo Sapiens
cugcagauauagguaagauaaggcccuggccccuacuugugaaguaugaagcaggugcuggaac

SEQ ID NO: 695294 - RNA, 64 nt, Homo Sapiens
cucuaccaugaaggaugcggaaccagaaacuuuuacuugugauaugguuuuaaguagaugaaac

SEQ ID NO: 695295 - RNA, 64 nt, Homo Sapiens
gaaucauuggcuucuagaaaaaauaccuagagcuacuugugagucaguguucacaacuaagaau

SEQ ID NO: 695296 - RNA, 64 nt, Homo Sapiens
acaaggaaccugaccuaaccagaugauuucugagacuugugaugguguaaaauauauguuuucu

SEQ ID NO: 695297 - RNA, 64 nt, Homo Sapiens
cuuagcagcauggaagagaacauucuucuuguguacuugugacuuguaccgauauguuuaugcc

SEQ ID NO: 695298 - RNA, 64 nt, Homo Sapiens
guuuaauuuggaauuaguggccccaaacaaguaaacuugugaaagugaccauaagaaugucccu

SEQ ID NO: 695299 - RNA, 64 nt, Homo Sapiens
aauacaaacaugugagauuuucuuuuacaugucaacuugugacaucaugugguacauugaagcc

SEQ ID NO: 695300 - RNA, 64 nt, Homo Sapiens
uaaugguaauucuaugcaaguuuggaauuggaugacuugugaagaggcaguuuucuuauuugag

SEQ ID NO: 695301 - RNA, 64 nt, Homo Sapiens
uauuucuauuuauaauauucagcaaaagugaaagacuugugaagcauaugacauucuauuuuug

SEQ ID NO: 695302 - RNA, 64 nt, Homo Sapiens
uucgagcuacaugcaucuagggcggagaggcugcacuugugagagaaaauacuauuucaaguca

SEQ ID NO: 695303 - RNA, 64 nt, Homo Sapiens
uccauucagugacauccacagauuaugcagcuauacuugugaaaucgugcaugaggccccaggg

SEQ ID NO: 695304 - RNA, 64 nt, Homo Sapiens
auugaauaccuguuaaagaaaaauuacagaauaaacuugugacuggucuuguuuuacauuauau

SEQ ID NO: 695305 - RNA, 64 nt, Homo Sapiens
agauaaauggggccuuuaaaaauaugaaaaacaaacuugugaaaauguauaaaagaugcaucug

SEQ ID NO: 695306 - RNA, 64 nt, Homo Sapiens
uuuuuuuucuguuuuauaguuugcgcugcaugguacuugugaagcuuaaauauuuugaguguuc

SEQ ID NO: 695307 - RNA, 64 nt, Homo Sapiens
uuuaccaacaauuuuuaaugaaaaggaaaauuauacuugugauucucguagugacauuuauauu

SEQ ID NO: 695308 - RNA, 64 nt, Homo Sapiens
ucaucaauugcgaugcucccacaacucuuuacagacuugugaaaucuucaagaacaccuuuacu

SEQ ID NO: 695309 - RNA, 56 nt, Homo Sapiens
uaucugaagaucuggaaugagaacugacuugugaaaccucagcgugaagggacaua

SEQ ID NO: 695310 - RNA, 64 nt, Homo Sapiens
cagugauuucuuaagcaauuugaucuguaccuuuacuugugaaagguaugcuauauaauucagc

SEQ ID NO: 695311 - RNA, 64 nt, Homo Sapiens
aucagagggcugauggauuccaucauuugcacaaacuugugagccuucucagucuuuucaguuu

SEQ ID NO: 695312 - RNA, 64 nt, Homo Sapiens
ccuauucgauauuauguacgcauguccucuacacacuugugauucucugggauuugccuuccuu

SEQ ID NO: 695313 - RNA, 64 nt, Homo Sapiens
uccaucauucauccaggacuagucucccacugcaacuugugaacgggagacagucuaggaaugg

SEQ ID NO: 695314 - RNA, 64 nt, Homo Sapiens
gcuuauauuaugauuucugguuauuucaguuuuaacuugugaaacaguguauugguaauuuaaa

SEQ ID NO: 695315 - RNA, 64 nt, Homo Sapiens
uuuugaguacauacuaugugacuuguuuuacuggacuugugaaugucacagaagaaaaccacaa

SEQ ID NO: 695316 - RNA, 64 nt, Homo Sapiens
cuguugaucggccauagggcuuccauggguggaaacuugugagggaguuuguauuaggucuggu

SEQ ID NO: 695317 - RNA, 64 nt, Homo Sapiens
ccguaaauaaggggaaaaggcaguuagcucaaggacuugugacggauccacuuugguguucaag

SEQ ID NO: 695318 - RNA, 64 nt, Homo Sapiens
auaccgcaaaugucaugagaaguuugauucaguaacuugugauggaggauucuuugguaucuua

SEQ ID NO: 695319 - RNA, 64 nt, Homo Sapiens
gaauacuuagauuuguagcuuaaucacauucuagacuugugaguugaaugacaaagcaguugaa

SEQ ID NO: 695320 - RNA, 64 nt, Homo Sapiens
auuuaucuuucuaaauucuauuuuaaaagguaucacuugugaucgagauuguaagaaaagcauu

SEQ ID NO: 695321 - RNA, 64 nt, Homo Sapiens
cccccucgacucccuggugacauaccuccauuccacuugugacaugcccacccuccccaaccca

SEQ ID NO: 695322 - RNA, 64 nt, Homo Sapiens
ucaauguuucuuuuuuaaaauaaacaaccugaagacuugugaaaguugucuauagcuaugucua

SEQ ID NO: 695323 - RNA, 64 nt, Homo Sapiens
uaaaaucuuucuugugcauuauauucuuaaaaguacuugugaagcauacauauuaaaucaaagu

SEQ ID NO: 695324 - RNA, 64 nt, Homo Sapiens
aucaucuuguccuuuaauccuguaaauuuucuuuacuugugaguacuuuuguuaaguuuuuucu

SEQ ID NO: 695325 - RNA, 64 nt, Homo Sapiens
aauaugcuuucccuuuacacgacaaaaguccucaacuugugagcugauaauaggaaaagaaaag

SEQ ID NO: 695326 - RNA, 64 nt, Homo Sapiens
aaaaugaagaaaagagucuaaggaauguagcucaacuugugauaucaucauuuugaauaggaaa

SEQ ID NO: 695327 - RNA, 64 nt, Homo Sapiens
caugaagaauuauguugacauucuuggcuauaauacuugugacuuucagcuuuuuguuguuuug

SEQ ID NO: 695328 - RNA, 64 nt, Homo Sapiens
gcagcaaucugaaaucaucucuagucuugcuuucacuugugagcaguugucuucuaugauccca

SEQ ID NO: 695329 - RNA, 64 nt, Homo Sapiens
auauuguugaagaacacuuccuggaacacuucucacuugugaugcuguacuaauuuuuuuuuuu

SEQ ID NO: 695330 - RNA, 64 nt, Homo Sapiens
gucaagauccugguucuuauggguccaugaacacacuugugaccuuaguacuuggucauccagc

SEQ ID NO: 695331 - RNA, 64 nt, Homo Sapiens
cuuguagggaacuggaaccagcccacaacugcacacuugugagcugucauggaaaccugauccc

SEQ ID NO: 695332 - RNA, 64 nt, Homo Sapiens
auauuuuucacagauuaucuagaucuaccgacucacuugugagaucuuagaauaauuuugaaug

SEQ ID NO: 695333 - RNA, 64 nt, Homo Sapiens
auguuuuuaacuaaauuuacuuacaguuuuuguaacuugugauuuuuuucuuuguaauuuguaa

SEQ ID NO: 695334 - RNA, 64 nt, Homo Sapiens
gcuuugugucgcuucucacuugcaucagcaggacacuugugagagccgaggcgccauggggcgu

SEQ ID NO: 695335 - RNA, 64 nt, Homo Sapiens
gcgggcugggggggcauuccaggauuggagacugacuugugacuagagcuaaagagucugcagc

SEQ ID NO: 695336 - RNA, 64 nt, Homo Sapiens
cuuguuuuaauuuacugaugcuggagcuagaagcacuugugauuccacuaacuccuauagacuc

SEQ ID NO: 695337 - RNA, 64 nt, Homo Sapiens
uccuuggauaugauauuauuugaaauauaauuuaacuugugaacgaagguacuucagcuuaauc

SEQ ID NO: 695338 - RNA, 64 nt, Homo Sapiens
auggcuuuucauucuucaauaguccaucucccagacuugugacucccaggcuuccucuucuugu

SEQ ID NO: 695339 - RNA, 64 nt, Homo Sapiens
gaaccaugcccaguuuaugcauacuggcagauacacuugugacucucacacaggaaacuucccu

SEQ ID NO: 695340 - RNA, 64 nt, Homo Sapiens
aaugcccagaagaaccucagugauggcugaucuaacuugugaagucucugcuucacacucaugc

SEQ ID NO: 695341 - RNA, 64 nt, Homo Sapiens
acuagaaauuuggagaaagaacacuaacacauguacuugugauuuguucauguuauauuaaaac

SEQ ID NO: 695342 - RNA, 64 nt, Homo Sapiens
acagaaauacucuguacuucugagagaacacaucacuugugaggauauucauugugagguucua

SEQ ID NO: 695343 - RNA, 64 nt, Homo Sapiens
cauuaggaacuuuagcaugucaaaaugaauguuuacuugugaacucgauagagcaaggaaacca

SEQ ID NO: 695344 - RNA, 64 nt, Homo Sapiens
ugaagaccaagggucccccuuguuaccugcccaaacuugugacugcaucccucuggagucuacc

SEQ ID NO: 695345 - RNA, 64 nt, Homo Sapiens
ugaguguccagucgugugcaugaauuucaccccaacuugugacugcucacuuaugacgucuccc

SEQ ID NO: 695346 - RNA, 64 nt, Homo Sapiens
uugagauuuuugguuuuuugauuucuauucccuaacuugugaagacaaugaaaaaucaggcaga

SEQ ID NO: 695347 - RNA, 64 nt, Homo Sapiens
uuguuuugauuccaucauuaaugcacuuguggagacuugugauaagcugcugcuccuauauuuu

SEQ ID NO: 695348 - RNA, 64 nt, Homo Sapiens
uaauaaugcuuuauguuauacauuaaauguaaagacuugugaauccauguuugauugacuuuca

SEQ ID NO: 695349 - RNA, 64 nt, Homo Sapiens
gauuuuuucccuuuuuaugugggauauaguaguuacuugugacaagaauaauuuuggaauaauu

SEQ ID NO: 695350 - RNA, 64 nt, Homo Sapiens
uggccaucucuucuuugucuaccauuucaaauugacuugugaauacucagagcaguuauuuuuc

SEQ ID NO: 695351 - RNA, 64 nt, Homo Sapiens
uugguuauacaguuucaaaaagaagccuucauacacuugugaaacuuucaacauccugaauguu

SEQ ID NO: 695352 - RNA, 64 nt, Homo Sapiens
gaaaacacaaugugcauguuaaacaugucauuccacuugugaaacagucaaauauccuuccuaa

SEQ ID NO: 695353 - RNA, 64 nt, Homo Sapiens
agaugugcaaggggagcacagucauuuggaagucacuugugaaugcuuaaauaucaaagcaguu

SEQ ID NO: 695354 - RNA, 64 nt, Homo Sapiens
auucugaagugccaaaggaguaaaaaggcaaauuacuugugaucuaaauuuuguucuauaugaa

SEQ ID NO: 695355 - RNA, 64 nt, Homo Sapiens
ccggacagccgaacccaagaccggaggcaugucuacuugugaucucugguugcuguagcuccug

SEQ ID NO: 695356 - RNA, 64 nt, Homo Sapiens
uaaugaugauuauggaaugaauuuuaaugucccuacuugugaauaauuagcuuucucaaaugua

SEQ ID NO: 695357 - RNA, 64 nt, Homo Sapiens
ucaggccuauuuguguaggcccauggaaaucacuacuugugaaguagagaugccuuuuugucua

SEQ ID NO: 695358 - RNA, 64 nt, Homo Sapiens
uaccauccucugggccaacuguggaagcugcugcacuugugaagaauccugagcuuugauuccu

SEQ ID NO: 695359 - RNA, 64 nt, Homo Sapiens
agagauaaccuugcccuaguaucaauggcuuuguacuugugaugucucucuguuacacacuaac

SEQ ID NO: 695360 - RNA, 64 nt, Homo Sapiens
guuuagcuuaagacccaagaucuuuacuuugauaacuugugauuuaagaacugucuuuagauuu

SEQ ID NO: 695361 - RNA, 64 nt, Homo Sapiens
uaagaaauuuguauggugugaccuuacugcaaaaacuugugaugcaugucuucuuaauugcuga

SEQ ID NO: 695362 - RNA, 64 nt, Homo Sapiens
cugguaccuucuuuuuggcugagaucuuucuuuuacuugugauauauucauauuacucguuuau

SEQ ID NO: 695363 - RNA, 64 nt, Homo Sapiens
cuguaaaaugugauuuuuuacuuccacuuauaauacuugugauuggggagguuuguggaaauuc

SEQ ID NO: 695364 - RNA, 64 nt, Homo Sapiens
ucacugcacugcaugcaaacaagaaacgugucacacuugugacgucgggcauucauauaggaag

SEQ ID NO: 695365 - RNA, 64 nt, Homo Sapiens
aaguguauguaacuugcuuuaaauccauuaugcuacuugugaggcagaagaguuuucugugaag

SEQ ID NO: 695366 - RNA, 64 nt, Homo Sapiens
cagcugcccuugaggagcacaggcagaagugugaacuugugaauguaauugaucuuuccuuccu

SEQ ID NO: 695367 - RNA, 64 nt, Homo Sapiens
gaaugagagugaaagggacaaaacucuacaguauacuugugagacacuucaugaagccucugga

SEQ ID NO: 695368 - RNA, 64 nt, Homo Sapiens
auuuagacuuggcauccagcuuucucgcauagugacuugugacacuauggacagaacuacauuc

SEQ ID NO: 695369 - RNA, 60 nt, Homo Sapiens
ucuauagacaauuuuuuuuugaagaaagacacuugugacuaaaucauugaggucuccuga

SEQ ID NO: 695370 - RNA, 64 nt, Homo Sapiens
caggcagugucauggcagccguucuguggaggucacuugugaauuucuuuguuuucauagcugu

SEQ ID NO: 695371 - RNA, 64 nt, Homo Sapiens
uuuuuacugaauuaaucugaauaugcauuauuuuacuugugagucuguauaauauuucccuuaa

SEQ ID NO: 695372 - RNA, 64 nt, Homo Sapiens
uguuggccuucuucccacauggagccagagaucuacuugugacucauuucugcugagcagaguu

SEQ ID NO: 695373 - RNA, 64 nt, Homo Sapiens
uguuggccuucuucccacauggagccagagaucuacuugugacucguuucugcugagcagaguu

SEQ ID NO: 695374 - RNA, 64 nt, Homo Sapiens
cgccugccucggccucccaagucuugaucuccugacuugugaucucauuguguuagccgggaug

SEQ ID NO: 695375 - RNA, 64 nt, Homo Sapiens
gaguuguuucagugcuagaucuuaccagcuaaagacuugugauaccacuauauaguauaguugu

SEQ ID NO: 695376 - RNA, 64 nt, Homo Sapiens
acccugucaucaagguccuguagcuucuuuggagacuugugauaagcgcuucacuccagguugg

SEQ ID NO: 695377 - RNA, 64 nt, Homo Sapiens
uguuugcauguggccauuacacaaaugacaucaaacuugugagguuugguuuaucuucuuuuga

SEQ ID NO: 695378 - RNA, 64 nt, Homo Sapiens
ugagucuuuuucccuaauuuuacaugaugcgguaacuugugacuaagauaggacuuggcuuucu

SEQ ID NO: 695379 - RNA, 64 nt, Homo Sapiens
ucugaucuucaagcaagaaaauaagcaguguuguacuugugaauuuugugauauuuuauguaau

SEQ ID NO: 695380 - RNA, 64 nt, Homo Sapiens
uagugucuaucuuuaucauaaccugaugucccaaacuugugacaaguucuuuuggcaacugaag

SEQ ID NO: 695381 - RNA, 64 nt, Homo Sapiens
aucacaauuauuuuuaaacuuucuauuuucaaauacuugugauuaauaaggcauucuaugauga

SEQ ID NO: 695382 - RNA, 64 nt, Homo Sapiens
ccuuugcugacaagguuuugucuguuucaguuauacuugugaauugugaucuaacugcagaaag

SEQ ID NO: 695383 - RNA, 64 nt, Homo Sapiens
ucaggagacuuuguauuuagaauauucauguaaaacuugugaacaagcuuucauuuugaucaaa

SEQ ID NO: 695384 - RNA, 64 nt, Homo Sapiens
aaaauauuguaccauugaagaguuuggauguguaacuugugaugccuuagaaaaauauccuaag

SEQ ID NO: 695385 - RNA, 64 nt, Homo Sapiens
ugucagucucccucugccaaccuccuagaaggacacuugugauuacauuagggcucaccccuuu

SEQ ID NO: 695386 - RNA, 64 nt, Homo Sapiens
ggcauaucuaugaaaccuuuuguuuuuauuuuaaacuugugauaugacaugcuucucuccugau

SEQ ID NO: 695387 - RNA, 64 nt, Homo Sapiens
aaugcauuuaaagcuauuuuauauaugcugaauuacuugugaaguaaguaaacaugauauaaaa

SEQ ID NO: 695388 - RNA, 64 nt, Homo Sapiens
gaaauuguauuuuauugcuucucauauacaguaaacuugugauauuugacauuucaaaucagug

SEQ ID NO: 695389 - RNA, 64 nt, Homo Sapiens
ucacgcugacccuagccuguuuugcaaccauucuacuugugaaaccauuaaaaaaacauuuuau

SEQ ID NO: 695390 - RNA, 64 nt, Homo Sapiens
acacagccgauucaccugagacucagcuccgugaacuugugagaguauuucauguugcacaccc

SEQ ID NO: 695391 - RNA, 64 nt, Homo Sapiens
uuccccuucaagugcacuuguuaaacugugaugaacuugugauuuuguguuuuacuugaccaaa

SEQ ID NO: 695392 - RNA, 64 nt, Homo Sapiens
aaauuuaaacacuugaaugucaucaugguauccaacuugugacucauagggucugaacucacuc

SEQ ID NO: 695393 - RNA, 64 nt, Homo Sapiens
cugguaagauuuagaccuaaaucgcaucaugccaacuugugacuuugagacuauucaucaagaa

SEQ ID NO: 695394 - RNA, 64 nt, Homo Sapiens
ucagucuugauaucugagcuaucugggcucccuuacuugugaguaagggaucaugcucaccacu

SEQ ID NO: 695395 - RNA, 64 nt, Homo Sapiens
ucuuagaacuccaagauguuccauaaguguuuuuacuugugaggaaugagaagccauccaugga

SEQ ID NO: 695396 - RNA, 64 nt, Homo Sapiens
acgggcucaaagcuggauuagaaaggggagaggcacuugugacuuuguuugacucugugacuca

SEQ ID NO: 695397 - RNA, 64 nt, Homo Sapiens
cuggguagcccagacuuugaggacuuacugcuauacuugugauaggccccuguauccagauauu

SEQ ID NO: 695398 - RNA, 64 nt, Homo Sapiens
aguacucaggugugaggacauggccaguguuuuaacuugugacaggaguccugagguggugauu

SEQ ID NO: 695399 - RNA, 64 nt, Homo Sapiens
ccugauagaacagacuuuacaauacucaguuccaacuugugauucuagaauuuccacuuuggag

SEQ ID NO: 695400 - RNA, 64 nt, Homo Sapiens
aauuugcugcccucuuaagaucaagagcccucugacuugugaagcuucuugucuuuuugugggu

SEQ ID NO: 695401 - RNA, 64 nt, Homo Sapiens
uucugaauauuuucccuucaggagugcuggagugacuugugaauaugaagaguuguauguuuuu

SEQ ID NO: 695402 - RNA, 64 nt, Homo Sapiens
cucuuccucucuuuugcucauccaccuucacaccacuugugagcugacccccaggaacagcuug

SEQ ID NO: 695403 - RNA, 64 nt, Homo Sapiens
cccugcaggaaaacugaggcccuugggcaccucgacuugugaacgaguuguuggcugcucccuc

SEQ ID NO: 695404 - RNA, 64 nt, Homo Sapiens
aauuuuaucccauuuuuaauauuuuggucuagcaacuugugauacauagaugacaauuuuguga

SEQ ID NO: 695405 - RNA, 64 nt, Homo Sapiens
ugugcuaaaccaaguuaagucccauucaguggcaacuugugauagguaccugagugacggcaac

SEQ ID NO: 695406 - RNA, 64 nt, Homo Sapiens
ugcuucgauaaaggaauuuggaguuuaaaaaucaacuugugaaaacaagguuguuuuugucuuu

SEQ ID NO: 695407 - RNA, 64 nt, Homo Sapiens
aagcuuguaagaaagccccuggagaaaaugugacacuugugaaauugaaauccuucccuuuuaa

SEQ ID NO: 695408 - RNA, 64 nt, Homo Sapiens
auggccaucuuuaagcauauguacuuuuuuguuuacuugugaaaucacuuuguuucuuacaugu

SEQ ID NO: 695409 - RNA, 64 nt, Homo Sapiens
guguaccugaggcccccaucuuucucaaaaugggacuugugacgugugucuuuaaaugcugcuu

SEQ ID NO: 695410 - RNA, 64 nt, Homo Sapiens
uauauaauuuauguaucaccuaguauaaaagaaaacuugugauccaauauaauuggguuuuaaa

SEQ ID NO: 695411 - RNA, 64 nt, Homo Sapiens
ccaugaccuguuaaaaccaggucuauuaggagccacuugugacuuucuccuaggaaauggugaa

SEQ ID NO: 695412 - RNA, 64 nt, Homo Sapiens
uaccuugcuagcuagccagcagcaaaggaagcauacuugugaacccaaaaaguuuuuuuaaaaa

SEQ ID NO: 695413 - RNA, 64 nt, Homo Sapiens
uugcaggcugacuugcuaagucugacagugacaaacuugugagcuuacugcagucagucacaga

SEQ ID NO: 695414 - RNA, 64 nt, Homo Sapiens
agaaaaggggagcacaaggccuuaauggacauugacuugugaaaacgcaaacaugaauaugguu

SEQ ID NO: 695415 - RNA, 64 nt, Homo Sapiens
agggagccggagccugccuuguguuccuuuuuugacuugugacauuuuucaaacacauaauuaa

SEQ ID NO: 695416 - RNA, 64 nt, Homo Sapiens
aagguagagguauuugggaaaguagccagugggcacuugugauaucuaaaaucuguuaucccag

SEQ ID NO: 695417 - RNA, 64 nt, Homo Sapiens
cagccuucagauggcagaaguggaagaugagccuacuugugagcgaugugacuuuaaggaaaug

SEQ ID NO: 695418 - RNA, 64 nt, Homo Sapiens
uguguguucuauggaggggcagggaaaagguggcacuugugaguguguguggauuggcaggggg

SEQ ID NO: 695419 - RNA, 64 nt, Homo Sapiens
gugguaaaucaguguaaaagugucauauucucagacuugugaggcgguuuauagucagaaagau

SEQ ID NO: 695420 - RNA, 52 nt, Homo Sapiens
agaaaaacugaagauggaagggacuugugaucgagggaaggcuugggguuga

SEQ ID NO: 695421 - RNA, 64 nt, Homo Sapiens
agaaaaacugaagauggaaggcuugggguugaggacuugugaucaacucaacuugagagggaag

SEQ ID NO: 695422 - RNA, 64 nt, Homo Sapiens
gaucagagaagagucauguugggcauuauggaagacuugugauagacuccagugauucugcacu

SEQ ID NO: 695423 - RNA, 64 nt, Homo Sapiens
caugcucagccuaugucaucgcaccucgagcaacacuugugagcuagcccauguucgaccacau

SEQ ID NO: 695424 - RNA, 64 nt, Homo Sapiens
uuuucuaaaggugcuauuuauuuuguggauggggacuugugaauuuuucuuuuuuuuuuuuuuu

SEQ ID NO: 695425 - RNA, 64 nt, Homo Sapiens
auaauuugagaaagaccuuuccagguauuuuuucacuugugaaaugcuuuguaguaaccccugc

SEQ ID NO: 695426 - RNA, 64 nt, Homo Sapiens
guacuguuuaccauuuuucauucacuucucuuaaacuugugaaugcuucucacuuuuuuuuuuu

SEQ ID NO: 695427 - RNA, 64 nt, Homo Sapiens
uaggguaaaaauauaguuuuugaggguauucccaacuugugaucuucuaccacuuuagagacau

SEQ ID NO: 695428 - RNA, 64 nt, Homo Sapiens
agcuguuuugaaaugucccaguuuuacgacuguuacuugugaaucaguauugguggaugcuucc

SEQ ID NO: 695429 - RNA, 64 nt, Homo Sapiens
cucuaccugccucaagaaggggcucagagcagagacuugugaauuccuuaguaacugugaguau

SEQ ID NO: 695430 - RNA, 64 nt, Homo Sapiens
augaauuguuucuaacaaaccuugaucuguauauacuugugagggguuguuugguugccuaauu

SEQ ID NO: 695431 - RNA, 64 nt, Homo Sapiens
gagcucccagaagccaagaguguuuaaaugugacacuugugagaaggcauuugccaaaccaagc

SEQ ID NO: 695432 - RNA, 64 nt, Homo Sapiens
ugagauuuuuuaagggcuuuuccucuuaucaacaacuugugacaagaagagugcugucauuauu

SEQ ID NO: 695433 - RNA, 64 nt, Homo Sapiens
gcgacgucugcacggcccagacccaggauuccaaacuugugaacucgugacaaucacaaacuug

SEQ ID NO: 695434 - RNA, 64 nt, Homo Sapiens
acccuguaagauaauuggcuuuaaauuacgagagacuugugauaggacaguaaaaccuagaguu

SEQ ID NO: 695435 - RNA, 64 nt, Homo Sapiens
gagacuccuccgucucaaaaaaauaaauaaauaaacuugugagcuggccccaaccccuccuagg

SEQ ID NO: 695436 - RNA, 64 nt, Homo Sapiens
guaaccucuccccuguaccugugccaagccuagcacuugugaugccuccaugccccgagggccc

SEQ ID NO: 695437 - RNA, 64 nt, Homo Sapiens
auauucauuccuucauuacuuuuggaaaauucuuacuugugaauguuaaaaaugaaaaaaaaau

SEQ ID NO: 695438 - RNA, 64 nt, Homo Sapiens
caagggucacugucuucacagaaaaaguuugcugacuugugauugagaccuacugucccauugu

SEQ ID NO: 695439 - RNA, 64 nt, Homo Sapiens
uuuauugccacugcugagaaggcuguccuuccuaacuugugaggagaugaauccuuaauaauaa

SEQ ID NO: 695440 - RNA, 64 nt, Homo Sapiens
auucacacuacagagaaacuacauuuguuaggaaacuugugagcggagagcuuucuguuuuucu

SEQ ID NO: 695441 - RNA, 64 nt, Homo Sapiens
ugagcugagaccucuguccucugcagagguagugacuugugauggguggucagggaagaccucu

SEQ ID NO: 695442 - RNA, 64 nt, Homo Sapiens
augucuaguaagguccacucuguuaccucuucccacuugugacaccucacuccagcaugguguc

SEQ ID NO: 695443 - RNA, 64 nt, Homo Sapiens
cccuugggaaaaaaugggcacauucaagggucugacuugugagagauccuuccugggagccuca

SEQ ID NO: 695444 - RNA, 64 nt, Homo Sapiens
augugaugaacgcucugaacaggcggauacagaaacuugugagaguggggugggggcagaggag

SEQ ID NO: 695445 - RNA, 64 nt, Homo Sapiens
agccugccaauggacccaugaagauccaggaggcacuugugacuucguuuuccgccaggaccca

SEQ ID NO: 695446 - RNA, 64 nt, Homo Sapiens
cugaaagucuagguuuggccagcuagguagacugacuugugagguauuuauuuauucauuugag

SEQ ID NO: 695447 - RNA, 64 nt, Homo Sapiens
cuggguaugguggcacaugccuauagucucagcuacuugugaggcugaggcaggaggauucuuu

SEQ ID NO: 695448 - RNA, 64 nt, Homo Sapiens
agcugccaggcagucaaaaacagaagcuuccccgacuugugagucccugagaugugcucuuguu

SEQ ID NO: 695449 - RNA, 64 nt, Homo Sapiens
ugcugugcugcucgacgugagggugaaaugauugacuugugaccugccagguugcccgaugccc

SEQ ID NO: 695450 - RNA, 64 nt, Homo Sapiens
agcacugacaguaacugccaagaauuguuaacacacuugugaugugucagccacagauucaccc

SEQ ID NO: 695451 - RNA, 64 nt, Homo Sapiens
ugcagaaacauaggcaguagucuuugaccugcugacuugugacuagguucugcuucacacuugu

SEQ ID NO: 695452 - RNA, 64 nt, Homo Sapiens
agcaguuuagcugcaucuguggguuuuuuuuccaacuugugaaaaaagaccaguuuauaggguu

SEQ ID NO: 695453 - RNA, 64 nt, Homo Sapiens
uuuauaauacaaaagggucuugucucuuagaaauacuugugauuaguuaaccuagaaguauuuu

SEQ ID NO: 695454 - RNA, 64 nt, Homo Sapiens
cgucuggacugcuauucuaggacugugaggccauacuugugaaagcaguccaucuagggaaugg

SEQ ID NO: 695455 - RNA, 64 nt, Homo Sapiens
acuuggcaaguuuugcagccugucucaaacagggacuugugaguaauagggaccacaucuuauu

SEQ ID NO: 695456 - RNA, 64 nt, Homo Sapiens
acacuacgggaaucucuguguucuguaaauggguacuugugaucccaccugcaccuugagaugu

SEQ ID NO: 695457 - RNA, 64 nt, Homo Sapiens
acugaaguuugaugaagucuaaaauggugaagugacuugugaagggcaguaaguagguagagca

SEQ ID NO: 695458 - RNA, 64 nt, Homo Sapiens
guugaaugaguguguuuuguacauaacuucagauacuugugaacaugccuuauauuuguccaac

SEQ ID NO: 695459 - RNA, 64 nt, Homo Sapiens
aaugugaaauguuuagggacaucuccaugcugucacuugugauuugcccucuuauguauuuugg

SEQ ID NO: 695460 - RNA, 64 nt, Homo Sapiens
ccgagucacccagcuggucucauacauagacagcacuugugaaggauugaaugcagguuccagg

SEQ ID NO: 695461 - RNA, 64 nt, Homo Sapiens
aagucauggauaugucuaucccaugacacucaugacuugugaugaugagcuacuuuugaauuuu

SEQ ID NO: 695462 - RNA, 64 nt, Homo Sapiens
cuaaaauaagcuucaucucccuaccagagcgugcacuugugauccugacaaagucauccuccgu

SEQ ID NO: 695463 - RNA, 64 nt, Homo Sapiens
agagaaaaucacaugaaggagaccugggguccccacuugugagugcaacugcaaguaacucugg

SEQ ID NO: 695464 - RNA, 64 nt, Homo Sapiens
agauccauguaaggggcuccucuucccaccuggaacuugugaguggggacccaugauguauggg

SEQ ID NO: 695465 - RNA, 64 nt, Homo Sapiens
uuucuaucuaaagagagcuacacuugagaaggggacuugugaacucaaccacaaucuccucgag

SEQ ID NO: 695466 - RNA, 64 nt, Homo Sapiens
guccacguccuaaagacaccucuccuuuacaaagacuugugaugcucuggggcuucuguggcca

SEQ ID NO: 695467 - RNA, 64 nt, Homo Sapiens
uuccucagccuuucuuuuuugccaucacucuaccacuugugagcaaauugaguuaucagaauuc

SEQ ID NO: 695468 - RNA, 64 nt, Homo Sapiens
aaagaagccaucaagucuuaaguuuuucauuucaacuugugaacguuucuucugaugugaagca

SEQ ID NO: 695469 - RNA, 64 nt, Homo Sapiens
uguggaaccaggacuugguauuaagccuuucccaacuugugaauauagaauuugauaauacacu

SEQ ID NO: 695470 - RNA, 64 nt, Homo Sapiens
aaaguaauugguucaggaggugucaauagguugaacuugugagaaggcacugaaucugccaucc

SEQ ID NO: 695471 - RNA, 64 nt, Homo Sapiens
uacuagggagguucuuaaauccucauaucuggaaacuugugacguuuugacaccuuuccuauag

SEQ ID NO: 695472 - RNA, 64 nt, Homo Sapiens
uauuaauuuucuagcuaugguauuacuauaucacacuugugaguauguauucaaauacuaagua

SEQ ID NO: 695473 - RNA, 64 nt, Homo Sapiens
aaaaguacauuuguauauuacauauauggacauaacuugugaaggaugaaagaaaguacagccu

SEQ ID NO: 695474 - RNA, 64 nt, Homo Sapiens
agggggugagguggaauggggugggggaacauggacuugugacuaacgaagcugguugcugcug

SEQ ID NO: 695475 - RNA, 64 nt, Homo Sapiens
cuguuaugucuugaacuuuuccucaaagcauuacacuugugaauguauuuuugucuaauagggu

SEQ ID NO: 695476 - RNA, 64 nt, Homo Sapiens
uuaaaugcauuaggggagcugccauuuagaggaaacuugugaauucuuucauaaagcagaaaac

SEQ ID NO: 695477 - RNA, 64 nt, Homo Sapiens
aagcccacacuacccaaaacaaagaaugggaagcacuugugauaaagacaggcuccugagaaau

SEQ ID NO: 695478 - RNA, 64 nt, Homo Sapiens
aaucugauauauuggacuucuucaaaauuuaaaaacuugugauuuaagaagaggaaaagauaag

SEQ ID NO: 695479 - RNA, 64 nt, Homo Sapiens
caguguacuggagaggggaggcaaguugcuagguacuugugagguauuccccccuccuagcccu

SEQ ID NO: 695480 - RNA, 64 nt, Homo Sapiens
uuugcuuuaauuccaugaauuuucuaagucaaacacuugugacuaauuuacuacaauauguaca

SEQ ID NO: 695481 - RNA, 64 nt, Homo Sapiens
auauuugaauguauguuguuuuaguacuaucaagacuugugaauguauuuuuucacuuguugcc

SEQ ID NO: 695482 - RNA, 64 nt, Homo Sapiens
uuccauaugauaauucuuuagaaagguuuuagagacuugugagguccuaugagggauaauugca

SEQ ID NO: 695483 - RNA, 64 nt, Homo Sapiens
uacuagggagguucuuaaauccucauaucuggaaacuugugaaguuuugacaccuuuccuauag

SEQ ID NO: 695484 - RNA, 64 nt, Homo Sapiens; identical to SEQ ID NO: 695472

SEQ ID NO: 695485 - RNA, 59 nt, Homo Sapiens
gguggaggugcccguuccuggaccucagcgagccugagccgggcccggccgcacgcuga

SEQ ID NO: 695486 - RNA, 59 nt, Homo Sapiens
ccaagcacauugguccuaaaggggcugaagagccugaacugcaccuaacgggaaagaac

SEQ ID NO: 695487 - RNA, 59 nt, Homo Sapiens
ggcacaugccuguaauuccagcugcuugggagccugaggcaggagaacugcuugaaccc

SEQ ID NO: 695488 - RNA, 59 nt, Homo Sapiens
aaucaacagcauauugacacguuggagccgagccugaacaugccccucggccccagcac

SEQ ID NO: 695489 - RNA, 59 nt, Homo Sapiens
uggugggcgaggguggcgcaugggaggccgagccugaauccuugccugugucugacggg

SEQ ID NO: 695490 - RNA, 59 nt, Homo Sapiens
gcuguuuacauuguuuacuuacaaguaaggagccugaaauaaccuguaguuucgaaugc

SEQ ID NO: 695491 - RNA, 59 nt, Homo Sapiens
uugagcaggaguugguaaauaaacuaauggagccugaaagacucaaugaaauuguggaa

SEQ ID NO: 695492 - RNA, 59 nt, Homo Sapiens
uccuguuuuuccuaugcucugggugaauagagccugaugguauacuacugcuuugcgga

SEQ ID NO: 695493 - RNA, 59 nt, Homo Sapiens
gaagaaacaguucccuguugaagaaaguagagccugacacugcucccacuuuggagacc

SEQ ID NO: 695494 - RNA, 59 nt, Homo Sapiens
uguacuggguaugaguggaaggugauggagagccugauccugaagccucuacuugauga

SEQ ID NO: 695495 - RNA, 59 nt, Homo Sapiens
cugcucauuguuguuugggcucagguauugagccugauggcccagguauugagggccuc

SEQ ID NO: 695496 - RNA, 59 nt, Homo Sapiens
gacaggcauggaccugucuccagagagaggagccugaaguucguggggcgggacagcgu

SEQ ID NO: 695497 - RNA, 59 nt, Homo Sapiens
aaucuuaggcuaccacauucuauuauugagagccugagauguuagccauaguggacaag

SEQ ID NO: 695498 - RNA, 59 nt, Homo Sapiens
uuaaguacuaguagccuguuauugacugggagccugacugauguauuauauauauugua

SEQ ID NO: 695499 - RNA, 59 nt, Homo Sapiens
accaggcacaccucagucuucuugacccagagccugaaaacuguuuucacuggguucca

SEQ ID NO: 695500 - RNA, 59 nt, Homo Sapiens
aagguuaacaggcuguaguucugcagggagagccugaaguccugguaugggcucuugau

SEQ ID NO: 695501 - RNA, 59 nt, Homo Sapiens
aucacaaaagguucuucuggugagugcaagagccugagacuggaaaagguggacuuguc

SEQ ID NO: 695502 - RNA, 59 nt, Homo Sapiens
gagagacugugcugggaacauguaccacugagccugagauggggaugagggcagagaga

SEQ ID NO: 695503 - RNA, 59 nt, Homo Sapiens
uugaggcuauaaaaauguccuugaguuuggagccugagcucuggugaaaugcugauaca

SEQ ID NO: 695504 - RNA, 59 nt, Homo Sapiens
gcugcuucuguugugagcgaaucagccaagagccugaggcugaagggaaaaguacacag

SEQ ID NO: 695505 - RNA, 59 nt, Homo Sapiens
gggcagaagaucugggaucaauuaagauggagccugaaggacuauggaaucuugcuugu

SEQ ID NO: 695506 - RNA, 59 nt, Homo Sapiens
agaaccagcgccccgaugccugaggcugggagccugagccccuucagcuuugagggggg

SEQ ID NO: 695507 - RNA, 59 nt, Homo Sapiens
auggagagacagagggggcgcgcgcacaggagccugacuccgcugggagagugcaggag

SEQ ID NO: 695508 - RNA, 59 nt, Homo Sapiens
uucugucuuucacggugggcgcucggggggagccugaggaaaacccccuuagguaccug

SEQ ID NO: 695509 - RNA, 59 nt, Homo Sapiens
cagaggccgucgggaacgccguaccuugagagccugaauccauuaccuggaagguuucu

SEQ ID NO: 695510 - RNA, 59 nt, Homo Sapiens
gggugcugguugcugugucucccuggucagagccugaguggggucuugucuaccaccuc

SEQ ID NO: 695511 - RNA, 59 nt, Homo Sapiens
ugguggagggaaagggagacacccagucggagccugacaucuguugccuaccuggccug

SEQ ID NO: 695512 - RNA, 59 nt, Homo Sapiens
ggugugaggugacaggucucccuuccuuagagccugaguguuacccaggguccucaugu

SEQ ID NO: 695513 - RNA, 59 nt, Homo Sapiens
gaaucugaaggcacuggaaugacccccaggagccugaagauaggguggcuggcagaggg

SEQ ID NO: 695514 - RNA, 59 nt, Homo Sapiens
aggcuccacauuaggucaccucugcaguggagccugaaagcuucccguucagcgucaca

SEQ ID NO: 695515 - RNA, 50 nt, Homo Sapiens
auuccagguaagaaaauauagagccugaauaucuuggcucacguauuuaa

SEQ ID NO: 695516 - RNA, 59 nt, Homo Sapiens
ggugccuaguugacuuacuguaagucauggagccugaagccuucuucccaauagaagaa

SEQ ID NO: 695517 - RNA, 59 nt, Homo Sapiens
gggccaggucccagugcuggaaguugacugagccugaaagucugaauccuagagacaga

SEQ ID NO: 695518 - RNA, 59 nt, Homo Sapiens
ucuugcaggacucacuggaugagguaguagagccugaagggcucagcagggagcugcug

SEQ ID NO: 695519 - RNA, 59 nt, Homo Sapiens
ucuugcaggacucacuggaugcugagaaagagccugaagggcucagcagggagcugcug

SEQ ID NO: 695520 - RNA, 54 nt, Homo Sapiens; identical to SEQ ID NO: 128889

SEQ ID NO: 695521 - RNA, 59 nt, Homo Sapiens
cugccauucuaacauguuccgucugcguagagccugagauacagauacugauucagugg

SEQ ID NO: 695522 - RNA, 59 nt, Homo Sapiens
cucagucuccauucucccucgcugcccuggagccugaccaacaucugcucuugguuucu

SEQ ID NO: 695523 - RNA, 59 nt, Homo Sapiens
accugcccugcugagucccagcuggccgggagccugauccccgucccccucuggcucca

SEQ ID NO: 695524 - RNA, 59 nt, Homo Sapiens
caaugggacaguuacacuuggcugcagcugagccugagcagcuaguaagauuacccuga

SEQ ID NO: 695525 - RNA, 59 nt, Homo Sapiens
gguaccaaaagaguauugauuaugaccuggagccugagcuuugggagaauauacaaagg

SEQ ID NO: 695526 - RNA, 59 nt, Homo Sapiens
agaaauaccuccucccgcugacugccccagagccugaaagucucacccuuggagcccac

SEQ ID NO: 695527 - RNA, 59 nt, Homo Sapiens
cccugagccccuugcgauaucaccaccaagagccugauaacugagcaggguggauccug

SEQ ID NO: 695528 - RNA, 59 nt, Homo Sapiens
uagacuuggacaucucucuggcuucugaagagccugaagcuggccuggaccauuccugu

SEQ ID NO: 695529 - RNA, 58 nt, Homo Sapiens
aaggccccaccuuacucugaaagcuggggagccugaacauucacuccuuguccuccau

SEQ ID NO: 695530 - RNA, 59 nt, Homo Sapiens
ccacacccccuucuuaaaacuggggacaugagccugagcagaaagggugaagaagagcc

SEQ ID NO: 695531 - RNA, 59 nt, Homo Sapiens
acuaaugaagauacgguugcuucaccuuggagccugaacaugacauuucuaaguggggu

SEQ ID NO: 695532 - RNA, 59 nt, Homo Sapiens
gagaucugggaggucuccacugaggaugugagccugauuauccuauaggcagacguggg

SEQ ID NO: 695533 - RNA, 59 nt, Homo Sapiens
guggcccagaguugcucagaauuggagcagagccugagacguaucugcagauccuguca

SEQ ID NO: 695534 - RNA, 59 nt, Homo Sapiens
ggaaccugguacauccagucacuuugccagagccugagagagcgauguccucgguaagu

SEQ ID NO: 695535 - RNA, 59 nt, Homo Sapiens
gagcuugaagagugaaaacuguugugaaugagccugaucauaaaacggaccaggccauu

SEQ ID NO: 695536 - RNA, 59 nt, Homo Sapiens
ccaccgcccaccaccccuccugcuuccccgagccugacccuguuccgcccacuggcaau

SEQ ID NO: 695537 - RNA, 59 nt, Homo Sapiens
aggagaggggcucgaugggcugggggaaggagccugaagguugccccugguugcauccc

SEQ ID NO: 695538 - RNA, 59 nt, Homo Sapiens
ccaugcaguugauggugagcuggcuccaggagccugagguggagcaggagaguagcuca

SEQ ID NO: 695539 - RNA, 59 nt, Homo Sapiens
agcccagcguccacucuucauccccuggggagccugaggggcuuggacucuuucccauc

SEQ ID NO: 695540 - RNA, 59 nt, Homo Sapiens
ucuguuucaaauuucuccccugaaucugugagccugaggcagguugcugcaagcucagc

SEQ ID NO: 695541 - RNA, 59 nt, Homo Sapiens
uaggaauguguacauuguagaggagaguugagccugaauaggcauuuacuuuuggguaa

SEQ ID NO: 695542 - RNA, 59 nt, Homo Sapiens
cucucugauagcugugccauauuaccagagagccugaugacauuaaaaguuacauaaau

SEQ ID NO: 695543 - RNA, 59 nt, Homo Sapiens
gcucuuggguccuucuagggcacugggaagagccugaagaugaggaaaaguuuggagga

SEQ ID NO: 695544 - RNA, 59 nt, Homo Sapiens
gcccccaugcucggcuuccucacauucaggagccugacuuggaucagacuuggggcugc

SEQ ID NO: 695545 - RNA, 59 nt, Homo Sapiens
aucuuugggaaauuuucuacccugcucuugagccugauaacccaugccaggucuuauag

SEQ ID NO: 695546 - RNA, 59 nt, Homo Sapiens
uacgucaacuugguugcucugauaccccagagccugauugggggccucccggcccuggc

SEQ ID NO: 695547 - RNA, 59 nt, Homo Sapiens
gcccacccuacagaaaguggaacagcccggagccugaugugaaaggaccacggguguug

SEQ ID NO: 695548 - RNA, 59 nt, Homo Sapiens
aaaaauuaauaagacccagcuugaaaauugagccugauaacaagauuacaaauucacaa

SEQ ID NO: 695549 - RNA, 59 nt, Homo Sapiens
cccaggaguccagcaaucauuggggaagagagccugaggcuggcaauccuugcccagaa

SEQ ID NO: 695550 - RNA, 59 nt, Homo Sapiens
cucugcccaaacauaaagagaacucuggggagccugagccacaaaaauguuccuuuauu

SEQ ID NO: 695551 - RNA, 59 nt, Homo Sapiens
gacuugaguuucuuauucuagaacacuuggagccugaacucugaccaggccccucacuu

SEQ ID NO: 695552 - RNA, 59 nt, Homo Sapiens
aacuaauucuuuaaaaaaaaaaaaaaguugagccugaauuaaauguaauguuuccaagu

SEQ ID NO: 695553 - RNA, 59 nt, Homo Sapiens
uccagaauuuuucaucaagaagguagcuugagccugaaaugcaaaacccauggaggaau

SEQ ID NO: 695554 - RNA, 59 nt, Homo Sapiens
guucugcuccauaaaauaggcaccucauugagccugacuugacuuaggguuugucacuc

SEQ ID NO: 695555 - RNA, 59 nt, Homo Sapiens
uuauacaggaguuagguggggguagggaugagccugaggagauggggaaaccgagggcu

SEQ ID NO: 695556 - RNA, 59 nt, Homo Sapiens
ucgaagcccugcugucucaaauugacaucgagccugacaacagccgccgcuuccagacc

SEQ ID NO: 695557 - RNA, 59 nt, Homo Sapiens
caaaugguuuuucugcuuuaugaagagcugagccugauuuauaaacuuuacuuuccaga

SEQ ID NO: 695558 - RNA, 59 nt, Homo Sapiens
uccuacugacuuccaauuuacuuaauuuggagccugauucauuaaaguuaguggcaaaa

SEQ ID NO: 695559 - RNA, 59 nt, Homo Sapiens
gcuucugcuuaaucugagaauacugcccugagccugaaccuggcgagucugcuuucuuc

SEQ ID NO: 695560 - RNA, 59 nt, Homo Sapiens
acaagguuuaaugaggaagcuuuuaacaggagccugagcucuucucaccauuuuaccuc

SEQ ID NO: 695561 - RNA, 59 nt, Homo Sapiens
ggggccccucgacaucaccgucauugauggagccugaaccgugugcuccucggcagaug

SEQ ID NO: 695562 - RNA, 59 nt, Homo Sapiens
cagggagugucugcaguccugguggggcugagccugaggccuuccagaaagcaggagca

SEQ ID NO: 695563 - RNA, 59 nt, Homo Sapiens
uguugggaauugcaugccaucuccacccugagccugaccuuucugagugacaugggugu

SEQ ID NO: 695564 - RNA, 59 nt, Homo Sapiens
gugggggaggucccugccaguguuuagaagagccugacuguguucagugccuuggagca

SEQ ID NO: 695565 - RNA, 59 nt, Homo Sapiens
aaguuucaaagaagauaaaaaugcuugaagagccugagaguaaaaagauuaugcugcaa

SEQ ID NO: 695566 - RNA, 59 nt, Homo Sapiens
uccuucuuuaccccgcugagacagugggagagccugaagcagaauccugguauucacca

SEQ ID NO: 695567 - RNA, 59 nt, Homo Sapiens
aacuggaaacccccauuucugcgcaaucugagccugagccuaauaugcuuccugccauu

SEQ ID NO: 695568 - RNA, 56 nt, Homo Sapiens
ggcaggcucuguuaccucucuggggagagccugaaaagaggcccgacgaaugguga

SEQ ID NO: 695569 - RNA, 59 nt, Homo Sapiens
ugaaauauuuuuagcuuaguagagccacugagccugaguuucuuuugauaccuuugaga

SEQ ID NO: 695570 - RNA, 59 nt, Homo Sapiens
agagacaugacucagccuguagaugguuugagccugagcgcugccuguaacuugagagu

SEQ ID NO: 695571 - RNA, 59 nt, Homo Sapiens
ugugaauugcuugguuguaauuaaauucugagccugauauugauaugguuuuaagaagc

SEQ ID NO: 695572 - RNA, 59 nt, Homo Sapiens
gaaagguagaaggguuuauuuuauuaaaugagccugacuuagugacagugugugagcau

SEQ ID NO: 695573 - RNA, 59 nt, Homo Sapiens
guaaggcaccccacagaaauuaacuuggagagccugagaaauucccaguggccuuggca

SEQ ID NO: 695574 - RNA, 59 nt, Homo Sapiens
gggccauucccaaauuugggccugggccugagccugaccccacgccggggccuccaccg

SEQ ID NO: 695575 - RNA, 59 nt, Homo Sapiens
uuguaagcaacuugcuucuacagcccacagagccugaauccauuggcugcgcuaacccc

SEQ ID NO: 695576 - RNA, 59 nt, Homo Sapiens
uccugccuuucauuggcugagagcuggaggagccugagguuucccugccagaggaaacu

SEQ ID NO: 695577 - RNA, 59 nt, Homo Sapiens
gacugugcuggcucaacuuccccggggcagagccugauuugaucugccggcucucaguc

SEQ ID NO: 695578 - RNA, 59 nt, Homo Sapiens
cuccugacugaggaacaugggcucuccgggagccugaacaagugauggaacccucaggu

SEQ ID NO: 695579 - RNA, 59 nt, Homo Sapiens
gaggccagugcccacuugcccaccgaccugagccugaguaaguggcugucaccugagcc

SEQ ID NO: 695580 - RNA, 59 nt, Homo Sapiens
gcagccugagguguguccugggcuccucagagccugaagcaagcuuuuggaagccugca

SEQ ID NO: 695581 - RNA, 59 nt, Homo Sapiens
agggcauuugaaagacugccagguagugcgagccugagauggucuggaggauucucucu

SEQ ID NO: 695582 - RNA, 59 nt, Homo Sapiens
caccuggccaagaagagacaucuugacuugagccugaagacuauguacagagacugacc

SEQ ID NO: 695583 - RNA, 59 nt, Homo Sapiens
cucucccuccucucagagcccucccucgagagccugagugcaccaugucuuguggccuc

SEQ ID NO: 695584 - RNA, 59 nt, Homo Sapiens
cucuagaggcugagacgggagcaucucuugagccugagaaguggagauugcaauugagc

SEQ ID NO: 695585 - RNA, 59 nt, Homo Sapiens
ugugucaguccucugguuauaguauauaagagccugaggaggucuggcaagauagaugg

SEQ ID NO: 695586 - RNA, 59 nt, Homo Sapiens
aggcauuugacuccuacagcagaaguucugagccugaccacagaugguguguaaucuau

SEQ ID NO: 695587 - RNA, 59 nt, Homo Sapiens
uagugaugaguagucugggccucucucuggagccugaaguaagguccucacugaagcuu

SEQ ID NO: 695588 - RNA, 59 nt, Homo Sapiens
aaaacaaaauuugaaauuaaagucaucaugagccugaccaagaauuagguaaauuaaca

SEQ ID NO: 695589 - RNA, 59 nt, Homo Sapiens
ugaugccuucacugguugauuccagaacggagccugaugcucuguuguuagccuguaga

SEQ ID NO: 695590 - RNA, 59 nt, Homo Sapiens
ucaugauucauccucucuucagugagacugagccugauguguuaacaaauaggugaaga

SEQ ID NO: 695591 - RNA, 59 nt, Homo Sapiens
uguauuugagacuaggauagcuucaucuugagccugagccuuagaaucuguagaggagc

SEQ ID NO: 695592 - RNA, 59 nt, Homo Sapiens
aaggagcugaguuuggcaacaacccaagugagccugaagcagauucgccccagagccuc

SEQ ID NO: 695593 - RNA, 59 nt, Homo Sapiens
gcucacaguccuguauuuggcagguuugggagccugaggggccaucucccugacacuca

SEQ ID NO: 695594 - RNA, 59 nt, Homo Sapiens
uugccaggaauguuucagcugcaguugaagagccugacaagugaaguuguaaacacagu

SEQ ID NO: 695595 - RNA, 59 nt, Homo Sapiens
aaccagaccuaucaggaacgcaccuuccagagccugaugaauagcaacagcaauuuccg

SEQ ID NO: 695596 - RNA, 59 nt, Homo Sapiens
gugagguggaauuauuuuaaaccuuccaagagccugagagagcuuggaagcuucuggug

SEQ ID NO: 695597 - RNA, 59 nt, Homo Sapiens
acuucacugggagccuucugcuguguacggagccugaugauaggccucccccacggugc

SEQ ID NO: 695598 - RNA, 59 nt, Homo Sapiens
ggucaagugcugucuaccauccucaucuggagccugaaggccuccagugacaccacugu

SEQ ID NO: 695599 - RNA, 50 nt, Homo Sapiens
uucuuccuccaagaauuugagagccugauaaugacauugaaauuguuuaa

SEQ ID NO: 695600 - RNA, 59 nt, Homo Sapiens
cugagcucuugaaguagucaaugccuggagagccugacucuuagugggagaguaacaga

SEQ ID NO: 695601 - RNA, 59 nt, Homo Sapiens
uuggggggaagugggaggccuuggaaccugagccugacauucuuuuauaaaauuaucuu

SEQ ID NO: 695602 - RNA, 59 nt, Homo Sapiens
gacaccacuauuaaaaaaaauaggagugggagccugacauccacauuaauuaacauguc

SEQ ID NO: 695603 - RNA, 59 nt, Homo Sapiens
acugcacgggggagcagccccucgaucacgagccugagacugagugcugcaccugccuu

SEQ ID NO: 695604 - RNA, 59 nt, Homo Sapiens
cucagccccaggccagcugcggagccgcagagccugacgaggucaccugccgcccugug

SEQ ID NO: 695605 - RNA, 59 nt, Homo Sapiens
acacauugguccggggaccccucagugcagagccugaaguuggggguuuagggguggaa

SEQ ID NO: 695606 - RNA, 59 nt, Homo Sapiens
acccuuaauuccuauuucuggguguuugcgagccugauugcuaucaugaaguaaaaauu

SEQ ID NO: 695607 - RNA, 59 nt, Homo Sapiens
uuucuacugccugguagagcugccaucuugagccugaaauauaagaaauggucugguuu

SEQ ID NO: 695608 - RNA, 59 nt, Homo Sapiens
uuuggagcagacuguuuuaaguugcucaggagccugauggaaccaugaaccgagacucu

SEQ ID NO: 695609 - RNA, 59 nt, Homo Sapiens
gguggaggaguucugaucccugacugcuggagccugagaagagaacggagcugggaaug

SEQ ID NO: 695610 - RNA, 59 nt, Homo Sapiens
gagacggcgauuuucgggcuaaccacagugagccugagaccuuugugucagaaaaagga

SEQ ID NO: 695611 - RNA, 59 nt, Homo Sapiens
gcgcagcuccugaggacuucguacguacagagccugacaaccaauagaaacauuuagca

SEQ ID NO: 695612 - RNA, 59 nt, Homo Sapiens
cuauggaaaugcugcuaaaacuaauguuggagccugaaagcgggagggaggaaguacga

SEQ ID NO: 695613 - RNA, 59 nt, Homo Sapiens
auaauacgaagaccagcuucugacccacugagccugaucaaauaaaaauggauaggugg

SEQ ID NO: 695614 - RNA, 59 nt, Homo Sapiens
cagaagaauugcuugaagcugcuacuugggagccugaggggcaggcgccuguaaugccu

SEQ ID NO: 695615 - RNA, 59 nt, Homo Sapiens
ugucuucccaguguugguuugaacccugugagccugagacagagagggccaggcaccaa

SEQ ID NO: 695616 - RNA, 59 nt, Homo Sapiens
ucaaugugccgaucaguggagucaguaucgagccugaccaccgcaagccaggaagcagg

SEQ ID NO: 695617 - RNA, 59 nt, Homo Sapiens
acccuggaugcccagcaaggccacagaaagagccugauguccaugauccagguggcucu

SEQ ID NO: 695618 - RNA, 59 nt, Homo Sapiens
acuccuguugacccuggaucccacccuuugagccugaccccacugcagccucugcccag

SEQ ID NO: 695619 - RNA, 59 nt, Homo Sapiens
ccaaguugaacacccaagacagcugugaggagccugaucauagcaacaucaguuauggg

SEQ ID NO: 695620 - RNA, 59 nt, Homo Sapiens
ugcugcugugguguggcccagauucugcagagccugagccaggaagcacuggacacagu

SEQ ID NO: 695621 - RNA, 59 nt, Homo Sapiens
cuuggaggugccagaggcccucugugacagagccugagagcggaccagaccugcccugc

SEQ ID NO: 695622 - RNA, 59 nt, Homo Sapiens
uuuuaugggccuguguauccgguuauggggagccugagggagugagauggcugagugag

SEQ ID NO: 695623 - RNA, 59 nt, Homo Sapiens
cugugaucacuccaguggugagccagguagagccugaaggauccuucaugagaaaagcc

SEQ ID NO: 695624 - RNA, 59 nt, Homo Sapiens
gugagugcaacaaaggccucgagaagccagagccugagcccuugagaguaggugacacg

SEQ ID NO: 695625 - RNA, 59 nt, Homo Sapiens
gaaaucagugguguggggcagaggcccuggagccugauaacagcccuucuccuccaugg

SEQ ID NO: 695626 - RNA, 59 nt, Homo Sapiens
uuccagaugucucaugcugcauagggcaggagccugaaaagcuaauuugagaagauaau

SEQ ID NO: 695627 - RNA, 59 nt, Homo Sapiens
cuagucagagauugggagaaauacaagaugagccugaaucaucucauguaccugacagu

SEQ ID NO: 695628 - RNA, 59 nt, Homo Sapiens
uucuccaggccugggcuacgggggagggagagccugaggcucugcucagggcccauuuc

SEQ ID NO: 695629 - RNA, 59 nt, Homo Sapiens
ggagguggugaccucauucagucgguuaagagccugagcccugugaaguuaaacaccug

SEQ ID NO: 695630 - RNA, 59 nt, Homo Sapiens
ugguccagagccucccuccagugacuguggagccugagaaggcccccgggccccagcau

SEQ ID NO: 695631 - RNA, 59 nt, Homo Sapiens
gaaggccgugcagagcuggucacugaaaugagccugauaggauaggcuggagcauaaaa

SEQ ID NO: 695632 - RNA, 59 nt, Homo Sapiens
guuuuauaaaucccucaaacgauugcugagagccugauuguggaaagaagugagaugca

SEQ ID NO: 695633 - RNA, 59 nt, Homo Sapiens
uuuauguguuuuuaaacacuuuuuuaaaugagccugacaccuguguuucagcauuugga

SEQ ID NO: 695634 - RNA, 59 nt, Homo Sapiens
uugcccucccugaaugcaucgaugucagcgagccugacacuguccugggagcuggagag

SEQ ID NO: 695635 - RNA, 59 nt, Homo Sapiens
ugcccaaggcgaugcccuuugaacagagugagccugagccucccaccgcagacagugug

SEQ ID NO: 695636 - RNA, 59 nt, Homo Sapiens
accuuucguuuuucggcucaaguugcugggagccugagcuaauaacucuuucuucacag

SEQ ID NO: 695637 - RNA, 59 nt, Homo Sapiens
aacugccccaaugccacggucuccguagagagccugaaaccuuacuggcccacuucucu

SEQ ID NO: 695638 - RNA, 59 nt, Homo Sapiens
ccgggcgugguggcucacgcucucugaaagagccugaggugugcaagcacucacugugc

SEQ ID NO: 695639 - RNA, 59 nt, Homo Sapiens
uuagaaguauuuuuuucaaaauauguuaagagccugagcuuauuuugugcauuauauuu

SEQ ID NO: 695640 - RNA, 59 nt, Homo Sapiens
acauugggaaaggcugggcccuccuggaagagccugaagccaggucccaauucccaaag

SEQ ID NO: 695641 - RNA, 59 nt, Homo Sapiens
gaucuuuacuaguuauaaaggaaaaaauagagccugaggcaauccagcuauguuauauu

SEQ ID NO: 695642 - RNA, 59 nt, Homo Sapiens
cccuugguaaccucguggagacuuccuuugagccugaggagauuugugauccaggccuc

SEQ ID NO: 695643 - RNA, 59 nt, Homo Sapiens
gcuucaagcccaagaaugcaucaaucauugagccugaagagccuuagagagcucccauc

SEQ ID NO: 695644 - RNA, 59 nt, Homo Sapiens
ggaaucaggcaaggaaaugaauaaaaauggagccugaaggagugggcuuuaaccaggag

SEQ ID NO: 695645 - RNA, 59 nt, Homo Sapiens
cgguggugguggauagcaucacaagaaacgagccugaaaaucagguccagccgguccaa

SEQ ID NO: 695646 - RNA, 59 nt, Homo Sapiens
aggcagccuggagucagccauggcucucugagccugaggauggaaaugggagaugggag

SEQ ID NO: 695647 - RNA, 59 nt, Homo Sapiens
cccuuuucugccagacuacauuuuguggggagccugaggacucuggauucuuugagggg

SEQ ID NO: 695648 - RNA, 59 nt, Homo Sapiens
gugccugcccugcucuggagaccaguguggagccugaggggagcagggcgggcauuggg

SEQ ID NO: 695649 - RNA, 59 nt, Homo Sapiens
augcccugucagccaauggcccaaugacagagccugaaaggcuggggugugcucccuga

SEQ ID NO: 695650 - RNA, 59 nt, Homo Sapiens
ccuggggagaaggcccagccugccuugcagagccugaaguucucaguagcagaguccag

SEQ ID NO: 695651 - RNA, 59 nt, Homo Sapiens
aaauacccagucaguccucccaggcccaggagccugagggagcuggagugaggaucaaa

SEQ ID NO: 695652 - RNA, 59 nt, Homo Sapiens
uagugguucuuggaaaaaugucaaguugggagccugaaaccauuuuggguuaggagaag

SEQ ID NO: 695653 - RNA, 59 nt, Homo Sapiens
ucuuccuguuuuguacauaggggugacaagagccugaucaucugcagaggguuaggagu

SEQ ID NO: 695654 - RNA, 59 nt, Homo Sapiens
uacagagaagagugaggacuucagugggggagccugaggaagccgggagacacucuagg

SEQ ID NO: 695655 - RNA, 59 nt, Homo Sapiens
agaauaaaaaacaaaaccaaugauuucuggagccugaaaaugagaagaaaucuucaggg

SEQ ID NO: 695656 - RNA, 59 nt, Homo Sapiens
cagggcccagaggcugaguuggguugcuggagccugagugaccuuccucuggggcucua

SEQ ID NO: 695657 - RNA, 59 nt, Homo Sapiens
gauucugucuuuacugggguggaagggacgagccugaagaggacagccccuuagguuug

SEQ ID NO: 695658 - RNA, 59 nt, Homo Sapiens
acugccuuuaacugaauuugagcuugaaagagccugaggcacacuugccaucuagggcu

SEQ ID NO: 695659 - RNA, 59 nt, Homo Sapiens
cucuggaugcccgggauggcaaugagguggagccugaugaugaccacuucuccauugug

SEQ ID NO: 695660 - RNA, 59 nt, Homo Sapiens
cacgucagcuaccuggauauugaggagcugagccugaguggacucugccagugccuggu

SEQ ID NO: 695661 - RNA, 59 nt, Homo Sapiens
ccaguaaauacaugcuuaacaaaaggaaugagccugaaguucauaaagaauacauauca

SEQ ID NO: 695662 - RNA, 59 nt, Homo Sapiens
uuucaugcaggagcggggcaaguaagguugagccugacuguaaaccuagaacugcggaa

SEQ ID NO: 695663 - RNA, 59 nt, Homo Sapiens
ggacaauacccuguuggaagcaauguggagagccugauguuggaacgcacacugccguc

SEQ ID NO: 695664 - RNA, 59 nt, Homo Sapiens
gaaugaguguaggaaggaagaaaaagaaagagccugacauugaagagggggcagugugu

SEQ ID NO: 695665 - RNA, 59 nt, Homo Sapiens
gggugguuugcgaggaugagugggcucaagagccugagugcgcggagagaggugcgccg

SEQ ID NO: 695666 - RNA, 59 nt, Homo Sapiens
cugagggguuccgccuccucgagggcucagagccugacucaacugaaucaagugaggaa

SEQ ID NO: 695667 - RNA, 59 nt, Homo Sapiens
uugugugauuaucucaaaucuuacauaccgagccugagauucagccacuucugacauuu

SEQ ID NO: 695668 - RNA, 59 nt, Homo Sapiens
agauuuguauuuaauacacacuaaacucugagccugaaagcauuucaccccugaagucu

SEQ ID NO: 695669 - RNA, 59 nt, Homo Sapiens
cuucuguacgugucugacacugguauaacgagccugagcagcuggauuggcuggggaua

SEQ ID NO: 695670 - RNA, 59 nt, Homo Sapiens
ccaagaggcugcugaacuggacagacugggagccugaucaugcaaugagcauccuugga

SEQ ID NO: 695671 - RNA, 59 nt, Homo Sapiens
agcgucaggucccacuucuggcaagagcagagccugagacugaagcaugugguacagag

SEQ ID NO: 695672 - RNA, 59 nt, Homo Sapiens
agguguacgaggggaucaccgggcagauggagccugaucaggcggccagcgugugcaug

SEQ ID NO: 695673 - RNA, 59 nt, Homo Sapiens
ggcaccuuggcuuccgccuggacccuacagagccugaggugcccgggcccuuccuccaa

SEQ ID NO: 695674 - RNA, 59 nt, Homo Sapiens
cuuugauauguauguaauacgauuuuggagagccugaaacaguucauuuggccauuuug

SEQ ID NO: 695675 - RNA, 59 nt, Homo Sapiens
acauuuucagagccaaauuacugaaccuggagccugaaucugcuuggaaagucucucuu

SEQ ID NO: 695676 - RNA, 59 nt, Homo Sapiens
ugagaguccguacucggcuuagggccucagagccugaccguugcugaccagcuggagug

SEQ ID NO: 695677 - RNA, 59 nt, Homo Sapiens
uuuuaaugaagugcaauacuguuaaguuugagccugaaaaauuucauuuaaacuucuag

SEQ ID NO: 695678 - RNA, 59 nt, Homo Sapiens
caaacccgugacucagacuugacaaugccgagccugagauggaccacauccuaaccuga

SEQ ID NO: 695679 - RNA, 59 nt, Homo Sapiens
ucaccuaccccagggaacuuccaaggaaggagccugagccacuggggacuaagugggca

SEQ ID NO: 695680 - RNA, 59 nt, Homo Sapiens
ggagaggcccgggucagagcccugggggugagccugaaggccacagagaaagaaccuug

SEQ ID NO: 695681 - RNA, 59 nt, Homo Sapiens
cggcugcguagcuguggucccaggcccaggagccugagggggugucuaggugaucauuu

SEQ ID NO: 695682 - RNA, 59 nt, Homo Sapiens
aaagucacuuugucugucuuguucaccuggagccugacacaccguagguacugaguaca

SEQ ID NO: 695683 - RNA, 59 nt, Homo Sapiens
aaaaucugagacauggucacagccaagaggagccugagaagacaugacugcuagaugua

SEQ ID NO: 695684 - RNA, 59 nt, Homo Sapiens
gauauuucuuguggcaggggguggucaaagagccugauugcugacccagucucaggccu

SEQ ID NO: 695685 - RNA, 59 nt, Homo Sapiens
uggaguccggggaaagagagguggggggagagccugagguccccaagugaggggagucc

SEQ ID NO: 695686 - RNA, 59 nt, Homo Sapiens
augagucuucugacucuguuuuaguaguugagccugaccuauccaauuuacacagcaag

SEQ ID NO: 695687 - RNA, 59 nt, Homo Sapiens
agccccaaagcaggaagaagucggagucugagccugaagaugggggcucggacuccagc

SEQ ID NO: 695688 - RNA, 59 nt, Homo Sapiens
aagcagcaagaggacaugauaagaacaaagagccugagauguaagagacacaaaugaag

SEQ ID NO: 695689 - RNA, 59 nt, Homo Sapiens
agcaaauccuggaaggcagacaaaaauaagagccugaagcaaugcuuacaauagauguc

SEQ ID NO: 695690 - RNA, 59 nt, Homo Sapiens
uugcugacuccugauaaagaauauaaagugagccugauucuugaaaaaaucagaaccag

SEQ ID NO: 695691 - RNA, 59 nt, Homo Sapiens
ccugucucuacaaaaaaaaaauuugccaagagccugagugacagagcaagaccccaucu

SEQ ID NO: 695692 - RNA, 59 nt, Homo Sapiens
uggaccuggugccccugcucacugggcccgagccugaacugagccccagcgggcuggcg

SEQ ID NO: 695693 - RNA, 59 nt, Homo Sapiens
gccaaugcugaagacacagcuccgcuugggagccugagaacccaggcuucccaggccag

SEQ ID NO: 695694 - RNA, 59 nt, Homo Sapiens
caggcagcagagcgcucgcugugagaugagagccugagcuaagauggggaaacguccuc

SEQ ID NO: 695695 - RNA, 59 nt, Homo Sapiens
aagaagaggcuggggagggucacaguguggagccugaaccccugucuccaaagaucucc

SEQ ID NO: 695696 - RNA, 59 nt, Homo Sapiens
ccccaugccccaccuuugcugaccaugaugagccugacugaggaccuggagagcuggga

SEQ ID NO: 695697 - RNA, 59 nt, Homo Sapiens
ucuguacugcucgggccgcccaggucacagagccugagcuucguagccaaagcagccug

SEQ ID NO: 695698 - RNA, 59 nt, Homo Sapiens
aacagcuaggaucugcauuuucagguuccgagccugaccccuggaacugaccagcgcuc

SEQ ID NO: 695699 - RNA, 59 nt, Homo Sapiens
ucagugacugacagaggauccggaucucagagccugagaccagguuuauuggggccugg

SEQ ID NO: 695700 - RNA, 59 nt, Homo Sapiens
gcagccuuuggucuccuggaugggccuuugagccugauguuuacagugucugugugugu

SEQ ID NO: 695701 - RNA, 59 nt, Homo Sapiens
agaugagcugggcagggcagggguggguggagccugacccuggagggcacugagcugga

SEQ ID NO: 695702 - RNA, 59 nt, Homo Sapiens
cggggccucucuagggaagucugguuguagagccugaauaggcuccuggccccaugacc

SEQ ID NO: 695703 - RNA, 59 nt, Homo Sapiens
uucuaaaauaugcaucaagucauuggaaagagccugauuuauugugugucgagaggcag

SEQ ID NO: 695704 - RNA, 59 nt, Homo Sapiens
uggcucaguuuccggaagguuaucaacgugagccugaugguuuguaucaccaccuaugc

SEQ ID NO: 695705 - RNA, 59 nt, Homo Sapiens
ccgcugguagacuuuuguuaacaggcccugagccugaggcuaacccgcuuuuaccugag

SEQ ID NO: 695706 - RNA, 59 nt, Homo Sapiens
ucaucuuuguuggcucagaacgagccauagagccugaaauuucauccagggaaaugccu

SEQ ID NO: 695707 - RNA, 59 nt, Homo Sapiens
acagcagauguaggggacagagagagaacgagccugaaugagcaugucuuaccaaaaac

SEQ ID NO: 695708 - RNA, 59 nt, Homo Sapiens
ugggaggagggcaggcaucggggagccgggagccugacccucaucuuucuuccaaacag

SEQ ID NO: 695709 - RNA, 59 nt, Homo Sapiens
gguuaaggugggcauccuccagguacaacgagccugaagagccccuuucagugcagacg

SEQ ID NO: 695710 - RNA, 59 nt, Homo Sapiens
aaauaaucaccauuuuugaaaccaaaccagagccugaguguugccuaauuuguuuuccc

SEQ ID NO: 695711 - RNA, 59 nt, Homo Sapiens
gugaacuuggugggcccaggagggaacaggagccugagccagggcaauggcccugccac

SEQ ID NO: 695712 - RNA, 59 nt, Homo Sapiens
cacauacccacacauuccagggcuggggugagccugacugccaggaccccaggucaggg

SEQ ID NO: 695713 - RNA, 59 nt, Homo Sapiens
augucccgagaccuuagccuggcugaguggagccugagaccugcacaacagcucauggu

SEQ ID NO: 695714 - RNA, 59 nt, Homo Sapiens
agcuggaaacuuccacuuccccaaccucagagccugacuguaaugaagagacuggcagc

SEQ ID NO: 695715 - RNA, 59 nt, Homo Sapiens
aaguauuuggcuauuaacugccaaaacaagagccugauuuuuugaggccaguaauucgu

SEQ ID NO: 695716 - RNA, 59 nt, Homo Sapiens
cucugagcuggggaggugggaggccaggcgagccugacucuguugaucuacccgugccu

SEQ ID NO: 695717 - RNA, 59 nt, Homo Sapiens
gcaccgucuucuagagcccuggcccacccgagccugagggcuggcggggagcagcccug

SEQ ID NO: 695718 - RNA, 59 nt, Homo Sapiens
guaccaagaaguuccugccuuuugucucugagccugauguguguaggggugauggaaag

SEQ ID NO: 695719 - RNA, 59 nt, Homo Sapiens
uugccucuuagugggagaauaacuugacagagccugagucaguguucauagcuuccugc

SEQ ID NO: 695720 - RNA, 59 nt, Homo Sapiens
cccaagcaggacccggggguaugggaggagagccugaggcucucccaccuccuccccag

SEQ ID NO: 695721 - RNA, 59 nt, Homo Sapiens
cugacucuugaggguuggggauuccagcugagccugaauugcugaaguggccucuccau

SEQ ID NO: 695722 - RNA, 59 nt, Homo Sapiens
uugaccucaaacggguggcgggguuauuggagccugagcuaguauuagcgugaugcuug

SEQ ID NO: 695723 - RNA, 59 nt, Homo Sapiens
cuugggaacaugcgugugacgaggagcaggagccugagcaccucggugggcccaguggg

SEQ ID NO: 695724 - RNA, 59 nt, Homo Sapiens
cuugggaacaugcgugugacgaggagcaggagccugagcaccucagugggcccaguggg

SEQ ID NO: 695725 - RNA, 59 nt, Homo Sapiens
gugcccagcaugaaggugggggccucugggagccugacacauagcacugccucuuccag

SEQ ID NO: 695726 - RNA, 59 nt, Homo Sapiens
caggaggauugcuugagcucgguacuugggagccugaggggcucacgccuguaguccca

SEQ ID NO: 695727 - RNA, 59 nt, Homo Sapiens
cugggcuggagccuucucccugaggccgggagccugagcucagccugcagagaagaaag

SEQ ID NO: 695728 - RNA, 59 nt, Homo Sapiens
guacaucucuuggauuuguugcacaacuugagccugacuuuccuccaugcuugugaacu

SEQ ID NO: 695729 - RNA, 59 nt, Homo Sapiens
caggagaaucgcuugaaccugcuacuugggagccugaggggcacgcaccuguaguccca

SEQ ID NO: 695730 - RNA, 59 nt, Homo Sapiens
ccauuggcccaggcccuggcgggcagggagagccugaccagccccgacugcccaccuga

SEQ ID NO: 695731 - RNA, 59 nt, Homo Sapiens
cucaggcuguuggagaagcaucugcccaggagccugagccugguacacgaagggaacug

SEQ ID NO: 695732 - RNA, 59 nt, Homo Sapiens
aaggacauagagguauauuggaagaggcagagccugaggugguaggaggaggacccugg

SEQ ID NO: 695733 - RNA, 59 nt, Homo Sapiens
gguuucuucaggguaaacuagcaaugccugagccugaaccuuaauguggggccucaguu

SEQ ID NO: 695734 - RNA, 59 nt, Homo Sapiens
ugguugugcagaacaaacaauugcaggaugagccugaaccaugaugagucugaaggcau

SEQ ID NO: 695735 - RNA, 59 nt, Homo Sapiens
ccaacccacaucacuauucuccagaacuagagccugagccuagcugaugagggacagaa

SEQ ID NO: 695736 - RNA, 59 nt, Homo Sapiens
cggagggggacgccccacggggcccugcggagccugaagccggagagcaggcggcucuu

SEQ ID NO: 695737 - RNA, 59 nt, Homo Sapiens
uccccaaguuggaccuugauauuuauucugagccugagcucagauaauauauuauauau

SEQ ID NO: 695738 - RNA, 59 nt, Homo Sapiens
ucaccaaaugaugccacuucccagaggcagagccugagucacuggucacccuuaauauu

SEQ ID NO: 695739 - RNA, 59 nt, Homo Sapiens
cuggcaggcuuccaaacugaggaaagcuggagccugacgucagagcuuuuaacucggac

SEQ ID NO: 695740 - RNA, 59 nt, Homo Sapiens
ggcgcaugccuguaaucccagcuacuugggagccugaggcgggagaauugcuugaaccc

SEQ ID NO: 695741 - RNA, 59 nt, Homo Sapiens
gguucaguaaagaaagaaauguguuaacugagccugaaucccuucugggaaguaauaau

SEQ ID NO: 695742 - RNA, 59 nt, Homo Sapiens
cugcacccugacaggcacaccccacugaagagccugagucccaggaggccuccuggaag

SEQ ID NO: 695743 - RNA, 59 nt, Homo Sapiens
acuccgcugccgacccugccugagcgcgggagccugaggaccggguggaggcggugggg

SEQ ID NO: 695744 - RNA, 59 nt, Homo Sapiens
ccccagcccuggggauggggaaggacauggagccugagccagagaaccagcucugaguc

SEQ ID NO: 695745 - RNA, 59 nt, Homo Sapiens
ucacaggccgaugggguaagacuucgagagagccugauccuggggucuucugagacucc

SEQ ID NO: 695746 - RNA, 59 nt, Homo Sapiens
uucugugcucccuccugagaacccuuuaugagccugauuccucagucucaccagaauuc

SEQ ID NO: 695747 - RNA, 59 nt, Homo Sapiens
gggggcggggccuacauuccaauggggcggagccugagcuaggggguguggccuggcug

SEQ ID NO: 695748 - RNA, 59 nt, Homo Sapiens
gccuggacuccuguccagacaccuggugagagccugaggcugguguucagggcccugga

SEQ ID NO: 695749 - RNA, 59 nt, Homo Sapiens
aaaaggcaugggccugaauucaggcugcagagccugacuccucccuguggcuacuuuug

SEQ ID NO: 695750 - RNA, 59 nt, Homo Sapiens
guguauauguuaggcuuuguuuucuuaaagagccugauagagcaggggucgccaaaugu

SEQ ID NO: 695751 - RNA, 59 nt, Homo Sapiens
acucagaguacaaggaguucgagggccgugagccugacugcuaccuccucaccuugcag

SEQ ID NO: 695752 - RNA, 59 nt, Homo Sapiens
cugggugccagcuucgccaucuaucccuggagccugagaaggaaaaucacuccuacacg

SEQ ID NO: 695753 - RNA, 59 nt, Homo Sapiens
cagagaaccagcucugagucaaggacauggagccugagcucccagcccuggggacgggg

SEQ ID NO: 695754 - RNA, 59 nt, Homo Sapiens
ucccuggaaugagugugggugagacuccugagccugaggggggagcccaaaucuaggga

SEQ ID NO: 695755 - RNA, 59 nt, Homo Sapiens
caggagaaugguuugaacacgcaacuuaggagccugaggagugugcaucuguagucuca

SEQ ID NO: 695756 - RNA, 59 nt, Homo Sapiens
ccagccagccugagcucuccugcaagacagagccugauguggcacggagugggguugcg

SEQ ID NO: 695757 - RNA, 59 nt, Homo Sapiens
auaacccagagagggagcuggacuucagggagccugagugaugcuuucccaggagcagg

SEQ ID NO: 695758 - RNA, 59 nt, Homo Sapiens
ucacacuuccagcgcccagguccaagucugagccugaccuccccuuggggaccuagccu

SEQ ID NO: 695759 - RNA, 59 nt, Homo Sapiens
gggccugcaccagguuugcuuaggccauggagccugaggugcucucugugcucaccucc

SEQ ID NO: 695760 - RNA, 59 nt, Homo Sapiens
ucaacacugcagugagcuauggaucacuugagccugagucucaggaggcugaagcagga

SEQ ID NO: 695761 - RNA, 59 nt, Homo Sapiens
uuuguugcuguuuugauuuguuaaacagugagccugaauagagguauuuaucuuuacuu

SEQ ID NO: 695762 - RNA, 59 nt, Homo Sapiens
auggucccuuugguuucugggagaugggugagccugaagagcaugccacugagcaagga

SEQ ID NO: 695763 - RNA, 59 nt, Homo Sapiens
ccccggcgcgggggcugcuacccucaguugagccugagccagacuugaaaaugacaaaa

SEQ ID NO: 695764 - RNA, 59 nt, Homo Sapiens
auaagguuuuucagcaggaguuacacugggagccugagguccucaccuuccucucagua

SEQ ID NO: 695765 - RNA, 59 nt, Homo Sapiens
cccagccucuccacucccccgccagaaaggagccugagugauucucuuuucuucuuguu

SEQ ID NO: 695766 - RNA, 59 nt, Homo Sapiens
ggugggugccuguaaucccagcuacaugggagccugaggcaugagaaucacuugaacuc

SEQ ID NO: 695767 - RNA, 59 nt, Homo Sapiens
ucuuaacgaauaaaggucccucauaucuggagccugaugcaagcgcuucugcugaaagu

SEQ ID NO: 695768 - RNA, 59 nt, Homo Sapiens
cugggggugccucuguggcgggcuggccugagccugaugaggcgccuguaccuggccca

SEQ ID NO: 695769 - RNA, 59 nt, Homo Sapiens
cccuggaucugccaccuagcagacguggggagccugaccccaugccugucauggaaccc

SEQ ID NO: 695770 - RNA, 59 nt, Homo Sapiens
ccccucuagagacccuccagcuaaaaacagagccugaguucagggacccaaguggugag

SEQ ID NO: 695771 - RNA, 59 nt, Homo Sapiens
agccucagauuccaauagcucacucccuagagccugacgccggggccccugaccccuga

SEQ ID NO: 695772 - RNA, 59 nt, Homo Sapiens
agccucagauuccaauaccucacuccccagagccugaugccggggccccugaccccuga

SEQ ID NO: 695773 - RNA, 59 nt, Homo Sapiens
cuccaacucuccgugaggccccucucccagagccugacacacucuguggccgaacucua

SEQ ID NO: 695774 - RNA, 59 nt, Homo Sapiens
gcucagaggauuccugccagcacgggccugagccugagagaccacgcagcagagucccc

SEQ ID NO: 695775 - RNA, 59 nt, Homo Sapiens
cccgagcaguggaggucccgcagcuaccugagccugacgaacaacaaguacgcggccag

SEQ ID NO: 695776 - RNA, 59 nt, Homo Sapiens
uauuucauaucuccugcuguugccauacugagccugagggacgggcuuggcucccucuc

SEQ ID NO: 695777 - RNA, 59 nt, Homo Sapiens
cucccuggaacagggagaggcugcagcuggagccugaccagcucauagggaagaaagag

SEQ ID NO: 695778 - RNA, 59 nt, Homo Sapiens
ugucccccccacauaaagagagcuucucagagccugacugaagagcugacguuuugcuu

SEQ ID NO: 695779 - RNA, 59 nt, Homo Sapiens
uguuacaaaccaccaaauaauacaguugugagccugaauacaggacugaacuccuauac

SEQ ID NO: 695780 - RNA, 59 nt, Homo Sapiens
uaaccuuuuagggugguuagcacugggaggagccugaccuuuauuuauuuuuugaaggc

SEQ ID NO: 695781 - RNA, 59 nt, Homo Sapiens
gccuuugagucacauggcccgacauuaaagagccugaauacuucuuccccccauccuca

SEQ ID NO: 695782 - RNA, 59 nt, Homo Sapiens
caugaagugggaagcccagugguaugaaggagccugagcuggaaggcaggaugaggaga

SEQ ID NO: 695783 - RNA, 59 nt, Homo Sapiens
uggggagagggccggggcucgucaaggaugagccugaucaagucagacuuguauuauaa

SEQ ID NO: 695784 - RNA, 59 nt, Homo Sapiens
cccaacuuugugugugugggagaagacaagagccugauggguucccaggagggagaaag

SEQ ID NO: 695785 - RNA, 59 nt, Homo Sapiens
acaggcuuggagaaauggcuucacagagggagccugaguuggacagucuucucuguuga

SEQ ID NO: 695786 - RNA, 59 nt, Homo Sapiens
gccucucgccugcucucagccugcuucaugagccugacucagugagccaaacccggugg

SEQ ID NO: 695787 - RNA, 59 nt, Homo Sapiens
cucaggaggcugagaugagaggaucacuugagccugaggagguccaggccacagugauc

SEQ ID NO: 695788 - RNA, 64 nt, Homo Sapiens
uuucuguuuaugccagauuaaaacuugaaaaauuacaggugagaauauuugaaacagauuuuaa

SEQ ID NO: 695789 - RNA, 64 nt, Homo Sapiens
gaaccaaguuucacagaggcaucacuucuaguuuacaggugagguaaccuggugacuggcucuu

SEQ ID NO: 695790 - RNA, 64 nt, Homo Sapiens
acaaacaugagggaggguugacuguaacaggugaacaggugaacaauauacauuucacagauaa

SEQ ID NO: 695791 - RNA, 64 nt, Homo Sapiens
aggugaacacaaacaugaggacagauaaacuguaacaggugaacgauauauaaauauacauuuc

SEQ ID NO: 695792 - RNA, 64 nt, Homo Sapiens
gcuugcuagggaaccugcaugccuaguaagcgccacaggugacucugaugcaggcgccacagcc

SEQ ID NO: 695793 - RNA, 64 nt, Homo Sapiens
accuuggacagaggucaauccuugaugcuccagcacaggugacgucacuaauugucacuuucca

SEQ ID NO: 695794 - RNA, 64 nt, Homo Sapiens
gccaccacacucagcuaauugaguagcugagacuacaggugaguaucccuccccucagccuccu

SEQ ID NO: 695795 - RNA, 64 nt, Homo Sapiens
gccaccgugcccggcuaauggaguaguugggauuacaggugacucucuccugccucagccuccc

SEQ ID NO: 695796 - RNA, 64 nt, Homo Sapiens
ugauauguuacugguauucgauacugaaaaauguacaggugaaaugauuaucuuuuagagaagu

SEQ ID NO: 695797 - RNA, 64 nt, Homo Sapiens
acuucuguguucccaagaaguggaauugucaaguacaggugagcgaugugaacccagugaucag

SEQ ID NO: 695798 - RNA, 64 nt, Homo Sapiens; identical to SEQ ID NO: 53319

SEQ ID NO: 695799 - RNA, 64 nt, Homo Sapiens; identical to SEQ ID NO: 53320

SEQ ID NO: 695800 - RNA, 64 nt, Homo Sapiens; identical to SEQ ID NO: 53321

SEQ ID NO: 695801 - RNA, 64 nt, Homo Sapiens; identical to SEQ ID NO: 53322

SEQ ID NO: 695802 - RNA, 64 nt, Homo Sapiens; identical to SEQ ID NO: 53323

SEQ ID NO: 695803 - RNA, 64 nt, Homo Sapiens; identical to SEQ ID NO: 53324

SEQ ID NO: 695804 - RNA, 64 nt, Homo Sapiens; identical to SEQ ID NO: 53325

SEQ ID NO: 695805 - RNA, 64 nt, Homo Sapiens; identical to SEQ ID NO: 53326

SEQ ID NO: 695806 - RNA, 64 nt, Homo Sapiens; identical to SEQ ID NO: 53327

SEQ ID NO: 695807 - RNA, 64 nt, Homo Sapiens; identical to SEQ ID NO: 53328

SEQ ID NO: 695808 - RNA, 64 nt, Homo Sapiens; identical to SEQ ID NO: 53329

SEQ ID NO: 695809 - RNA, 64 nt, Homo Sapiens; identical to SEQ ID NO: 53330

SEQ ID NO: 695810 - RNA, 64 nt, Homo Sapiens; identical to SEQ ID NO: 53331

SEQ ID NO: 695811 - RNA, 64 nt, Homo Sapiens; identical to SEQ ID NO: 53332

SEQ ID NO: 695812 - RNA, 64 nt, Homo Sapiens; identical to SEQ ID NO: 53333

SEQ ID NO: 695813 - RNA, 64 nt, Homo Sapiens; identical to SEQ ID NO: 53334

SEQ ID NO: 695814 - RNA, 64 nt, Homo Sapiens
gguagcaguuguggaugucacaggccuggcguugcuuccgcacccggcugugacuauacagaac

SEQ ID NO: 695815 - RNA, 64 nt, Homo Sapiens
aaggagaugccaauucugcuugugcagacuggugcuuccgcagaacaauacauccuaugcuuuc

SEQ ID NO: 695816 - RNA, 64 nt, Homo Sapiens
gaacccuggccugcccgcgaucaccacgaggcugcuuccgcaggacaccugggcaggagugcuc

SEQ ID NO: 695817 - RNA, 64 nt, Homo Sapiens
ggaacacgccagucccccuugugggagaugagaucuuccgcacaggugugacaggguagaggag

SEQ ID NO: 695818 - RNA, 64 nt, Homo Sapiens
gguagugcccaagccuggucguguugccaggaguggugacaagaaaugcagcuuacaucaaacg

SEQ ID NO: 695819 - RNA, 64 nt, Homo Sapiens
uguuucuacaaaucucucucaaauguauuauuuuggugacaaaaaugaaggagcuuuguaaauu

SEQ ID NO: 695820 - RNA, 64 nt, Homo Sapiens
gagccucuugacugguacucgcggggaccuaacuggugacaauuuguuacagcaguuugccaag

SEQ ID NO: 695821 - RNA, 64 nt, Homo Sapiens
uauuccaugugaugcuugugcuuuuguaaaguuaggugacaaguaguagucauucuuagccuug

SEQ ID NO: 695822 - RNA, 64 nt, Homo Sapiens
uuaucaguuguuauuguuaucccuugaaagcgagggugacaaaaacaacaaaacaccguuauaa

SEQ ID NO: 695823 - RNA, 64 nt, Homo Sapiens
acguauaucuuaauucuggguugcuuguuuuuuaggugacaaaaauaaaauauuguauuuuaau

SEQ ID NO: 695824 - RNA, 64 nt, Homo Sapiens
ucgggaagaaggggacaauggcagaacagguguuggugacaauugucaccaauuggauaaagca

SEQ ID NO: 695825 - RNA, 64 nt, Homo Sapiens
gugagccgagaucgugccauugcacuccagccugggugacaaagcgagacuccaucucaaaaaa

SEQ ID NO: 695826 - RNA, 64 nt, Homo Sapiens
gugagccaagauggcgccauugcacuccagccugggugacaagagugaaacuccaucucaaaaa

SEQ ID NO: 695827 - RNA, 64 nt, Homo Sapiens
aguaagccaugauugcgccacugcacucagcccgggugacaaagcaagacccugucucagaaaa

SEQ ID NO: 695828 - RNA, 64 nt, Homo Sapiens
gccacaggagaaaaaucuucaggaucuugggcuaggugacaaguucuuggacuuugccccgaaa

SEQ ID NO: 695829 - RNA, 64 nt, Homo Sapiens
auacuguaugaucgcauuuauauaacauucuugaggugacaaaauuauugaaaugaagaacaga

SEQ ID NO: 695830 - RNA, 64 nt, Homo Sapiens
uggaaaugcgugugaccugugaagugguguauugucacaguagcuuauuugaacuugagaccau

SEQ ID NO: 695831 - RNA, 64 nt, Homo Sapiens
auuauggaaaauuacuuaaaacgugaauacaucaucacaguagaauuuauuaugagagcaugua

SEQ ID NO: 695832 - RNA, 64 nt, Homo Sapiens
aaaguuuuaagaaaagauucauuuggaauuuuauucacaguauaaaauuuccucaccugaagua

SEQ ID NO: 695833 - RNA, 64 nt, Homo Sapiens
uauaaaaguguccuaagcauauuagccaaucuuuucacaguagagcauacuuaaggcugcuugg

SEQ ID NO: 695834 - RNA, 64 nt, Homo Sapiens
gaugugauucaaaauguuucauucacaguacacgucacaguauuaaaaccuggccgucucuucu

SEQ ID NO: 695835 - RNA, 64 nt, Homo Sapiens
cgucacaguauugaugugaugccgucucuucuauucacaguacaucagugcuggccaaaaccug

SEQ ID NO: 695836 - RNA, 64 nt, Homo Sapiens; identical to SEQ ID NO: 69124

SEQ ID NO: 695837 - RNA, 64 nt, Homo Sapiens; identical to SEQ ID NO: 69125

SEQ ID NO: 695838 - RNA, 64 nt, Homo Sapiens; identical to SEQ ID NO: 69126

SEQ ID NO: 695839 - RNA, 64 nt, Homo Sapiens; identical to SEQ ID NO: 69127

SEQ ID NO: 695840 - RNA, 64 nt, Homo Sapiens; identical to SEQ ID NO: 69128

SEQ ID NO: 695841 - RNA, 64 nt, Homo Sapiens; identical to SEQ ID NO: 69129

SEQ ID NO: 695842 - RNA, 64 nt, Homo Sapiens; identical to SEQ ID NO: 77130

SEQ ID NO: 695843 - RNA, 64 nt, Homo Sapiens; identical to SEQ ID NO: 77131

SEQ ID NO: 695844 - RNA, 64 nt, Homo Sapiens; identical to SEQ ID NO: 77132

SEQ ID NO: 695845 - RNA, 64 nt, Homo Sapiens; identical to SEQ ID NO: 77133

SEQ ID NO: 695846 - RNA, 64 nt, Homo Sapiens; identical to SEQ ID NO: 77134

SEQ ID NO: 695847 - RNA, 64 nt, Homo Sapiens; identical to SEQ ID NO: 77135

SEQ ID NO: 695848 - RNA, 64 nt, Homo Sapiens; identical to SEQ ID NO: 77136

SEQ ID NO: 695849 - RNA, 62 nt, Homo Sapiens; identical to SEQ ID NO: 77137

SEQ ID NO: 695850 - RNA, 64 nt, Homo Sapiens; identical to SEQ ID NO: 77138

SEQ ID NO: 695851 - RNA, 64 nt, Homo Sapiens; identical to SEQ ID NO: 77139

SEQ ID NO: 695852 - RNA, 64 nt, Homo Sapiens; identical to SEQ ID NO: 77140

SEQ ID NO: 695853 - RNA, 64 nt, Homo Sapiens; identical to SEQ ID NO: 77141

SEQ ID NO: 695854 - RNA, 64 nt, Homo Sapiens; identical to SEQ ID NO: 77142

SEQ ID NO: 695855 - RNA, 64 nt, Homo Sapiens; identical to SEQ ID NO: 77143

SEQ ID NO: 695856 - RNA, 64 nt, Homo Sapiens; identical to SEQ ID NO: 77144

SEQ ID NO: 695857 - RNA, 64 nt, Homo Sapiens; identical to SEQ ID NO: 77145

SEQ ID NO: 695858 - RNA, 64 nt, Homo Sapiens; identical to SEQ ID NO: 77146

SEQ ID NO: 695859 - RNA, 64 nt, Homo Sapiens; identical to SEQ ID NO: 77147

SEQ ID NO: 695860 - RNA, 64 nt, Homo Sapiens; identical to SEQ ID NO: 77148

SEQ ID NO: 695861 - RNA, 64 nt, Homo Sapiens; identical to SEQ ID NO: 77149

SEQ ID NO: 695862 - RNA, 64 nt, Homo Sapiens; identical to SEQ ID NO: 77150

SEQ ID NO: 695863 - RNA, 64 nt, Homo Sapiens; identical to SEQ ID NO: 77151

SEQ ID NO: 695864 - RNA, 64 nt, Homo Sapiens; identical to SEQ ID NO: 77152

SEQ ID NO: 695865 - RNA, 64 nt, Homo Sapiens; identical to SEQ ID NO: 77153

SEQ ID NO: 695866 - RNA, 64 nt, Homo Sapiens; identical to SEQ ID NO: 77154

SEQ ID NO: 695867 - RNA, 64 nt, Homo Sapiens; identical to SEQ ID NO: 77155

SEQ ID NO: 695868 - RNA, 64 nt, Homo Sapiens; identical to SEQ ID NO: 77156

SEQ ID NO: 695869 - RNA, 64 nt, Homo Sapiens; identical to SEQ ID NO: 77157

SEQ ID NO: 695870 - RNA, 64 nt, Homo Sapiens; identical to SEQ ID NO: 77158

SEQ ID NO: 695871 - RNA, 64 nt, Homo Sapiens; identical to SEQ ID NO: 77159

SEQ ID NO: 695872 - RNA, 64 nt, Homo Sapiens; identical to SEQ ID NO: 77160

SEQ ID NO: 695873 - RNA, 64 nt, Homo Sapiens; identical to SEQ ID NO: 437863

SEQ ID NO: 695874 - RNA, 64 nt, Homo Sapiens; identical to SEQ ID NO: 437864

SEQ ID NO: 695875 - RNA, 64 nt, Homo Sapiens; identical to SEQ ID NO: 284748

SEQ ID NO: 695876 - RNA, 64 nt, Homo Sapiens; identical to SEQ ID NO: 284749

SEQ ID NO: 695877 - RNA, 64 nt, Homo Sapiens; identical to SEQ ID NO: 284750

SEQ ID NO: 695878 - RNA, 64 nt, Homo Sapiens; identical to SEQ ID NO: 284751

SEQ ID NO: 695879 - RNA, 64 nt, Homo Sapiens; identical to SEQ ID NO: 284752

SEQ ID NO: 695880 - RNA, 64 nt, Homo Sapiens; identical to SEQ ID NO: 284753

SEQ ID NO: 695881 - RNA, 64 nt, Homo Sapiens; identical to SEQ ID NO: 284754

SEQ ID NO: 695882 - RNA, 64 nt, Homo Sapiens; identical to SEQ ID NO: 284755

SEQ ID NO: 695883 - RNA, 64 nt, Homo Sapiens; identical to SEQ ID NO: 284756

SEQ ID NO: 695884 - RNA, 64 nt, Homo Sapiens; identical to SEQ ID NO: 284757

SEQ ID NO: 695885 - RNA, 64 nt, Homo Sapiens; identical to SEQ ID NO: 284758

SEQ ID NO: 695886 - RNA, 64 nt, Homo Sapiens; identical to SEQ ID NO: 284759

SEQ ID NO: 695887 - RNA, 64 nt, Homo Sapiens; identical to SEQ ID NO: 284760

SEQ ID NO: 695888 - RNA, 64 nt, Homo Sapiens; identical to SEQ ID NO: 284761

SEQ ID NO: 695889 - RNA, 64 nt, Homo Sapiens; identical to SEQ ID NO: 284762

SEQ ID NO: 695890 - RNA, 64 nt, Homo Sapiens; identical to SEQ ID NO: 284763

SEQ ID NO: 695891 - RNA, 64 nt, Homo Sapiens; identical to SEQ ID NO: 284764

SEQ ID NO: 695892 - RNA, 64 nt, Homo Sapiens; identical to SEQ ID NO: 284765

SEQ ID NO: 695893 - RNA, 64 nt, Homo Sapiens; identical to SEQ ID NO: 284766

SEQ ID NO: 695894 - RNA, 64 nt, Homo Sapiens; identical to SEQ ID NO: 284767

SEQ ID NO: 695895 - RNA, 64 nt, Homo Sapiens; identical to SEQ ID NO: 284768

SEQ ID NO: 695896 - RNA, 64 nt, Homo Sapiens; identical to SEQ ID NO: 284769

SEQ ID NO: 695897 - RNA, 64 nt, Homo Sapiens; identical to SEQ ID NO: 284770

SEQ ID NO: 695898 - RNA, 64 nt, Homo Sapiens; identical to SEQ ID NO: 284771

SEQ ID NO: 695899 - RNA, 64 nt, Homo Sapiens; identical to SEQ ID NO: 284772

SEQ ID NO: 695900 - RNA, 64 nt, Homo Sapiens; identical to SEQ ID NO: 284773

SEQ ID NO: 695901 - RNA, 64 nt, Homo Sapiens; identical to SEQ ID NO: 284774

SEQ ID NO: 695902 - RNA, 64 nt, Homo Sapiens; identical to SEQ ID NO: 284775

SEQ ID NO: 695903 - RNA, 64 nt, Homo Sapiens; identical to SEQ ID NO: 284776

SEQ ID NO: 695904 - RNA, 64 nt, Homo Sapiens; identical to SEQ ID NO: 284777

SEQ ID NO: 695905 - RNA, 64 nt, Homo Sapiens; identical to SEQ ID NO: 284778

SEQ ID NO: 695906 - RNA, 64 nt, Homo Sapiens; identical to SEQ ID NO: 284779

SEQ ID NO: 695907 - RNA, 64 nt, Homo Sapiens; identical to SEQ ID NO: 284780

SEQ ID NO: 695908 - RNA, 64 nt, Homo Sapiens; identical to SEQ ID NO: 284781

SEQ ID NO: 695909 - RNA, 64 nt, Homo Sapiens; identical to SEQ ID NO: 284782

SEQ ID NO: 695910 - RNA, 64 nt, Homo Sapiens; identical to SEQ ID NO: 284783

SEQ ID NO: 695911 - RNA, 64 nt, Homo Sapiens; identical to SEQ ID NO: 284784

SEQ ID NO: 695912 - RNA, 64 nt, Homo Sapiens; identical to SEQ ID NO: 284785

SEQ ID NO: 695913 - RNA, 64 nt, Homo Sapiens; identical to SEQ ID NO: 284786

SEQ ID NO: 695914 - RNA, 64 nt, Homo Sapiens; identical to SEQ ID NO: 284787

SEQ ID NO: 695915 - RNA, 64 nt, Homo Sapiens; identical to SEQ ID NO: 284788

SEQ ID NO: 695916 - RNA, 64 nt, Homo Sapiens; identical to SEQ ID NO: 284789

SEQ ID NO: 695917 - RNA, 64 nt, Homo Sapiens; identical to SEQ ID NO: 284790

SEQ ID NO: 695918 - RNA, 64 nt, Homo Sapiens; identical to SEQ ID NO: 284791

SEQ ID NO: 695919 - RNA, 64 nt, Homo Sapiens; identical to SEQ ID NO: 284792

SEQ ID NO: 695920 - RNA, 64 nt, Homo Sapiens; identical to SEQ ID NO: 284793

SEQ ID NO: 695921 - RNA, 64 nt, Homo Sapiens; identical to SEQ ID NO: 284794

SEQ ID NO: 695922 - RNA, 64 nt, Homo Sapiens; identical to SEQ ID NO: 284795

SEQ ID NO: 695923 - RNA, 64 nt, Homo Sapiens; identical to SEQ ID NO: 284796

SEQ ID NO: 695924 - RNA, 64 nt, Homo Sapiens; identical to SEQ ID NO: 284797

SEQ ID NO: 695925 - RNA, 64 nt, Homo Sapiens; identical to SEQ ID NO: 284798

SEQ ID NO: 695926 - RNA, 64 nt, Homo Sapiens; identical to SEQ ID NO: 284799

SEQ ID NO: 695927 - RNA, 64 nt, Homo Sapiens; identical to SEQ ID NO: 284800

SEQ ID NO: 695928 - RNA, 64 nt, Homo Sapiens; identical to SEQ ID NO: 284801

SEQ ID NO: 695929 - RNA, 64 nt, Homo Sapiens; identical to SEQ ID NO: 284802

SEQ ID NO: 695930 - RNA, 64 nt, Homo Sapiens; identical to SEQ ID NO: 284803

SEQ ID NO: 695931 - RNA, 64 nt, Homo Sapiens; identical to SEQ ID NO: 284804

SEQ ID NO: 695932 - RNA, 64 nt, Homo Sapiens; identical to SEQ ID NO: 284805

SEQ ID NO: 695933 - RNA, 64 nt, Homo Sapiens; identical to SEQ ID NO: 284806

SEQ ID NO: 695934 - RNA, 64 nt, Homo Sapiens; identical to SEQ ID NO: 284807

SEQ ID NO: 695935 - RNA, 64 nt, Homo Sapiens; identical to SEQ ID NO: 284808

SEQ ID NO: 695936 - RNA, 64 nt, Homo Sapiens; identical to SEQ ID NO: 284809

SEQ ID NO: 695937 - RNA, 64 nt, Homo Sapiens; identical to SEQ ID NO: 284810

SEQ ID NO: 695938 - RNA, 64 nt, Homo Sapiens; identical to SEQ ID NO: 284811

SEQ ID NO: 695939 - RNA, 64 nt, Homo Sapiens; identical to SEQ ID NO: 284812

SEQ ID NO: 695940 - RNA, 64 nt, Homo Sapiens; identical to SEQ ID NO: 284813

SEQ ID NO: 695941 - RNA, 64 nt, Homo Sapiens; identical to SEQ ID NO: 284814

SEQ ID NO: 695942 - RNA, 64 nt, Homo Sapiens; identical to SEQ ID NO: 284815

SEQ ID NO: 695943 - RNA, 64 nt, Homo Sapiens; identical to SEQ ID NO: 284816

SEQ ID NO: 695944 - RNA, 64 nt, Homo Sapiens; identical to SEQ ID NO: 284817

SEQ ID NO: 695945 - RNA, 64 nt, Homo Sapiens; identical to SEQ ID NO: 284818

SEQ ID NO: 695946 - RNA, 64 nt, Homo Sapiens; identical to SEQ ID NO: 284819

SEQ ID NO: 695947 - RNA, 64 nt, Homo Sapiens; identical to SEQ ID NO: 284820

SEQ ID NO: 695948 - RNA, 64 nt, Homo Sapiens; identical to SEQ ID NO: 284821

SEQ ID NO: 695949 - RNA, 64 nt, Homo Sapiens; identical to SEQ ID NO: 284822

SEQ ID NO: 695950 - RNA, 64 nt, Homo Sapiens; identical to SEQ ID NO: 284823

SEQ ID NO: 695951 - RNA, 64 nt, Homo Sapiens; identical to SEQ ID NO: 284824

SEQ ID NO: 695952 - RNA, 57 nt, Homo Sapiens; identical to SEQ ID NO: 284825

SEQ ID NO: 695953 - RNA, 52 nt, Homo Sapiens; identical to SEQ ID NO: 284826

SEQ ID NO: 695954 - RNA, 64 nt, Homo Sapiens; identical to SEQ ID NO: 284827

SEQ ID NO: 695955 - RNA, 64 nt, Homo Sapiens; identical to SEQ ID NO: 284828

SEQ ID NO: 695956 - RNA, 64 nt, Homo Sapiens; identical to SEQ ID NO: 284829

SEQ ID NO: 695957 - RNA, 64 nt, Homo Sapiens; identical to SEQ ID NO: 284830

SEQ ID NO: 695958 - RNA, 64 nt, Homo Sapiens; identical to SEQ ID NO: 284831

SEQ ID NO: 695959 - RNA, 64 nt, Homo Sapiens; identical to SEQ ID NO: 284832

SEQ ID NO: 695960 - RNA, 64 nt, Homo Sapiens; identical to SEQ ID NO: 284833

SEQ ID NO: 695961 - RNA, 64 nt, Homo Sapiens; identical to SEQ ID NO: 284834

SEQ ID NO: 695962 - RNA, 64 nt, Homo Sapiens; identical to SEQ ID NO: 284835

SEQ ID NO: 695963 - RNA, 64 nt, Homo Sapiens; identical to SEQ ID NO: 284836

SEQ ID NO: 695964 - RNA, 64 nt, Homo Sapiens; identical to SEQ ID NO: 284837

SEQ ID NO: 695965 - RNA, 64 nt, Homo Sapiens; identical to SEQ ID NO: 284838

SEQ ID NO: 695966 - RNA, 64 nt, Homo Sapiens; identical to SEQ ID NO: 284839

SEQ ID NO: 695967 - RNA, 64 nt, Homo Sapiens; identical to SEQ ID NO: 284840

SEQ ID NO: 695968 - RNA, 64 nt, Homo Sapiens
uugauauaauguguuaugcuguuuaguugaaauguccccuuaacauggaauaguauccccuuau

SEQ ID NO: 695969 - RNA, 64 nt, Homo Sapiens
uuuaguugaaauguccccuuucaauggaauaguauccccuuaugaaucagccuaugccagggcu

SEQ ID NO: 695970 - RNA, 64 nt, Homo Sapiens
ugucuuugaacuuucucuuugcauuauuuaacacuccccuuaacauaucauuuccccccaguca

SEQ ID NO: 695971 - RNA, 64 nt, Homo Sapiens
aaacuugaagugauaugcagagguguuuuuuuuuuccccuuaaaacuuugaugcauuuauuuuu

SEQ ID NO: 695972 - RNA, 64 nt, Homo Sapiens
ucuagaacugcuccuugguguuggcucucaaguguccccuuagaaugagauuggauuugacccc

SEQ ID NO: 695973 - RNA, 64 nt, Homo Sapiens
gacaaaaugaagacuaucauuuuguuguuguuguuccccuuacagcaucugaagacuggguuuu

SEQ ID NO: 695974 - RNA, 64 nt, Homo Sapiens
ugaagucuuucguagacaccccagagcacacacauccccuuaguccaccgguuagaugucucuc

SEQ ID NO: 695975 - RNA, 64 nt, Homo Sapiens
gggaacacguccuaggcaggucugacgugaaaccuccccuuacccugaaccgugugacucugca

SEQ ID NO: 695976 - RNA, 64 nt, Homo Sapiens
cugccaccagcaaggauaaacggaaauauuuguauccccuuacacauauugacaaaaugguuuc

SEQ ID NO: 695977 - RNA, 64 nt, Homo Sapiens
auuacuaaauauuuuauuuuauaucgugggcaucuccccuuaugugcagcuguuuucacuuagc

SEQ ID NO: 695978 - RNA, 64 nt, Homo Sapiens
augaggaugucaccaacugacuaacaggagaaaggacaaccaggucaacucugaaagagcaaac

SEQ ID NO: 695979 - RNA, 63 nt, Homo Sapiens
augaucaaaaacugccuuccugccagcucaggugacaaccauuggagcccagcuuuuugguaa

SEQ ID NO: 695980 - RNA, 64 nt, Homo Sapiens; identical to SEQ ID NO: 130376

SEQ ID NO: 695981 - RNA, 64 nt, Homo Sapiens; identical to SEQ ID NO: 130377

SEQ ID NO: 695982 - RNA, 64 nt, Homo Sapiens; identical to SEQ ID NO: 130378

SEQ ID NO: 695983 - RNA, 64 nt, Homo Sapiens; identical to SEQ ID NO: 130379

SEQ ID NO: 695984 - RNA, 64 nt, Homo Sapiens
cuuuuaguuuacaucccucauguaaagacaguaacaugcaaacacucccaaucaugucucuuua

SEQ ID NO: 695985 - RNA, 64 nt, Homo Sapiens
uugggcauaaugugaacuaacauccacugaugaacaugcaaacucauauuuuuguuaccuaaug

SEQ ID NO: 695986 - RNA, 64 nt, Homo Sapiens
uuuuuuuucuuuuuccugcuguauaacuccuugccaugcaaacucucaagaggccaauauauuc

SEQ ID NO: 695987 - RNA, 64 nt, Homo Sapiens
uguuugaaugagccucuuaaaauaaacuuagagccaugcaaaugccagcagcuuaauggauuuc

SEQ ID NO: 695988 - RNA, 64 nt, Homo Sapiens
ucugaugguggcuuccagggguggaaccucagugcaugcaaaucggcaaagcuaucuuccccaa

SEQ ID NO: 695989 - RNA, 64 nt, Homo Sapiens
uguuuucuucuuccuucucacuuauagcuaccuucaugcaaaacaccagccauucagaaaacuu

SEQ ID NO: 695990 - RNA, 64 nt, Homo Sapiens
uaaaucuauggagcauucucagccauaccuuggacaugcaaauauugaaugaacuguaaaguac

SEQ ID NO: 695991 - RNA, 64 nt, Homo Sapiens
ugagugagcacaggauuugccauaaaaaaaaacccaugcaaaccuucuugauguaauuuaucac

SEQ ID NO: 695992 - RNA, 64 nt, Homo Sapiens
gcucaucucugucccacuuggcaucagcuggcgucaugcaaagucaugcaaaggcugggaccac

SEQ ID NO: 695993 - RNA, 64 nt, Homo Sapiens
gucccacuuggcaucagcuggcgucaugcaaagucaugcaaaggcugggaccacgugagaucau

SEQ ID NO: 695994 - RNA, 64 nt, Homo Sapiens
gcagaagcaaacccaguaaagcacacccauuccacaugcaaagggugggacgggcagcgguggg

SEQ ID NO: 695995 - RNA, 64 nt, Homo Sapiens
agauggccgcuccaggccugccacaaccuugcggcaugcaaaugcccaggagaagccgccugag

SEQ ID NO: 695996 - RNA, 64 nt, Homo Sapiens; identical to SEQ ID NO: 433911

SEQ ID NO: 695997 - RNA, 64 nt, Homo Sapiens; identical to SEQ ID NO: 433912

SEQ ID NO: 695998 - RNA, 64 nt, Homo Sapiens; identical to SEQ ID NO: 433913

SEQ ID NO: 695999 - RNA, 64 nt, Homo Sapiens; identical to SEQ ID NO: 433914

SEQ ID NO: 696000 - RNA, 64 nt, Homo Sapiens; identical to SEQ ID NO: 433915

SEQ ID NO: 696001 - RNA, 64 nt, Homo Sapiens; identical to SEQ ID NO: 433916

SEQ ID NO: 696002 - RNA, 64 nt, Homo Sapiens; identical to SEQ ID NO: 433917

SEQ ID NO: 696003 - RNA, 64 nt, Homo Sapiens; identical to SEQ ID NO: 433918

SEQ ID NO: 696004 - RNA, 64 nt, Homo Sapiens; identical to SEQ ID NO: 433919

SEQ ID NO: 696005 - RNA, 64 nt, Homo Sapiens; identical to SEQ ID NO: 433920

SEQ ID NO: 696006 - RNA, 64 nt, Homo Sapiens; identical to SEQ ID NO: 433921

SEQ ID NO: 696007 - RNA, 64 nt, Homo Sapiens; identical to SEQ ID NO: 433922

SEQ ID NO: 696008 - RNA, 64 nt, Homo Sapiens; identical to SEQ ID NO: 433923

SEQ ID NO: 696009 - RNA, 61 nt, Homo Sapiens; identical to SEQ ID NO: 433924

SEQ ID NO: 696010 - RNA, 64 nt, Homo Sapiens; identical to SEQ ID NO: 433925

SEQ ID NO: 696011 - RNA, 60 nt, Homo Sapiens; identical to SEQ ID NO: 433926

SEQ ID NO: 696012 - RNA, 64 nt, Homo Sapiens; identical to SEQ ID NO: 433927

SEQ ID NO: 696013 - RNA, 64 nt, Homo Sapiens; identical to SEQ ID NO: 433928

SEQ ID NO: 696014 - RNA, 64 nt, Homo Sapiens; identical to SEQ ID NO: 433929

SEQ ID NO: 696015 - RNA, 64 nt, Homo Sapiens; identical to SEQ ID NO: 433930

SEQ ID NO: 696016 - RNA, 64 nt, Homo Sapiens; identical to SEQ ID NO: 433931

SEQ ID NO: 696017 - RNA, 64 nt, Homo Sapiens; identical to SEQ ID NO: 433932

SEQ ID NO: 696018 - RNA, 64 nt, Homo Sapiens; identical to SEQ ID NO: 433933

SEQ ID NO: 696019 - RNA, 64 nt, Homo Sapiens; identical to SEQ ID NO: 433934

SEQ ID NO: 696020 - RNA, 64 nt, Homo Sapiens; identical to SEQ ID NO: 433935

SEQ ID NO: 696021 - RNA, 64 nt, Homo Sapiens; identical to SEQ ID NO: 433936

SEQ ID NO: 696022 - RNA, 64 nt, Homo Sapiens; identical to SEQ ID NO: 433937

SEQ ID NO: 696023 - RNA, 64 nt, Homo Sapiens; identical to SEQ ID NO: 433938

SEQ ID NO: 696024 - RNA, 64 nt, Homo Sapiens; identical to SEQ ID NO: 433939

SEQ ID NO: 696025 - RNA, 64 nt, Homo Sapiens; identical to SEQ ID NO: 433940

SEQ ID NO: 696026 - RNA, 64 nt, Homo Sapiens; identical to SEQ ID NO: 433941

SEQ ID NO: 696027 - RNA, 64 nt, Homo Sapiens; identical to SEQ ID NO: 433942

SEQ ID NO: 696028 - RNA, 64 nt, Homo Sapiens; identical to SEQ ID NO: 158079

SEQ ID NO: 696029 - RNA, 64 nt, Homo Sapiens; identical to SEQ ID NO: 158080

SEQ ID NO: 696030 - RNA, 64 nt, Homo Sapiens; identical to SEQ ID NO: 158081

SEQ ID NO: 696031 - RNA, 64 nt, Homo Sapiens; identical to SEQ ID NO: 158082

SEQ ID NO: 696032 - RNA, 64 nt, Homo Sapiens; identical to SEQ ID NO: 158083

SEQ ID NO: 696033 - RNA, 64 nt, Homo Sapiens; identical to SEQ ID NO: 158084

SEQ ID NO: 696034 - RNA, 64 nt, Homo Sapiens; identical to SEQ ID NO: 158085

SEQ ID NO: 696035 - RNA, 64 nt, Homo Sapiens; identical to SEQ ID NO: 158086

SEQ ID NO: 696036 - RNA, 64 nt, Homo Sapiens; identical to SEQ ID NO: 158087

SEQ ID NO: 696037 - RNA, 64 nt, Homo Sapiens
cacaagaccauuguacugcaauacuugaguauuuguguagcaaacagccucuuagguuggagag

SEQ ID NO: 696038 - RNA, 63 nt, Homo Sapiens
uauugauacaaucuaauaaauaauguguuugacaguguagcagaaauaaugcuauguguucac

SEQ ID NO: 696039 - RNA, 64 nt, Homo Sapiens
uuacuccuuugucgcuuauccagaaugaugcuauguguagcaucuugcuguaaauccuguacaa

SEQ ID NO: 696040 - RNA, 64 nt, Homo Sapiens
uuucugcauuuaauagguuagaauguaaauuaaaguguagcaauagcaacaaaauauuuauucu

SEQ ID NO: 696041 - RNA, 64 nt, Homo Sapiens
auugcagaaaaggcuucccuuggcucccaaggagguguagcaggugugagcaauauuagugcca

SEQ ID NO: 696042 - RNA, 64 nt, Homo Sapiens
aauucuuccauacacaggugugcuucuagucaguguguagcaaggaaagccccguucacugcuc

SEQ ID NO: 696043 - RNA, 64 nt, Homo Sapiens
caagauauuuggggaauaaaaauaacagcuugguguguagcaucugcagccacuuggcaaauga

SEQ ID NO: 696044 - RNA, 64 nt, Homo Sapiens
ugaaaccugugacucagguuuaugaaugguguuuguguagcaacacauugugugcuauguuuau

SEQ ID NO: 696045 - RNA, 64 nt, Homo Sapiens
uaaagucaugauauuuuccucagugcugcugucaguguagcaaauggcagcccccagcuccccu

SEQ ID NO: 696046 - RNA, 64 nt, Homo Sapiens
gagccugcuguguccugggugggaucucagauguguguagcacgggguguggugaggguucuag

SEQ ID NO: 696047 - RNA, 64 nt, Homo Sapiens
cagauaaguauacagcgacaggcaaaggugucccguguagcacuagcaggccauacuguguugg

SEQ ID NO: 696048 - RNA, 64 nt, Homo Sapiens
auucaccacagcaggauaggugcuguuccauucuguguagcacccaaccaaucguagauguuuu

SEQ ID NO: 696049 - RNA, 64 nt, Homo Sapiens
cuugaaauguucuguuuaaauuccuucccuuucuguguagcaguugcugugcuggguuaacagc

SEQ ID NO: 696050 - RNA, 64 nt, Homo Sapiens
gaaagcaauaugauaugcuggaacccaauuguggguguagcaauaacacgagcacacucucuuc

SEQ ID NO: 696051 - RNA, 64 nt, Homo Sapiens
uuuuuuuaccaacagcauacuuaacagacuugcuguguagcaguuuuuuucugguggaguugcu

SEQ ID NO: 696052 - RNA, 64 nt, Homo Sapiens
gcaguauagaucugugcauagauauaugcauuaaguguagcaaaucgugauguaaauuuuuuac

SEQ ID NO: 696053 - RNA, 64 nt, Homo Sapiens
uacuagcaaagacaugggcaccggaguaggucccguguagcaugcgggugcuguagagaaaauu

SEQ ID NO: 696054 - RNA, 64 nt, Homo Sapiens
auaguaguuguuccuuagagcaauauguuguuacguguagcagaaauaaaguuuucuuugcuua

SEQ ID NO: 696055 - RNA, 64 nt, Homo Sapiens
uuauaguuuaauaguaagggagauaacacagcauguguagcaccaguugauaauuggucucuag

SEQ ID NO: 696056 - RNA, 64 nt, Homo Sapiens
uuaaagucugaaggacagcacucucaauaacucaguguagcacuaguguuauugaacuguaauu

SEQ ID NO: 696057 - RNA, 64 nt, Homo Sapiens
uuuuuuuuauucuucccacaucuaauuuuuaaagguguagcaccacuaagcauuuaaaagagaa

SEQ ID NO: 696058 - RNA, 64 nt, Homo Sapiens
uugcagaaaaacaggauuagaaaguaauuaugagguguagcagaauagucacuguuuaaggaaa

SEQ ID NO: 696059 - RNA, 64 nt, Homo Sapiens
uggcucucaggaaaaauacccgccucaugaaaguguguagcagguagaaguguacggucacggu

SEQ ID NO: 696060 - RNA, 64 nt, Homo Sapiens
uggaaauauuuauaaguuaucauuugcugccucaguguagcaauuaggacaaacauagauauga

SEQ ID NO: 696061 - RNA, 64 nt, Homo Sapiens
aguugaucagacugaaaaacuggcucuaaaguugguguagcagcuuuuuacuugaaauuaaauu

SEQ ID NO: 696062 - RNA, 64 nt, Homo Sapiens
cauuuuacagugccaugcacuaccacaagagagaguguagcaccuacuguauuuauaaacuuug

SEQ ID NO: 696063 - RNA, 64 nt, Homo Sapiens
guaauuauguacuaucaaacugcuagagucaccuguguagcauuugcaugccuuucuaaaggua

SEQ ID NO: 696064 - RNA, 64 nt, Homo Sapiens
uccccacucucucuuucuccgguaguuuaaaaguguguagcaccagugaguuaucgugagaucu

SEQ ID NO: 696065 - RNA, 64 nt, Homo Sapiens
gguacaaaggcaaaaggaccacagcaccacuuagguguagcauggauuuuaaacugcagucagu

SEQ ID NO: 696066 - RNA, 64 nt, Homo Sapiens
uagguaacauguuaaugagggaaaauguuuaccaguguagcauuggaucaaaaaguuuaucaca

SEQ ID NO: 696067 - RNA, 64 nt, Homo Sapiens
gacugugugcaccagucccagacacuuggcagaaguguagcagcguuacacaugugugcgaagc

SEQ ID NO: 696068 - RNA, 64 nt, Homo Sapiens
aaggcuuugggccugagagggaagaggaaggccuguguagcagaggcguguaucugguccuagu

SEQ ID NO: 696069 - RNA, 64 nt, Homo Sapiens
aucuugagaguccuuguucuugauugugaauacuguguagcagguccugaaucuugggcccuuu

SEQ ID NO: 696070 - RNA, 64 nt, Homo Sapiens
uugccagggaccccaccccugaggaaggggaccaguguagcaacgggacggguggugcuuaaaa

SEQ ID NO: 696071 - RNA, 64 nt, Homo Sapiens
uugagaagaggcuugggaguagugucuccuccucguguagcagcgagauggaauucaagagaga

SEQ ID NO: 696072 - RNA, 64 nt, Homo Sapiens
uguugcauuacaaagaaaaaguuggaucugagcuguguagcacuagccucuuuccccguguccc

SEQ ID NO: 696073 - RNA, 64 nt, Homo Sapiens
uaacuccuuuuccacuuuaacauacauauuccugguguagcacuuguuuuaugguuucauguaa

SEQ ID NO: 696074 - RNA, 64 nt, Homo Sapiens
cacugcaacagaugccuccuucaaaccagcccugguguagcagaagguguauuacaucagguuu

SEQ ID NO: 696075 - RNA, 64 nt, Homo Sapiens
agagggcagaauccgcagcucucaucauugugauguguagcaugucugcccucugacuggacau

SEQ ID NO: 696076 - RNA, 64 nt, Homo Sapiens
agaugagcccaaacuuucgaucuaggugggugauguguagcaguucaagggaagggugcugugu

SEQ ID NO: 696077 - RNA, 64 nt, Homo Sapiens
aaugaacaguaauugccugguagguuugguguguguguagcauuguguguccaucuguuauaug

SEQ ID NO: 696078 - RNA, 64 nt, Homo Sapiens
auuaaaagaaaacagcacagagaaguuaaaugcgguguagcaaaguuauggggucugcuugagg

SEQ ID NO: 696079 - RNA, 64 nt, Homo Sapiens
uguccucuuccuuauuccucuagugguugaagcuguguagcauuuuaacauauauauauucaca

SEQ ID NO: 696080 - RNA, 64 nt, Homo Sapiens
aacaucccaaggcugucccauaggguuggaaguuguguagcauucacucccuuaccuacuggca

SEQ ID NO: 696081 - RNA, 64 nt, Homo Sapiens
auucaauuacgggaacuaccuuaauuuuaguccuguguagcagaauaucugaagcucucguuca

SEQ ID NO: 696082 - RNA, 64 nt, Homo Sapiens
cuuuuauuaucuaauacuaucuuacgucuaauuaguguagcauuuacaagaaagaaaaauuaag

SEQ ID NO: 696083 - RNA, 64 nt, Homo Sapiens
cuguguacugcaguugguaugaccccucuaaggaguguagcaacuacagucuaaagcugguuua

SEQ ID NO: 696084 - RNA, 64 nt, Homo Sapiens
ugauuuuuauccaugcgucaguuuuucccacccaguguagcauccuaaagauaaagccagaagc

SEQ ID NO: 696085 - RNA, 64 nt, Homo Sapiens
uucagcagcaucuaucauguagauaaauucccagguguagcauuacagcuucugacuaauauag

SEQ ID NO: 696086 - RNA, 64 nt, Homo Sapiens
ccuaggcagggcuggcuuucuuagcguguaacuuguguagcagcacagggcccacacuuagaag

SEQ ID NO: 696087 - RNA, 64 nt, Homo Sapiens
aaaggaggccacaggagauuccugggagcacuggguguagcaaaacaaagccacucucugcuuc

SEQ ID NO: 696088 - RNA, 64 nt, Homo Sapiens
gaagaagccuguaacacuccucugcgucuauccuguguagcauacuggcuucaccaucaauccu

SEQ ID NO: 696089 - RNA, 64 nt, Homo Sapiens
uguaaauacaacagaacauuaauaaauaucucuuguguagcaccuuuuacuguagauuagugcu

SEQ ID NO: 696090 - RNA, 64 nt, Homo Sapiens
cugggacuaugguacuaaauccaguagaugggcuguguagcaacucucccagggaacacacuag

SEQ ID NO: 696091 - RNA, 64 nt, Homo Sapiens
ccagguguuguccgugucuguggggaggggcuccguguagcaacgcggcuuccccaucgccuuc

SEQ ID NO: 696092 - RNA, 64 nt, Homo Sapiens
uacucuuccuuaauggacagagaaacgguuuuaaguguagcaaccuauaucaggaacaucccug

SEQ ID NO: 696093 - RNA, 64 nt, Homo Sapiens
uuuaaaaauauauauguauauagucuuuuuuuauguguagcauaauauauucuguaaagugcca

SEQ ID NO: 696094 - RNA, 64 nt, Homo Sapiens
gcgcuaaacacuguggaggcccacauauauacauguguagcacaccacaugcaaacacacacag

SEQ ID NO: 696095 - RNA, 64 nt, Homo Sapiens
cccucagcauuguuuuucuccucccagcuugguuguguagcaaucgaaggaaccauccuugguu

SEQ ID NO: 696096 - RNA, 64 nt, Homo Sapiens
gugauuguaguuuaauacaggaacacacagggcuguguagcaugauaccaggcccaggagauca

SEQ ID NO: 696097 - RNA, 64 nt, Homo Sapiens
acuggagagguccacagccuuguccagaguuccuguguagcacggggagcaaugauggagggag

SEQ ID NO: 696098 - RNA, 64 nt, Homo Sapiens
cuugcugucugucucucucucaguacaguucaagguguagcaaguguacccacacagauagcau

SEQ ID NO: 696099 - RNA, 64 nt, Homo Sapiens
uguuaauaagaccaaauuaaaaaggcuaguggcuguguagcauccucagugcaaaacccagcuc

SEQ ID NO: 696100 - RNA, 64 nt, Homo Sapiens
ugcuaagcccaaagauuacauguugguguucaaaguguagcaaaaaaugauguauauuuauaaa

SEQ ID NO: 696101 - RNA, 64 nt, Homo Sapiens
aaaggaaaaaaaaaucuucagaugcaaugguuuuguguagcaucuugucuaucauguuuuguaa

SEQ ID NO: 696102 - RNA, 64 nt, Homo Sapiens
ucagugguauuuugcauuggaaaaaggaagcacuguguagcagugaauugucugcuuuccaccg

SEQ ID NO: 696103 - RNA, 64 nt, Homo Sapiens
cauuaacgaugacagggguacugucaccgcuucuguguagcaaacgaggcucccagagcagccu

SEQ ID NO: 696104 - RNA, 64 nt, Homo Sapiens
uugaaacauuauuuuuuuuuaacaguaguaccacguguagcauuuauuuugaucaaacugugca

SEQ ID NO: 696105 - RNA, 64 nt, Homo Sapiens
ucucuauauaaauauauaaauuuauauguuuccaguguagcagaauucauaguaaaguucguuu

SEQ ID NO: 696106 - RNA, 64 nt, Homo Sapiens
uuugacuuugcaauaacgugcuaccauauuuuaaguguagcagcauuugauuuuucuaaacuau

SEQ ID NO: 696107 - RNA, 64 nt, Homo Sapiens
agggucuggacaugcaucuccuaaaggaagaacuguguagcaccauugaucacaauguaacauu

SEQ ID NO: 696108 - RNA, 64 nt, Homo Sapiens
gggaagucccuuauuuggaagagagaaaggauguguguagcacacacucaucauggauugcuca

SEQ ID NO: 696109 - RNA, 64 nt, Homo Sapiens
agagccagucacuucccuccgcuaacagucuccaguguagcaggggaaauccauucagaaauga

SEQ ID NO: 696110 - RNA, 64 nt, Homo Sapiens
uagcuuacaaggggacaauugguauucagggacaguguagcaagggugacuguauaaaguuagu

SEQ ID NO: 696111 - RNA, 64 nt, Homo Sapiens
uuaggaauauuuuucucccccuaccccauaaauuguguagcacuuuuuauuccauuugcuuuca

SEQ ID NO: 696112 - RNA, 64 nt, Homo Sapiens
ucauaccuaguuuuauaagcuguucuguaacauaguguagcaaaaaaaaaaguucaagucaugu

SEQ ID NO: 696113 - RNA, 64 nt, Homo Sapiens
uuaaagucauuuguaauguuauuguauaguuauuguguagcacauaugguuugcacuguauagu

SEQ ID NO: 696114 - RNA, 64 nt, Homo Sapiens
guccacauguaaauuuauaggcugcaucccagguguguagcaaaaauggaacaaaacucaucug

SEQ ID NO: 696115 - RNA, 64 nt, Homo Sapiens
augccaaccagcccugcgcggggaggucucgggaguguagcaccgcuguucuuggggagaagga

SEQ ID NO: 696116 - RNA, 64 nt, Homo Sapiens
gggggagaagugagaagugucagaauauccuccaguguagcacacuuucuugcacauuaggaag

SEQ ID NO: 696117 - RNA, 64 nt, Homo Sapiens
gcacaauauagaucucagucucuccucaaaccuuguguagcauuggggucuuuucagucuuccc

SEQ ID NO: 696118 - RNA, 64 nt, Homo Sapiens
agacuuaggacucaugugcaguaaauauaaauaaguguagcaucagaagcaguaggaauggccg

SEQ ID NO: 696119 - RNA, 64 nt, Homo Sapiens
uaaguugucuaugggcacaaaguuuucuucauuuguguagcaaacuucuugugaauguggauua

SEQ ID NO: 696120 - RNA, 64 nt, Homo Sapiens
gcaaaaggcccugcucucuggaguguuguauauaguguagcaaaagaguauuuauacaucccac

SEQ ID NO: 696121 - RNA, 64 nt, Homo Sapiens
agguguaugcaguugugaccccauguguggggaaguguagcaaggacggcugguggagggggaa

SEQ ID NO: 696122 - RNA, 64 nt, Homo Sapiens
gugugguauggcuacacagauacucauguuccugguguagcaacguauauguaaugguuauaug

SEQ ID NO: 696123 - RNA, 51 nt, Homo Sapiens
aaaaggcugugcugcccugagguguagcagaacuuugcccuggccgaguga

SEQ ID NO: 696124 - RNA, 64 nt, Homo Sapiens
uaaauuuccuauaccuucugauuuuuguaaaacuguguagcauugcaaaaaaaauuuuuuagca

SEQ ID NO: 696125 - RNA, 64 nt, Homo Sapiens
gaacugcacuaggauuaauuucauugcuaaaaauguguagcacaccagaagaugucugcauuac

SEQ ID NO: 696126 - RNA, 64 nt, Homo Sapiens
uuuugagccaauuaagaaaauugccauuuuuaaaguguagcauuucaggguaaagacccaugaa

SEQ ID NO: 696127 - RNA, 64 nt, Homo Sapiens
cuuaggggccaacaaggcuuccagcuggauguguguguagcauguaccuuauuauuuuuguuac

SEQ ID NO: 696128 - RNA, 64 nt, Homo Sapiens
uguuuccccuuacugauaagcggccacuuuaggaguguagcaaauauagauugagcuauguuag

SEQ ID NO: 696129 - RNA, 64 nt, Homo Sapiens
cuuggguguggguuccucuuguuuugguuauuuuguguagcaguuuaaucaguggauaacugag

SEQ ID NO: 696130 - RNA, 64 nt, Homo Sapiens
gauucuggacagucagcucuucaucugcccaacuguguagcaucugcauugcccagucuuucau

SEQ ID NO: 696131 - RNA, 64 nt, Homo Sapiens
uuucuguccuagcuggagguguaaaaugcacaauguguagcagguagaauacagcuccuuaucg

SEQ ID NO: 696132 - RNA, 64 nt, Homo Sapiens
gguuuugccuaguguuccaaauacauuauguacaguguagcagugagauaagaaacauaguuuu

SEQ ID NO: 696133 - RNA, 64 nt, Homo Sapiens
aauuacacgaggcaaacaguaaauuugcucggguguguagcaguccuuuaaagauacaguguga

SEQ ID NO: 696134 - RNA, 64 nt, Homo Sapiens
uuguucacuguggaggaguuccucaucaaggaauguguagcagaugugguaagcuagguucauu

SEQ ID NO: 696135 - RNA, 64 nt, Homo Sapiens
auugguuuuccaaaaaaugucagaucuggaaacaguguagcagccccaaguucagcuuuggagg

SEQ ID NO: 696136 - RNA, 58 nt, Homo Sapiens
aagaucugacucaagacugacucugauaguguagcauuuucccugggggaguuuuggu

SEQ ID NO: 696137 - RNA, 64 nt, Homo Sapiens
aaaugauugucacacaugucacuguagccucuugguguagcaagcucacauacaaaauacuuuu

SEQ ID NO: 696138 - RNA, 64 nt, Homo Sapiens
uaaugaucaguuuacuuucaguggauucagaauuguguagcaggauaaccuuguauuuuuccau

SEQ ID NO: 696139 - RNA, 64 nt, Homo Sapiens
uuggccuacaggacagauuuugccugggcgcugcguguagcaucggcgcucacuuaccucugac

SEQ ID NO: 696140 - RNA, 64 nt, Homo Sapiens
ugcugcaacguugccugcuggccucuuugcuacuguguagcacccaccggggccacuuccggcu

SEQ ID NO: 696141 - RNA, 64 nt, Homo Sapiens
gugccuugcaugcaguaggcaaauaauauaauugguguagcacagcugugaaguuuuaaggaau

SEQ ID NO: 696142 - RNA, 64 nt, Homo Sapiens
accuuuuuuucucuccuaagacaccugcaauaaaguguagcacccugguacaucugugauguuu

SEQ ID NO: 696143 - RNA, 64 nt, Homo Sapiens
cuuuucuuugaaauacaauaauuuauauagaaauguguagcagcaaauuauauuggggauuaga

SEQ ID NO: 696144 - RNA, 64 nt, Homo Sapiens
ccaaccuggauggggguuuggggaaggagggcauguguagcagagaacuuaggggggccuccuu

SEQ ID NO: 696145 - RNA, 64 nt, Homo Sapiens
cacuguagcuauuagcggcuccucgcccccaccaguguagcaucuuccucugcagaauaaaauc

SEQ ID NO: 696146 - RNA, 64 nt, Homo Sapiens
cucaauaaauggccuauaugugcaaagaaagaauguguagcaaaugaaaauaccagaccaagaa

SEQ ID NO: 696147 - RNA, 64 nt, Homo Sapiens
uccuuuucccuccaugcuccagguccaugcacagguguagcauguccugcuuccguuuuucaua

SEQ ID NO: 696148 - RNA, 64 nt, Homo Sapiens
cugccauucccuucuacugcacugcccaagguguguguagcacaaacaguucucauuacaaagg

SEQ ID NO: 696149 - RNA, 64 nt, Homo Sapiens
uacgagggcagucuuaacuuguguuaaggccuguguguagcauugaagguaaguaugaaggagu

SEQ ID NO: 696150 - RNA, 64 nt, Homo Sapiens
gaauuacacugugggaaaacuaccauuguaauaaguguagcaaaaucuccuuagauaucugaaa

SEQ ID NO: 696151 - RNA, 64 nt, Homo Sapiens
auuaugaaaauagcuugaccgacaaauaacaucuguguagcagugagagaaugagagugaaagg

SEQ ID NO: 696152 - RNA, 64 nt, Homo Sapiens
cucacuggccguuuguuuuuauaugggcaaaaugguguagcaggcaucagaaguuacaauaggc

SEQ ID NO: 696153 - RNA, 64 nt, Homo Sapiens
ugacagagaauaacucagaauaucucuaucgauuguguagcaauuagaauuuucucccuuuaug

SEQ ID NO: 696154 - RNA, 64 nt, Homo Sapiens
gagauuaagcgugcuaacuguagacgggaacacgguguagcaugaagauacucaucuuucuaca

SEQ ID NO: 696155 - RNA, 64 nt, Homo Sapiens
ucagauugagcacuucacuaaagucaaaggaccuguguagcauuugauauguaagcuugaccua

SEQ ID NO: 696156 - RNA, 64 nt, Homo Sapiens
cucagagguaggcaaguuuguccccauccacugaguguagcaucuucaccagugacagaugguu

SEQ ID NO: 696157 - RNA, 64 nt, Homo Sapiens
uuagggaugaagaguucaaacuugguuuugaucaguguagcaaaauggacuucaggagcccuua

SEQ ID NO: 696158 - RNA, 64 nt, Homo Sapiens
ggcuuuuucuaaagaggauggcagaacuuccaacguguagcaauacuauaagaaccaagguagc

SEQ ID NO: 696159 - RNA, 64 nt, Homo Sapiens
uguuuuauagcuccaaaugguuuuuuuauucucaguguagcaacuguuugauuucuuucuggau

SEQ ID NO: 696160 - RNA, 64 nt, Homo Sapiens
uacugucuuuaaaaauuaaguaagguuucauucaguguagcaauuacuuauaaugaaacuucau

SEQ ID NO: 696161 - RNA, 64 nt, Homo Sapiens
gaaauauucugucagcuuuuuauagaacuguuuuguguagcauguuuaaaacuguaaagcugug

SEQ ID NO: 696162 - RNA, 64 nt, Homo Sapiens
augaaaagguuuauauucacuauucuuuauuucaguguagcacuuuuagagccaaaaaaacuca

SEQ ID NO: 696163 - RNA, 64 nt, Homo Sapiens
acagugaagggaaaagagucugugaaggugaucaguguagcaguaagacaucuaaaaucaagac

SEQ ID NO: 696164 - RNA, 64 nt, Homo Sapiens
uucagaagaggcuaucaaagguggaaaagaaaagguguagcacucagccauaacaaguuuacuu

SEQ ID NO: 696165 - RNA, 64 nt, Homo Sapiens
gggguguguacaacuuaacaagaugaaggaguguguguagcaugguaugaaaacacugagaagg

SEQ ID NO: 696166 - RNA, 64 nt, Homo Sapiens
ucacaugugaccauguuggagguacuaggugcaaguguagcaugauugaaguaucagcuuguuu

SEQ ID NO: 696167 - RNA, 64 nt, Homo Sapiens
cugagaaguggguucaggcgaagggugaagccauguguagcaguuccugccagugcagaucugg

SEQ ID NO: 696168 - RNA, 64 nt, Homo Sapiens
acgucaguauuguuuuaaaguuucugucuguaaaguguagcaucauauauaaaaagaguuucgc

SEQ ID NO: 696169 - RNA, 53 nt, Homo Sapiens
gaucucgcuccuguguuuccuagguguagcagagcaggcccccuccccgcuaa

SEQ ID NO: 696170 - RNA, 64 nt, Homo Sapiens
acacuuguucagguuugcaucgauuuucaguuuaguguagcagcuuuaauuguaaaaugagaac

SEQ ID NO: 696171 - RNA, 64 nt, Homo Sapiens
cugugaaguuucugucauucguccagaucuguguguguagcaugugcugaggaagcacgugcug

SEQ ID NO: 696172 - RNA, 64 nt, Homo Sapiens
aggaaaaucacaauuacaccacuuuagacccuauguguagcaggucacaacuuacccuugugug

SEQ ID NO: 696173 - RNA, 64 nt, Homo Sapiens
acugcugugaggcagaggaaugauggagaaucuaguguagcagccuccaggcaggauucagcac

SEQ ID NO: 696174 - RNA, 64 nt, Homo Sapiens
aaaagauuuauuagaaaauucucacgcugaacugguguagcauguggugcagcauucagugaaa

SEQ ID NO: 696175 - RNA, 64 nt, Homo Sapiens
gaccuguggucuccaugccugugcccucacacagguguagcacacgcaugugcagauggcacca

SEQ ID NO: 696176 - RNA, 64 nt, Homo Sapiens
gaagaugcccacgugccugaccaccaggcgcccaguguagcacgguggaaccguuccugaaagg

SEQ ID NO: 696177 - RNA, 64 nt, Homo Sapiens
cuccugccugcuccaagaaacccaugaggacaaaguguagcagcucacuggggucuguguggug

SEQ ID NO: 696178 - RNA, 64 nt, Homo Sapiens
aagaaaaagccccuucuccaauugcauaacuggcguguagcacagaauaagugaauguuucuuu

SEQ ID NO: 696179 - RNA, 64 nt, Homo Sapiens
ugaguaaugcugguuagcugcacuaggcgcaguuguguagcaguuucucuuauguauuuuugug

SEQ ID NO: 696180 - RNA, 64 nt, Homo Sapiens
ccuaccaggucccuuucaucgucguugcaagacuguguagcagguuuugcagaaacuuuugagg

SEQ ID NO: 696181 - RNA, 64 nt, Homo Sapiens
acuguugcuaaaaaaagucauguaguuucauguaguguagcauccuuggcaucguuuuccaaaa

SEQ ID NO: 696182 - RNA, 64 nt, Homo Sapiens
uguuaccugaagacgugcuauugaagccagcuguguguagcagccaucaacaggggagcuaaag

SEQ ID NO: 696183 - RNA, 64 nt, Homo Sapiens
agccagccauauauuuucaguucaugagugacaaguguagcaaaggucuuaugcucauaagcag

SEQ ID NO: 696184 - RNA, 64 nt, Homo Sapiens
gcugugaauccccugggcagggggcgacaacuccguguagcauuaacccccguggcgggguccg

SEQ ID NO: 696185 - RNA, 64 nt, Homo Sapiens
cagacuuacagaagaaguggcccuccauagacauguguagcaucaaaacacaaaggcccacacu

SEQ ID NO: 696186 - RNA, 64 nt, Homo Sapiens
ugcaggccgguggguccacuccaacucccccugaguguagcagcacacuuuccauacaccaggu

SEQ ID NO: 696187 - RNA, 64 nt, Homo Sapiens
aacaacucuuauuucacaaaaagguaaaaaucacguguagcaagaagucaauggagaagacaga

SEQ ID NO: 696188 - RNA, 64 nt, Homo Sapiens
acgacguuauguuuggguaaugcaacacaucuacguguagcacuucauugccauagcaucauga

SEQ ID NO: 696189 - RNA, 64 nt, Homo Sapiens
cuuauggucuugcagaacacaucagaagggcugcguguagcaccugaacccagguuaggggcag

SEQ ID NO: 696190 - RNA, 64 nt, Homo Sapiens
cagucauucauccaggccacguuuccucugcggaguguagcagcccugccuuucauagcaggga

SEQ ID NO: 696191 - RNA, 64 nt, Homo Sapiens
uucucucccuugaaggcugacugaaauccccgagguguagcaucauuugcucucuacugauugg

SEQ ID NO: 696192 - RNA, 64 nt, Homo Sapiens
uuacuuucagggggcugcuuuccugggccaggcuguguagcacuucccacccucaggcaugagu

SEQ ID NO: 696193 - RNA, 64 nt, Homo Sapiens
uggggagacagcaggaucacaaguugggaguguaguguagcauccucugcucuugggaguguaa

SEQ ID NO: 696194 - RNA, 64 nt, Homo Sapiens
ccccaaccucccugacuuccuucaguaacugacaguguagcauuguucuugauuaguuuggcac

SEQ ID NO: 696195 - RNA, 64 nt, Homo Sapiens
cuggaauauuguguaaacuaucugucuuacauuaguguagcauuuugcaauuuggggaacaucu

SEQ ID NO: 696196 - RNA, 64 nt, Homo Sapiens
aagguggaugcacuucccgcaccuccagucuucuguguagcagcuuuaacccacguuugucugu

SEQ ID NO: 696197 - RNA, 64 nt, Homo Sapiens
uguccugggcccugccacccgucugggcuccuuuguguagcauuaucagccucggucuggccuc

SEQ ID NO: 696198 - RNA, 64 nt, Homo Sapiens
auaucuaugucuauaucaucugauaguuaauuauuucaacuaauccugcugagcuccaguauuu

SEQ ID NO: 696199 - RNA, 64 nt, Homo Sapiens
uauugaaugauuacuauauguucacauaguuuauuucaacuauuaaguagaggcaaugcaaaga

SEQ ID NO: 696200 - RNA, 64 nt, Homo Sapiens; identical to SEQ ID NO: 343068

SEQ ID NO: 696201 - RNA, 64 nt, Homo Sapiens; identical to SEQ ID NO: 343069

SEQ ID NO: 696202 - RNA, 64 nt, Homo Sapiens; identical to SEQ ID NO: 343070

SEQ ID NO: 696203 - RNA, 64 nt, Homo Sapiens; identical to SEQ ID NO: 343071

SEQ ID NO: 696204 - RNA, 64 nt, Homo Sapiens; identical to SEQ ID NO: 343072

SEQ ID NO: 696205 - RNA, 64 nt, Homo Sapiens; identical to SEQ ID NO: 343073

SEQ ID NO: 696206 - RNA, 64 nt, Homo Sapiens; identical to SEQ ID NO: 411037

SEQ ID NO: 696207 - RNA, 64 nt, Homo Sapiens; identical to SEQ ID NO: 411038

SEQ ID NO: 696208 - RNA, 64 nt, Homo Sapiens; identical to SEQ ID NO: 411039

SEQ ID NO: 696209 - RNA, 64 nt, Homo Sapiens; identical to SEQ ID NO: 411040

SEQ ID NO: 696210 - RNA, 64 nt, Homo Sapiens; identical to SEQ ID NO: 411041

SEQ ID NO: 696211 - RNA, 64 nt, Homo Sapiens; identical to SEQ ID NO: 411042

SEQ ID NO: 696212 - RNA, 64 nt, Homo Sapiens; identical to SEQ ID NO: 411043

SEQ ID NO: 696213 - RNA, 64 nt, Homo Sapiens; identical to SEQ ID NO: 411044

SEQ ID NO: 696214 - RNA, 64 nt, Homo Sapiens; identical to SEQ ID NO: 411045

SEQ ID NO: 696215 - RNA, 64 nt, Homo Sapiens; identical to SEQ ID NO: 411046

SEQ ID NO: 696216 - RNA, 64 nt, Homo Sapiens; identical to SEQ ID NO: 411047

SEQ ID NO: 696217 - RNA, 64 nt, Homo Sapiens; identical to SEQ ID NO: 411048

SEQ ID NO: 696218 - RNA, 64 nt, Homo Sapiens; identical to SEQ ID NO: 411049

SEQ ID NO: 696219 - RNA, 64 nt, Homo Sapiens; identical to SEQ ID NO: 411050

SEQ ID NO: 696220 - RNA, 64 nt, Homo Sapiens; identical to SEQ ID NO: 411051

SEQ ID NO: 696221 - RNA, 64 nt, Homo Sapiens; identical to SEQ ID NO: 411052

SEQ ID NO: 696222 - RNA, 64 nt, Homo Sapiens; identical to SEQ ID NO: 411053

SEQ ID NO: 696223 - RNA, 64 nt, Homo Sapiens; identical to SEQ ID NO: 411054

SEQ ID NO: 696224 - RNA, 64 nt, Homo Sapiens; identical to SEQ ID NO: 411055

SEQ ID NO: 696225 - RNA, 64 nt, Homo Sapiens; identical to SEQ ID NO: 411056

SEQ ID NO: 696226 - RNA, 64 nt, Homo Sapiens; identical to SEQ ID NO: 411057

SEQ ID NO: 696227 - RNA, 64 nt, Homo Sapiens; identical to SEQ ID NO: 411058

SEQ ID NO: 696228 - RNA, 64 nt, Homo Sapiens; identical to SEQ ID NO: 411059

SEQ ID NO: 696229 - RNA, 64 nt, Homo Sapiens; identical to SEQ ID NO: 411060

SEQ ID NO: 696230 - RNA, 64 nt, Homo Sapiens; identical to SEQ ID NO: 411061

SEQ ID NO: 696231 - RNA, 64 nt, Homo Sapiens; identical to SEQ ID NO: 411062

SEQ ID NO: 696232 - RNA, 64 nt, Homo Sapiens; identical to SEQ ID NO: 411063

SEQ ID NO: 696233 - RNA, 64 nt, Homo Sapiens; identical to SEQ ID NO: 411064

SEQ ID NO: 696234 - RNA, 64 nt, Homo Sapiens; identical to SEQ ID NO: 411065

SEQ ID NO: 696235 - RNA, 64 nt, Homo Sapiens; identical to SEQ ID NO: 411066

SEQ ID NO: 696236 - RNA, 64 nt, Homo Sapiens; identical to SEQ ID NO: 411067

SEQ ID NO: 696237 - RNA, 64 nt, Homo Sapiens; identical to SEQ ID NO: 411068

SEQ ID NO: 696238 - RNA, 64 nt, Homo Sapiens; identical to SEQ ID NO: 411069

SEQ ID NO: 696239 - RNA, 64 nt, Homo Sapiens; identical to SEQ ID NO: 411070

SEQ ID NO: 696240 - RNA, 64 nt, Homo Sapiens; identical to SEQ ID NO: 411071

SEQ ID NO: 696241 - RNA, 64 nt, Homo Sapiens; identical to SEQ ID NO: 411072

SEQ ID NO: 696242 - RNA, 64 nt, Homo Sapiens; identical to SEQ ID NO: 411073

SEQ ID NO: 696243 - RNA, 64 nt, Homo Sapiens; identical to SEQ ID NO: 411074

SEQ ID NO: 696244 - RNA, 64 nt, Homo Sapiens; identical to SEQ ID NO: 411075

SEQ ID NO: 696245 - RNA, 64 nt, Homo Sapiens; identical to SEQ ID NO: 411076

SEQ ID NO: 696246 - RNA, 64 nt, Homo Sapiens; identical to SEQ ID NO: 411077

SEQ ID NO: 696247 - RNA, 64 nt, Homo Sapiens; identical to SEQ ID NO: 411078

SEQ ID NO: 696248 - RNA, 64 nt, Homo Sapiens; identical to SEQ ID NO: 411079

SEQ ID NO: 696249 - RNA, 64 nt, Homo Sapiens; identical to SEQ ID NO: 411080

SEQ ID NO: 696250 - RNA, 64 nt, Homo Sapiens; identical to SEQ ID NO: 411081

SEQ ID NO: 696251 - RNA, 64 nt, Homo Sapiens; identical to SEQ ID NO: 411082

SEQ ID NO: 696252 - RNA, 64 nt, Homo Sapiens; identical to SEQ ID NO: 411083

SEQ ID NO: 696253 - RNA, 64 nt, Homo Sapiens; identical to SEQ ID NO: 411084

SEQ ID NO: 696254 - RNA, 64 nt, Homo Sapiens; identical to SEQ ID NO: 411085

SEQ ID NO: 696255 - RNA, 64 nt, Homo Sapiens; identical to SEQ ID NO: 411086

SEQ ID NO: 696256 - RNA, 64 nt, Homo Sapiens; identical to SEQ ID NO: 411087

SEQ ID NO: 696257 - RNA, 64 nt, Homo Sapiens; identical to SEQ ID NO: 411088

SEQ ID NO: 696258 - RNA, 62 nt, Homo Sapiens
guguguccaguuuggccuccugcccaaacuguccauuccagcagcuccugcccccuucucug

SEQ ID NO: 696259 - RNA, 62 nt, Homo Sapiens
ugccccauccucucucugaagccagggcccuuccauuccauuuagccuuuggaucauccugg

SEQ ID NO: 696260 - RNA, 62 nt, Homo Sapiens
gauugccuguuucugauuugcugcucuucaucccauuccaggcagccucugucaggccuuca

SEQ ID NO: 696261 - RNA, 62 nt, Homo Sapiens
ccuggaauugccagcugacaucuugaauccuuccauuccacacagaaugcaaccaagucaca

SEQ ID NO: 696262 - RNA, 62 nt, Homo Sapiens
ucaggucaaaccaagccaagagcacccuguccccauuccaaggggccagcagcacuuuggcc

SEQ ID NO: 696263 - RNA, 62 nt, Homo Sapiens
agggugauggguagagcuuuccagaaccuucuccauuccagaaucucugccccuguguaauc

SEQ ID NO: 696264 - RNA, 62 nt, Homo Sapiens
agaaccuuugauucugcacauuccgaagugaaccauuccaccauccgcacugcccuugggac

SEQ ID NO: 696265 - RNA, 62 nt, Homo Sapiens
ccaccuguuuccccuuccaugguuccaccuuuccauuccaaaggagcacauuuuguggaccu

SEQ ID NO: 696266 - RNA, 62 nt, Homo Sapiens
ugugcaaucuuugcuucuuguaggcuaucgccccauuccagcggagacuuauguaggaggga

SEQ ID NO: 696267 - RNA, 62 nt, Homo Sapiens
acaccaggcacccucugccacuuagacauaauccauuccacucauuauuccagcaaacacuu

SEQ ID NO: 696268 - RNA, 62 nt, Homo Sapiens
ugguguacuguucugauuuuuaaauuguuugaccauuccagucaccauuaaaacauuugacu

SEQ ID NO: 696269 - RNA, 62 nt, Homo Sapiens
gugaggugucauucccugcagccugccagugcccauuccacuaaggacugcuucugcccucu

SEQ ID NO: 696270 - RNA, 62 nt, Homo Sapiens
gauugauucucaccagcguuuacucguccccgccauuccagguccagauugguuuaaccaau

SEQ ID NO: 696271 - RNA, 62 nt, Homo Sapiens
caucucuggccugagugacauuuccaggaccuccauuccacuugccucccacugaauggcag

SEQ ID NO: 696272 - RNA, 64 nt, Homo Sapiens; identical to SEQ ID NO: 579631

SEQ ID NO: 696273 - RNA, 64 nt, Homo Sapiens; identical to SEQ ID NO: 579632

SEQ ID NO: 696274 - RNA, 64 nt, Homo Sapiens; identical to SEQ ID NO: 579633

SEQ ID NO: 696275 - RNA, 64 nt, Homo Sapiens; identical to SEQ ID NO: 579634

SEQ ID NO: 696276 - RNA, 64 nt, Homo Sapiens; identical to SEQ ID NO: 579635

SEQ ID NO: 696277 - RNA, 64 nt, Homo Sapiens; identical to SEQ ID NO: 579636

SEQ ID NO: 696278 - RNA, 62 nt, Homo Sapiens; identical to SEQ ID NO: 275089

SEQ ID NO: 696279 - RNA, 64 nt, Homo Sapiens; identical to SEQ ID NO: 579638

SEQ ID NO: 696280 - RNA, 64 nt, Homo Sapiens; identical to SEQ ID NO: 579639

SEQ ID NO: 696281 - RNA, 64 nt, Homo Sapiens; identical to SEQ ID NO: 579640

SEQ ID NO: 696282 - RNA, 64 nt, Homo Sapiens; identical to SEQ ID NO: 579641

SEQ ID NO: 696283 - RNA, 64 nt, Homo Sapiens; identical to SEQ ID NO: 579642

SEQ ID NO: 696284 - RNA, 64 nt, Homo Sapiens; identical to SEQ ID NO: 579643

SEQ ID NO: 696285 - RNA, 64 nt, Homo Sapiens; identical to SEQ ID NO: 579644

SEQ ID NO: 696286 - RNA, 64 nt, Homo Sapiens; identical to SEQ ID NO: 579645

SEQ ID NO: 696287 - RNA, 64 nt, Homo Sapiens; identical to SEQ ID NO: 579646

SEQ ID NO: 696288 - RNA, 64 nt, Homo Sapiens; identical to SEQ ID NO: 579647

SEQ ID NO: 696289 - RNA, 64 nt, Homo Sapiens; identical to SEQ ID NO: 579648

SEQ ID NO: 696290 - RNA, 64 nt, Homo Sapiens; identical to SEQ ID NO: 579649

SEQ ID NO: 696291 - RNA, 64 nt, Homo Sapiens; identical to SEQ ID NO: 579650

SEQ ID NO: 696292 - RNA, 64 nt, Homo Sapiens; identical to SEQ ID NO: 579651

SEQ ID NO: 696293 - RNA, 64 nt, Homo Sapiens; identical to SEQ ID NO: 579652

SEQ ID NO: 696294 - RNA, 64 nt, Homo Sapiens
guguucaccucacacuaagggauuuccauaauguagcaguuaccuauuuaacuaaggcccaacc

SEQ ID NO: 696295 - RNA, 64 nt, Homo Sapiens
aaggaaauauugcuaaaaugaauucauuauuaccagcaguuaugacaugauugcugacuuggau

SEQ ID NO: 696296 - RNA, 64 nt, Homo Sapiens
acuuaaucuguaaauugaauauuuuuuagcagauagcaguuagcuaauuuauuguuuuaaauua

SEQ ID NO: 696297 - RNA, 64 nt, Homo Sapiens
gcaaaaccucagugauuacauggugaaaggaaauagcaguuacaugagacaaaaguugaggacu

SEQ ID NO: 696298 - RNA, 64 nt, Homo Sapiens
cuuuuagauaaaucaaaugagccaucagugaggcagcaguuacuucaaggauaugauauguuaa

SEQ ID NO: 696299 - RNA, 64 nt, Homo Sapiens
uugggaggcugaggugggcauaucaccugaggucagcaguuaaagaccagccugaccaaaaugg

SEQ ID NO: 696300 - RNA, 64 nt, Homo Sapiens
auaaagaggauuaaacccuuaugcuucugaucucagcaguuauaaccucaaagaauauuugcac

SEQ ID NO: 696301 - RNA, 64 nt, Homo Sapiens
gacuggcuagaggucucuugauucaggauggagaagcaguuagucuucaaguaaacaaagcaau

SEQ ID NO: 696302 - RNA, 64 nt, Homo Sapiens
cccuuaccugaaggcuucaagaaagaauuccugcagcaguuauuaaacagcuuaaauucuucaa

SEQ ID NO: 696303 - RNA, 64 nt, Homo Sapiens
uaguuaguuacucacucuagggauagcuuuauaaagcaguuaguuauauggcauaugaauacca

SEQ ID NO: 696304 - RNA, 64 nt, Homo Sapiens
ccuguugagcaguuuacuucgaaaacaccuauugagcaguuauaaaauugggacucaacucuuu

SEQ ID NO: 696305 - RNA, 64 nt, Homo Sapiens
cuaacccuuaauuaucuuacgccuuugcugagacagcaguuacaacaagacaacuacaguuccu

SEQ ID NO: 696306 - RNA, 64 nt, Homo Sapiens; identical to SEQ ID NO: 80199

SEQ ID NO: 696307 - RNA, 64 nt, Homo Sapiens; identical to SEQ ID NO: 80200

SEQ ID NO: 696308 - RNA, 64 nt, Homo Sapiens; identical to SEQ ID NO: 80201

SEQ ID NO: 696309 - RNA, 64 nt, Homo Sapiens; identical to SEQ ID NO: 80202

SEQ ID NO: 696310 - RNA, 64 nt, Homo Sapiens; identical to SEQ ID NO: 80203

SEQ ID NO: 696311 - RNA, 64 nt, Homo Sapiens; identical to SEQ ID NO: 80204

SEQ ID NO: 696312 - RNA, 64 nt, Homo Sapiens; identical to SEQ ID NO: 80205

SEQ ID NO: 696313 - RNA, 64 nt, Homo Sapiens; identical to SEQ ID NO: 80206

SEQ ID NO: 696314 - RNA, 64 nt, Homo Sapiens; identical to SEQ ID NO: 80207

SEQ ID NO: 696315 - RNA, 64 nt, Homo Sapiens; identical to SEQ ID NO: 80208

SEQ ID NO: 696316 - RNA, 64 nt, Homo Sapiens; identical to SEQ ID NO: 80209

SEQ ID NO: 696317 - RNA, 64 nt, Homo Sapiens; identical to SEQ ID NO: 80210

SEQ ID NO: 696318 - RNA, 64 nt, Homo Sapiens; identical to SEQ ID NO: 80211

SEQ ID NO: 696319 - RNA, 64 nt, Homo Sapiens; identical to SEQ ID NO: 80212

SEQ ID NO: 696320 - RNA, 64 nt, Homo Sapiens; identical to SEQ ID NO: 80213

SEQ ID NO: 696321 - RNA, 64 nt, Homo Sapiens; identical to SEQ ID NO: 80214

SEQ ID NO: 696322 - RNA, 64 nt, Homo Sapiens; identical to SEQ ID NO: 80215

SEQ ID NO: 696323 - RNA, 64 nt, Homo Sapiens; identical to SEQ ID NO: 80216

SEQ ID NO: 696324 - RNA, 64 nt, Homo Sapiens; identical to SEQ ID NO: 80217

SEQ ID NO: 696325 - RNA, 64 nt, Homo Sapiens; identical to SEQ ID NO: 80218

SEQ ID NO: 696326 - RNA, 64 nt, Homo Sapiens; identical to SEQ ID NO: 80219

SEQ ID NO: 696327 - RNA, 64 nt, Homo Sapiens; identical to SEQ ID NO: 80220

SEQ ID NO: 696328 - RNA, 64 nt, Homo Sapiens; identical to SEQ ID NO: 80221

SEQ ID NO: 696329 - RNA, 64 nt, Homo Sapiens; identical to SEQ ID NO: 80222

SEQ ID NO: 696330 - RNA, 64 nt, Homo Sapiens; identical to SEQ ID NO: 80223

SEQ ID NO: 696331 - RNA, 64 nt, Homo Sapiens; identical to SEQ ID NO: 80224

SEQ ID NO: 696332 - RNA, 64 nt, Homo Sapiens; identical to SEQ ID NO: 80225

SEQ ID NO: 696333 - RNA, 64 nt, Homo Sapiens; identical to SEQ ID NO: 80226

SEQ ID NO: 696334 - RNA, 64 nt, Homo Sapiens; identical to SEQ ID NO: 80227

SEQ ID NO: 696335 - RNA, 64 nt, Homo Sapiens; identical to SEQ ID NO: 80228

SEQ ID NO: 696336 - RNA, 64 nt, Homo Sapiens; identical to SEQ ID NO: 80229

SEQ ID NO: 696337 - RNA, 64 nt, Homo Sapiens; identical to SEQ ID NO: 80230

SEQ ID NO: 696338 - RNA, 64 nt, Homo Sapiens; identical to SEQ ID NO: 80231

SEQ ID NO: 696339 - RNA, 52 nt, Homo Sapiens; identical to SEQ ID NO: 80232

SEQ ID NO: 696340 - RNA, 64 nt, Homo Sapiens; identical to SEQ ID NO: 80233

SEQ ID NO: 696341 - RNA, 64 nt, Homo Sapiens; identical to SEQ ID NO: 80234

SEQ ID NO: 696342 - RNA, 64 nt, Homo Sapiens; identical to SEQ ID NO: 80235

SEQ ID NO: 696343 - RNA, 64 nt, Homo Sapiens; identical to SEQ ID NO: 80236

SEQ ID NO: 696344 - RNA, 64 nt, Homo Sapiens; identical to SEQ ID NO: 80237

SEQ ID NO: 696345 - RNA, 64 nt, Homo Sapiens; identical to SEQ ID NO: 80238

SEQ ID NO: 696346 - RNA, 64 nt, Homo Sapiens; identical to SEQ ID NO: 80239

SEQ ID NO: 696347 - RNA, 64 nt, Homo Sapiens; identical to SEQ ID NO: 80240

SEQ ID NO: 696348 - RNA, 64 nt, Homo Sapiens; identical to SEQ ID NO: 80241

SEQ ID NO: 696349 - RNA, 64 nt, Homo Sapiens; identical to SEQ ID NO: 80242

SEQ ID NO: 696350 - RNA, 64 nt, Homo Sapiens; identical to SEQ ID NO: 80243

SEQ ID NO: 696351 - RNA, 64 nt, Homo Sapiens; identical to SEQ ID NO: 80244

SEQ ID NO: 696352 - RNA, 64 nt, Homo Sapiens; identical to SEQ ID NO: 80245

SEQ ID NO: 696353 - RNA, 64 nt, Homo Sapiens; identical to SEQ ID NO: 80246

SEQ ID NO: 696354 - RNA, 64 nt, Homo Sapiens; identical to SEQ ID NO: 80247

SEQ ID NO: 696355 - RNA, 64 nt, Homo Sapiens; identical to SEQ ID NO: 80248

SEQ ID NO: 696356 - RNA, 64 nt, Homo Sapiens; identical to SEQ ID NO: 80249

SEQ ID NO: 696357 - RNA, 64 nt, Homo Sapiens; identical to SEQ ID NO: 80250

SEQ ID NO: 696358 - RNA, 64 nt, Homo Sapiens; identical to SEQ ID NO: 80251

SEQ ID NO: 696359 - RNA, 64 nt, Homo Sapiens; identical to SEQ ID NO: 80252

SEQ ID NO: 696360 - RNA, 64 nt, Homo Sapiens; identical to SEQ ID NO: 80253

SEQ ID NO: 696361 - RNA, 64 nt, Homo Sapiens; identical to SEQ ID NO: 80254

SEQ ID NO: 696362 - RNA, 64 nt, Homo Sapiens; identical to SEQ ID NO: 80255

SEQ ID NO: 696363 - RNA, 64 nt, Homo Sapiens; identical to SEQ ID NO: 80256

SEQ ID NO: 696364 - RNA, 64 nt, Homo Sapiens; identical to SEQ ID NO: 80257

SEQ ID NO: 696365 - RNA, 64 nt, Homo Sapiens; identical to SEQ ID NO: 80258

SEQ ID NO: 696366 - RNA, 64 nt, Homo Sapiens; identical to SEQ ID NO: 80259

SEQ ID NO: 696367 - RNA, 64 nt, Homo Sapiens; identical to SEQ ID NO: 80260

SEQ ID NO: 696368 - RNA, 64 nt, Homo Sapiens; identical to SEQ ID NO: 80261

SEQ ID NO: 696369 - RNA, 64 nt, Homo Sapiens; identical to SEQ ID NO: 80262

SEQ ID NO: 696370 - RNA, 64 nt, Homo Sapiens; identical to SEQ ID NO: 80263

SEQ ID NO: 696371 - RNA, 64 nt, Homo Sapiens; identical to SEQ ID NO: 80264

SEQ ID NO: 696372 - RNA, 64 nt, Homo Sapiens; identical to SEQ ID NO: 80265

SEQ ID NO: 696373 - RNA, 64 nt, Homo Sapiens; identical to SEQ ID NO: 80266

SEQ ID NO: 696374 - RNA, 64 nt, Homo Sapiens; identical to SEQ ID NO: 80267

SEQ ID NO: 696375 - RNA, 64 nt, Homo Sapiens; identical to SEQ ID NO: 80268

SEQ ID NO: 696376 - RNA, 64 nt, Homo Sapiens; identical to SEQ ID NO: 80269

SEQ ID NO: 696377 - RNA, 64 nt, Homo Sapiens; identical to SEQ ID NO: 80270

SEQ ID NO: 696378 - RNA, 64 nt, Homo Sapiens; identical to SEQ ID NO: 80271

SEQ ID NO: 696379 - RNA, 64 nt, Homo Sapiens; identical to SEQ ID NO: 80272

SEQ ID NO: 696380 - RNA, 64 nt, Homo Sapiens; identical to SEQ ID NO: 80273

SEQ ID NO: 696381 - RNA, 64 nt, Homo Sapiens; identical to SEQ ID NO: 80274

SEQ ID NO: 696382 - RNA, 64 nt, Homo Sapiens; identical to SEQ ID NO: 80275

SEQ ID NO: 696383 - RNA, 64 nt, Homo Sapiens; identical to SEQ ID NO: 80276

SEQ ID NO: 696384 - RNA, 64 nt, Homo Sapiens; identical to SEQ ID NO: 80277

SEQ ID NO: 696385 - RNA, 64 nt, Homo Sapiens; identical to SEQ ID NO: 80278

SEQ ID NO: 696386 - RNA, 64 nt, Homo Sapiens; identical to SEQ ID NO: 80279

SEQ ID NO: 696387 - RNA, 64 nt, Homo Sapiens; identical to SEQ ID NO: 80280

SEQ ID NO: 696388 - RNA, 64 nt, Homo Sapiens; identical to SEQ ID NO: 80281

SEQ ID NO: 696389 - RNA, 64 nt, Homo Sapiens; identical to SEQ ID NO: 80282

SEQ ID NO: 696390 - RNA, 64 nt, Homo Sapiens; identical to SEQ ID NO: 80283

SEQ ID NO: 696391 - RNA, 64 nt, Homo Sapiens; identical to SEQ ID NO: 80284

SEQ ID NO: 696392 - RNA, 64 nt, Homo Sapiens; identical to SEQ ID NO: 80285

SEQ ID NO: 696393 - RNA, 64 nt, Homo Sapiens; identical to SEQ ID NO: 80286

SEQ ID NO: 696394 - RNA, 64 nt, Homo Sapiens; identical to SEQ ID NO: 80287

SEQ ID NO: 696395 - RNA, 64 nt, Homo Sapiens; identical to SEQ ID NO: 80288

SEQ ID NO: 696396 - RNA, 64 nt, Homo Sapiens; identical to SEQ ID NO: 80289

SEQ ID NO: 696397 - RNA, 64 nt, Homo Sapiens; identical to SEQ ID NO: 80290

SEQ ID NO: 696398 - RNA, 64 nt, Homo Sapiens; identical to SEQ ID NO: 80291

SEQ ID NO: 696399 - RNA, 64 nt, Homo Sapiens; identical to SEQ ID NO: 80292

SEQ ID NO: 696400 - RNA, 64 nt, Homo Sapiens; identical to SEQ ID NO: 80293

SEQ ID NO: 696401 - RNA, 64 nt, Homo Sapiens; identical to SEQ ID NO: 80294

SEQ ID NO: 696402 - RNA, 64 nt, Homo Sapiens; identical to SEQ ID NO: 80295

SEQ ID NO: 696403 - RNA, 64 nt, Homo Sapiens; identical to SEQ ID NO: 80296

SEQ ID NO: 696404 - RNA, 64 nt, Homo Sapiens; identical to SEQ ID NO: 80297

SEQ ID NO: 696405 - RNA, 64 nt, Homo Sapiens; identical to SEQ ID NO: 80298

SEQ ID NO: 696406 - RNA, 64 nt, Homo Sapiens; identical to SEQ ID NO: 80299

SEQ ID NO: 696407 - RNA, 64 nt, Homo Sapiens; identical to SEQ ID NO: 80300

SEQ ID NO: 696408 - RNA, 64 nt, Homo Sapiens; identical to SEQ ID NO: 80301

SEQ ID NO: 696409 - RNA, 64 nt, Homo Sapiens; identical to SEQ ID NO: 80302

SEQ ID NO: 696410 - RNA, 64 nt, Homo Sapiens; identical to SEQ ID NO: 80303

SEQ ID NO: 696411 - RNA, 64 nt, Homo Sapiens; identical to SEQ ID NO: 80304

SEQ ID NO: 696412 - RNA, 64 nt, Homo Sapiens; identical to SEQ ID NO: 80305

SEQ ID NO: 696413 - RNA, 64 nt, Homo Sapiens; identical to SEQ ID NO: 80306

SEQ ID NO: 696414 - RNA, 64 nt, Homo Sapiens; identical to SEQ ID NO: 80307

SEQ ID NO: 696415 - RNA, 64 nt, Homo Sapiens; identical to SEQ ID NO: 80308

SEQ ID NO: 696416 - RNA, 64 nt, Homo Sapiens; identical to SEQ ID NO: 80309

SEQ ID NO: 696417 - RNA, 64 nt, Homo Sapiens; identical to SEQ ID NO: 80310

SEQ ID NO: 696418 - RNA, 64 nt, Homo Sapiens; identical to SEQ ID NO: 80311

SEQ ID NO: 696419 - RNA, 64 nt, Homo Sapiens; identical to SEQ ID NO: 80312

SEQ ID NO: 696420 - RNA, 64 nt, Homo Sapiens; identical to SEQ ID NO: 80313

SEQ ID NO: 696421 - RNA, 64 nt, Homo Sapiens; identical to SEQ ID NO: 80314

SEQ ID NO: 696422 - RNA, 64 nt, Homo Sapiens; identical to SEQ ID NO: 80315

SEQ ID NO: 696423 - RNA, 64 nt, Homo Sapiens; identical to SEQ ID NO: 80316

SEQ ID NO: 696424 - RNA, 64 nt, Homo Sapiens; identical to SEQ ID NO: 80317

SEQ ID NO: 696425 - RNA, 64 nt, Homo Sapiens; identical to SEQ ID NO: 80318

SEQ ID NO: 696426 - RNA, 64 nt, Homo Sapiens; identical to SEQ ID NO: 80319

SEQ ID NO: 696427 - RNA, 64 nt, Homo Sapiens; identical to SEQ ID NO: 80320

SEQ ID NO: 696428 - RNA, 64 nt, Homo Sapiens; identical to SEQ ID NO: 80321

SEQ ID NO: 696429 - RNA, 64 nt, Homo Sapiens; identical to SEQ ID NO: 80322

SEQ ID NO: 696430 - RNA, 64 nt, Homo Sapiens; identical to SEQ ID NO: 80323

SEQ ID NO: 696431 - RNA, 64 nt, Homo Sapiens; identical to SEQ ID NO: 80324

SEQ ID NO: 696432 - RNA, 51 nt, Homo Sapiens; identical to SEQ ID NO: 80325

SEQ ID NO: 696433 - RNA, 64 nt, Homo Sapiens; identical to SEQ ID NO: 80326

SEQ ID NO: 696434 - RNA, 64 nt, Homo Sapiens; identical to SEQ ID NO: 80327

SEQ ID NO: 696435 - RNA, 64 nt, Homo Sapiens; identical to SEQ ID NO: 80328

SEQ ID NO: 696436 - RNA, 64 nt, Homo Sapiens; identical to SEQ ID NO: 80329

SEQ ID NO: 696437 - RNA, 64 nt, Homo Sapiens; identical to SEQ ID NO: 80330

SEQ ID NO: 696438 - RNA, 62 nt, Homo Sapiens; identical to SEQ ID NO: 80331

SEQ ID NO: 696439 - RNA, 64 nt, Homo Sapiens; identical to SEQ ID NO: 80332

SEQ ID NO: 696440 - RNA, 64 nt, Homo Sapiens; identical to SEQ ID NO: 80333

SEQ ID NO: 696441 - RNA, 64 nt, Homo Sapiens; identical to SEQ ID NO: 80334

SEQ ID NO: 696442 - RNA, 54 nt, Homo Sapiens; identical to SEQ ID NO: 80335

SEQ ID NO: 696443 - RNA, 64 nt, Homo Sapiens; identical to SEQ ID NO: 80336

SEQ ID NO: 696444 - RNA, 64 nt, Homo Sapiens; identical to SEQ ID NO: 80337

SEQ ID NO: 696445 - RNA, 64 nt, Homo Sapiens; identical to SEQ ID NO: 80338

SEQ ID NO: 696446 - RNA, 64 nt, Homo Sapiens; identical to SEQ ID NO: 80339

SEQ ID NO: 696447 - RNA, 64 nt, Homo Sapiens; identical to SEQ ID NO: 80340

SEQ ID NO: 696448 - RNA, 64 nt, Homo Sapiens; identical to SEQ ID NO: 80341

SEQ ID NO: 696449 - RNA, 64 nt, Homo Sapiens; identical to SEQ ID NO: 80342

SEQ ID NO: 696450 - RNA, 64 nt, Homo Sapiens; identical to SEQ ID NO: 80343

SEQ ID NO: 696451 - RNA, 64 nt, Homo Sapiens; identical to SEQ ID NO: 80344

SEQ ID NO: 696452 - RNA, 64 nt, Homo Sapiens; identical to SEQ ID NO: 80345

SEQ ID NO: 696453 - RNA, 64 nt, Homo Sapiens; identical to SEQ ID NO: 80346

SEQ ID NO: 696454 - RNA, 64 nt, Homo Sapiens; identical to SEQ ID NO: 80347

SEQ ID NO: 696455 - RNA, 64 nt, Homo Sapiens; identical to SEQ ID NO: 80348

SEQ ID NO: 696456 - RNA, 64 nt, Homo Sapiens; identical to SEQ ID NO: 80349

SEQ ID NO: 696457 - RNA, 64 nt, Homo Sapiens; identical to SEQ ID NO: 80350

SEQ ID NO: 696458 - RNA, 64 nt, Homo Sapiens; identical to SEQ ID NO: 80351

SEQ ID NO: 696459 - RNA, 59 nt, Homo Sapiens; identical to SEQ ID NO: 80352

SEQ ID NO: 696460 - RNA, 64 nt, Homo Sapiens; identical to SEQ ID NO: 80353

SEQ ID NO: 696461 - RNA, 64 nt, Homo Sapiens; identical to SEQ ID NO: 80354

SEQ ID NO: 696462 - RNA, 64 nt, Homo Sapiens; identical to SEQ ID NO: 80355

SEQ ID NO: 696463 - RNA, 64 nt, Homo Sapiens; identical to SEQ ID NO: 80356

SEQ ID NO: 696464 - RNA, 64 nt, Homo Sapiens; identical to SEQ ID NO: 80357

SEQ ID NO: 696465 - RNA, 64 nt, Homo Sapiens; identical to SEQ ID NO: 80358

SEQ ID NO: 696466 - RNA, 64 nt, Homo Sapiens; identical to SEQ ID NO: 80359

SEQ ID NO: 696467 - RNA, 64 nt, Homo Sapiens; identical to SEQ ID NO: 80360

SEQ ID NO: 696468 - RNA, 64 nt, Homo Sapiens; identical to SEQ ID NO: 80361

SEQ ID NO: 696469 - RNA, 64 nt, Homo Sapiens; identical to SEQ ID NO: 80362

SEQ ID NO: 696470 - RNA, 64 nt, Homo Sapiens; identical to SEQ ID NO: 80363

SEQ ID NO: 696471 - RNA, 64 nt, Homo Sapiens; identical to SEQ ID NO: 80364

SEQ ID NO: 696472 - RNA, 64 nt, Homo Sapiens; identical to SEQ ID NO: 80365

SEQ ID NO: 696473 - RNA, 64 nt, Homo Sapiens; identical to SEQ ID NO: 80366

SEQ ID NO: 696474 - RNA, 64 nt, Homo Sapiens; identical to SEQ ID NO: 80367

SEQ ID NO: 696475 - RNA, 64 nt, Homo Sapiens; identical to SEQ ID NO: 80368

SEQ ID NO: 696476 - RNA, 64 nt, Homo Sapiens; identical to SEQ ID NO: 80369

SEQ ID NO: 696477 - RNA, 64 nt, Homo Sapiens; identical to SEQ ID NO: 80370

SEQ ID NO: 696478 - RNA, 64 nt, Homo Sapiens; identical to SEQ ID NO: 80371

SEQ ID NO: 696479 - RNA, 64 nt, Homo Sapiens; identical to SEQ ID NO: 80372

SEQ ID NO: 696480 - RNA, 64 nt, Homo Sapiens; identical to SEQ ID NO: 80373

SEQ ID NO: 696481 - RNA, 64 nt, Homo Sapiens; identical to SEQ ID NO: 80374

SEQ ID NO: 696482 - RNA, 64 nt, Homo Sapiens; identical to SEQ ID NO: 80375

SEQ ID NO: 696483 - RNA, 64 nt, Homo Sapiens; identical to SEQ ID NO: 80376

SEQ ID NO: 696484 - RNA, 64 nt, Homo Sapiens; identical to SEQ ID NO: 80377

SEQ ID NO: 696485 - RNA, 64 nt, Homo Sapiens; identical to SEQ ID NO: 80378

SEQ ID NO: 696486 - RNA, 64 nt, Homo Sapiens; identical to SEQ ID NO: 80379

SEQ ID NO: 696487 - RNA, 64 nt, Homo Sapiens; identical to SEQ ID NO: 80380

SEQ ID NO: 696488 - RNA, 64 nt, Homo Sapiens; identical to SEQ ID NO: 80381

SEQ ID NO: 696489 - RNA, 64 nt, Homo Sapiens; identical to SEQ ID NO: 80382

SEQ ID NO: 696490 - RNA, 64 nt, Homo Sapiens; identical to SEQ ID NO: 80383

SEQ ID NO: 696491 - RNA, 64 nt, Homo Sapiens; identical to SEQ ID NO: 80384

SEQ ID NO: 696492 - RNA, 64 nt, Homo Sapiens; identical to SEQ ID NO: 80385

SEQ ID NO: 696493 - RNA, 64 nt, Homo Sapiens; identical to SEQ ID NO: 80386

SEQ ID NO: 696494 - RNA, 64 nt, Homo Sapiens; identical to SEQ ID NO: 80387

SEQ ID NO: 696495 - RNA, 64 nt, Homo Sapiens; identical to SEQ ID NO: 80388

SEQ ID NO: 696496 - RNA, 64 nt, Homo Sapiens; identical to SEQ ID NO: 80389

SEQ ID NO: 696497 - RNA, 64 nt, Homo Sapiens; identical to SEQ ID NO: 80390

SEQ ID NO: 696498 - RNA, 64 nt, Homo Sapiens; identical to SEQ ID NO: 80391

SEQ ID NO: 696499 - RNA, 53 nt, Homo Sapiens; identical to SEQ ID NO: 80392

SEQ ID NO: 696500 - RNA, 64 nt, Homo Sapiens; identical to SEQ ID NO: 80393

SEQ ID NO: 696501 - RNA, 64 nt, Homo Sapiens; identical to SEQ ID NO: 80394

SEQ ID NO: 696502 - RNA, 64 nt, Homo Sapiens; identical to SEQ ID NO: 80395

SEQ ID NO: 696503 - RNA, 64 nt, Homo Sapiens; identical to SEQ ID NO: 80396

SEQ ID NO: 696504 - RNA, 64 nt, Homo Sapiens; identical to SEQ ID NO: 80397

SEQ ID NO: 696505 - RNA, 64 nt, Homo Sapiens; identical to SEQ ID NO: 80398

SEQ ID NO: 696506 - RNA, 64 nt, Homo Sapiens; identical to SEQ ID NO: 80399

SEQ ID NO: 696507 - RNA, 64 nt, Homo Sapiens; identical to SEQ ID NO: 80400

SEQ ID NO: 696508 - RNA, 64 nt, Homo Sapiens; identical to SEQ ID NO: 80401

SEQ ID NO: 696509 - RNA, 64 nt, Homo Sapiens; identical to SEQ ID NO: 80402

SEQ ID NO: 696510 - RNA, 64 nt, Homo Sapiens; identical to SEQ ID NO: 80403

SEQ ID NO: 696511 - RNA, 64 nt, Homo Sapiens; identical to SEQ ID NO: 80404

SEQ ID NO: 696512 - RNA, 64 nt, Homo Sapiens; identical to SEQ ID NO: 80405

SEQ ID NO: 696513 - RNA, 64 nt, Homo Sapiens; identical to SEQ ID NO: 80406

SEQ ID NO: 696514 - RNA, 64 nt, Homo Sapiens; identical to SEQ ID NO: 80407

SEQ ID NO: 696515 - RNA, 64 nt, Homo Sapiens; identical to SEQ ID NO: 80408

SEQ ID NO: 696516 - RNA, 64 nt, Homo Sapiens; identical to SEQ ID NO: 80409

SEQ ID NO: 696517 - RNA, 64 nt, Homo Sapiens; identical to SEQ ID NO: 80410

SEQ ID NO: 696518 - RNA, 64 nt, Homo Sapiens; identical to SEQ ID NO: 80411

SEQ ID NO: 696519 - RNA, 64 nt, Homo Sapiens; identical to SEQ ID NO: 80412

SEQ ID NO: 696520 - RNA, 64 nt, Homo Sapiens; identical to SEQ ID NO: 80413

SEQ ID NO: 696521 - RNA, 64 nt, Homo Sapiens; identical to SEQ ID NO: 80414

SEQ ID NO: 696522 - RNA, 64 nt, Homo Sapiens; identical to SEQ ID NO: 80415

SEQ ID NO: 696523 - RNA, 64 nt, Homo Sapiens; identical to SEQ ID NO: 80416

SEQ ID NO: 696524 - RNA, 64 nt, Homo Sapiens; identical to SEQ ID NO: 80417

SEQ ID NO: 696525 - RNA, 64 nt, Homo Sapiens; identical to SEQ ID NO: 80418

SEQ ID NO: 696526 - RNA, 64 nt, Homo Sapiens; identical to SEQ ID NO: 144868

SEQ ID NO: 696527 - RNA, 64 nt, Homo Sapiens; identical to SEQ ID NO: 144869

SEQ ID NO: 696528 - RNA, 64 nt, Homo Sapiens; identical to SEQ ID NO: 144870

SEQ ID NO: 696529 - RNA, 64 nt, Homo Sapiens; identical to SEQ ID NO: 144871

SEQ ID NO: 696530 - RNA, 64 nt, Homo Sapiens; identical to SEQ ID NO: 144872

SEQ ID NO: 696531 - RNA, 64 nt, Homo Sapiens; identical to SEQ ID NO: 144873

SEQ ID NO: 696532 - RNA, 64 nt, Homo Sapiens; identical to SEQ ID NO: 144874

SEQ ID NO: 696533 - RNA, 64 nt, Homo Sapiens; identical to SEQ ID NO: 144875

SEQ ID NO: 696534 - RNA, 64 nt, Homo Sapiens; identical to SEQ ID NO: 144876

SEQ ID NO: 696535 - RNA, 64 nt, Homo Sapiens; identical to SEQ ID NO: 144877

SEQ ID NO: 696536 - RNA, 64 nt, Homo Sapiens; identical to SEQ ID NO: 144878

SEQ ID NO: 696537 - RNA, 64 nt, Homo Sapiens; identical to SEQ ID NO: 144879

SEQ ID NO: 696538 - RNA, 64 nt, Homo Sapiens; identical to SEQ ID NO: 144880

SEQ ID NO: 696539 - RNA, 64 nt, Homo Sapiens; identical to SEQ ID NO: 144881

SEQ ID NO: 696540 - RNA, 64 nt, Homo Sapiens; identical to SEQ ID NO: 144882

SEQ ID NO: 696541 - RNA, 64 nt, Homo Sapiens; identical to SEQ ID NO: 144883

SEQ ID NO: 696542 - RNA, 64 nt, Homo Sapiens; identical to SEQ ID NO: 144884

SEQ ID NO: 696543 - RNA, 64 nt, Homo Sapiens; identical to SEQ ID NO: 144885

SEQ ID NO: 696544 - RNA, 64 nt, Homo Sapiens; identical to SEQ ID NO: 144886

SEQ ID NO: 696545 - RNA, 64 nt, Homo Sapiens; identical to SEQ ID NO: 144887

SEQ ID NO: 696546 - RNA, 64 nt, Homo Sapiens; identical to SEQ ID NO: 144888

SEQ ID NO: 696547 - RNA, 64 nt, Homo Sapiens; identical to SEQ ID NO: 144889

SEQ ID NO: 696548 - RNA, 64 nt, Homo Sapiens; identical to SEQ ID NO: 144890

SEQ ID NO: 696549 - RNA, 64 nt, Homo Sapiens; identical to SEQ ID NO: 144891

SEQ ID NO: 696550 - RNA, 64 nt, Homo Sapiens; identical to SEQ ID NO: 144892

SEQ ID NO: 696551 - RNA, 64 nt, Homo Sapiens; identical to SEQ ID NO: 144893

SEQ ID NO: 696552 - RNA, 64 nt, Homo Sapiens; identical to SEQ ID NO: 144894

SEQ ID NO: 696553 - RNA, 64 nt, Homo Sapiens; identical to SEQ ID NO: 144895

SEQ ID NO: 696554 - RNA, 64 nt, Homo Sapiens; identical to SEQ ID NO: 144896

SEQ ID NO: 696555 - RNA, 64 nt, Homo Sapiens; identical to SEQ ID NO: 144897

SEQ ID NO: 696556 - RNA, 64 nt, Homo Sapiens; identical to SEQ ID NO: 144898

SEQ ID NO: 696557 - RNA, 64 nt, Homo Sapiens; identical to SEQ ID NO: 144899

SEQ ID NO: 696558 - RNA, 64 nt, Homo Sapiens; identical to SEQ ID NO: 144900

SEQ ID NO: 696559 - RNA, 64 nt, Homo Sapiens; identical to SEQ ID NO: 144901

SEQ ID NO: 696560 - RNA, 64 nt, Homo Sapiens; identical to SEQ ID NO: 144902

SEQ ID NO: 696561 - RNA, 64 nt, Homo Sapiens; identical to SEQ ID NO: 144903

SEQ ID NO: 696562 - RNA, 64 nt, Homo Sapiens; identical to SEQ ID NO: 144904

SEQ ID NO: 696563 - RNA, 64 nt, Homo Sapiens; identical to SEQ ID NO: 144905

SEQ ID NO: 696564 - RNA, 64 nt, Homo Sapiens; identical to SEQ ID NO: 144906

SEQ ID NO: 696565 - RNA, 64 nt, Homo Sapiens; identical to SEQ ID NO: 144907

SEQ ID NO: 696566 - RNA, 64 nt, Homo Sapiens; identical to SEQ ID NO: 496651

SEQ ID NO: 696567 - RNA, 64 nt, Homo Sapiens; identical to SEQ ID NO: 496652

SEQ ID NO: 696568 - RNA, 64 nt, Homo Sapiens; identical to SEQ ID NO: 496653

SEQ ID NO: 696569 - RNA, 64 nt, Homo Sapiens; identical to SEQ ID NO: 496654

SEQ ID NO: 696570 - RNA, 64 nt, Homo Sapiens; identical to SEQ ID NO: 496655

SEQ ID NO: 696571 - RNA, 64 nt, Homo Sapiens; identical to SEQ ID NO: 496656

SEQ ID NO: 696572 - RNA, 64 nt, Homo Sapiens; identical to SEQ ID NO: 496657

SEQ ID NO: 696573 - RNA, 64 nt, Homo Sapiens; identical to SEQ ID NO: 496658

SEQ ID NO: 696574 - RNA, 64 nt, Homo Sapiens; identical to SEQ ID NO: 496659

SEQ ID NO: 696575 - RNA, 64 nt, Homo Sapiens; identical to SEQ ID NO: 496660

SEQ ID NO: 696576 - RNA, 64 nt, Homo Sapiens; identical to SEQ ID NO: 496661

SEQ ID NO: 696577 - RNA, 64 nt, Homo Sapiens; identical to SEQ ID NO: 496662

SEQ ID NO: 696578 - RNA, 64 nt, Homo Sapiens; identical to SEQ ID NO: 496663

SEQ ID NO: 696579 - RNA, 64 nt, Homo Sapiens; identical to SEQ ID NO: 496664

SEQ ID NO: 696580 - RNA, 64 nt, Homo Sapiens; identical to SEQ ID NO: 496665

SEQ ID NO: 696581 - RNA, 64 nt, Homo Sapiens; identical to SEQ ID NO: 496665

SEQ ID NO: 696582 - RNA, 64 nt, Homo Sapiens
cucuuuguggaaaaagaaacaggguuuugaacucuguuaacauuugaaaaauauauuuucaaau

SEQ ID NO: 696583 - RNA, 64 nt, Homo Sapiens
uuucauuuuuacgagaguuugaaaauagacacacuguuaacacuucugccaguuuuuucugauc

SEQ ID NO: 696584 - RNA, 64 nt, Homo Sapiens
uccaaucugaaguauugcacaucugaacugggacuguuaacacugaugccaauacagugugggg

SEQ ID NO: 696585 - RNA, 64 nt, Homo Sapiens
agaaauuaacaggccacagguuucuuuaaagcuguguuaacauaucuugccuuaaaaugugugu

SEQ ID NO: 696586 - RNA, 64 nt, Homo Sapiens
ccauugaacauacuuuuaaauaaagugaaauauuuguuaacagccaaagagaaacucauuuuuu

SEQ ID NO: 696587 - RNA, 64 nt, Homo Sapiens
uagaggauagaggccaggguaacuggugggaugcuguuaacauccagacauuuuugguugucac

SEQ ID NO: 696588 - RNA, 64 nt, Homo Sapiens
gauaagugaucauggugugccucaaauucacaaauguuaacauggaauuuuuaaucacacggau

SEQ ID NO: 696589 - RNA, 64 nt, Homo Sapiens
auucuguuuguuaauauuuuaccacuaugcuuaauguuaacauguuuuagaauuaauuuuccaa

SEQ ID NO: 696590 - RNA, 64 nt, Homo Sapiens
gaaaggggaauucugugauggcaaaugaaaaaaauguuaacauuugguagacaugugcuuugac

SEQ ID NO: 696591 - RNA, 64 nt, Homo Sapiens
gccauucugccguagcuagauguucugugggguuuguuaacauggaacuacucagcuuucuuuc

SEQ ID NO: 696592 - RNA, 64 nt, Homo Sapiens
cuaaaagcugaaaaucucaguuuaaaaaucaaaauguuaacacaaagcuaagauucaucagagc

SEQ ID NO: 696593 - RNA, 64 nt, Homo Sapiens
gccuuuucgauggaaucacaauuauucugaguauuguuaacagucauugauguagacuugucag

SEQ ID NO: 696594 - RNA, 64 nt, Homo Sapiens
uuguacuggugacccaccucucaucaguaaaccuuguuaacauuggcuuaucacaaaaaucauu

SEQ ID NO: 696595 - RNA, 64 nt, Homo Sapiens
guucauaacaaaaaaugcuaguucugagauauaauguuaacauugucuuuguauucuauaguau

SEQ ID NO: 696596 - RNA, 64 nt, Homo Sapiens
uuuaugugaguagcauuucccuaucuugcaguucuguuaacaugaaaauggcauuuuuccauaa

SEQ ID NO: 696597 - RNA, 64 nt, Homo Sapiens
uuuuuuauuuuuucaacuucaagguauuaacagcuguuaacacuuaaaaaguacugccacauau

SEQ ID NO: 696598 - RNA, 64 nt, Homo Sapiens
caagauuugcuguuagaaaugaaguaaucuucucuguuaacagcaucaaaauacuauauuuaua

SEQ ID NO: 696599 - RNA, 64 nt, Homo Sapiens
ugguaucuuugaguauuuacagcccucucauacuuguuaacaauuuucagcugacauuuccacc

SEQ ID NO: 696600 - RNA, 64 nt, Homo Sapiens; identical to SEQ ID NO: 520367

SEQ ID NO: 696601 - RNA, 64 nt, Homo Sapiens; identical to SEQ ID NO: 520368

SEQ ID NO: 696602 - RNA, 64 nt, Homo Sapiens; identical to SEQ ID NO: 520394

SEQ ID NO: 696603 - RNA, 64 nt, Homo Sapiens; identical to SEQ ID NO: 520395

SEQ ID NO: 696604 - RNA, 64 nt, Homo Sapiens; identical to SEQ ID NO: 520405

SEQ ID NO: 696605 - RNA, 64 nt, Homo Sapiens; identical to SEQ ID NO: 520406

SEQ ID NO: 696606 - RNA, 64 nt, Homo Sapiens; identical to SEQ ID NO: 520425

SEQ ID NO: 696607 - RNA, 64 nt, Homo Sapiens; identical to SEQ ID NO: 520426

SEQ ID NO: 696608 - RNA, 64 nt, Homo Sapiens; identical to SEQ ID NO: 520427

SEQ ID NO: 696609 - RNA, 64 nt, Homo Sapiens; identical to SEQ ID NO: 520428

SEQ ID NO: 696610 - RNA, 64 nt, Homo Sapiens; identical to SEQ ID NO: 520431

SEQ ID NO: 696611 - RNA, 64 nt, Homo Sapiens; identical to SEQ ID NO: 520432

SEQ ID NO: 696612 - RNA, 64 nt, Homo Sapiens; identical to SEQ ID NO: 520447

SEQ ID NO: 696613 - RNA, 64 nt, Homo Sapiens; identical to SEQ ID NO: 520448

SEQ ID NO: 696614 - RNA, 64 nt, Homo Sapiens; identical to SEQ ID NO: 520468

SEQ ID NO: 696615 - RNA, 64 nt, Homo Sapiens; identical to SEQ ID NO: 520469

SEQ ID NO: 696616 - RNA, 64 nt, Homo Sapiens; identical to SEQ ID NO: 520476

SEQ ID NO: 696617 - RNA, 59 nt, Homo Sapiens; identical to SEQ ID NO: 520477

SEQ ID NO: 696618 - RNA, 64 nt, Homo Sapiens; identical to SEQ ID NO: 520485

SEQ ID NO: 696619 - RNA, 64 nt, Homo Sapiens; identical to SEQ ID NO: 520486

SEQ ID NO: 696620 - RNA, 64 nt, Homo Sapiens; identical to SEQ ID NO: 520510

SEQ ID NO: 696621 - RNA, 64 nt, Homo Sapiens; identical to SEQ ID NO: 520511

SEQ ID NO: 696622 - RNA, 64 nt, Homo Sapiens; identical to SEQ ID NO: 520529

SEQ ID NO: 696623 - RNA, 64 nt, Homo Sapiens; identical to SEQ ID NO: 520530

SEQ ID NO: 696624 - RNA, 64 nt, Homo Sapiens; identical to SEQ ID NO: 520594

SEQ ID NO: 696625 - RNA, 64 nt, Homo Sapiens; identical to SEQ ID NO: 520595

SEQ ID NO: 696626 - RNA, 64 nt, Homo Sapiens; identical to SEQ ID NO: 520618

SEQ ID NO: 696627 - RNA, 64 nt, Homo Sapiens; identical to SEQ ID NO: 520619

SEQ ID NO: 696628 - RNA, 64 nt, Homo Sapiens; identical to SEQ ID NO: 520631

SEQ ID NO: 696629 - RNA, 64 nt, Homo Sapiens; identical to SEQ ID NO: 520632

SEQ ID NO: 696630 - RNA, 64 nt, Homo Sapiens; identical to SEQ ID NO: 520633

SEQ ID NO: 696631 - RNA, 64 nt, Homo Sapiens; identical to SEQ ID NO: 520648

SEQ ID NO: 696632 - RNA, 64 nt, Homo Sapiens; identical to SEQ ID NO: 520649

SEQ ID NO: 696633 - RNA, 64 nt, Homo Sapiens; identical to SEQ ID NO: 520651

SEQ ID NO: 696634 - RNA, 64 nt, Homo Sapiens; identical to SEQ ID NO: 520652

SEQ ID NO: 696635 - RNA, 64 nt, Homo Sapiens; identical to SEQ ID NO: 520663

SEQ ID NO: 696636 - RNA, 64 nt, Homo Sapiens; identical to SEQ ID NO: 520664

SEQ ID NO: 696637 - RNA, 64 nt, Homo Sapiens; identical to SEQ ID NO: 520683

SEQ ID NO: 696638 - RNA, 64 nt, Homo Sapiens; identical to SEQ ID NO: 520684

SEQ ID NO: 696639 - RNA, 64 nt, Homo Sapiens; identical to SEQ ID NO: 101831

SEQ ID NO: 696640 - RNA, 64 nt, Homo Sapiens; identical to SEQ ID NO: 101832

SEQ ID NO: 696641 - RNA, 64 nt, Homo Sapiens; identical to SEQ ID NO: 101833

SEQ ID NO: 696642 - RNA, 64 nt, Homo Sapiens; identical to SEQ ID NO: 101834

SEQ ID NO: 696643 - RNA, 61 nt, Homo Sapiens; identical to SEQ ID NO: 101835

SEQ ID NO: 696644 - RNA, 64 nt, Homo Sapiens; identical to SEQ ID NO: 101836

SEQ ID NO: 696645 - RNA, 64 nt, Homo Sapiens; identical to SEQ ID NO: 101837

SEQ ID NO: 696646 - RNA, 64 nt, Homo Sapiens; identical to SEQ ID NO: 101838

SEQ ID NO: 696647 - RNA, 64 nt, Homo Sapiens; identical to SEQ ID NO: 101839

SEQ ID NO: 696648 - RNA, 64 nt, Homo Sapiens; identical to SEQ ID NO: 101840

SEQ ID NO: 696649 - RNA, 64 nt, Homo Sapiens; identical to SEQ ID NO: 101841

SEQ ID NO: 696650 - RNA, 64 nt, Homo Sapiens; identical to SEQ ID NO: 101842

SEQ ID NO: 696651 - RNA, 64 nt, Homo Sapiens; identical to SEQ ID NO: 101843

SEQ ID NO: 696652 - RNA, 64 nt, Homo Sapiens; identical to SEQ ID NO: 101844

SEQ ID NO: 696653 - RNA, 64 nt, Homo Sapiens; identical to SEQ ID NO: 101845

SEQ ID NO: 696654 - RNA, 64 nt, Homo Sapiens; identical to SEQ ID NO: 101846

SEQ ID NO: 696655 - RNA, 64 nt, Homo Sapiens; identical to SEQ ID NO: 101847

SEQ ID NO: 696656 - RNA, 64 nt, Homo Sapiens; identical to SEQ ID NO: 101848

SEQ ID NO: 696657 - RNA, 64 nt, Homo Sapiens; identical to SEQ ID NO: 101849

SEQ ID NO: 696658 - RNA, 64 nt, Homo Sapiens; identical to SEQ ID NO: 101850

SEQ ID NO: 696659 - RNA, 64 nt, Homo Sapiens; identical to SEQ ID NO: 101851

SEQ ID NO: 696660 - RNA, 64 nt, Homo Sapiens; identical to SEQ ID NO: 101852

SEQ ID NO: 696661 - RNA, 64 nt, Homo Sapiens; identical to SEQ ID NO: 101853

SEQ ID NO: 696662 - RNA, 64 nt, Homo Sapiens; identical to SEQ ID NO: 101854

SEQ ID NO: 696663 - RNA, 64 nt, Homo Sapiens
gauccauuagggaucgaggugcuacacuggccuccagggauaagccuggggcuacuguugcugg

SEQ ID NO: 696664 - RNA, 64 nt, Homo Sapiens
cuggaauaccuuccuucuuaaaaucugaucauggcagggauaugcagggcacuuuuuacuauuu

SEQ ID NO: 696665 - RNA, 64 nt, Homo Sapiens
ucugcuaugcaccagccucaccucugcaaccacacagggauauugccugcucuucccauguugg

SEQ ID NO: 696666 - RNA, 64 nt, Homo Sapiens
uaaaacuuauuuuauauaccccgcccccaccccucagggauauuagaagcagauccuggcccuc

SEQ ID NO: 696667 - RNA, 64 nt, Homo Sapiens
ucccaauugaguaguucaagagaaagguuuaauucagggauaaguuucuugugcuucagcuacu

SEQ ID NO: 696668 - RNA, 64 nt, Homo Sapiens
uucugagacaugucacuuggaugucacuuaaugacagggauauguaaguuucauauauagucau

SEQ ID NO: 696669 - RNA, 64 nt, Homo Sapiens
gcugauccuucuuuucacuuucugucaaugucaccagggauaaggugggacaaugggggguggg

SEQ ID NO: 696670 - RNA, 64 nt, Homo Sapiens
gggcgcugagcucaggcccagaacuggcugauuucagggauacccaggacgcgugaaacacaga

SEQ ID NO: 696671 - RNA, 64 nt, Homo Sapiens
aucuuucuucuuaguuuacagugaaauauuaucucagggauauuuuuuuuuuuuuuuugagacg

SEQ ID NO: 696672 - RNA, 64 nt, Homo Sapiens
gauuacaggcgugagccaccgcgcccggccaucucagggauauuuaaacaaaggaagaggaaau

SEQ ID NO: 696673 - RNA, 64 nt, Homo Sapiens
ccuucugggccagaggcaccaucccuucuggccauccaucaaguccaucaaggcccagcccugc

SEQ ID NO: 696674 - RNA, 64 nt, Homo Sapiens
ccagaggcaccaucccuucuggccauccaucaaguccaucaaggcccagcccugcugagaaaug

SEQ ID NO: 696675 - RNA, 64 nt, Homo Sapiens
gaguauuugagauuggccaagcagaacuaugaaguccaucaaguaagucaaagaucaucguuuc

SEQ ID NO: 696676 - RNA, 64 nt, Homo Sapiens
agcagccugaacagacuaagacggggguguugcuuccaucaaaggauguacuaaguuguggauu

SEQ ID NO: 696677 - RNA, 64 nt, Homo Sapiens
ccuagcauguaagacuuaaauuucuccccauuugggacaucaaguucaaaguaagagucagcuu

SEQ ID NO: 696678 - RNA, 64 nt, Homo Sapiens
cugcaacccgguuuaccagucaugaagcuguugcggacaucauuuuucugaugaucauugcugg

SEQ ID NO: 696679 - RNA, 64 nt, Homo Sapiens
agccagagcacaggaagccagagcagggcgauugggacaucaccuucuugaugguaacuucuca

SEQ ID NO: 696680 - RNA, 64 nt, Homo Sapiens
gccccuggaacuggggccacgccacaccagcucuggacaucaccuuaccagaggauccccgaga

SEQ ID NO: 696681 - RNA, 64 nt, Homo Sapiens; identical to SEQ ID NO: 415046

SEQ ID NO: 696682 - RNA, 64 nt, Homo Sapiens; identical to SEQ ID NO: 415047

SEQ ID NO: 696683 - RNA, 64 nt, Homo Sapiens
uucuuuuuguagcuggggcuccuucuauuuggggcuugaugacugaggugcacugggaggcucc

SEQ ID NO: 696684 - RNA, 64 nt, Homo Sapiens
gacaacacccauuuuuccuuccuuuccauaaauccuugaugauucagcuuguaggggaggggcu

SEQ ID NO: 696685 - RNA, 64 nt, Homo Sapiens
auucaucuuuguugaaucuguugugcagauuuuucuugaugagcauucuguuuuuuuuucuuug

SEQ ID NO: 696686 - RNA, 64 nt, Homo Sapiens
ugaaguggaauuugggguugcucuuggaaguggccuugaugaggauccuuuacaacuauucaga

SEQ ID NO: 696687 - RNA, 64 nt, Homo Sapiens
uccccugccagggcucgggcgcuguggcuccugccuugaugaagcccguguccugccuugauga

SEQ ID NO: 696688 - RNA, 64 nt, Homo Sapiens
uguggcuccugccuugaugaagcccguguccugccuugaugaagccugugccaccugcaagugc

SEQ ID NO: 696689 - RNA, 64 nt, Homo Sapiens
ccucaaauuuauuacaaauuuaguauuuuuaguacuugaugacucuaauuacaugaaugcaccu

SEQ ID NO: 696690 - RNA, 64 nt, Homo Sapiens
guuuggagucagaaccuggguaugacucuguggccuugaugaagcaaguuacuuaaacucuuga

SEQ ID NO: 696691 - RNA, 64 nt, Homo Sapiens
uugcauaaaauuaugcauugagcaaacaguaccacuugaugauuaaguuacaggucacuuuaaa

SEQ ID NO: 696692 - RNA, 64 nt, Homo Sapiens
auaaaaaguaaauaaaagcauuccuagaaaacugcuugaugacaaauugguauuuugcugaaaa

SEQ ID NO: 696693 - RNA, 64 nt, Homo Sapiens
uguuuaaacugaguagcagaauuaauuaucuauccuugaugauguccuuuuaugcucaccugac

SEQ ID NO: 696694 - RNA, 64 nt, Homo Sapiens
uuggucugccucugagccacgaaaagguccuugacuugaugaauucuccgcaaggugguagcag

SEQ ID NO: 696695 - RNA, 64 nt, Homo Sapiens; identical to SEQ ID NO: 53319

SEQ ID NO: 696696 - RNA, 64 nt, Homo Sapiens; identical to SEQ ID NO: 53320

SEQ ID NO: 696697 - RNA, 64 nt, Homo Sapiens; identical to SEQ ID NO: 53321

SEQ ID NO: 696698 - RNA, 64 nt, Homo Sapiens; identical to SEQ ID NO: 53322

SEQ ID NO: 696699 - RNA, 64 nt, Homo Sapiens; identical to SEQ ID NO: 53323

SEQ ID NO: 696700 - RNA, 64 nt, Homo Sapiens; identical to SEQ ID NO: 53324

SEQ ID NO: 696701 - RNA, 64 nt, Homo Sapiens; identical to SEQ ID NO: 53325

SEQ ID NO: 696702 - RNA, 64 nt, Homo Sapiens; identical to SEQ ID NO: 53326

SEQ ID NO: 696703 - RNA, 64 nt, Homo Sapiens; identical to SEQ ID NO: 53327

SEQ ID NO: 696704 - RNA, 64 nt, Homo Sapiens; identical to SEQ ID NO: 53328

SEQ ID NO: 696705 - RNA, 64 nt, Homo Sapiens; identical to SEQ ID NO: 53329

SEQ ID NO: 696706 - RNA, 64 nt, Homo Sapiens; identical to SEQ ID NO: 53330

SEQ ID NO: 696707 - RNA, 64 nt, Homo Sapiens; identical to SEQ ID NO: 53331

SEQ ID NO: 696708 - RNA, 64 nt, Homo Sapiens; identical to SEQ ID NO: 53332

SEQ ID NO: 696709 - RNA, 64 nt, Homo Sapiens; identical to SEQ ID NO: 53333

SEQ ID NO: 696710 - RNA, 64 nt, Homo Sapiens; identical to SEQ ID NO: 53334

SEQ ID NO: 696711 - RNA, 64 nt, Homo Sapiens; identical to SEQ ID NO: 257776

SEQ ID NO: 696712 - RNA, 64 nt, Homo Sapiens; identical to SEQ ID NO: 257777

SEQ ID NO: 696713 - RNA, 64 nt, Homo Sapiens
cugaaauuuuauaguguguaaauuguauaaaacugcuuagaaacacaaauuuuacucaaguuua

SEQ ID NO: 696714 - RNA, 64 nt, Homo Sapiens
auuaguaauauaaguugggaaugagguauuaguggcuuagaagagaaaacuggcaagagaauug

SEQ ID NO: 696715 - RNA, 64 nt, Homo Sapiens
aaaagagaauugggggcuuagggucggaacccaagcuuagaacuuuaagcaacaagaccaccac

SEQ ID NO: 696716 - RNA, 64 nt, Homo Sapiens
ucgcccuacuauucaguggcgagaaauaaaguuugcuuagaaaagaaacauggucuccuucuug

SEQ ID NO: 696717 - RNA, 64 nt, Homo Sapiens
ugcagauuuuagaucuaaugucuaaacauggugugcuuagaaaccugcagaaggaucugaaaga

SEQ ID NO: 696718 - RNA, 64 nt, Homo Sapiens
agauacuaaauccagagcuauuuacauagggccagcuuagaaauuuaauucaaauaccaaauag

SEQ ID NO: 696719 - RNA, 64 nt, Homo Sapiens
auguacucugcacagggggagugaaguaauauuggcuuagaagacuucaccuuuuguuuuucau

SEQ ID NO: 696720 - RNA, 64 nt, Homo Sapiens
gagcguggacuugaugcagugaugacaaaucauugcuuagaauuaauguuuucaaaugugcaac

SEQ ID NO: 696721 - RNA, 64 nt, Homo Sapiens
gaaugacauaccugggcucaggggaagcaagggggcuuagaauuugugggguauucccaaaagg

SEQ ID NO: 696722 - RNA, 64 nt, Homo Sapiens
aacugcucugcacuguuuaauccauuuccaaggggcuuagaaaagcuaacaagggugugucccc

SEQ ID NO: 696723 - RNA, 64 nt, Homo Sapiens
agagcauucuuuuccucaaaacgagcugcauaauucuuggaauuuaugucuuaccacauggugg

SEQ ID NO: 696724 - RNA, 64 nt, Homo Sapiens
cuugcucaggagagggaauaacgcaggucccuuuucuuggaaggcuuguacuauggccaugaca

SEQ ID NO: 696725 - RNA, 64 nt, Homo Sapiens
cauugccccaugggcucagguguuugagccaaggucuuggaaggguagggcuucugcagagcca

SEQ ID NO: 696726 - RNA, 64 nt, Homo Sapiens
cguggggagaguucugccuggccugaggcugcacucuuggaaggggccuucccgggggcuuuuu

SEQ ID NO: 696727 - RNA, 64 nt, Homo Sapiens
uaaaaaauauuuucaaagugaagcugagagagaaucuuggaaacacacauaccuguugaucaug

SEQ ID NO: 696728 - RNA, 64 nt, Homo Sapiens
cucuuuccugucuccucuccucugaucuguucuuucuuggaacaccacccaagaacgucaccuc

SEQ ID NO: 696729 - RNA, 64 nt, Homo Sapiens
uauccugcucagaaccauucacauuuaauucaauucuuggaaaaaauuaaagcuuuuugcccac

SEQ ID NO: 696730 - RNA, 64 nt, Homo Sapiens
caugauguugcauuaauaguuguuuuugucccuuucuuggaaauguuaaugccaaaguugccug

SEQ ID NO: 696731 - RNA, 64 nt, Homo Sapiens
acugaucuuuccaaaauauuggaaaggagcucacucuuggaaaggguuuccuguccagcuucuu

SEQ ID NO: 696732 - RNA, 64 nt, Homo Sapiens
gagcucacucuuggaaagacuuuccuguccagcuucuuggaaagucagauccacauuuauuggg

SEQ ID NO: 696733 - RNA, 64 nt, Homo Sapiens
uccuucauaaagccgcucuuugaucucucaccugucuuggaaaccauguuggacuuucacagug

SEQ ID NO: 696734 - RNA, 64 nt, Homo Sapiens
agcuugaguguuuucaucuuuaaagcugugggauucuuggaagccccaacuuuccaaaucugga

SEQ ID NO: 696735 - RNA, 64 nt, Homo Sapiens
ugaagaucugucgauucaucaaagauuuuccuucucuuggaaugaaaagauauuucagucuagg

SEQ ID NO: 696736 - RNA, 64 nt, Homo Sapiens
caguaagugcauauccuaaccauuucaccaugcaucuuggaauugggccccuuucugaucucac

SEQ ID NO: 696737 - RNA, 64 nt, Homo Sapiens
ccucauggucacuaauuuucgcuaauuagaaauaucuuggaaaguucaaaauuguacacaguuu

SEQ ID NO: 696738 - RNA, 64 nt, Homo Sapiens
uugcaggauuggaugggaacuuaucuacugcccuucuuggaaguuuucuuuuucuuuugaaaag

SEQ ID NO: 696739 - RNA, 64 nt, Homo Sapiens
gucccagcuaccaagucagaucuagagcaacuuuucuuggaacuaguggcuggaagaaccacug

SEQ ID NO: 696740 - RNA, 64 nt, Homo Sapiens
acagcgucuuccuucuuuauaagugaccuucugaucuuggaaaacuagauggaccccagcauuu

SEQ ID NO: 696741 - RNA, 64 nt, Homo Sapiens
ggcuuccccugugaugaaaauuaggaauuuucucucuuggaaaaaugaggaauuucaugaugau

SEQ ID NO: 696742 - RNA, 64 nt, Homo Sapiens
uuuauggucagucuacuuuuauacauaucacuauucuuggaauaguaucaacuagcauuggaaa

SEQ ID NO: 696743 - RNA, 64 nt, Homo Sapiens
cacagggaagauugaagagagagaucuugucguuucuuggaaguguuuaccgauggaugggcua

SEQ ID NO: 696744 - RNA, 64 nt, Homo Sapiens
ucuagguaauucaagcccucaggaauugaacacuucuuggaaaaugccagaaugagcaaccuca

SEQ ID NO: 696745 - RNA, 64 nt, Homo Sapiens
gcccaauaggcucagcucaugaugacagaacacaucuuggaaagacugacucuguuauguaacu

SEQ ID NO: 696746 - RNA, 64 nt, Homo Sapiens
uagaugaauacucaggcuaaccuaguggaugugaucuuggaacuuccaugauuauccacuuaaa

SEQ ID NO: 696747 - RNA, 64 nt, Homo Sapiens
ggagaauuuucucuagacuaauagcaaggcaucgucuuggaaccgcuuaauaauuaauggcuac

SEQ ID NO: 696748 - RNA, 64 nt, Homo Sapiens
auaucauuguuuugcaaauuucuguuuuucacauucuuggaaauaccaucugccuuaaauuucc

SEQ ID NO: 696749 - RNA, 64 nt, Homo Sapiens
ugcacuccagccugggcaccaaugugagaaccugucuuggaaaaaaaaaaaaagaaacauguuu

SEQ ID NO: 696750 - RNA, 64 nt, Homo Sapiens
ccagggcucuccuguugguaguuccugcuuuucuucuuggaaauuccucguggaccucgagauc

SEQ ID NO: 696751 - RNA, 64 nt, Homo Sapiens
ucaaaaaaaaucuuaaccugcagcaggcuguuugucuuggaagcuuuuguuugagcuuauaaga

SEQ ID NO: 696752 - RNA, 64 nt, Homo Sapiens
uaauaagcuacagaacuaauauucugcaaaugucucuuggaacacacugccuuaaacagauauu

SEQ ID NO: 696753 - RNA, 64 nt, Homo Sapiens
augucuuccaagugccaucccagccugccacgauucuuggaaaugggcuaauugccaccaauuu

SEQ ID NO: 696754 - RNA, 64 nt, Homo Sapiens
ccuuugggaagcagcaggaaugucagugacaccaucuuggaauaccucaacuaccucuucucac

SEQ ID NO: 696755 - RNA, 64 nt, Homo Sapiens
acccuaaauauguuuacauaccauuaagauaugauucauguaacaauguuaaauuaauuauaau

SEQ ID NO: 696756 - RNA, 64 nt, Homo Sapiens
acaugaaauucaacuuuccaaauaaaaguucuacuucauguaauccaaaaauguuuguauucug

SEQ ID NO: 696757 - RNA, 64 nt, Homo Sapiens
uuauacaguugguucacuucugaccagaaugcucuucauguagcgugccuguuaacaagaauac

SEQ ID NO: 696758 - RNA, 64 nt, Homo Sapiens
auuaauugcuaguuaugauguaaaguacagauauuucauguagaauaaauaauguuggugagga

SEQ ID NO: 696759 - RNA, 64 nt, Homo Sapiens
uuuaucucaagauaggaagaaaauuuccuccacauucauguacaaugauguaaauauuucaaua

SEQ ID NO: 696760 - RNA, 64 nt, Homo Sapiens
uccagacuuaaaacaugaugaguugagcucuaucuucauguacucauccugaauccuuauuuuu

SEQ ID NO: 696761 - RNA, 64 nt, Homo Sapiens
acccucagucuacacucacaccaucuccauugcauucauguacucauuucugcucagauucccc

SEQ ID NO: 696762 - RNA, 64 nt, Homo Sapiens
uuuguaucaccucuucacaauucucucuuacugcuucauguaauccucugggaaacagaccuuu

SEQ ID NO: 696763 - RNA, 64 nt, Homo Sapiens
auaagugaacaacuggaaauuacaaaugaaguauuucauguaauauaacauucaauuugcuauu

SEQ ID NO: 696764 - RNA, 64 nt, Homo Sapiens
uuauagucacucauucuucgaaaggaugagauuuuucauguauccuguucacauccaguugucu

SEQ ID NO: 696765 - RNA, 64 nt, Homo Sapiens
cugguaggggauuuuugagaauucuuuuaccacuuucauguaaguuucaagcuaagcuuauuga

SEQ ID NO: 696766 - RNA, 64 nt, Homo Sapiens
aagauagccaaaagcauaggauuuuaacucaaaauucauguaacuucaaacucauaaacucagu

SEQ ID NO: 696767 - RNA, 64 nt, Homo Sapiens
cuugauuguauacugucuuuuaauccuucauuguuucauguaugaaguuuuuaaucacccccua

SEQ ID NO: 696768 - RNA, 64 nt, Homo Sapiens
auaaacuugaugaauauuauaugugaggaaaacuuucauguauagcacucauugcuucagacag

SEQ ID NO: 696769 - RNA, 64 nt, Homo Sapiens
uuagucuugguucugaaacuuuucucuacagcuuuucauguaaaugaauggacuuuucaacuac

SEQ ID NO: 696770 - RNA, 64 nt, Homo Sapiens
uggaauaaaaguuuuaugaaacacguguauuaaauucauguaaguccaagcauaauuguuaaga

SEQ ID NO: 696771 - RNA, 64 nt, Homo Sapiens
ucaagcacagcaguaaaacauugguauucauuacuucauguauaaugcaggaaaaaugaauugc

SEQ ID NO: 696772 - RNA, 64 nt, Homo Sapiens
gguauuaaagauuuaaagucucuuaggaauauuauucauguaacuccauggcauaaauaguugu

SEQ ID NO: 696773 - RNA, 64 nt, Homo Sapiens
uuaaggguguacauuuugauguugaacaucaguuuucauguagacuuaggacucaugugcagua

SEQ ID NO: 696774 - RNA, 64 nt, Homo Sapiens
gcagcauuuauuuuaugauauaaugaaauguucguucauguauauacauuuuuaaaagugcuuu

SEQ ID NO: 696775 - RNA, 64 nt, Homo Sapiens
uacauguggauaucuaugaaugguaauguuuuccuucauguaagugccuauucagaguuucaga

SEQ ID NO: 696776 - RNA, 64 nt, Homo Sapiens
ucaggcacagaaagaauagccugauguccaugacuucauguaguaugaggguguccuaaagauc

SEQ ID NO: 696777 - RNA, 64 nt, Homo Sapiens
uuugucuuuuccucuagaaccagcaggguucaguuucauguaucggaccuugcugcauccugca

SEQ ID NO: 696778 - RNA, 64 nt, Homo Sapiens
cauaugucuuguaggugguaaaacuuuuuugauguucauguacuuggauuuguaaaucaagcug

SEQ ID NO: 696779 - RNA, 64 nt, Homo Sapiens
uuguauauaaaauauaggcaugaauauauauauauucauguaucuuuauauacacauauguaca

SEQ ID NO: 696780 - RNA, 64 nt, Homo Sapiens
gaauguacuggguugaaugguguccucuccaaaauucauguacuuccuggagccucaguaugug

SEQ ID NO: 696781 - RNA, 64 nt, Homo Sapiens
ccuucaauaaacacaaaauugguuucaaaauguuuucauguaaaaauaaauuaacuuuucugua

SEQ ID NO: 696782 - RNA, 64 nt, Homo Sapiens
agauaauuccagcagaauccgucuaagaagaccuuucauguacuucccuaggacuagaugcaua

SEQ ID NO: 696783 - RNA, 64 nt, Homo Sapiens
uugauagauauuacauggacuaaauuuugucaauuucauguaauuuacccuuugcaauaaaaau

SEQ ID NO: 696784 - RNA, 64 nt, Homo Sapiens
cugcagcuuguccuuuugcccacauagggccuauuucauguacuguuaguuuucucuggggacu

SEQ ID NO: 696785 - RNA, 64 nt, Homo Sapiens
cagagagaaggagcucaaaagauacuugaugucuuucauguaaguuuaccuggucuuuuccuau

SEQ ID NO: 696786 - RNA, 64 nt, Homo Sapiens
ccucuggcucgguuuccuuucuuuggucugauacuucauguauuugaauauaguuaaaucguau

SEQ ID NO: 696787 - RNA, 64 nt, Homo Sapiens
uugugaugugacuaaaagccacuuugugacucccuucauguaauccucuuuuccuccccacucc

SEQ ID NO: 696788 - RNA, 64 nt, Homo Sapiens
gugugucacaucacauauugugcagcuguugguuuucauguagugcccugcgauggaaauuaga

SEQ ID NO: 696789 - RNA, 64 nt, Homo Sapiens
ucauguagugcccugcgauggaaauuagauauauuucauguauuuuuccauugaagguggaguu

SEQ ID NO: 696790 - RNA, 64 nt, Homo Sapiens
gcaggauuugaaacuuggagagcuguuuucucauuucauguacacuugccccaaauugucuuug

SEQ ID NO: 696791 - RNA, 64 nt, Homo Sapiens
uuguaccaaggucacuuaucuaacaaaauaacccuucauguauuuuaaauuuauuugacaaguc

SEQ ID NO: 696792 - RNA, 64 nt, Homo Sapiens
uugauuuuggaauucugucauugcgauguauauuuucauguaauucaccuauuguacaaagaaa

SEQ ID NO: 696793 - RNA, 64 nt, Homo Sapiens
uccacaaauacaccuuguacuaauauauauacuguucauguacaauagcacaacaugauccgga

SEQ ID NO: 696794 - RNA, 64 nt, Homo Sapiens; identical to SEQ ID NO: 58182

SEQ ID NO: 696795 - RNA, 64 nt, Homo Sapiens; identical to SEQ ID NO: 58183

SEQ ID NO: 696796 - RNA, 64 nt, Homo Sapiens; identical to SEQ ID NO: 58184

SEQ ID NO: 696797 - RNA, 64 nt, Homo Sapiens; identical to SEQ ID NO: 58185

SEQ ID NO: 696798 - RNA, 64 nt, Homo Sapiens; identical to SEQ ID NO: 58186

SEQ ID NO: 696799 - RNA, 64 nt, Homo Sapiens; identical to SEQ ID NO: 58187

SEQ ID NO: 696800 - RNA, 64 nt, Homo Sapiens; identical to SEQ ID NO: 58188

SEQ ID NO: 696801 - RNA, 64 nt, Homo Sapiens; identical to SEQ ID NO: 58189

SEQ ID NO: 696802 - RNA, 64 nt, Homo Sapiens; identical to SEQ ID NO: 58190

SEQ ID NO: 696803 - RNA, 64 nt, Homo Sapiens; identical to SEQ ID NO: 58191

SEQ ID NO: 696804 - RNA, 64 nt, Homo Sapiens; identical to SEQ ID NO: 58192

SEQ ID NO: 696805 - RNA, 64 nt, Homo Sapiens; identical to SEQ ID NO: 58193

SEQ ID NO: 696806 - RNA, 64 nt, Homo Sapiens; identical to SEQ ID NO: 58194

SEQ ID NO: 696807 - RNA, 64 nt, Homo Sapiens; identical to SEQ ID NO: 58195

SEQ ID NO: 696808 - RNA, 64 nt, Homo Sapiens; identical to SEQ ID NO: 58196

SEQ ID NO: 696809 - RNA, 64 nt, Homo Sapiens; identical to SEQ ID NO: 58197

SEQ ID NO: 696810 - RNA, 64 nt, Homo Sapiens; identical to SEQ ID NO: 58198

SEQ ID NO: 696811 - RNA, 64 nt, Homo Sapiens; identical to SEQ ID NO: 58199

SEQ ID NO: 696812 - RNA, 64 nt, Homo Sapiens; identical to SEQ ID NO: 58200

SEQ ID NO: 696813 - RNA, 64 nt, Homo Sapiens; identical to SEQ ID NO: 58201

SEQ ID NO: 696814 - RNA, 64 nt, Homo Sapiens; identical to SEQ ID NO: 58202

SEQ ID NO: 696815 - RNA, 64 nt, Homo Sapiens; identical to SEQ ID NO: 58203

SEQ ID NO: 696816 - RNA, 64 nt, Homo Sapiens; identical to SEQ ID NO: 58204

SEQ ID NO: 696817 - RNA, 64 nt, Homo Sapiens; identical to SEQ ID NO: 58205

SEQ ID NO: 696818 - RNA, 64 nt, Homo Sapiens; identical to SEQ ID NO: 58206

SEQ ID NO: 696819 - RNA, 64 nt, Homo Sapiens; identical to SEQ ID NO: 58207

SEQ ID NO: 696820 - RNA, 64 nt, Homo Sapiens; identical to SEQ ID NO: 58208

SEQ ID NO: 696821 - RNA, 64 nt, Homo Sapiens; identical to SEQ ID NO: 58209

SEQ ID NO: 696822 - RNA, 64 nt, Homo Sapiens; identical to SEQ ID NO: 58210

SEQ ID NO: 696823 - RNA, 64 nt, Homo Sapiens; identical to SEQ ID NO: 58211

SEQ ID NO: 696824 - RNA, 64 nt, Homo Sapiens; identical to SEQ ID NO: 58212

SEQ ID NO: 696825 - RNA, 64 nt, Homo Sapiens; identical to SEQ ID NO: 58213

SEQ ID NO: 696826 - RNA, 64 nt, Homo Sapiens; identical to SEQ ID NO: 58214

SEQ ID NO: 696827 - RNA, 64 nt, Homo Sapiens; identical to SEQ ID NO: 58215

SEQ ID NO: 696828 - RNA, 64 nt, Homo Sapiens; identical to SEQ ID NO: 87706

SEQ ID NO: 696829 - RNA, 64 nt, Homo Sapiens; identical to SEQ ID NO: 87707

SEQ ID NO: 696830 - RNA, 64 nt, Homo Sapiens; identical to SEQ ID NO: 87708

SEQ ID NO: 696831 - RNA, 64 nt, Homo Sapiens; identical to SEQ ID NO: 87709

SEQ ID NO: 696832 - RNA, 64 nt, Homo Sapiens; identical to SEQ ID NO: 87710

SEQ ID NO: 696833 - RNA, 64 nt, Homo Sapiens; identical to SEQ ID NO: 87711

SEQ ID NO: 696834 - RNA, 64 nt, Homo Sapiens; identical to SEQ ID NO: 87712

SEQ ID NO: 696835 - RNA, 64 nt, Homo Sapiens; identical to SEQ ID NO: 87713

SEQ ID NO: 696836 - RNA, 64 nt, Homo Sapiens; identical to SEQ ID NO: 87714

SEQ ID NO: 696837 - RNA, 64 nt, Homo Sapiens; identical to SEQ ID NO: 87715

SEQ ID NO: 696838 - RNA, 64 nt, Homo Sapiens; identical to SEQ ID NO: 87716

SEQ ID NO: 696839 - RNA, 64 nt, Homo Sapiens; identical to SEQ ID NO: 87717

SEQ ID NO: 696840 - RNA, 64 nt, Homo Sapiens; identical to SEQ ID NO: 87718

SEQ ID NO: 696841 - RNA, 64 nt, Homo Sapiens; identical to SEQ ID NO: 87719

SEQ ID NO: 696842 - RNA, 64 nt, Homo Sapiens; identical to SEQ ID NO: 87720

SEQ ID NO: 696843 - RNA, 64 nt, Homo Sapiens; identical to SEQ ID NO: 87721

SEQ ID NO: 696844 - RNA, 64 nt, Homo Sapiens; identical to SEQ ID NO: 87722

SEQ ID NO: 696845 - RNA, 64 nt, Homo Sapiens; identical to SEQ ID NO: 87723

SEQ ID NO: 696846 - RNA, 64 nt, Homo Sapiens; identical to SEQ ID NO: 87724

SEQ ID NO: 696847 - RNA, 64 nt, Homo Sapiens; identical to SEQ ID NO: 87725

SEQ ID NO: 696848 - RNA, 64 nt, Homo Sapiens; identical to SEQ ID NO: 87726

SEQ ID NO: 696849 - RNA, 64 nt, Homo Sapiens; identical to SEQ ID NO: 87727

SEQ ID NO: 696850 - RNA, 64 nt, Homo Sapiens; identical to SEQ ID NO: 87728

SEQ ID NO: 696851 - RNA, 64 nt, Homo Sapiens; identical to SEQ ID NO: 87729

SEQ ID NO: 696852 - RNA, 64 nt, Homo Sapiens; identical to SEQ ID NO: 87730

SEQ ID NO: 696853 - RNA, 64 nt, Homo Sapiens; identical to SEQ ID NO: 87731

SEQ ID NO: 696854 - RNA, 64 nt, Homo Sapiens; identical to SEQ ID NO: 87732

SEQ ID NO: 696855 - RNA, 64 nt, Homo Sapiens; identical to SEQ ID NO: 87733

SEQ ID NO: 696856 - RNA, 64 nt, Homo Sapiens; identical to SEQ ID NO: 87734

SEQ ID NO: 696857 - RNA, 64 nt, Homo Sapiens; identical to SEQ ID NO: 87735

SEQ ID NO: 696858 - RNA, 64 nt, Homo Sapiens; identical to SEQ ID NO: 87736

SEQ ID NO: 696859 - RNA, 64 nt, Homo Sapiens; identical to SEQ ID NO: 87737

SEQ ID NO: 696860 - RNA, 64 nt, Homo Sapiens; identical to SEQ ID NO: 87738

SEQ ID NO: 696861 - RNA, 64 nt, Homo Sapiens; identical to SEQ ID NO: 87739

SEQ ID NO: 696862 - RNA, 64 nt, Homo Sapiens; identical to SEQ ID NO: 87740

SEQ ID NO: 696863 - RNA, 64 nt, Homo Sapiens; identical to SEQ ID NO: 87741

SEQ ID NO: 696864 - RNA, 64 nt, Homo Sapiens; identical to SEQ ID NO: 87742

SEQ ID NO: 696865 - RNA, 64 nt, Homo Sapiens; identical to SEQ ID NO: 87743

SEQ ID NO: 696866 - RNA, 64 nt, Homo Sapiens; identical to SEQ ID NO: 87744

SEQ ID NO: 696867 - RNA, 64 nt, Homo Sapiens; identical to SEQ ID NO: 87745

SEQ ID NO: 696868 - RNA, 64 nt, Homo Sapiens; identical to SEQ ID NO: 87746

SEQ ID NO: 696869 - RNA, 64 nt, Homo Sapiens; identical to SEQ ID NO: 87747

SEQ ID NO: 696870 - RNA, 64 nt, Homo Sapiens; identical to SEQ ID NO: 87748

SEQ ID NO: 696871 - RNA, 64 nt, Homo Sapiens; identical to SEQ ID NO: 87749

SEQ ID NO: 696872 - RNA, 64 nt, Homo Sapiens; identical to SEQ ID NO: 87750

SEQ ID NO: 696873 - RNA, 64 nt, Homo Sapiens; identical to SEQ ID NO: 87751

SEQ ID NO: 696874 - RNA, 64 nt, Homo Sapiens; identical to SEQ ID NO: 87752

SEQ ID NO: 696875 - RNA, 64 nt, Homo Sapiens; identical to SEQ ID NO: 87753

SEQ ID NO: 696876 - RNA, 64 nt, Homo Sapiens; identical to SEQ ID NO: 87754

SEQ ID NO: 696877 - RNA, 64 nt, Homo Sapiens; identical to SEQ ID NO: 87755

SEQ ID NO: 696878 - RNA, 64 nt, Homo Sapiens; identical to SEQ ID NO: 87756

SEQ ID NO: 696879 - RNA, 63 nt, Homo Sapiens; identical to SEQ ID NO: 87757

SEQ ID NO: 696880 - RNA, 64 nt, Homo Sapiens; identical to SEQ ID NO: 87758

SEQ ID NO: 696881 - RNA, 64 nt, Homo Sapiens; identical to SEQ ID NO: 235822

SEQ ID NO: 696882 - RNA, 64 nt, Homo Sapiens; identical to SEQ ID NO: 235823

SEQ ID NO: 696883 - RNA, 64 nt, Homo Sapiens; identical to SEQ ID NO: 235824

SEQ ID NO: 696884 - RNA, 64 nt, Homo Sapiens; identical to SEQ ID NO: 235825

SEQ ID NO: 696885 - RNA, 64 nt, Homo Sapiens; identical to SEQ ID NO: 235826

SEQ ID NO: 696886 - RNA, 64 nt, Homo Sapiens; identical to SEQ ID NO: 235827

SEQ ID NO: 696887 - RNA, 64 nt, Homo Sapiens; identical to SEQ ID NO: 235828

SEQ ID NO: 696888 - RNA, 64 nt, Homo Sapiens; identical to SEQ ID NO: 235829

SEQ ID NO: 696889 - RNA, 64 nt, Homo Sapiens; identical to SEQ ID NO: 235830

SEQ ID NO: 696890 - RNA, 64 nt, Homo Sapiens; identical to SEQ ID NO: 235831

SEQ ID NO: 696891 - RNA, 64 nt, Homo Sapiens; identical to SEQ ID NO: 235832

SEQ ID NO: 696892 - RNA, 64 nt, Homo Sapiens; identical to SEQ ID NO: 235833

SEQ ID NO: 696893 - RNA, 64 nt, Homo Sapiens; identical to SEQ ID NO: 235834

SEQ ID NO: 696894 - RNA, 64 nt, Homo Sapiens; identical to SEQ ID NO: 235835

SEQ ID NO: 696895 - RNA, 64 nt, Homo Sapiens; identical to SEQ ID NO: 235836

SEQ ID NO: 696896 - RNA, 64 nt, Homo Sapiens; identical to SEQ ID NO: 235837

SEQ ID NO: 696897 - RNA, 64 nt, Homo Sapiens; identical to SEQ ID NO: 235838

SEQ ID NO: 696898 - RNA, 64 nt, Homo Sapiens; identical to SEQ ID NO: 235839

SEQ ID NO: 696899 - RNA, 64 nt, Homo Sapiens; identical to SEQ ID NO: 235840

SEQ ID NO: 696900 - RNA, 64 nt, Homo Sapiens; identical to SEQ ID NO: 235841

SEQ ID NO: 696901 - RNA, 64 nt, Homo Sapiens; identical to SEQ ID NO: 235842

SEQ ID NO: 696902 - RNA, 64 nt, Homo Sapiens; identical to SEQ ID NO: 235843

SEQ ID NO: 696903 - RNA, 64 nt, Homo Sapiens; identical to SEQ ID NO: 235844

SEQ ID NO: 696904 - RNA, 64 nt, Homo Sapiens; identical to SEQ ID NO: 235845

SEQ ID NO: 696905 - RNA, 55 nt, Homo Sapiens; identical to SEQ ID NO: 235846

SEQ ID NO: 696906 - RNA, 64 nt, Homo Sapiens; identical to SEQ ID NO: 235847

SEQ ID NO: 696907 - RNA, 64 nt, Homo Sapiens; identical to SEQ ID NO: 235848

SEQ ID NO: 696908 - RNA, 64 nt, Homo Sapiens; identical to SEQ ID NO: 235849

SEQ ID NO: 696909 - RNA, 64 nt, Homo Sapiens; identical to SEQ ID NO: 235850

SEQ ID NO: 696910 - RNA, 64 nt, Homo Sapiens; identical to SEQ ID NO: 235851

SEQ ID NO: 696911 - RNA, 64 nt, Homo Sapiens; identical to SEQ ID NO: 235852

SEQ ID NO: 696912 - RNA, 64 nt, Homo Sapiens; identical to SEQ ID NO: 235853

SEQ ID NO: 696913 - RNA, 64 nt, Homo Sapiens; identical to SEQ ID NO: 235854

SEQ ID NO: 696914 - RNA, 64 nt, Homo Sapiens; identical to SEQ ID NO: 235855

SEQ ID NO: 696915 - RNA, 64 nt, Homo Sapiens; identical to SEQ ID NO: 235856

SEQ ID NO: 696916 - RNA, 64 nt, Homo Sapiens; identical to SEQ ID NO: 235857

SEQ ID NO: 696917 - RNA, 64 nt, Homo Sapiens; identical to SEQ ID NO: 235858

SEQ ID NO: 696918 - RNA, 64 nt, Homo Sapiens; identical to SEQ ID NO: 235859

SEQ ID NO: 696919 - RNA, 64 nt, Homo Sapiens; identical to SEQ ID NO: 235860

SEQ ID NO: 696920 - RNA, 64 nt, Homo Sapiens; identical to SEQ ID NO: 235861

SEQ ID NO: 696921 - RNA, 64 nt, Homo Sapiens; identical to SEQ ID NO: 235862

SEQ ID NO: 696922 - RNA, 64 nt, Homo Sapiens; identical to SEQ ID NO: 235863

SEQ ID NO: 696923 - RNA, 64 nt, Homo Sapiens; identical to SEQ ID NO: 235864

SEQ ID NO: 696924 - RNA, 64 nt, Homo Sapiens; identical to SEQ ID NO: 235865

SEQ ID NO: 696925 - RNA, 64 nt, Homo Sapiens; identical to SEQ ID NO: 235866

SEQ ID NO: 696926 - RNA, 64 nt, Homo Sapiens; identical to SEQ ID NO: 235867

SEQ ID NO: 696927 - RNA, 64 nt, Homo Sapiens; identical to SEQ ID NO: 235868

SEQ ID NO: 696928 - RNA, 64 nt, Homo Sapiens; identical to SEQ ID NO: 235869

SEQ ID NO: 696929 - RNA, 64 nt, Homo Sapiens; identical to SEQ ID NO: 235870

SEQ ID NO: 696930 - RNA, 64 nt, Homo Sapiens; identical to SEQ ID NO: 235871

SEQ ID NO: 696931 - RNA, 64 nt, Homo Sapiens; identical to SEQ ID NO: 235872

SEQ ID NO: 696932 - RNA, 64 nt, Homo Sapiens; identical to SEQ ID NO: 235873

SEQ ID NO: 696933 - RNA, 64 nt, Homo Sapiens; identical to SEQ ID NO: 235874

SEQ ID NO: 696934 - RNA, 64 nt, Homo Sapiens; identical to SEQ ID NO: 235875

SEQ ID NO: 696935 - RNA, 64 nt, Homo Sapiens; identical to SEQ ID NO: 235876

SEQ ID NO: 696936 - RNA, 64 nt, Homo Sapiens; identical to SEQ ID NO: 235877

SEQ ID NO: 696937 - RNA, 64 nt, Homo Sapiens; identical to SEQ ID NO: 235878

SEQ ID NO: 696938 - RNA, 64 nt, Homo Sapiens; identical to SEQ ID NO: 235879

SEQ ID NO: 696939 - RNA, 64 nt, Homo Sapiens; identical to SEQ ID NO: 235880

SEQ ID NO: 696940 - RNA, 64 nt, Homo Sapiens; identical to SEQ ID NO: 235881

SEQ ID NO: 696941 - RNA, 64 nt, Homo Sapiens; identical to SEQ ID NO: 235882

SEQ ID NO: 696942 - RNA, 64 nt, Homo Sapiens; identical to SEQ ID NO: 235883

SEQ ID NO: 696943 - RNA, 64 nt, Homo Sapiens; identical to SEQ ID NO: 235884

SEQ ID NO: 696944 - RNA, 64 nt, Homo Sapiens; identical to SEQ ID NO: 235885

SEQ ID NO: 696945 - RNA, 64 nt, Homo Sapiens; identical to SEQ ID NO: 235886

SEQ ID NO: 696946 - RNA, 61 nt, Homo Sapiens
cuuaaacucauggggagggcccccaaacccugagcuucacacauauggggggccgugcaca

SEQ ID NO: 696947 - RNA, 61 nt, Homo Sapiens
cucuccgcuccaccccuuaggcgcugcuacagagcuucacgcugcccugucccggguuugc

SEQ ID NO: 696948 - RNA, 61 nt, Homo Sapiens
gugaucaagguauggcggccagaagcuuccugagcuucaagacaaggucaucaugcuccac

SEQ ID NO: 696949 - RNA, 61 nt, Homo Sapiens
gucaucuuuuuccacuuugauuuauuaacuugagcuucacuucugcaacccgguuuaccag

SEQ ID NO: 696950 - RNA, 61 nt, Homo Sapiens
auggcaugauuuaaggcuucuuuucaccugagagcuucaguucuucugcagaauggcugca

SEQ ID NO: 696951 - RNA, 61 nt, Homo Sapiens
ucagucuuccacacacaaaaaauaccucacagagcuucaccaaaucacagauucaggagga

SEQ ID NO: 696952 - RNA, 61 nt, Homo Sapiens
cuuagccuccugaguagccauugccucaagugagcuucaacccaagcuggccuugaacccc

SEQ ID NO: 696953 - RNA, 61 nt, Homo Sapiens
ccucugggucagagacugacuguuauaaauggagcuucagcugcaucuaacuguucaucuc

SEQ ID NO: 696954 - RNA, 61 nt, Homo Sapiens
cucgcgucccacugcccacagccucuugccugagcuucagaacuccaaagauguaacucua

SEQ ID NO: 696955 - RNA, 61 nt, Homo Sapiens
gcauacaggucaauuaagaagugucucuauagagcuucaaaaggccugaagggauaagauu

SEQ ID NO: 696956 - RNA, 64 nt, Homo Sapiens
uauguugaaugcuuaaagcaaggcauaccuguccuagcaggaucugcccacaccucggccguac

SEQ ID NO: 696957 - RNA, 64 nt, Homo Sapiens
gguuguuuuuuuuuuuuuuucuccauucugaaaauagcaggacauuuaccucuuaaauaaacuu

SEQ ID NO: 696958 - RNA, 64 nt, Homo Sapiens
gacaaaggcuucccagagccaccaaaaaccuucuuagcaggacagcugugagaggcaucagaac

SEQ ID NO: 696959 - RNA, 64 nt, Homo Sapiens
augcaccuugaucucacccucacuccaaggcacauagcaggaucacucccuagcuucucugagc

SEQ ID NO: 696960 - RNA, 64 nt, Homo Sapiens
cucccuuggcuucgcccuccaggcucugaguggcuagcaggaccguuacuguguggauacagga

SEQ ID NO: 696961 - RNA, 64 nt, Homo Sapiens
ucagaugcaggagagagaccaaggaggagaagccuagcaggauugguuugaggguccaagggac

SEQ ID NO: 696962 - RNA, 64 nt, Homo Sapiens; identical to SEQ ID NO: 154299

SEQ ID NO: 696963 - RNA, 64 nt, Homo Sapiens; identical to SEQ ID NO: 154300

SEQ ID NO: 696964 - RNA, 64 nt, Homo Sapiens; identical to SEQ ID NO: 154301

SEQ ID NO: 696965 - RNA, 64 nt, Homo Sapiens; identical to SEQ ID NO: 154302

SEQ ID NO: 696966 - RNA, 64 nt, Homo Sapiens; identical to SEQ ID NO: 154303

SEQ ID NO: 696967 - RNA, 64 nt, Homo Sapiens; identical to SEQ ID NO: 154304

SEQ ID NO: 696968 - RNA, 64 nt, Homo Sapiens; identical to SEQ ID NO: 154305

SEQ ID NO: 696969 - RNA, 64 nt, Homo Sapiens; identical to SEQ ID NO: 154306

SEQ ID NO: 696970 - RNA, 64 nt, Homo Sapiens; identical to SEQ ID NO: 154307

SEQ ID NO: 696971 - RNA, 64 nt, Homo Sapiens; identical to SEQ ID NO: 154308

SEQ ID NO: 696972 - RNA, 64 nt, Homo Sapiens; identical to SEQ ID NO: 154309

SEQ ID NO: 696973 - RNA, 64 nt, Homo Sapiens; identical to SEQ ID NO: 154310

SEQ ID NO: 696974 - RNA, 64 nt, Homo Sapiens; identical to SEQ ID NO: 154311

SEQ ID NO: 696975 - RNA, 64 nt, Homo Sapiens; identical to SEQ ID NO: 154312

SEQ ID NO: 696976 - RNA, 64 nt, Homo Sapiens; identical to SEQ ID NO: 154313

SEQ ID NO: 696977 - RNA, 54 nt, Homo Sapiens; identical to SEQ ID NO: 154314

SEQ ID NO: 696978 - RNA, 64 nt, Homo Sapiens; identical to SEQ ID NO: 154315

SEQ ID NO: 696979 - RNA, 64 nt, Homo Sapiens; identical to SEQ ID NO: 154316

SEQ ID NO: 696980 - RNA, 64 nt, Homo Sapiens; identical to SEQ ID NO: 154317

SEQ ID NO: 696981 - RNA, 64 nt, Homo Sapiens; identical to SEQ ID NO: 154318

SEQ ID NO: 696982 - RNA, 64 nt, Homo Sapiens; identical to SEQ ID NO: 154319

SEQ ID NO: 696983 - RNA, 64 nt, Homo Sapiens; identical to SEQ ID NO: 154320

SEQ ID NO: 696984 - RNA, 64 nt, Homo Sapiens; identical to SEQ ID NO: 154321

SEQ ID NO: 696985 - RNA, 64 nt, Homo Sapiens; identical to SEQ ID NO: 154322

SEQ ID NO: 696986 - RNA, 64 nt, Homo Sapiens; identical to SEQ ID NO: 154323

SEQ ID NO: 696987 - RNA, 64 nt, Homo Sapiens; identical to SEQ ID NO: 154324

SEQ ID NO: 696988 - RNA, 64 nt, Homo Sapiens; identical to SEQ ID NO: 154325

SEQ ID NO: 696989 - RNA, 64 nt, Homo Sapiens; identical to SEQ ID NO: 154326

SEQ ID NO: 696990 - RNA, 64 nt, Homo Sapiens; identical to SEQ ID NO: 154327

SEQ ID NO: 696991 - RNA, 64 nt, Homo Sapiens; identical to SEQ ID NO: 154328

SEQ ID NO: 696992 - RNA, 64 nt, Homo Sapiens; identical to SEQ ID NO: 154329

SEQ ID NO: 696993 - RNA, 64 nt, Homo Sapiens; identical to SEQ ID NO: 154330

SEQ ID NO: 696994 - RNA, 64 nt, Homo Sapiens; identical to SEQ ID NO: 154331

SEQ ID NO: 696995 - RNA, 64 nt, Homo Sapiens; identical to SEQ ID NO: 154332

SEQ ID NO: 696996 - RNA, 64 nt, Homo Sapiens; identical to SEQ ID NO: 154333

SEQ ID NO: 696997 - RNA, 64 nt, Homo Sapiens; identical to SEQ ID NO: 154334

SEQ ID NO: 696998 - RNA, 64 nt, Homo Sapiens; identical to SEQ ID NO: 154335

SEQ ID NO: 696999 - RNA, 64 nt, Homo Sapiens; identical to SEQ ID NO: 154336

SEQ ID NO: 697000 - RNA, 64 nt, Homo Sapiens; identical to SEQ ID NO: 154337

SEQ ID NO: 697001 - RNA, 64 nt, Homo Sapiens; identical to SEQ ID NO: 154338

SEQ ID NO: 697002 - RNA, 64 nt, Homo Sapiens; identical to SEQ ID NO: 154339

SEQ ID NO: 697003 - RNA, 64 nt, Homo Sapiens; identical to SEQ ID NO: 154340

SEQ ID NO: 697004 - RNA, 64 nt, Homo Sapiens; identical to SEQ ID NO: 154341

SEQ ID NO: 697005 - RNA, 64 nt, Homo Sapiens; identical to SEQ ID NO: 154342

SEQ ID NO: 697006 - RNA, 64 nt, Homo Sapiens; identical to SEQ ID NO: 154343

SEQ ID NO: 697007 - RNA, 64 nt, Homo Sapiens; identical to SEQ ID NO: 154344

SEQ ID NO: 697008 - RNA, 64 nt, Homo Sapiens; identical to SEQ ID NO: 154345

SEQ ID NO: 697009 - RNA, 55 nt, Homo Sapiens; identical to SEQ ID NO: 154346

SEQ ID NO: 697010 - RNA, 64 nt, Homo Sapiens; identical to SEQ ID NO: 154347

SEQ ID NO: 697011 - RNA, 64 nt, Homo Sapiens; identical to SEQ ID NO: 154348

SEQ ID NO: 697012 - RNA, 64 nt, Homo Sapiens; identical to SEQ ID NO: 154349

SEQ ID NO: 697013 - RNA, 64 nt, Homo Sapiens; identical to SEQ ID NO: 154350

SEQ ID NO: 697014 - RNA, 64 nt, Homo Sapiens; identical to SEQ ID NO: 154351

SEQ ID NO: 697015 - RNA, 64 nt, Homo Sapiens; identical to SEQ ID NO: 154352

SEQ ID NO: 697016 - RNA, 64 nt, Homo Sapiens; identical to SEQ ID NO: 154353

SEQ ID NO: 697017 - RNA, 64 nt, Homo Sapiens; identical to SEQ ID NO: 154354

SEQ ID NO: 697018 - RNA, 64 nt, Homo Sapiens; identical to SEQ ID NO: 154355

SEQ ID NO: 697019 - RNA, 64 nt, Homo Sapiens; identical to SEQ ID NO: 154356

SEQ ID NO: 697020 - RNA, 64 nt, Homo Sapiens
uaaguuuucggcucugaagaacugacacuagcuagauuuguauucagagugugagagcaagcuc

SEQ ID NO: 697021 - RNA, 64 nt, Homo Sapiens
uaagcuaccuaauccucugaaaacuguuuucucugauuuguauuuagauuccuccccccauuau

SEQ ID NO: 697022 - RNA, 64 nt, Homo Sapiens
cacuauuuacugaaaaguucauccuuuccccagugauuuguaacacugccucuuucauaaauua

SEQ ID NO: 697023 - RNA, 64 nt, Homo Sapiens
ucaaacaaacccaagagcauugaaauuuugauuggauuuguauugaauuuauagauuaaucugg

SEQ ID NO: 697024 - RNA, 64 nt, Homo Sapiens
aucauauaauuaccuuuucaugcugccugagcaagauuuguagagacauuugaguuauacucug

SEQ ID NO: 697025 - RNA, 64 nt, Homo Sapiens
guuucuuaaucauuggacaugcuacuucuggugugauuuguaauuagcauaguaugcuacuauu

SEQ ID NO: 697026 - RNA, 64 nt, Homo Sapiens
ucaagcugaaacuuuuuugaagcaauuuaccuuggauuuguaaacucuguagcuuuucagaaga

SEQ ID NO: 697027 - RNA, 64 nt, Homo Sapiens
aauuuuuucugaaauuuaaagauuauuuuuauaugauuuguacaaaauacugauuucuuccaug

SEQ ID NO: 697028 - RNA, 64 nt, Homo Sapiens
uauugugaauucuuuuucacugcaagaguaacaggauuuguagccuugugcuucuugcuaagag

SEQ ID NO: 697029 - RNA, 64 nt, Homo Sapiens
cugaacugaucccaggugaacgguuuauugccuagauuuguacucagaggaauuuuuuuuguuu

SEQ ID NO: 697030 - RNA, 64 nt, Homo Sapiens
gaagagcccauuaucaacuuuuaaaagugaauuugauuuguacccaccaggagaaauacaguug

SEQ ID NO: 697031 - RNA, 64 nt, Homo Sapiens
aaguauuuugguauuuuaaggucucaugauuagggauuuguagccucagguuugaaucagucac

SEQ ID NO: 697032 - RNA, 64 nt, Homo Sapiens
uucucaucuauucuuuuugguuuugaaaagugaggauuuguauuuauguacuuggauuguuucu

SEQ ID NO: 697033 - RNA, 64 nt, Homo Sapiens
caguuucuuauuuucauauuuuauuacugucagagauuuguagauaugcauuguauauugcaau

SEQ ID NO: 697034 - RNA, 64 nt, Homo Sapiens
uccaagccugcuguuuugaacccacagcaguggagauuuguauucuuauuuacaguuguguacu

SEQ ID NO: 697035 - RNA, 64 nt, Homo Sapiens
guuuuguguaauaauuauuuguaaauauuauuuagauuuguauuuagacaugauuuauaucuaa

SEQ ID NO: 697036 - RNA, 64 nt, Homo Sapiens
uauaauugcuuagccuccaugaccugucguuaaggauuuguaggcaggauuuuucauuaggaga

SEQ ID NO: 697037 - RNA, 64 nt, Homo Sapiens
ucugugcuugaacuugaaugauggggcucugaaagauuuguauccauauuucaaacacaacuag

SEQ ID NO: 697038 - RNA, 64 nt, Homo Sapiens
acuuaaaugaucagacagaauauaacauucucaggauuuguaacaguaccuaauuuguucaaug

SEQ ID NO: 697039 - RNA, 64 nt, Homo Sapiens
ucagaguauuuuuuaaaggauuuaauacauaggugauuuguaccuauaaugucagagacucaug

SEQ ID NO: 697040 - RNA, 64 nt, Homo Sapiens
aaaaggugcuacgguagugaugaaauuauaaguagauuuguaguuugucccauuuauuauuuua

SEQ ID NO: 697041 - RNA, 64 nt, Homo Sapiens
uucugacacuugugguauaguauuaguggaaagugauuuguaauaugauuuuauauccaccuac

SEQ ID NO: 697042 - RNA, 64 nt, Homo Sapiens
cuuucucguggguaaauauacccacagguucuaugauuuguagcucuagguuucuugaugauca

SEQ ID NO: 697043 - RNA, 64 nt, Homo Sapiens; identical to SEQ ID NO: 48360

SEQ ID NO: 697044 - RNA, 64 nt, Homo Sapiens; identical to SEQ ID NO: 48361

SEQ ID NO: 697045 - RNA, 64 nt, Homo Sapiens; identical to SEQ ID NO: 48362

SEQ ID NO: 697046 - RNA, 64 nt, Homo Sapiens; identical to SEQ ID NO: 48363

SEQ ID NO: 697047 - RNA, 64 nt, Homo Sapiens; identical to SEQ ID NO: 48364

SEQ ID NO: 697048 - RNA, 64 nt, Homo Sapiens; identical to SEQ ID NO: 48365

SEQ ID NO: 697049 - RNA, 64 nt, Homo Sapiens; identical to SEQ ID NO: 48366

SEQ ID NO: 697050 - RNA, 64 nt, Homo Sapiens; identical to SEQ ID NO: 48367

SEQ ID NO: 697051 - RNA, 64 nt, Homo Sapiens; identical to SEQ ID NO: 48368

SEQ ID NO: 697052 - RNA, 64 nt, Homo Sapiens; identical to SEQ ID NO: 48369

SEQ ID NO: 697053 - RNA, 64 nt, Homo Sapiens; identical to SEQ ID NO: 48370

SEQ ID NO: 697054 - RNA, 64 nt, Homo Sapiens; identical to SEQ ID NO: 48371

SEQ ID NO: 697055 - RNA, 64 nt, Homo Sapiens; identical to SEQ ID NO: 48372

SEQ ID NO: 697056 - RNA, 64 nt, Homo Sapiens; identical to SEQ ID NO: 48373

SEQ ID NO: 697057 - RNA, 64 nt, Homo Sapiens; identical to SEQ ID NO: 48374

SEQ ID NO: 697058 - RNA, 64 nt, Homo Sapiens; identical to SEQ ID NO: 48375

SEQ ID NO: 697059 - RNA, 64 nt, Homo Sapiens; identical to SEQ ID NO: 48376

SEQ ID NO: 697060 - RNA, 64 nt, Homo Sapiens; identical to SEQ ID NO: 48377

SEQ ID NO: 697061 - RNA, 64 nt, Homo Sapiens; identical to SEQ ID NO: 48378

SEQ ID NO: 697062 - RNA, 64 nt, Homo Sapiens; identical to SEQ ID NO: 48379

SEQ ID NO: 697063 - RNA, 64 nt, Homo Sapiens; identical to SEQ ID NO: 48380

SEQ ID NO: 697064 - RNA, 64 nt, Homo Sapiens; identical to SEQ ID NO: 48381

SEQ ID NO: 697065 - RNA, 64 nt, Homo Sapiens; identical to SEQ ID NO: 48382

SEQ ID NO: 697066 - RNA, 64 nt, Homo Sapiens; identical to SEQ ID NO: 48383

SEQ ID NO: 697067 - RNA, 64 nt, Homo Sapiens; identical to SEQ ID NO: 48384

SEQ ID NO: 697068 - RNA, 64 nt, Homo Sapiens; identical to SEQ ID NO: 48385

SEQ ID NO: 697069 - RNA, 64 nt, Homo Sapiens; identical to SEQ ID NO: 48386

SEQ ID NO: 697070 - RNA, 64 nt, Homo Sapiens; identical to SEQ ID NO: 48387

SEQ ID NO: 697071 - RNA, 64 nt, Homo Sapiens; identical to SEQ ID NO: 48388

SEQ ID NO: 697072 - RNA, 64 nt, Homo Sapiens; identical to SEQ ID NO: 48389

SEQ ID NO: 697073 - RNA, 64 nt, Homo Sapiens; identical to SEQ ID NO: 48390

SEQ ID NO: 697074 - RNA, 64 nt, Homo Sapiens; identical to SEQ ID NO: 48391

SEQ ID NO: 697075 - RNA, 64 nt, Homo Sapiens; identical to SEQ ID NO: 48392

SEQ ID NO: 697076 - RNA, 64 nt, Homo Sapiens; identical to SEQ ID NO: 48393

SEQ ID NO: 697077 - RNA, 64 nt, Homo Sapiens; identical to SEQ ID NO: 48394

SEQ ID NO: 697078 - RNA, 64 nt, Homo Sapiens; identical to SEQ ID NO: 48395

SEQ ID NO: 697079 - RNA, 64 nt, Homo Sapiens; identical to SEQ ID NO: 48396

SEQ ID NO: 697080 - RNA, 64 nt, Homo Sapiens; identical to SEQ ID NO: 48397

SEQ ID NO: 697081 - RNA, 64 nt, Homo Sapiens; identical to SEQ ID NO: 48398

SEQ ID NO: 697082 - RNA, 64 nt, Homo Sapiens; identical to SEQ ID NO: 48399

SEQ ID NO: 697083 - RNA, 64 nt, Homo Sapiens; identical to SEQ ID NO: 48400

SEQ ID NO: 697084 - RNA, 64 nt, Homo Sapiens; identical to SEQ ID NO: 48401

SEQ ID NO: 697085 - RNA, 64 nt, Homo Sapiens; identical to SEQ ID NO: 48402

SEQ ID NO: 697086 - RNA, 64 nt, Homo Sapiens; identical to SEQ ID NO: 48403

SEQ ID NO: 697087 - RNA, 64 nt, Homo Sapiens; identical to SEQ ID NO: 48404

SEQ ID NO: 697088 - RNA, 64 nt, Homo Sapiens; identical to SEQ ID NO: 48405

SEQ ID NO: 697089 - RNA, 64 nt, Homo Sapiens; identical to SEQ ID NO: 48406

SEQ ID NO: 697090 - RNA, 64 nt, Homo Sapiens; identical to SEQ ID NO: 48407

SEQ ID NO: 697091 - RNA, 64 nt, Homo Sapiens; identical to SEQ ID NO: 48408

SEQ ID NO: 697092 - RNA, 64 nt, Homo Sapiens; identical to SEQ ID NO: 48409

SEQ ID NO: 697093 - RNA, 64 nt, Homo Sapiens; identical to SEQ ID NO: 48410

SEQ ID NO: 697094 - RNA, 64 nt, Homo Sapiens; identical to SEQ ID NO: 48411

SEQ ID NO: 697095 - RNA, 64 nt, Homo Sapiens; identical to SEQ ID NO: 48412

SEQ ID NO: 697096 - RNA, 64 nt, Homo Sapiens; identical to SEQ ID NO: 48413

SEQ ID NO: 697097 - RNA, 64 nt, Homo Sapiens; identical to SEQ ID NO: 48414

SEQ ID NO: 697098 - RNA, 64 nt, Homo Sapiens; identical to SEQ ID NO: 48415

SEQ ID NO: 697099 - RNA, 64 nt, Homo Sapiens; identical to SEQ ID NO: 48416

SEQ ID NO: 697100 - RNA, 64 nt, Homo Sapiens; identical to SEQ ID NO: 48417

SEQ ID NO: 697101 - RNA, 64 nt, Homo Sapiens; identical to SEQ ID NO: 48418

SEQ ID NO: 697102 - RNA, 64 nt, Homo Sapiens; identical to SEQ ID NO: 48419

SEQ ID NO: 697103 - RNA, 64 nt, Homo Sapiens; identical to SEQ ID NO: 48420

SEQ ID NO: 697104 - RNA, 64 nt, Homo Sapiens; identical to SEQ ID NO: 48421

SEQ ID NO: 697105 - RNA, 64 nt, Homo Sapiens; identical to SEQ ID NO: 48422

SEQ ID NO: 697106 - RNA, 64 nt, Homo Sapiens; identical to SEQ ID NO: 48423

SEQ ID NO: 697107 - RNA, 64 nt, Homo Sapiens; identical to SEQ ID NO: 48424

SEQ ID NO: 697108 - RNA, 64 nt, Homo Sapiens; identical to SEQ ID NO: 48425

SEQ ID NO: 697109 - RNA, 64 nt, Homo Sapiens; identical to SEQ ID NO: 48426

SEQ ID NO: 697110 - RNA, 64 nt, Homo Sapiens; identical to SEQ ID NO: 48427

SEQ ID NO: 697111 - RNA, 64 nt, Homo Sapiens; identical to SEQ ID NO: 48428

SEQ ID NO: 697112 - RNA, 64 nt, Homo Sapiens; identical to SEQ ID NO: 48429

SEQ ID NO: 697113 - RNA, 64 nt, Homo Sapiens; identical to SEQ ID NO: 48430

SEQ ID NO: 697114 - RNA, 64 nt, Homo Sapiens; identical to SEQ ID NO: 48431

SEQ ID NO: 697115 - RNA, 64 nt, Homo Sapiens; identical to SEQ ID NO: 48432

SEQ ID NO: 697116 - RNA, 64 nt, Homo Sapiens; identical to SEQ ID NO: 48433

SEQ ID NO: 697117 - RNA, 64 nt, Homo Sapiens; identical to SEQ ID NO: 48434

SEQ ID NO: 697118 - RNA, 64 nt, Homo Sapiens; identical to SEQ ID NO: 48435

SEQ ID NO: 697119 - RNA, 64 nt, Homo Sapiens; identical to SEQ ID NO: 48436

SEQ ID NO: 697120 - RNA, 64 nt, Homo Sapiens; identical to SEQ ID NO: 48437

SEQ ID NO: 697121 - RNA, 64 nt, Homo Sapiens; identical to SEQ ID NO: 48438

SEQ ID NO: 697122 - RNA, 64 nt, Homo Sapiens; identical to SEQ ID NO: 48439

SEQ ID NO: 697123 - RNA, 64 nt, Homo Sapiens; identical to SEQ ID NO: 48440

SEQ ID NO: 697124 - RNA, 64 nt, Homo Sapiens; identical to SEQ ID NO: 48441

SEQ ID NO: 697125 - RNA, 64 nt, Homo Sapiens; identical to SEQ ID NO: 48442

SEQ ID NO: 697126 - RNA, 64 nt, Homo Sapiens; identical to SEQ ID NO: 48443

SEQ ID NO: 697127 - RNA, 64 nt, Homo Sapiens; identical to SEQ ID NO: 48444

SEQ ID NO: 697128 - RNA, 64 nt, Homo Sapiens; identical to SEQ ID NO: 48445

SEQ ID NO: 697129 - RNA, 64 nt, Homo Sapiens; identical to SEQ ID NO: 48446

SEQ ID NO: 697130 - RNA, 64 nt, Homo Sapiens; identical to SEQ ID NO: 48447

SEQ ID NO: 697131 - RNA, 64 nt, Homo Sapiens; identical to SEQ ID NO: 48448

SEQ ID NO: 697132 - RNA, 64 nt, Homo Sapiens; identical to SEQ ID NO: 48449

SEQ ID NO: 697133 - RNA, 64 nt, Homo Sapiens; identical to SEQ ID NO: 48450

SEQ ID NO: 697134 - RNA, 64 nt, Homo Sapiens; identical to SEQ ID NO: 48451

SEQ ID NO: 697135 - RNA, 64 nt, Homo Sapiens; identical to SEQ ID NO: 48452

SEQ ID NO: 697136 - RNA, 64 nt, Homo Sapiens; identical to SEQ ID NO: 48453

SEQ ID NO: 697137 - RNA, 64 nt, Homo Sapiens; identical to SEQ ID NO: 48454

SEQ ID NO: 697138 - RNA, 64 nt, Homo Sapiens; identical to SEQ ID NO: 48455

SEQ ID NO: 697139 - RNA, 64 nt, Homo Sapiens; identical to SEQ ID NO: 48456

SEQ ID NO: 697140 - RNA, 64 nt, Homo Sapiens; identical to SEQ ID NO: 48457

SEQ ID NO: 697141 - RNA, 64 nt, Homo Sapiens; identical to SEQ ID NO: 48458

SEQ ID NO: 697142 - RNA, 64 nt, Homo Sapiens; identical to SEQ ID NO: 48459

SEQ ID NO: 697143 - RNA, 64 nt, Homo Sapiens; identical to SEQ ID NO: 48460

SEQ ID NO: 697144 - RNA, 64 nt, Homo Sapiens; identical to SEQ ID NO: 48461

SEQ ID NO: 697145 - RNA, 64 nt, Homo Sapiens; identical to SEQ ID NO: 48462

SEQ ID NO: 697146 - RNA, 64 nt, Homo Sapiens; identical to SEQ ID NO: 48463

SEQ ID NO: 697147 - RNA, 64 nt, Homo Sapiens; identical to SEQ ID NO: 48464

SEQ ID NO: 697148 - RNA, 64 nt, Homo Sapiens; identical to SEQ ID NO: 48465

SEQ ID NO: 697149 - RNA, 64 nt, Homo Sapiens; identical to SEQ ID NO: 48466

SEQ ID NO: 697150 - RNA, 64 nt, Homo Sapiens; identical to SEQ ID NO: 48467

SEQ ID NO: 697151 - RNA, 64 nt, Homo Sapiens; identical to SEQ ID NO: 48468

SEQ ID NO: 697152 - RNA, 64 nt, Homo Sapiens; identical to SEQ ID NO: 48469

SEQ ID NO: 697153 - RNA, 64 nt, Homo Sapiens; identical to SEQ ID NO: 48470

SEQ ID NO: 697154 - RNA, 64 nt, Homo Sapiens; identical to SEQ ID NO: 48471

SEQ ID NO: 697155 - RNA, 64 nt, Homo Sapiens; identical to SEQ ID NO: 48472

SEQ ID NO: 697156 - RNA, 64 nt, Homo Sapiens; identical to SEQ ID NO: 48473

SEQ ID NO: 697157 - RNA, 64 nt, Homo Sapiens; identical to SEQ ID NO: 48474

SEQ ID NO: 697158 - RNA, 64 nt, Homo Sapiens; identical to SEQ ID NO: 48475

SEQ ID NO: 697159 - RNA, 64 nt, Homo Sapiens; identical to SEQ ID NO: 48476

SEQ ID NO: 697160 - RNA, 64 nt, Homo Sapiens; identical to SEQ ID NO: 48477

SEQ ID NO: 697161 - RNA, 64 nt, Homo Sapiens; identical to SEQ ID NO: 48478

SEQ ID NO: 697162 - RNA, 64 nt, Homo Sapiens; identical to SEQ ID NO: 48479

SEQ ID NO: 697163 - RNA, 64 nt, Homo Sapiens; identical to SEQ ID NO: 48480

SEQ ID NO: 697164 - RNA, 64 nt, Homo Sapiens; identical to SEQ ID NO: 48481

SEQ ID NO: 697165 - RNA, 64 nt, Homo Sapiens; identical to SEQ ID NO: 48482

SEQ ID NO: 697166 - RNA, 64 nt, Homo Sapiens; identical to SEQ ID NO: 48483

SEQ ID NO: 697167 - RNA, 64 nt, Homo Sapiens; identical to SEQ ID NO: 48484

SEQ ID NO: 697168 - RNA, 64 nt, Homo Sapiens; identical to SEQ ID NO: 48485

SEQ ID NO: 697169 - RNA, 64 nt, Homo Sapiens; identical to SEQ ID NO: 48486

SEQ ID NO: 697170 - RNA, 64 nt, Homo Sapiens; identical to SEQ ID NO: 48487

SEQ ID NO: 697171 - RNA, 64 nt, Homo Sapiens; identical to SEQ ID NO: 48488

SEQ ID NO: 697172 - RNA, 64 nt, Homo Sapiens; identical to SEQ ID NO: 48489

SEQ ID NO: 697173 - RNA, 64 nt, Homo Sapiens; identical to SEQ ID NO: 48490

SEQ ID NO: 697174 - RNA, 64 nt, Homo Sapiens; identical to SEQ ID NO: 48491

SEQ ID NO: 697175 - RNA, 64 nt, Homo Sapiens; identical to SEQ ID NO: 48492

SEQ ID NO: 697176 - RNA, 64 nt, Homo Sapiens; identical to SEQ ID NO: 48493

SEQ ID NO: 697177 - RNA, 64 nt, Homo Sapiens; identical to SEQ ID NO: 48494

SEQ ID NO: 697178 - RNA, 64 nt, Homo Sapiens; identical to SEQ ID NO: 48495

SEQ ID NO: 697179 - RNA, 64 nt, Homo Sapiens; identical to SEQ ID NO: 48496

SEQ ID NO: 697180 - RNA, 64 nt, Homo Sapiens; identical to SEQ ID NO: 48497

SEQ ID NO: 697181 - RNA, 64 nt, Homo Sapiens; identical to SEQ ID NO: 48498

SEQ ID NO: 697182 - RNA, 64 nt, Homo Sapiens; identical to SEQ ID NO: 277422

SEQ ID NO: 697183 - RNA, 64 nt, Homo Sapiens; identical to SEQ ID NO: 277423

SEQ ID NO: 697184 - RNA, 64 nt, Homo Sapiens; identical to SEQ ID NO: 277424

SEQ ID NO: 697185 - RNA, 64 nt, Homo Sapiens; identical to SEQ ID NO: 277425

SEQ ID NO: 697186 - RNA, 64 nt, Homo Sapiens; identical to SEQ ID NO: 277426

SEQ ID NO: 697187 - RNA, 64 nt, Homo Sapiens; identical to SEQ ID NO: 277427

SEQ ID NO: 697188 - RNA, 64 nt, Homo Sapiens; identical to SEQ ID NO: 277428

SEQ ID NO: 697189 - RNA, 64 nt, Homo Sapiens; identical to SEQ ID NO: 277429

SEQ ID NO: 697190 - RNA, 64 nt, Homo Sapiens; identical to SEQ ID NO: 277430

SEQ ID NO: 697191 - RNA, 64 nt, Homo Sapiens; identical to SEQ ID NO: 277431

SEQ ID NO: 697192 - RNA, 64 nt, Homo Sapiens; identical to SEQ ID NO: 277432

SEQ ID NO: 697193 - RNA, 64 nt, Homo Sapiens; identical to SEQ ID NO: 277433

SEQ ID NO: 697194 - RNA, 64 nt, Homo Sapiens; identical to SEQ ID NO: 277434

SEQ ID NO: 697195 - RNA, 64 nt, Homo Sapiens; identical to SEQ ID NO: 277435

SEQ ID NO: 697196 - RNA, 64 nt, Homo Sapiens; identical to SEQ ID NO: 277436

SEQ ID NO: 697197 - RNA, 64 nt, Homo Sapiens; identical to SEQ ID NO: 277437

SEQ ID NO: 697198 - RNA, 64 nt, Homo Sapiens; identical to SEQ ID NO: 277438

SEQ ID NO: 697199 - RNA, 64 nt, Homo Sapiens; identical to SEQ ID NO: 277439

SEQ ID NO: 697200 - RNA, 64 nt, Homo Sapiens; identical to SEQ ID NO: 277440

SEQ ID NO: 697201 - RNA, 64 nt, Homo Sapiens; identical to SEQ ID NO: 277441

SEQ ID NO: 697202 - RNA, 64 nt, Homo Sapiens; identical to SEQ ID NO: 277442

SEQ ID NO: 697203 - RNA, 64 nt, Homo Sapiens; identical to SEQ ID NO: 277443

SEQ ID NO: 697204 - RNA, 64 nt, Homo Sapiens; identical to SEQ ID NO: 277444

SEQ ID NO: 697205 - RNA, 64 nt, Homo Sapiens; identical to SEQ ID NO: 277445

SEQ ID NO: 697206 - RNA, 64 nt, Homo Sapiens; identical to SEQ ID NO: 277446

SEQ ID NO: 697207 - RNA, 64 nt, Homo Sapiens; identical to SEQ ID NO: 277447

SEQ ID NO: 697208 - RNA, 64 nt, Homo Sapiens; identical to SEQ ID NO: 277448

SEQ ID NO: 697209 - RNA, 64 nt, Homo Sapiens; identical to SEQ ID NO: 45025

SEQ ID NO: 697210 - RNA, 64 nt, Homo Sapiens; identical to SEQ ID NO: 45026

SEQ ID NO: 697211 - RNA, 64 nt, Homo Sapiens; identical to SEQ ID NO: 45027

SEQ ID NO: 697212 - RNA, 64 nt, Homo Sapiens; identical to SEQ ID NO: 45028

SEQ ID NO: 697213 - RNA, 64 nt, Homo Sapiens; identical to SEQ ID NO: 45029

SEQ ID NO: 697214 - RNA, 64 nt, Homo Sapiens; identical to SEQ ID NO: 45030

SEQ ID NO: 697215 - RNA, 64 nt, Homo Sapiens; identical to SEQ ID NO: 45031

SEQ ID NO: 697216 - RNA, 64 nt, Homo Sapiens; identical to SEQ ID NO: 45032

SEQ ID NO: 697217 - RNA, 64 nt, Homo Sapiens; identical to SEQ ID NO: 45033

SEQ ID NO: 697218 - RNA, 64 nt, Homo Sapiens; identical to SEQ ID NO: 45034

SEQ ID NO: 697219 - RNA, 64 nt, Homo Sapiens; identical to SEQ ID NO: 45035

SEQ ID NO: 697220 - RNA, 64 nt, Homo Sapiens; identical to SEQ ID NO: 45036

SEQ ID NO: 697221 - RNA, 64 nt, Homo Sapiens; identical to SEQ ID NO: 45037

SEQ ID NO: 697222 - RNA, 64 nt, Homo Sapiens; identical to SEQ ID NO: 45038

SEQ ID NO: 697223 - RNA, 64 nt, Homo Sapiens; identical to SEQ ID NO: 45039

SEQ ID NO: 697224 - RNA, 64 nt, Homo Sapiens; identical to SEQ ID NO: 45040

SEQ ID NO: 697225 - RNA, 64 nt, Homo Sapiens; identical to SEQ ID NO: 45041

SEQ ID NO: 697226 - RNA, 64 nt, Homo Sapiens; identical to SEQ ID NO: 45042

SEQ ID NO: 697227 - RNA, 64 nt, Homo Sapiens; identical to SEQ ID NO: 45043

SEQ ID NO: 697228 - RNA, 64 nt, Homo Sapiens; identical to SEQ ID NO: 45044

SEQ ID NO: 697229 - RNA, 64 nt, Homo Sapiens; identical to SEQ ID NO: 45045

SEQ ID NO: 697230 - RNA, 64 nt, Homo Sapiens; identical to SEQ ID NO: 45046

SEQ ID NO: 697231 - RNA, 64 nt, Homo Sapiens; identical to SEQ ID NO: 45047

SEQ ID NO: 697232 - RNA, 64 nt, Homo Sapiens; identical to SEQ ID NO: 45048

SEQ ID NO: 697233 - RNA, 64 nt, Homo Sapiens; identical to SEQ ID NO: 45049

SEQ ID NO: 697234 - RNA, 64 nt, Homo Sapiens; identical to SEQ ID NO: 45050

SEQ ID NO: 697235 - RNA, 64 nt, Homo Sapiens; identical to SEQ ID NO: 45051

SEQ ID NO: 697236 - RNA, 64 nt, Homo Sapiens; identical to SEQ ID NO: 45052

SEQ ID NO: 697237 - RNA, 64 nt, Homo Sapiens; identical to SEQ ID NO: 45053

SEQ ID NO: 697238 - RNA, 64 nt, Homo Sapiens; identical to SEQ ID NO: 45054

SEQ ID NO: 697239 - RNA, 64 nt, Homo Sapiens; identical to SEQ ID NO: 45055

SEQ ID NO: 697240 - RNA, 64 nt, Homo Sapiens; identical to SEQ ID NO: 45056

SEQ ID NO: 697241 - RNA, 64 nt, Homo Sapiens; identical to SEQ ID NO: 45057

SEQ ID NO: 697242 - RNA, 64 nt, Homo Sapiens; identical to SEQ ID NO: 45058

SEQ ID NO: 697243 - RNA, 64 nt, Homo Sapiens; identical to SEQ ID NO: 45059

SEQ ID NO: 697244 - RNA, 64 nt, Homo Sapiens; identical to SEQ ID NO: 45060

SEQ ID NO: 697245 - RNA, 64 nt, Homo Sapiens; identical to SEQ ID NO: 45061

SEQ ID NO: 697246 - RNA, 64 nt, Homo Sapiens; identical to SEQ ID NO: 45062

SEQ ID NO: 697247 - RNA, 64 nt, Homo Sapiens; identical to SEQ ID NO: 45063

SEQ ID NO: 697248 - RNA, 64 nt, Homo Sapiens; identical to SEQ ID NO: 45064

SEQ ID NO: 697249 - RNA, 64 nt, Homo Sapiens; identical to SEQ ID NO: 45065

SEQ ID NO: 697250 - RNA, 64 nt, Homo Sapiens; identical to SEQ ID NO: 45066

SEQ ID NO: 697251 - RNA, 64 nt, Homo Sapiens
aauucaaacauacagaaacaugcccauuccugugauagcauacaauauacaauauacaaacaua

SEQ ID NO: 697252 - RNA, 64 nt, Homo Sapiens
uguacacacaaaaaugugugcugugguauaccaaauagcauacauaugaggaguguguauguac

SEQ ID NO: 697253 - RNA, 64 nt, Homo Sapiens
uaaugaguagugcuguucauauuacuuuaguucuauagcauacuugcaucuuuaacaugcuauc

SEQ ID NO: 697254 - RNA, 64 nt, Homo Sapiens
uagcccagaacaguuuaaugguacuuacugagcuauagcauagcugcuuaguuguuuuugagau

SEQ ID NO: 697255 - RNA, 64 nt, Homo Sapiens
gcucugcccacaaacaggcgucccuuucccucuggauaacaacaaaagcaagccgggaggcugg

SEQ ID NO: 697256 - RNA, 64 nt, Homo Sapiens
ccuucuauuacaugcaaaaaaucauuguuuuuaagauaacaaaaguagggaauaaacaagcuga

SEQ ID NO: 697257 - RNA, 64 nt, Homo Sapiens
gagugaaagccaaagcacuuauaauuggauuauggauaacaagaaaauauacccaugugaaaua

SEQ ID NO: 697258 - RNA, 64 nt, Homo Sapiens
accagguauggcaaguuguguuuuugaccaaaaagauaacaaauccuuucccaguuagguuugc

SEQ ID NO: 697259 - RNA, 64 nt, Homo Sapiens; identical to SEQ ID NO: 379229

SEQ ID NO: 697260 - RNA, 64 nt, Homo Sapiens; identical to SEQ ID NO: 379230

SEQ ID NO: 697261 - RNA, 64 nt, Homo Sapiens; identical to SEQ ID NO: 379231

SEQ ID NO: 697262 - RNA, 64 nt, Homo Sapiens; identical to SEQ ID NO: 379232

SEQ ID NO: 697263 - RNA, 64 nt, Homo Sapiens; identical to SEQ ID NO: 379233

SEQ ID NO: 697264 - RNA, 64 nt, Homo Sapiens; identical to SEQ ID NO: 379234

SEQ ID NO: 697265 - RNA, 64 nt, Homo Sapiens; identical to SEQ ID NO: 379235

SEQ ID NO: 697266 - RNA, 64 nt, Homo Sapiens; identical to SEQ ID NO: 379236

SEQ ID NO: 697267 - RNA, 64 nt, Homo Sapiens; identical to SEQ ID NO: 379237

SEQ ID NO: 697268 - RNA, 64 nt, Homo Sapiens; identical to SEQ ID NO: 379238

SEQ ID NO: 697269 - RNA, 64 nt, Homo Sapiens; identical to SEQ ID NO: 379239

SEQ ID NO: 697270 - RNA, 64 nt, Homo Sapiens; identical to SEQ ID NO: 379240

SEQ ID NO: 697271 - RNA, 64 nt, Homo Sapiens; identical to SEQ ID NO: 379241

SEQ ID NO: 697272 - RNA, 64 nt, Homo Sapiens; identical to SEQ ID NO: 379242

SEQ ID NO: 697273 - RNA, 64 nt, Homo Sapiens; identical to SEQ ID NO: 379243

SEQ ID NO: 697274 - RNA, 64 nt, Homo Sapiens; identical to SEQ ID NO: 379244

SEQ ID NO: 697275 - RNA, 64 nt, Homo Sapiens; identical to SEQ ID NO: 379245

SEQ ID NO: 697276 - RNA, 64 nt, Homo Sapiens; identical to SEQ ID NO: 379246

SEQ ID NO: 697277 - RNA, 64 nt, Homo Sapiens; identical to SEQ ID NO: 379247

SEQ ID NO: 697278 - RNA, 64 nt, Homo Sapiens; identical to SEQ ID NO: 379248

SEQ ID NO: 697279 - RNA, 64 nt, Homo Sapiens; identical to SEQ ID NO: 379249

SEQ ID NO: 697280 - RNA, 64 nt, Homo Sapiens; identical to SEQ ID NO: 379250

SEQ ID NO: 697281 - RNA, 64 nt, Homo Sapiens; identical to SEQ ID NO: 379251

SEQ ID NO: 697282 - RNA, 64 nt, Homo Sapiens; identical to SEQ ID NO: 379252

SEQ ID NO: 697283 - RNA, 64 nt, Homo Sapiens; identical to SEQ ID NO: 379253

SEQ ID NO: 697284 - RNA, 64 nt, Homo Sapiens; identical to SEQ ID NO: 379254

SEQ ID NO: 697285 - RNA, 64 nt, Homo Sapiens; identical to SEQ ID NO: 379255

SEQ ID NO: 697286 - RNA, 64 nt, Homo Sapiens; identical to SEQ ID NO: 379256

SEQ ID NO: 697287 - RNA, 64 nt, Homo Sapiens; identical to SEQ ID NO: 379257

SEQ ID NO: 697288 - RNA, 64 nt, Homo Sapiens; identical to SEQ ID NO: 379258

SEQ ID NO: 697289 - RNA, 64 nt, Homo Sapiens; identical to SEQ ID NO: 379259

SEQ ID NO: 697290 - RNA, 59 nt, Homo Sapiens
ugugaagaggaggaaaagugaaucacggagagagaaaggaaaggauagaaucacaggcu

SEQ ID NO: 697291 - RNA, 59 nt, Homo Sapiens
ccagcuauacuuacuugcacaguggauuggagagaaaggauucuccagugugcacacuc

SEQ ID NO: 697292 - RNA, 59 nt, Homo Sapiens
ccgagugacacaugagagcuguaugaauugagagaaaaggcaacaaguagcauucuuca

SEQ ID NO: 697293 - RNA, 59 nt, Homo Sapiens
ugcucuauuauacccugauagagaugggggagagaaaggaauguuuuugauggugguuu

SEQ ID NO: 697294 - RNA, 59 nt, Homo Sapiens
uguguguguguguguguguguggcagagagagagaaagagagagagagagagaaauucu

SEQ ID NO: 697295 - RNA, 59 nt, Homo Sapiens
uguggcagagagagagaaagagagagagagagagaaauucuguuaaaaucuauucugug

SEQ ID NO: 697296 - RNA, 59 nt, Homo Sapiens
cgcagaccuccccagccccuagcccaggagagagaaagccaggcagguagccaggggga

SEQ ID NO: 697297 - RNA, 59 nt, Homo Sapiens
gcuggaggugggagcaggagauugagaaggagagaaagugggugagaugcuggagaaga

SEQ ID NO: 697298 - RNA, 59 nt, Homo Sapiens
cccuccccuccccugcugcaggggcucuggagagaaacaauaaagagauucacacacaa

SEQ ID NO: 697299 - RNA, 59 nt, Homo Sapiens
gcagcgccacagaagccccucuuaagugagagagaaagggucagcuuuucgucuaguaa

SEQ ID NO: 697300 - RNA, 59 nt, Homo Sapiens
acagggacuuugaaccuaggagggaagaggagagaaaauaccggaguagggggugggag

SEQ ID NO: 697301 - RNA, 59 nt, Homo Sapiens
aaaaagugugacauuacagaaaaaaaaaagagagaaacauuauuuguaugcuucaaaaa

SEQ ID NO: 697302 - RNA, 59 nt, Homo Sapiens
gaccaugcugcauacauucuagagagagagagagaaaaaaguuccguucugagagaaaa

SEQ ID NO: 697303 - RNA, 59 nt, Homo Sapiens
gagagagagagagaaaaagauuccguucugagagaaaaaaaacauguugcuguuuccag

SEQ ID NO: 697304 - RNA, 59 nt, Homo Sapiens
aacauagacuggaggagguaauccauggagagagaaaaagaagagggcucaggacaagg

SEQ ID NO: 697305 - RNA, 59 nt, Homo Sapiens
gggguuuugccagggaaguaaaaggaguugagagaaagaugggucaguucagaagacau

SEQ ID NO: 697306 - RNA, 59 nt, Homo Sapiens
acuuuuugcacuucuguauauagucaaaagagagaaaccuguauaauaguaagaucuua

SEQ ID NO: 697307 - RNA, 59 nt, Homo Sapiens
acugcauguuuaaaacuucaacaaaaaaagagagaaagaacuauacuaagaacauauau

SEQ ID NO: 697308 - RNA, 59 nt, Homo Sapiens
uaauauuaacacaaaaaaauaaacgaggagagagaaaaacaagaaaagagaaaauauua

SEQ ID NO: 697309 - RNA, 59 nt, Homo Sapiens
gaggaagggaacuuauuucugacaaacgggagagaaaaaagcaaacaaaaaaaucgaaa

SEQ ID NO: 697310 - RNA, 59 nt, Homo Sapiens
ccuugauaaacauaagagaauucauaccggagagaaacuguacaaaugugaagaauaug

SEQ ID NO: 697311 - RNA, 59 nt, Homo Sapiens
ucaaugcuuaauaaauauaauucaugcuggagagaaacuucacaugugaaccguguggc

SEQ ID NO: 697312 - RNA, 59 nt, Homo Sapiens
cuuuguuaaacauaagagaauuuauaccagagagaaacccuacacauguaaagaaugug

SEQ ID NO: 697313 - RNA, 59 nt, Homo Sapiens
ccacagccaggaggggccuuucccaccuggagagaaacuuccagaccagccccucauac

SEQ ID NO: 697314 - RNA, 59 nt, Homo Sapiens
ccacagccaagaggggccuuucucaccuggagagaaauuuccagaccauccccucucac

SEQ ID NO: 697315 - RNA, 59 nt, Homo Sapiens
ccacagccaagagaagccuuuccagccuggagagaaacuuccagaccagcccucucacu

SEQ ID NO: 697316 - RNA, 59 nt, Homo Sapiens
ccacagccaggagaggccuuucccaccuggagagaaacuuccagaccagccccucauac

SEQ ID NO: 697317 - RNA, 59 nt, Homo Sapiens
ccacagccaagaggggccuuucucaccuggagagaaacuuccagaccagccccucacac

SEQ ID NO: 697318 - RNA, 59 nt, Homo Sapiens
ccaccgccaggagaggccuuucccaccgggagagaaacuuccagaccagccccucacac

SEQ ID NO: 697319 - RNA, 59 nt, Homo Sapiens
ccacagccaggagaggccuuucccaccgggagagaaacuuccagaccagcccucucacu

SEQ ID NO: 697320 - RNA, 59 nt, Homo Sapiens
ccacagccaggagagaccuuuucugccuggagagaaacuuucagaccagccccacacac

SEQ ID NO: 697321 - RNA, 59 nt, Homo Sapiens
ccacagccaggagaggccuuucccaccuggagagaaacuuccagaccagccccucucac

SEQ ID NO: 697322 - RNA, 59 nt, Homo Sapiens
uuuaaugaugaaaaguuacacauuuuuuggagagaaaagucuuagcugaagguaaauca

SEQ ID NO: 697323 - RNA, 59 nt, Homo Sapiens
aaaugcauaagguuaguacaagaucaguagagagaaagucaaagauuacagaagugcug

SEQ ID NO: 697324 - RNA, 59 nt, Homo Sapiens
accaacaaagaagauguucauaucaacaugagagaaaucuuuaagccuucaaauuacau

SEQ ID NO: 697325 - RNA, 59 nt, Homo Sapiens
aauuuauuuuacauugacauggcaaagaggagagaaagaaaagcauacaucaugauuau

SEQ ID NO: 697326 - RNA, 59 nt, Homo Sapiens
gagagcacaaagauaacgcaggagagagagagagaaagaaugagaaagaaaaggaaugc

SEQ ID NO: 697327 - RNA, 59 nt, Homo Sapiens
aaugacagagaguucuggugagauacccagagagaaaaagagagagcagggugggguaa

SEQ ID NO: 697328 - RNA, 59 nt, Homo Sapiens
aaacuccuugaaaccagcuccuugcagcagagagaaauacaggaaauucuguuuauguu

SEQ ID NO: 697329 - RNA, 59 nt, Homo Sapiens
agggcaacuucuacucuucacuaaguuucgagagaaaggcacgaacaaaccaaggaaau

SEQ ID NO: 697330 - RNA, 59 nt, Homo Sapiens
cuucuccaaacgauuagucuaaauuuucagagagaaauagauaaaacacgccacagccu

SEQ ID NO: 697331 - RNA, 59 nt, Homo Sapiens
ugcaucuagggcggagaggcugcacuugugagagaaaauacuauuucaagucauauucu

SEQ ID NO: 697332 - RNA, 59 nt, Homo Sapiens
gcuuacuacacauaggaaaauucauacuggagagaaacuacaaaugugaagaauguguu

SEQ ID NO: 697333 - RNA, 59 nt, Homo Sapiens
cauaccuuacuauacagaaauucauacuggagagaaagccuacaauugugaagaaugug

SEQ ID NO: 697334 - RNA, 59 nt, Homo Sapiens
cuugcuacauauaagacaguuuauacuuugagagaaacccugcaaaugugaauaaugug

SEQ ID NO: 697335 - RNA, 59 nt, Homo Sapiens
acuuacugaacauaagaaaauuuacacuagagagaaagccuacaaaugugaagaaugug

SEQ ID NO: 697336 - RNA, 59 nt, Homo Sapiens
ccuuauuacacauaagauaauucauagcggagagaaaccccacaaaugugaagaaugug

SEQ ID NO: 697337 - RNA, 59 nt, Homo Sapiens
ucuuacugcacauaagaucauucauacuggagagaaaccuuacaaaugugaggaaugug

SEQ ID NO: 697338 - RNA, 59 nt, Homo Sapiens
ccuuacuaaacacaagaagauucauacuagagagaaacccuacaaaugugaagaaugug

SEQ ID NO: 697339 - RNA, 59 nt, Homo Sapiens
cuuuacuaugcauaagaaaauucaaacuggagagaaacucuacaaaugugaagaaugug

SEQ ID NO: 697340 - RNA, 59 nt, Homo Sapiens
aaaacuucuuacaccuaaaauucaugcaggagagaaacaccacaaaugugaaaaauuug

SEQ ID NO: 697341 - RNA, 59 nt, Homo Sapiens
ccuuucugcacauaauauaauucauacuggagagaaaccccacaaauaugaagaaugug

SEQ ID NO: 697342 - RNA, 59 nt, Homo Sapiens
ucuuauucagcaucaaagaauucacacaggagagaaagcacaugaauguaaugaaugug

SEQ ID NO: 697343 - RNA, 59 nt, Homo Sapiens
cauugcucagcaucagauaauucacaccagagagaaacccucugaaugugacgaaugaa

SEQ ID NO: 697344 - RNA, 59 nt, Homo Sapiens
uucaggcuuuacccaacaucgaaauaauggagagaaaauuguugauuauuuguuuauga

SEQ ID NO: 697345 - RNA, 59 nt, Homo Sapiens
uuacaagugugaagaauguguucauacuggagagaaaccacucauugaacacaagaaaa

SEQ ID NO: 697346 - RNA, 59 nt, Homo Sapiens
cuacaaaugugaagaauguguucauacuggagagaaaccccuuauuggacauaagagaa

SEQ ID NO: 697347 - RNA, 59 nt, Homo Sapiens
augcucucuagcaacauugauuguagaaggagagaaaccuuuccccauuuuucucuuuc

SEQ ID NO: 697348 - RNA, 59 nt, Homo Sapiens
aguuuccaaggauauguuucacgaagggagagagaaagcagagggagggagagagaaag

SEQ ID NO: 697349 - RNA, 59 nt, Homo Sapiens
cgaagggagagagaaagcagagggagggagagagaaagagaagagaaaugggaaagaag

SEQ ID NO: 697350 - RNA, 59 nt, Homo Sapiens
auaaaaauauagcauauaaugacuuugaggagagaaagcagugccauccuuuaaucaua

SEQ ID NO: 697351 - RNA, 59 nt, Homo Sapiens
uaaaauuaaaauaguauuuuaucauggaggagagaaacuguaacagcguaauuaaacac

SEQ ID NO: 697352 - RNA, 59 nt, Homo Sapiens
aaacacgaaagaaaagucaggaagguagagagagaaaaagggagggaaggagaaagaau

SEQ ID NO: 697353 - RNA, 59 nt, Homo Sapiens
ggaggaaagucauuccugccuaauccaucgagagaaagaggcuuacgaaaaacuuugcc

SEQ ID NO: 697354 - RNA, 59 nt, Homo Sapiens
acagagagaaggagaaagagggagggagagagagaaagagagagaaagagagagagaga

SEQ ID NO: 697355 - RNA, 59 nt, Homo Sapiens
ggagaaagagggagggagagagagaaagagagagaaagagagagagagagagagagaga

SEQ ID NO: 697356 - RNA, 59 nt, Homo Sapiens
agagagagaaagagagagagagagagagagagagaaagcugaacgugcacucugacaag

SEQ ID NO: 697357 - RNA, 59 nt, Homo Sapiens
cucuaucccuucuccuguccaggggcccagagagaaacacaccuaccccuggccuugcc

SEQ ID NO: 697358 - RNA, 59 nt, Homo Sapiens
uuuccguggcuggggguagacuuaauaaagagagaaauucaagaacugcuugcuuuauu

SEQ ID NO: 697359 - RNA, 59 nt, Homo Sapiens
uaacugccuaaaauguucuccuuagaugugagagaaagagaaaucagaaaaauuaauuc

SEQ ID NO: 697360 - RNA, 59 nt, Homo Sapiens
uaaaauaagaaagcccuaaaauacuauuggagagaaaaaauuaacuagguugcuacuuu

SEQ ID NO: 697361 - RNA, 59 nt, Homo Sapiens
gagauggcccucugugacucuuggaaggggagagaaacuagagagguuggaaggggugg

SEQ ID NO: 697362 - RNA, 59 nt, Homo Sapiens
gcucccaccugccagucccuuggggagaggagagaaagggcucugggacgugugggccc

SEQ ID NO: 697363 - RNA, 59 nt, Homo Sapiens
cuacaguugauccucaucuguuucagagggagagaaaugggguaccuaucccagccacg

SEQ ID NO: 697364 - RNA, 59 nt, Homo Sapiens
cacaucugucucugcaaugccaagaacuugagagaaaaauggcuggcuuuccuuagcag

SEQ ID NO: 697365 - RNA, 59 nt, Homo Sapiens
gggauauauuaagauauuuuuguacauaagagagaaagagagagaaaaauuuauagaag

SEQ ID NO: 697366 - RNA, 59 nt, Homo Sapiens
aagauauuuuuguacauaagagagaaagagagagaaaaauuuauagaaguuuuguacaa

SEQ ID NO: 697367 - RNA, 59 nt, Homo Sapiens
aagacuuagagaagaggaagugauauacagagagaaaaaaagaauaaaaacuaccaaag

SEQ ID NO: 697368 - RNA, 59 nt, Homo Sapiens
cuauugaggcagugacuguuugcaugugggagagaaacccuuucugacacuuuugagga

SEQ ID NO: 697369 - RNA, 59 nt, Homo Sapiens
aaauagcugcccuuaaagaguuguuagcagagagaaaaauaacagugaaugugcuccug

SEQ ID NO: 697370 - RNA, 59 nt, Homo Sapiens
uacacucagcaauaauuagaaaaaaaggagagagaaaagugauuuaaacaggguggauu

SEQ ID NO: 697371 - RNA, 59 nt, Homo Sapiens
uaacuuauuguguguuugauacagcuauagagagaaagagugcuuuuuauuguaauuca

SEQ ID NO: 697372 - RNA, 59 nt, Homo Sapiens
ggaacugaaggacgcgguuaugagaaagcgagagaaagauguggcagagagugugcaug

SEQ ID NO: 697373 - RNA, 59 nt, Homo Sapiens
aguaagugaaagggugccugcgcugacgugagagaaaggaaucuguaaacaguggaaac

SEQ ID NO: 697374 - RNA, 59 nt, Homo Sapiens
uuaccuaggagcauguaagagaaagaagggagagaaaagguugcaucugcaggaugccu

SEQ ID NO: 697375 - RNA, 59 nt, Homo Sapiens
cuuagaacauacacagauccuuucuaaaggagagaaagaagaaucagauuaucucuuuu

SEQ ID NO: 697376 - RNA, 59 nt, Homo Sapiens
cuuagaauguacacagauccucucuaaaugagagaaagauauagacuugagaauguuuu

SEQ ID NO: 697377 - RNA, 59 nt, Homo Sapiens
uuuaaggcaaugaaucacagaaauucuaagagagaaaguugguuuggcaugcgguaugg

SEQ ID NO: 697378 - RNA, 59 nt, Homo Sapiens
aggggauguaaccagcaaugggacuuacggagagaaauaugccuuaagccaccucccca

SEQ ID NO: 697379 - RNA, 59 nt, Homo Sapiens
acaucaccccaaggacaacggcagaaguagagagaaacuaccuaccucacuucaaauua

SEQ ID NO: 697380 - RNA, 59 nt, Homo Sapiens
cucggcuacuuuuguaaacuucagauuuggagagaaacacgaaagucugaauccugacc

SEQ ID NO: 697381 - RNA, 59 nt, Homo Sapiens
gagagagagaugcuguugaaugagagagagagagaaagaagugagagagagaaagagag

SEQ ID NO: 697382 - RNA, 59 nt, Homo Sapiens
gagugagagagagagagaaaagagugagagagagaaagaaccaguuuccagagagccag

SEQ ID NO: 697383 - RNA, 59 nt, Homo Sapiens
gaggagacagagagggagaggcagagagggagagaaacaaggagagagagacagaggag

SEQ ID NO: 697384 - RNA, 59 nt, Homo Sapiens
gagguggggagaggggagagaggaggggagagagaaagagaggagggagagagauggag

SEQ ID NO: 697385 - RNA, 59 nt, Homo Sapiens
auuucaaauacaugaaaaaucuuacacuggagagaaacccuaugaguguaagcaaugug

SEQ ID NO: 697386 - RNA, 59 nt, Homo Sapiens
ucuucgauuucauaaaaggacacacacuggagagaaacccugugaauguaagaaaugua

SEQ ID NO: 697387 - RNA, 59 nt, Homo Sapiens
ccuuugaauacaugcaagaacacacaauggagagaaacccuaugaauguaaagaaugca

SEQ ID NO: 697388 - RNA, 59 nt, Homo Sapiens
uuuucaauaucaugaaaggacucacaugggagagaaacccuaugaguguaugccaagug

SEQ ID NO: 697389 - RNA, 59 nt, Homo Sapiens
auuucaaacacaugaaaaaauucacacuggagagaaacccuauaaaugcaagcaaugug

SEQ ID NO: 697390 - RNA, 59 nt, Homo Sapiens
ccuuucaauuuaugaaaggacacacacuggagagaaacccuaugaauguaagaaaugug

SEQ ID NO: 697391 - RNA, 59 nt, Homo Sapiens
ucguuugaauacaugcaaaacacacacuggagagaaaccuaugaauguaaggaaugcaa

SEQ ID NO: 697392 - RNA, 59 nt, Homo Sapiens
auuucgaagacaugaaaaaacucacacuggagagaaacccuauaaaugcaugccaugug

SEQ ID NO: 697393 - RNA, 59 nt, Homo Sapiens
cuuucaguaucaugaaaggacucacacuggagagaaacccuaugaguguaagcaaugug

SEQ ID NO: 697394 - RNA, 59 nt, Homo Sapiens
caccuucgaaggcaugguaggacucacuggagagaaacccuaugaguguaaggaaugug

SEQ ID NO: 697395 - RNA, 59 nt, Homo Sapiens
cuuuugguaccaugaaaggacucacacuggagagaaacccuaugaguguaagcaaugug

SEQ ID NO: 697396 - RNA, 59 nt, Homo Sapiens
ccuucgaauccaugguagaacucacacuggagagaaacccuaugaguguaaggaaugug

SEQ ID NO: 697397 - RNA, 59 nt, Homo Sapiens
auuucaaauaccugaaaaaucuuacacuggagagaaacccuaugaguguaagcaaugug

SEQ ID NO: 697398 - RNA, 59 nt, Homo Sapiens
uuuucgauaacaugaaaggacucacacuggagagaaacccuaugaguguaagcaaugug

SEQ ID NO: 697399 - RNA, 59 nt, Homo Sapiens
aaaacacaaagcacaggucaggauccucugagagaaaaucaacauugcaccacguaggg

SEQ ID NO: 697400 - RNA, 59 nt, Homo Sapiens
gggcaacaggagauguggggacguguuaggagagaaaaaaaaaaaaacaaaaauauaua

SEQ ID NO: 697401 - RNA, 59 nt, Homo Sapiens
accaacacaagaucaaaaaggaaaaggacgagagaaaaauuauuuuuaagauaauuaaa

SEQ ID NO: 697402 - RNA, 59 nt, Homo Sapiens
cugaccgugcugaacagacccccccacacgagagaaaauaaaggagcaauaaagucacg

SEQ ID NO: 697403 - RNA, 59 nt, Homo Sapiens
ccuuaauacacauaagauaauuaaugcuggagagaaacccuacaaaugugaagaaugug

SEQ ID NO: 697404 - RNA, 59 nt, Homo Sapiens
ccuuacuaaauauaagauaauucauauuggagagaaauucuacagaugugaagaaugug

SEQ ID NO: 697405 - RNA, 59 nt, Homo Sapiens
cauuaguaaacauaagauaauucauacuggagagaaaaccuacaaaugugaggaaugug

SEQ ID NO: 697406 - RNA, 59 nt, Homo Sapiens
ccuuacuacacauuagauaauucaugcuggagagaaacccuacaaaugugaaaaaugug

SEQ ID NO: 697407 - RNA, 59 nt, Homo Sapiens
ucaacuccuaguaaacauaauuaaugauggagagaaaccauacaacugugaagaaugug

SEQ ID NO: 697408 - RNA, 59 nt, Homo Sapiens
aacuuuauugaacaaaauaauucauacaggagagaaacccuacaaaugugaagaaugug

SEQ ID NO: 697409 - RNA, 59 nt, Homo Sapiens
uuuuacuaaacauaagaaaauucauacuggagagaaacccuaugauugugaaaaauaug

SEQ ID NO: 697410 - RNA, 59 nt, Homo Sapiens
ccugcuucaacaucacaguauucauacuggagagaaaccuuacgaauguauuaaaugug

SEQ ID NO: 697411 - RNA, 59 nt, Homo Sapiens
ucuuacugcccaucaaagaguacauaauggagagaaacccaauagugugguaagugugg

SEQ ID NO: 697412 - RNA, 59 nt, Homo Sapiens
ucucauuacacaucagaaaauucacacuggagagaaaccuuaugaaugcagugaaugug

SEQ ID NO: 697413 - RNA, 59 nt, Homo Sapiens
ccucacugaacaugagaaaauucauacuggagagaaaccuuaucauuguaaucaaugug

SEQ ID NO: 697414 - RNA, 59 nt, Homo Sapiens
ucuucuugagcaugaaaaaauucauacuggagagaaaccauucaaauguaaugaaugug

SEQ ID NO: 697415 - RNA, 59 nt, Homo Sapiens
ggacagagugagacccugucugaaagaaagagagaaagaaagaaagaaagagagagaaa

SEQ ID NO: 697416 - RNA, 59 nt, Homo Sapiens
aaagaaagagagaaagaaagaaagaaagagagagaaagaaagaaagaaagaaagggaaa

SEQ ID NO: 697417 - RNA, 59 nt, Homo Sapiens
ggaaggaaaaagaaagagaaagagagagagagagaaagaaaaagaaagaaaaguaagaa

SEQ ID NO: 697418 - RNA, 59 nt, Homo Sapiens
ccuugcaugucaucauagacuucauacuggagagaaaccuuacaaaugugaagcaugug

SEQ ID NO: 697419 - RNA, 59 nt, Homo Sapiens
ccuuaaaagacauaggagaauucauacuggagagaaaccuuacaaguguaaugagugug

SEQ ID NO: 697420 - RNA, 59 nt, Homo Sapiens
ccuugcaguucaucagugaacucauacuggagagaaaccuuacaaaugucaugacugug

SEQ ID NO: 697421 - RNA, 59 nt, Homo Sapiens
cuaugcaaaacauaggagaauucaugcaggagagaaaugucacaagugugaugaguguu

SEQ ID NO: 697422 - RNA, 59 nt, Homo Sapiens
ccucauuagacaucagagaaucccuacuggagagaaaucuuacaaaugucaucagugug

SEQ ID NO: 697423 - RNA, 59 nt, Homo Sapiens
uuggagcacugagcaccauuuggaagcuugagagaaaccaaaauuaaagagagaaagag

SEQ ID NO: 697424 - RNA, 59 nt, Homo Sapiens
uuggaagcuugagagaaaccaaaauuaaagagagaaagagagagcgugcacgcuccugc

SEQ ID NO: 697425 - RNA, 59 nt, Homo Sapiens
caucugucguggcugagcgggcuguucuggagagaaaacaccccagugucacagggcga

SEQ ID NO: 697426 - RNA, 59 nt, Homo Sapiens
ccacaaauuccaaugucacaggggggagagagagaaaauggucuggugauggcagggau

SEQ ID NO: 697427 - RNA, 59 nt, Homo Sapiens
aaaucacccaccacccccccagacagagagagagaaaaacagaaacccgagaaagagag

SEQ ID NO: 697428 - RNA, 59 nt, Homo Sapiens
cugcaauuuaaaugguauggcucacauuggagagaaaccccuuaauguguguaugugaa

SEQ ID NO: 697429 - RNA, 59 nt, Homo Sapiens
guaugaauguagagaaucugaucucacuggagagaaacuccuuaccaaacacaucagaa

SEQ ID NO: 697430 - RNA, 59 nt, Homo Sapiens
uuaaagcuggguguccggggaguacaaaagagagaaauucuugagaaauaaagggacag

SEQ ID NO: 697431 - RNA, 59 nt, Homo Sapiens
uuuuguauguaaagaauuugcuccuaccagagagaaaccuuccucaccccaccugugaa

SEQ ID NO: 697432 - RNA, 59 nt, Homo Sapiens
uuauaaauguaaggauugugugcacacuggagagaaacccuuucgagugcacaugagaa

SEQ ID NO: 697433 - RNA, 59 nt, Homo Sapiens
cuaugaauguaaagaauguguucauacuggagagaaaccuauucauauacaugaacgaa

SEQ ID NO: 697434 - RNA, 59 nt, Homo Sapiens
uuaugaauguaaacagugugcccacacuggagagaaaccuuuccagauacaugaaagaa

SEQ ID NO: 697435 - RNA, 59 nt, Homo Sapiens
cuacaaauguaaggaaugugcucauacuggagagaaaccagcucaaagacaugaaagga

SEQ ID NO: 697436 - RNA, 59 nt, Homo Sapiens
cuacaaaugcaaggaaugugcucauacuggagagaaaccugcucaaagacaugaaaaga

SEQ ID NO: 697437 - RNA, 59 nt, Homo Sapiens
cuacaaauguaaggaaugugcucauacuggagagaaaccugcucaaaaacaugaaaagg

SEQ ID NO: 697438 - RNA, 59 nt, Homo Sapiens
uuaugaagguaaacaauguguucacacucgagagaaaccccuucuacaacaugaaagaa

SEQ ID NO: 697439 - RNA, 59 nt, Homo Sapiens
cuguacauguaaacaaugugcucacacuggagagaaacuuugucuaagacaugaaaaaa

SEQ ID NO: 697440 - RNA, 59 nt, Homo Sapiens
auaugaauguaagcaguguucucacucuggagagaaacuauuucguaugcaugaaagaa

SEQ ID NO: 697441 - RNA, 59 nt, Homo Sapiens
auaaagaaaauucuauauccuauauacuggagagaaacucuuuuaaagacaccugagaa

SEQ ID NO: 697442 - RNA, 59 nt, Homo Sapiens
caaggaauguaaacggugugcuuacgcuggagagaaauucuuuuggauguaugagagua

SEQ ID NO: 697443 - RNA, 59 nt, Homo Sapiens
acaaagcuggaagacaucaccuuaaacuggagagaaacuucuuacuaaacauaaaaaaa

SEQ ID NO: 697444 - RNA, 59 nt, Homo Sapiens
cuacaaauguaaagaauguguucauacuagagagaaaccccuuaugaaacaaaagauaa

SEQ ID NO: 697445 - RNA, 59 nt, Homo Sapiens
cuacaaaugugauaaauguguucauacuggagagaaaucuuuauuaaaacacaagauaa

SEQ ID NO: 697446 - RNA, 59 nt, Homo Sapiens
augcaugugugaagaaugugcucauacuggagagaaaccgcuuacuacauauaagacaa

SEQ ID NO: 697447 - RNA, 59 nt, Homo Sapiens
cuacaaaugcgaagaauguguucauacuggagagaaaccccuuguggaacauaagagaa

SEQ ID NO: 697448 - RNA, 59 nt, Homo Sapiens
cuacaaacgugaagaauguguucaugcuggagagaaacacuuuauuacacauaagaaaa

SEQ ID NO: 697449 - RNA, 59 nt, Homo Sapiens
cuacaaaggugaagaauguguucauacuggagagaaaaugucuaguaaacauaagaaaa

SEQ ID NO: 697450 - RNA, 59 nt, Homo Sapiens
ucacaagugugaugauuguguuuauacaggagagaaacccuaugcaaaacauaggagaa

SEQ ID NO: 697451 - RNA, 59 nt, Homo Sapiens
uuacaaaugucaugacugugcucauacuggagagaaaccuauugcaggucaucggugaa

SEQ ID NO: 697452 - RNA, 59 nt, Homo Sapiens
uuacaaguguaaugaguguguucacacuggagagaaaccccuggaacaacauacuggac

SEQ ID NO: 697453 - RNA, 59 nt, Homo Sapiens
uuacaaauguaagguuucuguuuauacuggagagaaagcaccuuaaagacauaggagaa

SEQ ID NO: 697454 - RNA, 59 nt, Homo Sapiens
ucacaugugugaugauuguguucauacaggagagaaacccuaugcaaaacauaggagaa

SEQ ID NO: 697455 - RNA, 59 nt, Homo Sapiens
uuacaaaugucaugacugugcucauacuggagagaaacccauugcaguucauugacaca

SEQ ID NO: 697456 - RNA, 59 nt, Homo Sapiens
cacaagugugaugauugugguucauacaggagagaaacucuaugcaaaacauaggagga

SEQ ID NO: 697457 - RNA, 59 nt, Homo Sapiens
uuauaaaugucaugauugugcucaugcuggagagaaaccuauugcuauucaucaucgaa

SEQ ID NO: 697458 - RNA, 59 nt, Homo Sapiens
uuacaagugcaaugaguguguucacacuggagagaaaccccuggcacaccauacuagaa

SEQ ID NO: 697459 - RNA, 59 nt, Homo Sapiens
cuacaaguguaaugaauguguucguauuggagagaaaccccuuguaauucaaaaggcaa

SEQ ID NO: 697460 - RNA, 59 nt, Homo Sapiens
uuacaaaugugaugaguguguucaaacuggagagaaaccccuggcaaaacauauuagaa

SEQ ID NO: 697461 - RNA, 59 nt, Homo Sapiens
uuacaaguguaaugaauguguucauacuggagagaaacuccuuguaagucacaaagcca

SEQ ID NO: 697462 - RNA, 59 nt, Homo Sapiens
uuaaaaguguaaugaguguguucauaguggagagaaaccccuuguauaccaucauagac

SEQ ID NO: 697463 - RNA, 59 nt, Homo Sapiens
ucacaagugugaugauuguguucauacaggagagaaacccuaugcaaaacauaggagga

SEQ ID NO: 697464 - RNA, 59 nt, Homo Sapiens
uuauaaaugucaugauugagcucaugcuggagagaaaccccuugcauuucacuggugaa

SEQ ID NO: 697465 - RNA, 59 nt, Homo Sapiens
uuacaagugcaaugaguguguucacacuggagagaaacccguggcaccccauacuagaa

SEQ ID NO: 697466 - RNA, 59 nt, Homo Sapiens
uuacaagcacaaugaauguguucauaguggagagaaaccucaaaauucacaccuuguaa

SEQ ID NO: 697467 - RNA, 59 nt, Homo Sapiens
cauuauaaguguaaugaguguucacacuggagagaaacuucuggcaaaacauacuagaa

SEQ ID NO: 697468 - RNA, 59 nt, Homo Sapiens
uuacaaaugggaggaauguguucauacuggagagaaacccuuugcacaucaccauagac

SEQ ID NO: 697469 - RNA, 59 nt, Homo Sapiens
uuacaagcauaaugaauguguucauacuggagagaaacccccuguaagucauaaggcaa

SEQ ID NO: 697470 - RNA, 59 nt, Homo Sapiens
uuuuuuaaacaaaugaugcugagaauaaggagagaaaugaauguagagagagguagaga

SEQ ID NO: 697471 - RNA, 59 nt, Homo Sapiens
ggagagaaaugaauguagagagagguagagagagaaauaugaacucuaacaaaggacug

SEQ ID NO: 697472 - RNA, 59 nt, Homo Sapiens
cccaguuaguggugugcaaaaaaaagaaugagagaaaagagaccugccagaagauuaaa

SEQ ID NO: 697473 - RNA, 59 nt, Homo Sapiens
ugggguuuuguuuccccaccaaaugaucagagagaaaagucuuagaaucucuuaugaaa

SEQ ID NO: 697474 - RNA, 59 nt, Homo Sapiens
guaauuugauuauuucauucugagaauuugagagaaauacugagcgagucucuagaggg

SEQ ID NO: 697475 - RNA, 59 nt, Homo Sapiens
auuucuauuaaugguuuaauuacauauuugagagaaaauuuucuuuuacaaaagaauau

SEQ ID NO: 697476 - RNA, 59 nt, Homo Sapiens
uaagagcugguucuaaaaucauaugacacgagagaaaagucaagugaggacuucaucac

SEQ ID NO: 697477 - RNA, 59 nt, Homo Sapiens
gagccgcugugcugguggggcaaagaauagagagaaaggauccagaggugccuucaggg

SEQ ID NO: 697478 - RNA, 59 nt, Homo Sapiens
gauuggcauuaguuaccacagccugcccagagagaaacuaucuucucccaacauuuacu

SEQ ID NO: 697479 - RNA, 59 nt, Homo Sapiens
guuacaaccgcuguaaaaugacggagagagagagaaagaaucccagacauuaacgguau

SEQ ID NO: 697480 - RNA, 64 nt, Homo Sapiens; identical to SEQ ID NO: 444750

SEQ ID NO: 697481 - RNA, 64 nt, Homo Sapiens; identical to SEQ ID NO: 444751

SEQ ID NO: 697482 - RNA, 64 nt, Homo Sapiens; identical to SEQ ID NO: 444752

SEQ ID NO: 697483 - RNA, 64 nt, Homo Sapiens; identical to SEQ ID NO: 444753

SEQ ID NO: 697484 - RNA, 60 nt, Homo Sapiens; identical to SEQ ID NO: 444754

SEQ ID NO: 697485 - RNA, 64 nt, Homo Sapiens; identical to SEQ ID NO: 444755

SEQ ID NO: 697486 - RNA, 64 nt, Homo Sapiens; identical to SEQ ID NO: 444756

SEQ ID NO: 697487 - RNA, 64 nt, Homo Sapiens; identical to SEQ ID NO: 444757

SEQ ID NO: 697488 - RNA, 64 nt, Homo Sapiens; identical to SEQ ID NO: 444758

SEQ ID NO: 697489 - RNA, 64 nt, Homo Sapiens; identical to SEQ ID NO: 444759

SEQ ID NO: 697490 - RNA, 64 nt, Homo Sapiens; identical to SEQ ID NO: 444760

SEQ ID NO: 697491 - RNA, 64 nt, Homo Sapiens; identical to SEQ ID NO: 444761

SEQ ID NO: 697492 - RNA, 52 nt, Homo Sapiens; identical to SEQ ID NO: 444762

SEQ ID NO: 697493 - RNA, 64 nt, Homo Sapiens; identical to SEQ ID NO: 444763

SEQ ID NO: 697494 - RNA, 64 nt, Homo Sapiens; identical to SEQ ID NO: 444764

SEQ ID NO: 697495 - RNA, 64 nt, Homo Sapiens; identical to SEQ ID NO: 444765

SEQ ID NO: 697496 - RNA, 64 nt, Homo Sapiens; identical to SEQ ID NO: 444766

SEQ ID NO: 697497 - RNA, 64 nt, Homo Sapiens; identical to SEQ ID NO: 444767

SEQ ID NO: 697498 - RNA, 64 nt, Homo Sapiens; identical to SEQ ID NO: 444768

SEQ ID NO: 697499 - RNA, 64 nt, Homo Sapiens; identical to SEQ ID NO: 444769

SEQ ID NO: 697500 - RNA, 64 nt, Homo Sapiens; identical to SEQ ID NO: 444770

SEQ ID NO: 697501 - RNA, 64 nt, Homo Sapiens; identical to SEQ ID NO: 444771

SEQ ID NO: 697502 - RNA, 64 nt, Homo Sapiens; identical to SEQ ID NO: 444772

SEQ ID NO: 697503 - RNA, 64 nt, Homo Sapiens; identical to SEQ ID NO: 444773

SEQ ID NO: 697504 - RNA, 64 nt, Homo Sapiens; identical to SEQ ID NO: 444774

SEQ ID NO: 697505 - RNA, 64 nt, Homo Sapiens; identical to SEQ ID NO: 444775

SEQ ID NO: 697506 - RNA, 64 nt, Homo Sapiens; identical to SEQ ID NO: 444776

SEQ ID NO: 697507 - RNA, 64 nt, Homo Sapiens; identical to SEQ ID NO: 444777

SEQ ID NO: 697508 - RNA, 64 nt, Homo Sapiens; identical to SEQ ID NO: 444778

SEQ ID NO: 697509 - RNA, 64 nt, Homo Sapiens; identical to SEQ ID NO: 444779

SEQ ID NO: 697510 - RNA, 64 nt, Homo Sapiens; identical to SEQ ID NO: 444780

SEQ ID NO: 697511 - RNA, 64 nt, Homo Sapiens; identical to SEQ ID NO: 444781

SEQ ID NO: 697512 - RNA, 64 nt, Homo Sapiens; identical to SEQ ID NO: 444782

SEQ ID NO: 697513 - RNA, 64 nt, Homo Sapiens; identical to SEQ ID NO: 444783

SEQ ID NO: 697514 - RNA, 64 nt, Homo Sapiens; identical to SEQ ID NO: 444784

SEQ ID NO: 697515 - RNA, 64 nt, Homo Sapiens; identical to SEQ ID NO: 444785

SEQ ID NO: 697516 - RNA, 64 nt, Homo Sapiens; identical to SEQ ID NO: 444786

SEQ ID NO: 697517 - RNA, 64 nt, Homo Sapiens; identical to SEQ ID NO: 444787

SEQ ID NO: 697518 - RNA, 64 nt, Homo Sapiens; identical to SEQ ID NO: 444788

SEQ ID NO: 697519 - RNA, 60 nt, Homo Sapiens; identical to SEQ ID NO: 444789

SEQ ID NO: 697520 - RNA, 64 nt, Homo Sapiens; identical to SEQ ID NO: 444790

SEQ ID NO: 697521 - RNA, 64 nt, Homo Sapiens; identical to SEQ ID NO: 444791

SEQ ID NO: 697522 - RNA, 64 nt, Homo Sapiens; identical to SEQ ID NO: 444792

SEQ ID NO: 697523 - RNA, 64 nt, Homo Sapiens; identical to SEQ ID NO: 444793

SEQ ID NO: 697524 - RNA, 64 nt, Homo Sapiens; identical to SEQ ID NO: 444794

SEQ ID NO: 697525 - RNA, 64 nt, Homo Sapiens; identical to SEQ ID NO: 444795

SEQ ID NO: 697526 - RNA, 64 nt, Homo Sapiens; identical to SEQ ID NO: 444796

SEQ ID NO: 697527 - RNA, 64 nt, Homo Sapiens; identical to SEQ ID NO: 444797

SEQ ID NO: 697528 - RNA, 64 nt, Homo Sapiens; identical to SEQ ID NO: 444798

SEQ ID NO: 697529 - RNA, 64 nt, Homo Sapiens; identical to SEQ ID NO: 444799

SEQ ID NO: 697530 - RNA, 64 nt, Homo Sapiens; identical to SEQ ID NO: 444800

SEQ ID NO: 697531 - RNA, 64 nt, Homo Sapiens; identical to SEQ ID NO: 444801

SEQ ID NO: 697532 - RNA, 64 nt, Homo Sapiens; identical to SEQ ID NO: 444802

SEQ ID NO: 697533 - RNA, 64 nt, Homo Sapiens; identical to SEQ ID NO: 444803

SEQ ID NO: 697534 - RNA, 64 nt, Homo Sapiens; identical to SEQ ID NO: 444804

SEQ ID NO: 697535 - RNA, 64 nt, Homo Sapiens; identical to SEQ ID NO: 444805

SEQ ID NO: 697536 - RNA, 64 nt, Homo Sapiens; identical to SEQ ID NO: 444806

SEQ ID NO: 697537 - RNA, 60 nt, Homo Sapiens; identical to SEQ ID NO: 444807

SEQ ID NO: 697538 - RNA, 64 nt, Homo Sapiens; identical to SEQ ID NO: 444808

SEQ ID NO: 697539 - RNA, 64 nt, Homo Sapiens; identical to SEQ ID NO: 444809

SEQ ID NO: 697540 - RNA, 64 nt, Homo Sapiens; identical to SEQ ID NO: 444810

SEQ ID NO: 697541 - RNA, 64 nt, Homo Sapiens; identical to SEQ ID NO: 444811

SEQ ID NO: 697542 - RNA, 64 nt, Homo Sapiens; identical to SEQ ID NO: 444812

SEQ ID NO: 697543 - RNA, 51 nt, Homo Sapiens; identical to SEQ ID NO: 444813

SEQ ID NO: 697544 - RNA, 64 nt, Homo Sapiens; identical to SEQ ID NO: 444814

SEQ ID NO: 697545 - RNA, 64 nt, Homo Sapiens; identical to SEQ ID NO: 444815

SEQ ID NO: 697546 - RNA, 64 nt, Homo Sapiens; identical to SEQ ID NO: 444816

SEQ ID NO: 697547 - RNA, 64 nt, Homo Sapiens; identical to SEQ ID NO: 444817

SEQ ID NO: 697548 - RNA, 64 nt, Homo Sapiens; identical to SEQ ID NO: 444818

SEQ ID NO: 697549 - RNA, 62 nt, Homo Sapiens; identical to SEQ ID NO: 444819

SEQ ID NO: 697550 - RNA, 64 nt, Homo Sapiens; identical to SEQ ID NO: 444820

SEQ ID NO: 697551 - RNA, 64 nt, Homo Sapiens; identical to SEQ ID NO: 444821

SEQ ID NO: 697552 - RNA, 64 nt, Homo Sapiens; identical to SEQ ID NO: 444822

SEQ ID NO: 697553 - RNA, 64 nt, Homo Sapiens; identical to SEQ ID NO: 444823

SEQ ID NO: 697554 - RNA, 64 nt, Homo Sapiens; identical to SEQ ID NO: 444824

SEQ ID NO: 697555 - RNA, 64 nt, Homo Sapiens; identical to SEQ ID NO: 444825

SEQ ID NO: 697556 - RNA, 64 nt, Homo Sapiens; identical to SEQ ID NO: 444826

SEQ ID NO: 697557 - RNA, 64 nt, Homo Sapiens; identical to SEQ ID NO: 444827

SEQ ID NO: 697558 - RNA, 64 nt, Homo Sapiens; identical to SEQ ID NO: 444828

SEQ ID NO: 697559 - RNA, 64 nt, Homo Sapiens; identical to SEQ ID NO: 444829

SEQ ID NO: 697560 - RNA, 64 nt, Homo Sapiens; identical to SEQ ID NO: 444830

SEQ ID NO: 697561 - RNA, 64 nt, Homo Sapiens; identical to SEQ ID NO: 444831

SEQ ID NO: 697562 - RNA, 64 nt, Homo Sapiens; identical to SEQ ID NO: 444832

SEQ ID NO: 697563 - RNA, 64 nt, Homo Sapiens; identical to SEQ ID NO: 444833

SEQ ID NO: 697564 - RNA, 64 nt, Homo Sapiens; identical to SEQ ID NO: 444834

SEQ ID NO: 697565 - RNA, 64 nt, Homo Sapiens; identical to SEQ ID NO: 444835

SEQ ID NO: 697566 - RNA, 64 nt, Homo Sapiens; identical to SEQ ID NO: 444836

SEQ ID NO: 697567 - RNA, 64 nt, Homo Sapiens; identical to SEQ ID NO: 444837

SEQ ID NO: 697568 - RNA, 64 nt, Homo Sapiens; identical to SEQ ID NO: 444838

SEQ ID NO: 697569 - RNA, 64 nt, Homo Sapiens; identical to SEQ ID NO: 444839

SEQ ID NO: 697570 - RNA, 64 nt, Homo Sapiens; identical to SEQ ID NO: 444840

SEQ ID NO: 697571 - RNA, 64 nt, Homo Sapiens; identical to SEQ ID NO: 444841

SEQ ID NO: 697572 - RNA, 64 nt, Homo Sapiens; identical to SEQ ID NO: 444842

SEQ ID NO: 697573 - RNA, 64 nt, Homo Sapiens; identical to SEQ ID NO: 444843

SEQ ID NO: 697574 - RNA, 64 nt, Homo Sapiens; identical to SEQ ID NO: 444844

SEQ ID NO: 697575 - RNA, 64 nt, Homo Sapiens; identical to SEQ ID NO: 444845

SEQ ID NO: 697576 - RNA, 64 nt, Homo Sapiens; identical to SEQ ID NO: 444846

SEQ ID NO: 697577 - RNA, 64 nt, Homo Sapiens; identical to SEQ ID NO: 444847

SEQ ID NO: 697578 - RNA, 64 nt, Homo Sapiens; identical to SEQ ID NO: 444848

SEQ ID NO: 697579 - RNA, 64 nt, Homo Sapiens; identical to SEQ ID NO: 444849

SEQ ID NO: 697580 - RNA, 64 nt, Homo Sapiens; identical to SEQ ID NO: 444850

SEQ ID NO: 697581 - RNA, 64 nt, Homo Sapiens; identical to SEQ ID NO: 444851

SEQ ID NO: 697582 - RNA, 64 nt, Homo Sapiens; identical to SEQ ID NO: 444852

SEQ ID NO: 697583 - RNA, 64 nt, Homo Sapiens; identical to SEQ ID NO: 334387

SEQ ID NO: 697584 - RNA, 64 nt, Homo Sapiens; identical to SEQ ID NO: 334388

SEQ ID NO: 697585 - RNA, 64 nt, Homo Sapiens; identical to SEQ ID NO: 334389

SEQ ID NO: 697586 - RNA, 64 nt, Homo Sapiens; identical to SEQ ID NO: 334390

SEQ ID NO: 697587 - RNA, 64 nt, Homo Sapiens; identical to SEQ ID NO: 334391

SEQ ID NO: 697588 - RNA, 64 nt, Homo Sapiens; identical to SEQ ID NO: 334392

SEQ ID NO: 697589 - RNA, 64 nt, Homo Sapiens; identical to SEQ ID NO: 334393

SEQ ID NO: 697590 - RNA, 64 nt, Homo Sapiens; identical to SEQ ID NO: 334394

SEQ ID NO: 697591 - RNA, 64 nt, Homo Sapiens; identical to SEQ ID NO: 334395

SEQ ID NO: 697592 - RNA, 64 nt, Homo Sapiens; identical to SEQ ID NO: 334396

SEQ ID NO: 697593 - RNA, 64 nt, Homo Sapiens; identical to SEQ ID NO: 334397

SEQ ID NO: 697594 - RNA, 64 nt, Homo Sapiens; identical to SEQ ID NO: 334398

SEQ ID NO: 697595 - RNA, 64 nt, Homo Sapiens
augcaugcucacagucccuuucagagcaccucuccagaugcaccccuggaucagugggguguau

SEQ ID NO: 697596 - RNA, 64 nt, Homo Sapiens
ccuucccccgagugcauggccccuucgcuugaggcagaugcagcgagcaaauuaggaaaaugua

SEQ ID NO: 697597 - RNA, 64 nt, Homo Sapiens
uauuuaacuucccaguagccacaaaugcaggccacagaugcaaaccaauagaaacacaacagcc

SEQ ID NO: 697598 - RNA, 64 nt, Homo Sapiens
uuuuuuuuaaauagaugcaaucugguuauuuugacagaugcaugauuuguaugguuuaguggag

SEQ ID NO: 697599 - RNA, 64 nt, Homo Sapiens
cuaaaucaugugacguuuugacuggcuugagauucagaugcauaauuuuuaauuauaauuauug

SEQ ID NO: 697600 - RNA, 64 nt, Homo Sapiens
uguaccuuuugagacuauguauuuauauuuggaucagaugcauauuuauuaauguacagucacu

SEQ ID NO: 697601 - RNA, 64 nt, Homo Sapiens
uuuucagaacucauccaguccuuguaaucuuaaacagaugcaaauccuaccccugcccuuaaug

SEQ ID NO: 697602 - RNA, 64 nt, Homo Sapiens
ucucacuuugaaagaaagacuccguaaucuuaaacagaugcaaauccaauuaggcggccaagua

SEQ ID NO: 697603 - RNA, 64 nt, Homo Sapiens
cgugcaggagccgagccaguccagcaggaaaguacagaugcagcgaagagaagaagaaaaucaa

SEQ ID NO: 697604 - RNA, 64 nt, Homo Sapiens
cucuugucucacaugcuagccuucuuggagcgagcagaugcaauauguuugucaaaaaguggau

SEQ ID NO: 697605 - RNA, 64 nt, Homo Sapiens
gcauaagcuacacaggaugugcuucugcagccuacagaugcagaaccagaaugagggggacaau

SEQ ID NO: 697606 - RNA, 64 nt, Homo Sapiens
cccaggggagggguguugucuggaagggcagguucagaugcagccuuccagauuuagaggcacu

SEQ ID NO: 697607 - RNA, 64 nt, Homo Sapiens
uacgaugucucagagcucugauuuuucuagccaucagaugcaaucuuuaaacugcggucaaaag

SEQ ID NO: 697608 - RNA, 64 nt, Homo Sapiens
caaggcauugcucuguuugcuggaagcugaggaccagaugcacauugugggcacaccugggaug

SEQ ID NO: 697609 - RNA, 64 nt, Homo Sapiens
ugggccgcaaaacacacaguccaaaagaggucaccagaugcacacauaacaauaccucgaauuu

SEQ ID NO: 697610 - RNA, 64 nt, Homo Sapiens
uguccagugccccaucauggcagugagaugcucccagaugcauuuuucuccugcacuuggcuug

SEQ ID NO: 697611 - RNA, 64 nt, Homo Sapiens
augggugccaagugccagggggcggaguccccagcagaugcauccuggccaucuguugcgugga

SEQ ID NO: 697612 - RNA, 64 nt, Homo Sapiens
uauauccagcauauucauaacuagagccauaucacagaugcauucaucauaauaauuccagaca

SEQ ID NO: 697613 - RNA, 64 nt, Homo Sapiens
caccgaugcacacgcacauagagauaugcacacacagaugcacacacagauauacacauggaug

SEQ ID NO: 697614 - RNA, 64 nt, Homo Sapiens
cacaccaaugcgcacacacaccgauguacacacacagaugcacacacagaugcacacacaccga

SEQ ID NO: 697615 - RNA, 64 nt, Homo Sapiens
cacacacaccgauguacacacacagaugcacacacagaugcacacacaccgaugcugacuccau

SEQ ID NO: 697616 - RNA, 64 nt, Homo Sapiens
aaagacacgcagauuacauuugauaaauguuacacagaugcauuugugcauuugaauacucugu

SEQ ID NO: 697617 - RNA, 64 nt, Homo Sapiens
uauagagagacucugggccacccucaaacaccgucagaugcauuagcagcccacugcaugggac

SEQ ID NO: 697618 - RNA, 64 nt, Homo Sapiens
gccgagcauuguggauuagccugaggcuuaaaaucagaugcaugucugguaagaugaccacugu

SEQ ID NO: 697619 - RNA, 64 nt, Homo Sapiens
guccugcucauugucuugaguuucuaaccaugugcagaugcaagcguucaggaguaggaauuaa

SEQ ID NO: 697620 - RNA, 64 nt, Homo Sapiens
uauuuugguaucuccuaucaccaaccucccuguccagaugcagcgaaucagcugugcucaauag

SEQ ID NO: 697621 - RNA, 64 nt, Homo Sapiens
auuaugaaaccugguuguacaaguggggaggugacagaugcacauggaagaaaaagauucagcc

SEQ ID NO: 697622 - RNA, 64 nt, Homo Sapiens
uaaaaauagaaucucacugauagccugcaagaaacagaugcagugccugcuuccguaucagucc

SEQ ID NO: 697623 - RNA, 64 nt, Homo Sapiens
gaaggccagagagccgcgcaguucucugcaggugcagaugcaggcaguggagguggccugagca

SEQ ID NO: 697624 - RNA, 64 nt, Homo Sapiens
agggagaauaaaccugaauacucuggguaucccacagaugcaaagacguuuccccucucucuaa

SEQ ID NO: 697625 - RNA, 64 nt, Homo Sapiens
cugcaucccagucccccuccagucauguggcucgcagaugcaucccgcuggucaagaagccaac

SEQ ID NO: 697626 - RNA, 64 nt, Homo Sapiens; identical to SEQ ID NO: 380102

SEQ ID NO: 697627 - RNA, 64 nt, Homo Sapiens; identical to SEQ ID NO: 380103

SEQ ID NO: 697628 - RNA, 64 nt, Homo Sapiens; identical to SEQ ID NO: 380104

SEQ ID NO: 697629 - RNA, 64 nt, Homo Sapiens; identical to SEQ ID NO: 380105

SEQ ID NO: 697630 - RNA, 64 nt, Homo Sapiens; identical to SEQ ID NO: 380106

SEQ ID NO: 697631 - RNA, 64 nt, Homo Sapiens; identical to SEQ ID NO: 380107

SEQ ID NO: 697632 - RNA, 64 nt, Homo Sapiens; identical to SEQ ID NO: 380108

SEQ ID NO: 697633 - RNA, 64 nt, Homo Sapiens; identical to SEQ ID NO: 380109

SEQ ID NO: 697634 - RNA, 64 nt, Homo Sapiens; identical to SEQ ID NO: 380110

SEQ ID NO: 697635 - RNA, 64 nt, Homo Sapiens; identical to SEQ ID NO: 380111

SEQ ID NO: 697636 - RNA, 64 nt, Homo Sapiens; identical to SEQ ID NO: 380112

SEQ ID NO: 697637 - RNA, 64 nt, Homo Sapiens; identical to SEQ ID NO: 380113

SEQ ID NO: 697638 - RNA, 64 nt, Homo Sapiens; identical to SEQ ID NO: 380114

SEQ ID NO: 697639 - RNA, 64 nt, Homo Sapiens; identical to SEQ ID NO: 380115

SEQ ID NO: 697640 - RNA, 58 nt, Homo Sapiens; identical to SEQ ID NO: 380116

SEQ ID NO: 697641 - RNA, 64 nt, Homo Sapiens; identical to SEQ ID NO: 380117

SEQ ID NO: 697642 - RNA, 64 nt, Homo Sapiens; identical to SEQ ID NO: 380118

SEQ ID NO: 697643 - RNA, 64 nt, Homo Sapiens; identical to SEQ ID NO: 380119

SEQ ID NO: 697644 - RNA, 64 nt, Homo Sapiens; identical to SEQ ID NO: 380120

SEQ ID NO: 697645 - RNA, 64 nt, Homo Sapiens; identical to SEQ ID NO: 380121

SEQ ID NO: 697646 - RNA, 64 nt, Homo Sapiens; identical to SEQ ID NO: 380122

SEQ ID NO: 697647 - RNA, 64 nt, Homo Sapiens; identical to SEQ ID NO: 380123

SEQ ID NO: 697648 - RNA, 64 nt, Homo Sapiens; identical to SEQ ID NO: 380124

SEQ ID NO: 697649 - RNA, 64 nt, Homo Sapiens; identical to SEQ ID NO: 380125

SEQ ID NO: 697650 - RNA, 64 nt, Homo Sapiens; identical to SEQ ID NO: 380126

SEQ ID NO: 697651 - RNA, 64 nt, Homo Sapiens; identical to SEQ ID NO: 380127

SEQ ID NO: 697652 - RNA, 64 nt, Homo Sapiens; identical to SEQ ID NO: 380128

SEQ ID NO: 697653 - RNA, 64 nt, Homo Sapiens; identical to SEQ ID NO: 380129

SEQ ID NO: 697654 - RNA, 64 nt, Homo Sapiens; identical to SEQ ID NO: 380130

SEQ ID NO: 697655 - RNA, 64 nt, Homo Sapiens; identical to SEQ ID NO: 380131

SEQ ID NO: 697656 - RNA, 64 nt, Homo Sapiens; identical to SEQ ID NO: 380132

SEQ ID NO: 697657 - RNA, 64 nt, Homo Sapiens; identical to SEQ ID NO: 380133

SEQ ID NO: 697658 - RNA, 64 nt, Homo Sapiens; identical to SEQ ID NO: 380134

SEQ ID NO: 697659 - RNA, 64 nt, Homo Sapiens; identical to SEQ ID NO: 380135

SEQ ID NO: 697660 - RNA, 64 nt, Homo Sapiens; identical to SEQ ID NO: 380136

SEQ ID NO: 697661 - RNA, 64 nt, Homo Sapiens; identical to SEQ ID NO: 380137

SEQ ID NO: 697662 - RNA, 64 nt, Homo Sapiens; identical to SEQ ID NO: 380138

SEQ ID NO: 697663 - RNA, 64 nt, Homo Sapiens; identical to SEQ ID NO: 380139

SEQ ID NO: 697664 - RNA, 64 nt, Homo Sapiens; identical to SEQ ID NO: 380140

SEQ ID NO: 697665 - RNA, 64 nt, Homo Sapiens; identical to SEQ ID NO: 380141

SEQ ID NO: 697666 - RNA, 64 nt, Homo Sapiens; identical to SEQ ID NO: 380142

SEQ ID NO: 697667 - RNA, 64 nt, Homo Sapiens; identical to SEQ ID NO: 380143

SEQ ID NO: 697668 - RNA, 64 nt, Homo Sapiens; identical to SEQ ID NO: 380144

SEQ ID NO: 697669 - RNA, 64 nt, Homo Sapiens; identical to SEQ ID NO: 380145

SEQ ID NO: 697670 - RNA, 64 nt, Homo Sapiens; identical to SEQ ID NO: 380146

SEQ ID NO: 697671 - RNA, 64 nt, Homo Sapiens; identical to SEQ ID NO: 380147

SEQ ID NO: 697672 - RNA, 59 nt, Homo Sapiens; identical to SEQ ID NO: 380148

SEQ ID NO: 697673 - RNA, 64 nt, Homo Sapiens; identical to SEQ ID NO: 380149

SEQ ID NO: 697674 - RNA, 64 nt, Homo Sapiens; identical to SEQ ID NO: 380150

SEQ ID NO: 697675 - RNA, 64 nt, Homo Sapiens; identical to SEQ ID NO: 380151

SEQ ID NO: 697676 - RNA, 64 nt, Homo Sapiens; identical to SEQ ID NO: 380152

SEQ ID NO: 697677 - RNA, 64 nt, Homo Sapiens; identical to SEQ ID NO: 380153

SEQ ID NO: 697678 - RNA, 64 nt, Homo Sapiens; identical to SEQ ID NO: 380154

SEQ ID NO: 697679 - RNA, 64 nt, Homo Sapiens; identical to SEQ ID NO: 380155

SEQ ID NO: 697680 - RNA, 64 nt, Homo Sapiens; identical to SEQ ID NO: 380156

SEQ ID NO: 697681 - RNA, 64 nt, Homo Sapiens; identical to SEQ ID NO: 380157

SEQ ID NO: 697682 - RNA, 64 nt, Homo Sapiens; identical to SEQ ID NO: 380158

SEQ ID NO: 697683 - RNA, 64 nt, Homo Sapiens; identical to SEQ ID NO: 380159

SEQ ID NO: 697684 - RNA, 64 nt, Homo Sapiens; identical to SEQ ID NO: 380160

SEQ ID NO: 697685 - RNA, 64 nt, Homo Sapiens; identical to SEQ ID NO: 380161

SEQ ID NO: 697686 - RNA, 54 nt, Homo Sapiens; identical to SEQ ID NO: 380162

SEQ ID NO: 697687 - RNA, 64 nt, Homo Sapiens; identical to SEQ ID NO: 380163

SEQ ID NO: 697688 - RNA, 64 nt, Homo Sapiens; identical to SEQ ID NO: 380164

SEQ ID NO: 697689 - RNA, 64 nt, Homo Sapiens; identical to SEQ ID NO: 380165

SEQ ID NO: 697690 - RNA, 64 nt, Homo Sapiens; identical to SEQ ID NO: 380166

SEQ ID NO: 697691 - RNA, 64 nt, Homo Sapiens; identical to SEQ ID NO: 380167

SEQ ID NO: 697692 - RNA, 64 nt, Homo Sapiens; identical to SEQ ID NO: 380168

SEQ ID NO: 697693 - RNA, 64 nt, Homo Sapiens; identical to SEQ ID NO: 380169

SEQ ID NO: 697694 - RNA, 64 nt, Homo Sapiens; identical to SEQ ID NO: 380170

SEQ ID NO: 697695 - RNA, 64 nt, Homo Sapiens; identical to SEQ ID NO: 380171

SEQ ID NO: 697696 - RNA, 64 nt, Homo Sapiens; identical to SEQ ID NO: 380172

SEQ ID NO: 697697 - RNA, 64 nt, Homo Sapiens; identical to SEQ ID NO: 380173

SEQ ID NO: 697698 - RNA, 64 nt, Homo Sapiens; identical to SEQ ID NO: 380174

SEQ ID NO: 697699 - RNA, 64 nt, Homo Sapiens; identical to SEQ ID NO: 380175

SEQ ID NO: 697700 - RNA, 64 nt, Homo Sapiens; identical to SEQ ID NO: 380176

SEQ ID NO: 697701 - RNA, 64 nt, Homo Sapiens; identical to SEQ ID NO: 380177

SEQ ID NO: 697702 - RNA, 64 nt, Homo Sapiens; identical to SEQ ID NO: 380178

SEQ ID NO: 697703 - RNA, 64 nt, Homo Sapiens; identical to SEQ ID NO: 380179

SEQ ID NO: 697704 - RNA, 64 nt, Homo Sapiens; identical to SEQ ID NO: 380180

SEQ ID NO: 697705 - RNA, 64 nt, Homo Sapiens; identical to SEQ ID NO: 380181

SEQ ID NO: 697706 - RNA, 64 nt, Homo Sapiens; identical to SEQ ID NO: 380182

SEQ ID NO: 697707 - RNA, 64 nt, Homo Sapiens; identical to SEQ ID NO: 380183

SEQ ID NO: 697708 - RNA, 64 nt, Homo Sapiens; identical to SEQ ID NO: 380184

SEQ ID NO: 697709 - RNA, 64 nt, Homo Sapiens; identical to SEQ ID NO: 380185

SEQ ID NO: 697710 - RNA, 64 nt, Homo Sapiens; identical to SEQ ID NO: 380186

SEQ ID NO: 697711 - RNA, 64 nt, Homo Sapiens; identical to SEQ ID NO: 380187

SEQ ID NO: 697712 - RNA, 64 nt, Homo Sapiens; identical to SEQ ID NO: 380188

SEQ ID NO: 697713 - RNA, 64 nt, Homo Sapiens; identical to SEQ ID NO: 380189

SEQ ID NO: 697714 - RNA, 64 nt, Homo Sapiens; identical to SEQ ID NO: 380190

SEQ ID NO: 697715 - RNA, 64 nt, Homo Sapiens; identical to SEQ ID NO: 380191

SEQ ID NO: 697716 - RNA, 64 nt, Homo Sapiens; identical to SEQ ID NO: 380192

SEQ ID NO: 697717 - RNA, 64 nt, Homo Sapiens; identical to SEQ ID NO: 380193

SEQ ID NO: 697718 - RNA, 64 nt, Homo Sapiens; identical to SEQ ID NO: 380194

SEQ ID NO: 697719 - RNA, 64 nt, Homo Sapiens; identical to SEQ ID NO: 380195

SEQ ID NO: 697720 - RNA, 58 nt, Homo Sapiens; identical to SEQ ID NO: 380196

SEQ ID NO: 697721 - RNA, 64 nt, Homo Sapiens; identical to SEQ ID NO: 380197

SEQ ID NO: 697722 - RNA, 64 nt, Homo Sapiens; identical to SEQ ID NO: 380198

SEQ ID NO: 697723 - RNA, 64 nt, Homo Sapiens; identical to SEQ ID NO: 380199

SEQ ID NO: 697724 - RNA, 64 nt, Homo Sapiens; identical to SEQ ID NO: 380200

SEQ ID NO: 697725 - RNA, 64 nt, Homo Sapiens; identical to SEQ ID NO: 380201

SEQ ID NO: 697726 - RNA, 64 nt, Homo Sapiens; identical to SEQ ID NO: 380202

SEQ ID NO: 697727 - RNA, 64 nt, Homo Sapiens; identical to SEQ ID NO: 380203

SEQ ID NO: 697728 - RNA, 64 nt, Homo Sapiens; identical to SEQ ID NO: 380204

SEQ ID NO: 697729 - RNA, 64 nt, Homo Sapiens; identical to SEQ ID NO: 380205

SEQ ID NO: 697730 - RNA, 64 nt, Homo Sapiens; identical to SEQ ID NO: 380206

SEQ ID NO: 697731 - RNA, 64 nt, Homo Sapiens; identical to SEQ ID NO: 380207

SEQ ID NO: 697732 - RNA, 64 nt, Homo Sapiens; identical to SEQ ID NO: 380208

SEQ ID NO: 697733 - RNA, 64 nt, Homo Sapiens; identical to SEQ ID NO: 380209

SEQ ID NO: 697734 - RNA, 63 nt, Homo Sapiens; identical to SEQ ID NO: 380210

SEQ ID NO: 697735 - RNA, 64 nt, Homo Sapiens; identical to SEQ ID NO: 380211

SEQ ID NO: 697736 - RNA, 64 nt, Homo Sapiens; identical to SEQ ID NO: 380212

SEQ ID NO: 697737 - RNA, 64 nt, Homo Sapiens; identical to SEQ ID NO: 380213

SEQ ID NO: 697738 - RNA, 64 nt, Homo Sapiens; identical to SEQ ID NO: 380214

SEQ ID NO: 697739 - RNA, 64 nt, Homo Sapiens; identical to SEQ ID NO: 380215

SEQ ID NO: 697740 - RNA, 64 nt, Homo Sapiens; identical to SEQ ID NO: 380216

SEQ ID NO: 697741 - RNA, 64 nt, Homo Sapiens; identical to SEQ ID NO: 380217

SEQ ID NO: 697742 - RNA, 64 nt, Homo Sapiens; identical to SEQ ID NO: 380218

SEQ ID NO: 697743 - RNA, 64 nt, Homo Sapiens; identical to SEQ ID NO: 380219

SEQ ID NO: 697744 - RNA, 64 nt, Homo Sapiens; identical to SEQ ID NO: 380220

SEQ ID NO: 697745 - RNA, 64 nt, Homo Sapiens; identical to SEQ ID NO: 380221

SEQ ID NO: 697746 - RNA, 64 nt, Homo Sapiens; identical to SEQ ID NO: 380222

SEQ ID NO: 697747 - RNA, 64 nt, Homo Sapiens; identical to SEQ ID NO: 380223

SEQ ID NO: 697748 - RNA, 64 nt, Homo Sapiens; identical to SEQ ID NO: 380224

SEQ ID NO: 697749 - RNA, 64 nt, Homo Sapiens; identical to SEQ ID NO: 380225

SEQ ID NO: 697750 - RNA, 64 nt, Homo Sapiens; identical to SEQ ID NO: 380226

SEQ ID NO: 697751 - RNA, 64 nt, Homo Sapiens; identical to SEQ ID NO: 380227

SEQ ID NO: 697752 - RNA, 64 nt, Homo Sapiens; identical to SEQ ID NO: 380228

SEQ ID NO: 697753 - RNA, 64 nt, Homo Sapiens; identical to SEQ ID NO: 380229

SEQ ID NO: 697754 - RNA, 64 nt, Homo Sapiens; identical to SEQ ID NO: 380230

SEQ ID NO: 697755 - RNA, 64 nt, Homo Sapiens; identical to SEQ ID NO: 380231

SEQ ID NO: 697756 - RNA, 64 nt, Homo Sapiens; identical to SEQ ID NO: 380232

SEQ ID NO: 697757 - RNA, 64 nt, Homo Sapiens; identical to SEQ ID NO: 380233

SEQ ID NO: 697758 - RNA, 64 nt, Homo Sapiens; identical to SEQ ID NO: 380234

SEQ ID NO: 697759 - RNA, 64 nt, Homo Sapiens; identical to SEQ ID NO: 380235

SEQ ID NO: 697760 - RNA, 51 nt, Homo Sapiens; identical to SEQ ID NO: 380236

SEQ ID NO: 697761 - RNA, 64 nt, Homo Sapiens; identical to SEQ ID NO: 380237

SEQ ID NO: 697762 - RNA, 64 nt, Homo Sapiens; identical to SEQ ID NO: 380238

SEQ ID NO: 697763 - RNA, 64 nt, Homo Sapiens; identical to SEQ ID NO: 380239

SEQ ID NO: 697764 - RNA, 64 nt, Homo Sapiens; identical to SEQ ID NO: 380240

SEQ ID NO: 697765 - RNA, 64 nt, Homo Sapiens; identical to SEQ ID NO: 380241

SEQ ID NO: 697766 - RNA, 64 nt, Homo Sapiens; identical to SEQ ID NO: 380242

SEQ ID NO: 697767 - RNA, 64 nt, Homo Sapiens; identical to SEQ ID NO: 380243

SEQ ID NO: 697768 - RNA, 64 nt, Homo Sapiens; identical to SEQ ID NO: 380244

SEQ ID NO: 697769 - RNA, 64 nt, Homo Sapiens; identical to SEQ ID NO: 380245

SEQ ID NO: 697770 - RNA, 64 nt, Homo Sapiens; identical to SEQ ID NO: 380246

SEQ ID NO: 697771 - RNA, 64 nt, Homo Sapiens; identical to SEQ ID NO: 380247

SEQ ID NO: 697772 - RNA, 64 nt, Homo Sapiens; identical to SEQ ID NO: 380248

SEQ ID NO: 697773 - RNA, 64 nt, Homo Sapiens; identical to SEQ ID NO: 380249

SEQ ID NO: 697774 - RNA, 64 nt, Homo Sapiens; identical to SEQ ID NO: 380250

SEQ ID NO: 697775 - RNA, 64 nt, Homo Sapiens; identical to SEQ ID NO: 380251

SEQ ID NO: 697776 - RNA, 64 nt, Homo Sapiens; identical to SEQ ID NO: 380252

SEQ ID NO: 697777 - RNA, 64 nt, Homo Sapiens; identical to SEQ ID NO: 380253

SEQ ID NO: 697778 - RNA, 64 nt, Homo Sapiens; identical to SEQ ID NO: 380254

SEQ ID NO: 697779 - RNA, 64 nt, Homo Sapiens; identical to SEQ ID NO: 380255

SEQ ID NO: 697780 - RNA, 64 nt, Homo Sapiens; identical to SEQ ID NO: 380256

SEQ ID NO: 697781 - RNA, 64 nt, Homo Sapiens; identical to SEQ ID NO: 380257

SEQ ID NO: 697782 - RNA, 64 nt, Homo Sapiens; identical to SEQ ID NO: 380258

SEQ ID NO: 697783 - RNA, 64 nt, Homo Sapiens; identical to SEQ ID NO: 380259

SEQ ID NO: 697784 - RNA, 64 nt, Homo Sapiens; identical to SEQ ID NO: 380260

SEQ ID NO: 697785 - RNA, 64 nt, Homo Sapiens; identical to SEQ ID NO: 380261

SEQ ID NO: 697786 - RNA, 64 nt, Homo Sapiens; identical to SEQ ID NO: 380262

SEQ ID NO: 697787 - RNA, 64 nt, Homo Sapiens; identical to SEQ ID NO: 380263

SEQ ID NO: 697788 - RNA, 64 nt, Homo Sapiens; identical to SEQ ID NO: 380264

SEQ ID NO: 697789 - RNA, 64 nt, Homo Sapiens; identical to SEQ ID NO: 380265

SEQ ID NO: 697790 - RNA, 64 nt, Homo Sapiens; identical to SEQ ID NO: 380266

SEQ ID NO: 697791 - RNA, 64 nt, Homo Sapiens; identical to SEQ ID NO: 380267

SEQ ID NO: 697792 - RNA, 64 nt, Homo Sapiens; identical to SEQ ID NO: 380268

SEQ ID NO: 697793 - RNA, 64 nt, Homo Sapiens; identical to SEQ ID NO: 380269

SEQ ID NO: 697794 - RNA, 64 nt, Homo Sapiens; identical to SEQ ID NO: 380270

SEQ ID NO: 697795 - RNA, 64 nt, Homo Sapiens; identical to SEQ ID NO: 380271

SEQ ID NO: 697796 - RNA, 64 nt, Homo Sapiens; identical to SEQ ID NO: 380272

SEQ ID NO: 697797 - RNA, 64 nt, Homo Sapiens; identical to SEQ ID NO: 380273

SEQ ID NO: 697798 - RNA, 64 nt, Homo Sapiens; identical to SEQ ID NO: 380274

SEQ ID NO: 697799 - RNA, 64 nt, Homo Sapiens; identical to SEQ ID NO: 380275

SEQ ID NO: 697800 - RNA, 64 nt, Homo Sapiens; identical to SEQ ID NO: 380276

SEQ ID NO: 697801 - RNA, 64 nt, Homo Sapiens; identical to SEQ ID NO: 380277

SEQ ID NO: 697802 - RNA, 64 nt, Homo Sapiens; identical to SEQ ID NO: 380278

SEQ ID NO: 697803 - RNA, 64 nt, Homo Sapiens; identical to SEQ ID NO: 380279

SEQ ID NO: 697804 - RNA, 50 nt, Homo Sapiens; identical to SEQ ID NO: 380280

SEQ ID NO: 697805 - RNA, 64 nt, Homo Sapiens; identical to SEQ ID NO: 380281

SEQ ID NO: 697806 - RNA, 63 nt, Homo Sapiens; identical to SEQ ID NO: 380282

SEQ ID NO: 697807 - RNA, 64 nt, Homo Sapiens; identical to SEQ ID NO: 380283

SEQ ID NO: 697808 - RNA, 64 nt, Homo Sapiens; identical to SEQ ID NO: 380284

SEQ ID NO: 697809 - RNA, 64 nt, Homo Sapiens; identical to SEQ ID NO: 380285

SEQ ID NO: 697810 - RNA, 64 nt, Homo Sapiens; identical to SEQ ID NO: 380286

SEQ ID NO: 697811 - RNA, 64 nt, Homo Sapiens; identical to SEQ ID NO: 380287

SEQ ID NO: 697812 - RNA, 64 nt, Homo Sapiens; identical to SEQ ID NO: 380288

SEQ ID NO: 697813 - RNA, 64 nt, Homo Sapiens; identical to SEQ ID NO: 380289

SEQ ID NO: 697814 - RNA, 64 nt, Homo Sapiens; identical to SEQ ID NO: 380290

SEQ ID NO: 697815 - RNA, 64 nt, Homo Sapiens; identical to SEQ ID NO: 380291

SEQ ID NO: 697816 - RNA, 64 nt, Homo Sapiens; identical to SEQ ID NO: 380292

SEQ ID NO: 697817 - RNA, 64 nt, Homo Sapiens; identical to SEQ ID NO: 380293

SEQ ID NO: 697818 - RNA, 64 nt, Homo Sapiens; identical to SEQ ID NO: 380294

SEQ ID NO: 697819 - RNA, 64 nt, Homo Sapiens; identical to SEQ ID NO: 380295

SEQ ID NO: 697820 - RNA, 64 nt, Homo Sapiens; identical to SEQ ID NO: 380296

SEQ ID NO: 697821 - RNA, 64 nt, Homo Sapiens; identical to SEQ ID NO: 380297

SEQ ID NO: 697822 - RNA, 64 nt, Homo Sapiens; identical to SEQ ID NO: 380298

SEQ ID NO: 697823 - RNA, 64 nt, Homo Sapiens; identical to SEQ ID NO: 380299

SEQ ID NO: 697824 - RNA, 64 nt, Homo Sapiens; identical to SEQ ID NO: 380300

SEQ ID NO: 697825 - RNA, 64 nt, Homo Sapiens; identical to SEQ ID NO: 380301

SEQ ID NO: 697826 - RNA, 64 nt, Homo Sapiens; identical to SEQ ID NO: 380302

SEQ ID NO: 697827 - RNA, 64 nt, Homo Sapiens; identical to SEQ ID NO: 380303

SEQ ID NO: 697828 - RNA, 64 nt, Homo Sapiens; identical to SEQ ID NO: 380304

SEQ ID NO: 697829 - RNA, 64 nt, Homo Sapiens; identical to SEQ ID NO: 380304

SEQ ID NO: 697830 - RNA, 64 nt, Homo Sapiens; identical to SEQ ID NO: 380306

SEQ ID NO: 697831 - RNA, 64 nt, Homo Sapiens; identical to SEQ ID NO: 380307

SEQ ID NO: 697832 - RNA, 64 nt, Homo Sapiens; identical to SEQ ID NO: 380308

SEQ ID NO: 697833 - RNA, 64 nt, Homo Sapiens; identical to SEQ ID NO: 380309

SEQ ID NO: 697834 - RNA, 64 nt, Homo Sapiens; identical to SEQ ID NO: 380310

SEQ ID NO: 697835 - RNA, 64 nt, Homo Sapiens; identical to SEQ ID NO: 380311

SEQ ID NO: 697836 - RNA, 64 nt, Homo Sapiens; identical to SEQ ID NO: 110917

SEQ ID NO: 697837 - RNA, 64 nt, Homo Sapiens; identical to SEQ ID NO: 110918

SEQ ID NO: 697838 - RNA, 64 nt, Homo Sapiens; identical to SEQ ID NO: 110919

SEQ ID NO: 697839 - RNA, 64 nt, Homo Sapiens; identical to SEQ ID NO: 110920

SEQ ID NO: 697840 - RNA, 64 nt, Homo Sapiens; identical to SEQ ID NO: 110921

SEQ ID NO: 697841 - RNA, 64 nt, Homo Sapiens; identical to SEQ ID NO: 110922

SEQ ID NO: 697842 - RNA, 64 nt, Homo Sapiens; identical to SEQ ID NO: 110923

SEQ ID NO: 697843 - RNA, 64 nt, Homo Sapiens; identical to SEQ ID NO: 110924

SEQ ID NO: 697844 - RNA, 64 nt, Homo Sapiens; identical to SEQ ID NO: 110925

SEQ ID NO: 697845 - RNA, 64 nt, Homo Sapiens; identical to SEQ ID NO: 110926

SEQ ID NO: 697846 - RNA, 64 nt, Homo Sapiens; identical to SEQ ID NO: 110927

SEQ ID NO: 697847 - RNA, 64 nt, Homo Sapiens; identical to SEQ ID NO: 110928

SEQ ID NO: 697848 - RNA, 61 nt, Homo Sapiens; identical to SEQ ID NO: 110929

SEQ ID NO: 697849 - RNA, 64 nt, Homo Sapiens; identical to SEQ ID NO: 110930

SEQ ID NO: 697850 - RNA, 64 nt, Homo Sapiens; identical to SEQ ID NO: 110931

SEQ ID NO: 697851 - RNA, 64 nt, Homo Sapiens; identical to SEQ ID NO: 110932

SEQ ID NO: 697852 - RNA, 64 nt, Homo Sapiens; identical to SEQ ID NO: 110933

SEQ ID NO: 697853 - RNA, 64 nt, Homo Sapiens; identical to SEQ ID NO: 110934

SEQ ID NO: 697854 - RNA, 64 nt, Homo Sapiens; identical to SEQ ID NO: 110935

SEQ ID NO: 697855 - RNA, 64 nt, Homo Sapiens; identical to SEQ ID NO: 110936

SEQ ID NO: 697856 - RNA, 64 nt, Homo Sapiens; identical to SEQ ID NO: 110937

SEQ ID NO: 697857 - RNA, 64 nt, Homo Sapiens; identical to SEQ ID NO: 110938

SEQ ID NO: 697858 - RNA, 64 nt, Homo Sapiens; identical to SEQ ID NO: 110939

SEQ ID NO: 697859 - RNA, 64 nt, Homo Sapiens; identical to SEQ ID NO: 110940

SEQ ID NO: 697860 - RNA, 64 nt, Homo Sapiens; identical to SEQ ID NO: 110941

SEQ ID NO: 697861 - RNA, 64 nt, Homo Sapiens; identical to SEQ ID NO: 110942

SEQ ID NO: 697862 - RNA, 64 nt, Homo Sapiens; identical to SEQ ID NO: 110943

SEQ ID NO: 697863 - RNA, 64 nt, Homo Sapiens; identical to SEQ ID NO: 110944

SEQ ID NO: 697864 - RNA, 64 nt, Homo Sapiens; identical to SEQ ID NO: 110945

SEQ ID NO: 697865 - RNA, 64 nt, Homo Sapiens; identical to SEQ ID NO: 110946

SEQ ID NO: 697866 - RNA, 64 nt, Homo Sapiens; identical to SEQ ID NO: 110947

SEQ ID NO: 697867 - RNA, 64 nt, Homo Sapiens; identical to SEQ ID NO: 110948

SEQ ID NO: 697868 - RNA, 64 nt, Homo Sapiens; identical to SEQ ID NO: 110949

SEQ ID NO: 697869 - RNA, 64 nt, Homo Sapiens; identical to SEQ ID NO: 110950

SEQ ID NO: 697870 - RNA, 64 nt, Homo Sapiens; identical to SEQ ID NO: 110951

SEQ ID NO: 697871 - RNA, 64 nt, Homo Sapiens; identical to SEQ ID NO: 110952

SEQ ID NO: 697872 - RNA, 64 nt, Homo Sapiens; identical to SEQ ID NO: 110953

SEQ ID NO: 697873 - RNA, 64 nt, Homo Sapiens; identical to SEQ ID NO: 110954

SEQ ID NO: 697874 - RNA, 64 nt, Homo Sapiens; identical to SEQ ID NO: 110955

SEQ ID NO: 697875 - RNA, 64 nt, Homo Sapiens; identical to SEQ ID NO: 110956

SEQ ID NO: 697876 - RNA, 64 nt, Homo Sapiens; identical to SEQ ID NO: 110957

SEQ ID NO: 697877 - RNA, 64 nt, Homo Sapiens; identical to SEQ ID NO: 110958

SEQ ID NO: 697878 - RNA, 64 nt, Homo Sapiens; identical to SEQ ID NO: 110959

SEQ ID NO: 697879 - RNA, 64 nt, Homo Sapiens; identical to SEQ ID NO: 110960

SEQ ID NO: 697880 - RNA, 64 nt, Homo Sapiens; identical to SEQ ID NO: 110961

SEQ ID NO: 697881 - RNA, 64 nt, Homo Sapiens; identical to SEQ ID NO: 110962

SEQ ID NO: 697882 - RNA, 64 nt, Homo Sapiens; identical to SEQ ID NO: 110963

SEQ ID NO: 697883 - RNA, 64 nt, Homo Sapiens; identical to SEQ ID NO: 110964

SEQ ID NO: 697884 - RNA, 64 nt, Homo Sapiens; identical to SEQ ID NO: 110965

SEQ ID NO: 697885 - RNA, 64 nt, Homo Sapiens; identical to SEQ ID NO: 110966

SEQ ID NO: 697886 - RNA, 64 nt, Homo Sapiens; identical to SEQ ID NO: 110967

SEQ ID NO: 697887 - RNA, 64 nt, Homo Sapiens; identical to SEQ ID NO: 110968

SEQ ID NO: 697888 - RNA, 64 nt, Homo Sapiens; identical to SEQ ID NO: 110969

SEQ ID NO: 697889 - RNA, 64 nt, Homo Sapiens; identical to SEQ ID NO: 110970

SEQ ID NO: 697890 - RNA, 64 nt, Homo Sapiens; identical to SEQ ID NO: 110971

SEQ ID NO: 697891 - RNA, 64 nt, Homo Sapiens; identical to SEQ ID NO: 110972

SEQ ID NO: 697892 - RNA, 64 nt, Homo Sapiens; identical to SEQ ID NO: 110973

SEQ ID NO: 697893 - RNA, 64 nt, Homo Sapiens; identical to SEQ ID NO: 110974

SEQ ID NO: 697894 - RNA, 64 nt, Homo Sapiens; identical to SEQ ID NO: 110975

SEQ ID NO: 697895 - RNA, 64 nt, Homo Sapiens; identical to SEQ ID NO: 110976

SEQ ID NO: 697896 - RNA, 64 nt, Homo Sapiens; identical to SEQ ID NO: 110977

SEQ ID NO: 697897 - RNA, 64 nt, Homo Sapiens; identical to SEQ ID NO: 110978

SEQ ID NO: 697898 - RNA, 64 nt, Homo Sapiens; identical to SEQ ID NO: 110979

SEQ ID NO: 697899 - RNA, 64 nt, Homo Sapiens; identical to SEQ ID NO: 110980

SEQ ID NO: 697900 - RNA, 64 nt, Homo Sapiens; identical to SEQ ID NO: 432758

SEQ ID NO: 697901 - RNA, 64 nt, Homo Sapiens; identical to SEQ ID NO: 432759

SEQ ID NO: 697902 - RNA, 64 nt, Homo Sapiens; identical to SEQ ID NO: 432760

SEQ ID NO: 697903 - RNA, 64 nt, Homo Sapiens; identical to SEQ ID NO: 432761

SEQ ID NO: 697904 - RNA, 64 nt, Homo Sapiens
cuaagaaaacaaacaagcuacucucuaccuggucaucuucaaggaacuguuggucucacucugu

SEQ ID NO: 697905 - RNA, 64 nt, Homo Sapiens
uaguuaccaccagcuuggcuugcaggugaccagcaucuucaaucaacagguggaggaaaggggu

SEQ ID NO: 697906 - RNA, 64 nt, Homo Sapiens
uuauuuaauuuuguuucauuuccagaguauuuuuaucuucaauucuugucagauauccugugcu

SEQ ID NO: 697907 - RNA, 64 nt, Homo Sapiens
cuugcagcuguguuuuggaaauaguuuuaaugaaaucuucaauucaauaaauaugaugaccuug

SEQ ID NO: 697908 - RNA, 64 nt, Homo Sapiens
cucagaaugcuuucaaggguaaccagauuuaagaaucuucaaacaauacacuguuaccuuuuga

SEQ ID NO: 697909 - RNA, 64 nt, Homo Sapiens
ugcuucagaauuggaauguuuauauuauguagaaaucuucaaagguagcauuauuaaauagcaa

SEQ ID NO: 697910 - RNA, 64 nt, Homo Sapiens
cucaaagagccaaguuaaaaucugcuuuuuccugaucuucaaacagggguuuaaaccucuuucu

SEQ ID NO: 697911 - RNA, 64 nt, Homo Sapiens
ucuugccagggugggaaguaugguauuuacucaaaucuucaauuaguucucuuguaugauaauu

SEQ ID NO: 697912 - RNA, 64 nt, Homo Sapiens
uuuaaggugaaagcauuugacccagggugucuucaucuucaauuuggguuuaauguuauagaaa

SEQ ID NO: 697913 - RNA, 64 nt, Homo Sapiens
gaacuguaccauaauuauguugaagguagaagugaucuucaaagagauggccauuaacuuagca

SEQ ID NO: 697914 - RNA, 64 nt, Homo Sapiens
ugaguccuaaagaacauacuaaggcuccuggugcaucuucaaaaaggcagugcuugaaugagaa

SEQ ID NO: 697915 - RNA, 61 nt, Homo Sapiens
uucuucagaagcucacugcuucucccaugucaucuucaaccaaggaggcuguuccugcuaa

SEQ ID NO: 697916 - RNA, 64 nt, Homo Sapiens
aguaaauggggaaauuaacaggacuuucuucuucaucuucaaacucuucagaagcagcaacagg

SEQ ID NO: 697917 - RNA, 64 nt, Homo Sapiens
ucuucuucacuucuuccuuguaauuauacuuaagaucuucaauuucuucaaaaaaugaaggauc

SEQ ID NO: 697918 - RNA, 64 nt, Homo Sapiens
gaucugaauuuggagaggacauggggaagaaucaaucuucaacagauaaucuuuaaguacagac

SEQ ID NO: 697919 - RNA, 64 nt, Homo Sapiens
cagcuauacuaaaauaaaacuuuauaugcuaauuaucuucaagggucuuucuaaaauaaaaggg

SEQ ID NO: 697920 - RNA, 64 nt, Homo Sapiens
gguacuacaacuaauaggugguccagaaaacaugaucuucaaugagaccuuaauggaauaaugg

SEQ ID NO: 697921 - RNA, 64 nt, Homo Sapiens
aguaggaguuguuucaaguugcucaaaaugccauaucuucaaccaagucaguauacuuuuggau

SEQ ID NO: 697922 - RNA, 64 nt, Homo Sapiens
aggaggaggacgaaggccuagacucagcugaaggaucuucaaagcaggaugaagaccuagacuu

SEQ ID NO: 697923 - RNA, 64 nt, Homo Sapiens
uagacuuaccugaaggccuagacucagcugaaggaucuucaaagcaggaugaagaccuagacuu

SEQ ID NO: 697924 - RNA, 64 nt, Homo Sapiens
caaagcaggaugaagaccuagacuuaccugaaggaucuucaaagcagaaugaagaccuaggcuu

SEQ ID NO: 697925 - RNA, 64 nt, Homo Sapiens
caaagcagaaugaagaccuaggcuuaccugaaggaucuucaaagcaggaugaagaccuagacuu

SEQ ID NO: 697926 - RNA, 64 nt, Homo Sapiens; identical to SEQ ID NO: 172497

SEQ ID NO: 697927 - RNA, 64 nt, Homo Sapiens; identical to SEQ ID NO: 172498

SEQ ID NO: 697928 - RNA, 64 nt, Homo Sapiens
cuuaauaccaauuucucugaguuucuugaaaugucuuuaaaacagacauuuuucucaccaaaca

SEQ ID NO: 697929 - RNA, 64 nt, Homo Sapiens
uguauacauuuuaggaaauguuacuuuuguuaaucuuuaaaaaauacaccuaaugaaagacauu

SEQ ID NO: 697930 - RNA, 64 nt, Homo Sapiens
gaucugcaauucaguucaacacaaguuuguugagcuuuaaaauguauuugaaguaauauuuaaa

SEQ ID NO: 697931 - RNA, 64 nt, Homo Sapiens
cauguacaguguuacauuauauauguauugugaacuuuaaaagacuauuuugauaaauuuauaa

SEQ ID NO: 697932 - RNA, 64 nt, Homo Sapiens
gagccaauuugaguuaguuuugcauccuggggggcuuuaaaauacagcaugcagugaaagauca

SEQ ID NO: 697933 - RNA, 64 nt, Homo Sapiens
gaaugucagucagucucuguaguuaaaacuuuuucuuuaaaauucaauuaagguacuucucccu

SEQ ID NO: 697934 - RNA, 64 nt, Homo Sapiens
gaaugucagucagucucuguaguuaaaacuuuuucuuuaaaauucaauuaaguuacaccagaau

SEQ ID NO: 697935 - RNA, 52 nt, Homo Sapiens
cuacaaaggagcacaaaugagccuuuaaaaaccaauucugagacugaacuuu

SEQ ID NO: 697936 - RNA, 64 nt, Homo Sapiens
aagggacugcaauuauucaguauuuuuuucuuuccuuuaaaaaaauauaucugaaguuucuugu

SEQ ID NO: 697937 - RNA, 64 nt, Homo Sapiens
aggaguugugggggaaggguuaauggguuaaauccuuuaaaacaagauugaaaaaugggcuucc

SEQ ID NO: 697938 - RNA, 64 nt, Homo Sapiens
gauauuuaguucaguggugcgacugguuugggugcuuuaaaauacuugguuuccagagggucug

SEQ ID NO: 697939 - RNA, 64 nt, Homo Sapiens
ucaauguuuggaucaaaacaauauuguguacaaccuuuaaaacauuauauguucuuuuuaacaa

SEQ ID NO: 697940 - RNA, 64 nt, Homo Sapiens
cucagauugcuugcuuacaguaaaaagcuagcaucuuuaaaaauuguccaauuucauuucagaa

SEQ ID NO: 697941 - RNA, 64 nt, Homo Sapiens
cacagccuucugccucuguacacaacauuaauuccuuuaaaauaacuguguaaaguuucuaauu

SEQ ID NO: 697942 - RNA, 64 nt, Homo Sapiens
acucacugucccaguggugguucuaggauauacacuuuaaaagauaaccaaugaugguguuugc

SEQ ID NO: 697943 - RNA, 64 nt, Homo Sapiens
uuuaauuuaccagucuuuaaauuuaguguuaguacuuuaaaauuuuuucuuucacuguacuuaa

SEQ ID NO: 697944 - RNA, 64 nt, Homo Sapiens
guauguacugguuacaucaaucaucuuugucauucuuuaaaaguuucauagacuauuuccuuuu

SEQ ID NO: 697945 - RNA, 64 nt, Homo Sapiens
uacauaaguggaacauuuaauguaaaugguucgucuuuaaaaugggaggcaaacugcacaagcu

SEQ ID NO: 697946 - RNA, 64 nt, Homo Sapiens
acaagaccacuuguugaaaucaagaaguguugaacuuuaaaaagacagccaggagcuaauuguu

SEQ ID NO: 697947 - RNA, 64 nt, Homo Sapiens
gcaugaaaccaccuuuaauuauauaaaauuguggcuuuaaaaaugguuucuacagcaacccuag

SEQ ID NO: 697948 - RNA, 64 nt, Homo Sapiens
uuacaaauuaaaaaaacauuuuuuucuugguagucuuuaaaaauuaggggauugaaaggaucca

SEQ ID NO: 697949 - RNA, 64 nt, Homo Sapiens
aacauuuugcauguguaaagcuucaugaaguucucuuuaaaaaauaccaaagcuuguuuauuuc

SEQ ID NO: 697950 - RNA, 64 nt, Homo Sapiens
uuauucuuaauaauuauuaaucccuucaaugaaacuuuaaaaaaacugaauuuuuauacauggc

SEQ ID NO: 697951 - RNA, 64 nt, Homo Sapiens
ugugguuccagcucaacuuuuaauauauugucuccuuuaaaacuaucaugguuauaauucuauu

SEQ ID NO: 697952 - RNA, 64 nt, Homo Sapiens
acuucaguuuugccaagugcaaugguguugccuucuuuaaaaaaugccguuuucuuacacuacc

SEQ ID NO: 697953 - RNA, 64 nt, Homo Sapiens
ugagauucaagugaauggaaggaaaaccacaugccuuuaaaacuaaacuguaauaauuaccugg

SEQ ID NO: 697954 - RNA, 64 nt, Homo Sapiens
cuaaauuuugguaccauaccaacuggaauuuaggcuuuaaaaauaauguuucaaggccaggugu

SEQ ID NO: 697955 - RNA, 64 nt, Homo Sapiens
auuaugcuaaguuaaaauacaguuuaguuauuugcuuuaaaauaaacucuucuuuuuuucuuua

SEQ ID NO: 697956 - RNA, 64 nt, Homo Sapiens
aacugaaauuugcugcugauauguugaguuuguucuuuaaaaaauagcucauauaucucaucuu

SEQ ID NO: 697957 - RNA, 64 nt, Homo Sapiens
uagugcuuucugauuacucgcauucuguuucuugcuuuaaaagaagaguaaagacaagaguguu

SEQ ID NO: 697958 - RNA, 64 nt, Homo Sapiens
auaaaucuauuuucuucagacuucugcaauaguucuuuaaaaucacaacaguuagcaagcugac

SEQ ID NO: 697959 - RNA, 64 nt, Homo Sapiens
auacuguauaguaaaaguuggucuaauaguagaacuuuaaaauuuuuucuuauugugaggaauc

SEQ ID NO: 697960 - RNA, 64 nt, Homo Sapiens
gcauauggaugugaagugaaaauauuagccuuaacuuuaaaauuuggguguuugauaguguuua

SEQ ID NO: 697961 - RNA, 64 nt, Homo Sapiens
aaguuuauuuugugaugcccucuugguuuugauacuuuaaaaucuguggcacccguucuacaug

SEQ ID NO: 697962 - RNA, 64 nt, Homo Sapiens
uuuuuuaacagauagaauuuguauuuuuauuguacuuuaaaaagauuuauguaauagguauaua

SEQ ID NO: 697963 - RNA, 64 nt, Homo Sapiens
uuauuuagauucacuuaacaaacaaauuuuucugcuuuaaaaaugucuuauugucccaagugua

SEQ ID NO: 697964 - RNA, 64 nt, Homo Sapiens
agauuuaauauuacagauaaaauguaaacuguuucuuuaaaauuggggcuucaacuuuggaauu

SEQ ID NO: 697965 - RNA, 64 nt, Homo Sapiens
uaucucauauaucucgucuuauguugaguuuguucuuuaaaaaaaacugaaauuugcugcugau

SEQ ID NO: 697966 - RNA, 64 nt, Homo Sapiens
aacucuucuuuuuuucuuuaaguuuaguuauuugcuuuaaaauaauugugcuaaguuaaaauac

SEQ ID NO: 697967 - RNA, 64 nt, Homo Sapiens
aauguuucaaggccagguguaacuggaauuuaggcuuuaaaaaucuaaauuuugguaccauacc

SEQ ID NO: 697968 - RNA, 64 nt, Homo Sapiens
cuuucccagaaguugguucccagauauuuuucuucuuuaaaaauucuaguuuguauuuuucucu

SEQ ID NO: 697969 - RNA, 64 nt, Homo Sapiens
acagggucuaaguauuuuaaaaaaaaaauuguagcuuuaaaauaucuuugcaacugauuuugca

SEQ ID NO: 697970 - RNA, 64 nt, Homo Sapiens
ugcuggcaccugcuauacuggaguauugcuaugucuuuaaaaaauuuuuuuuauuauauuuuau

SEQ ID NO: 697971 - RNA, 64 nt, Homo Sapiens
guucuuuuauaaauguaauaaggaauaucuugcucuuuaaaauuuauuaggauuuuuaugagua

SEQ ID NO: 697972 - RNA, 64 nt, Homo Sapiens
aacuaacaaacacccaaacuguuuggauugauugcuuuaaaaaacaaaccuggcucuuaccuuu

SEQ ID NO: 697973 - RNA, 64 nt, Homo Sapiens
caaauggggcauucaaguugugagcucagaauuacuuuaaaaggagguaacagccagccauuac

SEQ ID NO: 697974 - RNA, 64 nt, Homo Sapiens
ugcauuuuacuuguuuaugauggcauaaccauugcuuuaaaauguuuagacaguagaauauuga

SEQ ID NO: 697975 - RNA, 64 nt, Homo Sapiens
uugccuuuugcauaagccucuuuauaacauguaucuuuaaaacaauuaagucuuuaggaaugug

SEQ ID NO: 697976 - RNA, 64 nt, Homo Sapiens
aaaauuuuaaaacuauuuuuauauuuuuuuaaaucuuuaaaaauuuuaauuacugugauauuga

SEQ ID NO: 697977 - RNA, 64 nt, Homo Sapiens
aaguacauuuuaugucguuuaauauaauuauuuacuuuaaaaauuguacuucagaacaucagau

SEQ ID NO: 697978 - RNA, 64 nt, Homo Sapiens
ccaucuuaaaugacagugaauugacccauguucccuuuaaaauuaaaaaaaagaagagccuugu

SEQ ID NO: 697979 - RNA, 64 nt, Homo Sapiens
gaaccuuaaccucucuaagccacagcuucuucaucuuuaaaauaaggauaauaaucauucuuuc

SEQ ID NO: 697980 - RNA, 64 nt, Homo Sapiens
auauauugaaauaaagaauuauguaaaagccauucuuuaaaauauuuauagcauaaauauaugu

SEQ ID NO: 697981 - RNA, 64 nt, Homo Sapiens
uuguuagcaugcugcuugguuuucuuacuuagugcuuuaaaauguuuuuuuuuauguuuaagag

SEQ ID NO: 697982 - RNA, 64 nt, Homo Sapiens
aaaaaaaaaguagauagugccucuuuaaaaaacccuuuaaaagauugugugcauuuuuuucucc

SEQ ID NO: 697983 - RNA, 64 nt, Homo Sapiens
cccuuuaaaagaaaaaaaaaauuuuuuucucccucuuuaaaaaacuauucacugcuuugugugc

SEQ ID NO: 697984 - RNA, 64 nt, Homo Sapiens
guuguaaguacaguuggcaagaaaguaucaauugcuuuaaaacuauuaagcuugagauuguucu

SEQ ID NO: 697985 - RNA, 64 nt, Homo Sapiens
augcuauuuccaguuaaugcaucuuugauuaagacuuuaaaaaauaguuguuuuauccauuauc

SEQ ID NO: 697986 - RNA, 64 nt, Homo Sapiens
aaugguuuuucuccugaaauaaccugaugguuaucuuuaaaauugagugugcuaggauaccuga

SEQ ID NO: 697987 - RNA, 64 nt, Homo Sapiens
guuuuuauuugcauggcuguugaaugaccucugacuuuaaaaaaacagaaauguucuacaucuc

SEQ ID NO: 697988 - RNA, 64 nt, Homo Sapiens
uuuuagaacuuuuuuaaaauagcaagaccccauccuuuaaaaaacacuccagccugggcaauau

SEQ ID NO: 697989 - RNA, 64 nt, Homo Sapiens
aaguuucauucauauuuaucuuucugucauuugacuuuaaaaggauaaugcacagggcuugagc

SEQ ID NO: 697990 - RNA, 64 nt, Homo Sapiens
augcacagggcuugagcuuugaaauguucucagacuuuaaaauaagucccaucuccacuauuua

SEQ ID NO: 697991 - RNA, 64 nt, Homo Sapiens
auaaucauguuugaauuguuaauacuuucaaggacuuuaaaaaauccuuuucucugagaguuuu

SEQ ID NO: 697992 - RNA, 64 nt, Homo Sapiens
uucuuuaccuuuuccuugagcccugauugcugcacuuuaaaaaaaacacauuagucacaagaau

SEQ ID NO: 697993 - RNA, 64 nt, Homo Sapiens
auguuguacgaaauuuuacuauuugaauuugaaacuuuaaaaaaaauaauuaaacauuuggaac

SEQ ID NO: 697994 - RNA, 64 nt, Homo Sapiens
cauuguauggauaguaaaaucuauuuaacuugagcuuuaaaaauaguaccaaaugcuuuaaaaa

SEQ ID NO: 697995 - RNA, 64 nt, Homo Sapiens
uauuuaacuugagcuuuaaaaguaguaccaaaugcuuuaaaaacucaaaaacuguauugaugac

SEQ ID NO: 697996 - RNA, 64 nt, Homo Sapiens
uuuuaaugcauucuuuugaauuaaacaaaaaauucuuuaaaauaguuuauauuuuuuucaccuu

SEQ ID NO: 697997 - RNA, 64 nt, Homo Sapiens
ucguuuuugguuuagauuauguaguuuguucuugcuuuaaaauuacuuacaaaaacuugcagca

SEQ ID NO: 697998 - RNA, 64 nt, Homo Sapiens
uucugaguugaccaauaaauaaaaauaccacuuucuuuaaaaaagccuagggaauugaagcucu

SEQ ID NO: 697999 - RNA, 64 nt, Homo Sapiens
aaaaaagaaaagaaaaagcagcauccuuauauuucuuuaaaauacauagaaauaaaguuaguaa

SEQ ID NO: 698000 - RNA, 64 nt, Homo Sapiens
aaaauaauaguggcccugaaggaauaaauuccagcuuuaaaaaccaagucugaggaaauauuug

SEQ ID NO: 698001 - RNA, 64 nt, Homo Sapiens
gaauuauuguauuuaaaaaaaaacuaauacuuaucuuuaaaauaguaaauaggauuuuaaacag

SEQ ID NO: 698002 - RNA, 64 nt, Homo Sapiens
cagaucaaauacuaauaaacaauuagaaaucuuacuuuaaaaaacuuauaacucacuugucuuc

SEQ ID NO: 698003 - RNA, 64 nt, Homo Sapiens
ggcucccaucaugccauuuuuuguucauuuuaaucuuuaaaaaauaaaaauuaggcauauuaau

SEQ ID NO: 698004 - RNA, 64 nt, Homo Sapiens
aguuuauuuauaaauaaaacaauuuagauacaagcuuuaaaaccauagauguugaaaauacacg

SEQ ID NO: 698005 - RNA, 64 nt, Homo Sapiens
acaacacauaaggaaucugaccccugcaaauugucuuuaaaacauuuucaguccuucucccaac

SEQ ID NO: 698006 - RNA, 64 nt, Homo Sapiens
ugugcucuuuuucauauuuuuuuugcauggagggcuuuaaaauuaagccaauguauuaauuuuu

SEQ ID NO: 698007 - RNA, 64 nt, Homo Sapiens
agaaauauaaccuuuuaagcuguauguuuuuauacuuuaaaauaagauagguuuagccuuuaag

SEQ ID NO: 698008 - RNA, 64 nt, Homo Sapiens
uuuaauggauugcaccucugaguuguuuuaccuacuuuaaaaguaagcacacuaaccccucgga

SEQ ID NO: 698009 - RNA, 64 nt, Homo Sapiens
caaaacgaaagugcuucucauccaaccauccaaccuuuaaaaaaugguguuuaacuaagggcca

SEQ ID NO: 698010 - RNA, 64 nt, Homo Sapiens
cauauauuauuugcagugcaguauagaauaggcacuuuaaaacacucuuuccccgcaccccagc

SEQ ID NO: 698011 - RNA, 64 nt, Homo Sapiens
ucuauaauuuccauuuacuuaagacuuaaugagacuuuaaaagcauuuuuuaaccuccuaagua

SEQ ID NO: 698012 - RNA, 64 nt, Homo Sapiens
gaacugaugcgacuuguuuugcugcuugguagcacuuuaaaaaauuuuuugauuaaugaagaaa

SEQ ID NO: 698013 - RNA, 64 nt, Homo Sapiens
gcacuccagccugggugacagagcaauacccugucuuuaaaaauaaaagcuauuacuuggcaaa

SEQ ID NO: 698014 - RNA, 64 nt, Homo Sapiens
uauuauucccauuuuacaaauaauguaacugaggcuuuaaaaagccaagacaucugcccaaagu

SEQ ID NO: 698015 - RNA, 64 nt, Homo Sapiens
gcuugaagccauuuauagacgagcuucaaagcaacuuuaaaagauucuucuguagaaguaugag

SEQ ID NO: 698016 - RNA, 64 nt, Homo Sapiens
uauacauuuuguuucucucauaagaccauauucccuuuaaaagaguaagcuucaauaugugaau

SEQ ID NO: 698017 - RNA, 64 nt, Homo Sapiens
acugaguuaauaauguaaauaaguguguggccuucuuuaaaauagcuggcuaacauaggaggca

SEQ ID NO: 698018 - RNA, 64 nt, Homo Sapiens
gcucagguagccaaggcccuaacaauacuauauucuuuaaaaguugcaccaaagcaucggcaaa

SEQ ID NO: 698019 - RNA, 64 nt, Homo Sapiens
auauauauuuucaacuaguaacugguaaacaugccuuuaaaaauagcagaaauagaaauacaag

SEQ ID NO: 698020 - RNA, 64 nt, Homo Sapiens
aaaggauucaaacgcaacucaaaucugugcuggacuuuaaaaaaacaauucaggaccaaauuuu

SEQ ID NO: 698021 - RNA, 64 nt, Homo Sapiens
aaaguuuuaaacgaaauacugcucuguccagaggcuuuaaaacuggugcaauuacagcaaaaag

SEQ ID NO: 698022 - RNA, 64 nt, Homo Sapiens
caagagaauuugguuauaaauauuuuucugcauucuuuaaaagaugcuccuucuuagcaaucaa

SEQ ID NO: 698023 - RNA, 64 nt, Homo Sapiens
gcuuuuuccagugugcuccucucauucuucaauacuuuaaaaugauaggaaaaaagaaauacgu

SEQ ID NO: 698024 - RNA, 64 nt, Homo Sapiens
agaaauaaauauacaauuaccauuaaggaguguucuuuaaaaagcaaguuuguauauugaauua

SEQ ID NO: 698025 - RNA, 64 nt, Homo Sapiens
uuaaggugacaaagcacaugccuaugcuaggugucuuuaaaaaaggacacuagguugccacaga

SEQ ID NO: 698026 - RNA, 64 nt, Homo Sapiens
aacuaaaauuguuagguaaguuauuuauauauaacuuuaaaagaaguagaagauuuuuuggaga

SEQ ID NO: 698027 - RNA, 64 nt, Homo Sapiens
uguugauugugcuuuuauguaauaaaaugcaguacuuuaaaacauuuagauugugugugaacuu

SEQ ID NO: 698028 - RNA, 64 nt, Homo Sapiens
ccaguucaaaguuugcuuaguuacaacaaagcaccuuuaaaaaaaauacauuuuaaaaaaacau

SEQ ID NO: 698029 - RNA, 64 nt, Homo Sapiens
auacaccaaggaaacuggauccagaauuccuaaacuuuaaaaugguacugucugcggaguggag

SEQ ID NO: 698030 - RNA, 64 nt, Homo Sapiens
aaaaugcuaauuauuucccugauuaggaaaguuucuuuaaaaaacacguaauuuugccuagugc

SEQ ID NO: 698031 - RNA, 64 nt, Homo Sapiens
auuaccaagaaaauauugaguuuaccugauuaaacuuuaaaaguuaauuguagauuuaaauugu

SEQ ID NO: 698032 - RNA, 64 nt, Homo Sapiens
auuuuguuuaauauugguugaacaagaaaucugacuuuaaaagauuauuaaggagaauauuccu

SEQ ID NO: 698033 - RNA, 64 nt, Homo Sapiens
uuaaaaaaauuggaaacgguuuucuuagccccagcuuuaaaagcuagagaucucagagaaauag

SEQ ID NO: 698034 - RNA, 64 nt, Homo Sapiens
aaaaucacugccucauucuuacauauauauaacccuuuaaaaaaauguuacacugaucuaaagg

SEQ ID NO: 698035 - RNA, 64 nt, Homo Sapiens
aacaaacaaacaaacaaaaauguaugacacccagcuuuaaaacaauacuuuaugcucucugaaa

SEQ ID NO: 698036 - RNA, 64 nt, Homo Sapiens
cgccuuguaaguucuggggaauuggaauaucacacuuuaaaaacuaaagacgugccaaugaauu

SEQ ID NO: 698037 - RNA, 64 nt, Homo Sapiens
uuucauacuacuauuguuuuuagaaguuugaagacuuuaaaacaguguugauaaaaacuaauuu

SEQ ID NO: 698038 - RNA, 64 nt, Homo Sapiens
uuccagugucuucgccacauaaaauagccauuuucuuuaaaauaguuuuggacuaacgaagcug

SEQ ID NO: 698039 - RNA, 64 nt, Homo Sapiens
cucauuuuaacaaauaugaccgagucuaguuuuucuuuaaaaggauaguuuaugaguaaucuuu

SEQ ID NO: 698040 - RNA, 64 nt, Homo Sapiens
uaguuuuucuuuaaaaggauaguuuaugaguaaucuuuaaaaccauuuccauaccaucuguaua

SEQ ID NO: 698041 - RNA, 64 nt, Homo Sapiens
uauuaccacauaguauuuuuauguuacccaucaucuuuaaaaacauuauaggcugggcauggug

SEQ ID NO: 698042 - RNA, 64 nt, Homo Sapiens
guugauagaaaauauuaguuucagaauuacccuccuuuaaaaaauaagagacuauuuguuuucu

SEQ ID NO: 698043 - RNA, 64 nt, Homo Sapiens
uuuaauuucuaugaauaaaagaaauuuuuaaaaacuuuaaaauuuuaaauauuagucaaaauac

SEQ ID NO: 698044 - RNA, 64 nt, Homo Sapiens
aacucucuccagaaaauggauggagauaacuugucuuuaaaacuguaggccagccuuagccacu

SEQ ID NO: 698045 - RNA, 64 nt, Homo Sapiens
ucuuccaaagagauggcaauaugcugggcaucuacuuuaaaacaaaguugucugauuuuugcaa

SEQ ID NO: 698046 - RNA, 64 nt, Homo Sapiens
aaauuuauauagcucucauguauugaaggugcuacuuuaaaaacuguguuaauguacuugcaaa

SEQ ID NO: 698047 - RNA, 64 nt, Homo Sapiens
ccuccugccuuuaguucuaaaugguucugaauagcuuuaaaagaugaauaagaaaaaagaucaa

SEQ ID NO: 698048 - RNA, 64 nt, Homo Sapiens
auugugacuguacuuaaugccacugaacuguacacuuuaaaauggaaaauuuauauguauuuuu

SEQ ID NO: 698049 - RNA, 64 nt, Homo Sapiens
gacugauuguauauaguaagaaaagaucaaaagacuuuaaaaccuaaaugacuuuugacauaca

SEQ ID NO: 698050 - RNA, 64 nt, Homo Sapiens
augaaaucagugggaagcagaacaacagaaggaacuuuaaaagcaacaagcaauuauguaccau

SEQ ID NO: 698051 - RNA, 64 nt, Homo Sapiens
agauauaccaaaaagucuuauaauaggaauuuaacuuuaaaaacccacuuauugauaccuuacc

SEQ ID NO: 698052 - RNA, 64 nt, Homo Sapiens
uaauaaacaagacacaacguuuuuauacaacauacuuuaaaauauuaaggaguuuucuuaauuu

SEQ ID NO: 698053 - RNA, 64 nt, Homo Sapiens
aacuuuaaagguucuuuuguuuugcauaguuuaucuuuaaaaacugaagcuucaguauaccaug

SEQ ID NO: 698054 - RNA, 64 nt, Homo Sapiens
uaucugaaaguaguagucaggauggauauugguucuuuaaaauaacguagcugcaguuguccac

SEQ ID NO: 698055 - RNA, 64 nt, Homo Sapiens
aguaacgugcugcucaaggacuuuaccauaaagccuuuaaaaccaaaaaugaaaagcaauacaa

SEQ ID NO: 698056 - RNA, 64 nt, Homo Sapiens
aucuuuaacaauugucuuaaguaacugcucagagcuuuaaaaguagcuaacaucuuuacguacu

SEQ ID NO: 698057 - RNA, 64 nt, Homo Sapiens
ggaaggucaagcaaagaacuuuuaacauagagaucuuuaaaaagcagaauaccuaagcugcuuc

SEQ ID NO: 698058 - RNA, 64 nt, Homo Sapiens
agauucuugcuucugauaugaauagugguaaaaucuuuaaaacuuaauaugaucaaaguuaagc

SEQ ID NO: 698059 - RNA, 64 nt, Homo Sapiens
aaacagaaagaaaaauauuuaagaguauauaucucuuuaaaaaacaagggugggagguuuuuag

SEQ ID NO: 698060 - RNA, 64 nt, Homo Sapiens
guauaaaaauuucugcuuuuuauuuuagugccuacuuuaaaacagugcccuagaugaccauuuu

SEQ ID NO: 698061 - RNA, 64 nt, Homo Sapiens
aaauuguccuuugauuuuuuccuguaauaaagcucuuuaaaaugaguguccuaaauauuaauau

SEQ ID NO: 698062 - RNA, 64 nt, Homo Sapiens
aguuacccaaaaucugauuaauauucaaguaacacuuuaaaaccugaaagacaguaugagaaaa

SEQ ID NO: 698063 - RNA, 64 nt, Homo Sapiens
aauaaaauuuaucuaauuuaaaauaaaaugauuacuuuaaaaauuuaucaguuuucaauagauu

SEQ ID NO: 698064 - RNA, 64 nt, Homo Sapiens
auguuauauuuaugcuaaaauaacccuagauauacuuuaaaauaaaaguauaaaacauuaaaaa

SEQ ID NO: 698065 - RNA, 64 nt, Homo Sapiens
aucuuuuuauuuuauaaggcuguuuguaauguuacuuuaaaauuugggagacacuaguaguaua

SEQ ID NO: 698066 - RNA, 64 nt, Homo Sapiens
caagcagugagaaauaagaccuuuagacauauuucuuuaaaauguauuagugguuuacaaugcg

SEQ ID NO: 698067 - RNA, 64 nt, Homo Sapiens
cuuccucuuucuuccuccuccugucauugucugccuuuaaaauccccuaccuauccugaauggu

SEQ ID NO: 698068 - RNA, 64 nt, Homo Sapiens
cuaccuauccugaauggucucuguguuuaucucccuuuaaaaccucucuccuuaguugaugaga

SEQ ID NO: 698069 - RNA, 64 nt, Homo Sapiens
aggucuuuuuuuuauauuuuaucuuuaaauaguucuuuaaaaauaaaguguuguuuucaaagcc

SEQ ID NO: 698070 - RNA, 64 nt, Homo Sapiens
augucuuuguaugucucaagccaagaaaauagcucuuuaaaagaaaauuaaccuuugugcaaua

SEQ ID NO: 698071 - RNA, 64 nt, Homo Sapiens
aaccuuugugcaauaccaagacuugccuggauugcuuuaaaauuguacuucuuuuugugagcuu

SEQ ID NO: 698072 - RNA, 64 nt, Homo Sapiens
caugugguuucuaugcaaaguauucgaauuuugucuuuaaaauuuucagaauaggauaauuagg

SEQ ID NO: 698073 - RNA, 64 nt, Homo Sapiens
ggaagaaacugcugagcuugcacugacugucgggcuuuaaaaagggcucgacuauagaaaacuc

SEQ ID NO: 698074 - RNA, 64 nt, Homo Sapiens
cuuugugcugggaacucuacaucuagcaauuucucuuuaaaaccauaucagagaugcauacaaa

SEQ ID NO: 698075 - RNA, 64 nt, Homo Sapiens
aaggauaugguagcauuuuauaguacuaguuuugcuuuaaaaugcuauguaaauauacaaaaaa

SEQ ID NO: 698076 - RNA, 64 nt, Homo Sapiens
aacuccauggcauaaauaguuguauuuuuguguacuuuaaaaucaacuuauaacugugagaugu

SEQ ID NO: 698077 - RNA, 64 nt, Homo Sapiens
ggaaauuccauacucagauaucagucugcuagaacuuuaaaaugaaggacaaauccuguuaaag

SEQ ID NO: 698078 - RNA, 64 nt, Homo Sapiens
cuguuccguuuuuuucccagcaagucguuauugccuuuaaaaauaaaugaaacaagccgucuua

SEQ ID NO: 698079 - RNA, 64 nt, Homo Sapiens
ucuguuagagcaaaauuaaaagcgaugucugaaccuuuaaaacacaguuauccucaaaaacauc

SEQ ID NO: 698080 - RNA, 64 nt, Homo Sapiens
uucguauguguguugcacuacugauguugagcaccuuuaaaaugguccagaauucuauuuuaac

SEQ ID NO: 698081 - RNA, 64 nt, Homo Sapiens
ggauuuuagagccucgggaagaugugaaacgguucuuuaaaaugaccacucuccacuccacgag

SEQ ID NO: 698082 - RNA, 64 nt, Homo Sapiens
gacccgcaacaaguauuggacuccaggguacaugcuuuaaaacccuaucugcugcaccuucacu

SEQ ID NO: 698083 - RNA, 64 nt, Homo Sapiens
gugcacuacaguuuuagcgggcagcauggaauuccuuuaaaaagagcccgaagucugcugcugu

SEQ ID NO: 698084 - RNA, 64 nt, Homo Sapiens
aguuugugucaugagaauguaagucuuuuuucuacuuuaaaauuuaguagguucacugaguaac

SEQ ID NO: 698085 - RNA, 64 nt, Homo Sapiens
guguuuuacuuuugaauguuacaaaaggaaauaacuuuaaaacuauucucaagagaaaauauuc

SEQ ID NO: 698086 - RNA, 64 nt, Homo Sapiens
uuauuguuugaagcgaguuaauauucucaguugucuuuaaaaaucaguuacucuaauuccaggu

SEQ ID NO: 698087 - RNA, 64 nt, Homo Sapiens
uuuuauuacugaacuagcaacuagccuuuuccaccuuuaaaaguugugccaagucauaaucaua

SEQ ID NO: 698088 - RNA, 64 nt, Homo Sapiens
ggcauuuucucuacacacucacccucuuccaguucuuuaaaaacguuuaugauauuaagaucaa

SEQ ID NO: 698089 - RNA, 64 nt, Homo Sapiens
guuuuuaaaacucucugaguacaacaaacuugaucuuuaaaaauugcaagagccacauuuacaa

SEQ ID NO: 698090 - RNA, 64 nt, Homo Sapiens
aucaaucuuugauaugaucaagcaagucuuucaacuuuaaaauuuguuuuguuccaaucaacuu

SEQ ID NO: 698091 - RNA, 64 nt, Homo Sapiens
uauauacauuuuagacaaaaccuaugccuauacacuuuaaaaugagugaucugauccauaguau

SEQ ID NO: 698092 - RNA, 64 nt, Homo Sapiens
uguaaugucaaaaaugacucuucauauuucuucccuuuaaaauacuuuuauaaaaaacccuuug

SEQ ID NO: 698093 - RNA, 64 nt, Homo Sapiens
uaaagccaugcuggaaaauaauaguuauuaaguucuuuaaaaugagcaugcaucuguuuauucu

SEQ ID NO: 698094 - RNA, 64 nt, Homo Sapiens
ugcuuuuaacagagucugaauuggcugcaggaaucuuuaaaagagggcauccucuuuuuccaac

SEQ ID NO: 698095 - RNA, 64 nt, Homo Sapiens
cuuaagcaaaagaaaaagauuacccaaaaacugucuuuaaaagagagagagagaaaaaaaaaau

SEQ ID NO: 698096 - RNA, 64 nt, Homo Sapiens
ucgguuccgaugaauucuuauccccugccccuuccuuuaaaaaacuuagugacaaaauagacaa

SEQ ID NO: 698097 - RNA, 64 nt, Homo Sapiens
aaaauagucuauauuuuaaccugcauaaaaaggucuuuaaaauauuguugaacacuugaagcca

SEQ ID NO: 698098 - RNA, 64 nt, Homo Sapiens
cccccuaguuugugagaaacaucucaauaaagugcuuuaaaaagauuguguuaccagaauauuu

SEQ ID NO: 698099 - RNA, 64 nt, Homo Sapiens
ugauuaccaccuucgaagcuauauauuuugcauacuuuaaaaucaccuaacuuggacugcuuga

SEQ ID NO: 698100 - RNA, 64 nt, Homo Sapiens
acagaaauugcuuuuaaaaaauaucuggaacuaucuuuaaaaaaacuuuauuaauaaucaugua

SEQ ID NO: 698101 - RNA, 64 nt, Homo Sapiens
guaaaauggaaagugaauuugaauuuuacaugcacuuuaaaauaaccuaccaaaaaauggaaaa

SEQ ID NO: 698102 - RNA, 64 nt, Homo Sapiens
aaauuacccuuugacuuuuauauaaguaauauaucuuuaaaagauucauacuucgggaauauuu

SEQ ID NO: 698103 - RNA, 64 nt, Homo Sapiens
uacaaaaauacguguuuguuucugcccccuuugccuuuaaaacucuuuuuaugucugucaucau

SEQ ID NO: 698104 - RNA, 64 nt, Homo Sapiens
uugauaccuggguccuauucuuagccuggcagagcuuuaaaaaauucucaaucuuagcuacaua

SEQ ID NO: 698105 - RNA, 64 nt, Homo Sapiens
uuuuuuauuuuuuaaagcaucagaaugauagugccuuuaaaaauucaacuucaacuugcauucu

SEQ ID NO: 698106 - RNA, 64 nt, Homo Sapiens
auggucaacuucaacuugcaguauacucaacugacuuuaaaacucauuguuggaccaugacaua

SEQ ID NO: 698107 - RNA, 64 nt, Homo Sapiens
guguuccuaaguagaaauaccaaaugugcacauucuuuaaaaguuuguaaauguuaaucuuucu

SEQ ID NO: 698108 - RNA, 64 nt, Homo Sapiens
ugcugauuaguuuucaaugucaguuacuuaaaugcuuuaaaaauccauguuauaaugccauuag

SEQ ID NO: 698109 - RNA, 64 nt, Homo Sapiens
cuaccugugcugaaauuugggggaaguuuagguccuuuaaaaaaacauauuaaucauugacuac

SEQ ID NO: 698110 - RNA, 64 nt, Homo Sapiens
uauuuaaaguagaaauuuaauuuguagauauaaccuuuaaaaauuuucucauuaagacaauguu

SEQ ID NO: 698111 - RNA, 64 nt, Homo Sapiens
acaaccuuggaaaaguuauuucccuuuguaauaccuuuaaaaauccagaguauuauauucauuu

SEQ ID NO: 698112 - RNA, 64 nt, Homo Sapiens
gaucuauucuucagauauucaaaaacauuuuuugcuuuaaaaugcauaucuuuaauuggguguu

SEQ ID NO: 698113 - RNA, 64 nt, Homo Sapiens
uaaaucuuaaaauugcugaauuuacccucauauucuuuaaaaaacuuaaagcauuaugaaugua

SEQ ID NO: 698114 - RNA, 64 nt, Homo Sapiens
cagcuucuuuauuuccuccuaauggaaacauuaucuuuaaaaguugcauauaggaaauauacau

SEQ ID NO: 698115 - RNA, 64 nt, Homo Sapiens
aaguauaguuaaaacauuuguucuacaaauuaaccuuuaaaaauauaauuacugcuaaaaauag

SEQ ID NO: 698116 - RNA, 64 nt, Homo Sapiens
aaacaucaaauaaaaauggaaaaaaugaucauggcuuuaaaaaaaaaacaaaaacacacacaca

SEQ ID NO: 698117 - RNA, 64 nt, Homo Sapiens
cuguuaccacaauuaugagauuuccaaaggguuacuuuaaaaauuuggguaucacguaaaauuu

SEQ ID NO: 698118 - RNA, 64 nt, Homo Sapiens
auacauaaaaauuucaucuuggguuaaaaaucagcuuuaaaaaauauaacccccuauuuucagg

SEQ ID NO: 698119 - RNA, 64 nt, Homo Sapiens
uuuuaaucaggcagaguuuuagguaaaaaguacacuuuaaaauaucaaugcuauuaacaguauc

SEQ ID NO: 698120 - RNA, 64 nt, Homo Sapiens
caggaucaucaaugcuauuaacuaaagcagccaucuuuaaaauccuuucccaaaaucaaaguag

SEQ ID NO: 698121 - RNA, 64 nt, Homo Sapiens
aaaccauucagauugaaauuuauuuugaaauuggcuuuaaaauagcuuaucuuugaaacaauau

SEQ ID NO: 698122 - RNA, 64 nt, Homo Sapiens
ggaaagugggauaagaaaucauucauuaauuacacuuuaaaauuaaucaauuuauaaaggggua

SEQ ID NO: 698123 - RNA, 64 nt, Homo Sapiens
auuuguauaaaacuggaagugguugguuucuuuccuuuaaaaaaaccucaaaugcaauacuuug

SEQ ID NO: 698124 - RNA, 64 nt, Homo Sapiens
agaaagaauaaaaaaaccuuaaaucaugggcucacuuuaaaaaagauaaucugggaaagacacc

SEQ ID NO: 698125 - RNA, 64 nt, Homo Sapiens
aauggcagcaaaggguaguuccccuacaaaaaaacuuuaaaaaaaaaacacaaaaaauaaaaaa

SEQ ID NO: 698126 - RNA, 64 nt, Homo Sapiens
auugcagugcuauuuuuucucaguguaaaauugacuuuaaaaauccauuuguaucuaaugugua

SEQ ID NO: 698127 - RNA, 64 nt, Homo Sapiens
cacguugauuuuuuacaaaucugacaaaguguaacuuuaaaaagugggaaaggggucaccgugu

SEQ ID NO: 698128 - RNA, 64 nt, Homo Sapiens
aaaaacagaauguuguacguuaguucccugaggucuuuaaaaacggguucccacaaccgaguuc

SEQ ID NO: 698129 - RNA, 64 nt, Homo Sapiens
ggauaccuuuuucuuauacuuucuccuaggaaaacuuuaaaacuuuaaaaaggcaaaccuacca

SEQ ID NO: 698130 - RNA, 64 nt, Homo Sapiens
uuuucuuauacuuucuccuaggaaaacuuuaaaacuuuaaaaaggcaaaccuaccaauaggaau

SEQ ID NO: 698131 - RNA, 64 nt, Homo Sapiens
uucgguggaagauacgaaaagggugugcaauuuccuuuaaaauuuacacgugggaaacauuugu

SEQ ID NO: 698132 - RNA, 64 nt, Homo Sapiens
aucauucaaaauguggagaauuuaauggcuaaaucuuuaaaagccaaugcaacccacccaauug

SEQ ID NO: 698133 - RNA, 64 nt, Homo Sapiens
uuuacauuuuguuucaaauaugaaagugucugaacuuuaaaaagcugguacuuuuaucugucuu

SEQ ID NO: 698134 - RNA, 64 nt, Homo Sapiens
gaauaauaauacaauauuuacaaacaaucucuuccuuuaaaaaguaauauuccacuccgcagug

SEQ ID NO: 698135 - RNA, 64 nt, Homo Sapiens
uacuaugguauauauuuugacucuuaaaaauuaucuuuaaaacuauuuuauugaauauaauggc

SEQ ID NO: 698136 - RNA, 64 nt, Homo Sapiens
auucacuuuuauuguauaauuguaaaugauaugucuuuaaaaugcugauacuuauuuauaacau

SEQ ID NO: 698137 - RNA, 64 nt, Homo Sapiens
aaacacauuugaauauuguguauuucauacuauucuuuaaaaguaaucuuauguccuuuccuac

SEQ ID NO: 698138 - RNA, 64 nt, Homo Sapiens
cuguuaacaugaaaauggcauuuuuccauaauagcuuuaaaauaauuuuuuaguaauuauuaca

SEQ ID NO: 698139 - RNA, 64 nt, Homo Sapiens
uacuuuuguuuuaaaaggcuaaaauguuugugugcuuuaaaauucuuaaugaauucacuggcau

SEQ ID NO: 698140 - RNA, 64 nt, Homo Sapiens
cacagccucaucauuagcaacuuuauauacacagcuuuaaaaaauuugcuuuaaacuguuucag

SEQ ID NO: 698141 - RNA, 64 nt, Homo Sapiens
gugggaggauuauaaauagagacuuuccuuaagacuuuaaaaauguauuuaaaacuauuuuuua

SEQ ID NO: 698142 - RNA, 64 nt, Homo Sapiens
uuuuuuauuaaauacuuugugauuuccuauuaagcuuuaaaauaaaucauuguguaaaacacca

SEQ ID NO: 698143 - RNA, 64 nt, Homo Sapiens
uauacggugcuaauuaguaaaauguuccaguuagcuuuaaaaggacaaucauuuauaaugaauc

SEQ ID NO: 698144 - RNA, 64 nt, Homo Sapiens
uuaaugauacuucugauguuauuuguaaaauguccuuuaaaaguauuuggucguaaugaaaaua

SEQ ID NO: 698145 - RNA, 64 nt, Homo Sapiens
aaaaaagaaucugcgguauuagcaguaguaccuucuuuaaaaaaauuacuuguuaacuucuuac

SEQ ID NO: 698146 - RNA, 64 nt, Homo Sapiens
uuuucacagauaaaaaauugaaguuuuguaagagcuuuaaaauaagcugauuuuuuaaaaauuu

SEQ ID NO: 698147 - RNA, 64 nt, Homo Sapiens
uuuugacagaucaucucauaacaaguucuucauucuuuaaaauggugugcuuuaguacauagcc

SEQ ID NO: 698148 - RNA, 64 nt, Homo Sapiens
aaauauuuuugguuucuguauauuaucaugucuucuuuaaaagucaugacuguuguuugcacua

SEQ ID NO: 698149 - RNA, 64 nt, Homo Sapiens
agcuucuagucuccauaaccuaagaaauccuuaccuuuaaaaaaacuuuuugcuuugcuuugga

SEQ ID NO: 698150 - RNA, 64 nt, Homo Sapiens
gaaggugacucacuuugcuuuugcuaaaucucaccuuuaaaaacaacugcuucuaauccuuccu

SEQ ID NO: 698151 - RNA, 64 nt, Homo Sapiens
guccauuguucuuugaaaguaaugucagcauucccuuuaaaaguaauuucauuuuguaaaguua

SEQ ID NO: 698152 - RNA, 64 nt, Homo Sapiens
aaaaaaaggaaacacucauauuaaguuaaugggccuuuaaaaaauaaggaugggaacauuuaaa

SEQ ID NO: 698153 - RNA, 64 nt, Homo Sapiens
uuaucaaaaaauucuuugucuaauauauuggagucuuuaaaaguguugaagaauaaaauauuaa

SEQ ID NO: 698154 - RNA, 64 nt, Homo Sapiens
uucuaguauuuucuuauuucacuuuuacaccuaucuuuaaaaggaauuuaaauuuuguuuauau

SEQ ID NO: 698155 - RNA, 64 nt, Homo Sapiens
acaggacagcgggaaaaaucgaugagcgccaccucuuuaaaaacucacuuacguuuguccuuuu

SEQ ID NO: 698156 - RNA, 64 nt, Homo Sapiens
auaugcucuuuuaaauguuugguuuauauauuuucuuuaaaaauccugggcuggcacauugacu

SEQ ID NO: 698157 - RNA, 64 nt, Homo Sapiens
aaaugugauuauuuauauuuauguugaaagcggacuuuaaaaaaaauaaugugcuguaacacag

SEQ ID NO: 698158 - RNA, 64 nt, Homo Sapiens
gcagcauugucaguacagaccagugguucucaaacuuuaaaaugccucagcaucacuugggagc

SEQ ID NO: 698159 - RNA, 64 nt, Homo Sapiens
aaaagccuguuacuguuuaugcuuuaaaacaguacuuuaaaagggaggaacuuuacacugacca

SEQ ID NO: 698160 - RNA, 64 nt, Homo Sapiens
guacuuuaaaaggaaaagccuuuacacugaccagcuuuaaaacaaaugcacagaccugaggaac

SEQ ID NO: 698161 - RNA, 64 nt, Homo Sapiens
uuggugaaauuccauuacagaauaaaguuaauaccuuuaaaaacaaugaugaauguuacagguu

SEQ ID NO: 698162 - RNA, 64 nt, Homo Sapiens
augaauguuacagguuaauaguuuuuauauacuccuuuaaaaugguuucugacccauuuugaca

SEQ ID NO: 698163 - RNA, 64 nt, Homo Sapiens
gcugugaaccugccaauccgcuguaacaacucugcuuuaaaacaaaaccaaacaaaacuuuaaa

SEQ ID NO: 698164 - RNA, 64 nt, Homo Sapiens
uaacaacucugcuuuaaaacaaaaccaaacaaaacuuuaaaaaaaaaugugugauccagcuuuc

SEQ ID NO: 698165 - RNA, 64 nt, Homo Sapiens
uuacucuucaguuaagccuuuggaaacagcucgacuuuaaaaagcuccaaaugcagcuuuaaaa

SEQ ID NO: 698166 - RNA, 64 nt, Homo Sapiens
gaaacagcucgacuuuaaaaagcuccaaaugcagcuuuaaaaaauuaaucugggccagaauuuc

SEQ ID NO: 698167 - RNA, 64 nt, Homo Sapiens
aaaaaaaaaaucagagaaaacaucugcuuuuugucuuuaaaauauaugcacauuauaaugguua

SEQ ID NO: 698168 - RNA, 64 nt, Homo Sapiens
aaaaaaaaaacuucauuggcgcaggggagaugaacuuuaaaaaacaugcuaucaguuuuuuggg

SEQ ID NO: 698169 - RNA, 64 nt, Homo Sapiens
ucucaauucaagcuggauuaacccaauuuuacuucuuuaaaaagcaacuucuuugaugaaugua

SEQ ID NO: 698170 - RNA, 64 nt, Homo Sapiens
aaucuuugauuugcacuguugaugacaaaucugacuuuaaaaaaagcacuugaaaaugggaagc

SEQ ID NO: 698171 - RNA, 64 nt, Homo Sapiens
guuuugaacuucccuuccuuaaaguacucuaaaccuuuaaaaaaaaaucugauuuaugcagcag

SEQ ID NO: 698172 - RNA, 64 nt, Homo Sapiens
uaaggcagggacagcagucagaaucgacauaaagcuuuaaaaacucaagguuuuuucaaccuac

SEQ ID NO: 698173 - RNA, 64 nt, Homo Sapiens
uuuugauucagcucauuaugaaaaacaucccaaacuuuaaaaugcgaaauuauugguuggugug

SEQ ID NO: 698174 - RNA, 64 nt, Homo Sapiens
agaaucgauaaaaguucaucuuuggacagaaagccuuuaaaaaaaaaaucacucccucuucccc

SEQ ID NO: 698175 - RNA, 64 nt, Homo Sapiens
auuaagugcuuuuuuuucaucacuugauuauuuucuuuaaaaucagcuauuacaggauauuuuu

SEQ ID NO: 698176 - RNA, 64 nt, Homo Sapiens
aaugugggagaugagucaagcauggauaccuguucuuuaaaaggaugaauugaagugguuggua

SEQ ID NO: 698177 - RNA, 64 nt, Homo Sapiens
aaacaacucugagaugaacaagcaucuaccacggcuuuaaaacaaaaaugcacauuuaaagaga

SEQ ID NO: 698178 - RNA, 64 nt, Homo Sapiens
cacacauacacacacaaaacugggcagugguucacuuuaaaacaagaagauuaaacuuucauau

SEQ ID NO: 698179 - RNA, 64 nt, Homo Sapiens
augucauuggcaccauaaauccagaauauuuuaccuuuaaaaaacuaaugauuugcuucuaugu

SEQ ID NO: 698180 - RNA, 64 nt, Homo Sapiens
ucacuucucuuuucaguucuagaauaaacucauacuuuaaaagaggguauuuaagaaaaccugg

SEQ ID NO: 698181 - RNA, 64 nt, Homo Sapiens
caaacaguuccauuuucucuaaucugaaaaacaucuuuaaaauuucaauuuccauauguuacug

SEQ ID NO: 698182 - RNA, 64 nt, Homo Sapiens
auucaaaugaagagaaaaagaagugugaggucuacuuuaaaaaaaaaugauacuuaaauaaaga

SEQ ID NO: 698183 - RNA, 64 nt, Homo Sapiens
auggcaaaaagacgucaggcaauuuuuuuuaaugcuuuaaaaaaauaugaacacuggauaaccu

SEQ ID NO: 698184 - RNA, 64 nt, Homo Sapiens
uguaguugcauuuuugcuaaaaaaaaaaaaaaaccuuuaaaaauuguuggauguguacaaaagu

SEQ ID NO: 698185 - RNA, 64 nt, Homo Sapiens
guuacaggaaagccagccagaggaagugucagcacuuuaaaauucuagaccccaaaaaacuaca

SEQ ID NO: 698186 - RNA, 64 nt, Homo Sapiens
uugcuuuugagauagauuguagucuggguagcaucuuuaaaauguaugugggcuuaacuguugu

SEQ ID NO: 698187 - RNA, 64 nt, Homo Sapiens
gcuuuaaagggaaauuaaaccauucaugaauaaacuuuaaaaaugugaaguguccuuuuccuuu

SEQ ID NO: 698188 - RNA, 64 nt, Homo Sapiens
gaagacuagugagauuucuguaauaauuuuaauucuuuaaaaagugaaagcuuguuguaaagau

SEQ ID NO: 698189 - RNA, 64 nt, Homo Sapiens
gacauuccauacuaauauacauuguuuaugcuuucuuuaaaauaacuagaagaacauaaaagaa

SEQ ID NO: 698190 - RNA, 64 nt, Homo Sapiens
agugucagcaaggugucuuggguuuauuuugguucuuuaaaaaagggaagucuugagguuuuag

SEQ ID NO: 698191 - RNA, 64 nt, Homo Sapiens
acauauacacugaagaugaguuuuuaaucucuuacuuuaaaaagauuuauuuagaaucgugaau

SEQ ID NO: 698192 - RNA, 64 nt, Homo Sapiens
uagggaucuugaaggcucccguuuuugaaauaagcuuuaaaauaaaaaaugugaaguagugaug

SEQ ID NO: 698193 - RNA, 64 nt, Homo Sapiens
ucaaguagcaucucucucuuugcaaguuuuuggucuuuaaaaugucagaauguauuuuuacuac

SEQ ID NO: 698194 - RNA, 64 nt, Homo Sapiens
uacaucuccucuccuuggaggacagaaagaaugucuuuaaaauaccaaaccuuaguugaaauca

SEQ ID NO: 698195 - RNA, 64 nt, Homo Sapiens
cuacuuccccgcccgcaggaucagcucacguggccuuuaaaaacucacacagaagguacuaaug

SEQ ID NO: 698196 - RNA, 64 nt, Homo Sapiens
aguagaagauuuuuuggaaguuauuuguacauaacuuuaaaaggcaaacuaacgguagauaaau

SEQ ID NO: 698197 - RNA, 64 nt, Homo Sapiens
gcgaaaaaugugacaaaaucauacuggugaggaacuuuaaaaauuucuaaacauaaaauaaauc

SEQ ID NO: 698198 - RNA, 64 nt, Homo Sapiens
gggagaaauagaauggugcucuuaucuuucuugacuuuaaaaaaauuauuaaaaacaaaaaaaa

SEQ ID NO: 698199 - RNA, 64 nt, Homo Sapiens
aucagaaugauauaaaggagauacauguuucuuccuuuaaaaaauaaacggaaguuacauuguu

SEQ ID NO: 698200 - RNA, 64 nt, Homo Sapiens
aucccauuuaugcaauuuacaguuauuuuguguccuuuaaaaaaaaauggauagauuguuuuag

SEQ ID NO: 698201 - RNA, 64 nt, Homo Sapiens
agguaaauaaucauacacagaacaaagaguagaacuuuaaaagacagauaguauacacaucaua

SEQ ID NO: 698202 - RNA, 64 nt, Homo Sapiens
aaacauuuugugguguguuugccauuuauuuauucuuuaaaaauuccuuuccugcguuuccuuu

SEQ ID NO: 698203 - RNA, 64 nt, Homo Sapiens
agcaugggaucauauuuaaacguuucugcauuuccuuuaaaaauaaagaaacccauacucuagu

SEQ ID NO: 698204 - RNA, 64 nt, Homo Sapiens
ccacugcacuccagccuggugacagcgugagacucuuuaaaaaaagaaauuaaaagaguugaga

SEQ ID NO: 698205 - RNA, 64 nt, Homo Sapiens
aauuuguaugcaacagagaugcugcagcugaugccuuuaaaagguauucaucauggaagagcug

SEQ ID NO: 698206 - RNA, 64 nt, Homo Sapiens
gggcugauguaaauguuuuacuuucaacuguguucuuuaaaauaaauccuaccugguuuuuaaa

SEQ ID NO: 698207 - RNA, 64 nt, Homo Sapiens
aauauauuguuagauuaaaaccauuguauuaagacuuuaaaauguaagcauuguaauucugaaa

SEQ ID NO: 698208 - RNA, 64 nt, Homo Sapiens
uggucacuaaacucaggauuauuuuccugaugaucuuuaaaaugagucuuaaugggaacuuggc

SEQ ID NO: 698209 - RNA, 64 nt, Homo Sapiens
agacauucaaaauuugaugugugugcgcacauagcuuuaaaagagcauaugugugugcgugcgu

SEQ ID NO: 698210 - RNA, 64 nt, Homo Sapiens
acuuuuccaaccugcuuugugaauuaucaagugacuuuaaaaugaaacuucuuagguguuccag

SEQ ID NO: 698211 - RNA, 64 nt, Homo Sapiens
cgcauuacaaacuucuuaggcauuaggaauuucacuuuaaaaugagagagagauuagaaaacga

SEQ ID NO: 698212 - RNA, 64 nt, Homo Sapiens
acagaauucagugcucuuucauuuuacuguaaaucuuuaaaauaagucuuuugggaaccaaagu

SEQ ID NO: 698213 - RNA, 64 nt, Homo Sapiens
guucuuuaacacugacuacuugcugacacguacucuuuaaaaguugcauuauugauuuaaauaa

SEQ ID NO: 698214 - RNA, 64 nt, Homo Sapiens
aguuaguaugcauuuauaauuguagaauauucaccuuuaaaacuaacaguaauauuugaagauu

SEQ ID NO: 698215 - RNA, 64 nt, Homo Sapiens
auuaggcugaaagaguuuaucuuuuuauacuguacuuuaaaagcccguucugguuuuucuauua

SEQ ID NO: 698216 - RNA, 64 nt, Homo Sapiens
aucaggacacaacagagggcagaggccccauuagcuuuaaaauguagccccagguuggagcugg

SEQ ID NO: 698217 - RNA, 64 nt, Homo Sapiens
auuucucagcugggcaguaaucaauuuaaugguccuuuaaaaugucuguguauuaaaaauuuaa

SEQ ID NO: 698218 - RNA, 64 nt, Homo Sapiens
aauaauauuguauuagagaaucagaaccauuuuacuuuaaaauuuuagaggaggccaguaauga

SEQ ID NO: 698219 - RNA, 64 nt, Homo Sapiens
uauguauuuaacaaauacuuauaugaugacguuucuuuaaaaugggugccucauaggugugugg

SEQ ID NO: 698220 - RNA, 64 nt, Homo Sapiens
gaauuguagaacuauguuauaguccagucuacuucuuuaaaaaccauuuaaacugcuagauagu

SEQ ID NO: 698221 - RNA, 64 nt, Homo Sapiens
gaauaguccaauagaaaauucauucuuuauaggucuuuaaaaauuacuuuuauuauauuguuua

SEQ ID NO: 698222 - RNA, 64 nt, Homo Sapiens
aucuuuuaguguuucagauaaccucucaaaaagacuuuaaaauaaugcuauuacacaaagcugc

SEQ ID NO: 698223 - RNA, 64 nt, Homo Sapiens
uuaagagaauuuuuucuauuacuuauggaucaugcuuuaaaaugauuuuucuugauauuuauuu

SEQ ID NO: 698224 - RNA, 64 nt, Homo Sapiens
gccuccagugcauccuuacuuagguauuauacuucuuuaaaaagcucugaagcugcuacaauag

SEQ ID NO: 698225 - RNA, 64 nt, Homo Sapiens
ugauuccuuuuguccacuuauauaguuauuuucucuuuaaaaaaaaauuuuuuuuaauguauua

SEQ ID NO: 698226 - RNA, 64 nt, Homo Sapiens
uacauaaauccaugaguccaaacacuugagcacacuuuaaaaagauuaauaaaaccauaaauga

SEQ ID NO: 698227 - RNA, 64 nt, Homo Sapiens
uauuaauaaaaccauaaauguauugaacauucuacuuuaaaaauaaaauaaaucauaguaauaa

SEQ ID NO: 698228 - RNA, 64 nt, Homo Sapiens
cagugaagcugggugcggugcguccaccuuaaggcuuuaaaagaugaagauggauugaagagaa

SEQ ID NO: 698229 - RNA, 64 nt, Homo Sapiens
agaaacaaagaggggaagaucugguaacuugagacuuuaaaagaguaucuuuagugcuucuuac

SEQ ID NO: 698230 - RNA, 64 nt, Homo Sapiens
uuacuacaauauguacauuucaacuaaaguuguacuuuaaaaauauuacauacacaucagccau

SEQ ID NO: 698231 - RNA, 64 nt, Homo Sapiens
cucuuccaaccauuuaucuuaaagugcugcagggcuuuaaaauuuauuaacacuacucaaagca

SEQ ID NO: 698232 - RNA, 64 nt, Homo Sapiens
aaaauacagcagaaccucacucaguuaauuauuccuuuaaaaaguauaacauuucaguuacuuu

SEQ ID NO: 698233 - RNA, 64 nt, Homo Sapiens
uuuuaguagauuuuguaaaguagagucaauggaacuuuaaaauacaauuuuuuaaauguauuaa

SEQ ID NO: 698234 - RNA, 64 nt, Homo Sapiens
uaaacagaaauggagaccugaagaacagaaauuacuuuaaaaaaguguguaauaacacauugua

SEQ ID NO: 698235 - RNA, 64 nt, Homo Sapiens
uuuguuauuuucucaccuuuuguuguguaagaaacuuuaaaacaauucuuuuuauaucuauacc

SEQ ID NO: 698236 - RNA, 64 nt, Homo Sapiens
guaucuuuaguucuuccuaccuaguaacuugagacuuuaaaagaagaaacauggagaagaugug

SEQ ID NO: 698237 - RNA, 64 nt, Homo Sapiens
ugaaggugguaugaagagaacguccacuuuaaggcuuuaaaagacagugaagcugguuguaggg

SEQ ID NO: 698238 - RNA, 64 nt, Homo Sapiens
auaaaucauaguaauaauauuauugaacauucuacuuuaaaaauuauuaauaaaaccauaaaug

SEQ ID NO: 698239 - RNA, 64 nt, Homo Sapiens
auuaauaaaaccauaaaugaaacacuugagcacacuuuaaaaaguacauaaacccaugagucca

SEQ ID NO: 698240 - RNA, 64 nt, Homo Sapiens; identical to SEQ ID NO: 141970

SEQ ID NO: 698241 - RNA, 64 nt, Homo Sapiens; identical to SEQ ID NO: 141971

SEQ ID NO: 698242 - RNA, 64 nt, Homo Sapiens; identical to SEQ ID NO: 141972

SEQ ID NO: 698243 - RNA, 64 nt, Homo Sapiens; identical to SEQ ID NO: 141973

SEQ ID NO: 698244 - RNA, 64 nt, Homo Sapiens; identical to SEQ ID NO: 141974

SEQ ID NO: 698245 - RNA, 64 nt, Homo Sapiens; identical to SEQ ID NO: 141975

SEQ ID NO: 698246 - RNA, 64 nt, Homo Sapiens; identical to SEQ ID NO: 141976

SEQ ID NO: 698247 - RNA, 64 nt, Homo Sapiens; identical to SEQ ID NO: 141977

SEQ ID NO: 698248 - RNA, 64 nt, Homo Sapiens; identical to SEQ ID NO: 141978

SEQ ID NO: 698249 - RNA, 64 nt, Homo Sapiens; identical to SEQ ID NO: 141979

SEQ ID NO: 698250 - RNA, 64 nt, Homo Sapiens; identical to SEQ ID NO: 141980

SEQ ID NO: 698251 - RNA, 64 nt, Homo Sapiens; identical to SEQ ID NO: 141981

SEQ ID NO: 698252 - RNA, 64 nt, Homo Sapiens; identical to SEQ ID NO: 141982

SEQ ID NO: 698253 - RNA, 64 nt, Homo Sapiens; identical to SEQ ID NO: 141983

SEQ ID NO: 698254 - RNA, 64 nt, Homo Sapiens; identical to SEQ ID NO: 141984

SEQ ID NO: 698255 - RNA, 64 nt, Homo Sapiens; identical to SEQ ID NO: 141985

SEQ ID NO: 698256 - RNA, 64 nt, Homo Sapiens; identical to SEQ ID NO: 141986

SEQ ID NO: 698257 - RNA, 64 nt, Homo Sapiens; identical to SEQ ID NO: 141987

SEQ ID NO: 698258 - RNA, 64 nt, Homo Sapiens; identical to SEQ ID NO: 141988

SEQ ID NO: 698259 - RNA, 64 nt, Homo Sapiens; identical to SEQ ID NO: 141989

SEQ ID NO: 698260 - RNA, 64 nt, Homo Sapiens; identical to SEQ ID NO: 141990

SEQ ID NO: 698261 - RNA, 64 nt, Homo Sapiens; identical to SEQ ID NO: 141991

SEQ ID NO: 698262 - RNA, 64 nt, Homo Sapiens; identical to SEQ ID NO: 141992

SEQ ID NO: 698263 - RNA, 64 nt, Homo Sapiens; identical to SEQ ID NO: 141993

SEQ ID NO: 698264 - RNA, 64 nt, Homo Sapiens; identical to SEQ ID NO: 141994

SEQ ID NO: 698265 - RNA, 64 nt, Homo Sapiens; identical to SEQ ID NO: 141995

SEQ ID NO: 698266 - RNA, 64 nt, Homo Sapiens; identical to SEQ ID NO: 141996

SEQ ID NO: 698267 - RNA, 64 nt, Homo Sapiens; identical to SEQ ID NO: 141997

SEQ ID NO: 698268 - RNA, 64 nt, Homo Sapiens; identical to SEQ ID NO: 141998

SEQ ID NO: 698269 - RNA, 64 nt, Homo Sapiens; identical to SEQ ID NO: 141999

SEQ ID NO: 698270 - RNA, 64 nt, Homo Sapiens; identical to SEQ ID NO: 142000

SEQ ID NO: 698271 - RNA, 64 nt, Homo Sapiens; identical to SEQ ID NO: 142001

SEQ ID NO: 698272 - RNA, 64 nt, Homo Sapiens; identical to SEQ ID NO: 142002

SEQ ID NO: 698273 - RNA, 64 nt, Homo Sapiens; identical to SEQ ID NO: 142003

SEQ ID NO: 698274 - RNA, 64 nt, Homo Sapiens; identical to SEQ ID NO: 142004

SEQ ID NO: 698275 - RNA, 64 nt, Homo Sapiens; identical to SEQ ID NO: 142005

SEQ ID NO: 698276 - RNA, 64 nt, Homo Sapiens; identical to SEQ ID NO: 142006

SEQ ID NO: 698277 - RNA, 64 nt, Homo Sapiens; identical to SEQ ID NO: 142007

SEQ ID NO: 698278 - RNA, 64 nt, Homo Sapiens; identical to SEQ ID NO: 142008

SEQ ID NO: 698279 - RNA, 64 nt, Homo Sapiens; identical to SEQ ID NO: 142009

SEQ ID NO: 698280 - RNA, 64 nt, Homo Sapiens; identical to SEQ ID NO: 142010

SEQ ID NO: 698281 - RNA, 64 nt, Homo Sapiens; identical to SEQ ID NO: 142011

SEQ ID NO: 698282 - RNA, 64 nt, Homo Sapiens; identical to SEQ ID NO: 142012

SEQ ID NO: 698283 - RNA, 64 nt, Homo Sapiens; identical to SEQ ID NO: 142013

SEQ ID NO: 698284 - RNA, 64 nt, Homo Sapiens; identical to SEQ ID NO: 142014

SEQ ID NO: 698285 - RNA, 64 nt, Homo Sapiens; identical to SEQ ID NO: 142015

SEQ ID NO: 698286 - RNA, 64 nt, Homo Sapiens; identical to SEQ ID NO: 142016

SEQ ID NO: 698287 - RNA, 64 nt, Homo Sapiens; identical to SEQ ID NO: 142017

SEQ ID NO: 698288 - RNA, 64 nt, Homo Sapiens; identical to SEQ ID NO: 142018

SEQ ID NO: 698289 - RNA, 64 nt, Homo Sapiens; identical to SEQ ID NO: 142019

SEQ ID NO: 698290 - RNA, 64 nt, Homo Sapiens; identical to SEQ ID NO: 142020

SEQ ID NO: 698291 - RNA, 64 nt, Homo Sapiens; identical to SEQ ID NO: 142021

SEQ ID NO: 698292 - RNA, 64 nt, Homo Sapiens; identical to SEQ ID NO: 142022

SEQ ID NO: 698293 - RNA, 64 nt, Homo Sapiens; identical to SEQ ID NO: 142023

SEQ ID NO: 698294 - RNA, 64 nt, Homo Sapiens; identical to SEQ ID NO: 142024

SEQ ID NO: 698295 - RNA, 64 nt, Homo Sapiens; identical to SEQ ID NO: 142025

SEQ ID NO: 698296 - RNA, 64 nt, Homo Sapiens; identical to SEQ ID NO: 142026

SEQ ID NO: 698297 - RNA, 64 nt, Homo Sapiens; identical to SEQ ID NO: 142027

SEQ ID NO: 698298 - RNA, 64 nt, Homo Sapiens; identical to SEQ ID NO: 142028

SEQ ID NO: 698299 - RNA, 64 nt, Homo Sapiens; identical to SEQ ID NO: 142029

SEQ ID NO: 698300 - RNA, 64 nt, Homo Sapiens; identical to SEQ ID NO: 142030

SEQ ID NO: 698301 - RNA, 64 nt, Homo Sapiens; identical to SEQ ID NO: 142031

SEQ ID NO: 698302 - RNA, 64 nt, Homo Sapiens; identical to SEQ ID NO: 142032

SEQ ID NO: 698303 - RNA, 64 nt, Homo Sapiens; identical to SEQ ID NO: 142033

SEQ ID NO: 698304 - RNA, 64 nt, Homo Sapiens; identical to SEQ ID NO: 142034

SEQ ID NO: 698305 - RNA, 64 nt, Homo Sapiens; identical to SEQ ID NO: 142035

SEQ ID NO: 698306 - RNA, 64 nt, Homo Sapiens; identical to SEQ ID NO: 142036

SEQ ID NO: 698307 - RNA, 64 nt, Homo Sapiens; identical to SEQ ID NO: 142037

SEQ ID NO: 698308 - RNA, 64 nt, Homo Sapiens; identical to SEQ ID NO: 142038

SEQ ID NO: 698309 - RNA, 64 nt, Homo Sapiens; identical to SEQ ID NO: 142039

SEQ ID NO: 698310 - RNA, 64 nt, Homo Sapiens; identical to SEQ ID NO: 142040

SEQ ID NO: 698311 - RNA, 64 nt, Homo Sapiens; identical to SEQ ID NO: 142041

SEQ ID NO: 698312 - RNA, 64 nt, Homo Sapiens; identical to SEQ ID NO: 142042

SEQ ID NO: 698313 - RNA, 64 nt, Homo Sapiens; identical to SEQ ID NO: 142043

SEQ ID NO: 698314 - RNA, 64 nt, Homo Sapiens; identical to SEQ ID NO: 142044

SEQ ID NO: 698315 - RNA, 62 nt, Homo Sapiens
ugacuucaguugagggcaagucucuggaaaagaggcuguaggcaucuggcagcuaccaugca

SEQ ID NO: 698316 - RNA, 62 nt, Homo Sapiens
agucaauauugucaguacuuugcuuugauugaaggcuguagagcugaguuaccaaaauuucu

SEQ ID NO: 698317 - RNA, 64 nt, Homo Sapiens
gccccuagauguugccacauucacaucuccuugauggccuuagaucucuugacuagucaaggac

SEQ ID NO: 698318 - RNA, 64 nt, Homo Sapiens
aaaucuuugguuguguggaugccuguguucagaguggccuuaucuugaccucaguucuggauuu

SEQ ID NO: 698319 - RNA, 64 nt, Homo Sapiens
aagaaaaugcaucaucaguuugcuauuucccugauggccuuaauuuuagaguggucuuggauua

SEQ ID NO: 698320 - RNA, 64 nt, Homo Sapiens
aacauguuuaggcaacuagucagaaaaccagcuauggccuuacagaaagggaaaaauuaaccca

SEQ ID NO: 698321 - RNA, 64 nt, Homo Sapiens
uccugcaaguuccccagugucuccugcuguccacuggccuuagccagcugccacacccccgaca

SEQ ID NO: 698322 - RNA, 64 nt, Homo Sapiens
gcacacuguccugcauccaggcugcacaaucauguggccuuaggccacugcaauuccuccuagg

SEQ ID NO: 698323 - RNA, 64 nt, Homo Sapiens; identical to SEQ ID NO: 585264

SEQ ID NO: 698324 - RNA, 64 nt, Homo Sapiens; identical to SEQ ID NO: 585265

SEQ ID NO: 698325 - RNA, 64 nt, Homo Sapiens; identical to SEQ ID NO: 585266

SEQ ID NO: 698326 - RNA, 64 nt, Homo Sapiens; identical to SEQ ID NO: 585267

SEQ ID NO: 698327 - RNA, 64 nt, Homo Sapiens; identical to SEQ ID NO: 585268

SEQ ID NO: 698328 - RNA, 64 nt, Homo Sapiens; identical to SEQ ID NO: 585269

SEQ ID NO: 698329 - RNA, 64 nt, Homo Sapiens; identical to SEQ ID NO: 585270

SEQ ID NO: 698330 - RNA, 64 nt, Homo Sapiens; identical to SEQ ID NO: 585270

SEQ ID NO: 698331 - RNA, 64 nt, Homo Sapiens; identical to SEQ ID NO: 585272

SEQ ID NO: 698332 - RNA, 64 nt, Homo Sapiens; identical to SEQ ID NO: 585273

SEQ ID NO: 698333 - RNA, 64 nt, Homo Sapiens; identical to SEQ ID NO: 585274

SEQ ID NO: 698334 - RNA, 64 nt, Homo Sapiens; identical to SEQ ID NO: 585275

SEQ ID NO: 698335 - RNA, 64 nt, Homo Sapiens; identical to SEQ ID NO: 585276

SEQ ID NO: 698336 - RNA, 64 nt, Homo Sapiens; identical to SEQ ID NO: 585277

SEQ ID NO: 698337 - RNA, 64 nt, Homo Sapiens; identical to SEQ ID NO: 585278

SEQ ID NO: 698338 - RNA, 64 nt, Homo Sapiens; identical to SEQ ID NO: 585279

SEQ ID NO: 698339 - RNA, 64 nt, Homo Sapiens; identical to SEQ ID NO: 585280

SEQ ID NO: 698340 - RNA, 64 nt, Homo Sapiens; identical to SEQ ID NO: 585281

SEQ ID NO: 698341 - RNA, 64 nt, Homo Sapiens; identical to SEQ ID NO: 585282

SEQ ID NO: 698342 - RNA, 64 nt, Homo Sapiens; identical to SEQ ID NO: 585283

SEQ ID NO: 698343 - RNA, 64 nt, Homo Sapiens; identical to SEQ ID NO: 585284

SEQ ID NO: 698344 - RNA, 64 nt, Homo Sapiens; identical to SEQ ID NO: 585285

SEQ ID NO: 698345 - RNA, 64 nt, Homo Sapiens; identical to SEQ ID NO: 585286

SEQ ID NO: 698346 - RNA, 64 nt, Homo Sapiens; identical to SEQ ID NO: 585287

SEQ ID NO: 698347 - RNA, 64 nt, Homo Sapiens; identical to SEQ ID NO: 585288

SEQ ID NO: 698348 - RNA, 64 nt, Homo Sapiens; identical to SEQ ID NO: 585289

SEQ ID NO: 698349 - RNA, 64 nt, Homo Sapiens; identical to SEQ ID NO: 585290

SEQ ID NO: 698350 - RNA, 64 nt, Homo Sapiens; identical to SEQ ID NO: 585291

SEQ ID NO: 698351 - RNA, 64 nt, Homo Sapiens; identical to SEQ ID NO: 585292

SEQ ID NO: 698352 - RNA, 64 nt, Homo Sapiens; identical to SEQ ID NO: 585293

SEQ ID NO: 698353 - RNA, 64 nt, Homo Sapiens; identical to SEQ ID NO: 585294

SEQ ID NO: 698354 - RNA, 64 nt, Homo Sapiens; identical to SEQ ID NO: 585295

SEQ ID NO: 698355 - RNA, 64 nt, Homo Sapiens; identical to SEQ ID NO: 585296

SEQ ID NO: 698356 - RNA, 64 nt, Homo Sapiens; identical to SEQ ID NO: 585297

SEQ ID NO: 698357 - RNA, 64 nt, Homo Sapiens; identical to SEQ ID NO: 585298

SEQ ID NO: 698358 - RNA, 64 nt, Homo Sapiens; identical to SEQ ID NO: 585299

SEQ ID NO: 698359 - RNA, 64 nt, Homo Sapiens; identical to SEQ ID NO: 50853

SEQ ID NO: 698360 - RNA, 64 nt, Homo Sapiens; identical to SEQ ID NO: 50854

SEQ ID NO: 698361 - RNA, 64 nt, Homo Sapiens; identical to SEQ ID NO: 50855

SEQ ID NO: 698362 - RNA, 64 nt, Homo Sapiens; identical to SEQ ID NO: 50856

SEQ ID NO: 698363 - RNA, 64 nt, Homo Sapiens; identical to SEQ ID NO: 50857

SEQ ID NO: 698364 - RNA, 64 nt, Homo Sapiens; identical to SEQ ID NO: 50858

SEQ ID NO: 698365 - RNA, 64 nt, Homo Sapiens; identical to SEQ ID NO: 50859

SEQ ID NO: 698366 - RNA, 64 nt, Homo Sapiens; identical to SEQ ID NO: 50860

SEQ ID NO: 698367 - RNA, 64 nt, Homo Sapiens; identical to SEQ ID NO: 50861

SEQ ID NO: 698368 - RNA, 64 nt, Homo Sapiens; identical to SEQ ID NO: 50862

SEQ ID NO: 698369 - RNA, 64 nt, Homo Sapiens; identical to SEQ ID NO: 50863

SEQ ID NO: 698370 - RNA, 64 nt, Homo Sapiens; identical to SEQ ID NO: 50864

SEQ ID NO: 698371 - RNA, 64 nt, Homo Sapiens; identical to SEQ ID NO: 50865

SEQ ID NO: 698372 - RNA, 64 nt, Homo Sapiens; identical to SEQ ID NO: 50866

SEQ ID NO: 698373 - RNA, 64 nt, Homo Sapiens; identical to SEQ ID NO: 50867

SEQ ID NO: 698374 - RNA, 64 nt, Homo Sapiens; identical to SEQ ID NO: 50868

SEQ ID NO: 698375 - RNA, 64 nt, Homo Sapiens; identical to SEQ ID NO: 50869

SEQ ID NO: 698376 - RNA, 64 nt, Homo Sapiens; identical to SEQ ID NO: 50870

SEQ ID NO: 698377 - RNA, 64 nt, Homo Sapiens; identical to SEQ ID NO: 50871

SEQ ID NO: 698378 - RNA, 64 nt, Homo Sapiens; identical to SEQ ID NO: 50872

SEQ ID NO: 698379 - RNA, 64 nt, Homo Sapiens; identical to SEQ ID NO: 50873

SEQ ID NO: 698380 - RNA, 64 nt, Homo Sapiens; identical to SEQ ID NO: 50874

SEQ ID NO: 698381 - RNA, 64 nt, Homo Sapiens; identical to SEQ ID NO: 50875

SEQ ID NO: 698382 - RNA, 64 nt, Homo Sapiens; identical to SEQ ID NO: 50876

SEQ ID NO: 698383 - RNA, 64 nt, Homo Sapiens; identical to SEQ ID NO: 50877

SEQ ID NO: 698384 - RNA, 64 nt, Homo Sapiens; identical to SEQ ID NO: 50878

SEQ ID NO: 698385 - RNA, 64 nt, Homo Sapiens; identical to SEQ ID NO: 50879

SEQ ID NO: 698386 - RNA, 64 nt, Homo Sapiens; identical to SEQ ID NO: 50880

SEQ ID NO: 698387 - RNA, 64 nt, Homo Sapiens; identical to SEQ ID NO: 50881

SEQ ID NO: 698388 - RNA, 64 nt, Homo Sapiens; identical to SEQ ID NO: 50882

SEQ ID NO: 698389 - RNA, 64 nt, Homo Sapiens; identical to SEQ ID NO: 50883

SEQ ID NO: 698390 - RNA, 64 nt, Homo Sapiens; identical to SEQ ID NO: 50884

SEQ ID NO: 698391 - RNA, 64 nt, Homo Sapiens; identical to SEQ ID NO: 50885

SEQ ID NO: 698392 - RNA, 64 nt, Homo Sapiens; identical to SEQ ID NO: 50886

SEQ ID NO: 698393 - RNA, 64 nt, Homo Sapiens; identical to SEQ ID NO: 50887

SEQ ID NO: 698394 - RNA, 64 nt, Homo Sapiens; identical to SEQ ID NO: 50888

SEQ ID NO: 698395 - RNA, 64 nt, Homo Sapiens; identical to SEQ ID NO: 50889

SEQ ID NO: 698396 - RNA, 64 nt, Homo Sapiens; identical to SEQ ID NO: 50890

SEQ ID NO: 698397 - RNA, 64 nt, Homo Sapiens; identical to SEQ ID NO: 50891

SEQ ID NO: 698398 - RNA, 64 nt, Homo Sapiens; identical to SEQ ID NO: 50892

SEQ ID NO: 698399 - RNA, 64 nt, Homo Sapiens; identical to SEQ ID NO: 50893

SEQ ID NO: 698400 - RNA, 64 nt, Homo Sapiens; identical to SEQ ID NO: 50894

SEQ ID NO: 698401 - RNA, 64 nt, Homo Sapiens; identical to SEQ ID NO: 50895

SEQ ID NO: 698402 - RNA, 64 nt, Homo Sapiens; identical to SEQ ID NO: 50896

SEQ ID NO: 698403 - RNA, 64 nt, Homo Sapiens; identical to SEQ ID NO: 50897

SEQ ID NO: 698404 - RNA, 64 nt, Homo Sapiens; identical to SEQ ID NO: 50898

SEQ ID NO: 698405 - RNA, 64 nt, Homo Sapiens; identical to SEQ ID NO: 50899

SEQ ID NO: 698406 - RNA, 64 nt, Homo Sapiens; identical to SEQ ID NO: 50900

SEQ ID NO: 698407 - RNA, 64 nt, Homo Sapiens; identical to SEQ ID NO: 50901

SEQ ID NO: 698408 - RNA, 64 nt, Homo Sapiens; identical to SEQ ID NO: 50902

SEQ ID NO: 698409 - RNA, 64 nt, Homo Sapiens; identical to SEQ ID NO: 50903

SEQ ID NO: 698410 - RNA, 64 nt, Homo Sapiens; identical to SEQ ID NO: 50904

SEQ ID NO: 698411 - RNA, 64 nt, Homo Sapiens; identical to SEQ ID NO: 50905

SEQ ID NO: 698412 - RNA, 64 nt, Homo Sapiens; identical to SEQ ID NO: 50906

SEQ ID NO: 698413 - RNA, 64 nt, Homo Sapiens; identical to SEQ ID NO: 50907

SEQ ID NO: 698414 - RNA, 64 nt, Homo Sapiens; identical to SEQ ID NO: 50908

SEQ ID NO: 698415 - RNA, 64 nt, Homo Sapiens; identical to SEQ ID NO: 50909

SEQ ID NO: 698416 - RNA, 64 nt, Homo Sapiens; identical to SEQ ID NO: 50910

SEQ ID NO: 698417 - RNA, 64 nt, Homo Sapiens; identical to SEQ ID NO: 50911

SEQ ID NO: 698418 - RNA, 64 nt, Homo Sapiens; identical to SEQ ID NO: 50912

SEQ ID NO: 698419 - RNA, 64 nt, Homo Sapiens; identical to SEQ ID NO: 50913

SEQ ID NO: 698420 - RNA, 64 nt, Homo Sapiens; identical to SEQ ID NO: 50914

SEQ ID NO: 698421 - RNA, 64 nt, Homo Sapiens; identical to SEQ ID NO: 50915

SEQ ID NO: 698422 - RNA, 64 nt, Homo Sapiens; identical to SEQ ID NO: 50916

SEQ ID NO: 698423 - RNA, 64 nt, Homo Sapiens; identical to SEQ ID NO: 50917

SEQ ID NO: 698424 - RNA, 64 nt, Homo Sapiens; identical to SEQ ID NO: 50918

SEQ ID NO: 698425 - RNA, 64 nt, Homo Sapiens; identical to SEQ ID NO: 50919

SEQ ID NO: 698426 - RNA, 64 nt, Homo Sapiens; identical to SEQ ID NO: 50920

SEQ ID NO: 698427 - RNA, 64 nt, Homo Sapiens; identical to SEQ ID NO: 50921

SEQ ID NO: 698428 - RNA, 64 nt, Homo Sapiens; identical to SEQ ID NO: 50922

SEQ ID NO: 698429 - RNA, 64 nt, Homo Sapiens; identical to SEQ ID NO: 50923

SEQ ID NO: 698430 - RNA, 64 nt, Homo Sapiens; identical to SEQ ID NO: 50924

SEQ ID NO: 698431 - RNA, 64 nt, Homo Sapiens; identical to SEQ ID NO: 50925

SEQ ID NO: 698432 - RNA, 64 nt, Homo Sapiens; identical to SEQ ID NO: 50926

SEQ ID NO: 698433 - RNA, 64 nt, Homo Sapiens; identical to SEQ ID NO: 50927

SEQ ID NO: 698434 - RNA, 64 nt, Homo Sapiens; identical to SEQ ID NO: 50928

SEQ ID NO: 698435 - RNA, 64 nt, Homo Sapiens; identical to SEQ ID NO: 25175

SEQ ID NO: 698436 - RNA, 64 nt, Homo Sapiens; identical to SEQ ID NO: 25176

SEQ ID NO: 698437 - RNA, 64 nt, Homo Sapiens; identical to SEQ ID NO: 25177

SEQ ID NO: 698438 - RNA, 64 nt, Homo Sapiens; identical to SEQ ID NO: 25178

SEQ ID NO: 698439 - RNA, 64 nt, Homo Sapiens; identical to SEQ ID NO: 25179

SEQ ID NO: 698440 - RNA, 64 nt, Homo Sapiens; identical to SEQ ID NO: 25180

SEQ ID NO: 698441 - RNA, 64 nt, Homo Sapiens; identical to SEQ ID NO: 25181

SEQ ID NO: 698442 - RNA, 64 nt, Homo Sapiens; identical to SEQ ID NO: 25182

SEQ ID NO: 698443 - RNA, 64 nt, Homo Sapiens; identical to SEQ ID NO: 25183

SEQ ID NO: 698444 - RNA, 64 nt, Homo Sapiens; identical to SEQ ID NO: 25184

SEQ ID NO: 698445 - RNA, 64 nt, Homo Sapiens; identical to SEQ ID NO: 25185

SEQ ID NO: 698446 - RNA, 64 nt, Homo Sapiens; identical to SEQ ID NO: 25186

SEQ ID NO: 698447 - RNA, 64 nt, Homo Sapiens; identical to SEQ ID NO: 25187

SEQ ID NO: 698448 - RNA, 64 nt, Homo Sapiens; identical to SEQ ID NO: 25188

SEQ ID NO: 698449 - RNA, 64 nt, Homo Sapiens; identical to SEQ ID NO: 25189

SEQ ID NO: 698450 - RNA, 64 nt, Homo Sapiens; identical to SEQ ID NO: 25190

SEQ ID NO: 698451 - RNA, 64 nt, Homo Sapiens; identical to SEQ ID NO: 25191

SEQ ID NO: 698452 - RNA, 64 nt, Homo Sapiens; identical to SEQ ID NO: 25192

SEQ ID NO: 698453 - RNA, 64 nt, Homo Sapiens; identical to SEQ ID NO: 25193

SEQ ID NO: 698454 - RNA, 64 nt, Homo Sapiens; identical to SEQ ID NO: 25194

SEQ ID NO: 698455 - RNA, 64 nt, Homo Sapiens; identical to SEQ ID NO: 25195

SEQ ID NO: 698456 - RNA, 64 nt, Homo Sapiens; identical to SEQ ID NO: 25196

SEQ ID NO: 698457 - RNA, 64 nt, Homo Sapiens; identical to SEQ ID NO: 25197

SEQ ID NO: 698458 - RNA, 64 nt, Homo Sapiens; identical to SEQ ID NO: 25198

SEQ ID NO: 698459 - RNA, 64 nt, Homo Sapiens; identical to SEQ ID NO: 25199

SEQ ID NO: 698460 - RNA, 64 nt, Homo Sapiens; identical to SEQ ID NO: 25200

SEQ ID NO: 698461 - RNA, 64 nt, Homo Sapiens; identical to SEQ ID NO: 25201

SEQ ID NO: 698462 - RNA, 64 nt, Homo Sapiens; identical to SEQ ID NO: 25202

SEQ ID NO: 698463 - RNA, 64 nt, Homo Sapiens; identical to SEQ ID NO: 25203

SEQ ID NO: 698464 - RNA, 64 nt, Homo Sapiens; identical to SEQ ID NO: 25204

SEQ ID NO: 698465 - RNA, 64 nt, Homo Sapiens; identical to SEQ ID NO: 25205

SEQ ID NO: 698466 - RNA, 64 nt, Homo Sapiens; identical to SEQ ID NO: 25206

SEQ ID NO: 698467 - RNA, 64 nt, Homo Sapiens; identical to SEQ ID NO: 25207

SEQ ID NO: 698468 - RNA, 64 nt, Homo Sapiens; identical to SEQ ID NO: 25208

SEQ ID NO: 698469 - RNA, 64 nt, Homo Sapiens; identical to SEQ ID NO: 25209

SEQ ID NO: 698470 - RNA, 64 nt, Homo Sapiens; identical to SEQ ID NO: 25210

SEQ ID NO: 698471 - RNA, 64 nt, Homo Sapiens; identical to SEQ ID NO: 25211

SEQ ID NO: 698472 - RNA, 64 nt, Homo Sapiens; identical to SEQ ID NO: 25212

SEQ ID NO: 698473 - RNA, 64 nt, Homo Sapiens; identical to SEQ ID NO: 25213

SEQ ID NO: 698474 - RNA, 64 nt, Homo Sapiens; identical to SEQ ID NO: 25214

SEQ ID NO: 698475 - RNA, 64 nt, Homo Sapiens; identical to SEQ ID NO: 25215

SEQ ID NO: 698476 - RNA, 64 nt, Homo Sapiens; identical to SEQ ID NO: 25216

SEQ ID NO: 698477 - RNA, 64 nt, Homo Sapiens; identical to SEQ ID NO: 25217

SEQ ID NO: 698478 - RNA, 64 nt, Homo Sapiens; identical to SEQ ID NO: 25218

SEQ ID NO: 698479 - RNA, 64 nt, Homo Sapiens; identical to SEQ ID NO: 25219

SEQ ID NO: 698480 - RNA, 64 nt, Homo Sapiens; identical to SEQ ID NO: 25220

SEQ ID NO: 698481 - RNA, 64 nt, Homo Sapiens; identical to SEQ ID NO: 25221

SEQ ID NO: 698482 - RNA, 64 nt, Homo Sapiens; identical to SEQ ID NO: 25222

SEQ ID NO: 698483 - RNA, 64 nt, Homo Sapiens; identical to SEQ ID NO: 25223

SEQ ID NO: 698484 - RNA, 64 nt, Homo Sapiens; identical to SEQ ID NO: 25224

SEQ ID NO: 698485 - RNA, 64 nt, Homo Sapiens; identical to SEQ ID NO: 25225

SEQ ID NO: 698486 - RNA, 64 nt, Homo Sapiens; identical to SEQ ID NO: 25226

SEQ ID NO: 698487 - RNA, 64 nt, Homo Sapiens; identical to SEQ ID NO: 25227

SEQ ID NO: 698488 - RNA, 64 nt, Homo Sapiens; identical to SEQ ID NO: 25228

SEQ ID NO: 698489 - RNA, 64 nt, Homo Sapiens; identical to SEQ ID NO: 25229

SEQ ID NO: 698490 - RNA, 64 nt, Homo Sapiens; identical to SEQ ID NO: 25230

SEQ ID NO: 698491 - RNA, 64 nt, Homo Sapiens; identical to SEQ ID NO: 25231

SEQ ID NO: 698492 - RNA, 64 nt, Homo Sapiens; identical to SEQ ID NO: 25232

SEQ ID NO: 698493 - RNA, 64 nt, Homo Sapiens; identical to SEQ ID NO: 25233

SEQ ID NO: 698494 - RNA, 64 nt, Homo Sapiens; identical to SEQ ID NO: 25234

SEQ ID NO: 698495 - RNA, 64 nt, Homo Sapiens; identical to SEQ ID NO: 25235

SEQ ID NO: 698496 - RNA, 64 nt, Homo Sapiens; identical to SEQ ID NO: 25236

SEQ ID NO: 698497 - RNA, 64 nt, Homo Sapiens; identical to SEQ ID NO: 25237

SEQ ID NO: 698498 - RNA, 64 nt, Homo Sapiens; identical to SEQ ID NO: 25238

SEQ ID NO: 698499 - RNA, 64 nt, Homo Sapiens; identical to SEQ ID NO: 25239

SEQ ID NO: 698500 - RNA, 64 nt, Homo Sapiens; identical to SEQ ID NO: 25240

SEQ ID NO: 698501 - RNA, 64 nt, Homo Sapiens; identical to SEQ ID NO: 25241

SEQ ID NO: 698502 - RNA, 64 nt, Homo Sapiens; identical to SEQ ID NO: 25242

SEQ ID NO: 698503 - RNA, 64 nt, Homo Sapiens; identical to SEQ ID NO: 25243

SEQ ID NO: 698504 - RNA, 64 nt, Homo Sapiens; identical to SEQ ID NO: 25244

SEQ ID NO: 698505 - RNA, 64 nt, Homo Sapiens; identical to SEQ ID NO: 25245

SEQ ID NO: 698506 - RNA, 64 nt, Homo Sapiens; identical to SEQ ID NO: 25246

SEQ ID NO: 698507 - RNA, 64 nt, Homo Sapiens; identical to SEQ ID NO: 25247

SEQ ID NO: 698508 - RNA, 64 nt, Homo Sapiens; identical to SEQ ID NO: 25248

SEQ ID NO: 698509 - RNA, 64 nt, Homo Sapiens; identical to SEQ ID NO: 25249

SEQ ID NO: 698510 - RNA, 64 nt, Homo Sapiens; identical to SEQ ID NO: 25250

SEQ ID NO: 698511 - RNA, 64 nt, Homo Sapiens; identical to SEQ ID NO: 25251

SEQ ID NO: 698512 - RNA, 64 nt, Homo Sapiens; identical to SEQ ID NO: 25252

SEQ ID NO: 698513 - RNA, 64 nt, Homo Sapiens; identical to SEQ ID NO: 25253

SEQ ID NO: 698514 - RNA, 64 nt, Homo Sapiens; identical to SEQ ID NO: 25254

SEQ ID NO: 698515 - RNA, 64 nt, Homo Sapiens; identical to SEQ ID NO: 25255

SEQ ID NO: 698516 - RNA, 64 nt, Homo Sapiens; identical to SEQ ID NO: 25256

SEQ ID NO: 698517 - RNA, 64 nt, Homo Sapiens; identical to SEQ ID NO: 25257

SEQ ID NO: 698518 - RNA, 64 nt, Homo Sapiens; identical to SEQ ID NO: 25258

SEQ ID NO: 698519 - RNA, 64 nt, Homo Sapiens; identical to SEQ ID NO: 25259

SEQ ID NO: 698520 - RNA, 64 nt, Homo Sapiens; identical to SEQ ID NO: 25260

SEQ ID NO: 698521 - RNA, 64 nt, Homo Sapiens; identical to SEQ ID NO: 25261

SEQ ID NO: 698522 - RNA, 64 nt, Homo Sapiens; identical to SEQ ID NO: 25262

SEQ ID NO: 698523 - RNA, 64 nt, Homo Sapiens; identical to SEQ ID NO: 25263

SEQ ID NO: 698524 - RNA, 64 nt, Homo Sapiens; identical to SEQ ID NO: 25264

SEQ ID NO: 698525 - RNA, 63 nt, Homo Sapiens; identical to SEQ ID NO: 25265

SEQ ID NO: 698526 - RNA, 64 nt, Homo Sapiens; identical to SEQ ID NO: 25266

SEQ ID NO: 698527 - RNA, 64 nt, Homo Sapiens; identical to SEQ ID NO: 25267

SEQ ID NO: 698528 - RNA, 64 nt, Homo Sapiens; identical to SEQ ID NO: 25268

SEQ ID NO: 698529 - RNA, 64 nt, Homo Sapiens; identical to SEQ ID NO: 25269

SEQ ID NO: 698530 - RNA, 64 nt, Homo Sapiens; identical to SEQ ID NO: 25270

SEQ ID NO: 698531 - RNA, 64 nt, Homo Sapiens; identical to SEQ ID NO: 25271

SEQ ID NO: 698532 - RNA, 64 nt, Homo Sapiens; identical to SEQ ID NO: 25272

SEQ ID NO: 698533 - RNA, 64 nt, Homo Sapiens; identical to SEQ ID NO: 25273

SEQ ID NO: 698534 - RNA, 64 nt, Homo Sapiens; identical to SEQ ID NO: 25274

SEQ ID NO: 698535 - RNA, 64 nt, Homo Sapiens; identical to SEQ ID NO: 25275

SEQ ID NO: 698536 - RNA, 64 nt, Homo Sapiens; identical to SEQ ID NO: 25276

SEQ ID NO: 698537 - RNA, 64 nt, Homo Sapiens; identical to SEQ ID NO: 25277

SEQ ID NO: 698538 - RNA, 64 nt, Homo Sapiens; identical to SEQ ID NO: 25278

SEQ ID NO: 698539 - RNA, 64 nt, Homo Sapiens; identical to SEQ ID NO: 25279

SEQ ID NO: 698540 - RNA, 64 nt, Homo Sapiens; identical to SEQ ID NO: 25280

SEQ ID NO: 698541 - RNA, 64 nt, Homo Sapiens; identical to SEQ ID NO: 25281

SEQ ID NO: 698542 - RNA, 64 nt, Homo Sapiens; identical to SEQ ID NO: 25282

SEQ ID NO: 698543 - RNA, 64 nt, Homo Sapiens; identical to SEQ ID NO: 25283

SEQ ID NO: 698544 - RNA, 64 nt, Homo Sapiens; identical to SEQ ID NO: 25284

SEQ ID NO: 698545 - RNA, 64 nt, Homo Sapiens; identical to SEQ ID NO: 25285

SEQ ID NO: 698546 - RNA, 64 nt, Homo Sapiens; identical to SEQ ID NO: 25286

SEQ ID NO: 698547 - RNA, 64 nt, Homo Sapiens; identical to SEQ ID NO: 25287

SEQ ID NO: 698548 - RNA, 64 nt, Homo Sapiens; identical to SEQ ID NO: 25288

SEQ ID NO: 698549 - RNA, 64 nt, Homo Sapiens; identical to SEQ ID NO: 25289

SEQ ID NO: 698550 - RNA, 64 nt, Homo Sapiens; identical to SEQ ID NO: 25290

SEQ ID NO: 698551 - RNA, 64 nt, Homo Sapiens; identical to SEQ ID NO: 25291

SEQ ID NO: 698552 - RNA, 64 nt, Homo Sapiens; identical to SEQ ID NO: 25292

SEQ ID NO: 698553 - RNA, 64 nt, Homo Sapiens; identical to SEQ ID NO: 25293

SEQ ID NO: 698554 - RNA, 64 nt, Homo Sapiens; identical to SEQ ID NO: 25294

SEQ ID NO: 698555 - RNA, 64 nt, Homo Sapiens; identical to SEQ ID NO: 25295

SEQ ID NO: 698556 - RNA, 64 nt, Homo Sapiens; identical to SEQ ID NO: 25296

SEQ ID NO: 698557 - RNA, 64 nt, Homo Sapiens; identical to SEQ ID NO: 25297

SEQ ID NO: 698558 - RNA, 64 nt, Homo Sapiens; identical to SEQ ID NO: 25298

SEQ ID NO: 698559 - RNA, 64 nt, Homo Sapiens; identical to SEQ ID NO: 25299

SEQ ID NO: 698560 - RNA, 64 nt, Homo Sapiens; identical to SEQ ID NO: 25300

SEQ ID NO: 698561 - RNA, 64 nt, Homo Sapiens; identical to SEQ ID NO: 25301

SEQ ID NO: 698562 - RNA, 64 nt, Homo Sapiens; identical to SEQ ID NO: 25302

SEQ ID NO: 698563 - RNA, 64 nt, Homo Sapiens; identical to SEQ ID NO: 25303

SEQ ID NO: 698564 - RNA, 64 nt, Homo Sapiens; identical to SEQ ID NO: 25304

SEQ ID NO: 698565 - RNA, 64 nt, Homo Sapiens; identical to SEQ ID NO: 25305

SEQ ID NO: 698566 - RNA, 64 nt, Homo Sapiens; identical to SEQ ID NO: 25306

SEQ ID NO: 698567 - RNA, 64 nt, Homo Sapiens; identical to SEQ ID NO: 25307

SEQ ID NO: 698568 - RNA, 64 nt, Homo Sapiens; identical to SEQ ID NO: 25308

SEQ ID NO: 698569 - RNA, 64 nt, Homo Sapiens; identical to SEQ ID NO: 25309

SEQ ID NO: 698570 - RNA, 64 nt, Homo Sapiens; identical to SEQ ID NO: 25310

SEQ ID NO: 698571 - RNA, 64 nt, Homo Sapiens; identical to SEQ ID NO: 25311

SEQ ID NO: 698572 - RNA, 64 nt, Homo Sapiens; identical to SEQ ID NO: 25312

SEQ ID NO: 698573 - RNA, 64 nt, Homo Sapiens; identical to SEQ ID NO: 25313

SEQ ID NO: 698574 - RNA, 64 nt, Homo Sapiens; identical to SEQ ID NO: 25314

SEQ ID NO: 698575 - RNA, 64 nt, Homo Sapiens; identical to SEQ ID NO: 25315

SEQ ID NO: 698576 - RNA, 64 nt, Homo Sapiens; identical to SEQ ID NO: 25316

SEQ ID NO: 698577 - RNA, 64 nt, Homo Sapiens; identical to SEQ ID NO: 25317

SEQ ID NO: 698578 - RNA, 64 nt, Homo Sapiens; identical to SEQ ID NO: 25318

SEQ ID NO: 698579 - RNA, 64 nt, Homo Sapiens; identical to SEQ ID NO: 25319

SEQ ID NO: 698580 - RNA, 64 nt, Homo Sapiens; identical to SEQ ID NO: 25320

SEQ ID NO: 698581 - RNA, 64 nt, Homo Sapiens; identical to SEQ ID NO: 25321

SEQ ID NO: 698582 - RNA, 64 nt, Homo Sapiens; identical to SEQ ID NO: 25322

SEQ ID NO: 698583 - RNA, 64 nt, Homo Sapiens; identical to SEQ ID NO: 25323

SEQ ID NO: 698584 - RNA, 64 nt, Homo Sapiens; identical to SEQ ID NO: 25324

SEQ ID NO: 698585 - RNA, 64 nt, Homo Sapiens; identical to SEQ ID NO: 25325

SEQ ID NO: 698586 - RNA, 64 nt, Homo Sapiens; identical to SEQ ID NO: 25326

SEQ ID NO: 698587 - RNA, 64 nt, Homo Sapiens; identical to SEQ ID NO: 25327

SEQ ID NO: 698588 - RNA, 64 nt, Homo Sapiens; identical to SEQ ID NO: 25328

SEQ ID NO: 698589 - RNA, 64 nt, Homo Sapiens; identical to SEQ ID NO: 25329

SEQ ID NO: 698590 - RNA, 64 nt, Homo Sapiens; identical to SEQ ID NO: 25330

SEQ ID NO: 698591 - RNA, 64 nt, Homo Sapiens; identical to SEQ ID NO: 25331

SEQ ID NO: 698592 - RNA, 64 nt, Homo Sapiens; identical to SEQ ID NO: 25332

SEQ ID NO: 698593 - RNA, 64 nt, Homo Sapiens; identical to SEQ ID NO: 25333

SEQ ID NO: 698594 - RNA, 64 nt, Homo Sapiens; identical to SEQ ID NO: 25334

SEQ ID NO: 698595 - RNA, 64 nt, Homo Sapiens; identical to SEQ ID NO: 25335

SEQ ID NO: 698596 - RNA, 64 nt, Homo Sapiens; identical to SEQ ID NO: 25336

SEQ ID NO: 698597 - RNA, 64 nt, Homo Sapiens; identical to SEQ ID NO: 25337

SEQ ID NO: 698598 - RNA, 64 nt, Homo Sapiens; identical to SEQ ID NO: 25338

SEQ ID NO: 698599 - RNA, 64 nt, Homo Sapiens; identical to SEQ ID NO: 25339

SEQ ID NO: 698600 - RNA, 64 nt, Homo Sapiens; identical to SEQ ID NO: 25340

SEQ ID NO: 698601 - RNA, 64 nt, Homo Sapiens; identical to SEQ ID NO: 25341

SEQ ID NO: 698602 - RNA, 64 nt, Homo Sapiens; identical to SEQ ID NO: 25342

SEQ ID NO: 698603 - RNA, 64 nt, Homo Sapiens; identical to SEQ ID NO: 25343

SEQ ID NO: 698604 - RNA, 64 nt, Homo Sapiens; identical to SEQ ID NO: 25344

SEQ ID NO: 698605 - RNA, 64 nt, Homo Sapiens; identical to SEQ ID NO: 25345

SEQ ID NO: 698606 - RNA, 64 nt, Homo Sapiens; identical to SEQ ID NO: 25346

SEQ ID NO: 698607 - RNA, 64 nt, Homo Sapiens; identical to SEQ ID NO: 25347

SEQ ID NO: 698608 - RNA, 64 nt, Homo Sapiens; identical to SEQ ID NO: 25348

SEQ ID NO: 698609 - RNA, 64 nt, Homo Sapiens; identical to SEQ ID NO: 25349

SEQ ID NO: 698610 - RNA, 64 nt, Homo Sapiens; identical to SEQ ID NO: 25350

SEQ ID NO: 698611 - RNA, 64 nt, Homo Sapiens; identical to SEQ ID NO: 25351

SEQ ID NO: 698612 - RNA, 64 nt, Homo Sapiens; identical to SEQ ID NO: 25352

SEQ ID NO: 698613 - RNA, 64 nt, Homo Sapiens; identical to SEQ ID NO: 25353

SEQ ID NO: 698614 - RNA, 64 nt, Homo Sapiens; identical to SEQ ID NO: 25354

SEQ ID NO: 698615 - RNA, 64 nt, Homo Sapiens; identical to SEQ ID NO: 25355

SEQ ID NO: 698616 - RNA, 64 nt, Homo Sapiens; identical to SEQ ID NO: 25356

SEQ ID NO: 698617 - RNA, 64 nt, Homo Sapiens; identical to SEQ ID NO: 25357

SEQ ID NO: 698618 - RNA, 64 nt, Homo Sapiens; identical to SEQ ID NO: 25358

SEQ ID NO: 698619 - RNA, 64 nt, Homo Sapiens; identical to SEQ ID NO: 25359

SEQ ID NO: 698620 - RNA, 64 nt, Homo Sapiens; identical to SEQ ID NO: 25360

SEQ ID NO: 698621 - RNA, 64 nt, Homo Sapiens; identical to SEQ ID NO: 25361

SEQ ID NO: 698622 - RNA, 64 nt, Homo Sapiens; identical to SEQ ID NO: 25362

SEQ ID NO: 698623 - RNA, 64 nt, Homo Sapiens; identical to SEQ ID NO: 25363

SEQ ID NO: 698624 - RNA, 64 nt, Homo Sapiens; identical to SEQ ID NO: 25364

SEQ ID NO: 698625 - RNA, 64 nt, Homo Sapiens; identical to SEQ ID NO: 25365

SEQ ID NO: 698626 - RNA, 64 nt, Homo Sapiens; identical to SEQ ID NO: 25366

SEQ ID NO: 698627 - RNA, 64 nt, Homo Sapiens; identical to SEQ ID NO: 25367

SEQ ID NO: 698628 - RNA, 64 nt, Homo Sapiens; identical to SEQ ID NO: 25368

SEQ ID NO: 698629 - RNA, 64 nt, Homo Sapiens; identical to SEQ ID NO: 25369

SEQ ID NO: 698630 - RNA, 64 nt, Homo Sapiens; identical to SEQ ID NO: 25370

SEQ ID NO: 698631 - RNA, 64 nt, Homo Sapiens; identical to SEQ ID NO: 25371

SEQ ID NO: 698632 - RNA, 64 nt, Homo Sapiens; identical to SEQ ID NO: 25372

SEQ ID NO: 698633 - RNA, 64 nt, Homo Sapiens; identical to SEQ ID NO: 25373

SEQ ID NO: 698634 - RNA, 64 nt, Homo Sapiens; identical to SEQ ID NO: 25374

SEQ ID NO: 698635 - RNA, 64 nt, Homo Sapiens; identical to SEQ ID NO: 25375

SEQ ID NO: 698636 - RNA, 64 nt, Homo Sapiens; identical to SEQ ID NO: 25376

SEQ ID NO: 698637 - RNA, 64 nt, Homo Sapiens; identical to SEQ ID NO: 25377

SEQ ID NO: 698638 - RNA, 64 nt, Homo Sapiens; identical to SEQ ID NO: 25378

SEQ ID NO: 698639 - RNA, 64 nt, Homo Sapiens; identical to SEQ ID NO: 25379

SEQ ID NO: 698640 - RNA, 64 nt, Homo Sapiens; identical to SEQ ID NO: 25380

SEQ ID NO: 698641 - RNA, 64 nt, Homo Sapiens; identical to SEQ ID NO: 25381

SEQ ID NO: 698642 - RNA, 64 nt, Homo Sapiens; identical to SEQ ID NO: 25382

SEQ ID NO: 698643 - RNA, 64 nt, Homo Sapiens; identical to SEQ ID NO: 25383

SEQ ID NO: 698644 - RNA, 64 nt, Homo Sapiens; identical to SEQ ID NO: 25384

SEQ ID NO: 698645 - RNA, 64 nt, Homo Sapiens; identical to SEQ ID NO: 25385

SEQ ID NO: 698646 - RNA, 64 nt, Homo Sapiens; identical to SEQ ID NO: 25386

SEQ ID NO: 698647 - RNA, 64 nt, Homo Sapiens; identical to SEQ ID NO: 25387

SEQ ID NO: 698648 - RNA, 64 nt, Homo Sapiens; identical to SEQ ID NO: 25388

SEQ ID NO: 698649 - RNA, 64 nt, Homo Sapiens; identical to SEQ ID NO: 25389

SEQ ID NO: 698650 - RNA, 64 nt, Homo Sapiens; identical to SEQ ID NO: 25390

SEQ ID NO: 698651 - RNA, 64 nt, Homo Sapiens; identical to SEQ ID NO: 25391

SEQ ID NO: 698652 - RNA, 64 nt, Homo Sapiens; identical to SEQ ID NO: 25392

SEQ ID NO: 698653 - RNA, 64 nt, Homo Sapiens; identical to SEQ ID NO: 25393

SEQ ID NO: 698654 - RNA, 64 nt, Homo Sapiens; identical to SEQ ID NO: 25394

SEQ ID NO: 698655 - RNA, 64 nt, Homo Sapiens; identical to SEQ ID NO: 25395

SEQ ID NO: 698656 - RNA, 64 nt, Homo Sapiens; identical to SEQ ID NO: 25396

SEQ ID NO: 698657 - RNA, 64 nt, Homo Sapiens; identical to SEQ ID NO: 25397

SEQ ID NO: 698658 - RNA, 64 nt, Homo Sapiens; identical to SEQ ID NO: 25398

SEQ ID NO: 698659 - RNA, 64 nt, Homo Sapiens; identical to SEQ ID NO: 25399

SEQ ID NO: 698660 - RNA, 64 nt, Homo Sapiens; identical to SEQ ID NO: 25400

SEQ ID NO: 698661 - RNA, 64 nt, Homo Sapiens; identical to SEQ ID NO: 25401

SEQ ID NO: 698662 - RNA, 64 nt, Homo Sapiens; identical to SEQ ID NO: 25402

SEQ ID NO: 698663 - RNA, 64 nt, Homo Sapiens; identical to SEQ ID NO: 25403

SEQ ID NO: 698664 - RNA, 64 nt, Homo Sapiens; identical to SEQ ID NO: 25404

SEQ ID NO: 698665 - RNA, 64 nt, Homo Sapiens; identical to SEQ ID NO: 25405

SEQ ID NO: 698666 - RNA, 64 nt, Homo Sapiens; identical to SEQ ID NO: 25406

SEQ ID NO: 698667 - RNA, 64 nt, Homo Sapiens; identical to SEQ ID NO: 25407

SEQ ID NO: 698668 - RNA, 64 nt, Homo Sapiens; identical to SEQ ID NO: 25408

SEQ ID NO: 698669 - RNA, 64 nt, Homo Sapiens; identical to SEQ ID NO: 25409

SEQ ID NO: 698670 - RNA, 64 nt, Homo Sapiens; identical to SEQ ID NO: 25410

SEQ ID NO: 698671 - RNA, 64 nt, Homo Sapiens; identical to SEQ ID NO: 25411

SEQ ID NO: 698672 - RNA, 64 nt, Homo Sapiens; identical to SEQ ID NO: 25412

SEQ ID NO: 698673 - RNA, 64 nt, Homo Sapiens; identical to SEQ ID NO: 25413

SEQ ID NO: 698674 - RNA, 64 nt, Homo Sapiens; identical to SEQ ID NO: 25414

SEQ ID NO: 698675 - RNA, 64 nt, Homo Sapiens; identical to SEQ ID NO: 25415

SEQ ID NO: 698676 - RNA, 64 nt, Homo Sapiens; identical to SEQ ID NO: 25416

SEQ ID NO: 698677 - RNA, 64 nt, Homo Sapiens; identical to SEQ ID NO: 25417

SEQ ID NO: 698678 - RNA, 64 nt, Homo Sapiens; identical to SEQ ID NO: 25418

SEQ ID NO: 698679 - RNA, 64 nt, Homo Sapiens; identical to SEQ ID NO: 25419

SEQ ID NO: 698680 - RNA, 64 nt, Homo Sapiens; identical to SEQ ID NO: 25420

SEQ ID NO: 698681 - RNA, 64 nt, Homo Sapiens; identical to SEQ ID NO: 25421

SEQ ID NO: 698682 - RNA, 64 nt, Homo Sapiens; identical to SEQ ID NO: 25422

SEQ ID NO: 698683 - RNA, 64 nt, Homo Sapiens; identical to SEQ ID NO: 25423

SEQ ID NO: 698684 - RNA, 64 nt, Homo Sapiens; identical to SEQ ID NO: 25424

SEQ ID NO: 698685 - RNA, 64 nt, Homo Sapiens; identical to SEQ ID NO: 25425

SEQ ID NO: 698686 - RNA, 64 nt, Homo Sapiens; identical to SEQ ID NO: 25426

SEQ ID NO: 698687 - RNA, 64 nt, Homo Sapiens; identical to SEQ ID NO: 25427

SEQ ID NO: 698688 - RNA, 64 nt, Homo Sapiens; identical to SEQ ID NO: 25428

SEQ ID NO: 698689 - RNA, 64 nt, Homo Sapiens; identical to SEQ ID NO: 25429

SEQ ID NO: 698690 - RNA, 64 nt, Homo Sapiens; identical to SEQ ID NO: 25430

SEQ ID NO: 698691 - RNA, 64 nt, Homo Sapiens; identical to SEQ ID NO: 25431

SEQ ID NO: 698692 - RNA, 64 nt, Homo Sapiens; identical to SEQ ID NO: 25432

SEQ ID NO: 698693 - RNA, 64 nt, Homo Sapiens; identical to SEQ ID NO: 25433

SEQ ID NO: 698694 - RNA, 64 nt, Homo Sapiens; identical to SEQ ID NO: 25434

SEQ ID NO: 698695 - RNA, 64 nt, Homo Sapiens; identical to SEQ ID NO: 25435

SEQ ID NO: 698696 - RNA, 64 nt, Homo Sapiens; identical to SEQ ID NO: 25436

SEQ ID NO: 698697 - RNA, 64 nt, Homo Sapiens; identical to SEQ ID NO: 25437

SEQ ID NO: 698698 - RNA, 64 nt, Homo Sapiens; identical to SEQ ID NO: 25438

SEQ ID NO: 698699 - RNA, 64 nt, Homo Sapiens; identical to SEQ ID NO: 25439

SEQ ID NO: 698700 - RNA, 64 nt, Homo Sapiens; identical to SEQ ID NO: 25440

SEQ ID NO: 698701 - RNA, 64 nt, Homo Sapiens; identical to SEQ ID NO: 25441

SEQ ID NO: 698702 - RNA, 64 nt, Homo Sapiens; identical to SEQ ID NO: 25442

SEQ ID NO: 698703 - RNA, 64 nt, Homo Sapiens; identical to SEQ ID NO: 25443

SEQ ID NO: 698704 - RNA, 64 nt, Homo Sapiens; identical to SEQ ID NO: 25444

SEQ ID NO: 698705 - RNA, 64 nt, Homo Sapiens; identical to SEQ ID NO: 25445

SEQ ID NO: 698706 - RNA, 64 nt, Homo Sapiens; identical to SEQ ID NO: 25446

SEQ ID NO: 698707 - RNA, 64 nt, Homo Sapiens; identical to SEQ ID NO: 25447

SEQ ID NO: 698708 - RNA, 64 nt, Homo Sapiens; identical to SEQ ID NO: 25448

SEQ ID NO: 698709 - RNA, 64 nt, Homo Sapiens; identical to SEQ ID NO: 25449

SEQ ID NO: 698710 - RNA, 64 nt, Homo Sapiens; identical to SEQ ID NO: 25450

SEQ ID NO: 698711 - RNA, 64 nt, Homo Sapiens; identical to SEQ ID NO: 25451

SEQ ID NO: 698712 - RNA, 64 nt, Homo Sapiens; identical to SEQ ID NO: 25452

SEQ ID NO: 698713 - RNA, 64 nt, Homo Sapiens; identical to SEQ ID NO: 25453

SEQ ID NO: 698714 - RNA, 64 nt, Homo Sapiens; identical to SEQ ID NO: 25454

SEQ ID NO: 698715 - RNA, 64 nt, Homo Sapiens; identical to SEQ ID NO: 25455

SEQ ID NO: 698716 - RNA, 64 nt, Homo Sapiens; identical to SEQ ID NO: 25456

SEQ ID NO: 698717 - RNA, 64 nt, Homo Sapiens; identical to SEQ ID NO: 25457

SEQ ID NO: 698718 - RNA, 64 nt, Homo Sapiens; identical to SEQ ID NO: 25458

SEQ ID NO: 698719 - RNA, 64 nt, Homo Sapiens; identical to SEQ ID NO: 25459

SEQ ID NO: 698720 - RNA, 64 nt, Homo Sapiens; identical to SEQ ID NO: 25460

SEQ ID NO: 698721 - RNA, 64 nt, Homo Sapiens; identical to SEQ ID NO: 25461

SEQ ID NO: 698722 - RNA, 64 nt, Homo Sapiens; identical to SEQ ID NO: 25462

SEQ ID NO: 698723 - RNA, 64 nt, Homo Sapiens; identical to SEQ ID NO: 25463

SEQ ID NO: 698724 - RNA, 64 nt, Homo Sapiens; identical to SEQ ID NO: 25464

SEQ ID NO: 698725 - RNA, 64 nt, Homo Sapiens; identical to SEQ ID NO: 25465

SEQ ID NO: 698726 - RNA, 64 nt, Homo Sapiens; identical to SEQ ID NO: 25466

SEQ ID NO: 698727 - RNA, 64 nt, Homo Sapiens; identical to SEQ ID NO: 25467

SEQ ID NO: 698728 - RNA, 64 nt, Homo Sapiens; identical to SEQ ID NO: 25468

SEQ ID NO: 698729 - RNA, 64 nt, Homo Sapiens; identical to SEQ ID NO: 25469

SEQ ID NO: 698730 - RNA, 64 nt, Homo Sapiens; identical to SEQ ID NO: 25470

SEQ ID NO: 698731 - RNA, 64 nt, Homo Sapiens; identical to SEQ ID NO: 25471

SEQ ID NO: 698732 - RNA, 64 nt, Homo Sapiens; identical to SEQ ID NO: 25472

SEQ ID NO: 698733 - RNA, 64 nt, Homo Sapiens; identical to SEQ ID NO: 25473

SEQ ID NO: 698734 - RNA, 64 nt, Homo Sapiens; identical to SEQ ID NO: 25474

SEQ ID NO: 698735 - RNA, 64 nt, Homo Sapiens; identical to SEQ ID NO: 25475

SEQ ID NO: 698736 - RNA, 64 nt, Homo Sapiens; identical to SEQ ID NO: 25476

SEQ ID NO: 698737 - RNA, 64 nt, Homo Sapiens; identical to SEQ ID NO: 25477

SEQ ID NO: 698738 - RNA, 64 nt, Homo Sapiens; identical to SEQ ID NO: 25478

SEQ ID NO: 698739 - RNA, 64 nt, Homo Sapiens; identical to SEQ ID NO: 25479

SEQ ID NO: 698740 - RNA, 64 nt, Homo Sapiens; identical to SEQ ID NO: 25480

SEQ ID NO: 698741 - RNA, 64 nt, Homo Sapiens; identical to SEQ ID NO: 25481

SEQ ID NO: 698742 - RNA, 64 nt, Homo Sapiens; identical to SEQ ID NO: 25482

SEQ ID NO: 698743 - RNA, 64 nt, Homo Sapiens; identical to SEQ ID NO: 25483

SEQ ID NO: 698744 - RNA, 64 nt, Homo Sapiens; identical to SEQ ID NO: 25484

SEQ ID NO: 698745 - RNA, 64 nt, Homo Sapiens; identical to SEQ ID NO: 25485

SEQ ID NO: 698746 - RNA, 64 nt, Homo Sapiens; identical to SEQ ID NO: 25486

SEQ ID NO: 698747 - RNA, 64 nt, Homo Sapiens; identical to SEQ ID NO: 25487

SEQ ID NO: 698748 - RNA, 64 nt, Homo Sapiens; identical to SEQ ID NO: 25488

SEQ ID NO: 698749 - RNA, 64 nt, Homo Sapiens; identical to SEQ ID NO: 25489

SEQ ID NO: 698750 - RNA, 64 nt, Homo Sapiens; identical to SEQ ID NO: 25490

SEQ ID NO: 698751 - RNA, 64 nt, Homo Sapiens; identical to SEQ ID NO: 25491

SEQ ID NO: 698752 - RNA, 64 nt, Homo Sapiens; identical to SEQ ID NO: 25492

SEQ ID NO: 698753 - RNA, 64 nt, Homo Sapiens; identical to SEQ ID NO: 25493

SEQ ID NO: 698754 - RNA, 64 nt, Homo Sapiens; identical to SEQ ID NO: 25494

SEQ ID NO: 698755 - RNA, 64 nt, Homo Sapiens; identical to SEQ ID NO: 25495

SEQ ID NO: 698756 - RNA, 64 nt, Homo Sapiens; identical to SEQ ID NO: 25496

SEQ ID NO: 698757 - RNA, 64 nt, Homo Sapiens; identical to SEQ ID NO: 25497

SEQ ID NO: 698758 - RNA, 64 nt, Homo Sapiens; identical to SEQ ID NO: 25498

SEQ ID NO: 698759 - RNA, 64 nt, Homo Sapiens; identical to SEQ ID NO: 25499

SEQ ID NO: 698760 - RNA, 64 nt, Homo Sapiens; identical to SEQ ID NO: 25500

SEQ ID NO: 698761 - RNA, 64 nt, Homo Sapiens; identical to SEQ ID NO: 25501

SEQ ID NO: 698762 - RNA, 64 nt, Homo Sapiens; identical to SEQ ID NO: 25502

SEQ ID NO: 698763 - RNA, 64 nt, Homo Sapiens; identical to SEQ ID NO: 25503

SEQ ID NO: 698764 - RNA, 64 nt, Homo Sapiens; identical to SEQ ID NO: 25504

SEQ ID NO: 698765 - RNA, 64 nt, Homo Sapiens; identical to SEQ ID NO: 25505

SEQ ID NO: 698766 - RNA, 64 nt, Homo Sapiens; identical to SEQ ID NO: 25506

SEQ ID NO: 698767 - RNA, 64 nt, Homo Sapiens; identical to SEQ ID NO: 25507

SEQ ID NO: 698768 - RNA, 64 nt, Homo Sapiens; identical to SEQ ID NO: 25508

SEQ ID NO: 698769 - RNA, 64 nt, Homo Sapiens; identical to SEQ ID NO: 25509

SEQ ID NO: 698770 - RNA, 64 nt, Homo Sapiens; identical to SEQ ID NO: 25510

SEQ ID NO: 698771 - RNA, 64 nt, Homo Sapiens; identical to SEQ ID NO: 25511

SEQ ID NO: 698772 - RNA, 64 nt, Homo Sapiens; identical to SEQ ID NO: 25512

SEQ ID NO: 698773 - RNA, 64 nt, Homo Sapiens; identical to SEQ ID NO: 25513

SEQ ID NO: 698774 - RNA, 64 nt, Homo Sapiens; identical to SEQ ID NO: 25514

SEQ ID NO: 698775 - RNA, 64 nt, Homo Sapiens; identical to SEQ ID NO: 25515

SEQ ID NO: 698776 - RNA, 64 nt, Homo Sapiens; identical to SEQ ID NO: 25516

SEQ ID NO: 698777 - RNA, 64 nt, Homo Sapiens; identical to SEQ ID NO: 25517

SEQ ID NO: 698778 - RNA, 64 nt, Homo Sapiens; identical to SEQ ID NO: 25518

SEQ ID NO: 698779 - RNA, 64 nt, Homo Sapiens; identical to SEQ ID NO: 25519

SEQ ID NO: 698780 - RNA, 64 nt, Homo Sapiens; identical to SEQ ID NO: 25520

SEQ ID NO: 698781 - RNA, 64 nt, Homo Sapiens; identical to SEQ ID NO: 25521

SEQ ID NO: 698782 - RNA, 64 nt, Homo Sapiens; identical to SEQ ID NO: 25522

SEQ ID NO: 698783 - RNA, 64 nt, Homo Sapiens; identical to SEQ ID NO: 25523

SEQ ID NO: 698784 - RNA, 64 nt, Homo Sapiens; identical to SEQ ID NO: 25524

SEQ ID NO: 698785 - RNA, 64 nt, Homo Sapiens; identical to SEQ ID NO: 25525

SEQ ID NO: 698786 - RNA, 64 nt, Homo Sapiens; identical to SEQ ID NO: 25526

SEQ ID NO: 698787 - RNA, 64 nt, Homo Sapiens; identical to SEQ ID NO: 25527

SEQ ID NO: 698788 - RNA, 64 nt, Homo Sapiens; identical to SEQ ID NO: 25528

SEQ ID NO: 698789 - RNA, 64 nt, Homo Sapiens; identical to SEQ ID NO: 25529

SEQ ID NO: 698790 - RNA, 64 nt, Homo Sapiens; identical to SEQ ID NO: 25530

SEQ ID NO: 698791 - RNA, 64 nt, Homo Sapiens; identical to SEQ ID NO: 25531

SEQ ID NO: 698792 - RNA, 64 nt, Homo Sapiens; identical to SEQ ID NO: 25532

SEQ ID NO: 698793 - RNA, 64 nt, Homo Sapiens; identical to SEQ ID NO: 25533

SEQ ID NO: 698794 - RNA, 64 nt, Homo Sapiens; identical to SEQ ID NO: 25534

SEQ ID NO: 698795 - RNA, 64 nt, Homo Sapiens; identical to SEQ ID NO: 25535

SEQ ID NO: 698796 - RNA, 64 nt, Homo Sapiens; identical to SEQ ID NO: 25536

SEQ ID NO: 698797 - RNA, 64 nt, Homo Sapiens; identical to SEQ ID NO: 25537

SEQ ID NO: 698798 - RNA, 64 nt, Homo Sapiens; identical to SEQ ID NO: 25538

SEQ ID NO: 698799 - RNA, 64 nt, Homo Sapiens; identical to SEQ ID NO: 25539

SEQ ID NO: 698800 - RNA, 64 nt, Homo Sapiens; identical to SEQ ID NO: 25540

SEQ ID NO: 698801 - RNA, 64 nt, Homo Sapiens; identical to SEQ ID NO: 25541

SEQ ID NO: 698802 - RNA, 64 nt, Homo Sapiens; identical to SEQ ID NO: 25542

SEQ ID NO: 698803 - RNA, 64 nt, Homo Sapiens; identical to SEQ ID NO: 25543

SEQ ID NO: 698804 - RNA, 64 nt, Homo Sapiens; identical to SEQ ID NO: 25544

SEQ ID NO: 698805 - RNA, 64 nt, Homo Sapiens; identical to SEQ ID NO: 25545

SEQ ID NO: 698806 - RNA, 64 nt, Homo Sapiens; identical to SEQ ID NO: 25546

SEQ ID NO: 698807 - RNA, 64 nt, Homo Sapiens; identical to SEQ ID NO: 25547

SEQ ID NO: 698808 - RNA, 64 nt, Homo Sapiens; identical to SEQ ID NO: 25548

SEQ ID NO: 698809 - RNA, 64 nt, Homo Sapiens; identical to SEQ ID NO: 25549

SEQ ID NO: 698810 - RNA, 64 nt, Homo Sapiens; identical to SEQ ID NO: 25550

SEQ ID NO: 698811 - RNA, 64 nt, Homo Sapiens; identical to SEQ ID NO: 25551

SEQ ID NO: 698812 - RNA, 64 nt, Homo Sapiens; identical to SEQ ID NO: 25552

SEQ ID NO: 698813 - RNA, 64 nt, Homo Sapiens; identical to SEQ ID NO: 25553

SEQ ID NO: 698814 - RNA, 64 nt, Homo Sapiens; identical to SEQ ID NO: 25554

SEQ ID NO: 698815 - RNA, 64 nt, Homo Sapiens; identical to SEQ ID NO: 25555

SEQ ID NO: 698816 - RNA, 64 nt, Homo Sapiens; identical to SEQ ID NO: 25556

SEQ ID NO: 698817 - RNA, 64 nt, Homo Sapiens; identical to SEQ ID NO: 25557

SEQ ID NO: 698818 - RNA, 64 nt, Homo Sapiens; identical to SEQ ID NO: 25558

SEQ ID NO: 698819 - RNA, 64 nt, Homo Sapiens; identical to SEQ ID NO: 25559

SEQ ID NO: 698820 - RNA, 64 nt, Homo Sapiens; identical to SEQ ID NO: 25560

SEQ ID NO: 698821 - RNA, 63 nt, Homo Sapiens; identical to SEQ ID NO: 25561

SEQ ID NO: 698822 - RNA, 62 nt, Homo Sapiens; identical to SEQ ID NO: 25562

SEQ ID NO: 698823 - RNA, 64 nt, Homo Sapiens; identical to SEQ ID NO: 25563

SEQ ID NO: 698824 - RNA, 64 nt, Homo Sapiens; identical to SEQ ID NO: 25564

SEQ ID NO: 698825 - RNA, 64 nt, Homo Sapiens; identical to SEQ ID NO: 25565

SEQ ID NO: 698826 - RNA, 64 nt, Homo Sapiens; identical to SEQ ID NO: 25566

SEQ ID NO: 698827 - RNA, 64 nt, Homo Sapiens; identical to SEQ ID NO: 25567

SEQ ID NO: 698828 - RNA, 64 nt, Homo Sapiens; identical to SEQ ID NO: 25568

SEQ ID NO: 698829 - RNA, 64 nt, Homo Sapiens; identical to SEQ ID NO: 25569

SEQ ID NO: 698830 - RNA, 64 nt, Homo Sapiens; identical to SEQ ID NO: 25570

SEQ ID NO: 698831 - RNA, 64 nt, Homo Sapiens; identical to SEQ ID NO: 25571

SEQ ID NO: 698832 - RNA, 64 nt, Homo Sapiens; identical to SEQ ID NO: 25572

SEQ ID NO: 698833 - RNA, 64 nt, Homo Sapiens; identical to SEQ ID NO: 25573

SEQ ID NO: 698834 - RNA, 64 nt, Homo Sapiens; identical to SEQ ID NO: 25574

SEQ ID NO: 698835 - RNA, 64 nt, Homo Sapiens; identical to SEQ ID NO: 25575

SEQ ID NO: 698836 - RNA, 64 nt, Homo Sapiens; identical to SEQ ID NO: 25576

SEQ ID NO: 698837 - RNA, 64 nt, Homo Sapiens; identical to SEQ ID NO: 25577

SEQ ID NO: 698838 - RNA, 64 nt, Homo Sapiens; identical to SEQ ID NO: 25578

SEQ ID NO: 698839 - RNA, 64 nt, Homo Sapiens; identical to SEQ ID NO: 25579

SEQ ID NO: 698840 - RNA, 64 nt, Homo Sapiens; identical to SEQ ID NO: 25580

SEQ ID NO: 698841 - RNA, 64 nt, Homo Sapiens; identical to SEQ ID NO: 25581

SEQ ID NO: 698842 - RNA, 64 nt, Homo Sapiens; identical to SEQ ID NO: 25582

SEQ ID NO: 698843 - RNA, 64 nt, Homo Sapiens; identical to SEQ ID NO: 25583

SEQ ID NO: 698844 - RNA, 64 nt, Homo Sapiens; identical to SEQ ID NO: 25584

SEQ ID NO: 698845 - RNA, 64 nt, Homo Sapiens; identical to SEQ ID NO: 25585

SEQ ID NO: 698846 - RNA, 64 nt, Homo Sapiens; identical to SEQ ID NO: 25586

SEQ ID NO: 698847 - RNA, 64 nt, Homo Sapiens; identical to SEQ ID NO: 25587

SEQ ID NO: 698848 - RNA, 64 nt, Homo Sapiens; identical to SEQ ID NO: 25588

SEQ ID NO: 698849 - RNA, 64 nt, Homo Sapiens; identical to SEQ ID NO: 25589

SEQ ID NO: 698850 - RNA, 64 nt, Homo Sapiens; identical to SEQ ID NO: 25590

SEQ ID NO: 698851 - RNA, 64 nt, Homo Sapiens; identical to SEQ ID NO: 25591

SEQ ID NO: 698852 - RNA, 64 nt, Homo Sapiens; identical to SEQ ID NO: 25592

SEQ ID NO: 698853 - RNA, 64 nt, Homo Sapiens; identical to SEQ ID NO: 25593

SEQ ID NO: 698854 - RNA, 64 nt, Homo Sapiens; identical to SEQ ID NO: 25594

SEQ ID NO: 698855 - RNA, 64 nt, Homo Sapiens; identical to SEQ ID NO: 25595

SEQ ID NO: 698856 - RNA, 64 nt, Homo Sapiens; identical to SEQ ID NO: 25596

SEQ ID NO: 698857 - RNA, 64 nt, Homo Sapiens; identical to SEQ ID NO: 25597

SEQ ID NO: 698858 - RNA, 64 nt, Homo Sapiens; identical to SEQ ID NO: 25598

SEQ ID NO: 698859 - RNA, 64 nt, Homo Sapiens; identical to SEQ ID NO: 25599

SEQ ID NO: 698860 - RNA, 64 nt, Homo Sapiens; identical to SEQ ID NO: 25600

SEQ ID NO: 698861 - RNA, 64 nt, Homo Sapiens; identical to SEQ ID NO: 25601

SEQ ID NO: 698862 - RNA, 64 nt, Homo Sapiens; identical to SEQ ID NO: 25602

SEQ ID NO: 698863 - RNA, 64 nt, Homo Sapiens; identical to SEQ ID NO: 25603

SEQ ID NO: 698864 - RNA, 64 nt, Homo Sapiens; identical to SEQ ID NO: 25604

SEQ ID NO: 698865 - RNA, 64 nt, Homo Sapiens; identical to SEQ ID NO: 25605

SEQ ID NO: 698866 - RNA, 64 nt, Homo Sapiens; identical to SEQ ID NO: 25606

SEQ ID NO: 698867 - RNA, 64 nt, Homo Sapiens; identical to SEQ ID NO: 25607

SEQ ID NO: 698868 - RNA, 64 nt, Homo Sapiens; identical to SEQ ID NO: 25608

SEQ ID NO: 698869 - RNA, 64 nt, Homo Sapiens; identical to SEQ ID NO: 25609

SEQ ID NO: 698870 - RNA, 64 nt, Homo Sapiens; identical to SEQ ID NO: 25610

SEQ ID NO: 698871 - RNA, 64 nt, Homo Sapiens; identical to SEQ ID NO: 25611

SEQ ID NO: 698872 - RNA, 64 nt, Homo Sapiens; identical to SEQ ID NO: 25612

SEQ ID NO: 698873 - RNA, 64 nt, Homo Sapiens; identical to SEQ ID NO: 25613

SEQ ID NO: 698874 - RNA, 64 nt, Homo Sapiens; identical to SEQ ID NO: 25614

SEQ ID NO: 698875 - RNA, 64 nt, Homo Sapiens; identical to SEQ ID NO: 25615

SEQ ID NO: 698876 - RNA, 64 nt, Homo Sapiens; identical to SEQ ID NO: 25616

SEQ ID NO: 698877 - RNA, 64 nt, Homo Sapiens; identical to SEQ ID NO: 25617

SEQ ID NO: 698878 - RNA, 64 nt, Homo Sapiens; identical to SEQ ID NO: 25618

SEQ ID NO: 698879 - RNA, 64 nt, Homo Sapiens; identical to SEQ ID NO: 25619

SEQ ID NO: 698880 - RNA, 64 nt, Homo Sapiens; identical to SEQ ID NO: 25620

SEQ ID NO: 698881 - RNA, 64 nt, Homo Sapiens; identical to SEQ ID NO: 25621

SEQ ID NO: 698882 - RNA, 64 nt, Homo Sapiens; identical to SEQ ID NO: 25622

SEQ ID NO: 698883 - RNA, 64 nt, Homo Sapiens; identical to SEQ ID NO: 25623

SEQ ID NO: 698884 - RNA, 64 nt, Homo Sapiens; identical to SEQ ID NO: 25624

SEQ ID NO: 698885 - RNA, 64 nt, Homo Sapiens; identical to SEQ ID NO: 25625

SEQ ID NO: 698886 - RNA, 64 nt, Homo Sapiens; identical to SEQ ID NO: 25626

SEQ ID NO: 698887 - RNA, 64 nt, Homo Sapiens; identical to SEQ ID NO: 25627

SEQ ID NO: 698888 - RNA, 64 nt, Homo Sapiens; identical to SEQ ID NO: 25628

SEQ ID NO: 698889 - RNA, 64 nt, Homo Sapiens; identical to SEQ ID NO: 25629

SEQ ID NO: 698890 - RNA, 64 nt, Homo Sapiens; identical to SEQ ID NO: 25630

SEQ ID NO: 698891 - RNA, 64 nt, Homo Sapiens; identical to SEQ ID NO: 25631

SEQ ID NO: 698892 - RNA, 64 nt, Homo Sapiens; identical to SEQ ID NO: 25632

SEQ ID NO: 698893 - RNA, 64 nt, Homo Sapiens; identical to SEQ ID NO: 25633

SEQ ID NO: 698894 - RNA, 64 nt, Homo Sapiens; identical to SEQ ID NO: 25634

SEQ ID NO: 698895 - RNA, 64 nt, Homo Sapiens; identical to SEQ ID NO: 25635

SEQ ID NO: 698896 - RNA, 64 nt, Homo Sapiens; identical to SEQ ID NO: 25636

SEQ ID NO: 698897 - RNA, 64 nt, Homo Sapiens; identical to SEQ ID NO: 25637

SEQ ID NO: 698898 - RNA, 64 nt, Homo Sapiens; identical to SEQ ID NO: 25638

SEQ ID NO: 698899 - RNA, 64 nt, Homo Sapiens; identical to SEQ ID NO: 25639

SEQ ID NO: 698900 - RNA, 64 nt, Homo Sapiens; identical to SEQ ID NO: 25640

SEQ ID NO: 698901 - RNA, 64 nt, Homo Sapiens; identical to SEQ ID NO: 25641

SEQ ID NO: 698902 - RNA, 64 nt, Homo Sapiens; identical to SEQ ID NO: 25642

SEQ ID NO: 698903 - RNA, 64 nt, Homo Sapiens; identical to SEQ ID NO: 25643

SEQ ID NO: 698904 - RNA, 64 nt, Homo Sapiens; identical to SEQ ID NO: 25644

SEQ ID NO: 698905 - RNA, 64 nt, Homo Sapiens; identical to SEQ ID NO: 25645

SEQ ID NO: 698906 - RNA, 64 nt, Homo Sapiens; identical to SEQ ID NO: 25646

SEQ ID NO: 698907 - RNA, 64 nt, Homo Sapiens; identical to SEQ ID NO: 25647

SEQ ID NO: 698908 - RNA, 64 nt, Homo Sapiens; identical to SEQ ID NO: 25648

SEQ ID NO: 698909 - RNA, 64 nt, Homo Sapiens; identical to SEQ ID NO: 25649

SEQ ID NO: 698910 - RNA, 64 nt, Homo Sapiens; identical to SEQ ID NO: 25650

SEQ ID NO: 698911 - RNA, 64 nt, Homo Sapiens; identical to SEQ ID NO: 25651

SEQ ID NO: 698912 - RNA, 64 nt, Homo Sapiens; identical to SEQ ID NO: 25652

SEQ ID NO: 698913 - RNA, 64 nt, Homo Sapiens; identical to SEQ ID NO: 25653

SEQ ID NO: 698914 - RNA, 64 nt, Homo Sapiens; identical to SEQ ID NO: 25654

SEQ ID NO: 698915 - RNA, 64 nt, Homo Sapiens; identical to SEQ ID NO: 25655

SEQ ID NO: 698916 - RNA, 64 nt, Homo Sapiens; identical to SEQ ID NO: 25656

SEQ ID NO: 698917 - RNA, 64 nt, Homo Sapiens; identical to SEQ ID NO: 25657

SEQ ID NO: 698918 - RNA, 64 nt, Homo Sapiens; identical to SEQ ID NO: 25658

SEQ ID NO: 698919 - RNA, 64 nt, Homo Sapiens; identical to SEQ ID NO: 25659

SEQ ID NO: 698920 - RNA, 64 nt, Homo Sapiens; identical to SEQ ID NO: 25660

SEQ ID NO: 698921 - RNA, 64 nt, Homo Sapiens; identical to SEQ ID NO: 25661

SEQ ID NO: 698922 - RNA, 64 nt, Homo Sapiens; identical to SEQ ID NO: 25662

SEQ ID NO: 698923 - RNA, 64 nt, Homo Sapiens; identical to SEQ ID NO: 25663

SEQ ID NO: 698924 - RNA, 64 nt, Homo Sapiens; identical to SEQ ID NO: 25664

SEQ ID NO: 698925 - RNA, 64 nt, Homo Sapiens; identical to SEQ ID NO: 25665

SEQ ID NO: 698926 - RNA, 64 nt, Homo Sapiens; identical to SEQ ID NO: 25666

SEQ ID NO: 698927 - RNA, 64 nt, Homo Sapiens; identical to SEQ ID NO: 25667

SEQ ID NO: 698928 - RNA, 64 nt, Homo Sapiens; identical to SEQ ID NO: 25668

SEQ ID NO: 698929 - RNA, 64 nt, Homo Sapiens; identical to SEQ ID NO: 25669

SEQ ID NO: 698930 - RNA, 64 nt, Homo Sapiens; identical to SEQ ID NO: 25670

SEQ ID NO: 698931 - RNA, 64 nt, Homo Sapiens; identical to SEQ ID NO: 25671

SEQ ID NO: 698932 - RNA, 64 nt, Homo Sapiens; identical to SEQ ID NO: 25672

SEQ ID NO: 698933 - RNA, 64 nt, Homo Sapiens; identical to SEQ ID NO: 25673

SEQ ID NO: 698934 - RNA, 64 nt, Homo Sapiens; identical to SEQ ID NO: 25674

SEQ ID NO: 698935 - RNA, 64 nt, Homo Sapiens; identical to SEQ ID NO: 25675

SEQ ID NO: 698936 - RNA, 64 nt, Homo Sapiens; identical to SEQ ID NO: 25676

SEQ ID NO: 698937 - RNA, 64 nt, Homo Sapiens; identical to SEQ ID NO: 25677

SEQ ID NO: 698938 - RNA, 64 nt, Homo Sapiens; identical to SEQ ID NO: 25678

SEQ ID NO: 698939 - RNA, 64 nt, Homo Sapiens; identical to SEQ ID NO: 25679

SEQ ID NO: 698940 - RNA, 64 nt, Homo Sapiens; identical to SEQ ID NO: 25680

SEQ ID NO: 698941 - RNA, 64 nt, Homo Sapiens; identical to SEQ ID NO: 25681

SEQ ID NO: 698942 - RNA, 64 nt, Homo Sapiens; identical to SEQ ID NO: 25682

SEQ ID NO: 698943 - RNA, 64 nt, Homo Sapiens; identical to SEQ ID NO: 25683

SEQ ID NO: 698944 - RNA, 64 nt, Homo Sapiens; identical to SEQ ID NO: 25684

SEQ ID NO: 698945 - RNA, 64 nt, Homo Sapiens; identical to SEQ ID NO: 25685

SEQ ID NO: 698946 - RNA, 64 nt, Homo Sapiens; identical to SEQ ID NO: 25686

SEQ ID NO: 698947 - RNA, 64 nt, Homo Sapiens; identical to SEQ ID NO: 25687

SEQ ID NO: 698948 - RNA, 64 nt, Homo Sapiens; identical to SEQ ID NO: 25688

SEQ ID NO: 698949 - RNA, 64 nt, Homo Sapiens; identical to SEQ ID NO: 25689

SEQ ID NO: 698950 - RNA, 64 nt, Homo Sapiens; identical to SEQ ID NO: 25690

SEQ ID NO: 698951 - RNA, 64 nt, Homo Sapiens; identical to SEQ ID NO: 25691

SEQ ID NO: 698952 - RNA, 64 nt, Homo Sapiens; identical to SEQ ID NO: 25692

SEQ ID NO: 698953 - RNA, 64 nt, Homo Sapiens; identical to SEQ ID NO: 25693

SEQ ID NO: 698954 - RNA, 64 nt, Homo Sapiens; identical to SEQ ID NO: 25694

SEQ ID NO: 698955 - RNA, 64 nt, Homo Sapiens; identical to SEQ ID NO: 25695

SEQ ID NO: 698956 - RNA, 64 nt, Homo Sapiens; identical to SEQ ID NO: 25696

SEQ ID NO: 698957 - RNA, 64 nt, Homo Sapiens; identical to SEQ ID NO: 25697

SEQ ID NO: 698958 - RNA, 64 nt, Homo Sapiens; identical to SEQ ID NO: 25698

SEQ ID NO: 698959 - RNA, 64 nt, Homo Sapiens; identical to SEQ ID NO: 25699

SEQ ID NO: 698960 - RNA, 64 nt, Homo Sapiens; identical to SEQ ID NO: 25700

SEQ ID NO: 698961 - RNA, 64 nt, Homo Sapiens; identical to SEQ ID NO: 25701

SEQ ID NO: 698962 - RNA, 64 nt, Homo Sapiens; identical to SEQ ID NO: 25702

SEQ ID NO: 698963 - RNA, 64 nt, Homo Sapiens; identical to SEQ ID NO: 25703

SEQ ID NO: 698964 - RNA, 64 nt, Homo Sapiens; identical to SEQ ID NO: 25704

SEQ ID NO: 698965 - RNA, 64 nt, Homo Sapiens; identical to SEQ ID NO: 25705

SEQ ID NO: 698966 - RNA, 64 nt, Homo Sapiens; identical to SEQ ID NO: 25706

SEQ ID NO: 698967 - RNA, 64 nt, Homo Sapiens; identical to SEQ ID NO: 25707

SEQ ID NO: 698968 - RNA, 64 nt, Homo Sapiens; identical to SEQ ID NO: 25708

SEQ ID NO: 698969 - RNA, 64 nt, Homo Sapiens; identical to SEQ ID NO: 25709

SEQ ID NO: 698970 - RNA, 64 nt, Homo Sapiens; identical to SEQ ID NO: 25710

SEQ ID NO: 698971 - RNA, 64 nt, Homo Sapiens; identical to SEQ ID NO: 25711

SEQ ID NO: 698972 - RNA, 64 nt, Homo Sapiens; identical to SEQ ID NO: 25712

SEQ ID NO: 698973 - RNA, 64 nt, Homo Sapiens; identical to SEQ ID NO: 25713

SEQ ID NO: 698974 - RNA, 64 nt, Homo Sapiens; identical to SEQ ID NO: 25714

SEQ ID NO: 698975 - RNA, 64 nt, Homo Sapiens; identical to SEQ ID NO: 25715

SEQ ID NO: 698976 - RNA, 64 nt, Homo Sapiens; identical to SEQ ID NO: 25716

SEQ ID NO: 698977 - RNA, 64 nt, Homo Sapiens; identical to SEQ ID NO: 25717

SEQ ID NO: 698978 - RNA, 64 nt, Homo Sapiens; identical to SEQ ID NO: 25718

SEQ ID NO: 698979 - RNA, 64 nt, Homo Sapiens; identical to SEQ ID NO: 25719

SEQ ID NO: 698980 - RNA, 64 nt, Homo Sapiens; identical to SEQ ID NO: 25720

SEQ ID NO: 698981 - RNA, 64 nt, Homo Sapiens; identical to SEQ ID NO: 25721

SEQ ID NO: 698982 - RNA, 64 nt, Homo Sapiens; identical to SEQ ID NO: 25722

SEQ ID NO: 698983 - RNA, 64 nt, Homo Sapiens; identical to SEQ ID NO: 25723

SEQ ID NO: 698984 - RNA, 64 nt, Homo Sapiens; identical to SEQ ID NO: 25724

SEQ ID NO: 698985 - RNA, 64 nt, Homo Sapiens; identical to SEQ ID NO: 25725

SEQ ID NO: 698986 - RNA, 64 nt, Homo Sapiens; identical to SEQ ID NO: 25726

SEQ ID NO: 698987 - RNA, 64 nt, Homo Sapiens; identical to SEQ ID NO: 25727

SEQ ID NO: 698988 - RNA, 64 nt, Homo Sapiens; identical to SEQ ID NO: 25728

SEQ ID NO: 698989 - RNA, 64 nt, Homo Sapiens; identical to SEQ ID NO: 25729

SEQ ID NO: 698990 - RNA, 64 nt, Homo Sapiens; identical to SEQ ID NO: 25730

SEQ ID NO: 698991 - RNA, 64 nt, Homo Sapiens; identical to SEQ ID NO: 25731

SEQ ID NO: 698992 - RNA, 64 nt, Homo Sapiens; identical to SEQ ID NO: 25732

SEQ ID NO: 698993 - RNA, 64 nt, Homo Sapiens; identical to SEQ ID NO: 25733

SEQ ID NO: 698994 - RNA, 64 nt, Homo Sapiens; identical to SEQ ID NO: 25734

SEQ ID NO: 698995 - RNA, 64 nt, Homo Sapiens; identical to SEQ ID NO: 25735

SEQ ID NO: 698996 - RNA, 64 nt, Homo Sapiens; identical to SEQ ID NO: 25736

SEQ ID NO: 698997 - RNA, 64 nt, Homo Sapiens; identical to SEQ ID NO: 25737

SEQ ID NO: 698998 - RNA, 64 nt, Homo Sapiens; identical to SEQ ID NO: 25738

SEQ ID NO: 698999 - RNA, 64 nt, Homo Sapiens; identical to SEQ ID NO: 25739

SEQ ID NO: 699000 - RNA, 64 nt, Homo Sapiens; identical to SEQ ID NO: 25740

SEQ ID NO: 699001 - RNA, 64 nt, Homo Sapiens; identical to SEQ ID NO: 25741

SEQ ID NO: 699002 - RNA, 64 nt, Homo Sapiens; identical to SEQ ID NO: 25742

SEQ ID NO: 699003 - RNA, 64 nt, Homo Sapiens; identical to SEQ ID NO: 25743

SEQ ID NO: 699004 - RNA, 64 nt, Homo Sapiens; identical to SEQ ID NO: 25744

SEQ ID NO: 699005 - RNA, 64 nt, Homo Sapiens; identical to SEQ ID NO: 25745

SEQ ID NO: 699006 - RNA, 64 nt, Homo Sapiens; identical to SEQ ID NO: 25746

SEQ ID NO: 699007 - RNA, 64 nt, Homo Sapiens; identical to SEQ ID NO: 25747

SEQ ID NO: 699008 - RNA, 64 nt, Homo Sapiens; identical to SEQ ID NO: 25748

SEQ ID NO: 699009 - RNA, 64 nt, Homo Sapiens; identical to SEQ ID NO: 25749

SEQ ID NO: 699010 - RNA, 64 nt, Homo Sapiens; identical to SEQ ID NO: 25750

SEQ ID NO: 699011 - RNA, 64 nt, Homo Sapiens; identical to SEQ ID NO: 25751

SEQ ID NO: 699012 - RNA, 64 nt, Homo Sapiens; identical to SEQ ID NO: 25752

SEQ ID NO: 699013 - RNA, 64 nt, Homo Sapiens; identical to SEQ ID NO: 25753

SEQ ID NO: 699014 - RNA, 64 nt, Homo Sapiens; identical to SEQ ID NO: 25754

SEQ ID NO: 699015 - RNA, 64 nt, Homo Sapiens; identical to SEQ ID NO: 25755

SEQ ID NO: 699016 - RNA, 64 nt, Homo Sapiens; identical to SEQ ID NO: 25756

SEQ ID NO: 699017 - RNA, 64 nt, Homo Sapiens; identical to SEQ ID NO: 25757

SEQ ID NO: 699018 - RNA, 64 nt, Homo Sapiens; identical to SEQ ID NO: 25758

SEQ ID NO: 699019 - RNA, 64 nt, Homo Sapiens; identical to SEQ ID NO: 25759

SEQ ID NO: 699020 - RNA, 64 nt, Homo Sapiens; identical to SEQ ID NO: 25760

SEQ ID NO: 699021 - RNA, 64 nt, Homo Sapiens; identical to SEQ ID NO: 25761

SEQ ID NO: 699022 - RNA, 64 nt, Homo Sapiens; identical to SEQ ID NO: 25762

SEQ ID NO: 699023 - RNA, 64 nt, Homo Sapiens; identical to SEQ ID NO: 25763

SEQ ID NO: 699024 - RNA, 64 nt, Homo Sapiens; identical to SEQ ID NO: 25764

SEQ ID NO: 699025 - RNA, 64 nt, Homo Sapiens; identical to SEQ ID NO: 25765

SEQ ID NO: 699026 - RNA, 64 nt, Homo Sapiens; identical to SEQ ID NO: 25766

SEQ ID NO: 699027 - RNA, 64 nt, Homo Sapiens; identical to SEQ ID NO: 25767

SEQ ID NO: 699028 - RNA, 64 nt, Homo Sapiens; identical to SEQ ID NO: 25768

SEQ ID NO: 699029 - RNA, 64 nt, Homo Sapiens; identical to SEQ ID NO: 25769

SEQ ID NO: 699030 - RNA, 64 nt, Homo Sapiens; identical to SEQ ID NO: 25770

SEQ ID NO: 699031 - RNA, 64 nt, Homo Sapiens; identical to SEQ ID NO: 25771

SEQ ID NO: 699032 - RNA, 64 nt, Homo Sapiens; identical to SEQ ID NO: 25772

SEQ ID NO: 699033 - RNA, 64 nt, Homo Sapiens; identical to SEQ ID NO: 25773

SEQ ID NO: 699034 - RNA, 64 nt, Homo Sapiens; identical to SEQ ID NO: 25774

SEQ ID NO: 699035 - RNA, 64 nt, Homo Sapiens; identical to SEQ ID NO: 25775

SEQ ID NO: 699036 - RNA, 64 nt, Homo Sapiens; identical to SEQ ID NO: 25776

SEQ ID NO: 699037 - RNA, 64 nt, Homo Sapiens; identical to SEQ ID NO: 25777

SEQ ID NO: 699038 - RNA, 64 nt, Homo Sapiens; identical to SEQ ID NO: 25778

SEQ ID NO: 699039 - RNA, 64 nt, Homo Sapiens; identical to SEQ ID NO: 25779

SEQ ID NO: 699040 - RNA, 64 nt, Homo Sapiens; identical to SEQ ID NO: 25780

SEQ ID NO: 699041 - RNA, 64 nt, Homo Sapiens; identical to SEQ ID NO: 25781

SEQ ID NO: 699042 - RNA, 64 nt, Homo Sapiens; identical to SEQ ID NO: 25782

SEQ ID NO: 699043 - RNA, 64 nt, Homo Sapiens; identical to SEQ ID NO: 25783

SEQ ID NO: 699044 - RNA, 64 nt, Homo Sapiens; identical to SEQ ID NO: 25784

SEQ ID NO: 699045 - RNA, 64 nt, Homo Sapiens; identical to SEQ ID NO: 25785

SEQ ID NO: 699046 - RNA, 64 nt, Homo Sapiens; identical to SEQ ID NO: 25786

SEQ ID NO: 699047 - RNA, 64 nt, Homo Sapiens; identical to SEQ ID NO: 25787

SEQ ID NO: 699048 - RNA, 64 nt, Homo Sapiens; identical to SEQ ID NO: 25788

SEQ ID NO: 699049 - RNA, 64 nt, Homo Sapiens; identical to SEQ ID NO: 25789

SEQ ID NO: 699050 - RNA, 64 nt, Homo Sapiens; identical to SEQ ID NO: 25790

SEQ ID NO: 699051 - RNA, 64 nt, Homo Sapiens; identical to SEQ ID NO: 25791

SEQ ID NO: 699052 - RNA, 64 nt, Homo Sapiens; identical to SEQ ID NO: 25792

SEQ ID NO: 699053 - RNA, 64 nt, Homo Sapiens; identical to SEQ ID NO: 25793

SEQ ID NO: 699054 - RNA, 64 nt, Homo Sapiens; identical to SEQ ID NO: 25794

SEQ ID NO: 699055 - RNA, 64 nt, Homo Sapiens; identical to SEQ ID NO: 25795

SEQ ID NO: 699056 - RNA, 64 nt, Homo Sapiens; identical to SEQ ID NO: 25796

SEQ ID NO: 699057 - RNA, 64 nt, Homo Sapiens; identical to SEQ ID NO: 25797

SEQ ID NO: 699058 - RNA, 64 nt, Homo Sapiens; identical to SEQ ID NO: 25798

SEQ ID NO: 699059 - RNA, 64 nt, Homo Sapiens; identical to SEQ ID NO: 25799

SEQ ID NO: 699060 - RNA, 64 nt, Homo Sapiens; identical to SEQ ID NO: 25800

SEQ ID NO: 699061 - RNA, 64 nt, Homo Sapiens; identical to SEQ ID NO: 25801

SEQ ID NO: 699062 - RNA, 64 nt, Homo Sapiens; identical to SEQ ID NO: 25802

SEQ ID NO: 699063 - RNA, 64 nt, Homo Sapiens; identical to SEQ ID NO: 25803

SEQ ID NO: 699064 - RNA, 64 nt, Homo Sapiens; identical to SEQ ID NO: 25804

SEQ ID NO: 699065 - RNA, 64 nt, Homo Sapiens; identical to SEQ ID NO: 25805

SEQ ID NO: 699066 - RNA, 64 nt, Homo Sapiens; identical to SEQ ID NO: 25806

SEQ ID NO: 699067 - RNA, 64 nt, Homo Sapiens; identical to SEQ ID NO: 25807

SEQ ID NO: 699068 - RNA, 64 nt, Homo Sapiens; identical to SEQ ID NO: 25808

SEQ ID NO: 699069 - RNA, 64 nt, Homo Sapiens; identical to SEQ ID NO: 25809

SEQ ID NO: 699070 - RNA, 64 nt, Homo Sapiens; identical to SEQ ID NO: 25810

SEQ ID NO: 699071 - RNA, 64 nt, Homo Sapiens; identical to SEQ ID NO: 25811

SEQ ID NO: 699072 - RNA, 64 nt, Homo Sapiens; identical to SEQ ID NO: 25812

SEQ ID NO: 699073 - RNA, 64 nt, Homo Sapiens; identical to SEQ ID NO: 25813

SEQ ID NO: 699074 - RNA, 64 nt, Homo Sapiens; identical to SEQ ID NO: 25814

SEQ ID NO: 699075 - RNA, 64 nt, Homo Sapiens; identical to SEQ ID NO: 25815

SEQ ID NO: 699076 - RNA, 64 nt, Homo Sapiens; identical to SEQ ID NO: 25816

SEQ ID NO: 699077 - RNA, 64 nt, Homo Sapiens; identical to SEQ ID NO: 25817

SEQ ID NO: 699078 - RNA, 64 nt, Homo Sapiens; identical to SEQ ID NO: 25818

SEQ ID NO: 699079 - RNA, 64 nt, Homo Sapiens; identical to SEQ ID NO: 25819

SEQ ID NO: 699080 - RNA, 64 nt, Homo Sapiens; identical to SEQ ID NO: 25820

SEQ ID NO: 699081 - RNA, 64 nt, Homo Sapiens; identical to SEQ ID NO: 25821

SEQ ID NO: 699082 - RNA, 62 nt, Homo Sapiens; identical to SEQ ID NO: 25822

SEQ ID NO: 699083 - RNA, 64 nt, Homo Sapiens; identical to SEQ ID NO: 25823

SEQ ID NO: 699084 - RNA, 64 nt, Homo Sapiens; identical to SEQ ID NO: 25824

SEQ ID NO: 699085 - RNA, 64 nt, Homo Sapiens; identical to SEQ ID NO: 25825

SEQ ID NO: 699086 - RNA, 64 nt, Homo Sapiens; identical to SEQ ID NO: 25826

SEQ ID NO: 699087 - RNA, 64 nt, Homo Sapiens; identical to SEQ ID NO: 25827

SEQ ID NO: 699088 - RNA, 64 nt, Homo Sapiens; identical to SEQ ID NO: 25828

SEQ ID NO: 699089 - RNA, 64 nt, Homo Sapiens; identical to SEQ ID NO: 25829

SEQ ID NO: 699090 - RNA, 64 nt, Homo Sapiens; identical to SEQ ID NO: 25830

SEQ ID NO: 699091 - RNA, 64 nt, Homo Sapiens; identical to SEQ ID NO: 25831

SEQ ID NO: 699092 - RNA, 64 nt, Homo Sapiens; identical to SEQ ID NO: 25832

SEQ ID NO: 699093 - RNA, 64 nt, Homo Sapiens; identical to SEQ ID NO: 25833

SEQ ID NO: 699094 - RNA, 64 nt, Homo Sapiens; identical to SEQ ID NO: 25834

SEQ ID NO: 699095 - RNA, 64 nt, Homo Sapiens; identical to SEQ ID NO: 25835

SEQ ID NO: 699096 - RNA, 64 nt, Homo Sapiens; identical to SEQ ID NO: 25836

SEQ ID NO: 699097 - RNA, 64 nt, Homo Sapiens; identical to SEQ ID NO: 25837

SEQ ID NO: 699098 - RNA, 64 nt, Homo Sapiens; identical to SEQ ID NO: 25838

SEQ ID NO: 699099 - RNA, 64 nt, Homo Sapiens; identical to SEQ ID NO: 25839

SEQ ID NO: 699100 - RNA, 64 nt, Homo Sapiens; identical to SEQ ID NO: 25840

SEQ ID NO: 699101 - RNA, 64 nt, Homo Sapiens; identical to SEQ ID NO: 25841

SEQ ID NO: 699102 - RNA, 64 nt, Homo Sapiens; identical to SEQ ID NO: 25842

SEQ ID NO: 699103 - RNA, 64 nt, Homo Sapiens; identical to SEQ ID NO: 25843

SEQ ID NO: 699104 - RNA, 64 nt, Homo Sapiens; identical to SEQ ID NO: 25844

SEQ ID NO: 699105 - RNA, 64 nt, Homo Sapiens; identical to SEQ ID NO: 25845

SEQ ID NO: 699106 - RNA, 64 nt, Homo Sapiens; identical to SEQ ID NO: 25846

SEQ ID NO: 699107 - RNA, 64 nt, Homo Sapiens; identical to SEQ ID NO: 25847

SEQ ID NO: 699108 - RNA, 64 nt, Homo Sapiens; identical to SEQ ID NO: 25848

SEQ ID NO: 699109 - RNA, 64 nt, Homo Sapiens; identical to SEQ ID NO: 25849

SEQ ID NO: 699110 - RNA, 64 nt, Homo Sapiens; identical to SEQ ID NO: 25850

SEQ ID NO: 699111 - RNA, 64 nt, Homo Sapiens; identical to SEQ ID NO: 25851

SEQ ID NO: 699112 - RNA, 64 nt, Homo Sapiens; identical to SEQ ID NO: 25852

SEQ ID NO: 699113 - RNA, 64 nt, Homo Sapiens; identical to SEQ ID NO: 25853

SEQ ID NO: 699114 - RNA, 64 nt, Homo Sapiens; identical to SEQ ID NO: 25854

SEQ ID NO: 699115 - RNA, 64 nt, Homo Sapiens; identical to SEQ ID NO: 25855

SEQ ID NO: 699116 - RNA, 64 nt, Homo Sapiens; identical to SEQ ID NO: 25856

SEQ ID NO: 699117 - RNA, 64 nt, Homo Sapiens; identical to SEQ ID NO: 25857

SEQ ID NO: 699118 - RNA, 64 nt, Homo Sapiens; identical to SEQ ID NO: 25858

SEQ ID NO: 699119 - RNA, 64 nt, Homo Sapiens; identical to SEQ ID NO: 25859

SEQ ID NO: 699120 - RNA, 64 nt, Homo Sapiens; identical to SEQ ID NO: 25860

SEQ ID NO: 699121 - RNA, 64 nt, Homo Sapiens; identical to SEQ ID NO: 25861

SEQ ID NO: 699122 - RNA, 64 nt, Homo Sapiens; identical to SEQ ID NO: 25862

SEQ ID NO: 699123 - RNA, 64 nt, Homo Sapiens; identical to SEQ ID NO: 25863

SEQ ID NO: 699124 - RNA, 64 nt, Homo Sapiens; identical to SEQ ID NO: 25864

SEQ ID NO: 699125 - RNA, 64 nt, Homo Sapiens; identical to SEQ ID NO: 25865

SEQ ID NO: 699126 - RNA, 64 nt, Homo Sapiens; identical to SEQ ID NO: 25866

SEQ ID NO: 699127 - RNA, 64 nt, Homo Sapiens; identical to SEQ ID NO: 25867

SEQ ID NO: 699128 - RNA, 64 nt, Homo Sapiens; identical to SEQ ID NO: 25868

SEQ ID NO: 699129 - RNA, 64 nt, Homo Sapiens; identical to SEQ ID NO: 25869

SEQ ID NO: 699130 - RNA, 64 nt, Homo Sapiens; identical to SEQ ID NO: 25870

SEQ ID NO: 699131 - RNA, 64 nt, Homo Sapiens; identical to SEQ ID NO: 25871

SEQ ID NO: 699132 - RNA, 64 nt, Homo Sapiens; identical to SEQ ID NO: 25872

SEQ ID NO: 699133 - RNA, 64 nt, Homo Sapiens; identical to SEQ ID NO: 25873

SEQ ID NO: 699134 - RNA, 64 nt, Homo Sapiens; identical to SEQ ID NO: 25874

SEQ ID NO: 699135 - RNA, 64 nt, Homo Sapiens; identical to SEQ ID NO: 25875

SEQ ID NO: 699136 - RNA, 64 nt, Homo Sapiens; identical to SEQ ID NO: 25876

SEQ ID NO: 699137 - RNA, 64 nt, Homo Sapiens; identical to SEQ ID NO: 25877

SEQ ID NO: 699138 - RNA, 64 nt, Homo Sapiens; identical to SEQ ID NO: 25878

SEQ ID NO: 699139 - RNA, 64 nt, Homo Sapiens; identical to SEQ ID NO: 25879

SEQ ID NO: 699140 - RNA, 64 nt, Homo Sapiens; identical to SEQ ID NO: 25880

SEQ ID NO: 699141 - RNA, 64 nt, Homo Sapiens; identical to SEQ ID NO: 25881

SEQ ID NO: 699142 - RNA, 64 nt, Homo Sapiens; identical to SEQ ID NO: 25882

SEQ ID NO: 699143 - RNA, 64 nt, Homo Sapiens; identical to SEQ ID NO: 25883

SEQ ID NO: 699144 - RNA, 64 nt, Homo Sapiens; identical to SEQ ID NO: 25884

SEQ ID NO: 699145 - RNA, 64 nt, Homo Sapiens; identical to SEQ ID NO: 25885

SEQ ID NO: 699146 - RNA, 64 nt, Homo Sapiens; identical to SEQ ID NO: 25886

SEQ ID NO: 699147 - RNA, 64 nt, Homo Sapiens; identical to SEQ ID NO: 25887

SEQ ID NO: 699148 - RNA, 64 nt, Homo Sapiens; identical to SEQ ID NO: 25888

SEQ ID NO: 699149 - RNA, 64 nt, Homo Sapiens; identical to SEQ ID NO: 25889

SEQ ID NO: 699150 - RNA, 64 nt, Homo Sapiens; identical to SEQ ID NO: 25890

SEQ ID NO: 699151 - RNA, 64 nt, Homo Sapiens; identical to SEQ ID NO: 25891

SEQ ID NO: 699152 - RNA, 64 nt, Homo Sapiens; identical to SEQ ID NO: 25892

SEQ ID NO: 699153 - RNA, 64 nt, Homo Sapiens; identical to SEQ ID NO: 25893

SEQ ID NO: 699154 - RNA, 64 nt, Homo Sapiens; identical to SEQ ID NO: 25894

SEQ ID NO: 699155 - RNA, 64 nt, Homo Sapiens; identical to SEQ ID NO: 25895

SEQ ID NO: 699156 - RNA, 64 nt, Homo Sapiens; identical to SEQ ID NO: 25896

SEQ ID NO: 699157 - RNA, 64 nt, Homo Sapiens; identical to SEQ ID NO: 25897

SEQ ID NO: 699158 - RNA, 64 nt, Homo Sapiens; identical to SEQ ID NO: 25898

SEQ ID NO: 699159 - RNA, 64 nt, Homo Sapiens; identical to SEQ ID NO: 25899

SEQ ID NO: 699160 - RNA, 64 nt, Homo Sapiens; identical to SEQ ID NO: 25900

SEQ ID NO: 699161 - RNA, 64 nt, Homo Sapiens; identical to SEQ ID NO: 25901

SEQ ID NO: 699162 - RNA, 64 nt, Homo Sapiens; identical to SEQ ID NO: 25902

SEQ ID NO: 699163 - RNA, 64 nt, Homo Sapiens; identical to SEQ ID NO: 25903

SEQ ID NO: 699164 - RNA, 64 nt, Homo Sapiens; identical to SEQ ID NO: 25904

SEQ ID NO: 699165 - RNA, 64 nt, Homo Sapiens; identical to SEQ ID NO: 25905

SEQ ID NO: 699166 - RNA, 64 nt, Homo Sapiens; identical to SEQ ID NO: 25906

SEQ ID NO: 699167 - RNA, 64 nt, Homo Sapiens; identical to SEQ ID NO: 25907

SEQ ID NO: 699168 - RNA, 64 nt, Homo Sapiens; identical to SEQ ID NO: 25908

SEQ ID NO: 699169 - RNA, 64 nt, Homo Sapiens; identical to SEQ ID NO: 25909

SEQ ID NO: 699170 - RNA, 64 nt, Homo Sapiens; identical to SEQ ID NO: 25910

SEQ ID NO: 699171 - RNA, 64 nt, Homo Sapiens; identical to SEQ ID NO: 25911

SEQ ID NO: 699172 - RNA, 64 nt, Homo Sapiens; identical to SEQ ID NO: 25912

SEQ ID NO: 699173 - RNA, 64 nt, Homo Sapiens; identical to SEQ ID NO: 25913

SEQ ID NO: 699174 - RNA, 64 nt, Homo Sapiens; identical to SEQ ID NO: 25914

SEQ ID NO: 699175 - RNA, 64 nt, Homo Sapiens; identical to SEQ ID NO: 25915

SEQ ID NO: 699176 - RNA, 64 nt, Homo Sapiens; identical to SEQ ID NO: 25916

SEQ ID NO: 699177 - RNA, 64 nt, Homo Sapiens; identical to SEQ ID NO: 25917

SEQ ID NO: 699178 - RNA, 64 nt, Homo Sapiens; identical to SEQ ID NO: 25918

SEQ ID NO: 699179 - RNA, 64 nt, Homo Sapiens; identical to SEQ ID NO: 25919

SEQ ID NO: 699180 - RNA, 64 nt, Homo Sapiens; identical to SEQ ID NO: 25920

SEQ ID NO: 699181 - RNA, 64 nt, Homo Sapiens; identical to SEQ ID NO: 25921

SEQ ID NO: 699182 - RNA, 64 nt, Homo Sapiens; identical to SEQ ID NO: 25922

SEQ ID NO: 699183 - RNA, 64 nt, Homo Sapiens; identical to SEQ ID NO: 25923

SEQ ID NO: 699184 - RNA, 64 nt, Homo Sapiens; identical to SEQ ID NO: 25924

SEQ ID NO: 699185 - RNA, 64 nt, Homo Sapiens; identical to SEQ ID NO: 25925

SEQ ID NO: 699186 - RNA, 64 nt, Homo Sapiens; identical to SEQ ID NO: 25926

SEQ ID NO: 699187 - RNA, 64 nt, Homo Sapiens; identical to SEQ ID NO: 25927

SEQ ID NO: 699188 - RNA, 64 nt, Homo Sapiens; identical to SEQ ID NO: 25928

SEQ ID NO: 699189 - RNA, 64 nt, Homo Sapiens; identical to SEQ ID NO: 25929

SEQ ID NO: 699190 - RNA, 64 nt, Homo Sapiens; identical to SEQ ID NO: 25930

SEQ ID NO: 699191 - RNA, 64 nt, Homo Sapiens; identical to SEQ ID NO: 25931

SEQ ID NO: 699192 - RNA, 64 nt, Homo Sapiens; identical to SEQ ID NO: 25932

SEQ ID NO: 699193 - RNA, 64 nt, Homo Sapiens; identical to SEQ ID NO: 25933

SEQ ID NO: 699194 - RNA, 64 nt, Homo Sapiens; identical to SEQ ID NO: 25934

SEQ ID NO: 699195 - RNA, 64 nt, Homo Sapiens; identical to SEQ ID NO: 25935

SEQ ID NO: 699196 - RNA, 64 nt, Homo Sapiens; identical to SEQ ID NO: 25936

SEQ ID NO: 699197 - RNA, 64 nt, Homo Sapiens; identical to SEQ ID NO: 25937

SEQ ID NO: 699198 - RNA, 64 nt, Homo Sapiens; identical to SEQ ID NO: 25938

SEQ ID NO: 699199 - RNA, 64 nt, Homo Sapiens; identical to SEQ ID NO: 25939

SEQ ID NO: 699200 - RNA, 64 nt, Homo Sapiens; identical to SEQ ID NO: 25940

SEQ ID NO: 699201 - RNA, 64 nt, Homo Sapiens; identical to SEQ ID NO: 25941

SEQ ID NO: 699202 - RNA, 64 nt, Homo Sapiens; identical to SEQ ID NO: 25942

SEQ ID NO: 699203 - RNA, 64 nt, Homo Sapiens; identical to SEQ ID NO: 25943

SEQ ID NO: 699204 - RNA, 64 nt, Homo Sapiens; identical to SEQ ID NO: 25944

SEQ ID NO: 699205 - RNA, 64 nt, Homo Sapiens; identical to SEQ ID NO: 25945

SEQ ID NO: 699206 - RNA, 64 nt, Homo Sapiens; identical to SEQ ID NO: 25946

SEQ ID NO: 699207 - RNA, 64 nt, Homo Sapiens; identical to SEQ ID NO: 25947

SEQ ID NO: 699208 - RNA, 64 nt, Homo Sapiens; identical to SEQ ID NO: 25948

SEQ ID NO: 699209 - RNA, 64 nt, Homo Sapiens; identical to SEQ ID NO: 25949

SEQ ID NO: 699210 - RNA, 64 nt, Homo Sapiens; identical to SEQ ID NO: 25950

SEQ ID NO: 699211 - RNA, 64 nt, Homo Sapiens; identical to SEQ ID NO: 25951

SEQ ID NO: 699212 - RNA, 64 nt, Homo Sapiens; identical to SEQ ID NO: 25952

SEQ ID NO: 699213 - RNA, 64 nt, Homo Sapiens; identical to SEQ ID NO: 25953

SEQ ID NO: 699214 - RNA, 64 nt, Homo Sapiens; identical to SEQ ID NO: 25954

SEQ ID NO: 699215 - RNA, 64 nt, Homo Sapiens; identical to SEQ ID NO: 25955

SEQ ID NO: 699216 - RNA, 64 nt, Homo Sapiens; identical to SEQ ID NO: 25956

SEQ ID NO: 699217 - RNA, 64 nt, Homo Sapiens; identical to SEQ ID NO: 25957

SEQ ID NO: 699218 - RNA, 64 nt, Homo Sapiens; identical to SEQ ID NO: 25958

SEQ ID NO: 699219 - RNA, 64 nt, Homo Sapiens; identical to SEQ ID NO: 25959

SEQ ID NO: 699220 - RNA, 64 nt, Homo Sapiens; identical to SEQ ID NO: 25960

SEQ ID NO: 699221 - RNA, 64 nt, Homo Sapiens; identical to SEQ ID NO: 25961

SEQ ID NO: 699222 - RNA, 64 nt, Homo Sapiens; identical to SEQ ID NO: 25962

SEQ ID NO: 699223 - RNA, 64 nt, Homo Sapiens; identical to SEQ ID NO: 25963

SEQ ID NO: 699224 - RNA, 64 nt, Homo Sapiens; identical to SEQ ID NO: 25964

SEQ ID NO: 699225 - RNA, 64 nt, Homo Sapiens; identical to SEQ ID NO: 25965

SEQ ID NO: 699226 - RNA, 64 nt, Homo Sapiens; identical to SEQ ID NO: 25966

SEQ ID NO: 699227 - RNA, 64 nt, Homo Sapiens; identical to SEQ ID NO: 25967

SEQ ID NO: 699228 - RNA, 64 nt, Homo Sapiens; identical to SEQ ID NO: 25968

SEQ ID NO: 699229 - RNA, 64 nt, Homo Sapiens; identical to SEQ ID NO: 25969

SEQ ID NO: 699230 - RNA, 64 nt, Homo Sapiens; identical to SEQ ID NO: 25970

SEQ ID NO: 699231 - RNA, 64 nt, Homo Sapiens; identical to SEQ ID NO: 25971

SEQ ID NO: 699232 - RNA, 64 nt, Homo Sapiens; identical to SEQ ID NO: 25972

SEQ ID NO: 699233 - RNA, 64 nt, Homo Sapiens; identical to SEQ ID NO: 25973

SEQ ID NO: 699234 - RNA, 64 nt, Homo Sapiens; identical to SEQ ID NO: 25974

SEQ ID NO: 699235 - RNA, 64 nt, Homo Sapiens; identical to SEQ ID NO: 25975

SEQ ID NO: 699236 - RNA, 64 nt, Homo Sapiens; identical to SEQ ID NO: 25976

SEQ ID NO: 699237 - RNA, 64 nt, Homo Sapiens; identical to SEQ ID NO: 25977

SEQ ID NO: 699238 - RNA, 64 nt, Homo Sapiens; identical to SEQ ID NO: 25978

SEQ ID NO: 699239 - RNA, 64 nt, Homo Sapiens; identical to SEQ ID NO: 25979

SEQ ID NO: 699240 - RNA, 64 nt, Homo Sapiens; identical to SEQ ID NO: 25980

SEQ ID NO: 699241 - RNA, 64 nt, Homo Sapiens; identical to SEQ ID NO: 25981

SEQ ID NO: 699242 - RNA, 64 nt, Homo Sapiens; identical to SEQ ID NO: 25982

SEQ ID NO: 699243 - RNA, 64 nt, Homo Sapiens; identical to SEQ ID NO: 25983

SEQ ID NO: 699244 - RNA, 64 nt, Homo Sapiens; identical to SEQ ID NO: 25984

SEQ ID NO: 699245 - RNA, 64 nt, Homo Sapiens; identical to SEQ ID NO: 25985

SEQ ID NO: 699246 - RNA, 64 nt, Homo Sapiens; identical to SEQ ID NO: 25986

SEQ ID NO: 699247 - RNA, 64 nt, Homo Sapiens; identical to SEQ ID NO: 25987

SEQ ID NO: 699248 - RNA, 64 nt, Homo Sapiens; identical to SEQ ID NO: 25988

SEQ ID NO: 699249 - RNA, 64 nt, Homo Sapiens; identical to SEQ ID NO: 25989

SEQ ID NO: 699250 - RNA, 64 nt, Homo Sapiens; identical to SEQ ID NO: 25990

SEQ ID NO: 699251 - RNA, 64 nt, Homo Sapiens; identical to SEQ ID NO: 25991

SEQ ID NO: 699252 - RNA, 64 nt, Homo Sapiens; identical to SEQ ID NO: 25992

SEQ ID NO: 699253 - RNA, 64 nt, Homo Sapiens; identical to SEQ ID NO: 25993

SEQ ID NO: 699254 - RNA, 64 nt, Homo Sapiens; identical to SEQ ID NO: 25994

SEQ ID NO: 699255 - RNA, 64 nt, Homo Sapiens; identical to SEQ ID NO: 25995

SEQ ID NO: 699256 - RNA, 64 nt, Homo Sapiens; identical to SEQ ID NO: 25996

SEQ ID NO: 699257 - RNA, 64 nt, Homo Sapiens; identical to SEQ ID NO: 25997

SEQ ID NO: 699258 - RNA, 64 nt, Homo Sapiens; identical to SEQ ID NO: 25998

SEQ ID NO: 699259 - RNA, 64 nt, Homo Sapiens; identical to SEQ ID NO: 25999

SEQ ID NO: 699260 - RNA, 64 nt, Homo Sapiens; identical to SEQ ID NO: 26000

SEQ ID NO: 699261 - RNA, 64 nt, Homo Sapiens; identical to SEQ ID NO: 26001

SEQ ID NO: 699262 - RNA, 64 nt, Homo Sapiens; identical to SEQ ID NO: 26002

SEQ ID NO: 699263 - RNA, 64 nt, Homo Sapiens; identical to SEQ ID NO: 26003

SEQ ID NO: 699264 - RNA, 64 nt, Homo Sapiens; identical to SEQ ID NO: 26004

SEQ ID NO: 699265 - RNA, 64 nt, Homo Sapiens; identical to SEQ ID NO: 26005

SEQ ID NO: 699266 - RNA, 64 nt, Homo Sapiens; identical to SEQ ID NO: 26006

SEQ ID NO: 699267 - RNA, 64 nt, Homo Sapiens; identical to SEQ ID NO: 26007

SEQ ID NO: 699268 - RNA, 64 nt, Homo Sapiens; identical to SEQ ID NO: 26008

SEQ ID NO: 699269 - RNA, 64 nt, Homo Sapiens; identical to SEQ ID NO: 26009

SEQ ID NO: 699270 - RNA, 64 nt, Homo Sapiens; identical to SEQ ID NO: 26010

SEQ ID NO: 699271 - RNA, 64 nt, Homo Sapiens; identical to SEQ ID NO: 26011

SEQ ID NO: 699272 - RNA, 64 nt, Homo Sapiens; identical to SEQ ID NO: 26012

SEQ ID NO: 699273 - RNA, 64 nt, Homo Sapiens; identical to SEQ ID NO: 26013

SEQ ID NO: 699274 - RNA, 64 nt, Homo Sapiens; identical to SEQ ID NO: 26014

SEQ ID NO: 699275 - RNA, 64 nt, Homo Sapiens; identical to SEQ ID NO: 26015

SEQ ID NO: 699276 - RNA, 64 nt, Homo Sapiens; identical to SEQ ID NO: 26016

SEQ ID NO: 699277 - RNA, 64 nt, Homo Sapiens; identical to SEQ ID NO: 26017

SEQ ID NO: 699278 - RNA, 64 nt, Homo Sapiens; identical to SEQ ID NO: 26018

SEQ ID NO: 699279 - RNA, 64 nt, Homo Sapiens; identical to SEQ ID NO: 26019

SEQ ID NO: 699280 - RNA, 64 nt, Homo Sapiens; identical to SEQ ID NO: 26020

SEQ ID NO: 699281 - RNA, 64 nt, Homo Sapiens; identical to SEQ ID NO: 26021

SEQ ID NO: 699282 - RNA, 64 nt, Homo Sapiens; identical to SEQ ID NO: 26022

SEQ ID NO: 699283 - RNA, 64 nt, Homo Sapiens; identical to SEQ ID NO: 26023

SEQ ID NO: 699284 - RNA, 64 nt, Homo Sapiens; identical to SEQ ID NO: 26024

SEQ ID NO: 699285 - RNA, 64 nt, Homo Sapiens; identical to SEQ ID NO: 26025

SEQ ID NO: 699286 - RNA, 64 nt, Homo Sapiens; identical to SEQ ID NO: 26026

SEQ ID NO: 699287 - RNA, 64 nt, Homo Sapiens; identical to SEQ ID NO: 26027

SEQ ID NO: 699288 - RNA, 64 nt, Homo Sapiens; identical to SEQ ID NO: 26028

SEQ ID NO: 699289 - RNA, 64 nt, Homo Sapiens; identical to SEQ ID NO: 26029

SEQ ID NO: 699290 - RNA, 64 nt, Homo Sapiens; identical to SEQ ID NO: 26030

SEQ ID NO: 699291 - RNA, 64 nt, Homo Sapiens; identical to SEQ ID NO: 26031

SEQ ID NO: 699292 - RNA, 64 nt, Homo Sapiens; identical to SEQ ID NO: 26032

SEQ ID NO: 699293 - RNA, 64 nt, Homo Sapiens; identical to SEQ ID NO: 26033

SEQ ID NO: 699294 - RNA, 64 nt, Homo Sapiens; identical to SEQ ID NO: 26034

SEQ ID NO: 699295 - RNA, 64 nt, Homo Sapiens; identical to SEQ ID NO: 26035

SEQ ID NO: 699296 - RNA, 64 nt, Homo Sapiens; identical to SEQ ID NO: 26036

SEQ ID NO: 699297 - RNA, 64 nt, Homo Sapiens; identical to SEQ ID NO: 26037

SEQ ID NO: 699298 - RNA, 64 nt, Homo Sapiens; identical to SEQ ID NO: 26038

SEQ ID NO: 699299 - RNA, 64 nt, Homo Sapiens; identical to SEQ ID NO: 26039

SEQ ID NO: 699300 - RNA, 64 nt, Homo Sapiens; identical to SEQ ID NO: 26040

SEQ ID NO: 699301 - RNA, 64 nt, Homo Sapiens; identical to SEQ ID NO: 26041

SEQ ID NO: 699302 - RNA, 64 nt, Homo Sapiens; identical to SEQ ID NO: 26042

SEQ ID NO: 699303 - RNA, 64 nt, Homo Sapiens; identical to SEQ ID NO: 26043

SEQ ID NO: 699304 - RNA, 64 nt, Homo Sapiens; identical to SEQ ID NO: 26044

SEQ ID NO: 699305 - RNA, 64 nt, Homo Sapiens; identical to SEQ ID NO: 26045

SEQ ID NO: 699306 - RNA, 64 nt, Homo Sapiens; identical to SEQ ID NO: 26046

SEQ ID NO: 699307 - RNA, 64 nt, Homo Sapiens; identical to SEQ ID NO: 26047

SEQ ID NO: 699308 - RNA, 64 nt, Homo Sapiens; identical to SEQ ID NO: 26048

SEQ ID NO: 699309 - RNA, 64 nt, Homo Sapiens; identical to SEQ ID NO: 26049

SEQ ID NO: 699310 - RNA, 64 nt, Homo Sapiens; identical to SEQ ID NO: 26050

SEQ ID NO: 699311 - RNA, 64 nt, Homo Sapiens; identical to SEQ ID NO: 26051

SEQ ID NO: 699312 - RNA, 64 nt, Homo Sapiens; identical to SEQ ID NO: 26052

SEQ ID NO: 699313 - RNA, 64 nt, Homo Sapiens; identical to SEQ ID NO: 26053

SEQ ID NO: 699314 - RNA, 64 nt, Homo Sapiens; identical to SEQ ID NO: 26054

SEQ ID NO: 699315 - RNA, 64 nt, Homo Sapiens; identical to SEQ ID NO: 26055

SEQ ID NO: 699316 - RNA, 64 nt, Homo Sapiens; identical to SEQ ID NO: 26056

SEQ ID NO: 699317 - RNA, 64 nt, Homo Sapiens; identical to SEQ ID NO: 26057

SEQ ID NO: 699318 - RNA, 64 nt, Homo Sapiens; identical to SEQ ID NO: 26058

SEQ ID NO: 699319 - RNA, 64 nt, Homo Sapiens; identical to SEQ ID NO: 26059

SEQ ID NO: 699320 - RNA, 64 nt, Homo Sapiens; identical to SEQ ID NO: 26060

SEQ ID NO: 699321 - RNA, 64 nt, Homo Sapiens; identical to SEQ ID NO: 26061

SEQ ID NO: 699322 - RNA, 64 nt, Homo Sapiens; identical to SEQ ID NO: 26062

SEQ ID NO: 699323 - RNA, 64 nt, Homo Sapiens; identical to SEQ ID NO: 26063

SEQ ID NO: 699324 - RNA, 64 nt, Homo Sapiens; identical to SEQ ID NO: 26064

SEQ ID NO: 699325 - RNA, 64 nt, Homo Sapiens; identical to SEQ ID NO: 26065

SEQ ID NO: 699326 - RNA, 64 nt, Homo Sapiens; identical to SEQ ID NO: 26066

SEQ ID NO: 699327 - RNA, 64 nt, Homo Sapiens; identical to SEQ ID NO: 26067

SEQ ID NO: 699328 - RNA, 64 nt, Homo Sapiens; identical to SEQ ID NO: 26068

SEQ ID NO: 699329 - RNA, 64 nt, Homo Sapiens; identical to SEQ ID NO: 26069

SEQ ID NO: 699330 - RNA, 64 nt, Homo Sapiens; identical to SEQ ID NO: 26070

SEQ ID NO: 699331 - RNA, 64 nt, Homo Sapiens; identical to SEQ ID NO: 26071

SEQ ID NO: 699332 - RNA, 64 nt, Homo Sapiens; identical to SEQ ID NO: 26072

SEQ ID NO: 699333 - RNA, 64 nt, Homo Sapiens; identical to SEQ ID NO: 26073

SEQ ID NO: 699334 - RNA, 64 nt, Homo Sapiens; identical to SEQ ID NO: 26074

SEQ ID NO: 699335 - RNA, 64 nt, Homo Sapiens; identical to SEQ ID NO: 26075

SEQ ID NO: 699336 - RNA, 64 nt, Homo Sapiens; identical to SEQ ID NO: 26076

SEQ ID NO: 699337 - RNA, 64 nt, Homo Sapiens; identical to SEQ ID NO: 26077

SEQ ID NO: 699338 - RNA, 64 nt, Homo Sapiens; identical to SEQ ID NO: 26078

SEQ ID NO: 699339 - RNA, 64 nt, Homo Sapiens; identical to SEQ ID NO: 26079

SEQ ID NO: 699340 - RNA, 64 nt, Homo Sapiens; identical to SEQ ID NO: 26080

SEQ ID NO: 699341 - RNA, 64 nt, Homo Sapiens; identical to SEQ ID NO: 26081

SEQ ID NO: 699342 - RNA, 64 nt, Homo Sapiens; identical to SEQ ID NO: 26082

SEQ ID NO: 699343 - RNA, 64 nt, Homo Sapiens; identical to SEQ ID NO: 26083

SEQ ID NO: 699344 - RNA, 64 nt, Homo Sapiens; identical to SEQ ID NO: 26084

SEQ ID NO: 699345 - RNA, 64 nt, Homo Sapiens; identical to SEQ ID NO: 26085

SEQ ID NO: 699346 - RNA, 64 nt, Homo Sapiens; identical to SEQ ID NO: 26086

SEQ ID NO: 699347 - RNA, 64 nt, Homo Sapiens; identical to SEQ ID NO: 26087

SEQ ID NO: 699348 - RNA, 64 nt, Homo Sapiens; identical to SEQ ID NO: 26088

SEQ ID NO: 699349 - RNA, 64 nt, Homo Sapiens; identical to SEQ ID NO: 26089

SEQ ID NO: 699350 - RNA, 64 nt, Homo Sapiens; identical to SEQ ID NO: 26090

SEQ ID NO: 699351 - RNA, 64 nt, Homo Sapiens; identical to SEQ ID NO: 26091

SEQ ID NO: 699352 - RNA, 64 nt, Homo Sapiens; identical to SEQ ID NO: 26092

SEQ ID NO: 699353 - RNA, 64 nt, Homo Sapiens; identical to SEQ ID NO: 26093

SEQ ID NO: 699354 - RNA, 64 nt, Homo Sapiens; identical to SEQ ID NO: 26094

SEQ ID NO: 699355 - RNA, 64 nt, Homo Sapiens; identical to SEQ ID NO: 26095

SEQ ID NO: 699356 - RNA, 64 nt, Homo Sapiens; identical to SEQ ID NO: 26096

SEQ ID NO: 699357 - RNA, 64 nt, Homo Sapiens; identical to SEQ ID NO: 26097

SEQ ID NO: 699358 - RNA, 64 nt, Homo Sapiens; identical to SEQ ID NO: 26098

SEQ ID NO: 699359 - RNA, 64 nt, Homo Sapiens; identical to SEQ ID NO: 26099

SEQ ID NO: 699360 - RNA, 64 nt, Homo Sapiens; identical to SEQ ID NO: 26100

SEQ ID NO: 699361 - RNA, 64 nt, Homo Sapiens; identical to SEQ ID NO: 26101

SEQ ID NO: 699362 - RNA, 64 nt, Homo Sapiens; identical to SEQ ID NO: 26102

SEQ ID NO: 699363 - RNA, 64 nt, Homo Sapiens; identical to SEQ ID NO: 26103

SEQ ID NO: 699364 - RNA, 64 nt, Homo Sapiens; identical to SEQ ID NO: 26104

SEQ ID NO: 699365 - RNA, 64 nt, Homo Sapiens; identical to SEQ ID NO: 26105

SEQ ID NO: 699366 - RNA, 64 nt, Homo Sapiens; identical to SEQ ID NO: 26106

SEQ ID NO: 699367 - RNA, 64 nt, Homo Sapiens; identical to SEQ ID NO: 26107

SEQ ID NO: 699368 - RNA, 64 nt, Homo Sapiens; identical to SEQ ID NO: 26108

SEQ ID NO: 699369 - RNA, 64 nt, Homo Sapiens; identical to SEQ ID NO: 26109

SEQ ID NO: 699370 - RNA, 64 nt, Homo Sapiens; identical to SEQ ID NO: 26110

SEQ ID NO: 699371 - RNA, 64 nt, Homo Sapiens; identical to SEQ ID NO: 26111

SEQ ID NO: 699372 - RNA, 64 nt, Homo Sapiens; identical to SEQ ID NO: 26112

SEQ ID NO: 699373 - RNA, 64 nt, Homo Sapiens; identical to SEQ ID NO: 26113

SEQ ID NO: 699374 - RNA, 64 nt, Homo Sapiens; identical to SEQ ID NO: 26114

SEQ ID NO: 699375 - RNA, 64 nt, Homo Sapiens; identical to SEQ ID NO: 26115

SEQ ID NO: 699376 - RNA, 64 nt, Homo Sapiens; identical to SEQ ID NO: 26116

SEQ ID NO: 699377 - RNA, 64 nt, Homo Sapiens; identical to SEQ ID NO: 26117

SEQ ID NO: 699378 - RNA, 64 nt, Homo Sapiens; identical to SEQ ID NO: 26118

SEQ ID NO: 699379 - RNA, 64 nt, Homo Sapiens; identical to SEQ ID NO: 26119

SEQ ID NO: 699380 - RNA, 64 nt, Homo Sapiens; identical to SEQ ID NO: 26120

SEQ ID NO: 699381 - RNA, 64 nt, Homo Sapiens; identical to SEQ ID NO: 26121

SEQ ID NO: 699382 - RNA, 64 nt, Homo Sapiens; identical to SEQ ID NO: 26122

SEQ ID NO: 699383 - RNA, 64 nt, Homo Sapiens; identical to SEQ ID NO: 26123

SEQ ID NO: 699384 - RNA, 64 nt, Homo Sapiens; identical to SEQ ID NO: 26124

SEQ ID NO: 699385 - RNA, 64 nt, Homo Sapiens; identical to SEQ ID NO: 26125

SEQ ID NO: 699386 - RNA, 64 nt, Homo Sapiens; identical to SEQ ID NO: 26126

SEQ ID NO: 699387 - RNA, 64 nt, Homo Sapiens; identical to SEQ ID NO: 26127

SEQ ID NO: 699388 - RNA, 64 nt, Homo Sapiens; identical to SEQ ID NO: 26128

SEQ ID NO: 699389 - RNA, 64 nt, Homo Sapiens; identical to SEQ ID NO: 26129

SEQ ID NO: 699390 - RNA, 64 nt, Homo Sapiens; identical to SEQ ID NO: 26130

SEQ ID NO: 699391 - RNA, 64 nt, Homo Sapiens; identical to SEQ ID NO: 26131

SEQ ID NO: 699392 - RNA, 64 nt, Homo Sapiens; identical to SEQ ID NO: 26132

SEQ ID NO: 699393 - RNA, 64 nt, Homo Sapiens; identical to SEQ ID NO: 26133

SEQ ID NO: 699394 - RNA, 64 nt, Homo Sapiens; identical to SEQ ID NO: 26134

SEQ ID NO: 699395 - RNA, 64 nt, Homo Sapiens; identical to SEQ ID NO: 26135

SEQ ID NO: 699396 - RNA, 64 nt, Homo Sapiens; identical to SEQ ID NO: 26136

SEQ ID NO: 699397 - RNA, 64 nt, Homo Sapiens; identical to SEQ ID NO: 26137

SEQ ID NO: 699398 - RNA, 64 nt, Homo Sapiens; identical to SEQ ID NO: 26138

SEQ ID NO: 699399 - RNA, 64 nt, Homo Sapiens; identical to SEQ ID NO: 26139

SEQ ID NO: 699400 - RNA, 64 nt, Homo Sapiens; identical to SEQ ID NO: 26140

SEQ ID NO: 699401 - RNA, 64 nt, Homo Sapiens; identical to SEQ ID NO: 26141

SEQ ID NO: 699402 - RNA, 64 nt, Homo Sapiens; identical to SEQ ID NO: 26142

SEQ ID NO: 699403 - RNA, 64 nt, Homo Sapiens; identical to SEQ ID NO: 26143

SEQ ID NO: 699404 - RNA, 64 nt, Homo Sapiens; identical to SEQ ID NO: 26144

SEQ ID NO: 699405 - RNA, 64 nt, Homo Sapiens; identical to SEQ ID NO: 26145

SEQ ID NO: 699406 - RNA, 64 nt, Homo Sapiens; identical to SEQ ID NO: 26146

SEQ ID NO: 699407 - RNA, 64 nt, Homo Sapiens; identical to SEQ ID NO: 26147

SEQ ID NO: 699408 - RNA, 64 nt, Homo Sapiens; identical to SEQ ID NO: 26148

SEQ ID NO: 699409 - RNA, 64 nt, Homo Sapiens; identical to SEQ ID NO: 26149

SEQ ID NO: 699410 - RNA, 64 nt, Homo Sapiens; identical to SEQ ID NO: 26150

SEQ ID NO: 699411 - RNA, 64 nt, Homo Sapiens; identical to SEQ ID NO: 26151

SEQ ID NO: 699412 - RNA, 64 nt, Homo Sapiens; identical to SEQ ID NO: 26152

SEQ ID NO: 699413 - RNA, 64 nt, Homo Sapiens; identical to SEQ ID NO: 26153

SEQ ID NO: 699414 - RNA, 64 nt, Homo Sapiens; identical to SEQ ID NO: 26154

SEQ ID NO: 699415 - RNA, 64 nt, Homo Sapiens; identical to SEQ ID NO: 26155

SEQ ID NO: 699416 - RNA, 64 nt, Homo Sapiens; identical to SEQ ID NO: 26156

SEQ ID NO: 699417 - RNA, 64 nt, Homo Sapiens; identical to SEQ ID NO: 26157

SEQ ID NO: 699418 - RNA, 64 nt, Homo Sapiens; identical to SEQ ID NO: 26158

SEQ ID NO: 699419 - RNA, 64 nt, Homo Sapiens; identical to SEQ ID NO: 26159

SEQ ID NO: 699420 - RNA, 64 nt, Homo Sapiens; identical to SEQ ID NO: 26160

SEQ ID NO: 699421 - RNA, 64 nt, Homo Sapiens; identical to SEQ ID NO: 26161

SEQ ID NO: 699422 - RNA, 64 nt, Homo Sapiens; identical to SEQ ID NO: 26162

SEQ ID NO: 699423 - RNA, 64 nt, Homo Sapiens; identical to SEQ ID NO: 26163

SEQ ID NO: 699424 - RNA, 64 nt, Homo Sapiens; identical to SEQ ID NO: 26164

SEQ ID NO: 699425 - RNA, 64 nt, Homo Sapiens; identical to SEQ ID NO: 26165

SEQ ID NO: 699426 - RNA, 64 nt, Homo Sapiens; identical to SEQ ID NO: 26166

SEQ ID NO: 699427 - RNA, 64 nt, Homo Sapiens; identical to SEQ ID NO: 26167

SEQ ID NO: 699428 - RNA, 64 nt, Homo Sapiens; identical to SEQ ID NO: 26168

SEQ ID NO: 699429 - RNA, 64 nt, Homo Sapiens; identical to SEQ ID NO: 26169

SEQ ID NO: 699430 - RNA, 64 nt, Homo Sapiens; identical to SEQ ID NO: 26170

SEQ ID NO: 699431 - RNA, 64 nt, Homo Sapiens; identical to SEQ ID NO: 26171

SEQ ID NO: 699432 - RNA, 64 nt, Homo Sapiens; identical to SEQ ID NO: 26172

SEQ ID NO: 699433 - RNA, 64 nt, Homo Sapiens; identical to SEQ ID NO: 26173

SEQ ID NO: 699434 - RNA, 64 nt, Homo Sapiens; identical to SEQ ID NO: 26174

SEQ ID NO: 699435 - RNA, 64 nt, Homo Sapiens; identical to SEQ ID NO: 26175

SEQ ID NO: 699436 - RNA, 64 nt, Homo Sapiens; identical to SEQ ID NO: 26176

SEQ ID NO: 699437 - RNA, 64 nt, Homo Sapiens; identical to SEQ ID NO: 26177

SEQ ID NO: 699438 - RNA, 64 nt, Homo Sapiens; identical to SEQ ID NO: 26178

SEQ ID NO: 699439 - RNA, 64 nt, Homo Sapiens; identical to SEQ ID NO: 26179

SEQ ID NO: 699440 - RNA, 64 nt, Homo Sapiens; identical to SEQ ID NO: 26180

SEQ ID NO: 699441 - RNA, 64 nt, Homo Sapiens; identical to SEQ ID NO: 26181

SEQ ID NO: 699442 - RNA, 64 nt, Homo Sapiens; identical to SEQ ID NO: 26182

SEQ ID NO: 699443 - RNA, 64 nt, Homo Sapiens; identical to SEQ ID NO: 26183

SEQ ID NO: 699444 - RNA, 64 nt, Homo Sapiens; identical to SEQ ID NO: 26184

SEQ ID NO: 699445 - RNA, 64 nt, Homo Sapiens; identical to SEQ ID NO: 26185

SEQ ID NO: 699446 - RNA, 64 nt, Homo Sapiens; identical to SEQ ID NO: 26186

SEQ ID NO: 699447 - RNA, 64 nt, Homo Sapiens; identical to SEQ ID NO: 26187

SEQ ID NO: 699448 - RNA, 64 nt, Homo Sapiens; identical to SEQ ID NO: 26188

SEQ ID NO: 699449 - RNA, 64 nt, Homo Sapiens; identical to SEQ ID NO: 26189

SEQ ID NO: 699450 - RNA, 64 nt, Homo Sapiens; identical to SEQ ID NO: 26190

SEQ ID NO: 699451 - RNA, 64 nt, Homo Sapiens; identical to SEQ ID NO: 26191

SEQ ID NO: 699452 - RNA, 62 nt, Homo Sapiens; identical to SEQ ID NO: 26192

SEQ ID NO: 699453 - RNA, 61 nt, Homo Sapiens; identical to SEQ ID NO: 26193

SEQ ID NO: 699454 - RNA, 64 nt, Homo Sapiens; identical to SEQ ID NO: 26194

SEQ ID NO: 699455 - RNA, 64 nt, Homo Sapiens; identical to SEQ ID NO: 26195

SEQ ID NO: 699456 - RNA, 64 nt, Homo Sapiens; identical to SEQ ID NO: 26196

SEQ ID NO: 699457 - RNA, 64 nt, Homo Sapiens; identical to SEQ ID NO: 26197

SEQ ID NO: 699458 - RNA, 64 nt, Homo Sapiens; identical to SEQ ID NO: 26198

SEQ ID NO: 699459 - RNA, 64 nt, Homo Sapiens; identical to SEQ ID NO: 26199

SEQ ID NO: 699460 - RNA, 64 nt, Homo Sapiens; identical to SEQ ID NO: 26200

SEQ ID NO: 699461 - RNA, 64 nt, Homo Sapiens; identical to SEQ ID NO: 26201

SEQ ID NO: 699462 - RNA, 64 nt, Homo Sapiens; identical to SEQ ID NO: 26202

SEQ ID NO: 699463 - RNA, 64 nt, Homo Sapiens; identical to SEQ ID NO: 26203

SEQ ID NO: 699464 - RNA, 64 nt, Homo Sapiens; identical to SEQ ID NO: 26204

SEQ ID NO: 699465 - RNA, 64 nt, Homo Sapiens; identical to SEQ ID NO: 26205

SEQ ID NO: 699466 - RNA, 64 nt, Homo Sapiens; identical to SEQ ID NO: 26206

SEQ ID NO: 699467 - RNA, 64 nt, Homo Sapiens; identical to SEQ ID NO: 26207

SEQ ID NO: 699468 - RNA, 64 nt, Homo Sapiens; identical to SEQ ID NO: 26208

SEQ ID NO: 699469 - RNA, 64 nt, Homo Sapiens; identical to SEQ ID NO: 26209

SEQ ID NO: 699470 - RNA, 64 nt, Homo Sapiens; identical to SEQ ID NO: 26210

SEQ ID NO: 699471 - RNA, 64 nt, Homo Sapiens; identical to SEQ ID NO: 26211

SEQ ID NO: 699472 - RNA, 64 nt, Homo Sapiens; identical to SEQ ID NO: 26212

SEQ ID NO: 699473 - RNA, 64 nt, Homo Sapiens; identical to SEQ ID NO: 26213

SEQ ID NO: 699474 - RNA, 64 nt, Homo Sapiens; identical to SEQ ID NO: 26214

SEQ ID NO: 699475 - RNA, 64 nt, Homo Sapiens; identical to SEQ ID NO: 26215

SEQ ID NO: 699476 - RNA, 64 nt, Homo Sapiens; identical to SEQ ID NO: 26216

SEQ ID NO: 699477 - RNA, 64 nt, Homo Sapiens; identical to SEQ ID NO: 26217

SEQ ID NO: 699478 - RNA, 64 nt, Homo Sapiens; identical to SEQ ID NO: 26218

SEQ ID NO: 699479 - RNA, 64 nt, Homo Sapiens; identical to SEQ ID NO: 26219

SEQ ID NO: 699480 - RNA, 64 nt, Homo Sapiens; identical to SEQ ID NO: 26220

SEQ ID NO: 699481 - RNA, 64 nt, Homo Sapiens; identical to SEQ ID NO: 26221

SEQ ID NO: 699482 - RNA, 64 nt, Homo Sapiens; identical to SEQ ID NO: 26222

SEQ ID NO: 699483 - RNA, 64 nt, Homo Sapiens; identical to SEQ ID NO: 26223

SEQ ID NO: 699484 - RNA, 64 nt, Homo Sapiens; identical to SEQ ID NO: 26224

SEQ ID NO: 699485 - RNA, 64 nt, Homo Sapiens; identical to SEQ ID NO: 26225

SEQ ID NO: 699486 - RNA, 64 nt, Homo Sapiens; identical to SEQ ID NO: 26226

SEQ ID NO: 699487 - RNA, 64 nt, Homo Sapiens; identical to SEQ ID NO: 26227

SEQ ID NO: 699488 - RNA, 64 nt, Homo Sapiens; identical to SEQ ID NO: 26228

SEQ ID NO: 699489 - RNA, 64 nt, Homo Sapiens; identical to SEQ ID NO: 26229

SEQ ID NO: 699490 - RNA, 64 nt, Homo Sapiens; identical to SEQ ID NO: 26230

SEQ ID NO: 699491 - RNA, 64 nt, Homo Sapiens; identical to SEQ ID NO: 26231

SEQ ID NO: 699492 - RNA, 64 nt, Homo Sapiens; identical to SEQ ID NO: 26232

SEQ ID NO: 699493 - RNA, 64 nt, Homo Sapiens; identical to SEQ ID NO: 26233

SEQ ID NO: 699494 - RNA, 64 nt, Homo Sapiens; identical to SEQ ID NO: 26234

SEQ ID NO: 699495 - RNA, 64 nt, Homo Sapiens; identical to SEQ ID NO: 26235

SEQ ID NO: 699496 - RNA, 64 nt, Homo Sapiens; identical to SEQ ID NO: 26236

SEQ ID NO: 699497 - RNA, 64 nt, Homo Sapiens; identical to SEQ ID NO: 26237

SEQ ID NO: 699498 - RNA, 64 nt, Homo Sapiens; identical to SEQ ID NO: 26238

SEQ ID NO: 699499 - RNA, 64 nt, Homo Sapiens; identical to SEQ ID NO: 26239

SEQ ID NO: 699500 - RNA, 64 nt, Homo Sapiens; identical to SEQ ID NO: 26240

SEQ ID NO: 699501 - RNA, 64 nt, Homo Sapiens; identical to SEQ ID NO: 26241

SEQ ID NO: 699502 - RNA, 64 nt, Homo Sapiens; identical to SEQ ID NO: 26242

SEQ ID NO: 699503 - RNA, 64 nt, Homo Sapiens; identical to SEQ ID NO: 26243

SEQ ID NO: 699504 - RNA, 64 nt, Homo Sapiens; identical to SEQ ID NO: 26244

SEQ ID NO: 699505 - RNA, 64 nt, Homo Sapiens; identical to SEQ ID NO: 26245

SEQ ID NO: 699506 - RNA, 64 nt, Homo Sapiens; identical to SEQ ID NO: 26246

SEQ ID NO: 699507 - RNA, 64 nt, Homo Sapiens; identical to SEQ ID NO: 26247

SEQ ID NO: 699508 - RNA, 64 nt, Homo Sapiens; identical to SEQ ID NO: 26248

SEQ ID NO: 699509 - RNA, 64 nt, Homo Sapiens; identical to SEQ ID NO: 26249

SEQ ID NO: 699510 - RNA, 64 nt, Homo Sapiens; identical to SEQ ID NO: 26250

SEQ ID NO: 699511 - RNA, 64 nt, Homo Sapiens; identical to SEQ ID NO: 26251

SEQ ID NO: 699512 - RNA, 64 nt, Homo Sapiens; identical to SEQ ID NO: 26252

SEQ ID NO: 699513 - RNA, 64 nt, Homo Sapiens; identical to SEQ ID NO: 26253

SEQ ID NO: 699514 - RNA, 64 nt, Homo Sapiens; identical to SEQ ID NO: 26254

SEQ ID NO: 699515 - RNA, 64 nt, Homo Sapiens; identical to SEQ ID NO: 26255

SEQ ID NO: 699516 - RNA, 64 nt, Homo Sapiens; identical to SEQ ID NO: 26256

SEQ ID NO: 699517 - RNA, 64 nt, Homo Sapiens; identical to SEQ ID NO: 26257

SEQ ID NO: 699518 - RNA, 64 nt, Homo Sapiens; identical to SEQ ID NO: 26258

SEQ ID NO: 699519 - RNA, 64 nt, Homo Sapiens; identical to SEQ ID NO: 26259

SEQ ID NO: 699520 - RNA, 64 nt, Homo Sapiens; identical to SEQ ID NO: 26260

SEQ ID NO: 699521 - RNA, 64 nt, Homo Sapiens; identical to SEQ ID NO: 26261

SEQ ID NO: 699522 - RNA, 64 nt, Homo Sapiens; identical to SEQ ID NO: 26262

SEQ ID NO: 699523 - RNA, 64 nt, Homo Sapiens; identical to SEQ ID NO: 26263

SEQ ID NO: 699524 - RNA, 64 nt, Homo Sapiens; identical to SEQ ID NO: 26264

SEQ ID NO: 699525 - RNA, 64 nt, Homo Sapiens; identical to SEQ ID NO: 26265

SEQ ID NO: 699526 - RNA, 64 nt, Homo Sapiens; identical to SEQ ID NO: 26266

SEQ ID NO: 699527 - RNA, 64 nt, Homo Sapiens; identical to SEQ ID NO: 26267

SEQ ID NO: 699528 - RNA, 64 nt, Homo Sapiens; identical to SEQ ID NO: 26268

SEQ ID NO: 699529 - RNA, 64 nt, Homo Sapiens; identical to SEQ ID NO: 26269

SEQ ID NO: 699530 - RNA, 64 nt, Homo Sapiens; identical to SEQ ID NO: 26270

SEQ ID NO: 699531 - RNA, 64 nt, Homo Sapiens; identical to SEQ ID NO: 26271

SEQ ID NO: 699532 - RNA, 64 nt, Homo Sapiens; identical to SEQ ID NO: 26272

SEQ ID NO: 699533 - RNA, 64 nt, Homo Sapiens; identical to SEQ ID NO: 26273

SEQ ID NO: 699534 - RNA, 64 nt, Homo Sapiens; identical to SEQ ID NO: 26274

SEQ ID NO: 699535 - RNA, 64 nt, Homo Sapiens; identical to SEQ ID NO: 26275

SEQ ID NO: 699536 - RNA, 64 nt, Homo Sapiens; identical to SEQ ID NO: 26276

SEQ ID NO: 699537 - RNA, 64 nt, Homo Sapiens; identical to SEQ ID NO: 26277

SEQ ID NO: 699538 - RNA, 64 nt, Homo Sapiens; identical to SEQ ID NO: 26278

SEQ ID NO: 699539 - RNA, 64 nt, Homo Sapiens; identical to SEQ ID NO: 26279

SEQ ID NO: 699540 - RNA, 64 nt, Homo Sapiens; identical to SEQ ID NO: 26280

SEQ ID NO: 699541 - RNA, 64 nt, Homo Sapiens; identical to SEQ ID NO: 26281

SEQ ID NO: 699542 - RNA, 64 nt, Homo Sapiens; identical to SEQ ID NO: 26282

SEQ ID NO: 699543 - RNA, 64 nt, Homo Sapiens; identical to SEQ ID NO: 26283

SEQ ID NO: 699544 - RNA, 64 nt, Homo Sapiens; identical to SEQ ID NO: 26284

SEQ ID NO: 699545 - RNA, 64 nt, Homo Sapiens; identical to SEQ ID NO: 26285

SEQ ID NO: 699546 - RNA, 64 nt, Homo Sapiens; identical to SEQ ID NO: 26286

SEQ ID NO: 699547 - RNA, 64 nt, Homo Sapiens; identical to SEQ ID NO: 26287

SEQ ID NO: 699548 - RNA, 64 nt, Homo Sapiens; identical to SEQ ID NO: 26288

SEQ ID NO: 699549 - RNA, 64 nt, Homo Sapiens; identical to SEQ ID NO: 26289

SEQ ID NO: 699550 - RNA, 64 nt, Homo Sapiens; identical to SEQ ID NO: 26290

SEQ ID NO: 699551 - RNA, 64 nt, Homo Sapiens; identical to SEQ ID NO: 26291

SEQ ID NO: 699552 - RNA, 64 nt, Homo Sapiens; identical to SEQ ID NO: 26292

SEQ ID NO: 699553 - RNA, 64 nt, Homo Sapiens; identical to SEQ ID NO: 26293

SEQ ID NO: 699554 - RNA, 64 nt, Homo Sapiens; identical to SEQ ID NO: 26294

SEQ ID NO: 699555 - RNA, 64 nt, Homo Sapiens; identical to SEQ ID NO: 26295

SEQ ID NO: 699556 - RNA, 64 nt, Homo Sapiens; identical to SEQ ID NO: 26296

SEQ ID NO: 699557 - RNA, 64 nt, Homo Sapiens; identical to SEQ ID NO: 26297

SEQ ID NO: 699558 - RNA, 64 nt, Homo Sapiens; identical to SEQ ID NO: 26298

SEQ ID NO: 699559 - RNA, 64 nt, Homo Sapiens; identical to SEQ ID NO: 26299

SEQ ID NO: 699560 - RNA, 64 nt, Homo Sapiens; identical to SEQ ID NO: 26300

SEQ ID NO: 699561 - RNA, 64 nt, Homo Sapiens; identical to SEQ ID NO: 26301

SEQ ID NO: 699562 - RNA, 64 nt, Homo Sapiens; identical to SEQ ID NO: 26302

SEQ ID NO: 699563 - RNA, 64 nt, Homo Sapiens; identical to SEQ ID NO: 26303

SEQ ID NO: 699564 - RNA, 64 nt, Homo Sapiens; identical to SEQ ID NO: 26304

SEQ ID NO: 699565 - RNA, 64 nt, Homo Sapiens; identical to SEQ ID NO: 26305

SEQ ID NO: 699566 - RNA, 64 nt, Homo Sapiens; identical to SEQ ID NO: 26306

SEQ ID NO: 699567 - RNA, 64 nt, Homo Sapiens; identical to SEQ ID NO: 26307

SEQ ID NO: 699568 - RNA, 64 nt, Homo Sapiens; identical to SEQ ID NO: 26308

SEQ ID NO: 699569 - RNA, 64 nt, Homo Sapiens; identical to SEQ ID NO: 26309

SEQ ID NO: 699570 - RNA, 64 nt, Homo Sapiens; identical to SEQ ID NO: 26310

SEQ ID NO: 699571 - RNA, 64 nt, Homo Sapiens; identical to SEQ ID NO: 26311

SEQ ID NO: 699572 - RNA, 64 nt, Homo Sapiens; identical to SEQ ID NO: 26312

SEQ ID NO: 699573 - RNA, 64 nt, Homo Sapiens; identical to SEQ ID NO: 26313

SEQ ID NO: 699574 - RNA, 64 nt, Homo Sapiens; identical to SEQ ID NO: 26314

SEQ ID NO: 699575 - RNA, 64 nt, Homo Sapiens; identical to SEQ ID NO: 26315

SEQ ID NO: 699576 - RNA, 64 nt, Homo Sapiens; identical to SEQ ID NO: 26316

SEQ ID NO: 699577 - RNA, 64 nt, Homo Sapiens; identical to SEQ ID NO: 26317

SEQ ID NO: 699578 - RNA, 64 nt, Homo Sapiens; identical to SEQ ID NO: 26318

SEQ ID NO: 699579 - RNA, 64 nt, Homo Sapiens; identical to SEQ ID NO: 26319

SEQ ID NO: 699580 - RNA, 64 nt, Homo Sapiens; identical to SEQ ID NO: 26320

SEQ ID NO: 699581 - RNA, 64 nt, Homo Sapiens; identical to SEQ ID NO: 26321

SEQ ID NO: 699582 - RNA, 64 nt, Homo Sapiens; identical to SEQ ID NO: 26322

SEQ ID NO: 699583 - RNA, 64 nt, Homo Sapiens; identical to SEQ ID NO: 26323

SEQ ID NO: 699584 - RNA, 64 nt, Homo Sapiens; identical to SEQ ID NO: 26324

SEQ ID NO: 699585 - RNA, 64 nt, Homo Sapiens; identical to SEQ ID NO: 26325

SEQ ID NO: 699586 - RNA, 64 nt, Homo Sapiens; identical to SEQ ID NO: 26326

SEQ ID NO: 699587 - RNA, 64 nt, Homo Sapiens; identical to SEQ ID NO: 26327

SEQ ID NO: 699588 - RNA, 64 nt, Homo Sapiens; identical to SEQ ID NO: 26328

SEQ ID NO: 699589 - RNA, 64 nt, Homo Sapiens; identical to SEQ ID NO: 26329

SEQ ID NO: 699590 - RNA, 64 nt, Homo Sapiens; identical to SEQ ID NO: 26330

SEQ ID NO: 699591 - RNA, 64 nt, Homo Sapiens; identical to SEQ ID NO: 26331

SEQ ID NO: 699592 - RNA, 64 nt, Homo Sapiens; identical to SEQ ID NO: 26332

SEQ ID NO: 699593 - RNA, 64 nt, Homo Sapiens; identical to SEQ ID NO: 26333

SEQ ID NO: 699594 - RNA, 64 nt, Homo Sapiens; identical to SEQ ID NO: 26334

SEQ ID NO: 699595 - RNA, 64 nt, Homo Sapiens; identical to SEQ ID NO: 26335

SEQ ID NO: 699596 - RNA, 64 nt, Homo Sapiens; identical to SEQ ID NO: 26336

SEQ ID NO: 699597 - RNA, 64 nt, Homo Sapiens; identical to SEQ ID NO: 26337

SEQ ID NO: 699598 - RNA, 64 nt, Homo Sapiens; identical to SEQ ID NO: 26338

SEQ ID NO: 699599 - RNA, 64 nt, Homo Sapiens; identical to SEQ ID NO: 26339

SEQ ID NO: 699600 - RNA, 64 nt, Homo Sapiens; identical to SEQ ID NO: 26340

SEQ ID NO: 699601 - RNA, 64 nt, Homo Sapiens; identical to SEQ ID NO: 26341

SEQ ID NO: 699602 - RNA, 64 nt, Homo Sapiens; identical to SEQ ID NO: 26342

SEQ ID NO: 699603 - RNA, 64 nt, Homo Sapiens; identical to SEQ ID NO: 26343

SEQ ID NO: 699604 - RNA, 64 nt, Homo Sapiens; identical to SEQ ID NO: 26344

SEQ ID NO: 699605 - RNA, 64 nt, Homo Sapiens; identical to SEQ ID NO: 26345

SEQ ID NO: 699606 - RNA, 64 nt, Homo Sapiens; identical to SEQ ID NO: 26346

SEQ ID NO: 699607 - RNA, 64 nt, Homo Sapiens; identical to SEQ ID NO: 26347

SEQ ID NO: 699608 - RNA, 64 nt, Homo Sapiens; identical to SEQ ID NO: 26348

SEQ ID NO: 699609 - RNA, 64 nt, Homo Sapiens; identical to SEQ ID NO: 26349

SEQ ID NO: 699610 - RNA, 64 nt, Homo Sapiens; identical to SEQ ID NO: 26350

SEQ ID NO: 699611 - RNA, 64 nt, Homo Sapiens; identical to SEQ ID NO: 26351

SEQ ID NO: 699612 - RNA, 64 nt, Homo Sapiens; identical to SEQ ID NO: 26352

SEQ ID NO: 699613 - RNA, 64 nt, Homo Sapiens; identical to SEQ ID NO: 26353

SEQ ID NO: 699614 - RNA, 64 nt, Homo Sapiens; identical to SEQ ID NO: 26354

SEQ ID NO: 699615 - RNA, 64 nt, Homo Sapiens; identical to SEQ ID NO: 26355

SEQ ID NO: 699616 - RNA, 64 nt, Homo Sapiens; identical to SEQ ID NO: 26356

SEQ ID NO: 699617 - RNA, 64 nt, Homo Sapiens; identical to SEQ ID NO: 26357

SEQ ID NO: 699618 - RNA, 64 nt, Homo Sapiens; identical to SEQ ID NO: 26358

SEQ ID NO: 699619 - RNA, 64 nt, Homo Sapiens; identical to SEQ ID NO: 26359

SEQ ID NO: 699620 - RNA, 64 nt, Homo Sapiens; identical to SEQ ID NO: 26360

SEQ ID NO: 699621 - RNA, 64 nt, Homo Sapiens; identical to SEQ ID NO: 26361

SEQ ID NO: 699622 - RNA, 64 nt, Homo Sapiens; identical to SEQ ID NO: 26362

SEQ ID NO: 699623 - RNA, 64 nt, Homo Sapiens; identical to SEQ ID NO: 26363

SEQ ID NO: 699624 - RNA, 64 nt, Homo Sapiens; identical to SEQ ID NO: 26364

SEQ ID NO: 699625 - RNA, 64 nt, Homo Sapiens; identical to SEQ ID NO: 26365

SEQ ID NO: 699626 - RNA, 64 nt, Homo Sapiens; identical to SEQ ID NO: 26366

SEQ ID NO: 699627 - RNA, 64 nt, Homo Sapiens; identical to SEQ ID NO: 26367

SEQ ID NO: 699628 - RNA, 64 nt, Homo Sapiens; identical to SEQ ID NO: 26368

SEQ ID NO: 699629 - RNA, 64 nt, Homo Sapiens; identical to SEQ ID NO: 26369

SEQ ID NO: 699630 - RNA, 64 nt, Homo Sapiens; identical to SEQ ID NO: 26370

SEQ ID NO: 699631 - RNA, 64 nt, Homo Sapiens; identical to SEQ ID NO: 26371

SEQ ID NO: 699632 - RNA, 64 nt, Homo Sapiens; identical to SEQ ID NO: 26372

SEQ ID NO: 699633 - RNA, 64 nt, Homo Sapiens; identical to SEQ ID NO: 26373

SEQ ID NO: 699634 - RNA, 64 nt, Homo Sapiens; identical to SEQ ID NO: 26374

SEQ ID NO: 699635 - RNA, 64 nt, Homo Sapiens; identical to SEQ ID NO: 26375

SEQ ID NO: 699636 - RNA, 64 nt, Homo Sapiens; identical to SEQ ID NO: 26376

SEQ ID NO: 699637 - RNA, 64 nt, Homo Sapiens; identical to SEQ ID NO: 26377

SEQ ID NO: 699638 - RNA, 64 nt, Homo Sapiens; identical to SEQ ID NO: 26378

SEQ ID NO: 699639 - RNA, 64 nt, Homo Sapiens; identical to SEQ ID NO: 26379

SEQ ID NO: 699640 - RNA, 64 nt, Homo Sapiens; identical to SEQ ID NO: 26380

SEQ ID NO: 699641 - RNA, 64 nt, Homo Sapiens; identical to SEQ ID NO: 26381

SEQ ID NO: 699642 - RNA, 64 nt, Homo Sapiens; identical to SEQ ID NO: 26382

SEQ ID NO: 699643 - RNA, 64 nt, Homo Sapiens; identical to SEQ ID NO: 26383

SEQ ID NO: 699644 - RNA, 64 nt, Homo Sapiens; identical to SEQ ID NO: 26384

SEQ ID NO: 699645 - RNA, 64 nt, Homo Sapiens; identical to SEQ ID NO: 26385

SEQ ID NO: 699646 - RNA, 64 nt, Homo Sapiens; identical to SEQ ID NO: 26386

SEQ ID NO: 699647 - RNA, 64 nt, Homo Sapiens; identical to SEQ ID NO: 26387

SEQ ID NO: 699648 - RNA, 64 nt, Homo Sapiens; identical to SEQ ID NO: 26388

SEQ ID NO: 699649 - RNA, 64 nt, Homo Sapiens; identical to SEQ ID NO: 26389

SEQ ID NO: 699650 - RNA, 64 nt, Homo Sapiens; identical to SEQ ID NO: 26390

SEQ ID NO: 699651 - RNA, 64 nt, Homo Sapiens; identical to SEQ ID NO: 26391

SEQ ID NO: 699652 - RNA, 64 nt, Homo Sapiens; identical to SEQ ID NO: 26392

SEQ ID NO: 699653 - RNA, 64 nt, Homo Sapiens; identical to SEQ ID NO: 26393

SEQ ID NO: 699654 - RNA, 64 nt, Homo Sapiens; identical to SEQ ID NO: 26394

SEQ ID NO: 699655 - RNA, 64 nt, Homo Sapiens; identical to SEQ ID NO: 26395

SEQ ID NO: 699656 - RNA, 64 nt, Homo Sapiens; identical to SEQ ID NO: 26396

SEQ ID NO: 699657 - RNA, 64 nt, Homo Sapiens; identical to SEQ ID NO: 26397

SEQ ID NO: 699658 - RNA, 64 nt, Homo Sapiens; identical to SEQ ID NO: 26398

SEQ ID NO: 699659 - RNA, 64 nt, Homo Sapiens; identical to SEQ ID NO: 26399

SEQ ID NO: 699660 - RNA, 64 nt, Homo Sapiens; identical to SEQ ID NO: 26400

SEQ ID NO: 699661 - RNA, 64 nt, Homo Sapiens; identical to SEQ ID NO: 26401

SEQ ID NO: 699662 - RNA, 64 nt, Homo Sapiens; identical to SEQ ID NO: 26402

SEQ ID NO: 699663 - RNA, 64 nt, Homo Sapiens; identical to SEQ ID NO: 26403

SEQ ID NO: 699664 - RNA, 64 nt, Homo Sapiens; identical to SEQ ID NO: 26404

SEQ ID NO: 699665 - RNA, 64 nt, Homo Sapiens; identical to SEQ ID NO: 26405

SEQ ID NO: 699666 - RNA, 64 nt, Homo Sapiens; identical to SEQ ID NO: 26406

SEQ ID NO: 699667 - RNA, 64 nt, Homo Sapiens; identical to SEQ ID NO: 26407

SEQ ID NO: 699668 - RNA, 64 nt, Homo Sapiens; identical to SEQ ID NO: 26408

SEQ ID NO: 699669 - RNA, 64 nt, Homo Sapiens; identical to SEQ ID NO: 26409

SEQ ID NO: 699670 - RNA, 64 nt, Homo Sapiens; identical to SEQ ID NO: 26410

SEQ ID NO: 699671 - RNA, 64 nt, Homo Sapiens; identical to SEQ ID NO: 26411

SEQ ID NO: 699672 - RNA, 64 nt, Homo Sapiens; identical to SEQ ID NO: 26412

SEQ ID NO: 699673 - RNA, 64 nt, Homo Sapiens; identical to SEQ ID NO: 26413

SEQ ID NO: 699674 - RNA, 64 nt, Homo Sapiens; identical to SEQ ID NO: 26414

SEQ ID NO: 699675 - RNA, 64 nt, Homo Sapiens; identical to SEQ ID NO: 26415

SEQ ID NO: 699676 - RNA, 64 nt, Homo Sapiens; identical to SEQ ID NO: 26416

SEQ ID NO: 699677 - RNA, 64 nt, Homo Sapiens; identical to SEQ ID NO: 26417

SEQ ID NO: 699678 - RNA, 64 nt, Homo Sapiens; identical to SEQ ID NO: 26418

SEQ ID NO: 699679 - RNA, 64 nt, Homo Sapiens; identical to SEQ ID NO: 26419

SEQ ID NO: 699680 - RNA, 64 nt, Homo Sapiens; identical to SEQ ID NO: 26420

SEQ ID NO: 699681 - RNA, 64 nt, Homo Sapiens; identical to SEQ ID NO: 26421

SEQ ID NO: 699682 - RNA, 64 nt, Homo Sapiens; identical to SEQ ID NO: 26422

SEQ ID NO: 699683 - RNA, 64 nt, Homo Sapiens; identical to SEQ ID NO: 26423

SEQ ID NO: 699684 - RNA, 64 nt, Homo Sapiens; identical to SEQ ID NO: 26424

SEQ ID NO: 699685 - RNA, 64 nt, Homo Sapiens; identical to SEQ ID NO: 26425

SEQ ID NO: 699686 - RNA, 64 nt, Homo Sapiens; identical to SEQ ID NO: 26426

SEQ ID NO: 699687 - RNA, 64 nt, Homo Sapiens; identical to SEQ ID NO: 26427

SEQ ID NO: 699688 - RNA, 64 nt, Homo Sapiens; identical to SEQ ID NO: 26428

SEQ ID NO: 699689 - RNA, 64 nt, Homo Sapiens; identical to SEQ ID NO: 26429

SEQ ID NO: 699690 - RNA, 64 nt, Homo Sapiens; identical to SEQ ID NO: 26430

SEQ ID NO: 699691 - RNA, 64 nt, Homo Sapiens; identical to SEQ ID NO: 26431

SEQ ID NO: 699692 - RNA, 64 nt, Homo Sapiens; identical to SEQ ID NO: 26432

SEQ ID NO: 699693 - RNA, 64 nt, Homo Sapiens; identical to SEQ ID NO: 26433

SEQ ID NO: 699694 - RNA, 64 nt, Homo Sapiens; identical to SEQ ID NO: 26434

SEQ ID NO: 699695 - RNA, 64 nt, Homo Sapiens; identical to SEQ ID NO: 26435

SEQ ID NO: 699696 - RNA, 64 nt, Homo Sapiens; identical to SEQ ID NO: 26436

SEQ ID NO: 699697 - RNA, 64 nt, Homo Sapiens; identical to SEQ ID NO: 26437

SEQ ID NO: 699698 - RNA, 64 nt, Homo Sapiens; identical to SEQ ID NO: 26438

SEQ ID NO: 699699 - RNA, 64 nt, Homo Sapiens; identical to SEQ ID NO: 26439

SEQ ID NO: 699700 - RNA, 64 nt, Homo Sapiens; identical to SEQ ID NO: 26440

SEQ ID NO: 699701 - RNA, 64 nt, Homo Sapiens; identical to SEQ ID NO: 26441

SEQ ID NO: 699702 - RNA, 64 nt, Homo Sapiens; identical to SEQ ID NO: 26442

SEQ ID NO: 699703 - RNA, 64 nt, Homo Sapiens; identical to SEQ ID NO: 26443

SEQ ID NO: 699704 - RNA, 64 nt, Homo Sapiens; identical to SEQ ID NO: 26444

SEQ ID NO: 699705 - RNA, 64 nt, Homo Sapiens; identical to SEQ ID NO: 26445

SEQ ID NO: 699706 - RNA, 64 nt, Homo Sapiens; identical to SEQ ID NO: 26446

SEQ ID NO: 699707 - RNA, 64 nt, Homo Sapiens; identical to SEQ ID NO: 26447

SEQ ID NO: 699708 - RNA, 64 nt, Homo Sapiens; identical to SEQ ID NO: 26448

SEQ ID NO: 699709 - RNA, 64 nt, Homo Sapiens; identical to SEQ ID NO: 26449

SEQ ID NO: 699710 - RNA, 64 nt, Homo Sapiens; identical to SEQ ID NO: 26450

SEQ ID NO: 699711 - RNA, 64 nt, Homo Sapiens; identical to SEQ ID NO: 26451

SEQ ID NO: 699712 - RNA, 64 nt, Homo Sapiens; identical to SEQ ID NO: 26452

SEQ ID NO: 699713 - RNA, 64 nt, Homo Sapiens; identical to SEQ ID NO: 26453

SEQ ID NO: 699714 - RNA, 64 nt, Homo Sapiens; identical to SEQ ID NO: 26454

SEQ ID NO: 699715 - RNA, 64 nt, Homo Sapiens; identical to SEQ ID NO: 26455

SEQ ID NO: 699716 - RNA, 64 nt, Homo Sapiens; identical to SEQ ID NO: 26456

SEQ ID NO: 699717 - RNA, 64 nt, Homo Sapiens; identical to SEQ ID NO: 26457

SEQ ID NO: 699718 - RNA, 64 nt, Homo Sapiens; identical to SEQ ID NO: 26458

SEQ ID NO: 699719 - RNA, 64 nt, Homo Sapiens; identical to SEQ ID NO: 26459

SEQ ID NO: 699720 - RNA, 64 nt, Homo Sapiens; identical to SEQ ID NO: 26460

SEQ ID NO: 699721 - RNA, 64 nt, Homo Sapiens; identical to SEQ ID NO: 26461

SEQ ID NO: 699722 - RNA, 64 nt, Homo Sapiens; identical to SEQ ID NO: 26462

SEQ ID NO: 699723 - RNA, 64 nt, Homo Sapiens; identical to SEQ ID NO: 26463

SEQ ID NO: 699724 - RNA, 64 nt, Homo Sapiens; identical to SEQ ID NO: 26464

SEQ ID NO: 699725 - RNA, 64 nt, Homo Sapiens; identical to SEQ ID NO: 26465

SEQ ID NO: 699726 - RNA, 64 nt, Homo Sapiens; identical to SEQ ID NO: 26466

SEQ ID NO: 699727 - RNA, 64 nt, Homo Sapiens; identical to SEQ ID NO: 26467

SEQ ID NO: 699728 - RNA, 64 nt, Homo Sapiens; identical to SEQ ID NO: 26468

SEQ ID NO: 699729 - RNA, 64 nt, Homo Sapiens; identical to SEQ ID NO: 26469

SEQ ID NO: 699730 - RNA, 64 nt, Homo Sapiens; identical to SEQ ID NO: 26470

SEQ ID NO: 699731 - RNA, 64 nt, Homo Sapiens; identical to SEQ ID NO: 26471

SEQ ID NO: 699732 - RNA, 64 nt, Homo Sapiens; identical to SEQ ID NO: 26472

SEQ ID NO: 699733 - RNA, 64 nt, Homo Sapiens; identical to SEQ ID NO: 26473

SEQ ID NO: 699734 - RNA, 64 nt, Homo Sapiens; identical to SEQ ID NO: 26474

SEQ ID NO: 699735 - RNA, 64 nt, Homo Sapiens; identical to SEQ ID NO: 26475

SEQ ID NO: 699736 - RNA, 64 nt, Homo Sapiens; identical to SEQ ID NO: 26476

SEQ ID NO: 699737 - RNA, 64 nt, Homo Sapiens; identical to SEQ ID NO: 26477

SEQ ID NO: 699738 - RNA, 64 nt, Homo Sapiens; identical to SEQ ID NO: 26478

SEQ ID NO: 699739 - RNA, 64 nt, Homo Sapiens; identical to SEQ ID NO: 26479

SEQ ID NO: 699740 - RNA, 64 nt, Homo Sapiens; identical to SEQ ID NO: 26480

SEQ ID NO: 699741 - RNA, 64 nt, Homo Sapiens; identical to SEQ ID NO: 26481

SEQ ID NO: 699742 - RNA, 63 nt, Homo Sapiens; identical to SEQ ID NO: 26482

SEQ ID NO: 699743 - RNA, 63 nt, Homo Sapiens; identical to SEQ ID NO: 26483

SEQ ID NO: 699744 - RNA, 64 nt, Homo Sapiens; identical to SEQ ID NO: 26484

SEQ ID NO: 699745 - RNA, 64 nt, Homo Sapiens; identical to SEQ ID NO: 26485

SEQ ID NO: 699746 - RNA, 64 nt, Homo Sapiens; identical to SEQ ID NO: 26486

SEQ ID NO: 699747 - RNA, 64 nt, Homo Sapiens; identical to SEQ ID NO: 26487

SEQ ID NO: 699748 - RNA, 64 nt, Homo Sapiens; identical to SEQ ID NO: 26488

SEQ ID NO: 699749 - RNA, 64 nt, Homo Sapiens; identical to SEQ ID NO: 26489

SEQ ID NO: 699750 - RNA, 64 nt, Homo Sapiens; identical to SEQ ID NO: 26490

SEQ ID NO: 699751 - RNA, 64 nt, Homo Sapiens; identical to SEQ ID NO: 26491

SEQ ID NO: 699752 - RNA, 64 nt, Homo Sapiens; identical to SEQ ID NO: 26492

SEQ ID NO: 699753 - RNA, 64 nt, Homo Sapiens; identical to SEQ ID NO: 26493

SEQ ID NO: 699754 - RNA, 64 nt, Homo Sapiens; identical to SEQ ID NO: 26494

SEQ ID NO: 699755 - RNA, 64 nt, Homo Sapiens; identical to SEQ ID NO: 26495

SEQ ID NO: 699756 - RNA, 64 nt, Homo Sapiens; identical to SEQ ID NO: 26496

SEQ ID NO: 699757 - RNA, 64 nt, Homo Sapiens; identical to SEQ ID NO: 26497

SEQ ID NO: 699758 - RNA, 64 nt, Homo Sapiens; identical to SEQ ID NO: 26498

SEQ ID NO: 699759 - RNA, 64 nt, Homo Sapiens; identical to SEQ ID NO: 26499

SEQ ID NO: 699760 - RNA, 64 nt, Homo Sapiens; identical to SEQ ID NO: 26500

SEQ ID NO: 699761 - RNA, 64 nt, Homo Sapiens; identical to SEQ ID NO: 26501

SEQ ID NO: 699762 - RNA, 64 nt, Homo Sapiens; identical to SEQ ID NO: 26502

SEQ ID NO: 699763 - RNA, 64 nt, Homo Sapiens; identical to SEQ ID NO: 26503

SEQ ID NO: 699764 - RNA, 64 nt, Homo Sapiens; identical to SEQ ID NO: 26504

SEQ ID NO: 699765 - RNA, 64 nt, Homo Sapiens; identical to SEQ ID NO: 26505

SEQ ID NO: 699766 - RNA, 64 nt, Homo Sapiens; identical to SEQ ID NO: 26506

SEQ ID NO: 699767 - RNA, 64 nt, Homo Sapiens; identical to SEQ ID NO: 26507

SEQ ID NO: 699768 - RNA, 64 nt, Homo Sapiens; identical to SEQ ID NO: 26508

SEQ ID NO: 699769 - RNA, 64 nt, Homo Sapiens; identical to SEQ ID NO: 26509

SEQ ID NO: 699770 - RNA, 64 nt, Homo Sapiens; identical to SEQ ID NO: 26510

SEQ ID NO: 699771 - RNA, 64 nt, Homo Sapiens; identical to SEQ ID NO: 26511

SEQ ID NO: 699772 - RNA, 64 nt, Homo Sapiens; identical to SEQ ID NO: 26512

SEQ ID NO: 699773 - RNA, 64 nt, Homo Sapiens; identical to SEQ ID NO: 26513

SEQ ID NO: 699774 - RNA, 64 nt, Homo Sapiens; identical to SEQ ID NO: 26514

SEQ ID NO: 699775 - RNA, 64 nt, Homo Sapiens; identical to SEQ ID NO: 26515

SEQ ID NO: 699776 - RNA, 64 nt, Homo Sapiens; identical to SEQ ID NO: 26516

SEQ ID NO: 699777 - RNA, 64 nt, Homo Sapiens; identical to SEQ ID NO: 26517

SEQ ID NO: 699778 - RNA, 64 nt, Homo Sapiens; identical to SEQ ID NO: 26518

SEQ ID NO: 699779 - RNA, 64 nt, Homo Sapiens; identical to SEQ ID NO: 26519

SEQ ID NO: 699780 - RNA, 64 nt, Homo Sapiens; identical to SEQ ID NO: 26520

SEQ ID NO: 699781 - RNA, 64 nt, Homo Sapiens; identical to SEQ ID NO: 26521

SEQ ID NO: 699782 - RNA, 64 nt, Homo Sapiens; identical to SEQ ID NO: 26522

SEQ ID NO: 699783 - RNA, 64 nt, Homo Sapiens; identical to SEQ ID NO: 26523

SEQ ID NO: 699784 - RNA, 64 nt, Homo Sapiens; identical to SEQ ID NO: 26524

SEQ ID NO: 699785 - RNA, 64 nt, Homo Sapiens; identical to SEQ ID NO: 26525

SEQ ID NO: 699786 - RNA, 64 nt, Homo Sapiens; identical to SEQ ID NO: 26526

SEQ ID NO: 699787 - RNA, 64 nt, Homo Sapiens; identical to SEQ ID NO: 26527

SEQ ID NO: 699788 - RNA, 64 nt, Homo Sapiens; identical to SEQ ID NO: 26528

SEQ ID NO: 699789 - RNA, 64 nt, Homo Sapiens; identical to SEQ ID NO: 26529

SEQ ID NO: 699790 - RNA, 64 nt, Homo Sapiens; identical to SEQ ID NO: 26530

SEQ ID NO: 699791 - RNA, 64 nt, Homo Sapiens; identical to SEQ ID NO: 26531

SEQ ID NO: 699792 - RNA, 64 nt, Homo Sapiens; identical to SEQ ID NO: 26532

SEQ ID NO: 699793 - RNA, 64 nt, Homo Sapiens; identical to SEQ ID NO: 26533

SEQ ID NO: 699794 - RNA, 64 nt, Homo Sapiens; identical to SEQ ID NO: 26534

SEQ ID NO: 699795 - RNA, 64 nt, Homo Sapiens; identical to SEQ ID NO: 26535

SEQ ID NO: 699796 - RNA, 64 nt, Homo Sapiens; identical to SEQ ID NO: 26536

SEQ ID NO: 699797 - RNA, 64 nt, Homo Sapiens; identical to SEQ ID NO: 26537

SEQ ID NO: 699798 - RNA, 64 nt, Homo Sapiens; identical to SEQ ID NO: 26538

SEQ ID NO: 699799 - RNA, 64 nt, Homo Sapiens; identical to SEQ ID NO: 26539

SEQ ID NO: 699800 - RNA, 64 nt, Homo Sapiens; identical to SEQ ID NO: 26540

SEQ ID NO: 699801 - RNA, 64 nt, Homo Sapiens; identical to SEQ ID NO: 26541

SEQ ID NO: 699802 - RNA, 64 nt, Homo Sapiens; identical to SEQ ID NO: 26542

SEQ ID NO: 699803 - RNA, 64 nt, Homo Sapiens; identical to SEQ ID NO: 26543

SEQ ID NO: 699804 - RNA, 64 nt, Homo Sapiens; identical to SEQ ID NO: 26544

SEQ ID NO: 699805 - RNA, 64 nt, Homo Sapiens; identical to SEQ ID NO: 26545

SEQ ID NO: 699806 - RNA, 64 nt, Homo Sapiens; identical to SEQ ID NO: 26546

SEQ ID NO: 699807 - RNA, 64 nt, Homo Sapiens; identical to SEQ ID NO: 26547

SEQ ID NO: 699808 - RNA, 64 nt, Homo Sapiens; identical to SEQ ID NO: 26548

SEQ ID NO: 699809 - RNA, 64 nt, Homo Sapiens; identical to SEQ ID NO: 26549

SEQ ID NO: 699810 - RNA, 64 nt, Homo Sapiens; identical to SEQ ID NO: 26550

SEQ ID NO: 699811 - RNA, 64 nt, Homo Sapiens; identical to SEQ ID NO: 26551

SEQ ID NO: 699812 - RNA, 64 nt, Homo Sapiens; identical to SEQ ID NO: 26552

SEQ ID NO: 699813 - RNA, 64 nt, Homo Sapiens; identical to SEQ ID NO: 26553

SEQ ID NO: 699814 - RNA, 64 nt, Homo Sapiens; identical to SEQ ID NO: 26554

SEQ ID NO: 699815 - RNA, 64 nt, Homo Sapiens; identical to SEQ ID NO: 26555

SEQ ID NO: 699816 - RNA, 64 nt, Homo Sapiens; identical to SEQ ID NO: 26556

SEQ ID NO: 699817 - RNA, 64 nt, Homo Sapiens; identical to SEQ ID NO: 26557

SEQ ID NO: 699818 - RNA, 64 nt, Homo Sapiens; identical to SEQ ID NO: 26558

SEQ ID NO: 699819 - RNA, 50 nt, Homo Sapiens; identical to SEQ ID NO: 26559

SEQ ID NO: 699820 - RNA, 51 nt, Homo Sapiens; identical to SEQ ID NO: 26560

SEQ ID NO: 699821 - RNA, 52 nt, Homo Sapiens; identical to SEQ ID NO: 26561

SEQ ID NO: 699822 - RNA, 53 nt, Homo Sapiens; identical to SEQ ID NO: 26562

SEQ ID NO: 699823 - RNA, 54 nt, Homo Sapiens; identical to SEQ ID NO: 26563

SEQ ID NO: 699824 - RNA, 64 nt, Homo Sapiens; identical to SEQ ID NO: 26564

SEQ ID NO: 699825 - RNA, 64 nt, Homo Sapiens; identical to SEQ ID NO: 26565

SEQ ID NO: 699826 - RNA, 64 nt, Homo Sapiens; identical to SEQ ID NO: 26566

SEQ ID NO: 699827 - RNA, 64 nt, Homo Sapiens; identical to SEQ ID NO: 26567

SEQ ID NO: 699828 - RNA, 64 nt, Homo Sapiens; identical to SEQ ID NO: 26568

SEQ ID NO: 699829 - RNA, 64 nt, Homo Sapiens; identical to SEQ ID NO: 26569

SEQ ID NO: 699830 - RNA, 64 nt, Homo Sapiens; identical to SEQ ID NO: 26570

SEQ ID NO: 699831 - RNA, 64 nt, Homo Sapiens; identical to SEQ ID NO: 26571

SEQ ID NO: 699832 - RNA, 64 nt, Homo Sapiens; identical to SEQ ID NO: 26572

SEQ ID NO: 699833 - RNA, 64 nt, Homo Sapiens; identical to SEQ ID NO: 26573

SEQ ID NO: 699834 - RNA, 64 nt, Homo Sapiens; identical to SEQ ID NO: 26574

SEQ ID NO: 699835 - RNA, 64 nt, Homo Sapiens; identical to SEQ ID NO: 26575

SEQ ID NO: 699836 - RNA, 64 nt, Homo Sapiens; identical to SEQ ID NO: 26576

SEQ ID NO: 699837 - RNA, 64 nt, Homo Sapiens; identical to SEQ ID NO: 26577

SEQ ID NO: 699838 - RNA, 64 nt, Homo Sapiens; identical to SEQ ID NO: 26578

SEQ ID NO: 699839 - RNA, 64 nt, Homo Sapiens; identical to SEQ ID NO: 26579

SEQ ID NO: 699840 - RNA, 64 nt, Homo Sapiens; identical to SEQ ID NO: 26580

SEQ ID NO: 699841 - RNA, 64 nt, Homo Sapiens; identical to SEQ ID NO: 26581

SEQ ID NO: 699842 - RNA, 64 nt, Homo Sapiens; identical to SEQ ID NO: 26582

SEQ ID NO: 699843 - RNA, 64 nt, Homo Sapiens; identical to SEQ ID NO: 26583

SEQ ID NO: 699844 - RNA, 64 nt, Homo Sapiens; identical to SEQ ID NO: 26584

SEQ ID NO: 699845 - RNA, 64 nt, Homo Sapiens; identical to SEQ ID NO: 26585

SEQ ID NO: 699846 - RNA, 64 nt, Homo Sapiens; identical to SEQ ID NO: 26586

SEQ ID NO: 699847 - RNA, 64 nt, Homo Sapiens; identical to SEQ ID NO: 26587

SEQ ID NO: 699848 - RNA, 64 nt, Homo Sapiens; identical to SEQ ID NO: 26588

SEQ ID NO: 699849 - RNA, 64 nt, Homo Sapiens; identical to SEQ ID NO: 26589

SEQ ID NO: 699850 - RNA, 64 nt, Homo Sapiens; identical to SEQ ID NO: 26590

SEQ ID NO: 699851 - RNA, 64 nt, Homo Sapiens; identical to SEQ ID NO: 26591

SEQ ID NO: 699852 - RNA, 64 nt, Homo Sapiens; identical to SEQ ID NO: 26592

SEQ ID NO: 699853 - RNA, 64 nt, Homo Sapiens; identical to SEQ ID NO: 26593

SEQ ID NO: 699854 - RNA, 64 nt, Homo Sapiens; identical to SEQ ID NO: 26594

SEQ ID NO: 699855 - RNA, 64 nt, Homo Sapiens; identical to SEQ ID NO: 26595

SEQ ID NO: 699856 - RNA, 64 nt, Homo Sapiens; identical to SEQ ID NO: 26596

SEQ ID NO: 699857 - RNA, 64 nt, Homo Sapiens; identical to SEQ ID NO: 26597

SEQ ID NO: 699858 - RNA, 64 nt, Homo Sapiens; identical to SEQ ID NO: 26598

SEQ ID NO: 699859 - RNA, 64 nt, Homo Sapiens; identical to SEQ ID NO: 26599

SEQ ID NO: 699860 - RNA, 64 nt, Homo Sapiens; identical to SEQ ID NO: 26600

SEQ ID NO: 699861 - RNA, 64 nt, Homo Sapiens; identical to SEQ ID NO: 26601

SEQ ID NO: 699862 - RNA, 64 nt, Homo Sapiens; identical to SEQ ID NO: 26602

SEQ ID NO: 699863 - RNA, 64 nt, Homo Sapiens; identical to SEQ ID NO: 26603

SEQ ID NO: 699864 - RNA, 64 nt, Homo Sapiens; identical to SEQ ID NO: 26604

SEQ ID NO: 699865 - RNA, 64 nt, Homo Sapiens; identical to SEQ ID NO: 26605

SEQ ID NO: 699866 - RNA, 64 nt, Homo Sapiens; identical to SEQ ID NO: 26606

SEQ ID NO: 699867 - RNA, 64 nt, Homo Sapiens; identical to SEQ ID NO: 26607

SEQ ID NO: 699868 - RNA, 64 nt, Homo Sapiens; identical to SEQ ID NO: 26608

SEQ ID NO: 699869 - RNA, 64 nt, Homo Sapiens; identical to SEQ ID NO: 26609

SEQ ID NO: 699870 - RNA, 64 nt, Homo Sapiens; identical to SEQ ID NO: 26610

SEQ ID NO: 699871 - RNA, 64 nt, Homo Sapiens; identical to SEQ ID NO: 26611

SEQ ID NO: 699872 - RNA, 64 nt, Homo Sapiens; identical to SEQ ID NO: 26612

SEQ ID NO: 699873 - RNA, 64 nt, Homo Sapiens; identical to SEQ ID NO: 26613

SEQ ID NO: 699874 - RNA, 64 nt, Homo Sapiens; identical to SEQ ID NO: 26614

SEQ ID NO: 699875 - RNA, 64 nt, Homo Sapiens; identical to SEQ ID NO: 26615

SEQ ID NO: 699876 - RNA, 64 nt, Homo Sapiens; identical to SEQ ID NO: 26616

SEQ ID NO: 699877 - RNA, 64 nt, Homo Sapiens; identical to SEQ ID NO: 26617

SEQ ID NO: 699878 - RNA, 64 nt, Homo Sapiens; identical to SEQ ID NO: 26618

SEQ ID NO: 699879 - RNA, 64 nt, Homo Sapiens; identical to SEQ ID NO: 26619

SEQ ID NO: 699880 - RNA, 64 nt, Homo Sapiens; identical to SEQ ID NO: 26620

SEQ ID NO: 699881 - RNA, 64 nt, Homo Sapiens; identical to SEQ ID NO: 26621

SEQ ID NO: 699882 - RNA, 64 nt, Homo Sapiens; identical to SEQ ID NO: 26622

SEQ ID NO: 699883 - RNA, 64 nt, Homo Sapiens; identical to SEQ ID NO: 26623

SEQ ID NO: 699884 - RNA, 64 nt, Homo Sapiens; identical to SEQ ID NO: 26624

SEQ ID NO: 699885 - RNA, 64 nt, Homo Sapiens; identical to SEQ ID NO: 26625

SEQ ID NO: 699886 - RNA, 64 nt, Homo Sapiens; identical to SEQ ID NO: 26626

SEQ ID NO: 699887 - RNA, 64 nt, Homo Sapiens; identical to SEQ ID NO: 26627

SEQ ID NO: 699888 - RNA, 64 nt, Homo Sapiens; identical to SEQ ID NO: 26628

SEQ ID NO: 699889 - RNA, 64 nt, Homo Sapiens; identical to SEQ ID NO: 26629

SEQ ID NO: 699890 - RNA, 64 nt, Homo Sapiens; identical to SEQ ID NO: 26630

SEQ ID NO: 699891 - RNA, 64 nt, Homo Sapiens; identical to SEQ ID NO: 26631

SEQ ID NO: 699892 - RNA, 64 nt, Homo Sapiens; identical to SEQ ID NO: 26632

SEQ ID NO: 699893 - RNA, 64 nt, Homo Sapiens; identical to SEQ ID NO: 26633

SEQ ID NO: 699894 - RNA, 64 nt, Homo Sapiens; identical to SEQ ID NO: 26634

SEQ ID NO: 699895 - RNA, 64 nt, Homo Sapiens; identical to SEQ ID NO: 26635

SEQ ID NO: 699896 - RNA, 64 nt, Homo Sapiens; identical to SEQ ID NO: 26636

SEQ ID NO: 699897 - RNA, 64 nt, Homo Sapiens; identical to SEQ ID NO: 26637

SEQ ID NO: 699898 - RNA, 64 nt, Homo Sapiens; identical to SEQ ID NO: 26638

SEQ ID NO: 699899 - RNA, 64 nt, Homo Sapiens; identical to SEQ ID NO: 26639

SEQ ID NO: 699900 - RNA, 64 nt, Homo Sapiens; identical to SEQ ID NO: 26640

SEQ ID NO: 699901 - RNA, 64 nt, Homo Sapiens; identical to SEQ ID NO: 26641

SEQ ID NO: 699902 - RNA, 64 nt, Homo Sapiens; identical to SEQ ID NO: 26642

SEQ ID NO: 699903 - RNA, 64 nt, Homo Sapiens; identical to SEQ ID NO: 26643

SEQ ID NO: 699904 - RNA, 64 nt, Homo Sapiens; identical to SEQ ID NO: 26644

SEQ ID NO: 699905 - RNA, 64 nt, Homo Sapiens; identical to SEQ ID NO: 26645

SEQ ID NO: 699906 - RNA, 64 nt, Homo Sapiens; identical to SEQ ID NO: 26646

SEQ ID NO: 699907 - RNA, 64 nt, Homo Sapiens; identical to SEQ ID NO: 26647

SEQ ID NO: 699908 - RNA, 64 nt, Homo Sapiens; identical to SEQ ID NO: 26648

SEQ ID NO: 699909 - RNA, 64 nt, Homo Sapiens; identical to SEQ ID NO: 26649

SEQ ID NO: 699910 - RNA, 64 nt, Homo Sapiens; identical to SEQ ID NO: 26650

SEQ ID NO: 699911 - RNA, 64 nt, Homo Sapiens; identical to SEQ ID NO: 26651

SEQ ID NO: 699912 - RNA, 64 nt, Homo Sapiens; identical to SEQ ID NO: 26652

SEQ ID NO: 699913 - RNA, 64 nt, Homo Sapiens; identical to SEQ ID NO: 26653

SEQ ID NO: 699914 - RNA, 64 nt, Homo Sapiens; identical to SEQ ID NO: 26654

SEQ ID NO: 699915 - RNA, 59 nt, Homo Sapiens; identical to SEQ ID NO: 26655

SEQ ID NO: 699916 - RNA, 60 nt, Homo Sapiens; identical to SEQ ID NO: 26656

SEQ ID NO: 699917 - RNA, 64 nt, Homo Sapiens; identical to SEQ ID NO: 26657

SEQ ID NO: 699918 - RNA, 64 nt, Homo Sapiens; identical to SEQ ID NO: 26658

SEQ ID NO: 699919 - RNA, 64 nt, Homo Sapiens; identical to SEQ ID NO: 26659

SEQ ID NO: 699920 - RNA, 64 nt, Homo Sapiens; identical to SEQ ID NO: 26660

SEQ ID NO: 699921 - RNA, 64 nt, Homo Sapiens; identical to SEQ ID NO: 26661

SEQ ID NO: 699922 - RNA, 64 nt, Homo Sapiens; identical to SEQ ID NO: 26662

SEQ ID NO: 699923 - RNA, 64 nt, Homo Sapiens; identical to SEQ ID NO: 26663

SEQ ID NO: 699924 - RNA, 64 nt, Homo Sapiens; identical to SEQ ID NO: 26664

SEQ ID NO: 699925 - RNA, 64 nt, Homo Sapiens; identical to SEQ ID NO: 26665

SEQ ID NO: 699926 - RNA, 64 nt, Homo Sapiens; identical to SEQ ID NO: 26666

SEQ ID NO: 699927 - RNA, 64 nt, Homo Sapiens; identical to SEQ ID NO: 26667

SEQ ID NO: 699928 - RNA, 64 nt, Homo Sapiens; identical to SEQ ID NO: 26668

SEQ ID NO: 699929 - RNA, 64 nt, Homo Sapiens; identical to SEQ ID NO: 26669

SEQ ID NO: 699930 - RNA, 64 nt, Homo Sapiens; identical to SEQ ID NO: 26670

SEQ ID NO: 699931 - RNA, 64 nt, Homo Sapiens; identical to SEQ ID NO: 26671

SEQ ID NO: 699932 - RNA, 64 nt, Homo Sapiens; identical to SEQ ID NO: 26672

SEQ ID NO: 699933 - RNA, 64 nt, Homo Sapiens; identical to SEQ ID NO: 26673

SEQ ID NO: 699934 - RNA, 64 nt, Homo Sapiens; identical to SEQ ID NO: 26674

SEQ ID NO: 699935 - RNA, 64 nt, Homo Sapiens; identical to SEQ ID NO: 26675

SEQ ID NO: 699936 - RNA, 64 nt, Homo Sapiens; identical to SEQ ID NO: 26676

SEQ ID NO: 699937 - RNA, 64 nt, Homo Sapiens; identical to SEQ ID NO: 26677

SEQ ID NO: 699938 - RNA, 64 nt, Homo Sapiens; identical to SEQ ID NO: 26678

SEQ ID NO: 699939 - RNA, 64 nt, Homo Sapiens; identical to SEQ ID NO: 26679

SEQ ID NO: 699940 - RNA, 64 nt, Homo Sapiens; identical to SEQ ID NO: 26680

SEQ ID NO: 699941 - RNA, 64 nt, Homo Sapiens; identical to SEQ ID NO: 26681

SEQ ID NO: 699942 - RNA, 64 nt, Homo Sapiens; identical to SEQ ID NO: 26682

SEQ ID NO: 699943 - RNA, 64 nt, Homo Sapiens; identical to SEQ ID NO: 26683

SEQ ID NO: 699944 - RNA, 64 nt, Homo Sapiens; identical to SEQ ID NO: 26684

SEQ ID NO: 699945 - RNA, 64 nt, Homo Sapiens; identical to SEQ ID NO: 26685

SEQ ID NO: 699946 - RNA, 64 nt, Homo Sapiens; identical to SEQ ID NO: 26686

SEQ ID NO: 699947 - RNA, 64 nt, Homo Sapiens; identical to SEQ ID NO: 26687

SEQ ID NO: 699948 - RNA, 64 nt, Homo Sapiens; identical to SEQ ID NO: 26688

SEQ ID NO: 699949 - RNA, 64 nt, Homo Sapiens; identical to SEQ ID NO: 26689

SEQ ID NO: 699950 - RNA, 64 nt, Homo Sapiens; identical to SEQ ID NO: 26690

SEQ ID NO: 699951 - RNA, 64 nt, Homo Sapiens; identical to SEQ ID NO: 26691

SEQ ID NO: 699952 - RNA, 64 nt, Homo Sapiens; identical to SEQ ID NO: 26692

SEQ ID NO: 699953 - RNA, 64 nt, Homo Sapiens; identical to SEQ ID NO: 26693

SEQ ID NO: 699954 - RNA, 64 nt, Homo Sapiens; identical to SEQ ID NO: 26694

SEQ ID NO: 699955 - RNA, 64 nt, Homo Sapiens; identical to SEQ ID NO: 26695

SEQ ID NO: 699956 - RNA, 64 nt, Homo Sapiens; identical to SEQ ID NO: 26696

SEQ ID NO: 699957 - RNA, 64 nt, Homo Sapiens; identical to SEQ ID NO: 26697

SEQ ID NO: 699958 - RNA, 64 nt, Homo Sapiens; identical to SEQ ID NO: 26698

SEQ ID NO: 699959 - RNA, 64 nt, Homo Sapiens; identical to SEQ ID NO: 26699

SEQ ID NO: 699960 - RNA, 64 nt, Homo Sapiens; identical to SEQ ID NO: 26700

SEQ ID NO: 699961 - RNA, 64 nt, Homo Sapiens; identical to SEQ ID NO: 26701

SEQ ID NO: 699962 - RNA, 64 nt, Homo Sapiens; identical to SEQ ID NO: 26702

SEQ ID NO: 699963 - RNA, 64 nt, Homo Sapiens; identical to SEQ ID NO: 26703

SEQ ID NO: 699964 - RNA, 64 nt, Homo Sapiens; identical to SEQ ID NO: 26704

SEQ ID NO: 699965 - RNA, 64 nt, Homo Sapiens; identical to SEQ ID NO: 26705

SEQ ID NO: 699966 - RNA, 64 nt, Homo Sapiens; identical to SEQ ID NO: 26706

SEQ ID NO: 699967 - RNA, 64 nt, Homo Sapiens; identical to SEQ ID NO: 26707

SEQ ID NO: 699968 - RNA, 64 nt, Homo Sapiens; identical to SEQ ID NO: 26708

SEQ ID NO: 699969 - RNA, 64 nt, Homo Sapiens; identical to SEQ ID NO: 26709

SEQ ID NO: 699970 - RNA, 64 nt, Homo Sapiens; identical to SEQ ID NO: 26710

SEQ ID NO: 699971 - RNA, 64 nt, Homo Sapiens; identical to SEQ ID NO: 26711

SEQ ID NO: 699972 - RNA, 64 nt, Homo Sapiens; identical to SEQ ID NO: 26712

SEQ ID NO: 699973 - RNA, 64 nt, Homo Sapiens; identical to SEQ ID NO: 26713

SEQ ID NO: 699974 - RNA, 64 nt, Homo Sapiens; identical to SEQ ID NO: 26714

SEQ ID NO: 699975 - RNA, 64 nt, Homo Sapiens; identical to SEQ ID NO: 26715

SEQ ID NO: 699976 - RNA, 64 nt, Homo Sapiens; identical to SEQ ID NO: 26716

SEQ ID NO: 699977 - RNA, 64 nt, Homo Sapiens; identical to SEQ ID NO: 26717

SEQ ID NO: 699978 - RNA, 64 nt, Homo Sapiens; identical to SEQ ID NO: 26718

SEQ ID NO: 699979 - RNA, 64 nt, Homo Sapiens; identical to SEQ ID NO: 26719

SEQ ID NO: 699980 - RNA, 64 nt, Homo Sapiens; identical to SEQ ID NO: 26720

SEQ ID NO: 699981 - RNA, 64 nt, Homo Sapiens; identical to SEQ ID NO: 26721

SEQ ID NO: 699982 - RNA, 64 nt, Homo Sapiens; identical to SEQ ID NO: 26722

SEQ ID NO: 699983 - RNA, 64 nt, Homo Sapiens; identical to SEQ ID NO: 26723

SEQ ID NO: 699984 - RNA, 64 nt, Homo Sapiens; identical to SEQ ID NO: 26724

SEQ ID NO: 699985 - RNA, 64 nt, Homo Sapiens; identical to SEQ ID NO: 26725

SEQ ID NO: 699986 - RNA, 64 nt, Homo Sapiens; identical to SEQ ID NO: 26726

SEQ ID NO: 699987 - RNA, 64 nt, Homo Sapiens; identical to SEQ ID NO: 26727

SEQ ID NO: 699988 - RNA, 64 nt, Homo Sapiens; identical to SEQ ID NO: 26728

SEQ ID NO: 699989 - RNA, 64 nt, Homo Sapiens; identical to SEQ ID NO: 26729

SEQ ID NO: 699990 - RNA, 64 nt, Homo Sapiens; identical to SEQ ID NO: 26730

SEQ ID NO: 699991 - RNA, 64 nt, Homo Sapiens; identical to SEQ ID NO: 26731

SEQ ID NO: 699992 - RNA, 64 nt, Homo Sapiens; identical to SEQ ID NO: 26732

SEQ ID NO: 699993 - RNA, 64 nt, Homo Sapiens; identical to SEQ ID NO: 26733

SEQ ID NO: 699994 - RNA, 64 nt, Homo Sapiens; identical to SEQ ID NO: 26734

SEQ ID NO: 699995 - RNA, 64 nt, Homo Sapiens; identical to SEQ ID NO: 26735

SEQ ID NO: 699996 - RNA, 64 nt, Homo Sapiens; identical to SEQ ID NO: 26736

SEQ ID NO: 699997 - RNA, 64 nt, Homo Sapiens; identical to SEQ ID NO: 26737

SEQ ID NO: 699998 - RNA, 64 nt, Homo Sapiens; identical to SEQ ID NO: 26738

SEQ ID NO: 699999 - RNA, 64 nt, Homo Sapiens; identical to SEQ ID NO: 26739

SEQ ID NO: 700000 - RNA, 64 nt, Homo Sapiens; identical to SEQ ID NO: 26740

SEQ ID NO: 700001 - RNA, 64 nt, Homo Sapiens; identical to SEQ ID NO: 26741

SEQ ID NO: 700002 - RNA, 64 nt, Homo Sapiens; identical to SEQ ID NO: 26742

SEQ ID NO: 700003 - RNA, 64 nt, Homo Sapiens; identical to SEQ ID NO: 26743

SEQ ID NO: 700004 - RNA, 64 nt, Homo Sapiens; identical to SEQ ID NO: 26744

SEQ ID NO: 700005 - RNA, 64 nt, Homo Sapiens; identical to SEQ ID NO: 26745

SEQ ID NO: 700006 - RNA, 64 nt, Homo Sapiens; identical to SEQ ID NO: 26746

SEQ ID NO: 700007 - RNA, 64 nt, Homo Sapiens; identical to SEQ ID NO: 26747

SEQ ID NO: 700008 - RNA, 64 nt, Homo Sapiens; identical to SEQ ID NO: 26748

SEQ ID NO: 700009 - RNA, 64 nt, Homo Sapiens; identical to SEQ ID NO: 26749

SEQ ID NO: 700010 - RNA, 64 nt, Homo Sapiens; identical to SEQ ID NO: 26750

SEQ ID NO: 700011 - RNA, 64 nt, Homo Sapiens; identical to SEQ ID NO: 26751

SEQ ID NO: 700012 - RNA, 64 nt, Homo Sapiens; identical to SEQ ID NO: 26752

SEQ ID NO: 700013 - RNA, 64 nt, Homo Sapiens; identical to SEQ ID NO: 26753

SEQ ID NO: 700014 - RNA, 64 nt, Homo Sapiens; identical to SEQ ID NO: 26754

SEQ ID NO: 700015 - RNA, 64 nt, Homo Sapiens; identical to SEQ ID NO: 26755

SEQ ID NO: 700016 - RNA, 64 nt, Homo Sapiens; identical to SEQ ID NO: 26756

SEQ ID NO: 700017 - RNA, 64 nt, Homo Sapiens; identical to SEQ ID NO: 26757

SEQ ID NO: 700018 - RNA, 64 nt, Homo Sapiens; identical to SEQ ID NO: 26758

SEQ ID NO: 700019 - RNA, 64 nt, Homo Sapiens; identical to SEQ ID NO: 26759

SEQ ID NO: 700020 - RNA, 64 nt, Homo Sapiens; identical to SEQ ID NO: 26760

SEQ ID NO: 700021 - RNA, 64 nt, Homo Sapiens; identical to SEQ ID NO: 26761

SEQ ID NO: 700022 - RNA, 64 nt, Homo Sapiens; identical to SEQ ID NO: 26762

SEQ ID NO: 700023 - RNA, 64 nt, Homo Sapiens; identical to SEQ ID NO: 26763

SEQ ID NO: 700024 - RNA, 64 nt, Homo Sapiens; identical to SEQ ID NO: 26764

SEQ ID NO: 700025 - RNA, 64 nt, Homo Sapiens; identical to SEQ ID NO: 26765

SEQ ID NO: 700026 - RNA, 64 nt, Homo Sapiens; identical to SEQ ID NO: 26766

SEQ ID NO: 700027 - RNA, 64 nt, Homo Sapiens; identical to SEQ ID NO: 26767

SEQ ID NO: 700028 - RNA, 64 nt, Homo Sapiens; identical to SEQ ID NO: 26768

SEQ ID NO: 700029 - RNA, 64 nt, Homo Sapiens; identical to SEQ ID NO: 26769

SEQ ID NO: 700030 - RNA, 64 nt, Homo Sapiens; identical to SEQ ID NO: 26770

SEQ ID NO: 700031 - RNA, 64 nt, Homo Sapiens; identical to SEQ ID NO: 26771

SEQ ID NO: 700032 - RNA, 64 nt, Homo Sapiens; identical to SEQ ID NO: 26772

SEQ ID NO: 700033 - RNA, 64 nt, Homo Sapiens; identical to SEQ ID NO: 26773

SEQ ID NO: 700034 - RNA, 64 nt, Homo Sapiens; identical to SEQ ID NO: 26774

SEQ ID NO: 700035 - RNA, 64 nt, Homo Sapiens; identical to SEQ ID NO: 26775

SEQ ID NO: 700036 - RNA, 64 nt, Homo Sapiens; identical to SEQ ID NO: 26776

SEQ ID NO: 700037 - RNA, 64 nt, Homo Sapiens; identical to SEQ ID NO: 26777

SEQ ID NO: 700038 - RNA, 64 nt, Homo Sapiens; identical to SEQ ID NO: 26778

SEQ ID NO: 700039 - RNA, 64 nt, Homo Sapiens; identical to SEQ ID NO: 26779

SEQ ID NO: 700040 - RNA, 64 nt, Homo Sapiens; identical to SEQ ID NO: 26780

SEQ ID NO: 700041 - RNA, 64 nt, Homo Sapiens; identical to SEQ ID NO: 26781

SEQ ID NO: 700042 - RNA, 64 nt, Homo Sapiens; identical to SEQ ID NO: 26782

SEQ ID NO: 700043 - RNA, 64 nt, Homo Sapiens; identical to SEQ ID NO: 26783

SEQ ID NO: 700044 - RNA, 64 nt, Homo Sapiens; identical to SEQ ID NO: 26784

SEQ ID NO: 700045 - RNA, 64 nt, Homo Sapiens; identical to SEQ ID NO: 26785

SEQ ID NO: 700046 - RNA, 64 nt, Homo Sapiens; identical to SEQ ID NO: 26786

SEQ ID NO: 700047 - RNA, 64 nt, Homo Sapiens; identical to SEQ ID NO: 26787

SEQ ID NO: 700048 - RNA, 64 nt, Homo Sapiens; identical to SEQ ID NO: 26788

SEQ ID NO: 700049 - RNA, 64 nt, Homo Sapiens; identical to SEQ ID NO: 26789

SEQ ID NO: 700050 - RNA, 64 nt, Homo Sapiens; identical to SEQ ID NO: 26790

SEQ ID NO: 700051 - RNA, 64 nt, Homo Sapiens; identical to SEQ ID NO: 26791

SEQ ID NO: 700052 - RNA, 64 nt, Homo Sapiens; identical to SEQ ID NO: 26792

SEQ ID NO: 700053 - RNA, 64 nt, Homo Sapiens; identical to SEQ ID NO: 26793

SEQ ID NO: 700054 - RNA, 64 nt, Homo Sapiens; identical to SEQ ID NO: 26794

SEQ ID NO: 700055 - RNA, 64 nt, Homo Sapiens; identical to SEQ ID NO: 26795

SEQ ID NO: 700056 - RNA, 64 nt, Homo Sapiens; identical to SEQ ID NO: 26796

SEQ ID NO: 700057 - RNA, 64 nt, Homo Sapiens; identical to SEQ ID NO: 26797

SEQ ID NO: 700058 - RNA, 64 nt, Homo Sapiens; identical to SEQ ID NO: 26798

SEQ ID NO: 700059 - RNA, 64 nt, Homo Sapiens; identical to SEQ ID NO: 26799

SEQ ID NO: 700060 - RNA, 64 nt, Homo Sapiens; identical to SEQ ID NO: 26800

SEQ ID NO: 700061 - RNA, 64 nt, Homo Sapiens; identical to SEQ ID NO: 26801

SEQ ID NO: 700062 - RNA, 64 nt, Homo Sapiens; identical to SEQ ID NO: 26802

SEQ ID NO: 700063 - RNA, 64 nt, Homo Sapiens; identical to SEQ ID NO: 26803

SEQ ID NO: 700064 - RNA, 64 nt, Homo Sapiens; identical to SEQ ID NO: 26804

SEQ ID NO: 700065 - RNA, 64 nt, Homo Sapiens; identical to SEQ ID NO: 26805

SEQ ID NO: 700066 - RNA, 64 nt, Homo Sapiens; identical to SEQ ID NO: 26806

SEQ ID NO: 700067 - RNA, 64 nt, Homo Sapiens; identical to SEQ ID NO: 26807

SEQ ID NO: 700068 - RNA, 64 nt, Homo Sapiens; identical to SEQ ID NO: 26808

SEQ ID NO: 700069 - RNA, 64 nt, Homo Sapiens; identical to SEQ ID NO: 26809

SEQ ID NO: 700070 - RNA, 64 nt, Homo Sapiens; identical to SEQ ID NO: 26810

SEQ ID NO: 700071 - RNA, 64 nt, Homo Sapiens; identical to SEQ ID NO: 26811

SEQ ID NO: 700072 - RNA, 64 nt, Homo Sapiens; identical to SEQ ID NO: 26812

SEQ ID NO: 700073 - RNA, 64 nt, Homo Sapiens; identical to SEQ ID NO: 26813

SEQ ID NO: 700074 - RNA, 64 nt, Homo Sapiens; identical to SEQ ID NO: 26814

SEQ ID NO: 700075 - RNA, 64 nt, Homo Sapiens; identical to SEQ ID NO: 26815

SEQ ID NO: 700076 - RNA, 64 nt, Homo Sapiens; identical to SEQ ID NO: 26816

SEQ ID NO: 700077 - RNA, 64 nt, Homo Sapiens; identical to SEQ ID NO: 26817

SEQ ID NO: 700078 - RNA, 64 nt, Homo Sapiens; identical to SEQ ID NO: 26818

SEQ ID NO: 700079 - RNA, 64 nt, Homo Sapiens; identical to SEQ ID NO: 26819

SEQ ID NO: 700080 - RNA, 64 nt, Homo Sapiens; identical to SEQ ID NO: 26820

SEQ ID NO: 700081 - RNA, 64 nt, Homo Sapiens; identical to SEQ ID NO: 26821

SEQ ID NO: 700082 - RNA, 64 nt, Homo Sapiens; identical to SEQ ID NO: 26822

SEQ ID NO: 700083 - RNA, 64 nt, Homo Sapiens; identical to SEQ ID NO: 26823

SEQ ID NO: 700084 - RNA, 64 nt, Homo Sapiens; identical to SEQ ID NO: 26824

SEQ ID NO: 700085 - RNA, 64 nt, Homo Sapiens; identical to SEQ ID NO: 26825

SEQ ID NO: 700086 - RNA, 64 nt, Homo Sapiens; identical to SEQ ID NO: 26826

SEQ ID NO: 700087 - RNA, 64 nt, Homo Sapiens; identical to SEQ ID NO: 26827

SEQ ID NO: 700088 - RNA, 64 nt, Homo Sapiens; identical to SEQ ID NO: 26828

SEQ ID NO: 700089 - RNA, 64 nt, Homo Sapiens; identical to SEQ ID NO: 26829

SEQ ID NO: 700090 - RNA, 64 nt, Homo Sapiens; identical to SEQ ID NO: 26830

SEQ ID NO: 700091 - RNA, 64 nt, Homo Sapiens; identical to SEQ ID NO: 26831

SEQ ID NO: 700092 - RNA, 64 nt, Homo Sapiens; identical to SEQ ID NO: 26832

SEQ ID NO: 700093 - RNA, 64 nt, Homo Sapiens; identical to SEQ ID NO: 26833

SEQ ID NO: 700094 - RNA, 64 nt, Homo Sapiens; identical to SEQ ID NO: 26834

SEQ ID NO: 700095 - RNA, 64 nt, Homo Sapiens; identical to SEQ ID NO: 26835

SEQ ID NO: 700096 - RNA, 64 nt, Homo Sapiens; identical to SEQ ID NO: 26836

SEQ ID NO: 700097 - RNA, 64 nt, Homo Sapiens; identical to SEQ ID NO: 26837

SEQ ID NO: 700098 - RNA, 64 nt, Homo Sapiens; identical to SEQ ID NO: 26838

SEQ ID NO: 700099 - RNA, 64 nt, Homo Sapiens; identical to SEQ ID NO: 26839

SEQ ID NO: 700100 - RNA, 64 nt, Homo Sapiens; identical to SEQ ID NO: 26840

SEQ ID NO: 700101 - RNA, 64 nt, Homo Sapiens; identical to SEQ ID NO: 26841

SEQ ID NO: 700102 - RNA, 64 nt, Homo Sapiens; identical to SEQ ID NO: 26842

SEQ ID NO: 700103 - RNA, 64 nt, Homo Sapiens; identical to SEQ ID NO: 26843

SEQ ID NO: 700104 - RNA, 64 nt, Homo Sapiens; identical to SEQ ID NO: 26844

SEQ ID NO: 700105 - RNA, 64 nt, Homo Sapiens; identical to SEQ ID NO: 26845

SEQ ID NO: 700106 - RNA, 64 nt, Homo Sapiens; identical to SEQ ID NO: 26846

SEQ ID NO: 700107 - RNA, 64 nt, Homo Sapiens; identical to SEQ ID NO: 26847

SEQ ID NO: 700108 - RNA, 64 nt, Homo Sapiens; identical to SEQ ID NO: 26848

SEQ ID NO: 700109 - RNA, 64 nt, Homo Sapiens; identical to SEQ ID NO: 26849

SEQ ID NO: 700110 - RNA, 64 nt, Homo Sapiens; identical to SEQ ID NO: 26850

SEQ ID NO: 700111 - RNA, 64 nt, Homo Sapiens; identical to SEQ ID NO: 26851

SEQ ID NO: 700112 - RNA, 64 nt, Homo Sapiens; identical to SEQ ID NO: 26852

SEQ ID NO: 700113 - RNA, 64 nt, Homo Sapiens; identical to SEQ ID NO: 26853

SEQ ID NO: 700114 - RNA, 64 nt, Homo Sapiens; identical to SEQ ID NO: 26854

SEQ ID NO: 700115 - RNA, 64 nt, Homo Sapiens; identical to SEQ ID NO: 26855

SEQ ID NO: 700116 - RNA, 64 nt, Homo Sapiens; identical to SEQ ID NO: 26856

SEQ ID NO: 700117 - RNA, 64 nt, Homo Sapiens; identical to SEQ ID NO: 26857

SEQ ID NO: 700118 - RNA, 64 nt, Homo Sapiens; identical to SEQ ID NO: 26858

SEQ ID NO: 700119 - RNA, 64 nt, Homo Sapiens; identical to SEQ ID NO: 26859

SEQ ID NO: 700120 - RNA, 64 nt, Homo Sapiens; identical to SEQ ID NO: 26860

SEQ ID NO: 700121 - RNA, 64 nt, Homo Sapiens; identical to SEQ ID NO: 26861

SEQ ID NO: 700122 - RNA, 64 nt, Homo Sapiens; identical to SEQ ID NO: 26862

SEQ ID NO: 700123 - RNA, 55 nt, Homo Sapiens; identical to SEQ ID NO: 26863

SEQ ID NO: 700124 - RNA, 54 nt, Homo Sapiens; identical to SEQ ID NO: 26864

SEQ ID NO: 700125 - RNA, 53 nt, Homo Sapiens; identical to SEQ ID NO: 26865

SEQ ID NO: 700126 - RNA, 64 nt, Homo Sapiens; identical to SEQ ID NO: 26866

SEQ ID NO: 700127 - RNA, 64 nt, Homo Sapiens; identical to SEQ ID NO: 26867

SEQ ID NO: 700128 - RNA, 64 nt, Homo Sapiens; identical to SEQ ID NO: 26868

SEQ ID NO: 700129 - RNA, 64 nt, Homo Sapiens; identical to SEQ ID NO: 26869

SEQ ID NO: 700130 - RNA, 64 nt, Homo Sapiens; identical to SEQ ID NO: 26870

SEQ ID NO: 700131 - RNA, 64 nt, Homo Sapiens; identical to SEQ ID NO: 26871

SEQ ID NO: 700132 - RNA, 64 nt, Homo Sapiens; identical to SEQ ID NO: 26872

SEQ ID NO: 700133 - RNA, 64 nt, Homo Sapiens; identical to SEQ ID NO: 26873

SEQ ID NO: 700134 - RNA, 64 nt, Homo Sapiens; identical to SEQ ID NO: 26874

SEQ ID NO: 700135 - RNA, 64 nt, Homo Sapiens; identical to SEQ ID NO: 26875

SEQ ID NO: 700136 - RNA, 64 nt, Homo Sapiens; identical to SEQ ID NO: 26876

SEQ ID NO: 700137 - RNA, 64 nt, Homo Sapiens; identical to SEQ ID NO: 26877

SEQ ID NO: 700138 - RNA, 64 nt, Homo Sapiens; identical to SEQ ID NO: 26878

SEQ ID NO: 700139 - RNA, 64 nt, Homo Sapiens; identical to SEQ ID NO: 26879

SEQ ID NO: 700140 - RNA, 64 nt, Homo Sapiens; identical to SEQ ID NO: 26880

SEQ ID NO: 700141 - RNA, 64 nt, Homo Sapiens; identical to SEQ ID NO: 26881

SEQ ID NO: 700142 - RNA, 64 nt, Homo Sapiens; identical to SEQ ID NO: 26882

SEQ ID NO: 700143 - RNA, 64 nt, Homo Sapiens; identical to SEQ ID NO: 26883

SEQ ID NO: 700144 - RNA, 64 nt, Homo Sapiens; identical to SEQ ID NO: 26884

SEQ ID NO: 700145 - RNA, 64 nt, Homo Sapiens; identical to SEQ ID NO: 26885

SEQ ID NO: 700146 - RNA, 64 nt, Homo Sapiens; identical to SEQ ID NO: 26886

SEQ ID NO: 700147 - RNA, 64 nt, Homo Sapiens; identical to SEQ ID NO: 26887

SEQ ID NO: 700148 - RNA, 64 nt, Homo Sapiens; identical to SEQ ID NO: 26888

SEQ ID NO: 700149 - RNA, 64 nt, Homo Sapiens; identical to SEQ ID NO: 26889

SEQ ID NO: 700150 - RNA, 64 nt, Homo Sapiens; identical to SEQ ID NO: 26890

SEQ ID NO: 700151 - RNA, 64 nt, Homo Sapiens; identical to SEQ ID NO: 26891

SEQ ID NO: 700152 - RNA, 64 nt, Homo Sapiens; identical to SEQ ID NO: 26892

SEQ ID NO: 700153 - RNA, 64 nt, Homo Sapiens; identical to SEQ ID NO: 26893

SEQ ID NO: 700154 - RNA, 64 nt, Homo Sapiens; identical to SEQ ID NO: 26894

SEQ ID NO: 700155 - RNA, 64 nt, Homo Sapiens; identical to SEQ ID NO: 26895

SEQ ID NO: 700156 - RNA, 64 nt, Homo Sapiens; identical to SEQ ID NO: 26896

SEQ ID NO: 700157 - RNA, 64 nt, Homo Sapiens; identical to SEQ ID NO: 26897

SEQ ID NO: 700158 - RNA, 64 nt, Homo Sapiens; identical to SEQ ID NO: 26898

SEQ ID NO: 700159 - RNA, 64 nt, Homo Sapiens; identical to SEQ ID NO: 26899

SEQ ID NO: 700160 - RNA, 64 nt, Homo Sapiens; identical to SEQ ID NO: 26900

SEQ ID NO: 700161 - RNA, 64 nt, Homo Sapiens; identical to SEQ ID NO: 26901

SEQ ID NO: 700162 - RNA, 64 nt, Homo Sapiens; identical to SEQ ID NO: 26902

SEQ ID NO: 700163 - RNA, 64 nt, Homo Sapiens; identical to SEQ ID NO: 26903

SEQ ID NO: 700164 - RNA, 64 nt, Homo Sapiens; identical to SEQ ID NO: 26904

SEQ ID NO: 700165 - RNA, 64 nt, Homo Sapiens; identical to SEQ ID NO: 26905

SEQ ID NO: 700166 - RNA, 64 nt, Homo Sapiens; identical to SEQ ID NO: 26906

SEQ ID NO: 700167 - RNA, 64 nt, Homo Sapiens; identical to SEQ ID NO: 26907

SEQ ID NO: 700168 - RNA, 64 nt, Homo Sapiens; identical to SEQ ID NO: 26908

SEQ ID NO: 700169 - RNA, 64 nt, Homo Sapiens; identical to SEQ ID NO: 26909

SEQ ID NO: 700170 - RNA, 64 nt, Homo Sapiens; identical to SEQ ID NO: 26910

SEQ ID NO: 700171 - RNA, 64 nt, Homo Sapiens; identical to SEQ ID NO: 26911

SEQ ID NO: 700172 - RNA, 64 nt, Homo Sapiens; identical to SEQ ID NO: 26912

SEQ ID NO: 700173 - RNA, 64 nt, Homo Sapiens; identical to SEQ ID NO: 26913

SEQ ID NO: 700174 - RNA, 64 nt, Homo Sapiens; identical to SEQ ID NO: 26914

SEQ ID NO: 700175 - RNA, 64 nt, Homo Sapiens; identical to SEQ ID NO: 26915

SEQ ID NO: 700176 - RNA, 64 nt, Homo Sapiens; identical to SEQ ID NO: 26916

SEQ ID NO: 700177 - RNA, 64 nt, Homo Sapiens; identical to SEQ ID NO: 26917

SEQ ID NO: 700178 - RNA, 64 nt, Homo Sapiens; identical to SEQ ID NO: 26918

SEQ ID NO: 700179 - RNA, 64 nt, Homo Sapiens; identical to SEQ ID NO: 26919

SEQ ID NO: 700180 - RNA, 64 nt, Homo Sapiens; identical to SEQ ID NO: 26920

SEQ ID NO: 700181 - RNA, 64 nt, Homo Sapiens; identical to SEQ ID NO: 26921

SEQ ID NO: 700182 - RNA, 64 nt, Homo Sapiens; identical to SEQ ID NO: 26922

SEQ ID NO: 700183 - RNA, 64 nt, Homo Sapiens; identical to SEQ ID NO: 26923

SEQ ID NO: 700184 - RNA, 64 nt, Homo Sapiens; identical to SEQ ID NO: 26924

SEQ ID NO: 700185 - RNA, 64 nt, Homo Sapiens; identical to SEQ ID NO: 26925

SEQ ID NO: 700186 - RNA, 64 nt, Homo Sapiens; identical to SEQ ID NO: 26926

SEQ ID NO: 700187 - RNA, 64 nt, Homo Sapiens; identical to SEQ ID NO: 26927

SEQ ID NO: 700188 - RNA, 64 nt, Homo Sapiens; identical to SEQ ID NO: 26928

SEQ ID NO: 700189 - RNA, 64 nt, Homo Sapiens; identical to SEQ ID NO: 26929

SEQ ID NO: 700190 - RNA, 64 nt, Homo Sapiens; identical to SEQ ID NO: 26930

SEQ ID NO: 700191 - RNA, 64 nt, Homo Sapiens; identical to SEQ ID NO: 26931

SEQ ID NO: 700192 - RNA, 64 nt, Homo Sapiens; identical to SEQ ID NO: 26932

SEQ ID NO: 700193 - RNA, 64 nt, Homo Sapiens; identical to SEQ ID NO: 26933

SEQ ID NO: 700194 - RNA, 64 nt, Homo Sapiens; identical to SEQ ID NO: 26934

SEQ ID NO: 700195 - RNA, 64 nt, Homo Sapiens; identical to SEQ ID NO: 26935

SEQ ID NO: 700196 - RNA, 64 nt, Homo Sapiens; identical to SEQ ID NO: 26936

SEQ ID NO: 700197 - RNA, 64 nt, Homo Sapiens; identical to SEQ ID NO: 26937

SEQ ID NO: 700198 - RNA, 64 nt, Homo Sapiens; identical to SEQ ID NO: 26938

SEQ ID NO: 700199 - RNA, 64 nt, Homo Sapiens; identical to SEQ ID NO: 26939

SEQ ID NO: 700200 - RNA, 64 nt, Homo Sapiens; identical to SEQ ID NO: 26940

SEQ ID NO: 700201 - RNA, 64 nt, Homo Sapiens; identical to SEQ ID NO: 26941

SEQ ID NO: 700202 - RNA, 64 nt, Homo Sapiens; identical to SEQ ID NO: 26942

SEQ ID NO: 700203 - RNA, 64 nt, Homo Sapiens; identical to SEQ ID NO: 26943

SEQ ID NO: 700204 - RNA, 64 nt, Homo Sapiens; identical to SEQ ID NO: 26944

SEQ ID NO: 700205 - RNA, 64 nt, Homo Sapiens; identical to SEQ ID NO: 26945

SEQ ID NO: 700206 - RNA, 64 nt, Homo Sapiens; identical to SEQ ID NO: 26946

SEQ ID NO: 700207 - RNA, 64 nt, Homo Sapiens; identical to SEQ ID NO: 26947

SEQ ID NO: 700208 - RNA, 64 nt, Homo Sapiens; identical to SEQ ID NO: 26948

SEQ ID NO: 700209 - RNA, 64 nt, Homo Sapiens; identical to SEQ ID NO: 26949

SEQ ID NO: 700210 - RNA, 64 nt, Homo Sapiens; identical to SEQ ID NO: 26950

SEQ ID NO: 700211 - RNA, 64 nt, Homo Sapiens; identical to SEQ ID NO: 26951

SEQ ID NO: 700212 - RNA, 64 nt, Homo Sapiens; identical to SEQ ID NO: 26952

SEQ ID NO: 700213 - RNA, 64 nt, Homo Sapiens; identical to SEQ ID NO: 26953

SEQ ID NO: 700214 - RNA, 64 nt, Homo Sapiens; identical to SEQ ID NO: 26954

SEQ ID NO: 700215 - RNA, 64 nt, Homo Sapiens; identical to SEQ ID NO: 26955

SEQ ID NO: 700216 - RNA, 64 nt, Homo Sapiens; identical to SEQ ID NO: 26956

SEQ ID NO: 700217 - RNA, 64 nt, Homo Sapiens; identical to SEQ ID NO: 26957

SEQ ID NO: 700218 - RNA, 64 nt, Homo Sapiens; identical to SEQ ID NO: 26958

SEQ ID NO: 700219 - RNA, 64 nt, Homo Sapiens; identical to SEQ ID NO: 26959

SEQ ID NO: 700220 - RNA, 64 nt, Homo Sapiens; identical to SEQ ID NO: 26960

SEQ ID NO: 700221 - RNA, 64 nt, Homo Sapiens; identical to SEQ ID NO: 26961

SEQ ID NO: 700222 - RNA, 64 nt, Homo Sapiens; identical to SEQ ID NO: 26962

SEQ ID NO: 700223 - RNA, 64 nt, Homo Sapiens; identical to SEQ ID NO: 26963

SEQ ID NO: 700224 - RNA, 64 nt, Homo Sapiens; identical to SEQ ID NO: 26964

SEQ ID NO: 700225 - RNA, 64 nt, Homo Sapiens; identical to SEQ ID NO: 26965

SEQ ID NO: 700226 - RNA, 64 nt, Homo Sapiens; identical to SEQ ID NO: 26966

SEQ ID NO: 700227 - RNA, 64 nt, Homo Sapiens; identical to SEQ ID NO: 26967

SEQ ID NO: 700228 - RNA, 64 nt, Homo Sapiens; identical to SEQ ID NO: 26968

SEQ ID NO: 700229 - RNA, 64 nt, Homo Sapiens; identical to SEQ ID NO: 26969

SEQ ID NO: 700230 - RNA, 64 nt, Homo Sapiens; identical to SEQ ID NO: 26970

SEQ ID NO: 700231 - RNA, 64 nt, Homo Sapiens; identical to SEQ ID NO: 26971

SEQ ID NO: 700232 - RNA, 64 nt, Homo Sapiens; identical to SEQ ID NO: 26972

SEQ ID NO: 700233 - RNA, 64 nt, Homo Sapiens; identical to SEQ ID NO: 26973

SEQ ID NO: 700234 - RNA, 64 nt, Homo Sapiens; identical to SEQ ID NO: 26974

SEQ ID NO: 700235 - RNA, 64 nt, Homo Sapiens; identical to SEQ ID NO: 26975

SEQ ID NO: 700236 - RNA, 64 nt, Homo Sapiens; identical to SEQ ID NO: 26976

SEQ ID NO: 700237 - RNA, 64 nt, Homo Sapiens; identical to SEQ ID NO: 26977

SEQ ID NO: 700238 - RNA, 64 nt, Homo Sapiens; identical to SEQ ID NO: 26978

SEQ ID NO: 700239 - RNA, 64 nt, Homo Sapiens; identical to SEQ ID NO: 26979

SEQ ID NO: 700240 - RNA, 64 nt, Homo Sapiens; identical to SEQ ID NO: 26980

SEQ ID NO: 700241 - RNA, 64 nt, Homo Sapiens; identical to SEQ ID NO: 26981

SEQ ID NO: 700242 - RNA, 64 nt, Homo Sapiens; identical to SEQ ID NO: 26982

SEQ ID NO: 700243 - RNA, 64 nt, Homo Sapiens; identical to SEQ ID NO: 26983

SEQ ID NO: 700244 - RNA, 64 nt, Homo Sapiens; identical to SEQ ID NO: 26984

SEQ ID NO: 700245 - RNA, 64 nt, Homo Sapiens; identical to SEQ ID NO: 26985

SEQ ID NO: 700246 - RNA, 64 nt, Homo Sapiens; identical to SEQ ID NO: 26986

SEQ ID NO: 700247 - RNA, 64 nt, Homo Sapiens; identical to SEQ ID NO: 26987

SEQ ID NO: 700248 - RNA, 64 nt, Homo Sapiens; identical to SEQ ID NO: 26988

SEQ ID NO: 700249 - RNA, 64 nt, Homo Sapiens; identical to SEQ ID NO: 26989

SEQ ID NO: 700250 - RNA, 64 nt, Homo Sapiens; identical to SEQ ID NO: 26990

SEQ ID NO: 700251 - RNA, 64 nt, Homo Sapiens; identical to SEQ ID NO: 26991

SEQ ID NO: 700252 - RNA, 64 nt, Homo Sapiens; identical to SEQ ID NO: 26992

SEQ ID NO: 700253 - RNA, 64 nt, Homo Sapiens; identical to SEQ ID NO: 26993

SEQ ID NO: 700254 - RNA, 64 nt, Homo Sapiens; identical to SEQ ID NO: 26994

SEQ ID NO: 700255 - RNA, 64 nt, Homo Sapiens; identical to SEQ ID NO: 26995

SEQ ID NO: 700256 - RNA, 64 nt, Homo Sapiens; identical to SEQ ID NO: 26996

SEQ ID NO: 700257 - RNA, 64 nt, Homo Sapiens; identical to SEQ ID NO: 26997

SEQ ID NO: 700258 - RNA, 64 nt, Homo Sapiens; identical to SEQ ID NO: 26998

SEQ ID NO: 700259 - RNA, 64 nt, Homo Sapiens; identical to SEQ ID NO: 26999

SEQ ID NO: 700260 - RNA, 64 nt, Homo Sapiens; identical to SEQ ID NO: 27000

SEQ ID NO: 700261 - RNA, 64 nt, Homo Sapiens; identical to SEQ ID NO: 27001

SEQ ID NO: 700262 - RNA, 64 nt, Homo Sapiens; identical to SEQ ID NO: 27002

SEQ ID NO: 700263 - RNA, 64 nt, Homo Sapiens; identical to SEQ ID NO: 27003

SEQ ID NO: 700264 - RNA, 64 nt, Homo Sapiens; identical to SEQ ID NO: 27004

SEQ ID NO: 700265 - RNA, 64 nt, Homo Sapiens; identical to SEQ ID NO: 27005

SEQ ID NO: 700266 - RNA, 64 nt, Homo Sapiens; identical to SEQ ID NO: 27006

SEQ ID NO: 700267 - RNA, 64 nt, Homo Sapiens; identical to SEQ ID NO: 27007

SEQ ID NO: 700268 - RNA, 64 nt, Homo Sapiens; identical to SEQ ID NO: 27008

SEQ ID NO: 700269 - RNA, 64 nt, Homo Sapiens; identical to SEQ ID NO: 27009

SEQ ID NO: 700270 - RNA, 64 nt, Homo Sapiens; identical to SEQ ID NO: 27010

SEQ ID NO: 700271 - RNA, 64 nt, Homo Sapiens; identical to SEQ ID NO: 27011

SEQ ID NO: 700272 - RNA, 64 nt, Homo Sapiens; identical to SEQ ID NO: 27012

SEQ ID NO: 700273 - RNA, 64 nt, Homo Sapiens; identical to SEQ ID NO: 27013

SEQ ID NO: 700274 - RNA, 64 nt, Homo Sapiens; identical to SEQ ID NO: 27014

SEQ ID NO: 700275 - RNA, 64 nt, Homo Sapiens; identical to SEQ ID NO: 27015

SEQ ID NO: 700276 - RNA, 64 nt, Homo Sapiens; identical to SEQ ID NO: 27016

SEQ ID NO: 700277 - RNA, 64 nt, Homo Sapiens; identical to SEQ ID NO: 27017

SEQ ID NO: 700278 - RNA, 64 nt, Homo Sapiens; identical to SEQ ID NO: 27018

SEQ ID NO: 700279 - RNA, 64 nt, Homo Sapiens; identical to SEQ ID NO: 27019

SEQ ID NO: 700280 - RNA, 64 nt, Homo Sapiens; identical to SEQ ID NO: 27020

SEQ ID NO: 700281 - RNA, 64 nt, Homo Sapiens; identical to SEQ ID NO: 27021

SEQ ID NO: 700282 - RNA, 64 nt, Homo Sapiens; identical to SEQ ID NO: 27022

SEQ ID NO: 700283 - RNA, 64 nt, Homo Sapiens; identical to SEQ ID NO: 27023

SEQ ID NO: 700284 - RNA, 64 nt, Homo Sapiens; identical to SEQ ID NO: 27024

SEQ ID NO: 700285 - RNA, 64 nt, Homo Sapiens; identical to SEQ ID NO: 27025

SEQ ID NO: 700286 - RNA, 64 nt, Homo Sapiens; identical to SEQ ID NO: 27026

SEQ ID NO: 700287 - RNA, 64 nt, Homo Sapiens; identical to SEQ ID NO: 27027

SEQ ID NO: 700288 - RNA, 64 nt, Homo Sapiens; identical to SEQ ID NO: 27028

SEQ ID NO: 700289 - RNA, 64 nt, Homo Sapiens; identical to SEQ ID NO: 27029

SEQ ID NO: 700290 - RNA, 64 nt, Homo Sapiens; identical to SEQ ID NO: 27030

SEQ ID NO: 700291 - RNA, 64 nt, Homo Sapiens; identical to SEQ ID NO: 27031

SEQ ID NO: 700292 - RNA, 64 nt, Homo Sapiens; identical to SEQ ID NO: 27032

SEQ ID NO: 700293 - RNA, 64 nt, Homo Sapiens; identical to SEQ ID NO: 27033

SEQ ID NO: 700294 - RNA, 64 nt, Homo Sapiens; identical to SEQ ID NO: 27034

SEQ ID NO: 700295 - RNA, 64 nt, Homo Sapiens; identical to SEQ ID NO: 27035

SEQ ID NO: 700296 - RNA, 64 nt, Homo Sapiens; identical to SEQ ID NO: 27036

SEQ ID NO: 700297 - RNA, 64 nt, Homo Sapiens; identical to SEQ ID NO: 27037

SEQ ID NO: 700298 - RNA, 64 nt, Homo Sapiens; identical to SEQ ID NO: 27038

SEQ ID NO: 700299 - RNA, 64 nt, Homo Sapiens; identical to SEQ ID NO: 27039

SEQ ID NO: 700300 - RNA, 64 nt, Homo Sapiens; identical to SEQ ID NO: 27040

SEQ ID NO: 700301 - RNA, 64 nt, Homo Sapiens; identical to SEQ ID NO: 27041

SEQ ID NO: 700302 - RNA, 64 nt, Homo Sapiens; identical to SEQ ID NO: 27042

SEQ ID NO: 700303 - RNA, 64 nt, Homo Sapiens; identical to SEQ ID NO: 27043

SEQ ID NO: 700304 - RNA, 64 nt, Homo Sapiens; identical to SEQ ID NO: 27044

SEQ ID NO: 700305 - RNA, 64 nt, Homo Sapiens; identical to SEQ ID NO: 27045

SEQ ID NO: 700306 - RNA, 64 nt, Homo Sapiens; identical to SEQ ID NO: 27046

SEQ ID NO: 700307 - RNA, 64 nt, Homo Sapiens; identical to SEQ ID NO: 27047

SEQ ID NO: 700308 - RNA, 64 nt, Homo Sapiens; identical to SEQ ID NO: 27048

SEQ ID NO: 700309 - RNA, 64 nt, Homo Sapiens; identical to SEQ ID NO: 27049

SEQ ID NO: 700310 - RNA, 64 nt, Homo Sapiens; identical to SEQ ID NO: 27050

SEQ ID NO: 700311 - RNA, 64 nt, Homo Sapiens; identical to SEQ ID NO: 27051

SEQ ID NO: 700312 - RNA, 64 nt, Homo Sapiens; identical to SEQ ID NO: 27052

SEQ ID NO: 700313 - RNA, 64 nt, Homo Sapiens; identical to SEQ ID NO: 27053

SEQ ID NO: 700314 - RNA, 64 nt, Homo Sapiens; identical to SEQ ID NO: 27054

SEQ ID NO: 700315 - RNA, 64 nt, Homo Sapiens; identical to SEQ ID NO: 27055

SEQ ID NO: 700316 - RNA, 64 nt, Homo Sapiens; identical to SEQ ID NO: 27056

SEQ ID NO: 700317 - RNA, 64 nt, Homo Sapiens; identical to SEQ ID NO: 27057

SEQ ID NO: 700318 - RNA, 64 nt, Homo Sapiens; identical to SEQ ID NO: 27058

SEQ ID NO: 700319 - RNA, 64 nt, Homo Sapiens; identical to SEQ ID NO: 27059

SEQ ID NO: 700320 - RNA, 64 nt, Homo Sapiens; identical to SEQ ID NO: 27060

SEQ ID NO: 700321 - RNA, 64 nt, Homo Sapiens; identical to SEQ ID NO: 27061

SEQ ID NO: 700322 - RNA, 64 nt, Homo Sapiens; identical to SEQ ID NO: 27062

SEQ ID NO: 700323 - RNA, 64 nt, Homo Sapiens; identical to SEQ ID NO: 27063

SEQ ID NO: 700324 - RNA, 64 nt, Homo Sapiens; identical to SEQ ID NO: 27064

SEQ ID NO: 700325 - RNA, 64 nt, Homo Sapiens; identical to SEQ ID NO: 27065

SEQ ID NO: 700326 - RNA, 64 nt, Homo Sapiens; identical to SEQ ID NO: 27066

SEQ ID NO: 700327 - RNA, 64 nt, Homo Sapiens; identical to SEQ ID NO: 27067

SEQ ID NO: 700328 - RNA, 64 nt, Homo Sapiens; identical to SEQ ID NO: 27068

SEQ ID NO: 700329 - RNA, 64 nt, Homo Sapiens; identical to SEQ ID NO: 27069

SEQ ID NO: 700330 - RNA, 64 nt, Homo Sapiens; identical to SEQ ID NO: 27070

SEQ ID NO: 700331 - RNA, 64 nt, Homo Sapiens; identical to SEQ ID NO: 27071

SEQ ID NO: 700332 - RNA, 64 nt, Homo Sapiens; identical to SEQ ID NO: 27072

SEQ ID NO: 700333 - RNA, 64 nt, Homo Sapiens; identical to SEQ ID NO: 27073

SEQ ID NO: 700334 - RNA, 64 nt, Homo Sapiens; identical to SEQ ID NO: 27074

SEQ ID NO: 700335 - RNA, 64 nt, Homo Sapiens; identical to SEQ ID NO: 27075

SEQ ID NO: 700336 - RNA, 64 nt, Homo Sapiens; identical to SEQ ID NO: 27076

SEQ ID NO: 700337 - RNA, 64 nt, Homo Sapiens; identical to SEQ ID NO: 27077

SEQ ID NO: 700338 - RNA, 64 nt, Homo Sapiens; identical to SEQ ID NO: 27078

SEQ ID NO: 700339 - RNA, 64 nt, Homo Sapiens; identical to SEQ ID NO: 27079

SEQ ID NO: 700340 - RNA, 64 nt, Homo Sapiens; identical to SEQ ID NO: 27080

SEQ ID NO: 700341 - RNA, 64 nt, Homo Sapiens; identical to SEQ ID NO: 27081

SEQ ID NO: 700342 - RNA, 64 nt, Homo Sapiens; identical to SEQ ID NO: 27082

SEQ ID NO: 700343 - RNA, 64 nt, Homo Sapiens; identical to SEQ ID NO: 27083

SEQ ID NO: 700344 - RNA, 64 nt, Homo Sapiens; identical to SEQ ID NO: 27084

SEQ ID NO: 700345 - RNA, 64 nt, Homo Sapiens; identical to SEQ ID NO: 27085

SEQ ID NO: 700346 - RNA, 64 nt, Homo Sapiens; identical to SEQ ID NO: 27086

SEQ ID NO: 700347 - RNA, 64 nt, Homo Sapiens; identical to SEQ ID NO: 27087

SEQ ID NO: 700348 - RNA, 64 nt, Homo Sapiens; identical to SEQ ID NO: 27088

SEQ ID NO: 700349 - RNA, 64 nt, Homo Sapiens; identical to SEQ ID NO: 27089

SEQ ID NO: 700350 - RNA, 64 nt, Homo Sapiens; identical to SEQ ID NO: 27090

SEQ ID NO: 700351 - RNA, 64 nt, Homo Sapiens; identical to SEQ ID NO: 27091

SEQ ID NO: 700352 - RNA, 64 nt, Homo Sapiens; identical to SEQ ID NO: 27092

SEQ ID NO: 700353 - RNA, 64 nt, Homo Sapiens; identical to SEQ ID NO: 27093

SEQ ID NO: 700354 - RNA, 64 nt, Homo Sapiens; identical to SEQ ID NO: 27094

SEQ ID NO: 700355 - RNA, 64 nt, Homo Sapiens; identical to SEQ ID NO: 27095

SEQ ID NO: 700356 - RNA, 64 nt, Homo Sapiens; identical to SEQ ID NO: 27096

SEQ ID NO: 700357 - RNA, 64 nt, Homo Sapiens; identical to SEQ ID NO: 27097

SEQ ID NO: 700358 - RNA, 64 nt, Homo Sapiens; identical to SEQ ID NO: 27098

SEQ ID NO: 700359 - RNA, 64 nt, Homo Sapiens; identical to SEQ ID NO: 27099

SEQ ID NO: 700360 - RNA, 64 nt, Homo Sapiens; identical to SEQ ID NO: 27100

SEQ ID NO: 700361 - RNA, 64 nt, Homo Sapiens; identical to SEQ ID NO: 27101

SEQ ID NO: 700362 - RNA, 64 nt, Homo Sapiens; identical to SEQ ID NO: 27102

SEQ ID NO: 700363 - RNA, 64 nt, Homo Sapiens; identical to SEQ ID NO: 27103

SEQ ID NO: 700364 - RNA, 64 nt, Homo Sapiens; identical to SEQ ID NO: 27104

SEQ ID NO: 700365 - RNA, 64 nt, Homo Sapiens; identical to SEQ ID NO: 27105

SEQ ID NO: 700366 - RNA, 64 nt, Homo Sapiens; identical to SEQ ID NO: 27106

SEQ ID NO: 700367 - RNA, 64 nt, Homo Sapiens; identical to SEQ ID NO: 27107

SEQ ID NO: 700368 - RNA, 64 nt, Homo Sapiens; identical to SEQ ID NO: 27108

SEQ ID NO: 700369 - RNA, 64 nt, Homo Sapiens; identical to SEQ ID NO: 27109

SEQ ID NO: 700370 - RNA, 64 nt, Homo Sapiens; identical to SEQ ID NO: 27110

SEQ ID NO: 700371 - RNA, 64 nt, Homo Sapiens; identical to SEQ ID NO: 27111

SEQ ID NO: 700372 - RNA, 64 nt, Homo Sapiens; identical to SEQ ID NO: 27112

SEQ ID NO: 700373 - RNA, 64 nt, Homo Sapiens; identical to SEQ ID NO: 27113

SEQ ID NO: 700374 - RNA, 64 nt, Homo Sapiens; identical to SEQ ID NO: 27114

SEQ ID NO: 700375 - RNA, 64 nt, Homo Sapiens; identical to SEQ ID NO: 27115

SEQ ID NO: 700376 - RNA, 64 nt, Homo Sapiens; identical to SEQ ID NO: 27116

SEQ ID NO: 700377 - RNA, 64 nt, Homo Sapiens; identical to SEQ ID NO: 27117

SEQ ID NO: 700378 - RNA, 64 nt, Homo Sapiens; identical to SEQ ID NO: 27118

SEQ ID NO: 700379 - RNA, 64 nt, Homo Sapiens; identical to SEQ ID NO: 27119

SEQ ID NO: 700380 - RNA, 64 nt, Homo Sapiens; identical to SEQ ID NO: 27120

SEQ ID NO: 700381 - RNA, 64 nt, Homo Sapiens; identical to SEQ ID NO: 27121

SEQ ID NO: 700382 - RNA, 64 nt, Homo Sapiens; identical to SEQ ID NO: 27122

SEQ ID NO: 700383 - RNA, 64 nt, Homo Sapiens; identical to SEQ ID NO: 27123

SEQ ID NO: 700384 - RNA, 64 nt, Homo Sapiens; identical to SEQ ID NO: 27124

SEQ ID NO: 700385 - RNA, 64 nt, Homo Sapiens; identical to SEQ ID NO: 27125

SEQ ID NO: 700386 - RNA, 64 nt, Homo Sapiens; identical to SEQ ID NO: 27126

SEQ ID NO: 700387 - RNA, 64 nt, Homo Sapiens; identical to SEQ ID NO: 27127

SEQ ID NO: 700388 - RNA, 64 nt, Homo Sapiens; identical to SEQ ID NO: 27128

SEQ ID NO: 700389 - RNA, 64 nt, Homo Sapiens; identical to SEQ ID NO: 27129

SEQ ID NO: 700390 - RNA, 64 nt, Homo Sapiens; identical to SEQ ID NO: 27130

SEQ ID NO: 700391 - RNA, 64 nt, Homo Sapiens; identical to SEQ ID NO: 27131

SEQ ID NO: 700392 - RNA, 64 nt, Homo Sapiens; identical to SEQ ID NO: 27132

SEQ ID NO: 700393 - RNA, 64 nt, Homo Sapiens; identical to SEQ ID NO: 27133

SEQ ID NO: 700394 - RNA, 64 nt, Homo Sapiens; identical to SEQ ID NO: 27134

SEQ ID NO: 700395 - RNA, 64 nt, Homo Sapiens; identical to SEQ ID NO: 27135

SEQ ID NO: 700396 - RNA, 64 nt, Homo Sapiens; identical to SEQ ID NO: 27136

SEQ ID NO: 700397 - RNA, 64 nt, Homo Sapiens; identical to SEQ ID NO: 27137

SEQ ID NO: 700398 - RNA, 64 nt, Homo Sapiens; identical to SEQ ID NO: 27138

SEQ ID NO: 700399 - RNA, 64 nt, Homo Sapiens; identical to SEQ ID NO: 27139

SEQ ID NO: 700400 - RNA, 64 nt, Homo Sapiens; identical to SEQ ID NO: 27140

SEQ ID NO: 700401 - RNA, 64 nt, Homo Sapiens; identical to SEQ ID NO: 27141

SEQ ID NO: 700402 - RNA, 64 nt, Homo Sapiens; identical to SEQ ID NO: 27142

SEQ ID NO: 700403 - RNA, 64 nt, Homo Sapiens; identical to SEQ ID NO: 27143

SEQ ID NO: 700404 - RNA, 64 nt, Homo Sapiens; identical to SEQ ID NO: 27144

SEQ ID NO: 700405 - RNA, 64 nt, Homo Sapiens; identical to SEQ ID NO: 27145

SEQ ID NO: 700406 - RNA, 64 nt, Homo Sapiens; identical to SEQ ID NO: 27146

SEQ ID NO: 700407 - RNA, 64 nt, Homo Sapiens; identical to SEQ ID NO: 27147

SEQ ID NO: 700408 - RNA, 64 nt, Homo Sapiens; identical to SEQ ID NO: 27148

SEQ ID NO: 700409 - RNA, 64 nt, Homo Sapiens; identical to SEQ ID NO: 27149

SEQ ID NO: 700410 - RNA, 64 nt, Homo Sapiens; identical to SEQ ID NO: 27150

SEQ ID NO: 700411 - RNA, 64 nt, Homo Sapiens; identical to SEQ ID NO: 27151

SEQ ID NO: 700412 - RNA, 64 nt, Homo Sapiens; identical to SEQ ID NO: 27152

SEQ ID NO: 700413 - RNA, 64 nt, Homo Sapiens; identical to SEQ ID NO: 27153

SEQ ID NO: 700414 - RNA, 64 nt, Homo Sapiens; identical to SEQ ID NO: 27154

SEQ ID NO: 700415 - RNA, 64 nt, Homo Sapiens; identical to SEQ ID NO: 27155

SEQ ID NO: 700416 - RNA, 64 nt, Homo Sapiens; identical to SEQ ID NO: 27156

SEQ ID NO: 700417 - RNA, 64 nt, Homo Sapiens; identical to SEQ ID NO: 27157

SEQ ID NO: 700418 - RNA, 64 nt, Homo Sapiens; identical to SEQ ID NO: 27158

SEQ ID NO: 700419 - RNA, 64 nt, Homo Sapiens; identical to SEQ ID NO: 27159

SEQ ID NO: 700420 - RNA, 64 nt, Homo Sapiens; identical to SEQ ID NO: 27160

SEQ ID NO: 700421 - RNA, 64 nt, Homo Sapiens; identical to SEQ ID NO: 27161

SEQ ID NO: 700422 - RNA, 64 nt, Homo Sapiens; identical to SEQ ID NO: 27162

SEQ ID NO: 700423 - RNA, 64 nt, Homo Sapiens; identical to SEQ ID NO: 27163

SEQ ID NO: 700424 - RNA, 64 nt, Homo Sapiens; identical to SEQ ID NO: 27164

SEQ ID NO: 700425 - RNA, 64 nt, Homo Sapiens; identical to SEQ ID NO: 27165

SEQ ID NO: 700426 - RNA, 64 nt, Homo Sapiens; identical to SEQ ID NO: 27166

SEQ ID NO: 700427 - RNA, 64 nt, Homo Sapiens; identical to SEQ ID NO: 27167

SEQ ID NO: 700428 - RNA, 64 nt, Homo Sapiens; identical to SEQ ID NO: 27168

SEQ ID NO: 700429 - RNA, 64 nt, Homo Sapiens; identical to SEQ ID NO: 27169

SEQ ID NO: 700430 - RNA, 64 nt, Homo Sapiens; identical to SEQ ID NO: 27170

SEQ ID NO: 700431 - RNA, 64 nt, Homo Sapiens; identical to SEQ ID NO: 27171

SEQ ID NO: 700432 - RNA, 64 nt, Homo Sapiens; identical to SEQ ID NO: 27172

SEQ ID NO: 700433 - RNA, 64 nt, Homo Sapiens; identical to SEQ ID NO: 27173

SEQ ID NO: 700434 - RNA, 64 nt, Homo Sapiens; identical to SEQ ID NO: 27174

SEQ ID NO: 700435 - RNA, 64 nt, Homo Sapiens; identical to SEQ ID NO: 27175

SEQ ID NO: 700436 - RNA, 64 nt, Homo Sapiens; identical to SEQ ID NO: 27176

SEQ ID NO: 700437 - RNA, 64 nt, Homo Sapiens; identical to SEQ ID NO: 27177

SEQ ID NO: 700438 - RNA, 64 nt, Homo Sapiens; identical to SEQ ID NO: 27178

SEQ ID NO: 700439 - RNA, 64 nt, Homo Sapiens; identical to SEQ ID NO: 27179

SEQ ID NO: 700440 - RNA, 64 nt, Homo Sapiens; identical to SEQ ID NO: 27180

SEQ ID NO: 700441 - RNA, 64 nt, Homo Sapiens; identical to SEQ ID NO: 27181

SEQ ID NO: 700442 - RNA, 64 nt, Homo Sapiens; identical to SEQ ID NO: 27182

SEQ ID NO: 700443 - RNA, 64 nt, Homo Sapiens; identical to SEQ ID NO: 27183

SEQ ID NO: 700444 - RNA, 64 nt, Homo Sapiens; identical to SEQ ID NO: 27184

SEQ ID NO: 700445 - RNA, 64 nt, Homo Sapiens; identical to SEQ ID NO: 27185

SEQ ID NO: 700446 - RNA, 64 nt, Homo Sapiens; identical to SEQ ID NO: 27186

SEQ ID NO: 700447 - RNA, 64 nt, Homo Sapiens; identical to SEQ ID NO: 27187

SEQ ID NO: 700448 - RNA, 64 nt, Homo Sapiens; identical to SEQ ID NO: 27188

SEQ ID NO: 700449 - RNA, 64 nt, Homo Sapiens; identical to SEQ ID NO: 27189

SEQ ID NO: 700450 - RNA, 64 nt, Homo Sapiens; identical to SEQ ID NO: 27190

SEQ ID NO: 700451 - RNA, 64 nt, Homo Sapiens; identical to SEQ ID NO: 27191

SEQ ID NO: 700452 - RNA, 64 nt, Homo Sapiens; identical to SEQ ID NO: 27192

SEQ ID NO: 700453 - RNA, 64 nt, Homo Sapiens; identical to SEQ ID NO: 27193

SEQ ID NO: 700454 - RNA, 64 nt, Homo Sapiens; identical to SEQ ID NO: 27194

SEQ ID NO: 700455 - RNA, 64 nt, Homo Sapiens; identical to SEQ ID NO: 27195

SEQ ID NO: 700456 - RNA, 64 nt, Homo Sapiens; identical to SEQ ID NO: 27196

SEQ ID NO: 700457 - RNA, 64 nt, Homo Sapiens; identical to SEQ ID NO: 27197

SEQ ID NO: 700458 - RNA, 64 nt, Homo Sapiens; identical to SEQ ID NO: 27198

SEQ ID NO: 700459 - RNA, 64 nt, Homo Sapiens; identical to SEQ ID NO: 27199

SEQ ID NO: 700460 - RNA, 64 nt, Homo Sapiens; identical to SEQ ID NO: 27200

SEQ ID NO: 700461 - RNA, 64 nt, Homo Sapiens; identical to SEQ ID NO: 27201

SEQ ID NO: 700462 - RNA, 64 nt, Homo Sapiens; identical to SEQ ID NO: 27202

SEQ ID NO: 700463 - RNA, 64 nt, Homo Sapiens; identical to SEQ ID NO: 27203

SEQ ID NO: 700464 - RNA, 64 nt, Homo Sapiens; identical to SEQ ID NO: 27204

SEQ ID NO: 700465 - RNA, 64 nt, Homo Sapiens; identical to SEQ ID NO: 27205

SEQ ID NO: 700466 - RNA, 64 nt, Homo Sapiens; identical to SEQ ID NO: 27206

SEQ ID NO: 700467 - RNA, 64 nt, Homo Sapiens; identical to SEQ ID NO: 27207

SEQ ID NO: 700468 - RNA, 64 nt, Homo Sapiens; identical to SEQ ID NO: 27208

SEQ ID NO: 700469 - RNA, 64 nt, Homo Sapiens; identical to SEQ ID NO: 27209

SEQ ID NO: 700470 - RNA, 64 nt, Homo Sapiens; identical to SEQ ID NO: 27210

SEQ ID NO: 700471 - RNA, 64 nt, Homo Sapiens; identical to SEQ ID NO: 27211

SEQ ID NO: 700472 - RNA, 64 nt, Homo Sapiens; identical to SEQ ID NO: 27212

SEQ ID NO: 700473 - RNA, 64 nt, Homo Sapiens; identical to SEQ ID NO: 27213

SEQ ID NO: 700474 - RNA, 64 nt, Homo Sapiens; identical to SEQ ID NO: 27214

SEQ ID NO: 700475 - RNA, 64 nt, Homo Sapiens; identical to SEQ ID NO: 27215

SEQ ID NO: 700476 - RNA, 64 nt, Homo Sapiens; identical to SEQ ID NO: 27216

SEQ ID NO: 700477 - RNA, 64 nt, Homo Sapiens; identical to SEQ ID NO: 27217

SEQ ID NO: 700478 - RNA, 64 nt, Homo Sapiens; identical to SEQ ID NO: 27218

SEQ ID NO: 700479 - RNA, 64 nt, Homo Sapiens; identical to SEQ ID NO: 27219

SEQ ID NO: 700480 - RNA, 64 nt, Homo Sapiens; identical to SEQ ID NO: 27220

SEQ ID NO: 700481 - RNA, 64 nt, Homo Sapiens; identical to SEQ ID NO: 27221

SEQ ID NO: 700482 - RNA, 64 nt, Homo Sapiens; identical to SEQ ID NO: 27222

SEQ ID NO: 700483 - RNA, 64 nt, Homo Sapiens; identical to SEQ ID NO: 27223

SEQ ID NO: 700484 - RNA, 64 nt, Homo Sapiens; identical to SEQ ID NO: 27224

SEQ ID NO: 700485 - RNA, 64 nt, Homo Sapiens; identical to SEQ ID NO: 27225

SEQ ID NO: 700486 - RNA, 64 nt, Homo Sapiens; identical to SEQ ID NO: 27226

SEQ ID NO: 700487 - RNA, 64 nt, Homo Sapiens; identical to SEQ ID NO: 27227

SEQ ID NO: 700488 - RNA, 64 nt, Homo Sapiens; identical to SEQ ID NO: 27228

SEQ ID NO: 700489 - RNA, 64 nt, Homo Sapiens; identical to SEQ ID NO: 27229

SEQ ID NO: 700490 - RNA, 64 nt, Homo Sapiens; identical to SEQ ID NO: 27230

SEQ ID NO: 700491 - RNA, 64 nt, Homo Sapiens; identical to SEQ ID NO: 27231

SEQ ID NO: 700492 - RNA, 64 nt, Homo Sapiens; identical to SEQ ID NO: 27232

SEQ ID NO: 700493 - RNA, 64 nt, Homo Sapiens; identical to SEQ ID NO: 27233

SEQ ID NO: 700494 - RNA, 64 nt, Homo Sapiens; identical to SEQ ID NO: 27234

SEQ ID NO: 700495 - RNA, 64 nt, Homo Sapiens; identical to SEQ ID NO: 27235

SEQ ID NO: 700496 - RNA, 64 nt, Homo Sapiens; identical to SEQ ID NO: 27236

SEQ ID NO: 700497 - RNA, 64 nt, Homo Sapiens; identical to SEQ ID NO: 27237

SEQ ID NO: 700498 - RNA, 64 nt, Homo Sapiens; identical to SEQ ID NO: 27238

SEQ ID NO: 700499 - RNA, 64 nt, Homo Sapiens; identical to SEQ ID NO: 27239

SEQ ID NO: 700500 - RNA, 64 nt, Homo Sapiens; identical to SEQ ID NO: 27240

SEQ ID NO: 700501 - RNA, 64 nt, Homo Sapiens; identical to SEQ ID NO: 27241

SEQ ID NO: 700502 - RNA, 64 nt, Homo Sapiens; identical to SEQ ID NO: 27242

SEQ ID NO: 700503 - RNA, 64 nt, Homo Sapiens; identical to SEQ ID NO: 27243

SEQ ID NO: 700504 - RNA, 64 nt, Homo Sapiens; identical to SEQ ID NO: 27244

SEQ ID NO: 700505 - RNA, 64 nt, Homo Sapiens; identical to SEQ ID NO: 27245

SEQ ID NO: 700506 - RNA, 64 nt, Homo Sapiens; identical to SEQ ID NO: 27246

SEQ ID NO: 700507 - RNA, 64 nt, Homo Sapiens; identical to SEQ ID NO: 27247

SEQ ID NO: 700508 - RNA, 64 nt, Homo Sapiens; identical to SEQ ID NO: 27248

SEQ ID NO: 700509 - RNA, 64 nt, Homo Sapiens; identical to SEQ ID NO: 27249

SEQ ID NO: 700510 - RNA, 64 nt, Homo Sapiens; identical to SEQ ID NO: 27250

SEQ ID NO: 700511 - RNA, 64 nt, Homo Sapiens; identical to SEQ ID NO: 27251

SEQ ID NO: 700512 - RNA, 64 nt, Homo Sapiens; identical to SEQ ID NO: 27252

SEQ ID NO: 700513 - RNA, 64 nt, Homo Sapiens; identical to SEQ ID NO: 27253

SEQ ID NO: 700514 - RNA, 64 nt, Homo Sapiens; identical to SEQ ID NO: 27254

SEQ ID NO: 700515 - RNA, 64 nt, Homo Sapiens; identical to SEQ ID NO: 27255

SEQ ID NO: 700516 - RNA, 64 nt, Homo Sapiens; identical to SEQ ID NO: 27256

SEQ ID NO: 700517 - RNA, 64 nt, Homo Sapiens; identical to SEQ ID NO: 27257

SEQ ID NO: 700518 - RNA, 64 nt, Homo Sapiens; identical to SEQ ID NO: 27258

SEQ ID NO: 700519 - RNA, 64 nt, Homo Sapiens; identical to SEQ ID NO: 27259

SEQ ID NO: 700520 - RNA, 64 nt, Homo Sapiens; identical to SEQ ID NO: 27260

SEQ ID NO: 700521 - RNA, 64 nt, Homo Sapiens; identical to SEQ ID NO: 27261

SEQ ID NO: 700522 - RNA, 64 nt, Homo Sapiens; identical to SEQ ID NO: 27262

SEQ ID NO: 700523 - RNA, 64 nt, Homo Sapiens; identical to SEQ ID NO: 27263

SEQ ID NO: 700524 - RNA, 64 nt, Homo Sapiens; identical to SEQ ID NO: 27264

SEQ ID NO: 700525 - RNA, 64 nt, Homo Sapiens; identical to SEQ ID NO: 27265

SEQ ID NO: 700526 - RNA, 64 nt, Homo Sapiens; identical to SEQ ID NO: 27266

SEQ ID NO: 700527 - RNA, 64 nt, Homo Sapiens; identical to SEQ ID NO: 27267

SEQ ID NO: 700528 - RNA, 64 nt, Homo Sapiens; identical to SEQ ID NO: 27268

SEQ ID NO: 700529 - RNA, 64 nt, Homo Sapiens; identical to SEQ ID NO: 27269

SEQ ID NO: 700530 - RNA, 64 nt, Homo Sapiens; identical to SEQ ID NO: 27270

SEQ ID NO: 700531 - RNA, 64 nt, Homo Sapiens; identical to SEQ ID NO: 27271

SEQ ID NO: 700532 - RNA, 64 nt, Homo Sapiens; identical to SEQ ID NO: 27272

SEQ ID NO: 700533 - RNA, 64 nt, Homo Sapiens; identical to SEQ ID NO: 27273

SEQ ID NO: 700534 - RNA, 64 nt, Homo Sapiens; identical to SEQ ID NO: 27274

SEQ ID NO: 700535 - RNA, 64 nt, Homo Sapiens; identical to SEQ ID NO: 27275

SEQ ID NO: 700536 - RNA, 64 nt, Homo Sapiens; identical to SEQ ID NO: 27276

SEQ ID NO: 700537 - RNA, 64 nt, Homo Sapiens; identical to SEQ ID NO: 27277

SEQ ID NO: 700538 - RNA, 64 nt, Homo Sapiens; identical to SEQ ID NO: 27278

SEQ ID NO: 700539 - RNA, 64 nt, Homo Sapiens; identical to SEQ ID NO: 27279

SEQ ID NO: 700540 - RNA, 64 nt, Homo Sapiens; identical to SEQ ID NO: 27280

SEQ ID NO: 700541 - RNA, 64 nt, Homo Sapiens; identical to SEQ ID NO: 27281

SEQ ID NO: 700542 - RNA, 64 nt, Homo Sapiens; identical to SEQ ID NO: 27282

SEQ ID NO: 700543 - RNA, 64 nt, Homo Sapiens; identical to SEQ ID NO: 27283

SEQ ID NO: 700544 - RNA, 64 nt, Homo Sapiens; identical to SEQ ID NO: 27284

SEQ ID NO: 700545 - RNA, 64 nt, Homo Sapiens; identical to SEQ ID NO: 27285

SEQ ID NO: 700546 - RNA, 64 nt, Homo Sapiens; identical to SEQ ID NO: 27286

SEQ ID NO: 700547 - RNA, 64 nt, Homo Sapiens; identical to SEQ ID NO: 27287

SEQ ID NO: 700548 - RNA, 64 nt, Homo Sapiens; identical to SEQ ID NO: 27288

SEQ ID NO: 700549 - RNA, 64 nt, Homo Sapiens; identical to SEQ ID NO: 27289

SEQ ID NO: 700550 - RNA, 64 nt, Homo Sapiens; identical to SEQ ID NO: 27290

SEQ ID NO: 700551 - RNA, 64 nt, Homo Sapiens; identical to SEQ ID NO: 27291

SEQ ID NO: 700552 - RNA, 64 nt, Homo Sapiens; identical to SEQ ID NO: 27292

SEQ ID NO: 700553 - RNA, 64 nt, Homo Sapiens; identical to SEQ ID NO: 27293

SEQ ID NO: 700554 - RNA, 64 nt, Homo Sapiens; identical to SEQ ID NO: 27294

SEQ ID NO: 700555 - RNA, 64 nt, Homo Sapiens; identical to SEQ ID NO: 27295

SEQ ID NO: 700556 - RNA, 64 nt, Homo Sapiens; identical to SEQ ID NO: 27296

SEQ ID NO: 700557 - RNA, 64 nt, Homo Sapiens; identical to SEQ ID NO: 27297

SEQ ID NO: 700558 - RNA, 64 nt, Homo Sapiens; identical to SEQ ID NO: 27298

SEQ ID NO: 700559 - RNA, 64 nt, Homo Sapiens; identical to SEQ ID NO: 27299

SEQ ID NO: 700560 - RNA, 64 nt, Homo Sapiens; identical to SEQ ID NO: 27300

SEQ ID NO: 700561 - RNA, 64 nt, Homo Sapiens; identical to SEQ ID NO: 27301

SEQ ID NO: 700562 - RNA, 64 nt, Homo Sapiens; identical to SEQ ID NO: 27302

SEQ ID NO: 700563 - RNA, 64 nt, Homo Sapiens; identical to SEQ ID NO: 27303

SEQ ID NO: 700564 - RNA, 64 nt, Homo Sapiens; identical to SEQ ID NO: 27304

SEQ ID NO: 700565 - RNA, 64 nt, Homo Sapiens; identical to SEQ ID NO: 27305

SEQ ID NO: 700566 - RNA, 64 nt, Homo Sapiens; identical to SEQ ID NO: 27306

SEQ ID NO: 700567 - RNA, 64 nt, Homo Sapiens; identical to SEQ ID NO: 27307

SEQ ID NO: 700568 - RNA, 64 nt, Homo Sapiens; identical to SEQ ID NO: 27308

SEQ ID NO: 700569 - RNA, 64 nt, Homo Sapiens; identical to SEQ ID NO: 27309

SEQ ID NO: 700570 - RNA, 64 nt, Homo Sapiens; identical to SEQ ID NO: 27310

SEQ ID NO: 700571 - RNA, 64 nt, Homo Sapiens; identical to SEQ ID NO: 27311

SEQ ID NO: 700572 - RNA, 64 nt, Homo Sapiens; identical to SEQ ID NO: 27312

SEQ ID NO: 700573 - RNA, 63 nt, Homo Sapiens; identical to SEQ ID NO: 27313

SEQ ID NO: 700574 - RNA, 64 nt, Homo Sapiens; identical to SEQ ID NO: 27314

SEQ ID NO: 700575 - RNA, 64 nt, Homo Sapiens; identical to SEQ ID NO: 27315

SEQ ID NO: 700576 - RNA, 64 nt, Homo Sapiens; identical to SEQ ID NO: 27316

SEQ ID NO: 700577 - RNA, 64 nt, Homo Sapiens; identical to SEQ ID NO: 27317

SEQ ID NO: 700578 - RNA, 64 nt, Homo Sapiens; identical to SEQ ID NO: 27318

SEQ ID NO: 700579 - RNA, 64 nt, Homo Sapiens; identical to SEQ ID NO: 27319

SEQ ID NO: 700580 - RNA, 64 nt, Homo Sapiens; identical to SEQ ID NO: 27320

SEQ ID NO: 700581 - RNA, 64 nt, Homo Sapiens; identical to SEQ ID NO: 27321

SEQ ID NO: 700582 - RNA, 64 nt, Homo Sapiens; identical to SEQ ID NO: 27322

SEQ ID NO: 700583 - RNA, 64 nt, Homo Sapiens; identical to SEQ ID NO: 27323

SEQ ID NO: 700584 - RNA, 64 nt, Homo Sapiens; identical to SEQ ID NO: 27324

SEQ ID NO: 700585 - RNA, 64 nt, Homo Sapiens; identical to SEQ ID NO: 27325

SEQ ID NO: 700586 - RNA, 64 nt, Homo Sapiens; identical to SEQ ID NO: 27326

SEQ ID NO: 700587 - RNA, 64 nt, Homo Sapiens; identical to SEQ ID NO: 27327

SEQ ID NO: 700588 - RNA, 64 nt, Homo Sapiens; identical to SEQ ID NO: 27328

SEQ ID NO: 700589 - RNA, 64 nt, Homo Sapiens; identical to SEQ ID NO: 27329

SEQ ID NO: 700590 - RNA, 64 nt, Homo Sapiens; identical to SEQ ID NO: 27330

SEQ ID NO: 700591 - RNA, 64 nt, Homo Sapiens; identical to SEQ ID NO: 27331

SEQ ID NO: 700592 - RNA, 64 nt, Homo Sapiens; identical to SEQ ID NO: 27332

SEQ ID NO: 700593 - RNA, 64 nt, Homo Sapiens; identical to SEQ ID NO: 27333

SEQ ID NO: 700594 - RNA, 64 nt, Homo Sapiens; identical to SEQ ID NO: 27334

SEQ ID NO: 700595 - RNA, 64 nt, Homo Sapiens; identical to SEQ ID NO: 27335

SEQ ID NO: 700596 - RNA, 64 nt, Homo Sapiens; identical to SEQ ID NO: 27336

SEQ ID NO: 700597 - RNA, 64 nt, Homo Sapiens; identical to SEQ ID NO: 27337

SEQ ID NO: 700598 - RNA, 64 nt, Homo Sapiens; identical to SEQ ID NO: 27338

SEQ ID NO: 700599 - RNA, 64 nt, Homo Sapiens; identical to SEQ ID NO: 27339

SEQ ID NO: 700600 - RNA, 64 nt, Homo Sapiens; identical to SEQ ID NO: 27340

SEQ ID NO: 700601 - RNA, 64 nt, Homo Sapiens; identical to SEQ ID NO: 27341

SEQ ID NO: 700602 - RNA, 64 nt, Homo Sapiens; identical to SEQ ID NO: 27342

SEQ ID NO: 700603 - RNA, 64 nt, Homo Sapiens; identical to SEQ ID NO: 27343

SEQ ID NO: 700604 - RNA, 64 nt, Homo Sapiens; identical to SEQ ID NO: 27344

SEQ ID NO: 700605 - RNA, 64 nt, Homo Sapiens; identical to SEQ ID NO: 27345

SEQ ID NO: 700606 - RNA, 64 nt, Homo Sapiens; identical to SEQ ID NO: 27346

SEQ ID NO: 700607 - RNA, 64 nt, Homo Sapiens; identical to SEQ ID NO: 27347

SEQ ID NO: 700608 - RNA, 64 nt, Homo Sapiens; identical to SEQ ID NO: 27348

SEQ ID NO: 700609 - RNA, 64 nt, Homo Sapiens; identical to SEQ ID NO: 27349

SEQ ID NO: 700610 - RNA, 64 nt, Homo Sapiens; identical to SEQ ID NO: 27350

SEQ ID NO: 700611 - RNA, 64 nt, Homo Sapiens; identical to SEQ ID NO: 27351

SEQ ID NO: 700612 - RNA, 64 nt, Homo Sapiens; identical to SEQ ID NO: 27352

SEQ ID NO: 700613 - RNA, 64 nt, Homo Sapiens; identical to SEQ ID NO: 27353

SEQ ID NO: 700614 - RNA, 64 nt, Homo Sapiens; identical to SEQ ID NO: 27354

SEQ ID NO: 700615 - RNA, 64 nt, Homo Sapiens; identical to SEQ ID NO: 27355

SEQ ID NO: 700616 - RNA, 64 nt, Homo Sapiens; identical to SEQ ID NO: 27356

SEQ ID NO: 700617 - RNA, 64 nt, Homo Sapiens; identical to SEQ ID NO: 27357

SEQ ID NO: 700618 - RNA, 64 nt, Homo Sapiens; identical to SEQ ID NO: 27358

SEQ ID NO: 700619 - RNA, 64 nt, Homo Sapiens; identical to SEQ ID NO: 27359

SEQ ID NO: 700620 - RNA, 64 nt, Homo Sapiens; identical to SEQ ID NO: 27360

SEQ ID NO: 700621 - RNA, 64 nt, Homo Sapiens; identical to SEQ ID NO: 27361

SEQ ID NO: 700622 - RNA, 64 nt, Homo Sapiens; identical to SEQ ID NO: 27362

SEQ ID NO: 700623 - RNA, 64 nt, Homo Sapiens; identical to SEQ ID NO: 27363

SEQ ID NO: 700624 - RNA, 64 nt, Homo Sapiens; identical to SEQ ID NO: 27364

SEQ ID NO: 700625 - RNA, 64 nt, Homo Sapiens; identical to SEQ ID NO: 27365

SEQ ID NO: 700626 - RNA, 64 nt, Homo Sapiens; identical to SEQ ID NO: 27366

SEQ ID NO: 700627 - RNA, 64 nt, Homo Sapiens; identical to SEQ ID NO: 27367

SEQ ID NO: 700628 - RNA, 64 nt, Homo Sapiens; identical to SEQ ID NO: 27368

SEQ ID NO: 700629 - RNA, 64 nt, Homo Sapiens; identical to SEQ ID NO: 27369

SEQ ID NO: 700630 - RNA, 64 nt, Homo Sapiens; identical to SEQ ID NO: 27370

SEQ ID NO: 700631 - RNA, 64 nt, Homo Sapiens; identical to SEQ ID NO: 27371

SEQ ID NO: 700632 - RNA, 64 nt, Homo Sapiens; identical to SEQ ID NO: 27372

SEQ ID NO: 700633 - RNA, 64 nt, Homo Sapiens; identical to SEQ ID NO: 27373

SEQ ID NO: 700634 - RNA, 64 nt, Homo Sapiens; identical to SEQ ID NO: 27374

SEQ ID NO: 700635 - RNA, 64 nt, Homo Sapiens; identical to SEQ ID NO: 27375

SEQ ID NO: 700636 - RNA, 64 nt, Homo Sapiens; identical to SEQ ID NO: 27376

SEQ ID NO: 700637 - RNA, 64 nt, Homo Sapiens; identical to SEQ ID NO: 27377

SEQ ID NO: 700638 - RNA, 64 nt, Homo Sapiens; identical to SEQ ID NO: 27378

SEQ ID NO: 700639 - RNA, 64 nt, Homo Sapiens; identical to SEQ ID NO: 27379

SEQ ID NO: 700640 - RNA, 64 nt, Homo Sapiens; identical to SEQ ID NO: 27380

SEQ ID NO: 700641 - RNA, 64 nt, Homo Sapiens; identical to SEQ ID NO: 27381

SEQ ID NO: 700642 - RNA, 64 nt, Homo Sapiens; identical to SEQ ID NO: 27382

SEQ ID NO: 700643 - RNA, 64 nt, Homo Sapiens; identical to SEQ ID NO: 27383

SEQ ID NO: 700644 - RNA, 64 nt, Homo Sapiens; identical to SEQ ID NO: 27384

SEQ ID NO: 700645 - RNA, 64 nt, Homo Sapiens; identical to SEQ ID NO: 27385

SEQ ID NO: 700646 - RNA, 64 nt, Homo Sapiens; identical to SEQ ID NO: 27386

SEQ ID NO: 700647 - RNA, 64 nt, Homo Sapiens; identical to SEQ ID NO: 27387

SEQ ID NO: 700648 - RNA, 64 nt, Homo Sapiens; identical to SEQ ID NO: 27388

SEQ ID NO: 700649 - RNA, 64 nt, Homo Sapiens; identical to SEQ ID NO: 27389

SEQ ID NO: 700650 - RNA, 64 nt, Homo Sapiens; identical to SEQ ID NO: 27390

SEQ ID NO: 700651 - RNA, 64 nt, Homo Sapiens; identical to SEQ ID NO: 27391

SEQ ID NO: 700652 - RNA, 64 nt, Homo Sapiens; identical to SEQ ID NO: 27392

SEQ ID NO: 700653 - RNA, 64 nt, Homo Sapiens; identical to SEQ ID NO: 27393

SEQ ID NO: 700654 - RNA, 64 nt, Homo Sapiens; identical to SEQ ID NO: 27394

SEQ ID NO: 700655 - RNA, 64 nt, Homo Sapiens; identical to SEQ ID NO: 27395

SEQ ID NO: 700656 - RNA, 64 nt, Homo Sapiens; identical to SEQ ID NO: 27396

SEQ ID NO: 700657 - RNA, 64 nt, Homo Sapiens; identical to SEQ ID NO: 27397

SEQ ID NO: 700658 - RNA, 64 nt, Homo Sapiens; identical to SEQ ID NO: 27398

SEQ ID NO: 700659 - RNA, 64 nt, Homo Sapiens; identical to SEQ ID NO: 27399

SEQ ID NO: 700660 - RNA, 64 nt, Homo Sapiens; identical to SEQ ID NO: 27400

SEQ ID NO: 700661 - RNA, 64 nt, Homo Sapiens; identical to SEQ ID NO: 27401

SEQ ID NO: 700662 - RNA, 64 nt, Homo Sapiens; identical to SEQ ID NO: 27402

SEQ ID NO: 700663 - RNA, 64 nt, Homo Sapiens; identical to SEQ ID NO: 27403

SEQ ID NO: 700664 - RNA, 64 nt, Homo Sapiens; identical to SEQ ID NO: 27404

SEQ ID NO: 700665 - RNA, 64 nt, Homo Sapiens; identical to SEQ ID NO: 27405

SEQ ID NO: 700666 - RNA, 64 nt, Homo Sapiens; identical to SEQ ID NO: 27406

SEQ ID NO: 700667 - RNA, 64 nt, Homo Sapiens; identical to SEQ ID NO: 27407

SEQ ID NO: 700668 - RNA, 64 nt, Homo Sapiens; identical to SEQ ID NO: 27408

SEQ ID NO: 700669 - RNA, 64 nt, Homo Sapiens; identical to SEQ ID NO: 27409

SEQ ID NO: 700670 - RNA, 64 nt, Homo Sapiens; identical to SEQ ID NO: 27410

SEQ ID NO: 700671 - RNA, 64 nt, Homo Sapiens; identical to SEQ ID NO: 27411

SEQ ID NO: 700672 - RNA, 64 nt, Homo Sapiens; identical to SEQ ID NO: 27412

SEQ ID NO: 700673 - RNA, 64 nt, Homo Sapiens; identical to SEQ ID NO: 27413

SEQ ID NO: 700674 - RNA, 64 nt, Homo Sapiens; identical to SEQ ID NO: 27414

SEQ ID NO: 700675 - RNA, 64 nt, Homo Sapiens; identical to SEQ ID NO: 27415

SEQ ID NO: 700676 - RNA, 64 nt, Homo Sapiens; identical to SEQ ID NO: 27416

SEQ ID NO: 700677 - RNA, 64 nt, Homo Sapiens; identical to SEQ ID NO: 27417

SEQ ID NO: 700678 - RNA, 64 nt, Homo Sapiens; identical to SEQ ID NO: 27418

SEQ ID NO: 700679 - RNA, 64 nt, Homo Sapiens; identical to SEQ ID NO: 27419

SEQ ID NO: 700680 - RNA, 64 nt, Homo Sapiens; identical to SEQ ID NO: 27420

SEQ ID NO: 700681 - RNA, 64 nt, Homo Sapiens; identical to SEQ ID NO: 27421

SEQ ID NO: 700682 - RNA, 64 nt, Homo Sapiens; identical to SEQ ID NO: 27422

SEQ ID NO: 700683 - RNA, 64 nt, Homo Sapiens; identical to SEQ ID NO: 27423

SEQ ID NO: 700684 - RNA, 64 nt, Homo Sapiens; identical to SEQ ID NO: 27424

SEQ ID NO: 700685 - RNA, 64 nt, Homo Sapiens; identical to SEQ ID NO: 27425

SEQ ID NO: 700686 - RNA, 64 nt, Homo Sapiens; identical to SEQ ID NO: 27426

SEQ ID NO: 700687 - RNA, 64 nt, Homo Sapiens; identical to SEQ ID NO: 27427

SEQ ID NO: 700688 - RNA, 64 nt, Homo Sapiens; identical to SEQ ID NO: 27428

SEQ ID NO: 700689 - RNA, 64 nt, Homo Sapiens; identical to SEQ ID NO: 27429

SEQ ID NO: 700690 - RNA, 64 nt, Homo Sapiens; identical to SEQ ID NO: 27430

SEQ ID NO: 700691 - RNA, 64 nt, Homo Sapiens; identical to SEQ ID NO: 27431

SEQ ID NO: 700692 - RNA, 64 nt, Homo Sapiens; identical to SEQ ID NO: 27432

SEQ ID NO: 700693 - RNA, 64 nt, Homo Sapiens; identical to SEQ ID NO: 27433

SEQ ID NO: 700694 - RNA, 64 nt, Homo Sapiens; identical to SEQ ID NO: 27434

SEQ ID NO: 700695 - RNA, 64 nt, Homo Sapiens; identical to SEQ ID NO: 27435

SEQ ID NO: 700696 - RNA, 64 nt, Homo Sapiens; identical to SEQ ID NO: 27436

SEQ ID NO: 700697 - RNA, 64 nt, Homo Sapiens; identical to SEQ ID NO: 27437

SEQ ID NO: 700698 - RNA, 64 nt, Homo Sapiens; identical to SEQ ID NO: 27438

SEQ ID NO: 700699 - RNA, 64 nt, Homo Sapiens; identical to SEQ ID NO: 27439

SEQ ID NO: 700700 - RNA, 64 nt, Homo Sapiens; identical to SEQ ID NO: 27440

SEQ ID NO: 700701 - RNA, 64 nt, Homo Sapiens; identical to SEQ ID NO: 27441

SEQ ID NO: 700702 - RNA, 64 nt, Homo Sapiens; identical to SEQ ID NO: 27442

SEQ ID NO: 700703 - RNA, 64 nt, Homo Sapiens; identical to SEQ ID NO: 27443

SEQ ID NO: 700704 - RNA, 64 nt, Homo Sapiens; identical to SEQ ID NO: 27444

SEQ ID NO: 700705 - RNA, 64 nt, Homo Sapiens; identical to SEQ ID NO: 27445

SEQ ID NO: 700706 - RNA, 64 nt, Homo Sapiens; identical to SEQ ID NO: 27446

SEQ ID NO: 700707 - RNA, 64 nt, Homo Sapiens; identical to SEQ ID NO: 27447

SEQ ID NO: 700708 - RNA, 64 nt, Homo Sapiens; identical to SEQ ID NO: 27448

SEQ ID NO: 700709 - RNA, 64 nt, Homo Sapiens; identical to SEQ ID NO: 27449

SEQ ID NO: 700710 - RNA, 64 nt, Homo Sapiens; identical to SEQ ID NO: 27450

SEQ ID NO: 700711 - RNA, 64 nt, Homo Sapiens; identical to SEQ ID NO: 27451

SEQ ID NO: 700712 - RNA, 64 nt, Homo Sapiens; identical to SEQ ID NO: 27452

SEQ ID NO: 700713 - RNA, 64 nt, Homo Sapiens; identical to SEQ ID NO: 27453

SEQ ID NO: 700714 - RNA, 64 nt, Homo Sapiens; identical to SEQ ID NO: 27454

SEQ ID NO: 700715 - RNA, 64 nt, Homo Sapiens; identical to SEQ ID NO: 27455

SEQ ID NO: 700716 - RNA, 64 nt, Homo Sapiens; identical to SEQ ID NO: 27456

SEQ ID NO: 700717 - RNA, 64 nt, Homo Sapiens; identical to SEQ ID NO: 27457

SEQ ID NO: 700718 - RNA, 64 nt, Homo Sapiens; identical to SEQ ID NO: 27458

SEQ ID NO: 700719 - RNA, 64 nt, Homo Sapiens; identical to SEQ ID NO: 27459

SEQ ID NO: 700720 - RNA, 64 nt, Homo Sapiens; identical to SEQ ID NO: 27460

SEQ ID NO: 700721 - RNA, 64 nt, Homo Sapiens; identical to SEQ ID NO: 27461

SEQ ID NO: 700722 - RNA, 64 nt, Homo Sapiens; identical to SEQ ID NO: 27462

SEQ ID NO: 700723 - RNA, 64 nt, Homo Sapiens; identical to SEQ ID NO: 27463

SEQ ID NO: 700724 - RNA, 64 nt, Homo Sapiens; identical to SEQ ID NO: 27464

SEQ ID NO: 700725 - RNA, 64 nt, Homo Sapiens; identical to SEQ ID NO: 27465

SEQ ID NO: 700726 - RNA, 64 nt, Homo Sapiens; identical to SEQ ID NO: 27466

SEQ ID NO: 700727 - RNA, 64 nt, Homo Sapiens; identical to SEQ ID NO: 27467

SEQ ID NO: 700728 - RNA, 64 nt, Homo Sapiens; identical to SEQ ID NO: 27468

SEQ ID NO: 700729 - RNA, 64 nt, Homo Sapiens; identical to SEQ ID NO: 27469

SEQ ID NO: 700730 - RNA, 64 nt, Homo Sapiens; identical to SEQ ID NO: 27470

SEQ ID NO: 700731 - RNA, 64 nt, Homo Sapiens; identical to SEQ ID NO: 27471

SEQ ID NO: 700732 - RNA, 64 nt, Homo Sapiens; identical to SEQ ID NO: 27472

SEQ ID NO: 700733 - RNA, 64 nt, Homo Sapiens; identical to SEQ ID NO: 27473

SEQ ID NO: 700734 - RNA, 64 nt, Homo Sapiens; identical to SEQ ID NO: 27474

SEQ ID NO: 700735 - RNA, 64 nt, Homo Sapiens; identical to SEQ ID NO: 27475

SEQ ID NO: 700736 - RNA, 64 nt, Homo Sapiens; identical to SEQ ID NO: 27476

SEQ ID NO: 700737 - RNA, 64 nt, Homo Sapiens; identical to SEQ ID NO: 27477

SEQ ID NO: 700738 - RNA, 64 nt, Homo Sapiens; identical to SEQ ID NO: 27478

SEQ ID NO: 700739 - RNA, 64 nt, Homo Sapiens; identical to SEQ ID NO: 27479

SEQ ID NO: 700740 - RNA, 64 nt, Homo Sapiens; identical to SEQ ID NO: 27480

SEQ ID NO: 700741 - RNA, 64 nt, Homo Sapiens; identical to SEQ ID NO: 27481

SEQ ID NO: 700742 - RNA, 64 nt, Homo Sapiens; identical to SEQ ID NO: 27482

SEQ ID NO: 700743 - RNA, 64 nt, Homo Sapiens; identical to SEQ ID NO: 27483

SEQ ID NO: 700744 - RNA, 64 nt, Homo Sapiens; identical to SEQ ID NO: 27484

SEQ ID NO: 700745 - RNA, 64 nt, Homo Sapiens; identical to SEQ ID NO: 27485

SEQ ID NO: 700746 - RNA, 64 nt, Homo Sapiens; identical to SEQ ID NO: 27486

SEQ ID NO: 700747 - RNA, 64 nt, Homo Sapiens; identical to SEQ ID NO: 27487

SEQ ID NO: 700748 - RNA, 64 nt, Homo Sapiens; identical to SEQ ID NO: 27488

SEQ ID NO: 700749 - RNA, 64 nt, Homo Sapiens; identical to SEQ ID NO: 27489

SEQ ID NO: 700750 - RNA, 64 nt, Homo Sapiens; identical to SEQ ID NO: 27490

SEQ ID NO: 700751 - RNA, 64 nt, Homo Sapiens; identical to SEQ ID NO: 27491

SEQ ID NO: 700752 - RNA, 64 nt, Homo Sapiens; identical to SEQ ID NO: 27492

SEQ ID NO: 700753 - RNA, 64 nt, Homo Sapiens; identical to SEQ ID NO: 27493

SEQ ID NO: 700754 - RNA, 64 nt, Homo Sapiens; identical to SEQ ID NO: 27494

SEQ ID NO: 700755 - RNA, 64 nt, Homo Sapiens; identical to SEQ ID NO: 27495

SEQ ID NO: 700756 - RNA, 64 nt, Homo Sapiens; identical to SEQ ID NO: 27496

SEQ ID NO: 700757 - RNA, 64 nt, Homo Sapiens; identical to SEQ ID NO: 27497

SEQ ID NO: 700758 - RNA, 64 nt, Homo Sapiens; identical to SEQ ID NO: 27498

SEQ ID NO: 700759 - RNA, 64 nt, Homo Sapiens; identical to SEQ ID NO: 27499

SEQ ID NO: 700760 - RNA, 64 nt, Homo Sapiens; identical to SEQ ID NO: 27500

SEQ ID NO: 700761 - RNA, 64 nt, Homo Sapiens; identical to SEQ ID NO: 27501

SEQ ID NO: 700762 - RNA, 64 nt, Homo Sapiens; identical to SEQ ID NO: 27502

SEQ ID NO: 700763 - RNA, 64 nt, Homo Sapiens; identical to SEQ ID NO: 27503

SEQ ID NO: 700764 - RNA, 64 nt, Homo Sapiens; identical to SEQ ID NO: 27504

SEQ ID NO: 700765 - RNA, 64 nt, Homo Sapiens; identical to SEQ ID NO: 27505

SEQ ID NO: 700766 - RNA, 64 nt, Homo Sapiens; identical to SEQ ID NO: 27506

SEQ ID NO: 700767 - RNA, 64 nt, Homo Sapiens; identical to SEQ ID NO: 27507

SEQ ID NO: 700768 - RNA, 64 nt, Homo Sapiens; identical to SEQ ID NO: 27508

SEQ ID NO: 700769 - RNA, 64 nt, Homo Sapiens; identical to SEQ ID NO: 27509

SEQ ID NO: 700770 - RNA, 64 nt, Homo Sapiens; identical to SEQ ID NO: 27510

SEQ ID NO: 700771 - RNA, 64 nt, Homo Sapiens; identical to SEQ ID NO: 27511

SEQ ID NO: 700772 - RNA, 64 nt, Homo Sapiens; identical to SEQ ID NO: 27512

SEQ ID NO: 700773 - RNA, 64 nt, Homo Sapiens; identical to SEQ ID NO: 27513

SEQ ID NO: 700774 - RNA, 64 nt, Homo Sapiens; identical to SEQ ID NO: 27514

SEQ ID NO: 700775 - RNA, 64 nt, Homo Sapiens; identical to SEQ ID NO: 27515

SEQ ID NO: 700776 - RNA, 64 nt, Homo Sapiens; identical to SEQ ID NO: 27516

SEQ ID NO: 700777 - RNA, 64 nt, Homo Sapiens; identical to SEQ ID NO: 27517

SEQ ID NO: 700778 - RNA, 64 nt, Homo Sapiens; identical to SEQ ID NO: 27518

SEQ ID NO: 700779 - RNA, 64 nt, Homo Sapiens; identical to SEQ ID NO: 27519

SEQ ID NO: 700780 - RNA, 64 nt, Homo Sapiens; identical to SEQ ID NO: 27520

SEQ ID NO: 700781 - RNA, 64 nt, Homo Sapiens; identical to SEQ ID NO: 27521

SEQ ID NO: 700782 - RNA, 64 nt, Homo Sapiens; identical to SEQ ID NO: 27522

SEQ ID NO: 700783 - RNA, 64 nt, Homo Sapiens; identical to SEQ ID NO: 27523

SEQ ID NO: 700784 - RNA, 64 nt, Homo Sapiens; identical to SEQ ID NO: 27524

SEQ ID NO: 700785 - RNA, 64 nt, Homo Sapiens; identical to SEQ ID NO: 27525

SEQ ID NO: 700786 - RNA, 64 nt, Homo Sapiens; identical to SEQ ID NO: 27526

SEQ ID NO: 700787 - RNA, 64 nt, Homo Sapiens; identical to SEQ ID NO: 27527

SEQ ID NO: 700788 - RNA, 64 nt, Homo Sapiens; identical to SEQ ID NO: 27528

SEQ ID NO: 700789 - RNA, 64 nt, Homo Sapiens; identical to SEQ ID NO: 27529

SEQ ID NO: 700790 - RNA, 64 nt, Homo Sapiens; identical to SEQ ID NO: 27530

SEQ ID NO: 700791 - RNA, 64 nt, Homo Sapiens; identical to SEQ ID NO: 27531

SEQ ID NO: 700792 - RNA, 64 nt, Homo Sapiens; identical to SEQ ID NO: 27532

SEQ ID NO: 700793 - RNA, 64 nt, Homo Sapiens; identical to SEQ ID NO: 27533

SEQ ID NO: 700794 - RNA, 64 nt, Homo Sapiens; identical to SEQ ID NO: 27534

SEQ ID NO: 700795 - RNA, 64 nt, Homo Sapiens; identical to SEQ ID NO: 27535

SEQ ID NO: 700796 - RNA, 64 nt, Homo Sapiens; identical to SEQ ID NO: 27536

SEQ ID NO: 700797 - RNA, 64 nt, Homo Sapiens; identical to SEQ ID NO: 27537

SEQ ID NO: 700798 - RNA, 64 nt, Homo Sapiens; identical to SEQ ID NO: 27538

SEQ ID NO: 700799 - RNA, 64 nt, Homo Sapiens; identical to SEQ ID NO: 27539

SEQ ID NO: 700800 - RNA, 64 nt, Homo Sapiens; identical to SEQ ID NO: 27540

SEQ ID NO: 700801 - RNA, 64 nt, Homo Sapiens; identical to SEQ ID NO: 27541

SEQ ID NO: 700802 - RNA, 64 nt, Homo Sapiens; identical to SEQ ID NO: 27542

SEQ ID NO: 700803 - RNA, 64 nt, Homo Sapiens; identical to SEQ ID NO: 27543

SEQ ID NO: 700804 - RNA, 64 nt, Homo Sapiens; identical to SEQ ID NO: 27544

SEQ ID NO: 700805 - RNA, 64 nt, Homo Sapiens; identical to SEQ ID NO: 27545

SEQ ID NO: 700806 - RNA, 64 nt, Homo Sapiens; identical to SEQ ID NO: 27546

SEQ ID NO: 700807 - RNA, 64 nt, Homo Sapiens; identical to SEQ ID NO: 27547

SEQ ID NO: 700808 - RNA, 64 nt, Homo Sapiens; identical to SEQ ID NO: 27548

SEQ ID NO: 700809 - RNA, 64 nt, Homo Sapiens; identical to SEQ ID NO: 27549

SEQ ID NO: 700810 - RNA, 64 nt, Homo Sapiens; identical to SEQ ID NO: 27550

SEQ ID NO: 700811 - RNA, 64 nt, Homo Sapiens; identical to SEQ ID NO: 27551

SEQ ID NO: 700812 - RNA, 64 nt, Homo Sapiens; identical to SEQ ID NO: 27552

SEQ ID NO: 700813 - RNA, 64 nt, Homo Sapiens; identical to SEQ ID NO: 27553

SEQ ID NO: 700814 - RNA, 64 nt, Homo Sapiens; identical to SEQ ID NO: 27554

SEQ ID NO: 700815 - RNA, 64 nt, Homo Sapiens; identical to SEQ ID NO: 27555

SEQ ID NO: 700816 - RNA, 64 nt, Homo Sapiens; identical to SEQ ID NO: 27556

SEQ ID NO: 700817 - RNA, 64 nt, Homo Sapiens; identical to SEQ ID NO: 27557

SEQ ID NO: 700818 - RNA, 64 nt, Homo Sapiens; identical to SEQ ID NO: 27558

SEQ ID NO: 700819 - RNA, 64 nt, Homo Sapiens; identical to SEQ ID NO: 27559

SEQ ID NO: 700820 - RNA, 64 nt, Homo Sapiens; identical to SEQ ID NO: 27560

SEQ ID NO: 700821 - RNA, 64 nt, Homo Sapiens; identical to SEQ ID NO: 27561

SEQ ID NO: 700822 - RNA, 64 nt, Homo Sapiens; identical to SEQ ID NO: 27562

SEQ ID NO: 700823 - RNA, 64 nt, Homo Sapiens; identical to SEQ ID NO: 27563

SEQ ID NO: 700824 - RNA, 64 nt, Homo Sapiens; identical to SEQ ID NO: 27564

SEQ ID NO: 700825 - RNA, 64 nt, Homo Sapiens; identical to SEQ ID NO: 27565

SEQ ID NO: 700826 - RNA, 64 nt, Homo Sapiens; identical to SEQ ID NO: 27566

SEQ ID NO: 700827 - RNA, 64 nt, Homo Sapiens; identical to SEQ ID NO: 27567

SEQ ID NO: 700828 - RNA, 64 nt, Homo Sapiens; identical to SEQ ID NO: 27568

SEQ ID NO: 700829 - RNA, 64 nt, Homo Sapiens; identical to SEQ ID NO: 27569

SEQ ID NO: 700830 - RNA, 64 nt, Homo Sapiens; identical to SEQ ID NO: 27570

SEQ ID NO: 700831 - RNA, 64 nt, Homo Sapiens; identical to SEQ ID NO: 27571

SEQ ID NO: 700832 - RNA, 64 nt, Homo Sapiens; identical to SEQ ID NO: 27572

SEQ ID NO: 700833 - RNA, 64 nt, Homo Sapiens; identical to SEQ ID NO: 27573

SEQ ID NO: 700834 - RNA, 64 nt, Homo Sapiens; identical to SEQ ID NO: 27574

SEQ ID NO: 700835 - RNA, 64 nt, Homo Sapiens; identical to SEQ ID NO: 27575

SEQ ID NO: 700836 - RNA, 64 nt, Homo Sapiens; identical to SEQ ID NO: 27576

SEQ ID NO: 700837 - RNA, 64 nt, Homo Sapiens; identical to SEQ ID NO: 27577

SEQ ID NO: 700838 - RNA, 64 nt, Homo Sapiens; identical to SEQ ID NO: 27578

SEQ ID NO: 700839 - RNA, 64 nt, Homo Sapiens; identical to SEQ ID NO: 27579

SEQ ID NO: 700840 - RNA, 64 nt, Homo Sapiens; identical to SEQ ID NO: 27580

SEQ ID NO: 700841 - RNA, 64 nt, Homo Sapiens; identical to SEQ ID NO: 27581

SEQ ID NO: 700842 - RNA, 64 nt, Homo Sapiens; identical to SEQ ID NO: 27582

SEQ ID NO: 700843 - RNA, 64 nt, Homo Sapiens; identical to SEQ ID NO: 27583

SEQ ID NO: 700844 - RNA, 64 nt, Homo Sapiens; identical to SEQ ID NO: 27584

SEQ ID NO: 700845 - RNA, 64 nt, Homo Sapiens; identical to SEQ ID NO: 27585

SEQ ID NO: 700846 - RNA, 64 nt, Homo Sapiens; identical to SEQ ID NO: 27586

SEQ ID NO: 700847 - RNA, 64 nt, Homo Sapiens; identical to SEQ ID NO: 27587

SEQ ID NO: 700848 - RNA, 64 nt, Homo Sapiens; identical to SEQ ID NO: 27588

SEQ ID NO: 700849 - RNA, 64 nt, Homo Sapiens; identical to SEQ ID NO: 27589

SEQ ID NO: 700850 - RNA, 64 nt, Homo Sapiens; identical to SEQ ID NO: 27590

SEQ ID NO: 700851 - RNA, 64 nt, Homo Sapiens; identical to SEQ ID NO: 27591

SEQ ID NO: 700852 - RNA, 64 nt, Homo Sapiens; identical to SEQ ID NO: 27592

SEQ ID NO: 700853 - RNA, 64 nt, Homo Sapiens; identical to SEQ ID NO: 27593

SEQ ID NO: 700854 - RNA, 64 nt, Homo Sapiens; identical to SEQ ID NO: 27594

SEQ ID NO: 700855 - RNA, 64 nt, Homo Sapiens; identical to SEQ ID NO: 27595

SEQ ID NO: 700856 - RNA, 64 nt, Homo Sapiens; identical to SEQ ID NO: 27596

SEQ ID NO: 700857 - RNA, 64 nt, Homo Sapiens; identical to SEQ ID NO: 27597

SEQ ID NO: 700858 - RNA, 64 nt, Homo Sapiens; identical to SEQ ID NO: 27598

SEQ ID NO: 700859 - RNA, 64 nt, Homo Sapiens; identical to SEQ ID NO: 27599

SEQ ID NO: 700860 - RNA, 64 nt, Homo Sapiens; identical to SEQ ID NO: 27600

SEQ ID NO: 700861 - RNA, 64 nt, Homo Sapiens; identical to SEQ ID NO: 27601

SEQ ID NO: 700862 - RNA, 64 nt, Homo Sapiens; identical to SEQ ID NO: 27602

SEQ ID NO: 700863 - RNA, 64 nt, Homo Sapiens; identical to SEQ ID NO: 27603

SEQ ID NO: 700864 - RNA, 64 nt, Homo Sapiens; identical to SEQ ID NO: 27604

SEQ ID NO: 700865 - RNA, 64 nt, Homo Sapiens; identical to SEQ ID NO: 27605

SEQ ID NO: 700866 - RNA, 64 nt, Homo Sapiens; identical to SEQ ID NO: 27606

SEQ ID NO: 700867 - RNA, 64 nt, Homo Sapiens; identical to SEQ ID NO: 27607

SEQ ID NO: 700868 - RNA, 64 nt, Homo Sapiens; identical to SEQ ID NO: 27608

SEQ ID NO: 700869 - RNA, 64 nt, Homo Sapiens; identical to SEQ ID NO: 27609

SEQ ID NO: 700870 - RNA, 64 nt, Homo Sapiens; identical to SEQ ID NO: 27610

SEQ ID NO: 700871 - RNA, 64 nt, Homo Sapiens; identical to SEQ ID NO: 27611

SEQ ID NO: 700872 - RNA, 64 nt, Homo Sapiens; identical to SEQ ID NO: 27612

SEQ ID NO: 700873 - RNA, 64 nt, Homo Sapiens; identical to SEQ ID NO: 27613

SEQ ID NO: 700874 - RNA, 64 nt, Homo Sapiens; identical to SEQ ID NO: 27614

SEQ ID NO: 700875 - RNA, 64 nt, Homo Sapiens; identical to SEQ ID NO: 27615

SEQ ID NO: 700876 - RNA, 64 nt, Homo Sapiens; identical to SEQ ID NO: 27616

SEQ ID NO: 700877 - RNA, 64 nt, Homo Sapiens; identical to SEQ ID NO: 27617

SEQ ID NO: 700878 - RNA, 64 nt, Homo Sapiens; identical to SEQ ID NO: 27618

SEQ ID NO: 700879 - RNA, 64 nt, Homo Sapiens; identical to SEQ ID NO: 27619

SEQ ID NO: 700880 - RNA, 64 nt, Homo Sapiens; identical to SEQ ID NO: 27620

SEQ ID NO: 700881 - RNA, 64 nt, Homo Sapiens; identical to SEQ ID NO: 27621

SEQ ID NO: 700882 - RNA, 64 nt, Homo Sapiens; identical to SEQ ID NO: 27622

SEQ ID NO: 700883 - RNA, 64 nt, Homo Sapiens; identical to SEQ ID NO: 27623

SEQ ID NO: 700884 - RNA, 64 nt, Homo Sapiens; identical to SEQ ID NO: 27624

SEQ ID NO: 700885 - RNA, 64 nt, Homo Sapiens; identical to SEQ ID NO: 27625

SEQ ID NO: 700886 - RNA, 64 nt, Homo Sapiens; identical to SEQ ID NO: 27626

SEQ ID NO: 700887 - RNA, 64 nt, Homo Sapiens; identical to SEQ ID NO: 27627

SEQ ID NO: 700888 - RNA, 64 nt, Homo Sapiens; identical to SEQ ID NO: 27628

SEQ ID NO: 700889 - RNA, 64 nt, Homo Sapiens; identical to SEQ ID NO: 27629

SEQ ID NO: 700890 - RNA, 64 nt, Homo Sapiens; identical to SEQ ID NO: 27630

SEQ ID NO: 700891 - RNA, 64 nt, Homo Sapiens; identical to SEQ ID NO: 27631

SEQ ID NO: 700892 - RNA, 64 nt, Homo Sapiens; identical to SEQ ID NO: 27632

SEQ ID NO: 700893 - RNA, 64 nt, Homo Sapiens; identical to SEQ ID NO: 27633

SEQ ID NO: 700894 - RNA, 64 nt, Homo Sapiens; identical to SEQ ID NO: 27634

SEQ ID NO: 700895 - RNA, 64 nt, Homo Sapiens; identical to SEQ ID NO: 27635

SEQ ID NO: 700896 - RNA, 64 nt, Homo Sapiens; identical to SEQ ID NO: 27636

SEQ ID NO: 700897 - RNA, 64 nt, Homo Sapiens; identical to SEQ ID NO: 27637

SEQ ID NO: 700898 - RNA, 64 nt, Homo Sapiens; identical to SEQ ID NO: 27638

SEQ ID NO: 700899 - RNA, 64 nt, Homo Sapiens; identical to SEQ ID NO: 27639

SEQ ID NO: 700900 - RNA, 64 nt, Homo Sapiens; identical to SEQ ID NO: 27640

SEQ ID NO: 700901 - RNA, 64 nt, Homo Sapiens; identical to SEQ ID NO: 27641

SEQ ID NO: 700902 - RNA, 64 nt, Homo Sapiens; identical to SEQ ID NO: 27642

SEQ ID NO: 700903 - RNA, 64 nt, Homo Sapiens; identical to SEQ ID NO: 27643

SEQ ID NO: 700904 - RNA, 64 nt, Homo Sapiens; identical to SEQ ID NO: 27644

SEQ ID NO: 700905 - RNA, 64 nt, Homo Sapiens; identical to SEQ ID NO: 27645

SEQ ID NO: 700906 - RNA, 64 nt, Homo Sapiens; identical to SEQ ID NO: 27646

SEQ ID NO: 700907 - RNA, 64 nt, Homo Sapiens; identical to SEQ ID NO: 27647

SEQ ID NO: 700908 - RNA, 64 nt, Homo Sapiens; identical to SEQ ID NO: 27648

SEQ ID NO: 700909 - RNA, 64 nt, Homo Sapiens; identical to SEQ ID NO: 27649

SEQ ID NO: 700910 - RNA, 64 nt, Homo Sapiens; identical to SEQ ID NO: 27650

SEQ ID NO: 700911 - RNA, 64 nt, Homo Sapiens; identical to SEQ ID NO: 27651

SEQ ID NO: 700912 - RNA, 64 nt, Homo Sapiens; identical to SEQ ID NO: 27652

SEQ ID NO: 700913 - RNA, 64 nt, Homo Sapiens; identical to SEQ ID NO: 27653

SEQ ID NO: 700914 - RNA, 64 nt, Homo Sapiens; identical to SEQ ID NO: 27654

SEQ ID NO: 700915 - RNA, 64 nt, Homo Sapiens; identical to SEQ ID NO: 27655

SEQ ID NO: 700916 - RNA, 64 nt, Homo Sapiens; identical to SEQ ID NO: 27656

SEQ ID NO: 700917 - RNA, 64 nt, Homo Sapiens; identical to SEQ ID NO: 27657

SEQ ID NO: 700918 - RNA, 64 nt, Homo Sapiens; identical to SEQ ID NO: 27658

SEQ ID NO: 700919 - RNA, 64 nt, Homo Sapiens; identical to SEQ ID NO: 27659

SEQ ID NO: 700920 - RNA, 64 nt, Homo Sapiens; identical to SEQ ID NO: 27660

SEQ ID NO: 700921 - RNA, 64 nt, Homo Sapiens; identical to SEQ ID NO: 27661

SEQ ID NO: 700922 - RNA, 64 nt, Homo Sapiens; identical to SEQ ID NO: 27662

SEQ ID NO: 700923 - RNA, 64 nt, Homo Sapiens; identical to SEQ ID NO: 27663

SEQ ID NO: 700924 - RNA, 64 nt, Homo Sapiens; identical to SEQ ID NO: 27664

SEQ ID NO: 700925 - RNA, 64 nt, Homo Sapiens; identical to SEQ ID NO: 27665

SEQ ID NO: 700926 - RNA, 64 nt, Homo Sapiens; identical to SEQ ID NO: 27666

SEQ ID NO: 700927 - RNA, 64 nt, Homo Sapiens; identical to SEQ ID NO: 27667

SEQ ID NO: 700928 - RNA, 64 nt, Homo Sapiens; identical to SEQ ID NO: 27668

SEQ ID NO: 700929 - RNA, 64 nt, Homo Sapiens; identical to SEQ ID NO: 27669

SEQ ID NO: 700930 - RNA, 64 nt, Homo Sapiens; identical to SEQ ID NO: 27670

SEQ ID NO: 700931 - RNA, 64 nt, Homo Sapiens; identical to SEQ ID NO: 27671

SEQ ID NO: 700932 - RNA, 64 nt, Homo Sapiens; identical to SEQ ID NO: 27672

SEQ ID NO: 700933 - RNA, 64 nt, Homo Sapiens; identical to SEQ ID NO: 27673

SEQ ID NO: 700934 - RNA, 64 nt, Homo Sapiens; identical to SEQ ID NO: 27674

SEQ ID NO: 700935 - RNA, 64 nt, Homo Sapiens; identical to SEQ ID NO: 27675

SEQ ID NO: 700936 - RNA, 64 nt, Homo Sapiens; identical to SEQ ID NO: 27676

SEQ ID NO: 700937 - RNA, 64 nt, Homo Sapiens; identical to SEQ ID NO: 27677

SEQ ID NO: 700938 - RNA, 64 nt, Homo Sapiens; identical to SEQ ID NO: 27678

SEQ ID NO: 700939 - RNA, 64 nt, Homo Sapiens; identical to SEQ ID NO: 27679

SEQ ID NO: 700940 - RNA, 64 nt, Homo Sapiens; identical to SEQ ID NO: 27680

SEQ ID NO: 700941 - RNA, 64 nt, Homo Sapiens; identical to SEQ ID NO: 27681

SEQ ID NO: 700942 - RNA, 64 nt, Homo Sapiens; identical to SEQ ID NO: 27682

SEQ ID NO: 700943 - RNA, 64 nt, Homo Sapiens; identical to SEQ ID NO: 27683

SEQ ID NO: 700944 - RNA, 64 nt, Homo Sapiens; identical to SEQ ID NO: 27684

SEQ ID NO: 700945 - RNA, 64 nt, Homo Sapiens; identical to SEQ ID NO: 27685

SEQ ID NO: 700946 - RNA, 64 nt, Homo Sapiens; identical to SEQ ID NO: 27686

SEQ ID NO: 700947 - RNA, 64 nt, Homo Sapiens; identical to SEQ ID NO: 27687

SEQ ID NO: 700948 - RNA, 64 nt, Homo Sapiens; identical to SEQ ID NO: 27688

SEQ ID NO: 700949 - RNA, 64 nt, Homo Sapiens; identical to SEQ ID NO: 27689

SEQ ID NO: 700950 - RNA, 64 nt, Homo Sapiens; identical to SEQ ID NO: 27690

SEQ ID NO: 700951 - RNA, 64 nt, Homo Sapiens; identical to SEQ ID NO: 27691

SEQ ID NO: 700952 - RNA, 64 nt, Homo Sapiens; identical to SEQ ID NO: 27692

SEQ ID NO: 700953 - RNA, 64 nt, Homo Sapiens; identical to SEQ ID NO: 27693

SEQ ID NO: 700954 - RNA, 64 nt, Homo Sapiens; identical to SEQ ID NO: 27694

SEQ ID NO: 700955 - RNA, 64 nt, Homo Sapiens; identical to SEQ ID NO: 27695

SEQ ID NO: 700956 - RNA, 64 nt, Homo Sapiens; identical to SEQ ID NO: 27696

SEQ ID NO: 700957 - RNA, 64 nt, Homo Sapiens; identical to SEQ ID NO: 27697

SEQ ID NO: 700958 - RNA, 64 nt, Homo Sapiens; identical to SEQ ID NO: 27698

SEQ ID NO: 700959 - RNA, 64 nt, Homo Sapiens; identical to SEQ ID NO: 27699

SEQ ID NO: 700960 - RNA, 64 nt, Homo Sapiens; identical to SEQ ID NO: 27700

SEQ ID NO: 700961 - RNA, 64 nt, Homo Sapiens; identical to SEQ ID NO: 27701

SEQ ID NO: 700962 - RNA, 64 nt, Homo Sapiens; identical to SEQ ID NO: 27702

SEQ ID NO: 700963 - RNA, 64 nt, Homo Sapiens; identical to SEQ ID NO: 27703

SEQ ID NO: 700964 - RNA, 64 nt, Homo Sapiens; identical to SEQ ID NO: 27704

SEQ ID NO: 700965 - RNA, 64 nt, Homo Sapiens; identical to SEQ ID NO: 27705

SEQ ID NO: 700966 - RNA, 64 nt, Homo Sapiens; identical to SEQ ID NO: 27706

SEQ ID NO: 700967 - RNA, 64 nt, Homo Sapiens; identical to SEQ ID NO: 27707

SEQ ID NO: 700968 - RNA, 64 nt, Homo Sapiens; identical to SEQ ID NO: 27708

SEQ ID NO: 700969 - RNA, 64 nt, Homo Sapiens; identical to SEQ ID NO: 27709

SEQ ID NO: 700970 - RNA, 64 nt, Homo Sapiens; identical to SEQ ID NO: 27710

SEQ ID NO: 700971 - RNA, 64 nt, Homo Sapiens; identical to SEQ ID NO: 27711

SEQ ID NO: 700972 - RNA, 64 nt, Homo Sapiens; identical to SEQ ID NO: 27712

SEQ ID NO: 700973 - RNA, 64 nt, Homo Sapiens; identical to SEQ ID NO: 27713

SEQ ID NO: 700974 - RNA, 64 nt, Homo Sapiens; identical to SEQ ID NO: 27714

SEQ ID NO: 700975 - RNA, 64 nt, Homo Sapiens; identical to SEQ ID NO: 27715

SEQ ID NO: 700976 - RNA, 64 nt, Homo Sapiens; identical to SEQ ID NO: 27716

SEQ ID NO: 700977 - RNA, 64 nt, Homo Sapiens; identical to SEQ ID NO: 27717

SEQ ID NO: 700978 - RNA, 64 nt, Homo Sapiens; identical to SEQ ID NO: 27718

SEQ ID NO: 700979 - RNA, 64 nt, Homo Sapiens; identical to SEQ ID NO: 27719

SEQ ID NO: 700980 - RNA, 64 nt, Homo Sapiens; identical to SEQ ID NO: 27720

SEQ ID NO: 700981 - RNA, 64 nt, Homo Sapiens; identical to SEQ ID NO: 27721

SEQ ID NO: 700982 - RNA, 64 nt, Homo Sapiens; identical to SEQ ID NO: 27722

SEQ ID NO: 700983 - RNA, 64 nt, Homo Sapiens; identical to SEQ ID NO: 27723

SEQ ID NO: 700984 - RNA, 64 nt, Homo Sapiens; identical to SEQ ID NO: 27724

SEQ ID NO: 700985 - RNA, 64 nt, Homo Sapiens; identical to SEQ ID NO: 27725

SEQ ID NO: 700986 - RNA, 64 nt, Homo Sapiens; identical to SEQ ID NO: 27726

SEQ ID NO: 700987 - RNA, 64 nt, Homo Sapiens; identical to SEQ ID NO: 27727

SEQ ID NO: 700988 - RNA, 64 nt, Homo Sapiens; identical to SEQ ID NO: 27728

SEQ ID NO: 700989 - RNA, 64 nt, Homo Sapiens; identical to SEQ ID NO: 27729

SEQ ID NO: 700990 - RNA, 64 nt, Homo Sapiens; identical to SEQ ID NO: 27730

SEQ ID NO: 700991 - RNA, 64 nt, Homo Sapiens; identical to SEQ ID NO: 27731

SEQ ID NO: 700992 - RNA, 64 nt, Homo Sapiens; identical to SEQ ID NO: 27732

SEQ ID NO: 700993 - RNA, 64 nt, Homo Sapiens; identical to SEQ ID NO: 27733

SEQ ID NO: 700994 - RNA, 64 nt, Homo Sapiens; identical to SEQ ID NO: 27734

SEQ ID NO: 700995 - RNA, 64 nt, Homo Sapiens; identical to SEQ ID NO: 27735

SEQ ID NO: 700996 - RNA, 64 nt, Homo Sapiens; identical to SEQ ID NO: 27736

SEQ ID NO: 700997 - RNA, 64 nt, Homo Sapiens; identical to SEQ ID NO: 27737

SEQ ID NO: 700998 - RNA, 64 nt, Homo Sapiens; identical to SEQ ID NO: 27738

SEQ ID NO: 700999 - RNA, 64 nt, Homo Sapiens; identical to SEQ ID NO: 27739

SEQ ID NO: 701000 - RNA, 64 nt, Homo Sapiens; identical to SEQ ID NO: 27740

SEQ ID NO: 701001 - RNA, 64 nt, Homo Sapiens; identical to SEQ ID NO: 27741

SEQ ID NO: 701002 - RNA, 64 nt, Homo Sapiens; identical to SEQ ID NO: 27742

SEQ ID NO: 701003 - RNA, 64 nt, Homo Sapiens; identical to SEQ ID NO: 27743

SEQ ID NO: 701004 - RNA, 64 nt, Homo Sapiens; identical to SEQ ID NO: 27744

SEQ ID NO: 701005 - RNA, 64 nt, Homo Sapiens; identical to SEQ ID NO: 27745

SEQ ID NO: 701006 - RNA, 64 nt, Homo Sapiens; identical to SEQ ID NO: 27746

SEQ ID NO: 701007 - RNA, 64 nt, Homo Sapiens; identical to SEQ ID NO: 27747

SEQ ID NO: 701008 - RNA, 64 nt, Homo Sapiens; identical to SEQ ID NO: 27748

SEQ ID NO: 701009 - RNA, 64 nt, Homo Sapiens; identical to SEQ ID NO: 27749

SEQ ID NO: 701010 - RNA, 64 nt, Homo Sapiens; identical to SEQ ID NO: 27750

SEQ ID NO: 701011 - RNA, 64 nt, Homo Sapiens; identical to SEQ ID NO: 27751

SEQ ID NO: 701012 - RNA, 64 nt, Homo Sapiens; identical to SEQ ID NO: 27752

SEQ ID NO: 701013 - RNA, 64 nt, Homo Sapiens; identical to SEQ ID NO: 27753

SEQ ID NO: 701014 - RNA, 64 nt, Homo Sapiens; identical to SEQ ID NO: 27754

SEQ ID NO: 701015 - RNA, 64 nt, Homo Sapiens; identical to SEQ ID NO: 27755

SEQ ID NO: 701016 - RNA, 64 nt, Homo Sapiens; identical to SEQ ID NO: 27756

SEQ ID NO: 701017 - RNA, 64 nt, Homo Sapiens; identical to SEQ ID NO: 27757

SEQ ID NO: 701018 - RNA, 64 nt, Homo Sapiens; identical to SEQ ID NO: 27758

SEQ ID NO: 701019 - RNA, 64 nt, Homo Sapiens; identical to SEQ ID NO: 27759

SEQ ID NO: 701020 - RNA, 64 nt, Homo Sapiens; identical to SEQ ID NO: 27760

SEQ ID NO: 701021 - RNA, 64 nt, Homo Sapiens; identical to SEQ ID NO: 27761

SEQ ID NO: 701022 - RNA, 64 nt, Homo Sapiens; identical to SEQ ID NO: 27762

SEQ ID NO: 701023 - RNA, 64 nt, Homo Sapiens; identical to SEQ ID NO: 27763

SEQ ID NO: 701024 - RNA, 64 nt, Homo Sapiens; identical to SEQ ID NO: 27764

SEQ ID NO: 701025 - RNA, 64 nt, Homo Sapiens; identical to SEQ ID NO: 27765

SEQ ID NO: 701026 - RNA, 64 nt, Homo Sapiens; identical to SEQ ID NO: 27766

SEQ ID NO: 701027 - RNA, 64 nt, Homo Sapiens; identical to SEQ ID NO: 27767

SEQ ID NO: 701028 - RNA, 64 nt, Homo Sapiens; identical to SEQ ID NO: 27768

SEQ ID NO: 701029 - RNA, 64 nt, Homo Sapiens; identical to SEQ ID NO: 27769

SEQ ID NO: 701030 - RNA, 64 nt, Homo Sapiens; identical to SEQ ID NO: 27770

SEQ ID NO: 701031 - RNA, 64 nt, Homo Sapiens; identical to SEQ ID NO: 27771

SEQ ID NO: 701032 - RNA, 64 nt, Homo Sapiens; identical to SEQ ID NO: 27772

SEQ ID NO: 701033 - RNA, 64 nt, Homo Sapiens; identical to SEQ ID NO: 27773

SEQ ID NO: 701034 - RNA, 64 nt, Homo Sapiens; identical to SEQ ID NO: 27774

SEQ ID NO: 701035 - RNA, 64 nt, Homo Sapiens; identical to SEQ ID NO: 27775

SEQ ID NO: 701036 - RNA, 64 nt, Homo Sapiens; identical to SEQ ID NO: 27776

SEQ ID NO: 701037 - RNA, 64 nt, Homo Sapiens; identical to SEQ ID NO: 27777

SEQ ID NO: 701038 - RNA, 64 nt, Homo Sapiens; identical to SEQ ID NO: 27778

SEQ ID NO: 701039 - RNA, 64 nt, Homo Sapiens; identical to SEQ ID NO: 27779

SEQ ID NO: 701040 - RNA, 64 nt, Homo Sapiens; identical to SEQ ID NO: 27780

SEQ ID NO: 701041 - RNA, 64 nt, Homo Sapiens; identical to SEQ ID NO: 27781

SEQ ID NO: 701042 - RNA, 64 nt, Homo Sapiens; identical to SEQ ID NO: 27782

SEQ ID NO: 701043 - RNA, 64 nt, Homo Sapiens; identical to SEQ ID NO: 27783

SEQ ID NO: 701044 - RNA, 64 nt, Homo Sapiens; identical to SEQ ID NO: 27784

SEQ ID NO: 701045 - RNA, 64 nt, Homo Sapiens; identical to SEQ ID NO: 27785

SEQ ID NO: 701046 - RNA, 64 nt, Homo Sapiens; identical to SEQ ID NO: 27786

SEQ ID NO: 701047 - RNA, 64 nt, Homo Sapiens; identical to SEQ ID NO: 27787

SEQ ID NO: 701048 - RNA, 64 nt, Homo Sapiens; identical to SEQ ID NO: 27788

SEQ ID NO: 701049 - RNA, 64 nt, Homo Sapiens; identical to SEQ ID NO: 27789

SEQ ID NO: 701050 - RNA, 64 nt, Homo Sapiens; identical to SEQ ID NO: 27790

SEQ ID NO: 701051 - RNA, 64 nt, Homo Sapiens; identical to SEQ ID NO: 27791

SEQ ID NO: 701052 - RNA, 64 nt, Homo Sapiens; identical to SEQ ID NO: 27792

SEQ ID NO: 701053 - RNA, 64 nt, Homo Sapiens; identical to SEQ ID NO: 27793

SEQ ID NO: 701054 - RNA, 64 nt, Homo Sapiens; identical to SEQ ID NO: 27794

SEQ ID NO: 701055 - RNA, 64 nt, Homo Sapiens; identical to SEQ ID NO: 27795

SEQ ID NO: 701056 - RNA, 64 nt, Homo Sapiens; identical to SEQ ID NO: 27796

SEQ ID NO: 701057 - RNA, 64 nt, Homo Sapiens; identical to SEQ ID NO: 27797

SEQ ID NO: 701058 - RNA, 64 nt, Homo Sapiens; identical to SEQ ID NO: 27798

SEQ ID NO: 701059 - RNA, 64 nt, Homo Sapiens; identical to SEQ ID NO: 27799

SEQ ID NO: 701060 - RNA, 64 nt, Homo Sapiens; identical to SEQ ID NO: 27800

SEQ ID NO: 701061 - RNA, 64 nt, Homo Sapiens; identical to SEQ ID NO: 27801

SEQ ID NO: 701062 - RNA, 64 nt, Homo Sapiens; identical to SEQ ID NO: 27802

SEQ ID NO: 701063 - RNA, 64 nt, Homo Sapiens; identical to SEQ ID NO: 27803

SEQ ID NO: 701064 - RNA, 64 nt, Homo Sapiens; identical to SEQ ID NO: 27804

SEQ ID NO: 701065 - RNA, 64 nt, Homo Sapiens; identical to SEQ ID NO: 27805

SEQ ID NO: 701066 - RNA, 64 nt, Homo Sapiens; identical to SEQ ID NO: 27806

SEQ ID NO: 701067 - RNA, 64 nt, Homo Sapiens; identical to SEQ ID NO: 27807

SEQ ID NO: 701068 - RNA, 64 nt, Homo Sapiens; identical to SEQ ID NO: 27808

SEQ ID NO: 701069 - RNA, 64 nt, Homo Sapiens; identical to SEQ ID NO: 27809

SEQ ID NO: 701070 - RNA, 64 nt, Homo Sapiens; identical to SEQ ID NO: 27810

SEQ ID NO: 701071 - RNA, 64 nt, Homo Sapiens; identical to SEQ ID NO: 27811

SEQ ID NO: 701072 - RNA, 64 nt, Homo Sapiens; identical to SEQ ID NO: 27812

SEQ ID NO: 701073 - RNA, 64 nt, Homo Sapiens; identical to SEQ ID NO: 27813

SEQ ID NO: 701074 - RNA, 64 nt, Homo Sapiens; identical to SEQ ID NO: 27814

SEQ ID NO: 701075 - RNA, 64 nt, Homo Sapiens; identical to SEQ ID NO: 27815

SEQ ID NO: 701076 - RNA, 64 nt, Homo Sapiens; identical to SEQ ID NO: 27816

SEQ ID NO: 701077 - RNA, 64 nt, Homo Sapiens; identical to SEQ ID NO: 27817

SEQ ID NO: 701078 - RNA, 64 nt, Homo Sapiens; identical to SEQ ID NO: 27818

SEQ ID NO: 701079 - RNA, 64 nt, Homo Sapiens; identical to SEQ ID NO: 27819

SEQ ID NO: 701080 - RNA, 64 nt, Homo Sapiens; identical to SEQ ID NO: 27820

SEQ ID NO: 701081 - RNA, 64 nt, Homo Sapiens; identical to SEQ ID NO: 27821

SEQ ID NO: 701082 - RNA, 64 nt, Homo Sapiens; identical to SEQ ID NO: 27822

SEQ ID NO: 701083 - RNA, 64 nt, Homo Sapiens; identical to SEQ ID NO: 27823

SEQ ID NO: 701084 - RNA, 64 nt, Homo Sapiens; identical to SEQ ID NO: 27824

SEQ ID NO: 701085 - RNA, 64 nt, Homo Sapiens; identical to SEQ ID NO: 27825

SEQ ID NO: 701086 - RNA, 64 nt, Homo Sapiens; identical to SEQ ID NO: 27826

SEQ ID NO: 701087 - RNA, 64 nt, Homo Sapiens; identical to SEQ ID NO: 27827

SEQ ID NO: 701088 - RNA, 64 nt, Homo Sapiens; identical to SEQ ID NO: 27828

SEQ ID NO: 701089 - RNA, 64 nt, Homo Sapiens; identical to SEQ ID NO: 27829

SEQ ID NO: 701090 - RNA, 64 nt, Homo Sapiens; identical to SEQ ID NO: 27830

SEQ ID NO: 701091 - RNA, 64 nt, Homo Sapiens; identical to SEQ ID NO: 27831

SEQ ID NO: 701092 - RNA, 64 nt, Homo Sapiens; identical to SEQ ID NO: 27832

SEQ ID NO: 701093 - RNA, 64 nt, Homo Sapiens; identical to SEQ ID NO: 27833

SEQ ID NO: 701094 - RNA, 64 nt, Homo Sapiens; identical to SEQ ID NO: 27834

SEQ ID NO: 701095 - RNA, 64 nt, Homo Sapiens; identical to SEQ ID NO: 27835

SEQ ID NO: 701096 - RNA, 64 nt, Homo Sapiens; identical to SEQ ID NO: 27836

SEQ ID NO: 701097 - RNA, 64 nt, Homo Sapiens; identical to SEQ ID NO: 27837

SEQ ID NO: 701098 - RNA, 64 nt, Homo Sapiens; identical to SEQ ID NO: 27838

SEQ ID NO: 701099 - RNA, 64 nt, Homo Sapiens; identical to SEQ ID NO: 27839

SEQ ID NO: 701100 - RNA, 64 nt, Homo Sapiens; identical to SEQ ID NO: 27840

SEQ ID NO: 701101 - RNA, 64 nt, Homo Sapiens; identical to SEQ ID NO: 27841

SEQ ID NO: 701102 - RNA, 64 nt, Homo Sapiens; identical to SEQ ID NO: 27842

SEQ ID NO: 701103 - RNA, 64 nt, Homo Sapiens; identical to SEQ ID NO: 27843

SEQ ID NO: 701104 - RNA, 64 nt, Homo Sapiens; identical to SEQ ID NO: 27844

SEQ ID NO: 701105 - RNA, 64 nt, Homo Sapiens; identical to SEQ ID NO: 27845

SEQ ID NO: 701106 - RNA, 64 nt, Homo Sapiens; identical to SEQ ID NO: 27846

SEQ ID NO: 701107 - RNA, 64 nt, Homo Sapiens; identical to SEQ ID NO: 27847

SEQ ID NO: 701108 - RNA, 64 nt, Homo Sapiens; identical to SEQ ID NO: 27848

SEQ ID NO: 701109 - RNA, 64 nt, Homo Sapiens; identical to SEQ ID NO: 27849

SEQ ID NO: 701110 - RNA, 64 nt, Homo Sapiens; identical to SEQ ID NO: 27850

SEQ ID NO: 701111 - RNA, 64 nt, Homo Sapiens; identical to SEQ ID NO: 27851

SEQ ID NO: 701112 - RNA, 64 nt, Homo Sapiens; identical to SEQ ID NO: 27852

SEQ ID NO: 701113 - RNA, 64 nt, Homo Sapiens; identical to SEQ ID NO: 27853

SEQ ID NO: 701114 - RNA, 64 nt, Homo Sapiens; identical to SEQ ID NO: 27854

SEQ ID NO: 701115 - RNA, 64 nt, Homo Sapiens; identical to SEQ ID NO: 27855

SEQ ID NO: 701116 - RNA, 64 nt, Homo Sapiens; identical to SEQ ID NO: 27856

SEQ ID NO: 701117 - RNA, 64 nt, Homo Sapiens; identical to SEQ ID NO: 27857

SEQ ID NO: 701118 - RNA, 64 nt, Homo Sapiens; identical to SEQ ID NO: 27858

SEQ ID NO: 701119 - RNA, 64 nt, Homo Sapiens; identical to SEQ ID NO: 27859

SEQ ID NO: 701120 - RNA, 64 nt, Homo Sapiens; identical to SEQ ID NO: 27860

SEQ ID NO: 701121 - RNA, 64 nt, Homo Sapiens; identical to SEQ ID NO: 27861

SEQ ID NO: 701122 - RNA, 64 nt, Homo Sapiens; identical to SEQ ID NO: 27862

SEQ ID NO: 701123 - RNA, 64 nt, Homo Sapiens; identical to SEQ ID NO: 27863

SEQ ID NO: 701124 - RNA, 64 nt, Homo Sapiens; identical to SEQ ID NO: 27864

SEQ ID NO: 701125 - RNA, 64 nt, Homo Sapiens; identical to SEQ ID NO: 27865

SEQ ID NO: 701126 - RNA, 64 nt, Homo Sapiens; identical to SEQ ID NO: 27866

SEQ ID NO: 701127 - RNA, 64 nt, Homo Sapiens; identical to SEQ ID NO: 27867

SEQ ID NO: 701128 - RNA, 64 nt, Homo Sapiens; identical to SEQ ID NO: 27868

SEQ ID NO: 701129 - RNA, 64 nt, Homo Sapiens; identical to SEQ ID NO: 27869

SEQ ID NO: 701130 - RNA, 64 nt, Homo Sapiens; identical to SEQ ID NO: 27870

SEQ ID NO: 701131 - RNA, 64 nt, Homo Sapiens; identical to SEQ ID NO: 27871

SEQ ID NO: 701132 - RNA, 64 nt, Homo Sapiens; identical to SEQ ID NO: 27872

SEQ ID NO: 701133 - RNA, 64 nt, Homo Sapiens; identical to SEQ ID NO: 27873

SEQ ID NO: 701134 - RNA, 64 nt, Homo Sapiens; identical to SEQ ID NO: 27874

SEQ ID NO: 701135 - RNA, 64 nt, Homo Sapiens; identical to SEQ ID NO: 27875

SEQ ID NO: 701136 - RNA, 64 nt, Homo Sapiens; identical to SEQ ID NO: 27876

SEQ ID NO: 701137 - RNA, 64 nt, Homo Sapiens; identical to SEQ ID NO: 27877

SEQ ID NO: 701138 - RNA, 64 nt, Homo Sapiens; identical to SEQ ID NO: 27878

SEQ ID NO: 701139 - RNA, 64 nt, Homo Sapiens; identical to SEQ ID NO: 27879

SEQ ID NO: 701140 - RNA, 64 nt, Homo Sapiens; identical to SEQ ID NO: 27880

SEQ ID NO: 701141 - RNA, 64 nt, Homo Sapiens; identical to SEQ ID NO: 27881

SEQ ID NO: 701142 - RNA, 64 nt, Homo Sapiens; identical to SEQ ID NO: 27882

SEQ ID NO: 701143 - RNA, 64 nt, Homo Sapiens; identical to SEQ ID NO: 27883

SEQ ID NO: 701144 - RNA, 64 nt, Homo Sapiens; identical to SEQ ID NO: 27884

SEQ ID NO: 701145 - RNA, 64 nt, Homo Sapiens; identical to SEQ ID NO: 27885

SEQ ID NO: 701146 - RNA, 64 nt, Homo Sapiens; identical to SEQ ID NO: 27886

SEQ ID NO: 701147 - RNA, 64 nt, Homo Sapiens; identical to SEQ ID NO: 27887

SEQ ID NO: 701148 - RNA, 64 nt, Homo Sapiens; identical to SEQ ID NO: 27888

SEQ ID NO: 701149 - RNA, 64 nt, Homo Sapiens; identical to SEQ ID NO: 27889

SEQ ID NO: 701150 - RNA, 64 nt, Homo Sapiens; identical to SEQ ID NO: 27890

SEQ ID NO: 701151 - RNA, 64 nt, Homo Sapiens; identical to SEQ ID NO: 27891

SEQ ID NO: 701152 - RNA, 64 nt, Homo Sapiens; identical to SEQ ID NO: 27892

SEQ ID NO: 701153 - RNA, 64 nt, Homo Sapiens; identical to SEQ ID NO: 27893

SEQ ID NO: 701154 - RNA, 64 nt, Homo Sapiens; identical to SEQ ID NO: 27894

SEQ ID NO: 701155 - RNA, 64 nt, Homo Sapiens; identical to SEQ ID NO: 27895

SEQ ID NO: 701156 - RNA, 64 nt, Homo Sapiens; identical to SEQ ID NO: 27896

SEQ ID NO: 701157 - RNA, 64 nt, Homo Sapiens; identical to SEQ ID NO: 27897

SEQ ID NO: 701158 - RNA, 64 nt, Homo Sapiens; identical to SEQ ID NO: 27898

SEQ ID NO: 701159 - RNA, 64 nt, Homo Sapiens; identical to SEQ ID NO: 27899

SEQ ID NO: 701160 - RNA, 55 nt, Homo Sapiens; identical to SEQ ID NO: 27900

SEQ ID NO: 701161 - RNA, 54 nt, Homo Sapiens; identical to SEQ ID NO: 27901

SEQ ID NO: 701162 - RNA, 53 nt, Homo Sapiens; identical to SEQ ID NO: 27902

SEQ ID NO: 701163 - RNA, 52 nt, Homo Sapiens; identical to SEQ ID NO: 27903

SEQ ID NO: 701164 - RNA, 51 nt, Homo Sapiens; identical to SEQ ID NO: 27904

SEQ ID NO: 701165 - RNA, 50 nt, Homo Sapiens; identical to SEQ ID NO: 27905

SEQ ID NO: 701166 - RNA, 64 nt, Homo Sapiens; identical to SEQ ID NO: 27906

SEQ ID NO: 701167 - RNA, 64 nt, Homo Sapiens; identical to SEQ ID NO: 27907

SEQ ID NO: 701168 - RNA, 64 nt, Homo Sapiens; identical to SEQ ID NO: 27908

SEQ ID NO: 701169 - RNA, 64 nt, Homo Sapiens; identical to SEQ ID NO: 27909

SEQ ID NO: 701170 - RNA, 64 nt, Homo Sapiens; identical to SEQ ID NO: 27910

SEQ ID NO: 701171 - RNA, 64 nt, Homo Sapiens; identical to SEQ ID NO: 27911

SEQ ID NO: 701172 - RNA, 64 nt, Homo Sapiens; identical to SEQ ID NO: 27912

SEQ ID NO: 701173 - RNA, 64 nt, Homo Sapiens; identical to SEQ ID NO: 27913

SEQ ID NO: 701174 - RNA, 64 nt, Homo Sapiens; identical to SEQ ID NO: 27914

SEQ ID NO: 701175 - RNA, 64 nt, Homo Sapiens; identical to SEQ ID NO: 27915

SEQ ID NO: 701176 - RNA, 64 nt, Homo Sapiens; identical to SEQ ID NO: 27916

SEQ ID NO: 701177 - RNA, 64 nt, Homo Sapiens; identical to SEQ ID NO: 27917

SEQ ID NO: 701178 - RNA, 64 nt, Homo Sapiens; identical to SEQ ID NO: 27918

SEQ ID NO: 701179 - RNA, 64 nt, Homo Sapiens; identical to SEQ ID NO: 27919

SEQ ID NO: 701180 - RNA, 64 nt, Homo Sapiens; identical to SEQ ID NO: 27920

SEQ ID NO: 701181 - RNA, 64 nt, Homo Sapiens; identical to SEQ ID NO: 27921

SEQ ID NO: 701182 - RNA, 64 nt, Homo Sapiens; identical to SEQ ID NO: 27922

SEQ ID NO: 701183 - RNA, 64 nt, Homo Sapiens; identical to SEQ ID NO: 27923

SEQ ID NO: 701184 - RNA, 64 nt, Homo Sapiens; identical to SEQ ID NO: 27924

SEQ ID NO: 701185 - RNA, 64 nt, Homo Sapiens; identical to SEQ ID NO: 27925

SEQ ID NO: 701186 - RNA, 64 nt, Homo Sapiens; identical to SEQ ID NO: 27926

SEQ ID NO: 701187 - RNA, 64 nt, Homo Sapiens; identical to SEQ ID NO: 27927

SEQ ID NO: 701188 - RNA, 64 nt, Homo Sapiens; identical to SEQ ID NO: 27928

SEQ ID NO: 701189 - RNA, 64 nt, Homo Sapiens; identical to SEQ ID NO: 27929

SEQ ID NO: 701190 - RNA, 64 nt, Homo Sapiens; identical to SEQ ID NO: 27930

SEQ ID NO: 701191 - RNA, 64 nt, Homo Sapiens; identical to SEQ ID NO: 27931

SEQ ID NO: 701192 - RNA, 64 nt, Homo Sapiens; identical to SEQ ID NO: 27932

SEQ ID NO: 701193 - RNA, 64 nt, Homo Sapiens; identical to SEQ ID NO: 27933

SEQ ID NO: 701194 - RNA, 64 nt, Homo Sapiens; identical to SEQ ID NO: 27934

SEQ ID NO: 701195 - RNA, 64 nt, Homo Sapiens; identical to SEQ ID NO: 27935

SEQ ID NO: 701196 - RNA, 64 nt, Homo Sapiens; identical to SEQ ID NO: 27936

SEQ ID NO: 701197 - RNA, 64 nt, Homo Sapiens; identical to SEQ ID NO: 27937

SEQ ID NO: 701198 - RNA, 64 nt, Homo Sapiens; identical to SEQ ID NO: 27938

SEQ ID NO: 701199 - RNA, 64 nt, Homo Sapiens; identical to SEQ ID NO: 27939

SEQ ID NO: 701200 - RNA, 64 nt, Homo Sapiens; identical to SEQ ID NO: 27940

SEQ ID NO: 701201 - RNA, 64 nt, Homo Sapiens; identical to SEQ ID NO: 27941

SEQ ID NO: 701202 - RNA, 64 nt, Homo Sapiens; identical to SEQ ID NO: 27942

SEQ ID NO: 701203 - RNA, 64 nt, Homo Sapiens; identical to SEQ ID NO: 27943

SEQ ID NO: 701204 - RNA, 64 nt, Homo Sapiens; identical to SEQ ID NO: 27944

SEQ ID NO: 701205 - RNA, 64 nt, Homo Sapiens; identical to SEQ ID NO: 27945

SEQ ID NO: 701206 - RNA, 64 nt, Homo Sapiens; identical to SEQ ID NO: 27946

SEQ ID NO: 701207 - RNA, 64 nt, Homo Sapiens; identical to SEQ ID NO: 27947

SEQ ID NO: 701208 - RNA, 64 nt, Homo Sapiens; identical to SEQ ID NO: 27948

SEQ ID NO: 701209 - RNA, 64 nt, Homo Sapiens; identical to SEQ ID NO: 27949

SEQ ID NO: 701210 - RNA, 64 nt, Homo Sapiens; identical to SEQ ID NO: 27950

SEQ ID NO: 701211 - RNA, 64 nt, Homo Sapiens; identical to SEQ ID NO: 27951

SEQ ID NO: 701212 - RNA, 64 nt, Homo Sapiens; identical to SEQ ID NO: 27952

SEQ ID NO: 701213 - RNA, 64 nt, Homo Sapiens; identical to SEQ ID NO: 27953

SEQ ID NO: 701214 - RNA, 64 nt, Homo Sapiens; identical to SEQ ID NO: 27954

SEQ ID NO: 701215 - RNA, 64 nt, Homo Sapiens; identical to SEQ ID NO: 27955

SEQ ID NO: 701216 - RNA, 64 nt, Homo Sapiens; identical to SEQ ID NO: 27956

SEQ ID NO: 701217 - RNA, 64 nt, Homo Sapiens; identical to SEQ ID NO: 27957

SEQ ID NO: 701218 - RNA, 64 nt, Homo Sapiens; identical to SEQ ID NO: 27958

SEQ ID NO: 701219 - RNA, 64 nt, Homo Sapiens; identical to SEQ ID NO: 27959

SEQ ID NO: 701220 - RNA, 64 nt, Homo Sapiens; identical to SEQ ID NO: 27960

SEQ ID NO: 701221 - RNA, 64 nt, Homo Sapiens; identical to SEQ ID NO: 27961

SEQ ID NO: 701222 - RNA, 64 nt, Homo Sapiens; identical to SEQ ID NO: 27962

SEQ ID NO: 701223 - RNA, 64 nt, Homo Sapiens; identical to SEQ ID NO: 27963

SEQ ID NO: 701224 - RNA, 64 nt, Homo Sapiens; identical to SEQ ID NO: 27964

SEQ ID NO: 701225 - RNA, 64 nt, Homo Sapiens; identical to SEQ ID NO: 27965

SEQ ID NO: 701226 - RNA, 64 nt, Homo Sapiens; identical to SEQ ID NO: 27966

SEQ ID NO: 701227 - RNA, 64 nt, Homo Sapiens; identical to SEQ ID NO: 27967

SEQ ID NO: 701228 - RNA, 64 nt, Homo Sapiens; identical to SEQ ID NO: 27968

SEQ ID NO: 701229 - RNA, 64 nt, Homo Sapiens; identical to SEQ ID NO: 27969

SEQ ID NO: 701230 - RNA, 64 nt, Homo Sapiens; identical to SEQ ID NO: 27970

SEQ ID NO: 701231 - RNA, 64 nt, Homo Sapiens; identical to SEQ ID NO: 27971

SEQ ID NO: 701232 - RNA, 64 nt, Homo Sapiens; identical to SEQ ID NO: 27972

SEQ ID NO: 701233 - RNA, 64 nt, Homo Sapiens; identical to SEQ ID NO: 27973

SEQ ID NO: 701234 - RNA, 64 nt, Homo Sapiens; identical to SEQ ID NO: 27974

SEQ ID NO: 701235 - RNA, 64 nt, Homo Sapiens; identical to SEQ ID NO: 27975

SEQ ID NO: 701236 - RNA, 64 nt, Homo Sapiens; identical to SEQ ID NO: 27976

SEQ ID NO: 701237 - RNA, 64 nt, Homo Sapiens; identical to SEQ ID NO: 27977

SEQ ID NO: 701238 - RNA, 64 nt, Homo Sapiens; identical to SEQ ID NO: 27978

SEQ ID NO: 701239 - RNA, 64 nt, Homo Sapiens; identical to SEQ ID NO: 27979

SEQ ID NO: 701240 - RNA, 64 nt, Homo Sapiens; identical to SEQ ID NO: 27980

SEQ ID NO: 701241 - RNA, 64 nt, Homo Sapiens; identical to SEQ ID NO: 27981

SEQ ID NO: 701242 - RNA, 64 nt, Homo Sapiens; identical to SEQ ID NO: 27982

SEQ ID NO: 701243 - RNA, 64 nt, Homo Sapiens; identical to SEQ ID NO: 27983

SEQ ID NO: 701244 - RNA, 64 nt, Homo Sapiens; identical to SEQ ID NO: 27984

SEQ ID NO: 701245 - RNA, 64 nt, Homo Sapiens; identical to SEQ ID NO: 27985

SEQ ID NO: 701246 - RNA, 64 nt, Homo Sapiens; identical to SEQ ID NO: 27986

SEQ ID NO: 701247 - RNA, 64 nt, Homo Sapiens; identical to SEQ ID NO: 27987

SEQ ID NO: 701248 - RNA, 64 nt, Homo Sapiens; identical to SEQ ID NO: 27988

SEQ ID NO: 701249 - RNA, 64 nt, Homo Sapiens; identical to SEQ ID NO: 27989

SEQ ID NO: 701250 - RNA, 64 nt, Homo Sapiens; identical to SEQ ID NO: 27990

SEQ ID NO: 701251 - RNA, 64 nt, Homo Sapiens; identical to SEQ ID NO: 27991

SEQ ID NO: 701252 - RNA, 64 nt, Homo Sapiens; identical to SEQ ID NO: 27992

SEQ ID NO: 701253 - RNA, 64 nt, Homo Sapiens; identical to SEQ ID NO: 27993

SEQ ID NO: 701254 - RNA, 64 nt, Homo Sapiens; identical to SEQ ID NO: 27994

SEQ ID NO: 701255 - RNA, 64 nt, Homo Sapiens; identical to SEQ ID NO: 27995

SEQ ID NO: 701256 - RNA, 64 nt, Homo Sapiens; identical to SEQ ID NO: 27996

SEQ ID NO: 701257 - RNA, 64 nt, Homo Sapiens; identical to SEQ ID NO: 27997

SEQ ID NO: 701258 - RNA, 64 nt, Homo Sapiens; identical to SEQ ID NO: 27998

SEQ ID NO: 701259 - RNA, 64 nt, Homo Sapiens; identical to SEQ ID NO: 27999

SEQ ID NO: 701260 - RNA, 64 nt, Homo Sapiens; identical to SEQ ID NO: 28000

SEQ ID NO: 701261 - RNA, 64 nt, Homo Sapiens; identical to SEQ ID NO: 28001

SEQ ID NO: 701262 - RNA, 64 nt, Homo Sapiens; identical to SEQ ID NO: 28002

SEQ ID NO: 701263 - RNA, 64 nt, Homo Sapiens; identical to SEQ ID NO: 28003

SEQ ID NO: 701264 - RNA, 64 nt, Homo Sapiens; identical to SEQ ID NO: 28004

SEQ ID NO: 701265 - RNA, 64 nt, Homo Sapiens; identical to SEQ ID NO: 28005

SEQ ID NO: 701266 - RNA, 64 nt, Homo Sapiens; identical to SEQ ID NO: 28006

SEQ ID NO: 701267 - RNA, 64 nt, Homo Sapiens; identical to SEQ ID NO: 28007

SEQ ID NO: 701268 - RNA, 64 nt, Homo Sapiens; identical to SEQ ID NO: 28008

SEQ ID NO: 701269 - RNA, 64 nt, Homo Sapiens; identical to SEQ ID NO: 28009

SEQ ID NO: 701270 - RNA, 64 nt, Homo Sapiens; identical to SEQ ID NO: 28010

SEQ ID NO: 701271 - RNA, 64 nt, Homo Sapiens; identical to SEQ ID NO: 28011

SEQ ID NO: 701272 - RNA, 64 nt, Homo Sapiens; identical to SEQ ID NO: 28012

SEQ ID NO: 701273 - RNA, 64 nt, Homo Sapiens; identical to SEQ ID NO: 28013

SEQ ID NO: 701274 - RNA, 64 nt, Homo Sapiens; identical to SEQ ID NO: 28014

SEQ ID NO: 701275 - RNA, 64 nt, Homo Sapiens; identical to SEQ ID NO: 28015

SEQ ID NO: 701276 - RNA, 64 nt, Homo Sapiens; identical to SEQ ID NO: 28016

SEQ ID NO: 701277 - RNA, 64 nt, Homo Sapiens; identical to SEQ ID NO: 28017

SEQ ID NO: 701278 - RNA, 64 nt, Homo Sapiens; identical to SEQ ID NO: 28018

SEQ ID NO: 701279 - RNA, 64 nt, Homo Sapiens; identical to SEQ ID NO: 28019

SEQ ID NO: 701280 - RNA, 64 nt, Homo Sapiens; identical to SEQ ID NO: 28020

SEQ ID NO: 701281 - RNA, 64 nt, Homo Sapiens; identical to SEQ ID NO: 28021

SEQ ID NO: 701282 - RNA, 64 nt, Homo Sapiens; identical to SEQ ID NO: 28022

SEQ ID NO: 701283 - RNA, 64 nt, Homo Sapiens; identical to SEQ ID NO: 28023

SEQ ID NO: 701284 - RNA, 64 nt, Homo Sapiens; identical to SEQ ID NO: 28024

SEQ ID NO: 701285 - RNA, 64 nt, Homo Sapiens; identical to SEQ ID NO: 28025

SEQ ID NO: 701286 - RNA, 64 nt, Homo Sapiens; identical to SEQ ID NO: 28026

SEQ ID NO: 701287 - RNA, 64 nt, Homo Sapiens; identical to SEQ ID NO: 28027

SEQ ID NO: 701288 - RNA, 64 nt, Homo Sapiens; identical to SEQ ID NO: 28028

SEQ ID NO: 701289 - RNA, 64 nt, Homo Sapiens; identical to SEQ ID NO: 28029

SEQ ID NO: 701290 - RNA, 64 nt, Homo Sapiens; identical to SEQ ID NO: 28030

SEQ ID NO: 701291 - RNA, 64 nt, Homo Sapiens; identical to SEQ ID NO: 28031

SEQ ID NO: 701292 - RNA, 64 nt, Homo Sapiens; identical to SEQ ID NO: 28032

SEQ ID NO: 701293 - RNA, 64 nt, Homo Sapiens; identical to SEQ ID NO: 28033

SEQ ID NO: 701294 - RNA, 64 nt, Homo Sapiens; identical to SEQ ID NO: 28034

SEQ ID NO: 701295 - RNA, 64 nt, Homo Sapiens; identical to SEQ ID NO: 28035

SEQ ID NO: 701296 - RNA, 64 nt, Homo Sapiens; identical to SEQ ID NO: 28036

SEQ ID NO: 701297 - RNA, 64 nt, Homo Sapiens; identical to SEQ ID NO: 28037

SEQ ID NO: 701298 - RNA, 64 nt, Homo Sapiens; identical to SEQ ID NO: 28038

SEQ ID NO: 701299 - RNA, 64 nt, Homo Sapiens; identical to SEQ ID NO: 28039

SEQ ID NO: 701300 - RNA, 64 nt, Homo Sapiens; identical to SEQ ID NO: 28040

SEQ ID NO: 701301 - RNA, 64 nt, Homo Sapiens; identical to SEQ ID NO: 28041

SEQ ID NO: 701302 - RNA, 64 nt, Homo Sapiens; identical to SEQ ID NO: 28042

SEQ ID NO: 701303 - RNA, 64 nt, Homo Sapiens; identical to SEQ ID NO: 28043

SEQ ID NO: 701304 - RNA, 64 nt, Homo Sapiens; identical to SEQ ID NO: 28044

SEQ ID NO: 701305 - RNA, 64 nt, Homo Sapiens; identical to SEQ ID NO: 28045

SEQ ID NO: 701306 - RNA, 64 nt, Homo Sapiens; identical to SEQ ID NO: 28046

SEQ ID NO: 701307 - RNA, 64 nt, Homo Sapiens; identical to SEQ ID NO: 28047

SEQ ID NO: 701308 - RNA, 64 nt, Homo Sapiens; identical to SEQ ID NO: 28048

SEQ ID NO: 701309 - RNA, 64 nt, Homo Sapiens; identical to SEQ ID NO: 28049

SEQ ID NO: 701310 - RNA, 64 nt, Homo Sapiens; identical to SEQ ID NO: 28050

SEQ ID NO: 701311 - RNA, 64 nt, Homo Sapiens; identical to SEQ ID NO: 28051

SEQ ID NO: 701312 - RNA, 64 nt, Homo Sapiens; identical to SEQ ID NO: 28052

SEQ ID NO: 701313 - RNA, 64 nt, Homo Sapiens; identical to SEQ ID NO: 28053

SEQ ID NO: 701314 - RNA, 64 nt, Homo Sapiens; identical to SEQ ID NO: 28054

SEQ ID NO: 701315 - RNA, 64 nt, Homo Sapiens; identical to SEQ ID NO: 28055

SEQ ID NO: 701316 - RNA, 64 nt, Homo Sapiens; identical to SEQ ID NO: 28056

SEQ ID NO: 701317 - RNA, 64 nt, Homo Sapiens; identical to SEQ ID NO: 28057

SEQ ID NO: 701318 - RNA, 64 nt, Homo Sapiens; identical to SEQ ID NO: 28058

SEQ ID NO: 701319 - RNA, 64 nt, Homo Sapiens; identical to SEQ ID NO: 28059

SEQ ID NO: 701320 - RNA, 64 nt, Homo Sapiens; identical to SEQ ID NO: 28060

SEQ ID NO: 701321 - RNA, 64 nt, Homo Sapiens; identical to SEQ ID NO: 28061

SEQ ID NO: 701322 - RNA, 64 nt, Homo Sapiens; identical to SEQ ID NO: 28062

SEQ ID NO: 701323 - RNA, 64 nt, Homo Sapiens; identical to SEQ ID NO: 28063

SEQ ID NO: 701324 - RNA, 64 nt, Homo Sapiens; identical to SEQ ID NO: 28064

SEQ ID NO: 701325 - RNA, 64 nt, Homo Sapiens; identical to SEQ ID NO: 28065

SEQ ID NO: 701326 - RNA, 64 nt, Homo Sapiens; identical to SEQ ID NO: 28066

SEQ ID NO: 701327 - RNA, 64 nt, Homo Sapiens; identical to SEQ ID NO: 28067

SEQ ID NO: 701328 - RNA, 64 nt, Homo Sapiens; identical to SEQ ID NO: 28068

SEQ ID NO: 701329 - RNA, 64 nt, Homo Sapiens; identical to SEQ ID NO: 28069

SEQ ID NO: 701330 - RNA, 64 nt, Homo Sapiens; identical to SEQ ID NO: 28070

SEQ ID NO: 701331 - RNA, 64 nt, Homo Sapiens; identical to SEQ ID NO: 28071

SEQ ID NO: 701332 - RNA, 64 nt, Homo Sapiens; identical to SEQ ID NO: 28072

SEQ ID NO: 701333 - RNA, 64 nt, Homo Sapiens; identical to SEQ ID NO: 28073

SEQ ID NO: 701334 - RNA, 64 nt, Homo Sapiens; identical to SEQ ID NO: 28074

SEQ ID NO: 701335 - RNA, 64 nt, Homo Sapiens; identical to SEQ ID NO: 28075

SEQ ID NO: 701336 - RNA, 64 nt, Homo Sapiens; identical to SEQ ID NO: 28076

SEQ ID NO: 701337 - RNA, 64 nt, Homo Sapiens; identical to SEQ ID NO: 28077

SEQ ID NO: 701338 - RNA, 64 nt, Homo Sapiens; identical to SEQ ID NO: 28078

SEQ ID NO: 701339 - RNA, 64 nt, Homo Sapiens; identical to SEQ ID NO: 28079

SEQ ID NO: 701340 - RNA, 64 nt, Homo Sapiens; identical to SEQ ID NO: 28080

SEQ ID NO: 701341 - RNA, 64 nt, Homo Sapiens; identical to SEQ ID NO: 28081

SEQ ID NO: 701342 - RNA, 64 nt, Homo Sapiens; identical to SEQ ID NO: 28082

SEQ ID NO: 701343 - RNA, 64 nt, Homo Sapiens; identical to SEQ ID NO: 28083

SEQ ID NO: 701344 - RNA, 64 nt, Homo Sapiens; identical to SEQ ID NO: 28084

SEQ ID NO: 701345 - RNA, 64 nt, Homo Sapiens; identical to SEQ ID NO: 28085

SEQ ID NO: 701346 - RNA, 64 nt, Homo Sapiens; identical to SEQ ID NO: 28086

SEQ ID NO: 701347 - RNA, 64 nt, Homo Sapiens; identical to SEQ ID NO: 28087

SEQ ID NO: 701348 - RNA, 64 nt, Homo Sapiens; identical to SEQ ID NO: 28088

SEQ ID NO: 701349 - RNA, 64 nt, Homo Sapiens; identical to SEQ ID NO: 28089

SEQ ID NO: 701350 - RNA, 64 nt, Homo Sapiens; identical to SEQ ID NO: 28090

SEQ ID NO: 701351 - RNA, 64 nt, Homo Sapiens; identical to SEQ ID NO: 28091

SEQ ID NO: 701352 - RNA, 64 nt, Homo Sapiens; identical to SEQ ID NO: 28092

SEQ ID NO: 701353 - RNA, 64 nt, Homo Sapiens; identical to SEQ ID NO: 28093

SEQ ID NO: 701354 - RNA, 64 nt, Homo Sapiens; identical to SEQ ID NO: 28094

SEQ ID NO: 701355 - RNA, 64 nt, Homo Sapiens; identical to SEQ ID NO: 28095

SEQ ID NO: 701356 - RNA, 64 nt, Homo Sapiens; identical to SEQ ID NO: 28096

SEQ ID NO: 701357 - RNA, 64 nt, Homo Sapiens; identical to SEQ ID NO: 28097

SEQ ID NO: 701358 - RNA, 64 nt, Homo Sapiens; identical to SEQ ID NO: 28098

SEQ ID NO: 701359 - RNA, 64 nt, Homo Sapiens; identical to SEQ ID NO: 28099

SEQ ID NO: 701360 - RNA, 64 nt, Homo Sapiens; identical to SEQ ID NO: 28100

SEQ ID NO: 701361 - RNA, 64 nt, Homo Sapiens; identical to SEQ ID NO: 28101

SEQ ID NO: 701362 - RNA, 64 nt, Homo Sapiens; identical to SEQ ID NO: 28102

SEQ ID NO: 701363 - RNA, 64 nt, Homo Sapiens; identical to SEQ ID NO: 28103

SEQ ID NO: 701364 - RNA, 64 nt, Homo Sapiens; identical to SEQ ID NO: 28104

SEQ ID NO: 701365 - RNA, 64 nt, Homo Sapiens; identical to SEQ ID NO: 28105

SEQ ID NO: 701366 - RNA, 64 nt, Homo Sapiens; identical to SEQ ID NO: 28106

SEQ ID NO: 701367 - RNA, 64 nt, Homo Sapiens; identical to SEQ ID NO: 28107

SEQ ID NO: 701368 - RNA, 64 nt, Homo Sapiens; identical to SEQ ID NO: 28108

SEQ ID NO: 701369 - RNA, 64 nt, Homo Sapiens; identical to SEQ ID NO: 28109

SEQ ID NO: 701370 - RNA, 64 nt, Homo Sapiens; identical to SEQ ID NO: 28110

SEQ ID NO: 701371 - RNA, 64 nt, Homo Sapiens; identical to SEQ ID NO: 28111

SEQ ID NO: 701372 - RNA, 64 nt, Homo Sapiens; identical to SEQ ID NO: 28112

SEQ ID NO: 701373 - RNA, 64 nt, Homo Sapiens; identical to SEQ ID NO: 28113

SEQ ID NO: 701374 - RNA, 64 nt, Homo Sapiens; identical to SEQ ID NO: 28114

SEQ ID NO: 701375 - RNA, 64 nt, Homo Sapiens; identical to SEQ ID NO: 28115

SEQ ID NO: 701376 - RNA, 64 nt, Homo Sapiens; identical to SEQ ID NO: 28116

SEQ ID NO: 701377 - RNA, 64 nt, Homo Sapiens; identical to SEQ ID NO: 28117

SEQ ID NO: 701378 - RNA, 64 nt, Homo Sapiens; identical to SEQ ID NO: 28118

SEQ ID NO: 701379 - RNA, 64 nt, Homo Sapiens; identical to SEQ ID NO: 28119

SEQ ID NO: 701380 - RNA, 64 nt, Homo Sapiens; identical to SEQ ID NO: 28120

SEQ ID NO: 701381 - RNA, 64 nt, Homo Sapiens; identical to SEQ ID NO: 28121

SEQ ID NO: 701382 - RNA, 64 nt, Homo Sapiens; identical to SEQ ID NO: 28122

SEQ ID NO: 701383 - RNA, 64 nt, Homo Sapiens; identical to SEQ ID NO: 28123

SEQ ID NO: 701384 - RNA, 64 nt, Homo Sapiens; identical to SEQ ID NO: 28124

SEQ ID NO: 701385 - RNA, 64 nt, Homo Sapiens; identical to SEQ ID NO: 28125

SEQ ID NO: 701386 - RNA, 64 nt, Homo Sapiens; identical to SEQ ID NO: 28126

SEQ ID NO: 701387 - RNA, 64 nt, Homo Sapiens; identical to SEQ ID NO: 28127

SEQ ID NO: 701388 - RNA, 64 nt, Homo Sapiens; identical to SEQ ID NO: 28128

SEQ ID NO: 701389 - RNA, 64 nt, Homo Sapiens; identical to SEQ ID NO: 28129

SEQ ID NO: 701390 - RNA, 64 nt, Homo Sapiens; identical to SEQ ID NO: 28130

SEQ ID NO: 701391 - RNA, 64 nt, Homo Sapiens; identical to SEQ ID NO: 28131

SEQ ID NO: 701392 - RNA, 64 nt, Homo Sapiens; identical to SEQ ID NO: 28132

SEQ ID NO: 701393 - RNA, 64 nt, Homo Sapiens; identical to SEQ ID NO: 28133

SEQ ID NO: 701394 - RNA, 64 nt, Homo Sapiens; identical to SEQ ID NO: 28134

SEQ ID NO: 701395 - RNA, 64 nt, Homo Sapiens; identical to SEQ ID NO: 28135

SEQ ID NO: 701396 - RNA, 64 nt, Homo Sapiens; identical to SEQ ID NO: 28136

SEQ ID NO: 701397 - RNA, 64 nt, Homo Sapiens; identical to SEQ ID NO: 28137

SEQ ID NO: 701398 - RNA, 64 nt, Homo Sapiens; identical to SEQ ID NO: 28138

SEQ ID NO: 701399 - RNA, 64 nt, Homo Sapiens; identical to SEQ ID NO: 28139

SEQ ID NO: 701400 - RNA, 64 nt, Homo Sapiens; identical to SEQ ID NO: 28140

SEQ ID NO: 701401 - RNA, 64 nt, Homo Sapiens; identical to SEQ ID NO: 28141

SEQ ID NO: 701402 - RNA, 64 nt, Homo Sapiens; identical to SEQ ID NO: 28142

SEQ ID NO: 701403 - RNA, 64 nt, Homo Sapiens; identical to SEQ ID NO: 28143

SEQ ID NO: 701404 - RNA, 64 nt, Homo Sapiens; identical to SEQ ID NO: 28144

SEQ ID NO: 701405 - RNA, 64 nt, Homo Sapiens; identical to SEQ ID NO: 28145

SEQ ID NO: 701406 - RNA, 64 nt, Homo Sapiens; identical to SEQ ID NO: 28146

SEQ ID NO: 701407 - RNA, 64 nt, Homo Sapiens; identical to SEQ ID NO: 28147

SEQ ID NO: 701408 - RNA, 64 nt, Homo Sapiens; identical to SEQ ID NO: 28148

SEQ ID NO: 701409 - RNA, 64 nt, Homo Sapiens; identical to SEQ ID NO: 28149

SEQ ID NO: 701410 - RNA, 64 nt, Homo Sapiens; identical to SEQ ID NO: 28150

SEQ ID NO: 701411 - RNA, 64 nt, Homo Sapiens; identical to SEQ ID NO: 28151

SEQ ID NO: 701412 - RNA, 64 nt, Homo Sapiens; identical to SEQ ID NO: 28152

SEQ ID NO: 701413 - RNA, 64 nt, Homo Sapiens; identical to SEQ ID NO: 28153

SEQ ID NO: 701414 - RNA, 64 nt, Homo Sapiens; identical to SEQ ID NO: 28154

SEQ ID NO: 701415 - RNA, 64 nt, Homo Sapiens; identical to SEQ ID NO: 28155

SEQ ID NO: 701416 - RNA, 64 nt, Homo Sapiens; identical to SEQ ID NO: 28156

SEQ ID NO: 701417 - RNA, 64 nt, Homo Sapiens; identical to SEQ ID NO: 28157

SEQ ID NO: 701418 - RNA, 64 nt, Homo Sapiens; identical to SEQ ID NO: 28158

SEQ ID NO: 701419 - RNA, 64 nt, Homo Sapiens; identical to SEQ ID NO: 28159

SEQ ID NO: 701420 - RNA, 64 nt, Homo Sapiens; identical to SEQ ID NO: 28160

SEQ ID NO: 701421 - RNA, 64 nt, Homo Sapiens; identical to SEQ ID NO: 28161

SEQ ID NO: 701422 - RNA, 64 nt, Homo Sapiens; identical to SEQ ID NO: 28162

SEQ ID NO: 701423 - RNA, 64 nt, Homo Sapiens; identical to SEQ ID NO: 28163

SEQ ID NO: 701424 - RNA, 64 nt, Homo Sapiens; identical to SEQ ID NO: 28164

SEQ ID NO: 701425 - RNA, 64 nt, Homo Sapiens; identical to SEQ ID NO: 28165

SEQ ID NO: 701426 - RNA, 64 nt, Homo Sapiens; identical to SEQ ID NO: 28166

SEQ ID NO: 701427 - RNA, 64 nt, Homo Sapiens; identical to SEQ ID NO: 28167

SEQ ID NO: 701428 - RNA, 64 nt, Homo Sapiens; identical to SEQ ID NO: 28168

SEQ ID NO: 701429 - RNA, 64 nt, Homo Sapiens; identical to SEQ ID NO: 28169

SEQ ID NO: 701430 - RNA, 64 nt, Homo Sapiens; identical to SEQ ID NO: 28170

SEQ ID NO: 701431 - RNA, 64 nt, Homo Sapiens; identical to SEQ ID NO: 28171

SEQ ID NO: 701432 - RNA, 64 nt, Homo Sapiens; identical to SEQ ID NO: 28172

SEQ ID NO: 701433 - RNA, 64 nt, Homo Sapiens; identical to SEQ ID NO: 28173

SEQ ID NO: 701434 - RNA, 64 nt, Homo Sapiens; identical to SEQ ID NO: 28174

SEQ ID NO: 701435 - RNA, 64 nt, Homo Sapiens; identical to SEQ ID NO: 28175

SEQ ID NO: 701436 - RNA, 64 nt, Homo Sapiens; identical to SEQ ID NO: 28176

SEQ ID NO: 701437 - RNA, 64 nt, Homo Sapiens; identical to SEQ ID NO: 28177

SEQ ID NO: 701438 - RNA, 64 nt, Homo Sapiens; identical to SEQ ID NO: 28178

SEQ ID NO: 701439 - RNA, 64 nt, Homo Sapiens; identical to SEQ ID NO: 28179

SEQ ID NO: 701440 - RNA, 64 nt, Homo Sapiens; identical to SEQ ID NO: 28180

SEQ ID NO: 701441 - RNA, 64 nt, Homo Sapiens; identical to SEQ ID NO: 28181

SEQ ID NO: 701442 - RNA, 64 nt, Homo Sapiens; identical to SEQ ID NO: 28182

SEQ ID NO: 701443 - RNA, 64 nt, Homo Sapiens; identical to SEQ ID NO: 28183

SEQ ID NO: 701444 - RNA, 64 nt, Homo Sapiens; identical to SEQ ID NO: 28184

SEQ ID NO: 701445 - RNA, 64 nt, Homo Sapiens; identical to SEQ ID NO: 28185

SEQ ID NO: 701446 - RNA, 64 nt, Homo Sapiens; identical to SEQ ID NO: 28186

SEQ ID NO: 701447 - RNA, 64 nt, Homo Sapiens; identical to SEQ ID NO: 28187

SEQ ID NO: 701448 - RNA, 64 nt, Homo Sapiens; identical to SEQ ID NO: 28188

SEQ ID NO: 701449 - RNA, 64 nt, Homo Sapiens; identical to SEQ ID NO: 28189

SEQ ID NO: 701450 - RNA, 64 nt, Homo Sapiens; identical to SEQ ID NO: 28190

SEQ ID NO: 701451 - RNA, 64 nt, Homo Sapiens; identical to SEQ ID NO: 28191

SEQ ID NO: 701452 - RNA, 64 nt, Homo Sapiens; identical to SEQ ID NO: 28192

SEQ ID NO: 701453 - RNA, 64 nt, Homo Sapiens; identical to SEQ ID NO: 28193

SEQ ID NO: 701454 - RNA, 64 nt, Homo Sapiens; identical to SEQ ID NO: 28194

SEQ ID NO: 701455 - RNA, 64 nt, Homo Sapiens; identical to SEQ ID NO: 28195

SEQ ID NO: 701456 - RNA, 64 nt, Homo Sapiens; identical to SEQ ID NO: 28196

SEQ ID NO: 701457 - RNA, 64 nt, Homo Sapiens; identical to SEQ ID NO: 28197

SEQ ID NO: 701458 - RNA, 64 nt, Homo Sapiens; identical to SEQ ID NO: 28198

SEQ ID NO: 701459 - RNA, 64 nt, Homo Sapiens; identical to SEQ ID NO: 28199

SEQ ID NO: 701460 - RNA, 64 nt, Homo Sapiens; identical to SEQ ID NO: 28200

SEQ ID NO: 701461 - RNA, 64 nt, Homo Sapiens; identical to SEQ ID NO: 28201

SEQ ID NO: 701462 - RNA, 64 nt, Homo Sapiens; identical to SEQ ID NO: 28202

SEQ ID NO: 701463 - RNA, 64 nt, Homo Sapiens; identical to SEQ ID NO: 28203

SEQ ID NO: 701464 - RNA, 64 nt, Homo Sapiens; identical to SEQ ID NO: 28204

SEQ ID NO: 701465 - RNA, 64 nt, Homo Sapiens; identical to SEQ ID NO: 28205

SEQ ID NO: 701466 - RNA, 64 nt, Homo Sapiens; identical to SEQ ID NO: 28206

SEQ ID NO: 701467 - RNA, 64 nt, Homo Sapiens; identical to SEQ ID NO: 28207

SEQ ID NO: 701468 - RNA, 64 nt, Homo Sapiens; identical to SEQ ID NO: 28208

SEQ ID NO: 701469 - RNA, 64 nt, Homo Sapiens; identical to SEQ ID NO: 28209

SEQ ID NO: 701470 - RNA, 64 nt, Homo Sapiens; identical to SEQ ID NO: 28210

SEQ ID NO: 701471 - RNA, 64 nt, Homo Sapiens; identical to SEQ ID NO: 28211

SEQ ID NO: 701472 - RNA, 64 nt, Homo Sapiens; identical to SEQ ID NO: 28212

SEQ ID NO: 701473 - RNA, 64 nt, Homo Sapiens; identical to SEQ ID NO: 28213

SEQ ID NO: 701474 - RNA, 64 nt, Homo Sapiens; identical to SEQ ID NO: 28214

SEQ ID NO: 701475 - RNA, 64 nt, Homo Sapiens; identical to SEQ ID NO: 28215

SEQ ID NO: 701476 - RNA, 64 nt, Homo Sapiens; identical to SEQ ID NO: 28216

SEQ ID NO: 701477 - RNA, 64 nt, Homo Sapiens; identical to SEQ ID NO: 28217

SEQ ID NO: 701478 - RNA, 64 nt, Homo Sapiens; identical to SEQ ID NO: 28218

SEQ ID NO: 701479 - RNA, 64 nt, Homo Sapiens; identical to SEQ ID NO: 28219

SEQ ID NO: 701480 - RNA, 64 nt, Homo Sapiens; identical to SEQ ID NO: 28220

SEQ ID NO: 701481 - RNA, 64 nt, Homo Sapiens; identical to SEQ ID NO: 28221

SEQ ID NO: 701482 - RNA, 64 nt, Homo Sapiens; identical to SEQ ID NO: 28222

SEQ ID NO: 701483 - RNA, 64 nt, Homo Sapiens; identical to SEQ ID NO: 28223

SEQ ID NO: 701484 - RNA, 64 nt, Homo Sapiens; identical to SEQ ID NO: 28224

SEQ ID NO: 701485 - RNA, 64 nt, Homo Sapiens; identical to SEQ ID NO: 28225

SEQ ID NO: 701486 - RNA, 64 nt, Homo Sapiens; identical to SEQ ID NO: 28226

SEQ ID NO: 701487 - RNA, 64 nt, Homo Sapiens; identical to SEQ ID NO: 28227

SEQ ID NO: 701488 - RNA, 64 nt, Homo Sapiens; identical to SEQ ID NO: 28228

SEQ ID NO: 701489 - RNA, 64 nt, Homo Sapiens; identical to SEQ ID NO: 28229

SEQ ID NO: 701490 - RNA, 64 nt, Homo Sapiens; identical to SEQ ID NO: 28230

SEQ ID NO: 701491 - RNA, 64 nt, Homo Sapiens; identical to SEQ ID NO: 28231

SEQ ID NO: 701492 - RNA, 64 nt, Homo Sapiens; identical to SEQ ID NO: 28232

SEQ ID NO: 701493 - RNA, 64 nt, Homo Sapiens; identical to SEQ ID NO: 28233

SEQ ID NO: 701494 - RNA, 64 nt, Homo Sapiens; identical to SEQ ID NO: 28234

SEQ ID NO: 701495 - RNA, 64 nt, Homo Sapiens; identical to SEQ ID NO: 28235

SEQ ID NO: 701496 - RNA, 64 nt, Homo Sapiens; identical to SEQ ID NO: 28236

SEQ ID NO: 701497 - RNA, 64 nt, Homo Sapiens; identical to SEQ ID NO: 28237

SEQ ID NO: 701498 - RNA, 64 nt, Homo Sapiens; identical to SEQ ID NO: 28238

SEQ ID NO: 701499 - RNA, 64 nt, Homo Sapiens; identical to SEQ ID NO: 28239

SEQ ID NO: 701500 - RNA, 64 nt, Homo Sapiens; identical to SEQ ID NO: 28240

SEQ ID NO: 701501 - RNA, 64 nt, Homo Sapiens; identical to SEQ ID NO: 28241

SEQ ID NO: 701502 - RNA, 64 nt, Homo Sapiens; identical to SEQ ID NO: 28242

SEQ ID NO: 701503 - RNA, 64 nt, Homo Sapiens; identical to SEQ ID NO: 28243

SEQ ID NO: 701504 - RNA, 64 nt, Homo Sapiens; identical to SEQ ID NO: 28244

SEQ ID NO: 701505 - RNA, 64 nt, Homo Sapiens; identical to SEQ ID NO: 28245

SEQ ID NO: 701506 - RNA, 64 nt, Homo Sapiens; identical to SEQ ID NO: 28246

SEQ ID NO: 701507 - RNA, 64 nt, Homo Sapiens; identical to SEQ ID NO: 28247

SEQ ID NO: 701508 - RNA, 64 nt, Homo Sapiens; identical to SEQ ID NO: 28248

SEQ ID NO: 701509 - RNA, 64 nt, Homo Sapiens; identical to SEQ ID NO: 28249

SEQ ID NO: 701510 - RNA, 64 nt, Homo Sapiens; identical to SEQ ID NO: 28250

SEQ ID NO: 701511 - RNA, 64 nt, Homo Sapiens; identical to SEQ ID NO: 28251

SEQ ID NO: 701512 - RNA, 64 nt, Homo Sapiens; identical to SEQ ID NO: 28252

SEQ ID NO: 701513 - RNA, 64 nt, Homo Sapiens; identical to SEQ ID NO: 28253

SEQ ID NO: 701514 - RNA, 64 nt, Homo Sapiens; identical to SEQ ID NO: 28254

SEQ ID NO: 701515 - RNA, 64 nt, Homo Sapiens; identical to SEQ ID NO: 28255

SEQ ID NO: 701516 - RNA, 64 nt, Homo Sapiens; identical to SEQ ID NO: 28256

SEQ ID NO: 701517 - RNA, 64 nt, Homo Sapiens; identical to SEQ ID NO: 28257

SEQ ID NO: 701518 - RNA, 64 nt, Homo Sapiens; identical to SEQ ID NO: 28258

SEQ ID NO: 701519 - RNA, 64 nt, Homo Sapiens; identical to SEQ ID NO: 28259

SEQ ID NO: 701520 - RNA, 64 nt, Homo Sapiens; identical to SEQ ID NO: 28260

SEQ ID NO: 701521 - RNA, 64 nt, Homo Sapiens; identical to SEQ ID NO: 28261

SEQ ID NO: 701522 - RNA, 64 nt, Homo Sapiens; identical to SEQ ID NO: 28262

SEQ ID NO: 701523 - RNA, 64 nt, Homo Sapiens; identical to SEQ ID NO: 28263

SEQ ID NO: 701524 - RNA, 64 nt, Homo Sapiens; identical to SEQ ID NO: 28264

SEQ ID NO: 701525 - RNA, 64 nt, Homo Sapiens; identical to SEQ ID NO: 28265

SEQ ID NO: 701526 - RNA, 64 nt, Homo Sapiens; identical to SEQ ID NO: 28266

SEQ ID NO: 701527 - RNA, 64 nt, Homo Sapiens; identical to SEQ ID NO: 28267

SEQ ID NO: 701528 - RNA, 64 nt, Homo Sapiens; identical to SEQ ID NO: 28268

SEQ ID NO: 701529 - RNA, 64 nt, Homo Sapiens; identical to SEQ ID NO: 28269

SEQ ID NO: 701530 - RNA, 64 nt, Homo Sapiens; identical to SEQ ID NO: 28270

SEQ ID NO: 701531 - RNA, 64 nt, Homo Sapiens; identical to SEQ ID NO: 28271

SEQ ID NO: 701532 - RNA, 64 nt, Homo Sapiens; identical to SEQ ID NO: 28272

SEQ ID NO: 701533 - RNA, 64 nt, Homo Sapiens; identical to SEQ ID NO: 28273

SEQ ID NO: 701534 - RNA, 64 nt, Homo Sapiens; identical to SEQ ID NO: 28274

SEQ ID NO: 701535 - RNA, 64 nt, Homo Sapiens; identical to SEQ ID NO: 28275

SEQ ID NO: 701536 - RNA, 64 nt, Homo Sapiens; identical to SEQ ID NO: 28276

SEQ ID NO: 701537 - RNA, 64 nt, Homo Sapiens; identical to SEQ ID NO: 28277

SEQ ID NO: 701538 - RNA, 64 nt, Homo Sapiens; identical to SEQ ID NO: 28278

SEQ ID NO: 701539 - RNA, 64 nt, Homo Sapiens; identical to SEQ ID NO: 28279

SEQ ID NO: 701540 - RNA, 64 nt, Homo Sapiens; identical to SEQ ID NO: 28280

SEQ ID NO: 701541 - RNA, 64 nt, Homo Sapiens; identical to SEQ ID NO: 28281

SEQ ID NO: 701542 - RNA, 64 nt, Homo Sapiens; identical to SEQ ID NO: 28282

SEQ ID NO: 701543 - RNA, 64 nt, Homo Sapiens; identical to SEQ ID NO: 28283

SEQ ID NO: 701544 - RNA, 64 nt, Homo Sapiens; identical to SEQ ID NO: 28284

SEQ ID NO: 701545 - RNA, 64 nt, Homo Sapiens; identical to SEQ ID NO: 28285

SEQ ID NO: 701546 - RNA, 64 nt, Homo Sapiens; identical to SEQ ID NO: 28286

SEQ ID NO: 701547 - RNA, 64 nt, Homo Sapiens; identical to SEQ ID NO: 28287

SEQ ID NO: 701548 - RNA, 64 nt, Homo Sapiens; identical to SEQ ID NO: 28288

SEQ ID NO: 701549 - RNA, 64 nt, Homo Sapiens; identical to SEQ ID NO: 28289

SEQ ID NO: 701550 - RNA, 64 nt, Homo Sapiens; identical to SEQ ID NO: 28290

SEQ ID NO: 701551 - RNA, 64 nt, Homo Sapiens; identical to SEQ ID NO: 28291

SEQ ID NO: 701552 - RNA, 64 nt, Homo Sapiens; identical to SEQ ID NO: 28292

SEQ ID NO: 701553 - RNA, 64 nt, Homo Sapiens; identical to SEQ ID NO: 28293

SEQ ID NO: 701554 - RNA, 64 nt, Homo Sapiens; identical to SEQ ID NO: 28294

SEQ ID NO: 701555 - RNA, 64 nt, Homo Sapiens; identical to SEQ ID NO: 28295

SEQ ID NO: 701556 - RNA, 64 nt, Homo Sapiens; identical to SEQ ID NO: 28296

SEQ ID NO: 701557 - RNA, 64 nt, Homo Sapiens; identical to SEQ ID NO: 28297

SEQ ID NO: 701558 - RNA, 64 nt, Homo Sapiens; identical to SEQ ID NO: 28298

SEQ ID NO: 701559 - RNA, 64 nt, Homo Sapiens; identical to SEQ ID NO: 28299

SEQ ID NO: 701560 - RNA, 64 nt, Homo Sapiens; identical to SEQ ID NO: 28300

SEQ ID NO: 701561 - RNA, 64 nt, Homo Sapiens; identical to SEQ ID NO: 28301

SEQ ID NO: 701562 - RNA, 64 nt, Homo Sapiens; identical to SEQ ID NO: 28302

SEQ ID NO: 701563 - RNA, 64 nt, Homo Sapiens; identical to SEQ ID NO: 28303

SEQ ID NO: 701564 - RNA, 64 nt, Homo Sapiens; identical to SEQ ID NO: 28304

SEQ ID NO: 701565 - RNA, 64 nt, Homo Sapiens; identical to SEQ ID NO: 28305

SEQ ID NO: 701566 - RNA, 64 nt, Homo Sapiens; identical to SEQ ID NO: 28306

SEQ ID NO: 701567 - RNA, 64 nt, Homo Sapiens; identical to SEQ ID NO: 28307

SEQ ID NO: 701568 - RNA, 64 nt, Homo Sapiens; identical to SEQ ID NO: 28308

SEQ ID NO: 701569 - RNA, 64 nt, Homo Sapiens; identical to SEQ ID NO: 28309

SEQ ID NO: 701570 - RNA, 64 nt, Homo Sapiens; identical to SEQ ID NO: 28310

SEQ ID NO: 701571 - RNA, 64 nt, Homo Sapiens; identical to SEQ ID NO: 28311

SEQ ID NO: 701572 - RNA, 64 nt, Homo Sapiens; identical to SEQ ID NO: 28312

SEQ ID NO: 701573 - RNA, 64 nt, Homo Sapiens; identical to SEQ ID NO: 28313

SEQ ID NO: 701574 - RNA, 64 nt, Homo Sapiens; identical to SEQ ID NO: 28314

SEQ ID NO: 701575 - RNA, 64 nt, Homo Sapiens; identical to SEQ ID NO: 28315

SEQ ID NO: 701576 - RNA, 64 nt, Homo Sapiens; identical to SEQ ID NO: 28316

SEQ ID NO: 701577 - RNA, 64 nt, Homo Sapiens; identical to SEQ ID NO: 28317

SEQ ID NO: 701578 - RNA, 64 nt, Homo Sapiens; identical to SEQ ID NO: 28318

SEQ ID NO: 701579 - RNA, 64 nt, Homo Sapiens; identical to SEQ ID NO: 28319

SEQ ID NO: 701580 - RNA, 64 nt, Homo Sapiens; identical to SEQ ID NO: 28320

SEQ ID NO: 701581 - RNA, 64 nt, Homo Sapiens; identical to SEQ ID NO: 28321

SEQ ID NO: 701582 - RNA, 64 nt, Homo Sapiens; identical to SEQ ID NO: 28322

SEQ ID NO: 701583 - RNA, 64 nt, Homo Sapiens; identical to SEQ ID NO: 28323

SEQ ID NO: 701584 - RNA, 64 nt, Homo Sapiens; identical to SEQ ID NO: 28324

SEQ ID NO: 701585 - RNA, 64 nt, Homo Sapiens; identical to SEQ ID NO: 28325

SEQ ID NO: 701586 - RNA, 64 nt, Homo Sapiens; identical to SEQ ID NO: 28326

SEQ ID NO: 701587 - RNA, 64 nt, Homo Sapiens; identical to SEQ ID NO: 28327

SEQ ID NO: 701588 - RNA, 64 nt, Homo Sapiens; identical to SEQ ID NO: 28328

SEQ ID NO: 701589 - RNA, 64 nt, Homo Sapiens; identical to SEQ ID NO: 28329

SEQ ID NO: 701590 - RNA, 64 nt, Homo Sapiens; identical to SEQ ID NO: 28330

SEQ ID NO: 701591 - RNA, 64 nt, Homo Sapiens; identical to SEQ ID NO: 28331

SEQ ID NO: 701592 - RNA, 64 nt, Homo Sapiens; identical to SEQ ID NO: 28332

SEQ ID NO: 701593 - RNA, 64 nt, Homo Sapiens; identical to SEQ ID NO: 28333

SEQ ID NO: 701594 - RNA, 64 nt, Homo Sapiens; identical to SEQ ID NO: 28334

SEQ ID NO: 701595 - RNA, 64 nt, Homo Sapiens; identical to SEQ ID NO: 28335

SEQ ID NO: 701596 - RNA, 64 nt, Homo Sapiens; identical to SEQ ID NO: 28336

SEQ ID NO: 701597 - RNA, 64 nt, Homo Sapiens; identical to SEQ ID NO: 28337

SEQ ID NO: 701598 - RNA, 64 nt, Homo Sapiens; identical to SEQ ID NO: 28338

SEQ ID NO: 701599 - RNA, 64 nt, Homo Sapiens; identical to SEQ ID NO: 28339

SEQ ID NO: 701600 - RNA, 64 nt, Homo Sapiens; identical to SEQ ID NO: 28340

SEQ ID NO: 701601 - RNA, 64 nt, Homo Sapiens; identical to SEQ ID NO: 28341

SEQ ID NO: 701602 - RNA, 64 nt, Homo Sapiens; identical to SEQ ID NO: 28342

SEQ ID NO: 701603 - RNA, 64 nt, Homo Sapiens; identical to SEQ ID NO: 28343

SEQ ID NO: 701604 - RNA, 64 nt, Homo Sapiens; identical to SEQ ID NO: 28344

SEQ ID NO: 701605 - RNA, 64 nt, Homo Sapiens; identical to SEQ ID NO: 28345

SEQ ID NO: 701606 - RNA, 64 nt, Homo Sapiens; identical to SEQ ID NO: 28346

SEQ ID NO: 701607 - RNA, 64 nt, Homo Sapiens; identical to SEQ ID NO: 28347

SEQ ID NO: 701608 - RNA, 64 nt, Homo Sapiens; identical to SEQ ID NO: 28348

SEQ ID NO: 701609 - RNA, 64 nt, Homo Sapiens; identical to SEQ ID NO: 28349

SEQ ID NO: 701610 - RNA, 64 nt, Homo Sapiens; identical to SEQ ID NO: 28350

SEQ ID NO: 701611 - RNA, 64 nt, Homo Sapiens; identical to SEQ ID NO: 28351

SEQ ID NO: 701612 - RNA, 64 nt, Homo Sapiens; identical to SEQ ID NO: 28352

SEQ ID NO: 701613 - RNA, 64 nt, Homo Sapiens; identical to SEQ ID NO: 28353

SEQ ID NO: 701614 - RNA, 64 nt, Homo Sapiens; identical to SEQ ID NO: 28354

SEQ ID NO: 701615 - RNA, 64 nt, Homo Sapiens; identical to SEQ ID NO: 28355

SEQ ID NO: 701616 - RNA, 64 nt, Homo Sapiens; identical to SEQ ID NO: 28356

SEQ ID NO: 701617 - RNA, 64 nt, Homo Sapiens; identical to SEQ ID NO: 28357

SEQ ID NO: 701618 - RNA, 64 nt, Homo Sapiens; identical to SEQ ID NO: 28358

SEQ ID NO: 701619 - RNA, 64 nt, Homo Sapiens; identical to SEQ ID NO: 28359

SEQ ID NO: 701620 - RNA, 64 nt, Homo Sapiens; identical to SEQ ID NO: 28360

SEQ ID NO: 701621 - RNA, 64 nt, Homo Sapiens; identical to SEQ ID NO: 28361

SEQ ID NO: 701622 - RNA, 64 nt, Homo Sapiens; identical to SEQ ID NO: 28362

SEQ ID NO: 701623 - RNA, 64 nt, Homo Sapiens; identical to SEQ ID NO: 28363

SEQ ID NO: 701624 - RNA, 64 nt, Homo Sapiens; identical to SEQ ID NO: 28364

SEQ ID NO: 701625 - RNA, 64 nt, Homo Sapiens; identical to SEQ ID NO: 28365

SEQ ID NO: 701626 - RNA, 64 nt, Homo Sapiens; identical to SEQ ID NO: 28366

SEQ ID NO: 701627 - RNA, 64 nt, Homo Sapiens; identical to SEQ ID NO: 28367

SEQ ID NO: 701628 - RNA, 64 nt, Homo Sapiens; identical to SEQ ID NO: 28368

SEQ ID NO: 701629 - RNA, 64 nt, Homo Sapiens; identical to SEQ ID NO: 28369

SEQ ID NO: 701630 - RNA, 64 nt, Homo Sapiens; identical to SEQ ID NO: 28370

SEQ ID NO: 701631 - RNA, 64 nt, Homo Sapiens; identical to SEQ ID NO: 28371

SEQ ID NO: 701632 - RNA, 64 nt, Homo Sapiens; identical to SEQ ID NO: 28372

SEQ ID NO: 701633 - RNA, 64 nt, Homo Sapiens; identical to SEQ ID NO: 28373

SEQ ID NO: 701634 - RNA, 64 nt, Homo Sapiens; identical to SEQ ID NO: 28374

SEQ ID NO: 701635 - RNA, 64 nt, Homo Sapiens; identical to SEQ ID NO: 28375

SEQ ID NO: 701636 - RNA, 64 nt, Homo Sapiens; identical to SEQ ID NO: 28376

SEQ ID NO: 701637 - RNA, 64 nt, Homo Sapiens; identical to SEQ ID NO: 28377

SEQ ID NO: 701638 - RNA, 64 nt, Homo Sapiens; identical to SEQ ID NO: 28378

SEQ ID NO: 701639 - RNA, 64 nt, Homo Sapiens; identical to SEQ ID NO: 28379

SEQ ID NO: 701640 - RNA, 64 nt, Homo Sapiens; identical to SEQ ID NO: 28380

SEQ ID NO: 701641 - RNA, 64 nt, Homo Sapiens; identical to SEQ ID NO: 28381

SEQ ID NO: 701642 - RNA, 64 nt, Homo Sapiens; identical to SEQ ID NO: 28382

SEQ ID NO: 701643 - RNA, 64 nt, Homo Sapiens; identical to SEQ ID NO: 28383

SEQ ID NO: 701644 - RNA, 64 nt, Homo Sapiens; identical to SEQ ID NO: 28384

SEQ ID NO: 701645 - RNA, 64 nt, Homo Sapiens; identical to SEQ ID NO: 28385

SEQ ID NO: 701646 - RNA, 64 nt, Homo Sapiens; identical to SEQ ID NO: 28386

SEQ ID NO: 701647 - RNA, 64 nt, Homo Sapiens; identical to SEQ ID NO: 28387

SEQ ID NO: 701648 - RNA, 64 nt, Homo Sapiens; identical to SEQ ID NO: 28388

SEQ ID NO: 701649 - RNA, 64 nt, Homo Sapiens; identical to SEQ ID NO: 28389

SEQ ID NO: 701650 - RNA, 64 nt, Homo Sapiens; identical to SEQ ID NO: 28390

SEQ ID NO: 701651 - RNA, 64 nt, Homo Sapiens; identical to SEQ ID NO: 28391

SEQ ID NO: 701652 - RNA, 64 nt, Homo Sapiens; identical to SEQ ID NO: 28392

SEQ ID NO: 701653 - RNA, 64 nt, Homo Sapiens; identical to SEQ ID NO: 28393

SEQ ID NO: 701654 - RNA, 64 nt, Homo Sapiens; identical to SEQ ID NO: 28394

SEQ ID NO: 701655 - RNA, 64 nt, Homo Sapiens; identical to SEQ ID NO: 28395

SEQ ID NO: 701656 - RNA, 64 nt, Homo Sapiens; identical to SEQ ID NO: 28396

SEQ ID NO: 701657 - RNA, 64 nt, Homo Sapiens; identical to SEQ ID NO: 28397

SEQ ID NO: 701658 - RNA, 64 nt, Homo Sapiens; identical to SEQ ID NO: 28398

SEQ ID NO: 701659 - RNA, 64 nt, Homo Sapiens; identical to SEQ ID NO: 28399

SEQ ID NO: 701660 - RNA, 64 nt, Homo Sapiens; identical to SEQ ID NO: 28400

SEQ ID NO: 701661 - RNA, 64 nt, Homo Sapiens; identical to SEQ ID NO: 28401

SEQ ID NO: 701662 - RNA, 64 nt, Homo Sapiens; identical to SEQ ID NO: 28402

SEQ ID NO: 701663 - RNA, 64 nt, Homo Sapiens; identical to SEQ ID NO: 28403

SEQ ID NO: 701664 - RNA, 64 nt, Homo Sapiens; identical to SEQ ID NO: 28404

SEQ ID NO: 701665 - RNA, 64 nt, Homo Sapiens; identical to SEQ ID NO: 28405

SEQ ID NO: 701666 - RNA, 64 nt, Homo Sapiens; identical to SEQ ID NO: 28406

SEQ ID NO: 701667 - RNA, 64 nt, Homo Sapiens; identical to SEQ ID NO: 28407

SEQ ID NO: 701668 - RNA, 64 nt, Homo Sapiens; identical to SEQ ID NO: 28408

SEQ ID NO: 701669 - RNA, 64 nt, Homo Sapiens; identical to SEQ ID NO: 28409

SEQ ID NO: 701670 - RNA, 64 nt, Homo Sapiens; identical to SEQ ID NO: 28410

SEQ ID NO: 701671 - RNA, 64 nt, Homo Sapiens; identical to SEQ ID NO: 28411

SEQ ID NO: 701672 - RNA, 64 nt, Homo Sapiens; identical to SEQ ID NO: 28412

SEQ ID NO: 701673 - RNA, 64 nt, Homo Sapiens; identical to SEQ ID NO: 28413

SEQ ID NO: 701674 - RNA, 64 nt, Homo Sapiens; identical to SEQ ID NO: 28414

SEQ ID NO: 701675 - RNA, 64 nt, Homo Sapiens; identical to SEQ ID NO: 28415

SEQ ID NO: 701676 - RNA, 64 nt, Homo Sapiens; identical to SEQ ID NO: 28416

SEQ ID NO: 701677 - RNA, 64 nt, Homo Sapiens; identical to SEQ ID NO: 28417

SEQ ID NO: 701678 - RNA, 64 nt, Homo Sapiens; identical to SEQ ID NO: 28418

SEQ ID NO: 701679 - RNA, 64 nt, Homo Sapiens; identical to SEQ ID NO: 28419

SEQ ID NO: 701680 - RNA, 64 nt, Homo Sapiens; identical to SEQ ID NO: 28420

SEQ ID NO: 701681 - RNA, 64 nt, Homo Sapiens; identical to SEQ ID NO: 28421

SEQ ID NO: 701682 - RNA, 64 nt, Homo Sapiens; identical to SEQ ID NO: 28422

SEQ ID NO: 701683 - RNA, 64 nt, Homo Sapiens; identical to SEQ ID NO: 28423

SEQ ID NO: 701684 - RNA, 64 nt, Homo Sapiens; identical to SEQ ID NO: 28424

SEQ ID NO: 701685 - RNA, 64 nt, Homo Sapiens; identical to SEQ ID NO: 28425

SEQ ID NO: 701686 - RNA, 64 nt, Homo Sapiens; identical to SEQ ID NO: 28426

SEQ ID NO: 701687 - RNA, 64 nt, Homo Sapiens; identical to SEQ ID NO: 28427

SEQ ID NO: 701688 - RNA, 64 nt, Homo Sapiens; identical to SEQ ID NO: 28428

SEQ ID NO: 701689 - RNA, 64 nt, Homo Sapiens; identical to SEQ ID NO: 28429

SEQ ID NO: 701690 - RNA, 64 nt, Homo Sapiens; identical to SEQ ID NO: 28430

SEQ ID NO: 701691 - RNA, 64 nt, Homo Sapiens; identical to SEQ ID NO: 28431

SEQ ID NO: 701692 - RNA, 64 nt, Homo Sapiens; identical to SEQ ID NO: 28432

SEQ ID NO: 701693 - RNA, 64 nt, Homo Sapiens; identical to SEQ ID NO: 28433

SEQ ID NO: 701694 - RNA, 64 nt, Homo Sapiens; identical to SEQ ID NO: 28434

SEQ ID NO: 701695 - RNA, 64 nt, Homo Sapiens; identical to SEQ ID NO: 28435

SEQ ID NO: 701696 - RNA, 64 nt, Homo Sapiens; identical to SEQ ID NO: 28436

SEQ ID NO: 701697 - RNA, 64 nt, Homo Sapiens; identical to SEQ ID NO: 28437

SEQ ID NO: 701698 - RNA, 64 nt, Homo Sapiens; identical to SEQ ID NO: 28438

SEQ ID NO: 701699 - RNA, 64 nt, Homo Sapiens; identical to SEQ ID NO: 28439

SEQ ID NO: 701700 - RNA, 64 nt, Homo Sapiens; identical to SEQ ID NO: 28440

SEQ ID NO: 701701 - RNA, 64 nt, Homo Sapiens; identical to SEQ ID NO: 28441

SEQ ID NO: 701702 - RNA, 64 nt, Homo Sapiens; identical to SEQ ID NO: 28442

SEQ ID NO: 701703 - RNA, 64 nt, Homo Sapiens; identical to SEQ ID NO: 28443

SEQ ID NO: 701704 - RNA, 64 nt, Homo Sapiens; identical to SEQ ID NO: 28444

SEQ ID NO: 701705 - RNA, 64 nt, Homo Sapiens; identical to SEQ ID NO: 28445

SEQ ID NO: 701706 - RNA, 64 nt, Homo Sapiens; identical to SEQ ID NO: 28446

SEQ ID NO: 701707 - RNA, 64 nt, Homo Sapiens; identical to SEQ ID NO: 28447

SEQ ID NO: 701708 - RNA, 64 nt, Homo Sapiens; identical to SEQ ID NO: 28448

SEQ ID NO: 701709 - RNA, 64 nt, Homo Sapiens; identical to SEQ ID NO: 28449

SEQ ID NO: 701710 - RNA, 64 nt, Homo Sapiens; identical to SEQ ID NO: 28450

SEQ ID NO: 701711 - RNA, 64 nt, Homo Sapiens; identical to SEQ ID NO: 28451

SEQ ID NO: 701712 - RNA, 64 nt, Homo Sapiens; identical to SEQ ID NO: 28452

SEQ ID NO: 701713 - RNA, 64 nt, Homo Sapiens; identical to SEQ ID NO: 28453

SEQ ID NO: 701714 - RNA, 64 nt, Homo Sapiens; identical to SEQ ID NO: 28454

SEQ ID NO: 701715 - RNA, 64 nt, Homo Sapiens; identical to SEQ ID NO: 28455

SEQ ID NO: 701716 - RNA, 64 nt, Homo Sapiens; identical to SEQ ID NO: 28456

SEQ ID NO: 701717 - RNA, 64 nt, Homo Sapiens; identical to SEQ ID NO: 28457

SEQ ID NO: 701718 - RNA, 64 nt, Homo Sapiens; identical to SEQ ID NO: 28458

SEQ ID NO: 701719 - RNA, 64 nt, Homo Sapiens; identical to SEQ ID NO: 28459

SEQ ID NO: 701720 - RNA, 64 nt, Homo Sapiens; identical to SEQ ID NO: 28460

SEQ ID NO: 701721 - RNA, 64 nt, Homo Sapiens; identical to SEQ ID NO: 28461

SEQ ID NO: 701722 - RNA, 64 nt, Homo Sapiens; identical to SEQ ID NO: 28462

SEQ ID NO: 701723 - RNA, 64 nt, Homo Sapiens; identical to SEQ ID NO: 28463

SEQ ID NO: 701724 - RNA, 64 nt, Homo Sapiens; identical to SEQ ID NO: 28464

SEQ ID NO: 701725 - RNA, 64 nt, Homo Sapiens; identical to SEQ ID NO: 28465

SEQ ID NO: 701726 - RNA, 64 nt, Homo Sapiens; identical to SEQ ID NO: 28466

SEQ ID NO: 701727 - RNA, 64 nt, Homo Sapiens; identical to SEQ ID NO: 28467

SEQ ID NO: 701728 - RNA, 64 nt, Homo Sapiens; identical to SEQ ID NO: 28468

SEQ ID NO: 701729 - RNA, 64 nt, Homo Sapiens; identical to SEQ ID NO: 28469

SEQ ID NO: 701730 - RNA, 64 nt, Homo Sapiens; identical to SEQ ID NO: 28470

SEQ ID NO: 701731 - RNA, 64 nt, Homo Sapiens; identical to SEQ ID NO: 28471

SEQ ID NO: 701732 - RNA, 64 nt, Homo Sapiens; identical to SEQ ID NO: 28472

SEQ ID NO: 701733 - RNA, 64 nt, Homo Sapiens; identical to SEQ ID NO: 28473

SEQ ID NO: 701734 - RNA, 64 nt, Homo Sapiens; identical to SEQ ID NO: 28474

SEQ ID NO: 701735 - RNA, 64 nt, Homo Sapiens; identical to SEQ ID NO: 28475

SEQ ID NO: 701736 - RNA, 64 nt, Homo Sapiens; identical to SEQ ID NO: 28476

SEQ ID NO: 701737 - RNA, 64 nt, Homo Sapiens; identical to SEQ ID NO: 28477

SEQ ID NO: 701738 - RNA, 64 nt, Homo Sapiens; identical to SEQ ID NO: 28478

SEQ ID NO: 701739 - RNA, 64 nt, Homo Sapiens; identical to SEQ ID NO: 28479

SEQ ID NO: 701740 - RNA, 64 nt, Homo Sapiens; identical to SEQ ID NO: 28480

SEQ ID NO: 701741 - RNA, 64 nt, Homo Sapiens; identical to SEQ ID NO: 28481

SEQ ID NO: 701742 - RNA, 64 nt, Homo Sapiens; identical to SEQ ID NO: 28482

SEQ ID NO: 701743 - RNA, 64 nt, Homo Sapiens; identical to SEQ ID NO: 28483

SEQ ID NO: 701744 - RNA, 64 nt, Homo Sapiens; identical to SEQ ID NO: 28484

SEQ ID NO: 701745 - RNA, 64 nt, Homo Sapiens; identical to SEQ ID NO: 28485

SEQ ID NO: 701746 - RNA, 64 nt, Homo Sapiens; identical to SEQ ID NO: 28486

SEQ ID NO: 701747 - RNA, 64 nt, Homo Sapiens; identical to SEQ ID NO: 28487

SEQ ID NO: 701748 - RNA, 64 nt, Homo Sapiens; identical to SEQ ID NO: 28488

SEQ ID NO: 701749 - RNA, 64 nt, Homo Sapiens; identical to SEQ ID NO: 28489

SEQ ID NO: 701750 - RNA, 64 nt, Homo Sapiens; identical to SEQ ID NO: 28490

SEQ ID NO: 701751 - RNA, 51 nt, Homo Sapiens; identical to SEQ ID NO: 28491

SEQ ID NO: 701752 - RNA, 50 nt, Homo Sapiens; identical to SEQ ID NO: 28492

SEQ ID NO: 701753 - RNA, 64 nt, Homo Sapiens; identical to SEQ ID NO: 28493

SEQ ID NO: 701754 - RNA, 64 nt, Homo Sapiens; identical to SEQ ID NO: 28494

SEQ ID NO: 701755 - RNA, 64 nt, Homo Sapiens; identical to SEQ ID NO: 28495

SEQ ID NO: 701756 - RNA, 64 nt, Homo Sapiens; identical to SEQ ID NO: 28496

SEQ ID NO: 701757 - RNA, 64 nt, Homo Sapiens; identical to SEQ ID NO: 28497

SEQ ID NO: 701758 - RNA, 64 nt, Homo Sapiens; identical to SEQ ID NO: 28498

SEQ ID NO: 701759 - RNA, 64 nt, Homo Sapiens; identical to SEQ ID NO: 28499

SEQ ID NO: 701760 - RNA, 64 nt, Homo Sapiens; identical to SEQ ID NO: 28500

SEQ ID NO: 701761 - RNA, 64 nt, Homo Sapiens; identical to SEQ ID NO: 28501

SEQ ID NO: 701762 - RNA, 64 nt, Homo Sapiens; identical to SEQ ID NO: 28502

SEQ ID NO: 701763 - RNA, 64 nt, Homo Sapiens; identical to SEQ ID NO: 28503

SEQ ID NO: 701764 - RNA, 64 nt, Homo Sapiens; identical to SEQ ID NO: 28504

SEQ ID NO: 701765 - RNA, 64 nt, Homo Sapiens; identical to SEQ ID NO: 28505

SEQ ID NO: 701766 - RNA, 64 nt, Homo Sapiens; identical to SEQ ID NO: 28506

SEQ ID NO: 701767 - RNA, 64 nt, Homo Sapiens; identical to SEQ ID NO: 28507

SEQ ID NO: 701768 - RNA, 64 nt, Homo Sapiens; identical to SEQ ID NO: 28508

SEQ ID NO: 701769 - RNA, 64 nt, Homo Sapiens; identical to SEQ ID NO: 28509

SEQ ID NO: 701770 - RNA, 64 nt, Homo Sapiens; identical to SEQ ID NO: 28510

SEQ ID NO: 701771 - RNA, 64 nt, Homo Sapiens; identical to SEQ ID NO: 28511

SEQ ID NO: 701772 - RNA, 64 nt, Homo Sapiens; identical to SEQ ID NO: 28512

SEQ ID NO: 701773 - RNA, 64 nt, Homo Sapiens; identical to SEQ ID NO: 28513

SEQ ID NO: 701774 - RNA, 64 nt, Homo Sapiens; identical to SEQ ID NO: 28514

SEQ ID NO: 701775 - RNA, 64 nt, Homo Sapiens; identical to SEQ ID NO: 28515

SEQ ID NO: 701776 - RNA, 64 nt, Homo Sapiens; identical to SEQ ID NO: 28516

SEQ ID NO: 701777 - RNA, 64 nt, Homo Sapiens; identical to SEQ ID NO: 28517

SEQ ID NO: 701778 - RNA, 64 nt, Homo Sapiens; identical to SEQ ID NO: 28518

SEQ ID NO: 701779 - RNA, 64 nt, Homo Sapiens; identical to SEQ ID NO: 28519

SEQ ID NO: 701780 - RNA, 64 nt, Homo Sapiens; identical to SEQ ID NO: 28520

SEQ ID NO: 701781 - RNA, 64 nt, Homo Sapiens; identical to SEQ ID NO: 28521

SEQ ID NO: 701782 - RNA, 64 nt, Homo Sapiens; identical to SEQ ID NO: 28522

SEQ ID NO: 701783 - RNA, 64 nt, Homo Sapiens; identical to SEQ ID NO: 28523

SEQ ID NO: 701784 - RNA, 64 nt, Homo Sapiens; identical to SEQ ID NO: 28524

SEQ ID NO: 701785 - RNA, 64 nt, Homo Sapiens; identical to SEQ ID NO: 28525

SEQ ID NO: 701786 - RNA, 64 nt, Homo Sapiens; identical to SEQ ID NO: 28526

SEQ ID NO: 701787 - RNA, 64 nt, Homo Sapiens; identical to SEQ ID NO: 28527

SEQ ID NO: 701788 - RNA, 64 nt, Homo Sapiens; identical to SEQ ID NO: 28528

SEQ ID NO: 701789 - RNA, 64 nt, Homo Sapiens; identical to SEQ ID NO: 28529

SEQ ID NO: 701790 - RNA, 64 nt, Homo Sapiens; identical to SEQ ID NO: 28530

SEQ ID NO: 701791 - RNA, 64 nt, Homo Sapiens; identical to SEQ ID NO: 28531

SEQ ID NO: 701792 - RNA, 64 nt, Homo Sapiens; identical to SEQ ID NO: 28532

SEQ ID NO: 701793 - RNA, 64 nt, Homo Sapiens; identical to SEQ ID NO: 28533

SEQ ID NO: 701794 - RNA, 64 nt, Homo Sapiens; identical to SEQ ID NO: 28534

SEQ ID NO: 701795 - RNA, 64 nt, Homo Sapiens; identical to SEQ ID NO: 28535

SEQ ID NO: 701796 - RNA, 64 nt, Homo Sapiens; identical to SEQ ID NO: 28536

SEQ ID NO: 701797 - RNA, 64 nt, Homo Sapiens; identical to SEQ ID NO: 28537

SEQ ID NO: 701798 - RNA, 64 nt, Homo Sapiens; identical to SEQ ID NO: 28538

SEQ ID NO: 701799 - RNA, 64 nt, Homo Sapiens; identical to SEQ ID NO: 28539

SEQ ID NO: 701800 - RNA, 64 nt, Homo Sapiens; identical to SEQ ID NO: 28540

SEQ ID NO: 701801 - RNA, 64 nt, Homo Sapiens; identical to SEQ ID NO: 28541

SEQ ID NO: 701802 - RNA, 64 nt, Homo Sapiens; identical to SEQ ID NO: 28542

SEQ ID NO: 701803 - RNA, 64 nt, Homo Sapiens; identical to SEQ ID NO: 28543

SEQ ID NO: 701804 - RNA, 64 nt, Homo Sapiens; identical to SEQ ID NO: 28544

SEQ ID NO: 701805 - RNA, 64 nt, Homo Sapiens; identical to SEQ ID NO: 28545

SEQ ID NO: 701806 - RNA, 64 nt, Homo Sapiens; identical to SEQ ID NO: 28546

SEQ ID NO: 701807 - RNA, 64 nt, Homo Sapiens; identical to SEQ ID NO: 28547

SEQ ID NO: 701808 - RNA, 64 nt, Homo Sapiens; identical to SEQ ID NO: 28548

SEQ ID NO: 701809 - RNA, 64 nt, Homo Sapiens; identical to SEQ ID NO: 28549

SEQ ID NO: 701810 - RNA, 64 nt, Homo Sapiens; identical to SEQ ID NO: 28550

SEQ ID NO: 701811 - RNA, 64 nt, Homo Sapiens; identical to SEQ ID NO: 28551

SEQ ID NO: 701812 - RNA, 64 nt, Homo Sapiens; identical to SEQ ID NO: 28552

SEQ ID NO: 701813 - RNA, 64 nt, Homo Sapiens; identical to SEQ ID NO: 28553

SEQ ID NO: 701814 - RNA, 64 nt, Homo Sapiens; identical to SEQ ID NO: 28554

SEQ ID NO: 701815 - RNA, 64 nt, Homo Sapiens; identical to SEQ ID NO: 28555

SEQ ID NO: 701816 - RNA, 64 nt, Homo Sapiens; identical to SEQ ID NO: 28556

SEQ ID NO: 701817 - RNA, 64 nt, Homo Sapiens; identical to SEQ ID NO: 28557

SEQ ID NO: 701818 - RNA, 64 nt, Homo Sapiens; identical to SEQ ID NO: 28558

SEQ ID NO: 701819 - RNA, 64 nt, Homo Sapiens; identical to SEQ ID NO: 28559

SEQ ID NO: 701820 - RNA, 64 nt, Homo Sapiens; identical to SEQ ID NO: 28560

SEQ ID NO: 701821 - RNA, 64 nt, Homo Sapiens; identical to SEQ ID NO: 28561

SEQ ID NO: 701822 - RNA, 64 nt, Homo Sapiens; identical to SEQ ID NO: 28562

SEQ ID NO: 701823 - RNA, 64 nt, Homo Sapiens; identical to SEQ ID NO: 28563

SEQ ID NO: 701824 - RNA, 64 nt, Homo Sapiens; identical to SEQ ID NO: 28564

SEQ ID NO: 701825 - RNA, 64 nt, Homo Sapiens; identical to SEQ ID NO: 28565

SEQ ID NO: 701826 - RNA, 64 nt, Homo Sapiens; identical to SEQ ID NO: 28566

SEQ ID NO: 701827 - RNA, 64 nt, Homo Sapiens; identical to SEQ ID NO: 28567

SEQ ID NO: 701828 - RNA, 64 nt, Homo Sapiens; identical to SEQ ID NO: 28568

SEQ ID NO: 701829 - RNA, 64 nt, Homo Sapiens; identical to SEQ ID NO: 28569

SEQ ID NO: 701830 - RNA, 64 nt, Homo Sapiens; identical to SEQ ID NO: 28570

SEQ ID NO: 701831 - RNA, 64 nt, Homo Sapiens; identical to SEQ ID NO: 28571

SEQ ID NO: 701832 - RNA, 64 nt, Homo Sapiens; identical to SEQ ID NO: 28572

SEQ ID NO: 701833 - RNA, 64 nt, Homo Sapiens; identical to SEQ ID NO: 28573

SEQ ID NO: 701834 - RNA, 64 nt, Homo Sapiens; identical to SEQ ID NO: 28574

SEQ ID NO: 701835 - RNA, 64 nt, Homo Sapiens; identical to SEQ ID NO: 28575

SEQ ID NO: 701836 - RNA, 64 nt, Homo Sapiens; identical to SEQ ID NO: 28576

SEQ ID NO: 701837 - RNA, 64 nt, Homo Sapiens; identical to SEQ ID NO: 28577

SEQ ID NO: 701838 - RNA, 64 nt, Homo Sapiens; identical to SEQ ID NO: 28578

SEQ ID NO: 701839 - RNA, 64 nt, Homo Sapiens; identical to SEQ ID NO: 28579

SEQ ID NO: 701840 - RNA, 64 nt, Homo Sapiens; identical to SEQ ID NO: 28580

SEQ ID NO: 701841 - RNA, 64 nt, Homo Sapiens; identical to SEQ ID NO: 28581

SEQ ID NO: 701842 - RNA, 64 nt, Homo Sapiens; identical to SEQ ID NO: 28582

SEQ ID NO: 701843 - RNA, 64 nt, Homo Sapiens; identical to SEQ ID NO: 28583

SEQ ID NO: 701844 - RNA, 64 nt, Homo Sapiens; identical to SEQ ID NO: 28584

SEQ ID NO: 701845 - RNA, 64 nt, Homo Sapiens; identical to SEQ ID NO: 28585

SEQ ID NO: 701846 - RNA, 64 nt, Homo Sapiens; identical to SEQ ID NO: 28586

SEQ ID NO: 701847 - RNA, 64 nt, Homo Sapiens; identical to SEQ ID NO: 28587

SEQ ID NO: 701848 - RNA, 64 nt, Homo Sapiens; identical to SEQ ID NO: 28588

SEQ ID NO: 701849 - RNA, 64 nt, Homo Sapiens; identical to SEQ ID NO: 28589

SEQ ID NO: 701850 - RNA, 64 nt, Homo Sapiens; identical to SEQ ID NO: 28590

SEQ ID NO: 701851 - RNA, 64 nt, Homo Sapiens; identical to SEQ ID NO: 28591

SEQ ID NO: 701852 - RNA, 64 nt, Homo Sapiens; identical to SEQ ID NO: 28592

SEQ ID NO: 701853 - RNA, 64 nt, Homo Sapiens; identical to SEQ ID NO: 28593

SEQ ID NO: 701854 - RNA, 64 nt, Homo Sapiens; identical to SEQ ID NO: 28594

SEQ ID NO: 701855 - RNA, 64 nt, Homo Sapiens; identical to SEQ ID NO: 28595

SEQ ID NO: 701856 - RNA, 64 nt, Homo Sapiens; identical to SEQ ID NO: 28596

SEQ ID NO: 701857 - RNA, 64 nt, Homo Sapiens; identical to SEQ ID NO: 28597

SEQ ID NO: 701858 - RNA, 64 nt, Homo Sapiens; identical to SEQ ID NO: 28598

SEQ ID NO: 701859 - RNA, 64 nt, Homo Sapiens; identical to SEQ ID NO: 28599

SEQ ID NO: 701860 - RNA, 64 nt, Homo Sapiens; identical to SEQ ID NO: 28600

SEQ ID NO: 701861 - RNA, 64 nt, Homo Sapiens; identical to SEQ ID NO: 28601

SEQ ID NO: 701862 - RNA, 64 nt, Homo Sapiens; identical to SEQ ID NO: 28602

SEQ ID NO: 701863 - RNA, 64 nt, Homo Sapiens; identical to SEQ ID NO: 28603

SEQ ID NO: 701864 - RNA, 64 nt, Homo Sapiens; identical to SEQ ID NO: 28604

SEQ ID NO: 701865 - RNA, 64 nt, Homo Sapiens; identical to SEQ ID NO: 28605

SEQ ID NO: 701866 - RNA, 64 nt, Homo Sapiens; identical to SEQ ID NO: 28606

SEQ ID NO: 701867 - RNA, 64 nt, Homo Sapiens; identical to SEQ ID NO: 28607

SEQ ID NO: 701868 - RNA, 64 nt, Homo Sapiens; identical to SEQ ID NO: 28608

SEQ ID NO: 701869 - RNA, 64 nt, Homo Sapiens; identical to SEQ ID NO: 28609

SEQ ID NO: 701870 - RNA, 64 nt, Homo Sapiens; identical to SEQ ID NO: 28610

SEQ ID NO: 701871 - RNA, 64 nt, Homo Sapiens; identical to SEQ ID NO: 28611

SEQ ID NO: 701872 - RNA, 64 nt, Homo Sapiens; identical to SEQ ID NO: 28612

SEQ ID NO: 701873 - RNA, 64 nt, Homo Sapiens; identical to SEQ ID NO: 28613

SEQ ID NO: 701874 - RNA, 64 nt, Homo Sapiens; identical to SEQ ID NO: 28614

SEQ ID NO: 701875 - RNA, 64 nt, Homo Sapiens; identical to SEQ ID NO: 28615

SEQ ID NO: 701876 - RNA, 64 nt, Homo Sapiens; identical to SEQ ID NO: 28616

SEQ ID NO: 701877 - RNA, 64 nt, Homo Sapiens; identical to SEQ ID NO: 28617

SEQ ID NO: 701878 - RNA, 64 nt, Homo Sapiens; identical to SEQ ID NO: 28618

SEQ ID NO: 701879 - RNA, 64 nt, Homo Sapiens; identical to SEQ ID NO: 28619

SEQ ID NO: 701880 - RNA, 64 nt, Homo Sapiens; identical to SEQ ID NO: 28620

SEQ ID NO: 701881 - RNA, 64 nt, Homo Sapiens; identical to SEQ ID NO: 28549

SEQ ID NO: 701882 - RNA, 64 nt, Homo Sapiens; identical to SEQ ID NO: 28622

SEQ ID NO: 701883 - RNA, 64 nt, Homo Sapiens; identical to SEQ ID NO: 28623

SEQ ID NO: 701884 - RNA, 64 nt, Homo Sapiens; identical to SEQ ID NO: 28624

SEQ ID NO: 701885 - RNA, 64 nt, Homo Sapiens; identical to SEQ ID NO: 28625

SEQ ID NO: 701886 - RNA, 64 nt, Homo Sapiens; identical to SEQ ID NO: 28626

SEQ ID NO: 701887 - RNA, 64 nt, Homo Sapiens; identical to SEQ ID NO: 28627

SEQ ID NO: 701888 - RNA, 64 nt, Homo Sapiens; identical to SEQ ID NO: 28628

SEQ ID NO: 701889 - RNA, 64 nt, Homo Sapiens; identical to SEQ ID NO: 28629

SEQ ID NO: 701890 - RNA, 64 nt, Homo Sapiens; identical to SEQ ID NO: 28630

SEQ ID NO: 701891 - RNA, 64 nt, Homo Sapiens; identical to SEQ ID NO: 28631

SEQ ID NO: 701892 - RNA, 64 nt, Homo Sapiens; identical to SEQ ID NO: 28632

SEQ ID NO: 701893 - RNA, 64 nt, Homo Sapiens; identical to SEQ ID NO: 28633

SEQ ID NO: 701894 - RNA, 64 nt, Homo Sapiens; identical to SEQ ID NO: 28634

SEQ ID NO: 701895 - RNA, 64 nt, Homo Sapiens; identical to SEQ ID NO: 28635

SEQ ID NO: 701896 - RNA, 64 nt, Homo Sapiens; identical to SEQ ID NO: 28636

SEQ ID NO: 701897 - RNA, 64 nt, Homo Sapiens; identical to SEQ ID NO: 28637

SEQ ID NO: 701898 - RNA, 64 nt, Homo Sapiens; identical to SEQ ID NO: 28638

SEQ ID NO: 701899 - RNA, 64 nt, Homo Sapiens; identical to SEQ ID NO: 28639

SEQ ID NO: 701900 - RNA, 64 nt, Homo Sapiens; identical to SEQ ID NO: 28640

SEQ ID NO: 701901 - RNA, 64 nt, Homo Sapiens; identical to SEQ ID NO: 28641

SEQ ID NO: 701902 - RNA, 64 nt, Homo Sapiens; identical to SEQ ID NO: 28642

SEQ ID NO: 701903 - RNA, 64 nt, Homo Sapiens; identical to SEQ ID NO: 28643

SEQ ID NO: 701904 - RNA, 64 nt, Homo Sapiens; identical to SEQ ID NO: 28644

SEQ ID NO: 701905 - RNA, 64 nt, Homo Sapiens; identical to SEQ ID NO: 28645

SEQ ID NO: 701906 - RNA, 64 nt, Homo Sapiens; identical to SEQ ID NO: 28646

SEQ ID NO: 701907 - RNA, 64 nt, Homo Sapiens; identical to SEQ ID NO: 28647

SEQ ID NO: 701908 - RNA, 64 nt, Homo Sapiens; identical to SEQ ID NO: 28648

SEQ ID NO: 701909 - RNA, 64 nt, Homo Sapiens; identical to SEQ ID NO: 28649

SEQ ID NO: 701910 - RNA, 64 nt, Homo Sapiens; identical to SEQ ID NO: 28650

SEQ ID NO: 701911 - RNA, 64 nt, Homo Sapiens; identical to SEQ ID NO: 28651

SEQ ID NO: 701912 - RNA, 64 nt, Homo Sapiens; identical to SEQ ID NO: 28652

SEQ ID NO: 701913 - RNA, 64 nt, Homo Sapiens; identical to SEQ ID NO: 28653

SEQ ID NO: 701914 - RNA, 64 nt, Homo Sapiens; identical to SEQ ID NO: 28654

SEQ ID NO: 701915 - RNA, 64 nt, Homo Sapiens; identical to SEQ ID NO: 28655

SEQ ID NO: 701916 - RNA, 64 nt, Homo Sapiens; identical to SEQ ID NO: 28656

SEQ ID NO: 701917 - RNA, 64 nt, Homo Sapiens; identical to SEQ ID NO: 28657

SEQ ID NO: 701918 - RNA, 64 nt, Homo Sapiens; identical to SEQ ID NO: 28658

SEQ ID NO: 701919 - RNA, 64 nt, Homo Sapiens; identical to SEQ ID NO: 28659

SEQ ID NO: 701920 - RNA, 64 nt, Homo Sapiens; identical to SEQ ID NO: 28660

SEQ ID NO: 701921 - RNA, 64 nt, Homo Sapiens; identical to SEQ ID NO: 28661

SEQ ID NO: 701922 - RNA, 64 nt, Homo Sapiens; identical to SEQ ID NO: 28662

SEQ ID NO: 701923 - RNA, 64 nt, Homo Sapiens; identical to SEQ ID NO: 28663

SEQ ID NO: 701924 - RNA, 64 nt, Homo Sapiens; identical to SEQ ID NO: 28664

SEQ ID NO: 701925 - RNA, 64 nt, Homo Sapiens; identical to SEQ ID NO: 28665

SEQ ID NO: 701926 - RNA, 64 nt, Homo Sapiens; identical to SEQ ID NO: 28666

SEQ ID NO: 701927 - RNA, 64 nt, Homo Sapiens; identical to SEQ ID NO: 28667

SEQ ID NO: 701928 - RNA, 64 nt, Homo Sapiens; identical to SEQ ID NO: 28668

SEQ ID NO: 701929 - RNA, 64 nt, Homo Sapiens; identical to SEQ ID NO: 28669

SEQ ID NO: 701930 - RNA, 64 nt, Homo Sapiens; identical to SEQ ID NO: 28670

SEQ ID NO: 701931 - RNA, 64 nt, Homo Sapiens; identical to SEQ ID NO: 28671

SEQ ID NO: 701932 - RNA, 64 nt, Homo Sapiens; identical to SEQ ID NO: 28672

SEQ ID NO: 701933 - RNA, 64 nt, Homo Sapiens; identical to SEQ ID NO: 28673

SEQ ID NO: 701934 - RNA, 64 nt, Homo Sapiens; identical to SEQ ID NO: 28674

SEQ ID NO: 701935 - RNA, 64 nt, Homo Sapiens; identical to SEQ ID NO: 28675

SEQ ID NO: 701936 - RNA, 64 nt, Homo Sapiens; identical to SEQ ID NO: 28676

SEQ ID NO: 701937 - RNA, 64 nt, Homo Sapiens; identical to SEQ ID NO: 28677

SEQ ID NO: 701938 - RNA, 64 nt, Homo Sapiens; identical to SEQ ID NO: 28678

SEQ ID NO: 701939 - RNA, 64 nt, Homo Sapiens; identical to SEQ ID NO: 28679

SEQ ID NO: 701940 - RNA, 64 nt, Homo Sapiens; identical to SEQ ID NO: 28680

SEQ ID NO: 701941 - RNA, 64 nt, Homo Sapiens; identical to SEQ ID NO: 28681

SEQ ID NO: 701942 - RNA, 64 nt, Homo Sapiens; identical to SEQ ID NO: 28682

SEQ ID NO: 701943 - RNA, 64 nt, Homo Sapiens; identical to SEQ ID NO: 28683

SEQ ID NO: 701944 - RNA, 64 nt, Homo Sapiens; identical to SEQ ID NO: 28684

SEQ ID NO: 701945 - RNA, 64 nt, Homo Sapiens; identical to SEQ ID NO: 28685

SEQ ID NO: 701946 - RNA, 64 nt, Homo Sapiens; identical to SEQ ID NO: 28686

SEQ ID NO: 701947 - RNA, 64 nt, Homo Sapiens; identical to SEQ ID NO: 28687

SEQ ID NO: 701948 - RNA, 64 nt, Homo Sapiens; identical to SEQ ID NO: 28688

SEQ ID NO: 701949 - RNA, 64 nt, Homo Sapiens; identical to SEQ ID NO: 28689

SEQ ID NO: 701950 - RNA, 64 nt, Homo Sapiens; identical to SEQ ID NO: 28690

SEQ ID NO: 701951 - RNA, 64 nt, Homo Sapiens; identical to SEQ ID NO: 28691

SEQ ID NO: 701952 - RNA, 64 nt, Homo Sapiens; identical to SEQ ID NO: 28692

SEQ ID NO: 701953 - RNA, 64 nt, Homo Sapiens; identical to SEQ ID NO: 28693

SEQ ID NO: 701954 - RNA, 64 nt, Homo Sapiens; identical to SEQ ID NO: 28694

SEQ ID NO: 701955 - RNA, 64 nt, Homo Sapiens; identical to SEQ ID NO: 28695

SEQ ID NO: 701956 - RNA, 64 nt, Homo Sapiens; identical to SEQ ID NO: 28696

SEQ ID NO: 701957 - RNA, 64 nt, Homo Sapiens; identical to SEQ ID NO: 28697

SEQ ID NO: 701958 - RNA, 64 nt, Homo Sapiens; identical to SEQ ID NO: 28698

SEQ ID NO: 701959 - RNA, 64 nt, Homo Sapiens; identical to SEQ ID NO: 28699

SEQ ID NO: 701960 - RNA, 64 nt, Homo Sapiens; identical to SEQ ID NO: 28700

SEQ ID NO: 701961 - RNA, 64 nt, Homo Sapiens; identical to SEQ ID NO: 28701

SEQ ID NO: 701962 - RNA, 64 nt, Homo Sapiens; identical to SEQ ID NO: 28702

SEQ ID NO: 701963 - RNA, 64 nt, Homo Sapiens; identical to SEQ ID NO: 28703

SEQ ID NO: 701964 - RNA, 64 nt, Homo Sapiens; identical to SEQ ID NO: 28704

SEQ ID NO: 701965 - RNA, 64 nt, Homo Sapiens; identical to SEQ ID NO: 28705

SEQ ID NO: 701966 - RNA, 64 nt, Homo Sapiens; identical to SEQ ID NO: 28706

SEQ ID NO: 701967 - RNA, 64 nt, Homo Sapiens; identical to SEQ ID NO: 28707

SEQ ID NO: 701968 - RNA, 64 nt, Homo Sapiens; identical to SEQ ID NO: 28708

SEQ ID NO: 701969 - RNA, 64 nt, Homo Sapiens; identical to SEQ ID NO: 28709

SEQ ID NO: 701970 - RNA, 64 nt, Homo Sapiens; identical to SEQ ID NO: 28710

SEQ ID NO: 701971 - RNA, 64 nt, Homo Sapiens; identical to SEQ ID NO: 28711

SEQ ID NO: 701972 - RNA, 64 nt, Homo Sapiens; identical to SEQ ID NO: 28712

SEQ ID NO: 701973 - RNA, 64 nt, Homo Sapiens; identical to SEQ ID NO: 28713

SEQ ID NO: 701974 - RNA, 64 nt, Homo Sapiens; identical to SEQ ID NO: 28714

SEQ ID NO: 701975 - RNA, 64 nt, Homo Sapiens; identical to SEQ ID NO: 28715

SEQ ID NO: 701976 - RNA, 64 nt, Homo Sapiens; identical to SEQ ID NO: 28716

SEQ ID NO: 701977 - RNA, 64 nt, Homo Sapiens; identical to SEQ ID NO: 28717

SEQ ID NO: 701978 - RNA, 64 nt, Homo Sapiens; identical to SEQ ID NO: 28718

SEQ ID NO: 701979 - RNA, 64 nt, Homo Sapiens; identical to SEQ ID NO: 28719

SEQ ID NO: 701980 - RNA, 64 nt, Homo Sapiens; identical to SEQ ID NO: 28720

SEQ ID NO: 701981 - RNA, 64 nt, Homo Sapiens; identical to SEQ ID NO: 28721

SEQ ID NO: 701982 - RNA, 64 nt, Homo Sapiens; identical to SEQ ID NO: 28722

SEQ ID NO: 701983 - RNA, 64 nt, Homo Sapiens; identical to SEQ ID NO: 28723

SEQ ID NO: 701984 - RNA, 64 nt, Homo Sapiens; identical to SEQ ID NO: 28724

SEQ ID NO: 701985 - RNA, 64 nt, Homo Sapiens; identical to SEQ ID NO: 28725

SEQ ID NO: 701986 - RNA, 64 nt, Homo Sapiens; identical to SEQ ID NO: 28726

SEQ ID NO: 701987 - RNA, 64 nt, Homo Sapiens; identical to SEQ ID NO: 28727

SEQ ID NO: 701988 - RNA, 64 nt, Homo Sapiens; identical to SEQ ID NO: 28728

SEQ ID NO: 701989 - RNA, 64 nt, Homo Sapiens; identical to SEQ ID NO: 28729

SEQ ID NO: 701990 - RNA, 64 nt, Homo Sapiens; identical to SEQ ID NO: 28730

SEQ ID NO: 701991 - RNA, 64 nt, Homo Sapiens; identical to SEQ ID NO: 28731

SEQ ID NO: 701992 - RNA, 64 nt, Homo Sapiens; identical to SEQ ID NO: 28732

SEQ ID NO: 701993 - RNA, 64 nt, Homo Sapiens; identical to SEQ ID NO: 28733

SEQ ID NO: 701994 - RNA, 64 nt, Homo Sapiens; identical to SEQ ID NO: 28734

SEQ ID NO: 701995 - RNA, 64 nt, Homo Sapiens; identical to SEQ ID NO: 28735

SEQ ID NO: 701996 - RNA, 64 nt, Homo Sapiens; identical to SEQ ID NO: 28736

SEQ ID NO: 701997 - RNA, 64 nt, Homo Sapiens; identical to SEQ ID NO: 28737

SEQ ID NO: 701998 - RNA, 64 nt, Homo Sapiens; identical to SEQ ID NO: 28738

SEQ ID NO: 701999 - RNA, 64 nt, Homo Sapiens; identical to SEQ ID NO: 28739

SEQ ID NO: 702000 - RNA, 64 nt, Homo Sapiens; identical to SEQ ID NO: 28740

SEQ ID NO: 702001 - RNA, 64 nt, Homo Sapiens; identical to SEQ ID NO: 28741

SEQ ID NO: 702002 - RNA, 64 nt, Homo Sapiens; identical to SEQ ID NO: 28742

SEQ ID NO: 702003 - RNA, 64 nt, Homo Sapiens; identical to SEQ ID NO: 28743

SEQ ID NO: 702004 - RNA, 64 nt, Homo Sapiens; identical to SEQ ID NO: 28744

SEQ ID NO: 702005 - RNA, 64 nt, Homo Sapiens; identical to SEQ ID NO: 28745

SEQ ID NO: 702006 - RNA, 64 nt, Homo Sapiens; identical to SEQ ID NO: 28746

SEQ ID NO: 702007 - RNA, 64 nt, Homo Sapiens; identical to SEQ ID NO: 28747

SEQ ID NO: 702008 - RNA, 64 nt, Homo Sapiens; identical to SEQ ID NO: 28748

SEQ ID NO: 702009 - RNA, 64 nt, Homo Sapiens; identical to SEQ ID NO: 28749

SEQ ID NO: 702010 - RNA, 64 nt, Homo Sapiens; identical to SEQ ID NO: 28750

SEQ ID NO: 702011 - RNA, 64 nt, Homo Sapiens; identical to SEQ ID NO: 28751

SEQ ID NO: 702012 - RNA, 64 nt, Homo Sapiens; identical to SEQ ID NO: 28752

SEQ ID NO: 702013 - RNA, 64 nt, Homo Sapiens; identical to SEQ ID NO: 28753

SEQ ID NO: 702014 - RNA, 64 nt, Homo Sapiens; identical to SEQ ID NO: 28754

SEQ ID NO: 702015 - RNA, 64 nt, Homo Sapiens; identical to SEQ ID NO: 28755

SEQ ID NO: 702016 - RNA, 64 nt, Homo Sapiens; identical to SEQ ID NO: 28756

SEQ ID NO: 702017 - RNA, 64 nt, Homo Sapiens; identical to SEQ ID NO: 28757

SEQ ID NO: 702018 - RNA, 64 nt, Homo Sapiens; identical to SEQ ID NO: 28758

SEQ ID NO: 702019 - RNA, 64 nt, Homo Sapiens; identical to SEQ ID NO: 28759

SEQ ID NO: 702020 - RNA, 64 nt, Homo Sapiens; identical to SEQ ID NO: 28760

SEQ ID NO: 702021 - RNA, 64 nt, Homo Sapiens; identical to SEQ ID NO: 28761

SEQ ID NO: 702022 - RNA, 64 nt, Homo Sapiens; identical to SEQ ID NO: 28762

SEQ ID NO: 702023 - RNA, 64 nt, Homo Sapiens; identical to SEQ ID NO: 28763

SEQ ID NO: 702024 - RNA, 64 nt, Homo Sapiens; identical to SEQ ID NO: 28764

SEQ ID NO: 702025 - RNA, 64 nt, Homo Sapiens; identical to SEQ ID NO: 28765

SEQ ID NO: 702026 - RNA, 64 nt, Homo Sapiens; identical to SEQ ID NO: 28766

SEQ ID NO: 702027 - RNA, 64 nt, Homo Sapiens; identical to SEQ ID NO: 28767

SEQ ID NO: 702028 - RNA, 64 nt, Homo Sapiens; identical to SEQ ID NO: 28768

SEQ ID NO: 702029 - RNA, 64 nt, Homo Sapiens; identical to SEQ ID NO: 28769

SEQ ID NO: 702030 - RNA, 64 nt, Homo Sapiens; identical to SEQ ID NO: 28770

SEQ ID NO: 702031 - RNA, 64 nt, Homo Sapiens; identical to SEQ ID NO: 28771

SEQ ID NO: 702032 - RNA, 64 nt, Homo Sapiens; identical to SEQ ID NO: 28772

SEQ ID NO: 702033 - RNA, 64 nt, Homo Sapiens; identical to SEQ ID NO: 28773

SEQ ID NO: 702034 - RNA, 64 nt, Homo Sapiens; identical to SEQ ID NO: 28774

SEQ ID NO: 702035 - RNA, 64 nt, Homo Sapiens; identical to SEQ ID NO: 28775

SEQ ID NO: 702036 - RNA, 64 nt, Homo Sapiens; identical to SEQ ID NO: 28776

SEQ ID NO: 702037 - RNA, 64 nt, Homo Sapiens; identical to SEQ ID NO: 28777

SEQ ID NO: 702038 - RNA, 64 nt, Homo Sapiens; identical to SEQ ID NO: 28778

SEQ ID NO: 702039 - RNA, 64 nt, Homo Sapiens; identical to SEQ ID NO: 28779

SEQ ID NO: 702040 - RNA, 64 nt, Homo Sapiens; identical to SEQ ID NO: 28780

SEQ ID NO: 702041 - RNA, 64 nt, Homo Sapiens; identical to SEQ ID NO: 28781

SEQ ID NO: 702042 - RNA, 64 nt, Homo Sapiens; identical to SEQ ID NO: 28782

SEQ ID NO: 702043 - RNA, 64 nt, Homo Sapiens; identical to SEQ ID NO: 28783

SEQ ID NO: 702044 - RNA, 64 nt, Homo Sapiens; identical to SEQ ID NO: 28784

SEQ ID NO: 702045 - RNA, 64 nt, Homo Sapiens; identical to SEQ ID NO: 28785

SEQ ID NO: 702046 - RNA, 64 nt, Homo Sapiens; identical to SEQ ID NO: 28786

SEQ ID NO: 702047 - RNA, 64 nt, Homo Sapiens; identical to SEQ ID NO: 28787

SEQ ID NO: 702048 - RNA, 64 nt, Homo Sapiens; identical to SEQ ID NO: 28788

SEQ ID NO: 702049 - RNA, 64 nt, Homo Sapiens; identical to SEQ ID NO: 28789

SEQ ID NO: 702050 - RNA, 64 nt, Homo Sapiens; identical to SEQ ID NO: 28790

SEQ ID NO: 702051 - RNA, 64 nt, Homo Sapiens; identical to SEQ ID NO: 28791

SEQ ID NO: 702052 - RNA, 64 nt, Homo Sapiens; identical to SEQ ID NO: 28792

SEQ ID NO: 702053 - RNA, 64 nt, Homo Sapiens; identical to SEQ ID NO: 28793

SEQ ID NO: 702054 - RNA, 64 nt, Homo Sapiens; identical to SEQ ID NO: 28794

SEQ ID NO: 702055 - RNA, 64 nt, Homo Sapiens; identical to SEQ ID NO: 28795

SEQ ID NO: 702056 - RNA, 64 nt, Homo Sapiens; identical to SEQ ID NO: 28796

SEQ ID NO: 702057 - RNA, 64 nt, Homo Sapiens; identical to SEQ ID NO: 28797

SEQ ID NO: 702058 - RNA, 64 nt, Homo Sapiens; identical to SEQ ID NO: 28798

SEQ ID NO: 702059 - RNA, 64 nt, Homo Sapiens; identical to SEQ ID NO: 28799

SEQ ID NO: 702060 - RNA, 64 nt, Homo Sapiens; identical to SEQ ID NO: 28800

SEQ ID NO: 702061 - RNA, 64 nt, Homo Sapiens; identical to SEQ ID NO: 28801

SEQ ID NO: 702062 - RNA, 64 nt, Homo Sapiens; identical to SEQ ID NO: 28802

SEQ ID NO: 702063 - RNA, 64 nt, Homo Sapiens; identical to SEQ ID NO: 28803

SEQ ID NO: 702064 - RNA, 64 nt, Homo Sapiens; identical to SEQ ID NO: 28804

SEQ ID NO: 702065 - RNA, 64 nt, Homo Sapiens; identical to SEQ ID NO: 28805

SEQ ID NO: 702066 - RNA, 64 nt, Homo Sapiens; identical to SEQ ID NO: 28806

SEQ ID NO: 702067 - RNA, 64 nt, Homo Sapiens; identical to SEQ ID NO: 28807

SEQ ID NO: 702068 - RNA, 64 nt, Homo Sapiens; identical to SEQ ID NO: 28808

SEQ ID NO: 702069 - RNA, 64 nt, Homo Sapiens; identical to SEQ ID NO: 28809

SEQ ID NO: 702070 - RNA, 64 nt, Homo Sapiens; identical to SEQ ID NO: 28810

SEQ ID NO: 702071 - RNA, 64 nt, Homo Sapiens; identical to SEQ ID NO: 28811

SEQ ID NO: 702072 - RNA, 64 nt, Homo Sapiens; identical to SEQ ID NO: 28812

SEQ ID NO: 702073 - RNA, 64 nt, Homo Sapiens; identical to SEQ ID NO: 28813

SEQ ID NO: 702074 - RNA, 64 nt, Homo Sapiens; identical to SEQ ID NO: 28814

SEQ ID NO: 702075 - RNA, 64 nt, Homo Sapiens; identical to SEQ ID NO: 28815

SEQ ID NO: 702076 - RNA, 64 nt, Homo Sapiens; identical to SEQ ID NO: 28816

SEQ ID NO: 702077 - RNA, 64 nt, Homo Sapiens; identical to SEQ ID NO: 28817

SEQ ID NO: 702078 - RNA, 64 nt, Homo Sapiens; identical to SEQ ID NO: 28818

SEQ ID NO: 702079 - RNA, 64 nt, Homo Sapiens; identical to SEQ ID NO: 28819

SEQ ID NO: 702080 - RNA, 64 nt, Homo Sapiens; identical to SEQ ID NO: 28820

SEQ ID NO: 702081 - RNA, 64 nt, Homo Sapiens; identical to SEQ ID NO: 28821

SEQ ID NO: 702082 - RNA, 64 nt, Homo Sapiens; identical to SEQ ID NO: 28822

SEQ ID NO: 702083 - RNA, 64 nt, Homo Sapiens; identical to SEQ ID NO: 28823

SEQ ID NO: 702084 - RNA, 64 nt, Homo Sapiens; identical to SEQ ID NO: 28824

SEQ ID NO: 702085 - RNA, 64 nt, Homo Sapiens; identical to SEQ ID NO: 28825

SEQ ID NO: 702086 - RNA, 64 nt, Homo Sapiens; identical to SEQ ID NO: 28826

SEQ ID NO: 702087 - RNA, 64 nt, Homo Sapiens; identical to SEQ ID NO: 28827

SEQ ID NO: 702088 - RNA, 64 nt, Homo Sapiens; identical to SEQ ID NO: 28828

SEQ ID NO: 702089 - RNA, 64 nt, Homo Sapiens; identical to SEQ ID NO: 28829

SEQ ID NO: 702090 - RNA, 64 nt, Homo Sapiens; identical to SEQ ID NO: 28830

SEQ ID NO: 702091 - RNA, 64 nt, Homo Sapiens; identical to SEQ ID NO: 28831

SEQ ID NO: 702092 - RNA, 64 nt, Homo Sapiens; identical to SEQ ID NO: 28832

SEQ ID NO: 702093 - RNA, 64 nt, Homo Sapiens; identical to SEQ ID NO: 28833

SEQ ID NO: 702094 - RNA, 64 nt, Homo Sapiens; identical to SEQ ID NO: 28834

SEQ ID NO: 702095 - RNA, 64 nt, Homo Sapiens; identical to SEQ ID NO: 28835

SEQ ID NO: 702096 - RNA, 64 nt, Homo Sapiens; identical to SEQ ID NO: 28836

SEQ ID NO: 702097 - RNA, 64 nt, Homo Sapiens; identical to SEQ ID NO: 28837

SEQ ID NO: 702098 - RNA, 64 nt, Homo Sapiens; identical to SEQ ID NO: 28838

SEQ ID NO: 702099 - RNA, 64 nt, Homo Sapiens; identical to SEQ ID NO: 28839

SEQ ID NO: 702100 - RNA, 64 nt, Homo Sapiens; identical to SEQ ID NO: 28840

SEQ ID NO: 702101 - RNA, 64 nt, Homo Sapiens; identical to SEQ ID NO: 28841

SEQ ID NO: 702102 - RNA, 64 nt, Homo Sapiens; identical to SEQ ID NO: 28842

SEQ ID NO: 702103 - RNA, 64 nt, Homo Sapiens; identical to SEQ ID NO: 28843

SEQ ID NO: 702104 - RNA, 64 nt, Homo Sapiens; identical to SEQ ID NO: 28844

SEQ ID NO: 702105 - RNA, 64 nt, Homo Sapiens; identical to SEQ ID NO: 28845

SEQ ID NO: 702106 - RNA, 64 nt, Homo Sapiens; identical to SEQ ID NO: 28846

SEQ ID NO: 702107 - RNA, 64 nt, Homo Sapiens; identical to SEQ ID NO: 28847

SEQ ID NO: 702108 - RNA, 64 nt, Homo Sapiens; identical to SEQ ID NO: 28848

SEQ ID NO: 702109 - RNA, 64 nt, Homo Sapiens; identical to SEQ ID NO: 28849

SEQ ID NO: 702110 - RNA, 64 nt, Homo Sapiens; identical to SEQ ID NO: 28850

SEQ ID NO: 702111 - RNA, 64 nt, Homo Sapiens; identical to SEQ ID NO: 28851

SEQ ID NO: 702112 - RNA, 64 nt, Homo Sapiens; identical to SEQ ID NO: 28852

SEQ ID NO: 702113 - RNA, 64 nt, Homo Sapiens; identical to SEQ ID NO: 28853

SEQ ID NO: 702114 - RNA, 64 nt, Homo Sapiens; identical to SEQ ID NO: 28854

SEQ ID NO: 702115 - RNA, 64 nt, Homo Sapiens; identical to SEQ ID NO: 28855

SEQ ID NO: 702116 - RNA, 64 nt, Homo Sapiens; identical to SEQ ID NO: 28856

SEQ ID NO: 702117 - RNA, 64 nt, Homo Sapiens; identical to SEQ ID NO: 28857

SEQ ID NO: 702118 - RNA, 63 nt, Homo Sapiens; identical to SEQ ID NO: 28858

SEQ ID NO: 702119 - RNA, 62 nt, Homo Sapiens; identical to SEQ ID NO: 28859

SEQ ID NO: 702120 - RNA, 64 nt, Homo Sapiens; identical to SEQ ID NO: 28860

SEQ ID NO: 702121 - RNA, 64 nt, Homo Sapiens; identical to SEQ ID NO: 28861

SEQ ID NO: 702122 - RNA, 64 nt, Homo Sapiens; identical to SEQ ID NO: 28862

SEQ ID NO: 702123 - RNA, 64 nt, Homo Sapiens; identical to SEQ ID NO: 28863

SEQ ID NO: 702124 - RNA, 64 nt, Homo Sapiens; identical to SEQ ID NO: 28864

SEQ ID NO: 702125 - RNA, 64 nt, Homo Sapiens; identical to SEQ ID NO: 28865

SEQ ID NO: 702126 - RNA, 64 nt, Homo Sapiens; identical to SEQ ID NO: 28866

SEQ ID NO: 702127 - RNA, 64 nt, Homo Sapiens; identical to SEQ ID NO: 28867

SEQ ID NO: 702128 - RNA, 64 nt, Homo Sapiens; identical to SEQ ID NO: 28868

SEQ ID NO: 702129 - RNA, 64 nt, Homo Sapiens; identical to SEQ ID NO: 28869

SEQ ID NO: 702130 - RNA, 64 nt, Homo Sapiens; identical to SEQ ID NO: 28870

SEQ ID NO: 702131 - RNA, 64 nt, Homo Sapiens; identical to SEQ ID NO: 28871

SEQ ID NO: 702132 - RNA, 64 nt, Homo Sapiens; identical to SEQ ID NO: 28872

SEQ ID NO: 702133 - RNA, 64 nt, Homo Sapiens; identical to SEQ ID NO: 28873

SEQ ID NO: 702134 - RNA, 64 nt, Homo Sapiens; identical to SEQ ID NO: 28874

SEQ ID NO: 702135 - RNA, 64 nt, Homo Sapiens; identical to SEQ ID NO: 28875

SEQ ID NO: 702136 - RNA, 64 nt, Homo Sapiens; identical to SEQ ID NO: 28876

SEQ ID NO: 702137 - RNA, 64 nt, Homo Sapiens; identical to SEQ ID NO: 28877

SEQ ID NO: 702138 - RNA, 64 nt, Homo Sapiens; identical to SEQ ID NO: 28878

SEQ ID NO: 702139 - RNA, 64 nt, Homo Sapiens; identical to SEQ ID NO: 28879

SEQ ID NO: 702140 - RNA, 64 nt, Homo Sapiens; identical to SEQ ID NO: 28880

SEQ ID NO: 702141 - RNA, 64 nt, Homo Sapiens; identical to SEQ ID NO: 28881

SEQ ID NO: 702142 - RNA, 64 nt, Homo Sapiens; identical to SEQ ID NO: 28882

SEQ ID NO: 702143 - RNA, 64 nt, Homo Sapiens; identical to SEQ ID NO: 28883

SEQ ID NO: 702144 - RNA, 64 nt, Homo Sapiens; identical to SEQ ID NO: 28884

SEQ ID NO: 702145 - RNA, 64 nt, Homo Sapiens; identical to SEQ ID NO: 28885

SEQ ID NO: 702146 - RNA, 64 nt, Homo Sapiens; identical to SEQ ID NO: 28886

SEQ ID NO: 702147 - RNA, 64 nt, Homo Sapiens; identical to SEQ ID NO: 28887

SEQ ID NO: 702148 - RNA, 64 nt, Homo Sapiens; identical to SEQ ID NO: 28888

SEQ ID NO: 702149 - RNA, 64 nt, Homo Sapiens; identical to SEQ ID NO: 28889

SEQ ID NO: 702150 - RNA, 64 nt, Homo Sapiens; identical to SEQ ID NO: 28890

SEQ ID NO: 702151 - RNA, 64 nt, Homo Sapiens; identical to SEQ ID NO: 28891

SEQ ID NO: 702152 - RNA, 64 nt, Homo Sapiens; identical to SEQ ID NO: 28892

SEQ ID NO: 702153 - RNA, 64 nt, Homo Sapiens; identical to SEQ ID NO: 28893

SEQ ID NO: 702154 - RNA, 64 nt, Homo Sapiens; identical to SEQ ID NO: 28894

SEQ ID NO: 702155 - RNA, 64 nt, Homo Sapiens; identical to SEQ ID NO: 28895

SEQ ID NO: 702156 - RNA, 64 nt, Homo Sapiens; identical to SEQ ID NO: 28896

SEQ ID NO: 702157 - RNA, 64 nt, Homo Sapiens; identical to SEQ ID NO: 28897

SEQ ID NO: 702158 - RNA, 64 nt, Homo Sapiens; identical to SEQ ID NO: 28898

SEQ ID NO: 702159 - RNA, 64 nt, Homo Sapiens; identical to SEQ ID NO: 28899

SEQ ID NO: 702160 - RNA, 64 nt, Homo Sapiens; identical to SEQ ID NO: 28900

SEQ ID NO: 702161 - RNA, 64 nt, Homo Sapiens; identical to SEQ ID NO: 28901

SEQ ID NO: 702162 - RNA, 64 nt, Homo Sapiens; identical to SEQ ID NO: 28902

SEQ ID NO: 702163 - RNA, 64 nt, Homo Sapiens; identical to SEQ ID NO: 28903

SEQ ID NO: 702164 - RNA, 64 nt, Homo Sapiens; identical to SEQ ID NO: 28904

SEQ ID NO: 702165 - RNA, 64 nt, Homo Sapiens; identical to SEQ ID NO: 28905

SEQ ID NO: 702166 - RNA, 64 nt, Homo Sapiens; identical to SEQ ID NO: 28906

SEQ ID NO: 702167 - RNA, 64 nt, Homo Sapiens; identical to SEQ ID NO: 28907

SEQ ID NO: 702168 - RNA, 64 nt, Homo Sapiens; identical to SEQ ID NO: 28908

SEQ ID NO: 702169 - RNA, 64 nt, Homo Sapiens; identical to SEQ ID NO: 28909

SEQ ID NO: 702170 - RNA, 64 nt, Homo Sapiens; identical to SEQ ID NO: 28910

SEQ ID NO: 702171 - RNA, 64 nt, Homo Sapiens; identical to SEQ ID NO: 28911

SEQ ID NO: 702172 - RNA, 64 nt, Homo Sapiens; identical to SEQ ID NO: 28912

SEQ ID NO: 702173 - RNA, 64 nt, Homo Sapiens; identical to SEQ ID NO: 28913

SEQ ID NO: 702174 - RNA, 64 nt, Homo Sapiens; identical to SEQ ID NO: 28914

SEQ ID NO: 702175 - RNA, 64 nt, Homo Sapiens; identical to SEQ ID NO: 28915

SEQ ID NO: 702176 - RNA, 64 nt, Homo Sapiens; identical to SEQ ID NO: 28916

SEQ ID NO: 702177 - RNA, 64 nt, Homo Sapiens; identical to SEQ ID NO: 28917

SEQ ID NO: 702178 - RNA, 64 nt, Homo Sapiens; identical to SEQ ID NO: 28918

SEQ ID NO: 702179 - RNA, 64 nt, Homo Sapiens; identical to SEQ ID NO: 28919

SEQ ID NO: 702180 - RNA, 64 nt, Homo Sapiens; identical to SEQ ID NO: 28920

SEQ ID NO: 702181 - RNA, 64 nt, Homo Sapiens; identical to SEQ ID NO: 28921

SEQ ID NO: 702182 - RNA, 64 nt, Homo Sapiens; identical to SEQ ID NO: 28922

SEQ ID NO: 702183 - RNA, 64 nt, Homo Sapiens; identical to SEQ ID NO: 28923

SEQ ID NO: 702184 - RNA, 64 nt, Homo Sapiens; identical to SEQ ID NO: 28924

SEQ ID NO: 702185 - RNA, 64 nt, Homo Sapiens; identical to SEQ ID NO: 28925

SEQ ID NO: 702186 - RNA, 64 nt, Homo Sapiens; identical to SEQ ID NO: 28926

SEQ ID NO: 702187 - RNA, 64 nt, Homo Sapiens; identical to SEQ ID NO: 28927

SEQ ID NO: 702188 - RNA, 64 nt, Homo Sapiens; identical to SEQ ID NO: 28928

SEQ ID NO: 702189 - RNA, 64 nt, Homo Sapiens; identical to SEQ ID NO: 28929

SEQ ID NO: 702190 - RNA, 64 nt, Homo Sapiens; identical to SEQ ID NO: 28930

SEQ ID NO: 702191 - RNA, 64 nt, Homo Sapiens; identical to SEQ ID NO: 28931

SEQ ID NO: 702192 - RNA, 64 nt, Homo Sapiens; identical to SEQ ID NO: 28932

SEQ ID NO: 702193 - RNA, 64 nt, Homo Sapiens; identical to SEQ ID NO: 28933

SEQ ID NO: 702194 - RNA, 64 nt, Homo Sapiens; identical to SEQ ID NO: 28934

SEQ ID NO: 702195 - RNA, 64 nt, Homo Sapiens; identical to SEQ ID NO: 28935

SEQ ID NO: 702196 - RNA, 64 nt, Homo Sapiens; identical to SEQ ID NO: 28936

SEQ ID NO: 702197 - RNA, 64 nt, Homo Sapiens; identical to SEQ ID NO: 28937

SEQ ID NO: 702198 - RNA, 64 nt, Homo Sapiens; identical to SEQ ID NO: 28938

SEQ ID NO: 702199 - RNA, 64 nt, Homo Sapiens; identical to SEQ ID NO: 28939

SEQ ID NO: 702200 - RNA, 64 nt, Homo Sapiens; identical to SEQ ID NO: 28940

SEQ ID NO: 702201 - RNA, 64 nt, Homo Sapiens; identical to SEQ ID NO: 28941

SEQ ID NO: 702202 - RNA, 64 nt, Homo Sapiens; identical to SEQ ID NO: 28942

SEQ ID NO: 702203 - RNA, 64 nt, Homo Sapiens; identical to SEQ ID NO: 28943

SEQ ID NO: 702204 - RNA, 64 nt, Homo Sapiens; identical to SEQ ID NO: 28944

SEQ ID NO: 702205 - RNA, 64 nt, Homo Sapiens; identical to SEQ ID NO: 28945

SEQ ID NO: 702206 - RNA, 64 nt, Homo Sapiens; identical to SEQ ID NO: 28946

SEQ ID NO: 702207 - RNA, 64 nt, Homo Sapiens; identical to SEQ ID NO: 28947

SEQ ID NO: 702208 - RNA, 64 nt, Homo Sapiens; identical to SEQ ID NO: 28948

SEQ ID NO: 702209 - RNA, 64 nt, Homo Sapiens; identical to SEQ ID NO: 28949

SEQ ID NO: 702210 - RNA, 64 nt, Homo Sapiens; identical to SEQ ID NO: 28950

SEQ ID NO: 702211 - RNA, 64 nt, Homo Sapiens; identical to SEQ ID NO: 28951

SEQ ID NO: 702212 - RNA, 64 nt, Homo Sapiens; identical to SEQ ID NO: 28952

SEQ ID NO: 702213 - RNA, 64 nt, Homo Sapiens; identical to SEQ ID NO: 28953

SEQ ID NO: 702214 - RNA, 64 nt, Homo Sapiens; identical to SEQ ID NO: 28954

SEQ ID NO: 702215 - RNA, 64 nt, Homo Sapiens; identical to SEQ ID NO: 28955

SEQ ID NO: 702216 - RNA, 64 nt, Homo Sapiens; identical to SEQ ID NO: 28956

SEQ ID NO: 702217 - RNA, 64 nt, Homo Sapiens; identical to SEQ ID NO: 28957

SEQ ID NO: 702218 - RNA, 64 nt, Homo Sapiens; identical to SEQ ID NO: 28958

SEQ ID NO: 702219 - RNA, 64 nt, Homo Sapiens; identical to SEQ ID NO: 28959

SEQ ID NO: 702220 - RNA, 64 nt, Homo Sapiens; identical to SEQ ID NO: 28960

SEQ ID NO: 702221 - RNA, 64 nt, Homo Sapiens; identical to SEQ ID NO: 28961

SEQ ID NO: 702222 - RNA, 64 nt, Homo Sapiens; identical to SEQ ID NO: 28962

SEQ ID NO: 702223 - RNA, 64 nt, Homo Sapiens; identical to SEQ ID NO: 28963

SEQ ID NO: 702224 - RNA, 64 nt, Homo Sapiens; identical to SEQ ID NO: 28964

SEQ ID NO: 702225 - RNA, 64 nt, Homo Sapiens; identical to SEQ ID NO: 28965

SEQ ID NO: 702226 - RNA, 64 nt, Homo Sapiens; identical to SEQ ID NO: 28966

SEQ ID NO: 702227 - RNA, 64 nt, Homo Sapiens; identical to SEQ ID NO: 28967

SEQ ID NO: 702228 - RNA, 64 nt, Homo Sapiens; identical to SEQ ID NO: 28968

SEQ ID NO: 702229 - RNA, 64 nt, Homo Sapiens; identical to SEQ ID NO: 28969

SEQ ID NO: 702230 - RNA, 64 nt, Homo Sapiens; identical to SEQ ID NO: 28970

SEQ ID NO: 702231 - RNA, 64 nt, Homo Sapiens; identical to SEQ ID NO: 28971

SEQ ID NO: 702232 - RNA, 64 nt, Homo Sapiens; identical to SEQ ID NO: 28972

SEQ ID NO: 702233 - RNA, 64 nt, Homo Sapiens; identical to SEQ ID NO: 28973

SEQ ID NO: 702234 - RNA, 64 nt, Homo Sapiens; identical to SEQ ID NO: 28974

SEQ ID NO: 702235 - RNA, 64 nt, Homo Sapiens; identical to SEQ ID NO: 28975

SEQ ID NO: 702236 - RNA, 64 nt, Homo Sapiens; identical to SEQ ID NO: 28976

SEQ ID NO: 702237 - RNA, 64 nt, Homo Sapiens; identical to SEQ ID NO: 28977

SEQ ID NO: 702238 - RNA, 64 nt, Homo Sapiens; identical to SEQ ID NO: 28978

SEQ ID NO: 702239 - RNA, 64 nt, Homo Sapiens; identical to SEQ ID NO: 28979

SEQ ID NO: 702240 - RNA, 64 nt, Homo Sapiens; identical to SEQ ID NO: 28980

SEQ ID NO: 702241 - RNA, 64 nt, Homo Sapiens; identical to SEQ ID NO: 28981

SEQ ID NO: 702242 - RNA, 64 nt, Homo Sapiens; identical to SEQ ID NO: 28982

SEQ ID NO: 702243 - RNA, 64 nt, Homo Sapiens; identical to SEQ ID NO: 28983

SEQ ID NO: 702244 - RNA, 64 nt, Homo Sapiens; identical to SEQ ID NO: 28984

SEQ ID NO: 702245 - RNA, 64 nt, Homo Sapiens; identical to SEQ ID NO: 28985

SEQ ID NO: 702246 - RNA, 64 nt, Homo Sapiens; identical to SEQ ID NO: 28986

SEQ ID NO: 702247 - RNA, 64 nt, Homo Sapiens; identical to SEQ ID NO: 28987

SEQ ID NO: 702248 - RNA, 64 nt, Homo Sapiens; identical to SEQ ID NO: 28988

SEQ ID NO: 702249 - RNA, 64 nt, Homo Sapiens; identical to SEQ ID NO: 28989

SEQ ID NO: 702250 - RNA, 64 nt, Homo Sapiens; identical to SEQ ID NO: 28990

SEQ ID NO: 702251 - RNA, 64 nt, Homo Sapiens; identical to SEQ ID NO: 28991

SEQ ID NO: 702252 - RNA, 64 nt, Homo Sapiens; identical to SEQ ID NO: 28992

SEQ ID NO: 702253 - RNA, 64 nt, Homo Sapiens; identical to SEQ ID NO: 28993

SEQ ID NO: 702254 - RNA, 64 nt, Homo Sapiens; identical to SEQ ID NO: 28994

SEQ ID NO: 702255 - RNA, 64 nt, Homo Sapiens; identical to SEQ ID NO: 28995

SEQ ID NO: 702256 - RNA, 64 nt, Homo Sapiens; identical to SEQ ID NO: 28996

SEQ ID NO: 702257 - RNA, 64 nt, Homo Sapiens; identical to SEQ ID NO: 28997

SEQ ID NO: 702258 - RNA, 64 nt, Homo Sapiens; identical to SEQ ID NO: 28998

SEQ ID NO: 702259 - RNA, 64 nt, Homo Sapiens; identical to SEQ ID NO: 28999

SEQ ID NO: 702260 - RNA, 64 nt, Homo Sapiens; identical to SEQ ID NO: 29000

SEQ ID NO: 702261 - RNA, 64 nt, Homo Sapiens; identical to SEQ ID NO: 29001

SEQ ID NO: 702262 - RNA, 64 nt, Homo Sapiens; identical to SEQ ID NO: 29002

SEQ ID NO: 702263 - RNA, 64 nt, Homo Sapiens; identical to SEQ ID NO: 29003

SEQ ID NO: 702264 - RNA, 64 nt, Homo Sapiens; identical to SEQ ID NO: 29004

SEQ ID NO: 702265 - RNA, 64 nt, Homo Sapiens; identical to SEQ ID NO: 29005

SEQ ID NO: 702266 - RNA, 64 nt, Homo Sapiens; identical to SEQ ID NO: 29006

SEQ ID NO: 702267 - RNA, 64 nt, Homo Sapiens; identical to SEQ ID NO: 29007

SEQ ID NO: 702268 - RNA, 64 nt, Homo Sapiens; identical to SEQ ID NO: 29008

SEQ ID NO: 702269 - RNA, 64 nt, Homo Sapiens; identical to SEQ ID NO: 29009

SEQ ID NO: 702270 - RNA, 64 nt, Homo Sapiens; identical to SEQ ID NO: 29010

SEQ ID NO: 702271 - RNA, 64 nt, Homo Sapiens; identical to SEQ ID NO: 29011

SEQ ID NO: 702272 - RNA, 64 nt, Homo Sapiens; identical to SEQ ID NO: 29012

SEQ ID NO: 702273 - RNA, 64 nt, Homo Sapiens; identical to SEQ ID NO: 29013

SEQ ID NO: 702274 - RNA, 64 nt, Homo Sapiens; identical to SEQ ID NO: 29014

SEQ ID NO: 702275 - RNA, 64 nt, Homo Sapiens; identical to SEQ ID NO: 29015

SEQ ID NO: 702276 - RNA, 64 nt, Homo Sapiens; identical to SEQ ID NO: 29016

SEQ ID NO: 702277 - RNA, 64 nt, Homo Sapiens; identical to SEQ ID NO: 29017

SEQ ID NO: 702278 - RNA, 64 nt, Homo Sapiens; identical to SEQ ID NO: 29018

SEQ ID NO: 702279 - RNA, 64 nt, Homo Sapiens; identical to SEQ ID NO: 29019

SEQ ID NO: 702280 - RNA, 64 nt, Homo Sapiens; identical to SEQ ID NO: 29020

SEQ ID NO: 702281 - RNA, 64 nt, Homo Sapiens; identical to SEQ ID NO: 29021

SEQ ID NO: 702282 - RNA, 64 nt, Homo Sapiens; identical to SEQ ID NO: 29022

SEQ ID NO: 702283 - RNA, 64 nt, Homo Sapiens; identical to SEQ ID NO: 29023

SEQ ID NO: 702284 - RNA, 64 nt, Homo Sapiens; identical to SEQ ID NO: 29024

SEQ ID NO: 702285 - RNA, 64 nt, Homo Sapiens; identical to SEQ ID NO: 29025

SEQ ID NO: 702286 - RNA, 64 nt, Homo Sapiens; identical to SEQ ID NO: 29026

SEQ ID NO: 702287 - RNA, 64 nt, Homo Sapiens; identical to SEQ ID NO: 29027

SEQ ID NO: 702288 - RNA, 64 nt, Homo Sapiens; identical to SEQ ID NO: 29028

SEQ ID NO: 702289 - RNA, 64 nt, Homo Sapiens; identical to SEQ ID NO: 29029

SEQ ID NO: 702290 - RNA, 64 nt, Homo Sapiens; identical to SEQ ID NO: 29030

SEQ ID NO: 702291 - RNA, 64 nt, Homo Sapiens; identical to SEQ ID NO: 29031

SEQ ID NO: 702292 - RNA, 64 nt, Homo Sapiens; identical to SEQ ID NO: 29032

SEQ ID NO: 702293 - RNA, 64 nt, Homo Sapiens; identical to SEQ ID NO: 29033

SEQ ID NO: 702294 - RNA, 64 nt, Homo Sapiens; identical to SEQ ID NO: 29034

SEQ ID NO: 702295 - RNA, 64 nt, Homo Sapiens; identical to SEQ ID NO: 29035

SEQ ID NO: 702296 - RNA, 64 nt, Homo Sapiens; identical to SEQ ID NO: 29036

SEQ ID NO: 702297 - RNA, 64 nt, Homo Sapiens; identical to SEQ ID NO: 29037

SEQ ID NO: 702298 - RNA, 64 nt, Homo Sapiens; identical to SEQ ID NO: 29038

SEQ ID NO: 702299 - RNA, 64 nt, Homo Sapiens; identical to SEQ ID NO: 29039

SEQ ID NO: 702300 - RNA, 64 nt, Homo Sapiens; identical to SEQ ID NO: 29040

SEQ ID NO: 702301 - RNA, 64 nt, Homo Sapiens; identical to SEQ ID NO: 29041

SEQ ID NO: 702302 - RNA, 64 nt, Homo Sapiens; identical to SEQ ID NO: 29042

SEQ ID NO: 702303 - RNA, 64 nt, Homo Sapiens; identical to SEQ ID NO: 29043

SEQ ID NO: 702304 - RNA, 64 nt, Homo Sapiens; identical to SEQ ID NO: 29044

SEQ ID NO: 702305 - RNA, 64 nt, Homo Sapiens; identical to SEQ ID NO: 29045

SEQ ID NO: 702306 - RNA, 64 nt, Homo Sapiens; identical to SEQ ID NO: 29046

SEQ ID NO: 702307 - RNA, 64 nt, Homo Sapiens; identical to SEQ ID NO: 29047

SEQ ID NO: 702308 - RNA, 64 nt, Homo Sapiens; identical to SEQ ID NO: 29048

SEQ ID NO: 702309 - RNA, 64 nt, Homo Sapiens; identical to SEQ ID NO: 29049

SEQ ID NO: 702310 - RNA, 64 nt, Homo Sapiens; identical to SEQ ID NO: 29050

SEQ ID NO: 702311 - RNA, 64 nt, Homo Sapiens; identical to SEQ ID NO: 29051

SEQ ID NO: 702312 - RNA, 64 nt, Homo Sapiens; identical to SEQ ID NO: 29052

SEQ ID NO: 702313 - RNA, 64 nt, Homo Sapiens; identical to SEQ ID NO: 29053

SEQ ID NO: 702314 - RNA, 64 nt, Homo Sapiens; identical to SEQ ID NO: 29054

SEQ ID NO: 702315 - RNA, 64 nt, Homo Sapiens; identical to SEQ ID NO: 29055

SEQ ID NO: 702316 - RNA, 64 nt, Homo Sapiens; identical to SEQ ID NO: 29056

SEQ ID NO: 702317 - RNA, 64 nt, Homo Sapiens; identical to SEQ ID NO: 29057

SEQ ID NO: 702318 - RNA, 64 nt, Homo Sapiens; identical to SEQ ID NO: 29058

SEQ ID NO: 702319 - RNA, 64 nt, Homo Sapiens; identical to SEQ ID NO: 29059

SEQ ID NO: 702320 - RNA, 64 nt, Homo Sapiens; identical to SEQ ID NO: 29060

SEQ ID NO: 702321 - RNA, 64 nt, Homo Sapiens; identical to SEQ ID NO: 29061

SEQ ID NO: 702322 - RNA, 64 nt, Homo Sapiens; identical to SEQ ID NO: 29062

SEQ ID NO: 702323 - RNA, 64 nt, Homo Sapiens; identical to SEQ ID NO: 29063

SEQ ID NO: 702324 - RNA, 64 nt, Homo Sapiens; identical to SEQ ID NO: 29064

SEQ ID NO: 702325 - RNA, 64 nt, Homo Sapiens; identical to SEQ ID NO: 29065

SEQ ID NO: 702326 - RNA, 64 nt, Homo Sapiens; identical to SEQ ID NO: 29066

SEQ ID NO: 702327 - RNA, 64 nt, Homo Sapiens; identical to SEQ ID NO: 29067

SEQ ID NO: 702328 - RNA, 64 nt, Homo Sapiens; identical to SEQ ID NO: 29068

SEQ ID NO: 702329 - RNA, 64 nt, Homo Sapiens; identical to SEQ ID NO: 29069

SEQ ID NO: 702330 - RNA, 64 nt, Homo Sapiens; identical to SEQ ID NO: 29070

SEQ ID NO: 702331 - RNA, 64 nt, Homo Sapiens; identical to SEQ ID NO: 29071

SEQ ID NO: 702332 - RNA, 64 nt, Homo Sapiens; identical to SEQ ID NO: 29072

SEQ ID NO: 702333 - RNA, 64 nt, Homo Sapiens; identical to SEQ ID NO: 29073

SEQ ID NO: 702334 - RNA, 64 nt, Homo Sapiens; identical to SEQ ID NO: 29074

SEQ ID NO: 702335 - RNA, 64 nt, Homo Sapiens; identical to SEQ ID NO: 29075

SEQ ID NO: 702336 - RNA, 64 nt, Homo Sapiens; identical to SEQ ID NO: 29076

SEQ ID NO: 702337 - RNA, 64 nt, Homo Sapiens; identical to SEQ ID NO: 29077

SEQ ID NO: 702338 - RNA, 64 nt, Homo Sapiens; identical to SEQ ID NO: 29078

SEQ ID NO: 702339 - RNA, 64 nt, Homo Sapiens; identical to SEQ ID NO: 29079

SEQ ID NO: 702340 - RNA, 64 nt, Homo Sapiens; identical to SEQ ID NO: 29080

SEQ ID NO: 702341 - RNA, 64 nt, Homo Sapiens; identical to SEQ ID NO: 29081

SEQ ID NO: 702342 - RNA, 64 nt, Homo Sapiens; identical to SEQ ID NO: 29082

SEQ ID NO: 702343 - RNA, 64 nt, Homo Sapiens; identical to SEQ ID NO: 29083

SEQ ID NO: 702344 - RNA, 64 nt, Homo Sapiens; identical to SEQ ID NO: 29084

SEQ ID NO: 702345 - RNA, 64 nt, Homo Sapiens; identical to SEQ ID NO: 29085

SEQ ID NO: 702346 - RNA, 64 nt, Homo Sapiens; identical to SEQ ID NO: 29086

SEQ ID NO: 702347 - RNA, 64 nt, Homo Sapiens; identical to SEQ ID NO: 29087

SEQ ID NO: 702348 - RNA, 64 nt, Homo Sapiens; identical to SEQ ID NO: 29088

SEQ ID NO: 702349 - RNA, 64 nt, Homo Sapiens; identical to SEQ ID NO: 29089

SEQ ID NO: 702350 - RNA, 64 nt, Homo Sapiens; identical to SEQ ID NO: 29090

SEQ ID NO: 702351 - RNA, 64 nt, Homo Sapiens; identical to SEQ ID NO: 29091

SEQ ID NO: 702352 - RNA, 64 nt, Homo Sapiens; identical to SEQ ID NO: 29092

SEQ ID NO: 702353 - RNA, 64 nt, Homo Sapiens; identical to SEQ ID NO: 29093

SEQ ID NO: 702354 - RNA, 64 nt, Homo Sapiens; identical to SEQ ID NO: 29094

SEQ ID NO: 702355 - RNA, 64 nt, Homo Sapiens; identical to SEQ ID NO: 29095

SEQ ID NO: 702356 - RNA, 64 nt, Homo Sapiens; identical to SEQ ID NO: 29096

SEQ ID NO: 702357 - RNA, 64 nt, Homo Sapiens; identical to SEQ ID NO: 29097

SEQ ID NO: 702358 - RNA, 64 nt, Homo Sapiens; identical to SEQ ID NO: 29098

SEQ ID NO: 702359 - RNA, 64 nt, Homo Sapiens; identical to SEQ ID NO: 29099

SEQ ID NO: 702360 - RNA, 64 nt, Homo Sapiens; identical to SEQ ID NO: 29100

SEQ ID NO: 702361 - RNA, 64 nt, Homo Sapiens; identical to SEQ ID NO: 29101

SEQ ID NO: 702362 - RNA, 64 nt, Homo Sapiens; identical to SEQ ID NO: 29102

SEQ ID NO: 702363 - RNA, 64 nt, Homo Sapiens; identical to SEQ ID NO: 29103

SEQ ID NO: 702364 - RNA, 64 nt, Homo Sapiens; identical to SEQ ID NO: 29104

SEQ ID NO: 702365 - RNA, 62 nt, Homo Sapiens; identical to SEQ ID NO: 29105

SEQ ID NO: 702366 - RNA, 63 nt, Homo Sapiens; identical to SEQ ID NO: 29106

SEQ ID NO: 702367 - RNA, 64 nt, Homo Sapiens; identical to SEQ ID NO: 29107

SEQ ID NO: 702368 - RNA, 64 nt, Homo Sapiens; identical to SEQ ID NO: 29108

SEQ ID NO: 702369 - RNA, 64 nt, Homo Sapiens; identical to SEQ ID NO: 29109

SEQ ID NO: 702370 - RNA, 64 nt, Homo Sapiens; identical to SEQ ID NO: 29110

SEQ ID NO: 702371 - RNA, 64 nt, Homo Sapiens; identical to SEQ ID NO: 29111

SEQ ID NO: 702372 - RNA, 64 nt, Homo Sapiens; identical to SEQ ID NO: 29112

SEQ ID NO: 702373 - RNA, 64 nt, Homo Sapiens; identical to SEQ ID NO: 29113

SEQ ID NO: 702374 - RNA, 64 nt, Homo Sapiens; identical to SEQ ID NO: 29114

SEQ ID NO: 702375 - RNA, 64 nt, Homo Sapiens; identical to SEQ ID NO: 29115

SEQ ID NO: 702376 - RNA, 64 nt, Homo Sapiens; identical to SEQ ID NO: 29116

SEQ ID NO: 702377 - RNA, 64 nt, Homo Sapiens; identical to SEQ ID NO: 29117

SEQ ID NO: 702378 - RNA, 64 nt, Homo Sapiens; identical to SEQ ID NO: 29118

SEQ ID NO: 702379 - RNA, 64 nt, Homo Sapiens; identical to SEQ ID NO: 29119

SEQ ID NO: 702380 - RNA, 64 nt, Homo Sapiens; identical to SEQ ID NO: 29120

SEQ ID NO: 702381 - RNA, 64 nt, Homo Sapiens; identical to SEQ ID NO: 29121

SEQ ID NO: 702382 - RNA, 64 nt, Homo Sapiens; identical to SEQ ID NO: 29122

SEQ ID NO: 702383 - RNA, 64 nt, Homo Sapiens; identical to SEQ ID NO: 29123

SEQ ID NO: 702384 - RNA, 64 nt, Homo Sapiens; identical to SEQ ID NO: 29124

SEQ ID NO: 702385 - RNA, 64 nt, Homo Sapiens; identical to SEQ ID NO: 29125

SEQ ID NO: 702386 - RNA, 64 nt, Homo Sapiens; identical to SEQ ID NO: 29126

SEQ ID NO: 702387 - RNA, 64 nt, Homo Sapiens; identical to SEQ ID NO: 29127

SEQ ID NO: 702388 - RNA, 64 nt, Homo Sapiens; identical to SEQ ID NO: 29128

SEQ ID NO: 702389 - RNA, 64 nt, Homo Sapiens; identical to SEQ ID NO: 29129

SEQ ID NO: 702390 - RNA, 64 nt, Homo Sapiens; identical to SEQ ID NO: 29130

SEQ ID NO: 702391 - RNA, 64 nt, Homo Sapiens; identical to SEQ ID NO: 29131

SEQ ID NO: 702392 - RNA, 64 nt, Homo Sapiens; identical to SEQ ID NO: 29132

SEQ ID NO: 702393 - RNA, 64 nt, Homo Sapiens; identical to SEQ ID NO: 29133

SEQ ID NO: 702394 - RNA, 64 nt, Homo Sapiens; identical to SEQ ID NO: 29134

SEQ ID NO: 702395 - RNA, 64 nt, Homo Sapiens; identical to SEQ ID NO: 29135

SEQ ID NO: 702396 - RNA, 64 nt, Homo Sapiens; identical to SEQ ID NO: 29136

SEQ ID NO: 702397 - RNA, 64 nt, Homo Sapiens; identical to SEQ ID NO: 29137

SEQ ID NO: 702398 - RNA, 64 nt, Homo Sapiens; identical to SEQ ID NO: 29138

SEQ ID NO: 702399 - RNA, 64 nt, Homo Sapiens; identical to SEQ ID NO: 29139

SEQ ID NO: 702400 - RNA, 64 nt, Homo Sapiens; identical to SEQ ID NO: 29140

SEQ ID NO: 702401 - RNA, 64 nt, Homo Sapiens; identical to SEQ ID NO: 29141

SEQ ID NO: 702402 - RNA, 64 nt, Homo Sapiens; identical to SEQ ID NO: 29142

SEQ ID NO: 702403 - RNA, 64 nt, Homo Sapiens; identical to SEQ ID NO: 29143

SEQ ID NO: 702404 - RNA, 64 nt, Homo Sapiens; identical to SEQ ID NO: 29144

SEQ ID NO: 702405 - RNA, 64 nt, Homo Sapiens; identical to SEQ ID NO: 29145

SEQ ID NO: 702406 - RNA, 64 nt, Homo Sapiens; identical to SEQ ID NO: 29146

SEQ ID NO: 702407 - RNA, 64 nt, Homo Sapiens; identical to SEQ ID NO: 29147

SEQ ID NO: 702408 - RNA, 64 nt, Homo Sapiens; identical to SEQ ID NO: 29148

SEQ ID NO: 702409 - RNA, 64 nt, Homo Sapiens; identical to SEQ ID NO: 29149

SEQ ID NO: 702410 - RNA, 64 nt, Homo Sapiens; identical to SEQ ID NO: 29150

SEQ ID NO: 702411 - RNA, 64 nt, Homo Sapiens; identical to SEQ ID NO: 29151

SEQ ID NO: 702412 - RNA, 64 nt, Homo Sapiens; identical to SEQ ID NO: 29152

SEQ ID NO: 702413 - RNA, 64 nt, Homo Sapiens; identical to SEQ ID NO: 29153

SEQ ID NO: 702414 - RNA, 64 nt, Homo Sapiens; identical to SEQ ID NO: 29154

SEQ ID NO: 702415 - RNA, 64 nt, Homo Sapiens; identical to SEQ ID NO: 29155

SEQ ID NO: 702416 - RNA, 64 nt, Homo Sapiens; identical to SEQ ID NO: 29156

SEQ ID NO: 702417 - RNA, 64 nt, Homo Sapiens; identical to SEQ ID NO: 29157

SEQ ID NO: 702418 - RNA, 64 nt, Homo Sapiens; identical to SEQ ID NO: 29158

SEQ ID NO: 702419 - RNA, 64 nt, Homo Sapiens; identical to SEQ ID NO: 29159

SEQ ID NO: 702420 - RNA, 64 nt, Homo Sapiens; identical to SEQ ID NO: 29160

SEQ ID NO: 702421 - RNA, 64 nt, Homo Sapiens; identical to SEQ ID NO: 29161

SEQ ID NO: 702422 - RNA, 64 nt, Homo Sapiens; identical to SEQ ID NO: 29162

SEQ ID NO: 702423 - RNA, 64 nt, Homo Sapiens; identical to SEQ ID NO: 29163

SEQ ID NO: 702424 - RNA, 64 nt, Homo Sapiens; identical to SEQ ID NO: 29164

SEQ ID NO: 702425 - RNA, 64 nt, Homo Sapiens; identical to SEQ ID NO: 29165

SEQ ID NO: 702426 - RNA, 64 nt, Homo Sapiens; identical to SEQ ID NO: 29166

SEQ ID NO: 702427 - RNA, 64 nt, Homo Sapiens; identical to SEQ ID NO: 29167

SEQ ID NO: 702428 - RNA, 64 nt, Homo Sapiens; identical to SEQ ID NO: 29168

SEQ ID NO: 702429 - RNA, 64 nt, Homo Sapiens; identical to SEQ ID NO: 29169

SEQ ID NO: 702430 - RNA, 64 nt, Homo Sapiens; identical to SEQ ID NO: 29170

SEQ ID NO: 702431 - RNA, 64 nt, Homo Sapiens; identical to SEQ ID NO: 29171

SEQ ID NO: 702432 - RNA, 64 nt, Homo Sapiens; identical to SEQ ID NO: 29172

SEQ ID NO: 702433 - RNA, 64 nt, Homo Sapiens; identical to SEQ ID NO: 29173

SEQ ID NO: 702434 - RNA, 64 nt, Homo Sapiens; identical to SEQ ID NO: 29174

SEQ ID NO: 702435 - RNA, 64 nt, Homo Sapiens; identical to SEQ ID NO: 29175

SEQ ID NO: 702436 - RNA, 64 nt, Homo Sapiens; identical to SEQ ID NO: 29176

SEQ ID NO: 702437 - RNA, 64 nt, Homo Sapiens; identical to SEQ ID NO: 29177

SEQ ID NO: 702438 - RNA, 64 nt, Homo Sapiens; identical to SEQ ID NO: 29178

SEQ ID NO: 702439 - RNA, 64 nt, Homo Sapiens; identical to SEQ ID NO: 29179

SEQ ID NO: 702440 - RNA, 64 nt, Homo Sapiens; identical to SEQ ID NO: 29180

SEQ ID NO: 702441 - RNA, 64 nt, Homo Sapiens; identical to SEQ ID NO: 29181

SEQ ID NO: 702442 - RNA, 64 nt, Homo Sapiens; identical to SEQ ID NO: 29182

SEQ ID NO: 702443 - RNA, 64 nt, Homo Sapiens; identical to SEQ ID NO: 29183

SEQ ID NO: 702444 - RNA, 64 nt, Homo Sapiens; identical to SEQ ID NO: 29184

SEQ ID NO: 702445 - RNA, 64 nt, Homo Sapiens; identical to SEQ ID NO: 29185

SEQ ID NO: 702446 - RNA, 64 nt, Homo Sapiens; identical to SEQ ID NO: 29186

SEQ ID NO: 702447 - RNA, 64 nt, Homo Sapiens; identical to SEQ ID NO: 29187

SEQ ID NO: 702448 - RNA, 64 nt, Homo Sapiens; identical to SEQ ID NO: 29188

SEQ ID NO: 702449 - RNA, 64 nt, Homo Sapiens; identical to SEQ ID NO: 29189

SEQ ID NO: 702450 - RNA, 64 nt, Homo Sapiens; identical to SEQ ID NO: 29190

SEQ ID NO: 702451 - RNA, 64 nt, Homo Sapiens; identical to SEQ ID NO: 29191

SEQ ID NO: 702452 - RNA, 64 nt, Homo Sapiens; identical to SEQ ID NO: 29192

SEQ ID NO: 702453 - RNA, 64 nt, Homo Sapiens; identical to SEQ ID NO: 29193

SEQ ID NO: 702454 - RNA, 64 nt, Homo Sapiens; identical to SEQ ID NO: 29194

SEQ ID NO: 702455 - RNA, 64 nt, Homo Sapiens; identical to SEQ ID NO: 29195

SEQ ID NO: 702456 - RNA, 64 nt, Homo Sapiens; identical to SEQ ID NO: 29196

SEQ ID NO: 702457 - RNA, 64 nt, Homo Sapiens; identical to SEQ ID NO: 29197

SEQ ID NO: 702458 - RNA, 64 nt, Homo Sapiens; identical to SEQ ID NO: 29198

SEQ ID NO: 702459 - RNA, 64 nt, Homo Sapiens; identical to SEQ ID NO: 29199

SEQ ID NO: 702460 - RNA, 64 nt, Homo Sapiens; identical to SEQ ID NO: 29200

SEQ ID NO: 702461 - RNA, 64 nt, Homo Sapiens; identical to SEQ ID NO: 29201

SEQ ID NO: 702462 - RNA, 64 nt, Homo Sapiens; identical to SEQ ID NO: 29202

SEQ ID NO: 702463 - RNA, 64 nt, Homo Sapiens; identical to SEQ ID NO: 29203

SEQ ID NO: 702464 - RNA, 64 nt, Homo Sapiens; identical to SEQ ID NO: 29204

SEQ ID NO: 702465 - RNA, 64 nt, Homo Sapiens; identical to SEQ ID NO: 29205

SEQ ID NO: 702466 - RNA, 64 nt, Homo Sapiens; identical to SEQ ID NO: 29206

SEQ ID NO: 702467 - RNA, 64 nt, Homo Sapiens; identical to SEQ ID NO: 29207

SEQ ID NO: 702468 - RNA, 64 nt, Homo Sapiens; identical to SEQ ID NO: 29208

SEQ ID NO: 702469 - RNA, 64 nt, Homo Sapiens; identical to SEQ ID NO: 29209

SEQ ID NO: 702470 - RNA, 64 nt, Homo Sapiens; identical to SEQ ID NO: 29210

SEQ ID NO: 702471 - RNA, 64 nt, Homo Sapiens; identical to SEQ ID NO: 29211

SEQ ID NO: 702472 - RNA, 64 nt, Homo Sapiens; identical to SEQ ID NO: 29212

SEQ ID NO: 702473 - RNA, 64 nt, Homo Sapiens; identical to SEQ ID NO: 29213

SEQ ID NO: 702474 - RNA, 64 nt, Homo Sapiens; identical to SEQ ID NO: 29214

SEQ ID NO: 702475 - RNA, 64 nt, Homo Sapiens; identical to SEQ ID NO: 29215

SEQ ID NO: 702476 - RNA, 64 nt, Homo Sapiens; identical to SEQ ID NO: 29216

SEQ ID NO: 702477 - RNA, 64 nt, Homo Sapiens; identical to SEQ ID NO: 29217

SEQ ID NO: 702478 - RNA, 64 nt, Homo Sapiens; identical to SEQ ID NO: 29218

SEQ ID NO: 702479 - RNA, 64 nt, Homo Sapiens; identical to SEQ ID NO: 29219

SEQ ID NO: 702480 - RNA, 64 nt, Homo Sapiens; identical to SEQ ID NO: 29220

SEQ ID NO: 702481 - RNA, 64 nt, Homo Sapiens; identical to SEQ ID NO: 29221

SEQ ID NO: 702482 - RNA, 64 nt, Homo Sapiens; identical to SEQ ID NO: 29222

SEQ ID NO: 702483 - RNA, 64 nt, Homo Sapiens; identical to SEQ ID NO: 29223

SEQ ID NO: 702484 - RNA, 64 nt, Homo Sapiens; identical to SEQ ID NO: 29224

SEQ ID NO: 702485 - RNA, 64 nt, Homo Sapiens; identical to SEQ ID NO: 29225

SEQ ID NO: 702486 - RNA, 64 nt, Homo Sapiens; identical to SEQ ID NO: 29226

SEQ ID NO: 702487 - RNA, 64 nt, Homo Sapiens; identical to SEQ ID NO: 29227

SEQ ID NO: 702488 - RNA, 64 nt, Homo Sapiens; identical to SEQ ID NO: 29228

SEQ ID NO: 702489 - RNA, 64 nt, Homo Sapiens; identical to SEQ ID NO: 29229

SEQ ID NO: 702490 - RNA, 64 nt, Homo Sapiens; identical to SEQ ID NO: 29230

SEQ ID NO: 702491 - RNA, 64 nt, Homo Sapiens; identical to SEQ ID NO: 29231

SEQ ID NO: 702492 - RNA, 64 nt, Homo Sapiens; identical to SEQ ID NO: 29232

SEQ ID NO: 702493 - RNA, 64 nt, Homo Sapiens; identical to SEQ ID NO: 29233

SEQ ID NO: 702494 - RNA, 64 nt, Homo Sapiens; identical to SEQ ID NO: 29234

SEQ ID NO: 702495 - RNA, 64 nt, Homo Sapiens; identical to SEQ ID NO: 29235

SEQ ID NO: 702496 - RNA, 64 nt, Homo Sapiens; identical to SEQ ID NO: 29236

SEQ ID NO: 702497 - RNA, 64 nt, Homo Sapiens; identical to SEQ ID NO: 29237

SEQ ID NO: 702498 - RNA, 64 nt, Homo Sapiens; identical to SEQ ID NO: 29238

SEQ ID NO: 702499 - RNA, 64 nt, Homo Sapiens; identical to SEQ ID NO: 29239

SEQ ID NO: 702500 - RNA, 64 nt, Homo Sapiens; identical to SEQ ID NO: 29240

SEQ ID NO: 702501 - RNA, 64 nt, Homo Sapiens; identical to SEQ ID NO: 29241

SEQ ID NO: 702502 - RNA, 64 nt, Homo Sapiens; identical to SEQ ID NO: 29242

SEQ ID NO: 702503 - RNA, 64 nt, Homo Sapiens; identical to SEQ ID NO: 29243

SEQ ID NO: 702504 - RNA, 64 nt, Homo Sapiens; identical to SEQ ID NO: 29244

SEQ ID NO: 702505 - RNA, 64 nt, Homo Sapiens; identical to SEQ ID NO: 29245

SEQ ID NO: 702506 - RNA, 64 nt, Homo Sapiens; identical to SEQ ID NO: 29246

SEQ ID NO: 702507 - RNA, 64 nt, Homo Sapiens; identical to SEQ ID NO: 29247

SEQ ID NO: 702508 - RNA, 64 nt, Homo Sapiens; identical to SEQ ID NO: 29248

SEQ ID NO: 702509 - RNA, 64 nt, Homo Sapiens; identical to SEQ ID NO: 29249

SEQ ID NO: 702510 - RNA, 64 nt, Homo Sapiens; identical to SEQ ID NO: 29250

SEQ ID NO: 702511 - RNA, 64 nt, Homo Sapiens; identical to SEQ ID NO: 29251

SEQ ID NO: 702512 - RNA, 64 nt, Homo Sapiens; identical to SEQ ID NO: 29252

SEQ ID NO: 702513 - RNA, 64 nt, Homo Sapiens; identical to SEQ ID NO: 29253

SEQ ID NO: 702514 - RNA, 64 nt, Homo Sapiens; identical to SEQ ID NO: 29254

SEQ ID NO: 702515 - RNA, 64 nt, Homo Sapiens; identical to SEQ ID NO: 29255

SEQ ID NO: 702516 - RNA, 64 nt, Homo Sapiens; identical to SEQ ID NO: 29256

SEQ ID NO: 702517 - RNA, 64 nt, Homo Sapiens; identical to SEQ ID NO: 29257

SEQ ID NO: 702518 - RNA, 64 nt, Homo Sapiens; identical to SEQ ID NO: 29258

SEQ ID NO: 702519 - RNA, 64 nt, Homo Sapiens; identical to SEQ ID NO: 29259

SEQ ID NO: 702520 - RNA, 64 nt, Homo Sapiens; identical to SEQ ID NO: 29260

SEQ ID NO: 702521 - RNA, 64 nt, Homo Sapiens; identical to SEQ ID NO: 29261

SEQ ID NO: 702522 - RNA, 64 nt, Homo Sapiens; identical to SEQ ID NO: 29262

SEQ ID NO: 702523 - RNA, 64 nt, Homo Sapiens; identical to SEQ ID NO: 29263

SEQ ID NO: 702524 - RNA, 64 nt, Homo Sapiens; identical to SEQ ID NO: 29264

SEQ ID NO: 702525 - RNA, 64 nt, Homo Sapiens; identical to SEQ ID NO: 29265

SEQ ID NO: 702526 - RNA, 64 nt, Homo Sapiens; identical to SEQ ID NO: 29266

SEQ ID NO: 702527 - RNA, 64 nt, Homo Sapiens; identical to SEQ ID NO: 29267

SEQ ID NO: 702528 - RNA, 64 nt, Homo Sapiens; identical to SEQ ID NO: 29268

SEQ ID NO: 702529 - RNA, 64 nt, Homo Sapiens; identical to SEQ ID NO: 29269

SEQ ID NO: 702530 - RNA, 64 nt, Homo Sapiens; identical to SEQ ID NO: 29270

SEQ ID NO: 702531 - RNA, 64 nt, Homo Sapiens; identical to SEQ ID NO: 29271

SEQ ID NO: 702532 - RNA, 64 nt, Homo Sapiens; identical to SEQ ID NO: 29272

SEQ ID NO: 702533 - RNA, 64 nt, Homo Sapiens; identical to SEQ ID NO: 29273

SEQ ID NO: 702534 - RNA, 64 nt, Homo Sapiens; identical to SEQ ID NO: 29274

SEQ ID NO: 702535 - RNA, 64 nt, Homo Sapiens; identical to SEQ ID NO: 29275

SEQ ID NO: 702536 - RNA, 64 nt, Homo Sapiens; identical to SEQ ID NO: 29276

SEQ ID NO: 702537 - RNA, 64 nt, Homo Sapiens; identical to SEQ ID NO: 29277

SEQ ID NO: 702538 - RNA, 64 nt, Homo Sapiens; identical to SEQ ID NO: 29278

SEQ ID NO: 702539 - RNA, 64 nt, Homo Sapiens; identical to SEQ ID NO: 29279

SEQ ID NO: 702540 - RNA, 64 nt, Homo Sapiens; identical to SEQ ID NO: 29280

SEQ ID NO: 702541 - RNA, 64 nt, Homo Sapiens; identical to SEQ ID NO: 29281

SEQ ID NO: 702542 - RNA, 64 nt, Homo Sapiens; identical to SEQ ID NO: 29282

SEQ ID NO: 702543 - RNA, 64 nt, Homo Sapiens; identical to SEQ ID NO: 29283

SEQ ID NO: 702544 - RNA, 64 nt, Homo Sapiens; identical to SEQ ID NO: 29284

SEQ ID NO: 702545 - RNA, 64 nt, Homo Sapiens; identical to SEQ ID NO: 29285

SEQ ID NO: 702546 - RNA, 64 nt, Homo Sapiens; identical to SEQ ID NO: 29286

SEQ ID NO: 702547 - RNA, 64 nt, Homo Sapiens; identical to SEQ ID NO: 29287

SEQ ID NO: 702548 - RNA, 64 nt, Homo Sapiens; identical to SEQ ID NO: 29288

SEQ ID NO: 702549 - RNA, 64 nt, Homo Sapiens; identical to SEQ ID NO: 29289

SEQ ID NO: 702550 - RNA, 64 nt, Homo Sapiens; identical to SEQ ID NO: 29290

SEQ ID NO: 702551 - RNA, 64 nt, Homo Sapiens; identical to SEQ ID NO: 29291

SEQ ID NO: 702552 - RNA, 64 nt, Homo Sapiens; identical to SEQ ID NO: 29292

SEQ ID NO: 702553 - RNA, 64 nt, Homo Sapiens; identical to SEQ ID NO: 29293

SEQ ID NO: 702554 - RNA, 64 nt, Homo Sapiens; identical to SEQ ID NO: 29294

SEQ ID NO: 702555 - RNA, 64 nt, Homo Sapiens; identical to SEQ ID NO: 29295

SEQ ID NO: 702556 - RNA, 64 nt, Homo Sapiens; identical to SEQ ID NO: 29296

SEQ ID NO: 702557 - RNA, 64 nt, Homo Sapiens; identical to SEQ ID NO: 29297

SEQ ID NO: 702558 - RNA, 64 nt, Homo Sapiens; identical to SEQ ID NO: 29298

SEQ ID NO: 702559 - RNA, 64 nt, Homo Sapiens; identical to SEQ ID NO: 29299

SEQ ID NO: 702560 - RNA, 64 nt, Homo Sapiens; identical to SEQ ID NO: 29300

SEQ ID NO: 702561 - RNA, 64 nt, Homo Sapiens; identical to SEQ ID NO: 29301

SEQ ID NO: 702562 - RNA, 64 nt, Homo Sapiens; identical to SEQ ID NO: 29302

SEQ ID NO: 702563 - RNA, 64 nt, Homo Sapiens; identical to SEQ ID NO: 29303

SEQ ID NO: 702564 - RNA, 64 nt, Homo Sapiens; identical to SEQ ID NO: 29304

SEQ ID NO: 702565 - RNA, 64 nt, Homo Sapiens; identical to SEQ ID NO: 29305

SEQ ID NO: 702566 - RNA, 64 nt, Homo Sapiens; identical to SEQ ID NO: 29306

SEQ ID NO: 702567 - RNA, 64 nt, Homo Sapiens; identical to SEQ ID NO: 29307

SEQ ID NO: 702568 - RNA, 64 nt, Homo Sapiens; identical to SEQ ID NO: 29308

SEQ ID NO: 702569 - RNA, 64 nt, Homo Sapiens; identical to SEQ ID NO: 29309

SEQ ID NO: 702570 - RNA, 64 nt, Homo Sapiens; identical to SEQ ID NO: 29310

SEQ ID NO: 702571 - RNA, 64 nt, Homo Sapiens; identical to SEQ ID NO: 29311

SEQ ID NO: 702572 - RNA, 64 nt, Homo Sapiens; identical to SEQ ID NO: 29312

SEQ ID NO: 702573 - RNA, 64 nt, Homo Sapiens; identical to SEQ ID NO: 29313

SEQ ID NO: 702574 - RNA, 64 nt, Homo Sapiens; identical to SEQ ID NO: 29314

SEQ ID NO: 702575 - RNA, 64 nt, Homo Sapiens; identical to SEQ ID NO: 29315

SEQ ID NO: 702576 - RNA, 64 nt, Homo Sapiens; identical to SEQ ID NO: 29316

SEQ ID NO: 702577 - RNA, 64 nt, Homo Sapiens; identical to SEQ ID NO: 29317

SEQ ID NO: 702578 - RNA, 64 nt, Homo Sapiens; identical to SEQ ID NO: 29318

SEQ ID NO: 702579 - RNA, 64 nt, Homo Sapiens; identical to SEQ ID NO: 29319

SEQ ID NO: 702580 - RNA, 64 nt, Homo Sapiens; identical to SEQ ID NO: 29320

SEQ ID NO: 702581 - RNA, 64 nt, Homo Sapiens; identical to SEQ ID NO: 29321

SEQ ID NO: 702582 - RNA, 64 nt, Homo Sapiens; identical to SEQ ID NO: 29322

SEQ ID NO: 702583 - RNA, 64 nt, Homo Sapiens; identical to SEQ ID NO: 29323

SEQ ID NO: 702584 - RNA, 64 nt, Homo Sapiens; identical to SEQ ID NO: 29324

SEQ ID NO: 702585 - RNA, 64 nt, Homo Sapiens; identical to SEQ ID NO: 29325

SEQ ID NO: 702586 - RNA, 64 nt, Homo Sapiens; identical to SEQ ID NO: 29326

SEQ ID NO: 702587 - RNA, 64 nt, Homo Sapiens; identical to SEQ ID NO: 29327

SEQ ID NO: 702588 - RNA, 64 nt, Homo Sapiens; identical to SEQ ID NO: 29328

SEQ ID NO: 702589 - RNA, 64 nt, Homo Sapiens; identical to SEQ ID NO: 29329

SEQ ID NO: 702590 - RNA, 64 nt, Homo Sapiens; identical to SEQ ID NO: 29330

SEQ ID NO: 702591 - RNA, 64 nt, Homo Sapiens; identical to SEQ ID NO: 29331

SEQ ID NO: 702592 - RNA, 64 nt, Homo Sapiens; identical to SEQ ID NO: 29332

SEQ ID NO: 702593 - RNA, 64 nt, Homo Sapiens; identical to SEQ ID NO: 29333

SEQ ID NO: 702594 - RNA, 64 nt, Homo Sapiens; identical to SEQ ID NO: 29334

SEQ ID NO: 702595 - RNA, 64 nt, Homo Sapiens; identical to SEQ ID NO: 29335

SEQ ID NO: 702596 - RNA, 64 nt, Homo Sapiens; identical to SEQ ID NO: 29336

SEQ ID NO: 702597 - RNA, 64 nt, Homo Sapiens; identical to SEQ ID NO: 29337

SEQ ID NO: 702598 - RNA, 64 nt, Homo Sapiens; identical to SEQ ID NO: 29338

SEQ ID NO: 702599 - RNA, 64 nt, Homo Sapiens; identical to SEQ ID NO: 29339

SEQ ID NO: 702600 - RNA, 64 nt, Homo Sapiens; identical to SEQ ID NO: 29340

SEQ ID NO: 702601 - RNA, 64 nt, Homo Sapiens; identical to SEQ ID NO: 29341

SEQ ID NO: 702602 - RNA, 64 nt, Homo Sapiens; identical to SEQ ID NO: 29342

SEQ ID NO: 702603 - RNA, 64 nt, Homo Sapiens; identical to SEQ ID NO: 29343

SEQ ID NO: 702604 - RNA, 64 nt, Homo Sapiens; identical to SEQ ID NO: 29344

SEQ ID NO: 702605 - RNA, 64 nt, Homo Sapiens; identical to SEQ ID NO: 29345

SEQ ID NO: 702606 - RNA, 64 nt, Homo Sapiens; identical to SEQ ID NO: 29346

SEQ ID NO: 702607 - RNA, 64 nt, Homo Sapiens; identical to SEQ ID NO: 29347

SEQ ID NO: 702608 - RNA, 64 nt, Homo Sapiens; identical to SEQ ID NO: 29348

SEQ ID NO: 702609 - RNA, 64 nt, Homo Sapiens; identical to SEQ ID NO: 29349

SEQ ID NO: 702610 - RNA, 64 nt, Homo Sapiens; identical to SEQ ID NO: 29350

SEQ ID NO: 702611 - RNA, 64 nt, Homo Sapiens; identical to SEQ ID NO: 29351

SEQ ID NO: 702612 - RNA, 64 nt, Homo Sapiens; identical to SEQ ID NO: 29352

SEQ ID NO: 702613 - RNA, 64 nt, Homo Sapiens; identical to SEQ ID NO: 29353

SEQ ID NO: 702614 - RNA, 64 nt, Homo Sapiens; identical to SEQ ID NO: 29354

SEQ ID NO: 702615 - RNA, 64 nt, Homo Sapiens; identical to SEQ ID NO: 29355

SEQ ID NO: 702616 - RNA, 64 nt, Homo Sapiens; identical to SEQ ID NO: 29356

SEQ ID NO: 702617 - RNA, 64 nt, Homo Sapiens; identical to SEQ ID NO: 29357

SEQ ID NO: 702618 - RNA, 64 nt, Homo Sapiens; identical to SEQ ID NO: 29358

SEQ ID NO: 702619 - RNA, 64 nt, Homo Sapiens; identical to SEQ ID NO: 29359

SEQ ID NO: 702620 - RNA, 64 nt, Homo Sapiens; identical to SEQ ID NO: 29360

SEQ ID NO: 702621 - RNA, 64 nt, Homo Sapiens; identical to SEQ ID NO: 29361

SEQ ID NO: 702622 - RNA, 64 nt, Homo Sapiens; identical to SEQ ID NO: 29362

SEQ ID NO: 702623 - RNA, 64 nt, Homo Sapiens; identical to SEQ ID NO: 29363

SEQ ID NO: 702624 - RNA, 64 nt, Homo Sapiens; identical to SEQ ID NO: 29364

SEQ ID NO: 702625 - RNA, 64 nt, Homo Sapiens; identical to SEQ ID NO: 29365

SEQ ID NO: 702626 - RNA, 64 nt, Homo Sapiens; identical to SEQ ID NO: 29366

SEQ ID NO: 702627 - RNA, 64 nt, Homo Sapiens; identical to SEQ ID NO: 29367

SEQ ID NO: 702628 - RNA, 64 nt, Homo Sapiens; identical to SEQ ID NO: 29368

SEQ ID NO: 702629 - RNA, 64 nt, Homo Sapiens; identical to SEQ ID NO: 29369

SEQ ID NO: 702630 - RNA, 64 nt, Homo Sapiens; identical to SEQ ID NO: 29370

SEQ ID NO: 702631 - RNA, 64 nt, Homo Sapiens; identical to SEQ ID NO: 29371

SEQ ID NO: 702632 - RNA, 64 nt, Homo Sapiens; identical to SEQ ID NO: 29372

SEQ ID NO: 702633 - RNA, 64 nt, Homo Sapiens; identical to SEQ ID NO: 29373

SEQ ID NO: 702634 - RNA, 64 nt, Homo Sapiens; identical to SEQ ID NO: 29374

SEQ ID NO: 702635 - RNA, 64 nt, Homo Sapiens; identical to SEQ ID NO: 29375

SEQ ID NO: 702636 - RNA, 64 nt, Homo Sapiens; identical to SEQ ID NO: 29376

SEQ ID NO: 702637 - RNA, 64 nt, Homo Sapiens; identical to SEQ ID NO: 29377

SEQ ID NO: 702638 - RNA, 64 nt, Homo Sapiens; identical to SEQ ID NO: 29378

SEQ ID NO: 702639 - RNA, 64 nt, Homo Sapiens; identical to SEQ ID NO: 29379

SEQ ID NO: 702640 - RNA, 64 nt, Homo Sapiens; identical to SEQ ID NO: 29380

SEQ ID NO: 702641 - RNA, 64 nt, Homo Sapiens; identical to SEQ ID NO: 29381

SEQ ID NO: 702642 - RNA, 64 nt, Homo Sapiens; identical to SEQ ID NO: 29382

SEQ ID NO: 702643 - RNA, 64 nt, Homo Sapiens; identical to SEQ ID NO: 29383

SEQ ID NO: 702644 - RNA, 64 nt, Homo Sapiens; identical to SEQ ID NO: 29384

SEQ ID NO: 702645 - RNA, 64 nt, Homo Sapiens; identical to SEQ ID NO: 29385

SEQ ID NO: 702646 - RNA, 64 nt, Homo Sapiens; identical to SEQ ID NO: 29386

SEQ ID NO: 702647 - RNA, 64 nt, Homo Sapiens; identical to SEQ ID NO: 29387

SEQ ID NO: 702648 - RNA, 64 nt, Homo Sapiens; identical to SEQ ID NO: 29388

SEQ ID NO: 702649 - RNA, 64 nt, Homo Sapiens; identical to SEQ ID NO: 29389

SEQ ID NO: 702650 - RNA, 64 nt, Homo Sapiens; identical to SEQ ID NO: 29390

SEQ ID NO: 702651 - RNA, 64 nt, Homo Sapiens; identical to SEQ ID NO: 29391

SEQ ID NO: 702652 - RNA, 64 nt, Homo Sapiens; identical to SEQ ID NO: 29392

SEQ ID NO: 702653 - RNA, 64 nt, Homo Sapiens; identical to SEQ ID NO: 29393

SEQ ID NO: 702654 - RNA, 64 nt, Homo Sapiens; identical to SEQ ID NO: 29394

SEQ ID NO: 702655 - RNA, 64 nt, Homo Sapiens; identical to SEQ ID NO: 29395

SEQ ID NO: 702656 - RNA, 64 nt, Homo Sapiens; identical to SEQ ID NO: 29396

SEQ ID NO: 702657 - RNA, 64 nt, Homo Sapiens; identical to SEQ ID NO: 29397

SEQ ID NO: 702658 - RNA, 64 nt, Homo Sapiens; identical to SEQ ID NO: 29398

SEQ ID NO: 702659 - RNA, 64 nt, Homo Sapiens; identical to SEQ ID NO: 29399

SEQ ID NO: 702660 - RNA, 64 nt, Homo Sapiens; identical to SEQ ID NO: 29400

SEQ ID NO: 702661 - RNA, 64 nt, Homo Sapiens; identical to SEQ ID NO: 29401

SEQ ID NO: 702662 - RNA, 64 nt, Homo Sapiens; identical to SEQ ID NO: 29402

SEQ ID NO: 702663 - RNA, 64 nt, Homo Sapiens; identical to SEQ ID NO: 29403

SEQ ID NO: 702664 - RNA, 64 nt, Homo Sapiens; identical to SEQ ID NO: 29404

SEQ ID NO: 702665 - RNA, 64 nt, Homo Sapiens; identical to SEQ ID NO: 29405

SEQ ID NO: 702666 - RNA, 64 nt, Homo Sapiens; identical to SEQ ID NO: 29406

SEQ ID NO: 702667 - RNA, 64 nt, Homo Sapiens; identical to SEQ ID NO: 29407

SEQ ID NO: 702668 - RNA, 64 nt, Homo Sapiens; identical to SEQ ID NO: 29408

SEQ ID NO: 702669 - RNA, 64 nt, Homo Sapiens; identical to SEQ ID NO: 29409

SEQ ID NO: 702670 - RNA, 64 nt, Homo Sapiens; identical to SEQ ID NO: 29410

SEQ ID NO: 702671 - RNA, 64 nt, Homo Sapiens; identical to SEQ ID NO: 29411

SEQ ID NO: 702672 - RNA, 64 nt, Homo Sapiens; identical to SEQ ID NO: 29412

SEQ ID NO: 702673 - RNA, 64 nt, Homo Sapiens; identical to SEQ ID NO: 29413

SEQ ID NO: 702674 - RNA, 64 nt, Homo Sapiens; identical to SEQ ID NO: 29414

SEQ ID NO: 702675 - RNA, 64 nt, Homo Sapiens; identical to SEQ ID NO: 29415

SEQ ID NO: 702676 - RNA, 64 nt, Homo Sapiens; identical to SEQ ID NO: 29416

SEQ ID NO: 702677 - RNA, 64 nt, Homo Sapiens; identical to SEQ ID NO: 29417

SEQ ID NO: 702678 - RNA, 64 nt, Homo Sapiens; identical to SEQ ID NO: 29418

SEQ ID NO: 702679 - RNA, 64 nt, Homo Sapiens; identical to SEQ ID NO: 29419

SEQ ID NO: 702680 - RNA, 64 nt, Homo Sapiens; identical to SEQ ID NO: 29420

SEQ ID NO: 702681 - RNA, 64 nt, Homo Sapiens; identical to SEQ ID NO: 29421

SEQ ID NO: 702682 - RNA, 64 nt, Homo Sapiens; identical to SEQ ID NO: 29422

SEQ ID NO: 702683 - RNA, 64 nt, Homo Sapiens; identical to SEQ ID NO: 29423

SEQ ID NO: 702684 - RNA, 64 nt, Homo Sapiens; identical to SEQ ID NO: 29424

SEQ ID NO: 702685 - RNA, 64 nt, Homo Sapiens; identical to SEQ ID NO: 29425

SEQ ID NO: 702686 - RNA, 64 nt, Homo Sapiens; identical to SEQ ID NO: 29426

SEQ ID NO: 702687 - RNA, 64 nt, Homo Sapiens; identical to SEQ ID NO: 29427

SEQ ID NO: 702688 - RNA, 64 nt, Homo Sapiens; identical to SEQ ID NO: 29428

SEQ ID NO: 702689 - RNA, 64 nt, Homo Sapiens; identical to SEQ ID NO: 29429

SEQ ID NO: 702690 - RNA, 64 nt, Homo Sapiens; identical to SEQ ID NO: 29430

SEQ ID NO: 702691 - RNA, 64 nt, Homo Sapiens; identical to SEQ ID NO: 29431

SEQ ID NO: 702692 - RNA, 64 nt, Homo Sapiens; identical to SEQ ID NO: 29432

SEQ ID NO: 702693 - RNA, 64 nt, Homo Sapiens; identical to SEQ ID NO: 29433

SEQ ID NO: 702694 - RNA, 64 nt, Homo Sapiens; identical to SEQ ID NO: 29434

SEQ ID NO: 702695 - RNA, 64 nt, Homo Sapiens; identical to SEQ ID NO: 29435

SEQ ID NO: 702696 - RNA, 64 nt, Homo Sapiens; identical to SEQ ID NO: 29436

SEQ ID NO: 702697 - RNA, 64 nt, Homo Sapiens; identical to SEQ ID NO: 29437

SEQ ID NO: 702698 - RNA, 64 nt, Homo Sapiens; identical to SEQ ID NO: 29438

SEQ ID NO: 702699 - RNA, 64 nt, Homo Sapiens; identical to SEQ ID NO: 29439

SEQ ID NO: 702700 - RNA, 64 nt, Homo Sapiens; identical to SEQ ID NO: 29440

SEQ ID NO: 702701 - RNA, 64 nt, Homo Sapiens; identical to SEQ ID NO: 29441

SEQ ID NO: 702702 - RNA, 64 nt, Homo Sapiens; identical to SEQ ID NO: 29442

SEQ ID NO: 702703 - RNA, 64 nt, Homo Sapiens; identical to SEQ ID NO: 29443

SEQ ID NO: 702704 - RNA, 64 nt, Homo Sapiens; identical to SEQ ID NO: 29444

SEQ ID NO: 702705 - RNA, 64 nt, Homo Sapiens; identical to SEQ ID NO: 29445

SEQ ID NO: 702706 - RNA, 64 nt, Homo Sapiens; identical to SEQ ID NO: 29446

SEQ ID NO: 702707 - RNA, 64 nt, Homo Sapiens; identical to SEQ ID NO: 29447

SEQ ID NO: 702708 - RNA, 64 nt, Homo Sapiens; identical to SEQ ID NO: 29448

SEQ ID NO: 702709 - RNA, 64 nt, Homo Sapiens; identical to SEQ ID NO: 29449

SEQ ID NO: 702710 - RNA, 64 nt, Homo Sapiens; identical to SEQ ID NO: 29450

SEQ ID NO: 702711 - RNA, 64 nt, Homo Sapiens; identical to SEQ ID NO: 29451

SEQ ID NO: 702712 - RNA, 64 nt, Homo Sapiens; identical to SEQ ID NO: 29452

SEQ ID NO: 702713 - RNA, 64 nt, Homo Sapiens; identical to SEQ ID NO: 29453

SEQ ID NO: 702714 - RNA, 64 nt, Homo Sapiens; identical to SEQ ID NO: 29454

SEQ ID NO: 702715 - RNA, 64 nt, Homo Sapiens; identical to SEQ ID NO: 29455

SEQ ID NO: 702716 - RNA, 64 nt, Homo Sapiens; identical to SEQ ID NO: 29456

SEQ ID NO: 702717 - RNA, 64 nt, Homo Sapiens; identical to SEQ ID NO: 29457

SEQ ID NO: 702718 - RNA, 64 nt, Homo Sapiens; identical to SEQ ID NO: 29458

SEQ ID NO: 702719 - RNA, 64 nt, Homo Sapiens; identical to SEQ ID NO: 29459

SEQ ID NO: 702720 - RNA, 64 nt, Homo Sapiens; identical to SEQ ID NO: 29460

SEQ ID NO: 702721 - RNA, 64 nt, Homo Sapiens; identical to SEQ ID NO: 29461

SEQ ID NO: 702722 - RNA, 64 nt, Homo Sapiens; identical to SEQ ID NO: 29462

SEQ ID NO: 702723 - RNA, 64 nt, Homo Sapiens; identical to SEQ ID NO: 29463

SEQ ID NO: 702724 - RNA, 64 nt, Homo Sapiens; identical to SEQ ID NO: 29464

SEQ ID NO: 702725 - RNA, 64 nt, Homo Sapiens; identical to SEQ ID NO: 29465

SEQ ID NO: 702726 - RNA, 64 nt, Homo Sapiens; identical to SEQ ID NO: 29466

SEQ ID NO: 702727 - RNA, 64 nt, Homo Sapiens; identical to SEQ ID NO: 29467

SEQ ID NO: 702728 - RNA, 64 nt, Homo Sapiens; identical to SEQ ID NO: 29468

SEQ ID NO: 702729 - RNA, 64 nt, Homo Sapiens; identical to SEQ ID NO: 29469

SEQ ID NO: 702730 - RNA, 64 nt, Homo Sapiens; identical to SEQ ID NO: 29470

SEQ ID NO: 702731 - RNA, 64 nt, Homo Sapiens; identical to SEQ ID NO: 29471

SEQ ID NO: 702732 - RNA, 64 nt, Homo Sapiens; identical to SEQ ID NO: 29472

SEQ ID NO: 702733 - RNA, 64 nt, Homo Sapiens; identical to SEQ ID NO: 29473

SEQ ID NO: 702734 - RNA, 64 nt, Homo Sapiens; identical to SEQ ID NO: 29474

SEQ ID NO: 702735 - RNA, 64 nt, Homo Sapiens; identical to SEQ ID NO: 29475

SEQ ID NO: 702736 - RNA, 64 nt, Homo Sapiens; identical to SEQ ID NO: 29476

SEQ ID NO: 702737 - RNA, 64 nt, Homo Sapiens; identical to SEQ ID NO: 29477

SEQ ID NO: 702738 - RNA, 64 nt, Homo Sapiens; identical to SEQ ID NO: 29478

SEQ ID NO: 702739 - RNA, 64 nt, Homo Sapiens; identical to SEQ ID NO: 29479

SEQ ID NO: 702740 - RNA, 64 nt, Homo Sapiens; identical to SEQ ID NO: 29480

SEQ ID NO: 702741 - RNA, 64 nt, Homo Sapiens; identical to SEQ ID NO: 29481

SEQ ID NO: 702742 - RNA, 64 nt, Homo Sapiens; identical to SEQ ID NO: 29482

SEQ ID NO: 702743 - RNA, 64 nt, Homo Sapiens; identical to SEQ ID NO: 29483

SEQ ID NO: 702744 - RNA, 64 nt, Homo Sapiens; identical to SEQ ID NO: 29484

SEQ ID NO: 702745 - RNA, 64 nt, Homo Sapiens; identical to SEQ ID NO: 29485

SEQ ID NO: 702746 - RNA, 64 nt, Homo Sapiens; identical to SEQ ID NO: 29486

SEQ ID NO: 702747 - RNA, 64 nt, Homo Sapiens; identical to SEQ ID NO: 29487

SEQ ID NO: 702748 - RNA, 64 nt, Homo Sapiens; identical to SEQ ID NO: 29488

SEQ ID NO: 702749 - RNA, 64 nt, Homo Sapiens; identical to SEQ ID NO: 29489

SEQ ID NO: 702750 - RNA, 64 nt, Homo Sapiens; identical to SEQ ID NO: 29490

SEQ ID NO: 702751 - RNA, 64 nt, Homo Sapiens; identical to SEQ ID NO: 29491

SEQ ID NO: 702752 - RNA, 64 nt, Homo Sapiens; identical to SEQ ID NO: 29492

SEQ ID NO: 702753 - RNA, 64 nt, Homo Sapiens; identical to SEQ ID NO: 29493

SEQ ID NO: 702754 - RNA, 64 nt, Homo Sapiens; identical to SEQ ID NO: 29494

SEQ ID NO: 702755 - RNA, 64 nt, Homo Sapiens; identical to SEQ ID NO: 29495

SEQ ID NO: 702756 - RNA, 64 nt, Homo Sapiens; identical to SEQ ID NO: 29496

SEQ ID NO: 702757 - RNA, 64 nt, Homo Sapiens; identical to SEQ ID NO: 29497

SEQ ID NO: 702758 - RNA, 64 nt, Homo Sapiens; identical to SEQ ID NO: 29498

SEQ ID NO: 702759 - RNA, 64 nt, Homo Sapiens; identical to SEQ ID NO: 29499

SEQ ID NO: 702760 - RNA, 64 nt, Homo Sapiens; identical to SEQ ID NO: 29500

SEQ ID NO: 702761 - RNA, 64 nt, Homo Sapiens; identical to SEQ ID NO: 29501

SEQ ID NO: 702762 - RNA, 64 nt, Homo Sapiens; identical to SEQ ID NO: 29502

SEQ ID NO: 702763 - RNA, 64 nt, Homo Sapiens; identical to SEQ ID NO: 29503

SEQ ID NO: 702764 - RNA, 64 nt, Homo Sapiens; identical to SEQ ID NO: 29504

SEQ ID NO: 702765 - RNA, 64 nt, Homo Sapiens; identical to SEQ ID NO: 29505

SEQ ID NO: 702766 - RNA, 64 nt, Homo Sapiens; identical to SEQ ID NO: 29506

SEQ ID NO: 702767 - RNA, 64 nt, Homo Sapiens; identical to SEQ ID NO: 29507

SEQ ID NO: 702768 - RNA, 64 nt, Homo Sapiens; identical to SEQ ID NO: 29508

SEQ ID NO: 702769 - RNA, 64 nt, Homo Sapiens; identical to SEQ ID NO: 29509

SEQ ID NO: 702770 - RNA, 64 nt, Homo Sapiens; identical to SEQ ID NO: 29510

SEQ ID NO: 702771 - RNA, 64 nt, Homo Sapiens; identical to SEQ ID NO: 29511

SEQ ID NO: 702772 - RNA, 64 nt, Homo Sapiens; identical to SEQ ID NO: 29512

SEQ ID NO: 702773 - RNA, 64 nt, Homo Sapiens; identical to SEQ ID NO: 29513

SEQ ID NO: 702774 - RNA, 54 nt, Homo Sapiens; identical to SEQ ID NO: 29514

SEQ ID NO: 702775 - RNA, 64 nt, Homo Sapiens; identical to SEQ ID NO: 29515

SEQ ID NO: 702776 - RNA, 64 nt, Homo Sapiens; identical to SEQ ID NO: 29516

SEQ ID NO: 702777 - RNA, 64 nt, Homo Sapiens; identical to SEQ ID NO: 29517

SEQ ID NO: 702778 - RNA, 64 nt, Homo Sapiens; identical to SEQ ID NO: 29518

SEQ ID NO: 702779 - RNA, 64 nt, Homo Sapiens; identical to SEQ ID NO: 29519

SEQ ID NO: 702780 - RNA, 64 nt, Homo Sapiens; identical to SEQ ID NO: 29520

SEQ ID NO: 702781 - RNA, 64 nt, Homo Sapiens; identical to SEQ ID NO: 29521

SEQ ID NO: 702782 - RNA, 64 nt, Homo Sapiens; identical to SEQ ID NO: 29522

SEQ ID NO: 702783 - RNA, 64 nt, Homo Sapiens; identical to SEQ ID NO: 29523

SEQ ID NO: 702784 - RNA, 64 nt, Homo Sapiens; identical to SEQ ID NO: 29524

SEQ ID NO: 702785 - RNA, 64 nt, Homo Sapiens; identical to SEQ ID NO: 29525

SEQ ID NO: 702786 - RNA, 64 nt, Homo Sapiens; identical to SEQ ID NO: 29526

SEQ ID NO: 702787 - RNA, 64 nt, Homo Sapiens; identical to SEQ ID NO: 29527

SEQ ID NO: 702788 - RNA, 64 nt, Homo Sapiens; identical to SEQ ID NO: 29528

SEQ ID NO: 702789 - RNA, 64 nt, Homo Sapiens; identical to SEQ ID NO: 29529

SEQ ID NO: 702790 - RNA, 64 nt, Homo Sapiens; identical to SEQ ID NO: 29530

SEQ ID NO: 702791 - RNA, 64 nt, Homo Sapiens; identical to SEQ ID NO: 29531

SEQ ID NO: 702792 - RNA, 64 nt, Homo Sapiens; identical to SEQ ID NO: 29532

SEQ ID NO: 702793 - RNA, 64 nt, Homo Sapiens; identical to SEQ ID NO: 29533

SEQ ID NO: 702794 - RNA, 64 nt, Homo Sapiens; identical to SEQ ID NO: 29534

SEQ ID NO: 702795 - RNA, 64 nt, Homo Sapiens; identical to SEQ ID NO: 29535

SEQ ID NO: 702796 - RNA, 64 nt, Homo Sapiens; identical to SEQ ID NO: 29536

SEQ ID NO: 702797 - RNA, 64 nt, Homo Sapiens; identical to SEQ ID NO: 29537

SEQ ID NO: 702798 - RNA, 64 nt, Homo Sapiens; identical to SEQ ID NO: 29538

SEQ ID NO: 702799 - RNA, 64 nt, Homo Sapiens; identical to SEQ ID NO: 29539

SEQ ID NO: 702800 - RNA, 64 nt, Homo Sapiens; identical to SEQ ID NO: 29540

SEQ ID NO: 702801 - RNA, 64 nt, Homo Sapiens; identical to SEQ ID NO: 29541

SEQ ID NO: 702802 - RNA, 64 nt, Homo Sapiens; identical to SEQ ID NO: 29542

SEQ ID NO: 702803 - RNA, 64 nt, Homo Sapiens; identical to SEQ ID NO: 29543

SEQ ID NO: 702804 - RNA, 64 nt, Homo Sapiens; identical to SEQ ID NO: 29544

SEQ ID NO: 702805 - RNA, 64 nt, Homo Sapiens; identical to SEQ ID NO: 29545

SEQ ID NO: 702806 - RNA, 64 nt, Homo Sapiens; identical to SEQ ID NO: 29546

SEQ ID NO: 702807 - RNA, 64 nt, Homo Sapiens; identical to SEQ ID NO: 29547

SEQ ID NO: 702808 - RNA, 64 nt, Homo Sapiens; identical to SEQ ID NO: 29548

SEQ ID NO: 702809 - RNA, 64 nt, Homo Sapiens; identical to SEQ ID NO: 29549

SEQ ID NO: 702810 - RNA, 64 nt, Homo Sapiens; identical to SEQ ID NO: 29550

SEQ ID NO: 702811 - RNA, 64 nt, Homo Sapiens; identical to SEQ ID NO: 29551

SEQ ID NO: 702812 - RNA, 64 nt, Homo Sapiens; identical to SEQ ID NO: 29552

SEQ ID NO: 702813 - RNA, 64 nt, Homo Sapiens; identical to SEQ ID NO: 29553

SEQ ID NO: 702814 - RNA, 64 nt, Homo Sapiens; identical to SEQ ID NO: 29554

SEQ ID NO: 702815 - RNA, 64 nt, Homo Sapiens; identical to SEQ ID NO: 29555

SEQ ID NO: 702816 - RNA, 64 nt, Homo Sapiens; identical to SEQ ID NO: 29556

SEQ ID NO: 702817 - RNA, 64 nt, Homo Sapiens; identical to SEQ ID NO: 29557

SEQ ID NO: 702818 - RNA, 64 nt, Homo Sapiens; identical to SEQ ID NO: 29558

SEQ ID NO: 702819 - RNA, 64 nt, Homo Sapiens; identical to SEQ ID NO: 29559

SEQ ID NO: 702820 - RNA, 64 nt, Homo Sapiens; identical to SEQ ID NO: 29560

SEQ ID NO: 702821 - RNA, 64 nt, Homo Sapiens; identical to SEQ ID NO: 29561

SEQ ID NO: 702822 - RNA, 64 nt, Homo Sapiens; identical to SEQ ID NO: 29562

SEQ ID NO: 702823 - RNA, 64 nt, Homo Sapiens; identical to SEQ ID NO: 29563

SEQ ID NO: 702824 - RNA, 64 nt, Homo Sapiens; identical to SEQ ID NO: 29564

SEQ ID NO: 702825 - RNA, 64 nt, Homo Sapiens; identical to SEQ ID NO: 29565

SEQ ID NO: 702826 - RNA, 64 nt, Homo Sapiens; identical to SEQ ID NO: 29566

SEQ ID NO: 702827 - RNA, 64 nt, Homo Sapiens; identical to SEQ ID NO: 29567

SEQ ID NO: 702828 - RNA, 64 nt, Homo Sapiens; identical to SEQ ID NO: 29568

SEQ ID NO: 702829 - RNA, 64 nt, Homo Sapiens; identical to SEQ ID NO: 29569

SEQ ID NO: 702830 - RNA, 64 nt, Homo Sapiens; identical to SEQ ID NO: 29570

SEQ ID NO: 702831 - RNA, 64 nt, Homo Sapiens; identical to SEQ ID NO: 29571

SEQ ID NO: 702832 - RNA, 64 nt, Homo Sapiens; identical to SEQ ID NO: 29572

SEQ ID NO: 702833 - RNA, 64 nt, Homo Sapiens; identical to SEQ ID NO: 29573

SEQ ID NO: 702834 - RNA, 64 nt, Homo Sapiens; identical to SEQ ID NO: 29574

SEQ ID NO: 702835 - RNA, 64 nt, Homo Sapiens; identical to SEQ ID NO: 29575

SEQ ID NO: 702836 - RNA, 64 nt, Homo Sapiens; identical to SEQ ID NO: 29576

SEQ ID NO: 702837 - RNA, 64 nt, Homo Sapiens; identical to SEQ ID NO: 29577

SEQ ID NO: 702838 - RNA, 64 nt, Homo Sapiens; identical to SEQ ID NO: 29578

SEQ ID NO: 702839 - RNA, 64 nt, Homo Sapiens; identical to SEQ ID NO: 29579

SEQ ID NO: 702840 - RNA, 64 nt, Homo Sapiens; identical to SEQ ID NO: 29580

SEQ ID NO: 702841 - RNA, 64 nt, Homo Sapiens; identical to SEQ ID NO: 29581

SEQ ID NO: 702842 - RNA, 64 nt, Homo Sapiens; identical to SEQ ID NO: 29582

SEQ ID NO: 702843 - RNA, 64 nt, Homo Sapiens; identical to SEQ ID NO: 29583

SEQ ID NO: 702844 - RNA, 64 nt, Homo Sapiens; identical to SEQ ID NO: 29584

SEQ ID NO: 702845 - RNA, 64 nt, Homo Sapiens; identical to SEQ ID NO: 29585

SEQ ID NO: 702846 - RNA, 64 nt, Homo Sapiens; identical to SEQ ID NO: 29586

SEQ ID NO: 702847 - RNA, 64 nt, Homo Sapiens; identical to SEQ ID NO: 29587

SEQ ID NO: 702848 - RNA, 64 nt, Homo Sapiens; identical to SEQ ID NO: 29588

SEQ ID NO: 702849 - RNA, 64 nt, Homo Sapiens; identical to SEQ ID NO: 29589

SEQ ID NO: 702850 - RNA, 64 nt, Homo Sapiens; identical to SEQ ID NO: 29590

SEQ ID NO: 702851 - RNA, 64 nt, Homo Sapiens; identical to SEQ ID NO: 29591

SEQ ID NO: 702852 - RNA, 64 nt, Homo Sapiens; identical to SEQ ID NO: 29592

SEQ ID NO: 702853 - RNA, 64 nt, Homo Sapiens; identical to SEQ ID NO: 29593

SEQ ID NO: 702854 - RNA, 64 nt, Homo Sapiens; identical to SEQ ID NO: 29594

SEQ ID NO: 702855 - RNA, 64 nt, Homo Sapiens; identical to SEQ ID NO: 29595

SEQ ID NO: 702856 - RNA, 64 nt, Homo Sapiens; identical to SEQ ID NO: 29596

SEQ ID NO: 702857 - RNA, 64 nt, Homo Sapiens; identical to SEQ ID NO: 29597

SEQ ID NO: 702858 - RNA, 64 nt, Homo Sapiens; identical to SEQ ID NO: 29598

SEQ ID NO: 702859 - RNA, 64 nt, Homo Sapiens; identical to SEQ ID NO: 29599

SEQ ID NO: 702860 - RNA, 64 nt, Homo Sapiens; identical to SEQ ID NO: 29600

SEQ ID NO: 702861 - RNA, 64 nt, Homo Sapiens; identical to SEQ ID NO: 29601

SEQ ID NO: 702862 - RNA, 64 nt, Homo Sapiens; identical to SEQ ID NO: 29602

SEQ ID NO: 702863 - RNA, 64 nt, Homo Sapiens; identical to SEQ ID NO: 29603

SEQ ID NO: 702864 - RNA, 64 nt, Homo Sapiens; identical to SEQ ID NO: 29604

SEQ ID NO: 702865 - RNA, 64 nt, Homo Sapiens; identical to SEQ ID NO: 29605

SEQ ID NO: 702866 - RNA, 64 nt, Homo Sapiens; identical to SEQ ID NO: 29606

SEQ ID NO: 702867 - RNA, 64 nt, Homo Sapiens; identical to SEQ ID NO: 29607

SEQ ID NO: 702868 - RNA, 64 nt, Homo Sapiens; identical to SEQ ID NO: 29608

SEQ ID NO: 702869 - RNA, 64 nt, Homo Sapiens; identical to SEQ ID NO: 29609

SEQ ID NO: 702870 - RNA, 64 nt, Homo Sapiens; identical to SEQ ID NO: 29610

SEQ ID NO: 702871 - RNA, 64 nt, Homo Sapiens; identical to SEQ ID NO: 29611

SEQ ID NO: 702872 - RNA, 64 nt, Homo Sapiens; identical to SEQ ID NO: 29612

SEQ ID NO: 702873 - RNA, 64 nt, Homo Sapiens; identical to SEQ ID NO: 29613

SEQ ID NO: 702874 - RNA, 64 nt, Homo Sapiens; identical to SEQ ID NO: 29614

SEQ ID NO: 702875 - RNA, 64 nt, Homo Sapiens; identical to SEQ ID NO: 29615

SEQ ID NO: 702876 - RNA, 64 nt, Homo Sapiens; identical to SEQ ID NO: 29616

SEQ ID NO: 702877 - RNA, 64 nt, Homo Sapiens; identical to SEQ ID NO: 29617

SEQ ID NO: 702878 - RNA, 64 nt, Homo Sapiens; identical to SEQ ID NO: 29618

SEQ ID NO: 702879 - RNA, 64 nt, Homo Sapiens; identical to SEQ ID NO: 29619

SEQ ID NO: 702880 - RNA, 64 nt, Homo Sapiens; identical to SEQ ID NO: 29620

SEQ ID NO: 702881 - RNA, 64 nt, Homo Sapiens; identical to SEQ ID NO: 29621

SEQ ID NO: 702882 - RNA, 64 nt, Homo Sapiens; identical to SEQ ID NO: 29622

SEQ ID NO: 702883 - RNA, 64 nt, Homo Sapiens; identical to SEQ ID NO: 29623

SEQ ID NO: 702884 - RNA, 64 nt, Homo Sapiens; identical to SEQ ID NO: 29624

SEQ ID NO: 702885 - RNA, 64 nt, Homo Sapiens; identical to SEQ ID NO: 29625

SEQ ID NO: 702886 - RNA, 64 nt, Homo Sapiens; identical to SEQ ID NO: 29626

SEQ ID NO: 702887 - RNA, 64 nt, Homo Sapiens; identical to SEQ ID NO: 29627

SEQ ID NO: 702888 - RNA, 64 nt, Homo Sapiens; identical to SEQ ID NO: 29628

SEQ ID NO: 702889 - RNA, 64 nt, Homo Sapiens; identical to SEQ ID NO: 29629

SEQ ID NO: 702890 - RNA, 64 nt, Homo Sapiens; identical to SEQ ID NO: 29630

SEQ ID NO: 702891 - RNA, 64 nt, Homo Sapiens; identical to SEQ ID NO: 29631

SEQ ID NO: 702892 - RNA, 64 nt, Homo Sapiens; identical to SEQ ID NO: 29632

SEQ ID NO: 702893 - RNA, 64 nt, Homo Sapiens; identical to SEQ ID NO: 29633

SEQ ID NO: 702894 - RNA, 64 nt, Homo Sapiens; identical to SEQ ID NO: 29634

SEQ ID NO: 702895 - RNA, 64 nt, Homo Sapiens; identical to SEQ ID NO: 29635

SEQ ID NO: 702896 - RNA, 64 nt, Homo Sapiens; identical to SEQ ID NO: 29636

SEQ ID NO: 702897 - RNA, 64 nt, Homo Sapiens; identical to SEQ ID NO: 29637

SEQ ID NO: 702898 - RNA, 64 nt, Homo Sapiens; identical to SEQ ID NO: 29638

SEQ ID NO: 702899 - RNA, 64 nt, Homo Sapiens; identical to SEQ ID NO: 29639

SEQ ID NO: 702900 - RNA, 64 nt, Homo Sapiens; identical to SEQ ID NO: 29640

SEQ ID NO: 702901 - RNA, 64 nt, Homo Sapiens; identical to SEQ ID NO: 29641

SEQ ID NO: 702902 - RNA, 64 nt, Homo Sapiens; identical to SEQ ID NO: 29642

SEQ ID NO: 702903 - RNA, 64 nt, Homo Sapiens; identical to SEQ ID NO: 29643

SEQ ID NO: 702904 - RNA, 64 nt, Homo Sapiens; identical to SEQ ID NO: 29644

SEQ ID NO: 702905 - RNA, 64 nt, Homo Sapiens; identical to SEQ ID NO: 29645

SEQ ID NO: 702906 - RNA, 64 nt, Homo Sapiens; identical to SEQ ID NO: 29646

SEQ ID NO: 702907 - RNA, 64 nt, Homo Sapiens; identical to SEQ ID NO: 29647

SEQ ID NO: 702908 - RNA, 64 nt, Homo Sapiens; identical to SEQ ID NO: 29648

SEQ ID NO: 702909 - RNA, 64 nt, Homo Sapiens; identical to SEQ ID NO: 29649

SEQ ID NO: 702910 - RNA, 64 nt, Homo Sapiens; identical to SEQ ID NO: 29650

SEQ ID NO: 702911 - RNA, 64 nt, Homo Sapiens; identical to SEQ ID NO: 29651

SEQ ID NO: 702912 - RNA, 64 nt, Homo Sapiens; identical to SEQ ID NO: 29652

SEQ ID NO: 702913 - RNA, 64 nt, Homo Sapiens; identical to SEQ ID NO: 29653

SEQ ID NO: 702914 - RNA, 64 nt, Homo Sapiens; identical to SEQ ID NO: 29654

SEQ ID NO: 702915 - RNA, 64 nt, Homo Sapiens; identical to SEQ ID NO: 29655

SEQ ID NO: 702916 - RNA, 64 nt, Homo Sapiens; identical to SEQ ID NO: 29656

SEQ ID NO: 702917 - RNA, 64 nt, Homo Sapiens; identical to SEQ ID NO: 29657

SEQ ID NO: 702918 - RNA, 64 nt, Homo Sapiens; identical to SEQ ID NO: 29658

SEQ ID NO: 702919 - RNA, 64 nt, Homo Sapiens; identical to SEQ ID NO: 29659

SEQ ID NO: 702920 - RNA, 64 nt, Homo Sapiens; identical to SEQ ID NO: 29660

SEQ ID NO: 702921 - RNA, 64 nt, Homo Sapiens; identical to SEQ ID NO: 29661

SEQ ID NO: 702922 - RNA, 64 nt, Homo Sapiens; identical to SEQ ID NO: 29662

SEQ ID NO: 702923 - RNA, 64 nt, Homo Sapiens; identical to SEQ ID NO: 29663

SEQ ID NO: 702924 - RNA, 64 nt, Homo Sapiens; identical to SEQ ID NO: 29664

SEQ ID NO: 702925 - RNA, 64 nt, Homo Sapiens; identical to SEQ ID NO: 29665

SEQ ID NO: 702926 - RNA, 64 nt, Homo Sapiens; identical to SEQ ID NO: 29666

SEQ ID NO: 702927 - RNA, 64 nt, Homo Sapiens; identical to SEQ ID NO: 29667

SEQ ID NO: 702928 - RNA, 64 nt, Homo Sapiens; identical to SEQ ID NO: 29668

SEQ ID NO: 702929 - RNA, 64 nt, Homo Sapiens; identical to SEQ ID NO: 29669

SEQ ID NO: 702930 - RNA, 64 nt, Homo Sapiens; identical to SEQ ID NO: 29670

SEQ ID NO: 702931 - RNA, 64 nt, Homo Sapiens; identical to SEQ ID NO: 29671

SEQ ID NO: 702932 - RNA, 64 nt, Homo Sapiens; identical to SEQ ID NO: 29672

SEQ ID NO: 702933 - RNA, 64 nt, Homo Sapiens; identical to SEQ ID NO: 29673

SEQ ID NO: 702934 - RNA, 64 nt, Homo Sapiens; identical to SEQ ID NO: 29674

SEQ ID NO: 702935 - RNA, 64 nt, Homo Sapiens; identical to SEQ ID NO: 29675

SEQ ID NO: 702936 - RNA, 64 nt, Homo Sapiens; identical to SEQ ID NO: 29676

SEQ ID NO: 702937 - RNA, 64 nt, Homo Sapiens; identical to SEQ ID NO: 29677

SEQ ID NO: 702938 - RNA, 64 nt, Homo Sapiens; identical to SEQ ID NO: 29678

SEQ ID NO: 702939 - RNA, 64 nt, Homo Sapiens; identical to SEQ ID NO: 29679

SEQ ID NO: 702940 - RNA, 64 nt, Homo Sapiens; identical to SEQ ID NO: 29680

SEQ ID NO: 702941 - RNA, 64 nt, Homo Sapiens; identical to SEQ ID NO: 29681

SEQ ID NO: 702942 - RNA, 64 nt, Homo Sapiens; identical to SEQ ID NO: 29682

SEQ ID NO: 702943 - RNA, 64 nt, Homo Sapiens; identical to SEQ ID NO: 29683

SEQ ID NO: 702944 - RNA, 64 nt, Homo Sapiens; identical to SEQ ID NO: 29684

SEQ ID NO: 702945 - RNA, 64 nt, Homo Sapiens; identical to SEQ ID NO: 29685

SEQ ID NO: 702946 - RNA, 64 nt, Homo Sapiens; identical to SEQ ID NO: 29686

SEQ ID NO: 702947 - RNA, 64 nt, Homo Sapiens; identical to SEQ ID NO: 29687

SEQ ID NO: 702948 - RNA, 64 nt, Homo Sapiens; identical to SEQ ID NO: 29688

SEQ ID NO: 702949 - RNA, 64 nt, Homo Sapiens; identical to SEQ ID NO: 29689

SEQ ID NO: 702950 - RNA, 64 nt, Homo Sapiens; identical to SEQ ID NO: 29690

SEQ ID NO: 702951 - RNA, 64 nt, Homo Sapiens; identical to SEQ ID NO: 29691

SEQ ID NO: 702952 - RNA, 64 nt, Homo Sapiens; identical to SEQ ID NO: 29692

SEQ ID NO: 702953 - RNA, 64 nt, Homo Sapiens; identical to SEQ ID NO: 29693

SEQ ID NO: 702954 - RNA, 64 nt, Homo Sapiens; identical to SEQ ID NO: 29694

SEQ ID NO: 702955 - RNA, 64 nt, Homo Sapiens; identical to SEQ ID NO: 29695

SEQ ID NO: 702956 - RNA, 64 nt, Homo Sapiens; identical to SEQ ID NO: 29696

SEQ ID NO: 702957 - RNA, 64 nt, Homo Sapiens; identical to SEQ ID NO: 29697

SEQ ID NO: 702958 - RNA, 64 nt, Homo Sapiens; identical to SEQ ID NO: 29698

SEQ ID NO: 702959 - RNA, 64 nt, Homo Sapiens; identical to SEQ ID NO: 29699

SEQ ID NO: 702960 - RNA, 64 nt, Homo Sapiens; identical to SEQ ID NO: 29700

SEQ ID NO: 702961 - RNA, 64 nt, Homo Sapiens; identical to SEQ ID NO: 29701

SEQ ID NO: 702962 - RNA, 64 nt, Homo Sapiens; identical to SEQ ID NO: 29702

SEQ ID NO: 702963 - RNA, 64 nt, Homo Sapiens; identical to SEQ ID NO: 29703

SEQ ID NO: 702964 - RNA, 64 nt, Homo Sapiens; identical to SEQ ID NO: 29704

SEQ ID NO: 702965 - RNA, 64 nt, Homo Sapiens; identical to SEQ ID NO: 29705

SEQ ID NO: 702966 - RNA, 64 nt, Homo Sapiens; identical to SEQ ID NO: 29706

SEQ ID NO: 702967 - RNA, 64 nt, Homo Sapiens; identical to SEQ ID NO: 29707

SEQ ID NO: 702968 - RNA, 64 nt, Homo Sapiens; identical to SEQ ID NO: 29708

SEQ ID NO: 702969 - RNA, 64 nt, Homo Sapiens; identical to SEQ ID NO: 29709

SEQ ID NO: 702970 - RNA, 64 nt, Homo Sapiens; identical to SEQ ID NO: 29710

SEQ ID NO: 702971 - RNA, 64 nt, Homo Sapiens; identical to SEQ ID NO: 29711

SEQ ID NO: 702972 - RNA, 64 nt, Homo Sapiens; identical to SEQ ID NO: 29712

SEQ ID NO: 702973 - RNA, 64 nt, Homo Sapiens; identical to SEQ ID NO: 29713

SEQ ID NO: 702974 - RNA, 64 nt, Homo Sapiens; identical to SEQ ID NO: 29714

SEQ ID NO: 702975 - RNA, 64 nt, Homo Sapiens; identical to SEQ ID NO: 29715

SEQ ID NO: 702976 - RNA, 64 nt, Homo Sapiens; identical to SEQ ID NO: 29716

SEQ ID NO: 702977 - RNA, 64 nt, Homo Sapiens; identical to SEQ ID NO: 29717

SEQ ID NO: 702978 - RNA, 64 nt, Homo Sapiens; identical to SEQ ID NO: 29718

SEQ ID NO: 702979 - RNA, 64 nt, Homo Sapiens; identical to SEQ ID NO: 29719

SEQ ID NO: 702980 - RNA, 64 nt, Homo Sapiens; identical to SEQ ID NO: 29720

SEQ ID NO: 702981 - RNA, 64 nt, Homo Sapiens; identical to SEQ ID NO: 29721

SEQ ID NO: 702982 - RNA, 64 nt, Homo Sapiens; identical to SEQ ID NO: 29722

SEQ ID NO: 702983 - RNA, 64 nt, Homo Sapiens; identical to SEQ ID NO: 29723

SEQ ID NO: 702984 - RNA, 64 nt, Homo Sapiens; identical to SEQ ID NO: 29724

SEQ ID NO: 702985 - RNA, 64 nt, Homo Sapiens; identical to SEQ ID NO: 29725

SEQ ID NO: 702986 - RNA, 64 nt, Homo Sapiens; identical to SEQ ID NO: 29726

SEQ ID NO: 702987 - RNA, 64 nt, Homo Sapiens; identical to SEQ ID NO: 29727

SEQ ID NO: 702988 - RNA, 64 nt, Homo Sapiens; identical to SEQ ID NO: 29728

SEQ ID NO: 702989 - RNA, 64 nt, Homo Sapiens; identical to SEQ ID NO: 29729

SEQ ID NO: 702990 - RNA, 64 nt, Homo Sapiens; identical to SEQ ID NO: 29730

SEQ ID NO: 702991 - RNA, 64 nt, Homo Sapiens; identical to SEQ ID NO: 29731

SEQ ID NO: 702992 - RNA, 64 nt, Homo Sapiens; identical to SEQ ID NO: 29732

SEQ ID NO: 702993 - RNA, 64 nt, Homo Sapiens; identical to SEQ ID NO: 29733

SEQ ID NO: 702994 - RNA, 64 nt, Homo Sapiens; identical to SEQ ID NO: 29734

SEQ ID NO: 702995 - RNA, 64 nt, Homo Sapiens; identical to SEQ ID NO: 29735

SEQ ID NO: 702996 - RNA, 64 nt, Homo Sapiens; identical to SEQ ID NO: 29736

SEQ ID NO: 702997 - RNA, 64 nt, Homo Sapiens; identical to SEQ ID NO: 29737

SEQ ID NO: 702998 - RNA, 64 nt, Homo Sapiens; identical to SEQ ID NO: 29738

SEQ ID NO: 702999 - RNA, 64 nt, Homo Sapiens; identical to SEQ ID NO: 29739

SEQ ID NO: 703000 - RNA, 64 nt, Homo Sapiens; identical to SEQ ID NO: 29740

SEQ ID NO: 703001 - RNA, 64 nt, Homo Sapiens; identical to SEQ ID NO: 29741

SEQ ID NO: 703002 - RNA, 64 nt, Homo Sapiens; identical to SEQ ID NO: 29742

SEQ ID NO: 703003 - RNA, 64 nt, Homo Sapiens; identical to SEQ ID NO: 29743

SEQ ID NO: 703004 - RNA, 64 nt, Homo Sapiens; identical to SEQ ID NO: 29744

SEQ ID NO: 703005 - RNA, 64 nt, Homo Sapiens; identical to SEQ ID NO: 29745

SEQ ID NO: 703006 - RNA, 64 nt, Homo Sapiens; identical to SEQ ID NO: 29746

SEQ ID NO: 703007 - RNA, 64 nt, Homo Sapiens; identical to SEQ ID NO: 29747

SEQ ID NO: 703008 - RNA, 64 nt, Homo Sapiens; identical to SEQ ID NO: 29748

SEQ ID NO: 703009 - RNA, 64 nt, Homo Sapiens; identical to SEQ ID NO: 29749

SEQ ID NO: 703010 - RNA, 64 nt, Homo Sapiens; identical to SEQ ID NO: 29750

SEQ ID NO: 703011 - RNA, 64 nt, Homo Sapiens; identical to SEQ ID NO: 29751

SEQ ID NO: 703012 - RNA, 64 nt, Homo Sapiens; identical to SEQ ID NO: 29752

SEQ ID NO: 703013 - RNA, 64 nt, Homo Sapiens; identical to SEQ ID NO: 29753

SEQ ID NO: 703014 - RNA, 64 nt, Homo Sapiens; identical to SEQ ID NO: 29754

SEQ ID NO: 703015 - RNA, 64 nt, Homo Sapiens; identical to SEQ ID NO: 29755

SEQ ID NO: 703016 - RNA, 64 nt, Homo Sapiens; identical to SEQ ID NO: 29756

SEQ ID NO: 703017 - RNA, 64 nt, Homo Sapiens; identical to SEQ ID NO: 29757

SEQ ID NO: 703018 - RNA, 64 nt, Homo Sapiens; identical to SEQ ID NO: 29758

SEQ ID NO: 703019 - RNA, 64 nt, Homo Sapiens; identical to SEQ ID NO: 29759

SEQ ID NO: 703020 - RNA, 64 nt, Homo Sapiens; identical to SEQ ID NO: 29760

SEQ ID NO: 703021 - RNA, 64 nt, Homo Sapiens; identical to SEQ ID NO: 29761

SEQ ID NO: 703022 - RNA, 64 nt, Homo Sapiens; identical to SEQ ID NO: 29762

SEQ ID NO: 703023 - RNA, 64 nt, Homo Sapiens; identical to SEQ ID NO: 29763

SEQ ID NO: 703024 - RNA, 64 nt, Homo Sapiens; identical to SEQ ID NO: 29764

SEQ ID NO: 703025 - RNA, 64 nt, Homo Sapiens; identical to SEQ ID NO: 29765

SEQ ID NO: 703026 - RNA, 64 nt, Homo Sapiens; identical to SEQ ID NO: 29766

SEQ ID NO: 703027 - RNA, 64 nt, Homo Sapiens; identical to SEQ ID NO: 29767

SEQ ID NO: 703028 - RNA, 64 nt, Homo Sapiens; identical to SEQ ID NO: 29768

SEQ ID NO: 703029 - RNA, 64 nt, Homo Sapiens; identical to SEQ ID NO: 29769

SEQ ID NO: 703030 - RNA, 64 nt, Homo Sapiens; identical to SEQ ID NO: 29770

SEQ ID NO: 703031 - RNA, 64 nt, Homo Sapiens; identical to SEQ ID NO: 29771

SEQ ID NO: 703032 - RNA, 64 nt, Homo Sapiens; identical to SEQ ID NO: 29772

SEQ ID NO: 703033 - RNA, 64 nt, Homo Sapiens; identical to SEQ ID NO: 29773

SEQ ID NO: 703034 - RNA, 64 nt, Homo Sapiens; identical to SEQ ID NO: 29774

SEQ ID NO: 703035 - RNA, 64 nt, Homo Sapiens; identical to SEQ ID NO: 29775

SEQ ID NO: 703036 - RNA, 64 nt, Homo Sapiens; identical to SEQ ID NO: 29776

SEQ ID NO: 703037 - RNA, 64 nt, Homo Sapiens; identical to SEQ ID NO: 29777

SEQ ID NO: 703038 - RNA, 64 nt, Homo Sapiens; identical to SEQ ID NO: 29778

SEQ ID NO: 703039 - RNA, 64 nt, Homo Sapiens; identical to SEQ ID NO: 29779

SEQ ID NO: 703040 - RNA, 64 nt, Homo Sapiens; identical to SEQ ID NO: 29780

SEQ ID NO: 703041 - RNA, 64 nt, Homo Sapiens; identical to SEQ ID NO: 29781

SEQ ID NO: 703042 - RNA, 64 nt, Homo Sapiens; identical to SEQ ID NO: 29782

SEQ ID NO: 703043 - RNA, 64 nt, Homo Sapiens; identical to SEQ ID NO: 29783

SEQ ID NO: 703044 - RNA, 64 nt, Homo Sapiens; identical to SEQ ID NO: 29784

SEQ ID NO: 703045 - RNA, 64 nt, Homo Sapiens; identical to SEQ ID NO: 29785

SEQ ID NO: 703046 - RNA, 64 nt, Homo Sapiens; identical to SEQ ID NO: 29786

SEQ ID NO: 703047 - RNA, 64 nt, Homo Sapiens; identical to SEQ ID NO: 29787

SEQ ID NO: 703048 - RNA, 64 nt, Homo Sapiens; identical to SEQ ID NO: 29788

SEQ ID NO: 703049 - RNA, 64 nt, Homo Sapiens; identical to SEQ ID NO: 29789

SEQ ID NO: 703050 - RNA, 64 nt, Homo Sapiens; identical to SEQ ID NO: 29790

SEQ ID NO: 703051 - RNA, 64 nt, Homo Sapiens; identical to SEQ ID NO: 29791

SEQ ID NO: 703052 - RNA, 64 nt, Homo Sapiens; identical to SEQ ID NO: 29792

SEQ ID NO: 703053 - RNA, 64 nt, Homo Sapiens; identical to SEQ ID NO: 29793

SEQ ID NO: 703054 - RNA, 64 nt, Homo Sapiens; identical to SEQ ID NO: 29794

SEQ ID NO: 703055 - RNA, 64 nt, Homo Sapiens; identical to SEQ ID NO: 29795

SEQ ID NO: 703056 - RNA, 64 nt, Homo Sapiens; identical to SEQ ID NO: 29796

SEQ ID NO: 703057 - RNA, 64 nt, Homo Sapiens; identical to SEQ ID NO: 29797

SEQ ID NO: 703058 - RNA, 64 nt, Homo Sapiens; identical to SEQ ID NO: 29798

SEQ ID NO: 703059 - RNA, 64 nt, Homo Sapiens; identical to SEQ ID NO: 29799

SEQ ID NO: 703060 - RNA, 64 nt, Homo Sapiens; identical to SEQ ID NO: 29800

SEQ ID NO: 703061 - RNA, 64 nt, Homo Sapiens; identical to SEQ ID NO: 29801

SEQ ID NO: 703062 - RNA, 64 nt, Homo Sapiens; identical to SEQ ID NO: 29802

SEQ ID NO: 703063 - RNA, 64 nt, Homo Sapiens; identical to SEQ ID NO: 29803

SEQ ID NO: 703064 - RNA, 64 nt, Homo Sapiens; identical to SEQ ID NO: 29804

SEQ ID NO: 703065 - RNA, 64 nt, Homo Sapiens; identical to SEQ ID NO: 29805

SEQ ID NO: 703066 - RNA, 64 nt, Homo Sapiens; identical to SEQ ID NO: 29806

SEQ ID NO: 703067 - RNA, 64 nt, Homo Sapiens; identical to SEQ ID NO: 29807

SEQ ID NO: 703068 - RNA, 64 nt, Homo Sapiens; identical to SEQ ID NO: 29808

SEQ ID NO: 703069 - RNA, 64 nt, Homo Sapiens; identical to SEQ ID NO: 29809

SEQ ID NO: 703070 - RNA, 64 nt, Homo Sapiens; identical to SEQ ID NO: 29810

SEQ ID NO: 703071 - RNA, 64 nt, Homo Sapiens; identical to SEQ ID NO: 29811

SEQ ID NO: 703072 - RNA, 64 nt, Homo Sapiens; identical to SEQ ID NO: 29812

SEQ ID NO: 703073 - RNA, 64 nt, Homo Sapiens; identical to SEQ ID NO: 29813

SEQ ID NO: 703074 - RNA, 64 nt, Homo Sapiens; identical to SEQ ID NO: 29814

SEQ ID NO: 703075 - RNA, 64 nt, Homo Sapiens; identical to SEQ ID NO: 29815

SEQ ID NO: 703076 - RNA, 64 nt, Homo Sapiens; identical to SEQ ID NO: 29816

SEQ ID NO: 703077 - RNA, 64 nt, Homo Sapiens; identical to SEQ ID NO: 29817

SEQ ID NO: 703078 - RNA, 64 nt, Homo Sapiens; identical to SEQ ID NO: 29818

SEQ ID NO: 703079 - RNA, 64 nt, Homo Sapiens; identical to SEQ ID NO: 29819

SEQ ID NO: 703080 - RNA, 64 nt, Homo Sapiens; identical to SEQ ID NO: 29820

SEQ ID NO: 703081 - RNA, 64 nt, Homo Sapiens; identical to SEQ ID NO: 29821

SEQ ID NO: 703082 - RNA, 64 nt, Homo Sapiens; identical to SEQ ID NO: 29822

SEQ ID NO: 703083 - RNA, 64 nt, Homo Sapiens; identical to SEQ ID NO: 29823

SEQ ID NO: 703084 - RNA, 64 nt, Homo Sapiens; identical to SEQ ID NO: 29824

SEQ ID NO: 703085 - RNA, 64 nt, Homo Sapiens; identical to SEQ ID NO: 29825

SEQ ID NO: 703086 - RNA, 64 nt, Homo Sapiens; identical to SEQ ID NO: 29826

SEQ ID NO: 703087 - RNA, 64 nt, Homo Sapiens; identical to SEQ ID NO: 29827

SEQ ID NO: 703088 - RNA, 64 nt, Homo Sapiens; identical to SEQ ID NO: 29828

SEQ ID NO: 703089 - RNA, 64 nt, Homo Sapiens; identical to SEQ ID NO: 29829

SEQ ID NO: 703090 - RNA, 64 nt, Homo Sapiens; identical to SEQ ID NO: 29830

SEQ ID NO: 703091 - RNA, 64 nt, Homo Sapiens; identical to SEQ ID NO: 29831

SEQ ID NO: 703092 - RNA, 64 nt, Homo Sapiens; identical to SEQ ID NO: 29832

SEQ ID NO: 703093 - RNA, 64 nt, Homo Sapiens; identical to SEQ ID NO: 29833

SEQ ID NO: 703094 - RNA, 64 nt, Homo Sapiens; identical to SEQ ID NO: 29834

SEQ ID NO: 703095 - RNA, 64 nt, Homo Sapiens; identical to SEQ ID NO: 29835

SEQ ID NO: 703096 - RNA, 64 nt, Homo Sapiens; identical to SEQ ID NO: 29836

SEQ ID NO: 703097 - RNA, 64 nt, Homo Sapiens; identical to SEQ ID NO: 29837

SEQ ID NO: 703098 - RNA, 64 nt, Homo Sapiens; identical to SEQ ID NO: 29838

SEQ ID NO: 703099 - RNA, 64 nt, Homo Sapiens; identical to SEQ ID NO: 29839

SEQ ID NO: 703100 - RNA, 64 nt, Homo Sapiens; identical to SEQ ID NO: 29840

SEQ ID NO: 703101 - RNA, 64 nt, Homo Sapiens; identical to SEQ ID NO: 29841

SEQ ID NO: 703102 - RNA, 64 nt, Homo Sapiens; identical to SEQ ID NO: 29842

SEQ ID NO: 703103 - RNA, 64 nt, Homo Sapiens; identical to SEQ ID NO: 29843

SEQ ID NO: 703104 - RNA, 64 nt, Homo Sapiens; identical to SEQ ID NO: 29844

SEQ ID NO: 703105 - RNA, 64 nt, Homo Sapiens; identical to SEQ ID NO: 29845

SEQ ID NO: 703106 - RNA, 64 nt, Homo Sapiens; identical to SEQ ID NO: 29846

SEQ ID NO: 703107 - RNA, 64 nt, Homo Sapiens; identical to SEQ ID NO: 29847

SEQ ID NO: 703108 - RNA, 64 nt, Homo Sapiens; identical to SEQ ID NO: 29848

SEQ ID NO: 703109 - RNA, 64 nt, Homo Sapiens; identical to SEQ ID NO: 29849

SEQ ID NO: 703110 - RNA, 64 nt, Homo Sapiens; identical to SEQ ID NO: 29850

SEQ ID NO: 703111 - RNA, 64 nt, Homo Sapiens; identical to SEQ ID NO: 29851

SEQ ID NO: 703112 - RNA, 64 nt, Homo Sapiens; identical to SEQ ID NO: 29852

SEQ ID NO: 703113 - RNA, 64 nt, Homo Sapiens; identical to SEQ ID NO: 29853

SEQ ID NO: 703114 - RNA, 64 nt, Homo Sapiens; identical to SEQ ID NO: 29854

SEQ ID NO: 703115 - RNA, 64 nt, Homo Sapiens; identical to SEQ ID NO: 29855

SEQ ID NO: 703116 - RNA, 64 nt, Homo Sapiens; identical to SEQ ID NO: 29856

SEQ ID NO: 703117 - RNA, 64 nt, Homo Sapiens; identical to SEQ ID NO: 29857

SEQ ID NO: 703118 - RNA, 64 nt, Homo Sapiens; identical to SEQ ID NO: 29858

SEQ ID NO: 703119 - RNA, 64 nt, Homo Sapiens; identical to SEQ ID NO: 29859

SEQ ID NO: 703120 - RNA, 64 nt, Homo Sapiens; identical to SEQ ID NO: 29860

SEQ ID NO: 703121 - RNA, 64 nt, Homo Sapiens; identical to SEQ ID NO: 29861

SEQ ID NO: 703122 - RNA, 64 nt, Homo Sapiens; identical to SEQ ID NO: 29862

SEQ ID NO: 703123 - RNA, 64 nt, Homo Sapiens; identical to SEQ ID NO: 29863

SEQ ID NO: 703124 - RNA, 64 nt, Homo Sapiens; identical to SEQ ID NO: 29864

SEQ ID NO: 703125 - RNA, 64 nt, Homo Sapiens; identical to SEQ ID NO: 29865

SEQ ID NO: 703126 - RNA, 64 nt, Homo Sapiens; identical to SEQ ID NO: 29866

SEQ ID NO: 703127 - RNA, 64 nt, Homo Sapiens; identical to SEQ ID NO: 29867

SEQ ID NO: 703128 - RNA, 64 nt, Homo Sapiens; identical to SEQ ID NO: 29868

SEQ ID NO: 703129 - RNA, 64 nt, Homo Sapiens; identical to SEQ ID NO: 29869

SEQ ID NO: 703130 - RNA, 64 nt, Homo Sapiens; identical to SEQ ID NO: 29870

SEQ ID NO: 703131 - RNA, 64 nt, Homo Sapiens; identical to SEQ ID NO: 29871

SEQ ID NO: 703132 - RNA, 64 nt, Homo Sapiens; identical to SEQ ID NO: 29872

SEQ ID NO: 703133 - RNA, 64 nt, Homo Sapiens; identical to SEQ ID NO: 29873

SEQ ID NO: 703134 - RNA, 64 nt, Homo Sapiens; identical to SEQ ID NO: 29874

SEQ ID NO: 703135 - RNA, 64 nt, Homo Sapiens; identical to SEQ ID NO: 29875

SEQ ID NO: 703136 - RNA, 64 nt, Homo Sapiens; identical to SEQ ID NO: 29876

SEQ ID NO: 703137 - RNA, 64 nt, Homo Sapiens; identical to SEQ ID NO: 29877

SEQ ID NO: 703138 - RNA, 64 nt, Homo Sapiens; identical to SEQ ID NO: 29878

SEQ ID NO: 703139 - RNA, 64 nt, Homo Sapiens; identical to SEQ ID NO: 29879

SEQ ID NO: 703140 - RNA, 64 nt, Homo Sapiens; identical to SEQ ID NO: 29880

SEQ ID NO: 703141 - RNA, 64 nt, Homo Sapiens; identical to SEQ ID NO: 29881

SEQ ID NO: 703142 - RNA, 64 nt, Homo Sapiens; identical to SEQ ID NO: 29882

SEQ ID NO: 703143 - RNA, 64 nt, Homo Sapiens; identical to SEQ ID NO: 29883

SEQ ID NO: 703144 - RNA, 64 nt, Homo Sapiens; identical to SEQ ID NO: 29884

SEQ ID NO: 703145 - RNA, 64 nt, Homo Sapiens; identical to SEQ ID NO: 29885

SEQ ID NO: 703146 - RNA, 64 nt, Homo Sapiens; identical to SEQ ID NO: 29886

SEQ ID NO: 703147 - RNA, 64 nt, Homo Sapiens; identical to SEQ ID NO: 29887

SEQ ID NO: 703148 - RNA, 64 nt, Homo Sapiens; identical to SEQ ID NO: 29888

SEQ ID NO: 703149 - RNA, 64 nt, Homo Sapiens; identical to SEQ ID NO: 29889

SEQ ID NO: 703150 - RNA, 64 nt, Homo Sapiens; identical to SEQ ID NO: 29890

SEQ ID NO: 703151 - RNA, 64 nt, Homo Sapiens; identical to SEQ ID NO: 29891

SEQ ID NO: 703152 - RNA, 64 nt, Homo Sapiens; identical to SEQ ID NO: 29892

SEQ ID NO: 703153 - RNA, 64 nt, Homo Sapiens; identical to SEQ ID NO: 29893

SEQ ID NO: 703154 - RNA, 64 nt, Homo Sapiens; identical to SEQ ID NO: 29894

SEQ ID NO: 703155 - RNA, 64 nt, Homo Sapiens; identical to SEQ ID NO: 29895

SEQ ID NO: 703156 - RNA, 64 nt, Homo Sapiens; identical to SEQ ID NO: 29896

SEQ ID NO: 703157 - RNA, 64 nt, Homo Sapiens; identical to SEQ ID NO: 29897

SEQ ID NO: 703158 - RNA, 64 nt, Homo Sapiens; identical to SEQ ID NO: 29898

SEQ ID NO: 703159 - RNA, 64 nt, Homo Sapiens; identical to SEQ ID NO: 29899

SEQ ID NO: 703160 - RNA, 64 nt, Homo Sapiens; identical to SEQ ID NO: 29900

SEQ ID NO: 703161 - RNA, 64 nt, Homo Sapiens; identical to SEQ ID NO: 29901

SEQ ID NO: 703162 - RNA, 64 nt, Homo Sapiens; identical to SEQ ID NO: 29902

SEQ ID NO: 703163 - RNA, 64 nt, Homo Sapiens; identical to SEQ ID NO: 29903

SEQ ID NO: 703164 - RNA, 64 nt, Homo Sapiens; identical to SEQ ID NO: 29904

SEQ ID NO: 703165 - RNA, 64 nt, Homo Sapiens; identical to SEQ ID NO: 29905

SEQ ID NO: 703166 - RNA, 64 nt, Homo Sapiens; identical to SEQ ID NO: 29906

SEQ ID NO: 703167 - RNA, 64 nt, Homo Sapiens; identical to SEQ ID NO: 29907

SEQ ID NO: 703168 - RNA, 64 nt, Homo Sapiens; identical to SEQ ID NO: 29908

SEQ ID NO: 703169 - RNA, 64 nt, Homo Sapiens; identical to SEQ ID NO: 29909

SEQ ID NO: 703170 - RNA, 64 nt, Homo Sapiens; identical to SEQ ID NO: 29910

SEQ ID NO: 703171 - RNA, 64 nt, Homo Sapiens; identical to SEQ ID NO: 29911

SEQ ID NO: 703172 - RNA, 64 nt, Homo Sapiens; identical to SEQ ID NO: 29912

SEQ ID NO: 703173 - RNA, 64 nt, Homo Sapiens; identical to SEQ ID NO: 29913

SEQ ID NO: 703174 - RNA, 64 nt, Homo Sapiens; identical to SEQ ID NO: 29914

SEQ ID NO: 703175 - RNA, 64 nt, Homo Sapiens; identical to SEQ ID NO: 29915

SEQ ID NO: 703176 - RNA, 64 nt, Homo Sapiens; identical to SEQ ID NO: 29916

SEQ ID NO: 703177 - RNA, 64 nt, Homo Sapiens; identical to SEQ ID NO: 29917

SEQ ID NO: 703178 - RNA, 64 nt, Homo Sapiens; identical to SEQ ID NO: 29918

SEQ ID NO: 703179 - RNA, 64 nt, Homo Sapiens; identical to SEQ ID NO: 29919

SEQ ID NO: 703180 - RNA, 64 nt, Homo Sapiens; identical to SEQ ID NO: 29920

SEQ ID NO: 703181 - RNA, 64 nt, Homo Sapiens; identical to SEQ ID NO: 29921

SEQ ID NO: 703182 - RNA, 64 nt, Homo Sapiens; identical to SEQ ID NO: 29922

SEQ ID NO: 703183 - RNA, 64 nt, Homo Sapiens; identical to SEQ ID NO: 29923

SEQ ID NO: 703184 - RNA, 64 nt, Homo Sapiens; identical to SEQ ID NO: 29924

SEQ ID NO: 703185 - RNA, 64 nt, Homo Sapiens; identical to SEQ ID NO: 29925

SEQ ID NO: 703186 - RNA, 64 nt, Homo Sapiens; identical to SEQ ID NO: 29926

SEQ ID NO: 703187 - RNA, 64 nt, Homo Sapiens; identical to SEQ ID NO: 29927

SEQ ID NO: 703188 - RNA, 64 nt, Homo Sapiens; identical to SEQ ID NO: 29928

SEQ ID NO: 703189 - RNA, 64 nt, Homo Sapiens; identical to SEQ ID NO: 29929

SEQ ID NO: 703190 - RNA, 64 nt, Homo Sapiens; identical to SEQ ID NO: 29930

SEQ ID NO: 703191 - RNA, 64 nt, Homo Sapiens; identical to SEQ ID NO: 29931

SEQ ID NO: 703192 - RNA, 64 nt, Homo Sapiens; identical to SEQ ID NO: 29932

SEQ ID NO: 703193 - RNA, 64 nt, Homo Sapiens; identical to SEQ ID NO: 29933

SEQ ID NO: 703194 - RNA, 64 nt, Homo Sapiens; identical to SEQ ID NO: 29934

SEQ ID NO: 703195 - RNA, 64 nt, Homo Sapiens; identical to SEQ ID NO: 29935

SEQ ID NO: 703196 - RNA, 64 nt, Homo Sapiens; identical to SEQ ID NO: 29936

SEQ ID NO: 703197 - RNA, 64 nt, Homo Sapiens; identical to SEQ ID NO: 29937

SEQ ID NO: 703198 - RNA, 64 nt, Homo Sapiens; identical to SEQ ID NO: 29938

SEQ ID NO: 703199 - RNA, 64 nt, Homo Sapiens; identical to SEQ ID NO: 29939

SEQ ID NO: 703200 - RNA, 64 nt, Homo Sapiens; identical to SEQ ID NO: 29940

SEQ ID NO: 703201 - RNA, 64 nt, Homo Sapiens; identical to SEQ ID NO: 29941

SEQ ID NO: 703202 - RNA, 64 nt, Homo Sapiens; identical to SEQ ID NO: 29942

SEQ ID NO: 703203 - RNA, 64 nt, Homo Sapiens; identical to SEQ ID NO: 29943

SEQ ID NO: 703204 - RNA, 64 nt, Homo Sapiens; identical to SEQ ID NO: 29944

SEQ ID NO: 703205 - RNA, 64 nt, Homo Sapiens; identical to SEQ ID NO: 29945

SEQ ID NO: 703206 - RNA, 64 nt, Homo Sapiens; identical to SEQ ID NO: 29946

SEQ ID NO: 703207 - RNA, 64 nt, Homo Sapiens; identical to SEQ ID NO: 29947

SEQ ID NO: 703208 - RNA, 64 nt, Homo Sapiens; identical to SEQ ID NO: 29948

SEQ ID NO: 703209 - RNA, 64 nt, Homo Sapiens; identical to SEQ ID NO: 29949

SEQ ID NO: 703210 - RNA, 64 nt, Homo Sapiens; identical to SEQ ID NO: 29950

SEQ ID NO: 703211 - RNA, 64 nt, Homo Sapiens; identical to SEQ ID NO: 29951

SEQ ID NO: 703212 - RNA, 64 nt, Homo Sapiens; identical to SEQ ID NO: 29952

SEQ ID NO: 703213 - RNA, 64 nt, Homo Sapiens; identical to SEQ ID NO: 29953

SEQ ID NO: 703214 - RNA, 64 nt, Homo Sapiens; identical to SEQ ID NO: 29954

SEQ ID NO: 703215 - RNA, 64 nt, Homo Sapiens; identical to SEQ ID NO: 29955

SEQ ID NO: 703216 - RNA, 64 nt, Homo Sapiens; identical to SEQ ID NO: 29956

SEQ ID NO: 703217 - RNA, 64 nt, Homo Sapiens; identical to SEQ ID NO: 29957

SEQ ID NO: 703218 - RNA, 64 nt, Homo Sapiens; identical to SEQ ID NO: 29958

SEQ ID NO: 703219 - RNA, 64 nt, Homo Sapiens; identical to SEQ ID NO: 29959

SEQ ID NO: 703220 - RNA, 64 nt, Homo Sapiens; identical to SEQ ID NO: 29960

SEQ ID NO: 703221 - RNA, 64 nt, Homo Sapiens; identical to SEQ ID NO: 29961

SEQ ID NO: 703222 - RNA, 64 nt, Homo Sapiens; identical to SEQ ID NO: 29962

SEQ ID NO: 703223 - RNA, 64 nt, Homo Sapiens; identical to SEQ ID NO: 29963

SEQ ID NO: 703224 - RNA, 64 nt, Homo Sapiens; identical to SEQ ID NO: 29964

SEQ ID NO: 703225 - RNA, 64 nt, Homo Sapiens; identical to SEQ ID NO: 29965

SEQ ID NO: 703226 - RNA, 64 nt, Homo Sapiens; identical to SEQ ID NO: 29966

SEQ ID NO: 703227 - RNA, 64 nt, Homo Sapiens; identical to SEQ ID NO: 29967

SEQ ID NO: 703228 - RNA, 64 nt, Homo Sapiens; identical to SEQ ID NO: 29968

SEQ ID NO: 703229 - RNA, 64 nt, Homo Sapiens; identical to SEQ ID NO: 29969

SEQ ID NO: 703230 - RNA, 64 nt, Homo Sapiens; identical to SEQ ID NO: 29970

SEQ ID NO: 703231 - RNA, 64 nt, Homo Sapiens; identical to SEQ ID NO: 29971

SEQ ID NO: 703232 - RNA, 64 nt, Homo Sapiens; identical to SEQ ID NO: 29972

SEQ ID NO: 703233 - RNA, 64 nt, Homo Sapiens; identical to SEQ ID NO: 29973

SEQ ID NO: 703234 - RNA, 64 nt, Homo Sapiens; identical to SEQ ID NO: 29974

SEQ ID NO: 703235 - RNA, 64 nt, Homo Sapiens; identical to SEQ ID NO: 29975

SEQ ID NO: 703236 - RNA, 64 nt, Homo Sapiens; identical to SEQ ID NO: 29976

SEQ ID NO: 703237 - RNA, 64 nt, Homo Sapiens; identical to SEQ ID NO: 29977

SEQ ID NO: 703238 - RNA, 64 nt, Homo Sapiens; identical to SEQ ID NO: 29978

SEQ ID NO: 703239 - RNA, 64 nt, Homo Sapiens; identical to SEQ ID NO: 29979

SEQ ID NO: 703240 - RNA, 64 nt, Homo Sapiens; identical to SEQ ID NO: 29980

SEQ ID NO: 703241 - RNA, 64 nt, Homo Sapiens; identical to SEQ ID NO: 29981

SEQ ID NO: 703242 - RNA, 64 nt, Homo Sapiens; identical to SEQ ID NO: 29982

SEQ ID NO: 703243 - RNA, 64 nt, Homo Sapiens; identical to SEQ ID NO: 29983

SEQ ID NO: 703244 - RNA, 64 nt, Homo Sapiens; identical to SEQ ID NO: 29984

SEQ ID NO: 703245 - RNA, 64 nt, Homo Sapiens; identical to SEQ ID NO: 29985

SEQ ID NO: 703246 - RNA, 64 nt, Homo Sapiens; identical to SEQ ID NO: 29986

SEQ ID NO: 703247 - RNA, 64 nt, Homo Sapiens; identical to SEQ ID NO: 29987

SEQ ID NO: 703248 - RNA, 64 nt, Homo Sapiens; identical to SEQ ID NO: 29988

SEQ ID NO: 703249 - RNA, 64 nt, Homo Sapiens; identical to SEQ ID NO: 29989

SEQ ID NO: 703250 - RNA, 64 nt, Homo Sapiens; identical to SEQ ID NO: 29990

SEQ ID NO: 703251 - RNA, 64 nt, Homo Sapiens; identical to SEQ ID NO: 29991

SEQ ID NO: 703252 - RNA, 64 nt, Homo Sapiens; identical to SEQ ID NO: 29992

SEQ ID NO: 703253 - RNA, 64 nt, Homo Sapiens; identical to SEQ ID NO: 29993

SEQ ID NO: 703254 - RNA, 64 nt, Homo Sapiens; identical to SEQ ID NO: 29994

SEQ ID NO: 703255 - RNA, 64 nt, Homo Sapiens; identical to SEQ ID NO: 29995

SEQ ID NO: 703256 - RNA, 64 nt, Homo Sapiens; identical to SEQ ID NO: 29996

SEQ ID NO: 703257 - RNA, 64 nt, Homo Sapiens; identical to SEQ ID NO: 29997

SEQ ID NO: 703258 - RNA, 64 nt, Homo Sapiens; identical to SEQ ID NO: 29998

SEQ ID NO: 703259 - RNA, 64 nt, Homo Sapiens; identical to SEQ ID NO: 29999

SEQ ID NO: 703260 - RNA, 64 nt, Homo Sapiens; identical to SEQ ID NO: 30000

SEQ ID NO: 703261 - RNA, 64 nt, Homo Sapiens; identical to SEQ ID NO: 30001

SEQ ID NO: 703262 - RNA, 64 nt, Homo Sapiens; identical to SEQ ID NO: 30002

SEQ ID NO: 703263 - RNA, 64 nt, Homo Sapiens; identical to SEQ ID NO: 30003

SEQ ID NO: 703264 - RNA, 64 nt, Homo Sapiens; identical to SEQ ID NO: 30004

SEQ ID NO: 703265 - RNA, 64 nt, Homo Sapiens; identical to SEQ ID NO: 30005

SEQ ID NO: 703266 - RNA, 64 nt, Homo Sapiens; identical to SEQ ID NO: 30006

SEQ ID NO: 703267 - RNA, 64 nt, Homo Sapiens; identical to SEQ ID NO: 30007

SEQ ID NO: 703268 - RNA, 64 nt, Homo Sapiens; identical to SEQ ID NO: 30008

SEQ ID NO: 703269 - RNA, 64 nt, Homo Sapiens; identical to SEQ ID NO: 30009

SEQ ID NO: 703270 - RNA, 64 nt, Homo Sapiens; identical to SEQ ID NO: 30010

SEQ ID NO: 703271 - RNA, 64 nt, Homo Sapiens; identical to SEQ ID NO: 30011

SEQ ID NO: 703272 - RNA, 64 nt, Homo Sapiens; identical to SEQ ID NO: 30012

SEQ ID NO: 703273 - RNA, 64 nt, Homo Sapiens; identical to SEQ ID NO: 30013

SEQ ID NO: 703274 - RNA, 64 nt, Homo Sapiens; identical to SEQ ID NO: 30014

SEQ ID NO: 703275 - RNA, 64 nt, Homo Sapiens; identical to SEQ ID NO: 30015

SEQ ID NO: 703276 - RNA, 64 nt, Homo Sapiens; identical to SEQ ID NO: 30016

SEQ ID NO: 703277 - RNA, 64 nt, Homo Sapiens; identical to SEQ ID NO: 30017

SEQ ID NO: 703278 - RNA, 64 nt, Homo Sapiens; identical to SEQ ID NO: 30018

SEQ ID NO: 703279 - RNA, 64 nt, Homo Sapiens; identical to SEQ ID NO: 30019

SEQ ID NO: 703280 - RNA, 64 nt, Homo Sapiens; identical to SEQ ID NO: 30020

SEQ ID NO: 703281 - RNA, 64 nt, Homo Sapiens; identical to SEQ ID NO: 30021

SEQ ID NO: 703282 - RNA, 64 nt, Homo Sapiens; identical to SEQ ID NO: 30022

SEQ ID NO: 703283 - RNA, 64 nt, Homo Sapiens; identical to SEQ ID NO: 30023

SEQ ID NO: 703284 - RNA, 64 nt, Homo Sapiens; identical to SEQ ID NO: 30024

SEQ ID NO: 703285 - RNA, 64 nt, Homo Sapiens; identical to SEQ ID NO: 30025

SEQ ID NO: 703286 - RNA, 64 nt, Homo Sapiens; identical to SEQ ID NO: 30026

SEQ ID NO: 703287 - RNA, 64 nt, Homo Sapiens; identical to SEQ ID NO: 30027

SEQ ID NO: 703288 - RNA, 64 nt, Homo Sapiens; identical to SEQ ID NO: 30028

SEQ ID NO: 703289 - RNA, 64 nt, Homo Sapiens; identical to SEQ ID NO: 30029

SEQ ID NO: 703290 - RNA, 64 nt, Homo Sapiens; identical to SEQ ID NO: 30030

SEQ ID NO: 703291 - RNA, 64 nt, Homo Sapiens; identical to SEQ ID NO: 30031

SEQ ID NO: 703292 - RNA, 64 nt, Homo Sapiens; identical to SEQ ID NO: 30032

SEQ ID NO: 703293 - RNA, 64 nt, Homo Sapiens; identical to SEQ ID NO: 30033

SEQ ID NO: 703294 - RNA, 64 nt, Homo Sapiens; identical to SEQ ID NO: 30034

SEQ ID NO: 703295 - RNA, 64 nt, Homo Sapiens; identical to SEQ ID NO: 30035

SEQ ID NO: 703296 - RNA, 64 nt, Homo Sapiens; identical to SEQ ID NO: 30036

SEQ ID NO: 703297 - RNA, 64 nt, Homo Sapiens; identical to SEQ ID NO: 30037

SEQ ID NO: 703298 - RNA, 64 nt, Homo Sapiens; identical to SEQ ID NO: 30038

SEQ ID NO: 703299 - RNA, 64 nt, Homo Sapiens; identical to SEQ ID NO: 30039

SEQ ID NO: 703300 - RNA, 64 nt, Homo Sapiens; identical to SEQ ID NO: 30040

SEQ ID NO: 703301 - RNA, 64 nt, Homo Sapiens; identical to SEQ ID NO: 30041

SEQ ID NO: 703302 - RNA, 64 nt, Homo Sapiens; identical to SEQ ID NO: 30042

SEQ ID NO: 703303 - RNA, 64 nt, Homo Sapiens; identical to SEQ ID NO: 30043

SEQ ID NO: 703304 - RNA, 64 nt, Homo Sapiens; identical to SEQ ID NO: 30044

SEQ ID NO: 703305 - RNA, 64 nt, Homo Sapiens; identical to SEQ ID NO: 30045

SEQ ID NO: 703306 - RNA, 64 nt, Homo Sapiens; identical to SEQ ID NO: 30046

SEQ ID NO: 703307 - RNA, 64 nt, Homo Sapiens; identical to SEQ ID NO: 30047

SEQ ID NO: 703308 - RNA, 64 nt, Homo Sapiens; identical to SEQ ID NO: 30048

SEQ ID NO: 703309 - RNA, 64 nt, Homo Sapiens; identical to SEQ ID NO: 30049

SEQ ID NO: 703310 - RNA, 64 nt, Homo Sapiens; identical to SEQ ID NO: 30050

SEQ ID NO: 703311 - RNA, 64 nt, Homo Sapiens; identical to SEQ ID NO: 30051

SEQ ID NO: 703312 - RNA, 64 nt, Homo Sapiens; identical to SEQ ID NO: 30052

SEQ ID NO: 703313 - RNA, 64 nt, Homo Sapiens; identical to SEQ ID NO: 30053

SEQ ID NO: 703314 - RNA, 64 nt, Homo Sapiens; identical to SEQ ID NO: 30054

SEQ ID NO: 703315 - RNA, 64 nt, Homo Sapiens; identical to SEQ ID NO: 30055

SEQ ID NO: 703316 - RNA, 64 nt, Homo Sapiens; identical to SEQ ID NO: 30056

SEQ ID NO: 703317 - RNA, 64 nt, Homo Sapiens; identical to SEQ ID NO: 30057

SEQ ID NO: 703318 - RNA, 64 nt, Homo Sapiens; identical to SEQ ID NO: 30058

SEQ ID NO: 703319 - RNA, 64 nt, Homo Sapiens; identical to SEQ ID NO: 30059

SEQ ID NO: 703320 - RNA, 64 nt, Homo Sapiens; identical to SEQ ID NO: 30060

SEQ ID NO: 703321 - RNA, 64 nt, Homo Sapiens; identical to SEQ ID NO: 30061

SEQ ID NO: 703322 - RNA, 64 nt, Homo Sapiens; identical to SEQ ID NO: 30062

SEQ ID NO: 703323 - RNA, 64 nt, Homo Sapiens; identical to SEQ ID NO: 30063

SEQ ID NO: 703324 - RNA, 64 nt, Homo Sapiens; identical to SEQ ID NO: 30064

SEQ ID NO: 703325 - RNA, 64 nt, Homo Sapiens; identical to SEQ ID NO: 30065

SEQ ID NO: 703326 - RNA, 64 nt, Homo Sapiens; identical to SEQ ID NO: 30066

SEQ ID NO: 703327 - RNA, 64 nt, Homo Sapiens; identical to SEQ ID NO: 30067

SEQ ID NO: 703328 - RNA, 64 nt, Homo Sapiens; identical to SEQ ID NO: 30068

SEQ ID NO: 703329 - RNA, 64 nt, Homo Sapiens; identical to SEQ ID NO: 30069

SEQ ID NO: 703330 - RNA, 64 nt, Homo Sapiens; identical to SEQ ID NO: 30070

SEQ ID NO: 703331 - RNA, 64 nt, Homo Sapiens; identical to SEQ ID NO: 30071

SEQ ID NO: 703332 - RNA, 64 nt, Homo Sapiens; identical to SEQ ID NO: 30072

SEQ ID NO: 703333 - RNA, 64 nt, Homo Sapiens; identical to SEQ ID NO: 30073

SEQ ID NO: 703334 - RNA, 64 nt, Homo Sapiens; identical to SEQ ID NO: 30074

SEQ ID NO: 703335 - RNA, 64 nt, Homo Sapiens; identical to SEQ ID NO: 30075

SEQ ID NO: 703336 - RNA, 64 nt, Homo Sapiens; identical to SEQ ID NO: 30076

SEQ ID NO: 703337 - RNA, 64 nt, Homo Sapiens; identical to SEQ ID NO: 30077

SEQ ID NO: 703338 - RNA, 64 nt, Homo Sapiens; identical to SEQ ID NO: 30078

SEQ ID NO: 703339 - RNA, 64 nt, Homo Sapiens; identical to SEQ ID NO: 30079

SEQ ID NO: 703340 - RNA, 64 nt, Homo Sapiens; identical to SEQ ID NO: 30080

SEQ ID NO: 703341 - RNA, 64 nt, Homo Sapiens; identical to SEQ ID NO: 30081

SEQ ID NO: 703342 - RNA, 64 nt, Homo Sapiens; identical to SEQ ID NO: 30082

SEQ ID NO: 703343 - RNA, 64 nt, Homo Sapiens; identical to SEQ ID NO: 30083

SEQ ID NO: 703344 - RNA, 64 nt, Homo Sapiens; identical to SEQ ID NO: 30084

SEQ ID NO: 703345 - RNA, 64 nt, Homo Sapiens; identical to SEQ ID NO: 30085

SEQ ID NO: 703346 - RNA, 64 nt, Homo Sapiens; identical to SEQ ID NO: 30086

SEQ ID NO: 703347 - RNA, 64 nt, Homo Sapiens; identical to SEQ ID NO: 30087

SEQ ID NO: 703348 - RNA, 64 nt, Homo Sapiens; identical to SEQ ID NO: 30088

SEQ ID NO: 703349 - RNA, 64 nt, Homo Sapiens; identical to SEQ ID NO: 30089

SEQ ID NO: 703350 - RNA, 64 nt, Homo Sapiens; identical to SEQ ID NO: 30090

SEQ ID NO: 703351 - RNA, 64 nt, Homo Sapiens; identical to SEQ ID NO: 30091

SEQ ID NO: 703352 - RNA, 64 nt, Homo Sapiens; identical to SEQ ID NO: 30092

SEQ ID NO: 703353 - RNA, 64 nt, Homo Sapiens; identical to SEQ ID NO: 30093

SEQ ID NO: 703354 - RNA, 64 nt, Homo Sapiens; identical to SEQ ID NO: 30094

SEQ ID NO: 703355 - RNA, 64 nt, Homo Sapiens; identical to SEQ ID NO: 30095

SEQ ID NO: 703356 - RNA, 64 nt, Homo Sapiens; identical to SEQ ID NO: 30096

SEQ ID NO: 703357 - RNA, 64 nt, Homo Sapiens; identical to SEQ ID NO: 30097

SEQ ID NO: 703358 - RNA, 64 nt, Homo Sapiens; identical to SEQ ID NO: 30098

SEQ ID NO: 703359 - RNA, 64 nt, Homo Sapiens; identical to SEQ ID NO: 30099

SEQ ID NO: 703360 - RNA, 64 nt, Homo Sapiens; identical to SEQ ID NO: 30100

SEQ ID NO: 703361 - RNA, 64 nt, Homo Sapiens; identical to SEQ ID NO: 30101

SEQ ID NO: 703362 - RNA, 64 nt, Homo Sapiens; identical to SEQ ID NO: 30102

SEQ ID NO: 703363 - RNA, 64 nt, Homo Sapiens; identical to SEQ ID NO: 30103

SEQ ID NO: 703364 - RNA, 64 nt, Homo Sapiens; identical to SEQ ID NO: 30104

SEQ ID NO: 703365 - RNA, 64 nt, Homo Sapiens; identical to SEQ ID NO: 30105

SEQ ID NO: 703366 - RNA, 64 nt, Homo Sapiens; identical to SEQ ID NO: 30106

SEQ ID NO: 703367 - RNA, 64 nt, Homo Sapiens; identical to SEQ ID NO: 30107

SEQ ID NO: 703368 - RNA, 64 nt, Homo Sapiens; identical to SEQ ID NO: 30108

SEQ ID NO: 703369 - RNA, 64 nt, Homo Sapiens; identical to SEQ ID NO: 30109

SEQ ID NO: 703370 - RNA, 64 nt, Homo Sapiens; identical to SEQ ID NO: 30110

SEQ ID NO: 703371 - RNA, 64 nt, Homo Sapiens; identical to SEQ ID NO: 30111

SEQ ID NO: 703372 - RNA, 64 nt, Homo Sapiens; identical to SEQ ID NO: 30112

SEQ ID NO: 703373 - RNA, 64 nt, Homo Sapiens; identical to SEQ ID NO: 30113

SEQ ID NO: 703374 - RNA, 64 nt, Homo Sapiens; identical to SEQ ID NO: 30114

SEQ ID NO: 703375 - RNA, 52 nt, Homo Sapiens; identical to SEQ ID NO: 30115

SEQ ID NO: 703376 - RNA, 64 nt, Homo Sapiens; identical to SEQ ID NO: 30116

SEQ ID NO: 703377 - RNA, 64 nt, Homo Sapiens; identical to SEQ ID NO: 30117

SEQ ID NO: 703378 - RNA, 64 nt, Homo Sapiens; identical to SEQ ID NO: 30118

SEQ ID NO: 703379 - RNA, 64 nt, Homo Sapiens; identical to SEQ ID NO: 30119

SEQ ID NO: 703380 - RNA, 64 nt, Homo Sapiens; identical to SEQ ID NO: 30120

SEQ ID NO: 703381 - RNA, 64 nt, Homo Sapiens; identical to SEQ ID NO: 30121

SEQ ID NO: 703382 - RNA, 64 nt, Homo Sapiens; identical to SEQ ID NO: 30122

SEQ ID NO: 703383 - RNA, 64 nt, Homo Sapiens; identical to SEQ ID NO: 30123

SEQ ID NO: 703384 - RNA, 64 nt, Homo Sapiens; identical to SEQ ID NO: 30124

SEQ ID NO: 703385 - RNA, 64 nt, Homo Sapiens; identical to SEQ ID NO: 30125

SEQ ID NO: 703386 - RNA, 64 nt, Homo Sapiens; identical to SEQ ID NO: 30126

SEQ ID NO: 703387 - RNA, 64 nt, Homo Sapiens; identical to SEQ ID NO: 30127

SEQ ID NO: 703388 - RNA, 64 nt, Homo Sapiens; identical to SEQ ID NO: 30128

SEQ ID NO: 703389 - RNA, 64 nt, Homo Sapiens; identical to SEQ ID NO: 30129

SEQ ID NO: 703390 - RNA, 64 nt, Homo Sapiens; identical to SEQ ID NO: 30130

SEQ ID NO: 703391 - RNA, 64 nt, Homo Sapiens; identical to SEQ ID NO: 30131

SEQ ID NO: 703392 - RNA, 64 nt, Homo Sapiens; identical to SEQ ID NO: 30132

SEQ ID NO: 703393 - RNA, 64 nt, Homo Sapiens; identical to SEQ ID NO: 30133

SEQ ID NO: 703394 - RNA, 64 nt, Homo Sapiens; identical to SEQ ID NO: 30134

SEQ ID NO: 703395 - RNA, 64 nt, Homo Sapiens; identical to SEQ ID NO: 30135

SEQ ID NO: 703396 - RNA, 64 nt, Homo Sapiens; identical to SEQ ID NO: 30136

SEQ ID NO: 703397 - RNA, 64 nt, Homo Sapiens; identical to SEQ ID NO: 30137

SEQ ID NO: 703398 - RNA, 64 nt, Homo Sapiens; identical to SEQ ID NO: 30138

SEQ ID NO: 703399 - RNA, 64 nt, Homo Sapiens; identical to SEQ ID NO: 30139

SEQ ID NO: 703400 - RNA, 64 nt, Homo Sapiens; identical to SEQ ID NO: 30140

SEQ ID NO: 703401 - RNA, 64 nt, Homo Sapiens; identical to SEQ ID NO: 30141

SEQ ID NO: 703402 - RNA, 64 nt, Homo Sapiens; identical to SEQ ID NO: 30142

SEQ ID NO: 703403 - RNA, 64 nt, Homo Sapiens; identical to SEQ ID NO: 30143

SEQ ID NO: 703404 - RNA, 64 nt, Homo Sapiens; identical to SEQ ID NO: 30144

SEQ ID NO: 703405 - RNA, 64 nt, Homo Sapiens; identical to SEQ ID NO: 30145

SEQ ID NO: 703406 - RNA, 64 nt, Homo Sapiens; identical to SEQ ID NO: 30146

SEQ ID NO: 703407 - RNA, 64 nt, Homo Sapiens; identical to SEQ ID NO: 30147

SEQ ID NO: 703408 - RNA, 64 nt, Homo Sapiens; identical to SEQ ID NO: 30148

SEQ ID NO: 703409 - RNA, 64 nt, Homo Sapiens; identical to SEQ ID NO: 30149

SEQ ID NO: 703410 - RNA, 64 nt, Homo Sapiens; identical to SEQ ID NO: 30150

SEQ ID NO: 703411 - RNA, 64 nt, Homo Sapiens; identical to SEQ ID NO: 30151

SEQ ID NO: 703412 - RNA, 64 nt, Homo Sapiens; identical to SEQ ID NO: 30152

SEQ ID NO: 703413 - RNA, 64 nt, Homo Sapiens; identical to SEQ ID NO: 30153

SEQ ID NO: 703414 - RNA, 64 nt, Homo Sapiens; identical to SEQ ID NO: 30154

SEQ ID NO: 703415 - RNA, 64 nt, Homo Sapiens; identical to SEQ ID NO: 30155

SEQ ID NO: 703416 - RNA, 64 nt, Homo Sapiens; identical to SEQ ID NO: 30156

SEQ ID NO: 703417 - RNA, 64 nt, Homo Sapiens; identical to SEQ ID NO: 30157

SEQ ID NO: 703418 - RNA, 64 nt, Homo Sapiens; identical to SEQ ID NO: 30158

SEQ ID NO: 703419 - RNA, 64 nt, Homo Sapiens; identical to SEQ ID NO: 30159

SEQ ID NO: 703420 - RNA, 64 nt, Homo Sapiens; identical to SEQ ID NO: 30160

SEQ ID NO: 703421 - RNA, 64 nt, Homo Sapiens; identical to SEQ ID NO: 30161

SEQ ID NO: 703422 - RNA, 64 nt, Homo Sapiens; identical to SEQ ID NO: 30162

SEQ ID NO: 703423 - RNA, 64 nt, Homo Sapiens; identical to SEQ ID NO: 30163

SEQ ID NO: 703424 - RNA, 64 nt, Homo Sapiens; identical to SEQ ID NO: 30164

SEQ ID NO: 703425 - RNA, 64 nt, Homo Sapiens; identical to SEQ ID NO: 30165

SEQ ID NO: 703426 - RNA, 64 nt, Homo Sapiens; identical to SEQ ID NO: 30166

SEQ ID NO: 703427 - RNA, 64 nt, Homo Sapiens; identical to SEQ ID NO: 30167

SEQ ID NO: 703428 - RNA, 64 nt, Homo Sapiens; identical to SEQ ID NO: 30168

SEQ ID NO: 703429 - RNA, 64 nt, Homo Sapiens; identical to SEQ ID NO: 30169

SEQ ID NO: 703430 - RNA, 64 nt, Homo Sapiens; identical to SEQ ID NO: 30170

SEQ ID NO: 703431 - RNA, 64 nt, Homo Sapiens; identical to SEQ ID NO: 30171

SEQ ID NO: 703432 - RNA, 64 nt, Homo Sapiens; identical to SEQ ID NO: 30172

SEQ ID NO: 703433 - RNA, 64 nt, Homo Sapiens; identical to SEQ ID NO: 30173

SEQ ID NO: 703434 - RNA, 64 nt, Homo Sapiens; identical to SEQ ID NO: 30174

SEQ ID NO: 703435 - RNA, 64 nt, Homo Sapiens; identical to SEQ ID NO: 30175

SEQ ID NO: 703436 - RNA, 64 nt, Homo Sapiens; identical to SEQ ID NO: 30176

SEQ ID NO: 703437 - RNA, 64 nt, Homo Sapiens; identical to SEQ ID NO: 30177

SEQ ID NO: 703438 - RNA, 64 nt, Homo Sapiens; identical to SEQ ID NO: 30178

SEQ ID NO: 703439 - RNA, 64 nt, Homo Sapiens; identical to SEQ ID NO: 30179

SEQ ID NO: 703440 - RNA, 64 nt, Homo Sapiens; identical to SEQ ID NO: 30180

SEQ ID NO: 703441 - RNA, 64 nt, Homo Sapiens; identical to SEQ ID NO: 30181

SEQ ID NO: 703442 - RNA, 64 nt, Homo Sapiens; identical to SEQ ID NO: 30182

SEQ ID NO: 703443 - RNA, 64 nt, Homo Sapiens; identical to SEQ ID NO: 30183

SEQ ID NO: 703444 - RNA, 64 nt, Homo Sapiens; identical to SEQ ID NO: 30184

SEQ ID NO: 703445 - RNA, 64 nt, Homo Sapiens; identical to SEQ ID NO: 30185

SEQ ID NO: 703446 - RNA, 64 nt, Homo Sapiens; identical to SEQ ID NO: 30186

SEQ ID NO: 703447 - RNA, 64 nt, Homo Sapiens; identical to SEQ ID NO: 30187

SEQ ID NO: 703448 - RNA, 64 nt, Homo Sapiens; identical to SEQ ID NO: 30188

SEQ ID NO: 703449 - RNA, 64 nt, Homo Sapiens; identical to SEQ ID NO: 30189

SEQ ID NO: 703450 - RNA, 64 nt, Homo Sapiens; identical to SEQ ID NO: 30190

SEQ ID NO: 703451 - RNA, 64 nt, Homo Sapiens; identical to SEQ ID NO: 30191

SEQ ID NO: 703452 - RNA, 64 nt, Homo Sapiens; identical to SEQ ID NO: 30192

SEQ ID NO: 703453 - RNA, 64 nt, Homo Sapiens; identical to SEQ ID NO: 30193

SEQ ID NO: 703454 - RNA, 64 nt, Homo Sapiens; identical to SEQ ID NO: 30194

SEQ ID NO: 703455 - RNA, 64 nt, Homo Sapiens; identical to SEQ ID NO: 30195

SEQ ID NO: 703456 - RNA, 64 nt, Homo Sapiens; identical to SEQ ID NO: 30196

SEQ ID NO: 703457 - RNA, 64 nt, Homo Sapiens; identical to SEQ ID NO: 30197

SEQ ID NO: 703458 - RNA, 64 nt, Homo Sapiens; identical to SEQ ID NO: 30198

SEQ ID NO: 703459 - RNA, 64 nt, Homo Sapiens; identical to SEQ ID NO: 30199

SEQ ID NO: 703460 - RNA, 64 nt, Homo Sapiens; identical to SEQ ID NO: 30200

SEQ ID NO: 703461 - RNA, 64 nt, Homo Sapiens; identical to SEQ ID NO: 30201

SEQ ID NO: 703462 - RNA, 64 nt, Homo Sapiens; identical to SEQ ID NO: 30202

SEQ ID NO: 703463 - RNA, 64 nt, Homo Sapiens; identical to SEQ ID NO: 30203

SEQ ID NO: 703464 - RNA, 64 nt, Homo Sapiens; identical to SEQ ID NO: 30204

SEQ ID NO: 703465 - RNA, 64 nt, Homo Sapiens; identical to SEQ ID NO: 30205

SEQ ID NO: 703466 - RNA, 64 nt, Homo Sapiens; identical to SEQ ID NO: 30206

SEQ ID NO: 703467 - RNA, 64 nt, Homo Sapiens; identical to SEQ ID NO: 30207

SEQ ID NO: 703468 - RNA, 64 nt, Homo Sapiens; identical to SEQ ID NO: 30208

SEQ ID NO: 703469 - RNA, 64 nt, Homo Sapiens; identical to SEQ ID NO: 30209

SEQ ID NO: 703470 - RNA, 64 nt, Homo Sapiens; identical to SEQ ID NO: 30210

SEQ ID NO: 703471 - RNA, 64 nt, Homo Sapiens; identical to SEQ ID NO: 30211

SEQ ID NO: 703472 - RNA, 64 nt, Homo Sapiens; identical to SEQ ID NO: 30212

SEQ ID NO: 703473 - RNA, 64 nt, Homo Sapiens; identical to SEQ ID NO: 30213

SEQ ID NO: 703474 - RNA, 64 nt, Homo Sapiens; identical to SEQ ID NO: 30214

SEQ ID NO: 703475 - RNA, 64 nt, Homo Sapiens; identical to SEQ ID NO: 30215

SEQ ID NO: 703476 - RNA, 64 nt, Homo Sapiens; identical to SEQ ID NO: 30216

SEQ ID NO: 703477 - RNA, 64 nt, Homo Sapiens; identical to SEQ ID NO: 30217

SEQ ID NO: 703478 - RNA, 64 nt, Homo Sapiens; identical to SEQ ID NO: 30218

SEQ ID NO: 703479 - RNA, 64 nt, Homo Sapiens; identical to SEQ ID NO: 30219

SEQ ID NO: 703480 - RNA, 64 nt, Homo Sapiens; identical to SEQ ID NO: 30220

SEQ ID NO: 703481 - RNA, 64 nt, Homo Sapiens; identical to SEQ ID NO: 30221

SEQ ID NO: 703482 - RNA, 64 nt, Homo Sapiens; identical to SEQ ID NO: 30222

SEQ ID NO: 703483 - RNA, 64 nt, Homo Sapiens; identical to SEQ ID NO: 30223

SEQ ID NO: 703484 - RNA, 64 nt, Homo Sapiens; identical to SEQ ID NO: 30224

SEQ ID NO: 703485 - RNA, 64 nt, Homo Sapiens; identical to SEQ ID NO: 30225

SEQ ID NO: 703486 - RNA, 64 nt, Homo Sapiens; identical to SEQ ID NO: 30226

SEQ ID NO: 703487 - RNA, 64 nt, Homo Sapiens; identical to SEQ ID NO: 30227

SEQ ID NO: 703488 - RNA, 64 nt, Homo Sapiens; identical to SEQ ID NO: 30228

SEQ ID NO: 703489 - RNA, 64 nt, Homo Sapiens; identical to SEQ ID NO: 30229

SEQ ID NO: 703490 - RNA, 64 nt, Homo Sapiens; identical to SEQ ID NO: 30230

SEQ ID NO: 703491 - RNA, 64 nt, Homo Sapiens; identical to SEQ ID NO: 30231

SEQ ID NO: 703492 - RNA, 64 nt, Homo Sapiens; identical to SEQ ID NO: 30232

SEQ ID NO: 703493 - RNA, 64 nt, Homo Sapiens; identical to SEQ ID NO: 30233

SEQ ID NO: 703494 - RNA, 64 nt, Homo Sapiens; identical to SEQ ID NO: 30234

SEQ ID NO: 703495 - RNA, 64 nt, Homo Sapiens; identical to SEQ ID NO: 30235

SEQ ID NO: 703496 - RNA, 64 nt, Homo Sapiens; identical to SEQ ID NO: 30236

SEQ ID NO: 703497 - RNA, 64 nt, Homo Sapiens; identical to SEQ ID NO: 30237

SEQ ID NO: 703498 - RNA, 64 nt, Homo Sapiens; identical to SEQ ID NO: 30238

SEQ ID NO: 703499 - RNA, 64 nt, Homo Sapiens; identical to SEQ ID NO: 30239

SEQ ID NO: 703500 - RNA, 64 nt, Homo Sapiens; identical to SEQ ID NO: 30240

SEQ ID NO: 703501 - RNA, 64 nt, Homo Sapiens; identical to SEQ ID NO: 30241

SEQ ID NO: 703502 - RNA, 64 nt, Homo Sapiens; identical to SEQ ID NO: 30242

SEQ ID NO: 703503 - RNA, 64 nt, Homo Sapiens; identical to SEQ ID NO: 30243

SEQ ID NO: 703504 - RNA, 64 nt, Homo Sapiens; identical to SEQ ID NO: 30244

SEQ ID NO: 703505 - RNA, 64 nt, Homo Sapiens; identical to SEQ ID NO: 30245

SEQ ID NO: 703506 - RNA, 64 nt, Homo Sapiens; identical to SEQ ID NO: 30246

SEQ ID NO: 703507 - RNA, 64 nt, Homo Sapiens; identical to SEQ ID NO: 30247

SEQ ID NO: 703508 - RNA, 64 nt, Homo Sapiens; identical to SEQ ID NO: 30248

SEQ ID NO: 703509 - RNA, 64 nt, Homo Sapiens; identical to SEQ ID NO: 30249

SEQ ID NO: 703510 - RNA, 64 nt, Homo Sapiens; identical to SEQ ID NO: 30250

SEQ ID NO: 703511 - RNA, 64 nt, Homo Sapiens; identical to SEQ ID NO: 30251

SEQ ID NO: 703512 - RNA, 64 nt, Homo Sapiens; identical to SEQ ID NO: 30252

SEQ ID NO: 703513 - RNA, 64 nt, Homo Sapiens; identical to SEQ ID NO: 30253

SEQ ID NO: 703514 - RNA, 64 nt, Homo Sapiens; identical to SEQ ID NO: 30254

SEQ ID NO: 703515 - RNA, 64 nt, Homo Sapiens; identical to SEQ ID NO: 30255

SEQ ID NO: 703516 - RNA, 63 nt, Homo Sapiens; identical to SEQ ID NO: 30256

SEQ ID NO: 703517 - RNA, 64 nt, Homo Sapiens; identical to SEQ ID NO: 30257

SEQ ID NO: 703518 - RNA, 64 nt, Homo Sapiens; identical to SEQ ID NO: 30258

SEQ ID NO: 703519 - RNA, 64 nt, Homo Sapiens; identical to SEQ ID NO: 30259

SEQ ID NO: 703520 - RNA, 64 nt, Homo Sapiens; identical to SEQ ID NO: 30260

SEQ ID NO: 703521 - RNA, 64 nt, Homo Sapiens; identical to SEQ ID NO: 30261

SEQ ID NO: 703522 - RNA, 64 nt, Homo Sapiens; identical to SEQ ID NO: 30262

SEQ ID NO: 703523 - RNA, 64 nt, Homo Sapiens; identical to SEQ ID NO: 30263

SEQ ID NO: 703524 - RNA, 64 nt, Homo Sapiens; identical to SEQ ID NO: 30264

SEQ ID NO: 703525 - RNA, 64 nt, Homo Sapiens; identical to SEQ ID NO: 30265

SEQ ID NO: 703526 - RNA, 64 nt, Homo Sapiens; identical to SEQ ID NO: 30266

SEQ ID NO: 703527 - RNA, 64 nt, Homo Sapiens; identical to SEQ ID NO: 30267

SEQ ID NO: 703528 - RNA, 64 nt, Homo Sapiens; identical to SEQ ID NO: 30268

SEQ ID NO: 703529 - RNA, 64 nt, Homo Sapiens; identical to SEQ ID NO: 30269

SEQ ID NO: 703530 - RNA, 64 nt, Homo Sapiens; identical to SEQ ID NO: 30270

SEQ ID NO: 703531 - RNA, 64 nt, Homo Sapiens; identical to SEQ ID NO: 30271

SEQ ID NO: 703532 - RNA, 64 nt, Homo Sapiens; identical to SEQ ID NO: 30272

SEQ ID NO: 703533 - RNA, 64 nt, Homo Sapiens; identical to SEQ ID NO: 30273

SEQ ID NO: 703534 - RNA, 64 nt, Homo Sapiens; identical to SEQ ID NO: 30274

SEQ ID NO: 703535 - RNA, 64 nt, Homo Sapiens; identical to SEQ ID NO: 30275

SEQ ID NO: 703536 - RNA, 64 nt, Homo Sapiens; identical to SEQ ID NO: 30276

SEQ ID NO: 703537 - RNA, 64 nt, Homo Sapiens; identical to SEQ ID NO: 30277

SEQ ID NO: 703538 - RNA, 64 nt, Homo Sapiens; identical to SEQ ID NO: 30278

SEQ ID NO: 703539 - RNA, 64 nt, Homo Sapiens; identical to SEQ ID NO: 30279

SEQ ID NO: 703540 - RNA, 64 nt, Homo Sapiens; identical to SEQ ID NO: 30280

SEQ ID NO: 703541 - RNA, 64 nt, Homo Sapiens; identical to SEQ ID NO: 30281

SEQ ID NO: 703542 - RNA, 64 nt, Homo Sapiens; identical to SEQ ID NO: 30282

SEQ ID NO: 703543 - RNA, 64 nt, Homo Sapiens; identical to SEQ ID NO: 30283

SEQ ID NO: 703544 - RNA, 64 nt, Homo Sapiens; identical to SEQ ID NO: 30284

SEQ ID NO: 703545 - RNA, 64 nt, Homo Sapiens; identical to SEQ ID NO: 30285

SEQ ID NO: 703546 - RNA, 64 nt, Homo Sapiens; identical to SEQ ID NO: 30286

SEQ ID NO: 703547 - RNA, 64 nt, Homo Sapiens; identical to SEQ ID NO: 30287

SEQ ID NO: 703548 - RNA, 64 nt, Homo Sapiens; identical to SEQ ID NO: 30288

SEQ ID NO: 703549 - RNA, 64 nt, Homo Sapiens; identical to SEQ ID NO: 30289

SEQ ID NO: 703550 - RNA, 64 nt, Homo Sapiens; identical to SEQ ID NO: 30290

SEQ ID NO: 703551 - RNA, 64 nt, Homo Sapiens; identical to SEQ ID NO: 30291

SEQ ID NO: 703552 - RNA, 64 nt, Homo Sapiens; identical to SEQ ID NO: 30292

SEQ ID NO: 703553 - RNA, 64 nt, Homo Sapiens; identical to SEQ ID NO: 30293

SEQ ID NO: 703554 - RNA, 64 nt, Homo Sapiens; identical to SEQ ID NO: 30294

SEQ ID NO: 703555 - RNA, 64 nt, Homo Sapiens; identical to SEQ ID NO: 30295

SEQ ID NO: 703556 - RNA, 64 nt, Homo Sapiens; identical to SEQ ID NO: 30296

SEQ ID NO: 703557 - RNA, 64 nt, Homo Sapiens; identical to SEQ ID NO: 30297

SEQ ID NO: 703558 - RNA, 64 nt, Homo Sapiens; identical to SEQ ID NO: 30298

SEQ ID NO: 703559 - RNA, 64 nt, Homo Sapiens; identical to SEQ ID NO: 30299

SEQ ID NO: 703560 - RNA, 64 nt, Homo Sapiens; identical to SEQ ID NO: 30300

SEQ ID NO: 703561 - RNA, 64 nt, Homo Sapiens; identical to SEQ ID NO: 30301

SEQ ID NO: 703562 - RNA, 64 nt, Homo Sapiens; identical to SEQ ID NO: 30302

SEQ ID NO: 703563 - RNA, 64 nt, Homo Sapiens; identical to SEQ ID NO: 30303

SEQ ID NO: 703564 - RNA, 64 nt, Homo Sapiens; identical to SEQ ID NO: 30304

SEQ ID NO: 703565 - RNA, 64 nt, Homo Sapiens; identical to SEQ ID NO: 30305

SEQ ID NO: 703566 - RNA, 64 nt, Homo Sapiens; identical to SEQ ID NO: 30306

SEQ ID NO: 703567 - RNA, 64 nt, Homo Sapiens; identical to SEQ ID NO: 30307

SEQ ID NO: 703568 - RNA, 64 nt, Homo Sapiens; identical to SEQ ID NO: 30308

SEQ ID NO: 703569 - RNA, 64 nt, Homo Sapiens; identical to SEQ ID NO: 30309

SEQ ID NO: 703570 - RNA, 64 nt, Homo Sapiens; identical to SEQ ID NO: 30310

SEQ ID NO: 703571 - RNA, 64 nt, Homo Sapiens; identical to SEQ ID NO: 30311

SEQ ID NO: 703572 - RNA, 64 nt, Homo Sapiens; identical to SEQ ID NO: 30312

SEQ ID NO: 703573 - RNA, 64 nt, Homo Sapiens; identical to SEQ ID NO: 30313

SEQ ID NO: 703574 - RNA, 64 nt, Homo Sapiens; identical to SEQ ID NO: 30314

SEQ ID NO: 703575 - RNA, 64 nt, Homo Sapiens; identical to SEQ ID NO: 30315

SEQ ID NO: 703576 - RNA, 64 nt, Homo Sapiens; identical to SEQ ID NO: 30316

SEQ ID NO: 703577 - RNA, 64 nt, Homo Sapiens; identical to SEQ ID NO: 30317

SEQ ID NO: 703578 - RNA, 64 nt, Homo Sapiens; identical to SEQ ID NO: 30318

SEQ ID NO: 703579 - RNA, 64 nt, Homo Sapiens; identical to SEQ ID NO: 30319

SEQ ID NO: 703580 - RNA, 64 nt, Homo Sapiens; identical to SEQ ID NO: 30320

SEQ ID NO: 703581 - RNA, 64 nt, Homo Sapiens; identical to SEQ ID NO: 30321

SEQ ID NO: 703582 - RNA, 64 nt, Homo Sapiens; identical to SEQ ID NO: 30322

SEQ ID NO: 703583 - RNA, 64 nt, Homo Sapiens; identical to SEQ ID NO: 30323

SEQ ID NO: 703584 - RNA, 64 nt, Homo Sapiens; identical to SEQ ID NO: 30324

SEQ ID NO: 703585 - RNA, 64 nt, Homo Sapiens; identical to SEQ ID NO: 30325

SEQ ID NO: 703586 - RNA, 64 nt, Homo Sapiens; identical to SEQ ID NO: 30326

SEQ ID NO: 703587 - RNA, 64 nt, Homo Sapiens; identical to SEQ ID NO: 30327

SEQ ID NO: 703588 - RNA, 64 nt, Homo Sapiens; identical to SEQ ID NO: 30328

SEQ ID NO: 703589 - RNA, 64 nt, Homo Sapiens; identical to SEQ ID NO: 30329

SEQ ID NO: 703590 - RNA, 64 nt, Homo Sapiens; identical to SEQ ID NO: 30330

SEQ ID NO: 703591 - RNA, 64 nt, Homo Sapiens; identical to SEQ ID NO: 30331

SEQ ID NO: 703592 - RNA, 64 nt, Homo Sapiens; identical to SEQ ID NO: 30332

SEQ ID NO: 703593 - RNA, 64 nt, Homo Sapiens; identical to SEQ ID NO: 30333

SEQ ID NO: 703594 - RNA, 64 nt, Homo Sapiens; identical to SEQ ID NO: 30334

SEQ ID NO: 703595 - RNA, 64 nt, Homo Sapiens; identical to SEQ ID NO: 30335

SEQ ID NO: 703596 - RNA, 64 nt, Homo Sapiens; identical to SEQ ID NO: 30336

SEQ ID NO: 703597 - RNA, 64 nt, Homo Sapiens; identical to SEQ ID NO: 30337

SEQ ID NO: 703598 - RNA, 64 nt, Homo Sapiens; identical to SEQ ID NO: 30338

SEQ ID NO: 703599 - RNA, 64 nt, Homo Sapiens; identical to SEQ ID NO: 30339

SEQ ID NO: 703600 - RNA, 64 nt, Homo Sapiens; identical to SEQ ID NO: 30340

SEQ ID NO: 703601 - RNA, 64 nt, Homo Sapiens; identical to SEQ ID NO: 30341

SEQ ID NO: 703602 - RNA, 64 nt, Homo Sapiens; identical to SEQ ID NO: 30342

SEQ ID NO: 703603 - RNA, 64 nt, Homo Sapiens; identical to SEQ ID NO: 30343

SEQ ID NO: 703604 - RNA, 64 nt, Homo Sapiens; identical to SEQ ID NO: 30344

SEQ ID NO: 703605 - RNA, 64 nt, Homo Sapiens; identical to SEQ ID NO: 30345

SEQ ID NO: 703606 - RNA, 64 nt, Homo Sapiens; identical to SEQ ID NO: 30346

SEQ ID NO: 703607 - RNA, 64 nt, Homo Sapiens; identical to SEQ ID NO: 30347

SEQ ID NO: 703608 - RNA, 64 nt, Homo Sapiens; identical to SEQ ID NO: 30348

SEQ ID NO: 703609 - RNA, 64 nt, Homo Sapiens; identical to SEQ ID NO: 30349

SEQ ID NO: 703610 - RNA, 64 nt, Homo Sapiens; identical to SEQ ID NO: 30350

SEQ ID NO: 703611 - RNA, 64 nt, Homo Sapiens; identical to SEQ ID NO: 30351

SEQ ID NO: 703612 - RNA, 64 nt, Homo Sapiens; identical to SEQ ID NO: 30352

SEQ ID NO: 703613 - RNA, 64 nt, Homo Sapiens; identical to SEQ ID NO: 30353

SEQ ID NO: 703614 - RNA, 64 nt, Homo Sapiens; identical to SEQ ID NO: 30354

SEQ ID NO: 703615 - RNA, 64 nt, Homo Sapiens; identical to SEQ ID NO: 30355

SEQ ID NO: 703616 - RNA, 64 nt, Homo Sapiens; identical to SEQ ID NO: 30356

SEQ ID NO: 703617 - RNA, 64 nt, Homo Sapiens; identical to SEQ ID NO: 30357

SEQ ID NO: 703618 - RNA, 64 nt, Homo Sapiens; identical to SEQ ID NO: 30358

SEQ ID NO: 703619 - RNA, 64 nt, Homo Sapiens; identical to SEQ ID NO: 30359

SEQ ID NO: 703620 - RNA, 64 nt, Homo Sapiens; identical to SEQ ID NO: 30360

SEQ ID NO: 703621 - RNA, 64 nt, Homo Sapiens; identical to SEQ ID NO: 30361

SEQ ID NO: 703622 - RNA, 64 nt, Homo Sapiens; identical to SEQ ID NO: 30362

SEQ ID NO: 703623 - RNA, 64 nt, Homo Sapiens; identical to SEQ ID NO: 30363

SEQ ID NO: 703624 - RNA, 64 nt, Homo Sapiens; identical to SEQ ID NO: 30364

SEQ ID NO: 703625 - RNA, 64 nt, Homo Sapiens; identical to SEQ ID NO: 30365

SEQ ID NO: 703626 - RNA, 64 nt, Homo Sapiens; identical to SEQ ID NO: 30366

SEQ ID NO: 703627 - RNA, 64 nt, Homo Sapiens; identical to SEQ ID NO: 30367

SEQ ID NO: 703628 - RNA, 64 nt, Homo Sapiens; identical to SEQ ID NO: 30368

SEQ ID NO: 703629 - RNA, 64 nt, Homo Sapiens; identical to SEQ ID NO: 30369

SEQ ID NO: 703630 - RNA, 64 nt, Homo Sapiens; identical to SEQ ID NO: 30370

SEQ ID NO: 703631 - RNA, 64 nt, Homo Sapiens; identical to SEQ ID NO: 30371

SEQ ID NO: 703632 - RNA, 64 nt, Homo Sapiens; identical to SEQ ID NO: 30372

SEQ ID NO: 703633 - RNA, 64 nt, Homo Sapiens; identical to SEQ ID NO: 30373

SEQ ID NO: 703634 - RNA, 64 nt, Homo Sapiens; identical to SEQ ID NO: 30374

SEQ ID NO: 703635 - RNA, 64 nt, Homo Sapiens; identical to SEQ ID NO: 30375

SEQ ID NO: 703636 - RNA, 64 nt, Homo Sapiens; identical to SEQ ID NO: 30376

SEQ ID NO: 703637 - RNA, 64 nt, Homo Sapiens; identical to SEQ ID NO: 30377

SEQ ID NO: 703638 - RNA, 64 nt, Homo Sapiens; identical to SEQ ID NO: 30378

SEQ ID NO: 703639 - RNA, 64 nt, Homo Sapiens; identical to SEQ ID NO: 30379

SEQ ID NO: 703640 - RNA, 64 nt, Homo Sapiens; identical to SEQ ID NO: 30380

SEQ ID NO: 703641 - RNA, 64 nt, Homo Sapiens; identical to SEQ ID NO: 30381

SEQ ID NO: 703642 - RNA, 64 nt, Homo Sapiens; identical to SEQ ID NO: 30382

SEQ ID NO: 703643 - RNA, 64 nt, Homo Sapiens; identical to SEQ ID NO: 30383

SEQ ID NO: 703644 - RNA, 64 nt, Homo Sapiens; identical to SEQ ID NO: 30384

SEQ ID NO: 703645 - RNA, 64 nt, Homo Sapiens; identical to SEQ ID NO: 30385

SEQ ID NO: 703646 - RNA, 64 nt, Homo Sapiens; identical to SEQ ID NO: 30386

SEQ ID NO: 703647 - RNA, 64 nt, Homo Sapiens; identical to SEQ ID NO: 30387

SEQ ID NO: 703648 - RNA, 64 nt, Homo Sapiens; identical to SEQ ID NO: 30388

SEQ ID NO: 703649 - RNA, 64 nt, Homo Sapiens; identical to SEQ ID NO: 30389

SEQ ID NO: 703650 - RNA, 64 nt, Homo Sapiens; identical to SEQ ID NO: 30390

SEQ ID NO: 703651 - RNA, 64 nt, Homo Sapiens; identical to SEQ ID NO: 30391

SEQ ID NO: 703652 - RNA, 64 nt, Homo Sapiens; identical to SEQ ID NO: 30392

SEQ ID NO: 703653 - RNA, 64 nt, Homo Sapiens; identical to SEQ ID NO: 30393

SEQ ID NO: 703654 - RNA, 64 nt, Homo Sapiens; identical to SEQ ID NO: 30394

SEQ ID NO: 703655 - RNA, 64 nt, Homo Sapiens; identical to SEQ ID NO: 30395

SEQ ID NO: 703656 - RNA, 64 nt, Homo Sapiens; identical to SEQ ID NO: 30396

SEQ ID NO: 703657 - RNA, 64 nt, Homo Sapiens; identical to SEQ ID NO: 30397

SEQ ID NO: 703658 - RNA, 64 nt, Homo Sapiens; identical to SEQ ID NO: 30398

SEQ ID NO: 703659 - RNA, 64 nt, Homo Sapiens; identical to SEQ ID NO: 30399

SEQ ID NO: 703660 - RNA, 64 nt, Homo Sapiens; identical to SEQ ID NO: 30400

SEQ ID NO: 703661 - RNA, 64 nt, Homo Sapiens; identical to SEQ ID NO: 30401

SEQ ID NO: 703662 - RNA, 64 nt, Homo Sapiens; identical to SEQ ID NO: 30402

SEQ ID NO: 703663 - RNA, 64 nt, Homo Sapiens; identical to SEQ ID NO: 30403

SEQ ID NO: 703664 - RNA, 64 nt, Homo Sapiens; identical to SEQ ID NO: 30404

SEQ ID NO: 703665 - RNA, 64 nt, Homo Sapiens; identical to SEQ ID NO: 30405

SEQ ID NO: 703666 - RNA, 64 nt, Homo Sapiens; identical to SEQ ID NO: 30406

SEQ ID NO: 703667 - RNA, 64 nt, Homo Sapiens; identical to SEQ ID NO: 30407

SEQ ID NO: 703668 - RNA, 64 nt, Homo Sapiens; identical to SEQ ID NO: 30408

SEQ ID NO: 703669 - RNA, 64 nt, Homo Sapiens; identical to SEQ ID NO: 30409

SEQ ID NO: 703670 - RNA, 64 nt, Homo Sapiens; identical to SEQ ID NO: 30410

SEQ ID NO: 703671 - RNA, 64 nt, Homo Sapiens; identical to SEQ ID NO: 30411

SEQ ID NO: 703672 - RNA, 64 nt, Homo Sapiens; identical to SEQ ID NO: 30412

SEQ ID NO: 703673 - RNA, 64 nt, Homo Sapiens; identical to SEQ ID NO: 30413

SEQ ID NO: 703674 - RNA, 64 nt, Homo Sapiens; identical to SEQ ID NO: 30414

SEQ ID NO: 703675 - RNA, 64 nt, Homo Sapiens; identical to SEQ ID NO: 30415

SEQ ID NO: 703676 - RNA, 64 nt, Homo Sapiens; identical to SEQ ID NO: 30416

SEQ ID NO: 703677 - RNA, 64 nt, Homo Sapiens; identical to SEQ ID NO: 30417

SEQ ID NO: 703678 - RNA, 64 nt, Homo Sapiens; identical to SEQ ID NO: 30418

SEQ ID NO: 703679 - RNA, 64 nt, Homo Sapiens; identical to SEQ ID NO: 30419

SEQ ID NO: 703680 - RNA, 64 nt, Homo Sapiens; identical to SEQ ID NO: 30420

SEQ ID NO: 703681 - RNA, 64 nt, Homo Sapiens; identical to SEQ ID NO: 30421

SEQ ID NO: 703682 - RNA, 64 nt, Homo Sapiens; identical to SEQ ID NO: 30422

SEQ ID NO: 703683 - RNA, 64 nt, Homo Sapiens; identical to SEQ ID NO: 30423

SEQ ID NO: 703684 - RNA, 64 nt, Homo Sapiens; identical to SEQ ID NO: 30424

SEQ ID NO: 703685 - RNA, 64 nt, Homo Sapiens; identical to SEQ ID NO: 30425

SEQ ID NO: 703686 - RNA, 64 nt, Homo Sapiens; identical to SEQ ID NO: 30426

SEQ ID NO: 703687 - RNA, 64 nt, Homo Sapiens; identical to SEQ ID NO: 30427

SEQ ID NO: 703688 - RNA, 64 nt, Homo Sapiens; identical to SEQ ID NO: 30428

SEQ ID NO: 703689 - RNA, 64 nt, Homo Sapiens; identical to SEQ ID NO: 30429

SEQ ID NO: 703690 - RNA, 64 nt, Homo Sapiens; identical to SEQ ID NO: 30430

SEQ ID NO: 703691 - RNA, 64 nt, Homo Sapiens; identical to SEQ ID NO: 30431

SEQ ID NO: 703692 - RNA, 64 nt, Homo Sapiens; identical to SEQ ID NO: 30432

SEQ ID NO: 703693 - RNA, 64 nt, Homo Sapiens; identical to SEQ ID NO: 30433

SEQ ID NO: 703694 - RNA, 64 nt, Homo Sapiens; identical to SEQ ID NO: 30434

SEQ ID NO: 703695 - RNA, 64 nt, Homo Sapiens; identical to SEQ ID NO: 30435

SEQ ID NO: 703696 - RNA, 64 nt, Homo Sapiens; identical to SEQ ID NO: 30436

SEQ ID NO: 703697 - RNA, 64 nt, Homo Sapiens; identical to SEQ ID NO: 30437

SEQ ID NO: 703698 - RNA, 64 nt, Homo Sapiens; identical to SEQ ID NO: 30438

SEQ ID NO: 703699 - RNA, 64 nt, Homo Sapiens; identical to SEQ ID NO: 30439

SEQ ID NO: 703700 - RNA, 64 nt, Homo Sapiens; identical to SEQ ID NO: 30440

SEQ ID NO: 703701 - RNA, 64 nt, Homo Sapiens; identical to SEQ ID NO: 30441

SEQ ID NO: 703702 - RNA, 64 nt, Homo Sapiens; identical to SEQ ID NO: 30442

SEQ ID NO: 703703 - RNA, 64 nt, Homo Sapiens; identical to SEQ ID NO: 30443

SEQ ID NO: 703704 - RNA, 64 nt, Homo Sapiens; identical to SEQ ID NO: 30444

SEQ ID NO: 703705 - RNA, 64 nt, Homo Sapiens; identical to SEQ ID NO: 30445

SEQ ID NO: 703706 - RNA, 64 nt, Homo Sapiens; identical to SEQ ID NO: 30446

SEQ ID NO: 703707 - RNA, 64 nt, Homo Sapiens; identical to SEQ ID NO: 30447

SEQ ID NO: 703708 - RNA, 64 nt, Homo Sapiens; identical to SEQ ID NO: 30448

SEQ ID NO: 703709 - RNA, 64 nt, Homo Sapiens; identical to SEQ ID NO: 30449

SEQ ID NO: 703710 - RNA, 64 nt, Homo Sapiens; identical to SEQ ID NO: 30450

SEQ ID NO: 703711 - RNA, 64 nt, Homo Sapiens; identical to SEQ ID NO: 30451

SEQ ID NO: 703712 - RNA, 64 nt, Homo Sapiens; identical to SEQ ID NO: 30452

SEQ ID NO: 703713 - RNA, 64 nt, Homo Sapiens; identical to SEQ ID NO: 30453

SEQ ID NO: 703714 - RNA, 64 nt, Homo Sapiens; identical to SEQ ID NO: 30454

SEQ ID NO: 703715 - RNA, 64 nt, Homo Sapiens; identical to SEQ ID NO: 30455

SEQ ID NO: 703716 - RNA, 64 nt, Homo Sapiens; identical to SEQ ID NO: 30456

SEQ ID NO: 703717 - RNA, 64 nt, Homo Sapiens; identical to SEQ ID NO: 30457

SEQ ID NO: 703718 - RNA, 64 nt, Homo Sapiens; identical to SEQ ID NO: 30458

SEQ ID NO: 703719 - RNA, 64 nt, Homo Sapiens; identical to SEQ ID NO: 30459

SEQ ID NO: 703720 - RNA, 64 nt, Homo Sapiens; identical to SEQ ID NO: 30460

SEQ ID NO: 703721 - RNA, 64 nt, Homo Sapiens; identical to SEQ ID NO: 30461

SEQ ID NO: 703722 - RNA, 64 nt, Homo Sapiens; identical to SEQ ID NO: 30462

SEQ ID NO: 703723 - RNA, 64 nt, Homo Sapiens; identical to SEQ ID NO: 30463

SEQ ID NO: 703724 - RNA, 64 nt, Homo Sapiens; identical to SEQ ID NO: 30464

SEQ ID NO: 703725 - RNA, 64 nt, Homo Sapiens; identical to SEQ ID NO: 30465

SEQ ID NO: 703726 - RNA, 64 nt, Homo Sapiens; identical to SEQ ID NO: 30466

SEQ ID NO: 703727 - RNA, 64 nt, Homo Sapiens; identical to SEQ ID NO: 30467

SEQ ID NO: 703728 - RNA, 64 nt, Homo Sapiens; identical to SEQ ID NO: 30468

SEQ ID NO: 703729 - RNA, 64 nt, Homo Sapiens; identical to SEQ ID NO: 30469

SEQ ID NO: 703730 - RNA, 64 nt, Homo Sapiens; identical to SEQ ID NO: 30470

SEQ ID NO: 703731 - RNA, 64 nt, Homo Sapiens; identical to SEQ ID NO: 30471

SEQ ID NO: 703732 - RNA, 64 nt, Homo Sapiens; identical to SEQ ID NO: 30472

SEQ ID NO: 703733 - RNA, 64 nt, Homo Sapiens; identical to SEQ ID NO: 30473

SEQ ID NO: 703734 - RNA, 64 nt, Homo Sapiens; identical to SEQ ID NO: 30474

SEQ ID NO: 703735 - RNA, 64 nt, Homo Sapiens; identical to SEQ ID NO: 30475

SEQ ID NO: 703736 - RNA, 64 nt, Homo Sapiens; identical to SEQ ID NO: 30476

SEQ ID NO: 703737 - RNA, 64 nt, Homo Sapiens; identical to SEQ ID NO: 30477

SEQ ID NO: 703738 - RNA, 64 nt, Homo Sapiens; identical to SEQ ID NO: 30478

SEQ ID NO: 703739 - RNA, 64 nt, Homo Sapiens; identical to SEQ ID NO: 30479

SEQ ID NO: 703740 - RNA, 64 nt, Homo Sapiens; identical to SEQ ID NO: 30480

SEQ ID NO: 703741 - RNA, 64 nt, Homo Sapiens; identical to SEQ ID NO: 30481

SEQ ID NO: 703742 - RNA, 64 nt, Homo Sapiens; identical to SEQ ID NO: 30482

SEQ ID NO: 703743 - RNA, 64 nt, Homo Sapiens; identical to SEQ ID NO: 30483

SEQ ID NO: 703744 - RNA, 64 nt, Homo Sapiens; identical to SEQ ID NO: 30484

SEQ ID NO: 703745 - RNA, 64 nt, Homo Sapiens; identical to SEQ ID NO: 30485

SEQ ID NO: 703746 - RNA, 64 nt, Homo Sapiens; identical to SEQ ID NO: 30486

SEQ ID NO: 703747 - RNA, 64 nt, Homo Sapiens; identical to SEQ ID NO: 30487

SEQ ID NO: 703748 - RNA, 64 nt, Homo Sapiens; identical to SEQ ID NO: 30488

SEQ ID NO: 703749 - RNA, 64 nt, Homo Sapiens; identical to SEQ ID NO: 30489

SEQ ID NO: 703750 - RNA, 64 nt, Homo Sapiens; identical to SEQ ID NO: 30490

SEQ ID NO: 703751 - RNA, 64 nt, Homo Sapiens; identical to SEQ ID NO: 30491

SEQ ID NO: 703752 - RNA, 64 nt, Homo Sapiens; identical to SEQ ID NO: 30492

SEQ ID NO: 703753 - RNA, 64 nt, Homo Sapiens; identical to SEQ ID NO: 30493

SEQ ID NO: 703754 - RNA, 64 nt, Homo Sapiens; identical to SEQ ID NO: 30494

SEQ ID NO: 703755 - RNA, 64 nt, Homo Sapiens; identical to SEQ ID NO: 30495

SEQ ID NO: 703756 - RNA, 64 nt, Homo Sapiens; identical to SEQ ID NO: 30496

SEQ ID NO: 703757 - RNA, 64 nt, Homo Sapiens; identical to SEQ ID NO: 30497

SEQ ID NO: 703758 - RNA, 64 nt, Homo Sapiens; identical to SEQ ID NO: 30498

SEQ ID NO: 703759 - RNA, 64 nt, Homo Sapiens; identical to SEQ ID NO: 30499

SEQ ID NO: 703760 - RNA, 64 nt, Homo Sapiens; identical to SEQ ID NO: 30500

SEQ ID NO: 703761 - RNA, 64 nt, Homo Sapiens; identical to SEQ ID NO: 30501

SEQ ID NO: 703762 - RNA, 64 nt, Homo Sapiens; identical to SEQ ID NO: 30502

SEQ ID NO: 703763 - RNA, 64 nt, Homo Sapiens; identical to SEQ ID NO: 30503

SEQ ID NO: 703764 - RNA, 64 nt, Homo Sapiens; identical to SEQ ID NO: 30504

SEQ ID NO: 703765 - RNA, 64 nt, Homo Sapiens; identical to SEQ ID NO: 30505

SEQ ID NO: 703766 - RNA, 64 nt, Homo Sapiens; identical to SEQ ID NO: 30506

SEQ ID NO: 703767 - RNA, 64 nt, Homo Sapiens; identical to SEQ ID NO: 30507

SEQ ID NO: 703768 - RNA, 64 nt, Homo Sapiens; identical to SEQ ID NO: 30508

SEQ ID NO: 703769 - RNA, 64 nt, Homo Sapiens; identical to SEQ ID NO: 30509

SEQ ID NO: 703770 - RNA, 64 nt, Homo Sapiens; identical to SEQ ID NO: 30510

SEQ ID NO: 703771 - RNA, 64 nt, Homo Sapiens; identical to SEQ ID NO: 30511

SEQ ID NO: 703772 - RNA, 64 nt, Homo Sapiens; identical to SEQ ID NO: 30512

SEQ ID NO: 703773 - RNA, 64 nt, Homo Sapiens; identical to SEQ ID NO: 30513

SEQ ID NO: 703774 - RNA, 64 nt, Homo Sapiens; identical to SEQ ID NO: 30514

SEQ ID NO: 703775 - RNA, 64 nt, Homo Sapiens; identical to SEQ ID NO: 30515

SEQ ID NO: 703776 - RNA, 64 nt, Homo Sapiens; identical to SEQ ID NO: 30516

SEQ ID NO: 703777 - RNA, 64 nt, Homo Sapiens; identical to SEQ ID NO: 30517

SEQ ID NO: 703778 - RNA, 64 nt, Homo Sapiens; identical to SEQ ID NO: 30518

SEQ ID NO: 703779 - RNA, 64 nt, Homo Sapiens; identical to SEQ ID NO: 30519

SEQ ID NO: 703780 - RNA, 64 nt, Homo Sapiens; identical to SEQ ID NO: 30520

SEQ ID NO: 703781 - RNA, 64 nt, Homo Sapiens; identical to SEQ ID NO: 30521

SEQ ID NO: 703782 - RNA, 64 nt, Homo Sapiens; identical to SEQ ID NO: 30522

SEQ ID NO: 703783 - RNA, 64 nt, Homo Sapiens; identical to SEQ ID NO: 30523

SEQ ID NO: 703784 - RNA, 63 nt, Homo Sapiens; identical to SEQ ID NO: 30524

SEQ ID NO: 703785 - RNA, 62 nt, Homo Sapiens; identical to SEQ ID NO: 30525

SEQ ID NO: 703786 - RNA, 64 nt, Homo Sapiens; identical to SEQ ID NO: 30526

SEQ ID NO: 703787 - RNA, 64 nt, Homo Sapiens; identical to SEQ ID NO: 30527

SEQ ID NO: 703788 - RNA, 64 nt, Homo Sapiens; identical to SEQ ID NO: 30528

SEQ ID NO: 703789 - RNA, 64 nt, Homo Sapiens; identical to SEQ ID NO: 30529

SEQ ID NO: 703790 - RNA, 64 nt, Homo Sapiens; identical to SEQ ID NO: 30530

SEQ ID NO: 703791 - RNA, 64 nt, Homo Sapiens; identical to SEQ ID NO: 30531

SEQ ID NO: 703792 - RNA, 64 nt, Homo Sapiens; identical to SEQ ID NO: 30532

SEQ ID NO: 703793 - RNA, 64 nt, Homo Sapiens; identical to SEQ ID NO: 30533

SEQ ID NO: 703794 - RNA, 64 nt, Homo Sapiens; identical to SEQ ID NO: 30534

SEQ ID NO: 703795 - RNA, 64 nt, Homo Sapiens; identical to SEQ ID NO: 30535

SEQ ID NO: 703796 - RNA, 64 nt, Homo Sapiens; identical to SEQ ID NO: 30536

SEQ ID NO: 703797 - RNA, 64 nt, Homo Sapiens; identical to SEQ ID NO: 30537

SEQ ID NO: 703798 - RNA, 64 nt, Homo Sapiens; identical to SEQ ID NO: 30538

SEQ ID NO: 703799 - RNA, 64 nt, Homo Sapiens; identical to SEQ ID NO: 30539

SEQ ID NO: 703800 - RNA, 64 nt, Homo Sapiens; identical to SEQ ID NO: 30540

SEQ ID NO: 703801 - RNA, 64 nt, Homo Sapiens; identical to SEQ ID NO: 30541

SEQ ID NO: 703802 - RNA, 64 nt, Homo Sapiens; identical to SEQ ID NO: 30542

SEQ ID NO: 703803 - RNA, 64 nt, Homo Sapiens; identical to SEQ ID NO: 30543

SEQ ID NO: 703804 - RNA, 64 nt, Homo Sapiens; identical to SEQ ID NO: 30544

SEQ ID NO: 703805 - RNA, 64 nt, Homo Sapiens; identical to SEQ ID NO: 30545

SEQ ID NO: 703806 - RNA, 64 nt, Homo Sapiens; identical to SEQ ID NO: 30546

SEQ ID NO: 703807 - RNA, 64 nt, Homo Sapiens; identical to SEQ ID NO: 30547

SEQ ID NO: 703808 - RNA, 64 nt, Homo Sapiens; identical to SEQ ID NO: 30548

SEQ ID NO: 703809 - RNA, 64 nt, Homo Sapiens; identical to SEQ ID NO: 30549

SEQ ID NO: 703810 - RNA, 64 nt, Homo Sapiens; identical to SEQ ID NO: 30550

SEQ ID NO: 703811 - RNA, 64 nt, Homo Sapiens; identical to SEQ ID NO: 30551

SEQ ID NO: 703812 - RNA, 64 nt, Homo Sapiens; identical to SEQ ID NO: 30552

SEQ ID NO: 703813 - RNA, 64 nt, Homo Sapiens; identical to SEQ ID NO: 30553

SEQ ID NO: 703814 - RNA, 64 nt, Homo Sapiens; identical to SEQ ID NO: 30554

SEQ ID NO: 703815 - RNA, 64 nt, Homo Sapiens; identical to SEQ ID NO: 30555

SEQ ID NO: 703816 - RNA, 64 nt, Homo Sapiens; identical to SEQ ID NO: 30556

SEQ ID NO: 703817 - RNA, 64 nt, Homo Sapiens; identical to SEQ ID NO: 30557

SEQ ID NO: 703818 - RNA, 64 nt, Homo Sapiens; identical to SEQ ID NO: 30558

SEQ ID NO: 703819 - RNA, 64 nt, Homo Sapiens; identical to SEQ ID NO: 30559

SEQ ID NO: 703820 - RNA, 64 nt, Homo Sapiens; identical to SEQ ID NO: 30560

SEQ ID NO: 703821 - RNA, 64 nt, Homo Sapiens; identical to SEQ ID NO: 30561

SEQ ID NO: 703822 - RNA, 64 nt, Homo Sapiens; identical to SEQ ID NO: 30562

SEQ ID NO: 703823 - RNA, 64 nt, Homo Sapiens; identical to SEQ ID NO: 30563

SEQ ID NO: 703824 - RNA, 64 nt, Homo Sapiens; identical to SEQ ID NO: 30564

SEQ ID NO: 703825 - RNA, 64 nt, Homo Sapiens; identical to SEQ ID NO: 30565

SEQ ID NO: 703826 - RNA, 64 nt, Homo Sapiens; identical to SEQ ID NO: 30566

SEQ ID NO: 703827 - RNA, 64 nt, Homo Sapiens; identical to SEQ ID NO: 30567

SEQ ID NO: 703828 - RNA, 64 nt, Homo Sapiens; identical to SEQ ID NO: 30568

SEQ ID NO: 703829 - RNA, 64 nt, Homo Sapiens; identical to SEQ ID NO: 30569

SEQ ID NO: 703830 - RNA, 64 nt, Homo Sapiens; identical to SEQ ID NO: 30570

SEQ ID NO: 703831 - RNA, 64 nt, Homo Sapiens; identical to SEQ ID NO: 30571

SEQ ID NO: 703832 - RNA, 64 nt, Homo Sapiens; identical to SEQ ID NO: 30572

SEQ ID NO: 703833 - RNA, 64 nt, Homo Sapiens; identical to SEQ ID NO: 30573

SEQ ID NO: 703834 - RNA, 64 nt, Homo Sapiens; identical to SEQ ID NO: 30574

SEQ ID NO: 703835 - RNA, 64 nt, Homo Sapiens; identical to SEQ ID NO: 30575

SEQ ID NO: 703836 - RNA, 64 nt, Homo Sapiens; identical to SEQ ID NO: 30576

SEQ ID NO: 703837 - RNA, 64 nt, Homo Sapiens; identical to SEQ ID NO: 30577

SEQ ID NO: 703838 - RNA, 64 nt, Homo Sapiens; identical to SEQ ID NO: 30578

SEQ ID NO: 703839 - RNA, 64 nt, Homo Sapiens; identical to SEQ ID NO: 30579

SEQ ID NO: 703840 - RNA, 64 nt, Homo Sapiens; identical to SEQ ID NO: 30580

SEQ ID NO: 703841 - RNA, 64 nt, Homo Sapiens; identical to SEQ ID NO: 30581

SEQ ID NO: 703842 - RNA, 64 nt, Homo Sapiens; identical to SEQ ID NO: 30582

SEQ ID NO: 703843 - RNA, 64 nt, Homo Sapiens; identical to SEQ ID NO: 30583

SEQ ID NO: 703844 - RNA, 64 nt, Homo Sapiens; identical to SEQ ID NO: 30584

SEQ ID NO: 703845 - RNA, 64 nt, Homo Sapiens; identical to SEQ ID NO: 30585

SEQ ID NO: 703846 - RNA, 64 nt, Homo Sapiens; identical to SEQ ID NO: 30586

SEQ ID NO: 703847 - RNA, 64 nt, Homo Sapiens; identical to SEQ ID NO: 30587

SEQ ID NO: 703848 - RNA, 64 nt, Homo Sapiens; identical to SEQ ID NO: 30588

SEQ ID NO: 703849 - RNA, 64 nt, Homo Sapiens; identical to SEQ ID NO: 30589

SEQ ID NO: 703850 - RNA, 64 nt, Homo Sapiens; identical to SEQ ID NO: 30590

SEQ ID NO: 703851 - RNA, 64 nt, Homo Sapiens; identical to SEQ ID NO: 30591

SEQ ID NO: 703852 - RNA, 64 nt, Homo Sapiens; identical to SEQ ID NO: 30592

SEQ ID NO: 703853 - RNA, 64 nt, Homo Sapiens; identical to SEQ ID NO: 30593

SEQ ID NO: 703854 - RNA, 64 nt, Homo Sapiens; identical to SEQ ID NO: 30594

SEQ ID NO: 703855 - RNA, 64 nt, Homo Sapiens; identical to SEQ ID NO: 30595

SEQ ID NO: 703856 - RNA, 64 nt, Homo Sapiens; identical to SEQ ID NO: 30596

SEQ ID NO: 703857 - RNA, 64 nt, Homo Sapiens; identical to SEQ ID NO: 30597

SEQ ID NO: 703858 - RNA, 64 nt, Homo Sapiens; identical to SEQ ID NO: 30598

SEQ ID NO: 703859 - RNA, 64 nt, Homo Sapiens; identical to SEQ ID NO: 30599

SEQ ID NO: 703860 - RNA, 64 nt, Homo Sapiens; identical to SEQ ID NO: 30600

SEQ ID NO: 703861 - RNA, 64 nt, Homo Sapiens; identical to SEQ ID NO: 30601

SEQ ID NO: 703862 - RNA, 64 nt, Homo Sapiens; identical to SEQ ID NO: 30602

SEQ ID NO: 703863 - RNA, 64 nt, Homo Sapiens; identical to SEQ ID NO: 30603

SEQ ID NO: 703864 - RNA, 64 nt, Homo Sapiens; identical to SEQ ID NO: 30604

SEQ ID NO: 703865 - RNA, 64 nt, Homo Sapiens; identical to SEQ ID NO: 30605

SEQ ID NO: 703866 - RNA, 64 nt, Homo Sapiens; identical to SEQ ID NO: 30606

SEQ ID NO: 703867 - RNA, 64 nt, Homo Sapiens; identical to SEQ ID NO: 30607

SEQ ID NO: 703868 - RNA, 64 nt, Homo Sapiens; identical to SEQ ID NO: 30608

SEQ ID NO: 703869 - RNA, 64 nt, Homo Sapiens; identical to SEQ ID NO: 30609

SEQ ID NO: 703870 - RNA, 64 nt, Homo Sapiens; identical to SEQ ID NO: 30610

SEQ ID NO: 703871 - RNA, 64 nt, Homo Sapiens; identical to SEQ ID NO: 30611

SEQ ID NO: 703872 - RNA, 64 nt, Homo Sapiens; identical to SEQ ID NO: 30612

SEQ ID NO: 703873 - RNA, 64 nt, Homo Sapiens; identical to SEQ ID NO: 30613

SEQ ID NO: 703874 - RNA, 64 nt, Homo Sapiens; identical to SEQ ID NO: 30614

SEQ ID NO: 703875 - RNA, 64 nt, Homo Sapiens; identical to SEQ ID NO: 30615

SEQ ID NO: 703876 - RNA, 64 nt, Homo Sapiens; identical to SEQ ID NO: 30616

SEQ ID NO: 703877 - RNA, 64 nt, Homo Sapiens; identical to SEQ ID NO: 30617

SEQ ID NO: 703878 - RNA, 64 nt, Homo Sapiens; identical to SEQ ID NO: 30618

SEQ ID NO: 703879 - RNA, 64 nt, Homo Sapiens; identical to SEQ ID NO: 30619

SEQ ID NO: 703880 - RNA, 64 nt, Homo Sapiens; identical to SEQ ID NO: 30620

SEQ ID NO: 703881 - RNA, 64 nt, Homo Sapiens; identical to SEQ ID NO: 30621

SEQ ID NO: 703882 - RNA, 64 nt, Homo Sapiens; identical to SEQ ID NO: 30622

SEQ ID NO: 703883 - RNA, 64 nt, Homo Sapiens; identical to SEQ ID NO: 30623

SEQ ID NO: 703884 - RNA, 64 nt, Homo Sapiens; identical to SEQ ID NO: 30624

SEQ ID NO: 703885 - RNA, 64 nt, Homo Sapiens; identical to SEQ ID NO: 30625

SEQ ID NO: 703886 - RNA, 64 nt, Homo Sapiens; identical to SEQ ID NO: 30626

SEQ ID NO: 703887 - RNA, 64 nt, Homo Sapiens; identical to SEQ ID NO: 30627

SEQ ID NO: 703888 - RNA, 64 nt, Homo Sapiens; identical to SEQ ID NO: 30628

SEQ ID NO: 703889 - RNA, 64 nt, Homo Sapiens; identical to SEQ ID NO: 30629

SEQ ID NO: 703890 - RNA, 64 nt, Homo Sapiens; identical to SEQ ID NO: 30630

SEQ ID NO: 703891 - RNA, 64 nt, Homo Sapiens; identical to SEQ ID NO: 30631

SEQ ID NO: 703892 - RNA, 64 nt, Homo Sapiens; identical to SEQ ID NO: 30632

SEQ ID NO: 703893 - RNA, 64 nt, Homo Sapiens; identical to SEQ ID NO: 30633

SEQ ID NO: 703894 - RNA, 64 nt, Homo Sapiens; identical to SEQ ID NO: 30634

SEQ ID NO: 703895 - RNA, 64 nt, Homo Sapiens; identical to SEQ ID NO: 30635

SEQ ID NO: 703896 - RNA, 64 nt, Homo Sapiens; identical to SEQ ID NO: 30636

SEQ ID NO: 703897 - RNA, 64 nt, Homo Sapiens; identical to SEQ ID NO: 30637

SEQ ID NO: 703898 - RNA, 64 nt, Homo Sapiens; identical to SEQ ID NO: 30638

SEQ ID NO: 703899 - RNA, 64 nt, Homo Sapiens; identical to SEQ ID NO: 30639

SEQ ID NO: 703900 - RNA, 64 nt, Homo Sapiens; identical to SEQ ID NO: 30640

SEQ ID NO: 703901 - RNA, 64 nt, Homo Sapiens; identical to SEQ ID NO: 30641

SEQ ID NO: 703902 - RNA, 64 nt, Homo Sapiens; identical to SEQ ID NO: 30642

SEQ ID NO: 703903 - RNA, 64 nt, Homo Sapiens; identical to SEQ ID NO: 30643

SEQ ID NO: 703904 - RNA, 64 nt, Homo Sapiens; identical to SEQ ID NO: 30644

SEQ ID NO: 703905 - RNA, 64 nt, Homo Sapiens; identical to SEQ ID NO: 30645

SEQ ID NO: 703906 - RNA, 64 nt, Homo Sapiens; identical to SEQ ID NO: 30646

SEQ ID NO: 703907 - RNA, 64 nt, Homo Sapiens; identical to SEQ ID NO: 30647

SEQ ID NO: 703908 - RNA, 64 nt, Homo Sapiens; identical to SEQ ID NO: 30648

SEQ ID NO: 703909 - RNA, 64 nt, Homo Sapiens; identical to SEQ ID NO: 30649

SEQ ID NO: 703910 - RNA, 64 nt, Homo Sapiens; identical to SEQ ID NO: 30650

SEQ ID NO: 703911 - RNA, 64 nt, Homo Sapiens; identical to SEQ ID NO: 30651

SEQ ID NO: 703912 - RNA, 64 nt, Homo Sapiens; identical to SEQ ID NO: 30652

SEQ ID NO: 703913 - RNA, 64 nt, Homo Sapiens; identical to SEQ ID NO: 30653

SEQ ID NO: 703914 - RNA, 64 nt, Homo Sapiens; identical to SEQ ID NO: 30654

SEQ ID NO: 703915 - RNA, 64 nt, Homo Sapiens; identical to SEQ ID NO: 30655

SEQ ID NO: 703916 - RNA, 64 nt, Homo Sapiens; identical to SEQ ID NO: 30656

SEQ ID NO: 703917 - RNA, 64 nt, Homo Sapiens; identical to SEQ ID NO: 30657

SEQ ID NO: 703918 - RNA, 64 nt, Homo Sapiens; identical to SEQ ID NO: 30658

SEQ ID NO: 703919 - RNA, 64 nt, Homo Sapiens; identical to SEQ ID NO: 30659

SEQ ID NO: 703920 - RNA, 64 nt, Homo Sapiens; identical to SEQ ID NO: 30660

SEQ ID NO: 703921 - RNA, 62 nt, Homo Sapiens; identical to SEQ ID NO: 30661

SEQ ID NO: 703922 - RNA, 63 nt, Homo Sapiens; identical to SEQ ID NO: 30662

SEQ ID NO: 703923 - RNA, 64 nt, Homo Sapiens; identical to SEQ ID NO: 30663

SEQ ID NO: 703924 - RNA, 64 nt, Homo Sapiens; identical to SEQ ID NO: 30664

SEQ ID NO: 703925 - RNA, 64 nt, Homo Sapiens; identical to SEQ ID NO: 30665

SEQ ID NO: 703926 - RNA, 64 nt, Homo Sapiens; identical to SEQ ID NO: 30666

SEQ ID NO: 703927 - RNA, 64 nt, Homo Sapiens; identical to SEQ ID NO: 30667

SEQ ID NO: 703928 - RNA, 64 nt, Homo Sapiens; identical to SEQ ID NO: 30668

SEQ ID NO: 703929 - RNA, 64 nt, Homo Sapiens; identical to SEQ ID NO: 30669

SEQ ID NO: 703930 - RNA, 64 nt, Homo Sapiens; identical to SEQ ID NO: 30670

SEQ ID NO: 703931 - RNA, 64 nt, Homo Sapiens; identical to SEQ ID NO: 30671

SEQ ID NO: 703932 - RNA, 64 nt, Homo Sapiens; identical to SEQ ID NO: 30672

SEQ ID NO: 703933 - RNA, 64 nt, Homo Sapiens; identical to SEQ ID NO: 30673

SEQ ID NO: 703934 - RNA, 64 nt, Homo Sapiens; identical to SEQ ID NO: 30674

SEQ ID NO: 703935 - RNA, 64 nt, Homo Sapiens; identical to SEQ ID NO: 30675

SEQ ID NO: 703936 - RNA, 64 nt, Homo Sapiens; identical to SEQ ID NO: 30676

SEQ ID NO: 703937 - RNA, 64 nt, Homo Sapiens; identical to SEQ ID NO: 30677

SEQ ID NO: 703938 - RNA, 64 nt, Homo Sapiens; identical to SEQ ID NO: 30678

SEQ ID NO: 703939 - RNA, 64 nt, Homo Sapiens; identical to SEQ ID NO: 30679

SEQ ID NO: 703940 - RNA, 64 nt, Homo Sapiens; identical to SEQ ID NO: 30680

SEQ ID NO: 703941 - RNA, 64 nt, Homo Sapiens; identical to SEQ ID NO: 30681

SEQ ID NO: 703942 - RNA, 64 nt, Homo Sapiens; identical to SEQ ID NO: 30682

SEQ ID NO: 703943 - RNA, 64 nt, Homo Sapiens; identical to SEQ ID NO: 30683

SEQ ID NO: 703944 - RNA, 64 nt, Homo Sapiens; identical to SEQ ID NO: 30684

SEQ ID NO: 703945 - RNA, 64 nt, Homo Sapiens; identical to SEQ ID NO: 30685

SEQ ID NO: 703946 - RNA, 64 nt, Homo Sapiens; identical to SEQ ID NO: 30686

SEQ ID NO: 703947 - RNA, 64 nt, Homo Sapiens; identical to SEQ ID NO: 30687

SEQ ID NO: 703948 - RNA, 64 nt, Homo Sapiens; identical to SEQ ID NO: 30688

SEQ ID NO: 703949 - RNA, 64 nt, Homo Sapiens; identical to SEQ ID NO: 30689

SEQ ID NO: 703950 - RNA, 64 nt, Homo Sapiens; identical to SEQ ID NO: 30690

SEQ ID NO: 703951 - RNA, 64 nt, Homo Sapiens; identical to SEQ ID NO: 30691

SEQ ID NO: 703952 - RNA, 64 nt, Homo Sapiens; identical to SEQ ID NO: 30692

SEQ ID NO: 703953 - RNA, 64 nt, Homo Sapiens; identical to SEQ ID NO: 30693

SEQ ID NO: 703954 - RNA, 64 nt, Homo Sapiens; identical to SEQ ID NO: 30694

SEQ ID NO: 703955 - RNA, 64 nt, Homo Sapiens; identical to SEQ ID NO: 30695

SEQ ID NO: 703956 - RNA, 64 nt, Homo Sapiens; identical to SEQ ID NO: 30696

SEQ ID NO: 703957 - RNA, 64 nt, Homo Sapiens; identical to SEQ ID NO: 30697

SEQ ID NO: 703958 - RNA, 64 nt, Homo Sapiens; identical to SEQ ID NO: 30698

SEQ ID NO: 703959 - RNA, 64 nt, Homo Sapiens; identical to SEQ ID NO: 30699

SEQ ID NO: 703960 - RNA, 64 nt, Homo Sapiens; identical to SEQ ID NO: 30700

SEQ ID NO: 703961 - RNA, 64 nt, Homo Sapiens; identical to SEQ ID NO: 30701

SEQ ID NO: 703962 - RNA, 64 nt, Homo Sapiens; identical to SEQ ID NO: 30702

SEQ ID NO: 703963 - RNA, 64 nt, Homo Sapiens; identical to SEQ ID NO: 30703

SEQ ID NO: 703964 - RNA, 64 nt, Homo Sapiens; identical to SEQ ID NO: 30704

SEQ ID NO: 703965 - RNA, 64 nt, Homo Sapiens; identical to SEQ ID NO: 30705

SEQ ID NO: 703966 - RNA, 64 nt, Homo Sapiens; identical to SEQ ID NO: 30706

SEQ ID NO: 703967 - RNA, 64 nt, Homo Sapiens; identical to SEQ ID NO: 30707

SEQ ID NO: 703968 - RNA, 64 nt, Homo Sapiens; identical to SEQ ID NO: 30708

SEQ ID NO: 703969 - RNA, 64 nt, Homo Sapiens; identical to SEQ ID NO: 30709

SEQ ID NO: 703970 - RNA, 64 nt, Homo Sapiens; identical to SEQ ID NO: 30710

SEQ ID NO: 703971 - RNA, 64 nt, Homo Sapiens; identical to SEQ ID NO: 30711

SEQ ID NO: 703972 - RNA, 64 nt, Homo Sapiens; identical to SEQ ID NO: 30712

SEQ ID NO: 703973 - RNA, 64 nt, Homo Sapiens; identical to SEQ ID NO: 30713

SEQ ID NO: 703974 - RNA, 64 nt, Homo Sapiens; identical to SEQ ID NO: 30714

SEQ ID NO: 703975 - RNA, 64 nt, Homo Sapiens; identical to SEQ ID NO: 30715

SEQ ID NO: 703976 - RNA, 64 nt, Homo Sapiens; identical to SEQ ID NO: 30716

SEQ ID NO: 703977 - RNA, 64 nt, Homo Sapiens; identical to SEQ ID NO: 30717

SEQ ID NO: 703978 - RNA, 64 nt, Homo Sapiens; identical to SEQ ID NO: 30718

SEQ ID NO: 703979 - RNA, 64 nt, Homo Sapiens; identical to SEQ ID NO: 30719

SEQ ID NO: 703980 - RNA, 64 nt, Homo Sapiens; identical to SEQ ID NO: 30720

SEQ ID NO: 703981 - RNA, 64 nt, Homo Sapiens; identical to SEQ ID NO: 30721

SEQ ID NO: 703982 - RNA, 58 nt, Homo Sapiens; identical to SEQ ID NO: 30722

SEQ ID NO: 703983 - RNA, 64 nt, Homo Sapiens; identical to SEQ ID NO: 30723

SEQ ID NO: 703984 - RNA, 64 nt, Homo Sapiens; identical to SEQ ID NO: 30724

SEQ ID NO: 703985 - RNA, 64 nt, Homo Sapiens; identical to SEQ ID NO: 30725

SEQ ID NO: 703986 - RNA, 64 nt, Homo Sapiens; identical to SEQ ID NO: 30726

SEQ ID NO: 703987 - RNA, 64 nt, Homo Sapiens; identical to SEQ ID NO: 30727

SEQ ID NO: 703988 - RNA, 64 nt, Homo Sapiens; identical to SEQ ID NO: 30728

SEQ ID NO: 703989 - RNA, 64 nt, Homo Sapiens; identical to SEQ ID NO: 30729

SEQ ID NO: 703990 - RNA, 64 nt, Homo Sapiens; identical to SEQ ID NO: 30730

SEQ ID NO: 703991 - RNA, 64 nt, Homo Sapiens; identical to SEQ ID NO: 30731

SEQ ID NO: 703992 - RNA, 64 nt, Homo Sapiens; identical to SEQ ID NO: 30732

SEQ ID NO: 703993 - RNA, 64 nt, Homo Sapiens; identical to SEQ ID NO: 30733

SEQ ID NO: 703994 - RNA, 64 nt, Homo Sapiens; identical to SEQ ID NO: 30734

SEQ ID NO: 703995 - RNA, 64 nt, Homo Sapiens; identical to SEQ ID NO: 30735

SEQ ID NO: 703996 - RNA, 64 nt, Homo Sapiens; identical to SEQ ID NO: 30736

SEQ ID NO: 703997 - RNA, 64 nt, Homo Sapiens; identical to SEQ ID NO: 30737

SEQ ID NO: 703998 - RNA, 64 nt, Homo Sapiens; identical to SEQ ID NO: 30738

SEQ ID NO: 703999 - RNA, 64 nt, Homo Sapiens; identical to SEQ ID NO: 30739

SEQ ID NO: 704000 - RNA, 64 nt, Homo Sapiens; identical to SEQ ID NO: 30740

SEQ ID NO: 704001 - RNA, 64 nt, Homo Sapiens; identical to SEQ ID NO: 30741

SEQ ID NO: 704002 - RNA, 64 nt, Homo Sapiens; identical to SEQ ID NO: 30742

SEQ ID NO: 704003 - RNA, 64 nt, Homo Sapiens; identical to SEQ ID NO: 30743

SEQ ID NO: 704004 - RNA, 64 nt, Homo Sapiens; identical to SEQ ID NO: 30744

SEQ ID NO: 704005 - RNA, 64 nt, Homo Sapiens; identical to SEQ ID NO: 30745

SEQ ID NO: 704006 - RNA, 64 nt, Homo Sapiens; identical to SEQ ID NO: 30746

SEQ ID NO: 704007 - RNA, 64 nt, Homo Sapiens; identical to SEQ ID NO: 30747

SEQ ID NO: 704008 - RNA, 64 nt, Homo Sapiens; identical to SEQ ID NO: 30748

SEQ ID NO: 704009 - RNA, 64 nt, Homo Sapiens; identical to SEQ ID NO: 30749

SEQ ID NO: 704010 - RNA, 64 nt, Homo Sapiens; identical to SEQ ID NO: 30750

SEQ ID NO: 704011 - RNA, 64 nt, Homo Sapiens; identical to SEQ ID NO: 30751

SEQ ID NO: 704012 - RNA, 64 nt, Homo Sapiens; identical to SEQ ID NO: 30752

SEQ ID NO: 704013 - RNA, 64 nt, Homo Sapiens; identical to SEQ ID NO: 30753

SEQ ID NO: 704014 - RNA, 64 nt, Homo Sapiens; identical to SEQ ID NO: 30754

SEQ ID NO: 704015 - RNA, 64 nt, Homo Sapiens; identical to SEQ ID NO: 30755

SEQ ID NO: 704016 - RNA, 64 nt, Homo Sapiens; identical to SEQ ID NO: 30756

SEQ ID NO: 704017 - RNA, 64 nt, Homo Sapiens; identical to SEQ ID NO: 30757

SEQ ID NO: 704018 - RNA, 64 nt, Homo Sapiens; identical to SEQ ID NO: 30758

SEQ ID NO: 704019 - RNA, 64 nt, Homo Sapiens; identical to SEQ ID NO: 30759

SEQ ID NO: 704020 - RNA, 64 nt, Homo Sapiens; identical to SEQ ID NO: 30760

SEQ ID NO: 704021 - RNA, 64 nt, Homo Sapiens; identical to SEQ ID NO: 30761

SEQ ID NO: 704022 - RNA, 64 nt, Homo Sapiens; identical to SEQ ID NO: 30762

SEQ ID NO: 704023 - RNA, 64 nt, Homo Sapiens; identical to SEQ ID NO: 30763

SEQ ID NO: 704024 - RNA, 64 nt, Homo Sapiens; identical to SEQ ID NO: 30764

SEQ ID NO: 704025 - RNA, 64 nt, Homo Sapiens; identical to SEQ ID NO: 30765

SEQ ID NO: 704026 - RNA, 64 nt, Homo Sapiens; identical to SEQ ID NO: 30766

SEQ ID NO: 704027 - RNA, 64 nt, Homo Sapiens; identical to SEQ ID NO: 30767

SEQ ID NO: 704028 - RNA, 64 nt, Homo Sapiens; identical to SEQ ID NO: 30768

SEQ ID NO: 704029 - RNA, 64 nt, Homo Sapiens; identical to SEQ ID NO: 30769

SEQ ID NO: 704030 - RNA, 64 nt, Homo Sapiens; identical to SEQ ID NO: 30770

SEQ ID NO: 704031 - RNA, 64 nt, Homo Sapiens; identical to SEQ ID NO: 30771

SEQ ID NO: 704032 - RNA, 64 nt, Homo Sapiens; identical to SEQ ID NO: 30772

SEQ ID NO: 704033 - RNA, 64 nt, Homo Sapiens; identical to SEQ ID NO: 30773

SEQ ID NO: 704034 - RNA, 64 nt, Homo Sapiens; identical to SEQ ID NO: 30774

SEQ ID NO: 704035 - RNA, 64 nt, Homo Sapiens; identical to SEQ ID NO: 30775

SEQ ID NO: 704036 - RNA, 64 nt, Homo Sapiens; identical to SEQ ID NO: 30776

SEQ ID NO: 704037 - RNA, 64 nt, Homo Sapiens; identical to SEQ ID NO: 30777

SEQ ID NO: 704038 - RNA, 64 nt, Homo Sapiens; identical to SEQ ID NO: 30778

SEQ ID NO: 704039 - RNA, 64 nt, Homo Sapiens; identical to SEQ ID NO: 30779

SEQ ID NO: 704040 - RNA, 64 nt, Homo Sapiens; identical to SEQ ID NO: 30780

SEQ ID NO: 704041 - RNA, 64 nt, Homo Sapiens; identical to SEQ ID NO: 30781

SEQ ID NO: 704042 - RNA, 64 nt, Homo Sapiens; identical to SEQ ID NO: 30782

SEQ ID NO: 704043 - RNA, 64 nt, Homo Sapiens; identical to SEQ ID NO: 30783

SEQ ID NO: 704044 - RNA, 64 nt, Homo Sapiens; identical to SEQ ID NO: 30784

SEQ ID NO: 704045 - RNA, 64 nt, Homo Sapiens; identical to SEQ ID NO: 30785

SEQ ID NO: 704046 - RNA, 64 nt, Homo Sapiens; identical to SEQ ID NO: 30786

SEQ ID NO: 704047 - RNA, 64 nt, Homo Sapiens; identical to SEQ ID NO: 30787

SEQ ID NO: 704048 - RNA, 64 nt, Homo Sapiens; identical to SEQ ID NO: 30788

SEQ ID NO: 704049 - RNA, 64 nt, Homo Sapiens; identical to SEQ ID NO: 30789

SEQ ID NO: 704050 - RNA, 64 nt, Homo Sapiens; identical to SEQ ID NO: 30790

SEQ ID NO: 704051 - RNA, 64 nt, Homo Sapiens; identical to SEQ ID NO: 30791

SEQ ID NO: 704052 - RNA, 64 nt, Homo Sapiens; identical to SEQ ID NO: 30792

SEQ ID NO: 704053 - RNA, 64 nt, Homo Sapiens; identical to SEQ ID NO: 30793

SEQ ID NO: 704054 - RNA, 64 nt, Homo Sapiens; identical to SEQ ID NO: 30794

SEQ ID NO: 704055 - RNA, 64 nt, Homo Sapiens; identical to SEQ ID NO: 30795

SEQ ID NO: 704056 - RNA, 64 nt, Homo Sapiens; identical to SEQ ID NO: 30796

SEQ ID NO: 704057 - RNA, 64 nt, Homo Sapiens; identical to SEQ ID NO: 30797

SEQ ID NO: 704058 - RNA, 64 nt, Homo Sapiens; identical to SEQ ID NO: 30798

SEQ ID NO: 704059 - RNA, 64 nt, Homo Sapiens; identical to SEQ ID NO: 30799

SEQ ID NO: 704060 - RNA, 64 nt, Homo Sapiens; identical to SEQ ID NO: 30800

SEQ ID NO: 704061 - RNA, 64 nt, Homo Sapiens; identical to SEQ ID NO: 30801

SEQ ID NO: 704062 - RNA, 64 nt, Homo Sapiens; identical to SEQ ID NO: 30802

SEQ ID NO: 704063 - RNA, 64 nt, Homo Sapiens; identical to SEQ ID NO: 30803

SEQ ID NO: 704064 - RNA, 64 nt, Homo Sapiens; identical to SEQ ID NO: 30804

SEQ ID NO: 704065 - RNA, 64 nt, Homo Sapiens; identical to SEQ ID NO: 30805

SEQ ID NO: 704066 - RNA, 64 nt, Homo Sapiens; identical to SEQ ID NO: 30806

SEQ ID NO: 704067 - RNA, 64 nt, Homo Sapiens; identical to SEQ ID NO: 30807

SEQ ID NO: 704068 - RNA, 64 nt, Homo Sapiens; identical to SEQ ID NO: 30808

SEQ ID NO: 704069 - RNA, 64 nt, Homo Sapiens; identical to SEQ ID NO: 30809

SEQ ID NO: 704070 - RNA, 64 nt, Homo Sapiens; identical to SEQ ID NO: 30810

SEQ ID NO: 704071 - RNA, 64 nt, Homo Sapiens; identical to SEQ ID NO: 30811

SEQ ID NO: 704072 - RNA, 64 nt, Homo Sapiens; identical to SEQ ID NO: 30812

SEQ ID NO: 704073 - RNA, 64 nt, Homo Sapiens; identical to SEQ ID NO: 30813

SEQ ID NO: 704074 - RNA, 64 nt, Homo Sapiens; identical to SEQ ID NO: 30814

SEQ ID NO: 704075 - RNA, 64 nt, Homo Sapiens; identical to SEQ ID NO: 30815

SEQ ID NO: 704076 - RNA, 64 nt, Homo Sapiens; identical to SEQ ID NO: 30816

SEQ ID NO: 704077 - RNA, 64 nt, Homo Sapiens; identical to SEQ ID NO: 30817

SEQ ID NO: 704078 - RNA, 64 nt, Homo Sapiens; identical to SEQ ID NO: 30818

SEQ ID NO: 704079 - RNA, 64 nt, Homo Sapiens; identical to SEQ ID NO: 30819

SEQ ID NO: 704080 - RNA, 64 nt, Homo Sapiens; identical to SEQ ID NO: 30820

SEQ ID NO: 704081 - RNA, 64 nt, Homo Sapiens; identical to SEQ ID NO: 30821

SEQ ID NO: 704082 - RNA, 64 nt, Homo Sapiens; identical to SEQ ID NO: 30822

SEQ ID NO: 704083 - RNA, 64 nt, Homo Sapiens; identical to SEQ ID NO: 30823

SEQ ID NO: 704084 - RNA, 64 nt, Homo Sapiens; identical to SEQ ID NO: 30824

SEQ ID NO: 704085 - RNA, 64 nt, Homo Sapiens; identical to SEQ ID NO: 30825

SEQ ID NO: 704086 - RNA, 64 nt, Homo Sapiens; identical to SEQ ID NO: 30826

SEQ ID NO: 704087 - RNA, 64 nt, Homo Sapiens; identical to SEQ ID NO: 30827

SEQ ID NO: 704088 - RNA, 64 nt, Homo Sapiens; identical to SEQ ID NO: 30828

SEQ ID NO: 704089 - RNA, 64 nt, Homo Sapiens; identical to SEQ ID NO: 30829

SEQ ID NO: 704090 - RNA, 64 nt, Homo Sapiens; identical to SEQ ID NO: 30830

SEQ ID NO: 704091 - RNA, 64 nt, Homo Sapiens; identical to SEQ ID NO: 30831

SEQ ID NO: 704092 - RNA, 64 nt, Homo Sapiens; identical to SEQ ID NO: 30832

SEQ ID NO: 704093 - RNA, 64 nt, Homo Sapiens; identical to SEQ ID NO: 30833

SEQ ID NO: 704094 - RNA, 64 nt, Homo Sapiens; identical to SEQ ID NO: 30834

SEQ ID NO: 704095 - RNA, 64 nt, Homo Sapiens; identical to SEQ ID NO: 30835

SEQ ID NO: 704096 - RNA, 64 nt, Homo Sapiens; identical to SEQ ID NO: 30836

SEQ ID NO: 704097 - RNA, 64 nt, Homo Sapiens; identical to SEQ ID NO: 30837

SEQ ID NO: 704098 - RNA, 64 nt, Homo Sapiens; identical to SEQ ID NO: 30838

SEQ ID NO: 704099 - RNA, 64 nt, Homo Sapiens; identical to SEQ ID NO: 30839

SEQ ID NO: 704100 - RNA, 64 nt, Homo Sapiens; identical to SEQ ID NO: 30840

SEQ ID NO: 704101 - RNA, 64 nt, Homo Sapiens; identical to SEQ ID NO: 30841

SEQ ID NO: 704102 - RNA, 64 nt, Homo Sapiens; identical to SEQ ID NO: 30842

SEQ ID NO: 704103 - RNA, 64 nt, Homo Sapiens; identical to SEQ ID NO: 30843

SEQ ID NO: 704104 - RNA, 64 nt, Homo Sapiens; identical to SEQ ID NO: 30844

SEQ ID NO: 704105 - RNA, 64 nt, Homo Sapiens; identical to SEQ ID NO: 30845

SEQ ID NO: 704106 - RNA, 64 nt, Homo Sapiens; identical to SEQ ID NO: 30846

SEQ ID NO: 704107 - RNA, 64 nt, Homo Sapiens; identical to SEQ ID NO: 30847

SEQ ID NO: 704108 - RNA, 64 nt, Homo Sapiens; identical to SEQ ID NO: 30848

SEQ ID NO: 704109 - RNA, 64 nt, Homo Sapiens; identical to SEQ ID NO: 30849

SEQ ID NO: 704110 - RNA, 64 nt, Homo Sapiens; identical to SEQ ID NO: 30850

SEQ ID NO: 704111 - RNA, 64 nt, Homo Sapiens; identical to SEQ ID NO: 30851

SEQ ID NO: 704112 - RNA, 64 nt, Homo Sapiens; identical to SEQ ID NO: 30852

SEQ ID NO: 704113 - RNA, 64 nt, Homo Sapiens; identical to SEQ ID NO: 30853

SEQ ID NO: 704114 - RNA, 64 nt, Homo Sapiens; identical to SEQ ID NO: 30854

SEQ ID NO: 704115 - RNA, 64 nt, Homo Sapiens; identical to SEQ ID NO: 30855

SEQ ID NO: 704116 - RNA, 64 nt, Homo Sapiens; identical to SEQ ID NO: 30856

SEQ ID NO: 704117 - RNA, 64 nt, Homo Sapiens; identical to SEQ ID NO: 30857

SEQ ID NO: 704118 - RNA, 64 nt, Homo Sapiens; identical to SEQ ID NO: 30858

SEQ ID NO: 704119 - RNA, 64 nt, Homo Sapiens; identical to SEQ ID NO: 30859

SEQ ID NO: 704120 - RNA, 64 nt, Homo Sapiens; identical to SEQ ID NO: 30860

SEQ ID NO: 704121 - RNA, 64 nt, Homo Sapiens; identical to SEQ ID NO: 30861

SEQ ID NO: 704122 - RNA, 64 nt, Homo Sapiens; identical to SEQ ID NO: 30862

SEQ ID NO: 704123 - RNA, 64 nt, Homo Sapiens; identical to SEQ ID NO: 30863

SEQ ID NO: 704124 - RNA, 64 nt, Homo Sapiens; identical to SEQ ID NO: 30864

SEQ ID NO: 704125 - RNA, 64 nt, Homo Sapiens; identical to SEQ ID NO: 30865

SEQ ID NO: 704126 - RNA, 64 nt, Homo Sapiens; identical to SEQ ID NO: 30866

SEQ ID NO: 704127 - RNA, 64 nt, Homo Sapiens; identical to SEQ ID NO: 30867

SEQ ID NO: 704128 - RNA, 64 nt, Homo Sapiens; identical to SEQ ID NO: 30868

SEQ ID NO: 704129 - RNA, 64 nt, Homo Sapiens; identical to SEQ ID NO: 30869

SEQ ID NO: 704130 - RNA, 64 nt, Homo Sapiens; identical to SEQ ID NO: 30870

SEQ ID NO: 704131 - RNA, 64 nt, Homo Sapiens; identical to SEQ ID NO: 30871

SEQ ID NO: 704132 - RNA, 64 nt, Homo Sapiens; identical to SEQ ID NO: 30872

SEQ ID NO: 704133 - RNA, 64 nt, Homo Sapiens; identical to SEQ ID NO: 30873

SEQ ID NO: 704134 - RNA, 64 nt, Homo Sapiens; identical to SEQ ID NO: 30874

SEQ ID NO: 704135 - RNA, 64 nt, Homo Sapiens; identical to SEQ ID NO: 30875

SEQ ID NO: 704136 - RNA, 64 nt, Homo Sapiens; identical to SEQ ID NO: 30876

SEQ ID NO: 704137 - RNA, 64 nt, Homo Sapiens; identical to SEQ ID NO: 30877

SEQ ID NO: 704138 - RNA, 64 nt, Homo Sapiens; identical to SEQ ID NO: 30878

SEQ ID NO: 704139 - RNA, 64 nt, Homo Sapiens; identical to SEQ ID NO: 30879

SEQ ID NO: 704140 - RNA, 64 nt, Homo Sapiens; identical to SEQ ID NO: 30880

SEQ ID NO: 704141 - RNA, 64 nt, Homo Sapiens; identical to SEQ ID NO: 30881

SEQ ID NO: 704142 - RNA, 64 nt, Homo Sapiens; identical to SEQ ID NO: 30882

SEQ ID NO: 704143 - RNA, 64 nt, Homo Sapiens; identical to SEQ ID NO: 30883

SEQ ID NO: 704144 - RNA, 64 nt, Homo Sapiens; identical to SEQ ID NO: 30884

SEQ ID NO: 704145 - RNA, 64 nt, Homo Sapiens; identical to SEQ ID NO: 30885

SEQ ID NO: 704146 - RNA, 64 nt, Homo Sapiens; identical to SEQ ID NO: 30886

SEQ ID NO: 704147 - RNA, 64 nt, Homo Sapiens; identical to SEQ ID NO: 30887

SEQ ID NO: 704148 - RNA, 64 nt, Homo Sapiens; identical to SEQ ID NO: 30888

SEQ ID NO: 704149 - RNA, 64 nt, Homo Sapiens; identical to SEQ ID NO: 30889

SEQ ID NO: 704150 - RNA, 64 nt, Homo Sapiens; identical to SEQ ID NO: 30890

SEQ ID NO: 704151 - RNA, 64 nt, Homo Sapiens; identical to SEQ ID NO: 30891

SEQ ID NO: 704152 - RNA, 64 nt, Homo Sapiens; identical to SEQ ID NO: 30892

SEQ ID NO: 704153 - RNA, 64 nt, Homo Sapiens; identical to SEQ ID NO: 30893

SEQ ID NO: 704154 - RNA, 64 nt, Homo Sapiens; identical to SEQ ID NO: 30894

SEQ ID NO: 704155 - RNA, 64 nt, Homo Sapiens; identical to SEQ ID NO: 30895

SEQ ID NO: 704156 - RNA, 64 nt, Homo Sapiens; identical to SEQ ID NO: 30896

SEQ ID NO: 704157 - RNA, 64 nt, Homo Sapiens; identical to SEQ ID NO: 30897

SEQ ID NO: 704158 - RNA, 64 nt, Homo Sapiens; identical to SEQ ID NO: 30898

SEQ ID NO: 704159 - RNA, 64 nt, Homo Sapiens; identical to SEQ ID NO: 30899

SEQ ID NO: 704160 - RNA, 64 nt, Homo Sapiens; identical to SEQ ID NO: 30900

SEQ ID NO: 704161 - RNA, 64 nt, Homo Sapiens; identical to SEQ ID NO: 30901

SEQ ID NO: 704162 - RNA, 64 nt, Homo Sapiens; identical to SEQ ID NO: 30902

SEQ ID NO: 704163 - RNA, 64 nt, Homo Sapiens; identical to SEQ ID NO: 30903

SEQ ID NO: 704164 - RNA, 64 nt, Homo Sapiens; identical to SEQ ID NO: 30904

SEQ ID NO: 704165 - RNA, 64 nt, Homo Sapiens; identical to SEQ ID NO: 30905

SEQ ID NO: 704166 - RNA, 64 nt, Homo Sapiens; identical to SEQ ID NO: 30906

SEQ ID NO: 704167 - RNA, 64 nt, Homo Sapiens; identical to SEQ ID NO: 30907

SEQ ID NO: 704168 - RNA, 64 nt, Homo Sapiens; identical to SEQ ID NO: 30908

SEQ ID NO: 704169 - RNA, 64 nt, Homo Sapiens; identical to SEQ ID NO: 30909

SEQ ID NO: 704170 - RNA, 64 nt, Homo Sapiens; identical to SEQ ID NO: 30910

SEQ ID NO: 704171 - RNA, 64 nt, Homo Sapiens; identical to SEQ ID NO: 30911

SEQ ID NO: 704172 - RNA, 64 nt, Homo Sapiens; identical to SEQ ID NO: 30912

SEQ ID NO: 704173 - RNA, 64 nt, Homo Sapiens; identical to SEQ ID NO: 30913

SEQ ID NO: 704174 - RNA, 64 nt, Homo Sapiens; identical to SEQ ID NO: 30914

SEQ ID NO: 704175 - RNA, 64 nt, Homo Sapiens; identical to SEQ ID NO: 30915

SEQ ID NO: 704176 - RNA, 64 nt, Homo Sapiens; identical to SEQ ID NO: 30916

SEQ ID NO: 704177 - RNA, 64 nt, Homo Sapiens; identical to SEQ ID NO: 30917

SEQ ID NO: 704178 - RNA, 64 nt, Homo Sapiens; identical to SEQ ID NO: 30918

SEQ ID NO: 704179 - RNA, 64 nt, Homo Sapiens; identical to SEQ ID NO: 30919

SEQ ID NO: 704180 - RNA, 64 nt, Homo Sapiens; identical to SEQ ID NO: 30920

SEQ ID NO: 704181 - RNA, 64 nt, Homo Sapiens; identical to SEQ ID NO: 30921

SEQ ID NO: 704182 - RNA, 64 nt, Homo Sapiens; identical to SEQ ID NO: 30922

SEQ ID NO: 704183 - RNA, 64 nt, Homo Sapiens; identical to SEQ ID NO: 30923

SEQ ID NO: 704184 - RNA, 64 nt, Homo Sapiens; identical to SEQ ID NO: 30924

SEQ ID NO: 704185 - RNA, 64 nt, Homo Sapiens; identical to SEQ ID NO: 30925

SEQ ID NO: 704186 - RNA, 64 nt, Homo Sapiens; identical to SEQ ID NO: 30926

SEQ ID NO: 704187 - RNA, 64 nt, Homo Sapiens; identical to SEQ ID NO: 30927

SEQ ID NO: 704188 - RNA, 64 nt, Homo Sapiens; identical to SEQ ID NO: 30928

SEQ ID NO: 704189 - RNA, 64 nt, Homo Sapiens; identical to SEQ ID NO: 30929

SEQ ID NO: 704190 - RNA, 64 nt, Homo Sapiens; identical to SEQ ID NO: 30930

SEQ ID NO: 704191 - RNA, 64 nt, Homo Sapiens; identical to SEQ ID NO: 30931

SEQ ID NO: 704192 - RNA, 64 nt, Homo Sapiens; identical to SEQ ID NO: 30932

SEQ ID NO: 704193 - RNA, 64 nt, Homo Sapiens; identical to SEQ ID NO: 30933

SEQ ID NO: 704194 - RNA, 64 nt, Homo Sapiens; identical to SEQ ID NO: 30934

SEQ ID NO: 704195 - RNA, 64 nt, Homo Sapiens; identical to SEQ ID NO: 30935

SEQ ID NO: 704196 - RNA, 64 nt, Homo Sapiens; identical to SEQ ID NO: 30936

SEQ ID NO: 704197 - RNA, 64 nt, Homo Sapiens; identical to SEQ ID NO: 30937

SEQ ID NO: 704198 - RNA, 64 nt, Homo Sapiens; identical to SEQ ID NO: 30938

SEQ ID NO: 704199 - RNA, 64 nt, Homo Sapiens; identical to SEQ ID NO: 30939

SEQ ID NO: 704200 - RNA, 64 nt, Homo Sapiens; identical to SEQ ID NO: 30940

SEQ ID NO: 704201 - RNA, 64 nt, Homo Sapiens; identical to SEQ ID NO: 30941

SEQ ID NO: 704202 - RNA, 64 nt, Homo Sapiens; identical to SEQ ID NO: 30942

SEQ ID NO: 704203 - RNA, 64 nt, Homo Sapiens; identical to SEQ ID NO: 30943

SEQ ID NO: 704204 - RNA, 64 nt, Homo Sapiens; identical to SEQ ID NO: 30944

SEQ ID NO: 704205 - RNA, 64 nt, Homo Sapiens; identical to SEQ ID NO: 30945

SEQ ID NO: 704206 - RNA, 64 nt, Homo Sapiens; identical to SEQ ID NO: 30946

SEQ ID NO: 704207 - RNA, 64 nt, Homo Sapiens; identical to SEQ ID NO: 30947

SEQ ID NO: 704208 - RNA, 64 nt, Homo Sapiens; identical to SEQ ID NO: 30948

SEQ ID NO: 704209 - RNA, 64 nt, Homo Sapiens; identical to SEQ ID NO: 30949

SEQ ID NO: 704210 - RNA, 64 nt, Homo Sapiens; identical to SEQ ID NO: 30950

SEQ ID NO: 704211 - RNA, 64 nt, Homo Sapiens; identical to SEQ ID NO: 30951

SEQ ID NO: 704212 - RNA, 64 nt, Homo Sapiens; identical to SEQ ID NO: 30952

SEQ ID NO: 704213 - RNA, 64 nt, Homo Sapiens; identical to SEQ ID NO: 30953

SEQ ID NO: 704214 - RNA, 64 nt, Homo Sapiens; identical to SEQ ID NO: 30954

SEQ ID NO: 704215 - RNA, 64 nt, Homo Sapiens; identical to SEQ ID NO: 30955

SEQ ID NO: 704216 - RNA, 64 nt, Homo Sapiens; identical to SEQ ID NO: 30956

SEQ ID NO: 704217 - RNA, 64 nt, Homo Sapiens; identical to SEQ ID NO: 30957

SEQ ID NO: 704218 - RNA, 64 nt, Homo Sapiens; identical to SEQ ID NO: 30958

SEQ ID NO: 704219 - RNA, 64 nt, Homo Sapiens; identical to SEQ ID NO: 30959

SEQ ID NO: 704220 - RNA, 64 nt, Homo Sapiens; identical to SEQ ID NO: 30960

SEQ ID NO: 704221 - RNA, 64 nt, Homo Sapiens; identical to SEQ ID NO: 30961

SEQ ID NO: 704222 - RNA, 64 nt, Homo Sapiens; identical to SEQ ID NO: 30962

SEQ ID NO: 704223 - RNA, 64 nt, Homo Sapiens; identical to SEQ ID NO: 30963

SEQ ID NO: 704224 - RNA, 64 nt, Homo Sapiens; identical to SEQ ID NO: 30964

SEQ ID NO: 704225 - RNA, 64 nt, Homo Sapiens; identical to SEQ ID NO: 30965

SEQ ID NO: 704226 - RNA, 64 nt, Homo Sapiens; identical to SEQ ID NO: 30966

SEQ ID NO: 704227 - RNA, 64 nt, Homo Sapiens; identical to SEQ ID NO: 30967

SEQ ID NO: 704228 - RNA, 64 nt, Homo Sapiens; identical to SEQ ID NO: 30968

SEQ ID NO: 704229 - RNA, 64 nt, Homo Sapiens; identical to SEQ ID NO: 30969

SEQ ID NO: 704230 - RNA, 64 nt, Homo Sapiens; identical to SEQ ID NO: 30970

SEQ ID NO: 704231 - RNA, 64 nt, Homo Sapiens; identical to SEQ ID NO: 30971

SEQ ID NO: 704232 - RNA, 64 nt, Homo Sapiens; identical to SEQ ID NO: 30972

SEQ ID NO: 704233 - RNA, 64 nt, Homo Sapiens; identical to SEQ ID NO: 30973

SEQ ID NO: 704234 - RNA, 64 nt, Homo Sapiens; identical to SEQ ID NO: 30974

SEQ ID NO: 704235 - RNA, 64 nt, Homo Sapiens; identical to SEQ ID NO: 30975

SEQ ID NO: 704236 - RNA, 64 nt, Homo Sapiens; identical to SEQ ID NO: 30976

SEQ ID NO: 704237 - RNA, 64 nt, Homo Sapiens; identical to SEQ ID NO: 30977

SEQ ID NO: 704238 - RNA, 64 nt, Homo Sapiens; identical to SEQ ID NO: 30978

SEQ ID NO: 704239 - RNA, 64 nt, Homo Sapiens; identical to SEQ ID NO: 30979

SEQ ID NO: 704240 - RNA, 64 nt, Homo Sapiens; identical to SEQ ID NO: 30980

SEQ ID NO: 704241 - RNA, 64 nt, Homo Sapiens; identical to SEQ ID NO: 30981

SEQ ID NO: 704242 - RNA, 64 nt, Homo Sapiens; identical to SEQ ID NO: 30982

SEQ ID NO: 704243 - RNA, 64 nt, Homo Sapiens; identical to SEQ ID NO: 30983

SEQ ID NO: 704244 - RNA, 64 nt, Homo Sapiens; identical to SEQ ID NO: 30984

SEQ ID NO: 704245 - RNA, 60 nt, Homo Sapiens; identical to SEQ ID NO: 30985

SEQ ID NO: 704246 - RNA, 61 nt, Homo Sapiens; identical to SEQ ID NO: 30986

SEQ ID NO: 704247 - RNA, 64 nt, Homo Sapiens; identical to SEQ ID NO: 30987

SEQ ID NO: 704248 - RNA, 64 nt, Homo Sapiens; identical to SEQ ID NO: 30988

SEQ ID NO: 704249 - RNA, 64 nt, Homo Sapiens; identical to SEQ ID NO: 30989

SEQ ID NO: 704250 - RNA, 64 nt, Homo Sapiens; identical to SEQ ID NO: 30990

SEQ ID NO: 704251 - RNA, 64 nt, Homo Sapiens; identical to SEQ ID NO: 30991

SEQ ID NO: 704252 - RNA, 64 nt, Homo Sapiens; identical to SEQ ID NO: 30992

SEQ ID NO: 704253 - RNA, 64 nt, Homo Sapiens; identical to SEQ ID NO: 30993

SEQ ID NO: 704254 - RNA, 64 nt, Homo Sapiens; identical to SEQ ID NO: 30994

SEQ ID NO: 704255 - RNA, 64 nt, Homo Sapiens; identical to SEQ ID NO: 30995

SEQ ID NO: 704256 - RNA, 64 nt, Homo Sapiens; identical to SEQ ID NO: 30996

SEQ ID NO: 704257 - RNA, 64 nt, Homo Sapiens; identical to SEQ ID NO: 30997

SEQ ID NO: 704258 - RNA, 64 nt, Homo Sapiens; identical to SEQ ID NO: 30998

SEQ ID NO: 704259 - RNA, 64 nt, Homo Sapiens; identical to SEQ ID NO: 30999

SEQ ID NO: 704260 - RNA, 64 nt, Homo Sapiens; identical to SEQ ID NO: 31000

SEQ ID NO: 704261 - RNA, 64 nt, Homo Sapiens; identical to SEQ ID NO: 31001

SEQ ID NO: 704262 - RNA, 64 nt, Homo Sapiens; identical to SEQ ID NO: 31002

SEQ ID NO: 704263 - RNA, 64 nt, Homo Sapiens; identical to SEQ ID NO: 31003

SEQ ID NO: 704264 - RNA, 64 nt, Homo Sapiens; identical to SEQ ID NO: 31004

SEQ ID NO: 704265 - RNA, 64 nt, Homo Sapiens; identical to SEQ ID NO: 31005

SEQ ID NO: 704266 - RNA, 64 nt, Homo Sapiens; identical to SEQ ID NO: 31006

SEQ ID NO: 704267 - RNA, 64 nt, Homo Sapiens; identical to SEQ ID NO: 31007

SEQ ID NO: 704268 - RNA, 64 nt, Homo Sapiens; identical to SEQ ID NO: 31008

SEQ ID NO: 704269 - RNA, 64 nt, Homo Sapiens; identical to SEQ ID NO: 31009

SEQ ID NO: 704270 - RNA, 64 nt, Homo Sapiens; identical to SEQ ID NO: 31010

SEQ ID NO: 704271 - RNA, 64 nt, Homo Sapiens; identical to SEQ ID NO: 31011

SEQ ID NO: 704272 - RNA, 64 nt, Homo Sapiens; identical to SEQ ID NO: 31012

SEQ ID NO: 704273 - RNA, 64 nt, Homo Sapiens; identical to SEQ ID NO: 31013

SEQ ID NO: 704274 - RNA, 64 nt, Homo Sapiens; identical to SEQ ID NO: 31014

SEQ ID NO: 704275 - RNA, 64 nt, Homo Sapiens; identical to SEQ ID NO: 31015

SEQ ID NO: 704276 - RNA, 64 nt, Homo Sapiens; identical to SEQ ID NO: 31016

SEQ ID NO: 704277 - RNA, 64 nt, Homo Sapiens; identical to SEQ ID NO: 31017

SEQ ID NO: 704278 - RNA, 64 nt, Homo Sapiens; identical to SEQ ID NO: 31018

SEQ ID NO: 704279 - RNA, 64 nt, Homo Sapiens; identical to SEQ ID NO: 31019

SEQ ID NO: 704280 - RNA, 64 nt, Homo Sapiens; identical to SEQ ID NO: 31020

SEQ ID NO: 704281 - RNA, 64 nt, Homo Sapiens; identical to SEQ ID NO: 31021

SEQ ID NO: 704282 - RNA, 64 nt, Homo Sapiens; identical to SEQ ID NO: 31022

SEQ ID NO: 704283 - RNA, 64 nt, Homo Sapiens; identical to SEQ ID NO: 31023

SEQ ID NO: 704284 - RNA, 64 nt, Homo Sapiens; identical to SEQ ID NO: 31024

SEQ ID NO: 704285 - RNA, 64 nt, Homo Sapiens; identical to SEQ ID NO: 31025

SEQ ID NO: 704286 - RNA, 64 nt, Homo Sapiens; identical to SEQ ID NO: 31026

SEQ ID NO: 704287 - RNA, 64 nt, Homo Sapiens; identical to SEQ ID NO: 31027

SEQ ID NO: 704288 - RNA, 64 nt, Homo Sapiens; identical to SEQ ID NO: 31028

SEQ ID NO: 704289 - RNA, 64 nt, Homo Sapiens; identical to SEQ ID NO: 31029

SEQ ID NO: 704290 - RNA, 64 nt, Homo Sapiens; identical to SEQ ID NO: 31030

SEQ ID NO: 704291 - RNA, 64 nt, Homo Sapiens; identical to SEQ ID NO: 31031

SEQ ID NO: 704292 - RNA, 64 nt, Homo Sapiens; identical to SEQ ID NO: 31032

SEQ ID NO: 704293 - RNA, 64 nt, Homo Sapiens; identical to SEQ ID NO: 31033

SEQ ID NO: 704294 - RNA, 64 nt, Homo Sapiens; identical to SEQ ID NO: 31034

SEQ ID NO: 704295 - RNA, 64 nt, Homo Sapiens; identical to SEQ ID NO: 31035

SEQ ID NO: 704296 - RNA, 64 nt, Homo Sapiens; identical to SEQ ID NO: 31036

SEQ ID NO: 704297 - RNA, 64 nt, Homo Sapiens; identical to SEQ ID NO: 31037

SEQ ID NO: 704298 - RNA, 64 nt, Homo Sapiens; identical to SEQ ID NO: 31038

SEQ ID NO: 704299 - RNA, 64 nt, Homo Sapiens; identical to SEQ ID NO: 31039

SEQ ID NO: 704300 - RNA, 64 nt, Homo Sapiens; identical to SEQ ID NO: 31040

SEQ ID NO: 704301 - RNA, 64 nt, Homo Sapiens; identical to SEQ ID NO: 31041

SEQ ID NO: 704302 - RNA, 64 nt, Homo Sapiens; identical to SEQ ID NO: 31042

SEQ ID NO: 704303 - RNA, 64 nt, Homo Sapiens; identical to SEQ ID NO: 31043

SEQ ID NO: 704304 - RNA, 64 nt, Homo Sapiens; identical to SEQ ID NO: 31044

SEQ ID NO: 704305 - RNA, 64 nt, Homo Sapiens; identical to SEQ ID NO: 31045

SEQ ID NO: 704306 - RNA, 64 nt, Homo Sapiens; identical to SEQ ID NO: 31046

SEQ ID NO: 704307 - RNA, 64 nt, Homo Sapiens; identical to SEQ ID NO: 31047

SEQ ID NO: 704308 - RNA, 64 nt, Homo Sapiens; identical to SEQ ID NO: 31048

SEQ ID NO: 704309 - RNA, 64 nt, Homo Sapiens; identical to SEQ ID NO: 31049

SEQ ID NO: 704310 - RNA, 64 nt, Homo Sapiens; identical to SEQ ID NO: 31050

SEQ ID NO: 704311 - RNA, 64 nt, Homo Sapiens; identical to SEQ ID NO: 31051

SEQ ID NO: 704312 - RNA, 64 nt, Homo Sapiens; identical to SEQ ID NO: 31052

SEQ ID NO: 704313 - RNA, 64 nt, Homo Sapiens; identical to SEQ ID NO: 31053

SEQ ID NO: 704314 - RNA, 64 nt, Homo Sapiens; identical to SEQ ID NO: 31054

SEQ ID NO: 704315 - RNA, 64 nt, Homo Sapiens; identical to SEQ ID NO: 31055

SEQ ID NO: 704316 - RNA, 64 nt, Homo Sapiens; identical to SEQ ID NO: 31056

SEQ ID NO: 704317 - RNA, 64 nt, Homo Sapiens; identical to SEQ ID NO: 31057

SEQ ID NO: 704318 - RNA, 64 nt, Homo Sapiens; identical to SEQ ID NO: 31058

SEQ ID NO: 704319 - RNA, 64 nt, Homo Sapiens; identical to SEQ ID NO: 31059

SEQ ID NO: 704320 - RNA, 64 nt, Homo Sapiens; identical to SEQ ID NO: 31060

SEQ ID NO: 704321 - RNA, 64 nt, Homo Sapiens; identical to SEQ ID NO: 31061

SEQ ID NO: 704322 - RNA, 64 nt, Homo Sapiens; identical to SEQ ID NO: 31062

SEQ ID NO: 704323 - RNA, 64 nt, Homo Sapiens; identical to SEQ ID NO: 31063

SEQ ID NO: 704324 - RNA, 64 nt, Homo Sapiens; identical to SEQ ID NO: 31064

SEQ ID NO: 704325 - RNA, 64 nt, Homo Sapiens; identical to SEQ ID NO: 31065

SEQ ID NO: 704326 - RNA, 64 nt, Homo Sapiens; identical to SEQ ID NO: 31066

SEQ ID NO: 704327 - RNA, 64 nt, Homo Sapiens; identical to SEQ ID NO: 31067

SEQ ID NO: 704328 - RNA, 64 nt, Homo Sapiens; identical to SEQ ID NO: 31068

SEQ ID NO: 704329 - RNA, 64 nt, Homo Sapiens; identical to SEQ ID NO: 31069

SEQ ID NO: 704330 - RNA, 64 nt, Homo Sapiens; identical to SEQ ID NO: 31070

SEQ ID NO: 704331 - RNA, 64 nt, Homo Sapiens; identical to SEQ ID NO: 31071

SEQ ID NO: 704332 - RNA, 64 nt, Homo Sapiens; identical to SEQ ID NO: 31072

SEQ ID NO: 704333 - RNA, 64 nt, Homo Sapiens; identical to SEQ ID NO: 31073

SEQ ID NO: 704334 - RNA, 64 nt, Homo Sapiens; identical to SEQ ID NO: 31074

SEQ ID NO: 704335 - RNA, 64 nt, Homo Sapiens; identical to SEQ ID NO: 31075

SEQ ID NO: 704336 - RNA, 64 nt, Homo Sapiens; identical to SEQ ID NO: 31076

SEQ ID NO: 704337 - RNA, 64 nt, Homo Sapiens; identical to SEQ ID NO: 31077

SEQ ID NO: 704338 - RNA, 64 nt, Homo Sapiens; identical to SEQ ID NO: 31078

SEQ ID NO: 704339 - RNA, 64 nt, Homo Sapiens; identical to SEQ ID NO: 31079

SEQ ID NO: 704340 - RNA, 64 nt, Homo Sapiens; identical to SEQ ID NO: 31080

SEQ ID NO: 704341 - RNA, 64 nt, Homo Sapiens; identical to SEQ ID NO: 31081

SEQ ID NO: 704342 - RNA, 64 nt, Homo Sapiens; identical to SEQ ID NO: 31082

SEQ ID NO: 704343 - RNA, 64 nt, Homo Sapiens; identical to SEQ ID NO: 31083

SEQ ID NO: 704344 - RNA, 64 nt, Homo Sapiens; identical to SEQ ID NO: 31084

SEQ ID NO: 704345 - RNA, 64 nt, Homo Sapiens; identical to SEQ ID NO: 31085

SEQ ID NO: 704346 - RNA, 64 nt, Homo Sapiens; identical to SEQ ID NO: 31086

SEQ ID NO: 704347 - RNA, 64 nt, Homo Sapiens; identical to SEQ ID NO: 31087

SEQ ID NO: 704348 - RNA, 64 nt, Homo Sapiens; identical to SEQ ID NO: 31088

SEQ ID NO: 704349 - RNA, 64 nt, Homo Sapiens; identical to SEQ ID NO: 31089

SEQ ID NO: 704350 - RNA, 64 nt, Homo Sapiens; identical to SEQ ID NO: 31090

SEQ ID NO: 704351 - RNA, 64 nt, Homo Sapiens; identical to SEQ ID NO: 31091

SEQ ID NO: 704352 - RNA, 64 nt, Homo Sapiens; identical to SEQ ID NO: 31092

SEQ ID NO: 704353 - RNA, 64 nt, Homo Sapiens; identical to SEQ ID NO: 31093

SEQ ID NO: 704354 - RNA, 64 nt, Homo Sapiens; identical to SEQ ID NO: 31094

SEQ ID NO: 704355 - RNA, 64 nt, Homo Sapiens; identical to SEQ ID NO: 31095

SEQ ID NO: 704356 - RNA, 64 nt, Homo Sapiens; identical to SEQ ID NO: 31096

SEQ ID NO: 704357 - RNA, 64 nt, Homo Sapiens; identical to SEQ ID NO: 31097

SEQ ID NO: 704358 - RNA, 64 nt, Homo Sapiens; identical to SEQ ID NO: 31098

SEQ ID NO: 704359 - RNA, 64 nt, Homo Sapiens; identical to SEQ ID NO: 31099

SEQ ID NO: 704360 - RNA, 64 nt, Homo Sapiens; identical to SEQ ID NO: 31100

SEQ ID NO: 704361 - RNA, 64 nt, Homo Sapiens; identical to SEQ ID NO: 31101

SEQ ID NO: 704362 - RNA, 64 nt, Homo Sapiens; identical to SEQ ID NO: 31102

SEQ ID NO: 704363 - RNA, 64 nt, Homo Sapiens; identical to SEQ ID NO: 31103

SEQ ID NO: 704364 - RNA, 64 nt, Homo Sapiens; identical to SEQ ID NO: 31104

SEQ ID NO: 704365 - RNA, 64 nt, Homo Sapiens; identical to SEQ ID NO: 31105

SEQ ID NO: 704366 - RNA, 64 nt, Homo Sapiens; identical to SEQ ID NO: 31106

SEQ ID NO: 704367 - RNA, 64 nt, Homo Sapiens; identical to SEQ ID NO: 31107

SEQ ID NO: 704368 - RNA, 64 nt, Homo Sapiens; identical to SEQ ID NO: 31108

SEQ ID NO: 704369 - RNA, 64 nt, Homo Sapiens; identical to SEQ ID NO: 31109

SEQ ID NO: 704370 - RNA, 64 nt, Homo Sapiens; identical to SEQ ID NO: 31110

SEQ ID NO: 704371 - RNA, 64 nt, Homo Sapiens; identical to SEQ ID NO: 31111

SEQ ID NO: 704372 - RNA, 64 nt, Homo Sapiens; identical to SEQ ID NO: 31112

SEQ ID NO: 704373 - RNA, 64 nt, Homo Sapiens; identical to SEQ ID NO: 31113

SEQ ID NO: 704374 - RNA, 64 nt, Homo Sapiens; identical to SEQ ID NO: 31114

SEQ ID NO: 704375 - RNA, 64 nt, Homo Sapiens; identical to SEQ ID NO: 31115

SEQ ID NO: 704376 - RNA, 64 nt, Homo Sapiens; identical to SEQ ID NO: 31116

SEQ ID NO: 704377 - RNA, 64 nt, Homo Sapiens; identical to SEQ ID NO: 31117

SEQ ID NO: 704378 - RNA, 64 nt, Homo Sapiens; identical to SEQ ID NO: 31118

SEQ ID NO: 704379 - RNA, 64 nt, Homo Sapiens; identical to SEQ ID NO: 31119

SEQ ID NO: 704380 - RNA, 64 nt, Homo Sapiens; identical to SEQ ID NO: 31120

SEQ ID NO: 704381 - RNA, 64 nt, Homo Sapiens; identical to SEQ ID NO: 31121

SEQ ID NO: 704382 - RNA, 64 nt, Homo Sapiens; identical to SEQ ID NO: 31122

SEQ ID NO: 704383 - RNA, 64 nt, Homo Sapiens; identical to SEQ ID NO: 31123

SEQ ID NO: 704384 - RNA, 64 nt, Homo Sapiens; identical to SEQ ID NO: 31124

SEQ ID NO: 704385 - RNA, 64 nt, Homo Sapiens; identical to SEQ ID NO: 31125

SEQ ID NO: 704386 - RNA, 64 nt, Homo Sapiens; identical to SEQ ID NO: 31126

SEQ ID NO: 704387 - RNA, 64 nt, Homo Sapiens; identical to SEQ ID NO: 31127

SEQ ID NO: 704388 - RNA, 64 nt, Homo Sapiens; identical to SEQ ID NO: 31128

SEQ ID NO: 704389 - RNA, 64 nt, Homo Sapiens; identical to SEQ ID NO: 31129

SEQ ID NO: 704390 - RNA, 64 nt, Homo Sapiens; identical to SEQ ID NO: 31130

SEQ ID NO: 704391 - RNA, 64 nt, Homo Sapiens; identical to SEQ ID NO: 31131

SEQ ID NO: 704392 - RNA, 64 nt, Homo Sapiens; identical to SEQ ID NO: 31132

SEQ ID NO: 704393 - RNA, 64 nt, Homo Sapiens; identical to SEQ ID NO: 31133

SEQ ID NO: 704394 - RNA, 64 nt, Homo Sapiens; identical to SEQ ID NO: 31134

SEQ ID NO: 704395 - RNA, 64 nt, Homo Sapiens; identical to SEQ ID NO: 31135

SEQ ID NO: 704396 - RNA, 64 nt, Homo Sapiens; identical to SEQ ID NO: 31136

SEQ ID NO: 704397 - RNA, 64 nt, Homo Sapiens; identical to SEQ ID NO: 31137

SEQ ID NO: 704398 - RNA, 64 nt, Homo Sapiens; identical to SEQ ID NO: 31138

SEQ ID NO: 704399 - RNA, 64 nt, Homo Sapiens; identical to SEQ ID NO: 31139

SEQ ID NO: 704400 - RNA, 64 nt, Homo Sapiens; identical to SEQ ID NO: 31140

SEQ ID NO: 704401 - RNA, 64 nt, Homo Sapiens; identical to SEQ ID NO: 31141

SEQ ID NO: 704402 - RNA, 64 nt, Homo Sapiens; identical to SEQ ID NO: 31142

SEQ ID NO: 704403 - RNA, 64 nt, Homo Sapiens; identical to SEQ ID NO: 31143

SEQ ID NO: 704404 - RNA, 64 nt, Homo Sapiens; identical to SEQ ID NO: 31144

SEQ ID NO: 704405 - RNA, 64 nt, Homo Sapiens; identical to SEQ ID NO: 31145

SEQ ID NO: 704406 - RNA, 64 nt, Homo Sapiens; identical to SEQ ID NO: 31146

SEQ ID NO: 704407 - RNA, 64 nt, Homo Sapiens; identical to SEQ ID NO: 31147

SEQ ID NO: 704408 - RNA, 64 nt, Homo Sapiens; identical to SEQ ID NO: 31148

SEQ ID NO: 704409 - RNA, 64 nt, Homo Sapiens; identical to SEQ ID NO: 31149

SEQ ID NO: 704410 - RNA, 64 nt, Homo Sapiens; identical to SEQ ID NO: 31150

SEQ ID NO: 704411 - RNA, 64 nt, Homo Sapiens; identical to SEQ ID NO: 31151

SEQ ID NO: 704412 - RNA, 64 nt, Homo Sapiens; identical to SEQ ID NO: 31152

SEQ ID NO: 704413 - RNA, 64 nt, Homo Sapiens; identical to SEQ ID NO: 31153

SEQ ID NO: 704414 - RNA, 64 nt, Homo Sapiens; identical to SEQ ID NO: 31154

SEQ ID NO: 704415 - RNA, 64 nt, Homo Sapiens; identical to SEQ ID NO: 31155

SEQ ID NO: 704416 - RNA, 64 nt, Homo Sapiens; identical to SEQ ID NO: 31156

SEQ ID NO: 704417 - RNA, 64 nt, Homo Sapiens; identical to SEQ ID NO: 31157

SEQ ID NO: 704418 - RNA, 64 nt, Homo Sapiens; identical to SEQ ID NO: 31158

SEQ ID NO: 704419 - RNA, 64 nt, Homo Sapiens; identical to SEQ ID NO: 31159

SEQ ID NO: 704420 - RNA, 64 nt, Homo Sapiens; identical to SEQ ID NO: 31160

SEQ ID NO: 704421 - RNA, 64 nt, Homo Sapiens; identical to SEQ ID NO: 31161

SEQ ID NO: 704422 - RNA, 64 nt, Homo Sapiens; identical to SEQ ID NO: 31162

SEQ ID NO: 704423 - RNA, 64 nt, Homo Sapiens; identical to SEQ ID NO: 31163

SEQ ID NO: 704424 - RNA, 64 nt, Homo Sapiens; identical to SEQ ID NO: 31164

SEQ ID NO: 704425 - RNA, 64 nt, Homo Sapiens; identical to SEQ ID NO: 31165

SEQ ID NO: 704426 - RNA, 64 nt, Homo Sapiens; identical to SEQ ID NO: 31166

SEQ ID NO: 704427 - RNA, 64 nt, Homo Sapiens; identical to SEQ ID NO: 31167

SEQ ID NO: 704428 - RNA, 64 nt, Homo Sapiens; identical to SEQ ID NO: 31168

SEQ ID NO: 704429 - RNA, 64 nt, Homo Sapiens; identical to SEQ ID NO: 31169

SEQ ID NO: 704430 - RNA, 64 nt, Homo Sapiens; identical to SEQ ID NO: 31170

SEQ ID NO: 704431 - RNA, 64 nt, Homo Sapiens; identical to SEQ ID NO: 31171

SEQ ID NO: 704432 - RNA, 64 nt, Homo Sapiens; identical to SEQ ID NO: 31172

SEQ ID NO: 704433 - RNA, 64 nt, Homo Sapiens; identical to SEQ ID NO: 31173

SEQ ID NO: 704434 - RNA, 64 nt, Homo Sapiens; identical to SEQ ID NO: 31174

SEQ ID NO: 704435 - RNA, 64 nt, Homo Sapiens; identical to SEQ ID NO: 31175

SEQ ID NO: 704436 - RNA, 64 nt, Homo Sapiens; identical to SEQ ID NO: 31176

SEQ ID NO: 704437 - RNA, 64 nt, Homo Sapiens; identical to SEQ ID NO: 31177

SEQ ID NO: 704438 - RNA, 64 nt, Homo Sapiens; identical to SEQ ID NO: 31178

SEQ ID NO: 704439 - RNA, 64 nt, Homo Sapiens; identical to SEQ ID NO: 31179

SEQ ID NO: 704440 - RNA, 64 nt, Homo Sapiens; identical to SEQ ID NO: 31180

SEQ ID NO: 704441 - RNA, 64 nt, Homo Sapiens; identical to SEQ ID NO: 31181

SEQ ID NO: 704442 - RNA, 64 nt, Homo Sapiens; identical to SEQ ID NO: 31182

SEQ ID NO: 704443 - RNA, 64 nt, Homo Sapiens; identical to SEQ ID NO: 31183

SEQ ID NO: 704444 - RNA, 64 nt, Homo Sapiens; identical to SEQ ID NO: 31184

SEQ ID NO: 704445 - RNA, 64 nt, Homo Sapiens; identical to SEQ ID NO: 31185

SEQ ID NO: 704446 - RNA, 64 nt, Homo Sapiens; identical to SEQ ID NO: 31186

SEQ ID NO: 704447 - RNA, 64 nt, Homo Sapiens; identical to SEQ ID NO: 31187

SEQ ID NO: 704448 - RNA, 64 nt, Homo Sapiens; identical to SEQ ID NO: 31188

SEQ ID NO: 704449 - RNA, 64 nt, Homo Sapiens; identical to SEQ ID NO: 31189

SEQ ID NO: 704450 - RNA, 64 nt, Homo Sapiens; identical to SEQ ID NO: 31190

SEQ ID NO: 704451 - RNA, 64 nt, Homo Sapiens; identical to SEQ ID NO: 31191

SEQ ID NO: 704452 - RNA, 64 nt, Homo Sapiens; identical to SEQ ID NO: 31192

SEQ ID NO: 704453 - RNA, 64 nt, Homo Sapiens; identical to SEQ ID NO: 31193

SEQ ID NO: 704454 - RNA, 64 nt, Homo Sapiens; identical to SEQ ID NO: 31194

SEQ ID NO: 704455 - RNA, 64 nt, Homo Sapiens; identical to SEQ ID NO: 31195

SEQ ID NO: 704456 - RNA, 64 nt, Homo Sapiens; identical to SEQ ID NO: 31196

SEQ ID NO: 704457 - RNA, 64 nt, Homo Sapiens; identical to SEQ ID NO: 31197

SEQ ID NO: 704458 - RNA, 64 nt, Homo Sapiens; identical to SEQ ID NO: 31198

SEQ ID NO: 704459 - RNA, 64 nt, Homo Sapiens; identical to SEQ ID NO: 31199

SEQ ID NO: 704460 - RNA, 64 nt, Homo Sapiens; identical to SEQ ID NO: 31200

SEQ ID NO: 704461 - RNA, 64 nt, Homo Sapiens; identical to SEQ ID NO: 31201

SEQ ID NO: 704462 - RNA, 64 nt, Homo Sapiens; identical to SEQ ID NO: 31202

SEQ ID NO: 704463 - RNA, 64 nt, Homo Sapiens; identical to SEQ ID NO: 31203

SEQ ID NO: 704464 - RNA, 64 nt, Homo Sapiens; identical to SEQ ID NO: 31204

SEQ ID NO: 704465 - RNA, 64 nt, Homo Sapiens; identical to SEQ ID NO: 31205

SEQ ID NO: 704466 - RNA, 64 nt, Homo Sapiens; identical to SEQ ID NO: 31206

SEQ ID NO: 704467 - RNA, 64 nt, Homo Sapiens; identical to SEQ ID NO: 31207

SEQ ID NO: 704468 - RNA, 64 nt, Homo Sapiens; identical to SEQ ID NO: 31208

SEQ ID NO: 704469 - RNA, 64 nt, Homo Sapiens; identical to SEQ ID NO: 31209

SEQ ID NO: 704470 - RNA, 64 nt, Homo Sapiens; identical to SEQ ID NO: 31210

SEQ ID NO: 704471 - RNA, 64 nt, Homo Sapiens; identical to SEQ ID NO: 31211

SEQ ID NO: 704472 - RNA, 64 nt, Homo Sapiens; identical to SEQ ID NO: 31212

SEQ ID NO: 704473 - RNA, 64 nt, Homo Sapiens; identical to SEQ ID NO: 31213

SEQ ID NO: 704474 - RNA, 64 nt, Homo Sapiens; identical to SEQ ID NO: 31214

SEQ ID NO: 704475 - RNA, 64 nt, Homo Sapiens; identical to SEQ ID NO: 31215

SEQ ID NO: 704476 - RNA, 64 nt, Homo Sapiens; identical to SEQ ID NO: 31216

SEQ ID NO: 704477 - RNA, 64 nt, Homo Sapiens; identical to SEQ ID NO: 31217

SEQ ID NO: 704478 - RNA, 64 nt, Homo Sapiens; identical to SEQ ID NO: 31218

SEQ ID NO: 704479 - RNA, 64 nt, Homo Sapiens; identical to SEQ ID NO: 31219

SEQ ID NO: 704480 - RNA, 64 nt, Homo Sapiens; identical to SEQ ID NO: 31220

SEQ ID NO: 704481 - RNA, 64 nt, Homo Sapiens; identical to SEQ ID NO: 31221

SEQ ID NO: 704482 - RNA, 64 nt, Homo Sapiens; identical to SEQ ID NO: 31222

SEQ ID NO: 704483 - RNA, 64 nt, Homo Sapiens; identical to SEQ ID NO: 31223

SEQ ID NO: 704484 - RNA, 64 nt, Homo Sapiens; identical to SEQ ID NO: 31224

SEQ ID NO: 704485 - RNA, 64 nt, Homo Sapiens; identical to SEQ ID NO: 31225

SEQ ID NO: 704486 - RNA, 64 nt, Homo Sapiens; identical to SEQ ID NO: 31226

SEQ ID NO: 704487 - RNA, 64 nt, Homo Sapiens; identical to SEQ ID NO: 31227

SEQ ID NO: 704488 - RNA, 64 nt, Homo Sapiens; identical to SEQ ID NO: 31228

SEQ ID NO: 704489 - RNA, 64 nt, Homo Sapiens; identical to SEQ ID NO: 31229

SEQ ID NO: 704490 - RNA, 64 nt, Homo Sapiens; identical to SEQ ID NO: 31230

SEQ ID NO: 704491 - RNA, 64 nt, Homo Sapiens; identical to SEQ ID NO: 31231

SEQ ID NO: 704492 - RNA, 64 nt, Homo Sapiens; identical to SEQ ID NO: 31232

SEQ ID NO: 704493 - RNA, 64 nt, Homo Sapiens; identical to SEQ ID NO: 31233

SEQ ID NO: 704494 - RNA, 64 nt, Homo Sapiens; identical to SEQ ID NO: 31234

SEQ ID NO: 704495 - RNA, 64 nt, Homo Sapiens; identical to SEQ ID NO: 31235

SEQ ID NO: 704496 - RNA, 64 nt, Homo Sapiens; identical to SEQ ID NO: 31236

SEQ ID NO: 704497 - RNA, 64 nt, Homo Sapiens; identical to SEQ ID NO: 31237

SEQ ID NO: 704498 - RNA, 64 nt, Homo Sapiens; identical to SEQ ID NO: 31238

SEQ ID NO: 704499 - RNA, 64 nt, Homo Sapiens; identical to SEQ ID NO: 31239

SEQ ID NO: 704500 - RNA, 64 nt, Homo Sapiens; identical to SEQ ID NO: 31240

SEQ ID NO: 704501 - RNA, 62 nt, Homo Sapiens; identical to SEQ ID NO: 31241

SEQ ID NO: 704502 - RNA, 63 nt, Homo Sapiens; identical to SEQ ID NO: 31242

SEQ ID NO: 704503 - RNA, 64 nt, Homo Sapiens; identical to SEQ ID NO: 31243

SEQ ID NO: 704504 - RNA, 64 nt, Homo Sapiens; identical to SEQ ID NO: 31244

SEQ ID NO: 704505 - RNA, 64 nt, Homo Sapiens; identical to SEQ ID NO: 31245

SEQ ID NO: 704506 - RNA, 64 nt, Homo Sapiens; identical to SEQ ID NO: 31246

SEQ ID NO: 704507 - RNA, 64 nt, Homo Sapiens; identical to SEQ ID NO: 31247

SEQ ID NO: 704508 - RNA, 64 nt, Homo Sapiens; identical to SEQ ID NO: 31248

SEQ ID NO: 704509 - RNA, 64 nt, Homo Sapiens; identical to SEQ ID NO: 31249

SEQ ID NO: 704510 - RNA, 64 nt, Homo Sapiens; identical to SEQ ID NO: 31250

SEQ ID NO: 704511 - RNA, 64 nt, Homo Sapiens; identical to SEQ ID NO: 31251

SEQ ID NO: 704512 - RNA, 64 nt, Homo Sapiens; identical to SEQ ID NO: 31252

SEQ ID NO: 704513 - RNA, 64 nt, Homo Sapiens; identical to SEQ ID NO: 31253

SEQ ID NO: 704514 - RNA, 64 nt, Homo Sapiens; identical to SEQ ID NO: 31254

SEQ ID NO: 704515 - RNA, 64 nt, Homo Sapiens; identical to SEQ ID NO: 31255

SEQ ID NO: 704516 - RNA, 64 nt, Homo Sapiens; identical to SEQ ID NO: 31256

SEQ ID NO: 704517 - RNA, 64 nt, Homo Sapiens; identical to SEQ ID NO: 31257

SEQ ID NO: 704518 - RNA, 64 nt, Homo Sapiens; identical to SEQ ID NO: 31258

SEQ ID NO: 704519 - RNA, 64 nt, Homo Sapiens; identical to SEQ ID NO: 31259

SEQ ID NO: 704520 - RNA, 64 nt, Homo Sapiens; identical to SEQ ID NO: 31260

SEQ ID NO: 704521 - RNA, 64 nt, Homo Sapiens; identical to SEQ ID NO: 31261

SEQ ID NO: 704522 - RNA, 64 nt, Homo Sapiens; identical to SEQ ID NO: 31262

SEQ ID NO: 704523 - RNA, 64 nt, Homo Sapiens; identical to SEQ ID NO: 31263

SEQ ID NO: 704524 - RNA, 64 nt, Homo Sapiens; identical to SEQ ID NO: 31264

SEQ ID NO: 704525 - RNA, 64 nt, Homo Sapiens; identical to SEQ ID NO: 31265

SEQ ID NO: 704526 - RNA, 64 nt, Homo Sapiens; identical to SEQ ID NO: 31266

SEQ ID NO: 704527 - RNA, 64 nt, Homo Sapiens; identical to SEQ ID NO: 31267

SEQ ID NO: 704528 - RNA, 64 nt, Homo Sapiens; identical to SEQ ID NO: 31268

SEQ ID NO: 704529 - RNA, 64 nt, Homo Sapiens; identical to SEQ ID NO: 31269

SEQ ID NO: 704530 - RNA, 64 nt, Homo Sapiens; identical to SEQ ID NO: 31270

SEQ ID NO: 704531 - RNA, 64 nt, Homo Sapiens; identical to SEQ ID NO: 31271

SEQ ID NO: 704532 - RNA, 64 nt, Homo Sapiens; identical to SEQ ID NO: 31272

SEQ ID NO: 704533 - RNA, 64 nt, Homo Sapiens; identical to SEQ ID NO: 31273

SEQ ID NO: 704534 - RNA, 64 nt, Homo Sapiens; identical to SEQ ID NO: 31274

SEQ ID NO: 704535 - RNA, 64 nt, Homo Sapiens; identical to SEQ ID NO: 31275

SEQ ID NO: 704536 - RNA, 64 nt, Homo Sapiens; identical to SEQ ID NO: 31276

SEQ ID NO: 704537 - RNA, 64 nt, Homo Sapiens; identical to SEQ ID NO: 31277

SEQ ID NO: 704538 - RNA, 64 nt, Homo Sapiens; identical to SEQ ID NO: 31278

SEQ ID NO: 704539 - RNA, 64 nt, Homo Sapiens; identical to SEQ ID NO: 31279

SEQ ID NO: 704540 - RNA, 64 nt, Homo Sapiens; identical to SEQ ID NO: 31280

SEQ ID NO: 704541 - RNA, 64 nt, Homo Sapiens; identical to SEQ ID NO: 31281

SEQ ID NO: 704542 - RNA, 64 nt, Homo Sapiens; identical to SEQ ID NO: 31282

SEQ ID NO: 704543 - RNA, 64 nt, Homo Sapiens; identical to SEQ ID NO: 31283

SEQ ID NO: 704544 - RNA, 64 nt, Homo Sapiens; identical to SEQ ID NO: 31284

SEQ ID NO: 704545 - RNA, 64 nt, Homo Sapiens; identical to SEQ ID NO: 31285

SEQ ID NO: 704546 - RNA, 64 nt, Homo Sapiens; identical to SEQ ID NO: 31286

SEQ ID NO: 704547 - RNA, 64 nt, Homo Sapiens; identical to SEQ ID NO: 31287

SEQ ID NO: 704548 - RNA, 64 nt, Homo Sapiens; identical to SEQ ID NO: 31288

SEQ ID NO: 704549 - RNA, 64 nt, Homo Sapiens; identical to SEQ ID NO: 31289

SEQ ID NO: 704550 - RNA, 64 nt, Homo Sapiens; identical to SEQ ID NO: 31290

SEQ ID NO: 704551 - RNA, 64 nt, Homo Sapiens; identical to SEQ ID NO: 31291

SEQ ID NO: 704552 - RNA, 64 nt, Homo Sapiens; identical to SEQ ID NO: 31292

SEQ ID NO: 704553 - RNA, 64 nt, Homo Sapiens; identical to SEQ ID NO: 31293

SEQ ID NO: 704554 - RNA, 64 nt, Homo Sapiens; identical to SEQ ID NO: 31294

SEQ ID NO: 704555 - RNA, 64 nt, Homo Sapiens; identical to SEQ ID NO: 31295

SEQ ID NO: 704556 - RNA, 64 nt, Homo Sapiens; identical to SEQ ID NO: 31296

SEQ ID NO: 704557 - RNA, 64 nt, Homo Sapiens; identical to SEQ ID NO: 31297

SEQ ID NO: 704558 - RNA, 64 nt, Homo Sapiens; identical to SEQ ID NO: 31298

SEQ ID NO: 704559 - RNA, 64 nt, Homo Sapiens; identical to SEQ ID NO: 31299

SEQ ID NO: 704560 - RNA, 64 nt, Homo Sapiens; identical to SEQ ID NO: 31300

SEQ ID NO: 704561 - RNA, 64 nt, Homo Sapiens; identical to SEQ ID NO: 31301

SEQ ID NO: 704562 - RNA, 64 nt, Homo Sapiens; identical to SEQ ID NO: 31302

SEQ ID NO: 704563 - RNA, 64 nt, Homo Sapiens; identical to SEQ ID NO: 31303

SEQ ID NO: 704564 - RNA, 64 nt, Homo Sapiens; identical to SEQ ID NO: 31304

SEQ ID NO: 704565 - RNA, 64 nt, Homo Sapiens; identical to SEQ ID NO: 31305

SEQ ID NO: 704566 - RNA, 64 nt, Homo Sapiens; identical to SEQ ID NO: 31306

SEQ ID NO: 704567 - RNA, 64 nt, Homo Sapiens; identical to SEQ ID NO: 31307

SEQ ID NO: 704568 - RNA, 64 nt, Homo Sapiens; identical to SEQ ID NO: 31308

SEQ ID NO: 704569 - RNA, 64 nt, Homo Sapiens; identical to SEQ ID NO: 31309

SEQ ID NO: 704570 - RNA, 64 nt, Homo Sapiens; identical to SEQ ID NO: 31310

SEQ ID NO: 704571 - RNA, 64 nt, Homo Sapiens; identical to SEQ ID NO: 31311

SEQ ID NO: 704572 - RNA, 64 nt, Homo Sapiens; identical to SEQ ID NO: 31312

SEQ ID NO: 704573 - RNA, 64 nt, Homo Sapiens; identical to SEQ ID NO: 31313

SEQ ID NO: 704574 - RNA, 64 nt, Homo Sapiens; identical to SEQ ID NO: 31314

SEQ ID NO: 704575 - RNA, 64 nt, Homo Sapiens; identical to SEQ ID NO: 31315

SEQ ID NO: 704576 - RNA, 64 nt, Homo Sapiens; identical to SEQ ID NO: 31316

SEQ ID NO: 704577 - RNA, 64 nt, Homo Sapiens; identical to SEQ ID NO: 31317

SEQ ID NO: 704578 - RNA, 64 nt, Homo Sapiens; identical to SEQ ID NO: 31318

SEQ ID NO: 704579 - RNA, 64 nt, Homo Sapiens; identical to SEQ ID NO: 31319

SEQ ID NO: 704580 - RNA, 64 nt, Homo Sapiens; identical to SEQ ID NO: 31320

SEQ ID NO: 704581 - RNA, 64 nt, Homo Sapiens; identical to SEQ ID NO: 31321

SEQ ID NO: 704582 - RNA, 64 nt, Homo Sapiens; identical to SEQ ID NO: 31322

SEQ ID NO: 704583 - RNA, 64 nt, Homo Sapiens; identical to SEQ ID NO: 31323

SEQ ID NO: 704584 - RNA, 64 nt, Homo Sapiens; identical to SEQ ID NO: 31324

SEQ ID NO: 704585 - RNA, 64 nt, Homo Sapiens; identical to SEQ ID NO: 31325

SEQ ID NO: 704586 - RNA, 64 nt, Homo Sapiens; identical to SEQ ID NO: 31326

SEQ ID NO: 704587 - RNA, 64 nt, Homo Sapiens; identical to SEQ ID NO: 31327

SEQ ID NO: 704588 - RNA, 64 nt, Homo Sapiens; identical to SEQ ID NO: 31328

SEQ ID NO: 704589 - RNA, 64 nt, Homo Sapiens; identical to SEQ ID NO: 31329

SEQ ID NO: 704590 - RNA, 64 nt, Homo Sapiens; identical to SEQ ID NO: 31330

SEQ ID NO: 704591 - RNA, 64 nt, Homo Sapiens; identical to SEQ ID NO: 31331

SEQ ID NO: 704592 - RNA, 64 nt, Homo Sapiens; identical to SEQ ID NO: 31332

SEQ ID NO: 704593 - RNA, 64 nt, Homo Sapiens; identical to SEQ ID NO: 31333

SEQ ID NO: 704594 - RNA, 64 nt, Homo Sapiens; identical to SEQ ID NO: 31334

SEQ ID NO: 704595 - RNA, 64 nt, Homo Sapiens; identical to SEQ ID NO: 31335

SEQ ID NO: 704596 - RNA, 64 nt, Homo Sapiens; identical to SEQ ID NO: 31336

SEQ ID NO: 704597 - RNA, 64 nt, Homo Sapiens; identical to SEQ ID NO: 31337

SEQ ID NO: 704598 - RNA, 64 nt, Homo Sapiens; identical to SEQ ID NO: 31338

SEQ ID NO: 704599 - RNA, 64 nt, Homo Sapiens; identical to SEQ ID NO: 31339

SEQ ID NO: 704600 - RNA, 64 nt, Homo Sapiens; identical to SEQ ID NO: 31340

SEQ ID NO: 704601 - RNA, 64 nt, Homo Sapiens; identical to SEQ ID NO: 31341

SEQ ID NO: 704602 - RNA, 64 nt, Homo Sapiens; identical to SEQ ID NO: 31342

SEQ ID NO: 704603 - RNA, 64 nt, Homo Sapiens; identical to SEQ ID NO: 31343

SEQ ID NO: 704604 - RNA, 64 nt, Homo Sapiens; identical to SEQ ID NO: 31344

SEQ ID NO: 704605 - RNA, 64 nt, Homo Sapiens; identical to SEQ ID NO: 31345

SEQ ID NO: 704606 - RNA, 64 nt, Homo Sapiens; identical to SEQ ID NO: 31346

SEQ ID NO: 704607 - RNA, 64 nt, Homo Sapiens; identical to SEQ ID NO: 31347

SEQ ID NO: 704608 - RNA, 64 nt, Homo Sapiens; identical to SEQ ID NO: 31348

SEQ ID NO: 704609 - RNA, 64 nt, Homo Sapiens; identical to SEQ ID NO: 31349

SEQ ID NO: 704610 - RNA, 64 nt, Homo Sapiens; identical to SEQ ID NO: 31350

SEQ ID NO: 704611 - RNA, 64 nt, Homo Sapiens; identical to SEQ ID NO: 31351

SEQ ID NO: 704612 - RNA, 64 nt, Homo Sapiens; identical to SEQ ID NO: 31352

SEQ ID NO: 704613 - RNA, 64 nt, Homo Sapiens; identical to SEQ ID NO: 31353

SEQ ID NO: 704614 - RNA, 64 nt, Homo Sapiens; identical to SEQ ID NO: 31354

SEQ ID NO: 704615 - RNA, 64 nt, Homo Sapiens; identical to SEQ ID NO: 31355

SEQ ID NO: 704616 - RNA, 64 nt, Homo Sapiens; identical to SEQ ID NO: 31356

SEQ ID NO: 704617 - RNA, 64 nt, Homo Sapiens; identical to SEQ ID NO: 31357

SEQ ID NO: 704618 - RNA, 64 nt, Homo Sapiens; identical to SEQ ID NO: 31358

SEQ ID NO: 704619 - RNA, 64 nt, Homo Sapiens; identical to SEQ ID NO: 31359

SEQ ID NO: 704620 - RNA, 64 nt, Homo Sapiens; identical to SEQ ID NO: 31360

SEQ ID NO: 704621 - RNA, 64 nt, Homo Sapiens; identical to SEQ ID NO: 31361

SEQ ID NO: 704622 - RNA, 64 nt, Homo Sapiens; identical to SEQ ID NO: 31362

SEQ ID NO: 704623 - RNA, 64 nt, Homo Sapiens; identical to SEQ ID NO: 31363

SEQ ID NO: 704624 - RNA, 64 nt, Homo Sapiens; identical to SEQ ID NO: 31364

SEQ ID NO: 704625 - RNA, 64 nt, Homo Sapiens; identical to SEQ ID NO: 31365

SEQ ID NO: 704626 - RNA, 64 nt, Homo Sapiens; identical to SEQ ID NO: 31366

SEQ ID NO: 704627 - RNA, 64 nt, Homo Sapiens; identical to SEQ ID NO: 31367

SEQ ID NO: 704628 - RNA, 64 nt, Homo Sapiens; identical to SEQ ID NO: 31368

SEQ ID NO: 704629 - RNA, 64 nt, Homo Sapiens; identical to SEQ ID NO: 31369

SEQ ID NO: 704630 - RNA, 64 nt, Homo Sapiens; identical to SEQ ID NO: 31370

SEQ ID NO: 704631 - RNA, 64 nt, Homo Sapiens; identical to SEQ ID NO: 31371

SEQ ID NO: 704632 - RNA, 64 nt, Homo Sapiens; identical to SEQ ID NO: 31372

SEQ ID NO: 704633 - RNA, 64 nt, Homo Sapiens; identical to SEQ ID NO: 31373

SEQ ID NO: 704634 - RNA, 64 nt, Homo Sapiens; identical to SEQ ID NO: 31374

SEQ ID NO: 704635 - RNA, 64 nt, Homo Sapiens; identical to SEQ ID NO: 31375

SEQ ID NO: 704636 - RNA, 64 nt, Homo Sapiens; identical to SEQ ID NO: 31376

SEQ ID NO: 704637 - RNA, 64 nt, Homo Sapiens; identical to SEQ ID NO: 31377

SEQ ID NO: 704638 - RNA, 64 nt, Homo Sapiens; identical to SEQ ID NO: 31378

SEQ ID NO: 704639 - RNA, 64 nt, Homo Sapiens; identical to SEQ ID NO: 31379

SEQ ID NO: 704640 - RNA, 64 nt, Homo Sapiens; identical to SEQ ID NO: 31380

SEQ ID NO: 704641 - RNA, 64 nt, Homo Sapiens; identical to SEQ ID NO: 31381

SEQ ID NO: 704642 - RNA, 64 nt, Homo Sapiens; identical to SEQ ID NO: 31382

SEQ ID NO: 704643 - RNA, 64 nt, Homo Sapiens; identical to SEQ ID NO: 31383

SEQ ID NO: 704644 - RNA, 64 nt, Homo Sapiens; identical to SEQ ID NO: 31384

SEQ ID NO: 704645 - RNA, 64 nt, Homo Sapiens; identical to SEQ ID NO: 31385

SEQ ID NO: 704646 - RNA, 64 nt, Homo Sapiens; identical to SEQ ID NO: 31386

SEQ ID NO: 704647 - RNA, 64 nt, Homo Sapiens; identical to SEQ ID NO: 31387

SEQ ID NO: 704648 - RNA, 64 nt, Homo Sapiens; identical to SEQ ID NO: 31388

SEQ ID NO: 704649 - RNA, 64 nt, Homo Sapiens; identical to SEQ ID NO: 31389

SEQ ID NO: 704650 - RNA, 64 nt, Homo Sapiens; identical to SEQ ID NO: 31390

SEQ ID NO: 704651 - RNA, 64 nt, Homo Sapiens; identical to SEQ ID NO: 31391

SEQ ID NO: 704652 - RNA, 64 nt, Homo Sapiens; identical to SEQ ID NO: 31392

SEQ ID NO: 704653 - RNA, 64 nt, Homo Sapiens; identical to SEQ ID NO: 31393

SEQ ID NO: 704654 - RNA, 64 nt, Homo Sapiens; identical to SEQ ID NO: 31394

SEQ ID NO: 704655 - RNA, 64 nt, Homo Sapiens; identical to SEQ ID NO: 31395

SEQ ID NO: 704656 - RNA, 64 nt, Homo Sapiens; identical to SEQ ID NO: 31396

SEQ ID NO: 704657 - RNA, 64 nt, Homo Sapiens; identical to SEQ ID NO: 31397

SEQ ID NO: 704658 - RNA, 64 nt, Homo Sapiens; identical to SEQ ID NO: 31398

SEQ ID NO: 704659 - RNA, 64 nt, Homo Sapiens; identical to SEQ ID NO: 31399

SEQ ID NO: 704660 - RNA, 64 nt, Homo Sapiens; identical to SEQ ID NO: 31400

SEQ ID NO: 704661 - RNA, 64 nt, Homo Sapiens; identical to SEQ ID NO: 31401

SEQ ID NO: 704662 - RNA, 64 nt, Homo Sapiens; identical to SEQ ID NO: 31402

SEQ ID NO: 704663 - RNA, 64 nt, Homo Sapiens; identical to SEQ ID NO: 31403

SEQ ID NO: 704664 - RNA, 64 nt, Homo Sapiens; identical to SEQ ID NO: 31404

SEQ ID NO: 704665 - RNA, 64 nt, Homo Sapiens; identical to SEQ ID NO: 31405

SEQ ID NO: 704666 - RNA, 64 nt, Homo Sapiens; identical to SEQ ID NO: 31406

SEQ ID NO: 704667 - RNA, 64 nt, Homo Sapiens; identical to SEQ ID NO: 31407

SEQ ID NO: 704668 - RNA, 64 nt, Homo Sapiens; identical to SEQ ID NO: 31408

SEQ ID NO: 704669 - RNA, 64 nt, Homo Sapiens; identical to SEQ ID NO: 31409

SEQ ID NO: 704670 - RNA, 64 nt, Homo Sapiens; identical to SEQ ID NO: 31410

SEQ ID NO: 704671 - RNA, 64 nt, Homo Sapiens; identical to SEQ ID NO: 31411

SEQ ID NO: 704672 - RNA, 64 nt, Homo Sapiens; identical to SEQ ID NO: 31412

SEQ ID NO: 704673 - RNA, 64 nt, Homo Sapiens; identical to SEQ ID NO: 31413

SEQ ID NO: 704674 - RNA, 64 nt, Homo Sapiens; identical to SEQ ID NO: 31414

SEQ ID NO: 704675 - RNA, 64 nt, Homo Sapiens; identical to SEQ ID NO: 31415

SEQ ID NO: 704676 - RNA, 64 nt, Homo Sapiens; identical to SEQ ID NO: 31416

SEQ ID NO: 704677 - RNA, 64 nt, Homo Sapiens; identical to SEQ ID NO: 31417

SEQ ID NO: 704678 - RNA, 64 nt, Homo Sapiens; identical to SEQ ID NO: 31418

SEQ ID NO: 704679 - RNA, 64 nt, Homo Sapiens; identical to SEQ ID NO: 31419

SEQ ID NO: 704680 - RNA, 64 nt, Homo Sapiens; identical to SEQ ID NO: 31420

SEQ ID NO: 704681 - RNA, 64 nt, Homo Sapiens; identical to SEQ ID NO: 31421

SEQ ID NO: 704682 - RNA, 64 nt, Homo Sapiens; identical to SEQ ID NO: 31422

SEQ ID NO: 704683 - RNA, 64 nt, Homo Sapiens; identical to SEQ ID NO: 31423

SEQ ID NO: 704684 - RNA, 64 nt, Homo Sapiens; identical to SEQ ID NO: 31424

SEQ ID NO: 704685 - RNA, 64 nt, Homo Sapiens; identical to SEQ ID NO: 31425

SEQ ID NO: 704686 - RNA, 64 nt, Homo Sapiens; identical to SEQ ID NO: 31426

SEQ ID NO: 704687 - RNA, 64 nt, Homo Sapiens; identical to SEQ ID NO: 31427

SEQ ID NO: 704688 - RNA, 64 nt, Homo Sapiens; identical to SEQ ID NO: 31428

SEQ ID NO: 704689 - RNA, 64 nt, Homo Sapiens; identical to SEQ ID NO: 31429

SEQ ID NO: 704690 - RNA, 64 nt, Homo Sapiens; identical to SEQ ID NO: 31430

SEQ ID NO: 704691 - RNA, 64 nt, Homo Sapiens; identical to SEQ ID NO: 31431

SEQ ID NO: 704692 - RNA, 64 nt, Homo Sapiens; identical to SEQ ID NO: 31432

SEQ ID NO: 704693 - RNA, 64 nt, Homo Sapiens; identical to SEQ ID NO: 31433

SEQ ID NO: 704694 - RNA, 64 nt, Homo Sapiens; identical to SEQ ID NO: 31434

SEQ ID NO: 704695 - RNA, 64 nt, Homo Sapiens; identical to SEQ ID NO: 31435

SEQ ID NO: 704696 - RNA, 64 nt, Homo Sapiens; identical to SEQ ID NO: 31436

SEQ ID NO: 704697 - RNA, 64 nt, Homo Sapiens; identical to SEQ ID NO: 31437

SEQ ID NO: 704698 - RNA, 64 nt, Homo Sapiens; identical to SEQ ID NO: 31438

SEQ ID NO: 704699 - RNA, 64 nt, Homo Sapiens; identical to SEQ ID NO: 31439

SEQ ID NO: 704700 - RNA, 64 nt, Homo Sapiens; identical to SEQ ID NO: 31440

SEQ ID NO: 704701 - RNA, 64 nt, Homo Sapiens; identical to SEQ ID NO: 31441

SEQ ID NO: 704702 - RNA, 64 nt, Homo Sapiens; identical to SEQ ID NO: 31442

SEQ ID NO: 704703 - RNA, 64 nt, Homo Sapiens; identical to SEQ ID NO: 31443

SEQ ID NO: 704704 - RNA, 64 nt, Homo Sapiens; identical to SEQ ID NO: 31444

SEQ ID NO: 704705 - RNA, 64 nt, Homo Sapiens; identical to SEQ ID NO: 31445

SEQ ID NO: 704706 - RNA, 64 nt, Homo Sapiens; identical to SEQ ID NO: 31446

SEQ ID NO: 704707 - RNA, 64 nt, Homo Sapiens; identical to SEQ ID NO: 31447

SEQ ID NO: 704708 - RNA, 64 nt, Homo Sapiens; identical to SEQ ID NO: 31448

SEQ ID NO: 704709 - RNA, 64 nt, Homo Sapiens; identical to SEQ ID NO: 31449

SEQ ID NO: 704710 - RNA, 64 nt, Homo Sapiens; identical to SEQ ID NO: 31450

SEQ ID NO: 704711 - RNA, 64 nt, Homo Sapiens; identical to SEQ ID NO: 31451

SEQ ID NO: 704712 - RNA, 64 nt, Homo Sapiens; identical to SEQ ID NO: 31452

SEQ ID NO: 704713 - RNA, 64 nt, Homo Sapiens; identical to SEQ ID NO: 31453

SEQ ID NO: 704714 - RNA, 64 nt, Homo Sapiens; identical to SEQ ID NO: 31454

SEQ ID NO: 704715 - RNA, 64 nt, Homo Sapiens; identical to SEQ ID NO: 31455

SEQ ID NO: 704716 - RNA, 64 nt, Homo Sapiens; identical to SEQ ID NO: 31456

SEQ ID NO: 704717 - RNA, 64 nt, Homo Sapiens; identical to SEQ ID NO: 31457

SEQ ID NO: 704718 - RNA, 64 nt, Homo Sapiens; identical to SEQ ID NO: 31458

SEQ ID NO: 704719 - RNA, 64 nt, Homo Sapiens; identical to SEQ ID NO: 31459

SEQ ID NO: 704720 - RNA, 64 nt, Homo Sapiens; identical to SEQ ID NO: 31460

SEQ ID NO: 704721 - RNA, 64 nt, Homo Sapiens; identical to SEQ ID NO: 31461

SEQ ID NO: 704722 - RNA, 64 nt, Homo Sapiens; identical to SEQ ID NO: 31462

SEQ ID NO: 704723 - RNA, 64 nt, Homo Sapiens; identical to SEQ ID NO: 31463

SEQ ID NO: 704724 - RNA, 64 nt, Homo Sapiens; identical to SEQ ID NO: 31464

SEQ ID NO: 704725 - RNA, 64 nt, Homo Sapiens; identical to SEQ ID NO: 31465

SEQ ID NO: 704726 - RNA, 64 nt, Homo Sapiens; identical to SEQ ID NO: 31466

SEQ ID NO: 704727 - RNA, 64 nt, Homo Sapiens; identical to SEQ ID NO: 31467

SEQ ID NO: 704728 - RNA, 64 nt, Homo Sapiens; identical to SEQ ID NO: 31468

SEQ ID NO: 704729 - RNA, 64 nt, Homo Sapiens; identical to SEQ ID NO: 31469

SEQ ID NO: 704730 - RNA, 64 nt, Homo Sapiens; identical to SEQ ID NO: 31470

SEQ ID NO: 704731 - RNA, 64 nt, Homo Sapiens; identical to SEQ ID NO: 31471

SEQ ID NO: 704732 - RNA, 64 nt, Homo Sapiens; identical to SEQ ID NO: 31472

SEQ ID NO: 704733 - RNA, 64 nt, Homo Sapiens; identical to SEQ ID NO: 31473

SEQ ID NO: 704734 - RNA, 64 nt, Homo Sapiens; identical to SEQ ID NO: 31474

SEQ ID NO: 704735 - RNA, 64 nt, Homo Sapiens; identical to SEQ ID NO: 31475

SEQ ID NO: 704736 - RNA, 64 nt, Homo Sapiens; identical to SEQ ID NO: 31476

SEQ ID NO: 704737 - RNA, 64 nt, Homo Sapiens; identical to SEQ ID NO: 31477

SEQ ID NO: 704738 - RNA, 64 nt, Homo Sapiens; identical to SEQ ID NO: 31478

SEQ ID NO: 704739 - RNA, 64 nt, Homo Sapiens; identical to SEQ ID NO: 31479

SEQ ID NO: 704740 - RNA, 64 nt, Homo Sapiens; identical to SEQ ID NO: 31480

SEQ ID NO: 704741 - RNA, 64 nt, Homo Sapiens; identical to SEQ ID NO: 31481

SEQ ID NO: 704742 - RNA, 64 nt, Homo Sapiens; identical to SEQ ID NO: 31482

SEQ ID NO: 704743 - RNA, 64 nt, Homo Sapiens; identical to SEQ ID NO: 31483

SEQ ID NO: 704744 - RNA, 64 nt, Homo Sapiens; identical to SEQ ID NO: 31484

SEQ ID NO: 704745 - RNA, 64 nt, Homo Sapiens; identical to SEQ ID NO: 31485

SEQ ID NO: 704746 - RNA, 64 nt, Homo Sapiens; identical to SEQ ID NO: 31486

SEQ ID NO: 704747 - RNA, 64 nt, Homo Sapiens; identical to SEQ ID NO: 31487

SEQ ID NO: 704748 - RNA, 64 nt, Homo Sapiens; identical to SEQ ID NO: 31488

SEQ ID NO: 704749 - RNA, 64 nt, Homo Sapiens; identical to SEQ ID NO: 31489

SEQ ID NO: 704750 - RNA, 64 nt, Homo Sapiens; identical to SEQ ID NO: 31490

SEQ ID NO: 704751 - RNA, 64 nt, Homo Sapiens; identical to SEQ ID NO: 31491

SEQ ID NO: 704752 - RNA, 64 nt, Homo Sapiens; identical to SEQ ID NO: 31492

SEQ ID NO: 704753 - RNA, 64 nt, Homo Sapiens; identical to SEQ ID NO: 31493

SEQ ID NO: 704754 - RNA, 64 nt, Homo Sapiens; identical to SEQ ID NO: 31494

SEQ ID NO: 704755 - RNA, 64 nt, Homo Sapiens; identical to SEQ ID NO: 31495

SEQ ID NO: 704756 - RNA, 64 nt, Homo Sapiens; identical to SEQ ID NO: 31496

SEQ ID NO: 704757 - RNA, 64 nt, Homo Sapiens; identical to SEQ ID NO: 31497

SEQ ID NO: 704758 - RNA, 64 nt, Homo Sapiens; identical to SEQ ID NO: 31498

SEQ ID NO: 704759 - RNA, 64 nt, Homo Sapiens; identical to SEQ ID NO: 31499

SEQ ID NO: 704760 - RNA, 64 nt, Homo Sapiens; identical to SEQ ID NO: 31500

SEQ ID NO: 704761 - RNA, 64 nt, Homo Sapiens; identical to SEQ ID NO: 31501

SEQ ID NO: 704762 - RNA, 64 nt, Homo Sapiens; identical to SEQ ID NO: 31502

SEQ ID NO: 704763 - RNA, 64 nt, Homo Sapiens; identical to SEQ ID NO: 31503

SEQ ID NO: 704764 - RNA, 64 nt, Homo Sapiens; identical to SEQ ID NO: 31504

SEQ ID NO: 704765 - RNA, 64 nt, Homo Sapiens; identical to SEQ ID NO: 31505

SEQ ID NO: 704766 - RNA, 64 nt, Homo Sapiens; identical to SEQ ID NO: 31506

SEQ ID NO: 704767 - RNA, 64 nt, Homo Sapiens; identical to SEQ ID NO: 31507

SEQ ID NO: 704768 - RNA, 64 nt, Homo Sapiens; identical to SEQ ID NO: 31508

SEQ ID NO: 704769 - RNA, 64 nt, Homo Sapiens; identical to SEQ ID NO: 31509

SEQ ID NO: 704770 - RNA, 64 nt, Homo Sapiens; identical to SEQ ID NO: 31510

SEQ ID NO: 704771 - RNA, 64 nt, Homo Sapiens; identical to SEQ ID NO: 31511

SEQ ID NO: 704772 - RNA, 64 nt, Homo Sapiens; identical to SEQ ID NO: 31512

SEQ ID NO: 704773 - RNA, 64 nt, Homo Sapiens; identical to SEQ ID NO: 31513

SEQ ID NO: 704774 - RNA, 64 nt, Homo Sapiens; identical to SEQ ID NO: 31514

SEQ ID NO: 704775 - RNA, 64 nt, Homo Sapiens; identical to SEQ ID NO: 31515

SEQ ID NO: 704776 - RNA, 64 nt, Homo Sapiens; identical to SEQ ID NO: 31516

SEQ ID NO: 704777 - RNA, 64 nt, Homo Sapiens; identical to SEQ ID NO: 31517

SEQ ID NO: 704778 - RNA, 64 nt, Homo Sapiens; identical to SEQ ID NO: 31518

SEQ ID NO: 704779 - RNA, 64 nt, Homo Sapiens; identical to SEQ ID NO: 31519

SEQ ID NO: 704780 - RNA, 64 nt, Homo Sapiens; identical to SEQ ID NO: 31520

SEQ ID NO: 704781 - RNA, 64 nt, Homo Sapiens; identical to SEQ ID NO: 31521

SEQ ID NO: 704782 - RNA, 64 nt, Homo Sapiens; identical to SEQ ID NO: 31522

SEQ ID NO: 704783 - RNA, 64 nt, Homo Sapiens; identical to SEQ ID NO: 31523

SEQ ID NO: 704784 - RNA, 64 nt, Homo Sapiens; identical to SEQ ID NO: 31524

SEQ ID NO: 704785 - RNA, 64 nt, Homo Sapiens; identical to SEQ ID NO: 31525

SEQ ID NO: 704786 - RNA, 64 nt, Homo Sapiens; identical to SEQ ID NO: 31526

SEQ ID NO: 704787 - RNA, 64 nt, Homo Sapiens; identical to SEQ ID NO: 31527

SEQ ID NO: 704788 - RNA, 64 nt, Homo Sapiens; identical to SEQ ID NO: 31528

SEQ ID NO: 704789 - RNA, 64 nt, Homo Sapiens; identical to SEQ ID NO: 31529

SEQ ID NO: 704790 - RNA, 64 nt, Homo Sapiens; identical to SEQ ID NO: 31530

SEQ ID NO: 704791 - RNA, 64 nt, Homo Sapiens; identical to SEQ ID NO: 31531

SEQ ID NO: 704792 - RNA, 64 nt, Homo Sapiens; identical to SEQ ID NO: 31532

SEQ ID NO: 704793 - RNA, 64 nt, Homo Sapiens; identical to SEQ ID NO: 31533

SEQ ID NO: 704794 - RNA, 64 nt, Homo Sapiens; identical to SEQ ID NO: 31534

SEQ ID NO: 704795 - RNA, 64 nt, Homo Sapiens; identical to SEQ ID NO: 31535

SEQ ID NO: 704796 - RNA, 64 nt, Homo Sapiens; identical to SEQ ID NO: 31536

SEQ ID NO: 704797 - RNA, 64 nt, Homo Sapiens; identical to SEQ ID NO: 31537

SEQ ID NO: 704798 - RNA, 64 nt, Homo Sapiens; identical to SEQ ID NO: 31538

SEQ ID NO: 704799 - RNA, 64 nt, Homo Sapiens; identical to SEQ ID NO: 31539

SEQ ID NO: 704800 - RNA, 64 nt, Homo Sapiens; identical to SEQ ID NO: 31540

SEQ ID NO: 704801 - RNA, 64 nt, Homo Sapiens; identical to SEQ ID NO: 31541

SEQ ID NO: 704802 - RNA, 64 nt, Homo Sapiens; identical to SEQ ID NO: 31542

SEQ ID NO: 704803 - RNA, 64 nt, Homo Sapiens; identical to SEQ ID NO: 31543

SEQ ID NO: 704804 - RNA, 64 nt, Homo Sapiens; identical to SEQ ID NO: 31544

SEQ ID NO: 704805 - RNA, 64 nt, Homo Sapiens; identical to SEQ ID NO: 31545

SEQ ID NO: 704806 - RNA, 64 nt, Homo Sapiens; identical to SEQ ID NO: 31546

SEQ ID NO: 704807 - RNA, 64 nt, Homo Sapiens; identical to SEQ ID NO: 31547

SEQ ID NO: 704808 - RNA, 64 nt, Homo Sapiens; identical to SEQ ID NO: 31548

SEQ ID NO: 704809 - RNA, 64 nt, Homo Sapiens; identical to SEQ ID NO: 31549

SEQ ID NO: 704810 - RNA, 64 nt, Homo Sapiens; identical to SEQ ID NO: 31550

SEQ ID NO: 704811 - RNA, 64 nt, Homo Sapiens; identical to SEQ ID NO: 31551

SEQ ID NO: 704812 - RNA, 64 nt, Homo Sapiens; identical to SEQ ID NO: 31552

SEQ ID NO: 704813 - RNA, 64 nt, Homo Sapiens; identical to SEQ ID NO: 31553

SEQ ID NO: 704814 - RNA, 64 nt, Homo Sapiens; identical to SEQ ID NO: 31554

SEQ ID NO: 704815 - RNA, 64 nt, Homo Sapiens; identical to SEQ ID NO: 31555

SEQ ID NO: 704816 - RNA, 64 nt, Homo Sapiens; identical to SEQ ID NO: 31556

SEQ ID NO: 704817 - RNA, 50 nt, Homo Sapiens; identical to SEQ ID NO: 31557

SEQ ID NO: 704818 - RNA, 51 nt, Homo Sapiens; identical to SEQ ID NO: 31558

SEQ ID NO: 704819 - RNA, 64 nt, Homo Sapiens; identical to SEQ ID NO: 31559

SEQ ID NO: 704820 - RNA, 64 nt, Homo Sapiens; identical to SEQ ID NO: 31560

SEQ ID NO: 704821 - RNA, 64 nt, Homo Sapiens; identical to SEQ ID NO: 31561

SEQ ID NO: 704822 - RNA, 64 nt, Homo Sapiens; identical to SEQ ID NO: 31562

SEQ ID NO: 704823 - RNA, 64 nt, Homo Sapiens; identical to SEQ ID NO: 31563

SEQ ID NO: 704824 - RNA, 64 nt, Homo Sapiens; identical to SEQ ID NO: 31564

SEQ ID NO: 704825 - RNA, 64 nt, Homo Sapiens; identical to SEQ ID NO: 31565

SEQ ID NO: 704826 - RNA, 64 nt, Homo Sapiens; identical to SEQ ID NO: 31566

SEQ ID NO: 704827 - RNA, 64 nt, Homo Sapiens; identical to SEQ ID NO: 31567

SEQ ID NO: 704828 - RNA, 64 nt, Homo Sapiens; identical to SEQ ID NO: 31568

SEQ ID NO: 704829 - RNA, 64 nt, Homo Sapiens; identical to SEQ ID NO: 31569

SEQ ID NO: 704830 - RNA, 64 nt, Homo Sapiens; identical to SEQ ID NO: 31570

SEQ ID NO: 704831 - RNA, 64 nt, Homo Sapiens; identical to SEQ ID NO: 31571

SEQ ID NO: 704832 - RNA, 64 nt, Homo Sapiens; identical to SEQ ID NO: 31572

SEQ ID NO: 704833 - RNA, 64 nt, Homo Sapiens; identical to SEQ ID NO: 31573

SEQ ID NO: 704834 - RNA, 64 nt, Homo Sapiens; identical to SEQ ID NO: 31574

SEQ ID NO: 704835 - RNA, 64 nt, Homo Sapiens; identical to SEQ ID NO: 31575

SEQ ID NO: 704836 - RNA, 64 nt, Homo Sapiens; identical to SEQ ID NO: 31576

SEQ ID NO: 704837 - RNA, 64 nt, Homo Sapiens; identical to SEQ ID NO: 31577

SEQ ID NO: 704838 - RNA, 64 nt, Homo Sapiens; identical to SEQ ID NO: 31578

SEQ ID NO: 704839 - RNA, 64 nt, Homo Sapiens; identical to SEQ ID NO: 31579

SEQ ID NO: 704840 - RNA, 64 nt, Homo Sapiens; identical to SEQ ID NO: 31580

SEQ ID NO: 704841 - RNA, 64 nt, Homo Sapiens; identical to SEQ ID NO: 31581

SEQ ID NO: 704842 - RNA, 64 nt, Homo Sapiens; identical to SEQ ID NO: 31582

SEQ ID NO: 704843 - RNA, 64 nt, Homo Sapiens; identical to SEQ ID NO: 31583

SEQ ID NO: 704844 - RNA, 64 nt, Homo Sapiens; identical to SEQ ID NO: 31584

SEQ ID NO: 704845 - RNA, 64 nt, Homo Sapiens; identical to SEQ ID NO: 31585

SEQ ID NO: 704846 - RNA, 64 nt, Homo Sapiens; identical to SEQ ID NO: 31586

SEQ ID NO: 704847 - RNA, 64 nt, Homo Sapiens; identical to SEQ ID NO: 31587

SEQ ID NO: 704848 - RNA, 64 nt, Homo Sapiens; identical to SEQ ID NO: 31588

SEQ ID NO: 704849 - RNA, 64 nt, Homo Sapiens; identical to SEQ ID NO: 31589

SEQ ID NO: 704850 - RNA, 64 nt, Homo Sapiens; identical to SEQ ID NO: 31590

SEQ ID NO: 704851 - RNA, 64 nt, Homo Sapiens; identical to SEQ ID NO: 31591

SEQ ID NO: 704852 - RNA, 64 nt, Homo Sapiens; identical to SEQ ID NO: 31592

SEQ ID NO: 704853 - RNA, 64 nt, Homo Sapiens; identical to SEQ ID NO: 31593

SEQ ID NO: 704854 - RNA, 64 nt, Homo Sapiens; identical to SEQ ID NO: 31594

SEQ ID NO: 704855 - RNA, 64 nt, Homo Sapiens; identical to SEQ ID NO: 31595

SEQ ID NO: 704856 - RNA, 64 nt, Homo Sapiens; identical to SEQ ID NO: 31596

SEQ ID NO: 704857 - RNA, 64 nt, Homo Sapiens; identical to SEQ ID NO: 31597

SEQ ID NO: 704858 - RNA, 64 nt, Homo Sapiens; identical to SEQ ID NO: 31598

SEQ ID NO: 704859 - RNA, 64 nt, Homo Sapiens; identical to SEQ ID NO: 31599

SEQ ID NO: 704860 - RNA, 64 nt, Homo Sapiens; identical to SEQ ID NO: 31600

SEQ ID NO: 704861 - RNA, 64 nt, Homo Sapiens; identical to SEQ ID NO: 31601

SEQ ID NO: 704862 - RNA, 64 nt, Homo Sapiens; identical to SEQ ID NO: 31602

SEQ ID NO: 704863 - RNA, 64 nt, Homo Sapiens; identical to SEQ ID NO: 31603

SEQ ID NO: 704864 - RNA, 64 nt, Homo Sapiens; identical to SEQ ID NO: 31604

SEQ ID NO: 704865 - RNA, 64 nt, Homo Sapiens; identical to SEQ ID NO: 31605

SEQ ID NO: 704866 - RNA, 64 nt, Homo Sapiens; identical to SEQ ID NO: 31606

SEQ ID NO: 704867 - RNA, 64 nt, Homo Sapiens; identical to SEQ ID NO: 31607

SEQ ID NO: 704868 - RNA, 64 nt, Homo Sapiens; identical to SEQ ID NO: 31608

SEQ ID NO: 704869 - RNA, 64 nt, Homo Sapiens; identical to SEQ ID NO: 31609

SEQ ID NO: 704870 - RNA, 64 nt, Homo Sapiens; identical to SEQ ID NO: 31610

SEQ ID NO: 704871 - RNA, 64 nt, Homo Sapiens; identical to SEQ ID NO: 31611

SEQ ID NO: 704872 - RNA, 64 nt, Homo Sapiens; identical to SEQ ID NO: 31612

SEQ ID NO: 704873 - RNA, 64 nt, Homo Sapiens; identical to SEQ ID NO: 31613

SEQ ID NO: 704874 - RNA, 64 nt, Homo Sapiens; identical to SEQ ID NO: 31614

SEQ ID NO: 704875 - RNA, 64 nt, Homo Sapiens; identical to SEQ ID NO: 31615

SEQ ID NO: 704876 - RNA, 64 nt, Homo Sapiens; identical to SEQ ID NO: 31616

SEQ ID NO: 704877 - RNA, 64 nt, Homo Sapiens; identical to SEQ ID NO: 31617

SEQ ID NO: 704878 - RNA, 64 nt, Homo Sapiens; identical to SEQ ID NO: 31618

SEQ ID NO: 704879 - RNA, 64 nt, Homo Sapiens; identical to SEQ ID NO: 31619

SEQ ID NO: 704880 - RNA, 64 nt, Homo Sapiens; identical to SEQ ID NO: 31620

SEQ ID NO: 704881 - RNA, 64 nt, Homo Sapiens; identical to SEQ ID NO: 31621

SEQ ID NO: 704882 - RNA, 55 nt, Homo Sapiens; identical to SEQ ID NO: 31622

SEQ ID NO: 704883 - RNA, 54 nt, Homo Sapiens; identical to SEQ ID NO: 31623

SEQ ID NO: 704884 - RNA, 64 nt, Homo Sapiens; identical to SEQ ID NO: 31624

SEQ ID NO: 704885 - RNA, 64 nt, Homo Sapiens; identical to SEQ ID NO: 31625

SEQ ID NO: 704886 - RNA, 64 nt, Homo Sapiens; identical to SEQ ID NO: 31626

SEQ ID NO: 704887 - RNA, 64 nt, Homo Sapiens; identical to SEQ ID NO: 31627

SEQ ID NO: 704888 - RNA, 64 nt, Homo Sapiens; identical to SEQ ID NO: 31628

SEQ ID NO: 704889 - RNA, 64 nt, Homo Sapiens; identical to SEQ ID NO: 31629

SEQ ID NO: 704890 - RNA, 64 nt, Homo Sapiens; identical to SEQ ID NO: 31630

SEQ ID NO: 704891 - RNA, 64 nt, Homo Sapiens; identical to SEQ ID NO: 31631

SEQ ID NO: 704892 - RNA, 64 nt, Homo Sapiens; identical to SEQ ID NO: 31632

SEQ ID NO: 704893 - RNA, 64 nt, Homo Sapiens; identical to SEQ ID NO: 31633

SEQ ID NO: 704894 - RNA, 64 nt, Homo Sapiens; identical to SEQ ID NO: 31634

SEQ ID NO: 704895 - RNA, 64 nt, Homo Sapiens; identical to SEQ ID NO: 31635

SEQ ID NO: 704896 - RNA, 64 nt, Homo Sapiens; identical to SEQ ID NO: 31636

SEQ ID NO: 704897 - RNA, 64 nt, Homo Sapiens; identical to SEQ ID NO: 31637

SEQ ID NO: 704898 - RNA, 64 nt, Homo Sapiens; identical to SEQ ID NO: 31638

SEQ ID NO: 704899 - RNA, 64 nt, Homo Sapiens; identical to SEQ ID NO: 31639

SEQ ID NO: 704900 - RNA, 64 nt, Homo Sapiens; identical to SEQ ID NO: 31640

SEQ ID NO: 704901 - RNA, 64 nt, Homo Sapiens; identical to SEQ ID NO: 31641

SEQ ID NO: 704902 - RNA, 64 nt, Homo Sapiens; identical to SEQ ID NO: 31642

SEQ ID NO: 704903 - RNA, 64 nt, Homo Sapiens; identical to SEQ ID NO: 31643

SEQ ID NO: 704904 - RNA, 64 nt, Homo Sapiens; identical to SEQ ID NO: 31644

SEQ ID NO: 704905 - RNA, 64 nt, Homo Sapiens; identical to SEQ ID NO: 31645

SEQ ID NO: 704906 - RNA, 64 nt, Homo Sapiens; identical to SEQ ID NO: 31646

SEQ ID NO: 704907 - RNA, 64 nt, Homo Sapiens; identical to SEQ ID NO: 31647

SEQ ID NO: 704908 - RNA, 64 nt, Homo Sapiens; identical to SEQ ID NO: 31648

SEQ ID NO: 704909 - RNA, 64 nt, Homo Sapiens; identical to SEQ ID NO: 31649

SEQ ID NO: 704910 - RNA, 64 nt, Homo Sapiens; identical to SEQ ID NO: 31650

SEQ ID NO: 704911 - RNA, 64 nt, Homo Sapiens; identical to SEQ ID NO: 31651

SEQ ID NO: 704912 - RNA, 64 nt, Homo Sapiens; identical to SEQ ID NO: 31652

SEQ ID NO: 704913 - RNA, 64 nt, Homo Sapiens; identical to SEQ ID NO: 31653

SEQ ID NO: 704914 - RNA, 64 nt, Homo Sapiens; identical to SEQ ID NO: 31654

SEQ ID NO: 704915 - RNA, 64 nt, Homo Sapiens; identical to SEQ ID NO: 31655

SEQ ID NO: 704916 - RNA, 64 nt, Homo Sapiens; identical to SEQ ID NO: 31656

SEQ ID NO: 704917 - RNA, 64 nt, Homo Sapiens; identical to SEQ ID NO: 31657

SEQ ID NO: 704918 - RNA, 64 nt, Homo Sapiens; identical to SEQ ID NO: 31658

SEQ ID NO: 704919 - RNA, 64 nt, Homo Sapiens; identical to SEQ ID NO: 31659

SEQ ID NO: 704920 - RNA, 64 nt, Homo Sapiens; identical to SEQ ID NO: 31660

SEQ ID NO: 704921 - RNA, 64 nt, Homo Sapiens; identical to SEQ ID NO: 31661

SEQ ID NO: 704922 - RNA, 64 nt, Homo Sapiens; identical to SEQ ID NO: 31662

SEQ ID NO: 704923 - RNA, 64 nt, Homo Sapiens; identical to SEQ ID NO: 31663

SEQ ID NO: 704924 - RNA, 64 nt, Homo Sapiens; identical to SEQ ID NO: 31664

SEQ ID NO: 704925 - RNA, 64 nt, Homo Sapiens; identical to SEQ ID NO: 31665

SEQ ID NO: 704926 - RNA, 64 nt, Homo Sapiens; identical to SEQ ID NO: 31666

SEQ ID NO: 704927 - RNA, 64 nt, Homo Sapiens; identical to SEQ ID NO: 31667

SEQ ID NO: 704928 - RNA, 64 nt, Homo Sapiens; identical to SEQ ID NO: 31668

SEQ ID NO: 704929 - RNA, 64 nt, Homo Sapiens; identical to SEQ ID NO: 31669

SEQ ID NO: 704930 - RNA, 64 nt, Homo Sapiens; identical to SEQ ID NO: 31670

SEQ ID NO: 704931 - RNA, 64 nt, Homo Sapiens; identical to SEQ ID NO: 31671

SEQ ID NO: 704932 - RNA, 64 nt, Homo Sapiens; identical to SEQ ID NO: 31672

SEQ ID NO: 704933 - RNA, 64 nt, Homo Sapiens; identical to SEQ ID NO: 31673

SEQ ID NO: 704934 - RNA, 60 nt, Homo Sapiens; identical to SEQ ID NO: 31674

SEQ ID NO: 704935 - RNA, 64 nt, Homo Sapiens; identical to SEQ ID NO: 31675

SEQ ID NO: 704936 - RNA, 64 nt, Homo Sapiens; identical to SEQ ID NO: 31676

SEQ ID NO: 704937 - RNA, 64 nt, Homo Sapiens; identical to SEQ ID NO: 31677

SEQ ID NO: 704938 - RNA, 64 nt, Homo Sapiens; identical to SEQ ID NO: 31678

SEQ ID NO: 704939 - RNA, 64 nt, Homo Sapiens; identical to SEQ ID NO: 31679

SEQ ID NO: 704940 - RNA, 64 nt, Homo Sapiens; identical to SEQ ID NO: 31680

SEQ ID NO: 704941 - RNA, 64 nt, Homo Sapiens; identical to SEQ ID NO: 31681

SEQ ID NO: 704942 - RNA, 64 nt, Homo Sapiens; identical to SEQ ID NO: 31682

SEQ ID NO: 704943 - RNA, 64 nt, Homo Sapiens; identical to SEQ ID NO: 31683

SEQ ID NO: 704944 - RNA, 64 nt, Homo Sapiens; identical to SEQ ID NO: 31684

SEQ ID NO: 704945 - RNA, 64 nt, Homo Sapiens; identical to SEQ ID NO: 31685

SEQ ID NO: 704946 - RNA, 64 nt, Homo Sapiens; identical to SEQ ID NO: 31686

SEQ ID NO: 704947 - RNA, 64 nt, Homo Sapiens; identical to SEQ ID NO: 31687

SEQ ID NO: 704948 - RNA, 64 nt, Homo Sapiens; identical to SEQ ID NO: 31688

SEQ ID NO: 704949 - RNA, 64 nt, Homo Sapiens; identical to SEQ ID NO: 31689

SEQ ID NO: 704950 - RNA, 64 nt, Homo Sapiens; identical to SEQ ID NO: 31690

SEQ ID NO: 704951 - RNA, 64 nt, Homo Sapiens; identical to SEQ ID NO: 31691

SEQ ID NO: 704952 - RNA, 64 nt, Homo Sapiens; identical to SEQ ID NO: 31692

SEQ ID NO: 704953 - RNA, 64 nt, Homo Sapiens; identical to SEQ ID NO: 31693

SEQ ID NO: 704954 - RNA, 64 nt, Homo Sapiens; identical to SEQ ID NO: 31694

SEQ ID NO: 704955 - RNA, 64 nt, Homo Sapiens; identical to SEQ ID NO: 31695

SEQ ID NO: 704956 - RNA, 64 nt, Homo Sapiens; identical to SEQ ID NO: 31696

SEQ ID NO: 704957 - RNA, 64 nt, Homo Sapiens; identical to SEQ ID NO: 31697

SEQ ID NO: 704958 - RNA, 64 nt, Homo Sapiens; identical to SEQ ID NO: 31698

SEQ ID NO: 704959 - RNA, 64 nt, Homo Sapiens; identical to SEQ ID NO: 31699

SEQ ID NO: 704960 - RNA, 64 nt, Homo Sapiens; identical to SEQ ID NO: 31700

SEQ ID NO: 704961 - RNA, 64 nt, Homo Sapiens; identical to SEQ ID NO: 31701

SEQ ID NO: 704962 - RNA, 64 nt, Homo Sapiens; identical to SEQ ID NO: 31702

SEQ ID NO: 704963 - RNA, 64 nt, Homo Sapiens; identical to SEQ ID NO: 31703

SEQ ID NO: 704964 - RNA, 64 nt, Homo Sapiens; identical to SEQ ID NO: 31704

SEQ ID NO: 704965 - RNA, 64 nt, Homo Sapiens; identical to SEQ ID NO: 31705

SEQ ID NO: 704966 - RNA, 64 nt, Homo Sapiens; identical to SEQ ID NO: 31706

SEQ ID NO: 704967 - RNA, 64 nt, Homo Sapiens; identical to SEQ ID NO: 31707

SEQ ID NO: 704968 - RNA, 64 nt, Homo Sapiens; identical to SEQ ID NO: 31708

SEQ ID NO: 704969 - RNA, 64 nt, Homo Sapiens; identical to SEQ ID NO: 31709

SEQ ID NO: 704970 - RNA, 64 nt, Homo Sapiens; identical to SEQ ID NO: 31710

SEQ ID NO: 704971 - RNA, 64 nt, Homo Sapiens; identical to SEQ ID NO: 31711

SEQ ID NO: 704972 - RNA, 64 nt, Homo Sapiens; identical to SEQ ID NO: 31712

SEQ ID NO: 704973 - RNA, 64 nt, Homo Sapiens; identical to SEQ ID NO: 31713

SEQ ID NO: 704974 - RNA, 64 nt, Homo Sapiens; identical to SEQ ID NO: 31714

SEQ ID NO: 704975 - RNA, 64 nt, Homo Sapiens; identical to SEQ ID NO: 31715

SEQ ID NO: 704976 - RNA, 64 nt, Homo Sapiens; identical to SEQ ID NO: 31716

SEQ ID NO: 704977 - RNA, 64 nt, Homo Sapiens; identical to SEQ ID NO: 31717

SEQ ID NO: 704978 - RNA, 64 nt, Homo Sapiens; identical to SEQ ID NO: 31718

SEQ ID NO: 704979 - RNA, 64 nt, Homo Sapiens; identical to SEQ ID NO: 31719

SEQ ID NO: 704980 - RNA, 64 nt, Homo Sapiens; identical to SEQ ID NO: 31720

SEQ ID NO: 704981 - RNA, 64 nt, Homo Sapiens; identical to SEQ ID NO: 31721

SEQ ID NO: 704982 - RNA, 64 nt, Homo Sapiens; identical to SEQ ID NO: 31722

SEQ ID NO: 704983 - RNA, 64 nt, Homo Sapiens; identical to SEQ ID NO: 31723

SEQ ID NO: 704984 - RNA, 64 nt, Homo Sapiens; identical to SEQ ID NO: 31724

SEQ ID NO: 704985 - RNA, 64 nt, Homo Sapiens; identical to SEQ ID NO: 31725

SEQ ID NO: 704986 - RNA, 64 nt, Homo Sapiens; identical to SEQ ID NO: 31726

SEQ ID NO: 704987 - RNA, 64 nt, Homo Sapiens; identical to SEQ ID NO: 31727

SEQ ID NO: 704988 - RNA, 64 nt, Homo Sapiens; identical to SEQ ID NO: 31728

SEQ ID NO: 704989 - RNA, 64 nt, Homo Sapiens; identical to SEQ ID NO: 31729

SEQ ID NO: 704990 - RNA, 64 nt, Homo Sapiens; identical to SEQ ID NO: 31730

SEQ ID NO: 704991 - RNA, 64 nt, Homo Sapiens; identical to SEQ ID NO: 31731

SEQ ID NO: 704992 - RNA, 64 nt, Homo Sapiens; identical to SEQ ID NO: 31732

SEQ ID NO: 704993 - RNA, 64 nt, Homo Sapiens; identical to SEQ ID NO: 31733

SEQ ID NO: 704994 - RNA, 64 nt, Homo Sapiens; identical to SEQ ID NO: 31734

SEQ ID NO: 704995 - RNA, 64 nt, Homo Sapiens; identical to SEQ ID NO: 31735

SEQ ID NO: 704996 - RNA, 64 nt, Homo Sapiens; identical to SEQ ID NO: 31736

SEQ ID NO: 704997 - RNA, 64 nt, Homo Sapiens; identical to SEQ ID NO: 31737

SEQ ID NO: 704998 - RNA, 64 nt, Homo Sapiens; identical to SEQ ID NO: 31738

SEQ ID NO: 704999 - RNA, 64 nt, Homo Sapiens; identical to SEQ ID NO: 31739

SEQ ID NO: 705000 - RNA, 64 nt, Homo Sapiens; identical to SEQ ID NO: 31740

SEQ ID NO: 705001 - RNA, 64 nt, Homo Sapiens; identical to SEQ ID NO: 31741

SEQ ID NO: 705002 - RNA, 64 nt, Homo Sapiens; identical to SEQ ID NO: 31742

SEQ ID NO: 705003 - RNA, 64 nt, Homo Sapiens; identical to SEQ ID NO: 31743

SEQ ID NO: 705004 - RNA, 64 nt, Homo Sapiens; identical to SEQ ID NO: 31744

SEQ ID NO: 705005 - RNA, 64 nt, Homo Sapiens; identical to SEQ ID NO: 31745

SEQ ID NO: 705006 - RNA, 64 nt, Homo Sapiens; identical to SEQ ID NO: 31746

SEQ ID NO: 705007 - RNA, 64 nt, Homo Sapiens; identical to SEQ ID NO: 31747

SEQ ID NO: 705008 - RNA, 64 nt, Homo Sapiens; identical to SEQ ID NO: 31748

SEQ ID NO: 705009 - RNA, 64 nt, Homo Sapiens; identical to SEQ ID NO: 31749

SEQ ID NO: 705010 - RNA, 64 nt, Homo Sapiens; identical to SEQ ID NO: 31750

SEQ ID NO: 705011 - RNA, 64 nt, Homo Sapiens; identical to SEQ ID NO: 31751

SEQ ID NO: 705012 - RNA, 64 nt, Homo Sapiens; identical to SEQ ID NO: 31752

SEQ ID NO: 705013 - RNA, 64 nt, Homo Sapiens; identical to SEQ ID NO: 31753

SEQ ID NO: 705014 - RNA, 64 nt, Homo Sapiens; identical to SEQ ID NO: 31754

SEQ ID NO: 705015 - RNA, 64 nt, Homo Sapiens; identical to SEQ ID NO: 31755

SEQ ID NO: 705016 - RNA, 64 nt, Homo Sapiens; identical to SEQ ID NO: 31756

SEQ ID NO: 705017 - RNA, 64 nt, Homo Sapiens; identical to SEQ ID NO: 31757

SEQ ID NO: 705018 - RNA, 64 nt, Homo Sapiens; identical to SEQ ID NO: 31758

SEQ ID NO: 705019 - RNA, 64 nt, Homo Sapiens; identical to SEQ ID NO: 31759

SEQ ID NO: 705020 - RNA, 64 nt, Homo Sapiens; identical to SEQ ID NO: 31760

SEQ ID NO: 705021 - RNA, 64 nt, Homo Sapiens; identical to SEQ ID NO: 31761

SEQ ID NO: 705022 - RNA, 64 nt, Homo Sapiens; identical to SEQ ID NO: 31762

SEQ ID NO: 705023 - RNA, 64 nt, Homo Sapiens; identical to SEQ ID NO: 31763

SEQ ID NO: 705024 - RNA, 64 nt, Homo Sapiens; identical to SEQ ID NO: 31764

SEQ ID NO: 705025 - RNA, 64 nt, Homo Sapiens; identical to SEQ ID NO: 31765

SEQ ID NO: 705026 - RNA, 64 nt, Homo Sapiens; identical to SEQ ID NO: 31766

SEQ ID NO: 705027 - RNA, 64 nt, Homo Sapiens; identical to SEQ ID NO: 31767

SEQ ID NO: 705028 - RNA, 64 nt, Homo Sapiens; identical to SEQ ID NO: 31768

SEQ ID NO: 705029 - RNA, 64 nt, Homo Sapiens; identical to SEQ ID NO: 31769

SEQ ID NO: 705030 - RNA, 64 nt, Homo Sapiens; identical to SEQ ID NO: 31770

SEQ ID NO: 705031 - RNA, 64 nt, Homo Sapiens; identical to SEQ ID NO: 31771

SEQ ID NO: 705032 - RNA, 64 nt, Homo Sapiens; identical to SEQ ID NO: 31772

SEQ ID NO: 705033 - RNA, 64 nt, Homo Sapiens; identical to SEQ ID NO: 31773

SEQ ID NO: 705034 - RNA, 64 nt, Homo Sapiens; identical to SEQ ID NO: 31774

SEQ ID NO: 705035 - RNA, 64 nt, Homo Sapiens; identical to SEQ ID NO: 31775

SEQ ID NO: 705036 - RNA, 64 nt, Homo Sapiens; identical to SEQ ID NO: 31776

SEQ ID NO: 705037 - RNA, 64 nt, Homo Sapiens; identical to SEQ ID NO: 31777

SEQ ID NO: 705038 - RNA, 64 nt, Homo Sapiens; identical to SEQ ID NO: 31778

SEQ ID NO: 705039 - RNA, 64 nt, Homo Sapiens; identical to SEQ ID NO: 31779

SEQ ID NO: 705040 - RNA, 64 nt, Homo Sapiens; identical to SEQ ID NO: 31780

SEQ ID NO: 705041 - RNA, 64 nt, Homo Sapiens; identical to SEQ ID NO: 31781

SEQ ID NO: 705042 - RNA, 64 nt, Homo Sapiens; identical to SEQ ID NO: 31782

SEQ ID NO: 705043 - RNA, 64 nt, Homo Sapiens; identical to SEQ ID NO: 31783

SEQ ID NO: 705044 - RNA, 64 nt, Homo Sapiens; identical to SEQ ID NO: 31784

SEQ ID NO: 705045 - RNA, 64 nt, Homo Sapiens; identical to SEQ ID NO: 31785

SEQ ID NO: 705046 - RNA, 64 nt, Homo Sapiens; identical to SEQ ID NO: 31786

SEQ ID NO: 705047 - RNA, 64 nt, Homo Sapiens; identical to SEQ ID NO: 31787

SEQ ID NO: 705048 - RNA, 64 nt, Homo Sapiens; identical to SEQ ID NO: 31788

SEQ ID NO: 705049 - RNA, 64 nt, Homo Sapiens; identical to SEQ ID NO: 31789

SEQ ID NO: 705050 - RNA, 64 nt, Homo Sapiens; identical to SEQ ID NO: 31790

SEQ ID NO: 705051 - RNA, 64 nt, Homo Sapiens; identical to SEQ ID NO: 31791

SEQ ID NO: 705052 - RNA, 64 nt, Homo Sapiens; identical to SEQ ID NO: 31792

SEQ ID NO: 705053 - RNA, 64 nt, Homo Sapiens; identical to SEQ ID NO: 31793

SEQ ID NO: 705054 - RNA, 64 nt, Homo Sapiens; identical to SEQ ID NO: 31794

SEQ ID NO: 705055 - RNA, 64 nt, Homo Sapiens; identical to SEQ ID NO: 31795

SEQ ID NO: 705056 - RNA, 64 nt, Homo Sapiens; identical to SEQ ID NO: 31796

SEQ ID NO: 705057 - RNA, 64 nt, Homo Sapiens; identical to SEQ ID NO: 31797

SEQ ID NO: 705058 - RNA, 64 nt, Homo Sapiens; identical to SEQ ID NO: 31798

SEQ ID NO: 705059 - RNA, 64 nt, Homo Sapiens; identical to SEQ ID NO: 31799

SEQ ID NO: 705060 - RNA, 64 nt, Homo Sapiens; identical to SEQ ID NO: 31800

SEQ ID NO: 705061 - RNA, 64 nt, Homo Sapiens; identical to SEQ ID NO: 31801

SEQ ID NO: 705062 - RNA, 64 nt, Homo Sapiens; identical to SEQ ID NO: 31802

SEQ ID NO: 705063 - RNA, 64 nt, Homo Sapiens; identical to SEQ ID NO: 31803

SEQ ID NO: 705064 - RNA, 64 nt, Homo Sapiens; identical to SEQ ID NO: 31804

SEQ ID NO: 705065 - RNA, 64 nt, Homo Sapiens; identical to SEQ ID NO: 31805

SEQ ID NO: 705066 - RNA, 64 nt, Homo Sapiens; identical to SEQ ID NO: 31806

SEQ ID NO: 705067 - RNA, 64 nt, Homo Sapiens; identical to SEQ ID NO: 31807

SEQ ID NO: 705068 - RNA, 64 nt, Homo Sapiens; identical to SEQ ID NO: 31808

SEQ ID NO: 705069 - RNA, 64 nt, Homo Sapiens; identical to SEQ ID NO: 31809

SEQ ID NO: 705070 - RNA, 64 nt, Homo Sapiens; identical to SEQ ID NO: 31810

SEQ ID NO: 705071 - RNA, 64 nt, Homo Sapiens; identical to SEQ ID NO: 31811

SEQ ID NO: 705072 - RNA, 64 nt, Homo Sapiens; identical to SEQ ID NO: 31812

SEQ ID NO: 705073 - RNA, 64 nt, Homo Sapiens; identical to SEQ ID NO: 31813

SEQ ID NO: 705074 - RNA, 64 nt, Homo Sapiens; identical to SEQ ID NO: 31814

SEQ ID NO: 705075 - RNA, 64 nt, Homo Sapiens; identical to SEQ ID NO: 31815

SEQ ID NO: 705076 - RNA, 64 nt, Homo Sapiens; identical to SEQ ID NO: 31816

SEQ ID NO: 705077 - RNA, 64 nt, Homo Sapiens; identical to SEQ ID NO: 31817

SEQ ID NO: 705078 - RNA, 64 nt, Homo Sapiens; identical to SEQ ID NO: 31818

SEQ ID NO: 705079 - RNA, 64 nt, Homo Sapiens; identical to SEQ ID NO: 31819

SEQ ID NO: 705080 - RNA, 64 nt, Homo Sapiens; identical to SEQ ID NO: 31820

SEQ ID NO: 705081 - RNA, 64 nt, Homo Sapiens; identical to SEQ ID NO: 31821

SEQ ID NO: 705082 - RNA, 64 nt, Homo Sapiens; identical to SEQ ID NO: 31822

SEQ ID NO: 705083 - RNA, 64 nt, Homo Sapiens; identical to SEQ ID NO: 31823

SEQ ID NO: 705084 - RNA, 64 nt, Homo Sapiens; identical to SEQ ID NO: 31824

SEQ ID NO: 705085 - RNA, 64 nt, Homo Sapiens; identical to SEQ ID NO: 31825

SEQ ID NO: 705086 - RNA, 64 nt, Homo Sapiens; identical to SEQ ID NO: 31826

SEQ ID NO: 705087 - RNA, 64 nt, Homo Sapiens; identical to SEQ ID NO: 31827

SEQ ID NO: 705088 - RNA, 64 nt, Homo Sapiens; identical to SEQ ID NO: 31828

SEQ ID NO: 705089 - RNA, 64 nt, Homo Sapiens; identical to SEQ ID NO: 31829

SEQ ID NO: 705090 - RNA, 64 nt, Homo Sapiens; identical to SEQ ID NO: 31830

SEQ ID NO: 705091 - RNA, 64 nt, Homo Sapiens; identical to SEQ ID NO: 31831

SEQ ID NO: 705092 - RNA, 64 nt, Homo Sapiens; identical to SEQ ID NO: 31832

SEQ ID NO: 705093 - RNA, 64 nt, Homo Sapiens; identical to SEQ ID NO: 31833

SEQ ID NO: 705094 - RNA, 64 nt, Homo Sapiens; identical to SEQ ID NO: 31834

SEQ ID NO: 705095 - RNA, 64 nt, Homo Sapiens; identical to SEQ ID NO: 31835

SEQ ID NO: 705096 - RNA, 64 nt, Homo Sapiens; identical to SEQ ID NO: 31836

SEQ ID NO: 705097 - RNA, 64 nt, Homo Sapiens; identical to SEQ ID NO: 31837

SEQ ID NO: 705098 - RNA, 64 nt, Homo Sapiens; identical to SEQ ID NO: 31838

SEQ ID NO: 705099 - RNA, 64 nt, Homo Sapiens; identical to SEQ ID NO: 31839

SEQ ID NO: 705100 - RNA, 64 nt, Homo Sapiens; identical to SEQ ID NO: 31840

SEQ ID NO: 705101 - RNA, 64 nt, Homo Sapiens; identical to SEQ ID NO: 31841

SEQ ID NO: 705102 - RNA, 64 nt, Homo Sapiens; identical to SEQ ID NO: 31842

SEQ ID NO: 705103 - RNA, 64 nt, Homo Sapiens; identical to SEQ ID NO: 31843

SEQ ID NO: 705104 - RNA, 64 nt, Homo Sapiens; identical to SEQ ID NO: 31844

SEQ ID NO: 705105 - RNA, 64 nt, Homo Sapiens; identical to SEQ ID NO: 31845

SEQ ID NO: 705106 - RNA, 64 nt, Homo Sapiens; identical to SEQ ID NO: 31846

SEQ ID NO: 705107 - RNA, 64 nt, Homo Sapiens; identical to SEQ ID NO: 31847

SEQ ID NO: 705108 - RNA, 64 nt, Homo Sapiens; identical to SEQ ID NO: 31848

SEQ ID NO: 705109 - RNA, 64 nt, Homo Sapiens; identical to SEQ ID NO: 31849

SEQ ID NO: 705110 - RNA, 64 nt, Homo Sapiens; identical to SEQ ID NO: 31850

SEQ ID NO: 705111 - RNA, 64 nt, Homo Sapiens; identical to SEQ ID NO: 31851

SEQ ID NO: 705112 - RNA, 64 nt, Homo Sapiens; identical to SEQ ID NO: 31852

SEQ ID NO: 705113 - RNA, 64 nt, Homo Sapiens; identical to SEQ ID NO: 31853

SEQ ID NO: 705114 - RNA, 64 nt, Homo Sapiens; identical to SEQ ID NO: 31854

SEQ ID NO: 705115 - RNA, 64 nt, Homo Sapiens; identical to SEQ ID NO: 31855

SEQ ID NO: 705116 - RNA, 64 nt, Homo Sapiens; identical to SEQ ID NO: 31856

SEQ ID NO: 705117 - RNA, 64 nt, Homo Sapiens; identical to SEQ ID NO: 31857

SEQ ID NO: 705118 - RNA, 64 nt, Homo Sapiens; identical to SEQ ID NO: 31858

SEQ ID NO: 705119 - RNA, 64 nt, Homo Sapiens; identical to SEQ ID NO: 31859

SEQ ID NO: 705120 - RNA, 64 nt, Homo Sapiens; identical to SEQ ID NO: 31860

SEQ ID NO: 705121 - RNA, 64 nt, Homo Sapiens; identical to SEQ ID NO: 31861

SEQ ID NO: 705122 - RNA, 64 nt, Homo Sapiens; identical to SEQ ID NO: 31862

SEQ ID NO: 705123 - RNA, 64 nt, Homo Sapiens; identical to SEQ ID NO: 31863

SEQ ID NO: 705124 - RNA, 64 nt, Homo Sapiens; identical to SEQ ID NO: 31864

SEQ ID NO: 705125 - RNA, 64 nt, Homo Sapiens; identical to SEQ ID NO: 31865

SEQ ID NO: 705126 - RNA, 64 nt, Homo Sapiens; identical to SEQ ID NO: 31866

SEQ ID NO: 705127 - RNA, 64 nt, Homo Sapiens; identical to SEQ ID NO: 31867

SEQ ID NO: 705128 - RNA, 64 nt, Homo Sapiens; identical to SEQ ID NO: 31868

SEQ ID NO: 705129 - RNA, 64 nt, Homo Sapiens; identical to SEQ ID NO: 31869

SEQ ID NO: 705130 - RNA, 64 nt, Homo Sapiens; identical to SEQ ID NO: 31870

SEQ ID NO: 705131 - RNA, 64 nt, Homo Sapiens; identical to SEQ ID NO: 31871

SEQ ID NO: 705132 - RNA, 64 nt, Homo Sapiens; identical to SEQ ID NO: 31872

SEQ ID NO: 705133 - RNA, 64 nt, Homo Sapiens; identical to SEQ ID NO: 31873

SEQ ID NO: 705134 - RNA, 64 nt, Homo Sapiens; identical to SEQ ID NO: 31874

SEQ ID NO: 705135 - RNA, 64 nt, Homo Sapiens; identical to SEQ ID NO: 31875

SEQ ID NO: 705136 - RNA, 64 nt, Homo Sapiens; identical to SEQ ID NO: 31876

SEQ ID NO: 705137 - RNA, 64 nt, Homo Sapiens; identical to SEQ ID NO: 31877

SEQ ID NO: 705138 - RNA, 64 nt, Homo Sapiens; identical to SEQ ID NO: 31878

SEQ ID NO: 705139 - RNA, 64 nt, Homo Sapiens; identical to SEQ ID NO: 31879

SEQ ID NO: 705140 - RNA, 64 nt, Homo Sapiens; identical to SEQ ID NO: 31880

SEQ ID NO: 705141 - RNA, 64 nt, Homo Sapiens; identical to SEQ ID NO: 31881

SEQ ID NO: 705142 - RNA, 64 nt, Homo Sapiens; identical to SEQ ID NO: 31882

SEQ ID NO: 705143 - RNA, 64 nt, Homo Sapiens; identical to SEQ ID NO: 31883

SEQ ID NO: 705144 - RNA, 64 nt, Homo Sapiens; identical to SEQ ID NO: 31884

SEQ ID NO: 705145 - RNA, 64 nt, Homo Sapiens; identical to SEQ ID NO: 31885

SEQ ID NO: 705146 - RNA, 64 nt, Homo Sapiens; identical to SEQ ID NO: 31886

SEQ ID NO: 705147 - RNA, 64 nt, Homo Sapiens; identical to SEQ ID NO: 31887

SEQ ID NO: 705148 - RNA, 64 nt, Homo Sapiens; identical to SEQ ID NO: 31888

SEQ ID NO: 705149 - RNA, 64 nt, Homo Sapiens; identical to SEQ ID NO: 31889

SEQ ID NO: 705150 - RNA, 64 nt, Homo Sapiens; identical to SEQ ID NO: 31890

SEQ ID NO: 705151 - RNA, 64 nt, Homo Sapiens; identical to SEQ ID NO: 31891

SEQ ID NO: 705152 - RNA, 64 nt, Homo Sapiens; identical to SEQ ID NO: 31892

SEQ ID NO: 705153 - RNA, 64 nt, Homo Sapiens; identical to SEQ ID NO: 31893

SEQ ID NO: 705154 - RNA, 64 nt, Homo Sapiens; identical to SEQ ID NO: 31894

SEQ ID NO: 705155 - RNA, 64 nt, Homo Sapiens; identical to SEQ ID NO: 31895

SEQ ID NO: 705156 - RNA, 64 nt, Homo Sapiens; identical to SEQ ID NO: 31896

SEQ ID NO: 705157 - RNA, 64 nt, Homo Sapiens; identical to SEQ ID NO: 31897

SEQ ID NO: 705158 - RNA, 64 nt, Homo Sapiens; identical to SEQ ID NO: 31898

SEQ ID NO: 705159 - RNA, 64 nt, Homo Sapiens; identical to SEQ ID NO: 31899

SEQ ID NO: 705160 - RNA, 64 nt, Homo Sapiens; identical to SEQ ID NO: 31900

SEQ ID NO: 705161 - RNA, 64 nt, Homo Sapiens; identical to SEQ ID NO: 31901

SEQ ID NO: 705162 - RNA, 64 nt, Homo Sapiens; identical to SEQ ID NO: 31902

SEQ ID NO: 705163 - RNA, 64 nt, Homo Sapiens; identical to SEQ ID NO: 31903

SEQ ID NO: 705164 - RNA, 64 nt, Homo Sapiens; identical to SEQ ID NO: 31904

SEQ ID NO: 705165 - RNA, 64 nt, Homo Sapiens; identical to SEQ ID NO: 31905

SEQ ID NO: 705166 - RNA, 64 nt, Homo Sapiens; identical to SEQ ID NO: 31906

SEQ ID NO: 705167 - RNA, 64 nt, Homo Sapiens; identical to SEQ ID NO: 31907

SEQ ID NO: 705168 - RNA, 64 nt, Homo Sapiens; identical to SEQ ID NO: 31908

SEQ ID NO: 705169 - RNA, 64 nt, Homo Sapiens; identical to SEQ ID NO: 31909

SEQ ID NO: 705170 - RNA, 64 nt, Homo Sapiens; identical to SEQ ID NO: 31910

SEQ ID NO: 705171 - RNA, 64 nt, Homo Sapiens; identical to SEQ ID NO: 31911

SEQ ID NO: 705172 - RNA, 64 nt, Homo Sapiens; identical to SEQ ID NO: 31912

SEQ ID NO: 705173 - RNA, 64 nt, Homo Sapiens; identical to SEQ ID NO: 31913

SEQ ID NO: 705174 - RNA, 64 nt, Homo Sapiens; identical to SEQ ID NO: 31914

SEQ ID NO: 705175 - RNA, 64 nt, Homo Sapiens; identical to SEQ ID NO: 31915

SEQ ID NO: 705176 - RNA, 64 nt, Homo Sapiens; identical to SEQ ID NO: 31916

SEQ ID NO: 705177 - RNA, 64 nt, Homo Sapiens; identical to SEQ ID NO: 31917

SEQ ID NO: 705178 - RNA, 64 nt, Homo Sapiens; identical to SEQ ID NO: 31918

SEQ ID NO: 705179 - RNA, 64 nt, Homo Sapiens; identical to SEQ ID NO: 31919

SEQ ID NO: 705180 - RNA, 64 nt, Homo Sapiens; identical to SEQ ID NO: 31920

SEQ ID NO: 705181 - RNA, 64 nt, Homo Sapiens; identical to SEQ ID NO: 31921

SEQ ID NO: 705182 - RNA, 64 nt, Homo Sapiens; identical to SEQ ID NO: 31922

SEQ ID NO: 705183 - RNA, 64 nt, Homo Sapiens; identical to SEQ ID NO: 31923

SEQ ID NO: 705184 - RNA, 64 nt, Homo Sapiens; identical to SEQ ID NO: 31924

SEQ ID NO: 705185 - RNA, 64 nt, Homo Sapiens; identical to SEQ ID NO: 31925

SEQ ID NO: 705186 - RNA, 64 nt, Homo Sapiens; identical to SEQ ID NO: 31926

SEQ ID NO: 705187 - RNA, 64 nt, Homo Sapiens; identical to SEQ ID NO: 31927

SEQ ID NO: 705188 - RNA, 64 nt, Homo Sapiens; identical to SEQ ID NO: 31928

SEQ ID NO: 705189 - RNA, 64 nt, Homo Sapiens; identical to SEQ ID NO: 31929

SEQ ID NO: 705190 - RNA, 64 nt, Homo Sapiens; identical to SEQ ID NO: 31930

SEQ ID NO: 705191 - RNA, 64 nt, Homo Sapiens; identical to SEQ ID NO: 31931

SEQ ID NO: 705192 - RNA, 64 nt, Homo Sapiens; identical to SEQ ID NO: 31932

SEQ ID NO: 705193 - RNA, 64 nt, Homo Sapiens; identical to SEQ ID NO: 31933

SEQ ID NO: 705194 - RNA, 64 nt, Homo Sapiens; identical to SEQ ID NO: 31934

SEQ ID NO: 705195 - RNA, 64 nt, Homo Sapiens; identical to SEQ ID NO: 31935

SEQ ID NO: 705196 - RNA, 64 nt, Homo Sapiens; identical to SEQ ID NO: 31936

SEQ ID NO: 705197 - RNA, 64 nt, Homo Sapiens; identical to SEQ ID NO: 31937

SEQ ID NO: 705198 - RNA, 64 nt, Homo Sapiens; identical to SEQ ID NO: 31938

SEQ ID NO: 705199 - RNA, 64 nt, Homo Sapiens; identical to SEQ ID NO: 31939

SEQ ID NO: 705200 - RNA, 64 nt, Homo Sapiens; identical to SEQ ID NO: 31940

SEQ ID NO: 705201 - RNA, 64 nt, Homo Sapiens; identical to SEQ ID NO: 31941

SEQ ID NO: 705202 - RNA, 64 nt, Homo Sapiens; identical to SEQ ID NO: 31942

SEQ ID NO: 705203 - RNA, 64 nt, Homo Sapiens; identical to SEQ ID NO: 31943

SEQ ID NO: 705204 - RNA, 64 nt, Homo Sapiens; identical to SEQ ID NO: 31944

SEQ ID NO: 705205 - RNA, 64 nt, Homo Sapiens; identical to SEQ ID NO: 31945

SEQ ID NO: 705206 - RNA, 64 nt, Homo Sapiens; identical to SEQ ID NO: 31946

SEQ ID NO: 705207 - RNA, 64 nt, Homo Sapiens; identical to SEQ ID NO: 31947

SEQ ID NO: 705208 - RNA, 64 nt, Homo Sapiens; identical to SEQ ID NO: 31948

SEQ ID NO: 705209 - RNA, 64 nt, Homo Sapiens; identical to SEQ ID NO: 31949

SEQ ID NO: 705210 - RNA, 64 nt, Homo Sapiens; identical to SEQ ID NO: 31950

SEQ ID NO: 705211 - RNA, 64 nt, Homo Sapiens; identical to SEQ ID NO: 31951

SEQ ID NO: 705212 - RNA, 64 nt, Homo Sapiens; identical to SEQ ID NO: 31952

SEQ ID NO: 705213 - RNA, 64 nt, Homo Sapiens; identical to SEQ ID NO: 31953

SEQ ID NO: 705214 - RNA, 64 nt, Homo Sapiens; identical to SEQ ID NO: 31954

SEQ ID NO: 705215 - RNA, 64 nt, Homo Sapiens; identical to SEQ ID NO: 31955

SEQ ID NO: 705216 - RNA, 64 nt, Homo Sapiens; identical to SEQ ID NO: 31956

SEQ ID NO: 705217 - RNA, 64 nt, Homo Sapiens; identical to SEQ ID NO: 31957

SEQ ID NO: 705218 - RNA, 64 nt, Homo Sapiens; identical to SEQ ID NO: 31958

SEQ ID NO: 705219 - RNA, 64 nt, Homo Sapiens; identical to SEQ ID NO: 31959

SEQ ID NO: 705220 - RNA, 64 nt, Homo Sapiens; identical to SEQ ID NO: 31960

SEQ ID NO: 705221 - RNA, 64 nt, Homo Sapiens; identical to SEQ ID NO: 31961

SEQ ID NO: 705222 - RNA, 64 nt, Homo Sapiens; identical to SEQ ID NO: 31962

SEQ ID NO: 705223 - RNA, 64 nt, Homo Sapiens; identical to SEQ ID NO: 31963

SEQ ID NO: 705224 - RNA, 64 nt, Homo Sapiens; identical to SEQ ID NO: 31964

SEQ ID NO: 705225 - RNA, 64 nt, Homo Sapiens; identical to SEQ ID NO: 31965

SEQ ID NO: 705226 - RNA, 64 nt, Homo Sapiens; identical to SEQ ID NO: 31966

SEQ ID NO: 705227 - RNA, 64 nt, Homo Sapiens; identical to SEQ ID NO: 31967

SEQ ID NO: 705228 - RNA, 64 nt, Homo Sapiens; identical to SEQ ID NO: 31968

SEQ ID NO: 705229 - RNA, 64 nt, Homo Sapiens; identical to SEQ ID NO: 31969

SEQ ID NO: 705230 - RNA, 64 nt, Homo Sapiens; identical to SEQ ID NO: 31970

SEQ ID NO: 705231 - RNA, 64 nt, Homo Sapiens; identical to SEQ ID NO: 31971

SEQ ID NO: 705232 - RNA, 64 nt, Homo Sapiens; identical to SEQ ID NO: 31972

SEQ ID NO: 705233 - RNA, 64 nt, Homo Sapiens; identical to SEQ ID NO: 31973

SEQ ID NO: 705234 - RNA, 64 nt, Homo Sapiens; identical to SEQ ID NO: 31974

SEQ ID NO: 705235 - RNA, 64 nt, Homo Sapiens; identical to SEQ ID NO: 31975

SEQ ID NO: 705236 - RNA, 64 nt, Homo Sapiens; identical to SEQ ID NO: 31976

SEQ ID NO: 705237 - RNA, 64 nt, Homo Sapiens; identical to SEQ ID NO: 31977

SEQ ID NO: 705238 - RNA, 64 nt, Homo Sapiens; identical to SEQ ID NO: 31978

SEQ ID NO: 705239 - RNA, 64 nt, Homo Sapiens; identical to SEQ ID NO: 31979

SEQ ID NO: 705240 - RNA, 64 nt, Homo Sapiens; identical to SEQ ID NO: 31980

SEQ ID NO: 705241 - RNA, 64 nt, Homo Sapiens; identical to SEQ ID NO: 31981

SEQ ID NO: 705242 - RNA, 64 nt, Homo Sapiens; identical to SEQ ID NO: 31982

SEQ ID NO: 705243 - RNA, 64 nt, Homo Sapiens; identical to SEQ ID NO: 31983

SEQ ID NO: 705244 - RNA, 64 nt, Homo Sapiens; identical to SEQ ID NO: 31984

SEQ ID NO: 705245 - RNA, 64 nt, Homo Sapiens; identical to SEQ ID NO: 31985

SEQ ID NO: 705246 - RNA, 64 nt, Homo Sapiens; identical to SEQ ID NO: 31986

SEQ ID NO: 705247 - RNA, 64 nt, Homo Sapiens; identical to SEQ ID NO: 31987

SEQ ID NO: 705248 - RNA, 64 nt, Homo Sapiens; identical to SEQ ID NO: 31988

SEQ ID NO: 705249 - RNA, 64 nt, Homo Sapiens; identical to SEQ ID NO: 31989

SEQ ID NO: 705250 - RNA, 64 nt, Homo Sapiens; identical to SEQ ID NO: 31990

SEQ ID NO: 705251 - RNA, 64 nt, Homo Sapiens; identical to SEQ ID NO: 31991

SEQ ID NO: 705252 - RNA, 64 nt, Homo Sapiens; identical to SEQ ID NO: 31992

SEQ ID NO: 705253 - RNA, 64 nt, Homo Sapiens; identical to SEQ ID NO: 31993

SEQ ID NO: 705254 - RNA, 64 nt, Homo Sapiens; identical to SEQ ID NO: 31994

SEQ ID NO: 705255 - RNA, 64 nt, Homo Sapiens; identical to SEQ ID NO: 31995

SEQ ID NO: 705256 - RNA, 64 nt, Homo Sapiens; identical to SEQ ID NO: 31996

SEQ ID NO: 705257 - RNA, 64 nt, Homo Sapiens; identical to SEQ ID NO: 31997

SEQ ID NO: 705258 - RNA, 64 nt, Homo Sapiens; identical to SEQ ID NO: 31998

SEQ ID NO: 705259 - RNA, 64 nt, Homo Sapiens; identical to SEQ ID NO: 31999

SEQ ID NO: 705260 - RNA, 64 nt, Homo Sapiens; identical to SEQ ID NO: 32000

SEQ ID NO: 705261 - RNA, 64 nt, Homo Sapiens; identical to SEQ ID NO: 32001

SEQ ID NO: 705262 - RNA, 64 nt, Homo Sapiens; identical to SEQ ID NO: 32002

SEQ ID NO: 705263 - RNA, 64 nt, Homo Sapiens; identical to SEQ ID NO: 32003

SEQ ID NO: 705264 - RNA, 64 nt, Homo Sapiens; identical to SEQ ID NO: 32004

SEQ ID NO: 705265 - RNA, 64 nt, Homo Sapiens; identical to SEQ ID NO: 32005

SEQ ID NO: 705266 - RNA, 64 nt, Homo Sapiens; identical to SEQ ID NO: 32006

SEQ ID NO: 705267 - RNA, 64 nt, Homo Sapiens; identical to SEQ ID NO: 32007

SEQ ID NO: 705268 - RNA, 64 nt, Homo Sapiens; identical to SEQ ID NO: 32008

SEQ ID NO: 705269 - RNA, 64 nt, Homo Sapiens; identical to SEQ ID NO: 32009

SEQ ID NO: 705270 - RNA, 64 nt, Homo Sapiens; identical to SEQ ID NO: 32010

SEQ ID NO: 705271 - RNA, 64 nt, Homo Sapiens; identical to SEQ ID NO: 32011

SEQ ID NO: 705272 - RNA, 64 nt, Homo Sapiens; identical to SEQ ID NO: 32012

SEQ ID NO: 705273 - RNA, 64 nt, Homo Sapiens; identical to SEQ ID NO: 32013

SEQ ID NO: 705274 - RNA, 64 nt, Homo Sapiens; identical to SEQ ID NO: 32014

SEQ ID NO: 705275 - RNA, 64 nt, Homo Sapiens; identical to SEQ ID NO: 32015

SEQ ID NO: 705276 - RNA, 64 nt, Homo Sapiens; identical to SEQ ID NO: 32016

SEQ ID NO: 705277 - RNA, 64 nt, Homo Sapiens; identical to SEQ ID NO: 32017

SEQ ID NO: 705278 - RNA, 64 nt, Homo Sapiens; identical to SEQ ID NO: 32018

SEQ ID NO: 705279 - RNA, 64 nt, Homo Sapiens; identical to SEQ ID NO: 32019

SEQ ID NO: 705280 - RNA, 64 nt, Homo Sapiens; identical to SEQ ID NO: 32020

SEQ ID NO: 705281 - RNA, 64 nt, Homo Sapiens; identical to SEQ ID NO: 32021

SEQ ID NO: 705282 - RNA, 64 nt, Homo Sapiens; identical to SEQ ID NO: 32022

SEQ ID NO: 705283 - RNA, 64 nt, Homo Sapiens; identical to SEQ ID NO: 32023

SEQ ID NO: 705284 - RNA, 64 nt, Homo Sapiens; identical to SEQ ID NO: 32024

SEQ ID NO: 705285 - RNA, 64 nt, Homo Sapiens; identical to SEQ ID NO: 32025

SEQ ID NO: 705286 - RNA, 64 nt, Homo Sapiens; identical to SEQ ID NO: 32026

SEQ ID NO: 705287 - RNA, 64 nt, Homo Sapiens; identical to SEQ ID NO: 32027

SEQ ID NO: 705288 - RNA, 64 nt, Homo Sapiens; identical to SEQ ID NO: 32028

SEQ ID NO: 705289 - RNA, 64 nt, Homo Sapiens; identical to SEQ ID NO: 32029

SEQ ID NO: 705290 - RNA, 64 nt, Homo Sapiens; identical to SEQ ID NO: 32030

SEQ ID NO: 705291 - RNA, 64 nt, Homo Sapiens; identical to SEQ ID NO: 32031

SEQ ID NO: 705292 - RNA, 64 nt, Homo Sapiens; identical to SEQ ID NO: 32032

SEQ ID NO: 705293 - RNA, 64 nt, Homo Sapiens; identical to SEQ ID NO: 32033

SEQ ID NO: 705294 - RNA, 64 nt, Homo Sapiens; identical to SEQ ID NO: 32034

SEQ ID NO: 705295 - RNA, 64 nt, Homo Sapiens; identical to SEQ ID NO: 32035

SEQ ID NO: 705296 - RNA, 64 nt, Homo Sapiens; identical to SEQ ID NO: 32036

SEQ ID NO: 705297 - RNA, 64 nt, Homo Sapiens; identical to SEQ ID NO: 32037

SEQ ID NO: 705298 - RNA, 64 nt, Homo Sapiens; identical to SEQ ID NO: 32038

SEQ ID NO: 705299 - RNA, 64 nt, Homo Sapiens; identical to SEQ ID NO: 32039

SEQ ID NO: 705300 - RNA, 64 nt, Homo Sapiens; identical to SEQ ID NO: 32040

SEQ ID NO: 705301 - RNA, 64 nt, Homo Sapiens; identical to SEQ ID NO: 32041

SEQ ID NO: 705302 - RNA, 64 nt, Homo Sapiens; identical to SEQ ID NO: 32042

SEQ ID NO: 705303 - RNA, 64 nt, Homo Sapiens; identical to SEQ ID NO: 32043

SEQ ID NO: 705304 - RNA, 63 nt, Homo Sapiens; identical to SEQ ID NO: 32044

SEQ ID NO: 705305 - RNA, 64 nt, Homo Sapiens; identical to SEQ ID NO: 32045

SEQ ID NO: 705306 - RNA, 64 nt, Homo Sapiens; identical to SEQ ID NO: 32046

SEQ ID NO: 705307 - RNA, 64 nt, Homo Sapiens; identical to SEQ ID NO: 32047

SEQ ID NO: 705308 - RNA, 64 nt, Homo Sapiens; identical to SEQ ID NO: 32048

SEQ ID NO: 705309 - RNA, 64 nt, Homo Sapiens; identical to SEQ ID NO: 32049

SEQ ID NO: 705310 - RNA, 64 nt, Homo Sapiens; identical to SEQ ID NO: 32050

SEQ ID NO: 705311 - RNA, 64 nt, Homo Sapiens; identical to SEQ ID NO: 32051

SEQ ID NO: 705312 - RNA, 64 nt, Homo Sapiens; identical to SEQ ID NO: 32052

SEQ ID NO: 705313 - RNA, 64 nt, Homo Sapiens; identical to SEQ ID NO: 32053

SEQ ID NO: 705314 - RNA, 64 nt, Homo Sapiens; identical to SEQ ID NO: 32054

SEQ ID NO: 705315 - RNA, 64 nt, Homo Sapiens; identical to SEQ ID NO: 32055

SEQ ID NO: 705316 - RNA, 64 nt, Homo Sapiens; identical to SEQ ID NO: 32056

SEQ ID NO: 705317 - RNA, 64 nt, Homo Sapiens; identical to SEQ ID NO: 32057

SEQ ID NO: 705318 - RNA, 64 nt, Homo Sapiens; identical to SEQ ID NO: 32058

SEQ ID NO: 705319 - RNA, 64 nt, Homo Sapiens; identical to SEQ ID NO: 32059

SEQ ID NO: 705320 - RNA, 64 nt, Homo Sapiens; identical to SEQ ID NO: 32060

SEQ ID NO: 705321 - RNA, 64 nt, Homo Sapiens; identical to SEQ ID NO: 32061

SEQ ID NO: 705322 - RNA, 64 nt, Homo Sapiens; identical to SEQ ID NO: 32062

SEQ ID NO: 705323 - RNA, 64 nt, Homo Sapiens; identical to SEQ ID NO: 32063

SEQ ID NO: 705324 - RNA, 64 nt, Homo Sapiens; identical to SEQ ID NO: 32064

SEQ ID NO: 705325 - RNA, 64 nt, Homo Sapiens; identical to SEQ ID NO: 32065

SEQ ID NO: 705326 - RNA, 64 nt, Homo Sapiens; identical to SEQ ID NO: 32066

SEQ ID NO: 705327 - RNA, 64 nt, Homo Sapiens; identical to SEQ ID NO: 32067

SEQ ID NO: 705328 - RNA, 64 nt, Homo Sapiens; identical to SEQ ID NO: 32068

SEQ ID NO: 705329 - RNA, 64 nt, Homo Sapiens; identical to SEQ ID NO: 32069

SEQ ID NO: 705330 - RNA, 64 nt, Homo Sapiens; identical to SEQ ID NO: 32070

SEQ ID NO: 705331 - RNA, 64 nt, Homo Sapiens; identical to SEQ ID NO: 32071

SEQ ID NO: 705332 - RNA, 64 nt, Homo Sapiens; identical to SEQ ID NO: 32072

SEQ ID NO: 705333 - RNA, 64 nt, Homo Sapiens; identical to SEQ ID NO: 32073

SEQ ID NO: 705334 - RNA, 64 nt, Homo Sapiens; identical to SEQ ID NO: 32074

SEQ ID NO: 705335 - RNA, 64 nt, Homo Sapiens; identical to SEQ ID NO: 32075

SEQ ID NO: 705336 - RNA, 64 nt, Homo Sapiens; identical to SEQ ID NO: 32076

SEQ ID NO: 705337 - RNA, 64 nt, Homo Sapiens; identical to SEQ ID NO: 32077

SEQ ID NO: 705338 - RNA, 64 nt, Homo Sapiens; identical to SEQ ID NO: 32078

SEQ ID NO: 705339 - RNA, 64 nt, Homo Sapiens; identical to SEQ ID NO: 32079

SEQ ID NO: 705340 - RNA, 64 nt, Homo Sapiens; identical to SEQ ID NO: 32080

SEQ ID NO: 705341 - RNA, 64 nt, Homo Sapiens; identical to SEQ ID NO: 32081

SEQ ID NO: 705342 - RNA, 64 nt, Homo Sapiens; identical to SEQ ID NO: 32082

SEQ ID NO: 705343 - RNA, 64 nt, Homo Sapiens; identical to SEQ ID NO: 32083

SEQ ID NO: 705344 - RNA, 64 nt, Homo Sapiens; identical to SEQ ID NO: 32084

SEQ ID NO: 705345 - RNA, 64 nt, Homo Sapiens; identical to SEQ ID NO: 32085

SEQ ID NO: 705346 - RNA, 64 nt, Homo Sapiens; identical to SEQ ID NO: 32086

SEQ ID NO: 705347 - RNA, 64 nt, Homo Sapiens; identical to SEQ ID NO: 32087

SEQ ID NO: 705348 - RNA, 64 nt, Homo Sapiens; identical to SEQ ID NO: 32088

SEQ ID NO: 705349 - RNA, 64 nt, Homo Sapiens; identical to SEQ ID NO: 32089

SEQ ID NO: 705350 - RNA, 64 nt, Homo Sapiens; identical to SEQ ID NO: 32090

SEQ ID NO: 705351 - RNA, 64 nt, Homo Sapiens; identical to SEQ ID NO: 32091

SEQ ID NO: 705352 - RNA, 64 nt, Homo Sapiens; identical to SEQ ID NO: 32092

SEQ ID NO: 705353 - RNA, 64 nt, Homo Sapiens; identical to SEQ ID NO: 32093

SEQ ID NO: 705354 - RNA, 64 nt, Homo Sapiens; identical to SEQ ID NO: 32094

SEQ ID NO: 705355 - RNA, 64 nt, Homo Sapiens; identical to SEQ ID NO: 32095

SEQ ID NO: 705356 - RNA, 64 nt, Homo Sapiens; identical to SEQ ID NO: 32096

SEQ ID NO: 705357 - RNA, 64 nt, Homo Sapiens; identical to SEQ ID NO: 32097

SEQ ID NO: 705358 - RNA, 64 nt, Homo Sapiens; identical to SEQ ID NO: 32098

SEQ ID NO: 705359 - RNA, 64 nt, Homo Sapiens; identical to SEQ ID NO: 32099

SEQ ID NO: 705360 - RNA, 64 nt, Homo Sapiens; identical to SEQ ID NO: 32100

SEQ ID NO: 705361 - RNA, 64 nt, Homo Sapiens; identical to SEQ ID NO: 32101

SEQ ID NO: 705362 - RNA, 64 nt, Homo Sapiens; identical to SEQ ID NO: 32102

SEQ ID NO: 705363 - RNA, 64 nt, Homo Sapiens; identical to SEQ ID NO: 32103

SEQ ID NO: 705364 - RNA, 64 nt, Homo Sapiens; identical to SEQ ID NO: 32104

SEQ ID NO: 705365 - RNA, 64 nt, Homo Sapiens; identical to SEQ ID NO: 32105

SEQ ID NO: 705366 - RNA, 64 nt, Homo Sapiens; identical to SEQ ID NO: 32106

SEQ ID NO: 705367 - RNA, 64 nt, Homo Sapiens; identical to SEQ ID NO: 32107

SEQ ID NO: 705368 - RNA, 64 nt, Homo Sapiens; identical to SEQ ID NO: 32108

SEQ ID NO: 705369 - RNA, 64 nt, Homo Sapiens; identical to SEQ ID NO: 32109

SEQ ID NO: 705370 - RNA, 64 nt, Homo Sapiens; identical to SEQ ID NO: 32110

SEQ ID NO: 705371 - RNA, 64 nt, Homo Sapiens; identical to SEQ ID NO: 32111

SEQ ID NO: 705372 - RNA, 64 nt, Homo Sapiens; identical to SEQ ID NO: 32112

SEQ ID NO: 705373 - RNA, 64 nt, Homo Sapiens; identical to SEQ ID NO: 32113

SEQ ID NO: 705374 - RNA, 64 nt, Homo Sapiens; identical to SEQ ID NO: 32114

SEQ ID NO: 705375 - RNA, 64 nt, Homo Sapiens; identical to SEQ ID NO: 32115

SEQ ID NO: 705376 - RNA, 64 nt, Homo Sapiens; identical to SEQ ID NO: 32116

SEQ ID NO: 705377 - RNA, 64 nt, Homo Sapiens; identical to SEQ ID NO: 32117

SEQ ID NO: 705378 - RNA, 64 nt, Homo Sapiens; identical to SEQ ID NO: 32118

SEQ ID NO: 705379 - RNA, 64 nt, Homo Sapiens; identical to SEQ ID NO: 32119

SEQ ID NO: 705380 - RNA, 64 nt, Homo Sapiens; identical to SEQ ID NO: 32120

SEQ ID NO: 705381 - RNA, 64 nt, Homo Sapiens; identical to SEQ ID NO: 32121

SEQ ID NO: 705382 - RNA, 64 nt, Homo Sapiens; identical to SEQ ID NO: 32122

SEQ ID NO: 705383 - RNA, 64 nt, Homo Sapiens; identical to SEQ ID NO: 32123

SEQ ID NO: 705384 - RNA, 64 nt, Homo Sapiens; identical to SEQ ID NO: 32124

SEQ ID NO: 705385 - RNA, 64 nt, Homo Sapiens; identical to SEQ ID NO: 32125

SEQ ID NO: 705386 - RNA, 64 nt, Homo Sapiens; identical to SEQ ID NO: 32126

SEQ ID NO: 705387 - RNA, 64 nt, Homo Sapiens; identical to SEQ ID NO: 32127

SEQ ID NO: 705388 - RNA, 64 nt, Homo Sapiens; identical to SEQ ID NO: 32128

SEQ ID NO: 705389 - RNA, 64 nt, Homo Sapiens; identical to SEQ ID NO: 32129

SEQ ID NO: 705390 - RNA, 64 nt, Homo Sapiens; identical to SEQ ID NO: 32130

SEQ ID NO: 705391 - RNA, 64 nt, Homo Sapiens; identical to SEQ ID NO: 32131

SEQ ID NO: 705392 - RNA, 64 nt, Homo Sapiens; identical to SEQ ID NO: 32132

SEQ ID NO: 705393 - RNA, 64 nt, Homo Sapiens; identical to SEQ ID NO: 32133

SEQ ID NO: 705394 - RNA, 64 nt, Homo Sapiens; identical to SEQ ID NO: 32134

SEQ ID NO: 705395 - RNA, 64 nt, Homo Sapiens; identical to SEQ ID NO: 32135

SEQ ID NO: 705396 - RNA, 64 nt, Homo Sapiens; identical to SEQ ID NO: 32136

SEQ ID NO: 705397 - RNA, 64 nt, Homo Sapiens; identical to SEQ ID NO: 32137

SEQ ID NO: 705398 - RNA, 64 nt, Homo Sapiens; identical to SEQ ID NO: 32138

SEQ ID NO: 705399 - RNA, 64 nt, Homo Sapiens; identical to SEQ ID NO: 32139

SEQ ID NO: 705400 - RNA, 64 nt, Homo Sapiens; identical to SEQ ID NO: 32140

SEQ ID NO: 705401 - RNA, 64 nt, Homo Sapiens; identical to SEQ ID NO: 32141

SEQ ID NO: 705402 - RNA, 64 nt, Homo Sapiens; identical to SEQ ID NO: 32142

SEQ ID NO: 705403 - RNA, 64 nt, Homo Sapiens; identical to SEQ ID NO: 32143

SEQ ID NO: 705404 - RNA, 64 nt, Homo Sapiens; identical to SEQ ID NO: 32144

SEQ ID NO: 705405 - RNA, 64 nt, Homo Sapiens; identical to SEQ ID NO: 32145

SEQ ID NO: 705406 - RNA, 64 nt, Homo Sapiens; identical to SEQ ID NO: 32146

SEQ ID NO: 705407 - RNA, 64 nt, Homo Sapiens; identical to SEQ ID NO: 32147

SEQ ID NO: 705408 - RNA, 64 nt, Homo Sapiens; identical to SEQ ID NO: 32148

SEQ ID NO: 705409 - RNA, 64 nt, Homo Sapiens; identical to SEQ ID NO: 32149

SEQ ID NO: 705410 - RNA, 64 nt, Homo Sapiens; identical to SEQ ID NO: 32150

SEQ ID NO: 705411 - RNA, 64 nt, Homo Sapiens; identical to SEQ ID NO: 32151

SEQ ID NO: 705412 - RNA, 64 nt, Homo Sapiens; identical to SEQ ID NO: 32152

SEQ ID NO: 705413 - RNA, 64 nt, Homo Sapiens; identical to SEQ ID NO: 32153

SEQ ID NO: 705414 - RNA, 64 nt, Homo Sapiens; identical to SEQ ID NO: 32154

SEQ ID NO: 705415 - RNA, 64 nt, Homo Sapiens; identical to SEQ ID NO: 32155

SEQ ID NO: 705416 - RNA, 64 nt, Homo Sapiens; identical to SEQ ID NO: 32156

SEQ ID NO: 705417 - RNA, 64 nt, Homo Sapiens; identical to SEQ ID NO: 32157

SEQ ID NO: 705418 - RNA, 64 nt, Homo Sapiens; identical to SEQ ID NO: 32158

SEQ ID NO: 705419 - RNA, 64 nt, Homo Sapiens; identical to SEQ ID NO: 32159

SEQ ID NO: 705420 - RNA, 64 nt, Homo Sapiens; identical to SEQ ID NO: 32160

SEQ ID NO: 705421 - RNA, 64 nt, Homo Sapiens; identical to SEQ ID NO: 32161

SEQ ID NO: 705422 - RNA, 64 nt, Homo Sapiens; identical to SEQ ID NO: 32162

SEQ ID NO: 705423 - RNA, 64 nt, Homo Sapiens; identical to SEQ ID NO: 32163

SEQ ID NO: 705424 - RNA, 64 nt, Homo Sapiens; identical to SEQ ID NO: 32164

SEQ ID NO: 705425 - RNA, 64 nt, Homo Sapiens; identical to SEQ ID NO: 32165

SEQ ID NO: 705426 - RNA, 64 nt, Homo Sapiens; identical to SEQ ID NO: 32166

SEQ ID NO: 705427 - RNA, 64 nt, Homo Sapiens; identical to SEQ ID NO: 32167

SEQ ID NO: 705428 - RNA, 64 nt, Homo Sapiens; identical to SEQ ID NO: 32168

SEQ ID NO: 705429 - RNA, 64 nt, Homo Sapiens; identical to SEQ ID NO: 32169

SEQ ID NO: 705430 - RNA, 64 nt, Homo Sapiens; identical to SEQ ID NO: 32170

SEQ ID NO: 705431 - RNA, 64 nt, Homo Sapiens; identical to SEQ ID NO: 32171

SEQ ID NO: 705432 - RNA, 64 nt, Homo Sapiens; identical to SEQ ID NO: 32172

SEQ ID NO: 705433 - RNA, 64 nt, Homo Sapiens; identical to SEQ ID NO: 32173

SEQ ID NO: 705434 - RNA, 64 nt, Homo Sapiens; identical to SEQ ID NO: 32174

SEQ ID NO: 705435 - RNA, 64 nt, Homo Sapiens; identical to SEQ ID NO: 32175

SEQ ID NO: 705436 - RNA, 64 nt, Homo Sapiens; identical to SEQ ID NO: 32176

SEQ ID NO: 705437 - RNA, 64 nt, Homo Sapiens; identical to SEQ ID NO: 32177

SEQ ID NO: 705438 - RNA, 64 nt, Homo Sapiens; identical to SEQ ID NO: 32178

SEQ ID NO: 705439 - RNA, 64 nt, Homo Sapiens; identical to SEQ ID NO: 32179

SEQ ID NO: 705440 - RNA, 64 nt, Homo Sapiens; identical to SEQ ID NO: 32180

SEQ ID NO: 705441 - RNA, 64 nt, Homo Sapiens; identical to SEQ ID NO: 32181

SEQ ID NO: 705442 - RNA, 64 nt, Homo Sapiens; identical to SEQ ID NO: 32182

SEQ ID NO: 705443 - RNA, 64 nt, Homo Sapiens; identical to SEQ ID NO: 32183

SEQ ID NO: 705444 - RNA, 64 nt, Homo Sapiens; identical to SEQ ID NO: 32184

SEQ ID NO: 705445 - RNA, 64 nt, Homo Sapiens; identical to SEQ ID NO: 32185

SEQ ID NO: 705446 - RNA, 64 nt, Homo Sapiens; identical to SEQ ID NO: 32186

SEQ ID NO: 705447 - RNA, 64 nt, Homo Sapiens; identical to SEQ ID NO: 32187

SEQ ID NO: 705448 - RNA, 64 nt, Homo Sapiens; identical to SEQ ID NO: 32188

SEQ ID NO: 705449 - RNA, 64 nt, Homo Sapiens; identical to SEQ ID NO: 32189

SEQ ID NO: 705450 - RNA, 64 nt, Homo Sapiens; identical to SEQ ID NO: 32190

SEQ ID NO: 705451 - RNA, 64 nt, Homo Sapiens; identical to SEQ ID NO: 32191

SEQ ID NO: 705452 - RNA, 64 nt, Homo Sapiens; identical to SEQ ID NO: 32192

SEQ ID NO: 705453 - RNA, 64 nt, Homo Sapiens; identical to SEQ ID NO: 32193

SEQ ID NO: 705454 - RNA, 64 nt, Homo Sapiens; identical to SEQ ID NO: 32194

SEQ ID NO: 705455 - RNA, 64 nt, Homo Sapiens; identical to SEQ ID NO: 32195

SEQ ID NO: 705456 - RNA, 64 nt, Homo Sapiens; identical to SEQ ID NO: 32196

SEQ ID NO: 705457 - RNA, 64 nt, Homo Sapiens; identical to SEQ ID NO: 32197

SEQ ID NO: 705458 - RNA, 64 nt, Homo Sapiens; identical to SEQ ID NO: 32198

SEQ ID NO: 705459 - RNA, 64 nt, Homo Sapiens; identical to SEQ ID NO: 32199

SEQ ID NO: 705460 - RNA, 64 nt, Homo Sapiens; identical to SEQ ID NO: 32200

SEQ ID NO: 705461 - RNA, 64 nt, Homo Sapiens; identical to SEQ ID NO: 32201

SEQ ID NO: 705462 - RNA, 64 nt, Homo Sapiens; identical to SEQ ID NO: 32202

SEQ ID NO: 705463 - RNA, 64 nt, Homo Sapiens; identical to SEQ ID NO: 32203

SEQ ID NO: 705464 - RNA, 64 nt, Homo Sapiens; identical to SEQ ID NO: 32204

SEQ ID NO: 705465 - RNA, 64 nt, Homo Sapiens; identical to SEQ ID NO: 32205

SEQ ID NO: 705466 - RNA, 64 nt, Homo Sapiens; identical to SEQ ID NO: 32206

SEQ ID NO: 705467 - RNA, 64 nt, Homo Sapiens; identical to SEQ ID NO: 32207

SEQ ID NO: 705468 - RNA, 64 nt, Homo Sapiens; identical to SEQ ID NO: 32208

SEQ ID NO: 705469 - RNA, 64 nt, Homo Sapiens; identical to SEQ ID NO: 32209

SEQ ID NO: 705470 - RNA, 64 nt, Homo Sapiens; identical to SEQ ID NO: 32210

SEQ ID NO: 705471 - RNA, 64 nt, Homo Sapiens; identical to SEQ ID NO: 32211

SEQ ID NO: 705472 - RNA, 64 nt, Homo Sapiens; identical to SEQ ID NO: 32212

SEQ ID NO: 705473 - RNA, 64 nt, Homo Sapiens; identical to SEQ ID NO: 32213

SEQ ID NO: 705474 - RNA, 64 nt, Homo Sapiens; identical to SEQ ID NO: 32214

SEQ ID NO: 705475 - RNA, 64 nt, Homo Sapiens; identical to SEQ ID NO: 32215

SEQ ID NO: 705476 - RNA, 64 nt, Homo Sapiens; identical to SEQ ID NO: 32216

SEQ ID NO: 705477 - RNA, 64 nt, Homo Sapiens; identical to SEQ ID NO: 32217

SEQ ID NO: 705478 - RNA, 64 nt, Homo Sapiens; identical to SEQ ID NO: 32218

SEQ ID NO: 705479 - RNA, 64 nt, Homo Sapiens; identical to SEQ ID NO: 32219

SEQ ID NO: 705480 - RNA, 64 nt, Homo Sapiens; identical to SEQ ID NO: 32220

SEQ ID NO: 705481 - RNA, 64 nt, Homo Sapiens; identical to SEQ ID NO: 32221

SEQ ID NO: 705482 - RNA, 64 nt, Homo Sapiens; identical to SEQ ID NO: 32222

SEQ ID NO: 705483 - RNA, 64 nt, Homo Sapiens; identical to SEQ ID NO: 32223

SEQ ID NO: 705484 - RNA, 64 nt, Homo Sapiens; identical to SEQ ID NO: 32224

SEQ ID NO: 705485 - RNA, 64 nt, Homo Sapiens; identical to SEQ ID NO: 32225

SEQ ID NO: 705486 - RNA, 64 nt, Homo Sapiens; identical to SEQ ID NO: 32226

SEQ ID NO: 705487 - RNA, 64 nt, Homo Sapiens; identical to SEQ ID NO: 32227

SEQ ID NO: 705488 - RNA, 64 nt, Homo Sapiens; identical to SEQ ID NO: 32228

SEQ ID NO: 705489 - RNA, 64 nt, Homo Sapiens; identical to SEQ ID NO: 32229

SEQ ID NO: 705490 - RNA, 64 nt, Homo Sapiens; identical to SEQ ID NO: 32230

SEQ ID NO: 705491 - RNA, 64 nt, Homo Sapiens; identical to SEQ ID NO: 32231

SEQ ID NO: 705492 - RNA, 64 nt, Homo Sapiens; identical to SEQ ID NO: 32232

SEQ ID NO: 705493 - RNA, 64 nt, Homo Sapiens; identical to SEQ ID NO: 32233

SEQ ID NO: 705494 - RNA, 64 nt, Homo Sapiens; identical to SEQ ID NO: 32234

SEQ ID NO: 705495 - RNA, 64 nt, Homo Sapiens; identical to SEQ ID NO: 32235

SEQ ID NO: 705496 - RNA, 64 nt, Homo Sapiens; identical to SEQ ID NO: 32236

SEQ ID NO: 705497 - RNA, 64 nt, Homo Sapiens; identical to SEQ ID NO: 32237

SEQ ID NO: 705498 - RNA, 64 nt, Homo Sapiens; identical to SEQ ID NO: 32238

SEQ ID NO: 705499 - RNA, 64 nt, Homo Sapiens; identical to SEQ ID NO: 32239

SEQ ID NO: 705500 - RNA, 64 nt, Homo Sapiens; identical to SEQ ID NO: 32240

SEQ ID NO: 705501 - RNA, 64 nt, Homo Sapiens; identical to SEQ ID NO: 32241

SEQ ID NO: 705502 - RNA, 64 nt, Homo Sapiens; identical to SEQ ID NO: 32242

SEQ ID NO: 705503 - RNA, 64 nt, Homo Sapiens; identical to SEQ ID NO: 32243

SEQ ID NO: 705504 - RNA, 64 nt, Homo Sapiens; identical to SEQ ID NO: 32244

SEQ ID NO: 705505 - RNA, 64 nt, Homo Sapiens; identical to SEQ ID NO: 32245

SEQ ID NO: 705506 - RNA, 64 nt, Homo Sapiens; identical to SEQ ID NO: 32246

SEQ ID NO: 705507 - RNA, 64 nt, Homo Sapiens; identical to SEQ ID NO: 32247

SEQ ID NO: 705508 - RNA, 64 nt, Homo Sapiens; identical to SEQ ID NO: 32248

SEQ ID NO: 705509 - RNA, 64 nt, Homo Sapiens; identical to SEQ ID NO: 32249

SEQ ID NO: 705510 - RNA, 64 nt, Homo Sapiens; identical to SEQ ID NO: 32250

SEQ ID NO: 705511 - RNA, 64 nt, Homo Sapiens; identical to SEQ ID NO: 32251

SEQ ID NO: 705512 - RNA, 64 nt, Homo Sapiens; identical to SEQ ID NO: 32252

SEQ ID NO: 705513 - RNA, 64 nt, Homo Sapiens; identical to SEQ ID NO: 32253

SEQ ID NO: 705514 - RNA, 64 nt, Homo Sapiens; identical to SEQ ID NO: 32254

SEQ ID NO: 705515 - RNA, 64 nt, Homo Sapiens; identical to SEQ ID NO: 32255

SEQ ID NO: 705516 - RNA, 64 nt, Homo Sapiens; identical to SEQ ID NO: 32256

SEQ ID NO: 705517 - RNA, 64 nt, Homo Sapiens; identical to SEQ ID NO: 32257

SEQ ID NO: 705518 - RNA, 64 nt, Homo Sapiens; identical to SEQ ID NO: 32258

SEQ ID NO: 705519 - RNA, 64 nt, Homo Sapiens; identical to SEQ ID NO: 32259

SEQ ID NO: 705520 - RNA, 64 nt, Homo Sapiens; identical to SEQ ID NO: 32260

SEQ ID NO: 705521 - RNA, 64 nt, Homo Sapiens; identical to SEQ ID NO: 32261

SEQ ID NO: 705522 - RNA, 64 nt, Homo Sapiens; identical to SEQ ID NO: 32262

SEQ ID NO: 705523 - RNA, 64 nt, Homo Sapiens; identical to SEQ ID NO: 32263

SEQ ID NO: 705524 - RNA, 64 nt, Homo Sapiens; identical to SEQ ID NO: 32264

SEQ ID NO: 705525 - RNA, 64 nt, Homo Sapiens; identical to SEQ ID NO: 32265

SEQ ID NO: 705526 - RNA, 64 nt, Homo Sapiens; identical to SEQ ID NO: 32266

SEQ ID NO: 705527 - RNA, 64 nt, Homo Sapiens; identical to SEQ ID NO: 32267

SEQ ID NO: 705528 - RNA, 64 nt, Homo Sapiens; identical to SEQ ID NO: 32268

SEQ ID NO: 705529 - RNA, 64 nt, Homo Sapiens; identical to SEQ ID NO: 32269

SEQ ID NO: 705530 - RNA, 64 nt, Homo Sapiens; identical to SEQ ID NO: 32270

SEQ ID NO: 705531 - RNA, 64 nt, Homo Sapiens; identical to SEQ ID NO: 32271

SEQ ID NO: 705532 - RNA, 64 nt, Homo Sapiens; identical to SEQ ID NO: 32272

SEQ ID NO: 705533 - RNA, 64 nt, Homo Sapiens; identical to SEQ ID NO: 32273

SEQ ID NO: 705534 - RNA, 64 nt, Homo Sapiens; identical to SEQ ID NO: 32274

SEQ ID NO: 705535 - RNA, 64 nt, Homo Sapiens; identical to SEQ ID NO: 32275

SEQ ID NO: 705536 - RNA, 64 nt, Homo Sapiens; identical to SEQ ID NO: 32276

SEQ ID NO: 705537 - RNA, 64 nt, Homo Sapiens; identical to SEQ ID NO: 32277

SEQ ID NO: 705538 - RNA, 64 nt, Homo Sapiens; identical to SEQ ID NO: 32278

SEQ ID NO: 705539 - RNA, 64 nt, Homo Sapiens; identical to SEQ ID NO: 32279

SEQ ID NO: 705540 - RNA, 64 nt, Homo Sapiens; identical to SEQ ID NO: 32280

SEQ ID NO: 705541 - RNA, 64 nt, Homo Sapiens; identical to SEQ ID NO: 32281

SEQ ID NO: 705542 - RNA, 64 nt, Homo Sapiens; identical to SEQ ID NO: 32282

SEQ ID NO: 705543 - RNA, 64 nt, Homo Sapiens; identical to SEQ ID NO: 32283

SEQ ID NO: 705544 - RNA, 64 nt, Homo Sapiens; identical to SEQ ID NO: 32284

SEQ ID NO: 705545 - RNA, 64 nt, Homo Sapiens; identical to SEQ ID NO: 32285

SEQ ID NO: 705546 - RNA, 64 nt, Homo Sapiens; identical to SEQ ID NO: 32286

SEQ ID NO: 705547 - RNA, 64 nt, Homo Sapiens; identical to SEQ ID NO: 32287

SEQ ID NO: 705548 - RNA, 64 nt, Homo Sapiens; identical to SEQ ID NO: 32288

SEQ ID NO: 705549 - RNA, 64 nt, Homo Sapiens; identical to SEQ ID NO: 32289

SEQ ID NO: 705550 - RNA, 64 nt, Homo Sapiens; identical to SEQ ID NO: 32290

SEQ ID NO: 705551 - RNA, 64 nt, Homo Sapiens; identical to SEQ ID NO: 32291

SEQ ID NO: 705552 - RNA, 64 nt, Homo Sapiens; identical to SEQ ID NO: 32292

SEQ ID NO: 705553 - RNA, 64 nt, Homo Sapiens; identical to SEQ ID NO: 32293

SEQ ID NO: 705554 - RNA, 64 nt, Homo Sapiens; identical to SEQ ID NO: 32294

SEQ ID NO: 705555 - RNA, 64 nt, Homo Sapiens; identical to SEQ ID NO: 32295

SEQ ID NO: 705556 - RNA, 64 nt, Homo Sapiens; identical to SEQ ID NO: 32296

SEQ ID NO: 705557 - RNA, 64 nt, Homo Sapiens; identical to SEQ ID NO: 32297

SEQ ID NO: 705558 - RNA, 64 nt, Homo Sapiens; identical to SEQ ID NO: 32298

SEQ ID NO: 705559 - RNA, 64 nt, Homo Sapiens; identical to SEQ ID NO: 32299

SEQ ID NO: 705560 - RNA, 64 nt, Homo Sapiens; identical to SEQ ID NO: 32300

SEQ ID NO: 705561 - RNA, 64 nt, Homo Sapiens; identical to SEQ ID NO: 32301

SEQ ID NO: 705562 - RNA, 64 nt, Homo Sapiens; identical to SEQ ID NO: 32302

SEQ ID NO: 705563 - RNA, 64 nt, Homo Sapiens; identical to SEQ ID NO: 32303

SEQ ID NO: 705564 - RNA, 64 nt, Homo Sapiens; identical to SEQ ID NO: 32304

SEQ ID NO: 705565 - RNA, 64 nt, Homo Sapiens; identical to SEQ ID NO: 32305

SEQ ID NO: 705566 - RNA, 64 nt, Homo Sapiens; identical to SEQ ID NO: 32306

SEQ ID NO: 705567 - RNA, 64 nt, Homo Sapiens; identical to SEQ ID NO: 32307

SEQ ID NO: 705568 - RNA, 64 nt, Homo Sapiens; identical to SEQ ID NO: 32308

SEQ ID NO: 705569 - RNA, 64 nt, Homo Sapiens; identical to SEQ ID NO: 32309

SEQ ID NO: 705570 - RNA, 64 nt, Homo Sapiens; identical to SEQ ID NO: 32310

SEQ ID NO: 705571 - RNA, 64 nt, Homo Sapiens; identical to SEQ ID NO: 32311

SEQ ID NO: 705572 - RNA, 64 nt, Homo Sapiens; identical to SEQ ID NO: 32312

SEQ ID NO: 705573 - RNA, 64 nt, Homo Sapiens; identical to SEQ ID NO: 32313

SEQ ID NO: 705574 - RNA, 64 nt, Homo Sapiens; identical to SEQ ID NO: 32314

SEQ ID NO: 705575 - RNA, 64 nt, Homo Sapiens; identical to SEQ ID NO: 32315

SEQ ID NO: 705576 - RNA, 64 nt, Homo Sapiens; identical to SEQ ID NO: 32316

SEQ ID NO: 705577 - RNA, 64 nt, Homo Sapiens; identical to SEQ ID NO: 32317

SEQ ID NO: 705578 - RNA, 64 nt, Homo Sapiens; identical to SEQ ID NO: 32318

SEQ ID NO: 705579 - RNA, 64 nt, Homo Sapiens; identical to SEQ ID NO: 32319

SEQ ID NO: 705580 - RNA, 64 nt, Homo Sapiens; identical to SEQ ID NO: 32320

SEQ ID NO: 705581 - RNA, 64 nt, Homo Sapiens; identical to SEQ ID NO: 32321

SEQ ID NO: 705582 - RNA, 64 nt, Homo Sapiens; identical to SEQ ID NO: 32322

SEQ ID NO: 705583 - RNA, 64 nt, Homo Sapiens; identical to SEQ ID NO: 32323

SEQ ID NO: 705584 - RNA, 64 nt, Homo Sapiens; identical to SEQ ID NO: 32324

SEQ ID NO: 705585 - RNA, 64 nt, Homo Sapiens; identical to SEQ ID NO: 32325

SEQ ID NO: 705586 - RNA, 64 nt, Homo Sapiens; identical to SEQ ID NO: 32326

SEQ ID NO: 705587 - RNA, 64 nt, Homo Sapiens; identical to SEQ ID NO: 32327

SEQ ID NO: 705588 - RNA, 64 nt, Homo Sapiens; identical to SEQ ID NO: 32328

SEQ ID NO: 705589 - RNA, 64 nt, Homo Sapiens; identical to SEQ ID NO: 32329

SEQ ID NO: 705590 - RNA, 64 nt, Homo Sapiens; identical to SEQ ID NO: 32330

SEQ ID NO: 705591 - RNA, 64 nt, Homo Sapiens; identical to SEQ ID NO: 32331

SEQ ID NO: 705592 - RNA, 64 nt, Homo Sapiens; identical to SEQ ID NO: 32332

SEQ ID NO: 705593 - RNA, 64 nt, Homo Sapiens; identical to SEQ ID NO: 32333

SEQ ID NO: 705594 - RNA, 64 nt, Homo Sapiens; identical to SEQ ID NO: 32334

SEQ ID NO: 705595 - RNA, 64 nt, Homo Sapiens; identical to SEQ ID NO: 32335

SEQ ID NO: 705596 - RNA, 64 nt, Homo Sapiens; identical to SEQ ID NO: 32336

SEQ ID NO: 705597 - RNA, 64 nt, Homo Sapiens; identical to SEQ ID NO: 32337

SEQ ID NO: 705598 - RNA, 64 nt, Homo Sapiens; identical to SEQ ID NO: 32338

SEQ ID NO: 705599 - RNA, 64 nt, Homo Sapiens; identical to SEQ ID NO: 32339

SEQ ID NO: 705600 - RNA, 64 nt, Homo Sapiens; identical to SEQ ID NO: 32340

SEQ ID NO: 705601 - RNA, 64 nt, Homo Sapiens; identical to SEQ ID NO: 32341

SEQ ID NO: 705602 - RNA, 64 nt, Homo Sapiens; identical to SEQ ID NO: 32342

SEQ ID NO: 705603 - RNA, 64 nt, Homo Sapiens; identical to SEQ ID NO: 32343

SEQ ID NO: 705604 - RNA, 64 nt, Homo Sapiens; identical to SEQ ID NO: 32344

SEQ ID NO: 705605 - RNA, 64 nt, Homo Sapiens; identical to SEQ ID NO: 32345

SEQ ID NO: 705606 - RNA, 64 nt, Homo Sapiens; identical to SEQ ID NO: 32346

SEQ ID NO: 705607 - RNA, 64 nt, Homo Sapiens; identical to SEQ ID NO: 32347

SEQ ID NO: 705608 - RNA, 64 nt, Homo Sapiens; identical to SEQ ID NO: 32348

SEQ ID NO: 705609 - RNA, 64 nt, Homo Sapiens; identical to SEQ ID NO: 32349

SEQ ID NO: 705610 - RNA, 64 nt, Homo Sapiens; identical to SEQ ID NO: 32350

SEQ ID NO: 705611 - RNA, 64 nt, Homo Sapiens; identical to SEQ ID NO: 32351

SEQ ID NO: 705612 - RNA, 64 nt, Homo Sapiens; identical to SEQ ID NO: 32352

SEQ ID NO: 705613 - RNA, 64 nt, Homo Sapiens; identical to SEQ ID NO: 32353

SEQ ID NO: 705614 - RNA, 64 nt, Homo Sapiens; identical to SEQ ID NO: 32354

SEQ ID NO: 705615 - RNA, 64 nt, Homo Sapiens; identical to SEQ ID NO: 32355

SEQ ID NO: 705616 - RNA, 64 nt, Homo Sapiens; identical to SEQ ID NO: 32356

SEQ ID NO: 705617 - RNA, 64 nt, Homo Sapiens; identical to SEQ ID NO: 32357

SEQ ID NO: 705618 - RNA, 64 nt, Homo Sapiens; identical to SEQ ID NO: 32358

SEQ ID NO: 705619 - RNA, 64 nt, Homo Sapiens; identical to SEQ ID NO: 32359

SEQ ID NO: 705620 - RNA, 64 nt, Homo Sapiens; identical to SEQ ID NO: 32360

SEQ ID NO: 705621 - RNA, 64 nt, Homo Sapiens; identical to SEQ ID NO: 32361

SEQ ID NO: 705622 - RNA, 64 nt, Homo Sapiens; identical to SEQ ID NO: 32362

SEQ ID NO: 705623 - RNA, 64 nt, Homo Sapiens; identical to SEQ ID NO: 32363

SEQ ID NO: 705624 - RNA, 64 nt, Homo Sapiens; identical to SEQ ID NO: 32364

SEQ ID NO: 705625 - RNA, 64 nt, Homo Sapiens; identical to SEQ ID NO: 32365

SEQ ID NO: 705626 - RNA, 64 nt, Homo Sapiens; identical to SEQ ID NO: 32366

SEQ ID NO: 705627 - RNA, 64 nt, Homo Sapiens; identical to SEQ ID NO: 32367

SEQ ID NO: 705628 - RNA, 64 nt, Homo Sapiens; identical to SEQ ID NO: 32368

SEQ ID NO: 705629 - RNA, 64 nt, Homo Sapiens; identical to SEQ ID NO: 32369

SEQ ID NO: 705630 - RNA, 64 nt, Homo Sapiens; identical to SEQ ID NO: 32370

SEQ ID NO: 705631 - RNA, 64 nt, Homo Sapiens; identical to SEQ ID NO: 32371

SEQ ID NO: 705632 - RNA, 64 nt, Homo Sapiens; identical to SEQ ID NO: 32372

SEQ ID NO: 705633 - RNA, 64 nt, Homo Sapiens; identical to SEQ ID NO: 32373

SEQ ID NO: 705634 - RNA, 64 nt, Homo Sapiens; identical to SEQ ID NO: 32374

SEQ ID NO: 705635 - RNA, 64 nt, Homo Sapiens; identical to SEQ ID NO: 32375

SEQ ID NO: 705636 - RNA, 64 nt, Homo Sapiens; identical to SEQ ID NO: 32376

SEQ ID NO: 705637 - RNA, 64 nt, Homo Sapiens; identical to SEQ ID NO: 32377

SEQ ID NO: 705638 - RNA, 64 nt, Homo Sapiens; identical to SEQ ID NO: 32378

SEQ ID NO: 705639 - RNA, 64 nt, Homo Sapiens; identical to SEQ ID NO: 32379

SEQ ID NO: 705640 - RNA, 64 nt, Homo Sapiens; identical to SEQ ID NO: 32380

SEQ ID NO: 705641 - RNA, 64 nt, Homo Sapiens; identical to SEQ ID NO: 32381

SEQ ID NO: 705642 - RNA, 64 nt, Homo Sapiens; identical to SEQ ID NO: 32382

SEQ ID NO: 705643 - RNA, 64 nt, Homo Sapiens; identical to SEQ ID NO: 32383

SEQ ID NO: 705644 - RNA, 64 nt, Homo Sapiens; identical to SEQ ID NO: 32384

SEQ ID NO: 705645 - RNA, 64 nt, Homo Sapiens; identical to SEQ ID NO: 32385

SEQ ID NO: 705646 - RNA, 64 nt, Homo Sapiens; identical to SEQ ID NO: 32386

SEQ ID NO: 705647 - RNA, 64 nt, Homo Sapiens; identical to SEQ ID NO: 32387

SEQ ID NO: 705648 - RNA, 64 nt, Homo Sapiens; identical to SEQ ID NO: 32388

SEQ ID NO: 705649 - RNA, 64 nt, Homo Sapiens; identical to SEQ ID NO: 32389

SEQ ID NO: 705650 - RNA, 64 nt, Homo Sapiens; identical to SEQ ID NO: 32390

SEQ ID NO: 705651 - RNA, 64 nt, Homo Sapiens; identical to SEQ ID NO: 32391

SEQ ID NO: 705652 - RNA, 64 nt, Homo Sapiens; identical to SEQ ID NO: 32392

SEQ ID NO: 705653 - RNA, 64 nt, Homo Sapiens; identical to SEQ ID NO: 32393

SEQ ID NO: 705654 - RNA, 64 nt, Homo Sapiens; identical to SEQ ID NO: 32394

SEQ ID NO: 705655 - RNA, 64 nt, Homo Sapiens; identical to SEQ ID NO: 32395

SEQ ID NO: 705656 - RNA, 64 nt, Homo Sapiens; identical to SEQ ID NO: 32396

SEQ ID NO: 705657 - RNA, 64 nt, Homo Sapiens; identical to SEQ ID NO: 32397

SEQ ID NO: 705658 - RNA, 64 nt, Homo Sapiens; identical to SEQ ID NO: 32398

SEQ ID NO: 705659 - RNA, 64 nt, Homo Sapiens; identical to SEQ ID NO: 32399

SEQ ID NO: 705660 - RNA, 64 nt, Homo Sapiens; identical to SEQ ID NO: 32400

SEQ ID NO: 705661 - RNA, 64 nt, Homo Sapiens; identical to SEQ ID NO: 32401

SEQ ID NO: 705662 - RNA, 64 nt, Homo Sapiens; identical to SEQ ID NO: 32402

SEQ ID NO: 705663 - RNA, 64 nt, Homo Sapiens; identical to SEQ ID NO: 32403

SEQ ID NO: 705664 - RNA, 64 nt, Homo Sapiens; identical to SEQ ID NO: 32404

SEQ ID NO: 705665 - RNA, 64 nt, Homo Sapiens; identical to SEQ ID NO: 32405

SEQ ID NO: 705666 - RNA, 64 nt, Homo Sapiens; identical to SEQ ID NO: 32406

SEQ ID NO: 705667 - RNA, 64 nt, Homo Sapiens; identical to SEQ ID NO: 32407

SEQ ID NO: 705668 - RNA, 64 nt, Homo Sapiens; identical to SEQ ID NO: 32408

SEQ ID NO: 705669 - RNA, 64 nt, Homo Sapiens; identical to SEQ ID NO: 32409

SEQ ID NO: 705670 - RNA, 64 nt, Homo Sapiens; identical to SEQ ID NO: 32410

SEQ ID NO: 705671 - RNA, 64 nt, Homo Sapiens; identical to SEQ ID NO: 32411

SEQ ID NO: 705672 - RNA, 64 nt, Homo Sapiens; identical to SEQ ID NO: 32412

SEQ ID NO: 705673 - RNA, 64 nt, Homo Sapiens; identical to SEQ ID NO: 32413

SEQ ID NO: 705674 - RNA, 64 nt, Homo Sapiens; identical to SEQ ID NO: 32414

SEQ ID NO: 705675 - RNA, 64 nt, Homo Sapiens; identical to SEQ ID NO: 32415

SEQ ID NO: 705676 - RNA, 64 nt, Homo Sapiens; identical to SEQ ID NO: 32416

SEQ ID NO: 705677 - RNA, 64 nt, Homo Sapiens; identical to SEQ ID NO: 32417

SEQ ID NO: 705678 - RNA, 64 nt, Homo Sapiens; identical to SEQ ID NO: 32418

SEQ ID NO: 705679 - RNA, 64 nt, Homo Sapiens; identical to SEQ ID NO: 32419

SEQ ID NO: 705680 - RNA, 64 nt, Homo Sapiens; identical to SEQ ID NO: 32420

SEQ ID NO: 705681 - RNA, 64 nt, Homo Sapiens; identical to SEQ ID NO: 32421

SEQ ID NO: 705682 - RNA, 64 nt, Homo Sapiens; identical to SEQ ID NO: 32422

SEQ ID NO: 705683 - RNA, 64 nt, Homo Sapiens; identical to SEQ ID NO: 32423

SEQ ID NO: 705684 - RNA, 64 nt, Homo Sapiens; identical to SEQ ID NO: 32424

SEQ ID NO: 705685 - RNA, 64 nt, Homo Sapiens; identical to SEQ ID NO: 32425

SEQ ID NO: 705686 - RNA, 64 nt, Homo Sapiens; identical to SEQ ID NO: 32426

SEQ ID NO: 705687 - RNA, 64 nt, Homo Sapiens; identical to SEQ ID NO: 32427

SEQ ID NO: 705688 - RNA, 64 nt, Homo Sapiens; identical to SEQ ID NO: 32428

SEQ ID NO: 705689 - RNA, 64 nt, Homo Sapiens; identical to SEQ ID NO: 32429

SEQ ID NO: 705690 - RNA, 64 nt, Homo Sapiens; identical to SEQ ID NO: 32430

SEQ ID NO: 705691 - RNA, 64 nt, Homo Sapiens; identical to SEQ ID NO: 32431

SEQ ID NO: 705692 - RNA, 64 nt, Homo Sapiens; identical to SEQ ID NO: 32432

SEQ ID NO: 705693 - RNA, 64 nt, Homo Sapiens; identical to SEQ ID NO: 32433

SEQ ID NO: 705694 - RNA, 64 nt, Homo Sapiens; identical to SEQ ID NO: 32434

SEQ ID NO: 705695 - RNA, 64 nt, Homo Sapiens; identical to SEQ ID NO: 32435

SEQ ID NO: 705696 - RNA, 64 nt, Homo Sapiens; identical to SEQ ID NO: 32436

SEQ ID NO: 705697 - RNA, 64 nt, Homo Sapiens; identical to SEQ ID NO: 32437

SEQ ID NO: 705698 - RNA, 64 nt, Homo Sapiens; identical to SEQ ID NO: 32438

SEQ ID NO: 705699 - RNA, 64 nt, Homo Sapiens; identical to SEQ ID NO: 32439

SEQ ID NO: 705700 - RNA, 64 nt, Homo Sapiens; identical to SEQ ID NO: 32440

SEQ ID NO: 705701 - RNA, 64 nt, Homo Sapiens; identical to SEQ ID NO: 32441

SEQ ID NO: 705702 - RNA, 64 nt, Homo Sapiens; identical to SEQ ID NO: 32442

SEQ ID NO: 705703 - RNA, 64 nt, Homo Sapiens; identical to SEQ ID NO: 32443

SEQ ID NO: 705704 - RNA, 64 nt, Homo Sapiens; identical to SEQ ID NO: 32444

SEQ ID NO: 705705 - RNA, 64 nt, Homo Sapiens; identical to SEQ ID NO: 32445

SEQ ID NO: 705706 - RNA, 64 nt, Homo Sapiens; identical to SEQ ID NO: 32446

SEQ ID NO: 705707 - RNA, 64 nt, Homo Sapiens; identical to SEQ ID NO: 32447

SEQ ID NO: 705708 - RNA, 64 nt, Homo Sapiens; identical to SEQ ID NO: 32448

SEQ ID NO: 705709 - RNA, 64 nt, Homo Sapiens; identical to SEQ ID NO: 32449

SEQ ID NO: 705710 - RNA, 64 nt, Homo Sapiens; identical to SEQ ID NO: 32450

SEQ ID NO: 705711 - RNA, 64 nt, Homo Sapiens; identical to SEQ ID NO: 32451

SEQ ID NO: 705712 - RNA, 64 nt, Homo Sapiens; identical to SEQ ID NO: 32452

SEQ ID NO: 705713 - RNA, 64 nt, Homo Sapiens; identical to SEQ ID NO: 32453

SEQ ID NO: 705714 - RNA, 64 nt, Homo Sapiens; identical to SEQ ID NO: 32454

SEQ ID NO: 705715 - RNA, 64 nt, Homo Sapiens; identical to SEQ ID NO: 32455

SEQ ID NO: 705716 - RNA, 64 nt, Homo Sapiens; identical to SEQ ID NO: 32456

SEQ ID NO: 705717 - RNA, 64 nt, Homo Sapiens; identical to SEQ ID NO: 32457

SEQ ID NO: 705718 - RNA, 64 nt, Homo Sapiens; identical to SEQ ID NO: 32458

SEQ ID NO: 705719 - RNA, 64 nt, Homo Sapiens; identical to SEQ ID NO: 32459

SEQ ID NO: 705720 - RNA, 64 nt, Homo Sapiens; identical to SEQ ID NO: 32460

SEQ ID NO: 705721 - RNA, 64 nt, Homo Sapiens; identical to SEQ ID NO: 32461

SEQ ID NO: 705722 - RNA, 64 nt, Homo Sapiens; identical to SEQ ID NO: 32462

SEQ ID NO: 705723 - RNA, 64 nt, Homo Sapiens; identical to SEQ ID NO: 32463

SEQ ID NO: 705724 - RNA, 64 nt, Homo Sapiens; identical to SEQ ID NO: 32464

SEQ ID NO: 705725 - RNA, 64 nt, Homo Sapiens; identical to SEQ ID NO: 32465

SEQ ID NO: 705726 - RNA, 64 nt, Homo Sapiens; identical to SEQ ID NO: 32466

SEQ ID NO: 705727 - RNA, 64 nt, Homo Sapiens; identical to SEQ ID NO: 32467

SEQ ID NO: 705728 - RNA, 64 nt, Homo Sapiens; identical to SEQ ID NO: 32468

SEQ ID NO: 705729 - RNA, 64 nt, Homo Sapiens; identical to SEQ ID NO: 32469

SEQ ID NO: 705730 - RNA, 64 nt, Homo Sapiens; identical to SEQ ID NO: 32470

SEQ ID NO: 705731 - RNA, 64 nt, Homo Sapiens; identical to SEQ ID NO: 32471

SEQ ID NO: 705732 - RNA, 64 nt, Homo Sapiens; identical to SEQ ID NO: 32472

SEQ ID NO: 705733 - RNA, 64 nt, Homo Sapiens; identical to SEQ ID NO: 32473

SEQ ID NO: 705734 - RNA, 64 nt, Homo Sapiens; identical to SEQ ID NO: 32474

SEQ ID NO: 705735 - RNA, 64 nt, Homo Sapiens; identical to SEQ ID NO: 32475

SEQ ID NO: 705736 - RNA, 64 nt, Homo Sapiens; identical to SEQ ID NO: 32476

SEQ ID NO: 705737 - RNA, 64 nt, Homo Sapiens; identical to SEQ ID NO: 32477

SEQ ID NO: 705738 - RNA, 64 nt, Homo Sapiens; identical to SEQ ID NO: 32478

SEQ ID NO: 705739 - RNA, 64 nt, Homo Sapiens; identical to SEQ ID NO: 32479

SEQ ID NO: 705740 - RNA, 64 nt, Homo Sapiens; identical to SEQ ID NO: 32480

SEQ ID NO: 705741 - RNA, 64 nt, Homo Sapiens; identical to SEQ ID NO: 32481

SEQ ID NO: 705742 - RNA, 64 nt, Homo Sapiens; identical to SEQ ID NO: 32482

SEQ ID NO: 705743 - RNA, 64 nt, Homo Sapiens; identical to SEQ ID NO: 32483

SEQ ID NO: 705744 - RNA, 64 nt, Homo Sapiens; identical to SEQ ID NO: 32484

SEQ ID NO: 705745 - RNA, 64 nt, Homo Sapiens; identical to SEQ ID NO: 32485

SEQ ID NO: 705746 - RNA, 64 nt, Homo Sapiens; identical to SEQ ID NO: 32486

SEQ ID NO: 705747 - RNA, 64 nt, Homo Sapiens; identical to SEQ ID NO: 32487

SEQ ID NO: 705748 - RNA, 64 nt, Homo Sapiens; identical to SEQ ID NO: 32488

SEQ ID NO: 705749 - RNA, 64 nt, Homo Sapiens; identical to SEQ ID NO: 32489

SEQ ID NO: 705750 - RNA, 64 nt, Homo Sapiens; identical to SEQ ID NO: 32490

SEQ ID NO: 705751 - RNA, 64 nt, Homo Sapiens; identical to SEQ ID NO: 32491

SEQ ID NO: 705752 - RNA, 64 nt, Homo Sapiens; identical to SEQ ID NO: 32492

SEQ ID NO: 705753 - RNA, 64 nt, Homo Sapiens; identical to SEQ ID NO: 32493

SEQ ID NO: 705754 - RNA, 64 nt, Homo Sapiens; identical to SEQ ID NO: 32494

SEQ ID NO: 705755 - RNA, 64 nt, Homo Sapiens; identical to SEQ ID NO: 32495

SEQ ID NO: 705756 - RNA, 64 nt, Homo Sapiens; identical to SEQ ID NO: 32496

SEQ ID NO: 705757 - RNA, 64 nt, Homo Sapiens; identical to SEQ ID NO: 32497

SEQ ID NO: 705758 - RNA, 64 nt, Homo Sapiens; identical to SEQ ID NO: 32498

SEQ ID NO: 705759 - RNA, 64 nt, Homo Sapiens; identical to SEQ ID NO: 32499

SEQ ID NO: 705760 - RNA, 64 nt, Homo Sapiens; identical to SEQ ID NO: 32500

SEQ ID NO: 705761 - RNA, 64 nt, Homo Sapiens; identical to SEQ ID NO: 32501

SEQ ID NO: 705762 - RNA, 64 nt, Homo Sapiens; identical to SEQ ID NO: 32502

SEQ ID NO: 705763 - RNA, 64 nt, Homo Sapiens; identical to SEQ ID NO: 32503

SEQ ID NO: 705764 - RNA, 64 nt, Homo Sapiens; identical to SEQ ID NO: 32504

SEQ ID NO: 705765 - RNA, 64 nt, Homo Sapiens; identical to SEQ ID NO: 32505

SEQ ID NO: 705766 - RNA, 64 nt, Homo Sapiens; identical to SEQ ID NO: 32506

SEQ ID NO: 705767 - RNA, 64 nt, Homo Sapiens; identical to SEQ ID NO: 32507

SEQ ID NO: 705768 - RNA, 64 nt, Homo Sapiens; identical to SEQ ID NO: 32508

SEQ ID NO: 705769 - RNA, 64 nt, Homo Sapiens; identical to SEQ ID NO: 32509

SEQ ID NO: 705770 - RNA, 64 nt, Homo Sapiens; identical to SEQ ID NO: 32510

SEQ ID NO: 705771 - RNA, 64 nt, Homo Sapiens; identical to SEQ ID NO: 32511

SEQ ID NO: 705772 - RNA, 64 nt, Homo Sapiens; identical to SEQ ID NO: 32512

SEQ ID NO: 705773 - RNA, 64 nt, Homo Sapiens; identical to SEQ ID NO: 32513

SEQ ID NO: 705774 - RNA, 64 nt, Homo Sapiens; identical to SEQ ID NO: 32514

SEQ ID NO: 705775 - RNA, 64 nt, Homo Sapiens; identical to SEQ ID NO: 32515

SEQ ID NO: 705776 - RNA, 64 nt, Homo Sapiens; identical to SEQ ID NO: 32516

SEQ ID NO: 705777 - RNA, 64 nt, Homo Sapiens; identical to SEQ ID NO: 32517

SEQ ID NO: 705778 - RNA, 64 nt, Homo Sapiens; identical to SEQ ID NO: 32518

SEQ ID NO: 705779 - RNA, 64 nt, Homo Sapiens; identical to SEQ ID NO: 32519

SEQ ID NO: 705780 - RNA, 64 nt, Homo Sapiens; identical to SEQ ID NO: 32520

SEQ ID NO: 705781 - RNA, 64 nt, Homo Sapiens; identical to SEQ ID NO: 32521

SEQ ID NO: 705782 - RNA, 64 nt, Homo Sapiens; identical to SEQ ID NO: 32522

SEQ ID NO: 705783 - RNA, 64 nt, Homo Sapiens; identical to SEQ ID NO: 32523

SEQ ID NO: 705784 - RNA, 64 nt, Homo Sapiens; identical to SEQ ID NO: 32524

SEQ ID NO: 705785 - RNA, 64 nt, Homo Sapiens; identical to SEQ ID NO: 32525

SEQ ID NO: 705786 - RNA, 64 nt, Homo Sapiens; identical to SEQ ID NO: 32526

SEQ ID NO: 705787 - RNA, 64 nt, Homo Sapiens; identical to SEQ ID NO: 32527

SEQ ID NO: 705788 - RNA, 64 nt, Homo Sapiens; identical to SEQ ID NO: 32528

SEQ ID NO: 705789 - RNA, 64 nt, Homo Sapiens; identical to SEQ ID NO: 32529

SEQ ID NO: 705790 - RNA, 64 nt, Homo Sapiens; identical to SEQ ID NO: 32530

SEQ ID NO: 705791 - RNA, 64 nt, Homo Sapiens; identical to SEQ ID NO: 32531

SEQ ID NO: 705792 - RNA, 64 nt, Homo Sapiens; identical to SEQ ID NO: 32532

SEQ ID NO: 705793 - RNA, 64 nt, Homo Sapiens; identical to SEQ ID NO: 32533

SEQ ID NO: 705794 - RNA, 64 nt, Homo Sapiens; identical to SEQ ID NO: 32534

SEQ ID NO: 705795 - RNA, 64 nt, Homo Sapiens; identical to SEQ ID NO: 32535

SEQ ID NO: 705796 - RNA, 64 nt, Homo Sapiens; identical to SEQ ID NO: 32536

SEQ ID NO: 705797 - RNA, 64 nt, Homo Sapiens; identical to SEQ ID NO: 32537

SEQ ID NO: 705798 - RNA, 64 nt, Homo Sapiens; identical to SEQ ID NO: 32538

SEQ ID NO: 705799 - RNA, 64 nt, Homo Sapiens; identical to SEQ ID NO: 32539

SEQ ID NO: 705800 - RNA, 64 nt, Homo Sapiens; identical to SEQ ID NO: 32540

SEQ ID NO: 705801 - RNA, 64 nt, Homo Sapiens; identical to SEQ ID NO: 32541

SEQ ID NO: 705802 - RNA, 64 nt, Homo Sapiens; identical to SEQ ID NO: 32542

SEQ ID NO: 705803 - RNA, 64 nt, Homo Sapiens; identical to SEQ ID NO: 32543

SEQ ID NO: 705804 - RNA, 64 nt, Homo Sapiens; identical to SEQ ID NO: 32544

SEQ ID NO: 705805 - RNA, 64 nt, Homo Sapiens; identical to SEQ ID NO: 32545

SEQ ID NO: 705806 - RNA, 64 nt, Homo Sapiens; identical to SEQ ID NO: 32546

SEQ ID NO: 705807 - RNA, 64 nt, Homo Sapiens; identical to SEQ ID NO: 32547

SEQ ID NO: 705808 - RNA, 64 nt, Homo Sapiens; identical to SEQ ID NO: 32548

SEQ ID NO: 705809 - RNA, 64 nt, Homo Sapiens; identical to SEQ ID NO: 32549

SEQ ID NO: 705810 - RNA, 64 nt, Homo Sapiens; identical to SEQ ID NO: 32550

SEQ ID NO: 705811 - RNA, 64 nt, Homo Sapiens; identical to SEQ ID NO: 32551

SEQ ID NO: 705812 - RNA, 64 nt, Homo Sapiens; identical to SEQ ID NO: 32552

SEQ ID NO: 705813 - RNA, 64 nt, Homo Sapiens; identical to SEQ ID NO: 32553

SEQ ID NO: 705814 - RNA, 64 nt, Homo Sapiens; identical to SEQ ID NO: 32554

SEQ ID NO: 705815 - RNA, 64 nt, Homo Sapiens; identical to SEQ ID NO: 32555

SEQ ID NO: 705816 - RNA, 64 nt, Homo Sapiens; identical to SEQ ID NO: 32556

SEQ ID NO: 705817 - RNA, 64 nt, Homo Sapiens; identical to SEQ ID NO: 32557

SEQ ID NO: 705818 - RNA, 64 nt, Homo Sapiens; identical to SEQ ID NO: 32558

SEQ ID NO: 705819 - RNA, 64 nt, Homo Sapiens; identical to SEQ ID NO: 32559

SEQ ID NO: 705820 - RNA, 63 nt, Homo Sapiens; identical to SEQ ID NO: 32560

SEQ ID NO: 705821 - RNA, 64 nt, Homo Sapiens; identical to SEQ ID NO: 32561

SEQ ID NO: 705822 - RNA, 64 nt, Homo Sapiens; identical to SEQ ID NO: 32562

SEQ ID NO: 705823 - RNA, 64 nt, Homo Sapiens; identical to SEQ ID NO: 32563

SEQ ID NO: 705824 - RNA, 64 nt, Homo Sapiens; identical to SEQ ID NO: 32564

SEQ ID NO: 705825 - RNA, 64 nt, Homo Sapiens; identical to SEQ ID NO: 32565

SEQ ID NO: 705826 - RNA, 64 nt, Homo Sapiens; identical to SEQ ID NO: 32566

SEQ ID NO: 705827 - RNA, 64 nt, Homo Sapiens; identical to SEQ ID NO: 32567

SEQ ID NO: 705828 - RNA, 64 nt, Homo Sapiens; identical to SEQ ID NO: 32568

SEQ ID NO: 705829 - RNA, 64 nt, Homo Sapiens; identical to SEQ ID NO: 32569

SEQ ID NO: 705830 - RNA, 64 nt, Homo Sapiens; identical to SEQ ID NO: 32570

SEQ ID NO: 705831 - RNA, 64 nt, Homo Sapiens; identical to SEQ ID NO: 32571

SEQ ID NO: 705832 - RNA, 64 nt, Homo Sapiens; identical to SEQ ID NO: 32572

SEQ ID NO: 705833 - RNA, 64 nt, Homo Sapiens; identical to SEQ ID NO: 32573

SEQ ID NO: 705834 - RNA, 64 nt, Homo Sapiens; identical to SEQ ID NO: 32574

SEQ ID NO: 705835 - RNA, 64 nt, Homo Sapiens; identical to SEQ ID NO: 32575

SEQ ID NO: 705836 - RNA, 64 nt, Homo Sapiens; identical to SEQ ID NO: 32576

SEQ ID NO: 705837 - RNA, 64 nt, Homo Sapiens; identical to SEQ ID NO: 32577

SEQ ID NO: 705838 - RNA, 64 nt, Homo Sapiens; identical to SEQ ID NO: 32578

SEQ ID NO: 705839 - RNA, 64 nt, Homo Sapiens; identical to SEQ ID NO: 32579

SEQ ID NO: 705840 - RNA, 64 nt, Homo Sapiens; identical to SEQ ID NO: 32580

SEQ ID NO: 705841 - RNA, 64 nt, Homo Sapiens; identical to SEQ ID NO: 32581

SEQ ID NO: 705842 - RNA, 64 nt, Homo Sapiens; identical to SEQ ID NO: 32582

SEQ ID NO: 705843 - RNA, 64 nt, Homo Sapiens; identical to SEQ ID NO: 32583

SEQ ID NO: 705844 - RNA, 64 nt, Homo Sapiens; identical to SEQ ID NO: 32584

SEQ ID NO: 705845 - RNA, 64 nt, Homo Sapiens; identical to SEQ ID NO: 32585

SEQ ID NO: 705846 - RNA, 64 nt, Homo Sapiens; identical to SEQ ID NO: 32586

SEQ ID NO: 705847 - RNA, 64 nt, Homo Sapiens; identical to SEQ ID NO: 32587

SEQ ID NO: 705848 - RNA, 64 nt, Homo Sapiens; identical to SEQ ID NO: 32588

SEQ ID NO: 705849 - RNA, 64 nt, Homo Sapiens; identical to SEQ ID NO: 32589

SEQ ID NO: 705850 - RNA, 64 nt, Homo Sapiens; identical to SEQ ID NO: 32590

SEQ ID NO: 705851 - RNA, 64 nt, Homo Sapiens; identical to SEQ ID NO: 32591

SEQ ID NO: 705852 - RNA, 64 nt, Homo Sapiens; identical to SEQ ID NO: 32592

SEQ ID NO: 705853 - RNA, 64 nt, Homo Sapiens; identical to SEQ ID NO: 32593

SEQ ID NO: 705854 - RNA, 64 nt, Homo Sapiens; identical to SEQ ID NO: 32594

SEQ ID NO: 705855 - RNA, 64 nt, Homo Sapiens; identical to SEQ ID NO: 32595

SEQ ID NO: 705856 - RNA, 64 nt, Homo Sapiens; identical to SEQ ID NO: 32596

SEQ ID NO: 705857 - RNA, 64 nt, Homo Sapiens; identical to SEQ ID NO: 32597

SEQ ID NO: 705858 - RNA, 64 nt, Homo Sapiens; identical to SEQ ID NO: 32598

SEQ ID NO: 705859 - RNA, 64 nt, Homo Sapiens; identical to SEQ ID NO: 32599

SEQ ID NO: 705860 - RNA, 64 nt, Homo Sapiens; identical to SEQ ID NO: 32600

SEQ ID NO: 705861 - RNA, 64 nt, Homo Sapiens; identical to SEQ ID NO: 32601

SEQ ID NO: 705862 - RNA, 64 nt, Homo Sapiens; identical to SEQ ID NO: 32602

SEQ ID NO: 705863 - RNA, 64 nt, Homo Sapiens; identical to SEQ ID NO: 32603

SEQ ID NO: 705864 - RNA, 64 nt, Homo Sapiens; identical to SEQ ID NO: 32604

SEQ ID NO: 705865 - RNA, 64 nt, Homo Sapiens; identical to SEQ ID NO: 32605

SEQ ID NO: 705866 - RNA, 64 nt, Homo Sapiens; identical to SEQ ID NO: 32606

SEQ ID NO: 705867 - RNA, 64 nt, Homo Sapiens; identical to SEQ ID NO: 32607

SEQ ID NO: 705868 - RNA, 64 nt, Homo Sapiens; identical to SEQ ID NO: 32608

SEQ ID NO: 705869 - RNA, 64 nt, Homo Sapiens; identical to SEQ ID NO: 32609

SEQ ID NO: 705870 - RNA, 64 nt, Homo Sapiens; identical to SEQ ID NO: 32610

SEQ ID NO: 705871 - RNA, 64 nt, Homo Sapiens; identical to SEQ ID NO: 32611

SEQ ID NO: 705872 - RNA, 64 nt, Homo Sapiens; identical to SEQ ID NO: 32612

SEQ ID NO: 705873 - RNA, 64 nt, Homo Sapiens; identical to SEQ ID NO: 32613

SEQ ID NO: 705874 - RNA, 64 nt, Homo Sapiens; identical to SEQ ID NO: 32614

SEQ ID NO: 705875 - RNA, 64 nt, Homo Sapiens; identical to SEQ ID NO: 32615

SEQ ID NO: 705876 - RNA, 64 nt, Homo Sapiens; identical to SEQ ID NO: 32616

SEQ ID NO: 705877 - RNA, 64 nt, Homo Sapiens; identical to SEQ ID NO: 32617

SEQ ID NO: 705878 - RNA, 64 nt, Homo Sapiens; identical to SEQ ID NO: 32618

SEQ ID NO: 705879 - RNA, 64 nt, Homo Sapiens; identical to SEQ ID NO: 32619

SEQ ID NO: 705880 - RNA, 64 nt, Homo Sapiens; identical to SEQ ID NO: 32620

SEQ ID NO: 705881 - RNA, 64 nt, Homo Sapiens; identical to SEQ ID NO: 32621

SEQ ID NO: 705882 - RNA, 64 nt, Homo Sapiens; identical to SEQ ID NO: 32622

SEQ ID NO: 705883 - RNA, 64 nt, Homo Sapiens; identical to SEQ ID NO: 32623

SEQ ID NO: 705884 - RNA, 64 nt, Homo Sapiens; identical to SEQ ID NO: 32624

SEQ ID NO: 705885 - RNA, 64 nt, Homo Sapiens; identical to SEQ ID NO: 32625

SEQ ID NO: 705886 - RNA, 64 nt, Homo Sapiens; identical to SEQ ID NO: 32626

SEQ ID NO: 705887 - RNA, 64 nt, Homo Sapiens; identical to SEQ ID NO: 32627

SEQ ID NO: 705888 - RNA, 64 nt, Homo Sapiens; identical to SEQ ID NO: 32628

SEQ ID NO: 705889 - RNA, 64 nt, Homo Sapiens; identical to SEQ ID NO: 32629

SEQ ID NO: 705890 - RNA, 64 nt, Homo Sapiens; identical to SEQ ID NO: 32630

SEQ ID NO: 705891 - RNA, 64 nt, Homo Sapiens; identical to SEQ ID NO: 32631

SEQ ID NO: 705892 - RNA, 64 nt, Homo Sapiens; identical to SEQ ID NO: 32632

SEQ ID NO: 705893 - RNA, 64 nt, Homo Sapiens; identical to SEQ ID NO: 32633

SEQ ID NO: 705894 - RNA, 64 nt, Homo Sapiens; identical to SEQ ID NO: 32634

SEQ ID NO: 705895 - RNA, 64 nt, Homo Sapiens; identical to SEQ ID NO: 32635

SEQ ID NO: 705896 - RNA, 64 nt, Homo Sapiens; identical to SEQ ID NO: 32636

SEQ ID NO: 705897 - RNA, 64 nt, Homo Sapiens; identical to SEQ ID NO: 32637

SEQ ID NO: 705898 - RNA, 64 nt, Homo Sapiens; identical to SEQ ID NO: 32638

SEQ ID NO: 705899 - RNA, 64 nt, Homo Sapiens; identical to SEQ ID NO: 32639

SEQ ID NO: 705900 - RNA, 64 nt, Homo Sapiens; identical to SEQ ID NO: 32640

SEQ ID NO: 705901 - RNA, 64 nt, Homo Sapiens; identical to SEQ ID NO: 32641

SEQ ID NO: 705902 - RNA, 64 nt, Homo Sapiens; identical to SEQ ID NO: 32642

SEQ ID NO: 705903 - RNA, 64 nt, Homo Sapiens; identical to SEQ ID NO: 32643

SEQ ID NO: 705904 - RNA, 64 nt, Homo Sapiens; identical to SEQ ID NO: 32644

SEQ ID NO: 705905 - RNA, 64 nt, Homo Sapiens; identical to SEQ ID NO: 32645

SEQ ID NO: 705906 - RNA, 64 nt, Homo Sapiens; identical to SEQ ID NO: 32646

SEQ ID NO: 705907 - RNA, 64 nt, Homo Sapiens; identical to SEQ ID NO: 32647

SEQ ID NO: 705908 - RNA, 64 nt, Homo Sapiens; identical to SEQ ID NO: 32648

SEQ ID NO: 705909 - RNA, 64 nt, Homo Sapiens; identical to SEQ ID NO: 32649

SEQ ID NO: 705910 - RNA, 64 nt, Homo Sapiens; identical to SEQ ID NO: 32650

SEQ ID NO: 705911 - RNA, 64 nt, Homo Sapiens; identical to SEQ ID NO: 32651

SEQ ID NO: 705912 - RNA, 64 nt, Homo Sapiens; identical to SEQ ID NO: 32652

SEQ ID NO: 705913 - RNA, 64 nt, Homo Sapiens; identical to SEQ ID NO: 32653

SEQ ID NO: 705914 - RNA, 64 nt, Homo Sapiens; identical to SEQ ID NO: 32654

SEQ ID NO: 705915 - RNA, 64 nt, Homo Sapiens; identical to SEQ ID NO: 32655

SEQ ID NO: 705916 - RNA, 64 nt, Homo Sapiens; identical to SEQ ID NO: 32656

SEQ ID NO: 705917 - RNA, 64 nt, Homo Sapiens; identical to SEQ ID NO: 32657

SEQ ID NO: 705918 - RNA, 64 nt, Homo Sapiens; identical to SEQ ID NO: 32658

SEQ ID NO: 705919 - RNA, 64 nt, Homo Sapiens; identical to SEQ ID NO: 32659

SEQ ID NO: 705920 - RNA, 64 nt, Homo Sapiens; identical to SEQ ID NO: 32660

SEQ ID NO: 705921 - RNA, 64 nt, Homo Sapiens; identical to SEQ ID NO: 32661

SEQ ID NO: 705922 - RNA, 64 nt, Homo Sapiens; identical to SEQ ID NO: 32662

SEQ ID NO: 705923 - RNA, 64 nt, Homo Sapiens; identical to SEQ ID NO: 32663

SEQ ID NO: 705924 - RNA, 64 nt, Homo Sapiens; identical to SEQ ID NO: 32664

SEQ ID NO: 705925 - RNA, 64 nt, Homo Sapiens; identical to SEQ ID NO: 32665

SEQ ID NO: 705926 - RNA, 64 nt, Homo Sapiens; identical to SEQ ID NO: 32666

SEQ ID NO: 705927 - RNA, 64 nt, Homo Sapiens; identical to SEQ ID NO: 32667

SEQ ID NO: 705928 - RNA, 64 nt, Homo Sapiens; identical to SEQ ID NO: 32668

SEQ ID NO: 705929 - RNA, 64 nt, Homo Sapiens; identical to SEQ ID NO: 32669

SEQ ID NO: 705930 - RNA, 64 nt, Homo Sapiens; identical to SEQ ID NO: 32670

SEQ ID NO: 705931 - RNA, 64 nt, Homo Sapiens; identical to SEQ ID NO: 32671

SEQ ID NO: 705932 - RNA, 64 nt, Homo Sapiens; identical to SEQ ID NO: 32672

SEQ ID NO: 705933 - RNA, 64 nt, Homo Sapiens; identical to SEQ ID NO: 32673

SEQ ID NO: 705934 - RNA, 64 nt, Homo Sapiens; identical to SEQ ID NO: 32674

SEQ ID NO: 705935 - RNA, 64 nt, Homo Sapiens; identical to SEQ ID NO: 32675

SEQ ID NO: 705936 - RNA, 64 nt, Homo Sapiens; identical to SEQ ID NO: 32676

SEQ ID NO: 705937 - RNA, 64 nt, Homo Sapiens; identical to SEQ ID NO: 32677

SEQ ID NO: 705938 - RNA, 64 nt, Homo Sapiens; identical to SEQ ID NO: 32678

SEQ ID NO: 705939 - RNA, 64 nt, Homo Sapiens; identical to SEQ ID NO: 32679

SEQ ID NO: 705940 - RNA, 64 nt, Homo Sapiens; identical to SEQ ID NO: 32680

SEQ ID NO: 705941 - RNA, 64 nt, Homo Sapiens; identical to SEQ ID NO: 32681

SEQ ID NO: 705942 - RNA, 64 nt, Homo Sapiens; identical to SEQ ID NO: 32682

SEQ ID NO: 705943 - RNA, 64 nt, Homo Sapiens; identical to SEQ ID NO: 32683

SEQ ID NO: 705944 - RNA, 64 nt, Homo Sapiens; identical to SEQ ID NO: 32684

SEQ ID NO: 705945 - RNA, 64 nt, Homo Sapiens; identical to SEQ ID NO: 32685

SEQ ID NO: 705946 - RNA, 64 nt, Homo Sapiens; identical to SEQ ID NO: 32686

SEQ ID NO: 705947 - RNA, 64 nt, Homo Sapiens; identical to SEQ ID NO: 32687

SEQ ID NO: 705948 - RNA, 64 nt, Homo Sapiens; identical to SEQ ID NO: 32688

SEQ ID NO: 705949 - RNA, 64 nt, Homo Sapiens; identical to SEQ ID NO: 32689

SEQ ID NO: 705950 - RNA, 64 nt, Homo Sapiens; identical to SEQ ID NO: 32690

SEQ ID NO: 705951 - RNA, 64 nt, Homo Sapiens; identical to SEQ ID NO: 32691

SEQ ID NO: 705952 - RNA, 64 nt, Homo Sapiens; identical to SEQ ID NO: 32692

SEQ ID NO: 705953 - RNA, 64 nt, Homo Sapiens; identical to SEQ ID NO: 32693

SEQ ID NO: 705954 - RNA, 64 nt, Homo Sapiens; identical to SEQ ID NO: 32694

SEQ ID NO: 705955 - RNA, 64 nt, Homo Sapiens; identical to SEQ ID NO: 32695

SEQ ID NO: 705956 - RNA, 64 nt, Homo Sapiens; identical to SEQ ID NO: 32696

SEQ ID NO: 705957 - RNA, 64 nt, Homo Sapiens; identical to SEQ ID NO: 32697

SEQ ID NO: 705958 - RNA, 64 nt, Homo Sapiens; identical to SEQ ID NO: 32698

SEQ ID NO: 705959 - RNA, 64 nt, Homo Sapiens; identical to SEQ ID NO: 32699

SEQ ID NO: 705960 - RNA, 64 nt, Homo Sapiens; identical to SEQ ID NO: 32700

SEQ ID NO: 705961 - RNA, 64 nt, Homo Sapiens; identical to SEQ ID NO: 32701

SEQ ID NO: 705962 - RNA, 64 nt, Homo Sapiens; identical to SEQ ID NO: 32702

SEQ ID NO: 705963 - RNA, 64 nt, Homo Sapiens; identical to SEQ ID NO: 32703

SEQ ID NO: 705964 - RNA, 64 nt, Homo Sapiens; identical to SEQ ID NO: 32704

SEQ ID NO: 705965 - RNA, 64 nt, Homo Sapiens; identical to SEQ ID NO: 32705

SEQ ID NO: 705966 - RNA, 64 nt, Homo Sapiens; identical to SEQ ID NO: 32706

SEQ ID NO: 705967 - RNA, 64 nt, Homo Sapiens; identical to SEQ ID NO: 32707

SEQ ID NO: 705968 - RNA, 64 nt, Homo Sapiens; identical to SEQ ID NO: 32708

SEQ ID NO: 705969 - RNA, 64 nt, Homo Sapiens; identical to SEQ ID NO: 32709

SEQ ID NO: 705970 - RNA, 64 nt, Homo Sapiens; identical to SEQ ID NO: 32710

SEQ ID NO: 705971 - RNA, 64 nt, Homo Sapiens; identical to SEQ ID NO: 32711

SEQ ID NO: 705972 - RNA, 64 nt, Homo Sapiens; identical to SEQ ID NO: 32712

SEQ ID NO: 705973 - RNA, 64 nt, Homo Sapiens; identical to SEQ ID NO: 32713

SEQ ID NO: 705974 - RNA, 64 nt, Homo Sapiens; identical to SEQ ID NO: 32714

SEQ ID NO: 705975 - RNA, 64 nt, Homo Sapiens; identical to SEQ ID NO: 32715

SEQ ID NO: 705976 - RNA, 64 nt, Homo Sapiens; identical to SEQ ID NO: 32716

SEQ ID NO: 705977 - RNA, 64 nt, Homo Sapiens; identical to SEQ ID NO: 32717

SEQ ID NO: 705978 - RNA, 64 nt, Homo Sapiens; identical to SEQ ID NO: 32718

SEQ ID NO: 705979 - RNA, 64 nt, Homo Sapiens; identical to SEQ ID NO: 32719

SEQ ID NO: 705980 - RNA, 64 nt, Homo Sapiens; identical to SEQ ID NO: 32720

SEQ ID NO: 705981 - RNA, 64 nt, Homo Sapiens; identical to SEQ ID NO: 32721

SEQ ID NO: 705982 - RNA, 64 nt, Homo Sapiens; identical to SEQ ID NO: 32722

SEQ ID NO: 705983 - RNA, 64 nt, Homo Sapiens; identical to SEQ ID NO: 32723

SEQ ID NO: 705984 - RNA, 64 nt, Homo Sapiens; identical to SEQ ID NO: 32724

SEQ ID NO: 705985 - RNA, 64 nt, Homo Sapiens; identical to SEQ ID NO: 32725

SEQ ID NO: 705986 - RNA, 64 nt, Homo Sapiens; identical to SEQ ID NO: 32726

SEQ ID NO: 705987 - RNA, 64 nt, Homo Sapiens; identical to SEQ ID NO: 32727

SEQ ID NO: 705988 - RNA, 64 nt, Homo Sapiens; identical to SEQ ID NO: 32728

SEQ ID NO: 705989 - RNA, 64 nt, Homo Sapiens; identical to SEQ ID NO: 32729

SEQ ID NO: 705990 - RNA, 64 nt, Homo Sapiens; identical to SEQ ID NO: 32730

SEQ ID NO: 705991 - RNA, 64 nt, Homo Sapiens; identical to SEQ ID NO: 32731

SEQ ID NO: 705992 - RNA, 64 nt, Homo Sapiens; identical to SEQ ID NO: 32732

SEQ ID NO: 705993 - RNA, 64 nt, Homo Sapiens; identical to SEQ ID NO: 32733

SEQ ID NO: 705994 - RNA, 64 nt, Homo Sapiens; identical to SEQ ID NO: 32734

SEQ ID NO: 705995 - RNA, 64 nt, Homo Sapiens; identical to SEQ ID NO: 32735

SEQ ID NO: 705996 - RNA, 64 nt, Homo Sapiens; identical to SEQ ID NO: 32736

SEQ ID NO: 705997 - RNA, 64 nt, Homo Sapiens; identical to SEQ ID NO: 32737

SEQ ID NO: 705998 - RNA, 64 nt, Homo Sapiens; identical to SEQ ID NO: 32738

SEQ ID NO: 705999 - RNA, 64 nt, Homo Sapiens; identical to SEQ ID NO: 32739

SEQ ID NO: 706000 - RNA, 64 nt, Homo Sapiens; identical to SEQ ID NO: 32740

SEQ ID NO: 706001 - RNA, 64 nt, Homo Sapiens; identical to SEQ ID NO: 32741

SEQ ID NO: 706002 - RNA, 64 nt, Homo Sapiens; identical to SEQ ID NO: 32742

SEQ ID NO: 706003 - RNA, 64 nt, Homo Sapiens; identical to SEQ ID NO: 32743

SEQ ID NO: 706004 - RNA, 64 nt, Homo Sapiens; identical to SEQ ID NO: 32744

SEQ ID NO: 706005 - RNA, 64 nt, Homo Sapiens; identical to SEQ ID NO: 32745

SEQ ID NO: 706006 - RNA, 64 nt, Homo Sapiens; identical to SEQ ID NO: 32746

SEQ ID NO: 706007 - RNA, 64 nt, Homo Sapiens; identical to SEQ ID NO: 32747

SEQ ID NO: 706008 - RNA, 64 nt, Homo Sapiens; identical to SEQ ID NO: 32748

SEQ ID NO: 706009 - RNA, 64 nt, Homo Sapiens; identical to SEQ ID NO: 32749

SEQ ID NO: 706010 - RNA, 64 nt, Homo Sapiens; identical to SEQ ID NO: 32750

SEQ ID NO: 706011 - RNA, 64 nt, Homo Sapiens; identical to SEQ ID NO: 32751

SEQ ID NO: 706012 - RNA, 64 nt, Homo Sapiens; identical to SEQ ID NO: 32752

SEQ ID NO: 706013 - RNA, 64 nt, Homo Sapiens; identical to SEQ ID NO: 32753

SEQ ID NO: 706014 - RNA, 64 nt, Homo Sapiens; identical to SEQ ID NO: 32754

SEQ ID NO: 706015 - RNA, 64 nt, Homo Sapiens; identical to SEQ ID NO: 32755

SEQ ID NO: 706016 - RNA, 64 nt, Homo Sapiens; identical to SEQ ID NO: 32756

SEQ ID NO: 706017 - RNA, 64 nt, Homo Sapiens; identical to SEQ ID NO: 32757

SEQ ID NO: 706018 - RNA, 64 nt, Homo Sapiens; identical to SEQ ID NO: 32758

SEQ ID NO: 706019 - RNA, 64 nt, Homo Sapiens; identical to SEQ ID NO: 32759

SEQ ID NO: 706020 - RNA, 64 nt, Homo Sapiens; identical to SEQ ID NO: 32760

SEQ ID NO: 706021 - RNA, 64 nt, Homo Sapiens; identical to SEQ ID NO: 32761

SEQ ID NO: 706022 - RNA, 64 nt, Homo Sapiens; identical to SEQ ID NO: 32762

SEQ ID NO: 706023 - RNA, 64 nt, Homo Sapiens; identical to SEQ ID NO: 32763

SEQ ID NO: 706024 - RNA, 64 nt, Homo Sapiens; identical to SEQ ID NO: 32764

SEQ ID NO: 706025 - RNA, 64 nt, Homo Sapiens; identical to SEQ ID NO: 32765

SEQ ID NO: 706026 - RNA, 64 nt, Homo Sapiens; identical to SEQ ID NO: 32766

SEQ ID NO: 706027 - RNA, 64 nt, Homo Sapiens; identical to SEQ ID NO: 32767

SEQ ID NO: 706028 - RNA, 64 nt, Homo Sapiens; identical to SEQ ID NO: 32768

SEQ ID NO: 706029 - RNA, 64 nt, Homo Sapiens; identical to SEQ ID NO: 32769

SEQ ID NO: 706030 - RNA, 64 nt, Homo Sapiens; identical to SEQ ID NO: 32770

SEQ ID NO: 706031 - RNA, 64 nt, Homo Sapiens; identical to SEQ ID NO: 32771

SEQ ID NO: 706032 - RNA, 64 nt, Homo Sapiens; identical to SEQ ID NO: 32772

SEQ ID NO: 706033 - RNA, 64 nt, Homo Sapiens; identical to SEQ ID NO: 32773

SEQ ID NO: 706034 - RNA, 64 nt, Homo Sapiens; identical to SEQ ID NO: 32774

SEQ ID NO: 706035 - RNA, 64 nt, Homo Sapiens; identical to SEQ ID NO: 32775

SEQ ID NO: 706036 - RNA, 64 nt, Homo Sapiens; identical to SEQ ID NO: 32776

SEQ ID NO: 706037 - RNA, 64 nt, Homo Sapiens; identical to SEQ ID NO: 32777

SEQ ID NO: 706038 - RNA, 64 nt, Homo Sapiens; identical to SEQ ID NO: 32778

SEQ ID NO: 706039 - RNA, 64 nt, Homo Sapiens; identical to SEQ ID NO: 32779

SEQ ID NO: 706040 - RNA, 64 nt, Homo Sapiens; identical to SEQ ID NO: 32780

SEQ ID NO: 706041 - RNA, 64 nt, Homo Sapiens; identical to SEQ ID NO: 32781

SEQ ID NO: 706042 - RNA, 64 nt, Homo Sapiens; identical to SEQ ID NO: 32782

SEQ ID NO: 706043 - RNA, 64 nt, Homo Sapiens; identical to SEQ ID NO: 32783

SEQ ID NO: 706044 - RNA, 64 nt, Homo Sapiens; identical to SEQ ID NO: 32784

SEQ ID NO: 706045 - RNA, 64 nt, Homo Sapiens; identical to SEQ ID NO: 32785

SEQ ID NO: 706046 - RNA, 64 nt, Homo Sapiens; identical to SEQ ID NO: 32786

SEQ ID NO: 706047 - RNA, 64 nt, Homo Sapiens; identical to SEQ ID NO: 32787

SEQ ID NO: 706048 - RNA, 64 nt, Homo Sapiens; identical to SEQ ID NO: 32788

SEQ ID NO: 706049 - RNA, 64 nt, Homo Sapiens; identical to SEQ ID NO: 32789

SEQ ID NO: 706050 - RNA, 64 nt, Homo Sapiens; identical to SEQ ID NO: 32790

SEQ ID NO: 706051 - RNA, 64 nt, Homo Sapiens; identical to SEQ ID NO: 32791

SEQ ID NO: 706052 - RNA, 64 nt, Homo Sapiens; identical to SEQ ID NO: 32792

SEQ ID NO: 706053 - RNA, 64 nt, Homo Sapiens; identical to SEQ ID NO: 32793

SEQ ID NO: 706054 - RNA, 64 nt, Homo Sapiens; identical to SEQ ID NO: 32794

SEQ ID NO: 706055 - RNA, 64 nt, Homo Sapiens; identical to SEQ ID NO: 32795

SEQ ID NO: 706056 - RNA, 64 nt, Homo Sapiens; identical to SEQ ID NO: 32796

SEQ ID NO: 706057 - RNA, 64 nt, Homo Sapiens; identical to SEQ ID NO: 32797

SEQ ID NO: 706058 - RNA, 64 nt, Homo Sapiens; identical to SEQ ID NO: 32798

SEQ ID NO: 706059 - RNA, 64 nt, Homo Sapiens; identical to SEQ ID NO: 32799

SEQ ID NO: 706060 - RNA, 64 nt, Homo Sapiens; identical to SEQ ID NO: 32800

SEQ ID NO: 706061 - RNA, 64 nt, Homo Sapiens; identical to SEQ ID NO: 32801

SEQ ID NO: 706062 - RNA, 64 nt, Homo Sapiens; identical to SEQ ID NO: 32802

SEQ ID NO: 706063 - RNA, 64 nt, Homo Sapiens; identical to SEQ ID NO: 32803

SEQ ID NO: 706064 - RNA, 64 nt, Homo Sapiens; identical to SEQ ID NO: 32804

SEQ ID NO: 706065 - RNA, 64 nt, Homo Sapiens; identical to SEQ ID NO: 32805

SEQ ID NO: 706066 - RNA, 64 nt, Homo Sapiens; identical to SEQ ID NO: 32806

SEQ ID NO: 706067 - RNA, 64 nt, Homo Sapiens; identical to SEQ ID NO: 32807

SEQ ID NO: 706068 - RNA, 64 nt, Homo Sapiens; identical to SEQ ID NO: 32808

SEQ ID NO: 706069 - RNA, 64 nt, Homo Sapiens; identical to SEQ ID NO: 32809

SEQ ID NO: 706070 - RNA, 64 nt, Homo Sapiens; identical to SEQ ID NO: 32810

SEQ ID NO: 706071 - RNA, 64 nt, Homo Sapiens; identical to SEQ ID NO: 32811

SEQ ID NO: 706072 - RNA, 64 nt, Homo Sapiens; identical to SEQ ID NO: 32812

SEQ ID NO: 706073 - RNA, 64 nt, Homo Sapiens; identical to SEQ ID NO: 32813

SEQ ID NO: 706074 - RNA, 64 nt, Homo Sapiens; identical to SEQ ID NO: 32814

SEQ ID NO: 706075 - RNA, 64 nt, Homo Sapiens; identical to SEQ ID NO: 32815

SEQ ID NO: 706076 - RNA, 64 nt, Homo Sapiens; identical to SEQ ID NO: 32816

SEQ ID NO: 706077 - RNA, 64 nt, Homo Sapiens; identical to SEQ ID NO: 32817

SEQ ID NO: 706078 - RNA, 64 nt, Homo Sapiens; identical to SEQ ID NO: 32818

SEQ ID NO: 706079 - RNA, 64 nt, Homo Sapiens; identical to SEQ ID NO: 32819

SEQ ID NO: 706080 - RNA, 64 nt, Homo Sapiens; identical to SEQ ID NO: 32820

SEQ ID NO: 706081 - RNA, 64 nt, Homo Sapiens; identical to SEQ ID NO: 32821

SEQ ID NO: 706082 - RNA, 64 nt, Homo Sapiens; identical to SEQ ID NO: 32822

SEQ ID NO: 706083 - RNA, 64 nt, Homo Sapiens; identical to SEQ ID NO: 32823

SEQ ID NO: 706084 - RNA, 64 nt, Homo Sapiens; identical to SEQ ID NO: 32824

SEQ ID NO: 706085 - RNA, 64 nt, Homo Sapiens; identical to SEQ ID NO: 32825

SEQ ID NO: 706086 - RNA, 64 nt, Homo Sapiens; identical to SEQ ID NO: 32826

SEQ ID NO: 706087 - RNA, 64 nt, Homo Sapiens; identical to SEQ ID NO: 32827

SEQ ID NO: 706088 - RNA, 64 nt, Homo Sapiens; identical to SEQ ID NO: 32828

SEQ ID NO: 706089 - RNA, 64 nt, Homo Sapiens; identical to SEQ ID NO: 32829

SEQ ID NO: 706090 - RNA, 64 nt, Homo Sapiens; identical to SEQ ID NO: 32830

SEQ ID NO: 706091 - RNA, 64 nt, Homo Sapiens; identical to SEQ ID NO: 32831

SEQ ID NO: 706092 - RNA, 64 nt, Homo Sapiens; identical to SEQ ID NO: 32832

SEQ ID NO: 706093 - RNA, 64 nt, Homo Sapiens; identical to SEQ ID NO: 32833

SEQ ID NO: 706094 - RNA, 64 nt, Homo Sapiens; identical to SEQ ID NO: 32834

SEQ ID NO: 706095 - RNA, 64 nt, Homo Sapiens; identical to SEQ ID NO: 32835

SEQ ID NO: 706096 - RNA, 64 nt, Homo Sapiens; identical to SEQ ID NO: 32836

SEQ ID NO: 706097 - RNA, 64 nt, Homo Sapiens; identical to SEQ ID NO: 32837

SEQ ID NO: 706098 - RNA, 64 nt, Homo Sapiens; identical to SEQ ID NO: 32838

SEQ ID NO: 706099 - RNA, 64 nt, Homo Sapiens; identical to SEQ ID NO: 32839

SEQ ID NO: 706100 - RNA, 64 nt, Homo Sapiens; identical to SEQ ID NO: 32840

SEQ ID NO: 706101 - RNA, 64 nt, Homo Sapiens; identical to SEQ ID NO: 32841

SEQ ID NO: 706102 - RNA, 64 nt, Homo Sapiens; identical to SEQ ID NO: 32842

SEQ ID NO: 706103 - RNA, 64 nt, Homo Sapiens; identical to SEQ ID NO: 32843

SEQ ID NO: 706104 - RNA, 64 nt, Homo Sapiens; identical to SEQ ID NO: 32844

SEQ ID NO: 706105 - RNA, 64 nt, Homo Sapiens; identical to SEQ ID NO: 32845

SEQ ID NO: 706106 - RNA, 64 nt, Homo Sapiens; identical to SEQ ID NO: 32846

SEQ ID NO: 706107 - RNA, 64 nt, Homo Sapiens; identical to SEQ ID NO: 32847

SEQ ID NO: 706108 - RNA, 64 nt, Homo Sapiens; identical to SEQ ID NO: 32848

SEQ ID NO: 706109 - RNA, 64 nt, Homo Sapiens; identical to SEQ ID NO: 32849

SEQ ID NO: 706110 - RNA, 64 nt, Homo Sapiens; identical to SEQ ID NO: 32850

SEQ ID NO: 706111 - RNA, 64 nt, Homo Sapiens; identical to SEQ ID NO: 32851

SEQ ID NO: 706112 - RNA, 53 nt, Homo Sapiens; identical to SEQ ID NO: 32852

SEQ ID NO: 706113 - RNA, 52 nt, Homo Sapiens; identical to SEQ ID NO: 32853

SEQ ID NO: 706114 - RNA, 51 nt, Homo Sapiens; identical to SEQ ID NO: 32854

SEQ ID NO: 706115 - RNA, 50 nt, Homo Sapiens; identical to SEQ ID NO: 32855

SEQ ID NO: 706116 - RNA, 64 nt, Homo Sapiens; identical to SEQ ID NO: 32856

SEQ ID NO: 706117 - RNA, 64 nt, Homo Sapiens; identical to SEQ ID NO: 32857

SEQ ID NO: 706118 - RNA, 64 nt, Homo Sapiens; identical to SEQ ID NO: 32858

SEQ ID NO: 706119 - RNA, 64 nt, Homo Sapiens; identical to SEQ ID NO: 32859

SEQ ID NO: 706120 - RNA, 64 nt, Homo Sapiens; identical to SEQ ID NO: 32860

SEQ ID NO: 706121 - RNA, 64 nt, Homo Sapiens; identical to SEQ ID NO: 32861

SEQ ID NO: 706122 - RNA, 64 nt, Homo Sapiens; identical to SEQ ID NO: 32862

SEQ ID NO: 706123 - RNA, 64 nt, Homo Sapiens; identical to SEQ ID NO: 32863

SEQ ID NO: 706124 - RNA, 64 nt, Homo Sapiens; identical to SEQ ID NO: 32864

SEQ ID NO: 706125 - RNA, 64 nt, Homo Sapiens; identical to SEQ ID NO: 32865

SEQ ID NO: 706126 - RNA, 64 nt, Homo Sapiens; identical to SEQ ID NO: 32866

SEQ ID NO: 706127 - RNA, 64 nt, Homo Sapiens; identical to SEQ ID NO: 32867

SEQ ID NO: 706128 - RNA, 64 nt, Homo Sapiens; identical to SEQ ID NO: 32868

SEQ ID NO: 706129 - RNA, 64 nt, Homo Sapiens; identical to SEQ ID NO: 32869

SEQ ID NO: 706130 - RNA, 64 nt, Homo Sapiens; identical to SEQ ID NO: 32870

SEQ ID NO: 706131 - RNA, 64 nt, Homo Sapiens; identical to SEQ ID NO: 32871

SEQ ID NO: 706132 - RNA, 64 nt, Homo Sapiens; identical to SEQ ID NO: 32872

SEQ ID NO: 706133 - RNA, 64 nt, Homo Sapiens; identical to SEQ ID NO: 32873

SEQ ID NO: 706134 - RNA, 64 nt, Homo Sapiens; identical to SEQ ID NO: 32874

SEQ ID NO: 706135 - RNA, 64 nt, Homo Sapiens; identical to SEQ ID NO: 32875

SEQ ID NO: 706136 - RNA, 64 nt, Homo Sapiens; identical to SEQ ID NO: 32876

SEQ ID NO: 706137 - RNA, 64 nt, Homo Sapiens; identical to SEQ ID NO: 32877

SEQ ID NO: 706138 - RNA, 64 nt, Homo Sapiens; identical to SEQ ID NO: 32878

SEQ ID NO: 706139 - RNA, 64 nt, Homo Sapiens; identical to SEQ ID NO: 32879

SEQ ID NO: 706140 - RNA, 64 nt, Homo Sapiens; identical to SEQ ID NO: 32880

SEQ ID NO: 706141 - RNA, 64 nt, Homo Sapiens; identical to SEQ ID NO: 32881

SEQ ID NO: 706142 - RNA, 64 nt, Homo Sapiens; identical to SEQ ID NO: 32882

SEQ ID NO: 706143 - RNA, 64 nt, Homo Sapiens; identical to SEQ ID NO: 32883

SEQ ID NO: 706144 - RNA, 64 nt, Homo Sapiens; identical to SEQ ID NO: 32884

SEQ ID NO: 706145 - RNA, 64 nt, Homo Sapiens; identical to SEQ ID NO: 32885

SEQ ID NO: 706146 - RNA, 64 nt, Homo Sapiens; identical to SEQ ID NO: 32886

SEQ ID NO: 706147 - RNA, 64 nt, Homo Sapiens; identical to SEQ ID NO: 32887

SEQ ID NO: 706148 - RNA, 64 nt, Homo Sapiens; identical to SEQ ID NO: 32888

SEQ ID NO: 706149 - RNA, 64 nt, Homo Sapiens; identical to SEQ ID NO: 32889

SEQ ID NO: 706150 - RNA, 64 nt, Homo Sapiens; identical to SEQ ID NO: 32890

SEQ ID NO: 706151 - RNA, 64 nt, Homo Sapiens; identical to SEQ ID NO: 32891

SEQ ID NO: 706152 - RNA, 64 nt, Homo Sapiens; identical to SEQ ID NO: 32892

SEQ ID NO: 706153 - RNA, 64 nt, Homo Sapiens; identical to SEQ ID NO: 32893

SEQ ID NO: 706154 - RNA, 64 nt, Homo Sapiens; identical to SEQ ID NO: 32894

SEQ ID NO: 706155 - RNA, 64 nt, Homo Sapiens; identical to SEQ ID NO: 32895

SEQ ID NO: 706156 - RNA, 64 nt, Homo Sapiens; identical to SEQ ID NO: 32896

SEQ ID NO: 706157 - RNA, 64 nt, Homo Sapiens; identical to SEQ ID NO: 32897

SEQ ID NO: 706158 - RNA, 64 nt, Homo Sapiens; identical to SEQ ID NO: 32898

SEQ ID NO: 706159 - RNA, 64 nt, Homo Sapiens; identical to SEQ ID NO: 32899

SEQ ID NO: 706160 - RNA, 64 nt, Homo Sapiens; identical to SEQ ID NO: 32900

SEQ ID NO: 706161 - RNA, 64 nt, Homo Sapiens; identical to SEQ ID NO: 32901

SEQ ID NO: 706162 - RNA, 64 nt, Homo Sapiens; identical to SEQ ID NO: 32902

SEQ ID NO: 706163 - RNA, 64 nt, Homo Sapiens; identical to SEQ ID NO: 32903

SEQ ID NO: 706164 - RNA, 64 nt, Homo Sapiens; identical to SEQ ID NO: 32904

SEQ ID NO: 706165 - RNA, 64 nt, Homo Sapiens; identical to SEQ ID NO: 32905

SEQ ID NO: 706166 - RNA, 64 nt, Homo Sapiens; identical to SEQ ID NO: 32906

SEQ ID NO: 706167 - RNA, 64 nt, Homo Sapiens; identical to SEQ ID NO: 32907

SEQ ID NO: 706168 - RNA, 64 nt, Homo Sapiens; identical to SEQ ID NO: 32908

SEQ ID NO: 706169 - RNA, 64 nt, Homo Sapiens; identical to SEQ ID NO: 32909

SEQ ID NO: 706170 - RNA, 64 nt, Homo Sapiens; identical to SEQ ID NO: 32910

SEQ ID NO: 706171 - RNA, 64 nt, Homo Sapiens; identical to SEQ ID NO: 32911

SEQ ID NO: 706172 - RNA, 64 nt, Homo Sapiens; identical to SEQ ID NO: 32912

SEQ ID NO: 706173 - RNA, 64 nt, Homo Sapiens; identical to SEQ ID NO: 32913

SEQ ID NO: 706174 - RNA, 64 nt, Homo Sapiens; identical to SEQ ID NO: 32914

SEQ ID NO: 706175 - RNA, 64 nt, Homo Sapiens; identical to SEQ ID NO: 32915

SEQ ID NO: 706176 - RNA, 64 nt, Homo Sapiens; identical to SEQ ID NO: 32916

SEQ ID NO: 706177 - RNA, 64 nt, Homo Sapiens; identical to SEQ ID NO: 32917

SEQ ID NO: 706178 - RNA, 64 nt, Homo Sapiens; identical to SEQ ID NO: 32918

SEQ ID NO: 706179 - RNA, 64 nt, Homo Sapiens; identical to SEQ ID NO: 32919

SEQ ID NO: 706180 - RNA, 64 nt, Homo Sapiens; identical to SEQ ID NO: 32920

SEQ ID NO: 706181 - RNA, 64 nt, Homo Sapiens; identical to SEQ ID NO: 32921

SEQ ID NO: 706182 - RNA, 64 nt, Homo Sapiens; identical to SEQ ID NO: 32922

SEQ ID NO: 706183 - RNA, 64 nt, Homo Sapiens; identical to SEQ ID NO: 32923

SEQ ID NO: 706184 - RNA, 64 nt, Homo Sapiens; identical to SEQ ID NO: 32924

SEQ ID NO: 706185 - RNA, 64 nt, Homo Sapiens; identical to SEQ ID NO: 32925

SEQ ID NO: 706186 - RNA, 64 nt, Homo Sapiens; identical to SEQ ID NO: 32926

SEQ ID NO: 706187 - RNA, 64 nt, Homo Sapiens; identical to SEQ ID NO: 32927

SEQ ID NO: 706188 - RNA, 64 nt, Homo Sapiens; identical to SEQ ID NO: 32928

SEQ ID NO: 706189 - RNA, 64 nt, Homo Sapiens; identical to SEQ ID NO: 32929

SEQ ID NO: 706190 - RNA, 64 nt, Homo Sapiens; identical to SEQ ID NO: 32930

SEQ ID NO: 706191 - RNA, 64 nt, Homo Sapiens; identical to SEQ ID NO: 32931

SEQ ID NO: 706192 - RNA, 64 nt, Homo Sapiens; identical to SEQ ID NO: 32932

SEQ ID NO: 706193 - RNA, 64 nt, Homo Sapiens; identical to SEQ ID NO: 32933

SEQ ID NO: 706194 - RNA, 64 nt, Homo Sapiens; identical to SEQ ID NO: 32934

SEQ ID NO: 706195 - RNA, 64 nt, Homo Sapiens; identical to SEQ ID NO: 32935

SEQ ID NO: 706196 - RNA, 64 nt, Homo Sapiens; identical to SEQ ID NO: 32936

SEQ ID NO: 706197 - RNA, 64 nt, Homo Sapiens; identical to SEQ ID NO: 32937

SEQ ID NO: 706198 - RNA, 64 nt, Homo Sapiens; identical to SEQ ID NO: 32938

SEQ ID NO: 706199 - RNA, 64 nt, Homo Sapiens; identical to SEQ ID NO: 32939

SEQ ID NO: 706200 - RNA, 64 nt, Homo Sapiens; identical to SEQ ID NO: 32940

SEQ ID NO: 706201 - RNA, 64 nt, Homo Sapiens; identical to SEQ ID NO: 32941

SEQ ID NO: 706202 - RNA, 64 nt, Homo Sapiens; identical to SEQ ID NO: 32942

SEQ ID NO: 706203 - RNA, 64 nt, Homo Sapiens; identical to SEQ ID NO: 32943

SEQ ID NO: 706204 - RNA, 64 nt, Homo Sapiens; identical to SEQ ID NO: 32944

SEQ ID NO: 706205 - RNA, 64 nt, Homo Sapiens; identical to SEQ ID NO: 32945

SEQ ID NO: 706206 - RNA, 64 nt, Homo Sapiens; identical to SEQ ID NO: 32946

SEQ ID NO: 706207 - RNA, 64 nt, Homo Sapiens; identical to SEQ ID NO: 32947

SEQ ID NO: 706208 - RNA, 64 nt, Homo Sapiens; identical to SEQ ID NO: 32948

SEQ ID NO: 706209 - RNA, 64 nt, Homo Sapiens; identical to SEQ ID NO: 32949

SEQ ID NO: 706210 - RNA, 64 nt, Homo Sapiens; identical to SEQ ID NO: 32950

SEQ ID NO: 706211 - RNA, 64 nt, Homo Sapiens; identical to SEQ ID NO: 32951

SEQ ID NO: 706212 - RNA, 64 nt, Homo Sapiens; identical to SEQ ID NO: 32952

SEQ ID NO: 706213 - RNA, 64 nt, Homo Sapiens; identical to SEQ ID NO: 32953

SEQ ID NO: 706214 - RNA, 64 nt, Homo Sapiens; identical to SEQ ID NO: 32954

SEQ ID NO: 706215 - RNA, 64 nt, Homo Sapiens; identical to SEQ ID NO: 32955

SEQ ID NO: 706216 - RNA, 64 nt, Homo Sapiens; identical to SEQ ID NO: 32956

SEQ ID NO: 706217 - RNA, 64 nt, Homo Sapiens; identical to SEQ ID NO: 32957

SEQ ID NO: 706218 - RNA, 64 nt, Homo Sapiens; identical to SEQ ID NO: 32958

SEQ ID NO: 706219 - RNA, 64 nt, Homo Sapiens; identical to SEQ ID NO: 32959

SEQ ID NO: 706220 - RNA, 64 nt, Homo Sapiens; identical to SEQ ID NO: 32960

SEQ ID NO: 706221 - RNA, 64 nt, Homo Sapiens; identical to SEQ ID NO: 32961

SEQ ID NO: 706222 - RNA, 64 nt, Homo Sapiens; identical to SEQ ID NO: 32962

SEQ ID NO: 706223 - RNA, 64 nt, Homo Sapiens; identical to SEQ ID NO: 32963

SEQ ID NO: 706224 - RNA, 64 nt, Homo Sapiens; identical to SEQ ID NO: 32964

SEQ ID NO: 706225 - RNA, 64 nt, Homo Sapiens; identical to SEQ ID NO: 32965

SEQ ID NO: 706226 - RNA, 64 nt, Homo Sapiens; identical to SEQ ID NO: 32966

SEQ ID NO: 706227 - RNA, 64 nt, Homo Sapiens; identical to SEQ ID NO: 32967

SEQ ID NO: 706228 - RNA, 64 nt, Homo Sapiens; identical to SEQ ID NO: 32968

SEQ ID NO: 706229 - RNA, 64 nt, Homo Sapiens; identical to SEQ ID NO: 32969

SEQ ID NO: 706230 - RNA, 64 nt, Homo Sapiens; identical to SEQ ID NO: 32970

SEQ ID NO: 706231 - RNA, 64 nt, Homo Sapiens; identical to SEQ ID NO: 32971

SEQ ID NO: 706232 - RNA, 64 nt, Homo Sapiens; identical to SEQ ID NO: 32972

SEQ ID NO: 706233 - RNA, 64 nt, Homo Sapiens; identical to SEQ ID NO: 32973

SEQ ID NO: 706234 - RNA, 64 nt, Homo Sapiens; identical to SEQ ID NO: 32974

SEQ ID NO: 706235 - RNA, 64 nt, Homo Sapiens; identical to SEQ ID NO: 32975

SEQ ID NO: 706236 - RNA, 64 nt, Homo Sapiens; identical to SEQ ID NO: 32976

SEQ ID NO: 706237 - RNA, 64 nt, Homo Sapiens; identical to SEQ ID NO: 32977

SEQ ID NO: 706238 - RNA, 64 nt, Homo Sapiens; identical to SEQ ID NO: 32978

SEQ ID NO: 706239 - RNA, 64 nt, Homo Sapiens; identical to SEQ ID NO: 32979

SEQ ID NO: 706240 - RNA, 64 nt, Homo Sapiens; identical to SEQ ID NO: 32980

SEQ ID NO: 706241 - RNA, 64 nt, Homo Sapiens; identical to SEQ ID NO: 32981

SEQ ID NO: 706242 - RNA, 64 nt, Homo Sapiens; identical to SEQ ID NO: 32982

SEQ ID NO: 706243 - RNA, 64 nt, Homo Sapiens; identical to SEQ ID NO: 32983

SEQ ID NO: 706244 - RNA, 64 nt, Homo Sapiens; identical to SEQ ID NO: 32984

SEQ ID NO: 706245 - RNA, 64 nt, Homo Sapiens; identical to SEQ ID NO: 32985

SEQ ID NO: 706246 - RNA, 64 nt, Homo Sapiens; identical to SEQ ID NO: 32986

SEQ ID NO: 706247 - RNA, 64 nt, Homo Sapiens; identical to SEQ ID NO: 32987

SEQ ID NO: 706248 - RNA, 64 nt, Homo Sapiens; identical to SEQ ID NO: 32988

SEQ ID NO: 706249 - RNA, 64 nt, Homo Sapiens; identical to SEQ ID NO: 32989

SEQ ID NO: 706250 - RNA, 64 nt, Homo Sapiens; identical to SEQ ID NO: 32990

SEQ ID NO: 706251 - RNA, 64 nt, Homo Sapiens; identical to SEQ ID NO: 32991

SEQ ID NO: 706252 - RNA, 64 nt, Homo Sapiens; identical to SEQ ID NO: 32992

SEQ ID NO: 706253 - RNA, 64 nt, Homo Sapiens; identical to SEQ ID NO: 32993

SEQ ID NO: 706254 - RNA, 64 nt, Homo Sapiens; identical to SEQ ID NO: 32994

SEQ ID NO: 706255 - RNA, 64 nt, Homo Sapiens; identical to SEQ ID NO: 32995

SEQ ID NO: 706256 - RNA, 64 nt, Homo Sapiens; identical to SEQ ID NO: 32996

SEQ ID NO: 706257 - RNA, 64 nt, Homo Sapiens; identical to SEQ ID NO: 32997

SEQ ID NO: 706258 - RNA, 64 nt, Homo Sapiens; identical to SEQ ID NO: 32998

SEQ ID NO: 706259 - RNA, 64 nt, Homo Sapiens; identical to SEQ ID NO: 32999

SEQ ID NO: 706260 - RNA, 64 nt, Homo Sapiens; identical to SEQ ID NO: 33000

SEQ ID NO: 706261 - RNA, 64 nt, Homo Sapiens; identical to SEQ ID NO: 33001

SEQ ID NO: 706262 - RNA, 64 nt, Homo Sapiens; identical to SEQ ID NO: 33002

SEQ ID NO: 706263 - RNA, 64 nt, Homo Sapiens; identical to SEQ ID NO: 33003

SEQ ID NO: 706264 - RNA, 64 nt, Homo Sapiens; identical to SEQ ID NO: 33004

SEQ ID NO: 706265 - RNA, 64 nt, Homo Sapiens; identical to SEQ ID NO: 33005

SEQ ID NO: 706266 - RNA, 64 nt, Homo Sapiens; identical to SEQ ID NO: 33006

SEQ ID NO: 706267 - RNA, 64 nt, Homo Sapiens; identical to SEQ ID NO: 33007

SEQ ID NO: 706268 - RNA, 64 nt, Homo Sapiens; identical to SEQ ID NO: 33008

SEQ ID NO: 706269 - RNA, 64 nt, Homo Sapiens; identical to SEQ ID NO: 33009

SEQ ID NO: 706270 - RNA, 64 nt, Homo Sapiens; identical to SEQ ID NO: 33010

SEQ ID NO: 706271 - RNA, 64 nt, Homo Sapiens; identical to SEQ ID NO: 33011

SEQ ID NO: 706272 - RNA, 64 nt, Homo Sapiens; identical to SEQ ID NO: 33012

SEQ ID NO: 706273 - RNA, 64 nt, Homo Sapiens; identical to SEQ ID NO: 33013

SEQ ID NO: 706274 - RNA, 64 nt, Homo Sapiens; identical to SEQ ID NO: 33014

SEQ ID NO: 706275 - RNA, 64 nt, Homo Sapiens; identical to SEQ ID NO: 33015

SEQ ID NO: 706276 - RNA, 64 nt, Homo Sapiens; identical to SEQ ID NO: 33016

SEQ ID NO: 706277 - RNA, 64 nt, Homo Sapiens; identical to SEQ ID NO: 33017

SEQ ID NO: 706278 - RNA, 64 nt, Homo Sapiens; identical to SEQ ID NO: 33018

SEQ ID NO: 706279 - RNA, 64 nt, Homo Sapiens; identical to SEQ ID NO: 33019

SEQ ID NO: 706280 - RNA, 64 nt, Homo Sapiens; identical to SEQ ID NO: 33020

SEQ ID NO: 706281 - RNA, 64 nt, Homo Sapiens; identical to SEQ ID NO: 33021

SEQ ID NO: 706282 - RNA, 64 nt, Homo Sapiens; identical to SEQ ID NO: 33022

SEQ ID NO: 706283 - RNA, 64 nt, Homo Sapiens; identical to SEQ ID NO: 33023

SEQ ID NO: 706284 - RNA, 64 nt, Homo Sapiens; identical to SEQ ID NO: 33024

SEQ ID NO: 706285 - RNA, 64 nt, Homo Sapiens; identical to SEQ ID NO: 33025

SEQ ID NO: 706286 - RNA, 64 nt, Homo Sapiens; identical to SEQ ID NO: 33026

SEQ ID NO: 706287 - RNA, 64 nt, Homo Sapiens; identical to SEQ ID NO: 33027

SEQ ID NO: 706288 - RNA, 64 nt, Homo Sapiens; identical to SEQ ID NO: 33028

SEQ ID NO: 706289 - RNA, 64 nt, Homo Sapiens; identical to SEQ ID NO: 33029

SEQ ID NO: 706290 - RNA, 64 nt, Homo Sapiens; identical to SEQ ID NO: 33030

SEQ ID NO: 706291 - RNA, 64 nt, Homo Sapiens; identical to SEQ ID NO: 33031

SEQ ID NO: 706292 - RNA, 64 nt, Homo Sapiens; identical to SEQ ID NO: 33032

SEQ ID NO: 706293 - RNA, 64 nt, Homo Sapiens; identical to SEQ ID NO: 33033

SEQ ID NO: 706294 - RNA, 64 nt, Homo Sapiens; identical to SEQ ID NO: 33034

SEQ ID NO: 706295 - RNA, 64 nt, Homo Sapiens; identical to SEQ ID NO: 33035

SEQ ID NO: 706296 - RNA, 64 nt, Homo Sapiens; identical to SEQ ID NO: 33036

SEQ ID NO: 706297 - RNA, 64 nt, Homo Sapiens; identical to SEQ ID NO: 33037

SEQ ID NO: 706298 - RNA, 64 nt, Homo Sapiens; identical to SEQ ID NO: 33038

SEQ ID NO: 706299 - RNA, 64 nt, Homo Sapiens; identical to SEQ ID NO: 33039

SEQ ID NO: 706300 - RNA, 64 nt, Homo Sapiens; identical to SEQ ID NO: 33040

SEQ ID NO: 706301 - RNA, 64 nt, Homo Sapiens; identical to SEQ ID NO: 33041

SEQ ID NO: 706302 - RNA, 64 nt, Homo Sapiens; identical to SEQ ID NO: 33042

SEQ ID NO: 706303 - RNA, 64 nt, Homo Sapiens; identical to SEQ ID NO: 33043

SEQ ID NO: 706304 - RNA, 64 nt, Homo Sapiens; identical to SEQ ID NO: 33044

SEQ ID NO: 706305 - RNA, 64 nt, Homo Sapiens; identical to SEQ ID NO: 33045

SEQ ID NO: 706306 - RNA, 64 nt, Homo Sapiens; identical to SEQ ID NO: 33046

SEQ ID NO: 706307 - RNA, 64 nt, Homo Sapiens; identical to SEQ ID NO: 33047

SEQ ID NO: 706308 - RNA, 64 nt, Homo Sapiens; identical to SEQ ID NO: 33048

SEQ ID NO: 706309 - RNA, 64 nt, Homo Sapiens; identical to SEQ ID NO: 33049

SEQ ID NO: 706310 - RNA, 64 nt, Homo Sapiens; identical to SEQ ID NO: 33050

SEQ ID NO: 706311 - RNA, 64 nt, Homo Sapiens; identical to SEQ ID NO: 33051

SEQ ID NO: 706312 - RNA, 64 nt, Homo Sapiens; identical to SEQ ID NO: 33052

SEQ ID NO: 706313 - RNA, 64 nt, Homo Sapiens; identical to SEQ ID NO: 33053

SEQ ID NO: 706314 - RNA, 64 nt, Homo Sapiens; identical to SEQ ID NO: 33054

SEQ ID NO: 706315 - RNA, 64 nt, Homo Sapiens; identical to SEQ ID NO: 33055

SEQ ID NO: 706316 - RNA, 64 nt, Homo Sapiens; identical to SEQ ID NO: 33056

SEQ ID NO: 706317 - RNA, 64 nt, Homo Sapiens; identical to SEQ ID NO: 33057

SEQ ID NO: 706318 - RNA, 64 nt, Homo Sapiens; identical to SEQ ID NO: 33058

SEQ ID NO: 706319 - RNA, 64 nt, Homo Sapiens; identical to SEQ ID NO: 33059

SEQ ID NO: 706320 - RNA, 64 nt, Homo Sapiens; identical to SEQ ID NO: 33060

SEQ ID NO: 706321 - RNA, 64 nt, Homo Sapiens; identical to SEQ ID NO: 33061

SEQ ID NO: 706322 - RNA, 64 nt, Homo Sapiens; identical to SEQ ID NO: 33062

SEQ ID NO: 706323 - RNA, 64 nt, Homo Sapiens; identical to SEQ ID NO: 33063

SEQ ID NO: 706324 - RNA, 64 nt, Homo Sapiens; identical to SEQ ID NO: 33064

SEQ ID NO: 706325 - RNA, 64 nt, Homo Sapiens; identical to SEQ ID NO: 33065

SEQ ID NO: 706326 - RNA, 64 nt, Homo Sapiens; identical to SEQ ID NO: 33066

SEQ ID NO: 706327 - RNA, 58 nt, Homo Sapiens; identical to SEQ ID NO: 33067

SEQ ID NO: 706328 - RNA, 59 nt, Homo Sapiens; identical to SEQ ID NO: 33068

SEQ ID NO: 706329 - RNA, 60 nt, Homo Sapiens; identical to SEQ ID NO: 33069

SEQ ID NO: 706330 - RNA, 61 nt, Homo Sapiens; identical to SEQ ID NO: 33070

SEQ ID NO: 706331 - RNA, 64 nt, Homo Sapiens; identical to SEQ ID NO: 33071

SEQ ID NO: 706332 - RNA, 64 nt, Homo Sapiens; identical to SEQ ID NO: 33072

SEQ ID NO: 706333 - RNA, 64 nt, Homo Sapiens; identical to SEQ ID NO: 33073

SEQ ID NO: 706334 - RNA, 64 nt, Homo Sapiens; identical to SEQ ID NO: 33074

SEQ ID NO: 706335 - RNA, 64 nt, Homo Sapiens; identical to SEQ ID NO: 33075

SEQ ID NO: 706336 - RNA, 64 nt, Homo Sapiens; identical to SEQ ID NO: 33076

SEQ ID NO: 706337 - RNA, 64 nt, Homo Sapiens; identical to SEQ ID NO: 33077

SEQ ID NO: 706338 - RNA, 64 nt, Homo Sapiens; identical to SEQ ID NO: 33078

SEQ ID NO: 706339 - RNA, 64 nt, Homo Sapiens; identical to SEQ ID NO: 33079

SEQ ID NO: 706340 - RNA, 64 nt, Homo Sapiens; identical to SEQ ID NO: 33080

SEQ ID NO: 706341 - RNA, 64 nt, Homo Sapiens; identical to SEQ ID NO: 33081

SEQ ID NO: 706342 - RNA, 64 nt, Homo Sapiens; identical to SEQ ID NO: 33082

SEQ ID NO: 706343 - RNA, 64 nt, Homo Sapiens; identical to SEQ ID NO: 33083

SEQ ID NO: 706344 - RNA, 64 nt, Homo Sapiens; identical to SEQ ID NO: 33084

SEQ ID NO: 706345 - RNA, 64 nt, Homo Sapiens; identical to SEQ ID NO: 33085

SEQ ID NO: 706346 - RNA, 64 nt, Homo Sapiens; identical to SEQ ID NO: 33086

SEQ ID NO: 706347 - RNA, 64 nt, Homo Sapiens; identical to SEQ ID NO: 33087

SEQ ID NO: 706348 - RNA, 64 nt, Homo Sapiens; identical to SEQ ID NO: 33088

SEQ ID NO: 706349 - RNA, 64 nt, Homo Sapiens; identical to SEQ ID NO: 33089

SEQ ID NO: 706350 - RNA, 64 nt, Homo Sapiens; identical to SEQ ID NO: 33090

SEQ ID NO: 706351 - RNA, 64 nt, Homo Sapiens; identical to SEQ ID NO: 33091

SEQ ID NO: 706352 - RNA, 64 nt, Homo Sapiens; identical to SEQ ID NO: 33092

SEQ ID NO: 706353 - RNA, 64 nt, Homo Sapiens; identical to SEQ ID NO: 33093

SEQ ID NO: 706354 - RNA, 64 nt, Homo Sapiens; identical to SEQ ID NO: 33094

SEQ ID NO: 706355 - RNA, 64 nt, Homo Sapiens; identical to SEQ ID NO: 33095

SEQ ID NO: 706356 - RNA, 64 nt, Homo Sapiens; identical to SEQ ID NO: 33096

SEQ ID NO: 706357 - RNA, 64 nt, Homo Sapiens; identical to SEQ ID NO: 33097

SEQ ID NO: 706358 - RNA, 64 nt, Homo Sapiens; identical to SEQ ID NO: 33098

SEQ ID NO: 706359 - RNA, 64 nt, Homo Sapiens; identical to SEQ ID NO: 33099

SEQ ID NO: 706360 - RNA, 64 nt, Homo Sapiens; identical to SEQ ID NO: 33100

SEQ ID NO: 706361 - RNA, 64 nt, Homo Sapiens; identical to SEQ ID NO: 33101

SEQ ID NO: 706362 - RNA, 64 nt, Homo Sapiens; identical to SEQ ID NO: 33102

SEQ ID NO: 706363 - RNA, 64 nt, Homo Sapiens; identical to SEQ ID NO: 33103

SEQ ID NO: 706364 - RNA, 64 nt, Homo Sapiens; identical to SEQ ID NO: 33104

SEQ ID NO: 706365 - RNA, 64 nt, Homo Sapiens; identical to SEQ ID NO: 33105

SEQ ID NO: 706366 - RNA, 64 nt, Homo Sapiens; identical to SEQ ID NO: 33106

SEQ ID NO: 706367 - RNA, 64 nt, Homo Sapiens; identical to SEQ ID NO: 33107

SEQ ID NO: 706368 - RNA, 64 nt, Homo Sapiens; identical to SEQ ID NO: 33108

SEQ ID NO: 706369 - RNA, 64 nt, Homo Sapiens; identical to SEQ ID NO: 33109

SEQ ID NO: 706370 - RNA, 64 nt, Homo Sapiens; identical to SEQ ID NO: 33110

SEQ ID NO: 706371 - RNA, 64 nt, Homo Sapiens; identical to SEQ ID NO: 33111

SEQ ID NO: 706372 - RNA, 64 nt, Homo Sapiens; identical to SEQ ID NO: 33112

SEQ ID NO: 706373 - RNA, 64 nt, Homo Sapiens; identical to SEQ ID NO: 33113

SEQ ID NO: 706374 - RNA, 64 nt, Homo Sapiens; identical to SEQ ID NO: 33114

SEQ ID NO: 706375 - RNA, 64 nt, Homo Sapiens; identical to SEQ ID NO: 33115

SEQ ID NO: 706376 - RNA, 64 nt, Homo Sapiens; identical to SEQ ID NO: 33116

SEQ ID NO: 706377 - RNA, 64 nt, Homo Sapiens; identical to SEQ ID NO: 33117

SEQ ID NO: 706378 - RNA, 64 nt, Homo Sapiens; identical to SEQ ID NO: 33118

SEQ ID NO: 706379 - RNA, 64 nt, Homo Sapiens; identical to SEQ ID NO: 33119

SEQ ID NO: 706380 - RNA, 64 nt, Homo Sapiens; identical to SEQ ID NO: 33120

SEQ ID NO: 706381 - RNA, 64 nt, Homo Sapiens; identical to SEQ ID NO: 33121

SEQ ID NO: 706382 - RNA, 64 nt, Homo Sapiens; identical to SEQ ID NO: 33122

SEQ ID NO: 706383 - RNA, 64 nt, Homo Sapiens; identical to SEQ ID NO: 33123

SEQ ID NO: 706384 - RNA, 64 nt, Homo Sapiens; identical to SEQ ID NO: 33124

SEQ ID NO: 706385 - RNA, 64 nt, Homo Sapiens; identical to SEQ ID NO: 33125

SEQ ID NO: 706386 - RNA, 64 nt, Homo Sapiens; identical to SEQ ID NO: 33126

SEQ ID NO: 706387 - RNA, 64 nt, Homo Sapiens; identical to SEQ ID NO: 33127

SEQ ID NO: 706388 - RNA, 64 nt, Homo Sapiens; identical to SEQ ID NO: 33128

SEQ ID NO: 706389 - RNA, 64 nt, Homo Sapiens; identical to SEQ ID NO: 33129

SEQ ID NO: 706390 - RNA, 64 nt, Homo Sapiens; identical to SEQ ID NO: 33130

SEQ ID NO: 706391 - RNA, 64 nt, Homo Sapiens; identical to SEQ ID NO: 33131

SEQ ID NO: 706392 - RNA, 64 nt, Homo Sapiens; identical to SEQ ID NO: 33132

SEQ ID NO: 706393 - RNA, 64 nt, Homo Sapiens; identical to SEQ ID NO: 33133

SEQ ID NO: 706394 - RNA, 64 nt, Homo Sapiens; identical to SEQ ID NO: 33134

SEQ ID NO: 706395 - RNA, 64 nt, Homo Sapiens; identical to SEQ ID NO: 33135

SEQ ID NO: 706396 - RNA, 64 nt, Homo Sapiens; identical to SEQ ID NO: 33136

SEQ ID NO: 706397 - RNA, 64 nt, Homo Sapiens; identical to SEQ ID NO: 33137

SEQ ID NO: 706398 - RNA, 64 nt, Homo Sapiens; identical to SEQ ID NO: 33138

SEQ ID NO: 706399 - RNA, 64 nt, Homo Sapiens; identical to SEQ ID NO: 33139

SEQ ID NO: 706400 - RNA, 64 nt, Homo Sapiens; identical to SEQ ID NO: 33140

SEQ ID NO: 706401 - RNA, 64 nt, Homo Sapiens; identical to SEQ ID NO: 33141

SEQ ID NO: 706402 - RNA, 64 nt, Homo Sapiens; identical to SEQ ID NO: 33142

SEQ ID NO: 706403 - RNA, 64 nt, Homo Sapiens; identical to SEQ ID NO: 33143

SEQ ID NO: 706404 - RNA, 64 nt, Homo Sapiens; identical to SEQ ID NO: 33144

SEQ ID NO: 706405 - RNA, 64 nt, Homo Sapiens; identical to SEQ ID NO: 33145

SEQ ID NO: 706406 - RNA, 64 nt, Homo Sapiens; identical to SEQ ID NO: 33146

SEQ ID NO: 706407 - RNA, 64 nt, Homo Sapiens; identical to SEQ ID NO: 33147

SEQ ID NO: 706408 - RNA, 64 nt, Homo Sapiens; identical to SEQ ID NO: 33148

SEQ ID NO: 706409 - RNA, 64 nt, Homo Sapiens; identical to SEQ ID NO: 33149

SEQ ID NO: 706410 - RNA, 64 nt, Homo Sapiens; identical to SEQ ID NO: 33150

SEQ ID NO: 706411 - RNA, 64 nt, Homo Sapiens; identical to SEQ ID NO: 33151

SEQ ID NO: 706412 - RNA, 64 nt, Homo Sapiens; identical to SEQ ID NO: 33152

SEQ ID NO: 706413 - RNA, 64 nt, Homo Sapiens; identical to SEQ ID NO: 33153

SEQ ID NO: 706414 - RNA, 64 nt, Homo Sapiens; identical to SEQ ID NO: 33154

SEQ ID NO: 706415 - RNA, 64 nt, Homo Sapiens; identical to SEQ ID NO: 33155

SEQ ID NO: 706416 - RNA, 64 nt, Homo Sapiens; identical to SEQ ID NO: 33156

SEQ ID NO: 706417 - RNA, 64 nt, Homo Sapiens; identical to SEQ ID NO: 33157

SEQ ID NO: 706418 - RNA, 64 nt, Homo Sapiens; identical to SEQ ID NO: 33158

SEQ ID NO: 706419 - RNA, 64 nt, Homo Sapiens; identical to SEQ ID NO: 33159

SEQ ID NO: 706420 - RNA, 64 nt, Homo Sapiens; identical to SEQ ID NO: 33160

SEQ ID NO: 706421 - RNA, 64 nt, Homo Sapiens; identical to SEQ ID NO: 33161

SEQ ID NO: 706422 - RNA, 64 nt, Homo Sapiens; identical to SEQ ID NO: 33162

SEQ ID NO: 706423 - RNA, 64 nt, Homo Sapiens; identical to SEQ ID NO: 33163

SEQ ID NO: 706424 - RNA, 64 nt, Homo Sapiens; identical to SEQ ID NO: 33164

SEQ ID NO: 706425 - RNA, 64 nt, Homo Sapiens; identical to SEQ ID NO: 33165

SEQ ID NO: 706426 - RNA, 64 nt, Homo Sapiens; identical to SEQ ID NO: 33166

SEQ ID NO: 706427 - RNA, 64 nt, Homo Sapiens; identical to SEQ ID NO: 33167

SEQ ID NO: 706428 - RNA, 64 nt, Homo Sapiens; identical to SEQ ID NO: 33168

SEQ ID NO: 706429 - RNA, 64 nt, Homo Sapiens; identical to SEQ ID NO: 33169

SEQ ID NO: 706430 - RNA, 64 nt, Homo Sapiens; identical to SEQ ID NO: 33170

SEQ ID NO: 706431 - RNA, 64 nt, Homo Sapiens; identical to SEQ ID NO: 33171

SEQ ID NO: 706432 - RNA, 64 nt, Homo Sapiens; identical to SEQ ID NO: 33172

SEQ ID NO: 706433 - RNA, 64 nt, Homo Sapiens; identical to SEQ ID NO: 33173

SEQ ID NO: 706434 - RNA, 64 nt, Homo Sapiens; identical to SEQ ID NO: 33174

SEQ ID NO: 706435 - RNA, 64 nt, Homo Sapiens; identical to SEQ ID NO: 33175

SEQ ID NO: 706436 - RNA, 64 nt, Homo Sapiens; identical to SEQ ID NO: 33176

SEQ ID NO: 706437 - RNA, 64 nt, Homo Sapiens; identical to SEQ ID NO: 33177

SEQ ID NO: 706438 - RNA, 64 nt, Homo Sapiens; identical to SEQ ID NO: 33178

SEQ ID NO: 706439 - RNA, 64 nt, Homo Sapiens; identical to SEQ ID NO: 33179

SEQ ID NO: 706440 - RNA, 64 nt, Homo Sapiens; identical to SEQ ID NO: 33180

SEQ ID NO: 706441 - RNA, 64 nt, Homo Sapiens; identical to SEQ ID NO: 33181

SEQ ID NO: 706442 - RNA, 64 nt, Homo Sapiens; identical to SEQ ID NO: 33182

SEQ ID NO: 706443 - RNA, 64 nt, Homo Sapiens; identical to SEQ ID NO: 33183

SEQ ID NO: 706444 - RNA, 64 nt, Homo Sapiens; identical to SEQ ID NO: 33184

SEQ ID NO: 706445 - RNA, 64 nt, Homo Sapiens; identical to SEQ ID NO: 33185

SEQ ID NO: 706446 - RNA, 64 nt, Homo Sapiens; identical to SEQ ID NO: 33186

SEQ ID NO: 706447 - RNA, 64 nt, Homo Sapiens; identical to SEQ ID NO: 33187

SEQ ID NO: 706448 - RNA, 64 nt, Homo Sapiens; identical to SEQ ID NO: 33188

SEQ ID NO: 706449 - RNA, 64 nt, Homo Sapiens; identical to SEQ ID NO: 33189

SEQ ID NO: 706450 - RNA, 64 nt, Homo Sapiens; identical to SEQ ID NO: 33190

SEQ ID NO: 706451 - RNA, 64 nt, Homo Sapiens; identical to SEQ ID NO: 33191

SEQ ID NO: 706452 - RNA, 64 nt, Homo Sapiens; identical to SEQ ID NO: 33192

SEQ ID NO: 706453 - RNA, 64 nt, Homo Sapiens; identical to SEQ ID NO: 33193

SEQ ID NO: 706454 - RNA, 64 nt, Homo Sapiens; identical to SEQ ID NO: 33194

SEQ ID NO: 706455 - RNA, 64 nt, Homo Sapiens; identical to SEQ ID NO: 33195

SEQ ID NO: 706456 - RNA, 64 nt, Homo Sapiens; identical to SEQ ID NO: 33196

SEQ ID NO: 706457 - RNA, 64 nt, Homo Sapiens; identical to SEQ ID NO: 33197

SEQ ID NO: 706458 - RNA, 64 nt, Homo Sapiens; identical to SEQ ID NO: 33198

SEQ ID NO: 706459 - RNA, 64 nt, Homo Sapiens; identical to SEQ ID NO: 33199

SEQ ID NO: 706460 - RNA, 64 nt, Homo Sapiens; identical to SEQ ID NO: 33200

SEQ ID NO: 706461 - RNA, 64 nt, Homo Sapiens; identical to SEQ ID NO: 33201

SEQ ID NO: 706462 - RNA, 64 nt, Homo Sapiens; identical to SEQ ID NO: 33202

SEQ ID NO: 706463 - RNA, 64 nt, Homo Sapiens; identical to SEQ ID NO: 33203

SEQ ID NO: 706464 - RNA, 64 nt, Homo Sapiens; identical to SEQ ID NO: 33204

SEQ ID NO: 706465 - RNA, 64 nt, Homo Sapiens; identical to SEQ ID NO: 33205

SEQ ID NO: 706466 - RNA, 64 nt, Homo Sapiens; identical to SEQ ID NO: 33206

SEQ ID NO: 706467 - RNA, 64 nt, Homo Sapiens; identical to SEQ ID NO: 33207

SEQ ID NO: 706468 - RNA, 64 nt, Homo Sapiens; identical to SEQ ID NO: 33208

SEQ ID NO: 706469 - RNA, 64 nt, Homo Sapiens; identical to SEQ ID NO: 33209

SEQ ID NO: 706470 - RNA, 64 nt, Homo Sapiens; identical to SEQ ID NO: 33210

SEQ ID NO: 706471 - RNA, 64 nt, Homo Sapiens; identical to SEQ ID NO: 33211

SEQ ID NO: 706472 - RNA, 64 nt, Homo Sapiens; identical to SEQ ID NO: 33212

SEQ ID NO: 706473 - RNA, 64 nt, Homo Sapiens; identical to SEQ ID NO: 33213

SEQ ID NO: 706474 - RNA, 64 nt, Homo Sapiens; identical to SEQ ID NO: 33214

SEQ ID NO: 706475 - RNA, 64 nt, Homo Sapiens; identical to SEQ ID NO: 33215

SEQ ID NO: 706476 - RNA, 64 nt, Homo Sapiens; identical to SEQ ID NO: 33216

SEQ ID NO: 706477 - RNA, 64 nt, Homo Sapiens; identical to SEQ ID NO: 33217

SEQ ID NO: 706478 - RNA, 64 nt, Homo Sapiens; identical to SEQ ID NO: 33218

SEQ ID NO: 706479 - RNA, 64 nt, Homo Sapiens; identical to SEQ ID NO: 33219

SEQ ID NO: 706480 - RNA, 64 nt, Homo Sapiens; identical to SEQ ID NO: 33220

SEQ ID NO: 706481 - RNA, 64 nt, Homo Sapiens; identical to SEQ ID NO: 33221

SEQ ID NO: 706482 - RNA, 64 nt, Homo Sapiens; identical to SEQ ID NO: 33222

SEQ ID NO: 706483 - RNA, 64 nt, Homo Sapiens; identical to SEQ ID NO: 33223

SEQ ID NO: 706484 - RNA, 64 nt, Homo Sapiens; identical to SEQ ID NO: 33224

SEQ ID NO: 706485 - RNA, 64 nt, Homo Sapiens; identical to SEQ ID NO: 33225

SEQ ID NO: 706486 - RNA, 64 nt, Homo Sapiens; identical to SEQ ID NO: 33226

SEQ ID NO: 706487 - RNA, 64 nt, Homo Sapiens; identical to SEQ ID NO: 33227

SEQ ID NO: 706488 - RNA, 64 nt, Homo Sapiens; identical to SEQ ID NO: 33228

SEQ ID NO: 706489 - RNA, 64 nt, Homo Sapiens; identical to SEQ ID NO: 33229

SEQ ID NO: 706490 - RNA, 62 nt, Homo Sapiens; identical to SEQ ID NO: 33230

SEQ ID NO: 706491 - RNA, 64 nt, Homo Sapiens; identical to SEQ ID NO: 33231

SEQ ID NO: 706492 - RNA, 64 nt, Homo Sapiens; identical to SEQ ID NO: 33232

SEQ ID NO: 706493 - RNA, 64 nt, Homo Sapiens; identical to SEQ ID NO: 33233

SEQ ID NO: 706494 - RNA, 64 nt, Homo Sapiens; identical to SEQ ID NO: 33234

SEQ ID NO: 706495 - RNA, 64 nt, Homo Sapiens; identical to SEQ ID NO: 33235

SEQ ID NO: 706496 - RNA, 64 nt, Homo Sapiens; identical to SEQ ID NO: 33236

SEQ ID NO: 706497 - RNA, 64 nt, Homo Sapiens; identical to SEQ ID NO: 33237

SEQ ID NO: 706498 - RNA, 64 nt, Homo Sapiens; identical to SEQ ID NO: 33238

SEQ ID NO: 706499 - RNA, 64 nt, Homo Sapiens; identical to SEQ ID NO: 33239

SEQ ID NO: 706500 - RNA, 64 nt, Homo Sapiens; identical to SEQ ID NO: 33240

SEQ ID NO: 706501 - RNA, 64 nt, Homo Sapiens; identical to SEQ ID NO: 33241

SEQ ID NO: 706502 - RNA, 64 nt, Homo Sapiens; identical to SEQ ID NO: 33242

SEQ ID NO: 706503 - RNA, 64 nt, Homo Sapiens; identical to SEQ ID NO: 33243

SEQ ID NO: 706504 - RNA, 64 nt, Homo Sapiens; identical to SEQ ID NO: 33244

SEQ ID NO: 706505 - RNA, 64 nt, Homo Sapiens; identical to SEQ ID NO: 33245

SEQ ID NO: 706506 - RNA, 64 nt, Homo Sapiens; identical to SEQ ID NO: 33246

SEQ ID NO: 706507 - RNA, 64 nt, Homo Sapiens; identical to SEQ ID NO: 33247

SEQ ID NO: 706508 - RNA, 64 nt, Homo Sapiens; identical to SEQ ID NO: 33248

SEQ ID NO: 706509 - RNA, 64 nt, Homo Sapiens; identical to SEQ ID NO: 33249

SEQ ID NO: 706510 - RNA, 64 nt, Homo Sapiens; identical to SEQ ID NO: 33250

SEQ ID NO: 706511 - RNA, 64 nt, Homo Sapiens; identical to SEQ ID NO: 33251

SEQ ID NO: 706512 - RNA, 64 nt, Homo Sapiens; identical to SEQ ID NO: 33252

SEQ ID NO: 706513 - RNA, 64 nt, Homo Sapiens; identical to SEQ ID NO: 33253

SEQ ID NO: 706514 - RNA, 64 nt, Homo Sapiens; identical to SEQ ID NO: 33254

SEQ ID NO: 706515 - RNA, 64 nt, Homo Sapiens; identical to SEQ ID NO: 33255

SEQ ID NO: 706516 - RNA, 64 nt, Homo Sapiens; identical to SEQ ID NO: 33256

SEQ ID NO: 706517 - RNA, 64 nt, Homo Sapiens; identical to SEQ ID NO: 33257

SEQ ID NO: 706518 - RNA, 64 nt, Homo Sapiens; identical to SEQ ID NO: 33258

SEQ ID NO: 706519 - RNA, 64 nt, Homo Sapiens; identical to SEQ ID NO: 33259

SEQ ID NO: 706520 - RNA, 64 nt, Homo Sapiens; identical to SEQ ID NO: 33260

SEQ ID NO: 706521 - RNA, 64 nt, Homo Sapiens; identical to SEQ ID NO: 33261

SEQ ID NO: 706522 - RNA, 64 nt, Homo Sapiens; identical to SEQ ID NO: 33262

SEQ ID NO: 706523 - RNA, 64 nt, Homo Sapiens; identical to SEQ ID NO: 33263

SEQ ID NO: 706524 - RNA, 64 nt, Homo Sapiens; identical to SEQ ID NO: 33264

SEQ ID NO: 706525 - RNA, 64 nt, Homo Sapiens; identical to SEQ ID NO: 33265

SEQ ID NO: 706526 - RNA, 64 nt, Homo Sapiens; identical to SEQ ID NO: 33266

SEQ ID NO: 706527 - RNA, 64 nt, Homo Sapiens; identical to SEQ ID NO: 33267

SEQ ID NO: 706528 - RNA, 64 nt, Homo Sapiens; identical to SEQ ID NO: 33268

SEQ ID NO: 706529 - RNA, 64 nt, Homo Sapiens; identical to SEQ ID NO: 33269

SEQ ID NO: 706530 - RNA, 64 nt, Homo Sapiens; identical to SEQ ID NO: 33270

SEQ ID NO: 706531 - RNA, 64 nt, Homo Sapiens; identical to SEQ ID NO: 33271

SEQ ID NO: 706532 - RNA, 64 nt, Homo Sapiens; identical to SEQ ID NO: 33272

SEQ ID NO: 706533 - RNA, 64 nt, Homo Sapiens; identical to SEQ ID NO: 33273

SEQ ID NO: 706534 - RNA, 64 nt, Homo Sapiens; identical to SEQ ID NO: 33274

SEQ ID NO: 706535 - RNA, 64 nt, Homo Sapiens; identical to SEQ ID NO: 33275

SEQ ID NO: 706536 - RNA, 64 nt, Homo Sapiens; identical to SEQ ID NO: 33276

SEQ ID NO: 706537 - RNA, 64 nt, Homo Sapiens; identical to SEQ ID NO: 33277

SEQ ID NO: 706538 - RNA, 64 nt, Homo Sapiens; identical to SEQ ID NO: 33278

SEQ ID NO: 706539 - RNA, 64 nt, Homo Sapiens; identical to SEQ ID NO: 33279

SEQ ID NO: 706540 - RNA, 64 nt, Homo Sapiens; identical to SEQ ID NO: 33280

SEQ ID NO: 706541 - RNA, 64 nt, Homo Sapiens; identical to SEQ ID NO: 33281

SEQ ID NO: 706542 - RNA, 64 nt, Homo Sapiens; identical to SEQ ID NO: 33282

SEQ ID NO: 706543 - RNA, 64 nt, Homo Sapiens; identical to SEQ ID NO: 33283

SEQ ID NO: 706544 - RNA, 64 nt, Homo Sapiens; identical to SEQ ID NO: 33284

SEQ ID NO: 706545 - RNA, 64 nt, Homo Sapiens; identical to SEQ ID NO: 33285

SEQ ID NO: 706546 - RNA, 64 nt, Homo Sapiens; identical to SEQ ID NO: 33286

SEQ ID NO: 706547 - RNA, 64 nt, Homo Sapiens; identical to SEQ ID NO: 33287

SEQ ID NO: 706548 - RNA, 64 nt, Homo Sapiens; identical to SEQ ID NO: 33288

SEQ ID NO: 706549 - RNA, 64 nt, Homo Sapiens; identical to SEQ ID NO: 33289

SEQ ID NO: 706550 - RNA, 64 nt, Homo Sapiens; identical to SEQ ID NO: 33290

SEQ ID NO: 706551 - RNA, 64 nt, Homo Sapiens; identical to SEQ ID NO: 33291

SEQ ID NO: 706552 - RNA, 64 nt, Homo Sapiens; identical to SEQ ID NO: 33292

SEQ ID NO: 706553 - RNA, 64 nt, Homo Sapiens; identical to SEQ ID NO: 33293

SEQ ID NO: 706554 - RNA, 64 nt, Homo Sapiens; identical to SEQ ID NO: 33294

SEQ ID NO: 706555 - RNA, 64 nt, Homo Sapiens; identical to SEQ ID NO: 33295

SEQ ID NO: 706556 - RNA, 64 nt, Homo Sapiens; identical to SEQ ID NO: 33296

SEQ ID NO: 706557 - RNA, 64 nt, Homo Sapiens; identical to SEQ ID NO: 33297

SEQ ID NO: 706558 - RNA, 64 nt, Homo Sapiens; identical to SEQ ID NO: 33298

SEQ ID NO: 706559 - RNA, 64 nt, Homo Sapiens; identical to SEQ ID NO: 33299

SEQ ID NO: 706560 - RNA, 64 nt, Homo Sapiens; identical to SEQ ID NO: 33300

SEQ ID NO: 706561 - RNA, 64 nt, Homo Sapiens; identical to SEQ ID NO: 33301

SEQ ID NO: 706562 - RNA, 64 nt, Homo Sapiens; identical to SEQ ID NO: 33302

SEQ ID NO: 706563 - RNA, 64 nt, Homo Sapiens; identical to SEQ ID NO: 33303

SEQ ID NO: 706564 - RNA, 64 nt, Homo Sapiens; identical to SEQ ID NO: 33304

SEQ ID NO: 706565 - RNA, 64 nt, Homo Sapiens; identical to SEQ ID NO: 33305

SEQ ID NO: 706566 - RNA, 64 nt, Homo Sapiens; identical to SEQ ID NO: 33306

SEQ ID NO: 706567 - RNA, 64 nt, Homo Sapiens; identical to SEQ ID NO: 33307

SEQ ID NO: 706568 - RNA, 64 nt, Homo Sapiens; identical to SEQ ID NO: 33308

SEQ ID NO: 706569 - RNA, 64 nt, Homo Sapiens; identical to SEQ ID NO: 33309

SEQ ID NO: 706570 - RNA, 64 nt, Homo Sapiens; identical to SEQ ID NO: 33310

SEQ ID NO: 706571 - RNA, 64 nt, Homo Sapiens; identical to SEQ ID NO: 33311

SEQ ID NO: 706572 - RNA, 64 nt, Homo Sapiens; identical to SEQ ID NO: 33312

SEQ ID NO: 706573 - RNA, 64 nt, Homo Sapiens; identical to SEQ ID NO: 33313

SEQ ID NO: 706574 - RNA, 64 nt, Homo Sapiens; identical to SEQ ID NO: 33314

SEQ ID NO: 706575 - RNA, 64 nt, Homo Sapiens; identical to SEQ ID NO: 33315

SEQ ID NO: 706576 - RNA, 64 nt, Homo Sapiens; identical to SEQ ID NO: 33316

SEQ ID NO: 706577 - RNA, 64 nt, Homo Sapiens; identical to SEQ ID NO: 33317

SEQ ID NO: 706578 - RNA, 64 nt, Homo Sapiens; identical to SEQ ID NO: 33318

SEQ ID NO: 706579 - RNA, 64 nt, Homo Sapiens; identical to SEQ ID NO: 33319

SEQ ID NO: 706580 - RNA, 64 nt, Homo Sapiens; identical to SEQ ID NO: 33320

SEQ ID NO: 706581 - RNA, 64 nt, Homo Sapiens; identical to SEQ ID NO: 33321

SEQ ID NO: 706582 - RNA, 64 nt, Homo Sapiens; identical to SEQ ID NO: 33322

SEQ ID NO: 706583 - RNA, 64 nt, Homo Sapiens; identical to SEQ ID NO: 33323

SEQ ID NO: 706584 - RNA, 64 nt, Homo Sapiens; identical to SEQ ID NO: 33324

SEQ ID NO: 706585 - RNA, 64 nt, Homo Sapiens; identical to SEQ ID NO: 33325

SEQ ID NO: 706586 - RNA, 64 nt, Homo Sapiens; identical to SEQ ID NO: 33326

SEQ ID NO: 706587 - RNA, 64 nt, Homo Sapiens; identical to SEQ ID NO: 33327

SEQ ID NO: 706588 - RNA, 64 nt, Homo Sapiens; identical to SEQ ID NO: 33328

SEQ ID NO: 706589 - RNA, 64 nt, Homo Sapiens; identical to SEQ ID NO: 33329

SEQ ID NO: 706590 - RNA, 64 nt, Homo Sapiens; identical to SEQ ID NO: 33330

SEQ ID NO: 706591 - RNA, 64 nt, Homo Sapiens; identical to SEQ ID NO: 33331

SEQ ID NO: 706592 - RNA, 64 nt, Homo Sapiens; identical to SEQ ID NO: 33332

SEQ ID NO: 706593 - RNA, 64 nt, Homo Sapiens; identical to SEQ ID NO: 33333

SEQ ID NO: 706594 - RNA, 64 nt, Homo Sapiens; identical to SEQ ID NO: 33334

SEQ ID NO: 706595 - RNA, 64 nt, Homo Sapiens; identical to SEQ ID NO: 33335

SEQ ID NO: 706596 - RNA, 64 nt, Homo Sapiens; identical to SEQ ID NO: 33336

SEQ ID NO: 706597 - RNA, 64 nt, Homo Sapiens; identical to SEQ ID NO: 33337

SEQ ID NO: 706598 - RNA, 64 nt, Homo Sapiens; identical to SEQ ID NO: 33338

SEQ ID NO: 706599 - RNA, 64 nt, Homo Sapiens; identical to SEQ ID NO: 33339

SEQ ID NO: 706600 - RNA, 64 nt, Homo Sapiens; identical to SEQ ID NO: 33340

SEQ ID NO: 706601 - RNA, 64 nt, Homo Sapiens; identical to SEQ ID NO: 33341

SEQ ID NO: 706602 - RNA, 64 nt, Homo Sapiens; identical to SEQ ID NO: 33342

SEQ ID NO: 706603 - RNA, 64 nt, Homo Sapiens; identical to SEQ ID NO: 33343

SEQ ID NO: 706604 - RNA, 64 nt, Homo Sapiens; identical to SEQ ID NO: 33344

SEQ ID NO: 706605 - RNA, 64 nt, Homo Sapiens; identical to SEQ ID NO: 33345

SEQ ID NO: 706606 - RNA, 64 nt, Homo Sapiens; identical to SEQ ID NO: 33346

SEQ ID NO: 706607 - RNA, 64 nt, Homo Sapiens; identical to SEQ ID NO: 33347

SEQ ID NO: 706608 - RNA, 64 nt, Homo Sapiens; identical to SEQ ID NO: 33348

SEQ ID NO: 706609 - RNA, 64 nt, Homo Sapiens; identical to SEQ ID NO: 33349

SEQ ID NO: 706610 - RNA, 64 nt, Homo Sapiens; identical to SEQ ID NO: 33350

SEQ ID NO: 706611 - RNA, 64 nt, Homo Sapiens; identical to SEQ ID NO: 33351

SEQ ID NO: 706612 - RNA, 64 nt, Homo Sapiens; identical to SEQ ID NO: 33352

SEQ ID NO: 706613 - RNA, 64 nt, Homo Sapiens; identical to SEQ ID NO: 33353

SEQ ID NO: 706614 - RNA, 64 nt, Homo Sapiens; identical to SEQ ID NO: 33354

SEQ ID NO: 706615 - RNA, 64 nt, Homo Sapiens; identical to SEQ ID NO: 33355

SEQ ID NO: 706616 - RNA, 64 nt, Homo Sapiens; identical to SEQ ID NO: 33356

SEQ ID NO: 706617 - RNA, 64 nt, Homo Sapiens; identical to SEQ ID NO: 33357

SEQ ID NO: 706618 - RNA, 64 nt, Homo Sapiens; identical to SEQ ID NO: 33358

SEQ ID NO: 706619 - RNA, 64 nt, Homo Sapiens; identical to SEQ ID NO: 33359

SEQ ID NO: 706620 - RNA, 64 nt, Homo Sapiens; identical to SEQ ID NO: 33360

SEQ ID NO: 706621 - RNA, 64 nt, Homo Sapiens; identical to SEQ ID NO: 33361

SEQ ID NO: 706622 - RNA, 64 nt, Homo Sapiens; identical to SEQ ID NO: 33362

SEQ ID NO: 706623 - RNA, 64 nt, Homo Sapiens; identical to SEQ ID NO: 33363

SEQ ID NO: 706624 - RNA, 64 nt, Homo Sapiens; identical to SEQ ID NO: 33364

SEQ ID NO: 706625 - RNA, 64 nt, Homo Sapiens; identical to SEQ ID NO: 33365

SEQ ID NO: 706626 - RNA, 64 nt, Homo Sapiens; identical to SEQ ID NO: 33366

SEQ ID NO: 706627 - RNA, 64 nt, Homo Sapiens; identical to SEQ ID NO: 33367

SEQ ID NO: 706628 - RNA, 64 nt, Homo Sapiens; identical to SEQ ID NO: 33368

SEQ ID NO: 706629 - RNA, 64 nt, Homo Sapiens; identical to SEQ ID NO: 33369

SEQ ID NO: 706630 - RNA, 64 nt, Homo Sapiens; identical to SEQ ID NO: 33370

SEQ ID NO: 706631 - RNA, 64 nt, Homo Sapiens; identical to SEQ ID NO: 33371

SEQ ID NO: 706632 - RNA, 64 nt, Homo Sapiens; identical to SEQ ID NO: 33372

SEQ ID NO: 706633 - RNA, 64 nt, Homo Sapiens; identical to SEQ ID NO: 33373

SEQ ID NO: 706634 - RNA, 64 nt, Homo Sapiens; identical to SEQ ID NO: 33374

SEQ ID NO: 706635 - RNA, 64 nt, Homo Sapiens; identical to SEQ ID NO: 33375

SEQ ID NO: 706636 - RNA, 64 nt, Homo Sapiens; identical to SEQ ID NO: 33376

SEQ ID NO: 706637 - RNA, 64 nt, Homo Sapiens; identical to SEQ ID NO: 33377

SEQ ID NO: 706638 - RNA, 64 nt, Homo Sapiens; identical to SEQ ID NO: 33378

SEQ ID NO: 706639 - RNA, 64 nt, Homo Sapiens; identical to SEQ ID NO: 33379

SEQ ID NO: 706640 - RNA, 64 nt, Homo Sapiens; identical to SEQ ID NO: 33380

SEQ ID NO: 706641 - RNA, 64 nt, Homo Sapiens; identical to SEQ ID NO: 33381

SEQ ID NO: 706642 - RNA, 64 nt, Homo Sapiens; identical to SEQ ID NO: 33382

SEQ ID NO: 706643 - RNA, 64 nt, Homo Sapiens; identical to SEQ ID NO: 33383

SEQ ID NO: 706644 - RNA, 64 nt, Homo Sapiens; identical to SEQ ID NO: 33384

SEQ ID NO: 706645 - RNA, 64 nt, Homo Sapiens; identical to SEQ ID NO: 33385

SEQ ID NO: 706646 - RNA, 64 nt, Homo Sapiens; identical to SEQ ID NO: 33386

SEQ ID NO: 706647 - RNA, 64 nt, Homo Sapiens; identical to SEQ ID NO: 33387

SEQ ID NO: 706648 - RNA, 64 nt, Homo Sapiens; identical to SEQ ID NO: 33388

SEQ ID NO: 706649 - RNA, 64 nt, Homo Sapiens; identical to SEQ ID NO: 33389

SEQ ID NO: 706650 - RNA, 64 nt, Homo Sapiens; identical to SEQ ID NO: 33390

SEQ ID NO: 706651 - RNA, 64 nt, Homo Sapiens; identical to SEQ ID NO: 33391

SEQ ID NO: 706652 - RNA, 64 nt, Homo Sapiens; identical to SEQ ID NO: 33392

SEQ ID NO: 706653 - RNA, 64 nt, Homo Sapiens; identical to SEQ ID NO: 33393

SEQ ID NO: 706654 - RNA, 64 nt, Homo Sapiens; identical to SEQ ID NO: 33394

SEQ ID NO: 706655 - RNA, 64 nt, Homo Sapiens; identical to SEQ ID NO: 33395

SEQ ID NO: 706656 - RNA, 64 nt, Homo Sapiens; identical to SEQ ID NO: 33396

SEQ ID NO: 706657 - RNA, 64 nt, Homo Sapiens; identical to SEQ ID NO: 33397

SEQ ID NO: 706658 - RNA, 64 nt, Homo Sapiens; identical to SEQ ID NO: 33398

SEQ ID NO: 706659 - RNA, 64 nt, Homo Sapiens; identical to SEQ ID NO: 33399

SEQ ID NO: 706660 - RNA, 64 nt, Homo Sapiens; identical to SEQ ID NO: 33400

SEQ ID NO: 706661 - RNA, 64 nt, Homo Sapiens; identical to SEQ ID NO: 33401

SEQ ID NO: 706662 - RNA, 64 nt, Homo Sapiens; identical to SEQ ID NO: 33402

SEQ ID NO: 706663 - RNA, 64 nt, Homo Sapiens; identical to SEQ ID NO: 33403

SEQ ID NO: 706664 - RNA, 64 nt, Homo Sapiens; identical to SEQ ID NO: 33404

SEQ ID NO: 706665 - RNA, 64 nt, Homo Sapiens; identical to SEQ ID NO: 33405

SEQ ID NO: 706666 - RNA, 64 nt, Homo Sapiens; identical to SEQ ID NO: 33406

SEQ ID NO: 706667 - RNA, 64 nt, Homo Sapiens; identical to SEQ ID NO: 33407

SEQ ID NO: 706668 - RNA, 64 nt, Homo Sapiens; identical to SEQ ID NO: 33408

SEQ ID NO: 706669 - RNA, 64 nt, Homo Sapiens; identical to SEQ ID NO: 33409

SEQ ID NO: 706670 - RNA, 64 nt, Homo Sapiens; identical to SEQ ID NO: 33410

SEQ ID NO: 706671 - RNA, 64 nt, Homo Sapiens; identical to SEQ ID NO: 33411

SEQ ID NO: 706672 - RNA, 64 nt, Homo Sapiens; identical to SEQ ID NO: 33412

SEQ ID NO: 706673 - RNA, 64 nt, Homo Sapiens; identical to SEQ ID NO: 33413

SEQ ID NO: 706674 - RNA, 64 nt, Homo Sapiens; identical to SEQ ID NO: 33414

SEQ ID NO: 706675 - RNA, 64 nt, Homo Sapiens; identical to SEQ ID NO: 33415

SEQ ID NO: 706676 - RNA, 64 nt, Homo Sapiens; identical to SEQ ID NO: 33416

SEQ ID NO: 706677 - RNA, 64 nt, Homo Sapiens; identical to SEQ ID NO: 33417

SEQ ID NO: 706678 - RNA, 64 nt, Homo Sapiens; identical to SEQ ID NO: 33418

SEQ ID NO: 706679 - RNA, 64 nt, Homo Sapiens; identical to SEQ ID NO: 33419

SEQ ID NO: 706680 - RNA, 64 nt, Homo Sapiens; identical to SEQ ID NO: 33420

SEQ ID NO: 706681 - RNA, 64 nt, Homo Sapiens; identical to SEQ ID NO: 33421

SEQ ID NO: 706682 - RNA, 64 nt, Homo Sapiens; identical to SEQ ID NO: 33422

SEQ ID NO: 706683 - RNA, 64 nt, Homo Sapiens; identical to SEQ ID NO: 33423

SEQ ID NO: 706684 - RNA, 64 nt, Homo Sapiens; identical to SEQ ID NO: 33424

SEQ ID NO: 706685 - RNA, 64 nt, Homo Sapiens; identical to SEQ ID NO: 33425

SEQ ID NO: 706686 - RNA, 64 nt, Homo Sapiens; identical to SEQ ID NO: 33426

SEQ ID NO: 706687 - RNA, 64 nt, Homo Sapiens; identical to SEQ ID NO: 33427

SEQ ID NO: 706688 - RNA, 64 nt, Homo Sapiens; identical to SEQ ID NO: 33428

SEQ ID NO: 706689 - RNA, 64 nt, Homo Sapiens; identical to SEQ ID NO: 33429

SEQ ID NO: 706690 - RNA, 64 nt, Homo Sapiens; identical to SEQ ID NO: 33430

SEQ ID NO: 706691 - RNA, 64 nt, Homo Sapiens; identical to SEQ ID NO: 33431

SEQ ID NO: 706692 - RNA, 64 nt, Homo Sapiens; identical to SEQ ID NO: 33432

SEQ ID NO: 706693 - RNA, 63 nt, Homo Sapiens; identical to SEQ ID NO: 33433

SEQ ID NO: 706694 - RNA, 62 nt, Homo Sapiens; identical to SEQ ID NO: 33434

SEQ ID NO: 706695 - RNA, 64 nt, Homo Sapiens; identical to SEQ ID NO: 33435

SEQ ID NO: 706696 - RNA, 64 nt, Homo Sapiens; identical to SEQ ID NO: 33436

SEQ ID NO: 706697 - RNA, 64 nt, Homo Sapiens; identical to SEQ ID NO: 33437

SEQ ID NO: 706698 - RNA, 64 nt, Homo Sapiens; identical to SEQ ID NO: 33438

SEQ ID NO: 706699 - RNA, 64 nt, Homo Sapiens; identical to SEQ ID NO: 33439

SEQ ID NO: 706700 - RNA, 64 nt, Homo Sapiens; identical to SEQ ID NO: 33440

SEQ ID NO: 706701 - RNA, 64 nt, Homo Sapiens; identical to SEQ ID NO: 33441

SEQ ID NO: 706702 - RNA, 64 nt, Homo Sapiens; identical to SEQ ID NO: 33442

SEQ ID NO: 706703 - RNA, 64 nt, Homo Sapiens; identical to SEQ ID NO: 33443

SEQ ID NO: 706704 - RNA, 64 nt, Homo Sapiens; identical to SEQ ID NO: 33444

SEQ ID NO: 706705 - RNA, 64 nt, Homo Sapiens; identical to SEQ ID NO: 33445

SEQ ID NO: 706706 - RNA, 64 nt, Homo Sapiens; identical to SEQ ID NO: 33446

SEQ ID NO: 706707 - RNA, 64 nt, Homo Sapiens; identical to SEQ ID NO: 33447

SEQ ID NO: 706708 - RNA, 64 nt, Homo Sapiens; identical to SEQ ID NO: 33448

SEQ ID NO: 706709 - RNA, 64 nt, Homo Sapiens; identical to SEQ ID NO: 33449

SEQ ID NO: 706710 - RNA, 64 nt, Homo Sapiens; identical to SEQ ID NO: 33450

SEQ ID NO: 706711 - RNA, 64 nt, Homo Sapiens; identical to SEQ ID NO: 33451

SEQ ID NO: 706712 - RNA, 64 nt, Homo Sapiens; identical to SEQ ID NO: 33452

SEQ ID NO: 706713 - RNA, 64 nt, Homo Sapiens; identical to SEQ ID NO: 33453

SEQ ID NO: 706714 - RNA, 64 nt, Homo Sapiens; identical to SEQ ID NO: 33454

SEQ ID NO: 706715 - RNA, 64 nt, Homo Sapiens; identical to SEQ ID NO: 33455

SEQ ID NO: 706716 - RNA, 64 nt, Homo Sapiens; identical to SEQ ID NO: 33456

SEQ ID NO: 706717 - RNA, 64 nt, Homo Sapiens; identical to SEQ ID NO: 33457

SEQ ID NO: 706718 - RNA, 64 nt, Homo Sapiens; identical to SEQ ID NO: 33458

SEQ ID NO: 706719 - RNA, 64 nt, Homo Sapiens; identical to SEQ ID NO: 33459

SEQ ID NO: 706720 - RNA, 64 nt, Homo Sapiens; identical to SEQ ID NO: 33460

SEQ ID NO: 706721 - RNA, 64 nt, Homo Sapiens; identical to SEQ ID NO: 33461

SEQ ID NO: 706722 - RNA, 64 nt, Homo Sapiens; identical to SEQ ID NO: 33462

SEQ ID NO: 706723 - RNA, 64 nt, Homo Sapiens; identical to SEQ ID NO: 33463

SEQ ID NO: 706724 - RNA, 64 nt, Homo Sapiens; identical to SEQ ID NO: 33464

SEQ ID NO: 706725 - RNA, 64 nt, Homo Sapiens; identical to SEQ ID NO: 33465

SEQ ID NO: 706726 - RNA, 64 nt, Homo Sapiens; identical to SEQ ID NO: 33466

SEQ ID NO: 706727 - RNA, 64 nt, Homo Sapiens; identical to SEQ ID NO: 33467

SEQ ID NO: 706728 - RNA, 64 nt, Homo Sapiens; identical to SEQ ID NO: 33468

SEQ ID NO: 706729 - RNA, 64 nt, Homo Sapiens; identical to SEQ ID NO: 33469

SEQ ID NO: 706730 - RNA, 64 nt, Homo Sapiens; identical to SEQ ID NO: 33470

SEQ ID NO: 706731 - RNA, 64 nt, Homo Sapiens; identical to SEQ ID NO: 33471

SEQ ID NO: 706732 - RNA, 64 nt, Homo Sapiens; identical to SEQ ID NO: 33472

SEQ ID NO: 706733 - RNA, 64 nt, Homo Sapiens; identical to SEQ ID NO: 33473

SEQ ID NO: 706734 - RNA, 64 nt, Homo Sapiens; identical to SEQ ID NO: 33474

SEQ ID NO: 706735 - RNA, 64 nt, Homo Sapiens; identical to SEQ ID NO: 33475

SEQ ID NO: 706736 - RNA, 64 nt, Homo Sapiens; identical to SEQ ID NO: 33476

SEQ ID NO: 706737 - RNA, 64 nt, Homo Sapiens; identical to SEQ ID NO: 33477

SEQ ID NO: 706738 - RNA, 64 nt, Homo Sapiens; identical to SEQ ID NO: 33478

SEQ ID NO: 706739 - RNA, 64 nt, Homo Sapiens; identical to SEQ ID NO: 33479

SEQ ID NO: 706740 - RNA, 64 nt, Homo Sapiens; identical to SEQ ID NO: 33480

SEQ ID NO: 706741 - RNA, 64 nt, Homo Sapiens; identical to SEQ ID NO: 33481

SEQ ID NO: 706742 - RNA, 64 nt, Homo Sapiens; identical to SEQ ID NO: 33482

SEQ ID NO: 706743 - RNA, 64 nt, Homo Sapiens; identical to SEQ ID NO: 33483

SEQ ID NO: 706744 - RNA, 64 nt, Homo Sapiens; identical to SEQ ID NO: 33484

SEQ ID NO: 706745 - RNA, 64 nt, Homo Sapiens; identical to SEQ ID NO: 33485

SEQ ID NO: 706746 - RNA, 64 nt, Homo Sapiens; identical to SEQ ID NO: 33486

SEQ ID NO: 706747 - RNA, 64 nt, Homo Sapiens; identical to SEQ ID NO: 33487

SEQ ID NO: 706748 - RNA, 64 nt, Homo Sapiens; identical to SEQ ID NO: 33488

SEQ ID NO: 706749 - RNA, 64 nt, Homo Sapiens; identical to SEQ ID NO: 33489

SEQ ID NO: 706750 - RNA, 64 nt, Homo Sapiens; identical to SEQ ID NO: 33490

SEQ ID NO: 706751 - RNA, 64 nt, Homo Sapiens; identical to SEQ ID NO: 33491

SEQ ID NO: 706752 - RNA, 64 nt, Homo Sapiens; identical to SEQ ID NO: 33492

SEQ ID NO: 706753 - RNA, 64 nt, Homo Sapiens; identical to SEQ ID NO: 33493

SEQ ID NO: 706754 - RNA, 64 nt, Homo Sapiens; identical to SEQ ID NO: 33494

SEQ ID NO: 706755 - RNA, 64 nt, Homo Sapiens; identical to SEQ ID NO: 33495

SEQ ID NO: 706756 - RNA, 64 nt, Homo Sapiens; identical to SEQ ID NO: 33496

SEQ ID NO: 706757 - RNA, 64 nt, Homo Sapiens; identical to SEQ ID NO: 33497

SEQ ID NO: 706758 - RNA, 64 nt, Homo Sapiens; identical to SEQ ID NO: 33498

SEQ ID NO: 706759 - RNA, 64 nt, Homo Sapiens; identical to SEQ ID NO: 33499

SEQ ID NO: 706760 - RNA, 64 nt, Homo Sapiens; identical to SEQ ID NO: 33500

SEQ ID NO: 706761 - RNA, 64 nt, Homo Sapiens; identical to SEQ ID NO: 33501

SEQ ID NO: 706762 - RNA, 64 nt, Homo Sapiens; identical to SEQ ID NO: 33502

SEQ ID NO: 706763 - RNA, 64 nt, Homo Sapiens; identical to SEQ ID NO: 33503

SEQ ID NO: 706764 - RNA, 64 nt, Homo Sapiens; identical to SEQ ID NO: 33504

SEQ ID NO: 706765 - RNA, 64 nt, Homo Sapiens; identical to SEQ ID NO: 33505

SEQ ID NO: 706766 - RNA, 64 nt, Homo Sapiens; identical to SEQ ID NO: 33506

SEQ ID NO: 706767 - RNA, 64 nt, Homo Sapiens; identical to SEQ ID NO: 33507

SEQ ID NO: 706768 - RNA, 64 nt, Homo Sapiens; identical to SEQ ID NO: 33508

SEQ ID NO: 706769 - RNA, 64 nt, Homo Sapiens; identical to SEQ ID NO: 33509

SEQ ID NO: 706770 - RNA, 64 nt, Homo Sapiens; identical to SEQ ID NO: 33510

SEQ ID NO: 706771 - RNA, 64 nt, Homo Sapiens; identical to SEQ ID NO: 33511

SEQ ID NO: 706772 - RNA, 64 nt, Homo Sapiens; identical to SEQ ID NO: 33512

SEQ ID NO: 706773 - RNA, 64 nt, Homo Sapiens; identical to SEQ ID NO: 33513

SEQ ID NO: 706774 - RNA, 64 nt, Homo Sapiens; identical to SEQ ID NO: 33514

SEQ ID NO: 706775 - RNA, 64 nt, Homo Sapiens; identical to SEQ ID NO: 33515

SEQ ID NO: 706776 - RNA, 64 nt, Homo Sapiens; identical to SEQ ID NO: 33516

SEQ ID NO: 706777 - RNA, 64 nt, Homo Sapiens; identical to SEQ ID NO: 33517

SEQ ID NO: 706778 - RNA, 64 nt, Homo Sapiens; identical to SEQ ID NO: 33518

SEQ ID NO: 706779 - RNA, 64 nt, Homo Sapiens; identical to SEQ ID NO: 33519

SEQ ID NO: 706780 - RNA, 64 nt, Homo Sapiens; identical to SEQ ID NO: 33520

SEQ ID NO: 706781 - RNA, 64 nt, Homo Sapiens; identical to SEQ ID NO: 33521

SEQ ID NO: 706782 - RNA, 64 nt, Homo Sapiens; identical to SEQ ID NO: 33522

SEQ ID NO: 706783 - RNA, 64 nt, Homo Sapiens; identical to SEQ ID NO: 33523

SEQ ID NO: 706784 - RNA, 64 nt, Homo Sapiens; identical to SEQ ID NO: 33524

SEQ ID NO: 706785 - RNA, 64 nt, Homo Sapiens; identical to SEQ ID NO: 33525

SEQ ID NO: 706786 - RNA, 64 nt, Homo Sapiens; identical to SEQ ID NO: 33526

SEQ ID NO: 706787 - RNA, 64 nt, Homo Sapiens; identical to SEQ ID NO: 33527

SEQ ID NO: 706788 - RNA, 64 nt, Homo Sapiens; identical to SEQ ID NO: 33528

SEQ ID NO: 706789 - RNA, 64 nt, Homo Sapiens; identical to SEQ ID NO: 33529

SEQ ID NO: 706790 - RNA, 64 nt, Homo Sapiens; identical to SEQ ID NO: 33530

SEQ ID NO: 706791 - RNA, 64 nt, Homo Sapiens; identical to SEQ ID NO: 33531

SEQ ID NO: 706792 - RNA, 64 nt, Homo Sapiens; identical to SEQ ID NO: 33532

SEQ ID NO: 706793 - RNA, 64 nt, Homo Sapiens; identical to SEQ ID NO: 33533

SEQ ID NO: 706794 - RNA, 64 nt, Homo Sapiens; identical to SEQ ID NO: 33534

SEQ ID NO: 706795 - RNA, 64 nt, Homo Sapiens; identical to SEQ ID NO: 33535

SEQ ID NO: 706796 - RNA, 64 nt, Homo Sapiens; identical to SEQ ID NO: 33536

SEQ ID NO: 706797 - RNA, 64 nt, Homo Sapiens; identical to SEQ ID NO: 33537

SEQ ID NO: 706798 - RNA, 64 nt, Homo Sapiens; identical to SEQ ID NO: 33538

SEQ ID NO: 706799 - RNA, 64 nt, Homo Sapiens; identical to SEQ ID NO: 33539

SEQ ID NO: 706800 - RNA, 64 nt, Homo Sapiens; identical to SEQ ID NO: 33540

SEQ ID NO: 706801 - RNA, 64 nt, Homo Sapiens; identical to SEQ ID NO: 33541

SEQ ID NO: 706802 - RNA, 64 nt, Homo Sapiens; identical to SEQ ID NO: 33542

SEQ ID NO: 706803 - RNA, 64 nt, Homo Sapiens; identical to SEQ ID NO: 33543

SEQ ID NO: 706804 - RNA, 64 nt, Homo Sapiens; identical to SEQ ID NO: 33544

SEQ ID NO: 706805 - RNA, 64 nt, Homo Sapiens; identical to SEQ ID NO: 33545

SEQ ID NO: 706806 - RNA, 64 nt, Homo Sapiens; identical to SEQ ID NO: 33546

SEQ ID NO: 706807 - RNA, 64 nt, Homo Sapiens; identical to SEQ ID NO: 33547

SEQ ID NO: 706808 - RNA, 64 nt, Homo Sapiens; identical to SEQ ID NO: 33548

SEQ ID NO: 706809 - RNA, 64 nt, Homo Sapiens; identical to SEQ ID NO: 33549

SEQ ID NO: 706810 - RNA, 64 nt, Homo Sapiens; identical to SEQ ID NO: 33550

SEQ ID NO: 706811 - RNA, 64 nt, Homo Sapiens; identical to SEQ ID NO: 33551

SEQ ID NO: 706812 - RNA, 64 nt, Homo Sapiens; identical to SEQ ID NO: 33552

SEQ ID NO: 706813 - RNA, 64 nt, Homo Sapiens; identical to SEQ ID NO: 33553

SEQ ID NO: 706814 - RNA, 64 nt, Homo Sapiens; identical to SEQ ID NO: 33554

SEQ ID NO: 706815 - RNA, 64 nt, Homo Sapiens; identical to SEQ ID NO: 33555

SEQ ID NO: 706816 - RNA, 64 nt, Homo Sapiens; identical to SEQ ID NO: 33556

SEQ ID NO: 706817 - RNA, 64 nt, Homo Sapiens; identical to SEQ ID NO: 33557

SEQ ID NO: 706818 - RNA, 64 nt, Homo Sapiens; identical to SEQ ID NO: 33558

SEQ ID NO: 706819 - RNA, 64 nt, Homo Sapiens; identical to SEQ ID NO: 33559

SEQ ID NO: 706820 - RNA, 64 nt, Homo Sapiens; identical to SEQ ID NO: 33560

SEQ ID NO: 706821 - RNA, 64 nt, Homo Sapiens; identical to SEQ ID NO: 33561

SEQ ID NO: 706822 - RNA, 64 nt, Homo Sapiens; identical to SEQ ID NO: 33562

SEQ ID NO: 706823 - RNA, 64 nt, Homo Sapiens; identical to SEQ ID NO: 33563

SEQ ID NO: 706824 - RNA, 64 nt, Homo Sapiens; identical to SEQ ID NO: 33564

SEQ ID NO: 706825 - RNA, 64 nt, Homo Sapiens; identical to SEQ ID NO: 33565

SEQ ID NO: 706826 - RNA, 64 nt, Homo Sapiens; identical to SEQ ID NO: 33566

SEQ ID NO: 706827 - RNA, 64 nt, Homo Sapiens; identical to SEQ ID NO: 33567

SEQ ID NO: 706828 - RNA, 64 nt, Homo Sapiens; identical to SEQ ID NO: 33568

SEQ ID NO: 706829 - RNA, 64 nt, Homo Sapiens; identical to SEQ ID NO: 33569

SEQ ID NO: 706830 - RNA, 64 nt, Homo Sapiens; identical to SEQ ID NO: 33570

SEQ ID NO: 706831 - RNA, 64 nt, Homo Sapiens; identical to SEQ ID NO: 33571

SEQ ID NO: 706832 - RNA, 64 nt, Homo Sapiens; identical to SEQ ID NO: 33572

SEQ ID NO: 706833 - RNA, 64 nt, Homo Sapiens; identical to SEQ ID NO: 33573

SEQ ID NO: 706834 - RNA, 64 nt, Homo Sapiens; identical to SEQ ID NO: 33574

SEQ ID NO: 706835 - RNA, 64 nt, Homo Sapiens; identical to SEQ ID NO: 33575

SEQ ID NO: 706836 - RNA, 64 nt, Homo Sapiens; identical to SEQ ID NO: 33576

SEQ ID NO: 706837 - RNA, 64 nt, Homo Sapiens; identical to SEQ ID NO: 33577

SEQ ID NO: 706838 - RNA, 64 nt, Homo Sapiens; identical to SEQ ID NO: 33578

SEQ ID NO: 706839 - RNA, 64 nt, Homo Sapiens; identical to SEQ ID NO: 33579

SEQ ID NO: 706840 - RNA, 64 nt, Homo Sapiens; identical to SEQ ID NO: 33580

SEQ ID NO: 706841 - RNA, 64 nt, Homo Sapiens; identical to SEQ ID NO: 33581

SEQ ID NO: 706842 - RNA, 64 nt, Homo Sapiens; identical to SEQ ID NO: 33582

SEQ ID NO: 706843 - RNA, 64 nt, Homo Sapiens; identical to SEQ ID NO: 33583

SEQ ID NO: 706844 - RNA, 64 nt, Homo Sapiens; identical to SEQ ID NO: 33584

SEQ ID NO: 706845 - RNA, 64 nt, Homo Sapiens; identical to SEQ ID NO: 33585

SEQ ID NO: 706846 - RNA, 64 nt, Homo Sapiens; identical to SEQ ID NO: 33586

SEQ ID NO: 706847 - RNA, 64 nt, Homo Sapiens; identical to SEQ ID NO: 33587

SEQ ID NO: 706848 - RNA, 64 nt, Homo Sapiens; identical to SEQ ID NO: 33588

SEQ ID NO: 706849 - RNA, 64 nt, Homo Sapiens; identical to SEQ ID NO: 33589

SEQ ID NO: 706850 - RNA, 64 nt, Homo Sapiens; identical to SEQ ID NO: 33590

SEQ ID NO: 706851 - RNA, 64 nt, Homo Sapiens; identical to SEQ ID NO: 33591

SEQ ID NO: 706852 - RNA, 64 nt, Homo Sapiens; identical to SEQ ID NO: 33592

SEQ ID NO: 706853 - RNA, 64 nt, Homo Sapiens; identical to SEQ ID NO: 33593

SEQ ID NO: 706854 - RNA, 64 nt, Homo Sapiens; identical to SEQ ID NO: 33594

SEQ ID NO: 706855 - RNA, 64 nt, Homo Sapiens; identical to SEQ ID NO: 33595

SEQ ID NO: 706856 - RNA, 64 nt, Homo Sapiens; identical to SEQ ID NO: 33596

SEQ ID NO: 706857 - RNA, 64 nt, Homo Sapiens; identical to SEQ ID NO: 33597

SEQ ID NO: 706858 - RNA, 64 nt, Homo Sapiens; identical to SEQ ID NO: 33598

SEQ ID NO: 706859 - RNA, 64 nt, Homo Sapiens; identical to SEQ ID NO: 33599

SEQ ID NO: 706860 - RNA, 64 nt, Homo Sapiens; identical to SEQ ID NO: 33600

SEQ ID NO: 706861 - RNA, 64 nt, Homo Sapiens; identical to SEQ ID NO: 33601

SEQ ID NO: 706862 - RNA, 64 nt, Homo Sapiens; identical to SEQ ID NO: 33602

SEQ ID NO: 706863 - RNA, 64 nt, Homo Sapiens; identical to SEQ ID NO: 33603

SEQ ID NO: 706864 - RNA, 64 nt, Homo Sapiens; identical to SEQ ID NO: 33604

SEQ ID NO: 706865 - RNA, 64 nt, Homo Sapiens; identical to SEQ ID NO: 33605

SEQ ID NO: 706866 - RNA, 64 nt, Homo Sapiens; identical to SEQ ID NO: 33606

SEQ ID NO: 706867 - RNA, 64 nt, Homo Sapiens; identical to SEQ ID NO: 33607

SEQ ID NO: 706868 - RNA, 64 nt, Homo Sapiens; identical to SEQ ID NO: 33608

SEQ ID NO: 706869 - RNA, 64 nt, Homo Sapiens; identical to SEQ ID NO: 33609

SEQ ID NO: 706870 - RNA, 64 nt, Homo Sapiens; identical to SEQ ID NO: 33610

SEQ ID NO: 706871 - RNA, 64 nt, Homo Sapiens; identical to SEQ ID NO: 33611

SEQ ID NO: 706872 - RNA, 64 nt, Homo Sapiens; identical to SEQ ID NO: 33612

SEQ ID NO: 706873 - RNA, 64 nt, Homo Sapiens; identical to SEQ ID NO: 33613

SEQ ID NO: 706874 - RNA, 64 nt, Homo Sapiens; identical to SEQ ID NO: 33614

SEQ ID NO: 706875 - RNA, 64 nt, Homo Sapiens; identical to SEQ ID NO: 33615

SEQ ID NO: 706876 - RNA, 64 nt, Homo Sapiens; identical to SEQ ID NO: 33616

SEQ ID NO: 706877 - RNA, 64 nt, Homo Sapiens; identical to SEQ ID NO: 33617

SEQ ID NO: 706878 - RNA, 64 nt, Homo Sapiens; identical to SEQ ID NO: 33618

SEQ ID NO: 706879 - RNA, 64 nt, Homo Sapiens; identical to SEQ ID NO: 33619

SEQ ID NO: 706880 - RNA, 64 nt, Homo Sapiens; identical to SEQ ID NO: 33620

SEQ ID NO: 706881 - RNA, 64 nt, Homo Sapiens; identical to SEQ ID NO: 33621

SEQ ID NO: 706882 - RNA, 64 nt, Homo Sapiens; identical to SEQ ID NO: 33622

SEQ ID NO: 706883 - RNA, 64 nt, Homo Sapiens; identical to SEQ ID NO: 33623

SEQ ID NO: 706884 - RNA, 64 nt, Homo Sapiens; identical to SEQ ID NO: 33624

SEQ ID NO: 706885 - RNA, 64 nt, Homo Sapiens; identical to SEQ ID NO: 33625

SEQ ID NO: 706886 - RNA, 64 nt, Homo Sapiens; identical to SEQ ID NO: 33626

SEQ ID NO: 706887 - RNA, 64 nt, Homo Sapiens; identical to SEQ ID NO: 33627

SEQ ID NO: 706888 - RNA, 64 nt, Homo Sapiens; identical to SEQ ID NO: 33628

SEQ ID NO: 706889 - RNA, 64 nt, Homo Sapiens; identical to SEQ ID NO: 33629

SEQ ID NO: 706890 - RNA, 64 nt, Homo Sapiens; identical to SEQ ID NO: 33630

SEQ ID NO: 706891 - RNA, 64 nt, Homo Sapiens; identical to SEQ ID NO: 33631

SEQ ID NO: 706892 - RNA, 64 nt, Homo Sapiens; identical to SEQ ID NO: 33632

SEQ ID NO: 706893 - RNA, 64 nt, Homo Sapiens; identical to SEQ ID NO: 33633

SEQ ID NO: 706894 - RNA, 64 nt, Homo Sapiens; identical to SEQ ID NO: 33634

SEQ ID NO: 706895 - RNA, 64 nt, Homo Sapiens; identical to SEQ ID NO: 33635

SEQ ID NO: 706896 - RNA, 64 nt, Homo Sapiens; identical to SEQ ID NO: 33636

SEQ ID NO: 706897 - RNA, 64 nt, Homo Sapiens; identical to SEQ ID NO: 33637

SEQ ID NO: 706898 - RNA, 64 nt, Homo Sapiens; identical to SEQ ID NO: 33638

SEQ ID NO: 706899 - RNA, 64 nt, Homo Sapiens; identical to SEQ ID NO: 33639

SEQ ID NO: 706900 - RNA, 64 nt, Homo Sapiens; identical to SEQ ID NO: 33640

SEQ ID NO: 706901 - RNA, 64 nt, Homo Sapiens; identical to SEQ ID NO: 33641

SEQ ID NO: 706902 - RNA, 64 nt, Homo Sapiens; identical to SEQ ID NO: 33642

SEQ ID NO: 706903 - RNA, 64 nt, Homo Sapiens; identical to SEQ ID NO: 33643

SEQ ID NO: 706904 - RNA, 64 nt, Homo Sapiens; identical to SEQ ID NO: 33644

SEQ ID NO: 706905 - RNA, 64 nt, Homo Sapiens; identical to SEQ ID NO: 33645

SEQ ID NO: 706906 - RNA, 64 nt, Homo Sapiens; identical to SEQ ID NO: 33646

SEQ ID NO: 706907 - RNA, 64 nt, Homo Sapiens; identical to SEQ ID NO: 33647

SEQ ID NO: 706908 - RNA, 64 nt, Homo Sapiens; identical to SEQ ID NO: 33648

SEQ ID NO: 706909 - RNA, 64 nt, Homo Sapiens; identical to SEQ ID NO: 33649

SEQ ID NO: 706910 - RNA, 64 nt, Homo Sapiens; identical to SEQ ID NO: 33650

SEQ ID NO: 706911 - RNA, 64 nt, Homo Sapiens; identical to SEQ ID NO: 33651

SEQ ID NO: 706912 - RNA, 64 nt, Homo Sapiens; identical to SEQ ID NO: 33652

SEQ ID NO: 706913 - RNA, 64 nt, Homo Sapiens; identical to SEQ ID NO: 33653

SEQ ID NO: 706914 - RNA, 64 nt, Homo Sapiens; identical to SEQ ID NO: 33654

SEQ ID NO: 706915 - RNA, 64 nt, Homo Sapiens; identical to SEQ ID NO: 33655

SEQ ID NO: 706916 - RNA, 64 nt, Homo Sapiens; identical to SEQ ID NO: 33656

SEQ ID NO: 706917 - RNA, 64 nt, Homo Sapiens; identical to SEQ ID NO: 33657

SEQ ID NO: 706918 - RNA, 64 nt, Homo Sapiens; identical to SEQ ID NO: 33658

SEQ ID NO: 706919 - RNA, 64 nt, Homo Sapiens; identical to SEQ ID NO: 33659

SEQ ID NO: 706920 - RNA, 64 nt, Homo Sapiens; identical to SEQ ID NO: 33660

SEQ ID NO: 706921 - RNA, 64 nt, Homo Sapiens; identical to SEQ ID NO: 33661

SEQ ID NO: 706922 - RNA, 64 nt, Homo Sapiens; identical to SEQ ID NO: 33662

SEQ ID NO: 706923 - RNA, 64 nt, Homo Sapiens; identical to SEQ ID NO: 33663

SEQ ID NO: 706924 - RNA, 64 nt, Homo Sapiens; identical to SEQ ID NO: 33664

SEQ ID NO: 706925 - RNA, 64 nt, Homo Sapiens; identical to SEQ ID NO: 33665

SEQ ID NO: 706926 - RNA, 64 nt, Homo Sapiens; identical to SEQ ID NO: 33666

SEQ ID NO: 706927 - RNA, 64 nt, Homo Sapiens; identical to SEQ ID NO: 33667

SEQ ID NO: 706928 - RNA, 64 nt, Homo Sapiens; identical to SEQ ID NO: 33668

SEQ ID NO: 706929 - RNA, 64 nt, Homo Sapiens; identical to SEQ ID NO: 33669

SEQ ID NO: 706930 - RNA, 64 nt, Homo Sapiens; identical to SEQ ID NO: 33670

SEQ ID NO: 706931 - RNA, 64 nt, Homo Sapiens; identical to SEQ ID NO: 33671

SEQ ID NO: 706932 - RNA, 64 nt, Homo Sapiens; identical to SEQ ID NO: 33672

SEQ ID NO: 706933 - RNA, 64 nt, Homo Sapiens; identical to SEQ ID NO: 33673

SEQ ID NO: 706934 - RNA, 64 nt, Homo Sapiens; identical to SEQ ID NO: 33674

SEQ ID NO: 706935 - RNA, 64 nt, Homo Sapiens; identical to SEQ ID NO: 33675

SEQ ID NO: 706936 - RNA, 64 nt, Homo Sapiens; identical to SEQ ID NO: 33676

SEQ ID NO: 706937 - RNA, 64 nt, Homo Sapiens; identical to SEQ ID NO: 33677

SEQ ID NO: 706938 - RNA, 64 nt, Homo Sapiens; identical to SEQ ID NO: 33678

SEQ ID NO: 706939 - RNA, 64 nt, Homo Sapiens; identical to SEQ ID NO: 33679

SEQ ID NO: 706940 - RNA, 64 nt, Homo Sapiens; identical to SEQ ID NO: 33680

SEQ ID NO: 706941 - RNA, 64 nt, Homo Sapiens; identical to SEQ ID NO: 33681

SEQ ID NO: 706942 - RNA, 64 nt, Homo Sapiens; identical to SEQ ID NO: 33682

SEQ ID NO: 706943 - RNA, 64 nt, Homo Sapiens; identical to SEQ ID NO: 33683

SEQ ID NO: 706944 - RNA, 64 nt, Homo Sapiens; identical to SEQ ID NO: 33684

SEQ ID NO: 706945 - RNA, 64 nt, Homo Sapiens; identical to SEQ ID NO: 33685

SEQ ID NO: 706946 - RNA, 64 nt, Homo Sapiens; identical to SEQ ID NO: 33686

SEQ ID NO: 706947 - RNA, 64 nt, Homo Sapiens; identical to SEQ ID NO: 33687

SEQ ID NO: 706948 - RNA, 64 nt, Homo Sapiens; identical to SEQ ID NO: 33688

SEQ ID NO: 706949 - RNA, 64 nt, Homo Sapiens; identical to SEQ ID NO: 33689

SEQ ID NO: 706950 - RNA, 64 nt, Homo Sapiens; identical to SEQ ID NO: 33690

SEQ ID NO: 706951 - RNA, 64 nt, Homo Sapiens; identical to SEQ ID NO: 33691

SEQ ID NO: 706952 - RNA, 64 nt, Homo Sapiens; identical to SEQ ID NO: 33692

SEQ ID NO: 706953 - RNA, 64 nt, Homo Sapiens; identical to SEQ ID NO: 33693

SEQ ID NO: 706954 - RNA, 64 nt, Homo Sapiens; identical to SEQ ID NO: 33694

SEQ ID NO: 706955 - RNA, 64 nt, Homo Sapiens; identical to SEQ ID NO: 33695

SEQ ID NO: 706956 - RNA, 64 nt, Homo Sapiens; identical to SEQ ID NO: 33696

SEQ ID NO: 706957 - RNA, 64 nt, Homo Sapiens; identical to SEQ ID NO: 33697

SEQ ID NO: 706958 - RNA, 64 nt, Homo Sapiens; identical to SEQ ID NO: 33698

SEQ ID NO: 706959 - RNA, 64 nt, Homo Sapiens; identical to SEQ ID NO: 33699

SEQ ID NO: 706960 - RNA, 64 nt, Homo Sapiens; identical to SEQ ID NO: 33700

SEQ ID NO: 706961 - RNA, 64 nt, Homo Sapiens; identical to SEQ ID NO: 33701

SEQ ID NO: 706962 - RNA, 64 nt, Homo Sapiens; identical to SEQ ID NO: 33702

SEQ ID NO: 706963 - RNA, 64 nt, Homo Sapiens; identical to SEQ ID NO: 33703

SEQ ID NO: 706964 - RNA, 64 nt, Homo Sapiens; identical to SEQ ID NO: 33704

SEQ ID NO: 706965 - RNA, 64 nt, Homo Sapiens; identical to SEQ ID NO: 33705

SEQ ID NO: 706966 - RNA, 64 nt, Homo Sapiens; identical to SEQ ID NO: 33706

SEQ ID NO: 706967 - RNA, 64 nt, Homo Sapiens; identical to SEQ ID NO: 33707

SEQ ID NO: 706968 - RNA, 64 nt, Homo Sapiens; identical to SEQ ID NO: 33708

SEQ ID NO: 706969 - RNA, 64 nt, Homo Sapiens; identical to SEQ ID NO: 33709

SEQ ID NO: 706970 - RNA, 64 nt, Homo Sapiens; identical to SEQ ID NO: 33710

SEQ ID NO: 706971 - RNA, 64 nt, Homo Sapiens; identical to SEQ ID NO: 33711

SEQ ID NO: 706972 - RNA, 64 nt, Homo Sapiens; identical to SEQ ID NO: 33712

SEQ ID NO: 706973 - RNA, 64 nt, Homo Sapiens; identical to SEQ ID NO: 33713

SEQ ID NO: 706974 - RNA, 64 nt, Homo Sapiens; identical to SEQ ID NO: 33714

SEQ ID NO: 706975 - RNA, 64 nt, Homo Sapiens; identical to SEQ ID NO: 33715

SEQ ID NO: 706976 - RNA, 64 nt, Homo Sapiens; identical to SEQ ID NO: 33716

SEQ ID NO: 706977 - RNA, 64 nt, Homo Sapiens; identical to SEQ ID NO: 33717

SEQ ID NO: 706978 - RNA, 64 nt, Homo Sapiens; identical to SEQ ID NO: 33718

SEQ ID NO: 706979 - RNA, 64 nt, Homo Sapiens; identical to SEQ ID NO: 33719

SEQ ID NO: 706980 - RNA, 64 nt, Homo Sapiens; identical to SEQ ID NO: 33720

SEQ ID NO: 706981 - RNA, 64 nt, Homo Sapiens; identical to SEQ ID NO: 33721

SEQ ID NO: 706982 - RNA, 64 nt, Homo Sapiens; identical to SEQ ID NO: 33722

SEQ ID NO: 706983 - RNA, 64 nt, Homo Sapiens; identical to SEQ ID NO: 33723

SEQ ID NO: 706984 - RNA, 64 nt, Homo Sapiens; identical to SEQ ID NO: 33724

SEQ ID NO: 706985 - RNA, 64 nt, Homo Sapiens; identical to SEQ ID NO: 33725

SEQ ID NO: 706986 - RNA, 64 nt, Homo Sapiens; identical to SEQ ID NO: 33726

SEQ ID NO: 706987 - RNA, 64 nt, Homo Sapiens; identical to SEQ ID NO: 33727

SEQ ID NO: 706988 - RNA, 64 nt, Homo Sapiens; identical to SEQ ID NO: 33728

SEQ ID NO: 706989 - RNA, 64 nt, Homo Sapiens; identical to SEQ ID NO: 33729

SEQ ID NO: 706990 - RNA, 64 nt, Homo Sapiens; identical to SEQ ID NO: 33730

SEQ ID NO: 706991 - RNA, 64 nt, Homo Sapiens; identical to SEQ ID NO: 33731

SEQ ID NO: 706992 - RNA, 64 nt, Homo Sapiens; identical to SEQ ID NO: 33732

SEQ ID NO: 706993 - RNA, 64 nt, Homo Sapiens; identical to SEQ ID NO: 33733

SEQ ID NO: 706994 - RNA, 64 nt, Homo Sapiens; identical to SEQ ID NO: 33734

SEQ ID NO: 706995 - RNA, 64 nt, Homo Sapiens; identical to SEQ ID NO: 33735

SEQ ID NO: 706996 - RNA, 64 nt, Homo Sapiens; identical to SEQ ID NO: 33736

SEQ ID NO: 706997 - RNA, 64 nt, Homo Sapiens; identical to SEQ ID NO: 33737

SEQ ID NO: 706998 - RNA, 64 nt, Homo Sapiens; identical to SEQ ID NO: 33738

SEQ ID NO: 706999 - RNA, 64 nt, Homo Sapiens; identical to SEQ ID NO: 33739

SEQ ID NO: 707000 - RNA, 64 nt, Homo Sapiens; identical to SEQ ID NO: 33740

SEQ ID NO: 707001 - RNA, 64 nt, Homo Sapiens; identical to SEQ ID NO: 33741

SEQ ID NO: 707002 - RNA, 64 nt, Homo Sapiens; identical to SEQ ID NO: 33742

SEQ ID NO: 707003 - RNA, 64 nt, Homo Sapiens; identical to SEQ ID NO: 33743

SEQ ID NO: 707004 - RNA, 64 nt, Homo Sapiens; identical to SEQ ID NO: 33744

SEQ ID NO: 707005 - RNA, 64 nt, Homo Sapiens; identical to SEQ ID NO: 33745

SEQ ID NO: 707006 - RNA, 64 nt, Homo Sapiens; identical to SEQ ID NO: 33746

SEQ ID NO: 707007 - RNA, 64 nt, Homo Sapiens; identical to SEQ ID NO: 33747

SEQ ID NO: 707008 - RNA, 64 nt, Homo Sapiens; identical to SEQ ID NO: 33748

SEQ ID NO: 707009 - RNA, 64 nt, Homo Sapiens; identical to SEQ ID NO: 33749

SEQ ID NO: 707010 - RNA, 64 nt, Homo Sapiens; identical to SEQ ID NO: 33750

SEQ ID NO: 707011 - RNA, 64 nt, Homo Sapiens; identical to SEQ ID NO: 33751

SEQ ID NO: 707012 - RNA, 64 nt, Homo Sapiens; identical to SEQ ID NO: 33752

SEQ ID NO: 707013 - RNA, 64 nt, Homo Sapiens; identical to SEQ ID NO: 33753

SEQ ID NO: 707014 - RNA, 64 nt, Homo Sapiens; identical to SEQ ID NO: 33754

SEQ ID NO: 707015 - RNA, 64 nt, Homo Sapiens; identical to SEQ ID NO: 33755

SEQ ID NO: 707016 - RNA, 64 nt, Homo Sapiens; identical to SEQ ID NO: 33756

SEQ ID NO: 707017 - RNA, 64 nt, Homo Sapiens; identical to SEQ ID NO: 33757

SEQ ID NO: 707018 - RNA, 64 nt, Homo Sapiens; identical to SEQ ID NO: 33758

SEQ ID NO: 707019 - RNA, 64 nt, Homo Sapiens; identical to SEQ ID NO: 33759

SEQ ID NO: 707020 - RNA, 64 nt, Homo Sapiens; identical to SEQ ID NO: 33760

SEQ ID NO: 707021 - RNA, 64 nt, Homo Sapiens; identical to SEQ ID NO: 33761

SEQ ID NO: 707022 - RNA, 64 nt, Homo Sapiens; identical to SEQ ID NO: 33762

SEQ ID NO: 707023 - RNA, 64 nt, Homo Sapiens; identical to SEQ ID NO: 33763

SEQ ID NO: 707024 - RNA, 64 nt, Homo Sapiens; identical to SEQ ID NO: 33764

SEQ ID NO: 707025 - RNA, 64 nt, Homo Sapiens; identical to SEQ ID NO: 33765

SEQ ID NO: 707026 - RNA, 64 nt, Homo Sapiens; identical to SEQ ID NO: 33766

SEQ ID NO: 707027 - RNA, 64 nt, Homo Sapiens; identical to SEQ ID NO: 33767

SEQ ID NO: 707028 - RNA, 64 nt, Homo Sapiens; identical to SEQ ID NO: 33768

SEQ ID NO: 707029 - RNA, 64 nt, Homo Sapiens; identical to SEQ ID NO: 33769

SEQ ID NO: 707030 - RNA, 64 nt, Homo Sapiens; identical to SEQ ID NO: 33770

SEQ ID NO: 707031 - RNA, 64 nt, Homo Sapiens; identical to SEQ ID NO: 33771

SEQ ID NO: 707032 - RNA, 64 nt, Homo Sapiens; identical to SEQ ID NO: 33772

SEQ ID NO: 707033 - RNA, 64 nt, Homo Sapiens; identical to SEQ ID NO: 33773

SEQ ID NO: 707034 - RNA, 64 nt, Homo Sapiens; identical to SEQ ID NO: 33774

SEQ ID NO: 707035 - RNA, 64 nt, Homo Sapiens; identical to SEQ ID NO: 33775

SEQ ID NO: 707036 - RNA, 64 nt, Homo Sapiens; identical to SEQ ID NO: 33776

SEQ ID NO: 707037 - RNA, 64 nt, Homo Sapiens; identical to SEQ ID NO: 33777

SEQ ID NO: 707038 - RNA, 64 nt, Homo Sapiens; identical to SEQ ID NO: 33778

SEQ ID NO: 707039 - RNA, 64 nt, Homo Sapiens; identical to SEQ ID NO: 33779

SEQ ID NO: 707040 - RNA, 64 nt, Homo Sapiens; identical to SEQ ID NO: 33780

SEQ ID NO: 707041 - RNA, 64 nt, Homo Sapiens; identical to SEQ ID NO: 33781

SEQ ID NO: 707042 - RNA, 64 nt, Homo Sapiens; identical to SEQ ID NO: 33782

SEQ ID NO: 707043 - RNA, 64 nt, Homo Sapiens; identical to SEQ ID NO: 33783

SEQ ID NO: 707044 - RNA, 64 nt, Homo Sapiens; identical to SEQ ID NO: 33784

SEQ ID NO: 707045 - RNA, 64 nt, Homo Sapiens; identical to SEQ ID NO: 33785

SEQ ID NO: 707046 - RNA, 64 nt, Homo Sapiens; identical to SEQ ID NO: 33786

SEQ ID NO: 707047 - RNA, 64 nt, Homo Sapiens; identical to SEQ ID NO: 33787

SEQ ID NO: 707048 - RNA, 64 nt, Homo Sapiens; identical to SEQ ID NO: 33788

SEQ ID NO: 707049 - RNA, 64 nt, Homo Sapiens; identical to SEQ ID NO: 33789

SEQ ID NO: 707050 - RNA, 64 nt, Homo Sapiens; identical to SEQ ID NO: 33790

SEQ ID NO: 707051 - RNA, 64 nt, Homo Sapiens; identical to SEQ ID NO: 33791

SEQ ID NO: 707052 - RNA, 64 nt, Homo Sapiens; identical to SEQ ID NO: 33792

SEQ ID NO: 707053 - RNA, 64 nt, Homo Sapiens; identical to SEQ ID NO: 33793

SEQ ID NO: 707054 - RNA, 64 nt, Homo Sapiens; identical to SEQ ID NO: 33794

SEQ ID NO: 707055 - RNA, 64 nt, Homo Sapiens; identical to SEQ ID NO: 33795

SEQ ID NO: 707056 - RNA, 64 nt, Homo Sapiens; identical to SEQ ID NO: 33796

SEQ ID NO: 707057 - RNA, 64 nt, Homo Sapiens; identical to SEQ ID NO: 33797

SEQ ID NO: 707058 - RNA, 64 nt, Homo Sapiens; identical to SEQ ID NO: 33798

SEQ ID NO: 707059 - RNA, 64 nt, Homo Sapiens; identical to SEQ ID NO: 33799

SEQ ID NO: 707060 - RNA, 64 nt, Homo Sapiens; identical to SEQ ID NO: 33800

SEQ ID NO: 707061 - RNA, 64 nt, Homo Sapiens; identical to SEQ ID NO: 33801

SEQ ID NO: 707062 - RNA, 64 nt, Homo Sapiens; identical to SEQ ID NO: 33802

SEQ ID NO: 707063 - RNA, 64 nt, Homo Sapiens; identical to SEQ ID NO: 33803

SEQ ID NO: 707064 - RNA, 64 nt, Homo Sapiens; identical to SEQ ID NO: 33804

SEQ ID NO: 707065 - RNA, 64 nt, Homo Sapiens; identical to SEQ ID NO: 33805

SEQ ID NO: 707066 - RNA, 64 nt, Homo Sapiens; identical to SEQ ID NO: 33806

SEQ ID NO: 707067 - RNA, 64 nt, Homo Sapiens; identical to SEQ ID NO: 33807

SEQ ID NO: 707068 - RNA, 64 nt, Homo Sapiens; identical to SEQ ID NO: 33808

SEQ ID NO: 707069 - RNA, 64 nt, Homo Sapiens; identical to SEQ ID NO: 33809

SEQ ID NO: 707070 - RNA, 64 nt, Homo Sapiens; identical to SEQ ID NO: 33810

SEQ ID NO: 707071 - RNA, 64 nt, Homo Sapiens; identical to SEQ ID NO: 33811

SEQ ID NO: 707072 - RNA, 64 nt, Homo Sapiens; identical to SEQ ID NO: 33812

SEQ ID NO: 707073 - RNA, 64 nt, Homo Sapiens; identical to SEQ ID NO: 33813

SEQ ID NO: 707074 - RNA, 64 nt, Homo Sapiens; identical to SEQ ID NO: 33814

SEQ ID NO: 707075 - RNA, 64 nt, Homo Sapiens; identical to SEQ ID NO: 33815

SEQ ID NO: 707076 - RNA, 64 nt, Homo Sapiens; identical to SEQ ID NO: 33816

SEQ ID NO: 707077 - RNA, 64 nt, Homo Sapiens; identical to SEQ ID NO: 33817

SEQ ID NO: 707078 - RNA, 64 nt, Homo Sapiens; identical to SEQ ID NO: 33818

SEQ ID NO: 707079 - RNA, 64 nt, Homo Sapiens; identical to SEQ ID NO: 33819

SEQ ID NO: 707080 - RNA, 64 nt, Homo Sapiens; identical to SEQ ID NO: 33820

SEQ ID NO: 707081 - RNA, 64 nt, Homo Sapiens; identical to SEQ ID NO: 33821

SEQ ID NO: 707082 - RNA, 64 nt, Homo Sapiens; identical to SEQ ID NO: 33822

SEQ ID NO: 707083 - RNA, 64 nt, Homo Sapiens; identical to SEQ ID NO: 33823

SEQ ID NO: 707084 - RNA, 64 nt, Homo Sapiens; identical to SEQ ID NO: 33824

SEQ ID NO: 707085 - RNA, 64 nt, Homo Sapiens; identical to SEQ ID NO: 33825

SEQ ID NO: 707086 - RNA, 64 nt, Homo Sapiens; identical to SEQ ID NO: 33826

SEQ ID NO: 707087 - RNA, 64 nt, Homo Sapiens; identical to SEQ ID NO: 33827

SEQ ID NO: 707088 - RNA, 64 nt, Homo Sapiens; identical to SEQ ID NO: 33828

SEQ ID NO: 707089 - RNA, 64 nt, Homo Sapiens; identical to SEQ ID NO: 33829

SEQ ID NO: 707090 - RNA, 64 nt, Homo Sapiens; identical to SEQ ID NO: 33830

SEQ ID NO: 707091 - RNA, 64 nt, Homo Sapiens; identical to SEQ ID NO: 33831

SEQ ID NO: 707092 - RNA, 64 nt, Homo Sapiens; identical to SEQ ID NO: 33832

SEQ ID NO: 707093 - RNA, 64 nt, Homo Sapiens; identical to SEQ ID NO: 33833

SEQ ID NO: 707094 - RNA, 64 nt, Homo Sapiens; identical to SEQ ID NO: 33834

SEQ ID NO: 707095 - RNA, 64 nt, Homo Sapiens; identical to SEQ ID NO: 33835

SEQ ID NO: 707096 - RNA, 64 nt, Homo Sapiens; identical to SEQ ID NO: 33836

SEQ ID NO: 707097 - RNA, 64 nt, Homo Sapiens; identical to SEQ ID NO: 33837

SEQ ID NO: 707098 - RNA, 64 nt, Homo Sapiens; identical to SEQ ID NO: 33838

SEQ ID NO: 707099 - RNA, 64 nt, Homo Sapiens; identical to SEQ ID NO: 33839

SEQ ID NO: 707100 - RNA, 64 nt, Homo Sapiens; identical to SEQ ID NO: 33840

SEQ ID NO: 707101 - RNA, 64 nt, Homo Sapiens; identical to SEQ ID NO: 33841

SEQ ID NO: 707102 - RNA, 64 nt, Homo Sapiens; identical to SEQ ID NO: 33842

SEQ ID NO: 707103 - RNA, 64 nt, Homo Sapiens; identical to SEQ ID NO: 33843

SEQ ID NO: 707104 - RNA, 64 nt, Homo Sapiens; identical to SEQ ID NO: 33844

SEQ ID NO: 707105 - RNA, 64 nt, Homo Sapiens; identical to SEQ ID NO: 33845

SEQ ID NO: 707106 - RNA, 64 nt, Homo Sapiens; identical to SEQ ID NO: 33846

SEQ ID NO: 707107 - RNA, 64 nt, Homo Sapiens; identical to SEQ ID NO: 33847

SEQ ID NO: 707108 - RNA, 64 nt, Homo Sapiens; identical to SEQ ID NO: 33848

SEQ ID NO: 707109 - RNA, 64 nt, Homo Sapiens; identical to SEQ ID NO: 33849

SEQ ID NO: 707110 - RNA, 64 nt, Homo Sapiens; identical to SEQ ID NO: 33850

SEQ ID NO: 707111 - RNA, 64 nt, Homo Sapiens; identical to SEQ ID NO: 33851

SEQ ID NO: 707112 - RNA, 64 nt, Homo Sapiens; identical to SEQ ID NO: 33852

SEQ ID NO: 707113 - RNA, 64 nt, Homo Sapiens; identical to SEQ ID NO: 33853

SEQ ID NO: 707114 - RNA, 64 nt, Homo Sapiens; identical to SEQ ID NO: 33854

SEQ ID NO: 707115 - RNA, 64 nt, Homo Sapiens; identical to SEQ ID NO: 33855

SEQ ID NO: 707116 - RNA, 64 nt, Homo Sapiens; identical to SEQ ID NO: 33856

SEQ ID NO: 707117 - RNA, 64 nt, Homo Sapiens; identical to SEQ ID NO: 33857

SEQ ID NO: 707118 - RNA, 64 nt, Homo Sapiens; identical to SEQ ID NO: 33858

SEQ ID NO: 707119 - RNA, 64 nt, Homo Sapiens; identical to SEQ ID NO: 33859

SEQ ID NO: 707120 - RNA, 64 nt, Homo Sapiens; identical to SEQ ID NO: 33860

SEQ ID NO: 707121 - RNA, 64 nt, Homo Sapiens; identical to SEQ ID NO: 33861

SEQ ID NO: 707122 - RNA, 64 nt, Homo Sapiens; identical to SEQ ID NO: 33862

SEQ ID NO: 707123 - RNA, 64 nt, Homo Sapiens; identical to SEQ ID NO: 33863

SEQ ID NO: 707124 - RNA, 64 nt, Homo Sapiens; identical to SEQ ID NO: 33864

SEQ ID NO: 707125 - RNA, 64 nt, Homo Sapiens; identical to SEQ ID NO: 33865

SEQ ID NO: 707126 - RNA, 64 nt, Homo Sapiens; identical to SEQ ID NO: 33866

SEQ ID NO: 707127 - RNA, 64 nt, Homo Sapiens; identical to SEQ ID NO: 33867

SEQ ID NO: 707128 - RNA, 64 nt, Homo Sapiens; identical to SEQ ID NO: 33868

SEQ ID NO: 707129 - RNA, 64 nt, Homo Sapiens; identical to SEQ ID NO: 33869

SEQ ID NO: 707130 - RNA, 64 nt, Homo Sapiens; identical to SEQ ID NO: 33870

SEQ ID NO: 707131 - RNA, 64 nt, Homo Sapiens; identical to SEQ ID NO: 33871

SEQ ID NO: 707132 - RNA, 64 nt, Homo Sapiens; identical to SEQ ID NO: 33872

SEQ ID NO: 707133 - RNA, 64 nt, Homo Sapiens; identical to SEQ ID NO: 33873

SEQ ID NO: 707134 - RNA, 64 nt, Homo Sapiens; identical to SEQ ID NO: 33874

SEQ ID NO: 707135 - RNA, 64 nt, Homo Sapiens; identical to SEQ ID NO: 33875

SEQ ID NO: 707136 - RNA, 64 nt, Homo Sapiens; identical to SEQ ID NO: 33876

SEQ ID NO: 707137 - RNA, 64 nt, Homo Sapiens; identical to SEQ ID NO: 33877

SEQ ID NO: 707138 - RNA, 64 nt, Homo Sapiens; identical to SEQ ID NO: 33878

SEQ ID NO: 707139 - RNA, 64 nt, Homo Sapiens; identical to SEQ ID NO: 33879

SEQ ID NO: 707140 - RNA, 64 nt, Homo Sapiens; identical to SEQ ID NO: 33880

SEQ ID NO: 707141 - RNA, 64 nt, Homo Sapiens; identical to SEQ ID NO: 33881

SEQ ID NO: 707142 - RNA, 64 nt, Homo Sapiens; identical to SEQ ID NO: 33882

SEQ ID NO: 707143 - RNA, 64 nt, Homo Sapiens; identical to SEQ ID NO: 33883

SEQ ID NO: 707144 - RNA, 64 nt, Homo Sapiens; identical to SEQ ID NO: 33884

SEQ ID NO: 707145 - RNA, 64 nt, Homo Sapiens; identical to SEQ ID NO: 33885

SEQ ID NO: 707146 - RNA, 64 nt, Homo Sapiens; identical to SEQ ID NO: 33886

SEQ ID NO: 707147 - RNA, 64 nt, Homo Sapiens; identical to SEQ ID NO: 33887

SEQ ID NO: 707148 - RNA, 64 nt, Homo Sapiens; identical to SEQ ID NO: 33888

SEQ ID NO: 707149 - RNA, 64 nt, Homo Sapiens; identical to SEQ ID NO: 33889

SEQ ID NO: 707150 - RNA, 64 nt, Homo Sapiens; identical to SEQ ID NO: 33890

SEQ ID NO: 707151 - RNA, 64 nt, Homo Sapiens; identical to SEQ ID NO: 33891

SEQ ID NO: 707152 - RNA, 64 nt, Homo Sapiens; identical to SEQ ID NO: 33892

SEQ ID NO: 707153 - RNA, 64 nt, Homo Sapiens; identical to SEQ ID NO: 33893

SEQ ID NO: 707154 - RNA, 64 nt, Homo Sapiens; identical to SEQ ID NO: 33894

SEQ ID NO: 707155 - RNA, 64 nt, Homo Sapiens; identical to SEQ ID NO: 33895

SEQ ID NO: 707156 - RNA, 64 nt, Homo Sapiens; identical to SEQ ID NO: 33896

SEQ ID NO: 707157 - RNA, 64 nt, Homo Sapiens; identical to SEQ ID NO: 33897

SEQ ID NO: 707158 - RNA, 64 nt, Homo Sapiens; identical to SEQ ID NO: 33898

SEQ ID NO: 707159 - RNA, 64 nt, Homo Sapiens; identical to SEQ ID NO: 33899

SEQ ID NO: 707160 - RNA, 64 nt, Homo Sapiens; identical to SEQ ID NO: 33900

SEQ ID NO: 707161 - RNA, 64 nt, Homo Sapiens; identical to SEQ ID NO: 33901

SEQ ID NO: 707162 - RNA, 64 nt, Homo Sapiens; identical to SEQ ID NO: 33902

SEQ ID NO: 707163 - RNA, 64 nt, Homo Sapiens; identical to SEQ ID NO: 33903

SEQ ID NO: 707164 - RNA, 64 nt, Homo Sapiens; identical to SEQ ID NO: 33904

SEQ ID NO: 707165 - RNA, 64 nt, Homo Sapiens; identical to SEQ ID NO: 33905

SEQ ID NO: 707166 - RNA, 64 nt, Homo Sapiens; identical to SEQ ID NO: 33906

SEQ ID NO: 707167 - RNA, 64 nt, Homo Sapiens; identical to SEQ ID NO: 33907

SEQ ID NO: 707168 - RNA, 64 nt, Homo Sapiens; identical to SEQ ID NO: 33908

SEQ ID NO: 707169 - RNA, 64 nt, Homo Sapiens; identical to SEQ ID NO: 33909

SEQ ID NO: 707170 - RNA, 64 nt, Homo Sapiens; identical to SEQ ID NO: 33910

SEQ ID NO: 707171 - RNA, 64 nt, Homo Sapiens; identical to SEQ ID NO: 33911

SEQ ID NO: 707172 - RNA, 64 nt, Homo Sapiens; identical to SEQ ID NO: 33912

SEQ ID NO: 707173 - RNA, 64 nt, Homo Sapiens; identical to SEQ ID NO: 33913

SEQ ID NO: 707174 - RNA, 64 nt, Homo Sapiens; identical to SEQ ID NO: 33914

SEQ ID NO: 707175 - RNA, 64 nt, Homo Sapiens; identical to SEQ ID NO: 33915

SEQ ID NO: 707176 - RNA, 64 nt, Homo Sapiens; identical to SEQ ID NO: 33916

SEQ ID NO: 707177 - RNA, 64 nt, Homo Sapiens; identical to SEQ ID NO: 33917

SEQ ID NO: 707178 - RNA, 64 nt, Homo Sapiens; identical to SEQ ID NO: 33918

SEQ ID NO: 707179 - RNA, 64 nt, Homo Sapiens; identical to SEQ ID NO: 33919

SEQ ID NO: 707180 - RNA, 64 nt, Homo Sapiens; identical to SEQ ID NO: 33920

SEQ ID NO: 707181 - RNA, 64 nt, Homo Sapiens; identical to SEQ ID NO: 33921

SEQ ID NO: 707182 - RNA, 64 nt, Homo Sapiens; identical to SEQ ID NO: 33922

SEQ ID NO: 707183 - RNA, 64 nt, Homo Sapiens; identical to SEQ ID NO: 33923

SEQ ID NO: 707184 - RNA, 64 nt, Homo Sapiens; identical to SEQ ID NO: 33924

SEQ ID NO: 707185 - RNA, 64 nt, Homo Sapiens; identical to SEQ ID NO: 33925

SEQ ID NO: 707186 - RNA, 64 nt, Homo Sapiens; identical to SEQ ID NO: 33926

SEQ ID NO: 707187 - RNA, 64 nt, Homo Sapiens; identical to SEQ ID NO: 33927

SEQ ID NO: 707188 - RNA, 64 nt, Homo Sapiens; identical to SEQ ID NO: 33928

SEQ ID NO: 707189 - RNA, 64 nt, Homo Sapiens; identical to SEQ ID NO: 33929

SEQ ID NO: 707190 - RNA, 64 nt, Homo Sapiens; identical to SEQ ID NO: 33930

SEQ ID NO: 707191 - RNA, 64 nt, Homo Sapiens; identical to SEQ ID NO: 33931

SEQ ID NO: 707192 - RNA, 64 nt, Homo Sapiens; identical to SEQ ID NO: 33932

SEQ ID NO: 707193 - RNA, 64 nt, Homo Sapiens; identical to SEQ ID NO: 33933

SEQ ID NO: 707194 - RNA, 64 nt, Homo Sapiens; identical to SEQ ID NO: 33934

SEQ ID NO: 707195 - RNA, 64 nt, Homo Sapiens; identical to SEQ ID NO: 33935

SEQ ID NO: 707196 - RNA, 64 nt, Homo Sapiens; identical to SEQ ID NO: 33936

SEQ ID NO: 707197 - RNA, 64 nt, Homo Sapiens; identical to SEQ ID NO: 33937

SEQ ID NO: 707198 - RNA, 64 nt, Homo Sapiens; identical to SEQ ID NO: 33938

SEQ ID NO: 707199 - RNA, 64 nt, Homo Sapiens; identical to SEQ ID NO: 33939

SEQ ID NO: 707200 - RNA, 64 nt, Homo Sapiens; identical to SEQ ID NO: 33940

SEQ ID NO: 707201 - RNA, 64 nt, Homo Sapiens; identical to SEQ ID NO: 33941

SEQ ID NO: 707202 - RNA, 64 nt, Homo Sapiens; identical to SEQ ID NO: 33942

SEQ ID NO: 707203 - RNA, 64 nt, Homo Sapiens; identical to SEQ ID NO: 33943

SEQ ID NO: 707204 - RNA, 64 nt, Homo Sapiens; identical to SEQ ID NO: 33944

SEQ ID NO: 707205 - RNA, 64 nt, Homo Sapiens; identical to SEQ ID NO: 33945

SEQ ID NO: 707206 - RNA, 64 nt, Homo Sapiens; identical to SEQ ID NO: 33946

SEQ ID NO: 707207 - RNA, 64 nt, Homo Sapiens; identical to SEQ ID NO: 33947

SEQ ID NO: 707208 - RNA, 64 nt, Homo Sapiens; identical to SEQ ID NO: 33948

SEQ ID NO: 707209 - RNA, 64 nt, Homo Sapiens; identical to SEQ ID NO: 33949

SEQ ID NO: 707210 - RNA, 64 nt, Homo Sapiens; identical to SEQ ID NO: 33950

SEQ ID NO: 707211 - RNA, 64 nt, Homo Sapiens; identical to SEQ ID NO: 33951

SEQ ID NO: 707212 - RNA, 64 nt, Homo Sapiens; identical to SEQ ID NO: 33952

SEQ ID NO: 707213 - RNA, 63 nt, Homo Sapiens; identical to SEQ ID NO: 33953

SEQ ID NO: 707214 - RNA, 62 nt, Homo Sapiens; identical to SEQ ID NO: 33954

SEQ ID NO: 707215 - RNA, 64 nt, Homo Sapiens; identical to SEQ ID NO: 33955

SEQ ID NO: 707216 - RNA, 64 nt, Homo Sapiens; identical to SEQ ID NO: 33956

SEQ ID NO: 707217 - RNA, 64 nt, Homo Sapiens; identical to SEQ ID NO: 33957

SEQ ID NO: 707218 - RNA, 64 nt, Homo Sapiens; identical to SEQ ID NO: 33958

SEQ ID NO: 707219 - RNA, 64 nt, Homo Sapiens; identical to SEQ ID NO: 33959

SEQ ID NO: 707220 - RNA, 64 nt, Homo Sapiens; identical to SEQ ID NO: 33960

SEQ ID NO: 707221 - RNA, 64 nt, Homo Sapiens; identical to SEQ ID NO: 33961

SEQ ID NO: 707222 - RNA, 64 nt, Homo Sapiens; identical to SEQ ID NO: 33962

SEQ ID NO: 707223 - RNA, 64 nt, Homo Sapiens; identical to SEQ ID NO: 33963

SEQ ID NO: 707224 - RNA, 64 nt, Homo Sapiens; identical to SEQ ID NO: 33964

SEQ ID NO: 707225 - RNA, 64 nt, Homo Sapiens; identical to SEQ ID NO: 33965

SEQ ID NO: 707226 - RNA, 64 nt, Homo Sapiens; identical to SEQ ID NO: 33966

SEQ ID NO: 707227 - RNA, 64 nt, Homo Sapiens; identical to SEQ ID NO: 33967

SEQ ID NO: 707228 - RNA, 64 nt, Homo Sapiens; identical to SEQ ID NO: 33968

SEQ ID NO: 707229 - RNA, 64 nt, Homo Sapiens; identical to SEQ ID NO: 33969

SEQ ID NO: 707230 - RNA, 64 nt, Homo Sapiens; identical to SEQ ID NO: 33970

SEQ ID NO: 707231 - RNA, 64 nt, Homo Sapiens; identical to SEQ ID NO: 33971

SEQ ID NO: 707232 - RNA, 64 nt, Homo Sapiens; identical to SEQ ID NO: 33972

SEQ ID NO: 707233 - RNA, 64 nt, Homo Sapiens; identical to SEQ ID NO: 33973

SEQ ID NO: 707234 - RNA, 64 nt, Homo Sapiens; identical to SEQ ID NO: 33974

SEQ ID NO: 707235 - RNA, 64 nt, Homo Sapiens; identical to SEQ ID NO: 33975

SEQ ID NO: 707236 - RNA, 64 nt, Homo Sapiens; identical to SEQ ID NO: 33976

SEQ ID NO: 707237 - RNA, 64 nt, Homo Sapiens; identical to SEQ ID NO: 33977

SEQ ID NO: 707238 - RNA, 64 nt, Homo Sapiens; identical to SEQ ID NO: 33978

SEQ ID NO: 707239 - RNA, 64 nt, Homo Sapiens; identical to SEQ ID NO: 33979

SEQ ID NO: 707240 - RNA, 64 nt, Homo Sapiens; identical to SEQ ID NO: 33980

SEQ ID NO: 707241 - RNA, 64 nt, Homo Sapiens; identical to SEQ ID NO: 33981

SEQ ID NO: 707242 - RNA, 64 nt, Homo Sapiens; identical to SEQ ID NO: 33982

SEQ ID NO: 707243 - RNA, 64 nt, Homo Sapiens; identical to SEQ ID NO: 33983

SEQ ID NO: 707244 - RNA, 64 nt, Homo Sapiens; identical to SEQ ID NO: 33984

SEQ ID NO: 707245 - RNA, 64 nt, Homo Sapiens; identical to SEQ ID NO: 33985

SEQ ID NO: 707246 - RNA, 64 nt, Homo Sapiens; identical to SEQ ID NO: 33986

SEQ ID NO: 707247 - RNA, 64 nt, Homo Sapiens; identical to SEQ ID NO: 33987

SEQ ID NO: 707248 - RNA, 64 nt, Homo Sapiens; identical to SEQ ID NO: 33988

SEQ ID NO: 707249 - RNA, 64 nt, Homo Sapiens; identical to SEQ ID NO: 33989

SEQ ID NO: 707250 - RNA, 64 nt, Homo Sapiens; identical to SEQ ID NO: 33990

SEQ ID NO: 707251 - RNA, 64 nt, Homo Sapiens; identical to SEQ ID NO: 33991

SEQ ID NO: 707252 - RNA, 64 nt, Homo Sapiens; identical to SEQ ID NO: 33992

SEQ ID NO: 707253 - RNA, 64 nt, Homo Sapiens; identical to SEQ ID NO: 33993

SEQ ID NO: 707254 - RNA, 64 nt, Homo Sapiens; identical to SEQ ID NO: 33994

SEQ ID NO: 707255 - RNA, 64 nt, Homo Sapiens; identical to SEQ ID NO: 33995

SEQ ID NO: 707256 - RNA, 64 nt, Homo Sapiens; identical to SEQ ID NO: 33996

SEQ ID NO: 707257 - RNA, 64 nt, Homo Sapiens; identical to SEQ ID NO: 33997

SEQ ID NO: 707258 - RNA, 64 nt, Homo Sapiens; identical to SEQ ID NO: 33998

SEQ ID NO: 707259 - RNA, 64 nt, Homo Sapiens; identical to SEQ ID NO: 33999

SEQ ID NO: 707260 - RNA, 64 nt, Homo Sapiens; identical to SEQ ID NO: 34000

SEQ ID NO: 707261 - RNA, 64 nt, Homo Sapiens; identical to SEQ ID NO: 34001

SEQ ID NO: 707262 - RNA, 64 nt, Homo Sapiens; identical to SEQ ID NO: 34002

SEQ ID NO: 707263 - RNA, 64 nt, Homo Sapiens; identical to SEQ ID NO: 34003

SEQ ID NO: 707264 - RNA, 64 nt, Homo Sapiens; identical to SEQ ID NO: 34004

SEQ ID NO: 707265 - RNA, 64 nt, Homo Sapiens; identical to SEQ ID NO: 34005

SEQ ID NO: 707266 - RNA, 64 nt, Homo Sapiens; identical to SEQ ID NO: 34006

SEQ ID NO: 707267 - RNA, 64 nt, Homo Sapiens; identical to SEQ ID NO: 34007

SEQ ID NO: 707268 - RNA, 64 nt, Homo Sapiens; identical to SEQ ID NO: 34008

SEQ ID NO: 707269 - RNA, 64 nt, Homo Sapiens; identical to SEQ ID NO: 34009

SEQ ID NO: 707270 - RNA, 64 nt, Homo Sapiens; identical to SEQ ID NO: 34010

SEQ ID NO: 707271 - RNA, 64 nt, Homo Sapiens; identical to SEQ ID NO: 34011

SEQ ID NO: 707272 - RNA, 64 nt, Homo Sapiens; identical to SEQ ID NO: 34012

SEQ ID NO: 707273 - RNA, 64 nt, Homo Sapiens; identical to SEQ ID NO: 34013

SEQ ID NO: 707274 - RNA, 64 nt, Homo Sapiens; identical to SEQ ID NO: 34014

SEQ ID NO: 707275 - RNA, 64 nt, Homo Sapiens; identical to SEQ ID NO: 34015

SEQ ID NO: 707276 - RNA, 64 nt, Homo Sapiens; identical to SEQ ID NO: 34016

SEQ ID NO: 707277 - RNA, 64 nt, Homo Sapiens; identical to SEQ ID NO: 34017

SEQ ID NO: 707278 - RNA, 64 nt, Homo Sapiens; identical to SEQ ID NO: 34018

SEQ ID NO: 707279 - RNA, 64 nt, Homo Sapiens; identical to SEQ ID NO: 34019

SEQ ID NO: 707280 - RNA, 64 nt, Homo Sapiens; identical to SEQ ID NO: 34020

SEQ ID NO: 707281 - RNA, 64 nt, Homo Sapiens; identical to SEQ ID NO: 34021

SEQ ID NO: 707282 - RNA, 64 nt, Homo Sapiens; identical to SEQ ID NO: 34022

SEQ ID NO: 707283 - RNA, 64 nt, Homo Sapiens; identical to SEQ ID NO: 34023

SEQ ID NO: 707284 - RNA, 64 nt, Homo Sapiens; identical to SEQ ID NO: 34024

SEQ ID NO: 707285 - RNA, 64 nt, Homo Sapiens; identical to SEQ ID NO: 34025

SEQ ID NO: 707286 - RNA, 64 nt, Homo Sapiens; identical to SEQ ID NO: 34026

SEQ ID NO: 707287 - RNA, 64 nt, Homo Sapiens; identical to SEQ ID NO: 34027

SEQ ID NO: 707288 - RNA, 64 nt, Homo Sapiens; identical to SEQ ID NO: 34028

SEQ ID NO: 707289 - RNA, 64 nt, Homo Sapiens; identical to SEQ ID NO: 34029

SEQ ID NO: 707290 - RNA, 64 nt, Homo Sapiens; identical to SEQ ID NO: 34030

SEQ ID NO: 707291 - RNA, 64 nt, Homo Sapiens; identical to SEQ ID NO: 34031

SEQ ID NO: 707292 - RNA, 64 nt, Homo Sapiens; identical to SEQ ID NO: 34032

SEQ ID NO: 707293 - RNA, 64 nt, Homo Sapiens; identical to SEQ ID NO: 34033

SEQ ID NO: 707294 - RNA, 64 nt, Homo Sapiens; identical to SEQ ID NO: 34034

SEQ ID NO: 707295 - RNA, 64 nt, Homo Sapiens; identical to SEQ ID NO: 34035

SEQ ID NO: 707296 - RNA, 64 nt, Homo Sapiens; identical to SEQ ID NO: 34036

SEQ ID NO: 707297 - RNA, 64 nt, Homo Sapiens; identical to SEQ ID NO: 34037

SEQ ID NO: 707298 - RNA, 64 nt, Homo Sapiens; identical to SEQ ID NO: 34038

SEQ ID NO: 707299 - RNA, 64 nt, Homo Sapiens; identical to SEQ ID NO: 34039

SEQ ID NO: 707300 - RNA, 64 nt, Homo Sapiens; identical to SEQ ID NO: 34040

SEQ ID NO: 707301 - RNA, 64 nt, Homo Sapiens; identical to SEQ ID NO: 34041

SEQ ID NO: 707302 - RNA, 64 nt, Homo Sapiens; identical to SEQ ID NO: 34042

SEQ ID NO: 707303 - RNA, 64 nt, Homo Sapiens; identical to SEQ ID NO: 34043

SEQ ID NO: 707304 - RNA, 64 nt, Homo Sapiens; identical to SEQ ID NO: 34044

SEQ ID NO: 707305 - RNA, 64 nt, Homo Sapiens; identical to SEQ ID NO: 34045

SEQ ID NO: 707306 - RNA, 64 nt, Homo Sapiens; identical to SEQ ID NO: 34046

SEQ ID NO: 707307 - RNA, 64 nt, Homo Sapiens; identical to SEQ ID NO: 34047

SEQ ID NO: 707308 - RNA, 64 nt, Homo Sapiens; identical to SEQ ID NO: 34048

SEQ ID NO: 707309 - RNA, 64 nt, Homo Sapiens; identical to SEQ ID NO: 34049

SEQ ID NO: 707310 - RNA, 64 nt, Homo Sapiens; identical to SEQ ID NO: 34050

SEQ ID NO: 707311 - RNA, 64 nt, Homo Sapiens; identical to SEQ ID NO: 34051

SEQ ID NO: 707312 - RNA, 64 nt, Homo Sapiens; identical to SEQ ID NO: 34052

SEQ ID NO: 707313 - RNA, 64 nt, Homo Sapiens; identical to SEQ ID NO: 34053

SEQ ID NO: 707314 - RNA, 64 nt, Homo Sapiens; identical to SEQ ID NO: 34054

SEQ ID NO: 707315 - RNA, 64 nt, Homo Sapiens; identical to SEQ ID NO: 34055

SEQ ID NO: 707316 - RNA, 64 nt, Homo Sapiens; identical to SEQ ID NO: 34056

SEQ ID NO: 707317 - RNA, 64 nt, Homo Sapiens; identical to SEQ ID NO: 34057

SEQ ID NO: 707318 - RNA, 64 nt, Homo Sapiens; identical to SEQ ID NO: 34058

SEQ ID NO: 707319 - RNA, 64 nt, Homo Sapiens; identical to SEQ ID NO: 34059

SEQ ID NO: 707320 - RNA, 64 nt, Homo Sapiens; identical to SEQ ID NO: 34060

SEQ ID NO: 707321 - RNA, 64 nt, Homo Sapiens; identical to SEQ ID NO: 34061

SEQ ID NO: 707322 - RNA, 64 nt, Homo Sapiens; identical to SEQ ID NO: 34062

SEQ ID NO: 707323 - RNA, 64 nt, Homo Sapiens; identical to SEQ ID NO: 34063

SEQ ID NO: 707324 - RNA, 64 nt, Homo Sapiens; identical to SEQ ID NO: 34064

SEQ ID NO: 707325 - RNA, 64 nt, Homo Sapiens; identical to SEQ ID NO: 34065

SEQ ID NO: 707326 - RNA, 64 nt, Homo Sapiens; identical to SEQ ID NO: 34066

SEQ ID NO: 707327 - RNA, 64 nt, Homo Sapiens; identical to SEQ ID NO: 34067

SEQ ID NO: 707328 - RNA, 64 nt, Homo Sapiens; identical to SEQ ID NO: 34068

SEQ ID NO: 707329 - RNA, 64 nt, Homo Sapiens; identical to SEQ ID NO: 34069

SEQ ID NO: 707330 - RNA, 64 nt, Homo Sapiens; identical to SEQ ID NO: 34070

SEQ ID NO: 707331 - RNA, 64 nt, Homo Sapiens; identical to SEQ ID NO: 34071

SEQ ID NO: 707332 - RNA, 64 nt, Homo Sapiens; identical to SEQ ID NO: 34072

SEQ ID NO: 707333 - RNA, 64 nt, Homo Sapiens; identical to SEQ ID NO: 34073

SEQ ID NO: 707334 - RNA, 64 nt, Homo Sapiens; identical to SEQ ID NO: 34074

SEQ ID NO: 707335 - RNA, 64 nt, Homo Sapiens; identical to SEQ ID NO: 34075

SEQ ID NO: 707336 - RNA, 64 nt, Homo Sapiens; identical to SEQ ID NO: 34076

SEQ ID NO: 707337 - RNA, 64 nt, Homo Sapiens; identical to SEQ ID NO: 34077

SEQ ID NO: 707338 - RNA, 64 nt, Homo Sapiens; identical to SEQ ID NO: 34078

SEQ ID NO: 707339 - RNA, 64 nt, Homo Sapiens; identical to SEQ ID NO: 34079

SEQ ID NO: 707340 - RNA, 64 nt, Homo Sapiens; identical to SEQ ID NO: 34080

SEQ ID NO: 707341 - RNA, 64 nt, Homo Sapiens; identical to SEQ ID NO: 34081

SEQ ID NO: 707342 - RNA, 64 nt, Homo Sapiens; identical to SEQ ID NO: 34082

SEQ ID NO: 707343 - RNA, 64 nt, Homo Sapiens; identical to SEQ ID NO: 34083

SEQ ID NO: 707344 - RNA, 64 nt, Homo Sapiens; identical to SEQ ID NO: 34084

SEQ ID NO: 707345 - RNA, 64 nt, Homo Sapiens; identical to SEQ ID NO: 34085

SEQ ID NO: 707346 - RNA, 64 nt, Homo Sapiens; identical to SEQ ID NO: 34086

SEQ ID NO: 707347 - RNA, 64 nt, Homo Sapiens; identical to SEQ ID NO: 34087

SEQ ID NO: 707348 - RNA, 64 nt, Homo Sapiens; identical to SEQ ID NO: 34088

SEQ ID NO: 707349 - RNA, 64 nt, Homo Sapiens; identical to SEQ ID NO: 34089

SEQ ID NO: 707350 - RNA, 64 nt, Homo Sapiens; identical to SEQ ID NO: 34090

SEQ ID NO: 707351 - RNA, 64 nt, Homo Sapiens; identical to SEQ ID NO: 34091

SEQ ID NO: 707352 - RNA, 64 nt, Homo Sapiens; identical to SEQ ID NO: 34092

SEQ ID NO: 707353 - RNA, 64 nt, Homo Sapiens; identical to SEQ ID NO: 34093

SEQ ID NO: 707354 - RNA, 64 nt, Homo Sapiens; identical to SEQ ID NO: 34094

SEQ ID NO: 707355 - RNA, 64 nt, Homo Sapiens; identical to SEQ ID NO: 34095

SEQ ID NO: 707356 - RNA, 64 nt, Homo Sapiens; identical to SEQ ID NO: 34096

SEQ ID NO: 707357 - RNA, 64 nt, Homo Sapiens; identical to SEQ ID NO: 34097

SEQ ID NO: 707358 - RNA, 64 nt, Homo Sapiens; identical to SEQ ID NO: 34098

SEQ ID NO: 707359 - RNA, 64 nt, Homo Sapiens; identical to SEQ ID NO: 34099

SEQ ID NO: 707360 - RNA, 64 nt, Homo Sapiens; identical to SEQ ID NO: 34100

SEQ ID NO: 707361 - RNA, 64 nt, Homo Sapiens; identical to SEQ ID NO: 34101

SEQ ID NO: 707362 - RNA, 64 nt, Homo Sapiens; identical to SEQ ID NO: 34102

SEQ ID NO: 707363 - RNA, 64 nt, Homo Sapiens; identical to SEQ ID NO: 34103

SEQ ID NO: 707364 - RNA, 64 nt, Homo Sapiens; identical to SEQ ID NO: 34104

SEQ ID NO: 707365 - RNA, 64 nt, Homo Sapiens; identical to SEQ ID NO: 34105

SEQ ID NO: 707366 - RNA, 64 nt, Homo Sapiens; identical to SEQ ID NO: 34106

SEQ ID NO: 707367 - RNA, 64 nt, Homo Sapiens; identical to SEQ ID NO: 34107

SEQ ID NO: 707368 - RNA, 64 nt, Homo Sapiens; identical to SEQ ID NO: 34108

SEQ ID NO: 707369 - RNA, 64 nt, Homo Sapiens; identical to SEQ ID NO: 34109

SEQ ID NO: 707370 - RNA, 64 nt, Homo Sapiens; identical to SEQ ID NO: 34110

SEQ ID NO: 707371 - RNA, 64 nt, Homo Sapiens; identical to SEQ ID NO: 34111

SEQ ID NO: 707372 - RNA, 64 nt, Homo Sapiens; identical to SEQ ID NO: 34112

SEQ ID NO: 707373 - RNA, 64 nt, Homo Sapiens; identical to SEQ ID NO: 34113

SEQ ID NO: 707374 - RNA, 64 nt, Homo Sapiens; identical to SEQ ID NO: 34114

SEQ ID NO: 707375 - RNA, 64 nt, Homo Sapiens; identical to SEQ ID NO: 34115

SEQ ID NO: 707376 - RNA, 64 nt, Homo Sapiens; identical to SEQ ID NO: 34116

SEQ ID NO: 707377 - RNA, 64 nt, Homo Sapiens; identical to SEQ ID NO: 34117

SEQ ID NO: 707378 - RNA, 64 nt, Homo Sapiens; identical to SEQ ID NO: 34118

SEQ ID NO: 707379 - RNA, 64 nt, Homo Sapiens; identical to SEQ ID NO: 34119

SEQ ID NO: 707380 - RNA, 64 nt, Homo Sapiens; identical to SEQ ID NO: 34120

SEQ ID NO: 707381 - RNA, 64 nt, Homo Sapiens; identical to SEQ ID NO: 34121

SEQ ID NO: 707382 - RNA, 64 nt, Homo Sapiens; identical to SEQ ID NO: 34122

SEQ ID NO: 707383 - RNA, 64 nt, Homo Sapiens; identical to SEQ ID NO: 34123

SEQ ID NO: 707384 - RNA, 64 nt, Homo Sapiens; identical to SEQ ID NO: 34124

SEQ ID NO: 707385 - RNA, 64 nt, Homo Sapiens; identical to SEQ ID NO: 34125

SEQ ID NO: 707386 - RNA, 64 nt, Homo Sapiens; identical to SEQ ID NO: 34126

SEQ ID NO: 707387 - RNA, 64 nt, Homo Sapiens; identical to SEQ ID NO: 34127

SEQ ID NO: 707388 - RNA, 64 nt, Homo Sapiens; identical to SEQ ID NO: 34128

SEQ ID NO: 707389 - RNA, 64 nt, Homo Sapiens; identical to SEQ ID NO: 34129

SEQ ID NO: 707390 - RNA, 64 nt, Homo Sapiens; identical to SEQ ID NO: 34130

SEQ ID NO: 707391 - RNA, 64 nt, Homo Sapiens; identical to SEQ ID NO: 34131

SEQ ID NO: 707392 - RNA, 64 nt, Homo Sapiens; identical to SEQ ID NO: 34132

SEQ ID NO: 707393 - RNA, 64 nt, Homo Sapiens; identical to SEQ ID NO: 34133

SEQ ID NO: 707394 - RNA, 64 nt, Homo Sapiens; identical to SEQ ID NO: 34134

SEQ ID NO: 707395 - RNA, 64 nt, Homo Sapiens; identical to SEQ ID NO: 34135

SEQ ID NO: 707396 - RNA, 64 nt, Homo Sapiens; identical to SEQ ID NO: 34136

SEQ ID NO: 707397 - RNA, 64 nt, Homo Sapiens; identical to SEQ ID NO: 34137

SEQ ID NO: 707398 - RNA, 64 nt, Homo Sapiens; identical to SEQ ID NO: 34138

SEQ ID NO: 707399 - RNA, 64 nt, Homo Sapiens; identical to SEQ ID NO: 34139

SEQ ID NO: 707400 - RNA, 64 nt, Homo Sapiens; identical to SEQ ID NO: 34140

SEQ ID NO: 707401 - RNA, 64 nt, Homo Sapiens; identical to SEQ ID NO: 34141

SEQ ID NO: 707402 - RNA, 64 nt, Homo Sapiens; identical to SEQ ID NO: 34142

SEQ ID NO: 707403 - RNA, 64 nt, Homo Sapiens; identical to SEQ ID NO: 34143

SEQ ID NO: 707404 - RNA, 64 nt, Homo Sapiens; identical to SEQ ID NO: 34144

SEQ ID NO: 707405 - RNA, 64 nt, Homo Sapiens; identical to SEQ ID NO: 34145

SEQ ID NO: 707406 - RNA, 64 nt, Homo Sapiens; identical to SEQ ID NO: 34146

SEQ ID NO: 707407 - RNA, 64 nt, Homo Sapiens; identical to SEQ ID NO: 34147

SEQ ID NO: 707408 - RNA, 64 nt, Homo Sapiens; identical to SEQ ID NO: 34148

SEQ ID NO: 707409 - RNA, 64 nt, Homo Sapiens; identical to SEQ ID NO: 34149

SEQ ID NO: 707410 - RNA, 64 nt, Homo Sapiens; identical to SEQ ID NO: 34150

SEQ ID NO: 707411 - RNA, 64 nt, Homo Sapiens; identical to SEQ ID NO: 34151

SEQ ID NO: 707412 - RNA, 64 nt, Homo Sapiens; identical to SEQ ID NO: 34152

SEQ ID NO: 707413 - RNA, 64 nt, Homo Sapiens; identical to SEQ ID NO: 34153

SEQ ID NO: 707414 - RNA, 64 nt, Homo Sapiens; identical to SEQ ID NO: 34154

SEQ ID NO: 707415 - RNA, 64 nt, Homo Sapiens; identical to SEQ ID NO: 34155

SEQ ID NO: 707416 - RNA, 64 nt, Homo Sapiens; identical to SEQ ID NO: 34156

SEQ ID NO: 707417 - RNA, 64 nt, Homo Sapiens; identical to SEQ ID NO: 34157

SEQ ID NO: 707418 - RNA, 64 nt, Homo Sapiens; identical to SEQ ID NO: 34158

SEQ ID NO: 707419 - RNA, 64 nt, Homo Sapiens; identical to SEQ ID NO: 34159

SEQ ID NO: 707420 - RNA, 64 nt, Homo Sapiens; identical to SEQ ID NO: 34160

SEQ ID NO: 707421 - RNA, 64 nt, Homo Sapiens; identical to SEQ ID NO: 34161

SEQ ID NO: 707422 - RNA, 64 nt, Homo Sapiens; identical to SEQ ID NO: 34162

SEQ ID NO: 707423 - RNA, 64 nt, Homo Sapiens; identical to SEQ ID NO: 34163

SEQ ID NO: 707424 - RNA, 64 nt, Homo Sapiens; identical to SEQ ID NO: 34164

SEQ ID NO: 707425 - RNA, 64 nt, Homo Sapiens; identical to SEQ ID NO: 34165

SEQ ID NO: 707426 - RNA, 64 nt, Homo Sapiens; identical to SEQ ID NO: 34166

SEQ ID NO: 707427 - RNA, 64 nt, Homo Sapiens; identical to SEQ ID NO: 34167

SEQ ID NO: 707428 - RNA, 64 nt, Homo Sapiens; identical to SEQ ID NO: 34168

SEQ ID NO: 707429 - RNA, 64 nt, Homo Sapiens; identical to SEQ ID NO: 34169

SEQ ID NO: 707430 - RNA, 64 nt, Homo Sapiens; identical to SEQ ID NO: 34170

SEQ ID NO: 707431 - RNA, 64 nt, Homo Sapiens; identical to SEQ ID NO: 34171

SEQ ID NO: 707432 - RNA, 64 nt, Homo Sapiens; identical to SEQ ID NO: 34172

SEQ ID NO: 707433 - RNA, 64 nt, Homo Sapiens; identical to SEQ ID NO: 34173

SEQ ID NO: 707434 - RNA, 64 nt, Homo Sapiens; identical to SEQ ID NO: 34174

SEQ ID NO: 707435 - RNA, 64 nt, Homo Sapiens; identical to SEQ ID NO: 34175

SEQ ID NO: 707436 - RNA, 64 nt, Homo Sapiens; identical to SEQ ID NO: 34176

SEQ ID NO: 707437 - RNA, 64 nt, Homo Sapiens; identical to SEQ ID NO: 34177

SEQ ID NO: 707438 - RNA, 64 nt, Homo Sapiens; identical to SEQ ID NO: 34178

SEQ ID NO: 707439 - RNA, 64 nt, Homo Sapiens; identical to SEQ ID NO: 34179

SEQ ID NO: 707440 - RNA, 64 nt, Homo Sapiens; identical to SEQ ID NO: 34180

SEQ ID NO: 707441 - RNA, 64 nt, Homo Sapiens; identical to SEQ ID NO: 34181

SEQ ID NO: 707442 - RNA, 64 nt, Homo Sapiens; identical to SEQ ID NO: 34182

SEQ ID NO: 707443 - RNA, 64 nt, Homo Sapiens; identical to SEQ ID NO: 34183

SEQ ID NO: 707444 - RNA, 64 nt, Homo Sapiens; identical to SEQ ID NO: 34184

SEQ ID NO: 707445 - RNA, 64 nt, Homo Sapiens; identical to SEQ ID NO: 34185

SEQ ID NO: 707446 - RNA, 64 nt, Homo Sapiens; identical to SEQ ID NO: 34186

SEQ ID NO: 707447 - RNA, 64 nt, Homo Sapiens; identical to SEQ ID NO: 34187

SEQ ID NO: 707448 - RNA, 64 nt, Homo Sapiens; identical to SEQ ID NO: 34188

SEQ ID NO: 707449 - RNA, 63 nt, Homo Sapiens; identical to SEQ ID NO: 34189

SEQ ID NO: 707450 - RNA, 64 nt, Homo Sapiens; identical to SEQ ID NO: 34190

SEQ ID NO: 707451 - RNA, 64 nt, Homo Sapiens; identical to SEQ ID NO: 34191

SEQ ID NO: 707452 - RNA, 64 nt, Homo Sapiens; identical to SEQ ID NO: 34192

SEQ ID NO: 707453 - RNA, 64 nt, Homo Sapiens; identical to SEQ ID NO: 34193

SEQ ID NO: 707454 - RNA, 64 nt, Homo Sapiens; identical to SEQ ID NO: 34194

SEQ ID NO: 707455 - RNA, 64 nt, Homo Sapiens; identical to SEQ ID NO: 34195

SEQ ID NO: 707456 - RNA, 64 nt, Homo Sapiens; identical to SEQ ID NO: 34196

SEQ ID NO: 707457 - RNA, 64 nt, Homo Sapiens; identical to SEQ ID NO: 34197

SEQ ID NO: 707458 - RNA, 64 nt, Homo Sapiens; identical to SEQ ID NO: 34198

SEQ ID NO: 707459 - RNA, 64 nt, Homo Sapiens; identical to SEQ ID NO: 34199

SEQ ID NO: 707460 - RNA, 64 nt, Homo Sapiens; identical to SEQ ID NO: 34200

SEQ ID NO: 707461 - RNA, 64 nt, Homo Sapiens; identical to SEQ ID NO: 34201

SEQ ID NO: 707462 - RNA, 64 nt, Homo Sapiens; identical to SEQ ID NO: 34202

SEQ ID NO: 707463 - RNA, 64 nt, Homo Sapiens; identical to SEQ ID NO: 34203

SEQ ID NO: 707464 - RNA, 64 nt, Homo Sapiens; identical to SEQ ID NO: 34204

SEQ ID NO: 707465 - RNA, 64 nt, Homo Sapiens; identical to SEQ ID NO: 34205

SEQ ID NO: 707466 - RNA, 64 nt, Homo Sapiens; identical to SEQ ID NO: 34206

SEQ ID NO: 707467 - RNA, 64 nt, Homo Sapiens; identical to SEQ ID NO: 34207

SEQ ID NO: 707468 - RNA, 64 nt, Homo Sapiens; identical to SEQ ID NO: 34208

SEQ ID NO: 707469 - RNA, 64 nt, Homo Sapiens; identical to SEQ ID NO: 34209

SEQ ID NO: 707470 - RNA, 64 nt, Homo Sapiens; identical to SEQ ID NO: 34210

SEQ ID NO: 707471 - RNA, 64 nt, Homo Sapiens; identical to SEQ ID NO: 34211

SEQ ID NO: 707472 - RNA, 64 nt, Homo Sapiens; identical to SEQ ID NO: 34212

SEQ ID NO: 707473 - RNA, 64 nt, Homo Sapiens; identical to SEQ ID NO: 34213

SEQ ID NO: 707474 - RNA, 64 nt, Homo Sapiens; identical to SEQ ID NO: 34214

SEQ ID NO: 707475 - RNA, 64 nt, Homo Sapiens; identical to SEQ ID NO: 34215

SEQ ID NO: 707476 - RNA, 64 nt, Homo Sapiens; identical to SEQ ID NO: 34216

SEQ ID NO: 707477 - RNA, 64 nt, Homo Sapiens; identical to SEQ ID NO: 34217

SEQ ID NO: 707478 - RNA, 64 nt, Homo Sapiens; identical to SEQ ID NO: 34218

SEQ ID NO: 707479 - RNA, 64 nt, Homo Sapiens; identical to SEQ ID NO: 34219

SEQ ID NO: 707480 - RNA, 64 nt, Homo Sapiens; identical to SEQ ID NO: 34220

SEQ ID NO: 707481 - RNA, 64 nt, Homo Sapiens; identical to SEQ ID NO: 34221

SEQ ID NO: 707482 - RNA, 64 nt, Homo Sapiens; identical to SEQ ID NO: 34222

SEQ ID NO: 707483 - RNA, 64 nt, Homo Sapiens; identical to SEQ ID NO: 34223

SEQ ID NO: 707484 - RNA, 64 nt, Homo Sapiens; identical to SEQ ID NO: 34224

SEQ ID NO: 707485 - RNA, 64 nt, Homo Sapiens; identical to SEQ ID NO: 34225

SEQ ID NO: 707486 - RNA, 64 nt, Homo Sapiens; identical to SEQ ID NO: 34226

SEQ ID NO: 707487 - RNA, 64 nt, Homo Sapiens; identical to SEQ ID NO: 34227

SEQ ID NO: 707488 - RNA, 64 nt, Homo Sapiens; identical to SEQ ID NO: 34228

SEQ ID NO: 707489 - RNA, 64 nt, Homo Sapiens; identical to SEQ ID NO: 34229

SEQ ID NO: 707490 - RNA, 64 nt, Homo Sapiens; identical to SEQ ID NO: 34230

SEQ ID NO: 707491 - RNA, 64 nt, Homo Sapiens; identical to SEQ ID NO: 34231

SEQ ID NO: 707492 - RNA, 64 nt, Homo Sapiens; identical to SEQ ID NO: 34232

SEQ ID NO: 707493 - RNA, 64 nt, Homo Sapiens; identical to SEQ ID NO: 34233

SEQ ID NO: 707494 - RNA, 64 nt, Homo Sapiens; identical to SEQ ID NO: 34234

SEQ ID NO: 707495 - RNA, 64 nt, Homo Sapiens; identical to SEQ ID NO: 34235

SEQ ID NO: 707496 - RNA, 64 nt, Homo Sapiens; identical to SEQ ID NO: 34236

SEQ ID NO: 707497 - RNA, 64 nt, Homo Sapiens; identical to SEQ ID NO: 34237

SEQ ID NO: 707498 - RNA, 64 nt, Homo Sapiens; identical to SEQ ID NO: 34238

SEQ ID NO: 707499 - RNA, 64 nt, Homo Sapiens; identical to SEQ ID NO: 34239

SEQ ID NO: 707500 - RNA, 64 nt, Homo Sapiens; identical to SEQ ID NO: 34240

SEQ ID NO: 707501 - RNA, 64 nt, Homo Sapiens; identical to SEQ ID NO: 34241

SEQ ID NO: 707502 - RNA, 64 nt, Homo Sapiens; identical to SEQ ID NO: 34242

SEQ ID NO: 707503 - RNA, 64 nt, Homo Sapiens; identical to SEQ ID NO: 34243

SEQ ID NO: 707504 - RNA, 64 nt, Homo Sapiens; identical to SEQ ID NO: 34244

SEQ ID NO: 707505 - RNA, 64 nt, Homo Sapiens; identical to SEQ ID NO: 34245

SEQ ID NO: 707506 - RNA, 64 nt, Homo Sapiens; identical to SEQ ID NO: 34246

SEQ ID NO: 707507 - RNA, 64 nt, Homo Sapiens; identical to SEQ ID NO: 34247

SEQ ID NO: 707508 - RNA, 64 nt, Homo Sapiens; identical to SEQ ID NO: 34248

SEQ ID NO: 707509 - RNA, 64 nt, Homo Sapiens; identical to SEQ ID NO: 34249

SEQ ID NO: 707510 - RNA, 64 nt, Homo Sapiens; identical to SEQ ID NO: 34250

SEQ ID NO: 707511 - RNA, 64 nt, Homo Sapiens; identical to SEQ ID NO: 34251

SEQ ID NO: 707512 - RNA, 64 nt, Homo Sapiens; identical to SEQ ID NO: 34252

SEQ ID NO: 707513 - RNA, 64 nt, Homo Sapiens; identical to SEQ ID NO: 34253

SEQ ID NO: 707514 - RNA, 64 nt, Homo Sapiens; identical to SEQ ID NO: 34254

SEQ ID NO: 707515 - RNA, 64 nt, Homo Sapiens; identical to SEQ ID NO: 34255

SEQ ID NO: 707516 - RNA, 64 nt, Homo Sapiens; identical to SEQ ID NO: 34256

SEQ ID NO: 707517 - RNA, 64 nt, Homo Sapiens; identical to SEQ ID NO: 34257

SEQ ID NO: 707518 - RNA, 63 nt, Homo Sapiens; identical to SEQ ID NO: 34258

SEQ ID NO: 707519 - RNA, 64 nt, Homo Sapiens; identical to SEQ ID NO: 34259

SEQ ID NO: 707520 - RNA, 64 nt, Homo Sapiens; identical to SEQ ID NO: 34260

SEQ ID NO: 707521 - RNA, 64 nt, Homo Sapiens; identical to SEQ ID NO: 34261

SEQ ID NO: 707522 - RNA, 64 nt, Homo Sapiens; identical to SEQ ID NO: 34262

SEQ ID NO: 707523 - RNA, 64 nt, Homo Sapiens; identical to SEQ ID NO: 34263

SEQ ID NO: 707524 - RNA, 64 nt, Homo Sapiens; identical to SEQ ID NO: 34264

SEQ ID NO: 707525 - RNA, 64 nt, Homo Sapiens; identical to SEQ ID NO: 34265

SEQ ID NO: 707526 - RNA, 64 nt, Homo Sapiens; identical to SEQ ID NO: 34266

SEQ ID NO: 707527 - RNA, 64 nt, Homo Sapiens; identical to SEQ ID NO: 34267

SEQ ID NO: 707528 - RNA, 64 nt, Homo Sapiens; identical to SEQ ID NO: 34268

SEQ ID NO: 707529 - RNA, 64 nt, Homo Sapiens; identical to SEQ ID NO: 34269

SEQ ID NO: 707530 - RNA, 64 nt, Homo Sapiens; identical to SEQ ID NO: 34270

SEQ ID NO: 707531 - RNA, 64 nt, Homo Sapiens; identical to SEQ ID NO: 34271

SEQ ID NO: 707532 - RNA, 64 nt, Homo Sapiens; identical to SEQ ID NO: 34272

SEQ ID NO: 707533 - RNA, 64 nt, Homo Sapiens; identical to SEQ ID NO: 34273

SEQ ID NO: 707534 - RNA, 64 nt, Homo Sapiens; identical to SEQ ID NO: 34274

SEQ ID NO: 707535 - RNA, 64 nt, Homo Sapiens; identical to SEQ ID NO: 34275

SEQ ID NO: 707536 - RNA, 64 nt, Homo Sapiens; identical to SEQ ID NO: 34276

SEQ ID NO: 707537 - RNA, 64 nt, Homo Sapiens; identical to SEQ ID NO: 34277

SEQ ID NO: 707538 - RNA, 64 nt, Homo Sapiens; identical to SEQ ID NO: 34278

SEQ ID NO: 707539 - RNA, 64 nt, Homo Sapiens; identical to SEQ ID NO: 34279

SEQ ID NO: 707540 - RNA, 64 nt, Homo Sapiens; identical to SEQ ID NO: 34280

SEQ ID NO: 707541 - RNA, 64 nt, Homo Sapiens; identical to SEQ ID NO: 34281

SEQ ID NO: 707542 - RNA, 64 nt, Homo Sapiens; identical to SEQ ID NO: 34282

SEQ ID NO: 707543 - RNA, 64 nt, Homo Sapiens; identical to SEQ ID NO: 34283

SEQ ID NO: 707544 - RNA, 64 nt, Homo Sapiens; identical to SEQ ID NO: 34284

SEQ ID NO: 707545 - RNA, 64 nt, Homo Sapiens; identical to SEQ ID NO: 34285

SEQ ID NO: 707546 - RNA, 64 nt, Homo Sapiens; identical to SEQ ID NO: 34286

SEQ ID NO: 707547 - RNA, 64 nt, Homo Sapiens; identical to SEQ ID NO: 34287

SEQ ID NO: 707548 - RNA, 64 nt, Homo Sapiens; identical to SEQ ID NO: 34288

SEQ ID NO: 707549 - RNA, 64 nt, Homo Sapiens; identical to SEQ ID NO: 34289

SEQ ID NO: 707550 - RNA, 64 nt, Homo Sapiens; identical to SEQ ID NO: 34290

SEQ ID NO: 707551 - RNA, 64 nt, Homo Sapiens; identical to SEQ ID NO: 34291

SEQ ID NO: 707552 - RNA, 64 nt, Homo Sapiens; identical to SEQ ID NO: 34292

SEQ ID NO: 707553 - RNA, 64 nt, Homo Sapiens; identical to SEQ ID NO: 34293

SEQ ID NO: 707554 - RNA, 64 nt, Homo Sapiens; identical to SEQ ID NO: 34294

SEQ ID NO: 707555 - RNA, 64 nt, Homo Sapiens; identical to SEQ ID NO: 34295

SEQ ID NO: 707556 - RNA, 64 nt, Homo Sapiens; identical to SEQ ID NO: 34296

SEQ ID NO: 707557 - RNA, 64 nt, Homo Sapiens; identical to SEQ ID NO: 34297

SEQ ID NO: 707558 - RNA, 64 nt, Homo Sapiens; identical to SEQ ID NO: 34298

SEQ ID NO: 707559 - RNA, 64 nt, Homo Sapiens; identical to SEQ ID NO: 34299

SEQ ID NO: 707560 - RNA, 64 nt, Homo Sapiens; identical to SEQ ID NO: 34300

SEQ ID NO: 707561 - RNA, 64 nt, Homo Sapiens; identical to SEQ ID NO: 34301

SEQ ID NO: 707562 - RNA, 64 nt, Homo Sapiens; identical to SEQ ID NO: 34302

SEQ ID NO: 707563 - RNA, 64 nt, Homo Sapiens; identical to SEQ ID NO: 34303

SEQ ID NO: 707564 - RNA, 64 nt, Homo Sapiens; identical to SEQ ID NO: 34304

SEQ ID NO: 707565 - RNA, 64 nt, Homo Sapiens; identical to SEQ ID NO: 34305

SEQ ID NO: 707566 - RNA, 64 nt, Homo Sapiens; identical to SEQ ID NO: 34306

SEQ ID NO: 707567 - RNA, 64 nt, Homo Sapiens; identical to SEQ ID NO: 34307

SEQ ID NO: 707568 - RNA, 64 nt, Homo Sapiens; identical to SEQ ID NO: 34308

SEQ ID NO: 707569 - RNA, 64 nt, Homo Sapiens; identical to SEQ ID NO: 34309

SEQ ID NO: 707570 - RNA, 64 nt, Homo Sapiens; identical to SEQ ID NO: 34310

SEQ ID NO: 707571 - RNA, 64 nt, Homo Sapiens; identical to SEQ ID NO: 34311

SEQ ID NO: 707572 - RNA, 64 nt, Homo Sapiens; identical to SEQ ID NO: 34312

SEQ ID NO: 707573 - RNA, 64 nt, Homo Sapiens; identical to SEQ ID NO: 34313

SEQ ID NO: 707574 - RNA, 64 nt, Homo Sapiens; identical to SEQ ID NO: 34314

SEQ ID NO: 707575 - RNA, 64 nt, Homo Sapiens; identical to SEQ ID NO: 34315

SEQ ID NO: 707576 - RNA, 64 nt, Homo Sapiens; identical to SEQ ID NO: 34316

SEQ ID NO: 707577 - RNA, 64 nt, Homo Sapiens; identical to SEQ ID NO: 34317

SEQ ID NO: 707578 - RNA, 64 nt, Homo Sapiens; identical to SEQ ID NO: 34318

SEQ ID NO: 707579 - RNA, 64 nt, Homo Sapiens; identical to SEQ ID NO: 34319

SEQ ID NO: 707580 - RNA, 64 nt, Homo Sapiens; identical to SEQ ID NO: 34320

SEQ ID NO: 707581 - RNA, 64 nt, Homo Sapiens; identical to SEQ ID NO: 34321

SEQ ID NO: 707582 - RNA, 64 nt, Homo Sapiens; identical to SEQ ID NO: 34322

SEQ ID NO: 707583 - RNA, 64 nt, Homo Sapiens; identical to SEQ ID NO: 34323

SEQ ID NO: 707584 - RNA, 64 nt, Homo Sapiens; identical to SEQ ID NO: 34324

SEQ ID NO: 707585 - RNA, 64 nt, Homo Sapiens; identical to SEQ ID NO: 34325

SEQ ID NO: 707586 - RNA, 64 nt, Homo Sapiens; identical to SEQ ID NO: 34326

SEQ ID NO: 707587 - RNA, 64 nt, Homo Sapiens; identical to SEQ ID NO: 34327

SEQ ID NO: 707588 - RNA, 64 nt, Homo Sapiens; identical to SEQ ID NO: 34328

SEQ ID NO: 707589 - RNA, 64 nt, Homo Sapiens; identical to SEQ ID NO: 34329

SEQ ID NO: 707590 - RNA, 64 nt, Homo Sapiens; identical to SEQ ID NO: 34330

SEQ ID NO: 707591 - RNA, 64 nt, Homo Sapiens; identical to SEQ ID NO: 34331

SEQ ID NO: 707592 - RNA, 64 nt, Homo Sapiens; identical to SEQ ID NO: 34332

SEQ ID NO: 707593 - RNA, 64 nt, Homo Sapiens; identical to SEQ ID NO: 34333

SEQ ID NO: 707594 - RNA, 64 nt, Homo Sapiens; identical to SEQ ID NO: 34334

SEQ ID NO: 707595 - RNA, 64 nt, Homo Sapiens; identical to SEQ ID NO: 34335

SEQ ID NO: 707596 - RNA, 64 nt, Homo Sapiens; identical to SEQ ID NO: 34336

SEQ ID NO: 707597 - RNA, 64 nt, Homo Sapiens; identical to SEQ ID NO: 34337

SEQ ID NO: 707598 - RNA, 64 nt, Homo Sapiens; identical to SEQ ID NO: 34338

SEQ ID NO: 707599 - RNA, 64 nt, Homo Sapiens; identical to SEQ ID NO: 34339

SEQ ID NO: 707600 - RNA, 64 nt, Homo Sapiens; identical to SEQ ID NO: 34340

SEQ ID NO: 707601 - RNA, 64 nt, Homo Sapiens; identical to SEQ ID NO: 34341

SEQ ID NO: 707602 - RNA, 64 nt, Homo Sapiens; identical to SEQ ID NO: 34342

SEQ ID NO: 707603 - RNA, 64 nt, Homo Sapiens; identical to SEQ ID NO: 34343

SEQ ID NO: 707604 - RNA, 64 nt, Homo Sapiens; identical to SEQ ID NO: 34344

SEQ ID NO: 707605 - RNA, 64 nt, Homo Sapiens; identical to SEQ ID NO: 34345

SEQ ID NO: 707606 - RNA, 64 nt, Homo Sapiens; identical to SEQ ID NO: 34346

SEQ ID NO: 707607 - RNA, 64 nt, Homo Sapiens; identical to SEQ ID NO: 34347

SEQ ID NO: 707608 - RNA, 64 nt, Homo Sapiens; identical to SEQ ID NO: 34348

SEQ ID NO: 707609 - RNA, 64 nt, Homo Sapiens; identical to SEQ ID NO: 34349

SEQ ID NO: 707610 - RNA, 64 nt, Homo Sapiens; identical to SEQ ID NO: 34350

SEQ ID NO: 707611 - RNA, 64 nt, Homo Sapiens; identical to SEQ ID NO: 34351

SEQ ID NO: 707612 - RNA, 64 nt, Homo Sapiens; identical to SEQ ID NO: 34352

SEQ ID NO: 707613 - RNA, 64 nt, Homo Sapiens; identical to SEQ ID NO: 34353

SEQ ID NO: 707614 - RNA, 64 nt, Homo Sapiens; identical to SEQ ID NO: 34354

SEQ ID NO: 707615 - RNA, 64 nt, Homo Sapiens; identical to SEQ ID NO: 34355

SEQ ID NO: 707616 - RNA, 64 nt, Homo Sapiens; identical to SEQ ID NO: 34356

SEQ ID NO: 707617 - RNA, 64 nt, Homo Sapiens; identical to SEQ ID NO: 34357

SEQ ID NO: 707618 - RNA, 64 nt, Homo Sapiens; identical to SEQ ID NO: 34358

SEQ ID NO: 707619 - RNA, 64 nt, Homo Sapiens; identical to SEQ ID NO: 34359

SEQ ID NO: 707620 - RNA, 64 nt, Homo Sapiens; identical to SEQ ID NO: 34360

SEQ ID NO: 707621 - RNA, 64 nt, Homo Sapiens; identical to SEQ ID NO: 34361

SEQ ID NO: 707622 - RNA, 64 nt, Homo Sapiens; identical to SEQ ID NO: 34362

SEQ ID NO: 707623 - RNA, 64 nt, Homo Sapiens; identical to SEQ ID NO: 34363

SEQ ID NO: 707624 - RNA, 64 nt, Homo Sapiens; identical to SEQ ID NO: 34364

SEQ ID NO: 707625 - RNA, 64 nt, Homo Sapiens; identical to SEQ ID NO: 34365

SEQ ID NO: 707626 - RNA, 64 nt, Homo Sapiens; identical to SEQ ID NO: 34366

SEQ ID NO: 707627 - RNA, 64 nt, Homo Sapiens; identical to SEQ ID NO: 34367

SEQ ID NO: 707628 - RNA, 64 nt, Homo Sapiens; identical to SEQ ID NO: 34368

SEQ ID NO: 707629 - RNA, 64 nt, Homo Sapiens; identical to SEQ ID NO: 34369

SEQ ID NO: 707630 - RNA, 64 nt, Homo Sapiens; identical to SEQ ID NO: 34370

SEQ ID NO: 707631 - RNA, 64 nt, Homo Sapiens; identical to SEQ ID NO: 34371

SEQ ID NO: 707632 - RNA, 64 nt, Homo Sapiens; identical to SEQ ID NO: 34372

SEQ ID NO: 707633 - RNA, 64 nt, Homo Sapiens; identical to SEQ ID NO: 34373

SEQ ID NO: 707634 - RNA, 64 nt, Homo Sapiens; identical to SEQ ID NO: 34374

SEQ ID NO: 707635 - RNA, 64 nt, Homo Sapiens; identical to SEQ ID NO: 34375

SEQ ID NO: 707636 - RNA, 64 nt, Homo Sapiens; identical to SEQ ID NO: 34376

SEQ ID NO: 707637 - RNA, 64 nt, Homo Sapiens; identical to SEQ ID NO: 34377

SEQ ID NO: 707638 - RNA, 64 nt, Homo Sapiens; identical to SEQ ID NO: 34378

SEQ ID NO: 707639 - RNA, 64 nt, Homo Sapiens; identical to SEQ ID NO: 34379

SEQ ID NO: 707640 - RNA, 64 nt, Homo Sapiens; identical to SEQ ID NO: 34380

SEQ ID NO: 707641 - RNA, 64 nt, Homo Sapiens; identical to SEQ ID NO: 34381

SEQ ID NO: 707642 - RNA, 64 nt, Homo Sapiens; identical to SEQ ID NO: 34382

SEQ ID NO: 707643 - RNA, 64 nt, Homo Sapiens; identical to SEQ ID NO: 34383

SEQ ID NO: 707644 - RNA, 64 nt, Homo Sapiens; identical to SEQ ID NO: 34384

SEQ ID NO: 707645 - RNA, 64 nt, Homo Sapiens; identical to SEQ ID NO: 34385

SEQ ID NO: 707646 - RNA, 64 nt, Homo Sapiens; identical to SEQ ID NO: 34386

SEQ ID NO: 707647 - RNA, 64 nt, Homo Sapiens; identical to SEQ ID NO: 34387

SEQ ID NO: 707648 - RNA, 64 nt, Homo Sapiens; identical to SEQ ID NO: 34388

SEQ ID NO: 707649 - RNA, 64 nt, Homo Sapiens; identical to SEQ ID NO: 34389

SEQ ID NO: 707650 - RNA, 64 nt, Homo Sapiens; identical to SEQ ID NO: 34390

SEQ ID NO: 707651 - RNA, 64 nt, Homo Sapiens; identical to SEQ ID NO: 34391

SEQ ID NO: 707652 - RNA, 64 nt, Homo Sapiens; identical to SEQ ID NO: 34392

SEQ ID NO: 707653 - RNA, 64 nt, Homo Sapiens; identical to SEQ ID NO: 34393

SEQ ID NO: 707654 - RNA, 64 nt, Homo Sapiens; identical to SEQ ID NO: 34394

SEQ ID NO: 707655 - RNA, 64 nt, Homo Sapiens; identical to SEQ ID NO: 34395

SEQ ID NO: 707656 - RNA, 64 nt, Homo Sapiens; identical to SEQ ID NO: 34396

SEQ ID NO: 707657 - RNA, 64 nt, Homo Sapiens; identical to SEQ ID NO: 34397

SEQ ID NO: 707658 - RNA, 64 nt, Homo Sapiens; identical to SEQ ID NO: 34398

SEQ ID NO: 707659 - RNA, 64 nt, Homo Sapiens; identical to SEQ ID NO: 34399

SEQ ID NO: 707660 - RNA, 64 nt, Homo Sapiens; identical to SEQ ID NO: 34400

SEQ ID NO: 707661 - RNA, 64 nt, Homo Sapiens; identical to SEQ ID NO: 34401

SEQ ID NO: 707662 - RNA, 64 nt, Homo Sapiens; identical to SEQ ID NO: 34402

SEQ ID NO: 707663 - RNA, 64 nt, Homo Sapiens; identical to SEQ ID NO: 34403

SEQ ID NO: 707664 - RNA, 64 nt, Homo Sapiens; identical to SEQ ID NO: 34404

SEQ ID NO: 707665 - RNA, 64 nt, Homo Sapiens; identical to SEQ ID NO: 34405

SEQ ID NO: 707666 - RNA, 64 nt, Homo Sapiens; identical to SEQ ID NO: 34406

SEQ ID NO: 707667 - RNA, 64 nt, Homo Sapiens; identical to SEQ ID NO: 34407

SEQ ID NO: 707668 - RNA, 64 nt, Homo Sapiens; identical to SEQ ID NO: 34408

SEQ ID NO: 707669 - RNA, 64 nt, Homo Sapiens; identical to SEQ ID NO: 34409

SEQ ID NO: 707670 - RNA, 64 nt, Homo Sapiens; identical to SEQ ID NO: 34410

SEQ ID NO: 707671 - RNA, 64 nt, Homo Sapiens; identical to SEQ ID NO: 34411

SEQ ID NO: 707672 - RNA, 64 nt, Homo Sapiens; identical to SEQ ID NO: 34412

SEQ ID NO: 707673 - RNA, 64 nt, Homo Sapiens; identical to SEQ ID NO: 34413

SEQ ID NO: 707674 - RNA, 64 nt, Homo Sapiens; identical to SEQ ID NO: 34414

SEQ ID NO: 707675 - RNA, 64 nt, Homo Sapiens; identical to SEQ ID NO: 34415

SEQ ID NO: 707676 - RNA, 64 nt, Homo Sapiens; identical to SEQ ID NO: 34416

SEQ ID NO: 707677 - RNA, 64 nt, Homo Sapiens; identical to SEQ ID NO: 34417

SEQ ID NO: 707678 - RNA, 64 nt, Homo Sapiens; identical to SEQ ID NO: 34418

SEQ ID NO: 707679 - RNA, 64 nt, Homo Sapiens; identical to SEQ ID NO: 34419

SEQ ID NO: 707680 - RNA, 64 nt, Homo Sapiens; identical to SEQ ID NO: 34420

SEQ ID NO: 707681 - RNA, 64 nt, Homo Sapiens; identical to SEQ ID NO: 34421

SEQ ID NO: 707682 - RNA, 64 nt, Homo Sapiens; identical to SEQ ID NO: 34422

SEQ ID NO: 707683 - RNA, 64 nt, Homo Sapiens; identical to SEQ ID NO: 34423

SEQ ID NO: 707684 - RNA, 64 nt, Homo Sapiens; identical to SEQ ID NO: 34424

SEQ ID NO: 707685 - RNA, 64 nt, Homo Sapiens; identical to SEQ ID NO: 34425

SEQ ID NO: 707686 - RNA, 64 nt, Homo Sapiens; identical to SEQ ID NO: 34426

SEQ ID NO: 707687 - RNA, 64 nt, Homo Sapiens; identical to SEQ ID NO: 34427

SEQ ID NO: 707688 - RNA, 64 nt, Homo Sapiens; identical to SEQ ID NO: 34428

SEQ ID NO: 707689 - RNA, 64 nt, Homo Sapiens; identical to SEQ ID NO: 34429

SEQ ID NO: 707690 - RNA, 64 nt, Homo Sapiens; identical to SEQ ID NO: 34430

SEQ ID NO: 707691 - RNA, 64 nt, Homo Sapiens; identical to SEQ ID NO: 34431

SEQ ID NO: 707692 - RNA, 64 nt, Homo Sapiens; identical to SEQ ID NO: 34432

SEQ ID NO: 707693 - RNA, 64 nt, Homo Sapiens; identical to SEQ ID NO: 34433

SEQ ID NO: 707694 - RNA, 64 nt, Homo Sapiens; identical to SEQ ID NO: 34434

SEQ ID NO: 707695 - RNA, 64 nt, Homo Sapiens; identical to SEQ ID NO: 34435

SEQ ID NO: 707696 - RNA, 64 nt, Homo Sapiens; identical to SEQ ID NO: 34436

SEQ ID NO: 707697 - RNA, 64 nt, Homo Sapiens; identical to SEQ ID NO: 34437

SEQ ID NO: 707698 - RNA, 64 nt, Homo Sapiens; identical to SEQ ID NO: 34438

SEQ ID NO: 707699 - RNA, 64 nt, Homo Sapiens; identical to SEQ ID NO: 34439

SEQ ID NO: 707700 - RNA, 64 nt, Homo Sapiens; identical to SEQ ID NO: 34440

SEQ ID NO: 707701 - RNA, 64 nt, Homo Sapiens; identical to SEQ ID NO: 34441

SEQ ID NO: 707702 - RNA, 64 nt, Homo Sapiens; identical to SEQ ID NO: 34442

SEQ ID NO: 707703 - RNA, 64 nt, Homo Sapiens; identical to SEQ ID NO: 34443

SEQ ID NO: 707704 - RNA, 64 nt, Homo Sapiens; identical to SEQ ID NO: 34444

SEQ ID NO: 707705 - RNA, 64 nt, Homo Sapiens; identical to SEQ ID NO: 34445

SEQ ID NO: 707706 - RNA, 64 nt, Homo Sapiens; identical to SEQ ID NO: 34446

SEQ ID NO: 707707 - RNA, 64 nt, Homo Sapiens; identical to SEQ ID NO: 34447

SEQ ID NO: 707708 - RNA, 64 nt, Homo Sapiens; identical to SEQ ID NO: 34448

SEQ ID NO: 707709 - RNA, 64 nt, Homo Sapiens; identical to SEQ ID NO: 34449

SEQ ID NO: 707710 - RNA, 64 nt, Homo Sapiens; identical to SEQ ID NO: 34450

SEQ ID NO: 707711 - RNA, 64 nt, Homo Sapiens; identical to SEQ ID NO: 34451

SEQ ID NO: 707712 - RNA, 64 nt, Homo Sapiens; identical to SEQ ID NO: 34452

SEQ ID NO: 707713 - RNA, 64 nt, Homo Sapiens; identical to SEQ ID NO: 34453

SEQ ID NO: 707714 - RNA, 64 nt, Homo Sapiens; identical to SEQ ID NO: 34454

SEQ ID NO: 707715 - RNA, 64 nt, Homo Sapiens; identical to SEQ ID NO: 34455

SEQ ID NO: 707716 - RNA, 64 nt, Homo Sapiens; identical to SEQ ID NO: 34456

SEQ ID NO: 707717 - RNA, 64 nt, Homo Sapiens; identical to SEQ ID NO: 34457

SEQ ID NO: 707718 - RNA, 64 nt, Homo Sapiens; identical to SEQ ID NO: 34458

SEQ ID NO: 707719 - RNA, 64 nt, Homo Sapiens; identical to SEQ ID NO: 34459

SEQ ID NO: 707720 - RNA, 64 nt, Homo Sapiens; identical to SEQ ID NO: 34460

SEQ ID NO: 707721 - RNA, 56 nt, Homo Sapiens; identical to SEQ ID NO: 34461

SEQ ID NO: 707722 - RNA, 64 nt, Homo Sapiens; identical to SEQ ID NO: 34462

SEQ ID NO: 707723 - RNA, 64 nt, Homo Sapiens; identical to SEQ ID NO: 34463

SEQ ID NO: 707724 - RNA, 64 nt, Homo Sapiens; identical to SEQ ID NO: 34464

SEQ ID NO: 707725 - RNA, 64 nt, Homo Sapiens; identical to SEQ ID NO: 34465

SEQ ID NO: 707726 - RNA, 64 nt, Homo Sapiens; identical to SEQ ID NO: 34466

SEQ ID NO: 707727 - RNA, 64 nt, Homo Sapiens; identical to SEQ ID NO: 34467

SEQ ID NO: 707728 - RNA, 64 nt, Homo Sapiens; identical to SEQ ID NO: 34468

SEQ ID NO: 707729 - RNA, 64 nt, Homo Sapiens; identical to SEQ ID NO: 34469

SEQ ID NO: 707730 - RNA, 64 nt, Homo Sapiens; identical to SEQ ID NO: 34470

SEQ ID NO: 707731 - RNA, 64 nt, Homo Sapiens; identical to SEQ ID NO: 34471

SEQ ID NO: 707732 - RNA, 64 nt, Homo Sapiens; identical to SEQ ID NO: 34472

SEQ ID NO: 707733 - RNA, 64 nt, Homo Sapiens; identical to SEQ ID NO: 34473

SEQ ID NO: 707734 - RNA, 64 nt, Homo Sapiens; identical to SEQ ID NO: 34474

SEQ ID NO: 707735 - RNA, 64 nt, Homo Sapiens; identical to SEQ ID NO: 34475

SEQ ID NO: 707736 - RNA, 64 nt, Homo Sapiens; identical to SEQ ID NO: 34476

SEQ ID NO: 707737 - RNA, 64 nt, Homo Sapiens; identical to SEQ ID NO: 34477

SEQ ID NO: 707738 - RNA, 64 nt, Homo Sapiens; identical to SEQ ID NO: 34478

SEQ ID NO: 707739 - RNA, 64 nt, Homo Sapiens; identical to SEQ ID NO: 34479

SEQ ID NO: 707740 - RNA, 64 nt, Homo Sapiens; identical to SEQ ID NO: 34480

SEQ ID NO: 707741 - RNA, 64 nt, Homo Sapiens; identical to SEQ ID NO: 34481

SEQ ID NO: 707742 - RNA, 64 nt, Homo Sapiens; identical to SEQ ID NO: 34482

SEQ ID NO: 707743 - RNA, 64 nt, Homo Sapiens; identical to SEQ ID NO: 34483

SEQ ID NO: 707744 - RNA, 64 nt, Homo Sapiens; identical to SEQ ID NO: 34484

SEQ ID NO: 707745 - RNA, 64 nt, Homo Sapiens; identical to SEQ ID NO: 34485

SEQ ID NO: 707746 - RNA, 64 nt, Homo Sapiens; identical to SEQ ID NO: 34486

SEQ ID NO: 707747 - RNA, 64 nt, Homo Sapiens; identical to SEQ ID NO: 34487

SEQ ID NO: 707748 - RNA, 64 nt, Homo Sapiens; identical to SEQ ID NO: 34488

SEQ ID NO: 707749 - RNA, 64 nt, Homo Sapiens; identical to SEQ ID NO: 34489

SEQ ID NO: 707750 - RNA, 64 nt, Homo Sapiens; identical to SEQ ID NO: 34490

SEQ ID NO: 707751 - RNA, 64 nt, Homo Sapiens; identical to SEQ ID NO: 34491

SEQ ID NO: 707752 - RNA, 64 nt, Homo Sapiens; identical to SEQ ID NO: 34492

SEQ ID NO: 707753 - RNA, 64 nt, Homo Sapiens; identical to SEQ ID NO: 34493

SEQ ID NO: 707754 - RNA, 64 nt, Homo Sapiens; identical to SEQ ID NO: 34494

SEQ ID NO: 707755 - RNA, 64 nt, Homo Sapiens; identical to SEQ ID NO: 34495

SEQ ID NO: 707756 - RNA, 64 nt, Homo Sapiens; identical to SEQ ID NO: 34496

SEQ ID NO: 707757 - RNA, 64 nt, Homo Sapiens; identical to SEQ ID NO: 34497

SEQ ID NO: 707758 - RNA, 64 nt, Homo Sapiens; identical to SEQ ID NO: 34498

SEQ ID NO: 707759 - RNA, 64 nt, Homo Sapiens; identical to SEQ ID NO: 34499

SEQ ID NO: 707760 - RNA, 64 nt, Homo Sapiens; identical to SEQ ID NO: 34500

SEQ ID NO: 707761 - RNA, 64 nt, Homo Sapiens; identical to SEQ ID NO: 34501

SEQ ID NO: 707762 - RNA, 64 nt, Homo Sapiens; identical to SEQ ID NO: 34502

SEQ ID NO: 707763 - RNA, 64 nt, Homo Sapiens; identical to SEQ ID NO: 34503

SEQ ID NO: 707764 - RNA, 64 nt, Homo Sapiens; identical to SEQ ID NO: 34504

SEQ ID NO: 707765 - RNA, 64 nt, Homo Sapiens; identical to SEQ ID NO: 34505

SEQ ID NO: 707766 - RNA, 64 nt, Homo Sapiens; identical to SEQ ID NO: 34506

SEQ ID NO: 707767 - RNA, 64 nt, Homo Sapiens; identical to SEQ ID NO: 34507

SEQ ID NO: 707768 - RNA, 64 nt, Homo Sapiens; identical to SEQ ID NO: 34508

SEQ ID NO: 707769 - RNA, 64 nt, Homo Sapiens; identical to SEQ ID NO: 34509

SEQ ID NO: 707770 - RNA, 64 nt, Homo Sapiens; identical to SEQ ID NO: 34510

SEQ ID NO: 707771 - RNA, 64 nt, Homo Sapiens; identical to SEQ ID NO: 34511

SEQ ID NO: 707772 - RNA, 64 nt, Homo Sapiens; identical to SEQ ID NO: 34512

SEQ ID NO: 707773 - RNA, 64 nt, Homo Sapiens; identical to SEQ ID NO: 34513

SEQ ID NO: 707774 - RNA, 64 nt, Homo Sapiens; identical to SEQ ID NO: 34514

SEQ ID NO: 707775 - RNA, 64 nt, Homo Sapiens; identical to SEQ ID NO: 34515

SEQ ID NO: 707776 - RNA, 64 nt, Homo Sapiens; identical to SEQ ID NO: 34516

SEQ ID NO: 707777 - RNA, 64 nt, Homo Sapiens; identical to SEQ ID NO: 34517

SEQ ID NO: 707778 - RNA, 64 nt, Homo Sapiens; identical to SEQ ID NO: 34518

SEQ ID NO: 707779 - RNA, 64 nt, Homo Sapiens; identical to SEQ ID NO: 34519

SEQ ID NO: 707780 - RNA, 64 nt, Homo Sapiens; identical to SEQ ID NO: 34520

SEQ ID NO: 707781 - RNA, 64 nt, Homo Sapiens; identical to SEQ ID NO: 34521

SEQ ID NO: 707782 - RNA, 64 nt, Homo Sapiens; identical to SEQ ID NO: 34522

SEQ ID NO: 707783 - RNA, 64 nt, Homo Sapiens; identical to SEQ ID NO: 34523

SEQ ID NO: 707784 - RNA, 64 nt, Homo Sapiens; identical to SEQ ID NO: 34524

SEQ ID NO: 707785 - RNA, 64 nt, Homo Sapiens; identical to SEQ ID NO: 34525

SEQ ID NO: 707786 - RNA, 64 nt, Homo Sapiens; identical to SEQ ID NO: 34526

SEQ ID NO: 707787 - RNA, 64 nt, Homo Sapiens; identical to SEQ ID NO: 34527

SEQ ID NO: 707788 - RNA, 64 nt, Homo Sapiens; identical to SEQ ID NO: 34528

SEQ ID NO: 707789 - RNA, 64 nt, Homo Sapiens; identical to SEQ ID NO: 34529

SEQ ID NO: 707790 - RNA, 64 nt, Homo Sapiens; identical to SEQ ID NO: 34530

SEQ ID NO: 707791 - RNA, 64 nt, Homo Sapiens; identical to SEQ ID NO: 34531

SEQ ID NO: 707792 - RNA, 64 nt, Homo Sapiens; identical to SEQ ID NO: 34532

SEQ ID NO: 707793 - RNA, 64 nt, Homo Sapiens; identical to SEQ ID NO: 34533

SEQ ID NO: 707794 - RNA, 64 nt, Homo Sapiens; identical to SEQ ID NO: 34534

SEQ ID NO: 707795 - RNA, 64 nt, Homo Sapiens; identical to SEQ ID NO: 34535

SEQ ID NO: 707796 - RNA, 64 nt, Homo Sapiens; identical to SEQ ID NO: 34536

SEQ ID NO: 707797 - RNA, 64 nt, Homo Sapiens; identical to SEQ ID NO: 34537

SEQ ID NO: 707798 - RNA, 64 nt, Homo Sapiens; identical to SEQ ID NO: 34538

SEQ ID NO: 707799 - RNA, 64 nt, Homo Sapiens; identical to SEQ ID NO: 34539

SEQ ID NO: 707800 - RNA, 64 nt, Homo Sapiens; identical to SEQ ID NO: 34540

SEQ ID NO: 707801 - RNA, 64 nt, Homo Sapiens; identical to SEQ ID NO: 34541

SEQ ID NO: 707802 - RNA, 64 nt, Homo Sapiens; identical to SEQ ID NO: 34542

SEQ ID NO: 707803 - RNA, 64 nt, Homo Sapiens; identical to SEQ ID NO: 34543

SEQ ID NO: 707804 - RNA, 64 nt, Homo Sapiens; identical to SEQ ID NO: 34544

SEQ ID NO: 707805 - RNA, 64 nt, Homo Sapiens; identical to SEQ ID NO: 34545

SEQ ID NO: 707806 - RNA, 64 nt, Homo Sapiens; identical to SEQ ID NO: 34546

SEQ ID NO: 707807 - RNA, 64 nt, Homo Sapiens; identical to SEQ ID NO: 34547

SEQ ID NO: 707808 - RNA, 64 nt, Homo Sapiens; identical to SEQ ID NO: 34548

SEQ ID NO: 707809 - RNA, 64 nt, Homo Sapiens; identical to SEQ ID NO: 34549

SEQ ID NO: 707810 - RNA, 64 nt, Homo Sapiens; identical to SEQ ID NO: 34550

SEQ ID NO: 707811 - RNA, 64 nt, Homo Sapiens; identical to SEQ ID NO: 34551

SEQ ID NO: 707812 - RNA, 64 nt, Homo Sapiens; identical to SEQ ID NO: 34552

SEQ ID NO: 707813 - RNA, 64 nt, Homo Sapiens; identical to SEQ ID NO: 34553

SEQ ID NO: 707814 - RNA, 64 nt, Homo Sapiens; identical to SEQ ID NO: 34554

SEQ ID NO: 707815 - RNA, 64 nt, Homo Sapiens; identical to SEQ ID NO: 34555

SEQ ID NO: 707816 - RNA, 64 nt, Homo Sapiens; identical to SEQ ID NO: 34556

SEQ ID NO: 707817 - RNA, 64 nt, Homo Sapiens; identical to SEQ ID NO: 34557

SEQ ID NO: 707818 - RNA, 64 nt, Homo Sapiens; identical to SEQ ID NO: 34558

SEQ ID NO: 707819 - RNA, 64 nt, Homo Sapiens; identical to SEQ ID NO: 34559

SEQ ID NO: 707820 - RNA, 64 nt, Homo Sapiens; identical to SEQ ID NO: 34560

SEQ ID NO: 707821 - RNA, 64 nt, Homo Sapiens; identical to SEQ ID NO: 34561

SEQ ID NO: 707822 - RNA, 64 nt, Homo Sapiens; identical to SEQ ID NO: 34562

SEQ ID NO: 707823 - RNA, 64 nt, Homo Sapiens; identical to SEQ ID NO: 34563

SEQ ID NO: 707824 - RNA, 64 nt, Homo Sapiens; identical to SEQ ID NO: 34564

SEQ ID NO: 707825 - RNA, 64 nt, Homo Sapiens; identical to SEQ ID NO: 34565

SEQ ID NO: 707826 - RNA, 64 nt, Homo Sapiens; identical to SEQ ID NO: 34566

SEQ ID NO: 707827 - RNA, 64 nt, Homo Sapiens; identical to SEQ ID NO: 34567

SEQ ID NO: 707828 - RNA, 64 nt, Homo Sapiens; identical to SEQ ID NO: 34568

SEQ ID NO: 707829 - RNA, 64 nt, Homo Sapiens; identical to SEQ ID NO: 34569

SEQ ID NO: 707830 - RNA, 64 nt, Homo Sapiens; identical to SEQ ID NO: 34570

SEQ ID NO: 707831 - RNA, 64 nt, Homo Sapiens; identical to SEQ ID NO: 34571

SEQ ID NO: 707832 - RNA, 64 nt, Homo Sapiens; identical to SEQ ID NO: 34572

SEQ ID NO: 707833 - RNA, 64 nt, Homo Sapiens; identical to SEQ ID NO: 34573

SEQ ID NO: 707834 - RNA, 64 nt, Homo Sapiens; identical to SEQ ID NO: 34574

SEQ ID NO: 707835 - RNA, 64 nt, Homo Sapiens; identical to SEQ ID NO: 34575

SEQ ID NO: 707836 - RNA, 64 nt, Homo Sapiens; identical to SEQ ID NO: 34576

SEQ ID NO: 707837 - RNA, 64 nt, Homo Sapiens; identical to SEQ ID NO: 34577

SEQ ID NO: 707838 - RNA, 64 nt, Homo Sapiens; identical to SEQ ID NO: 34578

SEQ ID NO: 707839 - RNA, 64 nt, Homo Sapiens; identical to SEQ ID NO: 34579

SEQ ID NO: 707840 - RNA, 64 nt, Homo Sapiens; identical to SEQ ID NO: 34580

SEQ ID NO: 707841 - RNA, 64 nt, Homo Sapiens; identical to SEQ ID NO: 34581

SEQ ID NO: 707842 - RNA, 64 nt, Homo Sapiens; identical to SEQ ID NO: 34582

SEQ ID NO: 707843 - RNA, 64 nt, Homo Sapiens; identical to SEQ ID NO: 34583

SEQ ID NO: 707844 - RNA, 64 nt, Homo Sapiens; identical to SEQ ID NO: 34584

SEQ ID NO: 707845 - RNA, 64 nt, Homo Sapiens; identical to SEQ ID NO: 34585

SEQ ID NO: 707846 - RNA, 64 nt, Homo Sapiens; identical to SEQ ID NO: 34586

SEQ ID NO: 707847 - RNA, 64 nt, Homo Sapiens; identical to SEQ ID NO: 34587

SEQ ID NO: 707848 - RNA, 64 nt, Homo Sapiens; identical to SEQ ID NO: 34588

SEQ ID NO: 707849 - RNA, 64 nt, Homo Sapiens; identical to SEQ ID NO: 34589

SEQ ID NO: 707850 - RNA, 64 nt, Homo Sapiens; identical to SEQ ID NO: 34590

SEQ ID NO: 707851 - RNA, 64 nt, Homo Sapiens; identical to SEQ ID NO: 34591

SEQ ID NO: 707852 - RNA, 64 nt, Homo Sapiens; identical to SEQ ID NO: 34592

SEQ ID NO: 707853 - RNA, 64 nt, Homo Sapiens; identical to SEQ ID NO: 34593

SEQ ID NO: 707854 - RNA, 64 nt, Homo Sapiens; identical to SEQ ID NO: 34594

SEQ ID NO: 707855 - RNA, 64 nt, Homo Sapiens; identical to SEQ ID NO: 34595

SEQ ID NO: 707856 - RNA, 64 nt, Homo Sapiens; identical to SEQ ID NO: 34596

SEQ ID NO: 707857 - RNA, 64 nt, Homo Sapiens; identical to SEQ ID NO: 34597

SEQ ID NO: 707858 - RNA, 64 nt, Homo Sapiens; identical to SEQ ID NO: 34598

SEQ ID NO: 707859 - RNA, 64 nt, Homo Sapiens; identical to SEQ ID NO: 34599

SEQ ID NO: 707860 - RNA, 64 nt, Homo Sapiens; identical to SEQ ID NO: 34600

SEQ ID NO: 707861 - RNA, 64 nt, Homo Sapiens; identical to SEQ ID NO: 34601

SEQ ID NO: 707862 - RNA, 64 nt, Homo Sapiens; identical to SEQ ID NO: 34602

SEQ ID NO: 707863 - RNA, 64 nt, Homo Sapiens; identical to SEQ ID NO: 34603

SEQ ID NO: 707864 - RNA, 64 nt, Homo Sapiens; identical to SEQ ID NO: 34604

SEQ ID NO: 707865 - RNA, 64 nt, Homo Sapiens; identical to SEQ ID NO: 34605

SEQ ID NO: 707866 - RNA, 64 nt, Homo Sapiens; identical to SEQ ID NO: 34606

SEQ ID NO: 707867 - RNA, 64 nt, Homo Sapiens; identical to SEQ ID NO: 34607

SEQ ID NO: 707868 - RNA, 64 nt, Homo Sapiens; identical to SEQ ID NO: 34608

SEQ ID NO: 707869 - RNA, 64 nt, Homo Sapiens; identical to SEQ ID NO: 34609

SEQ ID NO: 707870 - RNA, 64 nt, Homo Sapiens; identical to SEQ ID NO: 34610

SEQ ID NO: 707871 - RNA, 64 nt, Homo Sapiens; identical to SEQ ID NO: 34611

SEQ ID NO: 707872 - RNA, 64 nt, Homo Sapiens; identical to SEQ ID NO: 34612

SEQ ID NO: 707873 - RNA, 64 nt, Homo Sapiens; identical to SEQ ID NO: 34613

SEQ ID NO: 707874 - RNA, 64 nt, Homo Sapiens; identical to SEQ ID NO: 34614

SEQ ID NO: 707875 - RNA, 64 nt, Homo Sapiens; identical to SEQ ID NO: 34615

SEQ ID NO: 707876 - RNA, 64 nt, Homo Sapiens; identical to SEQ ID NO: 34616

SEQ ID NO: 707877 - RNA, 64 nt, Homo Sapiens; identical to SEQ ID NO: 34617

SEQ ID NO: 707878 - RNA, 64 nt, Homo Sapiens; identical to SEQ ID NO: 34618

SEQ ID NO: 707879 - RNA, 64 nt, Homo Sapiens; identical to SEQ ID NO: 34619

SEQ ID NO: 707880 - RNA, 64 nt, Homo Sapiens; identical to SEQ ID NO: 34620

SEQ ID NO: 707881 - RNA, 64 nt, Homo Sapiens; identical to SEQ ID NO: 34621

SEQ ID NO: 707882 - RNA, 64 nt, Homo Sapiens; identical to SEQ ID NO: 34622

SEQ ID NO: 707883 - RNA, 64 nt, Homo Sapiens; identical to SEQ ID NO: 34623

SEQ ID NO: 707884 - RNA, 64 nt, Homo Sapiens; identical to SEQ ID NO: 34624

SEQ ID NO: 707885 - RNA, 64 nt, Homo Sapiens; identical to SEQ ID NO: 34625

SEQ ID NO: 707886 - RNA, 64 nt, Homo Sapiens; identical to SEQ ID NO: 34626

SEQ ID NO: 707887 - RNA, 64 nt, Homo Sapiens; identical to SEQ ID NO: 34627

SEQ ID NO: 707888 - RNA, 64 nt, Homo Sapiens; identical to SEQ ID NO: 34628

SEQ ID NO: 707889 - RNA, 64 nt, Homo Sapiens; identical to SEQ ID NO: 34629

SEQ ID NO: 707890 - RNA, 64 nt, Homo Sapiens; identical to SEQ ID NO: 34630

SEQ ID NO: 707891 - RNA, 64 nt, Homo Sapiens; identical to SEQ ID NO: 34631

SEQ ID NO: 707892 - RNA, 64 nt, Homo Sapiens; identical to SEQ ID NO: 34632

SEQ ID NO: 707893 - RNA, 64 nt, Homo Sapiens; identical to SEQ ID NO: 34633

SEQ ID NO: 707894 - RNA, 64 nt, Homo Sapiens; identical to SEQ ID NO: 34634

SEQ ID NO: 707895 - RNA, 64 nt, Homo Sapiens; identical to SEQ ID NO: 34635

SEQ ID NO: 707896 - RNA, 64 nt, Homo Sapiens; identical to SEQ ID NO: 34636

SEQ ID NO: 707897 - RNA, 64 nt, Homo Sapiens; identical to SEQ ID NO: 34637

SEQ ID NO: 707898 - RNA, 64 nt, Homo Sapiens; identical to SEQ ID NO: 34638

SEQ ID NO: 707899 - RNA, 64 nt, Homo Sapiens; identical to SEQ ID NO: 34639

SEQ ID NO: 707900 - RNA, 64 nt, Homo Sapiens; identical to SEQ ID NO: 34640

SEQ ID NO: 707901 - RNA, 64 nt, Homo Sapiens; identical to SEQ ID NO: 34641

SEQ ID NO: 707902 - RNA, 64 nt, Homo Sapiens; identical to SEQ ID NO: 34642

SEQ ID NO: 707903 - RNA, 64 nt, Homo Sapiens; identical to SEQ ID NO: 34643

SEQ ID NO: 707904 - RNA, 64 nt, Homo Sapiens; identical to SEQ ID NO: 34644

SEQ ID NO: 707905 - RNA, 64 nt, Homo Sapiens; identical to SEQ ID NO: 34645

SEQ ID NO: 707906 - RNA, 64 nt, Homo Sapiens; identical to SEQ ID NO: 34646

SEQ ID NO: 707907 - RNA, 64 nt, Homo Sapiens; identical to SEQ ID NO: 34647

SEQ ID NO: 707908 - RNA, 64 nt, Homo Sapiens; identical to SEQ ID NO: 34648

SEQ ID NO: 707909 - RNA, 64 nt, Homo Sapiens; identical to SEQ ID NO: 34649

SEQ ID NO: 707910 - RNA, 64 nt, Homo Sapiens; identical to SEQ ID NO: 34650

SEQ ID NO: 707911 - RNA, 64 nt, Homo Sapiens; identical to SEQ ID NO: 34651

SEQ ID NO: 707912 - RNA, 64 nt, Homo Sapiens; identical to SEQ ID NO: 34652

SEQ ID NO: 707913 - RNA, 64 nt, Homo Sapiens; identical to SEQ ID NO: 34653

SEQ ID NO: 707914 - RNA, 64 nt, Homo Sapiens; identical to SEQ ID NO: 34654

SEQ ID NO: 707915 - RNA, 64 nt, Homo Sapiens; identical to SEQ ID NO: 34655

SEQ ID NO: 707916 - RNA, 64 nt, Homo Sapiens; identical to SEQ ID NO: 34656

SEQ ID NO: 707917 - RNA, 64 nt, Homo Sapiens; identical to SEQ ID NO: 34657

SEQ ID NO: 707918 - RNA, 64 nt, Homo Sapiens; identical to SEQ ID NO: 34658

SEQ ID NO: 707919 - RNA, 64 nt, Homo Sapiens; identical to SEQ ID NO: 34659

SEQ ID NO: 707920 - RNA, 64 nt, Homo Sapiens; identical to SEQ ID NO: 34660

SEQ ID NO: 707921 - RNA, 64 nt, Homo Sapiens; identical to SEQ ID NO: 34661

SEQ ID NO: 707922 - RNA, 64 nt, Homo Sapiens; identical to SEQ ID NO: 34662

SEQ ID NO: 707923 - RNA, 64 nt, Homo Sapiens; identical to SEQ ID NO: 34663

SEQ ID NO: 707924 - RNA, 64 nt, Homo Sapiens; identical to SEQ ID NO: 34664

SEQ ID NO: 707925 - RNA, 64 nt, Homo Sapiens; identical to SEQ ID NO: 34665

SEQ ID NO: 707926 - RNA, 64 nt, Homo Sapiens; identical to SEQ ID NO: 34666

SEQ ID NO: 707927 - RNA, 64 nt, Homo Sapiens; identical to SEQ ID NO: 34667

SEQ ID NO: 707928 - RNA, 64 nt, Homo Sapiens; identical to SEQ ID NO: 34668

SEQ ID NO: 707929 - RNA, 64 nt, Homo Sapiens; identical to SEQ ID NO: 34669

SEQ ID NO: 707930 - RNA, 64 nt, Homo Sapiens; identical to SEQ ID NO: 34670

SEQ ID NO: 707931 - RNA, 64 nt, Homo Sapiens; identical to SEQ ID NO: 34671

SEQ ID NO: 707932 - RNA, 64 nt, Homo Sapiens; identical to SEQ ID NO: 34672

SEQ ID NO: 707933 - RNA, 64 nt, Homo Sapiens; identical to SEQ ID NO: 34673

SEQ ID NO: 707934 - RNA, 64 nt, Homo Sapiens; identical to SEQ ID NO: 34674

SEQ ID NO: 707935 - RNA, 64 nt, Homo Sapiens; identical to SEQ ID NO: 34675

SEQ ID NO: 707936 - RNA, 64 nt, Homo Sapiens; identical to SEQ ID NO: 34676

SEQ ID NO: 707937 - RNA, 64 nt, Homo Sapiens; identical to SEQ ID NO: 34677

SEQ ID NO: 707938 - RNA, 64 nt, Homo Sapiens; identical to SEQ ID NO: 34678

SEQ ID NO: 707939 - RNA, 64 nt, Homo Sapiens; identical to SEQ ID NO: 34679

SEQ ID NO: 707940 - RNA, 64 nt, Homo Sapiens; identical to SEQ ID NO: 34680

SEQ ID NO: 707941 - RNA, 64 nt, Homo Sapiens; identical to SEQ ID NO: 34681

SEQ ID NO: 707942 - RNA, 64 nt, Homo Sapiens; identical to SEQ ID NO: 34682

SEQ ID NO: 707943 - RNA, 64 nt, Homo Sapiens; identical to SEQ ID NO: 34683

SEQ ID NO: 707944 - RNA, 64 nt, Homo Sapiens; identical to SEQ ID NO: 34684

SEQ ID NO: 707945 - RNA, 64 nt, Homo Sapiens; identical to SEQ ID NO: 34685

SEQ ID NO: 707946 - RNA, 64 nt, Homo Sapiens; identical to SEQ ID NO: 34686

SEQ ID NO: 707947 - RNA, 64 nt, Homo Sapiens; identical to SEQ ID NO: 34687

SEQ ID NO: 707948 - RNA, 64 nt, Homo Sapiens; identical to SEQ ID NO: 34688

SEQ ID NO: 707949 - RNA, 64 nt, Homo Sapiens; identical to SEQ ID NO: 34689

SEQ ID NO: 707950 - RNA, 64 nt, Homo Sapiens; identical to SEQ ID NO: 34690

SEQ ID NO: 707951 - RNA, 64 nt, Homo Sapiens; identical to SEQ ID NO: 34691

SEQ ID NO: 707952 - RNA, 64 nt, Homo Sapiens; identical to SEQ ID NO: 34692

SEQ ID NO: 707953 - RNA, 64 nt, Homo Sapiens; identical to SEQ ID NO: 34693

SEQ ID NO: 707954 - RNA, 64 nt, Homo Sapiens; identical to SEQ ID NO: 34694

SEQ ID NO: 707955 - RNA, 64 nt, Homo Sapiens; identical to SEQ ID NO: 34695

SEQ ID NO: 707956 - RNA, 64 nt, Homo Sapiens; identical to SEQ ID NO: 34696

SEQ ID NO: 707957 - RNA, 64 nt, Homo Sapiens; identical to SEQ ID NO: 34697

SEQ ID NO: 707958 - RNA, 64 nt, Homo Sapiens; identical to SEQ ID NO: 34698

SEQ ID NO: 707959 - RNA, 64 nt, Homo Sapiens; identical to SEQ ID NO: 34699

SEQ ID NO: 707960 - RNA, 64 nt, Homo Sapiens; identical to SEQ ID NO: 34700

SEQ ID NO: 707961 - RNA, 64 nt, Homo Sapiens; identical to SEQ ID NO: 34701

SEQ ID NO: 707962 - RNA, 64 nt, Homo Sapiens; identical to SEQ ID NO: 34702

SEQ ID NO: 707963 - RNA, 64 nt, Homo Sapiens; identical to SEQ ID NO: 34703

SEQ ID NO: 707964 - RNA, 64 nt, Homo Sapiens; identical to SEQ ID NO: 34704

SEQ ID NO: 707965 - RNA, 64 nt, Homo Sapiens; identical to SEQ ID NO: 34705

SEQ ID NO: 707966 - RNA, 64 nt, Homo Sapiens; identical to SEQ ID NO: 34706

SEQ ID NO: 707967 - RNA, 64 nt, Homo Sapiens; identical to SEQ ID NO: 34707

SEQ ID NO: 707968 - RNA, 64 nt, Homo Sapiens; identical to SEQ ID NO: 34708

SEQ ID NO: 707969 - RNA, 64 nt, Homo Sapiens; identical to SEQ ID NO: 34709

SEQ ID NO: 707970 - RNA, 64 nt, Homo Sapiens; identical to SEQ ID NO: 34710

SEQ ID NO: 707971 - RNA, 64 nt, Homo Sapiens; identical to SEQ ID NO: 34711

SEQ ID NO: 707972 - RNA, 64 nt, Homo Sapiens; identical to SEQ ID NO: 34712

SEQ ID NO: 707973 - RNA, 64 nt, Homo Sapiens; identical to SEQ ID NO: 34713

SEQ ID NO: 707974 - RNA, 64 nt, Homo Sapiens; identical to SEQ ID NO: 34714

SEQ ID NO: 707975 - RNA, 64 nt, Homo Sapiens; identical to SEQ ID NO: 34715

SEQ ID NO: 707976 - RNA, 64 nt, Homo Sapiens; identical to SEQ ID NO: 34716

SEQ ID NO: 707977 - RNA, 64 nt, Homo Sapiens; identical to SEQ ID NO: 34717

SEQ ID NO: 707978 - RNA, 64 nt, Homo Sapiens; identical to SEQ ID NO: 34718

SEQ ID NO: 707979 - RNA, 64 nt, Homo Sapiens; identical to SEQ ID NO: 34719

SEQ ID NO: 707980 - RNA, 64 nt, Homo Sapiens; identical to SEQ ID NO: 34720

SEQ ID NO: 707981 - RNA, 64 nt, Homo Sapiens; identical to SEQ ID NO: 34721

SEQ ID NO: 707982 - RNA, 64 nt, Homo Sapiens; identical to SEQ ID NO: 34722

SEQ ID NO: 707983 - RNA, 64 nt, Homo Sapiens; identical to SEQ ID NO: 34723

SEQ ID NO: 707984 - RNA, 64 nt, Homo Sapiens; identical to SEQ ID NO: 34724

SEQ ID NO: 707985 - RNA, 64 nt, Homo Sapiens; identical to SEQ ID NO: 34725

SEQ ID NO: 707986 - RNA, 64 nt, Homo Sapiens; identical to SEQ ID NO: 34726

SEQ ID NO: 707987 - RNA, 64 nt, Homo Sapiens; identical to SEQ ID NO: 34727

SEQ ID NO: 707988 - RNA, 64 nt, Homo Sapiens; identical to SEQ ID NO: 34728

SEQ ID NO: 707989 - RNA, 64 nt, Homo Sapiens; identical to SEQ ID NO: 34729

SEQ ID NO: 707990 - RNA, 64 nt, Homo Sapiens; identical to SEQ ID NO: 34730

SEQ ID NO: 707991 - RNA, 64 nt, Homo Sapiens; identical to SEQ ID NO: 34731

SEQ ID NO: 707992 - RNA, 64 nt, Homo Sapiens; identical to SEQ ID NO: 34732

SEQ ID NO: 707993 - RNA, 64 nt, Homo Sapiens; identical to SEQ ID NO: 34733

SEQ ID NO: 707994 - RNA, 64 nt, Homo Sapiens; identical to SEQ ID NO: 34734

SEQ ID NO: 707995 - RNA, 64 nt, Homo Sapiens; identical to SEQ ID NO: 34735

SEQ ID NO: 707996 - RNA, 64 nt, Homo Sapiens; identical to SEQ ID NO: 34736

SEQ ID NO: 707997 - RNA, 64 nt, Homo Sapiens; identical to SEQ ID NO: 34737

SEQ ID NO: 707998 - RNA, 64 nt, Homo Sapiens; identical to SEQ ID NO: 34738

SEQ ID NO: 707999 - RNA, 64 nt, Homo Sapiens; identical to SEQ ID NO: 34739

SEQ ID NO: 708000 - RNA, 64 nt, Homo Sapiens; identical to SEQ ID NO: 34740

SEQ ID NO: 708001 - RNA, 64 nt, Homo Sapiens; identical to SEQ ID NO: 34741

SEQ ID NO: 708002 - RNA, 63 nt, Homo Sapiens; identical to SEQ ID NO: 34742

SEQ ID NO: 708003 - RNA, 62 nt, Homo Sapiens; identical to SEQ ID NO: 34743

SEQ ID NO: 708004 - RNA, 64 nt, Homo Sapiens; identical to SEQ ID NO: 34744

SEQ ID NO: 708005 - RNA, 64 nt, Homo Sapiens; identical to SEQ ID NO: 34745

SEQ ID NO: 708006 - RNA, 64 nt, Homo Sapiens; identical to SEQ ID NO: 34746

SEQ ID NO: 708007 - RNA, 64 nt, Homo Sapiens; identical to SEQ ID NO: 34747

SEQ ID NO: 708008 - RNA, 64 nt, Homo Sapiens; identical to SEQ ID NO: 34748

SEQ ID NO: 708009 - RNA, 64 nt, Homo Sapiens; identical to SEQ ID NO: 34749

SEQ ID NO: 708010 - RNA, 64 nt, Homo Sapiens; identical to SEQ ID NO: 34750

SEQ ID NO: 708011 - RNA, 64 nt, Homo Sapiens; identical to SEQ ID NO: 34751

SEQ ID NO: 708012 - RNA, 64 nt, Homo Sapiens; identical to SEQ ID NO: 34752

SEQ ID NO: 708013 - RNA, 64 nt, Homo Sapiens; identical to SEQ ID NO: 34753

SEQ ID NO: 708014 - RNA, 64 nt, Homo Sapiens; identical to SEQ ID NO: 34754

SEQ ID NO: 708015 - RNA, 64 nt, Homo Sapiens; identical to SEQ ID NO: 34755

SEQ ID NO: 708016 - RNA, 64 nt, Homo Sapiens; identical to SEQ ID NO: 34756

SEQ ID NO: 708017 - RNA, 64 nt, Homo Sapiens; identical to SEQ ID NO: 34757

SEQ ID NO: 708018 - RNA, 64 nt, Homo Sapiens; identical to SEQ ID NO: 34758

SEQ ID NO: 708019 - RNA, 64 nt, Homo Sapiens; identical to SEQ ID NO: 34759

SEQ ID NO: 708020 - RNA, 64 nt, Homo Sapiens; identical to SEQ ID NO: 34760

SEQ ID NO: 708021 - RNA, 64 nt, Homo Sapiens; identical to SEQ ID NO: 34761

SEQ ID NO: 708022 - RNA, 64 nt, Homo Sapiens; identical to SEQ ID NO: 34762

SEQ ID NO: 708023 - RNA, 64 nt, Homo Sapiens; identical to SEQ ID NO: 34763

SEQ ID NO: 708024 - RNA, 64 nt, Homo Sapiens; identical to SEQ ID NO: 34764

SEQ ID NO: 708025 - RNA, 64 nt, Homo Sapiens; identical to SEQ ID NO: 34765

SEQ ID NO: 708026 - RNA, 64 nt, Homo Sapiens; identical to SEQ ID NO: 34766

SEQ ID NO: 708027 - RNA, 64 nt, Homo Sapiens; identical to SEQ ID NO: 34767

SEQ ID NO: 708028 - RNA, 64 nt, Homo Sapiens; identical to SEQ ID NO: 34768

SEQ ID NO: 708029 - RNA, 64 nt, Homo Sapiens; identical to SEQ ID NO: 34769

SEQ ID NO: 708030 - RNA, 64 nt, Homo Sapiens; identical to SEQ ID NO: 34770

SEQ ID NO: 708031 - RNA, 64 nt, Homo Sapiens; identical to SEQ ID NO: 34771

SEQ ID NO: 708032 - RNA, 64 nt, Homo Sapiens; identical to SEQ ID NO: 34772

SEQ ID NO: 708033 - RNA, 64 nt, Homo Sapiens; identical to SEQ ID NO: 34773

SEQ ID NO: 708034 - RNA, 64 nt, Homo Sapiens; identical to SEQ ID NO: 34774

SEQ ID NO: 708035 - RNA, 64 nt, Homo Sapiens; identical to SEQ ID NO: 34775

SEQ ID NO: 708036 - RNA, 64 nt, Homo Sapiens; identical to SEQ ID NO: 34776

SEQ ID NO: 708037 - RNA, 64 nt, Homo Sapiens; identical to SEQ ID NO: 34777

SEQ ID NO: 708038 - RNA, 64 nt, Homo Sapiens; identical to SEQ ID NO: 34778

SEQ ID NO: 708039 - RNA, 64 nt, Homo Sapiens; identical to SEQ ID NO: 34779

SEQ ID NO: 708040 - RNA, 64 nt, Homo Sapiens; identical to SEQ ID NO: 34780

SEQ ID NO: 708041 - RNA, 64 nt, Homo Sapiens; identical to SEQ ID NO: 34781

SEQ ID NO: 708042 - RNA, 64 nt, Homo Sapiens; identical to SEQ ID NO: 34782

SEQ ID NO: 708043 - RNA, 64 nt, Homo Sapiens; identical to SEQ ID NO: 34783

SEQ ID NO: 708044 - RNA, 64 nt, Homo Sapiens; identical to SEQ ID NO: 34784

SEQ ID NO: 708045 - RNA, 64 nt, Homo Sapiens; identical to SEQ ID NO: 34785

SEQ ID NO: 708046 - RNA, 64 nt, Homo Sapiens; identical to SEQ ID NO: 34786

SEQ ID NO: 708047 - RNA, 64 nt, Homo Sapiens; identical to SEQ ID NO: 34787

SEQ ID NO: 708048 - RNA, 64 nt, Homo Sapiens; identical to SEQ ID NO: 34788

SEQ ID NO: 708049 - RNA, 64 nt, Homo Sapiens; identical to SEQ ID NO: 34789

SEQ ID NO: 708050 - RNA, 64 nt, Homo Sapiens; identical to SEQ ID NO: 34790

SEQ ID NO: 708051 - RNA, 64 nt, Homo Sapiens; identical to SEQ ID NO: 34791

SEQ ID NO: 708052 - RNA, 64 nt, Homo Sapiens; identical to SEQ ID NO: 34792

SEQ ID NO: 708053 - RNA, 64 nt, Homo Sapiens; identical to SEQ ID NO: 34793

SEQ ID NO: 708054 - RNA, 64 nt, Homo Sapiens; identical to SEQ ID NO: 34794

SEQ ID NO: 708055 - RNA, 64 nt, Homo Sapiens; identical to SEQ ID NO: 34795

SEQ ID NO: 708056 - RNA, 64 nt, Homo Sapiens; identical to SEQ ID NO: 34796

SEQ ID NO: 708057 - RNA, 64 nt, Homo Sapiens; identical to SEQ ID NO: 34797

SEQ ID NO: 708058 - RNA, 64 nt, Homo Sapiens; identical to SEQ ID NO: 34798

SEQ ID NO: 708059 - RNA, 64 nt, Homo Sapiens; identical to SEQ ID NO: 34799

SEQ ID NO: 708060 - RNA, 64 nt, Homo Sapiens; identical to SEQ ID NO: 34800

SEQ ID NO: 708061 - RNA, 64 nt, Homo Sapiens; identical to SEQ ID NO: 34801

SEQ ID NO: 708062 - RNA, 64 nt, Homo Sapiens; identical to SEQ ID NO: 34802

SEQ ID NO: 708063 - RNA, 64 nt, Homo Sapiens; identical to SEQ ID NO: 34803

SEQ ID NO: 708064 - RNA, 64 nt, Homo Sapiens; identical to SEQ ID NO: 34804

SEQ ID NO: 708065 - RNA, 64 nt, Homo Sapiens; identical to SEQ ID NO: 34805

SEQ ID NO: 708066 - RNA, 64 nt, Homo Sapiens; identical to SEQ ID NO: 34806

SEQ ID NO: 708067 - RNA, 64 nt, Homo Sapiens; identical to SEQ ID NO: 34807

SEQ ID NO: 708068 - RNA, 64 nt, Homo Sapiens; identical to SEQ ID NO: 34808

SEQ ID NO: 708069 - RNA, 64 nt, Homo Sapiens; identical to SEQ ID NO: 34809

SEQ ID NO: 708070 - RNA, 64 nt, Homo Sapiens; identical to SEQ ID NO: 34810

SEQ ID NO: 708071 - RNA, 64 nt, Homo Sapiens; identical to SEQ ID NO: 34811

SEQ ID NO: 708072 - RNA, 64 nt, Homo Sapiens; identical to SEQ ID NO: 34812

SEQ ID NO: 708073 - RNA, 64 nt, Homo Sapiens; identical to SEQ ID NO: 34813

SEQ ID NO: 708074 - RNA, 64 nt, Homo Sapiens; identical to SEQ ID NO: 34814

SEQ ID NO: 708075 - RNA, 64 nt, Homo Sapiens; identical to SEQ ID NO: 34815

SEQ ID NO: 708076 - RNA, 64 nt, Homo Sapiens; identical to SEQ ID NO: 34816

SEQ ID NO: 708077 - RNA, 64 nt, Homo Sapiens; identical to SEQ ID NO: 34817

SEQ ID NO: 708078 - RNA, 64 nt, Homo Sapiens; identical to SEQ ID NO: 34818

SEQ ID NO: 708079 - RNA, 64 nt, Homo Sapiens; identical to SEQ ID NO: 34819

SEQ ID NO: 708080 - RNA, 64 nt, Homo Sapiens; identical to SEQ ID NO: 34820

SEQ ID NO: 708081 - RNA, 64 nt, Homo Sapiens; identical to SEQ ID NO: 34821

SEQ ID NO: 708082 - RNA, 64 nt, Homo Sapiens; identical to SEQ ID NO: 34822

SEQ ID NO: 708083 - RNA, 64 nt, Homo Sapiens; identical to SEQ ID NO: 34823

SEQ ID NO: 708084 - RNA, 64 nt, Homo Sapiens; identical to SEQ ID NO: 34824

SEQ ID NO: 708085 - RNA, 64 nt, Homo Sapiens; identical to SEQ ID NO: 34825

SEQ ID NO: 708086 - RNA, 64 nt, Homo Sapiens; identical to SEQ ID NO: 34826

SEQ ID NO: 708087 - RNA, 64 nt, Homo Sapiens; identical to SEQ ID NO: 34827

SEQ ID NO: 708088 - RNA, 64 nt, Homo Sapiens; identical to SEQ ID NO: 34828

SEQ ID NO: 708089 - RNA, 64 nt, Homo Sapiens; identical to SEQ ID NO: 34829

SEQ ID NO: 708090 - RNA, 64 nt, Homo Sapiens; identical to SEQ ID NO: 34830

SEQ ID NO: 708091 - RNA, 64 nt, Homo Sapiens; identical to SEQ ID NO: 34831

SEQ ID NO: 708092 - RNA, 64 nt, Homo Sapiens; identical to SEQ ID NO: 34832

SEQ ID NO: 708093 - RNA, 64 nt, Homo Sapiens; identical to SEQ ID NO: 34833

SEQ ID NO: 708094 - RNA, 64 nt, Homo Sapiens; identical to SEQ ID NO: 34834

SEQ ID NO: 708095 - RNA, 64 nt, Homo Sapiens; identical to SEQ ID NO: 34835

SEQ ID NO: 708096 - RNA, 64 nt, Homo Sapiens; identical to SEQ ID NO: 34836

SEQ ID NO: 708097 - RNA, 64 nt, Homo Sapiens; identical to SEQ ID NO: 34837

SEQ ID NO: 708098 - RNA, 64 nt, Homo Sapiens; identical to SEQ ID NO: 34838

SEQ ID NO: 708099 - RNA, 64 nt, Homo Sapiens; identical to SEQ ID NO: 34839

SEQ ID NO: 708100 - RNA, 64 nt, Homo Sapiens; identical to SEQ ID NO: 34840

SEQ ID NO: 708101 - RNA, 64 nt, Homo Sapiens; identical to SEQ ID NO: 34841

SEQ ID NO: 708102 - RNA, 64 nt, Homo Sapiens; identical to SEQ ID NO: 34842

SEQ ID NO: 708103 - RNA, 64 nt, Homo Sapiens; identical to SEQ ID NO: 34843

SEQ ID NO: 708104 - RNA, 64 nt, Homo Sapiens; identical to SEQ ID NO: 34844

SEQ ID NO: 708105 - RNA, 64 nt, Homo Sapiens; identical to SEQ ID NO: 34845

SEQ ID NO: 708106 - RNA, 64 nt, Homo Sapiens; identical to SEQ ID NO: 34846

SEQ ID NO: 708107 - RNA, 64 nt, Homo Sapiens; identical to SEQ ID NO: 34847

SEQ ID NO: 708108 - RNA, 64 nt, Homo Sapiens; identical to SEQ ID NO: 34848

SEQ ID NO: 708109 - RNA, 64 nt, Homo Sapiens; identical to SEQ ID NO: 34849

SEQ ID NO: 708110 - RNA, 64 nt, Homo Sapiens; identical to SEQ ID NO: 34850

SEQ ID NO: 708111 - RNA, 64 nt, Homo Sapiens; identical to SEQ ID NO: 34851

SEQ ID NO: 708112 - RNA, 64 nt, Homo Sapiens; identical to SEQ ID NO: 34852

SEQ ID NO: 708113 - RNA, 64 nt, Homo Sapiens; identical to SEQ ID NO: 34853

SEQ ID NO: 708114 - RNA, 64 nt, Homo Sapiens; identical to SEQ ID NO: 34854

SEQ ID NO: 708115 - RNA, 64 nt, Homo Sapiens; identical to SEQ ID NO: 34855

SEQ ID NO: 708116 - RNA, 64 nt, Homo Sapiens; identical to SEQ ID NO: 34856

SEQ ID NO: 708117 - RNA, 64 nt, Homo Sapiens; identical to SEQ ID NO: 34857

SEQ ID NO: 708118 - RNA, 63 nt, Homo Sapiens; identical to SEQ ID NO: 34858

SEQ ID NO: 708119 - RNA, 64 nt, Homo Sapiens; identical to SEQ ID NO: 34859

SEQ ID NO: 708120 - RNA, 64 nt, Homo Sapiens; identical to SEQ ID NO: 34860

SEQ ID NO: 708121 - RNA, 64 nt, Homo Sapiens; identical to SEQ ID NO: 34861

SEQ ID NO: 708122 - RNA, 64 nt, Homo Sapiens; identical to SEQ ID NO: 34862

SEQ ID NO: 708123 - RNA, 64 nt, Homo Sapiens; identical to SEQ ID NO: 34863

SEQ ID NO: 708124 - RNA, 64 nt, Homo Sapiens; identical to SEQ ID NO: 34864

SEQ ID NO: 708125 - RNA, 64 nt, Homo Sapiens; identical to SEQ ID NO: 34865

SEQ ID NO: 708126 - RNA, 64 nt, Homo Sapiens; identical to SEQ ID NO: 34866

SEQ ID NO: 708127 - RNA, 64 nt, Homo Sapiens; identical to SEQ ID NO: 34867

SEQ ID NO: 708128 - RNA, 64 nt, Homo Sapiens; identical to SEQ ID NO: 34868

SEQ ID NO: 708129 - RNA, 64 nt, Homo Sapiens; identical to SEQ ID NO: 34869

SEQ ID NO: 708130 - RNA, 64 nt, Homo Sapiens; identical to SEQ ID NO: 34870

SEQ ID NO: 708131 - RNA, 64 nt, Homo Sapiens; identical to SEQ ID NO: 34871

SEQ ID NO: 708132 - RNA, 64 nt, Homo Sapiens; identical to SEQ ID NO: 34872

SEQ ID NO: 708133 - RNA, 64 nt, Homo Sapiens; identical to SEQ ID NO: 34873

SEQ ID NO: 708134 - RNA, 64 nt, Homo Sapiens; identical to SEQ ID NO: 34874

SEQ ID NO: 708135 - RNA, 64 nt, Homo Sapiens; identical to SEQ ID NO: 34875

SEQ ID NO: 708136 - RNA, 64 nt, Homo Sapiens; identical to SEQ ID NO: 34876

SEQ ID NO: 708137 - RNA, 64 nt, Homo Sapiens; identical to SEQ ID NO: 34877

SEQ ID NO: 708138 - RNA, 64 nt, Homo Sapiens; identical to SEQ ID NO: 34878

SEQ ID NO: 708139 - RNA, 64 nt, Homo Sapiens; identical to SEQ ID NO: 34879

SEQ ID NO: 708140 - RNA, 64 nt, Homo Sapiens; identical to SEQ ID NO: 34880

SEQ ID NO: 708141 - RNA, 64 nt, Homo Sapiens; identical to SEQ ID NO: 34881

SEQ ID NO: 708142 - RNA, 64 nt, Homo Sapiens; identical to SEQ ID NO: 34882

SEQ ID NO: 708143 - RNA, 64 nt, Homo Sapiens; identical to SEQ ID NO: 34883

SEQ ID NO: 708144 - RNA, 64 nt, Homo Sapiens; identical to SEQ ID NO: 34884

SEQ ID NO: 708145 - RNA, 64 nt, Homo Sapiens; identical to SEQ ID NO: 34885

SEQ ID NO: 708146 - RNA, 64 nt, Homo Sapiens; identical to SEQ ID NO: 34886

SEQ ID NO: 708147 - RNA, 64 nt, Homo Sapiens; identical to SEQ ID NO: 34887

SEQ ID NO: 708148 - RNA, 64 nt, Homo Sapiens; identical to SEQ ID NO: 34888

SEQ ID NO: 708149 - RNA, 64 nt, Homo Sapiens; identical to SEQ ID NO: 34889

SEQ ID NO: 708150 - RNA, 64 nt, Homo Sapiens; identical to SEQ ID NO: 34890

SEQ ID NO: 708151 - RNA, 64 nt, Homo Sapiens; identical to SEQ ID NO: 34891

SEQ ID NO: 708152 - RNA, 64 nt, Homo Sapiens; identical to SEQ ID NO: 34892

SEQ ID NO: 708153 - RNA, 64 nt, Homo Sapiens; identical to SEQ ID NO: 34893

SEQ ID NO: 708154 - RNA, 64 nt, Homo Sapiens; identical to SEQ ID NO: 34894

SEQ ID NO: 708155 - RNA, 64 nt, Homo Sapiens; identical to SEQ ID NO: 34895

SEQ ID NO: 708156 - RNA, 64 nt, Homo Sapiens; identical to SEQ ID NO: 34896

SEQ ID NO: 708157 - RNA, 64 nt, Homo Sapiens; identical to SEQ ID NO: 34897

SEQ ID NO: 708158 - RNA, 64 nt, Homo Sapiens; identical to SEQ ID NO: 34898

SEQ ID NO: 708159 - RNA, 64 nt, Homo Sapiens; identical to SEQ ID NO: 34899

SEQ ID NO: 708160 - RNA, 64 nt, Homo Sapiens; identical to SEQ ID NO: 34900

SEQ ID NO: 708161 - RNA, 64 nt, Homo Sapiens; identical to SEQ ID NO: 34901

SEQ ID NO: 708162 - RNA, 64 nt, Homo Sapiens; identical to SEQ ID NO: 34902

SEQ ID NO: 708163 - RNA, 64 nt, Homo Sapiens; identical to SEQ ID NO: 34903

SEQ ID NO: 708164 - RNA, 64 nt, Homo Sapiens; identical to SEQ ID NO: 34904

SEQ ID NO: 708165 - RNA, 64 nt, Homo Sapiens; identical to SEQ ID NO: 34905

SEQ ID NO: 708166 - RNA, 64 nt, Homo Sapiens; identical to SEQ ID NO: 34906

SEQ ID NO: 708167 - RNA, 64 nt, Homo Sapiens; identical to SEQ ID NO: 34907

SEQ ID NO: 708168 - RNA, 64 nt, Homo Sapiens; identical to SEQ ID NO: 34908

SEQ ID NO: 708169 - RNA, 64 nt, Homo Sapiens; identical to SEQ ID NO: 34909

SEQ ID NO: 708170 - RNA, 64 nt, Homo Sapiens; identical to SEQ ID NO: 34910

SEQ ID NO: 708171 - RNA, 64 nt, Homo Sapiens; identical to SEQ ID NO: 34911

SEQ ID NO: 708172 - RNA, 64 nt, Homo Sapiens; identical to SEQ ID NO: 34912

SEQ ID NO: 708173 - RNA, 64 nt, Homo Sapiens; identical to SEQ ID NO: 34913

SEQ ID NO: 708174 - RNA, 64 nt, Homo Sapiens; identical to SEQ ID NO: 34914

SEQ ID NO: 708175 - RNA, 64 nt, Homo Sapiens; identical to SEQ ID NO: 34915

SEQ ID NO: 708176 - RNA, 64 nt, Homo Sapiens; identical to SEQ ID NO: 34916

SEQ ID NO: 708177 - RNA, 64 nt, Homo Sapiens; identical to SEQ ID NO: 34917

SEQ ID NO: 708178 - RNA, 64 nt, Homo Sapiens; identical to SEQ ID NO: 34918

SEQ ID NO: 708179 - RNA, 64 nt, Homo Sapiens; identical to SEQ ID NO: 34919

SEQ ID NO: 708180 - RNA, 64 nt, Homo Sapiens; identical to SEQ ID NO: 34920

SEQ ID NO: 708181 - RNA, 64 nt, Homo Sapiens; identical to SEQ ID NO: 34921

SEQ ID NO: 708182 - RNA, 64 nt, Homo Sapiens; identical to SEQ ID NO: 34922

SEQ ID NO: 708183 - RNA, 64 nt, Homo Sapiens; identical to SEQ ID NO: 34923

SEQ ID NO: 708184 - RNA, 64 nt, Homo Sapiens; identical to SEQ ID NO: 34924

SEQ ID NO: 708185 - RNA, 64 nt, Homo Sapiens; identical to SEQ ID NO: 34925

SEQ ID NO: 708186 - RNA, 64 nt, Homo Sapiens; identical to SEQ ID NO: 34926

SEQ ID NO: 708187 - RNA, 64 nt, Homo Sapiens; identical to SEQ ID NO: 34927

SEQ ID NO: 708188 - RNA, 64 nt, Homo Sapiens; identical to SEQ ID NO: 34928

SEQ ID NO: 708189 - RNA, 63 nt, Homo Sapiens; identical to SEQ ID NO: 34929

SEQ ID NO: 708190 - RNA, 64 nt, Homo Sapiens; identical to SEQ ID NO: 34930

SEQ ID NO: 708191 - RNA, 64 nt, Homo Sapiens; identical to SEQ ID NO: 34931

SEQ ID NO: 708192 - RNA, 64 nt, Homo Sapiens; identical to SEQ ID NO: 34932

SEQ ID NO: 708193 - RNA, 64 nt, Homo Sapiens; identical to SEQ ID NO: 34933

SEQ ID NO: 708194 - RNA, 64 nt, Homo Sapiens; identical to SEQ ID NO: 34934

SEQ ID NO: 708195 - RNA, 64 nt, Homo Sapiens; identical to SEQ ID NO: 34935

SEQ ID NO: 708196 - RNA, 64 nt, Homo Sapiens; identical to SEQ ID NO: 34936

SEQ ID NO: 708197 - RNA, 64 nt, Homo Sapiens; identical to SEQ ID NO: 34937

SEQ ID NO: 708198 - RNA, 64 nt, Homo Sapiens; identical to SEQ ID NO: 34938

SEQ ID NO: 708199 - RNA, 64 nt, Homo Sapiens; identical to SEQ ID NO: 34939

SEQ ID NO: 708200 - RNA, 64 nt, Homo Sapiens; identical to SEQ ID NO: 34940

SEQ ID NO: 708201 - RNA, 64 nt, Homo Sapiens; identical to SEQ ID NO: 34941

SEQ ID NO: 708202 - RNA, 64 nt, Homo Sapiens; identical to SEQ ID NO: 34942

SEQ ID NO: 708203 - RNA, 64 nt, Homo Sapiens; identical to SEQ ID NO: 34943

SEQ ID NO: 708204 - RNA, 64 nt, Homo Sapiens; identical to SEQ ID NO: 34944

SEQ ID NO: 708205 - RNA, 64 nt, Homo Sapiens; identical to SEQ ID NO: 34945

SEQ ID NO: 708206 - RNA, 64 nt, Homo Sapiens; identical to SEQ ID NO: 34946

SEQ ID NO: 708207 - RNA, 64 nt, Homo Sapiens; identical to SEQ ID NO: 34947

SEQ ID NO: 708208 - RNA, 64 nt, Homo Sapiens; identical to SEQ ID NO: 34948

SEQ ID NO: 708209 - RNA, 64 nt, Homo Sapiens; identical to SEQ ID NO: 34949

SEQ ID NO: 708210 - RNA, 64 nt, Homo Sapiens; identical to SEQ ID NO: 34950

SEQ ID NO: 708211 - RNA, 64 nt, Homo Sapiens; identical to SEQ ID NO: 34951

SEQ ID NO: 708212 - RNA, 64 nt, Homo Sapiens; identical to SEQ ID NO: 34952

SEQ ID NO: 708213 - RNA, 64 nt, Homo Sapiens; identical to SEQ ID NO: 34953

SEQ ID NO: 708214 - RNA, 64 nt, Homo Sapiens; identical to SEQ ID NO: 34954

SEQ ID NO: 708215 - RNA, 64 nt, Homo Sapiens; identical to SEQ ID NO: 34955

SEQ ID NO: 708216 - RNA, 64 nt, Homo Sapiens; identical to SEQ ID NO: 34956

SEQ ID NO: 708217 - RNA, 64 nt, Homo Sapiens; identical to SEQ ID NO: 34957

SEQ ID NO: 708218 - RNA, 64 nt, Homo Sapiens; identical to SEQ ID NO: 34958

SEQ ID NO: 708219 - RNA, 64 nt, Homo Sapiens; identical to SEQ ID NO: 34959

SEQ ID NO: 708220 - RNA, 64 nt, Homo Sapiens; identical to SEQ ID NO: 34960

SEQ ID NO: 708221 - RNA, 64 nt, Homo Sapiens; identical to SEQ ID NO: 34961

SEQ ID NO: 708222 - RNA, 64 nt, Homo Sapiens; identical to SEQ ID NO: 34962

SEQ ID NO: 708223 - RNA, 64 nt, Homo Sapiens; identical to SEQ ID NO: 34963

SEQ ID NO: 708224 - RNA, 64 nt, Homo Sapiens; identical to SEQ ID NO: 34964

SEQ ID NO: 708225 - RNA, 64 nt, Homo Sapiens; identical to SEQ ID NO: 34965

SEQ ID NO: 708226 - RNA, 64 nt, Homo Sapiens; identical to SEQ ID NO: 34966

SEQ ID NO: 708227 - RNA, 64 nt, Homo Sapiens; identical to SEQ ID NO: 34967

SEQ ID NO: 708228 - RNA, 64 nt, Homo Sapiens; identical to SEQ ID NO: 34968

SEQ ID NO: 708229 - RNA, 64 nt, Homo Sapiens; identical to SEQ ID NO: 34969

SEQ ID NO: 708230 - RNA, 64 nt, Homo Sapiens; identical to SEQ ID NO: 34970

SEQ ID NO: 708231 - RNA, 64 nt, Homo Sapiens; identical to SEQ ID NO: 34971

SEQ ID NO: 708232 - RNA, 64 nt, Homo Sapiens; identical to SEQ ID NO: 34972

SEQ ID NO: 708233 - RNA, 64 nt, Homo Sapiens; identical to SEQ ID NO: 34973

SEQ ID NO: 708234 - RNA, 64 nt, Homo Sapiens; identical to SEQ ID NO: 34974

SEQ ID NO: 708235 - RNA, 64 nt, Homo Sapiens; identical to SEQ ID NO: 34975

SEQ ID NO: 708236 - RNA, 64 nt, Homo Sapiens; identical to SEQ ID NO: 34976

SEQ ID NO: 708237 - RNA, 64 nt, Homo Sapiens; identical to SEQ ID NO: 34977

SEQ ID NO: 708238 - RNA, 64 nt, Homo Sapiens; identical to SEQ ID NO: 34978

SEQ ID NO: 708239 - RNA, 64 nt, Homo Sapiens; identical to SEQ ID NO: 34979

SEQ ID NO: 708240 - RNA, 64 nt, Homo Sapiens; identical to SEQ ID NO: 34980

SEQ ID NO: 708241 - RNA, 64 nt, Homo Sapiens; identical to SEQ ID NO: 34981

SEQ ID NO: 708242 - RNA, 64 nt, Homo Sapiens; identical to SEQ ID NO: 34982

SEQ ID NO: 708243 - RNA, 64 nt, Homo Sapiens; identical to SEQ ID NO: 34983

SEQ ID NO: 708244 - RNA, 64 nt, Homo Sapiens; identical to SEQ ID NO: 34984

SEQ ID NO: 708245 - RNA, 64 nt, Homo Sapiens; identical to SEQ ID NO: 34985

SEQ ID NO: 708246 - RNA, 64 nt, Homo Sapiens; identical to SEQ ID NO: 34986

SEQ ID NO: 708247 - RNA, 64 nt, Homo Sapiens; identical to SEQ ID NO: 34987

SEQ ID NO: 708248 - RNA, 64 nt, Homo Sapiens; identical to SEQ ID NO: 34988

SEQ ID NO: 708249 - RNA, 64 nt, Homo Sapiens; identical to SEQ ID NO: 34989

SEQ ID NO: 708250 - RNA, 64 nt, Homo Sapiens; identical to SEQ ID NO: 34990

SEQ ID NO: 708251 - RNA, 64 nt, Homo Sapiens; identical to SEQ ID NO: 34991

SEQ ID NO: 708252 - RNA, 64 nt, Homo Sapiens; identical to SEQ ID NO: 34992

SEQ ID NO: 708253 - RNA, 64 nt, Homo Sapiens; identical to SEQ ID NO: 34993

SEQ ID NO: 708254 - RNA, 64 nt, Homo Sapiens; identical to SEQ ID NO: 34994

SEQ ID NO: 708255 - RNA, 64 nt, Homo Sapiens; identical to SEQ ID NO: 34995

SEQ ID NO: 708256 - RNA, 64 nt, Homo Sapiens; identical to SEQ ID NO: 34996

SEQ ID NO: 708257 - RNA, 64 nt, Homo Sapiens; identical to SEQ ID NO: 34997

SEQ ID NO: 708258 - RNA, 64 nt, Homo Sapiens; identical to SEQ ID NO: 34998

SEQ ID NO: 708259 - RNA, 64 nt, Homo Sapiens; identical to SEQ ID NO: 34999

SEQ ID NO: 708260 - RNA, 64 nt, Homo Sapiens; identical to SEQ ID NO: 35000

SEQ ID NO: 708261 - RNA, 64 nt, Homo Sapiens; identical to SEQ ID NO: 35001

SEQ ID NO: 708262 - RNA, 64 nt, Homo Sapiens; identical to SEQ ID NO: 35002

SEQ ID NO: 708263 - RNA, 64 nt, Homo Sapiens; identical to SEQ ID NO: 35003

SEQ ID NO: 708264 - RNA, 64 nt, Homo Sapiens; identical to SEQ ID NO: 35004

SEQ ID NO: 708265 - RNA, 64 nt, Homo Sapiens; identical to SEQ ID NO: 35005

SEQ ID NO: 708266 - RNA, 64 nt, Homo Sapiens; identical to SEQ ID NO: 35006

SEQ ID NO: 708267 - RNA, 64 nt, Homo Sapiens; identical to SEQ ID NO: 35007

SEQ ID NO: 708268 - RNA, 64 nt, Homo Sapiens; identical to SEQ ID NO: 35008

SEQ ID NO: 708269 - RNA, 64 nt, Homo Sapiens; identical to SEQ ID NO: 35009

SEQ ID NO: 708270 - RNA, 64 nt, Homo Sapiens; identical to SEQ ID NO: 35010

SEQ ID NO: 708271 - RNA, 64 nt, Homo Sapiens; identical to SEQ ID NO: 35011

SEQ ID NO: 708272 - RNA, 64 nt, Homo Sapiens; identical to SEQ ID NO: 35012

SEQ ID NO: 708273 - RNA, 64 nt, Homo Sapiens; identical to SEQ ID NO: 35013

SEQ ID NO: 708274 - RNA, 64 nt, Homo Sapiens; identical to SEQ ID NO: 35014

SEQ ID NO: 708275 - RNA, 64 nt, Homo Sapiens; identical to SEQ ID NO: 35015

SEQ ID NO: 708276 - RNA, 64 nt, Homo Sapiens; identical to SEQ ID NO: 35016

SEQ ID NO: 708277 - RNA, 64 nt, Homo Sapiens; identical to SEQ ID NO: 35017

SEQ ID NO: 708278 - RNA, 64 nt, Homo Sapiens; identical to SEQ ID NO: 35018

SEQ ID NO: 708279 - RNA, 64 nt, Homo Sapiens; identical to SEQ ID NO: 35019

SEQ ID NO: 708280 - RNA, 64 nt, Homo Sapiens; identical to SEQ ID NO: 35020

SEQ ID NO: 708281 - RNA, 64 nt, Homo Sapiens; identical to SEQ ID NO: 35021

SEQ ID NO: 708282 - RNA, 64 nt, Homo Sapiens; identical to SEQ ID NO: 35022

SEQ ID NO: 708283 - RNA, 64 nt, Homo Sapiens; identical to SEQ ID NO: 35023

SEQ ID NO: 708284 - RNA, 64 nt, Homo Sapiens; identical to SEQ ID NO: 35024

SEQ ID NO: 708285 - RNA, 64 nt, Homo Sapiens; identical to SEQ ID NO: 35025

SEQ ID NO: 708286 - RNA, 64 nt, Homo Sapiens; identical to SEQ ID NO: 35026

SEQ ID NO: 708287 - RNA, 64 nt, Homo Sapiens; identical to SEQ ID NO: 35027

SEQ ID NO: 708288 - RNA, 64 nt, Homo Sapiens; identical to SEQ ID NO: 35028

SEQ ID NO: 708289 - RNA, 64 nt, Homo Sapiens; identical to SEQ ID NO: 35029

SEQ ID NO: 708290 - RNA, 64 nt, Homo Sapiens; identical to SEQ ID NO: 35030

SEQ ID NO: 708291 - RNA, 64 nt, Homo Sapiens; identical to SEQ ID NO: 35031

SEQ ID NO: 708292 - RNA, 64 nt, Homo Sapiens; identical to SEQ ID NO: 35032

SEQ ID NO: 708293 - RNA, 64 nt, Homo Sapiens; identical to SEQ ID NO: 35033

SEQ ID NO: 708294 - RNA, 64 nt, Homo Sapiens; identical to SEQ ID NO: 35034

SEQ ID NO: 708295 - RNA, 64 nt, Homo Sapiens; identical to SEQ ID NO: 35035

SEQ ID NO: 708296 - RNA, 64 nt, Homo Sapiens; identical to SEQ ID NO: 35036

SEQ ID NO: 708297 - RNA, 64 nt, Homo Sapiens; identical to SEQ ID NO: 35037

SEQ ID NO: 708298 - RNA, 64 nt, Homo Sapiens; identical to SEQ ID NO: 35038

SEQ ID NO: 708299 - RNA, 64 nt, Homo Sapiens; identical to SEQ ID NO: 35039

SEQ ID NO: 708300 - RNA, 64 nt, Homo Sapiens; identical to SEQ ID NO: 35040

SEQ ID NO: 708301 - RNA, 64 nt, Homo Sapiens; identical to SEQ ID NO: 35041

SEQ ID NO: 708302 - RNA, 64 nt, Homo Sapiens; identical to SEQ ID NO: 35042

SEQ ID NO: 708303 - RNA, 64 nt, Homo Sapiens; identical to SEQ ID NO: 35043

SEQ ID NO: 708304 - RNA, 64 nt, Homo Sapiens; identical to SEQ ID NO: 35044

SEQ ID NO: 708305 - RNA, 64 nt, Homo Sapiens; identical to SEQ ID NO: 35045

SEQ ID NO: 708306 - RNA, 64 nt, Homo Sapiens; identical to SEQ ID NO: 35046

SEQ ID NO: 708307 - RNA, 64 nt, Homo Sapiens; identical to SEQ ID NO: 35047

SEQ ID NO: 708308 - RNA, 64 nt, Homo Sapiens; identical to SEQ ID NO: 35048

SEQ ID NO: 708309 - RNA, 64 nt, Homo Sapiens; identical to SEQ ID NO: 35049

SEQ ID NO: 708310 - RNA, 64 nt, Homo Sapiens; identical to SEQ ID NO: 35050

SEQ ID NO: 708311 - RNA, 64 nt, Homo Sapiens; identical to SEQ ID NO: 35051

SEQ ID NO: 708312 - RNA, 64 nt, Homo Sapiens; identical to SEQ ID NO: 35052

SEQ ID NO: 708313 - RNA, 64 nt, Homo Sapiens; identical to SEQ ID NO: 35053

SEQ ID NO: 708314 - RNA, 64 nt, Homo Sapiens; identical to SEQ ID NO: 35054

SEQ ID NO: 708315 - RNA, 64 nt, Homo Sapiens; identical to SEQ ID NO: 35055

SEQ ID NO: 708316 - RNA, 64 nt, Homo Sapiens; identical to SEQ ID NO: 35056

SEQ ID NO: 708317 - RNA, 64 nt, Homo Sapiens; identical to SEQ ID NO: 35057

SEQ ID NO: 708318 - RNA, 64 nt, Homo Sapiens; identical to SEQ ID NO: 35058

SEQ ID NO: 708319 - RNA, 64 nt, Homo Sapiens; identical to SEQ ID NO: 35059

SEQ ID NO: 708320 - RNA, 64 nt, Homo Sapiens; identical to SEQ ID NO: 35060

SEQ ID NO: 708321 - RNA, 64 nt, Homo Sapiens; identical to SEQ ID NO: 35061

SEQ ID NO: 708322 - RNA, 64 nt, Homo Sapiens; identical to SEQ ID NO: 35062

SEQ ID NO: 708323 - RNA, 64 nt, Homo Sapiens; identical to SEQ ID NO: 35063

SEQ ID NO: 708324 - RNA, 64 nt, Homo Sapiens; identical to SEQ ID NO: 35064

SEQ ID NO: 708325 - RNA, 64 nt, Homo Sapiens; identical to SEQ ID NO: 35065

SEQ ID NO: 708326 - RNA, 64 nt, Homo Sapiens; identical to SEQ ID NO: 35066

SEQ ID NO: 708327 - RNA, 64 nt, Homo Sapiens; identical to SEQ ID NO: 35067

SEQ ID NO: 708328 - RNA, 64 nt, Homo Sapiens; identical to SEQ ID NO: 35068

SEQ ID NO: 708329 - RNA, 64 nt, Homo Sapiens; identical to SEQ ID NO: 35069

SEQ ID NO: 708330 - RNA, 64 nt, Homo Sapiens; identical to SEQ ID NO: 35070

SEQ ID NO: 708331 - RNA, 64 nt, Homo Sapiens; identical to SEQ ID NO: 35071

SEQ ID NO: 708332 - RNA, 64 nt, Homo Sapiens; identical to SEQ ID NO: 35072

SEQ ID NO: 708333 - RNA, 64 nt, Homo Sapiens; identical to SEQ ID NO: 35073

SEQ ID NO: 708334 - RNA, 64 nt, Homo Sapiens; identical to SEQ ID NO: 35074

SEQ ID NO: 708335 - RNA, 64 nt, Homo Sapiens; identical to SEQ ID NO: 35075

SEQ ID NO: 708336 - RNA, 64 nt, Homo Sapiens; identical to SEQ ID NO: 35076

SEQ ID NO: 708337 - RNA, 64 nt, Homo Sapiens; identical to SEQ ID NO: 35077

SEQ ID NO: 708338 - RNA, 64 nt, Homo Sapiens; identical to SEQ ID NO: 35078

SEQ ID NO: 708339 - RNA, 64 nt, Homo Sapiens; identical to SEQ ID NO: 35079

SEQ ID NO: 708340 - RNA, 64 nt, Homo Sapiens; identical to SEQ ID NO: 35080

SEQ ID NO: 708341 - RNA, 64 nt, Homo Sapiens; identical to SEQ ID NO: 35081

SEQ ID NO: 708342 - RNA, 64 nt, Homo Sapiens; identical to SEQ ID NO: 35082

SEQ ID NO: 708343 - RNA, 64 nt, Homo Sapiens; identical to SEQ ID NO: 35083

SEQ ID NO: 708344 - RNA, 64 nt, Homo Sapiens; identical to SEQ ID NO: 35084

SEQ ID NO: 708345 - RNA, 64 nt, Homo Sapiens; identical to SEQ ID NO: 35085

SEQ ID NO: 708346 - RNA, 64 nt, Homo Sapiens; identical to SEQ ID NO: 35086

SEQ ID NO: 708347 - RNA, 64 nt, Homo Sapiens; identical to SEQ ID NO: 35087

SEQ ID NO: 708348 - RNA, 64 nt, Homo Sapiens; identical to SEQ ID NO: 35088

SEQ ID NO: 708349 - RNA, 64 nt, Homo Sapiens; identical to SEQ ID NO: 35089

SEQ ID NO: 708350 - RNA, 64 nt, Homo Sapiens; identical to SEQ ID NO: 35090

SEQ ID NO: 708351 - RNA, 64 nt, Homo Sapiens; identical to SEQ ID NO: 35091

SEQ ID NO: 708352 - RNA, 64 nt, Homo Sapiens; identical to SEQ ID NO: 35092

SEQ ID NO: 708353 - RNA, 64 nt, Homo Sapiens; identical to SEQ ID NO: 35093

SEQ ID NO: 708354 - RNA, 64 nt, Homo Sapiens; identical to SEQ ID NO: 35094

SEQ ID NO: 708355 - RNA, 64 nt, Homo Sapiens; identical to SEQ ID NO: 35095

SEQ ID NO: 708356 - RNA, 64 nt, Homo Sapiens; identical to SEQ ID NO: 35096

SEQ ID NO: 708357 - RNA, 64 nt, Homo Sapiens; identical to SEQ ID NO: 35097

SEQ ID NO: 708358 - RNA, 64 nt, Homo Sapiens; identical to SEQ ID NO: 35098

SEQ ID NO: 708359 - RNA, 64 nt, Homo Sapiens; identical to SEQ ID NO: 35099

SEQ ID NO: 708360 - RNA, 64 nt, Homo Sapiens; identical to SEQ ID NO: 35100

SEQ ID NO: 708361 - RNA, 64 nt, Homo Sapiens; identical to SEQ ID NO: 35101

SEQ ID NO: 708362 - RNA, 64 nt, Homo Sapiens; identical to SEQ ID NO: 35102

SEQ ID NO: 708363 - RNA, 64 nt, Homo Sapiens; identical to SEQ ID NO: 35103

SEQ ID NO: 708364 - RNA, 64 nt, Homo Sapiens; identical to SEQ ID NO: 35104

SEQ ID NO: 708365 - RNA, 64 nt, Homo Sapiens; identical to SEQ ID NO: 35105

SEQ ID NO: 708366 - RNA, 64 nt, Homo Sapiens; identical to SEQ ID NO: 35106

SEQ ID NO: 708367 - RNA, 64 nt, Homo Sapiens; identical to SEQ ID NO: 35107

SEQ ID NO: 708368 - RNA, 64 nt, Homo Sapiens; identical to SEQ ID NO: 35108

SEQ ID NO: 708369 - RNA, 64 nt, Homo Sapiens; identical to SEQ ID NO: 35109

SEQ ID NO: 708370 - RNA, 64 nt, Homo Sapiens; identical to SEQ ID NO: 35110

SEQ ID NO: 708371 - RNA, 64 nt, Homo Sapiens; identical to SEQ ID NO: 35111

SEQ ID NO: 708372 - RNA, 64 nt, Homo Sapiens; identical to SEQ ID NO: 35112

SEQ ID NO: 708373 - RNA, 64 nt, Homo Sapiens; identical to SEQ ID NO: 35113

SEQ ID NO: 708374 - RNA, 64 nt, Homo Sapiens; identical to SEQ ID NO: 35114

SEQ ID NO: 708375 - RNA, 64 nt, Homo Sapiens; identical to SEQ ID NO: 35115

SEQ ID NO: 708376 - RNA, 64 nt, Homo Sapiens; identical to SEQ ID NO: 35116

SEQ ID NO: 708377 - RNA, 64 nt, Homo Sapiens; identical to SEQ ID NO: 35117

SEQ ID NO: 708378 - RNA, 64 nt, Homo Sapiens; identical to SEQ ID NO: 35118

SEQ ID NO: 708379 - RNA, 64 nt, Homo Sapiens; identical to SEQ ID NO: 35119

SEQ ID NO: 708380 - RNA, 64 nt, Homo Sapiens; identical to SEQ ID NO: 35120

SEQ ID NO: 708381 - RNA, 64 nt, Homo Sapiens; identical to SEQ ID NO: 35121

SEQ ID NO: 708382 - RNA, 64 nt, Homo Sapiens; identical to SEQ ID NO: 35122

SEQ ID NO: 708383 - RNA, 64 nt, Homo Sapiens; identical to SEQ ID NO: 35123

SEQ ID NO: 708384 - RNA, 64 nt, Homo Sapiens; identical to SEQ ID NO: 35124

SEQ ID NO: 708385 - RNA, 64 nt, Homo Sapiens; identical to SEQ ID NO: 35125

SEQ ID NO: 708386 - RNA, 64 nt, Homo Sapiens; identical to SEQ ID NO: 35126

SEQ ID NO: 708387 - RNA, 64 nt, Homo Sapiens; identical to SEQ ID NO: 35127

SEQ ID NO: 708388 - RNA, 64 nt, Homo Sapiens; identical to SEQ ID NO: 35128

SEQ ID NO: 708389 - RNA, 64 nt, Homo Sapiens; identical to SEQ ID NO: 35129

SEQ ID NO: 708390 - RNA, 64 nt, Homo Sapiens; identical to SEQ ID NO: 35130

SEQ ID NO: 708391 - RNA, 64 nt, Homo Sapiens; identical to SEQ ID NO: 35131

SEQ ID NO: 708392 - RNA, 64 nt, Homo Sapiens; identical to SEQ ID NO: 35132

SEQ ID NO: 708393 - RNA, 64 nt, Homo Sapiens; identical to SEQ ID NO: 35133

SEQ ID NO: 708394 - RNA, 64 nt, Homo Sapiens; identical to SEQ ID NO: 35134

SEQ ID NO: 708395 - RNA, 64 nt, Homo Sapiens; identical to SEQ ID NO: 35135

SEQ ID NO: 708396 - RNA, 64 nt, Homo Sapiens; identical to SEQ ID NO: 35136

SEQ ID NO: 708397 - RNA, 64 nt, Homo Sapiens; identical to SEQ ID NO: 35137

SEQ ID NO: 708398 - RNA, 64 nt, Homo Sapiens; identical to SEQ ID NO: 35138

SEQ ID NO: 708399 - RNA, 64 nt, Homo Sapiens; identical to SEQ ID NO: 35139

SEQ ID NO: 708400 - RNA, 64 nt, Homo Sapiens; identical to SEQ ID NO: 35140

SEQ ID NO: 708401 - RNA, 64 nt, Homo Sapiens; identical to SEQ ID NO: 35141

SEQ ID NO: 708402 - RNA, 64 nt, Homo Sapiens; identical to SEQ ID NO: 35142

SEQ ID NO: 708403 - RNA, 64 nt, Homo Sapiens; identical to SEQ ID NO: 35143

SEQ ID NO: 708404 - RNA, 64 nt, Homo Sapiens; identical to SEQ ID NO: 35144

SEQ ID NO: 708405 - RNA, 64 nt, Homo Sapiens; identical to SEQ ID NO: 35145

SEQ ID NO: 708406 - RNA, 64 nt, Homo Sapiens; identical to SEQ ID NO: 35146

SEQ ID NO: 708407 - RNA, 64 nt, Homo Sapiens; identical to SEQ ID NO: 35147

SEQ ID NO: 708408 - RNA, 64 nt, Homo Sapiens; identical to SEQ ID NO: 35148

SEQ ID NO: 708409 - RNA, 64 nt, Homo Sapiens; identical to SEQ ID NO: 35149

SEQ ID NO: 708410 - RNA, 64 nt, Homo Sapiens; identical to SEQ ID NO: 35150

SEQ ID NO: 708411 - RNA, 64 nt, Homo Sapiens; identical to SEQ ID NO: 35151

SEQ ID NO: 708412 - RNA, 64 nt, Homo Sapiens; identical to SEQ ID NO: 35152

SEQ ID NO: 708413 - RNA, 64 nt, Homo Sapiens; identical to SEQ ID NO: 35153

SEQ ID NO: 708414 - RNA, 64 nt, Homo Sapiens; identical to SEQ ID NO: 35154

SEQ ID NO: 708415 - RNA, 64 nt, Homo Sapiens; identical to SEQ ID NO: 35155

SEQ ID NO: 708416 - RNA, 64 nt, Homo Sapiens; identical to SEQ ID NO: 35156

SEQ ID NO: 708417 - RNA, 64 nt, Homo Sapiens; identical to SEQ ID NO: 35157

SEQ ID NO: 708418 - RNA, 64 nt, Homo Sapiens; identical to SEQ ID NO: 35158

SEQ ID NO: 708419 - RNA, 64 nt, Homo Sapiens; identical to SEQ ID NO: 35159

SEQ ID NO: 708420 - RNA, 64 nt, Homo Sapiens; identical to SEQ ID NO: 35160

SEQ ID NO: 708421 - RNA, 64 nt, Homo Sapiens; identical to SEQ ID NO: 35161

SEQ ID NO: 708422 - RNA, 64 nt, Homo Sapiens; identical to SEQ ID NO: 35162

SEQ ID NO: 708423 - RNA, 64 nt, Homo Sapiens; identical to SEQ ID NO: 35163

SEQ ID NO: 708424 - RNA, 64 nt, Homo Sapiens; identical to SEQ ID NO: 35164

SEQ ID NO: 708425 - RNA, 64 nt, Homo Sapiens; identical to SEQ ID NO: 35165

SEQ ID NO: 708426 - RNA, 64 nt, Homo Sapiens; identical to SEQ ID NO: 35166

SEQ ID NO: 708427 - RNA, 64 nt, Homo Sapiens; identical to SEQ ID NO: 35167

SEQ ID NO: 708428 - RNA, 64 nt, Homo Sapiens; identical to SEQ ID NO: 35168

SEQ ID NO: 708429 - RNA, 64 nt, Homo Sapiens; identical to SEQ ID NO: 35169

SEQ ID NO: 708430 - RNA, 64 nt, Homo Sapiens; identical to SEQ ID NO: 35170

SEQ ID NO: 708431 - RNA, 64 nt, Homo Sapiens; identical to SEQ ID NO: 35171

SEQ ID NO: 708432 - RNA, 64 nt, Homo Sapiens; identical to SEQ ID NO: 35172

SEQ ID NO: 708433 - RNA, 64 nt, Homo Sapiens; identical to SEQ ID NO: 35173

SEQ ID NO: 708434 - RNA, 64 nt, Homo Sapiens; identical to SEQ ID NO: 35174

SEQ ID NO: 708435 - RNA, 64 nt, Homo Sapiens; identical to SEQ ID NO: 35175

SEQ ID NO: 708436 - RNA, 64 nt, Homo Sapiens; identical to SEQ ID NO: 35176

SEQ ID NO: 708437 - RNA, 64 nt, Homo Sapiens; identical to SEQ ID NO: 35177

SEQ ID NO: 708438 - RNA, 64 nt, Homo Sapiens; identical to SEQ ID NO: 35178

SEQ ID NO: 708439 - RNA, 64 nt, Homo Sapiens; identical to SEQ ID NO: 35179

SEQ ID NO: 708440 - RNA, 64 nt, Homo Sapiens; identical to SEQ ID NO: 35180

SEQ ID NO: 708441 - RNA, 64 nt, Homo Sapiens; identical to SEQ ID NO: 35181

SEQ ID NO: 708442 - RNA, 64 nt, Homo Sapiens; identical to SEQ ID NO: 35182

SEQ ID NO: 708443 - RNA, 64 nt, Homo Sapiens; identical to SEQ ID NO: 35183

SEQ ID NO: 708444 - RNA, 64 nt, Homo Sapiens; identical to SEQ ID NO: 35184

SEQ ID NO: 708445 - RNA, 64 nt, Homo Sapiens; identical to SEQ ID NO: 35185

SEQ ID NO: 708446 - RNA, 64 nt, Homo Sapiens; identical to SEQ ID NO: 35186

SEQ ID NO: 708447 - RNA, 64 nt, Homo Sapiens; identical to SEQ ID NO: 35187

SEQ ID NO: 708448 - RNA, 64 nt, Homo Sapiens; identical to SEQ ID NO: 35188

SEQ ID NO: 708449 - RNA, 64 nt, Homo Sapiens; identical to SEQ ID NO: 35189

SEQ ID NO: 708450 - RNA, 64 nt, Homo Sapiens; identical to SEQ ID NO: 35190

SEQ ID NO: 708451 - RNA, 64 nt, Homo Sapiens; identical to SEQ ID NO: 35191

SEQ ID NO: 708452 - RNA, 64 nt, Homo Sapiens; identical to SEQ ID NO: 35192

SEQ ID NO: 708453 - RNA, 64 nt, Homo Sapiens; identical to SEQ ID NO: 35193

SEQ ID NO: 708454 - RNA, 64 nt, Homo Sapiens; identical to SEQ ID NO: 35194

SEQ ID NO: 708455 - RNA, 64 nt, Homo Sapiens; identical to SEQ ID NO: 35195

SEQ ID NO: 708456 - RNA, 64 nt, Homo Sapiens; identical to SEQ ID NO: 35196

SEQ ID NO: 708457 - RNA, 64 nt, Homo Sapiens; identical to SEQ ID NO: 35197

SEQ ID NO: 708458 - RNA, 64 nt, Homo Sapiens; identical to SEQ ID NO: 35198

SEQ ID NO: 708459 - RNA, 64 nt, Homo Sapiens; identical to SEQ ID NO: 35199

SEQ ID NO: 708460 - RNA, 64 nt, Homo Sapiens; identical to SEQ ID NO: 35200

SEQ ID NO: 708461 - RNA, 64 nt, Homo Sapiens; identical to SEQ ID NO: 35201

SEQ ID NO: 708462 - RNA, 64 nt, Homo Sapiens; identical to SEQ ID NO: 35202

SEQ ID NO: 708463 - RNA, 64 nt, Homo Sapiens; identical to SEQ ID NO: 35203

SEQ ID NO: 708464 - RNA, 64 nt, Homo Sapiens; identical to SEQ ID NO: 35204

SEQ ID NO: 708465 - RNA, 64 nt, Homo Sapiens; identical to SEQ ID NO: 35205

SEQ ID NO: 708466 - RNA, 64 nt, Homo Sapiens; identical to SEQ ID NO: 35206

SEQ ID NO: 708467 - RNA, 64 nt, Homo Sapiens; identical to SEQ ID NO: 35207

SEQ ID NO: 708468 - RNA, 64 nt, Homo Sapiens; identical to SEQ ID NO: 35208

SEQ ID NO: 708469 - RNA, 64 nt, Homo Sapiens; identical to SEQ ID NO: 35209

SEQ ID NO: 708470 - RNA, 64 nt, Homo Sapiens; identical to SEQ ID NO: 35210

SEQ ID NO: 708471 - RNA, 64 nt, Homo Sapiens; identical to SEQ ID NO: 35211

SEQ ID NO: 708472 - RNA, 64 nt, Homo Sapiens; identical to SEQ ID NO: 35212

SEQ ID NO: 708473 - RNA, 64 nt, Homo Sapiens; identical to SEQ ID NO: 35213

SEQ ID NO: 708474 - RNA, 64 nt, Homo Sapiens; identical to SEQ ID NO: 35214

SEQ ID NO: 708475 - RNA, 64 nt, Homo Sapiens; identical to SEQ ID NO: 35215

SEQ ID NO: 708476 - RNA, 64 nt, Homo Sapiens; identical to SEQ ID NO: 35216

SEQ ID NO: 708477 - RNA, 64 nt, Homo Sapiens; identical to SEQ ID NO: 35217

SEQ ID NO: 708478 - RNA, 64 nt, Homo Sapiens; identical to SEQ ID NO: 35218

SEQ ID NO: 708479 - RNA, 64 nt, Homo Sapiens; identical to SEQ ID NO: 35219

SEQ ID NO: 708480 - RNA, 64 nt, Homo Sapiens; identical to SEQ ID NO: 35220

SEQ ID NO: 708481 - RNA, 64 nt, Homo Sapiens; identical to SEQ ID NO: 35221

SEQ ID NO: 708482 - RNA, 64 nt, Homo Sapiens; identical to SEQ ID NO: 35222

SEQ ID NO: 708483 - RNA, 64 nt, Homo Sapiens; identical to SEQ ID NO: 35223

SEQ ID NO: 708484 - RNA, 64 nt, Homo Sapiens; identical to SEQ ID NO: 35224

SEQ ID NO: 708485 - RNA, 64 nt, Homo Sapiens; identical to SEQ ID NO: 35225

SEQ ID NO: 708486 - RNA, 64 nt, Homo Sapiens; identical to SEQ ID NO: 35226

SEQ ID NO: 708487 - RNA, 64 nt, Homo Sapiens; identical to SEQ ID NO: 35227

SEQ ID NO: 708488 - RNA, 64 nt, Homo Sapiens; identical to SEQ ID NO: 35228

SEQ ID NO: 708489 - RNA, 64 nt, Homo Sapiens; identical to SEQ ID NO: 35229

SEQ ID NO: 708490 - RNA, 64 nt, Homo Sapiens; identical to SEQ ID NO: 35230

SEQ ID NO: 708491 - RNA, 64 nt, Homo Sapiens; identical to SEQ ID NO: 35231

SEQ ID NO: 708492 - RNA, 64 nt, Homo Sapiens; identical to SEQ ID NO: 35232

SEQ ID NO: 708493 - RNA, 64 nt, Homo Sapiens; identical to SEQ ID NO: 35233

SEQ ID NO: 708494 - RNA, 64 nt, Homo Sapiens; identical to SEQ ID NO: 35234

SEQ ID NO: 708495 - RNA, 64 nt, Homo Sapiens; identical to SEQ ID NO: 35235

SEQ ID NO: 708496 - RNA, 64 nt, Homo Sapiens; identical to SEQ ID NO: 35236

SEQ ID NO: 708497 - RNA, 64 nt, Homo Sapiens; identical to SEQ ID NO: 35237

SEQ ID NO: 708498 - RNA, 64 nt, Homo Sapiens; identical to SEQ ID NO: 35238

SEQ ID NO: 708499 - RNA, 64 nt, Homo Sapiens; identical to SEQ ID NO: 35239

SEQ ID NO: 708500 - RNA, 64 nt, Homo Sapiens; identical to SEQ ID NO: 35240

SEQ ID NO: 708501 - RNA, 64 nt, Homo Sapiens; identical to SEQ ID NO: 35241

SEQ ID NO: 708502 - RNA, 64 nt, Homo Sapiens; identical to SEQ ID NO: 35242

SEQ ID NO: 708503 - RNA, 64 nt, Homo Sapiens; identical to SEQ ID NO: 35243

SEQ ID NO: 708504 - RNA, 64 nt, Homo Sapiens; identical to SEQ ID NO: 35244

SEQ ID NO: 708505 - RNA, 64 nt, Homo Sapiens; identical to SEQ ID NO: 35245

SEQ ID NO: 708506 - RNA, 64 nt, Homo Sapiens; identical to SEQ ID NO: 35246

SEQ ID NO: 708507 - RNA, 64 nt, Homo Sapiens; identical to SEQ ID NO: 35247

SEQ ID NO: 708508 - RNA, 64 nt, Homo Sapiens; identical to SEQ ID NO: 35248

SEQ ID NO: 708509 - RNA, 64 nt, Homo Sapiens; identical to SEQ ID NO: 35249

SEQ ID NO: 708510 - RNA, 64 nt, Homo Sapiens; identical to SEQ ID NO: 35250

SEQ ID NO: 708511 - RNA, 64 nt, Homo Sapiens; identical to SEQ ID NO: 35251

SEQ ID NO: 708512 - RNA, 64 nt, Homo Sapiens; identical to SEQ ID NO: 35252

SEQ ID NO: 708513 - RNA, 64 nt, Homo Sapiens; identical to SEQ ID NO: 35253

SEQ ID NO: 708514 - RNA, 64 nt, Homo Sapiens; identical to SEQ ID NO: 35254

SEQ ID NO: 708515 - RNA, 64 nt, Homo Sapiens; identical to SEQ ID NO: 35255

SEQ ID NO: 708516 - RNA, 64 nt, Homo Sapiens; identical to SEQ ID NO: 35256

SEQ ID NO: 708517 - RNA, 64 nt, Homo Sapiens; identical to SEQ ID NO: 35257

SEQ ID NO: 708518 - RNA, 64 nt, Homo Sapiens; identical to SEQ ID NO: 35258

SEQ ID NO: 708519 - RNA, 64 nt, Homo Sapiens; identical to SEQ ID NO: 35259

SEQ ID NO: 708520 - RNA, 64 nt, Homo Sapiens; identical to SEQ ID NO: 35260

SEQ ID NO: 708521 - RNA, 64 nt, Homo Sapiens; identical to SEQ ID NO: 35261

SEQ ID NO: 708522 - RNA, 64 nt, Homo Sapiens; identical to SEQ ID NO: 35262

SEQ ID NO: 708523 - RNA, 64 nt, Homo Sapiens; identical to SEQ ID NO: 35263

SEQ ID NO: 708524 - RNA, 64 nt, Homo Sapiens; identical to SEQ ID NO: 35264

SEQ ID NO: 708525 - RNA, 64 nt, Homo Sapiens; identical to SEQ ID NO: 35265

SEQ ID NO: 708526 - RNA, 64 nt, Homo Sapiens; identical to SEQ ID NO: 35266

SEQ ID NO: 708527 - RNA, 64 nt, Homo Sapiens; identical to SEQ ID NO: 35267

SEQ ID NO: 708528 - RNA, 64 nt, Homo Sapiens; identical to SEQ ID NO: 35268

SEQ ID NO: 708529 - RNA, 64 nt, Homo Sapiens; identical to SEQ ID NO: 35269

SEQ ID NO: 708530 - RNA, 64 nt, Homo Sapiens; identical to SEQ ID NO: 35270

SEQ ID NO: 708531 - RNA, 64 nt, Homo Sapiens; identical to SEQ ID NO: 35271

SEQ ID NO: 708532 - RNA, 64 nt, Homo Sapiens; identical to SEQ ID NO: 35272

SEQ ID NO: 708533 - RNA, 64 nt, Homo Sapiens; identical to SEQ ID NO: 35273

SEQ ID NO: 708534 - RNA, 64 nt, Homo Sapiens; identical to SEQ ID NO: 35274

SEQ ID NO: 708535 - RNA, 64 nt, Homo Sapiens; identical to SEQ ID NO: 35275

SEQ ID NO: 708536 - RNA, 64 nt, Homo Sapiens; identical to SEQ ID NO: 35276

SEQ ID NO: 708537 - RNA, 64 nt, Homo Sapiens; identical to SEQ ID NO: 35277

SEQ ID NO: 708538 - RNA, 64 nt, Homo Sapiens; identical to SEQ ID NO: 35278

SEQ ID NO: 708539 - RNA, 64 nt, Homo Sapiens; identical to SEQ ID NO: 35279

SEQ ID NO: 708540 - RNA, 64 nt, Homo Sapiens; identical to SEQ ID NO: 35280

SEQ ID NO: 708541 - RNA, 64 nt, Homo Sapiens; identical to SEQ ID NO: 35281

SEQ ID NO: 708542 - RNA, 64 nt, Homo Sapiens; identical to SEQ ID NO: 35282

SEQ ID NO: 708543 - RNA, 64 nt, Homo Sapiens; identical to SEQ ID NO: 35283

SEQ ID NO: 708544 - RNA, 64 nt, Homo Sapiens; identical to SEQ ID NO: 35284

SEQ ID NO: 708545 - RNA, 64 nt, Homo Sapiens; identical to SEQ ID NO: 35285

SEQ ID NO: 708546 - RNA, 64 nt, Homo Sapiens; identical to SEQ ID NO: 35286

SEQ ID NO: 708547 - RNA, 64 nt, Homo Sapiens; identical to SEQ ID NO: 35287

SEQ ID NO: 708548 - RNA, 64 nt, Homo Sapiens; identical to SEQ ID NO: 35288

SEQ ID NO: 708549 - RNA, 64 nt, Homo Sapiens; identical to SEQ ID NO: 35289

SEQ ID NO: 708550 - RNA, 64 nt, Homo Sapiens; identical to SEQ ID NO: 35290

SEQ ID NO: 708551 - RNA, 64 nt, Homo Sapiens; identical to SEQ ID NO: 35291

SEQ ID NO: 708552 - RNA, 64 nt, Homo Sapiens; identical to SEQ ID NO: 35292

SEQ ID NO: 708553 - RNA, 64 nt, Homo Sapiens; identical to SEQ ID NO: 35293

SEQ ID NO: 708554 - RNA, 64 nt, Homo Sapiens; identical to SEQ ID NO: 35294

SEQ ID NO: 708555 - RNA, 64 nt, Homo Sapiens; identical to SEQ ID NO: 35295

SEQ ID NO: 708556 - RNA, 64 nt, Homo Sapiens; identical to SEQ ID NO: 35296

SEQ ID NO: 708557 - RNA, 64 nt, Homo Sapiens; identical to SEQ ID NO: 35297

SEQ ID NO: 708558 - RNA, 64 nt, Homo Sapiens; identical to SEQ ID NO: 35298

SEQ ID NO: 708559 - RNA, 64 nt, Homo Sapiens; identical to SEQ ID NO: 35299

SEQ ID NO: 708560 - RNA, 64 nt, Homo Sapiens; identical to SEQ ID NO: 35300

SEQ ID NO: 708561 - RNA, 64 nt, Homo Sapiens; identical to SEQ ID NO: 35301

SEQ ID NO: 708562 - RNA, 64 nt, Homo Sapiens; identical to SEQ ID NO: 35302

SEQ ID NO: 708563 - RNA, 64 nt, Homo Sapiens; identical to SEQ ID NO: 35303

SEQ ID NO: 708564 - RNA, 64 nt, Homo Sapiens; identical to SEQ ID NO: 35304

SEQ ID NO: 708565 - RNA, 64 nt, Homo Sapiens; identical to SEQ ID NO: 35305

SEQ ID NO: 708566 - RNA, 64 nt, Homo Sapiens; identical to SEQ ID NO: 35306

SEQ ID NO: 708567 - RNA, 64 nt, Homo Sapiens; identical to SEQ ID NO: 35307

SEQ ID NO: 708568 - RNA, 64 nt, Homo Sapiens; identical to SEQ ID NO: 35308

SEQ ID NO: 708569 - RNA, 64 nt, Homo Sapiens; identical to SEQ ID NO: 35309

SEQ ID NO: 708570 - RNA, 64 nt, Homo Sapiens; identical to SEQ ID NO: 35310

SEQ ID NO: 708571 - RNA, 64 nt, Homo Sapiens; identical to SEQ ID NO: 35311

SEQ ID NO: 708572 - RNA, 64 nt, Homo Sapiens; identical to SEQ ID NO: 35312

SEQ ID NO: 708573 - RNA, 64 nt, Homo Sapiens; identical to SEQ ID NO: 35313

SEQ ID NO: 708574 - RNA, 64 nt, Homo Sapiens; identical to SEQ ID NO: 35314

SEQ ID NO: 708575 - RNA, 64 nt, Homo Sapiens; identical to SEQ ID NO: 35315

SEQ ID NO: 708576 - RNA, 64 nt, Homo Sapiens; identical to SEQ ID NO: 35316

SEQ ID NO: 708577 - RNA, 64 nt, Homo Sapiens; identical to SEQ ID NO: 35317

SEQ ID NO: 708578 - RNA, 64 nt, Homo Sapiens; identical to SEQ ID NO: 35318

SEQ ID NO: 708579 - RNA, 64 nt, Homo Sapiens; identical to SEQ ID NO: 35319

SEQ ID NO: 708580 - RNA, 64 nt, Homo Sapiens; identical to SEQ ID NO: 35320

SEQ ID NO: 708581 - RNA, 64 nt, Homo Sapiens; identical to SEQ ID NO: 35321

SEQ ID NO: 708582 - RNA, 64 nt, Homo Sapiens; identical to SEQ ID NO: 35322

SEQ ID NO: 708583 - RNA, 64 nt, Homo Sapiens; identical to SEQ ID NO: 35323

SEQ ID NO: 708584 - RNA, 64 nt, Homo Sapiens; identical to SEQ ID NO: 35324

SEQ ID NO: 708585 - RNA, 64 nt, Homo Sapiens; identical to SEQ ID NO: 35325

SEQ ID NO: 708586 - RNA, 64 nt, Homo Sapiens; identical to SEQ ID NO: 35326

SEQ ID NO: 708587 - RNA, 64 nt, Homo Sapiens; identical to SEQ ID NO: 35327

SEQ ID NO: 708588 - RNA, 64 nt, Homo Sapiens; identical to SEQ ID NO: 35328

SEQ ID NO: 708589 - RNA, 64 nt, Homo Sapiens; identical to SEQ ID NO: 35329

SEQ ID NO: 708590 - RNA, 64 nt, Homo Sapiens; identical to SEQ ID NO: 35330

SEQ ID NO: 708591 - RNA, 64 nt, Homo Sapiens; identical to SEQ ID NO: 35331

SEQ ID NO: 708592 - RNA, 64 nt, Homo Sapiens; identical to SEQ ID NO: 35332

SEQ ID NO: 708593 - RNA, 64 nt, Homo Sapiens; identical to SEQ ID NO: 35333

SEQ ID NO: 708594 - RNA, 64 nt, Homo Sapiens; identical to SEQ ID NO: 35334

SEQ ID NO: 708595 - RNA, 64 nt, Homo Sapiens; identical to SEQ ID NO: 35335

SEQ ID NO: 708596 - RNA, 64 nt, Homo Sapiens; identical to SEQ ID NO: 35336

SEQ ID NO: 708597 - RNA, 64 nt, Homo Sapiens; identical to SEQ ID NO: 35337

SEQ ID NO: 708598 - RNA, 64 nt, Homo Sapiens; identical to SEQ ID NO: 35338

SEQ ID NO: 708599 - RNA, 64 nt, Homo Sapiens; identical to SEQ ID NO: 35339

SEQ ID NO: 708600 - RNA, 64 nt, Homo Sapiens; identical to SEQ ID NO: 35340

SEQ ID NO: 708601 - RNA, 64 nt, Homo Sapiens; identical to SEQ ID NO: 35341

SEQ ID NO: 708602 - RNA, 64 nt, Homo Sapiens; identical to SEQ ID NO: 35342

SEQ ID NO: 708603 - RNA, 64 nt, Homo Sapiens; identical to SEQ ID NO: 35343

SEQ ID NO: 708604 - RNA, 64 nt, Homo Sapiens; identical to SEQ ID NO: 35344

SEQ ID NO: 708605 - RNA, 64 nt, Homo Sapiens; identical to SEQ ID NO: 35345

SEQ ID NO: 708606 - RNA, 64 nt, Homo Sapiens; identical to SEQ ID NO: 35346

SEQ ID NO: 708607 - RNA, 64 nt, Homo Sapiens; identical to SEQ ID NO: 35347

SEQ ID NO: 708608 - RNA, 64 nt, Homo Sapiens; identical to SEQ ID NO: 35348

SEQ ID NO: 708609 - RNA, 64 nt, Homo Sapiens; identical to SEQ ID NO: 35349

SEQ ID NO: 708610 - RNA, 64 nt, Homo Sapiens; identical to SEQ ID NO: 35350

SEQ ID NO: 708611 - RNA, 64 nt, Homo Sapiens; identical to SEQ ID NO: 35351

SEQ ID NO: 708612 - RNA, 64 nt, Homo Sapiens; identical to SEQ ID NO: 35352

SEQ ID NO: 708613 - RNA, 64 nt, Homo Sapiens; identical to SEQ ID NO: 35353

SEQ ID NO: 708614 - RNA, 64 nt, Homo Sapiens; identical to SEQ ID NO: 35354

SEQ ID NO: 708615 - RNA, 64 nt, Homo Sapiens; identical to SEQ ID NO: 35355

SEQ ID NO: 708616 - RNA, 64 nt, Homo Sapiens; identical to SEQ ID NO: 35356

SEQ ID NO: 708617 - RNA, 64 nt, Homo Sapiens; identical to SEQ ID NO: 35357

SEQ ID NO: 708618 - RNA, 64 nt, Homo Sapiens; identical to SEQ ID NO: 35358

SEQ ID NO: 708619 - RNA, 64 nt, Homo Sapiens; identical to SEQ ID NO: 35359

SEQ ID NO: 708620 - RNA, 64 nt, Homo Sapiens; identical to SEQ ID NO: 35360

SEQ ID NO: 708621 - RNA, 64 nt, Homo Sapiens; identical to SEQ ID NO: 35361

SEQ ID NO: 708622 - RNA, 64 nt, Homo Sapiens; identical to SEQ ID NO: 35362

SEQ ID NO: 708623 - RNA, 64 nt, Homo Sapiens; identical to SEQ ID NO: 35363

SEQ ID NO: 708624 - RNA, 64 nt, Homo Sapiens; identical to SEQ ID NO: 35364

SEQ ID NO: 708625 - RNA, 64 nt, Homo Sapiens; identical to SEQ ID NO: 35365

SEQ ID NO: 708626 - RNA, 64 nt, Homo Sapiens; identical to SEQ ID NO: 35366

SEQ ID NO: 708627 - RNA, 64 nt, Homo Sapiens; identical to SEQ ID NO: 35367

SEQ ID NO: 708628 - RNA, 64 nt, Homo Sapiens; identical to SEQ ID NO: 35368

SEQ ID NO: 708629 - RNA, 64 nt, Homo Sapiens; identical to SEQ ID NO: 35369

SEQ ID NO: 708630 - RNA, 64 nt, Homo Sapiens; identical to SEQ ID NO: 35370

SEQ ID NO: 708631 - RNA, 64 nt, Homo Sapiens; identical to SEQ ID NO: 35371

SEQ ID NO: 708632 - RNA, 64 nt, Homo Sapiens; identical to SEQ ID NO: 35372

SEQ ID NO: 708633 - RNA, 64 nt, Homo Sapiens; identical to SEQ ID NO: 35373

SEQ ID NO: 708634 - RNA, 64 nt, Homo Sapiens; identical to SEQ ID NO: 35374

SEQ ID NO: 708635 - RNA, 64 nt, Homo Sapiens; identical to SEQ ID NO: 35375

SEQ ID NO: 708636 - RNA, 64 nt, Homo Sapiens; identical to SEQ ID NO: 35376

SEQ ID NO: 708637 - RNA, 64 nt, Homo Sapiens; identical to SEQ ID NO: 35377

SEQ ID NO: 708638 - RNA, 64 nt, Homo Sapiens; identical to SEQ ID NO: 35378

SEQ ID NO: 708639 - RNA, 64 nt, Homo Sapiens; identical to SEQ ID NO: 35379

SEQ ID NO: 708640 - RNA, 64 nt, Homo Sapiens; identical to SEQ ID NO: 35380

SEQ ID NO: 708641 - RNA, 64 nt, Homo Sapiens; identical to SEQ ID NO: 35381

SEQ ID NO: 708642 - RNA, 64 nt, Homo Sapiens; identical to SEQ ID NO: 35382

SEQ ID NO: 708643 - RNA, 64 nt, Homo Sapiens; identical to SEQ ID NO: 35383

SEQ ID NO: 708644 - RNA, 64 nt, Homo Sapiens; identical to SEQ ID NO: 35384

SEQ ID NO: 708645 - RNA, 64 nt, Homo Sapiens; identical to SEQ ID NO: 35385

SEQ ID NO: 708646 - RNA, 64 nt, Homo Sapiens; identical to SEQ ID NO: 35386

SEQ ID NO: 708647 - RNA, 64 nt, Homo Sapiens; identical to SEQ ID NO: 35387

SEQ ID NO: 708648 - RNA, 64 nt, Homo Sapiens; identical to SEQ ID NO: 35388

SEQ ID NO: 708649 - RNA, 64 nt, Homo Sapiens; identical to SEQ ID NO: 35389

SEQ ID NO: 708650 - RNA, 64 nt, Homo Sapiens; identical to SEQ ID NO: 35390

SEQ ID NO: 708651 - RNA, 64 nt, Homo Sapiens; identical to SEQ ID NO: 35391

SEQ ID NO: 708652 - RNA, 64 nt, Homo Sapiens; identical to SEQ ID NO: 35392

SEQ ID NO: 708653 - RNA, 64 nt, Homo Sapiens; identical to SEQ ID NO: 35393

SEQ ID NO: 708654 - RNA, 64 nt, Homo Sapiens; identical to SEQ ID NO: 35394

SEQ ID NO: 708655 - RNA, 64 nt, Homo Sapiens; identical to SEQ ID NO: 35395

SEQ ID NO: 708656 - RNA, 64 nt, Homo Sapiens; identical to SEQ ID NO: 35396

SEQ ID NO: 708657 - RNA, 64 nt, Homo Sapiens; identical to SEQ ID NO: 35397

SEQ ID NO: 708658 - RNA, 64 nt, Homo Sapiens; identical to SEQ ID NO: 35398

SEQ ID NO: 708659 - RNA, 64 nt, Homo Sapiens; identical to SEQ ID NO: 35399

SEQ ID NO: 708660 - RNA, 64 nt, Homo Sapiens; identical to SEQ ID NO: 35400

SEQ ID NO: 708661 - RNA, 64 nt, Homo Sapiens; identical to SEQ ID NO: 35401

SEQ ID NO: 708662 - RNA, 64 nt, Homo Sapiens; identical to SEQ ID NO: 35402

SEQ ID NO: 708663 - RNA, 64 nt, Homo Sapiens; identical to SEQ ID NO: 35403

SEQ ID NO: 708664 - RNA, 64 nt, Homo Sapiens; identical to SEQ ID NO: 35404

SEQ ID NO: 708665 - RNA, 64 nt, Homo Sapiens; identical to SEQ ID NO: 35405

SEQ ID NO: 708666 - RNA, 64 nt, Homo Sapiens; identical to SEQ ID NO: 35406

SEQ ID NO: 708667 - RNA, 64 nt, Homo Sapiens; identical to SEQ ID NO: 35407

SEQ ID NO: 708668 - RNA, 64 nt, Homo Sapiens; identical to SEQ ID NO: 35408

SEQ ID NO: 708669 - RNA, 64 nt, Homo Sapiens; identical to SEQ ID NO: 35409

SEQ ID NO: 708670 - RNA, 64 nt, Homo Sapiens; identical to SEQ ID NO: 35410

SEQ ID NO: 708671 - RNA, 64 nt, Homo Sapiens; identical to SEQ ID NO: 35411

SEQ ID NO: 708672 - RNA, 64 nt, Homo Sapiens; identical to SEQ ID NO: 35412

SEQ ID NO: 708673 - RNA, 64 nt, Homo Sapiens; identical to SEQ ID NO: 35413

SEQ ID NO: 708674 - RNA, 64 nt, Homo Sapiens; identical to SEQ ID NO: 35414

SEQ ID NO: 708675 - RNA, 64 nt, Homo Sapiens; identical to SEQ ID NO: 35415

SEQ ID NO: 708676 - RNA, 64 nt, Homo Sapiens; identical to SEQ ID NO: 35416

SEQ ID NO: 708677 - RNA, 64 nt, Homo Sapiens; identical to SEQ ID NO: 35417

SEQ ID NO: 708678 - RNA, 64 nt, Homo Sapiens; identical to SEQ ID NO: 35418

SEQ ID NO: 708679 - RNA, 64 nt, Homo Sapiens; identical to SEQ ID NO: 35419

SEQ ID NO: 708680 - RNA, 64 nt, Homo Sapiens; identical to SEQ ID NO: 35420

SEQ ID NO: 708681 - RNA, 64 nt, Homo Sapiens; identical to SEQ ID NO: 35421

SEQ ID NO: 708682 - RNA, 64 nt, Homo Sapiens; identical to SEQ ID NO: 35422

SEQ ID NO: 708683 - RNA, 64 nt, Homo Sapiens; identical to SEQ ID NO: 35423

SEQ ID NO: 708684 - RNA, 64 nt, Homo Sapiens; identical to SEQ ID NO: 35424

SEQ ID NO: 708685 - RNA, 64 nt, Homo Sapiens; identical to SEQ ID NO: 35425

SEQ ID NO: 708686 - RNA, 64 nt, Homo Sapiens; identical to SEQ ID NO: 35426

SEQ ID NO: 708687 - RNA, 64 nt, Homo Sapiens; identical to SEQ ID NO: 35427

SEQ ID NO: 708688 - RNA, 64 nt, Homo Sapiens; identical to SEQ ID NO: 35428

SEQ ID NO: 708689 - RNA, 64 nt, Homo Sapiens; identical to SEQ ID NO: 35429

SEQ ID NO: 708690 - RNA, 64 nt, Homo Sapiens; identical to SEQ ID NO: 35430

SEQ ID NO: 708691 - RNA, 64 nt, Homo Sapiens; identical to SEQ ID NO: 35431

SEQ ID NO: 708692 - RNA, 64 nt, Homo Sapiens; identical to SEQ ID NO: 35432

SEQ ID NO: 708693 - RNA, 64 nt, Homo Sapiens; identical to SEQ ID NO: 35433

SEQ ID NO: 708694 - RNA, 64 nt, Homo Sapiens; identical to SEQ ID NO: 35434

SEQ ID NO: 708695 - RNA, 64 nt, Homo Sapiens; identical to SEQ ID NO: 35435

SEQ ID NO: 708696 - RNA, 64 nt, Homo Sapiens; identical to SEQ ID NO: 35436

SEQ ID NO: 708697 - RNA, 64 nt, Homo Sapiens; identical to SEQ ID NO: 35437

SEQ ID NO: 708698 - RNA, 64 nt, Homo Sapiens; identical to SEQ ID NO: 35438

SEQ ID NO: 708699 - RNA, 64 nt, Homo Sapiens; identical to SEQ ID NO: 35439

SEQ ID NO: 708700 - RNA, 64 nt, Homo Sapiens; identical to SEQ ID NO: 35440

SEQ ID NO: 708701 - RNA, 64 nt, Homo Sapiens; identical to SEQ ID NO: 35441

SEQ ID NO: 708702 - RNA, 64 nt, Homo Sapiens; identical to SEQ ID NO: 35442

SEQ ID NO: 708703 - RNA, 64 nt, Homo Sapiens; identical to SEQ ID NO: 35443

SEQ ID NO: 708704 - RNA, 64 nt, Homo Sapiens; identical to SEQ ID NO: 35444

SEQ ID NO: 708705 - RNA, 64 nt, Homo Sapiens; identical to SEQ ID NO: 35445

SEQ ID NO: 708706 - RNA, 64 nt, Homo Sapiens; identical to SEQ ID NO: 35446

SEQ ID NO: 708707 - RNA, 64 nt, Homo Sapiens; identical to SEQ ID NO: 35447

SEQ ID NO: 708708 - RNA, 64 nt, Homo Sapiens; identical to SEQ ID NO: 35448

SEQ ID NO: 708709 - RNA, 64 nt, Homo Sapiens; identical to SEQ ID NO: 35449

SEQ ID NO: 708710 - RNA, 64 nt, Homo Sapiens; identical to SEQ ID NO: 35450

SEQ ID NO: 708711 - RNA, 64 nt, Homo Sapiens; identical to SEQ ID NO: 35451

SEQ ID NO: 708712 - RNA, 64 nt, Homo Sapiens; identical to SEQ ID NO: 35452

SEQ ID NO: 708713 - RNA, 64 nt, Homo Sapiens; identical to SEQ ID NO: 35453

SEQ ID NO: 708714 - RNA, 64 nt, Homo Sapiens; identical to SEQ ID NO: 35454

SEQ ID NO: 708715 - RNA, 64 nt, Homo Sapiens; identical to SEQ ID NO: 35455

SEQ ID NO: 708716 - RNA, 64 nt, Homo Sapiens; identical to SEQ ID NO: 35456

SEQ ID NO: 708717 - RNA, 64 nt, Homo Sapiens; identical to SEQ ID NO: 35457

SEQ ID NO: 708718 - RNA, 64 nt, Homo Sapiens; identical to SEQ ID NO: 35458

SEQ ID NO: 708719 - RNA, 64 nt, Homo Sapiens; identical to SEQ ID NO: 35459

SEQ ID NO: 708720 - RNA, 64 nt, Homo Sapiens; identical to SEQ ID NO: 35460

SEQ ID NO: 708721 - RNA, 64 nt, Homo Sapiens; identical to SEQ ID NO: 35461

SEQ ID NO: 708722 - RNA, 64 nt, Homo Sapiens; identical to SEQ ID NO: 35462

SEQ ID NO: 708723 - RNA, 64 nt, Homo Sapiens; identical to SEQ ID NO: 35463

SEQ ID NO: 708724 - RNA, 64 nt, Homo Sapiens; identical to SEQ ID NO: 35464

SEQ ID NO: 708725 - RNA, 64 nt, Homo Sapiens; identical to SEQ ID NO: 35465

SEQ ID NO: 708726 - RNA, 64 nt, Homo Sapiens; identical to SEQ ID NO: 35466

SEQ ID NO: 708727 - RNA, 64 nt, Homo Sapiens; identical to SEQ ID NO: 35467

SEQ ID NO: 708728 - RNA, 64 nt, Homo Sapiens; identical to SEQ ID NO: 35468

SEQ ID NO: 708729 - RNA, 64 nt, Homo Sapiens; identical to SEQ ID NO: 35469

SEQ ID NO: 708730 - RNA, 64 nt, Homo Sapiens; identical to SEQ ID NO: 35470

SEQ ID NO: 708731 - RNA, 64 nt, Homo Sapiens; identical to SEQ ID NO: 35471

SEQ ID NO: 708732 - RNA, 64 nt, Homo Sapiens; identical to SEQ ID NO: 35472

SEQ ID NO: 708733 - RNA, 64 nt, Homo Sapiens; identical to SEQ ID NO: 35473

SEQ ID NO: 708734 - RNA, 64 nt, Homo Sapiens; identical to SEQ ID NO: 35474

SEQ ID NO: 708735 - RNA, 64 nt, Homo Sapiens; identical to SEQ ID NO: 35475

SEQ ID NO: 708736 - RNA, 64 nt, Homo Sapiens; identical to SEQ ID NO: 35476

SEQ ID NO: 708737 - RNA, 64 nt, Homo Sapiens; identical to SEQ ID NO: 35477

SEQ ID NO: 708738 - RNA, 64 nt, Homo Sapiens; identical to SEQ ID NO: 35478

SEQ ID NO: 708739 - RNA, 64 nt, Homo Sapiens; identical to SEQ ID NO: 35479

SEQ ID NO: 708740 - RNA, 61 nt, Homo Sapiens; identical to SEQ ID NO: 35480

SEQ ID NO: 708741 - RNA, 60 nt, Homo Sapiens; identical to SEQ ID NO: 35481

SEQ ID NO: 708742 - RNA, 59 nt, Homo Sapiens; identical to SEQ ID NO: 35482

SEQ ID NO: 708743 - RNA, 58 nt, Homo Sapiens; identical to SEQ ID NO: 35483

SEQ ID NO: 708744 - RNA, 57 nt, Homo Sapiens; identical to SEQ ID NO: 35484

SEQ ID NO: 708745 - RNA, 64 nt, Homo Sapiens; identical to SEQ ID NO: 35485

SEQ ID NO: 708746 - RNA, 64 nt, Homo Sapiens; identical to SEQ ID NO: 35486

SEQ ID NO: 708747 - RNA, 64 nt, Homo Sapiens; identical to SEQ ID NO: 35487

SEQ ID NO: 708748 - RNA, 64 nt, Homo Sapiens; identical to SEQ ID NO: 35488

SEQ ID NO: 708749 - RNA, 64 nt, Homo Sapiens; identical to SEQ ID NO: 35489

SEQ ID NO: 708750 - RNA, 64 nt, Homo Sapiens; identical to SEQ ID NO: 35490

SEQ ID NO: 708751 - RNA, 64 nt, Homo Sapiens; identical to SEQ ID NO: 35491

SEQ ID NO: 708752 - RNA, 64 nt, Homo Sapiens; identical to SEQ ID NO: 35492

SEQ ID NO: 708753 - RNA, 64 nt, Homo Sapiens; identical to SEQ ID NO: 35493

SEQ ID NO: 708754 - RNA, 64 nt, Homo Sapiens; identical to SEQ ID NO: 35494

SEQ ID NO: 708755 - RNA, 64 nt, Homo Sapiens; identical to SEQ ID NO: 35495

SEQ ID NO: 708756 - RNA, 64 nt, Homo Sapiens; identical to SEQ ID NO: 35496

SEQ ID NO: 708757 - RNA, 64 nt, Homo Sapiens; identical to SEQ ID NO: 35497

SEQ ID NO: 708758 - RNA, 64 nt, Homo Sapiens; identical to SEQ ID NO: 35498

SEQ ID NO: 708759 - RNA, 64 nt, Homo Sapiens; identical to SEQ ID NO: 35499

SEQ ID NO: 708760 - RNA, 64 nt, Homo Sapiens; identical to SEQ ID NO: 35500

SEQ ID NO: 708761 - RNA, 64 nt, Homo Sapiens; identical to SEQ ID NO: 35501

SEQ ID NO: 708762 - RNA, 64 nt, Homo Sapiens; identical to SEQ ID NO: 35502

SEQ ID NO: 708763 - RNA, 64 nt, Homo Sapiens; identical to SEQ ID NO: 35503

SEQ ID NO: 708764 - RNA, 64 nt, Homo Sapiens; identical to SEQ ID NO: 35504

SEQ ID NO: 708765 - RNA, 64 nt, Homo Sapiens; identical to SEQ ID NO: 35505

SEQ ID NO: 708766 - RNA, 64 nt, Homo Sapiens; identical to SEQ ID NO: 35506

SEQ ID NO: 708767 - RNA, 64 nt, Homo Sapiens; identical to SEQ ID NO: 35507

SEQ ID NO: 708768 - RNA, 64 nt, Homo Sapiens; identical to SEQ ID NO: 35508

SEQ ID NO: 708769 - RNA, 64 nt, Homo Sapiens; identical to SEQ ID NO: 35509

SEQ ID NO: 708770 - RNA, 64 nt, Homo Sapiens; identical to SEQ ID NO: 35510

SEQ ID NO: 708771 - RNA, 64 nt, Homo Sapiens; identical to SEQ ID NO: 35511

SEQ ID NO: 708772 - RNA, 64 nt, Homo Sapiens; identical to SEQ ID NO: 35512

SEQ ID NO: 708773 - RNA, 64 nt, Homo Sapiens; identical to SEQ ID NO: 35513

SEQ ID NO: 708774 - RNA, 64 nt, Homo Sapiens; identical to SEQ ID NO: 35514

SEQ ID NO: 708775 - RNA, 64 nt, Homo Sapiens; identical to SEQ ID NO: 35515

SEQ ID NO: 708776 - RNA, 64 nt, Homo Sapiens; identical to SEQ ID NO: 35516

SEQ ID NO: 708777 - RNA, 64 nt, Homo Sapiens; identical to SEQ ID NO: 35517

SEQ ID NO: 708778 - RNA, 64 nt, Homo Sapiens; identical to SEQ ID NO: 35518

SEQ ID NO: 708779 - RNA, 64 nt, Homo Sapiens; identical to SEQ ID NO: 35519

SEQ ID NO: 708780 - RNA, 64 nt, Homo Sapiens; identical to SEQ ID NO: 35520

SEQ ID NO: 708781 - RNA, 64 nt, Homo Sapiens; identical to SEQ ID NO: 35521

SEQ ID NO: 708782 - RNA, 64 nt, Homo Sapiens; identical to SEQ ID NO: 35522

SEQ ID NO: 708783 - RNA, 64 nt, Homo Sapiens; identical to SEQ ID NO: 35523

SEQ ID NO: 708784 - RNA, 64 nt, Homo Sapiens; identical to SEQ ID NO: 35524

SEQ ID NO: 708785 - RNA, 64 nt, Homo Sapiens; identical to SEQ ID NO: 35525

SEQ ID NO: 708786 - RNA, 64 nt, Homo Sapiens; identical to SEQ ID NO: 35526

SEQ ID NO: 708787 - RNA, 64 nt, Homo Sapiens; identical to SEQ ID NO: 35527

SEQ ID NO: 708788 - RNA, 64 nt, Homo Sapiens; identical to SEQ ID NO: 35528

SEQ ID NO: 708789 - RNA, 64 nt, Homo Sapiens; identical to SEQ ID NO: 35529

SEQ ID NO: 708790 - RNA, 64 nt, Homo Sapiens; identical to SEQ ID NO: 35530

SEQ ID NO: 708791 - RNA, 64 nt, Homo Sapiens; identical to SEQ ID NO: 35531

SEQ ID NO: 708792 - RNA, 64 nt, Homo Sapiens; identical to SEQ ID NO: 35532

SEQ ID NO: 708793 - RNA, 64 nt, Homo Sapiens; identical to SEQ ID NO: 35533

SEQ ID NO: 708794 - RNA, 64 nt, Homo Sapiens; identical to SEQ ID NO: 35534

SEQ ID NO: 708795 - RNA, 64 nt, Homo Sapiens; identical to SEQ ID NO: 35535

SEQ ID NO: 708796 - RNA, 64 nt, Homo Sapiens; identical to SEQ ID NO: 35536

SEQ ID NO: 708797 - RNA, 64 nt, Homo Sapiens; identical to SEQ ID NO: 35537

SEQ ID NO: 708798 - RNA, 64 nt, Homo Sapiens; identical to SEQ ID NO: 35538

SEQ ID NO: 708799 - RNA, 64 nt, Homo Sapiens; identical to SEQ ID NO: 35539

SEQ ID NO: 708800 - RNA, 64 nt, Homo Sapiens; identical to SEQ ID NO: 35540

SEQ ID NO: 708801 - RNA, 64 nt, Homo Sapiens; identical to SEQ ID NO: 35541

SEQ ID NO: 708802 - RNA, 64 nt, Homo Sapiens; identical to SEQ ID NO: 35542

SEQ ID NO: 708803 - RNA, 64 nt, Homo Sapiens; identical to SEQ ID NO: 35543

SEQ ID NO: 708804 - RNA, 64 nt, Homo Sapiens; identical to SEQ ID NO: 35544

SEQ ID NO: 708805 - RNA, 64 nt, Homo Sapiens; identical to SEQ ID NO: 35545

SEQ ID NO: 708806 - RNA, 64 nt, Homo Sapiens; identical to SEQ ID NO: 35546

SEQ ID NO: 708807 - RNA, 64 nt, Homo Sapiens; identical to SEQ ID NO: 35547

SEQ ID NO: 708808 - RNA, 64 nt, Homo Sapiens; identical to SEQ ID NO: 35548

SEQ ID NO: 708809 - RNA, 64 nt, Homo Sapiens; identical to SEQ ID NO: 35549

SEQ ID NO: 708810 - RNA, 64 nt, Homo Sapiens; identical to SEQ ID NO: 35550

SEQ ID NO: 708811 - RNA, 64 nt, Homo Sapiens; identical to SEQ ID NO: 35551

SEQ ID NO: 708812 - RNA, 64 nt, Homo Sapiens; identical to SEQ ID NO: 35552

SEQ ID NO: 708813 - RNA, 64 nt, Homo Sapiens; identical to SEQ ID NO: 35553

SEQ ID NO: 708814 - RNA, 64 nt, Homo Sapiens; identical to SEQ ID NO: 35554

SEQ ID NO: 708815 - RNA, 64 nt, Homo Sapiens; identical to SEQ ID NO: 35555

SEQ ID NO: 708816 - RNA, 64 nt, Homo Sapiens; identical to SEQ ID NO: 35556

SEQ ID NO: 708817 - RNA, 64 nt, Homo Sapiens; identical to SEQ ID NO: 35557

SEQ ID NO: 708818 - RNA, 64 nt, Homo Sapiens; identical to SEQ ID NO: 35558

SEQ ID NO: 708819 - RNA, 64 nt, Homo Sapiens; identical to SEQ ID NO: 35559

SEQ ID NO: 708820 - RNA, 64 nt, Homo Sapiens; identical to SEQ ID NO: 35560

SEQ ID NO: 708821 - RNA, 64 nt, Homo Sapiens; identical to SEQ ID NO: 35561

SEQ ID NO: 708822 - RNA, 64 nt, Homo Sapiens; identical to SEQ ID NO: 35562

SEQ ID NO: 708823 - RNA, 64 nt, Homo Sapiens; identical to SEQ ID NO: 35563

SEQ ID NO: 708824 - RNA, 64 nt, Homo Sapiens; identical to SEQ ID NO: 35564

SEQ ID NO: 708825 - RNA, 64 nt, Homo Sapiens; identical to SEQ ID NO: 35565

SEQ ID NO: 708826 - RNA, 64 nt, Homo Sapiens; identical to SEQ ID NO: 35566

SEQ ID NO: 708827 - RNA, 64 nt, Homo Sapiens; identical to SEQ ID NO: 35567

SEQ ID NO: 708828 - RNA, 64 nt, Homo Sapiens; identical to SEQ ID NO: 35568

SEQ ID NO: 708829 - RNA, 64 nt, Homo Sapiens; identical to SEQ ID NO: 35569

SEQ ID NO: 708830 - RNA, 64 nt, Homo Sapiens; identical to SEQ ID NO: 35570

SEQ ID NO: 708831 - RNA, 64 nt, Homo Sapiens; identical to SEQ ID NO: 35571

SEQ ID NO: 708832 - RNA, 64 nt, Homo Sapiens; identical to SEQ ID NO: 35572

SEQ ID NO: 708833 - RNA, 64 nt, Homo Sapiens; identical to SEQ ID NO: 35573

SEQ ID NO: 708834 - RNA, 64 nt, Homo Sapiens; identical to SEQ ID NO: 35574

SEQ ID NO: 708835 - RNA, 64 nt, Homo Sapiens; identical to SEQ ID NO: 35575

SEQ ID NO: 708836 - RNA, 64 nt, Homo Sapiens; identical to SEQ ID NO: 35576

SEQ ID NO: 708837 - RNA, 64 nt, Homo Sapiens; identical to SEQ ID NO: 35577

SEQ ID NO: 708838 - RNA, 64 nt, Homo Sapiens; identical to SEQ ID NO: 35578

SEQ ID NO: 708839 - RNA, 64 nt, Homo Sapiens; identical to SEQ ID NO: 35579

SEQ ID NO: 708840 - RNA, 64 nt, Homo Sapiens; identical to SEQ ID NO: 35580

SEQ ID NO: 708841 - RNA, 64 nt, Homo Sapiens; identical to SEQ ID NO: 35581

SEQ ID NO: 708842 - RNA, 64 nt, Homo Sapiens; identical to SEQ ID NO: 35582

SEQ ID NO: 708843 - RNA, 64 nt, Homo Sapiens; identical to SEQ ID NO: 35583

SEQ ID NO: 708844 - RNA, 64 nt, Homo Sapiens; identical to SEQ ID NO: 35584

SEQ ID NO: 708845 - RNA, 64 nt, Homo Sapiens; identical to SEQ ID NO: 35585

SEQ ID NO: 708846 - RNA, 64 nt, Homo Sapiens; identical to SEQ ID NO: 35586

SEQ ID NO: 708847 - RNA, 64 nt, Homo Sapiens; identical to SEQ ID NO: 35587

SEQ ID NO: 708848 - RNA, 64 nt, Homo Sapiens; identical to SEQ ID NO: 35588

SEQ ID NO: 708849 - RNA, 64 nt, Homo Sapiens; identical to SEQ ID NO: 35589

SEQ ID NO: 708850 - RNA, 64 nt, Homo Sapiens; identical to SEQ ID NO: 35590

SEQ ID NO: 708851 - RNA, 64 nt, Homo Sapiens; identical to SEQ ID NO: 35591

SEQ ID NO: 708852 - RNA, 64 nt, Homo Sapiens; identical to SEQ ID NO: 35592

SEQ ID NO: 708853 - RNA, 64 nt, Homo Sapiens; identical to SEQ ID NO: 35593

SEQ ID NO: 708854 - RNA, 64 nt, Homo Sapiens; identical to SEQ ID NO: 35594

SEQ ID NO: 708855 - RNA, 64 nt, Homo Sapiens; identical to SEQ ID NO: 35595

SEQ ID NO: 708856 - RNA, 64 nt, Homo Sapiens; identical to SEQ ID NO: 35596

SEQ ID NO: 708857 - RNA, 64 nt, Homo Sapiens; identical to SEQ ID NO: 35597

SEQ ID NO: 708858 - RNA, 64 nt, Homo Sapiens; identical to SEQ ID NO: 35598

SEQ ID NO: 708859 - RNA, 64 nt, Homo Sapiens; identical to SEQ ID NO: 35599

SEQ ID NO: 708860 - RNA, 64 nt, Homo Sapiens; identical to SEQ ID NO: 35600

SEQ ID NO: 708861 - RNA, 64 nt, Homo Sapiens; identical to SEQ ID NO: 35601

SEQ ID NO: 708862 - RNA, 64 nt, Homo Sapiens; identical to SEQ ID NO: 35602

SEQ ID NO: 708863 - RNA, 64 nt, Homo Sapiens; identical to SEQ ID NO: 35603

SEQ ID NO: 708864 - RNA, 64 nt, Homo Sapiens; identical to SEQ ID NO: 35604

SEQ ID NO: 708865 - RNA, 64 nt, Homo Sapiens; identical to SEQ ID NO: 35605

SEQ ID NO: 708866 - RNA, 64 nt, Homo Sapiens; identical to SEQ ID NO: 35606

SEQ ID NO: 708867 - RNA, 64 nt, Homo Sapiens; identical to SEQ ID NO: 35607

SEQ ID NO: 708868 - RNA, 64 nt, Homo Sapiens; identical to SEQ ID NO: 35608

SEQ ID NO: 708869 - RNA, 64 nt, Homo Sapiens; identical to SEQ ID NO: 35609

SEQ ID NO: 708870 - RNA, 64 nt, Homo Sapiens; identical to SEQ ID NO: 35610

SEQ ID NO: 708871 - RNA, 64 nt, Homo Sapiens; identical to SEQ ID NO: 35611

SEQ ID NO: 708872 - RNA, 64 nt, Homo Sapiens; identical to SEQ ID NO: 35612

SEQ ID NO: 708873 - RNA, 64 nt, Homo Sapiens; identical to SEQ ID NO: 35613

SEQ ID NO: 708874 - RNA, 64 nt, Homo Sapiens; identical to SEQ ID NO: 35614

SEQ ID NO: 708875 - RNA, 64 nt, Homo Sapiens; identical to SEQ ID NO: 35615

SEQ ID NO: 708876 - RNA, 64 nt, Homo Sapiens; identical to SEQ ID NO: 35616

SEQ ID NO: 708877 - RNA, 64 nt, Homo Sapiens; identical to SEQ ID NO: 35617

SEQ ID NO: 708878 - RNA, 64 nt, Homo Sapiens; identical to SEQ ID NO: 35618

SEQ ID NO: 708879 - RNA, 64 nt, Homo Sapiens; identical to SEQ ID NO: 35619

SEQ ID NO: 708880 - RNA, 64 nt, Homo Sapiens; identical to SEQ ID NO: 35620

SEQ ID NO: 708881 - RNA, 64 nt, Homo Sapiens; identical to SEQ ID NO: 35621

SEQ ID NO: 708882 - RNA, 64 nt, Homo Sapiens; identical to SEQ ID NO: 35622

SEQ ID NO: 708883 - RNA, 64 nt, Homo Sapiens; identical to SEQ ID NO: 35623

SEQ ID NO: 708884 - RNA, 64 nt, Homo Sapiens; identical to SEQ ID NO: 35624

SEQ ID NO: 708885 - RNA, 64 nt, Homo Sapiens; identical to SEQ ID NO: 35625

SEQ ID NO: 708886 - RNA, 64 nt, Homo Sapiens; identical to SEQ ID NO: 35626

SEQ ID NO: 708887 - RNA, 64 nt, Homo Sapiens; identical to SEQ ID NO: 35627

SEQ ID NO: 708888 - RNA, 64 nt, Homo Sapiens; identical to SEQ ID NO: 35628

SEQ ID NO: 708889 - RNA, 64 nt, Homo Sapiens; identical to SEQ ID NO: 35629

SEQ ID NO: 708890 - RNA, 64 nt, Homo Sapiens; identical to SEQ ID NO: 35630

SEQ ID NO: 708891 - RNA, 64 nt, Homo Sapiens; identical to SEQ ID NO: 35631

SEQ ID NO: 708892 - RNA, 64 nt, Homo Sapiens; identical to SEQ ID NO: 35632

SEQ ID NO: 708893 - RNA, 64 nt, Homo Sapiens; identical to SEQ ID NO: 35633

SEQ ID NO: 708894 - RNA, 64 nt, Homo Sapiens; identical to SEQ ID NO: 35634

SEQ ID NO: 708895 - RNA, 64 nt, Homo Sapiens; identical to SEQ ID NO: 35635

SEQ ID NO: 708896 - RNA, 64 nt, Homo Sapiens; identical to SEQ ID NO: 35636

SEQ ID NO: 708897 - RNA, 64 nt, Homo Sapiens; identical to SEQ ID NO: 35637

SEQ ID NO: 708898 - RNA, 64 nt, Homo Sapiens; identical to SEQ ID NO: 35638

SEQ ID NO: 708899 - RNA, 64 nt, Homo Sapiens; identical to SEQ ID NO: 35639

SEQ ID NO: 708900 - RNA, 64 nt, Homo Sapiens; identical to SEQ ID NO: 35640

SEQ ID NO: 708901 - RNA, 64 nt, Homo Sapiens; identical to SEQ ID NO: 35641

SEQ ID NO: 708902 - RNA, 64 nt, Homo Sapiens; identical to SEQ ID NO: 35642

SEQ ID NO: 708903 - RNA, 64 nt, Homo Sapiens; identical to SEQ ID NO: 35643

SEQ ID NO: 708904 - RNA, 64 nt, Homo Sapiens; identical to SEQ ID NO: 35644

SEQ ID NO: 708905 - RNA, 64 nt, Homo Sapiens; identical to SEQ ID NO: 35645

SEQ ID NO: 708906 - RNA, 64 nt, Homo Sapiens; identical to SEQ ID NO: 35646

SEQ ID NO: 708907 - RNA, 64 nt, Homo Sapiens; identical to SEQ ID NO: 35647

SEQ ID NO: 708908 - RNA, 64 nt, Homo Sapiens; identical to SEQ ID NO: 35648

SEQ ID NO: 708909 - RNA, 64 nt, Homo Sapiens; identical to SEQ ID NO: 35649

SEQ ID NO: 708910 - RNA, 64 nt, Homo Sapiens; identical to SEQ ID NO: 35650

SEQ ID NO: 708911 - RNA, 64 nt, Homo Sapiens; identical to SEQ ID NO: 35651

SEQ ID NO: 708912 - RNA, 64 nt, Homo Sapiens; identical to SEQ ID NO: 35652

SEQ ID NO: 708913 - RNA, 64 nt, Homo Sapiens; identical to SEQ ID NO: 35653

SEQ ID NO: 708914 - RNA, 64 nt, Homo Sapiens; identical to SEQ ID NO: 35654

SEQ ID NO: 708915 - RNA, 64 nt, Homo Sapiens; identical to SEQ ID NO: 35655

SEQ ID NO: 708916 - RNA, 64 nt, Homo Sapiens; identical to SEQ ID NO: 35656

SEQ ID NO: 708917 - RNA, 64 nt, Homo Sapiens; identical to SEQ ID NO: 35657

SEQ ID NO: 708918 - RNA, 64 nt, Homo Sapiens; identical to SEQ ID NO: 35658

SEQ ID NO: 708919 - RNA, 64 nt, Homo Sapiens; identical to SEQ ID NO: 35659

SEQ ID NO: 708920 - RNA, 64 nt, Homo Sapiens; identical to SEQ ID NO: 35660

SEQ ID NO: 708921 - RNA, 64 nt, Homo Sapiens; identical to SEQ ID NO: 35661

SEQ ID NO: 708922 - RNA, 64 nt, Homo Sapiens; identical to SEQ ID NO: 35662

SEQ ID NO: 708923 - RNA, 64 nt, Homo Sapiens; identical to SEQ ID NO: 35663

SEQ ID NO: 708924 - RNA, 64 nt, Homo Sapiens; identical to SEQ ID NO: 35664

SEQ ID NO: 708925 - RNA, 64 nt, Homo Sapiens; identical to SEQ ID NO: 35665

SEQ ID NO: 708926 - RNA, 64 nt, Homo Sapiens; identical to SEQ ID NO: 35666

SEQ ID NO: 708927 - RNA, 64 nt, Homo Sapiens; identical to SEQ ID NO: 35667

SEQ ID NO: 708928 - RNA, 64 nt, Homo Sapiens; identical to SEQ ID NO: 35668

SEQ ID NO: 708929 - RNA, 64 nt, Homo Sapiens; identical to SEQ ID NO: 35669

SEQ ID NO: 708930 - RNA, 64 nt, Homo Sapiens; identical to SEQ ID NO: 35670

SEQ ID NO: 708931 - RNA, 64 nt, Homo Sapiens; identical to SEQ ID NO: 35671

SEQ ID NO: 708932 - RNA, 64 nt, Homo Sapiens; identical to SEQ ID NO: 35672

SEQ ID NO: 708933 - RNA, 64 nt, Homo Sapiens; identical to SEQ ID NO: 35673

SEQ ID NO: 708934 - RNA, 64 nt, Homo Sapiens; identical to SEQ ID NO: 35674

SEQ ID NO: 708935 - RNA, 64 nt, Homo Sapiens; identical to SEQ ID NO: 35675

SEQ ID NO: 708936 - RNA, 64 nt, Homo Sapiens; identical to SEQ ID NO: 35676

SEQ ID NO: 708937 - RNA, 64 nt, Homo Sapiens; identical to SEQ ID NO: 35677

SEQ ID NO: 708938 - RNA, 64 nt, Homo Sapiens; identical to SEQ ID NO: 35678

SEQ ID NO: 708939 - RNA, 64 nt, Homo Sapiens; identical to SEQ ID NO: 35679

SEQ ID NO: 708940 - RNA, 64 nt, Homo Sapiens; identical to SEQ ID NO: 35680

SEQ ID NO: 708941 - RNA, 64 nt, Homo Sapiens; identical to SEQ ID NO: 35681

SEQ ID NO: 708942 - RNA, 64 nt, Homo Sapiens; identical to SEQ ID NO: 35682

SEQ ID NO: 708943 - RNA, 64 nt, Homo Sapiens; identical to SEQ ID NO: 35683

SEQ ID NO: 708944 - RNA, 64 nt, Homo Sapiens; identical to SEQ ID NO: 35684

SEQ ID NO: 708945 - RNA, 64 nt, Homo Sapiens; identical to SEQ ID NO: 35685

SEQ ID NO: 708946 - RNA, 64 nt, Homo Sapiens; identical to SEQ ID NO: 35686

SEQ ID NO: 708947 - RNA, 64 nt, Homo Sapiens; identical to SEQ ID NO: 35687

SEQ ID NO: 708948 - RNA, 64 nt, Homo Sapiens; identical to SEQ ID NO: 35688

SEQ ID NO: 708949 - RNA, 64 nt, Homo Sapiens; identical to SEQ ID NO: 35689

SEQ ID NO: 708950 - RNA, 64 nt, Homo Sapiens; identical to SEQ ID NO: 35690

SEQ ID NO: 708951 - RNA, 64 nt, Homo Sapiens; identical to SEQ ID NO: 35691

SEQ ID NO: 708952 - RNA, 64 nt, Homo Sapiens; identical to SEQ ID NO: 35692

SEQ ID NO: 708953 - RNA, 64 nt, Homo Sapiens; identical to SEQ ID NO: 35693

SEQ ID NO: 708954 - RNA, 64 nt, Homo Sapiens; identical to SEQ ID NO: 35694

SEQ ID NO: 708955 - RNA, 64 nt, Homo Sapiens; identical to SEQ ID NO: 35695

SEQ ID NO: 708956 - RNA, 64 nt, Homo Sapiens; identical to SEQ ID NO: 35696

SEQ ID NO: 708957 - RNA, 64 nt, Homo Sapiens; identical to SEQ ID NO: 35697

SEQ ID NO: 708958 - RNA, 64 nt, Homo Sapiens; identical to SEQ ID NO: 35698

SEQ ID NO: 708959 - RNA, 64 nt, Homo Sapiens; identical to SEQ ID NO: 35699

SEQ ID NO: 708960 - RNA, 64 nt, Homo Sapiens; identical to SEQ ID NO: 35700

SEQ ID NO: 708961 - RNA, 64 nt, Homo Sapiens; identical to SEQ ID NO: 35701

SEQ ID NO: 708962 - RNA, 64 nt, Homo Sapiens; identical to SEQ ID NO: 35702

SEQ ID NO: 708963 - RNA, 64 nt, Homo Sapiens; identical to SEQ ID NO: 35703

SEQ ID NO: 708964 - RNA, 64 nt, Homo Sapiens; identical to SEQ ID NO: 35704

SEQ ID NO: 708965 - RNA, 64 nt, Homo Sapiens; identical to SEQ ID NO: 35705

SEQ ID NO: 708966 - RNA, 64 nt, Homo Sapiens; identical to SEQ ID NO: 35706

SEQ ID NO: 708967 - RNA, 64 nt, Homo Sapiens; identical to SEQ ID NO: 35707

SEQ ID NO: 708968 - RNA, 64 nt, Homo Sapiens; identical to SEQ ID NO: 35708

SEQ ID NO: 708969 - RNA, 64 nt, Homo Sapiens; identical to SEQ ID NO: 35709

SEQ ID NO: 708970 - RNA, 64 nt, Homo Sapiens; identical to SEQ ID NO: 35710

SEQ ID NO: 708971 - RNA, 64 nt, Homo Sapiens; identical to SEQ ID NO: 35711

SEQ ID NO: 708972 - RNA, 64 nt, Homo Sapiens; identical to SEQ ID NO: 35712

SEQ ID NO: 708973 - RNA, 64 nt, Homo Sapiens; identical to SEQ ID NO: 35713

SEQ ID NO: 708974 - RNA, 64 nt, Homo Sapiens; identical to SEQ ID NO: 35714

SEQ ID NO: 708975 - RNA, 64 nt, Homo Sapiens; identical to SEQ ID NO: 35715

SEQ ID NO: 708976 - RNA, 64 nt, Homo Sapiens; identical to SEQ ID NO: 35716

SEQ ID NO: 708977 - RNA, 64 nt, Homo Sapiens; identical to SEQ ID NO: 35717

SEQ ID NO: 708978 - RNA, 64 nt, Homo Sapiens; identical to SEQ ID NO: 35718

SEQ ID NO: 708979 - RNA, 64 nt, Homo Sapiens; identical to SEQ ID NO: 35719

SEQ ID NO: 708980 - RNA, 64 nt, Homo Sapiens; identical to SEQ ID NO: 35720

SEQ ID NO: 708981 - RNA, 64 nt, Homo Sapiens; identical to SEQ ID NO: 35721

SEQ ID NO: 708982 - RNA, 64 nt, Homo Sapiens; identical to SEQ ID NO: 35722

SEQ ID NO: 708983 - RNA, 64 nt, Homo Sapiens; identical to SEQ ID NO: 35723

SEQ ID NO: 708984 - RNA, 64 nt, Homo Sapiens; identical to SEQ ID NO: 35724

SEQ ID NO: 708985 - RNA, 64 nt, Homo Sapiens; identical to SEQ ID NO: 35725

SEQ ID NO: 708986 - RNA, 64 nt, Homo Sapiens; identical to SEQ ID NO: 35726

SEQ ID NO: 708987 - RNA, 64 nt, Homo Sapiens; identical to SEQ ID NO: 35727

SEQ ID NO: 708988 - RNA, 64 nt, Homo Sapiens; identical to SEQ ID NO: 35728

SEQ ID NO: 708989 - RNA, 64 nt, Homo Sapiens; identical to SEQ ID NO: 35729

SEQ ID NO: 708990 - RNA, 64 nt, Homo Sapiens; identical to SEQ ID NO: 35730

SEQ ID NO: 708991 - RNA, 64 nt, Homo Sapiens; identical to SEQ ID NO: 35731

SEQ ID NO: 708992 - RNA, 64 nt, Homo Sapiens; identical to SEQ ID NO: 35732

SEQ ID NO: 708993 - RNA, 64 nt, Homo Sapiens; identical to SEQ ID NO: 35733

SEQ ID NO: 708994 - RNA, 64 nt, Homo Sapiens; identical to SEQ ID NO: 35734

SEQ ID NO: 708995 - RNA, 64 nt, Homo Sapiens; identical to SEQ ID NO: 35735

SEQ ID NO: 708996 - RNA, 64 nt, Homo Sapiens; identical to SEQ ID NO: 35736

SEQ ID NO: 708997 - RNA, 64 nt, Homo Sapiens; identical to SEQ ID NO: 35737

SEQ ID NO: 708998 - RNA, 64 nt, Homo Sapiens; identical to SEQ ID NO: 35738

SEQ ID NO: 708999 - RNA, 64 nt, Homo Sapiens; identical to SEQ ID NO: 35739

SEQ ID NO: 709000 - RNA, 64 nt, Homo Sapiens; identical to SEQ ID NO: 35740

SEQ ID NO: 709001 - RNA, 64 nt, Homo Sapiens; identical to SEQ ID NO: 35741

SEQ ID NO: 709002 - RNA, 64 nt, Homo Sapiens; identical to SEQ ID NO: 35742

SEQ ID NO: 709003 - RNA, 64 nt, Homo Sapiens; identical to SEQ ID NO: 35743

SEQ ID NO: 709004 - RNA, 64 nt, Homo Sapiens; identical to SEQ ID NO: 35744

SEQ ID NO: 709005 - RNA, 64 nt, Homo Sapiens; identical to SEQ ID NO: 35745

SEQ ID NO: 709006 - RNA, 64 nt, Homo Sapiens; identical to SEQ ID NO: 35746

SEQ ID NO: 709007 - RNA, 64 nt, Homo Sapiens; identical to SEQ ID NO: 35747

SEQ ID NO: 709008 - RNA, 64 nt, Homo Sapiens; identical to SEQ ID NO: 35748

SEQ ID NO: 709009 - RNA, 64 nt, Homo Sapiens; identical to SEQ ID NO: 35749

SEQ ID NO: 709010 - RNA, 64 nt, Homo Sapiens; identical to SEQ ID NO: 35750

SEQ ID NO: 709011 - RNA, 64 nt, Homo Sapiens; identical to SEQ ID NO: 35751

SEQ ID NO: 709012 - RNA, 64 nt, Homo Sapiens; identical to SEQ ID NO: 35752

SEQ ID NO: 709013 - RNA, 64 nt, Homo Sapiens; identical to SEQ ID NO: 35753

SEQ ID NO: 709014 - RNA, 64 nt, Homo Sapiens; identical to SEQ ID NO: 35754

SEQ ID NO: 709015 - RNA, 64 nt, Homo Sapiens; identical to SEQ ID NO: 35755

SEQ ID NO: 709016 - RNA, 64 nt, Homo Sapiens; identical to SEQ ID NO: 35756

SEQ ID NO: 709017 - RNA, 64 nt, Homo Sapiens; identical to SEQ ID NO: 35757

SEQ ID NO: 709018 - RNA, 64 nt, Homo Sapiens; identical to SEQ ID NO: 35758

SEQ ID NO: 709019 - RNA, 64 nt, Homo Sapiens; identical to SEQ ID NO: 35759

SEQ ID NO: 709020 - RNA, 64 nt, Homo Sapiens; identical to SEQ ID NO: 35760

SEQ ID NO: 709021 - RNA, 64 nt, Homo Sapiens; identical to SEQ ID NO: 35761

SEQ ID NO: 709022 - RNA, 64 nt, Homo Sapiens; identical to SEQ ID NO: 35762

SEQ ID NO: 709023 - RNA, 64 nt, Homo Sapiens; identical to SEQ ID NO: 35763

SEQ ID NO: 709024 - RNA, 64 nt, Homo Sapiens; identical to SEQ ID NO: 35764

SEQ ID NO: 709025 - RNA, 64 nt, Homo Sapiens; identical to SEQ ID NO: 35765

SEQ ID NO: 709026 - RNA, 64 nt, Homo Sapiens; identical to SEQ ID NO: 35766

SEQ ID NO: 709027 - RNA, 64 nt, Homo Sapiens; identical to SEQ ID NO: 35767

SEQ ID NO: 709028 - RNA, 64 nt, Homo Sapiens; identical to SEQ ID NO: 35768

SEQ ID NO: 709029 - RNA, 64 nt, Homo Sapiens; identical to SEQ ID NO: 35769

SEQ ID NO: 709030 - RNA, 64 nt, Homo Sapiens; identical to SEQ ID NO: 35770

SEQ ID NO: 709031 - RNA, 64 nt, Homo Sapiens; identical to SEQ ID NO: 35771

SEQ ID NO: 709032 - RNA, 64 nt, Homo Sapiens; identical to SEQ ID NO: 35772

SEQ ID NO: 709033 - RNA, 64 nt, Homo Sapiens; identical to SEQ ID NO: 35773

SEQ ID NO: 709034 - RNA, 64 nt, Homo Sapiens; identical to SEQ ID NO: 35774

SEQ ID NO: 709035 - RNA, 64 nt, Homo Sapiens; identical to SEQ ID NO: 35775

SEQ ID NO: 709036 - RNA, 64 nt, Homo Sapiens; identical to SEQ ID NO: 35776

SEQ ID NO: 709037 - RNA, 64 nt, Homo Sapiens; identical to SEQ ID NO: 35777

SEQ ID NO: 709038 - RNA, 64 nt, Homo Sapiens; identical to SEQ ID NO: 35778

SEQ ID NO: 709039 - RNA, 64 nt, Homo Sapiens; identical to SEQ ID NO: 35779

SEQ ID NO: 709040 - RNA, 64 nt, Homo Sapiens; identical to SEQ ID NO: 35780

SEQ ID NO: 709041 - RNA, 64 nt, Homo Sapiens; identical to SEQ ID NO: 35781

SEQ ID NO: 709042 - RNA, 64 nt, Homo Sapiens; identical to SEQ ID NO: 35782

SEQ ID NO: 709043 - RNA, 64 nt, Homo Sapiens; identical to SEQ ID NO: 35783

SEQ ID NO: 709044 - RNA, 64 nt, Homo Sapiens; identical to SEQ ID NO: 35784

SEQ ID NO: 709045 - RNA, 64 nt, Homo Sapiens; identical to SEQ ID NO: 35785

SEQ ID NO: 709046 - RNA, 64 nt, Homo Sapiens; identical to SEQ ID NO: 35786

SEQ ID NO: 709047 - RNA, 64 nt, Homo Sapiens; identical to SEQ ID NO: 35787

SEQ ID NO: 709048 - RNA, 64 nt, Homo Sapiens; identical to SEQ ID NO: 35788

SEQ ID NO: 709049 - RNA, 64 nt, Homo Sapiens; identical to SEQ ID NO: 35789

SEQ ID NO: 709050 - RNA, 64 nt, Homo Sapiens; identical to SEQ ID NO: 35790

SEQ ID NO: 709051 - RNA, 64 nt, Homo Sapiens; identical to SEQ ID NO: 35791

SEQ ID NO: 709052 - RNA, 64 nt, Homo Sapiens; identical to SEQ ID NO: 35792

SEQ ID NO: 709053 - RNA, 64 nt, Homo Sapiens; identical to SEQ ID NO: 35793

SEQ ID NO: 709054 - RNA, 64 nt, Homo Sapiens; identical to SEQ ID NO: 35794

SEQ ID NO: 709055 - RNA, 64 nt, Homo Sapiens; identical to SEQ ID NO: 35795

SEQ ID NO: 709056 - RNA, 64 nt, Homo Sapiens; identical to SEQ ID NO: 35796

SEQ ID NO: 709057 - RNA, 64 nt, Homo Sapiens; identical to SEQ ID NO: 35797

SEQ ID NO: 709058 - RNA, 64 nt, Homo Sapiens; identical to SEQ ID NO: 35798

SEQ ID NO: 709059 - RNA, 64 nt, Homo Sapiens; identical to SEQ ID NO: 35799

SEQ ID NO: 709060 - RNA, 64 nt, Homo Sapiens; identical to SEQ ID NO: 35800

SEQ ID NO: 709061 - RNA, 64 nt, Homo Sapiens; identical to SEQ ID NO: 35801

SEQ ID NO: 709062 - RNA, 64 nt, Homo Sapiens; identical to SEQ ID NO: 35802

SEQ ID NO: 709063 - RNA, 64 nt, Homo Sapiens; identical to SEQ ID NO: 35803

SEQ ID NO: 709064 - RNA, 64 nt, Homo Sapiens; identical to SEQ ID NO: 35804

SEQ ID NO: 709065 - RNA, 64 nt, Homo Sapiens; identical to SEQ ID NO: 35805

SEQ ID NO: 709066 - RNA, 64 nt, Homo Sapiens; identical to SEQ ID NO: 35806

SEQ ID NO: 709067 - RNA, 64 nt, Homo Sapiens; identical to SEQ ID NO: 35807

SEQ ID NO: 709068 - RNA, 64 nt, Homo Sapiens; identical to SEQ ID NO: 35808

SEQ ID NO: 709069 - RNA, 64 nt, Homo Sapiens; identical to SEQ ID NO: 35809

SEQ ID NO: 709070 - RNA, 64 nt, Homo Sapiens; identical to SEQ ID NO: 35810

SEQ ID NO: 709071 - RNA, 64 nt, Homo Sapiens; identical to SEQ ID NO: 35811

SEQ ID NO: 709072 - RNA, 64 nt, Homo Sapiens; identical to SEQ ID NO: 35812

SEQ ID NO: 709073 - RNA, 64 nt, Homo Sapiens; identical to SEQ ID NO: 35813

SEQ ID NO: 709074 - RNA, 64 nt, Homo Sapiens; identical to SEQ ID NO: 35814

SEQ ID NO: 709075 - RNA, 64 nt, Homo Sapiens; identical to SEQ ID NO: 35815

SEQ ID NO: 709076 - RNA, 64 nt, Homo Sapiens; identical to SEQ ID NO: 35816

SEQ ID NO: 709077 - RNA, 64 nt, Homo Sapiens; identical to SEQ ID NO: 35817

SEQ ID NO: 709078 - RNA, 64 nt, Homo Sapiens; identical to SEQ ID NO: 35818

SEQ ID NO: 709079 - RNA, 64 nt, Homo Sapiens; identical to SEQ ID NO: 35819

SEQ ID NO: 709080 - RNA, 64 nt, Homo Sapiens; identical to SEQ ID NO: 35820

SEQ ID NO: 709081 - RNA, 64 nt, Homo Sapiens; identical to SEQ ID NO: 35821

SEQ ID NO: 709082 - RNA, 64 nt, Homo Sapiens; identical to SEQ ID NO: 35822

SEQ ID NO: 709083 - RNA, 64 nt, Homo Sapiens; identical to SEQ ID NO: 35823

SEQ ID NO: 709084 - RNA, 64 nt, Homo Sapiens; identical to SEQ ID NO: 35824

SEQ ID NO: 709085 - RNA, 64 nt, Homo Sapiens; identical to SEQ ID NO: 35825

SEQ ID NO: 709086 - RNA, 64 nt, Homo Sapiens; identical to SEQ ID NO: 35826

SEQ ID NO: 709087 - RNA, 64 nt, Homo Sapiens; identical to SEQ ID NO: 35827

SEQ ID NO: 709088 - RNA, 64 nt, Homo Sapiens; identical to SEQ ID NO: 35828

SEQ ID NO: 709089 - RNA, 64 nt, Homo Sapiens; identical to SEQ ID NO: 35829

SEQ ID NO: 709090 - RNA, 64 nt, Homo Sapiens; identical to SEQ ID NO: 35830

SEQ ID NO: 709091 - RNA, 64 nt, Homo Sapiens; identical to SEQ ID NO: 35831

SEQ ID NO: 709092 - RNA, 64 nt, Homo Sapiens; identical to SEQ ID NO: 35832

SEQ ID NO: 709093 - RNA, 64 nt, Homo Sapiens; identical to SEQ ID NO: 35833

SEQ ID NO: 709094 - RNA, 64 nt, Homo Sapiens; identical to SEQ ID NO: 35834

SEQ ID NO: 709095 - RNA, 64 nt, Homo Sapiens; identical to SEQ ID NO: 35835

SEQ ID NO: 709096 - RNA, 64 nt, Homo Sapiens; identical to SEQ ID NO: 35836

SEQ ID NO: 709097 - RNA, 64 nt, Homo Sapiens; identical to SEQ ID NO: 35837

SEQ ID NO: 709098 - RNA, 64 nt, Homo Sapiens; identical to SEQ ID NO: 35838

SEQ ID NO: 709099 - RNA, 64 nt, Homo Sapiens; identical to SEQ ID NO: 35839

SEQ ID NO: 709100 - RNA, 64 nt, Homo Sapiens; identical to SEQ ID NO: 35840

SEQ ID NO: 709101 - RNA, 64 nt, Homo Sapiens; identical to SEQ ID NO: 35841

SEQ ID NO: 709102 - RNA, 64 nt, Homo Sapiens; identical to SEQ ID NO: 35842

SEQ ID NO: 709103 - RNA, 64 nt, Homo Sapiens; identical to SEQ ID NO: 35843

SEQ ID NO: 709104 - RNA, 64 nt, Homo Sapiens; identical to SEQ ID NO: 35844

SEQ ID NO: 709105 - RNA, 64 nt, Homo Sapiens; identical to SEQ ID NO: 35845

SEQ ID NO: 709106 - RNA, 64 nt, Homo Sapiens; identical to SEQ ID NO: 35846

SEQ ID NO: 709107 - RNA, 64 nt, Homo Sapiens; identical to SEQ ID NO: 35847

SEQ ID NO: 709108 - RNA, 64 nt, Homo Sapiens; identical to SEQ ID NO: 35848

SEQ ID NO: 709109 - RNA, 64 nt, Homo Sapiens; identical to SEQ ID NO: 35849

SEQ ID NO: 709110 - RNA, 64 nt, Homo Sapiens; identical to SEQ ID NO: 35850

SEQ ID NO: 709111 - RNA, 64 nt, Homo Sapiens; identical to SEQ ID NO: 35851

SEQ ID NO: 709112 - RNA, 64 nt, Homo Sapiens; identical to SEQ ID NO: 35852

SEQ ID NO: 709113 - RNA, 64 nt, Homo Sapiens; identical to SEQ ID NO: 35853

SEQ ID NO: 709114 - RNA, 64 nt, Homo Sapiens; identical to SEQ ID NO: 35854

SEQ ID NO: 709115 - RNA, 64 nt, Homo Sapiens; identical to SEQ ID NO: 35855

SEQ ID NO: 709116 - RNA, 64 nt, Homo Sapiens; identical to SEQ ID NO: 35856

SEQ ID NO: 709117 - RNA, 64 nt, Homo Sapiens; identical to SEQ ID NO: 35857

SEQ ID NO: 709118 - RNA, 64 nt, Homo Sapiens; identical to SEQ ID NO: 35858

SEQ ID NO: 709119 - RNA, 64 nt, Homo Sapiens; identical to SEQ ID NO: 35859

SEQ ID NO: 709120 - RNA, 64 nt, Homo Sapiens; identical to SEQ ID NO: 35860

SEQ ID NO: 709121 - RNA, 64 nt, Homo Sapiens; identical to SEQ ID NO: 35861

SEQ ID NO: 709122 - RNA, 64 nt, Homo Sapiens; identical to SEQ ID NO: 35862

SEQ ID NO: 709123 - RNA, 64 nt, Homo Sapiens; identical to SEQ ID NO: 35863

SEQ ID NO: 709124 - RNA, 64 nt, Homo Sapiens; identical to SEQ ID NO: 35864

SEQ ID NO: 709125 - RNA, 64 nt, Homo Sapiens; identical to SEQ ID NO: 35865

SEQ ID NO: 709126 - RNA, 64 nt, Homo Sapiens; identical to SEQ ID NO: 35866

SEQ ID NO: 709127 - RNA, 64 nt, Homo Sapiens; identical to SEQ ID NO: 35867

SEQ ID NO: 709128 - RNA, 64 nt, Homo Sapiens; identical to SEQ ID NO: 35868

SEQ ID NO: 709129 - RNA, 64 nt, Homo Sapiens; identical to SEQ ID NO: 35869

SEQ ID NO: 709130 - RNA, 64 nt, Homo Sapiens; identical to SEQ ID NO: 35870

SEQ ID NO: 709131 - RNA, 64 nt, Homo Sapiens; identical to SEQ ID NO: 35871

SEQ ID NO: 709132 - RNA, 64 nt, Homo Sapiens; identical to SEQ ID NO: 35872

SEQ ID NO: 709133 - RNA, 64 nt, Homo Sapiens; identical to SEQ ID NO: 35873

SEQ ID NO: 709134 - RNA, 64 nt, Homo Sapiens; identical to SEQ ID NO: 35874

SEQ ID NO: 709135 - RNA, 64 nt, Homo Sapiens; identical to SEQ ID NO: 35875

SEQ ID NO: 709136 - RNA, 64 nt, Homo Sapiens; identical to SEQ ID NO: 35876

SEQ ID NO: 709137 - RNA, 64 nt, Homo Sapiens; identical to SEQ ID NO: 35877

SEQ ID NO: 709138 - RNA, 64 nt, Homo Sapiens; identical to SEQ ID NO: 35878

SEQ ID NO: 709139 - RNA, 64 nt, Homo Sapiens; identical to SEQ ID NO: 35879

SEQ ID NO: 709140 - RNA, 64 nt, Homo Sapiens; identical to SEQ ID NO: 35880

SEQ ID NO: 709141 - RNA, 64 nt, Homo Sapiens; identical to SEQ ID NO: 35881

SEQ ID NO: 709142 - RNA, 64 nt, Homo Sapiens; identical to SEQ ID NO: 35882

SEQ ID NO: 709143 - RNA, 64 nt, Homo Sapiens; identical to SEQ ID NO: 35883

SEQ ID NO: 709144 - RNA, 64 nt, Homo Sapiens; identical to SEQ ID NO: 35884

SEQ ID NO: 709145 - RNA, 64 nt, Homo Sapiens; identical to SEQ ID NO: 35885

SEQ ID NO: 709146 - RNA, 64 nt, Homo Sapiens; identical to SEQ ID NO: 35886

SEQ ID NO: 709147 - RNA, 64 nt, Homo Sapiens; identical to SEQ ID NO: 35887

SEQ ID NO: 709148 - RNA, 64 nt, Homo Sapiens; identical to SEQ ID NO: 35888

SEQ ID NO: 709149 - RNA, 64 nt, Homo Sapiens; identical to SEQ ID NO: 35889

SEQ ID NO: 709150 - RNA, 64 nt, Homo Sapiens; identical to SEQ ID NO: 35890

SEQ ID NO: 709151 - RNA, 64 nt, Homo Sapiens; identical to SEQ ID NO: 35891

SEQ ID NO: 709152 - RNA, 64 nt, Homo Sapiens; identical to SEQ ID NO: 35892

SEQ ID NO: 709153 - RNA, 64 nt, Homo Sapiens; identical to SEQ ID NO: 35893

SEQ ID NO: 709154 - RNA, 64 nt, Homo Sapiens; identical to SEQ ID NO: 35894

SEQ ID NO: 709155 - RNA, 64 nt, Homo Sapiens; identical to SEQ ID NO: 35895

SEQ ID NO: 709156 - RNA, 64 nt, Homo Sapiens; identical to SEQ ID NO: 35896

SEQ ID NO: 709157 - RNA, 64 nt, Homo Sapiens; identical to SEQ ID NO: 35897

SEQ ID NO: 709158 - RNA, 64 nt, Homo Sapiens; identical to SEQ ID NO: 35898

SEQ ID NO: 709159 - RNA, 64 nt, Homo Sapiens; identical to SEQ ID NO: 35899

SEQ ID NO: 709160 - RNA, 64 nt, Homo Sapiens; identical to SEQ ID NO: 35900

SEQ ID NO: 709161 - RNA, 64 nt, Homo Sapiens; identical to SEQ ID NO: 35901

SEQ ID NO: 709162 - RNA, 64 nt, Homo Sapiens; identical to SEQ ID NO: 35902

SEQ ID NO: 709163 - RNA, 64 nt, Homo Sapiens; identical to SEQ ID NO: 35903

SEQ ID NO: 709164 - RNA, 64 nt, Homo Sapiens; identical to SEQ ID NO: 35904

SEQ ID NO: 709165 - RNA, 64 nt, Homo Sapiens; identical to SEQ ID NO: 35905

SEQ ID NO: 709166 - RNA, 64 nt, Homo Sapiens; identical to SEQ ID NO: 35906

SEQ ID NO: 709167 - RNA, 64 nt, Homo Sapiens; identical to SEQ ID NO: 35907

SEQ ID NO: 709168 - RNA, 64 nt, Homo Sapiens; identical to SEQ ID NO: 35908

SEQ ID NO: 709169 - RNA, 64 nt, Homo Sapiens; identical to SEQ ID NO: 35909

SEQ ID NO: 709170 - RNA, 64 nt, Homo Sapiens; identical to SEQ ID NO: 35910

SEQ ID NO: 709171 - RNA, 64 nt, Homo Sapiens; identical to SEQ ID NO: 35911

SEQ ID NO: 709172 - RNA, 64 nt, Homo Sapiens; identical to SEQ ID NO: 35912

SEQ ID NO: 709173 - RNA, 64 nt, Homo Sapiens; identical to SEQ ID NO: 35913

SEQ ID NO: 709174 - RNA, 64 nt, Homo Sapiens; identical to SEQ ID NO: 35914

SEQ ID NO: 709175 - RNA, 64 nt, Homo Sapiens; identical to SEQ ID NO: 35915

SEQ ID NO: 709176 - RNA, 64 nt, Homo Sapiens; identical to SEQ ID NO: 35916

SEQ ID NO: 709177 - RNA, 64 nt, Homo Sapiens; identical to SEQ ID NO: 35917

SEQ ID NO: 709178 - RNA, 64 nt, Homo Sapiens; identical to SEQ ID NO: 35918

SEQ ID NO: 709179 - RNA, 64 nt, Homo Sapiens; identical to SEQ ID NO: 35919

SEQ ID NO: 709180 - RNA, 64 nt, Homo Sapiens; identical to SEQ ID NO: 35920

SEQ ID NO: 709181 - RNA, 64 nt, Homo Sapiens; identical to SEQ ID NO: 35921

SEQ ID NO: 709182 - RNA, 64 nt, Homo Sapiens; identical to SEQ ID NO: 35922

SEQ ID NO: 709183 - RNA, 64 nt, Homo Sapiens; identical to SEQ ID NO: 35923

SEQ ID NO: 709184 - RNA, 64 nt, Homo Sapiens; identical to SEQ ID NO: 35924

SEQ ID NO: 709185 - RNA, 64 nt, Homo Sapiens; identical to SEQ ID NO: 35925

SEQ ID NO: 709186 - RNA, 64 nt, Homo Sapiens; identical to SEQ ID NO: 35926

SEQ ID NO: 709187 - RNA, 64 nt, Homo Sapiens; identical to SEQ ID NO: 35927

SEQ ID NO: 709188 - RNA, 64 nt, Homo Sapiens; identical to SEQ ID NO: 35928

SEQ ID NO: 709189 - RNA, 64 nt, Homo Sapiens; identical to SEQ ID NO: 35929

SEQ ID NO: 709190 - RNA, 64 nt, Homo Sapiens; identical to SEQ ID NO: 35930

SEQ ID NO: 709191 - RNA, 64 nt, Homo Sapiens; identical to SEQ ID NO: 35931

SEQ ID NO: 709192 - RNA, 64 nt, Homo Sapiens; identical to SEQ ID NO: 35932

SEQ ID NO: 709193 - RNA, 64 nt, Homo Sapiens; identical to SEQ ID NO: 35933

SEQ ID NO: 709194 - RNA, 64 nt, Homo Sapiens; identical to SEQ ID NO: 35934

SEQ ID NO: 709195 - RNA, 64 nt, Homo Sapiens; identical to SEQ ID NO: 35935

SEQ ID NO: 709196 - RNA, 64 nt, Homo Sapiens; identical to SEQ ID NO: 35936

SEQ ID NO: 709197 - RNA, 64 nt, Homo Sapiens; identical to SEQ ID NO: 35937

SEQ ID NO: 709198 - RNA, 64 nt, Homo Sapiens; identical to SEQ ID NO: 35938

SEQ ID NO: 709199 - RNA, 64 nt, Homo Sapiens; identical to SEQ ID NO: 35939

SEQ ID NO: 709200 - RNA, 64 nt, Homo Sapiens; identical to SEQ ID NO: 35940

SEQ ID NO: 709201 - RNA, 64 nt, Homo Sapiens; identical to SEQ ID NO: 35941

SEQ ID NO: 709202 - RNA, 64 nt, Homo Sapiens; identical to SEQ ID NO: 35942

SEQ ID NO: 709203 - RNA, 64 nt, Homo Sapiens; identical to SEQ ID NO: 35943

SEQ ID NO: 709204 - RNA, 64 nt, Homo Sapiens; identical to SEQ ID NO: 35944

SEQ ID NO: 709205 - RNA, 64 nt, Homo Sapiens; identical to SEQ ID NO: 35945

SEQ ID NO: 709206 - RNA, 64 nt, Homo Sapiens; identical to SEQ ID NO: 35946

SEQ ID NO: 709207 - RNA, 64 nt, Homo Sapiens; identical to SEQ ID NO: 35947

SEQ ID NO: 709208 - RNA, 64 nt, Homo Sapiens; identical to SEQ ID NO: 35948

SEQ ID NO: 709209 - RNA, 64 nt, Homo Sapiens; identical to SEQ ID NO: 35949

SEQ ID NO: 709210 - RNA, 64 nt, Homo Sapiens; identical to SEQ ID NO: 35950

SEQ ID NO: 709211 - RNA, 64 nt, Homo Sapiens; identical to SEQ ID NO: 35951

SEQ ID NO: 709212 - RNA, 64 nt, Homo Sapiens; identical to SEQ ID NO: 35952

SEQ ID NO: 709213 - RNA, 64 nt, Homo Sapiens; identical to SEQ ID NO: 35953

SEQ ID NO: 709214 - RNA, 64 nt, Homo Sapiens; identical to SEQ ID NO: 35954

SEQ ID NO: 709215 - RNA, 64 nt, Homo Sapiens; identical to SEQ ID NO: 35955

SEQ ID NO: 709216 - RNA, 64 nt, Homo Sapiens; identical to SEQ ID NO: 35956

SEQ ID NO: 709217 - RNA, 64 nt, Homo Sapiens; identical to SEQ ID NO: 35957

SEQ ID NO: 709218 - RNA, 64 nt, Homo Sapiens; identical to SEQ ID NO: 35958

SEQ ID NO: 709219 - RNA, 64 nt, Homo Sapiens; identical to SEQ ID NO: 35959

SEQ ID NO: 709220 - RNA, 64 nt, Homo Sapiens; identical to SEQ ID NO: 35960

SEQ ID NO: 709221 - RNA, 64 nt, Homo Sapiens; identical to SEQ ID NO: 35961

SEQ ID NO: 709222 - RNA, 64 nt, Homo Sapiens; identical to SEQ ID NO: 35962

SEQ ID NO: 709223 - RNA, 64 nt, Homo Sapiens; identical to SEQ ID NO: 35963

SEQ ID NO: 709224 - RNA, 64 nt, Homo Sapiens; identical to SEQ ID NO: 35964

SEQ ID NO: 709225 - RNA, 64 nt, Homo Sapiens; identical to SEQ ID NO: 35965

SEQ ID NO: 709226 - RNA, 64 nt, Homo Sapiens; identical to SEQ ID NO: 35966

SEQ ID NO: 709227 - RNA, 64 nt, Homo Sapiens; identical to SEQ ID NO: 35967

SEQ ID NO: 709228 - RNA, 64 nt, Homo Sapiens; identical to SEQ ID NO: 35968

SEQ ID NO: 709229 - RNA, 64 nt, Homo Sapiens; identical to SEQ ID NO: 35969

SEQ ID NO: 709230 - RNA, 64 nt, Homo Sapiens; identical to SEQ ID NO: 35970

SEQ ID NO: 709231 - RNA, 64 nt, Homo Sapiens; identical to SEQ ID NO: 35971

SEQ ID NO: 709232 - RNA, 64 nt, Homo Sapiens; identical to SEQ ID NO: 35972

SEQ ID NO: 709233 - RNA, 64 nt, Homo Sapiens; identical to SEQ ID NO: 35973

SEQ ID NO: 709234 - RNA, 64 nt, Homo Sapiens; identical to SEQ ID NO: 35974

SEQ ID NO: 709235 - RNA, 64 nt, Homo Sapiens; identical to SEQ ID NO: 35975

SEQ ID NO: 709236 - RNA, 64 nt, Homo Sapiens; identical to SEQ ID NO: 35976

SEQ ID NO: 709237 - RNA, 64 nt, Homo Sapiens; identical to SEQ ID NO: 35977

SEQ ID NO: 709238 - RNA, 64 nt, Homo Sapiens; identical to SEQ ID NO: 35978

SEQ ID NO: 709239 - RNA, 64 nt, Homo Sapiens; identical to SEQ ID NO: 35979

SEQ ID NO: 709240 - RNA, 64 nt, Homo Sapiens; identical to SEQ ID NO: 35980

SEQ ID NO: 709241 - RNA, 64 nt, Homo Sapiens; identical to SEQ ID NO: 35981

SEQ ID NO: 709242 - RNA, 64 nt, Homo Sapiens; identical to SEQ ID NO: 35982

SEQ ID NO: 709243 - RNA, 64 nt, Homo Sapiens; identical to SEQ ID NO: 35983

SEQ ID NO: 709244 - RNA, 64 nt, Homo Sapiens; identical to SEQ ID NO: 35984

SEQ ID NO: 709245 - RNA, 64 nt, Homo Sapiens; identical to SEQ ID NO: 35985

SEQ ID NO: 709246 - RNA, 64 nt, Homo Sapiens; identical to SEQ ID NO: 35986

SEQ ID NO: 709247 - RNA, 64 nt, Homo Sapiens; identical to SEQ ID NO: 35987

SEQ ID NO: 709248 - RNA, 64 nt, Homo Sapiens; identical to SEQ ID NO: 35988

SEQ ID NO: 709249 - RNA, 64 nt, Homo Sapiens; identical to SEQ ID NO: 35989

SEQ ID NO: 709250 - RNA, 64 nt, Homo Sapiens; identical to SEQ ID NO: 35990

SEQ ID NO: 709251 - RNA, 64 nt, Homo Sapiens; identical to SEQ ID NO: 35991

SEQ ID NO: 709252 - RNA, 64 nt, Homo Sapiens; identical to SEQ ID NO: 35992

SEQ ID NO: 709253 - RNA, 64 nt, Homo Sapiens; identical to SEQ ID NO: 35993

SEQ ID NO: 709254 - RNA, 64 nt, Homo Sapiens; identical to SEQ ID NO: 35994

SEQ ID NO: 709255 - RNA, 64 nt, Homo Sapiens; identical to SEQ ID NO: 35995

SEQ ID NO: 709256 - RNA, 64 nt, Homo Sapiens; identical to SEQ ID NO: 35996

SEQ ID NO: 709257 - RNA, 64 nt, Homo Sapiens; identical to SEQ ID NO: 35997

SEQ ID NO: 709258 - RNA, 64 nt, Homo Sapiens; identical to SEQ ID NO: 35998

SEQ ID NO: 709259 - RNA, 64 nt, Homo Sapiens; identical to SEQ ID NO: 35999

SEQ ID NO: 709260 - RNA, 64 nt, Homo Sapiens; identical to SEQ ID NO: 36000

SEQ ID NO: 709261 - RNA, 64 nt, Homo Sapiens; identical to SEQ ID NO: 36001

SEQ ID NO: 709262 - RNA, 64 nt, Homo Sapiens; identical to SEQ ID NO: 36002

SEQ ID NO: 709263 - RNA, 64 nt, Homo Sapiens; identical to SEQ ID NO: 36003

SEQ ID NO: 709264 - RNA, 64 nt, Homo Sapiens; identical to SEQ ID NO: 36004

SEQ ID NO: 709265 - RNA, 64 nt, Homo Sapiens; identical to SEQ ID NO: 36005

SEQ ID NO: 709266 - RNA, 64 nt, Homo Sapiens; identical to SEQ ID NO: 36006

SEQ ID NO: 709267 - RNA, 64 nt, Homo Sapiens; identical to SEQ ID NO: 36007

SEQ ID NO: 709268 - RNA, 64 nt, Homo Sapiens; identical to SEQ ID NO: 36008

SEQ ID NO: 709269 - RNA, 64 nt, Homo Sapiens; identical to SEQ ID NO: 36009

SEQ ID NO: 709270 - RNA, 64 nt, Homo Sapiens; identical to SEQ ID NO: 36010

SEQ ID NO: 709271 - RNA, 64 nt, Homo Sapiens; identical to SEQ ID NO: 36011

SEQ ID NO: 709272 - RNA, 64 nt, Homo Sapiens; identical to SEQ ID NO: 36012

SEQ ID NO: 709273 - RNA, 64 nt, Homo Sapiens; identical to SEQ ID NO: 36013

SEQ ID NO: 709274 - RNA, 64 nt, Homo Sapiens; identical to SEQ ID NO: 36014

SEQ ID NO: 709275 - RNA, 64 nt, Homo Sapiens; identical to SEQ ID NO: 36015

SEQ ID NO: 709276 - RNA, 64 nt, Homo Sapiens; identical to SEQ ID NO: 36016

SEQ ID NO: 709277 - RNA, 64 nt, Homo Sapiens; identical to SEQ ID NO: 36017

SEQ ID NO: 709278 - RNA, 64 nt, Homo Sapiens; identical to SEQ ID NO: 36018

SEQ ID NO: 709279 - RNA, 64 nt, Homo Sapiens; identical to SEQ ID NO: 36019

SEQ ID NO: 709280 - RNA, 64 nt, Homo Sapiens; identical to SEQ ID NO: 36020

SEQ ID NO: 709281 - RNA, 64 nt, Homo Sapiens; identical to SEQ ID NO: 36021

SEQ ID NO: 709282 - RNA, 64 nt, Homo Sapiens; identical to SEQ ID NO: 36022

SEQ ID NO: 709283 - RNA, 64 nt, Homo Sapiens; identical to SEQ ID NO: 36023

SEQ ID NO: 709284 - RNA, 64 nt, Homo Sapiens; identical to SEQ ID NO: 36024

SEQ ID NO: 709285 - RNA, 64 nt, Homo Sapiens; identical to SEQ ID NO: 36025

SEQ ID NO: 709286 - RNA, 64 nt, Homo Sapiens; identical to SEQ ID NO: 36026

SEQ ID NO: 709287 - RNA, 64 nt, Homo Sapiens; identical to SEQ ID NO: 36027

SEQ ID NO: 709288 - RNA, 64 nt, Homo Sapiens; identical to SEQ ID NO: 36028

SEQ ID NO: 709289 - RNA, 64 nt, Homo Sapiens; identical to SEQ ID NO: 36029

SEQ ID NO: 709290 - RNA, 64 nt, Homo Sapiens; identical to SEQ ID NO: 36030

SEQ ID NO: 709291 - RNA, 64 nt, Homo Sapiens; identical to SEQ ID NO: 36031

SEQ ID NO: 709292 - RNA, 64 nt, Homo Sapiens; identical to SEQ ID NO: 36032

SEQ ID NO: 709293 - RNA, 64 nt, Homo Sapiens; identical to SEQ ID NO: 36033

SEQ ID NO: 709294 - RNA, 64 nt, Homo Sapiens; identical to SEQ ID NO: 36034

SEQ ID NO: 709295 - RNA, 64 nt, Homo Sapiens; identical to SEQ ID NO: 36035

SEQ ID NO: 709296 - RNA, 64 nt, Homo Sapiens; identical to SEQ ID NO: 36036

SEQ ID NO: 709297 - RNA, 64 nt, Homo Sapiens; identical to SEQ ID NO: 36037

SEQ ID NO: 709298 - RNA, 64 nt, Homo Sapiens; identical to SEQ ID NO: 36038

SEQ ID NO: 709299 - RNA, 64 nt, Homo Sapiens; identical to SEQ ID NO: 36039

SEQ ID NO: 709300 - RNA, 64 nt, Homo Sapiens; identical to SEQ ID NO: 36040

SEQ ID NO: 709301 - RNA, 64 nt, Homo Sapiens; identical to SEQ ID NO: 36041

SEQ ID NO: 709302 - RNA, 64 nt, Homo Sapiens; identical to SEQ ID NO: 36042

SEQ ID NO: 709303 - RNA, 64 nt, Homo Sapiens; identical to SEQ ID NO: 36043

SEQ ID NO: 709304 - RNA, 64 nt, Homo Sapiens; identical to SEQ ID NO: 36044

SEQ ID NO: 709305 - RNA, 64 nt, Homo Sapiens; identical to SEQ ID NO: 36045

SEQ ID NO: 709306 - RNA, 64 nt, Homo Sapiens; identical to SEQ ID NO: 36046

SEQ ID NO: 709307 - RNA, 64 nt, Homo Sapiens; identical to SEQ ID NO: 36047

SEQ ID NO: 709308 - RNA, 64 nt, Homo Sapiens; identical to SEQ ID NO: 36048

SEQ ID NO: 709309 - RNA, 64 nt, Homo Sapiens; identical to SEQ ID NO: 36049

SEQ ID NO: 709310 - RNA, 64 nt, Homo Sapiens; identical to SEQ ID NO: 36050

SEQ ID NO: 709311 - RNA, 64 nt, Homo Sapiens; identical to SEQ ID NO: 36051

SEQ ID NO: 709312 - RNA, 64 nt, Homo Sapiens; identical to SEQ ID NO: 36052

SEQ ID NO: 709313 - RNA, 64 nt, Homo Sapiens; identical to SEQ ID NO: 36053

SEQ ID NO: 709314 - RNA, 64 nt, Homo Sapiens; identical to SEQ ID NO: 36054

SEQ ID NO: 709315 - RNA, 64 nt, Homo Sapiens; identical to SEQ ID NO: 36055

SEQ ID NO: 709316 - RNA, 64 nt, Homo Sapiens; identical to SEQ ID NO: 36056

SEQ ID NO: 709317 - RNA, 64 nt, Homo Sapiens; identical to SEQ ID NO: 36057

SEQ ID NO: 709318 - RNA, 64 nt, Homo Sapiens; identical to SEQ ID NO: 36058

SEQ ID NO: 709319 - RNA, 64 nt, Homo Sapiens; identical to SEQ ID NO: 36059

SEQ ID NO: 709320 - RNA, 64 nt, Homo Sapiens; identical to SEQ ID NO: 36060

SEQ ID NO: 709321 - RNA, 64 nt, Homo Sapiens; identical to SEQ ID NO: 36061

SEQ ID NO: 709322 - RNA, 64 nt, Homo Sapiens; identical to SEQ ID NO: 36062

SEQ ID NO: 709323 - RNA, 64 nt, Homo Sapiens; identical to SEQ ID NO: 36063

SEQ ID NO: 709324 - RNA, 64 nt, Homo Sapiens; identical to SEQ ID NO: 36064

SEQ ID NO: 709325 - RNA, 64 nt, Homo Sapiens; identical to SEQ ID NO: 36065

SEQ ID NO: 709326 - RNA, 64 nt, Homo Sapiens; identical to SEQ ID NO: 36066

SEQ ID NO: 709327 - RNA, 64 nt, Homo Sapiens; identical to SEQ ID NO: 36067

SEQ ID NO: 709328 - RNA, 64 nt, Homo Sapiens; identical to SEQ ID NO: 36068

SEQ ID NO: 709329 - RNA, 64 nt, Homo Sapiens; identical to SEQ ID NO: 36069

SEQ ID NO: 709330 - RNA, 64 nt, Homo Sapiens; identical to SEQ ID NO: 36070

SEQ ID NO: 709331 - RNA, 64 nt, Homo Sapiens; identical to SEQ ID NO: 36071

SEQ ID NO: 709332 - RNA, 64 nt, Homo Sapiens; identical to SEQ ID NO: 36072

SEQ ID NO: 709333 - RNA, 64 nt, Homo Sapiens; identical to SEQ ID NO: 36073

SEQ ID NO: 709334 - RNA, 64 nt, Homo Sapiens; identical to SEQ ID NO: 36074

SEQ ID NO: 709335 - RNA, 64 nt, Homo Sapiens; identical to SEQ ID NO: 36075

SEQ ID NO: 709336 - RNA, 64 nt, Homo Sapiens; identical to SEQ ID NO: 36076

SEQ ID NO: 709337 - RNA, 64 nt, Homo Sapiens; identical to SEQ ID NO: 36077

SEQ ID NO: 709338 - RNA, 64 nt, Homo Sapiens; identical to SEQ ID NO: 36078

SEQ ID NO: 709339 - RNA, 64 nt, Homo Sapiens; identical to SEQ ID NO: 36079

SEQ ID NO: 709340 - RNA, 64 nt, Homo Sapiens; identical to SEQ ID NO: 36080

SEQ ID NO: 709341 - RNA, 64 nt, Homo Sapiens; identical to SEQ ID NO: 36081

SEQ ID NO: 709342 - RNA, 64 nt, Homo Sapiens; identical to SEQ ID NO: 36082

SEQ ID NO: 709343 - RNA, 64 nt, Homo Sapiens; identical to SEQ ID NO: 36083

SEQ ID NO: 709344 - RNA, 64 nt, Homo Sapiens; identical to SEQ ID NO: 36084

SEQ ID NO: 709345 - RNA, 64 nt, Homo Sapiens; identical to SEQ ID NO: 36085

SEQ ID NO: 709346 - RNA, 64 nt, Homo Sapiens; identical to SEQ ID NO: 36086

SEQ ID NO: 709347 - RNA, 64 nt, Homo Sapiens; identical to SEQ ID NO: 36087

SEQ ID NO: 709348 - RNA, 64 nt, Homo Sapiens; identical to SEQ ID NO: 36088

SEQ ID NO: 709349 - RNA, 64 nt, Homo Sapiens; identical to SEQ ID NO: 36089

SEQ ID NO: 709350 - RNA, 64 nt, Homo Sapiens; identical to SEQ ID NO: 36090

SEQ ID NO: 709351 - RNA, 64 nt, Homo Sapiens; identical to SEQ ID NO: 36091

SEQ ID NO: 709352 - RNA, 64 nt, Homo Sapiens; identical to SEQ ID NO: 36092

SEQ ID NO: 709353 - RNA, 64 nt, Homo Sapiens; identical to SEQ ID NO: 36093

SEQ ID NO: 709354 - RNA, 64 nt, Homo Sapiens; identical to SEQ ID NO: 36094

SEQ ID NO: 709355 - RNA, 64 nt, Homo Sapiens; identical to SEQ ID NO: 36095

SEQ ID NO: 709356 - RNA, 64 nt, Homo Sapiens; identical to SEQ ID NO: 36096

SEQ ID NO: 709357 - RNA, 64 nt, Homo Sapiens; identical to SEQ ID NO: 36097

SEQ ID NO: 709358 - RNA, 64 nt, Homo Sapiens; identical to SEQ ID NO: 36098

SEQ ID NO: 709359 - RNA, 64 nt, Homo Sapiens; identical to SEQ ID NO: 36099

SEQ ID NO: 709360 - RNA, 64 nt, Homo Sapiens; identical to SEQ ID NO: 36100

SEQ ID NO: 709361 - RNA, 64 nt, Homo Sapiens; identical to SEQ ID NO: 36101

SEQ ID NO: 709362 - RNA, 64 nt, Homo Sapiens; identical to SEQ ID NO: 36102

SEQ ID NO: 709363 - RNA, 64 nt, Homo Sapiens; identical to SEQ ID NO: 36103

SEQ ID NO: 709364 - RNA, 64 nt, Homo Sapiens; identical to SEQ ID NO: 36104

SEQ ID NO: 709365 - RNA, 64 nt, Homo Sapiens; identical to SEQ ID NO: 36105

SEQ ID NO: 709366 - RNA, 64 nt, Homo Sapiens; identical to SEQ ID NO: 36106

SEQ ID NO: 709367 - RNA, 64 nt, Homo Sapiens; identical to SEQ ID NO: 36107

SEQ ID NO: 709368 - RNA, 64 nt, Homo Sapiens; identical to SEQ ID NO: 36108

SEQ ID NO: 709369 - RNA, 64 nt, Homo Sapiens; identical to SEQ ID NO: 36109

SEQ ID NO: 709370 - RNA, 64 nt, Homo Sapiens; identical to SEQ ID NO: 36110

SEQ ID NO: 709371 - RNA, 64 nt, Homo Sapiens; identical to SEQ ID NO: 36111

SEQ ID NO: 709372 - RNA, 64 nt, Homo Sapiens; identical to SEQ ID NO: 36112

SEQ ID NO: 709373 - RNA, 64 nt, Homo Sapiens; identical to SEQ ID NO: 36113

SEQ ID NO: 709374 - RNA, 64 nt, Homo Sapiens; identical to SEQ ID NO: 36114

SEQ ID NO: 709375 - RNA, 64 nt, Homo Sapiens; identical to SEQ ID NO: 36115

SEQ ID NO: 709376 - RNA, 64 nt, Homo Sapiens; identical to SEQ ID NO: 36116

SEQ ID NO: 709377 - RNA, 64 nt, Homo Sapiens; identical to SEQ ID NO: 36117

SEQ ID NO: 709378 - RNA, 64 nt, Homo Sapiens; identical to SEQ ID NO: 36118

SEQ ID NO: 709379 - RNA, 64 nt, Homo Sapiens; identical to SEQ ID NO: 36119

SEQ ID NO: 709380 - RNA, 64 nt, Homo Sapiens; identical to SEQ ID NO: 36120

SEQ ID NO: 709381 - RNA, 62 nt, Homo Sapiens; identical to SEQ ID NO: 36121

SEQ ID NO: 709382 - RNA, 63 nt, Homo Sapiens; identical to SEQ ID NO: 36122

SEQ ID NO: 709383 - RNA, 64 nt, Homo Sapiens; identical to SEQ ID NO: 36123

SEQ ID NO: 709384 - RNA, 64 nt, Homo Sapiens; identical to SEQ ID NO: 36124

SEQ ID NO: 709385 - RNA, 64 nt, Homo Sapiens; identical to SEQ ID NO: 36125

SEQ ID NO: 709386 - RNA, 64 nt, Homo Sapiens; identical to SEQ ID NO: 36126

SEQ ID NO: 709387 - RNA, 64 nt, Homo Sapiens; identical to SEQ ID NO: 36127

SEQ ID NO: 709388 - RNA, 64 nt, Homo Sapiens; identical to SEQ ID NO: 36128

SEQ ID NO: 709389 - RNA, 64 nt, Homo Sapiens; identical to SEQ ID NO: 36129

SEQ ID NO: 709390 - RNA, 64 nt, Homo Sapiens; identical to SEQ ID NO: 36130

SEQ ID NO: 709391 - RNA, 64 nt, Homo Sapiens; identical to SEQ ID NO: 36131

SEQ ID NO: 709392 - RNA, 64 nt, Homo Sapiens; identical to SEQ ID NO: 36132

SEQ ID NO: 709393 - RNA, 64 nt, Homo Sapiens; identical to SEQ ID NO: 36133

SEQ ID NO: 709394 - RNA, 64 nt, Homo Sapiens; identical to SEQ ID NO: 36134

SEQ ID NO: 709395 - RNA, 64 nt, Homo Sapiens; identical to SEQ ID NO: 36135

SEQ ID NO: 709396 - RNA, 64 nt, Homo Sapiens; identical to SEQ ID NO: 36136

SEQ ID NO: 709397 - RNA, 64 nt, Homo Sapiens; identical to SEQ ID NO: 36137

SEQ ID NO: 709398 - RNA, 64 nt, Homo Sapiens; identical to SEQ ID NO: 36138

SEQ ID NO: 709399 - RNA, 64 nt, Homo Sapiens; identical to SEQ ID NO: 36139

SEQ ID NO: 709400 - RNA, 64 nt, Homo Sapiens; identical to SEQ ID NO: 36140

SEQ ID NO: 709401 - RNA, 64 nt, Homo Sapiens; identical to SEQ ID NO: 36141

SEQ ID NO: 709402 - RNA, 64 nt, Homo Sapiens; identical to SEQ ID NO: 36142

SEQ ID NO: 709403 - RNA, 64 nt, Homo Sapiens; identical to SEQ ID NO: 36143

SEQ ID NO: 709404 - RNA, 64 nt, Homo Sapiens; identical to SEQ ID NO: 36144

SEQ ID NO: 709405 - RNA, 64 nt, Homo Sapiens; identical to SEQ ID NO: 36145

SEQ ID NO: 709406 - RNA, 64 nt, Homo Sapiens; identical to SEQ ID NO: 36146

SEQ ID NO: 709407 - RNA, 64 nt, Homo Sapiens; identical to SEQ ID NO: 36147

SEQ ID NO: 709408 - RNA, 64 nt, Homo Sapiens; identical to SEQ ID NO: 36148

SEQ ID NO: 709409 - RNA, 64 nt, Homo Sapiens; identical to SEQ ID NO: 36149

SEQ ID NO: 709410 - RNA, 64 nt, Homo Sapiens; identical to SEQ ID NO: 36150

SEQ ID NO: 709411 - RNA, 64 nt, Homo Sapiens; identical to SEQ ID NO: 36151

SEQ ID NO: 709412 - RNA, 64 nt, Homo Sapiens; identical to SEQ ID NO: 36152

SEQ ID NO: 709413 - RNA, 64 nt, Homo Sapiens; identical to SEQ ID NO: 36153

SEQ ID NO: 709414 - RNA, 64 nt, Homo Sapiens; identical to SEQ ID NO: 36154

SEQ ID NO: 709415 - RNA, 64 nt, Homo Sapiens; identical to SEQ ID NO: 36155

SEQ ID NO: 709416 - RNA, 64 nt, Homo Sapiens; identical to SEQ ID NO: 36156

SEQ ID NO: 709417 - RNA, 64 nt, Homo Sapiens; identical to SEQ ID NO: 36157

SEQ ID NO: 709418 - RNA, 64 nt, Homo Sapiens; identical to SEQ ID NO: 36158

SEQ ID NO: 709419 - RNA, 64 nt, Homo Sapiens; identical to SEQ ID NO: 36159

SEQ ID NO: 709420 - RNA, 64 nt, Homo Sapiens; identical to SEQ ID NO: 36160

SEQ ID NO: 709421 - RNA, 64 nt, Homo Sapiens; identical to SEQ ID NO: 36161

SEQ ID NO: 709422 - RNA, 64 nt, Homo Sapiens; identical to SEQ ID NO: 36162

SEQ ID NO: 709423 - RNA, 64 nt, Homo Sapiens; identical to SEQ ID NO: 36163

SEQ ID NO: 709424 - RNA, 64 nt, Homo Sapiens; identical to SEQ ID NO: 36164

SEQ ID NO: 709425 - RNA, 64 nt, Homo Sapiens; identical to SEQ ID NO: 36165

SEQ ID NO: 709426 - RNA, 64 nt, Homo Sapiens; identical to SEQ ID NO: 36166

SEQ ID NO: 709427 - RNA, 64 nt, Homo Sapiens; identical to SEQ ID NO: 36167

SEQ ID NO: 709428 - RNA, 64 nt, Homo Sapiens; identical to SEQ ID NO: 36168

SEQ ID NO: 709429 - RNA, 64 nt, Homo Sapiens; identical to SEQ ID NO: 36169

SEQ ID NO: 709430 - RNA, 64 nt, Homo Sapiens; identical to SEQ ID NO: 36170

SEQ ID NO: 709431 - RNA, 64 nt, Homo Sapiens; identical to SEQ ID NO: 36171

SEQ ID NO: 709432 - RNA, 64 nt, Homo Sapiens; identical to SEQ ID NO: 36172

SEQ ID NO: 709433 - RNA, 64 nt, Homo Sapiens; identical to SEQ ID NO: 36173

SEQ ID NO: 709434 - RNA, 64 nt, Homo Sapiens; identical to SEQ ID NO: 36174

SEQ ID NO: 709435 - RNA, 64 nt, Homo Sapiens; identical to SEQ ID NO: 36175

SEQ ID NO: 709436 - RNA, 64 nt, Homo Sapiens; identical to SEQ ID NO: 36176

SEQ ID NO: 709437 - RNA, 64 nt, Homo Sapiens; identical to SEQ ID NO: 36177

SEQ ID NO: 709438 - RNA, 64 nt, Homo Sapiens; identical to SEQ ID NO: 36178

SEQ ID NO: 709439 - RNA, 64 nt, Homo Sapiens; identical to SEQ ID NO: 36179

SEQ ID NO: 709440 - RNA, 64 nt, Homo Sapiens; identical to SEQ ID NO: 36180

SEQ ID NO: 709441 - RNA, 64 nt, Homo Sapiens; identical to SEQ ID NO: 36181

SEQ ID NO: 709442 - RNA, 64 nt, Homo Sapiens; identical to SEQ ID NO: 36182

SEQ ID NO: 709443 - RNA, 64 nt, Homo Sapiens; identical to SEQ ID NO: 36183

SEQ ID NO: 709444 - RNA, 64 nt, Homo Sapiens; identical to SEQ ID NO: 36184

SEQ ID NO: 709445 - RNA, 64 nt, Homo Sapiens; identical to SEQ ID NO: 36185

SEQ ID NO: 709446 - RNA, 64 nt, Homo Sapiens; identical to SEQ ID NO: 36186

SEQ ID NO: 709447 - RNA, 64 nt, Homo Sapiens; identical to SEQ ID NO: 36187

SEQ ID NO: 709448 - RNA, 64 nt, Homo Sapiens; identical to SEQ ID NO: 36188

SEQ ID NO: 709449 - RNA, 64 nt, Homo Sapiens; identical to SEQ ID NO: 36189

SEQ ID NO: 709450 - RNA, 64 nt, Homo Sapiens; identical to SEQ ID NO: 36190

SEQ ID NO: 709451 - RNA, 64 nt, Homo Sapiens; identical to SEQ ID NO: 36191

SEQ ID NO: 709452 - RNA, 64 nt, Homo Sapiens; identical to SEQ ID NO: 36192

SEQ ID NO: 709453 - RNA, 64 nt, Homo Sapiens; identical to SEQ ID NO: 36193

SEQ ID NO: 709454 - RNA, 64 nt, Homo Sapiens; identical to SEQ ID NO: 36194

SEQ ID NO: 709455 - RNA, 64 nt, Homo Sapiens; identical to SEQ ID NO: 36195

SEQ ID NO: 709456 - RNA, 64 nt, Homo Sapiens; identical to SEQ ID NO: 36196

SEQ ID NO: 709457 - RNA, 64 nt, Homo Sapiens; identical to SEQ ID NO: 36197

SEQ ID NO: 709458 - RNA, 64 nt, Homo Sapiens; identical to SEQ ID NO: 36198

SEQ ID NO: 709459 - RNA, 64 nt, Homo Sapiens; identical to SEQ ID NO: 36199

SEQ ID NO: 709460 - RNA, 64 nt, Homo Sapiens; identical to SEQ ID NO: 36200

SEQ ID NO: 709461 - RNA, 64 nt, Homo Sapiens; identical to SEQ ID NO: 36201

SEQ ID NO: 709462 - RNA, 64 nt, Homo Sapiens; identical to SEQ ID NO: 36202

SEQ ID NO: 709463 - RNA, 64 nt, Homo Sapiens; identical to SEQ ID NO: 36203

SEQ ID NO: 709464 - RNA, 64 nt, Homo Sapiens; identical to SEQ ID NO: 36204

SEQ ID NO: 709465 - RNA, 64 nt, Homo Sapiens; identical to SEQ ID NO: 36205

SEQ ID NO: 709466 - RNA, 64 nt, Homo Sapiens; identical to SEQ ID NO: 36206

SEQ ID NO: 709467 - RNA, 64 nt, Homo Sapiens; identical to SEQ ID NO: 36207

SEQ ID NO: 709468 - RNA, 64 nt, Homo Sapiens; identical to SEQ ID NO: 36208

SEQ ID NO: 709469 - RNA, 64 nt, Homo Sapiens; identical to SEQ ID NO: 36209

SEQ ID NO: 709470 - RNA, 64 nt, Homo Sapiens; identical to SEQ ID NO: 36210

SEQ ID NO: 709471 - RNA, 64 nt, Homo Sapiens; identical to SEQ ID NO: 36211

SEQ ID NO: 709472 - RNA, 64 nt, Homo Sapiens; identical to SEQ ID NO: 36212

SEQ ID NO: 709473 - RNA, 64 nt, Homo Sapiens; identical to SEQ ID NO: 36213

SEQ ID NO: 709474 - RNA, 64 nt, Homo Sapiens; identical to SEQ ID NO: 36214

SEQ ID NO: 709475 - RNA, 64 nt, Homo Sapiens; identical to SEQ ID NO: 36215

SEQ ID NO: 709476 - RNA, 64 nt, Homo Sapiens; identical to SEQ ID NO: 36216

SEQ ID NO: 709477 - RNA, 64 nt, Homo Sapiens; identical to SEQ ID NO: 36217

SEQ ID NO: 709478 - RNA, 64 nt, Homo Sapiens; identical to SEQ ID NO: 36218

SEQ ID NO: 709479 - RNA, 64 nt, Homo Sapiens; identical to SEQ ID NO: 36219

SEQ ID NO: 709480 - RNA, 64 nt, Homo Sapiens; identical to SEQ ID NO: 36220

SEQ ID NO: 709481 - RNA, 64 nt, Homo Sapiens; identical to SEQ ID NO: 36221

SEQ ID NO: 709482 - RNA, 64 nt, Homo Sapiens; identical to SEQ ID NO: 36222

SEQ ID NO: 709483 - RNA, 64 nt, Homo Sapiens; identical to SEQ ID NO: 36223

SEQ ID NO: 709484 - RNA, 64 nt, Homo Sapiens; identical to SEQ ID NO: 36224

SEQ ID NO: 709485 - RNA, 64 nt, Homo Sapiens; identical to SEQ ID NO: 36225

SEQ ID NO: 709486 - RNA, 64 nt, Homo Sapiens; identical to SEQ ID NO: 36226

SEQ ID NO: 709487 - RNA, 64 nt, Homo Sapiens; identical to SEQ ID NO: 36227

SEQ ID NO: 709488 - RNA, 64 nt, Homo Sapiens; identical to SEQ ID NO: 36228

SEQ ID NO: 709489 - RNA, 64 nt, Homo Sapiens; identical to SEQ ID NO: 36229

SEQ ID NO: 709490 - RNA, 64 nt, Homo Sapiens; identical to SEQ ID NO: 36230

SEQ ID NO: 709491 - RNA, 64 nt, Homo Sapiens; identical to SEQ ID NO: 36231

SEQ ID NO: 709492 - RNA, 64 nt, Homo Sapiens; identical to SEQ ID NO: 36232

SEQ ID NO: 709493 - RNA, 64 nt, Homo Sapiens; identical to SEQ ID NO: 36233

SEQ ID NO: 709494 - RNA, 64 nt, Homo Sapiens; identical to SEQ ID NO: 36234

SEQ ID NO: 709495 - RNA, 64 nt, Homo Sapiens; identical to SEQ ID NO: 36235

SEQ ID NO: 709496 - RNA, 64 nt, Homo Sapiens; identical to SEQ ID NO: 36236

SEQ ID NO: 709497 - RNA, 64 nt, Homo Sapiens; identical to SEQ ID NO: 36237

SEQ ID NO: 709498 - RNA, 64 nt, Homo Sapiens; identical to SEQ ID NO: 36238

SEQ ID NO: 709499 - RNA, 64 nt, Homo Sapiens; identical to SEQ ID NO: 36239

SEQ ID NO: 709500 - RNA, 64 nt, Homo Sapiens; identical to SEQ ID NO: 36240

SEQ ID NO: 709501 - RNA, 64 nt, Homo Sapiens; identical to SEQ ID NO: 36241

SEQ ID NO: 709502 - RNA, 64 nt, Homo Sapiens; identical to SEQ ID NO: 36242

SEQ ID NO: 709503 - RNA, 64 nt, Homo Sapiens; identical to SEQ ID NO: 36243

SEQ ID NO: 709504 - RNA, 64 nt, Homo Sapiens; identical to SEQ ID NO: 36244

SEQ ID NO: 709505 - RNA, 64 nt, Homo Sapiens; identical to SEQ ID NO: 36245

SEQ ID NO: 709506 - RNA, 64 nt, Homo Sapiens; identical to SEQ ID NO: 36246

SEQ ID NO: 709507 - RNA, 64 nt, Homo Sapiens; identical to SEQ ID NO: 36247

SEQ ID NO: 709508 - RNA, 64 nt, Homo Sapiens; identical to SEQ ID NO: 36248

SEQ ID NO: 709509 - RNA, 64 nt, Homo Sapiens; identical to SEQ ID NO: 36249

SEQ ID NO: 709510 - RNA, 64 nt, Homo Sapiens; identical to SEQ ID NO: 36250

SEQ ID NO: 709511 - RNA, 64 nt, Homo Sapiens; identical to SEQ ID NO: 36251

SEQ ID NO: 709512 - RNA, 64 nt, Homo Sapiens; identical to SEQ ID NO: 36252

SEQ ID NO: 709513 - RNA, 64 nt, Homo Sapiens; identical to SEQ ID NO: 36253

SEQ ID NO: 709514 - RNA, 64 nt, Homo Sapiens; identical to SEQ ID NO: 36254

SEQ ID NO: 709515 - RNA, 64 nt, Homo Sapiens; identical to SEQ ID NO: 36255

SEQ ID NO: 709516 - RNA, 64 nt, Homo Sapiens; identical to SEQ ID NO: 36256

SEQ ID NO: 709517 - RNA, 64 nt, Homo Sapiens; identical to SEQ ID NO: 36257

SEQ ID NO: 709518 - RNA, 64 nt, Homo Sapiens; identical to SEQ ID NO: 36258

SEQ ID NO: 709519 - RNA, 64 nt, Homo Sapiens; identical to SEQ ID NO: 36259

SEQ ID NO: 709520 - RNA, 64 nt, Homo Sapiens; identical to SEQ ID NO: 36260

SEQ ID NO: 709521 - RNA, 64 nt, Homo Sapiens; identical to SEQ ID NO: 36261

SEQ ID NO: 709522 - RNA, 64 nt, Homo Sapiens; identical to SEQ ID NO: 36262

SEQ ID NO: 709523 - RNA, 64 nt, Homo Sapiens; identical to SEQ ID NO: 36263

SEQ ID NO: 709524 - RNA, 64 nt, Homo Sapiens; identical to SEQ ID NO: 36264

SEQ ID NO: 709525 - RNA, 64 nt, Homo Sapiens; identical to SEQ ID NO: 36265

SEQ ID NO: 709526 - RNA, 64 nt, Homo Sapiens; identical to SEQ ID NO: 36266

SEQ ID NO: 709527 - RNA, 64 nt, Homo Sapiens; identical to SEQ ID NO: 36267

SEQ ID NO: 709528 - RNA, 64 nt, Homo Sapiens; identical to SEQ ID NO: 36268

SEQ ID NO: 709529 - RNA, 64 nt, Homo Sapiens; identical to SEQ ID NO: 36269

SEQ ID NO: 709530 - RNA, 64 nt, Homo Sapiens; identical to SEQ ID NO: 36270

SEQ ID NO: 709531 - RNA, 64 nt, Homo Sapiens; identical to SEQ ID NO: 36271

SEQ ID NO: 709532 - RNA, 64 nt, Homo Sapiens; identical to SEQ ID NO: 36272

SEQ ID NO: 709533 - RNA, 64 nt, Homo Sapiens; identical to SEQ ID NO: 36273

SEQ ID NO: 709534 - RNA, 64 nt, Homo Sapiens; identical to SEQ ID NO: 36274

SEQ ID NO: 709535 - RNA, 64 nt, Homo Sapiens; identical to SEQ ID NO: 36275

SEQ ID NO: 709536 - RNA, 64 nt, Homo Sapiens; identical to SEQ ID NO: 36276

SEQ ID NO: 709537 - RNA, 64 nt, Homo Sapiens; identical to SEQ ID NO: 36277

SEQ ID NO: 709538 - RNA, 64 nt, Homo Sapiens; identical to SEQ ID NO: 36278

SEQ ID NO: 709539 - RNA, 64 nt, Homo Sapiens; identical to SEQ ID NO: 36279

SEQ ID NO: 709540 - RNA, 64 nt, Homo Sapiens; identical to SEQ ID NO: 36280

SEQ ID NO: 709541 - RNA, 64 nt, Homo Sapiens; identical to SEQ ID NO: 36281

SEQ ID NO: 709542 - RNA, 64 nt, Homo Sapiens; identical to SEQ ID NO: 36282

SEQ ID NO: 709543 - RNA, 64 nt, Homo Sapiens; identical to SEQ ID NO: 36283

SEQ ID NO: 709544 - RNA, 64 nt, Homo Sapiens; identical to SEQ ID NO: 36284

SEQ ID NO: 709545 - RNA, 64 nt, Homo Sapiens; identical to SEQ ID NO: 36285

SEQ ID NO: 709546 - RNA, 64 nt, Homo Sapiens; identical to SEQ ID NO: 36286

SEQ ID NO: 709547 - RNA, 64 nt, Homo Sapiens; identical to SEQ ID NO: 36287

SEQ ID NO: 709548 - RNA, 64 nt, Homo Sapiens; identical to SEQ ID NO: 36288

SEQ ID NO: 709549 - RNA, 64 nt, Homo Sapiens; identical to SEQ ID NO: 36289

SEQ ID NO: 709550 - RNA, 64 nt, Homo Sapiens; identical to SEQ ID NO: 36290

SEQ ID NO: 709551 - RNA, 64 nt, Homo Sapiens; identical to SEQ ID NO: 36291

SEQ ID NO: 709552 - RNA, 64 nt, Homo Sapiens; identical to SEQ ID NO: 36292

SEQ ID NO: 709553 - RNA, 64 nt, Homo Sapiens; identical to SEQ ID NO: 36293

SEQ ID NO: 709554 - RNA, 64 nt, Homo Sapiens; identical to SEQ ID NO: 36294

SEQ ID NO: 709555 - RNA, 64 nt, Homo Sapiens; identical to SEQ ID NO: 36295

SEQ ID NO: 709556 - RNA, 64 nt, Homo Sapiens; identical to SEQ ID NO: 36296

SEQ ID NO: 709557 - RNA, 64 nt, Homo Sapiens; identical to SEQ ID NO: 36297

SEQ ID NO: 709558 - RNA, 64 nt, Homo Sapiens; identical to SEQ ID NO: 36298

SEQ ID NO: 709559 - RNA, 64 nt, Homo Sapiens; identical to SEQ ID NO: 36299

SEQ ID NO: 709560 - RNA, 64 nt, Homo Sapiens; identical to SEQ ID NO: 36300

SEQ ID NO: 709561 - RNA, 64 nt, Homo Sapiens; identical to SEQ ID NO: 36301

SEQ ID NO: 709562 - RNA, 64 nt, Homo Sapiens; identical to SEQ ID NO: 36302

SEQ ID NO: 709563 - RNA, 64 nt, Homo Sapiens; identical to SEQ ID NO: 36303

SEQ ID NO: 709564 - RNA, 64 nt, Homo Sapiens; identical to SEQ ID NO: 36304

SEQ ID NO: 709565 - RNA, 64 nt, Homo Sapiens; identical to SEQ ID NO: 36305

SEQ ID NO: 709566 - RNA, 64 nt, Homo Sapiens; identical to SEQ ID NO: 36306

SEQ ID NO: 709567 - RNA, 64 nt, Homo Sapiens; identical to SEQ ID NO: 36307

SEQ ID NO: 709568 - RNA, 64 nt, Homo Sapiens; identical to SEQ ID NO: 36308

SEQ ID NO: 709569 - RNA, 64 nt, Homo Sapiens; identical to SEQ ID NO: 36309

SEQ ID NO: 709570 - RNA, 64 nt, Homo Sapiens; identical to SEQ ID NO: 36310

SEQ ID NO: 709571 - RNA, 64 nt, Homo Sapiens; identical to SEQ ID NO: 36311

SEQ ID NO: 709572 - RNA, 64 nt, Homo Sapiens; identical to SEQ ID NO: 36312

SEQ ID NO: 709573 - RNA, 64 nt, Homo Sapiens; identical to SEQ ID NO: 36313

SEQ ID NO: 709574 - RNA, 64 nt, Homo Sapiens; identical to SEQ ID NO: 36314

SEQ ID NO: 709575 - RNA, 64 nt, Homo Sapiens; identical to SEQ ID NO: 36315

SEQ ID NO: 709576 - RNA, 64 nt, Homo Sapiens; identical to SEQ ID NO: 36316

SEQ ID NO: 709577 - RNA, 64 nt, Homo Sapiens; identical to SEQ ID NO: 36317

SEQ ID NO: 709578 - RNA, 64 nt, Homo Sapiens; identical to SEQ ID NO: 36318

SEQ ID NO: 709579 - RNA, 64 nt, Homo Sapiens; identical to SEQ ID NO: 36319

SEQ ID NO: 709580 - RNA, 64 nt, Homo Sapiens; identical to SEQ ID NO: 36320

SEQ ID NO: 709581 - RNA, 64 nt, Homo Sapiens; identical to SEQ ID NO: 36321

SEQ ID NO: 709582 - RNA, 64 nt, Homo Sapiens; identical to SEQ ID NO: 36322

SEQ ID NO: 709583 - RNA, 64 nt, Homo Sapiens; identical to SEQ ID NO: 36323

SEQ ID NO: 709584 - RNA, 64 nt, Homo Sapiens; identical to SEQ ID NO: 36324

SEQ ID NO: 709585 - RNA, 64 nt, Homo Sapiens; identical to SEQ ID NO: 36325

SEQ ID NO: 709586 - RNA, 64 nt, Homo Sapiens; identical to SEQ ID NO: 36326

SEQ ID NO: 709587 - RNA, 64 nt, Homo Sapiens; identical to SEQ ID NO: 36327

SEQ ID NO: 709588 - RNA, 64 nt, Homo Sapiens; identical to SEQ ID NO: 36328

SEQ ID NO: 709589 - RNA, 64 nt, Homo Sapiens; identical to SEQ ID NO: 36329

SEQ ID NO: 709590 - RNA, 64 nt, Homo Sapiens; identical to SEQ ID NO: 36330

SEQ ID NO: 709591 - RNA, 64 nt, Homo Sapiens; identical to SEQ ID NO: 36331

SEQ ID NO: 709592 - RNA, 64 nt, Homo Sapiens; identical to SEQ ID NO: 36332

SEQ ID NO: 709593 - RNA, 64 nt, Homo Sapiens; identical to SEQ ID NO: 36333

SEQ ID NO: 709594 - RNA, 64 nt, Homo Sapiens; identical to SEQ ID NO: 36334

SEQ ID NO: 709595 - RNA, 64 nt, Homo Sapiens; identical to SEQ ID NO: 36335

SEQ ID NO: 709596 - RNA, 64 nt, Homo Sapiens; identical to SEQ ID NO: 36336

SEQ ID NO: 709597 - RNA, 64 nt, Homo Sapiens; identical to SEQ ID NO: 36337

SEQ ID NO: 709598 - RNA, 64 nt, Homo Sapiens; identical to SEQ ID NO: 36338

SEQ ID NO: 709599 - RNA, 64 nt, Homo Sapiens; identical to SEQ ID NO: 36339

SEQ ID NO: 709600 - RNA, 64 nt, Homo Sapiens; identical to SEQ ID NO: 36340

SEQ ID NO: 709601 - RNA, 64 nt, Homo Sapiens; identical to SEQ ID NO: 36341

SEQ ID NO: 709602 - RNA, 64 nt, Homo Sapiens; identical to SEQ ID NO: 36342

SEQ ID NO: 709603 - RNA, 64 nt, Homo Sapiens; identical to SEQ ID NO: 36343

SEQ ID NO: 709604 - RNA, 64 nt, Homo Sapiens; identical to SEQ ID NO: 36344

SEQ ID NO: 709605 - RNA, 64 nt, Homo Sapiens; identical to SEQ ID NO: 36345

SEQ ID NO: 709606 - RNA, 64 nt, Homo Sapiens; identical to SEQ ID NO: 36346

SEQ ID NO: 709607 - RNA, 64 nt, Homo Sapiens; identical to SEQ ID NO: 36347

SEQ ID NO: 709608 - RNA, 64 nt, Homo Sapiens; identical to SEQ ID NO: 36348

SEQ ID NO: 709609 - RNA, 64 nt, Homo Sapiens; identical to SEQ ID NO: 36349

SEQ ID NO: 709610 - RNA, 64 nt, Homo Sapiens; identical to SEQ ID NO: 36350

SEQ ID NO: 709611 - RNA, 64 nt, Homo Sapiens; identical to SEQ ID NO: 36351

SEQ ID NO: 709612 - RNA, 64 nt, Homo Sapiens; identical to SEQ ID NO: 36352

SEQ ID NO: 709613 - RNA, 64 nt, Homo Sapiens; identical to SEQ ID NO: 36353

SEQ ID NO: 709614 - RNA, 64 nt, Homo Sapiens; identical to SEQ ID NO: 36354

SEQ ID NO: 709615 - RNA, 64 nt, Homo Sapiens; identical to SEQ ID NO: 36355

SEQ ID NO: 709616 - RNA, 64 nt, Homo Sapiens; identical to SEQ ID NO: 36356

SEQ ID NO: 709617 - RNA, 64 nt, Homo Sapiens; identical to SEQ ID NO: 36357

SEQ ID NO: 709618 - RNA, 64 nt, Homo Sapiens; identical to SEQ ID NO: 36358

SEQ ID NO: 709619 - RNA, 64 nt, Homo Sapiens; identical to SEQ ID NO: 36359

SEQ ID NO: 709620 - RNA, 64 nt, Homo Sapiens; identical to SEQ ID NO: 36360

SEQ ID NO: 709621 - RNA, 64 nt, Homo Sapiens; identical to SEQ ID NO: 36361

SEQ ID NO: 709622 - RNA, 64 nt, Homo Sapiens; identical to SEQ ID NO: 36362

SEQ ID NO: 709623 - RNA, 64 nt, Homo Sapiens; identical to SEQ ID NO: 36363

SEQ ID NO: 709624 - RNA, 64 nt, Homo Sapiens; identical to SEQ ID NO: 36364

SEQ ID NO: 709625 - RNA, 64 nt, Homo Sapiens; identical to SEQ ID NO: 36365

SEQ ID NO: 709626 - RNA, 64 nt, Homo Sapiens; identical to SEQ ID NO: 36366

SEQ ID NO: 709627 - RNA, 64 nt, Homo Sapiens; identical to SEQ ID NO: 36367

SEQ ID NO: 709628 - RNA, 64 nt, Homo Sapiens; identical to SEQ ID NO: 36368

SEQ ID NO: 709629 - RNA, 64 nt, Homo Sapiens; identical to SEQ ID NO: 36369

SEQ ID NO: 709630 - RNA, 64 nt, Homo Sapiens; identical to SEQ ID NO: 36370

SEQ ID NO: 709631 - RNA, 64 nt, Homo Sapiens; identical to SEQ ID NO: 36371

SEQ ID NO: 709632 - RNA, 64 nt, Homo Sapiens; identical to SEQ ID NO: 36372

SEQ ID NO: 709633 - RNA, 64 nt, Homo Sapiens; identical to SEQ ID NO: 36373

SEQ ID NO: 709634 - RNA, 64 nt, Homo Sapiens; identical to SEQ ID NO: 36374

SEQ ID NO: 709635 - RNA, 64 nt, Homo Sapiens; identical to SEQ ID NO: 36375

SEQ ID NO: 709636 - RNA, 64 nt, Homo Sapiens; identical to SEQ ID NO: 36376

SEQ ID NO: 709637 - RNA, 64 nt, Homo Sapiens; identical to SEQ ID NO: 36377

SEQ ID NO: 709638 - RNA, 64 nt, Homo Sapiens; identical to SEQ ID NO: 36378

SEQ ID NO: 709639 - RNA, 64 nt, Homo Sapiens; identical to SEQ ID NO: 36379

SEQ ID NO: 709640 - RNA, 64 nt, Homo Sapiens; identical to SEQ ID NO: 36380

SEQ ID NO: 709641 - RNA, 64 nt, Homo Sapiens; identical to SEQ ID NO: 36381

SEQ ID NO: 709642 - RNA, 64 nt, Homo Sapiens; identical to SEQ ID NO: 36382

SEQ ID NO: 709643 - RNA, 64 nt, Homo Sapiens; identical to SEQ ID NO: 36383

SEQ ID NO: 709644 - RNA, 64 nt, Homo Sapiens; identical to SEQ ID NO: 36384

SEQ ID NO: 709645 - RNA, 64 nt, Homo Sapiens; identical to SEQ ID NO: 36385

SEQ ID NO: 709646 - RNA, 64 nt, Homo Sapiens; identical to SEQ ID NO: 36386

SEQ ID NO: 709647 - RNA, 64 nt, Homo Sapiens; identical to SEQ ID NO: 36387

SEQ ID NO: 709648 - RNA, 64 nt, Homo Sapiens; identical to SEQ ID NO: 36388

SEQ ID NO: 709649 - RNA, 64 nt, Homo Sapiens; identical to SEQ ID NO: 36389

SEQ ID NO: 709650 - RNA, 64 nt, Homo Sapiens; identical to SEQ ID NO: 36390

SEQ ID NO: 709651 - RNA, 64 nt, Homo Sapiens; identical to SEQ ID NO: 36391

SEQ ID NO: 709652 - RNA, 64 nt, Homo Sapiens; identical to SEQ ID NO: 36392

SEQ ID NO: 709653 - RNA, 64 nt, Homo Sapiens; identical to SEQ ID NO: 36393

SEQ ID NO: 709654 - RNA, 64 nt, Homo Sapiens; identical to SEQ ID NO: 36394

SEQ ID NO: 709655 - RNA, 64 nt, Homo Sapiens; identical to SEQ ID NO: 36395

SEQ ID NO: 709656 - RNA, 64 nt, Homo Sapiens; identical to SEQ ID NO: 36396

SEQ ID NO: 709657 - RNA, 64 nt, Homo Sapiens; identical to SEQ ID NO: 36397

SEQ ID NO: 709658 - RNA, 64 nt, Homo Sapiens; identical to SEQ ID NO: 36398

SEQ ID NO: 709659 - RNA, 64 nt, Homo Sapiens; identical to SEQ ID NO: 36399

SEQ ID NO: 709660 - RNA, 64 nt, Homo Sapiens; identical to SEQ ID NO: 36400

SEQ ID NO: 709661 - RNA, 64 nt, Homo Sapiens; identical to SEQ ID NO: 36401

SEQ ID NO: 709662 - RNA, 64 nt, Homo Sapiens; identical to SEQ ID NO: 36402

SEQ ID NO: 709663 - RNA, 64 nt, Homo Sapiens; identical to SEQ ID NO: 36403

SEQ ID NO: 709664 - RNA, 64 nt, Homo Sapiens; identical to SEQ ID NO: 36404

SEQ ID NO: 709665 - RNA, 64 nt, Homo Sapiens; identical to SEQ ID NO: 36405

SEQ ID NO: 709666 - RNA, 64 nt, Homo Sapiens; identical to SEQ ID NO: 36406

SEQ ID NO: 709667 - RNA, 64 nt, Homo Sapiens; identical to SEQ ID NO: 36407

SEQ ID NO: 709668 - RNA, 64 nt, Homo Sapiens; identical to SEQ ID NO: 36408

SEQ ID NO: 709669 - RNA, 64 nt, Homo Sapiens; identical to SEQ ID NO: 36409

SEQ ID NO: 709670 - RNA, 64 nt, Homo Sapiens; identical to SEQ ID NO: 36410

SEQ ID NO: 709671 - RNA, 64 nt, Homo Sapiens; identical to SEQ ID NO: 36411

SEQ ID NO: 709672 - RNA, 64 nt, Homo Sapiens; identical to SEQ ID NO: 36412

SEQ ID NO: 709673 - RNA, 64 nt, Homo Sapiens; identical to SEQ ID NO: 36413

SEQ ID NO: 709674 - RNA, 64 nt, Homo Sapiens; identical to SEQ ID NO: 36414

SEQ ID NO: 709675 - RNA, 64 nt, Homo Sapiens; identical to SEQ ID NO: 36415

SEQ ID NO: 709676 - RNA, 64 nt, Homo Sapiens; identical to SEQ ID NO: 36416

SEQ ID NO: 709677 - RNA, 64 nt, Homo Sapiens; identical to SEQ ID NO: 36417

SEQ ID NO: 709678 - RNA, 64 nt, Homo Sapiens; identical to SEQ ID NO: 36418

SEQ ID NO: 709679 - RNA, 64 nt, Homo Sapiens; identical to SEQ ID NO: 36419

SEQ ID NO: 709680 - RNA, 64 nt, Homo Sapiens; identical to SEQ ID NO: 36420

SEQ ID NO: 709681 - RNA, 64 nt, Homo Sapiens; identical to SEQ ID NO: 36421

SEQ ID NO: 709682 - RNA, 64 nt, Homo Sapiens; identical to SEQ ID NO: 36422

SEQ ID NO: 709683 - RNA, 64 nt, Homo Sapiens; identical to SEQ ID NO: 36423

SEQ ID NO: 709684 - RNA, 64 nt, Homo Sapiens; identical to SEQ ID NO: 36424

SEQ ID NO: 709685 - RNA, 64 nt, Homo Sapiens; identical to SEQ ID NO: 36425

SEQ ID NO: 709686 - RNA, 64 nt, Homo Sapiens; identical to SEQ ID NO: 36426

SEQ ID NO: 709687 - RNA, 64 nt, Homo Sapiens; identical to SEQ ID NO: 36427

SEQ ID NO: 709688 - RNA, 64 nt, Homo Sapiens; identical to SEQ ID NO: 36428

SEQ ID NO: 709689 - RNA, 64 nt, Homo Sapiens; identical to SEQ ID NO: 36429

SEQ ID NO: 709690 - RNA, 64 nt, Homo Sapiens; identical to SEQ ID NO: 36430

SEQ ID NO: 709691 - RNA, 64 nt, Homo Sapiens; identical to SEQ ID NO: 36431

SEQ ID NO: 709692 - RNA, 64 nt, Homo Sapiens; identical to SEQ ID NO: 36432

SEQ ID NO: 709693 - RNA, 64 nt, Homo Sapiens; identical to SEQ ID NO: 36433

SEQ ID NO: 709694 - RNA, 64 nt, Homo Sapiens; identical to SEQ ID NO: 36434

SEQ ID NO: 709695 - RNA, 64 nt, Homo Sapiens; identical to SEQ ID NO: 36435

SEQ ID NO: 709696 - RNA, 64 nt, Homo Sapiens; identical to SEQ ID NO: 36436

SEQ ID NO: 709697 - RNA, 64 nt, Homo Sapiens; identical to SEQ ID NO: 36437

SEQ ID NO: 709698 - RNA, 64 nt, Homo Sapiens; identical to SEQ ID NO: 36438

SEQ ID NO: 709699 - RNA, 64 nt, Homo Sapiens; identical to SEQ ID NO: 36439

SEQ ID NO: 709700 - RNA, 64 nt, Homo Sapiens; identical to SEQ ID NO: 36440

SEQ ID NO: 709701 - RNA, 64 nt, Homo Sapiens; identical to SEQ ID NO: 36441

SEQ ID NO: 709702 - RNA, 64 nt, Homo Sapiens; identical to SEQ ID NO: 36442

SEQ ID NO: 709703 - RNA, 64 nt, Homo Sapiens; identical to SEQ ID NO: 36443

SEQ ID NO: 709704 - RNA, 64 nt, Homo Sapiens; identical to SEQ ID NO: 36444

SEQ ID NO: 709705 - RNA, 64 nt, Homo Sapiens; identical to SEQ ID NO: 36445

SEQ ID NO: 709706 - RNA, 64 nt, Homo Sapiens; identical to SEQ ID NO: 36446

SEQ ID NO: 709707 - RNA, 64 nt, Homo Sapiens; identical to SEQ ID NO: 36447

SEQ ID NO: 709708 - RNA, 64 nt, Homo Sapiens; identical to SEQ ID NO: 36448

SEQ ID NO: 709709 - RNA, 64 nt, Homo Sapiens; identical to SEQ ID NO: 36449

SEQ ID NO: 709710 - RNA, 64 nt, Homo Sapiens; identical to SEQ ID NO: 36450

SEQ ID NO: 709711 - RNA, 64 nt, Homo Sapiens; identical to SEQ ID NO: 36451

SEQ ID NO: 709712 - RNA, 64 nt, Homo Sapiens; identical to SEQ ID NO: 36452

SEQ ID NO: 709713 - RNA, 64 nt, Homo Sapiens; identical to SEQ ID NO: 36453

SEQ ID NO: 709714 - RNA, 64 nt, Homo Sapiens; identical to SEQ ID NO: 36454

SEQ ID NO: 709715 - RNA, 64 nt, Homo Sapiens; identical to SEQ ID NO: 36455

SEQ ID NO: 709716 - RNA, 64 nt, Homo Sapiens; identical to SEQ ID NO: 36456

SEQ ID NO: 709717 - RNA, 64 nt, Homo Sapiens; identical to SEQ ID NO: 36457

SEQ ID NO: 709718 - RNA, 64 nt, Homo Sapiens; identical to SEQ ID NO: 36458

SEQ ID NO: 709719 - RNA, 64 nt, Homo Sapiens; identical to SEQ ID NO: 36459

SEQ ID NO: 709720 - RNA, 64 nt, Homo Sapiens; identical to SEQ ID NO: 36460

SEQ ID NO: 709721 - RNA, 64 nt, Homo Sapiens; identical to SEQ ID NO: 36461

SEQ ID NO: 709722 - RNA, 64 nt, Homo Sapiens; identical to SEQ ID NO: 36462

SEQ ID NO: 709723 - RNA, 64 nt, Homo Sapiens; identical to SEQ ID NO: 36463

SEQ ID NO: 709724 - RNA, 64 nt, Homo Sapiens; identical to SEQ ID NO: 36464

SEQ ID NO: 709725 - RNA, 64 nt, Homo Sapiens; identical to SEQ ID NO: 36465

SEQ ID NO: 709726 - RNA, 64 nt, Homo Sapiens; identical to SEQ ID NO: 36466

SEQ ID NO: 709727 - RNA, 64 nt, Homo Sapiens; identical to SEQ ID NO: 36467

SEQ ID NO: 709728 - RNA, 64 nt, Homo Sapiens; identical to SEQ ID NO: 36468

SEQ ID NO: 709729 - RNA, 64 nt, Homo Sapiens; identical to SEQ ID NO: 36469

SEQ ID NO: 709730 - RNA, 64 nt, Homo Sapiens; identical to SEQ ID NO: 36470

SEQ ID NO: 709731 - RNA, 64 nt, Homo Sapiens; identical to SEQ ID NO: 36471

SEQ ID NO: 709732 - RNA, 64 nt, Homo Sapiens; identical to SEQ ID NO: 36472

SEQ ID NO: 709733 - RNA, 64 nt, Homo Sapiens; identical to SEQ ID NO: 36473

SEQ ID NO: 709734 - RNA, 64 nt, Homo Sapiens; identical to SEQ ID NO: 36474

SEQ ID NO: 709735 - RNA, 64 nt, Homo Sapiens; identical to SEQ ID NO: 36475

SEQ ID NO: 709736 - RNA, 64 nt, Homo Sapiens; identical to SEQ ID NO: 36476

SEQ ID NO: 709737 - RNA, 64 nt, Homo Sapiens; identical to SEQ ID NO: 36477

SEQ ID NO: 709738 - RNA, 64 nt, Homo Sapiens; identical to SEQ ID NO: 36478

SEQ ID NO: 709739 - RNA, 64 nt, Homo Sapiens; identical to SEQ ID NO: 36479

SEQ ID NO: 709740 - RNA, 64 nt, Homo Sapiens; identical to SEQ ID NO: 36480

SEQ ID NO: 709741 - RNA, 64 nt, Homo Sapiens; identical to SEQ ID NO: 36481

SEQ ID NO: 709742 - RNA, 64 nt, Homo Sapiens; identical to SEQ ID NO: 36482

SEQ ID NO: 709743 - RNA, 64 nt, Homo Sapiens; identical to SEQ ID NO: 36483

SEQ ID NO: 709744 - RNA, 64 nt, Homo Sapiens; identical to SEQ ID NO: 36484

SEQ ID NO: 709745 - RNA, 64 nt, Homo Sapiens; identical to SEQ ID NO: 36485

SEQ ID NO: 709746 - RNA, 64 nt, Homo Sapiens; identical to SEQ ID NO: 36486

SEQ ID NO: 709747 - RNA, 64 nt, Homo Sapiens; identical to SEQ ID NO: 36487

SEQ ID NO: 709748 - RNA, 64 nt, Homo Sapiens; identical to SEQ ID NO: 36488

SEQ ID NO: 709749 - RNA, 64 nt, Homo Sapiens; identical to SEQ ID NO: 36489

SEQ ID NO: 709750 - RNA, 64 nt, Homo Sapiens; identical to SEQ ID NO: 36490

SEQ ID NO: 709751 - RNA, 64 nt, Homo Sapiens; identical to SEQ ID NO: 36491

SEQ ID NO: 709752 - RNA, 64 nt, Homo Sapiens; identical to SEQ ID NO: 36492

SEQ ID NO: 709753 - RNA, 64 nt, Homo Sapiens; identical to SEQ ID NO: 36493

SEQ ID NO: 709754 - RNA, 64 nt, Homo Sapiens; identical to SEQ ID NO: 36494

SEQ ID NO: 709755 - RNA, 64 nt, Homo Sapiens; identical to SEQ ID NO: 36495

SEQ ID NO: 709756 - RNA, 64 nt, Homo Sapiens; identical to SEQ ID NO: 36496

SEQ ID NO: 709757 - RNA, 64 nt, Homo Sapiens; identical to SEQ ID NO: 36497

SEQ ID NO: 709758 - RNA, 64 nt, Homo Sapiens; identical to SEQ ID NO: 36498

SEQ ID NO: 709759 - RNA, 64 nt, Homo Sapiens; identical to SEQ ID NO: 36499

SEQ ID NO: 709760 - RNA, 64 nt, Homo Sapiens; identical to SEQ ID NO: 36500

SEQ ID NO: 709761 - RNA, 64 nt, Homo Sapiens; identical to SEQ ID NO: 36501

SEQ ID NO: 709762 - RNA, 64 nt, Homo Sapiens; identical to SEQ ID NO: 36502

SEQ ID NO: 709763 - RNA, 64 nt, Homo Sapiens; identical to SEQ ID NO: 36503

SEQ ID NO: 709764 - RNA, 64 nt, Homo Sapiens; identical to SEQ ID NO: 36504

SEQ ID NO: 709765 - RNA, 64 nt, Homo Sapiens; identical to SEQ ID NO: 36505

SEQ ID NO: 709766 - RNA, 64 nt, Homo Sapiens; identical to SEQ ID NO: 36506

SEQ ID NO: 709767 - RNA, 64 nt, Homo Sapiens; identical to SEQ ID NO: 36507

SEQ ID NO: 709768 - RNA, 64 nt, Homo Sapiens; identical to SEQ ID NO: 36508

SEQ ID NO: 709769 - RNA, 64 nt, Homo Sapiens; identical to SEQ ID NO: 36509

SEQ ID NO: 709770 - RNA, 64 nt, Homo Sapiens; identical to SEQ ID NO: 36510

SEQ ID NO: 709771 - RNA, 64 nt, Homo Sapiens; identical to SEQ ID NO: 36511

SEQ ID NO: 709772 - RNA, 64 nt, Homo Sapiens; identical to SEQ ID NO: 36512

SEQ ID NO: 709773 - RNA, 64 nt, Homo Sapiens; identical to SEQ ID NO: 36513

SEQ ID NO: 709774 - RNA, 64 nt, Homo Sapiens; identical to SEQ ID NO: 36514

SEQ ID NO: 709775 - RNA, 64 nt, Homo Sapiens; identical to SEQ ID NO: 36515

SEQ ID NO: 709776 - RNA, 64 nt, Homo Sapiens; identical to SEQ ID NO: 36516

SEQ ID NO: 709777 - RNA, 64 nt, Homo Sapiens; identical to SEQ ID NO: 36517

SEQ ID NO: 709778 - RNA, 64 nt, Homo Sapiens; identical to SEQ ID NO: 36518

SEQ ID NO: 709779 - RNA, 64 nt, Homo Sapiens; identical to SEQ ID NO: 36519

SEQ ID NO: 709780 - RNA, 64 nt, Homo Sapiens; identical to SEQ ID NO: 36520

SEQ ID NO: 709781 - RNA, 64 nt, Homo Sapiens; identical to SEQ ID NO: 36521

SEQ ID NO: 709782 - RNA, 64 nt, Homo Sapiens; identical to SEQ ID NO: 36522

SEQ ID NO: 709783 - RNA, 64 nt, Homo Sapiens; identical to SEQ ID NO: 36523

SEQ ID NO: 709784 - RNA, 64 nt, Homo Sapiens; identical to SEQ ID NO: 36524

SEQ ID NO: 709785 - RNA, 64 nt, Homo Sapiens; identical to SEQ ID NO: 36525

SEQ ID NO: 709786 - RNA, 64 nt, Homo Sapiens; identical to SEQ ID NO: 36526

SEQ ID NO: 709787 - RNA, 64 nt, Homo Sapiens; identical to SEQ ID NO: 36527

SEQ ID NO: 709788 - RNA, 64 nt, Homo Sapiens; identical to SEQ ID NO: 36528

SEQ ID NO: 709789 - RNA, 64 nt, Homo Sapiens; identical to SEQ ID NO: 36529

SEQ ID NO: 709790 - RNA, 64 nt, Homo Sapiens; identical to SEQ ID NO: 36530

SEQ ID NO: 709791 - RNA, 64 nt, Homo Sapiens; identical to SEQ ID NO: 36531

SEQ ID NO: 709792 - RNA, 64 nt, Homo Sapiens; identical to SEQ ID NO: 36532

SEQ ID NO: 709793 - RNA, 64 nt, Homo Sapiens; identical to SEQ ID NO: 36533

SEQ ID NO: 709794 - RNA, 64 nt, Homo Sapiens; identical to SEQ ID NO: 36534

SEQ ID NO: 709795 - RNA, 64 nt, Homo Sapiens; identical to SEQ ID NO: 36535

SEQ ID NO: 709796 - RNA, 64 nt, Homo Sapiens; identical to SEQ ID NO: 36536

SEQ ID NO: 709797 - RNA, 64 nt, Homo Sapiens; identical to SEQ ID NO: 36537

SEQ ID NO: 709798 - RNA, 64 nt, Homo Sapiens; identical to SEQ ID NO: 36538

SEQ ID NO: 709799 - RNA, 64 nt, Homo Sapiens; identical to SEQ ID NO: 36539

SEQ ID NO: 709800 - RNA, 64 nt, Homo Sapiens; identical to SEQ ID NO: 36540

SEQ ID NO: 709801 - RNA, 64 nt, Homo Sapiens; identical to SEQ ID NO: 36541

SEQ ID NO: 709802 - RNA, 64 nt, Homo Sapiens; identical to SEQ ID NO: 36542

SEQ ID NO: 709803 - RNA, 64 nt, Homo Sapiens; identical to SEQ ID NO: 36543

SEQ ID NO: 709804 - RNA, 64 nt, Homo Sapiens; identical to SEQ ID NO: 36544

SEQ ID NO: 709805 - RNA, 64 nt, Homo Sapiens; identical to SEQ ID NO: 36545

SEQ ID NO: 709806 - RNA, 64 nt, Homo Sapiens; identical to SEQ ID NO: 36546

SEQ ID NO: 709807 - RNA, 64 nt, Homo Sapiens; identical to SEQ ID NO: 36547

SEQ ID NO: 709808 - RNA, 64 nt, Homo Sapiens; identical to SEQ ID NO: 36548

SEQ ID NO: 709809 - RNA, 64 nt, Homo Sapiens; identical to SEQ ID NO: 36549

SEQ ID NO: 709810 - RNA, 64 nt, Homo Sapiens; identical to SEQ ID NO: 36550

SEQ ID NO: 709811 - RNA, 64 nt, Homo Sapiens; identical to SEQ ID NO: 36551

SEQ ID NO: 709812 - RNA, 64 nt, Homo Sapiens; identical to SEQ ID NO: 36552

SEQ ID NO: 709813 - RNA, 64 nt, Homo Sapiens; identical to SEQ ID NO: 36553

SEQ ID NO: 709814 - RNA, 64 nt, Homo Sapiens; identical to SEQ ID NO: 36554

SEQ ID NO: 709815 - RNA, 64 nt, Homo Sapiens; identical to SEQ ID NO: 36555

SEQ ID NO: 709816 - RNA, 64 nt, Homo Sapiens; identical to SEQ ID NO: 36556

SEQ ID NO: 709817 - RNA, 64 nt, Homo Sapiens; identical to SEQ ID NO: 36557

SEQ ID NO: 709818 - RNA, 64 nt, Homo Sapiens; identical to SEQ ID NO: 36558

SEQ ID NO: 709819 - RNA, 64 nt, Homo Sapiens; identical to SEQ ID NO: 36559

SEQ ID NO: 709820 - RNA, 64 nt, Homo Sapiens; identical to SEQ ID NO: 36560

SEQ ID NO: 709821 - RNA, 64 nt, Homo Sapiens; identical to SEQ ID NO: 36561

SEQ ID NO: 709822 - RNA, 64 nt, Homo Sapiens; identical to SEQ ID NO: 36562

SEQ ID NO: 709823 - RNA, 64 nt, Homo Sapiens; identical to SEQ ID NO: 36563

SEQ ID NO: 709824 - RNA, 64 nt, Homo Sapiens; identical to SEQ ID NO: 36564

SEQ ID NO: 709825 - RNA, 64 nt, Homo Sapiens; identical to SEQ ID NO: 36565

SEQ ID NO: 709826 - RNA, 64 nt, Homo Sapiens; identical to SEQ ID NO: 36566

SEQ ID NO: 709827 - RNA, 64 nt, Homo Sapiens; identical to SEQ ID NO: 36567

SEQ ID NO: 709828 - RNA, 64 nt, Homo Sapiens; identical to SEQ ID NO: 36568

SEQ ID NO: 709829 - RNA, 64 nt, Homo Sapiens; identical to SEQ ID NO: 36569

SEQ ID NO: 709830 - RNA, 64 nt, Homo Sapiens; identical to SEQ ID NO: 36570

SEQ ID NO: 709831 - RNA, 64 nt, Homo Sapiens; identical to SEQ ID NO: 36571

SEQ ID NO: 709832 - RNA, 64 nt, Homo Sapiens; identical to SEQ ID NO: 36572

SEQ ID NO: 709833 - RNA, 64 nt, Homo Sapiens; identical to SEQ ID NO: 36573

SEQ ID NO: 709834 - RNA, 64 nt, Homo Sapiens; identical to SEQ ID NO: 36574

SEQ ID NO: 709835 - RNA, 64 nt, Homo Sapiens; identical to SEQ ID NO: 36575

SEQ ID NO: 709836 - RNA, 64 nt, Homo Sapiens; identical to SEQ ID NO: 36576

SEQ ID NO: 709837 - RNA, 64 nt, Homo Sapiens; identical to SEQ ID NO: 36577

SEQ ID NO: 709838 - RNA, 64 nt, Homo Sapiens; identical to SEQ ID NO: 36578

SEQ ID NO: 709839 - RNA, 64 nt, Homo Sapiens; identical to SEQ ID NO: 36579

SEQ ID NO: 709840 - RNA, 64 nt, Homo Sapiens; identical to SEQ ID NO: 36580

SEQ ID NO: 709841 - RNA, 64 nt, Homo Sapiens; identical to SEQ ID NO: 36581

SEQ ID NO: 709842 - RNA, 64 nt, Homo Sapiens; identical to SEQ ID NO: 36582

SEQ ID NO: 709843 - RNA, 64 nt, Homo Sapiens; identical to SEQ ID NO: 36583

SEQ ID NO: 709844 - RNA, 64 nt, Homo Sapiens; identical to SEQ ID NO: 36584

SEQ ID NO: 709845 - RNA, 64 nt, Homo Sapiens; identical to SEQ ID NO: 36585

SEQ ID NO: 709846 - RNA, 64 nt, Homo Sapiens; identical to SEQ ID NO: 36586

SEQ ID NO: 709847 - RNA, 64 nt, Homo Sapiens; identical to SEQ ID NO: 36587

SEQ ID NO: 709848 - RNA, 64 nt, Homo Sapiens; identical to SEQ ID NO: 36588

SEQ ID NO: 709849 - RNA, 64 nt, Homo Sapiens; identical to SEQ ID NO: 36589

SEQ ID NO: 709850 - RNA, 64 nt, Homo Sapiens; identical to SEQ ID NO: 36590

SEQ ID NO: 709851 - RNA, 64 nt, Homo Sapiens; identical to SEQ ID NO: 36591

SEQ ID NO: 709852 - RNA, 64 nt, Homo Sapiens; identical to SEQ ID NO: 36592

SEQ ID NO: 709853 - RNA, 64 nt, Homo Sapiens; identical to SEQ ID NO: 36593

SEQ ID NO: 709854 - RNA, 64 nt, Homo Sapiens; identical to SEQ ID NO: 36594

SEQ ID NO: 709855 - RNA, 64 nt, Homo Sapiens; identical to SEQ ID NO: 36595

SEQ ID NO: 709856 - RNA, 64 nt, Homo Sapiens; identical to SEQ ID NO: 36596

SEQ ID NO: 709857 - RNA, 64 nt, Homo Sapiens; identical to SEQ ID NO: 36597

SEQ ID NO: 709858 - RNA, 64 nt, Homo Sapiens; identical to SEQ ID NO: 36598

SEQ ID NO: 709859 - RNA, 64 nt, Homo Sapiens; identical to SEQ ID NO: 36599

SEQ ID NO: 709860 - RNA, 64 nt, Homo Sapiens; identical to SEQ ID NO: 36600

SEQ ID NO: 709861 - RNA, 64 nt, Homo Sapiens; identical to SEQ ID NO: 36601

SEQ ID NO: 709862 - RNA, 64 nt, Homo Sapiens; identical to SEQ ID NO: 36602

SEQ ID NO: 709863 - RNA, 64 nt, Homo Sapiens; identical to SEQ ID NO: 36603

SEQ ID NO: 709864 - RNA, 64 nt, Homo Sapiens; identical to SEQ ID NO: 36604

SEQ ID NO: 709865 - RNA, 64 nt, Homo Sapiens; identical to SEQ ID NO: 36605

SEQ ID NO: 709866 - RNA, 64 nt, Homo Sapiens; identical to SEQ ID NO: 36606

SEQ ID NO: 709867 - RNA, 64 nt, Homo Sapiens; identical to SEQ ID NO: 36607

SEQ ID NO: 709868 - RNA, 64 nt, Homo Sapiens; identical to SEQ ID NO: 36608

SEQ ID NO: 709869 - RNA, 64 nt, Homo Sapiens; identical to SEQ ID NO: 36609

SEQ ID NO: 709870 - RNA, 64 nt, Homo Sapiens; identical to SEQ ID NO: 36610

SEQ ID NO: 709871 - RNA, 64 nt, Homo Sapiens; identical to SEQ ID NO: 36611

SEQ ID NO: 709872 - RNA, 64 nt, Homo Sapiens; identical to SEQ ID NO: 36612

SEQ ID NO: 709873 - RNA, 64 nt, Homo Sapiens; identical to SEQ ID NO: 36613

SEQ ID NO: 709874 - RNA, 64 nt, Homo Sapiens; identical to SEQ ID NO: 36614

SEQ ID NO: 709875 - RNA, 64 nt, Homo Sapiens; identical to SEQ ID NO: 36615

SEQ ID NO: 709876 - RNA, 64 nt, Homo Sapiens; identical to SEQ ID NO: 36616

SEQ ID NO: 709877 - RNA, 64 nt, Homo Sapiens; identical to SEQ ID NO: 36617

SEQ ID NO: 709878 - RNA, 64 nt, Homo Sapiens; identical to SEQ ID NO: 36618

SEQ ID NO: 709879 - RNA, 64 nt, Homo Sapiens; identical to SEQ ID NO: 36619

SEQ ID NO: 709880 - RNA, 64 nt, Homo Sapiens; identical to SEQ ID NO: 36620

SEQ ID NO: 709881 - RNA, 64 nt, Homo Sapiens; identical to SEQ ID NO: 36621

SEQ ID NO: 709882 - RNA, 64 nt, Homo Sapiens; identical to SEQ ID NO: 36622

SEQ ID NO: 709883 - RNA, 64 nt, Homo Sapiens; identical to SEQ ID NO: 36623

SEQ ID NO: 709884 - RNA, 64 nt, Homo Sapiens; identical to SEQ ID NO: 36624

SEQ ID NO: 709885 - RNA, 64 nt, Homo Sapiens; identical to SEQ ID NO: 36625

SEQ ID NO: 709886 - RNA, 64 nt, Homo Sapiens; identical to SEQ ID NO: 36626

SEQ ID NO: 709887 - RNA, 64 nt, Homo Sapiens; identical to SEQ ID NO: 36627

SEQ ID NO: 709888 - RNA, 64 nt, Homo Sapiens; identical to SEQ ID NO: 36628

SEQ ID NO: 709889 - RNA, 64 nt, Homo Sapiens; identical to SEQ ID NO: 36629

SEQ ID NO: 709890 - RNA, 64 nt, Homo Sapiens; identical to SEQ ID NO: 36630

SEQ ID NO: 709891 - RNA, 64 nt, Homo Sapiens; identical to SEQ ID NO: 36631

SEQ ID NO: 709892 - RNA, 64 nt, Homo Sapiens; identical to SEQ ID NO: 36632

SEQ ID NO: 709893 - RNA, 64 nt, Homo Sapiens; identical to SEQ ID NO: 36633

SEQ ID NO: 709894 - RNA, 64 nt, Homo Sapiens; identical to SEQ ID NO: 36634

SEQ ID NO: 709895 - RNA, 64 nt, Homo Sapiens; identical to SEQ ID NO: 36635

SEQ ID NO: 709896 - RNA, 64 nt, Homo Sapiens; identical to SEQ ID NO: 36636

SEQ ID NO: 709897 - RNA, 64 nt, Homo Sapiens; identical to SEQ ID NO: 36637

SEQ ID NO: 709898 - RNA, 64 nt, Homo Sapiens; identical to SEQ ID NO: 36638

SEQ ID NO: 709899 - RNA, 64 nt, Homo Sapiens; identical to SEQ ID NO: 36639

SEQ ID NO: 709900 - RNA, 64 nt, Homo Sapiens; identical to SEQ ID NO: 36640

SEQ ID NO: 709901 - RNA, 64 nt, Homo Sapiens; identical to SEQ ID NO: 36641

SEQ ID NO: 709902 - RNA, 64 nt, Homo Sapiens; identical to SEQ ID NO: 36642

SEQ ID NO: 709903 - RNA, 64 nt, Homo Sapiens; identical to SEQ ID NO: 36643

SEQ ID NO: 709904 - RNA, 64 nt, Homo Sapiens; identical to SEQ ID NO: 36644

SEQ ID NO: 709905 - RNA, 64 nt, Homo Sapiens; identical to SEQ ID NO: 36645

SEQ ID NO: 709906 - RNA, 64 nt, Homo Sapiens; identical to SEQ ID NO: 36646

SEQ ID NO: 709907 - RNA, 64 nt, Homo Sapiens; identical to SEQ ID NO: 36647

SEQ ID NO: 709908 - RNA, 64 nt, Homo Sapiens; identical to SEQ ID NO: 36648

SEQ ID NO: 709909 - RNA, 64 nt, Homo Sapiens; identical to SEQ ID NO: 36649

SEQ ID NO: 709910 - RNA, 64 nt, Homo Sapiens; identical to SEQ ID NO: 36650

SEQ ID NO: 709911 - RNA, 64 nt, Homo Sapiens; identical to SEQ ID NO: 36651

SEQ ID NO: 709912 - RNA, 64 nt, Homo Sapiens; identical to SEQ ID NO: 36652

SEQ ID NO: 709913 - RNA, 64 nt, Homo Sapiens; identical to SEQ ID NO: 36653

SEQ ID NO: 709914 - RNA, 64 nt, Homo Sapiens; identical to SEQ ID NO: 36654

SEQ ID NO: 709915 - RNA, 64 nt, Homo Sapiens; identical to SEQ ID NO: 36655

SEQ ID NO: 709916 - RNA, 64 nt, Homo Sapiens; identical to SEQ ID NO: 36656

SEQ ID NO: 709917 - RNA, 64 nt, Homo Sapiens; identical to SEQ ID NO: 36657

SEQ ID NO: 709918 - RNA, 64 nt, Homo Sapiens; identical to SEQ ID NO: 36658

SEQ ID NO: 709919 - RNA, 64 nt, Homo Sapiens; identical to SEQ ID NO: 36659

SEQ ID NO: 709920 - RNA, 64 nt, Homo Sapiens; identical to SEQ ID NO: 36660

SEQ ID NO: 709921 - RNA, 64 nt, Homo Sapiens; identical to SEQ ID NO: 36661

SEQ ID NO: 709922 - RNA, 64 nt, Homo Sapiens; identical to SEQ ID NO: 36662

SEQ ID NO: 709923 - RNA, 64 nt, Homo Sapiens; identical to SEQ ID NO: 36663

SEQ ID NO: 709924 - RNA, 64 nt, Homo Sapiens; identical to SEQ ID NO: 36664

SEQ ID NO: 709925 - RNA, 64 nt, Homo Sapiens; identical to SEQ ID NO: 36665

SEQ ID NO: 709926 - RNA, 64 nt, Homo Sapiens; identical to SEQ ID NO: 36666

SEQ ID NO: 709927 - RNA, 64 nt, Homo Sapiens; identical to SEQ ID NO: 36667

SEQ ID NO: 709928 - RNA, 64 nt, Homo Sapiens; identical to SEQ ID NO: 36668

SEQ ID NO: 709929 - RNA, 64 nt, Homo Sapiens; identical to SEQ ID NO: 36669

SEQ ID NO: 709930 - RNA, 64 nt, Homo Sapiens; identical to SEQ ID NO: 36670

SEQ ID NO: 709931 - RNA, 64 nt, Homo Sapiens; identical to SEQ ID NO: 36671

SEQ ID NO: 709932 - RNA, 64 nt, Homo Sapiens; identical to SEQ ID NO: 36672

SEQ ID NO: 709933 - RNA, 64 nt, Homo Sapiens; identical to SEQ ID NO: 36673

SEQ ID NO: 709934 - RNA, 64 nt, Homo Sapiens; identical to SEQ ID NO: 36674

SEQ ID NO: 709935 - RNA, 64 nt, Homo Sapiens; identical to SEQ ID NO: 36675

SEQ ID NO: 709936 - RNA, 64 nt, Homo Sapiens; identical to SEQ ID NO: 36676

SEQ ID NO: 709937 - RNA, 64 nt, Homo Sapiens; identical to SEQ ID NO: 36677

SEQ ID NO: 709938 - RNA, 64 nt, Homo Sapiens; identical to SEQ ID NO: 36678

SEQ ID NO: 709939 - RNA, 64 nt, Homo Sapiens; identical to SEQ ID NO: 36679

SEQ ID NO: 709940 - RNA, 64 nt, Homo Sapiens; identical to SEQ ID NO: 36680

SEQ ID NO: 709941 - RNA, 64 nt, Homo Sapiens; identical to SEQ ID NO: 36681

SEQ ID NO: 709942 - RNA, 64 nt, Homo Sapiens; identical to SEQ ID NO: 36682

SEQ ID NO: 709943 - RNA, 64 nt, Homo Sapiens; identical to SEQ ID NO: 36683

SEQ ID NO: 709944 - RNA, 64 nt, Homo Sapiens; identical to SEQ ID NO: 36684

SEQ ID NO: 709945 - RNA, 64 nt, Homo Sapiens; identical to SEQ ID NO: 36685

SEQ ID NO: 709946 - RNA, 64 nt, Homo Sapiens; identical to SEQ ID NO: 36686

SEQ ID NO: 709947 - RNA, 64 nt, Homo Sapiens; identical to SEQ ID NO: 36687

SEQ ID NO: 709948 - RNA, 64 nt, Homo Sapiens; identical to SEQ ID NO: 36688

SEQ ID NO: 709949 - RNA, 64 nt, Homo Sapiens; identical to SEQ ID NO: 36689

SEQ ID NO: 709950 - RNA, 64 nt, Homo Sapiens; identical to SEQ ID NO: 36690

SEQ ID NO: 709951 - RNA, 64 nt, Homo Sapiens; identical to SEQ ID NO: 36691

SEQ ID NO: 709952 - RNA, 64 nt, Homo Sapiens; identical to SEQ ID NO: 36692

SEQ ID NO: 709953 - RNA, 64 nt, Homo Sapiens; identical to SEQ ID NO: 36693

SEQ ID NO: 709954 - RNA, 64 nt, Homo Sapiens; identical to SEQ ID NO: 36694

SEQ ID NO: 709955 - RNA, 64 nt, Homo Sapiens; identical to SEQ ID NO: 36695

SEQ ID NO: 709956 - RNA, 64 nt, Homo Sapiens; identical to SEQ ID NO: 36696

SEQ ID NO: 709957 - RNA, 64 nt, Homo Sapiens; identical to SEQ ID NO: 36697

SEQ ID NO: 709958 - RNA, 64 nt, Homo Sapiens; identical to SEQ ID NO: 36698

SEQ ID NO: 709959 - RNA, 64 nt, Homo Sapiens; identical to SEQ ID NO: 36699

SEQ ID NO: 709960 - RNA, 64 nt, Homo Sapiens; identical to SEQ ID NO: 36700

SEQ ID NO: 709961 - RNA, 64 nt, Homo Sapiens; identical to SEQ ID NO: 36701

SEQ ID NO: 709962 - RNA, 64 nt, Homo Sapiens; identical to SEQ ID NO: 36702

SEQ ID NO: 709963 - RNA, 64 nt, Homo Sapiens; identical to SEQ ID NO: 36703

SEQ ID NO: 709964 - RNA, 64 nt, Homo Sapiens; identical to SEQ ID NO: 36704

SEQ ID NO: 709965 - RNA, 64 nt, Homo Sapiens; identical to SEQ ID NO: 36705

SEQ ID NO: 709966 - RNA, 64 nt, Homo Sapiens; identical to SEQ ID NO: 36706

SEQ ID NO: 709967 - RNA, 64 nt, Homo Sapiens; identical to SEQ ID NO: 36707

SEQ ID NO: 709968 - RNA, 64 nt, Homo Sapiens; identical to SEQ ID NO: 36708

SEQ ID NO: 709969 - RNA, 64 nt, Homo Sapiens; identical to SEQ ID NO: 36709

SEQ ID NO: 709970 - RNA, 64 nt, Homo Sapiens; identical to SEQ ID NO: 36710

SEQ ID NO: 709971 - RNA, 64 nt, Homo Sapiens; identical to SEQ ID NO: 36711

SEQ ID NO: 709972 - RNA, 64 nt, Homo Sapiens; identical to SEQ ID NO: 36712

SEQ ID NO: 709973 - RNA, 64 nt, Homo Sapiens; identical to SEQ ID NO: 36713

SEQ ID NO: 709974 - RNA, 64 nt, Homo Sapiens; identical to SEQ ID NO: 36714

SEQ ID NO: 709975 - RNA, 64 nt, Homo Sapiens; identical to SEQ ID NO: 36715

SEQ ID NO: 709976 - RNA, 64 nt, Homo Sapiens; identical to SEQ ID NO: 36716

SEQ ID NO: 709977 - RNA, 64 nt, Homo Sapiens; identical to SEQ ID NO: 36717

SEQ ID NO: 709978 - RNA, 64 nt, Homo Sapiens; identical to SEQ ID NO: 36718

SEQ ID NO: 709979 - RNA, 64 nt, Homo Sapiens; identical to SEQ ID NO: 36719

SEQ ID NO: 709980 - RNA, 64 nt, Homo Sapiens; identical to SEQ ID NO: 36720

SEQ ID NO: 709981 - RNA, 64 nt, Homo Sapiens; identical to SEQ ID NO: 36721

SEQ ID NO: 709982 - RNA, 64 nt, Homo Sapiens; identical to SEQ ID NO: 36722

SEQ ID NO: 709983 - RNA, 64 nt, Homo Sapiens; identical to SEQ ID NO: 36723

SEQ ID NO: 709984 - RNA, 64 nt, Homo Sapiens; identical to SEQ ID NO: 36724

SEQ ID NO: 709985 - RNA, 64 nt, Homo Sapiens; identical to SEQ ID NO: 36725

SEQ ID NO: 709986 - RNA, 64 nt, Homo Sapiens; identical to SEQ ID NO: 36726

SEQ ID NO: 709987 - RNA, 64 nt, Homo Sapiens; identical to SEQ ID NO: 36727

SEQ ID NO: 709988 - RNA, 64 nt, Homo Sapiens; identical to SEQ ID NO: 36728

SEQ ID NO: 709989 - RNA, 64 nt, Homo Sapiens; identical to SEQ ID NO: 36729

SEQ ID NO: 709990 - RNA, 64 nt, Homo Sapiens; identical to SEQ ID NO: 36730

SEQ ID NO: 709991 - RNA, 64 nt, Homo Sapiens; identical to SEQ ID NO: 36731

SEQ ID NO: 709992 - RNA, 64 nt, Homo Sapiens; identical to SEQ ID NO: 36732

SEQ ID NO: 709993 - RNA, 64 nt, Homo Sapiens; identical to SEQ ID NO: 36733

SEQ ID NO: 709994 - RNA, 64 nt, Homo Sapiens; identical to SEQ ID NO: 36734

SEQ ID NO: 709995 - RNA, 64 nt, Homo Sapiens; identical to SEQ ID NO: 36735

SEQ ID NO: 709996 - RNA, 64 nt, Homo Sapiens; identical to SEQ ID NO: 36736

SEQ ID NO: 709997 - RNA, 64 nt, Homo Sapiens; identical to SEQ ID NO: 36737

SEQ ID NO: 709998 - RNA, 64 nt, Homo Sapiens; identical to SEQ ID NO: 36738

SEQ ID NO: 709999 - RNA, 64 nt, Homo Sapiens; identical to SEQ ID NO: 36739

SEQ ID NO: 710000 - RNA, 64 nt, Homo Sapiens; identical to SEQ ID NO: 36740

SEQ ID NO: 710001 - RNA, 64 nt, Homo Sapiens; identical to SEQ ID NO: 36741

SEQ ID NO: 710002 - RNA, 64 nt, Homo Sapiens; identical to SEQ ID NO: 36742

SEQ ID NO: 710003 - RNA, 64 nt, Homo Sapiens; identical to SEQ ID NO: 36743

SEQ ID NO: 710004 - RNA, 64 nt, Homo Sapiens; identical to SEQ ID NO: 36744

SEQ ID NO: 710005 - RNA, 64 nt, Homo Sapiens; identical to SEQ ID NO: 36745

SEQ ID NO: 710006 - RNA, 64 nt, Homo Sapiens; identical to SEQ ID NO: 36746

SEQ ID NO: 710007 - RNA, 64 nt, Homo Sapiens; identical to SEQ ID NO: 36747

SEQ ID NO: 710008 - RNA, 64 nt, Homo Sapiens; identical to SEQ ID NO: 36748

SEQ ID NO: 710009 - RNA, 64 nt, Homo Sapiens; identical to SEQ ID NO: 36749

SEQ ID NO: 710010 - RNA, 64 nt, Homo Sapiens; identical to SEQ ID NO: 36750

SEQ ID NO: 710011 - RNA, 64 nt, Homo Sapiens; identical to SEQ ID NO: 36751

SEQ ID NO: 710012 - RNA, 64 nt, Homo Sapiens; identical to SEQ ID NO: 36752

SEQ ID NO: 710013 - RNA, 64 nt, Homo Sapiens; identical to SEQ ID NO: 36753

SEQ ID NO: 710014 - RNA, 64 nt, Homo Sapiens; identical to SEQ ID NO: 36754

SEQ ID NO: 710015 - RNA, 64 nt, Homo Sapiens; identical to SEQ ID NO: 36755

SEQ ID NO: 710016 - RNA, 64 nt, Homo Sapiens; identical to SEQ ID NO: 36756

SEQ ID NO: 710017 - RNA, 64 nt, Homo Sapiens; identical to SEQ ID NO: 36757

SEQ ID NO: 710018 - RNA, 64 nt, Homo Sapiens; identical to SEQ ID NO: 36758

SEQ ID NO: 710019 - RNA, 64 nt, Homo Sapiens; identical to SEQ ID NO: 36759

SEQ ID NO: 710020 - RNA, 64 nt, Homo Sapiens; identical to SEQ ID NO: 36760

SEQ ID NO: 710021 - RNA, 64 nt, Homo Sapiens; identical to SEQ ID NO: 36761

SEQ ID NO: 710022 - RNA, 64 nt, Homo Sapiens; identical to SEQ ID NO: 36762

SEQ ID NO: 710023 - RNA, 64 nt, Homo Sapiens; identical to SEQ ID NO: 36763

SEQ ID NO: 710024 - RNA, 64 nt, Homo Sapiens; identical to SEQ ID NO: 36764

SEQ ID NO: 710025 - RNA, 64 nt, Homo Sapiens; identical to SEQ ID NO: 36765

SEQ ID NO: 710026 - RNA, 64 nt, Homo Sapiens; identical to SEQ ID NO: 36766

SEQ ID NO: 710027 - RNA, 64 nt, Homo Sapiens; identical to SEQ ID NO: 36767

SEQ ID NO: 710028 - RNA, 64 nt, Homo Sapiens; identical to SEQ ID NO: 36768

SEQ ID NO: 710029 - RNA, 64 nt, Homo Sapiens; identical to SEQ ID NO: 36769

SEQ ID NO: 710030 - RNA, 64 nt, Homo Sapiens; identical to SEQ ID NO: 36770

SEQ ID NO: 710031 - RNA, 64 nt, Homo Sapiens; identical to SEQ ID NO: 36771

SEQ ID NO: 710032 - RNA, 64 nt, Homo Sapiens; identical to SEQ ID NO: 36772

SEQ ID NO: 710033 - RNA, 64 nt, Homo Sapiens; identical to SEQ ID NO: 36773

SEQ ID NO: 710034 - RNA, 64 nt, Homo Sapiens; identical to SEQ ID NO: 36774

SEQ ID NO: 710035 - RNA, 64 nt, Homo Sapiens; identical to SEQ ID NO: 36775

SEQ ID NO: 710036 - RNA, 61 nt, Homo Sapiens; identical to SEQ ID NO: 36776

SEQ ID NO: 710037 - RNA, 62 nt, Homo Sapiens; identical to SEQ ID NO: 36777

SEQ ID NO: 710038 - RNA, 64 nt, Homo Sapiens; identical to SEQ ID NO: 36778

SEQ ID NO: 710039 - RNA, 64 nt, Homo Sapiens; identical to SEQ ID NO: 36779

SEQ ID NO: 710040 - RNA, 64 nt, Homo Sapiens; identical to SEQ ID NO: 36780

SEQ ID NO: 710041 - RNA, 64 nt, Homo Sapiens; identical to SEQ ID NO: 36781

SEQ ID NO: 710042 - RNA, 64 nt, Homo Sapiens; identical to SEQ ID NO: 36782

SEQ ID NO: 710043 - RNA, 64 nt, Homo Sapiens; identical to SEQ ID NO: 36783

SEQ ID NO: 710044 - RNA, 64 nt, Homo Sapiens; identical to SEQ ID NO: 36784

SEQ ID NO: 710045 - RNA, 64 nt, Homo Sapiens; identical to SEQ ID NO: 36785

SEQ ID NO: 710046 - RNA, 64 nt, Homo Sapiens; identical to SEQ ID NO: 36786

SEQ ID NO: 710047 - RNA, 64 nt, Homo Sapiens; identical to SEQ ID NO: 36787

SEQ ID NO: 710048 - RNA, 64 nt, Homo Sapiens; identical to SEQ ID NO: 36788

SEQ ID NO: 710049 - RNA, 64 nt, Homo Sapiens; identical to SEQ ID NO: 36789

SEQ ID NO: 710050 - RNA, 64 nt, Homo Sapiens; identical to SEQ ID NO: 36790

SEQ ID NO: 710051 - RNA, 64 nt, Homo Sapiens; identical to SEQ ID NO: 36791

SEQ ID NO: 710052 - RNA, 64 nt, Homo Sapiens; identical to SEQ ID NO: 36792

SEQ ID NO: 710053 - RNA, 64 nt, Homo Sapiens; identical to SEQ ID NO: 36793

SEQ ID NO: 710054 - RNA, 64 nt, Homo Sapiens; identical to SEQ ID NO: 36794

SEQ ID NO: 710055 - RNA, 64 nt, Homo Sapiens; identical to SEQ ID NO: 36795

SEQ ID NO: 710056 - RNA, 64 nt, Homo Sapiens; identical to SEQ ID NO: 36796

SEQ ID NO: 710057 - RNA, 64 nt, Homo Sapiens; identical to SEQ ID NO: 36797

SEQ ID NO: 710058 - RNA, 64 nt, Homo Sapiens; identical to SEQ ID NO: 36798

SEQ ID NO: 710059 - RNA, 64 nt, Homo Sapiens; identical to SEQ ID NO: 36799

SEQ ID NO: 710060 - RNA, 64 nt, Homo Sapiens; identical to SEQ ID NO: 36800

SEQ ID NO: 710061 - RNA, 64 nt, Homo Sapiens; identical to SEQ ID NO: 36801

SEQ ID NO: 710062 - RNA, 64 nt, Homo Sapiens; identical to SEQ ID NO: 36802

SEQ ID NO: 710063 - RNA, 64 nt, Homo Sapiens; identical to SEQ ID NO: 36803

SEQ ID NO: 710064 - RNA, 64 nt, Homo Sapiens; identical to SEQ ID NO: 36804

SEQ ID NO: 710065 - RNA, 64 nt, Homo Sapiens; identical to SEQ ID NO: 36805

SEQ ID NO: 710066 - RNA, 64 nt, Homo Sapiens; identical to SEQ ID NO: 36806

SEQ ID NO: 710067 - RNA, 64 nt, Homo Sapiens; identical to SEQ ID NO: 36807

SEQ ID NO: 710068 - RNA, 64 nt, Homo Sapiens; identical to SEQ ID NO: 36808

SEQ ID NO: 710069 - RNA, 64 nt, Homo Sapiens; identical to SEQ ID NO: 36809

SEQ ID NO: 710070 - RNA, 64 nt, Homo Sapiens; identical to SEQ ID NO: 36810

SEQ ID NO: 710071 - RNA, 64 nt, Homo Sapiens; identical to SEQ ID NO: 36811

SEQ ID NO: 710072 - RNA, 64 nt, Homo Sapiens; identical to SEQ ID NO: 36812

SEQ ID NO: 710073 - RNA, 64 nt, Homo Sapiens; identical to SEQ ID NO: 36813

SEQ ID NO: 710074 - RNA, 64 nt, Homo Sapiens; identical to SEQ ID NO: 36814

SEQ ID NO: 710075 - RNA, 64 nt, Homo Sapiens; identical to SEQ ID NO: 36815

SEQ ID NO: 710076 - RNA, 64 nt, Homo Sapiens; identical to SEQ ID NO: 36816

SEQ ID NO: 710077 - RNA, 64 nt, Homo Sapiens; identical to SEQ ID NO: 36817

SEQ ID NO: 710078 - RNA, 64 nt, Homo Sapiens; identical to SEQ ID NO: 36818

SEQ ID NO: 710079 - RNA, 64 nt, Homo Sapiens; identical to SEQ ID NO: 36819

SEQ ID NO: 710080 - RNA, 64 nt, Homo Sapiens; identical to SEQ ID NO: 36820

SEQ ID NO: 710081 - RNA, 64 nt, Homo Sapiens; identical to SEQ ID NO: 36821

SEQ ID NO: 710082 - RNA, 64 nt, Homo Sapiens; identical to SEQ ID NO: 36822

SEQ ID NO: 710083 - RNA, 64 nt, Homo Sapiens; identical to SEQ ID NO: 36823

SEQ ID NO: 710084 - RNA, 64 nt, Homo Sapiens; identical to SEQ ID NO: 36824

SEQ ID NO: 710085 - RNA, 64 nt, Homo Sapiens; identical to SEQ ID NO: 36825

SEQ ID NO: 710086 - RNA, 64 nt, Homo Sapiens; identical to SEQ ID NO: 36826

SEQ ID NO: 710087 - RNA, 64 nt, Homo Sapiens; identical to SEQ ID NO: 36827

SEQ ID NO: 710088 - RNA, 64 nt, Homo Sapiens; identical to SEQ ID NO: 36828

SEQ ID NO: 710089 - RNA, 64 nt, Homo Sapiens; identical to SEQ ID NO: 36829

SEQ ID NO: 710090 - RNA, 64 nt, Homo Sapiens; identical to SEQ ID NO: 36830

SEQ ID NO: 710091 - RNA, 64 nt, Homo Sapiens; identical to SEQ ID NO: 36831

SEQ ID NO: 710092 - RNA, 64 nt, Homo Sapiens; identical to SEQ ID NO: 36832

SEQ ID NO: 710093 - RNA, 64 nt, Homo Sapiens; identical to SEQ ID NO: 36833

SEQ ID NO: 710094 - RNA, 64 nt, Homo Sapiens; identical to SEQ ID NO: 36834

SEQ ID NO: 710095 - RNA, 64 nt, Homo Sapiens; identical to SEQ ID NO: 36835

SEQ ID NO: 710096 - RNA, 64 nt, Homo Sapiens; identical to SEQ ID NO: 36836

SEQ ID NO: 710097 - RNA, 64 nt, Homo Sapiens; identical to SEQ ID NO: 36837

SEQ ID NO: 710098 - RNA, 64 nt, Homo Sapiens; identical to SEQ ID NO: 36838

SEQ ID NO: 710099 - RNA, 64 nt, Homo Sapiens; identical to SEQ ID NO: 36839

SEQ ID NO: 710100 - RNA, 64 nt, Homo Sapiens; identical to SEQ ID NO: 36840

SEQ ID NO: 710101 - RNA, 64 nt, Homo Sapiens; identical to SEQ ID NO: 36841

SEQ ID NO: 710102 - RNA, 64 nt, Homo Sapiens; identical to SEQ ID NO: 36842

SEQ ID NO: 710103 - RNA, 64 nt, Homo Sapiens; identical to SEQ ID NO: 36843

SEQ ID NO: 710104 - RNA, 64 nt, Homo Sapiens; identical to SEQ ID NO: 36844

SEQ ID NO: 710105 - RNA, 64 nt, Homo Sapiens; identical to SEQ ID NO: 36845

SEQ ID NO: 710106 - RNA, 64 nt, Homo Sapiens; identical to SEQ ID NO: 36846

SEQ ID NO: 710107 - RNA, 64 nt, Homo Sapiens; identical to SEQ ID NO: 36847

SEQ ID NO: 710108 - RNA, 64 nt, Homo Sapiens; identical to SEQ ID NO: 36848

SEQ ID NO: 710109 - RNA, 64 nt, Homo Sapiens; identical to SEQ ID NO: 36849

SEQ ID NO: 710110 - RNA, 64 nt, Homo Sapiens; identical to SEQ ID NO: 36850

SEQ ID NO: 710111 - RNA, 64 nt, Homo Sapiens; identical to SEQ ID NO: 36851

SEQ ID NO: 710112 - RNA, 64 nt, Homo Sapiens; identical to SEQ ID NO: 36852

SEQ ID NO: 710113 - RNA, 64 nt, Homo Sapiens; identical to SEQ ID NO: 36853

SEQ ID NO: 710114 - RNA, 64 nt, Homo Sapiens; identical to SEQ ID NO: 36854

SEQ ID NO: 710115 - RNA, 64 nt, Homo Sapiens; identical to SEQ ID NO: 36855

SEQ ID NO: 710116 - RNA, 64 nt, Homo Sapiens; identical to SEQ ID NO: 36856

SEQ ID NO: 710117 - RNA, 64 nt, Homo Sapiens; identical to SEQ ID NO: 36857

SEQ ID NO: 710118 - RNA, 64 nt, Homo Sapiens; identical to SEQ ID NO: 36858

SEQ ID NO: 710119 - RNA, 64 nt, Homo Sapiens; identical to SEQ ID NO: 36859

SEQ ID NO: 710120 - RNA, 64 nt, Homo Sapiens; identical to SEQ ID NO: 36860

SEQ ID NO: 710121 - RNA, 64 nt, Homo Sapiens; identical to SEQ ID NO: 36861

SEQ ID NO: 710122 - RNA, 64 nt, Homo Sapiens; identical to SEQ ID NO: 36862

SEQ ID NO: 710123 - RNA, 64 nt, Homo Sapiens; identical to SEQ ID NO: 36863

SEQ ID NO: 710124 - RNA, 64 nt, Homo Sapiens; identical to SEQ ID NO: 36864

SEQ ID NO: 710125 - RNA, 64 nt, Homo Sapiens; identical to SEQ ID NO: 36865

SEQ ID NO: 710126 - RNA, 64 nt, Homo Sapiens; identical to SEQ ID NO: 36866

SEQ ID NO: 710127 - RNA, 64 nt, Homo Sapiens; identical to SEQ ID NO: 36867

SEQ ID NO: 710128 - RNA, 64 nt, Homo Sapiens; identical to SEQ ID NO: 36868

SEQ ID NO: 710129 - RNA, 64 nt, Homo Sapiens; identical to SEQ ID NO: 36869

SEQ ID NO: 710130 - RNA, 64 nt, Homo Sapiens; identical to SEQ ID NO: 36870

SEQ ID NO: 710131 - RNA, 64 nt, Homo Sapiens; identical to SEQ ID NO: 36871

SEQ ID NO: 710132 - RNA, 64 nt, Homo Sapiens; identical to SEQ ID NO: 36872

SEQ ID NO: 710133 - RNA, 64 nt, Homo Sapiens; identical to SEQ ID NO: 36873

SEQ ID NO: 710134 - RNA, 64 nt, Homo Sapiens; identical to SEQ ID NO: 36874

SEQ ID NO: 710135 - RNA, 64 nt, Homo Sapiens; identical to SEQ ID NO: 36875

SEQ ID NO: 710136 - RNA, 64 nt, Homo Sapiens; identical to SEQ ID NO: 36876

SEQ ID NO: 710137 - RNA, 64 nt, Homo Sapiens; identical to SEQ ID NO: 36877

SEQ ID NO: 710138 - RNA, 64 nt, Homo Sapiens; identical to SEQ ID NO: 36878

SEQ ID NO: 710139 - RNA, 64 nt, Homo Sapiens; identical to SEQ ID NO: 36879

SEQ ID NO: 710140 - RNA, 64 nt, Homo Sapiens; identical to SEQ ID NO: 36880

SEQ ID NO: 710141 - RNA, 64 nt, Homo Sapiens; identical to SEQ ID NO: 36881

SEQ ID NO: 710142 - RNA, 64 nt, Homo Sapiens; identical to SEQ ID NO: 36882

SEQ ID NO: 710143 - RNA, 64 nt, Homo Sapiens; identical to SEQ ID NO: 36883

SEQ ID NO: 710144 - RNA, 64 nt, Homo Sapiens; identical to SEQ ID NO: 36884

SEQ ID NO: 710145 - RNA, 64 nt, Homo Sapiens; identical to SEQ ID NO: 36885

SEQ ID NO: 710146 - RNA, 64 nt, Homo Sapiens; identical to SEQ ID NO: 36886

SEQ ID NO: 710147 - RNA, 64 nt, Homo Sapiens; identical to SEQ ID NO: 36887

SEQ ID NO: 710148 - RNA, 64 nt, Homo Sapiens; identical to SEQ ID NO: 36888

SEQ ID NO: 710149 - RNA, 64 nt, Homo Sapiens; identical to SEQ ID NO: 36889

SEQ ID NO: 710150 - RNA, 64 nt, Homo Sapiens; identical to SEQ ID NO: 36890

SEQ ID NO: 710151 - RNA, 64 nt, Homo Sapiens; identical to SEQ ID NO: 36891

SEQ ID NO: 710152 - RNA, 64 nt, Homo Sapiens; identical to SEQ ID NO: 36892

SEQ ID NO: 710153 - RNA, 64 nt, Homo Sapiens; identical to SEQ ID NO: 36893

SEQ ID NO: 710154 - RNA, 64 nt, Homo Sapiens; identical to SEQ ID NO: 36894

SEQ ID NO: 710155 - RNA, 64 nt, Homo Sapiens; identical to SEQ ID NO: 36895

SEQ ID NO: 710156 - RNA, 64 nt, Homo Sapiens; identical to SEQ ID NO: 36896

SEQ ID NO: 710157 - RNA, 64 nt, Homo Sapiens; identical to SEQ ID NO: 36897

SEQ ID NO: 710158 - RNA, 64 nt, Homo Sapiens; identical to SEQ ID NO: 36898

SEQ ID NO: 710159 - RNA, 64 nt, Homo Sapiens; identical to SEQ ID NO: 36899

SEQ ID NO: 710160 - RNA, 64 nt, Homo Sapiens; identical to SEQ ID NO: 36900

SEQ ID NO: 710161 - RNA, 64 nt, Homo Sapiens; identical to SEQ ID NO: 36901

SEQ ID NO: 710162 - RNA, 64 nt, Homo Sapiens; identical to SEQ ID NO: 36902

SEQ ID NO: 710163 - RNA, 64 nt, Homo Sapiens; identical to SEQ ID NO: 36903

SEQ ID NO: 710164 - RNA, 64 nt, Homo Sapiens; identical to SEQ ID NO: 36904

SEQ ID NO: 710165 - RNA, 64 nt, Homo Sapiens; identical to SEQ ID NO: 36905

SEQ ID NO: 710166 - RNA, 64 nt, Homo Sapiens; identical to SEQ ID NO: 36906

SEQ ID NO: 710167 - RNA, 64 nt, Homo Sapiens; identical to SEQ ID NO: 36907

SEQ ID NO: 710168 - RNA, 64 nt, Homo Sapiens; identical to SEQ ID NO: 36908

SEQ ID NO: 710169 - RNA, 64 nt, Homo Sapiens; identical to SEQ ID NO: 36909

SEQ ID NO: 710170 - RNA, 64 nt, Homo Sapiens; identical to SEQ ID NO: 36910

SEQ ID NO: 710171 - RNA, 64 nt, Homo Sapiens; identical to SEQ ID NO: 36911

SEQ ID NO: 710172 - RNA, 64 nt, Homo Sapiens; identical to SEQ ID NO: 36912

SEQ ID NO: 710173 - RNA, 64 nt, Homo Sapiens; identical to SEQ ID NO: 36913

SEQ ID NO: 710174 - RNA, 64 nt, Homo Sapiens; identical to SEQ ID NO: 36914

SEQ ID NO: 710175 - RNA, 64 nt, Homo Sapiens; identical to SEQ ID NO: 36915

SEQ ID NO: 710176 - RNA, 64 nt, Homo Sapiens; identical to SEQ ID NO: 36916

SEQ ID NO: 710177 - RNA, 64 nt, Homo Sapiens; identical to SEQ ID NO: 36917

SEQ ID NO: 710178 - RNA, 64 nt, Homo Sapiens; identical to SEQ ID NO: 36918

SEQ ID NO: 710179 - RNA, 64 nt, Homo Sapiens; identical to SEQ ID NO: 36919

SEQ ID NO: 710180 - RNA, 64 nt, Homo Sapiens; identical to SEQ ID NO: 36920

SEQ ID NO: 710181 - RNA, 64 nt, Homo Sapiens; identical to SEQ ID NO: 36921

SEQ ID NO: 710182 - RNA, 64 nt, Homo Sapiens; identical to SEQ ID NO: 36922

SEQ ID NO: 710183 - RNA, 64 nt, Homo Sapiens; identical to SEQ ID NO: 36923

SEQ ID NO: 710184 - RNA, 64 nt, Homo Sapiens; identical to SEQ ID NO: 36924

SEQ ID NO: 710185 - RNA, 64 nt, Homo Sapiens; identical to SEQ ID NO: 36925

SEQ ID NO: 710186 - RNA, 64 nt, Homo Sapiens; identical to SEQ ID NO: 36926

SEQ ID NO: 710187 - RNA, 64 nt, Homo Sapiens; identical to SEQ ID NO: 36927

SEQ ID NO: 710188 - RNA, 64 nt, Homo Sapiens; identical to SEQ ID NO: 36928

SEQ ID NO: 710189 - RNA, 64 nt, Homo Sapiens; identical to SEQ ID NO: 36929

SEQ ID NO: 710190 - RNA, 64 nt, Homo Sapiens; identical to SEQ ID NO: 36930

SEQ ID NO: 710191 - RNA, 64 nt, Homo Sapiens; identical to SEQ ID NO: 36931

SEQ ID NO: 710192 - RNA, 64 nt, Homo Sapiens; identical to SEQ ID NO: 36932

SEQ ID NO: 710193 - RNA, 64 nt, Homo Sapiens; identical to SEQ ID NO: 36933

SEQ ID NO: 710194 - RNA, 64 nt, Homo Sapiens; identical to SEQ ID NO: 36934

SEQ ID NO: 710195 - RNA, 64 nt, Homo Sapiens; identical to SEQ ID NO: 36935

SEQ ID NO: 710196 - RNA, 64 nt, Homo Sapiens; identical to SEQ ID NO: 36936

SEQ ID NO: 710197 - RNA, 64 nt, Homo Sapiens; identical to SEQ ID NO: 36937

SEQ ID NO: 710198 - RNA, 64 nt, Homo Sapiens; identical to SEQ ID NO: 36938

SEQ ID NO: 710199 - RNA, 64 nt, Homo Sapiens; identical to SEQ ID NO: 36939

SEQ ID NO: 710200 - RNA, 64 nt, Homo Sapiens; identical to SEQ ID NO: 36940

SEQ ID NO: 710201 - RNA, 64 nt, Homo Sapiens; identical to SEQ ID NO: 36941

SEQ ID NO: 710202 - RNA, 64 nt, Homo Sapiens; identical to SEQ ID NO: 36942

SEQ ID NO: 710203 - RNA, 64 nt, Homo Sapiens; identical to SEQ ID NO: 36943

SEQ ID NO: 710204 - RNA, 64 nt, Homo Sapiens; identical to SEQ ID NO: 36944

SEQ ID NO: 710205 - RNA, 64 nt, Homo Sapiens; identical to SEQ ID NO: 36945

SEQ ID NO: 710206 - RNA, 64 nt, Homo Sapiens; identical to SEQ ID NO: 36946

SEQ ID NO: 710207 - RNA, 64 nt, Homo Sapiens; identical to SEQ ID NO: 36947

SEQ ID NO: 710208 - RNA, 64 nt, Homo Sapiens; identical to SEQ ID NO: 36948

SEQ ID NO: 710209 - RNA, 64 nt, Homo Sapiens; identical to SEQ ID NO: 36949

SEQ ID NO: 710210 - RNA, 64 nt, Homo Sapiens; identical to SEQ ID NO: 36950

SEQ ID NO: 710211 - RNA, 64 nt, Homo Sapiens; identical to SEQ ID NO: 36951

SEQ ID NO: 710212 - RNA, 64 nt, Homo Sapiens; identical to SEQ ID NO: 36952

SEQ ID NO: 710213 - RNA, 64 nt, Homo Sapiens; identical to SEQ ID NO: 36953

SEQ ID NO: 710214 - RNA, 64 nt, Homo Sapiens; identical to SEQ ID NO: 36954

SEQ ID NO: 710215 - RNA, 64 nt, Homo Sapiens; identical to SEQ ID NO: 36955

SEQ ID NO: 710216 - RNA, 64 nt, Homo Sapiens; identical to SEQ ID NO: 36956

SEQ ID NO: 710217 - RNA, 64 nt, Homo Sapiens; identical to SEQ ID NO: 36957

SEQ ID NO: 710218 - RNA, 64 nt, Homo Sapiens; identical to SEQ ID NO: 36958

SEQ ID NO: 710219 - RNA, 64 nt, Homo Sapiens; identical to SEQ ID NO: 36959

SEQ ID NO: 710220 - RNA, 64 nt, Homo Sapiens; identical to SEQ ID NO: 36960

SEQ ID NO: 710221 - RNA, 64 nt, Homo Sapiens; identical to SEQ ID NO: 36961

SEQ ID NO: 710222 - RNA, 64 nt, Homo Sapiens; identical to SEQ ID NO: 36962

SEQ ID NO: 710223 - RNA, 64 nt, Homo Sapiens; identical to SEQ ID NO: 36963

SEQ ID NO: 710224 - RNA, 64 nt, Homo Sapiens; identical to SEQ ID NO: 36964

SEQ ID NO: 710225 - RNA, 64 nt, Homo Sapiens; identical to SEQ ID NO: 36965

SEQ ID NO: 710226 - RNA, 64 nt, Homo Sapiens; identical to SEQ ID NO: 36966

SEQ ID NO: 710227 - RNA, 64 nt, Homo Sapiens; identical to SEQ ID NO: 36967

SEQ ID NO: 710228 - RNA, 64 nt, Homo Sapiens; identical to SEQ ID NO: 36968

SEQ ID NO: 710229 - RNA, 64 nt, Homo Sapiens; identical to SEQ ID NO: 36969

SEQ ID NO: 710230 - RNA, 64 nt, Homo Sapiens; identical to SEQ ID NO: 36970

SEQ ID NO: 710231 - RNA, 64 nt, Homo Sapiens; identical to SEQ ID NO: 36971

SEQ ID NO: 710232 - RNA, 64 nt, Homo Sapiens; identical to SEQ ID NO: 36972

SEQ ID NO: 710233 - RNA, 64 nt, Homo Sapiens; identical to SEQ ID NO: 36973

SEQ ID NO: 710234 - RNA, 64 nt, Homo Sapiens; identical to SEQ ID NO: 36974

SEQ ID NO: 710235 - RNA, 64 nt, Homo Sapiens; identical to SEQ ID NO: 36975

SEQ ID NO: 710236 - RNA, 64 nt, Homo Sapiens; identical to SEQ ID NO: 36976

SEQ ID NO: 710237 - RNA, 64 nt, Homo Sapiens; identical to SEQ ID NO: 36977

SEQ ID NO: 710238 - RNA, 64 nt, Homo Sapiens; identical to SEQ ID NO: 36978

SEQ ID NO: 710239 - RNA, 64 nt, Homo Sapiens; identical to SEQ ID NO: 36979

SEQ ID NO: 710240 - RNA, 64 nt, Homo Sapiens; identical to SEQ ID NO: 36980

SEQ ID NO: 710241 - RNA, 64 nt, Homo Sapiens; identical to SEQ ID NO: 36981

SEQ ID NO: 710242 - RNA, 64 nt, Homo Sapiens; identical to SEQ ID NO: 36982

SEQ ID NO: 710243 - RNA, 64 nt, Homo Sapiens; identical to SEQ ID NO: 36983

SEQ ID NO: 710244 - RNA, 64 nt, Homo Sapiens; identical to SEQ ID NO: 36984

SEQ ID NO: 710245 - RNA, 64 nt, Homo Sapiens; identical to SEQ ID NO: 36985

SEQ ID NO: 710246 - RNA, 64 nt, Homo Sapiens; identical to SEQ ID NO: 36986

SEQ ID NO: 710247 - RNA, 64 nt, Homo Sapiens; identical to SEQ ID NO: 36987

SEQ ID NO: 710248 - RNA, 64 nt, Homo Sapiens; identical to SEQ ID NO: 36988

SEQ ID NO: 710249 - RNA, 64 nt, Homo Sapiens; identical to SEQ ID NO: 36989

SEQ ID NO: 710250 - RNA, 64 nt, Homo Sapiens; identical to SEQ ID NO: 36990

SEQ ID NO: 710251 - RNA, 64 nt, Homo Sapiens; identical to SEQ ID NO: 36991

SEQ ID NO: 710252 - RNA, 64 nt, Homo Sapiens; identical to SEQ ID NO: 36992

SEQ ID NO: 710253 - RNA, 64 nt, Homo Sapiens; identical to SEQ ID NO: 36993

SEQ ID NO: 710254 - RNA, 64 nt, Homo Sapiens; identical to SEQ ID NO: 36994

SEQ ID NO: 710255 - RNA, 64 nt, Homo Sapiens; identical to SEQ ID NO: 36995

SEQ ID NO: 710256 - RNA, 64 nt, Homo Sapiens; identical to SEQ ID NO: 36996

SEQ ID NO: 710257 - RNA, 64 nt, Homo Sapiens; identical to SEQ ID NO: 36997

SEQ ID NO: 710258 - RNA, 64 nt, Homo Sapiens; identical to SEQ ID NO: 36998

SEQ ID NO: 710259 - RNA, 64 nt, Homo Sapiens; identical to SEQ ID NO: 36999

SEQ ID NO: 710260 - RNA, 64 nt, Homo Sapiens; identical to SEQ ID NO: 37000

SEQ ID NO: 710261 - RNA, 64 nt, Homo Sapiens; identical to SEQ ID NO: 37001

SEQ ID NO: 710262 - RNA, 64 nt, Homo Sapiens; identical to SEQ ID NO: 37002

SEQ ID NO: 710263 - RNA, 64 nt, Homo Sapiens; identical to SEQ ID NO: 37003

SEQ ID NO: 710264 - RNA, 64 nt, Homo Sapiens; identical to SEQ ID NO: 37004

SEQ ID NO: 710265 - RNA, 64 nt, Homo Sapiens; identical to SEQ ID NO: 37005

SEQ ID NO: 710266 - RNA, 64 nt, Homo Sapiens; identical to SEQ ID NO: 37006

SEQ ID NO: 710267 - RNA, 64 nt, Homo Sapiens; identical to SEQ ID NO: 37007

SEQ ID NO: 710268 - RNA, 64 nt, Homo Sapiens; identical to SEQ ID NO: 37008

SEQ ID NO: 710269 - RNA, 64 nt, Homo Sapiens; identical to SEQ ID NO: 37009

SEQ ID NO: 710270 - RNA, 64 nt, Homo Sapiens; identical to SEQ ID NO: 37010

SEQ ID NO: 710271 - RNA, 64 nt, Homo Sapiens; identical to SEQ ID NO: 37011

SEQ ID NO: 710272 - RNA, 64 nt, Homo Sapiens; identical to SEQ ID NO: 37012

SEQ ID NO: 710273 - RNA, 64 nt, Homo Sapiens; identical to SEQ ID NO: 37013

SEQ ID NO: 710274 - RNA, 64 nt, Homo Sapiens; identical to SEQ ID NO: 37014

SEQ ID NO: 710275 - RNA, 64 nt, Homo Sapiens; identical to SEQ ID NO: 37015

SEQ ID NO: 710276 - RNA, 64 nt, Homo Sapiens; identical to SEQ ID NO: 37016

SEQ ID NO: 710277 - RNA, 64 nt, Homo Sapiens; identical to SEQ ID NO: 37017

SEQ ID NO: 710278 - RNA, 64 nt, Homo Sapiens; identical to SEQ ID NO: 37018

SEQ ID NO: 710279 - RNA, 64 nt, Homo Sapiens; identical to SEQ ID NO: 37019

SEQ ID NO: 710280 - RNA, 64 nt, Homo Sapiens; identical to SEQ ID NO: 37020

SEQ ID NO: 710281 - RNA, 64 nt, Homo Sapiens; identical to SEQ ID NO: 37021

SEQ ID NO: 710282 - RNA, 64 nt, Homo Sapiens; identical to SEQ ID NO: 37022

SEQ ID NO: 710283 - RNA, 64 nt, Homo Sapiens; identical to SEQ ID NO: 37023

SEQ ID NO: 710284 - RNA, 64 nt, Homo Sapiens; identical to SEQ ID NO: 37024

SEQ ID NO: 710285 - RNA, 64 nt, Homo Sapiens; identical to SEQ ID NO: 37025

SEQ ID NO: 710286 - RNA, 64 nt, Homo Sapiens; identical to SEQ ID NO: 37026

SEQ ID NO: 710287 - RNA, 64 nt, Homo Sapiens; identical to SEQ ID NO: 37027

SEQ ID NO: 710288 - RNA, 64 nt, Homo Sapiens; identical to SEQ ID NO: 37028

SEQ ID NO: 710289 - RNA, 64 nt, Homo Sapiens; identical to SEQ ID NO: 37029

SEQ ID NO: 710290 - RNA, 64 nt, Homo Sapiens; identical to SEQ ID NO: 37030

SEQ ID NO: 710291 - RNA, 64 nt, Homo Sapiens; identical to SEQ ID NO: 37031

SEQ ID NO: 710292 - RNA, 64 nt, Homo Sapiens; identical to SEQ ID NO: 37032

SEQ ID NO: 710293 - RNA, 64 nt, Homo Sapiens; identical to SEQ ID NO: 37033

SEQ ID NO: 710294 - RNA, 64 nt, Homo Sapiens; identical to SEQ ID NO: 37034

SEQ ID NO: 710295 - RNA, 64 nt, Homo Sapiens; identical to SEQ ID NO: 37035

SEQ ID NO: 710296 - RNA, 64 nt, Homo Sapiens; identical to SEQ ID NO: 37036

SEQ ID NO: 710297 - RNA, 64 nt, Homo Sapiens; identical to SEQ ID NO: 37037

SEQ ID NO: 710298 - RNA, 64 nt, Homo Sapiens; identical to SEQ ID NO: 37038

SEQ ID NO: 710299 - RNA, 64 nt, Homo Sapiens; identical to SEQ ID NO: 37039

SEQ ID NO: 710300 - RNA, 64 nt, Homo Sapiens; identical to SEQ ID NO: 37040

SEQ ID NO: 710301 - RNA, 64 nt, Homo Sapiens; identical to SEQ ID NO: 37041

SEQ ID NO: 710302 - RNA, 64 nt, Homo Sapiens; identical to SEQ ID NO: 37042

SEQ ID NO: 710303 - RNA, 64 nt, Homo Sapiens; identical to SEQ ID NO: 37043

SEQ ID NO: 710304 - RNA, 64 nt, Homo Sapiens; identical to SEQ ID NO: 37044

SEQ ID NO: 710305 - RNA, 64 nt, Homo Sapiens; identical to SEQ ID NO: 37045

SEQ ID NO: 710306 - RNA, 64 nt, Homo Sapiens; identical to SEQ ID NO: 37046

SEQ ID NO: 710307 - RNA, 64 nt, Homo Sapiens; identical to SEQ ID NO: 37047

SEQ ID NO: 710308 - RNA, 64 nt, Homo Sapiens; identical to SEQ ID NO: 37048

SEQ ID NO: 710309 - RNA, 64 nt, Homo Sapiens; identical to SEQ ID NO: 37049

SEQ ID NO: 710310 - RNA, 64 nt, Homo Sapiens; identical to SEQ ID NO: 37050

SEQ ID NO: 710311 - RNA, 64 nt, Homo Sapiens; identical to SEQ ID NO: 37051

SEQ ID NO: 710312 - RNA, 64 nt, Homo Sapiens; identical to SEQ ID NO: 37052

SEQ ID NO: 710313 - RNA, 64 nt, Homo Sapiens; identical to SEQ ID NO: 37053

SEQ ID NO: 710314 - RNA, 64 nt, Homo Sapiens; identical to SEQ ID NO: 37054

SEQ ID NO: 710315 - RNA, 64 nt, Homo Sapiens; identical to SEQ ID NO: 37055

SEQ ID NO: 710316 - RNA, 64 nt, Homo Sapiens; identical to SEQ ID NO: 37056

SEQ ID NO: 710317 - RNA, 64 nt, Homo Sapiens; identical to SEQ ID NO: 37057

SEQ ID NO: 710318 - RNA, 64 nt, Homo Sapiens; identical to SEQ ID NO: 37058

SEQ ID NO: 710319 - RNA, 64 nt, Homo Sapiens; identical to SEQ ID NO: 37059

SEQ ID NO: 710320 - RNA, 64 nt, Homo Sapiens; identical to SEQ ID NO: 37060

SEQ ID NO: 710321 - RNA, 64 nt, Homo Sapiens; identical to SEQ ID NO: 37061

SEQ ID NO: 710322 - RNA, 64 nt, Homo Sapiens; identical to SEQ ID NO: 37062

SEQ ID NO: 710323 - RNA, 64 nt, Homo Sapiens; identical to SEQ ID NO: 37063

SEQ ID NO: 710324 - RNA, 64 nt, Homo Sapiens; identical to SEQ ID NO: 37064

SEQ ID NO: 710325 - RNA, 64 nt, Homo Sapiens; identical to SEQ ID NO: 37065

SEQ ID NO: 710326 - RNA, 64 nt, Homo Sapiens; identical to SEQ ID NO: 37066

SEQ ID NO: 710327 - RNA, 64 nt, Homo Sapiens; identical to SEQ ID NO: 37067

SEQ ID NO: 710328 - RNA, 64 nt, Homo Sapiens; identical to SEQ ID NO: 37068

SEQ ID NO: 710329 - RNA, 64 nt, Homo Sapiens; identical to SEQ ID NO: 37069

SEQ ID NO: 710330 - RNA, 64 nt, Homo Sapiens; identical to SEQ ID NO: 37070

SEQ ID NO: 710331 - RNA, 64 nt, Homo Sapiens; identical to SEQ ID NO: 37071

SEQ ID NO: 710332 - RNA, 64 nt, Homo Sapiens; identical to SEQ ID NO: 37072

SEQ ID NO: 710333 - RNA, 64 nt, Homo Sapiens; identical to SEQ ID NO: 37073

SEQ ID NO: 710334 - RNA, 64 nt, Homo Sapiens; identical to SEQ ID NO: 37074

SEQ ID NO: 710335 - RNA, 64 nt, Homo Sapiens; identical to SEQ ID NO: 37075

SEQ ID NO: 710336 - RNA, 64 nt, Homo Sapiens; identical to SEQ ID NO: 37076

SEQ ID NO: 710337 - RNA, 64 nt, Homo Sapiens; identical to SEQ ID NO: 37077

SEQ ID NO: 710338 - RNA, 64 nt, Homo Sapiens; identical to SEQ ID NO: 37078

SEQ ID NO: 710339 - RNA, 64 nt, Homo Sapiens; identical to SEQ ID NO: 37079

SEQ ID NO: 710340 - RNA, 64 nt, Homo Sapiens; identical to SEQ ID NO: 37080

SEQ ID NO: 710341 - RNA, 64 nt, Homo Sapiens; identical to SEQ ID NO: 37081

SEQ ID NO: 710342 - RNA, 64 nt, Homo Sapiens; identical to SEQ ID NO: 37082

SEQ ID NO: 710343 - RNA, 64 nt, Homo Sapiens; identical to SEQ ID NO: 37083

SEQ ID NO: 710344 - RNA, 64 nt, Homo Sapiens; identical to SEQ ID NO: 37084

SEQ ID NO: 710345 - RNA, 64 nt, Homo Sapiens; identical to SEQ ID NO: 37085

SEQ ID NO: 710346 - RNA, 64 nt, Homo Sapiens; identical to SEQ ID NO: 37086

SEQ ID NO: 710347 - RNA, 64 nt, Homo Sapiens; identical to SEQ ID NO: 37087

SEQ ID NO: 710348 - RNA, 64 nt, Homo Sapiens; identical to SEQ ID NO: 37088

SEQ ID NO: 710349 - RNA, 64 nt, Homo Sapiens; identical to SEQ ID NO: 37089

SEQ ID NO: 710350 - RNA, 64 nt, Homo Sapiens; identical to SEQ ID NO: 37090

SEQ ID NO: 710351 - RNA, 64 nt, Homo Sapiens; identical to SEQ ID NO: 37091

SEQ ID NO: 710352 - RNA, 64 nt, Homo Sapiens; identical to SEQ ID NO: 37092

SEQ ID NO: 710353 - RNA, 64 nt, Homo Sapiens; identical to SEQ ID NO: 37093

SEQ ID NO: 710354 - RNA, 64 nt, Homo Sapiens; identical to SEQ ID NO: 37094

SEQ ID NO: 710355 - RNA, 64 nt, Homo Sapiens; identical to SEQ ID NO: 37095

SEQ ID NO: 710356 - RNA, 64 nt, Homo Sapiens; identical to SEQ ID NO: 37096

SEQ ID NO: 710357 - RNA, 64 nt, Homo Sapiens; identical to SEQ ID NO: 37097

SEQ ID NO: 710358 - RNA, 64 nt, Homo Sapiens; identical to SEQ ID NO: 37098

SEQ ID NO: 710359 - RNA, 64 nt, Homo Sapiens; identical to SEQ ID NO: 37099

SEQ ID NO: 710360 - RNA, 64 nt, Homo Sapiens; identical to SEQ ID NO: 37100

SEQ ID NO: 710361 - RNA, 64 nt, Homo Sapiens; identical to SEQ ID NO: 37101

SEQ ID NO: 710362 - RNA, 64 nt, Homo Sapiens; identical to SEQ ID NO: 37102

SEQ ID NO: 710363 - RNA, 64 nt, Homo Sapiens; identical to SEQ ID NO: 37103

SEQ ID NO: 710364 - RNA, 64 nt, Homo Sapiens; identical to SEQ ID NO: 37104

SEQ ID NO: 710365 - RNA, 64 nt, Homo Sapiens; identical to SEQ ID NO: 37105

SEQ ID NO: 710366 - RNA, 64 nt, Homo Sapiens; identical to SEQ ID NO: 37106

SEQ ID NO: 710367 - RNA, 64 nt, Homo Sapiens; identical to SEQ ID NO: 37107

SEQ ID NO: 710368 - RNA, 64 nt, Homo Sapiens; identical to SEQ ID NO: 37108

SEQ ID NO: 710369 - RNA, 64 nt, Homo Sapiens; identical to SEQ ID NO: 37109

SEQ ID NO: 710370 - RNA, 64 nt, Homo Sapiens; identical to SEQ ID NO: 37110

SEQ ID NO: 710371 - RNA, 64 nt, Homo Sapiens; identical to SEQ ID NO: 37111

SEQ ID NO: 710372 - RNA, 64 nt, Homo Sapiens; identical to SEQ ID NO: 37112

SEQ ID NO: 710373 - RNA, 64 nt, Homo Sapiens; identical to SEQ ID NO: 37113

SEQ ID NO: 710374 - RNA, 64 nt, Homo Sapiens; identical to SEQ ID NO: 37114

SEQ ID NO: 710375 - RNA, 64 nt, Homo Sapiens; identical to SEQ ID NO: 37115

SEQ ID NO: 710376 - RNA, 64 nt, Homo Sapiens; identical to SEQ ID NO: 37116

SEQ ID NO: 710377 - RNA, 64 nt, Homo Sapiens; identical to SEQ ID NO: 37117

SEQ ID NO: 710378 - RNA, 64 nt, Homo Sapiens; identical to SEQ ID NO: 37118

SEQ ID NO: 710379 - RNA, 64 nt, Homo Sapiens; identical to SEQ ID NO: 37119

SEQ ID NO: 710380 - RNA, 64 nt, Homo Sapiens; identical to SEQ ID NO: 37120

SEQ ID NO: 710381 - RNA, 64 nt, Homo Sapiens; identical to SEQ ID NO: 37121

SEQ ID NO: 710382 - RNA, 64 nt, Homo Sapiens; identical to SEQ ID NO: 37122

SEQ ID NO: 710383 - RNA, 64 nt, Homo Sapiens; identical to SEQ ID NO: 37123

SEQ ID NO: 710384 - RNA, 64 nt, Homo Sapiens; identical to SEQ ID NO: 37124

SEQ ID NO: 710385 - RNA, 64 nt, Homo Sapiens; identical to SEQ ID NO: 37125

SEQ ID NO: 710386 - RNA, 64 nt, Homo Sapiens; identical to SEQ ID NO: 37126

SEQ ID NO: 710387 - RNA, 64 nt, Homo Sapiens; identical to SEQ ID NO: 37127

SEQ ID NO: 710388 - RNA, 64 nt, Homo Sapiens; identical to SEQ ID NO: 37128

SEQ ID NO: 710389 - RNA, 64 nt, Homo Sapiens; identical to SEQ ID NO: 37129

SEQ ID NO: 710390 - RNA, 64 nt, Homo Sapiens; identical to SEQ ID NO: 37130

SEQ ID NO: 710391 - RNA, 64 nt, Homo Sapiens; identical to SEQ ID NO: 37131

SEQ ID NO: 710392 - RNA, 64 nt, Homo Sapiens; identical to SEQ ID NO: 37132

SEQ ID NO: 710393 - RNA, 64 nt, Homo Sapiens; identical to SEQ ID NO: 37133

SEQ ID NO: 710394 - RNA, 64 nt, Homo Sapiens; identical to SEQ ID NO: 37134

SEQ ID NO: 710395 - RNA, 64 nt, Homo Sapiens; identical to SEQ ID NO: 37135

SEQ ID NO: 710396 - RNA, 64 nt, Homo Sapiens; identical to SEQ ID NO: 37136

SEQ ID NO: 710397 - RNA, 64 nt, Homo Sapiens; identical to SEQ ID NO: 37137

SEQ ID NO: 710398 - RNA, 64 nt, Homo Sapiens; identical to SEQ ID NO: 37138

SEQ ID NO: 710399 - RNA, 64 nt, Homo Sapiens; identical to SEQ ID NO: 37139

SEQ ID NO: 710400 - RNA, 64 nt, Homo Sapiens; identical to SEQ ID NO: 37140

SEQ ID NO: 710401 - RNA, 64 nt, Homo Sapiens; identical to SEQ ID NO: 37141

SEQ ID NO: 710402 - RNA, 64 nt, Homo Sapiens; identical to SEQ ID NO: 37142

SEQ ID NO: 710403 - RNA, 64 nt, Homo Sapiens; identical to SEQ ID NO: 37143

SEQ ID NO: 710404 - RNA, 64 nt, Homo Sapiens; identical to SEQ ID NO: 37144

SEQ ID NO: 710405 - RNA, 64 nt, Homo Sapiens; identical to SEQ ID NO: 37145

SEQ ID NO: 710406 - RNA, 64 nt, Homo Sapiens; identical to SEQ ID NO: 37146

SEQ ID NO: 710407 - RNA, 64 nt, Homo Sapiens; identical to SEQ ID NO: 37147

SEQ ID NO: 710408 - RNA, 64 nt, Homo Sapiens; identical to SEQ ID NO: 37148

SEQ ID NO: 710409 - RNA, 64 nt, Homo Sapiens; identical to SEQ ID NO: 37149

SEQ ID NO: 710410 - RNA, 64 nt, Homo Sapiens; identical to SEQ ID NO: 37150

SEQ ID NO: 710411 - RNA, 64 nt, Homo Sapiens; identical to SEQ ID NO: 37151

SEQ ID NO: 710412 - RNA, 63 nt, Homo Sapiens; identical to SEQ ID NO: 37152

SEQ ID NO: 710413 - RNA, 62 nt, Homo Sapiens; identical to SEQ ID NO: 37153

SEQ ID NO: 710414 - RNA, 64 nt, Homo Sapiens; identical to SEQ ID NO: 37154

SEQ ID NO: 710415 - RNA, 64 nt, Homo Sapiens; identical to SEQ ID NO: 37155

SEQ ID NO: 710416 - RNA, 64 nt, Homo Sapiens; identical to SEQ ID NO: 37156

SEQ ID NO: 710417 - RNA, 64 nt, Homo Sapiens; identical to SEQ ID NO: 37157

SEQ ID NO: 710418 - RNA, 64 nt, Homo Sapiens; identical to SEQ ID NO: 37158

SEQ ID NO: 710419 - RNA, 64 nt, Homo Sapiens; identical to SEQ ID NO: 37159

SEQ ID NO: 710420 - RNA, 64 nt, Homo Sapiens; identical to SEQ ID NO: 37160

SEQ ID NO: 710421 - RNA, 64 nt, Homo Sapiens; identical to SEQ ID NO: 37161

SEQ ID NO: 710422 - RNA, 64 nt, Homo Sapiens; identical to SEQ ID NO: 37162

SEQ ID NO: 710423 - RNA, 64 nt, Homo Sapiens; identical to SEQ ID NO: 37163

SEQ ID NO: 710424 - RNA, 64 nt, Homo Sapiens; identical to SEQ ID NO: 37164

SEQ ID NO: 710425 - RNA, 64 nt, Homo Sapiens; identical to SEQ ID NO: 37165

SEQ ID NO: 710426 - RNA, 64 nt, Homo Sapiens; identical to SEQ ID NO: 37166

SEQ ID NO: 710427 - RNA, 64 nt, Homo Sapiens; identical to SEQ ID NO: 37167

SEQ ID NO: 710428 - RNA, 64 nt, Homo Sapiens; identical to SEQ ID NO: 37168

SEQ ID NO: 710429 - RNA, 64 nt, Homo Sapiens; identical to SEQ ID NO: 37169

SEQ ID NO: 710430 - RNA, 64 nt, Homo Sapiens; identical to SEQ ID NO: 37170

SEQ ID NO: 710431 - RNA, 64 nt, Homo Sapiens; identical to SEQ ID NO: 37171

SEQ ID NO: 710432 - RNA, 64 nt, Homo Sapiens; identical to SEQ ID NO: 37172

SEQ ID NO: 710433 - RNA, 64 nt, Homo Sapiens; identical to SEQ ID NO: 37173

SEQ ID NO: 710434 - RNA, 64 nt, Homo Sapiens; identical to SEQ ID NO: 37174

SEQ ID NO: 710435 - RNA, 64 nt, Homo Sapiens; identical to SEQ ID NO: 37175

SEQ ID NO: 710436 - RNA, 64 nt, Homo Sapiens; identical to SEQ ID NO: 37176

SEQ ID NO: 710437 - RNA, 64 nt, Homo Sapiens; identical to SEQ ID NO: 37177

SEQ ID NO: 710438 - RNA, 64 nt, Homo Sapiens; identical to SEQ ID NO: 37178

SEQ ID NO: 710439 - RNA, 64 nt, Homo Sapiens; identical to SEQ ID NO: 37179

SEQ ID NO: 710440 - RNA, 64 nt, Homo Sapiens; identical to SEQ ID NO: 37180

SEQ ID NO: 710441 - RNA, 64 nt, Homo Sapiens; identical to SEQ ID NO: 37181

SEQ ID NO: 710442 - RNA, 64 nt, Homo Sapiens; identical to SEQ ID NO: 37182

SEQ ID NO: 710443 - RNA, 64 nt, Homo Sapiens; identical to SEQ ID NO: 37183

SEQ ID NO: 710444 - RNA, 64 nt, Homo Sapiens; identical to SEQ ID NO: 37184

SEQ ID NO: 710445 - RNA, 64 nt, Homo Sapiens; identical to SEQ ID NO: 37185

SEQ ID NO: 710446 - RNA, 64 nt, Homo Sapiens; identical to SEQ ID NO: 37186

SEQ ID NO: 710447 - RNA, 64 nt, Homo Sapiens; identical to SEQ ID NO: 37187

SEQ ID NO: 710448 - RNA, 64 nt, Homo Sapiens; identical to SEQ ID NO: 37188

SEQ ID NO: 710449 - RNA, 64 nt, Homo Sapiens; identical to SEQ ID NO: 37189

SEQ ID NO: 710450 - RNA, 64 nt, Homo Sapiens; identical to SEQ ID NO: 37190

SEQ ID NO: 710451 - RNA, 64 nt, Homo Sapiens; identical to SEQ ID NO: 37191

SEQ ID NO: 710452 - RNA, 64 nt, Homo Sapiens; identical to SEQ ID NO: 37192

SEQ ID NO: 710453 - RNA, 64 nt, Homo Sapiens; identical to SEQ ID NO: 37193

SEQ ID NO: 710454 - RNA, 64 nt, Homo Sapiens; identical to SEQ ID NO: 37194

SEQ ID NO: 710455 - RNA, 64 nt, Homo Sapiens; identical to SEQ ID NO: 37195

SEQ ID NO: 710456 - RNA, 64 nt, Homo Sapiens; identical to SEQ ID NO: 37196

SEQ ID NO: 710457 - RNA, 64 nt, Homo Sapiens; identical to SEQ ID NO: 37197

SEQ ID NO: 710458 - RNA, 64 nt, Homo Sapiens; identical to SEQ ID NO: 37198

SEQ ID NO: 710459 - RNA, 64 nt, Homo Sapiens; identical to SEQ ID NO: 37199

SEQ ID NO: 710460 - RNA, 64 nt, Homo Sapiens; identical to SEQ ID NO: 37200

SEQ ID NO: 710461 - RNA, 64 nt, Homo Sapiens; identical to SEQ ID NO: 37201

SEQ ID NO: 710462 - RNA, 64 nt, Homo Sapiens; identical to SEQ ID NO: 37202

SEQ ID NO: 710463 - RNA, 64 nt, Homo Sapiens; identical to SEQ ID NO: 37203

SEQ ID NO: 710464 - RNA, 64 nt, Homo Sapiens; identical to SEQ ID NO: 37204

SEQ ID NO: 710465 - RNA, 64 nt, Homo Sapiens; identical to SEQ ID NO: 37205

SEQ ID NO: 710466 - RNA, 64 nt, Homo Sapiens; identical to SEQ ID NO: 37206

SEQ ID NO: 710467 - RNA, 64 nt, Homo Sapiens; identical to SEQ ID NO: 37207

SEQ ID NO: 710468 - RNA, 64 nt, Homo Sapiens; identical to SEQ ID NO: 37208

SEQ ID NO: 710469 - RNA, 64 nt, Homo Sapiens; identical to SEQ ID NO: 37209

SEQ ID NO: 710470 - RNA, 64 nt, Homo Sapiens; identical to SEQ ID NO: 37210

SEQ ID NO: 710471 - RNA, 64 nt, Homo Sapiens; identical to SEQ ID NO: 37211

SEQ ID NO: 710472 - RNA, 64 nt, Homo Sapiens; identical to SEQ ID NO: 37212

SEQ ID NO: 710473 - RNA, 64 nt, Homo Sapiens; identical to SEQ ID NO: 37213

SEQ ID NO: 710474 - RNA, 64 nt, Homo Sapiens; identical to SEQ ID NO: 37214

SEQ ID NO: 710475 - RNA, 64 nt, Homo Sapiens; identical to SEQ ID NO: 37215

SEQ ID NO: 710476 - RNA, 64 nt, Homo Sapiens; identical to SEQ ID NO: 37216

SEQ ID NO: 710477 - RNA, 64 nt, Homo Sapiens; identical to SEQ ID NO: 37217

SEQ ID NO: 710478 - RNA, 64 nt, Homo Sapiens; identical to SEQ ID NO: 37218

SEQ ID NO: 710479 - RNA, 64 nt, Homo Sapiens; identical to SEQ ID NO: 37219

SEQ ID NO: 710480 - RNA, 64 nt, Homo Sapiens; identical to SEQ ID NO: 37220

SEQ ID NO: 710481 - RNA, 64 nt, Homo Sapiens; identical to SEQ ID NO: 37221

SEQ ID NO: 710482 - RNA, 64 nt, Homo Sapiens; identical to SEQ ID NO: 37222

SEQ ID NO: 710483 - RNA, 64 nt, Homo Sapiens; identical to SEQ ID NO: 37223

SEQ ID NO: 710484 - RNA, 64 nt, Homo Sapiens; identical to SEQ ID NO: 37224

SEQ ID NO: 710485 - RNA, 64 nt, Homo Sapiens; identical to SEQ ID NO: 37225

SEQ ID NO: 710486 - RNA, 64 nt, Homo Sapiens; identical to SEQ ID NO: 37226

SEQ ID NO: 710487 - RNA, 64 nt, Homo Sapiens; identical to SEQ ID NO: 37227

SEQ ID NO: 710488 - RNA, 64 nt, Homo Sapiens; identical to SEQ ID NO: 37228

SEQ ID NO: 710489 - RNA, 64 nt, Homo Sapiens; identical to SEQ ID NO: 37229

SEQ ID NO: 710490 - RNA, 64 nt, Homo Sapiens; identical to SEQ ID NO: 37230

SEQ ID NO: 710491 - RNA, 64 nt, Homo Sapiens; identical to SEQ ID NO: 37231

SEQ ID NO: 710492 - RNA, 64 nt, Homo Sapiens; identical to SEQ ID NO: 37232

SEQ ID NO: 710493 - RNA, 64 nt, Homo Sapiens; identical to SEQ ID NO: 37233

SEQ ID NO: 710494 - RNA, 64 nt, Homo Sapiens; identical to SEQ ID NO: 37234

SEQ ID NO: 710495 - RNA, 64 nt, Homo Sapiens; identical to SEQ ID NO: 37235

SEQ ID NO: 710496 - RNA, 64 nt, Homo Sapiens; identical to SEQ ID NO: 37236

SEQ ID NO: 710497 - RNA, 64 nt, Homo Sapiens; identical to SEQ ID NO: 37237

SEQ ID NO: 710498 - RNA, 64 nt, Homo Sapiens; identical to SEQ ID NO: 37238

SEQ ID NO: 710499 - RNA, 64 nt, Homo Sapiens; identical to SEQ ID NO: 37239

SEQ ID NO: 710500 - RNA, 64 nt, Homo Sapiens; identical to SEQ ID NO: 37240

SEQ ID NO: 710501 - RNA, 64 nt, Homo Sapiens; identical to SEQ ID NO: 37241

SEQ ID NO: 710502 - RNA, 64 nt, Homo Sapiens; identical to SEQ ID NO: 37242

SEQ ID NO: 710503 - RNA, 64 nt, Homo Sapiens; identical to SEQ ID NO: 37243

SEQ ID NO: 710504 - RNA, 64 nt, Homo Sapiens; identical to SEQ ID NO: 37244

SEQ ID NO: 710505 - RNA, 64 nt, Homo Sapiens; identical to SEQ ID NO: 37245

SEQ ID NO: 710506 - RNA, 64 nt, Homo Sapiens; identical to SEQ ID NO: 37246

SEQ ID NO: 710507 - RNA, 64 nt, Homo Sapiens; identical to SEQ ID NO: 37247

SEQ ID NO: 710508 - RNA, 64 nt, Homo Sapiens; identical to SEQ ID NO: 37248

SEQ ID NO: 710509 - RNA, 64 nt, Homo Sapiens; identical to SEQ ID NO: 37249

SEQ ID NO: 710510 - RNA, 64 nt, Homo Sapiens; identical to SEQ ID NO: 37250

SEQ ID NO: 710511 - RNA, 64 nt, Homo Sapiens; identical to SEQ ID NO: 37251

SEQ ID NO: 710512 - RNA, 64 nt, Homo Sapiens; identical to SEQ ID NO: 37252

SEQ ID NO: 710513 - RNA, 64 nt, Homo Sapiens; identical to SEQ ID NO: 37253

SEQ ID NO: 710514 - RNA, 64 nt, Homo Sapiens; identical to SEQ ID NO: 37254

SEQ ID NO: 710515 - RNA, 64 nt, Homo Sapiens; identical to SEQ ID NO: 37255

SEQ ID NO: 710516 - RNA, 64 nt, Homo Sapiens; identical to SEQ ID NO: 37256

SEQ ID NO: 710517 - RNA, 64 nt, Homo Sapiens; identical to SEQ ID NO: 37257

SEQ ID NO: 710518 - RNA, 64 nt, Homo Sapiens; identical to SEQ ID NO: 37258

SEQ ID NO: 710519 - RNA, 64 nt, Homo Sapiens; identical to SEQ ID NO: 37259

SEQ ID NO: 710520 - RNA, 64 nt, Homo Sapiens; identical to SEQ ID NO: 37260

SEQ ID NO: 710521 - RNA, 64 nt, Homo Sapiens; identical to SEQ ID NO: 37261

SEQ ID NO: 710522 - RNA, 64 nt, Homo Sapiens; identical to SEQ ID NO: 37262

SEQ ID NO: 710523 - RNA, 64 nt, Homo Sapiens; identical to SEQ ID NO: 37263

SEQ ID NO: 710524 - RNA, 64 nt, Homo Sapiens; identical to SEQ ID NO: 37264

SEQ ID NO: 710525 - RNA, 64 nt, Homo Sapiens; identical to SEQ ID NO: 37265

SEQ ID NO: 710526 - RNA, 64 nt, Homo Sapiens; identical to SEQ ID NO: 37266

SEQ ID NO: 710527 - RNA, 64 nt, Homo Sapiens; identical to SEQ ID NO: 37267

SEQ ID NO: 710528 - RNA, 64 nt, Homo Sapiens; identical to SEQ ID NO: 37268

SEQ ID NO: 710529 - RNA, 64 nt, Homo Sapiens; identical to SEQ ID NO: 37269

SEQ ID NO: 710530 - RNA, 64 nt, Homo Sapiens; identical to SEQ ID NO: 37270

SEQ ID NO: 710531 - RNA, 64 nt, Homo Sapiens; identical to SEQ ID NO: 37271

SEQ ID NO: 710532 - RNA, 64 nt, Homo Sapiens; identical to SEQ ID NO: 37272

SEQ ID NO: 710533 - RNA, 64 nt, Homo Sapiens; identical to SEQ ID NO: 37273

SEQ ID NO: 710534 - RNA, 64 nt, Homo Sapiens; identical to SEQ ID NO: 37274

SEQ ID NO: 710535 - RNA, 64 nt, Homo Sapiens; identical to SEQ ID NO: 37275

SEQ ID NO: 710536 - RNA, 64 nt, Homo Sapiens; identical to SEQ ID NO: 37276

SEQ ID NO: 710537 - RNA, 64 nt, Homo Sapiens; identical to SEQ ID NO: 37277

SEQ ID NO: 710538 - RNA, 64 nt, Homo Sapiens; identical to SEQ ID NO: 37278

SEQ ID NO: 710539 - RNA, 64 nt, Homo Sapiens; identical to SEQ ID NO: 37279

SEQ ID NO: 710540 - RNA, 64 nt, Homo Sapiens; identical to SEQ ID NO: 37280

SEQ ID NO: 710541 - RNA, 64 nt, Homo Sapiens; identical to SEQ ID NO: 37281

SEQ ID NO: 710542 - RNA, 64 nt, Homo Sapiens; identical to SEQ ID NO: 37282

SEQ ID NO: 710543 - RNA, 64 nt, Homo Sapiens; identical to SEQ ID NO: 37283

SEQ ID NO: 710544 - RNA, 64 nt, Homo Sapiens; identical to SEQ ID NO: 37284

SEQ ID NO: 710545 - RNA, 64 nt, Homo Sapiens; identical to SEQ ID NO: 37285

SEQ ID NO: 710546 - RNA, 64 nt, Homo Sapiens; identical to SEQ ID NO: 37286

SEQ ID NO: 710547 - RNA, 64 nt, Homo Sapiens; identical to SEQ ID NO: 37287

SEQ ID NO: 710548 - RNA, 64 nt, Homo Sapiens; identical to SEQ ID NO: 37288

SEQ ID NO: 710549 - RNA, 64 nt, Homo Sapiens; identical to SEQ ID NO: 37289

SEQ ID NO: 710550 - RNA, 64 nt, Homo Sapiens; identical to SEQ ID NO: 37290

SEQ ID NO: 710551 - RNA, 64 nt, Homo Sapiens; identical to SEQ ID NO: 37291

SEQ ID NO: 710552 - RNA, 64 nt, Homo Sapiens; identical to SEQ ID NO: 37292

SEQ ID NO: 710553 - RNA, 64 nt, Homo Sapiens; identical to SEQ ID NO: 37293

SEQ ID NO: 710554 - RNA, 64 nt, Homo Sapiens; identical to SEQ ID NO: 37294

SEQ ID NO: 710555 - RNA, 64 nt, Homo Sapiens; identical to SEQ ID NO: 37295

SEQ ID NO: 710556 - RNA, 64 nt, Homo Sapiens; identical to SEQ ID NO: 37296

SEQ ID NO: 710557 - RNA, 64 nt, Homo Sapiens; identical to SEQ ID NO: 37297

SEQ ID NO: 710558 - RNA, 64 nt, Homo Sapiens; identical to SEQ ID NO: 37298

SEQ ID NO: 710559 - RNA, 64 nt, Homo Sapiens; identical to SEQ ID NO: 37299

SEQ ID NO: 710560 - RNA, 64 nt, Homo Sapiens; identical to SEQ ID NO: 37300

SEQ ID NO: 710561 - RNA, 64 nt, Homo Sapiens; identical to SEQ ID NO: 37301

SEQ ID NO: 710562 - RNA, 64 nt, Homo Sapiens; identical to SEQ ID NO: 37302

SEQ ID NO: 710563 - RNA, 64 nt, Homo Sapiens; identical to SEQ ID NO: 37303

SEQ ID NO: 710564 - RNA, 64 nt, Homo Sapiens; identical to SEQ ID NO: 37304

SEQ ID NO: 710565 - RNA, 64 nt, Homo Sapiens; identical to SEQ ID NO: 37305

SEQ ID NO: 710566 - RNA, 64 nt, Homo Sapiens; identical to SEQ ID NO: 37306

SEQ ID NO: 710567 - RNA, 64 nt, Homo Sapiens; identical to SEQ ID NO: 37307

SEQ ID NO: 710568 - RNA, 64 nt, Homo Sapiens; identical to SEQ ID NO: 37308

SEQ ID NO: 710569 - RNA, 64 nt, Homo Sapiens; identical to SEQ ID NO: 37309

SEQ ID NO: 710570 - RNA, 64 nt, Homo Sapiens; identical to SEQ ID NO: 37310

SEQ ID NO: 710571 - RNA, 64 nt, Homo Sapiens; identical to SEQ ID NO: 37311

SEQ ID NO: 710572 - RNA, 64 nt, Homo Sapiens; identical to SEQ ID NO: 37312

SEQ ID NO: 710573 - RNA, 64 nt, Homo Sapiens; identical to SEQ ID NO: 37313

SEQ ID NO: 710574 - RNA, 64 nt, Homo Sapiens; identical to SEQ ID NO: 37314

SEQ ID NO: 710575 - RNA, 64 nt, Homo Sapiens; identical to SEQ ID NO: 37315

SEQ ID NO: 710576 - RNA, 64 nt, Homo Sapiens; identical to SEQ ID NO: 37316

SEQ ID NO: 710577 - RNA, 64 nt, Homo Sapiens; identical to SEQ ID NO: 37317

SEQ ID NO: 710578 - RNA, 64 nt, Homo Sapiens; identical to SEQ ID NO: 37318

SEQ ID NO: 710579 - RNA, 64 nt, Homo Sapiens; identical to SEQ ID NO: 37319

SEQ ID NO: 710580 - RNA, 64 nt, Homo Sapiens; identical to SEQ ID NO: 37320

SEQ ID NO: 710581 - RNA, 64 nt, Homo Sapiens; identical to SEQ ID NO: 37321

SEQ ID NO: 710582 - RNA, 64 nt, Homo Sapiens; identical to SEQ ID NO: 37322

SEQ ID NO: 710583 - RNA, 64 nt, Homo Sapiens; identical to SEQ ID NO: 37323

SEQ ID NO: 710584 - RNA, 64 nt, Homo Sapiens; identical to SEQ ID NO: 37324

SEQ ID NO: 710585 - RNA, 64 nt, Homo Sapiens; identical to SEQ ID NO: 37325

SEQ ID NO: 710586 - RNA, 64 nt, Homo Sapiens; identical to SEQ ID NO: 37326

SEQ ID NO: 710587 - RNA, 64 nt, Homo Sapiens; identical to SEQ ID NO: 37327

SEQ ID NO: 710588 - RNA, 64 nt, Homo Sapiens; identical to SEQ ID NO: 37328

SEQ ID NO: 710589 - RNA, 64 nt, Homo Sapiens; identical to SEQ ID NO: 37329

SEQ ID NO: 710590 - RNA, 64 nt, Homo Sapiens; identical to SEQ ID NO: 37330

SEQ ID NO: 710591 - RNA, 64 nt, Homo Sapiens; identical to SEQ ID NO: 37331

SEQ ID NO: 710592 - RNA, 64 nt, Homo Sapiens; identical to SEQ ID NO: 37332

SEQ ID NO: 710593 - RNA, 64 nt, Homo Sapiens; identical to SEQ ID NO: 37333

SEQ ID NO: 710594 - RNA, 64 nt, Homo Sapiens; identical to SEQ ID NO: 37334

SEQ ID NO: 710595 - RNA, 64 nt, Homo Sapiens; identical to SEQ ID NO: 37335

SEQ ID NO: 710596 - RNA, 64 nt, Homo Sapiens; identical to SEQ ID NO: 37336

SEQ ID NO: 710597 - RNA, 64 nt, Homo Sapiens; identical to SEQ ID NO: 37337

SEQ ID NO: 710598 - RNA, 64 nt, Homo Sapiens; identical to SEQ ID NO: 37338

SEQ ID NO: 710599 - RNA, 64 nt, Homo Sapiens; identical to SEQ ID NO: 37339

SEQ ID NO: 710600 - RNA, 64 nt, Homo Sapiens; identical to SEQ ID NO: 37340

SEQ ID NO: 710601 - RNA, 64 nt, Homo Sapiens; identical to SEQ ID NO: 37341

SEQ ID NO: 710602 - RNA, 64 nt, Homo Sapiens; identical to SEQ ID NO: 37342

SEQ ID NO: 710603 - RNA, 64 nt, Homo Sapiens; identical to SEQ ID NO: 37343

SEQ ID NO: 710604 - RNA, 64 nt, Homo Sapiens; identical to SEQ ID NO: 37344

SEQ ID NO: 710605 - RNA, 64 nt, Homo Sapiens; identical to SEQ ID NO: 37345

SEQ ID NO: 710606 - RNA, 64 nt, Homo Sapiens; identical to SEQ ID NO: 37346

SEQ ID NO: 710607 - RNA, 64 nt, Homo Sapiens; identical to SEQ ID NO: 37347

SEQ ID NO: 710608 - RNA, 64 nt, Homo Sapiens; identical to SEQ ID NO: 37348

SEQ ID NO: 710609 - RNA, 64 nt, Homo Sapiens; identical to SEQ ID NO: 37349

SEQ ID NO: 710610 - RNA, 64 nt, Homo Sapiens; identical to SEQ ID NO: 37350

SEQ ID NO: 710611 - RNA, 64 nt, Homo Sapiens; identical to SEQ ID NO: 37351

SEQ ID NO: 710612 - RNA, 64 nt, Homo Sapiens; identical to SEQ ID NO: 37352

SEQ ID NO: 710613 - RNA, 64 nt, Homo Sapiens; identical to SEQ ID NO: 37353

SEQ ID NO: 710614 - RNA, 64 nt, Homo Sapiens; identical to SEQ ID NO: 37354

SEQ ID NO: 710615 - RNA, 64 nt, Homo Sapiens; identical to SEQ ID NO: 37355

SEQ ID NO: 710616 - RNA, 64 nt, Homo Sapiens; identical to SEQ ID NO: 37356

SEQ ID NO: 710617 - RNA, 64 nt, Homo Sapiens; identical to SEQ ID NO: 37357

SEQ ID NO: 710618 - RNA, 64 nt, Homo Sapiens; identical to SEQ ID NO: 37358

SEQ ID NO: 710619 - RNA, 64 nt, Homo Sapiens; identical to SEQ ID NO: 37359

SEQ ID NO: 710620 - RNA, 64 nt, Homo Sapiens; identical to SEQ ID NO: 37360

SEQ ID NO: 710621 - RNA, 64 nt, Homo Sapiens; identical to SEQ ID NO: 37361

SEQ ID NO: 710622 - RNA, 64 nt, Homo Sapiens; identical to SEQ ID NO: 37362

SEQ ID NO: 710623 - RNA, 64 nt, Homo Sapiens; identical to SEQ ID NO: 37363

SEQ ID NO: 710624 - RNA, 64 nt, Homo Sapiens; identical to SEQ ID NO: 37364

SEQ ID NO: 710625 - RNA, 64 nt, Homo Sapiens; identical to SEQ ID NO: 37365

SEQ ID NO: 710626 - RNA, 64 nt, Homo Sapiens; identical to SEQ ID NO: 37366

SEQ ID NO: 710627 - RNA, 64 nt, Homo Sapiens; identical to SEQ ID NO: 37367

SEQ ID NO: 710628 - RNA, 64 nt, Homo Sapiens; identical to SEQ ID NO: 37368

SEQ ID NO: 710629 - RNA, 64 nt, Homo Sapiens; identical to SEQ ID NO: 37369

SEQ ID NO: 710630 - RNA, 64 nt, Homo Sapiens; identical to SEQ ID NO: 37370

SEQ ID NO: 710631 - RNA, 64 nt, Homo Sapiens; identical to SEQ ID NO: 37371

SEQ ID NO: 710632 - RNA, 64 nt, Homo Sapiens; identical to SEQ ID NO: 37372

SEQ ID NO: 710633 - RNA, 64 nt, Homo Sapiens; identical to SEQ ID NO: 37373

SEQ ID NO: 710634 - RNA, 64 nt, Homo Sapiens; identical to SEQ ID NO: 37374

SEQ ID NO: 710635 - RNA, 64 nt, Homo Sapiens; identical to SEQ ID NO: 37375

SEQ ID NO: 710636 - RNA, 64 nt, Homo Sapiens; identical to SEQ ID NO: 37376

SEQ ID NO: 710637 - RNA, 64 nt, Homo Sapiens; identical to SEQ ID NO: 37377

SEQ ID NO: 710638 - RNA, 64 nt, Homo Sapiens; identical to SEQ ID NO: 37378

SEQ ID NO: 710639 - RNA, 64 nt, Homo Sapiens; identical to SEQ ID NO: 37379

SEQ ID NO: 710640 - RNA, 64 nt, Homo Sapiens; identical to SEQ ID NO: 37380

SEQ ID NO: 710641 - RNA, 64 nt, Homo Sapiens; identical to SEQ ID NO: 37381

SEQ ID NO: 710642 - RNA, 64 nt, Homo Sapiens; identical to SEQ ID NO: 37382

SEQ ID NO: 710643 - RNA, 64 nt, Homo Sapiens; identical to SEQ ID NO: 37383

SEQ ID NO: 710644 - RNA, 64 nt, Homo Sapiens; identical to SEQ ID NO: 37384

SEQ ID NO: 710645 - RNA, 64 nt, Homo Sapiens; identical to SEQ ID NO: 37385

SEQ ID NO: 710646 - RNA, 64 nt, Homo Sapiens; identical to SEQ ID NO: 37386

SEQ ID NO: 710647 - RNA, 64 nt, Homo Sapiens; identical to SEQ ID NO: 37387

SEQ ID NO: 710648 - RNA, 64 nt, Homo Sapiens; identical to SEQ ID NO: 37388

SEQ ID NO: 710649 - RNA, 64 nt, Homo Sapiens; identical to SEQ ID NO: 37389

SEQ ID NO: 710650 - RNA, 64 nt, Homo Sapiens; identical to SEQ ID NO: 37390

SEQ ID NO: 710651 - RNA, 64 nt, Homo Sapiens; identical to SEQ ID NO: 37391

SEQ ID NO: 710652 - RNA, 64 nt, Homo Sapiens; identical to SEQ ID NO: 37392

SEQ ID NO: 710653 - RNA, 64 nt, Homo Sapiens; identical to SEQ ID NO: 37393

SEQ ID NO: 710654 - RNA, 64 nt, Homo Sapiens; identical to SEQ ID NO: 37394

SEQ ID NO: 710655 - RNA, 64 nt, Homo Sapiens; identical to SEQ ID NO: 37395

SEQ ID NO: 710656 - RNA, 64 nt, Homo Sapiens; identical to SEQ ID NO: 37396

SEQ ID NO: 710657 - RNA, 64 nt, Homo Sapiens; identical to SEQ ID NO: 37397

SEQ ID NO: 710658 - RNA, 64 nt, Homo Sapiens; identical to SEQ ID NO: 37398

SEQ ID NO: 710659 - RNA, 64 nt, Homo Sapiens; identical to SEQ ID NO: 37399

SEQ ID NO: 710660 - RNA, 64 nt, Homo Sapiens; identical to SEQ ID NO: 37400

SEQ ID NO: 710661 - RNA, 64 nt, Homo Sapiens; identical to SEQ ID NO: 37401

SEQ ID NO: 710662 - RNA, 64 nt, Homo Sapiens; identical to SEQ ID NO: 37402

SEQ ID NO: 710663 - RNA, 64 nt, Homo Sapiens; identical to SEQ ID NO: 37403

SEQ ID NO: 710664 - RNA, 64 nt, Homo Sapiens; identical to SEQ ID NO: 37404

SEQ ID NO: 710665 - RNA, 64 nt, Homo Sapiens; identical to SEQ ID NO: 37405

SEQ ID NO: 710666 - RNA, 64 nt, Homo Sapiens; identical to SEQ ID NO: 37406

SEQ ID NO: 710667 - RNA, 64 nt, Homo Sapiens; identical to SEQ ID NO: 37407

SEQ ID NO: 710668 - RNA, 64 nt, Homo Sapiens; identical to SEQ ID NO: 37408

SEQ ID NO: 710669 - RNA, 64 nt, Homo Sapiens; identical to SEQ ID NO: 37409

SEQ ID NO: 710670 - RNA, 64 nt, Homo Sapiens; identical to SEQ ID NO: 37410

SEQ ID NO: 710671 - RNA, 64 nt, Homo Sapiens; identical to SEQ ID NO: 37411

SEQ ID NO: 710672 - RNA, 64 nt, Homo Sapiens; identical to SEQ ID NO: 37412

SEQ ID NO: 710673 - RNA, 64 nt, Homo Sapiens; identical to SEQ ID NO: 37413

SEQ ID NO: 710674 - RNA, 64 nt, Homo Sapiens; identical to SEQ ID NO: 37414

SEQ ID NO: 710675 - RNA, 64 nt, Homo Sapiens; identical to SEQ ID NO: 37415

SEQ ID NO: 710676 - RNA, 64 nt, Homo Sapiens; identical to SEQ ID NO: 37416

SEQ ID NO: 710677 - RNA, 64 nt, Homo Sapiens; identical to SEQ ID NO: 37417

SEQ ID NO: 710678 - RNA, 64 nt, Homo Sapiens; identical to SEQ ID NO: 37418

SEQ ID NO: 710679 - RNA, 64 nt, Homo Sapiens; identical to SEQ ID NO: 37419

SEQ ID NO: 710680 - RNA, 64 nt, Homo Sapiens; identical to SEQ ID NO: 37420

SEQ ID NO: 710681 - RNA, 64 nt, Homo Sapiens; identical to SEQ ID NO: 37421

SEQ ID NO: 710682 - RNA, 64 nt, Homo Sapiens; identical to SEQ ID NO: 37422

SEQ ID NO: 710683 - RNA, 64 nt, Homo Sapiens; identical to SEQ ID NO: 37423

SEQ ID NO: 710684 - RNA, 64 nt, Homo Sapiens; identical to SEQ ID NO: 37424

SEQ ID NO: 710685 - RNA, 64 nt, Homo Sapiens; identical to SEQ ID NO: 37425

SEQ ID NO: 710686 - RNA, 64 nt, Homo Sapiens; identical to SEQ ID NO: 37426

SEQ ID NO: 710687 - RNA, 64 nt, Homo Sapiens; identical to SEQ ID NO: 37427

SEQ ID NO: 710688 - RNA, 64 nt, Homo Sapiens; identical to SEQ ID NO: 37428

SEQ ID NO: 710689 - RNA, 64 nt, Homo Sapiens; identical to SEQ ID NO: 37429

SEQ ID NO: 710690 - RNA, 64 nt, Homo Sapiens; identical to SEQ ID NO: 37430

SEQ ID NO: 710691 - RNA, 64 nt, Homo Sapiens; identical to SEQ ID NO: 37431

SEQ ID NO: 710692 - RNA, 64 nt, Homo Sapiens; identical to SEQ ID NO: 37432

SEQ ID NO: 710693 - RNA, 64 nt, Homo Sapiens; identical to SEQ ID NO: 37433

SEQ ID NO: 710694 - RNA, 64 nt, Homo Sapiens; identical to SEQ ID NO: 37434

SEQ ID NO: 710695 - RNA, 64 nt, Homo Sapiens; identical to SEQ ID NO: 37435

SEQ ID NO: 710696 - RNA, 64 nt, Homo Sapiens; identical to SEQ ID NO: 37436

SEQ ID NO: 710697 - RNA, 64 nt, Homo Sapiens; identical to SEQ ID NO: 37437

SEQ ID NO: 710698 - RNA, 64 nt, Homo Sapiens; identical to SEQ ID NO: 37438

SEQ ID NO: 710699 - RNA, 64 nt, Homo Sapiens; identical to SEQ ID NO: 37439

SEQ ID NO: 710700 - RNA, 64 nt, Homo Sapiens; identical to SEQ ID NO: 37440

SEQ ID NO: 710701 - RNA, 64 nt, Homo Sapiens; identical to SEQ ID NO: 37441

SEQ ID NO: 710702 - RNA, 64 nt, Homo Sapiens; identical to SEQ ID NO: 37442

SEQ ID NO: 710703 - RNA, 64 nt, Homo Sapiens; identical to SEQ ID NO: 37443

SEQ ID NO: 710704 - RNA, 64 nt, Homo Sapiens; identical to SEQ ID NO: 37444

SEQ ID NO: 710705 - RNA, 64 nt, Homo Sapiens; identical to SEQ ID NO: 37445

SEQ ID NO: 710706 - RNA, 64 nt, Homo Sapiens; identical to SEQ ID NO: 37446

SEQ ID NO: 710707 - RNA, 64 nt, Homo Sapiens; identical to SEQ ID NO: 37447

SEQ ID NO: 710708 - RNA, 64 nt, Homo Sapiens; identical to SEQ ID NO: 37448

SEQ ID NO: 710709 - RNA, 64 nt, Homo Sapiens; identical to SEQ ID NO: 37449

SEQ ID NO: 710710 - RNA, 64 nt, Homo Sapiens; identical to SEQ ID NO: 37450

SEQ ID NO: 710711 - RNA, 64 nt, Homo Sapiens; identical to SEQ ID NO: 37451

SEQ ID NO: 710712 - RNA, 64 nt, Homo Sapiens; identical to SEQ ID NO: 37452

SEQ ID NO: 710713 - RNA, 64 nt, Homo Sapiens; identical to SEQ ID NO: 37453

SEQ ID NO: 710714 - RNA, 64 nt, Homo Sapiens; identical to SEQ ID NO: 37454

SEQ ID NO: 710715 - RNA, 64 nt, Homo Sapiens; identical to SEQ ID NO: 37455

SEQ ID NO: 710716 - RNA, 64 nt, Homo Sapiens; identical to SEQ ID NO: 37456

SEQ ID NO: 710717 - RNA, 64 nt, Homo Sapiens; identical to SEQ ID NO: 37457

SEQ ID NO: 710718 - RNA, 64 nt, Homo Sapiens; identical to SEQ ID NO: 37458

SEQ ID NO: 710719 - RNA, 64 nt, Homo Sapiens; identical to SEQ ID NO: 37459

SEQ ID NO: 710720 - RNA, 64 nt, Homo Sapiens; identical to SEQ ID NO: 37460

SEQ ID NO: 710721 - RNA, 64 nt, Homo Sapiens; identical to SEQ ID NO: 37461

SEQ ID NO: 710722 - RNA, 64 nt, Homo Sapiens; identical to SEQ ID NO: 37462

SEQ ID NO: 710723 - RNA, 64 nt, Homo Sapiens; identical to SEQ ID NO: 37463

SEQ ID NO: 710724 - RNA, 64 nt, Homo Sapiens; identical to SEQ ID NO: 37464

SEQ ID NO: 710725 - RNA, 64 nt, Homo Sapiens; identical to SEQ ID NO: 37465

SEQ ID NO: 710726 - RNA, 64 nt, Homo Sapiens; identical to SEQ ID NO: 37466

SEQ ID NO: 710727 - RNA, 64 nt, Homo Sapiens; identical to SEQ ID NO: 37467

SEQ ID NO: 710728 - RNA, 64 nt, Homo Sapiens; identical to SEQ ID NO: 37468

SEQ ID NO: 710729 - RNA, 64 nt, Homo Sapiens; identical to SEQ ID NO: 37469

SEQ ID NO: 710730 - RNA, 64 nt, Homo Sapiens; identical to SEQ ID NO: 37470

SEQ ID NO: 710731 - RNA, 64 nt, Homo Sapiens; identical to SEQ ID NO: 37471

SEQ ID NO: 710732 - RNA, 64 nt, Homo Sapiens; identical to SEQ ID NO: 37472

SEQ ID NO: 710733 - RNA, 64 nt, Homo Sapiens; identical to SEQ ID NO: 37473

SEQ ID NO: 710734 - RNA, 64 nt, Homo Sapiens; identical to SEQ ID NO: 37474

SEQ ID NO: 710735 - RNA, 64 nt, Homo Sapiens; identical to SEQ ID NO: 37475

SEQ ID NO: 710736 - RNA, 64 nt, Homo Sapiens; identical to SEQ ID NO: 37476

SEQ ID NO: 710737 - RNA, 64 nt, Homo Sapiens; identical to SEQ ID NO: 37477

SEQ ID NO: 710738 - RNA, 64 nt, Homo Sapiens; identical to SEQ ID NO: 37478

SEQ ID NO: 710739 - RNA, 64 nt, Homo Sapiens; identical to SEQ ID NO: 37479

SEQ ID NO: 710740 - RNA, 64 nt, Homo Sapiens; identical to SEQ ID NO: 37480

SEQ ID NO: 710741 - RNA, 64 nt, Homo Sapiens; identical to SEQ ID NO: 37481

SEQ ID NO: 710742 - RNA, 64 nt, Homo Sapiens; identical to SEQ ID NO: 37482

SEQ ID NO: 710743 - RNA, 64 nt, Homo Sapiens; identical to SEQ ID NO: 37483

SEQ ID NO: 710744 - RNA, 64 nt, Homo Sapiens; identical to SEQ ID NO: 37484

SEQ ID NO: 710745 - RNA, 64 nt, Homo Sapiens; identical to SEQ ID NO: 37485

SEQ ID NO: 710746 - RNA, 64 nt, Homo Sapiens; identical to SEQ ID NO: 37486

SEQ ID NO: 710747 - RNA, 64 nt, Homo Sapiens; identical to SEQ ID NO: 37487

SEQ ID NO: 710748 - RNA, 64 nt, Homo Sapiens; identical to SEQ ID NO: 37488

SEQ ID NO: 710749 - RNA, 64 nt, Homo Sapiens; identical to SEQ ID NO: 37489

SEQ ID NO: 710750 - RNA, 64 nt, Homo Sapiens; identical to SEQ ID NO: 37490

SEQ ID NO: 710751 - RNA, 64 nt, Homo Sapiens; identical to SEQ ID NO: 37491

SEQ ID NO: 710752 - RNA, 64 nt, Homo Sapiens; identical to SEQ ID NO: 37492

SEQ ID NO: 710753 - RNA, 64 nt, Homo Sapiens; identical to SEQ ID NO: 37493

SEQ ID NO: 710754 - RNA, 64 nt, Homo Sapiens; identical to SEQ ID NO: 37494

SEQ ID NO: 710755 - RNA, 64 nt, Homo Sapiens; identical to SEQ ID NO: 37495

SEQ ID NO: 710756 - RNA, 64 nt, Homo Sapiens; identical to SEQ ID NO: 37496

SEQ ID NO: 710757 - RNA, 64 nt, Homo Sapiens; identical to SEQ ID NO: 37497

SEQ ID NO: 710758 - RNA, 64 nt, Homo Sapiens; identical to SEQ ID NO: 37498

SEQ ID NO: 710759 - RNA, 64 nt, Homo Sapiens; identical to SEQ ID NO: 37499

SEQ ID NO: 710760 - RNA, 64 nt, Homo Sapiens; identical to SEQ ID NO: 37500

SEQ ID NO: 710761 - RNA, 64 nt, Homo Sapiens; identical to SEQ ID NO: 37501

SEQ ID NO: 710762 - RNA, 64 nt, Homo Sapiens; identical to SEQ ID NO: 37502

SEQ ID NO: 710763 - RNA, 64 nt, Homo Sapiens; identical to SEQ ID NO: 37503

SEQ ID NO: 710764 - RNA, 64 nt, Homo Sapiens; identical to SEQ ID NO: 37504

SEQ ID NO: 710765 - RNA, 64 nt, Homo Sapiens; identical to SEQ ID NO: 37505

SEQ ID NO: 710766 - RNA, 64 nt, Homo Sapiens; identical to SEQ ID NO: 37506

SEQ ID NO: 710767 - RNA, 64 nt, Homo Sapiens; identical to SEQ ID NO: 37507

SEQ ID NO: 710768 - RNA, 64 nt, Homo Sapiens; identical to SEQ ID NO: 37508

SEQ ID NO: 710769 - RNA, 64 nt, Homo Sapiens; identical to SEQ ID NO: 37509

SEQ ID NO: 710770 - RNA, 64 nt, Homo Sapiens; identical to SEQ ID NO: 37510

SEQ ID NO: 710771 - RNA, 64 nt, Homo Sapiens; identical to SEQ ID NO: 37511

SEQ ID NO: 710772 - RNA, 64 nt, Homo Sapiens; identical to SEQ ID NO: 37512

SEQ ID NO: 710773 - RNA, 64 nt, Homo Sapiens; identical to SEQ ID NO: 37513

SEQ ID NO: 710774 - RNA, 64 nt, Homo Sapiens; identical to SEQ ID NO: 37514

SEQ ID NO: 710775 - RNA, 64 nt, Homo Sapiens; identical to SEQ ID NO: 37515

SEQ ID NO: 710776 - RNA, 64 nt, Homo Sapiens; identical to SEQ ID NO: 37516

SEQ ID NO: 710777 - RNA, 64 nt, Homo Sapiens; identical to SEQ ID NO: 37517

SEQ ID NO: 710778 - RNA, 64 nt, Homo Sapiens; identical to SEQ ID NO: 37518

SEQ ID NO: 710779 - RNA, 64 nt, Homo Sapiens; identical to SEQ ID NO: 37519

SEQ ID NO: 710780 - RNA, 64 nt, Homo Sapiens; identical to SEQ ID NO: 37520

SEQ ID NO: 710781 - RNA, 64 nt, Homo Sapiens; identical to SEQ ID NO: 37521

SEQ ID NO: 710782 - RNA, 64 nt, Homo Sapiens; identical to SEQ ID NO: 37522

SEQ ID NO: 710783 - RNA, 64 nt, Homo Sapiens; identical to SEQ ID NO: 37523

SEQ ID NO: 710784 - RNA, 64 nt, Homo Sapiens; identical to SEQ ID NO: 37524

SEQ ID NO: 710785 - RNA, 64 nt, Homo Sapiens; identical to SEQ ID NO: 37525

SEQ ID NO: 710786 - RNA, 64 nt, Homo Sapiens; identical to SEQ ID NO: 37526

SEQ ID NO: 710787 - RNA, 64 nt, Homo Sapiens; identical to SEQ ID NO: 147936

SEQ ID NO: 710788 - RNA, 64 nt, Homo Sapiens; identical to SEQ ID NO: 147937

SEQ ID NO: 710789 - RNA, 64 nt, Homo Sapiens; identical to SEQ ID NO: 147938

SEQ ID NO: 710790 - RNA, 64 nt, Homo Sapiens; identical to SEQ ID NO: 147939

SEQ ID NO: 710791 - RNA, 64 nt, Homo Sapiens; identical to SEQ ID NO: 147940

SEQ ID NO: 710792 - RNA, 64 nt, Homo Sapiens; identical to SEQ ID NO: 147941

SEQ ID NO: 710793 - RNA, 64 nt, Homo Sapiens; identical to SEQ ID NO: 212638

SEQ ID NO: 710794 - RNA, 64 nt, Homo Sapiens; identical to SEQ ID NO: 212639

SEQ ID NO: 710795 - RNA, 64 nt, Homo Sapiens; identical to SEQ ID NO: 212640

SEQ ID NO: 710796 - RNA, 64 nt, Homo Sapiens; identical to SEQ ID NO: 212641

SEQ ID NO: 710797 - RNA, 64 nt, Homo Sapiens; identical to SEQ ID NO: 212642

SEQ ID NO: 710798 - RNA, 64 nt, Homo Sapiens; identical to SEQ ID NO: 212643

SEQ ID NO: 710799 - RNA, 64 nt, Homo Sapiens; identical to SEQ ID NO: 212644

SEQ ID NO: 710800 - RNA, 64 nt, Homo Sapiens; identical to SEQ ID NO: 212645

SEQ ID NO: 710801 - RNA, 64 nt, Homo Sapiens; identical to SEQ ID NO: 212646

SEQ ID NO: 710802 - RNA, 64 nt, Homo Sapiens; identical to SEQ ID NO: 212647

SEQ ID NO: 710803 - RNA, 64 nt, Homo Sapiens; identical to SEQ ID NO: 212648

SEQ ID NO: 710804 - RNA, 64 nt, Homo Sapiens; identical to SEQ ID NO: 212649

SEQ ID NO: 710805 - RNA, 64 nt, Homo Sapiens; identical to SEQ ID NO: 212650

SEQ ID NO: 710806 - RNA, 64 nt, Homo Sapiens; identical to SEQ ID NO: 212651

SEQ ID NO: 710807 - RNA, 64 nt, Homo Sapiens; identical to SEQ ID NO: 212652

SEQ ID NO: 710808 - RNA, 64 nt, Homo Sapiens; identical to SEQ ID NO: 212653

SEQ ID NO: 710809 - RNA, 64 nt, Homo Sapiens; identical to SEQ ID NO: 212654

SEQ ID NO: 710810 - RNA, 64 nt, Homo Sapiens; identical to SEQ ID NO: 212655

SEQ ID NO: 710811 - RNA, 64 nt, Homo Sapiens; identical to SEQ ID NO: 212656

SEQ ID NO: 710812 - RNA, 64 nt, Homo Sapiens; identical to SEQ ID NO: 212657

SEQ ID NO: 710813 - RNA, 64 nt, Homo Sapiens; identical to SEQ ID NO: 212658

SEQ ID NO: 710814 - RNA, 64 nt, Homo Sapiens; identical to SEQ ID NO: 212659

SEQ ID NO: 710815 - RNA, 64 nt, Homo Sapiens; identical to SEQ ID NO: 212660

SEQ ID NO: 710816 - RNA, 64 nt, Homo Sapiens; identical to SEQ ID NO: 212661

SEQ ID NO: 710817 - RNA, 64 nt, Homo Sapiens; identical to SEQ ID NO: 212662

SEQ ID NO: 710818 - RNA, 64 nt, Homo Sapiens; identical to SEQ ID NO: 212663

SEQ ID NO: 710819 - RNA, 64 nt, Homo Sapiens; identical to SEQ ID NO: 212664

SEQ ID NO: 710820 - RNA, 64 nt, Homo Sapiens; identical to SEQ ID NO: 212665

SEQ ID NO: 710821 - RNA, 64 nt, Homo Sapiens; identical to SEQ ID NO: 212666

SEQ ID NO: 710822 - RNA, 62 nt, Homo Sapiens; identical to SEQ ID NO: 212667

SEQ ID NO: 710823 - RNA, 64 nt, Homo Sapiens; identical to SEQ ID NO: 212668

SEQ ID NO: 710824 - RNA, 64 nt, Homo Sapiens; identical to SEQ ID NO: 212669

SEQ ID NO: 710825 - RNA, 64 nt, Homo Sapiens; identical to SEQ ID NO: 212670

SEQ ID NO: 710826 - RNA, 64 nt, Homo Sapiens; identical to SEQ ID NO: 212671

SEQ ID NO: 710827 - RNA, 64 nt, Homo Sapiens; identical to SEQ ID NO: 212672

SEQ ID NO: 710828 - RNA, 64 nt, Homo Sapiens; identical to SEQ ID NO: 212673

SEQ ID NO: 710829 - RNA, 64 nt, Homo Sapiens; identical to SEQ ID NO: 212674

SEQ ID NO: 710830 - RNA, 64 nt, Homo Sapiens; identical to SEQ ID NO: 212675

SEQ ID NO: 710831 - RNA, 64 nt, Homo Sapiens; identical to SEQ ID NO: 212676

SEQ ID NO: 710832 - RNA, 64 nt, Homo Sapiens; identical to SEQ ID NO: 212677

SEQ ID NO: 710833 - RNA, 64 nt, Homo Sapiens; identical to SEQ ID NO: 212678

SEQ ID NO: 710834 - RNA, 64 nt, Homo Sapiens; identical to SEQ ID NO: 212679

SEQ ID NO: 710835 - RNA, 64 nt, Homo Sapiens
guauggcaaauggauaaaauauuguggcaucaacuacuuuuaaaguagaaaagcuauccauuuu

SEQ ID NO: 710836 - RNA, 64 nt, Homo Sapiens
auugaaauaaagccucuuaaaaugaaaaaucauauacuuuuaacaucacuuuuaagcuaauaaa

SEQ ID NO: 710837 - RNA, 64 nt, Homo Sapiens
aaaaucucaacuauaaccaguuuagcuuuuuccuuacuuuuaaaauaaaauuuuuuacuuuuaa

SEQ ID NO: 710838 - RNA, 64 nt, Homo Sapiens
uuagcuuuuuccuuacuuuuaaaauaaaauuuuuuacuuuuaacuauuuuuuuaguuaauauuu

SEQ ID NO: 710839 - RNA, 64 nt, Homo Sapiens
aagaaaacacugcagaaauauggaaauugucaguuacuuuuagauuuuagggacaaagacauuu

SEQ ID NO: 710840 - RNA, 64 nt, Homo Sapiens
acauguaaguuauacuaauuauaaaugaaguauauacuuuuaaaauuaucaacuagagauauuu

SEQ ID NO: 710841 - RNA, 64 nt, Homo Sapiens
guagacuuucaaaaugagugauuuguuagcuugguacuuuuaaguuugugguacagauccucca

SEQ ID NO: 710842 - RNA, 64 nt, Homo Sapiens
ucaaaugaucuguucugcacugagccaagcaaguuacuuuuaaaacugguggcaccacucauuu

SEQ ID NO: 710843 - RNA, 64 nt, Homo Sapiens
ucaggaaacuuacucuaguacauucuuuaaggcauacuuuuacccaguuuuauagauugcacau

SEQ ID NO: 710844 - RNA, 64 nt, Homo Sapiens
ugcaaccacacuaauucacauguuacaucacucauacuuuuagcacucauuacgucgucauucu

SEQ ID NO: 710845 - RNA, 64 nt, Homo Sapiens
ugucauugaauuguagguuuccuuuuuuuuucuuuacuuuuaaauuuuaacuuuuaaaaucuau

SEQ ID NO: 710846 - RNA, 64 nt, Homo Sapiens
ugguuaauugccuuguaaauuuugcgugucuguauacuuuuauaccaacuuauuguaggcucuu

SEQ ID NO: 710847 - RNA, 64 nt, Homo Sapiens
cuucugcacagagcauaaugugaaguuuuauaccuacuuuuaaaauucugcuuuccagaaacaa

SEQ ID NO: 710848 - RNA, 64 nt, Homo Sapiens
uuuuuuuuccauuuuugcacuuaacagugaugaauacuuuuacguuggaauccuccuucuagcu

SEQ ID NO: 710849 - RNA, 64 nt, Homo Sapiens
uaaaguaaugagaauaaaaauguuggcccaaaauuacuuuuauaaauaaauaauuccaaaauaa

SEQ ID NO: 710850 - RNA, 64 nt, Homo Sapiens
uuuaacaauuaaaugccuauuuuguuauauguuauacuuuuauucuuaauucugaauuuugaca

SEQ ID NO: 710851 - RNA, 64 nt, Homo Sapiens
auauuuauuuuuuuuaaagugucacuguaagcuauacuuuuaaacaggucuaaaauacuacauu

SEQ ID NO: 710852 - RNA, 64 nt, Homo Sapiens
guacauauuucugucuugcguagccuuuauucuguacuuuuaaucagauauuauguauaucuuc

SEQ ID NO: 710853 - RNA, 64 nt, Homo Sapiens
gauguguacucuuccuauuguuuuaaaaaaaauuuacuuuuauuacaucaaaaagguauauacu

SEQ ID NO: 710854 - RNA, 64 nt, Homo Sapiens
acaaaauuaacaucaaaaagaugauguuuugagauacuuuuauauuauuuaucacacuguugua

SEQ ID NO: 710855 - RNA, 64 nt, Homo Sapiens
cuuuuagcauucguuuuuuagugaucgccuggaguacuuuuagaaaauuaauguucugacaguu

SEQ ID NO: 710856 - RNA, 64 nt, Homo Sapiens
gauggauauguuuuccuuuuucccagauuuaggguacuuuuauucaaacaguguaacagguccu

SEQ ID NO: 710857 - RNA, 64 nt, Homo Sapiens
uauguuuaaaaucugaauggcaguacuagcucuauacuuuuaauacugcuuuguauuuuauaug

SEQ ID NO: 710858 - RNA, 64 nt, Homo Sapiens
uguauuuaagaauuuucuguuuuaaugcauguuauacuuuuauguaggauuccaaaccuucccu

SEQ ID NO: 710859 - RNA, 64 nt, Homo Sapiens
aaaauuuaaugagagcuuauauguguacuuuuucuacuuuuagguaagugcaaaaugguauaua

SEQ ID NO: 710860 - RNA, 64 nt, Homo Sapiens
uuggauuuauuaugaagaacaaccuguaaaaaguuacuuuuaucaggcauuuugaaaaacuuuc

SEQ ID NO: 710861 - RNA, 64 nt, Homo Sapiens
accaugugccaucuguacauauuacuguugcauuuacuuuuaauaaagcuuguggccccuuuua

SEQ ID NO: 710862 - RNA, 64 nt, Homo Sapiens
cuucuugugauugcugccauaauucuaaguuauuuacuuuuaccacuauuuaaguuaucaacuu

SEQ ID NO: 710863 - RNA, 64 nt, Homo Sapiens
uuugguguguuacauagccauguuucuauuaguuuacuuuuaaaucucaaauuuaaguuauuau

SEQ ID NO: 710864 - RNA, 64 nt, Homo Sapiens
guuuauauacuuauuauuuuaucuuuaagcaugcuacuuuuacuuggccaauauuuucuuaugu

SEQ ID NO: 710865 - RNA, 64 nt, Homo Sapiens
auuaaauuauuguuaauaauauaacauauaagaauacuuuuauuaaaauaaccaugcaacaaua

SEQ ID NO: 710866 - RNA, 64 nt, Homo Sapiens
caaaaccaauauauaauuuggcugcugauuggcuuacuuuuagauuuaaaguuacuuuggguau

SEQ ID NO: 710867 - RNA, 64 nt, Homo Sapiens
ccccuauggaugaucuuuaggaaaagcagcccuuuacuuuuaauacaggcuuuaaugaacuaua

SEQ ID NO: 710868 - RNA, 64 nt, Homo Sapiens
cucaauuuuucauauugcaaagaguagcuuuuuguacuuuuauuacugagagaucuucauauac

SEQ ID NO: 710869 - RNA, 64 nt, Homo Sapiens
uguguuauaucaaaugugucuauuuguucuauaauacuuuuauguucuucaugugcaaagugac

SEQ ID NO: 710870 - RNA, 64 nt, Homo Sapiens
auuaaauguauugagguauuuuuuuuguagagcuuacuuuuauuuguaugauauguaaaacaga

SEQ ID NO: 710871 - RNA, 64 nt, Homo Sapiens
ugucgucuuccggggaagggcaugcgggagaggcuacuuuuaugccacugagaagcuagacuuu

SEQ ID NO: 710872 - RNA, 64 nt, Homo Sapiens
uuuucccaggacaggacagucucagagaggguccuacuuuuaggcaguuccugccuauaauggu

SEQ ID NO: 710873 - RNA, 64 nt, Homo Sapiens
acuuuagugccugacugcugguuuucaaauuggguacuuuuaacaggguaguggggugcauuug

SEQ ID NO: 710874 - RNA, 64 nt, Homo Sapiens
ggauggugaaauugguugcuagaaucccaguuuuuacuuuuacuacuuuggacuaauuuaaaaa

SEQ ID NO: 710875 - RNA, 64 nt, Homo Sapiens
uguguguguguguguauauauauauauauauuuuuacuuuuauccucuuaccgaagguuacacu

SEQ ID NO: 710876 - RNA, 64 nt, Homo Sapiens
guccuccucagucagaauagaaaaguaacugaaauacuuuuaccuuucuguccuugauaaaaua

SEQ ID NO: 710877 - RNA, 64 nt, Homo Sapiens
uuaaagaaauuuaauguuucucucaaaaauaauauacuuuuacagaugucucugacaaagugug

SEQ ID NO: 710878 - RNA, 64 nt, Homo Sapiens
caaguagaacaaaaacuauugcuugcuuaaggcauacuuuuaauuuuuagugcacuuaauauua

SEQ ID NO: 710879 - RNA, 64 nt, Homo Sapiens
uuuuuuguuuuuuuuuuaugccuaauccccaaccuacuuuuagugcucgcccaaagagauacaa

SEQ ID NO: 710880 - RNA, 64 nt, Homo Sapiens
uccccaaaccaccuuugucacuuucccuuaacucuacuuuuacaaggcugccugcacccccucc

SEQ ID NO: 710881 - RNA, 64 nt, Homo Sapiens
cuuccacccaaacuggaagcagugaguuccccucuacuuuuagcuaaauaucauuucucaagug

SEQ ID NO: 710882 - RNA, 64 nt, Homo Sapiens
ucugacuuuuagaaaccuagagaaaaauaacuuguacuuuuauuuuauaaaguugcuggauaga

SEQ ID NO: 710883 - RNA, 64 nt, Homo Sapiens
ccucuucugggcauuuaagcugguauguuagugcuacuuuuaagauuguggagucugaguuaau

SEQ ID NO: 710884 - RNA, 64 nt, Homo Sapiens
ggagacuagaguaucuaguuuuuaguauuuaaacuacuuuuaauuauuuauauugauacucucu

SEQ ID NO: 710885 - RNA, 64 nt, Homo Sapiens
aacauauugguaaaugauaccuagcuuagcaaaauacuuuuaaaauuugcccugaguauuaaag

SEQ ID NO: 710886 - RNA, 64 nt, Homo Sapiens
uaccuuucagguaguuacauaucuuuuucauuaauacuuuuaaaugaauacaggcuuucuagag

SEQ ID NO: 710887 - RNA, 64 nt, Homo Sapiens
auuugugguaauacccagaaaaaugcuaugcuucuacuuuuaaagguuuuuuaaaauaacuggc

SEQ ID NO: 710888 - RNA, 64 nt, Homo Sapiens
uucuuaaucuuuuuuuagaauuaauauuaaaauguacuuuuacaagauuuuuuaaaaugcuuuu

SEQ ID NO: 710889 - RNA, 64 nt, Homo Sapiens
uuaaugguaauaaaauagauaaauucuauuuguuuacuuuuauacuuauuugcgugcacugaca

SEQ ID NO: 710890 - RNA, 64 nt, Homo Sapiens
acaagauacuuaauauuuuuuaaaaauauuucucuacuuuuaaauugaaauagaaauaguucuu

SEQ ID NO: 710891 - RNA, 64 nt, Homo Sapiens
acuuuuuucuuuuaaauuauuaaagugucuuuuauacuuuuaugaaaucauugguagcccccca

SEQ ID NO: 710892 - RNA, 64 nt, Homo Sapiens
uucuuuagcucuugugauaagauuuucuuuuuuuuacuuuuauacaaaggcagcaucuuugaau

SEQ ID NO: 710893 - RNA, 64 nt, Homo Sapiens
aaaggaaaauguacauaugauauauaaagugccauacuuuuaaucauguaauuauuucugcugu

SEQ ID NO: 710894 - RNA, 64 nt, Homo Sapiens
gggaauaaggaauguuugcaguugaaacuuuuuuuacuuuuauuauuaagggcuuacagaacau

SEQ ID NO: 710895 - RNA, 64 nt, Homo Sapiens
aagaugguguccggaagaugggaucuagaaguuuuacuuuuauacucuacuguaguacauuuca

SEQ ID NO: 710896 - RNA, 51 nt, Homo Sapiens
uuuuauucuccuucagagcaauacuuuuaaccccagaguggguggcaguga

SEQ ID NO: 710897 - RNA, 64 nt, Homo Sapiens
aacauuaguguauuuauuucuuguuaaagaaugguacuuuuauaccaacuaauauaaaauacca

SEQ ID NO: 710898 - RNA, 64 nt, Homo Sapiens
uagaacccaaggaaugccuucuguugaauacuguuacuuuuauauaucagugauugccauuaga

SEQ ID NO: 710899 - RNA, 64 nt, Homo Sapiens
gacccuuuuuguaaaugucaaggacauuuggauuuacuuuuacagaauauugaaaagauaagac

SEQ ID NO: 710900 - RNA, 64 nt, Homo Sapiens
gaauguucauuaauguaaauuguauuuauuuuuauacuuuuauuuucacuaguuuugcuucuag

SEQ ID NO: 710901 - RNA, 64 nt, Homo Sapiens
gguuauuuagaauccaguggggauaggcuuuguauacuuuuauuuaccuccaaagauauuuuca

SEQ ID NO: 710902 - RNA, 64 nt, Homo Sapiens
aguagaaugauuucauuuaguuagauccuacauauacuuuuaucagaggcuuuagauuauuauu

SEQ ID NO: 710903 - RNA, 64 nt, Homo Sapiens
uagaaacugaacaucaagaaccccaccaaaauauuacuuuuaaaaacaaugacaaaccacacaa

SEQ ID NO: 710904 - RNA, 64 nt, Homo Sapiens
uauuggauuuacuucuuauauugagucagaugcauacuuuuagauuugcauuggggaaaaugua

SEQ ID NO: 710905 - RNA, 64 nt, Homo Sapiens
uuuuauuucugacccuguguuuacaaaacaaauguacuuuuaccuuauauuuguauauuuacag

SEQ ID NO: 710906 - RNA, 64 nt, Homo Sapiens
ucuaauagcucaagaacacaaacuuuaaaaauaauacuuuuagcuauuauucccuugcucauau

SEQ ID NO: 710907 - RNA, 64 nt, Homo Sapiens
auucccuugcucauauaacugacacgugaaaugauacuuuuauuagccgucuaugggauuaaaa

SEQ ID NO: 710908 - RNA, 64 nt, Homo Sapiens
aaaauauauacuuauauaauuuuauuauguaacauacuuuuauugaacaauuuuaaauuuauuu

SEQ ID NO: 710909 - RNA, 64 nt, Homo Sapiens
uauuuuaaaauguaaaauuagcaacccaguuuuauacuuuuaguauuuauccuuuguauuacaa

SEQ ID NO: 710910 - RNA, 64 nt, Homo Sapiens
uaaaaugcaguauauuuuuuguauauuuuacuaauacuuuuauauuauaaguaaauuaaaauua

SEQ ID NO: 710911 - RNA, 64 nt, Homo Sapiens; identical to SEQ ID NO: 585938

SEQ ID NO: 710912 - RNA, 64 nt, Homo Sapiens; identical to SEQ ID NO: 585939

SEQ ID NO: 710913 - RNA, 64 nt, Homo Sapiens; identical to SEQ ID NO: 585975

SEQ ID NO: 710914 - RNA, 64 nt, Homo Sapiens; identical to SEQ ID NO: 585976

SEQ ID NO: 710915 - RNA, 64 nt, Homo Sapiens; identical to SEQ ID NO: 585989

SEQ ID NO: 710916 - RNA, 64 nt, Homo Sapiens; identical to SEQ ID NO: 585990

SEQ ID NO: 710917 - RNA, 64 nt, Homo Sapiens; identical to SEQ ID NO: 586015

SEQ ID NO: 710918 - RNA, 64 nt, Homo Sapiens; identical to SEQ ID NO: 586016

SEQ ID NO: 710919 - RNA, 64 nt, Homo Sapiens; identical to SEQ ID NO: 586033

SEQ ID NO: 710920 - RNA, 64 nt, Homo Sapiens; identical to SEQ ID NO: 586034

SEQ ID NO: 710921 - RNA, 64 nt, Homo Sapiens; identical to SEQ ID NO: 586055

SEQ ID NO: 710922 - RNA, 64 nt, Homo Sapiens; identical to SEQ ID NO: 586056

SEQ ID NO: 710923 - RNA, 64 nt, Homo Sapiens; identical to SEQ ID NO: 586149

SEQ ID NO: 710924 - RNA, 64 nt, Homo Sapiens; identical to SEQ ID NO: 586150

SEQ ID NO: 710925 - RNA, 64 nt, Homo Sapiens; identical to SEQ ID NO: 586153

SEQ ID NO: 710926 - RNA, 64 nt, Homo Sapiens; identical to SEQ ID NO: 586154

SEQ ID NO: 710927 - RNA, 64 nt, Homo Sapiens; identical to SEQ ID NO: 586176

SEQ ID NO: 710928 - RNA, 64 nt, Homo Sapiens; identical to SEQ ID NO: 586177

SEQ ID NO: 710929 - RNA, 64 nt, Homo Sapiens; identical to SEQ ID NO: 586192

SEQ ID NO: 710930 - RNA, 64 nt, Homo Sapiens; identical to SEQ ID NO: 586193

SEQ ID NO: 710931 - RNA, 64 nt, Homo Sapiens; identical to SEQ ID NO: 586220

SEQ ID NO: 710932 - RNA, 64 nt, Homo Sapiens; identical to SEQ ID NO: 586221

SEQ ID NO: 710933 - RNA, 64 nt, Homo Sapiens; identical to SEQ ID NO: 586224

SEQ ID NO: 710934 - RNA, 64 nt, Homo Sapiens; identical to SEQ ID NO: 586225

SEQ ID NO: 710935 - RNA, 64 nt, Homo Sapiens; identical to SEQ ID NO: 318013

SEQ ID NO: 710936 - RNA, 64 nt, Homo Sapiens; identical to SEQ ID NO: 318014

SEQ ID NO: 710937 - RNA, 64 nt, Homo Sapiens; identical to SEQ ID NO: 318015

SEQ ID NO: 710938 - RNA, 64 nt, Homo Sapiens; identical to SEQ ID NO: 318016

SEQ ID NO: 710939 - RNA, 64 nt, Homo Sapiens; identical to SEQ ID NO: 318017

SEQ ID NO: 710940 - RNA, 64 nt, Homo Sapiens; identical to SEQ ID NO: 318018

SEQ ID NO: 710941 - RNA, 64 nt, Homo Sapiens; identical to SEQ ID NO: 318019

SEQ ID NO: 710942 - RNA, 64 nt, Homo Sapiens; identical to SEQ ID NO: 318020

SEQ ID NO: 710943 - RNA, 64 nt, Homo Sapiens; identical to SEQ ID NO: 318021

SEQ ID NO: 710944 - RNA, 64 nt, Homo Sapiens; identical to SEQ ID NO: 318022

SEQ ID NO: 710945 - RNA, 64 nt, Homo Sapiens; identical to SEQ ID NO: 318023

SEQ ID NO: 710946 - RNA, 64 nt, Homo Sapiens; identical to SEQ ID NO: 318024

SEQ ID NO: 710947 - RNA, 64 nt, Homo Sapiens; identical to SEQ ID NO: 318025

SEQ ID NO: 710948 - RNA, 64 nt, Homo Sapiens; identical to SEQ ID NO: 318026

SEQ ID NO: 710949 - RNA, 64 nt, Homo Sapiens; identical to SEQ ID NO: 318027

SEQ ID NO: 710950 - RNA, 64 nt, Homo Sapiens; identical to SEQ ID NO: 318028

SEQ ID NO: 710951 - RNA, 59 nt, Homo Sapiens; identical to SEQ ID NO: 658163

SEQ ID NO: 710952 - RNA, 64 nt, Homo Sapiens; identical to SEQ ID NO: 658164

SEQ ID NO: 710953 - RNA, 64 nt, Homo Sapiens; identical to SEQ ID NO: 658165

SEQ ID NO: 710954 - RNA, 64 nt, Homo Sapiens; identical to SEQ ID NO: 658166

SEQ ID NO: 710955 - RNA, 64 nt, Homo Sapiens; identical to SEQ ID NO: 658167

SEQ ID NO: 710956 - RNA, 64 nt, Homo Sapiens; identical to SEQ ID NO: 658168

SEQ ID NO: 710957 - RNA, 64 nt, Homo Sapiens; identical to SEQ ID NO: 658169

SEQ ID NO: 710958 - RNA, 50 nt, Homo Sapiens; identical to SEQ ID NO: 658170

SEQ ID NO: 710959 - RNA, 64 nt, Homo Sapiens; identical to SEQ ID NO: 658171

SEQ ID NO: 710960 - RNA, 64 nt, Homo Sapiens; identical to SEQ ID NO: 658172

SEQ ID NO: 710961 - RNA, 52 nt, Homo Sapiens; identical to SEQ ID NO: 658173

SEQ ID NO: 710962 - RNA, 64 nt, Homo Sapiens; identical to SEQ ID NO: 658174

SEQ ID NO: 710963 - RNA, 64 nt, Homo Sapiens; identical to SEQ ID NO: 658175

SEQ ID NO: 710964 - RNA, 64 nt, Homo Sapiens; identical to SEQ ID NO: 658176

SEQ ID NO: 710965 - RNA, 64 nt, Homo Sapiens; identical to SEQ ID NO: 658177

SEQ ID NO: 710966 - RNA, 64 nt, Homo Sapiens; identical to SEQ ID NO: 658178

SEQ ID NO: 710967 - RNA, 64 nt, Homo Sapiens; identical to SEQ ID NO: 658179

SEQ ID NO: 710968 - RNA, 64 nt, Homo Sapiens; identical to SEQ ID NO: 658180

SEQ ID NO: 710969 - RNA, 64 nt, Homo Sapiens; identical to SEQ ID NO: 80933

SEQ ID NO: 710970 - RNA, 64 nt, Homo Sapiens; identical to SEQ ID NO: 80934

SEQ ID NO: 710971 - RNA, 64 nt, Homo Sapiens; identical to SEQ ID NO: 80935

SEQ ID NO: 710972 - RNA, 64 nt, Homo Sapiens; identical to SEQ ID NO: 80936

SEQ ID NO: 710973 - RNA, 64 nt, Homo Sapiens; identical to SEQ ID NO: 80937

SEQ ID NO: 710974 - RNA, 64 nt, Homo Sapiens; identical to SEQ ID NO: 80938

SEQ ID NO: 710975 - RNA, 64 nt, Homo Sapiens; identical to SEQ ID NO: 80939

SEQ ID NO: 710976 - RNA, 64 nt, Homo Sapiens; identical to SEQ ID NO: 80940

SEQ ID NO: 710977 - RNA, 64 nt, Homo Sapiens; identical to SEQ ID NO: 80941

SEQ ID NO: 710978 - RNA, 64 nt, Homo Sapiens; identical to SEQ ID NO: 80942

SEQ ID NO: 710979 - RNA, 64 nt, Homo Sapiens; identical to SEQ ID NO: 80943

SEQ ID NO: 710980 - RNA, 64 nt, Homo Sapiens; identical to SEQ ID NO: 80944

SEQ ID NO: 710981 - RNA, 64 nt, Homo Sapiens; identical to SEQ ID NO: 80945

SEQ ID NO: 710982 - RNA, 64 nt, Homo Sapiens; identical to SEQ ID NO: 80946

SEQ ID NO: 710983 - RNA, 64 nt, Homo Sapiens; identical to SEQ ID NO: 80947

SEQ ID NO: 710984 - RNA, 64 nt, Homo Sapiens; identical to SEQ ID NO: 80948

SEQ ID NO: 710985 - RNA, 64 nt, Homo Sapiens; identical to SEQ ID NO: 80949

SEQ ID NO: 710986 - RNA, 64 nt, Homo Sapiens; identical to SEQ ID NO: 80950

SEQ ID NO: 710987 - RNA, 64 nt, Homo Sapiens; identical to SEQ ID NO: 80951

SEQ ID NO: 710988 - RNA, 64 nt, Homo Sapiens; identical to SEQ ID NO: 80952

SEQ ID NO: 710989 - RNA, 64 nt, Homo Sapiens; identical to SEQ ID NO: 80953

SEQ ID NO: 710990 - RNA, 64 nt, Homo Sapiens; identical to SEQ ID NO: 80954

SEQ ID NO: 710991 - RNA, 63 nt, Homo Sapiens; identical to SEQ ID NO: 80955

SEQ ID NO: 710992 - RNA, 64 nt, Homo Sapiens; identical to SEQ ID NO: 80956

SEQ ID NO: 710993 - RNA, 64 nt, Homo Sapiens; identical to SEQ ID NO: 80957

SEQ ID NO: 710994 - RNA, 64 nt, Homo Sapiens; identical to SEQ ID NO: 80958

SEQ ID NO: 710995 - RNA, 64 nt, Homo Sapiens; identical to SEQ ID NO: 80959

SEQ ID NO: 710996 - RNA, 64 nt, Homo Sapiens; identical to SEQ ID NO: 80960

SEQ ID NO: 710997 - RNA, 64 nt, Homo Sapiens; identical to SEQ ID NO: 80961

SEQ ID NO: 710998 - RNA, 64 nt, Homo Sapiens; identical to SEQ ID NO: 80962

SEQ ID NO: 710999 - RNA, 64 nt, Homo Sapiens; identical to SEQ ID NO: 80963

SEQ ID NO: 711000 - RNA, 64 nt, Homo Sapiens; identical to SEQ ID NO: 80964

SEQ ID NO: 711001 - RNA, 64 nt, Homo Sapiens; identical to SEQ ID NO: 80965

SEQ ID NO: 711002 - RNA, 64 nt, Homo Sapiens; identical to SEQ ID NO: 80966

SEQ ID NO: 711003 - RNA, 64 nt, Homo Sapiens; identical to SEQ ID NO: 80967

SEQ ID NO: 711004 - RNA, 64 nt, Homo Sapiens; identical to SEQ ID NO: 80968

SEQ ID NO: 711005 - RNA, 64 nt, Homo Sapiens; identical to SEQ ID NO: 80969

SEQ ID NO: 711006 - RNA, 64 nt, Homo Sapiens; identical to SEQ ID NO: 80970

SEQ ID NO: 711007 - RNA, 64 nt, Homo Sapiens; identical to SEQ ID NO: 80971

SEQ ID NO: 711008 - RNA, 64 nt, Homo Sapiens; identical to SEQ ID NO: 80972

SEQ ID NO: 711009 - RNA, 64 nt, Homo Sapiens; identical to SEQ ID NO: 80973

SEQ ID NO: 711010 - RNA, 64 nt, Homo Sapiens; identical to SEQ ID NO: 80974

SEQ ID NO: 711011 - RNA, 64 nt, Homo Sapiens; identical to SEQ ID NO: 80975

SEQ ID NO: 711012 - RNA, 64 nt, Homo Sapiens; identical to SEQ ID NO: 80976

SEQ ID NO: 711013 - RNA, 64 nt, Homo Sapiens; identical to SEQ ID NO: 80977

SEQ ID NO: 711014 - RNA, 64 nt, Homo Sapiens; identical to SEQ ID NO: 80978

SEQ ID NO: 711015 - RNA, 64 nt, Homo Sapiens; identical to SEQ ID NO: 80979

SEQ ID NO: 711016 - RNA, 64 nt, Homo Sapiens; identical to SEQ ID NO: 80980

SEQ ID NO: 711017 - RNA, 64 nt, Homo Sapiens; identical to SEQ ID NO: 80981

SEQ ID NO: 711018 - RNA, 64 nt, Homo Sapiens; identical to SEQ ID NO: 80982

SEQ ID NO: 711019 - RNA, 64 nt, Homo Sapiens; identical to SEQ ID NO: 80983

SEQ ID NO: 711020 - RNA, 64 nt, Homo Sapiens; identical to SEQ ID NO: 80984

SEQ ID NO: 711021 - RNA, 64 nt, Homo Sapiens; identical to SEQ ID NO: 80985

SEQ ID NO: 711022 - RNA, 64 nt, Homo Sapiens; identical to SEQ ID NO: 80986

SEQ ID NO: 711023 - RNA, 64 nt, Homo Sapiens; identical to SEQ ID NO: 80987

SEQ ID NO: 711024 - RNA, 64 nt, Homo Sapiens; identical to SEQ ID NO: 80988

SEQ ID NO: 711025 - RNA, 64 nt, Homo Sapiens; identical to SEQ ID NO: 80989

SEQ ID NO: 711026 - RNA, 64 nt, Homo Sapiens; identical to SEQ ID NO: 80990

SEQ ID NO: 711027 - RNA, 64 nt, Homo Sapiens; identical to SEQ ID NO: 80991

SEQ ID NO: 711028 - RNA, 64 nt, Homo Sapiens; identical to SEQ ID NO: 80992

SEQ ID NO: 711029 - RNA, 64 nt, Homo Sapiens; identical to SEQ ID NO: 80993

SEQ ID NO: 711030 - RNA, 64 nt, Homo Sapiens; identical to SEQ ID NO: 80994

SEQ ID NO: 711031 - RNA, 64 nt, Homo Sapiens; identical to SEQ ID NO: 80995

SEQ ID NO: 711032 - RNA, 64 nt, Homo Sapiens; identical to SEQ ID NO: 80996

SEQ ID NO: 711033 - RNA, 64 nt, Homo Sapiens; identical to SEQ ID NO: 80997

SEQ ID NO: 711034 - RNA, 64 nt, Homo Sapiens; identical to SEQ ID NO: 80998

SEQ ID NO: 711035 - RNA, 64 nt, Homo Sapiens; identical to SEQ ID NO: 80999

SEQ ID NO: 711036 - RNA, 64 nt, Homo Sapiens; identical to SEQ ID NO: 81000

SEQ ID NO: 711037 - RNA, 64 nt, Homo Sapiens; identical to SEQ ID NO: 81001

SEQ ID NO: 711038 - RNA, 64 nt, Homo Sapiens; identical to SEQ ID NO: 81002

SEQ ID NO: 711039 - RNA, 64 nt, Homo Sapiens; identical to SEQ ID NO: 81003

SEQ ID NO: 711040 - RNA, 64 nt, Homo Sapiens; identical to SEQ ID NO: 81004

SEQ ID NO: 711041 - RNA, 64 nt, Homo Sapiens; identical to SEQ ID NO: 81005

SEQ ID NO: 711042 - RNA, 64 nt, Homo Sapiens; identical to SEQ ID NO: 81006

SEQ ID NO: 711043 - RNA, 64 nt, Homo Sapiens; identical to SEQ ID NO: 81007

SEQ ID NO: 711044 - RNA, 64 nt, Homo Sapiens; identical to SEQ ID NO: 81008

SEQ ID NO: 711045 - RNA, 64 nt, Homo Sapiens; identical to SEQ ID NO: 81009

SEQ ID NO: 711046 - RNA, 64 nt, Homo Sapiens; identical to SEQ ID NO: 81010

SEQ ID NO: 711047 - RNA, 64 nt, Homo Sapiens; identical to SEQ ID NO: 81011

SEQ ID NO: 711048 - RNA, 64 nt, Homo Sapiens; identical to SEQ ID NO: 81012

SEQ ID NO: 711049 - RNA, 64 nt, Homo Sapiens; identical to SEQ ID NO: 81013

SEQ ID NO: 711050 - RNA, 64 nt, Homo Sapiens; identical to SEQ ID NO: 81014

SEQ ID NO: 711051 - RNA, 64 nt, Homo Sapiens; identical to SEQ ID NO: 81015

SEQ ID NO: 711052 - RNA, 64 nt, Homo Sapiens; identical to SEQ ID NO: 81016

SEQ ID NO: 711053 - RNA, 64 nt, Homo Sapiens; identical to SEQ ID NO: 81017

SEQ ID NO: 711054 - RNA, 64 nt, Homo Sapiens; identical to SEQ ID NO: 81018

SEQ ID NO: 711055 - RNA, 64 nt, Homo Sapiens; identical to SEQ ID NO: 81019

SEQ ID NO: 711056 - RNA, 64 nt, Homo Sapiens; identical to SEQ ID NO: 81020

SEQ ID NO: 711057 - RNA, 64 nt, Homo Sapiens; identical to SEQ ID NO: 81021

SEQ ID NO: 711058 - RNA, 64 nt, Homo Sapiens; identical to SEQ ID NO: 81022

SEQ ID NO: 711059 - RNA, 64 nt, Homo Sapiens; identical to SEQ ID NO: 81023

SEQ ID NO: 711060 - RNA, 64 nt, Homo Sapiens; identical to SEQ ID NO: 81024

SEQ ID NO: 711061 - RNA, 64 nt, Homo Sapiens; identical to SEQ ID NO: 81025

SEQ ID NO: 711062 - RNA, 64 nt, Homo Sapiens; identical to SEQ ID NO: 81026

SEQ ID NO: 711063 - RNA, 64 nt, Homo Sapiens; identical to SEQ ID NO: 81027

SEQ ID NO: 711064 - RNA, 64 nt, Homo Sapiens; identical to SEQ ID NO: 81028

SEQ ID NO: 711065 - RNA, 64 nt, Homo Sapiens; identical to SEQ ID NO: 81029

SEQ ID NO: 711066 - RNA, 64 nt, Homo Sapiens; identical to SEQ ID NO: 81030

SEQ ID NO: 711067 - RNA, 64 nt, Homo Sapiens; identical to SEQ ID NO: 81031

SEQ ID NO: 711068 - RNA, 64 nt, Homo Sapiens; identical to SEQ ID NO: 81032

SEQ ID NO: 711069 - RNA, 64 nt, Homo Sapiens; identical to SEQ ID NO: 81033

SEQ ID NO: 711070 - RNA, 64 nt, Homo Sapiens; identical to SEQ ID NO: 81034

SEQ ID NO: 711071 - RNA, 64 nt, Homo Sapiens; identical to SEQ ID NO: 81035

SEQ ID NO: 711072 - RNA, 64 nt, Homo Sapiens; identical to SEQ ID NO: 81036

SEQ ID NO: 711073 - RNA, 64 nt, Homo Sapiens; identical to SEQ ID NO: 81037

SEQ ID NO: 711074 - RNA, 64 nt, Homo Sapiens; identical to SEQ ID NO: 81038

SEQ ID NO: 711075 - RNA, 64 nt, Homo Sapiens; identical to SEQ ID NO: 81039

SEQ ID NO: 711076 - RNA, 64 nt, Homo Sapiens; identical to SEQ ID NO: 81040

SEQ ID NO: 711077 - RNA, 64 nt, Homo Sapiens; identical to SEQ ID NO: 81041

SEQ ID NO: 711078 - RNA, 64 nt, Homo Sapiens; identical to SEQ ID NO: 81042

SEQ ID NO: 711079 - RNA, 64 nt, Homo Sapiens
aaauuuuuuacacguuugcagaggugcaaucaaauggaauuaagucucucgacuuuggaaggaa

SEQ ID NO: 711080 - RNA, 64 nt, Homo Sapiens
acauauauauauauauauauguaugaaacccgcauggaauuaucuguaugaaaucaaggugcgc

SEQ ID NO: 711081 - RNA, 64 nt, Homo Sapiens
auauuucucuuugauuauuuauuccucuugauuguggaauuaauuugauugcuugcuaauggua

SEQ ID NO: 711082 - RNA, 64 nt, Homo Sapiens
cugcauugugcuagcauggaagaaucaugggcuuuggaauuaaacccauuugguggaauuaaac

SEQ ID NO: 711083 - RNA, 64 nt, Homo Sapiens
aagaaucaugggcuuuggaauuaaacccauuugguggaauuaaacccauuugguuucaaauccc

SEQ ID NO: 711084 - RNA, 64 nt, Homo Sapiens
guaaacagccuacugaaaauccuuaccuuggaauuggaauuacuuccaacuuaaaaaggcaaaa

SEQ ID NO: 711085 - RNA, 64 nt, Homo Sapiens
cuacuguucuuucuuuaauaaacuaguacuauuauggaauuacuucacaaaaaaaguaauugua

SEQ ID NO: 711086 - RNA, 64 nt, Homo Sapiens
augggaucgcgagagagaugcagggaaggaggcuuggaauuaggaccccaggcagacucagaca

SEQ ID NO: 711087 - RNA, 51 nt, Homo Sapiens
aaagguaagaaucgccuuaauuggaauuagguuguucacuuucuaacuuga

SEQ ID NO: 711088 - RNA, 64 nt, Homo Sapiens
acccaaaauaaguagaacacaagacgguguauaauggaauuaacaauauggaaauuacugaaau

SEQ ID NO: 711089 - RNA, 64 nt, Homo Sapiens
auguuaauguccuaguauuacaguccuuguuugcuggaauuagaaguugaauuuugaaaagagu

SEQ ID NO: 711090 - RNA, 64 nt, Homo Sapiens
uccauguaaaucuagaucuuuggagcaauuaagauggaauuacaauuucuagggagcauuuuaa

SEQ ID NO: 711091 - RNA, 64 nt, Homo Sapiens
uuuuggcuuuuucauaauuuuaugucuuacaguauggaauuauaauacgaaaaucuuuauauga

SEQ ID NO: 711092 - RNA, 64 nt, Homo Sapiens
auauaauauauucgauagaaaugaaaaucugccguggaauuaacuaauaaguaguaacaauaaa

SEQ ID NO: 711093 - RNA, 64 nt, Homo Sapiens
guaauaaaucaacaaauaauuuuugauugacugguggaauuagauuuacuaaauaaaaauggcu

SEQ ID NO: 711094 - RNA, 64 nt, Homo Sapiens
gauuauuuucuguauuuuaguauauaguauaaaauggaauuauuggguuaaaguacuuuuauua

SEQ ID NO: 711095 - RNA, 64 nt, Homo Sapiens
gggauugucaccaguuguaccaauuugaagaaccuggaauuaguagaauucuagaaguuuacuu

SEQ ID NO: 711096 - RNA, 64 nt, Homo Sapiens
guauaaucuguagagccuccauggcucuaaaauuuggaauuaacuucucuugccuuaagagcug

SEQ ID NO: 711097 - RNA, 64 nt, Homo Sapiens
caagcaauucuccugccucagccucucgagcagcuggaauuacaggcacgugccacgacaccca

SEQ ID NO: 711098 - RNA, 64 nt, Homo Sapiens
uccuacuuauacuuccccaaaaaacaagcuuuacuggaauuaauggaaaauauuaugucaaucu

SEQ ID NO: 711099 - RNA, 64 nt, Homo Sapiens
gggacccgccaccacgcccggccucccaaguagcuggaauuacacaagugauucuccugucuca

SEQ ID NO: 711100 - RNA, 64 nt, Homo Sapiens
cacaaggucacauucucuguucuggcugggaugguggaauuaaggaaggaaaaaccugagccua

SEQ ID NO: 711101 - RNA, 64 nt, Homo Sapiens
ggcauuagccaccaugccugggcucccaaagugcuggaauuacaaggugauccacucgccccuu

SEQ ID NO: 711102 - RNA, 64 nt, Homo Sapiens
ggcaugugccaccacacccagccucgcgaguaguuggaauuauacaggcaauucucuugcauca

SEQ ID NO: 711103 - RNA, 64 nt, Homo Sapiens; identical to SEQ ID NO: 275791

SEQ ID NO: 711104 - RNA, 64 nt, Homo Sapiens; identical to SEQ ID NO: 275792

SEQ ID NO: 711105 - RNA, 64 nt, Homo Sapiens; identical to SEQ ID NO: 275793

SEQ ID NO: 711106 - RNA, 64 nt, Homo Sapiens; identical to SEQ ID NO: 275794

SEQ ID NO: 711107 - RNA, 64 nt, Homo Sapiens; identical to SEQ ID NO: 275795

SEQ ID NO: 711108 - RNA, 64 nt, Homo Sapiens; identical to SEQ ID NO: 275796

SEQ ID NO: 711109 - RNA, 64 nt, Homo Sapiens; identical to SEQ ID NO: 275797

SEQ ID NO: 711110 - RNA, 64 nt, Homo Sapiens; identical to SEQ ID NO: 275798

SEQ ID NO: 711111 - RNA, 64 nt, Homo Sapiens; identical to SEQ ID NO: 275799

SEQ ID NO: 711112 - RNA, 64 nt, Homo Sapiens; identical to SEQ ID NO: 275800

SEQ ID NO: 711113 - RNA, 64 nt, Homo Sapiens; identical to SEQ ID NO: 275801

SEQ ID NO: 711114 - RNA, 64 nt, Homo Sapiens; identical to SEQ ID NO: 275802

SEQ ID NO: 711115 - RNA, 64 nt, Homo Sapiens; identical to SEQ ID NO: 275803

SEQ ID NO: 711116 - RNA, 64 nt, Homo Sapiens; identical to SEQ ID NO: 275804

SEQ ID NO: 711117 - RNA, 64 nt, Homo Sapiens; identical to SEQ ID NO: 275805

SEQ ID NO: 711118 - RNA, 64 nt, Homo Sapiens; identical to SEQ ID NO: 275806

SEQ ID NO: 711119 - RNA, 64 nt, Homo Sapiens; identical to SEQ ID NO: 275807

SEQ ID NO: 711120 - RNA, 64 nt, Homo Sapiens; identical to SEQ ID NO: 275808

SEQ ID NO: 711121 - RNA, 64 nt, Homo Sapiens; identical to SEQ ID NO: 275809

SEQ ID NO: 711122 - RNA, 64 nt, Homo Sapiens; identical to SEQ ID NO: 275810

SEQ ID NO: 711123 - RNA, 64 nt, Homo Sapiens; identical to SEQ ID NO: 275811

SEQ ID NO: 711124 - RNA, 64 nt, Homo Sapiens; identical to SEQ ID NO: 275812

SEQ ID NO: 711125 - RNA, 64 nt, Homo Sapiens; identical to SEQ ID NO: 275813

SEQ ID NO: 711126 - RNA, 64 nt, Homo Sapiens; identical to SEQ ID NO: 275814

SEQ ID NO: 711127 - RNA, 64 nt, Homo Sapiens; identical to SEQ ID NO: 275815

SEQ ID NO: 711128 - RNA, 64 nt, Homo Sapiens; identical to SEQ ID NO: 275816

SEQ ID NO: 711129 - RNA, 64 nt, Homo Sapiens; identical to SEQ ID NO: 275817

SEQ ID NO: 711130 - RNA, 64 nt, Homo Sapiens; identical to SEQ ID NO: 275818

SEQ ID NO: 711131 - RNA, 64 nt, Homo Sapiens; identical to SEQ ID NO: 275819

SEQ ID NO: 711132 - RNA, 64 nt, Homo Sapiens; identical to SEQ ID NO: 275820

SEQ ID NO: 711133 - RNA, 64 nt, Homo Sapiens; identical to SEQ ID NO: 275821

SEQ ID NO: 711134 - RNA, 64 nt, Homo Sapiens; identical to SEQ ID NO: 275822

SEQ ID NO: 711135 - RNA, 64 nt, Homo Sapiens; identical to SEQ ID NO: 275823

SEQ ID NO: 711136 - RNA, 64 nt, Homo Sapiens; identical to SEQ ID NO: 275824

SEQ ID NO: 711137 - RNA, 64 nt, Homo Sapiens; identical to SEQ ID NO: 275825

SEQ ID NO: 711138 - RNA, 64 nt, Homo Sapiens; identical to SEQ ID NO: 275826

SEQ ID NO: 711139 - RNA, 64 nt, Homo Sapiens; identical to SEQ ID NO: 275827

SEQ ID NO: 711140 - RNA, 64 nt, Homo Sapiens; identical to SEQ ID NO: 275828

SEQ ID NO: 711141 - RNA, 64 nt, Homo Sapiens; identical to SEQ ID NO: 275829

SEQ ID NO: 711142 - RNA, 64 nt, Homo Sapiens; identical to SEQ ID NO: 275830

SEQ ID NO: 711143 - RNA, 64 nt, Homo Sapiens; identical to SEQ ID NO: 275831

SEQ ID NO: 711144 - RNA, 64 nt, Homo Sapiens; identical to SEQ ID NO: 275832

SEQ ID NO: 711145 - RNA, 64 nt, Homo Sapiens; identical to SEQ ID NO: 275833

SEQ ID NO: 711146 - RNA, 64 nt, Homo Sapiens; identical to SEQ ID NO: 275834

SEQ ID NO: 711147 - RNA, 64 nt, Homo Sapiens; identical to SEQ ID NO: 275835

SEQ ID NO: 711148 - RNA, 64 nt, Homo Sapiens; identical to SEQ ID NO: 275836

SEQ ID NO: 711149 - RNA, 64 nt, Homo Sapiens; identical to SEQ ID NO: 275837

SEQ ID NO: 711150 - RNA, 64 nt, Homo Sapiens; identical to SEQ ID NO: 275838

SEQ ID NO: 711151 - RNA, 64 nt, Homo Sapiens; identical to SEQ ID NO: 275839

SEQ ID NO: 711152 - RNA, 64 nt, Homo Sapiens; identical to SEQ ID NO: 275840

SEQ ID NO: 711153 - RNA, 62 nt, Homo Sapiens
ugaggccucaucuugaaccagaccuuaacgaccaaacccagaccaugccaaaguccagucug

SEQ ID NO: 711154 - RNA, 62 nt, Homo Sapiens
ggcugucaggaaacguguuuuauguuaagucacaaacccacuugacuucuggguacuggaau

SEQ ID NO: 711155 - RNA, 62 nt, Homo Sapiens
gccugucucuucucuuguuugauugucuugaccaaacccacaaaccuuggagagggaaugcu

SEQ ID NO: 711156 - RNA, 62 nt, Homo Sapiens
gcaucuuaccaacagcugguuaggugaguugccaaacccaagugggcaauuugugcuaaaac

SEQ ID NO: 711157 - RNA, 62 nt, Homo Sapiens
auccagaugaauauccgagauguaucacaaaacaaacccaaucaguuaaggugaauauguau

SEQ ID NO: 711158 - RNA, 62 nt, Homo Sapiens
uguaaauaacauaugacuucucccaucccacacaaacccaauacuggcucauccgcccuacu

SEQ ID NO: 711159 - RNA, 62 nt, Homo Sapiens
ucagauucugccuguuuucaagauggcagucccaaacccaacaacuguuggccacacugaaa

SEQ ID NO: 711160 - RNA, 62 nt, Homo Sapiens
gagggugucuccccaagccaggcacaccugcacaaacccagagccgacccucagcugccuuc

SEQ ID NO: 711161 - RNA, 62 nt, Homo Sapiens
accucagacaggaaagucggucuaccuuagagcaaacccagucauuaggggccuugccaagg

SEQ ID NO: 711162 - RNA, 62 nt, Homo Sapiens
cucaccugacagccgagggaaaagcugauucacaaacccacgcaagagaaaugauccuaucc

SEQ ID NO: 711163 - RNA, 62 nt, Homo Sapiens
uccagcuccuaguagcuuucacuccuuuccugcaaacccauuugaagggaagcccauucuaa

SEQ ID NO: 711164 - RNA, 62 nt, Homo Sapiens
cauaccagcuagaaucacuuaaauccccuccccaaacccaccacccauccaauggauugugc

SEQ ID NO: 711165 - RNA, 62 nt, Homo Sapiens
ggugcacccaccuguuuucugaaacacacgagcaaacccagagguggauguuaugaacagcu

SEQ ID NO: 711166 - RNA, 62 nt, Homo Sapiens
gaccaccagaggaggaugugugggauuguaggcaaacccaccuguggcaucacugaaaauaa

SEQ ID NO: 711167 - RNA, 62 nt, Homo Sapiens
ccccaacccauccucauccccaacuacagccccaaacccagccccagacuaauccacagcca

SEQ ID NO: 711168 - RNA, 62 nt, Homo Sapiens
ccccaacucauccucauccccaacugcagccccaaacccaacccagggccauccccaaaccc

SEQ ID NO: 711169 - RNA, 62 nt, Homo Sapiens
cugcagccccaaacccaacccagggccauccccaaacccauccccaagccaaacucaacacc

SEQ ID NO: 711170 - RNA, 62 nt, Homo Sapiens
auaauguauguggaauauccaugcuaauguugcaaacccauguccugcgggacagccagcgu

SEQ ID NO: 711171 - RNA, 54 nt, Homo Sapiens; identical to SEQ ID NO: 175380

SEQ ID NO: 711172 - RNA, 62 nt, Homo Sapiens
caucaucacauucagggcuauuuuuucccccacaaacccaagggcaggggccacucuuagcu

SEQ ID NO: 711173 - RNA, 62 nt, Homo Sapiens
gugaagcaaggagcuuagauaagacacccccucaaacccauucccucuccaggagaccuacc

SEQ ID NO: 711174 - RNA, 64 nt, Homo Sapiens
cugaauuaauaauucucucuuuucuuccaaggaaacaggagagaguucuucucauuucauuaug

SEQ ID NO: 711175 - RNA, 64 nt, Homo Sapiens
ugagcacuuccagucaguuuacucagaccuuuaaacaggagaguagaggucauuucuggaaugg

SEQ ID NO: 711176 - RNA, 64 nt, Homo Sapiens
cacugauuuacgaguaagcugaugagagcaaugaacaggagaaggagggagagagccaaauguc

SEQ ID NO: 711177 - RNA, 64 nt, Homo Sapiens
acuuauugcucuccuucugagucaggacauguguacaggagaccaagaacaaugaguauuagaa

SEQ ID NO: 711178 - RNA, 64 nt, Homo Sapiens
ugaagcacaucuguaggcaagauggcugagaaauacaggagaggcgucugcuuuuggaaaggaa

SEQ ID NO: 711179 - RNA, 64 nt, Homo Sapiens
uauaaagaugauacaaccaugauuugcaacuguaacaggagaccauuuauuauaagcguaccug

SEQ ID NO: 711180 - RNA, 64 nt, Homo Sapiens
accuucugcuguuuguuccaggcucaccuuuagaacaggagacuugagcuugaccuaaggauau

SEQ ID NO: 711181 - RNA, 64 nt, Homo Sapiens
agcaauuauuauauugaaggcuuuaauaaaggccacaggagacauuacuauagcauagauuguc

SEQ ID NO: 711182 - RNA, 64 nt, Homo Sapiens
accuguggauagacuuaguucuucuaucuuuguuacaggagaggucuccugcuucuuuagaccu

SEQ ID NO: 711183 - RNA, 64 nt, Homo Sapiens
cauuaugaacauuuauuuagagcaaguggauuacacaggagaacucaccuaaauaaaaauugaa

SEQ ID NO: 711184 - RNA, 64 nt, Homo Sapiens
ccauggggagagacccuggucccaggagcagaguacaggagacaaccccagcagccgacucgac

SEQ ID NO: 711185 - RNA, 64 nt, Homo Sapiens
caucugcagcaucuggcggacaguggcagcuacaacaggagaagaacgcagagcaguccagaac

SEQ ID NO: 711186 - RNA, 64 nt, Homo Sapiens
ggaaagaaaagucuccauugcuccucugcacuaaacaggagaauuuaggaaggcaccaaagaac

SEQ ID NO: 711187 - RNA, 64 nt, Homo Sapiens
gauggaaggaagggaggaagccgugaguuuacauacaggagaaucauccuuaaccaacuaggua

SEQ ID NO: 711188 - RNA, 64 nt, Homo Sapiens
cacuugaacccaggaggcagcucgggcagcugagacaggagaauugcgccuguaaucccagcua

SEQ ID NO: 711189 - RNA, 64 nt, Homo Sapiens
auauaucuggaauguccuuuucugaagucuauacacaggagauguguauuuguuagagauaauu

SEQ ID NO: 711190 - RNA, 64 nt, Homo Sapiens
aacucacaagugugaugauuauaggaggauucauacaggagagaaguuucauccuaugcaaaac

SEQ ID NO: 711191 - RNA, 64 nt, Homo Sapiens
ucauacuggagaaaaaacauucacagcuugaaagacaggagaauacaaaguugucagucacaaa

SEQ ID NO: 711192 - RNA, 63 nt, Homo Sapiens
ccuuggcacuguggaacugcauucucuugaaggugcugccaccaaggcaucuuucugaauuuc

SEQ ID NO: 711193 - RNA, 63 nt, Homo Sapiens
cccaccaucggguguaggugggaaugcugacaaugcugccaugcacuuccugccccaacugca

SEQ ID NO: 711194 - RNA, 63 nt, Homo Sapiens
cugugcugcugaggugcguauaauguggcucucugcugccaccaguuucuguugcugccaaag

SEQ ID NO: 711195 - RNA, 63 nt, Homo Sapiens
guaauguggcucucugcugccgccaguuucuguugcugccaaacauggggcugccgggcuggc

SEQ ID NO: 711196 - RNA, 63 nt, Homo Sapiens
cucccagcggggcucccugagcucucaaggagaugcugccaucacugggaggcucagaggacc

SEQ ID NO: 711197 - RNA, 63 nt, Homo Sapiens
auuuaaugagcgugggccuggaccuuccccagaugcugccaggcagccccuccccaagccuca

SEQ ID NO: 711198 - RNA, 63 nt, Homo Sapiens
cugccugcugcucccuuuuucugucucuguccaugcugccauguuucucugcugccaaauugg

SEQ ID NO: 711199 - RNA, 63 nt, Homo Sapiens
uuuucugucucuguccaugcugccauguuucucugcugccaaauugggccccuuggccccuuc

SEQ ID NO: 711200 - RNA, 63 nt, Homo Sapiens
uggaccccagggacuugccuuccccacccacucugcugccagcaggcccagggaucccugacc

SEQ ID NO: 711201 - RNA, 63 nt, Homo Sapiens
gccacaguucugggagccuucaacccuggcucaugcugccauagucuccacggugcccuucac

SEQ ID NO: 711202 - RNA, 63 nt, Homo Sapiens
ucuguggcauguuugaccuguggcaggacucgcugcugccaggugagucaccgccuguccugc

SEQ ID NO: 711203 - RNA, 63 nt, Homo Sapiens
ugccaucucugucucccugggugccagcagcccugcugccaugugcacugggguggcacugga

SEQ ID NO: 711204 - RNA, 63 nt, Homo Sapiens
gccugugggcagccgcgccagcugccgggacacugcugccagaccugcccccaggguaagucu

SEQ ID NO: 711205 - RNA, 63 nt, Homo Sapiens
aggcaggccagggcugcgcaucaguggacacauugcugccaggaagagcugcgacggugaggc

SEQ ID NO: 711206 - RNA, 63 nt, Homo Sapiens
uguacaaugguggagugagucuccgggccucagugcugccaucucucccaaguuccagagccu

SEQ ID NO: 711207 - RNA, 63 nt, Homo Sapiens
ucucaucuacguggugucgccccauggacgaccugcugccacuugggccgggaguacaagcug

SEQ ID NO: 711208 - RNA, 63 nt, Homo Sapiens
uaaggucacugcuguggcgacggacagcuuggaugcugccacgccacagaccuaauauauguc

SEQ ID NO: 711209 - RNA, 63 nt, Homo Sapiens
ucugggcauacagugucuggacagcuggacggaugcugccacaaagaccuggagggcagccac

SEQ ID NO: 711210 - RNA, 63 nt, Homo Sapiens
ucaugacuugggggugcuacuagaagccaggaaugcugccaaacauucuaccaugcacagcac

SEQ ID NO: 711211 - RNA, 63 nt, Homo Sapiens
ugaaaaugaacuuuuguuucuaaaguuggaccuugcugccaugacuguuuaguuuacagaaac

SEQ ID NO: 711212 - RNA, 63 nt, Homo Sapiens
ggaauacuuuuacuacucagaaaugaauuuaugugcugccauuugcuauaaaguugaacuuug

SEQ ID NO: 711213 - RNA, 63 nt, Homo Sapiens
ucagaaaaccuaccaaacaaaaacaucagaagcugcugccauaaugacuauuuucuacuguag

SEQ ID NO: 711214 - RNA, 63 nt, Homo Sapiens
uuggcucugauuugaaaucgggagaaacagagcugcugccaaugggaucuuuuagguaacucc

SEQ ID NO: 711215 - RNA, 63 nt, Homo Sapiens
uagcuuccgugugucugugcagugcccaugagcugcugccaaugggaucuuucagguaccccc

SEQ ID NO: 711216 - RNA, 63 nt, Homo Sapiens
ggaucgcccugcuggcugccggcaccgcccuccugcugccagagacgaggcaggcacagcugc

SEQ ID NO: 711217 - RNA, 63 nt, Homo Sapiens
gggaguaucgaacccucugccuagggccggaguugcugccaguacccgcucccucugcucauc

SEQ ID NO: 711218 - RNA, 63 nt, Homo Sapiens
cccguaccgccaacucgggucacaccugaacgcugcugccagccgaugccccagcccugcacg

SEQ ID NO: 711219 - RNA, 63 nt, Homo Sapiens
ucgccacaccuacuggggcaucuggcuggugccugcugccauggccagcccccacucucaccc

SEQ ID NO: 711220 - RNA, 63 nt, Homo Sapiens
cucccuucuuuaccuucauuucauccuguuggcugcugccaccaaaucugucuagaauccugc

SEQ ID NO: 711221 - RNA, 63 nt, Homo Sapiens
caauaaauauuuguuugggugguuugugagccuugcugccaaguccugccuuugggucgacau

SEQ ID NO: 711222 - RNA, 63 nt, Homo Sapiens
guggaguggguaauccaggcuucuaaccuugaaugcugccaguauugugcugccauuugauuu

SEQ ID NO: 711223 - RNA, 63 nt, Homo Sapiens
ugauuuuucuaaccuugaauugcugaccaauugugcugccauuaauuccagaagaagagaagc

SEQ ID NO: 711224 - RNA, 63 nt, Homo Sapiens
ugccauccucccacuugcagugcaggaucccacugcugccaaagagaugggacaaggaaccuc

SEQ ID NO: 711225 - RNA, 63 nt, Homo Sapiens
ccagaccuggacuccaaggccggccugcgcacuugcugccaccagaaacuggaggacaugauc

SEQ ID NO: 711226 - RNA, 63 nt, Homo Sapiens
acagagaaaggggcuguggugcuuguugguugaugcugccauguaagcuggacuccugggacu

SEQ ID NO: 711227 - RNA, 63 nt, Homo Sapiens
ucaacagcgcucaugucucuuggcccagucaggugcugccagguuuagauaggaaaguacaug

SEQ ID NO: 711228 - RNA, 63 nt, Homo Sapiens
agaugcuuccaugguccgugcucaguucucuggugcugccaaaaaugccugaccuuugagaug

SEQ ID NO: 711229 - RNA, 63 nt, Homo Sapiens
uagauagaaaaagaagcaugacagaagaacucaugcugccagaggucaacccacgcagaagaa

SEQ ID NO: 711230 - RNA, 63 nt, Homo Sapiens
agaucugaacuaaugcuaaccauuaguuucuguugcugccaacguucaaagucuacuagcucg

SEQ ID NO: 711231 - RNA, 63 nt, Homo Sapiens
gccugugacuuucuaaccugaaggcucucugccugcugccaagagcucuucacuaugacagua

SEQ ID NO: 711232 - RNA, 63 nt, Homo Sapiens
uucuaaaggcuugauauuuuguccgcuuucucuugcugccacaaaacuccccguuccugcgua

SEQ ID NO: 711233 - RNA, 63 nt, Homo Sapiens
caagcuggcgugugccagggcucgagucccacgugcugccaacucaaacauagccuccuuccc

SEQ ID NO: 711234 - RNA, 63 nt, Homo Sapiens
ccggcuccccuaaagguagaagauacucgagcaugcugccaggggagcuggauggugaaacac

SEQ ID NO: 711235 - RNA, 63 nt, Homo Sapiens
cacagccuaauuuucuggagaauccauccacucugcugccauuugugccuguuaugaaugaaa

SEQ ID NO: 711236 - RNA, 63 nt, Homo Sapiens
caucacagagcccuucuugguaauuaugguaccugcugccacugccuuuucagcugcacuauu

SEQ ID NO: 711237 - RNA, 63 nt, Homo Sapiens
gaugggccaagggaaggcuaucagagacccuggugcugccaccugccccuacucaagugucua

SEQ ID NO: 711238 - RNA, 63 nt, Homo Sapiens
aagggagggccuggggagccccacccuagcccuugcugccacaccacauugccucaacaaccg

SEQ ID NO: 711239 - RNA, 63 nt, Homo Sapiens
aaacguggugucaucugaugcauuuggaccauaugcugccagacugcagaacgggggagccgg

SEQ ID NO: 711240 - RNA, 63 nt, Homo Sapiens
agccuagcgaugccgcuggccagaccgugaccaugcugccagugugcucgccaugagcugggu

SEQ ID NO: 711241 - RNA, 63 nt, Homo Sapiens
uccaugucagggaagucgcuguccugcuugaacugcugccaaccagucuccuuggugauuaag

SEQ ID NO: 711242 - RNA, 63 nt, Homo Sapiens
uuagcuauugggagcaaucugaaaaaugccugcugcugccaagaaggucuauggcucaugucu

SEQ ID NO: 711243 - RNA, 63 nt, Homo Sapiens
ccacaaccugucucccaguccugcucucaccccugcugccacacacaugcccugagcagccag

SEQ ID NO: 711244 - RNA, 63 nt, Homo Sapiens
ucugcacuagggcucugugcuggaacccaggcaugcugccagccuuuucucuggaucugucag

SEQ ID NO: 711245 - RNA, 63 nt, Homo Sapiens
ccaugugcugccgcccaacccugccgccccaacugcugccagauccugcugcaucuccaguug

SEQ ID NO: 711246 - RNA, 63 nt, Homo Sapiens
cuuccugcaguaucucuagcuugcauuuccagcugcugccagcaccugcugccaccccagcua

SEQ ID NO: 711247 - RNA, 63 nt, Homo Sapiens
ccagcuauugcauuuccagccuacaggaccaccugcugccaccaucugcuggcaaaccaccug

SEQ ID NO: 711248 - RNA, 63 nt, Homo Sapiens
ccacugugcugaggcccugcagugucugcucacugcugccaucuucgcugcuagucaggguuc

SEQ ID NO: 711249 - RNA, 63 nt, Homo Sapiens
gauuccuguguggggagaagcucaguggccguuugcugccacugacaaggauuucacaugcag

SEQ ID NO: 711250 - RNA, 63 nt, Homo Sapiens
cccucuccccacugccccaacuggcguaaacccugcugccaggacggaaaacagaccucgggg

SEQ ID NO: 711251 - RNA, 63 nt, Homo Sapiens
agccaaaacaaagucuuuuuggauuuugccaagugcugccagucaguaaccaaacacauacau

SEQ ID NO: 711252 - RNA, 63 nt, Homo Sapiens
gagccuacugcugcucuccacucaacuggccucugcugccaggccacugccugucucugcuuc

SEQ ID NO: 711253 - RNA, 63 nt, Homo Sapiens
cugagccucccuggagaagguauuuuauaugucugcugccagcugcuggucuccacacccuca

SEQ ID NO: 711254 - RNA, 63 nt, Homo Sapiens
agguuggggugguuaagucuacaggggcccuccugcugccagcuggggagaugcugccagcac

SEQ ID NO: 711255 - RNA, 63 nt, Homo Sapiens
acacaggggcccuccugcuguguccuggggagaugcugccagcugggugcaggugagccggcg

SEQ ID NO: 711256 - RNA, 63 nt, Homo Sapiens
ucacauccacucaccacaucucccagagaacuaugcugccacucugcugccaggcuuacaucu

SEQ ID NO: 711257 - RNA, 63 nt, Homo Sapiens
cuuacaucuucccagagaaccugccaccugcccugcugccagggaccacccauagcccugcug

SEQ ID NO: 711258 - RNA, 63 nt, Homo Sapiens
ugcccugcugccaggcuuaccccauagcccugcugcugccaccguuacaaacugcgcagacca

SEQ ID NO: 711259 - RNA, 63 nt, Homo Sapiens
aacugucaaguguguguugugucccaugugagcugcugccaugccagaaacacccacaggcau

SEQ ID NO: 711260 - RNA, 63 nt, Homo Sapiens
accagccccacccuguuuugcccuuuguccuccugcugccaguaguccccagaacucugccug

SEQ ID NO: 711261 - RNA, 64 nt, Homo Sapiens; identical to SEQ ID NO: 417144

SEQ ID NO: 711262 - RNA, 64 nt, Homo Sapiens; identical to SEQ ID NO: 417145

SEQ ID NO: 711263 - RNA, 64 nt, Homo Sapiens; identical to SEQ ID NO: 166123

SEQ ID NO: 711264 - RNA, 64 nt, Homo Sapiens; identical to SEQ ID NO: 166124

SEQ ID NO: 711265 - RNA, 64 nt, Homo Sapiens; identical to SEQ ID NO: 166125

SEQ ID NO: 711266 - RNA, 64 nt, Homo Sapiens; identical to SEQ ID NO: 166126

SEQ ID NO: 711267 - RNA, 64 nt, Homo Sapiens; identical to SEQ ID NO: 166127

SEQ ID NO: 711268 - RNA, 64 nt, Homo Sapiens; identical to SEQ ID NO: 166128

SEQ ID NO: 711269 - RNA, 64 nt, Homo Sapiens; identical to SEQ ID NO: 166129

SEQ ID NO: 711270 - RNA, 64 nt, Homo Sapiens; identical to SEQ ID NO: 166130

SEQ ID NO: 711271 - RNA, 64 nt, Homo Sapiens; identical to SEQ ID NO: 166131

SEQ ID NO: 711272 - RNA, 64 nt, Homo Sapiens; identical to SEQ ID NO: 166132

SEQ ID NO: 711273 - RNA, 64 nt, Homo Sapiens; identical to SEQ ID NO: 166133

SEQ ID NO: 711274 - RNA, 64 nt, Homo Sapiens; identical to SEQ ID NO: 166134

SEQ ID NO: 711275 - RNA, 64 nt, Homo Sapiens; identical to SEQ ID NO: 166135

SEQ ID NO: 711276 - RNA, 64 nt, Homo Sapiens; identical to SEQ ID NO: 166136

SEQ ID NO: 711277 - RNA, 64 nt, Homo Sapiens; identical to SEQ ID NO: 166137

SEQ ID NO: 711278 - RNA, 64 nt, Homo Sapiens; identical to SEQ ID NO: 166138

SEQ ID NO: 711279 - RNA, 64 nt, Homo Sapiens; identical to SEQ ID NO: 166139

SEQ ID NO: 711280 - RNA, 64 nt, Homo Sapiens; identical to SEQ ID NO: 166140

SEQ ID NO: 711281 - RNA, 64 nt, Homo Sapiens; identical to SEQ ID NO: 166141

SEQ ID NO: 711282 - RNA, 64 nt, Homo Sapiens; identical to SEQ ID NO: 166142

SEQ ID NO: 711283 - RNA, 64 nt, Homo Sapiens; identical to SEQ ID NO: 166143

SEQ ID NO: 711284 - RNA, 64 nt, Homo Sapiens; identical to SEQ ID NO: 166144

SEQ ID NO: 711285 - RNA, 64 nt, Homo Sapiens; identical to SEQ ID NO: 166145

SEQ ID NO: 711286 - RNA, 64 nt, Homo Sapiens; identical to SEQ ID NO: 166146

SEQ ID NO: 711287 - RNA, 64 nt, Homo Sapiens; identical to SEQ ID NO: 166147

SEQ ID NO: 711288 - RNA, 64 nt, Homo Sapiens; identical to SEQ ID NO: 166148

SEQ ID NO: 711289 - RNA, 64 nt, Homo Sapiens; identical to SEQ ID NO: 166149

SEQ ID NO: 711290 - RNA, 64 nt, Homo Sapiens
guugaugguugacaaagcuugcuucacuccaucagagaaugacuaucaauuuuuuuuuaacugu

SEQ ID NO: 711291 - RNA, 64 nt, Homo Sapiens
uguacaugaaagaguacaccaugugaagagaagagagaaugauugaaaauguuuuaguauagaa

SEQ ID NO: 711292 - RNA, 64 nt, Homo Sapiens
acuaagugaaaagggaaaccggcgguggacaagagagaaugagagugaaaggcacgucuuacau

SEQ ID NO: 711293 - RNA, 64 nt, Homo Sapiens
cauaccaccuuguuggcucucaagguuuuucagugagaaugaaacccucuauaaauagauuacc

SEQ ID NO: 711294 - RNA, 64 nt, Homo Sapiens
gacagaaaaaaaaaagagagcguccugccagaaagagaaugaaugcccucucacacagacguga

SEQ ID NO: 711295 - RNA, 64 nt, Homo Sapiens
auuggaaaaaggaaaaaaaaggcgggccaaccccgagaaugaagggacauggagugacuaucgg

SEQ ID NO: 711296 - RNA, 64 nt, Homo Sapiens
auaacagagccuucacauuguguaauauuuguaugagaaugacucaagcucuuugagaacauuc

SEQ ID NO: 711297 - RNA, 64 nt, Homo Sapiens
uuagcauucugagaugagugucagguuuucaggagagaaugaguuggggugagcccagagucug

SEQ ID NO: 711298 - RNA, 64 nt, Homo Sapiens
cuggggucuuccgagugagcugguuuaauacucugagaaugagcagggagauccagagaaugaa

SEQ ID NO: 711299 - RNA, 64 nt, Homo Sapiens
gguuuaauacucugagaaugagcagggagauccagagaaugaaucccugaccgcaucaccuaaa

SEQ ID NO: 711300 - RNA, 64 nt, Homo Sapiens
aguauuugccucuggaaagagaaggaaaaacuaagagaaugaaaacccaugaagguaacuaacg

SEQ ID NO: 711301 - RNA, 64 nt, Homo Sapiens
ugaauccagcaaauaggaucgaguacacaaaccagagaaugacaaauacuccagcaaaaugaag

SEQ ID NO: 711302 - RNA, 64 nt, Homo Sapiens
acuaaaacauuccauuguuauauaaaguaacauugagaaugacaauuagaacuuaaugcagaca

SEQ ID NO: 711303 - RNA, 64 nt, Homo Sapiens
aagccaaaaagaaaauuguuaucagagaaagauugagaaugaaucuuuuauaccacuauuauau

SEQ ID NO: 711304 - RNA, 64 nt, Homo Sapiens
acgagcagacauucucuguagaagguaauggucugagaaugaaaagguguuugauggacauguu

SEQ ID NO: 711305 - RNA, 64 nt, Homo Sapiens
ucaccuuauuacugauuggguagagggggaaaaggagaaugaugaugauaguuuccuucugucu

SEQ ID NO: 711306 - RNA, 64 nt, Homo Sapiens
uuuucccaucucugcaagcagggauaacgguaaugagaaugauaauaaucauuauaugcagacc

SEQ ID NO: 711307 - RNA, 64 nt, Homo Sapiens
agaacaaccaaagcagcuuacagacgccugaacggagaaugaaguguuucaaguaagcgagucu

SEQ ID NO: 711308 - RNA, 64 nt, Homo Sapiens
gcaccuuaauauuaauggacuguuucagguaaaagagaaugaauguaugauugugaacugugaa

SEQ ID NO: 711309 - RNA, 64 nt, Homo Sapiens
aaaagagaaugaauguaugauugugaacugugaagagaaugaugcaggauccuauuuaguuacu

SEQ ID NO: 711310 - RNA, 64 nt, Homo Sapiens
ccuggagucauguugaagguucaacuacgguugggagaaugagauaggaggcuguggguuuuau

SEQ ID NO: 711311 - RNA, 64 nt, Homo Sapiens
gucuuuuuuuuuuuuuuuuuaggccucgagcagagagaaugaaacgaaaucuuagugcccacgg

SEQ ID NO: 711312 - RNA, 64 nt, Homo Sapiens
uucugcuugagggagggaauccaugaucguaagggagaaugacauaggguucucacagcgucau

SEQ ID NO: 711313 - RNA, 64 nt, Homo Sapiens
cgugagcacaucuuuagggaaguuuugugcuuuggagaaugacuccuuuccuuucugaaaauaa

SEQ ID NO: 711314 - RNA, 64 nt, Homo Sapiens
cuuguggagagcuuauacagcugaggcuuaggaagagaaugaaaccauugcacagauggggaaa

SEQ ID NO: 711315 - RNA, 64 nt, Homo Sapiens
uucagucucucugaaaaugauugucacgucuucugagaaugacugacauuuccaagcagacugu

SEQ ID NO: 711316 - RNA, 64 nt, Homo Sapiens
uuccuauaacuuggacgaugaccaggcggcuugggagaaugagcugcagaagaugacccggggg

SEQ ID NO: 711317 - RNA, 64 nt, Homo Sapiens
gcagaggagccucucaccuccuguccucugacaugagaaugaaaccaggaauggacuuggaguu

SEQ ID NO: 711318 - RNA, 64 nt, Homo Sapiens
uccaaucugugauuaaaaguaguaggggaguaaggagaaugaauaauaacugccacauguggga

SEQ ID NO: 711319 - RNA, 64 nt, Homo Sapiens
guaauccuggagaaauugugaaaagucggaaaaugagaaugaggugacaaaugugaagcuggcc

SEQ ID NO: 711320 - RNA, 64 nt, Homo Sapiens
acauaagcaggcuggcucagaagacguggaccgggagaaugaguagagccagaggucagugcug

SEQ ID NO: 711321 - RNA, 64 nt, Homo Sapiens
ggguggagaaacuggaauguuggagcucaugcaggagaaugagcuugacuccagagccgcuuua

SEQ ID NO: 711322 - RNA, 64 nt, Homo Sapiens
auguuaauauugcuuuaugaaaguuuuucuuguagagaaugacacacuuaaguuauuuaugcaa

SEQ ID NO: 711323 - RNA, 64 nt, Homo Sapiens
gcaguugcauugauucaguggagagagaaagagagagaaugaauaugggcagaggugagagaga

SEQ ID NO: 711324 - RNA, 64 nt, Homo Sapiens
uacugaaagacuugguuaucaagucuuuuggggagagaaugacauuuuuuuuuugagacagagu

SEQ ID NO: 711325 - RNA, 64 nt, Homo Sapiens
cugggauuacaggugugagccaccgcgcccggccgagaaugacaucuuaaagccaccauugcgu

SEQ ID NO: 711326 - RNA, 64 nt, Homo Sapiens; identical to SEQ ID NO: 579602

SEQ ID NO: 711327 - RNA, 64 nt, Homo Sapiens; identical to SEQ ID NO: 579603

SEQ ID NO: 711328 - RNA, 64 nt, Homo Sapiens; identical to SEQ ID NO: 579604

SEQ ID NO: 711329 - RNA, 64 nt, Homo Sapiens; identical to SEQ ID NO: 579605

SEQ ID NO: 711330 - RNA, 64 nt, Homo Sapiens; identical to SEQ ID NO: 579606

SEQ ID NO: 711331 - RNA, 64 nt, Homo Sapiens; identical to SEQ ID NO: 579607

SEQ ID NO: 711332 - RNA, 64 nt, Homo Sapiens; identical to SEQ ID NO: 579608

SEQ ID NO: 711333 - RNA, 64 nt, Homo Sapiens; identical to SEQ ID NO: 579609

SEQ ID NO: 711334 - RNA, 64 nt, Homo Sapiens; identical to SEQ ID NO: 579610

SEQ ID NO: 711335 - RNA, 60 nt, Homo Sapiens; identical to SEQ ID NO: 579611

SEQ ID NO: 711336 - RNA, 64 nt, Homo Sapiens
uucaugagcagcugcuugaguucaggaaguucacuguuagaaauaggcuuuguuagcugacuag

SEQ ID NO: 711337 - RNA, 64 nt, Homo Sapiens
gauauugcagaugacuugcuuacuguauuugcauuguuagaaaacaguuuguagacaaugauuc

SEQ ID NO: 711338 - RNA, 64 nt, Homo Sapiens
aggguuaaacuuugaggaauugaguggaauaacuuguuagaauggcuacuuuguuagaaaauac

SEQ ID NO: 711339 - RNA, 64 nt, Homo Sapiens
uacugaguggaauaacuugucauuugugcuacuuuguuagaaaauccuuccaaagacuguuagg

SEQ ID NO: 711340 - RNA, 64 nt, Homo Sapiens
ucauuagaagaacuugauaaaagacucaaauaaauguuagaaagagcccguaauuuuaggacuc

SEQ ID NO: 711341 - RNA, 64 nt, Homo Sapiens
gagucacuuugaaauaguuaauucaacagcaccauguuagaaauauauuggcagccaagacucu

SEQ ID NO: 711342 - RNA, 64 nt, Homo Sapiens
uaucuuuucucacauucagacuuacacuuaaugguguuagaaaucaacaaaacuccuuuuuaaa

SEQ ID NO: 711343 - RNA, 64 nt, Homo Sapiens
uagguauauacugacaaggcuucaggaaaaaaguuguuagaagauuuuuuaauguauaauaaag

SEQ ID NO: 711344 - RNA, 64 nt, Homo Sapiens
ucauaagcaauaauuaaauguuauuugauuacuguguuagaauugcuuuauuuauuaaaccaua

SEQ ID NO: 711345 - RNA, 64 nt, Homo Sapiens
uugguauccuuuuugugccaugaagauacaucucuguuagaacauucaaaagaaauagcaugau

SEQ ID NO: 711346 - RNA, 64 nt, Homo Sapiens
uuccgcaccuccugaggcccuggaugauucuaauuguuagaaauucuaauuguuagaaauccuu

SEQ ID NO: 711347 - RNA, 64 nt, Homo Sapiens
gcccuggaugauucuaauuguuagaaauucuaauuguuagaaauccuuccuuauaaugaaugaa

SEQ ID NO: 711348 - RNA, 64 nt, Homo Sapiens
aaaguuauucuacuaguugcuguagaaggcucaguguuagaaauuucauuucuguaaauuccua

SEQ ID NO: 711349 - RNA, 51 nt, Homo Sapiens
cuucauacacuugugaaauuauguuagaagcaagcucuuucaacauccuga

SEQ ID NO: 711350 - RNA, 64 nt, Homo Sapiens
ugacgauguguuuguuccaguuuugagaaacgauuguuagaaaucuuauuuacucagcuuaccu

SEQ ID NO: 711351 - RNA, 64 nt, Homo Sapiens
aauacauuuauauuaggacuauccagaaggguuuuguuagaauguaaaaaguaaagaaaguugc

SEQ ID NO: 711352 - RNA, 64 nt, Homo Sapiens; identical to SEQ ID NO: 496651

SEQ ID NO: 711353 - RNA, 64 nt, Homo Sapiens; identical to SEQ ID NO: 496652

SEQ ID NO: 711354 - RNA, 64 nt, Homo Sapiens; identical to SEQ ID NO: 496653

SEQ ID NO: 711355 - RNA, 64 nt, Homo Sapiens; identical to SEQ ID NO: 496654

SEQ ID NO: 711356 - RNA, 64 nt, Homo Sapiens; identical to SEQ ID NO: 496655

SEQ ID NO: 711357 - RNA, 64 nt, Homo Sapiens; identical to SEQ ID NO: 496656

SEQ ID NO: 711358 - RNA, 64 nt, Homo Sapiens; identical to SEQ ID NO: 496657

SEQ ID NO: 711359 - RNA, 64 nt, Homo Sapiens; identical to SEQ ID NO: 496658

SEQ ID NO: 711360 - RNA, 64 nt, Homo Sapiens; identical to SEQ ID NO: 496659

SEQ ID NO: 711361 - RNA, 64 nt, Homo Sapiens; identical to SEQ ID NO: 496660

SEQ ID NO: 711362 - RNA, 64 nt, Homo Sapiens; identical to SEQ ID NO: 496661

SEQ ID NO: 711363 - RNA, 64 nt, Homo Sapiens; identical to SEQ ID NO: 496662

SEQ ID NO: 711364 - RNA, 64 nt, Homo Sapiens; identical to SEQ ID NO: 496663

SEQ ID NO: 711365 - RNA, 64 nt, Homo Sapiens; identical to SEQ ID NO: 496664

SEQ ID NO: 711366 - RNA, 64 nt, Homo Sapiens; identical to SEQ ID NO: 496665

SEQ ID NO: 711367 - RNA, 64 nt, Homo Sapiens; identical to SEQ ID NO: 496665

SEQ ID NO: 711368 - RNA, 52 nt, Homo Sapiens; identical to SEQ ID NO: 305420

SEQ ID NO: 711369 - RNA, 64 nt, Homo Sapiens; identical to SEQ ID NO: 305421

SEQ ID NO: 711370 - RNA, 64 nt, Homo Sapiens
agcuguucugggaauggcuggucuucauauucccaguggagaggggaacaaguggggcugggca

SEQ ID NO: 711371 - RNA, 64 nt, Homo Sapiens
ccuguccucaugcggcuuauguuuucuggaggaaaguggagacacaaguccuuggcuuuagggc

SEQ ID NO: 711372 - RNA, 64 nt, Homo Sapiens
gggcucggguacaugggagcgcccaaggagguggaguggagagugucaucccaggacacuugag

SEQ ID NO: 711373 - RNA, 64 nt, Homo Sapiens
auugucagcgggcucacaugggggagcacccuggaguggagaugacacugcacgugggcguagu

SEQ ID NO: 711374 - RNA, 64 nt, Homo Sapiens
ucagaaaggcuuagccaaggccacaucugggaagaguggagaaauuugccacuugacgaucacg

SEQ ID NO: 711375 - RNA, 64 nt, Homo Sapiens
cagugucccacccuucacuucccgagggcgggugaguggagagcagagccaggagcucuggcag

SEQ ID NO: 711376 - RNA, 64 nt, Homo Sapiens
ggggcgggggugguggugaacucgggcuacugagaguggagaugaggaguggagaaugggaggg

SEQ ID NO: 711377 - RNA, 64 nt, Homo Sapiens
gggagggcucgggcuacugaaauugggucgaaggaguggagaaucacgguucuugacuuagugg

SEQ ID NO: 711378 - RNA, 64 nt, Homo Sapiens
uaaugcugaggcuauugcugaauaauggcuaucaaguggagaugugcuuugacugcaugcaugg

SEQ ID NO: 711379 - RNA, 64 nt, Homo Sapiens
uuaugggucuccagaaacucugccagccagccucaguggagaagcuuccucuaccaccagcuau

SEQ ID NO: 711380 - RNA, 64 nt, Homo Sapiens
uggugcccucaggaggagacaaagugugggcaggaguggagagccucuuugggugcacgguguc

SEQ ID NO: 711381 - RNA, 64 nt, Homo Sapiens
ggagcccuguuugcacguuccucauggucagagcaguggagacuugugcuuugccugccucagc

SEQ ID NO: 711382 - RNA, 64 nt, Homo Sapiens
aagugauucacucauccugagacuuucuuuuugcaguggagagagagaauaaucuaguuggggc

SEQ ID NO: 711383 - RNA, 64 nt, Homo Sapiens
uuaauuaaggggugaugauuugcaagagaaaauuaguggagagucacauagguaaaucauuauu

SEQ ID NO: 711384 - RNA, 64 nt, Homo Sapiens
uuuuaauuaaaagaaugugugaacuguaaggguuaguggagaguuguaaaacaaggauaauacu

SEQ ID NO: 711385 - RNA, 64 nt, Homo Sapiens
aaacaaacauaguggguauaaaugaguaacuuugaguggagaagcucaaucuucagcuacaggg

SEQ ID NO: 711386 - RNA, 64 nt, Homo Sapiens
gcaccaccaugcccggcuaauuuuuuguauuuuuaguggagacaggguuucaccauguuggcca

SEQ ID NO: 711387 - RNA, 64 nt, Homo Sapiens
ugugccaccauaccuggguaauuuuugcauuuuuaguggagagggaguuucaccauguuggcca

SEQ ID NO: 711388 - RNA, 64 nt, Homo Sapiens
cgccacugcacuccagccugcagagcuugcagugaguggagaugaauggcaugaaccugggagg

SEQ ID NO: 711389 - RNA, 64 nt, Homo Sapiens
gcccccccuccccaacauauuccauuauagugugaguggagacuaacuuggcugucauuuuucu

SEQ ID NO: 711390 - RNA, 64 nt, Homo Sapiens
uauacaugucuaucaaacccagacuugcuuccguaguggagacuugcuuuucagaacauaggga

SEQ ID NO: 711391 - RNA, 64 nt, Homo Sapiens
aaguaucaugucuccuuuaacuagcauaccccgaaguggagaagggugcagcaggcucaaaggc

SEQ ID NO: 711392 - RNA, 64 nt, Homo Sapiens; identical to SEQ ID NO: 418746

SEQ ID NO: 711393 - RNA, 64 nt, Homo Sapiens; identical to SEQ ID NO: 418747

SEQ ID NO: 711394 - RNA, 64 nt, Homo Sapiens; identical to SEQ ID NO: 418748

SEQ ID NO: 711395 - RNA, 64 nt, Homo Sapiens; identical to SEQ ID NO: 418749

SEQ ID NO: 711396 - RNA, 64 nt, Homo Sapiens; identical to SEQ ID NO: 418750

SEQ ID NO: 711397 - RNA, 64 nt, Homo Sapiens; identical to SEQ ID NO: 418751

SEQ ID NO: 711398 - RNA, 64 nt, Homo Sapiens; identical to SEQ ID NO: 418752

SEQ ID NO: 711399 - RNA, 64 nt, Homo Sapiens; identical to SEQ ID NO: 418753

SEQ ID NO: 711400 - RNA, 64 nt, Homo Sapiens; identical to SEQ ID NO: 418754

SEQ ID NO: 711401 - RNA, 64 nt, Homo Sapiens; identical to SEQ ID NO: 418755

SEQ ID NO: 711402 - RNA, 64 nt, Homo Sapiens; identical to SEQ ID NO: 418756

SEQ ID NO: 711403 - RNA, 64 nt, Homo Sapiens; identical to SEQ ID NO: 418757

SEQ ID NO: 711404 - RNA, 64 nt, Homo Sapiens; identical to SEQ ID NO: 418758

SEQ ID NO: 711405 - RNA, 64 nt, Homo Sapiens; identical to SEQ ID NO: 418759

SEQ ID NO: 711406 - RNA, 64 nt, Homo Sapiens; identical to SEQ ID NO: 418760

SEQ ID NO: 711407 - RNA, 64 nt, Homo Sapiens; identical to SEQ ID NO: 418761

SEQ ID NO: 711408 - RNA, 64 nt, Homo Sapiens; identical to SEQ ID NO: 418762

SEQ ID NO: 711409 - RNA, 64 nt, Homo Sapiens; identical to SEQ ID NO: 418763

SEQ ID NO: 711410 - RNA, 64 nt, Homo Sapiens; identical to SEQ ID NO: 418764

SEQ ID NO: 711411 - RNA, 64 nt, Homo Sapiens; identical to SEQ ID NO: 418765

SEQ ID NO: 711412 - RNA, 64 nt, Homo Sapiens; identical to SEQ ID NO: 418766

SEQ ID NO: 711413 - RNA, 64 nt, Homo Sapiens; identical to SEQ ID NO: 418767

SEQ ID NO: 711414 - RNA, 64 nt, Homo Sapiens; identical to SEQ ID NO: 418768

SEQ ID NO: 711415 - RNA, 64 nt, Homo Sapiens; identical to SEQ ID NO: 418769

SEQ ID NO: 711416 - RNA, 64 nt, Homo Sapiens; identical to SEQ ID NO: 418770

SEQ ID NO: 711417 - RNA, 64 nt, Homo Sapiens; identical to SEQ ID NO: 418771

SEQ ID NO: 711418 - RNA, 64 nt, Homo Sapiens; identical to SEQ ID NO: 418772

SEQ ID NO: 711419 - RNA, 64 nt, Homo Sapiens; identical to SEQ ID NO: 418773

SEQ ID NO: 711420 - RNA, 64 nt, Homo Sapiens; identical to SEQ ID NO: 418774

SEQ ID NO: 711421 - RNA, 64 nt, Homo Sapiens; identical to SEQ ID NO: 418775

SEQ ID NO: 711422 - RNA, 64 nt, Homo Sapiens; identical to SEQ ID NO: 418776

SEQ ID NO: 711423 - RNA, 64 nt, Homo Sapiens; identical to SEQ ID NO: 418777

SEQ ID NO: 711424 - RNA, 64 nt, Homo Sapiens; identical to SEQ ID NO: 418778

SEQ ID NO: 711425 - RNA, 64 nt, Homo Sapiens; identical to SEQ ID NO: 418779

SEQ ID NO: 711426 - RNA, 64 nt, Homo Sapiens; identical to SEQ ID NO: 418780

SEQ ID NO: 711427 - RNA, 64 nt, Homo Sapiens; identical to SEQ ID NO: 418781

SEQ ID NO: 711428 - RNA, 64 nt, Homo Sapiens; identical to SEQ ID NO: 418782

SEQ ID NO: 711429 - RNA, 64 nt, Homo Sapiens; identical to SEQ ID NO: 418783

SEQ ID NO: 711430 - RNA, 64 nt, Homo Sapiens; identical to SEQ ID NO: 418784

SEQ ID NO: 711431 - RNA, 64 nt, Homo Sapiens; identical to SEQ ID NO: 418785

SEQ ID NO: 711432 - RNA, 64 nt, Homo Sapiens; identical to SEQ ID NO: 418786

SEQ ID NO: 711433 - RNA, 64 nt, Homo Sapiens; identical to SEQ ID NO: 418787

SEQ ID NO: 711434 - RNA, 64 nt, Homo Sapiens; identical to SEQ ID NO: 418788

SEQ ID NO: 711435 - RNA, 64 nt, Homo Sapiens; identical to SEQ ID NO: 418789

SEQ ID NO: 711436 - RNA, 64 nt, Homo Sapiens; identical to SEQ ID NO: 418790

SEQ ID NO: 711437 - RNA, 64 nt, Homo Sapiens; identical to SEQ ID NO: 418791

SEQ ID NO: 711438 - RNA, 64 nt, Homo Sapiens; identical to SEQ ID NO: 418792

SEQ ID NO: 711439 - RNA, 64 nt, Homo Sapiens; identical to SEQ ID NO: 418793

SEQ ID NO: 711440 - RNA, 64 nt, Homo Sapiens; identical to SEQ ID NO: 418794

SEQ ID NO: 711441 - RNA, 64 nt, Homo Sapiens; identical to SEQ ID NO: 418795

SEQ ID NO: 711442 - RNA, 64 nt, Homo Sapiens; identical to SEQ ID NO: 418796

SEQ ID NO: 711443 - RNA, 64 nt, Homo Sapiens; identical to SEQ ID NO: 418797

SEQ ID NO: 711444 - RNA, 64 nt, Homo Sapiens; identical to SEQ ID NO: 418798

SEQ ID NO: 711445 - RNA, 64 nt, Homo Sapiens; identical to SEQ ID NO: 418799

SEQ ID NO: 711446 - RNA, 64 nt, Homo Sapiens; identical to SEQ ID NO: 418800

SEQ ID NO: 711447 - RNA, 64 nt, Homo Sapiens
ugucaaguuggguucacuugccaugcaggaagaggcccacuagagggcccaucaggcaguguua

SEQ ID NO: 711448 - RNA, 64 nt, Homo Sapiens
uaugguagggugcucagcagcaucccuggccucugcccacuagacaucagaagcacucccccag

SEQ ID NO: 711449 - RNA, 64 nt, Homo Sapiens
agaauccgaccacuuuccaauccagugccaauuggcccacuaagcauccuaaaggugaaugugc

SEQ ID NO: 711450 - RNA, 64 nt, Homo Sapiens
uuuugcuuucaccaauugauuccuucuucuuuuagcccacuauuaaaacauuucuuacugaaug

SEQ ID NO: 711451 - RNA, 64 nt, Homo Sapiens
ucuguucauucacugcacaagauauuuauugagugcccacuacgugccaggcacuguugcugag

SEQ ID NO: 711452 - RNA, 64 nt, Homo Sapiens
cccacuggacucaccuccccgucuaucuuugagcgcccacuagauguguuggcgcuuugcuuug

SEQ ID NO: 711453 - RNA, 64 nt, Homo Sapiens
guucugccucagccuccugaccuccccggggacagcccacuaagcgucgagaccaccagagcua

SEQ ID NO: 711454 - RNA, 64 nt, Homo Sapiens
ggcuccccuggucuccuccccguagccacucucugcccacuaccuaugcuucuagaaagccccu

SEQ ID NO: 711455 - RNA, 64 nt, Homo Sapiens
auuaagcuuaaauaauacguaaugggacuagauggcccacuaagccacuguuauuuuccuuccu

SEQ ID NO: 711456 - RNA, 64 nt, Homo Sapiens
ggaaaagcuaauucuauugcugagaaauucucaugcccacuaaaauuuauaaacuaacuggaac

SEQ ID NO: 711457 - RNA, 64 nt, Homo Sapiens
cgggagucuccucacugccacuaaaauccacccagcccacuaacugaggagcuaguguuaaucc

SEQ ID NO: 711458 - RNA, 64 nt, Homo Sapiens
ucugggacaggacaccuuggguuuguggacugcagcccacuaugauguuauuacuucucuggcc

SEQ ID NO: 711459 - RNA, 64 nt, Homo Sapiens
cauuauguuuggaauugcuuucuauaagaaaauugcccacuacuacuaacuugaucaacaauga

SEQ ID NO: 711460 - RNA, 64 nt, Homo Sapiens
ccuaaccugccucuggccccaguucguuuccucugcccacuaaucccugcgcaggacuucccag

SEQ ID NO: 711461 - RNA, 57 nt, Homo Sapiens
ggggcacccaccaguugcuggcugagcgcccacuagaucccauuugagcagcuguga

SEQ ID NO: 711462 - RNA, 64 nt, Homo Sapiens
agcccccagcaucucccaccggaugggcuggggggcccacuagcgggcagaggaggggugguca

SEQ ID NO: 711463 - RNA, 64 nt, Homo Sapiens
uagauagcuuuuuuuuuuuucuaaggaauauucagcccacuacaaguacuuauuaauugagucc

SEQ ID NO: 711464 - RNA, 64 nt, Homo Sapiens
aucaaacaaacaaacaaaaaaucagaccaucugagcccacuacucaacuggugucuuaccccaa

SEQ ID NO: 711465 - RNA, 64 nt, Homo Sapiens
uauuuuuaucggcuaggcguugcuaaagcuaggggcccacuaaaaagcaaauuucuaucagccu

SEQ ID NO: 711466 - RNA, 64 nt, Homo Sapiens
cggggcggggguugggacccccgcuugccgcggggcccacuaggcucuugaagcuguucagaag

SEQ ID NO: 711467 - RNA, 64 nt, Homo Sapiens
gcgugggacguggucagggcagggcucauucauugcccacuaggaucccacuggcgaagauggu

SEQ ID NO: 711468 - RNA, 64 nt, Homo Sapiens
gguaucacuccgagucucaaccucuuccccaguggcccacuaauccggcuucuccgcaggcuuu

SEQ ID NO: 711469 - RNA, 64 nt, Homo Sapiens
gauaacuauauuccuuuugccaauacuuuagcaagcccacuaaaagaggacacugauuaguugu

SEQ ID NO: 711470 - RNA, 64 nt, Homo Sapiens
cacccccacuacagcauugucagagcugaagccagcccacuacccaucagcccccacaauuugu

SEQ ID NO: 711471 - RNA, 64 nt, Homo Sapiens
ucuacucuagugcucucuuuaaagcaaauaaacugcccacuaucuccugaacuggaugucccua

SEQ ID NO: 711472 - RNA, 64 nt, Homo Sapiens
uguccuggguucucucuacuucacagacucgccugcccacuacgguccuucgguucuuacugag

SEQ ID NO: 711473 - RNA, 64 nt, Homo Sapiens
uauacauauauauuuauguaguuugcuuacauuggcccacuauagauuuggugugauaccuugu

SEQ ID NO: 711474 - RNA, 64 nt, Homo Sapiens
aucgaggaggacagucugcaccugacuggaucaagcccacuaacuuuuucucuucagaccuuca

SEQ ID NO: 711475 - RNA, 64 nt, Homo Sapiens
aaaccaagaaguuugacugggcuguuggcacauagcccacuaggaccuguuaccuugugaaguu

SEQ ID NO: 711476 - RNA, 64 nt, Homo Sapiens
gcccugggagagccagacccgugaaggagccagugcccacuaugcuguguuuggagacggccaa

SEQ ID NO: 711477 - RNA, 64 nt, Homo Sapiens
gcccuugagcuccccaaaaaccucacccgaggcugcccacuauggucaucuuuuucucuaaaau

SEQ ID NO: 711478 - RNA, 64 nt, Homo Sapiens
uucucccccagccacccucugccccugugguagagcccacuauaggcccaggcgccuuacgugc

SEQ ID NO: 711479 - RNA, 64 nt, Homo Sapiens
ggggaauccgcacucacaaaagaagacaaauggcgcccacuaguugagcugcacggaaggaaua

SEQ ID NO: 711480 - RNA, 64 nt, Homo Sapiens
gucuuaaugcuaaaugcucaaaaagccaaauuuggcccacuaugucaagugaaccuucaaaaac

SEQ ID NO: 711481 - RNA, 64 nt, Homo Sapiens
uccagccuguggcuuugcccggagcccccagccugcccacuacagcccgaguagagggcauccc

SEQ ID NO: 711482 - RNA, 64 nt, Homo Sapiens
cuaaagugaaaugggacagugccuugcagucuuugcccacuauacauaggcuaaggcuaagcuc

SEQ ID NO: 711483 - RNA, 64 nt, Homo Sapiens
ggaagggaacugggccucggagccucacugagcugcccacuacuccugcccagacuuucuaucc

SEQ ID NO: 711484 - RNA, 64 nt, Homo Sapiens
ugcacagaccccuguguucugugggugaacaacugcccacuaaccagacuggaaaacccagaaa

SEQ ID NO: 711485 - RNA, 64 nt, Homo Sapiens
uuguuccaagaaugauaugaaaggugaagaagaggcccacuagaggcuucauacugagacccag

SEQ ID NO: 711486 - RNA, 64 nt, Homo Sapiens
cauuuuuguauccugcaagcaucagacagaucuggcccacuaccgguuugacaaaugacagucc

SEQ ID NO: 711487 - RNA, 64 nt, Homo Sapiens
aaauaaaucauucucuucucaagauaugugugaagcccacuaggagugaugcaagcaucaugau

SEQ ID NO: 711488 - RNA, 64 nt, Homo Sapiens
aacuauaggagaaagaaguuauggacugggcaaagcccacuauagcagaggccccuuuaguauu

SEQ ID NO: 711489 - RNA, 64 nt, Homo Sapiens
uaggaccugccacacaagcagccguggacacaacgcccacuaccaccucccacauggaaaugua

SEQ ID NO: 711490 - RNA, 64 nt, Homo Sapiens
auugugaaauauggaauuauuucugacacaugaagcccacuaaacuaugcuuucuuauaaugca

SEQ ID NO: 711491 - RNA, 64 nt, Homo Sapiens
gccagaggagcuuguaacucuuuauccucauggugcccacuacgagucauacucuuccccaugc

SEQ ID NO: 711492 - RNA, 64 nt, Homo Sapiens
gaaaugcuaacaucccugccugguagccagacuagcccacuaaagcuccccuguaaaugggggc

SEQ ID NO: 711493 - RNA, 64 nt, Homo Sapiens
aaguuccacuuaacacaugacucuuaaaugaagugcccacuaagcaaagagcucuuuuuuagcu

SEQ ID NO: 711494 - RNA, 64 nt, Homo Sapiens
ucaggcacggacagggcacaugauaccaacugcugcccacuacggcacgccgcaccggagcacg

SEQ ID NO: 711495 - RNA, 64 nt, Homo Sapiens
aucaauauguggaacuucuuuaagcauucagugugcccacuaaaugccagccacaccuccacuu

SEQ ID NO: 711496 - RNA, 64 nt, Homo Sapiens
ugccucagccucccgagcagcugggauuacaggcgcccacuaauuuuuguauucuuaguagaaa

SEQ ID NO: 711497 - RNA, 64 nt, Homo Sapiens
gguugggcaauagucugcuuccacggugaucagagcccacuagcaggcuaagauuucuaaagua

SEQ ID NO: 711498 - RNA, 64 nt, Homo Sapiens
uaguuuggaaacaucacucuuucauccccaggaagcccacuacaaugaacaagucugcuaccuc

SEQ ID NO: 711499 - RNA, 64 nt, Homo Sapiens
cagaggccaaaggucggcagucuuguuaucaggagcccacuaugggccugggugcagguuaacu

SEQ ID NO: 711500 - RNA, 64 nt, Homo Sapiens
cauagcagcuccugaggcagcauccauggauugggcccacuacucucuaagaaccuucuauuca

SEQ ID NO: 711501 - RNA, 64 nt, Homo Sapiens
uggcauauaaacuuauaguagcaggccugcuuaagcccacuaccuaaacucagaaauacccaaa

SEQ ID NO: 711502 - RNA, 64 nt, Homo Sapiens
ggguuagggaccuauuuuuaacacuagggggcuggcccacuaggagggcuggcccuaagauaca

SEQ ID NO: 711503 - RNA, 64 nt, Homo Sapiens
uuugacuuacaguauaaccauguagccaauuguggcccacuaaaaucuacagaaguuaaugugg

SEQ ID NO: 711504 - RNA, 64 nt, Homo Sapiens
ugaucauuccagcuccucugggcucuggccucaggcccacuaaugauccugcuacccucuugaa

SEQ ID NO: 711505 - RNA, 64 nt, Homo Sapiens
gggucggcacacugucaguacaucaggcacaugggcccacuaggcugggguuucugguuuuguu

SEQ ID NO: 711506 - RNA, 64 nt, Homo Sapiens
gcugcaaaccacuguaccugccucagucaggccugcccacuaugggcagaccucucgcucagcc

SEQ ID NO: 711507 - RNA, 64 nt, Homo Sapiens
gcugugagagaggagcagguccucagcccaugccgcccacuaggccucagaccacaggggaggg

SEQ ID NO: 711508 - RNA, 64 nt, Homo Sapiens
agcuccuuuggcugggccaagaaggaucuagucugcccacuacauucucaaacaagaggacuug

SEQ ID NO: 711509 - RNA, 64 nt, Homo Sapiens
agccguggggggaagcacauaaucccgccccagggcccacuagcauccacugauuggaccuuau

SEQ ID NO: 711510 - RNA, 64 nt, Homo Sapiens
uucaggccauuuagaguuguauucccuguccccugcccacuaccacuagaucaggcagggaucc

SEQ ID NO: 711511 - RNA, 64 nt, Homo Sapiens
ggguuuuuuauucuuuggaguagaaaagaauggagcccacuaauauuauauuuuucuucugaaa

SEQ ID NO: 711512 - RNA, 64 nt, Homo Sapiens
aucccugcuccagcugccccucguccacgccugcgcccacuauccagccaccaccugccccgcc

SEQ ID NO: 711513 - RNA, 64 nt, Homo Sapiens
cugaggguucugaaaucaauguggucccucucuugcccacuaaacaaagaugguuguucggggu

SEQ ID NO: 711514 - RNA, 64 nt, Homo Sapiens
agaaacaguuugggaagaaaaggaaaagaaucccgcccacuaagacgcgaccccucagacaggg

SEQ ID NO: 711515 - RNA, 64 nt, Homo Sapiens
gguugcuuguccauggccaacgucccuaaagugagcccacuacugaggugggcuuugugguuug

SEQ ID NO: 711516 - RNA, 64 nt, Homo Sapiens
cucauauuauuuuccuuuugcaggcaucaucauagcccacuaguguacaguagcuggcuauuca

SEQ ID NO: 711517 - RNA, 64 nt, Homo Sapiens
ugccgaccccucagaauauauaucccuucguggagcccacuaggaagcuccucacuggaggccu

SEQ ID NO: 711518 - RNA, 64 nt, Homo Sapiens
gccuuuguagugcuuucggcgcauuuuuccagaagcccacuauucugaccaccagacaauuacu

SEQ ID NO: 711519 - RNA, 64 nt, Homo Sapiens
agaauugugacauaacgcugccagaugauguccugcccacuaaauaugucacugggaccaucac

SEQ ID NO: 711520 - RNA, 64 nt, Homo Sapiens
ccuuuuauuuuucuauuaccuugcuaccaaacaguuuagauagcaauauaauagcaaaaaagca

SEQ ID NO: 711521 - RNA, 64 nt, Homo Sapiens
aacuaucaugguuauaauucuauugggaaagacuuuuagauaacaaagauuucaaauguuaaaa

SEQ ID NO: 711522 - RNA, 64 nt, Homo Sapiens
aaagcuuauuuucauuauuaccauauaguauccuuuuagauacagauagguaacauguuuguaa

SEQ ID NO: 711523 - RNA, 64 nt, Homo Sapiens
uuuuuguccauucuaaaagucuauugagacagcuuuuagauacuugaauguacaaagacccaca

SEQ ID NO: 711524 - RNA, 64 nt, Homo Sapiens
agaaaauguuacugaacuauugacugaaaguaaauuuagauaaaauacagcuuuuuuccuuaug

SEQ ID NO: 711525 - RNA, 64 nt, Homo Sapiens
uacauauugaccaauggccucugaaaaagcacauuuuagauacugaaauugaaggaaagaaaau

SEQ ID NO: 711526 - RNA, 64 nt, Homo Sapiens
gguuaggaaguugauuauuauuuaguuggaggccuuuagauauuauucauucauuuacucauuc

SEQ ID NO: 711527 - RNA, 64 nt, Homo Sapiens
uuugcauaauagaaauuaccagaguuguucugucuuuagauaagguuugaaccaaagcucaaaa

SEQ ID NO: 711528 - RNA, 64 nt, Homo Sapiens
cagagauaaaaauagccccuguacugugcugauuuuuagauauaugggcuccugcccaguuugg

SEQ ID NO: 711529 - RNA, 64 nt, Homo Sapiens
guauauucuuccccagggaaauaacaucucuccauuuagauaaacccuaccuucaaaaauauau

SEQ ID NO: 711530 - RNA, 64 nt, Homo Sapiens
auuuagggcaggagugagaggucucucuuccugauuuagauaugcaaaagcugguauguucagu

SEQ ID NO: 711531 - RNA, 64 nt, Homo Sapiens
gauuacaguguagcuugcccaccgcauuugucguuuuagauacuuugcuagccggccacuuugg

SEQ ID NO: 711532 - RNA, 64 nt, Homo Sapiens
auuuuuuuuuaaguaggaccaaaggaaaacaagauuuagauagucugacuuugcuuuugaacaa

SEQ ID NO: 711533 - RNA, 64 nt, Homo Sapiens
uccuaauucgugggguuuuuuuuuguaaaaacaguuuagauaauccugaaugcaaucauuaacu

SEQ ID NO: 711534 - RNA, 64 nt, Homo Sapiens
uaauaaaauucgagcuacauacugacagaggacauuuagauacaagaauuuaaaccaaauuaaa

SEQ ID NO: 711535 - RNA, 64 nt, Homo Sapiens
uaacauuuauuuaacuuaaauuguuaauuaaaauuuuagauacuuaaauuuaauuuaccaaaua

SEQ ID NO: 711536 - RNA, 64 nt, Homo Sapiens
auauugagccaauuuaaauaaccacuggucuagcuuuagauaggccaggcuccaugcuuugaaa

SEQ ID NO: 711537 - RNA, 64 nt, Homo Sapiens
uuguugagccaauuuaaguaagaauaaagauuucuuuagauagguucagaaaauguaguuuaca

SEQ ID NO: 711538 - RNA, 64 nt, Homo Sapiens
ccaggaaaaaaaaaaaaaaaaaguccuguucuucuuuagauaaacaagagacauuuucauaauu

SEQ ID NO: 711539 - RNA, 64 nt, Homo Sapiens
uacaacuaauacuauuauuauccuucuuuuuuuauuuagauaauucuuuuaauuuaaacaaagg

SEQ ID NO: 711540 - RNA, 64 nt, Homo Sapiens
uauuaaagguuguuaagaugaaacaaacucugcauuuagauaacacugcuuuguuucauuucau

SEQ ID NO: 711541 - RNA, 64 nt, Homo Sapiens
auacuguuaauauuuuauugaguaguaaaccuguuuuagauaucggauguaacuugaugugagc

SEQ ID NO: 711542 - RNA, 64 nt, Homo Sapiens
uuagucugguggacuggacuaauuacuugaaggauuuagauagaguauuugcacugcugaagag

SEQ ID NO: 711543 - RNA, 64 nt, Homo Sapiens
uuuugcuuacccuaagagagguuuucuucuuauuuuuagauaauucaagugcuuagauaaauua

SEQ ID NO: 711544 - RNA, 64 nt, Homo Sapiens
uuuuagaaaaauaaauaaauauuuauagaccucuuuuagauauuuuaauaaaggauccuuugga

SEQ ID NO: 711545 - RNA, 64 nt, Homo Sapiens
aagccaucacaaaacacuauaagacugaccaaaauuuagauaaccuuugaaccacgauuuuuuu

SEQ ID NO: 711546 - RNA, 64 nt, Homo Sapiens
cucuaaauugagaaugguguagcacagaugacauuuuagauacacuuguucaaaaacagaggcc

SEQ ID NO: 711547 - RNA, 64 nt, Homo Sapiens
aagucucaccauucccuuuuagggacagggucucuuuagauagcacugagucucugaagaccac

SEQ ID NO: 711548 - RNA, 64 nt, Homo Sapiens
uauuauauuuaagaugcucaaaagaauaguuaguacuccaaaaacuuuuaacaguuacagcaau

SEQ ID NO: 711549 - RNA, 64 nt, Homo Sapiens
ucucaggaauuaaacuuuuaaagaacuuuuaccgacuccaaaaauucuuuccucugcucacuuu

SEQ ID NO: 711550 - RNA, 64 nt, Homo Sapiens
cgugauuagugaaaggaagauaaacguggauguuacuccaaaacuucguuuaaugaaugcuuaa

SEQ ID NO: 711551 - RNA, 64 nt, Homo Sapiens
aaaacaaacaauaccugaaugcucuguagccuaaacuccaaacauccucuuccauauggaucca

SEQ ID NO: 711552 - RNA, 64 nt, Homo Sapiens
auggcaccgcccugcaucccuaauaccaaaucugacuccaaaauuguggggugugacauacaag

SEQ ID NO: 711553 - RNA, 64 nt, Homo Sapiens
cauuacuacgccuccccacacgcccagaccccucacuccaaaauccuacuggcuguagcagaga

SEQ ID NO: 711554 - RNA, 64 nt, Homo Sapiens
uggcuaugcuggaucaucgcagcagcaggagacuacuccaaagggacgaccugacccaggggac

SEQ ID NO: 711555 - RNA, 64 nt, Homo Sapiens
caacaggcccucccucugccagcagacacuagacacuccaaagaacauggugguggucgaaguc

SEQ ID NO: 711556 - RNA, 64 nt, Homo Sapiens
ucaguuuccugauaaagauagcuuuaacaaacuaacuccaaauccuaaguaagcaacuuaaguu

SEQ ID NO: 711557 - RNA, 64 nt, Homo Sapiens
guauaauuacguaaacacauagcugugacaguacacuccaaaaugcuauuuaggguaggcuaac

SEQ ID NO: 711558 - RNA, 64 nt, Homo Sapiens
aacauggacuuuuacaaaacaaacuggacucauuacuccaaauaaucucaguucagaggcaacg

SEQ ID NO: 711559 - RNA, 64 nt, Homo Sapiens
aguagagaguaauauugaagaagugaaagaguucacuccaaauccaugaggcuuuaauauguaa

SEQ ID NO: 711560 - RNA, 64 nt, Homo Sapiens
caacucacaaagcaugaaccuuuacuccaaaacaacuccaaaaaugucuacauguuccuaaauc

SEQ ID NO: 711561 - RNA, 64 nt, Homo Sapiens
aacuccaaaaacaacucacaguuccuaaaucuuuacuccaaaacaauauucucuuugucuacau

SEQ ID NO: 711562 - RNA, 64 nt, Homo Sapiens
aaaaacccuuuuaauggaggcgaaaguuaacaaaacuccaaagcaauauuauuacuccaaagaa

SEQ ID NO: 711563 - RNA, 64 nt, Homo Sapiens
acgaaaguuaacaaaacuccagagaaauauuauuacuccaaagauguauucagcgccauacaca

SEQ ID NO: 711564 - RNA, 64 nt, Homo Sapiens; identical to SEQ ID NO: 71901

SEQ ID NO: 711565 - RNA, 64 nt, Homo Sapiens; identical to SEQ ID NO: 71902

SEQ ID NO: 711566 - RNA, 64 nt, Homo Sapiens; identical to SEQ ID NO: 71903

SEQ ID NO: 711567 - RNA, 64 nt, Homo Sapiens; identical to SEQ ID NO: 71904

SEQ ID NO: 711568 - RNA, 64 nt, Homo Sapiens; identical to SEQ ID NO: 71905

SEQ ID NO: 711569 - RNA, 64 nt, Homo Sapiens; identical to SEQ ID NO: 71906

SEQ ID NO: 711570 - RNA, 64 nt, Homo Sapiens; identical to SEQ ID NO: 71907

SEQ ID NO: 711571 - RNA, 64 nt, Homo Sapiens; identical to SEQ ID NO: 71908

SEQ ID NO: 711572 - RNA, 64 nt, Homo Sapiens; identical to SEQ ID NO: 71909

SEQ ID NO: 711573 - RNA, 64 nt, Homo Sapiens; identical to SEQ ID NO: 71910

SEQ ID NO: 711574 - RNA, 64 nt, Homo Sapiens; identical to SEQ ID NO: 71911

SEQ ID NO: 711575 - RNA, 64 nt, Homo Sapiens; identical to SEQ ID NO: 71912

SEQ ID NO: 711576 - RNA, 64 nt, Homo Sapiens; identical to SEQ ID NO: 71913

SEQ ID NO: 711577 - RNA, 64 nt, Homo Sapiens; identical to SEQ ID NO: 71914

SEQ ID NO: 711578 - RNA, 64 nt, Homo Sapiens; identical to SEQ ID NO: 71915

SEQ ID NO: 711579 - RNA, 64 nt, Homo Sapiens; identical to SEQ ID NO: 71916

SEQ ID NO: 711580 - RNA, 64 nt, Homo Sapiens; identical to SEQ ID NO: 71917

SEQ ID NO: 711581 - RNA, 64 nt, Homo Sapiens; identical to SEQ ID NO: 71918

SEQ ID NO: 711582 - RNA, 64 nt, Homo Sapiens; identical to SEQ ID NO: 71919

SEQ ID NO: 711583 - RNA, 64 nt, Homo Sapiens; identical to SEQ ID NO: 71920

SEQ ID NO: 711584 - RNA, 64 nt, Homo Sapiens; identical to SEQ ID NO: 71921

SEQ ID NO: 711585 - RNA, 64 nt, Homo Sapiens; identical to SEQ ID NO: 71922

SEQ ID NO: 711586 - RNA, 64 nt, Homo Sapiens; identical to SEQ ID NO: 71923

SEQ ID NO: 711587 - RNA, 64 nt, Homo Sapiens; identical to SEQ ID NO: 71924

SEQ ID NO: 711588 - RNA, 64 nt, Homo Sapiens; identical to SEQ ID NO: 71925

SEQ ID NO: 711589 - RNA, 64 nt, Homo Sapiens; identical to SEQ ID NO: 71926

SEQ ID NO: 711590 - RNA, 64 nt, Homo Sapiens; identical to SEQ ID NO: 71927

SEQ ID NO: 711591 - RNA, 64 nt, Homo Sapiens; identical to SEQ ID NO: 71928

SEQ ID NO: 711592 - RNA, 64 nt, Homo Sapiens; identical to SEQ ID NO: 71929

SEQ ID NO: 711593 - RNA, 64 nt, Homo Sapiens; identical to SEQ ID NO: 71930

SEQ ID NO: 711594 - RNA, 64 nt, Homo Sapiens; identical to SEQ ID NO: 71931

SEQ ID NO: 711595 - RNA, 64 nt, Homo Sapiens; identical to SEQ ID NO: 71932

SEQ ID NO: 711596 - RNA, 64 nt, Homo Sapiens; identical to SEQ ID NO: 71933

SEQ ID NO: 711597 - RNA, 64 nt, Homo Sapiens; identical to SEQ ID NO: 71934

SEQ ID NO: 711598 - RNA, 64 nt, Homo Sapiens; identical to SEQ ID NO: 71935

SEQ ID NO: 711599 - RNA, 64 nt, Homo Sapiens; identical to SEQ ID NO: 71936

SEQ ID NO: 711600 - RNA, 64 nt, Homo Sapiens; identical to SEQ ID NO: 71937

SEQ ID NO: 711601 - RNA, 64 nt, Homo Sapiens; identical to SEQ ID NO: 71938

SEQ ID NO: 711602 - RNA, 64 nt, Homo Sapiens; identical to SEQ ID NO: 71939

SEQ ID NO: 711603 - RNA, 64 nt, Homo Sapiens; identical to SEQ ID NO: 71940

SEQ ID NO: 711604 - RNA, 61 nt, Homo Sapiens
auugucaagcuccuaaaggguucauuuggccccuccucaaagacuaauguccccaugugaa

SEQ ID NO: 711605 - RNA, 61 nt, Homo Sapiens
cccacaccccacccucccuucccuucauaccccuccucaacguucuuuuacuuuauacuuu

SEQ ID NO: 711606 - RNA, 61 nt, Homo Sapiens
uuggagcacaauggugaagcacacuccccucccuccucaccugggguccaauguucugucu

SEQ ID NO: 711607 - RNA, 61 nt, Homo Sapiens
ucaccagcuucuugcucagggagacuuccgcccuccucacugaggcaacaugaagcccgag

SEQ ID NO: 711608 - RNA, 61 nt, Homo Sapiens
cuccagaauuacccuuccucgccucuaacucccuccucacacccuggcugaacagugcucu

SEQ ID NO: 711609 - RNA, 61 nt, Homo Sapiens
cagaccaaucuuaguuucuaugccucauccuccuccucauugccucggaggcuccucccuc

SEQ ID NO: 711610 - RNA, 61 nt, Homo Sapiens
ggggcucucagggcugggaggaccccagugcccuccucagaagaagcacaugggcuccugc

SEQ ID NO: 711611 - RNA, 61 nt, Homo Sapiens
cucacuugggggagcacagggccccgcugggccuccucaccaacggcagugccaaaaucag

SEQ ID NO: 711612 - RNA, 61 nt, Homo Sapiens
accuggggcucuugauccuggcacugcuggcccuccucacccuacuggguguuguucuggc

SEQ ID NO: 711613 - RNA, 61 nt, Homo Sapiens
ucccagcccaguccccgcgcgcgucccucuuccuccucauacuuucccuugacugagagcu

SEQ ID NO: 711614 - RNA, 61 nt, Homo Sapiens
cuuaauuauuauuuguguuuuaauuuaaacaccuccucauguacauacccuggccgccccc

SEQ ID NO: 711615 - RNA, 61 nt, Homo Sapiens
gcauuuuuauuuuaugaaauacuauuuaaagccuccucaucccguguucuccuuuuccucu

SEQ ID NO: 711616 - RNA, 61 nt, Homo Sapiens
ggaccaguagaggacacggaggguucagaccccuccucagacccuccccacaucugaaacu

SEQ ID NO: 711617 - RNA, 61 nt, Homo Sapiens
cguguuaaguccugguuccccaccugcugccccuccucaacacagagccccucccgccgcc

SEQ ID NO: 711618 - RNA, 61 nt, Homo Sapiens
cagccuccuugugagaguggcccaaagucccccuccucagcgcuugcugacuuagccuccu

SEQ ID NO: 711619 - RNA, 61 nt, Homo Sapiens
gggcuuucccccaacucaggugaacucggccccuccucaaucaaggagggaagagucccag

SEQ ID NO: 711620 - RNA, 61 nt, Homo Sapiens
cuagaguaaaagucccaguuuuaggaggcccccuccucacguuuacccagcaugacuuucc

SEQ ID NO: 711621 - RNA, 61 nt, Homo Sapiens
gaucacacugccgucacccaugcugcagcucccuccucagggaacaucccgcuucugaagc

SEQ ID NO: 711622 - RNA, 61 nt, Homo Sapiens
gcccccaagaugccgcagcuccagggcucuuccuccucaccagaaaucccugggcuuccac

SEQ ID NO: 711623 - RNA, 61 nt, Homo Sapiens
uuuauuccccagugggcaguuacugagcuuuccuccucagagccaugcuggcagcccuggg

SEQ ID NO: 711624 - RNA, 61 nt, Homo Sapiens
ucccucuauugcggauccacggauaaagcccccuccucacaaggguccuggggacggcaga

SEQ ID NO: 711625 - RNA, 61 nt, Homo Sapiens
uggauggaagguucugggugccucaacugugccuccucaggguacccggguaaaguggggg

SEQ ID NO: 711626 - RNA, 61 nt, Homo Sapiens
guuuuuaauauuaaacacauaugauaaucucccuccucaagugggcccagccagauaauac

SEQ ID NO: 711627 - RNA, 61 nt, Homo Sapiens
augcaggaggcugcccuguacggggccacugccuccucagcuccuacccaggcugccuggc

SEQ ID NO: 711628 - RNA, 61 nt, Homo Sapiens
auucucaccaggccaugggaguugccccucuccuccucacugugacagcagaccuggcugu

SEQ ID NO: 711629 - RNA, 61 nt, Homo Sapiens
gccauuauaguuuauuguguaaucccgugcuccuccucacuacagaucuccccacuacauu

SEQ ID NO: 711630 - RNA, 61 nt, Homo Sapiens
ccacguccuggggucaggccugcccaguguuccuccucacccuguuuccgcuacuauauua

SEQ ID NO: 711631 - RNA, 61 nt, Homo Sapiens
gcccaugaagaccccuucucaggccugcuuaccuccucacaucccaucucuacccagucuc

SEQ ID NO: 711632 - RNA, 61 nt, Homo Sapiens
ggaggacgcuguggggugagguccagggcugccuccucauggagcugugugugagcaggcg

SEQ ID NO: 711633 - RNA, 61 nt, Homo Sapiens
cuguagaacugcagaccugugcuguuugaugccuccucacugucccgucacuccugggaag

SEQ ID NO: 711634 - RNA, 61 nt, Homo Sapiens
gaggagagggccugugucugugccagaggucccuccucacaacccaccacacacccacaca

SEQ ID NO: 711635 - RNA, 61 nt, Homo Sapiens
agggcugagcaccuucucuggcuucccagaaccuccucacuugcauugagcaggcccaccu

SEQ ID NO: 711636 - RNA, 61 nt, Homo Sapiens
caccagaggacacacaggggcggaagucaguccuccucauuagugugagcggggcuuuagc

SEQ ID NO: 711637 - RNA, 61 nt, Homo Sapiens
caccagaggacacacacaggcggaagucagaccuccucagugagugugggagggcuuuagc

SEQ ID NO: 711638 - RNA, 61 nt, Homo Sapiens
cuccuuucaugucccugugccccccaguucuccuccucagccuuuuccuccucaguuuucu

SEQ ID NO: 711639 - RNA, 61 nt, Homo Sapiens
ugugccccccaguucuccuccucagccuuuuccuccucaguuuucucuuuaaaacugugaa

SEQ ID NO: 711640 - RNA, 61 nt, Homo Sapiens
aacuggggggaaaccgaaggcaagacugaauccuccucacaaucaccaucgcccuagggac

SEQ ID NO: 711641 - RNA, 61 nt, Homo Sapiens
accaucgcccuagggaccaaauucccuucuuccuccucaucugaagaucuccguggcugcc

SEQ ID NO: 711642 - RNA, 61 nt, Homo Sapiens
cacaagccaccucagcuugucgggucccuucccuccucagagcgugaaccccagggaacag

SEQ ID NO: 711643 - RNA, 61 nt, Homo Sapiens
ccucagggaugaccuccugcgcugaagcuauccuccucaggcccagccuucagugugggcu

SEQ ID NO: 711644 - RNA, 61 nt, Homo Sapiens
accugcucuucaccaacauccugcugcucaaccuccucaucgccauguucaagugagcgcc

SEQ ID NO: 711645 - RNA, 61 nt, Homo Sapiens
acggccgccccgccgcgccgccccccuucauccuccucagccaccugcagcucuucaucaa

SEQ ID NO: 711646 - RNA, 64 nt, Homo Sapiens
ucauaauaagcaaauuauuggcuucuuucuucuagacuaaaagaaauuaaagagaugaaacaau

SEQ ID NO: 711647 - RNA, 64 nt, Homo Sapiens
auaucauuaauuuuauaucaggauucauguaagagacuaaaaaugauccauagugguuaguacu

SEQ ID NO: 711648 - RNA, 64 nt, Homo Sapiens
uaccuagagagugaaacccguacaaugagauaaagacuaaaaagagaaaucccuuccuauauac

SEQ ID NO: 711649 - RNA, 64 nt, Homo Sapiens
ccaaucuuuuuucuaaaaauuaugcuggggucucgacuaaaacugaauuugaauuggaaaauuc

SEQ ID NO: 711650 - RNA, 64 nt, Homo Sapiens
ucuuuuucuagagaggaguugcuuaaaccaaugggacuaaaaccugaugggacaauaacgccuu

SEQ ID NO: 711651 - RNA, 64 nt, Homo Sapiens
guacucugucaucgaagagaccagcucugacacagacuaaaagcaucaccugcucaacucucaa

SEQ ID NO: 711652 - RNA, 64 nt, Homo Sapiens
cccccugcccccucaccuuuuuggguagguaaaagacuaaaagccauauggauuuuaacugaua

SEQ ID NO: 711653 - RNA, 64 nt, Homo Sapiens
aggauaguacacguuccccaggcccauaacagaggacuaaaaucucugaauuuuaaagacacag

SEQ ID NO: 711654 - RNA, 64 nt, Homo Sapiens
ggucaggguuuuuguguuguuuucaaauaaguuugacuaaaauaaguuuggcugacaguuuuug

SEQ ID NO: 711655 - RNA, 64 nt, Homo Sapiens
caaauuccauauguaaugccauugggagaguauugacuaaaauaucauucgucagggaaauaua

SEQ ID NO: 711656 - RNA, 64 nt, Homo Sapiens; identical to SEQ ID NO: 583228

SEQ ID NO: 711657 - RNA, 64 nt, Homo Sapiens; identical to SEQ ID NO: 583229

SEQ ID NO: 711658 - RNA, 64 nt, Homo Sapiens; identical to SEQ ID NO: 583230

SEQ ID NO: 711659 - RNA, 64 nt, Homo Sapiens; identical to SEQ ID NO: 583231

SEQ ID NO: 711660 - RNA, 64 nt, Homo Sapiens; identical to SEQ ID NO: 583232

SEQ ID NO: 711661 - RNA, 64 nt, Homo Sapiens; identical to SEQ ID NO: 583233

SEQ ID NO: 711662 - RNA, 64 nt, Homo Sapiens; identical to SEQ ID NO: 583234

SEQ ID NO: 711663 - RNA, 64 nt, Homo Sapiens; identical to SEQ ID NO: 583235

SEQ ID NO: 711664 - RNA, 64 nt, Homo Sapiens; identical to SEQ ID NO: 583236

SEQ ID NO: 711665 - RNA, 64 nt, Homo Sapiens; identical to SEQ ID NO: 583237

SEQ ID NO: 711666 - RNA, 64 nt, Homo Sapiens; identical to SEQ ID NO: 583238

SEQ ID NO: 711667 - RNA, 64 nt, Homo Sapiens; identical to SEQ ID NO: 583239

SEQ ID NO: 711668 - RNA, 64 nt, Homo Sapiens; identical to SEQ ID NO: 583240

SEQ ID NO: 711669 - RNA, 64 nt, Homo Sapiens; identical to SEQ ID NO: 583241

SEQ ID NO: 711670 - RNA, 64 nt, Homo Sapiens; identical to SEQ ID NO: 583242

SEQ ID NO: 711671 - RNA, 64 nt, Homo Sapiens; identical to SEQ ID NO: 583243

SEQ ID NO: 711672 - RNA, 64 nt, Homo Sapiens; identical to SEQ ID NO: 583244

SEQ ID NO: 711673 - RNA, 64 nt, Homo Sapiens; identical to SEQ ID NO: 583245

SEQ ID NO: 711674 - RNA, 64 nt, Homo Sapiens; identical to SEQ ID NO: 583246

SEQ ID NO: 711675 - RNA, 64 nt, Homo Sapiens; identical to SEQ ID NO: 583247

SEQ ID NO: 711676 - RNA, 64 nt, Homo Sapiens; identical to SEQ ID NO: 583248

SEQ ID NO: 711677 - RNA, 64 nt, Homo Sapiens; identical to SEQ ID NO: 583249

SEQ ID NO: 711678 - RNA, 64 nt, Homo Sapiens; identical to SEQ ID NO: 583250

SEQ ID NO: 711679 - RNA, 64 nt, Homo Sapiens; identical to SEQ ID NO: 583251

SEQ ID NO: 711680 - RNA, 64 nt, Homo Sapiens; identical to SEQ ID NO: 583252

SEQ ID NO: 711681 - RNA, 64 nt, Homo Sapiens; identical to SEQ ID NO: 583253

SEQ ID NO: 711682 - RNA, 64 nt, Homo Sapiens; identical to SEQ ID NO: 583254

SEQ ID NO: 711683 - RNA, 64 nt, Homo Sapiens; identical to SEQ ID NO: 583255

SEQ ID NO: 711684 - RNA, 64 nt, Homo Sapiens; identical to SEQ ID NO: 583256

SEQ ID NO: 711685 - RNA, 64 nt, Homo Sapiens; identical to SEQ ID NO: 583257

SEQ ID NO: 711686 - RNA, 64 nt, Homo Sapiens; identical to SEQ ID NO: 583258

SEQ ID NO: 711687 - RNA, 64 nt, Homo Sapiens; identical to SEQ ID NO: 583259

SEQ ID NO: 711688 - RNA, 64 nt, Homo Sapiens; identical to SEQ ID NO: 583260

SEQ ID NO: 711689 - RNA, 64 nt, Homo Sapiens; identical to SEQ ID NO: 583261

SEQ ID NO: 711690 - RNA, 64 nt, Homo Sapiens; identical to SEQ ID NO: 583262

SEQ ID NO: 711691 - RNA, 64 nt, Homo Sapiens; identical to SEQ ID NO: 583263

SEQ ID NO: 711692 - RNA, 64 nt, Homo Sapiens; identical to SEQ ID NO: 583264

SEQ ID NO: 711693 - RNA, 64 nt, Homo Sapiens; identical to SEQ ID NO: 583265

SEQ ID NO: 711694 - RNA, 64 nt, Homo Sapiens; identical to SEQ ID NO: 583266

SEQ ID NO: 711695 - RNA, 64 nt, Homo Sapiens; identical to SEQ ID NO: 583267

SEQ ID NO: 711696 - RNA, 64 nt, Homo Sapiens; identical to SEQ ID NO: 583268

SEQ ID NO: 711697 - RNA, 64 nt, Homo Sapiens; identical to SEQ ID NO: 583269

SEQ ID NO: 711698 - RNA, 64 nt, Homo Sapiens; identical to SEQ ID NO: 583270

SEQ ID NO: 711699 - RNA, 64 nt, Homo Sapiens; identical to SEQ ID NO: 583271

SEQ ID NO: 711700 - RNA, 64 nt, Homo Sapiens; identical to SEQ ID NO: 583272

SEQ ID NO: 711701 - RNA, 64 nt, Homo Sapiens; identical to SEQ ID NO: 583273

SEQ ID NO: 711702 - RNA, 64 nt, Homo Sapiens; identical to SEQ ID NO: 583274

SEQ ID NO: 711703 - RNA, 64 nt, Homo Sapiens; identical to SEQ ID NO: 583275

SEQ ID NO: 711704 - RNA, 64 nt, Homo Sapiens; identical to SEQ ID NO: 583276

SEQ ID NO: 711705 - RNA, 64 nt, Homo Sapiens; identical to SEQ ID NO: 110360

SEQ ID NO: 711706 - RNA, 64 nt, Homo Sapiens; identical to SEQ ID NO: 110361

SEQ ID NO: 711707 - RNA, 64 nt, Homo Sapiens; identical to SEQ ID NO: 110362

SEQ ID NO: 711708 - RNA, 64 nt, Homo Sapiens; identical to SEQ ID NO: 110363

SEQ ID NO: 711709 - RNA, 64 nt, Homo Sapiens; identical to SEQ ID NO: 110364

SEQ ID NO: 711710 - RNA, 64 nt, Homo Sapiens; identical to SEQ ID NO: 110365

SEQ ID NO: 711711 - RNA, 64 nt, Homo Sapiens; identical to SEQ ID NO: 110366

SEQ ID NO: 711712 - RNA, 64 nt, Homo Sapiens; identical to SEQ ID NO: 110367

SEQ ID NO: 711713 - RNA, 64 nt, Homo Sapiens; identical to SEQ ID NO: 110368

SEQ ID NO: 711714 - RNA, 64 nt, Homo Sapiens; identical to SEQ ID NO: 110369

SEQ ID NO: 711715 - RNA, 64 nt, Homo Sapiens; identical to SEQ ID NO: 110370

SEQ ID NO: 711716 - RNA, 64 nt, Homo Sapiens; identical to SEQ ID NO: 110371

SEQ ID NO: 711717 - RNA, 64 nt, Homo Sapiens; identical to SEQ ID NO: 110372

SEQ ID NO: 711718 - RNA, 64 nt, Homo Sapiens; identical to SEQ ID NO: 110373

SEQ ID NO: 711719 - RNA, 64 nt, Homo Sapiens; identical to SEQ ID NO: 110374

SEQ ID NO: 711720 - RNA, 64 nt, Homo Sapiens; identical to SEQ ID NO: 110375

SEQ ID NO: 711721 - RNA, 64 nt, Homo Sapiens; identical to SEQ ID NO: 110376

SEQ ID NO: 711722 - RNA, 64 nt, Homo Sapiens; identical to SEQ ID NO: 110377

SEQ ID NO: 711723 - RNA, 64 nt, Homo Sapiens; identical to SEQ ID NO: 110378

SEQ ID NO: 711724 - RNA, 64 nt, Homo Sapiens; identical to SEQ ID NO: 110379

SEQ ID NO: 711725 - RNA, 64 nt, Homo Sapiens; identical to SEQ ID NO: 110380

SEQ ID NO: 711726 - RNA, 64 nt, Homo Sapiens; identical to SEQ ID NO: 165842

SEQ ID NO: 711727 - RNA, 64 nt, Homo Sapiens; identical to SEQ ID NO: 165843

SEQ ID NO: 711728 - RNA, 64 nt, Homo Sapiens; identical to SEQ ID NO: 298981

SEQ ID NO: 711729 - RNA, 64 nt, Homo Sapiens; identical to SEQ ID NO: 298982

SEQ ID NO: 711730 - RNA, 64 nt, Homo Sapiens; identical to SEQ ID NO: 298983

SEQ ID NO: 711731 - RNA, 64 nt, Homo Sapiens; identical to SEQ ID NO: 298984

SEQ ID NO: 711732 - RNA, 64 nt, Homo Sapiens; identical to SEQ ID NO: 298985

SEQ ID NO: 711733 - RNA, 64 nt, Homo Sapiens; identical to SEQ ID NO: 298986

SEQ ID NO: 711734 - RNA, 64 nt, Homo Sapiens; identical to SEQ ID NO: 298987

SEQ ID NO: 711735 - RNA, 64 nt, Homo Sapiens; identical to SEQ ID NO: 298988

SEQ ID NO: 711736 - RNA, 64 nt, Homo Sapiens; identical to SEQ ID NO: 298989

SEQ ID NO: 711737 - RNA, 64 nt, Homo Sapiens; identical to SEQ ID NO: 298990

SEQ ID NO: 711738 - RNA, 64 nt, Homo Sapiens; identical to SEQ ID NO: 298991

SEQ ID NO: 711739 - RNA, 64 nt, Homo Sapiens; identical to SEQ ID NO: 298992

SEQ ID NO: 711740 - RNA, 64 nt, Homo Sapiens; identical to SEQ ID NO: 298993

SEQ ID NO: 711741 - RNA, 64 nt, Homo Sapiens; identical to SEQ ID NO: 298994

SEQ ID NO: 711742 - RNA, 64 nt, Homo Sapiens; identical to SEQ ID NO: 298995

SEQ ID NO: 711743 - RNA, 64 nt, Homo Sapiens; identical to SEQ ID NO: 298996

SEQ ID NO: 711744 - RNA, 64 nt, Homo Sapiens; identical to SEQ ID NO: 298997

SEQ ID NO: 711745 - RNA, 64 nt, Homo Sapiens; identical to SEQ ID NO: 298998

SEQ ID NO: 711746 - RNA, 64 nt, Homo Sapiens; identical to SEQ ID NO: 298999

SEQ ID NO: 711747 - RNA, 64 nt, Homo Sapiens; identical to SEQ ID NO: 299000

SEQ ID NO: 711748 - RNA, 64 nt, Homo Sapiens; identical to SEQ ID NO: 299001

SEQ ID NO: 711749 - RNA, 64 nt, Homo Sapiens; identical to SEQ ID NO: 299002

SEQ ID NO: 711750 - RNA, 64 nt, Homo Sapiens; identical to SEQ ID NO: 299003

SEQ ID NO: 711751 - RNA, 64 nt, Homo Sapiens; identical to SEQ ID NO: 299004

SEQ ID NO: 711752 - RNA, 64 nt, Homo Sapiens; identical to SEQ ID NO: 299005

SEQ ID NO: 711753 - RNA, 64 nt, Homo Sapiens; identical to SEQ ID NO: 299006

SEQ ID NO: 711754 - RNA, 64 nt, Homo Sapiens; identical to SEQ ID NO: 299007

SEQ ID NO: 711755 - RNA, 64 nt, Homo Sapiens; identical to SEQ ID NO: 299008

SEQ ID NO: 711756 - RNA, 64 nt, Homo Sapiens; identical to SEQ ID NO: 299009

SEQ ID NO: 711757 - RNA, 64 nt, Homo Sapiens; identical to SEQ ID NO: 299010

SEQ ID NO: 711758 - RNA, 64 nt, Homo Sapiens; identical to SEQ ID NO: 299011

SEQ ID NO: 711759 - RNA, 64 nt, Homo Sapiens; identical to SEQ ID NO: 299012

SEQ ID NO: 711760 - RNA, 64 nt, Homo Sapiens; identical to SEQ ID NO: 299013

SEQ ID NO: 711761 - RNA, 64 nt, Homo Sapiens; identical to SEQ ID NO: 299014

SEQ ID NO: 711762 - RNA, 64 nt, Homo Sapiens; identical to SEQ ID NO: 299015

SEQ ID NO: 711763 - RNA, 64 nt, Homo Sapiens; identical to SEQ ID NO: 299016

SEQ ID NO: 711764 - RNA, 64 nt, Homo Sapiens; identical to SEQ ID NO: 299017

SEQ ID NO: 711765 - RNA, 64 nt, Homo Sapiens; identical to SEQ ID NO: 299018

SEQ ID NO: 711766 - RNA, 64 nt, Homo Sapiens; identical to SEQ ID NO: 299019

SEQ ID NO: 711767 - RNA, 64 nt, Homo Sapiens; identical to SEQ ID NO: 299020

SEQ ID NO: 711768 - RNA, 64 nt, Homo Sapiens; identical to SEQ ID NO: 299021

SEQ ID NO: 711769 - RNA, 64 nt, Homo Sapiens; identical to SEQ ID NO: 299022

SEQ ID NO: 711770 - RNA, 64 nt, Homo Sapiens; identical to SEQ ID NO: 299023

SEQ ID NO: 711771 - RNA, 64 nt, Homo Sapiens; identical to SEQ ID NO: 299024

SEQ ID NO: 711772 - RNA, 64 nt, Homo Sapiens; identical to SEQ ID NO: 299025

SEQ ID NO: 711773 - RNA, 64 nt, Homo Sapiens; identical to SEQ ID NO: 299026

SEQ ID NO: 711774 - RNA, 64 nt, Homo Sapiens; identical to SEQ ID NO: 299027

SEQ ID NO: 711775 - RNA, 64 nt, Homo Sapiens; identical to SEQ ID NO: 299028

SEQ ID NO: 711776 - RNA, 64 nt, Homo Sapiens; identical to SEQ ID NO: 299029

SEQ ID NO: 711777 - RNA, 64 nt, Homo Sapiens; identical to SEQ ID NO: 299030

SEQ ID NO: 711778 - RNA, 64 nt, Homo Sapiens; identical to SEQ ID NO: 299031

SEQ ID NO: 711779 - RNA, 64 nt, Homo Sapiens; identical to SEQ ID NO: 299032

SEQ ID NO: 711780 - RNA, 64 nt, Homo Sapiens; identical to SEQ ID NO: 299033

SEQ ID NO: 711781 - RNA, 64 nt, Homo Sapiens; identical to SEQ ID NO: 299034

SEQ ID NO: 711782 - RNA, 64 nt, Homo Sapiens; identical to SEQ ID NO: 299035

SEQ ID NO: 711783 - RNA, 64 nt, Homo Sapiens; identical to SEQ ID NO: 299036

SEQ ID NO: 711784 - RNA, 64 nt, Homo Sapiens; identical to SEQ ID NO: 299037

SEQ ID NO: 711785 - RNA, 64 nt, Homo Sapiens; identical to SEQ ID NO: 299038

SEQ ID NO: 711786 - RNA, 64 nt, Homo Sapiens; identical to SEQ ID NO: 299039

SEQ ID NO: 711787 - RNA, 64 nt, Homo Sapiens; identical to SEQ ID NO: 299040

SEQ ID NO: 711788 - RNA, 64 nt, Homo Sapiens; identical to SEQ ID NO: 299041

SEQ ID NO: 711789 - RNA, 64 nt, Homo Sapiens; identical to SEQ ID NO: 164859

SEQ ID NO: 711790 - RNA, 64 nt, Homo Sapiens; identical to SEQ ID NO: 164860

SEQ ID NO: 711791 - RNA, 64 nt, Homo Sapiens; identical to SEQ ID NO: 164861

SEQ ID NO: 711792 - RNA, 64 nt, Homo Sapiens; identical to SEQ ID NO: 164862

SEQ ID NO: 711793 - RNA, 64 nt, Homo Sapiens; identical to SEQ ID NO: 164863

SEQ ID NO: 711794 - RNA, 64 nt, Homo Sapiens; identical to SEQ ID NO: 164864

SEQ ID NO: 711795 - RNA, 64 nt, Homo Sapiens; identical to SEQ ID NO: 164865

SEQ ID NO: 711796 - RNA, 64 nt, Homo Sapiens; identical to SEQ ID NO: 164866

SEQ ID NO: 711797 - RNA, 64 nt, Homo Sapiens; identical to SEQ ID NO: 164867

SEQ ID NO: 711798 - RNA, 64 nt, Homo Sapiens; identical to SEQ ID NO: 164868

SEQ ID NO: 711799 - RNA, 64 nt, Homo Sapiens; identical to SEQ ID NO: 164869

SEQ ID NO: 711800 - RNA, 64 nt, Homo Sapiens; identical to SEQ ID NO: 164870

SEQ ID NO: 711801 - RNA, 64 nt, Homo Sapiens; identical to SEQ ID NO: 164871

SEQ ID NO: 711802 - RNA, 64 nt, Homo Sapiens; identical to SEQ ID NO: 164872

SEQ ID NO: 711803 - RNA, 64 nt, Homo Sapiens; identical to SEQ ID NO: 164873

SEQ ID NO: 711804 - RNA, 64 nt, Homo Sapiens; identical to SEQ ID NO: 164874

SEQ ID NO: 711805 - RNA, 64 nt, Homo Sapiens; identical to SEQ ID NO: 164875

SEQ ID NO: 711806 - RNA, 64 nt, Homo Sapiens; identical to SEQ ID NO: 164876

SEQ ID NO: 711807 - RNA, 64 nt, Homo Sapiens; identical to SEQ ID NO: 164877

SEQ ID NO: 711808 - RNA, 64 nt, Homo Sapiens; identical to SEQ ID NO: 164878

SEQ ID NO: 711809 - RNA, 64 nt, Homo Sapiens; identical to SEQ ID NO: 164879

SEQ ID NO: 711810 - RNA, 64 nt, Homo Sapiens; identical to SEQ ID NO: 164880

SEQ ID NO: 711811 - RNA, 64 nt, Homo Sapiens; identical to SEQ ID NO: 164881

SEQ ID NO: 711812 - RNA, 64 nt, Homo Sapiens; identical to SEQ ID NO: 164882

SEQ ID NO: 711813 - RNA, 64 nt, Homo Sapiens; identical to SEQ ID NO: 164883

SEQ ID NO: 711814 - RNA, 64 nt, Homo Sapiens; identical to SEQ ID NO: 164884

SEQ ID NO: 711815 - RNA, 64 nt, Homo Sapiens; identical to SEQ ID NO: 164885

SEQ ID NO: 711816 - RNA, 64 nt, Homo Sapiens; identical to SEQ ID NO: 164886

SEQ ID NO: 711817 - RNA, 64 nt, Homo Sapiens; identical to SEQ ID NO: 141970

SEQ ID NO: 711818 - RNA, 64 nt, Homo Sapiens; identical to SEQ ID NO: 141971

SEQ ID NO: 711819 - RNA, 64 nt, Homo Sapiens; identical to SEQ ID NO: 141972

SEQ ID NO: 711820 - RNA, 64 nt, Homo Sapiens; identical to SEQ ID NO: 141973

SEQ ID NO: 711821 - RNA, 64 nt, Homo Sapiens; identical to SEQ ID NO: 141974

SEQ ID NO: 711822 - RNA, 64 nt, Homo Sapiens; identical to SEQ ID NO: 141975

SEQ ID NO: 711823 - RNA, 64 nt, Homo Sapiens; identical to SEQ ID NO: 141976

SEQ ID NO: 711824 - RNA, 64 nt, Homo Sapiens; identical to SEQ ID NO: 141977

SEQ ID NO: 711825 - RNA, 64 nt, Homo Sapiens; identical to SEQ ID NO: 141978

SEQ ID NO: 711826 - RNA, 64 nt, Homo Sapiens; identical to SEQ ID NO: 141979

SEQ ID NO: 711827 - RNA, 64 nt, Homo Sapiens; identical to SEQ ID NO: 141980

SEQ ID NO: 711828 - RNA, 64 nt, Homo Sapiens; identical to SEQ ID NO: 141981

SEQ ID NO: 711829 - RNA, 64 nt, Homo Sapiens; identical to SEQ ID NO: 141982

SEQ ID NO: 711830 - RNA, 64 nt, Homo Sapiens; identical to SEQ ID NO: 141983

SEQ ID NO: 711831 - RNA, 64 nt, Homo Sapiens; identical to SEQ ID NO: 141984

SEQ ID NO: 711832 - RNA, 64 nt, Homo Sapiens; identical to SEQ ID NO: 141985

SEQ ID NO: 711833 - RNA, 64 nt, Homo Sapiens; identical to SEQ ID NO: 141986

SEQ ID NO: 711834 - RNA, 64 nt, Homo Sapiens; identical to SEQ ID NO: 141987

SEQ ID NO: 711835 - RNA, 64 nt, Homo Sapiens; identical to SEQ ID NO: 141988

SEQ ID NO: 711836 - RNA, 64 nt, Homo Sapiens; identical to SEQ ID NO: 141989

SEQ ID NO: 711837 - RNA, 64 nt, Homo Sapiens; identical to SEQ ID NO: 141990

SEQ ID NO: 711838 - RNA, 64 nt, Homo Sapiens; identical to SEQ ID NO: 141991

SEQ ID NO: 711839 - RNA, 64 nt, Homo Sapiens; identical to SEQ ID NO: 141992

SEQ ID NO: 711840 - RNA, 64 nt, Homo Sapiens; identical to SEQ ID NO: 141993

SEQ ID NO: 711841 - RNA, 64 nt, Homo Sapiens; identical to SEQ ID NO: 141994

SEQ ID NO: 711842 - RNA, 64 nt, Homo Sapiens; identical to SEQ ID NO: 141995

SEQ ID NO: 711843 - RNA, 64 nt, Homo Sapiens; identical to SEQ ID NO: 141996

SEQ ID NO: 711844 - RNA, 64 nt, Homo Sapiens; identical to SEQ ID NO: 141997

SEQ ID NO: 711845 - RNA, 64 nt, Homo Sapiens; identical to SEQ ID NO: 141998

SEQ ID NO: 711846 - RNA, 64 nt, Homo Sapiens; identical to SEQ ID NO: 141999

SEQ ID NO: 711847 - RNA, 64 nt, Homo Sapiens; identical to SEQ ID NO: 142000

SEQ ID NO: 711848 - RNA, 64 nt, Homo Sapiens; identical to SEQ ID NO: 142001

SEQ ID NO: 711849 - RNA, 64 nt, Homo Sapiens; identical to SEQ ID NO: 142002

SEQ ID NO: 711850 - RNA, 64 nt, Homo Sapiens; identical to SEQ ID NO: 142003

SEQ ID NO: 711851 - RNA, 64 nt, Homo Sapiens; identical to SEQ ID NO: 142004

SEQ ID NO: 711852 - RNA, 64 nt, Homo Sapiens; identical to SEQ ID NO: 142005

SEQ ID NO: 711853 - RNA, 64 nt, Homo Sapiens; identical to SEQ ID NO: 142006

SEQ ID NO: 711854 - RNA, 64 nt, Homo Sapiens; identical to SEQ ID NO: 142007

SEQ ID NO: 711855 - RNA, 64 nt, Homo Sapiens; identical to SEQ ID NO: 142008

SEQ ID NO: 711856 - RNA, 64 nt, Homo Sapiens; identical to SEQ ID NO: 142009

SEQ ID NO: 711857 - RNA, 64 nt, Homo Sapiens; identical to SEQ ID NO: 142010

SEQ ID NO: 711858 - RNA, 64 nt, Homo Sapiens; identical to SEQ ID NO: 142011

SEQ ID NO: 711859 - RNA, 64 nt, Homo Sapiens; identical to SEQ ID NO: 142012

SEQ ID NO: 711860 - RNA, 64 nt, Homo Sapiens; identical to SEQ ID NO: 142013

SEQ ID NO: 711861 - RNA, 64 nt, Homo Sapiens; identical to SEQ ID NO: 142014

SEQ ID NO: 711862 - RNA, 64 nt, Homo Sapiens; identical to SEQ ID NO: 142015

SEQ ID NO: 711863 - RNA, 64 nt, Homo Sapiens; identical to SEQ ID NO: 142016

SEQ ID NO: 711864 - RNA, 64 nt, Homo Sapiens; identical to SEQ ID NO: 142017

SEQ ID NO: 711865 - RNA, 64 nt, Homo Sapiens; identical to SEQ ID NO: 142018

SEQ ID NO: 711866 - RNA, 64 nt, Homo Sapiens; identical to SEQ ID NO: 142019

SEQ ID NO: 711867 - RNA, 64 nt, Homo Sapiens; identical to SEQ ID NO: 142020

SEQ ID NO: 711868 - RNA, 64 nt, Homo Sapiens; identical to SEQ ID NO: 142021

SEQ ID NO: 711869 - RNA, 64 nt, Homo Sapiens; identical to SEQ ID NO: 142022

SEQ ID NO: 711870 - RNA, 64 nt, Homo Sapiens; identical to SEQ ID NO: 142023

SEQ ID NO: 711871 - RNA, 64 nt, Homo Sapiens; identical to SEQ ID NO: 142024

SEQ ID NO: 711872 - RNA, 64 nt, Homo Sapiens; identical to SEQ ID NO: 142025

SEQ ID NO: 711873 - RNA, 64 nt, Homo Sapiens; identical to SEQ ID NO: 142026

SEQ ID NO: 711874 - RNA, 64 nt, Homo Sapiens; identical to SEQ ID NO: 142027

SEQ ID NO: 711875 - RNA, 64 nt, Homo Sapiens; identical to SEQ ID NO: 142028

SEQ ID NO: 711876 - RNA, 64 nt, Homo Sapiens; identical to SEQ ID NO: 142029

SEQ ID NO: 711877 - RNA, 64 nt, Homo Sapiens; identical to SEQ ID NO: 142030

SEQ ID NO: 711878 - RNA, 64 nt, Homo Sapiens; identical to SEQ ID NO: 142031

SEQ ID NO: 711879 - RNA, 64 nt, Homo Sapiens; identical to SEQ ID NO: 142032

SEQ ID NO: 711880 - RNA, 64 nt, Homo Sapiens; identical to SEQ ID NO: 142033

SEQ ID NO: 711881 - RNA, 64 nt, Homo Sapiens; identical to SEQ ID NO: 142034

SEQ ID NO: 711882 - RNA, 64 nt, Homo Sapiens; identical to SEQ ID NO: 142035

SEQ ID NO: 711883 - RNA, 64 nt, Homo Sapiens; identical to SEQ ID NO: 142036

SEQ ID NO: 711884 - RNA, 64 nt, Homo Sapiens; identical to SEQ ID NO: 142037

SEQ ID NO: 711885 - RNA, 64 nt, Homo Sapiens; identical to SEQ ID NO: 142038

SEQ ID NO: 711886 - RNA, 64 nt, Homo Sapiens; identical to SEQ ID NO: 142039

SEQ ID NO: 711887 - RNA, 64 nt, Homo Sapiens; identical to SEQ ID NO: 142040

SEQ ID NO: 711888 - RNA, 64 nt, Homo Sapiens; identical to SEQ ID NO: 142041

SEQ ID NO: 711889 - RNA, 64 nt, Homo Sapiens; identical to SEQ ID NO: 142042

SEQ ID NO: 711890 - RNA, 64 nt, Homo Sapiens; identical to SEQ ID NO: 142043

SEQ ID NO: 711891 - RNA, 64 nt, Homo Sapiens; identical to SEQ ID NO: 142044

SEQ ID NO: 711892 - RNA, 59 nt, Homo Sapiens
gacuucucagaacuuugcaaaaaguuuggacaguagaugcaaaauaaggacuucaaucc

SEQ ID NO: 711893 - RNA, 59 nt, Homo Sapiens
ucaccuuuguuucauuauuaugcaacuuuacaguagauuagcaacaguuuucuguauug

SEQ ID NO: 711894 - RNA, 59 nt, Homo Sapiens
aacuuacuucugaaaugaagagauacacuacaguagaagaaaauggagagcuauguaac

SEQ ID NO: 711895 - RNA, 58 nt, Homo Sapiens
agucugguuaagcgaggucaauggcaagacaguagaugguuggacagccuggguguga

SEQ ID NO: 711896 - RNA, 64 nt, Homo Sapiens
cuacgugauauuugaagggaaggauaaguguugcuuucaguaguuauugccaauauuguuguug

SEQ ID NO: 711897 - RNA, 64 nt, Homo Sapiens
cauggggaugacaauuugauuauuacaauuuaguuuucaguaaucaaaaagauuucuaugaauu

SEQ ID NO: 711898 - RNA, 64 nt, Homo Sapiens
cuacugauccguaaaugauaaccacugcaaauuuuuucaguauaaaauuuuucacugcaaaaaa

SEQ ID NO: 711899 - RNA, 64 nt, Homo Sapiens
uuuuuucaguauaaaauuuuucacugcaaaaaaauuucaguagaaaauaaggaugcagggccag

SEQ ID NO: 711900 - RNA, 64 nt, Homo Sapiens
acaauuaaguuguuaauaacugugauuuuguaaauuucaguaauucauuuaaaugauguuucag

SEQ ID NO: 711901 - RNA, 64 nt, Homo Sapiens
auuuuguaaauuucaguaauucauuuaaaugauguuucaguagauauauucuagcauauuaaga

SEQ ID NO: 711902 - RNA, 64 nt, Homo Sapiens
ggauaaauagggugacuccaaaauucccucccuuuuucaguagaacauaacauagucucccuug

SEQ ID NO: 711903 - RNA, 64 nt, Homo Sapiens
gcuuguuccaaguuguucucaguagucaguugguuuucaguaaaauacaccaacaugagacauc

SEQ ID NO: 711904 - RNA, 64 nt, Homo Sapiens
uguacagugaaaagggaacauucuugcuguguuuuuucaguaagacuuucaggcacuucuuccc

SEQ ID NO: 711905 - RNA, 64 nt, Homo Sapiens
uucuguggcuuuuuccuuucgauaaaccaucagauuucaguaguacauuugggaaaagaagggg

SEQ ID NO: 711906 - RNA, 64 nt, Homo Sapiens
uuauacaacuacugccacauugacucuuucagauuuucaguauuuacacuacuggcuuaaguga

SEQ ID NO: 711907 - RNA, 64 nt, Homo Sapiens
agugaaguggagugaauaccgccaaguggaugcuuuucaguaacaaaguaaaacaacaggcuuu

SEQ ID NO: 711908 - RNA, 64 nt, Homo Sapiens
ugaacuuauuuuuuuaaauuuuaaugucuuagauuuucaguauuauauuacaagggccccagug

SEQ ID NO: 711909 - RNA, 64 nt, Homo Sapiens
cugcuagugcacaggcuguagccacacuuauucuuuucaguaacaaaaaaaaaaaaaaaagaaa

SEQ ID NO: 711910 - RNA, 64 nt, Homo Sapiens
gcaaguagccaugcuuugguuguguguuuggccuuuucaguauuagacaaucauucuacaagag

SEQ ID NO: 711911 - RNA, 64 nt, Homo Sapiens
cuaacacuaauggcaauuuacuuaugguauuuauuuucaguaguaaagacccagcuugaaugua

SEQ ID NO: 711912 - RNA, 64 nt, Homo Sapiens
aguuauggaguuaugggucucugaauuuguguuauuucaguaaaauuuagagaaggagccuaaa

SEQ ID NO: 711913 - RNA, 64 nt, Homo Sapiens
ugcgcaauccuugauuuaaugaguauuggauaauuuucaguaccaaauucugguaacuuuuuga

SEQ ID NO: 711914 - RNA, 64 nt, Homo Sapiens
guaguuaacauuuucuaguaugagcgugaucucuuuucaguauaggccaucugccauggugagg

SEQ ID NO: 711915 - RNA, 64 nt, Homo Sapiens
uaauuuguuuauuagccagguuuuaggacccuuuuuucaguaagauccucucugguucucuuac

SEQ ID NO: 711916 - RNA, 64 nt, Homo Sapiens
auuacuuccaaguuuucaugauguaugggaagauuuucaguagguguauuauauucacgguacc

SEQ ID NO: 711917 - RNA, 64 nt, Homo Sapiens
uuuaacuggacccuauuaugccuuuuaaaaauaauuucaguaacccauaaauacauguuguaaa

SEQ ID NO: 711918 - RNA, 64 nt, Homo Sapiens
acaugugcuuaaucucagauguaaucuauccucuuuucaguauugucccucucugauucacuua

SEQ ID NO: 711919 - RNA, 64 nt, Homo Sapiens
cacgguguuguuuuagaugcagcuuguggugccauuucaguaacuguuuuaaagaggcaacaaa

SEQ ID NO: 711920 - RNA, 64 nt, Homo Sapiens
ugauaaaugagcuagauggcucaauauguaagguuuucaguaguuuacccuccggaacccaagu

SEQ ID NO: 711921 - RNA, 64 nt, Homo Sapiens
uaguauuguuugauguaguuaaccuuaaguuauuuuucaguaauuucuucacaaaucaagauuc

SEQ ID NO: 711922 - RNA, 64 nt, Homo Sapiens
aaauuuagacaaaacaaugucauuuaguagaauauuucaguauuuaaguggaauuucaguauac

SEQ ID NO: 711923 - RNA, 64 nt, Homo Sapiens
ucauuuaguagaauauuucaguauuuaaguggaauuucaguauacuguacuauccuuuauaagu

SEQ ID NO: 711924 - RNA, 64 nt, Homo Sapiens
uucagagaacuagauaaaagcgaauaaaguacuguuucaguacauuauugcuuuauuuauugga

SEQ ID NO: 711925 - RNA, 64 nt, Homo Sapiens
aacaauuuuuauugcuuuauccuagcuacuucauuuucaguaaguggagagaaauucaggagca

SEQ ID NO: 711926 - RNA, 64 nt, Homo Sapiens
accuccccuaugcucaugcccucuucauucuccuuuucaguauaguggcucuuuaauuccugac

SEQ ID NO: 711927 - RNA, 64 nt, Homo Sapiens
uugcugcuguuuaaugcgcauagcaauagaauuguuucaguauuaagcagaaguagcugcuuuu

SEQ ID NO: 711928 - RNA, 64 nt, Homo Sapiens
auauuugaaaacuguaaauguguacaauaugcauuuucaguaaagugugucauuauacauuaau

SEQ ID NO: 711929 - RNA, 64 nt, Homo Sapiens
gugaaucagaaacuccugccauaucagagaacccuuucaguauacugaagucagaccucauuuu

SEQ ID NO: 711930 - RNA, 64 nt, Homo Sapiens
aaauuugggucagaacacaaauuugaagaugacuuuucaguauaugauggguauuuacauuuga

SEQ ID NO: 711931 - RNA, 64 nt, Homo Sapiens
gguuagauaaugugucuaguuguuugcaugccaauuucaguagccucaguuauucaaccuagga

SEQ ID NO: 711932 - RNA, 64 nt, Homo Sapiens
uuuaagcuccuucugucuuggcagagaaauuguauuucaguaauauuuccaaagagaagaacua

SEQ ID NO: 711933 - RNA, 64 nt, Homo Sapiens
ucauuucucaaagcuaaagaaauucuguugguauuuucaguaucuuucuuucuuucauaugauc

SEQ ID NO: 711934 - RNA, 64 nt, Homo Sapiens
cauuuguagagcuacaaaagguauccuuucuuauuuucaguagucagaauuuuaucuagaaauc

SEQ ID NO: 711935 - RNA, 64 nt, Homo Sapiens
ucaacaauaaaucuaacccuaguuguaucccuccuuucaguauuuuucacuuguugccccaaau

SEQ ID NO: 711936 - RNA, 64 nt, Homo Sapiens
cagucuaagcaggcaaagguaacugaugacuaaauuucaguagcuacuuucauuggauugaccc

SEQ ID NO: 711937 - RNA, 64 nt, Homo Sapiens
uucacauucagaacccagcaaccuggaguccaauuuucaguauuuuaacuaccucaauaaugcu

SEQ ID NO: 711938 - RNA, 64 nt, Homo Sapiens
caaucacaaauuauuuuggcacaagucucauaaauuucaguaaaguguucagacagagccuauu

SEQ ID NO: 711939 - RNA, 64 nt, Homo Sapiens
aagaguuucuauuaucuccauagaaaauuguggcuuucaguaccagaccucuugauacaaacaa

SEQ ID NO: 711940 - RNA, 64 nt, Homo Sapiens
agcuauaggugcuaccuaccgauagaagaaguuauuucaguauuggaaaaaauauuuucucuaa

SEQ ID NO: 711941 - RNA, 64 nt, Homo Sapiens
cuuucaaagguaucucugccaaaauggcugcccauuucaguaccgaguugugaggagaaagaag

SEQ ID NO: 711942 - RNA, 64 nt, Homo Sapiens
gcccucuguuacaucacuguucauuugucaaccuuuucaguaaaguuggguuuuagaucucuuu

SEQ ID NO: 711943 - RNA, 64 nt, Homo Sapiens
uugccuccaugauucuagugucaguaucacaguguuucaguaauuuccagaagccagcaguauu

SEQ ID NO: 711944 - RNA, 64 nt, Homo Sapiens
acaguguuucaguaauuugcagaagccagcaguauuucaguaucacaugucagaagauuauucc

SEQ ID NO: 711945 - RNA, 64 nt, Homo Sapiens
agugcuuuuuugguacuuuacaugaaagaauguguuucaguaucaucuguaaucguuaaguacc

SEQ ID NO: 711946 - RNA, 64 nt, Homo Sapiens
gacuguguaagcuaaauugcaauuuagcauugcauuucaguacuucaugaucaagguuuccuua

SEQ ID NO: 711947 - RNA, 64 nt, Homo Sapiens
gguguguacuuuuuaggggguggggcucuggcuuuuucaguaaacauaacuauuuuaagguuaa

SEQ ID NO: 711948 - RNA, 64 nt, Homo Sapiens
ucaauuguuugcucauuuguauugcugcguaguauuucaguauuucauuguauaccacaauuuu

SEQ ID NO: 711949 - RNA, 64 nt, Homo Sapiens
ugguauuauguuuucucuuaacuuggauuuuuuuuuucaguaacuuguuugguucuuguaaaaa

SEQ ID NO: 711950 - RNA, 64 nt, Homo Sapiens
uuuggauugggacucuaagcuuugugugugucuguuucaguauaauacaaaauuucacagauua

SEQ ID NO: 711951 - RNA, 64 nt, Homo Sapiens
gugaggcaauugauugaguauauuucccuucuuauuucaguaauacucuauuuuuuuucaugaa

SEQ ID NO: 711952 - RNA, 64 nt, Homo Sapiens
aaccuuuccuaagagauuugguaugugaggauacuuucaguaccacuccuaccauucauuuuuc

SEQ ID NO: 711953 - RNA, 64 nt, Homo Sapiens
agggaaagguaauauaaaaaucaguuuuaguguuuuucaguauuaaugucucaaaugucucgua

SEQ ID NO: 711954 - RNA, 64 nt, Homo Sapiens
cuucaauuacaaacaguuaacauacaaauguguuuuucaguagguguuagaucucuuuaguaaa

SEQ ID NO: 711955 - RNA, 55 nt, Homo Sapiens; identical to SEQ ID NO: 316954

SEQ ID NO: 711956 - RNA, 64 nt, Homo Sapiens; identical to SEQ ID NO: 316955

SEQ ID NO: 711957 - RNA, 64 nt, Homo Sapiens; identical to SEQ ID NO: 316956

SEQ ID NO: 711958 - RNA, 64 nt, Homo Sapiens; identical to SEQ ID NO: 316957

SEQ ID NO: 711959 - RNA, 64 nt, Homo Sapiens; identical to SEQ ID NO: 316958

SEQ ID NO: 711960 - RNA, 64 nt, Homo Sapiens; identical to SEQ ID NO: 316959

SEQ ID NO: 711961 - RNA, 64 nt, Homo Sapiens; identical to SEQ ID NO: 316960

SEQ ID NO: 711962 - RNA, 64 nt, Homo Sapiens; identical to SEQ ID NO: 316961

SEQ ID NO: 711963 - RNA, 64 nt, Homo Sapiens; identical to SEQ ID NO: 316962

SEQ ID NO: 711964 - RNA, 64 nt, Homo Sapiens; identical to SEQ ID NO: 316963

SEQ ID NO: 711965 - RNA, 64 nt, Homo Sapiens; identical to SEQ ID NO: 316964

SEQ ID NO: 711966 - RNA, 64 nt, Homo Sapiens; identical to SEQ ID NO: 316965

SEQ ID NO: 711967 - RNA, 64 nt, Homo Sapiens; identical to SEQ ID NO: 316966

SEQ ID NO: 711968 - RNA, 64 nt, Homo Sapiens; identical to SEQ ID NO: 316967

SEQ ID NO: 711969 - RNA, 64 nt, Homo Sapiens; identical to SEQ ID NO: 316968

SEQ ID NO: 711970 - RNA, 64 nt, Homo Sapiens; identical to SEQ ID NO: 316969

SEQ ID NO: 711971 - RNA, 64 nt, Homo Sapiens; identical to SEQ ID NO: 316970

SEQ ID NO: 711972 - RNA, 64 nt, Homo Sapiens; identical to SEQ ID NO: 316971

SEQ ID NO: 711973 - RNA, 64 nt, Homo Sapiens; identical to SEQ ID NO: 316972

SEQ ID NO: 711974 - RNA, 64 nt, Homo Sapiens; identical to SEQ ID NO: 316973

SEQ ID NO: 711975 - RNA, 64 nt, Homo Sapiens; identical to SEQ ID NO: 316974

SEQ ID NO: 711976 - RNA, 64 nt, Homo Sapiens; identical to SEQ ID NO: 316975

SEQ ID NO: 711977 - RNA, 64 nt, Homo Sapiens; identical to SEQ ID NO: 316976

SEQ ID NO: 711978 - RNA, 64 nt, Homo Sapiens; identical to SEQ ID NO: 316977

SEQ ID NO: 711979 - RNA, 64 nt, Homo Sapiens; identical to SEQ ID NO: 316978

SEQ ID NO: 711980 - RNA, 64 nt, Homo Sapiens; identical to SEQ ID NO: 316979

SEQ ID NO: 711981 - RNA, 64 nt, Homo Sapiens; identical to SEQ ID NO: 316980

SEQ ID NO: 711982 - RNA, 64 nt, Homo Sapiens; identical to SEQ ID NO: 316981

SEQ ID NO: 711983 - RNA, 64 nt, Homo Sapiens; identical to SEQ ID NO: 316982

SEQ ID NO: 711984 - RNA, 64 nt, Homo Sapiens; identical to SEQ ID NO: 316983

SEQ ID NO: 711985 - RNA, 64 nt, Homo Sapiens; identical to SEQ ID NO: 316984

SEQ ID NO: 711986 - RNA, 64 nt, Homo Sapiens; identical to SEQ ID NO: 316985

SEQ ID NO: 711987 - RNA, 64 nt, Homo Sapiens; identical to SEQ ID NO: 316986

SEQ ID NO: 711988 - RNA, 64 nt, Homo Sapiens; identical to SEQ ID NO: 316987

SEQ ID NO: 711989 - RNA, 64 nt, Homo Sapiens; identical to SEQ ID NO: 316988

SEQ ID NO: 711990 - RNA, 64 nt, Homo Sapiens; identical to SEQ ID NO: 316989

SEQ ID NO: 711991 - RNA, 64 nt, Homo Sapiens; identical to SEQ ID NO: 316990

SEQ ID NO: 711992 - RNA, 64 nt, Homo Sapiens; identical to SEQ ID NO: 316991

SEQ ID NO: 711993 - RNA, 64 nt, Homo Sapiens; identical to SEQ ID NO: 316992

SEQ ID NO: 711994 - RNA, 64 nt, Homo Sapiens; identical to SEQ ID NO: 316993

SEQ ID NO: 711995 - RNA, 64 nt, Homo Sapiens; identical to SEQ ID NO: 316994

SEQ ID NO: 711996 - RNA, 64 nt, Homo Sapiens; identical to SEQ ID NO: 344312

SEQ ID NO: 711997 - RNA, 64 nt, Homo Sapiens; identical to SEQ ID NO: 344313

SEQ ID NO: 711998 - RNA, 64 nt, Homo Sapiens; identical to SEQ ID NO: 344314

SEQ ID NO: 711999 - RNA, 64 nt, Homo Sapiens; identical to SEQ ID NO: 344315

SEQ ID NO: 712000 - RNA, 64 nt, Homo Sapiens; identical to SEQ ID NO: 344316

SEQ ID NO: 712001 - RNA, 64 nt, Homo Sapiens; identical to SEQ ID NO: 344317

SEQ ID NO: 712002 - RNA, 64 nt, Homo Sapiens; identical to SEQ ID NO: 344318

SEQ ID NO: 712003 - RNA, 64 nt, Homo Sapiens; identical to SEQ ID NO: 344319

SEQ ID NO: 712004 - RNA, 64 nt, Homo Sapiens; identical to SEQ ID NO: 344320

SEQ ID NO: 712005 - RNA, 64 nt, Homo Sapiens; identical to SEQ ID NO: 344321

SEQ ID NO: 712006 - RNA, 64 nt, Homo Sapiens; identical to SEQ ID NO: 344322

SEQ ID NO: 712007 - RNA, 58 nt, Homo Sapiens; identical to SEQ ID NO: 344323

SEQ ID NO: 712008 - RNA, 64 nt, Homo Sapiens; identical to SEQ ID NO: 344324

SEQ ID NO: 712009 - RNA, 64 nt, Homo Sapiens; identical to SEQ ID NO: 365319

SEQ ID NO: 712010 - RNA, 64 nt, Homo Sapiens; identical to SEQ ID NO: 365320

SEQ ID NO: 712011 - RNA, 64 nt, Homo Sapiens; identical to SEQ ID NO: 365321

SEQ ID NO: 712012 - RNA, 64 nt, Homo Sapiens; identical to SEQ ID NO: 365322

SEQ ID NO: 712013 - RNA, 64 nt, Homo Sapiens; identical to SEQ ID NO: 365323

SEQ ID NO: 712014 - RNA, 64 nt, Homo Sapiens; identical to SEQ ID NO: 365324

SEQ ID NO: 712015 - RNA, 64 nt, Homo Sapiens; identical to SEQ ID NO: 365325

SEQ ID NO: 712016 - RNA, 64 nt, Homo Sapiens; identical to SEQ ID NO: 365326

SEQ ID NO: 712017 - RNA, 64 nt, Homo Sapiens; identical to SEQ ID NO: 365327

SEQ ID NO: 712018 - RNA, 64 nt, Homo Sapiens; identical to SEQ ID NO: 365328

SEQ ID NO: 712019 - RNA, 64 nt, Homo Sapiens; identical to SEQ ID NO: 365329

SEQ ID NO: 712020 - RNA, 64 nt, Homo Sapiens; identical to SEQ ID NO: 365330

SEQ ID NO: 712021 - RNA, 64 nt, Homo Sapiens
uuguauuguuuagugucaguguaucauuuaguauuuguaucacuguaccauuuaguguuguaua

SEQ ID NO: 712022 - RNA, 64 nt, Homo Sapiens
auuuaauauugguuaucaccauacaguuuaauauuuguaucauuugguucauuguaucguuuag

SEQ ID NO: 712023 - RNA, 64 nt, Homo Sapiens
uaaaucuuuaauaauuuauauguagguaauauuuuuguaucacaaugcauuauuuuuuuccucc

SEQ ID NO: 712024 - RNA, 64 nt, Homo Sapiens
augcuuuaaacauucucauguguaauauauguuuuuguaucaaaaacacucauauauuucaaga

SEQ ID NO: 712025 - RNA, 64 nt, Homo Sapiens
cucacuaaccauucgacugagcacacuuucauauuuguaucagcuuuugugcuaaaacucucua

SEQ ID NO: 712026 - RNA, 64 nt, Homo Sapiens
gaaaauucacugcuauaagaaagguggagucaguuuguaucaguuaauaggauguucauauucc

SEQ ID NO: 712027 - RNA, 64 nt, Homo Sapiens
agcuguuggcuguuuuuuuuguuguuuguucauuuuguaucaguauaaucuacgauucuguuag

SEQ ID NO: 712028 - RNA, 64 nt, Homo Sapiens
guauauagaaaugcauuagacuuguacauugaucuuguaucaagcaacuuagaucaguuaacuu

SEQ ID NO: 712029 - RNA, 64 nt, Homo Sapiens
cugaguugauugugugguuuauauggacccuaauuuguaucauugguucaagggaaauuaaaug

SEQ ID NO: 712030 - RNA, 64 nt, Homo Sapiens
cacccuggauauguguucugacuaacuuauaauuuuguaucacauuaaaacuuguguggaaaaa

SEQ ID NO: 712031 - RNA, 64 nt, Homo Sapiens
aggaagccauugccauucugaaacacccagagacuuguaucagcgccagaaacaagggacagug

SEQ ID NO: 712032 - RNA, 64 nt, Homo Sapiens
caugguucuuucugguggaaauagggauggcuguuuguaucagcauuucuuuucacaaguuaau

SEQ ID NO: 712033 - RNA, 64 nt, Homo Sapiens
auuuauuuuuuaaaacucaaagagggaaagagccuuguaucauaugugaacauuguaucauagg

SEQ ID NO: 712034 - RNA, 64 nt, Homo Sapiens
aaagagggaaagagccuuguaucauaugugaacauuguaucauagguaauguuguacagacccu

SEQ ID NO: 712035 - RNA, 64 nt, Homo Sapiens; identical to SEQ ID NO: 168067

SEQ ID NO: 712036 - RNA, 64 nt, Homo Sapiens; identical to SEQ ID NO: 168068

SEQ ID NO: 712037 - RNA, 64 nt, Homo Sapiens; identical to SEQ ID NO: 168069

SEQ ID NO: 712038 - RNA, 64 nt, Homo Sapiens; identical to SEQ ID NO: 168070

SEQ ID NO: 712039 - RNA, 64 nt, Homo Sapiens; identical to SEQ ID NO: 168071

SEQ ID NO: 712040 - RNA, 64 nt, Homo Sapiens; identical to SEQ ID NO: 168072

SEQ ID NO: 712041 - RNA, 64 nt, Homo Sapiens; identical to SEQ ID NO: 168073

SEQ ID NO: 712042 - RNA, 64 nt, Homo Sapiens; identical to SEQ ID NO: 168074

SEQ ID NO: 712043 - RNA, 64 nt, Homo Sapiens; identical to SEQ ID NO: 168075

SEQ ID NO: 712044 - RNA, 64 nt, Homo Sapiens; identical to SEQ ID NO: 168076

SEQ ID NO: 712045 - RNA, 64 nt, Homo Sapiens; identical to SEQ ID NO: 168077

SEQ ID NO: 712046 - RNA, 64 nt, Homo Sapiens; identical to SEQ ID NO: 168078

SEQ ID NO: 712047 - RNA, 64 nt, Homo Sapiens; identical to SEQ ID NO: 168079

SEQ ID NO: 712048 - RNA, 64 nt, Homo Sapiens; identical to SEQ ID NO: 168080

SEQ ID NO: 712049 - RNA, 64 nt, Homo Sapiens; identical to SEQ ID NO: 196485

SEQ ID NO: 712050 - RNA, 64 nt, Homo Sapiens; identical to SEQ ID NO: 196486

SEQ ID NO: 712051 - RNA, 64 nt, Homo Sapiens; identical to SEQ ID NO: 196487

SEQ ID NO: 712052 - RNA, 64 nt, Homo Sapiens; identical to SEQ ID NO: 196488

SEQ ID NO: 712053 - RNA, 64 nt, Homo Sapiens; identical to SEQ ID NO: 196489

SEQ ID NO: 712054 - RNA, 64 nt, Homo Sapiens; identical to SEQ ID NO: 196490

SEQ ID NO: 712055 - RNA, 64 nt, Homo Sapiens; identical to SEQ ID NO: 196491

SEQ ID NO: 712056 - RNA, 64 nt, Homo Sapiens; identical to SEQ ID NO: 196492

SEQ ID NO: 712057 - RNA, 64 nt, Homo Sapiens; identical to SEQ ID NO: 196493

SEQ ID NO: 712058 - RNA, 64 nt, Homo Sapiens; identical to SEQ ID NO: 196494

SEQ ID NO: 712059 - RNA, 64 nt, Homo Sapiens; identical to SEQ ID NO: 196495

SEQ ID NO: 712060 - RNA, 64 nt, Homo Sapiens; identical to SEQ ID NO: 196496

SEQ ID NO: 712061 - RNA, 64 nt, Homo Sapiens; identical to SEQ ID NO: 196497

SEQ ID NO: 712062 - RNA, 64 nt, Homo Sapiens; identical to SEQ ID NO: 196498

SEQ ID NO: 712063 - RNA, 64 nt, Homo Sapiens; identical to SEQ ID NO: 196499

SEQ ID NO: 712064 - RNA, 64 nt, Homo Sapiens; identical to SEQ ID NO: 196500

SEQ ID NO: 712065 - RNA, 64 nt, Homo Sapiens; identical to SEQ ID NO: 196501

SEQ ID NO: 712066 - RNA, 64 nt, Homo Sapiens; identical to SEQ ID NO: 196502

SEQ ID NO: 712067 - RNA, 64 nt, Homo Sapiens; identical to SEQ ID NO: 196503

SEQ ID NO: 712068 - RNA, 64 nt, Homo Sapiens; identical to SEQ ID NO: 196504

SEQ ID NO: 712069 - RNA, 64 nt, Homo Sapiens; identical to SEQ ID NO: 196505

SEQ ID NO: 712070 - RNA, 64 nt, Homo Sapiens; identical to SEQ ID NO: 196506

SEQ ID NO: 712071 - RNA, 64 nt, Homo Sapiens; identical to SEQ ID NO: 196507

SEQ ID NO: 712072 - RNA, 64 nt, Homo Sapiens; identical to SEQ ID NO: 196508

SEQ ID NO: 712073 - RNA, 64 nt, Homo Sapiens; identical to SEQ ID NO: 196509

SEQ ID NO: 712074 - RNA, 64 nt, Homo Sapiens; identical to SEQ ID NO: 196510

SEQ ID NO: 712075 - RNA, 64 nt, Homo Sapiens; identical to SEQ ID NO: 196511

SEQ ID NO: 712076 - RNA, 64 nt, Homo Sapiens; identical to SEQ ID NO: 196512

SEQ ID NO: 712077 - RNA, 64 nt, Homo Sapiens; identical to SEQ ID NO: 196513

SEQ ID NO: 712078 - RNA, 64 nt, Homo Sapiens; identical to SEQ ID NO: 196514

SEQ ID NO: 712079 - RNA, 64 nt, Homo Sapiens; identical to SEQ ID NO: 196515

SEQ ID NO: 712080 - RNA, 64 nt, Homo Sapiens; identical to SEQ ID NO: 196516

SEQ ID NO: 712081 - RNA, 64 nt, Homo Sapiens; identical to SEQ ID NO: 196517

SEQ ID NO: 712082 - RNA, 64 nt, Homo Sapiens; identical to SEQ ID NO: 196518

SEQ ID NO: 712083 - RNA, 64 nt, Homo Sapiens; identical to SEQ ID NO: 196519

SEQ ID NO: 712084 - RNA, 64 nt, Homo Sapiens; identical to SEQ ID NO: 196520

SEQ ID NO: 712085 - RNA, 64 nt, Homo Sapiens; identical to SEQ ID NO: 196521

SEQ ID NO: 712086 - RNA, 64 nt, Homo Sapiens; identical to SEQ ID NO: 196522

SEQ ID NO: 712087 - RNA, 64 nt, Homo Sapiens; identical to SEQ ID NO: 196523

SEQ ID NO: 712088 - RNA, 64 nt, Homo Sapiens; identical to SEQ ID NO: 196524

SEQ ID NO: 712089 - RNA, 64 nt, Homo Sapiens; identical to SEQ ID NO: 196525

SEQ ID NO: 712090 - RNA, 64 nt, Homo Sapiens; identical to SEQ ID NO: 196526

SEQ ID NO: 712091 - RNA, 64 nt, Homo Sapiens; identical to SEQ ID NO: 196527

SEQ ID NO: 712092 - RNA, 64 nt, Homo Sapiens; identical to SEQ ID NO: 196528

SEQ ID NO: 712093 - RNA, 64 nt, Homo Sapiens; identical to SEQ ID NO: 196529

SEQ ID NO: 712094 - RNA, 64 nt, Homo Sapiens; identical to SEQ ID NO: 196530

SEQ ID NO: 712095 - RNA, 64 nt, Homo Sapiens; identical to SEQ ID NO: 196531

SEQ ID NO: 712096 - RNA, 64 nt, Homo Sapiens; identical to SEQ ID NO: 196532

SEQ ID NO: 712097 - RNA, 64 nt, Homo Sapiens; identical to SEQ ID NO: 196533

SEQ ID NO: 712098 - RNA, 64 nt, Homo Sapiens; identical to SEQ ID NO: 196534

SEQ ID NO: 712099 - RNA, 64 nt, Homo Sapiens; identical to SEQ ID NO: 196535

SEQ ID NO: 712100 - RNA, 64 nt, Homo Sapiens; identical to SEQ ID NO: 196536

SEQ ID NO: 712101 - RNA, 64 nt, Homo Sapiens; identical to SEQ ID NO: 196537

SEQ ID NO: 712102 - RNA, 64 nt, Homo Sapiens; identical to SEQ ID NO: 196538

SEQ ID NO: 712103 - RNA, 64 nt, Homo Sapiens; identical to SEQ ID NO: 196539

SEQ ID NO: 712104 - RNA, 64 nt, Homo Sapiens; identical to SEQ ID NO: 196540

SEQ ID NO: 712105 - RNA, 64 nt, Homo Sapiens; identical to SEQ ID NO: 196541

SEQ ID NO: 712106 - RNA, 64 nt, Homo Sapiens; identical to SEQ ID NO: 196542

SEQ ID NO: 712107 - RNA, 64 nt, Homo Sapiens; identical to SEQ ID NO: 196543

SEQ ID NO: 712108 - RNA, 64 nt, Homo Sapiens; identical to SEQ ID NO: 196544

SEQ ID NO: 712109 - RNA, 64 nt, Homo Sapiens; identical to SEQ ID NO: 196545

SEQ ID NO: 712110 - RNA, 64 nt, Homo Sapiens; identical to SEQ ID NO: 196546

SEQ ID NO: 712111 - RNA, 64 nt, Homo Sapiens; identical to SEQ ID NO: 196547

SEQ ID NO: 712112 - RNA, 64 nt, Homo Sapiens; identical to SEQ ID NO: 196548

SEQ ID NO: 712113 - RNA, 64 nt, Homo Sapiens; identical to SEQ ID NO: 196549

SEQ ID NO: 712114 - RNA, 64 nt, Homo Sapiens; identical to SEQ ID NO: 196550

SEQ ID NO: 712115 - RNA, 64 nt, Homo Sapiens; identical to SEQ ID NO: 196551

SEQ ID NO: 712116 - RNA, 64 nt, Homo Sapiens; identical to SEQ ID NO: 196551

SEQ ID NO: 712117 - RNA, 64 nt, Homo Sapiens; identical to SEQ ID NO: 196553

SEQ ID NO: 712118 - RNA, 64 nt, Homo Sapiens; identical to SEQ ID NO: 196554

SEQ ID NO: 712119 - RNA, 64 nt, Homo Sapiens; identical to SEQ ID NO: 196555

SEQ ID NO: 712120 - RNA, 64 nt, Homo Sapiens; identical to SEQ ID NO: 196556

SEQ ID NO: 712121 - RNA, 64 nt, Homo Sapiens; identical to SEQ ID NO: 196557

SEQ ID NO: 712122 - RNA, 64 nt, Homo Sapiens; identical to SEQ ID NO: 196558

SEQ ID NO: 712123 - RNA, 64 nt, Homo Sapiens; identical to SEQ ID NO: 196559

SEQ ID NO: 712124 - RNA, 64 nt, Homo Sapiens; identical to SEQ ID NO: 196560

SEQ ID NO: 712125 - RNA, 64 nt, Homo Sapiens; identical to SEQ ID NO: 196561

SEQ ID NO: 712126 - RNA, 64 nt, Homo Sapiens; identical to SEQ ID NO: 196562

SEQ ID NO: 712127 - RNA, 64 nt, Homo Sapiens; identical to SEQ ID NO: 196563

SEQ ID NO: 712128 - RNA, 64 nt, Homo Sapiens; identical to SEQ ID NO: 196564

SEQ ID NO: 712129 - RNA, 64 nt, Homo Sapiens; identical to SEQ ID NO: 196565

SEQ ID NO: 712130 - RNA, 64 nt, Homo Sapiens; identical to SEQ ID NO: 196566

SEQ ID NO: 712131 - RNA, 64 nt, Homo Sapiens; identical to SEQ ID NO: 196567

SEQ ID NO: 712132 - RNA, 64 nt, Homo Sapiens; identical to SEQ ID NO: 196568

SEQ ID NO: 712133 - RNA, 64 nt, Homo Sapiens; identical to SEQ ID NO: 196569

SEQ ID NO: 712134 - RNA, 64 nt, Homo Sapiens; identical to SEQ ID NO: 196570

SEQ ID NO: 712135 - RNA, 64 nt, Homo Sapiens; identical to SEQ ID NO: 196571

SEQ ID NO: 712136 - RNA, 64 nt, Homo Sapiens; identical to SEQ ID NO: 196572

SEQ ID NO: 712137 - RNA, 64 nt, Homo Sapiens
ggguugggaaaaaguggaaggcauaagcauagaaauauuuuaggauauuuuaggauaugugaau

SEQ ID NO: 712138 - RNA, 64 nt, Homo Sapiens
aaaguggaaggcauaagcauagaaauauuuuaggauauuuuaggauaugugaauaaagcuagac

SEQ ID NO: 712139 - RNA, 64 nt, Homo Sapiens
uuucauugacagcugacauaauucauugagugaaauauuuuaagccaaaaaaaaauucccuuuu

SEQ ID NO: 712140 - RNA, 64 nt, Homo Sapiens
ccacuguuuugaacuaccacaaaaguauaaaugaauauuuuaaugccacaaucuuuccuguugc

SEQ ID NO: 712141 - RNA, 64 nt, Homo Sapiens
ucuccuguggaaaucccaauugcuugaauuacugauauuuuagaauagacuuuuuaaaaugcca

SEQ ID NO: 712142 - RNA, 64 nt, Homo Sapiens
uggauaauguugcaacuacuuguuaugcauauaaauauuuuacuuuuucacauguauagauugc

SEQ ID NO: 712143 - RNA, 64 nt, Homo Sapiens
cauguuaauaaauuuaaaacaucauucguauaaaauauuuuaauuuucuuguauuucauuuaga

SEQ ID NO: 712144 - RNA, 64 nt, Homo Sapiens
uauauugcuuugaaguaagucucaauaaggcaauauauuuuagggcaucuuucuucuuaucucu

SEQ ID NO: 712145 - RNA, 64 nt, Homo Sapiens
auuuacaaaacaaggaaaaugcuguaaauauugcauauuuuauguauuuggaccaaaagguuac

SEQ ID NO: 712146 - RNA, 64 nt, Homo Sapiens
ucaguaaacuuucuguggaagggccagagaguaaauauuuuaggcuuugcagcccauacggucu

SEQ ID NO: 712147 - RNA, 64 nt, Homo Sapiens
uuuaacaguucagaauaggggcauuuauuuuaucauauuuuaggguggguuaggaguauccuuu

SEQ ID NO: 712148 - RNA, 64 nt, Homo Sapiens
auauauuaauuuuuguguaaugaaugccaacaguauauuuuauaugauuuacuuaugugaggaa

SEQ ID NO: 712149 - RNA, 64 nt, Homo Sapiens
auuaaugaaagaacauuguuauauucugcgugguauauuuuaaaguuuaagaaggcauguuaaa

SEQ ID NO: 712150 - RNA, 64 nt, Homo Sapiens
cuuauauaauaagugcauguaggaauugcaaaaaauauuuuaaaaauuuauuacugaauuuaaa

SEQ ID NO: 712151 - RNA, 64 nt, Homo Sapiens
aaaauauuuuaaaaauuuauuacugaauuuaaaaauauuuuagaaguuuuguaauggugguguu

SEQ ID NO: 712152 - RNA, 64 nt, Homo Sapiens
aauauuuuagaaguuuuguaauggugguguuuuaauauuuuacauaauuaaauauguacauauu

SEQ ID NO: 712153 - RNA, 64 nt, Homo Sapiens
acacaaauaacagcuuucuuauucagugaaaaagauauuuuauuucugauguuuuauuugcacu

SEQ ID NO: 712154 - RNA, 64 nt, Homo Sapiens
ucuauuugguuugcuuuuuuuuuuuugcuuuguuauauuuuauugcuacaaggggugugacuug

SEQ ID NO: 712155 - RNA, 64 nt, Homo Sapiens
gucuguauucaauaugguauaaaauauaaaaacuauauuuuaacuuagugaaauauuuuacuau

SEQ ID NO: 712156 - RNA, 64 nt, Homo Sapiens
auaaaauauaaaaacuauauuuuaacuuagugaaauauuuuacuauuucucuacuucagacaaa

SEQ ID NO: 712157 - RNA, 64 nt, Homo Sapiens
agaaacacuaguguuuaguuuuacaguaacccucauauuuuaaugguguuacagcauuugcaaa

SEQ ID NO: 712158 - RNA, 64 nt, Homo Sapiens
aucuggguuaucaacauuuucucaaaugcugucaauauuuuacuguaauuuauguucuuauauu

SEQ ID NO: 712159 - RNA, 64 nt, Homo Sapiens
guuugcauguaagagaccaggauauguaacucuuauauuuuaaguguauacauauuguguauau

SEQ ID NO: 712160 - RNA, 64 nt, Homo Sapiens
uauauaguccagucuucauuuuacauacacacacauauuuuacacacacacacauuuuacacac

SEQ ID NO: 712161 - RNA, 64 nt, Homo Sapiens
cuucucuguguuuucugguuuaaaagcugcacuuauauuuuagccuuauuauuuucuguaguuc

SEQ ID NO: 712162 - RNA, 64 nt, Homo Sapiens
cucagugagcaaauuguguaacugcucuugugcaauauuuuauguugaauuuucuucagacaaa

SEQ ID NO: 712163 - RNA, 64 nt, Homo Sapiens
gucuuaucugccuuuuuaucauauauauauauauauauuuuacaauauauauauauauauauau

SEQ ID NO: 712164 - RNA, 64 nt, Homo Sapiens
uauuaagauguuuguucuugcccuguuucuaaacauauuuuauaauaacaaauuucccacuucu

SEQ ID NO: 712165 - RNA, 64 nt, Homo Sapiens
cccaagauaugacaccaaggaucugagcuuggugauauuuuaucaguagacacacugugggagg

SEQ ID NO: 712166 - RNA, 64 nt, Homo Sapiens
auaagcaauuggcugugauggucugagaauuaaaauauuuuaguaaagguaugagggaaagaga

SEQ ID NO: 712167 - RNA, 64 nt, Homo Sapiens
uccucccuuuuccuuaagcagauccagccacuggauauuuuauauucugaaaguaucagcuacu

SEQ ID NO: 712168 - RNA, 64 nt, Homo Sapiens
gcuguagacuuacuuuccuaaguuuuauaugcauauauuuuagguuggaacugcauucuuuuaa

SEQ ID NO: 712169 - RNA, 64 nt, Homo Sapiens
caaacaguucuuggaccccuucuuaggucuaaugauauuuuaugacuuugugccuuugaccauc

SEQ ID NO: 712170 - RNA, 64 nt, Homo Sapiens
aacauguuuuaaaaagauacaaugaccugcuaauauauuuuaagaaaaugaggauuaguaauau

SEQ ID NO: 712171 - RNA, 64 nt, Homo Sapiens
aucuacuaaaaugaggauuauaucccccuuugggauauuuuaaaucaauggauggauuaauauu

SEQ ID NO: 712172 - RNA, 64 nt, Homo Sapiens
ucauagauuaaaauuuauaguuuaucuuuagguaauauuuuauaucugauacaugauguucaau

SEQ ID NO: 712173 - RNA, 64 nt, Homo Sapiens
guucauaauuaaugaauaaaaagcauggaauauuauauuuuauuagaaaccacuauuucaugaa

SEQ ID NO: 712174 - RNA, 64 nt, Homo Sapiens
uaauauagcauggcaccucaucuuuucuuguggaauauuuuaauuauuuucagguuuuguauuu

SEQ ID NO: 712175 - RNA, 64 nt, Homo Sapiens
gaauaucuaaauacuaaaauugccucuguaccaaauauuuuauggaagcaaauuauucaguagg

SEQ ID NO: 712176 - RNA, 64 nt, Homo Sapiens
aguuuacugccaugaaauacaacacacuaaaauuauauuuuaaauugguugauuguuuauauaa

SEQ ID NO: 712177 - RNA, 64 nt, Homo Sapiens
gcauggaucucgaagcagaaugaacuaaacaaacauauuuuagaagagaaaugugaagauaaga

SEQ ID NO: 712178 - RNA, 64 nt, Homo Sapiens
uacuuuugcagcuguuacagguaauacccaaguaauauuuuaaucuuugucuacagaacaauua

SEQ ID NO: 712179 - RNA, 64 nt, Homo Sapiens
uguucagaucaaagaccaaaacauuuucuuaaauauauuuuauguaauauuuuauuuguauaca

SEQ ID NO: 712180 - RNA, 64 nt, Homo Sapiens
agaccaaaacauuuucuuaaauauauuuuauguaauauuuuauuuguauacaguguuguugaug

SEQ ID NO: 712181 - RNA, 64 nt, Homo Sapiens
caguguuguugaugaaauauuuaacuagagcaugauauuuuaaauguuaagguguaacauaugu

SEQ ID NO: 712182 - RNA, 64 nt, Homo Sapiens
guauacaguguacaauguguauuucuucaaccauauauuuuaaaaagacguacauagaaacuua

SEQ ID NO: 712183 - RNA, 64 nt, Homo Sapiens
uuuuuucaacuccuauuguguuucuuugugugugauauuuuaaucaaaagugguugaguuguua

SEQ ID NO: 712184 - RNA, 64 nt, Homo Sapiens
cugcaaacuuuuucuguaaagggccgguuuauaaauauuuuagacuuugcaggcuauaauauau

SEQ ID NO: 712185 - RNA, 64 nt, Homo Sapiens
uauccuaaauauguuaucaaguauuuagaguucuauauuuuaaagauauauguguucauguauu

SEQ ID NO: 712186 - RNA, 64 nt, Homo Sapiens
gaucgaaccaaaaaaaaucauuuaaacuuuaaaaauauuuuaaauggacuuuggggagacauuu

SEQ ID NO: 712187 - RNA, 64 nt, Homo Sapiens
uuggcccuucaagcaaccuagcuaaaaggugcugauauuuuauuuaguacugccaacuucaagu

SEQ ID NO: 712188 - RNA, 64 nt, Homo Sapiens
uauaaccaaaugaaauauauuuaaaauauauugaauauuuuauauuguuauauccugacaagau

SEQ ID NO: 712189 - RNA, 64 nt, Homo Sapiens
auauuuuauauuguuauauccugacaagauuauaauauuuuaauguacuaauauuucuguaauu

SEQ ID NO: 712190 - RNA, 64 nt, Homo Sapiens
uaaaggugaaauugcauacacagauauguaguacauauuuuaaaaguuuuaucuuaaauugauu

SEQ ID NO: 712191 - RNA, 64 nt, Homo Sapiens
aaagacauuuuuuccccauuuuuugaaauagagaauauuuuauuauuuuugugaaaauagaguu

SEQ ID NO: 712192 - RNA, 64 nt, Homo Sapiens
gugaguauauacacuaagaagguauauguucuuuauauuuuaaugcacacuuuuggcucuuuuu

SEQ ID NO: 712193 - RNA, 64 nt, Homo Sapiens
aauucuuuaguauauucuugugcaauugggguuaauauuuuaaggauguaaauguugaugaaaa

SEQ ID NO: 712194 - RNA, 64 nt, Homo Sapiens
guguaauaccaguuuuguuaacuguuaggucuuuauauuuuaaauuauuugcauauuuguaaaa

SEQ ID NO: 712195 - RNA, 64 nt, Homo Sapiens
ugguuuuguuuaaaauuaccauauuuccacuuagauauuuuacaagcuauagaguugggaaaaa

SEQ ID NO: 712196 - RNA, 64 nt, Homo Sapiens
uuauuuuuugguacugaaucaaaauuuuaaugagauauuuuauauuucaaccuguaaucaacau

SEQ ID NO: 712197 - RNA, 64 nt, Homo Sapiens
caagugaaguuaauaugcauuuuacauuucuaauauauuuuaaaugugagccccauauacaauu

SEQ ID NO: 712198 - RNA, 64 nt, Homo Sapiens
acccugauuuuaauugugaaauuauaugauucauauauuuuaugaaucagaauaaccuucaaau

SEQ ID NO: 712199 - RNA, 64 nt, Homo Sapiens
uuggugguuuuauucuaucgguauaaaggcauugauauuuuagaugcacccguguuuguaaaaa

SEQ ID NO: 712200 - RNA, 64 nt, Homo Sapiens
aguauugcuaugucuuuaaaaaauuuuuuuuauuauauuuuauuuuuuugagacagggucuuga

SEQ ID NO: 712201 - RNA, 64 nt, Homo Sapiens
acugaauagaaaacuuugagaauaauauauauauauauuuuaaauguuuucacugacucauuga

SEQ ID NO: 712202 - RNA, 64 nt, Homo Sapiens
cuguaaugugcaauaugcuuugcaacuguagaugauauuuuauguuuaaucuguaaauaagaaa

SEQ ID NO: 712203 - RNA, 64 nt, Homo Sapiens
cagagcaagacucugucucaaaaaaaaaaauacaauauuuuaacaaugugcccucuuaagugug

SEQ ID NO: 712204 - RNA, 64 nt, Homo Sapiens
acuugguguuuauguugcaaucugguugugauuuauauuuuaaagcuuggugcuaaaccacaau

SEQ ID NO: 712205 - RNA, 64 nt, Homo Sapiens
uugucccacuguuguuuucauugaguuuggauuuauauuuuaaauguucgaaugaaaguaugau

SEQ ID NO: 712206 - RNA, 64 nt, Homo Sapiens
guaaaagggagugaauugguuuaaaaauauauguauauuuuaaacuuuguuguguguaggaaac

SEQ ID NO: 712207 - RNA, 64 nt, Homo Sapiens
uucuguuuuuuuuucuuugugagcacuggcuucuauauuuuauuucauauuuaugaauuauaaa

SEQ ID NO: 712208 - RNA, 64 nt, Homo Sapiens
aaaaucuuaaauaauguacuguuuagaaauauacauauuuuauacaaaauuauaaagaaagcau

SEQ ID NO: 712209 - RNA, 64 nt, Homo Sapiens
aauuuuuuuucaugcuuuaucaauagcccaggauauauuuuauuuuuagaauuuugugaaacag

SEQ ID NO: 712210 - RNA, 64 nt, Homo Sapiens
cuucaucaaugagugugauccaguuuuucauaagauauuuuauuuugaaauggaaauuaauguc

SEQ ID NO: 712211 - RNA, 64 nt, Homo Sapiens
uccaauuuuccuucagauauuuuuaauauuaaauauauuuuagugacagagugccaacuucuuu

SEQ ID NO: 712212 - RNA, 64 nt, Homo Sapiens
gagaugaaugugccaagcaaaaccacaacuguguauauuuuaaagcacaucauggcuuuaagua

SEQ ID NO: 712213 - RNA, 64 nt, Homo Sapiens
cacaugaauauucguauuguuaacuaaaugauuuauauuuuacugauuuaauauuacaguguaa

SEQ ID NO: 712214 - RNA, 64 nt, Homo Sapiens
ugcuaaugcauguauuuguaaugucuaggacgaaauauuuuauguugccaagucuucuguaaag

SEQ ID NO: 712215 - RNA, 64 nt, Homo Sapiens
aggaaauuagacauuuuauagcacugccauauuuauauuuuaaauuuuacaucuuugauauaaa

SEQ ID NO: 712216 - RNA, 64 nt, Homo Sapiens
aguuguuuaauaagagguaaugauuauauagcacauauuuuauucuuuccauguuuuaaaugua

SEQ ID NO: 712217 - RNA, 64 nt, Homo Sapiens
cucauuuaauauaaaccucauugauggacuuuuaauauuuuauucuguauuucuuuucuacaca

SEQ ID NO: 712218 - RNA, 64 nt, Homo Sapiens
ugaauaucagaaccauuuuugaauaaaucauuuuauauuuuauuauguuuuggguauggcuuug

SEQ ID NO: 712219 - RNA, 64 nt, Homo Sapiens
guuguaaaaaauauccaucaauaauuuuuuaaaaauauuuuacaacaaauuacagaauagcuaa

SEQ ID NO: 712220 - RNA, 64 nt, Homo Sapiens
ugggauuuguuuuuccugaacaauuuaaaaagucauauuuuaaguuuuaauuauucauucaugg

SEQ ID NO: 712221 - RNA, 64 nt, Homo Sapiens
gcuuugauuucucccaaagagugcuaaagaaaugauauuuuauuaaaguuuuuuuuuaaugacu

SEQ ID NO: 712222 - RNA, 64 nt, Homo Sapiens
aguuuaauuuaaaaaauuuauguuagauguuguuauauuuuaaacucuuuguuuuguacaguuc

SEQ ID NO: 712223 - RNA, 64 nt, Homo Sapiens
uuauggaacugcuaaauagaccaauuugauuugaauauuuuaaagagaggcaaaccaguccuac

SEQ ID NO: 712224 - RNA, 64 nt, Homo Sapiens
uuagugaagagguauuacugcuucuaaaaggggcauauuuuauaaugagaucuagagaacacgu

SEQ ID NO: 712225 - RNA, 64 nt, Homo Sapiens
acaauaaaugcaaaaaauaaguuuuauguuauguauauuuuaccuaaaaauaaaugguuaaaag

SEQ ID NO: 712226 - RNA, 64 nt, Homo Sapiens
auaauuuaaaaaauauaucuaaauuuuguuauguauauuuuaucauaaaaaugguuaaaauggu

SEQ ID NO: 712227 - RNA, 64 nt, Homo Sapiens
cauguuaaguauggucgcaguuuguauuuuaaaaauauuuuaugcagaaucuggccaauuuaag

SEQ ID NO: 712228 - RNA, 64 nt, Homo Sapiens
gaacuuugauugguuacuuuccgguuuucacuguauauuuuaauugguguuugccuaauuuaua

SEQ ID NO: 712229 - RNA, 64 nt, Homo Sapiens
ucucuuuagagcauuuuuaaugcaacuagccccuauauuuuaauguaagaguuacucugcaauc

SEQ ID NO: 712230 - RNA, 64 nt, Homo Sapiens
uagcauuuauauauuuguguauggaaaacacuugauauuuuaucccuguugcaucuggcugcac

SEQ ID NO: 712231 - RNA, 64 nt, Homo Sapiens
uagguaaacaccuucagcuuaaauuuuucguuaaauauuuuaguuuauuuuauuguuaucuucc

SEQ ID NO: 712232 - RNA, 64 nt, Homo Sapiens
aaauaggucauuaacuugaaacucuuaucaaaauauauuuuaccaguuuccagaauuuccagua

SEQ ID NO: 712233 - RNA, 64 nt, Homo Sapiens
ccccagucuugaugguauauugaacagacugaauauauuuuaccauuacagggcuaaaaggagu

SEQ ID NO: 712234 - RNA, 64 nt, Homo Sapiens
guuuucaaguguuuuauaauuaaaucauaauagcauauuuuaaaaucaaucuuccuaaaagguc

SEQ ID NO: 712235 - RNA, 64 nt, Homo Sapiens
aaaucaaucuuccuaaaaggucugcuuuuauuguauauuuuauuuaacaauaggcacuggguuu

SEQ ID NO: 712236 - RNA, 64 nt, Homo Sapiens
aacaauaggcacuggguuuguguuacauauuuauauauuuuauuuuauuuuuauaauauagaca

SEQ ID NO: 712237 - RNA, 64 nt, Homo Sapiens
uuuuuucuaggacuuugguuacuauacauauuguauauuuuaagaauucuuuauacaauuuuaa

SEQ ID NO: 712238 - RNA, 64 nt, Homo Sapiens
guauuuuuuuuaauauuauauggaccaucugauuauauuuuauuuauucaucuauuuaugguau

SEQ ID NO: 712239 - RNA, 64 nt, Homo Sapiens
uuggaccucacaaaucuuguacuuugaauaauguauauuuuaaacacuugugcauauacauagu

SEQ ID NO: 712240 - RNA, 64 nt, Homo Sapiens
auuaagagagcagcaaaugaaauaacuaaggggaauauuuuaaaugggaguuuuuuuaagguuu

SEQ ID NO: 712241 - RNA, 64 nt, Homo Sapiens
uagaugaagaagcuagaaaaugguagcuaaauauauauuuuagauauuaggaguaccauaauuc

SEQ ID NO: 712242 - RNA, 64 nt, Homo Sapiens
guuucuuggggaauauguuaauaagaaauaggaaauauuuuaauacacuguuaucuucacuuuu

SEQ ID NO: 712243 - RNA, 64 nt, Homo Sapiens
guugucuacaaaucugagccguuaacauuaaaaaauauuuuaaagguaaaauuuugaagacauu

SEQ ID NO: 712244 - RNA, 64 nt, Homo Sapiens
uuuccagaacaaaagcuuuaccuaagaacauuagauauuuuaguuagcuauagguucuucucuc

SEQ ID NO: 712245 - RNA, 64 nt, Homo Sapiens
auucagcauuugaaagauuuaucucaaccuggacauauuuuaagaaguuucagcaggcagcuuu

SEQ ID NO: 712246 - RNA, 64 nt, Homo Sapiens
uuuccauuuaaagguggacaagguuuucuuuaagauauuuuauucuuacauaaacauacuuaaa

SEQ ID NO: 712247 - RNA, 64 nt, Homo Sapiens
auguauuucacuuuaugacuugaauauuuaauauauauuuuaguuagcagcaaugcagauuugg

SEQ ID NO: 712248 - RNA, 64 nt, Homo Sapiens
aaaugcaaaacaacagcuggcuauuuagcagagaauauuuuaauacuuuuaaagacaaacauaa

SEQ ID NO: 712249 - RNA, 64 nt, Homo Sapiens
ucauacaaagcagaguacuuuauuucuuuguuggauauuuuaguaagcugggcaaugccuauuu

SEQ ID NO: 712250 - RNA, 64 nt, Homo Sapiens
uuuuuugccauacagauaaacuuguauuuucaggauauuuuauuaaugcuauauguauuguaua

SEQ ID NO: 712251 - RNA, 64 nt, Homo Sapiens
uuacuaaaaauggauuugaaguaauaaagcucacauauuuuacaaucuuuauuuucuuuaacau

SEQ ID NO: 712252 - RNA, 64 nt, Homo Sapiens
guaacuuugacaaauaaauuguauauguuuaaaaauauuuuauucauccguuauaucuaauuuu

SEQ ID NO: 712253 - RNA, 64 nt, Homo Sapiens
gcuuugaaugcucaaacuauugugauucauuuuuauauuuuauuucuuaaauaucauagagcac

SEQ ID NO: 712254 - RNA, 64 nt, Homo Sapiens
gauuuauuuuguuucuggagucacuaaaaaucauauauuuuacaacuaauuuggcucuuucugc

SEQ ID NO: 712255 - RNA, 64 nt, Homo Sapiens
cauuucaauugauuguacuaauuuauauuuuauuauauuuuauauuucauuuuaaacauccuaa

SEQ ID NO: 712256 - RNA, 64 nt, Homo Sapiens
auauuuuauacauuucaauuaacauccuaaauuuauauuuuauuucauguuucauuucauuuua

SEQ ID NO: 712257 - RNA, 64 nt, Homo Sapiens
uuguagaaaaguaaauauaaaaucgugaauuugcauauuuuagaucagaaaaacauuagaaugu

SEQ ID NO: 712258 - RNA, 64 nt, Homo Sapiens
uuauuuguuacuaaagcuauauuucugauaaaaaauauuuuaggauaauugccuacagagggau

SEQ ID NO: 712259 - RNA, 64 nt, Homo Sapiens
cauuugcauucaauuuacagguaccaguacguacauauuuuaauagaaagauacaaccuuuuua

SEQ ID NO: 712260 - RNA, 64 nt, Homo Sapiens
agugucucuucaagguuuuacuugauuuaauuugauauuuuacugguuuaccaguaagguguau

SEQ ID NO: 712261 - RNA, 64 nt, Homo Sapiens
aagaggcaugaacuuguccuaacaaugucaaagaauauuuuaaagguauaccaguuaaaguagu

SEQ ID NO: 712262 - RNA, 64 nt, Homo Sapiens
uuuucucucucucucuuuuuuuuuuuuacuuuacauauuuuauacaaugucauucauaacuaug

SEQ ID NO: 712263 - RNA, 64 nt, Homo Sapiens
uuuguaauuauuuucuuuauuguugguaaacuccauauuuuaaaaauuuaccuguauacauagu

SEQ ID NO: 712264 - RNA, 51 nt, Homo Sapiens
aaaagaaaauggagaaaugaaauauuuuaugaaagaaaauaauaacaauua

SEQ ID NO: 712265 - RNA, 64 nt, Homo Sapiens
gucaugcauuauccaaaaacaauaccaaaaagacauauuuuauaaaaugacaaaaaauauuuua

SEQ ID NO: 712266 - RNA, 64 nt, Homo Sapiens
uaccaaaaagacauauuuuauaaaaugacaaaaaauauuuuacauaauuacucauuuuuguuga

SEQ ID NO: 712267 - RNA, 64 nt, Homo Sapiens
uuugugaauuugucaacuuucgagcaucaaacaaauauuuuacuuaaauuuuauuuuaucuuau

SEQ ID NO: 712268 - RNA, 64 nt, Homo Sapiens
agaucuaccauuaauagaaaauaaacuaaaccuuauauuuuauuuuugccaaaauauuuuauua

SEQ ID NO: 712269 - RNA, 64 nt, Homo Sapiens
aauaaacuaaaccuuauauuuuauuuuugccaaaauauuuuauuauaaaauaugaccaaaauau

SEQ ID NO: 712270 - RNA, 64 nt, Homo Sapiens
uuauuagaacaaaagguguuuaaggaugaacuaaauauuuuaauugagcauuuauauggauaau

SEQ ID NO: 712271 - RNA, 64 nt, Homo Sapiens
uguaagcccauauguauuuacauccagagucauaauauuuuaaauaaacaaucaugcagaaacu

SEQ ID NO: 712272 - RNA, 64 nt, Homo Sapiens
ucucuuucagcuauuuuauuuaauauugugucagauauuuuacaagguaugaccuaauuaaaaa

SEQ ID NO: 712273 - RNA, 64 nt, Homo Sapiens
uaugaaaaugccaguaacguuuauuuaaaacaaaauauuuuaauuuuuaaauuuucccuuaaaa

SEQ ID NO: 712274 - RNA, 64 nt, Homo Sapiens
ccaaguuuauaaugguggucgcuuuaauacacacauauuuuauccccugacauuaaaugcugag

SEQ ID NO: 712275 - RNA, 64 nt, Homo Sapiens
aaugcagagcuauagucucauguacacagucuguauauuuuaauggaaaaaggauguguaaugg

SEQ ID NO: 712276 - RNA, 64 nt, Homo Sapiens
gcaguacguuuuuuuguaacuuuaccccuucuuaauauuuuacacuuuguuauagaugguaucc

SEQ ID NO: 712277 - RNA, 64 nt, Homo Sapiens
uuagagguuuuguuugcuuucucuguguauuuugauauuuuaaucaggaugugugcuucaguug

SEQ ID NO: 712278 - RNA, 64 nt, Homo Sapiens
cauuuauuuuccgaauguauuuuaguacuuuuucauauuuuauaaaaaguacugaaaaaugcuu

SEQ ID NO: 712279 - RNA, 64 nt, Homo Sapiens
uaauccaaaauguacuaaaucguuuuagaauguaauauuuuaggccauuuauacccuguaaagc

SEQ ID NO: 712280 - RNA, 64 nt, Homo Sapiens
auauaugugcuauagauauaccaccuagaaauagauauuuuauuaaagaaaauccaaauaaagc

SEQ ID NO: 712281 - RNA, 64 nt, Homo Sapiens
uuauuuuuuacuauuuaaccuauucacaauuuuaauauuuuaaucuuuuucuuuugaaaauaua

SEQ ID NO: 712282 - RNA, 64 nt, Homo Sapiens
uaguuaaaaaagacaaaagaauauaugucauacuauauuuuaaauaugcaaaaguuuaauuuuu

SEQ ID NO: 712283 - RNA, 64 nt, Homo Sapiens
ugauuuuuaauccaaaacuauaucuuauuucacaauauuuuaacccacuuccccaccacugaaa

SEQ ID NO: 712284 - RNA, 64 nt, Homo Sapiens
gauauuugaaacuaaucuuauaacuggucaggauauauuuuaauagcuuuuauuuccuggauag

SEQ ID NO: 712285 - RNA, 64 nt, Homo Sapiens
ugguuuuauguuaacauugucuguugagcacuaaauauuuuagucauuauucuacaaaugcauu

SEQ ID NO: 712286 - RNA, 64 nt, Homo Sapiens
ucuguaguuucugguuagcuuuuuuuugucgugcauauuuuauuuaguugcucuccuuuuuucu

SEQ ID NO: 712287 - RNA, 64 nt, Homo Sapiens
aacuuuagauuuaaugucuacuuauagguaguugauauuuuaaaaaccauuuaagacuacuuuu

SEQ ID NO: 712288 - RNA, 64 nt, Homo Sapiens
auugaaccauuuuuuaacuuuuuaaaauaaaauaauauuuuaauagcuuucugaaagauugggc

SEQ ID NO: 712289 - RNA, 64 nt, Homo Sapiens
cucaaaugcguuuuuguacuuaaaaauaaggguuauauuuuaccguuugucuguaaugaauggu

SEQ ID NO: 712290 - RNA, 64 nt, Homo Sapiens
ccaccgugccuggccuauuuuauuauauuguaauauauuuuauuauauuagccaccaugccugu

SEQ ID NO: 712291 - RNA, 64 nt, Homo Sapiens
ccaccaugccuguccuauuuucuuauguuuuaauauauuuuaauauauuacaugugcaguaauu

SEQ ID NO: 712292 - RNA, 64 nt, Homo Sapiens
uggagcagacagaaaagauauagcaaaugaagaaauauuuuaaggaaaccuauuugaaaaaaaa

SEQ ID NO: 712293 - RNA, 64 nt, Homo Sapiens
uggauguuuuugaaguaucuaaaauaguagcagaauauuuuauacuugguccuugcaauggugu

SEQ ID NO: 712294 - RNA, 64 nt, Homo Sapiens
uuucuuuuuuguuauuuuaucuugaaaacgguacauauuuuaguauuugugcagaaaaacaagu

SEQ ID NO: 712295 - RNA, 64 nt, Homo Sapiens
uuuugaaaagaugaaccaaaggauuugacugcuaauauuuuauuccuuacacuuuuuuucugaa

SEQ ID NO: 712296 - RNA, 64 nt, Homo Sapiens
cauauuaauuuacuugaauuugucauaaagcuaaauauuuuauauguuuucaaagauuauuuuu

SEQ ID NO: 712297 - RNA, 64 nt, Homo Sapiens
auuaacuagucauaacuguuuauacaccacucucauauuuuagugaucaauaugaagacagcua

SEQ ID NO: 712298 - RNA, 64 nt, Homo Sapiens
guuucacccaaaugccugagacugcuugaaagauauauuuuaaguggugcacuaauuagugaau

SEQ ID NO: 712299 - RNA, 64 nt, Homo Sapiens
uugaauaggauaaauuuucagagggcugccuaaaauauuuuauuucuagcauccugauucugga

SEQ ID NO: 712300 - RNA, 64 nt, Homo Sapiens
auguguuugucucuuaaagcauuggugaaaucacauauuuuauauucagcauaaaggagaauaa

SEQ ID NO: 712301 - RNA, 64 nt, Homo Sapiens
uguuuaguguuucugcuuuacagugcugaauuccauauuuuagaagcuaugaaaguccuuuuau

SEQ ID NO: 712302 - RNA, 64 nt, Homo Sapiens
uuaaguuuagcacuguaucagaaugaagaaacuaauauuuuacauaaaaacuaauacuuucaau

SEQ ID NO: 712303 - RNA, 64 nt, Homo Sapiens
ucagucuaauuguuuugacuguuauagaaaccaaauauuuuacuguuucuuuuaaggacuaaua

SEQ ID NO: 712304 - RNA, 64 nt, Homo Sapiens
guaaaauacauccuuuaaauauauaucuaagcauauauuuuaaaaggagcaaaaauaaaaccaa

SEQ ID NO: 712305 - RNA, 64 nt, Homo Sapiens
aaaaccaaaguguuaguaaauuuugauuuauuagauauuuuagaaaaauaauagaauucugaag

SEQ ID NO: 712306 - RNA, 64 nt, Homo Sapiens
aaucuauuuuuacugaauaaaguaauuauggaaaauauuuuaaacucuagaagcuucaauaaug

SEQ ID NO: 712307 - RNA, 64 nt, Homo Sapiens
ugccauaccaaggucauaauuccuuccgugagaaauauuuuagugggguaacaaaaagaauugc

SEQ ID NO: 712308 - RNA, 64 nt, Homo Sapiens
cauguaugauccagaaaauagguacgguuuuaaaauauuuuauauagaaaagcuacaaaguaaa

SEQ ID NO: 712309 - RNA, 64 nt, Homo Sapiens
ucuuuuuuugguuuuaaagguuuuuguuaauguaauauuuuaauagcaaagauaucaugacucu

SEQ ID NO: 712310 - RNA, 64 nt, Homo Sapiens
gggucaggcauuuuauaucaagggugcucugaacauauuuuauuuuuuaaaaaaacuauguuug

SEQ ID NO: 712311 - RNA, 64 nt, Homo Sapiens
uuccucaugucuuugagauuugaucaguuugugaauauuuuaugcuuugaugauauagugagaa

SEQ ID NO: 712312 - RNA, 64 nt, Homo Sapiens
uucuugggaaauuuauuuucuacgcuauucaaagauauuuuaaauaauauuuuaaaaacaugaa

SEQ ID NO: 712313 - RNA, 64 nt, Homo Sapiens
uuauuuucuacgcuauucaaagauauuuuaaauaauauuuuaaaaacaugaaauuuuuuuuuca

SEQ ID NO: 712314 - RNA, 64 nt, Homo Sapiens
uauguuauauucaauaucuuuucagaugcagucuauauuuuaugcugaguuuuaaaaaugaaau

SEQ ID NO: 712315 - RNA, 64 nt, Homo Sapiens
aguuuuuaaaauaaugcuacaaucuucauaacuaauauuuuaauggggagugacugcuuaauug

SEQ ID NO: 712316 - RNA, 64 nt, Homo Sapiens
uuuuaucuuuuucuuugacacaccgcgcccggcuauauuuuauccugggauuacaggcuugagc

SEQ ID NO: 712317 - RNA, 64 nt, Homo Sapiens
uuuuuuuuuuuuuuuuuucuuaaaauguacauuuauauuuuaucuagccuuauaaaaaagguug

SEQ ID NO: 712318 - RNA, 64 nt, Homo Sapiens
auuuuaugggucagucaacuuauauaaaaaugaaauauuuuaacaucuauuuuuguagauauuu

SEQ ID NO: 712319 - RNA, 64 nt, Homo Sapiens
uaaaaaugaaauauuuuaacaucuauuuuuguagauauuuuauagucugguuuuuguaaauguu

SEQ ID NO: 712320 - RNA, 64 nt, Homo Sapiens
ucaauguaauuaaacuguuaauuaagcccacaguauauuuuauuuucuguaauauuuacaaugu

SEQ ID NO: 712321 - RNA, 64 nt, Homo Sapiens
aucuccuaaaugcugggcaauguauauuuguaugauauuuuaaauagauuucucacacucuaac

SEQ ID NO: 712322 - RNA, 64 nt, Homo Sapiens
uuauuuuuugauugacuagauacaguguuauuugauauuuuaauuuuuugguuuuaaaucacug

SEQ ID NO: 712323 - RNA, 64 nt, Homo Sapiens
uccucuucuguugaaugcaguaaauaguugacauauauuuuauaugacauuaggaaauuuagga

SEQ ID NO: 712324 - RNA, 64 nt, Homo Sapiens
auauauuguaaaauuuagacuuuuuagcauuuuaauauuuuaauuauucuauauugcaaugauu

SEQ ID NO: 712325 - RNA, 64 nt, Homo Sapiens
aaacuauuguauagaauggaguaaacugccauuuauauuuuagagcugguguguucuuuugcau

SEQ ID NO: 712326 - RNA, 64 nt, Homo Sapiens
guaagaaaugacaaacugcugcacuugauuuucaauauuuuauagccaauaguggcugaguuuc

SEQ ID NO: 712327 - RNA, 64 nt, Homo Sapiens
gaaaauuuauuucagagcggauaucauacuguuaauauuuuauucaguaguaaaccuguuuuag

SEQ ID NO: 712328 - RNA, 64 nt, Homo Sapiens
ggaaaugaaaauuguggaauuauccauuaaauaaauauuuuaguuuuuauuuauuucuguaaga

SEQ ID NO: 712329 - RNA, 64 nt, Homo Sapiens
uagauggugaauuauauuaaauaucuuguuaguaauauuuuaagcuuuagcacaugauucacca

SEQ ID NO: 712330 - RNA, 64 nt, Homo Sapiens
cacauuuuuuucuaccuauaacacucuaggauguauauuuuauauaaaguauucuuuuucuuuu

SEQ ID NO: 712331 - RNA, 64 nt, Homo Sapiens
uuuccuaaauccaaccauuuucauuaauucaggcauauuuuaacuccacugcuuaccuacuuuc

SEQ ID NO: 712332 - RNA, 64 nt, Homo Sapiens
acauaggaggcaaugugugagacuuggggguucaauauuuuauauagaagaguuaauaagcaca

SEQ ID NO: 712333 - RNA, 64 nt, Homo Sapiens
caaauguauuuuuucuugugcauauuauaaaaauauauuuuaugagcucuuacucaaauaaaua

SEQ ID NO: 712334 - RNA, 64 nt, Homo Sapiens
uagcugaauauaucuuuauacauauguaaagccaauauuuuagaauaaguauuuuaguauaaau

SEQ ID NO: 712335 - RNA, 64 nt, Homo Sapiens
aagccaauauuuuagaauaaguauuuuaguauaaauauuuuaguaaaauacuauaaaaauaaaa

SEQ ID NO: 712336 - RNA, 64 nt, Homo Sapiens
acauaccaagacccccgucucuuuaaaaauauauauauuuuaaauauacuuaaauauauauuuc

SEQ ID NO: 712337 - RNA, 64 nt, Homo Sapiens
aauauauauuucuaauaucuuuaaauauauauauauauuuuaaagaccaauuuaugggagaauu

SEQ ID NO: 712338 - RNA, 64 nt, Homo Sapiens
guuuaugguuaaaaguuuuugaagugucucaaaaauauuuuacuaacuguaacccuaaaauuga

SEQ ID NO: 712339 - RNA, 64 nt, Homo Sapiens
auuugaguagaaaaucacuuaccagugagcauauauauuuuaaaauacuuucuuuggauauugu

SEQ ID NO: 712340 - RNA, 64 nt, Homo Sapiens
ucaauuuguggauuugauauccuggauauuuauuauauuuuauguaaugcugcauuucuauuug

SEQ ID NO: 712341 - RNA, 64 nt, Homo Sapiens
ucuuguuuuuaauauucaugcauguauauucaucauauuuuacaagguuccugguaaaaauuac

SEQ ID NO: 712342 - RNA, 64 nt, Homo Sapiens
gagauauaucuauuuucaauucaacuacagaaauauauuuuauuggccgggugcgguggcucau

SEQ ID NO: 712343 - RNA, 64 nt, Homo Sapiens
uccgucucaaaaacaaaaaaaaaagaaaagaaauauauuuuauucauucacauuaggucacugu

SEQ ID NO: 712344 - RNA, 64 nt, Homo Sapiens
agugguuagguuuggaaaagagaugaugaugguaauauuuuauuugugcuuuuuaagccauuuc

SEQ ID NO: 712345 - RNA, 64 nt, Homo Sapiens
uguugaauguucuauaucuuauuaguuaauuuguauauuuuauuaguauuuuggaaauagcaua

SEQ ID NO: 712346 - RNA, 64 nt, Homo Sapiens
cuccuuauuacauauauguugauauguaaaaugaauauuuuaguaauaugaaauacauguugua

SEQ ID NO: 712347 - RNA, 64 nt, Homo Sapiens
acagaaaagggcuucucagaaucagugaaucauuauauuuuaaaagacuguugauacuauaaac

SEQ ID NO: 712348 - RNA, 64 nt, Homo Sapiens
ugguauaauaaacucagauauugauuuauuuguaauauuuuaaauuuaaaugcaugaaauguaa

SEQ ID NO: 712349 - RNA, 64 nt, Homo Sapiens
uuuaaaaaaacuagggggaacaucuuuauagcauauauuuuauuucgcugcagcagcuuucuuu

SEQ ID NO: 712350 - RNA, 64 nt, Homo Sapiens
uagcauuuugcuugauuauuggugauuguaagucauauuuuauagagagcuaauuuuuuucaaa

SEQ ID NO: 712351 - RNA, 64 nt, Homo Sapiens
aucuccauuauuuguguaaauaucugagcugguaauauuuuaaauuauaaagauucuaaacaug

SEQ ID NO: 712352 - RNA, 64 nt, Homo Sapiens
ucucagauugguuauucagauacucagacuuuaaauauuuuaaaaugauguauuagaaauauuu

SEQ ID NO: 712353 - RNA, 64 nt, Homo Sapiens
cagacuuuaaauauuuuaaaaugauguauuagaaauauuuuacugucucaaaacuguucuguuc

SEQ ID NO: 712354 - RNA, 64 nt, Homo Sapiens
aacacuacuuuugcuuuuuuucaugcucucauauauauuuuaaaaaaaaugugaaaaaaauuau

SEQ ID NO: 712355 - RNA, 64 nt, Homo Sapiens
aucuuuucagugugauggcauaagucaacacuauauauuuuaugucagauaucauacugauuuu

SEQ ID NO: 712356 - RNA, 64 nt, Homo Sapiens
guuuuuucuaucuaaaauuauggcaauuccauacauauuuuagaaagucugccuguuuaguaag

SEQ ID NO: 712357 - RNA, 64 nt, Homo Sapiens
aaaaauuuaaguuuauucaggaacaaauacauaaauauuuuaaguugcaauuucauuguaaaau

SEQ ID NO: 712358 - RNA, 64 nt, Homo Sapiens
guauaaaguauuuauggaaauaccucucauuuaaauauuuuauaaggaucauacacaugacuua

SEQ ID NO: 712359 - RNA, 64 nt, Homo Sapiens
aaaacaaggaaaacauaauguaagauaugggaaaauauuuuaauaugcuuaauaaauacuuuaa

SEQ ID NO: 712360 - RNA, 64 nt, Homo Sapiens
ucagcugucaaggggagaccguugauguauguuuauauuuuaagacuguucuaagaagcaggca

SEQ ID NO: 712361 - RNA, 64 nt, Homo Sapiens
aaugcuagauauuggucugguuuccaauucauuuauauuuuacauguugauuugguauaaaguu

SEQ ID NO: 712362 - RNA, 64 nt, Homo Sapiens
uucuaaaagcauacacaaugugcuaugguaauacauauuuuaaauaaaaguacaauguuuagac

SEQ ID NO: 712363 - RNA, 64 nt, Homo Sapiens
agcaugcagccaucuuggugagagcuauguguaaauauuuuaagaugggagagcuauaaauggc

SEQ ID NO: 712364 - RNA, 64 nt, Homo Sapiens
uuuuaguuauuugugucaaauguacuuuuagggaauauuuuauuguuuuuguguaucaauauuu

SEQ ID NO: 712365 - RNA, 64 nt, Homo Sapiens
gaugcagacaauccaugcacuaaauagcuuacugauauuuuauguaauguuaauaugaagguaa

SEQ ID NO: 712366 - RNA, 64 nt, Homo Sapiens
uuaugcaagcaaacuaggagcauucuguauauacauauuuuaaaaguuaucaauauuuuaagau

SEQ ID NO: 712367 - RNA, 64 nt, Homo Sapiens
aucauucuguauauacauaucauacuaguuaucaauauuuuaagaucuucagggcugugaauuc

SEQ ID NO: 712368 - RNA, 64 nt, Homo Sapiens
caaggggagggagcagaagcacuuauguuuacggauauuuuaaacucuguuagagagcagccuu

SEQ ID NO: 712369 - RNA, 64 nt, Homo Sapiens
cugagggcuggggguugggggagucagcaugauuauauuuuaauguagaaaaugugacaucugg

SEQ ID NO: 712370 - RNA, 64 nt, Homo Sapiens
uuuacauauccaauuccaguaacucucaaauucaauauuuuauucaaacucuguugaggcauuu

SEQ ID NO: 712371 - RNA, 64 nt, Homo Sapiens
gcacaacaaaaaaauauccugggcaauaaaaaaaauauuuuaaaccagcuuuggagccacuuuu

SEQ ID NO: 712372 - RNA, 64 nt, Homo Sapiens
gugucccuggauauggaauaagcagguauaaaaaauauuuuaauuauaguuuuguuauaaauau

SEQ ID NO: 712373 - RNA, 64 nt, Homo Sapiens
uuagucauucaacaaaucccauaaguauguguuaauauuuuaauuguguaaaacucauuuguua

SEQ ID NO: 712374 - RNA, 64 nt, Homo Sapiens
cauguaaguaagccauuuuuauuugccuuucuagauauuuuauuuuauuguggaaaacuguaaa

SEQ ID NO: 712375 - RNA, 64 nt, Homo Sapiens
cuuagugaacauuacauuuucagaauagauccuaauauuuuauugagggccuaugugcuaaaaa

SEQ ID NO: 712376 - RNA, 64 nt, Homo Sapiens
caagcaauuauguaccauauauacacuguagcaaauauuuuauauuugagagucuuuacagcuu

SEQ ID NO: 712377 - RNA, 64 nt, Homo Sapiens
uccugcaaagcugaaacugauuagaaaauucuuuauauuuuaaaauagcucuuucucauuuuua

SEQ ID NO: 712378 - RNA, 64 nt, Homo Sapiens
uuuauauaggucccaaauuauaauugucaaauauauauuuuaaauuaauaaaaguugucauucu

SEQ ID NO: 712379 - RNA, 64 nt, Homo Sapiens
ugugaaacuaucuugaauuugcaaauauaguguuauauuuuauaaaguuuuguaaaaucccaaa

SEQ ID NO: 712380 - RNA, 64 nt, Homo Sapiens
ucaaccuuuauugacuuuguuuuuacaauaaaaaauauuuuacaacuuacuuucuguucucugu

SEQ ID NO: 712381 - RNA, 64 nt, Homo Sapiens
ucagaaguaugggucagaucgagagaauuuaguuauauuuuaaaaaaauuaguacuguuuuauu

SEQ ID NO: 712382 - RNA, 64 nt, Homo Sapiens
aguuauaaacuaaccucagauacauuuuaacaaaauauuuuaaaguuuguaauuucagguuuuu

SEQ ID NO: 712383 - RNA, 64 nt, Homo Sapiens
uaauuuaaaagaaaucucuuaacaaguuuguuauauauuuuauuuuuaauuugcuaaauauuuu

SEQ ID NO: 712384 - RNA, 64 nt, Homo Sapiens
aaguuuguuauauauuuuauguuuaauuugcuaaauauuuuaaccacuuauuacaaagacaaac

SEQ ID NO: 712385 - RNA, 64 nt, Homo Sapiens
uuguuuuuauuuuugaacauuagggaccaccaccauauuuuauuuaccugccuucaaaauaguu

SEQ ID NO: 712386 - RNA, 64 nt, Homo Sapiens
uuagacuaagcuaccugccuuaugaaugaaaaaaauauuuuagcuuugaggggaggauuauugc

SEQ ID NO: 712387 - RNA, 64 nt, Homo Sapiens
auaccucucucucuacauauaguuuuuuaugacaauauuuuaacgucauauauagccucaauug

SEQ ID NO: 712388 - RNA, 64 nt, Homo Sapiens
auuguuuuuaaucuguauagauaauugguaaauaauauuuuaaaccaguaaaaccauucaauca

SEQ ID NO: 712389 - RNA, 64 nt, Homo Sapiens
augccugaggaaauacauuuuauuaaauguauauauauuuuaaaugcaaauacagcuccaaaaa

SEQ ID NO: 712390 - RNA, 64 nt, Homo Sapiens
auuauuugucuauauucuaauuuaaaaacugaaaauauuuuaaaccagcuaaaauugugugcca

SEQ ID NO: 712391 - RNA, 64 nt, Homo Sapiens
gugcacacugaauagucuaaucuacauguaacacauauuuuagugugauuuucuauacucuaau

SEQ ID NO: 712392 - RNA, 64 nt, Homo Sapiens
guaccacuugauauaaaaaggauauccauaaugaauauuuuauacugcauccuuuacauuagcc

SEQ ID NO: 712393 - RNA, 64 nt, Homo Sapiens
uacucugcgguuauaaaaaugucuauucucuauuauauuuuauuaaguguauuuauuguuacaa

SEQ ID NO: 712394 - RNA, 64 nt, Homo Sapiens
aauugcucugugauacuuaacaaaaauguauuaaauauuuuaaaaaugcucauucuuuguagaa

SEQ ID NO: 712395 - RNA, 64 nt, Homo Sapiens
agagggauaacaaugcugauuacuaccuuuuaaaauauuuuagauaaaugcacagcaccacagc

SEQ ID NO: 712396 - RNA, 64 nt, Homo Sapiens
uuuaagcacucuagaaacaaugaagcuucuuggcauauuuuaaggagcucccaaaauguguuac

SEQ ID NO: 712397 - RNA, 64 nt, Homo Sapiens
uacuguguuucaacauaauaaauauaauagaaaaauauuuuauuuguauuguuguauaaaauau

SEQ ID NO: 712398 - RNA, 64 nt, Homo Sapiens
cuauccaaaauaccuauuuuaaauuuuuaauacaauauuuuauuuuaauauaaacaucugucag

SEQ ID NO: 712399 - RNA, 64 nt, Homo Sapiens
uuuucccaccuugacaccaggcaauguaguuagcauauuuuauguaccaugguuauaugauuaa

SEQ ID NO: 712400 - RNA, 64 nt, Homo Sapiens
aacacagugaauuuguagaguggggguauuugacauauuuuacaggguggaguguacuauauac

SEQ ID NO: 712401 - RNA, 64 nt, Homo Sapiens
aguucugaaggggaaauauaacaucuaugguuauauauuuuaaaaacuuagauuauaggcugua

SEQ ID NO: 712402 - RNA, 64 nt, Homo Sapiens
aaagagaugauguagauuuuucggauggguggguauauuuuauuuuccaguuuauuuucauauu

SEQ ID NO: 712403 - RNA, 64 nt, Homo Sapiens
caagcagaggcaggaagagcuagucuuagcauuuauauuuuaauaggaaguugacucccagcau

SEQ ID NO: 712404 - RNA, 64 nt, Homo Sapiens
uuuuagugugauucuuuguugcagaaaugucaauauauuuuaugacaugguucccuacuaggga

SEQ ID NO: 712405 - RNA, 64 nt, Homo Sapiens
uauuuggaagguguucaauaugguacuuggauagauauuuuaaauucauucaauuucagaucac

SEQ ID NO: 712406 - RNA, 64 nt, Homo Sapiens
cuuuucuaaauauuagauaagagaaaauuuuaucauauuuuagggauucuguacauuuauuugg

SEQ ID NO: 712407 - RNA, 64 nt, Homo Sapiens
ucuuaauacacacaguuaugaguaucaggauacuauauuuuaggaccuuuaaaguguguaguaa

SEQ ID NO: 712408 - RNA, 64 nt, Homo Sapiens
uauuuuuucuuuucuauugugugauuuuaauaauauauuuuaaaaucuuguuuuggugguuuua

SEQ ID NO: 712409 - RNA, 64 nt, Homo Sapiens
caacaauacaaauaaaauaucuauaugauuguaaauauuuuauaaaaauguaacucuauauauu

SEQ ID NO: 712410 - RNA, 64 nt, Homo Sapiens
acuuuuaugaaucagaauaaucuguauuuaccuaauauuuuauauucagaggcuuauuguuuuc

SEQ ID NO: 712411 - RNA, 64 nt, Homo Sapiens
aaaucuaaauaacauagcuauuuaaaaaugucuaauauuuuaucucauagucaauacaaguauu

SEQ ID NO: 712412 - RNA, 64 nt, Homo Sapiens
cuacagucaccaguuuucauuuuuuuaaaaaaauauauuuuaacgcaguggagcaaauugguca

SEQ ID NO: 712413 - RNA, 64 nt, Homo Sapiens
agauucucaagcaaauuuucaccauauagcaacgauauuuuaaccacuauuuuugcuauuuuau

SEQ ID NO: 712414 - RNA, 64 nt, Homo Sapiens
acaagaauguguaucuguuguuacuagagaauguauauuuuaugaugcuguggaugaaaauaac

SEQ ID NO: 712415 - RNA, 64 nt, Homo Sapiens
ggugcaaaauaccauuagaauagaguuugaacaaauauuuuaaaucauuuguguucucuuaaaa

SEQ ID NO: 712416 - RNA, 64 nt, Homo Sapiens
ccaucuuagaucggagugugaaguaaauuaugguauauuuuauguaacauuuuaauguuuaugc

SEQ ID NO: 712417 - RNA, 64 nt, Homo Sapiens
uuauagaaacaaguaauagcaagaaaauugauguauauuuuaaugauacauuaaaauucccuuu

SEQ ID NO: 712418 - RNA, 64 nt, Homo Sapiens
agucauuucuaauuuaguugucaaaaacauauacauauuuuaacauuaguuuuuuugaaaacuc

SEQ ID NO: 712419 - RNA, 64 nt, Homo Sapiens
caaauaaaaugaaauaugaguuucaauacuuuuuauauuuuaauauuuccauucauuaauauua

SEQ ID NO: 712420 - RNA, 64 nt, Homo Sapiens
uccguaaauuucauuugcagugguuagucaucagauauuuuagccaccuacacaaaagcaaacu

SEQ ID NO: 712421 - RNA, 64 nt, Homo Sapiens
agaaaauugaacaaauguaauggaucaauuuaaaauauuuuauuucuuaaaagccuuuuuugcc

SEQ ID NO: 712422 - RNA, 64 nt, Homo Sapiens
uaaucuuguuaauacuuguuauauggacccuaagauauuuuauuacagaguuuuuaauuaguga

SEQ ID NO: 712423 - RNA, 64 nt, Homo Sapiens
aauuagugaaaaauucaugaauaccauagagaaaauauuuuagaauuuaauguuucuuauauuu

SEQ ID NO: 712424 - RNA, 64 nt, Homo Sapiens
cuuccuugccuaugcccuugccuucuaguuccaaauauuuuagccagcuucacuguggcaauag

SEQ ID NO: 712425 - RNA, 64 nt, Homo Sapiens
uaacucaggugugauuuuugaaaaugucucuguaauauuuuaucuucuuuaaaaaaaagggggg

SEQ ID NO: 712426 - RNA, 64 nt, Homo Sapiens
gauauuuuugcugguuugcauguaggcauuaaaaauauuuuauuaauuuauguauacaagaaau

SEQ ID NO: 712427 - RNA, 64 nt, Homo Sapiens
caaacauuagauuugaaagaauaucgaagaaaaaauauuuuauuaucuaaaaaaauucauuuuu

SEQ ID NO: 712428 - RNA, 64 nt, Homo Sapiens
auguggaaugaucauugaaacuacauguuugugaauauuuuauaccugguguagacuuaaaaaa

SEQ ID NO: 712429 - RNA, 64 nt, Homo Sapiens
ccuuccauuccuagagacaaacaguauuuccccuauauuuuaguauucauuuuuauuuaaaugc

SEQ ID NO: 712430 - RNA, 64 nt, Homo Sapiens
ccuaaacguugaacuucuuccgcuuuagggaagcauauuuuaaagaagacaugggccaucccuc

SEQ ID NO: 712431 - RNA, 64 nt, Homo Sapiens
aaauguaaaaauggugguuugcugaggcugccccauauuuuagacaggauacuacagguggccu

SEQ ID NO: 712432 - RNA, 64 nt, Homo Sapiens
aaaaaaaaguggcuggucuaaguuuauaagcacaauauuuuaagguuuaaauaguuguacagau

SEQ ID NO: 712433 - RNA, 64 nt, Homo Sapiens
uugauccugcaaaaucuguugcuauauauccuuaauauuuuauaauuguuacauaguuaaaugu

SEQ ID NO: 712434 - RNA, 64 nt, Homo Sapiens
ucaacuuugguuccugugauauuucucauuaacaauauuuuaucuguggaaugucaaugccagg

SEQ ID NO: 712435 - RNA, 64 nt, Homo Sapiens
auaaauucuuagaaaguuuuaaacaaacaccaaaauauuuuagagaaaugacauuuuuauacua

SEQ ID NO: 712436 - RNA, 64 nt, Homo Sapiens
aacuguagagcugcuuucaauuuauauuuugugaauauuuuaaguuaguucauuuaauuuuaau

SEQ ID NO: 712437 - RNA, 64 nt, Homo Sapiens
gguuuauuucuauccccuguauuuauugguuuacauauuuuauucucugcaaaacuguuuacau

SEQ ID NO: 712438 - RNA, 64 nt, Homo Sapiens
uauaccuuguucacauaccccacaaaauucauuuauauuuuauaggaugagauccaagucuaaa

SEQ ID NO: 712439 - RNA, 64 nt, Homo Sapiens
auugguuggcagugccagcuggcucuuuuuuuuaauauuuuauuauuuuuguuaacuuuauuau

SEQ ID NO: 712440 - RNA, 64 nt, Homo Sapiens
ucucucuaagaauuaaauaaucuuuucuagcuuaauauuuuaauucuaauucaaacaacucuga

SEQ ID NO: 712441 - RNA, 64 nt, Homo Sapiens
ccugcauauuuuuauguaaaucucuaaauuuaaaauauuuuaaguacauuuauuuuugguguuu

SEQ ID NO: 712442 - RNA, 64 nt, Homo Sapiens
ucugguauuuaggcuggcaauauauauauuaaccauauuuuaaaaguaccaauuuuguuuuuac

SEQ ID NO: 712443 - RNA, 64 nt, Homo Sapiens
cauauauguuucccuuuucauuagcugaaugaggauauuuuaagaaguugaaagagaauuuauu

SEQ ID NO: 712444 - RNA, 64 nt, Homo Sapiens
ucuccaaacguugcuuagaugcuucaaaauuagcauauuuuaaguuuaccaguauaaaauacca

SEQ ID NO: 712445 - RNA, 64 nt, Homo Sapiens
agcacuucauucaauuaaaauacaugaauuuuaaauauuuuacaugaugugaauaggcaugaua

SEQ ID NO: 712446 - RNA, 64 nt, Homo Sapiens
gcuuucaaaucuuuuuuuaaaaaaauaguguaaaauauuuuaauaagccaaagccauguggaau

SEQ ID NO: 712447 - RNA, 64 nt, Homo Sapiens
cuuaacacaaaguauaacucuguagaguuggugaauauuuuagggaaauauuagcaaaaugcau

SEQ ID NO: 712448 - RNA, 64 nt, Homo Sapiens
aagaagaaaucaucucuacaauguagacaacauuauauuuuauagaauuuguuugaaauugagg

SEQ ID NO: 712449 - RNA, 64 nt, Homo Sapiens
ugaaguauuguaccagaguauuaaaagauauguaauauuuuauugauaaaucuauccuuuaaaa

SEQ ID NO: 712450 - RNA, 64 nt, Homo Sapiens
uuuuguauauuuuuguaacaaaauauaaaugaagauauuuuaccaugaagagauugcacuuauc

SEQ ID NO: 712451 - RNA, 64 nt, Homo Sapiens
cuuauccuugagaacagucuaaauauaaaugaagauauuuuaccaugaagagauugcacuuauc

SEQ ID NO: 712452 - RNA, 64 nt, Homo Sapiens
ugaccuauauucuugcaaauuauguuaauuuuucauauuuuaguuugauuuuagacaauuauuu

SEQ ID NO: 712453 - RNA, 64 nt, Homo Sapiens
aucaacaagccaacagacaagaaggagcgaaaguauauuuuauuugauggugauguggaugcuc

SEQ ID NO: 712454 - RNA, 64 nt, Homo Sapiens
uuuuauuuuuucuuguuuuuggcuugauauuacuauauuuuaacugaauagccagagcaucuaa

SEQ ID NO: 712455 - RNA, 64 nt, Homo Sapiens
auaaaucauuuagagaaauuuguaagaauguuguauauuuuaaccauauauaaaacagauguua

SEQ ID NO: 712456 - RNA, 64 nt, Homo Sapiens
ccugugaaagauuccacauacacuuaauuuacacauauuuuaauguauuucugguaauaagaag

SEQ ID NO: 712457 - RNA, 64 nt, Homo Sapiens
uguauuucauguuaguacuuaguuacagcaauagauauuuuauuauagggcaugugaaauguua

SEQ ID NO: 712458 - RNA, 64 nt, Homo Sapiens
uguauggguaucuucuaagaauuugguccaaauaauauuuuauuuccacguguauguuguuuuc

SEQ ID NO: 712459 - RNA, 64 nt, Homo Sapiens
uuugucaauauaauuuuuguauggguuuuugguuauauuuuauauuuucaugauauuagaacaa

SEQ ID NO: 712460 - RNA, 64 nt, Homo Sapiens
uugguaguacauuuucucccacagccguuugaauauauuuuauccuaauacaugguuuaaaguc

SEQ ID NO: 712461 - RNA, 64 nt, Homo Sapiens
cuacugauugaauguuaaugucaauguggaaaaaauauuuuaaaccagguagaggauucaagac

SEQ ID NO: 712462 - RNA, 64 nt, Homo Sapiens
aucaauuuauaaagggguaauugaaugccaaaagauauuuuagaguaaaaugcucaugaagguu

SEQ ID NO: 712463 - RNA, 64 nt, Homo Sapiens
gcagccaaguuuucauuucacauggauuuuaaaaauauuuuacuagaaaaacucauucagaaau

SEQ ID NO: 712464 - RNA, 64 nt, Homo Sapiens
acuguuuauuacuuccaugauuuucauaguauccauauuuuauuuauguuuuucugugugucag

SEQ ID NO: 712465 - RNA, 64 nt, Homo Sapiens
guuauguuuuucugugugucuguauccuggaacaauauuuuaugagucacucuuaauuaauauc

SEQ ID NO: 712466 - RNA, 64 nt, Homo Sapiens
auaaauuccaagucuuuucaccugucaggcaugcauauuuuaauaucuguuuggauagucagaa

SEQ ID NO: 712467 - RNA, 64 nt, Homo Sapiens
aaaauaugaguuguuacuuuguuucuucgaugucauauuuuauguguaauauauauguaaaggg

SEQ ID NO: 712468 - RNA, 64 nt, Homo Sapiens
acuguuagagcaaguauacucaaucaacuugcugauauuuuaguaguuaacagcuuccgagccu

SEQ ID NO: 712469 - RNA, 64 nt, Homo Sapiens
gcuaaauacaaugacauuugcuuuuaaaagguggauauuuuauuucugcuuuuugaaaauacuu

SEQ ID NO: 712470 - RNA, 64 nt, Homo Sapiens
aaaaauaguucuuuuaauucuuucaccuuaaagcauauuuuaugucucaaaaguauaaaaaacu

SEQ ID NO: 712471 - RNA, 64 nt, Homo Sapiens
acacauacauauauauacuauauauggaugaaacauauuuuaauguuguuuacuuuuuuaaaua

SEQ ID NO: 712472 - RNA, 64 nt, Homo Sapiens
uugaaguauuuugacuuuugagauugaauguaaaauauuuuaaauuugggaucaucgccuguuc

SEQ ID NO: 712473 - RNA, 64 nt, Homo Sapiens
aauauuaugucagcuuuaacauauaauauuuugaauauuuuagcuauauuuaguggcuuucugc

SEQ ID NO: 712474 - RNA, 64 nt, Homo Sapiens
uuucauaauguaaaucauauuuuuguuauuugccauauuuuauuugaagugauaaaauuuuaua

SEQ ID NO: 712475 - RNA, 64 nt, Homo Sapiens
cuagacugccuugguucaaacauacuuugaaacuauauuuuacccacaaauaccaauucuuauu

SEQ ID NO: 712476 - RNA, 64 nt, Homo Sapiens
aauaaaguauaguuauuuuaauucuuuaucuuggauauuuuauguugguuauuuuauauagcau

SEQ ID NO: 712477 - RNA, 64 nt, Homo Sapiens
ugguaacuaguauuuacagcuaaccuaucuauucauauuuuacauauauauauauauauauaca

SEQ ID NO: 712478 - RNA, 64 nt, Homo Sapiens
ugugguuuguuuuggcacuguuuuaaaaacucaaauauuuuaaacauuuguuaaguuggagcuu

SEQ ID NO: 712479 - RNA, 64 nt, Homo Sapiens
aaauuagaaaaagaaaacuuuucuuuuuuauuauauauuuuaguguaaguuaaguuaaacuucu

SEQ ID NO: 712480 - RNA, 64 nt, Homo Sapiens
aacaugggaaugauaauauauauuuuuucuuuuaauauuuuauuuuucuuuuuaugccacuuug

SEQ ID NO: 712481 - RNA, 64 nt, Homo Sapiens
acaccauacagaacaguacuggacaaaaggggugauauuuuaaauuuacuaucccagaaacagg

SEQ ID NO: 712482 - RNA, 64 nt, Homo Sapiens
gcuagcuugcaaaguuaugaaaauauugaaggcaauauuuuacuguauacggugcuaauuagua

SEQ ID NO: 712483 - RNA, 64 nt, Homo Sapiens
caaaacaacugguuauaugcaaugccuuccugucauauuuuagccuuuuauauagaacccaagg

SEQ ID NO: 712484 - RNA, 64 nt, Homo Sapiens
auauuaaagaaaaucuuuugacuuguccaugaaaauauuuuauggcauguguguuugcuagcuc

SEQ ID NO: 712485 - RNA, 64 nt, Homo Sapiens
auagaaaaaguauuuuuucuaaccaaaaaacuacauauuuuauugaaaaaaaaguuacguuaaa

SEQ ID NO: 712486 - RNA, 64 nt, Homo Sapiens
cuugcauuuccauaaggaaacauuguuuaaugaaauauuuuauuuauauuuuauuuucaagguu

SEQ ID NO: 712487 - RNA, 64 nt, Homo Sapiens
uucaagguucauuguuuaauguuucuuaauguuuauauuuuauuauuaucuuuuuagcaaaaug

SEQ ID NO: 712488 - RNA, 64 nt, Homo Sapiens
aacuuaugcagagcacuuuuuaaauccagaaagcauauuuuauagaaauuuuucuguuaaauuu

SEQ ID NO: 712489 - RNA, 64 nt, Homo Sapiens
aucauaccuaugacuuguuuauauuauguacauaauauuuuagagaauuuccuccuguagucau

SEQ ID NO: 712490 - RNA, 64 nt, Homo Sapiens
ccaggaguauaccuugcuauagagaaagauggugauauuuuagguuacuuugucccaggcaugc

SEQ ID NO: 712491 - RNA, 64 nt, Homo Sapiens
auuuguuuuauuuggaguuauuuucuucccucaaauauuuuacuagaauauacauacuuugcug

SEQ ID NO: 712492 - RNA, 64 nt, Homo Sapiens
uaacaacuaaacaggagccauuucaaggcgggagauauuuuaaacacccaaaauguugggucug

SEQ ID NO: 712493 - RNA, 64 nt, Homo Sapiens
uuccaacuuucauugaaaaugccauaucuauaccauauuuuauucgagucacugaugauguaau

SEQ ID NO: 712494 - RNA, 64 nt, Homo Sapiens
gagaugaaucaaaaaauaccccuaguaaugcuuuauauuuuaauacugcaaaagcuuuacaaau

SEQ ID NO: 712495 - RNA, 64 nt, Homo Sapiens
cuuggaccaauugauaauauuucugacuguauuaauauuuuagugcuauaaaauacuaugugaa

SEQ ID NO: 712496 - RNA, 64 nt, Homo Sapiens
acugugcagggaggaaaccauguauagcuuguacauauuuuaaaccagaccuucucacgaacug

SEQ ID NO: 712497 - RNA, 64 nt, Homo Sapiens
aguauuuucuuuagcuagcuuaaaaagaaaacauauauuuuauguaaaaacacauacauggcca

SEQ ID NO: 712498 - RNA, 64 nt, Homo Sapiens
auuaaaauuuugcaauauauuguguauuggucugauauuuuaguauauaguagaacauacuuuu

SEQ ID NO: 712499 - RNA, 64 nt, Homo Sapiens
auauuaaauauuuugcuuuuuagacagcuguaggauauuuuauuucauggguauaccauaacuu

SEQ ID NO: 712500 - RNA, 64 nt, Homo Sapiens
uuggaaaggagcuaguagcuuuaaggccaccaccauauuuuacuuuuuuaggauuuuucccccu

SEQ ID NO: 712501 - RNA, 64 nt, Homo Sapiens
uuuaggagccagguagguuaccugcuuacacacuauauuuuaauugaauucaaacuaucaagca

SEQ ID NO: 712502 - RNA, 64 nt, Homo Sapiens
aagucugugauuggggauuugcguuauaaaaugaauauuuuaaaaagcaacagcccuaauagcc

SEQ ID NO: 712503 - RNA, 64 nt, Homo Sapiens
ggacuccucacaggcgguggaaauaauuaauaccauauuuuauacaucuccagagccuuucauc

SEQ ID NO: 712504 - RNA, 64 nt, Homo Sapiens
uuaugauaaagggccuuuaauuaaaaaacaaaguauauuuuauuuguacuuuacugagcaaagu

SEQ ID NO: 712505 - RNA, 64 nt, Homo Sapiens
cuauauuauuacaaaaacggcagugauauaaagcauauuuuauucacccagcauauuuucuauu

SEQ ID NO: 712506 - RNA, 64 nt, Homo Sapiens
uauauacauguuuuucuuuuacaugcauauauauauauuuuauuuuauuuuauguuuuuuggag

SEQ ID NO: 712507 - RNA, 64 nt, Homo Sapiens
ccaaaacugauucagauuuucauacuuuaaugaaauauuuuauaauuugcaaauuuuuaaguaa

SEQ ID NO: 712508 - RNA, 64 nt, Homo Sapiens
guugcaguaacuaaccaccaauguuaacaucuucauauuuuauauuccuaauaacagugaugac

SEQ ID NO: 712509 - RNA, 64 nt, Homo Sapiens
augagccauucagucuuugcucacuauauauuuaauauuuuauuauuguuguuauuguuauuau

SEQ ID NO: 712510 - RNA, 64 nt, Homo Sapiens
auuuguucuuguauuuauugcuuggacaaaucacauauuuuaaauuguuuccuuuuucagauau

SEQ ID NO: 712511 - RNA, 64 nt, Homo Sapiens
aucagcuauuuugugaagccucaguucauuagaaauauuuuaaaauuuucuuuucccccauuaa

SEQ ID NO: 712512 - RNA, 64 nt, Homo Sapiens
aacagaagaguagcaucagaaagaaagugguuccauauuuuacaugcucaccucaaacaguaca

SEQ ID NO: 712513 - RNA, 64 nt, Homo Sapiens
gcaaauaaucacuucaccucaggcaauucuuuguauauuuuaaggacuauuuuuuuuucaaagu

SEQ ID NO: 712514 - RNA, 64 nt, Homo Sapiens
uaaagaaauugugcuuuuggcaacaguguuaaccauauuuuauuauaaaauaguuucagucauc

SEQ ID NO: 712515 - RNA, 64 nt, Homo Sapiens
acaggugugagccaccacacugggccaaugcuuaauauuuuaauguaucucaacaauaaaacca

SEQ ID NO: 712516 - RNA, 64 nt, Homo Sapiens
uuuuuuuugauuuuuguuuuuuugcagcuugcugauauuuuauauaaaaaagaaaagcaaagca

SEQ ID NO: 712517 - RNA, 64 nt, Homo Sapiens
aaaagcaaagcaaaagagaagcugauagucuugaauauuuuauuuuuuuaaugaaaagaaaaaa

SEQ ID NO: 712518 - RNA, 64 nt, Homo Sapiens
ucagccagcuuuucccaccaguggugcuguugagauauuuuaaaauauugccuccguuuuaucg

SEQ ID NO: 712519 - RNA, 64 nt, Homo Sapiens
acuagagcaagauggguuuuauaucuuaauaaauauauuuuauugagcuuguuagcuucuaauu

SEQ ID NO: 712520 - RNA, 64 nt, Homo Sapiens
guaauuguauaacugggagcauauuccugugcccauauuuuaauuagauauacaaucuggaaaa

SEQ ID NO: 712521 - RNA, 64 nt, Homo Sapiens
ugggacaaaaauuguucaucggacuuugcuuugaauauuuuagaguucuagagucagaacaggu

SEQ ID NO: 712522 - RNA, 64 nt, Homo Sapiens
ugaauacugauaaacauuuuucuuuccauuuaagauauuuuauuuaaccauguucuuuccuguc

SEQ ID NO: 712523 - RNA, 64 nt, Homo Sapiens
uuuaauauauuaacuuuguguuguuuuacuguguauauuuuauuucugaacaucuggaugccug

SEQ ID NO: 712524 - RNA, 64 nt, Homo Sapiens
uuuacagauuuuacuacaugcaaaccagacuuuuauauuuuaauacuuggccaacugauguuua

SEQ ID NO: 712525 - RNA, 64 nt, Homo Sapiens
uguuuuaaggaugcuucuaaagcuuuuuugagguauauuuuaaaauuguuguuguugaaagucc

SEQ ID NO: 712526 - RNA, 64 nt, Homo Sapiens
ugcuuguauacacaacagcuaagguuuagccuucauauuuuaauggcauucuguagguuuauag

SEQ ID NO: 712527 - RNA, 64 nt, Homo Sapiens
cuuuuauguugguuuuaaaagguaaaugcuuaccauauuuuauaauugagaacucuuacauagu

SEQ ID NO: 712528 - RNA, 64 nt, Homo Sapiens
gcaacuuuuuaggaauaccucuuuauacgucuacauauuuuaguauauaaaaauagauaaugcu

SEQ ID NO: 712529 - RNA, 64 nt, Homo Sapiens
cugcucuuucaaauaacucuaaugaauauucaagauauuuuagccuuuuaaaaaguugagauuu

SEQ ID NO: 712530 - RNA, 64 nt, Homo Sapiens
aacaugccuaauguuuucuuaaugaugacaacaaauauuuuaaaacugcauuuaucauuuuuua

SEQ ID NO: 712531 - RNA, 64 nt, Homo Sapiens
gaaauauaaauucuaaauuauauuuguuauaacuauauuuuauguuguauguuaucaggagcca

SEQ ID NO: 712532 - RNA, 64 nt, Homo Sapiens
cuuacuuuugcuccuuuauacagaauuauuaacuauauuuuacuaacuaaaaaacucuaguauu

SEQ ID NO: 712533 - RNA, 64 nt, Homo Sapiens
caggugugagccaccaugccuggccugcuuugacauauuuuauaguguguuaauuacaaauagu

SEQ ID NO: 712534 - RNA, 64 nt, Homo Sapiens
aagauuuaauacagugcuuuuuuuccucuuugaaauauuuuacuuuaauaccagugccuuuucu

SEQ ID NO: 712535 - RNA, 64 nt, Homo Sapiens
ccuuauccacauagccugaggguaauuuuauacgauauuuuaaauaguuguguacaugaagcau

SEQ ID NO: 712536 - RNA, 64 nt, Homo Sapiens
uaaugcacuuuuuauuuuauaauuuuguauugaaauauuuuagaaauguugauuaauuuuggug

SEQ ID NO: 712537 - RNA, 64 nt, Homo Sapiens
uacuugaaucuuugugggguacagguugaucuuuauauuuuacugguuguuuuaaaaauucuag

SEQ ID NO: 712538 - RNA, 64 nt, Homo Sapiens
auuacaauuuuaacaaauguaaguuauuuuuuuaauauuuuaaggucauaucuguguguuugua

SEQ ID NO: 712539 - RNA, 64 nt, Homo Sapiens
aaucugucucucuuuucuucgcuaaagaauccaaauauuuuaaauuuuuuuaauuuccauaugg

SEQ ID NO: 712540 - RNA, 64 nt, Homo Sapiens
gauuaugaaguauucauuaucuuuuuucauauaaauauuuuacagaccccuaauuauuuuguau

SEQ ID NO: 712541 - RNA, 64 nt, Homo Sapiens
aauacuuuuauauaaaaugcaaauuaaaauuaguauauuuuacuacuuaauuucauuuauaagu

SEQ ID NO: 712542 - RNA, 64 nt, Homo Sapiens
uauagcauguuuguguaaugucuuuauaauaaaaauauuuuaauucuugaauaauuauaauuau

SEQ ID NO: 712543 - RNA, 64 nt, Homo Sapiens
auaaugagagauggaggaaaaauccaucucaagcauauuuuaaauuccucuuauuaauacuaua

SEQ ID NO: 712544 - RNA, 64 nt, Homo Sapiens
gcuucuguuuucucaguuguauuuuaaaauguaaauauuuuaucccaaaaaaucacacaaauau

SEQ ID NO: 712545 - RNA, 64 nt, Homo Sapiens
auguaaauauuuuaucgcuuaaaaucacacaaauauauuuuaaagcucuuuuauaaccccccaa

SEQ ID NO: 712546 - RNA, 64 nt, Homo Sapiens
aagaaacuguuucaaaaauauuagugaccacaaaauauuuuauugaguuuauuaguacaugggc

SEQ ID NO: 712547 - RNA, 64 nt, Homo Sapiens
cuuuuguucuuuaauaugcuagcuggcuuccuagauauuuuaaauuuuagagaagauggccacc

SEQ ID NO: 712548 - RNA, 64 nt, Homo Sapiens
uucagaaaugaaguuuuuaauuguucauauguaaauauuuuacuuguaaauuuugcacaguuac

SEQ ID NO: 712549 - RNA, 64 nt, Homo Sapiens
ugcacuguguuuuuuagcuauuuucagcauaaauauauuuuacuaguuaaaagagaugaaaacc

SEQ ID NO: 712550 - RNA, 64 nt, Homo Sapiens
cucuugugaauuuggaucuuuuuacuuugagcauauauuuuagaauauguguauguuaaaggau

SEQ ID NO: 712551 - RNA, 64 nt, Homo Sapiens
ucuaugcaauucccauaugguuuuuuuuuaaaucauauuuuauucauuuucucccuuuagcaau

SEQ ID NO: 712552 - RNA, 64 nt, Homo Sapiens
gccugcagaaguuuaauaauuugacuuuuuucuaauauuuuaguuugaaagaaaauuucuuccc

SEQ ID NO: 712553 - RNA, 64 nt, Homo Sapiens
uuucaguuauaaaacaucuauuuugaaucuguaaauauuuuaaauguuuuauuaaggcauguaa

SEQ ID NO: 712554 - RNA, 64 nt, Homo Sapiens
aacaaugcaauaaaaccacuaaacuuuuguguccauauuuuacugagaccauguuucauuaaaa

SEQ ID NO: 712555 - RNA, 64 nt, Homo Sapiens
auuguaauuaauuuugaaaaauauucauguaaauauauuuuaggcaacucauuagcuagugaag

SEQ ID NO: 712556 - RNA, 64 nt, Homo Sapiens
aguuaacuuccuauucuuucuccaaaauuccacaauauuuuaguauucuuucacuugaaaaaac

SEQ ID NO: 712557 - RNA, 64 nt, Homo Sapiens
uuuccccuucuuugaaaagguagaagagaaaggaauauuuuaaaccuuuuuggcuuaaacagaa

SEQ ID NO: 712558 - RNA, 64 nt, Homo Sapiens
auauguccacccauugauuuuuaaagcuuuugugauauuuuagcauuuugaaagacuuucacag

SEQ ID NO: 712559 - RNA, 64 nt, Homo Sapiens
cagaaagugguuuagacauucuugauuaguuuccauauuuuaaguagcugcagucuuucauguu

SEQ ID NO: 712560 - RNA, 64 nt, Homo Sapiens
guuuucaacguuuacauucaauccaagccuuuguauauuuuagagcugugcaacacuuuaaguc

SEQ ID NO: 712561 - RNA, 64 nt, Homo Sapiens
uuuauguguuuauucuuuauauagauaguauuuuauauuuuauucucacccgaaguauucacac

SEQ ID NO: 712562 - RNA, 64 nt, Homo Sapiens
gguguuuacauaaauacuauguuuuacaguuuucauauuuuaaaauauuaauaaaguuaaauca

SEQ ID NO: 712563 - RNA, 64 nt, Homo Sapiens
uaacauuauauugauuguguuccccucaagcaucauauuuuacauuuuuuuaucaucuuuuaaa

SEQ ID NO: 712564 - RNA, 64 nt, Homo Sapiens
acuuuugugaccacuauuuuagaaacuuuauuuaauauuuuaauguuuucagucauugcuuugg

SEQ ID NO: 712565 - RNA, 64 nt, Homo Sapiens
uuucaaaaaauacugccguuacugucuuuuaugcauauuuuagccugaaauuuugaagcgucuu

SEQ ID NO: 712566 - RNA, 64 nt, Homo Sapiens
uguagaaauguguaucgcaaauguaagcacuggaauauuuuauuaucuuaaaaacucaggauug

SEQ ID NO: 712567 - RNA, 64 nt, Homo Sapiens
uuaaaaacucaggauugaugauuguaaguagugcauauuuuaucuccaaaauaauauuguggua

SEQ ID NO: 712568 - RNA, 64 nt, Homo Sapiens
auauuaauaaaguuaaucgcguuuuacaguuuucauauuuuaaagguguuuacauaaauacuau

SEQ ID NO: 712569 - RNA, 64 nt, Homo Sapiens
agaauugcagaacuguaguacaguucccauaaaaauauuuuaucagcaguuuuuguuuuguaga

SEQ ID NO: 712570 - RNA, 64 nt, Homo Sapiens
cuuaaaucuucagugauuccugauaccucugauaauauuuuauuaagauuauaguuauuaauau

SEQ ID NO: 712571 - RNA, 64 nt, Homo Sapiens
aaauaccaacuguucuauauucauuugcuugaagauauuuuacaagacuaacagaugaagucuc

SEQ ID NO: 712572 - RNA, 64 nt, Homo Sapiens
augugaaugguuuuguuuuuuuuguguuaaggauauauuuuauuagaauauguuauacccuuau

SEQ ID NO: 712573 - RNA, 64 nt, Homo Sapiens
caacucuuuuuaucuauaauugaaauguuacagcauauuuuaagcauucuaauuauauuuuaaa

SEQ ID NO: 712574 - RNA, 64 nt, Homo Sapiens
ugaaauguuacagcauauuucagacauucuaauuauauuuuaaauuaauaauuucaauguggac

SEQ ID NO: 712575 - RNA, 64 nt, Homo Sapiens
aggcccccaaaauuuaauaguugaauaaucaaaaauauuuuauugauuugugauuuaaugacag

SEQ ID NO: 712576 - RNA, 64 nt, Homo Sapiens
agauuuuguaaagucaguaaaauggaacuuuaaaauauuuuaguuuaaauguauuaauagaguc

SEQ ID NO: 712577 - RNA, 64 nt, Homo Sapiens
gcauucuaguauuuuuguguaaauguguagcuuuauauuuuauguuuacaaugcuuucuaccug

SEQ ID NO: 712578 - RNA, 64 nt, Homo Sapiens
augcuuucuaccugaaaugucuugcauauuuuauauauuuuacaaaucucuuugguuuugauuu

SEQ ID NO: 712579 - RNA, 64 nt, Homo Sapiens
uauuuuacaaugcuuucuacuuuugauuucuugcauauuuuauaucuaagaaaaaucucuuugg

SEQ ID NO: 712580 - RNA, 64 nt, Homo Sapiens; identical to SEQ ID NO: 120942

SEQ ID NO: 712581 - RNA, 64 nt, Homo Sapiens; identical to SEQ ID NO: 120943

SEQ ID NO: 712582 - RNA, 64 nt, Homo Sapiens; identical to SEQ ID NO: 120944

SEQ ID NO: 712583 - RNA, 64 nt, Homo Sapiens; identical to SEQ ID NO: 120945

SEQ ID NO: 712584 - RNA, 64 nt, Homo Sapiens; identical to SEQ ID NO: 120946

SEQ ID NO: 712585 - RNA, 64 nt, Homo Sapiens; identical to SEQ ID NO: 120947

SEQ ID NO: 712586 - RNA, 64 nt, Homo Sapiens; identical to SEQ ID NO: 120948

SEQ ID NO: 712587 - RNA, 64 nt, Homo Sapiens; identical to SEQ ID NO: 120949

SEQ ID NO: 712588 - RNA, 64 nt, Homo Sapiens; identical to SEQ ID NO: 120950

SEQ ID NO: 712589 - RNA, 64 nt, Homo Sapiens; identical to SEQ ID NO: 120951

SEQ ID NO: 712590 - RNA, 64 nt, Homo Sapiens; identical to SEQ ID NO: 120952

SEQ ID NO: 712591 - RNA, 64 nt, Homo Sapiens; identical to SEQ ID NO: 120953

SEQ ID NO: 712592 - RNA, 64 nt, Homo Sapiens; identical to SEQ ID NO: 120954

SEQ ID NO: 712593 - RNA, 64 nt, Homo Sapiens; identical to SEQ ID NO: 120955

SEQ ID NO: 712594 - RNA, 64 nt, Homo Sapiens; identical to SEQ ID NO: 120956

SEQ ID NO: 712595 - RNA, 64 nt, Homo Sapiens; identical to SEQ ID NO: 120957

SEQ ID NO: 712596 - RNA, 64 nt, Homo Sapiens; identical to SEQ ID NO: 120958

SEQ ID NO: 712597 - RNA, 64 nt, Homo Sapiens; identical to SEQ ID NO: 120959

SEQ ID NO: 712598 - RNA, 64 nt, Homo Sapiens; identical to SEQ ID NO: 120960

SEQ ID NO: 712599 - RNA, 64 nt, Homo Sapiens; identical to SEQ ID NO: 120961

SEQ ID NO: 712600 - RNA, 64 nt, Homo Sapiens; identical to SEQ ID NO: 120962

SEQ ID NO: 712601 - RNA, 64 nt, Homo Sapiens; identical to SEQ ID NO: 120963

SEQ ID NO: 712602 - RNA, 64 nt, Homo Sapiens; identical to SEQ ID NO: 120964

SEQ ID NO: 712603 - RNA, 62 nt, Homo Sapiens; identical to SEQ ID NO: 120965

SEQ ID NO: 712604 - RNA, 64 nt, Homo Sapiens; identical to SEQ ID NO: 120966

SEQ ID NO: 712605 - RNA, 64 nt, Homo Sapiens; identical to SEQ ID NO: 120967

SEQ ID NO: 712606 - RNA, 64 nt, Homo Sapiens; identical to SEQ ID NO: 120968

SEQ ID NO: 712607 - RNA, 64 nt, Homo Sapiens; identical to SEQ ID NO: 120969

SEQ ID NO: 712608 - RNA, 64 nt, Homo Sapiens; identical to SEQ ID NO: 120970

SEQ ID NO: 712609 - RNA, 64 nt, Homo Sapiens; identical to SEQ ID NO: 120971

SEQ ID NO: 712610 - RNA, 63 nt, Homo Sapiens
uuguaauucucauuauauaucucuuauuucuuucagggguaucuuuccauuuguuugugacau

SEQ ID NO: 712611 - RNA, 63 nt, Homo Sapiens
ugugcagguuuguuacauaguuuauuuuagauucagggguauaaauuuuuaauuuuuuuaacu

SEQ ID NO: 712612 - RNA, 63 nt, Homo Sapiens
acuaccaccuggccuagccuaggacuuuaucagcagggguaaauaggaacuauuaggaauguc

SEQ ID NO: 712613 - RNA, 63 nt, Homo Sapiens
gguauugauuaaagacggcuuccuagauaccaacagggguacaucaaaagcaagcuaguuacu

SEQ ID NO: 712614 - RNA, 63 nt, Homo Sapiens
uucuggccccaacccuugaccaaugcaccuuugcagggguaccagcugcaugcaccacagggg

SEQ ID NO: 712615 - RNA, 63 nt, Homo Sapiens
accccagcugcuugagagaacagaugaccuuuucagggguaacggacacuguggagcucugcc

SEQ ID NO: 712616 - RNA, 64 nt, Homo Sapiens
aguagacucugcucccuagcccugagcaggaggcugggagcagcucuguuuccuaauucaggac

SEQ ID NO: 712617 - RNA, 64 nt, Homo Sapiens
ugguccaagaggcuaccugcuccaaggcggagggugggagcaggugugccagggcucagggcuc

SEQ ID NO: 712618 - RNA, 64 nt, Homo Sapiens
uuuaccccugaguuccuuacuguucccccaagccugggagcagucuaucccccaacccugccau

SEQ ID NO: 712619 - RNA, 64 nt, Homo Sapiens
agaaacccaugaaaaggaggccacaggagauuccugggagcacuggguguagcaaaacaaagcc

SEQ ID NO: 712620 - RNA, 64 nt, Homo Sapiens
gccuauuuaugguuauucguuuuaguaaguucugugggagcaagguauuuaaaaucaaaacuaa

SEQ ID NO: 712621 - RNA, 64 nt, Homo Sapiens
guacugggaaaccccagaccacaguacugggaaaugggagcauauaguacugggaaaugggagc

SEQ ID NO: 712622 - RNA, 64 nt, Homo Sapiens
guacugggaaaugggagcauauaguacugggaaaugggagcacacaguacucggaaaugggagc

SEQ ID NO: 712623 - RNA, 64 nt, Homo Sapiens
guacugggaaaugggagcacacaguacucggaaaugggagcauaguacugggaaaggggaguuc

SEQ ID NO: 712624 - RNA, 64 nt, Homo Sapiens
guacugggaaaugggagcccacaguacugggaaaugggagcacaguacugagaaaugggagcac

SEQ ID NO: 712625 - RNA, 64 nt, Homo Sapiens
caguacugggaaaugggagcacaguacugagaaaugggagcacacaguacugggaaaugggcau

SEQ ID NO: 712626 - RNA, 64 nt, Homo Sapiens
guacugggaaaugggcauacacacuacugagaaaugggagcacacaguacugagaaaugggagu

SEQ ID NO: 712627 - RNA, 64 nt, Homo Sapiens
guacugagaaaugggaguacacaguacugagaagugggagcacacaguacugggaagugggagc

SEQ ID NO: 712628 - RNA, 64 nt, Homo Sapiens
guacugagaagugggagcacacaguacugggaagugggagcacacaguauugggaaaugggagc

SEQ ID NO: 712629 - RNA, 64 nt, Homo Sapiens
guacugggaagugggagcacacaguauugggaaaugggagcacacagcacugcaaaaugggagc

SEQ ID NO: 712630 - RNA, 64 nt, Homo Sapiens
guauugggaaaugggagcacacagcacugcaaaaugggagcacaguacugggaaaugggggcuc

SEQ ID NO: 712631 - RNA, 64 nt, Homo Sapiens
guacugggaaaugggggcucacaguacugggaaaugggagcacacaguacuaggaaaugggagc

SEQ ID NO: 712632 - RNA, 64 nt, Homo Sapiens
guacugggaaaugggagcacacaguacuaggaaaugggagcacacaguacugggaaaugggagc

SEQ ID NO: 712633 - RNA, 64 nt, Homo Sapiens
guacuaggaaaugggagcacacaguacugggaaaugggagcacaguuggcucacaccugugagc

SEQ ID NO: 712634 - RNA, 64 nt, Homo Sapiens
cagcuuucccuccucgcuggccugggcacccuccugggagcaggccuuccucccucccaccccc

SEQ ID NO: 712635 - RNA, 64 nt, Homo Sapiens
accucuguccacugcccagggaggggccuggggcugggagcagucccgguuuagccugaggucc

SEQ ID NO: 712636 - RNA, 64 nt, Homo Sapiens
gugaagacccugagagcaucagcacccuggcaccugggagcacaagcacagugaagaccauggg

SEQ ID NO: 712637 - RNA, 56 nt, Homo Sapiens
cuggcaccugggagcacaguagaccaugggagcaccagugucugggagcacaguga

SEQ ID NO: 712638 - RNA, 64 nt, Homo Sapiens
aggagagcuggacucgcucacuccaggaggcccuugggagcauggaacaccgcugccacugugg

SEQ ID NO: 712639 - RNA, 64 nt, Homo Sapiens
ugucuguuguagaaaacaccguaccccaacggucugggagcaccugguguagacggccuggccu

SEQ ID NO: 712640 - RNA, 64 nt, Homo Sapiens
gaugauaagcucuggaagcucuuggcgucuguucugggagcacgaauccggcugggagcaugac

SEQ ID NO: 712641 - RNA, 64 nt, Homo Sapiens
accuuggcgucuguucuggguacgacaauccggcugggagcaugccucaucacggcggcgaggc

SEQ ID NO: 712642 - RNA, 64 nt, Homo Sapiens
ugaacaauuuuguuccauuccagccugugcuaauugggagcacuccauugaaaagcaaguaaua

SEQ ID NO: 712643 - RNA, 64 nt, Homo Sapiens
ugcaggccacagugaaguguauaaaauaggacgcugggagcaguugagaacccaaaucauguuu

SEQ ID NO: 712644 - RNA, 64 nt, Homo Sapiens; identical to SEQ ID NO: 303515

SEQ ID NO: 712645 - RNA, 64 nt, Homo Sapiens; identical to SEQ ID NO: 303516

SEQ ID NO: 712646 - RNA, 64 nt, Homo Sapiens; identical to SEQ ID NO: 303517

SEQ ID NO: 712647 - RNA, 64 nt, Homo Sapiens; identical to SEQ ID NO: 303518

SEQ ID NO: 712648 - RNA, 64 nt, Homo Sapiens; identical to SEQ ID NO: 303519

SEQ ID NO: 712649 - RNA, 64 nt, Homo Sapiens; identical to SEQ ID NO: 303520

SEQ ID NO: 712650 - RNA, 64 nt, Homo Sapiens; identical to SEQ ID NO: 303521

SEQ ID NO: 712651 - RNA, 64 nt, Homo Sapiens; identical to SEQ ID NO: 303522

SEQ ID NO: 712652 - RNA, 64 nt, Homo Sapiens; identical to SEQ ID NO: 303523

SEQ ID NO: 712653 - RNA, 64 nt, Homo Sapiens; identical to SEQ ID NO: 303524

SEQ ID NO: 712654 - RNA, 64 nt, Homo Sapiens; identical to SEQ ID NO: 303525

SEQ ID NO: 712655 - RNA, 64 nt, Homo Sapiens; identical to SEQ ID NO: 303526

SEQ ID NO: 712656 - RNA, 64 nt, Homo Sapiens; identical to SEQ ID NO: 303527

SEQ ID NO: 712657 - RNA, 64 nt, Homo Sapiens; identical to SEQ ID NO: 303528

SEQ ID NO: 712658 - RNA, 64 nt, Homo Sapiens; identical to SEQ ID NO: 200782

SEQ ID NO: 712659 - RNA, 64 nt, Homo Sapiens; identical to SEQ ID NO: 200783

SEQ ID NO: 712660 - RNA, 64 nt, Homo Sapiens; identical to SEQ ID NO: 200784

SEQ ID NO: 712661 - RNA, 64 nt, Homo Sapiens; identical to SEQ ID NO: 200785

SEQ ID NO: 712662 - RNA, 64 nt, Homo Sapiens; identical to SEQ ID NO: 200786

SEQ ID NO: 712663 - RNA, 64 nt, Homo Sapiens; identical to SEQ ID NO: 200787

SEQ ID NO: 712664 - RNA, 64 nt, Homo Sapiens; identical to SEQ ID NO: 200788

SEQ ID NO: 712665 - RNA, 64 nt, Homo Sapiens; identical to SEQ ID NO: 200789

SEQ ID NO: 712666 - RNA, 64 nt, Homo Sapiens; identical to SEQ ID NO: 200790

SEQ ID NO: 712667 - RNA, 64 nt, Homo Sapiens; identical to SEQ ID NO: 200791

SEQ ID NO: 712668 - RNA, 64 nt, Homo Sapiens; identical to SEQ ID NO: 200792

SEQ ID NO: 712669 - RNA, 64 nt, Homo Sapiens; identical to SEQ ID NO: 200793

SEQ ID NO: 712670 - RNA, 64 nt, Homo Sapiens; identical to SEQ ID NO: 200794

SEQ ID NO: 712671 - RNA, 64 nt, Homo Sapiens; identical to SEQ ID NO: 200795

SEQ ID NO: 712672 - RNA, 64 nt, Homo Sapiens; identical to SEQ ID NO: 200796

SEQ ID NO: 712673 - RNA, 64 nt, Homo Sapiens; identical to SEQ ID NO: 200797

SEQ ID NO: 712674 - RNA, 64 nt, Homo Sapiens; identical to SEQ ID NO: 563739

SEQ ID NO: 712675 - RNA, 64 nt, Homo Sapiens; identical to SEQ ID NO: 563740

SEQ ID NO: 712676 - RNA, 64 nt, Homo Sapiens; identical to SEQ ID NO: 563741

SEQ ID NO: 712677 - RNA, 64 nt, Homo Sapiens; identical to SEQ ID NO: 563742

SEQ ID NO: 712678 - RNA, 64 nt, Homo Sapiens; identical to SEQ ID NO: 563743

SEQ ID NO: 712679 - RNA, 64 nt, Homo Sapiens; identical to SEQ ID NO: 563744

SEQ ID NO: 712680 - RNA, 64 nt, Homo Sapiens; identical to SEQ ID NO: 563745

SEQ ID NO: 712681 - RNA, 64 nt, Homo Sapiens; identical to SEQ ID NO: 563746

SEQ ID NO: 712682 - RNA, 64 nt, Homo Sapiens; identical to SEQ ID NO: 563747

SEQ ID NO: 712683 - RNA, 64 nt, Homo Sapiens; identical to SEQ ID NO: 563748

SEQ ID NO: 712684 - RNA, 64 nt, Homo Sapiens; identical to SEQ ID NO: 563749

SEQ ID NO: 712685 - RNA, 64 nt, Homo Sapiens; identical to SEQ ID NO: 563750

SEQ ID NO: 712686 - RNA, 64 nt, Homo Sapiens; identical to SEQ ID NO: 563751

SEQ ID NO: 712687 - RNA, 64 nt, Homo Sapiens; identical to SEQ ID NO: 563752

SEQ ID NO: 712688 - RNA, 64 nt, Homo Sapiens; identical to SEQ ID NO: 563753

SEQ ID NO: 712689 - RNA, 64 nt, Homo Sapiens; identical to SEQ ID NO: 563754

SEQ ID NO: 712690 - RNA, 64 nt, Homo Sapiens; identical to SEQ ID NO: 563755

SEQ ID NO: 712691 - RNA, 64 nt, Homo Sapiens; identical to SEQ ID NO: 563756

SEQ ID NO: 712692 - RNA, 64 nt, Homo Sapiens; identical to SEQ ID NO: 563757

SEQ ID NO: 712693 - RNA, 64 nt, Homo Sapiens; identical to SEQ ID NO: 563758

SEQ ID NO: 712694 - RNA, 64 nt, Homo Sapiens; identical to SEQ ID NO: 563759

SEQ ID NO: 712695 - RNA, 64 nt, Homo Sapiens; identical to SEQ ID NO: 563760

SEQ ID NO: 712696 - RNA, 64 nt, Homo Sapiens; identical to SEQ ID NO: 563761

SEQ ID NO: 712697 - RNA, 64 nt, Homo Sapiens; identical to SEQ ID NO: 563762

SEQ ID NO: 712698 - RNA, 64 nt, Homo Sapiens; identical to SEQ ID NO: 563763

SEQ ID NO: 712699 - RNA, 64 nt, Homo Sapiens; identical to SEQ ID NO: 563764

SEQ ID NO: 712700 - RNA, 64 nt, Homo Sapiens; identical to SEQ ID NO: 563765

SEQ ID NO: 712701 - RNA, 64 nt, Homo Sapiens; identical to SEQ ID NO: 563766

SEQ ID NO: 712702 - RNA, 64 nt, Homo Sapiens; identical to SEQ ID NO: 563767

SEQ ID NO: 712703 - RNA, 64 nt, Homo Sapiens; identical to SEQ ID NO: 563768

SEQ ID NO: 712704 - RNA, 64 nt, Homo Sapiens; identical to SEQ ID NO: 563769

SEQ ID NO: 712705 - RNA, 64 nt, Homo Sapiens; identical to SEQ ID NO: 563770

SEQ ID NO: 712706 - RNA, 64 nt, Homo Sapiens; identical to SEQ ID NO: 563771

SEQ ID NO: 712707 - RNA, 64 nt, Homo Sapiens; identical to SEQ ID NO: 563772

SEQ ID NO: 712708 - RNA, 64 nt, Homo Sapiens; identical to SEQ ID NO: 563773

SEQ ID NO: 712709 - RNA, 64 nt, Homo Sapiens; identical to SEQ ID NO: 563774

SEQ ID NO: 712710 - RNA, 64 nt, Homo Sapiens; identical to SEQ ID NO: 563775

SEQ ID NO: 712711 - RNA, 64 nt, Homo Sapiens; identical to SEQ ID NO: 563776

SEQ ID NO: 712712 - RNA, 64 nt, Homo Sapiens; identical to SEQ ID NO: 563777

SEQ ID NO: 712713 - RNA, 64 nt, Homo Sapiens; identical to SEQ ID NO: 563778

SEQ ID NO: 712714 - RNA, 64 nt, Homo Sapiens; identical to SEQ ID NO: 563779

SEQ ID NO: 712715 - RNA, 64 nt, Homo Sapiens; identical to SEQ ID NO: 563780

SEQ ID NO: 712716 - RNA, 64 nt, Homo Sapiens; identical to SEQ ID NO: 563781

SEQ ID NO: 712717 - RNA, 64 nt, Homo Sapiens; identical to SEQ ID NO: 563782

SEQ ID NO: 712718 - RNA, 64 nt, Homo Sapiens; identical to SEQ ID NO: 563783

SEQ ID NO: 712719 - RNA, 64 nt, Homo Sapiens; identical to SEQ ID NO: 563784

SEQ ID NO: 712720 - RNA, 64 nt, Homo Sapiens; identical to SEQ ID NO: 563785

SEQ ID NO: 712721 - RNA, 64 nt, Homo Sapiens; identical to SEQ ID NO: 563786

SEQ ID NO: 712722 - RNA, 64 nt, Homo Sapiens; identical to SEQ ID NO: 563787

SEQ ID NO: 712723 - RNA, 64 nt, Homo Sapiens; identical to SEQ ID NO: 563788

SEQ ID NO: 712724 - RNA, 64 nt, Homo Sapiens; identical to SEQ ID NO: 563789

SEQ ID NO: 712725 - RNA, 64 nt, Homo Sapiens; identical to SEQ ID NO: 563790

SEQ ID NO: 712726 - RNA, 64 nt, Homo Sapiens; identical to SEQ ID NO: 563791

SEQ ID NO: 712727 - RNA, 64 nt, Homo Sapiens; identical to SEQ ID NO: 563792

SEQ ID NO: 712728 - RNA, 64 nt, Homo Sapiens; identical to SEQ ID NO: 563793

SEQ ID NO: 712729 - RNA, 64 nt, Homo Sapiens; identical to SEQ ID NO: 563794

SEQ ID NO: 712730 - RNA, 64 nt, Homo Sapiens; identical to SEQ ID NO: 563795

SEQ ID NO: 712731 - RNA, 64 nt, Homo Sapiens; identical to SEQ ID NO: 563796

SEQ ID NO: 712732 - RNA, 64 nt, Homo Sapiens; identical to SEQ ID NO: 563797

SEQ ID NO: 712733 - RNA, 64 nt, Homo Sapiens; identical to SEQ ID NO: 563798

SEQ ID NO: 712734 - RNA, 64 nt, Homo Sapiens; identical to SEQ ID NO: 563799

SEQ ID NO: 712735 - RNA, 64 nt, Homo Sapiens; identical to SEQ ID NO: 563800

SEQ ID NO: 712736 - RNA, 64 nt, Homo Sapiens; identical to SEQ ID NO: 563801

SEQ ID NO: 712737 - RNA, 64 nt, Homo Sapiens; identical to SEQ ID NO: 563802

SEQ ID NO: 712738 - RNA, 64 nt, Homo Sapiens; identical to SEQ ID NO: 563803

SEQ ID NO: 712739 - RNA, 64 nt, Homo Sapiens; identical to SEQ ID NO: 563803

SEQ ID NO: 712740 - RNA, 64 nt, Homo Sapiens; identical to SEQ ID NO: 563803

SEQ ID NO: 712741 - RNA, 64 nt, Homo Sapiens; identical to SEQ ID NO: 563803

SEQ ID NO: 712742 - RNA, 64 nt, Homo Sapiens; identical to SEQ ID NO: 563807

SEQ ID NO: 712743 - RNA, 64 nt, Homo Sapiens; identical to SEQ ID NO: 563808

SEQ ID NO: 712744 - RNA, 64 nt, Homo Sapiens; identical to SEQ ID NO: 563809

SEQ ID NO: 712745 - RNA, 64 nt, Homo Sapiens; identical to SEQ ID NO: 563810

SEQ ID NO: 712746 - RNA, 64 nt, Homo Sapiens; identical to SEQ ID NO: 563811

SEQ ID NO: 712747 - RNA, 64 nt, Homo Sapiens; identical to SEQ ID NO: 563812

SEQ ID NO: 712748 - RNA, 64 nt, Homo Sapiens; identical to SEQ ID NO: 563813

SEQ ID NO: 712749 - RNA, 64 nt, Homo Sapiens; identical to SEQ ID NO: 563814

SEQ ID NO: 712750 - RNA, 64 nt, Homo Sapiens; identical to SEQ ID NO: 563815

SEQ ID NO: 712751 - RNA, 64 nt, Homo Sapiens; identical to SEQ ID NO: 563816

SEQ ID NO: 712752 - RNA, 64 nt, Homo Sapiens; identical to SEQ ID NO: 563817

SEQ ID NO: 712753 - RNA, 64 nt, Homo Sapiens; identical to SEQ ID NO: 332610

SEQ ID NO: 712754 - RNA, 64 nt, Homo Sapiens; identical to SEQ ID NO: 332611

SEQ ID NO: 712755 - RNA, 64 nt, Homo Sapiens; identical to SEQ ID NO: 332612

SEQ ID NO: 712756 - RNA, 64 nt, Homo Sapiens; identical to SEQ ID NO: 332613

SEQ ID NO: 712757 - RNA, 64 nt, Homo Sapiens; identical to SEQ ID NO: 332614

SEQ ID NO: 712758 - RNA, 64 nt, Homo Sapiens; identical to SEQ ID NO: 332615

SEQ ID NO: 712759 - RNA, 64 nt, Homo Sapiens; identical to SEQ ID NO: 332616

SEQ ID NO: 712760 - RNA, 64 nt, Homo Sapiens; identical to SEQ ID NO: 332617

SEQ ID NO: 712761 - RNA, 64 nt, Homo Sapiens; identical to SEQ ID NO: 332618

SEQ ID NO: 712762 - RNA, 64 nt, Homo Sapiens; identical to SEQ ID NO: 332619

SEQ ID NO: 712763 - RNA, 64 nt, Homo Sapiens; identical to SEQ ID NO: 332620

SEQ ID NO: 712764 - RNA, 64 nt, Homo Sapiens; identical to SEQ ID NO: 332621

SEQ ID NO: 712765 - RNA, 64 nt, Homo Sapiens; identical to SEQ ID NO: 332622

SEQ ID NO: 712766 - RNA, 64 nt, Homo Sapiens; identical to SEQ ID NO: 332623

SEQ ID NO: 712767 - RNA, 64 nt, Homo Sapiens
uccucccuccucucuaaauguaguccccucuccuccaucuaaaggcaacauuccuuacccauua

SEQ ID NO: 712768 - RNA, 64 nt, Homo Sapiens
gauuaugaagaaauacuugagcaauuucagaaaaccaucuaagugcuggaggaaccacgcuucc

SEQ ID NO: 712769 - RNA, 64 nt, Homo Sapiens
gucaagcuuguggaaaaagauuuagcaggcuagaccaucuaaguagccauuuucgaacaguaug

SEQ ID NO: 712770 - RNA, 64 nt, Homo Sapiens
uaggcugguagcuucuauguaauucgcaaugauuccaucuaaauaaaaguucuaugaucugcaa

SEQ ID NO: 712771 - RNA, 64 nt, Homo Sapiens
cuacuguaauagaucagcauccaaaagcaggaacccaucuaaaccagaaggaagcccucucaga

SEQ ID NO: 712772 - RNA, 64 nt, Homo Sapiens
uccugcccugccuuccuccugccuguagcccagcccaucuaaauggaagcugggaauugccccu

SEQ ID NO: 712773 - RNA, 64 nt, Homo Sapiens
aacaggaauaagugguagccuugcuuucugagcaccaucuaaagaauuuuaaaccucugcauua

SEQ ID NO: 712774 - RNA, 64 nt, Homo Sapiens
cugcaggccauccugggaguaaagggcugccuucccaucuaauuuauuguaaagucauauaguc

SEQ ID NO: 712775 - RNA, 64 nt, Homo Sapiens
aacccucgacccgaaacccugcgcugagauucuuccaucuaaaauccccauaucccaaggcgaa

SEQ ID NO: 712776 - RNA, 64 nt, Homo Sapiens
ugcagcuuccugucaacacugaguugugaucaucccaucuaagcugugucaucuuguugccaug

SEQ ID NO: 712777 - RNA, 64 nt, Homo Sapiens
cauuaccuuaaaagacauucaaaccuaaacacagccaucuaacuuccaaaguaaauccugaaca

SEQ ID NO: 712778 - RNA, 64 nt, Homo Sapiens
ugcccccucugcccugcgggugacagacagcccuccaucuaaacgguuaguggauggaaggggc

SEQ ID NO: 712779 - RNA, 64 nt, Homo Sapiens
auucaggaauuguagucugagaugaacauggucaccaucuaacuaguuuucauuaauccagaag

SEQ ID NO: 712780 - RNA, 64 nt, Homo Sapiens
aggaaaaguuuguuggaacaguccuugaaagucuccaucuaaagaacaaauuaugccucuuuaa

SEQ ID NO: 712781 - RNA, 64 nt, Homo Sapiens
aaaccugucaggaauacgagagugcaccgcugucccaucuaaagacccuuccccgugcucagac

SEQ ID NO: 712782 - RNA, 64 nt, Homo Sapiens
uguaaaaucucuguuguggugggcauagguggcaccaucuaaagaaaagaggucuuguuuuuug

SEQ ID NO: 712783 - RNA, 64 nt, Homo Sapiens
gaauagcugggacuagaagcaugcaccaccaugcccaucuaauauuuguauuuuuaguagagac

SEQ ID NO: 712784 - RNA, 64 nt, Homo Sapiens
uuuaucccgaucuccuggaaggcuguugugauuuccaucuaagaaaugagggucuugagaauca

SEQ ID NO: 712785 - RNA, 52 nt, Homo Sapiens
cugaagauaauuuacagugaccccaucuaaauaaaauacugcuuuugcaaac

SEQ ID NO: 712786 - RNA, 64 nt, Homo Sapiens
guucaaauauauaagagccaaacucuuuuccauuccaucuaaaauguuuucauuuaguacucuu

SEQ ID NO: 712787 - RNA, 64 nt, Homo Sapiens
gcccuuguucuuaggcccgucugcccgccuuccuccaucuaaccuuuccuguuuuauccgcagc

SEQ ID NO: 712788 - RNA, 64 nt, Homo Sapiens
aaaauggaucuggauuacuagaaagauaauucaaccaucuaaucgucuguaaaguguaaccuag

SEQ ID NO: 712789 - RNA, 64 nt, Homo Sapiens
uuugcuuagucuacaucucauaaaaugugcuucuccaucuaaaucuuuuaaguuauuaauuuuu

SEQ ID NO: 712790 - RNA, 64 nt, Homo Sapiens
cuaugcuggauaugaacuuuucaacaacuaauggccaucuaaugaagguauacuaaauaauaua

SEQ ID NO: 712791 - RNA, 64 nt, Homo Sapiens
uggagugauguuagcagacccucucugccaagauccaucuaaacauccagaggaacaagcaugu

SEQ ID NO: 712792 - RNA, 64 nt, Homo Sapiens
uauuguaauuguuuuggggugccacagacugcauccaucuaagacagugagcuuaguugaugug

SEQ ID NO: 712793 - RNA, 64 nt, Homo Sapiens
ugcagccaccaccuccugagcucaagugauccucccaucuaagcccccaaguagcuaggacuac

SEQ ID NO: 712794 - RNA, 64 nt, Homo Sapiens
gauuagcuggugcuauaggcaugcaccaccacguccaucuaaauuucuuuauuauuuguagaga

SEQ ID NO: 712795 - RNA, 64 nt, Homo Sapiens
aguuaaaaaaaaacccacuaugcuauaaguuaggccaucuaaaacagauuauuaaagagguuca

SEQ ID NO: 712796 - RNA, 64 nt, Homo Sapiens
cuguaucaucugcuguggucacuaccuggcagcaccaucuaaacacuuuucuucucuuugaggc

SEQ ID NO: 712797 - RNA, 64 nt, Homo Sapiens
uuccuucaucauccuggaagccaggauaaucucuccaucuaaagacaaagcccaccaggaagau

SEQ ID NO: 712798 - RNA, 64 nt, Homo Sapiens
cugggcuguacauguggauaugauuuccagggugccaucuaaucccuagccaggaauacccauu

SEQ ID NO: 712799 - RNA, 64 nt, Homo Sapiens
acucugugguuuauuauuaauuuuuuuccuguuaccaucuaagaagaauugcaaccggaaccau

SEQ ID NO: 712800 - RNA, 64 nt, Homo Sapiens
aaucccuuucuguaugucugcuagugacacagccccaucuaaaguccacagugaagaugguuga

SEQ ID NO: 712801 - RNA, 64 nt, Homo Sapiens
acucuucaaacuccacuuguuuuauguauccaucccaucuaaaauuuguuuagcauuucaagcu

SEQ ID NO: 712802 - RNA, 64 nt, Homo Sapiens
cacaauuaaaauuaggcuacauuuuagcuuuugcccaucuaaaguuagucgucuuuccuacaac

SEQ ID NO: 712803 - RNA, 64 nt, Homo Sapiens
acuaccuuguacccccaucaaaaucccaccugaaccaucuaauccuauaaacauaaagggguaa

SEQ ID NO: 712804 - RNA, 64 nt, Homo Sapiens
ccuggguugggaguuagugcauaucaucagcccuccaucuaaugugauugcuaagaugugcagg

SEQ ID NO: 712805 - RNA, 64 nt, Homo Sapiens
cacauuaucuaaaccauuuuguaguuccaaaaacccaucuaaauuucuugaguuccugaauuuu

SEQ ID NO: 712806 - RNA, 64 nt, Homo Sapiens
cauaagcuucucaaaugcaauuuguugauucugcccaucuaaguuguccucaggcgguuucauc

SEQ ID NO: 712807 - RNA, 64 nt, Homo Sapiens
uugcuuuugaccaucaccucagauggugugaaaaccaucuaaguucccuuugagucaugaugac

SEQ ID NO: 712808 - RNA, 64 nt, Homo Sapiens
uuaugcaaaaaaaaauguuuuuguccuugugaguccaucuaacaucauaauuaaucauguggcu

SEQ ID NO: 712809 - RNA, 64 nt, Homo Sapiens
gaugauugauuagugccucuuucugcaaacuuuuccaucuaaaaaaaaaaauguuuuuuuuaag

SEQ ID NO: 712810 - RNA, 64 nt, Homo Sapiens
guuaugcuggauuccacagugaaaucauuuaaaaccaucuaaauaaaccacuauauauuuuaug

SEQ ID NO: 712811 - RNA, 64 nt, Homo Sapiens
aacuuaagggaagccggcaucgguguuugguuucccaucuaaucacagccucacacuugaaaga

SEQ ID NO: 712812 - RNA, 64 nt, Homo Sapiens
ucaugcuagucuaaaccauguugggaugaaaggaccaucuaaaacuugaauccauuagccaggc

SEQ ID NO: 712813 - RNA, 64 nt, Homo Sapiens
gcggguuacuuucacauacacauccuuaaaggcaccaucuaauaagacaggaagguggugcuua

SEQ ID NO: 712814 - RNA, 64 nt, Homo Sapiens
ggcuuuuacuucuuuuuuauauguaaauaauaagccaucuaaguguaaaaguggcucauaucuu

SEQ ID NO: 712815 - RNA, 64 nt, Homo Sapiens
uaagccacccggcuaccuaauuccucaguaaccuccaucuaaaaucuccaaggaagcaauaaau

SEQ ID NO: 712816 - RNA, 64 nt, Homo Sapiens
gaggaagagauacaucauuuuuuaguauuaaggaccaucuaagacagcucuauuuuuuuuuugc

SEQ ID NO: 712817 - RNA, 64 nt, Homo Sapiens
uggaccuuggauuuuuauuuuggcaauuguaacuccaucuaaucaagaaagaauaaaaguuuau

SEQ ID NO: 712818 - RNA, 64 nt, Homo Sapiens
uagagagcccagaaaucaaccugcacaccuaccgccaucuaaucuucaauagaaaugggcaaug

SEQ ID NO: 712819 - RNA, 64 nt, Homo Sapiens
ugacgaaguuuucugauguggcaaaggauauuucccaucuaauaccaguuucucauuuauauuu

SEQ ID NO: 712820 - RNA, 64 nt, Homo Sapiens
ucuaacuagguccuuucaacccaauuagaaaccaccaucuaaccaaacagccaaacaagcuuaa

SEQ ID NO: 712821 - RNA, 64 nt, Homo Sapiens
uuugcaacuuccuguggccauagcuacacagaguccaucuaauuaccugacacucaagaguggc

SEQ ID NO: 712822 - RNA, 64 nt, Homo Sapiens
uacccaugcugcuuuucugaucuccuccugucccccaucuaaaaacugucaauccauugauuua

SEQ ID NO: 712823 - RNA, 64 nt, Homo Sapiens
uaagacaugccugaaauuugauaaaagcuauacuccaucuaaaauuuacaagaugaaauaauag

SEQ ID NO: 712824 - RNA, 64 nt, Homo Sapiens
augcacguuagaugaagauacaagcaucagcuucccaucuaaagaaaacugaaacccaguccuu

SEQ ID NO: 712825 - RNA, 64 nt, Homo Sapiens
gaauguguuucuuucugguuaaaaaaaggaaaaaccaucuaagaaaauauauauguauguaugu

SEQ ID NO: 712826 - RNA, 61 nt, Homo Sapiens
acgaugacauuuugugcuaaauuugcauauaccaucuaaaauccuuuuuuaaaaaaauuua

SEQ ID NO: 712827 - RNA, 64 nt, Homo Sapiens
uagguacugugcccaggaaggcugggugaagugaccaucuaaauugcaggauggugaaauuauc

SEQ ID NO: 712828 - RNA, 64 nt, Homo Sapiens
caaaaguauuuugaaaaaucauguauacccucacccaucuaaguugauaucuaaaauuuuaucu

SEQ ID NO: 712829 - RNA, 64 nt, Homo Sapiens
auacagaaccaaauuggaucaagauuucaagaagccaucuaagaaucaugaacagguuaaagau

SEQ ID NO: 712830 - RNA, 64 nt, Homo Sapiens
ggucuacagagaacuucaguuacuuguucuagguccaucuaaauaaaucuuaauuuccaaguua

SEQ ID NO: 712831 - RNA, 64 nt, Homo Sapiens
uucucucuccugcuauucugagauugccuuauuuccaucuaacaacaugcuguucucucuguug

SEQ ID NO: 712832 - RNA, 64 nt, Homo Sapiens
acuuguuucuaaggcacugcucugacuaaaauaaccaucuaaccuucaacuauaacugcuguuu

SEQ ID NO: 712833 - RNA, 64 nt, Homo Sapiens
uaugcauguauguaggcaaucaucuauguaucuaccaucuaaucuuugcccuaucauuuauuua

SEQ ID NO: 712834 - RNA, 64 nt, Homo Sapiens
auguaacuucuuucaguuauucuguuauucugguccaucuaaugggguggggaaggcagagauc

SEQ ID NO: 712835 - RNA, 64 nt, Homo Sapiens
uuucuaacacaacaaagugggaccaucucuauucccaucuaagccacucaaauugcugagugcu

SEQ ID NO: 712836 - RNA, 64 nt, Homo Sapiens
auuuaacuuuaaaaacccacuuauugauaccuuaccaucuaaaaugugugauuuuuauagucuc

SEQ ID NO: 712837 - RNA, 64 nt, Homo Sapiens
ucugaaucguaccuggauucugugccuaccugcuccaucuaaagcagaaaacuccacaacuaag

SEQ ID NO: 712838 - RNA, 64 nt, Homo Sapiens
uuuuucuaccaaagaucacagaccagaaaaaguuccaucuaaaauaucaugcccaggaaagcac

SEQ ID NO: 712839 - RNA, 64 nt, Homo Sapiens
uacucaccaaaauauaguuaaggaaugugcuuuuccaucuaaaagcuuauuucuaacuauuagg

SEQ ID NO: 712840 - RNA, 64 nt, Homo Sapiens
uguauaggagcucuuaaaaauuggaaaauaguccccaucuaauagguucugccuucaaggguug

SEQ ID NO: 712841 - RNA, 64 nt, Homo Sapiens
guuaagugucauuucuuuuagggacaguggaugcccaucuaaaagucuugucucacuuuggacu

SEQ ID NO: 712842 - RNA, 64 nt, Homo Sapiens
caggauucccucacucuuuucccaccuaaacuauccaucuaaucuuuaguuauuccuuucuuua

SEQ ID NO: 712843 - RNA, 64 nt, Homo Sapiens
ccagcguuuauucuuuuuuccuuuuuucagaucaccaucuaaguuacaucuuuagcucaggucc

SEQ ID NO: 712844 - RNA, 64 nt, Homo Sapiens
gaaaacacacaaauugaaaagcaaacccuuucaaccaucuaaauaaauugggaaacaguuguua

SEQ ID NO: 712845 - RNA, 64 nt, Homo Sapiens
cauuuuucauaucucaacuaacucagaauguuauccaucuaaagugcugugacuaauccaauau

SEQ ID NO: 712846 - RNA, 64 nt, Homo Sapiens
caguaaggagaaacagagagggaagacaugauaaccaucuaaucuggaaggcugggaaacuccu

SEQ ID NO: 712847 - RNA, 64 nt, Homo Sapiens
gcacuguuuuuuuuuuuuuggaaggucugcuccaccaucuaagagaguaagaccuguuguuuug

SEQ ID NO: 712848 - RNA, 64 nt, Homo Sapiens
ggugcuuugcaaaugucuuguauggcccagucccccaucuaaguucaguuucuuagggauggac

SEQ ID NO: 712849 - RNA, 64 nt, Homo Sapiens
gagcgggugcuacacccggcaagacagagcgucuccaucuaaaauuccuagggcaagcuuccaa

SEQ ID NO: 712850 - RNA, 64 nt, Homo Sapiens
uaccacuuaccuaugagguaaugcuuguuaucuuccaucuaauaaaaaucugcugcagaugugu

SEQ ID NO: 712851 - RNA, 64 nt, Homo Sapiens
aauguuucucaacugguuucuacugagcaaaauaccaucuaaaaggagaaugugaauaguugua

SEQ ID NO: 712852 - RNA, 64 nt, Homo Sapiens
aaaaggucuuuaaaauauuguugaacacuugaagccaucuaaaguaaaaagggaauuaugaguu

SEQ ID NO: 712853 - RNA, 64 nt, Homo Sapiens
cguuuucaagugcaugauuuggacagagcuuacuccaucuaacuuugccgcagcacaaucccgu

SEQ ID NO: 712854 - RNA, 64 nt, Homo Sapiens
gaagcuccaggggcuccuucuggaccaaguccuuccaucuaauaaaugccguagugacuugcug

SEQ ID NO: 712855 - RNA, 64 nt, Homo Sapiens
agcaggcucccagaguccccgaggcucaacuccuccaucuaaccggcagaaccuggagguguca

SEQ ID NO: 712856 - RNA, 64 nt, Homo Sapiens
aacacugggaggcacagcagguguucauaaauucccaucuaagaaggcaccaccaacuagacau

SEQ ID NO: 712857 - RNA, 64 nt, Homo Sapiens
uuguugcuuaaucccugcagcauucaagguuaauccaucuaagugacauuuuugaaauuccagc

SEQ ID NO: 712858 - RNA, 64 nt, Homo Sapiens
cuguuuuagauuuuuuuuuuuuuuccuuuucuagccaucuaaauugacucuuccaauauagguc

SEQ ID NO: 712859 - RNA, 64 nt, Homo Sapiens
uuuugccaaauacacugacauuuaaaauagugauccaucuaaauuuuuuucagcuggguuuuga

SEQ ID NO: 712860 - RNA, 64 nt, Homo Sapiens
ugccacuguggaaacagguucuagauuucauacuccaucuaaagucauuuuucaguuacaugua

SEQ ID NO: 712861 - RNA, 64 nt, Homo Sapiens
ucuuuuacuuuauacucacuuaaaaucaagaaucccaucuaaaacacauagguaccuuaucuga

SEQ ID NO: 712862 - RNA, 64 nt, Homo Sapiens
ucugcauaccccccgccccccaacguguagcucuccaucuaaguuuuggauaaacugaaguggc

SEQ ID NO: 712863 - RNA, 64 nt, Homo Sapiens
ugugcaguggucuaccucuuuacuuuuaauuuggccaucuaaaccaaacagcaauuugauucug

SEQ ID NO: 712864 - RNA, 64 nt, Homo Sapiens
cuauguuuuguggcuucccgcaaucauuuuuuacccaucuaacuauauuucccaguacuuuuca

SEQ ID NO: 712865 - RNA, 64 nt, Homo Sapiens
ggaggacauugguuugggggcucuuuggggaagcccaucuaacacagcugccaucuuagaugug

SEQ ID NO: 712866 - RNA, 64 nt, Homo Sapiens
ugcuugcuaggcucaauuacaugaggaauguaguccaucuaaacgagaucucuccucagcugga

SEQ ID NO: 712867 - RNA, 64 nt, Homo Sapiens
agacgagcagugaaaaccuuccuaaagugcacuaccaucuaagacgucuuuucagucuacucua

SEQ ID NO: 712868 - RNA, 64 nt, Homo Sapiens
agcuuguggccaaaccagcauuuacuaaaaguaaccaucuaaagaugccaggaugaaugaagag

SEQ ID NO: 712869 - RNA, 64 nt, Homo Sapiens
uuucuuccagggaaugccagcaccacggaaccuuccaucuaagacagacaaugccauuucuccc

SEQ ID NO: 712870 - RNA, 64 nt, Homo Sapiens
augugucagcuauucuaaauuacucauuucagucccaucuaaaaacaucuuggagaaccuuucu

SEQ ID NO: 712871 - RNA, 64 nt, Homo Sapiens
aauugagaaucuaaaccaagagaagugagacaaaccaucuaauaucuguaucaugcuauuaaua

SEQ ID NO: 712872 - RNA, 64 nt, Homo Sapiens
auaaaagaguggaagcccuacaucaaugaguuaaccaucuaaaagcuauauggcaaauagguau

SEQ ID NO: 712873 - RNA, 64 nt, Homo Sapiens
uuuuauuucguuuuuguuuugauccagugcucucccaucuaacaacuaaacaggagccauuuca

SEQ ID NO: 712874 - RNA, 64 nt, Homo Sapiens
gcgaccugcugagggcuugucugcucccacagcaccaucuaagaccccuccucuagaagugggg

SEQ ID NO: 712875 - RNA, 64 nt, Homo Sapiens
ccagacuguuuuacaagagagaaauuagcauauuccaucuaauacaguaugauguaacuaaugu

SEQ ID NO: 712876 - RNA, 64 nt, Homo Sapiens
aucaucaauuucuaaaaacagggugucaucuuggccaucuaaacuaacagucagaaccacuaau

SEQ ID NO: 712877 - RNA, 64 nt, Homo Sapiens
cuucuguucuuagcacugccagggucauugacuuccaucuaagcuugcaucaggaagauguucc

SEQ ID NO: 712878 - RNA, 64 nt, Homo Sapiens
gugaucauugcccuauccgagacccugaguccugccaucuaacuacgguuuccugccucccuga

SEQ ID NO: 712879 - RNA, 64 nt, Homo Sapiens
cagucuuuauaugcauuccgugauuggaaucagcccaucuaaaguuccggcugcccuuucuagg

SEQ ID NO: 712880 - RNA, 64 nt, Homo Sapiens
caugggauucagugaucauguuagaaccccagaaccaucuaagaacuugauggcucucaagacc

SEQ ID NO: 712881 - RNA, 64 nt, Homo Sapiens
cuuguuuaugauauuucuuguguuugguaguuagccaucuaaugcugcccuaagggacuuaacu

SEQ ID NO: 712882 - RNA, 64 nt, Homo Sapiens
uagagggcccagaaauaaagcuacacaccuacaaccaucuaaucuuugacaaaguugacaaaaa

SEQ ID NO: 712883 - RNA, 64 nt, Homo Sapiens
ugagccacaaccuucuguaauucacuucauacauccaucuaaauggauaccuuuccauccccuc

SEQ ID NO: 712884 - RNA, 64 nt, Homo Sapiens
ggaauuuaguauaaaggccaaucuguccugaaguccaucuaauguggugaaucacugaaagucu

SEQ ID NO: 712885 - RNA, 64 nt, Homo Sapiens
ggaacuuccucucuccuuccagacacuaguggaaccaucuaacuuaguuuugccaauuaccagu

SEQ ID NO: 712886 - RNA, 61 nt, Homo Sapiens
agacucacuaacuauuggcagcgggagacagccaucuaaacagcgcccgacucacagauga

SEQ ID NO: 712887 - RNA, 64 nt, Homo Sapiens
agaagaaagaccacuggagacaccugcaguuaaaccaucuaaagaaggaagagaaagaucaacu

SEQ ID NO: 712888 - RNA, 64 nt, Homo Sapiens
cuguucucuuccacucuccuugcuacccagaaauccaucuaaauaccugcccugacaugcacac

SEQ ID NO: 712889 - RNA, 64 nt, Homo Sapiens
uucguaaagaccugucuccucacggaaccgcugcccaucuaaccgccgcgccuccuccucuguc

SEQ ID NO: 712890 - RNA, 64 nt, Homo Sapiens
aagaaaaagaaaaacugaagacaagaacaaaacuccaucuaaagacugcacuccagccugggca

SEQ ID NO: 712891 - RNA, 64 nt, Homo Sapiens
aguguaaaacuguaccacuguaggcauuucuugaccaucuaaugucuauauuuauuauagcguu

SEQ ID NO: 712892 - RNA, 64 nt, Homo Sapiens
cugccacugcacuccagccugggagggugagacuccaucuaaaaaaaauaaaauaaauggcaac

SEQ ID NO: 712893 - RNA, 64 nt, Homo Sapiens
gaccuugggccauaauuucugagccucgguuuccccaucuaaggaacagauguggucguuccgc

SEQ ID NO: 712894 - RNA, 64 nt, Homo Sapiens
ggaaaaggugaguugcucauucugcucacuuccaccaucuaagagggcuccccugaauaucuuc

SEQ ID NO: 712895 - RNA, 64 nt, Homo Sapiens
uaugacacacuguuguaguauggauucauuuauaccaucuaauauuaguucaacaccaucaugg

SEQ ID NO: 712896 - RNA, 64 nt, Homo Sapiens
acugaugaguaaacuugcauucacuuccuucaaaccaucuaauuuucuccugaaguuuuggcag

SEQ ID NO: 712897 - RNA, 64 nt, Homo Sapiens
gugcuggguguuuucaccaccauccccccaucccccaucuaagaauccuaagaggcaggcgauc

SEQ ID NO: 712898 - RNA, 64 nt, Homo Sapiens
caugcaacuguauuuauuuuugaugacaagacucccaucuaaaguuuuucuccugccugaucau

SEQ ID NO: 712899 - RNA, 64 nt, Homo Sapiens
cuuuugauaggccauuagcauggggagauugaauccaucuaaucaggaguugggcugaguuugu

SEQ ID NO: 712900 - RNA, 64 nt, Homo Sapiens
ugcuucauccagggagggagaaggcuuuucagcaccaucuaauguuuuaaaaggcacuaguuuu

SEQ ID NO: 712901 - RNA, 64 nt, Homo Sapiens
cuguguuugaacuauaaaaagcaccggaucuuuuccaucuaauuccgcaaaaauugaucauuug

SEQ ID NO: 712902 - RNA, 64 nt, Homo Sapiens
auuccacacugcagggaggacccucagcaacaucccaucuaagcgaucacagccccacccuugu

SEQ ID NO: 712903 - RNA, 64 nt, Homo Sapiens
auauacauguuuauguaaacuaccccuugauuuuccaucuaaaaagggaccagggagaugccac

SEQ ID NO: 712904 - RNA, 64 nt, Homo Sapiens
uggagagaugaaucauucuacacaaaacaucuagccaucuaaaacaggcaauucuaagaucuuc

SEQ ID NO: 712905 - RNA, 64 nt, Homo Sapiens; identical to SEQ ID NO: 272847

SEQ ID NO: 712906 - RNA, 64 nt, Homo Sapiens; identical to SEQ ID NO: 272848

SEQ ID NO: 712907 - RNA, 64 nt, Homo Sapiens; identical to SEQ ID NO: 272849

SEQ ID NO: 712908 - RNA, 64 nt, Homo Sapiens; identical to SEQ ID NO: 272850

SEQ ID NO: 712909 - RNA, 64 nt, Homo Sapiens; identical to SEQ ID NO: 272851

SEQ ID NO: 712910 - RNA, 64 nt, Homo Sapiens; identical to SEQ ID NO: 272852

SEQ ID NO: 712911 - RNA, 64 nt, Homo Sapiens; identical to SEQ ID NO: 272853

SEQ ID NO: 712912 - RNA, 64 nt, Homo Sapiens; identical to SEQ ID NO: 272854

SEQ ID NO: 712913 - RNA, 64 nt, Homo Sapiens; identical to SEQ ID NO: 272855

SEQ ID NO: 712914 - RNA, 64 nt, Homo Sapiens; identical to SEQ ID NO: 272856

SEQ ID NO: 712915 - RNA, 64 nt, Homo Sapiens; identical to SEQ ID NO: 272857

SEQ ID NO: 712916 - RNA, 64 nt, Homo Sapiens; identical to SEQ ID NO: 272858

SEQ ID NO: 712917 - RNA, 64 nt, Homo Sapiens; identical to SEQ ID NO: 272859

SEQ ID NO: 712918 - RNA, 64 nt, Homo Sapiens; identical to SEQ ID NO: 379260

SEQ ID NO: 712919 - RNA, 64 nt, Homo Sapiens; identical to SEQ ID NO: 379261

SEQ ID NO: 712920 - RNA, 64 nt, Homo Sapiens; identical to SEQ ID NO: 379262

SEQ ID NO: 712921 - RNA, 64 nt, Homo Sapiens; identical to SEQ ID NO: 379263

SEQ ID NO: 712922 - RNA, 64 nt, Homo Sapiens; identical to SEQ ID NO: 379264

SEQ ID NO: 712923 - RNA, 64 nt, Homo Sapiens; identical to SEQ ID NO: 379265

SEQ ID NO: 712924 - RNA, 64 nt, Homo Sapiens; identical to SEQ ID NO: 379266

SEQ ID NO: 712925 - RNA, 64 nt, Homo Sapiens; identical to SEQ ID NO: 379267

SEQ ID NO: 712926 - RNA, 64 nt, Homo Sapiens; identical to SEQ ID NO: 379268

SEQ ID NO: 712927 - RNA, 64 nt, Homo Sapiens; identical to SEQ ID NO: 379269

SEQ ID NO: 712928 - RNA, 64 nt, Homo Sapiens; identical to SEQ ID NO: 379270

SEQ ID NO: 712929 - RNA, 64 nt, Homo Sapiens; identical to SEQ ID NO: 379271

SEQ ID NO: 712930 - RNA, 64 nt, Homo Sapiens; identical to SEQ ID NO: 379272

SEQ ID NO: 712931 - RNA, 64 nt, Homo Sapiens; identical to SEQ ID NO: 379273

SEQ ID NO: 712932 - RNA, 64 nt, Homo Sapiens
aaaugcuucauugaaagcuucaaaguuuauaugccuggugcacagugcuuagaaguaagcaauu

SEQ ID NO: 712933 - RNA, 64 nt, Homo Sapiens
acuugucuccauguguauccaugcauuauauacccuggugcaaucacacgacugucaucuaaag

SEQ ID NO: 712934 - RNA, 64 nt, Homo Sapiens
uaauccagcucugcccuuggagagaacagaagagcuggugcacuccagcaagaucuggggcugc

SEQ ID NO: 712935 - RNA, 64 nt, Homo Sapiens
agccucuggugcugucuccgucgccccgaagcuucuggugcagccacacagugggugcugggcc

SEQ ID NO: 712936 - RNA, 64 nt, Homo Sapiens
cugggcagguccugaccaacagacgcagaaccugcuggugcaagaggucugccaggucagaugg

SEQ ID NO: 712937 - RNA, 64 nt, Homo Sapiens
cccagcugccuuagacagaugaguggaaagaaggcuggugcagaucccaggagcagugaguugu

SEQ ID NO: 712938 - RNA, 64 nt, Homo Sapiens
gcugcgugcauugaggccgcuugagccccauggccuggugcaggcacuggagacaagcaugagc

SEQ ID NO: 712939 - RNA, 64 nt, Homo Sapiens
ccagcuggcggaggggcgaauggcugggguugggcuggugcagcgcuuccuuaagccauugccc

SEQ ID NO: 712940 - RNA, 64 nt, Homo Sapiens
gggagguccccaccccuccccuccaggagcaggccuggugcagcccacucugugccuggacauc

SEQ ID NO: 712941 - RNA, 64 nt, Homo Sapiens
acucugagccaagccacuggggccaugcguaugacuggugcagggaggcaaggcccacauucuc

SEQ ID NO: 712942 - RNA, 64 nt, Homo Sapiens
cccugaaccccccuaggugggcuggaaucagcaucuggugcaaagcucugugaccacugcugua

SEQ ID NO: 712943 - RNA, 64 nt, Homo Sapiens
gcuguaccacauuaugcagagcacacaggacaggcuggugcaccuccaggcugugccaggaaac

SEQ ID NO: 712944 - RNA, 64 nt, Homo Sapiens
uuuguuccuuuguuaacuguacccggcgguuaaccuggugcacuaagcaagccuguccuuccug

SEQ ID NO: 712945 - RNA, 64 nt, Homo Sapiens
uaauaggugcucaauaaaaagccuggaacagugucuggugcacaucuucuacuguaucgccagu

SEQ ID NO: 712946 - RNA, 64 nt, Homo Sapiens
ugugcugggcuagccugugaccccucgggacugccuggugcaggugguggcagcuggagggacc

SEQ ID NO: 712947 - RNA, 64 nt, Homo Sapiens
aggguuuauuagucccugccagcagcuguccucccuggugcagguggccuggccagcccacugg

SEQ ID NO: 712948 - RNA, 64 nt, Homo Sapiens
gcggaccccucacugugcgccugugcagggggugcuggugcacguggcaguguggauuuccagu

SEQ ID NO: 712949 - RNA, 64 nt, Homo Sapiens
gggcugcaacuuuucuguugauccuggaauguagcuggugcagugagagggaaagagaauugaa

SEQ ID NO: 712950 - RNA, 64 nt, Homo Sapiens
ccagcagcccaagggcuccagacacaccugaacacaucgugaugaugacguccucucaacucuc

SEQ ID NO: 712951 - RNA, 64 nt, Homo Sapiens
uauuuugagauguuuuuuccuuacaaugugaacucaucgugaucuuggaaaucaauaaagucaa

SEQ ID NO: 712952 - RNA, 64 nt, Homo Sapiens
gcgggcacaaacguccccaggcugggcucauucccaucgugagugagcccaggugaggacauag

SEQ ID NO: 712953 - RNA, 64 nt, Homo Sapiens
cuucagggccagaaggagggcugauggccaagagcaucgugaccggcgcugcagguacuuccuc

SEQ ID NO: 712954 - RNA, 64 nt, Homo Sapiens
caagcagaugccacauggaaccaguuacaauuagcaucgugaucacuccccaaaacaccccuuu

SEQ ID NO: 712955 - RNA, 64 nt, Homo Sapiens
uaacugaaguguuuaaaaagagaagccugcacagcaucgugaauauuucagagaagggauaaau

SEQ ID NO: 712956 - RNA, 64 nt, Homo Sapiens
ccauaaacaggaaugccuuuagccuccuugguuccaucgugaagcagcccuaggagucugcgag

SEQ ID NO: 712957 - RNA, 64 nt, Homo Sapiens
ugucugccucggacucccaaucuugaucuccugacaucgugauccaccguguuagccaggaugg

SEQ ID NO: 712958 - RNA, 64 nt, Homo Sapiens
ggccccucagccagggcugcuccagcagcgucaacaucgugaugauaccagugacacccaguca

SEQ ID NO: 712959 - RNA, 64 nt, Homo Sapiens
caggagggucccggcggaaagccagccccggacucaucgugacauugagaucccacuggagggu

SEQ ID NO: 712960 - RNA, 64 nt, Homo Sapiens
gguacauuuaaaauauguuacaccuagcuuauuacaucgugaaauauguauuaacucuuaagug

SEQ ID NO: 712961 - RNA, 64 nt, Homo Sapiens
gcaaugcuuaaccccaggaacacaguucuccaagcaucgugauaugagccagagaagacuugau

SEQ ID NO: 712962 - RNA, 64 nt, Homo Sapiens
cacacugccaccaucucaaagccaucccccuagccaucgugagcaucccagcggcaccgccauu

SEQ ID NO: 712963 - RNA, 64 nt, Homo Sapiens
auauucaucuacuuagaaauuauagcuguauaaacaucgugauuuuagcuuccaaauuaugcuu

SEQ ID NO: 712964 - RNA, 64 nt, Homo Sapiens
uuuucaucggcugugccauugucccaacuacugucaucgugaggacgugcuagccauuuccagu

SEQ ID NO: 712965 - RNA, 64 nt, Homo Sapiens
uggaaagcucugaccacuugaggccugaucugcccaucgugaagaagccuguaacacuccucug

SEQ ID NO: 712966 - RNA, 64 nt, Homo Sapiens
acuuugacuuucccacuguugcuggagacaaagacaucgugaugagagaaaguucgcacaaucu

SEQ ID NO: 712967 - RNA, 64 nt, Homo Sapiens
cuugggucucuuucccccaacuuuuccacauggucaucgugaaauaaaaaguccacucuggagu

SEQ ID NO: 712968 - RNA, 64 nt, Homo Sapiens
aucuugaccauuguugaaugaaauugaaauaagacaucgugaaacacgucuuuaaaagcaacaa

SEQ ID NO: 712969 - RNA, 64 nt, Homo Sapiens
cccuuacuggcucagcccuggcugguuuuaccaucaucgugaugccacugggugaggcaggcaa

SEQ ID NO: 712970 - RNA, 64 nt, Homo Sapiens
aauuguuugcauagaggaaggacaauaacccugccaucgugaguuaauguccgggcuggucaca

SEQ ID NO: 712971 - RNA, 64 nt, Homo Sapiens
uacauuaaguuauuuggcaaauaccaaggauuugcaucgugaaugggcaauauggauuauuuuu

SEQ ID NO: 712972 - RNA, 64 nt, Homo Sapiens
acugagccaucauuuccuggugaagcaaacacagcaucgugaucaagagucaucugcuugaaug

SEQ ID NO: 712973 - RNA, 64 nt, Homo Sapiens
ucuaguucaguuaauucauccuguugaauugcaccaucgugaaagaugggaaaaaucgugauga

SEQ ID NO: 712974 - RNA, 64 nt, Homo Sapiens
ugccgucuuuacaaaaaaauaccagccugaccaacaucgugaaacuugaggucagaaguucaag

SEQ ID NO: 712975 - RNA, 64 nt, Homo Sapiens
guggacuucccugcuguugcguggcugucucuaucaucgugacugagucuucugauuggcagcu

SEQ ID NO: 712976 - RNA, 64 nt, Homo Sapiens
gcugguaguaauauggugguaaucugagacaggacaucgugacuaccagaucggugacuccuaa

SEQ ID NO: 712977 - RNA, 64 nt, Homo Sapiens
auaggcuggcaagagcuguuuuugcauccauuugcaucgugaagacuggcauuuugauacuuca

SEQ ID NO: 712978 - RNA, 64 nt, Homo Sapiens
gaugccuuagacggggugugcaguauuuuagguacaucgugagcaaggagccugcauucccagg

SEQ ID NO: 712979 - RNA, 64 nt, Homo Sapiens
aucagaccuacuugggagagggggcugaugagaacaucgugacccuugcauaggcgccuagaau

SEQ ID NO: 712980 - RNA, 64 nt, Homo Sapiens
ucaugugggugggaaguucccagggcaguggucacaucgugagaauuagcaggaaaggcggggc

SEQ ID NO: 712981 - RNA, 64 nt, Homo Sapiens
aagagauagcaauguguuuuaaguugcgcaggcccaucgugauaaggaauuaggucacaaaugg

SEQ ID NO: 712982 - RNA, 64 nt, Homo Sapiens
ggauccaggcguucuuuaggauccuuggauaccacaucgugaaaucuuuuauuuuuuuacucug

SEQ ID NO: 712983 - RNA, 64 nt, Homo Sapiens
cccugucucuacuaaaaaugaccagucuggccaacaucgugaaacgggcggucagggguucgag

SEQ ID NO: 712984 - RNA, 64 nt, Homo Sapiens
cauuuuacuuuaaaagggaaccacuguauuuccacaucgugagucuucugcuccagaacucuau

SEQ ID NO: 712985 - RNA, 64 nt, Homo Sapiens
ccuuaugagcccauaaggaaccagauuucaaccucaucgugaaccaguggagcagagggguuac

SEQ ID NO: 712986 - RNA, 64 nt, Homo Sapiens
ggccccagauccucacacccagggagcagcugcacaucgugaaagacugaggcagcguggaugg

SEQ ID NO: 712987 - RNA, 64 nt, Homo Sapiens
aauguuacaguaauuucuguuaguuuuaugaagucaucgugaccuuccucauaacauuuaucuu

SEQ ID NO: 712988 - RNA, 64 nt, Homo Sapiens
uaaagaugcugaccuggggagaauggagaggccccaucgugaauuaguuggggaauugugagau

SEQ ID NO: 712989 - RNA, 64 nt, Homo Sapiens
aggugggcggaucacgaggucaggagaucgagaccaucgugacuaacacagugaaaccccgucu

SEQ ID NO: 712990 - RNA, 64 nt, Homo Sapiens
aaauuguuuaagaaaaaaaauuauaucaaaggugcaucgugaccaauaaaguuuaaaaaugcuu

SEQ ID NO: 712991 - RNA, 64 nt, Homo Sapiens
gcucaggaggcuucugagcuucuccuguacugugcaucgugagggccagagacaggaauguaag

SEQ ID NO: 712992 - RNA, 64 nt, Homo Sapiens
ugcagcaguugcacucuuuuucaugaagauauugcaucgugagcgauuuguaugugcucugggc

SEQ ID NO: 712993 - RNA, 64 nt, Homo Sapiens
ugauugcuuggcuauugucuucuagguaauugugcaucgugaugaacuacuuuuuaauugcaau

SEQ ID NO: 712994 - RNA, 64 nt, Homo Sapiens
ugccugccucaugcucucuauagaggaggauggucaucgugacagcagcagcucaaguuagcau

SEQ ID NO: 712995 - RNA, 64 nt, Homo Sapiens
uaugauuccuguggggaaacaauuucauucucuccaucgugaaaauaagugaauaagagugaag

SEQ ID NO: 712996 - RNA, 64 nt, Homo Sapiens
cugccacagugccugacuacaccccaccugucuucaucgugagggcagguggggacccaacucc

SEQ ID NO: 712997 - RNA, 64 nt, Homo Sapiens
ggcccuccagucagguucuguggguuuggaagcccaucgugaaaggggcugaccuuugccccuu

SEQ ID NO: 712998 - RNA, 64 nt, Homo Sapiens
gacucugaccagagaucgagaccauccuagccaacaucgugaaaccccaucucuacuaaaaaua

SEQ ID NO: 712999 - RNA, 64 nt, Homo Sapiens
uuuaggggccugggcuggggggauggggagggcacaucgugacuguguuuuucauaacuuaugu

SEQ ID NO: 713000 - RNA, 64 nt, Homo Sapiens
uagacaggaugccaggggccuuacaccagagggccaucgugacgcccaccccaccaugucccca

SEQ ID NO: 713001 - RNA, 53 nt, Homo Sapiens
caaaacucacuuguauaauagcccaucgugacuaccagaaauccuaccgauaa

SEQ ID NO: 713002 - RNA, 64 nt, Homo Sapiens
aggcucuuaucccacuccaugaugucccaagccucaucgugacgcuguggacaguuuuucccaa

SEQ ID NO: 713003 - RNA, 64 nt, Homo Sapiens
ggcccagcugggucugacaaggacccagcugucacaucgugaauauuuaaauguccugucacua

SEQ ID NO: 713004 - RNA, 64 nt, Homo Sapiens
augugccccuucccaggggccuguuucuuugugucaucgugagcagcagcugggggcuggagcc

SEQ ID NO: 713005 - RNA, 64 nt, Homo Sapiens
uuuugcaucuuaagucuuagaaauuaagauauuccaucgugaggaugagagagguccucagugu

SEQ ID NO: 713006 - RNA, 64 nt, Homo Sapiens
aaauuaucccaguggaacuucaacccgggcuguccaucgugacauuccgccuccuuccaccaug

SEQ ID NO: 713007 - RNA, 64 nt, Homo Sapiens
caaauaccuaaggaguccccaggagcuggcuggccaucgugauaggaucugucuguccuguaaa

SEQ ID NO: 713008 - RNA, 64 nt, Homo Sapiens
ugucuuuucaugcagauuaguuuuuccccccaaccaucgugauuuuuucuuuuuuuuuuuuuaa

SEQ ID NO: 713009 - RNA, 64 nt, Homo Sapiens
gaguucacagucuuaaaaguucuccugagacaagcaucgugauaucuugcagaaucugaaugug

SEQ ID NO: 713010 - RNA, 64 nt, Homo Sapiens
agcccucugaauagccccccggagaucacugcuccaucgugaggggccuuguccaucugauuca

SEQ ID NO: 713011 - RNA, 64 nt, Homo Sapiens
augagggcuuuuucuagcaaugguucaguuuuaacaucgugacaacuuaugcagaguaauauuu

SEQ ID NO: 713012 - RNA, 64 nt, Homo Sapiens
cagaccuguauaaauuaggucaccuucaauuugccaucgugacgagaaaccagcuaaaucaugg

SEQ ID NO: 713013 - RNA, 64 nt, Homo Sapiens
ggaaggccuaagaauggcaaagguuucucauauccaucgugauaaaacuauucugacuagaguc

SEQ ID NO: 713014 - RNA, 63 nt, Homo Sapiens
aaauccugacuggcaucucugcuugcgcuccuagccuagagauaaaugaaugaauaaacauga

SEQ ID NO: 713015 - RNA, 64 nt, Homo Sapiens
ccaggcagcuaaaggacaagcaugaacucaggugccuagagaagugcagcuucuaacccaggac

SEQ ID NO: 713016 - RNA, 64 nt, Homo Sapiens
cgaggaugggcuugagcuguugagagauuucugcccuagagauggccuuuguauaugggggggu

SEQ ID NO: 713017 - RNA, 64 nt, Homo Sapiens
agagaauagcacuugcaaaaauacagucuugguaccuagagacugucaugcagauaguauaauu

SEQ ID NO: 713018 - RNA, 64 nt, Homo Sapiens
gauggguaauagagcaggcccguguccagucauaccuagagauuuguggggggauacugaaccu

SEQ ID NO: 713019 - RNA, 64 nt, Homo Sapiens
gaaccaaguaaaaggaaacaugcuagaaaacgugccuagagaagacacuucaaccuuugccuua

SEQ ID NO: 713020 - RNA, 64 nt, Homo Sapiens
cuuuauugcacaaccagccuggguucuaagaaagccuagagaauuucuuauugcccuguuagaa

SEQ ID NO: 713021 - RNA, 64 nt, Homo Sapiens
uucuuauugcccuguuagaaaaauuaacugagcuccuagagaagaacaauccucauguaagcuu

SEQ ID NO: 713022 - RNA, 64 nt, Homo Sapiens
caguuacuacccaguuuguguuuuaaauauauugccuagagacuuuuauuuuuaauccucuuag

SEQ ID NO: 713023 - RNA, 64 nt, Homo Sapiens
aguauauacuaggguacuuuucagaaaagcaggcccuagagagauagaccauacauaucugaca

SEQ ID NO: 713024 - RNA, 64 nt, Homo Sapiens
aguuccuccaauucugaccgagugcugaucauucccuagagacaccaguaaccccgggcuuagc

SEQ ID NO: 713025 - RNA, 64 nt, Homo Sapiens
uccuucaaucaagguuuccaggcagagcaaauacccuagagauucucugugauauaggaaauuu

SEQ ID NO: 713026 - RNA, 64 nt, Homo Sapiens
gcccugagcaccagcuugauccgcuuaugaccauccuagagaggggaugaccuaugcaaucaca

SEQ ID NO: 713027 - RNA, 64 nt, Homo Sapiens
cugaaaguccuggggcaguacuuuauccuuaggcccuagagauagccaaaugccauuaaugcug

SEQ ID NO: 713028 - RNA, 64 nt, Homo Sapiens
cacuccuuaucuaugaagaacugcaaguggccaaccuagagauuguauguuuggaguuccaaau

SEQ ID NO: 713029 - RNA, 64 nt, Homo Sapiens
agauccacauccuaaaaauaacaugguggcagguccuagagaugcaacagggcacaugacauau

SEQ ID NO: 713030 - RNA, 64 nt, Homo Sapiens
ucaucucauuuaauccucccuuccucccuauuaaccuagagauuguuuuuguuuuuuauucucc

SEQ ID NO: 713031 - RNA, 64 nt, Homo Sapiens
ccuccccgcccucacccgccccacucccuccuaaccuagagauuguuacagaagcugaaauugc

SEQ ID NO: 713032 - RNA, 64 nt, Homo Sapiens; identical to SEQ ID NO: 109292

SEQ ID NO: 713033 - RNA, 64 nt, Homo Sapiens; identical to SEQ ID NO: 109293

SEQ ID NO: 713034 - RNA, 64 nt, Homo Sapiens; identical to SEQ ID NO: 109294

SEQ ID NO: 713035 - RNA, 64 nt, Homo Sapiens; identical to SEQ ID NO: 109295

SEQ ID NO: 713036 - RNA, 64 nt, Homo Sapiens; identical to SEQ ID NO: 109296

SEQ ID NO: 713037 - RNA, 64 nt, Homo Sapiens; identical to SEQ ID NO: 109297

SEQ ID NO: 713038 - RNA, 64 nt, Homo Sapiens; identical to SEQ ID NO: 109298

SEQ ID NO: 713039 - RNA, 64 nt, Homo Sapiens
acguauccuuagagaauaaggagcuuguuuuugcccuugauagcucuaacuucugaaacuuuug

SEQ ID NO: 713040 - RNA, 64 nt, Homo Sapiens
accugccugggcguucuacugacugaagucuugaccuugauaccuuucaguuccccacccaacu

SEQ ID NO: 713041 - RNA, 64 nt, Homo Sapiens
gaguugggaccagacuggcugucuggaauaauguccuugauacuauugauagcaguacugugcu

SEQ ID NO: 713042 - RNA, 64 nt, Homo Sapiens
uauacagccuuuggguacaaaggaagucauccuuccuugauauauguuauuuagagaucaagga

SEQ ID NO: 713043 - RNA, 64 nt, Homo Sapiens
aguuucaggccccaaaauaacacgagccccuccaccuugauagcuccuugauaucccaaucuug

SEQ ID NO: 713044 - RNA, 64 nt, Homo Sapiens
ccaaaauaacacgagccccuccaccuugauagcuccuugauaucccaaucuugcaguccuaacu

SEQ ID NO: 713045 - RNA, 64 nt, Homo Sapiens
agccccuaacucuacugccuuccacauauugguuccuugauacauuucauaugauaucagccaa

SEQ ID NO: 713046 - RNA, 64 nt, Homo Sapiens; identical to SEQ ID NO: 125091

SEQ ID NO: 713047 - RNA, 64 nt, Homo Sapiens; identical to SEQ ID NO: 125092

SEQ ID NO: 713048 - RNA, 64 nt, Homo Sapiens; identical to SEQ ID NO: 125093

SEQ ID NO: 713049 - RNA, 64 nt, Homo Sapiens; identical to SEQ ID NO: 125094

SEQ ID NO: 713050 - RNA, 64 nt, Homo Sapiens; identical to SEQ ID NO: 125095

SEQ ID NO: 713051 - RNA, 64 nt, Homo Sapiens; identical to SEQ ID NO: 125096

SEQ ID NO: 713052 - RNA, 64 nt, Homo Sapiens; identical to SEQ ID NO: 125097

SEQ ID NO: 713053 - RNA, 64 nt, Homo Sapiens; identical to SEQ ID NO: 125098

SEQ ID NO: 713054 - RNA, 64 nt, Homo Sapiens; identical to SEQ ID NO: 125099

SEQ ID NO: 713055 - RNA, 64 nt, Homo Sapiens; identical to SEQ ID NO: 125100

SEQ ID NO: 713056 - RNA, 64 nt, Homo Sapiens; identical to SEQ ID NO: 125101

SEQ ID NO: 713057 - RNA, 64 nt, Homo Sapiens; identical to SEQ ID NO: 125102

SEQ ID NO: 713058 - RNA, 64 nt, Homo Sapiens; identical to SEQ ID NO: 125103

SEQ ID NO: 713059 - RNA, 64 nt, Homo Sapiens; identical to SEQ ID NO: 125104

SEQ ID NO: 713060 - RNA, 64 nt, Homo Sapiens; identical to SEQ ID NO: 125105

SEQ ID NO: 713061 - RNA, 64 nt, Homo Sapiens; identical to SEQ ID NO: 125106

SEQ ID NO: 713062 - RNA, 64 nt, Homo Sapiens; identical to SEQ ID NO: 125107

SEQ ID NO: 713063 - RNA, 64 nt, Homo Sapiens; identical to SEQ ID NO: 125108

SEQ ID NO: 713064 - RNA, 64 nt, Homo Sapiens; identical to SEQ ID NO: 125109

SEQ ID NO: 713065 - RNA, 64 nt, Homo Sapiens; identical to SEQ ID NO: 125110

SEQ ID NO: 713066 - RNA, 64 nt, Homo Sapiens; identical to SEQ ID NO: 125111

SEQ ID NO: 713067 - RNA, 64 nt, Homo Sapiens; identical to SEQ ID NO: 125112

SEQ ID NO: 713068 - RNA, 64 nt, Homo Sapiens; identical to SEQ ID NO: 125113

SEQ ID NO: 713069 - RNA, 64 nt, Homo Sapiens; identical to SEQ ID NO: 125114

SEQ ID NO: 713070 - RNA, 64 nt, Homo Sapiens; identical to SEQ ID NO: 125115

SEQ ID NO: 713071 - RNA, 64 nt, Homo Sapiens; identical to SEQ ID NO: 125116

SEQ ID NO: 713072 - RNA, 64 nt, Homo Sapiens; identical to SEQ ID NO: 125117

SEQ ID NO: 713073 - RNA, 64 nt, Homo Sapiens; identical to SEQ ID NO: 125118

SEQ ID NO: 713074 - RNA, 64 nt, Homo Sapiens; identical to SEQ ID NO: 125119

SEQ ID NO: 713075 - RNA, 64 nt, Homo Sapiens; identical to SEQ ID NO: 125120

SEQ ID NO: 713076 - RNA, 64 nt, Homo Sapiens; identical to SEQ ID NO: 125121

SEQ ID NO: 713077 - RNA, 64 nt, Homo Sapiens; identical to SEQ ID NO: 125122

SEQ ID NO: 713078 - RNA, 64 nt, Homo Sapiens; identical to SEQ ID NO: 125123

SEQ ID NO: 713079 - RNA, 64 nt, Homo Sapiens; identical to SEQ ID NO: 125124

SEQ ID NO: 713080 - RNA, 64 nt, Homo Sapiens; identical to SEQ ID NO: 125125

SEQ ID NO: 713081 - RNA, 64 nt, Homo Sapiens; identical to SEQ ID NO: 125126

SEQ ID NO: 713082 - RNA, 64 nt, Homo Sapiens; identical to SEQ ID NO: 125127

SEQ ID NO: 713083 - RNA, 64 nt, Homo Sapiens; identical to SEQ ID NO: 125128

SEQ ID NO: 713084 - RNA, 64 nt, Homo Sapiens; identical to SEQ ID NO: 125129

SEQ ID NO: 713085 - RNA, 64 nt, Homo Sapiens; identical to SEQ ID NO: 125130

SEQ ID NO: 713086 - RNA, 64 nt, Homo Sapiens; identical to SEQ ID NO: 125131

SEQ ID NO: 713087 - RNA, 64 nt, Homo Sapiens; identical to SEQ ID NO: 125132

SEQ ID NO: 713088 - RNA, 64 nt, Homo Sapiens; identical to SEQ ID NO: 125133

SEQ ID NO: 713089 - RNA, 64 nt, Homo Sapiens; identical to SEQ ID NO: 125134

SEQ ID NO: 713090 - RNA, 64 nt, Homo Sapiens; identical to SEQ ID NO: 125135

SEQ ID NO: 713091 - RNA, 64 nt, Homo Sapiens; identical to SEQ ID NO: 125136

SEQ ID NO: 713092 - RNA, 64 nt, Homo Sapiens; identical to SEQ ID NO: 125137

SEQ ID NO: 713093 - RNA, 64 nt, Homo Sapiens; identical to SEQ ID NO: 125138

SEQ ID NO: 713094 - RNA, 64 nt, Homo Sapiens; identical to SEQ ID NO: 125139

SEQ ID NO: 713095 - RNA, 64 nt, Homo Sapiens; identical to SEQ ID NO: 125140

SEQ ID NO: 713096 - RNA, 64 nt, Homo Sapiens; identical to SEQ ID NO: 125141

SEQ ID NO: 713097 - RNA, 64 nt, Homo Sapiens; identical to SEQ ID NO: 125142

SEQ ID NO: 713098 - RNA, 64 nt, Homo Sapiens; identical to SEQ ID NO: 125143

SEQ ID NO: 713099 - RNA, 64 nt, Homo Sapiens; identical to SEQ ID NO: 125144

SEQ ID NO: 713100 - RNA, 64 nt, Homo Sapiens; identical to SEQ ID NO: 125145

SEQ ID NO: 713101 - RNA, 64 nt, Homo Sapiens; identical to SEQ ID NO: 125146

SEQ ID NO: 713102 - RNA, 64 nt, Homo Sapiens; identical to SEQ ID NO: 125147

SEQ ID NO: 713103 - RNA, 64 nt, Homo Sapiens; identical to SEQ ID NO: 125148

SEQ ID NO: 713104 - RNA, 64 nt, Homo Sapiens; identical to SEQ ID NO: 125149

SEQ ID NO: 713105 - RNA, 64 nt, Homo Sapiens; identical to SEQ ID NO: 125150

SEQ ID NO: 713106 - RNA, 64 nt, Homo Sapiens; identical to SEQ ID NO: 125151

SEQ ID NO: 713107 - RNA, 64 nt, Homo Sapiens; identical to SEQ ID NO: 125152

SEQ ID NO: 713108 - RNA, 64 nt, Homo Sapiens; identical to SEQ ID NO: 125153

SEQ ID NO: 713109 - RNA, 64 nt, Homo Sapiens; identical to SEQ ID NO: 125154

SEQ ID NO: 713110 - RNA, 64 nt, Homo Sapiens; identical to SEQ ID NO: 125155

SEQ ID NO: 713111 - RNA, 64 nt, Homo Sapiens; identical to SEQ ID NO: 125156

SEQ ID NO: 713112 - RNA, 64 nt, Homo Sapiens; identical to SEQ ID NO: 125157

SEQ ID NO: 713113 - RNA, 64 nt, Homo Sapiens; identical to SEQ ID NO: 125158

SEQ ID NO: 713114 - RNA, 64 nt, Homo Sapiens; identical to SEQ ID NO: 125159

SEQ ID NO: 713115 - RNA, 64 nt, Homo Sapiens; identical to SEQ ID NO: 125160

SEQ ID NO: 713116 - RNA, 64 nt, Homo Sapiens; identical to SEQ ID NO: 125161

SEQ ID NO: 713117 - RNA, 64 nt, Homo Sapiens; identical to SEQ ID NO: 125162

SEQ ID NO: 713118 - RNA, 64 nt, Homo Sapiens; identical to SEQ ID NO: 125163

SEQ ID NO: 713119 - RNA, 64 nt, Homo Sapiens; identical to SEQ ID NO: 125164

SEQ ID NO: 713120 - RNA, 64 nt, Homo Sapiens; identical to SEQ ID NO: 125165

SEQ ID NO: 713121 - RNA, 64 nt, Homo Sapiens; identical to SEQ ID NO: 125166

SEQ ID NO: 713122 - RNA, 64 nt, Homo Sapiens; identical to SEQ ID NO: 125167

SEQ ID NO: 713123 - RNA, 64 nt, Homo Sapiens; identical to SEQ ID NO: 125168

SEQ ID NO: 713124 - RNA, 64 nt, Homo Sapiens; identical to SEQ ID NO: 125169

SEQ ID NO: 713125 - RNA, 64 nt, Homo Sapiens; identical to SEQ ID NO: 125170

SEQ ID NO: 713126 - RNA, 64 nt, Homo Sapiens; identical to SEQ ID NO: 125171

SEQ ID NO: 713127 - RNA, 64 nt, Homo Sapiens; identical to SEQ ID NO: 125172

SEQ ID NO: 713128 - RNA, 64 nt, Homo Sapiens; identical to SEQ ID NO: 125173

SEQ ID NO: 713129 - RNA, 64 nt, Homo Sapiens; identical to SEQ ID NO: 125174

SEQ ID NO: 713130 - RNA, 64 nt, Homo Sapiens; identical to SEQ ID NO: 125175

SEQ ID NO: 713131 - RNA, 64 nt, Homo Sapiens; identical to SEQ ID NO: 125176

SEQ ID NO: 713132 - RNA, 64 nt, Homo Sapiens; identical to SEQ ID NO: 125177

SEQ ID NO: 713133 - RNA, 64 nt, Homo Sapiens; identical to SEQ ID NO: 125178

SEQ ID NO: 713134 - RNA, 64 nt, Homo Sapiens; identical to SEQ ID NO: 125179

SEQ ID NO: 713135 - RNA, 64 nt, Homo Sapiens; identical to SEQ ID NO: 125180

SEQ ID NO: 713136 - RNA, 64 nt, Homo Sapiens; identical to SEQ ID NO: 125181

SEQ ID NO: 713137 - RNA, 64 nt, Homo Sapiens; identical to SEQ ID NO: 125182

SEQ ID NO: 713138 - RNA, 64 nt, Homo Sapiens; identical to SEQ ID NO: 125183

SEQ ID NO: 713139 - RNA, 64 nt, Homo Sapiens; identical to SEQ ID NO: 125184

SEQ ID NO: 713140 - RNA, 64 nt, Homo Sapiens; identical to SEQ ID NO: 125185

SEQ ID NO: 713141 - RNA, 64 nt, Homo Sapiens; identical to SEQ ID NO: 125186

SEQ ID NO: 713142 - RNA, 64 nt, Homo Sapiens; identical to SEQ ID NO: 125187

SEQ ID NO: 713143 - RNA, 64 nt, Homo Sapiens; identical to SEQ ID NO: 125188

SEQ ID NO: 713144 - RNA, 64 nt, Homo Sapiens; identical to SEQ ID NO: 125189

SEQ ID NO: 713145 - RNA, 58 nt, Homo Sapiens; identical to SEQ ID NO: 125190

SEQ ID NO: 713146 - RNA, 64 nt, Homo Sapiens; identical to SEQ ID NO: 125191

SEQ ID NO: 713147 - RNA, 64 nt, Homo Sapiens; identical to SEQ ID NO: 125192

SEQ ID NO: 713148 - RNA, 64 nt, Homo Sapiens; identical to SEQ ID NO: 125193

SEQ ID NO: 713149 - RNA, 64 nt, Homo Sapiens; identical to SEQ ID NO: 125194

SEQ ID NO: 713150 - RNA, 64 nt, Homo Sapiens; identical to SEQ ID NO: 125195

SEQ ID NO: 713151 - RNA, 64 nt, Homo Sapiens; identical to SEQ ID NO: 125196

SEQ ID NO: 713152 - RNA, 64 nt, Homo Sapiens; identical to SEQ ID NO: 125197

SEQ ID NO: 713153 - RNA, 64 nt, Homo Sapiens; identical to SEQ ID NO: 125198

SEQ ID NO: 713154 - RNA, 64 nt, Homo Sapiens; identical to SEQ ID NO: 125199

SEQ ID NO: 713155 - RNA, 64 nt, Homo Sapiens; identical to SEQ ID NO: 125200

SEQ ID NO: 713156 - RNA, 64 nt, Homo Sapiens; identical to SEQ ID NO: 125201

SEQ ID NO: 713157 - RNA, 64 nt, Homo Sapiens; identical to SEQ ID NO: 125202

SEQ ID NO: 713158 - RNA, 64 nt, Homo Sapiens; identical to SEQ ID NO: 125203

SEQ ID NO: 713159 - RNA, 64 nt, Homo Sapiens; identical to SEQ ID NO: 125204

SEQ ID NO: 713160 - RNA, 64 nt, Homo Sapiens; identical to SEQ ID NO: 125205

SEQ ID NO: 713161 - RNA, 64 nt, Homo Sapiens; identical to SEQ ID NO: 125206

SEQ ID NO: 713162 - RNA, 64 nt, Homo Sapiens; identical to SEQ ID NO: 125207

SEQ ID NO: 713163 - RNA, 64 nt, Homo Sapiens; identical to SEQ ID NO: 125208

SEQ ID NO: 713164 - RNA, 64 nt, Homo Sapiens; identical to SEQ ID NO: 125209

SEQ ID NO: 713165 - RNA, 64 nt, Homo Sapiens; identical to SEQ ID NO: 125210

SEQ ID NO: 713166 - RNA, 64 nt, Homo Sapiens; identical to SEQ ID NO: 125211

SEQ ID NO: 713167 - RNA, 64 nt, Homo Sapiens; identical to SEQ ID NO: 125212

SEQ ID NO: 713168 - RNA, 64 nt, Homo Sapiens; identical to SEQ ID NO: 125213

SEQ ID NO: 713169 - RNA, 64 nt, Homo Sapiens; identical to SEQ ID NO: 125214

SEQ ID NO: 713170 - RNA, 64 nt, Homo Sapiens; identical to SEQ ID NO: 125215

SEQ ID NO: 713171 - RNA, 64 nt, Homo Sapiens; identical to SEQ ID NO: 125216

SEQ ID NO: 713172 - RNA, 64 nt, Homo Sapiens; identical to SEQ ID NO: 125217

SEQ ID NO: 713173 - RNA, 64 nt, Homo Sapiens; identical to SEQ ID NO: 125218

SEQ ID NO: 713174 - RNA, 64 nt, Homo Sapiens; identical to SEQ ID NO: 125219

SEQ ID NO: 713175 - RNA, 64 nt, Homo Sapiens; identical to SEQ ID NO: 125220

SEQ ID NO: 713176 - RNA, 64 nt, Homo Sapiens; identical to SEQ ID NO: 125221

SEQ ID NO: 713177 - RNA, 64 nt, Homo Sapiens; identical to SEQ ID NO: 125222

SEQ ID NO: 713178 - RNA, 64 nt, Homo Sapiens; identical to SEQ ID NO: 125223

SEQ ID NO: 713179 - RNA, 64 nt, Homo Sapiens; identical to SEQ ID NO: 125224

SEQ ID NO: 713180 - RNA, 64 nt, Homo Sapiens; identical to SEQ ID NO: 125225

SEQ ID NO: 713181 - RNA, 64 nt, Homo Sapiens; identical to SEQ ID NO: 125226

SEQ ID NO: 713182 - RNA, 64 nt, Homo Sapiens; identical to SEQ ID NO: 125227

SEQ ID NO: 713183 - RNA, 64 nt, Homo Sapiens; identical to SEQ ID NO: 125228

SEQ ID NO: 713184 - RNA, 64 nt, Homo Sapiens; identical to SEQ ID NO: 125229

SEQ ID NO: 713185 - RNA, 64 nt, Homo Sapiens; identical to SEQ ID NO: 125230

SEQ ID NO: 713186 - RNA, 64 nt, Homo Sapiens; identical to SEQ ID NO: 125231

SEQ ID NO: 713187 - RNA, 64 nt, Homo Sapiens; identical to SEQ ID NO: 125232

SEQ ID NO: 713188 - RNA, 64 nt, Homo Sapiens; identical to SEQ ID NO: 125233

SEQ ID NO: 713189 - RNA, 64 nt, Homo Sapiens; identical to SEQ ID NO: 125234

SEQ ID NO: 713190 - RNA, 64 nt, Homo Sapiens; identical to SEQ ID NO: 125235

SEQ ID NO: 713191 - RNA, 64 nt, Homo Sapiens; identical to SEQ ID NO: 125236

SEQ ID NO: 713192 - RNA, 64 nt, Homo Sapiens; identical to SEQ ID NO: 125237

SEQ ID NO: 713193 - RNA, 64 nt, Homo Sapiens; identical to SEQ ID NO: 125238

SEQ ID NO: 713194 - RNA, 64 nt, Homo Sapiens; identical to SEQ ID NO: 125239

SEQ ID NO: 713195 - RNA, 64 nt, Homo Sapiens; identical to SEQ ID NO: 125240

SEQ ID NO: 713196 - RNA, 64 nt, Homo Sapiens; identical to SEQ ID NO: 125241

SEQ ID NO: 713197 - RNA, 64 nt, Homo Sapiens; identical to SEQ ID NO: 125242

SEQ ID NO: 713198 - RNA, 64 nt, Homo Sapiens; identical to SEQ ID NO: 125243

SEQ ID NO: 713199 - RNA, 64 nt, Homo Sapiens; identical to SEQ ID NO: 125244

SEQ ID NO: 713200 - RNA, 64 nt, Homo Sapiens; identical to SEQ ID NO: 125245

SEQ ID NO: 713201 - RNA, 64 nt, Homo Sapiens; identical to SEQ ID NO: 125246

SEQ ID NO: 713202 - RNA, 64 nt, Homo Sapiens; identical to SEQ ID NO: 125247

SEQ ID NO: 713203 - RNA, 64 nt, Homo Sapiens; identical to SEQ ID NO: 125248

SEQ ID NO: 713204 - RNA, 64 nt, Homo Sapiens; identical to SEQ ID NO: 125249

SEQ ID NO: 713205 - RNA, 64 nt, Homo Sapiens; identical to SEQ ID NO: 125250

SEQ ID NO: 713206 - RNA, 64 nt, Homo Sapiens; identical to SEQ ID NO: 125251

SEQ ID NO: 713207 - RNA, 64 nt, Homo Sapiens; identical to SEQ ID NO: 125252

SEQ ID NO: 713208 - RNA, 64 nt, Homo Sapiens; identical to SEQ ID NO: 125253

SEQ ID NO: 713209 - RNA, 64 nt, Homo Sapiens; identical to SEQ ID NO: 125254

SEQ ID NO: 713210 - RNA, 64 nt, Homo Sapiens; identical to SEQ ID NO: 125255

SEQ ID NO: 713211 - RNA, 64 nt, Homo Sapiens; identical to SEQ ID NO: 125256

SEQ ID NO: 713212 - RNA, 64 nt, Homo Sapiens; identical to SEQ ID NO: 125257

SEQ ID NO: 713213 - RNA, 64 nt, Homo Sapiens; identical to SEQ ID NO: 125258

SEQ ID NO: 713214 - RNA, 64 nt, Homo Sapiens; identical to SEQ ID NO: 125259

SEQ ID NO: 713215 - RNA, 64 nt, Homo Sapiens; identical to SEQ ID NO: 125260

SEQ ID NO: 713216 - RNA, 64 nt, Homo Sapiens; identical to SEQ ID NO: 125261

SEQ ID NO: 713217 - RNA, 64 nt, Homo Sapiens; identical to SEQ ID NO: 125262

SEQ ID NO: 713218 - RNA, 64 nt, Homo Sapiens; identical to SEQ ID NO: 125263

SEQ ID NO: 713219 - RNA, 64 nt, Homo Sapiens; identical to SEQ ID NO: 125264

SEQ ID NO: 713220 - RNA, 64 nt, Homo Sapiens; identical to SEQ ID NO: 125265

SEQ ID NO: 713221 - RNA, 64 nt, Homo Sapiens; identical to SEQ ID NO: 125266

SEQ ID NO: 713222 - RNA, 64 nt, Homo Sapiens; identical to SEQ ID NO: 125267

SEQ ID NO: 713223 - RNA, 64 nt, Homo Sapiens; identical to SEQ ID NO: 125268

SEQ ID NO: 713224 - RNA, 64 nt, Homo Sapiens; identical to SEQ ID NO: 125269

SEQ ID NO: 713225 - RNA, 64 nt, Homo Sapiens; identical to SEQ ID NO: 125270

SEQ ID NO: 713226 - RNA, 64 nt, Homo Sapiens; identical to SEQ ID NO: 125271

SEQ ID NO: 713227 - RNA, 64 nt, Homo Sapiens; identical to SEQ ID NO: 125272

SEQ ID NO: 713228 - RNA, 64 nt, Homo Sapiens; identical to SEQ ID NO: 125273

SEQ ID NO: 713229 - RNA, 64 nt, Homo Sapiens; identical to SEQ ID NO: 125274

SEQ ID NO: 713230 - RNA, 64 nt, Homo Sapiens; identical to SEQ ID NO: 125275

SEQ ID NO: 713231 - RNA, 64 nt, Homo Sapiens; identical to SEQ ID NO: 125276

SEQ ID NO: 713232 - RNA, 64 nt, Homo Sapiens; identical to SEQ ID NO: 125277

SEQ ID NO: 713233 - RNA, 64 nt, Homo Sapiens; identical to SEQ ID NO: 125278

SEQ ID NO: 713234 - RNA, 64 nt, Homo Sapiens; identical to SEQ ID NO: 125279

SEQ ID NO: 713235 - RNA, 63 nt, Homo Sapiens; identical to SEQ ID NO: 125280

SEQ ID NO: 713236 - RNA, 64 nt, Homo Sapiens; identical to SEQ ID NO: 125281

SEQ ID NO: 713237 - RNA, 64 nt, Homo Sapiens; identical to SEQ ID NO: 125282

SEQ ID NO: 713238 - RNA, 64 nt, Homo Sapiens; identical to SEQ ID NO: 125283

SEQ ID NO: 713239 - RNA, 64 nt, Homo Sapiens; identical to SEQ ID NO: 125284

SEQ ID NO: 713240 - RNA, 64 nt, Homo Sapiens; identical to SEQ ID NO: 125285

SEQ ID NO: 713241 - RNA, 64 nt, Homo Sapiens; identical to SEQ ID NO: 125286

SEQ ID NO: 713242 - RNA, 64 nt, Homo Sapiens; identical to SEQ ID NO: 125287

SEQ ID NO: 713243 - RNA, 64 nt, Homo Sapiens; identical to SEQ ID NO: 125288

SEQ ID NO: 713244 - RNA, 64 nt, Homo Sapiens; identical to SEQ ID NO: 125289

SEQ ID NO: 713245 - RNA, 64 nt, Homo Sapiens; identical to SEQ ID NO: 125290

SEQ ID NO: 713246 - RNA, 64 nt, Homo Sapiens; identical to SEQ ID NO: 125291

SEQ ID NO: 713247 - RNA, 64 nt, Homo Sapiens; identical to SEQ ID NO: 125292

SEQ ID NO: 713248 - RNA, 64 nt, Homo Sapiens; identical to SEQ ID NO: 125293

SEQ ID NO: 713249 - RNA, 64 nt, Homo Sapiens; identical to SEQ ID NO: 125294

SEQ ID NO: 713250 - RNA, 64 nt, Homo Sapiens; identical to SEQ ID NO: 125295

SEQ ID NO: 713251 - RNA, 64 nt, Homo Sapiens; identical to SEQ ID NO: 125296

SEQ ID NO: 713252 - RNA, 64 nt, Homo Sapiens; identical to SEQ ID NO: 125297

SEQ ID NO: 713253 - RNA, 64 nt, Homo Sapiens; identical to SEQ ID NO: 606444

SEQ ID NO: 713254 - RNA, 64 nt, Homo Sapiens; identical to SEQ ID NO: 606445

SEQ ID NO: 713255 - RNA, 64 nt, Homo Sapiens; identical to SEQ ID NO: 606446

SEQ ID NO: 713256 - RNA, 64 nt, Homo Sapiens; identical to SEQ ID NO: 606447

SEQ ID NO: 713257 - RNA, 64 nt, Homo Sapiens; identical to SEQ ID NO: 606448

SEQ ID NO: 713258 - RNA, 64 nt, Homo Sapiens; identical to SEQ ID NO: 606449

SEQ ID NO: 713259 - RNA, 64 nt, Homo Sapiens; identical to SEQ ID NO: 606450

SEQ ID NO: 713260 - RNA, 64 nt, Homo Sapiens; identical to SEQ ID NO: 606451

SEQ ID NO: 713261 - RNA, 64 nt, Homo Sapiens; identical to SEQ ID NO: 606452

SEQ ID NO: 713262 - RNA, 64 nt, Homo Sapiens; identical to SEQ ID NO: 606453

SEQ ID NO: 713263 - RNA, 64 nt, Homo Sapiens; identical to SEQ ID NO: 606454

SEQ ID NO: 713264 - RNA, 64 nt, Homo Sapiens; identical to SEQ ID NO: 606455

SEQ ID NO: 713265 - RNA, 64 nt, Homo Sapiens; identical to SEQ ID NO: 606456

SEQ ID NO: 713266 - RNA, 64 nt, Homo Sapiens; identical to SEQ ID NO: 606457

SEQ ID NO: 713267 - RNA, 64 nt, Homo Sapiens; identical to SEQ ID NO: 606458

SEQ ID NO: 713268 - RNA, 64 nt, Homo Sapiens; identical to SEQ ID NO: 606459

SEQ ID NO: 713269 - RNA, 64 nt, Homo Sapiens; identical to SEQ ID NO: 606460

SEQ ID NO: 713270 - RNA, 64 nt, Homo Sapiens; identical to SEQ ID NO: 606461

SEQ ID NO: 713271 - RNA, 64 nt, Homo Sapiens; identical to SEQ ID NO: 606462

SEQ ID NO: 713272 - RNA, 64 nt, Homo Sapiens; identical to SEQ ID NO: 606463

SEQ ID NO: 713273 - RNA, 64 nt, Homo Sapiens; identical to SEQ ID NO: 606464

SEQ ID NO: 713274 - RNA, 64 nt, Homo Sapiens; identical to SEQ ID NO: 606465

SEQ ID NO: 713275 - RNA, 64 nt, Homo Sapiens; identical to SEQ ID NO: 606466

SEQ ID NO: 713276 - RNA, 64 nt, Homo Sapiens; identical to SEQ ID NO: 606467

SEQ ID NO: 713277 - RNA, 64 nt, Homo Sapiens; identical to SEQ ID NO: 606468

SEQ ID NO: 713278 - RNA, 64 nt, Homo Sapiens; identical to SEQ ID NO: 606469

SEQ ID NO: 713279 - RNA, 64 nt, Homo Sapiens; identical to SEQ ID NO: 606470

SEQ ID NO: 713280 - RNA, 64 nt, Homo Sapiens; identical to SEQ ID NO: 606471

SEQ ID NO: 713281 - RNA, 64 nt, Homo Sapiens; identical to SEQ ID NO: 606472

SEQ ID NO: 713282 - RNA, 64 nt, Homo Sapiens; identical to SEQ ID NO: 606473

SEQ ID NO: 713283 - RNA, 64 nt, Homo Sapiens; identical to SEQ ID NO: 606474

SEQ ID NO: 713284 - RNA, 64 nt, Homo Sapiens; identical to SEQ ID NO: 606475

SEQ ID NO: 713285 - RNA, 64 nt, Homo Sapiens; identical to SEQ ID NO: 606476

SEQ ID NO: 713286 - RNA, 64 nt, Homo Sapiens; identical to SEQ ID NO: 606477

SEQ ID NO: 713287 - RNA, 64 nt, Homo Sapiens; identical to SEQ ID NO: 606478

SEQ ID NO: 713288 - RNA, 64 nt, Homo Sapiens; identical to SEQ ID NO: 606479

SEQ ID NO: 713289 - RNA, 64 nt, Homo Sapiens; identical to SEQ ID NO: 421561

SEQ ID NO: 713290 - RNA, 64 nt, Homo Sapiens; identical to SEQ ID NO: 421562

SEQ ID NO: 713291 - RNA, 64 nt, Homo Sapiens; identical to SEQ ID NO: 421563

SEQ ID NO: 713292 - RNA, 64 nt, Homo Sapiens; identical to SEQ ID NO: 421564

SEQ ID NO: 713293 - RNA, 64 nt, Homo Sapiens; identical to SEQ ID NO: 421565

SEQ ID NO: 713294 - RNA, 64 nt, Homo Sapiens; identical to SEQ ID NO: 421566

SEQ ID NO: 713295 - RNA, 64 nt, Homo Sapiens; identical to SEQ ID NO: 421567

SEQ ID NO: 713296 - RNA, 64 nt, Homo Sapiens; identical to SEQ ID NO: 421568

SEQ ID NO: 713297 - RNA, 64 nt, Homo Sapiens; identical to SEQ ID NO: 421569

SEQ ID NO: 713298 - RNA, 64 nt, Homo Sapiens; identical to SEQ ID NO: 421570

SEQ ID NO: 713299 - RNA, 64 nt, Homo Sapiens; identical to SEQ ID NO: 421571

SEQ ID NO: 713300 - RNA, 64 nt, Homo Sapiens; identical to SEQ ID NO: 421572

SEQ ID NO: 713301 - RNA, 64 nt, Homo Sapiens; identical to SEQ ID NO: 421573

SEQ ID NO: 713302 - RNA, 64 nt, Homo Sapiens; identical to SEQ ID NO: 421574

SEQ ID NO: 713303 - RNA, 64 nt, Homo Sapiens; identical to SEQ ID NO: 421575

SEQ ID NO: 713304 - RNA, 64 nt, Homo Sapiens; identical to SEQ ID NO: 421576

SEQ ID NO: 713305 - RNA, 64 nt, Homo Sapiens; identical to SEQ ID NO: 421577

SEQ ID NO: 713306 - RNA, 64 nt, Homo Sapiens; identical to SEQ ID NO: 421578

SEQ ID NO: 713307 - RNA, 64 nt, Homo Sapiens; identical to SEQ ID NO: 421579

SEQ ID NO: 713308 - RNA, 64 nt, Homo Sapiens; identical to SEQ ID NO: 421580

SEQ ID NO: 713309 - RNA, 64 nt, Homo Sapiens; identical to SEQ ID NO: 421581

SEQ ID NO: 713310 - RNA, 64 nt, Homo Sapiens; identical to SEQ ID NO: 421582

SEQ ID NO: 713311 - RNA, 64 nt, Homo Sapiens; identical to SEQ ID NO: 421583

SEQ ID NO: 713312 - RNA, 64 nt, Homo Sapiens; identical to SEQ ID NO: 334708

SEQ ID NO: 713313 - RNA, 64 nt, Homo Sapiens; identical to SEQ ID NO: 334709

SEQ ID NO: 713314 - RNA, 64 nt, Homo Sapiens; identical to SEQ ID NO: 334710

SEQ ID NO: 713315 - RNA, 64 nt, Homo Sapiens; identical to SEQ ID NO: 334711

SEQ ID NO: 713316 - RNA, 64 nt, Homo Sapiens; identical to SEQ ID NO: 334712

SEQ ID NO: 713317 - RNA, 64 nt, Homo Sapiens; identical to SEQ ID NO: 334713

SEQ ID NO: 713318 - RNA, 64 nt, Homo Sapiens; identical to SEQ ID NO: 334714

SEQ ID NO: 713319 - RNA, 64 nt, Homo Sapiens; identical to SEQ ID NO: 334715

SEQ ID NO: 713320 - RNA, 64 nt, Homo Sapiens; identical to SEQ ID NO: 334716

SEQ ID NO: 713321 - RNA, 64 nt, Homo Sapiens; identical to SEQ ID NO: 334717

SEQ ID NO: 713322 - RNA, 64 nt, Homo Sapiens; identical to SEQ ID NO: 334718

SEQ ID NO: 713323 - RNA, 64 nt, Homo Sapiens; identical to SEQ ID NO: 334719

SEQ ID NO: 713324 - RNA, 64 nt, Homo Sapiens; identical to SEQ ID NO: 334720

SEQ ID NO: 713325 - RNA, 64 nt, Homo Sapiens; identical to SEQ ID NO: 334721

SEQ ID NO: 713326 - RNA, 64 nt, Homo Sapiens; identical to SEQ ID NO: 334722

SEQ ID NO: 713327 - RNA, 64 nt, Homo Sapiens; identical to SEQ ID NO: 334723

SEQ ID NO: 713328 - RNA, 64 nt, Homo Sapiens; identical to SEQ ID NO: 334724

SEQ ID NO: 713329 - RNA, 64 nt, Homo Sapiens; identical to SEQ ID NO: 334725

SEQ ID NO: 713330 - RNA, 64 nt, Homo Sapiens; identical to SEQ ID NO: 334726

SEQ ID NO: 713331 - RNA, 64 nt, Homo Sapiens; identical to SEQ ID NO: 334727

SEQ ID NO: 713332 - RNA, 64 nt, Homo Sapiens; identical to SEQ ID NO: 334728

SEQ ID NO: 713333 - RNA, 64 nt, Homo Sapiens; identical to SEQ ID NO: 334729

SEQ ID NO: 713334 - RNA, 64 nt, Homo Sapiens; identical to SEQ ID NO: 334730

SEQ ID NO: 713335 - RNA, 64 nt, Homo Sapiens; identical to SEQ ID NO: 334731

SEQ ID NO: 713336 - RNA, 64 nt, Homo Sapiens; identical to SEQ ID NO: 334732

SEQ ID NO: 713337 - RNA, 64 nt, Homo Sapiens; identical to SEQ ID NO: 334733

SEQ ID NO: 713338 - RNA, 64 nt, Homo Sapiens; identical to SEQ ID NO: 334734

SEQ ID NO: 713339 - RNA, 64 nt, Homo Sapiens; identical to SEQ ID NO: 334735

SEQ ID NO: 713340 - RNA, 64 nt, Homo Sapiens; identical to SEQ ID NO: 334736

SEQ ID NO: 713341 - RNA, 64 nt, Homo Sapiens; identical to SEQ ID NO: 334737

SEQ ID NO: 713342 - RNA, 64 nt, Homo Sapiens; identical to SEQ ID NO: 334738

SEQ ID NO: 713343 - RNA, 64 nt, Homo Sapiens; identical to SEQ ID NO: 334739

SEQ ID NO: 713344 - RNA, 64 nt, Homo Sapiens; identical to SEQ ID NO: 334740

SEQ ID NO: 713345 - RNA, 64 nt, Homo Sapiens; identical to SEQ ID NO: 334741

SEQ ID NO: 713346 - RNA, 64 nt, Homo Sapiens; identical to SEQ ID NO: 334742

SEQ ID NO: 713347 - RNA, 64 nt, Homo Sapiens; identical to SEQ ID NO: 334743

SEQ ID NO: 713348 - RNA, 64 nt, Homo Sapiens; identical to SEQ ID NO: 334744

SEQ ID NO: 713349 - RNA, 64 nt, Homo Sapiens; identical to SEQ ID NO: 334745

SEQ ID NO: 713350 - RNA, 64 nt, Homo Sapiens; identical to SEQ ID NO: 334746

SEQ ID NO: 713351 - RNA, 64 nt, Homo Sapiens; identical to SEQ ID NO: 334747

SEQ ID NO: 713352 - RNA, 64 nt, Homo Sapiens; identical to SEQ ID NO: 334748

SEQ ID NO: 713353 - RNA, 64 nt, Homo Sapiens; identical to SEQ ID NO: 334749

SEQ ID NO: 713354 - RNA, 64 nt, Homo Sapiens; identical to SEQ ID NO: 334750

SEQ ID NO: 713355 - RNA, 64 nt, Homo Sapiens; identical to SEQ ID NO: 334751

SEQ ID NO: 713356 - RNA, 64 nt, Homo Sapiens; identical to SEQ ID NO: 334752

SEQ ID NO: 713357 - RNA, 64 nt, Homo Sapiens; identical to SEQ ID NO: 334753

SEQ ID NO: 713358 - RNA, 64 nt, Homo Sapiens; identical to SEQ ID NO: 334754

SEQ ID NO: 713359 - RNA, 64 nt, Homo Sapiens; identical to SEQ ID NO: 334755

SEQ ID NO: 713360 - RNA, 64 nt, Homo Sapiens; identical to SEQ ID NO: 334756

SEQ ID NO: 713361 - RNA, 64 nt, Homo Sapiens; identical to SEQ ID NO: 334757

SEQ ID NO: 713362 - RNA, 64 nt, Homo Sapiens; identical to SEQ ID NO: 334758

SEQ ID NO: 713363 - RNA, 64 nt, Homo Sapiens; identical to SEQ ID NO: 334759

SEQ ID NO: 713364 - RNA, 64 nt, Homo Sapiens; identical to SEQ ID NO: 334760

SEQ ID NO: 713365 - RNA, 64 nt, Homo Sapiens; identical to SEQ ID NO: 334761

SEQ ID NO: 713366 - RNA, 64 nt, Homo Sapiens; identical to SEQ ID NO: 334762

SEQ ID NO: 713367 - RNA, 64 nt, Homo Sapiens; identical to SEQ ID NO: 334763

SEQ ID NO: 713368 - RNA, 64 nt, Homo Sapiens; identical to SEQ ID NO: 334764

SEQ ID NO: 713369 - RNA, 64 nt, Homo Sapiens; identical to SEQ ID NO: 334765

SEQ ID NO: 713370 - RNA, 64 nt, Homo Sapiens; identical to SEQ ID NO: 334766

SEQ ID NO: 713371 - RNA, 64 nt, Homo Sapiens; identical to SEQ ID NO: 334767

SEQ ID NO: 713372 - RNA, 64 nt, Homo Sapiens; identical to SEQ ID NO: 334768

SEQ ID NO: 713373 - RNA, 64 nt, Homo Sapiens; identical to SEQ ID NO: 334769

SEQ ID NO: 713374 - RNA, 64 nt, Homo Sapiens; identical to SEQ ID NO: 334770

SEQ ID NO: 713375 - RNA, 64 nt, Homo Sapiens; identical to SEQ ID NO: 334771

SEQ ID NO: 713376 - RNA, 64 nt, Homo Sapiens; identical to SEQ ID NO: 334772

SEQ ID NO: 713377 - RNA, 64 nt, Homo Sapiens; identical to SEQ ID NO: 348598

SEQ ID NO: 713378 - RNA, 64 nt, Homo Sapiens; identical to SEQ ID NO: 348599

SEQ ID NO: 713379 - RNA, 64 nt, Homo Sapiens; identical to SEQ ID NO: 348600

SEQ ID NO: 713380 - RNA, 64 nt, Homo Sapiens; identical to SEQ ID NO: 348601

SEQ ID NO: 713381 - RNA, 64 nt, Homo Sapiens; identical to SEQ ID NO: 348602

SEQ ID NO: 713382 - RNA, 64 nt, Homo Sapiens; identical to SEQ ID NO: 348603

SEQ ID NO: 713383 - RNA, 64 nt, Homo Sapiens; identical to SEQ ID NO: 348604

SEQ ID NO: 713384 - RNA, 64 nt, Homo Sapiens; identical to SEQ ID NO: 348605

SEQ ID NO: 713385 - RNA, 64 nt, Homo Sapiens; identical to SEQ ID NO: 348606

SEQ ID NO: 713386 - RNA, 64 nt, Homo Sapiens; identical to SEQ ID NO: 348607

SEQ ID NO: 713387 - RNA, 64 nt, Homo Sapiens; identical to SEQ ID NO: 348608

SEQ ID NO: 713388 - RNA, 64 nt, Homo Sapiens; identical to SEQ ID NO: 348609

SEQ ID NO: 713389 - RNA, 64 nt, Homo Sapiens; identical to SEQ ID NO: 348610

SEQ ID NO: 713390 - RNA, 64 nt, Homo Sapiens; identical to SEQ ID NO: 348611

SEQ ID NO: 713391 - RNA, 64 nt, Homo Sapiens; identical to SEQ ID NO: 348612

SEQ ID NO: 713392 - RNA, 64 nt, Homo Sapiens; identical to SEQ ID NO: 348613

SEQ ID NO: 713393 - RNA, 64 nt, Homo Sapiens; identical to SEQ ID NO: 348614

SEQ ID NO: 713394 - RNA, 64 nt, Homo Sapiens; identical to SEQ ID NO: 348615

SEQ ID NO: 713395 - RNA, 64 nt, Homo Sapiens; identical to SEQ ID NO: 348616

SEQ ID NO: 713396 - RNA, 64 nt, Homo Sapiens; identical to SEQ ID NO: 348617

SEQ ID NO: 713397 - RNA, 64 nt, Homo Sapiens
cucaagcuuuacugacuucaauuaucuguuuuuaaagacguagaagauuuauuuaauuugauau

SEQ ID NO: 713398 - RNA, 64 nt, Homo Sapiens
gaaaaggauuuuauuauccuuaggaaugucauccaagacguagagcuugaaugugacguuauuu

SEQ ID NO: 713399 - RNA, 64 nt, Homo Sapiens; identical to SEQ ID NO: 391843

SEQ ID NO: 713400 - RNA, 64 nt, Homo Sapiens; identical to SEQ ID NO: 391844

SEQ ID NO: 713401 - RNA, 64 nt, Homo Sapiens; identical to SEQ ID NO: 391845

SEQ ID NO: 713402 - RNA, 64 nt, Homo Sapiens; identical to SEQ ID NO: 391846

SEQ ID NO: 713403 - RNA, 64 nt, Homo Sapiens; identical to SEQ ID NO: 391847

SEQ ID NO: 713404 - RNA, 64 nt, Homo Sapiens; identical to SEQ ID NO: 391848

SEQ ID NO: 713405 - RNA, 64 nt, Homo Sapiens; identical to SEQ ID NO: 391849

SEQ ID NO: 713406 - RNA, 64 nt, Homo Sapiens; identical to SEQ ID NO: 391850

SEQ ID NO: 713407 - RNA, 64 nt, Homo Sapiens; identical to SEQ ID NO: 391851

SEQ ID NO: 713408 - RNA, 64 nt, Homo Sapiens; identical to SEQ ID NO: 391852

SEQ ID NO: 713409 - RNA, 64 nt, Homo Sapiens; identical to SEQ ID NO: 391853

SEQ ID NO: 713410 - RNA, 64 nt, Homo Sapiens; identical to SEQ ID NO: 391854

SEQ ID NO: 713411 - RNA, 64 nt, Homo Sapiens; identical to SEQ ID NO: 118026

SEQ ID NO: 713412 - RNA, 64 nt, Homo Sapiens; identical to SEQ ID NO: 118027

SEQ ID NO: 713413 - RNA, 64 nt, Homo Sapiens; identical to SEQ ID NO: 118028

SEQ ID NO: 713414 - RNA, 64 nt, Homo Sapiens; identical to SEQ ID NO: 118029

SEQ ID NO: 713415 - RNA, 64 nt, Homo Sapiens; identical to SEQ ID NO: 118030

SEQ ID NO: 713416 - RNA, 64 nt, Homo Sapiens; identical to SEQ ID NO: 118031

SEQ ID NO: 713417 - RNA, 64 nt, Homo Sapiens; identical to SEQ ID NO: 118032

SEQ ID NO: 713418 - RNA, 64 nt, Homo Sapiens; identical to SEQ ID NO: 118033

SEQ ID NO: 713419 - RNA, 64 nt, Homo Sapiens; identical to SEQ ID NO: 118034

SEQ ID NO: 713420 - RNA, 64 nt, Homo Sapiens; identical to SEQ ID NO: 118035

SEQ ID NO: 713421 - RNA, 64 nt, Homo Sapiens; identical to SEQ ID NO: 118036

SEQ ID NO: 713422 - RNA, 64 nt, Homo Sapiens; identical to SEQ ID NO: 118037

SEQ ID NO: 713423 - RNA, 64 nt, Homo Sapiens; identical to SEQ ID NO: 118038

SEQ ID NO: 713424 - RNA, 64 nt, Homo Sapiens; identical to SEQ ID NO: 118039

SEQ ID NO: 713425 - RNA, 64 nt, Homo Sapiens; identical to SEQ ID NO: 118040

SEQ ID NO: 713426 - RNA, 64 nt, Homo Sapiens; identical to SEQ ID NO: 118041

SEQ ID NO: 713427 - RNA, 64 nt, Homo Sapiens; identical to SEQ ID NO: 118042

SEQ ID NO: 713428 - RNA, 64 nt, Homo Sapiens; identical to SEQ ID NO: 118043

SEQ ID NO: 713429 - RNA, 64 nt, Homo Sapiens; identical to SEQ ID NO: 118044

SEQ ID NO: 713430 - RNA, 64 nt, Homo Sapiens; identical to SEQ ID NO: 118045

SEQ ID NO: 713431 - RNA, 64 nt, Homo Sapiens; identical to SEQ ID NO: 118046

SEQ ID NO: 713432 - RNA, 64 nt, Homo Sapiens; identical to SEQ ID NO: 118047

SEQ ID NO: 713433 - RNA, 64 nt, Homo Sapiens; identical to SEQ ID NO: 118048

SEQ ID NO: 713434 - RNA, 64 nt, Homo Sapiens; identical to SEQ ID NO: 118049

SEQ ID NO: 713435 - RNA, 64 nt, Homo Sapiens; identical to SEQ ID NO: 118050

SEQ ID NO: 713436 - RNA, 64 nt, Homo Sapiens; identical to SEQ ID NO: 118051

SEQ ID NO: 713437 - RNA, 64 nt, Homo Sapiens; identical to SEQ ID NO: 118052

SEQ ID NO: 713438 - RNA, 64 nt, Homo Sapiens; identical to SEQ ID NO: 118053

SEQ ID NO: 713439 - RNA, 64 nt, Homo Sapiens; identical to SEQ ID NO: 118054

SEQ ID NO: 713440 - RNA, 64 nt, Homo Sapiens; identical to SEQ ID NO: 118055

SEQ ID NO: 713441 - RNA, 64 nt, Homo Sapiens; identical to SEQ ID NO: 118056

SEQ ID NO: 713442 - RNA, 64 nt, Homo Sapiens; identical to SEQ ID NO: 118057

SEQ ID NO: 713443 - RNA, 64 nt, Homo Sapiens; identical to SEQ ID NO: 118058

SEQ ID NO: 713444 - RNA, 64 nt, Homo Sapiens; identical to SEQ ID NO: 118059

SEQ ID NO: 713445 - RNA, 64 nt, Homo Sapiens; identical to SEQ ID NO: 118060

SEQ ID NO: 713446 - RNA, 64 nt, Homo Sapiens; identical to SEQ ID NO: 118061

SEQ ID NO: 713447 - RNA, 64 nt, Homo Sapiens; identical to SEQ ID NO: 118062

SEQ ID NO: 713448 - RNA, 64 nt, Homo Sapiens; identical to SEQ ID NO: 118063

SEQ ID NO: 713449 - RNA, 64 nt, Homo Sapiens; identical to SEQ ID NO: 118064

SEQ ID NO: 713450 - RNA, 64 nt, Homo Sapiens; identical to SEQ ID NO: 118065

SEQ ID NO: 713451 - RNA, 64 nt, Homo Sapiens; identical to SEQ ID NO: 118066

SEQ ID NO: 713452 - RNA, 64 nt, Homo Sapiens; identical to SEQ ID NO: 291116

SEQ ID NO: 713453 - RNA, 64 nt, Homo Sapiens; identical to SEQ ID NO: 291117

SEQ ID NO: 713454 - RNA, 64 nt, Homo Sapiens; identical to SEQ ID NO: 291118

SEQ ID NO: 713455 - RNA, 64 nt, Homo Sapiens; identical to SEQ ID NO: 291119

SEQ ID NO: 713456 - RNA, 62 nt, Homo Sapiens; identical to SEQ ID NO: 291120

SEQ ID NO: 713457 - RNA, 64 nt, Homo Sapiens; identical to SEQ ID NO: 291121

SEQ ID NO: 713458 - RNA, 64 nt, Homo Sapiens; identical to SEQ ID NO: 291122

SEQ ID NO: 713459 - RNA, 64 nt, Homo Sapiens; identical to SEQ ID NO: 291123

SEQ ID NO: 713460 - RNA, 64 nt, Homo Sapiens; identical to SEQ ID NO: 291124

SEQ ID NO: 713461 - RNA, 64 nt, Homo Sapiens; identical to SEQ ID NO: 291125

SEQ ID NO: 713462 - RNA, 64 nt, Homo Sapiens; identical to SEQ ID NO: 291126

SEQ ID NO: 713463 - RNA, 64 nt, Homo Sapiens; identical to SEQ ID NO: 291127

SEQ ID NO: 713464 - RNA, 64 nt, Homo Sapiens; identical to SEQ ID NO: 291128

SEQ ID NO: 713465 - RNA, 64 nt, Homo Sapiens; identical to SEQ ID NO: 291129

SEQ ID NO: 713466 - RNA, 64 nt, Homo Sapiens; identical to SEQ ID NO: 291130

SEQ ID NO: 713467 - RNA, 64 nt, Homo Sapiens; identical to SEQ ID NO: 291131

SEQ ID NO: 713468 - RNA, 64 nt, Homo Sapiens; identical to SEQ ID NO: 291132

SEQ ID NO: 713469 - RNA, 64 nt, Homo Sapiens; identical to SEQ ID NO: 291133

SEQ ID NO: 713470 - RNA, 64 nt, Homo Sapiens; identical to SEQ ID NO: 291134

SEQ ID NO: 713471 - RNA, 64 nt, Homo Sapiens; identical to SEQ ID NO: 291135

SEQ ID NO: 713472 - RNA, 64 nt, Homo Sapiens; identical to SEQ ID NO: 291136

SEQ ID NO: 713473 - RNA, 64 nt, Homo Sapiens; identical to SEQ ID NO: 291137

SEQ ID NO: 713474 - RNA, 64 nt, Homo Sapiens; identical to SEQ ID NO: 291138

SEQ ID NO: 713475 - RNA, 64 nt, Homo Sapiens; identical to SEQ ID NO: 291139

SEQ ID NO: 713476 - RNA, 64 nt, Homo Sapiens; identical to SEQ ID NO: 291140

SEQ ID NO: 713477 - RNA, 64 nt, Homo Sapiens; identical to SEQ ID NO: 291141

SEQ ID NO: 713478 - RNA, 64 nt, Homo Sapiens; identical to SEQ ID NO: 291142

SEQ ID NO: 713479 - RNA, 64 nt, Homo Sapiens; identical to SEQ ID NO: 291143

SEQ ID NO: 713480 - RNA, 64 nt, Homo Sapiens; identical to SEQ ID NO: 291144

SEQ ID NO: 713481 - RNA, 64 nt, Homo Sapiens; identical to SEQ ID NO: 291145

SEQ ID NO: 713482 - RNA, 64 nt, Homo Sapiens; identical to SEQ ID NO: 291146

SEQ ID NO: 713483 - RNA, 64 nt, Homo Sapiens; identical to SEQ ID NO: 291147

SEQ ID NO: 713484 - RNA, 64 nt, Homo Sapiens; identical to SEQ ID NO: 291148

SEQ ID NO: 713485 - RNA, 64 nt, Homo Sapiens; identical to SEQ ID NO: 291149

SEQ ID NO: 713486 - RNA, 64 nt, Homo Sapiens; identical to SEQ ID NO: 58312

SEQ ID NO: 713487 - RNA, 64 nt, Homo Sapiens; identical to SEQ ID NO: 58313

SEQ ID NO: 713488 - RNA, 64 nt, Homo Sapiens; identical to SEQ ID NO: 58314

SEQ ID NO: 713489 - RNA, 64 nt, Homo Sapiens; identical to SEQ ID NO: 58315

SEQ ID NO: 713490 - RNA, 64 nt, Homo Sapiens; identical to SEQ ID NO: 58316

SEQ ID NO: 713491 - RNA, 64 nt, Homo Sapiens; identical to SEQ ID NO: 58317

SEQ ID NO: 713492 - RNA, 64 nt, Homo Sapiens; identical to SEQ ID NO: 58318

SEQ ID NO: 713493 - RNA, 64 nt, Homo Sapiens; identical to SEQ ID NO: 58319

SEQ ID NO: 713494 - RNA, 64 nt, Homo Sapiens; identical to SEQ ID NO: 58320

SEQ ID NO: 713495 - RNA, 64 nt, Homo Sapiens; identical to SEQ ID NO: 58321

SEQ ID NO: 713496 - RNA, 64 nt, Homo Sapiens; identical to SEQ ID NO: 58322

SEQ ID NO: 713497 - RNA, 64 nt, Homo Sapiens; identical to SEQ ID NO: 58323

SEQ ID NO: 713498 - RNA, 64 nt, Homo Sapiens; identical to SEQ ID NO: 58324

SEQ ID NO: 713499 - RNA, 64 nt, Homo Sapiens; identical to SEQ ID NO: 58325

SEQ ID NO: 713500 - RNA, 64 nt, Homo Sapiens; identical to SEQ ID NO: 58326

SEQ ID NO: 713501 - RNA, 64 nt, Homo Sapiens; identical to SEQ ID NO: 58327

SEQ ID NO: 713502 - RNA, 64 nt, Homo Sapiens; identical to SEQ ID NO: 58328

SEQ ID NO: 713503 - RNA, 64 nt, Homo Sapiens; identical to SEQ ID NO: 58329

SEQ ID NO: 713504 - RNA, 64 nt, Homo Sapiens; identical to SEQ ID NO: 58330

SEQ ID NO: 713505 - RNA, 64 nt, Homo Sapiens; identical to SEQ ID NO: 58331

SEQ ID NO: 713506 - RNA, 64 nt, Homo Sapiens; identical to SEQ ID NO: 58332

SEQ ID NO: 713507 - RNA, 64 nt, Homo Sapiens; identical to SEQ ID NO: 58333

SEQ ID NO: 713508 - RNA, 64 nt, Homo Sapiens; identical to SEQ ID NO: 58334

SEQ ID NO: 713509 - RNA, 64 nt, Homo Sapiens; identical to SEQ ID NO: 58335

SEQ ID NO: 713510 - RNA, 64 nt, Homo Sapiens; identical to SEQ ID NO: 58336

SEQ ID NO: 713511 - RNA, 64 nt, Homo Sapiens; identical to SEQ ID NO: 58337

SEQ ID NO: 713512 - RNA, 64 nt, Homo Sapiens; identical to SEQ ID NO: 58338

SEQ ID NO: 713513 - RNA, 64 nt, Homo Sapiens; identical to SEQ ID NO: 58339

SEQ ID NO: 713514 - RNA, 64 nt, Homo Sapiens; identical to SEQ ID NO: 58340

SEQ ID NO: 713515 - RNA, 64 nt, Homo Sapiens; identical to SEQ ID NO: 58341

SEQ ID NO: 713516 - RNA, 64 nt, Homo Sapiens; identical to SEQ ID NO: 58342

SEQ ID NO: 713517 - RNA, 64 nt, Homo Sapiens; identical to SEQ ID NO: 58343

SEQ ID NO: 713518 - RNA, 64 nt, Homo Sapiens; identical to SEQ ID NO: 58344

SEQ ID NO: 713519 - RNA, 64 nt, Homo Sapiens; identical to SEQ ID NO: 58345

SEQ ID NO: 713520 - RNA, 64 nt, Homo Sapiens; identical to SEQ ID NO: 58346

SEQ ID NO: 713521 - RNA, 64 nt, Homo Sapiens; identical to SEQ ID NO: 58347

SEQ ID NO: 713522 - RNA, 64 nt, Homo Sapiens; identical to SEQ ID NO: 58348

SEQ ID NO: 713523 - RNA, 64 nt, Homo Sapiens; identical to SEQ ID NO: 58349

SEQ ID NO: 713524 - RNA, 64 nt, Homo Sapiens; identical to SEQ ID NO: 58350

SEQ ID NO: 713525 - RNA, 64 nt, Homo Sapiens; identical to SEQ ID NO: 58351

SEQ ID NO: 713526 - RNA, 64 nt, Homo Sapiens; identical to SEQ ID NO: 58352

SEQ ID NO: 713527 - RNA, 64 nt, Homo Sapiens; identical to SEQ ID NO: 58353

SEQ ID NO: 713528 - RNA, 64 nt, Homo Sapiens; identical to SEQ ID NO: 58354

SEQ ID NO: 713529 - RNA, 64 nt, Homo Sapiens; identical to SEQ ID NO: 58355

SEQ ID NO: 713530 - RNA, 64 nt, Homo Sapiens; identical to SEQ ID NO: 58356

SEQ ID NO: 713531 - RNA, 64 nt, Homo Sapiens; identical to SEQ ID NO: 58357

SEQ ID NO: 713532 - RNA, 64 nt, Homo Sapiens; identical to SEQ ID NO: 58358

SEQ ID NO: 713533 - RNA, 64 nt, Homo Sapiens; identical to SEQ ID NO: 58359

SEQ ID NO: 713534 - RNA, 64 nt, Homo Sapiens; identical to SEQ ID NO: 58360

SEQ ID NO: 713535 - RNA, 64 nt, Homo Sapiens; identical to SEQ ID NO: 58361

SEQ ID NO: 713536 - RNA, 64 nt, Homo Sapiens; identical to SEQ ID NO: 58362

SEQ ID NO: 713537 - RNA, 64 nt, Homo Sapiens; identical to SEQ ID NO: 58363

SEQ ID NO: 713538 - RNA, 64 nt, Homo Sapiens; identical to SEQ ID NO: 58364

SEQ ID NO: 713539 - RNA, 64 nt, Homo Sapiens; identical to SEQ ID NO: 58365

SEQ ID NO: 713540 - RNA, 64 nt, Homo Sapiens; identical to SEQ ID NO: 58366

SEQ ID NO: 713541 - RNA, 64 nt, Homo Sapiens; identical to SEQ ID NO: 58367

SEQ ID NO: 713542 - RNA, 64 nt, Homo Sapiens; identical to SEQ ID NO: 58368

SEQ ID NO: 713543 - RNA, 64 nt, Homo Sapiens; identical to SEQ ID NO: 58369

SEQ ID NO: 713544 - RNA, 64 nt, Homo Sapiens; identical to SEQ ID NO: 58370

SEQ ID NO: 713545 - RNA, 64 nt, Homo Sapiens; identical to SEQ ID NO: 58371

SEQ ID NO: 713546 - RNA, 64 nt, Homo Sapiens; identical to SEQ ID NO: 58372

SEQ ID NO: 713547 - RNA, 64 nt, Homo Sapiens; identical to SEQ ID NO: 58373

SEQ ID NO: 713548 - RNA, 64 nt, Homo Sapiens; identical to SEQ ID NO: 58374

SEQ ID NO: 713549 - RNA, 64 nt, Homo Sapiens; identical to SEQ ID NO: 58375

SEQ ID NO: 713550 - RNA, 64 nt, Homo Sapiens; identical to SEQ ID NO: 58376

SEQ ID NO: 713551 - RNA, 64 nt, Homo Sapiens; identical to SEQ ID NO: 58377

SEQ ID NO: 713552 - RNA, 64 nt, Homo Sapiens; identical to SEQ ID NO: 58378

SEQ ID NO: 713553 - RNA, 64 nt, Homo Sapiens; identical to SEQ ID NO: 58379

SEQ ID NO: 713554 - RNA, 64 nt, Homo Sapiens; identical to SEQ ID NO: 58380

SEQ ID NO: 713555 - RNA, 64 nt, Homo Sapiens; identical to SEQ ID NO: 58381

SEQ ID NO: 713556 - RNA, 64 nt, Homo Sapiens; identical to SEQ ID NO: 58382

SEQ ID NO: 713557 - RNA, 64 nt, Homo Sapiens; identical to SEQ ID NO: 58383

SEQ ID NO: 713558 - RNA, 64 nt, Homo Sapiens; identical to SEQ ID NO: 58384

SEQ ID NO: 713559 - RNA, 64 nt, Homo Sapiens; identical to SEQ ID NO: 58385

SEQ ID NO: 713560 - RNA, 64 nt, Homo Sapiens; identical to SEQ ID NO: 58386

SEQ ID NO: 713561 - RNA, 64 nt, Homo Sapiens; identical to SEQ ID NO: 58387

SEQ ID NO: 713562 - RNA, 64 nt, Homo Sapiens; identical to SEQ ID NO: 58388

SEQ ID NO: 713563 - RNA, 64 nt, Homo Sapiens; identical to SEQ ID NO: 58389

SEQ ID NO: 713564 - RNA, 64 nt, Homo Sapiens; identical to SEQ ID NO: 58390

SEQ ID NO: 713565 - RNA, 64 nt, Homo Sapiens; identical to SEQ ID NO: 58391

SEQ ID NO: 713566 - RNA, 64 nt, Homo Sapiens; identical to SEQ ID NO: 58392

SEQ ID NO: 713567 - RNA, 64 nt, Homo Sapiens; identical to SEQ ID NO: 58393

SEQ ID NO: 713568 - RNA, 64 nt, Homo Sapiens; identical to SEQ ID NO: 58394

SEQ ID NO: 713569 - RNA, 64 nt, Homo Sapiens; identical to SEQ ID NO: 58395

SEQ ID NO: 713570 - RNA, 64 nt, Homo Sapiens; identical to SEQ ID NO: 58396

SEQ ID NO: 713571 - RNA, 64 nt, Homo Sapiens; identical to SEQ ID NO: 58397

SEQ ID NO: 713572 - RNA, 64 nt, Homo Sapiens; identical to SEQ ID NO: 58398

SEQ ID NO: 713573 - RNA, 64 nt, Homo Sapiens; identical to SEQ ID NO: 58399

SEQ ID NO: 713574 - RNA, 64 nt, Homo Sapiens; identical to SEQ ID NO: 58400

SEQ ID NO: 713575 - RNA, 64 nt, Homo Sapiens; identical to SEQ ID NO: 58401

SEQ ID NO: 713576 - RNA, 64 nt, Homo Sapiens; identical to SEQ ID NO: 58402

SEQ ID NO: 713577 - RNA, 64 nt, Homo Sapiens; identical to SEQ ID NO: 58403

SEQ ID NO: 713578 - RNA, 64 nt, Homo Sapiens; identical to SEQ ID NO: 58404

SEQ ID NO: 713579 - RNA, 64 nt, Homo Sapiens; identical to SEQ ID NO: 58405

SEQ ID NO: 713580 - RNA, 64 nt, Homo Sapiens; identical to SEQ ID NO: 58406

SEQ ID NO: 713581 - RNA, 64 nt, Homo Sapiens; identical to SEQ ID NO: 58407

SEQ ID NO: 713582 - RNA, 64 nt, Homo Sapiens; identical to SEQ ID NO: 58408

SEQ ID NO: 713583 - RNA, 64 nt, Homo Sapiens; identical to SEQ ID NO: 58409

SEQ ID NO: 713584 - RNA, 64 nt, Homo Sapiens; identical to SEQ ID NO: 58410

SEQ ID NO: 713585 - RNA, 64 nt, Homo Sapiens; identical to SEQ ID NO: 58411

SEQ ID NO: 713586 - RNA, 64 nt, Homo Sapiens; identical to SEQ ID NO: 58412

SEQ ID NO: 713587 - RNA, 64 nt, Homo Sapiens; identical to SEQ ID NO: 58413

SEQ ID NO: 713588 - RNA, 64 nt, Homo Sapiens; identical to SEQ ID NO: 58414

SEQ ID NO: 713589 - RNA, 64 nt, Homo Sapiens; identical to SEQ ID NO: 58415

SEQ ID NO: 713590 - RNA, 64 nt, Homo Sapiens; identical to SEQ ID NO: 58416

SEQ ID NO: 713591 - RNA, 64 nt, Homo Sapiens; identical to SEQ ID NO: 58417

SEQ ID NO: 713592 - RNA, 64 nt, Homo Sapiens; identical to SEQ ID NO: 58418

SEQ ID NO: 713593 - RNA, 64 nt, Homo Sapiens; identical to SEQ ID NO: 58419

SEQ ID NO: 713594 - RNA, 64 nt, Homo Sapiens; identical to SEQ ID NO: 58420

SEQ ID NO: 713595 - RNA, 64 nt, Homo Sapiens; identical to SEQ ID NO: 58421

SEQ ID NO: 713596 - RNA, 64 nt, Homo Sapiens; identical to SEQ ID NO: 58422

SEQ ID NO: 713597 - RNA, 64 nt, Homo Sapiens; identical to SEQ ID NO: 58423

SEQ ID NO: 713598 - RNA, 64 nt, Homo Sapiens; identical to SEQ ID NO: 58424

SEQ ID NO: 713599 - RNA, 64 nt, Homo Sapiens; identical to SEQ ID NO: 58425

SEQ ID NO: 713600 - RNA, 64 nt, Homo Sapiens; identical to SEQ ID NO: 58426

SEQ ID NO: 713601 - RNA, 64 nt, Homo Sapiens; identical to SEQ ID NO: 58427

SEQ ID NO: 713602 - RNA, 64 nt, Homo Sapiens; identical to SEQ ID NO: 58428

SEQ ID NO: 713603 - RNA, 64 nt, Homo Sapiens; identical to SEQ ID NO: 58429

SEQ ID NO: 713604 - RNA, 64 nt, Homo Sapiens; identical to SEQ ID NO: 58430

SEQ ID NO: 713605 - RNA, 64 nt, Homo Sapiens; identical to SEQ ID NO: 58431

SEQ ID NO: 713606 - RNA, 64 nt, Homo Sapiens; identical to SEQ ID NO: 58432

SEQ ID NO: 713607 - RNA, 64 nt, Homo Sapiens; identical to SEQ ID NO: 58433

SEQ ID NO: 713608 - RNA, 64 nt, Homo Sapiens; identical to SEQ ID NO: 58434

SEQ ID NO: 713609 - RNA, 64 nt, Homo Sapiens; identical to SEQ ID NO: 58435

SEQ ID NO: 713610 - RNA, 50 nt, Homo Sapiens; identical to SEQ ID NO: 58436

SEQ ID NO: 713611 - RNA, 64 nt, Homo Sapiens; identical to SEQ ID NO: 58437

SEQ ID NO: 713612 - RNA, 64 nt, Homo Sapiens; identical to SEQ ID NO: 58438

SEQ ID NO: 713613 - RNA, 64 nt, Homo Sapiens; identical to SEQ ID NO: 58439

SEQ ID NO: 713614 - RNA, 64 nt, Homo Sapiens; identical to SEQ ID NO: 58440

SEQ ID NO: 713615 - RNA, 64 nt, Homo Sapiens; identical to SEQ ID NO: 58441

SEQ ID NO: 713616 - RNA, 64 nt, Homo Sapiens; identical to SEQ ID NO: 58442

SEQ ID NO: 713617 - RNA, 64 nt, Homo Sapiens; identical to SEQ ID NO: 58443

SEQ ID NO: 713618 - RNA, 64 nt, Homo Sapiens; identical to SEQ ID NO: 58444

SEQ ID NO: 713619 - RNA, 64 nt, Homo Sapiens; identical to SEQ ID NO: 58445

SEQ ID NO: 713620 - RNA, 64 nt, Homo Sapiens; identical to SEQ ID NO: 58446

SEQ ID NO: 713621 - RNA, 64 nt, Homo Sapiens; identical to SEQ ID NO: 58447

SEQ ID NO: 713622 - RNA, 64 nt, Homo Sapiens; identical to SEQ ID NO: 58448

SEQ ID NO: 713623 - RNA, 64 nt, Homo Sapiens; identical to SEQ ID NO: 58449

SEQ ID NO: 713624 - RNA, 64 nt, Homo Sapiens; identical to SEQ ID NO: 58450

SEQ ID NO: 713625 - RNA, 64 nt, Homo Sapiens; identical to SEQ ID NO: 58451

SEQ ID NO: 713626 - RNA, 64 nt, Homo Sapiens; identical to SEQ ID NO: 58452

SEQ ID NO: 713627 - RNA, 64 nt, Homo Sapiens; identical to SEQ ID NO: 58453

SEQ ID NO: 713628 - RNA, 64 nt, Homo Sapiens; identical to SEQ ID NO: 58454

SEQ ID NO: 713629 - RNA, 64 nt, Homo Sapiens; identical to SEQ ID NO: 58455

SEQ ID NO: 713630 - RNA, 64 nt, Homo Sapiens; identical to SEQ ID NO: 58456

SEQ ID NO: 713631 - RNA, 64 nt, Homo Sapiens; identical to SEQ ID NO: 58457

SEQ ID NO: 713632 - RNA, 64 nt, Homo Sapiens; identical to SEQ ID NO: 58458

SEQ ID NO: 713633 - RNA, 64 nt, Homo Sapiens; identical to SEQ ID NO: 58459

SEQ ID NO: 713634 - RNA, 64 nt, Homo Sapiens; identical to SEQ ID NO: 58460

SEQ ID NO: 713635 - RNA, 64 nt, Homo Sapiens; identical to SEQ ID NO: 58461

SEQ ID NO: 713636 - RNA, 64 nt, Homo Sapiens; identical to SEQ ID NO: 58462

SEQ ID NO: 713637 - RNA, 64 nt, Homo Sapiens; identical to SEQ ID NO: 58463

SEQ ID NO: 713638 - RNA, 64 nt, Homo Sapiens; identical to SEQ ID NO: 58464

SEQ ID NO: 713639 - RNA, 64 nt, Homo Sapiens; identical to SEQ ID NO: 58465

SEQ ID NO: 713640 - RNA, 64 nt, Homo Sapiens; identical to SEQ ID NO: 58466

SEQ ID NO: 713641 - RNA, 64 nt, Homo Sapiens; identical to SEQ ID NO: 58467

SEQ ID NO: 713642 - RNA, 64 nt, Homo Sapiens; identical to SEQ ID NO: 338143

SEQ ID NO: 713643 - RNA, 64 nt, Homo Sapiens; identical to SEQ ID NO: 338144

SEQ ID NO: 713644 - RNA, 64 nt, Homo Sapiens; identical to SEQ ID NO: 338145

SEQ ID NO: 713645 - RNA, 64 nt, Homo Sapiens; identical to SEQ ID NO: 338146

SEQ ID NO: 713646 - RNA, 64 nt, Homo Sapiens; identical to SEQ ID NO: 338147

SEQ ID NO: 713647 - RNA, 64 nt, Homo Sapiens; identical to SEQ ID NO: 338148

SEQ ID NO: 713648 - RNA, 64 nt, Homo Sapiens; identical to SEQ ID NO: 338149

SEQ ID NO: 713649 - RNA, 64 nt, Homo Sapiens; identical to SEQ ID NO: 338150

SEQ ID NO: 713650 - RNA, 64 nt, Homo Sapiens; identical to SEQ ID NO: 338151

SEQ ID NO: 713651 - RNA, 64 nt, Homo Sapiens; identical to SEQ ID NO: 259948

SEQ ID NO: 713652 - RNA, 64 nt, Homo Sapiens; identical to SEQ ID NO: 259949

SEQ ID NO: 713653 - RNA, 64 nt, Homo Sapiens; identical to SEQ ID NO: 259950

SEQ ID NO: 713654 - RNA, 64 nt, Homo Sapiens; identical to SEQ ID NO: 259951

SEQ ID NO: 713655 - RNA, 64 nt, Homo Sapiens; identical to SEQ ID NO: 259952

SEQ ID NO: 713656 - RNA, 64 nt, Homo Sapiens; identical to SEQ ID NO: 259953

SEQ ID NO: 713657 - RNA, 64 nt, Homo Sapiens; identical to SEQ ID NO: 259954

SEQ ID NO: 713658 - RNA, 64 nt, Homo Sapiens; identical to SEQ ID NO: 259955

SEQ ID NO: 713659 - RNA, 64 nt, Homo Sapiens; identical to SEQ ID NO: 259956

SEQ ID NO: 713660 - RNA, 64 nt, Homo Sapiens; identical to SEQ ID NO: 259957

SEQ ID NO: 713661 - RNA, 64 nt, Homo Sapiens; identical to SEQ ID NO: 259958

SEQ ID NO: 713662 - RNA, 64 nt, Homo Sapiens; identical to SEQ ID NO: 259959

SEQ ID NO: 713663 - RNA, 64 nt, Homo Sapiens; identical to SEQ ID NO: 259960

SEQ ID NO: 713664 - RNA, 64 nt, Homo Sapiens; identical to SEQ ID NO: 259961

SEQ ID NO: 713665 - RNA, 64 nt, Homo Sapiens; identical to SEQ ID NO: 259962

SEQ ID NO: 713666 - RNA, 64 nt, Homo Sapiens; identical to SEQ ID NO: 259963

SEQ ID NO: 713667 - RNA, 64 nt, Homo Sapiens; identical to SEQ ID NO: 259964

SEQ ID NO: 713668 - RNA, 64 nt, Homo Sapiens; identical to SEQ ID NO: 259965

SEQ ID NO: 713669 - RNA, 64 nt, Homo Sapiens; identical to SEQ ID NO: 259966

SEQ ID NO: 713670 - RNA, 64 nt, Homo Sapiens; identical to SEQ ID NO: 259967

SEQ ID NO: 713671 - RNA, 64 nt, Homo Sapiens; identical to SEQ ID NO: 259968

SEQ ID NO: 713672 - RNA, 64 nt, Homo Sapiens; identical to SEQ ID NO: 259969

SEQ ID NO: 713673 - RNA, 64 nt, Homo Sapiens; identical to SEQ ID NO: 73185

SEQ ID NO: 713674 - RNA, 64 nt, Homo Sapiens; identical to SEQ ID NO: 73186

SEQ ID NO: 713675 - RNA, 64 nt, Homo Sapiens; identical to SEQ ID NO: 73187

SEQ ID NO: 713676 - RNA, 64 nt, Homo Sapiens; identical to SEQ ID NO: 73188

SEQ ID NO: 713677 - RNA, 64 nt, Homo Sapiens; identical to SEQ ID NO: 73189

SEQ ID NO: 713678 - RNA, 64 nt, Homo Sapiens; identical to SEQ ID NO: 73190

SEQ ID NO: 713679 - RNA, 64 nt, Homo Sapiens; identical to SEQ ID NO: 73191

SEQ ID NO: 713680 - RNA, 64 nt, Homo Sapiens; identical to SEQ ID NO: 73192

SEQ ID NO: 713681 - RNA, 64 nt, Homo Sapiens; identical to SEQ ID NO: 73193

SEQ ID NO: 713682 - RNA, 64 nt, Homo Sapiens; identical to SEQ ID NO: 73194

SEQ ID NO: 713683 - RNA, 64 nt, Homo Sapiens; identical to SEQ ID NO: 73195

SEQ ID NO: 713684 - RNA, 64 nt, Homo Sapiens; identical to SEQ ID NO: 73196

SEQ ID NO: 713685 - RNA, 64 nt, Homo Sapiens; identical to SEQ ID NO: 73197

SEQ ID NO: 713686 - RNA, 64 nt, Homo Sapiens; identical to SEQ ID NO: 73198

SEQ ID NO: 713687 - RNA, 64 nt, Homo Sapiens; identical to SEQ ID NO: 73199

SEQ ID NO: 713688 - RNA, 64 nt, Homo Sapiens; identical to SEQ ID NO: 73200

SEQ ID NO: 713689 - RNA, 64 nt, Homo Sapiens; identical to SEQ ID NO: 73201

SEQ ID NO: 713690 - RNA, 64 nt, Homo Sapiens; identical to SEQ ID NO: 73202

SEQ ID NO: 713691 - RNA, 64 nt, Homo Sapiens; identical to SEQ ID NO: 73203

SEQ ID NO: 713692 - RNA, 64 nt, Homo Sapiens; identical to SEQ ID NO: 73204

SEQ ID NO: 713693 - RNA, 64 nt, Homo Sapiens; identical to SEQ ID NO: 73205

SEQ ID NO: 713694 - RNA, 64 nt, Homo Sapiens; identical to SEQ ID NO: 73206

SEQ ID NO: 713695 - RNA, 64 nt, Homo Sapiens; identical to SEQ ID NO: 73207

SEQ ID NO: 713696 - RNA, 64 nt, Homo Sapiens; identical to SEQ ID NO: 73208

SEQ ID NO: 713697 - RNA, 64 nt, Homo Sapiens; identical to SEQ ID NO: 73209

SEQ ID NO: 713698 - RNA, 64 nt, Homo Sapiens; identical to SEQ ID NO: 73210

SEQ ID NO: 713699 - RNA, 64 nt, Homo Sapiens; identical to SEQ ID NO: 73211

SEQ ID NO: 713700 - RNA, 64 nt, Homo Sapiens; identical to SEQ ID NO: 73212

SEQ ID NO: 713701 - RNA, 64 nt, Homo Sapiens; identical to SEQ ID NO: 73213

SEQ ID NO: 713702 - RNA, 64 nt, Homo Sapiens; identical to SEQ ID NO: 73214

SEQ ID NO: 713703 - RNA, 64 nt, Homo Sapiens; identical to SEQ ID NO: 73215

SEQ ID NO: 713704 - RNA, 64 nt, Homo Sapiens; identical to SEQ ID NO: 73216

SEQ ID NO: 713705 - RNA, 64 nt, Homo Sapiens; identical to SEQ ID NO: 73217

SEQ ID NO: 713706 - RNA, 64 nt, Homo Sapiens; identical to SEQ ID NO: 73218

SEQ ID NO: 713707 - RNA, 64 nt, Homo Sapiens; identical to SEQ ID NO: 73219

SEQ ID NO: 713708 - RNA, 64 nt, Homo Sapiens; identical to SEQ ID NO: 73220

SEQ ID NO: 713709 - RNA, 64 nt, Homo Sapiens; identical to SEQ ID NO: 73221

SEQ ID NO: 713710 - RNA, 64 nt, Homo Sapiens; identical to SEQ ID NO: 73222

SEQ ID NO: 713711 - RNA, 64 nt, Homo Sapiens; identical to SEQ ID NO: 73223

SEQ ID NO: 713712 - RNA, 64 nt, Homo Sapiens; identical to SEQ ID NO: 73224

SEQ ID NO: 713713 - RNA, 64 nt, Homo Sapiens; identical to SEQ ID NO: 73225

SEQ ID NO: 713714 - RNA, 64 nt, Homo Sapiens; identical to SEQ ID NO: 73226

SEQ ID NO: 713715 - RNA, 64 nt, Homo Sapiens; identical to SEQ ID NO: 73227

SEQ ID NO: 713716 - RNA, 64 nt, Homo Sapiens; identical to SEQ ID NO: 73228

SEQ ID NO: 713717 - RNA, 64 nt, Homo Sapiens; identical to SEQ ID NO: 73229

SEQ ID NO: 713718 - RNA, 64 nt, Homo Sapiens; identical to SEQ ID NO: 73230

SEQ ID NO: 713719 - RNA, 64 nt, Homo Sapiens; identical to SEQ ID NO: 73231

SEQ ID NO: 713720 - RNA, 64 nt, Homo Sapiens; identical to SEQ ID NO: 73232

SEQ ID NO: 713721 - RNA, 64 nt, Homo Sapiens; identical to SEQ ID NO: 73233

SEQ ID NO: 713722 - RNA, 64 nt, Homo Sapiens; identical to SEQ ID NO: 73234

SEQ ID NO: 713723 - RNA, 64 nt, Homo Sapiens; identical to SEQ ID NO: 73235

SEQ ID NO: 713724 - RNA, 64 nt, Homo Sapiens; identical to SEQ ID NO: 73236

SEQ ID NO: 713725 - RNA, 64 nt, Homo Sapiens; identical to SEQ ID NO: 73237

SEQ ID NO: 713726 - RNA, 64 nt, Homo Sapiens; identical to SEQ ID NO: 73238

SEQ ID NO: 713727 - RNA, 64 nt, Homo Sapiens; identical to SEQ ID NO: 73239

SEQ ID NO: 713728 - RNA, 64 nt, Homo Sapiens; identical to SEQ ID NO: 73240

SEQ ID NO: 713729 - RNA, 64 nt, Homo Sapiens; identical to SEQ ID NO: 73241

SEQ ID NO: 713730 - RNA, 64 nt, Homo Sapiens; identical to SEQ ID NO: 73242

SEQ ID NO: 713731 - RNA, 64 nt, Homo Sapiens; identical to SEQ ID NO: 73243

SEQ ID NO: 713732 - RNA, 64 nt, Homo Sapiens; identical to SEQ ID NO: 73244

SEQ ID NO: 713733 - RNA, 64 nt, Homo Sapiens; identical to SEQ ID NO: 73245

SEQ ID NO: 713734 - RNA, 64 nt, Homo Sapiens; identical to SEQ ID NO: 73246

SEQ ID NO: 713735 - RNA, 64 nt, Homo Sapiens; identical to SEQ ID NO: 73247

SEQ ID NO: 713736 - RNA, 64 nt, Homo Sapiens; identical to SEQ ID NO: 73248

SEQ ID NO: 713737 - RNA, 64 nt, Homo Sapiens; identical to SEQ ID NO: 73249

SEQ ID NO: 713738 - RNA, 64 nt, Homo Sapiens; identical to SEQ ID NO: 73250

SEQ ID NO: 713739 - RNA, 64 nt, Homo Sapiens; identical to SEQ ID NO: 73251

SEQ ID NO: 713740 - RNA, 64 nt, Homo Sapiens; identical to SEQ ID NO: 73252

SEQ ID NO: 713741 - RNA, 64 nt, Homo Sapiens; identical to SEQ ID NO: 73253

SEQ ID NO: 713742 - RNA, 64 nt, Homo Sapiens; identical to SEQ ID NO: 73254

SEQ ID NO: 713743 - RNA, 64 nt, Homo Sapiens; identical to SEQ ID NO: 73255

SEQ ID NO: 713744 - RNA, 64 nt, Homo Sapiens; identical to SEQ ID NO: 73256

SEQ ID NO: 713745 - RNA, 64 nt, Homo Sapiens; identical to SEQ ID NO: 73257

SEQ ID NO: 713746 - RNA, 64 nt, Homo Sapiens; identical to SEQ ID NO: 73258

SEQ ID NO: 713747 - RNA, 64 nt, Homo Sapiens; identical to SEQ ID NO: 73259

SEQ ID NO: 713748 - RNA, 64 nt, Homo Sapiens; identical to SEQ ID NO: 73260

SEQ ID NO: 713749 - RNA, 64 nt, Homo Sapiens; identical to SEQ ID NO: 73261

SEQ ID NO: 713750 - RNA, 64 nt, Homo Sapiens; identical to SEQ ID NO: 73262

SEQ ID NO: 713751 - RNA, 64 nt, Homo Sapiens; identical to SEQ ID NO: 73263

SEQ ID NO: 713752 - RNA, 64 nt, Homo Sapiens; identical to SEQ ID NO: 73264

SEQ ID NO: 713753 - RNA, 64 nt, Homo Sapiens; identical to SEQ ID NO: 73265

SEQ ID NO: 713754 - RNA, 63 nt, Homo Sapiens; identical to SEQ ID NO: 73266

SEQ ID NO: 713755 - RNA, 64 nt, Homo Sapiens; identical to SEQ ID NO: 73267

SEQ ID NO: 713756 - RNA, 64 nt, Homo Sapiens; identical to SEQ ID NO: 73268

SEQ ID NO: 713757 - RNA, 64 nt, Homo Sapiens; identical to SEQ ID NO: 73269

SEQ ID NO: 713758 - RNA, 64 nt, Homo Sapiens; identical to SEQ ID NO: 73270

SEQ ID NO: 713759 - RNA, 64 nt, Homo Sapiens; identical to SEQ ID NO: 73271

SEQ ID NO: 713760 - RNA, 64 nt, Homo Sapiens; identical to SEQ ID NO: 73272

SEQ ID NO: 713761 - RNA, 64 nt, Homo Sapiens; identical to SEQ ID NO: 73273

SEQ ID NO: 713762 - RNA, 64 nt, Homo Sapiens; identical to SEQ ID NO: 73274

SEQ ID NO: 713763 - RNA, 64 nt, Homo Sapiens; identical to SEQ ID NO: 73275

SEQ ID NO: 713764 - RNA, 64 nt, Homo Sapiens; identical to SEQ ID NO: 73276

SEQ ID NO: 713765 - RNA, 64 nt, Homo Sapiens; identical to SEQ ID NO: 73277

SEQ ID NO: 713766 - RNA, 64 nt, Homo Sapiens; identical to SEQ ID NO: 73278

SEQ ID NO: 713767 - RNA, 64 nt, Homo Sapiens; identical to SEQ ID NO: 73279

SEQ ID NO: 713768 - RNA, 64 nt, Homo Sapiens; identical to SEQ ID NO: 73280

SEQ ID NO: 713769 - RNA, 64 nt, Homo Sapiens; identical to SEQ ID NO: 73281

SEQ ID NO: 713770 - RNA, 64 nt, Homo Sapiens; identical to SEQ ID NO: 73282

SEQ ID NO: 713771 - RNA, 64 nt, Homo Sapiens; identical to SEQ ID NO: 73283

SEQ ID NO: 713772 - RNA, 64 nt, Homo Sapiens; identical to SEQ ID NO: 73284

SEQ ID NO: 713773 - RNA, 64 nt, Homo Sapiens; identical to SEQ ID NO: 73285

SEQ ID NO: 713774 - RNA, 64 nt, Homo Sapiens; identical to SEQ ID NO: 73286

SEQ ID NO: 713775 - RNA, 64 nt, Homo Sapiens; identical to SEQ ID NO: 73287

SEQ ID NO: 713776 - RNA, 64 nt, Homo Sapiens; identical to SEQ ID NO: 73288

SEQ ID NO: 713777 - RNA, 64 nt, Homo Sapiens; identical to SEQ ID NO: 73289

SEQ ID NO: 713778 - RNA, 64 nt, Homo Sapiens; identical to SEQ ID NO: 73290

SEQ ID NO: 713779 - RNA, 64 nt, Homo Sapiens; identical to SEQ ID NO: 73291

SEQ ID NO: 713780 - RNA, 64 nt, Homo Sapiens; identical to SEQ ID NO: 73292

SEQ ID NO: 713781 - RNA, 64 nt, Homo Sapiens; identical to SEQ ID NO: 73293

SEQ ID NO: 713782 - RNA, 64 nt, Homo Sapiens; identical to SEQ ID NO: 73294

SEQ ID NO: 713783 - RNA, 64 nt, Homo Sapiens; identical to SEQ ID NO: 73295

SEQ ID NO: 713784 - RNA, 64 nt, Homo Sapiens; identical to SEQ ID NO: 73296

SEQ ID NO: 713785 - RNA, 64 nt, Homo Sapiens; identical to SEQ ID NO: 73297

SEQ ID NO: 713786 - RNA, 64 nt, Homo Sapiens; identical to SEQ ID NO: 73298

SEQ ID NO: 713787 - RNA, 64 nt, Homo Sapiens; identical to SEQ ID NO: 73299

SEQ ID NO: 713788 - RNA, 64 nt, Homo Sapiens; identical to SEQ ID NO: 73300

SEQ ID NO: 713789 - RNA, 64 nt, Homo Sapiens; identical to SEQ ID NO: 73301

SEQ ID NO: 713790 - RNA, 64 nt, Homo Sapiens; identical to SEQ ID NO: 73302

SEQ ID NO: 713791 - RNA, 64 nt, Homo Sapiens; identical to SEQ ID NO: 73303

SEQ ID NO: 713792 - RNA, 64 nt, Homo Sapiens; identical to SEQ ID NO: 73304

SEQ ID NO: 713793 - RNA, 64 nt, Homo Sapiens; identical to SEQ ID NO: 73305

SEQ ID NO: 713794 - RNA, 64 nt, Homo Sapiens; identical to SEQ ID NO: 73306

SEQ ID NO: 713795 - RNA, 64 nt, Homo Sapiens; identical to SEQ ID NO: 73307

SEQ ID NO: 713796 - RNA, 64 nt, Homo Sapiens; identical to SEQ ID NO: 73308

SEQ ID NO: 713797 - RNA, 64 nt, Homo Sapiens; identical to SEQ ID NO: 73309

SEQ ID NO: 713798 - RNA, 64 nt, Homo Sapiens; identical to SEQ ID NO: 73310

SEQ ID NO: 713799 - RNA, 64 nt, Homo Sapiens; identical to SEQ ID NO: 73311

SEQ ID NO: 713800 - RNA, 64 nt, Homo Sapiens; identical to SEQ ID NO: 73312

SEQ ID NO: 713801 - RNA, 64 nt, Homo Sapiens; identical to SEQ ID NO: 73313

SEQ ID NO: 713802 - RNA, 64 nt, Homo Sapiens; identical to SEQ ID NO: 73314

SEQ ID NO: 713803 - RNA, 64 nt, Homo Sapiens; identical to SEQ ID NO: 73315

SEQ ID NO: 713804 - RNA, 64 nt, Homo Sapiens; identical to SEQ ID NO: 73316

SEQ ID NO: 713805 - RNA, 64 nt, Homo Sapiens; identical to SEQ ID NO: 73317

SEQ ID NO: 713806 - RNA, 64 nt, Homo Sapiens; identical to SEQ ID NO: 73318

SEQ ID NO: 713807 - RNA, 64 nt, Homo Sapiens; identical to SEQ ID NO: 73319

SEQ ID NO: 713808 - RNA, 64 nt, Homo Sapiens; identical to SEQ ID NO: 73320

SEQ ID NO: 713809 - RNA, 64 nt, Homo Sapiens; identical to SEQ ID NO: 73311

SEQ ID NO: 713810 - RNA, 64 nt, Homo Sapiens; identical to SEQ ID NO: 73312

SEQ ID NO: 713811 - RNA, 64 nt, Homo Sapiens; identical to SEQ ID NO: 209022

SEQ ID NO: 713812 - RNA, 64 nt, Homo Sapiens; identical to SEQ ID NO: 209023

SEQ ID NO: 713813 - RNA, 64 nt, Homo Sapiens
ucucucuggcuaggcaggugugccgcaaauauuugacgaauagauggauggcagacauuaacug

SEQ ID NO: 713814 - RNA, 64 nt, Homo Sapiens
acccuaccuguggguguuugggguaucaaagaaggacgaauagcggaggagggcgcaggguggg

SEQ ID NO: 713815 - RNA, 64 nt, Homo Sapiens
uaaggugacagauaucccaacaacauaaagaaaagacgaauauuaaaaguaauuagaauauuuu

SEQ ID NO: 713816 - RNA, 64 nt, Homo Sapiens
gaggaugagucccaagaagguucuuuggaaggaggacgaauagaauggaguaaugaaauucuug

SEQ ID NO: 713817 - RNA, 64 nt, Homo Sapiens
cugauacaauacucaaccucuacagggaucucacgacgaauauuauaauguugcaaagggagac

SEQ ID NO: 713818 - RNA, 64 nt, Homo Sapiens
gcacagcccuguaacugcaccuucuguugacccagacgaauagguuucuaaagaaagcugugcu

SEQ ID NO: 713819 - RNA, 64 nt, Homo Sapiens
guuaggaaaaggaagacaagagaagagagagaaagacgaauagaagggaaggaaguguuugugu

SEQ ID NO: 713820 - RNA, 64 nt, Homo Sapiens
guacuguuucaguacauucaugcuuuauuuauuggacgaauaaaucaguaagaacaauuuuuau

SEQ ID NO: 713821 - RNA, 64 nt, Homo Sapiens
augaaaugugccuuuucugagucugggcugugaugacgaauauuaaaaggucuccugcagaucu

SEQ ID NO: 713822 - RNA, 64 nt, Homo Sapiens
cacucuccuucagggaaaauguuauguggaggaggacgaauaaauuuauuuuguuuuccuguuu

SEQ ID NO: 713823 - RNA, 64 nt, Homo Sapiens
caauucauuuuuucccaugagaugaagcacaugugacgaauacggacuagauaaccucuaagaa

SEQ ID NO: 713824 - RNA, 64 nt, Homo Sapiens
aaugucacauuugaauucuucugugcuggccauggacgaauaugauggaauucguguuaugaau

SEQ ID NO: 713825 - RNA, 64 nt, Homo Sapiens
cucccucccccuccuccccucuuuuacucuagacgacgaauaaagcccuguuagaggaugcggc

SEQ ID NO: 713826 - RNA, 64 nt, Homo Sapiens
ugaaucacggcaauuucuuagccaugagguuuaugacgaauaaacagaggaaauuaugaauuac

SEQ ID NO: 713827 - RNA, 64 nt, Homo Sapiens
uucuuacauauucuagauauaugacugauucaaggacgaauagcggauuggccggcagggugau

SEQ ID NO: 713828 - RNA, 64 nt, Homo Sapiens
guuuaauuacucauugcgucgaaaucuuccggaggacgaauagacauaacguucaguugggaug

SEQ ID NO: 713829 - RNA, 64 nt, Homo Sapiens
agccucccugcuugaggauggaaggaugaaauuugacgaauauaucaaacgccuugcuucuuug

SEQ ID NO: 713830 - RNA, 64 nt, Homo Sapiens
acuuuuaaaaauuguuuuuauauuuugaaucugagacgaauacaauaaaucaccugugugauaa

SEQ ID NO: 713831 - RNA, 64 nt, Homo Sapiens
auuuucuaacucagcaaauguagaccaauaaagagacgaauacauccaagucuccaccccuuuc

SEQ ID NO: 713832 - RNA, 64 nt, Homo Sapiens
auucuaguguguguuuagugauagauguagucuugacgaauauugcuuacuggugagguugagg

SEQ ID NO: 713833 - RNA, 64 nt, Homo Sapiens
cuggaucugcaaaaagcccgcagccugcuucagagacgaauaguuguuucccugcuagccucag

SEQ ID NO: 713834 - RNA, 64 nt, Homo Sapiens
caaugaaaaaagaaaacuucaggcugguacuccugacgaauauaggugccaaaauccucagcaa

SEQ ID NO: 713835 - RNA, 64 nt, Homo Sapiens
gacuuacugccuacaagaggaauuccuauucucugacgaauaaauggaggaaacuuucuuucuu

SEQ ID NO: 713836 - RNA, 64 nt, Homo Sapiens; identical to SEQ ID NO: 351043

SEQ ID NO: 713837 - RNA, 64 nt, Homo Sapiens; identical to SEQ ID NO: 351044

SEQ ID NO: 713838 - RNA, 64 nt, Homo Sapiens; identical to SEQ ID NO: 351045

SEQ ID NO: 713839 - RNA, 64 nt, Homo Sapiens; identical to SEQ ID NO: 351046

SEQ ID NO: 713840 - RNA, 64 nt, Homo Sapiens; identical to SEQ ID NO: 351047

SEQ ID NO: 713841 - RNA, 64 nt, Homo Sapiens; identical to SEQ ID NO: 351048

SEQ ID NO: 713842 - RNA, 64 nt, Homo Sapiens; identical to SEQ ID NO: 351049

SEQ ID NO: 713843 - RNA, 64 nt, Homo Sapiens; identical to SEQ ID NO: 351050

SEQ ID NO: 713844 - RNA, 64 nt, Homo Sapiens; identical to SEQ ID NO: 351051

SEQ ID NO: 713845 - RNA, 64 nt, Homo Sapiens; identical to SEQ ID NO: 351052

SEQ ID NO: 713846 - RNA, 64 nt, Homo Sapiens; identical to SEQ ID NO: 351053

SEQ ID NO: 713847 - RNA, 64 nt, Homo Sapiens; identical to SEQ ID NO: 351054

SEQ ID NO: 713848 - RNA, 64 nt, Homo Sapiens; identical to SEQ ID NO: 351055

SEQ ID NO: 713849 - RNA, 50 nt, Homo Sapiens; identical to SEQ ID NO: 351056

SEQ ID NO: 713850 - RNA, 64 nt, Homo Sapiens; identical to SEQ ID NO: 351057

SEQ ID NO: 713851 - RNA, 64 nt, Homo Sapiens; identical to SEQ ID NO: 351058

SEQ ID NO: 713852 - RNA, 64 nt, Homo Sapiens; identical to SEQ ID NO: 351059

SEQ ID NO: 713853 - RNA, 64 nt, Homo Sapiens; identical to SEQ ID NO: 351060

SEQ ID NO: 713854 - RNA, 64 nt, Homo Sapiens; identical to SEQ ID NO: 351061

SEQ ID NO: 713855 - RNA, 64 nt, Homo Sapiens; identical to SEQ ID NO: 351062

SEQ ID NO: 713856 - RNA, 64 nt, Homo Sapiens; identical to SEQ ID NO: 351063

SEQ ID NO: 713857 - RNA, 64 nt, Homo Sapiens; identical to SEQ ID NO: 351064

SEQ ID NO: 713858 - RNA, 64 nt, Homo Sapiens; identical to SEQ ID NO: 144190

SEQ ID NO: 713859 - RNA, 64 nt, Homo Sapiens; identical to SEQ ID NO: 144191

SEQ ID NO: 713860 - RNA, 64 nt, Homo Sapiens; identical to SEQ ID NO: 144192

SEQ ID NO: 713861 - RNA, 64 nt, Homo Sapiens; identical to SEQ ID NO: 144193

SEQ ID NO: 713862 - RNA, 64 nt, Homo Sapiens; identical to SEQ ID NO: 144194

SEQ ID NO: 713863 - RNA, 64 nt, Homo Sapiens; identical to SEQ ID NO: 144195

SEQ ID NO: 713864 - RNA, 64 nt, Homo Sapiens; identical to SEQ ID NO: 144196

SEQ ID NO: 713865 - RNA, 64 nt, Homo Sapiens; identical to SEQ ID NO: 144197

SEQ ID NO: 713866 - RNA, 64 nt, Homo Sapiens; identical to SEQ ID NO: 144198

SEQ ID NO: 713867 - RNA, 64 nt, Homo Sapiens; identical to SEQ ID NO: 144199

SEQ ID NO: 713868 - RNA, 64 nt, Homo Sapiens; identical to SEQ ID NO: 144200

SEQ ID NO: 713869 - RNA, 64 nt, Homo Sapiens; identical to SEQ ID NO: 144201

SEQ ID NO: 713870 - RNA, 64 nt, Homo Sapiens; identical to SEQ ID NO: 144202

SEQ ID NO: 713871 - RNA, 64 nt, Homo Sapiens; identical to SEQ ID NO: 144203

SEQ ID NO: 713872 - RNA, 64 nt, Homo Sapiens; identical to SEQ ID NO: 144204

SEQ ID NO: 713873 - RNA, 64 nt, Homo Sapiens; identical to SEQ ID NO: 144205

SEQ ID NO: 713874 - RNA, 64 nt, Homo Sapiens; identical to SEQ ID NO: 144206

SEQ ID NO: 713875 - RNA, 64 nt, Homo Sapiens; identical to SEQ ID NO: 144207

SEQ ID NO: 713876 - RNA, 64 nt, Homo Sapiens; identical to SEQ ID NO: 144208

SEQ ID NO: 713877 - RNA, 64 nt, Homo Sapiens; identical to SEQ ID NO: 144209

SEQ ID NO: 713878 - RNA, 64 nt, Homo Sapiens; identical to SEQ ID NO: 144210

SEQ ID NO: 713879 - RNA, 64 nt, Homo Sapiens; identical to SEQ ID NO: 144211

SEQ ID NO: 713880 - RNA, 64 nt, Homo Sapiens; identical to SEQ ID NO: 144212

SEQ ID NO: 713881 - RNA, 64 nt, Homo Sapiens; identical to SEQ ID NO: 144213

SEQ ID NO: 713882 - RNA, 64 nt, Homo Sapiens; identical to SEQ ID NO: 144214

SEQ ID NO: 713883 - RNA, 64 nt, Homo Sapiens; identical to SEQ ID NO: 144215

SEQ ID NO: 713884 - RNA, 64 nt, Homo Sapiens; identical to SEQ ID NO: 144216

SEQ ID NO: 713885 - RNA, 64 nt, Homo Sapiens; identical to SEQ ID NO: 144217

SEQ ID NO: 713886 - RNA, 64 nt, Homo Sapiens; identical to SEQ ID NO: 144218

SEQ ID NO: 713887 - RNA, 64 nt, Homo Sapiens; identical to SEQ ID NO: 144219

SEQ ID NO: 713888 - RNA, 64 nt, Homo Sapiens; identical to SEQ ID NO: 144220

SEQ ID NO: 713889 - RNA, 64 nt, Homo Sapiens; identical to SEQ ID NO: 144221

SEQ ID NO: 713890 - RNA, 64 nt, Homo Sapiens; identical to SEQ ID NO: 144222

SEQ ID NO: 713891 - RNA, 64 nt, Homo Sapiens; identical to SEQ ID NO: 144223

SEQ ID NO: 713892 - RNA, 64 nt, Homo Sapiens; identical to SEQ ID NO: 144224

SEQ ID NO: 713893 - RNA, 64 nt, Homo Sapiens; identical to SEQ ID NO: 144225

SEQ ID NO: 713894 - RNA, 64 nt, Homo Sapiens; identical to SEQ ID NO: 144226

SEQ ID NO: 713895 - RNA, 64 nt, Homo Sapiens; identical to SEQ ID NO: 144227

SEQ ID NO: 713896 - RNA, 64 nt, Homo Sapiens; identical to SEQ ID NO: 144228

SEQ ID NO: 713897 - RNA, 64 nt, Homo Sapiens; identical to SEQ ID NO: 144229

SEQ ID NO: 713898 - RNA, 64 nt, Homo Sapiens; identical to SEQ ID NO: 144230

SEQ ID NO: 713899 - RNA, 64 nt, Homo Sapiens; identical to SEQ ID NO: 144231

SEQ ID NO: 713900 - RNA, 64 nt, Homo Sapiens; identical to SEQ ID NO: 144232

SEQ ID NO: 713901 - RNA, 64 nt, Homo Sapiens; identical to SEQ ID NO: 144233

SEQ ID NO: 713902 - RNA, 64 nt, Homo Sapiens; identical to SEQ ID NO: 144234

SEQ ID NO: 713903 - RNA, 64 nt, Homo Sapiens; identical to SEQ ID NO: 144235

SEQ ID NO: 713904 - RNA, 64 nt, Homo Sapiens; identical to SEQ ID NO: 144236

SEQ ID NO: 713905 - RNA, 64 nt, Homo Sapiens; identical to SEQ ID NO: 144237

SEQ ID NO: 713906 - RNA, 64 nt, Homo Sapiens; identical to SEQ ID NO: 144238

SEQ ID NO: 713907 - RNA, 64 nt, Homo Sapiens; identical to SEQ ID NO: 144239

SEQ ID NO: 713908 - RNA, 64 nt, Homo Sapiens; identical to SEQ ID NO: 144240

SEQ ID NO: 713909 - RNA, 64 nt, Homo Sapiens; identical to SEQ ID NO: 144241

SEQ ID NO: 713910 - RNA, 64 nt, Homo Sapiens; identical to SEQ ID NO: 144242

SEQ ID NO: 713911 - RNA, 64 nt, Homo Sapiens; identical to SEQ ID NO: 144243

SEQ ID NO: 713912 - RNA, 64 nt, Homo Sapiens; identical to SEQ ID NO: 144244

SEQ ID NO: 713913 - RNA, 64 nt, Homo Sapiens; identical to SEQ ID NO: 144245

SEQ ID NO: 713914 - RNA, 64 nt, Homo Sapiens; identical to SEQ ID NO: 144246

SEQ ID NO: 713915 - RNA, 64 nt, Homo Sapiens; identical to SEQ ID NO: 144247

SEQ ID NO: 713916 - RNA, 64 nt, Homo Sapiens; identical to SEQ ID NO: 144248

SEQ ID NO: 713917 - RNA, 64 nt, Homo Sapiens; identical to SEQ ID NO: 144249

SEQ ID NO: 713918 - RNA, 64 nt, Homo Sapiens; identical to SEQ ID NO: 144250

SEQ ID NO: 713919 - RNA, 64 nt, Homo Sapiens; identical to SEQ ID NO: 144251

SEQ ID NO: 713920 - RNA, 64 nt, Homo Sapiens; identical to SEQ ID NO: 144252

SEQ ID NO: 713921 - RNA, 64 nt, Homo Sapiens; identical to SEQ ID NO: 144253

SEQ ID NO: 713922 - RNA, 64 nt, Homo Sapiens; identical to SEQ ID NO: 144254

SEQ ID NO: 713923 - RNA, 64 nt, Homo Sapiens; identical to SEQ ID NO: 144255

SEQ ID NO: 713924 - RNA, 64 nt, Homo Sapiens; identical to SEQ ID NO: 162095

SEQ ID NO: 713925 - RNA, 64 nt, Homo Sapiens; identical to SEQ ID NO: 162096

SEQ ID NO: 713926 - RNA, 64 nt, Homo Sapiens; identical to SEQ ID NO: 162097

SEQ ID NO: 713927 - RNA, 64 nt, Homo Sapiens; identical to SEQ ID NO: 162098

SEQ ID NO: 713928 - RNA, 64 nt, Homo Sapiens; identical to SEQ ID NO: 162099

SEQ ID NO: 713929 - RNA, 64 nt, Homo Sapiens; identical to SEQ ID NO: 162100

SEQ ID NO: 713930 - RNA, 64 nt, Homo Sapiens; identical to SEQ ID NO: 162101

SEQ ID NO: 713931 - RNA, 64 nt, Homo Sapiens; identical to SEQ ID NO: 162102

SEQ ID NO: 713932 - RNA, 61 nt, Homo Sapiens; identical to SEQ ID NO: 162103

SEQ ID NO: 713933 - RNA, 64 nt, Homo Sapiens; identical to SEQ ID NO: 162104

SEQ ID NO: 713934 - RNA, 64 nt, Homo Sapiens; identical to SEQ ID NO: 162105

SEQ ID NO: 713935 - RNA, 64 nt, Homo Sapiens; identical to SEQ ID NO: 162106

SEQ ID NO: 713936 - RNA, 64 nt, Homo Sapiens; identical to SEQ ID NO: 162107

SEQ ID NO: 713937 - RNA, 64 nt, Homo Sapiens; identical to SEQ ID NO: 162108

SEQ ID NO: 713938 - RNA, 64 nt, Homo Sapiens
uggcaggacacaucccggcccugggauuucuucgcugcucuagcuuggacuuccuggggccccg

SEQ ID NO: 713939 - RNA, 64 nt, Homo Sapiens
caggagucugugcucuuuuggaaccuaguacucucugcucuagcccugagucggccccacaugg

SEQ ID NO: 713940 - RNA, 64 nt, Homo Sapiens
aguuugauaucagcagacguccauagcuccggggcugcucuaacagaugcauggauacaaauuu

SEQ ID NO: 713941 - RNA, 64 nt, Homo Sapiens
uugagaaugacauuuuauugauguuugagcaccucugcucuagguuggaugcaucucuaauacc

SEQ ID NO: 713942 - RNA, 64 nt, Homo Sapiens
agcagauacaggcugguauacuguggugugugggcugcucuaggcugcacaugaaggugugugc

SEQ ID NO: 713943 - RNA, 64 nt, Homo Sapiens
gauacucagggggcuccugcuuccuugugggaugcugcucuagggcuagcuucaccaguuucug

SEQ ID NO: 713944 - RNA, 64 nt, Homo Sapiens
gacugggcauuuuucuuuuaaugaaauauguggacugcucuagcaaacccuauuuucagcuacu

SEQ ID NO: 713945 - RNA, 64 nt, Homo Sapiens
cacaagaaacuuggucugcagucuggaagcuugucugcucuauagaaaugaaaaugcagcauga

SEQ ID NO: 713946 - RNA, 64 nt, Homo Sapiens
uccagagaccccagcaacuggcccaggaugcaggcugcucuagagaccaaaggaacaccaggcc

SEQ ID NO: 713947 - RNA, 64 nt, Homo Sapiens
agagagggcaagucagccaggaacugccuccucccugcucuacagcuaagaaaacaccauucca

SEQ ID NO: 713948 - RNA, 64 nt, Homo Sapiens
cccugcccucuuccagccccaaucauuuugaacccugcucuaucaggaccuuuauuauuaaaau

SEQ ID NO: 713949 - RNA, 64 nt, Homo Sapiens
caggggcgacguguccccagacagcccucuccgucugcucuagcgggagggcagagggugaguc

SEQ ID NO: 713950 - RNA, 64 nt, Homo Sapiens
uauuuaugauaaaaaugcauuuuaaugccaguaucugcucuaaacuucugacuuagauacugau

SEQ ID NO: 713951 - RNA, 64 nt, Homo Sapiens
uaggacacagcaugcagcagcagcauuuguaacacugcucuaacuacuaaucauagauccugac

SEQ ID NO: 713952 - RNA, 64 nt, Homo Sapiens; identical to SEQ ID NO: 76226

SEQ ID NO: 713953 - RNA, 64 nt, Homo Sapiens; identical to SEQ ID NO: 76227

SEQ ID NO: 713954 - RNA, 64 nt, Homo Sapiens; identical to SEQ ID NO: 76228

SEQ ID NO: 713955 - RNA, 64 nt, Homo Sapiens; identical to SEQ ID NO: 76229

SEQ ID NO: 713956 - RNA, 64 nt, Homo Sapiens; identical to SEQ ID NO: 76230

SEQ ID NO: 713957 - RNA, 64 nt, Homo Sapiens; identical to SEQ ID NO: 76231

SEQ ID NO: 713958 - RNA, 64 nt, Homo Sapiens; identical to SEQ ID NO: 76232

SEQ ID NO: 713959 - RNA, 64 nt, Homo Sapiens; identical to SEQ ID NO: 76233

SEQ ID NO: 713960 - RNA, 64 nt, Homo Sapiens; identical to SEQ ID NO: 76234

SEQ ID NO: 713961 - RNA, 64 nt, Homo Sapiens; identical to SEQ ID NO: 76235

SEQ ID NO: 713962 - RNA, 64 nt, Homo Sapiens; identical to SEQ ID NO: 76236

SEQ ID NO: 713963 - RNA, 64 nt, Homo Sapiens; identical to SEQ ID NO: 76237

SEQ ID NO: 713964 - RNA, 64 nt, Homo Sapiens; identical to SEQ ID NO: 76238

SEQ ID NO: 713965 - RNA, 64 nt, Homo Sapiens; identical to SEQ ID NO: 76239

SEQ ID NO: 713966 - RNA, 64 nt, Homo Sapiens; identical to SEQ ID NO: 76240

SEQ ID NO: 713967 - RNA, 64 nt, Homo Sapiens; identical to SEQ ID NO: 76241

SEQ ID NO: 713968 - RNA, 64 nt, Homo Sapiens; identical to SEQ ID NO: 76242

SEQ ID NO: 713969 - RNA, 64 nt, Homo Sapiens; identical to SEQ ID NO: 76243

SEQ ID NO: 713970 - RNA, 64 nt, Homo Sapiens; identical to SEQ ID NO: 476473

SEQ ID NO: 713971 - RNA, 64 nt, Homo Sapiens; identical to SEQ ID NO: 476474

SEQ ID NO: 713972 - RNA, 64 nt, Homo Sapiens; identical to SEQ ID NO: 476475

SEQ ID NO: 713973 - RNA, 63 nt, Homo Sapiens; identical to SEQ ID NO: 476476

SEQ ID NO: 713974 - RNA, 64 nt, Homo Sapiens; identical to SEQ ID NO: 476477

SEQ ID NO: 713975 - RNA, 64 nt, Homo Sapiens; identical to SEQ ID NO: 476478

SEQ ID NO: 713976 - RNA, 64 nt, Homo Sapiens; identical to SEQ ID NO: 476479

SEQ ID NO: 713977 - RNA, 64 nt, Homo Sapiens; identical to SEQ ID NO: 476480

SEQ ID NO: 713978 - RNA, 64 nt, Homo Sapiens; identical to SEQ ID NO: 476481

SEQ ID NO: 713979 - RNA, 64 nt, Homo Sapiens; identical to SEQ ID NO: 476482

SEQ ID NO: 713980 - RNA, 64 nt, Homo Sapiens; identical to SEQ ID NO: 476483

SEQ ID NO: 713981 - RNA, 64 nt, Homo Sapiens; identical to SEQ ID NO: 476484

SEQ ID NO: 713982 - RNA, 64 nt, Homo Sapiens; identical to SEQ ID NO: 476485

SEQ ID NO: 713983 - RNA, 64 nt, Homo Sapiens; identical to SEQ ID NO: 476486

SEQ ID NO: 713984 - RNA, 64 nt, Homo Sapiens; identical to SEQ ID NO: 476487

SEQ ID NO: 713985 - RNA, 64 nt, Homo Sapiens; identical to SEQ ID NO: 476488

SEQ ID NO: 713986 - RNA, 64 nt, Homo Sapiens; identical to SEQ ID NO: 476489

SEQ ID NO: 713987 - RNA, 64 nt, Homo Sapiens; identical to SEQ ID NO: 476490

SEQ ID NO: 713988 - RNA, 64 nt, Homo Sapiens; identical to SEQ ID NO: 476491

SEQ ID NO: 713989 - RNA, 64 nt, Homo Sapiens; identical to SEQ ID NO: 476492

SEQ ID NO: 713990 - RNA, 64 nt, Homo Sapiens; identical to SEQ ID NO: 476493

SEQ ID NO: 713991 - RNA, 64 nt, Homo Sapiens; identical to SEQ ID NO: 476494

SEQ ID NO: 713992 - RNA, 64 nt, Homo Sapiens; identical to SEQ ID NO: 476495

SEQ ID NO: 713993 - RNA, 64 nt, Homo Sapiens; identical to SEQ ID NO: 476496

SEQ ID NO: 713994 - RNA, 64 nt, Homo Sapiens; identical to SEQ ID NO: 476497

SEQ ID NO: 713995 - RNA, 64 nt, Homo Sapiens; identical to SEQ ID NO: 476498

SEQ ID NO: 713996 - RNA, 64 nt, Homo Sapiens; identical to SEQ ID NO: 476499

SEQ ID NO: 713997 - RNA, 64 nt, Homo Sapiens; identical to SEQ ID NO: 476500

SEQ ID NO: 713998 - RNA, 64 nt, Homo Sapiens; identical to SEQ ID NO: 476501

SEQ ID NO: 713999 - RNA, 64 nt, Homo Sapiens; identical to SEQ ID NO: 476502

SEQ ID NO: 714000 - RNA, 64 nt, Homo Sapiens; identical to SEQ ID NO: 476503

SEQ ID NO: 714001 - RNA, 64 nt, Homo Sapiens; identical to SEQ ID NO: 476504

SEQ ID NO: 714002 - RNA, 64 nt, Homo Sapiens; identical to SEQ ID NO: 476505

SEQ ID NO: 714003 - RNA, 64 nt, Homo Sapiens; identical to SEQ ID NO: 476506

SEQ ID NO: 714004 - RNA, 64 nt, Homo Sapiens; identical to SEQ ID NO: 476507

SEQ ID NO: 714005 - RNA, 64 nt, Homo Sapiens; identical to SEQ ID NO: 476508

SEQ ID NO: 714006 - RNA, 64 nt, Homo Sapiens; identical to SEQ ID NO: 476509

SEQ ID NO: 714007 - RNA, 64 nt, Homo Sapiens; identical to SEQ ID NO: 476510

SEQ ID NO: 714008 - RNA, 64 nt, Homo Sapiens; identical to SEQ ID NO: 476511

SEQ ID NO: 714009 - RNA, 64 nt, Homo Sapiens; identical to SEQ ID NO: 476512

SEQ ID NO: 714010 - RNA, 64 nt, Homo Sapiens; identical to SEQ ID NO: 476513

SEQ ID NO: 714011 - RNA, 64 nt, Homo Sapiens; identical to SEQ ID NO: 476514

SEQ ID NO: 714012 - RNA, 64 nt, Homo Sapiens; identical to SEQ ID NO: 476515

SEQ ID NO: 714013 - RNA, 64 nt, Homo Sapiens; identical to SEQ ID NO: 476516

SEQ ID NO: 714014 - RNA, 64 nt, Homo Sapiens; identical to SEQ ID NO: 476517

SEQ ID NO: 714015 - RNA, 59 nt, Homo Sapiens; identical to SEQ ID NO: 476518

SEQ ID NO: 714016 - RNA, 64 nt, Homo Sapiens; identical to SEQ ID NO: 476519

SEQ ID NO: 714017 - RNA, 64 nt, Homo Sapiens; identical to SEQ ID NO: 476520

SEQ ID NO: 714018 - RNA, 64 nt, Homo Sapiens; identical to SEQ ID NO: 476521

SEQ ID NO: 714019 - RNA, 64 nt, Homo Sapiens; identical to SEQ ID NO: 476522

SEQ ID NO: 714020 - RNA, 64 nt, Homo Sapiens; identical to SEQ ID NO: 476523

SEQ ID NO: 714021 - RNA, 64 nt, Homo Sapiens; identical to SEQ ID NO: 476524

SEQ ID NO: 714022 - RNA, 64 nt, Homo Sapiens; identical to SEQ ID NO: 476525

SEQ ID NO: 714023 - RNA, 64 nt, Homo Sapiens; identical to SEQ ID NO: 476526

SEQ ID NO: 714024 - RNA, 64 nt, Homo Sapiens; identical to SEQ ID NO: 476527

SEQ ID NO: 714025 - RNA, 64 nt, Homo Sapiens; identical to SEQ ID NO: 476528

SEQ ID NO: 714026 - RNA, 64 nt, Homo Sapiens; identical to SEQ ID NO: 476529

SEQ ID NO: 714027 - RNA, 64 nt, Homo Sapiens; identical to SEQ ID NO: 476530

SEQ ID NO: 714028 - RNA, 64 nt, Homo Sapiens; identical to SEQ ID NO: 476531

SEQ ID NO: 714029 - RNA, 64 nt, Homo Sapiens; identical to SEQ ID NO: 476532

SEQ ID NO: 714030 - RNA, 64 nt, Homo Sapiens; identical to SEQ ID NO: 476533

SEQ ID NO: 714031 - RNA, 64 nt, Homo Sapiens; identical to SEQ ID NO: 476534

SEQ ID NO: 714032 - RNA, 64 nt, Homo Sapiens; identical to SEQ ID NO: 476535

SEQ ID NO: 714033 - RNA, 64 nt, Homo Sapiens; identical to SEQ ID NO: 476536

SEQ ID NO: 714034 - RNA, 64 nt, Homo Sapiens; identical to SEQ ID NO: 476537

SEQ ID NO: 714035 - RNA, 64 nt, Homo Sapiens; identical to SEQ ID NO: 476538

SEQ ID NO: 714036 - RNA, 64 nt, Homo Sapiens; identical to SEQ ID NO: 476539

SEQ ID NO: 714037 - RNA, 64 nt, Homo Sapiens; identical to SEQ ID NO: 476540

SEQ ID NO: 714038 - RNA, 64 nt, Homo Sapiens; identical to SEQ ID NO: 476541

SEQ ID NO: 714039 - RNA, 64 nt, Homo Sapiens; identical to SEQ ID NO: 476542

SEQ ID NO: 714040 - RNA, 64 nt, Homo Sapiens; identical to SEQ ID NO: 476543

SEQ ID NO: 714041 - RNA, 64 nt, Homo Sapiens; identical to SEQ ID NO: 476544

SEQ ID NO: 714042 - RNA, 64 nt, Homo Sapiens; identical to SEQ ID NO: 476545

SEQ ID NO: 714043 - RNA, 64 nt, Homo Sapiens; identical to SEQ ID NO: 476546

SEQ ID NO: 714044 - RNA, 64 nt, Homo Sapiens; identical to SEQ ID NO: 476547

SEQ ID NO: 714045 - RNA, 64 nt, Homo Sapiens; identical to SEQ ID NO: 476548

SEQ ID NO: 714046 - RNA, 64 nt, Homo Sapiens; identical to SEQ ID NO: 476549

SEQ ID NO: 714047 - RNA, 64 nt, Homo Sapiens; identical to SEQ ID NO: 476550

SEQ ID NO: 714048 - RNA, 64 nt, Homo Sapiens; identical to SEQ ID NO: 476551

SEQ ID NO: 714049 - RNA, 64 nt, Homo Sapiens; identical to SEQ ID NO: 476552

SEQ ID NO: 714050 - RNA, 64 nt, Homo Sapiens; identical to SEQ ID NO: 476553

SEQ ID NO: 714051 - RNA, 64 nt, Homo Sapiens; identical to SEQ ID NO: 476554

SEQ ID NO: 714052 - RNA, 64 nt, Homo Sapiens; identical to SEQ ID NO: 307734

SEQ ID NO: 714053 - RNA, 64 nt, Homo Sapiens; identical to SEQ ID NO: 307735

SEQ ID NO: 714054 - RNA, 64 nt, Homo Sapiens; identical to SEQ ID NO: 307736

SEQ ID NO: 714055 - RNA, 64 nt, Homo Sapiens; identical to SEQ ID NO: 307737

SEQ ID NO: 714056 - RNA, 64 nt, Homo Sapiens; identical to SEQ ID NO: 307738

SEQ ID NO: 714057 - RNA, 64 nt, Homo Sapiens; identical to SEQ ID NO: 307739

SEQ ID NO: 714058 - RNA, 64 nt, Homo Sapiens; identical to SEQ ID NO: 307740

SEQ ID NO: 714059 - RNA, 64 nt, Homo Sapiens; identical to SEQ ID NO: 307741

SEQ ID NO: 714060 - RNA, 59 nt, Homo Sapiens; identical to SEQ ID NO: 307742

SEQ ID NO: 714061 - RNA, 64 nt, Homo Sapiens; identical to SEQ ID NO: 307743

SEQ ID NO: 714062 - RNA, 64 nt, Homo Sapiens; identical to SEQ ID NO: 307744

SEQ ID NO: 714063 - RNA, 64 nt, Homo Sapiens; identical to SEQ ID NO: 307745

SEQ ID NO: 714064 - RNA, 64 nt, Homo Sapiens; identical to SEQ ID NO: 307746

SEQ ID NO: 714065 - RNA, 64 nt, Homo Sapiens; identical to SEQ ID NO: 307747

SEQ ID NO: 714066 - RNA, 64 nt, Homo Sapiens; identical to SEQ ID NO: 307748

SEQ ID NO: 714067 - RNA, 64 nt, Homo Sapiens; identical to SEQ ID NO: 307749

SEQ ID NO: 714068 - RNA, 64 nt, Homo Sapiens; identical to SEQ ID NO: 307750

SEQ ID NO: 714069 - RNA, 64 nt, Homo Sapiens; identical to SEQ ID NO: 307751

SEQ ID NO: 714070 - RNA, 64 nt, Homo Sapiens; identical to SEQ ID NO: 307752

SEQ ID NO: 714071 - RNA, 64 nt, Homo Sapiens; identical to SEQ ID NO: 307753

SEQ ID NO: 714072 - RNA, 64 nt, Homo Sapiens; identical to SEQ ID NO: 307754

SEQ ID NO: 714073 - RNA, 64 nt, Homo Sapiens; identical to SEQ ID NO: 307755

SEQ ID NO: 714074 - RNA, 64 nt, Homo Sapiens; identical to SEQ ID NO: 307756

SEQ ID NO: 714075 - RNA, 64 nt, Homo Sapiens; identical to SEQ ID NO: 307757

SEQ ID NO: 714076 - RNA, 64 nt, Homo Sapiens; identical to SEQ ID NO: 307758

SEQ ID NO: 714077 - RNA, 64 nt, Homo Sapiens; identical to SEQ ID NO: 307759

SEQ ID NO: 714078 - RNA, 64 nt, Homo Sapiens; identical to SEQ ID NO: 307760

SEQ ID NO: 714079 - RNA, 64 nt, Homo Sapiens; identical to SEQ ID NO: 307761

SEQ ID NO: 714080 - RNA, 64 nt, Homo Sapiens; identical to SEQ ID NO: 307762

SEQ ID NO: 714081 - RNA, 64 nt, Homo Sapiens; identical to SEQ ID NO: 307763

SEQ ID NO: 714082 - RNA, 64 nt, Homo Sapiens; identical to SEQ ID NO: 307764

SEQ ID NO: 714083 - RNA, 64 nt, Homo Sapiens; identical to SEQ ID NO: 307765

SEQ ID NO: 714084 - RNA, 64 nt, Homo Sapiens; identical to SEQ ID NO: 307766

SEQ ID NO: 714085 - RNA, 64 nt, Homo Sapiens; identical to SEQ ID NO: 307767

SEQ ID NO: 714086 - RNA, 64 nt, Homo Sapiens; identical to SEQ ID NO: 307768

SEQ ID NO: 714087 - RNA, 64 nt, Homo Sapiens; identical to SEQ ID NO: 307769

SEQ ID NO: 714088 - RNA, 64 nt, Homo Sapiens; identical to SEQ ID NO: 307770

SEQ ID NO: 714089 - RNA, 64 nt, Homo Sapiens; identical to SEQ ID NO: 307771

SEQ ID NO: 714090 - RNA, 64 nt, Homo Sapiens; identical to SEQ ID NO: 307772

SEQ ID NO: 714091 - RNA, 64 nt, Homo Sapiens; identical to SEQ ID NO: 307773

SEQ ID NO: 714092 - RNA, 64 nt, Homo Sapiens; identical to SEQ ID NO: 307774

SEQ ID NO: 714093 - RNA, 64 nt, Homo Sapiens; identical to SEQ ID NO: 307775

SEQ ID NO: 714094 - RNA, 64 nt, Homo Sapiens; identical to SEQ ID NO: 307776

SEQ ID NO: 714095 - RNA, 64 nt, Homo Sapiens; identical to SEQ ID NO: 307777

SEQ ID NO: 714096 - RNA, 64 nt, Homo Sapiens; identical to SEQ ID NO: 307778

SEQ ID NO: 714097 - RNA, 64 nt, Homo Sapiens; identical to SEQ ID NO: 307779

SEQ ID NO: 714098 - RNA, 64 nt, Homo Sapiens; identical to SEQ ID NO: 307780

SEQ ID NO: 714099 - RNA, 64 nt, Homo Sapiens; identical to SEQ ID NO: 307781

SEQ ID NO: 714100 - RNA, 64 nt, Homo Sapiens; identical to SEQ ID NO: 307782

SEQ ID NO: 714101 - RNA, 64 nt, Homo Sapiens; identical to SEQ ID NO: 307783

SEQ ID NO: 714102 - RNA, 64 nt, Homo Sapiens; identical to SEQ ID NO: 307784

SEQ ID NO: 714103 - RNA, 64 nt, Homo Sapiens; identical to SEQ ID NO: 307785

SEQ ID NO: 714104 - RNA, 64 nt, Homo Sapiens; identical to SEQ ID NO: 307786

SEQ ID NO: 714105 - RNA, 64 nt, Homo Sapiens; identical to SEQ ID NO: 307787

SEQ ID NO: 714106 - RNA, 64 nt, Homo Sapiens; identical to SEQ ID NO: 307788

SEQ ID NO: 714107 - RNA, 64 nt, Homo Sapiens; identical to SEQ ID NO: 307789

SEQ ID NO: 714108 - RNA, 64 nt, Homo Sapiens; identical to SEQ ID NO: 307790

SEQ ID NO: 714109 - RNA, 64 nt, Homo Sapiens; identical to SEQ ID NO: 307791

SEQ ID NO: 714110 - RNA, 64 nt, Homo Sapiens; identical to SEQ ID NO: 307792

SEQ ID NO: 714111 - RNA, 64 nt, Homo Sapiens; identical to SEQ ID NO: 307793

SEQ ID NO: 714112 - RNA, 64 nt, Homo Sapiens; identical to SEQ ID NO: 307794

SEQ ID NO: 714113 - RNA, 64 nt, Homo Sapiens; identical to SEQ ID NO: 307795

SEQ ID NO: 714114 - RNA, 64 nt, Homo Sapiens; identical to SEQ ID NO: 307796

SEQ ID NO: 714115 - RNA, 62 nt, Homo Sapiens; identical to SEQ ID NO: 307797

SEQ ID NO: 714116 - RNA, 64 nt, Homo Sapiens; identical to SEQ ID NO: 307798

SEQ ID NO: 714117 - RNA, 64 nt, Homo Sapiens; identical to SEQ ID NO: 307799

SEQ ID NO: 714118 - RNA, 64 nt, Homo Sapiens; identical to SEQ ID NO: 307800

SEQ ID NO: 714119 - RNA, 64 nt, Homo Sapiens; identical to SEQ ID NO: 307801

SEQ ID NO: 714120 - RNA, 64 nt, Homo Sapiens; identical to SEQ ID NO: 307802

SEQ ID NO: 714121 - RNA, 64 nt, Homo Sapiens; identical to SEQ ID NO: 307803

SEQ ID NO: 714122 - RNA, 64 nt, Homo Sapiens; identical to SEQ ID NO: 307804

SEQ ID NO: 714123 - RNA, 64 nt, Homo Sapiens; identical to SEQ ID NO: 307805

SEQ ID NO: 714124 - RNA, 64 nt, Homo Sapiens; identical to SEQ ID NO: 307806

SEQ ID NO: 714125 - RNA, 64 nt, Homo Sapiens; identical to SEQ ID NO: 307807

SEQ ID NO: 714126 - RNA, 64 nt, Homo Sapiens; identical to SEQ ID NO: 307808

SEQ ID NO: 714127 - RNA, 64 nt, Homo Sapiens; identical to SEQ ID NO: 307809

SEQ ID NO: 714128 - RNA, 64 nt, Homo Sapiens
agaaucgcccgaucacagaccccgaucacagacgagcggucaccacgagcagucaucggacuca

SEQ ID NO: 714129 - RNA, 64 nt, Homo Sapiens
agacucgcccgaucacagaccccgaucacagacgagcggucaccacgagcagucaucggacuca

SEQ ID NO: 714130 - RNA, 64 nt, Homo Sapiens
ggaaucgcccgaucacagaccccgaucacagacgagcggucaccacgagcagucaucggacuca

SEQ ID NO: 714131 - RNA, 64 nt, Homo Sapiens
ggaaucgcccggucacagaccccgaucacagacgagcggucaccgaaugugcgguucggaauca

SEQ ID NO: 714132 - RNA, 64 nt, Homo Sapiens; identical to SEQ ID NO: 156400

SEQ ID NO: 714133 - RNA, 64 nt, Homo Sapiens; identical to SEQ ID NO: 156401

SEQ ID NO: 714134 - RNA, 64 nt, Homo Sapiens; identical to SEQ ID NO: 156402

SEQ ID NO: 714135 - RNA, 64 nt, Homo Sapiens; identical to SEQ ID NO: 156403

SEQ ID NO: 714136 - RNA, 64 nt, Homo Sapiens; identical to SEQ ID NO: 156404

SEQ ID NO: 714137 - RNA, 64 nt, Homo Sapiens; identical to SEQ ID NO: 156405

SEQ ID NO: 714138 - RNA, 64 nt, Homo Sapiens; identical to SEQ ID NO: 156406

SEQ ID NO: 714139 - RNA, 64 nt, Homo Sapiens; identical to SEQ ID NO: 156407

SEQ ID NO: 714140 - RNA, 64 nt, Homo Sapiens; identical to SEQ ID NO: 156408

SEQ ID NO: 714141 - RNA, 64 nt, Homo Sapiens; identical to SEQ ID NO: 156409

SEQ ID NO: 714142 - RNA, 64 nt, Homo Sapiens; identical to SEQ ID NO: 156410

SEQ ID NO: 714143 - RNA, 64 nt, Homo Sapiens; identical to SEQ ID NO: 156411

SEQ ID NO: 714144 - RNA, 64 nt, Homo Sapiens; identical to SEQ ID NO: 156412

SEQ ID NO: 714145 - RNA, 64 nt, Homo Sapiens; identical to SEQ ID NO: 156413

SEQ ID NO: 714146 - RNA, 64 nt, Homo Sapiens; identical to SEQ ID NO: 156414

SEQ ID NO: 714147 - RNA, 64 nt, Homo Sapiens; identical to SEQ ID NO: 156415

SEQ ID NO: 714148 - RNA, 64 nt, Homo Sapiens; identical to SEQ ID NO: 156416

SEQ ID NO: 714149 - RNA, 64 nt, Homo Sapiens; identical to SEQ ID NO: 156417

SEQ ID NO: 714150 - RNA, 64 nt, Homo Sapiens; identical to SEQ ID NO: 156418

SEQ ID NO: 714151 - RNA, 64 nt, Homo Sapiens; identical to SEQ ID NO: 156419

SEQ ID NO: 714152 - RNA, 64 nt, Homo Sapiens; identical to SEQ ID NO: 156420

SEQ ID NO: 714153 - RNA, 56 nt, Homo Sapiens; identical to SEQ ID NO: 156421

SEQ ID NO: 714154 - RNA, 64 nt, Homo Sapiens; identical to SEQ ID NO: 156422

SEQ ID NO: 714155 - RNA, 64 nt, Homo Sapiens; identical to SEQ ID NO: 156423

SEQ ID NO: 714156 - RNA, 64 nt, Homo Sapiens; identical to SEQ ID NO: 156424

SEQ ID NO: 714157 - RNA, 64 nt, Homo Sapiens; identical to SEQ ID NO: 156425

SEQ ID NO: 714158 - RNA, 64 nt, Homo Sapiens; identical to SEQ ID NO: 156426

SEQ ID NO: 714159 - RNA, 64 nt, Homo Sapiens; identical to SEQ ID NO: 156427

SEQ ID NO: 714160 - RNA, 64 nt, Homo Sapiens; identical to SEQ ID NO: 156428

SEQ ID NO: 714161 - RNA, 64 nt, Homo Sapiens; identical to SEQ ID NO: 156429

SEQ ID NO: 714162 - RNA, 64 nt, Homo Sapiens; identical to SEQ ID NO: 156430

SEQ ID NO: 714163 - RNA, 64 nt, Homo Sapiens; identical to SEQ ID NO: 156431

SEQ ID NO: 714164 - RNA, 64 nt, Homo Sapiens; identical to SEQ ID NO: 156432

SEQ ID NO: 714165 - RNA, 64 nt, Homo Sapiens; identical to SEQ ID NO: 156433

SEQ ID NO: 714166 - RNA, 64 nt, Homo Sapiens; identical to SEQ ID NO: 156434

SEQ ID NO: 714167 - RNA, 64 nt, Homo Sapiens; identical to SEQ ID NO: 156435

SEQ ID NO: 714168 - RNA, 64 nt, Homo Sapiens; identical to SEQ ID NO: 156436

SEQ ID NO: 714169 - RNA, 64 nt, Homo Sapiens; identical to SEQ ID NO: 361234

SEQ ID NO: 714170 - RNA, 64 nt, Homo Sapiens; identical to SEQ ID NO: 361235

SEQ ID NO: 714171 - RNA, 64 nt, Homo Sapiens; identical to SEQ ID NO: 361236

SEQ ID NO: 714172 - RNA, 64 nt, Homo Sapiens; identical to SEQ ID NO: 361237

SEQ ID NO: 714173 - RNA, 64 nt, Homo Sapiens; identical to SEQ ID NO: 361238

SEQ ID NO: 714174 - RNA, 64 nt, Homo Sapiens; identical to SEQ ID NO: 361239

SEQ ID NO: 714175 - RNA, 64 nt, Homo Sapiens; identical to SEQ ID NO: 564540

SEQ ID NO: 714176 - RNA, 64 nt, Homo Sapiens; identical to SEQ ID NO: 564541

SEQ ID NO: 714177 - RNA, 64 nt, Homo Sapiens; identical to SEQ ID NO: 564542

SEQ ID NO: 714178 - RNA, 64 nt, Homo Sapiens; identical to SEQ ID NO: 564543

SEQ ID NO: 714179 - RNA, 64 nt, Homo Sapiens; identical to SEQ ID NO: 564544

SEQ ID NO: 714180 - RNA, 64 nt, Homo Sapiens; identical to SEQ ID NO: 564545

SEQ ID NO: 714181 - RNA, 64 nt, Homo Sapiens; identical to SEQ ID NO: 564546

SEQ ID NO: 714182 - RNA, 64 nt, Homo Sapiens; identical to SEQ ID NO: 564547

SEQ ID NO: 714183 - RNA, 64 nt, Homo Sapiens; identical to SEQ ID NO: 564548

SEQ ID NO: 714184 - RNA, 64 nt, Homo Sapiens; identical to SEQ ID NO: 564549

SEQ ID NO: 714185 - RNA, 64 nt, Homo Sapiens; identical to SEQ ID NO: 564550

SEQ ID NO: 714186 - RNA, 64 nt, Homo Sapiens; identical to SEQ ID NO: 564551

SEQ ID NO: 714187 - RNA, 64 nt, Homo Sapiens; identical to SEQ ID NO: 564552

SEQ ID NO: 714188 - RNA, 64 nt, Homo Sapiens; identical to SEQ ID NO: 564553

SEQ ID NO: 714189 - RNA, 64 nt, Homo Sapiens; identical to SEQ ID NO: 564554

SEQ ID NO: 714190 - RNA, 64 nt, Homo Sapiens; identical to SEQ ID NO: 564555

SEQ ID NO: 714191 - RNA, 64 nt, Homo Sapiens; identical to SEQ ID NO: 564556

SEQ ID NO: 714192 - RNA, 64 nt, Homo Sapiens; identical to SEQ ID NO: 564557

SEQ ID NO: 714193 - RNA, 64 nt, Homo Sapiens; identical to SEQ ID NO: 564558

SEQ ID NO: 714194 - RNA, 64 nt, Homo Sapiens; identical to SEQ ID NO: 564559

SEQ ID NO: 714195 - RNA, 64 nt, Homo Sapiens; identical to SEQ ID NO: 564560

SEQ ID NO: 714196 - RNA, 64 nt, Homo Sapiens; identical to SEQ ID NO: 564561

SEQ ID NO: 714197 - RNA, 64 nt, Homo Sapiens; identical to SEQ ID NO: 564562

SEQ ID NO: 714198 - RNA, 64 nt, Homo Sapiens; identical to SEQ ID NO: 564563

SEQ ID NO: 714199 - RNA, 64 nt, Homo Sapiens; identical to SEQ ID NO: 564564

SEQ ID NO: 714200 - RNA, 64 nt, Homo Sapiens; identical to SEQ ID NO: 564565

SEQ ID NO: 714201 - RNA, 64 nt, Homo Sapiens; identical to SEQ ID NO: 564566

SEQ ID NO: 714202 - RNA, 64 nt, Homo Sapiens; identical to SEQ ID NO: 564567

SEQ ID NO: 714203 - RNA, 64 nt, Homo Sapiens; identical to SEQ ID NO: 564568

SEQ ID NO: 714204 - RNA, 64 nt, Homo Sapiens; identical to SEQ ID NO: 564569

SEQ ID NO: 714205 - RNA, 64 nt, Homo Sapiens; identical to SEQ ID NO: 564570

SEQ ID NO: 714206 - RNA, 64 nt, Homo Sapiens; identical to SEQ ID NO: 564571

SEQ ID NO: 714207 - RNA, 64 nt, Homo Sapiens; identical to SEQ ID NO: 564572

SEQ ID NO: 714208 - RNA, 64 nt, Homo Sapiens; identical to SEQ ID NO: 564573

SEQ ID NO: 714209 - RNA, 64 nt, Homo Sapiens; identical to SEQ ID NO: 564574

SEQ ID NO: 714210 - RNA, 64 nt, Homo Sapiens; identical to SEQ ID NO: 564575

SEQ ID NO: 714211 - RNA, 64 nt, Homo Sapiens; identical to SEQ ID NO: 564576

SEQ ID NO: 714212 - RNA, 64 nt, Homo Sapiens
ucacucugucugguauaggcuaauuuugaagaacucccauaaguuucugcugcuucucccauaa

SEQ ID NO: 714213 - RNA, 64 nt, Homo Sapiens
auuuugaagaacucccauaaguuucugcugcuucucccauaacugcugccaccaccaucagaau

SEQ ID NO: 714214 - RNA, 64 nt, Homo Sapiens; identical to SEQ ID NO: 395904

SEQ ID NO: 714215 - RNA, 64 nt, Homo Sapiens; identical to SEQ ID NO: 395905

SEQ ID NO: 714216 - RNA, 64 nt, Homo Sapiens; identical to SEQ ID NO: 395906

SEQ ID NO: 714217 - RNA, 64 nt, Homo Sapiens; identical to SEQ ID NO: 395907

SEQ ID NO: 714218 - RNA, 64 nt, Homo Sapiens; identical to SEQ ID NO: 395908

SEQ ID NO: 714219 - RNA, 64 nt, Homo Sapiens; identical to SEQ ID NO: 395909

SEQ ID NO: 714220 - RNA, 64 nt, Homo Sapiens
aaagcaauggaaucuagaauucuuauaacaugaauaacaaaauguacagcaagccuauguaguu

SEQ ID NO: 714221 - RNA, 64 nt, Homo Sapiens
aucuucuacauguaaaacauuucugaugauuuuuuaacaaaaaauauaugaauuucuucauuug

SEQ ID NO: 714222 - RNA, 64 nt, Homo Sapiens
cuuuguaacagacuugcgguuuuguugauaccacuaacaaaauguaaauguccauccuccugca

SEQ ID NO: 714223 - RNA, 64 nt, Homo Sapiens
cauuuuuuauaaauguccauggaguuggcaagcuuaacaaaaccguauaguccaugauaucuaa

SEQ ID NO: 714224 - RNA, 64 nt, Homo Sapiens
cuuaagagaacuuaaagaacuggugauuuuuuuuuaacaaaaaaagggaccauugcaacuuuug

SEQ ID NO: 714225 - RNA, 64 nt, Homo Sapiens
ggagaaaacugaugucuucuaugcauccgauucuuaacaaaacugcagggagcuugaaaaaaug

SEQ ID NO: 714226 - RNA, 64 nt, Homo Sapiens
cauguauguauaaccuguugugaacaaucauacuuaacaaaacuacugaugguuuaugacaacg

SEQ ID NO: 714227 - RNA, 64 nt, Homo Sapiens
gaauaaauaggcauaugauacccacuuggacuuuuaacaaaaguaaaggaauaaauuugcauau

SEQ ID NO: 714228 - RNA, 64 nt, Homo Sapiens
cauuuaacauugcuuucuuuggucauaaagguuauaacaaaauaacugcauaaguauuauuuua

SEQ ID NO: 714229 - RNA, 64 nt, Homo Sapiens
ggcaaaagaaaugcagauuuuuguguaaguuggguaacaaaaauguugcuuagcacuuugcgca

SEQ ID NO: 714230 - RNA, 64 nt, Homo Sapiens
gaacccagagcaaucuagaauguuagaaagaaacuaacaaaagaucagaagucagcuuguucac

SEQ ID NO: 714231 - RNA, 64 nt, Homo Sapiens
cuuugauaacuuaagaaccacauuggggccuucuuaacaaaaguggauuagaaccacuuucaaa

SEQ ID NO: 714232 - RNA, 64 nt, Homo Sapiens
gcauagcuaaaggcuaaacauauggcuuuaguaguaacaaaaggguucauagaaacuucauggu

SEQ ID NO: 714233 - RNA, 64 nt, Homo Sapiens
ggagggaauaaaucaugacuuaucccauuuucaauaacaaaacgaaacuauggcacuaaccaaa

SEQ ID NO: 714234 - RNA, 64 nt, Homo Sapiens
acaauacugaaugggaaaaguaucuaauauuuuguaacaaaaagaccuucauauuaucuguuuu

SEQ ID NO: 714235 - RNA, 64 nt, Homo Sapiens
gaagcaagaagaaagccauuguguccucuacaauuaacaaaacuuaucucugauauacaaaggg

SEQ ID NO: 714236 - RNA, 64 nt, Homo Sapiens
ucagugcuuguuuuuauuuucuugacacauuuauuaacaaaaugcaucauggaaaaaaaaaucu

SEQ ID NO: 714237 - RNA, 64 nt, Homo Sapiens
caacuagagauuauaaagucucuaaagaaggcaauaacaaaauuuaucaagauauaguacuuuu

SEQ ID NO: 714238 - RNA, 64 nt, Homo Sapiens
agguuuauagguaaagccaaucugugcuuagcauuaacaaaauauccuaugagcccauaagggu

SEQ ID NO: 714239 - RNA, 64 nt, Homo Sapiens
caaagcaguguucuaaauaauaaauacaaaguaauaacaaaaguuuaugaauaggauauacuaa

SEQ ID NO: 714240 - RNA, 62 nt, Homo Sapiens
gaaauuggcugccaucguccaauaaaaacaucaguaacaaaauguuaacuguucuuggaaaa

SEQ ID NO: 714241 - RNA, 64 nt, Homo Sapiens
aaaaaaaagcaggaaaaaagcucccaguauguuuuaacaaaaaauuccaguuuuucuuuacuuu

SEQ ID NO: 714242 - RNA, 64 nt, Homo Sapiens
uuguuacuuuuaaagggaauauggauaagcauaguaacaaaacccaccagaaucuaagcaguuu

SEQ ID NO: 714243 - RNA, 64 nt, Homo Sapiens
ucaggcuauuuuaaaaaaacaauauuugcuucuauaacaaaaggaaacaaaucuaagaaucauu

SEQ ID NO: 714244 - RNA, 64 nt, Homo Sapiens
aaguucuugaaaauauaugcauucuccuaaauauuaacaaaaaugauuuggggaaaugacaugg

SEQ ID NO: 714245 - RNA, 64 nt, Homo Sapiens
cauucaccuguuuuauaugguuuaaaauucucuuuaacaaaauucagaaaauucaccugaaacg

SEQ ID NO: 714246 - RNA, 64 nt, Homo Sapiens
gugaaacuccaucuccaaaaaaaaaaagaaaaaguaacaaaaggaaauuauuuguuuuugaaau

SEQ ID NO: 714247 - RNA, 64 nt, Homo Sapiens
ggucaaaguaaauguauacaguuuuauuacaauguaacaaaaguugaaaaucaggcagaugugu

SEQ ID NO: 714248 - RNA, 64 nt, Homo Sapiens
uuucuugugacugguaacauugagggaguaaugauaacaaaagguccuaguaagaauugaaucu

SEQ ID NO: 714249 - RNA, 64 nt, Homo Sapiens
uauaacugugaagcuuaauuaaugauaaaacauuuaacaaaauccacaaguauagaaaacucuu

SEQ ID NO: 714250 - RNA, 64 nt, Homo Sapiens
ccaguggcuuuuaaagaaagcugguccucagcacuaacaaaaucacuacaauagccuagugcuu

SEQ ID NO: 714251 - RNA, 64 nt, Homo Sapiens
uuuucaaagaauucuuuuuucccaaaaagaggaguaacaaaaugucauuucugaaagaggcuua

SEQ ID NO: 714252 - RNA, 64 nt, Homo Sapiens
uaucugucuauaucauucauuacguguaaguauuuaacaaaaaagcauucuugaccaugaauga

SEQ ID NO: 714253 - RNA, 64 nt, Homo Sapiens
uguuucuuucuuuccaaaaucagccuucugucuguaacaaaaauguacuuuauagagauggagg

SEQ ID NO: 714254 - RNA, 64 nt, Homo Sapiens
gucaagucuuuauaguuguaugaacuuucucuuuuaacaaaaauacacuccccuuaacugucuu

SEQ ID NO: 714255 - RNA, 64 nt, Homo Sapiens
ggagcaucugaauuacauccguguuauuaacaguuaacaaaacugcaaaacuuuguauaauucu

SEQ ID NO: 714256 - RNA, 64 nt, Homo Sapiens
auggggggauuguuuauaaaguuuggguaauuuauaacaaaauuugcuaagguuugcuaaaaau

SEQ ID NO: 714257 - RNA, 64 nt, Homo Sapiens
uucaauuuuaugauggagccucuuacagaaacauuaacaaaaugcaggaaucugccacauuucu

SEQ ID NO: 714258 - RNA, 64 nt, Homo Sapiens
gaucucugaaaggccacagcuggagcaauuugaguaacaaaauaaaguaguauuggguuauaac

SEQ ID NO: 714259 - RNA, 64 nt, Homo Sapiens
uggacuuuauuguccuguuucuaucaaauuggacuaacaaaaauugauauaauacauucaucac

SEQ ID NO: 714260 - RNA, 64 nt, Homo Sapiens
uucagccaaacuguagaugaagagggcucugaucuaacaaaauaagguuauaugaguagauacu

SEQ ID NO: 714261 - RNA, 64 nt, Homo Sapiens
uuuaguacucaauguuucuggacauucucuuugauaacaaaaaauaaauuuuaaaaaggaauuu

SEQ ID NO: 714262 - RNA, 64 nt, Homo Sapiens
gaagugauacucuuuauuacaagaaacaaggaauuaacaaaaauaaggaacuuguugcuaccuu

SEQ ID NO: 714263 - RNA, 64 nt, Homo Sapiens
gugauuaaaauccaaaacuuuagcuguauuucaguaacaaaaacauaccuuacuagacugugau

SEQ ID NO: 714264 - RNA, 64 nt, Homo Sapiens
aaaacuauuaugaaagucaauaaaauagauaauuuaacaaaaguacaggauuagaacaugcuua

SEQ ID NO: 714265 - RNA, 64 nt, Homo Sapiens
guaucuguuucauaugcuuuuaauuuuaaaggaauaacaaaacugucuggcucaacggcaaguu

SEQ ID NO: 714266 - RNA, 64 nt, Homo Sapiens
aagcuagucauugagguauaugacaaaauguaaauaacaaaaaacugaaaucuaccaaaagagc

SEQ ID NO: 714267 - RNA, 64 nt, Homo Sapiens
uugugugugugugguuuauaaauuuuacuacguguaacaaaagucugcuuuuccagcaugagca

SEQ ID NO: 714268 - RNA, 64 nt, Homo Sapiens
ucagaucccuccuucagcugaaauugguuucauuuaacaaaagauggccaaauauauaccguga

SEQ ID NO: 714269 - RNA, 64 nt, Homo Sapiens
uaaaacaugacauucccugcgguuuaauuucaguuaacaaaauggaucuuugguuuuuuuguca

SEQ ID NO: 714270 - RNA, 64 nt, Homo Sapiens
agacauguuauucauccccaguaguagacaaaauuaacaaaaucacaaggaaauauagggaaaa

SEQ ID NO: 714271 - RNA, 64 nt, Homo Sapiens
aaacauuuaauaaacauucaccuuuuacuucaguuaacaaaagaauaauucuacaagaauguuu

SEQ ID NO: 714272 - RNA, 64 nt, Homo Sapiens
augaaguauggagguguguauguuuauauguauauaacaaaauauuuucauugugaccacucug

SEQ ID NO: 714273 - RNA, 64 nt, Homo Sapiens
caauauuccuuauuaauacaaacacaaaaaucauuaacaaaaauauuagcaaacugaauccagc

SEQ ID NO: 714274 - RNA, 64 nt, Homo Sapiens
ccgucuaugggauuaaaagaauaauuaaucccuuuaacaaaaagcaaaucaguuuccuuuuaac

SEQ ID NO: 714275 - RNA, 64 nt, Homo Sapiens
aacaacgaguaauuuauaaaugagaaagaaacacuaacaaaaggguguuauuuuuguauauugu

SEQ ID NO: 714276 - RNA, 64 nt, Homo Sapiens
cuuuggauacaagguuuggcaaaaaaaaaaauauuaacaaaauauucuguaagaaucaauuguc

SEQ ID NO: 714277 - RNA, 64 nt, Homo Sapiens
ccuuuaucucuguaaaauuuauacacacaaaaauuaacaaaagauucuguaagaauuaauuggc

SEQ ID NO: 714278 - RNA, 64 nt, Homo Sapiens
guacuauguuaugcacacaucauauauguaacuguaacaaaaguuuucuccucugcuaacuauu

SEQ ID NO: 714279 - RNA, 64 nt, Homo Sapiens
gauaaaauacaauugaagcaaaaucauguuuuuuuaacaaaagaugcaguucaguuacaagaug

SEQ ID NO: 714280 - RNA, 64 nt, Homo Sapiens; identical to SEQ ID NO: 484563

SEQ ID NO: 714281 - RNA, 64 nt, Homo Sapiens; identical to SEQ ID NO: 484564

SEQ ID NO: 714282 - RNA, 64 nt, Homo Sapiens; identical to SEQ ID NO: 484565

SEQ ID NO: 714283 - RNA, 64 nt, Homo Sapiens; identical to SEQ ID NO: 484566

SEQ ID NO: 714284 - RNA, 64 nt, Homo Sapiens; identical to SEQ ID NO: 484567

SEQ ID NO: 714285 - RNA, 64 nt, Homo Sapiens; identical to SEQ ID NO: 484568

SEQ ID NO: 714286 - RNA, 64 nt, Homo Sapiens; identical to SEQ ID NO: 484569

SEQ ID NO: 714287 - RNA, 64 nt, Homo Sapiens; identical to SEQ ID NO: 484570

SEQ ID NO: 714288 - RNA, 64 nt, Homo Sapiens; identical to SEQ ID NO: 484571

SEQ ID NO: 714289 - RNA, 64 nt, Homo Sapiens; identical to SEQ ID NO: 484572

SEQ ID NO: 714290 - RNA, 64 nt, Homo Sapiens; identical to SEQ ID NO: 484573

SEQ ID NO: 714291 - RNA, 64 nt, Homo Sapiens; identical to SEQ ID NO: 484574

SEQ ID NO: 714292 - RNA, 64 nt, Homo Sapiens; identical to SEQ ID NO: 484575

SEQ ID NO: 714293 - RNA, 64 nt, Homo Sapiens; identical to SEQ ID NO: 484576

SEQ ID NO: 714294 - RNA, 64 nt, Homo Sapiens; identical to SEQ ID NO: 484577

SEQ ID NO: 714295 - RNA, 64 nt, Homo Sapiens; identical to SEQ ID NO: 484578

SEQ ID NO: 714296 - RNA, 64 nt, Homo Sapiens; identical to SEQ ID NO: 484579

SEQ ID NO: 714297 - RNA, 64 nt, Homo Sapiens; identical to SEQ ID NO: 484580

SEQ ID NO: 714298 - RNA, 64 nt, Homo Sapiens; identical to SEQ ID NO: 484581

SEQ ID NO: 714299 - RNA, 64 nt, Homo Sapiens; identical to SEQ ID NO: 484582

SEQ ID NO: 714300 - RNA, 64 nt, Homo Sapiens; identical to SEQ ID NO: 484583

SEQ ID NO: 714301 - RNA, 64 nt, Homo Sapiens; identical to SEQ ID NO: 484584

SEQ ID NO: 714302 - RNA, 64 nt, Homo Sapiens; identical to SEQ ID NO: 484585

SEQ ID NO: 714303 - RNA, 64 nt, Homo Sapiens; identical to SEQ ID NO: 484586

SEQ ID NO: 714304 - RNA, 64 nt, Homo Sapiens; identical to SEQ ID NO: 484587

SEQ ID NO: 714305 - RNA, 64 nt, Homo Sapiens; identical to SEQ ID NO: 484588

SEQ ID NO: 714306 - RNA, 64 nt, Homo Sapiens; identical to SEQ ID NO: 484589

SEQ ID NO: 714307 - RNA, 64 nt, Homo Sapiens; identical to SEQ ID NO: 484590

SEQ ID NO: 714308 - RNA, 64 nt, Homo Sapiens; identical to SEQ ID NO: 484591

SEQ ID NO: 714309 - RNA, 64 nt, Homo Sapiens; identical to SEQ ID NO: 484592

SEQ ID NO: 714310 - RNA, 64 nt, Homo Sapiens; identical to SEQ ID NO: 484593

SEQ ID NO: 714311 - RNA, 64 nt, Homo Sapiens; identical to SEQ ID NO: 484594

SEQ ID NO: 714312 - RNA, 64 nt, Homo Sapiens; identical to SEQ ID NO: 484595

SEQ ID NO: 714313 - RNA, 64 nt, Homo Sapiens; identical to SEQ ID NO: 484596

SEQ ID NO: 714314 - RNA, 64 nt, Homo Sapiens; identical to SEQ ID NO: 484597

SEQ ID NO: 714315 - RNA, 64 nt, Homo Sapiens; identical to SEQ ID NO: 484598

SEQ ID NO: 714316 - RNA, 64 nt, Homo Sapiens; identical to SEQ ID NO: 484599

SEQ ID NO: 714317 - RNA, 64 nt, Homo Sapiens; identical to SEQ ID NO: 484600

SEQ ID NO: 714318 - RNA, 58 nt, Homo Sapiens; identical to SEQ ID NO: 165744

SEQ ID NO: 714319 - RNA, 64 nt, Homo Sapiens; identical to SEQ ID NO: 484602

SEQ ID NO: 714320 - RNA, 64 nt, Homo Sapiens; identical to SEQ ID NO: 484603

SEQ ID NO: 714321 - RNA, 64 nt, Homo Sapiens; identical to SEQ ID NO: 484604

SEQ ID NO: 714322 - RNA, 64 nt, Homo Sapiens; identical to SEQ ID NO: 484605

SEQ ID NO: 714323 - RNA, 64 nt, Homo Sapiens; identical to SEQ ID NO: 484606

SEQ ID NO: 714324 - RNA, 64 nt, Homo Sapiens; identical to SEQ ID NO: 484607

SEQ ID NO: 714325 - RNA, 64 nt, Homo Sapiens; identical to SEQ ID NO: 484608

SEQ ID NO: 714326 - RNA, 64 nt, Homo Sapiens; identical to SEQ ID NO: 484609

SEQ ID NO: 714327 - RNA, 64 nt, Homo Sapiens
gagauucagaaguuaggggucgaugauauagagugacuuggagaaaagacaguauuugcagugc

SEQ ID NO: 714328 - RNA, 64 nt, Homo Sapiens
aauucaugguaucuugagucuaauuauuuucugagacuuggauugggauugucuuuuuuuuuuu

SEQ ID NO: 714329 - RNA, 64 nt, Homo Sapiens
uagagcaggugguugaagagaucuucucuggucagacuuggaagaauuuccaaaacugaaguua

SEQ ID NO: 714330 - RNA, 64 nt, Homo Sapiens
uauuuugagcuuuggguucucaguagugaauugagacuuggaggugacuuuucauguuuggagu

SEQ ID NO: 714331 - RNA, 64 nt, Homo Sapiens
caugcagguguguguggugguucaauaaagaccugacuuggagaauugagaggccccugccacu

SEQ ID NO: 714332 - RNA, 64 nt, Homo Sapiens
gugcccugugcuaugucgugauaagaacugugcugacuuggaaguuguuuuuguucugagcucc

SEQ ID NO: 714333 - RNA, 64 nt, Homo Sapiens
guuuggcuuauacaaggugaagggccuugggaaagacuuggaggagcucagcagcagcagugag

SEQ ID NO: 714334 - RNA, 64 nt, Homo Sapiens
caauguuugaacaaacucaaaagcucacacauuugacuuggaaguguucauguuuuagguaaaa

SEQ ID NO: 714335 - RNA, 64 nt, Homo Sapiens
cgggaagggccuccugucccggacccggcauucggacuuggacucggggccgugggcucggccc

SEQ ID NO: 714336 - RNA, 64 nt, Homo Sapiens
cggggccaugggcuuggcccggaccuggcauccggacuuggacuuagggccgugggcucggccc

SEQ ID NO: 714337 - RNA, 64 nt, Homo Sapiens
gaguuacagaguaauuaaaugggguguucacagugacuuggauacaccaauuagaaauuaaaua

SEQ ID NO: 714338 - RNA, 64 nt, Homo Sapiens
auagaaccuggaauguuaggauuuugaaauguuagacuuggaaggggccuggucugucaacuag

SEQ ID NO: 714339 - RNA, 64 nt, Homo Sapiens
gacuauggaucuggcagauucuuuauccuuuguggacuuggaggaauuauuagcuguggcacaa

SEQ ID NO: 714340 - RNA, 64 nt, Homo Sapiens
gaaaaagguagcagugcuucucugguccucaagagacuuggauuuaaagguaggaugauguuuu

SEQ ID NO: 714341 - RNA, 64 nt, Homo Sapiens
cccuuggaguauggcuuuucgggacugugcgcuggacuuggagccugccuugcugggcccuucu

SEQ ID NO: 714342 - RNA, 64 nt, Homo Sapiens
uggggacaucaggguagcugcucaaaggagucaggacuuggaagccggacacccccugggaugg

SEQ ID NO: 714343 - RNA, 64 nt, Homo Sapiens
gggugaagccagcugggcuccugagucugguggggacuuggagaaccuuuaugucuagcuaagg

SEQ ID NO: 714344 - RNA, 64 nt, Homo Sapiens
caauccacacucuguaucuggcuacucugguggggacuuggagaaccuuuguguccacacucug

SEQ ID NO: 714345 - RNA, 64 nt, Homo Sapiens
uucuuggaagacauggauuguugauuuacuggaagacuuggagcgacuggauuugcuggaagac

SEQ ID NO: 714346 - RNA, 64 nt, Homo Sapiens
ugguggaagacacagauuuuuagauuuacuggaagacuuggauucuagauuuuucuggaagaac

SEQ ID NO: 714347 - RNA, 64 nt, Homo Sapiens
cauuauguauauuaauuaaauaauaaauuauaugaacuacuauauguccuauagaaaaugccau

SEQ ID NO: 714348 - RNA, 64 nt, Homo Sapiens
aacuugagucaucccgacguaaaccgugugaagcaacuacuauagguggcauccaagucuugga

SEQ ID NO: 714349 - RNA, 64 nt, Homo Sapiens
ugucaguuaugaaauuauuauaauucagccuucaaacuacuacugaucaacuaaaggaaagcua

SEQ ID NO: 714350 - RNA, 64 nt, Homo Sapiens
guggacgauguuugaugauuagacggucaucucuaacuacuaaacuaauaucugcauucuuguu

SEQ ID NO: 714351 - RNA, 63 nt, Homo Sapiens
uggggggacccagcaaggacucagagagucagacagugccacuuggccacuugggguaaagcc

SEQ ID NO: 714352 - RNA, 63 nt, Homo Sapiens
cagacagugccacuuggccacuugggguaaagccagugccagcaauaacaguuuaucaugcuc

SEQ ID NO: 714353 - RNA, 63 nt, Homo Sapiens
ccacagccuugggcccuagguaccccagcugaucagugccaggagagaccagagccucuggag

SEQ ID NO: 714354 - RNA, 63 nt, Homo Sapiens
acacccccuccucugagcucugaauaugggacccagugccaggagcuggaagacaagguguuu

SEQ ID NO: 714355 - RNA, 63 nt, Homo Sapiens
aaccuuucccaagccuuccuggcccacaguggccagugccauaggcagugcuguggacaguag

SEQ ID NO: 714356 - RNA, 63 nt, Homo Sapiens
ccagcaauacaugugcagggguugcugcuuucccagugccaggagaacccccgcuccgaguca

SEQ ID NO: 714357 - RNA, 63 nt, Homo Sapiens
aucuggcauguguuucuuggauaggggccagugcagugccauccuacagguggcuggagcagc

SEQ ID NO: 714358 - RNA, 63 nt, Homo Sapiens
gcacccaguccagaaggagcaauggcaccugggcagugccagggcuuaaagcccgcugcuccu

SEQ ID NO: 714359 - RNA, 63 nt, Homo Sapiens
ugcuaccacuucccaauaaaauauuuagugggucagugccaaguggggcaguuuuaguucuuu

SEQ ID NO: 714360 - RNA, 63 nt, Homo Sapiens
caguaucuccuggcguucuacaucagccuugcccagugccacagucucugaggcucuuugugg

SEQ ID NO: 714361 - RNA, 63 nt, Homo Sapiens
uuguuaggaaaacccaugggccgccgccacacucagugccauggggaagcgggcgucuccccc

SEQ ID NO: 714362 - RNA, 63 nt, Homo Sapiens
cccagggucuaacgguuaaggggacccacauaccagugccaagggggaugucaaguggugaug

SEQ ID NO: 714363 - RNA, 63 nt, Homo Sapiens
agugauuccuuggugacagguugagggcagcuccagugccagcaauaggguggcacagaagcu

SEQ ID NO: 714364 - RNA, 63 nt, Homo Sapiens
guggagcuggacuacggcggcaguauggaauuccagugccaggccagugaccucauucccgag

SEQ ID NO: 714365 - RNA, 63 nt, Homo Sapiens
uucaccaccguauucucagucacuuccacuaaacagugccaguguuuuaagguucugucacac

SEQ ID NO: 714366 - RNA, 63 nt, Homo Sapiens
gguuuguggcaggccuguguugagcaagacuaucagugccauuuuuuuucaacagcaugugcu

SEQ ID NO: 714367 - RNA, 63 nt, Homo Sapiens
gugacccaagaggcaggguugcaggccuuacagcagugccacgggccuggccauagggcaaga

SEQ ID NO: 714368 - RNA, 63 nt, Homo Sapiens
acucagaagucuggcagguguuagcuaauccuucagugccagcuugccacucagguugcaaaa

SEQ ID NO: 714369 - RNA, 63 nt, Homo Sapiens
accaauuaauucuugccaggcacugcugagaagcagugccauuaauuucucaggauauuuuug

SEQ ID NO: 714370 - RNA, 63 nt, Homo Sapiens
uaauuaaaagauacacugucgaaagugaaauuucagugccaaugcuacuagaaugcagcuaag

SEQ ID NO: 714371 - RNA, 63 nt, Homo Sapiens
auaaaccuguacccagcuguccccuuucaccuccagugccacaccggugcuggccacaccagc

SEQ ID NO: 714372 - RNA, 63 nt, Homo Sapiens
aggucauccgguggguggccucccgugugucaccagugccacaggcagcaacaacggcaagac

SEQ ID NO: 714373 - RNA, 63 nt, Homo Sapiens
auauaauacuaaucuaaacaguacuagaaauuacagugccaagagccaccaggaggcccagcc

SEQ ID NO: 714374 - RNA, 63 nt, Homo Sapiens
gagguagagcaaugaucagaugggugcacagaccagugccaaucugaacauuguuaauggccu

SEQ ID NO: 714375 - RNA, 63 nt, Homo Sapiens
uguuggugccauuuucagcaauuacggcuuugacagugccaccucuuugaugccaaaucagca

SEQ ID NO: 714376 - RNA, 63 nt, Homo Sapiens
ccccucaccacauacccuuugccuuuuagaacucagugccauccugggugcccagggcagagc

SEQ ID NO: 714377 - RNA, 63 nt, Homo Sapiens
ccuagcccuguggcuuccaccagucuccuccugcagugccacgugguggcauuucucgccuca

SEQ ID NO: 714378 - RNA, 63 nt, Homo Sapiens
uuaaagcauucuuucuagguuauuuuggggggacagugccaaguccaucuuugcccagucaau

SEQ ID NO: 714379 - RNA, 63 nt, Homo Sapiens
cauguuuaucauauauccuuaaguggacacauacagugccauguugaugugccucucaguuuu

SEQ ID NO: 714380 - RNA, 63 nt, Homo Sapiens
caugcccuuccccugggcuagauccccguaccacagugccagcgagggccuguccacacccug

SEQ ID NO: 714381 - RNA, 63 nt, Homo Sapiens
cucugaucugaggaccccgugccagggcuggggcagugccagaaggugccaaagagcaggccg

SEQ ID NO: 714382 - RNA, 63 nt, Homo Sapiens
cagucuuuaugcaaaugaaaagauggagcaaaccagugccaucaaaacagccacaauaaucag

SEQ ID NO: 714383 - RNA, 54 nt, Homo Sapiens; identical to SEQ ID NO: 248291

SEQ ID NO: 714384 - RNA, 63 nt, Homo Sapiens
cacuccuugggccccuaggaggacacauuugggcagugccaccguugauguuuccugcccaaa

SEQ ID NO: 714385 - RNA, 63 nt, Homo Sapiens
caauccgggcaggacccucguuccuuuugcccucagugccagcuccccugacaaucuggaagg

SEQ ID NO: 714386 - RNA, 63 nt, Homo Sapiens
auuuccauuucagccaguggguagcugauaagccagugccagcauccagcaugagcagauguc

SEQ ID NO: 714387 - RNA, 63 nt, Homo Sapiens
agcguuacugcucuccuucccuucaugauaagccagugccagcauccagcgugagcagacguc

SEQ ID NO: 714388 - RNA, 63 nt, Homo Sapiens
cuccuggcugcaggcacccccagccagaacacgcagugccagccgugccccccaggcaccuuc

SEQ ID NO: 714389 - RNA, 63 nt, Homo Sapiens
ggcaccuucucagccagcagcuccagcucagagcagugccagccccaccgcaacugcacggcc

SEQ ID NO: 714390 - RNA, 63 nt, Homo Sapiens
agggcagaggugcuaccuggccuggcuccuuaucagugccaugaugccccaccugcccugcuu

SEQ ID NO: 714391 - RNA, 63 nt, Homo Sapiens
cagggcagaggagagcagcucuuacuccugguucagugccacggaggcuagaacagagaagcc

SEQ ID NO: 714392 - RNA, 64 nt, Homo Sapiens; identical to SEQ ID NO: 79348

SEQ ID NO: 714393 - RNA, 64 nt, Homo Sapiens; identical to SEQ ID NO: 79349

SEQ ID NO: 714394 - RNA, 64 nt, Homo Sapiens; identical to SEQ ID NO: 79350

SEQ ID NO: 714395 - RNA, 64 nt, Homo Sapiens; identical to SEQ ID NO: 79351

SEQ ID NO: 714396 - RNA, 64 nt, Homo Sapiens; identical to SEQ ID NO: 79352

SEQ ID NO: 714397 - RNA, 64 nt, Homo Sapiens; identical to SEQ ID NO: 79353

SEQ ID NO: 714398 - RNA, 64 nt, Homo Sapiens; identical to SEQ ID NO: 79354

SEQ ID NO: 714399 - RNA, 64 nt, Homo Sapiens; identical to SEQ ID NO: 79355

SEQ ID NO: 714400 - RNA, 64 nt, Homo Sapiens; identical to SEQ ID NO: 79356

SEQ ID NO: 714401 - RNA, 64 nt, Homo Sapiens; identical to SEQ ID NO: 79357

SEQ ID NO: 714402 - RNA, 64 nt, Homo Sapiens; identical to SEQ ID NO: 79358

SEQ ID NO: 714403 - RNA, 64 nt, Homo Sapiens; identical to SEQ ID NO: 79359

SEQ ID NO: 714404 - RNA, 64 nt, Homo Sapiens; identical to SEQ ID NO: 79360

SEQ ID NO: 714405 - RNA, 64 nt, Homo Sapiens; identical to SEQ ID NO: 79361

SEQ ID NO: 714406 - RNA, 64 nt, Homo Sapiens; identical to SEQ ID NO: 79362

SEQ ID NO: 714407 - RNA, 64 nt, Homo Sapiens; identical to SEQ ID NO: 79363

SEQ ID NO: 714408 - RNA, 64 nt, Homo Sapiens; identical to SEQ ID NO: 79364

SEQ ID NO: 714409 - RNA, 64 nt, Homo Sapiens; identical to SEQ ID NO: 79365

SEQ ID NO: 714410 - RNA, 64 nt, Homo Sapiens; identical to SEQ ID NO: 79366

SEQ ID NO: 714411 - RNA, 64 nt, Homo Sapiens; identical to SEQ ID NO: 79367

SEQ ID NO: 714412 - RNA, 64 nt, Homo Sapiens; identical to SEQ ID NO: 79368

SEQ ID NO: 714413 - RNA, 64 nt, Homo Sapiens; identical to SEQ ID NO: 79369

SEQ ID NO: 714414 - RNA, 64 nt, Homo Sapiens; identical to SEQ ID NO: 79370

SEQ ID NO: 714415 - RNA, 64 nt, Homo Sapiens; identical to SEQ ID NO: 79371

SEQ ID NO: 714416 - RNA, 64 nt, Homo Sapiens; identical to SEQ ID NO: 79372

SEQ ID NO: 714417 - RNA, 64 nt, Homo Sapiens; identical to SEQ ID NO: 79373

SEQ ID NO: 714418 - RNA, 64 nt, Homo Sapiens; identical to SEQ ID NO: 79374

SEQ ID NO: 714419 - RNA, 64 nt, Homo Sapiens; identical to SEQ ID NO: 79375

SEQ ID NO: 714420 - RNA, 64 nt, Homo Sapiens; identical to SEQ ID NO: 79376

SEQ ID NO: 714421 - RNA, 64 nt, Homo Sapiens; identical to SEQ ID NO: 79377

SEQ ID NO: 714422 - RNA, 64 nt, Homo Sapiens; identical to SEQ ID NO: 79378

SEQ ID NO: 714423 - RNA, 64 nt, Homo Sapiens; identical to SEQ ID NO: 79379

SEQ ID NO: 714424 - RNA, 64 nt, Homo Sapiens; identical to SEQ ID NO: 79380

SEQ ID NO: 714425 - RNA, 64 nt, Homo Sapiens; identical to SEQ ID NO: 79381

SEQ ID NO: 714426 - RNA, 64 nt, Homo Sapiens; identical to SEQ ID NO: 79382

SEQ ID NO: 714427 - RNA, 64 nt, Homo Sapiens; identical to SEQ ID NO: 79383

SEQ ID NO: 714428 - RNA, 64 nt, Homo Sapiens; identical to SEQ ID NO: 79384

SEQ ID NO: 714429 - RNA, 64 nt, Homo Sapiens; identical to SEQ ID NO: 79385

SEQ ID NO: 714430 - RNA, 64 nt, Homo Sapiens; identical to SEQ ID NO: 79386

SEQ ID NO: 714431 - RNA, 64 nt, Homo Sapiens; identical to SEQ ID NO: 79387

SEQ ID NO: 714432 - RNA, 64 nt, Homo Sapiens; identical to SEQ ID NO: 79388

SEQ ID NO: 714433 - RNA, 64 nt, Homo Sapiens; identical to SEQ ID NO: 79389

SEQ ID NO: 714434 - RNA, 64 nt, Homo Sapiens; identical to SEQ ID NO: 79390

SEQ ID NO: 714435 - RNA, 64 nt, Homo Sapiens; identical to SEQ ID NO: 79391

SEQ ID NO: 714436 - RNA, 64 nt, Homo Sapiens; identical to SEQ ID NO: 558415

SEQ ID NO: 714437 - RNA, 64 nt, Homo Sapiens; identical to SEQ ID NO: 558416

SEQ ID NO: 714438 - RNA, 64 nt, Homo Sapiens; identical to SEQ ID NO: 558417

SEQ ID NO: 714439 - RNA, 64 nt, Homo Sapiens; identical to SEQ ID NO: 558418

SEQ ID NO: 714440 - RNA, 64 nt, Homo Sapiens
accuccuacuucucuuucuuguaaugaaacucuucaccuuuaggagaccugggcaguccuguca

SEQ ID NO: 714441 - RNA, 64 nt, Homo Sapiens
augcacacaaauagcuaaggagaauccacccaaacaccuuuaaaggauaggugucuguucauag

SEQ ID NO: 714442 - RNA, 64 nt, Homo Sapiens
uuugcacuuuuaauucaacaaagcuauuuacaaacaccuuuacuaugucaagcagaauaauuug

SEQ ID NO: 714443 - RNA, 64 nt, Homo Sapiens
acaguccuugcauccauucuguaacuacaccaaacaccuuuaguaguugugcaaagugaacauu

SEQ ID NO: 714444 - RNA, 64 nt, Homo Sapiens
uucaugaauaagcuucagcuaguuuagcguuaagcaccuuuaucaaaucuaagcuuagaagaaa

SEQ ID NO: 714445 - RNA, 64 nt, Homo Sapiens
ccuucugagcacucucucggcauugccuucacuccaccuuuaguuugggauacuaaucccuaga

SEQ ID NO: 714446 - RNA, 64 nt, Homo Sapiens
aauuuccuauuugaugguuuugcuccuuuuucaccaccuuuaccggucaacggagaauacuagc

SEQ ID NO: 714447 - RNA, 64 nt, Homo Sapiens
auuucuuaguuucauuucaaagagacugaaaggccaccuuuaggacuucagaagcuccuaaaac

SEQ ID NO: 714448 - RNA, 64 nt, Homo Sapiens
aaauguugccagagcagcaaaagcuguugagcaacaccuuuaugcuucagccuagggauaccug

SEQ ID NO: 714449 - RNA, 64 nt, Homo Sapiens
aaggccuuucuuuagaucugcauuaguuugcauucaccuuuacagucacauuuccauguuucaa

SEQ ID NO: 714450 - RNA, 64 nt, Homo Sapiens
gaauccaaauacauccaaaaucguugauuguacucaccuuuauggaaucucccacuucaguuuc

SEQ ID NO: 714451 - RNA, 64 nt, Homo Sapiens
uaagaauuaaaaccaaccuauugaaaguacucgacaccuuuagacaacucggaauauagcucuu

SEQ ID NO: 714452 - RNA, 64 nt, Homo Sapiens
cccccaccugagccccagcucgcugaccuugccucaccuuuaaccccucugagcugcacuucac

SEQ ID NO: 714453 - RNA, 64 nt, Homo Sapiens
uuugcagaccuuccuucaccgacucuggaaaccgcaccuuuaacagccccgcuucaccccuucu

SEQ ID NO: 714454 - RNA, 64 nt, Homo Sapiens
cuguuuugacagaaacugacaggaaucaaucaaaacaaucgaauuuugaauugaguaaagugca

SEQ ID NO: 714455 - RNA, 64 nt, Homo Sapiens
cacggcucuucuucccacggcacuuucugauguaacaaucgaguguguguuuucccaacugcag

SEQ ID NO: 714456 - RNA, 64 nt, Homo Sapiens
uauuagcauuucuuaguauuaaaugacugaugcaacaaucgagucggcuaugcuaacuugacaa

SEQ ID NO: 714457 - RNA, 64 nt, Homo Sapiens
gccuugcagcacucacacagagaagcucccaggaacaaucgauggggggaaagccaaggucugg

SEQ ID NO: 714458 - RNA, 64 nt, Homo Sapiens
uugcugaacaaugguuaauuaagauauugcuaacacaaucgagugauaauacaguuuuacugca

SEQ ID NO: 714459 - RNA, 64 nt, Homo Sapiens
acauugggccuugauuuuaaguuguuauauuuguacaaucgaguauuuuagaaauuacaugaaa

SEQ ID NO: 714460 - RNA, 64 nt, Homo Sapiens
acugcacaacuccuagaaggaggugaaguuucacacaaucgaagggcauugccacaaaucagcc

SEQ ID NO: 714461 - RNA, 64 nt, Homo Sapiens
uccuagccccacccagagguggagaacguuugguacaaucgacaugauucccucucccacccaa

SEQ ID NO: 714462 - RNA, 64 nt, Homo Sapiens
acuccgcugucggcacauucagcugagguucauuacaaucgagacugcaaugugaucuauguuu

SEQ ID NO: 714463 - RNA, 64 nt, Homo Sapiens
acauaaauauuuucuauguguguuucaguggaugacaaucgagcagcagaagaauggugugccu

SEQ ID NO: 714464 - RNA, 64 nt, Homo Sapiens
ccacuucccauccaggccuccacugugccaccggacaaucgagacaggcugcugacuggcccca

SEQ ID NO: 714465 - RNA, 64 nt, Homo Sapiens
uuugaaucacaauauuugauguacagucauuuugacaaucgauaggcaaaacaacuuugauaug

SEQ ID NO: 714466 - RNA, 64 nt, Homo Sapiens
ugaacacauuggccaaauaaggcauuucuauuucacaaucgaaucagacgcugacaguucuuca

SEQ ID NO: 714467 - RNA, 64 nt, Homo Sapiens
aaugaaauucuuacagccugccugguuuuauuuaacaaucgacaagagaccugcauugcuuucu

SEQ ID NO: 714468 - RNA, 64 nt, Homo Sapiens
gacugugcggaauuuaguggcaguggcuggaacgacaaucgaugugacguugacaauuacugga

SEQ ID NO: 714469 - RNA, 64 nt, Homo Sapiens
gccaccgcgcccggccccuaaguuaauauuucaaacaaucgaagguaaaacaacauauuguguu

SEQ ID NO: 714470 - RNA, 64 nt, Homo Sapiens
agcuccuuggacagacuguuagguggucccuucuacaaucgagcauccagaagguucguuagcc

SEQ ID NO: 714471 - RNA, 64 nt, Homo Sapiens
uaauguggccuugaauuuuaacacgacaaaagagacaaucgauagaucucggccagccaaagac

SEQ ID NO: 714472 - RNA, 64 nt, Homo Sapiens
augugccaagucugcagcacagugaccaaaucugacaaucgagcucuggaucaccacuugauua

SEQ ID NO: 714473 - RNA, 64 nt, Homo Sapiens
ucuggcuugagaacgaccuuuuccccaagacaagacaaucgaggucccccaccuccccacuuuu

SEQ ID NO: 714474 - RNA, 64 nt, Homo Sapiens
uagucccacaacugcaaaacgucuuacugaagcaacaaucgaaaaaugguucuguuuuaaaaag

SEQ ID NO: 714475 - RNA, 64 nt, Homo Sapiens; identical to SEQ ID NO: 363148

SEQ ID NO: 714476 - RNA, 64 nt, Homo Sapiens; identical to SEQ ID NO: 363149

SEQ ID NO: 714477 - RNA, 64 nt, Homo Sapiens; identical to SEQ ID NO: 363150

SEQ ID NO: 714478 - RNA, 64 nt, Homo Sapiens; identical to SEQ ID NO: 363151

SEQ ID NO: 714479 - RNA, 64 nt, Homo Sapiens; identical to SEQ ID NO: 363152

SEQ ID NO: 714480 - RNA, 64 nt, Homo Sapiens; identical to SEQ ID NO: 363153

SEQ ID NO: 714481 - RNA, 64 nt, Homo Sapiens; identical to SEQ ID NO: 363154

SEQ ID NO: 714482 - RNA, 64 nt, Homo Sapiens; identical to SEQ ID NO: 363155

SEQ ID NO: 714483 - RNA, 64 nt, Homo Sapiens; identical to SEQ ID NO: 363156

SEQ ID NO: 714484 - RNA, 64 nt, Homo Sapiens; identical to SEQ ID NO: 363157

SEQ ID NO: 714485 - RNA, 64 nt, Homo Sapiens; identical to SEQ ID NO: 363158

SEQ ID NO: 714486 - RNA, 64 nt, Homo Sapiens; identical to SEQ ID NO: 363159

SEQ ID NO: 714487 - RNA, 64 nt, Homo Sapiens; identical to SEQ ID NO: 363160

SEQ ID NO: 714488 - RNA, 64 nt, Homo Sapiens; identical to SEQ ID NO: 363161

SEQ ID NO: 714489 - RNA, 64 nt, Homo Sapiens; identical to SEQ ID NO: 363162

SEQ ID NO: 714490 - RNA, 64 nt, Homo Sapiens; identical to SEQ ID NO: 363163

SEQ ID NO: 714491 - RNA, 64 nt, Homo Sapiens; identical to SEQ ID NO: 363164

SEQ ID NO: 714492 - RNA, 64 nt, Homo Sapiens; identical to SEQ ID NO: 363165

SEQ ID NO: 714493 - RNA, 64 nt, Homo Sapiens; identical to SEQ ID NO: 363166

SEQ ID NO: 714494 - RNA, 64 nt, Homo Sapiens; identical to SEQ ID NO: 363167

SEQ ID NO: 714495 - RNA, 64 nt, Homo Sapiens; identical to SEQ ID NO: 363168

SEQ ID NO: 714496 - RNA, 64 nt, Homo Sapiens; identical to SEQ ID NO: 363169

SEQ ID NO: 714497 - RNA, 64 nt, Homo Sapiens; identical to SEQ ID NO: 363170

SEQ ID NO: 714498 - RNA, 64 nt, Homo Sapiens; identical to SEQ ID NO: 363171

SEQ ID NO: 714499 - RNA, 64 nt, Homo Sapiens; identical to SEQ ID NO: 363172

SEQ ID NO: 714500 - RNA, 64 nt, Homo Sapiens; identical to SEQ ID NO: 363173

SEQ ID NO: 714501 - RNA, 64 nt, Homo Sapiens; identical to SEQ ID NO: 363174

SEQ ID NO: 714502 - RNA, 64 nt, Homo Sapiens; identical to SEQ ID NO: 363175

SEQ ID NO: 714503 - RNA, 64 nt, Homo Sapiens; identical to SEQ ID NO: 363176

SEQ ID NO: 714504 - RNA, 64 nt, Homo Sapiens; identical to SEQ ID NO: 363177

SEQ ID NO: 714505 - RNA, 64 nt, Homo Sapiens; identical to SEQ ID NO: 363178

SEQ ID NO: 714506 - RNA, 64 nt, Homo Sapiens; identical to SEQ ID NO: 363179

SEQ ID NO: 714507 - RNA, 64 nt, Homo Sapiens; identical to SEQ ID NO: 363180

SEQ ID NO: 714508 - RNA, 64 nt, Homo Sapiens; identical to SEQ ID NO: 363181

SEQ ID NO: 714509 - RNA, 64 nt, Homo Sapiens; identical to SEQ ID NO: 363182

SEQ ID NO: 714510 - RNA, 64 nt, Homo Sapiens; identical to SEQ ID NO: 363183

SEQ ID NO: 714511 - RNA, 64 nt, Homo Sapiens; identical to SEQ ID NO: 363184

SEQ ID NO: 714512 - RNA, 64 nt, Homo Sapiens; identical to SEQ ID NO: 363185

SEQ ID NO: 714513 - RNA, 64 nt, Homo Sapiens; identical to SEQ ID NO: 363186

SEQ ID NO: 714514 - RNA, 64 nt, Homo Sapiens; identical to SEQ ID NO: 363187

SEQ ID NO: 714515 - RNA, 64 nt, Homo Sapiens; identical to SEQ ID NO: 363188

SEQ ID NO: 714516 - RNA, 64 nt, Homo Sapiens; identical to SEQ ID NO: 363189

SEQ ID NO: 714517 - RNA, 64 nt, Homo Sapiens; identical to SEQ ID NO: 363190

SEQ ID NO: 714518 - RNA, 64 nt, Homo Sapiens; identical to SEQ ID NO: 363191

SEQ ID NO: 714519 - RNA, 64 nt, Homo Sapiens; identical to SEQ ID NO: 363192

SEQ ID NO: 714520 - RNA, 64 nt, Homo Sapiens; identical to SEQ ID NO: 363193

SEQ ID NO: 714521 - RNA, 64 nt, Homo Sapiens; identical to SEQ ID NO: 363194

SEQ ID NO: 714522 - RNA, 64 nt, Homo Sapiens; identical to SEQ ID NO: 363195

SEQ ID NO: 714523 - RNA, 64 nt, Homo Sapiens; identical to SEQ ID NO: 83158

SEQ ID NO: 714524 - RNA, 64 nt, Homo Sapiens; identical to SEQ ID NO: 83159

SEQ ID NO: 714525 - RNA, 64 nt, Homo Sapiens; identical to SEQ ID NO: 83160

SEQ ID NO: 714526 - RNA, 64 nt, Homo Sapiens; identical to SEQ ID NO: 83161

SEQ ID NO: 714527 - RNA, 64 nt, Homo Sapiens; identical to SEQ ID NO: 433812

SEQ ID NO: 714528 - RNA, 64 nt, Homo Sapiens; identical to SEQ ID NO: 433813

SEQ ID NO: 714529 - RNA, 64 nt, Homo Sapiens; identical to SEQ ID NO: 433814

SEQ ID NO: 714530 - RNA, 64 nt, Homo Sapiens; identical to SEQ ID NO: 433815

SEQ ID NO: 714531 - RNA, 64 nt, Homo Sapiens; identical to SEQ ID NO: 433816

SEQ ID NO: 714532 - RNA, 64 nt, Homo Sapiens; identical to SEQ ID NO: 433817

SEQ ID NO: 714533 - RNA, 64 nt, Homo Sapiens; identical to SEQ ID NO: 433818

SEQ ID NO: 714534 - RNA, 64 nt, Homo Sapiens; identical to SEQ ID NO: 433819

SEQ ID NO: 714535 - RNA, 64 nt, Homo Sapiens; identical to SEQ ID NO: 433820

SEQ ID NO: 714536 - RNA, 64 nt, Homo Sapiens; identical to SEQ ID NO: 433821

SEQ ID NO: 714537 - RNA, 64 nt, Homo Sapiens; identical to SEQ ID NO: 433822

SEQ ID NO: 714538 - RNA, 64 nt, Homo Sapiens; identical to SEQ ID NO: 433823

SEQ ID NO: 714539 - RNA, 64 nt, Homo Sapiens; identical to SEQ ID NO: 433824

SEQ ID NO: 714540 - RNA, 64 nt, Homo Sapiens; identical to SEQ ID NO: 433825

SEQ ID NO: 714541 - RNA, 64 nt, Homo Sapiens; identical to SEQ ID NO: 433826

SEQ ID NO: 714542 - RNA, 64 nt, Homo Sapiens; identical to SEQ ID NO: 433827

SEQ ID NO: 714543 - RNA, 64 nt, Homo Sapiens; identical to SEQ ID NO: 433828

SEQ ID NO: 714544 - RNA, 64 nt, Homo Sapiens; identical to SEQ ID NO: 433829

SEQ ID NO: 714545 - RNA, 64 nt, Homo Sapiens; identical to SEQ ID NO: 433830

SEQ ID NO: 714546 - RNA, 64 nt, Homo Sapiens; identical to SEQ ID NO: 433831

SEQ ID NO: 714547 - RNA, 64 nt, Homo Sapiens; identical to SEQ ID NO: 433832

SEQ ID NO: 714548 - RNA, 64 nt, Homo Sapiens; identical to SEQ ID NO: 433833

SEQ ID NO: 714549 - RNA, 64 nt, Homo Sapiens; identical to SEQ ID NO: 433834

SEQ ID NO: 714550 - RNA, 64 nt, Homo Sapiens; identical to SEQ ID NO: 433835

SEQ ID NO: 714551 - RNA, 64 nt, Homo Sapiens; identical to SEQ ID NO: 433836

SEQ ID NO: 714552 - RNA, 64 nt, Homo Sapiens; identical to SEQ ID NO: 433837

SEQ ID NO: 714553 - RNA, 64 nt, Homo Sapiens; identical to SEQ ID NO: 433838

SEQ ID NO: 714554 - RNA, 64 nt, Homo Sapiens; identical to SEQ ID NO: 433839

SEQ ID NO: 714555 - RNA, 64 nt, Homo Sapiens; identical to SEQ ID NO: 433840

SEQ ID NO: 714556 - RNA, 64 nt, Homo Sapiens; identical to SEQ ID NO: 433841

SEQ ID NO: 714557 - RNA, 64 nt, Homo Sapiens; identical to SEQ ID NO: 433842

SEQ ID NO: 714558 - RNA, 64 nt, Homo Sapiens; identical to SEQ ID NO: 433843

SEQ ID NO: 714559 - RNA, 64 nt, Homo Sapiens; identical to SEQ ID NO: 433844

SEQ ID NO: 714560 - RNA, 64 nt, Homo Sapiens; identical to SEQ ID NO: 433845

SEQ ID NO: 714561 - RNA, 64 nt, Homo Sapiens; identical to SEQ ID NO: 433846

SEQ ID NO: 714562 - RNA, 64 nt, Homo Sapiens; identical to SEQ ID NO: 433847

SEQ ID NO: 714563 - RNA, 64 nt, Homo Sapiens; identical to SEQ ID NO: 433848

SEQ ID NO: 714564 - RNA, 64 nt, Homo Sapiens; identical to SEQ ID NO: 433849

SEQ ID NO: 714565 - RNA, 64 nt, Homo Sapiens; identical to SEQ ID NO: 433850

SEQ ID NO: 714566 - RNA, 64 nt, Homo Sapiens; identical to SEQ ID NO: 433851

SEQ ID NO: 714567 - RNA, 64 nt, Homo Sapiens; identical to SEQ ID NO: 433852

SEQ ID NO: 714568 - RNA, 64 nt, Homo Sapiens; identical to SEQ ID NO: 433853

SEQ ID NO: 714569 - RNA, 64 nt, Homo Sapiens; identical to SEQ ID NO: 433854

SEQ ID NO: 714570 - RNA, 64 nt, Homo Sapiens; identical to SEQ ID NO: 433855

SEQ ID NO: 714571 - RNA, 64 nt, Homo Sapiens; identical to SEQ ID NO: 433856

SEQ ID NO: 714572 - RNA, 64 nt, Homo Sapiens; identical to SEQ ID NO: 433857

SEQ ID NO: 714573 - RNA, 64 nt, Homo Sapiens; identical to SEQ ID NO: 433858

SEQ ID NO: 714574 - RNA, 64 nt, Homo Sapiens; identical to SEQ ID NO: 433859

SEQ ID NO: 714575 - RNA, 64 nt, Homo Sapiens; identical to SEQ ID NO: 433860

SEQ ID NO: 714576 - RNA, 64 nt, Homo Sapiens; identical to SEQ ID NO: 545246

SEQ ID NO: 714577 - RNA, 64 nt, Homo Sapiens; identical to SEQ ID NO: 545247

SEQ ID NO: 714578 - RNA, 64 nt, Homo Sapiens; identical to SEQ ID NO: 545248

SEQ ID NO: 714579 - RNA, 64 nt, Homo Sapiens; identical to SEQ ID NO: 545249

SEQ ID NO: 714580 - RNA, 64 nt, Homo Sapiens; identical to SEQ ID NO: 545250

SEQ ID NO: 714581 - RNA, 64 nt, Homo Sapiens; identical to SEQ ID NO: 545251

SEQ ID NO: 714582 - RNA, 64 nt, Homo Sapiens; identical to SEQ ID NO: 545252

SEQ ID NO: 714583 - RNA, 64 nt, Homo Sapiens; identical to SEQ ID NO: 545253

SEQ ID NO: 714584 - RNA, 64 nt, Homo Sapiens; identical to SEQ ID NO: 545254

SEQ ID NO: 714585 - RNA, 64 nt, Homo Sapiens; identical to SEQ ID NO: 545255

SEQ ID NO: 714586 - RNA, 64 nt, Homo Sapiens; identical to SEQ ID NO: 545256

SEQ ID NO: 714587 - RNA, 64 nt, Homo Sapiens; identical to SEQ ID NO: 545257

SEQ ID NO: 714588 - RNA, 64 nt, Homo Sapiens; identical to SEQ ID NO: 545258

SEQ ID NO: 714589 - RNA, 64 nt, Homo Sapiens; identical to SEQ ID NO: 545259

SEQ ID NO: 714590 - RNA, 64 nt, Homo Sapiens; identical to SEQ ID NO: 545260

SEQ ID NO: 714591 - RNA, 64 nt, Homo Sapiens; identical to SEQ ID NO: 545261

SEQ ID NO: 714592 - RNA, 64 nt, Homo Sapiens; identical to SEQ ID NO: 545262

SEQ ID NO: 714593 - RNA, 64 nt, Homo Sapiens; identical to SEQ ID NO: 545263

SEQ ID NO: 714594 - RNA, 64 nt, Homo Sapiens; identical to SEQ ID NO: 545264

SEQ ID NO: 714595 - RNA, 64 nt, Homo Sapiens; identical to SEQ ID NO: 545265

SEQ ID NO: 714596 - RNA, 64 nt, Homo Sapiens; identical to SEQ ID NO: 545266

SEQ ID NO: 714597 - RNA, 64 nt, Homo Sapiens; identical to SEQ ID NO: 545267

SEQ ID NO: 714598 - RNA, 64 nt, Homo Sapiens; identical to SEQ ID NO: 545268

SEQ ID NO: 714599 - RNA, 64 nt, Homo Sapiens; identical to SEQ ID NO: 545269

SEQ ID NO: 714600 - RNA, 64 nt, Homo Sapiens; identical to SEQ ID NO: 545270

SEQ ID NO: 714601 - RNA, 64 nt, Homo Sapiens; identical to SEQ ID NO: 545271

SEQ ID NO: 714602 - RNA, 64 nt, Homo Sapiens; identical to SEQ ID NO: 545272

SEQ ID NO: 714603 - RNA, 64 nt, Homo Sapiens; identical to SEQ ID NO: 545273

SEQ ID NO: 714604 - RNA, 64 nt, Homo Sapiens; identical to SEQ ID NO: 545274

SEQ ID NO: 714605 - RNA, 64 nt, Homo Sapiens; identical to SEQ ID NO: 97332

SEQ ID NO: 714606 - RNA, 64 nt, Homo Sapiens; identical to SEQ ID NO: 97333

SEQ ID NO: 714607 - RNA, 64 nt, Homo Sapiens; identical to SEQ ID NO: 97334

SEQ ID NO: 714608 - RNA, 64 nt, Homo Sapiens; identical to SEQ ID NO: 97335

SEQ ID NO: 714609 - RNA, 64 nt, Homo Sapiens; identical to SEQ ID NO: 97336

SEQ ID NO: 714610 - RNA, 64 nt, Homo Sapiens; identical to SEQ ID NO: 97337

SEQ ID NO: 714611 - RNA, 64 nt, Homo Sapiens; identical to SEQ ID NO: 97338

SEQ ID NO: 714612 - RNA, 64 nt, Homo Sapiens; identical to SEQ ID NO: 97339

SEQ ID NO: 714613 - RNA, 64 nt, Homo Sapiens; identical to SEQ ID NO: 97340

SEQ ID NO: 714614 - RNA, 64 nt, Homo Sapiens; identical to SEQ ID NO: 97341

SEQ ID NO: 714615 - RNA, 64 nt, Homo Sapiens; identical to SEQ ID NO: 97342

SEQ ID NO: 714616 - RNA, 64 nt, Homo Sapiens; identical to SEQ ID NO: 97343

SEQ ID NO: 714617 - RNA, 64 nt, Homo Sapiens; identical to SEQ ID NO: 97344

SEQ ID NO: 714618 - RNA, 64 nt, Homo Sapiens; identical to SEQ ID NO: 97345

SEQ ID NO: 714619 - RNA, 64 nt, Homo Sapiens; identical to SEQ ID NO: 97346

SEQ ID NO: 714620 - RNA, 64 nt, Homo Sapiens; identical to SEQ ID NO: 97347

SEQ ID NO: 714621 - RNA, 64 nt, Homo Sapiens; identical to SEQ ID NO: 97348

SEQ ID NO: 714622 - RNA, 64 nt, Homo Sapiens; identical to SEQ ID NO: 97349

SEQ ID NO: 714623 - RNA, 64 nt, Homo Sapiens; identical to SEQ ID NO: 97350

SEQ ID NO: 714624 - RNA, 64 nt, Homo Sapiens; identical to SEQ ID NO: 97351

SEQ ID NO: 714625 - RNA, 64 nt, Homo Sapiens; identical to SEQ ID NO: 97352

SEQ ID NO: 714626 - RNA, 64 nt, Homo Sapiens; identical to SEQ ID NO: 97353

SEQ ID NO: 714627 - RNA, 64 nt, Homo Sapiens; identical to SEQ ID NO: 97354

SEQ ID NO: 714628 - RNA, 64 nt, Homo Sapiens; identical to SEQ ID NO: 97355

SEQ ID NO: 714629 - RNA, 64 nt, Homo Sapiens; identical to SEQ ID NO: 97356

SEQ ID NO: 714630 - RNA, 64 nt, Homo Sapiens; identical to SEQ ID NO: 97357

SEQ ID NO: 714631 - RNA, 64 nt, Homo Sapiens; identical to SEQ ID NO: 97358

SEQ ID NO: 714632 - RNA, 64 nt, Homo Sapiens; identical to SEQ ID NO: 97359

SEQ ID NO: 714633 - RNA, 64 nt, Homo Sapiens; identical to SEQ ID NO: 97360

SEQ ID NO: 714634 - RNA, 64 nt, Homo Sapiens; identical to SEQ ID NO: 97361

SEQ ID NO: 714635 - RNA, 64 nt, Homo Sapiens; identical to SEQ ID NO: 97362

SEQ ID NO: 714636 - RNA, 64 nt, Homo Sapiens; identical to SEQ ID NO: 97363

SEQ ID NO: 714637 - RNA, 64 nt, Homo Sapiens; identical to SEQ ID NO: 97364

SEQ ID NO: 714638 - RNA, 64 nt, Homo Sapiens; identical to SEQ ID NO: 97365

SEQ ID NO: 714639 - RNA, 64 nt, Homo Sapiens; identical to SEQ ID NO: 97366

SEQ ID NO: 714640 - RNA, 64 nt, Homo Sapiens; identical to SEQ ID NO: 97367

SEQ ID NO: 714641 - RNA, 64 nt, Homo Sapiens; identical to SEQ ID NO: 97368

SEQ ID NO: 714642 - RNA, 64 nt, Homo Sapiens; identical to SEQ ID NO: 97369

SEQ ID NO: 714643 - RNA, 64 nt, Homo Sapiens; identical to SEQ ID NO: 97370

SEQ ID NO: 714644 - RNA, 64 nt, Homo Sapiens; identical to SEQ ID NO: 97371

SEQ ID NO: 714645 - RNA, 64 nt, Homo Sapiens; identical to SEQ ID NO: 97372

SEQ ID NO: 714646 - RNA, 64 nt, Homo Sapiens; identical to SEQ ID NO: 97373

SEQ ID NO: 714647 - RNA, 64 nt, Homo Sapiens; identical to SEQ ID NO: 97374

SEQ ID NO: 714648 - RNA, 64 nt, Homo Sapiens; identical to SEQ ID NO: 97375

SEQ ID NO: 714649 - RNA, 64 nt, Homo Sapiens; identical to SEQ ID NO: 97376

SEQ ID NO: 714650 - RNA, 64 nt, Homo Sapiens; identical to SEQ ID NO: 97377

SEQ ID NO: 714651 - RNA, 64 nt, Homo Sapiens; identical to SEQ ID NO: 97378

SEQ ID NO: 714652 - RNA, 64 nt, Homo Sapiens; identical to SEQ ID NO: 97379

SEQ ID NO: 714653 - RNA, 64 nt, Homo Sapiens; identical to SEQ ID NO: 97380

SEQ ID NO: 714654 - RNA, 64 nt, Homo Sapiens; identical to SEQ ID NO: 97381

SEQ ID NO: 714655 - RNA, 64 nt, Homo Sapiens; identical to SEQ ID NO: 97382

SEQ ID NO: 714656 - RNA, 64 nt, Homo Sapiens; identical to SEQ ID NO: 97383

SEQ ID NO: 714657 - RNA, 64 nt, Homo Sapiens; identical to SEQ ID NO: 97384

SEQ ID NO: 714658 - RNA, 64 nt, Homo Sapiens; identical to SEQ ID NO: 97385

SEQ ID NO: 714659 - RNA, 64 nt, Homo Sapiens; identical to SEQ ID NO: 97386

SEQ ID NO: 714660 - RNA, 64 nt, Homo Sapiens; identical to SEQ ID NO: 97387

SEQ ID NO: 714661 - RNA, 64 nt, Homo Sapiens; identical to SEQ ID NO: 97388

SEQ ID NO: 714662 - RNA, 64 nt, Homo Sapiens; identical to SEQ ID NO: 97389

SEQ ID NO: 714663 - RNA, 64 nt, Homo Sapiens; identical to SEQ ID NO: 97390

SEQ ID NO: 714664 - RNA, 64 nt, Homo Sapiens; identical to SEQ ID NO: 97391

SEQ ID NO: 714665 - RNA, 64 nt, Homo Sapiens; identical to SEQ ID NO: 97392

SEQ ID NO: 714666 - RNA, 64 nt, Homo Sapiens; identical to SEQ ID NO: 97393

SEQ ID NO: 714667 - RNA, 64 nt, Homo Sapiens; identical to SEQ ID NO: 97394

SEQ ID NO: 714668 - RNA, 64 nt, Homo Sapiens; identical to SEQ ID NO: 653567

SEQ ID NO: 714669 - RNA, 64 nt, Homo Sapiens; identical to SEQ ID NO: 653568

SEQ ID NO: 714670 - RNA, 64 nt, Homo Sapiens; identical to SEQ ID NO: 653569

SEQ ID NO: 714671 - RNA, 64 nt, Homo Sapiens; identical to SEQ ID NO: 653570

SEQ ID NO: 714672 - RNA, 64 nt, Homo Sapiens; identical to SEQ ID NO: 653571

SEQ ID NO: 714673 - RNA, 64 nt, Homo Sapiens; identical to SEQ ID NO: 653572

SEQ ID NO: 714674 - RNA, 64 nt, Homo Sapiens; identical to SEQ ID NO: 653573

SEQ ID NO: 714675 - RNA, 64 nt, Homo Sapiens; identical to SEQ ID NO: 653574

SEQ ID NO: 714676 - RNA, 64 nt, Homo Sapiens; identical to SEQ ID NO: 653575

SEQ ID NO: 714677 - RNA, 64 nt, Homo Sapiens; identical to SEQ ID NO: 653576

SEQ ID NO: 714678 - RNA, 64 nt, Homo Sapiens; identical to SEQ ID NO: 653577

SEQ ID NO: 714679 - RNA, 64 nt, Homo Sapiens; identical to SEQ ID NO: 653578

SEQ ID NO: 714680 - RNA, 64 nt, Homo Sapiens; identical to SEQ ID NO: 653579

SEQ ID NO: 714681 - RNA, 64 nt, Homo Sapiens; identical to SEQ ID NO: 653580

SEQ ID NO: 714682 - RNA, 64 nt, Homo Sapiens; identical to SEQ ID NO: 653581

SEQ ID NO: 714683 - RNA, 64 nt, Homo Sapiens; identical to SEQ ID NO: 653582

SEQ ID NO: 714684 - RNA, 64 nt, Homo Sapiens; identical to SEQ ID NO: 653583

SEQ ID NO: 714685 - RNA, 64 nt, Homo Sapiens; identical to SEQ ID NO: 653584

SEQ ID NO: 714686 - RNA, 64 nt, Homo Sapiens; identical to SEQ ID NO: 653585

SEQ ID NO: 714687 - RNA, 64 nt, Homo Sapiens; identical to SEQ ID NO: 653586

SEQ ID NO: 714688 - RNA, 64 nt, Homo Sapiens; identical to SEQ ID NO: 653587

SEQ ID NO: 714689 - RNA, 64 nt, Homo Sapiens; identical to SEQ ID NO: 653588

SEQ ID NO: 714690 - RNA, 64 nt, Homo Sapiens; identical to SEQ ID NO: 653589

SEQ ID NO: 714691 - RNA, 64 nt, Homo Sapiens; identical to SEQ ID NO: 653590

SEQ ID NO: 714692 - RNA, 64 nt, Homo Sapiens; identical to SEQ ID NO: 653591

SEQ ID NO: 714693 - RNA, 64 nt, Homo Sapiens; identical to SEQ ID NO: 653592

SEQ ID NO: 714694 - RNA, 64 nt, Homo Sapiens; identical to SEQ ID NO: 653593

SEQ ID NO: 714695 - RNA, 64 nt, Homo Sapiens; identical to SEQ ID NO: 653594

SEQ ID NO: 714696 - RNA, 64 nt, Homo Sapiens; identical to SEQ ID NO: 653595

SEQ ID NO: 714697 - RNA, 64 nt, Homo Sapiens; identical to SEQ ID NO: 653596

SEQ ID NO: 714698 - RNA, 64 nt, Homo Sapiens; identical to SEQ ID NO: 653597

SEQ ID NO: 714699 - RNA, 64 nt, Homo Sapiens; identical to SEQ ID NO: 653598

SEQ ID NO: 714700 - RNA, 64 nt, Homo Sapiens; identical to SEQ ID NO: 653599

SEQ ID NO: 714701 - RNA, 64 nt, Homo Sapiens; identical to SEQ ID NO: 653600

SEQ ID NO: 714702 - RNA, 63 nt, Homo Sapiens; identical to SEQ ID NO: 58102

SEQ ID NO: 714703 - RNA, 63 nt, Homo Sapiens; identical to SEQ ID NO: 58103

SEQ ID NO: 714704 - RNA, 63 nt, Homo Sapiens; identical to SEQ ID NO: 58104

SEQ ID NO: 714705 - RNA, 63 nt, Homo Sapiens; identical to SEQ ID NO: 58105

SEQ ID NO: 714706 - RNA, 63 nt, Homo Sapiens; identical to SEQ ID NO: 58106

SEQ ID NO: 714707 - RNA, 63 nt, Homo Sapiens; identical to SEQ ID NO: 58107

SEQ ID NO: 714708 - RNA, 63 nt, Homo Sapiens; identical to SEQ ID NO: 58108

SEQ ID NO: 714709 - RNA, 63 nt, Homo Sapiens; identical to SEQ ID NO: 58109

SEQ ID NO: 714710 - RNA, 63 nt, Homo Sapiens; identical to SEQ ID NO: 58110

SEQ ID NO: 714711 - RNA, 63 nt, Homo Sapiens; identical to SEQ ID NO: 58111

SEQ ID NO: 714712 - RNA, 63 nt, Homo Sapiens; identical to SEQ ID NO: 58112

SEQ ID NO: 714713 - RNA, 63 nt, Homo Sapiens; identical to SEQ ID NO: 58113

SEQ ID NO: 714714 - RNA, 63 nt, Homo Sapiens; identical to SEQ ID NO: 58114

SEQ ID NO: 714715 - RNA, 63 nt, Homo Sapiens; identical to SEQ ID NO: 58115

SEQ ID NO: 714716 - RNA, 63 nt, Homo Sapiens; identical to SEQ ID NO: 58116

SEQ ID NO: 714717 - RNA, 63 nt, Homo Sapiens; identical to SEQ ID NO: 58117

SEQ ID NO: 714718 - RNA, 63 nt, Homo Sapiens; identical to SEQ ID NO: 58118

SEQ ID NO: 714719 - RNA, 63 nt, Homo Sapiens; identical to SEQ ID NO: 58119

SEQ ID NO: 714720 - RNA, 63 nt, Homo Sapiens; identical to SEQ ID NO: 58120

SEQ ID NO: 714721 - RNA, 63 nt, Homo Sapiens; identical to SEQ ID NO: 58121

SEQ ID NO: 714722 - RNA, 63 nt, Homo Sapiens; identical to SEQ ID NO: 58122

SEQ ID NO: 714723 - RNA, 63 nt, Homo Sapiens; identical to SEQ ID NO: 58123

SEQ ID NO: 714724 - RNA, 63 nt, Homo Sapiens; identical to SEQ ID NO: 58124

SEQ ID NO: 714725 - RNA, 63 nt, Homo Sapiens; identical to SEQ ID NO: 58125

SEQ ID NO: 714726 - RNA, 63 nt, Homo Sapiens; identical to SEQ ID NO: 58126

SEQ ID NO: 714727 - RNA, 63 nt, Homo Sapiens; identical to SEQ ID NO: 58127

SEQ ID NO: 714728 - RNA, 63 nt, Homo Sapiens; identical to SEQ ID NO: 58128

SEQ ID NO: 714729 - RNA, 63 nt, Homo Sapiens; identical to SEQ ID NO: 58129

SEQ ID NO: 714730 - RNA, 63 nt, Homo Sapiens; identical to SEQ ID NO: 58130

SEQ ID NO: 714731 - RNA, 63 nt, Homo Sapiens; identical to SEQ ID NO: 58131

SEQ ID NO: 714732 - RNA, 63 nt, Homo Sapiens; identical to SEQ ID NO: 102980

SEQ ID NO: 714733 - RNA, 63 nt, Homo Sapiens; identical to SEQ ID NO: 102981

SEQ ID NO: 714734 - RNA, 63 nt, Homo Sapiens; identical to SEQ ID NO: 102982

SEQ ID NO: 714735 - RNA, 63 nt, Homo Sapiens; identical to SEQ ID NO: 102983

SEQ ID NO: 714736 - RNA, 63 nt, Homo Sapiens; identical to SEQ ID NO: 102984

SEQ ID NO: 714737 - RNA, 63 nt, Homo Sapiens; identical to SEQ ID NO: 102985

SEQ ID NO: 714738 - RNA, 63 nt, Homo Sapiens; identical to SEQ ID NO: 102986

SEQ ID NO: 714739 - RNA, 63 nt, Homo Sapiens; identical to SEQ ID NO: 102987

SEQ ID NO: 714740 - RNA, 63 nt, Homo Sapiens; identical to SEQ ID NO: 102988

SEQ ID NO: 714741 - RNA, 63 nt, Homo Sapiens; identical to SEQ ID NO: 102989

SEQ ID NO: 714742 - RNA, 63 nt, Homo Sapiens; identical to SEQ ID NO: 102990

SEQ ID NO: 714743 - RNA, 58 nt, Homo Sapiens; identical to SEQ ID NO: 102991

SEQ ID NO: 714744 - RNA, 63 nt, Homo Sapiens; identical to SEQ ID NO: 102992

SEQ ID NO: 714745 - RNA, 63 nt, Homo Sapiens; identical to SEQ ID NO: 102993

SEQ ID NO: 714746 - RNA, 63 nt, Homo Sapiens; identical to SEQ ID NO: 102994

SEQ ID NO: 714747 - RNA, 63 nt, Homo Sapiens; identical to SEQ ID NO: 102995

SEQ ID NO: 714748 - RNA, 63 nt, Homo Sapiens; identical to SEQ ID NO: 102996

SEQ ID NO: 714749 - RNA, 63 nt, Homo Sapiens; identical to SEQ ID NO: 102997

SEQ ID NO: 714750 - RNA, 63 nt, Homo Sapiens; identical to SEQ ID NO: 102998

SEQ ID NO: 714751 - RNA, 63 nt, Homo Sapiens; identical to SEQ ID NO: 102999

SEQ ID NO: 714752 - RNA, 63 nt, Homo Sapiens; identical to SEQ ID NO: 103000

SEQ ID NO: 714753 - RNA, 63 nt, Homo Sapiens; identical to SEQ ID NO: 103001

SEQ ID NO: 714754 - RNA, 63 nt, Homo Sapiens; identical to SEQ ID NO: 103002

SEQ ID NO: 714755 - RNA, 63 nt, Homo Sapiens; identical to SEQ ID NO: 103003

SEQ ID NO: 714756 - RNA, 63 nt, Homo Sapiens; identical to SEQ ID NO: 103004

SEQ ID NO: 714757 - RNA, 63 nt, Homo Sapiens; identical to SEQ ID NO: 103005

SEQ ID NO: 714758 - RNA, 63 nt, Homo Sapiens; identical to SEQ ID NO: 103006

SEQ ID NO: 714759 - RNA, 63 nt, Homo Sapiens; identical to SEQ ID NO: 103007

SEQ ID NO: 714760 - RNA, 63 nt, Homo Sapiens; identical to SEQ ID NO: 103008

SEQ ID NO: 714761 - RNA, 63 nt, Homo Sapiens; identical to SEQ ID NO: 103009

SEQ ID NO: 714762 - RNA, 63 nt, Homo Sapiens; identical to SEQ ID NO: 103010

SEQ ID NO: 714763 - RNA, 63 nt, Homo Sapiens; identical to SEQ ID NO: 103011

SEQ ID NO: 714764 - RNA, 63 nt, Homo Sapiens; identical to SEQ ID NO: 103012

SEQ ID NO: 714765 - RNA, 63 nt, Homo Sapiens; identical to SEQ ID NO: 103013

SEQ ID NO: 714766 - RNA, 53 nt, Homo Sapiens; identical to SEQ ID NO: 103014

SEQ ID NO: 714767 - RNA, 63 nt, Homo Sapiens; identical to SEQ ID NO: 103015

SEQ ID NO: 714768 - RNA, 63 nt, Homo Sapiens; identical to SEQ ID NO: 103016

SEQ ID NO: 714769 - RNA, 63 nt, Homo Sapiens; identical to SEQ ID NO: 103017

SEQ ID NO: 714770 - RNA, 63 nt, Homo Sapiens; identical to SEQ ID NO: 103018

SEQ ID NO: 714771 - RNA, 63 nt, Homo Sapiens; identical to SEQ ID NO: 103019

SEQ ID NO: 714772 - RNA, 63 nt, Homo Sapiens; identical to SEQ ID NO: 103020

SEQ ID NO: 714773 - RNA, 63 nt, Homo Sapiens; identical to SEQ ID NO: 103021

SEQ ID NO: 714774 - RNA, 63 nt, Homo Sapiens; identical to SEQ ID NO: 103022

SEQ ID NO: 714775 - RNA, 63 nt, Homo Sapiens; identical to SEQ ID NO: 103023

SEQ ID NO: 714776 - RNA, 63 nt, Homo Sapiens; identical to SEQ ID NO: 103024

SEQ ID NO: 714777 - RNA, 63 nt, Homo Sapiens; identical to SEQ ID NO: 103025

SEQ ID NO: 714778 - RNA, 63 nt, Homo Sapiens; identical to SEQ ID NO: 103026

SEQ ID NO: 714779 - RNA, 63 nt, Homo Sapiens; identical to SEQ ID NO: 103027

SEQ ID NO: 714780 - RNA, 63 nt, Homo Sapiens; identical to SEQ ID NO: 103028

SEQ ID NO: 714781 - RNA, 63 nt, Homo Sapiens; identical to SEQ ID NO: 103029

SEQ ID NO: 714782 - RNA, 63 nt, Homo Sapiens; identical to SEQ ID NO: 103030

SEQ ID NO: 714783 - RNA, 63 nt, Homo Sapiens; identical to SEQ ID NO: 103031

SEQ ID NO: 714784 - RNA, 63 nt, Homo Sapiens; identical to SEQ ID NO: 103032

SEQ ID NO: 714785 - RNA, 63 nt, Homo Sapiens; identical to SEQ ID NO: 103033

SEQ ID NO: 714786 - RNA, 63 nt, Homo Sapiens; identical to SEQ ID NO: 103034

SEQ ID NO: 714787 - RNA, 63 nt, Homo Sapiens; identical to SEQ ID NO: 103035

SEQ ID NO: 714788 - RNA, 63 nt, Homo Sapiens; identical to SEQ ID NO: 103036

SEQ ID NO: 714789 - RNA, 63 nt, Homo Sapiens; identical to SEQ ID NO: 103037

SEQ ID NO: 714790 - RNA, 63 nt, Homo Sapiens; identical to SEQ ID NO: 103038

SEQ ID NO: 714791 - RNA, 63 nt, Homo Sapiens; identical to SEQ ID NO: 103039

SEQ ID NO: 714792 - RNA, 63 nt, Homo Sapiens; identical to SEQ ID NO: 103040

SEQ ID NO: 714793 - RNA, 63 nt, Homo Sapiens; identical to SEQ ID NO: 103041

SEQ ID NO: 714794 - RNA, 63 nt, Homo Sapiens; identical to SEQ ID NO: 103042

SEQ ID NO: 714795 - RNA, 63 nt, Homo Sapiens; identical to SEQ ID NO: 103043

SEQ ID NO: 714796 - RNA, 63 nt, Homo Sapiens; identical to SEQ ID NO: 103044

SEQ ID NO: 714797 - RNA, 63 nt, Homo Sapiens; identical to SEQ ID NO: 103045

SEQ ID NO: 714798 - RNA, 63 nt, Homo Sapiens; identical to SEQ ID NO: 103046

SEQ ID NO: 714799 - RNA, 63 nt, Homo Sapiens; identical to SEQ ID NO: 103047

SEQ ID NO: 714800 - RNA, 63 nt, Homo Sapiens; identical to SEQ ID NO: 103048

SEQ ID NO: 714801 - RNA, 63 nt, Homo Sapiens; identical to SEQ ID NO: 103049

SEQ ID NO: 714802 - RNA, 63 nt, Homo Sapiens; identical to SEQ ID NO: 103050

SEQ ID NO: 714803 - RNA, 63 nt, Homo Sapiens; identical to SEQ ID NO: 103051

SEQ ID NO: 714804 - RNA, 63 nt, Homo Sapiens; identical to SEQ ID NO: 103052

SEQ ID NO: 714805 - RNA, 63 nt, Homo Sapiens; identical to SEQ ID NO: 103053

SEQ ID NO: 714806 - RNA, 63 nt, Homo Sapiens; identical to SEQ ID NO: 103054

SEQ ID NO: 714807 - RNA, 63 nt, Homo Sapiens; identical to SEQ ID NO: 103055

SEQ ID NO: 714808 - RNA, 63 nt, Homo Sapiens; identical to SEQ ID NO: 103056

SEQ ID NO: 714809 - RNA, 63 nt, Homo Sapiens; identical to SEQ ID NO: 103057

SEQ ID NO: 714810 - RNA, 63 nt, Homo Sapiens; identical to SEQ ID NO: 103058

SEQ ID NO: 714811 - RNA, 63 nt, Homo Sapiens; identical to SEQ ID NO: 103059

SEQ ID NO: 714812 - RNA, 63 nt, Homo Sapiens; identical to SEQ ID NO: 103060

SEQ ID NO: 714813 - RNA, 63 nt, Homo Sapiens; identical to SEQ ID NO: 103061

SEQ ID NO: 714814 - RNA, 63 nt, Homo Sapiens; identical to SEQ ID NO: 103062

SEQ ID NO: 714815 - RNA, 63 nt, Homo Sapiens; identical to SEQ ID NO: 103063

SEQ ID NO: 714816 - RNA, 63 nt, Homo Sapiens; identical to SEQ ID NO: 103064

SEQ ID NO: 714817 - RNA, 63 nt, Homo Sapiens; identical to SEQ ID NO: 103065

SEQ ID NO: 714818 - RNA, 63 nt, Homo Sapiens; identical to SEQ ID NO: 103066

SEQ ID NO: 714819 - RNA, 63 nt, Homo Sapiens; identical to SEQ ID NO: 103067

SEQ ID NO: 714820 - RNA, 63 nt, Homo Sapiens; identical to SEQ ID NO: 103068

SEQ ID NO: 714821 - RNA, 63 nt, Homo Sapiens; identical to SEQ ID NO: 103069

SEQ ID NO: 714822 - RNA, 63 nt, Homo Sapiens; identical to SEQ ID NO: 103070

SEQ ID NO: 714823 - RNA, 63 nt, Homo Sapiens; identical to SEQ ID NO: 103071

SEQ ID NO: 714824 - RNA, 63 nt, Homo Sapiens; identical to SEQ ID NO: 103072

SEQ ID NO: 714825 - RNA, 63 nt, Homo Sapiens; identical to SEQ ID NO: 103073

SEQ ID NO: 714826 - RNA, 63 nt, Homo Sapiens; identical to SEQ ID NO: 103074

SEQ ID NO: 714827 - RNA, 63 nt, Homo Sapiens; identical to SEQ ID NO: 103075

SEQ ID NO: 714828 - RNA, 63 nt, Homo Sapiens; identical to SEQ ID NO: 103076

SEQ ID NO: 714829 - RNA, 63 nt, Homo Sapiens; identical to SEQ ID NO: 103077

SEQ ID NO: 714830 - RNA, 63 nt, Homo Sapiens; identical to SEQ ID NO: 103078

SEQ ID NO: 714831 - RNA, 63 nt, Homo Sapiens; identical to SEQ ID NO: 103079

SEQ ID NO: 714832 - RNA, 63 nt, Homo Sapiens; identical to SEQ ID NO: 103080

SEQ ID NO: 714833 - RNA, 63 nt, Homo Sapiens; identical to SEQ ID NO: 103081

SEQ ID NO: 714834 - RNA, 63 nt, Homo Sapiens; identical to SEQ ID NO: 103082

SEQ ID NO: 714835 - RNA, 63 nt, Homo Sapiens; identical to SEQ ID NO: 103083

SEQ ID NO: 714836 - RNA, 63 nt, Homo Sapiens; identical to SEQ ID NO: 103084

SEQ ID NO: 714837 - RNA, 63 nt, Homo Sapiens; identical to SEQ ID NO: 103085

SEQ ID NO: 714838 - RNA, 63 nt, Homo Sapiens; identical to SEQ ID NO: 103086

SEQ ID NO: 714839 - RNA, 63 nt, Homo Sapiens; identical to SEQ ID NO: 103087

SEQ ID NO: 714840 - RNA, 63 nt, Homo Sapiens; identical to SEQ ID NO: 103088

SEQ ID NO: 714841 - RNA, 63 nt, Homo Sapiens; identical to SEQ ID NO: 103089

SEQ ID NO: 714842 - RNA, 63 nt, Homo Sapiens; identical to SEQ ID NO: 103090

SEQ ID NO: 714843 - RNA, 63 nt, Homo Sapiens; identical to SEQ ID NO: 103091

SEQ ID NO: 714844 - RNA, 63 nt, Homo Sapiens; identical to SEQ ID NO: 103092

SEQ ID NO: 714845 - RNA, 63 nt, Homo Sapiens; identical to SEQ ID NO: 103093

SEQ ID NO: 714846 - RNA, 63 nt, Homo Sapiens; identical to SEQ ID NO: 103094

SEQ ID NO: 714847 - RNA, 63 nt, Homo Sapiens; identical to SEQ ID NO: 103095

SEQ ID NO: 714848 - RNA, 63 nt, Homo Sapiens; identical to SEQ ID NO: 103096

SEQ ID NO: 714849 - RNA, 63 nt, Homo Sapiens; identical to SEQ ID NO: 103097

SEQ ID NO: 714850 - RNA, 60 nt, Homo Sapiens; identical to SEQ ID NO: 103098

SEQ ID NO: 714851 - RNA, 63 nt, Homo Sapiens; identical to SEQ ID NO: 103099

SEQ ID NO: 714852 - RNA, 63 nt, Homo Sapiens; identical to SEQ ID NO: 103100

SEQ ID NO: 714853 - RNA, 63 nt, Homo Sapiens; identical to SEQ ID NO: 103101

SEQ ID NO: 714854 - RNA, 63 nt, Homo Sapiens; identical to SEQ ID NO: 103102

SEQ ID NO: 714855 - RNA, 63 nt, Homo Sapiens; identical to SEQ ID NO: 103103

SEQ ID NO: 714856 - RNA, 63 nt, Homo Sapiens; identical to SEQ ID NO: 103104

SEQ ID NO: 714857 - RNA, 63 nt, Homo Sapiens; identical to SEQ ID NO: 103105

SEQ ID NO: 714858 - RNA, 63 nt, Homo Sapiens; identical to SEQ ID NO: 103106

SEQ ID NO: 714859 - RNA, 63 nt, Homo Sapiens; identical to SEQ ID NO: 103107

SEQ ID NO: 714860 - RNA, 63 nt, Homo Sapiens; identical to SEQ ID NO: 103108

SEQ ID NO: 714861 - RNA, 63 nt, Homo Sapiens; identical to SEQ ID NO: 103109

SEQ ID NO: 714862 - RNA, 63 nt, Homo Sapiens; identical to SEQ ID NO: 103110

SEQ ID NO: 714863 - RNA, 63 nt, Homo Sapiens; identical to SEQ ID NO: 103111

SEQ ID NO: 714864 - RNA, 63 nt, Homo Sapiens; identical to SEQ ID NO: 103112

SEQ ID NO: 714865 - RNA, 63 nt, Homo Sapiens; identical to SEQ ID NO: 103113

SEQ ID NO: 714866 - RNA, 63 nt, Homo Sapiens; identical to SEQ ID NO: 103114

SEQ ID NO: 714867 - RNA, 63 nt, Homo Sapiens; identical to SEQ ID NO: 103115

SEQ ID NO: 714868 - RNA, 63 nt, Homo Sapiens; identical to SEQ ID NO: 103116

SEQ ID NO: 714869 - RNA, 63 nt, Homo Sapiens; identical to SEQ ID NO: 103117

SEQ ID NO: 714870 - RNA, 63 nt, Homo Sapiens; identical to SEQ ID NO: 103118

SEQ ID NO: 714871 - RNA, 63 nt, Homo Sapiens; identical to SEQ ID NO: 103119

SEQ ID NO: 714872 - RNA, 63 nt, Homo Sapiens; identical to SEQ ID NO: 103120

SEQ ID NO: 714873 - RNA, 63 nt, Homo Sapiens; identical to SEQ ID NO: 103121

SEQ ID NO: 714874 - RNA, 63 nt, Homo Sapiens; identical to SEQ ID NO: 103122

SEQ ID NO: 714875 - RNA, 63 nt, Homo Sapiens; identical to SEQ ID NO: 103123

SEQ ID NO: 714876 - RNA, 63 nt, Homo Sapiens; identical to SEQ ID NO: 103124

SEQ ID NO: 714877 - RNA, 63 nt, Homo Sapiens; identical to SEQ ID NO: 103125

SEQ ID NO: 714878 - RNA, 63 nt, Homo Sapiens; identical to SEQ ID NO: 103126

SEQ ID NO: 714879 - RNA, 63 nt, Homo Sapiens; identical to SEQ ID NO: 103127

SEQ ID NO: 714880 - RNA, 63 nt, Homo Sapiens; identical to SEQ ID NO: 103128

SEQ ID NO: 714881 - RNA, 63 nt, Homo Sapiens; identical to SEQ ID NO: 103129

SEQ ID NO: 714882 - RNA, 63 nt, Homo Sapiens; identical to SEQ ID NO: 103130

SEQ ID NO: 714883 - RNA, 63 nt, Homo Sapiens; identical to SEQ ID NO: 103131

SEQ ID NO: 714884 - RNA, 63 nt, Homo Sapiens; identical to SEQ ID NO: 103132

SEQ ID NO: 714885 - RNA, 63 nt, Homo Sapiens; identical to SEQ ID NO: 103133

SEQ ID NO: 714886 - RNA, 63 nt, Homo Sapiens; identical to SEQ ID NO: 103134

SEQ ID NO: 714887 - RNA, 63 nt, Homo Sapiens; identical to SEQ ID NO: 103135

SEQ ID NO: 714888 - RNA, 63 nt, Homo Sapiens; identical to SEQ ID NO: 103136

SEQ ID NO: 714889 - RNA, 63 nt, Homo Sapiens; identical to SEQ ID NO: 103137

SEQ ID NO: 714890 - RNA, 63 nt, Homo Sapiens; identical to SEQ ID NO: 103138

SEQ ID NO: 714891 - RNA, 63 nt, Homo Sapiens; identical to SEQ ID NO: 103139

SEQ ID NO: 714892 - RNA, 63 nt, Homo Sapiens; identical to SEQ ID NO: 103140

SEQ ID NO: 714893 - RNA, 63 nt, Homo Sapiens; identical to SEQ ID NO: 103141

SEQ ID NO: 714894 - RNA, 63 nt, Homo Sapiens; identical to SEQ ID NO: 103142

SEQ ID NO: 714895 - RNA, 63 nt, Homo Sapiens; identical to SEQ ID NO: 103143

SEQ ID NO: 714896 - RNA, 63 nt, Homo Sapiens; identical to SEQ ID NO: 103144

SEQ ID NO: 714897 - RNA, 63 nt, Homo Sapiens; identical to SEQ ID NO: 103145

SEQ ID NO: 714898 - RNA, 63 nt, Homo Sapiens; identical to SEQ ID NO: 103146

SEQ ID NO: 714899 - RNA, 63 nt, Homo Sapiens; identical to SEQ ID NO: 103147

SEQ ID NO: 714900 - RNA, 63 nt, Homo Sapiens; identical to SEQ ID NO: 103148

SEQ ID NO: 714901 - RNA, 63 nt, Homo Sapiens; identical to SEQ ID NO: 103149

SEQ ID NO: 714902 - RNA, 63 nt, Homo Sapiens; identical to SEQ ID NO: 103150

SEQ ID NO: 714903 - RNA, 63 nt, Homo Sapiens; identical to SEQ ID NO: 103151

SEQ ID NO: 714904 - RNA, 63 nt, Homo Sapiens; identical to SEQ ID NO: 103152

SEQ ID NO: 714905 - RNA, 63 nt, Homo Sapiens; identical to SEQ ID NO: 103153

SEQ ID NO: 714906 - RNA, 63 nt, Homo Sapiens; identical to SEQ ID NO: 103154

SEQ ID NO: 714907 - RNA, 63 nt, Homo Sapiens; identical to SEQ ID NO: 103155

SEQ ID NO: 714908 - RNA, 63 nt, Homo Sapiens; identical to SEQ ID NO: 103156

SEQ ID NO: 714909 - RNA, 63 nt, Homo Sapiens; identical to SEQ ID NO: 103157

SEQ ID NO: 714910 - RNA, 63 nt, Homo Sapiens; identical to SEQ ID NO: 103158

SEQ ID NO: 714911 - RNA, 63 nt, Homo Sapiens; identical to SEQ ID NO: 103159

SEQ ID NO: 714912 - RNA, 63 nt, Homo Sapiens; identical to SEQ ID NO: 103160

SEQ ID NO: 714913 - RNA, 63 nt, Homo Sapiens; identical to SEQ ID NO: 103161

SEQ ID NO: 714914 - RNA, 63 nt, Homo Sapiens; identical to SEQ ID NO: 103162

SEQ ID NO: 714915 - RNA, 63 nt, Homo Sapiens; identical to SEQ ID NO: 103163

SEQ ID NO: 714916 - RNA, 63 nt, Homo Sapiens; identical to SEQ ID NO: 103164

SEQ ID NO: 714917 - RNA, 63 nt, Homo Sapiens; identical to SEQ ID NO: 103165

SEQ ID NO: 714918 - RNA, 63 nt, Homo Sapiens; identical to SEQ ID NO: 103166

SEQ ID NO: 714919 - RNA, 63 nt, Homo Sapiens; identical to SEQ ID NO: 103167

SEQ ID NO: 714920 - RNA, 63 nt, Homo Sapiens; identical to SEQ ID NO: 103168

SEQ ID NO: 714921 - RNA, 63 nt, Homo Sapiens; identical to SEQ ID NO: 103169

SEQ ID NO: 714922 - RNA, 63 nt, Homo Sapiens; identical to SEQ ID NO: 103170

SEQ ID NO: 714923 - RNA, 63 nt, Homo Sapiens; identical to SEQ ID NO: 103171

SEQ ID NO: 714924 - RNA, 63 nt, Homo Sapiens; identical to SEQ ID NO: 103172

SEQ ID NO: 714925 - RNA, 63 nt, Homo Sapiens; identical to SEQ ID NO: 103173

SEQ ID NO: 714926 - RNA, 63 nt, Homo Sapiens; identical to SEQ ID NO: 103174

SEQ ID NO: 714927 - RNA, 63 nt, Homo Sapiens; identical to SEQ ID NO: 103175

SEQ ID NO: 714928 - RNA, 63 nt, Homo Sapiens; identical to SEQ ID NO: 103176

SEQ ID NO: 714929 - RNA, 63 nt, Homo Sapiens; identical to SEQ ID NO: 103177

SEQ ID NO: 714930 - RNA, 63 nt, Homo Sapiens; identical to SEQ ID NO: 103178

SEQ ID NO: 714931 - RNA, 63 nt, Homo Sapiens; identical to SEQ ID NO: 103179

SEQ ID NO: 714932 - RNA, 63 nt, Homo Sapiens; identical to SEQ ID NO: 103180

SEQ ID NO: 714933 - RNA, 63 nt, Homo Sapiens; identical to SEQ ID NO: 103181

SEQ ID NO: 714934 - RNA, 63 nt, Homo Sapiens; identical to SEQ ID NO: 103182

SEQ ID NO: 714935 - RNA, 63 nt, Homo Sapiens; identical to SEQ ID NO: 103183

SEQ ID NO: 714936 - RNA, 63 nt, Homo Sapiens; identical to SEQ ID NO: 103184

SEQ ID NO: 714937 - RNA, 63 nt, Homo Sapiens; identical to SEQ ID NO: 103185

SEQ ID NO: 714938 - RNA, 63 nt, Homo Sapiens; identical to SEQ ID NO: 103186

SEQ ID NO: 714939 - RNA, 63 nt, Homo Sapiens; identical to SEQ ID NO: 103187

SEQ ID NO: 714940 - RNA, 63 nt, Homo Sapiens; identical to SEQ ID NO: 103188

SEQ ID NO: 714941 - RNA, 63 nt, Homo Sapiens; identical to SEQ ID NO: 103189

SEQ ID NO: 714942 - RNA, 63 nt, Homo Sapiens; identical to SEQ ID NO: 103190

SEQ ID NO: 714943 - RNA, 63 nt, Homo Sapiens; identical to SEQ ID NO: 103191

SEQ ID NO: 714944 - RNA, 63 nt, Homo Sapiens; identical to SEQ ID NO: 103192

SEQ ID NO: 714945 - RNA, 63 nt, Homo Sapiens; identical to SEQ ID NO: 103193

SEQ ID NO: 714946 - RNA, 63 nt, Homo Sapiens; identical to SEQ ID NO: 103194

SEQ ID NO: 714947 - RNA, 63 nt, Homo Sapiens; identical to SEQ ID NO: 103195

SEQ ID NO: 714948 - RNA, 51 nt, Homo Sapiens; identical to SEQ ID NO: 103196

SEQ ID NO: 714949 - RNA, 63 nt, Homo Sapiens; identical to SEQ ID NO: 103197

SEQ ID NO: 714950 - RNA, 63 nt, Homo Sapiens; identical to SEQ ID NO: 103198

SEQ ID NO: 714951 - RNA, 63 nt, Homo Sapiens; identical to SEQ ID NO: 103199

SEQ ID NO: 714952 - RNA, 63 nt, Homo Sapiens; identical to SEQ ID NO: 103200

SEQ ID NO: 714953 - RNA, 63 nt, Homo Sapiens; identical to SEQ ID NO: 103201

SEQ ID NO: 714954 - RNA, 63 nt, Homo Sapiens; identical to SEQ ID NO: 103202

SEQ ID NO: 714955 - RNA, 63 nt, Homo Sapiens; identical to SEQ ID NO: 103203

SEQ ID NO: 714956 - RNA, 63 nt, Homo Sapiens; identical to SEQ ID NO: 103204

SEQ ID NO: 714957 - RNA, 63 nt, Homo Sapiens; identical to SEQ ID NO: 103205

SEQ ID NO: 714958 - RNA, 63 nt, Homo Sapiens; identical to SEQ ID NO: 103206

SEQ ID NO: 714959 - RNA, 63 nt, Homo Sapiens; identical to SEQ ID NO: 103207

SEQ ID NO: 714960 - RNA, 63 nt, Homo Sapiens; identical to SEQ ID NO: 103208

SEQ ID NO: 714961 - RNA, 63 nt, Homo Sapiens; identical to SEQ ID NO: 103209

SEQ ID NO: 714962 - RNA, 63 nt, Homo Sapiens; identical to SEQ ID NO: 103210

SEQ ID NO: 714963 - RNA, 63 nt, Homo Sapiens; identical to SEQ ID NO: 103211

SEQ ID NO: 714964 - RNA, 63 nt, Homo Sapiens; identical to SEQ ID NO: 103212

SEQ ID NO: 714965 - RNA, 63 nt, Homo Sapiens; identical to SEQ ID NO: 103213

SEQ ID NO: 714966 - RNA, 63 nt, Homo Sapiens; identical to SEQ ID NO: 103214

SEQ ID NO: 714967 - RNA, 63 nt, Homo Sapiens; identical to SEQ ID NO: 103215

SEQ ID NO: 714968 - RNA, 63 nt, Homo Sapiens; identical to SEQ ID NO: 103216

SEQ ID NO: 714969 - RNA, 63 nt, Homo Sapiens; identical to SEQ ID NO: 103217

SEQ ID NO: 714970 - RNA, 63 nt, Homo Sapiens; identical to SEQ ID NO: 103218

SEQ ID NO: 714971 - RNA, 63 nt, Homo Sapiens; identical to SEQ ID NO: 103219

SEQ ID NO: 714972 - RNA, 63 nt, Homo Sapiens; identical to SEQ ID NO: 103220

SEQ ID NO: 714973 - RNA, 63 nt, Homo Sapiens; identical to SEQ ID NO: 103221

SEQ ID NO: 714974 - RNA, 63 nt, Homo Sapiens; identical to SEQ ID NO: 103222

SEQ ID NO: 714975 - RNA, 63 nt, Homo Sapiens; identical to SEQ ID NO: 103223

SEQ ID NO: 714976 - RNA, 63 nt, Homo Sapiens; identical to SEQ ID NO: 103224

SEQ ID NO: 714977 - RNA, 63 nt, Homo Sapiens; identical to SEQ ID NO: 103225

SEQ ID NO: 714978 - RNA, 63 nt, Homo Sapiens; identical to SEQ ID NO: 103226

SEQ ID NO: 714979 - RNA, 63 nt, Homo Sapiens; identical to SEQ ID NO: 103227

SEQ ID NO: 714980 - RNA, 63 nt, Homo Sapiens; identical to SEQ ID NO: 103228

SEQ ID NO: 714981 - RNA, 63 nt, Homo Sapiens; identical to SEQ ID NO: 103229

SEQ ID NO: 714982 - RNA, 63 nt, Homo Sapiens; identical to SEQ ID NO: 103230

SEQ ID NO: 714983 - RNA, 63 nt, Homo Sapiens; identical to SEQ ID NO: 103231

SEQ ID NO: 714984 - RNA, 63 nt, Homo Sapiens; identical to SEQ ID NO: 103232

SEQ ID NO: 714985 - RNA, 63 nt, Homo Sapiens; identical to SEQ ID NO: 103233

SEQ ID NO: 714986 - RNA, 63 nt, Homo Sapiens; identical to SEQ ID NO: 103234

SEQ ID NO: 714987 - RNA, 63 nt, Homo Sapiens; identical to SEQ ID NO: 103235

SEQ ID NO: 714988 - RNA, 63 nt, Homo Sapiens; identical to SEQ ID NO: 103236

SEQ ID NO: 714989 - RNA, 63 nt, Homo Sapiens; identical to SEQ ID NO: 103237

SEQ ID NO: 714990 - RNA, 63 nt, Homo Sapiens; identical to SEQ ID NO: 103238

SEQ ID NO: 714991 - RNA, 63 nt, Homo Sapiens; identical to SEQ ID NO: 103239

SEQ ID NO: 714992 - RNA, 63 nt, Homo Sapiens; identical to SEQ ID NO: 103240

SEQ ID NO: 714993 - RNA, 63 nt, Homo Sapiens; identical to SEQ ID NO: 103241

SEQ ID NO: 714994 - RNA, 63 nt, Homo Sapiens; identical to SEQ ID NO: 103242

SEQ ID NO: 714995 - RNA, 63 nt, Homo Sapiens; identical to SEQ ID NO: 103243

SEQ ID NO: 714996 - RNA, 63 nt, Homo Sapiens; identical to SEQ ID NO: 103244

SEQ ID NO: 714997 - RNA, 63 nt, Homo Sapiens; identical to SEQ ID NO: 103245

SEQ ID NO: 714998 - RNA, 63 nt, Homo Sapiens; identical to SEQ ID NO: 103246

SEQ ID NO: 714999 - RNA, 63 nt, Homo Sapiens; identical to SEQ ID NO: 103247

SEQ ID NO: 715000 - RNA, 63 nt, Homo Sapiens; identical to SEQ ID NO: 103248

SEQ ID NO: 715001 - RNA, 63 nt, Homo Sapiens; identical to SEQ ID NO: 103249

SEQ ID NO: 715002 - RNA, 63 nt, Homo Sapiens; identical to SEQ ID NO: 103250

SEQ ID NO: 715003 - RNA, 63 nt, Homo Sapiens; identical to SEQ ID NO: 103251

SEQ ID NO: 715004 - RNA, 63 nt, Homo Sapiens; identical to SEQ ID NO: 103252

SEQ ID NO: 715005 - RNA, 63 nt, Homo Sapiens; identical to SEQ ID NO: 103253

SEQ ID NO: 715006 - RNA, 63 nt, Homo Sapiens; identical to SEQ ID NO: 103254

SEQ ID NO: 715007 - RNA, 63 nt, Homo Sapiens; identical to SEQ ID NO: 103255

SEQ ID NO: 715008 - RNA, 63 nt, Homo Sapiens; identical to SEQ ID NO: 103256

SEQ ID NO: 715009 - RNA, 63 nt, Homo Sapiens; identical to SEQ ID NO: 103257

SEQ ID NO: 715010 - RNA, 63 nt, Homo Sapiens; identical to SEQ ID NO: 103258

SEQ ID NO: 715011 - RNA, 63 nt, Homo Sapiens; identical to SEQ ID NO: 103259

SEQ ID NO: 715012 - RNA, 63 nt, Homo Sapiens; identical to SEQ ID NO: 103260

SEQ ID NO: 715013 - RNA, 63 nt, Homo Sapiens; identical to SEQ ID NO: 103261

SEQ ID NO: 715014 - RNA, 63 nt, Homo Sapiens; identical to SEQ ID NO: 103262

SEQ ID NO: 715015 - RNA, 63 nt, Homo Sapiens; identical to SEQ ID NO: 103263

SEQ ID NO: 715016 - RNA, 63 nt, Homo Sapiens; identical to SEQ ID NO: 103264

SEQ ID NO: 715017 - RNA, 63 nt, Homo Sapiens; identical to SEQ ID NO: 103265

SEQ ID NO: 715018 - RNA, 63 nt, Homo Sapiens; identical to SEQ ID NO: 103266

SEQ ID NO: 715019 - RNA, 63 nt, Homo Sapiens; identical to SEQ ID NO: 103267

SEQ ID NO: 715020 - RNA, 63 nt, Homo Sapiens; identical to SEQ ID NO: 103268

SEQ ID NO: 715021 - RNA, 63 nt, Homo Sapiens; identical to SEQ ID NO: 103269

SEQ ID NO: 715022 - RNA, 63 nt, Homo Sapiens; identical to SEQ ID NO: 103270

SEQ ID NO: 715023 - RNA, 63 nt, Homo Sapiens; identical to SEQ ID NO: 103271

SEQ ID NO: 715024 - RNA, 63 nt, Homo Sapiens; identical to SEQ ID NO: 103272

SEQ ID NO: 715025 - RNA, 63 nt, Homo Sapiens; identical to SEQ ID NO: 103273

SEQ ID NO: 715026 - RNA, 63 nt, Homo Sapiens; identical to SEQ ID NO: 103274

SEQ ID NO: 715027 - RNA, 63 nt, Homo Sapiens; identical to SEQ ID NO: 103275

SEQ ID NO: 715028 - RNA, 63 nt, Homo Sapiens; identical to SEQ ID NO: 103276

SEQ ID NO: 715029 - RNA, 63 nt, Homo Sapiens; identical to SEQ ID NO: 103277

SEQ ID NO: 715030 - RNA, 63 nt, Homo Sapiens; identical to SEQ ID NO: 103278

SEQ ID NO: 715031 - RNA, 63 nt, Homo Sapiens; identical to SEQ ID NO: 103279

SEQ ID NO: 715032 - RNA, 63 nt, Homo Sapiens; identical to SEQ ID NO: 103280

SEQ ID NO: 715033 - RNA, 63 nt, Homo Sapiens; identical to SEQ ID NO: 103281

SEQ ID NO: 715034 - RNA, 63 nt, Homo Sapiens; identical to SEQ ID NO: 103282

SEQ ID NO: 715035 - RNA, 63 nt, Homo Sapiens; identical to SEQ ID NO: 103283

SEQ ID NO: 715036 - RNA, 63 nt, Homo Sapiens; identical to SEQ ID NO: 103284

SEQ ID NO: 715037 - RNA, 63 nt, Homo Sapiens; identical to SEQ ID NO: 103285

SEQ ID NO: 715038 - RNA, 63 nt, Homo Sapiens; identical to SEQ ID NO: 103286

SEQ ID NO: 715039 - RNA, 63 nt, Homo Sapiens; identical to SEQ ID NO: 103287

SEQ ID NO: 715040 - RNA, 63 nt, Homo Sapiens; identical to SEQ ID NO: 103288

SEQ ID NO: 715041 - RNA, 62 nt, Homo Sapiens; identical to SEQ ID NO: 103289

SEQ ID NO: 715042 - RNA, 62 nt, Homo Sapiens; identical to SEQ ID NO: 103290

SEQ ID NO: 715043 - RNA, 62 nt, Homo Sapiens; identical to SEQ ID NO: 103291

SEQ ID NO: 715044 - RNA, 62 nt, Homo Sapiens; identical to SEQ ID NO: 103292

SEQ ID NO: 715045 - RNA, 62 nt, Homo Sapiens; identical to SEQ ID NO: 103293

SEQ ID NO: 715046 - RNA, 62 nt, Homo Sapiens; identical to SEQ ID NO: 103294

SEQ ID NO: 715047 - RNA, 62 nt, Homo Sapiens; identical to SEQ ID NO: 103295

SEQ ID NO: 715048 - RNA, 62 nt, Homo Sapiens; identical to SEQ ID NO: 103296

SEQ ID NO: 715049 - RNA, 62 nt, Homo Sapiens; identical to SEQ ID NO: 103297

SEQ ID NO: 715050 - RNA, 62 nt, Homo Sapiens; identical to SEQ ID NO: 103298

SEQ ID NO: 715051 - RNA, 62 nt, Homo Sapiens; identical to SEQ ID NO: 103299

SEQ ID NO: 715052 - RNA, 57 nt, Homo Sapiens; identical to SEQ ID NO: 103300

SEQ ID NO: 715053 - RNA, 62 nt, Homo Sapiens; identical to SEQ ID NO: 103301

SEQ ID NO: 715054 - RNA, 62 nt, Homo Sapiens; identical to SEQ ID NO: 103302

SEQ ID NO: 715055 - RNA, 62 nt, Homo Sapiens; identical to SEQ ID NO: 103303

SEQ ID NO: 715056 - RNA, 62 nt, Homo Sapiens; identical to SEQ ID NO: 103304

SEQ ID NO: 715057 - RNA, 62 nt, Homo Sapiens; identical to SEQ ID NO: 103305

SEQ ID NO: 715058 - RNA, 62 nt, Homo Sapiens; identical to SEQ ID NO: 103306

SEQ ID NO: 715059 - RNA, 62 nt, Homo Sapiens; identical to SEQ ID NO: 103307

SEQ ID NO: 715060 - RNA, 62 nt, Homo Sapiens; identical to SEQ ID NO: 103308

SEQ ID NO: 715061 - RNA, 62 nt, Homo Sapiens; identical to SEQ ID NO: 103309

SEQ ID NO: 715062 - RNA, 62 nt, Homo Sapiens; identical to SEQ ID NO: 103310

SEQ ID NO: 715063 - RNA, 62 nt, Homo Sapiens; identical to SEQ ID NO: 103311

SEQ ID NO: 715064 - RNA, 62 nt, Homo Sapiens; identical to SEQ ID NO: 103312

SEQ ID NO: 715065 - RNA, 62 nt, Homo Sapiens; identical to SEQ ID NO: 103313

SEQ ID NO: 715066 - RNA, 62 nt, Homo Sapiens; identical to SEQ ID NO: 103314

SEQ ID NO: 715067 - RNA, 62 nt, Homo Sapiens; identical to SEQ ID NO: 103315

SEQ ID NO: 715068 - RNA, 62 nt, Homo Sapiens; identical to SEQ ID NO: 103316

SEQ ID NO: 715069 - RNA, 62 nt, Homo Sapiens; identical to SEQ ID NO: 103317

SEQ ID NO: 715070 - RNA, 62 nt, Homo Sapiens; identical to SEQ ID NO: 103318

SEQ ID NO: 715071 - RNA, 62 nt, Homo Sapiens; identical to SEQ ID NO: 103319

SEQ ID NO: 715072 - RNA, 62 nt, Homo Sapiens; identical to SEQ ID NO: 103320

SEQ ID NO: 715073 - RNA, 62 nt, Homo Sapiens; identical to SEQ ID NO: 103321

SEQ ID NO: 715074 - RNA, 62 nt, Homo Sapiens; identical to SEQ ID NO: 103322

SEQ ID NO: 715075 - RNA, 62 nt, Homo Sapiens; identical to SEQ ID NO: 103323

SEQ ID NO: 715076 - RNA, 62 nt, Homo Sapiens; identical to SEQ ID NO: 103324

SEQ ID NO: 715077 - RNA, 62 nt, Homo Sapiens; identical to SEQ ID NO: 103325

SEQ ID NO: 715078 - RNA, 62 nt, Homo Sapiens; identical to SEQ ID NO: 103326

SEQ ID NO: 715079 - RNA, 62 nt, Homo Sapiens; identical to SEQ ID NO: 103327

SEQ ID NO: 715080 - RNA, 62 nt, Homo Sapiens; identical to SEQ ID NO: 103328

SEQ ID NO: 715081 - RNA, 62 nt, Homo Sapiens; identical to SEQ ID NO: 103329

SEQ ID NO: 715082 - RNA, 62 nt, Homo Sapiens; identical to SEQ ID NO: 103330

SEQ ID NO: 715083 - RNA, 62 nt, Homo Sapiens; identical to SEQ ID NO: 103331

SEQ ID NO: 715084 - RNA, 62 nt, Homo Sapiens; identical to SEQ ID NO: 103332

SEQ ID NO: 715085 - RNA, 62 nt, Homo Sapiens; identical to SEQ ID NO: 103333

SEQ ID NO: 715086 - RNA, 62 nt, Homo Sapiens; identical to SEQ ID NO: 103334

SEQ ID NO: 715087 - RNA, 62 nt, Homo Sapiens; identical to SEQ ID NO: 103335

SEQ ID NO: 715088 - RNA, 62 nt, Homo Sapiens; identical to SEQ ID NO: 103336

SEQ ID NO: 715089 - RNA, 62 nt, Homo Sapiens; identical to SEQ ID NO: 103337

SEQ ID NO: 715090 - RNA, 62 nt, Homo Sapiens; identical to SEQ ID NO: 103338

SEQ ID NO: 715091 - RNA, 62 nt, Homo Sapiens; identical to SEQ ID NO: 103339

SEQ ID NO: 715092 - RNA, 62 nt, Homo Sapiens; identical to SEQ ID NO: 103340

SEQ ID NO: 715093 - RNA, 62 nt, Homo Sapiens; identical to SEQ ID NO: 103341

SEQ ID NO: 715094 - RNA, 62 nt, Homo Sapiens; identical to SEQ ID NO: 103342

SEQ ID NO: 715095 - RNA, 62 nt, Homo Sapiens; identical to SEQ ID NO: 103343

SEQ ID NO: 715096 - RNA, 62 nt, Homo Sapiens; identical to SEQ ID NO: 103344

SEQ ID NO: 715097 - RNA, 62 nt, Homo Sapiens; identical to SEQ ID NO: 103345

SEQ ID NO: 715098 - RNA, 62 nt, Homo Sapiens; identical to SEQ ID NO: 103346

SEQ ID NO: 715099 - RNA, 62 nt, Homo Sapiens; identical to SEQ ID NO: 103347

SEQ ID NO: 715100 - RNA, 62 nt, Homo Sapiens; identical to SEQ ID NO: 103348

SEQ ID NO: 715101 - RNA, 62 nt, Homo Sapiens; identical to SEQ ID NO: 103349

SEQ ID NO: 715102 - RNA, 62 nt, Homo Sapiens; identical to SEQ ID NO: 103350

SEQ ID NO: 715103 - RNA, 62 nt, Homo Sapiens; identical to SEQ ID NO: 103351

SEQ ID NO: 715104 - RNA, 62 nt, Homo Sapiens; identical to SEQ ID NO: 103352

SEQ ID NO: 715105 - RNA, 62 nt, Homo Sapiens; identical to SEQ ID NO: 103353

SEQ ID NO: 715106 - RNA, 62 nt, Homo Sapiens; identical to SEQ ID NO: 103354

SEQ ID NO: 715107 - RNA, 62 nt, Homo Sapiens; identical to SEQ ID NO: 103355

SEQ ID NO: 715108 - RNA, 62 nt, Homo Sapiens; identical to SEQ ID NO: 103356

SEQ ID NO: 715109 - RNA, 62 nt, Homo Sapiens; identical to SEQ ID NO: 103357

SEQ ID NO: 715110 - RNA, 62 nt, Homo Sapiens; identical to SEQ ID NO: 103358

SEQ ID NO: 715111 - RNA, 62 nt, Homo Sapiens; identical to SEQ ID NO: 103359

SEQ ID NO: 715112 - RNA, 62 nt, Homo Sapiens; identical to SEQ ID NO: 103360

SEQ ID NO: 715113 - RNA, 62 nt, Homo Sapiens; identical to SEQ ID NO: 103361

SEQ ID NO: 715114 - RNA, 62 nt, Homo Sapiens; identical to SEQ ID NO: 103362

SEQ ID NO: 715115 - RNA, 62 nt, Homo Sapiens; identical to SEQ ID NO: 103363

SEQ ID NO: 715116 - RNA, 62 nt, Homo Sapiens; identical to SEQ ID NO: 103364

SEQ ID NO: 715117 - RNA, 62 nt, Homo Sapiens; identical to SEQ ID NO: 103365

SEQ ID NO: 715118 - RNA, 62 nt, Homo Sapiens; identical to SEQ ID NO: 103366

SEQ ID NO: 715119 - RNA, 62 nt, Homo Sapiens; identical to SEQ ID NO: 103367

SEQ ID NO: 715120 - RNA, 62 nt, Homo Sapiens; identical to SEQ ID NO: 103368

SEQ ID NO: 715121 - RNA, 62 nt, Homo Sapiens; identical to SEQ ID NO: 103369

SEQ ID NO: 715122 - RNA, 62 nt, Homo Sapiens; identical to SEQ ID NO: 103370

SEQ ID NO: 715123 - RNA, 62 nt, Homo Sapiens; identical to SEQ ID NO: 103371

SEQ ID NO: 715124 - RNA, 59 nt, Homo Sapiens; identical to SEQ ID NO: 103372

SEQ ID NO: 715125 - RNA, 62 nt, Homo Sapiens; identical to SEQ ID NO: 103373

SEQ ID NO: 715126 - RNA, 62 nt, Homo Sapiens; identical to SEQ ID NO: 103374

SEQ ID NO: 715127 - RNA, 62 nt, Homo Sapiens; identical to SEQ ID NO: 103375

SEQ ID NO: 715128 - RNA, 62 nt, Homo Sapiens; identical to SEQ ID NO: 103376

SEQ ID NO: 715129 - RNA, 62 nt, Homo Sapiens; identical to SEQ ID NO: 103377

SEQ ID NO: 715130 - RNA, 62 nt, Homo Sapiens; identical to SEQ ID NO: 103378

SEQ ID NO: 715131 - RNA, 62 nt, Homo Sapiens; identical to SEQ ID NO: 103379

SEQ ID NO: 715132 - RNA, 62 nt, Homo Sapiens; identical to SEQ ID NO: 103380

SEQ ID NO: 715133 - RNA, 62 nt, Homo Sapiens; identical to SEQ ID NO: 103381

SEQ ID NO: 715134 - RNA, 62 nt, Homo Sapiens; identical to SEQ ID NO: 103382

SEQ ID NO: 715135 - RNA, 62 nt, Homo Sapiens; identical to SEQ ID NO: 103383

SEQ ID NO: 715136 - RNA, 62 nt, Homo Sapiens; identical to SEQ ID NO: 103384

SEQ ID NO: 715137 - RNA, 62 nt, Homo Sapiens; identical to SEQ ID NO: 103385

SEQ ID NO: 715138 - RNA, 62 nt, Homo Sapiens; identical to SEQ ID NO: 103386

SEQ ID NO: 715139 - RNA, 62 nt, Homo Sapiens; identical to SEQ ID NO: 103387

SEQ ID NO: 715140 - RNA, 62 nt, Homo Sapiens; identical to SEQ ID NO: 103388

SEQ ID NO: 715141 - RNA, 62 nt, Homo Sapiens; identical to SEQ ID NO: 103389

SEQ ID NO: 715142 - RNA, 62 nt, Homo Sapiens; identical to SEQ ID NO: 103390

SEQ ID NO: 715143 - RNA, 62 nt, Homo Sapiens; identical to SEQ ID NO: 103391

SEQ ID NO: 715144 - RNA, 62 nt, Homo Sapiens; identical to SEQ ID NO: 103392

SEQ ID NO: 715145 - RNA, 60 nt, Homo Sapiens; identical to SEQ ID NO: 103393

SEQ ID NO: 715146 - RNA, 62 nt, Homo Sapiens; identical to SEQ ID NO: 103394

SEQ ID NO: 715147 - RNA, 62 nt, Homo Sapiens; identical to SEQ ID NO: 103395

SEQ ID NO: 715148 - RNA, 62 nt, Homo Sapiens; identical to SEQ ID NO: 103396

SEQ ID NO: 715149 - RNA, 62 nt, Homo Sapiens; identical to SEQ ID NO: 103397

SEQ ID NO: 715150 - RNA, 62 nt, Homo Sapiens; identical to SEQ ID NO: 103398

SEQ ID NO: 715151 - RNA, 62 nt, Homo Sapiens; identical to SEQ ID NO: 103399

SEQ ID NO: 715152 - RNA, 62 nt, Homo Sapiens; identical to SEQ ID NO: 103400

SEQ ID NO: 715153 - RNA, 62 nt, Homo Sapiens; identical to SEQ ID NO: 103401

SEQ ID NO: 715154 - RNA, 62 nt, Homo Sapiens; identical to SEQ ID NO: 103402

SEQ ID NO: 715155 - RNA, 62 nt, Homo Sapiens; identical to SEQ ID NO: 103403

SEQ ID NO: 715156 - RNA, 62 nt, Homo Sapiens; identical to SEQ ID NO: 103404

SEQ ID NO: 715157 - RNA, 62 nt, Homo Sapiens; identical to SEQ ID NO: 103405

SEQ ID NO: 715158 - RNA, 62 nt, Homo Sapiens; identical to SEQ ID NO: 103406

SEQ ID NO: 715159 - RNA, 62 nt, Homo Sapiens; identical to SEQ ID NO: 103407

SEQ ID NO: 715160 - RNA, 62 nt, Homo Sapiens; identical to SEQ ID NO: 103408

SEQ ID NO: 715161 - RNA, 62 nt, Homo Sapiens; identical to SEQ ID NO: 103409

SEQ ID NO: 715162 - RNA, 62 nt, Homo Sapiens; identical to SEQ ID NO: 103410

SEQ ID NO: 715163 - RNA, 62 nt, Homo Sapiens; identical to SEQ ID NO: 103411

SEQ ID NO: 715164 - RNA, 62 nt, Homo Sapiens; identical to SEQ ID NO: 103412

SEQ ID NO: 715165 - RNA, 62 nt, Homo Sapiens; identical to SEQ ID NO: 103413

SEQ ID NO: 715166 - RNA, 62 nt, Homo Sapiens; identical to SEQ ID NO: 103414

SEQ ID NO: 715167 - RNA, 62 nt, Homo Sapiens; identical to SEQ ID NO: 103415

SEQ ID NO: 715168 - RNA, 62 nt, Homo Sapiens; identical to SEQ ID NO: 103416

SEQ ID NO: 715169 - RNA, 62 nt, Homo Sapiens; identical to SEQ ID NO: 103417

SEQ ID NO: 715170 - RNA, 62 nt, Homo Sapiens; identical to SEQ ID NO: 103418

SEQ ID NO: 715171 - RNA, 62 nt, Homo Sapiens; identical to SEQ ID NO: 103419

SEQ ID NO: 715172 - RNA, 62 nt, Homo Sapiens; identical to SEQ ID NO: 103420

SEQ ID NO: 715173 - RNA, 62 nt, Homo Sapiens; identical to SEQ ID NO: 103421

SEQ ID NO: 715174 - RNA, 62 nt, Homo Sapiens; identical to SEQ ID NO: 103422

SEQ ID NO: 715175 - RNA, 62 nt, Homo Sapiens; identical to SEQ ID NO: 103423

SEQ ID NO: 715176 - RNA, 62 nt, Homo Sapiens; identical to SEQ ID NO: 103424

SEQ ID NO: 715177 - RNA, 62 nt, Homo Sapiens; identical to SEQ ID NO: 103425

SEQ ID NO: 715178 - RNA, 62 nt, Homo Sapiens; identical to SEQ ID NO: 103426

SEQ ID NO: 715179 - RNA, 62 nt, Homo Sapiens; identical to SEQ ID NO: 103427

SEQ ID NO: 715180 - RNA, 62 nt, Homo Sapiens; identical to SEQ ID NO: 103428

SEQ ID NO: 715181 - RNA, 62 nt, Homo Sapiens; identical to SEQ ID NO: 103429

SEQ ID NO: 715182 - RNA, 62 nt, Homo Sapiens; identical to SEQ ID NO: 103430

SEQ ID NO: 715183 - RNA, 62 nt, Homo Sapiens; identical to SEQ ID NO: 103431

SEQ ID NO: 715184 - RNA, 62 nt, Homo Sapiens; identical to SEQ ID NO: 103432

SEQ ID NO: 715185 - RNA, 62 nt, Homo Sapiens; identical to SEQ ID NO: 103433

SEQ ID NO: 715186 - RNA, 62 nt, Homo Sapiens; identical to SEQ ID NO: 103434

SEQ ID NO: 715187 - RNA, 62 nt, Homo Sapiens; identical to SEQ ID NO: 103435

SEQ ID NO: 715188 - RNA, 62 nt, Homo Sapiens; identical to SEQ ID NO: 103436

SEQ ID NO: 715189 - RNA, 62 nt, Homo Sapiens; identical to SEQ ID NO: 103437

SEQ ID NO: 715190 - RNA, 62 nt, Homo Sapiens; identical to SEQ ID NO: 103438

SEQ ID NO: 715191 - RNA, 62 nt, Homo Sapiens; identical to SEQ ID NO: 103439

SEQ ID NO: 715192 - RNA, 62 nt, Homo Sapiens; identical to SEQ ID NO: 103440

SEQ ID NO: 715193 - RNA, 62 nt, Homo Sapiens; identical to SEQ ID NO: 103441

SEQ ID NO: 715194 - RNA, 62 nt, Homo Sapiens; identical to SEQ ID NO: 103442

SEQ ID NO: 715195 - RNA, 62 nt, Homo Sapiens; identical to SEQ ID NO: 103443

SEQ ID NO: 715196 - RNA, 62 nt, Homo Sapiens; identical to SEQ ID NO: 103444

SEQ ID NO: 715197 - RNA, 62 nt, Homo Sapiens; identical to SEQ ID NO: 103445

SEQ ID NO: 715198 - RNA, 62 nt, Homo Sapiens; identical to SEQ ID NO: 103446

SEQ ID NO: 715199 - RNA, 62 nt, Homo Sapiens; identical to SEQ ID NO: 103447

SEQ ID NO: 715200 - RNA, 62 nt, Homo Sapiens; identical to SEQ ID NO: 103448

SEQ ID NO: 715201 - RNA, 62 nt, Homo Sapiens; identical to SEQ ID NO: 103449

SEQ ID NO: 715202 - RNA, 62 nt, Homo Sapiens; identical to SEQ ID NO: 103450

SEQ ID NO: 715203 - RNA, 62 nt, Homo Sapiens; identical to SEQ ID NO: 103451

SEQ ID NO: 715204 - RNA, 62 nt, Homo Sapiens; identical to SEQ ID NO: 103452

SEQ ID NO: 715205 - RNA, 62 nt, Homo Sapiens; identical to SEQ ID NO: 103453

SEQ ID NO: 715206 - RNA, 62 nt, Homo Sapiens; identical to SEQ ID NO: 103454

SEQ ID NO: 715207 - RNA, 62 nt, Homo Sapiens; identical to SEQ ID NO: 103455

SEQ ID NO: 715208 - RNA, 62 nt, Homo Sapiens; identical to SEQ ID NO: 103456

SEQ ID NO: 715209 - RNA, 62 nt, Homo Sapiens; identical to SEQ ID NO: 103457

SEQ ID NO: 715210 - RNA, 62 nt, Homo Sapiens; identical to SEQ ID NO: 103458

SEQ ID NO: 715211 - RNA, 62 nt, Homo Sapiens; identical to SEQ ID NO: 103459

SEQ ID NO: 715212 - RNA, 62 nt, Homo Sapiens; identical to SEQ ID NO: 103460

SEQ ID NO: 715213 - RNA, 62 nt, Homo Sapiens; identical to SEQ ID NO: 103461

SEQ ID NO: 715214 - RNA, 62 nt, Homo Sapiens; identical to SEQ ID NO: 103462

SEQ ID NO: 715215 - RNA, 62 nt, Homo Sapiens; identical to SEQ ID NO: 103463

SEQ ID NO: 715216 - RNA, 62 nt, Homo Sapiens; identical to SEQ ID NO: 103464

SEQ ID NO: 715217 - RNA, 62 nt, Homo Sapiens; identical to SEQ ID NO: 103465

SEQ ID NO: 715218 - RNA, 62 nt, Homo Sapiens; identical to SEQ ID NO: 103466

SEQ ID NO: 715219 - RNA, 62 nt, Homo Sapiens; identical to SEQ ID NO: 103467

SEQ ID NO: 715220 - RNA, 62 nt, Homo Sapiens; identical to SEQ ID NO: 103468

SEQ ID NO: 715221 - RNA, 62 nt, Homo Sapiens; identical to SEQ ID NO: 103469

SEQ ID NO: 715222 - RNA, 62 nt, Homo Sapiens; identical to SEQ ID NO: 103470

SEQ ID NO: 715223 - RNA, 62 nt, Homo Sapiens; identical to SEQ ID NO: 103471

SEQ ID NO: 715224 - RNA, 62 nt, Homo Sapiens; identical to SEQ ID NO: 103472

SEQ ID NO: 715225 - RNA, 62 nt, Homo Sapiens; identical to SEQ ID NO: 103473

SEQ ID NO: 715226 - RNA, 62 nt, Homo Sapiens; identical to SEQ ID NO: 103474

SEQ ID NO: 715227 - RNA, 62 nt, Homo Sapiens; identical to SEQ ID NO: 103475

SEQ ID NO: 715228 - RNA, 62 nt, Homo Sapiens; identical to SEQ ID NO: 103476

SEQ ID NO: 715229 - RNA, 62 nt, Homo Sapiens; identical to SEQ ID NO: 103477

SEQ ID NO: 715230 - RNA, 62 nt, Homo Sapiens; identical to SEQ ID NO: 103478

SEQ ID NO: 715231 - RNA, 62 nt, Homo Sapiens; identical to SEQ ID NO: 103479

SEQ ID NO: 715232 - RNA, 62 nt, Homo Sapiens; identical to SEQ ID NO: 103480

SEQ ID NO: 715233 - RNA, 62 nt, Homo Sapiens; identical to SEQ ID NO: 103481

SEQ ID NO: 715234 - RNA, 62 nt, Homo Sapiens; identical to SEQ ID NO: 103482

SEQ ID NO: 715235 - RNA, 62 nt, Homo Sapiens; identical to SEQ ID NO: 103483

SEQ ID NO: 715236 - RNA, 62 nt, Homo Sapiens; identical to SEQ ID NO: 103484

SEQ ID NO: 715237 - RNA, 62 nt, Homo Sapiens; identical to SEQ ID NO: 103485

SEQ ID NO: 715238 - RNA, 62 nt, Homo Sapiens; identical to SEQ ID NO: 103486

SEQ ID NO: 715239 - RNA, 62 nt, Homo Sapiens; identical to SEQ ID NO: 103487

SEQ ID NO: 715240 - RNA, 62 nt, Homo Sapiens; identical to SEQ ID NO: 103488

SEQ ID NO: 715241 - RNA, 62 nt, Homo Sapiens; identical to SEQ ID NO: 103489

SEQ ID NO: 715242 - RNA, 62 nt, Homo Sapiens; identical to SEQ ID NO: 103490

SEQ ID NO: 715243 - RNA, 62 nt, Homo Sapiens; identical to SEQ ID NO: 103491

SEQ ID NO: 715244 - RNA, 62 nt, Homo Sapiens; identical to SEQ ID NO: 103492

SEQ ID NO: 715245 - RNA, 62 nt, Homo Sapiens; identical to SEQ ID NO: 103493

SEQ ID NO: 715246 - RNA, 62 nt, Homo Sapiens; identical to SEQ ID NO: 103494

SEQ ID NO: 715247 - RNA, 62 nt, Homo Sapiens; identical to SEQ ID NO: 103495

SEQ ID NO: 715248 - RNA, 62 nt, Homo Sapiens; identical to SEQ ID NO: 103496

SEQ ID NO: 715249 - RNA, 62 nt, Homo Sapiens; identical to SEQ ID NO: 103497

SEQ ID NO: 715250 - RNA, 62 nt, Homo Sapiens; identical to SEQ ID NO: 103498

SEQ ID NO: 715251 - RNA, 62 nt, Homo Sapiens; identical to SEQ ID NO: 103499

SEQ ID NO: 715252 - RNA, 62 nt, Homo Sapiens; identical to SEQ ID NO: 103500

SEQ ID NO: 715253 - RNA, 62 nt, Homo Sapiens; identical to SEQ ID NO: 103501

SEQ ID NO: 715254 - RNA, 62 nt, Homo Sapiens; identical to SEQ ID NO: 103502

SEQ ID NO: 715255 - RNA, 62 nt, Homo Sapiens; identical to SEQ ID NO: 103503

SEQ ID NO: 715256 - RNA, 62 nt, Homo Sapiens; identical to SEQ ID NO: 103504

SEQ ID NO: 715257 - RNA, 62 nt, Homo Sapiens; identical to SEQ ID NO: 103505

SEQ ID NO: 715258 - RNA, 62 nt, Homo Sapiens; identical to SEQ ID NO: 103506

SEQ ID NO: 715259 - RNA, 62 nt, Homo Sapiens; identical to SEQ ID NO: 103507

SEQ ID NO: 715260 - RNA, 63 nt, Homo Sapiens; identical to SEQ ID NO: 103508

SEQ ID NO: 715261 - RNA, 63 nt, Homo Sapiens; identical to SEQ ID NO: 103509

SEQ ID NO: 715262 - RNA, 63 nt, Homo Sapiens; identical to SEQ ID NO: 103510

SEQ ID NO: 715263 - RNA, 63 nt, Homo Sapiens; identical to SEQ ID NO: 103511

SEQ ID NO: 715264 - RNA, 63 nt, Homo Sapiens; identical to SEQ ID NO: 103512

SEQ ID NO: 715265 - RNA, 63 nt, Homo Sapiens; identical to SEQ ID NO: 103513

SEQ ID NO: 715266 - RNA, 63 nt, Homo Sapiens; identical to SEQ ID NO: 103514

SEQ ID NO: 715267 - RNA, 63 nt, Homo Sapiens; identical to SEQ ID NO: 103515

SEQ ID NO: 715268 - RNA, 63 nt, Homo Sapiens; identical to SEQ ID NO: 103516

SEQ ID NO: 715269 - RNA, 63 nt, Homo Sapiens; identical to SEQ ID NO: 103517

SEQ ID NO: 715270 - RNA, 63 nt, Homo Sapiens; identical to SEQ ID NO: 103518

SEQ ID NO: 715271 - RNA, 57 nt, Homo Sapiens; identical to SEQ ID NO: 103300

SEQ ID NO: 715272 - RNA, 63 nt, Homo Sapiens; identical to SEQ ID NO: 103520

SEQ ID NO: 715273 - RNA, 63 nt, Homo Sapiens; identical to SEQ ID NO: 103521

SEQ ID NO: 715274 - RNA, 63 nt, Homo Sapiens; identical to SEQ ID NO: 103522

SEQ ID NO: 715275 - RNA, 63 nt, Homo Sapiens; identical to SEQ ID NO: 103523

SEQ ID NO: 715276 - RNA, 63 nt, Homo Sapiens; identical to SEQ ID NO: 103524

SEQ ID NO: 715277 - RNA, 63 nt, Homo Sapiens; identical to SEQ ID NO: 103525

SEQ ID NO: 715278 - RNA, 63 nt, Homo Sapiens; identical to SEQ ID NO: 103526

SEQ ID NO: 715279 - RNA, 63 nt, Homo Sapiens; identical to SEQ ID NO: 103527

SEQ ID NO: 715280 - RNA, 63 nt, Homo Sapiens; identical to SEQ ID NO: 103528

SEQ ID NO: 715281 - RNA, 63 nt, Homo Sapiens; identical to SEQ ID NO: 103529

SEQ ID NO: 715282 - RNA, 63 nt, Homo Sapiens; identical to SEQ ID NO: 103530

SEQ ID NO: 715283 - RNA, 63 nt, Homo Sapiens; identical to SEQ ID NO: 103531

SEQ ID NO: 715284 - RNA, 63 nt, Homo Sapiens; identical to SEQ ID NO: 103532

SEQ ID NO: 715285 - RNA, 63 nt, Homo Sapiens; identical to SEQ ID NO: 103533

SEQ ID NO: 715286 - RNA, 63 nt, Homo Sapiens; identical to SEQ ID NO: 103534

SEQ ID NO: 715287 - RNA, 63 nt, Homo Sapiens; identical to SEQ ID NO: 103535

SEQ ID NO: 715288 - RNA, 63 nt, Homo Sapiens; identical to SEQ ID NO: 103536

SEQ ID NO: 715289 - RNA, 63 nt, Homo Sapiens; identical to SEQ ID NO: 103537

SEQ ID NO: 715290 - RNA, 63 nt, Homo Sapiens; identical to SEQ ID NO: 103538

SEQ ID NO: 715291 - RNA, 63 nt, Homo Sapiens; identical to SEQ ID NO: 103539

SEQ ID NO: 715292 - RNA, 63 nt, Homo Sapiens; identical to SEQ ID NO: 103540

SEQ ID NO: 715293 - RNA, 63 nt, Homo Sapiens; identical to SEQ ID NO: 103541

SEQ ID NO: 715294 - RNA, 63 nt, Homo Sapiens; identical to SEQ ID NO: 103542

SEQ ID NO: 715295 - RNA, 63 nt, Homo Sapiens; identical to SEQ ID NO: 103543

SEQ ID NO: 715296 - RNA, 63 nt, Homo Sapiens; identical to SEQ ID NO: 103544

SEQ ID NO: 715297 - RNA, 63 nt, Homo Sapiens; identical to SEQ ID NO: 103545

SEQ ID NO: 715298 - RNA, 63 nt, Homo Sapiens; identical to SEQ ID NO: 103546

SEQ ID NO: 715299 - RNA, 63 nt, Homo Sapiens; identical to SEQ ID NO: 103547

SEQ ID NO: 715300 - RNA, 63 nt, Homo Sapiens; identical to SEQ ID NO: 103548

SEQ ID NO: 715301 - RNA, 63 nt, Homo Sapiens; identical to SEQ ID NO: 103549

SEQ ID NO: 715302 - RNA, 63 nt, Homo Sapiens; identical to SEQ ID NO: 103550

SEQ ID NO: 715303 - RNA, 63 nt, Homo Sapiens; identical to SEQ ID NO: 103551

SEQ ID NO: 715304 - RNA, 63 nt, Homo Sapiens; identical to SEQ ID NO: 103552

SEQ ID NO: 715305 - RNA, 63 nt, Homo Sapiens; identical to SEQ ID NO: 103553

SEQ ID NO: 715306 - RNA, 63 nt, Homo Sapiens; identical to SEQ ID NO: 103554

SEQ ID NO: 715307 - RNA, 63 nt, Homo Sapiens; identical to SEQ ID NO: 103555

SEQ ID NO: 715308 - RNA, 63 nt, Homo Sapiens; identical to SEQ ID NO: 103556

SEQ ID NO: 715309 - RNA, 63 nt, Homo Sapiens; identical to SEQ ID NO: 103557

SEQ ID NO: 715310 - RNA, 63 nt, Homo Sapiens; identical to SEQ ID NO: 103558

SEQ ID NO: 715311 - RNA, 63 nt, Homo Sapiens; identical to SEQ ID NO: 103559

SEQ ID NO: 715312 - RNA, 63 nt, Homo Sapiens; identical to SEQ ID NO: 103560

SEQ ID NO: 715313 - RNA, 63 nt, Homo Sapiens; identical to SEQ ID NO: 103561

SEQ ID NO: 715314 - RNA, 63 nt, Homo Sapiens; identical to SEQ ID NO: 103562

SEQ ID NO: 715315 - RNA, 63 nt, Homo Sapiens; identical to SEQ ID NO: 103563

SEQ ID NO: 715316 - RNA, 63 nt, Homo Sapiens; identical to SEQ ID NO: 103564

SEQ ID NO: 715317 - RNA, 63 nt, Homo Sapiens; identical to SEQ ID NO: 103565

SEQ ID NO: 715318 - RNA, 63 nt, Homo Sapiens; identical to SEQ ID NO: 103566

SEQ ID NO: 715319 - RNA, 63 nt, Homo Sapiens; identical to SEQ ID NO: 103567

SEQ ID NO: 715320 - RNA, 63 nt, Homo Sapiens; identical to SEQ ID NO: 103568

SEQ ID NO: 715321 - RNA, 63 nt, Homo Sapiens; identical to SEQ ID NO: 103569

SEQ ID NO: 715322 - RNA, 63 nt, Homo Sapiens; identical to SEQ ID NO: 103570

SEQ ID NO: 715323 - RNA, 63 nt, Homo Sapiens; identical to SEQ ID NO: 103571

SEQ ID NO: 715324 - RNA, 63 nt, Homo Sapiens; identical to SEQ ID NO: 103572

SEQ ID NO: 715325 - RNA, 63 nt, Homo Sapiens; identical to SEQ ID NO: 103573

SEQ ID NO: 715326 - RNA, 63 nt, Homo Sapiens; identical to SEQ ID NO: 103574

SEQ ID NO: 715327 - RNA, 63 nt, Homo Sapiens; identical to SEQ ID NO: 103575

SEQ ID NO: 715328 - RNA, 63 nt, Homo Sapiens; identical to SEQ ID NO: 103576

SEQ ID NO: 715329 - RNA, 63 nt, Homo Sapiens; identical to SEQ ID NO: 103577

SEQ ID NO: 715330 - RNA, 63 nt, Homo Sapiens; identical to SEQ ID NO: 103578

SEQ ID NO: 715331 - RNA, 63 nt, Homo Sapiens; identical to SEQ ID NO: 103579

SEQ ID NO: 715332 - RNA, 63 nt, Homo Sapiens; identical to SEQ ID NO: 103580

SEQ ID NO: 715333 - RNA, 63 nt, Homo Sapiens; identical to SEQ ID NO: 103581

SEQ ID NO: 715334 - RNA, 63 nt, Homo Sapiens; identical to SEQ ID NO: 103582

SEQ ID NO: 715335 - RNA, 63 nt, Homo Sapiens; identical to SEQ ID NO: 103583

SEQ ID NO: 715336 - RNA, 63 nt, Homo Sapiens; identical to SEQ ID NO: 103584

SEQ ID NO: 715337 - RNA, 63 nt, Homo Sapiens; identical to SEQ ID NO: 103585

SEQ ID NO: 715338 - RNA, 63 nt, Homo Sapiens; identical to SEQ ID NO: 103586

SEQ ID NO: 715339 - RNA, 63 nt, Homo Sapiens; identical to SEQ ID NO: 103587

SEQ ID NO: 715340 - RNA, 63 nt, Homo Sapiens; identical to SEQ ID NO: 103588

SEQ ID NO: 715341 - RNA, 63 nt, Homo Sapiens; identical to SEQ ID NO: 103589

SEQ ID NO: 715342 - RNA, 63 nt, Homo Sapiens; identical to SEQ ID NO: 103590

SEQ ID NO: 715343 - RNA, 59 nt, Homo Sapiens; identical to SEQ ID NO: 103372

SEQ ID NO: 715344 - RNA, 63 nt, Homo Sapiens; identical to SEQ ID NO: 103592

SEQ ID NO: 715345 - RNA, 63 nt, Homo Sapiens; identical to SEQ ID NO: 103593

SEQ ID NO: 715346 - RNA, 63 nt, Homo Sapiens; identical to SEQ ID NO: 103594

SEQ ID NO: 715347 - RNA, 63 nt, Homo Sapiens; identical to SEQ ID NO: 103595

SEQ ID NO: 715348 - RNA, 63 nt, Homo Sapiens; identical to SEQ ID NO: 103596

SEQ ID NO: 715349 - RNA, 63 nt, Homo Sapiens; identical to SEQ ID NO: 103597

SEQ ID NO: 715350 - RNA, 63 nt, Homo Sapiens; identical to SEQ ID NO: 103598

SEQ ID NO: 715351 - RNA, 63 nt, Homo Sapiens; identical to SEQ ID NO: 103599

SEQ ID NO: 715352 - RNA, 63 nt, Homo Sapiens; identical to SEQ ID NO: 103600

SEQ ID NO: 715353 - RNA, 63 nt, Homo Sapiens; identical to SEQ ID NO: 103601

SEQ ID NO: 715354 - RNA, 63 nt, Homo Sapiens; identical to SEQ ID NO: 103602

SEQ ID NO: 715355 - RNA, 63 nt, Homo Sapiens; identical to SEQ ID NO: 103603

SEQ ID NO: 715356 - RNA, 63 nt, Homo Sapiens; identical to SEQ ID NO: 103604

SEQ ID NO: 715357 - RNA, 63 nt, Homo Sapiens; identical to SEQ ID NO: 103605

SEQ ID NO: 715358 - RNA, 63 nt, Homo Sapiens; identical to SEQ ID NO: 103606

SEQ ID NO: 715359 - RNA, 63 nt, Homo Sapiens; identical to SEQ ID NO: 103607

SEQ ID NO: 715360 - RNA, 63 nt, Homo Sapiens; identical to SEQ ID NO: 103608

SEQ ID NO: 715361 - RNA, 63 nt, Homo Sapiens; identical to SEQ ID NO: 103609

SEQ ID NO: 715362 - RNA, 63 nt, Homo Sapiens; identical to SEQ ID NO: 103610

SEQ ID NO: 715363 - RNA, 63 nt, Homo Sapiens; identical to SEQ ID NO: 103611

SEQ ID NO: 715364 - RNA, 61 nt, Homo Sapiens; identical to SEQ ID NO: 103612

SEQ ID NO: 715365 - RNA, 63 nt, Homo Sapiens; identical to SEQ ID NO: 103613

SEQ ID NO: 715366 - RNA, 63 nt, Homo Sapiens; identical to SEQ ID NO: 103614

SEQ ID NO: 715367 - RNA, 63 nt, Homo Sapiens; identical to SEQ ID NO: 103615

SEQ ID NO: 715368 - RNA, 63 nt, Homo Sapiens; identical to SEQ ID NO: 103616

SEQ ID NO: 715369 - RNA, 63 nt, Homo Sapiens; identical to SEQ ID NO: 103617

SEQ ID NO: 715370 - RNA, 63 nt, Homo Sapiens; identical to SEQ ID NO: 103618

SEQ ID NO: 715371 - RNA, 63 nt, Homo Sapiens; identical to SEQ ID NO: 103619

SEQ ID NO: 715372 - RNA, 63 nt, Homo Sapiens; identical to SEQ ID NO: 103620

SEQ ID NO: 715373 - RNA, 63 nt, Homo Sapiens; identical to SEQ ID NO: 103621

SEQ ID NO: 715374 - RNA, 63 nt, Homo Sapiens; identical to SEQ ID NO: 103622

SEQ ID NO: 715375 - RNA, 63 nt, Homo Sapiens; identical to SEQ ID NO: 103623

SEQ ID NO: 715376 - RNA, 63 nt, Homo Sapiens; identical to SEQ ID NO: 103624

SEQ ID NO: 715377 - RNA, 63 nt, Homo Sapiens; identical to SEQ ID NO: 103625

SEQ ID NO: 715378 - RNA, 63 nt, Homo Sapiens; identical to SEQ ID NO: 103626

SEQ ID NO: 715379 - RNA, 63 nt, Homo Sapiens; identical to SEQ ID NO: 103627

SEQ ID NO: 715380 - RNA, 63 nt, Homo Sapiens; identical to SEQ ID NO: 103628

SEQ ID NO: 715381 - RNA, 63 nt, Homo Sapiens; identical to SEQ ID NO: 103629

SEQ ID NO: 715382 - RNA, 63 nt, Homo Sapiens; identical to SEQ ID NO: 103630

SEQ ID NO: 715383 - RNA, 63 nt, Homo Sapiens; identical to SEQ ID NO: 103631

SEQ ID NO: 715384 - RNA, 63 nt, Homo Sapiens; identical to SEQ ID NO: 103632

SEQ ID NO: 715385 - RNA, 63 nt, Homo Sapiens; identical to SEQ ID NO: 103633

SEQ ID NO: 715386 - RNA, 63 nt, Homo Sapiens; identical to SEQ ID NO: 103634

SEQ ID NO: 715387 - RNA, 63 nt, Homo Sapiens; identical to SEQ ID NO: 103635

SEQ ID NO: 715388 - RNA, 63 nt, Homo Sapiens; identical to SEQ ID NO: 103636

SEQ ID NO: 715389 - RNA, 63 nt, Homo Sapiens; identical to SEQ ID NO: 103637

SEQ ID NO: 715390 - RNA, 63 nt, Homo Sapiens; identical to SEQ ID NO: 103638

SEQ ID NO: 715391 - RNA, 63 nt, Homo Sapiens; identical to SEQ ID NO: 103639

SEQ ID NO: 715392 - RNA, 63 nt, Homo Sapiens; identical to SEQ ID NO: 103640

SEQ ID NO: 715393 - RNA, 63 nt, Homo Sapiens; identical to SEQ ID NO: 103641

SEQ ID NO: 715394 - RNA, 63 nt, Homo Sapiens; identical to SEQ ID NO: 103642

SEQ ID NO: 715395 - RNA, 63 nt, Homo Sapiens; identical to SEQ ID NO: 103643

SEQ ID NO: 715396 - RNA, 63 nt, Homo Sapiens; identical to SEQ ID NO: 103644

SEQ ID NO: 715397 - RNA, 63 nt, Homo Sapiens; identical to SEQ ID NO: 103645

SEQ ID NO: 715398 - RNA, 63 nt, Homo Sapiens; identical to SEQ ID NO: 103646

SEQ ID NO: 715399 - RNA, 63 nt, Homo Sapiens; identical to SEQ ID NO: 103647

SEQ ID NO: 715400 - RNA, 63 nt, Homo Sapiens; identical to SEQ ID NO: 103648

SEQ ID NO: 715401 - RNA, 63 nt, Homo Sapiens; identical to SEQ ID NO: 103649

SEQ ID NO: 715402 - RNA, 63 nt, Homo Sapiens; identical to SEQ ID NO: 103650

SEQ ID NO: 715403 - RNA, 63 nt, Homo Sapiens; identical to SEQ ID NO: 103651

SEQ ID NO: 715404 - RNA, 63 nt, Homo Sapiens; identical to SEQ ID NO: 103652

SEQ ID NO: 715405 - RNA, 63 nt, Homo Sapiens; identical to SEQ ID NO: 103653

SEQ ID NO: 715406 - RNA, 63 nt, Homo Sapiens; identical to SEQ ID NO: 103654

SEQ ID NO: 715407 - RNA, 63 nt, Homo Sapiens; identical to SEQ ID NO: 103655

SEQ ID NO: 715408 - RNA, 63 nt, Homo Sapiens; identical to SEQ ID NO: 103656

SEQ ID NO: 715409 - RNA, 63 nt, Homo Sapiens; identical to SEQ ID NO: 103657

SEQ ID NO: 715410 - RNA, 63 nt, Homo Sapiens; identical to SEQ ID NO: 103658

SEQ ID NO: 715411 - RNA, 63 nt, Homo Sapiens; identical to SEQ ID NO: 103659

SEQ ID NO: 715412 - RNA, 63 nt, Homo Sapiens; identical to SEQ ID NO: 103660

SEQ ID NO: 715413 - RNA, 63 nt, Homo Sapiens; identical to SEQ ID NO: 103661

SEQ ID NO: 715414 - RNA, 63 nt, Homo Sapiens; identical to SEQ ID NO: 103662

SEQ ID NO: 715415 - RNA, 63 nt, Homo Sapiens; identical to SEQ ID NO: 103663

SEQ ID NO: 715416 - RNA, 63 nt, Homo Sapiens; identical to SEQ ID NO: 103664

SEQ ID NO: 715417 - RNA, 63 nt, Homo Sapiens; identical to SEQ ID NO: 103665

SEQ ID NO: 715418 - RNA, 63 nt, Homo Sapiens; identical to SEQ ID NO: 103666

SEQ ID NO: 715419 - RNA, 63 nt, Homo Sapiens; identical to SEQ ID NO: 103667

SEQ ID NO: 715420 - RNA, 63 nt, Homo Sapiens; identical to SEQ ID NO: 103668

SEQ ID NO: 715421 - RNA, 63 nt, Homo Sapiens; identical to SEQ ID NO: 103669

SEQ ID NO: 715422 - RNA, 63 nt, Homo Sapiens; identical to SEQ ID NO: 103670

SEQ ID NO: 715423 - RNA, 63 nt, Homo Sapiens; identical to SEQ ID NO: 103671

SEQ ID NO: 715424 - RNA, 63 nt, Homo Sapiens; identical to SEQ ID NO: 103672

SEQ ID NO: 715425 - RNA, 63 nt, Homo Sapiens; identical to SEQ ID NO: 103673

SEQ ID NO: 715426 - RNA, 63 nt, Homo Sapiens; identical to SEQ ID NO: 103674

SEQ ID NO: 715427 - RNA, 63 nt, Homo Sapiens; identical to SEQ ID NO: 103675

SEQ ID NO: 715428 - RNA, 63 nt, Homo Sapiens; identical to SEQ ID NO: 103676

SEQ ID NO: 715429 - RNA, 63 nt, Homo Sapiens; identical to SEQ ID NO: 103677

SEQ ID NO: 715430 - RNA, 63 nt, Homo Sapiens; identical to SEQ ID NO: 103678

SEQ ID NO: 715431 - RNA, 63 nt, Homo Sapiens; identical to SEQ ID NO: 103679

SEQ ID NO: 715432 - RNA, 63 nt, Homo Sapiens; identical to SEQ ID NO: 103680

SEQ ID NO: 715433 - RNA, 63 nt, Homo Sapiens; identical to SEQ ID NO: 103681

SEQ ID NO: 715434 - RNA, 63 nt, Homo Sapiens; identical to SEQ ID NO: 103682

SEQ ID NO: 715435 - RNA, 63 nt, Homo Sapiens; identical to SEQ ID NO: 103683

SEQ ID NO: 715436 - RNA, 63 nt, Homo Sapiens; identical to SEQ ID NO: 103684

SEQ ID NO: 715437 - RNA, 63 nt, Homo Sapiens; identical to SEQ ID NO: 103685

SEQ ID NO: 715438 - RNA, 63 nt, Homo Sapiens; identical to SEQ ID NO: 103686

SEQ ID NO: 715439 - RNA, 63 nt, Homo Sapiens; identical to SEQ ID NO: 103687

SEQ ID NO: 715440 - RNA, 63 nt, Homo Sapiens; identical to SEQ ID NO: 103688

SEQ ID NO: 715441 - RNA, 63 nt, Homo Sapiens; identical to SEQ ID NO: 103689

SEQ ID NO: 715442 - RNA, 63 nt, Homo Sapiens; identical to SEQ ID NO: 103690

SEQ ID NO: 715443 - RNA, 63 nt, Homo Sapiens; identical to SEQ ID NO: 103691

SEQ ID NO: 715444 - RNA, 63 nt, Homo Sapiens; identical to SEQ ID NO: 103692

SEQ ID NO: 715445 - RNA, 63 nt, Homo Sapiens; identical to SEQ ID NO: 103693

SEQ ID NO: 715446 - RNA, 63 nt, Homo Sapiens; identical to SEQ ID NO: 103694

SEQ ID NO: 715447 - RNA, 63 nt, Homo Sapiens; identical to SEQ ID NO: 103695

SEQ ID NO: 715448 - RNA, 63 nt, Homo Sapiens; identical to SEQ ID NO: 103696

SEQ ID NO: 715449 - RNA, 63 nt, Homo Sapiens; identical to SEQ ID NO: 103697

SEQ ID NO: 715450 - RNA, 63 nt, Homo Sapiens; identical to SEQ ID NO: 103698

SEQ ID NO: 715451 - RNA, 63 nt, Homo Sapiens; identical to SEQ ID NO: 103699

SEQ ID NO: 715452 - RNA, 63 nt, Homo Sapiens; identical to SEQ ID NO: 103700

SEQ ID NO: 715453 - RNA, 63 nt, Homo Sapiens; identical to SEQ ID NO: 103701

SEQ ID NO: 715454 - RNA, 63 nt, Homo Sapiens; identical to SEQ ID NO: 103702

SEQ ID NO: 715455 - RNA, 63 nt, Homo Sapiens; identical to SEQ ID NO: 103703

SEQ ID NO: 715456 - RNA, 63 nt, Homo Sapiens; identical to SEQ ID NO: 103704

SEQ ID NO: 715457 - RNA, 63 nt, Homo Sapiens; identical to SEQ ID NO: 103705

SEQ ID NO: 715458 - RNA, 63 nt, Homo Sapiens; identical to SEQ ID NO: 103706

SEQ ID NO: 715459 - RNA, 63 nt, Homo Sapiens; identical to SEQ ID NO: 103707

SEQ ID NO: 715460 - RNA, 63 nt, Homo Sapiens; identical to SEQ ID NO: 103708

SEQ ID NO: 715461 - RNA, 63 nt, Homo Sapiens; identical to SEQ ID NO: 103709

SEQ ID NO: 715462 - RNA, 63 nt, Homo Sapiens; identical to SEQ ID NO: 103710

SEQ ID NO: 715463 - RNA, 63 nt, Homo Sapiens; identical to SEQ ID NO: 103711

SEQ ID NO: 715464 - RNA, 63 nt, Homo Sapiens; identical to SEQ ID NO: 103712

SEQ ID NO: 715465 - RNA, 63 nt, Homo Sapiens; identical to SEQ ID NO: 103713

SEQ ID NO: 715466 - RNA, 63 nt, Homo Sapiens; identical to SEQ ID NO: 103714

SEQ ID NO: 715467 - RNA, 63 nt, Homo Sapiens; identical to SEQ ID NO: 103715

SEQ ID NO: 715468 - RNA, 63 nt, Homo Sapiens; identical to SEQ ID NO: 103716

SEQ ID NO: 715469 - RNA, 63 nt, Homo Sapiens; identical to SEQ ID NO: 103717

SEQ ID NO: 715470 - RNA, 63 nt, Homo Sapiens; identical to SEQ ID NO: 103718

SEQ ID NO: 715471 - RNA, 63 nt, Homo Sapiens; identical to SEQ ID NO: 103719

SEQ ID NO: 715472 - RNA, 63 nt, Homo Sapiens; identical to SEQ ID NO: 103720

SEQ ID NO: 715473 - RNA, 63 nt, Homo Sapiens; identical to SEQ ID NO: 103721

SEQ ID NO: 715474 - RNA, 63 nt, Homo Sapiens; identical to SEQ ID NO: 103722

SEQ ID NO: 715475 - RNA, 63 nt, Homo Sapiens; identical to SEQ ID NO: 103723

SEQ ID NO: 715476 - RNA, 63 nt, Homo Sapiens; identical to SEQ ID NO: 103724

SEQ ID NO: 715477 - RNA, 63 nt, Homo Sapiens; identical to SEQ ID NO: 103725

SEQ ID NO: 715478 - RNA, 63 nt, Homo Sapiens; identical to SEQ ID NO: 103726

SEQ ID NO: 715479 - RNA, 64 nt, Homo Sapiens; identical to SEQ ID NO: 87480

SEQ ID NO: 715480 - RNA, 64 nt, Homo Sapiens; identical to SEQ ID NO: 87481

SEQ ID NO: 715481 - RNA, 64 nt, Homo Sapiens; identical to SEQ ID NO: 87482

SEQ ID NO: 715482 - RNA, 64 nt, Homo Sapiens; identical to SEQ ID NO: 87483

SEQ ID NO: 715483 - RNA, 64 nt, Homo Sapiens; identical to SEQ ID NO: 87484

SEQ ID NO: 715484 - RNA, 64 nt, Homo Sapiens; identical to SEQ ID NO: 87485

SEQ ID NO: 715485 - RNA, 64 nt, Homo Sapiens; identical to SEQ ID NO: 87486

SEQ ID NO: 715486 - RNA, 64 nt, Homo Sapiens; identical to SEQ ID NO: 87487

SEQ ID NO: 715487 - RNA, 64 nt, Homo Sapiens; identical to SEQ ID NO: 87488

SEQ ID NO: 715488 - RNA, 64 nt, Homo Sapiens; identical to SEQ ID NO: 87489

SEQ ID NO: 715489 - RNA, 64 nt, Homo Sapiens; identical to SEQ ID NO: 87490

SEQ ID NO: 715490 - RNA, 64 nt, Homo Sapiens; identical to SEQ ID NO: 87491

SEQ ID NO: 715491 - RNA, 64 nt, Homo Sapiens; identical to SEQ ID NO: 87492

SEQ ID NO: 715492 - RNA, 64 nt, Homo Sapiens; identical to SEQ ID NO: 87493

SEQ ID NO: 715493 - RNA, 64 nt, Homo Sapiens; identical to SEQ ID NO: 87494

SEQ ID NO: 715494 - RNA, 64 nt, Homo Sapiens; identical to SEQ ID NO: 87495

SEQ ID NO: 715495 - RNA, 64 nt, Homo Sapiens; identical to SEQ ID NO: 87496

SEQ ID NO: 715496 - RNA, 64 nt, Homo Sapiens; identical to SEQ ID NO: 87497

SEQ ID NO: 715497 - RNA, 64 nt, Homo Sapiens; identical to SEQ ID NO: 87498

SEQ ID NO: 715498 - RNA, 64 nt, Homo Sapiens; identical to SEQ ID NO: 87499

SEQ ID NO: 715499 - RNA, 64 nt, Homo Sapiens; identical to SEQ ID NO: 87500

SEQ ID NO: 715500 - RNA, 64 nt, Homo Sapiens; identical to SEQ ID NO: 87501

SEQ ID NO: 715501 - RNA, 64 nt, Homo Sapiens; identical to SEQ ID NO: 87502

SEQ ID NO: 715502 - RNA, 64 nt, Homo Sapiens; identical to SEQ ID NO: 87503

SEQ ID NO: 715503 - RNA, 64 nt, Homo Sapiens; identical to SEQ ID NO: 87504

SEQ ID NO: 715504 - RNA, 64 nt, Homo Sapiens; identical to SEQ ID NO: 87505

SEQ ID NO: 715505 - RNA, 64 nt, Homo Sapiens; identical to SEQ ID NO: 87506

SEQ ID NO: 715506 - RNA, 64 nt, Homo Sapiens; identical to SEQ ID NO: 87507

SEQ ID NO: 715507 - RNA, 64 nt, Homo Sapiens; identical to SEQ ID NO: 87508

SEQ ID NO: 715508 - RNA, 64 nt, Homo Sapiens; identical to SEQ ID NO: 87509

SEQ ID NO: 715509 - RNA, 64 nt, Homo Sapiens; identical to SEQ ID NO: 87510

SEQ ID NO: 715510 - RNA, 64 nt, Homo Sapiens; identical to SEQ ID NO: 87511

SEQ ID NO: 715511 - RNA, 64 nt, Homo Sapiens; identical to SEQ ID NO: 87512

SEQ ID NO: 715512 - RNA, 64 nt, Homo Sapiens; identical to SEQ ID NO: 87513

SEQ ID NO: 715513 - RNA, 64 nt, Homo Sapiens; identical to SEQ ID NO: 87514

SEQ ID NO: 715514 - RNA, 64 nt, Homo Sapiens; identical to SEQ ID NO: 87515

SEQ ID NO: 715515 - RNA, 64 nt, Homo Sapiens; identical to SEQ ID NO: 87516

SEQ ID NO: 715516 - RNA, 64 nt, Homo Sapiens; identical to SEQ ID NO: 87517

SEQ ID NO: 715517 - RNA, 64 nt, Homo Sapiens; identical to SEQ ID NO: 87518

SEQ ID NO: 715518 - RNA, 64 nt, Homo Sapiens; identical to SEQ ID NO: 87519

SEQ ID NO: 715519 - RNA, 64 nt, Homo Sapiens; identical to SEQ ID NO: 87520

SEQ ID NO: 715520 - RNA, 64 nt, Homo Sapiens; identical to SEQ ID NO: 87521

SEQ ID NO: 715521 - RNA, 64 nt, Homo Sapiens; identical to SEQ ID NO: 87522

SEQ ID NO: 715522 - RNA, 64 nt, Homo Sapiens; identical to SEQ ID NO: 87523

SEQ ID NO: 715523 - RNA, 64 nt, Homo Sapiens; identical to SEQ ID NO: 87524

SEQ ID NO: 715524 - RNA, 64 nt, Homo Sapiens; identical to SEQ ID NO: 87525

SEQ ID NO: 715525 - RNA, 64 nt, Homo Sapiens; identical to SEQ ID NO: 87526

SEQ ID NO: 715526 - RNA, 64 nt, Homo Sapiens; identical to SEQ ID NO: 87527

SEQ ID NO: 715527 - RNA, 64 nt, Homo Sapiens; identical to SEQ ID NO: 87528

SEQ ID NO: 715528 - RNA, 64 nt, Homo Sapiens; identical to SEQ ID NO: 87529

SEQ ID NO: 715529 - RNA, 64 nt, Homo Sapiens; identical to SEQ ID NO: 87530

SEQ ID NO: 715530 - RNA, 64 nt, Homo Sapiens; identical to SEQ ID NO: 87531

SEQ ID NO: 715531 - RNA, 64 nt, Homo Sapiens; identical to SEQ ID NO: 87532

SEQ ID NO: 715532 - RNA, 64 nt, Homo Sapiens; identical to SEQ ID NO: 87533

SEQ ID NO: 715533 - RNA, 64 nt, Homo Sapiens; identical to SEQ ID NO: 87534

SEQ ID NO: 715534 - RNA, 64 nt, Homo Sapiens; identical to SEQ ID NO: 87535

SEQ ID NO: 715535 - RNA, 64 nt, Homo Sapiens; identical to SEQ ID NO: 87536

SEQ ID NO: 715536 - RNA, 61 nt, Homo Sapiens; identical to SEQ ID NO: 292803

SEQ ID NO: 715537 - RNA, 64 nt, Homo Sapiens; identical to SEQ ID NO: 292804

SEQ ID NO: 715538 - RNA, 64 nt, Homo Sapiens; identical to SEQ ID NO: 292805

SEQ ID NO: 715539 - RNA, 64 nt, Homo Sapiens; identical to SEQ ID NO: 292806

SEQ ID NO: 715540 - RNA, 64 nt, Homo Sapiens; identical to SEQ ID NO: 292807

SEQ ID NO: 715541 - RNA, 64 nt, Homo Sapiens; identical to SEQ ID NO: 292808

SEQ ID NO: 715542 - RNA, 64 nt, Homo Sapiens; identical to SEQ ID NO: 292809

SEQ ID NO: 715543 - RNA, 64 nt, Homo Sapiens; identical to SEQ ID NO: 292810

SEQ ID NO: 715544 - RNA, 64 nt, Homo Sapiens; identical to SEQ ID NO: 292811

SEQ ID NO: 715545 - RNA, 64 nt, Homo Sapiens; identical to SEQ ID NO: 292812

SEQ ID NO: 715546 - RNA, 64 nt, Homo Sapiens; identical to SEQ ID NO: 292813

SEQ ID NO: 715547 - RNA, 64 nt, Homo Sapiens; identical to SEQ ID NO: 292814

SEQ ID NO: 715548 - RNA, 64 nt, Homo Sapiens; identical to SEQ ID NO: 292815

SEQ ID NO: 715549 - RNA, 64 nt, Homo Sapiens; identical to SEQ ID NO: 292816

SEQ ID NO: 715550 - RNA, 64 nt, Homo Sapiens; identical to SEQ ID NO: 292817

SEQ ID NO: 715551 - RNA, 64 nt, Homo Sapiens; identical to SEQ ID NO: 292818

SEQ ID NO: 715552 - RNA, 64 nt, Homo Sapiens; identical to SEQ ID NO: 87480

SEQ ID NO: 715553 - RNA, 64 nt, Homo Sapiens; identical to SEQ ID NO: 87481

SEQ ID NO: 715554 - RNA, 64 nt, Homo Sapiens; identical to SEQ ID NO: 87482

SEQ ID NO: 715555 - RNA, 64 nt, Homo Sapiens; identical to SEQ ID NO: 87483

SEQ ID NO: 715556 - RNA, 64 nt, Homo Sapiens; identical to SEQ ID NO: 87484

SEQ ID NO: 715557 - RNA, 64 nt, Homo Sapiens; identical to SEQ ID NO: 87485

SEQ ID NO: 715558 - RNA, 64 nt, Homo Sapiens; identical to SEQ ID NO: 87486

SEQ ID NO: 715559 - RNA, 64 nt, Homo Sapiens; identical to SEQ ID NO: 87487

SEQ ID NO: 715560 - RNA, 64 nt, Homo Sapiens; identical to SEQ ID NO: 87488

SEQ ID NO: 715561 - RNA, 64 nt, Homo Sapiens; identical to SEQ ID NO: 87489

SEQ ID NO: 715562 - RNA, 64 nt, Homo Sapiens; identical to SEQ ID NO: 87490

SEQ ID NO: 715563 - RNA, 64 nt, Homo Sapiens; identical to SEQ ID NO: 87491

SEQ ID NO: 715564 - RNA, 64 nt, Homo Sapiens; identical to SEQ ID NO: 87492

SEQ ID NO: 715565 - RNA, 64 nt, Homo Sapiens; identical to SEQ ID NO: 87493

SEQ ID NO: 715566 - RNA, 64 nt, Homo Sapiens; identical to SEQ ID NO: 87494

SEQ ID NO: 715567 - RNA, 64 nt, Homo Sapiens; identical to SEQ ID NO: 87495

SEQ ID NO: 715568 - RNA, 64 nt, Homo Sapiens; identical to SEQ ID NO: 87496

SEQ ID NO: 715569 - RNA, 64 nt, Homo Sapiens; identical to SEQ ID NO: 87497

SEQ ID NO: 715570 - RNA, 64 nt, Homo Sapiens; identical to SEQ ID NO: 87498

SEQ ID NO: 715571 - RNA, 64 nt, Homo Sapiens; identical to SEQ ID NO: 87499

SEQ ID NO: 715572 - RNA, 64 nt, Homo Sapiens; identical to SEQ ID NO: 87500

SEQ ID NO: 715573 - RNA, 64 nt, Homo Sapiens; identical to SEQ ID NO: 87501

SEQ ID NO: 715574 - RNA, 64 nt, Homo Sapiens; identical to SEQ ID NO: 87502

SEQ ID NO: 715575 - RNA, 64 nt, Homo Sapiens; identical to SEQ ID NO: 87503

SEQ ID NO: 715576 - RNA, 64 nt, Homo Sapiens; identical to SEQ ID NO: 87504

SEQ ID NO: 715577 - RNA, 64 nt, Homo Sapiens; identical to SEQ ID NO: 87505

SEQ ID NO: 715578 - RNA, 64 nt, Homo Sapiens; identical to SEQ ID NO: 87506

SEQ ID NO: 715579 - RNA, 64 nt, Homo Sapiens; identical to SEQ ID NO: 87507

SEQ ID NO: 715580 - RNA, 64 nt, Homo Sapiens; identical to SEQ ID NO: 87508

SEQ ID NO: 715581 - RNA, 64 nt, Homo Sapiens; identical to SEQ ID NO: 87509

SEQ ID NO: 715582 - RNA, 64 nt, Homo Sapiens; identical to SEQ ID NO: 87510

SEQ ID NO: 715583 - RNA, 64 nt, Homo Sapiens; identical to SEQ ID NO: 87511

SEQ ID NO: 715584 - RNA, 64 nt, Homo Sapiens; identical to SEQ ID NO: 87512

SEQ ID NO: 715585 - RNA, 64 nt, Homo Sapiens; identical to SEQ ID NO: 87513

SEQ ID NO: 715586 - RNA, 64 nt, Homo Sapiens; identical to SEQ ID NO: 87514

SEQ ID NO: 715587 - RNA, 64 nt, Homo Sapiens; identical to SEQ ID NO: 87515

SEQ ID NO: 715588 - RNA, 64 nt, Homo Sapiens; identical to SEQ ID NO: 87516

SEQ ID NO: 715589 - RNA, 64 nt, Homo Sapiens; identical to SEQ ID NO: 87517

SEQ ID NO: 715590 - RNA, 64 nt, Homo Sapiens; identical to SEQ ID NO: 87518

SEQ ID NO: 715591 - RNA, 64 nt, Homo Sapiens; identical to SEQ ID NO: 87519

SEQ ID NO: 715592 - RNA, 64 nt, Homo Sapiens; identical to SEQ ID NO: 87520

SEQ ID NO: 715593 - RNA, 64 nt, Homo Sapiens; identical to SEQ ID NO: 87521

SEQ ID NO: 715594 - RNA, 64 nt, Homo Sapiens; identical to SEQ ID NO: 87522

SEQ ID NO: 715595 - RNA, 64 nt, Homo Sapiens; identical to SEQ ID NO: 87523

SEQ ID NO: 715596 - RNA, 64 nt, Homo Sapiens; identical to SEQ ID NO: 87524

SEQ ID NO: 715597 - RNA, 64 nt, Homo Sapiens; identical to SEQ ID NO: 87525

SEQ ID NO: 715598 - RNA, 64 nt, Homo Sapiens; identical to SEQ ID NO: 87526

SEQ ID NO: 715599 - RNA, 64 nt, Homo Sapiens; identical to SEQ ID NO: 87527

SEQ ID NO: 715600 - RNA, 64 nt, Homo Sapiens; identical to SEQ ID NO: 87528

SEQ ID NO: 715601 - RNA, 64 nt, Homo Sapiens; identical to SEQ ID NO: 87529

SEQ ID NO: 715602 - RNA, 64 nt, Homo Sapiens; identical to SEQ ID NO: 87530

SEQ ID NO: 715603 - RNA, 64 nt, Homo Sapiens; identical to SEQ ID NO: 87531

SEQ ID NO: 715604 - RNA, 64 nt, Homo Sapiens; identical to SEQ ID NO: 87532

SEQ ID NO: 715605 - RNA, 64 nt, Homo Sapiens; identical to SEQ ID NO: 87533

SEQ ID NO: 715606 - RNA, 64 nt, Homo Sapiens; identical to SEQ ID NO: 87534

SEQ ID NO: 715607 - RNA, 64 nt, Homo Sapiens; identical to SEQ ID NO: 87535

SEQ ID NO: 715608 - RNA, 64 nt, Homo Sapiens; identical to SEQ ID NO: 87536

SEQ ID NO: 715609 - RNA, 61 nt, Homo Sapiens; identical to SEQ ID NO: 292803

SEQ ID NO: 715610 - RNA, 64 nt, Homo Sapiens; identical to SEQ ID NO: 292804

SEQ ID NO: 715611 - RNA, 64 nt, Homo Sapiens; identical to SEQ ID NO: 292805

SEQ ID NO: 715612 - RNA, 64 nt, Homo Sapiens; identical to SEQ ID NO: 292806

SEQ ID NO: 715613 - RNA, 64 nt, Homo Sapiens; identical to SEQ ID NO: 292807

SEQ ID NO: 715614 - RNA, 64 nt, Homo Sapiens; identical to SEQ ID NO: 292808

SEQ ID NO: 715615 - RNA, 64 nt, Homo Sapiens; identical to SEQ ID NO: 292809

SEQ ID NO: 715616 - RNA, 64 nt, Homo Sapiens; identical to SEQ ID NO: 292810

SEQ ID NO: 715617 - RNA, 64 nt, Homo Sapiens; identical to SEQ ID NO: 292811

SEQ ID NO: 715618 - RNA, 64 nt, Homo Sapiens; identical to SEQ ID NO: 292812

SEQ ID NO: 715619 - RNA, 64 nt, Homo Sapiens; identical to SEQ ID NO: 292813

SEQ ID NO: 715620 - RNA, 64 nt, Homo Sapiens; identical to SEQ ID NO: 292814

SEQ ID NO: 715621 - RNA, 64 nt, Homo Sapiens; identical to SEQ ID NO: 292815

SEQ ID NO: 715622 - RNA, 64 nt, Homo Sapiens; identical to SEQ ID NO: 292816

SEQ ID NO: 715623 - RNA, 64 nt, Homo Sapiens; identical to SEQ ID NO: 292817

SEQ ID NO: 715624 - RNA, 64 nt, Homo Sapiens; identical to SEQ ID NO: 292818

SEQ ID NO: 715625 - RNA, 64 nt, Homo Sapiens; identical to SEQ ID NO: 87480

SEQ ID NO: 715626 - RNA, 64 nt, Homo Sapiens; identical to SEQ ID NO: 87481

SEQ ID NO: 715627 - RNA, 64 nt, Homo Sapiens; identical to SEQ ID NO: 87482

SEQ ID NO: 715628 - RNA, 64 nt, Homo Sapiens; identical to SEQ ID NO: 87483

SEQ ID NO: 715629 - RNA, 64 nt, Homo Sapiens; identical to SEQ ID NO: 87484

SEQ ID NO: 715630 - RNA, 64 nt, Homo Sapiens; identical to SEQ ID NO: 87485

SEQ ID NO: 715631 - RNA, 64 nt, Homo Sapiens; identical to SEQ ID NO: 87486

SEQ ID NO: 715632 - RNA, 64 nt, Homo Sapiens; identical to SEQ ID NO: 87487

SEQ ID NO: 715633 - RNA, 64 nt, Homo Sapiens; identical to SEQ ID NO: 87488

SEQ ID NO: 715634 - RNA, 64 nt, Homo Sapiens; identical to SEQ ID NO: 87489

SEQ ID NO: 715635 - RNA, 64 nt, Homo Sapiens; identical to SEQ ID NO: 87490

SEQ ID NO: 715636 - RNA, 64 nt, Homo Sapiens; identical to SEQ ID NO: 87491

SEQ ID NO: 715637 - RNA, 64 nt, Homo Sapiens; identical to SEQ ID NO: 87492

SEQ ID NO: 715638 - RNA, 64 nt, Homo Sapiens; identical to SEQ ID NO: 87493

SEQ ID NO: 715639 - RNA, 64 nt, Homo Sapiens; identical to SEQ ID NO: 87494

SEQ ID NO: 715640 - RNA, 64 nt, Homo Sapiens; identical to SEQ ID NO: 87495

SEQ ID NO: 715641 - RNA, 64 nt, Homo Sapiens; identical to SEQ ID NO: 87496

SEQ ID NO: 715642 - RNA, 64 nt, Homo Sapiens; identical to SEQ ID NO: 87497

SEQ ID NO: 715643 - RNA, 64 nt, Homo Sapiens; identical to SEQ ID NO: 87498

SEQ ID NO: 715644 - RNA, 64 nt, Homo Sapiens; identical to SEQ ID NO: 87499

SEQ ID NO: 715645 - RNA, 64 nt, Homo Sapiens; identical to SEQ ID NO: 87500

SEQ ID NO: 715646 - RNA, 64 nt, Homo Sapiens; identical to SEQ ID NO: 87501

SEQ ID NO: 715647 - RNA, 64 nt, Homo Sapiens; identical to SEQ ID NO: 87502

SEQ ID NO: 715648 - RNA, 64 nt, Homo Sapiens; identical to SEQ ID NO: 87503

SEQ ID NO: 715649 - RNA, 64 nt, Homo Sapiens; identical to SEQ ID NO: 87504

SEQ ID NO: 715650 - RNA, 64 nt, Homo Sapiens; identical to SEQ ID NO: 87505

SEQ ID NO: 715651 - RNA, 64 nt, Homo Sapiens; identical to SEQ ID NO: 87506

SEQ ID NO: 715652 - RNA, 64 nt, Homo Sapiens; identical to SEQ ID NO: 87507

SEQ ID NO: 715653 - RNA, 64 nt, Homo Sapiens; identical to SEQ ID NO: 87508

SEQ ID NO: 715654 - RNA, 64 nt, Homo Sapiens; identical to SEQ ID NO: 87509

SEQ ID NO: 715655 - RNA, 64 nt, Homo Sapiens; identical to SEQ ID NO: 87510

SEQ ID NO: 715656 - RNA, 64 nt, Homo Sapiens; identical to SEQ ID NO: 87511

SEQ ID NO: 715657 - RNA, 64 nt, Homo Sapiens; identical to SEQ ID NO: 87512

SEQ ID NO: 715658 - RNA, 64 nt, Homo Sapiens; identical to SEQ ID NO: 87513

SEQ ID NO: 715659 - RNA, 64 nt, Homo Sapiens; identical to SEQ ID NO: 87514

SEQ ID NO: 715660 - RNA, 64 nt, Homo Sapiens; identical to SEQ ID NO: 87515

SEQ ID NO: 715661 - RNA, 64 nt, Homo Sapiens; identical to SEQ ID NO: 87516

SEQ ID NO: 715662 - RNA, 64 nt, Homo Sapiens; identical to SEQ ID NO: 87517

SEQ ID NO: 715663 - RNA, 64 nt, Homo Sapiens; identical to SEQ ID NO: 87518

SEQ ID NO: 715664 - RNA, 64 nt, Homo Sapiens; identical to SEQ ID NO: 87519

SEQ ID NO: 715665 - RNA, 64 nt, Homo Sapiens; identical to SEQ ID NO: 87520

SEQ ID NO: 715666 - RNA, 64 nt, Homo Sapiens; identical to SEQ ID NO: 87521

SEQ ID NO: 715667 - RNA, 64 nt, Homo Sapiens; identical to SEQ ID NO: 87522

SEQ ID NO: 715668 - RNA, 64 nt, Homo Sapiens; identical to SEQ ID NO: 87523

SEQ ID NO: 715669 - RNA, 64 nt, Homo Sapiens; identical to SEQ ID NO: 87524

SEQ ID NO: 715670 - RNA, 64 nt, Homo Sapiens; identical to SEQ ID NO: 87525

SEQ ID NO: 715671 - RNA, 64 nt, Homo Sapiens; identical to SEQ ID NO: 87526

SEQ ID NO: 715672 - RNA, 64 nt, Homo Sapiens; identical to SEQ ID NO: 87527

SEQ ID NO: 715673 - RNA, 64 nt, Homo Sapiens; identical to SEQ ID NO: 87528

SEQ ID NO: 715674 - RNA, 64 nt, Homo Sapiens; identical to SEQ ID NO: 87529

SEQ ID NO: 715675 - RNA, 64 nt, Homo Sapiens; identical to SEQ ID NO: 87530

SEQ ID NO: 715676 - RNA, 64 nt, Homo Sapiens; identical to SEQ ID NO: 87531

SEQ ID NO: 715677 - RNA, 64 nt, Homo Sapiens; identical to SEQ ID NO: 87532

SEQ ID NO: 715678 - RNA, 64 nt, Homo Sapiens; identical to SEQ ID NO: 87533

SEQ ID NO: 715679 - RNA, 64 nt, Homo Sapiens; identical to SEQ ID NO: 87534

SEQ ID NO: 715680 - RNA, 64 nt, Homo Sapiens; identical to SEQ ID NO: 87535

SEQ ID NO: 715681 - RNA, 64 nt, Homo Sapiens; identical to SEQ ID NO: 87536

SEQ ID NO: 715682 - RNA, 61 nt, Homo Sapiens; identical to SEQ ID NO: 292803

SEQ ID NO: 715683 - RNA, 64 nt, Homo Sapiens; identical to SEQ ID NO: 292804

SEQ ID NO: 715684 - RNA, 64 nt, Homo Sapiens; identical to SEQ ID NO: 292805

SEQ ID NO: 715685 - RNA, 64 nt, Homo Sapiens; identical to SEQ ID NO: 292806

SEQ ID NO: 715686 - RNA, 64 nt, Homo Sapiens; identical to SEQ ID NO: 292807

SEQ ID NO: 715687 - RNA, 64 nt, Homo Sapiens; identical to SEQ ID NO: 292808

SEQ ID NO: 715688 - RNA, 64 nt, Homo Sapiens; identical to SEQ ID NO: 292809

SEQ ID NO: 715689 - RNA, 64 nt, Homo Sapiens; identical to SEQ ID NO: 292810

SEQ ID NO: 715690 - RNA, 64 nt, Homo Sapiens; identical to SEQ ID NO: 292811

SEQ ID NO: 715691 - RNA, 64 nt, Homo Sapiens; identical to SEQ ID NO: 292812

SEQ ID NO: 715692 - RNA, 64 nt, Homo Sapiens; identical to SEQ ID NO: 292813

SEQ ID NO: 715693 - RNA, 64 nt, Homo Sapiens; identical to SEQ ID NO: 292814

SEQ ID NO: 715694 - RNA, 64 nt, Homo Sapiens; identical to SEQ ID NO: 292815

SEQ ID NO: 715695 - RNA, 64 nt, Homo Sapiens; identical to SEQ ID NO: 292816

SEQ ID NO: 715696 - RNA, 64 nt, Homo Sapiens; identical to SEQ ID NO: 292817

SEQ ID NO: 715697 - RNA, 64 nt, Homo Sapiens; identical to SEQ ID NO: 292818

SEQ ID NO: 715698 - RNA, 64 nt, Homo Sapiens; identical to SEQ ID NO: 56427

SEQ ID NO: 715699 - RNA, 64 nt, Homo Sapiens; identical to SEQ ID NO: 56428

SEQ ID NO: 715700 - RNA, 64 nt, Homo Sapiens; identical to SEQ ID NO: 56429

SEQ ID NO: 715701 - RNA, 64 nt, Homo Sapiens; identical to SEQ ID NO: 56430

SEQ ID NO: 715702 - RNA, 64 nt, Homo Sapiens; identical to SEQ ID NO: 56431

SEQ ID NO: 715703 - RNA, 64 nt, Homo Sapiens; identical to SEQ ID NO: 56432

SEQ ID NO: 715704 - RNA, 64 nt, Homo Sapiens; identical to SEQ ID NO: 56433

SEQ ID NO: 715705 - RNA, 64 nt, Homo Sapiens; identical to SEQ ID NO: 56434

SEQ ID NO: 715706 - RNA, 64 nt, Homo Sapiens; identical to SEQ ID NO: 56435

SEQ ID NO: 715707 - RNA, 64 nt, Homo Sapiens; identical to SEQ ID NO: 56436

SEQ ID NO: 715708 - RNA, 57 nt, Homo Sapiens; identical to SEQ ID NO: 56437

SEQ ID NO: 715709 - RNA, 64 nt, Homo Sapiens; identical to SEQ ID NO: 56438

SEQ ID NO: 715710 - RNA, 62 nt, Homo Sapiens; identical to SEQ ID NO: 68749

SEQ ID NO: 715711 - RNA, 64 nt, Homo Sapiens; identical to SEQ ID NO: 68750

SEQ ID NO: 715712 - RNA, 64 nt, Homo Sapiens; identical to SEQ ID NO: 68751

SEQ ID NO: 715713 - RNA, 64 nt, Homo Sapiens; identical to SEQ ID NO: 68752

SEQ ID NO: 715714 - RNA, 64 nt, Homo Sapiens; identical to SEQ ID NO: 68753

SEQ ID NO: 715715 - RNA, 64 nt, Homo Sapiens; identical to SEQ ID NO: 68754

SEQ ID NO: 715716 - RNA, 64 nt, Homo Sapiens; identical to SEQ ID NO: 68755

SEQ ID NO: 715717 - RNA, 64 nt, Homo Sapiens; identical to SEQ ID NO: 68756

SEQ ID NO: 715718 - RNA, 64 nt, Homo Sapiens; identical to SEQ ID NO: 68757

SEQ ID NO: 715719 - RNA, 64 nt, Homo Sapiens; identical to SEQ ID NO: 48749

SEQ ID NO: 715720 - RNA, 64 nt, Homo Sapiens; identical to SEQ ID NO: 48750

SEQ ID NO: 715721 - RNA, 64 nt, Homo Sapiens; identical to SEQ ID NO: 48751

SEQ ID NO: 715722 - RNA, 64 nt, Homo Sapiens; identical to SEQ ID NO: 48752

SEQ ID NO: 715723 - RNA, 64 nt, Homo Sapiens; identical to SEQ ID NO: 48753

SEQ ID NO: 715724 - RNA, 64 nt, Homo Sapiens; identical to SEQ ID NO: 48754

SEQ ID NO: 715725 - RNA, 64 nt, Homo Sapiens; identical to SEQ ID NO: 48755

SEQ ID NO: 715726 - RNA, 64 nt, Homo Sapiens; identical to SEQ ID NO: 48756

SEQ ID NO: 715727 - RNA, 64 nt, Homo Sapiens; identical to SEQ ID NO: 48757

SEQ ID NO: 715728 - RNA, 64 nt, Homo Sapiens; identical to SEQ ID NO: 48758

SEQ ID NO: 715729 - RNA, 64 nt, Homo Sapiens
cgccaggaggccacgggccacgggaagaaccaagcggugccagccacgagacgucaccaagaaa

SEQ ID NO: 715730 - RNA, 64 nt, Homo Sapiens
caccuacacaggagucuucagacccagagaaggacggugccaagggccccaggggcagcaaggc

SEQ ID NO: 715731 - RNA, 64 nt, Homo Sapiens
acacucagagcuagucaguacaugaacaguggugcggugccagucuguguccguugugaucaca

SEQ ID NO: 715732 - RNA, 64 nt, Homo Sapiens
gacuguacaagcagaguacaacuacccgccuccccggugccagggcgccuguuggguuuggucc

SEQ ID NO: 715733 - RNA, 64 nt, Homo Sapiens
uccagaugaugauucagaagcuaauuuuaaaaaacggugccagguaccacaacaguaacagaac

SEQ ID NO: 715734 - RNA, 64 nt, Homo Sapiens
ugaaaaugcgccuccuccucggagacagacgcaucggugccaccuaguggcuggugggaguaac

SEQ ID NO: 715735 - RNA, 64 nt, Homo Sapiens
ccuuggaguuaggagccacccugggagguugugccggugccaugcuccucccugugucuuguau

SEQ ID NO: 715736 - RNA, 64 nt, Homo Sapiens
guggugggcagaucugaccacuccagggaagccucggugccagacccaacccagguuuaugcgu

SEQ ID NO: 715737 - RNA, 64 nt, Homo Sapiens
ucuuaguucuaaagaaucuuggguuauuuuguagcggugccaguauuucaguagaugggauuuc

SEQ ID NO: 715738 - RNA, 64 nt, Homo Sapiens
cccgcucugggcaccaccugggcaggcaugcacccggugccagccaccuccugcuggcuaccgg

SEQ ID NO: 715739 - RNA, 64 nt, Homo Sapiens
cacccaaaggagcuccgccuggacuuuggcucagcggugccacugaggacccgugugacucgcc

SEQ ID NO: 715740 - RNA, 64 nt, Homo Sapiens
uuuuuuaaagagauggaggcuggcucuguuggugcggugccaugaucauaguucacuauaaccu

SEQ ID NO: 715741 - RNA, 64 nt, Homo Sapiens
cugcagagugccuucaaaacucagcuguuccagccggugccaaccugugaacuucccaccauau

SEQ ID NO: 715742 - RNA, 64 nt, Homo Sapiens
uggaagcccggugucaugaaaugaaaccaaaccucggugccaucgcagaguauaaaaagaaggu

SEQ ID NO: 715743 - RNA, 64 nt, Homo Sapiens
ggaccccccggagauccugagccaucaugcgagucggugccaggcugggaaaaggagguacaca

SEQ ID NO: 715744 - RNA, 64 nt, Homo Sapiens
uccacacucaccucaccucugccggaauccugcacggugccaccccacggccgaauagccguga

SEQ ID NO: 715745 - RNA, 64 nt, Homo Sapiens
auucauuuucuaacaccauggaaauucuuaaucacggugccaaaguaaagguuaaacuugaaaa

SEQ ID NO: 715746 - RNA, 64 nt, Homo Sapiens
uuuucuggguguccaaaggaagcuggugguuucacggugccaggguagcauuucauucuucucu

SEQ ID NO: 715747 - RNA, 64 nt, Homo Sapiens
ggaugagaaagccugaggugccuggcaugcccaccggugccacucugcagccuccaccccuggc

SEQ ID NO: 715748 - RNA, 64 nt, Homo Sapiens
cagucauggaucuggguagucaccgauuucauuacggugccacguugaugucauuggccucucc

SEQ ID NO: 715749 - RNA, 64 nt, Homo Sapiens
acacuugcucaguucaggcagcucugcuggagggcggugccaugccuaagccugugcacaugca

SEQ ID NO: 715750 - RNA, 64 nt, Homo Sapiens
guuuccugacagccgcugcaauacacagucuugacggugccauccggguacucccuccucuuga

SEQ ID NO: 715751 - RNA, 64 nt, Homo Sapiens
cuaccacaagaaccugcgucacgaggggccggggcggugccaggaccgggugagcaacaggagg

SEQ ID NO: 715752 - RNA, 64 nt, Homo Sapiens
gccgcccgcguccucgccagccagaacccucggacggugccaggggcugugcccaccacccuuc

SEQ ID NO: 715753 - RNA, 64 nt, Homo Sapiens
cuccuucuucuguuccauuucaguucaguuucagcggugccaaccucuuugcguuuccuuuuug

SEQ ID NO: 715754 - RNA, 64 nt, Homo Sapiens
aaagucacuggacaaagaacauuuagcugguuaacggugccagaacuaacgacacauacaugaa

SEQ ID NO: 715755 - RNA, 64 nt, Homo Sapiens
cugcggugcuuggugugguucuugcaucuggucccggugccacaccccauggcaggaacagcca

SEQ ID NO: 715756 - RNA, 64 nt, Homo Sapiens
cgaccaagauugacuaguuugagauggguuuguucggugccagcugcaccuggggacccagagc

SEQ ID NO: 715757 - RNA, 64 nt, Homo Sapiens
uucaggcacgugcacccggcuacccagcuggguacggugccacguuccgugcucgagccguuuu

SEQ ID NO: 715758 - RNA, 64 nt, Homo Sapiens
ucaaaaaaaaaauugguguucaugacucuguggucggugccagaggaaaauaggaacgacucua

SEQ ID NO: 715759 - RNA, 64 nt, Homo Sapiens
gagcaucauuccuuucuaucugcugccagagccacggugccauuuacuccaaggacucacuuuc

SEQ ID NO: 715760 - RNA, 64 nt, Homo Sapiens
agggaggagccuuaaguuccgcaguuccucgccucggugccaucaggaaggagacagacagcug

SEQ ID NO: 715761 - RNA, 64 nt, Homo Sapiens
uggacaggcgggcucggaggcuacccgcuguggccggugccagcugcccuugcaggguggguga

SEQ ID NO: 715762 - RNA, 64 nt, Homo Sapiens
uucugcacacucggccaguucccucuccaauguccggugccaucuuuccugaccuuuguuucuu

SEQ ID NO: 715763 - RNA, 64 nt, Homo Sapiens
ccugacuccgccgccccucucccggaccuaggaccggugccagcaggguuccgaaggcgccauc

SEQ ID NO: 715764 - RNA, 64 nt, Homo Sapiens
augcggaccggggggaggcacugagacugccucacggugccaccaagaacagcaugaggacuug

SEQ ID NO: 715765 - RNA, 64 nt, Homo Sapiens
aaggccccaccccugccccugggcacguccugugcggugccaccgcagcuggagaggaagccug

SEQ ID NO: 715766 - RNA, 64 nt, Homo Sapiens
gugucuuuggaggugcugcuuaauaccaaacaugcggugccaugaagggacccuuuggggguug

SEQ ID NO: 715767 - RNA, 64 nt, Homo Sapiens
ccccgggcacggccccagcuccguggggcucucacggugccaaucacaagacccaggguugugc

SEQ ID NO: 715768 - RNA, 64 nt, Homo Sapiens
gcugugcugaggaggccgggucacaagauucccucggugccacagauguugggaggagaaacca

SEQ ID NO: 715769 - RNA, 64 nt, Homo Sapiens
ccugaacacggcuggccacucuccauacagaaaacggugccauccuaaaccucgugcuugugaa

SEQ ID NO: 715770 - RNA, 64 nt, Homo Sapiens
ugaggcugaggcaugcagcagugagggagguggacggugccagcuccuguggaaggcagaggca

SEQ ID NO: 715771 - RNA, 64 nt, Homo Sapiens
cggccgugacaaauccuaguuagucaaaacaaaucggugccaccugaaaaaaaaguuuguugua

SEQ ID NO: 715772 - RNA, 64 nt, Homo Sapiens
cuagcaaugaagguugggaagguuguucccuucccggugccagguccagauuucccuccaugau

SEQ ID NO: 715773 - RNA, 64 nt, Homo Sapiens
ccucaggucagggagaaugucucagagagggcagcggugccaggugaaccgcucuggucugcuc

SEQ ID NO: 715774 - RNA, 62 nt, Homo Sapiens
cacugcacuggggccagcugcagcagccucggcggugccaccucaaugaagaugagccguaa

SEQ ID NO: 715775 - RNA, 64 nt, Homo Sapiens
uuaauccaucuaagugacauuuuugaaauuccagcggugccacccaaucaugcccagcuucugu

SEQ ID NO: 715776 - RNA, 64 nt, Homo Sapiens
gcaagggcuaguugagacaucagagugagccaggcggugccaaacccucugcaacuacaaauag

SEQ ID NO: 715777 - RNA, 64 nt, Homo Sapiens
guuugggggcuuggggggcuguaccuaagaggggcggugccauuauucacaucucuucuugcau

SEQ ID NO: 715778 - RNA, 64 nt, Homo Sapiens
gcuguauuuauuucaguuguuaugccucugagaucggugccacggauguugcacuuggcuggcu

SEQ ID NO: 715779 - RNA, 64 nt, Homo Sapiens
acuccaaacaaguuccccgggcucgguuagcccacggugccaaauaagaauaugucagaagagu

SEQ ID NO: 715780 - RNA, 64 nt, Homo Sapiens
aggggacaggacagaaagccugcacugaggggugcggugccaacagggaaacucuucaccuccc

SEQ ID NO: 715781 - RNA, 64 nt, Homo Sapiens
gcugacaauggugaugaugggaaaaccugccuaacggugccacuguacucauaugggauuccca

SEQ ID NO: 715782 - RNA, 64 nt, Homo Sapiens
ccuguuucuuccugugacugcccccuucuggccacggugccauaccacucucugugaauaccua

SEQ ID NO: 715783 - RNA, 64 nt, Homo Sapiens
ugaagaagaagaaguugugaggacagcugccgcccggugccaccucgugguagacuaugacggu

SEQ ID NO: 715784 - RNA, 64 nt, Homo Sapiens
aaugagcaguguacuguggcuguuucaucuguuccggugccaaggguaugugcaggauacagug

SEQ ID NO: 715785 - RNA, 64 nt, Homo Sapiens
gccccccugaggacuagggcggccgaggccacugcggugccaguggggcucaucgagggucuca

SEQ ID NO: 715786 - RNA, 64 nt, Homo Sapiens
ucuuguguaugcagggcuauauugaaaaccaccacggugccaucgagcuccccuguuccccuuc

SEQ ID NO: 715787 - RNA, 64 nt, Homo Sapiens
gaacaccugugccucccugcucggccagcggccacggugccagagucaccaccuugccggccac

SEQ ID NO: 715788 - RNA, 64 nt, Homo Sapiens
uguauuaagccuuaacacuuuucuuaagugcauucggugccaacauuuuuuagagcuguaccaa

SEQ ID NO: 715789 - RNA, 64 nt, Homo Sapiens
aagagcagagaaaucaucaccaccuugggccccacggugccacgggcucaggcagcacaguagg

SEQ ID NO: 715790 - RNA, 64 nt, Homo Sapiens
accugcaucuggggcccauacugguuggcucccgcggugccaugucugcagugugccccccagc

SEQ ID NO: 715791 - RNA, 64 nt, Homo Sapiens
cccacccauagggcuggcucucucggcgguagggcggugccauccgggggugcagcuucaacuc

SEQ ID NO: 715792 - RNA, 64 nt, Homo Sapiens
uuggcuuccacaaauuccagugugccggcagcaccggugccaucagcucagaaccacggggguc

SEQ ID NO: 715793 - RNA, 64 nt, Homo Sapiens
agauggcacuuggugccuagugaaaguggacccgcggugccacuagucuuugguuggaguguug

SEQ ID NO: 715794 - RNA, 64 nt, Homo Sapiens
ccggcucugaagccaagggccuaauguuuacaaacggugccagcauccccagacaucaccaggu

SEQ ID NO: 715795 - RNA, 64 nt, Homo Sapiens
uuaggaagggugaguggcugguuccagggugggccggugccagcuccgggguggacugaacagc

SEQ ID NO: 715796 - RNA, 64 nt, Homo Sapiens
cacauugacauuuccauuacacacagcacugcugcggugccagggaccuagcgcaggacuuuug

SEQ ID NO: 715797 - RNA, 64 nt, Homo Sapiens
ucauaaagcuuccgugacuucuaaaccaucaggucggugccauaagagaugcucaaaaaagcau

SEQ ID NO: 715798 - RNA, 64 nt, Homo Sapiens
caguacuccagggaugggagagauucugucuuaccggugccaguauggaguaauggauucaaag

SEQ ID NO: 715799 - RNA, 64 nt, Homo Sapiens
cucccucccccaagcucagaacagcugcuuuucucggugccaacgagaggaccccucucuuaau

SEQ ID NO: 715800 - RNA, 64 nt, Homo Sapiens
uuccauauccgggugcucaacacggcucugugcccggugccauccggggccugcaggccagucc

SEQ ID NO: 715801 - RNA, 64 nt, Homo Sapiens
ucuuuccuugaaggggcgggcaccaggcuagguccggugccaauaaauccuuguggaaucugac

SEQ ID NO: 715802 - RNA, 64 nt, Homo Sapiens
uccagacaagacccacaaauccccaaggaggggacggugccacuuggcaaaaggagccucacac

SEQ ID NO: 715803 - RNA, 64 nt, Homo Sapiens
cccagugucccccaggccgugcccccccaccacgcggugccaggggccaucaucugcugcuggg

SEQ ID NO: 715804 - RNA, 64 nt, Homo Sapiens
agccauccccgccaacagcccgagggcagccucucggugccaagaagggcaugaagcgaggacc

SEQ ID NO: 715805 - RNA, 64 nt, Homo Sapiens
acgccggggcccggggcaacccaggagcgagagacggugccagaggcagugccagccacgggaa

SEQ ID NO: 715806 - RNA, 64 nt, Homo Sapiens
augagagcaggcacagaagggugcggccacaagccggugccagcguggacauagcuuccaagga

SEQ ID NO: 715807 - RNA, 63 nt, Homo Sapiens
ucgacuuucuuuccaacugagggcgcgccggcgcggugccagcgccgucugcccggccccgcc

SEQ ID NO: 715808 - RNA, 64 nt, Homo Sapiens
uuccugucacucccggggcugucccuguacuacacggugccauggagccggggagagcggggaa

SEQ ID NO: 715809 - RNA, 64 nt, Homo Sapiens
auuccgccgaggggaagccggugcgggccgcgcacggugccaggcaggacugccagggaucgga

SEQ ID NO: 715810 - RNA, 64 nt, Homo Sapiens
cagccucugagucccguggggccccggcucccaccggugccaaacccagccccugcggccguca

SEQ ID NO: 715811 - RNA, 64 nt, Homo Sapiens
agugccccgucuacagcuccgacacucccguuuucggugccaucagcgacagagcaguugagag

SEQ ID NO: 715812 - RNA, 64 nt, Homo Sapiens
gguucagggagaacagcugcgcauggagaggccacggugccagacagcuuggagauccaggggc

SEQ ID NO: 715813 - RNA, 64 nt, Homo Sapiens
aaauugcucuuuacuuuagcucacuuugauagaguuaauccauaaggcccauuuuucaugugcu

SEQ ID NO: 715814 - RNA, 64 nt, Homo Sapiens
uuauuacuguccugagccauguuguacagaaugcuuaauccaucgguuugauaaugcuuuuuaa

SEQ ID NO: 715815 - RNA, 64 nt, Homo Sapiens
uuuuuuucagguuagugauuuuuuuguauacaauuuaauccaaauguuaugacauucagaaauc

SEQ ID NO: 715816 - RNA, 64 nt, Homo Sapiens
cauggcuaaaucaaagcugccccugagaagagacuuaauccaagccugauuguacuaguggcau

SEQ ID NO: 715817 - RNA, 64 nt, Homo Sapiens
uacacuguauaguaucuugcacacuagcuuuuuauuaauccauggcaaugaguauaucaucagu

SEQ ID NO: 715818 - RNA, 64 nt, Homo Sapiens
ccaaguuuguauauaacugaaacuuuccacagcuuuaauccacgccuagcuggguguucaucau

SEQ ID NO: 715819 - RNA, 64 nt, Homo Sapiens
guggcuucuggcaccuggcgggcuggugaccuuuuuaauccaggccccaucagcaucccacgau

SEQ ID NO: 715820 - RNA, 64 nt, Homo Sapiens
aaauccacccagcccacuaacugaggagcuaguguuaauccagagaaccccccgcaaugugcuu

SEQ ID NO: 715821 - RNA, 64 nt, Homo Sapiens
aaacuucugguguggccagguuuuagguaacuuuuuaauccaaaacuauugugccauaaauguu

SEQ ID NO: 715822 - RNA, 64 nt, Homo Sapiens
uuaaaugcuuaugauauuuaaucauaaaaagggauuaauccaaccauuuucuaguaaagccaga

SEQ ID NO: 715823 - RNA, 64 nt, Homo Sapiens
uguaucaguucuuuguuaggcaugaacgucuuuauuaauccaucauucuuuucuucauucaaca

SEQ ID NO: 715824 - RNA, 64 nt, Homo Sapiens
gggauuugggggugaauuugucaauaucuggauuuuaauccagacaucucugcuaacaagccuu

SEQ ID NO: 715825 - RNA, 64 nt, Homo Sapiens
ucugcaaaaaugaccuauaacauuuuauuuuuucuuaauccaguuuuuacuagaaaauguauua

SEQ ID NO: 715826 - RNA, 64 nt, Homo Sapiens
ucuugauuaaagugauugaaaaauacuuuuguacuuaauccauuaguugauuccucaaguuaug

SEQ ID NO: 715827 - RNA, 64 nt, Homo Sapiens; identical to SEQ ID NO: 686451

SEQ ID NO: 715828 - RNA, 64 nt, Homo Sapiens; identical to SEQ ID NO: 686452

SEQ ID NO: 715829 - RNA, 64 nt, Homo Sapiens; identical to SEQ ID NO: 686453

SEQ ID NO: 715830 - RNA, 64 nt, Homo Sapiens; identical to SEQ ID NO: 686454

SEQ ID NO: 715831 - RNA, 64 nt, Homo Sapiens; identical to SEQ ID NO: 686455

SEQ ID NO: 715832 - RNA, 64 nt, Homo Sapiens; identical to SEQ ID NO: 686456

SEQ ID NO: 715833 - RNA, 64 nt, Homo Sapiens; identical to SEQ ID NO: 686457

SEQ ID NO: 715834 - RNA, 64 nt, Homo Sapiens; identical to SEQ ID NO: 686458

SEQ ID NO: 715835 - RNA, 64 nt, Homo Sapiens; identical to SEQ ID NO: 686459

SEQ ID NO: 715836 - RNA, 64 nt, Homo Sapiens; identical to SEQ ID NO: 686460

SEQ ID NO: 715837 - RNA, 64 nt, Homo Sapiens; identical to SEQ ID NO: 686461

SEQ ID NO: 715838 - RNA, 64 nt, Homo Sapiens; identical to SEQ ID NO: 686462

SEQ ID NO: 715839 - RNA, 64 nt, Homo Sapiens; identical to SEQ ID NO: 686463

SEQ ID NO: 715840 - RNA, 64 nt, Homo Sapiens; identical to SEQ ID NO: 686464

SEQ ID NO: 715841 - RNA, 64 nt, Homo Sapiens; identical to SEQ ID NO: 686465

SEQ ID NO: 715842 - RNA, 64 nt, Homo Sapiens; identical to SEQ ID NO: 686466

SEQ ID NO: 715843 - RNA, 64 nt, Homo Sapiens; identical to SEQ ID NO: 574523

SEQ ID NO: 715844 - RNA, 64 nt, Homo Sapiens; identical to SEQ ID NO: 574524

SEQ ID NO: 715845 - RNA, 64 nt, Homo Sapiens; identical to SEQ ID NO: 574525

SEQ ID NO: 715846 - RNA, 64 nt, Homo Sapiens; identical to SEQ ID NO: 574526

SEQ ID NO: 715847 - RNA, 64 nt, Homo Sapiens; identical to SEQ ID NO: 574527

SEQ ID NO: 715848 - RNA, 64 nt, Homo Sapiens; identical to SEQ ID NO: 574528

SEQ ID NO: 715849 - RNA, 64 nt, Homo Sapiens; identical to SEQ ID NO: 574529

SEQ ID NO: 715850 - RNA, 64 nt, Homo Sapiens; identical to SEQ ID NO: 574530

SEQ ID NO: 715851 - RNA, 64 nt, Homo Sapiens; identical to SEQ ID NO: 574531

SEQ ID NO: 715852 - RNA, 64 nt, Homo Sapiens; identical to SEQ ID NO: 574532

SEQ ID NO: 715853 - RNA, 64 nt, Homo Sapiens; identical to SEQ ID NO: 574533

SEQ ID NO: 715854 - RNA, 64 nt, Homo Sapiens; identical to SEQ ID NO: 574534

SEQ ID NO: 715855 - RNA, 64 nt, Homo Sapiens; identical to SEQ ID NO: 574535

SEQ ID NO: 715856 - RNA, 64 nt, Homo Sapiens; identical to SEQ ID NO: 574536

SEQ ID NO: 715857 - RNA, 64 nt, Homo Sapiens; identical to SEQ ID NO: 574537

SEQ ID NO: 715858 - RNA, 64 nt, Homo Sapiens; identical to SEQ ID NO: 574538

SEQ ID NO: 715859 - RNA, 64 nt, Homo Sapiens; identical to SEQ ID NO: 574539

SEQ ID NO: 715860 - RNA, 64 nt, Homo Sapiens; identical to SEQ ID NO: 574540

SEQ ID NO: 715861 - RNA, 64 nt, Homo Sapiens; identical to SEQ ID NO: 574541

SEQ ID NO: 715862 - RNA, 64 nt, Homo Sapiens; identical to SEQ ID NO: 574542

SEQ ID NO: 715863 - RNA, 64 nt, Homo Sapiens; identical to SEQ ID NO: 420267

SEQ ID NO: 715864 - RNA, 64 nt, Homo Sapiens; identical to SEQ ID NO: 420268

SEQ ID NO: 715865 - RNA, 64 nt, Homo Sapiens; identical to SEQ ID NO: 420269

SEQ ID NO: 715866 - RNA, 64 nt, Homo Sapiens; identical to SEQ ID NO: 420270

SEQ ID NO: 715867 - RNA, 64 nt, Homo Sapiens; identical to SEQ ID NO: 420271

SEQ ID NO: 715868 - RNA, 64 nt, Homo Sapiens; identical to SEQ ID NO: 420272

SEQ ID NO: 715869 - RNA, 64 nt, Homo Sapiens; identical to SEQ ID NO: 420273

SEQ ID NO: 715870 - RNA, 63 nt, Homo Sapiens; identical to SEQ ID NO: 420274

SEQ ID NO: 715871 - RNA, 64 nt, Homo Sapiens; identical to SEQ ID NO: 420275

SEQ ID NO: 715872 - RNA, 64 nt, Homo Sapiens; identical to SEQ ID NO: 420276

SEQ ID NO: 715873 - RNA, 64 nt, Homo Sapiens; identical to SEQ ID NO: 420277

SEQ ID NO: 715874 - RNA, 64 nt, Homo Sapiens; identical to SEQ ID NO: 420278

SEQ ID NO: 715875 - RNA, 60 nt, Homo Sapiens; identical to SEQ ID NO: 420279

SEQ ID NO: 715876 - RNA, 64 nt, Homo Sapiens; identical to SEQ ID NO: 420280

SEQ ID NO: 715877 - RNA, 64 nt, Homo Sapiens; identical to SEQ ID NO: 420281

SEQ ID NO: 715878 - RNA, 64 nt, Homo Sapiens; identical to SEQ ID NO: 420282

SEQ ID NO: 715879 - RNA, 64 nt, Homo Sapiens; identical to SEQ ID NO: 420283

SEQ ID NO: 715880 - RNA, 64 nt, Homo Sapiens; identical to SEQ ID NO: 420284

SEQ ID NO: 715881 - RNA, 64 nt, Homo Sapiens; identical to SEQ ID NO: 420285

SEQ ID NO: 715882 - RNA, 64 nt, Homo Sapiens; identical to SEQ ID NO: 420286

SEQ ID NO: 715883 - RNA, 64 nt, Homo Sapiens; identical to SEQ ID NO: 420287

SEQ ID NO: 715884 - RNA, 64 nt, Homo Sapiens; identical to SEQ ID NO: 420288

SEQ ID NO: 715885 - RNA, 64 nt, Homo Sapiens; identical to SEQ ID NO: 420289

SEQ ID NO: 715886 - RNA, 64 nt, Homo Sapiens; identical to SEQ ID NO: 420290

SEQ ID NO: 715887 - RNA, 64 nt, Homo Sapiens; identical to SEQ ID NO: 420291

SEQ ID NO: 715888 - RNA, 64 nt, Homo Sapiens; identical to SEQ ID NO: 420292

SEQ ID NO: 715889 - RNA, 64 nt, Homo Sapiens
uggggguuuuggggugggcgagcaggaaugcucugaccaugagggacacauucugaguaacauc

SEQ ID NO: 715890 - RNA, 64 nt, Homo Sapiens
cauuguagguauauaugggguccucauauuugaggaccaugaaaaguggaggagaggagaaaug

SEQ ID NO: 715891 - RNA, 64 nt, Homo Sapiens
aaucuagcauauguauguucaaagucuaucgacugaccaugauccuguagaaaugcucuuugaa

SEQ ID NO: 715892 - RNA, 64 nt, Homo Sapiens
uuaauccagaacuuccucauagcaacaucugguugaccaugauuacaccaucuucccaggcaaa

SEQ ID NO: 715893 - RNA, 64 nt, Homo Sapiens
cucacaaggcaacgcgaugaacuuugacagccaugaccaugaaauuugauccuugaaaauggga

SEQ ID NO: 715894 - RNA, 64 nt, Homo Sapiens
uucuuugauccuugaaaaugagcaccagacucaagaccaugaccgaaauaggaugauguuugug

SEQ ID NO: 715895 - RNA, 64 nt, Homo Sapiens; identical to SEQ ID NO: 109257

SEQ ID NO: 715896 - RNA, 64 nt, Homo Sapiens; identical to SEQ ID NO: 109258

SEQ ID NO: 715897 - RNA, 64 nt, Homo Sapiens; identical to SEQ ID NO: 109259

SEQ ID NO: 715898 - RNA, 64 nt, Homo Sapiens; identical to SEQ ID NO: 109260

SEQ ID NO: 715899 - RNA, 64 nt, Homo Sapiens; identical to SEQ ID NO: 109261

SEQ ID NO: 715900 - RNA, 64 nt, Homo Sapiens; identical to SEQ ID NO: 109262

SEQ ID NO: 715901 - RNA, 64 nt, Homo Sapiens; identical to SEQ ID NO: 109263

SEQ ID NO: 715902 - RNA, 64 nt, Homo Sapiens; identical to SEQ ID NO: 109264

SEQ ID NO: 715903 - RNA, 64 nt, Homo Sapiens; identical to SEQ ID NO: 109265

SEQ ID NO: 715904 - RNA, 64 nt, Homo Sapiens; identical to SEQ ID NO: 109266

SEQ ID NO: 715905 - RNA, 64 nt, Homo Sapiens; identical to SEQ ID NO: 109267

SEQ ID NO: 715906 - RNA, 64 nt, Homo Sapiens; identical to SEQ ID NO: 109268

SEQ ID NO: 715907 - RNA, 64 nt, Homo Sapiens; identical to SEQ ID NO: 109269

SEQ ID NO: 715908 - RNA, 64 nt, Homo Sapiens; identical to SEQ ID NO: 109270

SEQ ID NO: 715909 - RNA, 64 nt, Homo Sapiens; identical to SEQ ID NO: 109271

SEQ ID NO: 715910 - RNA, 64 nt, Homo Sapiens; identical to SEQ ID NO: 109272

SEQ ID NO: 715911 - RNA, 64 nt, Homo Sapiens; identical to SEQ ID NO: 109273

SEQ ID NO: 715912 - RNA, 64 nt, Homo Sapiens; identical to SEQ ID NO: 109274

SEQ ID NO: 715913 - RNA, 64 nt, Homo Sapiens; identical to SEQ ID NO: 109275

SEQ ID NO: 715914 - RNA, 64 nt, Homo Sapiens; identical to SEQ ID NO: 109276

SEQ ID NO: 715915 - RNA, 64 nt, Homo Sapiens; identical to SEQ ID NO: 109277

SEQ ID NO: 715916 - RNA, 64 nt, Homo Sapiens; identical to SEQ ID NO: 109278

SEQ ID NO: 715917 - RNA, 64 nt, Homo Sapiens; identical to SEQ ID NO: 109279

SEQ ID NO: 715918 - RNA, 64 nt, Homo Sapiens; identical to SEQ ID NO: 109280

SEQ ID NO: 715919 - RNA, 64 nt, Homo Sapiens; identical to SEQ ID NO: 109281

SEQ ID NO: 715920 - RNA, 64 nt, Homo Sapiens; identical to SEQ ID NO: 109282

SEQ ID NO: 715921 - RNA, 64 nt, Homo Sapiens; identical to SEQ ID NO: 109283

SEQ ID NO: 715922 - RNA, 64 nt, Homo Sapiens; identical to SEQ ID NO: 109284

SEQ ID NO: 715923 - RNA, 64 nt, Homo Sapiens; identical to SEQ ID NO: 109285

SEQ ID NO: 715924 - RNA, 64 nt, Homo Sapiens; identical to SEQ ID NO: 109286

SEQ ID NO: 715925 - RNA, 64 nt, Homo Sapiens; identical to SEQ ID NO: 109287

SEQ ID NO: 715926 - RNA, 64 nt, Homo Sapiens; identical to SEQ ID NO: 109288

SEQ ID NO: 715927 - RNA, 64 nt, Homo Sapiens; identical to SEQ ID NO: 109289

SEQ ID NO: 715928 - RNA, 64 nt, Homo Sapiens; identical to SEQ ID NO: 109290

SEQ ID NO: 715929 - RNA, 64 nt, Homo Sapiens; identical to SEQ ID NO: 109291

SEQ ID NO: 715930 - RNA, 64 nt, Homo Sapiens; identical to SEQ ID NO: 387874

SEQ ID NO: 715931 - RNA, 64 nt, Homo Sapiens; identical to SEQ ID NO: 387875

SEQ ID NO: 715932 - RNA, 64 nt, Homo Sapiens; identical to SEQ ID NO: 387876

SEQ ID NO: 715933 - RNA, 64 nt, Homo Sapiens; identical to SEQ ID NO: 387877

SEQ ID NO: 715934 - RNA, 64 nt, Homo Sapiens; identical to SEQ ID NO: 387878

SEQ ID NO: 715935 - RNA, 64 nt, Homo Sapiens; identical to SEQ ID NO: 387879

SEQ ID NO: 715936 - RNA, 64 nt, Homo Sapiens; identical to SEQ ID NO: 387880

SEQ ID NO: 715937 - RNA, 64 nt, Homo Sapiens; identical to SEQ ID NO: 387881

SEQ ID NO: 715938 - RNA, 64 nt, Homo Sapiens; identical to SEQ ID NO: 387882

SEQ ID NO: 715939 - RNA, 64 nt, Homo Sapiens; identical to SEQ ID NO: 387883

SEQ ID NO: 715940 - RNA, 64 nt, Homo Sapiens; identical to SEQ ID NO: 387884

SEQ ID NO: 715941 - RNA, 64 nt, Homo Sapiens; identical to SEQ ID NO: 387885

SEQ ID NO: 715942 - RNA, 64 nt, Homo Sapiens; identical to SEQ ID NO: 387886

SEQ ID NO: 715943 - RNA, 64 nt, Homo Sapiens; identical to SEQ ID NO: 387887

SEQ ID NO: 715944 - RNA, 64 nt, Homo Sapiens; identical to SEQ ID NO: 387888

SEQ ID NO: 715945 - RNA, 64 nt, Homo Sapiens; identical to SEQ ID NO: 387889

SEQ ID NO: 715946 - RNA, 64 nt, Homo Sapiens; identical to SEQ ID NO: 387890

SEQ ID NO: 715947 - RNA, 64 nt, Homo Sapiens; identical to SEQ ID NO: 387891

SEQ ID NO: 715948 - RNA, 64 nt, Homo Sapiens; identical to SEQ ID NO: 387892

SEQ ID NO: 715949 - RNA, 64 nt, Homo Sapiens; identical to SEQ ID NO: 387893

SEQ ID NO: 715950 - RNA, 64 nt, Homo Sapiens; identical to SEQ ID NO: 387894

SEQ ID NO: 715951 - RNA, 64 nt, Homo Sapiens; identical to SEQ ID NO: 387895

SEQ ID NO: 715952 - RNA, 64 nt, Homo Sapiens; identical to SEQ ID NO: 387896

SEQ ID NO: 715953 - RNA, 64 nt, Homo Sapiens; identical to SEQ ID NO: 387897

SEQ ID NO: 715954 - RNA, 64 nt, Homo Sapiens; identical to SEQ ID NO: 387898

SEQ ID NO: 715955 - RNA, 64 nt, Homo Sapiens; identical to SEQ ID NO: 387899

SEQ ID NO: 715956 - RNA, 64 nt, Homo Sapiens; identical to SEQ ID NO: 85822

SEQ ID NO: 715957 - RNA, 64 nt, Homo Sapiens; identical to SEQ ID NO: 85823

SEQ ID NO: 715958 - RNA, 64 nt, Homo Sapiens; identical to SEQ ID NO: 85824

SEQ ID NO: 715959 - RNA, 64 nt, Homo Sapiens; identical to SEQ ID NO: 85825

SEQ ID NO: 715960 - RNA, 64 nt, Homo Sapiens; identical to SEQ ID NO: 85826

SEQ ID NO: 715961 - RNA, 64 nt, Homo Sapiens; identical to SEQ ID NO: 85827

SEQ ID NO: 715962 - RNA, 64 nt, Homo Sapiens; identical to SEQ ID NO: 85828

SEQ ID NO: 715963 - RNA, 64 nt, Homo Sapiens; identical to SEQ ID NO: 85829

SEQ ID NO: 715964 - RNA, 64 nt, Homo Sapiens; identical to SEQ ID NO: 85830

SEQ ID NO: 715965 - RNA, 64 nt, Homo Sapiens; identical to SEQ ID NO: 85831

SEQ ID NO: 715966 - RNA, 64 nt, Homo Sapiens; identical to SEQ ID NO: 85832

SEQ ID NO: 715967 - RNA, 64 nt, Homo Sapiens; identical to SEQ ID NO: 85833

SEQ ID NO: 715968 - RNA, 64 nt, Homo Sapiens; identical to SEQ ID NO: 85834

SEQ ID NO: 715969 - RNA, 64 nt, Homo Sapiens; identical to SEQ ID NO: 85835

SEQ ID NO: 715970 - RNA, 64 nt, Homo Sapiens; identical to SEQ ID NO: 85836

SEQ ID NO: 715971 - RNA, 64 nt, Homo Sapiens; identical to SEQ ID NO: 85837

SEQ ID NO: 715972 - RNA, 64 nt, Homo Sapiens; identical to SEQ ID NO: 85838

SEQ ID NO: 715973 - RNA, 64 nt, Homo Sapiens; identical to SEQ ID NO: 85839

SEQ ID NO: 715974 - RNA, 64 nt, Homo Sapiens; identical to SEQ ID NO: 85840

SEQ ID NO: 715975 - RNA, 64 nt, Homo Sapiens; identical to SEQ ID NO: 85841

SEQ ID NO: 715976 - RNA, 64 nt, Homo Sapiens; identical to SEQ ID NO: 85842

SEQ ID NO: 715977 - RNA, 64 nt, Homo Sapiens; identical to SEQ ID NO: 85843

SEQ ID NO: 715978 - RNA, 64 nt, Homo Sapiens; identical to SEQ ID NO: 85844

SEQ ID NO: 715979 - RNA, 64 nt, Homo Sapiens; identical to SEQ ID NO: 85845

SEQ ID NO: 715980 - RNA, 64 nt, Homo Sapiens; identical to SEQ ID NO: 85846

SEQ ID NO: 715981 - RNA, 64 nt, Homo Sapiens; identical to SEQ ID NO: 85847

SEQ ID NO: 715982 - RNA, 64 nt, Homo Sapiens; identical to SEQ ID NO: 85848

SEQ ID NO: 715983 - RNA, 64 nt, Homo Sapiens; identical to SEQ ID NO: 85849

SEQ ID NO: 715984 - RNA, 64 nt, Homo Sapiens; identical to SEQ ID NO: 85850

SEQ ID NO: 715985 - RNA, 64 nt, Homo Sapiens; identical to SEQ ID NO: 85851

SEQ ID NO: 715986 - RNA, 64 nt, Homo Sapiens; identical to SEQ ID NO: 85852

SEQ ID NO: 715987 - RNA, 64 nt, Homo Sapiens; identical to SEQ ID NO: 85853

SEQ ID NO: 715988 - RNA, 64 nt, Homo Sapiens; identical to SEQ ID NO: 85854

SEQ ID NO: 715989 - RNA, 64 nt, Homo Sapiens; identical to SEQ ID NO: 85855

SEQ ID NO: 715990 - RNA, 64 nt, Homo Sapiens; identical to SEQ ID NO: 85856

SEQ ID NO: 715991 - RNA, 64 nt, Homo Sapiens; identical to SEQ ID NO: 85857

SEQ ID NO: 715992 - RNA, 64 nt, Homo Sapiens; identical to SEQ ID NO: 85858

SEQ ID NO: 715993 - RNA, 64 nt, Homo Sapiens; identical to SEQ ID NO: 85370

SEQ ID NO: 715994 - RNA, 64 nt, Homo Sapiens; identical to SEQ ID NO: 85371

SEQ ID NO: 715995 - RNA, 64 nt, Homo Sapiens; identical to SEQ ID NO: 85372

SEQ ID NO: 715996 - RNA, 64 nt, Homo Sapiens; identical to SEQ ID NO: 85373

SEQ ID NO: 715997 - RNA, 64 nt, Homo Sapiens; identical to SEQ ID NO: 85374

SEQ ID NO: 715998 - RNA, 64 nt, Homo Sapiens; identical to SEQ ID NO: 85375

SEQ ID NO: 715999 - RNA, 64 nt, Homo Sapiens; identical to SEQ ID NO: 85376

SEQ ID NO: 716000 - RNA, 64 nt, Homo Sapiens; identical to SEQ ID NO: 85377

SEQ ID NO: 716001 - RNA, 64 nt, Homo Sapiens; identical to SEQ ID NO: 85378

SEQ ID NO: 716002 - RNA, 64 nt, Homo Sapiens; identical to SEQ ID NO: 85379

SEQ ID NO: 716003 - RNA, 64 nt, Homo Sapiens; identical to SEQ ID NO: 85380

SEQ ID NO: 716004 - RNA, 64 nt, Homo Sapiens; identical to SEQ ID NO: 85381

SEQ ID NO: 716005 - RNA, 64 nt, Homo Sapiens; identical to SEQ ID NO: 85382

SEQ ID NO: 716006 - RNA, 64 nt, Homo Sapiens; identical to SEQ ID NO: 85383

SEQ ID NO: 716007 - RNA, 64 nt, Homo Sapiens; identical to SEQ ID NO: 85384

SEQ ID NO: 716008 - RNA, 64 nt, Homo Sapiens; identical to SEQ ID NO: 85385

SEQ ID NO: 716009 - RNA, 64 nt, Homo Sapiens; identical to SEQ ID NO: 85386

SEQ ID NO: 716010 - RNA, 64 nt, Homo Sapiens
gguaagggaccuucagggagagcugggcagacaggugggagauggagguagggcuggcuggagg

SEQ ID NO: 716011 - RNA, 64 nt, Homo Sapiens
uaagggagucauugccuugggccugggaaucuaagugggagacaauauuaauuuggauccgauu

SEQ ID NO: 716012 - RNA, 64 nt, Homo Sapiens
ccguugaaccugggaggcgguucagaaggccgaggugggagaauggugccuguaaucccggcua

SEQ ID NO: 716013 - RNA, 64 nt, Homo Sapiens
cagaccugggcgcaaacaacgaggccucaguccagugggagaaaaagcagguucugcuugcaaa

SEQ ID NO: 716014 - RNA, 64 nt, Homo Sapiens
gagggggguuaauggaacugccugacuguaaguggugggagagguuuccggggaaugugguacc

SEQ ID NO: 716015 - RNA, 64 nt, Homo Sapiens
gagcuaaaaucaggcucaguaauuuggagguggggugggagaaaacugcacaccuuccccauaa

SEQ ID NO: 716016 - RNA, 64 nt, Homo Sapiens
cugggcaggaucccaucagaccccagggccuaucgugggagagcauggggugggggccagggcc

SEQ ID NO: 716017 - RNA, 64 nt, Homo Sapiens
ggacacauggguguccagggcacccuuggacagggugggagaggauucugcacucugggaucca

SEQ ID NO: 716018 - RNA, 64 nt, Homo Sapiens
guggggcaggcuccguccuccacuccaggaaacugugggagaguugggagaaccccaauucuag

SEQ ID NO: 716019 - RNA, 64 nt, Homo Sapiens
cccaauucuagcacuccaggcuuucugagccugcgugggagaacagaggaggaacuccuggugc

SEQ ID NO: 716020 - RNA, 64 nt, Homo Sapiens
acacgcagcagagguuucccuugaagugcaagaggugggagaucaggcuguuccuuugcugcca

SEQ ID NO: 716021 - RNA, 64 nt, Homo Sapiens
aaaaugcuuuguccauggggaagugcacagauaugugggagaaccuuacaaggcucuaaaauga

SEQ ID NO: 716022 - RNA, 64 nt, Homo Sapiens
uuugcugaauuccaucccaaucucccaaucugcagugggagagcaugugggagaaauaccugau

SEQ ID NO: 716023 - RNA, 64 nt, Homo Sapiens
uaccugauucucccaaucuguggcagccccccaugugggagaaaccuauaggguccuccuuccc

SEQ ID NO: 716024 - RNA, 64 nt, Homo Sapiens
gggaacaggcagugaggaagacauugagcuuggggugggagaugugugaaaagagccaaguguu

SEQ ID NO: 716025 - RNA, 64 nt, Homo Sapiens
agggagcgcagccuucccagggaugugagagccggugggagagaugagggugagggaacagccu

SEQ ID NO: 716026 - RNA, 64 nt, Homo Sapiens
ugcugagcccagcgaauccugggaccugggaaaggugggagagacugcucugcacacauggaca

SEQ ID NO: 716027 - RNA, 64 nt, Homo Sapiens
ucuacagggaagacaccagcaggcuucuccuggcgugggagacgaaagcucucugucaauuaca

SEQ ID NO: 716028 - RNA, 64 nt, Homo Sapiens
uggauuugaauguggacuuggaagaauuuugcaggugggagauuuuaagggacuggagagaggu

SEQ ID NO: 716029 - RNA, 64 nt, Homo Sapiens
ugaacuccaauuaagggacugguggcuggugaaggugggagaugccccuuuuucccaccgauuc

SEQ ID NO: 716030 - RNA, 64 nt, Homo Sapiens
ccagaggugggaggagaaaacauagguuugaacagugggagauaucuagagacugggguuucuu

SEQ ID NO: 716031 - RNA, 64 nt, Homo Sapiens
aacccuauugaggcagugacuuuugaggaugcaugugggagagaagugucauacuuucugacac

SEQ ID NO: 716032 - RNA, 64 nt, Homo Sapiens
ggacauccuuuccagcucaaacguggguagggaugugggagaauaagaaugugggagaaccaag

SEQ ID NO: 716033 - RNA, 64 nt, Homo Sapiens
ucaaacguggguagggaugugggagaauaagaaugugggagaaccaagagaaaaaguggggcug

SEQ ID NO: 716034 - RNA, 64 nt, Homo Sapiens
auugcuuuuuucuuuuuuuuagaaaagugaaguggugggagagacgagggauagacagucucca

SEQ ID NO: 716035 - RNA, 64 nt, Homo Sapiens
cccgagcauccuccccacccccacgccucugcaagugggagagaucauccggaugcuucggacc

SEQ ID NO: 716036 - RNA, 64 nt, Homo Sapiens
ucaaacagaagcuuuucuuuggggaaggugauuugugggagacuaguguauuuuaaauuagcau

SEQ ID NO: 716037 - RNA, 64 nt, Homo Sapiens
ugauaauacaguaaaagcuuucuuacccagcauagugggagaguggagauuaauuaaaauuguu

SEQ ID NO: 716038 - RNA, 64 nt, Homo Sapiens
ugggcagaggggagaggaagcacaagaagugggagugggagaggaagccacgugcuggagagua

SEQ ID NO: 716039 - RNA, 64 nt, Homo Sapiens
gugggucagugugccacccucugcagggcagccugugggagaagggacagcggguaaaaagaga

SEQ ID NO: 716040 - RNA, 64 nt, Homo Sapiens
guauccuguuuuugucaguugaagcaagaagugggugggagaaugagaccaaaucuuuguccgg

SEQ ID NO: 716041 - RNA, 64 nt, Homo Sapiens
gagagagagcuguagugucagaguuugccucuuagugggagaauccugcaacuugacagagccu

SEQ ID NO: 716042 - RNA, 64 nt, Homo Sapiens
cuccuccaguccugucucaugggaagaagagagggugggagauuaaucccacuccugagggagg

SEQ ID NO: 716043 - RNA, 64 nt, Homo Sapiens
aagcagguagaccaccugucagaggguaucugaagugggagaagcgugugcagggcacacuggc

SEQ ID NO: 716044 - RNA, 64 nt, Homo Sapiens
uggcuuuuuuuuuucuucuguuugggggcacuuugugggagacugaccuucacucagcugugga

SEQ ID NO: 716045 - RNA, 64 nt, Homo Sapiens
accuggggccaucagaaaugaagacugucuccucgugggagagccgcuucagaaccucaaauga

SEQ ID NO: 716046 - RNA, 64 nt, Homo Sapiens
cagguggugccugccgagguccugaacuuucugggugggagaacaagaggguccaggcuggaaa

SEQ ID NO: 716047 - RNA, 64 nt, Homo Sapiens
ggugggcaguuaucacuggggcuauuuuuuuuaagugggagaagagagacuagcuucagcuuuu

SEQ ID NO: 716048 - RNA, 64 nt, Homo Sapiens
acauauaacuacuuaucucuagagaaaaaaagaugugggagaggguguguauguuuagagcaac

SEQ ID NO: 716049 - RNA, 64 nt, Homo Sapiens
acuggaucacgagggcagauagaggagggccuuggugggagaugaauuuuaauccccauguguc

SEQ ID NO: 716050 - RNA, 64 nt, Homo Sapiens
cguuguaugggacuggaagcacccacuggggcuggugggagaugaguguugaaucacaguuaca

SEQ ID NO: 716051 - RNA, 64 nt, Homo Sapiens
cccucugaguuggaaguugauuucccugagagcagugggagagggcauaagugaaucaugggca

SEQ ID NO: 716052 - RNA, 64 nt, Homo Sapiens
agaucuuccgcacaggaacaacaggguagaggaggugggagaugacgugggguggggcggugug

SEQ ID NO: 716053 - RNA, 64 nt, Homo Sapiens
ugggguggggcggugugacagggcaugggucugugugggagacgcaggguguggacggggcagc

SEQ ID NO: 716054 - RNA, 51 nt, Homo Sapiens; identical to SEQ ID NO: 64820

SEQ ID NO: 716055 - RNA, 64 nt, Homo Sapiens; identical to SEQ ID NO: 64821

SEQ ID NO: 716056 - RNA, 64 nt, Homo Sapiens; identical to SEQ ID NO: 64822

SEQ ID NO: 716057 - RNA, 64 nt, Homo Sapiens; identical to SEQ ID NO: 64823

SEQ ID NO: 716058 - RNA, 62 nt, Homo Sapiens
gacuugaagcagaguucaccagugagcucaggugucucaaagaaggguggaaguucuaaugu

SEQ ID NO: 716059 - RNA, 62 nt, Homo Sapiens
uauuuugcuucaaauaaacuuauuugaaaaguugucucaagucaaauggauucaucaccugu

SEQ ID NO: 716060 - RNA, 62 nt, Homo Sapiens
cuagaauuccuuuuauaagauuuaauuguaauugucucaaagcaucaaauaauacaucuuua

SEQ ID NO: 716061 - RNA, 62 nt, Homo Sapiens
cgguuuuuauccauccugucacccugagcaucugucucaaccugcugaggcacagacuucca

SEQ ID NO: 716062 - RNA, 62 nt, Homo Sapiens
uguuucuccagaauggugccuguuucucucugugucucaaugccugggacuggagguugaua

SEQ ID NO: 716063 - RNA, 62 nt, Homo Sapiens
augguuuuucaagucuauuuuuuuucuauguaugucucaauucucuuucaaaauuuuacaga

SEQ ID NO: 716064 - RNA, 62 nt, Homo Sapiens
auuaaagaauuuuguuuguuagaagaaaauucugucucaaaaagauaggugacugaccacaa

SEQ ID NO: 716065 - RNA, 62 nt, Homo Sapiens
aaguuaauuaauuuauagauauaccagggauuugucucaaaaaugggaaucagaagaauagu

SEQ ID NO: 716066 - RNA, 62 nt, Homo Sapiens
ugcacuccagccuggacaacagagcaagacucugucucaaaaaaaaaauaaaaaauaaaaaa

SEQ ID NO: 716067 - RNA, 62 nt, Homo Sapiens
acugcacuccagcuugagcaacacagugauacugucucaauaaauaaauaaauagaagaaau

SEQ ID NO: 716068 - RNA, 62 nt, Homo Sapiens
gcaaaacaaacagcaauaacagagugagacccugucucaaaaugcccuccagccugggugac

SEQ ID NO: 716069 - RNA, 62 nt, Homo Sapiens
aaaaaaaaaaagaaaagaaaagagccagacucugucucaaaaugcacuccagccugggugac

SEQ ID NO: 716070 - RNA, 62 nt, Homo Sapiens
aaacaugcaaagaagaggaagucacagaaacaugucucaauucccaugugcugugacuguag

SEQ ID NO: 716071 - RNA, 62 nt, Homo Sapiens
ugcaguccagccuaggcaacagagugagacuuugucucaaaaaaagagaaauuuuccuuaau

SEQ ID NO: 716072 - RNA, 62 nt, Homo Sapiens
gcuggccuuuggcuaccuguuuucucuaaugcugucucaauuuauucagacauaguagauag

SEQ ID NO: 716073 - RNA, 62 nt, Homo Sapiens
guggaaaaauuauauugucuauuuauauauuuugucucaaaaagucauauaaacaaguauug

SEQ ID NO: 716074 - RNA, 62 nt, Homo Sapiens
gaacaaugugugacaaauuguuuauaaaaauaugucucaaaauacaaauguuaauuucuguc

SEQ ID NO: 716075 - RNA, 62 nt, Homo Sapiens
aaauaaaaaaauucagauugagaccgagacacugucucaaaacuacacuccagccugaugac

SEQ ID NO: 716076 - RNA, 62 nt, Homo Sapiens
aaaugcagacuggccaggcaagagcaaaacccugucucaaaaugcauuccagccuggaugac

SEQ ID NO: 716077 - RNA, 62 nt, Homo Sapiens
ugcacucuagucugggugacagagcgagacucugucucaaaaaaaaaaaaauaaagccgggc

SEQ ID NO: 716078 - RNA, 62 nt, Homo Sapiens
gugugcuccagccugagcaacaagagcgaaacugucucaaaaaaaagaagaaaauaaauaaa

SEQ ID NO: 716079 - RNA, 62 nt, Homo Sapiens
aaaaaaaaagaaaaaagaaaagagcgaaccucugucucaaaaugcacuccagccggggugac

SEQ ID NO: 716080 - RNA, 62 nt, Homo Sapiens
aaaaaaaaacaaaaacaaacagaguaagacucugucucaaaauguacuccagcuugggcaac

SEQ ID NO: 716081 - RNA, 62 nt, Homo Sapiens
aagaaaaaaaagaaaaaaaaaaagcgaaacucugucucaaaagcauuccagccugggcaaca

SEQ ID NO: 716082 - RNA, 62 nt, Homo Sapiens
aaaaaaaaaagaggugggugagagcgaaacucugucucaaaagcacuccagccugggcaaca

SEQ ID NO: 716083 - RNA, 62 nt, Homo Sapiens
acacucaagcuugggcaacgagagcaaaacucugucucaaaaaaaaaauuagccagaugugg

SEQ ID NO: 716084 - RNA, 62 nt, Homo Sapiens
uguacuccagccuaggugacagagugagacccugucucaaaaauaaauaauaaauaaauaaa

SEQ ID NO: 716085 - RNA, 62 nt, Homo Sapiens
auuccuauggaaagucgcggugaaugcgugcaugucucaauguccacaaaggauucuggcua

SEQ ID NO: 716086 - RNA, 62 nt, Homo Sapiens
ugucuugucaucacaggcgccuauacagcuucugucucaauagggucagauauuuugcacug

SEQ ID NO: 716087 - RNA, 62 nt, Homo Sapiens
ccugaaucaccugaaucugaggauauuuuuagugucucaaggcccccccagauaccauguca

SEQ ID NO: 716088 - RNA, 62 nt, Homo Sapiens
ucaacagcccaauaagaauggcugaccaaaaaugucucaaagaacucaagcccaacggcggu

SEQ ID NO: 716089 - RNA, 62 nt, Homo Sapiens
guugucccuccccaucauccauuccugugaggugucucaaaccaaaguuaacagggagagga

SEQ ID NO: 716090 - RNA, 62 nt, Homo Sapiens
auacuguucuacugcuucccucaguaucugaaugucucaauuuaaaacuugaagcucuuuag

SEQ ID NO: 716091 - RNA, 64 nt, Homo Sapiens; identical to SEQ ID NO: 60102

SEQ ID NO: 716092 - RNA, 64 nt, Homo Sapiens; identical to SEQ ID NO: 60103

SEQ ID NO: 716093 - RNA, 64 nt, Homo Sapiens; identical to SEQ ID NO: 60104

SEQ ID NO: 716094 - RNA, 64 nt, Homo Sapiens; identical to SEQ ID NO: 60105

SEQ ID NO: 716095 - RNA, 64 nt, Homo Sapiens; identical to SEQ ID NO: 60106

SEQ ID NO: 716096 - RNA, 64 nt, Homo Sapiens; identical to SEQ ID NO: 60107

SEQ ID NO: 716097 - RNA, 64 nt, Homo Sapiens; identical to SEQ ID NO: 60108

SEQ ID NO: 716098 - RNA, 64 nt, Homo Sapiens; identical to SEQ ID NO: 60109

SEQ ID NO: 716099 - RNA, 64 nt, Homo Sapiens; identical to SEQ ID NO: 60110

SEQ ID NO: 716100 - RNA, 64 nt, Homo Sapiens; identical to SEQ ID NO: 60111

SEQ ID NO: 716101 - RNA, 64 nt, Homo Sapiens; identical to SEQ ID NO: 60112

SEQ ID NO: 716102 - RNA, 64 nt, Homo Sapiens; identical to SEQ ID NO: 60113

SEQ ID NO: 716103 - RNA, 64 nt, Homo Sapiens; identical to SEQ ID NO: 60114

SEQ ID NO: 716104 - RNA, 64 nt, Homo Sapiens; identical to SEQ ID NO: 60115

SEQ ID NO: 716105 - RNA, 64 nt, Homo Sapiens; identical to SEQ ID NO: 60116

SEQ ID NO: 716106 - RNA, 64 nt, Homo Sapiens; identical to SEQ ID NO: 60117

SEQ ID NO: 716107 - RNA, 64 nt, Homo Sapiens; identical to SEQ ID NO: 60118

SEQ ID NO: 716108 - RNA, 64 nt, Homo Sapiens; identical to SEQ ID NO: 60119

SEQ ID NO: 716109 - RNA, 64 nt, Homo Sapiens; identical to SEQ ID NO: 60120

SEQ ID NO: 716110 - RNA, 64 nt, Homo Sapiens; identical to SEQ ID NO: 60121

SEQ ID NO: 716111 - RNA, 64 nt, Homo Sapiens; identical to SEQ ID NO: 60122

SEQ ID NO: 716112 - RNA, 64 nt, Homo Sapiens; identical to SEQ ID NO: 60123

SEQ ID NO: 716113 - RNA, 64 nt, Homo Sapiens; identical to SEQ ID NO: 60124

SEQ ID NO: 716114 - RNA, 64 nt, Homo Sapiens; identical to SEQ ID NO: 60125

SEQ ID NO: 716115 - RNA, 64 nt, Homo Sapiens; identical to SEQ ID NO: 60126

SEQ ID NO: 716116 - RNA, 64 nt, Homo Sapiens; identical to SEQ ID NO: 60127

SEQ ID NO: 716117 - RNA, 64 nt, Homo Sapiens; identical to SEQ ID NO: 60128

SEQ ID NO: 716118 - RNA, 64 nt, Homo Sapiens; identical to SEQ ID NO: 60129

SEQ ID NO: 716119 - RNA, 64 nt, Homo Sapiens; identical to SEQ ID NO: 60130

SEQ ID NO: 716120 - RNA, 64 nt, Homo Sapiens; identical to SEQ ID NO: 60131

SEQ ID NO: 716121 - RNA, 64 nt, Homo Sapiens; identical to SEQ ID NO: 60132

SEQ ID NO: 716122 - RNA, 64 nt, Homo Sapiens; identical to SEQ ID NO: 60133

SEQ ID NO: 716123 - RNA, 64 nt, Homo Sapiens; identical to SEQ ID NO: 60134

SEQ ID NO: 716124 - RNA, 64 nt, Homo Sapiens; identical to SEQ ID NO: 60135

SEQ ID NO: 716125 - RNA, 64 nt, Homo Sapiens; identical to SEQ ID NO: 60136

SEQ ID NO: 716126 - RNA, 64 nt, Homo Sapiens; identical to SEQ ID NO: 60137

SEQ ID NO: 716127 - RNA, 64 nt, Homo Sapiens; identical to SEQ ID NO: 60138

SEQ ID NO: 716128 - RNA, 64 nt, Homo Sapiens; identical to SEQ ID NO: 60139

SEQ ID NO: 716129 - RNA, 64 nt, Homo Sapiens; identical to SEQ ID NO: 60140

SEQ ID NO: 716130 - RNA, 64 nt, Homo Sapiens; identical to SEQ ID NO: 60141

SEQ ID NO: 716131 - RNA, 64 nt, Homo Sapiens; identical to SEQ ID NO: 60142

SEQ ID NO: 716132 - RNA, 64 nt, Homo Sapiens; identical to SEQ ID NO: 60143

SEQ ID NO: 716133 - RNA, 64 nt, Homo Sapiens; identical to SEQ ID NO: 60144

SEQ ID NO: 716134 - RNA, 64 nt, Homo Sapiens; identical to SEQ ID NO: 60145

SEQ ID NO: 716135 - RNA, 64 nt, Homo Sapiens; identical to SEQ ID NO: 60146

SEQ ID NO: 716136 - RNA, 64 nt, Homo Sapiens; identical to SEQ ID NO: 60147

SEQ ID NO: 716137 - RNA, 64 nt, Homo Sapiens; identical to SEQ ID NO: 60148

SEQ ID NO: 716138 - RNA, 64 nt, Homo Sapiens; identical to SEQ ID NO: 60149

SEQ ID NO: 716139 - RNA, 64 nt, Homo Sapiens; identical to SEQ ID NO: 60150

SEQ ID NO: 716140 - RNA, 64 nt, Homo Sapiens; identical to SEQ ID NO: 60151

SEQ ID NO: 716141 - RNA, 64 nt, Homo Sapiens; identical to SEQ ID NO: 60152

SEQ ID NO: 716142 - RNA, 64 nt, Homo Sapiens; identical to SEQ ID NO: 60153

SEQ ID NO: 716143 - RNA, 64 nt, Homo Sapiens; identical to SEQ ID NO: 60154

SEQ ID NO: 716144 - RNA, 64 nt, Homo Sapiens; identical to SEQ ID NO: 60155

SEQ ID NO: 716145 - RNA, 64 nt, Homo Sapiens; identical to SEQ ID NO: 60156

SEQ ID NO: 716146 - RNA, 64 nt, Homo Sapiens; identical to SEQ ID NO: 60157

SEQ ID NO: 716147 - RNA, 64 nt, Homo Sapiens; identical to SEQ ID NO: 60158

SEQ ID NO: 716148 - RNA, 64 nt, Homo Sapiens; identical to SEQ ID NO: 60159

SEQ ID NO: 716149 - RNA, 64 nt, Homo Sapiens; identical to SEQ ID NO: 60160

SEQ ID NO: 716150 - RNA, 64 nt, Homo Sapiens; identical to SEQ ID NO: 60161

SEQ ID NO: 716151 - RNA, 64 nt, Homo Sapiens; identical to SEQ ID NO: 60162

SEQ ID NO: 716152 - RNA, 64 nt, Homo Sapiens; identical to SEQ ID NO: 60163

SEQ ID NO: 716153 - RNA, 64 nt, Homo Sapiens; identical to SEQ ID NO: 60164

SEQ ID NO: 716154 - RNA, 64 nt, Homo Sapiens; identical to SEQ ID NO: 60165

SEQ ID NO: 716155 - RNA, 64 nt, Homo Sapiens; identical to SEQ ID NO: 60166

SEQ ID NO: 716156 - RNA, 64 nt, Homo Sapiens; identical to SEQ ID NO: 60167

SEQ ID NO: 716157 - RNA, 64 nt, Homo Sapiens; identical to SEQ ID NO: 60168

SEQ ID NO: 716158 - RNA, 64 nt, Homo Sapiens; identical to SEQ ID NO: 60169

SEQ ID NO: 716159 - RNA, 64 nt, Homo Sapiens; identical to SEQ ID NO: 60170

SEQ ID NO: 716160 - RNA, 64 nt, Homo Sapiens; identical to SEQ ID NO: 60171

SEQ ID NO: 716161 - RNA, 64 nt, Homo Sapiens; identical to SEQ ID NO: 237342

SEQ ID NO: 716162 - RNA, 64 nt, Homo Sapiens; identical to SEQ ID NO: 237343

SEQ ID NO: 716163 - RNA, 64 nt, Homo Sapiens; identical to SEQ ID NO: 237344

SEQ ID NO: 716164 - RNA, 64 nt, Homo Sapiens; identical to SEQ ID NO: 237345

SEQ ID NO: 716165 - RNA, 64 nt, Homo Sapiens; identical to SEQ ID NO: 237346

SEQ ID NO: 716166 - RNA, 64 nt, Homo Sapiens; identical to SEQ ID NO: 237347

SEQ ID NO: 716167 - RNA, 64 nt, Homo Sapiens; identical to SEQ ID NO: 237348

SEQ ID NO: 716168 - RNA, 64 nt, Homo Sapiens; identical to SEQ ID NO: 237349

SEQ ID NO: 716169 - RNA, 64 nt, Homo Sapiens; identical to SEQ ID NO: 237350

SEQ ID NO: 716170 - RNA, 64 nt, Homo Sapiens; identical to SEQ ID NO: 237351

SEQ ID NO: 716171 - RNA, 64 nt, Homo Sapiens; identical to SEQ ID NO: 237352

SEQ ID NO: 716172 - RNA, 64 nt, Homo Sapiens; identical to SEQ ID NO: 237353

SEQ ID NO: 716173 - RNA, 64 nt, Homo Sapiens
gagaaaaaucacguagaaagcaucugucaggagugccauuaaaguugcucugagcuuguuuccu

SEQ ID NO: 716174 - RNA, 64 nt, Homo Sapiens
ggaaaccugaaggccauccugcagugcuggcuuggccauuaaauucaggcaggaggacaucuug

SEQ ID NO: 716175 - RNA, 64 nt, Homo Sapiens
cauuaccgagaggggacucaaaguguaagacucugccauuaaaaaccaucugaagaaacuuccc

SEQ ID NO: 716176 - RNA, 64 nt, Homo Sapiens
acuaccacauguguuucuguauuuauccuagugggccauuaaaauuaucucaauuuaguuuguu

SEQ ID NO: 716177 - RNA, 64 nt, Homo Sapiens
guguuguguuucauguucaagcuuaaucaaggcagccauuaauauacgaacugagcaugcuggg

SEQ ID NO: 716178 - RNA, 64 nt, Homo Sapiens
aucuuugcucuuuggacugaauucuuaccauacugccauuaaaauaaauuugccaacuaguaau

SEQ ID NO: 716179 - RNA, 64 nt, Homo Sapiens; identical to SEQ ID NO: 109572

SEQ ID NO: 716180 - RNA, 64 nt, Homo Sapiens; identical to SEQ ID NO: 109573

SEQ ID NO: 716181 - RNA, 64 nt, Homo Sapiens; identical to SEQ ID NO: 109574

SEQ ID NO: 716182 - RNA, 64 nt, Homo Sapiens; identical to SEQ ID NO: 109575

SEQ ID NO: 716183 - RNA, 64 nt, Homo Sapiens; identical to SEQ ID NO: 109576

SEQ ID NO: 716184 - RNA, 64 nt, Homo Sapiens; identical to SEQ ID NO: 109577

SEQ ID NO: 716185 - RNA, 64 nt, Homo Sapiens; identical to SEQ ID NO: 109578

SEQ ID NO: 716186 - RNA, 64 nt, Homo Sapiens; identical to SEQ ID NO: 109579

SEQ ID NO: 716187 - RNA, 64 nt, Homo Sapiens; identical to SEQ ID NO: 109580

SEQ ID NO: 716188 - RNA, 64 nt, Homo Sapiens; identical to SEQ ID NO: 109581

SEQ ID NO: 716189 - RNA, 64 nt, Homo Sapiens; identical to SEQ ID NO: 109582

SEQ ID NO: 716190 - RNA, 64 nt, Homo Sapiens; identical to SEQ ID NO: 109583

SEQ ID NO: 716191 - RNA, 64 nt, Homo Sapiens; identical to SEQ ID NO: 109584

SEQ ID NO: 716192 - RNA, 64 nt, Homo Sapiens; identical to SEQ ID NO: 109585

SEQ ID NO: 716193 - RNA, 64 nt, Homo Sapiens; identical to SEQ ID NO: 55558

SEQ ID NO: 716194 - RNA, 64 nt, Homo Sapiens; identical to SEQ ID NO: 55559

SEQ ID NO: 716195 - RNA, 64 nt, Homo Sapiens; identical to SEQ ID NO: 55560

SEQ ID NO: 716196 - RNA, 64 nt, Homo Sapiens; identical to SEQ ID NO: 55561

SEQ ID NO: 716197 - RNA, 64 nt, Homo Sapiens; identical to SEQ ID NO: 55562

SEQ ID NO: 716198 - RNA, 64 nt, Homo Sapiens; identical to SEQ ID NO: 55563

SEQ ID NO: 716199 - RNA, 64 nt, Homo Sapiens; identical to SEQ ID NO: 55564

SEQ ID NO: 716200 - RNA, 64 nt, Homo Sapiens; identical to SEQ ID NO: 55565

SEQ ID NO: 716201 - RNA, 64 nt, Homo Sapiens; identical to SEQ ID NO: 55566

SEQ ID NO: 716202 - RNA, 64 nt, Homo Sapiens; identical to SEQ ID NO: 55567

SEQ ID NO: 716203 - RNA, 64 nt, Homo Sapiens; identical to SEQ ID NO: 55568

SEQ ID NO: 716204 - RNA, 64 nt, Homo Sapiens; identical to SEQ ID NO: 55569

SEQ ID NO: 716205 - RNA, 64 nt, Homo Sapiens; identical to SEQ ID NO: 55570

SEQ ID NO: 716206 - RNA, 64 nt, Homo Sapiens; identical to SEQ ID NO: 55571

SEQ ID NO: 716207 - RNA, 64 nt, Homo Sapiens; identical to SEQ ID NO: 55572

SEQ ID NO: 716208 - RNA, 64 nt, Homo Sapiens; identical to SEQ ID NO: 55573

SEQ ID NO: 716209 - RNA, 64 nt, Homo Sapiens; identical to SEQ ID NO: 55574

SEQ ID NO: 716210 - RNA, 64 nt, Homo Sapiens; identical to SEQ ID NO: 55575

SEQ ID NO: 716211 - RNA, 64 nt, Homo Sapiens; identical to SEQ ID NO: 55576

SEQ ID NO: 716212 - RNA, 64 nt, Homo Sapiens; identical to SEQ ID NO: 55577

SEQ ID NO: 716213 - RNA, 64 nt, Homo Sapiens; identical to SEQ ID NO: 55578

SEQ ID NO: 716214 - RNA, 64 nt, Homo Sapiens; identical to SEQ ID NO: 55579

SEQ ID NO: 716215 - RNA, 64 nt, Homo Sapiens; identical to SEQ ID NO: 55580

SEQ ID NO: 716216 - RNA, 64 nt, Homo Sapiens; identical to SEQ ID NO: 55581

SEQ ID NO: 716217 - RNA, 64 nt, Homo Sapiens; identical to SEQ ID NO: 55582

SEQ ID NO: 716218 - RNA, 64 nt, Homo Sapiens; identical to SEQ ID NO: 55583

SEQ ID NO: 716219 - RNA, 64 nt, Homo Sapiens; identical to SEQ ID NO: 55584

SEQ ID NO: 716220 - RNA, 64 nt, Homo Sapiens; identical to SEQ ID NO: 55585

SEQ ID NO: 716221 - RNA, 64 nt, Homo Sapiens; identical to SEQ ID NO: 55586

SEQ ID NO: 716222 - RNA, 64 nt, Homo Sapiens; identical to SEQ ID NO: 55587

SEQ ID NO: 716223 - RNA, 64 nt, Homo Sapiens; identical to SEQ ID NO: 55588

SEQ ID NO: 716224 - RNA, 64 nt, Homo Sapiens; identical to SEQ ID NO: 55589

SEQ ID NO: 716225 - RNA, 64 nt, Homo Sapiens; identical to SEQ ID NO: 55590

SEQ ID NO: 716226 - RNA, 64 nt, Homo Sapiens; identical to SEQ ID NO: 55591

SEQ ID NO: 716227 - RNA, 64 nt, Homo Sapiens; identical to SEQ ID NO: 55592

SEQ ID NO: 716228 - RNA, 64 nt, Homo Sapiens; identical to SEQ ID NO: 55593

SEQ ID NO: 716229 - RNA, 64 nt, Homo Sapiens; identical to SEQ ID NO: 55594

SEQ ID NO: 716230 - RNA, 64 nt, Homo Sapiens; identical to SEQ ID NO: 55595

SEQ ID NO: 716231 - RNA, 64 nt, Homo Sapiens; identical to SEQ ID NO: 55596

SEQ ID NO: 716232 - RNA, 64 nt, Homo Sapiens; identical to SEQ ID NO: 55597

SEQ ID NO: 716233 - RNA, 64 nt, Homo Sapiens; identical to SEQ ID NO: 55598

SEQ ID NO: 716234 - RNA, 64 nt, Homo Sapiens; identical to SEQ ID NO: 55599

SEQ ID NO: 716235 - RNA, 64 nt, Homo Sapiens; identical to SEQ ID NO: 55600

SEQ ID NO: 716236 - RNA, 64 nt, Homo Sapiens; identical to SEQ ID NO: 55601

SEQ ID NO: 716237 - RNA, 64 nt, Homo Sapiens; identical to SEQ ID NO: 55602

SEQ ID NO: 716238 - RNA, 64 nt, Homo Sapiens; identical to SEQ ID NO: 55603

SEQ ID NO: 716239 - RNA, 64 nt, Homo Sapiens; identical to SEQ ID NO: 55604

SEQ ID NO: 716240 - RNA, 64 nt, Homo Sapiens; identical to SEQ ID NO: 55605

SEQ ID NO: 716241 - RNA, 64 nt, Homo Sapiens; identical to SEQ ID NO: 55606

SEQ ID NO: 716242 - RNA, 64 nt, Homo Sapiens; identical to SEQ ID NO: 55607

SEQ ID NO: 716243 - RNA, 64 nt, Homo Sapiens; identical to SEQ ID NO: 55608

SEQ ID NO: 716244 - RNA, 64 nt, Homo Sapiens; identical to SEQ ID NO: 55609

SEQ ID NO: 716245 - RNA, 64 nt, Homo Sapiens; identical to SEQ ID NO: 55610

SEQ ID NO: 716246 - RNA, 64 nt, Homo Sapiens; identical to SEQ ID NO: 55611

SEQ ID NO: 716247 - RNA, 64 nt, Homo Sapiens; identical to SEQ ID NO: 55612

SEQ ID NO: 716248 - RNA, 64 nt, Homo Sapiens; identical to SEQ ID NO: 55613

SEQ ID NO: 716249 - RNA, 64 nt, Homo Sapiens; identical to SEQ ID NO: 55614

SEQ ID NO: 716250 - RNA, 64 nt, Homo Sapiens; identical to SEQ ID NO: 55615

SEQ ID NO: 716251 - RNA, 64 nt, Homo Sapiens; identical to SEQ ID NO: 55616

SEQ ID NO: 716252 - RNA, 64 nt, Homo Sapiens; identical to SEQ ID NO: 55617

SEQ ID NO: 716253 - RNA, 64 nt, Homo Sapiens; identical to SEQ ID NO: 55618

SEQ ID NO: 716254 - RNA, 64 nt, Homo Sapiens; identical to SEQ ID NO: 55619

SEQ ID NO: 716255 - RNA, 64 nt, Homo Sapiens; identical to SEQ ID NO: 55620

SEQ ID NO: 716256 - RNA, 64 nt, Homo Sapiens; identical to SEQ ID NO: 55621

SEQ ID NO: 716257 - RNA, 64 nt, Homo Sapiens; identical to SEQ ID NO: 55622

SEQ ID NO: 716258 - RNA, 64 nt, Homo Sapiens; identical to SEQ ID NO: 55623

SEQ ID NO: 716259 - RNA, 64 nt, Homo Sapiens; identical to SEQ ID NO: 55624

SEQ ID NO: 716260 - RNA, 64 nt, Homo Sapiens; identical to SEQ ID NO: 55625

SEQ ID NO: 716261 - RNA, 64 nt, Homo Sapiens; identical to SEQ ID NO: 55626

SEQ ID NO: 716262 - RNA, 64 nt, Homo Sapiens; identical to SEQ ID NO: 55627

SEQ ID NO: 716263 - RNA, 64 nt, Homo Sapiens; identical to SEQ ID NO: 55628

SEQ ID NO: 716264 - RNA, 64 nt, Homo Sapiens; identical to SEQ ID NO: 55629

SEQ ID NO: 716265 - RNA, 64 nt, Homo Sapiens; identical to SEQ ID NO: 55630

SEQ ID NO: 716266 - RNA, 64 nt, Homo Sapiens; identical to SEQ ID NO: 55631

SEQ ID NO: 716267 - RNA, 64 nt, Homo Sapiens; identical to SEQ ID NO: 55632

SEQ ID NO: 716268 - RNA, 64 nt, Homo Sapiens; identical to SEQ ID NO: 55633

SEQ ID NO: 716269 - RNA, 64 nt, Homo Sapiens; identical to SEQ ID NO: 55634

SEQ ID NO: 716270 - RNA, 64 nt, Homo Sapiens; identical to SEQ ID NO: 55635

SEQ ID NO: 716271 - RNA, 64 nt, Homo Sapiens; identical to SEQ ID NO: 55636

SEQ ID NO: 716272 - RNA, 64 nt, Homo Sapiens; identical to SEQ ID NO: 55637

SEQ ID NO: 716273 - RNA, 64 nt, Homo Sapiens; identical to SEQ ID NO: 55638

SEQ ID NO: 716274 - RNA, 64 nt, Homo Sapiens; identical to SEQ ID NO: 55639

SEQ ID NO: 716275 - RNA, 64 nt, Homo Sapiens; identical to SEQ ID NO: 55640

SEQ ID NO: 716276 - RNA, 64 nt, Homo Sapiens; identical to SEQ ID NO: 55641

SEQ ID NO: 716277 - RNA, 64 nt, Homo Sapiens; identical to SEQ ID NO: 224102

SEQ ID NO: 716278 - RNA, 64 nt, Homo Sapiens; identical to SEQ ID NO: 224103

SEQ ID NO: 716279 - RNA, 64 nt, Homo Sapiens; identical to SEQ ID NO: 224104

SEQ ID NO: 716280 - RNA, 64 nt, Homo Sapiens; identical to SEQ ID NO: 224105

SEQ ID NO: 716281 - RNA, 63 nt, Homo Sapiens; identical to SEQ ID NO: 224106

SEQ ID NO: 716282 - RNA, 64 nt, Homo Sapiens; identical to SEQ ID NO: 224107

SEQ ID NO: 716283 - RNA, 64 nt, Homo Sapiens
acggacaggaagagcagcucgaaggcaggccugagccauucaccuucuggaguagaagcugcug

SEQ ID NO: 716284 - RNA, 64 nt, Homo Sapiens
ugagugaggcugaaggcuggaggacccagucuuggccauucagugugccaggggccaugggccc

SEQ ID NO: 716285 - RNA, 64 nt, Homo Sapiens
aggucuucccuuaaaacuuugggcuguuggcugagccauucaaagagcaucaucuguucuucaa

SEQ ID NO: 716286 - RNA, 64 nt, Homo Sapiens
cucccauaggagccuacacuaaguccaagugugagccauucacagacuagaacacaaggaggga

SEQ ID NO: 716287 - RNA, 64 nt, Homo Sapiens; identical to SEQ ID NO: 72674

SEQ ID NO: 716288 - RNA, 64 nt, Homo Sapiens; identical to SEQ ID NO: 72675

SEQ ID NO: 716289 - RNA, 64 nt, Homo Sapiens; identical to SEQ ID NO: 72676

SEQ ID NO: 716290 - RNA, 64 nt, Homo Sapiens; identical to SEQ ID NO: 72677

SEQ ID NO: 716291 - RNA, 64 nt, Homo Sapiens; identical to SEQ ID NO: 72678

SEQ ID NO: 716292 - RNA, 64 nt, Homo Sapiens; identical to SEQ ID NO: 72679

SEQ ID NO: 716293 - RNA, 64 nt, Homo Sapiens; identical to SEQ ID NO: 72680

SEQ ID NO: 716294 - RNA, 64 nt, Homo Sapiens; identical to SEQ ID NO: 72681

SEQ ID NO: 716295 - RNA, 64 nt, Homo Sapiens; identical to SEQ ID NO: 72682

SEQ ID NO: 716296 - RNA, 64 nt, Homo Sapiens; identical to SEQ ID NO: 72683

SEQ ID NO: 716297 - RNA, 64 nt, Homo Sapiens; identical to SEQ ID NO: 72684

SEQ ID NO: 716298 - RNA, 64 nt, Homo Sapiens; identical to SEQ ID NO: 72685

SEQ ID NO: 716299 - RNA, 64 nt, Homo Sapiens; identical to SEQ ID NO: 72686

SEQ ID NO: 716300 - RNA, 64 nt, Homo Sapiens; identical to SEQ ID NO: 72687

SEQ ID NO: 716301 - RNA, 64 nt, Homo Sapiens; identical to SEQ ID NO: 72688

SEQ ID NO: 716302 - RNA, 64 nt, Homo Sapiens; identical to SEQ ID NO: 72689

SEQ ID NO: 716303 - RNA, 64 nt, Homo Sapiens; identical to SEQ ID NO: 72690

SEQ ID NO: 716304 - RNA, 64 nt, Homo Sapiens; identical to SEQ ID NO: 72691

SEQ ID NO: 716305 - RNA, 64 nt, Homo Sapiens; identical to SEQ ID NO: 72692

SEQ ID NO: 716306 - RNA, 64 nt, Homo Sapiens; identical to SEQ ID NO: 72693

SEQ ID NO: 716307 - RNA, 64 nt, Homo Sapiens; identical to SEQ ID NO: 72694

SEQ ID NO: 716308 - RNA, 64 nt, Homo Sapiens; identical to SEQ ID NO: 72695

SEQ ID NO: 716309 - RNA, 64 nt, Homo Sapiens; identical to SEQ ID NO: 72696

SEQ ID NO: 716310 - RNA, 64 nt, Homo Sapiens; identical to SEQ ID NO: 72697

SEQ ID NO: 716311 - RNA, 64 nt, Homo Sapiens; identical to SEQ ID NO: 72698

SEQ ID NO: 716312 - RNA, 64 nt, Homo Sapiens; identical to SEQ ID NO: 72699

SEQ ID NO: 716313 - RNA, 64 nt, Homo Sapiens; identical to SEQ ID NO: 72700

SEQ ID NO: 716314 - RNA, 64 nt, Homo Sapiens; identical to SEQ ID NO: 72701

SEQ ID NO: 716315 - RNA, 64 nt, Homo Sapiens; identical to SEQ ID NO: 72702

SEQ ID NO: 716316 - RNA, 64 nt, Homo Sapiens; identical to SEQ ID NO: 72703

SEQ ID NO: 716317 - RNA, 64 nt, Homo Sapiens; identical to SEQ ID NO: 72704

SEQ ID NO: 716318 - RNA, 64 nt, Homo Sapiens; identical to SEQ ID NO: 72705

SEQ ID NO: 716319 - RNA, 64 nt, Homo Sapiens; identical to SEQ ID NO: 72706

SEQ ID NO: 716320 - RNA, 64 nt, Homo Sapiens; identical to SEQ ID NO: 72707

SEQ ID NO: 716321 - RNA, 64 nt, Homo Sapiens; identical to SEQ ID NO: 72708

SEQ ID NO: 716322 - RNA, 64 nt, Homo Sapiens; identical to SEQ ID NO: 72709

SEQ ID NO: 716323 - RNA, 64 nt, Homo Sapiens; identical to SEQ ID NO: 72710

SEQ ID NO: 716324 - RNA, 64 nt, Homo Sapiens; identical to SEQ ID NO: 72711

SEQ ID NO: 716325 - RNA, 64 nt, Homo Sapiens; identical to SEQ ID NO: 72712

SEQ ID NO: 716326 - RNA, 64 nt, Homo Sapiens; identical to SEQ ID NO: 72713

SEQ ID NO: 716327 - RNA, 64 nt, Homo Sapiens; identical to SEQ ID NO: 72714

SEQ ID NO: 716328 - RNA, 64 nt, Homo Sapiens; identical to SEQ ID NO: 72715

SEQ ID NO: 716329 - RNA, 64 nt, Homo Sapiens; identical to SEQ ID NO: 72716

SEQ ID NO: 716330 - RNA, 64 nt, Homo Sapiens; identical to SEQ ID NO: 72717

SEQ ID NO: 716331 - RNA, 64 nt, Homo Sapiens; identical to SEQ ID NO: 72718

SEQ ID NO: 716332 - RNA, 64 nt, Homo Sapiens; identical to SEQ ID NO: 72719

SEQ ID NO: 716333 - RNA, 64 nt, Homo Sapiens; identical to SEQ ID NO: 233847

SEQ ID NO: 716334 - RNA, 64 nt, Homo Sapiens; identical to SEQ ID NO: 233848

SEQ ID NO: 716335 - RNA, 64 nt, Homo Sapiens; identical to SEQ ID NO: 233849

SEQ ID NO: 716336 - RNA, 64 nt, Homo Sapiens; identical to SEQ ID NO: 233850

SEQ ID NO: 716337 - RNA, 64 nt, Homo Sapiens; identical to SEQ ID NO: 233851

SEQ ID NO: 716338 - RNA, 64 nt, Homo Sapiens; identical to SEQ ID NO: 233852

SEQ ID NO: 716339 - RNA, 64 nt, Homo Sapiens; identical to SEQ ID NO: 233853

SEQ ID NO: 716340 - RNA, 64 nt, Homo Sapiens; identical to SEQ ID NO: 233854

SEQ ID NO: 716341 - RNA, 64 nt, Homo Sapiens; identical to SEQ ID NO: 233855

SEQ ID NO: 716342 - RNA, 64 nt, Homo Sapiens; identical to SEQ ID NO: 233856

SEQ ID NO: 716343 - RNA, 64 nt, Homo Sapiens; identical to SEQ ID NO: 233857

SEQ ID NO: 716344 - RNA, 64 nt, Homo Sapiens; identical to SEQ ID NO: 233858

SEQ ID NO: 716345 - RNA, 64 nt, Homo Sapiens; identical to SEQ ID NO: 233859

SEQ ID NO: 716346 - RNA, 64 nt, Homo Sapiens; identical to SEQ ID NO: 233860

SEQ ID NO: 716347 - RNA, 64 nt, Homo Sapiens; identical to SEQ ID NO: 233861

SEQ ID NO: 716348 - RNA, 64 nt, Homo Sapiens; identical to SEQ ID NO: 233862

SEQ ID NO: 716349 - RNA, 64 nt, Homo Sapiens; identical to SEQ ID NO: 233863

SEQ ID NO: 716350 - RNA, 64 nt, Homo Sapiens; identical to SEQ ID NO: 233864

SEQ ID NO: 716351 - RNA, 64 nt, Homo Sapiens; identical to SEQ ID NO: 233865

SEQ ID NO: 716352 - RNA, 64 nt, Homo Sapiens; identical to SEQ ID NO: 233866

SEQ ID NO: 716353 - RNA, 64 nt, Homo Sapiens; identical to SEQ ID NO: 233867

SEQ ID NO: 716354 - RNA, 64 nt, Homo Sapiens; identical to SEQ ID NO: 233868

SEQ ID NO: 716355 - RNA, 64 nt, Homo Sapiens; identical to SEQ ID NO: 233869

SEQ ID NO: 716356 - RNA, 64 nt, Homo Sapiens; identical to SEQ ID NO: 233870

SEQ ID NO: 716357 - RNA, 64 nt, Homo Sapiens; identical to SEQ ID NO: 233871

SEQ ID NO: 716358 - RNA, 64 nt, Homo Sapiens; identical to SEQ ID NO: 233872

SEQ ID NO: 716359 - RNA, 64 nt, Homo Sapiens; identical to SEQ ID NO: 233873

SEQ ID NO: 716360 - RNA, 64 nt, Homo Sapiens; identical to SEQ ID NO: 233874

SEQ ID NO: 716361 - RNA, 64 nt, Homo Sapiens; identical to SEQ ID NO: 233875

SEQ ID NO: 716362 - RNA, 64 nt, Homo Sapiens; identical to SEQ ID NO: 233876

SEQ ID NO: 716363 - RNA, 64 nt, Homo Sapiens; identical to SEQ ID NO: 233877

SEQ ID NO: 716364 - RNA, 64 nt, Homo Sapiens; identical to SEQ ID NO: 233878

SEQ ID NO: 716365 - RNA, 64 nt, Homo Sapiens; identical to SEQ ID NO: 233879

SEQ ID NO: 716366 - RNA, 64 nt, Homo Sapiens; identical to SEQ ID NO: 233880

SEQ ID NO: 716367 - RNA, 64 nt, Homo Sapiens; identical to SEQ ID NO: 233881

SEQ ID NO: 716368 - RNA, 64 nt, Homo Sapiens; identical to SEQ ID NO: 233882

SEQ ID NO: 716369 - RNA, 64 nt, Homo Sapiens; identical to SEQ ID NO: 233883

SEQ ID NO: 716370 - RNA, 64 nt, Homo Sapiens; identical to SEQ ID NO: 233884

SEQ ID NO: 716371 - RNA, 64 nt, Homo Sapiens; identical to SEQ ID NO: 233885

SEQ ID NO: 716372 - RNA, 64 nt, Homo Sapiens; identical to SEQ ID NO: 233886

SEQ ID NO: 716373 - RNA, 64 nt, Homo Sapiens; identical to SEQ ID NO: 233887

SEQ ID NO: 716374 - RNA, 64 nt, Homo Sapiens; identical to SEQ ID NO: 233888

SEQ ID NO: 716375 - RNA, 64 nt, Homo Sapiens; identical to SEQ ID NO: 233889

SEQ ID NO: 716376 - RNA, 64 nt, Homo Sapiens; identical to SEQ ID NO: 233890

SEQ ID NO: 716377 - RNA, 64 nt, Homo Sapiens; identical to SEQ ID NO: 233891

SEQ ID NO: 716378 - RNA, 64 nt, Homo Sapiens; identical to SEQ ID NO: 233892

SEQ ID NO: 716379 - RNA, 64 nt, Homo Sapiens; identical to SEQ ID NO: 233893

SEQ ID NO: 716380 - RNA, 64 nt, Homo Sapiens; identical to SEQ ID NO: 233894

SEQ ID NO: 716381 - RNA, 64 nt, Homo Sapiens; identical to SEQ ID NO: 233895

SEQ ID NO: 716382 - RNA, 64 nt, Homo Sapiens; identical to SEQ ID NO: 233896

SEQ ID NO: 716383 - RNA, 64 nt, Homo Sapiens; identical to SEQ ID NO: 233897

SEQ ID NO: 716384 - RNA, 64 nt, Homo Sapiens; identical to SEQ ID NO: 233898

SEQ ID NO: 716385 - RNA, 64 nt, Homo Sapiens; identical to SEQ ID NO: 233899

SEQ ID NO: 716386 - RNA, 64 nt, Homo Sapiens; identical to SEQ ID NO: 233900

SEQ ID NO: 716387 - RNA, 64 nt, Homo Sapiens; identical to SEQ ID NO: 233901

SEQ ID NO: 716388 - RNA, 64 nt, Homo Sapiens; identical to SEQ ID NO: 233902

SEQ ID NO: 716389 - RNA, 64 nt, Homo Sapiens; identical to SEQ ID NO: 233903

SEQ ID NO: 716390 - RNA, 64 nt, Homo Sapiens; identical to SEQ ID NO: 233904

SEQ ID NO: 716391 - RNA, 64 nt, Homo Sapiens; identical to SEQ ID NO: 233905

SEQ ID NO: 716392 - RNA, 64 nt, Homo Sapiens; identical to SEQ ID NO: 233906

SEQ ID NO: 716393 - RNA, 64 nt, Homo Sapiens; identical to SEQ ID NO: 233907

SEQ ID NO: 716394 - RNA, 64 nt, Homo Sapiens; identical to SEQ ID NO: 233908

SEQ ID NO: 716395 - RNA, 64 nt, Homo Sapiens; identical to SEQ ID NO: 233909

SEQ ID NO: 716396 - RNA, 64 nt, Homo Sapiens; identical to SEQ ID NO: 233910

SEQ ID NO: 716397 - RNA, 64 nt, Homo Sapiens; identical to SEQ ID NO: 233911

SEQ ID NO: 716398 - RNA, 64 nt, Homo Sapiens; identical to SEQ ID NO: 233912

SEQ ID NO: 716399 - RNA, 64 nt, Homo Sapiens; identical to SEQ ID NO: 233913

SEQ ID NO: 716400 - RNA, 64 nt, Homo Sapiens; identical to SEQ ID NO: 233914

SEQ ID NO: 716401 - RNA, 64 nt, Homo Sapiens; identical to SEQ ID NO: 233915

SEQ ID NO: 716402 - RNA, 64 nt, Homo Sapiens; identical to SEQ ID NO: 233916

SEQ ID NO: 716403 - RNA, 64 nt, Homo Sapiens; identical to SEQ ID NO: 233917

SEQ ID NO: 716404 - RNA, 64 nt, Homo Sapiens; identical to SEQ ID NO: 233918

SEQ ID NO: 716405 - RNA, 64 nt, Homo Sapiens; identical to SEQ ID NO: 233919

SEQ ID NO: 716406 - RNA, 64 nt, Homo Sapiens; identical to SEQ ID NO: 233920

SEQ ID NO: 716407 - RNA, 64 nt, Homo Sapiens; identical to SEQ ID NO: 233921

SEQ ID NO: 716408 - RNA, 64 nt, Homo Sapiens; identical to SEQ ID NO: 233922

SEQ ID NO: 716409 - RNA, 64 nt, Homo Sapiens; identical to SEQ ID NO: 233923

SEQ ID NO: 716410 - RNA, 64 nt, Homo Sapiens; identical to SEQ ID NO: 233924

SEQ ID NO: 716411 - RNA, 64 nt, Homo Sapiens; identical to SEQ ID NO: 233925

SEQ ID NO: 716412 - RNA, 64 nt, Homo Sapiens; identical to SEQ ID NO: 233926

SEQ ID NO: 716413 - RNA, 64 nt, Homo Sapiens; identical to SEQ ID NO: 233927

SEQ ID NO: 716414 - RNA, 64 nt, Homo Sapiens; identical to SEQ ID NO: 233928

SEQ ID NO: 716415 - RNA, 64 nt, Homo Sapiens; identical to SEQ ID NO: 233929

SEQ ID NO: 716416 - RNA, 64 nt, Homo Sapiens; identical to SEQ ID NO: 233930

SEQ ID NO: 716417 - RNA, 64 nt, Homo Sapiens; identical to SEQ ID NO: 233931

SEQ ID NO: 716418 - RNA, 64 nt, Homo Sapiens; identical to SEQ ID NO: 233932

SEQ ID NO: 716419 - RNA, 64 nt, Homo Sapiens; identical to SEQ ID NO: 233933

SEQ ID NO: 716420 - RNA, 64 nt, Homo Sapiens; identical to SEQ ID NO: 233934

SEQ ID NO: 716421 - RNA, 64 nt, Homo Sapiens; identical to SEQ ID NO: 233935

SEQ ID NO: 716422 - RNA, 64 nt, Homo Sapiens; identical to SEQ ID NO: 233936

SEQ ID NO: 716423 - RNA, 64 nt, Homo Sapiens; identical to SEQ ID NO: 233937

SEQ ID NO: 716424 - RNA, 64 nt, Homo Sapiens; identical to SEQ ID NO: 233938

SEQ ID NO: 716425 - RNA, 64 nt, Homo Sapiens; identical to SEQ ID NO: 233939

SEQ ID NO: 716426 - RNA, 64 nt, Homo Sapiens; identical to SEQ ID NO: 233940

SEQ ID NO: 716427 - RNA, 64 nt, Homo Sapiens; identical to SEQ ID NO: 233941

SEQ ID NO: 716428 - RNA, 64 nt, Homo Sapiens; identical to SEQ ID NO: 233942

SEQ ID NO: 716429 - RNA, 64 nt, Homo Sapiens; identical to SEQ ID NO: 233943

SEQ ID NO: 716430 - RNA, 64 nt, Homo Sapiens; identical to SEQ ID NO: 233944

SEQ ID NO: 716431 - RNA, 64 nt, Homo Sapiens; identical to SEQ ID NO: 233945

SEQ ID NO: 716432 - RNA, 64 nt, Homo Sapiens; identical to SEQ ID NO: 233946

SEQ ID NO: 716433 - RNA, 64 nt, Homo Sapiens; identical to SEQ ID NO: 233947

SEQ ID NO: 716434 - RNA, 64 nt, Homo Sapiens; identical to SEQ ID NO: 233948

SEQ ID NO: 716435 - RNA, 64 nt, Homo Sapiens; identical to SEQ ID NO: 233949

SEQ ID NO: 716436 - RNA, 64 nt, Homo Sapiens; identical to SEQ ID NO: 233950

SEQ ID NO: 716437 - RNA, 64 nt, Homo Sapiens; identical to SEQ ID NO: 233951

SEQ ID NO: 716438 - RNA, 64 nt, Homo Sapiens; identical to SEQ ID NO: 233952

SEQ ID NO: 716439 - RNA, 64 nt, Homo Sapiens; identical to SEQ ID NO: 233953

SEQ ID NO: 716440 - RNA, 64 nt, Homo Sapiens; identical to SEQ ID NO: 233954

SEQ ID NO: 716441 - RNA, 64 nt, Homo Sapiens; identical to SEQ ID NO: 233955

SEQ ID NO: 716442 - RNA, 64 nt, Homo Sapiens; identical to SEQ ID NO: 233956

SEQ ID NO: 716443 - RNA, 64 nt, Homo Sapiens; identical to SEQ ID NO: 233957

SEQ ID NO: 716444 - RNA, 64 nt, Homo Sapiens; identical to SEQ ID NO: 233958

SEQ ID NO: 716445 - RNA, 64 nt, Homo Sapiens; identical to SEQ ID NO: 233959

SEQ ID NO: 716446 - RNA, 64 nt, Homo Sapiens; identical to SEQ ID NO: 233960

SEQ ID NO: 716447 - RNA, 64 nt, Homo Sapiens; identical to SEQ ID NO: 233961

SEQ ID NO: 716448 - RNA, 64 nt, Homo Sapiens; identical to SEQ ID NO: 233962

SEQ ID NO: 716449 - RNA, 64 nt, Homo Sapiens; identical to SEQ ID NO: 233963

SEQ ID NO: 716450 - RNA, 64 nt, Homo Sapiens; identical to SEQ ID NO: 233964

SEQ ID NO: 716451 - RNA, 64 nt, Homo Sapiens; identical to SEQ ID NO: 233965

SEQ ID NO: 716452 - RNA, 64 nt, Homo Sapiens; identical to SEQ ID NO: 233966

SEQ ID NO: 716453 - RNA, 64 nt, Homo Sapiens; identical to SEQ ID NO: 233967

SEQ ID NO: 716454 - RNA, 64 nt, Homo Sapiens; identical to SEQ ID NO: 233968

SEQ ID NO: 716455 - RNA, 64 nt, Homo Sapiens; identical to SEQ ID NO: 233969

SEQ ID NO: 716456 - RNA, 64 nt, Homo Sapiens; identical to SEQ ID NO: 233970

SEQ ID NO: 716457 - RNA, 64 nt, Homo Sapiens; identical to SEQ ID NO: 233971

SEQ ID NO: 716458 - RNA, 64 nt, Homo Sapiens; identical to SEQ ID NO: 233972

SEQ ID NO: 716459 - RNA, 64 nt, Homo Sapiens; identical to SEQ ID NO: 142128

SEQ ID NO: 716460 - RNA, 64 nt, Homo Sapiens; identical to SEQ ID NO: 142129

SEQ ID NO: 716461 - RNA, 64 nt, Homo Sapiens; identical to SEQ ID NO: 142130

SEQ ID NO: 716462 - RNA, 64 nt, Homo Sapiens; identical to SEQ ID NO: 142131

SEQ ID NO: 716463 - RNA, 64 nt, Homo Sapiens; identical to SEQ ID NO: 142132

SEQ ID NO: 716464 - RNA, 64 nt, Homo Sapiens; identical to SEQ ID NO: 142133

SEQ ID NO: 716465 - RNA, 64 nt, Homo Sapiens; identical to SEQ ID NO: 142134

SEQ ID NO: 716466 - RNA, 64 nt, Homo Sapiens; identical to SEQ ID NO: 142135

SEQ ID NO: 716467 - RNA, 64 nt, Homo Sapiens; identical to SEQ ID NO: 142136

SEQ ID NO: 716468 - RNA, 64 nt, Homo Sapiens; identical to SEQ ID NO: 142137

SEQ ID NO: 716469 - RNA, 64 nt, Homo Sapiens
cacagagcagagaagcagagauguuccuugaacugcccacaaguuuucaauaacuuuuauuucu

SEQ ID NO: 716470 - RNA, 64 nt, Homo Sapiens
uuuaaacccaugaguuuaugcccugggcuccuuagcccacaauaguguaauaaaagugccccgg

SEQ ID NO: 716471 - RNA, 64 nt, Homo Sapiens
auaacuauuauuuuagccuuaguagcuauuuggggcccacaaaaacuaaagaaagaaauucaaa

SEQ ID NO: 716472 - RNA, 64 nt, Homo Sapiens
uugcuucuuugcuuuugcuccccucuuccgaguugcccacaaacaaggaaaugagaauaugauc

SEQ ID NO: 716473 - RNA, 64 nt, Homo Sapiens
cugcuucaguuguccuccacagcacugauuugcagcccacaagcuggcagguuuaucugucuca

SEQ ID NO: 716474 - RNA, 64 nt, Homo Sapiens
gagaagauuaaaugugcaaaaccugcuugacugugcccacaaauccugauuguaggaauaaauu

SEQ ID NO: 716475 - RNA, 63 nt, Homo Sapiens
cacaggcacugccccaggacaacacaacaaggacagucacaacaaggacaacaaggacacaac

SEQ ID NO: 716476 - RNA, 63 nt, Homo Sapiens
acaacaaggacacaacacaacacacaacaaggacagucacaacaagccuagagccagaaagca

SEQ ID NO: 716477 - RNA, 63 nt, Homo Sapiens
ggguaaaagcuccuucacaccccuuccaaaagucagucacagaccacugcaacaugccuuccc

SEQ ID NO: 716478 - RNA, 63 nt, Homo Sapiens
ucagaaagauacagugauaauguguguaugaaucagucacaaugaauuuuacuugaauauugu

SEQ ID NO: 716479 - RNA, 63 nt, Homo Sapiens
gggcaugauuuguaccauccacccauacccacacagucacagucacacacacauauguauuac

SEQ ID NO: 716480 - RNA, 63 nt, Homo Sapiens
gauuuguaccauccacccauacccacacagucacagucacacacacauauguauuacuuacac

SEQ ID NO: 716481 - RNA, 63 nt, Homo Sapiens
uguacuguaguucaauaaaaguucauauugaagcagucacauucuauuugguggaagauagau

SEQ ID NO: 716482 - RNA, 63 nt, Homo Sapiens
agaguguauuuauuauguagauucagaauuuugcagucacagauuauaguaaaucauucaagg

SEQ ID NO: 716483 - RNA, 63 nt, Homo Sapiens
ucacagcuugaaagacaggagugacaaaguugucagucacaaaaucuuacaaaugugaagacu

SEQ ID NO: 716484 - RNA, 63 nt, Homo Sapiens
uugcaagucaucauagucuuaguuuuuaaucaacagucacaccaaguguaaugaauguggcau

SEQ ID NO: 716485 - RNA, 64 nt, Homo Sapiens; identical to SEQ ID NO: 695984

SEQ ID NO: 716486 - RNA, 64 nt, Homo Sapiens; identical to SEQ ID NO: 695985

SEQ ID NO: 716487 - RNA, 64 nt, Homo Sapiens; identical to SEQ ID NO: 695986

SEQ ID NO: 716488 - RNA, 64 nt, Homo Sapiens; identical to SEQ ID NO: 695987

SEQ ID NO: 716489 - RNA, 64 nt, Homo Sapiens; identical to SEQ ID NO: 695988

SEQ ID NO: 716490 - RNA, 64 nt, Homo Sapiens; identical to SEQ ID NO: 695989

SEQ ID NO: 716491 - RNA, 64 nt, Homo Sapiens; identical to SEQ ID NO: 695990

SEQ ID NO: 716492 - RNA, 64 nt, Homo Sapiens; identical to SEQ ID NO: 695991

SEQ ID NO: 716493 - RNA, 64 nt, Homo Sapiens; identical to SEQ ID NO: 695992

SEQ ID NO: 716494 - RNA, 64 nt, Homo Sapiens; identical to SEQ ID NO: 695993

SEQ ID NO: 716495 - RNA, 64 nt, Homo Sapiens; identical to SEQ ID NO: 695994

SEQ ID NO: 716496 - RNA, 64 nt, Homo Sapiens; identical to SEQ ID NO: 695995

SEQ ID NO: 716497 - RNA, 64 nt, Homo Sapiens; identical to SEQ ID NO: 112922

SEQ ID NO: 716498 - RNA, 64 nt, Homo Sapiens; identical to SEQ ID NO: 112923

SEQ ID NO: 716499 - RNA, 64 nt, Homo Sapiens; identical to SEQ ID NO: 112924

SEQ ID NO: 716500 - RNA, 64 nt, Homo Sapiens; identical to SEQ ID NO: 112925

SEQ ID NO: 716501 - RNA, 64 nt, Homo Sapiens; identical to SEQ ID NO: 112926

SEQ ID NO: 716502 - RNA, 64 nt, Homo Sapiens; identical to SEQ ID NO: 112927

SEQ ID NO: 716503 - RNA, 64 nt, Homo Sapiens; identical to SEQ ID NO: 112928

SEQ ID NO: 716504 - RNA, 64 nt, Homo Sapiens; identical to SEQ ID NO: 112929

SEQ ID NO: 716505 - RNA, 64 nt, Homo Sapiens; identical to SEQ ID NO: 112930

SEQ ID NO: 716506 - RNA, 64 nt, Homo Sapiens; identical to SEQ ID NO: 112931

SEQ ID NO: 716507 - RNA, 64 nt, Homo Sapiens; identical to SEQ ID NO: 112932

SEQ ID NO: 716508 - RNA, 64 nt, Homo Sapiens; identical to SEQ ID NO: 112933

SEQ ID NO: 716509 - RNA, 64 nt, Homo Sapiens; identical to SEQ ID NO: 112934

SEQ ID NO: 716510 - RNA, 64 nt, Homo Sapiens; identical to SEQ ID NO: 112935

SEQ ID NO: 716511 - RNA, 64 nt, Homo Sapiens; identical to SEQ ID NO: 112936

SEQ ID NO: 716512 - RNA, 64 nt, Homo Sapiens; identical to SEQ ID NO: 112937

SEQ ID NO: 716513 - RNA, 64 nt, Homo Sapiens; identical to SEQ ID NO: 112938

SEQ ID NO: 716514 - RNA, 64 nt, Homo Sapiens; identical to SEQ ID NO: 112939

SEQ ID NO: 716515 - RNA, 64 nt, Homo Sapiens; identical to SEQ ID NO: 112940

SEQ ID NO: 716516 - RNA, 64 nt, Homo Sapiens; identical to SEQ ID NO: 112941

SEQ ID NO: 716517 - RNA, 64 nt, Homo Sapiens; identical to SEQ ID NO: 112942

SEQ ID NO: 716518 - RNA, 64 nt, Homo Sapiens; identical to SEQ ID NO: 112943

SEQ ID NO: 716519 - RNA, 64 nt, Homo Sapiens; identical to SEQ ID NO: 112944

SEQ ID NO: 716520 - RNA, 64 nt, Homo Sapiens; identical to SEQ ID NO: 112945

SEQ ID NO: 716521 - RNA, 64 nt, Homo Sapiens; identical to SEQ ID NO: 112946

SEQ ID NO: 716522 - RNA, 64 nt, Homo Sapiens; identical to SEQ ID NO: 112947

SEQ ID NO: 716523 - RNA, 64 nt, Homo Sapiens; identical to SEQ ID NO: 112948

SEQ ID NO: 716524 - RNA, 64 nt, Homo Sapiens; identical to SEQ ID NO: 112949

SEQ ID NO: 716525 - RNA, 64 nt, Homo Sapiens; identical to SEQ ID NO: 112950

SEQ ID NO: 716526 - RNA, 64 nt, Homo Sapiens; identical to SEQ ID NO: 112951

SEQ ID NO: 716527 - RNA, 64 nt, Homo Sapiens; identical to SEQ ID NO: 112952

SEQ ID NO: 716528 - RNA, 64 nt, Homo Sapiens; identical to SEQ ID NO: 112953

SEQ ID NO: 716529 - RNA, 64 nt, Homo Sapiens; identical to SEQ ID NO: 112954

SEQ ID NO: 716530 - RNA, 50 nt, Homo Sapiens; identical to SEQ ID NO: 112955

SEQ ID NO: 716531 - RNA, 64 nt, Homo Sapiens; identical to SEQ ID NO: 112956

SEQ ID NO: 716532 - RNA, 64 nt, Homo Sapiens; identical to SEQ ID NO: 112957

SEQ ID NO: 716533 - RNA, 64 nt, Homo Sapiens; identical to SEQ ID NO: 112958

SEQ ID NO: 716534 - RNA, 64 nt, Homo Sapiens; identical to SEQ ID NO: 112959

SEQ ID NO: 716535 - RNA, 64 nt, Homo Sapiens; identical to SEQ ID NO: 112960

SEQ ID NO: 716536 - RNA, 64 nt, Homo Sapiens; identical to SEQ ID NO: 112961

SEQ ID NO: 716537 - RNA, 64 nt, Homo Sapiens; identical to SEQ ID NO: 275490

SEQ ID NO: 716538 - RNA, 64 nt, Homo Sapiens; identical to SEQ ID NO: 275491

SEQ ID NO: 716539 - RNA, 64 nt, Homo Sapiens; identical to SEQ ID NO: 275492

SEQ ID NO: 716540 - RNA, 64 nt, Homo Sapiens; identical to SEQ ID NO: 275493

SEQ ID NO: 716541 - RNA, 64 nt, Homo Sapiens; identical to SEQ ID NO: 275494

SEQ ID NO: 716542 - RNA, 64 nt, Homo Sapiens; identical to SEQ ID NO: 275495

SEQ ID NO: 716543 - RNA, 64 nt, Homo Sapiens; identical to SEQ ID NO: 275496

SEQ ID NO: 716544 - RNA, 64 nt, Homo Sapiens; identical to SEQ ID NO: 275497

SEQ ID NO: 716545 - RNA, 64 nt, Homo Sapiens; identical to SEQ ID NO: 275498

SEQ ID NO: 716546 - RNA, 64 nt, Homo Sapiens; identical to SEQ ID NO: 275499

SEQ ID NO: 716547 - RNA, 64 nt, Homo Sapiens; identical to SEQ ID NO: 275500

SEQ ID NO: 716548 - RNA, 64 nt, Homo Sapiens; identical to SEQ ID NO: 275501

SEQ ID NO: 716549 - RNA, 64 nt, Homo Sapiens; identical to SEQ ID NO: 275502

SEQ ID NO: 716550 - RNA, 64 nt, Homo Sapiens; identical to SEQ ID NO: 275503

SEQ ID NO: 716551 - RNA, 64 nt, Homo Sapiens; identical to SEQ ID NO: 275504

SEQ ID NO: 716552 - RNA, 64 nt, Homo Sapiens; identical to SEQ ID NO: 275505

SEQ ID NO: 716553 - RNA, 64 nt, Homo Sapiens; identical to SEQ ID NO: 275506

SEQ ID NO: 716554 - RNA, 64 nt, Homo Sapiens; identical to SEQ ID NO: 275507

SEQ ID NO: 716555 - RNA, 64 nt, Homo Sapiens; identical to SEQ ID NO: 275508

SEQ ID NO: 716556 - RNA, 64 nt, Homo Sapiens; identical to SEQ ID NO: 275509

SEQ ID NO: 716557 - RNA, 64 nt, Homo Sapiens; identical to SEQ ID NO: 275510

SEQ ID NO: 716558 - RNA, 64 nt, Homo Sapiens; identical to SEQ ID NO: 275511

SEQ ID NO: 716559 - RNA, 64 nt, Homo Sapiens; identical to SEQ ID NO: 275512

SEQ ID NO: 716560 - RNA, 64 nt, Homo Sapiens; identical to SEQ ID NO: 275513

SEQ ID NO: 716561 - RNA, 64 nt, Homo Sapiens; identical to SEQ ID NO: 275514

SEQ ID NO: 716562 - RNA, 64 nt, Homo Sapiens; identical to SEQ ID NO: 275515

SEQ ID NO: 716563 - RNA, 64 nt, Homo Sapiens; identical to SEQ ID NO: 275516

SEQ ID NO: 716564 - RNA, 64 nt, Homo Sapiens; identical to SEQ ID NO: 275517

SEQ ID NO: 716565 - RNA, 64 nt, Homo Sapiens
ucccucugcaguuuuggggagaucagcugcaggauuuuaacaggaauguuuuggucauugcauu

SEQ ID NO: 716566 - RNA, 64 nt, Homo Sapiens
uuccacauaaugaggagccaaagaaaucugauguuuuuaacaauuaaacugcuaauguuaaauu

SEQ ID NO: 716567 - RNA, 64 nt, Homo Sapiens
cuuaaaaaucuuaaagucacaaaaggaaaaagguuuuuaacauuuacaugaguuaacauuuuuu

SEQ ID NO: 716568 - RNA, 64 nt, Homo Sapiens
uuuccucuaugguaguuaaaauacagaauuagauuuuuaacaggugucauuugacuaaacguuu

SEQ ID NO: 716569 - RNA, 64 nt, Homo Sapiens
uuuacaagauaaaauuggacuucauuuaguaucuuuuuaacagaauuacuuggaauaaugagau

SEQ ID NO: 716570 - RNA, 64 nt, Homo Sapiens
acauuuaacagaucauuuauaaagcaggaguccauuuuaacacuuaccgacuuuuuuugguuug

SEQ ID NO: 716571 - RNA, 64 nt, Homo Sapiens
auauuuuauaccaaagccaauaaaaauucuuaacuuuuaacauauuuuaagccagguuacauuc

SEQ ID NO: 716572 - RNA, 64 nt, Homo Sapiens
acagacagaugaggacagagaaauaaugcaccacuuuuaacagaugaacugccaggcccggcca

SEQ ID NO: 716573 - RNA, 64 nt, Homo Sapiens
aacguggcuaggcuuccauuaggccacauuuguuuuuuaacaguuggacugaugggucugcucc

SEQ ID NO: 716574 - RNA, 64 nt, Homo Sapiens
gcgaguucuauauuuauuauuguauacuguagauuuuuaacaaaaaguuuagccuuuacuugaa

SEQ ID NO: 716575 - RNA, 64 nt, Homo Sapiens
auugcugacuuggauaauucucauguuauguuaauuuuaacauguaucugucaacaguuaauaa

SEQ ID NO: 716576 - RNA, 64 nt, Homo Sapiens
uucuauuacccagaacuuuucaacaccagucuguuuuuaacaggaugaguauugggccuaauug

SEQ ID NO: 716577 - RNA, 64 nt, Homo Sapiens
uuuuuaaggaaauauuuuuguaggacuaaaaaacuuuuaacaacccuauaaaagugaguguuua

SEQ ID NO: 716578 - RNA, 64 nt, Homo Sapiens
gaaaugacauuaggaucuaagucucccagcucauuuuuaacacuuaccaaaugucacaggagcu

SEQ ID NO: 716579 - RNA, 64 nt, Homo Sapiens
uugaauggaauaacugcauaauacucugucuucauuuuaacauggaaacuagagugcauuuaaa

SEQ ID NO: 716580 - RNA, 64 nt, Homo Sapiens
agaucucaacauauuuguugggccccuccccaaauuuuaacaucgauuacagcgugagcuaccu

SEQ ID NO: 716581 - RNA, 64 nt, Homo Sapiens
ugagaauaaauaggcauaugauacccacuuggacuuuuaacaaaaguaaaggaauaaauuugca

SEQ ID NO: 716582 - RNA, 64 nt, Homo Sapiens
aacagauguauuuugcacagugcacuuaugucuauuuuaacaauccuccugcaucuguauuuua

SEQ ID NO: 716583 - RNA, 64 nt, Homo Sapiens
aaucuggaagaaugacuguaucagucaauggggauuuuaacagacugccuugguacugccgagu

SEQ ID NO: 716584 - RNA, 64 nt, Homo Sapiens
auccaguuuuaagaggagccacuuaucaaagagauuuuaacaguaguaagaaggcaaagaauaa

SEQ ID NO: 716585 - RNA, 64 nt, Homo Sapiens
uauagugcuuauuugcaaaacugaagucuuaacauuuuaacauugauguuauugacauuauaca

SEQ ID NO: 716586 - RNA, 64 nt, Homo Sapiens
gcucauuuauguagaaugaaaaauauuguuaucguuuuaacauauacccugucaucaugcaaug

SEQ ID NO: 716587 - RNA, 64 nt, Homo Sapiens
guacuucuuaggcuuucauucugacuuuuuaaaauuuuaacaguggucugaaaugagaaacaua

SEQ ID NO: 716588 - RNA, 64 nt, Homo Sapiens
ccuucgugaauagagcaggcaucuuuaaggagacuuuuaacaguuauaggaaucauuuuuaaaa

SEQ ID NO: 716589 - RNA, 64 nt, Homo Sapiens
uguuaaacagagaaagggucauuuuguuuuacuuuuuuaacaugaugucaacuuuugacuaaga

SEQ ID NO: 716590 - RNA, 64 nt, Homo Sapiens
acuucuuagaaaauuaaaauuauuuuaauagaauuuuuaacaaaauugguaacuaggauaugua

SEQ ID NO: 716591 - RNA, 64 nt, Homo Sapiens
ccuuuauacagagaauucuacaaguuugcaaauauuuuaacaauauuaaaugugcaauagaacu

SEQ ID NO: 716592 - RNA, 64 nt, Homo Sapiens
uuauguuaaaccuuaauuuuuuuucuguaaucacuuuuaacacugcuaauagaaauuauguuuu

SEQ ID NO: 716593 - RNA, 64 nt, Homo Sapiens
aguccccuggaauuacacagcuuuagugcugagcuuuuaacaggaaauguggcccuagguauua

SEQ ID NO: 716594 - RNA, 64 nt, Homo Sapiens
aaguuacauuuagaucuauucugaagcuguucauuuuuaacaaauaaaauguuacagguuucac

SEQ ID NO: 716595 - RNA, 64 nt, Homo Sapiens
aaauucuuuucacuguauuuguuucacugacaguuuuuaacaauuagccagauguguaucagau

SEQ ID NO: 716596 - RNA, 64 nt, Homo Sapiens
aggacaaccacagagggauaaaaaccagaacaaauuuuaacaaagaaguacaaaaggaacuaug

SEQ ID NO: 716597 - RNA, 64 nt, Homo Sapiens
aguuaggcauaauauuucauaucagcagcucucauuuuaacaucauuaacaguauauuguacug

SEQ ID NO: 716598 - RNA, 64 nt, Homo Sapiens
gaacagaagugacuucauucggggaacauguauuuuuuaacauaaaauuauauuaaaaggaagc

SEQ ID NO: 716599 - RNA, 64 nt, Homo Sapiens
augugggugucagugucauuaaaccuuaguaccuuuuuaacagccgguuuccguagcaguuuug

SEQ ID NO: 716600 - RNA, 64 nt, Homo Sapiens
cucaaucaugggaauuuuaaacaucuuaggcacuuuuuaacauuagguaaaauuugcacacaaa

SEQ ID NO: 716601 - RNA, 64 nt, Homo Sapiens
uguauaagugcccaaguaauaguccauucauauuuuuuaacaaucugaaaacaacaacaacaaa

SEQ ID NO: 716602 - RNA, 64 nt, Homo Sapiens
agcuugucaaugcacauguaguauucuuuaaaguuuuuaacauagaaaaaaucuaaaggggaga

SEQ ID NO: 716603 - RNA, 64 nt, Homo Sapiens
augauguacaaacuaaggacaugacaucaaacauuuuuaacaaaagucgcagcacuaaaaaugg

SEQ ID NO: 716604 - RNA, 64 nt, Homo Sapiens
uauuuguccagaaggaagcuuggcugagcuggccuuuuaacauaggaauguauuucguuggaaa

SEQ ID NO: 716605 - RNA, 64 nt, Homo Sapiens
aguauuaaaauccauagacuaaaaucugagaauuuuuuaacauaugcaagucagccaaacauaa

SEQ ID NO: 716606 - RNA, 64 nt, Homo Sapiens
agggucaagaagugacuuguucagaacacauuguuuuuaacagaaaaaaaaucuuuuuauaaaa

SEQ ID NO: 716607 - RNA, 64 nt, Homo Sapiens
uuuaacagaaaaaaaaucuuuuuauaaaaugaacuuuuaacacuuggcucaaaccucuagguca

SEQ ID NO: 716608 - RNA, 64 nt, Homo Sapiens
cguaagggcccucaaaccguugggaacaaagccuuuuuaacacaugugagccaccgcacccagu

SEQ ID NO: 716609 - RNA, 64 nt, Homo Sapiens
aacugggugguccuuguagguguucacagcagccuuuuaacaacgcauugacguaucuuugaaa

SEQ ID NO: 716610 - RNA, 64 nt, Homo Sapiens
gauggguagagugggaauuuuuuccuaaucauguuuuuaacauuuuaaaauaaaauuuaauacu

SEQ ID NO: 716611 - RNA, 63 nt, Homo Sapiens
uuuaauucacguuugggaauauugaaugaauccauuuuaacauaagcacuguggugccaucuu

SEQ ID NO: 716612 - RNA, 64 nt, Homo Sapiens
ggucuccuuucuuacccaggacuccuuucuuccauuuuaacacuuccugguugcaagagggaug

SEQ ID NO: 716613 - RNA, 64 nt, Homo Sapiens
ugaauuaaauaagccucuuccccuuaccgauccuuuuuaacacucucagguuuguuuguuuccc

SEQ ID NO: 716614 - RNA, 64 nt, Homo Sapiens
aauuaagugaaaaucuucccuuuguuaaggagcuuuuuaacaagagugucuuugcuggguggug

SEQ ID NO: 716615 - RNA, 64 nt, Homo Sapiens
uuaguacauggcagauugccuguaagucuguucauuuuaacaacauacagggcugggcacggug

SEQ ID NO: 716616 - RNA, 64 nt, Homo Sapiens
auauaaaacuguuucaagccuaggauaagaauuauuuuaacaaccuuuuuaacaaaaauaaucu

SEQ ID NO: 716617 - RNA, 64 nt, Homo Sapiens
aauaaucuuaggauaagaaugaaaccuauucucuuuuuaacaaaauacagcugagugggaaccg

SEQ ID NO: 716618 - RNA, 64 nt, Homo Sapiens
aaaugcuuaggaucuucagacccaauagcucuaauuuuaacauuucuacccaauaagaggcucu

SEQ ID NO: 716619 - RNA, 64 nt, Homo Sapiens
aaagauaggcauagacacauaauuaugcuuaagcuuuuaacagcauuuuaaccgcucuaaaaau

SEQ ID NO: 716620 - RNA, 64 nt, Homo Sapiens
gcaaaugugugguaaacauucauauggccauuaauuuuaacauuaaaucguagguagggcaaug

SEQ ID NO: 716621 - RNA, 64 nt, Homo Sapiens
aguuagaaauuauaucccauaauuauuucuucacuuuuaacacaggacaaggcuucacauaaaa

SEQ ID NO: 716622 - RNA, 64 nt, Homo Sapiens
auauuuuaaaaguuauaaacucagguuuuuuacauuuuaacaaaaaauuuuuuuguuuguaauu

SEQ ID NO: 716623 - RNA, 64 nt, Homo Sapiens
ccucucucucuacauauaaauuuuuaugacaauauuuuaacauaauauauagccucaauugagu

SEQ ID NO: 716624 - RNA, 64 nt, Homo Sapiens
agaguguggacauuuuuauuacagaggcuuaauguuuuaacaaaaaauaagaaauacauuuuug

SEQ ID NO: 716625 - RNA, 64 nt, Homo Sapiens
uucaaugacuugaucaucugcuuccuuuuugaauuuuuaacagauaguaaguaaauuugguggu

SEQ ID NO: 716626 - RNA, 64 nt, Homo Sapiens
gcuccuggagagcaguauugcuguaguaggaauguuuuaacagugucauaugaaaaagaacaaa

SEQ ID NO: 716627 - RNA, 64 nt, Homo Sapiens
acagacccuaaauuuuauuaguuauauacuauacuuuuaacagucccacacagguuuuauuacu

SEQ ID NO: 716628 - RNA, 64 nt, Homo Sapiens
uuuuucugguuuaaaaaccacuguuggauagauguuuuaacaguauauacuuuugaauacauca

SEQ ID NO: 716629 - RNA, 64 nt, Homo Sapiens
gauuaaaauauacugcagggacuuuuauaaauuauuuuaacaaaccgucuacauauaacacaaa

SEQ ID NO: 716630 - RNA, 64 nt, Homo Sapiens
aagauuugugcaccacuacuuauaguucugugaauuuuaacagaauugaaauuucuucuuggug

SEQ ID NO: 716631 - RNA, 64 nt, Homo Sapiens
cuggaacauaaaagauuuuuucuuaacuuuuuuuuuuuaacacacuaaucuucaguuggaugaa

SEQ ID NO: 716632 - RNA, 64 nt, Homo Sapiens
uucuaccuuuuaauuugaaaacaaggaaauuaaauuuuaacagaaaucuuuuaaguauguuaua

SEQ ID NO: 716633 - RNA, 64 nt, Homo Sapiens
uuuuucuuaaaaaugaaaaaaaaaucaaagauuuuuuuaacaguucucagacuuaacuguugcc

SEQ ID NO: 716634 - RNA, 64 nt, Homo Sapiens
ucuaagcagugaaauguaaugauaaagagggauauuuuaacauauuuccgaaugaaugacucau

SEQ ID NO: 716635 - RNA, 64 nt, Homo Sapiens
auggcaucucaauauuuuugagaacuacauuuguuuuuaacauauguguuugagaaaagcauau

SEQ ID NO: 716636 - RNA, 64 nt, Homo Sapiens
aacucauauugaaacuucaucuagucucuuaauuuuuuaacacuaaauucaagucauuuguuuu

SEQ ID NO: 716637 - RNA, 64 nt, Homo Sapiens
uaauacauuucuuccacauuuuuuccagugugguuuuuaacagacuuuuuauaaaaaagaacau

SEQ ID NO: 716638 - RNA, 64 nt, Homo Sapiens
uuuacacuggaaugauuuagaguuuuaaaaguaguuuuaacaacuuauuucuuggugaaacaaa

SEQ ID NO: 716639 - RNA, 64 nt, Homo Sapiens
aagcaucagcucugcuucguucaguuacaggugguuuuaacagauucccaggauuccuuccaag

SEQ ID NO: 716640 - RNA, 64 nt, Homo Sapiens
ucucucaucccuuucccaggcugggucucucuacuuuuaacacaugugagccaccacacccagc

SEQ ID NO: 716641 - RNA, 64 nt, Homo Sapiens
ugccuugauaaauauauaugaucauugaaauacuuuuuaacaaaaaacagauucuauauuauua

SEQ ID NO: 716642 - RNA, 64 nt, Homo Sapiens
uauauccuauauaggaaacuaagcauuguauuuuuuuuaacaaaucuaaaaaagcacuaugaac

SEQ ID NO: 716643 - RNA, 64 nt, Homo Sapiens
gcaauuacauggauacuuuuagauauauuuaaaauuuuaacauuggcaucuaaaguguuauuug

SEQ ID NO: 716644 - RNA, 64 nt, Homo Sapiens
aaugcccacguaaauagcugucaucaucauuaucuuuuaacauuuugggggacuuuccaguuga

SEQ ID NO: 716645 - RNA, 64 nt, Homo Sapiens
aaaauuaaaacaacuguuaacauccuuaugauguuuuuaacaauauaacugccaucuccaacua

SEQ ID NO: 716646 - RNA, 64 nt, Homo Sapiens
cauggacauggucuuaaucaaccuaguagcuggguuuuaacacuauguguacuuuuguccucaa

SEQ ID NO: 716647 - RNA, 64 nt, Homo Sapiens
ucuugaauguacacauaaaguuugaugaaaguucuuuuaacaugaaugauuucuuaugguuuau

SEQ ID NO: 716648 - RNA, 64 nt, Homo Sapiens
cagacauacccauauuuaaagaguuuggaggccuuuuuaacauggagggcauuuguuugagugu

SEQ ID NO: 716649 - RNA, 64 nt, Homo Sapiens
acucaugaaugugcaguuugccgcacaucccacuuuuuaacaaauauguugauguguaaguuca

SEQ ID NO: 716650 - RNA, 64 nt, Homo Sapiens
auuuuacugcagcuuugaugugcauauuugaacuuuuuaacauuuguaacuuugguggcaaaga

SEQ ID NO: 716651 - RNA, 64 nt, Homo Sapiens
ugucaguacagcguauauggaaaauucaaguuguuuuuaacauauucaaguauguucaguauaa

SEQ ID NO: 716652 - RNA, 64 nt, Homo Sapiens
aaugucaagucuuuauaguucuuugaacuuucucuuuuaacaaauuaacacuccccuuaacugu

SEQ ID NO: 716653 - RNA, 64 nt, Homo Sapiens
gguggcuagccaaaguuuagagugccuuuuuuccuuuuaacauagcaccacgaaauacauaugc

SEQ ID NO: 716654 - RNA, 64 nt, Homo Sapiens
uuauguuuacaggcuuccuguuauuuaaauuuuuuuuuaacaucacugagugcacuuuacaucu

SEQ ID NO: 716655 - RNA, 64 nt, Homo Sapiens
guauuuuugaaggagcuaauaguuaauuuuauguuuuuaacauguaugucucugguuaggauga

SEQ ID NO: 716656 - RNA, 64 nt, Homo Sapiens
uaccuuauuuuucacuguacaaaaauuuaaguuuuuuuaacaacauuauguaagcaaaaccaau

SEQ ID NO: 716657 - RNA, 64 nt, Homo Sapiens
cacagcuacauaugacauuuauuaaguguaauuauuuuaacacugcacagcacacuauuaaaau

SEQ ID NO: 716658 - RNA, 64 nt, Homo Sapiens
aauggguacagagaaaaaaaauuuaagaccaauauuuuaacaggauaauuugguuauuacucac

SEQ ID NO: 716659 - RNA, 64 nt, Homo Sapiens
gaaaugcuuauuuuuaugacuauuuauuccaauguuuuaacaagaagcacagagauuuauagua

SEQ ID NO: 716660 - RNA, 64 nt, Homo Sapiens
cauguugggugagaggggaagaauuuuaguuuucuuuuaacaugugggugaauggauguguguu

SEQ ID NO: 716661 - RNA, 64 nt, Homo Sapiens
uuuuuaauauguaauucuucuuauguaaggaugauuuuaacaacuuaaaagaguugcauucuua

SEQ ID NO: 716662 - RNA, 64 nt, Homo Sapiens
uaauuauuggcuuguuucauuuuuuuccuccaguuuuuaacaagaucacauaacuggcuuauuu

SEQ ID NO: 716663 - RNA, 64 nt, Homo Sapiens
uccaguuuuuaacaagaucacauaacuggcuuauuuuuaacagcuuugucaaacuacaauuuac

SEQ ID NO: 716664 - RNA, 64 nt, Homo Sapiens
uugaccucucuccaaaacagucugcaaauaguucuuuuaacaauauuuuuaauagccaaguagu

SEQ ID NO: 716665 - RNA, 64 nt, Homo Sapiens
auuaaucccuuuaacaaaaaucaaaucaguuuccuuuuaacauacuggaacugguuucuauuug

SEQ ID NO: 716666 - RNA, 64 nt, Homo Sapiens
gugaugacacaacaauauguauuuaaaauuuaaauuuuaacaaagauuuaguuuguagaauuua

SEQ ID NO: 716667 - RNA, 64 nt, Homo Sapiens
guacagacaauacagaaauguacuguucccuuuauuuuaacauugcaagcaagaaagcagaaac

SEQ ID NO: 716668 - RNA, 64 nt, Homo Sapiens
agaaacccuacaaaugugaagaacguggccuggcuuuuaacaaauccucaacauuuacuaagca

SEQ ID NO: 716669 - RNA, 64 nt, Homo Sapiens
agcgaaacuacaauccugaaugaugucacagugcuuuuaacaauaccucaaacuuuucuaaaca

SEQ ID NO: 716670 - RNA, 64 nt, Homo Sapiens
uacccuuuauuuuuacuuccccuugacucauauguuuuaacaugauuuuaacaaacugcacuua

SEQ ID NO: 716671 - RNA, 64 nt, Homo Sapiens
uuuacuuccccuugacucauauguuuuaacaugauuuuaacaaacugcacuuauuaagaaaugu

SEQ ID NO: 716672 - RNA, 64 nt, Homo Sapiens
uaauuuucaaaaacucaaucaauguaauucaguauuuuaacaaaaggaaugaaaaauuaucauc

SEQ ID NO: 716673 - RNA, 64 nt, Homo Sapiens
ccuguguccauguguucucauuguuauacgaacauuuuaacaauguuaauucuugcagaccaug

SEQ ID NO: 716674 - RNA, 64 nt, Homo Sapiens
augacuacuagaaaacuaaaaacaaaacaaaucauuuuaacaagcgaagaaaaaagcaauacug

SEQ ID NO: 716675 - RNA, 64 nt, Homo Sapiens
uuaaauacuauugugcauucaauauauucaaccuuuuuaacauguucagauuauaugugauguu

SEQ ID NO: 716676 - RNA, 64 nt, Homo Sapiens
caaaugacuagucagaaccuugcuuaacaugagauuuuaacacaacaaugaaauuugccuuguc

SEQ ID NO: 716677 - RNA, 64 nt, Homo Sapiens
uaacccucaucugcaauauuuucaccccuaaaauuuuuaacaggguuuccuuuuuuucucacga

SEQ ID NO: 716678 - RNA, 64 nt, Homo Sapiens
gauauuuauguaauaagaaaaucaauauuuugcuuuuuaacaagaacagguuauauuguacagg

SEQ ID NO: 716679 - RNA, 64 nt, Homo Sapiens
uuauauuguacaggaucaauuguaagcacgauuuuuuuaacaggccucuuaucuaggagcuguu

SEQ ID NO: 716680 - RNA, 64 nt, Homo Sapiens
cuguauauugcauagcauuacacauuuaugccuauuuuaacauuaacuucuaaagaaguuuuuu

SEQ ID NO: 716681 - RNA, 64 nt, Homo Sapiens
guggauacagucuugguucuccaucuguaauuuuuuuuaacaguuugcuauagcuuacugcuua

SEQ ID NO: 716682 - RNA, 64 nt, Homo Sapiens
aauauuugaagauuuguagaacaaauauugugcauuuuaacagucaaaguaagcaauggaggua

SEQ ID NO: 716683 - RNA, 64 nt, Homo Sapiens
aguguaacaaauaaggucggggcacuaauuuugauuuuaacauuaaaaacaaagcuaaccauau

SEQ ID NO: 716684 - RNA, 64 nt, Homo Sapiens
uggaaguaaauuuguuucacauuauuuuucuuuuuuuuaacaaaaaacaugugauuugcaaauu

SEQ ID NO: 716685 - RNA, 64 nt, Homo Sapiens
auauuuugagagcuuugggucuguagcagagauguuuuaacauuuuuucagacuacugaaaucc

SEQ ID NO: 716686 - RNA, 64 nt, Homo Sapiens
gugacaaugagggcuuuuucauauuuugguucaguuuuaacaucaaggaaacuuaugcagagua

SEQ ID NO: 716687 - RNA, 64 nt, Homo Sapiens
aacgcagguguagaaucagaugaauacuugaacauuuuaacagucuaaucagcauauuuuuguc

SEQ ID NO: 716688 - RNA, 64 nt, Homo Sapiens; identical to SEQ ID NO: 99247

SEQ ID NO: 716689 - RNA, 64 nt, Homo Sapiens; identical to SEQ ID NO: 99248

SEQ ID NO: 716690 - RNA, 64 nt, Homo Sapiens; identical to SEQ ID NO: 99249

SEQ ID NO: 716691 - RNA, 64 nt, Homo Sapiens; identical to SEQ ID NO: 99250

SEQ ID NO: 716692 - RNA, 64 nt, Homo Sapiens; identical to SEQ ID NO: 99251

SEQ ID NO: 716693 - RNA, 64 nt, Homo Sapiens; identical to SEQ ID NO: 99252

SEQ ID NO: 716694 - RNA, 64 nt, Homo Sapiens; identical to SEQ ID NO: 99253

SEQ ID NO: 716695 - RNA, 64 nt, Homo Sapiens; identical to SEQ ID NO: 99254

SEQ ID NO: 716696 - RNA, 64 nt, Homo Sapiens; identical to SEQ ID NO: 99255

SEQ ID NO: 716697 - RNA, 64 nt, Homo Sapiens; identical to SEQ ID NO: 99256

SEQ ID NO: 716698 - RNA, 64 nt, Homo Sapiens; identical to SEQ ID NO: 99257

SEQ ID NO: 716699 - RNA, 64 nt, Homo Sapiens; identical to SEQ ID NO: 99258

SEQ ID NO: 716700 - RNA, 64 nt, Homo Sapiens; identical to SEQ ID NO: 99259

SEQ ID NO: 716701 - RNA, 64 nt, Homo Sapiens; identical to SEQ ID NO: 99260

SEQ ID NO: 716702 - RNA, 64 nt, Homo Sapiens; identical to SEQ ID NO: 99261

SEQ ID NO: 716703 - RNA, 64 nt, Homo Sapiens; identical to SEQ ID NO: 99262

SEQ ID NO: 716704 - RNA, 64 nt, Homo Sapiens; identical to SEQ ID NO: 99263

SEQ ID NO: 716705 - RNA, 64 nt, Homo Sapiens; identical to SEQ ID NO: 99264

SEQ ID NO: 716706 - RNA, 64 nt, Homo Sapiens; identical to SEQ ID NO: 99265

SEQ ID NO: 716707 - RNA, 64 nt, Homo Sapiens; identical to SEQ ID NO: 99266

SEQ ID NO: 716708 - RNA, 64 nt, Homo Sapiens; identical to SEQ ID NO: 99267

SEQ ID NO: 716709 - RNA, 64 nt, Homo Sapiens; identical to SEQ ID NO: 99268

SEQ ID NO: 716710 - RNA, 64 nt, Homo Sapiens; identical to SEQ ID NO: 99269

SEQ ID NO: 716711 - RNA, 64 nt, Homo Sapiens; identical to SEQ ID NO: 99270

SEQ ID NO: 716712 - RNA, 64 nt, Homo Sapiens; identical to SEQ ID NO: 99271

SEQ ID NO: 716713 - RNA, 64 nt, Homo Sapiens; identical to SEQ ID NO: 133252

SEQ ID NO: 716714 - RNA, 64 nt, Homo Sapiens; identical to SEQ ID NO: 133253

SEQ ID NO: 716715 - RNA, 64 nt, Homo Sapiens; identical to SEQ ID NO: 133254

SEQ ID NO: 716716 - RNA, 64 nt, Homo Sapiens; identical to SEQ ID NO: 133255

SEQ ID NO: 716717 - RNA, 64 nt, Homo Sapiens; identical to SEQ ID NO: 133256

SEQ ID NO: 716718 - RNA, 64 nt, Homo Sapiens; identical to SEQ ID NO: 133257

SEQ ID NO: 716719 - RNA, 64 nt, Homo Sapiens; identical to SEQ ID NO: 133258

SEQ ID NO: 716720 - RNA, 64 nt, Homo Sapiens; identical to SEQ ID NO: 133259

SEQ ID NO: 716721 - RNA, 64 nt, Homo Sapiens; identical to SEQ ID NO: 133260

SEQ ID NO: 716722 - RNA, 64 nt, Homo Sapiens; identical to SEQ ID NO: 133261

SEQ ID NO: 716723 - RNA, 64 nt, Homo Sapiens; identical to SEQ ID NO: 133262

SEQ ID NO: 716724 - RNA, 57 nt, Homo Sapiens; identical to SEQ ID NO: 133263

SEQ ID NO: 716725 - RNA, 64 nt, Homo Sapiens; identical to SEQ ID NO: 133264

SEQ ID NO: 716726 - RNA, 64 nt, Homo Sapiens; identical to SEQ ID NO: 133265

SEQ ID NO: 716727 - RNA, 64 nt, Homo Sapiens; identical to SEQ ID NO: 133266

SEQ ID NO: 716728 - RNA, 64 nt, Homo Sapiens; identical to SEQ ID NO: 133267

SEQ ID NO: 716729 - RNA, 64 nt, Homo Sapiens; identical to SEQ ID NO: 133268

SEQ ID NO: 716730 - RNA, 64 nt, Homo Sapiens; identical to SEQ ID NO: 133269

SEQ ID NO: 716731 - RNA, 64 nt, Homo Sapiens; identical to SEQ ID NO: 133270

SEQ ID NO: 716732 - RNA, 64 nt, Homo Sapiens; identical to SEQ ID NO: 366005

SEQ ID NO: 716733 - RNA, 64 nt, Homo Sapiens; identical to SEQ ID NO: 366006

SEQ ID NO: 716734 - RNA, 64 nt, Homo Sapiens; identical to SEQ ID NO: 366007

SEQ ID NO: 716735 - RNA, 64 nt, Homo Sapiens; identical to SEQ ID NO: 366008

SEQ ID NO: 716736 - RNA, 64 nt, Homo Sapiens; identical to SEQ ID NO: 366009

SEQ ID NO: 716737 - RNA, 64 nt, Homo Sapiens; identical to SEQ ID NO: 366010

SEQ ID NO: 716738 - RNA, 64 nt, Homo Sapiens; identical to SEQ ID NO: 366011

SEQ ID NO: 716739 - RNA, 64 nt, Homo Sapiens; identical to SEQ ID NO: 366012

SEQ ID NO: 716740 - RNA, 64 nt, Homo Sapiens; identical to SEQ ID NO: 366013

SEQ ID NO: 716741 - RNA, 64 nt, Homo Sapiens; identical to SEQ ID NO: 366014

SEQ ID NO: 716742 - RNA, 64 nt, Homo Sapiens; identical to SEQ ID NO: 366015

SEQ ID NO: 716743 - RNA, 64 nt, Homo Sapiens; identical to SEQ ID NO: 366016

SEQ ID NO: 716744 - RNA, 64 nt, Homo Sapiens; identical to SEQ ID NO: 366017

SEQ ID NO: 716745 - RNA, 64 nt, Homo Sapiens; identical to SEQ ID NO: 366018

SEQ ID NO: 716746 - RNA, 64 nt, Homo Sapiens; identical to SEQ ID NO: 366019

SEQ ID NO: 716747 - RNA, 64 nt, Homo Sapiens; identical to SEQ ID NO: 366020

SEQ ID NO: 716748 - RNA, 64 nt, Homo Sapiens; identical to SEQ ID NO: 366021

SEQ ID NO: 716749 - RNA, 64 nt, Homo Sapiens; identical to SEQ ID NO: 366022

SEQ ID NO: 716750 - RNA, 64 nt, Homo Sapiens; identical to SEQ ID NO: 366023

SEQ ID NO: 716751 - RNA, 64 nt, Homo Sapiens; identical to SEQ ID NO: 366024

SEQ ID NO: 716752 - RNA, 64 nt, Homo Sapiens
ucaaguaaagaagccauuuccacuacagugagaaagcccggaucccaacaguugucaaauugau

SEQ ID NO: 716753 - RNA, 64 nt, Homo Sapiens
uagaaacucagcagaagcugguaaaaacauggggagcccggaggacaggcugcuguccagggca

SEQ ID NO: 716754 - RNA, 64 nt, Homo Sapiens; identical to SEQ ID NO: 692338

SEQ ID NO: 716755 - RNA, 64 nt, Homo Sapiens; identical to SEQ ID NO: 692339

SEQ ID NO: 716756 - RNA, 64 nt, Homo Sapiens; identical to SEQ ID NO: 692340

SEQ ID NO: 716757 - RNA, 64 nt, Homo Sapiens; identical to SEQ ID NO: 692341

SEQ ID NO: 716758 - RNA, 64 nt, Homo Sapiens; identical to SEQ ID NO: 692342

SEQ ID NO: 716759 - RNA, 64 nt, Homo Sapiens; identical to SEQ ID NO: 692343

SEQ ID NO: 716760 - RNA, 64 nt, Homo Sapiens; identical to SEQ ID NO: 692344

SEQ ID NO: 716761 - RNA, 64 nt, Homo Sapiens; identical to SEQ ID NO: 692345

SEQ ID NO: 716762 - RNA, 64 nt, Homo Sapiens; identical to SEQ ID NO: 692346

SEQ ID NO: 716763 - RNA, 64 nt, Homo Sapiens; identical to SEQ ID NO: 692347

SEQ ID NO: 716764 - RNA, 64 nt, Homo Sapiens; identical to SEQ ID NO: 692348

SEQ ID NO: 716765 - RNA, 64 nt, Homo Sapiens; identical to SEQ ID NO: 692349

SEQ ID NO: 716766 - RNA, 64 nt, Homo Sapiens; identical to SEQ ID NO: 692350

SEQ ID NO: 716767 - RNA, 64 nt, Homo Sapiens; identical to SEQ ID NO: 692351

SEQ ID NO: 716768 - RNA, 64 nt, Homo Sapiens; identical to SEQ ID NO: 692352

SEQ ID NO: 716769 - RNA, 64 nt, Homo Sapiens; identical to SEQ ID NO: 692353

SEQ ID NO: 716770 - RNA, 64 nt, Homo Sapiens; identical to SEQ ID NO: 692354

SEQ ID NO: 716771 - RNA, 64 nt, Homo Sapiens; identical to SEQ ID NO: 692355

SEQ ID NO: 716772 - RNA, 62 nt, Homo Sapiens
uucagugucuucucagaaacaaccagcugagaaggcuacaagugacgacaaagauucuguuu

SEQ ID NO: 716773 - RNA, 62 nt, Homo Sapiens
uucagugucuucucagaaacaaccagcugagaaggcuacaagugacgagaaagauucuguuu

SEQ ID NO: 716774 - RNA, 62 nt, Homo Sapiens
uucagugucuucucagaaacaaccagccucaaaggcuacaagugacaagacagauucugcuu

SEQ ID NO: 716775 - RNA, 62 nt, Homo Sapiens
uucagugucuucucagaaacaaccagccuugaaggcuacaacugacgaggaagacucuguuu

SEQ ID NO: 716776 - RNA, 62 nt, Homo Sapiens
uucagugucuucucagaaacaaccagccuugaaggcuacaacugaugagaaagauucuguuu

SEQ ID NO: 716777 - RNA, 62 nt, Homo Sapiens
uucagugucuucucggaaaaaaccagccuugaaggcuacaagugaugagaaggauucuuuuu

SEQ ID NO: 716778 - RNA, 62 nt, Homo Sapiens
uucagugucuucugagaaaccaccaggcuugaaggcuacaagugaugagaaagauucuguuu

SEQ ID NO: 716779 - RNA, 62 nt, Homo Sapiens
uaucuguuuuuauauuucuguuaaaauauaugaggcuacagaacuaaaaauuaaaaccucuu

SEQ ID NO: 716780 - RNA, 62 nt, Homo Sapiens
aggcaggaggaucacuugagccccggaggucgaggcuacagugagccaagagugcacuacug

SEQ ID NO: 716781 - RNA, 64 nt, Homo Sapiens; identical to SEQ ID NO: 216152

SEQ ID NO: 716782 - RNA, 64 nt, Homo Sapiens; identical to SEQ ID NO: 216153

SEQ ID NO: 716783 - RNA, 64 nt, Homo Sapiens; identical to SEQ ID NO: 216154

SEQ ID NO: 716784 - RNA, 64 nt, Homo Sapiens; identical to SEQ ID NO: 216155

SEQ ID NO: 716785 - RNA, 64 nt, Homo Sapiens; identical to SEQ ID NO: 216156

SEQ ID NO: 716786 - RNA, 64 nt, Homo Sapiens; identical to SEQ ID NO: 216157

SEQ ID NO: 716787 - RNA, 64 nt, Homo Sapiens; identical to SEQ ID NO: 216158

SEQ ID NO: 716788 - RNA, 64 nt, Homo Sapiens; identical to SEQ ID NO: 216159

SEQ ID NO: 716789 - RNA, 64 nt, Homo Sapiens; identical to SEQ ID NO: 270302

SEQ ID NO: 716790 - RNA, 64 nt, Homo Sapiens; identical to SEQ ID NO: 270303

SEQ ID NO: 716791 - RNA, 64 nt, Homo Sapiens; identical to SEQ ID NO: 270304

SEQ ID NO: 716792 - RNA, 64 nt, Homo Sapiens; identical to SEQ ID NO: 270305

SEQ ID NO: 716793 - RNA, 64 nt, Homo Sapiens; identical to SEQ ID NO: 270306

SEQ ID NO: 716794 - RNA, 64 nt, Homo Sapiens; identical to SEQ ID NO: 270307

SEQ ID NO: 716795 - RNA, 64 nt, Homo Sapiens
aaacuugguuaugucaguuccuguguguagacaguaaggaaaaaaaggcaugcuauguguuacg

SEQ ID NO: 716796 - RNA, 64 nt, Homo Sapiens
ugcauuuucacccauucugugguucauuguaguuuaaggaaaccaagcauauagaugcauuagu

SEQ ID NO: 716797 - RNA, 64 nt, Homo Sapiens
uuaaaaacuuccccucaaaauuaaaaguaacuacuaaggaaagguuuaauucuucuucaguuca

SEQ ID NO: 716798 - RNA, 64 nt, Homo Sapiens
ugaucugggccuuuuuaaaaguuggguuacuguuuaaggaaagucuugguaacuauggcuuuau

SEQ ID NO: 716799 - RNA, 64 nt, Homo Sapiens
gguaaguggagguagucaggaaaggggaaguaauuaaggaaauuuaaguaauugaccaaaugga

SEQ ID NO: 716800 - RNA, 64 nt, Homo Sapiens
gcuauucacccaguaaacccaucagaugccuauguaaggaaagucucaguaugcaaaaccugaa

SEQ ID NO: 716801 - RNA, 64 nt, Homo Sapiens
aaaauacuuauauauacacacaacagaaacaaguuaaggaaacauucuccuaguuguguguggg

SEQ ID NO: 716802 - RNA, 64 nt, Homo Sapiens
agacuaaagcaagagaucuguguuucuccaaauauaaggaaaaaacuuuuaugucaaacucuuc

SEQ ID NO: 716803 - RNA, 64 nt, Homo Sapiens
uuuuuguucuuauacaaaaauuuuaacaacuuuuuaaggaaauauguuuauaggacuaaaaaac

SEQ ID NO: 716804 - RNA, 64 nt, Homo Sapiens
aaauauaauaaccagugcugguaaaaagauuuuauaaggaaaacaacaguacacaauuuauaaa

SEQ ID NO: 716805 - RNA, 64 nt, Homo Sapiens
acugaaauauagaugggaaaggaaguccuaguuuuaaggaaaccagauaacaucaugaggugug

SEQ ID NO: 716806 - RNA, 64 nt, Homo Sapiens
cacaucagaaugauacagaguuagcagguuuuucuaaggaaaugccauucaaaugccuccuaac

SEQ ID NO: 716807 - RNA, 64 nt, Homo Sapiens
uuauuugcauucuccuuguggauuuuuugucaccuaaggaaaugcauuugaugagugcuggaaa

SEQ ID NO: 716808 - RNA, 64 nt, Homo Sapiens
cuucuuaaaaguguaaagaagccucauaagaucauaaggaaaauguauauaugcuuuucacagc

SEQ ID NO: 716809 - RNA, 64 nt, Homo Sapiens
uguuaacaaugccaugaaagcauuuucuuucuccuaaggaaaagugaauuucuuaucagaauau

SEQ ID NO: 716810 - RNA, 64 nt, Homo Sapiens
gcuucuuuugagauuaauucaacugauuuuuccauaaggaaaauguauuagauccuauaaauug

SEQ ID NO: 716811 - RNA, 64 nt, Homo Sapiens
aguaauuaugagguguagcaaaauagucacuguuuaaggaaaaauccuugaaugucuguugaug

SEQ ID NO: 716812 - RNA, 64 nt, Homo Sapiens
ggaaacugaaacucuguggaauaaauacauagauuaaggaaauaucuauauuguauguauguau

SEQ ID NO: 716813 - RNA, 64 nt, Homo Sapiens
gaaaauaaucuggcaucaguuguuuguauuuuauuaaggaaaauauaagugaauuuugugcucu

SEQ ID NO: 716814 - RNA, 64 nt, Homo Sapiens
ccgauucuucauuauaaacauaguauauaugugguaaggaaaugaagauccuuauauuuacauc

SEQ ID NO: 716815 - RNA, 64 nt, Homo Sapiens
aaagggggucacgcacaucacugugugacacacguaaggaaaggaaacuaaaaugucuuaaugg

SEQ ID NO: 716816 - RNA, 64 nt, Homo Sapiens
uuuuuauuuguuauacaauggaagcacaauguuauaaggaaagguaauuuuaagcuaacaacca

SEQ ID NO: 716817 - RNA, 64 nt, Homo Sapiens
ucuuugauuauuuaucaaaaaaguauaaaucuuuuaaggaaaauguuagaauuuuaaaguuuuu

SEQ ID NO: 716818 - RNA, 64 nt, Homo Sapiens
auaaggacuuuuugauggaauuaaaugugggagguaaggaaaaggauuuagagguaaaaguaca

SEQ ID NO: 716819 - RNA, 64 nt, Homo Sapiens
gguaaccaauccagugaauagaugugcccuuuuauaaggaaacuucugauguuuauuaaaaaaa

SEQ ID NO: 716820 - RNA, 64 nt, Homo Sapiens
uccauuugccucuuccuuccuauuucccuuccgcuaaggaaaaaaauuggugucacauuuguaa

SEQ ID NO: 716821 - RNA, 64 nt, Homo Sapiens
auuuuuaaaaauuuagcuucuagauuccauuugguaaggaaaucaauauuggaaguauugcuaa

SEQ ID NO: 716822 - RNA, 64 nt, Homo Sapiens
aauauaaucucauguauaaauuuuuuucuuuaaauaaggaaaccauuuccauucuuaauuguaa

SEQ ID NO: 716823 - RNA, 64 nt, Homo Sapiens
aaacuauuuuuuuaaucaucgaaccaaguguuuuuaaggaaacaagccaccacgccuggcccau

SEQ ID NO: 716824 - RNA, 64 nt, Homo Sapiens
uuuuuugauuuugcguaagacccuuuaaacuuuguaaggaaauaaauaauaauaaaaaaaaaag

SEQ ID NO: 716825 - RNA, 64 nt, Homo Sapiens
uuaggagaaagugaggugcuguuuccuuuuaguuuaaggaaaaaugccacacuaauguuaccug

SEQ ID NO: 716826 - RNA, 64 nt, Homo Sapiens
cuacuugaccaagcaaaggggcugaaaaacugaauaaggaaacaacuuuauaagagaaacagug

SEQ ID NO: 716827 - RNA, 64 nt, Homo Sapiens
aacuugcccacaugauaacucauguuugcuuuaauaaggaaaauauguuauuugagguuaauua

SEQ ID NO: 716828 - RNA, 64 nt, Homo Sapiens
ucugaggacagauuagaaagacuucaggaaauucuaaggaaauuucuguaccuggagagagagu

SEQ ID NO: 716829 - RNA, 64 nt, Homo Sapiens
uaaaucuaacagaggauuuucagaguagugaauguaaggaaagcuuaauggaucucucccaccu

SEQ ID NO: 716830 - RNA, 64 nt, Homo Sapiens
aagcucuucuauccacccuuacgucagaugccucuaaggaaaauacacuagguaaguuaauuuu

SEQ ID NO: 716831 - RNA, 64 nt, Homo Sapiens
uuuagacuucaaggaauuccaaugaugaagauuuuaaggaaaguauuuuauauucaacagguau

SEQ ID NO: 716832 - RNA, 64 nt, Homo Sapiens
auagcuuuguaauuuaaauuauguguaaauauauuaaggaaagucaugagaacaucuuaaaacu

SEQ ID NO: 716833 - RNA, 64 nt, Homo Sapiens
uguuuuauaacugaguaauaaguugaagggcuuauaaggaaaaaggauguauuauugagaagua

SEQ ID NO: 716834 - RNA, 64 nt, Homo Sapiens
gugucugucacugguuagggguaagaugaggggauaaggaaagagacuuuucaauaaguuguga

SEQ ID NO: 716835 - RNA, 64 nt, Homo Sapiens
uuucuaaauuuauuuaaaugcuuagcaggaagcauaaggaaaagccaucggccuccaauaccca

SEQ ID NO: 716836 - RNA, 64 nt, Homo Sapiens
aaauuguguaaacauuuaauagcaaauuauuauuuaaggaaaauuaaauuugugacaggauugu

SEQ ID NO: 716837 - RNA, 64 nt, Homo Sapiens
cugacguauguacuagauggacccgcccugaugcuaaggaaaccagcuggaacaauucagauuc

SEQ ID NO: 716838 - RNA, 64 nt, Homo Sapiens
uaauuuaggguggcagccaaaaauauuacuguuuuaaggaaaacaaaaaaaaacaguaaaagug

SEQ ID NO: 716839 - RNA, 64 nt, Homo Sapiens
guuuucuuaaugagaugaugccaaacgaaaugucuaaggaaaaucuuucaacagaaaaccaaaa

SEQ ID NO: 716840 - RNA, 64 nt, Homo Sapiens
aagaaggaaauaucaucguauuucuuuuuuuuaauaaggaaaaaauaauauccauacagucaag

SEQ ID NO: 716841 - RNA, 64 nt, Homo Sapiens
cuuccucugcaaaaagauuuaacaaauacauucauaaggaaauguguguuguaacaaauauauu

SEQ ID NO: 716842 - RNA, 64 nt, Homo Sapiens
cuuccaaaaucuguaggugcaauuugcagauagcuaaggaaaauuuaccauaauuuaaucaguc

SEQ ID NO: 716843 - RNA, 64 nt, Homo Sapiens
aguccauaaaauuggcaagaauuguaggguuaguuaaggaaauuagacagguaaauguuauaua

SEQ ID NO: 716844 - RNA, 64 nt, Homo Sapiens
aaagcgcaaaaccaaguacaccuuuuuuuuuuuuuaaggaaaaacauuuuauacauuucagugg

SEQ ID NO: 716845 - RNA, 64 nt, Homo Sapiens
guucaaggccagauaugccuacagcuccagcauauaaggaaaguaugacugagaaaacuuguuu

SEQ ID NO: 716846 - RNA, 64 nt, Homo Sapiens
aaagggaaaucaaauuaauuuuucucguuagacauaaggaaauuuaaggaaaaacagcuuuaag

SEQ ID NO: 716847 - RNA, 64 nt, Homo Sapiens
caaauuaauuuuucucguuagacauaaggaaauuuaaggaaaaacagcuuuaagaacaguuacu

SEQ ID NO: 716848 - RNA, 64 nt, Homo Sapiens
gacacaagcuuuccuagagagcaaacauuuucccuaaggaaacaaggaucacaguuuuuaaaag

SEQ ID NO: 716849 - RNA, 64 nt, Homo Sapiens
gaaagucaugaucauccuaauucuugcauuuccauaaggaaagguuguuuaaugaaauauuuua

SEQ ID NO: 716850 - RNA, 64 nt, Homo Sapiens
agggugguaaauguaggagaaagagccuuggccuuaaggaaaucuuuacuccuguaagcaagag

SEQ ID NO: 716851 - RNA, 64 nt, Homo Sapiens
uuucuguuuguaagacuuaagugaguuaggucuuuaaggaaagcaacgcuccucugaaaugcuu

SEQ ID NO: 716852 - RNA, 64 nt, Homo Sapiens
gccauuuuuuaaaaaugccgugacgugugaaauuuaaggaaagauuuuuuaauugugguuguuc

SEQ ID NO: 716853 - RNA, 64 nt, Homo Sapiens
cuuuuaucgcaaugauaguccuuuauugucaucauaaggaaaaauaaagucuuucagcaacauu

SEQ ID NO: 716854 - RNA, 64 nt, Homo Sapiens
auuccacauagcucugggccaacuugaaagguauuaaggaaaaaaguugccgucuucacagaca

SEQ ID NO: 716855 - RNA, 64 nt, Homo Sapiens
ucugcuguuuuuagcaaaaggcugaaaaugacauuaaggaaaguuaaaggaagauacuaguuuu

SEQ ID NO: 716856 - RNA, 64 nt, Homo Sapiens
uguaaugauaggcggacuccagaugggcuggaaguaaggaaacauagcaaggagccaacauaac

SEQ ID NO: 716857 - RNA, 64 nt, Homo Sapiens
uuacaguauuuuuaauugaaaguccuaauucuguuaaggaaaggaguugauuaaauuuuaaggu

SEQ ID NO: 716858 - RNA, 64 nt, Homo Sapiens
uggguuggugcaaagaaguauaaacauauaucacuaaggaaaaagaaaguuugucuugcccuuc

SEQ ID NO: 716859 - RNA, 64 nt, Homo Sapiens
augcaugagcuaacaccugaucaaggaaagccucuaaggaaagggggaugcuucagguaggaca

SEQ ID NO: 716860 - RNA, 64 nt, Homo Sapiens
auacugaaaaccuuuccaaggcuaaaucuuauuauaaggaaaccuuuuguuuuuuuuuuuaacu

SEQ ID NO: 716861 - RNA, 64 nt, Homo Sapiens
acucuuagagguagguguauucccguuuuacagauaaggaaacugaggcccagagagcugaagu

SEQ ID NO: 716862 - RNA, 64 nt, Homo Sapiens
aguaaagcuagacaaaggcccagaaaucauacuguaaggaaauguuauuggaagcugauuccca

SEQ ID NO: 716863 - RNA, 64 nt, Homo Sapiens
uuuguggccaaauuggaugaaaaagaugaggcucuaaggaaaugguggcaugaagacccucucc

SEQ ID NO: 716864 - RNA, 64 nt, Homo Sapiens
auggguuuauuuuuccagcauaaaccucagaauuuaaggaaagaaaaugaugucuguuguuaua

SEQ ID NO: 716865 - RNA, 64 nt, Homo Sapiens
uaauaaaucauuaauaguuacuccuaaguaccuuuaaggaaaauuugaauaugugacacacaca

SEQ ID NO: 716866 - RNA, 64 nt, Homo Sapiens
guugucacuuuuauguuauagguuuuuuucuucuuaaggaaaacuuucuucccaagugcuguug

SEQ ID NO: 716867 - RNA, 64 nt, Homo Sapiens; identical to SEQ ID NO: 156143

SEQ ID NO: 716868 - RNA, 64 nt, Homo Sapiens; identical to SEQ ID NO: 156144

SEQ ID NO: 716869 - RNA, 64 nt, Homo Sapiens; identical to SEQ ID NO: 156145

SEQ ID NO: 716870 - RNA, 64 nt, Homo Sapiens; identical to SEQ ID NO: 156146

SEQ ID NO: 716871 - RNA, 64 nt, Homo Sapiens; identical to SEQ ID NO: 156147

SEQ ID NO: 716872 - RNA, 64 nt, Homo Sapiens; identical to SEQ ID NO: 156148

SEQ ID NO: 716873 - RNA, 64 nt, Homo Sapiens; identical to SEQ ID NO: 156149

SEQ ID NO: 716874 - RNA, 64 nt, Homo Sapiens; identical to SEQ ID NO: 156150

SEQ ID NO: 716875 - RNA, 64 nt, Homo Sapiens; identical to SEQ ID NO: 156151

SEQ ID NO: 716876 - RNA, 64 nt, Homo Sapiens; identical to SEQ ID NO: 156152

SEQ ID NO: 716877 - RNA, 64 nt, Homo Sapiens; identical to SEQ ID NO: 156153

SEQ ID NO: 716878 - RNA, 64 nt, Homo Sapiens; identical to SEQ ID NO: 156154

SEQ ID NO: 716879 - RNA, 64 nt, Homo Sapiens; identical to SEQ ID NO: 156155

SEQ ID NO: 716880 - RNA, 64 nt, Homo Sapiens; identical to SEQ ID NO: 156156

SEQ ID NO: 716881 - RNA, 64 nt, Homo Sapiens; identical to SEQ ID NO: 156157

SEQ ID NO: 716882 - RNA, 64 nt, Homo Sapiens; identical to SEQ ID NO: 156158

SEQ ID NO: 716883 - RNA, 64 nt, Homo Sapiens; identical to SEQ ID NO: 156159

SEQ ID NO: 716884 - RNA, 64 nt, Homo Sapiens; identical to SEQ ID NO: 156160

SEQ ID NO: 716885 - RNA, 64 nt, Homo Sapiens; identical to SEQ ID NO: 156161

SEQ ID NO: 716886 - RNA, 64 nt, Homo Sapiens; identical to SEQ ID NO: 156162

SEQ ID NO: 716887 - RNA, 64 nt, Homo Sapiens; identical to SEQ ID NO: 156163

SEQ ID NO: 716888 - RNA, 64 nt, Homo Sapiens; identical to SEQ ID NO: 156164

SEQ ID NO: 716889 - RNA, 64 nt, Homo Sapiens; identical to SEQ ID NO: 156165

SEQ ID NO: 716890 - RNA, 64 nt, Homo Sapiens; identical to SEQ ID NO: 156166

SEQ ID NO: 716891 - RNA, 64 nt, Homo Sapiens; identical to SEQ ID NO: 156167

SEQ ID NO: 716892 - RNA, 64 nt, Homo Sapiens; identical to SEQ ID NO: 156168

SEQ ID NO: 716893 - RNA, 64 nt, Homo Sapiens; identical to SEQ ID NO: 156169

SEQ ID NO: 716894 - RNA, 64 nt, Homo Sapiens; identical to SEQ ID NO: 156170

SEQ ID NO: 716895 - RNA, 64 nt, Homo Sapiens; identical to SEQ ID NO: 156171

SEQ ID NO: 716896 - RNA, 64 nt, Homo Sapiens; identical to SEQ ID NO: 156172

SEQ ID NO: 716897 - RNA, 64 nt, Homo Sapiens; identical to SEQ ID NO: 156173

SEQ ID NO: 716898 - RNA, 64 nt, Homo Sapiens; identical to SEQ ID NO: 156174

SEQ ID NO: 716899 - RNA, 64 nt, Homo Sapiens; identical to SEQ ID NO: 156175

SEQ ID NO: 716900 - RNA, 64 nt, Homo Sapiens; identical to SEQ ID NO: 156176

SEQ ID NO: 716901 - RNA, 64 nt, Homo Sapiens; identical to SEQ ID NO: 156177

SEQ ID NO: 716902 - RNA, 64 nt, Homo Sapiens; identical to SEQ ID NO: 156178

SEQ ID NO: 716903 - RNA, 64 nt, Homo Sapiens; identical to SEQ ID NO: 156179

SEQ ID NO: 716904 - RNA, 64 nt, Homo Sapiens; identical to SEQ ID NO: 156180

SEQ ID NO: 716905 - RNA, 64 nt, Homo Sapiens; identical to SEQ ID NO: 156181

SEQ ID NO: 716906 - RNA, 64 nt, Homo Sapiens; identical to SEQ ID NO: 156182

SEQ ID NO: 716907 - RNA, 64 nt, Homo Sapiens; identical to SEQ ID NO: 156183

SEQ ID NO: 716908 - RNA, 64 nt, Homo Sapiens; identical to SEQ ID NO: 156184

SEQ ID NO: 716909 - RNA, 64 nt, Homo Sapiens; identical to SEQ ID NO: 156185

SEQ ID NO: 716910 - RNA, 64 nt, Homo Sapiens; identical to SEQ ID NO: 156186

SEQ ID NO: 716911 - RNA, 64 nt, Homo Sapiens; identical to SEQ ID NO: 156187

SEQ ID NO: 716912 - RNA, 64 nt, Homo Sapiens; identical to SEQ ID NO: 156188

SEQ ID NO: 716913 - RNA, 64 nt, Homo Sapiens; identical to SEQ ID NO: 156189

SEQ ID NO: 716914 - RNA, 64 nt, Homo Sapiens; identical to SEQ ID NO: 156190

SEQ ID NO: 716915 - RNA, 64 nt, Homo Sapiens; identical to SEQ ID NO: 156191

SEQ ID NO: 716916 - RNA, 64 nt, Homo Sapiens; identical to SEQ ID NO: 156192

SEQ ID NO: 716917 - RNA, 64 nt, Homo Sapiens; identical to SEQ ID NO: 156193

SEQ ID NO: 716918 - RNA, 64 nt, Homo Sapiens; identical to SEQ ID NO: 156194

SEQ ID NO: 716919 - RNA, 64 nt, Homo Sapiens; identical to SEQ ID NO: 156195

SEQ ID NO: 716920 - RNA, 64 nt, Homo Sapiens; identical to SEQ ID NO: 156196

SEQ ID NO: 716921 - RNA, 64 nt, Homo Sapiens; identical to SEQ ID NO: 156197

SEQ ID NO: 716922 - RNA, 64 nt, Homo Sapiens; identical to SEQ ID NO: 156198

SEQ ID NO: 716923 - RNA, 64 nt, Homo Sapiens; identical to SEQ ID NO: 156199

SEQ ID NO: 716924 - RNA, 64 nt, Homo Sapiens; identical to SEQ ID NO: 156200

SEQ ID NO: 716925 - RNA, 64 nt, Homo Sapiens; identical to SEQ ID NO: 156201

SEQ ID NO: 716926 - RNA, 64 nt, Homo Sapiens; identical to SEQ ID NO: 156202

SEQ ID NO: 716927 - RNA, 64 nt, Homo Sapiens; identical to SEQ ID NO: 156203

SEQ ID NO: 716928 - RNA, 64 nt, Homo Sapiens; identical to SEQ ID NO: 156204

SEQ ID NO: 716929 - RNA, 64 nt, Homo Sapiens; identical to SEQ ID NO: 156205

SEQ ID NO: 716930 - RNA, 64 nt, Homo Sapiens; identical to SEQ ID NO: 156206

SEQ ID NO: 716931 - RNA, 64 nt, Homo Sapiens; identical to SEQ ID NO: 156207

SEQ ID NO: 716932 - RNA, 64 nt, Homo Sapiens; identical to SEQ ID NO: 156208

SEQ ID NO: 716933 - RNA, 64 nt, Homo Sapiens; identical to SEQ ID NO: 156209

SEQ ID NO: 716934 - RNA, 53 nt, Homo Sapiens; identical to SEQ ID NO: 156210

SEQ ID NO: 716935 - RNA, 64 nt, Homo Sapiens; identical to SEQ ID NO: 156211

SEQ ID NO: 716936 - RNA, 64 nt, Homo Sapiens; identical to SEQ ID NO: 156212

SEQ ID NO: 716937 - RNA, 64 nt, Homo Sapiens; identical to SEQ ID NO: 156213

SEQ ID NO: 716938 - RNA, 64 nt, Homo Sapiens; identical to SEQ ID NO: 156214

SEQ ID NO: 716939 - RNA, 64 nt, Homo Sapiens; identical to SEQ ID NO: 156215

SEQ ID NO: 716940 - RNA, 64 nt, Homo Sapiens; identical to SEQ ID NO: 156216

SEQ ID NO: 716941 - RNA, 64 nt, Homo Sapiens; identical to SEQ ID NO: 156217

SEQ ID NO: 716942 - RNA, 64 nt, Homo Sapiens; identical to SEQ ID NO: 156218

SEQ ID NO: 716943 - RNA, 64 nt, Homo Sapiens; identical to SEQ ID NO: 156219

SEQ ID NO: 716944 - RNA, 64 nt, Homo Sapiens; identical to SEQ ID NO: 156220

SEQ ID NO: 716945 - RNA, 64 nt, Homo Sapiens; identical to SEQ ID NO: 156221

SEQ ID NO: 716946 - RNA, 64 nt, Homo Sapiens; identical to SEQ ID NO: 156222

SEQ ID NO: 716947 - RNA, 64 nt, Homo Sapiens; identical to SEQ ID NO: 156223

SEQ ID NO: 716948 - RNA, 64 nt, Homo Sapiens; identical to SEQ ID NO: 156224

SEQ ID NO: 716949 - RNA, 64 nt, Homo Sapiens; identical to SEQ ID NO: 156225

SEQ ID NO: 716950 - RNA, 64 nt, Homo Sapiens; identical to SEQ ID NO: 156226

SEQ ID NO: 716951 - RNA, 64 nt, Homo Sapiens; identical to SEQ ID NO: 156227

SEQ ID NO: 716952 - RNA, 64 nt, Homo Sapiens; identical to SEQ ID NO: 156228

SEQ ID NO: 716953 - RNA, 64 nt, Homo Sapiens; identical to SEQ ID NO: 156229

SEQ ID NO: 716954 - RNA, 64 nt, Homo Sapiens; identical to SEQ ID NO: 156230

SEQ ID NO: 716955 - RNA, 64 nt, Homo Sapiens; identical to SEQ ID NO: 156231

SEQ ID NO: 716956 - RNA, 64 nt, Homo Sapiens; identical to SEQ ID NO: 156232

SEQ ID NO: 716957 - RNA, 64 nt, Homo Sapiens; identical to SEQ ID NO: 156233

SEQ ID NO: 716958 - RNA, 64 nt, Homo Sapiens; identical to SEQ ID NO: 156234

SEQ ID NO: 716959 - RNA, 64 nt, Homo Sapiens; identical to SEQ ID NO: 156235

SEQ ID NO: 716960 - RNA, 64 nt, Homo Sapiens; identical to SEQ ID NO: 156236

SEQ ID NO: 716961 - RNA, 64 nt, Homo Sapiens; identical to SEQ ID NO: 156237

SEQ ID NO: 716962 - RNA, 64 nt, Homo Sapiens; identical to SEQ ID NO: 156238

SEQ ID NO: 716963 - RNA, 64 nt, Homo Sapiens; identical to SEQ ID NO: 156239

SEQ ID NO: 716964 - RNA, 64 nt, Homo Sapiens; identical to SEQ ID NO: 156240

SEQ ID NO: 716965 - RNA, 64 nt, Homo Sapiens; identical to SEQ ID NO: 156241

SEQ ID NO: 716966 - RNA, 64 nt, Homo Sapiens; identical to SEQ ID NO: 156242

SEQ ID NO: 716967 - RNA, 64 nt, Homo Sapiens; identical to SEQ ID NO: 156243

SEQ ID NO: 716968 - RNA, 64 nt, Homo Sapiens; identical to SEQ ID NO: 156244

SEQ ID NO: 716969 - RNA, 64 nt, Homo Sapiens; identical to SEQ ID NO: 156245

SEQ ID NO: 716970 - RNA, 64 nt, Homo Sapiens; identical to SEQ ID NO: 156246

SEQ ID NO: 716971 - RNA, 64 nt, Homo Sapiens; identical to SEQ ID NO: 156247

SEQ ID NO: 716972 - RNA, 64 nt, Homo Sapiens; identical to SEQ ID NO: 156248

SEQ ID NO: 716973 - RNA, 64 nt, Homo Sapiens; identical to SEQ ID NO: 156249

SEQ ID NO: 716974 - RNA, 64 nt, Homo Sapiens; identical to SEQ ID NO: 156250

SEQ ID NO: 716975 - RNA, 64 nt, Homo Sapiens; identical to SEQ ID NO: 156251

SEQ ID NO: 716976 - RNA, 64 nt, Homo Sapiens; identical to SEQ ID NO: 156252

SEQ ID NO: 716977 - RNA, 64 nt, Homo Sapiens; identical to SEQ ID NO: 156253

SEQ ID NO: 716978 - RNA, 64 nt, Homo Sapiens; identical to SEQ ID NO: 156254

SEQ ID NO: 716979 - RNA, 64 nt, Homo Sapiens; identical to SEQ ID NO: 156255

SEQ ID NO: 716980 - RNA, 64 nt, Homo Sapiens; identical to SEQ ID NO: 156256

SEQ ID NO: 716981 - RNA, 64 nt, Homo Sapiens; identical to SEQ ID NO: 156257

SEQ ID NO: 716982 - RNA, 64 nt, Homo Sapiens; identical to SEQ ID NO: 156258

SEQ ID NO: 716983 - RNA, 64 nt, Homo Sapiens; identical to SEQ ID NO: 156259

SEQ ID NO: 716984 - RNA, 64 nt, Homo Sapiens; identical to SEQ ID NO: 156260

SEQ ID NO: 716985 - RNA, 64 nt, Homo Sapiens; identical to SEQ ID NO: 156261

SEQ ID NO: 716986 - RNA, 64 nt, Homo Sapiens; identical to SEQ ID NO: 156262

SEQ ID NO: 716987 - RNA, 64 nt, Homo Sapiens; identical to SEQ ID NO: 156263

SEQ ID NO: 716988 - RNA, 64 nt, Homo Sapiens; identical to SEQ ID NO: 156264

SEQ ID NO: 716989 - RNA, 64 nt, Homo Sapiens; identical to SEQ ID NO: 156265

SEQ ID NO: 716990 - RNA, 64 nt, Homo Sapiens; identical to SEQ ID NO: 156266

SEQ ID NO: 716991 - RNA, 64 nt, Homo Sapiens; identical to SEQ ID NO: 156267

SEQ ID NO: 716992 - RNA, 64 nt, Homo Sapiens; identical to SEQ ID NO: 156268

SEQ ID NO: 716993 - RNA, 64 nt, Homo Sapiens; identical to SEQ ID NO: 156269

SEQ ID NO: 716994 - RNA, 64 nt, Homo Sapiens; identical to SEQ ID NO: 156270

SEQ ID NO: 716995 - RNA, 64 nt, Homo Sapiens; identical to SEQ ID NO: 156271

SEQ ID NO: 716996 - RNA, 64 nt, Homo Sapiens; identical to SEQ ID NO: 156272

SEQ ID NO: 716997 - RNA, 64 nt, Homo Sapiens; identical to SEQ ID NO: 156273

SEQ ID NO: 716998 - RNA, 64 nt, Homo Sapiens; identical to SEQ ID NO: 156274

SEQ ID NO: 716999 - RNA, 64 nt, Homo Sapiens; identical to SEQ ID NO: 156275

SEQ ID NO: 717000 - RNA, 64 nt, Homo Sapiens; identical to SEQ ID NO: 156276

SEQ ID NO: 717001 - RNA, 64 nt, Homo Sapiens; identical to SEQ ID NO: 156277

SEQ ID NO: 717002 - RNA, 64 nt, Homo Sapiens; identical to SEQ ID NO: 156278

SEQ ID NO: 717003 - RNA, 64 nt, Homo Sapiens; identical to SEQ ID NO: 156279

SEQ ID NO: 717004 - RNA, 64 nt, Homo Sapiens; identical to SEQ ID NO: 156280

SEQ ID NO: 717005 - RNA, 64 nt, Homo Sapiens; identical to SEQ ID NO: 156281

SEQ ID NO: 717006 - RNA, 64 nt, Homo Sapiens; identical to SEQ ID NO: 156282

SEQ ID NO: 717007 - RNA, 64 nt, Homo Sapiens; identical to SEQ ID NO: 156283

SEQ ID NO: 717008 - RNA, 64 nt, Homo Sapiens; identical to SEQ ID NO: 156284

SEQ ID NO: 717009 - RNA, 64 nt, Homo Sapiens; identical to SEQ ID NO: 156285

SEQ ID NO: 717010 - RNA, 64 nt, Homo Sapiens; identical to SEQ ID NO: 156286

SEQ ID NO: 717011 - RNA, 64 nt, Homo Sapiens; identical to SEQ ID NO: 156287

SEQ ID NO: 717012 - RNA, 64 nt, Homo Sapiens; identical to SEQ ID NO: 167467

SEQ ID NO: 717013 - RNA, 64 nt, Homo Sapiens; identical to SEQ ID NO: 167468

SEQ ID NO: 717014 - RNA, 64 nt, Homo Sapiens; identical to SEQ ID NO: 167469

SEQ ID NO: 717015 - RNA, 64 nt, Homo Sapiens; identical to SEQ ID NO: 167470

SEQ ID NO: 717016 - RNA, 64 nt, Homo Sapiens; identical to SEQ ID NO: 167471

SEQ ID NO: 717017 - RNA, 64 nt, Homo Sapiens; identical to SEQ ID NO: 167472

SEQ ID NO: 717018 - RNA, 64 nt, Homo Sapiens; identical to SEQ ID NO: 358154

SEQ ID NO: 717019 - RNA, 64 nt, Homo Sapiens; identical to SEQ ID NO: 358155

SEQ ID NO: 717020 - RNA, 64 nt, Homo Sapiens; identical to SEQ ID NO: 358156

SEQ ID NO: 717021 - RNA, 64 nt, Homo Sapiens; identical to SEQ ID NO: 358157

SEQ ID NO: 717022 - RNA, 64 nt, Homo Sapiens; identical to SEQ ID NO: 358158

SEQ ID NO: 717023 - RNA, 64 nt, Homo Sapiens; identical to SEQ ID NO: 358159

SEQ ID NO: 717024 - RNA, 64 nt, Homo Sapiens; identical to SEQ ID NO: 358160

SEQ ID NO: 717025 - RNA, 64 nt, Homo Sapiens; identical to SEQ ID NO: 358161

SEQ ID NO: 717026 - RNA, 64 nt, Homo Sapiens; identical to SEQ ID NO: 358162

SEQ ID NO: 717027 - RNA, 64 nt, Homo Sapiens; identical to SEQ ID NO: 358163

SEQ ID NO: 717028 - RNA, 64 nt, Homo Sapiens; identical to SEQ ID NO: 358164

SEQ ID NO: 717029 - RNA, 64 nt, Homo Sapiens; identical to SEQ ID NO: 358165

SEQ ID NO: 717030 - RNA, 64 nt, Homo Sapiens; identical to SEQ ID NO: 358166

SEQ ID NO: 717031 - RNA, 64 nt, Homo Sapiens; identical to SEQ ID NO: 358167

SEQ ID NO: 717032 - RNA, 64 nt, Homo Sapiens; identical to SEQ ID NO: 358168

SEQ ID NO: 717033 - RNA, 64 nt, Homo Sapiens; identical to SEQ ID NO: 358169

SEQ ID NO: 717034 - RNA, 64 nt, Homo Sapiens; identical to SEQ ID NO: 358170

SEQ ID NO: 717035 - RNA, 64 nt, Homo Sapiens; identical to SEQ ID NO: 358171

SEQ ID NO: 717036 - RNA, 64 nt, Homo Sapiens; identical to SEQ ID NO: 358172

SEQ ID NO: 717037 - RNA, 56 nt, Homo Sapiens; identical to SEQ ID NO: 358173

SEQ ID NO: 717038 - RNA, 64 nt, Homo Sapiens; identical to SEQ ID NO: 358174

SEQ ID NO: 717039 - RNA, 64 nt, Homo Sapiens; identical to SEQ ID NO: 358175

SEQ ID NO: 717040 - RNA, 64 nt, Homo Sapiens; identical to SEQ ID NO: 358176

SEQ ID NO: 717041 - RNA, 64 nt, Homo Sapiens; identical to SEQ ID NO: 358177

SEQ ID NO: 717042 - RNA, 64 nt, Homo Sapiens; identical to SEQ ID NO: 358178

SEQ ID NO: 717043 - RNA, 64 nt, Homo Sapiens; identical to SEQ ID NO: 358179

SEQ ID NO: 717044 - RNA, 64 nt, Homo Sapiens; identical to SEQ ID NO: 358180

SEQ ID NO: 717045 - RNA, 64 nt, Homo Sapiens; identical to SEQ ID NO: 358181

SEQ ID NO: 717046 - RNA, 64 nt, Homo Sapiens; identical to SEQ ID NO: 358182

SEQ ID NO: 717047 - RNA, 64 nt, Homo Sapiens; identical to SEQ ID NO: 358183

SEQ ID NO: 717048 - RNA, 64 nt, Homo Sapiens; identical to SEQ ID NO: 358184

SEQ ID NO: 717049 - RNA, 64 nt, Homo Sapiens; identical to SEQ ID NO: 358185

SEQ ID NO: 717050 - RNA, 64 nt, Homo Sapiens; identical to SEQ ID NO: 358186

SEQ ID NO: 717051 - RNA, 64 nt, Homo Sapiens; identical to SEQ ID NO: 358187

SEQ ID NO: 717052 - RNA, 64 nt, Homo Sapiens; identical to SEQ ID NO: 358188

SEQ ID NO: 717053 - RNA, 64 nt, Homo Sapiens; identical to SEQ ID NO: 358189

SEQ ID NO: 717054 - RNA, 64 nt, Homo Sapiens; identical to SEQ ID NO: 358190

SEQ ID NO: 717055 - RNA, 64 nt, Homo Sapiens; identical to SEQ ID NO: 358191

SEQ ID NO: 717056 - RNA, 64 nt, Homo Sapiens; identical to SEQ ID NO: 358192

SEQ ID NO: 717057 - RNA, 64 nt, Homo Sapiens; identical to SEQ ID NO: 358193

SEQ ID NO: 717058 - RNA, 64 nt, Homo Sapiens; identical to SEQ ID NO: 358194

SEQ ID NO: 717059 - RNA, 64 nt, Homo Sapiens; identical to SEQ ID NO: 95478

SEQ ID NO: 717060 - RNA, 64 nt, Homo Sapiens; identical to SEQ ID NO: 95479

SEQ ID NO: 717061 - RNA, 64 nt, Homo Sapiens; identical to SEQ ID NO: 95480

SEQ ID NO: 717062 - RNA, 64 nt, Homo Sapiens; identical to SEQ ID NO: 95481

SEQ ID NO: 717063 - RNA, 64 nt, Homo Sapiens; identical to SEQ ID NO: 95482

SEQ ID NO: 717064 - RNA, 64 nt, Homo Sapiens; identical to SEQ ID NO: 95483

SEQ ID NO: 717065 - RNA, 64 nt, Homo Sapiens; identical to SEQ ID NO: 95484

SEQ ID NO: 717066 - RNA, 64 nt, Homo Sapiens; identical to SEQ ID NO: 95485

SEQ ID NO: 717067 - RNA, 64 nt, Homo Sapiens; identical to SEQ ID NO: 95486

SEQ ID NO: 717068 - RNA, 64 nt, Homo Sapiens; identical to SEQ ID NO: 95487

SEQ ID NO: 717069 - RNA, 64 nt, Homo Sapiens; identical to SEQ ID NO: 95488

SEQ ID NO: 717070 - RNA, 64 nt, Homo Sapiens; identical to SEQ ID NO: 95489

SEQ ID NO: 717071 - RNA, 64 nt, Homo Sapiens; identical to SEQ ID NO: 95490

SEQ ID NO: 717072 - RNA, 64 nt, Homo Sapiens; identical to SEQ ID NO: 95491

SEQ ID NO: 717073 - RNA, 64 nt, Homo Sapiens; identical to SEQ ID NO: 95492

SEQ ID NO: 717074 - RNA, 64 nt, Homo Sapiens; identical to SEQ ID NO: 95493

SEQ ID NO: 717075 - RNA, 64 nt, Homo Sapiens; identical to SEQ ID NO: 95494

SEQ ID NO: 717076 - RNA, 64 nt, Homo Sapiens; identical to SEQ ID NO: 95495

SEQ ID NO: 717077 - RNA, 64 nt, Homo Sapiens; identical to SEQ ID NO: 95496

SEQ ID NO: 717078 - RNA, 64 nt, Homo Sapiens; identical to SEQ ID NO: 95497

SEQ ID NO: 717079 - RNA, 64 nt, Homo Sapiens; identical to SEQ ID NO: 95498

SEQ ID NO: 717080 - RNA, 64 nt, Homo Sapiens; identical to SEQ ID NO: 95499

SEQ ID NO: 717081 - RNA, 64 nt, Homo Sapiens; identical to SEQ ID NO: 95500

SEQ ID NO: 717082 - RNA, 64 nt, Homo Sapiens; identical to SEQ ID NO: 95501

SEQ ID NO: 717083 - RNA, 64 nt, Homo Sapiens; identical to SEQ ID NO: 95502

SEQ ID NO: 717084 - RNA, 64 nt, Homo Sapiens; identical to SEQ ID NO: 95503

SEQ ID NO: 717085 - RNA, 64 nt, Homo Sapiens; identical to SEQ ID NO: 95504

SEQ ID NO: 717086 - RNA, 64 nt, Homo Sapiens; identical to SEQ ID NO: 95505

SEQ ID NO: 717087 - RNA, 64 nt, Homo Sapiens; identical to SEQ ID NO: 95506

SEQ ID NO: 717088 - RNA, 64 nt, Homo Sapiens; identical to SEQ ID NO: 95507

SEQ ID NO: 717089 - RNA, 64 nt, Homo Sapiens; identical to SEQ ID NO: 95508

SEQ ID NO: 717090 - RNA, 64 nt, Homo Sapiens; identical to SEQ ID NO: 95509

SEQ ID NO: 717091 - RNA, 64 nt, Homo Sapiens; identical to SEQ ID NO: 95510

SEQ ID NO: 717092 - RNA, 64 nt, Homo Sapiens; identical to SEQ ID NO: 95511

SEQ ID NO: 717093 - RNA, 64 nt, Homo Sapiens; identical to SEQ ID NO: 95512

SEQ ID NO: 717094 - RNA, 64 nt, Homo Sapiens; identical to SEQ ID NO: 95513

SEQ ID NO: 717095 - RNA, 64 nt, Homo Sapiens; identical to SEQ ID NO: 95514

SEQ ID NO: 717096 - RNA, 64 nt, Homo Sapiens; identical to SEQ ID NO: 95515

SEQ ID NO: 717097 - RNA, 64 nt, Homo Sapiens; identical to SEQ ID NO: 95516

SEQ ID NO: 717098 - RNA, 64 nt, Homo Sapiens; identical to SEQ ID NO: 95517

SEQ ID NO: 717099 - RNA, 64 nt, Homo Sapiens; identical to SEQ ID NO: 95518

SEQ ID NO: 717100 - RNA, 64 nt, Homo Sapiens; identical to SEQ ID NO: 95519

SEQ ID NO: 717101 - RNA, 64 nt, Homo Sapiens; identical to SEQ ID NO: 95520

SEQ ID NO: 717102 - RNA, 64 nt, Homo Sapiens; identical to SEQ ID NO: 95521

SEQ ID NO: 717103 - RNA, 64 nt, Homo Sapiens; identical to SEQ ID NO: 95522

SEQ ID NO: 717104 - RNA, 64 nt, Homo Sapiens; identical to SEQ ID NO: 95523

SEQ ID NO: 717105 - RNA, 64 nt, Homo Sapiens; identical to SEQ ID NO: 95524

SEQ ID NO: 717106 - RNA, 64 nt, Homo Sapiens; identical to SEQ ID NO: 95525

SEQ ID NO: 717107 - RNA, 64 nt, Homo Sapiens; identical to SEQ ID NO: 130466

SEQ ID NO: 717108 - RNA, 64 nt, Homo Sapiens; identical to SEQ ID NO: 130467

SEQ ID NO: 717109 - RNA, 64 nt, Homo Sapiens; identical to SEQ ID NO: 130468

SEQ ID NO: 717110 - RNA, 64 nt, Homo Sapiens; identical to SEQ ID NO: 130469

SEQ ID NO: 717111 - RNA, 64 nt, Homo Sapiens; identical to SEQ ID NO: 130470

SEQ ID NO: 717112 - RNA, 64 nt, Homo Sapiens; identical to SEQ ID NO: 130471

SEQ ID NO: 717113 - RNA, 64 nt, Homo Sapiens; identical to SEQ ID NO: 130472

SEQ ID NO: 717114 - RNA, 64 nt, Homo Sapiens; identical to SEQ ID NO: 130473

SEQ ID NO: 717115 - RNA, 64 nt, Homo Sapiens; identical to SEQ ID NO: 130474

SEQ ID NO: 717116 - RNA, 64 nt, Homo Sapiens; identical to SEQ ID NO: 130475

SEQ ID NO: 717117 - RNA, 64 nt, Homo Sapiens; identical to SEQ ID NO: 130476

SEQ ID NO: 717118 - RNA, 64 nt, Homo Sapiens; identical to SEQ ID NO: 130477

SEQ ID NO: 717119 - RNA, 64 nt, Homo Sapiens; identical to SEQ ID NO: 130478

SEQ ID NO: 717120 - RNA, 64 nt, Homo Sapiens; identical to SEQ ID NO: 130479

SEQ ID NO: 717121 - RNA, 64 nt, Homo Sapiens; identical to SEQ ID NO: 130480

SEQ ID NO: 717122 - RNA, 64 nt, Homo Sapiens; identical to SEQ ID NO: 130481

SEQ ID NO: 717123 - RNA, 64 nt, Homo Sapiens; identical to SEQ ID NO: 130482

SEQ ID NO: 717124 - RNA, 64 nt, Homo Sapiens; identical to SEQ ID NO: 130483

SEQ ID NO: 717125 - RNA, 64 nt, Homo Sapiens; identical to SEQ ID NO: 130484

SEQ ID NO: 717126 - RNA, 64 nt, Homo Sapiens; identical to SEQ ID NO: 130485

SEQ ID NO: 717127 - RNA, 64 nt, Homo Sapiens; identical to SEQ ID NO: 130486

SEQ ID NO: 717128 - RNA, 64 nt, Homo Sapiens; identical to SEQ ID NO: 130487

SEQ ID NO: 717129 - RNA, 64 nt, Homo Sapiens; identical to SEQ ID NO: 130488

SEQ ID NO: 717130 - RNA, 64 nt, Homo Sapiens; identical to SEQ ID NO: 130489

SEQ ID NO: 717131 - RNA, 64 nt, Homo Sapiens; identical to SEQ ID NO: 130490

SEQ ID NO: 717132 - RNA, 64 nt, Homo Sapiens; identical to SEQ ID NO: 130491

SEQ ID NO: 717133 - RNA, 64 nt, Homo Sapiens; identical to SEQ ID NO: 432969

SEQ ID NO: 717134 - RNA, 64 nt, Homo Sapiens; identical to SEQ ID NO: 432970

SEQ ID NO: 717135 - RNA, 64 nt, Homo Sapiens; identical to SEQ ID NO: 432971

SEQ ID NO: 717136 - RNA, 64 nt, Homo Sapiens; identical to SEQ ID NO: 432972

SEQ ID NO: 717137 - RNA, 64 nt, Homo Sapiens; identical to SEQ ID NO: 432973

SEQ ID NO: 717138 - RNA, 64 nt, Homo Sapiens; identical to SEQ ID NO: 432974

SEQ ID NO: 717139 - RNA, 64 nt, Homo Sapiens; identical to SEQ ID NO: 432975

SEQ ID NO: 717140 - RNA, 64 nt, Homo Sapiens; identical to SEQ ID NO: 432976

SEQ ID NO: 717141 - RNA, 64 nt, Homo Sapiens; identical to SEQ ID NO: 432977

SEQ ID NO: 717142 - RNA, 64 nt, Homo Sapiens; identical to SEQ ID NO: 432978

SEQ ID NO: 717143 - RNA, 64 nt, Homo Sapiens; identical to SEQ ID NO: 432979

SEQ ID NO: 717144 - RNA, 64 nt, Homo Sapiens; identical to SEQ ID NO: 432980

SEQ ID NO: 717145 - RNA, 64 nt, Homo Sapiens; identical to SEQ ID NO: 432981

SEQ ID NO: 717146 - RNA, 64 nt, Homo Sapiens; identical to SEQ ID NO: 432982

SEQ ID NO: 717147 - RNA, 64 nt, Homo Sapiens; identical to SEQ ID NO: 432983

SEQ ID NO: 717148 - RNA, 64 nt, Homo Sapiens; identical to SEQ ID NO: 432984

SEQ ID NO: 717149 - RNA, 64 nt, Homo Sapiens; identical to SEQ ID NO: 432985

SEQ ID NO: 717150 - RNA, 64 nt, Homo Sapiens; identical to SEQ ID NO: 432986

SEQ ID NO: 717151 - RNA, 64 nt, Homo Sapiens; identical to SEQ ID NO: 432987

SEQ ID NO: 717152 - RNA, 64 nt, Homo Sapiens; identical to SEQ ID NO: 432988

SEQ ID NO: 717153 - RNA, 64 nt, Homo Sapiens; identical to SEQ ID NO: 432989

SEQ ID NO: 717154 - RNA, 64 nt, Homo Sapiens; identical to SEQ ID NO: 432990

SEQ ID NO: 717155 - RNA, 64 nt, Homo Sapiens; identical to SEQ ID NO: 432991

SEQ ID NO: 717156 - RNA, 64 nt, Homo Sapiens; identical to SEQ ID NO: 432992

SEQ ID NO: 717157 - RNA, 64 nt, Homo Sapiens; identical to SEQ ID NO: 432993

SEQ ID NO: 717158 - RNA, 64 nt, Homo Sapiens; identical to SEQ ID NO: 432994

SEQ ID NO: 717159 - RNA, 64 nt, Homo Sapiens; identical to SEQ ID NO: 432995

SEQ ID NO: 717160 - RNA, 64 nt, Homo Sapiens; identical to SEQ ID NO: 432996

SEQ ID NO: 717161 - RNA, 64 nt, Homo Sapiens; identical to SEQ ID NO: 432997

SEQ ID NO: 717162 - RNA, 64 nt, Homo Sapiens; identical to SEQ ID NO: 154777

SEQ ID NO: 717163 - RNA, 64 nt, Homo Sapiens; identical to SEQ ID NO: 154778

SEQ ID NO: 717164 - RNA, 64 nt, Homo Sapiens; identical to SEQ ID NO: 154779

SEQ ID NO: 717165 - RNA, 64 nt, Homo Sapiens; identical to SEQ ID NO: 154780

SEQ ID NO: 717166 - RNA, 64 nt, Homo Sapiens; identical to SEQ ID NO: 154781

SEQ ID NO: 717167 - RNA, 64 nt, Homo Sapiens; identical to SEQ ID NO: 154782

SEQ ID NO: 717168 - RNA, 64 nt, Homo Sapiens; identical to SEQ ID NO: 154783

SEQ ID NO: 717169 - RNA, 64 nt, Homo Sapiens; identical to SEQ ID NO: 154784

SEQ ID NO: 717170 - RNA, 64 nt, Homo Sapiens; identical to SEQ ID NO: 154785

SEQ ID NO: 717171 - RNA, 64 nt, Homo Sapiens; identical to SEQ ID NO: 154786

SEQ ID NO: 717172 - RNA, 64 nt, Homo Sapiens; identical to SEQ ID NO: 154787

SEQ ID NO: 717173 - RNA, 64 nt, Homo Sapiens; identical to SEQ ID NO: 154788

SEQ ID NO: 717174 - RNA, 64 nt, Homo Sapiens; identical to SEQ ID NO: 154789

SEQ ID NO: 717175 - RNA, 64 nt, Homo Sapiens; identical to SEQ ID NO: 154790

SEQ ID NO: 717176 - RNA, 64 nt, Homo Sapiens; identical to SEQ ID NO: 154791

SEQ ID NO: 717177 - RNA, 64 nt, Homo Sapiens; identical to SEQ ID NO: 154792

SEQ ID NO: 717178 - RNA, 64 nt, Homo Sapiens; identical to SEQ ID NO: 154793

SEQ ID NO: 717179 - RNA, 64 nt, Homo Sapiens; identical to SEQ ID NO: 154794

SEQ ID NO: 717180 - RNA, 64 nt, Homo Sapiens; identical to SEQ ID NO: 154795

SEQ ID NO: 717181 - RNA, 64 nt, Homo Sapiens; identical to SEQ ID NO: 154796

SEQ ID NO: 717182 - RNA, 64 nt, Homo Sapiens; identical to SEQ ID NO: 154797

SEQ ID NO: 717183 - RNA, 64 nt, Homo Sapiens; identical to SEQ ID NO: 154798

SEQ ID NO: 717184 - RNA, 64 nt, Homo Sapiens; identical to SEQ ID NO: 154799

SEQ ID NO: 717185 - RNA, 64 nt, Homo Sapiens; identical to SEQ ID NO: 154800

SEQ ID NO: 717186 - RNA, 64 nt, Homo Sapiens
gggagagguguucgguuuccccagccuguuaaugaacagccauacguguaagcuuuuucuugag

SEQ ID NO: 717187 - RNA, 64 nt, Homo Sapiens
aaauaguaagcugguuuagaaacugacgagggcaaacagccaggacgcauuggagaggaauuug

SEQ ID NO: 717188 - RNA, 64 nt, Homo Sapiens
augugccaaggugggguauuuaccacagcagcugaacagccaaaugcauggugcaguugacagc

SEQ ID NO: 717189 - RNA, 64 nt, Homo Sapiens
gagaauuuaaaaauaagaaaauacauaagaccauaacagccaacagguggcaggaccaggacua

SEQ ID NO: 717190 - RNA, 64 nt, Homo Sapiens
ugauuuauguuucccucaguagccaaaaaugaauaacagccauugguauucaaaaaugaauaac

SEQ ID NO: 717191 - RNA, 64 nt, Homo Sapiens
aaugaauaacagccauuugaauucaaaaaugaauaacagccaaaaagcaguaauauuaacuggu

SEQ ID NO: 717192 - RNA, 64 nt, Homo Sapiens
uuuauagacagagaaaguaucugcugcuacugcuaacagccaaucuccccuuggccaggacaug

SEQ ID NO: 717193 - RNA, 64 nt, Homo Sapiens
gggggaccagcuucugccaguggacaagcuggggaacagccauagaugugccugucacccccau

SEQ ID NO: 717194 - RNA, 64 nt, Homo Sapiens
uccucgggcaccaaaguagguccccagcaucacaaacagccauuggcgucagcaucuugacuuu

SEQ ID NO: 717195 - RNA, 64 nt, Homo Sapiens
aggcgucagcaucuugacuuccuggaaaggcuagaacagccauuccccaucuucauguuacaaa

SEQ ID NO: 717196 - RNA, 64 nt, Homo Sapiens
gagccauguaggaaaugcacugauugcauguuauuguggcaagaauauccuaaaugucauuaaa

SEQ ID NO: 717197 - RNA, 64 nt, Homo Sapiens
aaugagcauuugaaauagauaauccuuuaagccuuguggcaaaauuuuuguggcuuuuguuuaa

SEQ ID NO: 717198 - RNA, 64 nt, Homo Sapiens
ucauacuugagagaaauccuacaaauguaaagaauguggcaaaccuuuggaugauccacaaacc

SEQ ID NO: 717199 - RNA, 64 nt, Homo Sapiens
caugcuggagggaagcccuacacauguggcagaauguggcaaagcauuuaauugguccucaaug

SEQ ID NO: 717200 - RNA, 64 nt, Homo Sapiens
auucaugcuggagagaaacuucacaugugaaccguguggcaaagccuuuaaaugguccucaacc

SEQ ID NO: 717201 - RNA, 64 nt, Homo Sapiens
uuauaccagagagaaacccuacacauguaaagaauguggcaaagccuucaauagguucucaacc

SEQ ID NO: 717202 - RNA, 64 nt, Homo Sapiens
ugauauuggugagaagccacaaaaauaugaaaaauguggcaaagccuucaaaugcuugucacau

SEQ ID NO: 717203 - RNA, 64 nt, Homo Sapiens
uucguacuggagagaauccuacaaaugugaaaaauguggcaaauccuuuaacugauccucaacu

SEQ ID NO: 717204 - RNA, 64 nt, Homo Sapiens
ucauacuggagaaaagccauacaaaugagaagaauguggcaaugccuuuaaucaguccucacac

SEQ ID NO: 717205 - RNA, 64 nt, Homo Sapiens
uuauacuggagaggaacucuauaguugugaagaauguggcaaagcuuuuaaccaauccucauac

SEQ ID NO: 717206 - RNA, 64 nt, Homo Sapiens
ucauacuggagagaaagccuacaauugugaagaauguggcaaagcuuuuaaccuuccuuaaccc

SEQ ID NO: 717207 - RNA, 64 nt, Homo Sapiens
ucauacuggaaagaaacccuacaaaugugaagucuguggcaaagcuuuuaacugauucucaacu

SEQ ID NO: 717208 - RNA, 64 nt, Homo Sapiens
uauacuuugagagaaacccugcaaaugugaauaauguggcaauacuuuaaaccaauccucaaac

SEQ ID NO: 717209 - RNA, 64 nt, Homo Sapiens
ccauacugaagaaaacuccuggaaguguaaaaaauguggcaacacuuuuaauaaaugcucaccc

SEQ ID NO: 717210 - RNA, 64 nt, Homo Sapiens
uuacacuagagagaaagccuacaaaugugaagaauguggcaaagccuuuaaccaguuuucaacc

SEQ ID NO: 717211 - RNA, 64 nt, Homo Sapiens
ucacaguggagaaaaacccuacaaaugugaagaauguggcaaagcuuuuaaccaguccucacac

SEQ ID NO: 717212 - RNA, 64 nt, Homo Sapiens
ucauaguaaagagaaacccuacaaaugugaacaguguggcaaggucuuuaagaaguccucaacu

SEQ ID NO: 717213 - RNA, 64 nt, Homo Sapiens
ucauacuggagagaaaccuuacaaaugugaggaauguggcaaagguuuuagccaacucucaaac

SEQ ID NO: 717214 - RNA, 64 nt, Homo Sapiens
ucaaacuggagagaaacucuacaaaugugaagaauguggcaaagcuuuuaaccaagucucaaca

SEQ ID NO: 717215 - RNA, 64 nt, Homo Sapiens
cuucuaaccauuucucaaccacaagugugaagaauguggcaaaaucauacuggagagaaaccuu

SEQ ID NO: 717216 - RNA, 64 nt, Homo Sapiens
cuucuaccugauccucaaaaacaaaugugaugaauguggcaaagucauacugaagagaaacagu

SEQ ID NO: 717217 - RNA, 64 nt, Homo Sapiens
cuuuuaaccaaucuucaacaacaaaugugaagaauguggcaaagucauacuggagagaaacccu

SEQ ID NO: 717218 - RNA, 64 nt, Homo Sapiens
gacucuucuuggagauuuucacuugguccuagaauguggcaacguaguugugcucgccagaacg

SEQ ID NO: 717219 - RNA, 64 nt, Homo Sapiens
ugaguaugcugacaccagaaacucagagccagcuuguggcaagcaguugggguggggggucucu

SEQ ID NO: 717220 - RNA, 64 nt, Homo Sapiens
aaugcuacugaaacuuaccugagaaccauaggacuguggcaaacaaaaccaauucaugaaguga

SEQ ID NO: 717221 - RNA, 64 nt, Homo Sapiens
ucaucacaauuagggaaugguuaguggucucuacuguggcaaaugccaacuguuggaauucacu

SEQ ID NO: 717222 - RNA, 54 nt, Homo Sapiens
gagaaacccuacaaaugugaagauuguggcaaagccucuaacccguccugaauu

SEQ ID NO: 717223 - RNA, 64 nt, Homo Sapiens
ucauacugaagaaaacuucuacaagugugaacaguguggcaaaacuuuuaaugaaugcucacac

SEQ ID NO: 717224 - RNA, 54 nt, Homo Sapiens
aagagacuguacaaaagugaagaauguggcaaaggccuuuacugcuccuauucc

SEQ ID NO: 717225 - RNA, 64 nt, Homo Sapiens
aggccuuuacugcuccuauucccuuacuaaagaauguggcaaagcuuuucaccaguacuuuacc

SEQ ID NO: 717226 - RNA, 64 nt, Homo Sapiens
uaaugcuggagagaaacccuacaaaugugaagaauguggcaaagauuucuauugauucucauac

SEQ ID NO: 717227 - RNA, 64 nt, Homo Sapiens
ucauauuggagagaaauucuacagaugugaagaauguggcaaaggcuuuaauuaguucucaucc

SEQ ID NO: 717228 - RNA, 64 nt, Homo Sapiens
ucauaaaggagauaaauuauacaaaugugaagaauguggcaaagcuuuuaacaaauccucaucc

SEQ ID NO: 717229 - RNA, 64 nt, Homo Sapiens
ucauacuggagagaaaaccuacaaaugugaggaauguggcaaagccuuuagccugucccuccaa

SEQ ID NO: 717230 - RNA, 64 nt, Homo Sapiens
uuauacuggagagaagcccuacaaaugugaaaaauguggcaaaccuuuuaaccaauccucaacc

SEQ ID NO: 717231 - RNA, 64 nt, Homo Sapiens
ucaugcuggagagaaacccuacaaaugugaaaaauguggcaaagcuuuuaaccaauuuucaaac

SEQ ID NO: 717232 - RNA, 64 nt, Homo Sapiens
ucauacuggagaaaaaucuuacaaaugugaagaauguggcaaagccuuuauccaguccucaacu

SEQ ID NO: 717233 - RNA, 64 nt, Homo Sapiens
uaaugauggagagaaaccauacaacugugaagaauguggcaaagcuuuuaaccaguccucaaac

SEQ ID NO: 717234 - RNA, 64 nt, Homo Sapiens
ucauauuggaaaaauuuccuacaaguaagaacaauguggcaaaguuuuuaacuaauacaccuua

SEQ ID NO: 717235 - RNA, 51 nt, Homo Sapiens
guaccuuacagauggaaugaauguggcaaaaucuuuaguuagaauucacac

SEQ ID NO: 717236 - RNA, 64 nt, Homo Sapiens
ggacucaggagaaaaaccuuacaaauaucauaaauguggcaaagaauuuaguuugcauugaagc

SEQ ID NO: 717237 - RNA, 64 nt, Homo Sapiens
ucauacuggagagaaaccuuacaaguguaaugaguguggcaaagccuuuagugaccagucaaca

SEQ ID NO: 717238 - RNA, 64 nt, Homo Sapiens
ccauaaugaagagagaucuuccgaguguaauaaauguggcaaauuuuucagacaucguucauac

SEQ ID NO: 717239 - RNA, 64 nt, Homo Sapiens
ucauacuggagagaaaccuuacaaaugucaugacuguggcaaggucuucagucaagcuucaucc

SEQ ID NO: 717240 - RNA, 64 nt, Homo Sapiens
cccuacuggagagaaaucuuacaaaugucaucaguguggcaaggucuucaguccgaggucacuc

SEQ ID NO: 717241 - RNA, 64 nt, Homo Sapiens
uuuuuaaugaauacucacacacaagugugaagaauguggcaaaauucuuacuagaaaaacucuu

SEQ ID NO: 717242 - RNA, 64 nt, Homo Sapiens
cauuuaacuggucccuaaauacaaauguaaagaauguggcaaagucauacuagagagaaacccu

SEQ ID NO: 717243 - RNA, 64 nt, Homo Sapiens
ccuuuaacuggcucuuaaucacaaaugugauaaauguggcaaagucauacuggagagaaauccu

SEQ ID NO: 717244 - RNA, 64 nt, Homo Sapiens
auaaaauuugcaagaaaauguuagauucuuaaaguguggcaaacguucuuuguuaaaaaaaaaa

SEQ ID NO: 717245 - RNA, 54 nt, Homo Sapiens
ccuuuuaccaguccucaacuaaaauguggcaaaggagaaacccuacaaauguga

SEQ ID NO: 717246 - RNA, 64 nt, Homo Sapiens
ccuuuaaccaguccuuaaggauaauuguguggaauguggcaaagucauacuggagggaauuccu

SEQ ID NO: 717247 - RNA, 64 nt, Homo Sapiens
cuuuuagcuguuccucaaucacaaaugugaagaauguggcaagcuuauacaggagggaaacccu

SEQ ID NO: 717248 - RNA, 64 nt, Homo Sapiens
cuuuuaaacaguccucaaucacaaaggugaagaauguggcaaagucauacuggagagaaaaucu

SEQ ID NO: 717249 - RNA, 64 nt, Homo Sapiens
ucuucuggcacaauucucacacaaauguaaugaauguggcaaggucuugcuggugagaaaccua

SEQ ID NO: 717250 - RNA, 64 nt, Homo Sapiens
ucuuaagguaaaaucugagaacuaauguacugaauguggcaaggccauagaggacagaaacuuu

SEQ ID NO: 717251 - RNA, 64 nt, Homo Sapiens
ucuucaguccaagaucacucacaaaugucaucaguguggcaaggcuauacuggacagaaaucuu

SEQ ID NO: 717252 - RNA, 64 nt, Homo Sapiens
ccuuugcuucacguucacacacaagugugaugauuguggcaaaguuauacaggagagaaaccuc

SEQ ID NO: 717253 - RNA, 64 nt, Homo Sapiens
uuuucagagaucguucacauacaaguguaauaaauguggcaaauccauaaugaagagagaucuu

SEQ ID NO: 717254 - RNA, 64 nt, Homo Sapiens
ccuuuggcaagcagucaacaacaaguguaaugaguguggcaaagucacacuggagagaaaccuu

SEQ ID NO: 717255 - RNA, 64 nt, Homo Sapiens
ucuugaguccgaggucacucacaaaugucagaaguguggcaaggcccuacuggacagaaaucuu

SEQ ID NO: 717256 - RNA, 64 nt, Homo Sapiens
ccuuuacuucauguucacacacaugugugaugauuguggcaaagucauacaggagagaaaccuc

SEQ ID NO: 717257 - RNA, 64 nt, Homo Sapiens
ucuucagucaagcuucauccacaaaugucaugacuguggcaaggucauacuggagagaaaccuu

SEQ ID NO: 717258 - RNA, 64 nt, Homo Sapiens
uuuucagacaucauucauacacaaguguaauaaauguggcaaaucuauaaugaauaaagaucua

SEQ ID NO: 717259 - RNA, 64 nt, Homo Sapiens
cguuuacuucacauucacacacaagugugaugauuguggcaaaguucauacaggagagaaacuc

SEQ ID NO: 717260 - RNA, 64 nt, Homo Sapiens
ucuucagucaaguuucauccauaaaugucaugauuguggcaaggucaugcuggagagaaaccuu

SEQ ID NO: 717261 - RNA, 64 nt, Homo Sapiens
ccuuuagugggcagucaccaacaagugcaaugaguguggcaaagucacacuggagagaaaccuu

SEQ ID NO: 717262 - RNA, 64 nt, Homo Sapiens
ccuuuggucaaaauucauacacaaaugugaugaguguggcaacaucaaacuggagagaaaccuu

SEQ ID NO: 717263 - RNA, 64 nt, Homo Sapiens
uuuuuaaucaaaaaacaaccacaaguguaaugaauguggcaaggucauacuggagagaaacuuu

SEQ ID NO: 717264 - RNA, 64 nt, Homo Sapiens
ccuuccaucacaauucaaccaaaaguguaaugaguguggcaacaucauaguggagagaaaccuu

SEQ ID NO: 717265 - RNA, 62 nt, Homo Sapiens
ccuucagucagaugucaaacaaguguaaugaguguggcaagaauaguggagagaaaccuuga

SEQ ID NO: 717266 - RNA, 64 nt, Homo Sapiens
cguuuacuucacauucacacacaagugugaugauuguggcaaagucauacaggagagaaaccuc

SEQ ID NO: 717267 - RNA, 64 nt, Homo Sapiens
uuuucagacaucguucaugcacaaguguaauaaauguggcaaauauccacagugaagagaucuu

SEQ ID NO: 717268 - RNA, 64 nt, Homo Sapiens
ccuuuagugggcagucaccaacaagugcaaugaguguggcaaacucacacuggagagaaaccuu

SEQ ID NO: 717269 - RNA, 64 nt, Homo Sapiens
ccguuggucaaaauucacacauaaguguaaugaguguggcaagaacacuggagagaaacucauu

SEQ ID NO: 717270 - RNA, 64 nt, Homo Sapiens
uuuuuaaucaaaaagcaaccacaagcauaaugaauguggcaaggucauacuggagagaaaccuu

SEQ ID NO: 717271 - RNA, 62 nt, Homo Sapiens
ccuuccaucacaauucaaccuaguguaaugaguguggcaagaauaguggagagaagccuuaa

SEQ ID NO: 717272 - RNA, 64 nt, Homo Sapiens
ucaggcuuagacauucauggauaugcuuuucuuucauuaggaacauuuugcuggugaugaggaa

SEQ ID NO: 717273 - RNA, 64 nt, Homo Sapiens
augaaaucuguuacucuacaaggaagguguucaucauuaggaggcagcuuuacuaagcuggugc

SEQ ID NO: 717274 - RNA, 64 nt, Homo Sapiens
ucuuaaugggaugaaaaccuauauaggagaguaccauuaggaauagaaauuauaccucaccagu

SEQ ID NO: 717275 - RNA, 64 nt, Homo Sapiens
agugaggcuaguugagaaauggagcgugacauuucauuaggaacucaguuaauacgugauagcu

SEQ ID NO: 717276 - RNA, 64 nt, Homo Sapiens
aaaggauuuaaucccuucaaucauauucccgaggcauuaggaaguaaagauuugaaagagaauc

SEQ ID NO: 717277 - RNA, 64 nt, Homo Sapiens
auaaaaacuugcaguucuauaauaaaguuaaguucauuaggaauuguauuuaaaucauugcuau

SEQ ID NO: 717278 - RNA, 64 nt, Homo Sapiens
augugaagcuaaucugcucaauaagauggucuagcauuaggaacacuaauugaucguuuaaggc

SEQ ID NO: 717279 - RNA, 64 nt, Homo Sapiens
accugagugcauuucccaccgagcauacucugugcauuaggaagucuuccugaugucacagccu

SEQ ID NO: 717280 - RNA, 64 nt, Homo Sapiens; identical to SEQ ID NO: 250605

SEQ ID NO: 717281 - RNA, 64 nt, Homo Sapiens; identical to SEQ ID NO: 250606

SEQ ID NO: 717282 - RNA, 64 nt, Homo Sapiens; identical to SEQ ID NO: 250607

SEQ ID NO: 717283 - RNA, 64 nt, Homo Sapiens; identical to SEQ ID NO: 250608

SEQ ID NO: 717284 - RNA, 64 nt, Homo Sapiens; identical to SEQ ID NO: 250609

SEQ ID NO: 717285 - RNA, 64 nt, Homo Sapiens; identical to SEQ ID NO: 250610

SEQ ID NO: 717286 - RNA, 64 nt, Homo Sapiens; identical to SEQ ID NO: 84778

SEQ ID NO: 717287 - RNA, 64 nt, Homo Sapiens; identical to SEQ ID NO: 84779

SEQ ID NO: 717288 - RNA, 64 nt, Homo Sapiens; identical to SEQ ID NO: 84780

SEQ ID NO: 717289 - RNA, 64 nt, Homo Sapiens; identical to SEQ ID NO: 84781

SEQ ID NO: 717290 - RNA, 64 nt, Homo Sapiens; identical to SEQ ID NO: 84782

SEQ ID NO: 717291 - RNA, 64 nt, Homo Sapiens; identical to SEQ ID NO: 84783

SEQ ID NO: 717292 - RNA, 64 nt, Homo Sapiens; identical to SEQ ID NO: 84784

SEQ ID NO: 717293 - RNA, 64 nt, Homo Sapiens; identical to SEQ ID NO: 84785

SEQ ID NO: 717294 - RNA, 64 nt, Homo Sapiens; identical to SEQ ID NO: 84786

SEQ ID NO: 717295 - RNA, 64 nt, Homo Sapiens; identical to SEQ ID NO: 84787

SEQ ID NO: 717296 - RNA, 64 nt, Homo Sapiens; identical to SEQ ID NO: 84788

SEQ ID NO: 717297 - RNA, 64 nt, Homo Sapiens; identical to SEQ ID NO: 84789

SEQ ID NO: 717298 - RNA, 64 nt, Homo Sapiens; identical to SEQ ID NO: 47705

SEQ ID NO: 717299 - RNA, 64 nt, Homo Sapiens; identical to SEQ ID NO: 47706

SEQ ID NO: 717300 - RNA, 64 nt, Homo Sapiens; identical to SEQ ID NO: 47707

SEQ ID NO: 717301 - RNA, 64 nt, Homo Sapiens; identical to SEQ ID NO: 47708

SEQ ID NO: 717302 - RNA, 64 nt, Homo Sapiens; identical to SEQ ID NO: 47709

SEQ ID NO: 717303 - RNA, 53 nt, Homo Sapiens; identical to SEQ ID NO: 47710

SEQ ID NO: 717304 - RNA, 64 nt, Homo Sapiens; identical to SEQ ID NO: 283920

SEQ ID NO: 717305 - RNA, 64 nt, Homo Sapiens; identical to SEQ ID NO: 283921

SEQ ID NO: 717306 - RNA, 64 nt, Homo Sapiens; identical to SEQ ID NO: 283922

SEQ ID NO: 717307 - RNA, 64 nt, Homo Sapiens; identical to SEQ ID NO: 283923

SEQ ID NO: 717308 - RNA, 64 nt, Homo Sapiens; identical to SEQ ID NO: 283924

SEQ ID NO: 717309 - RNA, 64 nt, Homo Sapiens; identical to SEQ ID NO: 283925

SEQ ID NO: 717310 - RNA, 64 nt, Homo Sapiens; identical to SEQ ID NO: 283926

SEQ ID NO: 717311 - RNA, 64 nt, Homo Sapiens; identical to SEQ ID NO: 283927

SEQ ID NO: 717312 - RNA, 64 nt, Homo Sapiens; identical to SEQ ID NO: 283928

SEQ ID NO: 717313 - RNA, 64 nt, Homo Sapiens; identical to SEQ ID NO: 283929

SEQ ID NO: 717314 - RNA, 64 nt, Homo Sapiens; identical to SEQ ID NO: 283930

SEQ ID NO: 717315 - RNA, 64 nt, Homo Sapiens; identical to SEQ ID NO: 283931

SEQ ID NO: 717316 - RNA, 64 nt, Homo Sapiens; identical to SEQ ID NO: 283932

SEQ ID NO: 717317 - RNA, 64 nt, Homo Sapiens; identical to SEQ ID NO: 283933

SEQ ID NO: 717318 - RNA, 64 nt, Homo Sapiens; identical to SEQ ID NO: 283934

SEQ ID NO: 717319 - RNA, 64 nt, Homo Sapiens; identical to SEQ ID NO: 283935

SEQ ID NO: 717320 - RNA, 64 nt, Homo Sapiens; identical to SEQ ID NO: 283930

SEQ ID NO: 717321 - RNA, 64 nt, Homo Sapiens; identical to SEQ ID NO: 283937

SEQ ID NO: 717322 - RNA, 64 nt, Homo Sapiens; identical to SEQ ID NO: 283938

SEQ ID NO: 717323 - RNA, 64 nt, Homo Sapiens; identical to SEQ ID NO: 283939

SEQ ID NO: 717324 - RNA, 64 nt, Homo Sapiens; identical to SEQ ID NO: 283940

SEQ ID NO: 717325 - RNA, 64 nt, Homo Sapiens; identical to SEQ ID NO: 283941

SEQ ID NO: 717326 - RNA, 64 nt, Homo Sapiens; identical to SEQ ID NO: 283942

SEQ ID NO: 717327 - RNA, 64 nt, Homo Sapiens; identical to SEQ ID NO: 283943

SEQ ID NO: 717328 - RNA, 64 nt, Homo Sapiens; identical to SEQ ID NO: 283944

SEQ ID NO: 717329 - RNA, 60 nt, Homo Sapiens; identical to SEQ ID NO: 283945

SEQ ID NO: 717330 - RNA, 64 nt, Homo Sapiens; identical to SEQ ID NO: 283946

SEQ ID NO: 717331 - RNA, 64 nt, Homo Sapiens; identical to SEQ ID NO: 283947

SEQ ID NO: 717332 - RNA, 64 nt, Homo Sapiens; identical to SEQ ID NO: 283948

SEQ ID NO: 717333 - RNA, 64 nt, Homo Sapiens; identical to SEQ ID NO: 283949

SEQ ID NO: 717334 - RNA, 64 nt, Homo Sapiens; identical to SEQ ID NO: 283950

SEQ ID NO: 717335 - RNA, 64 nt, Homo Sapiens; identical to SEQ ID NO: 283951

SEQ ID NO: 717336 - RNA, 64 nt, Homo Sapiens; identical to SEQ ID NO: 283952

SEQ ID NO: 717337 - RNA, 64 nt, Homo Sapiens; identical to SEQ ID NO: 283953

SEQ ID NO: 717338 - RNA, 64 nt, Homo Sapiens; identical to SEQ ID NO: 283954

SEQ ID NO: 717339 - RNA, 64 nt, Homo Sapiens; identical to SEQ ID NO: 283955

SEQ ID NO: 717340 - RNA, 64 nt, Homo Sapiens; identical to SEQ ID NO: 283956

SEQ ID NO: 717341 - RNA, 64 nt, Homo Sapiens; identical to SEQ ID NO: 283957

SEQ ID NO: 717342 - RNA, 64 nt, Homo Sapiens; identical to SEQ ID NO: 283958

SEQ ID NO: 717343 - RNA, 64 nt, Homo Sapiens; identical to SEQ ID NO: 283959

SEQ ID NO: 717344 - RNA, 64 nt, Homo Sapiens; identical to SEQ ID NO: 283960

SEQ ID NO: 717345 - RNA, 64 nt, Homo Sapiens; identical to SEQ ID NO: 283961

SEQ ID NO: 717346 - RNA, 64 nt, Homo Sapiens; identical to SEQ ID NO: 283962

SEQ ID NO: 717347 - RNA, 64 nt, Homo Sapiens; identical to SEQ ID NO: 283963

SEQ ID NO: 717348 - RNA, 64 nt, Homo Sapiens; identical to SEQ ID NO: 283964

SEQ ID NO: 717349 - RNA, 64 nt, Homo Sapiens; identical to SEQ ID NO: 283965

SEQ ID NO: 717350 - RNA, 64 nt, Homo Sapiens; identical to SEQ ID NO: 283966

SEQ ID NO: 717351 - RNA, 64 nt, Homo Sapiens; identical to SEQ ID NO: 283967

SEQ ID NO: 717352 - RNA, 64 nt, Homo Sapiens; identical to SEQ ID NO: 283968

SEQ ID NO: 717353 - RNA, 64 nt, Homo Sapiens; identical to SEQ ID NO: 283969

SEQ ID NO: 717354 - RNA, 64 nt, Homo Sapiens; identical to SEQ ID NO: 283970

SEQ ID NO: 717355 - RNA, 64 nt, Homo Sapiens; identical to SEQ ID NO: 283971

SEQ ID NO: 717356 - RNA, 64 nt, Homo Sapiens; identical to SEQ ID NO: 283972

SEQ ID NO: 717357 - RNA, 64 nt, Homo Sapiens; identical to SEQ ID NO: 283973

SEQ ID NO: 717358 - RNA, 64 nt, Homo Sapiens; identical to SEQ ID NO: 283974

SEQ ID NO: 717359 - RNA, 64 nt, Homo Sapiens; identical to SEQ ID NO: 283975

SEQ ID NO: 717360 - RNA, 64 nt, Homo Sapiens; identical to SEQ ID NO: 283976

SEQ ID NO: 717361 - RNA, 64 nt, Homo Sapiens; identical to SEQ ID NO: 283977

SEQ ID NO: 717362 - RNA, 64 nt, Homo Sapiens; identical to SEQ ID NO: 283978

SEQ ID NO: 717363 - RNA, 64 nt, Homo Sapiens; identical to SEQ ID NO: 283979

SEQ ID NO: 717364 - RNA, 64 nt, Homo Sapiens; identical to SEQ ID NO: 283980

SEQ ID NO: 717365 - RNA, 64 nt, Homo Sapiens; identical to SEQ ID NO: 283981

SEQ ID NO: 717366 - RNA, 64 nt, Homo Sapiens; identical to SEQ ID NO: 283982

SEQ ID NO: 717367 - RNA, 64 nt, Homo Sapiens; identical to SEQ ID NO: 283983

SEQ ID NO: 717368 - RNA, 64 nt, Homo Sapiens; identical to SEQ ID NO: 283984

SEQ ID NO: 717369 - RNA, 64 nt, Homo Sapiens
auggagcaaaacuguauaaacugauuuguaacuaacacuggaccauuggaucgauauuauaugc

SEQ ID NO: 717370 - RNA, 64 nt, Homo Sapiens
ucacugugaaaaauaacaguccaccccaagucauacacuggacccagugccugcggggacagga

SEQ ID NO: 717371 - RNA, 64 nt, Homo Sapiens
cuuugauucacccuccacagcagacaauaaacuuacacuggaaguuuggcucugguguuuucgc

SEQ ID NO: 717372 - RNA, 64 nt, Homo Sapiens
cucaaacucuuaggcucagggaugugaugauagcacacuggagcuagggcaguggcuauucaca

SEQ ID NO: 717373 - RNA, 64 nt, Homo Sapiens
cccuuggggaaggguggggagaaauauaggauagacacuggacauggcccauuggagcaccugg

SEQ ID NO: 717374 - RNA, 64 nt, Homo Sapiens
guggcugcgcccccagcuucucucucccugucacacacuggaccccacuggcugagaaucuggg

SEQ ID NO: 717375 - RNA, 64 nt, Homo Sapiens
ucagcuugggcuucuuccuccuccaucaccugaaacacuggaccuggggguagccccgccccag

SEQ ID NO: 717376 - RNA, 64 nt, Homo Sapiens
ucugggacaagaaaaagaaaacacaagaauguauacacuggaagauuugggccuccugccugcc

SEQ ID NO: 717377 - RNA, 64 nt, Homo Sapiens
gaugaggagguacagacacgugaccuuuuggugcacacuggagcuacuuggacaagaccagcau

SEQ ID NO: 717378 - RNA, 64 nt, Homo Sapiens
cucuuaggaaguaucaaaauaaaaugaucugauuacacuggacauagggucaauaacccauuau

SEQ ID NO: 717379 - RNA, 64 nt, Homo Sapiens
gcaugguugaaugugucuuucauuaagguauugaacacuggauucaaucagcauuguuauuuau

SEQ ID NO: 717380 - RNA, 64 nt, Homo Sapiens
ggggaccugcgcccccacaucacaggaagccuucacacuggaaggggucaggaacacuacacug

SEQ ID NO: 717381 - RNA, 64 nt, Homo Sapiens
aggagcugggucagccucugaggagucacagcauacacuggaaccgagcuccagcugccuuagg

SEQ ID NO: 717382 - RNA, 64 nt, Homo Sapiens
ucuuaauagguucaaaagcaaucuggucugaauaacacuggauuuguuucugugaucucugagg

SEQ ID NO: 717383 - RNA, 64 nt, Homo Sapiens
cuugcugauuuucagacagggaagucucucuauuacacuggagcuguuuuauagauaagucaau

SEQ ID NO: 717384 - RNA, 64 nt, Homo Sapiens
gaagcuucuacgcgcuagagaggaucaaggggccacacuggaccaugugaacagccauccugaa

SEQ ID NO: 717385 - RNA, 64 nt, Homo Sapiens
ugugaacagccauccugaacugccaucagcuaccacacuggacucugcagggcagccauccugg

SEQ ID NO: 717386 - RNA, 64 nt, Homo Sapiens
uguguuuaaacaaauguaauauuuuguacaagauacacuggagaacaaagggaacucaagauuc

SEQ ID NO: 717387 - RNA, 64 nt, Homo Sapiens
ggccccucuggccagggccccuguggcuuccugcacacuggacaggugacuguaugguagagac

SEQ ID NO: 717388 - RNA, 64 nt, Homo Sapiens
ucugccaagucauuucaaauacaugaaaaaucuuacacuggagagaaacccuaugaguguaagc

SEQ ID NO: 717389 - RNA, 64 nt, Homo Sapiens
uccuucacuuccuuucgauaucaugaaaggacucacacuggagagaaccccuaugaguguaagc

SEQ ID NO: 717390 - RNA, 64 nt, Homo Sapiens
ucugucaaaaaucuucgauuucauaaaaggacacacacuggagagaaacccugugaauguaaga

SEQ ID NO: 717391 - RNA, 64 nt, Homo Sapiens
uugccuacuuccuuucauagacaugaaaagacucacacuggaaggaaacacuaugaaugcaagc

SEQ ID NO: 717392 - RNA, 64 nt, Homo Sapiens
ucuucuaguucccuucaauaucaugaaaggacucacacuggagagaagcccuaugaauauaagc

SEQ ID NO: 717393 - RNA, 64 nt, Homo Sapiens
ucagccucgcaccuucaaaugcauggaaggacucacacuggagaaaaacccuaugaauguaagc

SEQ ID NO: 717394 - RNA, 64 nt, Homo Sapiens
ucugccaaguuauuucaaacacaugaaaaaauucacacuggagagaaacccuauaaaugcaagc

SEQ ID NO: 717395 - RNA, 64 nt, Homo Sapiens
ucugucaagaaccuuucaauuuaugaaaggacacacacuggagagaaacccuaugaauguaaga

SEQ ID NO: 717396 - RNA, 64 nt, Homo Sapiens
aucugccaagaucguuugaauacaugcaaaacacacacuggagagaaaccuaugaauguaagga

SEQ ID NO: 717397 - RNA, 64 nt, Homo Sapiens
ucugccaagucauuucgaagacaugaaaaaacucacacuggagagaaacccuauaaaugcaugc

SEQ ID NO: 717398 - RNA, 64 nt, Homo Sapiens
cuuuccaguuccuuucaguaucaugaaaggacucacacuggagagaaacccuaugaguguaagc

SEQ ID NO: 717399 - RNA, 64 nt, Homo Sapiens
aguuccaguuccuuuugguaccaugaaaggacucacacuggagagaaacccuaugaguguaagc

SEQ ID NO: 717400 - RNA, 64 nt, Homo Sapiens
ucugccccacaccuucgaauccaugguagaacucacacuggagagaaacccuaugaguguaagg

SEQ ID NO: 717401 - RNA, 64 nt, Homo Sapiens
ucugccaagucauuucaaauaccugaaaaaucuuacacuggagagaaacccuaugaguguaagc

SEQ ID NO: 717402 - RNA, 64 nt, Homo Sapiens
ucuuucacuucuuuucgauaacaugaaaggacucacacuggagagaaacccuaugaguguaagc

SEQ ID NO: 717403 - RNA, 64 nt, Homo Sapiens
ucuaccucacaccuucgaaaacaugguaggacucacacuggauagaaaccaaagcaggugaauc

SEQ ID NO: 717404 - RNA, 64 nt, Homo Sapiens
gguuccagacugguuggacuuguucgucuggacgacacuggaguggaacacugccucccacuuu

SEQ ID NO: 717405 - RNA, 64 nt, Homo Sapiens
cacuuucuugggacuuggagggagguggaacagcacacuggacuucucccgucucuagggcugc

SEQ ID NO: 717406 - RNA, 64 nt, Homo Sapiens
caccaacauauuguggcuggacagcaggcaguacacacuggagaaagacugaaugccgugaacg

SEQ ID NO: 717407 - RNA, 64 nt, Homo Sapiens
uacuacuccacacuacuuagacaucauguaguucacacuggaaaaaggccacguaugugccuug

SEQ ID NO: 717408 - RNA, 64 nt, Homo Sapiens
gacagcuguacacugaagagucaucagagaguucacacuggagaaagaccuuuugaaugcagca

SEQ ID NO: 717409 - RNA, 64 nt, Homo Sapiens
uacaacuccagccucauuaaacaucggagaauucacacuggagagagaccuuaucagugcagug

SEQ ID NO: 717410 - RNA, 64 nt, Homo Sapiens
ggaaauccguuagccacaccuccagucucauucaacacuggacaguuuacaauguggacaaugu

SEQ ID NO: 717411 - RNA, 64 nt, Homo Sapiens
caaaggccuaacccuauucaacaccagaaaguuuacacuggagaaaggccuuagggugacaggu

SEQ ID NO: 717412 - RNA, 64 nt, Homo Sapiens
agcuggcaauugaacaucauucaucuaaauaugcacacuggaggcaagaugagaauuccugaca

SEQ ID NO: 717413 - RNA, 64 nt, Homo Sapiens
cgaaaaucuagccuuauuauacaucugagaguucacacuggagaaaggccuuaugagugcagug

SEQ ID NO: 717414 - RNA, 64 nt, Homo Sapiens
gaaaacuccagccuuauuaaacacuugagaguucacacuggagaaaggccauaugaaugcauug

SEQ ID NO: 717415 - RNA, 64 nt, Homo Sapiens
gauguggagguaauauuauuuuuucuucaauauaacacuggaggaaaccccuuaugaggaugcc

SEQ ID NO: 717416 - RNA, 64 nt, Homo Sapiens
gaaaccuuauaaauguaagggcacaugagaaugcacacuggagauuccuuacaggcuuucgagu

SEQ ID NO: 717417 - RNA, 64 nt, Homo Sapiens
gaaaccuuaugaauguaaacacaugaaagaacccacacuggagaacucuugcagguuuccagau

SEQ ID NO: 717418 - RNA, 64 nt, Homo Sapiens
uaaacccuuugaguguaaaaacaugaaaguacucacacuggagaucuccuuuagguuuucaagc

SEQ ID NO: 717419 - RNA, 64 nt, Homo Sapiens
aaaacccuaugaauguaaaaacaugaaagaacucacacuggagaucuucuguagguuuucaagc

SEQ ID NO: 717420 - RNA, 64 nt, Homo Sapiens
uaaacccuuuaaguguaaagacauggaaggacucacacuggagaugucaacguucuuuccaaau

SEQ ID NO: 717421 - RNA, 64 nt, Homo Sapiens
gaugcuguaugauauaaggaucaugaaauaucucacacuggagaaauuuuuauuccuuucaaaa

SEQ ID NO: 717422 - RNA, 64 nt, Homo Sapiens
gaaacccuauaaauguaaauucaugaauaaacuuacacuggacaauuuccaguucccuuugaua

SEQ ID NO: 717423 - RNA, 64 nt, Homo Sapiens
gaagccguaugaauguaaggacaugaaaggauucacacuggagacauuuuggucacuuaaagca

SEQ ID NO: 717424 - RNA, 64 nt, Homo Sapiens
uggaccucacaaaaugcaagacacaugacaaugcacacuggagacauagcucaagcuuucgaag

SEQ ID NO: 717425 - RNA, 64 nt, Homo Sapiens
gaagaaacucuaugaaugcaucaugaaagaacucacacuggagauguuccaguacacugcaaag

SEQ ID NO: 717426 - RNA, 64 nt, Homo Sapiens
gaaacucuguacauguaaacacaugaaaaaacucacacuggagagauuacaguucuugucuaag

SEQ ID NO: 717427 - RNA, 64 nt, Homo Sapiens
gaaaccuuacaagugcaaugccauacuagaauucacacuggagaaaugauucacacguggcacc

SEQ ID NO: 717428 - RNA, 64 nt, Homo Sapiens
aaagccauagaaauguaaggacauaggagaauucacacuggagaucacaaauccagcuucaaau

SEQ ID NO: 717429 - RNA, 64 nt, Homo Sapiens
gaaacucauuauaaguguaaacauacuagaauucacacuggagauauaaugcauaucuggcaaa

SEQ ID NO: 717430 - RNA, 64 nt, Homo Sapiens
uacaaaugagaagagucuacuauuaauguucaaaacacuggaauuuuuuaacagaacguguauu

SEQ ID NO: 717431 - RNA, 64 nt, Homo Sapiens
uuuuuaacagaacguguauuaugggagagauuagacacuggagguuuuuauuacuuaagacuuu

SEQ ID NO: 717432 - RNA, 64 nt, Homo Sapiens; identical to SEQ ID NO: 290815

SEQ ID NO: 717433 - RNA, 64 nt, Homo Sapiens; identical to SEQ ID NO: 290816

SEQ ID NO: 717434 - RNA, 64 nt, Homo Sapiens; identical to SEQ ID NO: 290817

SEQ ID NO: 717435 - RNA, 64 nt, Homo Sapiens; identical to SEQ ID NO: 290818

SEQ ID NO: 717436 - RNA, 64 nt, Homo Sapiens; identical to SEQ ID NO: 290819

SEQ ID NO: 717437 - RNA, 64 nt, Homo Sapiens; identical to SEQ ID NO: 290820

SEQ ID NO: 717438 - RNA, 64 nt, Homo Sapiens; identical to SEQ ID NO: 290821

SEQ ID NO: 717439 - RNA, 64 nt, Homo Sapiens; identical to SEQ ID NO: 290822

SEQ ID NO: 717440 - RNA, 64 nt, Homo Sapiens; identical to SEQ ID NO: 290823

SEQ ID NO: 717441 - RNA, 64 nt, Homo Sapiens; identical to SEQ ID NO: 290824

SEQ ID NO: 717442 - RNA, 64 nt, Homo Sapiens; identical to SEQ ID NO: 290825

SEQ ID NO: 717443 - RNA, 64 nt, Homo Sapiens; identical to SEQ ID NO: 290826

SEQ ID NO: 717444 - RNA, 64 nt, Homo Sapiens; identical to SEQ ID NO: 290827

SEQ ID NO: 717445 - RNA, 64 nt, Homo Sapiens; identical to SEQ ID NO: 290828

SEQ ID NO: 717446 - RNA, 64 nt, Homo Sapiens; identical to SEQ ID NO: 290829

SEQ ID NO: 717447 - RNA, 64 nt, Homo Sapiens; identical to SEQ ID NO: 290830

SEQ ID NO: 717448 - RNA, 64 nt, Homo Sapiens; identical to SEQ ID NO: 290831

SEQ ID NO: 717449 - RNA, 64 nt, Homo Sapiens; identical to SEQ ID NO: 290832

SEQ ID NO: 717450 - RNA, 64 nt, Homo Sapiens; identical to SEQ ID NO: 290833

SEQ ID NO: 717451 - RNA, 64 nt, Homo Sapiens; identical to SEQ ID NO: 290834

SEQ ID NO: 717452 - RNA, 64 nt, Homo Sapiens; identical to SEQ ID NO: 290835

SEQ ID NO: 717453 - RNA, 64 nt, Homo Sapiens; identical to SEQ ID NO: 290836

SEQ ID NO: 717454 - RNA, 64 nt, Homo Sapiens; identical to SEQ ID NO: 290837

SEQ ID NO: 717455 - RNA, 64 nt, Homo Sapiens; identical to SEQ ID NO: 290838

SEQ ID NO: 717456 - RNA, 64 nt, Homo Sapiens; identical to SEQ ID NO: 290839

SEQ ID NO: 717457 - RNA, 64 nt, Homo Sapiens; identical to SEQ ID NO: 290840

SEQ ID NO: 717458 - RNA, 64 nt, Homo Sapiens; identical to SEQ ID NO: 290841

SEQ ID NO: 717459 - RNA, 64 nt, Homo Sapiens; identical to SEQ ID NO: 290842

SEQ ID NO: 717460 - RNA, 64 nt, Homo Sapiens; identical to SEQ ID NO: 290843

SEQ ID NO: 717461 - RNA, 64 nt, Homo Sapiens; identical to SEQ ID NO: 83829

SEQ ID NO: 717462 - RNA, 64 nt, Homo Sapiens; identical to SEQ ID NO: 83830

SEQ ID NO: 717463 - RNA, 64 nt, Homo Sapiens; identical to SEQ ID NO: 83831

SEQ ID NO: 717464 - RNA, 64 nt, Homo Sapiens; identical to SEQ ID NO: 83832

SEQ ID NO: 717465 - RNA, 64 nt, Homo Sapiens; identical to SEQ ID NO: 83833

SEQ ID NO: 717466 - RNA, 64 nt, Homo Sapiens; identical to SEQ ID NO: 83834

SEQ ID NO: 717467 - RNA, 64 nt, Homo Sapiens; identical to SEQ ID NO: 83835

SEQ ID NO: 717468 - RNA, 64 nt, Homo Sapiens; identical to SEQ ID NO: 83836

SEQ ID NO: 717469 - RNA, 64 nt, Homo Sapiens; identical to SEQ ID NO: 83837

SEQ ID NO: 717470 - RNA, 64 nt, Homo Sapiens; identical to SEQ ID NO: 83838

SEQ ID NO: 717471 - RNA, 64 nt, Homo Sapiens; identical to SEQ ID NO: 83839

SEQ ID NO: 717472 - RNA, 64 nt, Homo Sapiens; identical to SEQ ID NO: 83840

SEQ ID NO: 717473 - RNA, 64 nt, Homo Sapiens; identical to SEQ ID NO: 83841

SEQ ID NO: 717474 - RNA, 64 nt, Homo Sapiens; identical to SEQ ID NO: 83842

SEQ ID NO: 717475 - RNA, 64 nt, Homo Sapiens; identical to SEQ ID NO: 83843

SEQ ID NO: 717476 - RNA, 64 nt, Homo Sapiens; identical to SEQ ID NO: 83844

SEQ ID NO: 717477 - RNA, 64 nt, Homo Sapiens; identical to SEQ ID NO: 83845

SEQ ID NO: 717478 - RNA, 64 nt, Homo Sapiens; identical to SEQ ID NO: 83846

SEQ ID NO: 717479 - RNA, 64 nt, Homo Sapiens; identical to SEQ ID NO: 83847

SEQ ID NO: 717480 - RNA, 64 nt, Homo Sapiens; identical to SEQ ID NO: 83848

SEQ ID NO: 717481 - RNA, 64 nt, Homo Sapiens; identical to SEQ ID NO: 83849

SEQ ID NO: 717482 - RNA, 64 nt, Homo Sapiens; identical to SEQ ID NO: 83850

SEQ ID NO: 717483 - RNA, 64 nt, Homo Sapiens; identical to SEQ ID NO: 83851

SEQ ID NO: 717484 - RNA, 64 nt, Homo Sapiens; identical to SEQ ID NO: 83852

SEQ ID NO: 717485 - RNA, 64 nt, Homo Sapiens; identical to SEQ ID NO: 83853

SEQ ID NO: 717486 - RNA, 64 nt, Homo Sapiens; identical to SEQ ID NO: 83854

SEQ ID NO: 717487 - RNA, 64 nt, Homo Sapiens; identical to SEQ ID NO: 83855

SEQ ID NO: 717488 - RNA, 64 nt, Homo Sapiens; identical to SEQ ID NO: 83856

SEQ ID NO: 717489 - RNA, 64 nt, Homo Sapiens; identical to SEQ ID NO: 83857

SEQ ID NO: 717490 - RNA, 64 nt, Homo Sapiens; identical to SEQ ID NO: 83858

SEQ ID NO: 717491 - RNA, 64 nt, Homo Sapiens; identical to SEQ ID NO: 83859

SEQ ID NO: 717492 - RNA, 64 nt, Homo Sapiens; identical to SEQ ID NO: 83860

SEQ ID NO: 717493 - RNA, 64 nt, Homo Sapiens; identical to SEQ ID NO: 83861

SEQ ID NO: 717494 - RNA, 64 nt, Homo Sapiens; identical to SEQ ID NO: 83862

SEQ ID NO: 717495 - RNA, 64 nt, Homo Sapiens; identical to SEQ ID NO: 83863

SEQ ID NO: 717496 - RNA, 64 nt, Homo Sapiens; identical to SEQ ID NO: 83864

SEQ ID NO: 717497 - RNA, 64 nt, Homo Sapiens; identical to SEQ ID NO: 83865

SEQ ID NO: 717498 - RNA, 64 nt, Homo Sapiens; identical to SEQ ID NO: 83866

SEQ ID NO: 717499 - RNA, 64 nt, Homo Sapiens; identical to SEQ ID NO: 83867

SEQ ID NO: 717500 - RNA, 64 nt, Homo Sapiens; identical to SEQ ID NO: 83868

SEQ ID NO: 717501 - RNA, 64 nt, Homo Sapiens; identical to SEQ ID NO: 83869

SEQ ID NO: 717502 - RNA, 64 nt, Homo Sapiens; identical to SEQ ID NO: 83870

SEQ ID NO: 717503 - RNA, 64 nt, Homo Sapiens; identical to SEQ ID NO: 83871

SEQ ID NO: 717504 - RNA, 64 nt, Homo Sapiens; identical to SEQ ID NO: 83872

SEQ ID NO: 717505 - RNA, 64 nt, Homo Sapiens; identical to SEQ ID NO: 83873

SEQ ID NO: 717506 - RNA, 64 nt, Homo Sapiens; identical to SEQ ID NO: 83874

SEQ ID NO: 717507 - RNA, 64 nt, Homo Sapiens; identical to SEQ ID NO: 83875

SEQ ID NO: 717508 - RNA, 64 nt, Homo Sapiens; identical to SEQ ID NO: 83876

SEQ ID NO: 717509 - RNA, 64 nt, Homo Sapiens; identical to SEQ ID NO: 83877

SEQ ID NO: 717510 - RNA, 64 nt, Homo Sapiens; identical to SEQ ID NO: 83878

SEQ ID NO: 717511 - RNA, 64 nt, Homo Sapiens; identical to SEQ ID NO: 83879

SEQ ID NO: 717512 - RNA, 64 nt, Homo Sapiens; identical to SEQ ID NO: 83880

SEQ ID NO: 717513 - RNA, 64 nt, Homo Sapiens; identical to SEQ ID NO: 83881

SEQ ID NO: 717514 - RNA, 64 nt, Homo Sapiens; identical to SEQ ID NO: 356088

SEQ ID NO: 717515 - RNA, 64 nt, Homo Sapiens; identical to SEQ ID NO: 356089

SEQ ID NO: 717516 - RNA, 64 nt, Homo Sapiens; identical to SEQ ID NO: 356090

SEQ ID NO: 717517 - RNA, 64 nt, Homo Sapiens; identical to SEQ ID NO: 356091

SEQ ID NO: 717518 - RNA, 64 nt, Homo Sapiens; identical to SEQ ID NO: 356092

SEQ ID NO: 717519 - RNA, 64 nt, Homo Sapiens; identical to SEQ ID NO: 356093

SEQ ID NO: 717520 - RNA, 64 nt, Homo Sapiens; identical to SEQ ID NO: 356094

SEQ ID NO: 717521 - RNA, 64 nt, Homo Sapiens; identical to SEQ ID NO: 356095

SEQ ID NO: 717522 - RNA, 64 nt, Homo Sapiens; identical to SEQ ID NO: 356096

SEQ ID NO: 717523 - RNA, 64 nt, Homo Sapiens; identical to SEQ ID NO: 356097

SEQ ID NO: 717524 - RNA, 64 nt, Homo Sapiens; identical to SEQ ID NO: 356098

SEQ ID NO: 717525 - RNA, 64 nt, Homo Sapiens; identical to SEQ ID NO: 356099

SEQ ID NO: 717526 - RNA, 64 nt, Homo Sapiens; identical to SEQ ID NO: 356100

SEQ ID NO: 717527 - RNA, 64 nt, Homo Sapiens; identical to SEQ ID NO: 356101

SEQ ID NO: 717528 - RNA, 64 nt, Homo Sapiens; identical to SEQ ID NO: 356102

SEQ ID NO: 717529 - RNA, 64 nt, Homo Sapiens; identical to SEQ ID NO: 356103

SEQ ID NO: 717530 - RNA, 64 nt, Homo Sapiens; identical to SEQ ID NO: 356104

SEQ ID NO: 717531 - RNA, 64 nt, Homo Sapiens; identical to SEQ ID NO: 356105

SEQ ID NO: 717532 - RNA, 64 nt, Homo Sapiens; identical to SEQ ID NO: 356106

SEQ ID NO: 717533 - RNA, 64 nt, Homo Sapiens; identical to SEQ ID NO: 356107

SEQ ID NO: 717534 - RNA, 64 nt, Homo Sapiens; identical to SEQ ID NO: 356108

SEQ ID NO: 717535 - RNA, 64 nt, Homo Sapiens; identical to SEQ ID NO: 356109

SEQ ID NO: 717536 - RNA, 64 nt, Homo Sapiens; identical to SEQ ID NO: 356110

SEQ ID NO: 717537 - RNA, 64 nt, Homo Sapiens; identical to SEQ ID NO: 356111

SEQ ID NO: 717538 - RNA, 64 nt, Homo Sapiens; identical to SEQ ID NO: 356112

SEQ ID NO: 717539 - RNA, 64 nt, Homo Sapiens; identical to SEQ ID NO: 356113

SEQ ID NO: 717540 - RNA, 64 nt, Homo Sapiens; identical to SEQ ID NO: 356114

SEQ ID NO: 717541 - RNA, 64 nt, Homo Sapiens; identical to SEQ ID NO: 356115

SEQ ID NO: 717542 - RNA, 64 nt, Homo Sapiens; identical to SEQ ID NO: 356116

SEQ ID NO: 717543 - RNA, 64 nt, Homo Sapiens; identical to SEQ ID NO: 356117

SEQ ID NO: 717544 - RNA, 64 nt, Homo Sapiens; identical to SEQ ID NO: 356118

SEQ ID NO: 717545 - RNA, 64 nt, Homo Sapiens; identical to SEQ ID NO: 356119

SEQ ID NO: 717546 - RNA, 64 nt, Homo Sapiens; identical to SEQ ID NO: 356120

SEQ ID NO: 717547 - RNA, 64 nt, Homo Sapiens; identical to SEQ ID NO: 356121

SEQ ID NO: 717548 - RNA, 64 nt, Homo Sapiens; identical to SEQ ID NO: 356122

SEQ ID NO: 717549 - RNA, 64 nt, Homo Sapiens; identical to SEQ ID NO: 356123

SEQ ID NO: 717550 - RNA, 64 nt, Homo Sapiens; identical to SEQ ID NO: 356124

SEQ ID NO: 717551 - RNA, 64 nt, Homo Sapiens; identical to SEQ ID NO: 356125

SEQ ID NO: 717552 - RNA, 64 nt, Homo Sapiens; identical to SEQ ID NO: 356126

SEQ ID NO: 717553 - RNA, 64 nt, Homo Sapiens; identical to SEQ ID NO: 356127

SEQ ID NO: 717554 - RNA, 64 nt, Homo Sapiens; identical to SEQ ID NO: 356128

SEQ ID NO: 717555 - RNA, 64 nt, Homo Sapiens; identical to SEQ ID NO: 356129

SEQ ID NO: 717556 - RNA, 64 nt, Homo Sapiens; identical to SEQ ID NO: 356130

SEQ ID NO: 717557 - RNA, 64 nt, Homo Sapiens; identical to SEQ ID NO: 356131

SEQ ID NO: 717558 - RNA, 64 nt, Homo Sapiens; identical to SEQ ID NO: 356132

SEQ ID NO: 717559 - RNA, 64 nt, Homo Sapiens; identical to SEQ ID NO: 356133

SEQ ID NO: 717560 - RNA, 64 nt, Homo Sapiens; identical to SEQ ID NO: 356134

SEQ ID NO: 717561 - RNA, 64 nt, Homo Sapiens; identical to SEQ ID NO: 356135

SEQ ID NO: 717562 - RNA, 64 nt, Homo Sapiens; identical to SEQ ID NO: 356136

SEQ ID NO: 717563 - RNA, 64 nt, Homo Sapiens; identical to SEQ ID NO: 356137

SEQ ID NO: 717564 - RNA, 64 nt, Homo Sapiens; identical to SEQ ID NO: 356138

SEQ ID NO: 717565 - RNA, 64 nt, Homo Sapiens; identical to SEQ ID NO: 356139

SEQ ID NO: 717566 - RNA, 64 nt, Homo Sapiens; identical to SEQ ID NO: 356140

SEQ ID NO: 717567 - RNA, 64 nt, Homo Sapiens; identical to SEQ ID NO: 356141

SEQ ID NO: 717568 - RNA, 64 nt, Homo Sapiens; identical to SEQ ID NO: 356142

SEQ ID NO: 717569 - RNA, 64 nt, Homo Sapiens; identical to SEQ ID NO: 356143

SEQ ID NO: 717570 - RNA, 64 nt, Homo Sapiens; identical to SEQ ID NO: 356144

SEQ ID NO: 717571 - RNA, 64 nt, Homo Sapiens; identical to SEQ ID NO: 356145

SEQ ID NO: 717572 - RNA, 64 nt, Homo Sapiens; identical to SEQ ID NO: 356146

SEQ ID NO: 717573 - RNA, 64 nt, Homo Sapiens; identical to SEQ ID NO: 356147

SEQ ID NO: 717574 - RNA, 64 nt, Homo Sapiens; identical to SEQ ID NO: 356148

SEQ ID NO: 717575 - RNA, 64 nt, Homo Sapiens; identical to SEQ ID NO: 356149

SEQ ID NO: 717576 - RNA, 64 nt, Homo Sapiens; identical to SEQ ID NO: 356150

SEQ ID NO: 717577 - RNA, 64 nt, Homo Sapiens; identical to SEQ ID NO: 356151

SEQ ID NO: 717578 - RNA, 64 nt, Homo Sapiens; identical to SEQ ID NO: 356152

SEQ ID NO: 717579 - RNA, 64 nt, Homo Sapiens; identical to SEQ ID NO: 356153

SEQ ID NO: 717580 - RNA, 64 nt, Homo Sapiens; identical to SEQ ID NO: 356154

SEQ ID NO: 717581 - RNA, 64 nt, Homo Sapiens; identical to SEQ ID NO: 356155

SEQ ID NO: 717582 - RNA, 64 nt, Homo Sapiens; identical to SEQ ID NO: 356156

SEQ ID NO: 717583 - RNA, 64 nt, Homo Sapiens; identical to SEQ ID NO: 356157

SEQ ID NO: 717584 - RNA, 64 nt, Homo Sapiens; identical to SEQ ID NO: 356158

SEQ ID NO: 717585 - RNA, 64 nt, Homo Sapiens; identical to SEQ ID NO: 356159

SEQ ID NO: 717586 - RNA, 64 nt, Homo Sapiens; identical to SEQ ID NO: 356160

SEQ ID NO: 717587 - RNA, 64 nt, Homo Sapiens; identical to SEQ ID NO: 356161

SEQ ID NO: 717588 - RNA, 64 nt, Homo Sapiens; identical to SEQ ID NO: 356162

SEQ ID NO: 717589 - RNA, 64 nt, Homo Sapiens; identical to SEQ ID NO: 356163

SEQ ID NO: 717590 - RNA, 64 nt, Homo Sapiens; identical to SEQ ID NO: 356164

SEQ ID NO: 717591 - RNA, 64 nt, Homo Sapiens; identical to SEQ ID NO: 356165

SEQ ID NO: 717592 - RNA, 64 nt, Homo Sapiens; identical to SEQ ID NO: 356166

SEQ ID NO: 717593 - RNA, 64 nt, Homo Sapiens; identical to SEQ ID NO: 356167

SEQ ID NO: 717594 - RNA, 64 nt, Homo Sapiens; identical to SEQ ID NO: 356168

SEQ ID NO: 717595 - RNA, 64 nt, Homo Sapiens; identical to SEQ ID NO: 356169

SEQ ID NO: 717596 - RNA, 64 nt, Homo Sapiens; identical to SEQ ID NO: 356170

SEQ ID NO: 717597 - RNA, 64 nt, Homo Sapiens; identical to SEQ ID NO: 356171

SEQ ID NO: 717598 - RNA, 64 nt, Homo Sapiens; identical to SEQ ID NO: 356172

SEQ ID NO: 717599 - RNA, 64 nt, Homo Sapiens; identical to SEQ ID NO: 356173

SEQ ID NO: 717600 - RNA, 64 nt, Homo Sapiens; identical to SEQ ID NO: 356174

SEQ ID NO: 717601 - RNA, 64 nt, Homo Sapiens; identical to SEQ ID NO: 356175

SEQ ID NO: 717602 - RNA, 64 nt, Homo Sapiens; identical to SEQ ID NO: 356176

SEQ ID NO: 717603 - RNA, 64 nt, Homo Sapiens; identical to SEQ ID NO: 356177

SEQ ID NO: 717604 - RNA, 64 nt, Homo Sapiens; identical to SEQ ID NO: 356178

SEQ ID NO: 717605 - RNA, 64 nt, Homo Sapiens; identical to SEQ ID NO: 356179

SEQ ID NO: 717606 - RNA, 64 nt, Homo Sapiens; identical to SEQ ID NO: 356180

SEQ ID NO: 717607 - RNA, 64 nt, Homo Sapiens; identical to SEQ ID NO: 356181

SEQ ID NO: 717608 - RNA, 64 nt, Homo Sapiens; identical to SEQ ID NO: 356182

SEQ ID NO: 717609 - RNA, 64 nt, Homo Sapiens; identical to SEQ ID NO: 356183

SEQ ID NO: 717610 - RNA, 64 nt, Homo Sapiens; identical to SEQ ID NO: 356184

SEQ ID NO: 717611 - RNA, 64 nt, Homo Sapiens; identical to SEQ ID NO: 356185

SEQ ID NO: 717612 - RNA, 64 nt, Homo Sapiens; identical to SEQ ID NO: 356186

SEQ ID NO: 717613 - RNA, 64 nt, Homo Sapiens; identical to SEQ ID NO: 356187

SEQ ID NO: 717614 - RNA, 64 nt, Homo Sapiens; identical to SEQ ID NO: 356188

SEQ ID NO: 717615 - RNA, 64 nt, Homo Sapiens; identical to SEQ ID NO: 356189

SEQ ID NO: 717616 - RNA, 64 nt, Homo Sapiens; identical to SEQ ID NO: 356190

SEQ ID NO: 717617 - RNA, 64 nt, Homo Sapiens; identical to SEQ ID NO: 356191

SEQ ID NO: 717618 - RNA, 64 nt, Homo Sapiens; identical to SEQ ID NO: 356192

SEQ ID NO: 717619 - RNA, 64 nt, Homo Sapiens; identical to SEQ ID NO: 356193

SEQ ID NO: 717620 - RNA, 64 nt, Homo Sapiens; identical to SEQ ID NO: 356194

SEQ ID NO: 717621 - RNA, 64 nt, Homo Sapiens; identical to SEQ ID NO: 356195

SEQ ID NO: 717622 - RNA, 64 nt, Homo Sapiens; identical to SEQ ID NO: 356196

SEQ ID NO: 717623 - RNA, 64 nt, Homo Sapiens; identical to SEQ ID NO: 356197

SEQ ID NO: 717624 - RNA, 64 nt, Homo Sapiens; identical to SEQ ID NO: 356198

SEQ ID NO: 717625 - RNA, 64 nt, Homo Sapiens; identical to SEQ ID NO: 356199

SEQ ID NO: 717626 - RNA, 64 nt, Homo Sapiens; identical to SEQ ID NO: 356200

SEQ ID NO: 717627 - RNA, 64 nt, Homo Sapiens; identical to SEQ ID NO: 356201

SEQ ID NO: 717628 - RNA, 64 nt, Homo Sapiens; identical to SEQ ID NO: 356202

SEQ ID NO: 717629 - RNA, 64 nt, Homo Sapiens; identical to SEQ ID NO: 356203

SEQ ID NO: 717630 - RNA, 64 nt, Homo Sapiens; identical to SEQ ID NO: 356204

SEQ ID NO: 717631 - RNA, 64 nt, Homo Sapiens; identical to SEQ ID NO: 356205

SEQ ID NO: 717632 - RNA, 64 nt, Homo Sapiens; identical to SEQ ID NO: 356206

SEQ ID NO: 717633 - RNA, 64 nt, Homo Sapiens; identical to SEQ ID NO: 356207

SEQ ID NO: 717634 - RNA, 64 nt, Homo Sapiens; identical to SEQ ID NO: 356208

SEQ ID NO: 717635 - RNA, 64 nt, Homo Sapiens; identical to SEQ ID NO: 356209

SEQ ID NO: 717636 - RNA, 64 nt, Homo Sapiens; identical to SEQ ID NO: 356210

SEQ ID NO: 717637 - RNA, 64 nt, Homo Sapiens; identical to SEQ ID NO: 356211

SEQ ID NO: 717638 - RNA, 64 nt, Homo Sapiens; identical to SEQ ID NO: 356212

SEQ ID NO: 717639 - RNA, 64 nt, Homo Sapiens; identical to SEQ ID NO: 356213

SEQ ID NO: 717640 - RNA, 64 nt, Homo Sapiens; identical to SEQ ID NO: 356214

SEQ ID NO: 717641 - RNA, 64 nt, Homo Sapiens; identical to SEQ ID NO: 356215

SEQ ID NO: 717642 - RNA, 64 nt, Homo Sapiens; identical to SEQ ID NO: 356216

SEQ ID NO: 717643 - RNA, 64 nt, Homo Sapiens; identical to SEQ ID NO: 356217

SEQ ID NO: 717644 - RNA, 64 nt, Homo Sapiens; identical to SEQ ID NO: 356218

SEQ ID NO: 717645 - RNA, 64 nt, Homo Sapiens; identical to SEQ ID NO: 356219

SEQ ID NO: 717646 - RNA, 64 nt, Homo Sapiens; identical to SEQ ID NO: 356220

SEQ ID NO: 717647 - RNA, 64 nt, Homo Sapiens; identical to SEQ ID NO: 356221

SEQ ID NO: 717648 - RNA, 64 nt, Homo Sapiens; identical to SEQ ID NO: 356222

SEQ ID NO: 717649 - RNA, 64 nt, Homo Sapiens; identical to SEQ ID NO: 356223

SEQ ID NO: 717650 - RNA, 64 nt, Homo Sapiens; identical to SEQ ID NO: 356224

SEQ ID NO: 717651 - RNA, 64 nt, Homo Sapiens; identical to SEQ ID NO: 356225

SEQ ID NO: 717652 - RNA, 64 nt, Homo Sapiens; identical to SEQ ID NO: 356226

SEQ ID NO: 717653 - RNA, 64 nt, Homo Sapiens; identical to SEQ ID NO: 356227

SEQ ID NO: 717654 - RNA, 64 nt, Homo Sapiens; identical to SEQ ID NO: 356228

SEQ ID NO: 717655 - RNA, 64 nt, Homo Sapiens; identical to SEQ ID NO: 356229

SEQ ID NO: 717656 - RNA, 64 nt, Homo Sapiens; identical to SEQ ID NO: 356230

SEQ ID NO: 717657 - RNA, 64 nt, Homo Sapiens; identical to SEQ ID NO: 356231

SEQ ID NO: 717658 - RNA, 64 nt, Homo Sapiens; identical to SEQ ID NO: 356232

SEQ ID NO: 717659 - RNA, 64 nt, Homo Sapiens; identical to SEQ ID NO: 356233

SEQ ID NO: 717660 - RNA, 64 nt, Homo Sapiens; identical to SEQ ID NO: 356234

SEQ ID NO: 717661 - RNA, 64 nt, Homo Sapiens; identical to SEQ ID NO: 356235

SEQ ID NO: 717662 - RNA, 64 nt, Homo Sapiens; identical to SEQ ID NO: 356236

SEQ ID NO: 717663 - RNA, 64 nt, Homo Sapiens; identical to SEQ ID NO: 356237

SEQ ID NO: 717664 - RNA, 64 nt, Homo Sapiens; identical to SEQ ID NO: 356238

SEQ ID NO: 717665 - RNA, 64 nt, Homo Sapiens; identical to SEQ ID NO: 356239

SEQ ID NO: 717666 - RNA, 64 nt, Homo Sapiens; identical to SEQ ID NO: 356240

SEQ ID NO: 717667 - RNA, 64 nt, Homo Sapiens; identical to SEQ ID NO: 356241

SEQ ID NO: 717668 - RNA, 64 nt, Homo Sapiens; identical to SEQ ID NO: 356242

SEQ ID NO: 717669 - RNA, 64 nt, Homo Sapiens; identical to SEQ ID NO: 356243

SEQ ID NO: 717670 - RNA, 64 nt, Homo Sapiens; identical to SEQ ID NO: 356244

SEQ ID NO: 717671 - RNA, 64 nt, Homo Sapiens; identical to SEQ ID NO: 356245

SEQ ID NO: 717672 - RNA, 64 nt, Homo Sapiens; identical to SEQ ID NO: 356246

SEQ ID NO: 717673 - RNA, 64 nt, Homo Sapiens; identical to SEQ ID NO: 356247

SEQ ID NO: 717674 - RNA, 64 nt, Homo Sapiens; identical to SEQ ID NO: 356248

SEQ ID NO: 717675 - RNA, 64 nt, Homo Sapiens; identical to SEQ ID NO: 356249

SEQ ID NO: 717676 - RNA, 64 nt, Homo Sapiens; identical to SEQ ID NO: 356250

SEQ ID NO: 717677 - RNA, 64 nt, Homo Sapiens; identical to SEQ ID NO: 356251

SEQ ID NO: 717678 - RNA, 64 nt, Homo Sapiens; identical to SEQ ID NO: 356252

SEQ ID NO: 717679 - RNA, 64 nt, Homo Sapiens; identical to SEQ ID NO: 356253

SEQ ID NO: 717680 - RNA, 64 nt, Homo Sapiens; identical to SEQ ID NO: 356254

SEQ ID NO: 717681 - RNA, 64 nt, Homo Sapiens; identical to SEQ ID NO: 356255

SEQ ID NO: 717682 - RNA, 64 nt, Homo Sapiens; identical to SEQ ID NO: 356256

SEQ ID NO: 717683 - RNA, 64 nt, Homo Sapiens; identical to SEQ ID NO: 356257

SEQ ID NO: 717684 - RNA, 64 nt, Homo Sapiens; identical to SEQ ID NO: 356258

SEQ ID NO: 717685 - RNA, 64 nt, Homo Sapiens; identical to SEQ ID NO: 356259

SEQ ID NO: 717686 - RNA, 64 nt, Homo Sapiens; identical to SEQ ID NO: 356260

SEQ ID NO: 717687 - RNA, 64 nt, Homo Sapiens; identical to SEQ ID NO: 356261

SEQ ID NO: 717688 - RNA, 64 nt, Homo Sapiens; identical to SEQ ID NO: 356262

SEQ ID NO: 717689 - RNA, 64 nt, Homo Sapiens; identical to SEQ ID NO: 356263

SEQ ID NO: 717690 - RNA, 64 nt, Homo Sapiens; identical to SEQ ID NO: 356264

SEQ ID NO: 717691 - RNA, 64 nt, Homo Sapiens; identical to SEQ ID NO: 356265

SEQ ID NO: 717692 - RNA, 64 nt, Homo Sapiens; identical to SEQ ID NO: 356266

SEQ ID NO: 717693 - RNA, 64 nt, Homo Sapiens; identical to SEQ ID NO: 356267

SEQ ID NO: 717694 - RNA, 64 nt, Homo Sapiens; identical to SEQ ID NO: 356268

SEQ ID NO: 717695 - RNA, 64 nt, Homo Sapiens; identical to SEQ ID NO: 356269

SEQ ID NO: 717696 - RNA, 64 nt, Homo Sapiens; identical to SEQ ID NO: 356270

SEQ ID NO: 717697 - RNA, 64 nt, Homo Sapiens; identical to SEQ ID NO: 356271

SEQ ID NO: 717698 - RNA, 64 nt, Homo Sapiens; identical to SEQ ID NO: 356272

SEQ ID NO: 717699 - RNA, 64 nt, Homo Sapiens; identical to SEQ ID NO: 356273

SEQ ID NO: 717700 - RNA, 64 nt, Homo Sapiens; identical to SEQ ID NO: 356274

SEQ ID NO: 717701 - RNA, 64 nt, Homo Sapiens; identical to SEQ ID NO: 356275

SEQ ID NO: 717702 - RNA, 64 nt, Homo Sapiens; identical to SEQ ID NO: 356276

SEQ ID NO: 717703 - RNA, 64 nt, Homo Sapiens; identical to SEQ ID NO: 356277

SEQ ID NO: 717704 - RNA, 64 nt, Homo Sapiens; identical to SEQ ID NO: 356278

SEQ ID NO: 717705 - RNA, 64 nt, Homo Sapiens; identical to SEQ ID NO: 356279

SEQ ID NO: 717706 - RNA, 64 nt, Homo Sapiens; identical to SEQ ID NO: 356280

SEQ ID NO: 717707 - RNA, 64 nt, Homo Sapiens; identical to SEQ ID NO: 356281

SEQ ID NO: 717708 - RNA, 64 nt, Homo Sapiens; identical to SEQ ID NO: 356270

SEQ ID NO: 717709 - RNA, 64 nt, Homo Sapiens
cucuucccuaggacugacgauggugcuugaugagggaagguagacccuuucugguuuaaaaaaa

SEQ ID NO: 717710 - RNA, 64 nt, Homo Sapiens
gguccaauuuauuuaggaagaagaucaucaguuuggaagguacuucuuugacccuuaugacuga

SEQ ID NO: 717711 - RNA, 64 nt, Homo Sapiens
cacaggggggaggcacuaagucaugguccuggcuggaagguacugaaggcuucugcagcuuugg

SEQ ID NO: 717712 - RNA, 64 nt, Homo Sapiens
cuuuuucacuugggucucuggauuccugucauagggaagguauaucaggaggggaagaggccuu

SEQ ID NO: 717713 - RNA, 64 nt, Homo Sapiens; identical to SEQ ID NO: 229025

SEQ ID NO: 717714 - RNA, 64 nt, Homo Sapiens; identical to SEQ ID NO: 229026

SEQ ID NO: 717715 - RNA, 64 nt, Homo Sapiens; identical to SEQ ID NO: 229027

SEQ ID NO: 717716 - RNA, 64 nt, Homo Sapiens; identical to SEQ ID NO: 229028

SEQ ID NO: 717717 - RNA, 64 nt, Homo Sapiens; identical to SEQ ID NO: 229029

SEQ ID NO: 717718 - RNA, 64 nt, Homo Sapiens; identical to SEQ ID NO: 229030

SEQ ID NO: 717719 - RNA, 64 nt, Homo Sapiens; identical to SEQ ID NO: 229031

SEQ ID NO: 717720 - RNA, 64 nt, Homo Sapiens; identical to SEQ ID NO: 229032

SEQ ID NO: 717721 - RNA, 64 nt, Homo Sapiens; identical to SEQ ID NO: 229033

SEQ ID NO: 717722 - RNA, 64 nt, Homo Sapiens; identical to SEQ ID NO: 229034

SEQ ID NO: 717723 - RNA, 64 nt, Homo Sapiens; identical to SEQ ID NO: 229035

SEQ ID NO: 717724 - RNA, 64 nt, Homo Sapiens; identical to SEQ ID NO: 229036

SEQ ID NO: 717725 - RNA, 64 nt, Homo Sapiens; identical to SEQ ID NO: 229037

SEQ ID NO: 717726 - RNA, 64 nt, Homo Sapiens; identical to SEQ ID NO: 229038

SEQ ID NO: 717727 - RNA, 64 nt, Homo Sapiens; identical to SEQ ID NO: 229039

SEQ ID NO: 717728 - RNA, 64 nt, Homo Sapiens; identical to SEQ ID NO: 229040

SEQ ID NO: 717729 - RNA, 64 nt, Homo Sapiens; identical to SEQ ID NO: 229041

SEQ ID NO: 717730 - RNA, 64 nt, Homo Sapiens; identical to SEQ ID NO: 229042

SEQ ID NO: 717731 - RNA, 64 nt, Homo Sapiens; identical to SEQ ID NO: 229043

SEQ ID NO: 717732 - RNA, 64 nt, Homo Sapiens; identical to SEQ ID NO: 229044

SEQ ID NO: 717733 - RNA, 64 nt, Homo Sapiens; identical to SEQ ID NO: 229045

SEQ ID NO: 717734 - RNA, 64 nt, Homo Sapiens; identical to SEQ ID NO: 229046

SEQ ID NO: 717735 - RNA, 64 nt, Homo Sapiens; identical to SEQ ID NO: 229047

SEQ ID NO: 717736 - RNA, 64 nt, Homo Sapiens; identical to SEQ ID NO: 229048

SEQ ID NO: 717737 - RNA, 64 nt, Homo Sapiens; identical to SEQ ID NO: 229049

SEQ ID NO: 717738 - RNA, 64 nt, Homo Sapiens; identical to SEQ ID NO: 229050

SEQ ID NO: 717739 - RNA, 64 nt, Homo Sapiens; identical to SEQ ID NO: 229051

SEQ ID NO: 717740 - RNA, 64 nt, Homo Sapiens; identical to SEQ ID NO: 229052

SEQ ID NO: 717741 - RNA, 64 nt, Homo Sapiens; identical to SEQ ID NO: 229053

SEQ ID NO: 717742 - RNA, 64 nt, Homo Sapiens; identical to SEQ ID NO: 229054

SEQ ID NO: 717743 - RNA, 64 nt, Homo Sapiens; identical to SEQ ID NO: 333348

SEQ ID NO: 717744 - RNA, 64 nt, Homo Sapiens; identical to SEQ ID NO: 333349

SEQ ID NO: 717745 - RNA, 64 nt, Homo Sapiens; identical to SEQ ID NO: 333350

SEQ ID NO: 717746 - RNA, 64 nt, Homo Sapiens; identical to SEQ ID NO: 333351

SEQ ID NO: 717747 - RNA, 64 nt, Homo Sapiens; identical to SEQ ID NO: 333352

SEQ ID NO: 717748 - RNA, 64 nt, Homo Sapiens; identical to SEQ ID NO: 333353

SEQ ID NO: 717749 - RNA, 64 nt, Homo Sapiens; identical to SEQ ID NO: 333354

SEQ ID NO: 717750 - RNA, 64 nt, Homo Sapiens; identical to SEQ ID NO: 333355

SEQ ID NO: 717751 - RNA, 64 nt, Homo Sapiens; identical to SEQ ID NO: 333356

SEQ ID NO: 717752 - RNA, 64 nt, Homo Sapiens; identical to SEQ ID NO: 333357

SEQ ID NO: 717753 - RNA, 64 nt, Homo Sapiens; identical to SEQ ID NO: 333358

SEQ ID NO: 717754 - RNA, 64 nt, Homo Sapiens; identical to SEQ ID NO: 333359

SEQ ID NO: 717755 - RNA, 64 nt, Homo Sapiens; identical to SEQ ID NO: 333360

SEQ ID NO: 717756 - RNA, 64 nt, Homo Sapiens; identical to SEQ ID NO: 333361

SEQ ID NO: 717757 - RNA, 64 nt, Homo Sapiens; identical to SEQ ID NO: 333362

SEQ ID NO: 717758 - RNA, 64 nt, Homo Sapiens; identical to SEQ ID NO: 333363

SEQ ID NO: 717759 - RNA, 64 nt, Homo Sapiens; identical to SEQ ID NO: 333364

SEQ ID NO: 717760 - RNA, 64 nt, Homo Sapiens; identical to SEQ ID NO: 333365

SEQ ID NO: 717761 - RNA, 64 nt, Homo Sapiens; identical to SEQ ID NO: 333366

SEQ ID NO: 717762 - RNA, 64 nt, Homo Sapiens; identical to SEQ ID NO: 333367

SEQ ID NO: 717763 - RNA, 64 nt, Homo Sapiens; identical to SEQ ID NO: 333368

SEQ ID NO: 717764 - RNA, 64 nt, Homo Sapiens; identical to SEQ ID NO: 333369

SEQ ID NO: 717765 - RNA, 64 nt, Homo Sapiens; identical to SEQ ID NO: 333370

SEQ ID NO: 717766 - RNA, 64 nt, Homo Sapiens; identical to SEQ ID NO: 333371

SEQ ID NO: 717767 - RNA, 64 nt, Homo Sapiens; identical to SEQ ID NO: 333372

SEQ ID NO: 717768 - RNA, 64 nt, Homo Sapiens; identical to SEQ ID NO: 333373

SEQ ID NO: 717769 - RNA, 64 nt, Homo Sapiens; identical to SEQ ID NO: 333374

SEQ ID NO: 717770 - RNA, 64 nt, Homo Sapiens; identical to SEQ ID NO: 333375

SEQ ID NO: 717771 - RNA, 64 nt, Homo Sapiens; identical to SEQ ID NO: 333376

SEQ ID NO: 717772 - RNA, 64 nt, Homo Sapiens; identical to SEQ ID NO: 333377

SEQ ID NO: 717773 - RNA, 64 nt, Homo Sapiens; identical to SEQ ID NO: 333378

SEQ ID NO: 717774 - RNA, 64 nt, Homo Sapiens; identical to SEQ ID NO: 333379

SEQ ID NO: 717775 - RNA, 64 nt, Homo Sapiens; identical to SEQ ID NO: 333380

SEQ ID NO: 717776 - RNA, 64 nt, Homo Sapiens; identical to SEQ ID NO: 333381

SEQ ID NO: 717777 - RNA, 64 nt, Homo Sapiens; identical to SEQ ID NO: 333382

SEQ ID NO: 717778 - RNA, 64 nt, Homo Sapiens; identical to SEQ ID NO: 333383

SEQ ID NO: 717779 - RNA, 64 nt, Homo Sapiens; identical to SEQ ID NO: 333384

SEQ ID NO: 717780 - RNA, 64 nt, Homo Sapiens; identical to SEQ ID NO: 333385

SEQ ID NO: 717781 - RNA, 64 nt, Homo Sapiens; identical to SEQ ID NO: 333386

SEQ ID NO: 717782 - RNA, 64 nt, Homo Sapiens; identical to SEQ ID NO: 333387

SEQ ID NO: 717783 - RNA, 64 nt, Homo Sapiens; identical to SEQ ID NO: 333388

SEQ ID NO: 717784 - RNA, 64 nt, Homo Sapiens; identical to SEQ ID NO: 333389

SEQ ID NO: 717785 - RNA, 64 nt, Homo Sapiens; identical to SEQ ID NO: 333390

SEQ ID NO: 717786 - RNA, 64 nt, Homo Sapiens; identical to SEQ ID NO: 333391

SEQ ID NO: 717787 - RNA, 64 nt, Homo Sapiens; identical to SEQ ID NO: 333392

SEQ ID NO: 717788 - RNA, 64 nt, Homo Sapiens; identical to SEQ ID NO: 333393

SEQ ID NO: 717789 - RNA, 64 nt, Homo Sapiens; identical to SEQ ID NO: 333394

SEQ ID NO: 717790 - RNA, 64 nt, Homo Sapiens; identical to SEQ ID NO: 333395

SEQ ID NO: 717791 - RNA, 64 nt, Homo Sapiens; identical to SEQ ID NO: 333396

SEQ ID NO: 717792 - RNA, 64 nt, Homo Sapiens; identical to SEQ ID NO: 333397

SEQ ID NO: 717793 - RNA, 64 nt, Homo Sapiens; identical to SEQ ID NO: 333398

SEQ ID NO: 717794 - RNA, 64 nt, Homo Sapiens; identical to SEQ ID NO: 333399

SEQ ID NO: 717795 - RNA, 64 nt, Homo Sapiens; identical to SEQ ID NO: 333400

SEQ ID NO: 717796 - RNA, 64 nt, Homo Sapiens; identical to SEQ ID NO: 333401

SEQ ID NO: 717797 - RNA, 64 nt, Homo Sapiens; identical to SEQ ID NO: 333402

SEQ ID NO: 717798 - RNA, 64 nt, Homo Sapiens; identical to SEQ ID NO: 333403

SEQ ID NO: 717799 - RNA, 64 nt, Homo Sapiens; identical to SEQ ID NO: 333404

SEQ ID NO: 717800 - RNA, 64 nt, Homo Sapiens; identical to SEQ ID NO: 333405

SEQ ID NO: 717801 - RNA, 64 nt, Homo Sapiens; identical to SEQ ID NO: 333406

SEQ ID NO: 717802 - RNA, 64 nt, Homo Sapiens; identical to SEQ ID NO: 333407

SEQ ID NO: 717803 - RNA, 64 nt, Homo Sapiens; identical to SEQ ID NO: 333408

SEQ ID NO: 717804 - RNA, 64 nt, Homo Sapiens; identical to SEQ ID NO: 333409

SEQ ID NO: 717805 - RNA, 64 nt, Homo Sapiens; identical to SEQ ID NO: 333410

SEQ ID NO: 717806 - RNA, 64 nt, Homo Sapiens; identical to SEQ ID NO: 333411

SEQ ID NO: 717807 - RNA, 64 nt, Homo Sapiens; identical to SEQ ID NO: 333412

SEQ ID NO: 717808 - RNA, 64 nt, Homo Sapiens; identical to SEQ ID NO: 333413

SEQ ID NO: 717809 - RNA, 64 nt, Homo Sapiens; identical to SEQ ID NO: 333414

SEQ ID NO: 717810 - RNA, 64 nt, Homo Sapiens; identical to SEQ ID NO: 333415

SEQ ID NO: 717811 - RNA, 64 nt, Homo Sapiens; identical to SEQ ID NO: 333416

SEQ ID NO: 717812 - RNA, 64 nt, Homo Sapiens; identical to SEQ ID NO: 333417

SEQ ID NO: 717813 - RNA, 64 nt, Homo Sapiens; identical to SEQ ID NO: 333418

SEQ ID NO: 717814 - RNA, 64 nt, Homo Sapiens; identical to SEQ ID NO: 333419

SEQ ID NO: 717815 - RNA, 64 nt, Homo Sapiens; identical to SEQ ID NO: 333420

SEQ ID NO: 717816 - RNA, 64 nt, Homo Sapiens; identical to SEQ ID NO: 333421

SEQ ID NO: 717817 - RNA, 64 nt, Homo Sapiens; identical to SEQ ID NO: 333422

SEQ ID NO: 717818 - RNA, 64 nt, Homo Sapiens; identical to SEQ ID NO: 333423

SEQ ID NO: 717819 - RNA, 64 nt, Homo Sapiens; identical to SEQ ID NO: 333424

SEQ ID NO: 717820 - RNA, 64 nt, Homo Sapiens; identical to SEQ ID NO: 333425

SEQ ID NO: 717821 - RNA, 64 nt, Homo Sapiens; identical to SEQ ID NO: 333426

SEQ ID NO: 717822 - RNA, 64 nt, Homo Sapiens; identical to SEQ ID NO: 333427

SEQ ID NO: 717823 - RNA, 64 nt, Homo Sapiens; identical to SEQ ID NO: 333428

SEQ ID NO: 717824 - RNA, 64 nt, Homo Sapiens; identical to SEQ ID NO: 333429

SEQ ID NO: 717825 - RNA, 64 nt, Homo Sapiens; identical to SEQ ID NO: 333430

SEQ ID NO: 717826 - RNA, 64 nt, Homo Sapiens; identical to SEQ ID NO: 333431

SEQ ID NO: 717827 - RNA, 64 nt, Homo Sapiens; identical to SEQ ID NO: 333432

SEQ ID NO: 717828 - RNA, 64 nt, Homo Sapiens; identical to SEQ ID NO: 333433

SEQ ID NO: 717829 - RNA, 64 nt, Homo Sapiens; identical to SEQ ID NO: 333434

SEQ ID NO: 717830 - RNA, 64 nt, Homo Sapiens; identical to SEQ ID NO: 333435

SEQ ID NO: 717831 - RNA, 64 nt, Homo Sapiens; identical to SEQ ID NO: 333436

SEQ ID NO: 717832 - RNA, 64 nt, Homo Sapiens; identical to SEQ ID NO: 333437

SEQ ID NO: 717833 - RNA, 64 nt, Homo Sapiens; identical to SEQ ID NO: 333438

SEQ ID NO: 717834 - RNA, 64 nt, Homo Sapiens; identical to SEQ ID NO: 333439

SEQ ID NO: 717835 - RNA, 64 nt, Homo Sapiens; identical to SEQ ID NO: 333440

SEQ ID NO: 717836 - RNA, 64 nt, Homo Sapiens; identical to SEQ ID NO: 333441

SEQ ID NO: 717837 - RNA, 64 nt, Homo Sapiens; identical to SEQ ID NO: 333442

SEQ ID NO: 717838 - RNA, 64 nt, Homo Sapiens; identical to SEQ ID NO: 333443

SEQ ID NO: 717839 - RNA, 64 nt, Homo Sapiens; identical to SEQ ID NO: 333444

SEQ ID NO: 717840 - RNA, 64 nt, Homo Sapiens; identical to SEQ ID NO: 333445

SEQ ID NO: 717841 - RNA, 64 nt, Homo Sapiens; identical to SEQ ID NO: 333446

SEQ ID NO: 717842 - RNA, 64 nt, Homo Sapiens; identical to SEQ ID NO: 333447

SEQ ID NO: 717843 - RNA, 64 nt, Homo Sapiens; identical to SEQ ID NO: 333448

SEQ ID NO: 717844 - RNA, 64 nt, Homo Sapiens; identical to SEQ ID NO: 333449

SEQ ID NO: 717845 - RNA, 64 nt, Homo Sapiens; identical to SEQ ID NO: 333450

SEQ ID NO: 717846 - RNA, 64 nt, Homo Sapiens; identical to SEQ ID NO: 333451

SEQ ID NO: 717847 - RNA, 64 nt, Homo Sapiens; identical to SEQ ID NO: 333452

SEQ ID NO: 717848 - RNA, 64 nt, Homo Sapiens; identical to SEQ ID NO: 333453

SEQ ID NO: 717849 - RNA, 64 nt, Homo Sapiens; identical to SEQ ID NO: 333454

SEQ ID NO: 717850 - RNA, 55 nt, Homo Sapiens; identical to SEQ ID NO: 333455

SEQ ID NO: 717851 - RNA, 64 nt, Homo Sapiens; identical to SEQ ID NO: 333456

SEQ ID NO: 717852 - RNA, 64 nt, Homo Sapiens; identical to SEQ ID NO: 333457

SEQ ID NO: 717853 - RNA, 64 nt, Homo Sapiens; identical to SEQ ID NO: 333458

SEQ ID NO: 717854 - RNA, 64 nt, Homo Sapiens
aagggcaacugucuacugucugcuuauuuaagugacuauauauaaucaauucaucaagccaguu

SEQ ID NO: 717855 - RNA, 64 nt, Homo Sapiens
uucuuaucuuuccacagagcuauuuacauccuggacuauauaacuuaaaagaaguaaaacguaa

SEQ ID NO: 717856 - RNA, 64 nt, Homo Sapiens
ggggguauuugacauauuuuacaggguggaguguacuauauacuauuaccuuugaauguguuug

SEQ ID NO: 717857 - RNA, 64 nt, Homo Sapiens
uuuuuuccuggauaucuguguauuuucaaauguuacuauauauuaaagcagaaauauaaccaaa

SEQ ID NO: 717858 - RNA, 64 nt, Homo Sapiens
gggauuguaagaaaacuuuaauuaaaaauuaaagacuauauauaauuaaacuacucugcccugg

SEQ ID NO: 717859 - RNA, 64 nt, Homo Sapiens
aaauaaauaaaaaaauaaauaaaaauaaaaauagacuauauauagucuuugaauucauuuauuu

SEQ ID NO: 717860 - RNA, 64 nt, Homo Sapiens
cccacuuagguuuuucuucuuauagcuuuauagaacuauauaauaauauggacuugcuguguaa

SEQ ID NO: 717861 - RNA, 64 nt, Homo Sapiens
cauauuuuucuuccaagcucaagucaggauugugacuauauauuaaugagacucaguaauccaa

SEQ ID NO: 717862 - RNA, 64 nt, Homo Sapiens
aggaggccuugugcauuucacauguaaguaucaaacuauauaaauagggaaaguaaguugcacu

SEQ ID NO: 717863 - RNA, 64 nt, Homo Sapiens
aaucccaaaucaaguuauuuuuuagcuuuauggaacuauauagugguuuauaccuaaauguaac

SEQ ID NO: 717864 - RNA, 64 nt, Homo Sapiens
aacauggcuucaauuguuuuuaagagaauuuacaacuauauauuaaugaccacugaacuuacau

SEQ ID NO: 717865 - RNA, 64 nt, Homo Sapiens
uauaguguguauguguguuaacuauauacugggcacuauauauauauguauauauaguauauac

SEQ ID NO: 717866 - RNA, 64 nt, Homo Sapiens
gggcacuauauauauauaguuauauaguauauacacuauauacuacacacacacaauauaugua

SEQ ID NO: 717867 - RNA, 64 nt, Homo Sapiens
uauauauauauacacacacagcacuacauaacacacuauauauauacuauauaugcccacacau

SEQ ID NO: 717868 - RNA, 64 nt, Homo Sapiens
cccacacaugcacuacauaaugugugugauguauacuauauauguauauagugugugauguaua

SEQ ID NO: 717869 - RNA, 64 nt, Homo Sapiens
uauaguguauauacacauauacacacacacacacacuauauacauauuccaccauaacacacac

SEQ ID NO: 717870 - RNA, 64 nt, Homo Sapiens; identical to SEQ ID NO: 22653

SEQ ID NO: 717871 - RNA, 64 nt, Homo Sapiens; identical to SEQ ID NO: 22654

SEQ ID NO: 717872 - RNA, 64 nt, Homo Sapiens; identical to SEQ ID NO: 22655

SEQ ID NO: 717873 - RNA, 64 nt, Homo Sapiens; identical to SEQ ID NO: 22656

SEQ ID NO: 717874 - RNA, 64 nt, Homo Sapiens; identical to SEQ ID NO: 22657

SEQ ID NO: 717875 - RNA, 64 nt, Homo Sapiens; identical to SEQ ID NO: 22658

SEQ ID NO: 717876 - RNA, 64 nt, Homo Sapiens; identical to SEQ ID NO: 22659

SEQ ID NO: 717877 - RNA, 64 nt, Homo Sapiens; identical to SEQ ID NO: 22660

SEQ ID NO: 717878 - RNA, 64 nt, Homo Sapiens; identical to SEQ ID NO: 22661

SEQ ID NO: 717879 - RNA, 64 nt, Homo Sapiens; identical to SEQ ID NO: 22662

SEQ ID NO: 717880 - RNA, 64 nt, Homo Sapiens; identical to SEQ ID NO: 22663

SEQ ID NO: 717881 - RNA, 64 nt, Homo Sapiens; identical to SEQ ID NO: 22664

SEQ ID NO: 717882 - RNA, 64 nt, Homo Sapiens; identical to SEQ ID NO: 22665

SEQ ID NO: 717883 - RNA, 64 nt, Homo Sapiens; identical to SEQ ID NO: 22666

SEQ ID NO: 717884 - RNA, 64 nt, Homo Sapiens; identical to SEQ ID NO: 22667

SEQ ID NO: 717885 - RNA, 64 nt, Homo Sapiens; identical to SEQ ID NO: 22668

SEQ ID NO: 717886 - RNA, 64 nt, Homo Sapiens; identical to SEQ ID NO: 22669

SEQ ID NO: 717887 - RNA, 64 nt, Homo Sapiens; identical to SEQ ID NO: 22670

SEQ ID NO: 717888 - RNA, 64 nt, Homo Sapiens; identical to SEQ ID NO: 22671

SEQ ID NO: 717889 - RNA, 64 nt, Homo Sapiens; identical to SEQ ID NO: 22672

SEQ ID NO: 717890 - RNA, 64 nt, Homo Sapiens; identical to SEQ ID NO: 22673

SEQ ID NO: 717891 - RNA, 64 nt, Homo Sapiens; identical to SEQ ID NO: 22674

SEQ ID NO: 717892 - RNA, 64 nt, Homo Sapiens; identical to SEQ ID NO: 22675

SEQ ID NO: 717893 - RNA, 64 nt, Homo Sapiens; identical to SEQ ID NO: 22676

SEQ ID NO: 717894 - RNA, 64 nt, Homo Sapiens; identical to SEQ ID NO: 22677

SEQ ID NO: 717895 - RNA, 64 nt, Homo Sapiens; identical to SEQ ID NO: 22678

SEQ ID NO: 717896 - RNA, 64 nt, Homo Sapiens; identical to SEQ ID NO: 22679

SEQ ID NO: 717897 - RNA, 64 nt, Homo Sapiens; identical to SEQ ID NO: 22680

SEQ ID NO: 717898 - RNA, 64 nt, Homo Sapiens; identical to SEQ ID NO: 22681

SEQ ID NO: 717899 - RNA, 64 nt, Homo Sapiens; identical to SEQ ID NO: 22682

SEQ ID NO: 717900 - RNA, 64 nt, Homo Sapiens; identical to SEQ ID NO: 22683

SEQ ID NO: 717901 - RNA, 64 nt, Homo Sapiens; identical to SEQ ID NO: 22684

SEQ ID NO: 717902 - RNA, 64 nt, Homo Sapiens; identical to SEQ ID NO: 22685

SEQ ID NO: 717903 - RNA, 64 nt, Homo Sapiens; identical to SEQ ID NO: 22686

SEQ ID NO: 717904 - RNA, 64 nt, Homo Sapiens; identical to SEQ ID NO: 22687

SEQ ID NO: 717905 - RNA, 64 nt, Homo Sapiens; identical to SEQ ID NO: 22688

SEQ ID NO: 717906 - RNA, 64 nt, Homo Sapiens; identical to SEQ ID NO: 22689

SEQ ID NO: 717907 - RNA, 64 nt, Homo Sapiens; identical to SEQ ID NO: 22690

SEQ ID NO: 717908 - RNA, 64 nt, Homo Sapiens; identical to SEQ ID NO: 22691

SEQ ID NO: 717909 - RNA, 64 nt, Homo Sapiens; identical to SEQ ID NO: 22692

SEQ ID NO: 717910 - RNA, 64 nt, Homo Sapiens; identical to SEQ ID NO: 22693

SEQ ID NO: 717911 - RNA, 64 nt, Homo Sapiens; identical to SEQ ID NO: 22694

SEQ ID NO: 717912 - RNA, 64 nt, Homo Sapiens; identical to SEQ ID NO: 22695

SEQ ID NO: 717913 - RNA, 64 nt, Homo Sapiens; identical to SEQ ID NO: 22696

SEQ ID NO: 717914 - RNA, 64 nt, Homo Sapiens; identical to SEQ ID NO: 22697

SEQ ID NO: 717915 - RNA, 64 nt, Homo Sapiens; identical to SEQ ID NO: 22698

SEQ ID NO: 717916 - RNA, 64 nt, Homo Sapiens; identical to SEQ ID NO: 22699

SEQ ID NO: 717917 - RNA, 64 nt, Homo Sapiens; identical to SEQ ID NO: 22700

SEQ ID NO: 717918 - RNA, 64 nt, Homo Sapiens; identical to SEQ ID NO: 22701

SEQ ID NO: 717919 - RNA, 64 nt, Homo Sapiens; identical to SEQ ID NO: 22702

SEQ ID NO: 717920 - RNA, 64 nt, Homo Sapiens; identical to SEQ ID NO: 22703

SEQ ID NO: 717921 - RNA, 64 nt, Homo Sapiens; identical to SEQ ID NO: 22704

SEQ ID NO: 717922 - RNA, 64 nt, Homo Sapiens; identical to SEQ ID NO: 22705

SEQ ID NO: 717923 - RNA, 64 nt, Homo Sapiens; identical to SEQ ID NO: 22706

SEQ ID NO: 717924 - RNA, 64 nt, Homo Sapiens; identical to SEQ ID NO: 22707

SEQ ID NO: 717925 - RNA, 64 nt, Homo Sapiens; identical to SEQ ID NO: 22708

SEQ ID NO: 717926 - RNA, 64 nt, Homo Sapiens; identical to SEQ ID NO: 22709

SEQ ID NO: 717927 - RNA, 64 nt, Homo Sapiens; identical to SEQ ID NO: 22710

SEQ ID NO: 717928 - RNA, 64 nt, Homo Sapiens; identical to SEQ ID NO: 22711

SEQ ID NO: 717929 - RNA, 64 nt, Homo Sapiens; identical to SEQ ID NO: 22712

SEQ ID NO: 717930 - RNA, 64 nt, Homo Sapiens; identical to SEQ ID NO: 22713

SEQ ID NO: 717931 - RNA, 64 nt, Homo Sapiens; identical to SEQ ID NO: 22714

SEQ ID NO: 717932 - RNA, 64 nt, Homo Sapiens; identical to SEQ ID NO: 22715

SEQ ID NO: 717933 - RNA, 64 nt, Homo Sapiens; identical to SEQ ID NO: 22716

SEQ ID NO: 717934 - RNA, 64 nt, Homo Sapiens; identical to SEQ ID NO: 22717

SEQ ID NO: 717935 - RNA, 64 nt, Homo Sapiens; identical to SEQ ID NO: 22718

SEQ ID NO: 717936 - RNA, 64 nt, Homo Sapiens; identical to SEQ ID NO: 22719

SEQ ID NO: 717937 - RNA, 64 nt, Homo Sapiens; identical to SEQ ID NO: 22720

SEQ ID NO: 717938 - RNA, 64 nt, Homo Sapiens; identical to SEQ ID NO: 22721

SEQ ID NO: 717939 - RNA, 64 nt, Homo Sapiens; identical to SEQ ID NO: 22722

SEQ ID NO: 717940 - RNA, 64 nt, Homo Sapiens; identical to SEQ ID NO: 22723

SEQ ID NO: 717941 - RNA, 64 nt, Homo Sapiens; identical to SEQ ID NO: 22724

SEQ ID NO: 717942 - RNA, 64 nt, Homo Sapiens; identical to SEQ ID NO: 22725

SEQ ID NO: 717943 - RNA, 64 nt, Homo Sapiens; identical to SEQ ID NO: 22726

SEQ ID NO: 717944 - RNA, 64 nt, Homo Sapiens; identical to SEQ ID NO: 22727

SEQ ID NO: 717945 - RNA, 64 nt, Homo Sapiens; identical to SEQ ID NO: 22728

SEQ ID NO: 717946 - RNA, 64 nt, Homo Sapiens; identical to SEQ ID NO: 22729

SEQ ID NO: 717947 - RNA, 64 nt, Homo Sapiens; identical to SEQ ID NO: 22730

SEQ ID NO: 717948 - RNA, 64 nt, Homo Sapiens; identical to SEQ ID NO: 22731

SEQ ID NO: 717949 - RNA, 64 nt, Homo Sapiens; identical to SEQ ID NO: 22732

SEQ ID NO: 717950 - RNA, 64 nt, Homo Sapiens; identical to SEQ ID NO: 22733

SEQ ID NO: 717951 - RNA, 60 nt, Homo Sapiens; identical to SEQ ID NO: 22734

SEQ ID NO: 717952 - RNA, 64 nt, Homo Sapiens; identical to SEQ ID NO: 22735

SEQ ID NO: 717953 - RNA, 64 nt, Homo Sapiens; identical to SEQ ID NO: 22736

SEQ ID NO: 717954 - RNA, 64 nt, Homo Sapiens; identical to SEQ ID NO: 22737

SEQ ID NO: 717955 - RNA, 64 nt, Homo Sapiens; identical to SEQ ID NO: 22738

SEQ ID NO: 717956 - RNA, 64 nt, Homo Sapiens; identical to SEQ ID NO: 22739

SEQ ID NO: 717957 - RNA, 64 nt, Homo Sapiens; identical to SEQ ID NO: 22740

SEQ ID NO: 717958 - RNA, 64 nt, Homo Sapiens; identical to SEQ ID NO: 22741

SEQ ID NO: 717959 - RNA, 64 nt, Homo Sapiens; identical to SEQ ID NO: 22742

SEQ ID NO: 717960 - RNA, 64 nt, Homo Sapiens; identical to SEQ ID NO: 22743

SEQ ID NO: 717961 - RNA, 64 nt, Homo Sapiens; identical to SEQ ID NO: 22744

SEQ ID NO: 717962 - RNA, 64 nt, Homo Sapiens; identical to SEQ ID NO: 22745

SEQ ID NO: 717963 - RNA, 64 nt, Homo Sapiens; identical to SEQ ID NO: 22746

SEQ ID NO: 717964 - RNA, 64 nt, Homo Sapiens; identical to SEQ ID NO: 22747

SEQ ID NO: 717965 - RNA, 64 nt, Homo Sapiens; identical to SEQ ID NO: 22748

SEQ ID NO: 717966 - RNA, 64 nt, Homo Sapiens; identical to SEQ ID NO: 22749

SEQ ID NO: 717967 - RNA, 64 nt, Homo Sapiens; identical to SEQ ID NO: 22750

SEQ ID NO: 717968 - RNA, 64 nt, Homo Sapiens; identical to SEQ ID NO: 22751

SEQ ID NO: 717969 - RNA, 64 nt, Homo Sapiens; identical to SEQ ID NO: 22752

SEQ ID NO: 717970 - RNA, 64 nt, Homo Sapiens; identical to SEQ ID NO: 22753

SEQ ID NO: 717971 - RNA, 64 nt, Homo Sapiens; identical to SEQ ID NO: 22754

SEQ ID NO: 717972 - RNA, 64 nt, Homo Sapiens; identical to SEQ ID NO: 22755

SEQ ID NO: 717973 - RNA, 64 nt, Homo Sapiens; identical to SEQ ID NO: 22756

SEQ ID NO: 717974 - RNA, 64 nt, Homo Sapiens; identical to SEQ ID NO: 22757

SEQ ID NO: 717975 - RNA, 64 nt, Homo Sapiens; identical to SEQ ID NO: 22758

SEQ ID NO: 717976 - RNA, 64 nt, Homo Sapiens; identical to SEQ ID NO: 22759

SEQ ID NO: 717977 - RNA, 64 nt, Homo Sapiens; identical to SEQ ID NO: 22760

SEQ ID NO: 717978 - RNA, 64 nt, Homo Sapiens; identical to SEQ ID NO: 22761

SEQ ID NO: 717979 - RNA, 64 nt, Homo Sapiens; identical to SEQ ID NO: 22762

SEQ ID NO: 717980 - RNA, 64 nt, Homo Sapiens; identical to SEQ ID NO: 22763

SEQ ID NO: 717981 - RNA, 64 nt, Homo Sapiens; identical to SEQ ID NO: 22764

SEQ ID NO: 717982 - RNA, 64 nt, Homo Sapiens; identical to SEQ ID NO: 22765

SEQ ID NO: 717983 - RNA, 64 nt, Homo Sapiens; identical to SEQ ID NO: 22766

SEQ ID NO: 717984 - RNA, 64 nt, Homo Sapiens; identical to SEQ ID NO: 22767

SEQ ID NO: 717985 - RNA, 64 nt, Homo Sapiens; identical to SEQ ID NO: 22768

SEQ ID NO: 717986 - RNA, 64 nt, Homo Sapiens; identical to SEQ ID NO: 22769

SEQ ID NO: 717987 - RNA, 64 nt, Homo Sapiens; identical to SEQ ID NO: 22770

SEQ ID NO: 717988 - RNA, 64 nt, Homo Sapiens; identical to SEQ ID NO: 22771

SEQ ID NO: 717989 - RNA, 64 nt, Homo Sapiens; identical to SEQ ID NO: 22772

SEQ ID NO: 717990 - RNA, 64 nt, Homo Sapiens; identical to SEQ ID NO: 22773

SEQ ID NO: 717991 - RNA, 64 nt, Homo Sapiens; identical to SEQ ID NO: 22774

SEQ ID NO: 717992 - RNA, 64 nt, Homo Sapiens; identical to SEQ ID NO: 22775

SEQ ID NO: 717993 - RNA, 64 nt, Homo Sapiens; identical to SEQ ID NO: 22776

SEQ ID NO: 717994 - RNA, 64 nt, Homo Sapiens; identical to SEQ ID NO: 22777

SEQ ID NO: 717995 - RNA, 64 nt, Homo Sapiens; identical to SEQ ID NO: 22778

SEQ ID NO: 717996 - RNA, 64 nt, Homo Sapiens; identical to SEQ ID NO: 22779

SEQ ID NO: 717997 - RNA, 64 nt, Homo Sapiens; identical to SEQ ID NO: 22780

SEQ ID NO: 717998 - RNA, 64 nt, Homo Sapiens; identical to SEQ ID NO: 22781

SEQ ID NO: 717999 - RNA, 64 nt, Homo Sapiens; identical to SEQ ID NO: 22782

SEQ ID NO: 718000 - RNA, 64 nt, Homo Sapiens; identical to SEQ ID NO: 22783

SEQ ID NO: 718001 - RNA, 64 nt, Homo Sapiens; identical to SEQ ID NO: 22784

SEQ ID NO: 718002 - RNA, 64 nt, Homo Sapiens; identical to SEQ ID NO: 22785

SEQ ID NO: 718003 - RNA, 64 nt, Homo Sapiens; identical to SEQ ID NO: 22786

SEQ ID NO: 718004 - RNA, 64 nt, Homo Sapiens; identical to SEQ ID NO: 22787

SEQ ID NO: 718005 - RNA, 64 nt, Homo Sapiens; identical to SEQ ID NO: 22788

SEQ ID NO: 718006 - RNA, 64 nt, Homo Sapiens; identical to SEQ ID NO: 22789

SEQ ID NO: 718007 - RNA, 64 nt, Homo Sapiens; identical to SEQ ID NO: 22790

SEQ ID NO: 718008 - RNA, 64 nt, Homo Sapiens; identical to SEQ ID NO: 22791

SEQ ID NO: 718009 - RNA, 64 nt, Homo Sapiens; identical to SEQ ID NO: 22792

SEQ ID NO: 718010 - RNA, 64 nt, Homo Sapiens; identical to SEQ ID NO: 22793

SEQ ID NO: 718011 - RNA, 64 nt, Homo Sapiens; identical to SEQ ID NO: 22794

SEQ ID NO: 718012 - RNA, 64 nt, Homo Sapiens; identical to SEQ ID NO: 22795

SEQ ID NO: 718013 - RNA, 64 nt, Homo Sapiens; identical to SEQ ID NO: 22796

SEQ ID NO: 718014 - RNA, 64 nt, Homo Sapiens; identical to SEQ ID NO: 22797

SEQ ID NO: 718015 - RNA, 64 nt, Homo Sapiens; identical to SEQ ID NO: 22798

SEQ ID NO: 718016 - RNA, 64 nt, Homo Sapiens; identical to SEQ ID NO: 22799

SEQ ID NO: 718017 - RNA, 64 nt, Homo Sapiens; identical to SEQ ID NO: 22800

SEQ ID NO: 718018 - RNA, 64 nt, Homo Sapiens; identical to SEQ ID NO: 22801

SEQ ID NO: 718019 - RNA, 64 nt, Homo Sapiens; identical to SEQ ID NO: 22802

SEQ ID NO: 718020 - RNA, 64 nt, Homo Sapiens; identical to SEQ ID NO: 22803

SEQ ID NO: 718021 - RNA, 64 nt, Homo Sapiens; identical to SEQ ID NO: 22804

SEQ ID NO: 718022 - RNA, 64 nt, Homo Sapiens; identical to SEQ ID NO: 22805

SEQ ID NO: 718023 - RNA, 64 nt, Homo Sapiens; identical to SEQ ID NO: 22806

SEQ ID NO: 718024 - RNA, 64 nt, Homo Sapiens; identical to SEQ ID NO: 22807

SEQ ID NO: 718025 - RNA, 64 nt, Homo Sapiens; identical to SEQ ID NO: 22808

SEQ ID NO: 718026 - RNA, 64 nt, Homo Sapiens; identical to SEQ ID NO: 22809

SEQ ID NO: 718027 - RNA, 64 nt, Homo Sapiens; identical to SEQ ID NO: 22810

SEQ ID NO: 718028 - RNA, 64 nt, Homo Sapiens; identical to SEQ ID NO: 22811

SEQ ID NO: 718029 - RNA, 64 nt, Homo Sapiens; identical to SEQ ID NO: 22812

SEQ ID NO: 718030 - RNA, 64 nt, Homo Sapiens; identical to SEQ ID NO: 22813

SEQ ID NO: 718031 - RNA, 64 nt, Homo Sapiens; identical to SEQ ID NO: 22814

SEQ ID NO: 718032 - RNA, 64 nt, Homo Sapiens; identical to SEQ ID NO: 22815

SEQ ID NO: 718033 - RNA, 64 nt, Homo Sapiens; identical to SEQ ID NO: 22816

SEQ ID NO: 718034 - RNA, 64 nt, Homo Sapiens; identical to SEQ ID NO: 22817

SEQ ID NO: 718035 - RNA, 64 nt, Homo Sapiens; identical to SEQ ID NO: 22818

SEQ ID NO: 718036 - RNA, 64 nt, Homo Sapiens; identical to SEQ ID NO: 22819

SEQ ID NO: 718037 - RNA, 64 nt, Homo Sapiens; identical to SEQ ID NO: 22820

SEQ ID NO: 718038 - RNA, 64 nt, Homo Sapiens; identical to SEQ ID NO: 22821

SEQ ID NO: 718039 - RNA, 64 nt, Homo Sapiens; identical to SEQ ID NO: 22822

SEQ ID NO: 718040 - RNA, 64 nt, Homo Sapiens; identical to SEQ ID NO: 22823

SEQ ID NO: 718041 - RNA, 64 nt, Homo Sapiens; identical to SEQ ID NO: 22824

SEQ ID NO: 718042 - RNA, 64 nt, Homo Sapiens; identical to SEQ ID NO: 22825

SEQ ID NO: 718043 - RNA, 64 nt, Homo Sapiens; identical to SEQ ID NO: 22826

SEQ ID NO: 718044 - RNA, 64 nt, Homo Sapiens; identical to SEQ ID NO: 22827

SEQ ID NO: 718045 - RNA, 64 nt, Homo Sapiens; identical to SEQ ID NO: 22828

SEQ ID NO: 718046 - RNA, 64 nt, Homo Sapiens; identical to SEQ ID NO: 22829

SEQ ID NO: 718047 - RNA, 64 nt, Homo Sapiens; identical to SEQ ID NO: 22830

SEQ ID NO: 718048 - RNA, 64 nt, Homo Sapiens; identical to SEQ ID NO: 22831

SEQ ID NO: 718049 - RNA, 64 nt, Homo Sapiens; identical to SEQ ID NO: 22832

SEQ ID NO: 718050 - RNA, 64 nt, Homo Sapiens; identical to SEQ ID NO: 22833

SEQ ID NO: 718051 - RNA, 64 nt, Homo Sapiens; identical to SEQ ID NO: 22834

SEQ ID NO: 718052 - RNA, 64 nt, Homo Sapiens; identical to SEQ ID NO: 22835

SEQ ID NO: 718053 - RNA, 64 nt, Homo Sapiens; identical to SEQ ID NO: 22836

SEQ ID NO: 718054 - RNA, 64 nt, Homo Sapiens; identical to SEQ ID NO: 22837

SEQ ID NO: 718055 - RNA, 64 nt, Homo Sapiens; identical to SEQ ID NO: 22838

SEQ ID NO: 718056 - RNA, 64 nt, Homo Sapiens; identical to SEQ ID NO: 22839

SEQ ID NO: 718057 - RNA, 64 nt, Homo Sapiens; identical to SEQ ID NO: 22840

SEQ ID NO: 718058 - RNA, 64 nt, Homo Sapiens; identical to SEQ ID NO: 22841

SEQ ID NO: 718059 - RNA, 64 nt, Homo Sapiens; identical to SEQ ID NO: 22842

SEQ ID NO: 718060 - RNA, 64 nt, Homo Sapiens; identical to SEQ ID NO: 22843

SEQ ID NO: 718061 - RNA, 64 nt, Homo Sapiens; identical to SEQ ID NO: 22844

SEQ ID NO: 718062 - RNA, 64 nt, Homo Sapiens; identical to SEQ ID NO: 22845

SEQ ID NO: 718063 - RNA, 64 nt, Homo Sapiens; identical to SEQ ID NO: 22846

SEQ ID NO: 718064 - RNA, 64 nt, Homo Sapiens; identical to SEQ ID NO: 22847

SEQ ID NO: 718065 - RNA, 64 nt, Homo Sapiens; identical to SEQ ID NO: 22848

SEQ ID NO: 718066 - RNA, 64 nt, Homo Sapiens; identical to SEQ ID NO: 22849

SEQ ID NO: 718067 - RNA, 64 nt, Homo Sapiens; identical to SEQ ID NO: 22850

SEQ ID NO: 718068 - RNA, 64 nt, Homo Sapiens; identical to SEQ ID NO: 22851

SEQ ID NO: 718069 - RNA, 64 nt, Homo Sapiens; identical to SEQ ID NO: 22852

SEQ ID NO: 718070 - RNA, 64 nt, Homo Sapiens; identical to SEQ ID NO: 22853

SEQ ID NO: 718071 - RNA, 64 nt, Homo Sapiens; identical to SEQ ID NO: 22854

SEQ ID NO: 718072 - RNA, 64 nt, Homo Sapiens; identical to SEQ ID NO: 22855

SEQ ID NO: 718073 - RNA, 64 nt, Homo Sapiens; identical to SEQ ID NO: 22856

SEQ ID NO: 718074 - RNA, 64 nt, Homo Sapiens; identical to SEQ ID NO: 22857

SEQ ID NO: 718075 - RNA, 64 nt, Homo Sapiens; identical to SEQ ID NO: 22858

SEQ ID NO: 718076 - RNA, 64 nt, Homo Sapiens; identical to SEQ ID NO: 22859

SEQ ID NO: 718077 - RNA, 64 nt, Homo Sapiens; identical to SEQ ID NO: 22860

SEQ ID NO: 718078 - RNA, 64 nt, Homo Sapiens; identical to SEQ ID NO: 22861

SEQ ID NO: 718079 - RNA, 64 nt, Homo Sapiens; identical to SEQ ID NO: 22862

SEQ ID NO: 718080 - RNA, 64 nt, Homo Sapiens; identical to SEQ ID NO: 22863

SEQ ID NO: 718081 - RNA, 64 nt, Homo Sapiens; identical to SEQ ID NO: 22864

SEQ ID NO: 718082 - RNA, 64 nt, Homo Sapiens; identical to SEQ ID NO: 22865

SEQ ID NO: 718083 - RNA, 64 nt, Homo Sapiens; identical to SEQ ID NO: 22866

SEQ ID NO: 718084 - RNA, 64 nt, Homo Sapiens; identical to SEQ ID NO: 22867

SEQ ID NO: 718085 - RNA, 64 nt, Homo Sapiens; identical to SEQ ID NO: 22868

SEQ ID NO: 718086 - RNA, 64 nt, Homo Sapiens; identical to SEQ ID NO: 22869

SEQ ID NO: 718087 - RNA, 64 nt, Homo Sapiens; identical to SEQ ID NO: 22870

SEQ ID NO: 718088 - RNA, 64 nt, Homo Sapiens; identical to SEQ ID NO: 22871

SEQ ID NO: 718089 - RNA, 64 nt, Homo Sapiens; identical to SEQ ID NO: 22872

SEQ ID NO: 718090 - RNA, 64 nt, Homo Sapiens; identical to SEQ ID NO: 22873

SEQ ID NO: 718091 - RNA, 64 nt, Homo Sapiens; identical to SEQ ID NO: 22874

SEQ ID NO: 718092 - RNA, 64 nt, Homo Sapiens; identical to SEQ ID NO: 22875

SEQ ID NO: 718093 - RNA, 64 nt, Homo Sapiens; identical to SEQ ID NO: 22876

SEQ ID NO: 718094 - RNA, 64 nt, Homo Sapiens; identical to SEQ ID NO: 22877

SEQ ID NO: 718095 - RNA, 64 nt, Homo Sapiens; identical to SEQ ID NO: 22878

SEQ ID NO: 718096 - RNA, 64 nt, Homo Sapiens; identical to SEQ ID NO: 22879

SEQ ID NO: 718097 - RNA, 64 nt, Homo Sapiens; identical to SEQ ID NO: 22880

SEQ ID NO: 718098 - RNA, 64 nt, Homo Sapiens; identical to SEQ ID NO: 22881

SEQ ID NO: 718099 - RNA, 64 nt, Homo Sapiens; identical to SEQ ID NO: 22882

SEQ ID NO: 718100 - RNA, 64 nt, Homo Sapiens; identical to SEQ ID NO: 22883

SEQ ID NO: 718101 - RNA, 64 nt, Homo Sapiens; identical to SEQ ID NO: 22884

SEQ ID NO: 718102 - RNA, 64 nt, Homo Sapiens; identical to SEQ ID NO: 22885

SEQ ID NO: 718103 - RNA, 64 nt, Homo Sapiens; identical to SEQ ID NO: 22886

SEQ ID NO: 718104 - RNA, 64 nt, Homo Sapiens; identical to SEQ ID NO: 22887

SEQ ID NO: 718105 - RNA, 64 nt, Homo Sapiens; identical to SEQ ID NO: 22888

SEQ ID NO: 718106 - RNA, 64 nt, Homo Sapiens; identical to SEQ ID NO: 22889

SEQ ID NO: 718107 - RNA, 64 nt, Homo Sapiens; identical to SEQ ID NO: 22890

SEQ ID NO: 718108 - RNA, 64 nt, Homo Sapiens; identical to SEQ ID NO: 22891

SEQ ID NO: 718109 - RNA, 64 nt, Homo Sapiens; identical to SEQ ID NO: 22892

SEQ ID NO: 718110 - RNA, 64 nt, Homo Sapiens; identical to SEQ ID NO: 22893

SEQ ID NO: 718111 - RNA, 64 nt, Homo Sapiens; identical to SEQ ID NO: 22894

SEQ ID NO: 718112 - RNA, 64 nt, Homo Sapiens; identical to SEQ ID NO: 22895

SEQ ID NO: 718113 - RNA, 64 nt, Homo Sapiens; identical to SEQ ID NO: 22896

SEQ ID NO: 718114 - RNA, 64 nt, Homo Sapiens; identical to SEQ ID NO: 22897

SEQ ID NO: 718115 - RNA, 64 nt, Homo Sapiens; identical to SEQ ID NO: 22898

SEQ ID NO: 718116 - RNA, 64 nt, Homo Sapiens; identical to SEQ ID NO: 22899

SEQ ID NO: 718117 - RNA, 64 nt, Homo Sapiens; identical to SEQ ID NO: 22900

SEQ ID NO: 718118 - RNA, 64 nt, Homo Sapiens; identical to SEQ ID NO: 22901

SEQ ID NO: 718119 - RNA, 64 nt, Homo Sapiens; identical to SEQ ID NO: 22902

SEQ ID NO: 718120 - RNA, 64 nt, Homo Sapiens; identical to SEQ ID NO: 22903

SEQ ID NO: 718121 - RNA, 64 nt, Homo Sapiens; identical to SEQ ID NO: 22904

SEQ ID NO: 718122 - RNA, 64 nt, Homo Sapiens; identical to SEQ ID NO: 22905

SEQ ID NO: 718123 - RNA, 64 nt, Homo Sapiens; identical to SEQ ID NO: 22906

SEQ ID NO: 718124 - RNA, 64 nt, Homo Sapiens; identical to SEQ ID NO: 22907

SEQ ID NO: 718125 - RNA, 64 nt, Homo Sapiens; identical to SEQ ID NO: 22908

SEQ ID NO: 718126 - RNA, 64 nt, Homo Sapiens; identical to SEQ ID NO: 22909

SEQ ID NO: 718127 - RNA, 64 nt, Homo Sapiens; identical to SEQ ID NO: 22910

SEQ ID NO: 718128 - RNA, 64 nt, Homo Sapiens; identical to SEQ ID NO: 22911

SEQ ID NO: 718129 - RNA, 64 nt, Homo Sapiens; identical to SEQ ID NO: 22912

SEQ ID NO: 718130 - RNA, 64 nt, Homo Sapiens; identical to SEQ ID NO: 22913

SEQ ID NO: 718131 - RNA, 64 nt, Homo Sapiens; identical to SEQ ID NO: 22914

SEQ ID NO: 718132 - RNA, 64 nt, Homo Sapiens; identical to SEQ ID NO: 22915

SEQ ID NO: 718133 - RNA, 64 nt, Homo Sapiens; identical to SEQ ID NO: 22916

SEQ ID NO: 718134 - RNA, 64 nt, Homo Sapiens; identical to SEQ ID NO: 22917

SEQ ID NO: 718135 - RNA, 64 nt, Homo Sapiens; identical to SEQ ID NO: 22918

SEQ ID NO: 718136 - RNA, 64 nt, Homo Sapiens; identical to SEQ ID NO: 22919

SEQ ID NO: 718137 - RNA, 62 nt, Homo Sapiens; identical to SEQ ID NO: 22920

SEQ ID NO: 718138 - RNA, 64 nt, Homo Sapiens; identical to SEQ ID NO: 22921

SEQ ID NO: 718139 - RNA, 64 nt, Homo Sapiens; identical to SEQ ID NO: 22922

SEQ ID NO: 718140 - RNA, 64 nt, Homo Sapiens; identical to SEQ ID NO: 22923

SEQ ID NO: 718141 - RNA, 64 nt, Homo Sapiens; identical to SEQ ID NO: 22924

SEQ ID NO: 718142 - RNA, 64 nt, Homo Sapiens; identical to SEQ ID NO: 22925

SEQ ID NO: 718143 - RNA, 64 nt, Homo Sapiens; identical to SEQ ID NO: 22926

SEQ ID NO: 718144 - RNA, 64 nt, Homo Sapiens; identical to SEQ ID NO: 22927

SEQ ID NO: 718145 - RNA, 64 nt, Homo Sapiens; identical to SEQ ID NO: 22928

SEQ ID NO: 718146 - RNA, 64 nt, Homo Sapiens; identical to SEQ ID NO: 22929

SEQ ID NO: 718147 - RNA, 64 nt, Homo Sapiens; identical to SEQ ID NO: 22930

SEQ ID NO: 718148 - RNA, 64 nt, Homo Sapiens; identical to SEQ ID NO: 22931

SEQ ID NO: 718149 - RNA, 64 nt, Homo Sapiens; identical to SEQ ID NO: 22932

SEQ ID NO: 718150 - RNA, 64 nt, Homo Sapiens; identical to SEQ ID NO: 22933

SEQ ID NO: 718151 - RNA, 64 nt, Homo Sapiens; identical to SEQ ID NO: 22934

SEQ ID NO: 718152 - RNA, 64 nt, Homo Sapiens; identical to SEQ ID NO: 22935

SEQ ID NO: 718153 - RNA, 64 nt, Homo Sapiens; identical to SEQ ID NO: 22936

SEQ ID NO: 718154 - RNA, 64 nt, Homo Sapiens; identical to SEQ ID NO: 22937

SEQ ID NO: 718155 - RNA, 64 nt, Homo Sapiens; identical to SEQ ID NO: 22938

SEQ ID NO: 718156 - RNA, 64 nt, Homo Sapiens; identical to SEQ ID NO: 22939

SEQ ID NO: 718157 - RNA, 64 nt, Homo Sapiens; identical to SEQ ID NO: 22940

SEQ ID NO: 718158 - RNA, 64 nt, Homo Sapiens; identical to SEQ ID NO: 22941

SEQ ID NO: 718159 - RNA, 64 nt, Homo Sapiens; identical to SEQ ID NO: 22942

SEQ ID NO: 718160 - RNA, 64 nt, Homo Sapiens; identical to SEQ ID NO: 22943

SEQ ID NO: 718161 - RNA, 64 nt, Homo Sapiens; identical to SEQ ID NO: 22944

SEQ ID NO: 718162 - RNA, 64 nt, Homo Sapiens; identical to SEQ ID NO: 22945

SEQ ID NO: 718163 - RNA, 64 nt, Homo Sapiens; identical to SEQ ID NO: 22946

SEQ ID NO: 718164 - RNA, 64 nt, Homo Sapiens; identical to SEQ ID NO: 22947

SEQ ID NO: 718165 - RNA, 64 nt, Homo Sapiens; identical to SEQ ID NO: 22948

SEQ ID NO: 718166 - RNA, 64 nt, Homo Sapiens; identical to SEQ ID NO: 22949

SEQ ID NO: 718167 - RNA, 64 nt, Homo Sapiens; identical to SEQ ID NO: 22950

SEQ ID NO: 718168 - RNA, 64 nt, Homo Sapiens; identical to SEQ ID NO: 22951

SEQ ID NO: 718169 - RNA, 64 nt, Homo Sapiens; identical to SEQ ID NO: 22952

SEQ ID NO: 718170 - RNA, 64 nt, Homo Sapiens; identical to SEQ ID NO: 22953

SEQ ID NO: 718171 - RNA, 64 nt, Homo Sapiens; identical to SEQ ID NO: 22954

SEQ ID NO: 718172 - RNA, 64 nt, Homo Sapiens; identical to SEQ ID NO: 22955

SEQ ID NO: 718173 - RNA, 64 nt, Homo Sapiens; identical to SEQ ID NO: 22956

SEQ ID NO: 718174 - RNA, 64 nt, Homo Sapiens; identical to SEQ ID NO: 22957

SEQ ID NO: 718175 - RNA, 64 nt, Homo Sapiens; identical to SEQ ID NO: 22958

SEQ ID NO: 718176 - RNA, 64 nt, Homo Sapiens; identical to SEQ ID NO: 22959

SEQ ID NO: 718177 - RNA, 64 nt, Homo Sapiens; identical to SEQ ID NO: 22960

SEQ ID NO: 718178 - RNA, 64 nt, Homo Sapiens; identical to SEQ ID NO: 22961

SEQ ID NO: 718179 - RNA, 64 nt, Homo Sapiens; identical to SEQ ID NO: 22962

SEQ ID NO: 718180 - RNA, 64 nt, Homo Sapiens; identical to SEQ ID NO: 22963

SEQ ID NO: 718181 - RNA, 64 nt, Homo Sapiens; identical to SEQ ID NO: 22964

SEQ ID NO: 718182 - RNA, 64 nt, Homo Sapiens; identical to SEQ ID NO: 22965

SEQ ID NO: 718183 - RNA, 64 nt, Homo Sapiens; identical to SEQ ID NO: 22966

SEQ ID NO: 718184 - RNA, 64 nt, Homo Sapiens; identical to SEQ ID NO: 22967

SEQ ID NO: 718185 - RNA, 64 nt, Homo Sapiens; identical to SEQ ID NO: 22968

SEQ ID NO: 718186 - RNA, 64 nt, Homo Sapiens; identical to SEQ ID NO: 22969

SEQ ID NO: 718187 - RNA, 64 nt, Homo Sapiens; identical to SEQ ID NO: 22970

SEQ ID NO: 718188 - RNA, 64 nt, Homo Sapiens; identical to SEQ ID NO: 22971

SEQ ID NO: 718189 - RNA, 64 nt, Homo Sapiens; identical to SEQ ID NO: 22972

SEQ ID NO: 718190 - RNA, 64 nt, Homo Sapiens; identical to SEQ ID NO: 22973

SEQ ID NO: 718191 - RNA, 64 nt, Homo Sapiens; identical to SEQ ID NO: 22974

SEQ ID NO: 718192 - RNA, 64 nt, Homo Sapiens; identical to SEQ ID NO: 22975

SEQ ID NO: 718193 - RNA, 64 nt, Homo Sapiens; identical to SEQ ID NO: 22976

SEQ ID NO: 718194 - RNA, 64 nt, Homo Sapiens; identical to SEQ ID NO: 22977

SEQ ID NO: 718195 - RNA, 64 nt, Homo Sapiens; identical to SEQ ID NO: 22978

SEQ ID NO: 718196 - RNA, 64 nt, Homo Sapiens; identical to SEQ ID NO: 22979

SEQ ID NO: 718197 - RNA, 64 nt, Homo Sapiens; identical to SEQ ID NO: 22980

SEQ ID NO: 718198 - RNA, 64 nt, Homo Sapiens; identical to SEQ ID NO: 22981

SEQ ID NO: 718199 - RNA, 64 nt, Homo Sapiens; identical to SEQ ID NO: 22982

SEQ ID NO: 718200 - RNA, 64 nt, Homo Sapiens; identical to SEQ ID NO: 22983

SEQ ID NO: 718201 - RNA, 64 nt, Homo Sapiens; identical to SEQ ID NO: 22984

SEQ ID NO: 718202 - RNA, 64 nt, Homo Sapiens; identical to SEQ ID NO: 22985

SEQ ID NO: 718203 - RNA, 64 nt, Homo Sapiens; identical to SEQ ID NO: 22986

SEQ ID NO: 718204 - RNA, 64 nt, Homo Sapiens; identical to SEQ ID NO: 22987

SEQ ID NO: 718205 - RNA, 64 nt, Homo Sapiens; identical to SEQ ID NO: 22988

SEQ ID NO: 718206 - RNA, 64 nt, Homo Sapiens; identical to SEQ ID NO: 22989

SEQ ID NO: 718207 - RNA, 64 nt, Homo Sapiens; identical to SEQ ID NO: 22990

SEQ ID NO: 718208 - RNA, 64 nt, Homo Sapiens; identical to SEQ ID NO: 22991

SEQ ID NO: 718209 - RNA, 64 nt, Homo Sapiens; identical to SEQ ID NO: 22992

SEQ ID NO: 718210 - RNA, 64 nt, Homo Sapiens; identical to SEQ ID NO: 22993

SEQ ID NO: 718211 - RNA, 64 nt, Homo Sapiens; identical to SEQ ID NO: 22994

SEQ ID NO: 718212 - RNA, 52 nt, Homo Sapiens; identical to SEQ ID NO: 22995

SEQ ID NO: 718213 - RNA, 56 nt, Homo Sapiens; identical to SEQ ID NO: 22996

SEQ ID NO: 718214 - RNA, 64 nt, Homo Sapiens; identical to SEQ ID NO: 22997

SEQ ID NO: 718215 - RNA, 64 nt, Homo Sapiens; identical to SEQ ID NO: 22998

SEQ ID NO: 718216 - RNA, 64 nt, Homo Sapiens; identical to SEQ ID NO: 22999

SEQ ID NO: 718217 - RNA, 64 nt, Homo Sapiens; identical to SEQ ID NO: 23000

SEQ ID NO: 718218 - RNA, 64 nt, Homo Sapiens; identical to SEQ ID NO: 23001

SEQ ID NO: 718219 - RNA, 64 nt, Homo Sapiens; identical to SEQ ID NO: 23002

SEQ ID NO: 718220 - RNA, 64 nt, Homo Sapiens; identical to SEQ ID NO: 23003

SEQ ID NO: 718221 - RNA, 64 nt, Homo Sapiens; identical to SEQ ID NO: 23004

SEQ ID NO: 718222 - RNA, 64 nt, Homo Sapiens; identical to SEQ ID NO: 23005

SEQ ID NO: 718223 - RNA, 64 nt, Homo Sapiens; identical to SEQ ID NO: 23006

SEQ ID NO: 718224 - RNA, 64 nt, Homo Sapiens; identical to SEQ ID NO: 23007

SEQ ID NO: 718225 - RNA, 64 nt, Homo Sapiens; identical to SEQ ID NO: 23008

SEQ ID NO: 718226 - RNA, 64 nt, Homo Sapiens; identical to SEQ ID NO: 23009

SEQ ID NO: 718227 - RNA, 64 nt, Homo Sapiens; identical to SEQ ID NO: 23010

SEQ ID NO: 718228 - RNA, 64 nt, Homo Sapiens; identical to SEQ ID NO: 23011

SEQ ID NO: 718229 - RNA, 64 nt, Homo Sapiens; identical to SEQ ID NO: 23012

SEQ ID NO: 718230 - RNA, 64 nt, Homo Sapiens; identical to SEQ ID NO: 23013

SEQ ID NO: 718231 - RNA, 64 nt, Homo Sapiens; identical to SEQ ID NO: 23014

SEQ ID NO: 718232 - RNA, 64 nt, Homo Sapiens; identical to SEQ ID NO: 23015

SEQ ID NO: 718233 - RNA, 64 nt, Homo Sapiens; identical to SEQ ID NO: 23016

SEQ ID NO: 718234 - RNA, 64 nt, Homo Sapiens; identical to SEQ ID NO: 23017

SEQ ID NO: 718235 - RNA, 64 nt, Homo Sapiens; identical to SEQ ID NO: 23018

SEQ ID NO: 718236 - RNA, 64 nt, Homo Sapiens; identical to SEQ ID NO: 23019

SEQ ID NO: 718237 - RNA, 64 nt, Homo Sapiens; identical to SEQ ID NO: 23020

SEQ ID NO: 718238 - RNA, 64 nt, Homo Sapiens; identical to SEQ ID NO: 23021

SEQ ID NO: 718239 - RNA, 64 nt, Homo Sapiens; identical to SEQ ID NO: 23022

SEQ ID NO: 718240 - RNA, 64 nt, Homo Sapiens; identical to SEQ ID NO: 23023

SEQ ID NO: 718241 - RNA, 64 nt, Homo Sapiens; identical to SEQ ID NO: 23024

SEQ ID NO: 718242 - RNA, 64 nt, Homo Sapiens; identical to SEQ ID NO: 23025

SEQ ID NO: 718243 - RNA, 64 nt, Homo Sapiens; identical to SEQ ID NO: 23026

SEQ ID NO: 718244 - RNA, 64 nt, Homo Sapiens; identical to SEQ ID NO: 23027

SEQ ID NO: 718245 - RNA, 64 nt, Homo Sapiens; identical to SEQ ID NO: 23028

SEQ ID NO: 718246 - RNA, 64 nt, Homo Sapiens; identical to SEQ ID NO: 23029

SEQ ID NO: 718247 - RNA, 64 nt, Homo Sapiens; identical to SEQ ID NO: 23030

SEQ ID NO: 718248 - RNA, 64 nt, Homo Sapiens; identical to SEQ ID NO: 23031

SEQ ID NO: 718249 - RNA, 64 nt, Homo Sapiens; identical to SEQ ID NO: 23032

SEQ ID NO: 718250 - RNA, 64 nt, Homo Sapiens; identical to SEQ ID NO: 23033

SEQ ID NO: 718251 - RNA, 64 nt, Homo Sapiens; identical to SEQ ID NO: 23034

SEQ ID NO: 718252 - RNA, 64 nt, Homo Sapiens; identical to SEQ ID NO: 23035

SEQ ID NO: 718253 - RNA, 64 nt, Homo Sapiens; identical to SEQ ID NO: 23036

SEQ ID NO: 718254 - RNA, 64 nt, Homo Sapiens; identical to SEQ ID NO: 23037

SEQ ID NO: 718255 - RNA, 64 nt, Homo Sapiens; identical to SEQ ID NO: 23038

SEQ ID NO: 718256 - RNA, 64 nt, Homo Sapiens; identical to SEQ ID NO: 23039

SEQ ID NO: 718257 - RNA, 64 nt, Homo Sapiens; identical to SEQ ID NO: 23040

SEQ ID NO: 718258 - RNA, 64 nt, Homo Sapiens; identical to SEQ ID NO: 23041

SEQ ID NO: 718259 - RNA, 64 nt, Homo Sapiens; identical to SEQ ID NO: 23042

SEQ ID NO: 718260 - RNA, 64 nt, Homo Sapiens; identical to SEQ ID NO: 23043

SEQ ID NO: 718261 - RNA, 64 nt, Homo Sapiens; identical to SEQ ID NO: 23044

SEQ ID NO: 718262 - RNA, 64 nt, Homo Sapiens; identical to SEQ ID NO: 23045

SEQ ID NO: 718263 - RNA, 64 nt, Homo Sapiens; identical to SEQ ID NO: 23046

SEQ ID NO: 718264 - RNA, 64 nt, Homo Sapiens; identical to SEQ ID NO: 23047

SEQ ID NO: 718265 - RNA, 64 nt, Homo Sapiens; identical to SEQ ID NO: 23048

SEQ ID NO: 718266 - RNA, 64 nt, Homo Sapiens; identical to SEQ ID NO: 23049

SEQ ID NO: 718267 - RNA, 64 nt, Homo Sapiens; identical to SEQ ID NO: 23050

SEQ ID NO: 718268 - RNA, 64 nt, Homo Sapiens; identical to SEQ ID NO: 23051

SEQ ID NO: 718269 - RNA, 64 nt, Homo Sapiens; identical to SEQ ID NO: 23052

SEQ ID NO: 718270 - RNA, 64 nt, Homo Sapiens; identical to SEQ ID NO: 23053

SEQ ID NO: 718271 - RNA, 64 nt, Homo Sapiens; identical to SEQ ID NO: 23054

SEQ ID NO: 718272 - RNA, 64 nt, Homo Sapiens; identical to SEQ ID NO: 23055

SEQ ID NO: 718273 - RNA, 64 nt, Homo Sapiens; identical to SEQ ID NO: 23056

SEQ ID NO: 718274 - RNA, 64 nt, Homo Sapiens; identical to SEQ ID NO: 23057

SEQ ID NO: 718275 - RNA, 64 nt, Homo Sapiens; identical to SEQ ID NO: 23058

SEQ ID NO: 718276 - RNA, 64 nt, Homo Sapiens; identical to SEQ ID NO: 23059

SEQ ID NO: 718277 - RNA, 64 nt, Homo Sapiens; identical to SEQ ID NO: 23060

SEQ ID NO: 718278 - RNA, 64 nt, Homo Sapiens; identical to SEQ ID NO: 23061

SEQ ID NO: 718279 - RNA, 64 nt, Homo Sapiens; identical to SEQ ID NO: 23062

SEQ ID NO: 718280 - RNA, 64 nt, Homo Sapiens; identical to SEQ ID NO: 23063

SEQ ID NO: 718281 - RNA, 64 nt, Homo Sapiens; identical to SEQ ID NO: 23064

SEQ ID NO: 718282 - RNA, 64 nt, Homo Sapiens; identical to SEQ ID NO: 23065

SEQ ID NO: 718283 - RNA, 64 nt, Homo Sapiens; identical to SEQ ID NO: 23066

SEQ ID NO: 718284 - RNA, 64 nt, Homo Sapiens; identical to SEQ ID NO: 23067

SEQ ID NO: 718285 - RNA, 64 nt, Homo Sapiens; identical to SEQ ID NO: 23068

SEQ ID NO: 718286 - RNA, 64 nt, Homo Sapiens; identical to SEQ ID NO: 23069

SEQ ID NO: 718287 - RNA, 64 nt, Homo Sapiens; identical to SEQ ID NO: 23070

SEQ ID NO: 718288 - RNA, 64 nt, Homo Sapiens; identical to SEQ ID NO: 23071

SEQ ID NO: 718289 - RNA, 64 nt, Homo Sapiens; identical to SEQ ID NO: 23072

SEQ ID NO: 718290 - RNA, 64 nt, Homo Sapiens; identical to SEQ ID NO: 23073

SEQ ID NO: 718291 - RNA, 64 nt, Homo Sapiens; identical to SEQ ID NO: 23074

SEQ ID NO: 718292 - RNA, 64 nt, Homo Sapiens; identical to SEQ ID NO: 23075

SEQ ID NO: 718293 - RNA, 64 nt, Homo Sapiens; identical to SEQ ID NO: 23076

SEQ ID NO: 718294 - RNA, 64 nt, Homo Sapiens; identical to SEQ ID NO: 23077

SEQ ID NO: 718295 - RNA, 64 nt, Homo Sapiens; identical to SEQ ID NO: 23078

SEQ ID NO: 718296 - RNA, 64 nt, Homo Sapiens; identical to SEQ ID NO: 23079

SEQ ID NO: 718297 - RNA, 64 nt, Homo Sapiens; identical to SEQ ID NO: 23080

SEQ ID NO: 718298 - RNA, 64 nt, Homo Sapiens; identical to SEQ ID NO: 23081

SEQ ID NO: 718299 - RNA, 64 nt, Homo Sapiens; identical to SEQ ID NO: 23082

SEQ ID NO: 718300 - RNA, 64 nt, Homo Sapiens; identical to SEQ ID NO: 23083

SEQ ID NO: 718301 - RNA, 64 nt, Homo Sapiens; identical to SEQ ID NO: 23084

SEQ ID NO: 718302 - RNA, 64 nt, Homo Sapiens; identical to SEQ ID NO: 23085

SEQ ID NO: 718303 - RNA, 64 nt, Homo Sapiens; identical to SEQ ID NO: 23086

SEQ ID NO: 718304 - RNA, 64 nt, Homo Sapiens; identical to SEQ ID NO: 23087

SEQ ID NO: 718305 - RNA, 64 nt, Homo Sapiens; identical to SEQ ID NO: 23088

SEQ ID NO: 718306 - RNA, 64 nt, Homo Sapiens; identical to SEQ ID NO: 23089

SEQ ID NO: 718307 - RNA, 64 nt, Homo Sapiens; identical to SEQ ID NO: 23090

SEQ ID NO: 718308 - RNA, 64 nt, Homo Sapiens; identical to SEQ ID NO: 23091

SEQ ID NO: 718309 - RNA, 64 nt, Homo Sapiens; identical to SEQ ID NO: 23092

SEQ ID NO: 718310 - RNA, 64 nt, Homo Sapiens; identical to SEQ ID NO: 23093

SEQ ID NO: 718311 - RNA, 64 nt, Homo Sapiens; identical to SEQ ID NO: 23094

SEQ ID NO: 718312 - RNA, 64 nt, Homo Sapiens; identical to SEQ ID NO: 23095

SEQ ID NO: 718313 - RNA, 64 nt, Homo Sapiens; identical to SEQ ID NO: 23096

SEQ ID NO: 718314 - RNA, 64 nt, Homo Sapiens; identical to SEQ ID NO: 23097

SEQ ID NO: 718315 - RNA, 64 nt, Homo Sapiens; identical to SEQ ID NO: 23098

SEQ ID NO: 718316 - RNA, 64 nt, Homo Sapiens; identical to SEQ ID NO: 23099

SEQ ID NO: 718317 - RNA, 64 nt, Homo Sapiens; identical to SEQ ID NO: 23100

SEQ ID NO: 718318 - RNA, 64 nt, Homo Sapiens; identical to SEQ ID NO: 23101

SEQ ID NO: 718319 - RNA, 64 nt, Homo Sapiens; identical to SEQ ID NO: 23102

SEQ ID NO: 718320 - RNA, 64 nt, Homo Sapiens; identical to SEQ ID NO: 23103

SEQ ID NO: 718321 - RNA, 64 nt, Homo Sapiens; identical to SEQ ID NO: 23104

SEQ ID NO: 718322 - RNA, 64 nt, Homo Sapiens; identical to SEQ ID NO: 23105

SEQ ID NO: 718323 - RNA, 64 nt, Homo Sapiens; identical to SEQ ID NO: 23106

SEQ ID NO: 718324 - RNA, 64 nt, Homo Sapiens; identical to SEQ ID NO: 23107

SEQ ID NO: 718325 - RNA, 64 nt, Homo Sapiens; identical to SEQ ID NO: 23108

SEQ ID NO: 718326 - RNA, 64 nt, Homo Sapiens; identical to SEQ ID NO: 23109

SEQ ID NO: 718327 - RNA, 64 nt, Homo Sapiens; identical to SEQ ID NO: 23110

SEQ ID NO: 718328 - RNA, 64 nt, Homo Sapiens; identical to SEQ ID NO: 23111

SEQ ID NO: 718329 - RNA, 64 nt, Homo Sapiens; identical to SEQ ID NO: 23112

SEQ ID NO: 718330 - RNA, 64 nt, Homo Sapiens; identical to SEQ ID NO: 23113

SEQ ID NO: 718331 - RNA, 64 nt, Homo Sapiens; identical to SEQ ID NO: 23114

SEQ ID NO: 718332 - RNA, 64 nt, Homo Sapiens; identical to SEQ ID NO: 23115

SEQ ID NO: 718333 - RNA, 64 nt, Homo Sapiens; identical to SEQ ID NO: 23116

SEQ ID NO: 718334 - RNA, 64 nt, Homo Sapiens; identical to SEQ ID NO: 23117

SEQ ID NO: 718335 - RNA, 64 nt, Homo Sapiens; identical to SEQ ID NO: 23118

SEQ ID NO: 718336 - RNA, 64 nt, Homo Sapiens; identical to SEQ ID NO: 23119

SEQ ID NO: 718337 - RNA, 64 nt, Homo Sapiens; identical to SEQ ID NO: 23120

SEQ ID NO: 718338 - RNA, 64 nt, Homo Sapiens; identical to SEQ ID NO: 23121

SEQ ID NO: 718339 - RNA, 64 nt, Homo Sapiens; identical to SEQ ID NO: 23122

SEQ ID NO: 718340 - RNA, 64 nt, Homo Sapiens; identical to SEQ ID NO: 23123

SEQ ID NO: 718341 - RNA, 64 nt, Homo Sapiens; identical to SEQ ID NO: 23124

SEQ ID NO: 718342 - RNA, 64 nt, Homo Sapiens; identical to SEQ ID NO: 23125

SEQ ID NO: 718343 - RNA, 64 nt, Homo Sapiens; identical to SEQ ID NO: 23126

SEQ ID NO: 718344 - RNA, 64 nt, Homo Sapiens; identical to SEQ ID NO: 23127

SEQ ID NO: 718345 - RNA, 64 nt, Homo Sapiens; identical to SEQ ID NO: 23128

SEQ ID NO: 718346 - RNA, 64 nt, Homo Sapiens; identical to SEQ ID NO: 23129

SEQ ID NO: 718347 - RNA, 64 nt, Homo Sapiens; identical to SEQ ID NO: 23130

SEQ ID NO: 718348 - RNA, 64 nt, Homo Sapiens; identical to SEQ ID NO: 23131

SEQ ID NO: 718349 - RNA, 64 nt, Homo Sapiens; identical to SEQ ID NO: 23132

SEQ ID NO: 718350 - RNA, 64 nt, Homo Sapiens; identical to SEQ ID NO: 23133

SEQ ID NO: 718351 - RNA, 64 nt, Homo Sapiens; identical to SEQ ID NO: 23134

SEQ ID NO: 718352 - RNA, 64 nt, Homo Sapiens; identical to SEQ ID NO: 23135

SEQ ID NO: 718353 - RNA, 64 nt, Homo Sapiens; identical to SEQ ID NO: 23136

SEQ ID NO: 718354 - RNA, 64 nt, Homo Sapiens; identical to SEQ ID NO: 23137

SEQ ID NO: 718355 - RNA, 64 nt, Homo Sapiens; identical to SEQ ID NO: 23138

SEQ ID NO: 718356 - RNA, 64 nt, Homo Sapiens; identical to SEQ ID NO: 23139

SEQ ID NO: 718357 - RNA, 64 nt, Homo Sapiens; identical to SEQ ID NO: 23140

SEQ ID NO: 718358 - RNA, 64 nt, Homo Sapiens; identical to SEQ ID NO: 23141

SEQ ID NO: 718359 - RNA, 64 nt, Homo Sapiens; identical to SEQ ID NO: 23142

SEQ ID NO: 718360 - RNA, 64 nt, Homo Sapiens; identical to SEQ ID NO: 23143

SEQ ID NO: 718361 - RNA, 64 nt, Homo Sapiens; identical to SEQ ID NO: 145515

SEQ ID NO: 718362 - RNA, 64 nt, Homo Sapiens; identical to SEQ ID NO: 145516

SEQ ID NO: 718363 - RNA, 64 nt, Homo Sapiens; identical to SEQ ID NO: 145517

SEQ ID NO: 718364 - RNA, 64 nt, Homo Sapiens; identical to SEQ ID NO: 145518

SEQ ID NO: 718365 - RNA, 64 nt, Homo Sapiens; identical to SEQ ID NO: 145519

SEQ ID NO: 718366 - RNA, 64 nt, Homo Sapiens; identical to SEQ ID NO: 145520

SEQ ID NO: 718367 - RNA, 64 nt, Homo Sapiens; identical to SEQ ID NO: 145521

SEQ ID NO: 718368 - RNA, 64 nt, Homo Sapiens; identical to SEQ ID NO: 145522

SEQ ID NO: 718369 - RNA, 64 nt, Homo Sapiens; identical to SEQ ID NO: 145523

SEQ ID NO: 718370 - RNA, 64 nt, Homo Sapiens; identical to SEQ ID NO: 145524

SEQ ID NO: 718371 - RNA, 64 nt, Homo Sapiens; identical to SEQ ID NO: 145525

SEQ ID NO: 718372 - RNA, 64 nt, Homo Sapiens; identical to SEQ ID NO: 145526

SEQ ID NO: 718373 - RNA, 64 nt, Homo Sapiens; identical to SEQ ID NO: 145527

SEQ ID NO: 718374 - RNA, 64 nt, Homo Sapiens; identical to SEQ ID NO: 145528

SEQ ID NO: 718375 - RNA, 64 nt, Homo Sapiens; identical to SEQ ID NO: 145529

SEQ ID NO: 718376 - RNA, 64 nt, Homo Sapiens; identical to SEQ ID NO: 145530

SEQ ID NO: 718377 - RNA, 64 nt, Homo Sapiens; identical to SEQ ID NO: 145531

SEQ ID NO: 718378 - RNA, 64 nt, Homo Sapiens; identical to SEQ ID NO: 145532

SEQ ID NO: 718379 - RNA, 64 nt, Homo Sapiens; identical to SEQ ID NO: 145533

SEQ ID NO: 718380 - RNA, 64 nt, Homo Sapiens; identical to SEQ ID NO: 145534

SEQ ID NO: 718381 - RNA, 64 nt, Homo Sapiens; identical to SEQ ID NO: 145535

SEQ ID NO: 718382 - RNA, 64 nt, Homo Sapiens; identical to SEQ ID NO: 145536

SEQ ID NO: 718383 - RNA, 64 nt, Homo Sapiens
ugacgagcucaccguuggcuacccggucacggaggccggccaccugcagagccucuacacaggu

SEQ ID NO: 718384 - RNA, 64 nt, Homo Sapiens
gagcccgagggccugacagguucccagcagcugggccggccagccuugcacugugggggcuggu

SEQ ID NO: 718385 - RNA, 64 nt, Homo Sapiens
ggucccccacccucaccccggccccccacccgcagccggccacacuggagcagcucccagcaca

SEQ ID NO: 718386 - RNA, 64 nt, Homo Sapiens
cccuguguccucucauccucccgccgcccgucaggccggccagccucacaucagucucuccgcc

SEQ ID NO: 718387 - RNA, 53 nt, Homo Sapiens
cucugagucccuccgcguagucugccggccacaccgcaucuuccggccgucgg

SEQ ID NO: 718388 - RNA, 64 nt, Homo Sapiens
ggaacacuggcuggagacccuccgcaugcaccuggccggccaccugccacugggcccacagcug

SEQ ID NO: 718389 - RNA, 64 nt, Homo Sapiens
gcuaccuucagcacacugacaauaggaagcaggggccggccaucucgccacaaugccaugucgc

SEQ ID NO: 718390 - RNA, 64 nt, Homo Sapiens
aguccucgaugcuucugaacggcgagcacagagggccggccaccagccacuggaauugucacac

SEQ ID NO: 718391 - RNA, 64 nt, Homo Sapiens
cgcgccuccuccucuguccacacagaagccauaugccggccagcgccugaggccaggcccucug

SEQ ID NO: 718392 - RNA, 64 nt, Homo Sapiens
guguccgaggcgcaacgcuaggucccuuugacgggccggccacccuguuucccuccuucugcgu

SEQ ID NO: 718393 - RNA, 64 nt, Homo Sapiens
ucccgucgcuguccucgcccuacauugaguacacgccggccagcccggccuacgcccaguaccc

SEQ ID NO: 718394 - RNA, 64 nt, Homo Sapiens
cccaggcgcacaggggccgccgguaacaggggccgccggccaaaggccccuuuccagucauagc

SEQ ID NO: 718395 - RNA, 64 nt, Homo Sapiens; identical to SEQ ID NO: 145515

SEQ ID NO: 718396 - RNA, 64 nt, Homo Sapiens; identical to SEQ ID NO: 145516

SEQ ID NO: 718397 - RNA, 64 nt, Homo Sapiens; identical to SEQ ID NO: 145517

SEQ ID NO: 718398 - RNA, 64 nt, Homo Sapiens; identical to SEQ ID NO: 145518

SEQ ID NO: 718399 - RNA, 64 nt, Homo Sapiens; identical to SEQ ID NO: 145519

SEQ ID NO: 718400 - RNA, 64 nt, Homo Sapiens; identical to SEQ ID NO: 145520

SEQ ID NO: 718401 - RNA, 64 nt, Homo Sapiens; identical to SEQ ID NO: 145521

SEQ ID NO: 718402 - RNA, 64 nt, Homo Sapiens; identical to SEQ ID NO: 145522

SEQ ID NO: 718403 - RNA, 64 nt, Homo Sapiens; identical to SEQ ID NO: 145523

SEQ ID NO: 718404 - RNA, 64 nt, Homo Sapiens; identical to SEQ ID NO: 145524

SEQ ID NO: 718405 - RNA, 64 nt, Homo Sapiens; identical to SEQ ID NO: 145525

SEQ ID NO: 718406 - RNA, 64 nt, Homo Sapiens; identical to SEQ ID NO: 145526

SEQ ID NO: 718407 - RNA, 64 nt, Homo Sapiens; identical to SEQ ID NO: 145527

SEQ ID NO: 718408 - RNA, 64 nt, Homo Sapiens; identical to SEQ ID NO: 145528

SEQ ID NO: 718409 - RNA, 64 nt, Homo Sapiens; identical to SEQ ID NO: 145529

SEQ ID NO: 718410 - RNA, 64 nt, Homo Sapiens; identical to SEQ ID NO: 145530

SEQ ID NO: 718411 - RNA, 64 nt, Homo Sapiens; identical to SEQ ID NO: 145531

SEQ ID NO: 718412 - RNA, 64 nt, Homo Sapiens; identical to SEQ ID NO: 145532

SEQ ID NO: 718413 - RNA, 64 nt, Homo Sapiens; identical to SEQ ID NO: 145533

SEQ ID NO: 718414 - RNA, 64 nt, Homo Sapiens; identical to SEQ ID NO: 145534

SEQ ID NO: 718415 - RNA, 64 nt, Homo Sapiens; identical to SEQ ID NO: 145535

SEQ ID NO: 718416 - RNA, 64 nt, Homo Sapiens; identical to SEQ ID NO: 145536

SEQ ID NO: 718417 - RNA, 64 nt, Homo Sapiens; identical to SEQ ID NO: 718383

SEQ ID NO: 718418 - RNA, 64 nt, Homo Sapiens; identical to SEQ ID NO: 718384

SEQ ID NO: 718419 - RNA, 64 nt, Homo Sapiens; identical to SEQ ID NO: 718385

SEQ ID NO: 718420 - RNA, 64 nt, Homo Sapiens; identical to SEQ ID NO: 718386

SEQ ID NO: 718421 - RNA, 53 nt, Homo Sapiens; identical to SEQ ID NO: 718387

SEQ ID NO: 718422 - RNA, 64 nt, Homo Sapiens; identical to SEQ ID NO: 718388

SEQ ID NO: 718423 - RNA, 64 nt, Homo Sapiens; identical to SEQ ID NO: 718389

SEQ ID NO: 718424 - RNA, 64 nt, Homo Sapiens; identical to SEQ ID NO: 718390

SEQ ID NO: 718425 - RNA, 64 nt, Homo Sapiens; identical to SEQ ID NO: 718391

SEQ ID NO: 718426 - RNA, 64 nt, Homo Sapiens; identical to SEQ ID NO: 718392

SEQ ID NO: 718427 - RNA, 64 nt, Homo Sapiens; identical to SEQ ID NO: 718393

SEQ ID NO: 718428 - RNA, 64 nt, Homo Sapiens; identical to SEQ ID NO: 718394

SEQ ID NO: 718429 - RNA, 64 nt, Homo Sapiens; identical to SEQ ID NO: 145515

SEQ ID NO: 718430 - RNA, 64 nt, Homo Sapiens; identical to SEQ ID NO: 145516

SEQ ID NO: 718431 - RNA, 64 nt, Homo Sapiens; identical to SEQ ID NO: 145517

SEQ ID NO: 718432 - RNA, 64 nt, Homo Sapiens; identical to SEQ ID NO: 145518

SEQ ID NO: 718433 - RNA, 64 nt, Homo Sapiens; identical to SEQ ID NO: 145519

SEQ ID NO: 718434 - RNA, 64 nt, Homo Sapiens; identical to SEQ ID NO: 145520

SEQ ID NO: 718435 - RNA, 64 nt, Homo Sapiens; identical to SEQ ID NO: 145521

SEQ ID NO: 718436 - RNA, 64 nt, Homo Sapiens; identical to SEQ ID NO: 145522

SEQ ID NO: 718437 - RNA, 64 nt, Homo Sapiens; identical to SEQ ID NO: 145523

SEQ ID NO: 718438 - RNA, 64 nt, Homo Sapiens; identical to SEQ ID NO: 145524

SEQ ID NO: 718439 - RNA, 64 nt, Homo Sapiens; identical to SEQ ID NO: 145525

SEQ ID NO: 718440 - RNA, 64 nt, Homo Sapiens; identical to SEQ ID NO: 145526

SEQ ID NO: 718441 - RNA, 64 nt, Homo Sapiens; identical to SEQ ID NO: 145527

SEQ ID NO: 718442 - RNA, 64 nt, Homo Sapiens; identical to SEQ ID NO: 145528

SEQ ID NO: 718443 - RNA, 64 nt, Homo Sapiens; identical to SEQ ID NO: 145529

SEQ ID NO: 718444 - RNA, 64 nt, Homo Sapiens; identical to SEQ ID NO: 145530

SEQ ID NO: 718445 - RNA, 64 nt, Homo Sapiens; identical to SEQ ID NO: 145531

SEQ ID NO: 718446 - RNA, 64 nt, Homo Sapiens; identical to SEQ ID NO: 145532

SEQ ID NO: 718447 - RNA, 64 nt, Homo Sapiens; identical to SEQ ID NO: 145533

SEQ ID NO: 718448 - RNA, 64 nt, Homo Sapiens; identical to SEQ ID NO: 145534

SEQ ID NO: 718449 - RNA, 64 nt, Homo Sapiens; identical to SEQ ID NO: 145535

SEQ ID NO: 718450 - RNA, 64 nt, Homo Sapiens; identical to SEQ ID NO: 145536

SEQ ID NO: 718451 - RNA, 64 nt, Homo Sapiens; identical to SEQ ID NO: 718383

SEQ ID NO: 718452 - RNA, 64 nt, Homo Sapiens; identical to SEQ ID NO: 718384

SEQ ID NO: 718453 - RNA, 64 nt, Homo Sapiens; identical to SEQ ID NO: 718385

SEQ ID NO: 718454 - RNA, 64 nt, Homo Sapiens; identical to SEQ ID NO: 718386

SEQ ID NO: 718455 - RNA, 53 nt, Homo Sapiens; identical to SEQ ID NO: 718387

SEQ ID NO: 718456 - RNA, 64 nt, Homo Sapiens; identical to SEQ ID NO: 718388

SEQ ID NO: 718457 - RNA, 64 nt, Homo Sapiens; identical to SEQ ID NO: 718389

SEQ ID NO: 718458 - RNA, 64 nt, Homo Sapiens; identical to SEQ ID NO: 718390

SEQ ID NO: 718459 - RNA, 64 nt, Homo Sapiens; identical to SEQ ID NO: 718391

SEQ ID NO: 718460 - RNA, 64 nt, Homo Sapiens; identical to SEQ ID NO: 718392

SEQ ID NO: 718461 - RNA, 64 nt, Homo Sapiens; identical to SEQ ID NO: 718393

SEQ ID NO: 718462 - RNA, 64 nt, Homo Sapiens; identical to SEQ ID NO: 718394

SEQ ID NO: 718463 - RNA, 64 nt, Homo Sapiens
aauaacccuuuugguaaccguauugacugcagagucuauuuaagcaugugguuuuaaaaauaga

SEQ ID NO: 718464 - RNA, 64 nt, Homo Sapiens
gcguuucaguuacauuugcauuuaagacaaguguucuauuuauuucuuguauuguuuggaagaa

SEQ ID NO: 718465 - RNA, 64 nt, Homo Sapiens
uauuauaguacauauaccauguaaacucucaaacucuauuuagcugugaaauaguggugugcaa

SEQ ID NO: 718466 - RNA, 64 nt, Homo Sapiens
aaucagacuaaaaggugguaucucuucuuaguguucuauuuaucuuauuugcuaaugggagcac

SEQ ID NO: 718467 - RNA, 64 nt, Homo Sapiens
cuaagcccuuaggccucugagagugcuguuggguucuauuuauuuauuuauuuguuccuuuguu

SEQ ID NO: 718468 - RNA, 64 nt, Homo Sapiens
cgggaugggaggcacguggccucucuuuuauccgucuauuuauuuuguaaguguauucgugugg

SEQ ID NO: 718469 - RNA, 64 nt, Homo Sapiens
agucuacagagaagauucuuguauuuauuacaacucuauuuaauuaaugucaguauuucaacug

SEQ ID NO: 718470 - RNA, 64 nt, Homo Sapiens
ucuauuuaauuaaugucaguauuucaacugaaguucuauuuauuugugagacuguaaguuacau

SEQ ID NO: 718471 - RNA, 64 nt, Homo Sapiens
uacaauacauaggguuacucacaaggcugaagguucuauuuauuguuacuuaccaaacuuuuug

SEQ ID NO: 718472 - RNA, 64 nt, Homo Sapiens
uaccauacauaggguuacuuacuuuucugaagguucuauuuauuacuuugcaccaggucgacaa

SEQ ID NO: 718473 - RNA, 64 nt, Homo Sapiens
aacucauucguuuaaugaacuugacugucauaccucuauuuaguaauugcgaggguaagauuca

SEQ ID NO: 718474 - RNA, 64 nt, Homo Sapiens
aaagcaacuaagagaaagaaaaacauuguagauaucuauuuauauuuaaaguuuauguuucaug

SEQ ID NO: 718475 - RNA, 64 nt, Homo Sapiens
gggaaaauuuuccaagguuagauuccaauaaauaucuauuuauuauuaaauauuaaaauaucua

SEQ ID NO: 718476 - RNA, 64 nt, Homo Sapiens
aauaaauaucuauuuauuauuaaauauuaaaauaucuauuuauuauuaaaaccauuuauaaggc

SEQ ID NO: 718477 - RNA, 64 nt, Homo Sapiens
uacacauuuggaaauuauccauuuguaauuuuuuucuauuuaaggacacuuuauugcacaugaa

SEQ ID NO: 718478 - RNA, 64 nt, Homo Sapiens
aaaauguuacguguuucuauuuuuagaccuuuucucuauuuacauuuucauuuuaauguuaucc

SEQ ID NO: 718479 - RNA, 64 nt, Homo Sapiens
gcuucugucccuuccuucccggugugcaugugggucuauuuagaguggcugcauuauguccugg

SEQ ID NO: 718480 - RNA, 64 nt, Homo Sapiens
caagaggaugcuggggaauucagccauucuuuuaucuauuuaaccuuucacagacaugguaugg

SEQ ID NO: 718481 - RNA, 64 nt, Homo Sapiens
aguagaccuguagaagagcuaacagaauuauauuucuauuuaguuaaaauuguuaaugaaaaac

SEQ ID NO: 718482 - RNA, 64 nt, Homo Sapiens
cuggggcagguuccaggaacuugaacuaaaaauaucuauuuaagccucucucucuuucucuccu

SEQ ID NO: 718483 - RNA, 64 nt, Homo Sapiens
caaauggaauggaggcugugagcaaugugaggauucuauuuauuuauuuacguuugauaaaacu

SEQ ID NO: 718484 - RNA, 64 nt, Homo Sapiens
uaacuucugcagaguuugccccagaauucagaguucuauuuagaggaaguuaaaacaacaacaa

SEQ ID NO: 718485 - RNA, 64 nt, Homo Sapiens
cuauuaaauuuuuucucugauugagacaauucaaucuauuuaauaugguggaaaaccuuaaaaa

SEQ ID NO: 718486 - RNA, 64 nt, Homo Sapiens
uaccuacuacauacugcucuauucuuuccaguauucuauuuaagcacaauuaaaauuaggcuac

SEQ ID NO: 718487 - RNA, 64 nt, Homo Sapiens
aggggaacauuucauuuguguuauuucuuaaacuucuauuuaggaaauuacauuaaguauuaau

SEQ ID NO: 718488 - RNA, 64 nt, Homo Sapiens
agagagcaggguuuucucagauuccuuuuuaaucucuauuuaucugguuguuucugacaggaug

SEQ ID NO: 718489 - RNA, 64 nt, Homo Sapiens
guuaauuucuuucauaaagcaauuuaggaaauguucuauuuaaauuauguugaauaaauuuuaa

SEQ ID NO: 718490 - RNA, 64 nt, Homo Sapiens
ucauccauaugggucaaucaaagacauugccaucucuauuuaacaucuucuuuaaaggaaggau

SEQ ID NO: 718491 - RNA, 64 nt, Homo Sapiens
gugugggaggacagaguuagaggaaucuuccuuuucuauuuaugaagauucuacucuugguaag

SEQ ID NO: 718492 - RNA, 64 nt, Homo Sapiens
ucucucaauuuagcauuugcuuuugguuuuuuucucuauuuagcauucuguuaaggcacaaaaa

SEQ ID NO: 718493 - RNA, 64 nt, Homo Sapiens
cuuuauagagaaaccagacauaagguauuuaaaaucuauuuauggacauucugggucacagaua

SEQ ID NO: 718494 - RNA, 64 nt, Homo Sapiens
acucuuuucucucaagaaaaucccugauauuauuucuauuuaauuugggaccaggcuuuuauuu

SEQ ID NO: 718495 - RNA, 64 nt, Homo Sapiens
auuauuuugcaaaauaaccaugucacagcucugcucuauuuauuuacuuugguugacccuugua

SEQ ID NO: 718496 - RNA, 64 nt, Homo Sapiens
caaaccaccuuuuauguuuuuauuugaaucagauucuauuuaguuuucuuauuuagggggaaau

SEQ ID NO: 718497 - RNA, 64 nt, Homo Sapiens
agucagaguuucagcuuucuauucuuaauuuggaucuauuuauuaaaaaaaaacuguuguagaa

SEQ ID NO: 718498 - RNA, 64 nt, Homo Sapiens
aucgcauacagauauucuaauauuacauaacugaucuauuuauugcauauucaacacacugccu

SEQ ID NO: 718499 - RNA, 64 nt, Homo Sapiens
gcuuccagggauuuuuuuuugauaaggaaacacuucuauuuaaugggaguauuugguauguugg

SEQ ID NO: 718500 - RNA, 64 nt, Homo Sapiens
aacugggucaugugcaucugcaccuucaaaauguucuauuuaacccuggguuaggguguguguu

SEQ ID NO: 718501 - RNA, 64 nt, Homo Sapiens
uguacuaauuaacauauaauuuguaaauacaaguucuauuuaaguuaaccgcaucagaagccua

SEQ ID NO: 718502 - RNA, 64 nt, Homo Sapiens
ggacauguccaugaccagaacagugguucuacaaucuauuuauuuaaaugaaguuuauacagua

SEQ ID NO: 718503 - RNA, 64 nt, Homo Sapiens
cugaaagaacuauuccaugaagaagucagcaaguucuauuuaugucaauuugccuucaacaaag

SEQ ID NO: 718504 - RNA, 64 nt, Homo Sapiens
guuuaucaaucuaucaauguuuccucucuagcaaucuauuuacucaauuaucuacccaccuguc

SEQ ID NO: 718505 - RNA, 64 nt, Homo Sapiens
ucacucccauguuggguuugagacagacaccuuuucuauuuaccuccuaauggcauggagacuc

SEQ ID NO: 718506 - RNA, 64 nt, Homo Sapiens
cccugcccucaggcuccccagugcuccuggcccuucuauuuauuugacugauuauugcuucuuu

SEQ ID NO: 718507 - RNA, 52 nt, Homo Sapiens
ggcgcaugagaccauauuaaauucuauuuacuauuuguugaauuuauuuuuc

SEQ ID NO: 718508 - RNA, 64 nt, Homo Sapiens
agccuuuaaauucuaaacaaauuauaaugcaucaucuauuuaggaguuagauuuggaugugcua

SEQ ID NO: 718509 - RNA, 64 nt, Homo Sapiens
uuuuagauuauuuuuauuacuaauauauuuaauuucuauuuaaacuaauauuuucacaguuuau

SEQ ID NO: 718510 - RNA, 64 nt, Homo Sapiens
aaucacccacaaacuuguuccacaccauauggauucuauuuauagagcaauaauaauuaauuca

SEQ ID NO: 718511 - RNA, 64 nt, Homo Sapiens
aacauuaugacacuuuaaaacaguagcaaagaagucuauuuauuaacccacaaauguagcauca

SEQ ID NO: 718512 - RNA, 64 nt, Homo Sapiens
aaacaagugaauaggaaaauaauuaauauauuauucuauuuagcuuguaaaacacauggaaucu

SEQ ID NO: 718513 - RNA, 64 nt, Homo Sapiens
aauccuuuaauuaguuuauggcuucaucuccuuaucuauuuaaaaaacauaguaaauaauguuu

SEQ ID NO: 718514 - RNA, 64 nt, Homo Sapiens
ugccacugucaaucccagcauuuucuaaaaggucucuauuuaaauuauuuuucuacuuucccac

SEQ ID NO: 718515 - RNA, 64 nt, Homo Sapiens
uauuuauuauuuauuuuucuaucauuuacaggucucuauuuaugcuccaccaaguucacuguuc

SEQ ID NO: 718516 - RNA, 64 nt, Homo Sapiens
cugagccaagcccuccccaucccauguauuuaucucuauuuaauauuuaugucuauuuaagccu

SEQ ID NO: 718517 - RNA, 64 nt, Homo Sapiens
caucccauguauuuaucucuauuuaauauuuaugucuauuuaagccucauauuuaaagacaggg

SEQ ID NO: 718518 - RNA, 64 nt, Homo Sapiens
cagcaaaaucucauuucauaagacuuacaauaacucuauuuaaaauucagguauuguacucggg

SEQ ID NO: 718519 - RNA, 64 nt, Homo Sapiens
cuuaccuuucuaaacuccuuuagaguuaacgacuucuauuuaguauuguugguaucuccagccc

SEQ ID NO: 718520 - RNA, 64 nt, Homo Sapiens
cucuuggccucacccagggauaucuauuuauuauucuauuuaauuauuuguguauuuauuuauu

SEQ ID NO: 718521 - RNA, 64 nt, Homo Sapiens
auucuauuuaaucucuuggcuauuuauuuauuuaucuauuuauucuuccaguuauuuauuugug

SEQ ID NO: 718522 - RNA, 64 nt, Homo Sapiens
uuauuuaaaauaaaucuuccuaucaucuaggacuucuauuuaagccucuuaaauuccuaaacaa

SEQ ID NO: 718523 - RNA, 64 nt, Homo Sapiens
gcuuuucuguuuugggcaagguauauacuaaaguucuauuuagaaacucuaccgagugguuuuu

SEQ ID NO: 718524 - RNA, 64 nt, Homo Sapiens
aguuguucaaaucacugcagucuuuauuauggcaucuauuuagguaaaugcaauauaugucuug

SEQ ID NO: 718525 - RNA, 64 nt, Homo Sapiens
ugcauaaggucuuuggccuucauguugccauacaucuauuuaaguaaaccugucucuauuacag

SEQ ID NO: 718526 - RNA, 64 nt, Homo Sapiens
uuuguuuauuucuuugguuuguuaacuagugucaucuauuuagagaaacauuuuuguuuuuaau

SEQ ID NO: 718527 - RNA, 64 nt, Homo Sapiens
uguuuuagggaucaauuaccuaacuguuccuuggucuauuuauguauaagaaugcuuuuuaaag

SEQ ID NO: 718528 - RNA, 64 nt, Homo Sapiens
uaagccauccuguuagcuuuuaaaggaaguuaauuuaauuaacauuaauauacucuaugggcuc

SEQ ID NO: 718529 - RNA, 64 nt, Homo Sapiens
aagaccccaucuccauuuuuuuuuuaaugauuuuuuaauuaaaaaaaagaacaacaggauagag

SEQ ID NO: 718530 - RNA, 64 nt, Homo Sapiens
ggaaaacuuaggacuuauuggguuauuauuauuuuuaauuaaagcugguuuaauuaaaaagaaa

SEQ ID NO: 718531 - RNA, 64 nt, Homo Sapiens
uauuggguuauuauuauuuuuaauuaaagcugguuuaauuaaaaagaaagaaacuuuuuucugg

SEQ ID NO: 718532 - RNA, 64 nt, Homo Sapiens
acugacauauacagaaaaaggagcaguuuuaguuuuaauuaauuaaaauuaacagaugugauga

SEQ ID NO: 718533 - RNA, 64 nt, Homo Sapiens
acauauacagaaaaaggagcaguuuuaguuuuaauuaauuaaaauuaacagaugugaugaggau

SEQ ID NO: 718534 - RNA, 64 nt, Homo Sapiens
ggcuggguaacagagugagauccugucucaaaaauuaauuaauuaauuaauuaaaauaaacuag

SEQ ID NO: 718535 - RNA, 64 nt, Homo Sapiens
ggguaacagagugagauccugucucaaaaauuaauuaauuaauuaauuaaaauaaacuagguaa

SEQ ID NO: 718536 - RNA, 64 nt, Homo Sapiens
aacagagugagauccugucucaaaaauuaauuaauuaauuaauuaaaauaaacuagguaaacuu

SEQ ID NO: 718537 - RNA, 64 nt, Homo Sapiens
gagugagauccugucucaaaaauuaauuaauuaauuaauuaaaauaaacuagguaaacuuggau

SEQ ID NO: 718538 - RNA, 64 nt, Homo Sapiens
uagaaguaggaagugaaaauagguauacaguggauuaauuaaaugcagcgaaccaauauuugua

SEQ ID NO: 718539 - RNA, 64 nt, Homo Sapiens
auuagcauuuaguccaaugucuuuuuaagcuuauuuaauuaaaaaauuuccagugagcuuauca

SEQ ID NO: 718540 - RNA, 64 nt, Homo Sapiens
ucacaaauuugauaaauuaagucaaauauuuuuguuaauuaagcuaucuguuuuucuggugagg

SEQ ID NO: 718541 - RNA, 64 nt, Homo Sapiens
uucgauuccaugagcuucuuacccuaucuuuucuuuaauuaacaucuuucccccaguuguacuu

SEQ ID NO: 718542 - RNA, 64 nt, Homo Sapiens
ucuuugaaaagggaaaaguagugucuuauuuauauuaauuaaugauagagaauaucaucugaua

SEQ ID NO: 718543 - RNA, 64 nt, Homo Sapiens
aauggaauuuauauacaaaaaacuuuaauuuuacuuaauuaagauuuuaacugacucuuaauga

SEQ ID NO: 718544 - RNA, 64 nt, Homo Sapiens
acguauguuccauguuuauuuauuaacuccacaguuaauuaaggaucaggacaaagagacagac

SEQ ID NO: 718545 - RNA, 64 nt, Homo Sapiens
uaucuucagcuuguagucaguuccugcccuguuauuaauuaagacuucuuuccccacucaauuc

SEQ ID NO: 718546 - RNA, 64 nt, Homo Sapiens
acauuugcaggaaauucagacuugaugauucuuauuaauuaaucucaauuucuuauuaauuaau

SEQ ID NO: 718547 - RNA, 64 nt, Homo Sapiens
uugaugauucuuauuaauuacuaucaauuucuuauuaauuaaucugggccuguuacucauccug

SEQ ID NO: 718548 - RNA, 64 nt, Homo Sapiens
caauguuauguuuuuuagagcuguuuuccuuaguuuaauuaauaaccaauuauaagugagaaua

SEQ ID NO: 718549 - RNA, 64 nt, Homo Sapiens
ggaaccacuacuuauauacauaacuuaacauuguuuaauuaaauuaugaaauuugugccuaauu

SEQ ID NO: 718550 - RNA, 64 nt, Homo Sapiens
augcuacuuuugauuucauuuaacucaaugaaauuuaauuaaaccacuaagaaaagagcaguug

SEQ ID NO: 718551 - RNA, 64 nt, Homo Sapiens
agaggaccuauaugaaugguuuuaugucauuuuuuuaauuaaaaaagaaaaauucauauaaucg

SEQ ID NO: 718552 - RNA, 64 nt, Homo Sapiens
uacaaaaaaaaaacacaugguuaaauguuaaauuuuaauuaaggcccccaaaaauuaaauauaa

SEQ ID NO: 718553 - RNA, 64 nt, Homo Sapiens
uuacagcugaaaauuuugagaagguaaaaguuucuuaauuaaaauaugaacauauuuagcuugc

SEQ ID NO: 718554 - RNA, 64 nt, Homo Sapiens
uucaacuauagguuagucagaaugcuguuuuucguuaauuaacuuagccuguguugauaucucc

SEQ ID NO: 718555 - RNA, 64 nt, Homo Sapiens
uugauuuuuucuucagaauaugguauacuuaaaauuaauuaauuaagacaguuucuuuuuucuu

SEQ ID NO: 718556 - RNA, 64 nt, Homo Sapiens
uuuuuucuucagaauaugguauacuuaaaauuaauuaauuaagacaguuucuuuuuucuuuucu

SEQ ID NO: 718557 - RNA, 64 nt, Homo Sapiens
uauuuuaauaugguuuucaguuauguuuguggauuuaauuaaagaucauaaaugugcuacacau

SEQ ID NO: 718558 - RNA, 64 nt, Homo Sapiens
auugugcucagcagcuguuuaugcuuuggaugaguuaauuaaggugacuuaucagcaauggaag

SEQ ID NO: 718559 - RNA, 64 nt, Homo Sapiens
caugggauuaacuugagggucacuauugagccuauuaauuaauuauuguuuuaauaaaacaaac

SEQ ID NO: 718560 - RNA, 64 nt, Homo Sapiens
augguaauaugccugucuuuaaaguguuauuuuauuaauuaaaaggauauggcuauuauuauau

SEQ ID NO: 718561 - RNA, 64 nt, Homo Sapiens
ugaucugcuguaaaagaugaagauuuaagugaccuuaauuaaccuguccugugcccuacccuua

SEQ ID NO: 718562 - RNA, 64 nt, Homo Sapiens
ugaaauaaguucuuugacagagcauauugcuugguuaauuaaguaaccuaaaguaugcauuagg

SEQ ID NO: 718563 - RNA, 64 nt, Homo Sapiens
aaagugucaugccuugaccaaucuaaugaauugauuaauuaacugggccuuuauacuuaacuaa

SEQ ID NO: 718564 - RNA, 64 nt, Homo Sapiens
uucacugcagaaaauugauuaaguggcuguccuuuuaauuaagaguguggagucauaaacuuaa

SEQ ID NO: 718565 - RNA, 64 nt, Homo Sapiens
ucauguugcuugucgcuuucaauuaauggcuucguuaauuaauggagggggagggugaugcauu

SEQ ID NO: 718566 - RNA, 64 nt, Homo Sapiens
gcuucguuaauuaaugucaugggagggugaugcauuaauuaaugucagauggacugggaggagg

SEQ ID NO: 718567 - RNA, 64 nt, Homo Sapiens
cacauagaucugcuuuguguaguacguaaauaaauuaauuaaaaggaugccaguuaauuaaaug

SEQ ID NO: 718568 - RNA, 64 nt, Homo Sapiens
gaguacguaaauaaauuaauuauguggaugccaguuaauuaaauuacauucacucuguuucacg

SEQ ID NO: 718569 - RNA, 64 nt, Homo Sapiens
aaaauuaaugaagacagaggcuagaaagcauccauuaauuaaugagacacacuuaacuacuuau

SEQ ID NO: 718570 - RNA, 64 nt, Homo Sapiens
uuuaguuuguuuuuguuugguauaaauuaauuuguuaauuaaauauuucuuaaguauaaaccuu

SEQ ID NO: 718571 - RNA, 64 nt, Homo Sapiens
ucugcauugagcauauuuucuuacuuuuauuauuuuaauuaauaugacauaagcaaucauuuua

SEQ ID NO: 718572 - RNA, 64 nt, Homo Sapiens
aaugcuuagugaagcauaaaguuaccuacaucaauuaauuaaaugaacuuauguacagaaaaca

SEQ ID NO: 718573 - RNA, 64 nt, Homo Sapiens
gaauaaaaggccucuagaaauugcugaacaaugguuaauuaagauauugcuaacacaaucgagu

SEQ ID NO: 718574 - RNA, 64 nt, Homo Sapiens
acaauacauagcugcaauguguacaauggcugauuuaauuaaauaaaauguacaaguguuaaau

SEQ ID NO: 718575 - RNA, 64 nt, Homo Sapiens
uauuuuuuugagacagagucuuucuaauuuuuaauuaauuaauuucuccauuuuacuuauggcu

SEQ ID NO: 718576 - RNA, 64 nt, Homo Sapiens
aauuuauuuuuuugagacagggcuuuucuaauuuuuaauuaauuaaacucuccauuuuacuuau

SEQ ID NO: 718577 - RNA, 64 nt, Homo Sapiens
aucauaugcuuuuuuuaaugccuuuauccuuaauuuaauuaauuauuuuuagauucaaacaauc

SEQ ID NO: 718578 - RNA, 64 nt, Homo Sapiens
uuucauuaugauggaaggagaaauuaguuuacaauuaauuaagauaaugauuguuaacuuuuug

SEQ ID NO: 718579 - RNA, 64 nt, Homo Sapiens
gccauguguuaaauaaagucuaauuaaauuaaguuuaauuaaauuaguagagauaaauuuuugu

SEQ ID NO: 718580 - RNA, 64 nt, Homo Sapiens
uaaguuuaauuaaaugccaugagauaaauuuuuguuaauuaaaucauccugaagggcuguagua

SEQ ID NO: 718581 - RNA, 64 nt, Homo Sapiens
uuuuagauacuuaacauuuauuuaccaaauauuguuaauuaaaaaaugauaagaauaaauuuaa

SEQ ID NO: 718582 - RNA, 64 nt, Homo Sapiens
uaucuacuuauauguuacuuuuuuagaccuaaaauuaauuaacauauuauaucugggaccucuc

SEQ ID NO: 718583 - RNA, 64 nt, Homo Sapiens
aucugggauuauucuuugaaaaaauuugcuuuaauuaauuaaguaagcucacugcugaucguag

SEQ ID NO: 718584 - RNA, 64 nt, Homo Sapiens
aaguaucugggauuauucuuguagaaaauuugcuuuaauuaauuuaaaaagcucacugcugauc

SEQ ID NO: 718585 - RNA, 64 nt, Homo Sapiens
aaucuauauggaacaaacaugaaacaaauacauuuuaauuaaacacaaucuguaacagaaucaa

SEQ ID NO: 718586 - RNA, 64 nt, Homo Sapiens
aaucuguaacagaaucaagaucaagaaacaaauuuuaauuaaacucuccauguauauaacagaa

SEQ ID NO: 718587 - RNA, 64 nt, Homo Sapiens
cucacuguuuguucagucugcgagaauuuuuuuuuuaauuaauuuucuauguuuuuaagcuaca

SEQ ID NO: 718588 - RNA, 64 nt, Homo Sapiens
uagaugauaauucucagguaccugauaccuuugcuuaauuaaacgaaugagcugaaacagaccu

SEQ ID NO: 718589 - RNA, 64 nt, Homo Sapiens
ggcgacagagcaagacuccaucucaaaaaaaaaguuaauuaauuaauuagauuaaaguacaaca

SEQ ID NO: 718590 - RNA, 64 nt, Homo Sapiens
acagagcaagacuccaucucaaaaaaaaaguuaauuaauuaauuagauuaaaguacaacaauua

SEQ ID NO: 718591 - RNA, 64 nt, Homo Sapiens
caaauacugugaacuaucucaaucaguugauuaauuaauuaacuuuguauuuaccaaagauuua

SEQ ID NO: 718592 - RNA, 64 nt, Homo Sapiens
aacucaaauacugugaacuauuuaaaucaguugauuaauuaauuauacuuguauuuaccaaaga

SEQ ID NO: 718593 - RNA, 64 nt, Homo Sapiens
aaauaucuguauuuaauuuuuauauguuuaccuuuuaauuaaugauauauuuuuaagauaauaa

SEQ ID NO: 718594 - RNA, 64 nt, Homo Sapiens
augaauguguaacacagugcagauuucaagagauuuaauuaaucagguccaagauaccuaaaag

SEQ ID NO: 718595 - RNA, 64 nt, Homo Sapiens
uauuugucaacagauuuaaagaaaaccacaguuauuaauuaaagaaaauuaauuauguguaguu

SEQ ID NO: 718596 - RNA, 64 nt, Homo Sapiens
aaagaacuguauaagguggucauaagugaauauuuuaauuaaaauugguaaaaauaaauaauaa

SEQ ID NO: 718597 - RNA, 64 nt, Homo Sapiens
gcuuuaucuuuuuuuauacccuucucucucgugcuuaauuaauacagggaaaauauccauuuau

SEQ ID NO: 718598 - RNA, 64 nt, Homo Sapiens
aaaaagaaaaaacucuguugacaucuuacuggguuuaauuaaaaacugccucauugucuucugu

SEQ ID NO: 718599 - RNA, 64 nt, Homo Sapiens
auauugaugauccuacuaauuauccugcuguucuuuaauuaaugcuuaaugaauaauauggcac

SEQ ID NO: 718600 - RNA, 64 nt, Homo Sapiens
gaaucauuacauuuauaauaacaaaggccacaauuuaauuaauugguaagauauaaugcaaaaa

SEQ ID NO: 718601 - RNA, 64 nt, Homo Sapiens
auauguuuucaguacaauuuugaacagcaacuuuuuaauuaaacaucuuccaguguuaggaagu

SEQ ID NO: 718602 - RNA, 64 nt, Homo Sapiens
uuguuuguuuguuuaauguaucccuguucuguuuuuaauuaaacuccaagucucauuuuacaua

SEQ ID NO: 718603 - RNA, 64 nt, Homo Sapiens
aaauguuacaaaauucucagacauggugccacuuuuaauuaacuaguuuuuuuuuuuuuuuuaa

SEQ ID NO: 718604 - RNA, 64 nt, Homo Sapiens
uuugaguuuguuuaagguauugaauuuauuugaauuaauuaacaucauuaacuucauaacagca

SEQ ID NO: 718605 - RNA, 64 nt, Homo Sapiens
uauuucuugucugugaauuuauuuuacacaauauuuaauuaaaguuaacuguauaaaaauguuc

SEQ ID NO: 718606 - RNA, 64 nt, Homo Sapiens
uguuugccacauuaacuuuuuuacuucugauguuuuaauuaaaaccuaaaguuuaaaauaaaau

SEQ ID NO: 718607 - RNA, 64 nt, Homo Sapiens
ugcacauauuuuuaaaaguugagcauuuauuuuguuaauuaaaucuuuuauuccgaagaacucg

SEQ ID NO: 718608 - RNA, 64 nt, Homo Sapiens
ucuuuuucucuuccguacaaagaauguuauauuuuuaauuaauuugcacuugauagggacucaa

SEQ ID NO: 718609 - RNA, 64 nt, Homo Sapiens
cauuuauuuacaugugauugugauucaucaucccuuaauuaaauaucaaauuauauuuguguga

SEQ ID NO: 718610 - RNA, 64 nt, Homo Sapiens
cagcaugauguguuguguauaauuggaguagauauuaauuaagucaccuguauaauguuuugua

SEQ ID NO: 718611 - RNA, 64 nt, Homo Sapiens
uuaacucugguuucuaccagugccuuaaauuuguuuaauuaaauuaaauuauguuuuaaacaca

SEQ ID NO: 718612 - RNA, 64 nt, Homo Sapiens
cucaaauuuauuuuaauguauuaauuaaauguauuuaauuaaaugagccauucacacuuuuuau

SEQ ID NO: 718613 - RNA, 64 nt, Homo Sapiens
guauuuaauuaaaucucaaauucacacuuuuuauuuaauuaaauucauaaacgauucugagcca

SEQ ID NO: 718614 - RNA, 64 nt, Homo Sapiens
uugaguuuuuaugaugguuauuaaagacuaucaguuaauuaagacugauuacucuuuuuuuaag

SEQ ID NO: 718615 - RNA, 64 nt, Homo Sapiens
uucuguuguuguuuuggggacuuuuaaaauucauuuaauuaauauucuacuuucauuucuuaag

SEQ ID NO: 718616 - RNA, 63 nt, Homo Sapiens
auauuugggcuuuuuuuuuuuacauuuaauuaauuuaauuaagaugaaacccuaugguguuug

SEQ ID NO: 718617 - RNA, 64 nt, Homo Sapiens
uaauuaagauauuugggcuuugguguuuguacauuuaauuaauuuuauucaguaugaaacccua

SEQ ID NO: 718618 - RNA, 64 nt, Homo Sapiens
agcuuucuuacccagcauagugggagaguggagauuaauuaaaauuguuaauuaagaguuaauu

SEQ ID NO: 718619 - RNA, 64 nt, Homo Sapiens
agcauagugggagaguggagauuaauuaaaauuguuaauuaagaguuaauuccuauugacccag

SEQ ID NO: 718620 - RNA, 64 nt, Homo Sapiens
uuaauggauuuaauggaauuguaauuuuaaacauuuaauuaaauguaauuugggggauauuuug

SEQ ID NO: 718621 - RNA, 64 nt, Homo Sapiens
uauaaaaauguuaauucagaauuaguuuaaugccuuaauuaaacuaauuaauagcuuuggacac

SEQ ID NO: 718622 - RNA, 64 nt, Homo Sapiens
uuuuucauaauugagacagacuuucaggauuauuuuaauuaauuuggggggagaaaaaggaugu

SEQ ID NO: 718623 - RNA, 64 nt, Homo Sapiens
caaaacauguuaaacguuaccagauuaaauuuaauuaauuaauuaauuacauuguauagcccca

SEQ ID NO: 718624 - RNA, 64 nt, Homo Sapiens
aauucaaaacauguuaaacgcccacagauuaaauuuaauuaauuuaagaauuacauuguauagc

SEQ ID NO: 718625 - RNA, 64 nt, Homo Sapiens
cagaaacauuugaaauagaauuugcaugucugccuuaauuaacuuaaagacugauuuuaaucug

SEQ ID NO: 718626 - RNA, 64 nt, Homo Sapiens
aaauuacucauaauuuauaaugcuuaauauaaucuuaauuaaauuuagcaguuuuaguauaaga

SEQ ID NO: 718627 - RNA, 64 nt, Homo Sapiens
uaaaaugcucaauuauauauuuuuguugaguuuuuuaauuaaagacuuguaaaaaaaaaaaaca

SEQ ID NO: 718628 - RNA, 64 nt, Homo Sapiens
aaacaugcaauuuaugaaaagguucucuucaggauuaauuaaaucccauuggaauguauuucua

SEQ ID NO: 718629 - RNA, 64 nt, Homo Sapiens
aaaauauauaaaucucauuuucaaaacaaguguguuaauuaauagccuggcacauaguauguau

SEQ ID NO: 718630 - RNA, 64 nt, Homo Sapiens
cuccagccugcgugacagagagccugucucuaaauuaauuaauuaauuaauuuaauucaauuuu

SEQ ID NO: 718631 - RNA, 64 nt, Homo Sapiens
agccugcgugacagagagccugucucuaaauuaauuaauuaauuaauuuaauucaauuuuaaaa

SEQ ID NO: 718632 - RNA, 64 nt, Homo Sapiens
ugcgugacagagagccugucucuaaauuaauuaauuaauuaauuuaauucaauuuuaaaaagac

SEQ ID NO: 718633 - RNA, 64 nt, Homo Sapiens
aagccccuuuuuaaacccuaauccuuguauuuaauuaauuaaaccccccgcccugccuggccuc

SEQ ID NO: 718634 - RNA, 64 nt, Homo Sapiens
aaacaagccccuuuuuaaacccucauccuuguauuuaauuaauucccucccccgcccugccugg

SEQ ID NO: 718635 - RNA, 64 nt, Homo Sapiens
gaaauacauauuuuuauuugacuauguuuggaguuuaauuaauuauauauuuauacauuauuuu

SEQ ID NO: 718636 - RNA, 64 nt, Homo Sapiens
accuuauucuacaucauuaaccaguaaggacuuuuuaauuaaccacaauaccacuaucacaccu

SEQ ID NO: 718637 - RNA, 64 nt, Homo Sapiens
aguacgagcugcucuaagaagggaacccccaaauuuaauuaaagccuuaagcacaauuaauuaa

SEQ ID NO: 718638 - RNA, 64 nt, Homo Sapiens
gaacccccaaauuuaauuaaagccuuaagcacaauuaauuaaaagugaaacguaauuguacaag

SEQ ID NO: 718639 - RNA, 64 nt, Homo Sapiens
gaacugguuuuagcauuuacaaacuaaauuccaguuaauuaauuaauagcuuuauauugccuuu

SEQ ID NO: 718640 - RNA, 64 nt, Homo Sapiens
ugguuuuagcauuuacaaacuaaauuccaguuaauuaauuaauagcuuuauauugccuuuccug

SEQ ID NO: 718641 - RNA, 64 nt, Homo Sapiens
ucaaacacggcuucucaugcuuauuaauaauuaauuaauuaacauggagaguggguuuugucca

SEQ ID NO: 718642 - RNA, 64 nt, Homo Sapiens
aacaucaaacacggcuucucuccauuauuaauaauuaauuaauucuuuuggagaguggguuuug

SEQ ID NO: 718643 - RNA, 63 nt, Homo Sapiens
ugcauuaacccagaaauaccucgcuucuaucugugcacuuagcugggaacuuacccacuguaa

SEQ ID NO: 718644 - RNA, 63 nt, Homo Sapiens
cguccuggcuccaguuggaacacuuuccugagaugcacuuacuucucagcuucugcgaucaga

SEQ ID NO: 718645 - RNA, 63 nt, Homo Sapiens
aagggcccaaaugcauaaguuucuuugcacuguugcacuuacuuaauacaaauaaauguuuuu

SEQ ID NO: 718646 - RNA, 63 nt, Homo Sapiens
cuacuguucaguuuuuuaaaaguuuugaaaugcugcacuuacauuuaaaaaaacaacaacaac

SEQ ID NO: 718647 - RNA, 63 nt, Homo Sapiens
caccauuucccccugcucccccacagccgguucugcacuuaucaccgagucgccccuggaagc

SEQ ID NO: 718648 - RNA, 63 nt, Homo Sapiens
ugaccaagaaauuggguuucuuuucccucagccugcacuuacucuucuauuaagaccagaaaa

SEQ ID NO: 718649 - RNA, 63 nt, Homo Sapiens
auccuucuucucuguguuuucugguuuaaaagcugcacuuauauuuuagccuuauuauuuucu

SEQ ID NO: 718650 - RNA, 63 nt, Homo Sapiens
augaaaugaugucauaagcgaucacuuccuauaugcacuuauucucaagaagaacaucuuuau

SEQ ID NO: 718651 - RNA, 63 nt, Homo Sapiens
gaaaauuguuuuauuucaggcauguucccuuugugcacuuagguucauugugccucaguuccu

SEQ ID NO: 718652 - RNA, 63 nt, Homo Sapiens
ucucuguaaaauaauuggaaugaaaauacuucuugcacuuaaacacugcacaugccguacuuu

SEQ ID NO: 718653 - RNA, 63 nt, Homo Sapiens
uuucuuuagugggggaggguaagaaaagcaguuugcacuuaaaaagaaaaaaaaaaaacgggu

SEQ ID NO: 718654 - RNA, 63 nt, Homo Sapiens
aaagcauuuugcacaguguuuguuuuccugucuugcacuuacaaauaaggucuaugggaguag

SEQ ID NO: 718655 - RNA, 63 nt, Homo Sapiens
ucccuugugcuggccagaugucacuuagcagauugcacuuaagggaagacagucuuagcacug

SEQ ID NO: 718656 - RNA, 63 nt, Homo Sapiens
ccucaugguucuaguaaacgcuagaaugcuaauugcacuuaggcugaggggcuguccagucug

SEQ ID NO: 718657 - RNA, 63 nt, Homo Sapiens
uuuuuggggggugggaauguuagaaguugauuuugcacuuauucuuguuugagcucuugagcu

SEQ ID NO: 718658 - RNA, 63 nt, Homo Sapiens
ggucuguuucucagcaucaugaugcaguguggcugcacuuaagugaggcugacacgucugugu

SEQ ID NO: 718659 - RNA, 63 nt, Homo Sapiens
gcauggucagaccacgucacaguaauugcuguuugcacuuacuccaguauucuaagacauuug

SEQ ID NO: 718660 - RNA, 63 nt, Homo Sapiens
ccuguuucuaaauuauauauuguacaaagaaaaugcacuuaaauuuuacaugugauagucagu

SEQ ID NO: 718661 - RNA, 63 nt, Homo Sapiens
cccaccaccuggggacccccguggguuugaaucugcacuuaucguucagccagucagugacug

SEQ ID NO: 718662 - RNA, 63 nt, Homo Sapiens
cggaggagggcgcaggguggcagaaguuuugaaugcacuuaacaugacuaggaguguuagggg

SEQ ID NO: 718663 - RNA, 63 nt, Homo Sapiens
guccccuuuuuaguuuuuuuuucuuuuuuaucuugcacuuauuaauuucauacuauuuagauu

SEQ ID NO: 718664 - RNA, 63 nt, Homo Sapiens
guugcuuucaguaacauuuuugauuucauuccaugcacuuagaguagcagcuuagauuaacgu

SEQ ID NO: 718665 - RNA, 63 nt, Homo Sapiens
uuuuggagcaaauugacaugaaucaacacuuucugcacuuauccuccuugggcucuucccgca

SEQ ID NO: 718666 - RNA, 63 nt, Homo Sapiens
ggcuguugagggccacuuuuugcuaaagcacuuugcacuuaaugugcaggugacagcaggacu

SEQ ID NO: 718667 - RNA, 63 nt, Homo Sapiens
auagauuuaaguaaacagauguauuuugcacagugcacuuaugucuauuuuaacaauccuccu

SEQ ID NO: 718668 - RNA, 63 nt, Homo Sapiens
aucacgucuuuuguuaugcuaguaucagucagaugcacuuagagugaagaaacacuguaauua

SEQ ID NO: 718669 - RNA, 63 nt, Homo Sapiens
aaaacaguucuuguggccuucuauuaaauaguuugcacuuaagccuugccaguguucugagcu

SEQ ID NO: 718670 - RNA, 63 nt, Homo Sapiens
ucuuacugccaucauuauuuguuaaagauauuuugcacuuaauuuugugggaaaaauauugcu

SEQ ID NO: 718671 - RNA, 63 nt, Homo Sapiens
cacgguucuaauuaagugugaagguauagcuauugcacuuaugccaucuccaaaauuucuuaa

SEQ ID NO: 718672 - RNA, 63 nt, Homo Sapiens
ccccacccaucacauggcuggcuggcugcugggugcacuuacccuccuuggcuugguuacuuc

SEQ ID NO: 718673 - RNA, 63 nt, Homo Sapiens
ugcacaggccucagcuuugaagaacggagucuuugcacuuacacacacucuuccuguucugcc

SEQ ID NO: 718674 - RNA, 63 nt, Homo Sapiens
uuugcagcggaucacuggacaucaaagauucauugcacuuaugaacaaggaaccuucuuuuca

SEQ ID NO: 718675 - RNA, 63 nt, Homo Sapiens
agggagaauuuuagacuuaauuuuuaacucuauugcacuuaaagauuuuaguuagguuaccac

SEQ ID NO: 718676 - RNA, 63 nt, Homo Sapiens
uacaucuaaauuacaacccuuaauugccacgugugcacuuacuacucuccaguaugucuuauu

SEQ ID NO: 718677 - RNA, 63 nt, Homo Sapiens
uacaaauuuaguuuaaguguuugaacaacuauaugcacuuacgguuguguguuuaaaaugucu

SEQ ID NO: 718678 - RNA, 63 nt, Homo Sapiens
guaaaaagauauuucuaauuuacuguugcccauugcacuuacauaccaccaccaagaaagccu

SEQ ID NO: 718679 - RNA, 63 nt, Homo Sapiens
guuuaaaauuuuugugcaauucauauauuaaauugcacuuacuugcauacgcucauauucuag

SEQ ID NO: 718680 - RNA, 63 nt, Homo Sapiens
uuguccuauauauccguacgccagucgacuauuugcacuuaccgucauuguccccacaaugug

SEQ ID NO: 718681 - RNA, 63 nt, Homo Sapiens
ugcuuauuugacaacguuucagcccagggcuccugcacuuacuugcagaggccagaggccccc

SEQ ID NO: 718682 - RNA, 63 nt, Homo Sapiens
aaaucauguaaauaugucacuuugugacaaguuugcacuuacagucaagcaagacuuugugaa

SEQ ID NO: 718683 - RNA, 63 nt, Homo Sapiens
acacccuucaacaaaaucuaauauggauaaaguugcacuuauaaaaugccuuaaaaggaaugc

SEQ ID NO: 718684 - RNA, 63 nt, Homo Sapiens
uaugccaaaaaaaguuugaaagguuaucaaguuugcacuuaacuggagaguugugacaaguac

SEQ ID NO: 718685 - RNA, 63 nt, Homo Sapiens
ugaaaaccuuuucagugaugaguccuugguguuugcacuuaaagccugauggagugagaagaa

SEQ ID NO: 718686 - RNA, 63 nt, Homo Sapiens
aguuuuuacaaaacugcuuuuauuuauuacuugugcacuuaguuuauacacaacuuugcaaau

SEQ ID NO: 718687 - RNA, 63 nt, Homo Sapiens
gugauuguacauauuguacagcuuugcacagcuugcacuuacagaauuaguguucuagacucu

SEQ ID NO: 718688 - RNA, 63 nt, Homo Sapiens
uaucaaucauuuuccuuuuuuagguagucagucugcacuuaaaaagucuuuuuuuuuuuuguc

SEQ ID NO: 718689 - RNA, 63 nt, Homo Sapiens
ggaaguuacaucaggcaaguccuucauuauccuugcacuuaacuauaaucacaggagacucug

SEQ ID NO: 718690 - RNA, 63 nt, Homo Sapiens
cuguaauuuuauuuguucuucagaaauguaguuugcacuuaagaugucuaccuggcagauacu

SEQ ID NO: 718691 - RNA, 63 nt, Homo Sapiens
aucccaccuuuccucaaaugcaugaagaaauacugcacuuacacuaugaaguaaagaacugca

SEQ ID NO: 718692 - RNA, 63 nt, Homo Sapiens
auuggcuugcuucaguuguuuagugccauaaucugcacuuagcagagaucuguuauuuucagg

SEQ ID NO: 718693 - RNA, 63 nt, Homo Sapiens
caucuucuagccuuaugaccguauucuaccacuugcacuuacugcauacaauuugagcaugcu

SEQ ID NO: 718694 - RNA, 63 nt, Homo Sapiens
aauaauugagaagaaaaacuugcuuuguuuccgugcacuuaaagagcgugacacucauuuuag

SEQ ID NO: 718695 - RNA, 63 nt, Homo Sapiens
ucaggguaauuguauugagaacucaaauauacgugcacuuacaugugugguucguacucaagu

SEQ ID NO: 718696 - RNA, 63 nt, Homo Sapiens
cuuauaaauggagcacuuagaaauuuguuguucugcacuuaaccuagagagagaaaaaaugcu

SEQ ID NO: 718697 - RNA, 63 nt, Homo Sapiens
uacaauuaaaaccucauuuuuuuuuuccauuuuugcacuuaacagugaugaauacuuuuacgu

SEQ ID NO: 718698 - RNA, 63 nt, Homo Sapiens
uaauuucuuaauuuaaaaugauagcacuucucuugcacuuaagaauggcauccauaagauucu

SEQ ID NO: 718699 - RNA, 63 nt, Homo Sapiens
ugugauuccacuggcggaggauucuuggaagcuugcacuuaguuuccccugacuucaccccau

SEQ ID NO: 718700 - RNA, 63 nt, Homo Sapiens
aauuagaagcggauuuggaaaugcaaacuaacgugcacuuagauauccaagugggugagcuua

SEQ ID NO: 718701 - RNA, 63 nt, Homo Sapiens
uuuaauuaaaaaggcaaaaccugaaccaccuucugcacuuaaagaagucuaacaguacaaaua

SEQ ID NO: 718702 - RNA, 63 nt, Homo Sapiens
uauccagccuucacuccagcugguuaaaaauguugcacuuaucagcaacccuaccacuuucau

SEQ ID NO: 718703 - RNA, 63 nt, Homo Sapiens
uauucaagaaaaugaacaugcucuucaaaaagaugcacuuaguauuaaguugaaacuugaaca

SEQ ID NO: 718704 - RNA, 63 nt, Homo Sapiens
gcucuauaaauuaaguuugugcuuuccuugaaaugcacuuauucuuauuacaagcauuuuaua

SEQ ID NO: 718705 - RNA, 63 nt, Homo Sapiens
uuaaaauguaauuuaaaugaaagaaaauugaguugcacuuauugaccauuuuuuaauuuacuu

SEQ ID NO: 718706 - RNA, 63 nt, Homo Sapiens
aaaaguggacagcuucugccagcaacgaacaccugcacuuagaaggaggagcacaagauccuc

SEQ ID NO: 718707 - RNA, 63 nt, Homo Sapiens
ugacucauguguccucuuagugucugaguuaaaugcacuuaugauuucauuaggaucuaaagu

SEQ ID NO: 718708 - RNA, 63 nt, Homo Sapiens
cguaugucuugcaugcuuagcauuucacucaguugcacuuaguauuaaaauuuaaaaaaaaaa

SEQ ID NO: 718709 - RNA, 63 nt, Homo Sapiens
agaaccacccacaccucucucuguugguuauugugcacuuaaaaauuuuuccaggagggagac

SEQ ID NO: 718710 - RNA, 63 nt, Homo Sapiens
acuuugguuccacaucugucgaugcuugaaauaugcacuuagccuuuaaacauauucagaaca

SEQ ID NO: 718711 - RNA, 63 nt, Homo Sapiens
acccuuaugcgcuaauuuuguguuuacuucccaugcacuuaauuuuuaaguguaacauaacug

SEQ ID NO: 718712 - RNA, 63 nt, Homo Sapiens
aacacagucugcugcuauauagugggggaagcgugcacuuauuucuaaacauggguuuuuaac

SEQ ID NO: 718713 - RNA, 63 nt, Homo Sapiens
cuuucauugucuucaucuuccugccauacuuugugcacuuauugcucuccuucugagucagga

SEQ ID NO: 718714 - RNA, 63 nt, Homo Sapiens
ugcagccagucacuguguaaagccucucugaugugcacuuaagaguggguugcuuucucacaa

SEQ ID NO: 718715 - RNA, 63 nt, Homo Sapiens
aaggcaucagucccuauguauuugcaguucaccugcacuuaaggcacucuguuauuuagacuc

SEQ ID NO: 718716 - RNA, 63 nt, Homo Sapiens
cagaaugaaaccacauuuuuugguuugauaauaugcacuuauugacucccacucauuguuaug

SEQ ID NO: 718717 - RNA, 63 nt, Homo Sapiens
uugcaauuuagcuugcuuucaagcuucaccccuugcacuuaacauaagcuauuuuuggcauug

SEQ ID NO: 718718 - RNA, 63 nt, Homo Sapiens
uuaauaauguauauucuuucaugcuuuuuucugugcacuuaccuaagugugaauauguaaagg

SEQ ID NO: 718719 - RNA, 63 nt, Homo Sapiens; identical to SEQ ID NO: 642382

SEQ ID NO: 718720 - RNA, 63 nt, Homo Sapiens; identical to SEQ ID NO: 642383

SEQ ID NO: 718721 - RNA, 63 nt, Homo Sapiens
aaaauaauuuguuuuugcaacuauggcuuguuuugcacuuaauagagcuaauauauuuauugc

SEQ ID NO: 718722 - RNA, 63 nt, Homo Sapiens
uauuuugaccacaagggggagacauuucacagaugcacuuacaaacaccggcauaagaaauuu

SEQ ID NO: 718723 - RNA, 63 nt, Homo Sapiens; identical to SEQ ID NO: 642384

SEQ ID NO: 718724 - RNA, 63 nt, Homo Sapiens; identical to SEQ ID NO: 642385

SEQ ID NO: 718725 - RNA, 63 nt, Homo Sapiens
uuuuguauaauuuguguuucuuuuauuuuugauugcacuuaaaaccguuuauuuaacauauau

SEQ ID NO: 718726 - RNA, 63 nt, Homo Sapiens
ggaugccucauagacgaugacccuggccacagcugcacuuacagaauugauugcauaugcaag

SEQ ID NO: 718727 - RNA, 63 nt, Homo Sapiens
ccauuguuuaaauuuacaacuuuuacaauacauugcacuuaauuacaauuauugaaugaagcg

SEQ ID NO: 718728 - RNA, 63 nt, Homo Sapiens
uaggaagugacuugaauguacaaagauacuugaugcacuuauuuuuuaaugugagacagcaag

SEQ ID NO: 718729 - RNA, 63 nt, Homo Sapiens
uacuguguuauuuaaaugcuaagccaaaguaucugcacuuagguauaccucuuuaugccaaua

SEQ ID NO: 718730 - RNA, 63 nt, Homo Sapiens
caaaaagacaaaugauuguaggauccauggaagugcacuuaggcuugcugugguggaggccau

SEQ ID NO: 718731 - RNA, 63 nt, Homo Sapiens
guggagaguggcaggaagcaagcauguuugcugugcacuuaggaaaggcuggugagccagagg

SEQ ID NO: 718732 - RNA, 63 nt, Homo Sapiens
agcuaaauuugucccuuuuuuauuguuauuaauugcacuuaacauuuuuaguuauacuggaua

SEQ ID NO: 718733 - RNA, 63 nt, Homo Sapiens
aauuguguucuuaaaauauuguguaagaaucacugcacuuagcuguuggaauguuguuaaaug

SEQ ID NO: 718734 - RNA, 63 nt, Homo Sapiens
guaaaaauuggguaaauuuacuacugaggggagugcacuuauuuauuuaacuuacuuaucugg

SEQ ID NO: 718735 - RNA, 63 nt, Homo Sapiens; identical to SEQ ID NO: 642386

SEQ ID NO: 718736 - RNA, 63 nt, Homo Sapiens; identical to SEQ ID NO: 642387

SEQ ID NO: 718737 - RNA, 63 nt, Homo Sapiens
cacuuugcuuguauuuuaaaaggaggauauauuugcacuuauguauacuuuuacaguuugcca

SEQ ID NO: 718738 - RNA, 63 nt, Homo Sapiens
gauuaaauaauacauuuauaaucuacaacuguuugcacuuacagcuuuuuuuguaaauauaaa

SEQ ID NO: 718739 - RNA, 63 nt, Homo Sapiens
ccccaugauguaaguuuaccuauguaacaaaccugcacuuauacccaugaacuuaaaaugaaa

SEQ ID NO: 718740 - RNA, 63 nt, Homo Sapiens
gcaaagccuaguagagaaccagugcaccucaggugcacuuacauaugguggggcugaggcaaa

SEQ ID NO: 718741 - RNA, 63 nt, Homo Sapiens
aucaaacaaaaaauaaaucucgaagaaaaaaaaugcacuuacaugugcuuauuuggcuuuucu

SEQ ID NO: 718742 - RNA, 63 nt, Homo Sapiens
guggcacuucaaaaggcagcaccacugggcgccugcacuuauuugaaaauggaacuuugggag

SEQ ID NO: 718743 - RNA, 63 nt, Homo Sapiens
caauuuucucuuggugcuaccugauggaauuccugcacuuaaaguucuggcugacuaaacaag

SEQ ID NO: 718744 - RNA, 63 nt, Homo Sapiens
ugggagggcaaaaaaaaaaaaaaaguuuuuaugugcacuuaaauuuggggacaauuuuaugua

SEQ ID NO: 718745 - RNA, 63 nt, Homo Sapiens
gaaggcuucugacgcuuguggccagacugcaauugcacuuauguguuaugcuacuaauauuug

SEQ ID NO: 718746 - RNA, 54 nt, Homo Sapiens; identical to SEQ ID NO: 190234

SEQ ID NO: 718747 - RNA, 63 nt, Homo Sapiens
auuagcuugcuuaaggcauauugugguuuuuagugcacuuaauggucauagauucuugagcug

SEQ ID NO: 718748 - RNA, 63 nt, Homo Sapiens
aaaucaucccagcuaaguucacacaggaucagcugcacuuaagcacaugcacacagaacucug

SEQ ID NO: 718749 - RNA, 63 nt, Homo Sapiens
aaccaucuauugaauacacauacugguuuaauuugcacuuauuagcuacauugacgagacacu

SEQ ID NO: 718750 - RNA, 63 nt, Homo Sapiens
cauuaguuaaaaaaagauaagaguaucuuauucugcacuuauguaaacaagauauuuaaacua

SEQ ID NO: 718751 - RNA, 63 nt, Homo Sapiens
uugauuugaauuaauuuugguaaaaauaaacucugcacuuauugucauagcuaugacauuugu

SEQ ID NO: 718752 - RNA, 63 nt, Homo Sapiens
gcaaauaccaauaauuaagacuuggucucgucuugcacuuagucgagggcaggaguggcucaa

SEQ ID NO: 718753 - RNA, 63 nt, Homo Sapiens
uagaaccucauuuuuaaagaaccacugaaacccugcacuuagcguucacauggucaaaauuuc

SEQ ID NO: 718754 - RNA, 63 nt, Homo Sapiens; identical to SEQ ID NO: 642388

SEQ ID NO: 718755 - RNA, 63 nt, Homo Sapiens; identical to SEQ ID NO: 642389

SEQ ID NO: 718756 - RNA, 63 nt, Homo Sapiens
guuuuucauuuuaaaaaguccauaccuuauauaugcacuuaauuuguuggggcuuuacauacu

SEQ ID NO: 718757 - RNA, 63 nt, Homo Sapiens
aauuccaccagggccagagcagcuccaccacugugcacuuagccaugauggcaacagaaacca

SEQ ID NO: 718758 - RNA, 63 nt, Homo Sapiens
uucuucaaccagaaaaaccuauuguucuaaaagugcacuuaagagaugggauuacaaguggac

SEQ ID NO: 718759 - RNA, 63 nt, Homo Sapiens
ugucaucauaaucuuuauggugggggcagacuuugcacuuacugcagugcaacacuugcacuu

SEQ ID NO: 718760 - RNA, 63 nt, Homo Sapiens
ugaauguucuuuucaaaaaauaaaguagaaaaaugcacuuacuaagaacaugaaaaaaaauga

SEQ ID NO: 718761 - RNA, 63 nt, Homo Sapiens
auaaacuauaauuguagaaagggguaauuucugugcacuuacaacaagcugaguguucauguu

SEQ ID NO: 718762 - RNA, 63 nt, Homo Sapiens
ucauugaaaaaguccauagccaaaaccugacugugcacuuacuauaggacccugaccugccug

SEQ ID NO: 718763 - RNA, 63 nt, Homo Sapiens
ugauuuuuaaaccugguuuacagguauuacuucugcacuuaccaaauaaugccagauggaaau

SEQ ID NO: 718764 - RNA, 63 nt, Homo Sapiens
aaaauauuuaaaaacugaaaggaaucuaguauuugcacuuagcuugccuuaaaacuggagaga

SEQ ID NO: 718765 - RNA, 63 nt, Homo Sapiens
acuaauguccguguugguauuaauuaauucaacugcacuuaaccuggaauacaguuuucagug

SEQ ID NO: 718766 - RNA, 63 nt, Homo Sapiens
aaaugauuugaacaaauaaacagguguuucuuaugcacuuauauauuuuggcauauuauucuc

SEQ ID NO: 718767 - RNA, 63 nt, Homo Sapiens
accugacaguaugaccgaucgucuucucuuuucugcacuuaauugccucagccuagauguuuu

SEQ ID NO: 718768 - RNA, 63 nt, Homo Sapiens
uccccuguuucuguuuaacugagugacaaacucugcacuuaagcccauccccucccagaaaua

SEQ ID NO: 718769 - RNA, 63 nt, Homo Sapiens
ccuuuugcuaauaaaagugucuuucucccaugcugcacuuacugaggggaaggaggagccccu

SEQ ID NO: 718770 - RNA, 63 nt, Homo Sapiens
aagggauauuguaaaugaaacagcccucgacuuugcacuuaaaccccaccgugguucuuuuca

SEQ ID NO: 718771 - RNA, 63 nt, Homo Sapiens
gguugacuuaauauauuugcuuuuuuucucaccugcacuuagaggaaauuugaacaaguugga

SEQ ID NO: 718772 - RNA, 63 nt, Homo Sapiens
cucauuuagagaggaaaaguaaccaucacugguugcacuuaugauuucaugugcggggaucau

SEQ ID NO: 718773 - RNA, 63 nt, Homo Sapiens
cugucaagguacuugcuugugucugaacucuagugcacuuaugauuuuguagaccaugugaaa

SEQ ID NO: 718774 - RNA, 63 nt, Homo Sapiens
uuguuguuuuguuugcuuugggaucuuguuggaugcacuuagauauggaaaauggaagccaaa

SEQ ID NO: 718775 - RNA, 63 nt, Homo Sapiens
ugucucuaaauugauguucacccauuucaauauugcacuuauuaauggucuuuauuuuucuag

SEQ ID NO: 718776 - RNA, 63 nt, Homo Sapiens
uguuuuguaagaaucacuguuacauucuucuuuugcacuuaaaguugcauugccuacuguuau

SEQ ID NO: 718777 - RNA, 63 nt, Homo Sapiens
aggcuguuuacauggguugcaaacuuuaggaaaugcacuuauuauaaugauguaaacauggaa

SEQ ID NO: 718778 - RNA, 63 nt, Homo Sapiens
uuuaauuuauauguuaguuaauugaaaacuccuugcacuuagacucucuugaauuuaggaauc

SEQ ID NO: 718779 - RNA, 63 nt, Homo Sapiens
aagugcuaaauuuuaaaagcggugaauuauuuaugcacuuaggaauauuuuuaacauuacuga

SEQ ID NO: 718780 - RNA, 63 nt, Homo Sapiens
aacugcguucuggcuaacacucccagugcugggugcacuuaacuccucucaagccacauuucc

SEQ ID NO: 718781 - RNA, 63 nt, Homo Sapiens
uuacacuaaaaauccuugcauuuuaaagagagaugcacuuaagaauagagugaacugcucaua

SEQ ID NO: 718782 - RNA, 63 nt, Homo Sapiens
uuguugcugcauuaguguaauguggugugguuuugcacuuaaaagagguauucauaugcucua

SEQ ID NO: 718783 - RNA, 61 nt, Homo Sapiens; identical to SEQ ID NO: 190271

SEQ ID NO: 718784 - RNA, 63 nt, Homo Sapiens
guguuucuagguugaccuuguguuuuagaaauuugcacuuaauggaauuugcauuucagagau

SEQ ID NO: 718785 - RNA, 63 nt, Homo Sapiens
aaaaaugucacuacugcaacauuaggaauguccugcacuuaauagaauuauuuuucaccgcua

SEQ ID NO: 718786 - RNA, 62 nt, Homo Sapiens
gaguuuucggagaccaagaaauuaaaauacaauugcacuuacuguuuacuuguaaauguuau

SEQ ID NO: 718787 - RNA, 63 nt, Homo Sapiens
cuacugcuuuguacgaauucuaaguauucuuguugcacuuaauuagccuguauauccucagaa

SEQ ID NO: 718788 - RNA, 63 nt, Homo Sapiens
uucucauucuauggccauuggaaaaaauucaaaugcacuuauggagccuauagccagaacuca

SEQ ID NO: 718789 - RNA, 63 nt, Homo Sapiens
caguaaauuaucuugggauauuuagaagauagaugcacuuaugaagaaauauuccaaaugucu

SEQ ID NO: 718790 - RNA, 63 nt, Homo Sapiens
uguaaccaguggugauuugguagugaugcaaaaugcacuuauggggaguauuauaucccugua

SEQ ID NO: 718791 - RNA, 63 nt, Homo Sapiens
uaaguuuaaaucaaauacaguuccauaauucacugcacuuaaauucaaaccuuuaaguuagcu

SEQ ID NO: 718792 - RNA, 63 nt, Homo Sapiens
gacuccuguuguugaaguucgcugcauacaguuugcacuuauggcuaaaauuccugaaguuca

SEQ ID NO: 718793 - RNA, 63 nt, Homo Sapiens
uuuugaauuuuaaaaugaugcuuaaacucaaguugcacuuacaagagguauggagcagugcaa

SEQ ID NO: 718794 - RNA, 63 nt, Homo Sapiens
cugacagucccuucagugguucccaaaaggugaugcacuuaaguuucauucugagcauguuug

SEQ ID NO: 718795 - RNA, 63 nt, Homo Sapiens
caaaaacuugcugaaacacuugauauugcacagugcacuuauuuuguggccaaagcauggccu

SEQ ID NO: 718796 - RNA, 63 nt, Homo Sapiens
caguaagcguuuuuuuucuuugaagauuuaugaugcacuuauucaauagcugucagccguucc

SEQ ID NO: 718797 - RNA, 63 nt, Homo Sapiens
aaagucuacaccaauggaauuagaugagugcuaugcacuuaauuuuaaaauaaaacuaguuuu

SEQ ID NO: 718798 - RNA, 63 nt, Homo Sapiens
ggacaggagacuccaagcgcuaguauugcacgcugcacuuaauggacuggacucuugccaugg

SEQ ID NO: 718799 - RNA, 63 nt, Homo Sapiens
aacccauuugagggguggggggguguuaauuuaugcacuuauaagguguuuucuguguaacca

SEQ ID NO: 718800 - RNA, 63 nt, Homo Sapiens
uggcugcagcagaacacguugagggagucuuggugcacuuaggucacuguaagguucuagggc

SEQ ID NO: 718801 - RNA, 63 nt, Homo Sapiens; identical to SEQ ID NO: 642390

SEQ ID NO: 718802 - RNA, 63 nt, Homo Sapiens; identical to SEQ ID NO: 642391

SEQ ID NO: 718803 - RNA, 63 nt, Homo Sapiens
ccgcagcugcuauagauagcaguaucuguuaugugcacuuaagagguuaucagaauuaauaaa

SEQ ID NO: 718804 - RNA, 63 nt, Homo Sapiens
auuuuccuaauaaaguucuggaaaaaauguauaugcacuuauauacuuugaagucauaccaau

SEQ ID NO: 718805 - RNA, 63 nt, Homo Sapiens
uucagaaacuuagagaguuguugaacuggagcaugcacuuauugugguguuguucugauuguu

SEQ ID NO: 718806 - RNA, 63 nt, Homo Sapiens
uuagucuuuauguauuugcugauuuuacugaaaugcacuuauacauaaauguacuucaccagu

SEQ ID NO: 718807 - RNA, 63 nt, Homo Sapiens
ggaaaggcaaguuggucuuauagaaagcacuacugcacuuaguagcuaugugauuuugagcaa

SEQ ID NO: 718808 - RNA, 63 nt, Homo Sapiens
guuaagaagccaaagcuacuugaucaugcaaaaugcacuuauauauuuguuacacuguauugc

SEQ ID NO: 718809 - RNA, 63 nt, Homo Sapiens
augguuuaucuccagcaacauuucucuaguacuugcacuuauuaucuuuugucuaauuuaacc

SEQ ID NO: 718810 - RNA, 63 nt, Homo Sapiens
uuuacucccaguagcaagggauucuaaguuaguugcacuuacaugauuauuguuauuuaaaac

SEQ ID NO: 718811 - RNA, 63 nt, Homo Sapiens
cgacuuacuugcuagucucuaugagguccuuauugcacuuauugggguugaagcucuucagag

SEQ ID NO: 718812 - RNA, 63 nt, Homo Sapiens
cucccuucuucccuguguggggcucaagccuggugcacuuaguauagaagagcuaacguacuc

SEQ ID NO: 718813 - RNA, 63 nt, Homo Sapiens
gggcagaagcucugccuaaaaugaagugaaagcugcacuuaacccuuugugauaaugaugaca

SEQ ID NO: 718814 - RNA, 63 nt, Homo Sapiens
cuuggcagacccuugacuccagaagugucuccuugcacuuagcgaacuucuuuauuucaaaac

SEQ ID NO: 718815 - RNA, 63 nt, Homo Sapiens
aagcucccaggccgagaagcgguacugagagucugcacuuaacgauccaggaggccggggccg

SEQ ID NO: 718816 - RNA, 63 nt, Homo Sapiens
ccucagguaagugcauaggcucacucucuuuguugcacuuagcauguaugaaggaugacccca

SEQ ID NO: 718817 - RNA, 63 nt, Homo Sapiens
aacauuuaugcgguaggcucagaugucguaauuugcacuuagguaccaggugucaggaaacag

SEQ ID NO: 718818 - RNA, 63 nt, Homo Sapiens
uauauaaauagacuauauguucaauauuaucacugcacuuauaaaaaaagaaugauaugugag

SEQ ID NO: 718819 - RNA, 63 nt, Homo Sapiens
aaaucacuugguaaggauuauaaacuuaauuacugcacuuaaaaugaaacauuacuuuuuuua

SEQ ID NO: 718820 - RNA, 63 nt, Homo Sapiens
guucagcguuguaugucucucucuacacuguggugcacuuaacuuguggaauuuuuauacuaa

SEQ ID NO: 718821 - RNA, 63 nt, Homo Sapiens
ccagugaaaaugaaaggaaguuucaguauuagaugcacuuaaguuagccuccaccacccuuuc

SEQ ID NO: 718822 - RNA, 63 nt, Homo Sapiens
uuuuauauuugucgacgccaggucagucauuuuugcacuuaauuguauaugagauaacuagau

SEQ ID NO: 718823 - RNA, 63 nt, Homo Sapiens; identical to SEQ ID NO: 642392

SEQ ID NO: 718824 - RNA, 63 nt, Homo Sapiens; identical to SEQ ID NO: 642393

SEQ ID NO: 718825 - RNA, 63 nt, Homo Sapiens
uagucuccuuauaguugaagauaaaauguugagugcacuuauuuuagaauauccuagacauaa

SEQ ID NO: 718826 - RNA, 63 nt, Homo Sapiens
ccuuaacuguauuaacguucaauguauauuguuugcacuuaaugccucgcuagucaagcugug

SEQ ID NO: 718827 - RNA, 63 nt, Homo Sapiens
auuauuugguugaauuuguuuuccuuguuuuacugcacuuaauacaggaaaagucaucccuau

SEQ ID NO: 718828 - RNA, 63 nt, Homo Sapiens
auuugucauaugauggcacugccuuacgacugcugcacuuacccucccaagugccuaggccau

SEQ ID NO: 718829 - RNA, 63 nt, Homo Sapiens
uuacaaccuaguaauaaugucuauaauuugcccugcacuuauuugaauguuuauacuuuuauu

SEQ ID NO: 718830 - RNA, 63 nt, Homo Sapiens
gaaguauuuuuagaauaagaacaugaagcuucaugcacuuaaaggccaagaauauugcaaaau

SEQ ID NO: 718831 - RNA, 63 nt, Homo Sapiens
uuuaugacugccggggggguucuuuuuguguuaugcacuuaauuuuucucuauuuuccccugu

SEQ ID NO: 718832 - RNA, 63 nt, Homo Sapiens
ggaggcuuggaugggaauaugcugauuuuguucugcacuuaaaggcuucuccuccuggagggc

SEQ ID NO: 718833 - RNA, 63 nt, Homo Sapiens
ugaacagcccaaaagcauuagagaugguaaagcugcacuuacuauaauuauaacuuaauguua

SEQ ID NO: 718834 - RNA, 63 nt, Homo Sapiens
aaggaaaaucaggccuguugcaaaugacaguagugcacuuaaagcagcuccccaccccagagc

SEQ ID NO: 718835 - RNA, 63 nt, Homo Sapiens
acgcaccuauuucucaauagauguuguaaguauugcacuuaauuuggucauuugacaucagag

SEQ ID NO: 718836 - RNA, 63 nt, Homo Sapiens
ugagaaucaaauggaaacauaucauucuggaggugcacuuacucuucuacaauguggccggau

SEQ ID NO: 718837 - RNA, 63 nt, Homo Sapiens
uauuaaaacgacuccccaauuauuuugcagaauugcacuuaauauugaaauguacuguauagg

SEQ ID NO: 718838 - RNA, 63 nt, Homo Sapiens
agacgcugcaaucacagauuuuaaaaaauuguuugcacuuaaaaauaguugaaugcuggugga

SEQ ID NO: 718839 - RNA, 63 nt, Homo Sapiens
aaacugauuuuauuugggagaaacaaggaagggugcacuuaacuagcaaccuaagcaugauuu

SEQ ID NO: 718840 - RNA, 63 nt, Homo Sapiens
gcuagcucugcuuuuuaugcuuuucuucagauuugcacuuacucagcuuauuggacacaugga

SEQ ID NO: 718841 - RNA, 63 nt, Homo Sapiens
cuuagauuugugaagggagacuuuuuagaagccugcacuuaaguccuauuguacucucuucug

SEQ ID NO: 718842 - RNA, 63 nt, Homo Sapiens
uacuugauacugaaugcauagacucuggauauuugcacuuauguccuaauggauucaauuacg

SEQ ID NO: 718843 - RNA, 63 nt, Homo Sapiens
cagugguacgauuucuagcccguggcuuuaaaaugcacuuaaaguccuguccuugccuuuuau

SEQ ID NO: 718844 - RNA, 63 nt, Homo Sapiens
auuaucccagcuauuagauagaagggauguuacugcacuuauguguaaucagaucuuuauuua

SEQ ID NO: 718845 - RNA, 63 nt, Homo Sapiens
caaaccuagaugggacaccugaacaucauggagugcacuuauaguaaggugacuuuauugugu

SEQ ID NO: 718846 - RNA, 63 nt, Homo Sapiens
auagaguuuuuauuaauuacaagcaugugaaagugcacuuaagguuuguuuauuauaaacaaa

SEQ ID NO: 718847 - RNA, 63 nt, Homo Sapiens
guccuguccuugccuuuuaucguggcuuuaaaaugcacuuaaacagugguacgauuucucgcc

SEQ ID NO: 718848 - RNA, 63 nt, Homo Sapiens
aagggccagguuccaaauuauccaacuuccuccugcacuuaaaacuucaugcauggcuucucc

SEQ ID NO: 718849 - RNA, 63 nt, Homo Sapiens
uguauggguccauauguacggugugugugugugugcacuuaugaguccuuucugucauucugu

SEQ ID NO: 718850 - RNA, 63 nt, Homo Sapiens
uaauggucuucaauuuaauugaaaaauaucucaugcacuuaaaaugcauucaagaagcuaggg

SEQ ID NO: 718851 - RNA, 63 nt, Homo Sapiens
gccuuguaaauaaugacauggaagacccugugcugcacuuaaaauauugcugcuugauuauuu

SEQ ID NO: 718852 - RNA, 61 nt, Homo Sapiens; identical to SEQ ID NO: 190340

SEQ ID NO: 718853 - RNA, 63 nt, Homo Sapiens
acuuuauuacagagcuccuugguuuuuuacuucugcacuuaaauuuuuuuaaauaacaugaug

SEQ ID NO: 718854 - RNA, 63 nt, Homo Sapiens
uuuuuuuuaauuuucaggucaaguuuuuuauacugcacuuauuugucaaaauaaagauucuca

SEQ ID NO: 718855 - RNA, 63 nt, Homo Sapiens
aguggcugaaauccagcauuuuuacauaggagaugcacuuagccucuaagccucguuuuacuc

SEQ ID NO: 718856 - RNA, 63 nt, Homo Sapiens
cuuuggauggaggggagggccuuuguuaccuuuugcacuuauucuuucugugggugcuuugac

SEQ ID NO: 718857 - RNA, 63 nt, Homo Sapiens
ggaucccucugucuggggugggaugccuuacuuugcacuuaauuuaauaagggcauucucgga

SEQ ID NO: 718858 - RNA, 63 nt, Homo Sapiens
cucgaaguuaguaaauccuugcuuucguccccuugcacuuagaggaaugucugacaggcuuaa

SEQ ID NO: 718859 - RNA, 63 nt, Homo Sapiens
gaaaggucacuggcccgggcugcuuccaggcagugcacuuagagugcagaucacgaaugcacc

SEQ ID NO: 718860 - RNA, 63 nt, Homo Sapiens
gggauuguagguagauaacauccaaucacuguuugcacuuaucugaaaucuucccucuuggcu

SEQ ID NO: 718861 - RNA, 63 nt, Homo Sapiens
ucauggcucuccacucagacugugccuggccccugcacuuacaacuuccugccgcucuguggc

SEQ ID NO: 718862 - RNA, 63 nt, Homo Sapiens
auugaaaaguaaauguuuuauuaguucauugccugcacuuacugaucggaagagagaaagaac

SEQ ID NO: 718863 - RNA, 63 nt, Homo Sapiens
uugggcuguuuucucaacaaauggaaugccauuugcacuuacacaagacuuuccccauacucu

SEQ ID NO: 718864 - RNA, 63 nt, Homo Sapiens
gcugggagcagcacaaggacccagccuuuguucugcacuuaauaaaugguuuugcuacugcua

SEQ ID NO: 718865 - RNA, 63 nt, Homo Sapiens
gugccgggaaggaacugccgggacucaccgagcugcacuuaacuguucucuuucuggcuauuu

SEQ ID NO: 718866 - RNA, 63 nt, Homo Sapiens
uauugcggggagacagcucuugaggguuggggcugcacuuauucugagccugaaucugacucu

SEQ ID NO: 718867 - RNA, 63 nt, Homo Sapiens
gucuggagagcuuuggauaaaaauccuuguuuuugcacuuauuaaucaaacaguccugaauuc

SEQ ID NO: 718868 - RNA, 63 nt, Homo Sapiens
aauaugaaauagaaacuuuuucucucaacuuccugcacuuaacguuuucacuggauuuuuauc

SEQ ID NO: 718869 - RNA, 63 nt, Homo Sapiens
cucaauccagccccggagaaucuccagguguacugcacuuaccaagaagggggcucccuggga

SEQ ID NO: 718870 - RNA, 63 nt, Homo Sapiens
aauggaacccaaacagaagacugucuauuucugugcacuuaacggguuucaguacaaaugcug

SEQ ID NO: 718871 - RNA, 63 nt, Homo Sapiens
caaauaguauguggggauuugacuguaccauguugcacuuaaucguguaaagagauuacacau

SEQ ID NO: 718872 - RNA, 63 nt, Homo Sapiens
uaugaaccugcccugcucccuucaagaccucugugcacuuauuagaacagauaaucccuguau

SEQ ID NO: 718873 - RNA, 63 nt, Homo Sapiens
cugcgugggacaagggcuguucaucaugcucccugcacuuaggugccgacuggcugccugacu

SEQ ID NO: 718874 - RNA, 63 nt, Homo Sapiens
aauuaacaaaauguucuuccuuuaguuugcuuuugcacuuaaaauauauauaauugacuuuuu

SEQ ID NO: 718875 - RNA, 63 nt, Homo Sapiens
uauaaguaugcguuacaggguuugauacuuuccugcacuuagguuuguccuauucuucauuua

SEQ ID NO: 718876 - RNA, 63 nt, Homo Sapiens
uuagcauaauuuuagaugccugugaaauaguacugcacuuacauaaagugagacauugugaaa

SEQ ID NO: 718877 - RNA, 63 nt, Homo Sapiens
cauaauacauguaguauuuugugucuggcgucuugcacuuagcaugguguucuugagguucau

SEQ ID NO: 718878 - RNA, 63 nt, Homo Sapiens
caaaacuauuguguaaaacaauguacaugaaauugcacuuaacacauccuuaaacaaaguagu

SEQ ID NO: 718879 - RNA, 62 nt, Homo Sapiens
ugugaaaauauccuggaaauaaauacauguuucugcacuuagagccagggaccugccgcguu

SEQ ID NO: 718880 - RNA, 63 nt, Homo Sapiens
agccccagcgagauuuuccggugaauacgggauugcacuuacucuuucaucacggaaacagac

SEQ ID NO: 718881 - RNA, 63 nt, Homo Sapiens
auaagcccccgcggggcggagauuucuaccuucugcacuuacuccccaucagaagaucgaguu

SEQ ID NO: 718882 - RNA, 63 nt, Homo Sapiens
gguuuauuucaccugaauauaauuccuaacugaugcacuuaguauaugucaguuuuuauaaau

SEQ ID NO: 718883 - RNA, 63 nt, Homo Sapiens
gaaucucuaacaugcucuguuuacaucgauaaaugcacuuaaggaaaacaaacaaauuaaagc

SEQ ID NO: 718884 - RNA, 63 nt, Homo Sapiens
ugacucauauguuuuaacaugauuuuaacaaacugcacuuauuaagaaauguguuugcccugu

SEQ ID NO: 718885 - RNA, 63 nt, Homo Sapiens
ucacugugacucuagaguggccagacucagagcugcacuuaguagggguuccucaaaggaagg

SEQ ID NO: 718886 - RNA, 63 nt, Homo Sapiens
aauucacccaugaaagagacccagugguuacugugcacuuaggaaaaccuucagccacaucuu

SEQ ID NO: 718887 - RNA, 63 nt, Homo Sapiens
aauucacccaugagagagacccagugguugcuaugcacuuaggaaaacuuucagccacaucuu

SEQ ID NO: 718888 - RNA, 63 nt, Homo Sapiens
uaaacaaucagaccacauuuuugcuacucuugcugcacuuaugaagacagccuacauggucca

SEQ ID NO: 718889 - RNA, 58 nt, Homo Sapiens; identical to SEQ ID NO: 190377

SEQ ID NO: 718890 - RNA, 63 nt, Homo Sapiens
guauacaaauacaguauuuuccaugguucugccugcacuuacuuuguaaugccacgguugaga

SEQ ID NO: 718891 - RNA, 63 nt, Homo Sapiens
cuuuucccguugaugucuugaugcuccuaucugugcacuuaccguagguagggacacgugucc

SEQ ID NO: 718892 - RNA, 63 nt, Homo Sapiens
ucauuaccacggaagauauagccaagcaucacuugcacuuaaaagaaaugaaugugaaagaaa

SEQ ID NO: 718893 - RNA, 63 nt, Homo Sapiens
ucgaauuugaagagauugcucagggcucauuuuugcacuuaucuggggaguaccuguccaaga

SEQ ID NO: 718894 - RNA, 63 nt, Homo Sapiens
gggugagcgcgggugucgagccuaccuccagugugcacuuaggcugcaguaacuaucuauaca

SEQ ID NO: 718895 - RNA, 63 nt, Homo Sapiens
aggaagcacaugugcaccuuuccuuuacacuaaugcacuuaggauguuucugcaucaugucua

SEQ ID NO: 718896 - RNA, 63 nt, Homo Sapiens
gcucagcgaccuuuccucucaaaugcggaagcgugcacuuacaguucagaccguucuccugua

SEQ ID NO: 718897 - RNA, 63 nt, Homo Sapiens
auuauauucuauaaacauuaguugauaaccauaugcacuuaacauauuuucuggauucuggag

SEQ ID NO: 718898 - RNA, 63 nt, Homo Sapiens
aagcaaaucuauuagaaaaacagcaaacugcacugcacuuauauauguagaauguuaaaagca

SEQ ID NO: 718899 - RNA, 63 nt, Homo Sapiens
gacuucgguguccucggcucugaaggcgcucucugcacuuagaugcugucagcccucaacgua

SEQ ID NO: 718900 - RNA, 63 nt, Homo Sapiens; identical to SEQ ID NO: 642394

SEQ ID NO: 718901 - RNA, 63 nt, Homo Sapiens; identical to SEQ ID NO: 642395

SEQ ID NO: 718902 - RNA, 63 nt, Homo Sapiens
ggccuugcucacagcugauugcccucaggcaccugcacuuacacagcuaacucugaccuggga

SEQ ID NO: 718903 - RNA, 63 nt, Homo Sapiens
ugugagagucuucaaacuuucaggauccugagcugcacuuaccaagacuuucugcugcacuca

SEQ ID NO: 718904 - RNA, 63 nt, Homo Sapiens
accuucuugauagcucccugacgagugcugguaugcacuuaggcuuaugugugugggcuuggg

SEQ ID NO: 718905 - RNA, 63 nt, Homo Sapiens
augcuggucagucugaaaaggugaagcuggcugugcacuuacccccaucuuucucccucgggg

SEQ ID NO: 718906 - RNA, 63 nt, Homo Sapiens
uccccuuucccugucccagccccaucuguggguugcacuuacaaacccccacccaccuucaga

SEQ ID NO: 718907 - RNA, 63 nt, Homo Sapiens
uagaaaacuauugaaagaaaucacaggggaaacugcacuuagacugacagaauugaacaccaa

SEQ ID NO: 718908 - RNA, 63 nt, Homo Sapiens
uaaaauuuaggagagaacauuguagaaacuucuugcacuuauuaaauguaugcaauuccugag

SEQ ID NO: 718909 - RNA, 63 nt, Homo Sapiens
aauuagcaugcugcuuuuuguaugagcuuucuuugcacuuaaaauuuuaaaagucuauuuuau

SEQ ID NO: 718910 - RNA, 63 nt, Homo Sapiens
uuaucaauaaagaggcaaaucccuuaucuccucugcacuuaugugcccaugccgcucaggcua

SEQ ID NO: 718911 - RNA, 63 nt, Homo Sapiens
cuuauaaaauaacuugcauccuagauaacgaagugcacuuacaaugccaguguguccuagaac

SEQ ID NO: 718912 - RNA, 63 nt, Homo Sapiens; identical to SEQ ID NO: 100805

SEQ ID NO: 718913 - RNA, 63 nt, Homo Sapiens; identical to SEQ ID NO: 100806

SEQ ID NO: 718914 - RNA, 63 nt, Homo Sapiens; identical to SEQ ID NO: 100807

SEQ ID NO: 718915 - RNA, 63 nt, Homo Sapiens; identical to SEQ ID NO: 100808

SEQ ID NO: 718916 - RNA, 63 nt, Homo Sapiens; identical to SEQ ID NO: 100809

SEQ ID NO: 718917 - RNA, 63 nt, Homo Sapiens; identical to SEQ ID NO: 100810

SEQ ID NO: 718918 - RNA, 63 nt, Homo Sapiens; identical to SEQ ID NO: 100811

SEQ ID NO: 718919 - RNA, 63 nt, Homo Sapiens; identical to SEQ ID NO: 100812

SEQ ID NO: 718920 - RNA, 63 nt, Homo Sapiens; identical to SEQ ID NO: 100813

SEQ ID NO: 718921 - RNA, 63 nt, Homo Sapiens; identical to SEQ ID NO: 100814

SEQ ID NO: 718922 - RNA, 63 nt, Homo Sapiens; identical to SEQ ID NO: 100815

SEQ ID NO: 718923 - RNA, 63 nt, Homo Sapiens; identical to SEQ ID NO: 100816

SEQ ID NO: 718924 - RNA, 63 nt, Homo Sapiens; identical to SEQ ID NO: 100817

SEQ ID NO: 718925 - RNA, 63 nt, Homo Sapiens; identical to SEQ ID NO: 100818

SEQ ID NO: 718926 - RNA, 63 nt, Homo Sapiens; identical to SEQ ID NO: 100819

SEQ ID NO: 718927 - RNA, 63 nt, Homo Sapiens; identical to SEQ ID NO: 100820

SEQ ID NO: 718928 - RNA, 63 nt, Homo Sapiens; identical to SEQ ID NO: 100821

SEQ ID NO: 718929 - RNA, 63 nt, Homo Sapiens; identical to SEQ ID NO: 100822

SEQ ID NO: 718930 - RNA, 63 nt, Homo Sapiens; identical to SEQ ID NO: 100823

SEQ ID NO: 718931 - RNA, 63 nt, Homo Sapiens; identical to SEQ ID NO: 100824

SEQ ID NO: 718932 - RNA, 63 nt, Homo Sapiens; identical to SEQ ID NO: 100825

SEQ ID NO: 718933 - RNA, 63 nt, Homo Sapiens; identical to SEQ ID NO: 100826

SEQ ID NO: 718934 - RNA, 63 nt, Homo Sapiens; identical to SEQ ID NO: 100827

SEQ ID NO: 718935 - RNA, 63 nt, Homo Sapiens; identical to SEQ ID NO: 100828

SEQ ID NO: 718936 - RNA, 63 nt, Homo Sapiens; identical to SEQ ID NO: 100829

SEQ ID NO: 718937 - RNA, 63 nt, Homo Sapiens; identical to SEQ ID NO: 100830

SEQ ID NO: 718938 - RNA, 63 nt, Homo Sapiens; identical to SEQ ID NO: 100831

SEQ ID NO: 718939 - RNA, 63 nt, Homo Sapiens; identical to SEQ ID NO: 100832

SEQ ID NO: 718940 - RNA, 63 nt, Homo Sapiens; identical to SEQ ID NO: 100833

SEQ ID NO: 718941 - RNA, 63 nt, Homo Sapiens; identical to SEQ ID NO: 100834

SEQ ID NO: 718942 - RNA, 63 nt, Homo Sapiens; identical to SEQ ID NO: 100835

SEQ ID NO: 718943 - RNA, 63 nt, Homo Sapiens; identical to SEQ ID NO: 100836

SEQ ID NO: 718944 - RNA, 63 nt, Homo Sapiens; identical to SEQ ID NO: 100837

SEQ ID NO: 718945 - RNA, 63 nt, Homo Sapiens; identical to SEQ ID NO: 100838

SEQ ID NO: 718946 - RNA, 63 nt, Homo Sapiens; identical to SEQ ID NO: 100839

SEQ ID NO: 718947 - RNA, 63 nt, Homo Sapiens; identical to SEQ ID NO: 100840

SEQ ID NO: 718948 - RNA, 63 nt, Homo Sapiens; identical to SEQ ID NO: 100841

SEQ ID NO: 718949 - RNA, 63 nt, Homo Sapiens; identical to SEQ ID NO: 100842

SEQ ID NO: 718950 - RNA, 63 nt, Homo Sapiens; identical to SEQ ID NO: 100843

SEQ ID NO: 718951 - RNA, 63 nt, Homo Sapiens; identical to SEQ ID NO: 100844

SEQ ID NO: 718952 - RNA, 63 nt, Homo Sapiens; identical to SEQ ID NO: 100845

SEQ ID NO: 718953 - RNA, 63 nt, Homo Sapiens; identical to SEQ ID NO: 100846

SEQ ID NO: 718954 - RNA, 63 nt, Homo Sapiens; identical to SEQ ID NO: 100847

SEQ ID NO: 718955 - RNA, 63 nt, Homo Sapiens; identical to SEQ ID NO: 100848

SEQ ID NO: 718956 - RNA, 63 nt, Homo Sapiens; identical to SEQ ID NO: 100849

SEQ ID NO: 718957 - RNA, 63 nt, Homo Sapiens; identical to SEQ ID NO: 100850

SEQ ID NO: 718958 - RNA, 63 nt, Homo Sapiens; identical to SEQ ID NO: 100851

SEQ ID NO: 718959 - RNA, 63 nt, Homo Sapiens; identical to SEQ ID NO: 100852

SEQ ID NO: 718960 - RNA, 52 nt, Homo Sapiens; identical to SEQ ID NO: 100853

SEQ ID NO: 718961 - RNA, 63 nt, Homo Sapiens; identical to SEQ ID NO: 100854

SEQ ID NO: 718962 - RNA, 63 nt, Homo Sapiens; identical to SEQ ID NO: 100855

SEQ ID NO: 718963 - RNA, 63 nt, Homo Sapiens; identical to SEQ ID NO: 100856

SEQ ID NO: 718964 - RNA, 63 nt, Homo Sapiens; identical to SEQ ID NO: 100857

SEQ ID NO: 718965 - RNA, 63 nt, Homo Sapiens; identical to SEQ ID NO: 100858

SEQ ID NO: 718966 - RNA, 63 nt, Homo Sapiens; identical to SEQ ID NO: 100859

SEQ ID NO: 718967 - RNA, 63 nt, Homo Sapiens; identical to SEQ ID NO: 100860

SEQ ID NO: 718968 - RNA, 63 nt, Homo Sapiens; identical to SEQ ID NO: 100861

SEQ ID NO: 718969 - RNA, 63 nt, Homo Sapiens; identical to SEQ ID NO: 100862

SEQ ID NO: 718970 - RNA, 63 nt, Homo Sapiens; identical to SEQ ID NO: 100863

SEQ ID NO: 718971 - RNA, 63 nt, Homo Sapiens; identical to SEQ ID NO: 100864

SEQ ID NO: 718972 - RNA, 63 nt, Homo Sapiens; identical to SEQ ID NO: 100865

SEQ ID NO: 718973 - RNA, 63 nt, Homo Sapiens; identical to SEQ ID NO: 100866

SEQ ID NO: 718974 - RNA, 63 nt, Homo Sapiens; identical to SEQ ID NO: 100867

SEQ ID NO: 718975 - RNA, 63 nt, Homo Sapiens; identical to SEQ ID NO: 100868

SEQ ID NO: 718976 - RNA, 63 nt, Homo Sapiens; identical to SEQ ID NO: 100869

SEQ ID NO: 718977 - RNA, 63 nt, Homo Sapiens; identical to SEQ ID NO: 100870

SEQ ID NO: 718978 - RNA, 63 nt, Homo Sapiens; identical to SEQ ID NO: 100871

SEQ ID NO: 718979 - RNA, 63 nt, Homo Sapiens; identical to SEQ ID NO: 100872

SEQ ID NO: 718980 - RNA, 63 nt, Homo Sapiens; identical to SEQ ID NO: 100873

SEQ ID NO: 718981 - RNA, 63 nt, Homo Sapiens; identical to SEQ ID NO: 100874

SEQ ID NO: 718982 - RNA, 63 nt, Homo Sapiens; identical to SEQ ID NO: 100875

SEQ ID NO: 718983 - RNA, 63 nt, Homo Sapiens; identical to SEQ ID NO: 100876

SEQ ID NO: 718984 - RNA, 63 nt, Homo Sapiens; identical to SEQ ID NO: 100877

SEQ ID NO: 718985 - RNA, 63 nt, Homo Sapiens; identical to SEQ ID NO: 100878

SEQ ID NO: 718986 - RNA, 63 nt, Homo Sapiens; identical to SEQ ID NO: 100879

SEQ ID NO: 718987 - RNA, 63 nt, Homo Sapiens; identical to SEQ ID NO: 100880

SEQ ID NO: 718988 - RNA, 63 nt, Homo Sapiens; identical to SEQ ID NO: 100881

SEQ ID NO: 718989 - RNA, 63 nt, Homo Sapiens; identical to SEQ ID NO: 100882

SEQ ID NO: 718990 - RNA, 63 nt, Homo Sapiens; identical to SEQ ID NO: 100883

SEQ ID NO: 718991 - RNA, 63 nt, Homo Sapiens; identical to SEQ ID NO: 100884

SEQ ID NO: 718992 - RNA, 63 nt, Homo Sapiens; identical to SEQ ID NO: 100885

SEQ ID NO: 718993 - RNA, 63 nt, Homo Sapiens; identical to SEQ ID NO: 100886

SEQ ID NO: 718994 - RNA, 63 nt, Homo Sapiens; identical to SEQ ID NO: 100887

SEQ ID NO: 718995 - RNA, 63 nt, Homo Sapiens; identical to SEQ ID NO: 100888

SEQ ID NO: 718996 - RNA, 63 nt, Homo Sapiens; identical to SEQ ID NO: 100889

SEQ ID NO: 718997 - RNA, 63 nt, Homo Sapiens; identical to SEQ ID NO: 100890

SEQ ID NO: 718998 - RNA, 63 nt, Homo Sapiens; identical to SEQ ID NO: 100891

SEQ ID NO: 718999 - RNA, 63 nt, Homo Sapiens; identical to SEQ ID NO: 100892

SEQ ID NO: 719000 - RNA, 63 nt, Homo Sapiens; identical to SEQ ID NO: 100893

SEQ ID NO: 719001 - RNA, 63 nt, Homo Sapiens; identical to SEQ ID NO: 100894

SEQ ID NO: 719002 - RNA, 63 nt, Homo Sapiens; identical to SEQ ID NO: 100895

SEQ ID NO: 719003 - RNA, 63 nt, Homo Sapiens; identical to SEQ ID NO: 100896

SEQ ID NO: 719004 - RNA, 63 nt, Homo Sapiens; identical to SEQ ID NO: 100897

SEQ ID NO: 719005 - RNA, 63 nt, Homo Sapiens; identical to SEQ ID NO: 100898

SEQ ID NO: 719006 - RNA, 63 nt, Homo Sapiens; identical to SEQ ID NO: 100899

SEQ ID NO: 719007 - RNA, 63 nt, Homo Sapiens; identical to SEQ ID NO: 100900

SEQ ID NO: 719008 - RNA, 63 nt, Homo Sapiens; identical to SEQ ID NO: 100901

SEQ ID NO: 719009 - RNA, 63 nt, Homo Sapiens; identical to SEQ ID NO: 100902

SEQ ID NO: 719010 - RNA, 63 nt, Homo Sapiens; identical to SEQ ID NO: 100903

SEQ ID NO: 719011 - RNA, 63 nt, Homo Sapiens; identical to SEQ ID NO: 100904

SEQ ID NO: 719012 - RNA, 63 nt, Homo Sapiens; identical to SEQ ID NO: 100905

SEQ ID NO: 719013 - RNA, 63 nt, Homo Sapiens; identical to SEQ ID NO: 100906

SEQ ID NO: 719014 - RNA, 63 nt, Homo Sapiens; identical to SEQ ID NO: 100907

SEQ ID NO: 719015 - RNA, 63 nt, Homo Sapiens; identical to SEQ ID NO: 100908

SEQ ID NO: 719016 - RNA, 63 nt, Homo Sapiens; identical to SEQ ID NO: 100909

SEQ ID NO: 719017 - RNA, 63 nt, Homo Sapiens; identical to SEQ ID NO: 100910

SEQ ID NO: 719018 - RNA, 63 nt, Homo Sapiens; identical to SEQ ID NO: 100911

SEQ ID NO: 719019 - RNA, 63 nt, Homo Sapiens; identical to SEQ ID NO: 100912

SEQ ID NO: 719020 - RNA, 63 nt, Homo Sapiens; identical to SEQ ID NO: 100913

SEQ ID NO: 719021 - RNA, 63 nt, Homo Sapiens; identical to SEQ ID NO: 100914

SEQ ID NO: 719022 - RNA, 63 nt, Homo Sapiens; identical to SEQ ID NO: 100915

SEQ ID NO: 719023 - RNA, 63 nt, Homo Sapiens; identical to SEQ ID NO: 100916

SEQ ID NO: 719024 - RNA, 63 nt, Homo Sapiens; identical to SEQ ID NO: 100917

SEQ ID NO: 719025 - RNA, 63 nt, Homo Sapiens; identical to SEQ ID NO: 100918

SEQ ID NO: 719026 - RNA, 63 nt, Homo Sapiens; identical to SEQ ID NO: 100919

SEQ ID NO: 719027 - RNA, 63 nt, Homo Sapiens; identical to SEQ ID NO: 100920

SEQ ID NO: 719028 - RNA, 63 nt, Homo Sapiens; identical to SEQ ID NO: 100921

SEQ ID NO: 719029 - RNA, 63 nt, Homo Sapiens; identical to SEQ ID NO: 100922

SEQ ID NO: 719030 - RNA, 63 nt, Homo Sapiens; identical to SEQ ID NO: 100923

SEQ ID NO: 719031 - RNA, 63 nt, Homo Sapiens; identical to SEQ ID NO: 100924

SEQ ID NO: 719032 - RNA, 63 nt, Homo Sapiens; identical to SEQ ID NO: 100925

SEQ ID NO: 719033 - RNA, 63 nt, Homo Sapiens; identical to SEQ ID NO: 100926

SEQ ID NO: 719034 - RNA, 63 nt, Homo Sapiens; identical to SEQ ID NO: 100927

SEQ ID NO: 719035 - RNA, 63 nt, Homo Sapiens; identical to SEQ ID NO: 100928

SEQ ID NO: 719036 - RNA, 63 nt, Homo Sapiens; identical to SEQ ID NO: 100929

SEQ ID NO: 719037 - RNA, 63 nt, Homo Sapiens; identical to SEQ ID NO: 100930

SEQ ID NO: 719038 - RNA, 63 nt, Homo Sapiens; identical to SEQ ID NO: 100931

SEQ ID NO: 719039 - RNA, 63 nt, Homo Sapiens; identical to SEQ ID NO: 100932

SEQ ID NO: 719040 - RNA, 63 nt, Homo Sapiens; identical to SEQ ID NO: 100933

SEQ ID NO: 719041 - RNA, 63 nt, Homo Sapiens; identical to SEQ ID NO: 100934

SEQ ID NO: 719042 - RNA, 63 nt, Homo Sapiens; identical to SEQ ID NO: 100935

SEQ ID NO: 719043 - RNA, 63 nt, Homo Sapiens; identical to SEQ ID NO: 100936

SEQ ID NO: 719044 - RNA, 63 nt, Homo Sapiens; identical to SEQ ID NO: 100937

SEQ ID NO: 719045 - RNA, 63 nt, Homo Sapiens; identical to SEQ ID NO: 100938

SEQ ID NO: 719046 - RNA, 63 nt, Homo Sapiens; identical to SEQ ID NO: 100939

SEQ ID NO: 719047 - RNA, 63 nt, Homo Sapiens; identical to SEQ ID NO: 100940

SEQ ID NO: 719048 - RNA, 63 nt, Homo Sapiens; identical to SEQ ID NO: 100941

SEQ ID NO: 719049 - RNA, 63 nt, Homo Sapiens; identical to SEQ ID NO: 100942

SEQ ID NO: 719050 - RNA, 63 nt, Homo Sapiens; identical to SEQ ID NO: 100943

SEQ ID NO: 719051 - RNA, 63 nt, Homo Sapiens; identical to SEQ ID NO: 100944

SEQ ID NO: 719052 - RNA, 63 nt, Homo Sapiens; identical to SEQ ID NO: 100945

SEQ ID NO: 719053 - RNA, 63 nt, Homo Sapiens; identical to SEQ ID NO: 100946

SEQ ID NO: 719054 - RNA, 63 nt, Homo Sapiens; identical to SEQ ID NO: 100947

SEQ ID NO: 719055 - RNA, 63 nt, Homo Sapiens; identical to SEQ ID NO: 100948

SEQ ID NO: 719056 - RNA, 63 nt, Homo Sapiens; identical to SEQ ID NO: 100949

SEQ ID NO: 719057 - RNA, 63 nt, Homo Sapiens; identical to SEQ ID NO: 100950

SEQ ID NO: 719058 - RNA, 63 nt, Homo Sapiens; identical to SEQ ID NO: 100951

SEQ ID NO: 719059 - RNA, 63 nt, Homo Sapiens; identical to SEQ ID NO: 100952

SEQ ID NO: 719060 - RNA, 63 nt, Homo Sapiens; identical to SEQ ID NO: 100953

SEQ ID NO: 719061 - RNA, 63 nt, Homo Sapiens; identical to SEQ ID NO: 100954

SEQ ID NO: 719062 - RNA, 63 nt, Homo Sapiens; identical to SEQ ID NO: 100955

SEQ ID NO: 719063 - RNA, 63 nt, Homo Sapiens; identical to SEQ ID NO: 100956

SEQ ID NO: 719064 - RNA, 63 nt, Homo Sapiens; identical to SEQ ID NO: 100957

SEQ ID NO: 719065 - RNA, 63 nt, Homo Sapiens; identical to SEQ ID NO: 100958

SEQ ID NO: 719066 - RNA, 63 nt, Homo Sapiens; identical to SEQ ID NO: 100959

SEQ ID NO: 719067 - RNA, 63 nt, Homo Sapiens; identical to SEQ ID NO: 100960

SEQ ID NO: 719068 - RNA, 63 nt, Homo Sapiens; identical to SEQ ID NO: 100961

SEQ ID NO: 719069 - RNA, 63 nt, Homo Sapiens; identical to SEQ ID NO: 100962

SEQ ID NO: 719070 - RNA, 63 nt, Homo Sapiens; identical to SEQ ID NO: 100963

SEQ ID NO: 719071 - RNA, 63 nt, Homo Sapiens; identical to SEQ ID NO: 100964

SEQ ID NO: 719072 - RNA, 63 nt, Homo Sapiens; identical to SEQ ID NO: 100965

SEQ ID NO: 719073 - RNA, 63 nt, Homo Sapiens; identical to SEQ ID NO: 100966

SEQ ID NO: 719074 - RNA, 63 nt, Homo Sapiens; identical to SEQ ID NO: 100967

SEQ ID NO: 719075 - RNA, 62 nt, Homo Sapiens; identical to SEQ ID NO: 100968

SEQ ID NO: 719076 - RNA, 63 nt, Homo Sapiens; identical to SEQ ID NO: 100969

SEQ ID NO: 719077 - RNA, 63 nt, Homo Sapiens; identical to SEQ ID NO: 100970

SEQ ID NO: 719078 - RNA, 63 nt, Homo Sapiens; identical to SEQ ID NO: 100971

SEQ ID NO: 719079 - RNA, 63 nt, Homo Sapiens; identical to SEQ ID NO: 100972

SEQ ID NO: 719080 - RNA, 63 nt, Homo Sapiens; identical to SEQ ID NO: 100973

SEQ ID NO: 719081 - RNA, 63 nt, Homo Sapiens; identical to SEQ ID NO: 100974

SEQ ID NO: 719082 - RNA, 63 nt, Homo Sapiens; identical to SEQ ID NO: 100975

SEQ ID NO: 719083 - RNA, 63 nt, Homo Sapiens; identical to SEQ ID NO: 100976

SEQ ID NO: 719084 - RNA, 63 nt, Homo Sapiens; identical to SEQ ID NO: 100977

SEQ ID NO: 719085 - RNA, 63 nt, Homo Sapiens; identical to SEQ ID NO: 100978

SEQ ID NO: 719086 - RNA, 63 nt, Homo Sapiens; identical to SEQ ID NO: 100979

SEQ ID NO: 719087 - RNA, 63 nt, Homo Sapiens; identical to SEQ ID NO: 100980

SEQ ID NO: 719088 - RNA, 63 nt, Homo Sapiens; identical to SEQ ID NO: 100981

SEQ ID NO: 719089 - RNA, 63 nt, Homo Sapiens; identical to SEQ ID NO: 100982

SEQ ID NO: 719090 - RNA, 63 nt, Homo Sapiens; identical to SEQ ID NO: 100983

SEQ ID NO: 719091 - RNA, 63 nt, Homo Sapiens; identical to SEQ ID NO: 100984

SEQ ID NO: 719092 - RNA, 63 nt, Homo Sapiens; identical to SEQ ID NO: 100985

SEQ ID NO: 719093 - RNA, 63 nt, Homo Sapiens; identical to SEQ ID NO: 100986

SEQ ID NO: 719094 - RNA, 63 nt, Homo Sapiens; identical to SEQ ID NO: 100987

SEQ ID NO: 719095 - RNA, 63 nt, Homo Sapiens; identical to SEQ ID NO: 100988

SEQ ID NO: 719096 - RNA, 63 nt, Homo Sapiens; identical to SEQ ID NO: 100989

SEQ ID NO: 719097 - RNA, 63 nt, Homo Sapiens; identical to SEQ ID NO: 100990

SEQ ID NO: 719098 - RNA, 63 nt, Homo Sapiens; identical to SEQ ID NO: 100991

SEQ ID NO: 719099 - RNA, 63 nt, Homo Sapiens; identical to SEQ ID NO: 100992

SEQ ID NO: 719100 - RNA, 63 nt, Homo Sapiens; identical to SEQ ID NO: 100993

SEQ ID NO: 719101 - RNA, 63 nt, Homo Sapiens; identical to SEQ ID NO: 100994

SEQ ID NO: 719102 - RNA, 63 nt, Homo Sapiens; identical to SEQ ID NO: 100995

SEQ ID NO: 719103 - RNA, 63 nt, Homo Sapiens; identical to SEQ ID NO: 100996

SEQ ID NO: 719104 - RNA, 63 nt, Homo Sapiens; identical to SEQ ID NO: 100997

SEQ ID NO: 719105 - RNA, 63 nt, Homo Sapiens; identical to SEQ ID NO: 100998

SEQ ID NO: 719106 - RNA, 63 nt, Homo Sapiens; identical to SEQ ID NO: 100999

SEQ ID NO: 719107 - RNA, 63 nt, Homo Sapiens; identical to SEQ ID NO: 101000

SEQ ID NO: 719108 - RNA, 63 nt, Homo Sapiens; identical to SEQ ID NO: 101001

SEQ ID NO: 719109 - RNA, 63 nt, Homo Sapiens; identical to SEQ ID NO: 101002

SEQ ID NO: 719110 - RNA, 63 nt, Homo Sapiens; identical to SEQ ID NO: 101003

SEQ ID NO: 719111 - RNA, 63 nt, Homo Sapiens; identical to SEQ ID NO: 101004

SEQ ID NO: 719112 - RNA, 63 nt, Homo Sapiens; identical to SEQ ID NO: 101005

SEQ ID NO: 719113 - RNA, 63 nt, Homo Sapiens; identical to SEQ ID NO: 101006

SEQ ID NO: 719114 - RNA, 63 nt, Homo Sapiens; identical to SEQ ID NO: 101007

SEQ ID NO: 719115 - RNA, 63 nt, Homo Sapiens; identical to SEQ ID NO: 101008

SEQ ID NO: 719116 - RNA, 63 nt, Homo Sapiens; identical to SEQ ID NO: 101009

SEQ ID NO: 719117 - RNA, 63 nt, Homo Sapiens; identical to SEQ ID NO: 101010

SEQ ID NO: 719118 - RNA, 63 nt, Homo Sapiens; identical to SEQ ID NO: 101011

SEQ ID NO: 719119 - RNA, 63 nt, Homo Sapiens; identical to SEQ ID NO: 101012

SEQ ID NO: 719120 - RNA, 63 nt, Homo Sapiens; identical to SEQ ID NO: 101013

SEQ ID NO: 719121 - RNA, 63 nt, Homo Sapiens; identical to SEQ ID NO: 101014

SEQ ID NO: 719122 - RNA, 63 nt, Homo Sapiens; identical to SEQ ID NO: 101015

SEQ ID NO: 719123 - RNA, 63 nt, Homo Sapiens; identical to SEQ ID NO: 101016

SEQ ID NO: 719124 - RNA, 63 nt, Homo Sapiens; identical to SEQ ID NO: 101017

SEQ ID NO: 719125 - RNA, 63 nt, Homo Sapiens; identical to SEQ ID NO: 101018

SEQ ID NO: 719126 - RNA, 63 nt, Homo Sapiens; identical to SEQ ID NO: 101019

SEQ ID NO: 719127 - RNA, 63 nt, Homo Sapiens; identical to SEQ ID NO: 101020

SEQ ID NO: 719128 - RNA, 63 nt, Homo Sapiens; identical to SEQ ID NO: 101021

SEQ ID NO: 719129 - RNA, 63 nt, Homo Sapiens; identical to SEQ ID NO: 101022

SEQ ID NO: 719130 - RNA, 63 nt, Homo Sapiens; identical to SEQ ID NO: 101023

SEQ ID NO: 719131 - RNA, 63 nt, Homo Sapiens; identical to SEQ ID NO: 101024

SEQ ID NO: 719132 - RNA, 63 nt, Homo Sapiens; identical to SEQ ID NO: 101025

SEQ ID NO: 719133 - RNA, 63 nt, Homo Sapiens; identical to SEQ ID NO: 101026

SEQ ID NO: 719134 - RNA, 63 nt, Homo Sapiens; identical to SEQ ID NO: 101027

SEQ ID NO: 719135 - RNA, 63 nt, Homo Sapiens; identical to SEQ ID NO: 101028

SEQ ID NO: 719136 - RNA, 63 nt, Homo Sapiens; identical to SEQ ID NO: 101029

SEQ ID NO: 719137 - RNA, 63 nt, Homo Sapiens; identical to SEQ ID NO: 101030

SEQ ID NO: 719138 - RNA, 63 nt, Homo Sapiens; identical to SEQ ID NO: 101031

SEQ ID NO: 719139 - RNA, 63 nt, Homo Sapiens; identical to SEQ ID NO: 101032

SEQ ID NO: 719140 - RNA, 63 nt, Homo Sapiens; identical to SEQ ID NO: 101033

SEQ ID NO: 719141 - RNA, 63 nt, Homo Sapiens; identical to SEQ ID NO: 101034

SEQ ID NO: 719142 - RNA, 63 nt, Homo Sapiens; identical to SEQ ID NO: 101035

SEQ ID NO: 719143 - RNA, 63 nt, Homo Sapiens; identical to SEQ ID NO: 101036

SEQ ID NO: 719144 - RNA, 63 nt, Homo Sapiens; identical to SEQ ID NO: 101037

SEQ ID NO: 719145 - RNA, 63 nt, Homo Sapiens; identical to SEQ ID NO: 101038

SEQ ID NO: 719146 - RNA, 63 nt, Homo Sapiens; identical to SEQ ID NO: 101039

SEQ ID NO: 719147 - RNA, 63 nt, Homo Sapiens; identical to SEQ ID NO: 101040

SEQ ID NO: 719148 - RNA, 63 nt, Homo Sapiens; identical to SEQ ID NO: 101041

SEQ ID NO: 719149 - RNA, 63 nt, Homo Sapiens; identical to SEQ ID NO: 101042

SEQ ID NO: 719150 - RNA, 63 nt, Homo Sapiens; identical to SEQ ID NO: 101043

SEQ ID NO: 719151 - RNA, 63 nt, Homo Sapiens; identical to SEQ ID NO: 101044

SEQ ID NO: 719152 - RNA, 63 nt, Homo Sapiens; identical to SEQ ID NO: 101045

SEQ ID NO: 719153 - RNA, 63 nt, Homo Sapiens; identical to SEQ ID NO: 101046

SEQ ID NO: 719154 - RNA, 63 nt, Homo Sapiens; identical to SEQ ID NO: 101047

SEQ ID NO: 719155 - RNA, 63 nt, Homo Sapiens; identical to SEQ ID NO: 101048

SEQ ID NO: 719156 - RNA, 63 nt, Homo Sapiens; identical to SEQ ID NO: 101049

SEQ ID NO: 719157 - RNA, 63 nt, Homo Sapiens; identical to SEQ ID NO: 101050

SEQ ID NO: 719158 - RNA, 63 nt, Homo Sapiens; identical to SEQ ID NO: 101051

SEQ ID NO: 719159 - RNA, 63 nt, Homo Sapiens; identical to SEQ ID NO: 101052

SEQ ID NO: 719160 - RNA, 63 nt, Homo Sapiens; identical to SEQ ID NO: 101053

SEQ ID NO: 719161 - RNA, 63 nt, Homo Sapiens; identical to SEQ ID NO: 101054

SEQ ID NO: 719162 - RNA, 63 nt, Homo Sapiens; identical to SEQ ID NO: 101055

SEQ ID NO: 719163 - RNA, 63 nt, Homo Sapiens; identical to SEQ ID NO: 101056

SEQ ID NO: 719164 - RNA, 63 nt, Homo Sapiens; identical to SEQ ID NO: 101057

SEQ ID NO: 719165 - RNA, 63 nt, Homo Sapiens; identical to SEQ ID NO: 101058

SEQ ID NO: 719166 - RNA, 63 nt, Homo Sapiens; identical to SEQ ID NO: 101059

SEQ ID NO: 719167 - RNA, 63 nt, Homo Sapiens; identical to SEQ ID NO: 101060

SEQ ID NO: 719168 - RNA, 63 nt, Homo Sapiens; identical to SEQ ID NO: 101061

SEQ ID NO: 719169 - RNA, 63 nt, Homo Sapiens; identical to SEQ ID NO: 101062

SEQ ID NO: 719170 - RNA, 63 nt, Homo Sapiens; identical to SEQ ID NO: 101063

SEQ ID NO: 719171 - RNA, 63 nt, Homo Sapiens; identical to SEQ ID NO: 101064

SEQ ID NO: 719172 - RNA, 63 nt, Homo Sapiens; identical to SEQ ID NO: 101065

SEQ ID NO: 719173 - RNA, 63 nt, Homo Sapiens; identical to SEQ ID NO: 101066

SEQ ID NO: 719174 - RNA, 63 nt, Homo Sapiens; identical to SEQ ID NO: 101067

SEQ ID NO: 719175 - RNA, 63 nt, Homo Sapiens; identical to SEQ ID NO: 101068

SEQ ID NO: 719176 - RNA, 63 nt, Homo Sapiens; identical to SEQ ID NO: 101069

SEQ ID NO: 719177 - RNA, 63 nt, Homo Sapiens; identical to SEQ ID NO: 101070

SEQ ID NO: 719178 - RNA, 63 nt, Homo Sapiens; identical to SEQ ID NO: 101071

SEQ ID NO: 719179 - RNA, 63 nt, Homo Sapiens; identical to SEQ ID NO: 101072

SEQ ID NO: 719180 - RNA, 63 nt, Homo Sapiens; identical to SEQ ID NO: 101073

SEQ ID NO: 719181 - RNA, 63 nt, Homo Sapiens; identical to SEQ ID NO: 101074

SEQ ID NO: 719182 - RNA, 63 nt, Homo Sapiens; identical to SEQ ID NO: 101075

SEQ ID NO: 719183 - RNA, 63 nt, Homo Sapiens; identical to SEQ ID NO: 101076

SEQ ID NO: 719184 - RNA, 63 nt, Homo Sapiens; identical to SEQ ID NO: 101077

SEQ ID NO: 719185 - RNA, 63 nt, Homo Sapiens; identical to SEQ ID NO: 101078

SEQ ID NO: 719186 - RNA, 63 nt, Homo Sapiens; identical to SEQ ID NO: 101079

SEQ ID NO: 719187 - RNA, 63 nt, Homo Sapiens; identical to SEQ ID NO: 101080

SEQ ID NO: 719188 - RNA, 63 nt, Homo Sapiens; identical to SEQ ID NO: 101081

SEQ ID NO: 719189 - RNA, 63 nt, Homo Sapiens; identical to SEQ ID NO: 101082

SEQ ID NO: 719190 - RNA, 63 nt, Homo Sapiens; identical to SEQ ID NO: 101083

SEQ ID NO: 719191 - RNA, 63 nt, Homo Sapiens; identical to SEQ ID NO: 101084

SEQ ID NO: 719192 - RNA, 63 nt, Homo Sapiens; identical to SEQ ID NO: 101085

SEQ ID NO: 719193 - RNA, 63 nt, Homo Sapiens; identical to SEQ ID NO: 101086

SEQ ID NO: 719194 - RNA, 63 nt, Homo Sapiens; identical to SEQ ID NO: 101087

SEQ ID NO: 719195 - RNA, 63 nt, Homo Sapiens; identical to SEQ ID NO: 101088

SEQ ID NO: 719196 - RNA, 63 nt, Homo Sapiens; identical to SEQ ID NO: 101089

SEQ ID NO: 719197 - RNA, 63 nt, Homo Sapiens; identical to SEQ ID NO: 101090

SEQ ID NO: 719198 - RNA, 63 nt, Homo Sapiens; identical to SEQ ID NO: 101091

SEQ ID NO: 719199 - RNA, 63 nt, Homo Sapiens; identical to SEQ ID NO: 101092

SEQ ID NO: 719200 - RNA, 63 nt, Homo Sapiens; identical to SEQ ID NO: 101093

SEQ ID NO: 719201 - RNA, 63 nt, Homo Sapiens; identical to SEQ ID NO: 101094

SEQ ID NO: 719202 - RNA, 63 nt, Homo Sapiens; identical to SEQ ID NO: 101095

SEQ ID NO: 719203 - RNA, 63 nt, Homo Sapiens; identical to SEQ ID NO: 101096

SEQ ID NO: 719204 - RNA, 63 nt, Homo Sapiens; identical to SEQ ID NO: 101097

SEQ ID NO: 719205 - RNA, 63 nt, Homo Sapiens; identical to SEQ ID NO: 101098

SEQ ID NO: 719206 - RNA, 63 nt, Homo Sapiens; identical to SEQ ID NO: 101099

SEQ ID NO: 719207 - RNA, 63 nt, Homo Sapiens; identical to SEQ ID NO: 101100

SEQ ID NO: 719208 - RNA, 63 nt, Homo Sapiens; identical to SEQ ID NO: 101101

SEQ ID NO: 719209 - RNA, 63 nt, Homo Sapiens; identical to SEQ ID NO: 101102

SEQ ID NO: 719210 - RNA, 63 nt, Homo Sapiens; identical to SEQ ID NO: 101103

SEQ ID NO: 719211 - RNA, 63 nt, Homo Sapiens; identical to SEQ ID NO: 101104

SEQ ID NO: 719212 - RNA, 63 nt, Homo Sapiens; identical to SEQ ID NO: 101105

SEQ ID NO: 719213 - RNA, 63 nt, Homo Sapiens; identical to SEQ ID NO: 101106

SEQ ID NO: 719214 - RNA, 63 nt, Homo Sapiens; identical to SEQ ID NO: 101107

SEQ ID NO: 719215 - RNA, 63 nt, Homo Sapiens; identical to SEQ ID NO: 101108

SEQ ID NO: 719216 - RNA, 63 nt, Homo Sapiens; identical to SEQ ID NO: 101109

SEQ ID NO: 719217 - RNA, 63 nt, Homo Sapiens; identical to SEQ ID NO: 101110

SEQ ID NO: 719218 - RNA, 63 nt, Homo Sapiens; identical to SEQ ID NO: 101111

SEQ ID NO: 719219 - RNA, 63 nt, Homo Sapiens; identical to SEQ ID NO: 101112

SEQ ID NO: 719220 - RNA, 63 nt, Homo Sapiens; identical to SEQ ID NO: 101113

SEQ ID NO: 719221 - RNA, 63 nt, Homo Sapiens; identical to SEQ ID NO: 101114

SEQ ID NO: 719222 - RNA, 63 nt, Homo Sapiens; identical to SEQ ID NO: 101115

SEQ ID NO: 719223 - RNA, 63 nt, Homo Sapiens; identical to SEQ ID NO: 101116

SEQ ID NO: 719224 - RNA, 63 nt, Homo Sapiens; identical to SEQ ID NO: 101117

SEQ ID NO: 719225 - RNA, 63 nt, Homo Sapiens; identical to SEQ ID NO: 101118

SEQ ID NO: 719226 - RNA, 63 nt, Homo Sapiens; identical to SEQ ID NO: 101119

SEQ ID NO: 719227 - RNA, 63 nt, Homo Sapiens; identical to SEQ ID NO: 101120

SEQ ID NO: 719228 - RNA, 63 nt, Homo Sapiens; identical to SEQ ID NO: 101121

SEQ ID NO: 719229 - RNA, 63 nt, Homo Sapiens; identical to SEQ ID NO: 101122

SEQ ID NO: 719230 - RNA, 63 nt, Homo Sapiens; identical to SEQ ID NO: 101123

SEQ ID NO: 719231 - RNA, 63 nt, Homo Sapiens; identical to SEQ ID NO: 101124

SEQ ID NO: 719232 - RNA, 63 nt, Homo Sapiens; identical to SEQ ID NO: 101125

SEQ ID NO: 719233 - RNA, 63 nt, Homo Sapiens; identical to SEQ ID NO: 101126

SEQ ID NO: 719234 - RNA, 63 nt, Homo Sapiens; identical to SEQ ID NO: 101127

SEQ ID NO: 719235 - RNA, 63 nt, Homo Sapiens; identical to SEQ ID NO: 101128

SEQ ID NO: 719236 - RNA, 63 nt, Homo Sapiens; identical to SEQ ID NO: 101129

SEQ ID NO: 719237 - RNA, 63 nt, Homo Sapiens; identical to SEQ ID NO: 101130

SEQ ID NO: 719238 - RNA, 63 nt, Homo Sapiens; identical to SEQ ID NO: 101131

SEQ ID NO: 719239 - RNA, 63 nt, Homo Sapiens; identical to SEQ ID NO: 101132

SEQ ID NO: 719240 - RNA, 63 nt, Homo Sapiens; identical to SEQ ID NO: 101133

SEQ ID NO: 719241 - RNA, 63 nt, Homo Sapiens; identical to SEQ ID NO: 101134

SEQ ID NO: 719242 - RNA, 63 nt, Homo Sapiens; identical to SEQ ID NO: 101135

SEQ ID NO: 719243 - RNA, 63 nt, Homo Sapiens; identical to SEQ ID NO: 101136

SEQ ID NO: 719244 - RNA, 63 nt, Homo Sapiens; identical to SEQ ID NO: 101137

SEQ ID NO: 719245 - RNA, 63 nt, Homo Sapiens; identical to SEQ ID NO: 101138

SEQ ID NO: 719246 - RNA, 63 nt, Homo Sapiens; identical to SEQ ID NO: 101139

SEQ ID NO: 719247 - RNA, 63 nt, Homo Sapiens; identical to SEQ ID NO: 101140

SEQ ID NO: 719248 - RNA, 63 nt, Homo Sapiens; identical to SEQ ID NO: 101141

SEQ ID NO: 719249 - RNA, 63 nt, Homo Sapiens; identical to SEQ ID NO: 101142

SEQ ID NO: 719250 - RNA, 63 nt, Homo Sapiens; identical to SEQ ID NO: 101143

SEQ ID NO: 719251 - RNA, 63 nt, Homo Sapiens; identical to SEQ ID NO: 101144

SEQ ID NO: 719252 - RNA, 63 nt, Homo Sapiens; identical to SEQ ID NO: 101145

SEQ ID NO: 719253 - RNA, 63 nt, Homo Sapiens; identical to SEQ ID NO: 101146

SEQ ID NO: 719254 - RNA, 63 nt, Homo Sapiens; identical to SEQ ID NO: 101147

SEQ ID NO: 719255 - RNA, 63 nt, Homo Sapiens; identical to SEQ ID NO: 101148

SEQ ID NO: 719256 - RNA, 63 nt, Homo Sapiens; identical to SEQ ID NO: 101149

SEQ ID NO: 719257 - RNA, 63 nt, Homo Sapiens; identical to SEQ ID NO: 101150

SEQ ID NO: 719258 - RNA, 63 nt, Homo Sapiens; identical to SEQ ID NO: 101151

SEQ ID NO: 719259 - RNA, 63 nt, Homo Sapiens; identical to SEQ ID NO: 101152

SEQ ID NO: 719260 - RNA, 63 nt, Homo Sapiens; identical to SEQ ID NO: 101153

SEQ ID NO: 719261 - RNA, 63 nt, Homo Sapiens; identical to SEQ ID NO: 101154

SEQ ID NO: 719262 - RNA, 63 nt, Homo Sapiens; identical to SEQ ID NO: 101155

SEQ ID NO: 719263 - RNA, 63 nt, Homo Sapiens; identical to SEQ ID NO: 101156

SEQ ID NO: 719264 - RNA, 63 nt, Homo Sapiens; identical to SEQ ID NO: 101157

SEQ ID NO: 719265 - RNA, 63 nt, Homo Sapiens; identical to SEQ ID NO: 101158

SEQ ID NO: 719266 - RNA, 63 nt, Homo Sapiens; identical to SEQ ID NO: 101159

SEQ ID NO: 719267 - RNA, 63 nt, Homo Sapiens; identical to SEQ ID NO: 101160

SEQ ID NO: 719268 - RNA, 63 nt, Homo Sapiens; identical to SEQ ID NO: 101161

SEQ ID NO: 719269 - RNA, 63 nt, Homo Sapiens; identical to SEQ ID NO: 101162

SEQ ID NO: 719270 - RNA, 63 nt, Homo Sapiens; identical to SEQ ID NO: 101163

SEQ ID NO: 719271 - RNA, 63 nt, Homo Sapiens; identical to SEQ ID NO: 101164

SEQ ID NO: 719272 - RNA, 63 nt, Homo Sapiens; identical to SEQ ID NO: 101165

SEQ ID NO: 719273 - RNA, 63 nt, Homo Sapiens; identical to SEQ ID NO: 101166

SEQ ID NO: 719274 - RNA, 63 nt, Homo Sapiens; identical to SEQ ID NO: 101167

SEQ ID NO: 719275 - RNA, 63 nt, Homo Sapiens; identical to SEQ ID NO: 101168

SEQ ID NO: 719276 - RNA, 63 nt, Homo Sapiens; identical to SEQ ID NO: 101169

SEQ ID NO: 719277 - RNA, 63 nt, Homo Sapiens; identical to SEQ ID NO: 101170

SEQ ID NO: 719278 - RNA, 63 nt, Homo Sapiens; identical to SEQ ID NO: 101171

SEQ ID NO: 719279 - RNA, 63 nt, Homo Sapiens; identical to SEQ ID NO: 101172

SEQ ID NO: 719280 - RNA, 63 nt, Homo Sapiens; identical to SEQ ID NO: 101173

SEQ ID NO: 719281 - RNA, 63 nt, Homo Sapiens; identical to SEQ ID NO: 101174

SEQ ID NO: 719282 - RNA, 63 nt, Homo Sapiens; identical to SEQ ID NO: 101175

SEQ ID NO: 719283 - RNA, 63 nt, Homo Sapiens; identical to SEQ ID NO: 101176

SEQ ID NO: 719284 - RNA, 63 nt, Homo Sapiens; identical to SEQ ID NO: 101177

SEQ ID NO: 719285 - RNA, 63 nt, Homo Sapiens; identical to SEQ ID NO: 101178

SEQ ID NO: 719286 - RNA, 63 nt, Homo Sapiens; identical to SEQ ID NO: 101179

SEQ ID NO: 719287 - RNA, 63 nt, Homo Sapiens; identical to SEQ ID NO: 101180

SEQ ID NO: 719288 - RNA, 63 nt, Homo Sapiens; identical to SEQ ID NO: 101181

SEQ ID NO: 719289 - RNA, 63 nt, Homo Sapiens; identical to SEQ ID NO: 101182

SEQ ID NO: 719290 - RNA, 63 nt, Homo Sapiens; identical to SEQ ID NO: 101183

SEQ ID NO: 719291 - RNA, 63 nt, Homo Sapiens; identical to SEQ ID NO: 101184

SEQ ID NO: 719292 - RNA, 63 nt, Homo Sapiens; identical to SEQ ID NO: 101185

SEQ ID NO: 719293 - RNA, 63 nt, Homo Sapiens; identical to SEQ ID NO: 101186

SEQ ID NO: 719294 - RNA, 63 nt, Homo Sapiens; identical to SEQ ID NO: 101187

SEQ ID NO: 719295 - RNA, 63 nt, Homo Sapiens; identical to SEQ ID NO: 101188

SEQ ID NO: 719296 - RNA, 63 nt, Homo Sapiens; identical to SEQ ID NO: 101189

SEQ ID NO: 719297 - RNA, 63 nt, Homo Sapiens; identical to SEQ ID NO: 101190

SEQ ID NO: 719298 - RNA, 63 nt, Homo Sapiens; identical to SEQ ID NO: 101191

SEQ ID NO: 719299 - RNA, 63 nt, Homo Sapiens; identical to SEQ ID NO: 101192

SEQ ID NO: 719300 - RNA, 63 nt, Homo Sapiens; identical to SEQ ID NO: 101193

SEQ ID NO: 719301 - RNA, 63 nt, Homo Sapiens; identical to SEQ ID NO: 101194

SEQ ID NO: 719302 - RNA, 63 nt, Homo Sapiens; identical to SEQ ID NO: 101195

SEQ ID NO: 719303 - RNA, 63 nt, Homo Sapiens; identical to SEQ ID NO: 101196

SEQ ID NO: 719304 - RNA, 63 nt, Homo Sapiens; identical to SEQ ID NO: 101197

SEQ ID NO: 719305 - RNA, 63 nt, Homo Sapiens; identical to SEQ ID NO: 101198

SEQ ID NO: 719306 - RNA, 63 nt, Homo Sapiens; identical to SEQ ID NO: 101199

SEQ ID NO: 719307 - RNA, 63 nt, Homo Sapiens; identical to SEQ ID NO: 101200

SEQ ID NO: 719308 - RNA, 63 nt, Homo Sapiens; identical to SEQ ID NO: 101201

SEQ ID NO: 719309 - RNA, 63 nt, Homo Sapiens; identical to SEQ ID NO: 101202

SEQ ID NO: 719310 - RNA, 63 nt, Homo Sapiens; identical to SEQ ID NO: 101203

SEQ ID NO: 719311 - RNA, 63 nt, Homo Sapiens; identical to SEQ ID NO: 101204

SEQ ID NO: 719312 - RNA, 63 nt, Homo Sapiens; identical to SEQ ID NO: 101205

SEQ ID NO: 719313 - RNA, 63 nt, Homo Sapiens; identical to SEQ ID NO: 101206

SEQ ID NO: 719314 - RNA, 63 nt, Homo Sapiens; identical to SEQ ID NO: 101207

SEQ ID NO: 719315 - RNA, 63 nt, Homo Sapiens; identical to SEQ ID NO: 101208

SEQ ID NO: 719316 - RNA, 63 nt, Homo Sapiens; identical to SEQ ID NO: 101209

SEQ ID NO: 719317 - RNA, 63 nt, Homo Sapiens; identical to SEQ ID NO: 101210

SEQ ID NO: 719318 - RNA, 63 nt, Homo Sapiens; identical to SEQ ID NO: 101211

SEQ ID NO: 719319 - RNA, 63 nt, Homo Sapiens; identical to SEQ ID NO: 101212

SEQ ID NO: 719320 - RNA, 63 nt, Homo Sapiens; identical to SEQ ID NO: 101213

SEQ ID NO: 719321 - RNA, 63 nt, Homo Sapiens; identical to SEQ ID NO: 101214

SEQ ID NO: 719322 - RNA, 63 nt, Homo Sapiens; identical to SEQ ID NO: 101215

SEQ ID NO: 719323 - RNA, 63 nt, Homo Sapiens; identical to SEQ ID NO: 101216

SEQ ID NO: 719324 - RNA, 63 nt, Homo Sapiens; identical to SEQ ID NO: 101217

SEQ ID NO: 719325 - RNA, 63 nt, Homo Sapiens; identical to SEQ ID NO: 101218

SEQ ID NO: 719326 - RNA, 63 nt, Homo Sapiens; identical to SEQ ID NO: 101219

SEQ ID NO: 719327 - RNA, 63 nt, Homo Sapiens; identical to SEQ ID NO: 101220

SEQ ID NO: 719328 - RNA, 63 nt, Homo Sapiens; identical to SEQ ID NO: 101221

SEQ ID NO: 719329 - RNA, 63 nt, Homo Sapiens; identical to SEQ ID NO: 101222

SEQ ID NO: 719330 - RNA, 63 nt, Homo Sapiens; identical to SEQ ID NO: 101223

SEQ ID NO: 719331 - RNA, 63 nt, Homo Sapiens; identical to SEQ ID NO: 101224

SEQ ID NO: 719332 - RNA, 63 nt, Homo Sapiens; identical to SEQ ID NO: 101225

SEQ ID NO: 719333 - RNA, 63 nt, Homo Sapiens; identical to SEQ ID NO: 101226

SEQ ID NO: 719334 - RNA, 63 nt, Homo Sapiens; identical to SEQ ID NO: 101227

SEQ ID NO: 719335 - RNA, 63 nt, Homo Sapiens; identical to SEQ ID NO: 101228

SEQ ID NO: 719336 - RNA, 63 nt, Homo Sapiens; identical to SEQ ID NO: 101229

SEQ ID NO: 719337 - RNA, 63 nt, Homo Sapiens; identical to SEQ ID NO: 101230

SEQ ID NO: 719338 - RNA, 63 nt, Homo Sapiens; identical to SEQ ID NO: 101231

SEQ ID NO: 719339 - RNA, 63 nt, Homo Sapiens; identical to SEQ ID NO: 101232

SEQ ID NO: 719340 - RNA, 63 nt, Homo Sapiens; identical to SEQ ID NO: 101233

SEQ ID NO: 719341 - RNA, 63 nt, Homo Sapiens; identical to SEQ ID NO: 101234

SEQ ID NO: 719342 - RNA, 63 nt, Homo Sapiens; identical to SEQ ID NO: 101235

SEQ ID NO: 719343 - RNA, 63 nt, Homo Sapiens; identical to SEQ ID NO: 101236

SEQ ID NO: 719344 - RNA, 63 nt, Homo Sapiens; identical to SEQ ID NO: 101237

SEQ ID NO: 719345 - RNA, 63 nt, Homo Sapiens; identical to SEQ ID NO: 101238

SEQ ID NO: 719346 - RNA, 63 nt, Homo Sapiens; identical to SEQ ID NO: 101239

SEQ ID NO: 719347 - RNA, 63 nt, Homo Sapiens; identical to SEQ ID NO: 101240

SEQ ID NO: 719348 - RNA, 63 nt, Homo Sapiens; identical to SEQ ID NO: 101241

SEQ ID NO: 719349 - RNA, 63 nt, Homo Sapiens; identical to SEQ ID NO: 101242

SEQ ID NO: 719350 - RNA, 63 nt, Homo Sapiens; identical to SEQ ID NO: 101243

SEQ ID NO: 719351 - RNA, 63 nt, Homo Sapiens; identical to SEQ ID NO: 101244

SEQ ID NO: 719352 - RNA, 63 nt, Homo Sapiens; identical to SEQ ID NO: 101245

SEQ ID NO: 719353 - RNA, 63 nt, Homo Sapiens; identical to SEQ ID NO: 101246

SEQ ID NO: 719354 - RNA, 63 nt, Homo Sapiens; identical to SEQ ID NO: 101247

SEQ ID NO: 719355 - RNA, 63 nt, Homo Sapiens; identical to SEQ ID NO: 101248

SEQ ID NO: 719356 - RNA, 63 nt, Homo Sapiens; identical to SEQ ID NO: 101249

SEQ ID NO: 719357 - RNA, 63 nt, Homo Sapiens; identical to SEQ ID NO: 101250

SEQ ID NO: 719358 - RNA, 63 nt, Homo Sapiens; identical to SEQ ID NO: 101251

SEQ ID NO: 719359 - RNA, 63 nt, Homo Sapiens; identical to SEQ ID NO: 101252

SEQ ID NO: 719360 - RNA, 63 nt, Homo Sapiens; identical to SEQ ID NO: 101253

SEQ ID NO: 719361 - RNA, 63 nt, Homo Sapiens; identical to SEQ ID NO: 101254

SEQ ID NO: 719362 - RNA, 63 nt, Homo Sapiens; identical to SEQ ID NO: 101255

SEQ ID NO: 719363 - RNA, 63 nt, Homo Sapiens; identical to SEQ ID NO: 101256

SEQ ID NO: 719364 - RNA, 63 nt, Homo Sapiens; identical to SEQ ID NO: 101257

SEQ ID NO: 719365 - RNA, 63 nt, Homo Sapiens; identical to SEQ ID NO: 101258

SEQ ID NO: 719366 - RNA, 63 nt, Homo Sapiens; identical to SEQ ID NO: 101259

SEQ ID NO: 719367 - RNA, 63 nt, Homo Sapiens; identical to SEQ ID NO: 101260

SEQ ID NO: 719368 - RNA, 63 nt, Homo Sapiens; identical to SEQ ID NO: 101261

SEQ ID NO: 719369 - RNA, 63 nt, Homo Sapiens; identical to SEQ ID NO: 101262

SEQ ID NO: 719370 - RNA, 63 nt, Homo Sapiens; identical to SEQ ID NO: 101263

SEQ ID NO: 719371 - RNA, 63 nt, Homo Sapiens; identical to SEQ ID NO: 101264

SEQ ID NO: 719372 - RNA, 63 nt, Homo Sapiens; identical to SEQ ID NO: 101265

SEQ ID NO: 719373 - RNA, 63 nt, Homo Sapiens; identical to SEQ ID NO: 101266

SEQ ID NO: 719374 - RNA, 63 nt, Homo Sapiens; identical to SEQ ID NO: 101267

SEQ ID NO: 719375 - RNA, 63 nt, Homo Sapiens; identical to SEQ ID NO: 101268

SEQ ID NO: 719376 - RNA, 63 nt, Homo Sapiens; identical to SEQ ID NO: 101269

SEQ ID NO: 719377 - RNA, 63 nt, Homo Sapiens; identical to SEQ ID NO: 101270

SEQ ID NO: 719378 - RNA, 63 nt, Homo Sapiens; identical to SEQ ID NO: 101271

SEQ ID NO: 719379 - RNA, 63 nt, Homo Sapiens; identical to SEQ ID NO: 101272

SEQ ID NO: 719380 - RNA, 63 nt, Homo Sapiens; identical to SEQ ID NO: 101273

SEQ ID NO: 719381 - RNA, 63 nt, Homo Sapiens; identical to SEQ ID NO: 101274

SEQ ID NO: 719382 - RNA, 63 nt, Homo Sapiens; identical to SEQ ID NO: 101275

SEQ ID NO: 719383 - RNA, 63 nt, Homo Sapiens; identical to SEQ ID NO: 101276

SEQ ID NO: 719384 - RNA, 63 nt, Homo Sapiens; identical to SEQ ID NO: 101277

SEQ ID NO: 719385 - RNA, 63 nt, Homo Sapiens; identical to SEQ ID NO: 101278

SEQ ID NO: 719386 - RNA, 63 nt, Homo Sapiens; identical to SEQ ID NO: 101279

SEQ ID NO: 719387 - RNA, 63 nt, Homo Sapiens; identical to SEQ ID NO: 101280

SEQ ID NO: 719388 - RNA, 63 nt, Homo Sapiens; identical to SEQ ID NO: 101281

SEQ ID NO: 719389 - RNA, 63 nt, Homo Sapiens; identical to SEQ ID NO: 101282

SEQ ID NO: 719390 - RNA, 63 nt, Homo Sapiens; identical to SEQ ID NO: 101283

SEQ ID NO: 719391 - RNA, 63 nt, Homo Sapiens; identical to SEQ ID NO: 101284

SEQ ID NO: 719392 - RNA, 63 nt, Homo Sapiens; identical to SEQ ID NO: 101285

SEQ ID NO: 719393 - RNA, 63 nt, Homo Sapiens; identical to SEQ ID NO: 101286

SEQ ID NO: 719394 - RNA, 63 nt, Homo Sapiens; identical to SEQ ID NO: 101287

SEQ ID NO: 719395 - RNA, 63 nt, Homo Sapiens; identical to SEQ ID NO: 101288

SEQ ID NO: 719396 - RNA, 63 nt, Homo Sapiens; identical to SEQ ID NO: 101289

SEQ ID NO: 719397 - RNA, 63 nt, Homo Sapiens; identical to SEQ ID NO: 101290

SEQ ID NO: 719398 - RNA, 59 nt, Homo Sapiens; identical to SEQ ID NO: 101291

SEQ ID NO: 719399 - RNA, 63 nt, Homo Sapiens; identical to SEQ ID NO: 101292

SEQ ID NO: 719400 - RNA, 63 nt, Homo Sapiens; identical to SEQ ID NO: 101293

SEQ ID NO: 719401 - RNA, 63 nt, Homo Sapiens; identical to SEQ ID NO: 101294

SEQ ID NO: 719402 - RNA, 63 nt, Homo Sapiens; identical to SEQ ID NO: 101295

SEQ ID NO: 719403 - RNA, 63 nt, Homo Sapiens; identical to SEQ ID NO: 101296

SEQ ID NO: 719404 - RNA, 63 nt, Homo Sapiens; identical to SEQ ID NO: 101297

SEQ ID NO: 719405 - RNA, 63 nt, Homo Sapiens; identical to SEQ ID NO: 101298

SEQ ID NO: 719406 - RNA, 63 nt, Homo Sapiens; identical to SEQ ID NO: 101299

SEQ ID NO: 719407 - RNA, 63 nt, Homo Sapiens; identical to SEQ ID NO: 101300

SEQ ID NO: 719408 - RNA, 63 nt, Homo Sapiens; identical to SEQ ID NO: 101301

SEQ ID NO: 719409 - RNA, 63 nt, Homo Sapiens; identical to SEQ ID NO: 101302

SEQ ID NO: 719410 - RNA, 63 nt, Homo Sapiens; identical to SEQ ID NO: 101303

SEQ ID NO: 719411 - RNA, 63 nt, Homo Sapiens; identical to SEQ ID NO: 101304

SEQ ID NO: 719412 - RNA, 63 nt, Homo Sapiens; identical to SEQ ID NO: 101305

SEQ ID NO: 719413 - RNA, 63 nt, Homo Sapiens; identical to SEQ ID NO: 101306

SEQ ID NO: 719414 - RNA, 63 nt, Homo Sapiens; identical to SEQ ID NO: 101307

SEQ ID NO: 719415 - RNA, 63 nt, Homo Sapiens; identical to SEQ ID NO: 101308

SEQ ID NO: 719416 - RNA, 63 nt, Homo Sapiens; identical to SEQ ID NO: 101309

SEQ ID NO: 719417 - RNA, 63 nt, Homo Sapiens; identical to SEQ ID NO: 101310

SEQ ID NO: 719418 - RNA, 63 nt, Homo Sapiens; identical to SEQ ID NO: 101311

SEQ ID NO: 719419 - RNA, 63 nt, Homo Sapiens; identical to SEQ ID NO: 101312

SEQ ID NO: 719420 - RNA, 63 nt, Homo Sapiens; identical to SEQ ID NO: 101313

SEQ ID NO: 719421 - RNA, 63 nt, Homo Sapiens; identical to SEQ ID NO: 101314

SEQ ID NO: 719422 - RNA, 63 nt, Homo Sapiens; identical to SEQ ID NO: 101315

SEQ ID NO: 719423 - RNA, 63 nt, Homo Sapiens; identical to SEQ ID NO: 101316

SEQ ID NO: 719424 - RNA, 63 nt, Homo Sapiens; identical to SEQ ID NO: 101317

SEQ ID NO: 719425 - RNA, 64 nt, Homo Sapiens; identical to SEQ ID NO: 101318

SEQ ID NO: 719426 - RNA, 64 nt, Homo Sapiens; identical to SEQ ID NO: 101319

SEQ ID NO: 719427 - RNA, 64 nt, Homo Sapiens; identical to SEQ ID NO: 101320

SEQ ID NO: 719428 - RNA, 64 nt, Homo Sapiens; identical to SEQ ID NO: 101321

SEQ ID NO: 719429 - RNA, 64 nt, Homo Sapiens; identical to SEQ ID NO: 101322

SEQ ID NO: 719430 - RNA, 64 nt, Homo Sapiens; identical to SEQ ID NO: 101323

SEQ ID NO: 719431 - RNA, 64 nt, Homo Sapiens; identical to SEQ ID NO: 101324

SEQ ID NO: 719432 - RNA, 64 nt, Homo Sapiens; identical to SEQ ID NO: 101325

SEQ ID NO: 719433 - RNA, 64 nt, Homo Sapiens; identical to SEQ ID NO: 101326

SEQ ID NO: 719434 - RNA, 64 nt, Homo Sapiens; identical to SEQ ID NO: 101327

SEQ ID NO: 719435 - RNA, 64 nt, Homo Sapiens; identical to SEQ ID NO: 101328

SEQ ID NO: 719436 - RNA, 64 nt, Homo Sapiens; identical to SEQ ID NO: 101329

SEQ ID NO: 719437 - RNA, 64 nt, Homo Sapiens; identical to SEQ ID NO: 101330

SEQ ID NO: 719438 - RNA, 64 nt, Homo Sapiens; identical to SEQ ID NO: 101331

SEQ ID NO: 719439 - RNA, 64 nt, Homo Sapiens; identical to SEQ ID NO: 101332

SEQ ID NO: 719440 - RNA, 64 nt, Homo Sapiens; identical to SEQ ID NO: 101333

SEQ ID NO: 719441 - RNA, 64 nt, Homo Sapiens; identical to SEQ ID NO: 101334

SEQ ID NO: 719442 - RNA, 64 nt, Homo Sapiens; identical to SEQ ID NO: 101335

SEQ ID NO: 719443 - RNA, 64 nt, Homo Sapiens; identical to SEQ ID NO: 101336

SEQ ID NO: 719444 - RNA, 64 nt, Homo Sapiens; identical to SEQ ID NO: 101337

SEQ ID NO: 719445 - RNA, 64 nt, Homo Sapiens; identical to SEQ ID NO: 101338

SEQ ID NO: 719446 - RNA, 64 nt, Homo Sapiens; identical to SEQ ID NO: 101339

SEQ ID NO: 719447 - RNA, 64 nt, Homo Sapiens; identical to SEQ ID NO: 101340

SEQ ID NO: 719448 - RNA, 64 nt, Homo Sapiens; identical to SEQ ID NO: 101341

SEQ ID NO: 719449 - RNA, 64 nt, Homo Sapiens; identical to SEQ ID NO: 101342

SEQ ID NO: 719450 - RNA, 64 nt, Homo Sapiens; identical to SEQ ID NO: 101343

SEQ ID NO: 719451 - RNA, 64 nt, Homo Sapiens; identical to SEQ ID NO: 101344

SEQ ID NO: 719452 - RNA, 64 nt, Homo Sapiens; identical to SEQ ID NO: 101345

SEQ ID NO: 719453 - RNA, 64 nt, Homo Sapiens; identical to SEQ ID NO: 101346

SEQ ID NO: 719454 - RNA, 64 nt, Homo Sapiens; identical to SEQ ID NO: 101347

SEQ ID NO: 719455 - RNA, 64 nt, Homo Sapiens; identical to SEQ ID NO: 101348

SEQ ID NO: 719456 - RNA, 64 nt, Homo Sapiens; identical to SEQ ID NO: 101349

SEQ ID NO: 719457 - RNA, 64 nt, Homo Sapiens; identical to SEQ ID NO: 101350

SEQ ID NO: 719458 - RNA, 64 nt, Homo Sapiens; identical to SEQ ID NO: 101351

SEQ ID NO: 719459 - RNA, 64 nt, Homo Sapiens; identical to SEQ ID NO: 101352

SEQ ID NO: 719460 - RNA, 64 nt, Homo Sapiens; identical to SEQ ID NO: 101353

SEQ ID NO: 719461 - RNA, 64 nt, Homo Sapiens; identical to SEQ ID NO: 101354

SEQ ID NO: 719462 - RNA, 64 nt, Homo Sapiens; identical to SEQ ID NO: 101355

SEQ ID NO: 719463 - RNA, 64 nt, Homo Sapiens; identical to SEQ ID NO: 101356

SEQ ID NO: 719464 - RNA, 64 nt, Homo Sapiens; identical to SEQ ID NO: 101357

SEQ ID NO: 719465 - RNA, 64 nt, Homo Sapiens; identical to SEQ ID NO: 101358

SEQ ID NO: 719466 - RNA, 64 nt, Homo Sapiens; identical to SEQ ID NO: 101359

SEQ ID NO: 719467 - RNA, 64 nt, Homo Sapiens; identical to SEQ ID NO: 101360

SEQ ID NO: 719468 - RNA, 64 nt, Homo Sapiens; identical to SEQ ID NO: 101361

SEQ ID NO: 719469 - RNA, 64 nt, Homo Sapiens; identical to SEQ ID NO: 101362

SEQ ID NO: 719470 - RNA, 64 nt, Homo Sapiens; identical to SEQ ID NO: 101363

SEQ ID NO: 719471 - RNA, 64 nt, Homo Sapiens; identical to SEQ ID NO: 101364

SEQ ID NO: 719472 - RNA, 64 nt, Homo Sapiens; identical to SEQ ID NO: 101365

SEQ ID NO: 719473 - RNA, 52 nt, Homo Sapiens; identical to SEQ ID NO: 100853

SEQ ID NO: 719474 - RNA, 64 nt, Homo Sapiens; identical to SEQ ID NO: 101367

SEQ ID NO: 719475 - RNA, 64 nt, Homo Sapiens; identical to SEQ ID NO: 101368

SEQ ID NO: 719476 - RNA, 64 nt, Homo Sapiens; identical to SEQ ID NO: 101369

SEQ ID NO: 719477 - RNA, 64 nt, Homo Sapiens; identical to SEQ ID NO: 101370

SEQ ID NO: 719478 - RNA, 64 nt, Homo Sapiens; identical to SEQ ID NO: 101371

SEQ ID NO: 719479 - RNA, 64 nt, Homo Sapiens; identical to SEQ ID NO: 101372

SEQ ID NO: 719480 - RNA, 64 nt, Homo Sapiens; identical to SEQ ID NO: 101373

SEQ ID NO: 719481 - RNA, 64 nt, Homo Sapiens; identical to SEQ ID NO: 101374

SEQ ID NO: 719482 - RNA, 64 nt, Homo Sapiens; identical to SEQ ID NO: 101375

SEQ ID NO: 719483 - RNA, 64 nt, Homo Sapiens; identical to SEQ ID NO: 101376

SEQ ID NO: 719484 - RNA, 64 nt, Homo Sapiens; identical to SEQ ID NO: 101377

SEQ ID NO: 719485 - RNA, 64 nt, Homo Sapiens; identical to SEQ ID NO: 101378

SEQ ID NO: 719486 - RNA, 64 nt, Homo Sapiens; identical to SEQ ID NO: 101379

SEQ ID NO: 719487 - RNA, 64 nt, Homo Sapiens; identical to SEQ ID NO: 101380

SEQ ID NO: 719488 - RNA, 64 nt, Homo Sapiens; identical to SEQ ID NO: 101381

SEQ ID NO: 719489 - RNA, 64 nt, Homo Sapiens; identical to SEQ ID NO: 101382

SEQ ID NO: 719490 - RNA, 64 nt, Homo Sapiens; identical to SEQ ID NO: 101383

SEQ ID NO: 719491 - RNA, 64 nt, Homo Sapiens; identical to SEQ ID NO: 101384

SEQ ID NO: 719492 - RNA, 64 nt, Homo Sapiens; identical to SEQ ID NO: 101385

SEQ ID NO: 719493 - RNA, 64 nt, Homo Sapiens; identical to SEQ ID NO: 101386

SEQ ID NO: 719494 - RNA, 64 nt, Homo Sapiens; identical to SEQ ID NO: 101387

SEQ ID NO: 719495 - RNA, 64 nt, Homo Sapiens; identical to SEQ ID NO: 101388

SEQ ID NO: 719496 - RNA, 64 nt, Homo Sapiens; identical to SEQ ID NO: 101389

SEQ ID NO: 719497 - RNA, 64 nt, Homo Sapiens; identical to SEQ ID NO: 101390

SEQ ID NO: 719498 - RNA, 64 nt, Homo Sapiens; identical to SEQ ID NO: 101391

SEQ ID NO: 719499 - RNA, 64 nt, Homo Sapiens; identical to SEQ ID NO: 101392

SEQ ID NO: 719500 - RNA, 64 nt, Homo Sapiens; identical to SEQ ID NO: 101393

SEQ ID NO: 719501 - RNA, 64 nt, Homo Sapiens; identical to SEQ ID NO: 101394

SEQ ID NO: 719502 - RNA, 64 nt, Homo Sapiens; identical to SEQ ID NO: 101395

SEQ ID NO: 719503 - RNA, 64 nt, Homo Sapiens; identical to SEQ ID NO: 101396

SEQ ID NO: 719504 - RNA, 64 nt, Homo Sapiens; identical to SEQ ID NO: 101397

SEQ ID NO: 719505 - RNA, 64 nt, Homo Sapiens; identical to SEQ ID NO: 101398

SEQ ID NO: 719506 - RNA, 64 nt, Homo Sapiens; identical to SEQ ID NO: 101399

SEQ ID NO: 719507 - RNA, 64 nt, Homo Sapiens; identical to SEQ ID NO: 101400

SEQ ID NO: 719508 - RNA, 64 nt, Homo Sapiens; identical to SEQ ID NO: 101401

SEQ ID NO: 719509 - RNA, 64 nt, Homo Sapiens; identical to SEQ ID NO: 101402

SEQ ID NO: 719510 - RNA, 64 nt, Homo Sapiens; identical to SEQ ID NO: 101403

SEQ ID NO: 719511 - RNA, 64 nt, Homo Sapiens; identical to SEQ ID NO: 101404

SEQ ID NO: 719512 - RNA, 64 nt, Homo Sapiens; identical to SEQ ID NO: 101405

SEQ ID NO: 719513 - RNA, 64 nt, Homo Sapiens; identical to SEQ ID NO: 101406

SEQ ID NO: 719514 - RNA, 64 nt, Homo Sapiens; identical to SEQ ID NO: 101407

SEQ ID NO: 719515 - RNA, 64 nt, Homo Sapiens; identical to SEQ ID NO: 101408

SEQ ID NO: 719516 - RNA, 64 nt, Homo Sapiens; identical to SEQ ID NO: 101409

SEQ ID NO: 719517 - RNA, 64 nt, Homo Sapiens; identical to SEQ ID NO: 101410

SEQ ID NO: 719518 - RNA, 64 nt, Homo Sapiens; identical to SEQ ID NO: 101411

SEQ ID NO: 719519 - RNA, 64 nt, Homo Sapiens; identical to SEQ ID NO: 101412

SEQ ID NO: 719520 - RNA, 64 nt, Homo Sapiens; identical to SEQ ID NO: 101413

SEQ ID NO: 719521 - RNA, 64 nt, Homo Sapiens; identical to SEQ ID NO: 101414

SEQ ID NO: 719522 - RNA, 64 nt, Homo Sapiens; identical to SEQ ID NO: 101415

SEQ ID NO: 719523 - RNA, 64 nt, Homo Sapiens; identical to SEQ ID NO: 101416

SEQ ID NO: 719524 - RNA, 64 nt, Homo Sapiens; identical to SEQ ID NO: 101417

SEQ ID NO: 719525 - RNA, 64 nt, Homo Sapiens; identical to SEQ ID NO: 101418

SEQ ID NO: 719526 - RNA, 64 nt, Homo Sapiens; identical to SEQ ID NO: 101419

SEQ ID NO: 719527 - RNA, 64 nt, Homo Sapiens; identical to SEQ ID NO: 101420

SEQ ID NO: 719528 - RNA, 64 nt, Homo Sapiens; identical to SEQ ID NO: 101421

SEQ ID NO: 719529 - RNA, 64 nt, Homo Sapiens; identical to SEQ ID NO: 101422

SEQ ID NO: 719530 - RNA, 64 nt, Homo Sapiens; identical to SEQ ID NO: 101423

SEQ ID NO: 719531 - RNA, 64 nt, Homo Sapiens; identical to SEQ ID NO: 101424

SEQ ID NO: 719532 - RNA, 64 nt, Homo Sapiens; identical to SEQ ID NO: 101425

SEQ ID NO: 719533 - RNA, 64 nt, Homo Sapiens; identical to SEQ ID NO: 101426

SEQ ID NO: 719534 - RNA, 64 nt, Homo Sapiens; identical to SEQ ID NO: 101427

SEQ ID NO: 719535 - RNA, 64 nt, Homo Sapiens; identical to SEQ ID NO: 101428

SEQ ID NO: 719536 - RNA, 64 nt, Homo Sapiens; identical to SEQ ID NO: 101429

SEQ ID NO: 719537 - RNA, 64 nt, Homo Sapiens; identical to SEQ ID NO: 101430

SEQ ID NO: 719538 - RNA, 64 nt, Homo Sapiens; identical to SEQ ID NO: 101431

SEQ ID NO: 719539 - RNA, 64 nt, Homo Sapiens; identical to SEQ ID NO: 101432

SEQ ID NO: 719540 - RNA, 64 nt, Homo Sapiens; identical to SEQ ID NO: 101433

SEQ ID NO: 719541 - RNA, 64 nt, Homo Sapiens; identical to SEQ ID NO: 101434

SEQ ID NO: 719542 - RNA, 64 nt, Homo Sapiens; identical to SEQ ID NO: 101435

SEQ ID NO: 719543 - RNA, 64 nt, Homo Sapiens; identical to SEQ ID NO: 101436

SEQ ID NO: 719544 - RNA, 64 nt, Homo Sapiens; identical to SEQ ID NO: 101437

SEQ ID NO: 719545 - RNA, 64 nt, Homo Sapiens; identical to SEQ ID NO: 101438

SEQ ID NO: 719546 - RNA, 64 nt, Homo Sapiens; identical to SEQ ID NO: 101439

SEQ ID NO: 719547 - RNA, 64 nt, Homo Sapiens; identical to SEQ ID NO: 101440

SEQ ID NO: 719548 - RNA, 64 nt, Homo Sapiens; identical to SEQ ID NO: 101441

SEQ ID NO: 719549 - RNA, 64 nt, Homo Sapiens; identical to SEQ ID NO: 101442

SEQ ID NO: 719550 - RNA, 64 nt, Homo Sapiens; identical to SEQ ID NO: 101443

SEQ ID NO: 719551 - RNA, 64 nt, Homo Sapiens; identical to SEQ ID NO: 101444

SEQ ID NO: 719552 - RNA, 64 nt, Homo Sapiens; identical to SEQ ID NO: 101445

SEQ ID NO: 719553 - RNA, 64 nt, Homo Sapiens; identical to SEQ ID NO: 101446

SEQ ID NO: 719554 - RNA, 64 nt, Homo Sapiens; identical to SEQ ID NO: 101447

SEQ ID NO: 719555 - RNA, 64 nt, Homo Sapiens; identical to SEQ ID NO: 101448

SEQ ID NO: 719556 - RNA, 64 nt, Homo Sapiens; identical to SEQ ID NO: 101449

SEQ ID NO: 719557 - RNA, 64 nt, Homo Sapiens; identical to SEQ ID NO: 101450

SEQ ID NO: 719558 - RNA, 64 nt, Homo Sapiens; identical to SEQ ID NO: 101451

SEQ ID NO: 719559 - RNA, 64 nt, Homo Sapiens; identical to SEQ ID NO: 101452

SEQ ID NO: 719560 - RNA, 64 nt, Homo Sapiens; identical to SEQ ID NO: 101453

SEQ ID NO: 719561 - RNA, 64 nt, Homo Sapiens; identical to SEQ ID NO: 101454

SEQ ID NO: 719562 - RNA, 64 nt, Homo Sapiens; identical to SEQ ID NO: 101455

SEQ ID NO: 719563 - RNA, 64 nt, Homo Sapiens; identical to SEQ ID NO: 101456

SEQ ID NO: 719564 - RNA, 64 nt, Homo Sapiens; identical to SEQ ID NO: 101457

SEQ ID NO: 719565 - RNA, 64 nt, Homo Sapiens; identical to SEQ ID NO: 101458

SEQ ID NO: 719566 - RNA, 64 nt, Homo Sapiens; identical to SEQ ID NO: 101459

SEQ ID NO: 719567 - RNA, 64 nt, Homo Sapiens; identical to SEQ ID NO: 101460

SEQ ID NO: 719568 - RNA, 64 nt, Homo Sapiens; identical to SEQ ID NO: 101461

SEQ ID NO: 719569 - RNA, 64 nt, Homo Sapiens; identical to SEQ ID NO: 101462

SEQ ID NO: 719570 - RNA, 64 nt, Homo Sapiens; identical to SEQ ID NO: 101463

SEQ ID NO: 719571 - RNA, 64 nt, Homo Sapiens; identical to SEQ ID NO: 101464

SEQ ID NO: 719572 - RNA, 64 nt, Homo Sapiens; identical to SEQ ID NO: 101465

SEQ ID NO: 719573 - RNA, 64 nt, Homo Sapiens; identical to SEQ ID NO: 101466

SEQ ID NO: 719574 - RNA, 64 nt, Homo Sapiens; identical to SEQ ID NO: 101467

SEQ ID NO: 719575 - RNA, 64 nt, Homo Sapiens; identical to SEQ ID NO: 101468

SEQ ID NO: 719576 - RNA, 64 nt, Homo Sapiens; identical to SEQ ID NO: 101469

SEQ ID NO: 719577 - RNA, 64 nt, Homo Sapiens; identical to SEQ ID NO: 101470

SEQ ID NO: 719578 - RNA, 64 nt, Homo Sapiens; identical to SEQ ID NO: 101471

SEQ ID NO: 719579 - RNA, 64 nt, Homo Sapiens; identical to SEQ ID NO: 101472

SEQ ID NO: 719580 - RNA, 64 nt, Homo Sapiens; identical to SEQ ID NO: 101473

SEQ ID NO: 719581 - RNA, 64 nt, Homo Sapiens; identical to SEQ ID NO: 101474

SEQ ID NO: 719582 - RNA, 64 nt, Homo Sapiens; identical to SEQ ID NO: 101475

SEQ ID NO: 719583 - RNA, 64 nt, Homo Sapiens; identical to SEQ ID NO: 101476

SEQ ID NO: 719584 - RNA, 64 nt, Homo Sapiens; identical to SEQ ID NO: 101477

SEQ ID NO: 719585 - RNA, 64 nt, Homo Sapiens; identical to SEQ ID NO: 101478

SEQ ID NO: 719586 - RNA, 64 nt, Homo Sapiens; identical to SEQ ID NO: 101479

SEQ ID NO: 719587 - RNA, 64 nt, Homo Sapiens; identical to SEQ ID NO: 101480

SEQ ID NO: 719588 - RNA, 63 nt, Homo Sapiens; identical to SEQ ID NO: 101481

SEQ ID NO: 719589 - RNA, 64 nt, Homo Sapiens; identical to SEQ ID NO: 101482

SEQ ID NO: 719590 - RNA, 64 nt, Homo Sapiens; identical to SEQ ID NO: 101483

SEQ ID NO: 719591 - RNA, 64 nt, Homo Sapiens; identical to SEQ ID NO: 101484

SEQ ID NO: 719592 - RNA, 64 nt, Homo Sapiens; identical to SEQ ID NO: 101485

SEQ ID NO: 719593 - RNA, 64 nt, Homo Sapiens; identical to SEQ ID NO: 101486

SEQ ID NO: 719594 - RNA, 64 nt, Homo Sapiens; identical to SEQ ID NO: 101487

SEQ ID NO: 719595 - RNA, 64 nt, Homo Sapiens; identical to SEQ ID NO: 101488

SEQ ID NO: 719596 - RNA, 64 nt, Homo Sapiens; identical to SEQ ID NO: 101489

SEQ ID NO: 719597 - RNA, 64 nt, Homo Sapiens; identical to SEQ ID NO: 101490

SEQ ID NO: 719598 - RNA, 64 nt, Homo Sapiens; identical to SEQ ID NO: 101491

SEQ ID NO: 719599 - RNA, 64 nt, Homo Sapiens; identical to SEQ ID NO: 101492

SEQ ID NO: 719600 - RNA, 64 nt, Homo Sapiens; identical to SEQ ID NO: 101493

SEQ ID NO: 719601 - RNA, 64 nt, Homo Sapiens; identical to SEQ ID NO: 101494

SEQ ID NO: 719602 - RNA, 64 nt, Homo Sapiens; identical to SEQ ID NO: 101495

SEQ ID NO: 719603 - RNA, 64 nt, Homo Sapiens; identical to SEQ ID NO: 101496

SEQ ID NO: 719604 - RNA, 64 nt, Homo Sapiens; identical to SEQ ID NO: 101497

SEQ ID NO: 719605 - RNA, 64 nt, Homo Sapiens; identical to SEQ ID NO: 101498

SEQ ID NO: 719606 - RNA, 64 nt, Homo Sapiens; identical to SEQ ID NO: 101499

SEQ ID NO: 719607 - RNA, 64 nt, Homo Sapiens; identical to SEQ ID NO: 101500

SEQ ID NO: 719608 - RNA, 64 nt, Homo Sapiens; identical to SEQ ID NO: 101501

SEQ ID NO: 719609 - RNA, 64 nt, Homo Sapiens; identical to SEQ ID NO: 101502

SEQ ID NO: 719610 - RNA, 64 nt, Homo Sapiens; identical to SEQ ID NO: 101503

SEQ ID NO: 719611 - RNA, 64 nt, Homo Sapiens; identical to SEQ ID NO: 101504

SEQ ID NO: 719612 - RNA, 64 nt, Homo Sapiens; identical to SEQ ID NO: 101505

SEQ ID NO: 719613 - RNA, 64 nt, Homo Sapiens; identical to SEQ ID NO: 101506

SEQ ID NO: 719614 - RNA, 64 nt, Homo Sapiens; identical to SEQ ID NO: 101507

SEQ ID NO: 719615 - RNA, 64 nt, Homo Sapiens; identical to SEQ ID NO: 101508

SEQ ID NO: 719616 - RNA, 64 nt, Homo Sapiens; identical to SEQ ID NO: 101509

SEQ ID NO: 719617 - RNA, 64 nt, Homo Sapiens; identical to SEQ ID NO: 101510

SEQ ID NO: 719618 - RNA, 64 nt, Homo Sapiens; identical to SEQ ID NO: 101511

SEQ ID NO: 719619 - RNA, 64 nt, Homo Sapiens; identical to SEQ ID NO: 101512

SEQ ID NO: 719620 - RNA, 64 nt, Homo Sapiens; identical to SEQ ID NO: 101513

SEQ ID NO: 719621 - RNA, 64 nt, Homo Sapiens; identical to SEQ ID NO: 101514

SEQ ID NO: 719622 - RNA, 64 nt, Homo Sapiens; identical to SEQ ID NO: 101515

SEQ ID NO: 719623 - RNA, 64 nt, Homo Sapiens; identical to SEQ ID NO: 101516

SEQ ID NO: 719624 - RNA, 64 nt, Homo Sapiens; identical to SEQ ID NO: 101517

SEQ ID NO: 719625 - RNA, 64 nt, Homo Sapiens; identical to SEQ ID NO: 101518

SEQ ID NO: 719626 - RNA, 64 nt, Homo Sapiens; identical to SEQ ID NO: 101519

SEQ ID NO: 719627 - RNA, 64 nt, Homo Sapiens; identical to SEQ ID NO: 101520

SEQ ID NO: 719628 - RNA, 64 nt, Homo Sapiens; identical to SEQ ID NO: 101521

SEQ ID NO: 719629 - RNA, 64 nt, Homo Sapiens; identical to SEQ ID NO: 101522

SEQ ID NO: 719630 - RNA, 64 nt, Homo Sapiens; identical to SEQ ID NO: 101523

SEQ ID NO: 719631 - RNA, 64 nt, Homo Sapiens; identical to SEQ ID NO: 101524

SEQ ID NO: 719632 - RNA, 64 nt, Homo Sapiens; identical to SEQ ID NO: 101525

SEQ ID NO: 719633 - RNA, 64 nt, Homo Sapiens; identical to SEQ ID NO: 101526

SEQ ID NO: 719634 - RNA, 64 nt, Homo Sapiens; identical to SEQ ID NO: 101527

SEQ ID NO: 719635 - RNA, 64 nt, Homo Sapiens; identical to SEQ ID NO: 101528

SEQ ID NO: 719636 - RNA, 64 nt, Homo Sapiens; identical to SEQ ID NO: 101529

SEQ ID NO: 719637 - RNA, 64 nt, Homo Sapiens; identical to SEQ ID NO: 101530

SEQ ID NO: 719638 - RNA, 64 nt, Homo Sapiens; identical to SEQ ID NO: 101531

SEQ ID NO: 719639 - RNA, 64 nt, Homo Sapiens; identical to SEQ ID NO: 101532

SEQ ID NO: 719640 - RNA, 64 nt, Homo Sapiens; identical to SEQ ID NO: 101533

SEQ ID NO: 719641 - RNA, 64 nt, Homo Sapiens; identical to SEQ ID NO: 101534

SEQ ID NO: 719642 - RNA, 64 nt, Homo Sapiens; identical to SEQ ID NO: 101535

SEQ ID NO: 719643 - RNA, 64 nt, Homo Sapiens; identical to SEQ ID NO: 101536

SEQ ID NO: 719644 - RNA, 64 nt, Homo Sapiens; identical to SEQ ID NO: 101537

SEQ ID NO: 719645 - RNA, 64 nt, Homo Sapiens; identical to SEQ ID NO: 101538

SEQ ID NO: 719646 - RNA, 64 nt, Homo Sapiens; identical to SEQ ID NO: 101539

SEQ ID NO: 719647 - RNA, 64 nt, Homo Sapiens; identical to SEQ ID NO: 101540

SEQ ID NO: 719648 - RNA, 64 nt, Homo Sapiens; identical to SEQ ID NO: 101541

SEQ ID NO: 719649 - RNA, 64 nt, Homo Sapiens; identical to SEQ ID NO: 101542

SEQ ID NO: 719650 - RNA, 64 nt, Homo Sapiens; identical to SEQ ID NO: 101543

SEQ ID NO: 719651 - RNA, 64 nt, Homo Sapiens; identical to SEQ ID NO: 101544

SEQ ID NO: 719652 - RNA, 64 nt, Homo Sapiens; identical to SEQ ID NO: 101545

SEQ ID NO: 719653 - RNA, 64 nt, Homo Sapiens; identical to SEQ ID NO: 101546

SEQ ID NO: 719654 - RNA, 64 nt, Homo Sapiens; identical to SEQ ID NO: 101547

SEQ ID NO: 719655 - RNA, 64 nt, Homo Sapiens; identical to SEQ ID NO: 101548

SEQ ID NO: 719656 - RNA, 64 nt, Homo Sapiens; identical to SEQ ID NO: 101549

SEQ ID NO: 719657 - RNA, 64 nt, Homo Sapiens; identical to SEQ ID NO: 101550

SEQ ID NO: 719658 - RNA, 64 nt, Homo Sapiens; identical to SEQ ID NO: 101551

SEQ ID NO: 719659 - RNA, 64 nt, Homo Sapiens; identical to SEQ ID NO: 101552

SEQ ID NO: 719660 - RNA, 64 nt, Homo Sapiens; identical to SEQ ID NO: 101553

SEQ ID NO: 719661 - RNA, 64 nt, Homo Sapiens; identical to SEQ ID NO: 101554

SEQ ID NO: 719662 - RNA, 64 nt, Homo Sapiens; identical to SEQ ID NO: 101555

SEQ ID NO: 719663 - RNA, 64 nt, Homo Sapiens; identical to SEQ ID NO: 101556

SEQ ID NO: 719664 - RNA, 64 nt, Homo Sapiens; identical to SEQ ID NO: 101557

SEQ ID NO: 719665 - RNA, 64 nt, Homo Sapiens; identical to SEQ ID NO: 101558

SEQ ID NO: 719666 - RNA, 64 nt, Homo Sapiens; identical to SEQ ID NO: 101559

SEQ ID NO: 719667 - RNA, 64 nt, Homo Sapiens; identical to SEQ ID NO: 101560

SEQ ID NO: 719668 - RNA, 64 nt, Homo Sapiens; identical to SEQ ID NO: 101561

SEQ ID NO: 719669 - RNA, 64 nt, Homo Sapiens; identical to SEQ ID NO: 101562

SEQ ID NO: 719670 - RNA, 64 nt, Homo Sapiens; identical to SEQ ID NO: 101563

SEQ ID NO: 719671 - RNA, 64 nt, Homo Sapiens; identical to SEQ ID NO: 101564

SEQ ID NO: 719672 - RNA, 64 nt, Homo Sapiens; identical to SEQ ID NO: 101565

SEQ ID NO: 719673 - RNA, 64 nt, Homo Sapiens; identical to SEQ ID NO: 101566

SEQ ID NO: 719674 - RNA, 64 nt, Homo Sapiens; identical to SEQ ID NO: 101567

SEQ ID NO: 719675 - RNA, 64 nt, Homo Sapiens; identical to SEQ ID NO: 101568

SEQ ID NO: 719676 - RNA, 64 nt, Homo Sapiens; identical to SEQ ID NO: 101569

SEQ ID NO: 719677 - RNA, 64 nt, Homo Sapiens; identical to SEQ ID NO: 101570

SEQ ID NO: 719678 - RNA, 64 nt, Homo Sapiens; identical to SEQ ID NO: 101571

SEQ ID NO: 719679 - RNA, 64 nt, Homo Sapiens; identical to SEQ ID NO: 101572

SEQ ID NO: 719680 - RNA, 64 nt, Homo Sapiens; identical to SEQ ID NO: 101573

SEQ ID NO: 719681 - RNA, 64 nt, Homo Sapiens; identical to SEQ ID NO: 101574

SEQ ID NO: 719682 - RNA, 64 nt, Homo Sapiens; identical to SEQ ID NO: 101575

SEQ ID NO: 719683 - RNA, 64 nt, Homo Sapiens; identical to SEQ ID NO: 101576

SEQ ID NO: 719684 - RNA, 64 nt, Homo Sapiens; identical to SEQ ID NO: 101577

SEQ ID NO: 719685 - RNA, 64 nt, Homo Sapiens; identical to SEQ ID NO: 101578

SEQ ID NO: 719686 - RNA, 64 nt, Homo Sapiens; identical to SEQ ID NO: 101579

SEQ ID NO: 719687 - RNA, 64 nt, Homo Sapiens; identical to SEQ ID NO: 101580

SEQ ID NO: 719688 - RNA, 64 nt, Homo Sapiens; identical to SEQ ID NO: 101581

SEQ ID NO: 719689 - RNA, 64 nt, Homo Sapiens; identical to SEQ ID NO: 101582

SEQ ID NO: 719690 - RNA, 64 nt, Homo Sapiens; identical to SEQ ID NO: 101583

SEQ ID NO: 719691 - RNA, 64 nt, Homo Sapiens; identical to SEQ ID NO: 101584

SEQ ID NO: 719692 - RNA, 64 nt, Homo Sapiens; identical to SEQ ID NO: 101585

SEQ ID NO: 719693 - RNA, 64 nt, Homo Sapiens; identical to SEQ ID NO: 101586

SEQ ID NO: 719694 - RNA, 64 nt, Homo Sapiens; identical to SEQ ID NO: 101587

SEQ ID NO: 719695 - RNA, 64 nt, Homo Sapiens; identical to SEQ ID NO: 101588

SEQ ID NO: 719696 - RNA, 64 nt, Homo Sapiens; identical to SEQ ID NO: 101589

SEQ ID NO: 719697 - RNA, 64 nt, Homo Sapiens; identical to SEQ ID NO: 101590

SEQ ID NO: 719698 - RNA, 64 nt, Homo Sapiens; identical to SEQ ID NO: 101591

SEQ ID NO: 719699 - RNA, 64 nt, Homo Sapiens; identical to SEQ ID NO: 101592

SEQ ID NO: 719700 - RNA, 64 nt, Homo Sapiens; identical to SEQ ID NO: 101593

SEQ ID NO: 719701 - RNA, 64 nt, Homo Sapiens; identical to SEQ ID NO: 101594

SEQ ID NO: 719702 - RNA, 64 nt, Homo Sapiens; identical to SEQ ID NO: 101595

SEQ ID NO: 719703 - RNA, 64 nt, Homo Sapiens; identical to SEQ ID NO: 101596

SEQ ID NO: 719704 - RNA, 64 nt, Homo Sapiens; identical to SEQ ID NO: 101597

SEQ ID NO: 719705 - RNA, 64 nt, Homo Sapiens; identical to SEQ ID NO: 101598

SEQ ID NO: 719706 - RNA, 64 nt, Homo Sapiens; identical to SEQ ID NO: 101599

SEQ ID NO: 719707 - RNA, 64 nt, Homo Sapiens; identical to SEQ ID NO: 101600

SEQ ID NO: 719708 - RNA, 64 nt, Homo Sapiens; identical to SEQ ID NO: 101601

SEQ ID NO: 719709 - RNA, 64 nt, Homo Sapiens; identical to SEQ ID NO: 101602

SEQ ID NO: 719710 - RNA, 64 nt, Homo Sapiens; identical to SEQ ID NO: 101603

SEQ ID NO: 719711 - RNA, 64 nt, Homo Sapiens; identical to SEQ ID NO: 101604

SEQ ID NO: 719712 - RNA, 64 nt, Homo Sapiens; identical to SEQ ID NO: 101605

SEQ ID NO: 719713 - RNA, 64 nt, Homo Sapiens; identical to SEQ ID NO: 101606

SEQ ID NO: 719714 - RNA, 64 nt, Homo Sapiens; identical to SEQ ID NO: 101607

SEQ ID NO: 719715 - RNA, 64 nt, Homo Sapiens; identical to SEQ ID NO: 101608

SEQ ID NO: 719716 - RNA, 64 nt, Homo Sapiens; identical to SEQ ID NO: 101609

SEQ ID NO: 719717 - RNA, 64 nt, Homo Sapiens; identical to SEQ ID NO: 101610

SEQ ID NO: 719718 - RNA, 64 nt, Homo Sapiens; identical to SEQ ID NO: 101611

SEQ ID NO: 719719 - RNA, 64 nt, Homo Sapiens; identical to SEQ ID NO: 101612

SEQ ID NO: 719720 - RNA, 64 nt, Homo Sapiens; identical to SEQ ID NO: 101613

SEQ ID NO: 719721 - RNA, 64 nt, Homo Sapiens; identical to SEQ ID NO: 101614

SEQ ID NO: 719722 - RNA, 64 nt, Homo Sapiens; identical to SEQ ID NO: 101615

SEQ ID NO: 719723 - RNA, 64 nt, Homo Sapiens; identical to SEQ ID NO: 101616

SEQ ID NO: 719724 - RNA, 64 nt, Homo Sapiens; identical to SEQ ID NO: 101617

SEQ ID NO: 719725 - RNA, 64 nt, Homo Sapiens; identical to SEQ ID NO: 101618

SEQ ID NO: 719726 - RNA, 64 nt, Homo Sapiens; identical to SEQ ID NO: 101619

SEQ ID NO: 719727 - RNA, 64 nt, Homo Sapiens; identical to SEQ ID NO: 101620

SEQ ID NO: 719728 - RNA, 64 nt, Homo Sapiens; identical to SEQ ID NO: 101621

SEQ ID NO: 719729 - RNA, 64 nt, Homo Sapiens; identical to SEQ ID NO: 101622

SEQ ID NO: 719730 - RNA, 64 nt, Homo Sapiens; identical to SEQ ID NO: 101623

SEQ ID NO: 719731 - RNA, 64 nt, Homo Sapiens; identical to SEQ ID NO: 101624

SEQ ID NO: 719732 - RNA, 64 nt, Homo Sapiens; identical to SEQ ID NO: 101625

SEQ ID NO: 719733 - RNA, 64 nt, Homo Sapiens; identical to SEQ ID NO: 101626

SEQ ID NO: 719734 - RNA, 64 nt, Homo Sapiens; identical to SEQ ID NO: 101627

SEQ ID NO: 719735 - RNA, 64 nt, Homo Sapiens; identical to SEQ ID NO: 101628

SEQ ID NO: 719736 - RNA, 64 nt, Homo Sapiens; identical to SEQ ID NO: 101629

SEQ ID NO: 719737 - RNA, 64 nt, Homo Sapiens; identical to SEQ ID NO: 101630

SEQ ID NO: 719738 - RNA, 64 nt, Homo Sapiens; identical to SEQ ID NO: 101631

SEQ ID NO: 719739 - RNA, 64 nt, Homo Sapiens; identical to SEQ ID NO: 101632

SEQ ID NO: 719740 - RNA, 64 nt, Homo Sapiens; identical to SEQ ID NO: 101633

SEQ ID NO: 719741 - RNA, 64 nt, Homo Sapiens; identical to SEQ ID NO: 101634

SEQ ID NO: 719742 - RNA, 64 nt, Homo Sapiens; identical to SEQ ID NO: 101635

SEQ ID NO: 719743 - RNA, 64 nt, Homo Sapiens; identical to SEQ ID NO: 101636

SEQ ID NO: 719744 - RNA, 64 nt, Homo Sapiens; identical to SEQ ID NO: 101637

SEQ ID NO: 719745 - RNA, 64 nt, Homo Sapiens; identical to SEQ ID NO: 101638

SEQ ID NO: 719746 - RNA, 64 nt, Homo Sapiens; identical to SEQ ID NO: 101639

SEQ ID NO: 719747 - RNA, 64 nt, Homo Sapiens; identical to SEQ ID NO: 101640

SEQ ID NO: 719748 - RNA, 64 nt, Homo Sapiens; identical to SEQ ID NO: 101641

SEQ ID NO: 719749 - RNA, 64 nt, Homo Sapiens; identical to SEQ ID NO: 101642

SEQ ID NO: 719750 - RNA, 64 nt, Homo Sapiens; identical to SEQ ID NO: 101643

SEQ ID NO: 719751 - RNA, 64 nt, Homo Sapiens; identical to SEQ ID NO: 101644

SEQ ID NO: 719752 - RNA, 64 nt, Homo Sapiens; identical to SEQ ID NO: 101645

SEQ ID NO: 719753 - RNA, 64 nt, Homo Sapiens; identical to SEQ ID NO: 101646

SEQ ID NO: 719754 - RNA, 64 nt, Homo Sapiens; identical to SEQ ID NO: 101647

SEQ ID NO: 719755 - RNA, 64 nt, Homo Sapiens; identical to SEQ ID NO: 101648

SEQ ID NO: 719756 - RNA, 64 nt, Homo Sapiens; identical to SEQ ID NO: 101649

SEQ ID NO: 719757 - RNA, 64 nt, Homo Sapiens; identical to SEQ ID NO: 101650

SEQ ID NO: 719758 - RNA, 64 nt, Homo Sapiens; identical to SEQ ID NO: 101651

SEQ ID NO: 719759 - RNA, 64 nt, Homo Sapiens; identical to SEQ ID NO: 101652

SEQ ID NO: 719760 - RNA, 64 nt, Homo Sapiens; identical to SEQ ID NO: 101653

SEQ ID NO: 719761 - RNA, 64 nt, Homo Sapiens; identical to SEQ ID NO: 101654

SEQ ID NO: 719762 - RNA, 64 nt, Homo Sapiens; identical to SEQ ID NO: 101655

SEQ ID NO: 719763 - RNA, 64 nt, Homo Sapiens; identical to SEQ ID NO: 101656

SEQ ID NO: 719764 - RNA, 64 nt, Homo Sapiens; identical to SEQ ID NO: 101657

SEQ ID NO: 719765 - RNA, 64 nt, Homo Sapiens; identical to SEQ ID NO: 101658

SEQ ID NO: 719766 - RNA, 64 nt, Homo Sapiens; identical to SEQ ID NO: 101659

SEQ ID NO: 719767 - RNA, 64 nt, Homo Sapiens; identical to SEQ ID NO: 101660

SEQ ID NO: 719768 - RNA, 64 nt, Homo Sapiens; identical to SEQ ID NO: 101661

SEQ ID NO: 719769 - RNA, 64 nt, Homo Sapiens; identical to SEQ ID NO: 101662

SEQ ID NO: 719770 - RNA, 64 nt, Homo Sapiens; identical to SEQ ID NO: 101663

SEQ ID NO: 719771 - RNA, 64 nt, Homo Sapiens; identical to SEQ ID NO: 101664

SEQ ID NO: 719772 - RNA, 64 nt, Homo Sapiens; identical to SEQ ID NO: 101665

SEQ ID NO: 719773 - RNA, 64 nt, Homo Sapiens; identical to SEQ ID NO: 101666

SEQ ID NO: 719774 - RNA, 64 nt, Homo Sapiens; identical to SEQ ID NO: 101667

SEQ ID NO: 719775 - RNA, 64 nt, Homo Sapiens; identical to SEQ ID NO: 101668

SEQ ID NO: 719776 - RNA, 64 nt, Homo Sapiens; identical to SEQ ID NO: 101669

SEQ ID NO: 719777 - RNA, 64 nt, Homo Sapiens; identical to SEQ ID NO: 101670

SEQ ID NO: 719778 - RNA, 64 nt, Homo Sapiens; identical to SEQ ID NO: 101671

SEQ ID NO: 719779 - RNA, 64 nt, Homo Sapiens; identical to SEQ ID NO: 101672

SEQ ID NO: 719780 - RNA, 64 nt, Homo Sapiens; identical to SEQ ID NO: 101673

SEQ ID NO: 719781 - RNA, 64 nt, Homo Sapiens; identical to SEQ ID NO: 101674

SEQ ID NO: 719782 - RNA, 64 nt, Homo Sapiens; identical to SEQ ID NO: 101675

SEQ ID NO: 719783 - RNA, 64 nt, Homo Sapiens; identical to SEQ ID NO: 101676

SEQ ID NO: 719784 - RNA, 64 nt, Homo Sapiens; identical to SEQ ID NO: 101677

SEQ ID NO: 719785 - RNA, 64 nt, Homo Sapiens; identical to SEQ ID NO: 101678

SEQ ID NO: 719786 - RNA, 64 nt, Homo Sapiens; identical to SEQ ID NO: 101679

SEQ ID NO: 719787 - RNA, 64 nt, Homo Sapiens; identical to SEQ ID NO: 101680

SEQ ID NO: 719788 - RNA, 64 nt, Homo Sapiens; identical to SEQ ID NO: 101681

SEQ ID NO: 719789 - RNA, 64 nt, Homo Sapiens; identical to SEQ ID NO: 101682

SEQ ID NO: 719790 - RNA, 64 nt, Homo Sapiens; identical to SEQ ID NO: 101683

SEQ ID NO: 719791 - RNA, 64 nt, Homo Sapiens; identical to SEQ ID NO: 101684

SEQ ID NO: 719792 - RNA, 64 nt, Homo Sapiens; identical to SEQ ID NO: 101685

SEQ ID NO: 719793 - RNA, 64 nt, Homo Sapiens; identical to SEQ ID NO: 101686

SEQ ID NO: 719794 - RNA, 64 nt, Homo Sapiens; identical to SEQ ID NO: 101687

SEQ ID NO: 719795 - RNA, 64 nt, Homo Sapiens; identical to SEQ ID NO: 101688

SEQ ID NO: 719796 - RNA, 64 nt, Homo Sapiens; identical to SEQ ID NO: 101689

SEQ ID NO: 719797 - RNA, 64 nt, Homo Sapiens; identical to SEQ ID NO: 101690

SEQ ID NO: 719798 - RNA, 64 nt, Homo Sapiens; identical to SEQ ID NO: 101691

SEQ ID NO: 719799 - RNA, 64 nt, Homo Sapiens; identical to SEQ ID NO: 101692

SEQ ID NO: 719800 - RNA, 64 nt, Homo Sapiens; identical to SEQ ID NO: 101693

SEQ ID NO: 719801 - RNA, 64 nt, Homo Sapiens; identical to SEQ ID NO: 101694

SEQ ID NO: 719802 - RNA, 64 nt, Homo Sapiens; identical to SEQ ID NO: 101695

SEQ ID NO: 719803 - RNA, 64 nt, Homo Sapiens; identical to SEQ ID NO: 101696

SEQ ID NO: 719804 - RNA, 64 nt, Homo Sapiens; identical to SEQ ID NO: 101697

SEQ ID NO: 719805 - RNA, 64 nt, Homo Sapiens; identical to SEQ ID NO: 101698

SEQ ID NO: 719806 - RNA, 64 nt, Homo Sapiens; identical to SEQ ID NO: 101699

SEQ ID NO: 719807 - RNA, 64 nt, Homo Sapiens; identical to SEQ ID NO: 101700

SEQ ID NO: 719808 - RNA, 64 nt, Homo Sapiens; identical to SEQ ID NO: 101701

SEQ ID NO: 719809 - RNA, 64 nt, Homo Sapiens; identical to SEQ ID NO: 101702

SEQ ID NO: 719810 - RNA, 64 nt, Homo Sapiens; identical to SEQ ID NO: 101703

SEQ ID NO: 719811 - RNA, 64 nt, Homo Sapiens; identical to SEQ ID NO: 101704

SEQ ID NO: 719812 - RNA, 64 nt, Homo Sapiens; identical to SEQ ID NO: 101705

SEQ ID NO: 719813 - RNA, 64 nt, Homo Sapiens; identical to SEQ ID NO: 101706

SEQ ID NO: 719814 - RNA, 64 nt, Homo Sapiens; identical to SEQ ID NO: 101707

SEQ ID NO: 719815 - RNA, 64 nt, Homo Sapiens; identical to SEQ ID NO: 101708

SEQ ID NO: 719816 - RNA, 64 nt, Homo Sapiens; identical to SEQ ID NO: 101709

SEQ ID NO: 719817 - RNA, 64 nt, Homo Sapiens; identical to SEQ ID NO: 101710

SEQ ID NO: 719818 - RNA, 64 nt, Homo Sapiens; identical to SEQ ID NO: 101711

SEQ ID NO: 719819 - RNA, 64 nt, Homo Sapiens; identical to SEQ ID NO: 101712

SEQ ID NO: 719820 - RNA, 64 nt, Homo Sapiens; identical to SEQ ID NO: 101713

SEQ ID NO: 719821 - RNA, 64 nt, Homo Sapiens; identical to SEQ ID NO: 101714

SEQ ID NO: 719822 - RNA, 64 nt, Homo Sapiens; identical to SEQ ID NO: 101715

SEQ ID NO: 719823 - RNA, 64 nt, Homo Sapiens; identical to SEQ ID NO: 101716

SEQ ID NO: 719824 - RNA, 64 nt, Homo Sapiens; identical to SEQ ID NO: 101717

SEQ ID NO: 719825 - RNA, 64 nt, Homo Sapiens; identical to SEQ ID NO: 101718

SEQ ID NO: 719826 - RNA, 64 nt, Homo Sapiens; identical to SEQ ID NO: 101719

SEQ ID NO: 719827 - RNA, 64 nt, Homo Sapiens; identical to SEQ ID NO: 101720

SEQ ID NO: 719828 - RNA, 64 nt, Homo Sapiens; identical to SEQ ID NO: 101721

SEQ ID NO: 719829 - RNA, 64 nt, Homo Sapiens; identical to SEQ ID NO: 101722

SEQ ID NO: 719830 - RNA, 64 nt, Homo Sapiens; identical to SEQ ID NO: 101723

SEQ ID NO: 719831 - RNA, 64 nt, Homo Sapiens; identical to SEQ ID NO: 101724

SEQ ID NO: 719832 - RNA, 64 nt, Homo Sapiens; identical to SEQ ID NO: 101725

SEQ ID NO: 719833 - RNA, 64 nt, Homo Sapiens; identical to SEQ ID NO: 101726

SEQ ID NO: 719834 - RNA, 64 nt, Homo Sapiens; identical to SEQ ID NO: 101727

SEQ ID NO: 719835 - RNA, 64 nt, Homo Sapiens; identical to SEQ ID NO: 101728

SEQ ID NO: 719836 - RNA, 64 nt, Homo Sapiens; identical to SEQ ID NO: 101729

SEQ ID NO: 719837 - RNA, 64 nt, Homo Sapiens; identical to SEQ ID NO: 101730

SEQ ID NO: 719838 - RNA, 64 nt, Homo Sapiens; identical to SEQ ID NO: 101731

SEQ ID NO: 719839 - RNA, 64 nt, Homo Sapiens; identical to SEQ ID NO: 101732

SEQ ID NO: 719840 - RNA, 64 nt, Homo Sapiens; identical to SEQ ID NO: 101733

SEQ ID NO: 719841 - RNA, 64 nt, Homo Sapiens; identical to SEQ ID NO: 101734

SEQ ID NO: 719842 - RNA, 64 nt, Homo Sapiens; identical to SEQ ID NO: 101735

SEQ ID NO: 719843 - RNA, 64 nt, Homo Sapiens; identical to SEQ ID NO: 101736

SEQ ID NO: 719844 - RNA, 64 nt, Homo Sapiens; identical to SEQ ID NO: 101737

SEQ ID NO: 719845 - RNA, 64 nt, Homo Sapiens; identical to SEQ ID NO: 101738

SEQ ID NO: 719846 - RNA, 64 nt, Homo Sapiens; identical to SEQ ID NO: 101739

SEQ ID NO: 719847 - RNA, 64 nt, Homo Sapiens; identical to SEQ ID NO: 101740

SEQ ID NO: 719848 - RNA, 64 nt, Homo Sapiens; identical to SEQ ID NO: 101741

SEQ ID NO: 719849 - RNA, 64 nt, Homo Sapiens; identical to SEQ ID NO: 101742

SEQ ID NO: 719850 - RNA, 64 nt, Homo Sapiens; identical to SEQ ID NO: 101743

SEQ ID NO: 719851 - RNA, 64 nt, Homo Sapiens; identical to SEQ ID NO: 101744

SEQ ID NO: 719852 - RNA, 64 nt, Homo Sapiens; identical to SEQ ID NO: 101745

SEQ ID NO: 719853 - RNA, 64 nt, Homo Sapiens; identical to SEQ ID NO: 101746

SEQ ID NO: 719854 - RNA, 64 nt, Homo Sapiens; identical to SEQ ID NO: 101747

SEQ ID NO: 719855 - RNA, 64 nt, Homo Sapiens; identical to SEQ ID NO: 101748

SEQ ID NO: 719856 - RNA, 64 nt, Homo Sapiens; identical to SEQ ID NO: 101749

SEQ ID NO: 719857 - RNA, 64 nt, Homo Sapiens; identical to SEQ ID NO: 101750

SEQ ID NO: 719858 - RNA, 64 nt, Homo Sapiens; identical to SEQ ID NO: 101751

SEQ ID NO: 719859 - RNA, 64 nt, Homo Sapiens; identical to SEQ ID NO: 101752

SEQ ID NO: 719860 - RNA, 64 nt, Homo Sapiens; identical to SEQ ID NO: 101753

SEQ ID NO: 719861 - RNA, 64 nt, Homo Sapiens; identical to SEQ ID NO: 101754

SEQ ID NO: 719862 - RNA, 64 nt, Homo Sapiens; identical to SEQ ID NO: 101755

SEQ ID NO: 719863 - RNA, 64 nt, Homo Sapiens; identical to SEQ ID NO: 101756

SEQ ID NO: 719864 - RNA, 64 nt, Homo Sapiens; identical to SEQ ID NO: 101757

SEQ ID NO: 719865 - RNA, 64 nt, Homo Sapiens; identical to SEQ ID NO: 101758

SEQ ID NO: 719866 - RNA, 64 nt, Homo Sapiens; identical to SEQ ID NO: 101759

SEQ ID NO: 719867 - RNA, 64 nt, Homo Sapiens; identical to SEQ ID NO: 101760

SEQ ID NO: 719868 - RNA, 64 nt, Homo Sapiens; identical to SEQ ID NO: 101761

SEQ ID NO: 719869 - RNA, 64 nt, Homo Sapiens; identical to SEQ ID NO: 101762

SEQ ID NO: 719870 - RNA, 64 nt, Homo Sapiens; identical to SEQ ID NO: 101763

SEQ ID NO: 719871 - RNA, 64 nt, Homo Sapiens; identical to SEQ ID NO: 101764

SEQ ID NO: 719872 - RNA, 64 nt, Homo Sapiens; identical to SEQ ID NO: 101765

SEQ ID NO: 719873 - RNA, 64 nt, Homo Sapiens; identical to SEQ ID NO: 101766

SEQ ID NO: 719874 - RNA, 64 nt, Homo Sapiens; identical to SEQ ID NO: 101767

SEQ ID NO: 719875 - RNA, 64 nt, Homo Sapiens; identical to SEQ ID NO: 101768

SEQ ID NO: 719876 - RNA, 64 nt, Homo Sapiens; identical to SEQ ID NO: 101769

SEQ ID NO: 719877 - RNA, 64 nt, Homo Sapiens; identical to SEQ ID NO: 101770

SEQ ID NO: 719878 - RNA, 64 nt, Homo Sapiens; identical to SEQ ID NO: 101771

SEQ ID NO: 719879 - RNA, 64 nt, Homo Sapiens; identical to SEQ ID NO: 101772

SEQ ID NO: 719880 - RNA, 64 nt, Homo Sapiens; identical to SEQ ID NO: 101773

SEQ ID NO: 719881 - RNA, 64 nt, Homo Sapiens; identical to SEQ ID NO: 101774

SEQ ID NO: 719882 - RNA, 64 nt, Homo Sapiens; identical to SEQ ID NO: 101775

SEQ ID NO: 719883 - RNA, 64 nt, Homo Sapiens; identical to SEQ ID NO: 101776

SEQ ID NO: 719884 - RNA, 64 nt, Homo Sapiens; identical to SEQ ID NO: 101777

SEQ ID NO: 719885 - RNA, 64 nt, Homo Sapiens; identical to SEQ ID NO: 101778

SEQ ID NO: 719886 - RNA, 64 nt, Homo Sapiens; identical to SEQ ID NO: 101779

SEQ ID NO: 719887 - RNA, 64 nt, Homo Sapiens; identical to SEQ ID NO: 101780

SEQ ID NO: 719888 - RNA, 64 nt, Homo Sapiens; identical to SEQ ID NO: 101781

SEQ ID NO: 719889 - RNA, 64 nt, Homo Sapiens; identical to SEQ ID NO: 101782

SEQ ID NO: 719890 - RNA, 64 nt, Homo Sapiens; identical to SEQ ID NO: 101783

SEQ ID NO: 719891 - RNA, 64 nt, Homo Sapiens; identical to SEQ ID NO: 101784

SEQ ID NO: 719892 - RNA, 64 nt, Homo Sapiens; identical to SEQ ID NO: 101785

SEQ ID NO: 719893 - RNA, 64 nt, Homo Sapiens; identical to SEQ ID NO: 101786

SEQ ID NO: 719894 - RNA, 64 nt, Homo Sapiens; identical to SEQ ID NO: 101787

SEQ ID NO: 719895 - RNA, 64 nt, Homo Sapiens; identical to SEQ ID NO: 101788

SEQ ID NO: 719896 - RNA, 64 nt, Homo Sapiens; identical to SEQ ID NO: 101789

SEQ ID NO: 719897 - RNA, 64 nt, Homo Sapiens; identical to SEQ ID NO: 101790

SEQ ID NO: 719898 - RNA, 64 nt, Homo Sapiens; identical to SEQ ID NO: 101791

SEQ ID NO: 719899 - RNA, 64 nt, Homo Sapiens; identical to SEQ ID NO: 101792

SEQ ID NO: 719900 - RNA, 64 nt, Homo Sapiens; identical to SEQ ID NO: 101793

SEQ ID NO: 719901 - RNA, 64 nt, Homo Sapiens; identical to SEQ ID NO: 101794

SEQ ID NO: 719902 - RNA, 64 nt, Homo Sapiens; identical to SEQ ID NO: 101795

SEQ ID NO: 719903 - RNA, 64 nt, Homo Sapiens; identical to SEQ ID NO: 101796

SEQ ID NO: 719904 - RNA, 64 nt, Homo Sapiens; identical to SEQ ID NO: 101797

SEQ ID NO: 719905 - RNA, 64 nt, Homo Sapiens; identical to SEQ ID NO: 101798

SEQ ID NO: 719906 - RNA, 64 nt, Homo Sapiens; identical to SEQ ID NO: 101799

SEQ ID NO: 719907 - RNA, 64 nt, Homo Sapiens; identical to SEQ ID NO: 101800

SEQ ID NO: 719908 - RNA, 64 nt, Homo Sapiens; identical to SEQ ID NO: 101801

SEQ ID NO: 719909 - RNA, 64 nt, Homo Sapiens; identical to SEQ ID NO: 101802

SEQ ID NO: 719910 - RNA, 64 nt, Homo Sapiens; identical to SEQ ID NO: 101803

SEQ ID NO: 719911 - RNA, 59 nt, Homo Sapiens; identical to SEQ ID NO: 101291

SEQ ID NO: 719912 - RNA, 64 nt, Homo Sapiens; identical to SEQ ID NO: 101805

SEQ ID NO: 719913 - RNA, 64 nt, Homo Sapiens; identical to SEQ ID NO: 101806

SEQ ID NO: 719914 - RNA, 64 nt, Homo Sapiens; identical to SEQ ID NO: 101807

SEQ ID NO: 719915 - RNA, 64 nt, Homo Sapiens; identical to SEQ ID NO: 101808

SEQ ID NO: 719916 - RNA, 64 nt, Homo Sapiens; identical to SEQ ID NO: 101809

SEQ ID NO: 719917 - RNA, 64 nt, Homo Sapiens; identical to SEQ ID NO: 101810

SEQ ID NO: 719918 - RNA, 64 nt, Homo Sapiens; identical to SEQ ID NO: 101811

SEQ ID NO: 719919 - RNA, 64 nt, Homo Sapiens; identical to SEQ ID NO: 101812

SEQ ID NO: 719920 - RNA, 64 nt, Homo Sapiens; identical to SEQ ID NO: 101813

SEQ ID NO: 719921 - RNA, 64 nt, Homo Sapiens; identical to SEQ ID NO: 101814

SEQ ID NO: 719922 - RNA, 64 nt, Homo Sapiens; identical to SEQ ID NO: 101815

SEQ ID NO: 719923 - RNA, 64 nt, Homo Sapiens; identical to SEQ ID NO: 101816

SEQ ID NO: 719924 - RNA, 64 nt, Homo Sapiens; identical to SEQ ID NO: 101817

SEQ ID NO: 719925 - RNA, 64 nt, Homo Sapiens; identical to SEQ ID NO: 101818

SEQ ID NO: 719926 - RNA, 64 nt, Homo Sapiens; identical to SEQ ID NO: 101819

SEQ ID NO: 719927 - RNA, 64 nt, Homo Sapiens; identical to SEQ ID NO: 101820

SEQ ID NO: 719928 - RNA, 64 nt, Homo Sapiens; identical to SEQ ID NO: 101821

SEQ ID NO: 719929 - RNA, 64 nt, Homo Sapiens; identical to SEQ ID NO: 101822

SEQ ID NO: 719930 - RNA, 64 nt, Homo Sapiens; identical to SEQ ID NO: 101823

SEQ ID NO: 719931 - RNA, 64 nt, Homo Sapiens; identical to SEQ ID NO: 101824

SEQ ID NO: 719932 - RNA, 64 nt, Homo Sapiens; identical to SEQ ID NO: 101825

SEQ ID NO: 719933 - RNA, 64 nt, Homo Sapiens; identical to SEQ ID NO: 101826

SEQ ID NO: 719934 - RNA, 64 nt, Homo Sapiens; identical to SEQ ID NO: 101827

SEQ ID NO: 719935 - RNA, 64 nt, Homo Sapiens; identical to SEQ ID NO: 101828

SEQ ID NO: 719936 - RNA, 64 nt, Homo Sapiens; identical to SEQ ID NO: 101829

SEQ ID NO: 719937 - RNA, 64 nt, Homo Sapiens; identical to SEQ ID NO: 101830

SEQ ID NO: 719938 - RNA, 64 nt, Homo Sapiens; identical to SEQ ID NO: 94944

SEQ ID NO: 719939 - RNA, 64 nt, Homo Sapiens; identical to SEQ ID NO: 94945

SEQ ID NO: 719940 - RNA, 64 nt, Homo Sapiens; identical to SEQ ID NO: 94946

SEQ ID NO: 719941 - RNA, 64 nt, Homo Sapiens; identical to SEQ ID NO: 94947

SEQ ID NO: 719942 - RNA, 64 nt, Homo Sapiens; identical to SEQ ID NO: 94948

SEQ ID NO: 719943 - RNA, 64 nt, Homo Sapiens; identical to SEQ ID NO: 94949

SEQ ID NO: 719944 - RNA, 64 nt, Homo Sapiens; identical to SEQ ID NO: 94950

SEQ ID NO: 719945 - RNA, 59 nt, Homo Sapiens; identical to SEQ ID NO: 94951

SEQ ID NO: 719946 - RNA, 64 nt, Homo Sapiens; identical to SEQ ID NO: 94952

SEQ ID NO: 719947 - RNA, 64 nt, Homo Sapiens; identical to SEQ ID NO: 94953

SEQ ID NO: 719948 - RNA, 62 nt, Homo Sapiens; identical to SEQ ID NO: 94954

SEQ ID NO: 719949 - RNA, 64 nt, Homo Sapiens; identical to SEQ ID NO: 94955

SEQ ID NO: 719950 - RNA, 64 nt, Homo Sapiens
uguuaaugcccuauuuucuaauuuggcaccucuugaugccuaagcagguaagcagaugccuaag

SEQ ID NO: 719951 - RNA, 64 nt, Homo Sapiens
auuuggcaccucuugaugccuaagcagguaagcagaugccuaagcuguauuucuccaaauaaau

SEQ ID NO: 719952 - RNA, 64 nt, Homo Sapiens
cugcuggccuaaaaccacacuaaggagucucagggaugccuaugggccugagauucugcauuuc

SEQ ID NO: 719953 - RNA, 64 nt, Homo Sapiens
caaagaugaguuaaccaaagugugaacaugcccugaugccuaacaccugcugcuaacaccaagg

SEQ ID NO: 719954 - RNA, 64 nt, Homo Sapiens
gcucagccucggccgucugcccugcacuaccaaggccgaccacuagaggucagcgucgcgccgc

SEQ ID NO: 719955 - RNA, 64 nt, Homo Sapiens
gaagaauuacacuggccuuuguuuuucuggaaaugccgaccauggagaugcuuuagagucuucu

SEQ ID NO: 719956 - RNA, 64 nt, Homo Sapiens
aaaccucauuccuaccuacaucuagaacaauuaagccgaccaggaagggaauauugaggaauca

SEQ ID NO: 719957 - RNA, 62 nt, Homo Sapiens
cuugcucaucugaggaguugaggcccuuuuuagggccgaccauuugcacguuucgaucccaa

SEQ ID NO: 719958 - RNA, 64 nt, Homo Sapiens
agcgugaaauuagagcuggacuuaagacucauuggccgaccauccuguguccuggccuggcccu

SEQ ID NO: 719959 - RNA, 64 nt, Homo Sapiens
acuugggaucugaugggacaaugccgggcuccaggccgaccagcgcggcuccagauagaugggg

SEQ ID NO: 719960 - RNA, 64 nt, Homo Sapiens
caugccaagggaauccacccugcaguugcugagggccgaccaccugacagagccaaaugagggc

SEQ ID NO: 719961 - RNA, 64 nt, Homo Sapiens
guuugcuaaugcugcuuugcaaauaaaacuugcugccgaccacccacgggcauaaaaucaagug

SEQ ID NO: 719962 - RNA, 64 nt, Homo Sapiens
ucugcacugaagggcccucucgcggugaggccgcgccgaccaucgguuucgcgcugcuccugac

SEQ ID NO: 719963 - RNA, 64 nt, Homo Sapiens
agccaccccgccugcuucaugaggugccuccacagccgaccagccccucuaggcccugugccug

SEQ ID NO: 719964 - RNA, 64 nt, Homo Sapiens
uccuccuuccucugaguugaccagcagcaggucugccgaccaccagcaccauccucuccuccca

SEQ ID NO: 719965 - RNA, 64 nt, Homo Sapiens
caaagugcugggauuccaggugugagccgcugcggccgaccacauuugauguuugaaguuguaa

SEQ ID NO: 719966 - RNA, 64 nt, Homo Sapiens
auggaugcugcaaaaacguuacuccaaguacaaggccgaccacaccugcugugauuaacgagua

SEQ ID NO: 719967 - RNA, 64 nt, Homo Sapiens
ccuuauucucuucuaucuccguguccuagguccagccgaccauuccccagcacauacucccaua

SEQ ID NO: 719968 - RNA, 64 nt, Homo Sapiens
gcggggauagcaugcccaauuuguuucccucauggccgaccaggggcagcguacuucuaacuca

SEQ ID NO: 719969 - RNA, 64 nt, Homo Sapiens
cccagaaggcagggaaaggcucugaaagccagcugccgaccagagccccacacggaggcaucug

SEQ ID NO: 719970 - RNA, 64 nt, Homo Sapiens
uucucaugacagcuccaucaagaaugugggaugugccgaccaaggauuugagaaaguuguacag

SEQ ID NO: 719971 - RNA, 64 nt, Homo Sapiens
cggaguucagugccugggugcgccugccccuccugccgaccacagucugucuugcccgccugcc

SEQ ID NO: 719972 - RNA, 64 nt, Homo Sapiens
gacuuugugacuuaggcggcuguuggucgaagcggccgaccacucccguggaaugcucaccaca

SEQ ID NO: 719973 - RNA, 64 nt, Homo Sapiens
auugacuaguuuguuggacuuuuguucggugccagccgaccaaggggacccagagcgagauggg

SEQ ID NO: 719974 - RNA, 64 nt, Homo Sapiens
agcacuacagauugagcuuugaauguugucuuuugccgaccagguaucucccaccuaaaauaga

SEQ ID NO: 719975 - RNA, 64 nt, Homo Sapiens
ucacgauugcugaagccugagcaggucucugugggccgaccagaggggggcuucgagguggucc

SEQ ID NO: 719976 - RNA, 64 nt, Homo Sapiens
ggagccuuuuuaaaacacaucuguggaugccagggccgaccagauucgggcgucugugugcgcu

SEQ ID NO: 719977 - RNA, 64 nt, Homo Sapiens
cucgcaguugcaugugacagguuccgcuuugggagccgaccaucacccuucgcccagcaccgcg

SEQ ID NO: 719978 - RNA, 64 nt, Homo Sapiens
uuccuugccccugacauuuggacucuucccuugggccgaccacucuguucucauucuccuuccc

SEQ ID NO: 719979 - RNA, 64 nt, Homo Sapiens
gccaacgcccccucuguccuucccuggcccugcugccgaccaggagcugcccagccugugggcg

SEQ ID NO: 719980 - RNA, 64 nt, Homo Sapiens
cagacggaggggccccuggguuuguucagcagacgccgaccacuugaagaagaaagacauggua

SEQ ID NO: 719981 - RNA, 64 nt, Homo Sapiens
uguccaaugcugcugguuucucugauucuccucggccgaccaccaaaugaggaggcuguuuucc

SEQ ID NO: 719982 - RNA, 64 nt, Homo Sapiens
gcugcacuacagcccuggccuccacccccaccccgccgaccauccaagggagagugagaccugg

SEQ ID NO: 719983 - RNA, 64 nt, Homo Sapiens
cuauuaugcagcuuauuuuaccugaaacuguuaagccgaccaagaucccucccugcaagacaga

SEQ ID NO: 719984 - RNA, 64 nt, Homo Sapiens
gagccuguuggcaagagcugguauucccugcccagccgaccaaaugaccucugcauucuucagg

SEQ ID NO: 719985 - RNA, 64 nt, Homo Sapiens
augcggcuucucugccauuagcagcccugggcgggccgaccacacucgaggcugcggugcuacg

SEQ ID NO: 719986 - RNA, 64 nt, Homo Sapiens
cuggacacccucugccgaguccacugugacgucggccgaccaggucccagccacgcagggccau

SEQ ID NO: 719987 - RNA, 64 nt, Homo Sapiens
uagucacugcugcuacugccccugaccugggggagccgaccaaucugccagacacugcgccccg

SEQ ID NO: 719988 - RNA, 64 nt, Homo Sapiens
cucugcagugcaggagucacugauugaugggugugccgaccagcagcuucacaaaugucugcug

SEQ ID NO: 719989 - RNA, 64 nt, Homo Sapiens
aggccguccucuuugauaucaagccaagccgugagccgaccagaaaaaaaagacaaaaaaaaaa

SEQ ID NO: 719990 - RNA, 64 nt, Homo Sapiens
ggagccaagccuuuuccacuagagucucgugugugccgaccacacacacccagcaggcgcaacc

SEQ ID NO: 719991 - RNA, 64 nt, Homo Sapiens
cgcccucccggagagguggccgccaugcuucugugccgaccacgccccaggaccuccggagcgc

SEQ ID NO: 719992 - RNA, 64 nt, Homo Sapiens
aaggugucugcggaaacucggagcacgugaccaugccgaccacaucgcauugcuguugaauggu

SEQ ID NO: 719993 - RNA, 64 nt, Homo Sapiens
ucugguccccugcuuuuugagguuggguuaaaaugccgaccauggcagaggggucacagcucag

SEQ ID NO: 719994 - RNA, 64 nt, Homo Sapiens
ccccaggauggcggaagcucuccugaguuugagugccgaccaacgguucaggagaccggccugu

SEQ ID NO: 719995 - RNA, 64 nt, Homo Sapiens
aaugccugcuauaaaaauuugaaauauuagaauggccgaccauggcagugaccaggccucacua

SEQ ID NO: 719996 - RNA, 64 nt, Homo Sapiens; identical to SEQ ID NO: 670571

SEQ ID NO: 719997 - RNA, 64 nt, Homo Sapiens; identical to SEQ ID NO: 670572

SEQ ID NO: 719998 - RNA, 64 nt, Homo Sapiens; identical to SEQ ID NO: 670573

SEQ ID NO: 719999 - RNA, 64 nt, Homo Sapiens; identical to SEQ ID NO: 670574

SEQ ID NO: 720000 - RNA, 64 nt, Homo Sapiens; identical to SEQ ID NO: 670575

SEQ ID NO: 720001 - RNA, 64 nt, Homo Sapiens; identical to SEQ ID NO: 670576

SEQ ID NO: 720002 - RNA, 64 nt, Homo Sapiens; identical to SEQ ID NO: 670577

SEQ ID NO: 720003 - RNA, 64 nt, Homo Sapiens; identical to SEQ ID NO: 670578

SEQ ID NO: 720004 - RNA, 64 nt, Homo Sapiens; identical to SEQ ID NO: 670579

SEQ ID NO: 720005 - RNA, 64 nt, Homo Sapiens; identical to SEQ ID NO: 670580

SEQ ID NO: 720006 - RNA, 64 nt, Homo Sapiens; identical to SEQ ID NO: 670581

SEQ ID NO: 720007 - RNA, 64 nt, Homo Sapiens; identical to SEQ ID NO: 670582

SEQ ID NO: 720008 - RNA, 64 nt, Homo Sapiens; identical to SEQ ID NO: 670583

SEQ ID NO: 720009 - RNA, 64 nt, Homo Sapiens; identical to SEQ ID NO: 670584

SEQ ID NO: 720010 - RNA, 64 nt, Homo Sapiens; identical to SEQ ID NO: 670585

SEQ ID NO: 720011 - RNA, 64 nt, Homo Sapiens; identical to SEQ ID NO: 670586

SEQ ID NO: 720012 - RNA, 64 nt, Homo Sapiens; identical to SEQ ID NO: 670587

SEQ ID NO: 720013 - RNA, 64 nt, Homo Sapiens; identical to SEQ ID NO: 670588

SEQ ID NO: 720014 - RNA, 64 nt, Homo Sapiens; identical to SEQ ID NO: 670589

SEQ ID NO: 720015 - RNA, 64 nt, Homo Sapiens; identical to SEQ ID NO: 670590

SEQ ID NO: 720016 - RNA, 64 nt, Homo Sapiens; identical to SEQ ID NO: 670591

SEQ ID NO: 720017 - RNA, 64 nt, Homo Sapiens; identical to SEQ ID NO: 670592

SEQ ID NO: 720018 - RNA, 64 nt, Homo Sapiens; identical to SEQ ID NO: 670593

SEQ ID NO: 720019 - RNA, 64 nt, Homo Sapiens; identical to SEQ ID NO: 670594

SEQ ID NO: 720020 - RNA, 64 nt, Homo Sapiens; identical to SEQ ID NO: 670595

SEQ ID NO: 720021 - RNA, 64 nt, Homo Sapiens; identical to SEQ ID NO: 670596

SEQ ID NO: 720022 - RNA, 64 nt, Homo Sapiens; identical to SEQ ID NO: 670597

SEQ ID NO: 720023 - RNA, 64 nt, Homo Sapiens; identical to SEQ ID NO: 670598

SEQ ID NO: 720024 - RNA, 64 nt, Homo Sapiens; identical to SEQ ID NO: 670599

SEQ ID NO: 720025 - RNA, 64 nt, Homo Sapiens; identical to SEQ ID NO: 670600

SEQ ID NO: 720026 - RNA, 64 nt, Homo Sapiens; identical to SEQ ID NO: 670601

SEQ ID NO: 720027 - RNA, 64 nt, Homo Sapiens; identical to SEQ ID NO: 670602

SEQ ID NO: 720028 - RNA, 64 nt, Homo Sapiens; identical to SEQ ID NO: 670603

SEQ ID NO: 720029 - RNA, 64 nt, Homo Sapiens; identical to SEQ ID NO: 108409

SEQ ID NO: 720030 - RNA, 64 nt, Homo Sapiens; identical to SEQ ID NO: 108410

SEQ ID NO: 720031 - RNA, 64 nt, Homo Sapiens; identical to SEQ ID NO: 108411

SEQ ID NO: 720032 - RNA, 64 nt, Homo Sapiens; identical to SEQ ID NO: 108412

SEQ ID NO: 720033 - RNA, 63 nt, Homo Sapiens
gguuggaaagucucuuuuuuguaauuuguuuuugcaaaucauugugaggccacuuuuucuuuc

SEQ ID NO: 720034 - RNA, 63 nt, Homo Sapiens
ccuucuuucaucucuuuuuuguaauuuguuguugcaaaucauugugaggccacuuuucuuucc

SEQ ID NO: 720035 - RNA, 63 nt, Homo Sapiens
auguaccucguggaauucagccagcuucauguugcaaaucagaaagcugaccccaagacugca

SEQ ID NO: 720036 - RNA, 63 nt, Homo Sapiens
cauguugcaaaucagaaagcugaccccaagacugcaaaucaaugaagguauuggcauuguuaa

SEQ ID NO: 720037 - RNA, 63 nt, Homo Sapiens
uguuuaaaaaggcaguuugcuuuguaauuaaaagcaaaucauuaggcaucgucaugcacagua

SEQ ID NO: 720038 - RNA, 63 nt, Homo Sapiens
cuuuuguuuccuuuuucagauuuuauaaauacugcaaaucaggagguuagagaauaaauugau

SEQ ID NO: 720039 - RNA, 63 nt, Homo Sapiens
agccuuugcacuuuuaaaauaaaaaccaaguaugcaaaucaaagauauuugguagucaaaaua

SEQ ID NO: 720040 - RNA, 63 nt, Homo Sapiens
uugccuaaaaaggaaauuggaugggauacuguggcaaaucauaaaaaaccagauaauugaacu

SEQ ID NO: 720041 - RNA, 63 nt, Homo Sapiens
ggagaauccauaaugagagaugcuacaaccauugcaaaucauuugucacaaaguuuucaguaa

SEQ ID NO: 720042 - RNA, 63 nt, Homo Sapiens
ccuugaaacacauaagaaaaaaaguuuucgguugcaaaucaaaacaaauaggaagaaugugac

SEQ ID NO: 720043 - RNA, 63 nt, Homo Sapiens
guuuuauguaaaauauuaaagcuucauaaaacagcaaaucaauuaaauaugaucuaugauuuu

SEQ ID NO: 720044 - RNA, 63 nt, Homo Sapiens
aggacucaguacaaacuccgagcccuucauccagcaaaucagaaagucauuauuauauuuuuc

SEQ ID NO: 720045 - RNA, 64 nt, Homo Sapiens
auugucugagaauaggauuaaugagcaaaaguuaugauaauagaguuauaugaugguuuaaugg

SEQ ID NO: 720046 - RNA, 64 nt, Homo Sapiens
cuaacaaauauaaaggaacuugaaauguggggagugauaauaguccagugauuaaacuacaguc

SEQ ID NO: 720047 - RNA, 64 nt, Homo Sapiens
guguuaugggaaaacacauuuguucauagacuugugauaauaugcuaccuuagcuaaccagaau

SEQ ID NO: 720048 - RNA, 64 nt, Homo Sapiens
aaaccaucaaauuuuauaauccacugaagaaauaugauaauauaauuuuuuaaugagguauuua

SEQ ID NO: 720049 - RNA, 64 nt, Homo Sapiens
ucacuauccauuaggaguuuuucuuaaacuugucugauaauaagaaucaccuggaguuaggagg

SEQ ID NO: 720050 - RNA, 64 nt, Homo Sapiens
ucaguucucuuaguaagaacuuuagaaguaaucuugauaauaagcacagacagccuaacagcag

SEQ ID NO: 720051 - RNA, 64 nt, Homo Sapiens
acaaacuccuaugucaugagaauaaccgauguucugauaauaguagcaucuagguacagaugcu

SEQ ID NO: 720052 - RNA, 64 nt, Homo Sapiens
uacuagaagcagaaugaaaccacauuuuuugguuugauaauaugcacuuauugacucccacuca

SEQ ID NO: 720053 - RNA, 64 nt, Homo Sapiens
aauaauaauaauaauaauaaaaugauaauaaugaugauaauaauaaauuauuucauuugcacac

SEQ ID NO: 720054 - RNA, 64 nt, Homo Sapiens
gaugauaauaauaauaauaaucauuugcacacaaugauaauaauuauuauuaaaauaaauuauu

SEQ ID NO: 720055 - RNA, 64 nt, Homo Sapiens
acguguuugaaaagccuguaagaaauacaggauuugauaauauuuugaaggcaggaaaaaccca

SEQ ID NO: 720056 - RNA, 64 nt, Homo Sapiens
aaccuaacuguuuuuaccauugaaauuuaaauugugauaauagguuuuaaaugucuagaaugca

SEQ ID NO: 720057 - RNA, 64 nt, Homo Sapiens
uauuuaaaauauauuugagacaugaaauacauacugauaauacauaccucaugaaagauuuuau

SEQ ID NO: 720058 - RNA, 64 nt, Homo Sapiens
cuugauuaaggaauucuacuuucaaaaauuaaucugauaauaguaacaagguauauuauacuuu

SEQ ID NO: 720059 - RNA, 64 nt, Homo Sapiens
acuuguuauaaaauuuauucuuuuuagagauuugugauaauacaguuuaaaaacugcguuguua

SEQ ID NO: 720060 - RNA, 64 nt, Homo Sapiens
caugcauuuaugugcgugugugcauauaugugugugauaauacaauugcauacacaugccucca

SEQ ID NO: 720061 - RNA, 64 nt, Homo Sapiens
aaggauauaauuucuuaguauuguauacuugaaaugauaauaaaauucuaaucuauguugaacu

SEQ ID NO: 720062 - RNA, 64 nt, Homo Sapiens
uguaaugacaucagaaugaauuaacauuuaaaacugauaauaucauauauugccauacaaaaac

SEQ ID NO: 720063 - RNA, 64 nt, Homo Sapiens
auuaauuuuugcauugcuucgaucuuuuggccuaugauaauaccauacacugucagaaacuuga

SEQ ID NO: 720064 - RNA, 64 nt, Homo Sapiens
aauugcaaugauguuguaauuaauuaucauucauugauaauauuacuacuguuagcaccacuac

SEQ ID NO: 720065 - RNA, 64 nt, Homo Sapiens
ggaauuuauagaguuugagcuuuguucaauagacugauaauacuuacuaugguugcuuucccua

SEQ ID NO: 720066 - RNA, 64 nt, Homo Sapiens
ucuagagacucuaaaaacuaauugaacauuaauuugauaauaggaaacaaauacauaaguaacc

SEQ ID NO: 720067 - RNA, 64 nt, Homo Sapiens
guuauaguuugaaaguccaacuguauuaauugacugauaauaugauaauauagagauuaaauug

SEQ ID NO: 720068 - RNA, 64 nt, Homo Sapiens
uugaaaguccaacuguauuaauugacugauaauaugauaauauagagauuaaauuguuugucuu

SEQ ID NO: 720069 - RNA, 64 nt, Homo Sapiens
cauaugaauuauuaagcauaugugcuuucgcagcugauaauauaaaaggaaaucccacagucua

SEQ ID NO: 720070 - RNA, 64 nt, Homo Sapiens
ucaaauaucucaccacagugaauuauggguaaggugauaauauguuuaauuagcuugauuuaau

SEQ ID NO: 720071 - RNA, 64 nt, Homo Sapiens
uuauucuuaaaucuucagugaauauugauaccucugauaauauuagaaaaagauuauaguuauu

SEQ ID NO: 720072 - RNA, 64 nt, Homo Sapiens
gcugaauuaucuuaagugaggguuuuuuuaaaacugauaauaauuuuguuucuaagauauuuuu

SEQ ID NO: 720073 - RNA, 64 nt, Homo Sapiens
cagcuucccuacauuacacacacucagguugagucauucuaacuauaaaagugcaaugacuaag

SEQ ID NO: 720074 - RNA, 64 nt, Homo Sapiens
accuaaaucaccccagagcuuuaugucuuuuauucauucuaauucuuauuaaccggaauaugua

SEQ ID NO: 720075 - RNA, 64 nt, Homo Sapiens
cuggugcuucugcuuuugaacuauucauacuauacauucuaagaguuauauuucacuuaaaaua

SEQ ID NO: 720076 - RNA, 64 nt, Homo Sapiens
uuucagugugugaaauuacucaugacauuauuuccauucuaacaguuuuuauuuuguuauucag

SEQ ID NO: 720077 - RNA, 64 nt, Homo Sapiens
guaguuaagaugaaauuuauuuacuuuuccguuucauucuaaagggaaaaugcacacuuuguuu

SEQ ID NO: 720078 - RNA, 64 nt, Homo Sapiens
ggugacucucugcccuuggaugcaaacauuuuaucauucuaaauugucagccucuuucauagug

SEQ ID NO: 720079 - RNA, 64 nt, Homo Sapiens
aaccaaucuuucuguaugugcacaagagcuaauucauucuaauagauaugucagccucuacagu

SEQ ID NO: 720080 - RNA, 64 nt, Homo Sapiens
uguucccaggggaugcugaugagccugagacugccauucuaacaugauucagugggucugcgua

SEQ ID NO: 720081 - RNA, 64 nt, Homo Sapiens
gucuaaaaauuucaaaaaccgccaagguuagguucauucuaagagaaaaaaaccggaaaaauac

SEQ ID NO: 720082 - RNA, 64 nt, Homo Sapiens
gguuuaagagaguaucucauuuuuuaauaauagccauucuaacuguacccagccauuuuuugac

SEQ ID NO: 720083 - RNA, 64 nt, Homo Sapiens
gugggccugaggucaaugggucccccuguagacccauucuaaauucaggcauucucuauucuuu

SEQ ID NO: 720084 - RNA, 64 nt, Homo Sapiens
uugaguaaauacaauuuuuuagaacuauaaauagcauucuaaauaauauuucaucuaacugcuu

SEQ ID NO: 720085 - RNA, 64 nt, Homo Sapiens
gguacagacugaaaccuuuacuaauaacugaagacauucuaauuugauuuaggaugcucuauua

SEQ ID NO: 720086 - RNA, 64 nt, Homo Sapiens
agggucuguggcagacauugaugaauuaagaacacauucuaacaugcucuacuccuuccuguua

SEQ ID NO: 720087 - RNA, 64 nt, Homo Sapiens; identical to SEQ ID NO: 720086

SEQ ID NO: 720088 - RNA, 64 nt, Homo Sapiens
uccucaacuguuaccaaauauuuucaguucccuucauucuaaugauucuacaugaacaauaccc

SEQ ID NO: 720089 - RNA, 64 nt, Homo Sapiens
aagggcauucacucucuggaagauuucagagacccauucuaaacuagaugccucuuaaaaauga

SEQ ID NO: 720090 - RNA, 64 nt, Homo Sapiens
gguagugggaggagaacggucagaaucaaagugacauucuaagaaaaacuguaccuuagagauu

SEQ ID NO: 720091 - RNA, 64 nt, Homo Sapiens
ccccaagguuuaaacugcccaguuagcauucugacauucuaaaagccggcaaagcagcuuuuag

SEQ ID NO: 720092 - RNA, 64 nt, Homo Sapiens
uugucuccaucaguggucaccuugagggauuagacauucuaauggaauguccuggcuccacccu

SEQ ID NO: 720093 - RNA, 64 nt, Homo Sapiens
aacaaugacaguugaguggagugggaagggaagucauucuaaagaguccaaagucaguagcgcc

SEQ ID NO: 720094 - RNA, 64 nt, Homo Sapiens; identical to SEQ ID NO: 720045

SEQ ID NO: 720095 - RNA, 64 nt, Homo Sapiens; identical to SEQ ID NO: 720046

SEQ ID NO: 720096 - RNA, 64 nt, Homo Sapiens; identical to SEQ ID NO: 720047

SEQ ID NO: 720097 - RNA, 64 nt, Homo Sapiens; identical to SEQ ID NO: 720048

SEQ ID NO: 720098 - RNA, 64 nt, Homo Sapiens; identical to SEQ ID NO: 720049

SEQ ID NO: 720099 - RNA, 64 nt, Homo Sapiens; identical to SEQ ID NO: 720050

SEQ ID NO: 720100 - RNA, 64 nt, Homo Sapiens; identical to SEQ ID NO: 720051

SEQ ID NO: 720101 - RNA, 64 nt, Homo Sapiens; identical to SEQ ID NO: 720052

SEQ ID NO: 720102 - RNA, 64 nt, Homo Sapiens; identical to SEQ ID NO: 720053

SEQ ID NO: 720103 - RNA, 64 nt, Homo Sapiens; identical to SEQ ID NO: 720054

SEQ ID NO: 720104 - RNA, 64 nt, Homo Sapiens; identical to SEQ ID NO: 720055

SEQ ID NO: 720105 - RNA, 64 nt, Homo Sapiens; identical to SEQ ID NO: 720056

SEQ ID NO: 720106 - RNA, 64 nt, Homo Sapiens; identical to SEQ ID NO: 720057

SEQ ID NO: 720107 - RNA, 64 nt, Homo Sapiens; identical to SEQ ID NO: 720058

SEQ ID NO: 720108 - RNA, 64 nt, Homo Sapiens; identical to SEQ ID NO: 720059

SEQ ID NO: 720109 - RNA, 64 nt, Homo Sapiens; identical to SEQ ID NO: 720060

SEQ ID NO: 720110 - RNA, 64 nt, Homo Sapiens; identical to SEQ ID NO: 720061

SEQ ID NO: 720111 - RNA, 64 nt, Homo Sapiens; identical to SEQ ID NO: 720062

SEQ ID NO: 720112 - RNA, 64 nt, Homo Sapiens; identical to SEQ ID NO: 720063

SEQ ID NO: 720113 - RNA, 64 nt, Homo Sapiens; identical to SEQ ID NO: 720064

SEQ ID NO: 720114 - RNA, 64 nt, Homo Sapiens; identical to SEQ ID NO: 720065

SEQ ID NO: 720115 - RNA, 64 nt, Homo Sapiens; identical to SEQ ID NO: 720066

SEQ ID NO: 720116 - RNA, 64 nt, Homo Sapiens; identical to SEQ ID NO: 720067

SEQ ID NO: 720117 - RNA, 64 nt, Homo Sapiens; identical to SEQ ID NO: 720068

SEQ ID NO: 720118 - RNA, 64 nt, Homo Sapiens; identical to SEQ ID NO: 720069

SEQ ID NO: 720119 - RNA, 64 nt, Homo Sapiens; identical to SEQ ID NO: 720070

SEQ ID NO: 720120 - RNA, 64 nt, Homo Sapiens; identical to SEQ ID NO: 720071

SEQ ID NO: 720121 - RNA, 64 nt, Homo Sapiens; identical to SEQ ID NO: 720072

SEQ ID NO: 720122 - RNA, 64 nt, Homo Sapiens; identical to SEQ ID NO: 720073

SEQ ID NO: 720123 - RNA, 64 nt, Homo Sapiens; identical to SEQ ID NO: 720074

SEQ ID NO: 720124 - RNA, 64 nt, Homo Sapiens; identical to SEQ ID NO: 720075

SEQ ID NO: 720125 - RNA, 64 nt, Homo Sapiens; identical to SEQ ID NO: 720076

SEQ ID NO: 720126 - RNA, 64 nt, Homo Sapiens; identical to SEQ ID NO: 720077

SEQ ID NO: 720127 - RNA, 64 nt, Homo Sapiens; identical to SEQ ID NO: 720078

SEQ ID NO: 720128 - RNA, 64 nt, Homo Sapiens; identical to SEQ ID NO: 720079

SEQ ID NO: 720129 - RNA, 64 nt, Homo Sapiens; identical to SEQ ID NO: 720080

SEQ ID NO: 720130 - RNA, 64 nt, Homo Sapiens; identical to SEQ ID NO: 720081

SEQ ID NO: 720131 - RNA, 64 nt, Homo Sapiens; identical to SEQ ID NO: 720082

SEQ ID NO: 720132 - RNA, 64 nt, Homo Sapiens; identical to SEQ ID NO: 720083

SEQ ID NO: 720133 - RNA, 64 nt, Homo Sapiens; identical to SEQ ID NO: 720084

SEQ ID NO: 720134 - RNA, 64 nt, Homo Sapiens; identical to SEQ ID NO: 720085

SEQ ID NO: 720135 - RNA, 64 nt, Homo Sapiens; identical to SEQ ID NO: 720086

SEQ ID NO: 720136 - RNA, 64 nt, Homo Sapiens; identical to SEQ ID NO: 720086

SEQ ID NO: 720137 - RNA, 64 nt, Homo Sapiens; identical to SEQ ID NO: 720088

SEQ ID NO: 720138 - RNA, 64 nt, Homo Sapiens; identical to SEQ ID NO: 720089

SEQ ID NO: 720139 - RNA, 64 nt, Homo Sapiens; identical to SEQ ID NO: 720090

SEQ ID NO: 720140 - RNA, 64 nt, Homo Sapiens; identical to SEQ ID NO: 720091

SEQ ID NO: 720141 - RNA, 64 nt, Homo Sapiens; identical to SEQ ID NO: 720092

SEQ ID NO: 720142 - RNA, 64 nt, Homo Sapiens; identical to SEQ ID NO: 720093

SEQ ID NO: 720143 - RNA, 64 nt, Homo Sapiens; identical to SEQ ID NO: 211620

SEQ ID NO: 720144 - RNA, 64 nt, Homo Sapiens; identical to SEQ ID NO: 211621

SEQ ID NO: 720145 - RNA, 64 nt, Homo Sapiens; identical to SEQ ID NO: 211622

SEQ ID NO: 720146 - RNA, 64 nt, Homo Sapiens; identical to SEQ ID NO: 211623

SEQ ID NO: 720147 - RNA, 64 nt, Homo Sapiens; identical to SEQ ID NO: 211624

SEQ ID NO: 720148 - RNA, 64 nt, Homo Sapiens; identical to SEQ ID NO: 211625

SEQ ID NO: 720149 - RNA, 64 nt, Homo Sapiens; identical to SEQ ID NO: 211626

SEQ ID NO: 720150 - RNA, 64 nt, Homo Sapiens; identical to SEQ ID NO: 211627

SEQ ID NO: 720151 - RNA, 64 nt, Homo Sapiens; identical to SEQ ID NO: 211628

SEQ ID NO: 720152 - RNA, 64 nt, Homo Sapiens; identical to SEQ ID NO: 211629

SEQ ID NO: 720153 - RNA, 64 nt, Homo Sapiens; identical to SEQ ID NO: 211630

SEQ ID NO: 720154 - RNA, 64 nt, Homo Sapiens; identical to SEQ ID NO: 211631

SEQ ID NO: 720155 - RNA, 64 nt, Homo Sapiens; identical to SEQ ID NO: 211632

SEQ ID NO: 720156 - RNA, 64 nt, Homo Sapiens; identical to SEQ ID NO: 211633

SEQ ID NO: 720157 - RNA, 64 nt, Homo Sapiens; identical to SEQ ID NO: 211634

SEQ ID NO: 720158 - RNA, 64 nt, Homo Sapiens; identical to SEQ ID NO: 211635

SEQ ID NO: 720159 - RNA, 64 nt, Homo Sapiens; identical to SEQ ID NO: 211636

SEQ ID NO: 720160 - RNA, 64 nt, Homo Sapiens; identical to SEQ ID NO: 211637

SEQ ID NO: 720161 - RNA, 64 nt, Homo Sapiens; identical to SEQ ID NO: 211638

SEQ ID NO: 720162 - RNA, 64 nt, Homo Sapiens
ugucaccguggaccuuccugcaagaaucaagcuagaaggccacacaccagaggcugcagaaggc

SEQ ID NO: 720163 - RNA, 64 nt, Homo Sapiens
aaucaagcuagaaggccacacaccagaggcugcagaaggccaagccagagaguccucuggaugg

SEQ ID NO: 720164 - RNA, 64 nt, Homo Sapiens
guuagguuuccuuuagaaauggugugauaguaaggaaggccacuuaaugccagucccaggggag

SEQ ID NO: 720165 - RNA, 64 nt, Homo Sapiens
caaccuccacuucuucagcaccacacccaguagagaaggccaagacucagugaguucaucaggg

SEQ ID NO: 720166 - RNA, 64 nt, Homo Sapiens
ggguguucaccugcaaaguugggacccugccagggaaggccacugaccccuccugcucgcucug

SEQ ID NO: 720167 - RNA, 64 nt, Homo Sapiens
accaccacugagggcccggacagaggcccggaaggaaggccauggagucacgacagugugagag

SEQ ID NO: 720168 - RNA, 64 nt, Homo Sapiens
gcccuuuugagaauucaagauggcacugacacgggaaggccagcuacagguggacuccuggaau

SEQ ID NO: 720169 - RNA, 64 nt, Homo Sapiens
uccaagaguauucaggucuccucuugugagauaggaaggccaugaaaacaauuagauuucaaga

SEQ ID NO: 720170 - RNA, 64 nt, Homo Sapiens
cuggccugcccuuucucccaaggaggaagaggaggaaggccagagagucaggggugggaggaga

SEQ ID NO: 720171 - RNA, 64 nt, Homo Sapiens
ggcuggcacuacugcauucucagaacccagaacagaaggccacacaaucaauacacacacacug

SEQ ID NO: 720172 - RNA, 64 nt, Homo Sapiens
ugugcaggcagggagcacaguuugagaucaugcugaaggccaagcaggcccggaacucccaguu

SEQ ID NO: 720173 - RNA, 64 nt, Homo Sapiens
agaugaugacagugaugaugaugaagaaagcaaagaaggccaagaaaguucuaguagugcugca

SEQ ID NO: 720174 - RNA, 64 nt, Homo Sapiens
gcccgcccacuccuaccacaaggacuuugccucugaaggccaguggcagcaggugguggugggu

SEQ ID NO: 720175 - RNA, 64 nt, Homo Sapiens
gagaggcccgggucagagcccugggggugagccugaaggccacagagaaagaaccuugcccaaa

SEQ ID NO: 720176 - RNA, 64 nt, Homo Sapiens
guguggaauugcccuuugggguccuuccuuaauugaaggccaccuucucacagguuucauucug

SEQ ID NO: 720177 - RNA, 64 nt, Homo Sapiens
acuucagaaucaggacacucaagcucuggcagaggaaggccaaguuacuuucauggucuuaccc

SEQ ID NO: 720178 - RNA, 64 nt, Homo Sapiens
agcuccugguauggguuucucccaguucucuagggaaggccaccugcaggucacugaaacuuca

SEQ ID NO: 720179 - RNA, 64 nt, Homo Sapiens
gcagugugucuccugcaugcagaaagggagcagagaaggccaggggcuuuugcuaaaaauagug

SEQ ID NO: 720180 - RNA, 64 nt, Homo Sapiens
cugugaccuuagcccagcaagccaggcccuucaugaaggccaagaaggcugccaccauucccug

SEQ ID NO: 720181 - RNA, 64 nt, Homo Sapiens
ccccacugccucugugugccccuuugcguccugugaaggccauugagaaaugcccagugugccc

SEQ ID NO: 720182 - RNA, 64 nt, Homo Sapiens
cacacaguggccggggcugaagccacacagcccagaaggccagaaaaggcagccagauccccag

SEQ ID NO: 720183 - RNA, 64 nt, Homo Sapiens
cagaugauggggucagcaggcccaggagaauuaggaaggccauggggcagccuccagucugcuc

SEQ ID NO: 720184 - RNA, 64 nt, Homo Sapiens
gucuggggguaaggcuggggcuuccugggaaaaggaaggccaugagaaggcagagaaguaggcc

SEQ ID NO: 720185 - RNA, 64 nt, Homo Sapiens
ccugugccagccacccccugccccacugcugaaugaaggccauuucaagcgcugcuucucacuc

SEQ ID NO: 720186 - RNA, 64 nt, Homo Sapiens
uaaugagccauggccauuguccugcuugaacccugaaggccagguuauuuagggguauaugucc

SEQ ID NO: 720187 - RNA, 64 nt, Homo Sapiens
aaaagaaagagcugaaaaugggaaccagcaaugagaaggccagggaauagaggggaggugugca

SEQ ID NO: 720188 - RNA, 64 nt, Homo Sapiens
gguggagugggaagggagcauugcagccuaagaagaaggccagagagggaaaaggcaggugcuu

SEQ ID NO: 720189 - RNA, 64 nt, Homo Sapiens
ugguuucugggugcuagauccagcccaaaccugggaaggccagccuuguacagucugcuccucu

SEQ ID NO: 720190 - RNA, 64 nt, Homo Sapiens; identical to SEQ ID NO: 124377

SEQ ID NO: 720191 - RNA, 64 nt, Homo Sapiens; identical to SEQ ID NO: 124378

SEQ ID NO: 720192 - RNA, 64 nt, Homo Sapiens; identical to SEQ ID NO: 124379

SEQ ID NO: 720193 - RNA, 64 nt, Homo Sapiens; identical to SEQ ID NO: 124380

SEQ ID NO: 720194 - RNA, 64 nt, Homo Sapiens; identical to SEQ ID NO: 124381

SEQ ID NO: 720195 - RNA, 64 nt, Homo Sapiens; identical to SEQ ID NO: 124382

SEQ ID NO: 720196 - RNA, 64 nt, Homo Sapiens; identical to SEQ ID NO: 124383

SEQ ID NO: 720197 - RNA, 64 nt, Homo Sapiens; identical to SEQ ID NO: 124384

SEQ ID NO: 720198 - RNA, 64 nt, Homo Sapiens
uggagaguucugguuuuccaaugaauguuguggaaugcuacaccccucaugcuuaggacuaccc

SEQ ID NO: 720199 - RNA, 64 nt, Homo Sapiens
ucuuacuauggacaccaggucagcaagugaccaaaugcuacaggucacugcugcauuggugugg

SEQ ID NO: 720200 - RNA, 64 nt, Homo Sapiens
gguaucauguauggugauagguaucuagagcuuaaugcuacaugugagugacgaugauguacag

SEQ ID NO: 720201 - RNA, 64 nt, Homo Sapiens
cauuuaguaagaauaccacaucaaauaagaaauaaugcuacaauuuuaagaggggagggaaggg

SEQ ID NO: 720202 - RNA, 64 nt, Homo Sapiens
uuuuaaauuuucccuuaaaacacacuuuuggaauaugcuacaauauuacauguuuuuugucuuu

SEQ ID NO: 720203 - RNA, 64 nt, Homo Sapiens
cccagguaucugauuauuugaugugaauagagggaugcuacagaugucauuugucucccgcccu

SEQ ID NO: 720204 - RNA, 64 nt, Homo Sapiens
aaagcauaaaauaaugauuuauuuaauucaucuaaugcuacacaaagcuauaugugcauauguu

SEQ ID NO: 720205 - RNA, 64 nt, Homo Sapiens
aaacggaauggaagcauagccuaaauaugcuuugaugcuacauccagaaucucagacuacagca

SEQ ID NO: 720206 - RNA, 64 nt, Homo Sapiens
acacagauucauucguaaaucuagggacaauagaaaccugcaaaacugaucuucacuccaguca

SEQ ID NO: 720207 - RNA, 64 nt, Homo Sapiens
gaggaaaacagcaucuccucaaggaacugacagcaaccugcaaagagaaaagcagucaaguucc

SEQ ID NO: 720208 - RNA, 64 nt, Homo Sapiens
uuauguaaaaguaauaguaaaaugcuuacaggaaaaccugcagaguaguuagagaauauguaug

SEQ ID NO: 720209 - RNA, 64 nt, Homo Sapiens
gcagguuuccuaggucugaaucugcgaguagaugaaccugcagcaagcagcguuuauggugcuu

SEQ ID NO: 720210 - RNA, 64 nt, Homo Sapiens; identical to SEQ ID NO: 70765

SEQ ID NO: 720211 - RNA, 64 nt, Homo Sapiens; identical to SEQ ID NO: 70766

SEQ ID NO: 720212 - RNA, 64 nt, Homo Sapiens; identical to SEQ ID NO: 70767

SEQ ID NO: 720213 - RNA, 64 nt, Homo Sapiens; identical to SEQ ID NO: 70768

SEQ ID NO: 720214 - RNA, 64 nt, Homo Sapiens; identical to SEQ ID NO: 70769

SEQ ID NO: 720215 - RNA, 64 nt, Homo Sapiens; identical to SEQ ID NO: 70770

SEQ ID NO: 720216 - RNA, 64 nt, Homo Sapiens; identical to SEQ ID NO: 70771

SEQ ID NO: 720217 - RNA, 64 nt, Homo Sapiens; identical to SEQ ID NO: 70772

SEQ ID NO: 720218 - RNA, 64 nt, Homo Sapiens; identical to SEQ ID NO: 70773

SEQ ID NO: 720219 - RNA, 64 nt, Homo Sapiens; identical to SEQ ID NO: 70774

SEQ ID NO: 720220 - RNA, 64 nt, Homo Sapiens; identical to SEQ ID NO: 70775

SEQ ID NO: 720221 - RNA, 64 nt, Homo Sapiens; identical to SEQ ID NO: 70776

SEQ ID NO: 720222 - RNA, 64 nt, Homo Sapiens; identical to SEQ ID NO: 70777

SEQ ID NO: 720223 - RNA, 64 nt, Homo Sapiens; identical to SEQ ID NO: 70778

SEQ ID NO: 720224 - RNA, 64 nt, Homo Sapiens; identical to SEQ ID NO: 70779

SEQ ID NO: 720225 - RNA, 64 nt, Homo Sapiens; identical to SEQ ID NO: 70780

SEQ ID NO: 720226 - RNA, 64 nt, Homo Sapiens; identical to SEQ ID NO: 70781

SEQ ID NO: 720227 - RNA, 64 nt, Homo Sapiens; identical to SEQ ID NO: 70782

SEQ ID NO: 720228 - RNA, 64 nt, Homo Sapiens; identical to SEQ ID NO: 70783

SEQ ID NO: 720229 - RNA, 64 nt, Homo Sapiens; identical to SEQ ID NO: 70784

SEQ ID NO: 720230 - RNA, 64 nt, Homo Sapiens; identical to SEQ ID NO: 70785

SEQ ID NO: 720231 - RNA, 64 nt, Homo Sapiens; identical to SEQ ID NO: 70786

SEQ ID NO: 720232 - RNA, 64 nt, Homo Sapiens; identical to SEQ ID NO: 70787

SEQ ID NO: 720233 - RNA, 64 nt, Homo Sapiens; identical to SEQ ID NO: 70788

SEQ ID NO: 720234 - RNA, 64 nt, Homo Sapiens; identical to SEQ ID NO: 70789

SEQ ID NO: 720235 - RNA, 64 nt, Homo Sapiens; identical to SEQ ID NO: 70790

SEQ ID NO: 720236 - RNA, 64 nt, Homo Sapiens; identical to SEQ ID NO: 70791

SEQ ID NO: 720237 - RNA, 64 nt, Homo Sapiens; identical to SEQ ID NO: 70792

SEQ ID NO: 720238 - RNA, 64 nt, Homo Sapiens; identical to SEQ ID NO: 70793

SEQ ID NO: 720239 - RNA, 64 nt, Homo Sapiens; identical to SEQ ID NO: 70794

SEQ ID NO: 720240 - RNA, 64 nt, Homo Sapiens; identical to SEQ ID NO: 70795

SEQ ID NO: 720241 - RNA, 64 nt, Homo Sapiens; identical to SEQ ID NO: 70796

SEQ ID NO: 720242 - RNA, 64 nt, Homo Sapiens; identical to SEQ ID NO: 70797

SEQ ID NO: 720243 - RNA, 64 nt, Homo Sapiens; identical to SEQ ID NO: 70798

SEQ ID NO: 720244 - RNA, 64 nt, Homo Sapiens; identical to SEQ ID NO: 70799

SEQ ID NO: 720245 - RNA, 64 nt, Homo Sapiens; identical to SEQ ID NO: 70800

SEQ ID NO: 720246 - RNA, 64 nt, Homo Sapiens; identical to SEQ ID NO: 70801

SEQ ID NO: 720247 - RNA, 64 nt, Homo Sapiens; identical to SEQ ID NO: 70802

SEQ ID NO: 720248 - RNA, 64 nt, Homo Sapiens; identical to SEQ ID NO: 70803

SEQ ID NO: 720249 - RNA, 64 nt, Homo Sapiens; identical to SEQ ID NO: 70804

SEQ ID NO: 720250 - RNA, 64 nt, Homo Sapiens; identical to SEQ ID NO: 70805

SEQ ID NO: 720251 - RNA, 64 nt, Homo Sapiens; identical to SEQ ID NO: 70806

SEQ ID NO: 720252 - RNA, 64 nt, Homo Sapiens; identical to SEQ ID NO: 70807

SEQ ID NO: 720253 - RNA, 64 nt, Homo Sapiens; identical to SEQ ID NO: 70808

SEQ ID NO: 720254 - RNA, 64 nt, Homo Sapiens; identical to SEQ ID NO: 70809

SEQ ID NO: 720255 - RNA, 64 nt, Homo Sapiens; identical to SEQ ID NO: 70810

SEQ ID NO: 720256 - RNA, 64 nt, Homo Sapiens; identical to SEQ ID NO: 70811

SEQ ID NO: 720257 - RNA, 64 nt, Homo Sapiens; identical to SEQ ID NO: 70812

SEQ ID NO: 720258 - RNA, 64 nt, Homo Sapiens; identical to SEQ ID NO: 70813

SEQ ID NO: 720259 - RNA, 64 nt, Homo Sapiens; identical to SEQ ID NO: 70814

SEQ ID NO: 720260 - RNA, 64 nt, Homo Sapiens; identical to SEQ ID NO: 70814

SEQ ID NO: 720261 - RNA, 64 nt, Homo Sapiens; identical to SEQ ID NO: 70816

SEQ ID NO: 720262 - RNA, 64 nt, Homo Sapiens; identical to SEQ ID NO: 70817

SEQ ID NO: 720263 - RNA, 64 nt, Homo Sapiens; identical to SEQ ID NO: 70818

SEQ ID NO: 720264 - RNA, 64 nt, Homo Sapiens; identical to SEQ ID NO: 70819

SEQ ID NO: 720265 - RNA, 64 nt, Homo Sapiens; identical to SEQ ID NO: 70820

SEQ ID NO: 720266 - RNA, 64 nt, Homo Sapiens; identical to SEQ ID NO: 70821

SEQ ID NO: 720267 - RNA, 64 nt, Homo Sapiens; identical to SEQ ID NO: 70822

SEQ ID NO: 720268 - RNA, 64 nt, Homo Sapiens; identical to SEQ ID NO: 70823

SEQ ID NO: 720269 - RNA, 64 nt, Homo Sapiens; identical to SEQ ID NO: 70824

SEQ ID NO: 720270 - RNA, 64 nt, Homo Sapiens; identical to SEQ ID NO: 70825

SEQ ID NO: 720271 - RNA, 64 nt, Homo Sapiens; identical to SEQ ID NO: 70826

SEQ ID NO: 720272 - RNA, 64 nt, Homo Sapiens; identical to SEQ ID NO: 70827

SEQ ID NO: 720273 - RNA, 64 nt, Homo Sapiens; identical to SEQ ID NO: 70828

SEQ ID NO: 720274 - RNA, 64 nt, Homo Sapiens; identical to SEQ ID NO: 70829

SEQ ID NO: 720275 - RNA, 64 nt, Homo Sapiens; identical to SEQ ID NO: 126265

SEQ ID NO: 720276 - RNA, 64 nt, Homo Sapiens; identical to SEQ ID NO: 126266

SEQ ID NO: 720277 - RNA, 64 nt, Homo Sapiens; identical to SEQ ID NO: 126267

SEQ ID NO: 720278 - RNA, 64 nt, Homo Sapiens; identical to SEQ ID NO: 126268

SEQ ID NO: 720279 - RNA, 64 nt, Homo Sapiens; identical to SEQ ID NO: 126269

SEQ ID NO: 720280 - RNA, 64 nt, Homo Sapiens; identical to SEQ ID NO: 126270

SEQ ID NO: 720281 - RNA, 64 nt, Homo Sapiens; identical to SEQ ID NO: 126271

SEQ ID NO: 720282 - RNA, 64 nt, Homo Sapiens; identical to SEQ ID NO: 126272

SEQ ID NO: 720283 - RNA, 64 nt, Homo Sapiens; identical to SEQ ID NO: 126273

SEQ ID NO: 720284 - RNA, 64 nt, Homo Sapiens; identical to SEQ ID NO: 126274

SEQ ID NO: 720285 - RNA, 64 nt, Homo Sapiens; identical to SEQ ID NO: 126275

SEQ ID NO: 720286 - RNA, 64 nt, Homo Sapiens; identical to SEQ ID NO: 126276

SEQ ID NO: 720287 - RNA, 64 nt, Homo Sapiens; identical to SEQ ID NO: 126277

SEQ ID NO: 720288 - RNA, 64 nt, Homo Sapiens; identical to SEQ ID NO: 126278

SEQ ID NO: 720289 - RNA, 64 nt, Homo Sapiens; identical to SEQ ID NO: 126279

SEQ ID NO: 720290 - RNA, 64 nt, Homo Sapiens; identical to SEQ ID NO: 126280

SEQ ID NO: 720291 - RNA, 64 nt, Homo Sapiens; identical to SEQ ID NO: 259689

SEQ ID NO: 720292 - RNA, 64 nt, Homo Sapiens; identical to SEQ ID NO: 259690

SEQ ID NO: 720293 - RNA, 64 nt, Homo Sapiens; identical to SEQ ID NO: 259691

SEQ ID NO: 720294 - RNA, 64 nt, Homo Sapiens; identical to SEQ ID NO: 259692

SEQ ID NO: 720295 - RNA, 64 nt, Homo Sapiens; identical to SEQ ID NO: 259693

SEQ ID NO: 720296 - RNA, 64 nt, Homo Sapiens; identical to SEQ ID NO: 259694

SEQ ID NO: 720297 - RNA, 64 nt, Homo Sapiens; identical to SEQ ID NO: 259695

SEQ ID NO: 720298 - RNA, 64 nt, Homo Sapiens; identical to SEQ ID NO: 259696

SEQ ID NO: 720299 - RNA, 64 nt, Homo Sapiens; identical to SEQ ID NO: 238243

SEQ ID NO: 720300 - RNA, 64 nt, Homo Sapiens; identical to SEQ ID NO: 238244

SEQ ID NO: 720301 - RNA, 64 nt, Homo Sapiens; identical to SEQ ID NO: 238245

SEQ ID NO: 720302 - RNA, 64 nt, Homo Sapiens; identical to SEQ ID NO: 238246

SEQ ID NO: 720303 - RNA, 64 nt, Homo Sapiens; identical to SEQ ID NO: 238247

SEQ ID NO: 720304 - RNA, 64 nt, Homo Sapiens; identical to SEQ ID NO: 238248

SEQ ID NO: 720305 - RNA, 64 nt, Homo Sapiens; identical to SEQ ID NO: 238249

SEQ ID NO: 720306 - RNA, 64 nt, Homo Sapiens; identical to SEQ ID NO: 238250

SEQ ID NO: 720307 - RNA, 64 nt, Homo Sapiens; identical to SEQ ID NO: 238251

SEQ ID NO: 720308 - RNA, 64 nt, Homo Sapiens; identical to SEQ ID NO: 238252

SEQ ID NO: 720309 - RNA, 64 nt, Homo Sapiens; identical to SEQ ID NO: 238253

SEQ ID NO: 720310 - RNA, 64 nt, Homo Sapiens; identical to SEQ ID NO: 238254

SEQ ID NO: 720311 - RNA, 64 nt, Homo Sapiens; identical to SEQ ID NO: 238255

SEQ ID NO: 720312 - RNA, 64 nt, Homo Sapiens; identical to SEQ ID NO: 238256

SEQ ID NO: 720313 - RNA, 64 nt, Homo Sapiens; identical to SEQ ID NO: 238257

SEQ ID NO: 720314 - RNA, 64 nt, Homo Sapiens; identical to SEQ ID NO: 238258

SEQ ID NO: 720315 - RNA, 64 nt, Homo Sapiens; identical to SEQ ID NO: 238259

SEQ ID NO: 720316 - RNA, 64 nt, Homo Sapiens; identical to SEQ ID NO: 238260

SEQ ID NO: 720317 - RNA, 64 nt, Homo Sapiens; identical to SEQ ID NO: 238261

SEQ ID NO: 720318 - RNA, 64 nt, Homo Sapiens; identical to SEQ ID NO: 238262

SEQ ID NO: 720319 - RNA, 64 nt, Homo Sapiens; identical to SEQ ID NO: 238263

SEQ ID NO: 720320 - RNA, 64 nt, Homo Sapiens; identical to SEQ ID NO: 238264

SEQ ID NO: 720321 - RNA, 64 nt, Homo Sapiens; identical to SEQ ID NO: 238265

SEQ ID NO: 720322 - RNA, 64 nt, Homo Sapiens; identical to SEQ ID NO: 238266

SEQ ID NO: 720323 - RNA, 64 nt, Homo Sapiens; identical to SEQ ID NO: 238267

SEQ ID NO: 720324 - RNA, 64 nt, Homo Sapiens; identical to SEQ ID NO: 238268

SEQ ID NO: 720325 - RNA, 64 nt, Homo Sapiens; identical to SEQ ID NO: 238269

SEQ ID NO: 720326 - RNA, 64 nt, Homo Sapiens; identical to SEQ ID NO: 238270

SEQ ID NO: 720327 - RNA, 64 nt, Homo Sapiens; identical to SEQ ID NO: 238271

SEQ ID NO: 720328 - RNA, 64 nt, Homo Sapiens; identical to SEQ ID NO: 238272

SEQ ID NO: 720329 - RNA, 64 nt, Homo Sapiens; identical to SEQ ID NO: 238273

SEQ ID NO: 720330 - RNA, 64 nt, Homo Sapiens; identical to SEQ ID NO: 238274

SEQ ID NO: 720331 - RNA, 64 nt, Homo Sapiens; identical to SEQ ID NO: 238275

SEQ ID NO: 720332 - RNA, 64 nt, Homo Sapiens; identical to SEQ ID NO: 238276

SEQ ID NO: 720333 - RNA, 64 nt, Homo Sapiens; identical to SEQ ID NO: 238277

SEQ ID NO: 720334 - RNA, 64 nt, Homo Sapiens; identical to SEQ ID NO: 238278

SEQ ID NO: 720335 - RNA, 64 nt, Homo Sapiens; identical to SEQ ID NO: 238279

SEQ ID NO: 720336 - RNA, 64 nt, Homo Sapiens; identical to SEQ ID NO: 238280

SEQ ID NO: 720337 - RNA, 64 nt, Homo Sapiens; identical to SEQ ID NO: 238281

SEQ ID NO: 720338 - RNA, 64 nt, Homo Sapiens; identical to SEQ ID NO: 238282

SEQ ID NO: 720339 - RNA, 64 nt, Homo Sapiens; identical to SEQ ID NO: 238283

SEQ ID NO: 720340 - RNA, 64 nt, Homo Sapiens; identical to SEQ ID NO: 238284

SEQ ID NO: 720341 - RNA, 64 nt, Homo Sapiens; identical to SEQ ID NO: 238285

SEQ ID NO: 720342 - RNA, 64 nt, Homo Sapiens; identical to SEQ ID NO: 238286

SEQ ID NO: 720343 - RNA, 64 nt, Homo Sapiens; identical to SEQ ID NO: 238287

SEQ ID NO: 720344 - RNA, 64 nt, Homo Sapiens; identical to SEQ ID NO: 238288

SEQ ID NO: 720345 - RNA, 64 nt, Homo Sapiens; identical to SEQ ID NO: 238289

SEQ ID NO: 720346 - RNA, 64 nt, Homo Sapiens; identical to SEQ ID NO: 238290

SEQ ID NO: 720347 - RNA, 64 nt, Homo Sapiens; identical to SEQ ID NO: 238291

SEQ ID NO: 720348 - RNA, 64 nt, Homo Sapiens; identical to SEQ ID NO: 238292

SEQ ID NO: 720349 - RNA, 64 nt, Homo Sapiens; identical to SEQ ID NO: 238293

SEQ ID NO: 720350 - RNA, 64 nt, Homo Sapiens; identical to SEQ ID NO: 238294

SEQ ID NO: 720351 - RNA, 64 nt, Homo Sapiens; identical to SEQ ID NO: 238295

SEQ ID NO: 720352 - RNA, 64 nt, Homo Sapiens; identical to SEQ ID NO: 238296

SEQ ID NO: 720353 - RNA, 64 nt, Homo Sapiens; identical to SEQ ID NO: 238297

SEQ ID NO: 720354 - RNA, 64 nt, Homo Sapiens; identical to SEQ ID NO: 238298

SEQ ID NO: 720355 - RNA, 64 nt, Homo Sapiens; identical to SEQ ID NO: 238299

SEQ ID NO: 720356 - RNA, 64 nt, Homo Sapiens; identical to SEQ ID NO: 238300

SEQ ID NO: 720357 - RNA, 64 nt, Homo Sapiens; identical to SEQ ID NO: 238301

SEQ ID NO: 720358 - RNA, 64 nt, Homo Sapiens; identical to SEQ ID NO: 238302

SEQ ID NO: 720359 - RNA, 64 nt, Homo Sapiens; identical to SEQ ID NO: 238303

SEQ ID NO: 720360 - RNA, 64 nt, Homo Sapiens; identical to SEQ ID NO: 238304

SEQ ID NO: 720361 - RNA, 64 nt, Homo Sapiens; identical to SEQ ID NO: 238305

SEQ ID NO: 720362 - RNA, 64 nt, Homo Sapiens; identical to SEQ ID NO: 238306

SEQ ID NO: 720363 - RNA, 64 nt, Homo Sapiens; identical to SEQ ID NO: 238307

SEQ ID NO: 720364 - RNA, 64 nt, Homo Sapiens; identical to SEQ ID NO: 238308

SEQ ID NO: 720365 - RNA, 64 nt, Homo Sapiens; identical to SEQ ID NO: 238309

SEQ ID NO: 720366 - RNA, 64 nt, Homo Sapiens; identical to SEQ ID NO: 238310

SEQ ID NO: 720367 - RNA, 64 nt, Homo Sapiens; identical to SEQ ID NO: 238311

SEQ ID NO: 720368 - RNA, 64 nt, Homo Sapiens; identical to SEQ ID NO: 238312

SEQ ID NO: 720369 - RNA, 64 nt, Homo Sapiens; identical to SEQ ID NO: 238313

SEQ ID NO: 720370 - RNA, 64 nt, Homo Sapiens; identical to SEQ ID NO: 238314

SEQ ID NO: 720371 - RNA, 64 nt, Homo Sapiens; identical to SEQ ID NO: 238315

SEQ ID NO: 720372 - RNA, 64 nt, Homo Sapiens; identical to SEQ ID NO: 238316

SEQ ID NO: 720373 - RNA, 64 nt, Homo Sapiens; identical to SEQ ID NO: 238317

SEQ ID NO: 720374 - RNA, 64 nt, Homo Sapiens; identical to SEQ ID NO: 238318

SEQ ID NO: 720375 - RNA, 64 nt, Homo Sapiens; identical to SEQ ID NO: 238319

SEQ ID NO: 720376 - RNA, 64 nt, Homo Sapiens; identical to SEQ ID NO: 238320

SEQ ID NO: 720377 - RNA, 64 nt, Homo Sapiens; identical to SEQ ID NO: 238321

SEQ ID NO: 720378 - RNA, 64 nt, Homo Sapiens; identical to SEQ ID NO: 238322

SEQ ID NO: 720379 - RNA, 64 nt, Homo Sapiens; identical to SEQ ID NO: 238323

SEQ ID NO: 720380 - RNA, 64 nt, Homo Sapiens; identical to SEQ ID NO: 238324

SEQ ID NO: 720381 - RNA, 64 nt, Homo Sapiens; identical to SEQ ID NO: 238325

SEQ ID NO: 720382 - RNA, 64 nt, Homo Sapiens; identical to SEQ ID NO: 238326

SEQ ID NO: 720383 - RNA, 64 nt, Homo Sapiens; identical to SEQ ID NO: 238327

SEQ ID NO: 720384 - RNA, 64 nt, Homo Sapiens; identical to SEQ ID NO: 238328

SEQ ID NO: 720385 - RNA, 64 nt, Homo Sapiens; identical to SEQ ID NO: 238329

SEQ ID NO: 720386 - RNA, 64 nt, Homo Sapiens; identical to SEQ ID NO: 238330

SEQ ID NO: 720387 - RNA, 64 nt, Homo Sapiens; identical to SEQ ID NO: 238331

SEQ ID NO: 720388 - RNA, 64 nt, Homo Sapiens; identical to SEQ ID NO: 238332

SEQ ID NO: 720389 - RNA, 64 nt, Homo Sapiens; identical to SEQ ID NO: 238333

SEQ ID NO: 720390 - RNA, 64 nt, Homo Sapiens; identical to SEQ ID NO: 238334

SEQ ID NO: 720391 - RNA, 64 nt, Homo Sapiens; identical to SEQ ID NO: 238335

SEQ ID NO: 720392 - RNA, 64 nt, Homo Sapiens; identical to SEQ ID NO: 238336

SEQ ID NO: 720393 - RNA, 64 nt, Homo Sapiens; identical to SEQ ID NO: 238337

SEQ ID NO: 720394 - RNA, 64 nt, Homo Sapiens; identical to SEQ ID NO: 238338

SEQ ID NO: 720395 - RNA, 64 nt, Homo Sapiens; identical to SEQ ID NO: 238339

SEQ ID NO: 720396 - RNA, 64 nt, Homo Sapiens; identical to SEQ ID NO: 238340

SEQ ID NO: 720397 - RNA, 64 nt, Homo Sapiens; identical to SEQ ID NO: 238341

SEQ ID NO: 720398 - RNA, 64 nt, Homo Sapiens; identical to SEQ ID NO: 238342

SEQ ID NO: 720399 - RNA, 64 nt, Homo Sapiens; identical to SEQ ID NO: 238343

SEQ ID NO: 720400 - RNA, 64 nt, Homo Sapiens; identical to SEQ ID NO: 238344

SEQ ID NO: 720401 - RNA, 64 nt, Homo Sapiens; identical to SEQ ID NO: 238345

SEQ ID NO: 720402 - RNA, 64 nt, Homo Sapiens; identical to SEQ ID NO: 238346

SEQ ID NO: 720403 - RNA, 64 nt, Homo Sapiens; identical to SEQ ID NO: 238347

SEQ ID NO: 720404 - RNA, 64 nt, Homo Sapiens; identical to SEQ ID NO: 238348

SEQ ID NO: 720405 - RNA, 64 nt, Homo Sapiens; identical to SEQ ID NO: 238349

SEQ ID NO: 720406 - RNA, 64 nt, Homo Sapiens; identical to SEQ ID NO: 238350

SEQ ID NO: 720407 - RNA, 64 nt, Homo Sapiens; identical to SEQ ID NO: 238351

SEQ ID NO: 720408 - RNA, 64 nt, Homo Sapiens; identical to SEQ ID NO: 238352

SEQ ID NO: 720409 - RNA, 64 nt, Homo Sapiens; identical to SEQ ID NO: 238353

SEQ ID NO: 720410 - RNA, 64 nt, Homo Sapiens
auacugccucuugaguaaucuuucugaaauuuaaacuugauauuuuucgcccucuugcuugaaa

SEQ ID NO: 720411 - RNA, 64 nt, Homo Sapiens
acaucuuuccuucuuauucugcaaacauuagaccacuugauauucuuuaaauaugucauguacu

SEQ ID NO: 720412 - RNA, 64 nt, Homo Sapiens
caucuucccuuuccacagauaacuucuguuaacaacuugauaucuauuguacaagauguguuac

SEQ ID NO: 720413 - RNA, 64 nt, Homo Sapiens
gaaucguuuaugugggagaauuguuaaucugagaacuugauacuaaaauguuuuaauauauucu

SEQ ID NO: 720414 - RNA, 64 nt, Homo Sapiens
aauaaauauuugguauuuuguaaguuauccugacacuugauaaaaagauaaaucucaacuuuaa

SEQ ID NO: 720415 - RNA, 64 nt, Homo Sapiens; identical to SEQ ID NO: 22017

SEQ ID NO: 720416 - RNA, 64 nt, Homo Sapiens; identical to SEQ ID NO: 22018

SEQ ID NO: 720417 - RNA, 64 nt, Homo Sapiens; identical to SEQ ID NO: 22019

SEQ ID NO: 720418 - RNA, 64 nt, Homo Sapiens; identical to SEQ ID NO: 22020

SEQ ID NO: 720419 - RNA, 64 nt, Homo Sapiens; identical to SEQ ID NO: 22021

SEQ ID NO: 720420 - RNA, 64 nt, Homo Sapiens; identical to SEQ ID NO: 22022

SEQ ID NO: 720421 - RNA, 64 nt, Homo Sapiens; identical to SEQ ID NO: 22023

SEQ ID NO: 720422 - RNA, 64 nt, Homo Sapiens; identical to SEQ ID NO: 22024

SEQ ID NO: 720423 - RNA, 64 nt, Homo Sapiens; identical to SEQ ID NO: 22025

SEQ ID NO: 720424 - RNA, 64 nt, Homo Sapiens; identical to SEQ ID NO: 22026

SEQ ID NO: 720425 - RNA, 64 nt, Homo Sapiens; identical to SEQ ID NO: 22027

SEQ ID NO: 720426 - RNA, 64 nt, Homo Sapiens; identical to SEQ ID NO: 22028

SEQ ID NO: 720427 - RNA, 64 nt, Homo Sapiens; identical to SEQ ID NO: 22029

SEQ ID NO: 720428 - RNA, 64 nt, Homo Sapiens; identical to SEQ ID NO: 22030

SEQ ID NO: 720429 - RNA, 64 nt, Homo Sapiens
gcucuaaccucaccucauucuaagccagugguaagggaaacacagguacugugccaggcacuga

SEQ ID NO: 720430 - RNA, 64 nt, Homo Sapiens
gauggccugagauaagcaguuauagcaagaauuugggaaacacauauacauugagccaaguuug

SEQ ID NO: 720431 - RNA, 64 nt, Homo Sapiens
acucuggccccuuucucagugcuaucugaugacggggaaacaaaauuauucucugagagggaaa

SEQ ID NO: 720432 - RNA, 64 nt, Homo Sapiens
caaaauuauucucugagagggaaaggacauuugagggaaacaucaaauuuccccauaaauaaau

SEQ ID NO: 720433 - RNA, 64 nt, Homo Sapiens
ugacagagcguuccuuuuaucaauggcaaaucgagggaaacauaccaaugguucccaguuuuuc

SEQ ID NO: 720434 - RNA, 64 nt, Homo Sapiens
cagcauguccgaaaguaaaguguugggugaaguggggaaacaggacagcagcucugcuagcuug

SEQ ID NO: 720435 - RNA, 64 nt, Homo Sapiens
auucauaauccgcaggaucuguagaagacauuuugggaaacacugucuuaaauaaaaacucaau

SEQ ID NO: 720436 - RNA, 64 nt, Homo Sapiens
ggggcagauuucauaacaacaucucaaaaauuuggggaaacacaacguugaaaacuuccuaaga

SEQ ID NO: 720437 - RNA, 64 nt, Homo Sapiens
gggccagagaugggaaaauuucuuguucaguccggggaaacacaccuaggugcuggugaugggc

SEQ ID NO: 720438 - RNA, 64 nt, Homo Sapiens
cccaaguggccugaaacaguguagggaaagaccugggaaacacuggaccaaaaaagccugaucu

SEQ ID NO: 720439 - RNA, 64 nt, Homo Sapiens
aaaggauguuugagggcagcguagaccugucuuugggaaacauucaaagguaauuuuauuaccu

SEQ ID NO: 720440 - RNA, 64 nt, Homo Sapiens
aaaucucgcugaauugaagaugcaguucagggaagggaaacaauccgcauggcaguuccuaggu

SEQ ID NO: 720441 - RNA, 64 nt, Homo Sapiens
ugauaaaugaaacuguaccgauaauggaauuaaugggaaacacuucacuuguuagcugucacua

SEQ ID NO: 720442 - RNA, 56 nt, Homo Sapiens
uggagauggggaagccgucugcccaugggaaacaggugauguauggcaaugaguga

SEQ ID NO: 720443 - RNA, 64 nt, Homo Sapiens
aacaggacagggugaaaaugcugggaauuauuaugggaaacaaaacuaucuauguucauauuuu

SEQ ID NO: 720444 - RNA, 64 nt, Homo Sapiens
guugagauuuagcucauggauauauuuuuugguagggaaacauuagggucuccuuuucuuccuu

SEQ ID NO: 720445 - RNA, 64 nt, Homo Sapiens
acgugcuguuccuaaucuggcacucagccccucugggaaacaucuuuuaauuagcaucucagaa

SEQ ID NO: 720446 - RNA, 64 nt, Homo Sapiens
aguucccagggcacauuucuggaucagaacccaugggaaacaggagguacuaagugcaaugucu

SEQ ID NO: 720447 - RNA, 64 nt, Homo Sapiens
caggcccugagcucacaggcagccaauguaaagagggaaacacagugaguuaugcaguucccag

SEQ ID NO: 720448 - RNA, 64 nt, Homo Sapiens
cuuuaaucuguaagauucaugaaauucggggccagggaaacaguuuagccuuagggaagggaaa

SEQ ID NO: 720449 - RNA, 64 nt, Homo Sapiens
aucuucacuacaaacacgccugagaguggcacuggggaaacauaacuccaucuacaccuuggau

SEQ ID NO: 720450 - RNA, 64 nt, Homo Sapiens
gauuuuucugaagggcauacaaugaaaagugaaggggaaacacacacacacaaaaaaacaagua

SEQ ID NO: 720451 - RNA, 64 nt, Homo Sapiens
gccauaccucuuaacaccucauagaacacacuuugggaaacaguggggguaggaaaacucggcc

SEQ ID NO: 720452 - RNA, 64 nt, Homo Sapiens
cucugaauaaccuagccaauaucaaacgagaacagggaaacauugaagaggcaguucgcuugua

SEQ ID NO: 720453 - RNA, 64 nt, Homo Sapiens
ucaguccuaccuuugcugaugccuacucuaauaugggaaacacucuaaaggagaugcaggaugu

SEQ ID NO: 720454 - RNA, 60 nt, Homo Sapiens
acuuuagaggacuuauuuaagaauugcuaagggaaacaggucuuacacaaauugacacua

SEQ ID NO: 720455 - RNA, 64 nt, Homo Sapiens
aagauuuuauaauauuuuuaguuaaacaagaguugggaaacagguggagaauaaugcaagagag

SEQ ID NO: 720456 - RNA, 64 nt, Homo Sapiens; identical to SEQ ID NO: 625832

SEQ ID NO: 720457 - RNA, 64 nt, Homo Sapiens; identical to SEQ ID NO: 625833

SEQ ID NO: 720458 - RNA, 64 nt, Homo Sapiens; identical to SEQ ID NO: 625834

SEQ ID NO: 720459 - RNA, 64 nt, Homo Sapiens; identical to SEQ ID NO: 625835

SEQ ID NO: 720460 - RNA, 64 nt, Homo Sapiens; identical to SEQ ID NO: 625836

SEQ ID NO: 720461 - RNA, 64 nt, Homo Sapiens; identical to SEQ ID NO: 625837

SEQ ID NO: 720462 - RNA, 64 nt, Homo Sapiens; identical to SEQ ID NO: 625838

SEQ ID NO: 720463 - RNA, 64 nt, Homo Sapiens; identical to SEQ ID NO: 625839

SEQ ID NO: 720464 - RNA, 64 nt, Homo Sapiens; identical to SEQ ID NO: 625840

SEQ ID NO: 720465 - RNA, 64 nt, Homo Sapiens; identical to SEQ ID NO: 625841

SEQ ID NO: 720466 - RNA, 64 nt, Homo Sapiens; identical to SEQ ID NO: 625842

SEQ ID NO: 720467 - RNA, 64 nt, Homo Sapiens; identical to SEQ ID NO: 625843

SEQ ID NO: 720468 - RNA, 64 nt, Homo Sapiens; identical to SEQ ID NO: 625844

SEQ ID NO: 720469 - RNA, 64 nt, Homo Sapiens; identical to SEQ ID NO: 625845

SEQ ID NO: 720470 - RNA, 64 nt, Homo Sapiens; identical to SEQ ID NO: 625846

SEQ ID NO: 720471 - RNA, 64 nt, Homo Sapiens; identical to SEQ ID NO: 625847

SEQ ID NO: 720472 - RNA, 64 nt, Homo Sapiens; identical to SEQ ID NO: 625848

SEQ ID NO: 720473 - RNA, 64 nt, Homo Sapiens; identical to SEQ ID NO: 625849

SEQ ID NO: 720474 - RNA, 64 nt, Homo Sapiens; identical to SEQ ID NO: 625850

SEQ ID NO: 720475 - RNA, 64 nt, Homo Sapiens; identical to SEQ ID NO: 625851

SEQ ID NO: 720476 - RNA, 59 nt, Homo Sapiens; identical to SEQ ID NO: 625852

SEQ ID NO: 720477 - RNA, 64 nt, Homo Sapiens; identical to SEQ ID NO: 625853

SEQ ID NO: 720478 - RNA, 64 nt, Homo Sapiens
gccucaggccaugggucaaaccugggagggaaagagacccuacacauggccuagaaaugagaga

SEQ ID NO: 720479 - RNA, 64 nt, Homo Sapiens
gaacauuccaggugaggcacuucaaaguuuccuuagacccuauaguguuaagagguauuuuaaa

SEQ ID NO: 720480 - RNA, 64 nt, Homo Sapiens
aaauugucucguuuauuuuaaauaucugugaaguagacccuagagauuuuauucaagcuuucua

SEQ ID NO: 720481 - RNA, 64 nt, Homo Sapiens
ccuacaaaaaauuucugaaauaggcaacauagggagacccuaucccaggaguucaagaucagcc

SEQ ID NO: 720482 - RNA, 64 nt, Homo Sapiens
aaagagcaacucagcaggacacagaacuaaaacuacuacuuacaucuaacagacacacuacaag

SEQ ID NO: 720483 - RNA, 64 nt, Homo Sapiens
caggacagcauuugacuuuuauuuaaaaggcggcacuacuuauguaaaucugagcugugggaua

SEQ ID NO: 720484 - RNA, 64 nt, Homo Sapiens; identical to SEQ ID NO: 544429

SEQ ID NO: 720485 - RNA, 64 nt, Homo Sapiens; identical to SEQ ID NO: 544430

SEQ ID NO: 720486 - RNA, 64 nt, Homo Sapiens; identical to SEQ ID NO: 544431

SEQ ID NO: 720487 - RNA, 64 nt, Homo Sapiens; identical to SEQ ID NO: 544432

SEQ ID NO: 720488 - RNA, 64 nt, Homo Sapiens; identical to SEQ ID NO: 544433

SEQ ID NO: 720489 - RNA, 64 nt, Homo Sapiens; identical to SEQ ID NO: 544434

SEQ ID NO: 720490 - RNA, 64 nt, Homo Sapiens; identical to SEQ ID NO: 544435

SEQ ID NO: 720491 - RNA, 64 nt, Homo Sapiens; identical to SEQ ID NO: 544436

SEQ ID NO: 720492 - RNA, 64 nt, Homo Sapiens; identical to SEQ ID NO: 544437

SEQ ID NO: 720493 - RNA, 64 nt, Homo Sapiens; identical to SEQ ID NO: 544438

SEQ ID NO: 720494 - RNA, 64 nt, Homo Sapiens; identical to SEQ ID NO: 544439

SEQ ID NO: 720495 - RNA, 64 nt, Homo Sapiens; identical to SEQ ID NO: 544440

SEQ ID NO: 720496 - RNA, 64 nt, Homo Sapiens; identical to SEQ ID NO: 544441

SEQ ID NO: 720497 - RNA, 64 nt, Homo Sapiens; identical to SEQ ID NO: 544442

SEQ ID NO: 720498 - RNA, 64 nt, Homo Sapiens; identical to SEQ ID NO: 537024

SEQ ID NO: 720499 - RNA, 64 nt, Homo Sapiens; identical to SEQ ID NO: 537025

SEQ ID NO: 720500 - RNA, 64 nt, Homo Sapiens; identical to SEQ ID NO: 537026

SEQ ID NO: 720501 - RNA, 64 nt, Homo Sapiens; identical to SEQ ID NO: 537027

SEQ ID NO: 720502 - RNA, 64 nt, Homo Sapiens; identical to SEQ ID NO: 282773

SEQ ID NO: 720503 - RNA, 64 nt, Homo Sapiens; identical to SEQ ID NO: 282774

SEQ ID NO: 720504 - RNA, 64 nt, Homo Sapiens; identical to SEQ ID NO: 282775

SEQ ID NO: 720505 - RNA, 64 nt, Homo Sapiens; identical to SEQ ID NO: 282776

SEQ ID NO: 720506 - RNA, 64 nt, Homo Sapiens; identical to SEQ ID NO: 282777

SEQ ID NO: 720507 - RNA, 64 nt, Homo Sapiens; identical to SEQ ID NO: 282778

SEQ ID NO: 720508 - RNA, 64 nt, Homo Sapiens; identical to SEQ ID NO: 282779

SEQ ID NO: 720509 - RNA, 64 nt, Homo Sapiens; identical to SEQ ID NO: 282780

SEQ ID NO: 720510 - RNA, 64 nt, Homo Sapiens; identical to SEQ ID NO: 282781

SEQ ID NO: 720511 - RNA, 64 nt, Homo Sapiens; identical to SEQ ID NO: 282782

SEQ ID NO: 720512 - RNA, 64 nt, Homo Sapiens; identical to SEQ ID NO: 282783

SEQ ID NO: 720513 - RNA, 54 nt, Homo Sapiens; identical to SEQ ID NO: 282784

SEQ ID NO: 720514 - RNA, 64 nt, Homo Sapiens; identical to SEQ ID NO: 282785

SEQ ID NO: 720515 - RNA, 64 nt, Homo Sapiens; identical to SEQ ID NO: 282786

SEQ ID NO: 720516 - RNA, 64 nt, Homo Sapiens; identical to SEQ ID NO: 282787

SEQ ID NO: 720517 - RNA, 64 nt, Homo Sapiens; identical to SEQ ID NO: 282788

SEQ ID NO: 720518 - RNA, 64 nt, Homo Sapiens; identical to SEQ ID NO: 282789

SEQ ID NO: 720519 - RNA, 64 nt, Homo Sapiens; identical to SEQ ID NO: 282790

SEQ ID NO: 720520 - RNA, 64 nt, Homo Sapiens; identical to SEQ ID NO: 282791

SEQ ID NO: 720521 - RNA, 64 nt, Homo Sapiens; identical to SEQ ID NO: 282792

SEQ ID NO: 720522 - RNA, 64 nt, Homo Sapiens; identical to SEQ ID NO: 282793

SEQ ID NO: 720523 - RNA, 64 nt, Homo Sapiens; identical to SEQ ID NO: 282794

SEQ ID NO: 720524 - RNA, 64 nt, Homo Sapiens; identical to SEQ ID NO: 282795

SEQ ID NO: 720525 - RNA, 64 nt, Homo Sapiens; identical to SEQ ID NO: 282796

SEQ ID NO: 720526 - RNA, 64 nt, Homo Sapiens; identical to SEQ ID NO: 282797

SEQ ID NO: 720527 - RNA, 64 nt, Homo Sapiens; identical to SEQ ID NO: 282798

SEQ ID NO: 720528 - RNA, 64 nt, Homo Sapiens; identical to SEQ ID NO: 282799

SEQ ID NO: 720529 - RNA, 64 nt, Homo Sapiens; identical to SEQ ID NO: 282800

SEQ ID NO: 720530 - RNA, 64 nt, Homo Sapiens; identical to SEQ ID NO: 282801

SEQ ID NO: 720531 - RNA, 64 nt, Homo Sapiens; identical to SEQ ID NO: 282802

SEQ ID NO: 720532 - RNA, 64 nt, Homo Sapiens; identical to SEQ ID NO: 282803

SEQ ID NO: 720533 - RNA, 64 nt, Homo Sapiens; identical to SEQ ID NO: 282804

SEQ ID NO: 720534 - RNA, 64 nt, Homo Sapiens; identical to SEQ ID NO: 282805

SEQ ID NO: 720535 - RNA, 64 nt, Homo Sapiens; identical to SEQ ID NO: 282806

SEQ ID NO: 720536 - RNA, 64 nt, Homo Sapiens; identical to SEQ ID NO: 282807

SEQ ID NO: 720537 - RNA, 64 nt, Homo Sapiens; identical to SEQ ID NO: 282808

SEQ ID NO: 720538 - RNA, 64 nt, Homo Sapiens; identical to SEQ ID NO: 282809

SEQ ID NO: 720539 - RNA, 64 nt, Homo Sapiens; identical to SEQ ID NO: 282810

SEQ ID NO: 720540 - RNA, 64 nt, Homo Sapiens; identical to SEQ ID NO: 282811

SEQ ID NO: 720541 - RNA, 64 nt, Homo Sapiens; identical to SEQ ID NO: 282812

SEQ ID NO: 720542 - RNA, 64 nt, Homo Sapiens; identical to SEQ ID NO: 282813

SEQ ID NO: 720543 - RNA, 64 nt, Homo Sapiens; identical to SEQ ID NO: 282814

SEQ ID NO: 720544 - RNA, 64 nt, Homo Sapiens; identical to SEQ ID NO: 282815

SEQ ID NO: 720545 - RNA, 64 nt, Homo Sapiens; identical to SEQ ID NO: 282816

SEQ ID NO: 720546 - RNA, 64 nt, Homo Sapiens; identical to SEQ ID NO: 282817

SEQ ID NO: 720547 - RNA, 64 nt, Homo Sapiens; identical to SEQ ID NO: 282818

SEQ ID NO: 720548 - RNA, 64 nt, Homo Sapiens; identical to SEQ ID NO: 282819

SEQ ID NO: 720549 - RNA, 64 nt, Homo Sapiens; identical to SEQ ID NO: 282820

SEQ ID NO: 720550 - RNA, 64 nt, Homo Sapiens; identical to SEQ ID NO: 282821

SEQ ID NO: 720551 - RNA, 64 nt, Homo Sapiens; identical to SEQ ID NO: 282822

SEQ ID NO: 720552 - RNA, 64 nt, Homo Sapiens; identical to SEQ ID NO: 282823

SEQ ID NO: 720553 - RNA, 64 nt, Homo Sapiens; identical to SEQ ID NO: 282824

SEQ ID NO: 720554 - RNA, 64 nt, Homo Sapiens; identical to SEQ ID NO: 282825

SEQ ID NO: 720555 - RNA, 64 nt, Homo Sapiens; identical to SEQ ID NO: 282826

SEQ ID NO: 720556 - RNA, 64 nt, Homo Sapiens; identical to SEQ ID NO: 282827

SEQ ID NO: 720557 - RNA, 64 nt, Homo Sapiens; identical to SEQ ID NO: 282828

SEQ ID NO: 720558 - RNA, 64 nt, Homo Sapiens; identical to SEQ ID NO: 282829

SEQ ID NO: 720559 - RNA, 64 nt, Homo Sapiens; identical to SEQ ID NO: 282830

SEQ ID NO: 720560 - RNA, 64 nt, Homo Sapiens; identical to SEQ ID NO: 282831

SEQ ID NO: 720561 - RNA, 64 nt, Homo Sapiens; identical to SEQ ID NO: 282832

SEQ ID NO: 720562 - RNA, 64 nt, Homo Sapiens; identical to SEQ ID NO: 282833

SEQ ID NO: 720563 - RNA, 53 nt, Homo Sapiens; identical to SEQ ID NO: 282834

SEQ ID NO: 720564 - RNA, 64 nt, Homo Sapiens; identical to SEQ ID NO: 282835

SEQ ID NO: 720565 - RNA, 64 nt, Homo Sapiens; identical to SEQ ID NO: 282836

SEQ ID NO: 720566 - RNA, 64 nt, Homo Sapiens; identical to SEQ ID NO: 282837

SEQ ID NO: 720567 - RNA, 64 nt, Homo Sapiens; identical to SEQ ID NO: 282838

SEQ ID NO: 720568 - RNA, 64 nt, Homo Sapiens; identical to SEQ ID NO: 282839

SEQ ID NO: 720569 - RNA, 64 nt, Homo Sapiens; identical to SEQ ID NO: 282840

SEQ ID NO: 720570 - RNA, 64 nt, Homo Sapiens; identical to SEQ ID NO: 282841

SEQ ID NO: 720571 - RNA, 64 nt, Homo Sapiens; identical to SEQ ID NO: 282842

SEQ ID NO: 720572 - RNA, 64 nt, Homo Sapiens; identical to SEQ ID NO: 282843

SEQ ID NO: 720573 - RNA, 64 nt, Homo Sapiens; identical to SEQ ID NO: 282844

SEQ ID NO: 720574 - RNA, 64 nt, Homo Sapiens; identical to SEQ ID NO: 282845

SEQ ID NO: 720575 - RNA, 64 nt, Homo Sapiens; identical to SEQ ID NO: 282846

SEQ ID NO: 720576 - RNA, 53 nt, Homo Sapiens; identical to SEQ ID NO: 282847

SEQ ID NO: 720577 - RNA, 64 nt, Homo Sapiens; identical to SEQ ID NO: 282848

SEQ ID NO: 720578 - RNA, 64 nt, Homo Sapiens; identical to SEQ ID NO: 282849

SEQ ID NO: 720579 - RNA, 64 nt, Homo Sapiens; identical to SEQ ID NO: 282850

SEQ ID NO: 720580 - RNA, 64 nt, Homo Sapiens; identical to SEQ ID NO: 282851

SEQ ID NO: 720581 - RNA, 64 nt, Homo Sapiens; identical to SEQ ID NO: 282852

SEQ ID NO: 720582 - RNA, 64 nt, Homo Sapiens; identical to SEQ ID NO: 282853

SEQ ID NO: 720583 - RNA, 64 nt, Homo Sapiens; identical to SEQ ID NO: 282854

SEQ ID NO: 720584 - RNA, 64 nt, Homo Sapiens; identical to SEQ ID NO: 282855

SEQ ID NO: 720585 - RNA, 64 nt, Homo Sapiens; identical to SEQ ID NO: 282856

SEQ ID NO: 720586 - RNA, 64 nt, Homo Sapiens; identical to SEQ ID NO: 282857

SEQ ID NO: 720587 - RNA, 64 nt, Homo Sapiens; identical to SEQ ID NO: 282858

SEQ ID NO: 720588 - RNA, 64 nt, Homo Sapiens; identical to SEQ ID NO: 282859

SEQ ID NO: 720589 - RNA, 64 nt, Homo Sapiens; identical to SEQ ID NO: 282860

SEQ ID NO: 720590 - RNA, 64 nt, Homo Sapiens; identical to SEQ ID NO: 282861

SEQ ID NO: 720591 - RNA, 64 nt, Homo Sapiens; identical to SEQ ID NO: 282862

SEQ ID NO: 720592 - RNA, 64 nt, Homo Sapiens; identical to SEQ ID NO: 282863

SEQ ID NO: 720593 - RNA, 64 nt, Homo Sapiens; identical to SEQ ID NO: 282864

SEQ ID NO: 720594 - RNA, 64 nt, Homo Sapiens; identical to SEQ ID NO: 282865

SEQ ID NO: 720595 - RNA, 64 nt, Homo Sapiens; identical to SEQ ID NO: 282866

SEQ ID NO: 720596 - RNA, 64 nt, Homo Sapiens; identical to SEQ ID NO: 282867

SEQ ID NO: 720597 - RNA, 64 nt, Homo Sapiens; identical to SEQ ID NO: 282868

SEQ ID NO: 720598 - RNA, 64 nt, Homo Sapiens; identical to SEQ ID NO: 282869

SEQ ID NO: 720599 - RNA, 64 nt, Homo Sapiens; identical to SEQ ID NO: 282870

SEQ ID NO: 720600 - RNA, 64 nt, Homo Sapiens; identical to SEQ ID NO: 282871

SEQ ID NO: 720601 - RNA, 64 nt, Homo Sapiens; identical to SEQ ID NO: 282872

SEQ ID NO: 720602 - RNA, 64 nt, Homo Sapiens; identical to SEQ ID NO: 282873

SEQ ID NO: 720603 - RNA, 64 nt, Homo Sapiens; identical to SEQ ID NO: 282874

SEQ ID NO: 720604 - RNA, 64 nt, Homo Sapiens; identical to SEQ ID NO: 282875

SEQ ID NO: 720605 - RNA, 64 nt, Homo Sapiens; identical to SEQ ID NO: 282876

SEQ ID NO: 720606 - RNA, 64 nt, Homo Sapiens; identical to SEQ ID NO: 282877

SEQ ID NO: 720607 - RNA, 64 nt, Homo Sapiens; identical to SEQ ID NO: 282878

SEQ ID NO: 720608 - RNA, 64 nt, Homo Sapiens; identical to SEQ ID NO: 282879

SEQ ID NO: 720609 - RNA, 64 nt, Homo Sapiens; identical to SEQ ID NO: 282880

SEQ ID NO: 720610 - RNA, 64 nt, Homo Sapiens; identical to SEQ ID NO: 282881

SEQ ID NO: 720611 - RNA, 64 nt, Homo Sapiens; identical to SEQ ID NO: 282882

SEQ ID NO: 720612 - RNA, 64 nt, Homo Sapiens; identical to SEQ ID NO: 282883

SEQ ID NO: 720613 - RNA, 64 nt, Homo Sapiens; identical to SEQ ID NO: 282884

SEQ ID NO: 720614 - RNA, 64 nt, Homo Sapiens; identical to SEQ ID NO: 282885

SEQ ID NO: 720615 - RNA, 64 nt, Homo Sapiens; identical to SEQ ID NO: 282886

SEQ ID NO: 720616 - RNA, 64 nt, Homo Sapiens; identical to SEQ ID NO: 282887

SEQ ID NO: 720617 - RNA, 64 nt, Homo Sapiens; identical to SEQ ID NO: 282888

SEQ ID NO: 720618 - RNA, 64 nt, Homo Sapiens; identical to SEQ ID NO: 282889

SEQ ID NO: 720619 - RNA, 64 nt, Homo Sapiens; identical to SEQ ID NO: 282890

SEQ ID NO: 720620 - RNA, 64 nt, Homo Sapiens; identical to SEQ ID NO: 282891

SEQ ID NO: 720621 - RNA, 64 nt, Homo Sapiens; identical to SEQ ID NO: 282892

SEQ ID NO: 720622 - RNA, 64 nt, Homo Sapiens; identical to SEQ ID NO: 282893

SEQ ID NO: 720623 - RNA, 64 nt, Homo Sapiens; identical to SEQ ID NO: 282894

SEQ ID NO: 720624 - RNA, 64 nt, Homo Sapiens; identical to SEQ ID NO: 282895

SEQ ID NO: 720625 - RNA, 64 nt, Homo Sapiens; identical to SEQ ID NO: 282896

SEQ ID NO: 720626 - RNA, 64 nt, Homo Sapiens; identical to SEQ ID NO: 282897

SEQ ID NO: 720627 - RNA, 64 nt, Homo Sapiens; identical to SEQ ID NO: 282898

SEQ ID NO: 720628 - RNA, 64 nt, Homo Sapiens; identical to SEQ ID NO: 282899

SEQ ID NO: 720629 - RNA, 64 nt, Homo Sapiens; identical to SEQ ID NO: 282900

SEQ ID NO: 720630 - RNA, 64 nt, Homo Sapiens; identical to SEQ ID NO: 282901

SEQ ID NO: 720631 - RNA, 64 nt, Homo Sapiens; identical to SEQ ID NO: 282902

SEQ ID NO: 720632 - RNA, 64 nt, Homo Sapiens; identical to SEQ ID NO: 282903

SEQ ID NO: 720633 - RNA, 64 nt, Homo Sapiens; identical to SEQ ID NO: 282904

SEQ ID NO: 720634 - RNA, 64 nt, Homo Sapiens; identical to SEQ ID NO: 282905

SEQ ID NO: 720635 - RNA, 64 nt, Homo Sapiens; identical to SEQ ID NO: 282906

SEQ ID NO: 720636 - RNA, 64 nt, Homo Sapiens; identical to SEQ ID NO: 282907

SEQ ID NO: 720637 - RNA, 64 nt, Homo Sapiens; identical to SEQ ID NO: 282908

SEQ ID NO: 720638 - RNA, 64 nt, Homo Sapiens; identical to SEQ ID NO: 282909

SEQ ID NO: 720639 - RNA, 64 nt, Homo Sapiens; identical to SEQ ID NO: 282910

SEQ ID NO: 720640 - RNA, 64 nt, Homo Sapiens; identical to SEQ ID NO: 282911

SEQ ID NO: 720641 - RNA, 53 nt, Homo Sapiens; identical to SEQ ID NO: 615283

SEQ ID NO: 720642 - RNA, 64 nt, Homo Sapiens; identical to SEQ ID NO: 615284

SEQ ID NO: 720643 - RNA, 64 nt, Homo Sapiens; identical to SEQ ID NO: 615285

SEQ ID NO: 720644 - RNA, 64 nt, Homo Sapiens; identical to SEQ ID NO: 615286

SEQ ID NO: 720645 - RNA, 64 nt, Homo Sapiens; identical to SEQ ID NO: 615287

SEQ ID NO: 720646 - RNA, 64 nt, Homo Sapiens; identical to SEQ ID NO: 615288

SEQ ID NO: 720647 - RNA, 64 nt, Homo Sapiens; identical to SEQ ID NO: 615289

SEQ ID NO: 720648 - RNA, 64 nt, Homo Sapiens; identical to SEQ ID NO: 615290

SEQ ID NO: 720649 - RNA, 64 nt, Homo Sapiens; identical to SEQ ID NO: 615291

SEQ ID NO: 720650 - RNA, 62 nt, Homo Sapiens; identical to SEQ ID NO: 615292

SEQ ID NO: 720651 - RNA, 64 nt, Homo Sapiens; identical to SEQ ID NO: 615293

SEQ ID NO: 720652 - RNA, 64 nt, Homo Sapiens; identical to SEQ ID NO: 615294

SEQ ID NO: 720653 - RNA, 64 nt, Homo Sapiens; identical to SEQ ID NO: 615295

SEQ ID NO: 720654 - RNA, 64 nt, Homo Sapiens; identical to SEQ ID NO: 615296

SEQ ID NO: 720655 - RNA, 64 nt, Homo Sapiens; identical to SEQ ID NO: 615297

SEQ ID NO: 720656 - RNA, 64 nt, Homo Sapiens; identical to SEQ ID NO: 615298

SEQ ID NO: 720657 - RNA, 64 nt, Homo Sapiens; identical to SEQ ID NO: 615299

SEQ ID NO: 720658 - RNA, 64 nt, Homo Sapiens; identical to SEQ ID NO: 615300

SEQ ID NO: 720659 - RNA, 64 nt, Homo Sapiens; identical to SEQ ID NO: 615301

SEQ ID NO: 720660 - RNA, 64 nt, Homo Sapiens; identical to SEQ ID NO: 615302

SEQ ID NO: 720661 - RNA, 64 nt, Homo Sapiens; identical to SEQ ID NO: 615303

SEQ ID NO: 720662 - RNA, 64 nt, Homo Sapiens; identical to SEQ ID NO: 615304

SEQ ID NO: 720663 - RNA, 64 nt, Homo Sapiens; identical to SEQ ID NO: 615305

SEQ ID NO: 720664 - RNA, 64 nt, Homo Sapiens; identical to SEQ ID NO: 615306

SEQ ID NO: 720665 - RNA, 64 nt, Homo Sapiens; identical to SEQ ID NO: 615307

SEQ ID NO: 720666 - RNA, 64 nt, Homo Sapiens; identical to SEQ ID NO: 615308

SEQ ID NO: 720667 - RNA, 64 nt, Homo Sapiens; identical to SEQ ID NO: 615309

SEQ ID NO: 720668 - RNA, 64 nt, Homo Sapiens; identical to SEQ ID NO: 615310

SEQ ID NO: 720669 - RNA, 64 nt, Homo Sapiens; identical to SEQ ID NO: 615311

SEQ ID NO: 720670 - RNA, 64 nt, Homo Sapiens; identical to SEQ ID NO: 559716

SEQ ID NO: 720671 - RNA, 64 nt, Homo Sapiens; identical to SEQ ID NO: 559717

SEQ ID NO: 720672 - RNA, 64 nt, Homo Sapiens; identical to SEQ ID NO: 559718

SEQ ID NO: 720673 - RNA, 64 nt, Homo Sapiens; identical to SEQ ID NO: 559719

SEQ ID NO: 720674 - RNA, 64 nt, Homo Sapiens; identical to SEQ ID NO: 559720

SEQ ID NO: 720675 - RNA, 64 nt, Homo Sapiens; identical to SEQ ID NO: 559721

SEQ ID NO: 720676 - RNA, 64 nt, Homo Sapiens; identical to SEQ ID NO: 559722

SEQ ID NO: 720677 - RNA, 64 nt, Homo Sapiens; identical to SEQ ID NO: 559723

SEQ ID NO: 720678 - RNA, 64 nt, Homo Sapiens; identical to SEQ ID NO: 559724

SEQ ID NO: 720679 - RNA, 64 nt, Homo Sapiens; identical to SEQ ID NO: 559725

SEQ ID NO: 720680 - RNA, 64 nt, Homo Sapiens; identical to SEQ ID NO: 559726

SEQ ID NO: 720681 - RNA, 64 nt, Homo Sapiens; identical to SEQ ID NO: 68936

SEQ ID NO: 720682 - RNA, 64 nt, Homo Sapiens; identical to SEQ ID NO: 68937

SEQ ID NO: 720683 - RNA, 64 nt, Homo Sapiens; identical to SEQ ID NO: 68938

SEQ ID NO: 720684 - RNA, 64 nt, Homo Sapiens; identical to SEQ ID NO: 68939

SEQ ID NO: 720685 - RNA, 64 nt, Homo Sapiens; identical to SEQ ID NO: 68940

SEQ ID NO: 720686 - RNA, 64 nt, Homo Sapiens; identical to SEQ ID NO: 68941

SEQ ID NO: 720687 - RNA, 64 nt, Homo Sapiens; identical to SEQ ID NO: 68942

SEQ ID NO: 720688 - RNA, 64 nt, Homo Sapiens; identical to SEQ ID NO: 68943

SEQ ID NO: 720689 - RNA, 64 nt, Homo Sapiens; identical to SEQ ID NO: 68944

SEQ ID NO: 720690 - RNA, 64 nt, Homo Sapiens; identical to SEQ ID NO: 68945

SEQ ID NO: 720691 - RNA, 64 nt, Homo Sapiens; identical to SEQ ID NO: 68946

SEQ ID NO: 720692 - RNA, 64 nt, Homo Sapiens; identical to SEQ ID NO: 68947

SEQ ID NO: 720693 - RNA, 64 nt, Homo Sapiens; identical to SEQ ID NO: 68948

SEQ ID NO: 720694 - RNA, 64 nt, Homo Sapiens; identical to SEQ ID NO: 68949

SEQ ID NO: 720695 - RNA, 64 nt, Homo Sapiens; identical to SEQ ID NO: 68950

SEQ ID NO: 720696 - RNA, 64 nt, Homo Sapiens; identical to SEQ ID NO: 68951

SEQ ID NO: 720697 - RNA, 64 nt, Homo Sapiens; identical to SEQ ID NO: 68952

SEQ ID NO: 720698 - RNA, 64 nt, Homo Sapiens; identical to SEQ ID NO: 68953

SEQ ID NO: 720699 - RNA, 64 nt, Homo Sapiens; identical to SEQ ID NO: 68954

SEQ ID NO: 720700 - RNA, 64 nt, Homo Sapiens; identical to SEQ ID NO: 68955

SEQ ID NO: 720701 - RNA, 64 nt, Homo Sapiens; identical to SEQ ID NO: 68956

SEQ ID NO: 720702 - RNA, 64 nt, Homo Sapiens; identical to SEQ ID NO: 68957

SEQ ID NO: 720703 - RNA, 64 nt, Homo Sapiens; identical to SEQ ID NO: 68958

SEQ ID NO: 720704 - RNA, 64 nt, Homo Sapiens; identical to SEQ ID NO: 68959

SEQ ID NO: 720705 - RNA, 64 nt, Homo Sapiens; identical to SEQ ID NO: 68960

SEQ ID NO: 720706 - RNA, 64 nt, Homo Sapiens; identical to SEQ ID NO: 68961

SEQ ID NO: 720707 - RNA, 64 nt, Homo Sapiens; identical to SEQ ID NO: 68962

SEQ ID NO: 720708 - RNA, 64 nt, Homo Sapiens; identical to SEQ ID NO: 68963

SEQ ID NO: 720709 - RNA, 64 nt, Homo Sapiens; identical to SEQ ID NO: 68964

SEQ ID NO: 720710 - RNA, 64 nt, Homo Sapiens; identical to SEQ ID NO: 68965

SEQ ID NO: 720711 - RNA, 64 nt, Homo Sapiens; identical to SEQ ID NO: 68966

SEQ ID NO: 720712 - RNA, 64 nt, Homo Sapiens; identical to SEQ ID NO: 68967

SEQ ID NO: 720713 - RNA, 64 nt, Homo Sapiens; identical to SEQ ID NO: 68968

SEQ ID NO: 720714 - RNA, 64 nt, Homo Sapiens; identical to SEQ ID NO: 68969

SEQ ID NO: 720715 - RNA, 64 nt, Homo Sapiens; identical to SEQ ID NO: 68970

SEQ ID NO: 720716 - RNA, 64 nt, Homo Sapiens; identical to SEQ ID NO: 68971

SEQ ID NO: 720717 - RNA, 64 nt, Homo Sapiens; identical to SEQ ID NO: 68972

SEQ ID NO: 720718 - RNA, 64 nt, Homo Sapiens; identical to SEQ ID NO: 68973

SEQ ID NO: 720719 - RNA, 64 nt, Homo Sapiens; identical to SEQ ID NO: 68974

SEQ ID NO: 720720 - RNA, 64 nt, Homo Sapiens; identical to SEQ ID NO: 68975

SEQ ID NO: 720721 - RNA, 64 nt, Homo Sapiens; identical to SEQ ID NO: 68976

SEQ ID NO: 720722 - RNA, 64 nt, Homo Sapiens; identical to SEQ ID NO: 68977

SEQ ID NO: 720723 - RNA, 64 nt, Homo Sapiens; identical to SEQ ID NO: 68978

SEQ ID NO: 720724 - RNA, 64 nt, Homo Sapiens; identical to SEQ ID NO: 68979

SEQ ID NO: 720725 - RNA, 64 nt, Homo Sapiens; identical to SEQ ID NO: 68980

SEQ ID NO: 720726 - RNA, 64 nt, Homo Sapiens; identical to SEQ ID NO: 68981

SEQ ID NO: 720727 - RNA, 62 nt, Homo Sapiens; identical to SEQ ID NO: 68982

SEQ ID NO: 720728 - RNA, 64 nt, Homo Sapiens; identical to SEQ ID NO: 68983

SEQ ID NO: 720729 - RNA, 64 nt, Homo Sapiens; identical to SEQ ID NO: 68984

SEQ ID NO: 720730 - RNA, 64 nt, Homo Sapiens; identical to SEQ ID NO: 68985

SEQ ID NO: 720731 - RNA, 64 nt, Homo Sapiens; identical to SEQ ID NO: 68986

SEQ ID NO: 720732 - RNA, 64 nt, Homo Sapiens; identical to SEQ ID NO: 68987

SEQ ID NO: 720733 - RNA, 64 nt, Homo Sapiens; identical to SEQ ID NO: 68988

SEQ ID NO: 720734 - RNA, 64 nt, Homo Sapiens; identical to SEQ ID NO: 68989

SEQ ID NO: 720735 - RNA, 64 nt, Homo Sapiens; identical to SEQ ID NO: 68990

SEQ ID NO: 720736 - RNA, 64 nt, Homo Sapiens; identical to SEQ ID NO: 68991

SEQ ID NO: 720737 - RNA, 64 nt, Homo Sapiens; identical to SEQ ID NO: 68992

SEQ ID NO: 720738 - RNA, 64 nt, Homo Sapiens; identical to SEQ ID NO: 68993

SEQ ID NO: 720739 - RNA, 64 nt, Homo Sapiens; identical to SEQ ID NO: 68994

SEQ ID NO: 720740 - RNA, 64 nt, Homo Sapiens; identical to SEQ ID NO: 68995

SEQ ID NO: 720741 - RNA, 64 nt, Homo Sapiens; identical to SEQ ID NO: 68996

SEQ ID NO: 720742 - RNA, 64 nt, Homo Sapiens; identical to SEQ ID NO: 68997

SEQ ID NO: 720743 - RNA, 64 nt, Homo Sapiens; identical to SEQ ID NO: 68998

SEQ ID NO: 720744 - RNA, 64 nt, Homo Sapiens; identical to SEQ ID NO: 68999

SEQ ID NO: 720745 - RNA, 64 nt, Homo Sapiens; identical to SEQ ID NO: 69000

SEQ ID NO: 720746 - RNA, 64 nt, Homo Sapiens; identical to SEQ ID NO: 69001

SEQ ID NO: 720747 - RNA, 64 nt, Homo Sapiens; identical to SEQ ID NO: 69002

SEQ ID NO: 720748 - RNA, 64 nt, Homo Sapiens; identical to SEQ ID NO: 69003

SEQ ID NO: 720749 - RNA, 64 nt, Homo Sapiens; identical to SEQ ID NO: 69004

SEQ ID NO: 720750 - RNA, 64 nt, Homo Sapiens; identical to SEQ ID NO: 69005

SEQ ID NO: 720751 - RNA, 64 nt, Homo Sapiens; identical to SEQ ID NO: 69006

SEQ ID NO: 720752 - RNA, 64 nt, Homo Sapiens; identical to SEQ ID NO: 69007

SEQ ID NO: 720753 - RNA, 64 nt, Homo Sapiens; identical to SEQ ID NO: 69008

SEQ ID NO: 720754 - RNA, 64 nt, Homo Sapiens; identical to SEQ ID NO: 69009

SEQ ID NO: 720755 - RNA, 64 nt, Homo Sapiens; identical to SEQ ID NO: 69010

SEQ ID NO: 720756 - RNA, 64 nt, Homo Sapiens; identical to SEQ ID NO: 69011

SEQ ID NO: 720757 - RNA, 64 nt, Homo Sapiens; identical to SEQ ID NO: 69012

SEQ ID NO: 720758 - RNA, 64 nt, Homo Sapiens; identical to SEQ ID NO: 69013

SEQ ID NO: 720759 - RNA, 64 nt, Homo Sapiens; identical to SEQ ID NO: 69014

SEQ ID NO: 720760 - RNA, 64 nt, Homo Sapiens; identical to SEQ ID NO: 69015

SEQ ID NO: 720761 - RNA, 64 nt, Homo Sapiens; identical to SEQ ID NO: 69016

SEQ ID NO: 720762 - RNA, 64 nt, Homo Sapiens; identical to SEQ ID NO: 69017

SEQ ID NO: 720763 - RNA, 64 nt, Homo Sapiens; identical to SEQ ID NO: 69018

SEQ ID NO: 720764 - RNA, 64 nt, Homo Sapiens; identical to SEQ ID NO: 69019

SEQ ID NO: 720765 - RNA, 64 nt, Homo Sapiens; identical to SEQ ID NO: 69020

SEQ ID NO: 720766 - RNA, 64 nt, Homo Sapiens; identical to SEQ ID NO: 69021

SEQ ID NO: 720767 - RNA, 64 nt, Homo Sapiens; identical to SEQ ID NO: 69022

SEQ ID NO: 720768 - RNA, 64 nt, Homo Sapiens; identical to SEQ ID NO: 69023

SEQ ID NO: 720769 - RNA, 64 nt, Homo Sapiens; identical to SEQ ID NO: 69024

SEQ ID NO: 720770 - RNA, 64 nt, Homo Sapiens; identical to SEQ ID NO: 69025

SEQ ID NO: 720771 - RNA, 64 nt, Homo Sapiens; identical to SEQ ID NO: 69026

SEQ ID NO: 720772 - RNA, 64 nt, Homo Sapiens; identical to SEQ ID NO: 69027

SEQ ID NO: 720773 - RNA, 64 nt, Homo Sapiens; identical to SEQ ID NO: 69028

SEQ ID NO: 720774 - RNA, 64 nt, Homo Sapiens; identical to SEQ ID NO: 69029

SEQ ID NO: 720775 - RNA, 64 nt, Homo Sapiens; identical to SEQ ID NO: 69030

SEQ ID NO: 720776 - RNA, 64 nt, Homo Sapiens; identical to SEQ ID NO: 69031

SEQ ID NO: 720777 - RNA, 64 nt, Homo Sapiens; identical to SEQ ID NO: 69032

SEQ ID NO: 720778 - RNA, 64 nt, Homo Sapiens; identical to SEQ ID NO: 69033

SEQ ID NO: 720779 - RNA, 64 nt, Homo Sapiens; identical to SEQ ID NO: 69034

SEQ ID NO: 720780 - RNA, 64 nt, Homo Sapiens; identical to SEQ ID NO: 69035

SEQ ID NO: 720781 - RNA, 64 nt, Homo Sapiens; identical to SEQ ID NO: 69036

SEQ ID NO: 720782 - RNA, 64 nt, Homo Sapiens; identical to SEQ ID NO: 69037

SEQ ID NO: 720783 - RNA, 64 nt, Homo Sapiens; identical to SEQ ID NO: 69038

SEQ ID NO: 720784 - RNA, 64 nt, Homo Sapiens; identical to SEQ ID NO: 69039

SEQ ID NO: 720785 - RNA, 64 nt, Homo Sapiens; identical to SEQ ID NO: 69040

SEQ ID NO: 720786 - RNA, 64 nt, Homo Sapiens; identical to SEQ ID NO: 69041

SEQ ID NO: 720787 - RNA, 64 nt, Homo Sapiens; identical to SEQ ID NO: 69042

SEQ ID NO: 720788 - RNA, 64 nt, Homo Sapiens; identical to SEQ ID NO: 69043

SEQ ID NO: 720789 - RNA, 64 nt, Homo Sapiens; identical to SEQ ID NO: 69044

SEQ ID NO: 720790 - RNA, 64 nt, Homo Sapiens; identical to SEQ ID NO: 69045

SEQ ID NO: 720791 - RNA, 64 nt, Homo Sapiens; identical to SEQ ID NO: 69046

SEQ ID NO: 720792 - RNA, 64 nt, Homo Sapiens; identical to SEQ ID NO: 69047

SEQ ID NO: 720793 - RNA, 64 nt, Homo Sapiens; identical to SEQ ID NO: 69048

SEQ ID NO: 720794 - RNA, 64 nt, Homo Sapiens; identical to SEQ ID NO: 69049

SEQ ID NO: 720795 - RNA, 64 nt, Homo Sapiens; identical to SEQ ID NO: 69050

SEQ ID NO: 720796 - RNA, 64 nt, Homo Sapiens; identical to SEQ ID NO: 69051

SEQ ID NO: 720797 - RNA, 64 nt, Homo Sapiens; identical to SEQ ID NO: 69052

SEQ ID NO: 720798 - RNA, 64 nt, Homo Sapiens; identical to SEQ ID NO: 69053

SEQ ID NO: 720799 - RNA, 64 nt, Homo Sapiens; identical to SEQ ID NO: 69054

SEQ ID NO: 720800 - RNA, 64 nt, Homo Sapiens; identical to SEQ ID NO: 69055

SEQ ID NO: 720801 - RNA, 64 nt, Homo Sapiens; identical to SEQ ID NO: 69056

SEQ ID NO: 720802 - RNA, 64 nt, Homo Sapiens; identical to SEQ ID NO: 69057

SEQ ID NO: 720803 - RNA, 64 nt, Homo Sapiens; identical to SEQ ID NO: 69058

SEQ ID NO: 720804 - RNA, 64 nt, Homo Sapiens; identical to SEQ ID NO: 69059

SEQ ID NO: 720805 - RNA, 64 nt, Homo Sapiens; identical to SEQ ID NO: 69060

SEQ ID NO: 720806 - RNA, 64 nt, Homo Sapiens; identical to SEQ ID NO: 69061

SEQ ID NO: 720807 - RNA, 64 nt, Homo Sapiens; identical to SEQ ID NO: 69062

SEQ ID NO: 720808 - RNA, 64 nt, Homo Sapiens; identical to SEQ ID NO: 69063

SEQ ID NO: 720809 - RNA, 64 nt, Homo Sapiens; identical to SEQ ID NO: 69064

SEQ ID NO: 720810 - RNA, 64 nt, Homo Sapiens; identical to SEQ ID NO: 69065

SEQ ID NO: 720811 - RNA, 64 nt, Homo Sapiens; identical to SEQ ID NO: 69066

SEQ ID NO: 720812 - RNA, 64 nt, Homo Sapiens; identical to SEQ ID NO: 69067

SEQ ID NO: 720813 - RNA, 64 nt, Homo Sapiens; identical to SEQ ID NO: 69068

SEQ ID NO: 720814 - RNA, 64 nt, Homo Sapiens; identical to SEQ ID NO: 69069

SEQ ID NO: 720815 - RNA, 64 nt, Homo Sapiens; identical to SEQ ID NO: 69070

SEQ ID NO: 720816 - RNA, 64 nt, Homo Sapiens; identical to SEQ ID NO: 69071

SEQ ID NO: 720817 - RNA, 64 nt, Homo Sapiens; identical to SEQ ID NO: 69072

SEQ ID NO: 720818 - RNA, 64 nt, Homo Sapiens; identical to SEQ ID NO: 69073

SEQ ID NO: 720819 - RNA, 64 nt, Homo Sapiens; identical to SEQ ID NO: 69074

SEQ ID NO: 720820 - RNA, 64 nt, Homo Sapiens; identical to SEQ ID NO: 69075

SEQ ID NO: 720821 - RNA, 64 nt, Homo Sapiens; identical to SEQ ID NO: 69076

SEQ ID NO: 720822 - RNA, 64 nt, Homo Sapiens; identical to SEQ ID NO: 69077

SEQ ID NO: 720823 - RNA, 64 nt, Homo Sapiens; identical to SEQ ID NO: 69078

SEQ ID NO: 720824 - RNA, 64 nt, Homo Sapiens; identical to SEQ ID NO: 69079

SEQ ID NO: 720825 - RNA, 64 nt, Homo Sapiens; identical to SEQ ID NO: 69080

SEQ ID NO: 720826 - RNA, 64 nt, Homo Sapiens; identical to SEQ ID NO: 69081

SEQ ID NO: 720827 - RNA, 64 nt, Homo Sapiens; identical to SEQ ID NO: 69082

SEQ ID NO: 720828 - RNA, 64 nt, Homo Sapiens; identical to SEQ ID NO: 69083

SEQ ID NO: 720829 - RNA, 64 nt, Homo Sapiens; identical to SEQ ID NO: 69084

SEQ ID NO: 720830 - RNA, 64 nt, Homo Sapiens; identical to SEQ ID NO: 69085

SEQ ID NO: 720831 - RNA, 64 nt, Homo Sapiens; identical to SEQ ID NO: 69086

SEQ ID NO: 720832 - RNA, 64 nt, Homo Sapiens; identical to SEQ ID NO: 69087

SEQ ID NO: 720833 - RNA, 64 nt, Homo Sapiens; identical to SEQ ID NO: 69088

SEQ ID NO: 720834 - RNA, 64 nt, Homo Sapiens; identical to SEQ ID NO: 69089

SEQ ID NO: 720835 - RNA, 64 nt, Homo Sapiens; identical to SEQ ID NO: 69090

SEQ ID NO: 720836 - RNA, 64 nt, Homo Sapiens; identical to SEQ ID NO: 69091

SEQ ID NO: 720837 - RNA, 64 nt, Homo Sapiens; identical to SEQ ID NO: 69092

SEQ ID NO: 720838 - RNA, 64 nt, Homo Sapiens; identical to SEQ ID NO: 69093

SEQ ID NO: 720839 - RNA, 64 nt, Homo Sapiens; identical to SEQ ID NO: 88665

SEQ ID NO: 720840 - RNA, 64 nt, Homo Sapiens; identical to SEQ ID NO: 88666

SEQ ID NO: 720841 - RNA, 64 nt, Homo Sapiens; identical to SEQ ID NO: 88667

SEQ ID NO: 720842 - RNA, 64 nt, Homo Sapiens; identical to SEQ ID NO: 88668

SEQ ID NO: 720843 - RNA, 64 nt, Homo Sapiens; identical to SEQ ID NO: 88669

SEQ ID NO: 720844 - RNA, 64 nt, Homo Sapiens; identical to SEQ ID NO: 88670

SEQ ID NO: 720845 - RNA, 64 nt, Homo Sapiens; identical to SEQ ID NO: 88671

SEQ ID NO: 720846 - RNA, 64 nt, Homo Sapiens; identical to SEQ ID NO: 88672

SEQ ID NO: 720847 - RNA, 64 nt, Homo Sapiens; identical to SEQ ID NO: 88673

SEQ ID NO: 720848 - RNA, 64 nt, Homo Sapiens; identical to SEQ ID NO: 88674

SEQ ID NO: 720849 - RNA, 64 nt, Homo Sapiens; identical to SEQ ID NO: 88675

SEQ ID NO: 720850 - RNA, 64 nt, Homo Sapiens; identical to SEQ ID NO: 88676

SEQ ID NO: 720851 - RNA, 64 nt, Homo Sapiens; identical to SEQ ID NO: 88677

SEQ ID NO: 720852 - RNA, 64 nt, Homo Sapiens; identical to SEQ ID NO: 88678

SEQ ID NO: 720853 - RNA, 64 nt, Homo Sapiens; identical to SEQ ID NO: 88679

SEQ ID NO: 720854 - RNA, 64 nt, Homo Sapiens; identical to SEQ ID NO: 88680

SEQ ID NO: 720855 - RNA, 64 nt, Homo Sapiens; identical to SEQ ID NO: 88681

SEQ ID NO: 720856 - RNA, 64 nt, Homo Sapiens; identical to SEQ ID NO: 88682

SEQ ID NO: 720857 - RNA, 64 nt, Homo Sapiens; identical to SEQ ID NO: 88683

SEQ ID NO: 720858 - RNA, 64 nt, Homo Sapiens; identical to SEQ ID NO: 88684

SEQ ID NO: 720859 - RNA, 64 nt, Homo Sapiens; identical to SEQ ID NO: 88685

SEQ ID NO: 720860 - RNA, 64 nt, Homo Sapiens; identical to SEQ ID NO: 88686

SEQ ID NO: 720861 - RNA, 64 nt, Homo Sapiens; identical to SEQ ID NO: 88687

SEQ ID NO: 720862 - RNA, 64 nt, Homo Sapiens; identical to SEQ ID NO: 88688

SEQ ID NO: 720863 - RNA, 64 nt, Homo Sapiens; identical to SEQ ID NO: 88689

SEQ ID NO: 720864 - RNA, 64 nt, Homo Sapiens; identical to SEQ ID NO: 88690

SEQ ID NO: 720865 - RNA, 64 nt, Homo Sapiens; identical to SEQ ID NO: 88691

SEQ ID NO: 720866 - RNA, 50 nt, Homo Sapiens; identical to SEQ ID NO: 88692

SEQ ID NO: 720867 - RNA, 64 nt, Homo Sapiens; identical to SEQ ID NO: 88693

SEQ ID NO: 720868 - RNA, 64 nt, Homo Sapiens; identical to SEQ ID NO: 88694

SEQ ID NO: 720869 - RNA, 64 nt, Homo Sapiens; identical to SEQ ID NO: 88695

SEQ ID NO: 720870 - RNA, 64 nt, Homo Sapiens; identical to SEQ ID NO: 88696

SEQ ID NO: 720871 - RNA, 64 nt, Homo Sapiens; identical to SEQ ID NO: 88697

SEQ ID NO: 720872 - RNA, 64 nt, Homo Sapiens; identical to SEQ ID NO: 88698

SEQ ID NO: 720873 - RNA, 64 nt, Homo Sapiens; identical to SEQ ID NO: 88699

SEQ ID NO: 720874 - RNA, 64 nt, Homo Sapiens; identical to SEQ ID NO: 88700

SEQ ID NO: 720875 - RNA, 64 nt, Homo Sapiens; identical to SEQ ID NO: 88701

SEQ ID NO: 720876 - RNA, 64 nt, Homo Sapiens; identical to SEQ ID NO: 88702

SEQ ID NO: 720877 - RNA, 64 nt, Homo Sapiens; identical to SEQ ID NO: 88703

SEQ ID NO: 720878 - RNA, 64 nt, Homo Sapiens; identical to SEQ ID NO: 88704

SEQ ID NO: 720879 - RNA, 64 nt, Homo Sapiens; identical to SEQ ID NO: 88705

SEQ ID NO: 720880 - RNA, 64 nt, Homo Sapiens; identical to SEQ ID NO: 88706

SEQ ID NO: 720881 - RNA, 64 nt, Homo Sapiens; identical to SEQ ID NO: 88707

SEQ ID NO: 720882 - RNA, 64 nt, Homo Sapiens; identical to SEQ ID NO: 88708

SEQ ID NO: 720883 - RNA, 64 nt, Homo Sapiens; identical to SEQ ID NO: 88709

SEQ ID NO: 720884 - RNA, 64 nt, Homo Sapiens; identical to SEQ ID NO: 88710

SEQ ID NO: 720885 - RNA, 64 nt, Homo Sapiens; identical to SEQ ID NO: 88711

SEQ ID NO: 720886 - RNA, 64 nt, Homo Sapiens; identical to SEQ ID NO: 88712

SEQ ID NO: 720887 - RNA, 64 nt, Homo Sapiens; identical to SEQ ID NO: 88713

SEQ ID NO: 720888 - RNA, 64 nt, Homo Sapiens; identical to SEQ ID NO: 88714

SEQ ID NO: 720889 - RNA, 64 nt, Homo Sapiens; identical to SEQ ID NO: 88715

SEQ ID NO: 720890 - RNA, 64 nt, Homo Sapiens; identical to SEQ ID NO: 88716

SEQ ID NO: 720891 - RNA, 64 nt, Homo Sapiens; identical to SEQ ID NO: 88717

SEQ ID NO: 720892 - RNA, 64 nt, Homo Sapiens; identical to SEQ ID NO: 88718

SEQ ID NO: 720893 - RNA, 64 nt, Homo Sapiens; identical to SEQ ID NO: 88719

SEQ ID NO: 720894 - RNA, 64 nt, Homo Sapiens; identical to SEQ ID NO: 88720

SEQ ID NO: 720895 - RNA, 64 nt, Homo Sapiens; identical to SEQ ID NO: 88721

SEQ ID NO: 720896 - RNA, 64 nt, Homo Sapiens; identical to SEQ ID NO: 88722

SEQ ID NO: 720897 - RNA, 64 nt, Homo Sapiens; identical to SEQ ID NO: 88723

SEQ ID NO: 720898 - RNA, 64 nt, Homo Sapiens; identical to SEQ ID NO: 88724

SEQ ID NO: 720899 - RNA, 64 nt, Homo Sapiens; identical to SEQ ID NO: 88725

SEQ ID NO: 720900 - RNA, 64 nt, Homo Sapiens; identical to SEQ ID NO: 88726

SEQ ID NO: 720901 - RNA, 64 nt, Homo Sapiens; identical to SEQ ID NO: 88727

SEQ ID NO: 720902 - RNA, 64 nt, Homo Sapiens; identical to SEQ ID NO: 88728

SEQ ID NO: 720903 - RNA, 64 nt, Homo Sapiens; identical to SEQ ID NO: 88729

SEQ ID NO: 720904 - RNA, 64 nt, Homo Sapiens; identical to SEQ ID NO: 88730

SEQ ID NO: 720905 - RNA, 64 nt, Homo Sapiens; identical to SEQ ID NO: 88731

SEQ ID NO: 720906 - RNA, 64 nt, Homo Sapiens; identical to SEQ ID NO: 88732

SEQ ID NO: 720907 - RNA, 64 nt, Homo Sapiens; identical to SEQ ID NO: 88733

SEQ ID NO: 720908 - RNA, 64 nt, Homo Sapiens; identical to SEQ ID NO: 88734

SEQ ID NO: 720909 - RNA, 64 nt, Homo Sapiens; identical to SEQ ID NO: 88735

SEQ ID NO: 720910 - RNA, 64 nt, Homo Sapiens; identical to SEQ ID NO: 88736

SEQ ID NO: 720911 - RNA, 64 nt, Homo Sapiens; identical to SEQ ID NO: 88737

SEQ ID NO: 720912 - RNA, 64 nt, Homo Sapiens; identical to SEQ ID NO: 88738

SEQ ID NO: 720913 - RNA, 64 nt, Homo Sapiens; identical to SEQ ID NO: 88739

SEQ ID NO: 720914 - RNA, 64 nt, Homo Sapiens; identical to SEQ ID NO: 88740

SEQ ID NO: 720915 - RNA, 64 nt, Homo Sapiens; identical to SEQ ID NO: 88741

SEQ ID NO: 720916 - RNA, 64 nt, Homo Sapiens; identical to SEQ ID NO: 88742

SEQ ID NO: 720917 - RNA, 64 nt, Homo Sapiens; identical to SEQ ID NO: 88743

SEQ ID NO: 720918 - RNA, 64 nt, Homo Sapiens; identical to SEQ ID NO: 88744

SEQ ID NO: 720919 - RNA, 64 nt, Homo Sapiens; identical to SEQ ID NO: 88745

SEQ ID NO: 720920 - RNA, 64 nt, Homo Sapiens; identical to SEQ ID NO: 88746

SEQ ID NO: 720921 - RNA, 64 nt, Homo Sapiens; identical to SEQ ID NO: 88747

SEQ ID NO: 720922 - RNA, 64 nt, Homo Sapiens; identical to SEQ ID NO: 88748

SEQ ID NO: 720923 - RNA, 64 nt, Homo Sapiens; identical to SEQ ID NO: 88749

SEQ ID NO: 720924 - RNA, 64 nt, Homo Sapiens; identical to SEQ ID NO: 88750

SEQ ID NO: 720925 - RNA, 64 nt, Homo Sapiens; identical to SEQ ID NO: 88751

SEQ ID NO: 720926 - RNA, 64 nt, Homo Sapiens; identical to SEQ ID NO: 88752

SEQ ID NO: 720927 - RNA, 64 nt, Homo Sapiens; identical to SEQ ID NO: 88753

SEQ ID NO: 720928 - RNA, 64 nt, Homo Sapiens; identical to SEQ ID NO: 88754

SEQ ID NO: 720929 - RNA, 64 nt, Homo Sapiens; identical to SEQ ID NO: 88755

SEQ ID NO: 720930 - RNA, 64 nt, Homo Sapiens; identical to SEQ ID NO: 88756

SEQ ID NO: 720931 - RNA, 64 nt, Homo Sapiens; identical to SEQ ID NO: 88757

SEQ ID NO: 720932 - RNA, 64 nt, Homo Sapiens; identical to SEQ ID NO: 88758

SEQ ID NO: 720933 - RNA, 64 nt, Homo Sapiens; identical to SEQ ID NO: 88759

SEQ ID NO: 720934 - RNA, 64 nt, Homo Sapiens; identical to SEQ ID NO: 88760

SEQ ID NO: 720935 - RNA, 64 nt, Homo Sapiens; identical to SEQ ID NO: 88761

SEQ ID NO: 720936 - RNA, 64 nt, Homo Sapiens; identical to SEQ ID NO: 88762

SEQ ID NO: 720937 - RNA, 64 nt, Homo Sapiens; identical to SEQ ID NO: 88763

SEQ ID NO: 720938 - RNA, 64 nt, Homo Sapiens; identical to SEQ ID NO: 88764

SEQ ID NO: 720939 - RNA, 64 nt, Homo Sapiens; identical to SEQ ID NO: 88765

SEQ ID NO: 720940 - RNA, 64 nt, Homo Sapiens; identical to SEQ ID NO: 78937

SEQ ID NO: 720941 - RNA, 64 nt, Homo Sapiens; identical to SEQ ID NO: 78938

SEQ ID NO: 720942 - RNA, 64 nt, Homo Sapiens; identical to SEQ ID NO: 78939

SEQ ID NO: 720943 - RNA, 64 nt, Homo Sapiens; identical to SEQ ID NO: 78940

SEQ ID NO: 720944 - RNA, 64 nt, Homo Sapiens; identical to SEQ ID NO: 78941

SEQ ID NO: 720945 - RNA, 64 nt, Homo Sapiens; identical to SEQ ID NO: 78942

SEQ ID NO: 720946 - RNA, 64 nt, Homo Sapiens; identical to SEQ ID NO: 78943

SEQ ID NO: 720947 - RNA, 64 nt, Homo Sapiens; identical to SEQ ID NO: 78944

SEQ ID NO: 720948 - RNA, 64 nt, Homo Sapiens; identical to SEQ ID NO: 78945

SEQ ID NO: 720949 - RNA, 64 nt, Homo Sapiens; identical to SEQ ID NO: 78946

SEQ ID NO: 720950 - RNA, 64 nt, Homo Sapiens; identical to SEQ ID NO: 78947

SEQ ID NO: 720951 - RNA, 64 nt, Homo Sapiens; identical to SEQ ID NO: 78948

SEQ ID NO: 720952 - RNA, 64 nt, Homo Sapiens; identical to SEQ ID NO: 78949

SEQ ID NO: 720953 - RNA, 64 nt, Homo Sapiens; identical to SEQ ID NO: 78950

SEQ ID NO: 720954 - RNA, 64 nt, Homo Sapiens; identical to SEQ ID NO: 78951

SEQ ID NO: 720955 - RNA, 64 nt, Homo Sapiens; identical to SEQ ID NO: 78952

SEQ ID NO: 720956 - RNA, 64 nt, Homo Sapiens; identical to SEQ ID NO: 78953

SEQ ID NO: 720957 - RNA, 64 nt, Homo Sapiens; identical to SEQ ID NO: 78954

SEQ ID NO: 720958 - RNA, 64 nt, Homo Sapiens; identical to SEQ ID NO: 78955

SEQ ID NO: 720959 - RNA, 64 nt, Homo Sapiens; identical to SEQ ID NO: 78956

SEQ ID NO: 720960 - RNA, 64 nt, Homo Sapiens; identical to SEQ ID NO: 78957

SEQ ID NO: 720961 - RNA, 64 nt, Homo Sapiens; identical to SEQ ID NO: 78958

SEQ ID NO: 720962 - RNA, 64 nt, Homo Sapiens; identical to SEQ ID NO: 78959

SEQ ID NO: 720963 - RNA, 64 nt, Homo Sapiens; identical to SEQ ID NO: 78960

SEQ ID NO: 720964 - RNA, 64 nt, Homo Sapiens; identical to SEQ ID NO: 78961

SEQ ID NO: 720965 - RNA, 64 nt, Homo Sapiens; identical to SEQ ID NO: 78962

SEQ ID NO: 720966 - RNA, 64 nt, Homo Sapiens; identical to SEQ ID NO: 78963

SEQ ID NO: 720967 - RNA, 64 nt, Homo Sapiens; identical to SEQ ID NO: 78964

SEQ ID NO: 720968 - RNA, 64 nt, Homo Sapiens; identical to SEQ ID NO: 78965

SEQ ID NO: 720969 - RNA, 64 nt, Homo Sapiens; identical to SEQ ID NO: 78966

SEQ ID NO: 720970 - RNA, 64 nt, Homo Sapiens; identical to SEQ ID NO: 78967

SEQ ID NO: 720971 - RNA, 64 nt, Homo Sapiens; identical to SEQ ID NO: 78968

SEQ ID NO: 720972 - RNA, 64 nt, Homo Sapiens; identical to SEQ ID NO: 78969

SEQ ID NO: 720973 - RNA, 64 nt, Homo Sapiens; identical to SEQ ID NO: 78970

SEQ ID NO: 720974 - RNA, 64 nt, Homo Sapiens; identical to SEQ ID NO: 78971

SEQ ID NO: 720975 - RNA, 64 nt, Homo Sapiens; identical to SEQ ID NO: 78972

SEQ ID NO: 720976 - RNA, 64 nt, Homo Sapiens; identical to SEQ ID NO: 78973

SEQ ID NO: 720977 - RNA, 64 nt, Homo Sapiens; identical to SEQ ID NO: 78974

SEQ ID NO: 720978 - RNA, 64 nt, Homo Sapiens; identical to SEQ ID NO: 78975

SEQ ID NO: 720979 - RNA, 64 nt, Homo Sapiens; identical to SEQ ID NO: 78976

SEQ ID NO: 720980 - RNA, 64 nt, Homo Sapiens; identical to SEQ ID NO: 78977

SEQ ID NO: 720981 - RNA, 64 nt, Homo Sapiens; identical to SEQ ID NO: 78978

SEQ ID NO: 720982 - RNA, 64 nt, Homo Sapiens; identical to SEQ ID NO: 78979

SEQ ID NO: 720983 - RNA, 64 nt, Homo Sapiens; identical to SEQ ID NO: 78980

SEQ ID NO: 720984 - RNA, 64 nt, Homo Sapiens; identical to SEQ ID NO: 78981

SEQ ID NO: 720985 - RNA, 64 nt, Homo Sapiens; identical to SEQ ID NO: 78982

SEQ ID NO: 720986 - RNA, 64 nt, Homo Sapiens; identical to SEQ ID NO: 78983

SEQ ID NO: 720987 - RNA, 64 nt, Homo Sapiens; identical to SEQ ID NO: 78984

SEQ ID NO: 720988 - RNA, 64 nt, Homo Sapiens; identical to SEQ ID NO: 78985

SEQ ID NO: 720989 - RNA, 64 nt, Homo Sapiens; identical to SEQ ID NO: 78986

SEQ ID NO: 720990 - RNA, 64 nt, Homo Sapiens; identical to SEQ ID NO: 78987

SEQ ID NO: 720991 - RNA, 64 nt, Homo Sapiens; identical to SEQ ID NO: 78988

SEQ ID NO: 720992 - RNA, 64 nt, Homo Sapiens; identical to SEQ ID NO: 78989

SEQ ID NO: 720993 - RNA, 64 nt, Homo Sapiens; identical to SEQ ID NO: 78990

SEQ ID NO: 720994 - RNA, 64 nt, Homo Sapiens; identical to SEQ ID NO: 78991

SEQ ID NO: 720995 - RNA, 64 nt, Homo Sapiens; identical to SEQ ID NO: 78992

SEQ ID NO: 720996 - RNA, 64 nt, Homo Sapiens; identical to SEQ ID NO: 78993

SEQ ID NO: 720997 - RNA, 64 nt, Homo Sapiens; identical to SEQ ID NO: 78994

SEQ ID NO: 720998 - RNA, 64 nt, Homo Sapiens; identical to SEQ ID NO: 78995

SEQ ID NO: 720999 - RNA, 64 nt, Homo Sapiens; identical to SEQ ID NO: 78996

SEQ ID NO: 721000 - RNA, 64 nt, Homo Sapiens; identical to SEQ ID NO: 78997

SEQ ID NO: 721001 - RNA, 64 nt, Homo Sapiens; identical to SEQ ID NO: 78998

SEQ ID NO: 721002 - RNA, 64 nt, Homo Sapiens; identical to SEQ ID NO: 78999

SEQ ID NO: 721003 - RNA, 64 nt, Homo Sapiens; identical to SEQ ID NO: 79000

SEQ ID NO: 721004 - RNA, 64 nt, Homo Sapiens; identical to SEQ ID NO: 79001

SEQ ID NO: 721005 - RNA, 64 nt, Homo Sapiens; identical to SEQ ID NO: 79002

SEQ ID NO: 721006 - RNA, 64 nt, Homo Sapiens; identical to SEQ ID NO: 79003

SEQ ID NO: 721007 - RNA, 64 nt, Homo Sapiens; identical to SEQ ID NO: 79004

SEQ ID NO: 721008 - RNA, 64 nt, Homo Sapiens; identical to SEQ ID NO: 79005

SEQ ID NO: 721009 - RNA, 64 nt, Homo Sapiens; identical to SEQ ID NO: 79006

SEQ ID NO: 721010 - RNA, 64 nt, Homo Sapiens; identical to SEQ ID NO: 79007

SEQ ID NO: 721011 - RNA, 64 nt, Homo Sapiens; identical to SEQ ID NO: 79008

SEQ ID NO: 721012 - RNA, 64 nt, Homo Sapiens; identical to SEQ ID NO: 79009

SEQ ID NO: 721013 - RNA, 64 nt, Homo Sapiens; identical to SEQ ID NO: 79010

SEQ ID NO: 721014 - RNA, 64 nt, Homo Sapiens; identical to SEQ ID NO: 79011

SEQ ID NO: 721015 - RNA, 64 nt, Homo Sapiens; identical to SEQ ID NO: 79012

SEQ ID NO: 721016 - RNA, 64 nt, Homo Sapiens; identical to SEQ ID NO: 79013

SEQ ID NO: 721017 - RNA, 64 nt, Homo Sapiens; identical to SEQ ID NO: 79014

SEQ ID NO: 721018 - RNA, 64 nt, Homo Sapiens; identical to SEQ ID NO: 79015

SEQ ID NO: 721019 - RNA, 64 nt, Homo Sapiens; identical to SEQ ID NO: 79016

SEQ ID NO: 721020 - RNA, 64 nt, Homo Sapiens; identical to SEQ ID NO: 79017

SEQ ID NO: 721021 - RNA, 64 nt, Homo Sapiens; identical to SEQ ID NO: 79018

SEQ ID NO: 721022 - RNA, 64 nt, Homo Sapiens; identical to SEQ ID NO: 79019

SEQ ID NO: 721023 - RNA, 64 nt, Homo Sapiens; identical to SEQ ID NO: 79020

SEQ ID NO: 721024 - RNA, 64 nt, Homo Sapiens; identical to SEQ ID NO: 79021

SEQ ID NO: 721025 - RNA, 64 nt, Homo Sapiens; identical to SEQ ID NO: 79022

SEQ ID NO: 721026 - RNA, 64 nt, Homo Sapiens; identical to SEQ ID NO: 79023

SEQ ID NO: 721027 - RNA, 64 nt, Homo Sapiens; identical to SEQ ID NO: 79024

SEQ ID NO: 721028 - RNA, 64 nt, Homo Sapiens; identical to SEQ ID NO: 79025

SEQ ID NO: 721029 - RNA, 64 nt, Homo Sapiens; identical to SEQ ID NO: 79026

SEQ ID NO: 721030 - RNA, 64 nt, Homo Sapiens; identical to SEQ ID NO: 79027

SEQ ID NO: 721031 - RNA, 64 nt, Homo Sapiens; identical to SEQ ID NO: 79028

SEQ ID NO: 721032 - RNA, 64 nt, Homo Sapiens; identical to SEQ ID NO: 79029

SEQ ID NO: 721033 - RNA, 64 nt, Homo Sapiens; identical to SEQ ID NO: 79030

SEQ ID NO: 721034 - RNA, 64 nt, Homo Sapiens; identical to SEQ ID NO: 79031

SEQ ID NO: 721035 - RNA, 64 nt, Homo Sapiens; identical to SEQ ID NO: 79032

SEQ ID NO: 721036 - RNA, 64 nt, Homo Sapiens; identical to SEQ ID NO: 79033

SEQ ID NO: 721037 - RNA, 64 nt, Homo Sapiens; identical to SEQ ID NO: 79034

SEQ ID NO: 721038 - RNA, 64 nt, Homo Sapiens; identical to SEQ ID NO: 79035

SEQ ID NO: 721039 - RNA, 64 nt, Homo Sapiens; identical to SEQ ID NO: 79036

SEQ ID NO: 721040 - RNA, 64 nt, Homo Sapiens; identical to SEQ ID NO: 79037

SEQ ID NO: 721041 - RNA, 64 nt, Homo Sapiens; identical to SEQ ID NO: 79038

SEQ ID NO: 721042 - RNA, 64 nt, Homo Sapiens; identical to SEQ ID NO: 79039

SEQ ID NO: 721043 - RNA, 64 nt, Homo Sapiens; identical to SEQ ID NO: 79040

SEQ ID NO: 721044 - RNA, 64 nt, Homo Sapiens; identical to SEQ ID NO: 79041

SEQ ID NO: 721045 - RNA, 64 nt, Homo Sapiens; identical to SEQ ID NO: 79042

SEQ ID NO: 721046 - RNA, 64 nt, Homo Sapiens; identical to SEQ ID NO: 79043

SEQ ID NO: 721047 - RNA, 64 nt, Homo Sapiens; identical to SEQ ID NO: 79044

SEQ ID NO: 721048 - RNA, 64 nt, Homo Sapiens; identical to SEQ ID NO: 79045

SEQ ID NO: 721049 - RNA, 64 nt, Homo Sapiens; identical to SEQ ID NO: 79046

SEQ ID NO: 721050 - RNA, 64 nt, Homo Sapiens; identical to SEQ ID NO: 79047

SEQ ID NO: 721051 - RNA, 64 nt, Homo Sapiens; identical to SEQ ID NO: 79048

SEQ ID NO: 721052 - RNA, 64 nt, Homo Sapiens; identical to SEQ ID NO: 79049

SEQ ID NO: 721053 - RNA, 64 nt, Homo Sapiens; identical to SEQ ID NO: 79050

SEQ ID NO: 721054 - RNA, 61 nt, Homo Sapiens
gacaacugcagcaguggggagcccacgggcacagggagaggucuucucagcugguccccag

SEQ ID NO: 721055 - RNA, 61 nt, Homo Sapiens
gauuccauuuuucuucucagcugccugucugcagggagaagugaacaucauugaagcguga

SEQ ID NO: 721056 - RNA, 61 nt, Homo Sapiens
ccaaguaccaucuuuaucuaccagcggugugcagggagagaugcuccuuguugggcagaca

SEQ ID NO: 721057 - RNA, 61 nt, Homo Sapiens
agauggcuuaguguuuagacugaagcuuuugcagggagagaugcuuccauacagugguuuc

SEQ ID NO: 721058 - RNA, 61 nt, Homo Sapiens
uaacccuucgauauacauggcauguccuucacagggagaaugugucucagucccuguaagu

SEQ ID NO: 721059 - RNA, 61 nt, Homo Sapiens
gagauaacuuauugugaagguuucuuguauacagggagaguaucagugacuuaagagagau

SEQ ID NO: 721060 - RNA, 61 nt, Homo Sapiens
gugaagcagguaucagagucaguugacaggccagggagaggccagaaguggaugauguggg

SEQ ID NO: 721061 - RNA, 61 nt, Homo Sapiens
gugauccuugcucccugcagaacaucgaaaccagggagaaaaacaugaaaaccuccacagc

SEQ ID NO: 721062 - RNA, 61 nt, Homo Sapiens
guuuauuuuuagagauuacagaauuuuuaaacagggagacgugugauauacucccucccuu

SEQ ID NO: 721063 - RNA, 61 nt, Homo Sapiens
cuggucagucauuucagaggcagcagaugcccagggagacccaagaaagagucagguuagg

SEQ ID NO: 721064 - RNA, 61 nt, Homo Sapiens
cccacaagccccuccccugggcucucccaggcagggagaauggggagagggaccuccuugu

SEQ ID NO: 721065 - RNA, 61 nt, Homo Sapiens
gacauucccucaguguggggggcaggggacacagggagaggaugguugucccuggggaggg

SEQ ID NO: 721066 - RNA, 61 nt, Homo Sapiens
uuagccccucagaacagggagucccaggacccagggagaguguggggacaggacagccugu

SEQ ID NO: 721067 - RNA, 61 nt, Homo Sapiens
uggguaauaauagguacuaauucuggaaaaucagggagacaaaaaaaaacaugaauucuuu

SEQ ID NO: 721068 - RNA, 61 nt, Homo Sapiens
cugaguaaaccgagauccagcugugacgcuacagggagaggcaccuaggugagugcacagc

SEQ ID NO: 721069 - RNA, 61 nt, Homo Sapiens
aguucccugugcucauggagcuuacauucuacagggagaaagagauagccaauacauagga

SEQ ID NO: 721070 - RNA, 61 nt, Homo Sapiens
ugagaacuugcucuacguggucaggaaagagcagggagaccaagcagagucgugggcaggg

SEQ ID NO: 721071 - RNA, 61 nt, Homo Sapiens
cugucuagaugugggacucauugccccaaaccagggagaggaagagcucccacagggagag

SEQ ID NO: 721072 - RNA, 61 nt, Homo Sapiens
ugccccaaaccagggagaggaagagcucccacagggagagcccaggcucucuuugcagccu

SEQ ID NO: 721073 - RNA, 61 nt, Homo Sapiens
auguuuauuggcucauguggacagaaauguacagggagaauuacauuauuuuaacacacag

SEQ ID NO: 721074 - RNA, 61 nt, Homo Sapiens
uuucuuguucuauggaagaggaagcugagcucagggagauaugagcuccacagccacagcu

SEQ ID NO: 721075 - RNA, 61 nt, Homo Sapiens
ccagaccugcgugucagcccuuggugguggccagggagaggcgcccggugcagauggcccc

SEQ ID NO: 721076 - RNA, 61 nt, Homo Sapiens
uccccgcucggggagggcccggccgagcgggcagggagagccaguccugucggcugggccc

SEQ ID NO: 721077 - RNA, 61 nt, Homo Sapiens
cugcccugcugcagaccucgaaagucaggcucagggagacucaaacccaagaaggucuggc

SEQ ID NO: 721078 - RNA, 61 nt, Homo Sapiens
cagccuccacauucagaggcggacagagagacagggagagugcggccccgugggguaggag

SEQ ID NO: 721079 - RNA, 61 nt, Homo Sapiens
aagugccccagguugggagccucagccuguacagggagaugauccaggacgcccugcagga

SEQ ID NO: 721080 - RNA, 61 nt, Homo Sapiens
aagcacccaguuugagaguggugcucccgugcagggagaggccugaacuggccacucccca

SEQ ID NO: 721081 - RNA, 61 nt, Homo Sapiens
ccucggcugucuccugucccgggugaagcaccagggagagggucaugaaggacacucugca

SEQ ID NO: 721082 - RNA, 61 nt, Homo Sapiens
uugagcagguaucaacuaggcuggaaacagacagggagaagggucaucccuuccuccucuc

SEQ ID NO: 721083 - RNA, 53 nt, Homo Sapiens; identical to SEQ ID NO: 473025

SEQ ID NO: 721084 - RNA, 61 nt, Homo Sapiens
ggagacuugggucggccuccugaaaugacagcagggagacuugggugaccccccuuccagg

SEQ ID NO: 721085 - RNA, 61 nt, Homo Sapiens
gagcugcugugaaagccccugcacaaucagccagggagaacugggcggguuuaguggcccc

SEQ ID NO: 721086 - RNA, 61 nt, Homo Sapiens
cuuaggccuacgaugccacacaaagguuguucagggagaagggggugcaggaggcagaggg

SEQ ID NO: 721087 - RNA, 61 nt, Homo Sapiens
ggcuccugggcccuguucuuaggaucaguggcagggagaaacggguaucucuuuucucucu

SEQ ID NO: 721088 - RNA, 61 nt, Homo Sapiens
cucugagguuuccccaagagaaccagauuggcagggagaagcauuguggggcaauuguucc

SEQ ID NO: 721089 - RNA, 61 nt, Homo Sapiens
ccgucucuacaaaauaaaaaccuggguaucacagggagaccgccgaggaguucaagaccag

SEQ ID NO: 721090 - RNA, 53 nt, Homo Sapiens; identical to SEQ ID NO: 473032

SEQ ID NO: 721091 - RNA, 61 nt, Homo Sapiens
uacaggauguuggcugcuuggggaagggcaacagggagacccggugaggccugacauccug

SEQ ID NO: 721092 - RNA, 61 nt, Homo Sapiens
gagcagugucauugucagugacauuugaggacagggagaugcugggugguugaggggacug

SEQ ID NO: 721093 - RNA, 61 nt, Homo Sapiens
guggcauuguuucugcuguggugggaacuggcagggagagggucaccuccacucugguugg

SEQ ID NO: 721094 - RNA, 61 nt, Homo Sapiens
uggugcacucaccguccaccguuccccaaggcagggagagggaguggcccgucccugggag

SEQ ID NO: 721095 - RNA, 61 nt, Homo Sapiens
ucugcggcuuaaacucaucucgcuugaagggcagggagaaacccaugaaucucaggcacgg

SEQ ID NO: 721096 - RNA, 61 nt, Homo Sapiens
ggcugggcuucuuucucucauauacggacuccagggagagaucuaacaaaucuguaguaag

SEQ ID NO: 721097 - RNA, 61 nt, Homo Sapiens
uccacugaaggaaaaaacccagugacagcagcagggagaaagagcgagcagcguggagcuc

SEQ ID NO: 721098 - RNA, 61 nt, Homo Sapiens
ccaccaugcuucucugucacgcccugaggggcagggagaugaaucagugggcacaccaagg

SEQ ID NO: 721099 - RNA, 61 nt, Homo Sapiens
gugugccgcucguacuccuggggguaugaggcagggagaggaccucgggagugaggacgca

SEQ ID NO: 721100 - RNA, 61 nt, Homo Sapiens
ccaucuuauucaccauguccgggucucuagccagggagaccguguuucucuacugagccug

SEQ ID NO: 721101 - RNA, 61 nt, Homo Sapiens
gggcgcuagggguucuuaguuggugcagggacagggagauguauucagggaggaggaaaag

SEQ ID NO: 721102 - RNA, 61 nt, Homo Sapiens
aaacgauggaguagccagugguaauacaaagcagggagaacagaaagguagaguuacuaag

SEQ ID NO: 721103 - RNA, 61 nt, Homo Sapiens
uauacuugagaaagcacuaguggcuuguguucagggagaggagcuggcaguuuuuaaccac

SEQ ID NO: 721104 - RNA, 61 nt, Homo Sapiens
gugggcaccggccccaagugcagagucaaggcagggagaggccggcuggagccaggccccc

SEQ ID NO: 721105 - RNA, 61 nt, Homo Sapiens
augagucaggggcaccauggaccucacgugccagggagacuugaauguggcugucacucuu

SEQ ID NO: 721106 - RNA, 61 nt, Homo Sapiens
cuggcuucuccuuuggaagugaggcauugcacagggagacguacguaucagcggccccuug

SEQ ID NO: 721107 - RNA, 61 nt, Homo Sapiens
gagauggacacacugguguggauuaaccugccagggagacagagcucacaauaaaaauggc

SEQ ID NO: 721108 - RNA, 61 nt, Homo Sapiens
accucugugggcagggcuuggaggacacacucagggagaagaaccucaucuuguacuaaag

SEQ ID NO: 721109 - RNA, 61 nt, Homo Sapiens
cugcauguggggacacugugaucacacaccacagggagaauguaugggcaaagcuuuugug

SEQ ID NO: 721110 - RNA, 61 nt, Homo Sapiens
gagucuggccccagcuuuuccgacacuaaugcagggagaggggaccucacaggcaggacgg

SEQ ID NO: 721111 - RNA, 61 nt, Homo Sapiens
gaguagacagccuggccuggugcacucgccccagggagaugugcugccaggugacccgagg

SEQ ID NO: 721112 - RNA, 61 nt, Homo Sapiens
cugcuggcguuggcugugaucugcuggaucccagggagaacggcagcccccagaaggacca

SEQ ID NO: 721113 - RNA, 61 nt, Homo Sapiens
agcacuucgucuagugaaacgucugugacuacagggagauuacccucccccuggagcugau

SEQ ID NO: 721114 - RNA, 61 nt, Homo Sapiens
cuggcccgugucacugccucccucccuggaacagggagaggagcugcagcuggagccugac

SEQ ID NO: 721115 - RNA, 64 nt, Homo Sapiens; identical to SEQ ID NO: 362110

SEQ ID NO: 721116 - RNA, 64 nt, Homo Sapiens; identical to SEQ ID NO: 362111

SEQ ID NO: 721117 - RNA, 64 nt, Homo Sapiens; identical to SEQ ID NO: 362112

SEQ ID NO: 721118 - RNA, 64 nt, Homo Sapiens; identical to SEQ ID NO: 362113

SEQ ID NO: 721119 - RNA, 64 nt, Homo Sapiens; identical to SEQ ID NO: 362114

SEQ ID NO: 721120 - RNA, 64 nt, Homo Sapiens; identical to SEQ ID NO: 362115

SEQ ID NO: 721121 - RNA, 64 nt, Homo Sapiens; identical to SEQ ID NO: 362116

SEQ ID NO: 721122 - RNA, 64 nt, Homo Sapiens; identical to SEQ ID NO: 362117

SEQ ID NO: 721123 - RNA, 64 nt, Homo Sapiens; identical to SEQ ID NO: 362118

SEQ ID NO: 721124 - RNA, 64 nt, Homo Sapiens; identical to SEQ ID NO: 362119

SEQ ID NO: 721125 - RNA, 64 nt, Homo Sapiens; identical to SEQ ID NO: 362120

SEQ ID NO: 721126 - RNA, 64 nt, Homo Sapiens; identical to SEQ ID NO: 362121

SEQ ID NO: 721127 - RNA, 64 nt, Homo Sapiens; identical to SEQ ID NO: 362122

SEQ ID NO: 721128 - RNA, 64 nt, Homo Sapiens; identical to SEQ ID NO: 362123

SEQ ID NO: 721129 - RNA, 64 nt, Homo Sapiens; identical to SEQ ID NO: 362124

SEQ ID NO: 721130 - RNA, 64 nt, Homo Sapiens; identical to SEQ ID NO: 362125

SEQ ID NO: 721131 - RNA, 64 nt, Homo Sapiens; identical to SEQ ID NO: 362126

SEQ ID NO: 721132 - RNA, 64 nt, Homo Sapiens; identical to SEQ ID NO: 362127

SEQ ID NO: 721133 - RNA, 64 nt, Homo Sapiens; identical to SEQ ID NO: 362128

SEQ ID NO: 721134 - RNA, 64 nt, Homo Sapiens; identical to SEQ ID NO: 362129

SEQ ID NO: 721135 - RNA, 64 nt, Homo Sapiens; identical to SEQ ID NO: 362130

SEQ ID NO: 721136 - RNA, 64 nt, Homo Sapiens; identical to SEQ ID NO: 362131

SEQ ID NO: 721137 - RNA, 64 nt, Homo Sapiens; identical to SEQ ID NO: 362132

SEQ ID NO: 721138 - RNA, 64 nt, Homo Sapiens; identical to SEQ ID NO: 362133

SEQ ID NO: 721139 - RNA, 64 nt, Homo Sapiens; identical to SEQ ID NO: 362134

SEQ ID NO: 721140 - RNA, 64 nt, Homo Sapiens; identical to SEQ ID NO: 362135

SEQ ID NO: 721141 - RNA, 64 nt, Homo Sapiens; identical to SEQ ID NO: 362136

SEQ ID NO: 721142 - RNA, 64 nt, Homo Sapiens; identical to SEQ ID NO: 362137

SEQ ID NO: 721143 - RNA, 64 nt, Homo Sapiens; identical to SEQ ID NO: 362138

SEQ ID NO: 721144 - RNA, 64 nt, Homo Sapiens; identical to SEQ ID NO: 362139

SEQ ID NO: 721145 - RNA, 64 nt, Homo Sapiens; identical to SEQ ID NO: 362140

SEQ ID NO: 721146 - RNA, 64 nt, Homo Sapiens; identical to SEQ ID NO: 362141

SEQ ID NO: 721147 - RNA, 64 nt, Homo Sapiens; identical to SEQ ID NO: 362142

SEQ ID NO: 721148 - RNA, 64 nt, Homo Sapiens; identical to SEQ ID NO: 362143

SEQ ID NO: 721149 - RNA, 64 nt, Homo Sapiens; identical to SEQ ID NO: 362144

SEQ ID NO: 721150 - RNA, 64 nt, Homo Sapiens; identical to SEQ ID NO: 362145

SEQ ID NO: 721151 - RNA, 64 nt, Homo Sapiens; identical to SEQ ID NO: 362146

SEQ ID NO: 721152 - RNA, 64 nt, Homo Sapiens; identical to SEQ ID NO: 362147

SEQ ID NO: 721153 - RNA, 64 nt, Homo Sapiens; identical to SEQ ID NO: 362148

SEQ ID NO: 721154 - RNA, 64 nt, Homo Sapiens; identical to SEQ ID NO: 362149

SEQ ID NO: 721155 - RNA, 64 nt, Homo Sapiens; identical to SEQ ID NO: 362150

SEQ ID NO: 721156 - RNA, 64 nt, Homo Sapiens; identical to SEQ ID NO: 362151

SEQ ID NO: 721157 - RNA, 64 nt, Homo Sapiens; identical to SEQ ID NO: 362152

SEQ ID NO: 721158 - RNA, 64 nt, Homo Sapiens; identical to SEQ ID NO: 362153

SEQ ID NO: 721159 - RNA, 64 nt, Homo Sapiens; identical to SEQ ID NO: 362154

SEQ ID NO: 721160 - RNA, 64 nt, Homo Sapiens; identical to SEQ ID NO: 362155

SEQ ID NO: 721161 - RNA, 64 nt, Homo Sapiens; identical to SEQ ID NO: 362156

SEQ ID NO: 721162 - RNA, 64 nt, Homo Sapiens; identical to SEQ ID NO: 362157

SEQ ID NO: 721163 - RNA, 64 nt, Homo Sapiens; identical to SEQ ID NO: 362158

SEQ ID NO: 721164 - RNA, 64 nt, Homo Sapiens; identical to SEQ ID NO: 362159

SEQ ID NO: 721165 - RNA, 64 nt, Homo Sapiens; identical to SEQ ID NO: 362160

SEQ ID NO: 721166 - RNA, 64 nt, Homo Sapiens; identical to SEQ ID NO: 362161

SEQ ID NO: 721167 - RNA, 64 nt, Homo Sapiens; identical to SEQ ID NO: 362162

SEQ ID NO: 721168 - RNA, 64 nt, Homo Sapiens; identical to SEQ ID NO: 362163

SEQ ID NO: 721169 - RNA, 64 nt, Homo Sapiens; identical to SEQ ID NO: 362164

SEQ ID NO: 721170 - RNA, 64 nt, Homo Sapiens; identical to SEQ ID NO: 362165

SEQ ID NO: 721171 - RNA, 64 nt, Homo Sapiens; identical to SEQ ID NO: 362166

SEQ ID NO: 721172 - RNA, 64 nt, Homo Sapiens; identical to SEQ ID NO: 362167

SEQ ID NO: 721173 - RNA, 64 nt, Homo Sapiens; identical to SEQ ID NO: 362168

SEQ ID NO: 721174 - RNA, 64 nt, Homo Sapiens; identical to SEQ ID NO: 362169

SEQ ID NO: 721175 - RNA, 64 nt, Homo Sapiens; identical to SEQ ID NO: 362170

SEQ ID NO: 721176 - RNA, 64 nt, Homo Sapiens; identical to SEQ ID NO: 220617

SEQ ID NO: 721177 - RNA, 64 nt, Homo Sapiens; identical to SEQ ID NO: 220618

SEQ ID NO: 721178 - RNA, 64 nt, Homo Sapiens; identical to SEQ ID NO: 220619

SEQ ID NO: 721179 - RNA, 64 nt, Homo Sapiens; identical to SEQ ID NO: 220620

SEQ ID NO: 721180 - RNA, 64 nt, Homo Sapiens; identical to SEQ ID NO: 220621

SEQ ID NO: 721181 - RNA, 64 nt, Homo Sapiens; identical to SEQ ID NO: 220622

SEQ ID NO: 721182 - RNA, 64 nt, Homo Sapiens; identical to SEQ ID NO: 220623

SEQ ID NO: 721183 - RNA, 64 nt, Homo Sapiens; identical to SEQ ID NO: 220624

SEQ ID NO: 721184 - RNA, 64 nt, Homo Sapiens; identical to SEQ ID NO: 220625

SEQ ID NO: 721185 - RNA, 64 nt, Homo Sapiens; identical to SEQ ID NO: 220626

SEQ ID NO: 721186 - RNA, 64 nt, Homo Sapiens; identical to SEQ ID NO: 220627

SEQ ID NO: 721187 - RNA, 64 nt, Homo Sapiens; identical to SEQ ID NO: 220628

SEQ ID NO: 721188 - RNA, 64 nt, Homo Sapiens; identical to SEQ ID NO: 220629

SEQ ID NO: 721189 - RNA, 64 nt, Homo Sapiens; identical to SEQ ID NO: 220630

SEQ ID NO: 721190 - RNA, 64 nt, Homo Sapiens; identical to SEQ ID NO: 220631

SEQ ID NO: 721191 - RNA, 64 nt, Homo Sapiens; identical to SEQ ID NO: 220632

SEQ ID NO: 721192 - RNA, 64 nt, Homo Sapiens; identical to SEQ ID NO: 220633

SEQ ID NO: 721193 - RNA, 64 nt, Homo Sapiens; identical to SEQ ID NO: 220634

SEQ ID NO: 721194 - RNA, 64 nt, Homo Sapiens; identical to SEQ ID NO: 220635

SEQ ID NO: 721195 - RNA, 64 nt, Homo Sapiens; identical to SEQ ID NO: 220636

SEQ ID NO: 721196 - RNA, 64 nt, Homo Sapiens
agaggccugaagggacugccuacugcagcucguugccaaucacauagcuuucuauuuguuaagu

SEQ ID NO: 721197 - RNA, 64 nt, Homo Sapiens
uauuuuaugcugcaagaaccaggacacacaauucgccaaucaucccaccauauaaccuucgauu

SEQ ID NO: 721198 - RNA, 64 nt, Homo Sapiens
ccaucaguuguccuuacuuagaggagacagagaggccaaucaggucccagagcuugaaugcuaa

SEQ ID NO: 721199 - RNA, 64 nt, Homo Sapiens
cauuuuuuuauacaaccaaccaguuucuuuucuagccaaucaucucugaagaguugcuguuucu

SEQ ID NO: 721200 - RNA, 64 nt, Homo Sapiens
gccuggggaaucuguuggcgggauguauccuccagccaaucagggccaaucagggccuugagga

SEQ ID NO: 721201 - RNA, 64 nt, Homo Sapiens
gccuugaggaggauguauccuggagugucucccagccaaucaggucuggccaaucaaggcuugc

SEQ ID NO: 721202 - RNA, 64 nt, Homo Sapiens
gcuugcuggagugucucccagggaccaucuucuggccaaucaaguccgcccagccgcuaggcca

SEQ ID NO: 721203 - RNA, 64 nt, Homo Sapiens
ucgggccugggccguuaucuccccacaacccccagccaaucaggacuuuccagacuuggcccug

SEQ ID NO: 721204 - RNA, 64 nt, Homo Sapiens
aggugcugcuggccccuggugauccagcuucucugccaaucaugaccuguuccuuccugaaguc

SEQ ID NO: 721205 - RNA, 64 nt, Homo Sapiens
ugacucaaggaaaacuuccguucuguuucucccagccaaucauggcgcugcggucgggcggagc

SEQ ID NO: 721206 - RNA, 64 nt, Homo Sapiens
agacugggggaccggccggggucugcugugccccgccaaucacgucaugcugcagcccaggggc

SEQ ID NO: 721207 - RNA, 64 nt, Homo Sapiens
aauagcauacaaacucaauagcaaucaugacugagccaaucacuguuucucagaaaaacaaaac

SEQ ID NO: 721208 - RNA, 64 nt, Homo Sapiens
uggagggcuggguuuggccugcaggcuguagcuugccaaucagugacuuaaauuguugauuuuu

SEQ ID NO: 721209 - RNA, 64 nt, Homo Sapiens
augcuuauuuugggaaacuccagcuaaccauuaugccaaucaccuuuuugaaagucauacaaca

SEQ ID NO: 721210 - RNA, 64 nt, Homo Sapiens
ugcaaagugaggaaggaucuuccagucucaaauugccaaucauuacagauucacuggcuggguc

SEQ ID NO: 721211 - RNA, 64 nt, Homo Sapiens
aggcucggccgcagagccggggcccagcgaaucacgcagagaaaucuuacagaaaacaggggug

SEQ ID NO: 721212 - RNA, 64 nt, Homo Sapiens
gaauggugagggugggagucaggagacaagacagcgcagagagggcugguuagccggaaaaggc

SEQ ID NO: 721213 - RNA, 64 nt, Homo Sapiens
uuuuccacccugggccccaaugccguccuuuccccgcagagacuggucuuggaaacccucagca

SEQ ID NO: 721214 - RNA, 64 nt, Homo Sapiens
aagaccgagaaauuuaaagaaucggacagauggacgcagagaaccagagggcaaugugggaccu

SEQ ID NO: 721215 - RNA, 64 nt, Homo Sapiens
aaggcuggagagugagggaggaggcucugcuggccgcagagaacacagggaugggagggucccu

SEQ ID NO: 721216 - RNA, 64 nt, Homo Sapiens
aaccucuugggauucagcaccccaugugauggugcgcagagaggcagugcagaggggccguggc

SEQ ID NO: 721217 - RNA, 64 nt, Homo Sapiens
ccuaugucucccuagugccccuuuauuuaaagagcgcagagauuuccagcucucuuggcagggc

SEQ ID NO: 721218 - RNA, 64 nt, Homo Sapiens
gcacccaggagcagagcgcuuucuaggacugguccgcagagaaagggcagugugggacccucag

SEQ ID NO: 721219 - RNA, 64 nt, Homo Sapiens
ggagugcccugcggaguugcggggugcuggaaggcgcagagauugccagacuaacugggcucaa

SEQ ID NO: 721220 - RNA, 64 nt, Homo Sapiens
cucgagagcccgcgcuagagucggggaggaucugcgcagagaccgcagcaucacccaaaucggc

SEQ ID NO: 721221 - RNA, 64 nt, Homo Sapiens
cuuccgagcacacauaaaagcacaaagacagagacgcagagagagagagagagccacggagagg

SEQ ID NO: 721222 - RNA, 64 nt, Homo Sapiens
ccaggugcagguugggaauggggcugaccuuccucgcagagaggcucuuggucuucccaggcug

SEQ ID NO: 721223 - RNA, 64 nt, Homo Sapiens
uuugcagcaucagaucugagggggcugcugaaaucgcagagacuaggagggacagagaagcaag

SEQ ID NO: 721224 - RNA, 64 nt, Homo Sapiens
cuaccucgaguggcgaguccagacaccaucaccacgcagagaggggaggugggaggacaguuag

SEQ ID NO: 721225 - RNA, 64 nt, Homo Sapiens
ucacaucuaaacaaaguuuagguaaaugaauuaucgcagagaaaaaccacaugagaaaauuuuu

SEQ ID NO: 721226 - RNA, 64 nt, Homo Sapiens
uauccucccuuugguaccuuaauuugacuguccucgcagagaaugugaacauguguguguguug

SEQ ID NO: 721227 - RNA, 64 nt, Homo Sapiens
gccucugggagccacugggccaggggccccgggucgcagagagcacguucccguuauuuauucc

SEQ ID NO: 721228 - RNA, 64 nt, Homo Sapiens
agagaucucuguacuucaagacgccauugccuuccgcagagaccugagaggcugaacacccaaa

SEQ ID NO: 721229 - RNA, 64 nt, Homo Sapiens
agcuuuucccuguccugacaccaggcaagaaaagcgcagagaaaucggugucugacgauuuugg

SEQ ID NO: 721230 - RNA, 64 nt, Homo Sapiens
uucaucuauuauacuuuauccagcauauucuucacgcagagauucuaaaagugugugaaaccua

SEQ ID NO: 721231 - RNA, 64 nt, Homo Sapiens
cacaacuuuacacuuaucauucaaguucaggagccgcagagacgcaaucuauucauaauaaucu

SEQ ID NO: 721232 - RNA, 64 nt, Homo Sapiens
cacucuguccguggaguggacugcguugcugugccgcagagaucgagggaccaggcuggggucg

SEQ ID NO: 721233 - RNA, 64 nt, Homo Sapiens
guacauuugguugugcuuguggggaaaauaaaaacgcagagauccuuauauauuuauguuaaag

SEQ ID NO: 721234 - RNA, 64 nt, Homo Sapiens
uaggccuuguugaaggcuucaucaggaaaugugacgcagagauugugcugcugugcuucauauu

SEQ ID NO: 721235 - RNA, 64 nt, Homo Sapiens
uggcauucacucaaaugcuaauacuuaguuagaccgcagagagcacaagccagugcaugcauua

SEQ ID NO: 721236 - RNA, 64 nt, Homo Sapiens
gaaaaaaaaauuuacuuugagauuugagcauagacgcagagacucuguaugcucagaaaacauu

SEQ ID NO: 721237 - RNA, 64 nt, Homo Sapiens
gagagcgagcccccaaugcccggccaggcuaagccgcagagacccucucagcccccaccucagg

SEQ ID NO: 721238 - RNA, 64 nt, Homo Sapiens
gggucgccuuggauucccucguggacugagcggccgcagagacuuacuccagcucccaacuuuu

SEQ ID NO: 721239 - RNA, 64 nt, Homo Sapiens
cugagggcggucucugaucuacggggcggaaaggcgcagagaaguccaccccauugaugcggug

SEQ ID NO: 721240 - RNA, 64 nt, Homo Sapiens
acaggaagaggcaggggcgggccugcaggcuccccgcagagagcggcguggaccgaggguccca

SEQ ID NO: 721241 - RNA, 64 nt, Homo Sapiens
aagauaagcugaguguucccaccaggaagucacgcgcagagaggagagucuuacggagggcugg

SEQ ID NO: 721242 - RNA, 64 nt, Homo Sapiens
aauucuggcacuuggcugucauucggcuggccugcgcagagauuggcugugggccucaguuucc

SEQ ID NO: 721243 - RNA, 64 nt, Homo Sapiens
ccaccuuggagggucugaccaucuucaccuguuccgcagagaaauguugcucuccauuauuccc

SEQ ID NO: 721244 - RNA, 64 nt, Homo Sapiens
cugcagccagaggccgcacgcugcacugucgcgacgcagagaggcuucugugcaggcugggauc

SEQ ID NO: 721245 - RNA, 64 nt, Homo Sapiens
acucaagacucccgcuggccccugccacacaacacgcagagagggagucccgggaccauggccu

SEQ ID NO: 721246 - RNA, 64 nt, Homo Sapiens
cucuuugagugucugucuuucauccccacaugcccgcagagaucaagucacgccuuggcccuga

SEQ ID NO: 721247 - RNA, 64 nt, Homo Sapiens
cugaggcccaggcaggugaacgagaaaccacaagcgcagagacggcucagucagcccucgggga

SEQ ID NO: 721248 - RNA, 64 nt, Homo Sapiens
cucauccuguagggcacccaccacaaugccagaccgcagagagguaggugcugccuggcccucc

SEQ ID NO: 721249 - RNA, 64 nt, Homo Sapiens
ggggacugccaccuccccuugccagcugcugagccgcagagaagugacgguuccuacacaggac

SEQ ID NO: 721250 - RNA, 64 nt, Homo Sapiens
uaacugcaccucacccccgcacgugugcaugacucgcagagaauauuccagcaauuguguaccc

SEQ ID NO: 721251 - RNA, 64 nt, Homo Sapiens
uaucguuaagcaaauguacaauaugcucaggcaccgcagagagcugggcacgggcccaugugag

SEQ ID NO: 721252 - RNA, 64 nt, Homo Sapiens
ucuuuacugcugggauccacccccaagccuggaacgcagagaggaagaacaaaaaaagagaaac

SEQ ID NO: 721253 - RNA, 64 nt, Homo Sapiens
ugauuguccacauuucaugauaaaaugagagcuccgcagagaauguuagccuuucuguuguaaa

SEQ ID NO: 721254 - RNA, 64 nt, Homo Sapiens
uggguggucaggcccugaugagaccacaugagagcgcagagaggccugggugggggccggaaug

SEQ ID NO: 721255 - RNA, 64 nt, Homo Sapiens
cagggcccgcgcggcccccgacacgccccuggggcgcagagacaccggguuggcuuggggcgcg

SEQ ID NO: 721256 - RNA, 64 nt, Homo Sapiens
ugccuaaaaaggacagguggacugcuguaaaugacgcagagaaaaacauuuuugucuaugguga

SEQ ID NO: 721257 - RNA, 64 nt, Homo Sapiens
gccgagagcaaggcacaaccucgaguucuuggggcgcagagaacuuaggagagaagcacggagg

SEQ ID NO: 721258 - RNA, 64 nt, Homo Sapiens
cauaggaacgcugcauagaccauggaggccuuugcgcagagagcagagaggaugacuugcggcc

SEQ ID NO: 721259 - RNA, 64 nt, Homo Sapiens
cacuccaccgcgaucugccugcgggggaucucagcgcagagaaguugagaggacccaugaagga

SEQ ID NO: 721260 - RNA, 64 nt, Homo Sapiens
auggaaccacccauccgugauaggagcuacacagcgcagagaaacgagaaucgucagcuguaag

SEQ ID NO: 721261 - RNA, 64 nt, Homo Sapiens
augggauuccucccugcgaugcgugucuuucccacgcagagaagcccagucucuucucuggauc

SEQ ID NO: 721262 - RNA, 64 nt, Homo Sapiens
aacaaaugaggcucacccacuggagaaagcaggacgcagagaagcuggagggccccgugguucc

SEQ ID NO: 721263 - RNA, 64 nt, Homo Sapiens
cuggcugcccuggcucuuguccugggcccagccacgcagagaccggugagcucugagggcaagc

SEQ ID NO: 721264 - RNA, 64 nt, Homo Sapiens
cugaagaaugguuggcuguuugcuugccaacaaucgcagagaaggcgcugucagugugaaacgg

SEQ ID NO: 721265 - RNA, 64 nt, Homo Sapiens
gagagaauucuccacaaauucaaggaaucucaagcgcagagaggagacucccucauuuuaccau

SEQ ID NO: 721266 - RNA, 64 nt, Homo Sapiens
ccccgggcuuggcggcucuaggcuucucgacccacgcagagaaggcguuccuccgaaucccguc

SEQ ID NO: 721267 - RNA, 64 nt, Homo Sapiens
gacggugucuccuugcauccacagccaguaaccucgcagagaguaccguccggcucggguccgg

SEQ ID NO: 721268 - RNA, 64 nt, Homo Sapiens
acauguacaacuuuggucauaugagaagcaggugcgcagagaauuccuugaaagaucugagguu

SEQ ID NO: 721269 - RNA, 64 nt, Homo Sapiens
cauuucacagauggggagcucagcccucgaaggccgcagagacgccucccaggcccgucugcca

SEQ ID NO: 721270 - RNA, 59 nt, Homo Sapiens
acgaccaugacgagcucuagcuggaugggcgcagagaaccucaagaaggcaugaagcca

SEQ ID NO: 721271 - RNA, 64 nt, Homo Sapiens
gucaugcuguuuugugugcucucuugcuaaagaccgcagagaccauaccuguugucaaagaggg

SEQ ID NO: 721272 - RNA, 64 nt, Homo Sapiens
ccgaggagucugagccgggggcgcgggcgccuuccgcagagaccugcgcccacaggugcugucu

SEQ ID NO: 721273 - RNA, 64 nt, Homo Sapiens
gcacagggaccgggaccgggaccgugagcgggagcgcagagagcggagccgggagcgagacaag

SEQ ID NO: 721274 - RNA, 64 nt, Homo Sapiens
gcugggccccuccaggagucacagaugaggcccccgcagagacuggugaguggugacccuguca

SEQ ID NO: 721275 - RNA, 64 nt, Homo Sapiens
agcacacagcuuugggcacgaaguacaugaggggcgcagagaugcccugcaccccccucgucag

SEQ ID NO: 721276 - RNA, 64 nt, Homo Sapiens
uuguuuaugggcaguuucucgcaugucacagugccgcagagauugggugucauagccaucacga

SEQ ID NO: 721277 - RNA, 57 nt, Homo Sapiens
cguccccaccgcccgcccggggccucgcgcagagacugccacauccggggcuucuag

SEQ ID NO: 721278 - RNA, 64 nt, Homo Sapiens
cucagggucugaggaggcugugacgcccuaugaccgcagagaucuagacagucguaacaguccc

SEQ ID NO: 721279 - RNA, 64 nt, Homo Sapiens
cuguuggggcugauucggagagggcgccccgccgcgcagagaccagagcuccucagugccaguu

SEQ ID NO: 721280 - RNA, 64 nt, Homo Sapiens
gcguuugcugcgcacagacacucagcaggggccucgcagagaugcgugcauccagcagccccuu

SEQ ID NO: 721281 - RNA, 64 nt, Homo Sapiens
cguguaacacccuuccucugaucgcaccgccccucgcagagaguguaucaucuguuuuauuuuu

SEQ ID NO: 721282 - RNA, 64 nt, Homo Sapiens
gcuguauuuaagacucgcguauccaguguuuugucgcagagaguuuucgcucuuaaauccuggg

SEQ ID NO: 721283 - RNA, 64 nt, Homo Sapiens
uaaggggauuucuaaagcaggcaaucccuguagccgcagagaauaaacgccuucccaaaauggc

SEQ ID NO: 721284 - RNA, 64 nt, Homo Sapiens
auuaacggugcuaaccccgucugcuccucccucccgcagagacuggggccuggacuggacauga

SEQ ID NO: 721285 - RNA, 64 nt, Homo Sapiens
acaccaaagucuccuguucgaccaggugccuugccgcagagaaaaaaggcuguccggagggcag

SEQ ID NO: 721286 - RNA, 64 nt, Homo Sapiens
gugggaagugggagggucccagccccaccaaguacgcagagacccccuugucguccuggacacc

SEQ ID NO: 721287 - RNA, 64 nt, Homo Sapiens
gcugcuguggagugagguguauugguguugcagccgcagagaaaugccccaguguuauuuauuc

SEQ ID NO: 721288 - RNA, 64 nt, Homo Sapiens
uuuaauuuaauacuguuuuuguaacaaccuaaaacgcagagaagagaguguugcaguguauauu

SEQ ID NO: 721289 - RNA, 64 nt, Homo Sapiens
cggugguuccgcuccguggacuggaaagcuguuccgcagagaaaacugaagguacaacauguau

SEQ ID NO: 721290 - RNA, 64 nt, Homo Sapiens; identical to SEQ ID NO: 189518

SEQ ID NO: 721291 - RNA, 64 nt, Homo Sapiens; identical to SEQ ID NO: 189519

SEQ ID NO: 721292 - RNA, 64 nt, Homo Sapiens; identical to SEQ ID NO: 189520

SEQ ID NO: 721293 - RNA, 64 nt, Homo Sapiens; identical to SEQ ID NO: 189521

SEQ ID NO: 721294 - RNA, 64 nt, Homo Sapiens; identical to SEQ ID NO: 189522

SEQ ID NO: 721295 - RNA, 64 nt, Homo Sapiens; identical to SEQ ID NO: 189523

SEQ ID NO: 721296 - RNA, 64 nt, Homo Sapiens; identical to SEQ ID NO: 189524

SEQ ID NO: 721297 - RNA, 64 nt, Homo Sapiens; identical to SEQ ID NO: 189525

SEQ ID NO: 721298 - RNA, 64 nt, Homo Sapiens; identical to SEQ ID NO: 189526

SEQ ID NO: 721299 - RNA, 64 nt, Homo Sapiens; identical to SEQ ID NO: 189527

SEQ ID NO: 721300 - RNA, 64 nt, Homo Sapiens; identical to SEQ ID NO: 189528

SEQ ID NO: 721301 - RNA, 64 nt, Homo Sapiens; identical to SEQ ID NO: 189529

SEQ ID NO: 721302 - RNA, 64 nt, Homo Sapiens; identical to SEQ ID NO: 189530

SEQ ID NO: 721303 - RNA, 64 nt, Homo Sapiens; identical to SEQ ID NO: 720482

SEQ ID NO: 721304 - RNA, 64 nt, Homo Sapiens; identical to SEQ ID NO: 720483

SEQ ID NO: 721305 - RNA, 64 nt, Homo Sapiens; identical to SEQ ID NO: 310839

SEQ ID NO: 721306 - RNA, 64 nt, Homo Sapiens; identical to SEQ ID NO: 310840

SEQ ID NO: 721307 - RNA, 64 nt, Homo Sapiens; identical to SEQ ID NO: 310841

SEQ ID NO: 721308 - RNA, 64 nt, Homo Sapiens; identical to SEQ ID NO: 310842

SEQ ID NO: 721309 - RNA, 64 nt, Homo Sapiens; identical to SEQ ID NO: 310843

SEQ ID NO: 721310 - RNA, 64 nt, Homo Sapiens; identical to SEQ ID NO: 310844

SEQ ID NO: 721311 - RNA, 64 nt, Homo Sapiens; identical to SEQ ID NO: 310845

SEQ ID NO: 721312 - RNA, 64 nt, Homo Sapiens; identical to SEQ ID NO: 310846

SEQ ID NO: 721313 - RNA, 64 nt, Homo Sapiens; identical to SEQ ID NO: 310847

SEQ ID NO: 721314 - RNA, 64 nt, Homo Sapiens; identical to SEQ ID NO: 310848

SEQ ID NO: 721315 - RNA, 64 nt, Homo Sapiens; identical to SEQ ID NO: 310849

SEQ ID NO: 721316 - RNA, 64 nt, Homo Sapiens; identical to SEQ ID NO: 310850

SEQ ID NO: 721317 - RNA, 64 nt, Homo Sapiens; identical to SEQ ID NO: 310851

SEQ ID NO: 721318 - RNA, 64 nt, Homo Sapiens; identical to SEQ ID NO: 310852

SEQ ID NO: 721319 - RNA, 64 nt, Homo Sapiens; identical to SEQ ID NO: 310853

SEQ ID NO: 721320 - RNA, 64 nt, Homo Sapiens; identical to SEQ ID NO: 310854

SEQ ID NO: 721321 - RNA, 64 nt, Homo Sapiens; identical to SEQ ID NO: 310855

SEQ ID NO: 721322 - RNA, 64 nt, Homo Sapiens; identical to SEQ ID NO: 310856

SEQ ID NO: 721323 - RNA, 64 nt, Homo Sapiens; identical to SEQ ID NO: 310857

SEQ ID NO: 721324 - RNA, 64 nt, Homo Sapiens; identical to SEQ ID NO: 310858

SEQ ID NO: 721325 - RNA, 64 nt, Homo Sapiens; identical to SEQ ID NO: 310859

SEQ ID NO: 721326 - RNA, 64 nt, Homo Sapiens; identical to SEQ ID NO: 310860

SEQ ID NO: 721327 - RNA, 64 nt, Homo Sapiens; identical to SEQ ID NO: 97063

SEQ ID NO: 721328 - RNA, 64 nt, Homo Sapiens; identical to SEQ ID NO: 97064

SEQ ID NO: 721329 - RNA, 64 nt, Homo Sapiens; identical to SEQ ID NO: 97065

SEQ ID NO: 721330 - RNA, 64 nt, Homo Sapiens; identical to SEQ ID NO: 97066

SEQ ID NO: 721331 - RNA, 64 nt, Homo Sapiens; identical to SEQ ID NO: 97067

SEQ ID NO: 721332 - RNA, 64 nt, Homo Sapiens; identical to SEQ ID NO: 97068

SEQ ID NO: 721333 - RNA, 64 nt, Homo Sapiens; identical to SEQ ID NO: 97069

SEQ ID NO: 721334 - RNA, 64 nt, Homo Sapiens; identical to SEQ ID NO: 97070

SEQ ID NO: 721335 - RNA, 64 nt, Homo Sapiens; identical to SEQ ID NO: 97071

SEQ ID NO: 721336 - RNA, 64 nt, Homo Sapiens; identical to SEQ ID NO: 97072

SEQ ID NO: 721337 - RNA, 64 nt, Homo Sapiens; identical to SEQ ID NO: 97073

SEQ ID NO: 721338 - RNA, 64 nt, Homo Sapiens; identical to SEQ ID NO: 97074

SEQ ID NO: 721339 - RNA, 64 nt, Homo Sapiens; identical to SEQ ID NO: 97075

SEQ ID NO: 721340 - RNA, 64 nt, Homo Sapiens; identical to SEQ ID NO: 97076

SEQ ID NO: 721341 - RNA, 64 nt, Homo Sapiens; identical to SEQ ID NO: 97077

SEQ ID NO: 721342 - RNA, 64 nt, Homo Sapiens; identical to SEQ ID NO: 97078

SEQ ID NO: 721343 - RNA, 64 nt, Homo Sapiens; identical to SEQ ID NO: 97079

SEQ ID NO: 721344 - RNA, 64 nt, Homo Sapiens; identical to SEQ ID NO: 97080

SEQ ID NO: 721345 - RNA, 64 nt, Homo Sapiens; identical to SEQ ID NO: 97081

SEQ ID NO: 721346 - RNA, 64 nt, Homo Sapiens; identical to SEQ ID NO: 97082

SEQ ID NO: 721347 - RNA, 64 nt, Homo Sapiens; identical to SEQ ID NO: 97083

SEQ ID NO: 721348 - RNA, 64 nt, Homo Sapiens; identical to SEQ ID NO: 97084

SEQ ID NO: 721349 - RNA, 64 nt, Homo Sapiens; identical to SEQ ID NO: 97085

SEQ ID NO: 721350 - RNA, 64 nt, Homo Sapiens; identical to SEQ ID NO: 97086

SEQ ID NO: 721351 - RNA, 64 nt, Homo Sapiens; identical to SEQ ID NO: 97087

SEQ ID NO: 721352 - RNA, 64 nt, Homo Sapiens
agacauucuggugaccagacaaggggucuguucugcaguggagauuccuugcuuuucuuuuuua

SEQ ID NO: 721353 - RNA, 64 nt, Homo Sapiens
uuagccugcaaacaacauuaaccagguugcaguagcaguggaugcuugcuuuugccucugccca

SEQ ID NO: 721354 - RNA, 64 nt, Homo Sapiens
cuacggccuauucucagaggauuauguaaccccugcaguggaaacugagccagcuaacuuaaaa

SEQ ID NO: 721355 - RNA, 64 nt, Homo Sapiens
gggugcucuuucucugugccugcuccuuaugagugcaguggaaggaagccacacacuggucagu

SEQ ID NO: 721356 - RNA, 64 nt, Homo Sapiens
ggcgcuuccuuccaggaacagucccucaggagaggcaguggaccagaagagauggcgaaacgug

SEQ ID NO: 721357 - RNA, 64 nt, Homo Sapiens
aagcguucucccugccugagaugguguggccacagcaguggaaggcugcacacaggcacauucc

SEQ ID NO: 721358 - RNA, 64 nt, Homo Sapiens
ucugaagcucuuggaugucauuugaucggaauaugcaguggaauaggugacucacugaaaugcc

SEQ ID NO: 721359 - RNA, 64 nt, Homo Sapiens
cccaccucuugguggaggaaguugggccaacacugcaguggagauaaccaccuuugcgauaaug

SEQ ID NO: 721360 - RNA, 64 nt, Homo Sapiens
cgugcagucgcggugacggggggagggccgcccggcaguggacucgcugauccugggccgcagc

SEQ ID NO: 721361 - RNA, 64 nt, Homo Sapiens
gaaccaaacucacuguccccacuguggcaugagggcaguggagcaccauguuugagggcgaagg

SEQ ID NO: 721362 - RNA, 64 nt, Homo Sapiens
uuccuccccaaccugcaauaaauccgcuucuccugcaguggaugagugugggugccaguccucc

SEQ ID NO: 721363 - RNA, 64 nt, Homo Sapiens
auggcugggccuuuccagcccaacccacugucuugcaguggacggagagccuuggcgagggcag

SEQ ID NO: 721364 - RNA, 64 nt, Homo Sapiens
uagagaaguaacuuaaagguaaaaaaaaaaaaaggcaguggaaaacagugagacccugucucaa

SEQ ID NO: 721365 - RNA, 64 nt, Homo Sapiens
ccgggcgcagugacucacaccuuggaauuagaaagcaguggagagcucuaaacagaucgcaucc

SEQ ID NO: 721366 - RNA, 64 nt, Homo Sapiens
ucguaggcagccacggccccugugaauccaggaggcaguggacaaccugccuggugcauugcug

SEQ ID NO: 721367 - RNA, 64 nt, Homo Sapiens
cugcugugaaaacucugguacccucccaggucgggcaguggaggccaucccagucccucgccgu

SEQ ID NO: 721368 - RNA, 64 nt, Homo Sapiens
uggucagcgcaggccacggcccgagggggcgcccgcaguggacaggacccgcguggguugggaa

SEQ ID NO: 721369 - RNA, 64 nt, Homo Sapiens
caguggacaggacccgcguggguugggaaggaaagcaguggaacuggccggaccccgccuggag

SEQ ID NO: 721370 - RNA, 64 nt, Homo Sapiens
uucagcgguggaccaagcacugguguuggcuucugcaguggaccaagcaccaguggcuucagcg

SEQ ID NO: 721371 - RNA, 64 nt, Homo Sapiens
uuuggugguggaccgagcaccagugcuggcuuuggcaguggagccgccagucuuggugccugug

SEQ ID NO: 721372 - RNA, 64 nt, Homo Sapiens
ggaggccagguguccccagaccucuaacccuugccccuagcagccucuucuuuguggagccucu

SEQ ID NO: 721373 - RNA, 64 nt, Homo Sapiens
ccagacuucccauuuuacuuucugcaagcuguuucccuagcagcucccucuaggggagagguga

SEQ ID NO: 721374 - RNA, 64 nt, Homo Sapiens
cacugaaauccuuaagguugaggaggcuuuauuucccuagcacuggugaagggcuucaacuguc

SEQ ID NO: 721375 - RNA, 64 nt, Homo Sapiens
cucuucuuugagaagccagacugaucucugagcucccuagcacuguccucaaagaccaucugua

SEQ ID NO: 721376 - RNA, 64 nt, Homo Sapiens
cuggaucaaaacugcuuugggauggaaccucgagcccuagcagugaagaagauuccauuucuug

SEQ ID NO: 721377 - RNA, 64 nt, Homo Sapiens
agaggugacccucggacccgcugccguucgcgaacccuagcagaggacucagccaccgccgggg

SEQ ID NO: 721378 - RNA, 64 nt, Homo Sapiens
caccacguccuugaguggaguucccugcugaagccccuagcacacacugcaugccuuaacaagu

SEQ ID NO: 721379 - RNA, 64 nt, Homo Sapiens
cagucuccaaaccuggugccugugcuccuggccccccuagcaucaugcuaucccaggaguauca

SEQ ID NO: 721380 - RNA, 64 nt, Homo Sapiens
gguccuccaugguggugaggacucucccgguagacccuagcaaggccucauaauagauguggug

SEQ ID NO: 721381 - RNA, 64 nt, Homo Sapiens
ucauccugcccuuugaauacggaaucauuacgaucccuagcagcgaagggcaggagaguaccug

SEQ ID NO: 721382 - RNA, 64 nt, Homo Sapiens
gcccaggccuugcccucaugggagcaccauccugcccuagcagaguccagcucagguagcucua

SEQ ID NO: 721383 - RNA, 64 nt, Homo Sapiens
gagacuugugccuggaaggacugccccauuguaccccuagcacuccuuuccccacuauuucugc

SEQ ID NO: 721384 - RNA, 64 nt, Homo Sapiens
uuauuuagacuuaauuuuuucccauuguggaauucccuagcaaugagaaaaauuuucauugacu

SEQ ID NO: 721385 - RNA, 64 nt, Homo Sapiens
cuagccagaaaagcaagugguuccuagaguugcacccuagcaacguuggacuccaagcuguaac

SEQ ID NO: 721386 - RNA, 64 nt, Homo Sapiens
acugauaccuaccuguaucuggucucucugaagacccuagcagaagcacuguuuuggggcccuc

SEQ ID NO: 721387 - RNA, 64 nt, Homo Sapiens
ccauuuucccuuuuuccuggauugaaacuguucucccuagcaggucagagaaaugauuuucauu

SEQ ID NO: 721388 - RNA, 64 nt, Homo Sapiens
gcaugauguuaaccagaauagggaaacuauuguccccuagcaaguuuuaaauuuauuucaaaaa

SEQ ID NO: 721389 - RNA, 64 nt, Homo Sapiens
ggcccuaggaggggcugaguuggcuuuucgaccacccuagcacuuucccagaccuggggucccu

SEQ ID NO: 721390 - RNA, 64 nt, Homo Sapiens
uuuauuuauuuauuuuuauuauauaccuuuguuucccuagcauuaauagaggcagagacugggg

SEQ ID NO: 721391 - RNA, 64 nt, Homo Sapiens
auucucccuuguugcaacucuguguaccaagaaccccuagcaucagccucauuccuaagccaau

SEQ ID NO: 721392 - RNA, 64 nt, Homo Sapiens
uuauaccuguugaacaacucuccauuucccuggccccuagcaaccacccuucuacccuguuucu

SEQ ID NO: 721393 - RNA, 64 nt, Homo Sapiens
gguucucuccccugccgcugucccuucugcacugcccuagcagagggggcucccacaccacauu

SEQ ID NO: 721394 - RNA, 64 nt, Homo Sapiens
guaguugacacagcuccaggguucagagcugacccccuagcaaccaccugaagcacuuggaucu

SEQ ID NO: 721395 - RNA, 64 nt, Homo Sapiens
ggucuugggucuauuggcauuuuggaucacuguucccuagcaugcuagggagauggcuuucugc

SEQ ID NO: 721396 - RNA, 64 nt, Homo Sapiens
uuggauaagggauacucagcaaaacacuucuggucccuagcauuauauuccaaaccugaaaucc

SEQ ID NO: 721397 - RNA, 64 nt, Homo Sapiens
gauucccaacaagaauuuggauggaaaaccugaucccuagcaagaagucugcucuguaucaccu

SEQ ID NO: 721398 - RNA, 64 nt, Homo Sapiens
guauugcuaugcccucccauaaaaacacauugaucccuagcaagauuauugcauuccagauuuu

SEQ ID NO: 721399 - RNA, 64 nt, Homo Sapiens
ugggugcugggcugcagaggccggucaguggagccccuagcacgugugaacucaggcuuuucau

SEQ ID NO: 721400 - RNA, 64 nt, Homo Sapiens
gggcuuugaaaggccuuccaaacagcuccgucgccccuagcaacuccaccauugggcacugcca

SEQ ID NO: 721401 - RNA, 64 nt, Homo Sapiens
acuagggugacccucauccuguucugucuacucacccuagcagcccugcccagacucuucagcc

SEQ ID NO: 721402 - RNA, 64 nt, Homo Sapiens
augaagggaggagcuccaggaggcgagggaagagcccuagcagggcggccaucacaaccacuca

SEQ ID NO: 721403 - RNA, 64 nt, Homo Sapiens
aacuaauuauacaaacuugaaaggguucaccuugcccuagcaaaacuaggauugggacaccuuu

SEQ ID NO: 721404 - RNA, 64 nt, Homo Sapiens
auauuacaguggcugggcuguuuuuuucaguagccccuagcauuggcugggauuccuguuccug

SEQ ID NO: 721405 - RNA, 64 nt, Homo Sapiens
gccagucaucacuggacacgucuccucgcagcugcccuagcaaggggagacauugugguagcua

SEQ ID NO: 721406 - RNA, 64 nt, Homo Sapiens
gggcauagcgcccgccaugacacgcugcccgugccccuagcaggagcccuggugcuacccccug

SEQ ID NO: 721407 - RNA, 64 nt, Homo Sapiens
ucuuagaauuagaaacuuuguuaaaggaauaaaucccuagcagguaauauccauguucaauguu

SEQ ID NO: 721408 - RNA, 64 nt, Homo Sapiens
aaugacuguuuauuucaaacuuauaucuucagaucccuagcagagagauaguggaaaacuguuc

SEQ ID NO: 721409 - RNA, 64 nt, Homo Sapiens
gccuguugcuuugugagugguguuagccuaagaccccuagcagucagacuggugggguggcaga

SEQ ID NO: 721410 - RNA, 50 nt, Homo Sapiens
guaccugucuugccagcacucccuagcagucuugggcucugggcuccuga

SEQ ID NO: 721411 - RNA, 64 nt, Homo Sapiens
uuggguauucagaggugccuugcccggccugauacccuagcagggcuccuccaggccucugcgc

SEQ ID NO: 721412 - RNA, 64 nt, Homo Sapiens
aauccaccaguuuuucuaaguuauuuaaaagaugcccuagcagcaguagagagcccccacaaag

SEQ ID NO: 721413 - RNA, 64 nt, Homo Sapiens
aucuaauuaaaaaccaugguugcacauuaaaaugcccuagcaguaagaacuauguuaauuuuuu

SEQ ID NO: 721414 - RNA, 64 nt, Homo Sapiens
uguaacuaggaacaugcacuuccugugguauguccccuagcaaaaaaacagacaagguucugag

SEQ ID NO: 721415 - RNA, 64 nt, Homo Sapiens
ugaagggccacugguccccaacaaugugaggggucccuagcagcccacccugcugcuggugcac

SEQ ID NO: 721416 - RNA, 64 nt, Homo Sapiens
augugcucacuccauuuccuggucauccgcaaagcccuagcagagcccccacuguccacuguag

SEQ ID NO: 721417 - RNA, 64 nt, Homo Sapiens
ucuccuuggauaggggaccacgacauccucgaggcccuagcauuuuaguuauaaaaauauauag

SEQ ID NO: 721418 - RNA, 64 nt, Homo Sapiens
uugcuucccagggcucccugggauuuaggugaaucccuagcagaucucaccagaccauguggga

SEQ ID NO: 721419 - RNA, 64 nt, Homo Sapiens
aacuucauuacuuuccuuaggcccucugccccuccccuagcauauggcucuuucuccuauugaa

SEQ ID NO: 721420 - RNA, 64 nt, Homo Sapiens
ucaaccaugagguaaaagagccaaguucaaagaacccuagcacaaauuugcuuugggauuuucu

SEQ ID NO: 721421 - RNA, 64 nt, Homo Sapiens
uauauuuuuuguugucguuuuaacaucuccacgucccuagcauaaaaagaaaaagaaaaaaauu

SEQ ID NO: 721422 - RNA, 64 nt, Homo Sapiens
uucauuugucauucaaagcggaauaacaaguugucccuagcaaaaccgcugagcgcuuuauaau

SEQ ID NO: 721423 - RNA, 64 nt, Homo Sapiens
uccuauuguauauacuuggggaagguguagaacacccuagcaguuuugucccugaugucuuggg

SEQ ID NO: 721424 - RNA, 64 nt, Homo Sapiens
cuaccuucuguucaaaucauaggaacaggauuuccccuagcaagaaggaauuuggagauagcca

SEQ ID NO: 721425 - RNA, 64 nt, Homo Sapiens
ugauuuggugagaggaaucguugcugcccccuuccccuagcaccauauaugagucucaaguuuu

SEQ ID NO: 721426 - RNA, 64 nt, Homo Sapiens
cgguauuuuucuguuaaaauguuaaccguccuuccccuagcaaauuuaaaaacagaaagaaaau

SEQ ID NO: 721427 - RNA, 64 nt, Homo Sapiens
uuuugucuauuucauauuuguccccuagagccagcccuagcaaaugugugaguugggaguaguu

SEQ ID NO: 721428 - RNA, 64 nt, Homo Sapiens
aaacugcaugaaaaaucaugggccagagccucggcccuagcauugcacuuggccucaugcugga

SEQ ID NO: 721429 - RNA, 64 nt, Homo Sapiens
gcagagggaagucucugccagggagugcuccacucccuagcagacaccuauuuucugugcacau

SEQ ID NO: 721430 - RNA, 64 nt, Homo Sapiens
cuuuuggagcaaaaauauuauuaauagauguuuucccuagcagaauuugauuuaaaaacauaua

SEQ ID NO: 721431 - RNA, 64 nt, Homo Sapiens
ugggauaugcaaugcuucuaccaccuuuucuguucccuagcaucgauuguguuuguuggcacac

SEQ ID NO: 721432 - RNA, 64 nt, Homo Sapiens
cagugcaucacaucugcacacucucuucuccauucccuagcaggaacuucuagcucauuuaaca

SEQ ID NO: 721433 - RNA, 64 nt, Homo Sapiens
uggguacggguaccuuguauguuuacuuuuauaucccuagcacaaagcaagugccuggcacaua

SEQ ID NO: 721434 - RNA, 64 nt, Homo Sapiens
uggcaguccauaugccucccuaugcagugaagggcccuagcaguguuaacaaauugcugagauc

SEQ ID NO: 721435 - RNA, 64 nt, Homo Sapiens
cgucuccuagccaaucagaacuggcuguggaccacccuagcacggccaccucucagggccacug

SEQ ID NO: 721436 - RNA, 64 nt, Homo Sapiens
uggugguaguuugcuagugcuucuaaaaguugcucccuagcacugagagguguggguagguaaa

SEQ ID NO: 721437 - RNA, 64 nt, Homo Sapiens
ugugugagauaacuuccuucacaucucccauggucccuagcaaaaugcuaggccuguaguaguc

SEQ ID NO: 721438 - RNA, 64 nt, Homo Sapiens
uuuugaugucuagccccucccauuuccaaccccucccuagcaucccaggugcccugacccagga

SEQ ID NO: 721439 - RNA, 64 nt, Homo Sapiens
cccaauaauacagaacaagacaugaugggcaauacccuagcauauugggauuaagagcuuucua

SEQ ID NO: 721440 - RNA, 64 nt, Homo Sapiens
aauuucccaaacaguccacacuccucgugauccucccuagcauaccaagagcagcagccgcagc

SEQ ID NO: 721441 - RNA, 63 nt, Homo Sapiens
agaaggguucauggcccuuucgggggaggggugcccuagcauccccugcuuggaccucgauaa

SEQ ID NO: 721442 - RNA, 64 nt, Homo Sapiens
gacaagauuuucagccauuucacacucagcuuuccccuagcauguagaaaaaugcacauuuuuc

SEQ ID NO: 721443 - RNA, 64 nt, Homo Sapiens
gcuagggagggcaugaacacuuucccaguuguuacccuagcaaggacacaaaggacagaauucc

SEQ ID NO: 721444 - RNA, 64 nt, Homo Sapiens
guauuuguggggguccaaugugugcaaacggguucccuagcaaaauguggauggggugucugcg

SEQ ID NO: 721445 - RNA, 64 nt, Homo Sapiens
agcuauguguuaaacagaggugauggcagcccuucccuagcacacugguggaagagaccccuua

SEQ ID NO: 721446 - RNA, 64 nt, Homo Sapiens
cuuucaggcaaaauccaauuuacauuuuucccuucccuagcaauuacuuuuuuccagcuucaac

SEQ ID NO: 721447 - RNA, 64 nt, Homo Sapiens
caaacagauaugauuguguuugagggaaauaugucccuagcaggaaaagaauucaaagagguuc

SEQ ID NO: 721448 - RNA, 64 nt, Homo Sapiens
ccccucuguuccucuguuccucucuucuccugcccccuagcaaccacugguguuuucugucccu

SEQ ID NO: 721449 - RNA, 64 nt, Homo Sapiens
gagacagacagcgaagagaugaguugugugaaaccccuagcauaagcaugaaugcaauggugua

SEQ ID NO: 721450 - RNA, 64 nt, Homo Sapiens
acucacagagcuuuccguuuuagaaccuaacacccccuagcaaaugaagaguccgugguugccc

SEQ ID NO: 721451 - RNA, 64 nt, Homo Sapiens
gaggcagucauguuagcaaaugacacguuaauaucccuagcagaggcuguguucaccuucccug

SEQ ID NO: 721452 - RNA, 64 nt, Homo Sapiens
aagccccccaaucugugguauuuuauuauggcagcccuagcaagcuaauacagugguuugagag

SEQ ID NO: 721453 - RNA, 64 nt, Homo Sapiens
ccgcugccucguagagugaccucggacagagccccccuagcaauacagggaggcucccggggcc

SEQ ID NO: 721454 - RNA, 64 nt, Homo Sapiens
ggagagcuagagucccagcaaagggugcagcugacccuagcacuggcugugacaugcugcuugg

SEQ ID NO: 721455 - RNA, 64 nt, Homo Sapiens
agaauacagucuccauccuguuuugaccuaagaacccuagcagggggagggacccgagccuggc

SEQ ID NO: 721456 - RNA, 64 nt, Homo Sapiens
acuauuuaagagccaauuaaacaaaauguuuccucccuagcaaaauaucaauuucuuaaagaac

SEQ ID NO: 721457 - RNA, 64 nt, Homo Sapiens
gcagcugaggccucucuccacuggccgccagccucccuagcacaaggggaccauucagcaauga

SEQ ID NO: 721458 - RNA, 64 nt, Homo Sapiens
aaaaguguaaugaggaaaaugcuucauuaguuuccccuagcagacuuuuacuucucuuacacug

SEQ ID NO: 721459 - RNA, 64 nt, Homo Sapiens
caugcauuuguccuucucccacccccuuacuacacccuagcagaucagcugaguguacuuuauu

SEQ ID NO: 721460 - RNA, 64 nt, Homo Sapiens
agacucagcuguauuguuuucccaguucucuguccccuagcacuuuggggugcuuucuugagcc

SEQ ID NO: 721461 - RNA, 64 nt, Homo Sapiens
uucgggcuccucccucccaccacuccccaacuuccccuagcaguugcagggaagauaggacgag

SEQ ID NO: 721462 - RNA, 64 nt, Homo Sapiens
gaaacaugacacugaccuuggagagacacagcgucccuagcagugaacuauuucuacacagugg

SEQ ID NO: 721463 - RNA, 64 nt, Homo Sapiens
uuggcaggaccaccuccgccuacuucuccaccaucccuagcaugucagcccguucccagaucaa

SEQ ID NO: 721464 - RNA, 64 nt, Homo Sapiens
ggacugaaaacacuaucacaacacuaugagaagccccuagcacugguuaacgcuuuccuagccu

SEQ ID NO: 721465 - RNA, 64 nt, Homo Sapiens
uucagcgaaagccugucuccucacccacccccagcccuagcauaggaaaagcuuccuugaugug

SEQ ID NO: 721466 - RNA, 64 nt, Homo Sapiens
caaguagcauuuauaauagaggaaguauuguuaucccuagcaugaguguaauggugauaugaaa

SEQ ID NO: 721467 - RNA, 64 nt, Homo Sapiens
ccaauuguuuacuguuagaaagugggaauggggucccuagcagacuugccuggaaggagccuau

SEQ ID NO: 721468 - RNA, 64 nt, Homo Sapiens
cuucuccccaaccaggaugugguuccggacccagcccuagcagcgccuugagaagcaagaacau

SEQ ID NO: 721469 - RNA, 64 nt, Homo Sapiens
uguggaugaaucaaaugacuuccugccucuguuucccuagcaagguaaccccuuuccugcuuuu

SEQ ID NO: 721470 - RNA, 64 nt, Homo Sapiens
cugagaugugugugauuaaacauuuguaauaaagcccuagcacugccucucuagcagucaacuc

SEQ ID NO: 721471 - RNA, 64 nt, Homo Sapiens
ccaggagccaucuuggacuccgcccucuguugcucccuagcauucaguguuuccucagcucauc

SEQ ID NO: 721472 - RNA, 64 nt, Homo Sapiens
gcugagacccccagggcggcuuccaccuggugagcccuagcaggugaggucagaccaccuaggc

SEQ ID NO: 721473 - RNA, 64 nt, Homo Sapiens
ucuacuacaagugagaugguucucuugguugcaucccuagcacuccuucccguuauucaaccag

SEQ ID NO: 721474 - RNA, 64 nt, Homo Sapiens
caagugaccagaugcccuacucagcuuccaucaccccuagcaauauguauuaaagucugaagug

SEQ ID NO: 721475 - RNA, 64 nt, Homo Sapiens
gaaaaaaacaauauuaaaccgcccaagcagugugcccuagcagaggaaaaugcaacaucucgca

SEQ ID NO: 721476 - RNA, 64 nt, Homo Sapiens
ccugguugaaucuggcaauucuuuuugccaagaucccuagcagaagauuuagccauguccuucc

SEQ ID NO: 721477 - RNA, 64 nt, Homo Sapiens
auaccuacauugacccaagaaauauuuacgcaaucccuagcagaacauuguuucugaggaggca

SEQ ID NO: 721478 - RNA, 64 nt, Homo Sapiens
cuuucuucagcucacuuggcgaguucucgucugucccuagcaguaaaaaaucucaaagcuauuu

SEQ ID NO: 721479 - RNA, 64 nt, Homo Sapiens
aagucacuggauuuuucucuauuagucgugaaaucccuagcaacauacacaugcuugcaaaaac

SEQ ID NO: 721480 - RNA, 64 nt, Homo Sapiens
ggugggcugagcccaggucuguccugugcaggaccccuagcagucccgugcaggagccacaugg

SEQ ID NO: 721481 - RNA, 64 nt, Homo Sapiens
ccaauaaggcacagcccaguuagcagcuuagccccccuagcaaaccccaaggcacaaagugggc

SEQ ID NO: 721482 - RNA, 64 nt, Homo Sapiens
aaggggcucaccugucacccauccuggccagacacccuagcaggaggacucuuggaagcaggcc

SEQ ID NO: 721483 - RNA, 64 nt, Homo Sapiens
uccauguccaucccccagacgagcugagaggagacccuagcauccuccaaagaacagcuggacg

SEQ ID NO: 721484 - RNA, 64 nt, Homo Sapiens
agucugggcagcucuaugggcuagccaggcauaccccuagcauaaaggaaggagaaagugguua

SEQ ID NO: 721485 - RNA, 64 nt, Homo Sapiens
cggacucggccugccuuugcccucggccuacuugcccuagcaugaggcucugagagccaccugc

SEQ ID NO: 721486 - RNA, 64 nt, Homo Sapiens
agucugggcugggcaugguggcucacgccuguaacccuagcacuuuaggaaaucgaggcgagug

SEQ ID NO: 721487 - RNA, 64 nt, Homo Sapiens
gugaucagggcagagcugggacuccagcucauggcccuagcagccaguacagugcccugucugu

SEQ ID NO: 721488 - RNA, 64 nt, Homo Sapiens
gccccgcagaggcccgccugaagccagcccggcgcccuagcagaugcacgugucugucgaaucg

SEQ ID NO: 721489 - RNA, 64 nt, Homo Sapiens
gcgggcccuggggcgaggccaucucugccugccucccuagcaggcgccagcgguggaggcugag

SEQ ID NO: 721490 - RNA, 64 nt, Homo Sapiens
aaauggaaacaagacuauaaaugauaagcccugucccuagcaccaccucuccuguguguggaau

SEQ ID NO: 721491 - RNA, 64 nt, Homo Sapiens
uggggaccccggccucgagggaaggcaggucuuccccuagcacagcccuguggacacuggcugg

SEQ ID NO: 721492 - RNA, 64 nt, Homo Sapiens
accaugcucgcuggagaggccagggcaccugcaacccuagcaauccccucaccuggccaccugc

SEQ ID NO: 721493 - RNA, 64 nt, Homo Sapiens
agugcaagauggggagugaggaaagcgccuccaacccuagcaaaagucucugaggggcuaccag

SEQ ID NO: 721494 - RNA, 64 nt, Homo Sapiens
uugucaggcugucccuugcucccaaggugccacccccuagcaccucagccaagaacaggccugg

SEQ ID NO: 721495 - RNA, 64 nt, Homo Sapiens
gccacuugggucuccugcauaaauaagucauucucccuagcagagaaauaaaaaagccuuaggu

SEQ ID NO: 721496 - RNA, 64 nt, Homo Sapiens
uucccucucuuccgucucuaggucuguucuucuucccuagcauccuccuccccacaucuccuuu

SEQ ID NO: 721497 - RNA, 64 nt, Homo Sapiens
cuggcauuuggcauguccaugacauuggagacuccccuagcagggugccugacguguggggaac

SEQ ID NO: 721498 - RNA, 64 nt, Homo Sapiens
cgauaggccugacgcagcccccagcccagggccgcccuagcaacuuccuguacauaugacugua

SEQ ID NO: 721499 - RNA, 64 nt, Homo Sapiens
gucucaucaucagcaaccaugacugaugacugggcccuagcagguggcagguauaacauggcca

SEQ ID NO: 721500 - RNA, 64 nt, Homo Sapiens
gaccccacucggagggugcccucugcucaggccucccuagcaccucccccuaaccaaauucucc

SEQ ID NO: 721501 - RNA, 64 nt, Homo Sapiens
aaucacugccaagggcaagaggccaagauggcugcccuagcagcuccccagcuacuguuuuugg

SEQ ID NO: 721502 - RNA, 64 nt, Homo Sapiens
uuuaaggggaggggaagaaugugguccccuuugucccuagcaccugugugccugggucuaacau

SEQ ID NO: 721503 - RNA, 64 nt, Homo Sapiens
agcucccagccccucuuggcggagggggacauagcccuagcaggcccagcuguucuguccuagg

SEQ ID NO: 721504 - RNA, 64 nt, Homo Sapiens
uaauuauauaacuguucuuacugauuuuauugcccccuagcaauaagcccuuuccuuugaauac

SEQ ID NO: 721505 - RNA, 64 nt, Homo Sapiens
ugcccugcacagaguaauaacuuuacacucaccacccuagcaaggagacuuccauuuuuaguuc

SEQ ID NO: 721506 - RNA, 64 nt, Homo Sapiens
gguggcucggccucagcugccuggguuguggccgcccuagcauccuguaugcccacagcuacug

SEQ ID NO: 721507 - RNA, 64 nt, Homo Sapiens
gaaaugguugacauuacacaugguauuugucaugcccuagcauggacugucucauacugcucug

SEQ ID NO: 721508 - RNA, 64 nt, Homo Sapiens
ccggcucugggcuuucggccgagauucgcccaaccccuagcacuggaccacauuagacugggca

SEQ ID NO: 721509 - RNA, 64 nt, Homo Sapiens
aacuugugggauggugggguuuguuccucagcaccccuagcauggguccaauccuaggacagcc

SEQ ID NO: 721510 - RNA, 64 nt, Homo Sapiens
guccauccuguacaucucaagcaagggguuccuccccuagcaccugggcuuggcagaagggcca

SEQ ID NO: 721511 - RNA, 64 nt, Homo Sapiens
gggacuguggcuucuccgucacuccauucucagccccuagcagagcgucuggcacacuagauua

SEQ ID NO: 721512 - RNA, 64 nt, Homo Sapiens
cuggccuugccaucuugugguguggcuuaccauucccuagcacacucagaucucuauuucauuu

SEQ ID NO: 721513 - RNA, 64 nt, Homo Sapiens
uugccucugcacgugcacaccuccaggcuuccugcccuagcaguaaagcaagcaccugggugug

SEQ ID NO: 721514 - RNA, 64 nt, Homo Sapiens
caggucacugccuguggcugcccgcccuccccuccccuagcagccccggucagcccggcuggag

SEQ ID NO: 721515 - RNA, 64 nt, Homo Sapiens
ggggacacgaugagcaccaggccccaccuuuguccccuagcaaauucaggguacagcuccaccu

SEQ ID NO: 721516 - RNA, 64 nt, Homo Sapiens
uggauguggcagaggcaggcgggcugaggccagccccuagcagcagugccugcggccccucaca

SEQ ID NO: 721517 - RNA, 64 nt, Homo Sapiens
ccacaaacagaugcauaguauggguuuuggaagucccuagcaagcuguuauugguaagauuagg

SEQ ID NO: 721518 - RNA, 64 nt, Homo Sapiens
gguauaagaccagguggccugcuccuuuucugggcccuagcacagguggguaacccccacccaa

SEQ ID NO: 721519 - RNA, 64 nt, Homo Sapiens
aaauuuaaaaaauaacacaauuucuugccuguaacccuagcacuuugggaggccgaggcaggug

SEQ ID NO: 721520 - RNA, 64 nt, Homo Sapiens
uugccuuauaaaacuguuaggguaggucugucuacccuagcaaaagaaacacagaaauuuaaau

SEQ ID NO: 721521 - RNA, 64 nt, Homo Sapiens
aacaagagcuccccguuuccucccuccucccugucccuagcaaccaccaguggacuuccuguuu

SEQ ID NO: 721522 - RNA, 64 nt, Homo Sapiens
cacccuccacgccacccccuacuacucacucucacccuagcaaggagcuucgugcuaauaagag

SEQ ID NO: 721523 - RNA, 64 nt, Homo Sapiens
ugcgggaggguuuggccgauuacggcucuguguucccuagcagcgcuaugccccuuggaguaaa

SEQ ID NO: 721524 - RNA, 64 nt, Homo Sapiens
cugggacuggccccacucuccccuggccuccuugcccuagcacaagcacugggcuuccacaggc

SEQ ID NO: 721525 - RNA, 64 nt, Homo Sapiens
uugggaggcugaggcgggcagcucaugccuguaacccuagcacuguucagggcugggcgcggug

SEQ ID NO: 721526 - RNA, 64 nt, Homo Sapiens
auuccaucccagccagagcacuucaucuuagccccccuagcagcugagcugauccuugacuccu

SEQ ID NO: 721527 - RNA, 64 nt, Homo Sapiens
ugagucccuacuccccucccccuggcuaccuccccccuagcacggucacaccaaaggcaaaaag

SEQ ID NO: 721528 - RNA, 64 nt, Homo Sapiens
gcuaugccccuuggaguaaauacagcucuguguucccuagcagcugccggaggauuuggcugau

SEQ ID NO: 721529 - RNA, 64 nt, Homo Sapiens
cccuugucugagacugaaccuccugagaaggggccccuagcagcggucagagguccugucugga

SEQ ID NO: 721530 - RNA, 64 nt, Homo Sapiens; identical to SEQ ID NO: 334558

SEQ ID NO: 721531 - RNA, 64 nt, Homo Sapiens; identical to SEQ ID NO: 334559

SEQ ID NO: 721532 - RNA, 64 nt, Homo Sapiens; identical to SEQ ID NO: 334560

SEQ ID NO: 721533 - RNA, 64 nt, Homo Sapiens; identical to SEQ ID NO: 334561

SEQ ID NO: 721534 - RNA, 64 nt, Homo Sapiens; identical to SEQ ID NO: 334562

SEQ ID NO: 721535 - RNA, 64 nt, Homo Sapiens; identical to SEQ ID NO: 334563

SEQ ID NO: 721536 - RNA, 64 nt, Homo Sapiens; identical to SEQ ID NO: 334564

SEQ ID NO: 721537 - RNA, 64 nt, Homo Sapiens; identical to SEQ ID NO: 334565

SEQ ID NO: 721538 - RNA, 64 nt, Homo Sapiens; identical to SEQ ID NO: 334566

SEQ ID NO: 721539 - RNA, 64 nt, Homo Sapiens; identical to SEQ ID NO: 334567

SEQ ID NO: 721540 - RNA, 64 nt, Homo Sapiens; identical to SEQ ID NO: 334568

SEQ ID NO: 721541 - RNA, 64 nt, Homo Sapiens; identical to SEQ ID NO: 334569

SEQ ID NO: 721542 - RNA, 64 nt, Homo Sapiens; identical to SEQ ID NO: 334570

SEQ ID NO: 721543 - RNA, 64 nt, Homo Sapiens; identical to SEQ ID NO: 334571

SEQ ID NO: 721544 - RNA, 64 nt, Homo Sapiens; identical to SEQ ID NO: 334572

SEQ ID NO: 721545 - RNA, 64 nt, Homo Sapiens; identical to SEQ ID NO: 334573

SEQ ID NO: 721546 - RNA, 64 nt, Homo Sapiens; identical to SEQ ID NO: 334574

SEQ ID NO: 721547 - RNA, 64 nt, Homo Sapiens; identical to SEQ ID NO: 334575

SEQ ID NO: 721548 - RNA, 64 nt, Homo Sapiens; identical to SEQ ID NO: 334576

SEQ ID NO: 721549 - RNA, 64 nt, Homo Sapiens; identical to SEQ ID NO: 334577

SEQ ID NO: 721550 - RNA, 64 nt, Homo Sapiens; identical to SEQ ID NO: 334578

SEQ ID NO: 721551 - RNA, 64 nt, Homo Sapiens; identical to SEQ ID NO: 334579

SEQ ID NO: 721552 - RNA, 64 nt, Homo Sapiens; identical to SEQ ID NO: 334580

SEQ ID NO: 721553 - RNA, 64 nt, Homo Sapiens; identical to SEQ ID NO: 334581

SEQ ID NO: 721554 - RNA, 64 nt, Homo Sapiens
acuuuaugcagcagucagguacauaguuaggugaacccaaaagaaaaacucuugaaaacaagag

SEQ ID NO: 721555 - RNA, 64 nt, Homo Sapiens
uuccuucuaacgaguuguagaaaucugaguaaccacccaaaaaagcaauagaauguuucuguca

SEQ ID NO: 721556 - RNA, 64 nt, Homo Sapiens
aauacuaauguaacagcagaugaaaauugauaaaacccaaaagagagucaucuaaauuuguagu

SEQ ID NO: 721557 - RNA, 64 nt, Homo Sapiens
aaauacauuaucagugauugaaacguuuacauguacccaaaaaccauaaucaucucuuggaaga

SEQ ID NO: 721558 - RNA, 64 nt, Homo Sapiens
gggacaaacaucugacuugguaggucauccuaucacccaaaagaaauccauacacauacauacc

SEQ ID NO: 721559 - RNA, 64 nt, Homo Sapiens
aagaaaaaauagcucuaaauuagagcuguuuucaacccaaaaauaagcaauaaguuuauguuag

SEQ ID NO: 721560 - RNA, 64 nt, Homo Sapiens
ugaacuaccccacaacacgccuaaaacucaaaacacccaaaaauaucuccuccaauguccugaa

SEQ ID NO: 721561 - RNA, 64 nt, Homo Sapiens
ccaaaaauaucuccuccaauguccugaaacaugaacccaaaaagagacccacaauaaacucgug

SEQ ID NO: 721562 - RNA, 64 nt, Homo Sapiens
aaccauuucuuaaaaaauuuuuaaaaaaggcucaacccaaaagacaaaggggagaucccuuuuc

SEQ ID NO: 721563 - RNA, 64 nt, Homo Sapiens
ccucaggacugggaucuggcggcagggccagaucacccaaaacuaagagaaagccugugaaaua

SEQ ID NO: 721564 - RNA, 64 nt, Homo Sapiens
gaaaucaaauuuaucaguuuuuuucccccuaauuacccaaaagaucuuuugcaaacuauguuac

SEQ ID NO: 721565 - RNA, 64 nt, Homo Sapiens
augcuucugccucuuuaagacaaagaagaaugucacccaaaauugucauuuuuuucuuaauguu

SEQ ID NO: 721566 - RNA, 64 nt, Homo Sapiens; identical to SEQ ID NO: 603786

SEQ ID NO: 721567 - RNA, 64 nt, Homo Sapiens; identical to SEQ ID NO: 603787

SEQ ID NO: 721568 - RNA, 64 nt, Homo Sapiens; identical to SEQ ID NO: 603788

SEQ ID NO: 721569 - RNA, 64 nt, Homo Sapiens; identical to SEQ ID NO: 603789

SEQ ID NO: 721570 - RNA, 64 nt, Homo Sapiens
auccuaggcaaggcaaaaaugcacuuccacugaaacgaagcauuucugaccgcuuuuucuuggu

SEQ ID NO: 721571 - RNA, 64 nt, Homo Sapiens
guuggcacauaacauggaaccucugguggcugucacgaagcagaucauaacccugaaugugggg

SEQ ID NO: 721572 - RNA, 64 nt, Homo Sapiens
ugacugugcaucacgcagucaguucacugugaccacgaagcagccaaaugcagucuugguucua

SEQ ID NO: 721573 - RNA, 64 nt, Homo Sapiens
aucauucccguugaacgucagcaccuccauggaaacgaagcaccaccuccaaggaccggccuuu

SEQ ID NO: 721574 - RNA, 64 nt, Homo Sapiens
cugcaacaggcuggccaacaagccgacgcccgcuacgaagcagcacccgggaagggaaguccgc

SEQ ID NO: 721575 - RNA, 64 nt, Homo Sapiens
ggcagggagcuggggacauuuuaaucaucaauaaacgaagcacuuuauucuguacagauuuggg

SEQ ID NO: 721576 - RNA, 64 nt, Homo Sapiens
aguccucaguguguguguaacuucggaaagcgugacgaagcaguuacauagccccacucagcug

SEQ ID NO: 721577 - RNA, 64 nt, Homo Sapiens
cuuguuucugaggaagcuugauaccuugagcacgacgaagcaacgcuguggcccugcugugauc

SEQ ID NO: 721578 - RNA, 64 nt, Homo Sapiens
ucacacacaaugcuuuuuuugguuaaauguugauacgaagcaauguuuuggaauuacuuuaauu

SEQ ID NO: 721579 - RNA, 64 nt, Homo Sapiens
ugauuugcuuuuuaugccuguucugaauggcagcacgaagcaggccuguuacuuguaugucgcu

SEQ ID NO: 721580 - RNA, 64 nt, Homo Sapiens
uccaaaaggaaaagcuugggaugaagacggcaucacgaagcagcugaacccccccuuguuccaa

SEQ ID NO: 721581 - RNA, 64 nt, Homo Sapiens
uccucauuucucaugggcaacagaggccaaagaaacgaagcaagacaaacagcaaacaggcauu

SEQ ID NO: 721582 - RNA, 64 nt, Homo Sapiens
cagaaggccaagauccuugcuuugggggugccucacgaagcaucccuguagacauuuggcccca

SEQ ID NO: 721583 - RNA, 64 nt, Homo Sapiens
aaauaugucaagaacaggacagugaacuuaauggacgaagcaacagaagaaaggcauugcacag

SEQ ID NO: 721584 - RNA, 64 nt, Homo Sapiens
augcaaauccaauuaggcggccaaguagguggagacgaagcaccuuccuuuccccaucucuguc

SEQ ID NO: 721585 - RNA, 64 nt, Homo Sapiens
ccuaaaauaaccucaccccaaauacaauaaagggacgaagcacuuauagauaccacagacacau

SEQ ID NO: 721586 - RNA, 64 nt, Homo Sapiens
uuaguaagcaccuucuaaugaaaaaccaugaauuacgaagcacccugaugcauuucauuaaaaa

SEQ ID NO: 721587 - RNA, 64 nt, Homo Sapiens
uaggcuguacaucagacagaacaugagaagaagcacgaagcagucaagaaagcuguggcucaac

SEQ ID NO: 721588 - RNA, 64 nt, Homo Sapiens
aaucaguaacgcuacaaugaugauuccaauuauuacgaagcacugggaaacgugauucucagug

SEQ ID NO: 721589 - RNA, 64 nt, Homo Sapiens
accaagguguauaguaaccuauuuaucacauuuuacgaagcaauuuuaaucuuaaacacaucca

SEQ ID NO: 721590 - RNA, 64 nt, Homo Sapiens
cacuaacucgaucuucugggaguucucuggcuucacgaagcauguuuacggagaaaacuacaac

SEQ ID NO: 721591 - RNA, 64 nt, Homo Sapiens
gaggccuggaaucuuuuaucauuaaacaccuaguacgaagcauuugcaggaaccuacugugcag

SEQ ID NO: 721592 - RNA, 64 nt, Homo Sapiens
augccuugcaggauggacaggaugacagacagggacgaagcagagaccucuacagacccaaguc

SEQ ID NO: 721593 - RNA, 64 nt, Homo Sapiens
guugcuggcuuaguagagcccaccucuuuccagaacgaagcaaauuagaagggaaauaauguau

SEQ ID NO: 721594 - RNA, 64 nt, Homo Sapiens
cuucauguuaaguagcaauguugcuuguggugaaacgaagcaguugaauaaagaaaaaccauaa

SEQ ID NO: 721595 - RNA, 64 nt, Homo Sapiens
cuucccccaacucuugaacgaugaugauauucagacgaagcauugauguuauggaagaaagaaa

SEQ ID NO: 721596 - RNA, 64 nt, Homo Sapiens
acuguccaguuuucuugcugugucagcucuguuuacgaagcaaugccucaguacugguguagug

SEQ ID NO: 721597 - RNA, 64 nt, Homo Sapiens
cuccucuaccuuuaugguauuuugguguucacuuacgaagcauacaacuagaaccauauccaag

SEQ ID NO: 721598 - RNA, 64 nt, Homo Sapiens
cucaguagggccugccccuucaagggcagcaagaacgaagcaggauguugucacucccgucuga

SEQ ID NO: 721599 - RNA, 64 nt, Homo Sapiens
ugguaacaggcacaucuuccgcgcuggggccgggacgaagcacuccaucuucauucauaggucu

SEQ ID NO: 721600 - RNA, 64 nt, Homo Sapiens
ucguuuuggaagacgagagaaaguugagaagaacacgaagcacagacccugaugugauaaaaca

SEQ ID NO: 721601 - RNA, 64 nt, Homo Sapiens
auccgugugaaguuugucaaugaccucgggguggacgaagcagggauugaucaagacgguguuu

SEQ ID NO: 721602 - RNA, 64 nt, Homo Sapiens
auauguaaaaaguaagcagucguacucaaaacacacgaagcauauuucuuccuucucucauaaa

SEQ ID NO: 721603 - RNA, 64 nt, Homo Sapiens
uauaaugcaguuaucuucuuaauggacuguuuguacgaagcaugcauuuaauuguaccauucag

SEQ ID NO: 721604 - RNA, 64 nt, Homo Sapiens
ccugggauugcuucuuccagcuagaccugcagauacgaagcaaaugcugccuccauugaugucu

SEQ ID NO: 721605 - RNA, 64 nt, Homo Sapiens
cacugggauaccccaccccgagccccagggcgccacgaagcagcgcugggcugagggaagucag

SEQ ID NO: 721606 - RNA, 64 nt, Homo Sapiens
augaauuagggggccucuugggacaacccucaugacgaagcaaccaugcaucaucagaugacaa

SEQ ID NO: 721607 - RNA, 64 nt, Homo Sapiens
auuuauugauauuuaguccagaacaccaguucuaacgaagcaugcgugucucuucaucuacagg

SEQ ID NO: 721608 - RNA, 64 nt, Homo Sapiens
agcucccuucugaagcagagaagccuccauggucacgaagcagcguugugcugugugucccucg

SEQ ID NO: 721609 - RNA, 64 nt, Homo Sapiens
acuguccgucuuuaaacagaaagucaaaggagccacgaagcaagcggccguccgggcguccgcc

SEQ ID NO: 721610 - RNA, 64 nt, Homo Sapiens
agccaucgcgggcugcaucaggggcaagccaaguacgaagcagcccguuacgaggcuguggucc

SEQ ID NO: 721611 - RNA, 64 nt, Homo Sapiens
cccugcucccaucugucccuuuguccucaugcacacgaagcagccacacgcacacagccugguu

SEQ ID NO: 721612 - RNA, 64 nt, Homo Sapiens
acuccuucacgucaggcucagguuccaugggaggacgaagcaguggacgcauugugggcuuuag

SEQ ID NO: 721613 - RNA, 64 nt, Homo Sapiens
ccucagucuccuccguggcuagugugucuaguucacgaagcaauuaacugggucuuacuaucau

SEQ ID NO: 721614 - RNA, 64 nt, Homo Sapiens
acgcucaaugccccacgugccuucuccaggaggaacgaagcaggguuugaggguuggguggaug

SEQ ID NO: 721615 - RNA, 64 nt, Homo Sapiens
auuuggagggaagaaguaauggcgcuagugugggacgaagcacagaucccagcacuuuucccag

SEQ ID NO: 721616 - RNA, 64 nt, Homo Sapiens
cauaggcucaaaauaaaaggauggaggaagaucuacgaagcaaauggaaaacaaacaaaaaaag

SEQ ID NO: 721617 - RNA, 64 nt, Homo Sapiens
ggcugggcgugguggcucucgggaaagaaaacucacgaagcagagaacucagagggugccucag

SEQ ID NO: 721618 - RNA, 64 nt, Homo Sapiens
aucaguccaucccagagggacauugccuaggaacacgaagcacguuuguacuguaugccuucag

SEQ ID NO: 721619 - RNA, 64 nt, Homo Sapiens
uggacaucggagacuacagucaaggggagaagagacgaagcagccuccacuggcagacggcaga

SEQ ID NO: 721620 - RNA, 64 nt, Homo Sapiens
ucagauguuucgaguaaacuugaaaaggguaggcacgaagcaauuuguugcugcuugucacccc

SEQ ID NO: 721621 - RNA, 64 nt, Homo Sapiens
ccugccugucagccguggucagaauaaguuuuacacgaagcaggugaaagauuuaguucuuuuc

SEQ ID NO: 721622 - RNA, 64 nt, Homo Sapiens
ggggggcgguaggggucuugaugaaaccucuugaacgaagcacaguuugucccaucuuuguuca

SEQ ID NO: 721623 - RNA, 64 nt, Homo Sapiens
cugcugcagaugaaagaagaagcaacaauggccaacgaagcacuggugauuucugaggggcugg

SEQ ID NO: 721624 - RNA, 64 nt, Homo Sapiens
aagcaugccguggaucccacacuggcugcagaggacgaagcaggccuggccacaggaguccccu

SEQ ID NO: 721625 - RNA, 64 nt, Homo Sapiens; identical to SEQ ID NO: 383060

SEQ ID NO: 721626 - RNA, 64 nt, Homo Sapiens; identical to SEQ ID NO: 383061

SEQ ID NO: 721627 - RNA, 64 nt, Homo Sapiens; identical to SEQ ID NO: 383062

SEQ ID NO: 721628 - RNA, 64 nt, Homo Sapiens; identical to SEQ ID NO: 383063

SEQ ID NO: 721629 - RNA, 64 nt, Homo Sapiens; identical to SEQ ID NO: 383064

SEQ ID NO: 721630 - RNA, 64 nt, Homo Sapiens; identical to SEQ ID NO: 383065

SEQ ID NO: 721631 - RNA, 64 nt, Homo Sapiens; identical to SEQ ID NO: 383066

SEQ ID NO: 721632 - RNA, 64 nt, Homo Sapiens; identical to SEQ ID NO: 383067

SEQ ID NO: 721633 - RNA, 64 nt, Homo Sapiens; identical to SEQ ID NO: 383068

SEQ ID NO: 721634 - RNA, 64 nt, Homo Sapiens; identical to SEQ ID NO: 383069

SEQ ID NO: 721635 - RNA, 64 nt, Homo Sapiens; identical to SEQ ID NO: 383070

SEQ ID NO: 721636 - RNA, 64 nt, Homo Sapiens; identical to SEQ ID NO: 383071

SEQ ID NO: 721637 - RNA, 64 nt, Homo Sapiens; identical to SEQ ID NO: 383072

SEQ ID NO: 721638 - RNA, 64 nt, Homo Sapiens; identical to SEQ ID NO: 383073

SEQ ID NO: 721639 - RNA, 64 nt, Homo Sapiens; identical to SEQ ID NO: 383074

SEQ ID NO: 721640 - RNA, 64 nt, Homo Sapiens; identical to SEQ ID NO: 383075

SEQ ID NO: 721641 - RNA, 64 nt, Homo Sapiens; identical to SEQ ID NO: 383076

SEQ ID NO: 721642 - RNA, 64 nt, Homo Sapiens; identical to SEQ ID NO: 383077

SEQ ID NO: 721643 - RNA, 64 nt, Homo Sapiens; identical to SEQ ID NO: 383078

SEQ ID NO: 721644 - RNA, 51 nt, Homo Sapiens; identical to SEQ ID NO: 111105

SEQ ID NO: 721645 - RNA, 64 nt, Homo Sapiens; identical to SEQ ID NO: 383080

SEQ ID NO: 721646 - RNA, 64 nt, Homo Sapiens; identical to SEQ ID NO: 383081

SEQ ID NO: 721647 - RNA, 64 nt, Homo Sapiens; identical to SEQ ID NO: 383082

SEQ ID NO: 721648 - RNA, 64 nt, Homo Sapiens; identical to SEQ ID NO: 383083

SEQ ID NO: 721649 - RNA, 64 nt, Homo Sapiens; identical to SEQ ID NO: 383084

SEQ ID NO: 721650 - RNA, 64 nt, Homo Sapiens; identical to SEQ ID NO: 383085

SEQ ID NO: 721651 - RNA, 64 nt, Homo Sapiens; identical to SEQ ID NO: 383086

SEQ ID NO: 721652 - RNA, 64 nt, Homo Sapiens; identical to SEQ ID NO: 383087

SEQ ID NO: 721653 - RNA, 64 nt, Homo Sapiens; identical to SEQ ID NO: 383088

SEQ ID NO: 721654 - RNA, 64 nt, Homo Sapiens; identical to SEQ ID NO: 383089

SEQ ID NO: 721655 - RNA, 64 nt, Homo Sapiens; identical to SEQ ID NO: 383090

SEQ ID NO: 721656 - RNA, 64 nt, Homo Sapiens; identical to SEQ ID NO: 383091

SEQ ID NO: 721657 - RNA, 64 nt, Homo Sapiens; identical to SEQ ID NO: 383092

SEQ ID NO: 721658 - RNA, 64 nt, Homo Sapiens; identical to SEQ ID NO: 383093

SEQ ID NO: 721659 - RNA, 64 nt, Homo Sapiens; identical to SEQ ID NO: 383094

SEQ ID NO: 721660 - RNA, 64 nt, Homo Sapiens; identical to SEQ ID NO: 383095

SEQ ID NO: 721661 - RNA, 64 nt, Homo Sapiens
agacagucgugccauucacaaagucagaaaauacagcaggaagagacagcuuuuagaggggcag

SEQ ID NO: 721662 - RNA, 64 nt, Homo Sapiens
aaagugauggaaugacuucugcaacuguagucccagcaggaacugugaagaccagcugcccugc

SEQ ID NO: 721663 - RNA, 64 nt, Homo Sapiens
ugacucugaccuucugccuggaggaaauugcagaagcaggaaggauuuuaagcugaaggcauuu

SEQ ID NO: 721664 - RNA, 64 nt, Homo Sapiens
uuaaauuuuuuaaguucauggcaucuaagcaggcagcaggaacuacugcucuagauuaguagau

SEQ ID NO: 721665 - RNA, 64 nt, Homo Sapiens
cagguuuccugagugauauguacuccuuuuaagaagcaggaaagguuagcacaaaaugacuaua

SEQ ID NO: 721666 - RNA, 64 nt, Homo Sapiens
ucuuuuuuguuuccccuauugucuccagaacggcagcaggaaaguggcaugacuccaugaauuu

SEQ ID NO: 721667 - RNA, 64 nt, Homo Sapiens
cuuuccaaaagcccagagaugggaacucaggaaaagcaggaacccccggcagcagggcagccau

SEQ ID NO: 721668 - RNA, 64 nt, Homo Sapiens
caaggcucuucucugucccccagaaggagaacugagcaggaaacgcggggggugaggcuuagcc

SEQ ID NO: 721669 - RNA, 64 nt, Homo Sapiens
uuuaugcuaagugaccacaguauacaaaguaauaagcaggaaauuugauauggguuaaauuaug

SEQ ID NO: 721670 - RNA, 64 nt, Homo Sapiens
ugaccuagagguuuuugugguaugcauuggauauagcaggaaagaaagcacauuuccaaacagc

SEQ ID NO: 721671 - RNA, 64 nt, Homo Sapiens
caccgcuguccaccuugggcagagcaggaagagcagcaggaagggcaacggcucagugacagca

SEQ ID NO: 721672 - RNA, 64 nt, Homo Sapiens
gcagcaggaaggcaccgcugucagugacagcaagagcaggaagauccccacuggccgcaacggc

SEQ ID NO: 721673 - RNA, 64 nt, Homo Sapiens
uaacaaauuaagggaagauauuuugacacaagaaagcaggaacguggagaaauuggagcaggaa

SEQ ID NO: 721674 - RNA, 64 nt, Homo Sapiens
uugacacaagaaagcaggaacguggagaaauuggagcaggaaaagaaauuaucaaagcaauaga

SEQ ID NO: 721675 - RNA, 64 nt, Homo Sapiens
agugucuuuguguaucaccuuuuguguguuccucagcaggaaugcaugugcuggucucugugug

SEQ ID NO: 721676 - RNA, 64 nt, Homo Sapiens
acuggccuggcaccaccugguggguucuccugacagcaggaaccagaaauguugaaaagcuccu

SEQ ID NO: 721677 - RNA, 64 nt, Homo Sapiens
uacagaugcagccgugcagggaagaaaaucaaccagcaggaaaguuaguugagaaagaagagaa

SEQ ID NO: 721678 - RNA, 64 nt, Homo Sapiens
augaugcaagcgacaggaaacaagauaaaaccagagcaggaaaguucuucgaucccaagguuuc

SEQ ID NO: 721679 - RNA, 64 nt, Homo Sapiens
uugcauuugacgccuuuaaauuaaaagacuuugaagcaggaaugggaaaccagggucucauggu

SEQ ID NO: 721680 - RNA, 64 nt, Homo Sapiens
uugagucaaaauguguuuccuggaauucugccacagcaggaagcacuauauaauguaugcuuau

SEQ ID NO: 721681 - RNA, 64 nt, Homo Sapiens
uugcuaacaaagcacuuuuggacaaugcuaucccagcaggaaaaaaaaggauaauauaacuguu

SEQ ID NO: 721682 - RNA, 64 nt, Homo Sapiens
gaguauuugaucccuagauaagaacaugcaaaucagcaggaacuggucauacaggguaagcacc

SEQ ID NO: 721683 - RNA, 64 nt, Homo Sapiens
gcucuagaaaagucccaaaagcagcagaaggugaagcaggaagcacuugguuuucuccuuccug

SEQ ID NO: 721684 - RNA, 64 nt, Homo Sapiens
aggaaucucucucagguuuuuucugaccuaaaccagcaggaagucguccugggcuguaagcacc

SEQ ID NO: 721685 - RNA, 64 nt, Homo Sapiens
agggaugagagaaaggaggugguauggaagacucagcaggaacaagguaggcuucaaagagccu

SEQ ID NO: 721686 - RNA, 64 nt, Homo Sapiens
agugagggccccugcugggcccagccaccaggacagcaggaaccagggccuacuccucuuaugg

SEQ ID NO: 721687 - RNA, 64 nt, Homo Sapiens
uugauuaucuuuaagucucucuaccauggagaagagcaggaagggauacacucuccagugcauu

SEQ ID NO: 721688 - RNA, 64 nt, Homo Sapiens
gauuguauugauaaccacugggguuccgcauugaagcaggaacaaauugccucuuuuucuggcc

SEQ ID NO: 721689 - RNA, 64 nt, Homo Sapiens
cugauuaacccauguaaauaggcacuuaaauagaagcaggaaagggagacaaagacuggcuucu

SEQ ID NO: 721690 - RNA, 64 nt, Homo Sapiens
guggcuucauucuagauguagcuugugcagauguagcaggaaaauaggaaaaccuaccaucuca

SEQ ID NO: 721691 - RNA, 64 nt, Homo Sapiens
gguugcuggagcaagaggagucgccugaaccaagagcaggaagacaagaaaaugagggcuugag

SEQ ID NO: 721692 - RNA, 64 nt, Homo Sapiens
gguugcugagauuguuggaaucgccugaacgaagagcaggaagagaagaaaaugagggcuugag

SEQ ID NO: 721693 - RNA, 64 nt, Homo Sapiens
gguugcucagguuguuggagucaccugaaccaagagcaggaagagaagaaaaugagggcuugag

SEQ ID NO: 721694 - RNA, 64 nt, Homo Sapiens
uuugcaacaaaaagcugacccagaggccauacagagcaggaauaucccauugcccccuccucca

SEQ ID NO: 721695 - RNA, 64 nt, Homo Sapiens
cuucuguugucuaacguauggcaggcagacugggagcaggaaaacagagggccccaaagcccaa

SEQ ID NO: 721696 - RNA, 64 nt, Homo Sapiens
aggaaggguaauguuuccauucccaggugacaguagcaggaacaaaggcaagcuaacgcuaacu

SEQ ID NO: 721697 - RNA, 64 nt, Homo Sapiens
guaaacuuuacugaaacauauucugaaugaguagagcaggaaaauucauucagaaaguugccac

SEQ ID NO: 721698 - RNA, 64 nt, Homo Sapiens
ucugugaugucagagcaucuaggugggcugguagagcaggaagcuuaugguggugacaugcaug

SEQ ID NO: 721699 - RNA, 64 nt, Homo Sapiens
gaagugggaagggccagccaaagaaagagaaaguagcaggaaaggaugaguaggucagucuagg

SEQ ID NO: 721700 - RNA, 64 nt, Homo Sapiens
acuaacacauccuaggagggacccuauggacaaaagcaggaaugaccgugaugccacguaacuu

SEQ ID NO: 721701 - RNA, 64 nt, Homo Sapiens
uugcacuucacacuucuugaccuauagcuugcugagcaggaacccagggaccucaccugucgga

SEQ ID NO: 721702 - RNA, 64 nt, Homo Sapiens
uaaaauaucugccaucaucucaagguaauaggacagcaggaaccuuaaugcugcuuuugagcuu

SEQ ID NO: 721703 - RNA, 64 nt, Homo Sapiens
gugcauguggguagagaucauaccuuugggaagcagcaggaaauucagugacaccaucuuggaa

SEQ ID NO: 721704 - RNA, 65 nt, Homo Sapiens; identical to SEQ ID NO: 306964

SEQ ID NO: 721705 - RNA, 65 nt, Homo Sapiens; identical to SEQ ID NO: 306965

SEQ ID NO: 721706 - RNA, 65 nt, Homo Sapiens; identical to SEQ ID NO: 306966

SEQ ID NO: 721707 - RNA, 65 nt, Homo Sapiens; identical to SEQ ID NO: 306967

SEQ ID NO: 721708 - RNA, 65 nt, Homo Sapiens; identical to SEQ ID NO: 306968

SEQ ID NO: 721709 - RNA, 65 nt, Homo Sapiens; identical to SEQ ID NO: 306969

SEQ ID NO: 721710 - RNA, 65 nt, Homo Sapiens; identical to SEQ ID NO: 306970

SEQ ID NO: 721711 - RNA, 65 nt, Homo Sapiens; identical to SEQ ID NO: 306971

SEQ ID NO: 721712 - RNA, 65 nt, Homo Sapiens; identical to SEQ ID NO: 306972

SEQ ID NO: 721713 - RNA, 65 nt, Homo Sapiens; identical to SEQ ID NO: 306973

SEQ ID NO: 721714 - RNA, 65 nt, Homo Sapiens; identical to SEQ ID NO: 306974

SEQ ID NO: 721715 - RNA, 65 nt, Homo Sapiens; identical to SEQ ID NO: 306975

SEQ ID NO: 721716 - RNA, 65 nt, Homo Sapiens; identical to SEQ ID NO: 306976

SEQ ID NO: 721717 - RNA, 65 nt, Homo Sapiens; identical to SEQ ID NO: 306977

SEQ ID NO: 721718 - RNA, 65 nt, Homo Sapiens; identical to SEQ ID NO: 306978

SEQ ID NO: 721719 - RNA, 65 nt, Homo Sapiens; identical to SEQ ID NO: 306979

SEQ ID NO: 721720 - RNA, 65 nt, Homo Sapiens; identical to SEQ ID NO: 306980

SEQ ID NO: 721721 - RNA, 65 nt, Homo Sapiens; identical to SEQ ID NO: 306981

SEQ ID NO: 721722 - RNA, 65 nt, Homo Sapiens; identical to SEQ ID NO: 306982

SEQ ID NO: 721723 - RNA, 65 nt, Homo Sapiens; identical to SEQ ID NO: 306983

SEQ ID NO: 721724 - RNA, 64 nt, Homo Sapiens; identical to SEQ ID NO: 259863

SEQ ID NO: 721725 - RNA, 64 nt, Homo Sapiens; identical to SEQ ID NO: 259864

SEQ ID NO: 721726 - RNA, 64 nt, Homo Sapiens; identical to SEQ ID NO: 259865

SEQ ID NO: 721727 - RNA, 64 nt, Homo Sapiens; identical to SEQ ID NO: 259866

SEQ ID NO: 721728 - RNA, 64 nt, Homo Sapiens; identical to SEQ ID NO: 259867

SEQ ID NO: 721729 - RNA, 64 nt, Homo Sapiens; identical to SEQ ID NO: 259868

SEQ ID NO: 721730 - RNA, 64 nt, Homo Sapiens; identical to SEQ ID NO: 259869

SEQ ID NO: 721731 - RNA, 64 nt, Homo Sapiens; identical to SEQ ID NO: 259870

SEQ ID NO: 721732 - RNA, 64 nt, Homo Sapiens; identical to SEQ ID NO: 259871

SEQ ID NO: 721733 - RNA, 64 nt, Homo Sapiens; identical to SEQ ID NO: 259872

SEQ ID NO: 721734 - RNA, 64 nt, Homo Sapiens; identical to SEQ ID NO: 259873

SEQ ID NO: 721735 - RNA, 64 nt, Homo Sapiens; identical to SEQ ID NO: 259874

SEQ ID NO: 721736 - RNA, 64 nt, Homo Sapiens; identical to SEQ ID NO: 259875

SEQ ID NO: 721737 - RNA, 64 nt, Homo Sapiens; identical to SEQ ID NO: 259876

SEQ ID NO: 721738 - RNA, 64 nt, Homo Sapiens; identical to SEQ ID NO: 259877

SEQ ID NO: 721739 - RNA, 64 nt, Homo Sapiens; identical to SEQ ID NO: 259878

SEQ ID NO: 721740 - RNA, 64 nt, Homo Sapiens; identical to SEQ ID NO: 259879

SEQ ID NO: 721741 - RNA, 64 nt, Homo Sapiens; identical to SEQ ID NO: 259880

SEQ ID NO: 721742 - RNA, 64 nt, Homo Sapiens; identical to SEQ ID NO: 259881

SEQ ID NO: 721743 - RNA, 64 nt, Homo Sapiens; identical to SEQ ID NO: 259882

SEQ ID NO: 721744 - RNA, 64 nt, Homo Sapiens; identical to SEQ ID NO: 259883

SEQ ID NO: 721745 - RNA, 64 nt, Homo Sapiens; identical to SEQ ID NO: 259884

SEQ ID NO: 721746 - RNA, 64 nt, Homo Sapiens; identical to SEQ ID NO: 259885

SEQ ID NO: 721747 - RNA, 64 nt, Homo Sapiens; identical to SEQ ID NO: 259886

SEQ ID NO: 721748 - RNA, 64 nt, Homo Sapiens; identical to SEQ ID NO: 259887

SEQ ID NO: 721749 - RNA, 64 nt, Homo Sapiens; identical to SEQ ID NO: 259888

SEQ ID NO: 721750 - RNA, 64 nt, Homo Sapiens; identical to SEQ ID NO: 259889

SEQ ID NO: 721751 - RNA, 64 nt, Homo Sapiens; identical to SEQ ID NO: 259890

SEQ ID NO: 721752 - RNA, 64 nt, Homo Sapiens; identical to SEQ ID NO: 259891

SEQ ID NO: 721753 - RNA, 64 nt, Homo Sapiens; identical to SEQ ID NO: 259892

SEQ ID NO: 721754 - RNA, 64 nt, Homo Sapiens; identical to SEQ ID NO: 211358

SEQ ID NO: 721755 - RNA, 64 nt, Homo Sapiens; identical to SEQ ID NO: 211359

SEQ ID NO: 721756 - RNA, 64 nt, Homo Sapiens; identical to SEQ ID NO: 211360

SEQ ID NO: 721757 - RNA, 64 nt, Homo Sapiens; identical to SEQ ID NO: 211361

SEQ ID NO: 721758 - RNA, 64 nt, Homo Sapiens; identical to SEQ ID NO: 211362

SEQ ID NO: 721759 - RNA, 64 nt, Homo Sapiens; identical to SEQ ID NO: 211363

SEQ ID NO: 721760 - RNA, 64 nt, Homo Sapiens; identical to SEQ ID NO: 211364

SEQ ID NO: 721761 - RNA, 64 nt, Homo Sapiens; identical to SEQ ID NO: 211365

SEQ ID NO: 721762 - RNA, 64 nt, Homo Sapiens; identical to SEQ ID NO: 211366

SEQ ID NO: 721763 - RNA, 64 nt, Homo Sapiens; identical to SEQ ID NO: 211367

SEQ ID NO: 721764 - RNA, 64 nt, Homo Sapiens; identical to SEQ ID NO: 211368

SEQ ID NO: 721765 - RNA, 64 nt, Homo Sapiens; identical to SEQ ID NO: 211369

SEQ ID NO: 721766 - RNA, 64 nt, Homo Sapiens; identical to SEQ ID NO: 211370

SEQ ID NO: 721767 - RNA, 64 nt, Homo Sapiens; identical to SEQ ID NO: 211371

SEQ ID NO: 721768 - RNA, 64 nt, Homo Sapiens; identical to SEQ ID NO: 211372

SEQ ID NO: 721769 - RNA, 64 nt, Homo Sapiens; identical to SEQ ID NO: 211373

SEQ ID NO: 721770 - RNA, 64 nt, Homo Sapiens; identical to SEQ ID NO: 211374

SEQ ID NO: 721771 - RNA, 64 nt, Homo Sapiens; identical to SEQ ID NO: 211375

SEQ ID NO: 721772 - RNA, 50 nt, Homo Sapiens; identical to SEQ ID NO: 178066

SEQ ID NO: 721773 - RNA, 64 nt, Homo Sapiens; identical to SEQ ID NO: 211377

SEQ ID NO: 721774 - RNA, 64 nt, Homo Sapiens; identical to SEQ ID NO: 211378

SEQ ID NO: 721775 - RNA, 64 nt, Homo Sapiens; identical to SEQ ID NO: 211379

SEQ ID NO: 721776 - RNA, 64 nt, Homo Sapiens; identical to SEQ ID NO: 211380

SEQ ID NO: 721777 - RNA, 64 nt, Homo Sapiens; identical to SEQ ID NO: 211381

SEQ ID NO: 721778 - RNA, 64 nt, Homo Sapiens; identical to SEQ ID NO: 211382

SEQ ID NO: 721779 - RNA, 64 nt, Homo Sapiens; identical to SEQ ID NO: 211383

SEQ ID NO: 721780 - RNA, 64 nt, Homo Sapiens; identical to SEQ ID NO: 211384

SEQ ID NO: 721781 - RNA, 64 nt, Homo Sapiens; identical to SEQ ID NO: 211385

SEQ ID NO: 721782 - RNA, 64 nt, Homo Sapiens; identical to SEQ ID NO: 211386

SEQ ID NO: 721783 - RNA, 64 nt, Homo Sapiens; identical to SEQ ID NO: 211387

SEQ ID NO: 721784 - RNA, 64 nt, Homo Sapiens; identical to SEQ ID NO: 211388

SEQ ID NO: 721785 - RNA, 64 nt, Homo Sapiens; identical to SEQ ID NO: 211389

SEQ ID NO: 721786 - RNA, 64 nt, Homo Sapiens; identical to SEQ ID NO: 211390

SEQ ID NO: 721787 - RNA, 64 nt, Homo Sapiens; identical to SEQ ID NO: 211391

SEQ ID NO: 721788 - RNA, 64 nt, Homo Sapiens; identical to SEQ ID NO: 211392

SEQ ID NO: 721789 - RNA, 64 nt, Homo Sapiens; identical to SEQ ID NO: 211393

SEQ ID NO: 721790 - RNA, 64 nt, Homo Sapiens; identical to SEQ ID NO: 211394

SEQ ID NO: 721791 - RNA, 64 nt, Homo Sapiens; identical to SEQ ID NO: 211395

SEQ ID NO: 721792 - RNA, 64 nt, Homo Sapiens; identical to SEQ ID NO: 211396

SEQ ID NO: 721793 - RNA, 64 nt, Homo Sapiens; identical to SEQ ID NO: 211397

SEQ ID NO: 721794 - RNA, 64 nt, Homo Sapiens; identical to SEQ ID NO: 211398

SEQ ID NO: 721795 - RNA, 64 nt, Homo Sapiens; identical to SEQ ID NO: 211399

SEQ ID NO: 721796 - RNA, 64 nt, Homo Sapiens; identical to SEQ ID NO: 211400

SEQ ID NO: 721797 - RNA, 64 nt, Homo Sapiens; identical to SEQ ID NO: 211401

SEQ ID NO: 721798 - RNA, 64 nt, Homo Sapiens; identical to SEQ ID NO: 211402

SEQ ID NO: 721799 - RNA, 64 nt, Homo Sapiens; identical to SEQ ID NO: 211403

SEQ ID NO: 721800 - RNA, 64 nt, Homo Sapiens; identical to SEQ ID NO: 211404

SEQ ID NO: 721801 - RNA, 64 nt, Homo Sapiens; identical to SEQ ID NO: 211405

SEQ ID NO: 721802 - RNA, 64 nt, Homo Sapiens; identical to SEQ ID NO: 211406

SEQ ID NO: 721803 - RNA, 64 nt, Homo Sapiens; identical to SEQ ID NO: 211407

SEQ ID NO: 721804 - RNA, 64 nt, Homo Sapiens; identical to SEQ ID NO: 211408

SEQ ID NO: 721805 - RNA, 64 nt, Homo Sapiens; identical to SEQ ID NO: 211409

SEQ ID NO: 721806 - RNA, 64 nt, Homo Sapiens; identical to SEQ ID NO: 211410

SEQ ID NO: 721807 - RNA, 64 nt, Homo Sapiens; identical to SEQ ID NO: 211411

SEQ ID NO: 721808 - RNA, 64 nt, Homo Sapiens; identical to SEQ ID NO: 211412

SEQ ID NO: 721809 - RNA, 64 nt, Homo Sapiens; identical to SEQ ID NO: 211413

SEQ ID NO: 721810 - RNA, 64 nt, Homo Sapiens; identical to SEQ ID NO: 211414

SEQ ID NO: 721811 - RNA, 64 nt, Homo Sapiens; identical to SEQ ID NO: 211415

SEQ ID NO: 721812 - RNA, 64 nt, Homo Sapiens; identical to SEQ ID NO: 211416

SEQ ID NO: 721813 - RNA, 64 nt, Homo Sapiens; identical to SEQ ID NO: 211417

SEQ ID NO: 721814 - RNA, 64 nt, Homo Sapiens; identical to SEQ ID NO: 211418

SEQ ID NO: 721815 - RNA, 64 nt, Homo Sapiens; identical to SEQ ID NO: 211419

SEQ ID NO: 721816 - RNA, 64 nt, Homo Sapiens; identical to SEQ ID NO: 211420

SEQ ID NO: 721817 - RNA, 64 nt, Homo Sapiens; identical to SEQ ID NO: 211421

SEQ ID NO: 721818 - RNA, 64 nt, Homo Sapiens; identical to SEQ ID NO: 211422

SEQ ID NO: 721819 - RNA, 64 nt, Homo Sapiens; identical to SEQ ID NO: 211423

SEQ ID NO: 721820 - RNA, 64 nt, Homo Sapiens; identical to SEQ ID NO: 211424

SEQ ID NO: 721821 - RNA, 64 nt, Homo Sapiens; identical to SEQ ID NO: 211425

SEQ ID NO: 721822 - RNA, 64 nt, Homo Sapiens; identical to SEQ ID NO: 211426

SEQ ID NO: 721823 - RNA, 64 nt, Homo Sapiens; identical to SEQ ID NO: 211427

SEQ ID NO: 721824 - RNA, 64 nt, Homo Sapiens; identical to SEQ ID NO: 211428

SEQ ID NO: 721825 - RNA, 64 nt, Homo Sapiens; identical to SEQ ID NO: 211429

SEQ ID NO: 721826 - RNA, 64 nt, Homo Sapiens; identical to SEQ ID NO: 211430

SEQ ID NO: 721827 - RNA, 64 nt, Homo Sapiens; identical to SEQ ID NO: 211431

SEQ ID NO: 721828 - RNA, 64 nt, Homo Sapiens; identical to SEQ ID NO: 211432

SEQ ID NO: 721829 - RNA, 64 nt, Homo Sapiens; identical to SEQ ID NO: 211433

SEQ ID NO: 721830 - RNA, 64 nt, Homo Sapiens; identical to SEQ ID NO: 211434

SEQ ID NO: 721831 - RNA, 64 nt, Homo Sapiens; identical to SEQ ID NO: 211435

SEQ ID NO: 721832 - RNA, 64 nt, Homo Sapiens; identical to SEQ ID NO: 211436

SEQ ID NO: 721833 - RNA, 64 nt, Homo Sapiens; identical to SEQ ID NO: 211437

SEQ ID NO: 721834 - RNA, 64 nt, Homo Sapiens; identical to SEQ ID NO: 211438

SEQ ID NO: 721835 - RNA, 64 nt, Homo Sapiens; identical to SEQ ID NO: 211439

SEQ ID NO: 721836 - RNA, 64 nt, Homo Sapiens; identical to SEQ ID NO: 211440

SEQ ID NO: 721837 - RNA, 64 nt, Homo Sapiens; identical to SEQ ID NO: 211441

SEQ ID NO: 721838 - RNA, 64 nt, Homo Sapiens; identical to SEQ ID NO: 211442

SEQ ID NO: 721839 - RNA, 64 nt, Homo Sapiens; identical to SEQ ID NO: 211443

SEQ ID NO: 721840 - RNA, 64 nt, Homo Sapiens; identical to SEQ ID NO: 211444

SEQ ID NO: 721841 - RNA, 64 nt, Homo Sapiens; identical to SEQ ID NO: 211445

SEQ ID NO: 721842 - RNA, 64 nt, Homo Sapiens; identical to SEQ ID NO: 211446

SEQ ID NO: 721843 - RNA, 64 nt, Homo Sapiens; identical to SEQ ID NO: 211447

SEQ ID NO: 721844 - RNA, 64 nt, Homo Sapiens; identical to SEQ ID NO: 211448

SEQ ID NO: 721845 - RNA, 64 nt, Homo Sapiens; identical to SEQ ID NO: 211449

SEQ ID NO: 721846 - RNA, 64 nt, Homo Sapiens; identical to SEQ ID NO: 211450

SEQ ID NO: 721847 - RNA, 64 nt, Homo Sapiens; identical to SEQ ID NO: 211451

SEQ ID NO: 721848 - RNA, 64 nt, Homo Sapiens; identical to SEQ ID NO: 211452

SEQ ID NO: 721849 - RNA, 64 nt, Homo Sapiens; identical to SEQ ID NO: 211453

SEQ ID NO: 721850 - RNA, 64 nt, Homo Sapiens; identical to SEQ ID NO: 211454

SEQ ID NO: 721851 - RNA, 64 nt, Homo Sapiens; identical to SEQ ID NO: 211455

SEQ ID NO: 721852 - RNA, 64 nt, Homo Sapiens; identical to SEQ ID NO: 211456

SEQ ID NO: 721853 - RNA, 64 nt, Homo Sapiens; identical to SEQ ID NO: 211457

SEQ ID NO: 721854 - RNA, 64 nt, Homo Sapiens; identical to SEQ ID NO: 211458

SEQ ID NO: 721855 - RNA, 64 nt, Homo Sapiens; identical to SEQ ID NO: 211459

SEQ ID NO: 721856 - RNA, 64 nt, Homo Sapiens; identical to SEQ ID NO: 211460

SEQ ID NO: 721857 - RNA, 64 nt, Homo Sapiens; identical to SEQ ID NO: 211461

SEQ ID NO: 721858 - RNA, 64 nt, Homo Sapiens; identical to SEQ ID NO: 211462

SEQ ID NO: 721859 - RNA, 64 nt, Homo Sapiens; identical to SEQ ID NO: 211463

SEQ ID NO: 721860 - RNA, 64 nt, Homo Sapiens; identical to SEQ ID NO: 211464

SEQ ID NO: 721861 - RNA, 64 nt, Homo Sapiens; identical to SEQ ID NO: 211465

SEQ ID NO: 721862 - RNA, 64 nt, Homo Sapiens; identical to SEQ ID NO: 211466

SEQ ID NO: 721863 - RNA, 64 nt, Homo Sapiens; identical to SEQ ID NO: 211467

SEQ ID NO: 721864 - RNA, 64 nt, Homo Sapiens; identical to SEQ ID NO: 211468

SEQ ID NO: 721865 - RNA, 64 nt, Homo Sapiens; identical to SEQ ID NO: 211469

SEQ ID NO: 721866 - RNA, 64 nt, Homo Sapiens; identical to SEQ ID NO: 211470

SEQ ID NO: 721867 - RNA, 64 nt, Homo Sapiens; identical to SEQ ID NO: 211471

SEQ ID NO: 721868 - RNA, 64 nt, Homo Sapiens; identical to SEQ ID NO: 211472

SEQ ID NO: 721869 - RNA, 64 nt, Homo Sapiens; identical to SEQ ID NO: 211473

SEQ ID NO: 721870 - RNA, 64 nt, Homo Sapiens; identical to SEQ ID NO: 211474

SEQ ID NO: 721871 - RNA, 64 nt, Homo Sapiens; identical to SEQ ID NO: 211475

SEQ ID NO: 721872 - RNA, 64 nt, Homo Sapiens; identical to SEQ ID NO: 211476

SEQ ID NO: 721873 - RNA, 64 nt, Homo Sapiens; identical to SEQ ID NO: 211477

SEQ ID NO: 721874 - RNA, 64 nt, Homo Sapiens; identical to SEQ ID NO: 211478

SEQ ID NO: 721875 - RNA, 64 nt, Homo Sapiens; identical to SEQ ID NO: 211479

SEQ ID NO: 721876 - RNA, 64 nt, Homo Sapiens; identical to SEQ ID NO: 211480

SEQ ID NO: 721877 - RNA, 64 nt, Homo Sapiens; identical to SEQ ID NO: 211481

SEQ ID NO: 721878 - RNA, 64 nt, Homo Sapiens; identical to SEQ ID NO: 211482

SEQ ID NO: 721879 - RNA, 64 nt, Homo Sapiens; identical to SEQ ID NO: 211483

SEQ ID NO: 721880 - RNA, 64 nt, Homo Sapiens; identical to SEQ ID NO: 211484

SEQ ID NO: 721881 - RNA, 64 nt, Homo Sapiens; identical to SEQ ID NO: 211485

SEQ ID NO: 721882 - RNA, 64 nt, Homo Sapiens; identical to SEQ ID NO: 211486

SEQ ID NO: 721883 - RNA, 64 nt, Homo Sapiens; identical to SEQ ID NO: 211487

SEQ ID NO: 721884 - RNA, 64 nt, Homo Sapiens; identical to SEQ ID NO: 211488

SEQ ID NO: 721885 - RNA, 64 nt, Homo Sapiens; identical to SEQ ID NO: 211489

SEQ ID NO: 721886 - RNA, 64 nt, Homo Sapiens; identical to SEQ ID NO: 211490

SEQ ID NO: 721887 - RNA, 64 nt, Homo Sapiens; identical to SEQ ID NO: 211491

SEQ ID NO: 721888 - RNA, 64 nt, Homo Sapiens; identical to SEQ ID NO: 211492

SEQ ID NO: 721889 - RNA, 64 nt, Homo Sapiens; identical to SEQ ID NO: 211493

SEQ ID NO: 721890 - RNA, 64 nt, Homo Sapiens; identical to SEQ ID NO: 211494

SEQ ID NO: 721891 - RNA, 64 nt, Homo Sapiens; identical to SEQ ID NO: 211495

SEQ ID NO: 721892 - RNA, 64 nt, Homo Sapiens; identical to SEQ ID NO: 211496

SEQ ID NO: 721893 - RNA, 64 nt, Homo Sapiens; identical to SEQ ID NO: 211497

SEQ ID NO: 721894 - RNA, 64 nt, Homo Sapiens; identical to SEQ ID NO: 211498

SEQ ID NO: 721895 - RNA, 64 nt, Homo Sapiens; identical to SEQ ID NO: 211499

SEQ ID NO: 721896 - RNA, 64 nt, Homo Sapiens; identical to SEQ ID NO: 211500

SEQ ID NO: 721897 - RNA, 64 nt, Homo Sapiens; identical to SEQ ID NO: 211501

SEQ ID NO: 721898 - RNA, 64 nt, Homo Sapiens; identical to SEQ ID NO: 211502

SEQ ID NO: 721899 - RNA, 64 nt, Homo Sapiens; identical to SEQ ID NO: 211503

SEQ ID NO: 721900 - RNA, 64 nt, Homo Sapiens; identical to SEQ ID NO: 211504

SEQ ID NO: 721901 - RNA, 64 nt, Homo Sapiens; identical to SEQ ID NO: 211505

SEQ ID NO: 721902 - RNA, 64 nt, Homo Sapiens; identical to SEQ ID NO: 211506

SEQ ID NO: 721903 - RNA, 64 nt, Homo Sapiens; identical to SEQ ID NO: 211507

SEQ ID NO: 721904 - RNA, 64 nt, Homo Sapiens; identical to SEQ ID NO: 211508

SEQ ID NO: 721905 - RNA, 64 nt, Homo Sapiens; identical to SEQ ID NO: 211509

SEQ ID NO: 721906 - RNA, 64 nt, Homo Sapiens; identical to SEQ ID NO: 211510

SEQ ID NO: 721907 - RNA, 64 nt, Homo Sapiens; identical to SEQ ID NO: 211511

SEQ ID NO: 721908 - RNA, 64 nt, Homo Sapiens; identical to SEQ ID NO: 211512

SEQ ID NO: 721909 - RNA, 64 nt, Homo Sapiens; identical to SEQ ID NO: 211513

SEQ ID NO: 721910 - RNA, 64 nt, Homo Sapiens; identical to SEQ ID NO: 211514

SEQ ID NO: 721911 - RNA, 64 nt, Homo Sapiens; identical to SEQ ID NO: 211515

SEQ ID NO: 721912 - RNA, 64 nt, Homo Sapiens; identical to SEQ ID NO: 211516

SEQ ID NO: 721913 - RNA, 64 nt, Homo Sapiens; identical to SEQ ID NO: 211517

SEQ ID NO: 721914 - RNA, 64 nt, Homo Sapiens; identical to SEQ ID NO: 211518

SEQ ID NO: 721915 - RNA, 64 nt, Homo Sapiens; identical to SEQ ID NO: 211519

SEQ ID NO: 721916 - RNA, 64 nt, Homo Sapiens; identical to SEQ ID NO: 211520

SEQ ID NO: 721917 - RNA, 64 nt, Homo Sapiens; identical to SEQ ID NO: 211521

SEQ ID NO: 721918 - RNA, 64 nt, Homo Sapiens; identical to SEQ ID NO: 211522

SEQ ID NO: 721919 - RNA, 64 nt, Homo Sapiens; identical to SEQ ID NO: 211523

SEQ ID NO: 721920 - RNA, 64 nt, Homo Sapiens; identical to SEQ ID NO: 211524

SEQ ID NO: 721921 - RNA, 64 nt, Homo Sapiens; identical to SEQ ID NO: 211525

SEQ ID NO: 721922 - RNA, 64 nt, Homo Sapiens; identical to SEQ ID NO: 211526

SEQ ID NO: 721923 - RNA, 64 nt, Homo Sapiens; identical to SEQ ID NO: 211527

SEQ ID NO: 721924 - RNA, 64 nt, Homo Sapiens; identical to SEQ ID NO: 211528

SEQ ID NO: 721925 - RNA, 64 nt, Homo Sapiens; identical to SEQ ID NO: 211529

SEQ ID NO: 721926 - RNA, 64 nt, Homo Sapiens; identical to SEQ ID NO: 211530

SEQ ID NO: 721927 - RNA, 64 nt, Homo Sapiens; identical to SEQ ID NO: 211531

SEQ ID NO: 721928 - RNA, 64 nt, Homo Sapiens; identical to SEQ ID NO: 211532

SEQ ID NO: 721929 - RNA, 64 nt, Homo Sapiens; identical to SEQ ID NO: 211533

SEQ ID NO: 721930 - RNA, 64 nt, Homo Sapiens; identical to SEQ ID NO: 211534

SEQ ID NO: 721931 - RNA, 64 nt, Homo Sapiens; identical to SEQ ID NO: 211535

SEQ ID NO: 721932 - RNA, 64 nt, Homo Sapiens; identical to SEQ ID NO: 211536

SEQ ID NO: 721933 - RNA, 64 nt, Homo Sapiens; identical to SEQ ID NO: 211537

SEQ ID NO: 721934 - RNA, 64 nt, Homo Sapiens; identical to SEQ ID NO: 211538

SEQ ID NO: 721935 - RNA, 64 nt, Homo Sapiens; identical to SEQ ID NO: 211539

SEQ ID NO: 721936 - RNA, 64 nt, Homo Sapiens; identical to SEQ ID NO: 211540

SEQ ID NO: 721937 - RNA, 64 nt, Homo Sapiens; identical to SEQ ID NO: 211541

SEQ ID NO: 721938 - RNA, 64 nt, Homo Sapiens; identical to SEQ ID NO: 211542

SEQ ID NO: 721939 - RNA, 64 nt, Homo Sapiens; identical to SEQ ID NO: 211543

SEQ ID NO: 721940 - RNA, 64 nt, Homo Sapiens; identical to SEQ ID NO: 211544

SEQ ID NO: 721941 - RNA, 64 nt, Homo Sapiens; identical to SEQ ID NO: 211545

SEQ ID NO: 721942 - RNA, 64 nt, Homo Sapiens; identical to SEQ ID NO: 211546

SEQ ID NO: 721943 - RNA, 64 nt, Homo Sapiens; identical to SEQ ID NO: 211547

SEQ ID NO: 721944 - RNA, 64 nt, Homo Sapiens; identical to SEQ ID NO: 211548

SEQ ID NO: 721945 - RNA, 64 nt, Homo Sapiens; identical to SEQ ID NO: 211549

SEQ ID NO: 721946 - RNA, 64 nt, Homo Sapiens; identical to SEQ ID NO: 211550

SEQ ID NO: 721947 - RNA, 64 nt, Homo Sapiens; identical to SEQ ID NO: 211551

SEQ ID NO: 721948 - RNA, 64 nt, Homo Sapiens; identical to SEQ ID NO: 211552

SEQ ID NO: 721949 - RNA, 64 nt, Homo Sapiens; identical to SEQ ID NO: 211553

SEQ ID NO: 721950 - RNA, 64 nt, Homo Sapiens; identical to SEQ ID NO: 211554

SEQ ID NO: 721951 - RNA, 64 nt, Homo Sapiens; identical to SEQ ID NO: 211555

SEQ ID NO: 721952 - RNA, 64 nt, Homo Sapiens; identical to SEQ ID NO: 211556

SEQ ID NO: 721953 - RNA, 64 nt, Homo Sapiens; identical to SEQ ID NO: 211557

SEQ ID NO: 721954 - RNA, 64 nt, Homo Sapiens; identical to SEQ ID NO: 211558

SEQ ID NO: 721955 - RNA, 64 nt, Homo Sapiens; identical to SEQ ID NO: 211559

SEQ ID NO: 721956 - RNA, 64 nt, Homo Sapiens; identical to SEQ ID NO: 211560

SEQ ID NO: 721957 - RNA, 64 nt, Homo Sapiens; identical to SEQ ID NO: 194965

SEQ ID NO: 721958 - RNA, 64 nt, Homo Sapiens; identical to SEQ ID NO: 194966

SEQ ID NO: 721959 - RNA, 64 nt, Homo Sapiens; identical to SEQ ID NO: 194967

SEQ ID NO: 721960 - RNA, 64 nt, Homo Sapiens; identical to SEQ ID NO: 194968

SEQ ID NO: 721961 - RNA, 64 nt, Homo Sapiens; identical to SEQ ID NO: 194969

SEQ ID NO: 721962 - RNA, 64 nt, Homo Sapiens; identical to SEQ ID NO: 194970

SEQ ID NO: 721963 - RNA, 64 nt, Homo Sapiens; identical to SEQ ID NO: 194971

SEQ ID NO: 721964 - RNA, 64 nt, Homo Sapiens; identical to SEQ ID NO: 194972

SEQ ID NO: 721965 - RNA, 64 nt, Homo Sapiens; identical to SEQ ID NO: 194973

SEQ ID NO: 721966 - RNA, 64 nt, Homo Sapiens; identical to SEQ ID NO: 194974

SEQ ID NO: 721967 - RNA, 64 nt, Homo Sapiens; identical to SEQ ID NO: 194975

SEQ ID NO: 721968 - RNA, 64 nt, Homo Sapiens; identical to SEQ ID NO: 194976

SEQ ID NO: 721969 - RNA, 64 nt, Homo Sapiens; identical to SEQ ID NO: 194977

SEQ ID NO: 721970 - RNA, 64 nt, Homo Sapiens; identical to SEQ ID NO: 194978

SEQ ID NO: 721971 - RNA, 64 nt, Homo Sapiens; identical to SEQ ID NO: 194979

SEQ ID NO: 721972 - RNA, 64 nt, Homo Sapiens; identical to SEQ ID NO: 194980

SEQ ID NO: 721973 - RNA, 64 nt, Homo Sapiens; identical to SEQ ID NO: 194981

SEQ ID NO: 721974 - RNA, 64 nt, Homo Sapiens; identical to SEQ ID NO: 194982

SEQ ID NO: 721975 - RNA, 64 nt, Homo Sapiens
agaacguaucauccuagcuuccucucuuaauaaaccuagaaaaacggguaguaaacuguggaua

SEQ ID NO: 721976 - RNA, 64 nt, Homo Sapiens
ugugcaaggaucuuauuugugaugccuucccuccccuagaaagauuuugugcaauauauuaaau

SEQ ID NO: 721977 - RNA, 64 nt, Homo Sapiens
ucuccugucccuaaagggguuaagagagagaucaccuagaaaucccucuggacacuuguggguu

SEQ ID NO: 721978 - RNA, 64 nt, Homo Sapiens
aaauaggagacaucucagagaagccuagaaauuuccuagaaagacauuuauuuuuuaaacuuaa

SEQ ID NO: 721979 - RNA, 64 nt, Homo Sapiens
uccuagaaagaaaauaggaguuuaaacuuaaaagccuagaaauuuacaucauaaucauuuauuu

SEQ ID NO: 721980 - RNA, 64 nt, Homo Sapiens
ucuccaaaacugaacugauugcuuguugagauuaccuagaaagcuuuuggaaaaaaauagagcu

SEQ ID NO: 721981 - RNA, 64 nt, Homo Sapiens
cagauacacugaaucggaaucccuagggcuagagccuagaaaucucacuuuuuaaaaugcuucc

SEQ ID NO: 721982 - RNA, 64 nt, Homo Sapiens
aaauggaaaaauggucauuuaaaggguuuaauuuccuagaaagauagaagguagauaagaauua

SEQ ID NO: 721983 - RNA, 64 nt, Homo Sapiens
gugaguguuuuaaugagacucauucaaaaucaccccuagaaaaauccuucccuucccugugcag

SEQ ID NO: 721984 - RNA, 64 nt, Homo Sapiens
guugagaaagaacaaaaagggaauuuccagauguccuagaaauccuagcaacagauuucucugg

SEQ ID NO: 721985 - RNA, 64 nt, Homo Sapiens
aaauagaacuguaaugggguuguauuuaugggcgccuagaaagaaaacacaaggacuugguagg

SEQ ID NO: 721986 - RNA, 64 nt, Homo Sapiens
gggcaccaucacaauacagauaacauuagguuguccuagaaaggguguggagggaggaaggggg

SEQ ID NO: 721987 - RNA, 64 nt, Homo Sapiens
uguuucucauauggucuaccaguuugcugaugucccuagaaaacaaugcaaaaccuuugaggua

SEQ ID NO: 721988 - RNA, 64 nt, Homo Sapiens
ugaaauugaaaauaccaaaaauucauaauguauaccuagaaaagccuuuugauacaacuagguu

SEQ ID NO: 721989 - RNA, 64 nt, Homo Sapiens
caaaaucaaacugagauuucguguucucuguuuuccuagaaaacaaaagugcacauacgcaacu

SEQ ID NO: 721990 - RNA, 64 nt, Homo Sapiens
uaucugauauuaaacaucaucugcauuuuacuugccuagaaaauacacgguaacuuuucugccu

SEQ ID NO: 721991 - RNA, 64 nt, Homo Sapiens
ugaauggcaggugucccauaucugguuauguuaaccuagaaagggcucacucuaccucuaggca

SEQ ID NO: 721992 - RNA, 64 nt, Homo Sapiens
aaucuaaaacuguuaauuuaacccuuaacuugugccuagaaacuacagcacauauaaaauaugu

SEQ ID NO: 721993 - RNA, 64 nt, Homo Sapiens
ugaccaaccuuagguaaaacaaaaauauuguaauccuagaaauuauccuccagcuuucucaccu

SEQ ID NO: 721994 - RNA, 64 nt, Homo Sapiens
gaccugcauucaaccaacugucaaaaaugugcugccuagaaacaagagaugaacaacuuugccu

SEQ ID NO: 721995 - RNA, 64 nt, Homo Sapiens
aggauucuaccugaacugaauguuggucaaaugaccuagaaacacccuaaggagccugggauga

SEQ ID NO: 721996 - RNA, 64 nt, Homo Sapiens
aagaaaagccucagcucauagugaacacagcagaccuagaaauguagcagcagccuacugagua

SEQ ID NO: 721997 - RNA, 64 nt, Homo Sapiens
guggcagacauaucacaagaguccccagacucugccuagaaacaguguuugcccuuuggccagu

SEQ ID NO: 721998 - RNA, 64 nt, Homo Sapiens
auagaggauacaaaauugucuaauuuucaugacaccuagaaaacguuuucccagagcugccuau

SEQ ID NO: 721999 - RNA, 64 nt, Homo Sapiens
cucucaaaaaaaauguaucagaaaaguuugauuaccuagaaaguguguauagaaacugcaaaua

SEQ ID NO: 722000 - RNA, 64 nt, Homo Sapiens
gauuguguggaaccaguauguagcaaauggaaagccuagaaauaucuuauuuucuaaguuuacc

SEQ ID NO: 722001 - RNA, 64 nt, Homo Sapiens
ugggucuuuacuucugggaauuuguauguaacagccuagaaaauuaaaaggagguggaugcauc

SEQ ID NO: 722002 - RNA, 64 nt, Homo Sapiens; identical to SEQ ID NO: 722000

SEQ ID NO: 722003 - RNA, 64 nt, Homo Sapiens; identical to SEQ ID NO: 722001

SEQ ID NO: 722004 - RNA, 64 nt, Homo Sapiens; identical to SEQ ID NO: 558207

SEQ ID NO: 722005 - RNA, 64 nt, Homo Sapiens; identical to SEQ ID NO: 558208

SEQ ID NO: 722006 - RNA, 64 nt, Homo Sapiens; identical to SEQ ID NO: 558209

SEQ ID NO: 722007 - RNA, 64 nt, Homo Sapiens; identical to SEQ ID NO: 558210

SEQ ID NO: 722008 - RNA, 64 nt, Homo Sapiens; identical to SEQ ID NO: 558211

SEQ ID NO: 722009 - RNA, 64 nt, Homo Sapiens; identical to SEQ ID NO: 558212

SEQ ID NO: 722010 - RNA, 64 nt, Homo Sapiens; identical to SEQ ID NO: 558213

SEQ ID NO: 722011 - RNA, 64 nt, Homo Sapiens; identical to SEQ ID NO: 558214

SEQ ID NO: 722012 - RNA, 64 nt, Homo Sapiens; identical to SEQ ID NO: 558215

SEQ ID NO: 722013 - RNA, 64 nt, Homo Sapiens; identical to SEQ ID NO: 558216

SEQ ID NO: 722014 - RNA, 64 nt, Homo Sapiens; identical to SEQ ID NO: 558217

SEQ ID NO: 722015 - RNA, 64 nt, Homo Sapiens; identical to SEQ ID NO: 558218

SEQ ID NO: 722016 - RNA, 64 nt, Homo Sapiens; identical to SEQ ID NO: 558219

SEQ ID NO: 722017 - RNA, 64 nt, Homo Sapiens; identical to SEQ ID NO: 558220

SEQ ID NO: 722018 - RNA, 64 nt, Homo Sapiens; identical to SEQ ID NO: 558221

SEQ ID NO: 722019 - RNA, 64 nt, Homo Sapiens; identical to SEQ ID NO: 558222

SEQ ID NO: 722020 - RNA, 64 nt, Homo Sapiens; identical to SEQ ID NO: 558223

SEQ ID NO: 722021 - RNA, 64 nt, Homo Sapiens; identical to SEQ ID NO: 558224

SEQ ID NO: 722022 - RNA, 64 nt, Homo Sapiens; identical to SEQ ID NO: 558225

SEQ ID NO: 722023 - RNA, 64 nt, Homo Sapiens; identical to SEQ ID NO: 558226

SEQ ID NO: 722024 - RNA, 64 nt, Homo Sapiens; identical to SEQ ID NO: 558227

SEQ ID NO: 722025 - RNA, 64 nt, Homo Sapiens; identical to SEQ ID NO: 558228

SEQ ID NO: 722026 - RNA, 64 nt, Homo Sapiens; identical to SEQ ID NO: 302224

SEQ ID NO: 722027 - RNA, 64 nt, Homo Sapiens; identical to SEQ ID NO: 302225

SEQ ID NO: 722028 - RNA, 64 nt, Homo Sapiens; identical to SEQ ID NO: 302226

SEQ ID NO: 722029 - RNA, 64 nt, Homo Sapiens; identical to SEQ ID NO: 302227

SEQ ID NO: 722030 - RNA, 64 nt, Homo Sapiens; identical to SEQ ID NO: 302228

SEQ ID NO: 722031 - RNA, 64 nt, Homo Sapiens; identical to SEQ ID NO: 302229

SEQ ID NO: 722032 - RNA, 64 nt, Homo Sapiens; identical to SEQ ID NO: 302230

SEQ ID NO: 722033 - RNA, 64 nt, Homo Sapiens; identical to SEQ ID NO: 302231

SEQ ID NO: 722034 - RNA, 64 nt, Homo Sapiens; identical to SEQ ID NO: 302232

SEQ ID NO: 722035 - RNA, 64 nt, Homo Sapiens; identical to SEQ ID NO: 302233

SEQ ID NO: 722036 - RNA, 64 nt, Homo Sapiens; identical to SEQ ID NO: 302234

SEQ ID NO: 722037 - RNA, 64 nt, Homo Sapiens; identical to SEQ ID NO: 302235

SEQ ID NO: 722038 - RNA, 64 nt, Homo Sapiens; identical to SEQ ID NO: 302236

SEQ ID NO: 722039 - RNA, 64 nt, Homo Sapiens; identical to SEQ ID NO: 302237

SEQ ID NO: 722040 - RNA, 64 nt, Homo Sapiens; identical to SEQ ID NO: 302238

SEQ ID NO: 722041 - RNA, 64 nt, Homo Sapiens; identical to SEQ ID NO: 302239

SEQ ID NO: 722042 - RNA, 64 nt, Homo Sapiens; identical to SEQ ID NO: 302240

SEQ ID NO: 722043 - RNA, 64 nt, Homo Sapiens; identical to SEQ ID NO: 302241

SEQ ID NO: 722044 - RNA, 64 nt, Homo Sapiens; identical to SEQ ID NO: 302242

SEQ ID NO: 722045 - RNA, 64 nt, Homo Sapiens; identical to SEQ ID NO: 302243

SEQ ID NO: 722046 - RNA, 64 nt, Homo Sapiens; identical to SEQ ID NO: 302244

SEQ ID NO: 722047 - RNA, 64 nt, Homo Sapiens; identical to SEQ ID NO: 302245

SEQ ID NO: 722048 - RNA, 64 nt, Homo Sapiens; identical to SEQ ID NO: 302246

SEQ ID NO: 722049 - RNA, 64 nt, Homo Sapiens; identical to SEQ ID NO: 302247

SEQ ID NO: 722050 - RNA, 64 nt, Homo Sapiens; identical to SEQ ID NO: 302248

SEQ ID NO: 722051 - RNA, 64 nt, Homo Sapiens; identical to SEQ ID NO: 302249

SEQ ID NO: 722052 - RNA, 64 nt, Homo Sapiens; identical to SEQ ID NO: 302250

SEQ ID NO: 722053 - RNA, 64 nt, Homo Sapiens; identical to SEQ ID NO: 302251

SEQ ID NO: 722054 - RNA, 64 nt, Homo Sapiens
auuuagcauuuaaguugggguauuuagagccuguaaucuaaaugcuggcucaaauuuauucccc

SEQ ID NO: 722055 - RNA, 64 nt, Homo Sapiens
gcauaaucauaagcaccucaacacuugaauacauaaucuaaaaauuauauaguaaagcugguag

SEQ ID NO: 722056 - RNA, 64 nt, Homo Sapiens
ugugugaauaauccuuuuaaaaugaauagucuuaaaucuaaauuaguguuuuaaaaagguuuuu

SEQ ID NO: 722057 - RNA, 64 nt, Homo Sapiens
ugaauaguccuuggucauucucaauuaaaaaaaaaaucuaaagauuuaaagcccaguggauauu

SEQ ID NO: 722058 - RNA, 64 nt, Homo Sapiens
agucauuaugagaguauugacuaaauauuuucacaaucuaaauauugucacaaucuaaauuucu

SEQ ID NO: 722059 - RNA, 64 nt, Homo Sapiens
ugacuaaauauuuucacaaucuaaauauugucacaaucuaaauuucuguaguagagagagccgu

SEQ ID NO: 722060 - RNA, 64 nt, Homo Sapiens
aaggaggaaacauuuaaauuauaaaggacugaauaaucuaaaaagcauauaaaaguuucacaca

SEQ ID NO: 722061 - RNA, 64 nt, Homo Sapiens
aauacaacagaauagccacccaauuucugucugaaaucuaaauuggauggauuugaccaucauu

SEQ ID NO: 722062 - RNA, 64 nt, Homo Sapiens
auaccacaaaaauacauccccuguccuucuugagaaucuaaaacauaaaucaaucuaugcuguu

SEQ ID NO: 722063 - RNA, 64 nt, Homo Sapiens
auacuauaacaaccguguuuauaaucuucgcugaaaucuaaaauuccaaauuuuaaguuucuaa

SEQ ID NO: 722064 - RNA, 64 nt, Homo Sapiens
aauuaucacuguguauacaguaaagagauguagaaaucuaaaugauaaugucauauguuaaaaa

SEQ ID NO: 722065 - RNA, 64 nt, Homo Sapiens
auaugugcauuuccucauuugaagagaaaaguuuaaucuaaaugagccauggucaucuggugau

SEQ ID NO: 722066 - RNA, 64 nt, Homo Sapiens
uuaaagaucuaaauacaaaggauauacagucuugaaucuaaaauaauuugcuaacuaacuauuu

SEQ ID NO: 722067 - RNA, 64 nt, Homo Sapiens
cuauuuugauucuucagagagaacuacuaauaaaaaucuaaaagguaugucuuggugugauaac

SEQ ID NO: 722068 - RNA, 64 nt, Homo Sapiens
uccaaaagaaaacagaaaacaauuccacgaggccaaucuaaagggaaaaaauccuacacuacuu

SEQ ID NO: 722069 - RNA, 64 nt, Homo Sapiens
uuuuuuuaaucaauuguagagaauagucauuuuuaaucuaaauuagagaauugugauacaaugg

SEQ ID NO: 722070 - RNA, 64 nt, Homo Sapiens
uaguuaagcacugugucaaacaguuuaaaaaaaaaaucuaaaaacuccuuccucccuuccuuua

SEQ ID NO: 722071 - RNA, 64 nt, Homo Sapiens
auauuauuguuugaauuuuuuaaaugacauuaaaaaucuaaagguguuaugauugccauuucaa

SEQ ID NO: 722072 - RNA, 64 nt, Homo Sapiens
uuuuuuaaaaaaaaucauaauggcuagaaauuuuaaucuaaacucacauccaccgaugcauuug

SEQ ID NO: 722073 - RNA, 64 nt, Homo Sapiens
aauaaguggucagacuccuuucuaaacaaugcaaaaucuaaaugugucaaauaucuucccuaua

SEQ ID NO: 722074 - RNA, 64 nt, Homo Sapiens
cuuuguauuuaaaaguuaaaaaggacaaaaaaaaaaucuaaagcauuuaaaaucuagugaaaua

SEQ ID NO: 722075 - RNA, 64 nt, Homo Sapiens
uaagaauuuugagagggugaggaggguuguucagaaucuaaauuacagauagaugauuguuucu

SEQ ID NO: 722076 - RNA, 64 nt, Homo Sapiens
uccaucccuuccucccauuggccucuccuugccaaaucuaaauaguuuauauagggauggcaga

SEQ ID NO: 722077 - RNA, 64 nt, Homo Sapiens
cgggaagacggaucccaccucccuuucuuagcagaaucuaaauuacagccagaccucuggcugc

SEQ ID NO: 722078 - RNA, 64 nt, Homo Sapiens
aaacaucgagaaacuaugggaaaaaaaauugcaaaaucuaaaauaaaaaaugcaaaaucuaaaa

SEQ ID NO: 722079 - RNA, 64 nt, Homo Sapiens
aaaaaaauugcaaaaucuaaaauaaaaaaugcaaaaucuaaaauaaaaaauggaaaggaaacuu

SEQ ID NO: 722080 - RNA, 64 nt, Homo Sapiens
aacuauccccuugaagcaaguucucuugaaaggaaaucuaaacagugcacccccauggcugcca

SEQ ID NO: 722081 - RNA, 64 nt, Homo Sapiens
uauaauauuauuuaaaaugcugagaaaaugaaaaaaucuaaauggugaaauauauacuaaugcc

SEQ ID NO: 722082 - RNA, 64 nt, Homo Sapiens
agcucuuaugggcuucuaauaucucccuuaaaaaaaucuaaagcauggugauucugaagcuuac

SEQ ID NO: 722083 - RNA, 64 nt, Homo Sapiens
ugcuccuacuuuaaguaccuuaccagcgaauuuaaaucuaaaaaaaaauguguaaucuaaaaua

SEQ ID NO: 722084 - RNA, 64 nt, Homo Sapiens
auaccagcgaauuuaaaucuaaaugaaaauguguaaucuaaaauuuuuauccuaggugauuuuu

SEQ ID NO: 722085 - RNA, 64 nt, Homo Sapiens; identical to SEQ ID NO: 291437

SEQ ID NO: 722086 - RNA, 64 nt, Homo Sapiens; identical to SEQ ID NO: 291438

SEQ ID NO: 722087 - RNA, 64 nt, Homo Sapiens; identical to SEQ ID NO: 291439

SEQ ID NO: 722088 - RNA, 64 nt, Homo Sapiens; identical to SEQ ID NO: 291440

SEQ ID NO: 722089 - RNA, 64 nt, Homo Sapiens; identical to SEQ ID NO: 291441

SEQ ID NO: 722090 - RNA, 64 nt, Homo Sapiens; identical to SEQ ID NO: 291442

SEQ ID NO: 722091 - RNA, 64 nt, Homo Sapiens; identical to SEQ ID NO: 291443

SEQ ID NO: 722092 - RNA, 64 nt, Homo Sapiens; identical to SEQ ID NO: 291444

SEQ ID NO: 722093 - RNA, 64 nt, Homo Sapiens; identical to SEQ ID NO: 291445

SEQ ID NO: 722094 - RNA, 64 nt, Homo Sapiens; identical to SEQ ID NO: 291446

SEQ ID NO: 722095 - RNA, 64 nt, Homo Sapiens; identical to SEQ ID NO: 291447

SEQ ID NO: 722096 - RNA, 64 nt, Homo Sapiens; identical to SEQ ID NO: 291448

SEQ ID NO: 722097 - RNA, 64 nt, Homo Sapiens; identical to SEQ ID NO: 291449

SEQ ID NO: 722098 - RNA, 64 nt, Homo Sapiens; identical to SEQ ID NO: 291450

SEQ ID NO: 722099 - RNA, 59 nt, Homo Sapiens
gccacaaguucuuguuuagagaccagagcaggauuaauaauuuauuuuaacauuuuagu

SEQ ID NO: 722100 - RNA, 59 nt, Homo Sapiens
uuaauuaauuaaaauuaacagaugugaugaggauuaaaugaaucaaaagacuuaauuug

SEQ ID NO: 722101 - RNA, 59 nt, Homo Sapiens
uacccaccgguggugugaugcucaguuuuaggauuaaaaaauguuuaaguaaacucugu

SEQ ID NO: 722102 - RNA, 59 nt, Homo Sapiens
uucuuaaucaccuccacacucuucauguuaggauuaauuuuuuuaacuggaugaaaaau

SEQ ID NO: 722103 - RNA, 59 nt, Homo Sapiens
cuccuaacaauggaauauggccugggaugaggauuaacuguucuuuauuuauaagugcu

SEQ ID NO: 722104 - RNA, 59 nt, Homo Sapiens
accccauacuaccucacagauguguugugaggauuaauaaaauuaugucuaugguauuu

SEQ ID NO: 722105 - RNA, 59 nt, Homo Sapiens
uaaacuuuacaauuuacaucauaugugaaaggauuaauuaauuuagaucaauauuuuga

SEQ ID NO: 722106 - RNA, 59 nt, Homo Sapiens
uuuacaauuuagaucaauaugaauguaaaaggauuaaacuaauauauuaguacauucua

SEQ ID NO: 722107 - RNA, 59 nt, Homo Sapiens
auuguuuuuaccacaugaugacgugacucaggauuaaauccugagcuacaguuucaaaa

SEQ ID NO: 722108 - RNA, 59 nt, Homo Sapiens
uguuaaacaugguaagacugagguucugcaggauuaaagucagauuaaggguacagaaa

SEQ ID NO: 722109 - RNA, 59 nt, Homo Sapiens
uggauuuaauccauuuuuaauuguagauuaggauuaaaauuuugcuguuuaugaucuau

SEQ ID NO: 722110 - RNA, 59 nt, Homo Sapiens
ugggcagacauuauguaaaagacuuuaaaaggauuaaucugugcuuuuuugauuuugcu

SEQ ID NO: 722111 - RNA, 59 nt, Homo Sapiens
gcaaaagauauuaaauaugcaacuaguuaaggauuaauauaacuagcccuuuaaggauu

SEQ ID NO: 722112 - RNA, 59 nt, Homo Sapiens
aguuaaggauuaauagcaaaagcccuuuaaggauuaacuggacuaguuaaggauuaacu

SEQ ID NO: 722113 - RNA, 59 nt, Homo Sapiens
agcccuuuaaggauuaacuagacuaguuaaggauuaacugauaaugcacaaaaugaagg

SEQ ID NO: 722114 - RNA, 64 nt, Homo Sapiens; identical to SEQ ID NO: 238553

SEQ ID NO: 722115 - RNA, 64 nt, Homo Sapiens; identical to SEQ ID NO: 238554

SEQ ID NO: 722116 - RNA, 64 nt, Homo Sapiens; identical to SEQ ID NO: 238555

SEQ ID NO: 722117 - RNA, 64 nt, Homo Sapiens; identical to SEQ ID NO: 238556

SEQ ID NO: 722118 - RNA, 61 nt, Homo Sapiens; identical to SEQ ID NO: 238557

SEQ ID NO: 722119 - RNA, 64 nt, Homo Sapiens; identical to SEQ ID NO: 238558

SEQ ID NO: 722120 - RNA, 64 nt, Homo Sapiens; identical to SEQ ID NO: 238559

SEQ ID NO: 722121 - RNA, 64 nt, Homo Sapiens; identical to SEQ ID NO: 238560

SEQ ID NO: 722122 - RNA, 64 nt, Homo Sapiens; identical to SEQ ID NO: 238561

SEQ ID NO: 722123 - RNA, 64 nt, Homo Sapiens; identical to SEQ ID NO: 238562

SEQ ID NO: 722124 - RNA, 64 nt, Homo Sapiens; identical to SEQ ID NO: 238563

SEQ ID NO: 722125 - RNA, 64 nt, Homo Sapiens; identical to SEQ ID NO: 238564

SEQ ID NO: 722126 - RNA, 64 nt, Homo Sapiens; identical to SEQ ID NO: 238565

SEQ ID NO: 722127 - RNA, 64 nt, Homo Sapiens; identical to SEQ ID NO: 238566

SEQ ID NO: 722128 - RNA, 64 nt, Homo Sapiens; identical to SEQ ID NO: 238567

SEQ ID NO: 722129 - RNA, 64 nt, Homo Sapiens; identical to SEQ ID NO: 238568

SEQ ID NO: 722130 - RNA, 64 nt, Homo Sapiens; identical to SEQ ID NO: 238569

SEQ ID NO: 722131 - RNA, 64 nt, Homo Sapiens; identical to SEQ ID NO: 238570

SEQ ID NO: 722132 - RNA, 64 nt, Homo Sapiens; identical to SEQ ID NO: 238571

SEQ ID NO: 722133 - RNA, 64 nt, Homo Sapiens; identical to SEQ ID NO: 238572

SEQ ID NO: 722134 - RNA, 64 nt, Homo Sapiens; identical to SEQ ID NO: 238573

SEQ ID NO: 722135 - RNA, 64 nt, Homo Sapiens; identical to SEQ ID NO: 238574

SEQ ID NO: 722136 - RNA, 64 nt, Homo Sapiens; identical to SEQ ID NO: 238575

SEQ ID NO: 722137 - RNA, 64 nt, Homo Sapiens; identical to SEQ ID NO: 238576

SEQ ID NO: 722138 - RNA, 64 nt, Homo Sapiens; identical to SEQ ID NO: 238577

SEQ ID NO: 722139 - RNA, 64 nt, Homo Sapiens; identical to SEQ ID NO: 238578

SEQ ID NO: 722140 - RNA, 64 nt, Homo Sapiens; identical to SEQ ID NO: 238579

SEQ ID NO: 722141 - RNA, 64 nt, Homo Sapiens; identical to SEQ ID NO: 238580

SEQ ID NO: 722142 - RNA, 64 nt, Homo Sapiens; identical to SEQ ID NO: 238581

SEQ ID NO: 722143 - RNA, 64 nt, Homo Sapiens; identical to SEQ ID NO: 238582

SEQ ID NO: 722144 - RNA, 64 nt, Homo Sapiens; identical to SEQ ID NO: 238583

SEQ ID NO: 722145 - RNA, 64 nt, Homo Sapiens; identical to SEQ ID NO: 238584

SEQ ID NO: 722146 - RNA, 64 nt, Homo Sapiens; identical to SEQ ID NO: 238585

SEQ ID NO: 722147 - RNA, 64 nt, Homo Sapiens; identical to SEQ ID NO: 238586

SEQ ID NO: 722148 - RNA, 64 nt, Homo Sapiens; identical to SEQ ID NO: 238587

SEQ ID NO: 722149 - RNA, 64 nt, Homo Sapiens; identical to SEQ ID NO: 238588

SEQ ID NO: 722150 - RNA, 64 nt, Homo Sapiens; identical to SEQ ID NO: 238589

SEQ ID NO: 722151 - RNA, 64 nt, Homo Sapiens; identical to SEQ ID NO: 238590

SEQ ID NO: 722152 - RNA, 64 nt, Homo Sapiens; identical to SEQ ID NO: 238591

SEQ ID NO: 722153 - RNA, 64 nt, Homo Sapiens; identical to SEQ ID NO: 238592

SEQ ID NO: 722154 - RNA, 64 nt, Homo Sapiens; identical to SEQ ID NO: 238593

SEQ ID NO: 722155 - RNA, 51 nt, Homo Sapiens; identical to SEQ ID NO: 238594

SEQ ID NO: 722156 - RNA, 64 nt, Homo Sapiens; identical to SEQ ID NO: 238595

SEQ ID NO: 722157 - RNA, 64 nt, Homo Sapiens; identical to SEQ ID NO: 238596

SEQ ID NO: 722158 - RNA, 64 nt, Homo Sapiens; identical to SEQ ID NO: 238597

SEQ ID NO: 722159 - RNA, 64 nt, Homo Sapiens; identical to SEQ ID NO: 238598

SEQ ID NO: 722160 - RNA, 64 nt, Homo Sapiens; identical to SEQ ID NO: 238599

SEQ ID NO: 722161 - RNA, 64 nt, Homo Sapiens; identical to SEQ ID NO: 238600

SEQ ID NO: 722162 - RNA, 64 nt, Homo Sapiens; identical to SEQ ID NO: 238601

SEQ ID NO: 722163 - RNA, 64 nt, Homo Sapiens; identical to SEQ ID NO: 238602

SEQ ID NO: 722164 - RNA, 64 nt, Homo Sapiens; identical to SEQ ID NO: 238603

SEQ ID NO: 722165 - RNA, 64 nt, Homo Sapiens; identical to SEQ ID NO: 238604

SEQ ID NO: 722166 - RNA, 64 nt, Homo Sapiens; identical to SEQ ID NO: 238605

SEQ ID NO: 722167 - RNA, 64 nt, Homo Sapiens; identical to SEQ ID NO: 238606

SEQ ID NO: 722168 - RNA, 64 nt, Homo Sapiens; identical to SEQ ID NO: 238607

SEQ ID NO: 722169 - RNA, 64 nt, Homo Sapiens; identical to SEQ ID NO: 238608

SEQ ID NO: 722170 - RNA, 64 nt, Homo Sapiens; identical to SEQ ID NO: 238609

SEQ ID NO: 722171 - RNA, 64 nt, Homo Sapiens; identical to SEQ ID NO: 238610

SEQ ID NO: 722172 - RNA, 64 nt, Homo Sapiens; identical to SEQ ID NO: 238611

SEQ ID NO: 722173 - RNA, 64 nt, Homo Sapiens; identical to SEQ ID NO: 238612

SEQ ID NO: 722174 - RNA, 64 nt, Homo Sapiens; identical to SEQ ID NO: 238613

SEQ ID NO: 722175 - RNA, 64 nt, Homo Sapiens; identical to SEQ ID NO: 238614

SEQ ID NO: 722176 - RNA, 64 nt, Homo Sapiens; identical to SEQ ID NO: 238615

SEQ ID NO: 722177 - RNA, 64 nt, Homo Sapiens; identical to SEQ ID NO: 238616

SEQ ID NO: 722178 - RNA, 64 nt, Homo Sapiens; identical to SEQ ID NO: 238617

SEQ ID NO: 722179 - RNA, 64 nt, Homo Sapiens; identical to SEQ ID NO: 238618

SEQ ID NO: 722180 - RNA, 64 nt, Homo Sapiens; identical to SEQ ID NO: 238619

SEQ ID NO: 722181 - RNA, 64 nt, Homo Sapiens; identical to SEQ ID NO: 238620

SEQ ID NO: 722182 - RNA, 64 nt, Homo Sapiens; identical to SEQ ID NO: 238621

SEQ ID NO: 722183 - RNA, 64 nt, Homo Sapiens; identical to SEQ ID NO: 238622

SEQ ID NO: 722184 - RNA, 64 nt, Homo Sapiens; identical to SEQ ID NO: 238623

SEQ ID NO: 722185 - RNA, 64 nt, Homo Sapiens; identical to SEQ ID NO: 238624

SEQ ID NO: 722186 - RNA, 64 nt, Homo Sapiens; identical to SEQ ID NO: 238625

SEQ ID NO: 722187 - RNA, 64 nt, Homo Sapiens; identical to SEQ ID NO: 238626

SEQ ID NO: 722188 - RNA, 64 nt, Homo Sapiens; identical to SEQ ID NO: 238627

SEQ ID NO: 722189 - RNA, 64 nt, Homo Sapiens; identical to SEQ ID NO: 238628

SEQ ID NO: 722190 - RNA, 64 nt, Homo Sapiens; identical to SEQ ID NO: 238629

SEQ ID NO: 722191 - RNA, 64 nt, Homo Sapiens; identical to SEQ ID NO: 493291

SEQ ID NO: 722192 - RNA, 64 nt, Homo Sapiens; identical to SEQ ID NO: 493292

SEQ ID NO: 722193 - RNA, 64 nt, Homo Sapiens; identical to SEQ ID NO: 493293

SEQ ID NO: 722194 - RNA, 64 nt, Homo Sapiens; identical to SEQ ID NO: 493294

SEQ ID NO: 722195 - RNA, 64 nt, Homo Sapiens; identical to SEQ ID NO: 493295

SEQ ID NO: 722196 - RNA, 64 nt, Homo Sapiens; identical to SEQ ID NO: 493296

SEQ ID NO: 722197 - RNA, 64 nt, Homo Sapiens; identical to SEQ ID NO: 493297

SEQ ID NO: 722198 - RNA, 64 nt, Homo Sapiens; identical to SEQ ID NO: 493298

SEQ ID NO: 722199 - RNA, 64 nt, Homo Sapiens; identical to SEQ ID NO: 493299

SEQ ID NO: 722200 - RNA, 64 nt, Homo Sapiens; identical to SEQ ID NO: 493300

SEQ ID NO: 722201 - RNA, 64 nt, Homo Sapiens; identical to SEQ ID NO: 493301

SEQ ID NO: 722202 - RNA, 64 nt, Homo Sapiens; identical to SEQ ID NO: 493302

SEQ ID NO: 722203 - RNA, 64 nt, Homo Sapiens; identical to SEQ ID NO: 493303

SEQ ID NO: 722204 - RNA, 64 nt, Homo Sapiens; identical to SEQ ID NO: 493304

SEQ ID NO: 722205 - RNA, 64 nt, Homo Sapiens; identical to SEQ ID NO: 493305

SEQ ID NO: 722206 - RNA, 64 nt, Homo Sapiens; identical to SEQ ID NO: 493306

SEQ ID NO: 722207 - RNA, 64 nt, Homo Sapiens; identical to SEQ ID NO: 493307

SEQ ID NO: 722208 - RNA, 64 nt, Homo Sapiens; identical to SEQ ID NO: 493308

SEQ ID NO: 722209 - RNA, 64 nt, Homo Sapiens; identical to SEQ ID NO: 493309

SEQ ID NO: 722210 - RNA, 64 nt, Homo Sapiens; identical to SEQ ID NO: 493310

SEQ ID NO: 722211 - RNA, 64 nt, Homo Sapiens; identical to SEQ ID NO: 493311

SEQ ID NO: 722212 - RNA, 64 nt, Homo Sapiens; identical to SEQ ID NO: 493312

SEQ ID NO: 722213 - RNA, 64 nt, Homo Sapiens; identical to SEQ ID NO: 493313

SEQ ID NO: 722214 - RNA, 64 nt, Homo Sapiens; identical to SEQ ID NO: 493314

SEQ ID NO: 722215 - RNA, 64 nt, Homo Sapiens; identical to SEQ ID NO: 493315

SEQ ID NO: 722216 - RNA, 64 nt, Homo Sapiens; identical to SEQ ID NO: 493316

SEQ ID NO: 722217 - RNA, 64 nt, Homo Sapiens; identical to SEQ ID NO: 493317

SEQ ID NO: 722218 - RNA, 64 nt, Homo Sapiens; identical to SEQ ID NO: 493318

SEQ ID NO: 722219 - RNA, 64 nt, Homo Sapiens; identical to SEQ ID NO: 493319

SEQ ID NO: 722220 - RNA, 64 nt, Homo Sapiens; identical to SEQ ID NO: 493320

SEQ ID NO: 722221 - RNA, 64 nt, Homo Sapiens; identical to SEQ ID NO: 493321

SEQ ID NO: 722222 - RNA, 64 nt, Homo Sapiens; identical to SEQ ID NO: 493322

SEQ ID NO: 722223 - RNA, 64 nt, Homo Sapiens; identical to SEQ ID NO: 493323

SEQ ID NO: 722224 - RNA, 64 nt, Homo Sapiens; identical to SEQ ID NO: 493324

SEQ ID NO: 722225 - RNA, 64 nt, Homo Sapiens; identical to SEQ ID NO: 493325

SEQ ID NO: 722226 - RNA, 64 nt, Homo Sapiens; identical to SEQ ID NO: 493326

SEQ ID NO: 722227 - RNA, 64 nt, Homo Sapiens; identical to SEQ ID NO: 493327

SEQ ID NO: 722228 - RNA, 64 nt, Homo Sapiens; identical to SEQ ID NO: 493328

SEQ ID NO: 722229 - RNA, 64 nt, Homo Sapiens; identical to SEQ ID NO: 493329

SEQ ID NO: 722230 - RNA, 64 nt, Homo Sapiens; identical to SEQ ID NO: 493330

SEQ ID NO: 722231 - RNA, 64 nt, Homo Sapiens; identical to SEQ ID NO: 493331

SEQ ID NO: 722232 - RNA, 64 nt, Homo Sapiens; identical to SEQ ID NO: 493332

SEQ ID NO: 722233 - RNA, 64 nt, Homo Sapiens; identical to SEQ ID NO: 493333

SEQ ID NO: 722234 - RNA, 64 nt, Homo Sapiens; identical to SEQ ID NO: 493334

SEQ ID NO: 722235 - RNA, 64 nt, Homo Sapiens; identical to SEQ ID NO: 493335

SEQ ID NO: 722236 - RNA, 64 nt, Homo Sapiens; identical to SEQ ID NO: 493336

SEQ ID NO: 722237 - RNA, 64 nt, Homo Sapiens; identical to SEQ ID NO: 493337

SEQ ID NO: 722238 - RNA, 64 nt, Homo Sapiens; identical to SEQ ID NO: 493338

SEQ ID NO: 722239 - RNA, 64 nt, Homo Sapiens; identical to SEQ ID NO: 493339

SEQ ID NO: 722240 - RNA, 64 nt, Homo Sapiens; identical to SEQ ID NO: 493340

SEQ ID NO: 722241 - RNA, 64 nt, Homo Sapiens; identical to SEQ ID NO: 493341

SEQ ID NO: 722242 - RNA, 64 nt, Homo Sapiens; identical to SEQ ID NO: 128804

SEQ ID NO: 722243 - RNA, 64 nt, Homo Sapiens; identical to SEQ ID NO: 128805

SEQ ID NO: 722244 - RNA, 64 nt, Homo Sapiens; identical to SEQ ID NO: 128806

SEQ ID NO: 722245 - RNA, 64 nt, Homo Sapiens; identical to SEQ ID NO: 128807

SEQ ID NO: 722246 - RNA, 64 nt, Homo Sapiens; identical to SEQ ID NO: 128808

SEQ ID NO: 722247 - RNA, 64 nt, Homo Sapiens; identical to SEQ ID NO: 128809

SEQ ID NO: 722248 - RNA, 64 nt, Homo Sapiens; identical to SEQ ID NO: 128810

SEQ ID NO: 722249 - RNA, 64 nt, Homo Sapiens; identical to SEQ ID NO: 128811

SEQ ID NO: 722250 - RNA, 64 nt, Homo Sapiens; identical to SEQ ID NO: 128812

SEQ ID NO: 722251 - RNA, 64 nt, Homo Sapiens; identical to SEQ ID NO: 128813

SEQ ID NO: 722252 - RNA, 64 nt, Homo Sapiens; identical to SEQ ID NO: 128814

SEQ ID NO: 722253 - RNA, 64 nt, Homo Sapiens; identical to SEQ ID NO: 128815

SEQ ID NO: 722254 - RNA, 64 nt, Homo Sapiens; identical to SEQ ID NO: 128816

SEQ ID NO: 722255 - RNA, 64 nt, Homo Sapiens; identical to SEQ ID NO: 128817

SEQ ID NO: 722256 - RNA, 64 nt, Homo Sapiens; identical to SEQ ID NO: 128818

SEQ ID NO: 722257 - RNA, 64 nt, Homo Sapiens; identical to SEQ ID NO: 128819

SEQ ID NO: 722258 - RNA, 64 nt, Homo Sapiens; identical to SEQ ID NO: 128820

SEQ ID NO: 722259 - RNA, 64 nt, Homo Sapiens; identical to SEQ ID NO: 128821

SEQ ID NO: 722260 - RNA, 64 nt, Homo Sapiens; identical to SEQ ID NO: 128822

SEQ ID NO: 722261 - RNA, 64 nt, Homo Sapiens; identical to SEQ ID NO: 128823

SEQ ID NO: 722262 - RNA, 64 nt, Homo Sapiens; identical to SEQ ID NO: 128824

SEQ ID NO: 722263 - RNA, 64 nt, Homo Sapiens; identical to SEQ ID NO: 128825

SEQ ID NO: 722264 - RNA, 64 nt, Homo Sapiens; identical to SEQ ID NO: 128826

SEQ ID NO: 722265 - RNA, 64 nt, Homo Sapiens; identical to SEQ ID NO: 128827

SEQ ID NO: 722266 - RNA, 64 nt, Homo Sapiens; identical to SEQ ID NO: 287378

SEQ ID NO: 722267 - RNA, 64 nt, Homo Sapiens; identical to SEQ ID NO: 287379

SEQ ID NO: 722268 - RNA, 64 nt, Homo Sapiens; identical to SEQ ID NO: 287380

SEQ ID NO: 722269 - RNA, 64 nt, Homo Sapiens; identical to SEQ ID NO: 287381

SEQ ID NO: 722270 - RNA, 64 nt, Homo Sapiens; identical to SEQ ID NO: 287382

SEQ ID NO: 722271 - RNA, 64 nt, Homo Sapiens; identical to SEQ ID NO: 287383

SEQ ID NO: 722272 - RNA, 64 nt, Homo Sapiens; identical to SEQ ID NO: 287384

SEQ ID NO: 722273 - RNA, 64 nt, Homo Sapiens; identical to SEQ ID NO: 287385

SEQ ID NO: 722274 - RNA, 64 nt, Homo Sapiens; identical to SEQ ID NO: 287386

SEQ ID NO: 722275 - RNA, 64 nt, Homo Sapiens; identical to SEQ ID NO: 287387

SEQ ID NO: 722276 - RNA, 64 nt, Homo Sapiens
ccaguucauggaggcaaaaaacaaguuucuuguuauccugaaacuuucuaugcucaguggaaag

SEQ ID NO: 722277 - RNA, 64 nt, Homo Sapiens
aucccugccuguguccaugucagacuuugagcugauccugaauaauaaagccuuuuaccuuauc

SEQ ID NO: 722278 - RNA, 64 nt, Homo Sapiens
gaggucaugaggaggcccccgcuuugaguagauaauccugaauuuguauuuccuuuuguuuaau

SEQ ID NO: 722279 - RNA, 64 nt, Homo Sapiens
uguauuuccuuuuguuuaauaaagagcagccuucauccugaaaagguuucuucagcagggcuua

SEQ ID NO: 722280 - RNA, 64 nt, Homo Sapiens
agcugauguguaugggagccuaaacaaguguaguauccugaacuucucccauuaauugcuauuc

SEQ ID NO: 722281 - RNA, 64 nt, Homo Sapiens
ugaauuauguauggcaaccugguuuagcacuggcauccugaacaguuaagagucacugggaaau

SEQ ID NO: 722282 - RNA, 57 nt, Homo Sapiens
cccagucuucgaccugcugauccuuggauccugaaucugugcaaacaguaacgugug

SEQ ID NO: 722283 - RNA, 64 nt, Homo Sapiens
uguuaccauuuuaacgcugccuaauuuugccaaaauccugaacuuucucccucaucggcccggc

SEQ ID NO: 722284 - RNA, 51 nt, Homo Sapiens
cgcaucaagcugaugagugagauccugaacggcaucaaggugcugaagcug

SEQ ID NO: 722285 - RNA, 64 nt, Homo Sapiens
acaguccuucuuugacaccacaccaucaggccgcauccugaacugcuucuccaaggacaucuau

SEQ ID NO: 722286 - RNA, 64 nt, Homo Sapiens
cccauucuccgacuuacaacagaauccucagagcauccugaagccuggcgcccucuaguggaga

SEQ ID NO: 722287 - RNA, 64 nt, Homo Sapiens
agaacaugauccucaugacaggguuaaucccuauauccugaagagcagcgcggcagagucaugg

SEQ ID NO: 722288 - RNA, 62 nt, Homo Sapiens
gagcugagagggagcucaacuggccucugcugggcccugaaggcccagccccuugugagucc

SEQ ID NO: 722289 - RNA, 62 nt, Homo Sapiens
cacacagcccagccccuugucugcaccccauaggcccugaggaugucugugcagugucaggg

SEQ ID NO: 722290 - RNA, 62 nt, Homo Sapiens
cccucagggcucauuccuggggcccugaggguggcccugaccaaagcaaacaguccuccuga

SEQ ID NO: 722291 - RNA, 62 nt, Homo Sapiens
guggcccugacccccucaggcaguccuccugaggcccugaggauguuaucugcuaaagcaaa

SEQ ID NO: 722292 - RNA, 62 nt, Homo Sapiens
ugcagccuguccugggcugguggcucccggagggcccugagcugagggcauugcuuacacgg

SEQ ID NO: 722293 - RNA, 62 nt, Homo Sapiens
gagggcauugcuuacacggaugccuuccccugggcccugacauuggagccugggcauccuca

SEQ ID NO: 722294 - RNA, 62 nt, Homo Sapiens
caauuguuuuugacugaguaacugauccagcuggcccugaacggagguucauuuuccuuuaa

SEQ ID NO: 722295 - RNA, 62 nt, Homo Sapiens
ccaggcgugaguauggggaaccccagugcacuggcccugacuuccuguuuggccccuguuca

SEQ ID NO: 722296 - RNA, 62 nt, Homo Sapiens
aagucaggcuccuggcucugucccauucccuaggcccugagcagaagcuggaucacucuugg

SEQ ID NO: 722297 - RNA, 62 nt, Homo Sapiens
aauaaacccucagacccagggacaucugccugggcccugaccuggggacaacaggggcacau

SEQ ID NO: 722298 - RNA, 62 nt, Homo Sapiens
acgagaagagccuccgcccgacaccagaaaccggcccugagcgagccaagcgcaucgggagc

SEQ ID NO: 722299 - RNA, 62 nt, Homo Sapiens
cggucuguggggacgagggaagaggcucgccaggcccugaucucacaccgcacggcaggcac

SEQ ID NO: 722300 - RNA, 62 nt, Homo Sapiens
uggccugucccuagggcucuugggaaaggcagggcccugaaacagugguggagguggguguu

SEQ ID NO: 722301 - RNA, 62 nt, Homo Sapiens
ggccuuccuccucucaaaccacaugagaguagggcccugacacaggccucccaagcugaugg

SEQ ID NO: 722302 - RNA, 62 nt, Homo Sapiens
ucugcugcaguggccgcccugguggagauggaggcccugacccgggcucggggccccaccgg

SEQ ID NO: 722303 - RNA, 62 nt, Homo Sapiens
cacauccaggugcagcuggagugccaccacguggcccugagcaccagccagcugaucccucu

SEQ ID NO: 722304 - RNA, 62 nt, Homo Sapiens
ggccucugcagaggggaccucagccugucacuggcccugaagacuggccccacuucuggucu

SEQ ID NO: 722305 - RNA, 62 nt, Homo Sapiens
gaccagaacagggcagaguagguccccuccauggcccugaauccuccucugcuccagggcug

SEQ ID NO: 722306 - RNA, 62 nt, Homo Sapiens
cggaggcugugcuccgccaucacccaggggaaggcccugaggcugagaagaaguggcugcca

SEQ ID NO: 722307 - RNA, 62 nt, Homo Sapiens
ccucuggcuuucccaggagacaccagacgucaggcccugacuugcucaccagcccugcagcc

SEQ ID NO: 722308 - RNA, 62 nt, Homo Sapiens
cccuucuccagggccagguagaacgaggcaguggcccugagccagcuggccuuccuggguug

SEQ ID NO: 722309 - RNA, 54 nt, Homo Sapiens; identical to SEQ ID NO: 53521

SEQ ID NO: 722310 - RNA, 62 nt, Homo Sapiens
ccuccaccugccccagugcccagaccaaccaaggcccugacagcccugccuucugcccucug

SEQ ID NO: 722311 - RNA, 62 nt, Homo Sapiens
uucccuaccuggguggccugcuccccugccugggcccugacuucagcucccuguagugaagu

SEQ ID NO: 722312 - RNA, 62 nt, Homo Sapiens
gaggagaaccggcagcugcuggcugaaguucaggcccugagccgggagaacagggagcuccu

SEQ ID NO: 722313 - RNA, 62 nt, Homo Sapiens
ugcaggaacacgaaacagaugccaaccgagagggcccugagguacaggaaccggagaaacgu

SEQ ID NO: 722314 - RNA, 62 nt, Homo Sapiens
ccccaaggggaguccuuggacaaggaggccugggcccugagauccuccacggucagcgccgg

SEQ ID NO: 722315 - RNA, 62 nt, Homo Sapiens
cacugccuccugcaccuucacccagccaccaaggcccugacgcagcgggcuucuccaccuac

SEQ ID NO: 722316 - RNA, 62 nt, Homo Sapiens
uaagcugucuggccucucugucaugcguuucuggcccugacaggggucaggacaugucgggg

SEQ ID NO: 722317 - RNA, 62 nt, Homo Sapiens
gcauuguuccagcacggaggugaugugucacgggcccugacugagcuacagcgccaacgccu

SEQ ID NO: 722318 - RNA, 62 nt, Homo Sapiens
uagagcccuuccgccagcgccucugggacaguggcccugagcccaccccuuccugggauggg

SEQ ID NO: 722319 - RNA, 62 nt, Homo Sapiens
uguggcugggcccugccccacaaccggaugcaggcccugacuuccugugagugcaccaucug

SEQ ID NO: 722320 - RNA, 62 nt, Homo Sapiens
aaucccgggcgccggcaaggugagaccuuccaggcccugaggugcaacccagggcagggggc

SEQ ID NO: 722321 - RNA, 62 nt, Homo Sapiens
ccgcgccccacauuucugucggcgggcgccccggcccugaaccgcccgcgccccuccccacc

SEQ ID NO: 722322 - RNA, 62 nt, Homo Sapiens
ggcugcagccugcuuugggaggcccggcccacggcccugagccacuucugacuggugaucag

SEQ ID NO: 722323 - RNA, 62 nt, Homo Sapiens
gguggaccaccagccugggcggcgggcuugaaggcccugauggggcucugcucugagaguag

SEQ ID NO: 722324 - RNA, 62 nt, Homo Sapiens
acccaaagccucuuuuugccucccggaaucaaggcccugagggcagcaggaugguggccugg

SEQ ID NO: 722325 - RNA, 62 nt, Homo Sapiens
ggcgcucuugaccccugauuccagugaggacuggcccugaggaguccuugcagaccugcugc

SEQ ID NO: 722326 - RNA, 62 nt, Homo Sapiens
uggcagcaggggucagggaagagcggguggagggcccugaggccgcuaaaaugggcaaggga

SEQ ID NO: 722327 - RNA, 62 nt, Homo Sapiens
augccccgccuuaguuuuccggcaccugagguggcccugaaggagguggaggcccggggaga

SEQ ID NO: 722328 - RNA, 62 nt, Homo Sapiens
ucaccugacuugaggugaauuuuggagugaagggcccugaggucagcucccaggucggucgu

SEQ ID NO: 722329 - RNA, 62 nt, Homo Sapiens
gcucuccuuuggguguaugcagguguguggggggcccugaguggcaaguugcuuagcuaaca

SEQ ID NO: 722330 - RNA, 62 nt, Homo Sapiens
ggcuuuauuuaccguggugguucagagucccaggcccugaccucuaaagacuuuucauaaca

SEQ ID NO: 722331 - RNA, 62 nt, Homo Sapiens
gcacacccaccucuccgggggacuugacaaggggcccugaggccaagggaggucacuccucc

SEQ ID NO: 722332 - RNA, 64 nt, Homo Sapiens; identical to SEQ ID NO: 189518

SEQ ID NO: 722333 - RNA, 64 nt, Homo Sapiens; identical to SEQ ID NO: 189519

SEQ ID NO: 722334 - RNA, 64 nt, Homo Sapiens; identical to SEQ ID NO: 189520

SEQ ID NO: 722335 - RNA, 64 nt, Homo Sapiens; identical to SEQ ID NO: 189521

SEQ ID NO: 722336 - RNA, 64 nt, Homo Sapiens; identical to SEQ ID NO: 189522

SEQ ID NO: 722337 - RNA, 64 nt, Homo Sapiens; identical to SEQ ID NO: 189523

SEQ ID NO: 722338 - RNA, 64 nt, Homo Sapiens; identical to SEQ ID NO: 189524

SEQ ID NO: 722339 - RNA, 64 nt, Homo Sapiens; identical to SEQ ID NO: 189525

SEQ ID NO: 722340 - RNA, 64 nt, Homo Sapiens; identical to SEQ ID NO: 189526

SEQ ID NO: 722341 - RNA, 64 nt, Homo Sapiens; identical to SEQ ID NO: 189527

SEQ ID NO: 722342 - RNA, 64 nt, Homo Sapiens; identical to SEQ ID NO: 189528

SEQ ID NO: 722343 - RNA, 64 nt, Homo Sapiens; identical to SEQ ID NO: 189529

SEQ ID NO: 722344 - RNA, 64 nt, Homo Sapiens; identical to SEQ ID NO: 189530

SEQ ID NO: 722345 - RNA, 64 nt, Homo Sapiens; identical to SEQ ID NO: 720482

SEQ ID NO: 722346 - RNA, 64 nt, Homo Sapiens; identical to SEQ ID NO: 720483

SEQ ID NO: 722347 - RNA, 64 nt, Homo Sapiens; identical to SEQ ID NO: 328787

SEQ ID NO: 722348 - RNA, 64 nt, Homo Sapiens; identical to SEQ ID NO: 328788

SEQ ID NO: 722349 - RNA, 64 nt, Homo Sapiens; identical to SEQ ID NO: 328789

SEQ ID NO: 722350 - RNA, 64 nt, Homo Sapiens; identical to SEQ ID NO: 328790

SEQ ID NO: 722351 - RNA, 64 nt, Homo Sapiens; identical to SEQ ID NO: 328791

SEQ ID NO: 722352 - RNA, 64 nt, Homo Sapiens; identical to SEQ ID NO: 328792

SEQ ID NO: 722353 - RNA, 64 nt, Homo Sapiens; identical to SEQ ID NO: 328793

SEQ ID NO: 722354 - RNA, 64 nt, Homo Sapiens; identical to SEQ ID NO: 328794

SEQ ID NO: 722355 - RNA, 64 nt, Homo Sapiens; identical to SEQ ID NO: 328795

SEQ ID NO: 722356 - RNA, 64 nt, Homo Sapiens; identical to SEQ ID NO: 328796

SEQ ID NO: 722357 - RNA, 64 nt, Homo Sapiens; identical to SEQ ID NO: 328797

SEQ ID NO: 722358 - RNA, 64 nt, Homo Sapiens; identical to SEQ ID NO: 328798

SEQ ID NO: 722359 - RNA, 64 nt, Homo Sapiens; identical to SEQ ID NO: 328799

SEQ ID NO: 722360 - RNA, 64 nt, Homo Sapiens; identical to SEQ ID NO: 328800

SEQ ID NO: 722361 - RNA, 64 nt, Homo Sapiens; identical to SEQ ID NO: 328801

SEQ ID NO: 722362 - RNA, 64 nt, Homo Sapiens; identical to SEQ ID NO: 328802

SEQ ID NO: 722363 - RNA, 64 nt, Homo Sapiens; identical to SEQ ID NO: 328803

SEQ ID NO: 722364 - RNA, 64 nt, Homo Sapiens; identical to SEQ ID NO: 328804

SEQ ID NO: 722365 - RNA, 64 nt, Homo Sapiens
ucuaagaaauuuuucaguucacuagacuaaaauguuuuacaacaaaaagccuccaguuagccuc

SEQ ID NO: 722366 - RNA, 64 nt, Homo Sapiens
caacccauaaucauuaaguacuuaacaaagaauauuuuacaagugauaguauuucaacaaugug

SEQ ID NO: 722367 - RNA, 64 nt, Homo Sapiens
aaggaaacugagguccagaagaaaucauuucuguuuuuacaaacuacaauucugagugaucuua

SEQ ID NO: 722368 - RNA, 64 nt, Homo Sapiens
cugagugaucuuagaaaucaaaguguucauagaauuuuacaauugcaagcucaauagacuucau

SEQ ID NO: 722369 - RNA, 64 nt, Homo Sapiens
gauguauccuuccaauuugggaauugguggcagauuuuacaaaaggugcuuauucucaaagcag

SEQ ID NO: 722370 - RNA, 64 nt, Homo Sapiens
ggugcuuauucucaaagcagaauguuaguagaaauuuuacaauacaugugcugugaccauuuau

SEQ ID NO: 722371 - RNA, 64 nt, Homo Sapiens
cuuuuauuuccccacaagaugaauaaauguaagauuuuacaaauuuuuacuucauuauuuuuag

SEQ ID NO: 722372 - RNA, 64 nt, Homo Sapiens
uugagcucaucguaaauguccuuuaaacuuacuguuuuacaaaauaaaugugucauauuauauu

SEQ ID NO: 722373 - RNA, 64 nt, Homo Sapiens
uuaaagagaauuuacuucuaaaagccacaggugcuuuuacaaagcaaacugcauugaauuuaaa

SEQ ID NO: 722374 - RNA, 64 nt, Homo Sapiens
uuguuuucauuuguauugcaaaaguuagaagucauuuuacaaauuaaaaaaacauuuuuuucuu

SEQ ID NO: 722375 - RNA, 64 nt, Homo Sapiens
acgcuuugaaaccuuuagagggaagauccucauuuuuuacaauuuuguuccuuuucaucauaga

SEQ ID NO: 722376 - RNA, 64 nt, Homo Sapiens
ccaaaaauaauuguccuuuuuucuuucuuucuuuuuuuacaauaaggcucuugaaaauugucau

SEQ ID NO: 722377 - RNA, 64 nt, Homo Sapiens
auggaccuuuggggaagggggaguuuuuaguuuguuuuacaaauuuuuccugcaaaaguggaau

SEQ ID NO: 722378 - RNA, 64 nt, Homo Sapiens
cagcaaguuucaccuuggguuuguauuuuaaauguuuuacaagaauuguccaugugcuucccua

SEQ ID NO: 722379 - RNA, 64 nt, Homo Sapiens
ugaugacccccaaccaaguggcucccacacccuguuuuacaaaaaagaaaagaccaguccauga

SEQ ID NO: 722380 - RNA, 64 nt, Homo Sapiens
gcaaaguucccuacuuccugugacuucagcucuguuuuacaauaaaaucuugaaaaugccuaua

SEQ ID NO: 722381 - RNA, 64 nt, Homo Sapiens
uuucaaaaacuuaaaaaucaauaguuuuuuuuuuuuuuacaaagguuuuguuuggcucagacau

SEQ ID NO: 722382 - RNA, 64 nt, Homo Sapiens
gacauugcaaacucucauguaggauagagaacaguuuuacaauagacccuggauggcuacuaag

SEQ ID NO: 722383 - RNA, 64 nt, Homo Sapiens
gagaguugugacaaguacagcuauauuuucgccauuuuacaaugaaaauccuaucgugaacaac

SEQ ID NO: 722384 - RNA, 64 nt, Homo Sapiens
uucuuuguucuugguacuuagcaaacacagcauuuuuuacaacuuaguuuuuaguccuguaaau

SEQ ID NO: 722385 - RNA, 64 nt, Homo Sapiens
aacuagugcaugauucaccaaaaguuuacaugaauuuuacaacaaucugacauuuguauacaua

SEQ ID NO: 722386 - RNA, 64 nt, Homo Sapiens
cuauuuacuguaguguauuguuaauguuaauucuuuuuacaaaauuuuugcacaaaccaaaagu

SEQ ID NO: 722387 - RNA, 64 nt, Homo Sapiens
uuuguucuagugcauuuccacauaucugccauauuuuuacaaaauccauucuauuuuuaacuuc

SEQ ID NO: 722388 - RNA, 64 nt, Homo Sapiens
aauuaucacaauguacuauaaugccgucucauauuuuuacaaaucugugugucuuuuuuuacuu

SEQ ID NO: 722389 - RNA, 64 nt, Homo Sapiens
agaugaaaaaaguuaacauuuuugcacauauauuuuuuacaaacggaauaauuagaaacacacu

SEQ ID NO: 722390 - RNA, 64 nt, Homo Sapiens
uuuagaauuuugugaaacagacuuguauauucuauuuuacaacuacaaaugccuccaaaguauu

SEQ ID NO: 722391 - RNA, 64 nt, Homo Sapiens
gaauaugcaucuuaaaauggcaaguuuuccauauuuuuacaacucacuggugguuuuccgcauu

SEQ ID NO: 722392 - RNA, 64 nt, Homo Sapiens
aggugcuuuagcuaucaguaguaccaaaggaucuuuuuacaaggcuuccugugguauugacucu

SEQ ID NO: 722393 - RNA, 64 nt, Homo Sapiens
guuaugcuaagaggaaaucacugaggccauaucuuuuuacaaucugaaaaaaaaguaguaaaaa

SEQ ID NO: 722394 - RNA, 64 nt, Homo Sapiens
uaaaugaaauguuuuguagcuagaauaaaaucauuuuuacaaguacagcauucuuggaaagaau

SEQ ID NO: 722395 - RNA, 64 nt, Homo Sapiens
aaaaaaaaaagcccuauuucgcacuaacauuuuauuuuacaaguauuuuaaucuuauauuuugg

SEQ ID NO: 722396 - RNA, 64 nt, Homo Sapiens
ucuggaugaaucuugaaacacauuuagcugccaguuuuacaaaccuuuaauauaucagugcucc

SEQ ID NO: 722397 - RNA, 64 nt, Homo Sapiens
ccuuuucacaaagggaauugccuaacauguggacuuuuacaauaaaaaugcugcauucuaaucc

SEQ ID NO: 722398 - RNA, 64 nt, Homo Sapiens
ccacagacaaccucugaaagugccaauagguggauuuuacaaaacuuuuaauugauuagaauuc

SEQ ID NO: 722399 - RNA, 64 nt, Homo Sapiens
ggcuuuacauuuccuaaaauauaaaagaauauccuuuuacaaguauauacugcuuuaaaaaaga

SEQ ID NO: 722400 - RNA, 64 nt, Homo Sapiens
aagccugcuuaaaaaauguaguugagccccauaauuuuacaaaugggcgaacuuuuaaacuucu

SEQ ID NO: 722401 - RNA, 64 nt, Homo Sapiens
acuucuaacucuacuuggaucaaaaccucauacauuuuacaaagggguccugacaagucagcug

SEQ ID NO: 722402 - RNA, 64 nt, Homo Sapiens
uuuuauguaacaaacagccccuccccaccuccaguuuuacaacaaucagaaagggcacugauuu

SEQ ID NO: 722403 - RNA, 64 nt, Homo Sapiens
ucagaaagggcacugauuuauuugguauuuuucuuuuuacaaagcuaccuuuagucaaagguca

SEQ ID NO: 722404 - RNA, 64 nt, Homo Sapiens
gacuaaggaaaaaaccugccucuguagcaccauuuuuuacaaacugacucuuagaugcuauuga

SEQ ID NO: 722405 - RNA, 64 nt, Homo Sapiens
uuaauuugucucaaaacuguauugauaaaccauuuuuuacaaaaguguuuuauacaaaaaugga

SEQ ID NO: 722406 - RNA, 64 nt, Homo Sapiens
auaaugaaaauuaguugauucuaauauucaucaguuuuacaaacgauaacaagaaaugucuaga

SEQ ID NO: 722407 - RNA, 64 nt, Homo Sapiens
auaauguauuuuaaaaugggauccuuguaauguauuuuacaaggaaaguauuuuaaaauacauu

SEQ ID NO: 722408 - RNA, 64 nt, Homo Sapiens
aguggccucgaguacuugguaaguuacuuaaaauuuuuacaaaaauaucccacucaaugccaaa

SEQ ID NO: 722409 - RNA, 64 nt, Homo Sapiens
accagacuguagcaucauaaaguuaauuuacaguuuuuacaacauugcuucuacauucuuacug

SEQ ID NO: 722410 - RNA, 64 nt, Homo Sapiens
aucuuauaaaacccuugaaaauaaacagucucuuuuuuacaaagccuguguuagagcacagauu

SEQ ID NO: 722411 - RNA, 64 nt, Homo Sapiens
uaacauuuacauugucaaccuuuauugacuuuguuuuuacaauaaaaaauauuuuacaacuuac

SEQ ID NO: 722412 - RNA, 62 nt, Homo Sapiens
accuuuauugacuuuguuuuuacaauaaaaaauauuuuacaacuuacuuucuguucucugua

SEQ ID NO: 722413 - RNA, 64 nt, Homo Sapiens
uuuacgugucucaaagcacaacaaugguuuauuuuuuuacaagggugucuuuucauaagguuuu

SEQ ID NO: 722414 - RNA, 64 nt, Homo Sapiens
guuuauuuuuuuacaagguugucuuuucauaagguuuuacaaugauugcacagaaucagugugu

SEQ ID NO: 722415 - RNA, 64 nt, Homo Sapiens
cccauuuucaaauuacuuuuuauuaguaguaaacuuuuacaaauuuuccauauaggaaagccau

SEQ ID NO: 722416 - RNA, 64 nt, Homo Sapiens
ggauuuugcauuaacaggaauacuauuuggccauuuuuacaaauuuuuugagguuuuuggaagu

SEQ ID NO: 722417 - RNA, 64 nt, Homo Sapiens
guaauuauauugauguucauguuauaaaaaauuuuuuuacaauuaugaaaaucaguccauccuu

SEQ ID NO: 722418 - RNA, 64 nt, Homo Sapiens
uuugucaaacauguacuccuuucauacggguggcuuuuacaaggcaacuuccgucauuuaaugu

SEQ ID NO: 722419 - RNA, 64 nt, Homo Sapiens
cuugauugugugccauuuuauauaacagguccuguuuuacaaauaaauuuuguuuuacuaacau

SEQ ID NO: 722420 - RNA, 64 nt, Homo Sapiens
uauacuuauuuuaaagaaaaucuuauauaguacauuuuacaaaaauuauaaaaaaugaauuagu

SEQ ID NO: 722421 - RNA, 64 nt, Homo Sapiens
uuagauucauaauguuaggagcauuuaaucuguauuuuacaaguuaggaagcagaggaucagag

SEQ ID NO: 722422 - RNA, 64 nt, Homo Sapiens
caauagacccucgagggcuuguguccauuuggccuuuuacaaguguaaugccaauuucauugau

SEQ ID NO: 722423 - RNA, 64 nt, Homo Sapiens
cuggaaugcauuuauucuugaaauauuugugugauuuuacaaaaagcuuuuguaaucaguuauu

SEQ ID NO: 722424 - RNA, 64 nt, Homo Sapiens
gaaaugcaguggucacuucacagucaaaugaccuuuuuacaaaauggcaguugugaggaaaagc

SEQ ID NO: 722425 - RNA, 64 nt, Homo Sapiens
acauaauuuuaauggcuauauauggcauuaaaaauuuuacaaaagcaaaauugccacauuuucu

SEQ ID NO: 722426 - RNA, 64 nt, Homo Sapiens
aaauuuugcaugugccauuggcaaauggcuaccguuuuacaauacggugucuuucuuuauaaau

SEQ ID NO: 722427 - RNA, 64 nt, Homo Sapiens
uauguuuuaauuccaagugucagggcucaugauuuuuuacaaauagcucccagcccacucaucg

SEQ ID NO: 722428 - RNA, 64 nt, Homo Sapiens
auuuugauagugccauuuauuguuaaagauuuauuuuuacaaaguaaauucaggguuuuagaug

SEQ ID NO: 722429 - RNA, 64 nt, Homo Sapiens
aaaguaaauucaggguuuuagauguguacacagcuuuuacaaaucaauaaagaugauuguacaa

SEQ ID NO: 722430 - RNA, 64 nt, Homo Sapiens
aagacuaaaacugaacaagacuaaaggguaguuguuuuacaaugaagaucugaucagaauuuaa

SEQ ID NO: 722431 - RNA, 64 nt, Homo Sapiens
auguauccuuccuuugacaacaacuuggccauuauuuuacaauggauagaagauacuuuuaaga

SEQ ID NO: 722432 - RNA, 64 nt, Homo Sapiens
auagacuuuugcauugggacuggaauuucucaccuuuuacaauguuagugagaaccauaggcgu

SEQ ID NO: 722433 - RNA, 64 nt, Homo Sapiens
ucauuucuuucuggggucacccucuucuuguggcuuuuacaacugaacaaucucucuggaagug

SEQ ID NO: 722434 - RNA, 64 nt, Homo Sapiens
uggccagaggcauuuuuuaauguuacuuucacuuuuuuacaaccccaacuucuauguuuaucuu

SEQ ID NO: 722435 - RNA, 64 nt, Homo Sapiens
ccaacuucuauguuuaucuuauuccaacucacuuuuuuacaacuaguagaucauggcagcauga

SEQ ID NO: 722436 - RNA, 64 nt, Homo Sapiens
guuccugaaguguaucgauuucaaguuaacaaaauuuuacaaauguuauugaaguguucuucuc

SEQ ID NO: 722437 - RNA, 64 nt, Homo Sapiens
agucacuuuugggcugggcguguagaaaauaauuuuuuacaaaauauuauuuaucuucuuuuag

SEQ ID NO: 722438 - RNA, 64 nt, Homo Sapiens
acauuguaaauuacauauuaaauauuuuaucugcuuuuacaagcgcaaggugcaaaaauauaua

SEQ ID NO: 722439 - RNA, 64 nt, Homo Sapiens
cuugccagagaugaacacagaauguucuguuucauuuuacaagaacuauccugaguuucugugg

SEQ ID NO: 722440 - RNA, 64 nt, Homo Sapiens
ugcagcuuagggaugguuccuggaaguggacacauuuuacaaaaacguuuuuuaaauacacgcc

SEQ ID NO: 722441 - RNA, 64 nt, Homo Sapiens
ccaagauucauaugaagugauauuagauuguuccuuuuacaaaaguguuuagcuucaagacugg

SEQ ID NO: 722442 - RNA, 64 nt, Homo Sapiens
uagaaauuagaagcuuucugauuucuagaugagguuuuacaauuguuucuuacagucaugugca

SEQ ID NO: 722443 - RNA, 64 nt, Homo Sapiens
ucugcccucuucccuauaaaaucacacagcgugauuuuacaaggucccguggcaccuugcucag

SEQ ID NO: 722444 - RNA, 64 nt, Homo Sapiens
auguaauuuauauuccauuuucuuaguuuuuuuuuuuuacaacuuaaaagaagucaucucaaac

SEQ ID NO: 722445 - RNA, 64 nt, Homo Sapiens
ucuagguuuggcuaguucucaugaagugaaaaaguuuuacaaucauuaauuuuuuuuuuaaaca

SEQ ID NO: 722446 - RNA, 64 nt, Homo Sapiens
aacugcacaucaauuuuauaaaauaguguuauccuuuuacaauugaagcagcuuguuucuaaac

SEQ ID NO: 722447 - RNA, 64 nt, Homo Sapiens
augcuauucuuacacuugcuccuucaaacaguaguuuuacaaucuauuuuguacuguuuauaag

SEQ ID NO: 722448 - RNA, 64 nt, Homo Sapiens
guaguuuaaaaauaggaccauguaugagacacuuuuuuacaaaaagugccguauauacauaugu

SEQ ID NO: 722449 - RNA, 64 nt, Homo Sapiens
ugcuaaccauggcaagcaaacauuuacauuuguuuuuuacaauaaauuucuuuuaaaauauacu

SEQ ID NO: 722450 - RNA, 64 nt, Homo Sapiens
gggaaacuacauuaucacaaaauuauacaaauuuuuuuacaaguauuuacauacuguaucugaa

SEQ ID NO: 722451 - RNA, 64 nt, Homo Sapiens
aaaugggaaacaaggguuuaauuuaguucagccauuuuacaaggaaauaauaaaauacuaaaau

SEQ ID NO: 722452 - RNA, 64 nt, Homo Sapiens
gcuuuccaagugaugaauaugaaauguaaaagaauuuuacaaauaaaggcaaauuucaagggaa

SEQ ID NO: 722453 - RNA, 64 nt, Homo Sapiens
ugaggauuaccaauuaaacuuguacuuugccuuauuuuacaaaugguuuuuacuauugaacccu

SEQ ID NO: 722454 - RNA, 64 nt, Homo Sapiens
guuuuaaagccauuucauguguuuuguuuuuuuuuuuuacaauuccacagauucuaccuuuugu

SEQ ID NO: 722455 - RNA, 64 nt, Homo Sapiens
gguuuucuuacauaggacucuauacaaggauauauuuuacaaguugaucaguuuuugaaguccg

SEQ ID NO: 722456 - RNA, 64 nt, Homo Sapiens
ggguggccuuuuuuuaccgauccccuuuuuuauuuuuuacaaccggaccuccacccccaacuuc

SEQ ID NO: 722457 - RNA, 64 nt, Homo Sapiens
auaauuuuaguggaauuguuauugagaauaaaauuuuuacaaucauaacuggcuuuuuccaagu

SEQ ID NO: 722458 - RNA, 64 nt, Homo Sapiens
uugaggucuucguguucaagucuuuuuuuuuuuuuuuuacaauuuuguuuuucuuuuuuuucuu

SEQ ID NO: 722459 - RNA, 64 nt, Homo Sapiens
uuacgaugucauuugggucuaaugagugagaaauuuuuacaaaacacagggagagacaugggcg

SEQ ID NO: 722460 - RNA, 64 nt, Homo Sapiens
gggacaggguugcuggguacagaagccagacuucuuuuacaaguaacucuaggcuggguguggu

SEQ ID NO: 722461 - RNA, 64 nt, Homo Sapiens
cuacagcucucccccagcuaguaugaugauccuguuuuacaaaugcagaaaugaucuuaauauu

SEQ ID NO: 722462 - RNA, 64 nt, Homo Sapiens
augaguucuuaaaauuuugucagagccuucuucauuuuacaauauuuuguuauuuuuauuuuac

SEQ ID NO: 722463 - RNA, 64 nt, Homo Sapiens
acaauauuuuguuauuuuuauuuuaccuuuuucauuuuacaauauuucguuauuuuuauuuuac

SEQ ID NO: 722464 - RNA, 64 nt, Homo Sapiens
acaauauuucguuauuuuuauuuuaccuuuuucauuuuacaaguugcaauauauuguuucguuc

SEQ ID NO: 722465 - RNA, 64 nt, Homo Sapiens
uguuuaauaccuaguuguauuuuucuuuguaaguuuuuacaaauaauuuuucuugaaagcuaaa

SEQ ID NO: 722466 - RNA, 64 nt, Homo Sapiens
uuucaacagcagaccuucuguuuuuccaaagguauuuuacaauaaagcuaaucuauaaauaccg

SEQ ID NO: 722467 - RNA, 64 nt, Homo Sapiens
caagauguaauuuuuacuuuaucucucacacguauuuuacaaaacgucaugagaaacauugucu

SEQ ID NO: 722468 - RNA, 64 nt, Homo Sapiens
agaaaccuacuagcauucaaauaaucauucccuauuuuacaaugcaucaguucugucaagcuuc

SEQ ID NO: 722469 - RNA, 64 nt, Homo Sapiens
uggaucucacuguugucuuuauaaaaauggcacauuuuacaaaguaguuuauucuuauuauacu

SEQ ID NO: 722470 - RNA, 64 nt, Homo Sapiens
uuaacuguucuauucugauacuacgcguguuguuuuuuacaacagguauguuuuuguuucagaa

SEQ ID NO: 722471 - RNA, 64 nt, Homo Sapiens
aauguguaucugaaaagcaaggaauuugcagccguuuuacaaauaucuguggaacauguaaaua

SEQ ID NO: 722472 - RNA, 64 nt, Homo Sapiens
cagguuuguauauaaaaugaaaagcuauacuacuuuuuacaaaagggcaaacugggcugaugua

SEQ ID NO: 722473 - RNA, 64 nt, Homo Sapiens
ccauaagccuacaauagaugccucccuuaaggcauuuuacaaaccuucuuugaguuguuuaugg

SEQ ID NO: 722474 - RNA, 64 nt, Homo Sapiens
aaaucuaaaaugcuuaauccagauuuuugugucauuuuacaauuaacauuggaaauagaugauu

SEQ ID NO: 722475 - RNA, 64 nt, Homo Sapiens
uaaauaaaguguuuuacauaucauauuuaaacauuuuuacaaaauuggguuacaguauuuuuau

SEQ ID NO: 722476 - RNA, 64 nt, Homo Sapiens
uucauuuuuaaaaguaggcagggcucccucuuauuuuuacaaguuaagacuuucuaugugguuu

SEQ ID NO: 722477 - RNA, 64 nt, Homo Sapiens
ggaggcagaaaguccuggaaaaguaaauuguuuauuuuacaauaagaaagugauuacauauuuu

SEQ ID NO: 722478 - RNA, 64 nt, Homo Sapiens
auuuuacaauaagaaagugauuacauauuuuuuuuuuuacaaugguggaaaauuagaagucauu

SEQ ID NO: 722479 - RNA, 64 nt, Homo Sapiens
gcaaguucugggaccuuuuggggcacauguaucauuuuacaaaugagcuuucaagaccauuuaa

SEQ ID NO: 722480 - RNA, 64 nt, Homo Sapiens
aucaauaugguaucacaaugccuauuaagaggcuuuuuacaaauuacuuacuuaguaauaucug

SEQ ID NO: 722481 - RNA, 64 nt, Homo Sapiens
gccucgaaacacagaaaccuuucugcaguaaaucuuuuacaacuaagccuaaaagugggcuuga

SEQ ID NO: 722482 - RNA, 64 nt, Homo Sapiens
aaaaaaaaagaucuguuuugauauguugaauacuuuuuacaauuaaaaugcuuuuuauuucugc

SEQ ID NO: 722483 - RNA, 64 nt, Homo Sapiens
gcauuugccaaaccaagccagcuggagcgccacagccgcauacauacagguaacggggaaggac

SEQ ID NO: 722484 - RNA, 64 nt, Homo Sapiens
cuuccuugaaugucaguguguaaaccuggcuguagccgcauaugcagaauaacuguaauugugc

SEQ ID NO: 722485 - RNA, 64 nt, Homo Sapiens
gagucauacuccccacaaguagccacaauggccccccgcgaagugaggggcagaguuaaacauu

SEQ ID NO: 722486 - RNA, 64 nt, Homo Sapiens
aagagcgaaccaaagcgaugagcgagaacccgcgcccgcgaacagauggauggauggauggaug

SEQ ID NO: 722487 - RNA, 64 nt, Homo Sapiens
gguaaauacacccaaagggacucuccucuggucccccgcgaaaaccauuggaugaaguggugcc

SEQ ID NO: 722488 - RNA, 64 nt, Homo Sapiens
cggcagcagagcuggcacaccgauucugggaagccccgcgaaugauggcuuuugaauuaaugag

SEQ ID NO: 722489 - RNA, 64 nt, Homo Sapiens
aggauccuucugcuccgcucaggacccccggagccccgcgaaaacaucugccucccaggagggu

SEQ ID NO: 722490 - RNA, 64 nt, Homo Sapiens
ccucaggauuaugguuaacccaugauagugugaacccgcgaaggguuuugauggcagcaguaau

SEQ ID NO: 722491 - RNA, 64 nt, Homo Sapiens
agugccacaccucgaacugguuguagugggaagucccgcgaaacccggugcaucuggcacgugg

SEQ ID NO: 722492 - RNA, 64 nt, Homo Sapiens
cauccccccaagcccuagagcucccuccacucuucccgcgaacaucacaccguuccccgaccaa

SEQ ID NO: 722493 - RNA, 64 nt, Homo Sapiens
gacaguuuacaaaauuauuuaucgauccucccugcccgcgaaguugagcuggggcccacguggc

SEQ ID NO: 722494 - RNA, 64 nt, Homo Sapiens
aaucucgagagaacuggcauuccucgcggcagcccccgcgaagacgacaggggcgagggcugcu

SEQ ID NO: 722495 - RNA, 64 nt, Homo Sapiens
cacuccccccgccucgacggcaccacuggccggccccgcgaaagacugcgcgugcguagagcac

SEQ ID NO: 722496 - RNA, 64 nt, Homo Sapiens
ggcgaggccaccccccuccauccugggggaagcgcccgcgaaaaccguggagagaagccgccgc

SEQ ID NO: 722497 - RNA, 64 nt, Homo Sapiens
cgccccccgccagcccgcccccgguuguccaccucccgcgaagcccaaucgcgaggccgcgagc

SEQ ID NO: 722498 - RNA, 64 nt, Homo Sapiens
ccgaggccuggcucuggagcuuugccuuugguuccccgcgaaguggcgccccggacgccgcgau

SEQ ID NO: 722499 - RNA, 64 nt, Homo Sapiens; identical to SEQ ID NO: 492612

SEQ ID NO: 722500 - RNA, 64 nt, Homo Sapiens; identical to SEQ ID NO: 492613

SEQ ID NO: 722501 - RNA, 64 nt, Homo Sapiens; identical to SEQ ID NO: 492614

SEQ ID NO: 722502 - RNA, 64 nt, Homo Sapiens; identical to SEQ ID NO: 492615

SEQ ID NO: 722503 - RNA, 64 nt, Homo Sapiens; identical to SEQ ID NO: 492616

SEQ ID NO: 722504 - RNA, 64 nt, Homo Sapiens; identical to SEQ ID NO: 492617

SEQ ID NO: 722505 - RNA, 64 nt, Homo Sapiens
gggcuuuguccuccaggaggugggggaaugugguaacauugaauacaguugaauaaaaucgcuu

SEQ ID NO: 722506 - RNA, 64 nt, Homo Sapiens
ucucacaaugcauuguuaaguauguaaaagcaauaacauugauucucuguuguacuuuuuugua

SEQ ID NO: 722507 - RNA, 64 nt, Homo Sapiens
ggugaggcacaaagaguuucuugaucauccagagaacauugacagacaauuaugaauaauaaag

SEQ ID NO: 722508 - RNA, 64 nt, Homo Sapiens
aaacuaacaugacaagaaagcuauagaaaaaauaaacauugaacucaguucuucaagguuucau

SEQ ID NO: 722509 - RNA, 64 nt, Homo Sapiens
acguggacggaggaggggccagcacaguggcggcaacauugaaggaaggauugcaaugcccgcc

SEQ ID NO: 722510 - RNA, 64 nt, Homo Sapiens
augacuacgucccgugucuccaauguucaacauuaacauugauguuacauugagcgugaccuug

SEQ ID NO: 722511 - RNA, 64 nt, Homo Sapiens
auauauaaugaucacuucugaguuuaucaccaguaacauugauaccuauuuugggguauaaaca

SEQ ID NO: 722512 - RNA, 64 nt, Homo Sapiens
guaaagacaccuuauuuaauauaaucgauucauuaacauugaagucaugaccaacaacacugua

SEQ ID NO: 722513 - RNA, 64 nt, Homo Sapiens
agcuaagaugaaauucugacuaaugaaggagcagaacauugacaugaccuuuguggaacacaaa

SEQ ID NO: 722514 - RNA, 64 nt, Homo Sapiens
aaaaaaaaacauauuuuuaauuuuaugaaaacucaacauugaguuaaacacuguuauacaccug

SEQ ID NO: 722515 - RNA, 64 nt, Homo Sapiens
auguauguauuauaauuuuuggucgcuaucacaaaacauugacgacaaauuaaaucuucuggag

SEQ ID NO: 722516 - RNA, 64 nt, Homo Sapiens
ugcagacuaugguuuguacaugaaaauaaagaggaacauugaccuaacucaugauuuaugacau

SEQ ID NO: 722517 - RNA, 64 nt, Homo Sapiens
auaaugauuugguucagggcuuucaacugagugcaacauugagacauucaagguaguaggucuc

SEQ ID NO: 722518 - RNA, 64 nt, Homo Sapiens
augacaacuaaaacauuccacagacauauaaaguaacauugagaaaauacauuagaacuuaaug

SEQ ID NO: 722519 - RNA, 64 nt, Homo Sapiens
acacacauauuucuguuugauucuguaucaggguaacauugagaauauuucuuccaaguuugau

SEQ ID NO: 722520 - RNA, 64 nt, Homo Sapiens
acuuucacugauuuuuaaauauauuaggagacuaaacauugaaaguugcaaauuuaagcauuau

SEQ ID NO: 722521 - RNA, 64 nt, Homo Sapiens
acugcugcgauugcucaagguuguucuauauauuaacauugaacaguaacguaccguaugguca

SEQ ID NO: 722522 - RNA, 64 nt, Homo Sapiens
agaggaggauuuguuuauugcuggcuuuacaguaaacauugaaguucaaauaaauggcaguuaa

SEQ ID NO: 722523 - RNA, 64 nt, Homo Sapiens
caagucccugauauccagaaccccauaggcaaguaacauugacuguaagaccucuguagggcaa

SEQ ID NO: 722524 - RNA, 64 nt, Homo Sapiens
uggauguggacaucauugcuuaccaauuuuuaccaacauugaggcagggcucacucuccuaaau

SEQ ID NO: 722525 - RNA, 64 nt, Homo Sapiens
guucaagugcuguuucuuuguucaaagcauuagaaacauugagauauuuauuugugcacuacaa

SEQ ID NO: 722526 - RNA, 64 nt, Homo Sapiens
agcccucgaugacugcccuuugcugccacagcccaacauugaggccugcugcuugugguagaaa

SEQ ID NO: 722527 - RNA, 64 nt, Homo Sapiens; identical to SEQ ID NO: 47711

SEQ ID NO: 722528 - RNA, 64 nt, Homo Sapiens; identical to SEQ ID NO: 47712

SEQ ID NO: 722529 - RNA, 51 nt, Homo Sapiens; identical to SEQ ID NO: 47713

SEQ ID NO: 722530 - RNA, 64 nt, Homo Sapiens; identical to SEQ ID NO: 47714

SEQ ID NO: 722531 - RNA, 64 nt, Homo Sapiens; identical to SEQ ID NO: 47715

SEQ ID NO: 722532 - RNA, 64 nt, Homo Sapiens; identical to SEQ ID NO: 47716

SEQ ID NO: 722533 - RNA, 64 nt, Homo Sapiens; identical to SEQ ID NO: 47717

SEQ ID NO: 722534 - RNA, 64 nt, Homo Sapiens; identical to SEQ ID NO: 47718

SEQ ID NO: 722535 - RNA, 64 nt, Homo Sapiens; identical to SEQ ID NO: 47719

SEQ ID NO: 722536 - RNA, 64 nt, Homo Sapiens; identical to SEQ ID NO: 47720

SEQ ID NO: 722537 - RNA, 64 nt, Homo Sapiens; identical to SEQ ID NO: 47721

SEQ ID NO: 722538 - RNA, 64 nt, Homo Sapiens; identical to SEQ ID NO: 47722

SEQ ID NO: 722539 - RNA, 64 nt, Homo Sapiens; identical to SEQ ID NO: 47723

SEQ ID NO: 722540 - RNA, 59 nt, Homo Sapiens; identical to SEQ ID NO: 47724

SEQ ID NO: 722541 - RNA, 64 nt, Homo Sapiens; identical to SEQ ID NO: 47725

SEQ ID NO: 722542 - RNA, 64 nt, Homo Sapiens; identical to SEQ ID NO: 47726

SEQ ID NO: 722543 - RNA, 64 nt, Homo Sapiens; identical to SEQ ID NO: 47727

SEQ ID NO: 722544 - RNA, 64 nt, Homo Sapiens; identical to SEQ ID NO: 47728

SEQ ID NO: 722545 - RNA, 64 nt, Homo Sapiens; identical to SEQ ID NO: 47729

SEQ ID NO: 722546 - RNA, 64 nt, Homo Sapiens; identical to SEQ ID NO: 47730

SEQ ID NO: 722547 - RNA, 64 nt, Homo Sapiens; identical to SEQ ID NO: 47731

SEQ ID NO: 722548 - RNA, 64 nt, Homo Sapiens; identical to SEQ ID NO: 47732

SEQ ID NO: 722549 - RNA, 64 nt, Homo Sapiens; identical to SEQ ID NO: 47733

SEQ ID NO: 722550 - RNA, 64 nt, Homo Sapiens; identical to SEQ ID NO: 47734

SEQ ID NO: 722551 - RNA, 64 nt, Homo Sapiens; identical to SEQ ID NO: 47735

SEQ ID NO: 722552 - RNA, 64 nt, Homo Sapiens; identical to SEQ ID NO: 47736

SEQ ID NO: 722553 - RNA, 64 nt, Homo Sapiens; identical to SEQ ID NO: 47737

SEQ ID NO: 722554 - RNA, 64 nt, Homo Sapiens; identical to SEQ ID NO: 47738

SEQ ID NO: 722555 - RNA, 64 nt, Homo Sapiens; identical to SEQ ID NO: 47739

SEQ ID NO: 722556 - RNA, 64 nt, Homo Sapiens; identical to SEQ ID NO: 47740

SEQ ID NO: 722557 - RNA, 64 nt, Homo Sapiens; identical to SEQ ID NO: 47741

SEQ ID NO: 722558 - RNA, 64 nt, Homo Sapiens; identical to SEQ ID NO: 47742

SEQ ID NO: 722559 - RNA, 64 nt, Homo Sapiens; identical to SEQ ID NO: 47743

SEQ ID NO: 722560 - RNA, 64 nt, Homo Sapiens; identical to SEQ ID NO: 47744

SEQ ID NO: 722561 - RNA, 64 nt, Homo Sapiens; identical to SEQ ID NO: 47745

SEQ ID NO: 722562 - RNA, 64 nt, Homo Sapiens; identical to SEQ ID NO: 47746

SEQ ID NO: 722563 - RNA, 64 nt, Homo Sapiens; identical to SEQ ID NO: 47747

SEQ ID NO: 722564 - RNA, 64 nt, Homo Sapiens; identical to SEQ ID NO: 47748

SEQ ID NO: 722565 - RNA, 64 nt, Homo Sapiens; identical to SEQ ID NO: 47749

SEQ ID NO: 722566 - RNA, 64 nt, Homo Sapiens; identical to SEQ ID NO: 47750

SEQ ID NO: 722567 - RNA, 64 nt, Homo Sapiens; identical to SEQ ID NO: 47751

SEQ ID NO: 722568 - RNA, 64 nt, Homo Sapiens; identical to SEQ ID NO: 47752

SEQ ID NO: 722569 - RNA, 64 nt, Homo Sapiens; identical to SEQ ID NO: 47753

SEQ ID NO: 722570 - RNA, 64 nt, Homo Sapiens; identical to SEQ ID NO: 47754

SEQ ID NO: 722571 - RNA, 64 nt, Homo Sapiens; identical to SEQ ID NO: 47755

SEQ ID NO: 722572 - RNA, 64 nt, Homo Sapiens; identical to SEQ ID NO: 47756

SEQ ID NO: 722573 - RNA, 64 nt, Homo Sapiens; identical to SEQ ID NO: 47757

SEQ ID NO: 722574 - RNA, 64 nt, Homo Sapiens; identical to SEQ ID NO: 47758

SEQ ID NO: 722575 - RNA, 64 nt, Homo Sapiens; identical to SEQ ID NO: 47759

SEQ ID NO: 722576 - RNA, 64 nt, Homo Sapiens; identical to SEQ ID NO: 47760

SEQ ID NO: 722577 - RNA, 64 nt, Homo Sapiens; identical to SEQ ID NO: 47761

SEQ ID NO: 722578 - RNA, 64 nt, Homo Sapiens; identical to SEQ ID NO: 47762

SEQ ID NO: 722579 - RNA, 64 nt, Homo Sapiens; identical to SEQ ID NO: 47763

SEQ ID NO: 722580 - RNA, 64 nt, Homo Sapiens; identical to SEQ ID NO: 47764

SEQ ID NO: 722581 - RNA, 64 nt, Homo Sapiens; identical to SEQ ID NO: 47765

SEQ ID NO: 722582 - RNA, 64 nt, Homo Sapiens; identical to SEQ ID NO: 47766

SEQ ID NO: 722583 - RNA, 64 nt, Homo Sapiens; identical to SEQ ID NO: 47767

SEQ ID NO: 722584 - RNA, 64 nt, Homo Sapiens; identical to SEQ ID NO: 47768

SEQ ID NO: 722585 - RNA, 64 nt, Homo Sapiens; identical to SEQ ID NO: 47769

SEQ ID NO: 722586 - RNA, 64 nt, Homo Sapiens; identical to SEQ ID NO: 47770

SEQ ID NO: 722587 - RNA, 59 nt, Homo Sapiens; identical to SEQ ID NO: 47771

SEQ ID NO: 722588 - RNA, 64 nt, Homo Sapiens; identical to SEQ ID NO: 47772

SEQ ID NO: 722589 - RNA, 62 nt, Homo Sapiens
ggagggcuuccagcuauaauaucugccuccagggaggggaggggaugggaagcaccaccagc

SEQ ID NO: 722590 - RNA, 62 nt, Homo Sapiens
gcuuccagcuauaauaucugccuccagggaggggaggggaugggaagcaccaccagccagcg

SEQ ID NO: 722591 - RNA, 62 nt, Homo Sapiens
gagcagacgguauauuccagaggugggaggugggaggggaagggagaaauccaaaacaaagu

SEQ ID NO: 722592 - RNA, 62 nt, Homo Sapiens
ucucagcucuugggaacccccuugcucccaggggaggggaaaccuuuuucauucaacauugu

SEQ ID NO: 722593 - RNA, 62 nt, Homo Sapiens
uuuggugcgcccccugcugaggagcagccccaggaggggaccagaggggaugcugugucgcu

SEQ ID NO: 722594 - RNA, 62 nt, Homo Sapiens
aucucuuguaccagcccaggcaauaguguugaggaggggagcaaggcugcuaaguggaagac

SEQ ID NO: 722595 - RNA, 62 nt, Homo Sapiens
cgggcuggccugacacaaugguagcucugaagggaggggaagagagaggccugggugugacc

SEQ ID NO: 722596 - RNA, 62 nt, Homo Sapiens
auuaacuuauugucuaggccagagcgggggugggaggggaaugccacagugaagggaguggc

SEQ ID NO: 722597 - RNA, 62 nt, Homo Sapiens
agcuuuuaggaugugggaguaaaacuuuaaugggaggggagggcuggcugcuggaagaagga

SEQ ID NO: 722598 - RNA, 62 nt, Homo Sapiens
aaugacacaaauggcagggaagucaagggcagggaggggaggaugacugccauguacacugc

SEQ ID NO: 722599 - RNA, 62 nt, Homo Sapiens
gccuggggcugcccagagacgaaucagaguggggaggggacagguccaaggucuuuguccua

SEQ ID NO: 722600 - RNA, 62 nt, Homo Sapiens
gauggugguguugaugguggcggugguaggguggaggggagagaagaagaugcugaugauau

SEQ ID NO: 722601 - RNA, 62 nt, Homo Sapiens
gauugcaacaaaggcagagggggcggggcgggggaggggagguaggacccgcuccggaaggc

SEQ ID NO: 722602 - RNA, 62 nt, Homo Sapiens
cccagcuuucccaggggcacagcucuaggcugggaggggagaaccagccccucccccugccc

SEQ ID NO: 722603 - RNA, 62 nt, Homo Sapiens
ggccccuaccaaccuuugccucugccuuggagggaggggaggucuguuaccacuggggaagg

SEQ ID NO: 722604 - RNA, 62 nt, Homo Sapiens
gauaggaccgggggaccccagagggaggccuaggaggggacugcacccauacugcuucccua

SEQ ID NO: 722605 - RNA, 62 nt, Homo Sapiens
uccaacaggacagcgccuucccccaugcgcugggaggggacccuccauuucucccccucacc

SEQ ID NO: 722606 - RNA, 62 nt, Homo Sapiens
ccuccucccugccuggggagcccaguggccagggaggggagugguggagccagucgcuguaa

SEQ ID NO: 722607 - RNA, 62 nt, Homo Sapiens
cagaggggauuaaagagggggaagagcagaagggaggggagaaggaggaaaggaugggggcu

SEQ ID NO: 722608 - RNA, 62 nt, Homo Sapiens
aaaagauaaaaagcaagccaaagacaaagaaaggaggggaaauucccuccauuaaaacaacc

SEQ ID NO: 722609 - RNA, 62 nt, Homo Sapiens
gcgguccuuugauaagacccgccccuagucagggaggggaugccucccuucaaaaagacagc

SEQ ID NO: 722610 - RNA, 62 nt, Homo Sapiens
cgaggaagaguaauauuuagugaccuaccucaggaggggaggaccggccaggaauguuugca

SEQ ID NO: 722611 - RNA, 62 nt, Homo Sapiens
uaccagaauacaguuuauuucucuuguugcggggaggggauucucaauguagguacauuaca

SEQ ID NO: 722612 - RNA, 62 nt, Homo Sapiens
gauuuuuuauguucuucugugugggaggagagggaggggaggacgggcgccuucccggggga

SEQ ID NO: 722613 - RNA, 62 nt, Homo Sapiens
uguguuuuuucuuuuuuuuuaaguucuuaugaggaggggaggguaaauaaaccacugugcgu

SEQ ID NO: 722614 - RNA, 62 nt, Homo Sapiens
auucucugcuauauauaaaacggugcugugagggaggggaaaagcauuuuucaauauauuga

SEQ ID NO: 722615 - RNA, 62 nt, Homo Sapiens
ugcuagacaaacauaaaggggcaggguuguggggaggggaacguuuuugguggugugugcag

SEQ ID NO: 722616 - RNA, 62 nt, Homo Sapiens
ucaguagguccugggacuugacaaaguaugugggaggggaaggaaggacagaacuugacugg

SEQ ID NO: 722617 - RNA, 62 nt, Homo Sapiens
gaggguaacauuuccauuucggacagcagggaggaggggagucuggagguggcauccacacu

SEQ ID NO: 722618 - RNA, 62 nt, Homo Sapiens
gaacacugggguuuaggaccacccggaaccugggaggggaggagcgcuucucaauguguguc

SEQ ID NO: 722619 - RNA, 62 nt, Homo Sapiens
gcuuucacgcccacccacccgugcuguccaguggaggggaggggucccucagcuggggggca

SEQ ID NO: 722620 - RNA, 62 nt, Homo Sapiens
ggcuccuggcaaggccugaccccaugguggggggaggggaggggaggggagggaaugaggca

SEQ ID NO: 722621 - RNA, 62 nt, Homo Sapiens
cuggcaaggccugaccccaugguggggggaggggaggggaggggagggaaugaggcagcucu

SEQ ID NO: 722622 - RNA, 62 nt, Homo Sapiens
aaggccugaccccaugguggggggaggggaggggaggggagggaaugaggcagcucuaggau

SEQ ID NO: 722623 - RNA, 62 nt, Homo Sapiens
cauuuuggccuccccugccccccuuguuauggggaggggaccccgggugagggggcccuauu

SEQ ID NO: 722624 - RNA, 62 nt, Homo Sapiens
ggauggaugggguuugggguggguaggccaugggaggggagaagccccuccuuggcaccccc

SEQ ID NO: 722625 - RNA, 62 nt, Homo Sapiens
uccgcuccugcccagccugggggaaggagaaaggaggggagaaagcgggcucucacccccuc

SEQ ID NO: 722626 - RNA, 62 nt, Homo Sapiens
ucaccgggcccugugugugucaccgaggugcgggaggggaggagcauuaaagcugaaagauc

SEQ ID NO: 722627 - RNA, 62 nt, Homo Sapiens
aggcccagggaagaguguauuuggggagcaggggaggggaggguguugagaaagcugaacug

SEQ ID NO: 722628 - RNA, 62 nt, Homo Sapiens
aaaguggaugcaauuuuucuuucuuuuguuggggaggggaaugggaggggaaaugggaauau

SEQ ID NO: 722629 - RNA, 62 nt, Homo Sapiens
aauuuuucuuucuuuuguuggggaggggaaugggaggggaaaugggaauauaauauugucuc

SEQ ID NO: 722630 - RNA, 62 nt, Homo Sapiens
ggagggcuuuuaauuuauuucgaacccuggcuggaggggauauggggaguuggggaaaggaa

SEQ ID NO: 722631 - RNA, 62 nt, Homo Sapiens
auuccauccccaguggagucagccuacacaagggaggggaacccccucaucuccagugacuc

SEQ ID NO: 722632 - RNA, 62 nt, Homo Sapiens
aguguugaugccaaaauaccugggaugggaggggaggggagccaauucuaaacugcagugac

SEQ ID NO: 722633 - RNA, 62 nt, Homo Sapiens
ggagcaguguugaugccaaagugacugggaugggaggggagggcaugcaauucuaaacugca

SEQ ID NO: 722634 - RNA, 62 nt, Homo Sapiens
ccaaaaagggggaauaugggagggcagaguggggaggggaguccaugggccuggggccccaa

SEQ ID NO: 722635 - RNA, 62 nt, Homo Sapiens
ucaaaagggguucaaaccccaccucaguagguggaggggagcgccugccauugguuguauuu

SEQ ID NO: 722636 - RNA, 62 nt, Homo Sapiens
cacguagggggcaggggcaggggcgggcggagggaggggaggggugaaauccauacuguaga

SEQ ID NO: 722637 - RNA, 62 nt, Homo Sapiens
cccuggccacagccuucccucugcauugaccuggaggggagaggucagccuugaccuaauga

SEQ ID NO: 722638 - RNA, 62 nt, Homo Sapiens
ggccaggggccaggaguggggagaguugugauggaggggagaggggucacacccacccccug

SEQ ID NO: 722639 - RNA, 62 nt, Homo Sapiens
uccugaggggacugcugcccuccaggcagagaggaggggagguacggguucuccagcuccuu

SEQ ID NO: 722640 - RNA, 62 nt, Homo Sapiens
caccccaguguccacuuuugggccgaggugguggaggggaugguacugaggacagcggugga

SEQ ID NO: 722641 - RNA, 62 nt, Homo Sapiens
gcaguggcugauggggacacugagauaagaucggaggggagcugucaaugccagaagugguu

SEQ ID NO: 722642 - RNA, 62 nt, Homo Sapiens
cggugguggggaggaggggugcgccauggccuggaggggaguguguguuggggugugugugu

SEQ ID NO: 722643 - RNA, 62 nt, Homo Sapiens
ggccugagcuggacaggggagcuccuaguaggggaggggaggggaugcugggaucuagguga

SEQ ID NO: 722644 - RNA, 62 nt, Homo Sapiens
gagcuggacaggggagcuccuaguaggggaggggaggggaugcugggaucuaggugacaugc

SEQ ID NO: 722645 - RNA, 62 nt, Homo Sapiens
gucugggaacuugcgagucccugcugagaugaggaggggagccacaugccugcgccugcugc

SEQ ID NO: 722646 - RNA, 62 nt, Homo Sapiens
gacaggcagcccagcaguguaagccacaggaaggaggggagaagggcugucccagccccggc

SEQ ID NO: 722647 - RNA, 62 nt, Homo Sapiens
gugugggcaagagacuuccuaggcggaaggagggaggggaacaagccccacggugggucaga

SEQ ID NO: 722648 - RNA, 62 nt, Homo Sapiens
gccauggaaaggagaguuuggccauuggaugaggaggggacuucucaucgaggugugguaaa

SEQ ID NO: 722649 - RNA, 62 nt, Homo Sapiens
uauauugaauuuuauauuucauucuuuuggggggaggggaacuaagguguuguauaaauaau

SEQ ID NO: 722650 - RNA, 62 nt, Homo Sapiens
guuuaaaaucccagcugggcauguagaaugagggaggggaaacggagcuuuuuaaagaacug

SEQ ID NO: 722651 - RNA, 62 nt, Homo Sapiens
ccagccagcccgugacagcuucccccuaaucaggaggggacagcugggggcgcaagcuggug

SEQ ID NO: 722652 - RNA, 62 nt, Homo Sapiens
accugcagccaucugugaggcccgcggggaugggaggggaggaggguggccuguugguuucc

SEQ ID NO: 722653 - RNA, 62 nt, Homo Sapiens
cccauccugggggaugcuggguccugagugaaggaggggacccaggucugcggaggggaagu

SEQ ID NO: 722654 - RNA, 62 nt, Homo Sapiens
uguccugagugaaggagggggugcaggucugcggaggggaagaaaugagaaaggcccagaac

SEQ ID NO: 722655 - RNA, 62 nt, Homo Sapiens
ugcccucgggcgucuggcagccugagguggguggaggggacaguguucuggauagaucuauu

SEQ ID NO: 722656 - RNA, 62 nt, Homo Sapiens
gugaggugugcaagggugcacugaggguggugggaggggaucaccuggguuccaggccaucc

SEQ ID NO: 722657 - RNA, 62 nt, Homo Sapiens
uauuccggcuuuuuauauggcaccuuucugagggaggggauuuuacagccgagggaccucca

SEQ ID NO: 722658 - RNA, 62 nt, Homo Sapiens
gccuguuuuuacuuagaaagcaggcuugggcaggaggggaaauggauuugaaccaucucaga

SEQ ID NO: 722659 - RNA, 62 nt, Homo Sapiens
ucaagguuuggguggggacucuguuggggaggggaggggagcgaacccagaggaucuaggcc

SEQ ID NO: 722660 - RNA, 62 nt, Homo Sapiens
ggagcucaagguuuggguggaggcccuguuggggaggggaggauggagaacccagaggaucu

SEQ ID NO: 722661 - RNA, 62 nt, Homo Sapiens
ugcccuucuccacuccucucgucuugagcggaggaggggaucgggagagaguguggugggaa

SEQ ID NO: 722662 - RNA, 62 nt, Homo Sapiens
cugaggcguuuggccccggcauguggacccggggaggggaggcacucccucuccagcccccg

SEQ ID NO: 722663 - RNA, 62 nt, Homo Sapiens
acccugagggcucagccaggccccugccauagggaggggagggcacaacgcccggccugagc

SEQ ID NO: 722664 - RNA, 62 nt, Homo Sapiens
gaggcccaaaggcagaacagccagagggggcaggaggggaccaaaaaggaaaaugaggacgu

SEQ ID NO: 722665 - RNA, 62 nt, Homo Sapiens
guuggucccuguccuugcugcccaggcagcguggaggggaaggguagggcagccagagaaag

SEQ ID NO: 722666 - RNA, 62 nt, Homo Sapiens
gguaguaggugccagccuaggggagcuuccaaggaggggaaggcaaagcccuggccccugcc

SEQ ID NO: 722667 - RNA, 62 nt, Homo Sapiens
aggauguggcuucucaugaagcucuggccagaggaggggaacuuauugggggagggggggug

SEQ ID NO: 722668 - RNA, 62 nt, Homo Sapiens
agaggaggggaacuuauugggggaggggggguggaggggaggaaucuggaccucuaagucau

SEQ ID NO: 722669 - RNA, 62 nt, Homo Sapiens
aaagcugagaucuaaauggggacaaggcagguggaggggaggccaguguacauguaaaugcc

SEQ ID NO: 722670 - RNA, 62 nt, Homo Sapiens
gauuuucugccagaggggugggucagagcaguggaggggagacaucgcccaugugcuucugc

SEQ ID NO: 722671 - RNA, 62 nt, Homo Sapiens
gagcacaggaacagccuugagaaggcuuuguuggaggggacauccucauuugucucuaaguu

SEQ ID NO: 722672 - RNA, 62 nt, Homo Sapiens
gggaagagguacaggcggugcgggggugggguggaggggagggggcuggugcgcggaggggg

SEQ ID NO: 722673 - RNA, 62 nt, Homo Sapiens
uccuuugggguugagggagaugggagcuagggggaggggagggagaugucuuguugugggga

SEQ ID NO: 722674 - RNA, 62 nt, Homo Sapiens
ucucaaaccaaaguuaacagggagaggaugggggaggggacaaauuagaauaggauagcauc

SEQ ID NO: 722675 - RNA, 62 nt, Homo Sapiens
uaagaccuaucaugccaagagucacagaucugggaggggacuggaaaagacaccugucaaau

SEQ ID NO: 722676 - RNA, 62 nt, Homo Sapiens
gaugggcggccccgccccagugggaggcacagggaggggagaggcgcuggacuugggcgacc

SEQ ID NO: 722677 - RNA, 62 nt, Homo Sapiens
gggagugcggggaugcggaucagcugggaggaggaggggaggggaacuuccacccgagggga

SEQ ID NO: 722678 - RNA, 62 nt, Homo Sapiens
ugcggggaugcggaucagcugggaggaggaggggaggggaacuuccacccgaggggaagaug

SEQ ID NO: 722679 - RNA, 62 nt, Homo Sapiens
uguggggagggagcauuuuugguggucuugggggaggggaggggagggaagggcugguguug

SEQ ID NO: 722680 - RNA, 62 nt, Homo Sapiens
ggagggagcauuuuugguggucuugggggaggggaggggagggaagggcugguguugauuuu

SEQ ID NO: 722681 - RNA, 62 nt, Homo Sapiens
guuuuguguugguguuuccuauuuucugcacuggaggggaggggacuguugagguucugucu

SEQ ID NO: 722682 - RNA, 62 nt, Homo Sapiens
guguugguguuuccuauuuucugcacuggaggggaggggacuguugagguucugucuuuuuu

SEQ ID NO: 722683 - RNA, 62 nt, Homo Sapiens
cucugaccugaugguguugggguuuggguaggggaggggagcucggcugucagaacuccaug

SEQ ID NO: 722684 - RNA, 62 nt, Homo Sapiens
ugucagaacuccauggauauguuucuuuggauggaggggagggccuuuguuaccuuuugcac

SEQ ID NO: 722685 - RNA, 62 nt, Homo Sapiens
gagcugaggauuuccuggagagggggccggggggaggggacaggcaggggccugggccggcg

SEQ ID NO: 722686 - RNA, 62 nt, Homo Sapiens
uggggaaagcagaacugaagucccaggccuuuggaggggaaauccggagccucauguucucu

SEQ ID NO: 722687 - RNA, 62 nt, Homo Sapiens
caggaccauaggaagguccucacccuugguggggaggggaccuuuuuguguccucggcccuc

SEQ ID NO: 722688 - RNA, 62 nt, Homo Sapiens
aggcccccuuguccacuccagcuucuggccagggaggggauccuugcccaugccuggaccuu

SEQ ID NO: 722689 - RNA, 62 nt, Homo Sapiens
uaauaaggagggcugcuggggcauucuggaggggaggggagagaggcuggaaaguguccccu

SEQ ID NO: 722690 - RNA, 62 nt, Homo Sapiens
ggagauaauaaggagggcugccccugcauucuggaggggaggacguagaggcuggaaagugu

SEQ ID NO: 722691 - RNA, 62 nt, Homo Sapiens
aagggagauggguagcaucaagggagggauggggaggggagaacugguguauuauuuggggg

SEQ ID NO: 722692 - RNA, 62 nt, Homo Sapiens
ggggauaaguguuucaaggcacccaucccaguggaggggaaaucaagcuguauaguuugcac

SEQ ID NO: 722693 - RNA, 62 nt, Homo Sapiens
aaguagggaaggggguggccgugggcaacagaggaggggagccuuccaccgugggguugggg

SEQ ID NO: 722694 - RNA, 62 nt, Homo Sapiens
cuuuauuuauagaaaugacacgcagaagagggggaggggaagacacuuuauauacgaauaaa

SEQ ID NO: 722695 - RNA, 62 nt, Homo Sapiens
auucucugccccaggcuaauauuagggacuggggaggggaccaccagaggggagagggaagc

SEQ ID NO: 722696 - RNA, 62 nt, Homo Sapiens
caggccucagcaucucacauccaccaccuccaggaggggagaccacugguaaguccuccucc

SEQ ID NO: 722697 - RNA, 62 nt, Homo Sapiens
gcaggccaggagggccuccuuccugccacgagggaggggagucgggccccaggucgcccccg

SEQ ID NO: 722698 - RNA, 62 nt, Homo Sapiens
guccagagggucuucagaagccccccugggagggaggggaggaugagcacgcccagcucccc

SEQ ID NO: 722699 - RNA, 62 nt, Homo Sapiens
cuggcggagggagggaagaggagggagugacgggaggggaggaggucagcgaccuggggccg

SEQ ID NO: 722700 - RNA, 62 nt, Homo Sapiens
gcacuucuaguggucucaccuggaggcaagagggaggggacagaggcccugccacgucccgc

SEQ ID NO: 722701 - RNA, 62 nt, Homo Sapiens
cuggagguacugagacagggugcugaugggaaggaggggagccuuuggggggccacccgggg

SEQ ID NO: 722702 - RNA, 62 nt, Homo Sapiens
ccuuccucccaaaaguaucgggggcuggggcaggaggggagugaggcaggugacagugaggu

SEQ ID NO: 722703 - RNA, 62 nt, Homo Sapiens
uccucucuaaccuccuuuacccucaucugucuggaggggagcucugucuguccguguuauuu

SEQ ID NO: 722704 - RNA, 62 nt, Homo Sapiens
ucugaugguggcuggggcuggggugagcucagggaggggaagaggagaauacaugcagaguc

SEQ ID NO: 722705 - RNA, 62 nt, Homo Sapiens
gucaccugauauucuggccccaggggugggagggaggggagcuuggaaggcuaguccuguag

SEQ ID NO: 722706 - RNA, 62 nt, Homo Sapiens
cugaggacgcgugacauggugggcaccggaaaggaggggacuucuccugcaccccaagaagu

SEQ ID NO: 722707 - RNA, 62 nt, Homo Sapiens
uccccuggaccauccagggugcuagggggcagggaggggacacccccuccccgccuuuaccu

SEQ ID NO: 722708 - RNA, 62 nt, Homo Sapiens
ucuuccucucccuugucgccuucacuucuacaggaggggaaggggccagggaggggauucuc

SEQ ID NO: 722709 - RNA, 62 nt, Homo Sapiens
gccuucacuucuacaggaggggaaggggccagggaggggauucucccuuuaucaucaccuca

SEQ ID NO: 722710 - RNA, 62 nt, Homo Sapiens
aggguucagcagugacguagauugcccucugcggaggggaccuugcccccagaggagcaguc

SEQ ID NO: 722711 - RNA, 62 nt, Homo Sapiens
gugccacuuccagacaagacucacacccccaaggaggggacgaagagcuggcaaaaggagcc

SEQ ID NO: 722712 - RNA, 62 nt, Homo Sapiens
caucugguugccuuggaggcgaggggagauguggaggggacacugucacaacaauaagcagg

SEQ ID NO: 722713 - RNA, 62 nt, Homo Sapiens
uguggaggggacacaucuggaacaauaagcagggaggggagacccgucguaagaccugucac

SEQ ID NO: 722714 - RNA, 62 nt, Homo Sapiens
accuggggaaggaagaaugacaacagggcaggggaggggaagaguuccugacugugcaaggc

SEQ ID NO: 722715 - RNA, 62 nt, Homo Sapiens
ucuuuuucuaaaacacaaaacccccaagacugggaggggacucgaggccuaggccccugcca

SEQ ID NO: 722716 - RNA, 62 nt, Homo Sapiens
aaaaacucuauuuuuguaaaaaaaggggggugggaggggaagagcagaaacaaaaugaaaaa

SEQ ID NO: 722717 - RNA, 62 nt, Homo Sapiens
ugcuccugccagaagcuggugaggggaggccaggaggggagcucauuucacacccccgaagg

SEQ ID NO: 722718 - RNA, 62 nt, Homo Sapiens
ccaggaggggagcugcuccuacacccccgaagggaggggaggccacuccaucauuucauuuc

SEQ ID NO: 722719 - RNA, 62 nt, Homo Sapiens
aggcccguggcaggaggaggcccaugagagaaggaggggagcucccgaggcuacagcagacc

SEQ ID NO: 722720 - RNA, 62 nt, Homo Sapiens
auucuuggggcugagcuggguucucccugcgaggaggggagaugagggggccaggcgguggc

SEQ ID NO: 722721 - RNA, 62 nt, Homo Sapiens
gggaggcagaggaggaacauaaggaggggagaggaggggaaggaaaggaaggaaggaaggaa

SEQ ID NO: 722722 - RNA, 62 nt, Homo Sapiens
ggaggggaaggggaggcagaaaggaaggaaaaggaggggagagugcuccaaggaaaggaagg

SEQ ID NO: 722723 - RNA, 62 nt, Homo Sapiens
ccuccauucagguggaggucggcagggcagguggaggggagacuggaugcuuggguaacugg

SEQ ID NO: 722724 - RNA, 62 nt, Homo Sapiens
gggaagccuggguuuuuguaugggguggggacggaggggaaauaagcaauuacuuuucaugu

SEQ ID NO: 722725 - RNA, 62 nt, Homo Sapiens
ggggucccggauucuugggugguccccgaggaggaggggacugggaggcagguggacuccug

SEQ ID NO: 722726 - RNA, 62 nt, Homo Sapiens
ugccagggacuauucucaggcugaagaaggugggaggggagggcggaaccugaggagccacc

SEQ ID NO: 722727 - RNA, 62 nt, Homo Sapiens
uucuacggagaugcaggcagugccacgagggaggaggggaccugcaaagcuagaaucuaggg

SEQ ID NO: 722728 - RNA, 62 nt, Homo Sapiens
cacaucagaccuggggcaggugcgcaguguggggaggggauggggugcgucagggcccagca

SEQ ID NO: 722729 - RNA, 62 nt, Homo Sapiens
ccaaggcucuagaggguguucagguacacugaggaggggacggcuccgucuucacauugugc

SEQ ID NO: 722730 - RNA, 62 nt, Homo Sapiens
cugagaauccucggggcggucaggggaugucaggaggggaaggagccgcccucccuaucuug

SEQ ID NO: 722731 - RNA, 62 nt, Homo Sapiens
aaaagcucucugguuguaaccuggagacauguggaggggaauggcgaugggauuauaggacu

SEQ ID NO: 722732 - RNA, 62 nt, Homo Sapiens
uggggucccaggcagcgcugccugggggcuggggaggggaggcccagaggagggcuggccau

SEQ ID NO: 722733 - RNA, 62 nt, Homo Sapiens
cgcgcugacacagugaugggcugcccagggcuggaggggacgcuguuccucccgccgccacu

SEQ ID NO: 722734 - RNA, 62 nt, Homo Sapiens
cagaguuugggugcuggugguguggcuguaggggaggggagaccacacccaaggugggggcu

SEQ ID NO: 722735 - RNA, 62 nt, Homo Sapiens
ccccaucuggggacgauauggggagggagaugggaggggaaaggggagaggguuuuucucac

SEQ ID NO: 722736 - RNA, 62 nt, Homo Sapiens
cuggaauuagcuuggggccagggaagggacugggaggggagagaagagaaggagggaaggau

SEQ ID NO: 722737 - RNA, 62 nt, Homo Sapiens
uauguggaaguguguguggcagcaggcagcggggaggggaggaacagggaagggggagcugg

SEQ ID NO: 722738 - RNA, 62 nt, Homo Sapiens
ccacgggugucccugcccacucguguggcaagggaggggagggcaggagggcucggccugag

SEQ ID NO: 722739 - RNA, 62 nt, Homo Sapiens
agauggggucucagagcgagagcugcggagggggaggggaagaagaaggccucacuuuugcu

SEQ ID NO: 722740 - RNA, 62 nt, Homo Sapiens
ggaagggagaggcaagcugguggggguggcugggaggggaagccuuuucccgaggcuggggc

SEQ ID NO: 722741 - RNA, 62 nt, Homo Sapiens
gugcugggccugacauggcuagcuccaggucaggaggggaggccccauccccagcuagccca

SEQ ID NO: 722742 - RNA, 62 nt, Homo Sapiens
caggcguccuuggaggcagcaggguggagaauggaggggaacucccccaaaucgucauggaa

SEQ ID NO: 722743 - RNA, 62 nt, Homo Sapiens
aaaggcgucccucuuggcccgggggcaggcauggaggggagggcguuccugagggccagguc

SEQ ID NO: 722744 - RNA, 64 nt, Homo Sapiens
cugcauuguguauuaaacaccagguaauaugugcaaaaccgagggcuccaguaacaccuucuaa

SEQ ID NO: 722745 - RNA, 64 nt, Homo Sapiens
cucauucaucuagagguaaucuggcagucuugugaaaaccgaacacaacucagaaacuuggaau

SEQ ID NO: 722746 - RNA, 64 nt, Homo Sapiens; identical to SEQ ID NO: 125657

SEQ ID NO: 722747 - RNA, 64 nt, Homo Sapiens; identical to SEQ ID NO: 125658

SEQ ID NO: 722748 - RNA, 64 nt, Homo Sapiens; identical to SEQ ID NO: 125659

SEQ ID NO: 722749 - RNA, 64 nt, Homo Sapiens; identical to SEQ ID NO: 125660

SEQ ID NO: 722750 - RNA, 64 nt, Homo Sapiens; identical to SEQ ID NO: 125661

SEQ ID NO: 722751 - RNA, 64 nt, Homo Sapiens; identical to SEQ ID NO: 125662

SEQ ID NO: 722752 - RNA, 64 nt, Homo Sapiens; identical to SEQ ID NO: 125663

SEQ ID NO: 722753 - RNA, 64 nt, Homo Sapiens; identical to SEQ ID NO: 125664

SEQ ID NO: 722754 - RNA, 64 nt, Homo Sapiens; identical to SEQ ID NO: 125665

SEQ ID NO: 722755 - RNA, 64 nt, Homo Sapiens; identical to SEQ ID NO: 125666

SEQ ID NO: 722756 - RNA, 64 nt, Homo Sapiens; identical to SEQ ID NO: 645301

SEQ ID NO: 722757 - RNA, 64 nt, Homo Sapiens; identical to SEQ ID NO: 645302

SEQ ID NO: 722758 - RNA, 64 nt, Homo Sapiens; identical to SEQ ID NO: 645303

SEQ ID NO: 722759 - RNA, 64 nt, Homo Sapiens; identical to SEQ ID NO: 645304

SEQ ID NO: 722760 - RNA, 64 nt, Homo Sapiens; identical to SEQ ID NO: 645305

SEQ ID NO: 722761 - RNA, 64 nt, Homo Sapiens; identical to SEQ ID NO: 645306

SEQ ID NO: 722762 - RNA, 64 nt, Homo Sapiens; identical to SEQ ID NO: 645307

SEQ ID NO: 722763 - RNA, 64 nt, Homo Sapiens; identical to SEQ ID NO: 645308

SEQ ID NO: 722764 - RNA, 64 nt, Homo Sapiens; identical to SEQ ID NO: 645309

SEQ ID NO: 722765 - RNA, 64 nt, Homo Sapiens; identical to SEQ ID NO: 645310

SEQ ID NO: 722766 - RNA, 64 nt, Homo Sapiens; identical to SEQ ID NO: 645311

SEQ ID NO: 722767 - RNA, 64 nt, Homo Sapiens; identical to SEQ ID NO: 645312

SEQ ID NO: 722768 - RNA, 64 nt, Homo Sapiens; identical to SEQ ID NO: 645313

SEQ ID NO: 722769 - RNA, 64 nt, Homo Sapiens; identical to SEQ ID NO: 645314

SEQ ID NO: 722770 - RNA, 64 nt, Homo Sapiens; identical to SEQ ID NO: 645315

SEQ ID NO: 722771 - RNA, 64 nt, Homo Sapiens; identical to SEQ ID NO: 645316

SEQ ID NO: 722772 - RNA, 64 nt, Homo Sapiens; identical to SEQ ID NO: 645317

SEQ ID NO: 722773 - RNA, 64 nt, Homo Sapiens; identical to SEQ ID NO: 645318

SEQ ID NO: 722774 - RNA, 64 nt, Homo Sapiens; identical to SEQ ID NO: 645319

SEQ ID NO: 722775 - RNA, 64 nt, Homo Sapiens; identical to SEQ ID NO: 645320

SEQ ID NO: 722776 - RNA, 64 nt, Homo Sapiens; identical to SEQ ID NO: 645321

SEQ ID NO: 722777 - RNA, 64 nt, Homo Sapiens; identical to SEQ ID NO: 645322

SEQ ID NO: 722778 - RNA, 64 nt, Homo Sapiens; identical to SEQ ID NO: 645323

SEQ ID NO: 722779 - RNA, 64 nt, Homo Sapiens; identical to SEQ ID NO: 645324

SEQ ID NO: 722780 - RNA, 64 nt, Homo Sapiens; identical to SEQ ID NO: 645325

SEQ ID NO: 722781 - RNA, 64 nt, Homo Sapiens; identical to SEQ ID NO: 645326

SEQ ID NO: 722782 - RNA, 64 nt, Homo Sapiens; identical to SEQ ID NO: 645327

SEQ ID NO: 722783 - RNA, 64 nt, Homo Sapiens; identical to SEQ ID NO: 645328

SEQ ID NO: 722784 - RNA, 64 nt, Homo Sapiens; identical to SEQ ID NO: 645329

SEQ ID NO: 722785 - RNA, 64 nt, Homo Sapiens; identical to SEQ ID NO: 645330

SEQ ID NO: 722786 - RNA, 64 nt, Homo Sapiens; identical to SEQ ID NO: 645331

SEQ ID NO: 722787 - RNA, 64 nt, Homo Sapiens; identical to SEQ ID NO: 645332

SEQ ID NO: 722788 - RNA, 64 nt, Homo Sapiens; identical to SEQ ID NO: 645333

SEQ ID NO: 722789 - RNA, 64 nt, Homo Sapiens; identical to SEQ ID NO: 645334

SEQ ID NO: 722790 - RNA, 64 nt, Homo Sapiens; identical to SEQ ID NO: 645335

SEQ ID NO: 722791 - RNA, 64 nt, Homo Sapiens; identical to SEQ ID NO: 645336

SEQ ID NO: 722792 - RNA, 64 nt, Homo Sapiens; identical to SEQ ID NO: 645337

SEQ ID NO: 722793 - RNA, 64 nt, Homo Sapiens; identical to SEQ ID NO: 645338

SEQ ID NO: 722794 - RNA, 64 nt, Homo Sapiens; identical to SEQ ID NO: 645339

SEQ ID NO: 722795 - RNA, 64 nt, Homo Sapiens; identical to SEQ ID NO: 645340

SEQ ID NO: 722796 - RNA, 64 nt, Homo Sapiens; identical to SEQ ID NO: 645341

SEQ ID NO: 722797 - RNA, 64 nt, Homo Sapiens; identical to SEQ ID NO: 645342

SEQ ID NO: 722798 - RNA, 64 nt, Homo Sapiens; identical to SEQ ID NO: 645343

SEQ ID NO: 722799 - RNA, 64 nt, Homo Sapiens; identical to SEQ ID NO: 645344

SEQ ID NO: 722800 - RNA, 64 nt, Homo Sapiens; identical to SEQ ID NO: 645345

SEQ ID NO: 722801 - RNA, 64 nt, Homo Sapiens; identical to SEQ ID NO: 645346

SEQ ID NO: 722802 - RNA, 64 nt, Homo Sapiens; identical to SEQ ID NO: 645347

SEQ ID NO: 722803 - RNA, 64 nt, Homo Sapiens; identical to SEQ ID NO: 645348

SEQ ID NO: 722804 - RNA, 64 nt, Homo Sapiens; identical to SEQ ID NO: 645349

SEQ ID NO: 722805 - RNA, 64 nt, Homo Sapiens; identical to SEQ ID NO: 645350

SEQ ID NO: 722806 - RNA, 64 nt, Homo Sapiens
cucggacaggugcuaucgaaagcauuuuugaaaagggagaaagaggacaaugacguugaaacgc

SEQ ID NO: 722807 - RNA, 64 nt, Homo Sapiens
aucugcuccaaggagggaggcggccccucgcugggggagaaagcgcaccgccgccgucgucucc

SEQ ID NO: 722808 - RNA, 64 nt, Homo Sapiens
uccccugauauccaaccgugauuuuggaucacaugggagaaaaagucauccaguuuuucauguu

SEQ ID NO: 722809 - RNA, 64 nt, Homo Sapiens
uguuuucugugucuagugccaauuagcuaaaucagggagaaagaaaugaucacaugacuuuuag

SEQ ID NO: 722810 - RNA, 64 nt, Homo Sapiens
acugucuaaguuuauguugcauuuuuagucaaaagggagaaaucuuauuccuucuugaaaauuu

SEQ ID NO: 722811 - RNA, 64 nt, Homo Sapiens
auguggggugaaaugggaguagggggguggacaggggagaaacgaaaaccacaaaaagaaaacc

SEQ ID NO: 722812 - RNA, 64 nt, Homo Sapiens
uacaggguggugucagucaaggucuuucaggugggggagaaauugguuagggcucccacugcca

SEQ ID NO: 722813 - RNA, 64 nt, Homo Sapiens
ugaaaagacaguugugugcauggaugugugcguggggagaaagaacguggguaagaugucccuu

SEQ ID NO: 722814 - RNA, 64 nt, Homo Sapiens
cagucccacuccugucaccccacgcucugcacuggggagaaaacgggaggugcucgugcuggcc

SEQ ID NO: 722815 - RNA, 64 nt, Homo Sapiens
caggacaggagugaacucaaucuggaccugcacugggagaaauuuuucugccacaucucgcccu

SEQ ID NO: 722816 - RNA, 64 nt, Homo Sapiens
aaggcugaagagucagguugccagugacaguacugggagaaaccagcauuaaaguuccuaagac

SEQ ID NO: 722817 - RNA, 64 nt, Homo Sapiens
aagagaaguuuuguuuuuguaaauacucauaauagggagaaaccgaccuaauguaauaauagaa

SEQ ID NO: 722818 - RNA, 64 nt, Homo Sapiens
auauauaccacuuucccagaacaaaauaaauguugggagaaaugaccugucuccuuucucagcc

SEQ ID NO: 722819 - RNA, 64 nt, Homo Sapiens
cuucuuggcagcuuaacauugacuucuugguuuggggagaaauaaauuuuguuucagaauuuug

SEQ ID NO: 722820 - RNA, 64 nt, Homo Sapiens
uaggaauccuuugagaaugugauuccuuuugauggggagaaagggcaaauuauuuuaauauuuu

SEQ ID NO: 722821 - RNA, 64 nt, Homo Sapiens
auuuuuuaaguaguguuauaugcuaaaauaauuugggagaaaauauuauuaaacuagucaaaaa

SEQ ID NO: 722822 - RNA, 64 nt, Homo Sapiens
cgcugcugcugagauggacuuugggaaugaaugugggagaaaaucuucuacacaucugccuaac

SEQ ID NO: 722823 - RNA, 64 nt, Homo Sapiens
gcuuaaggacaugcuaggggauugugaaaagcuggggagaaaauauuacagccuuagaagaaag

SEQ ID NO: 722824 - RNA, 64 nt, Homo Sapiens
uaaucaugccuauuaaggauaauuuggaaaauuugggagaaaucgguuacauugaaagaaaguu

SEQ ID NO: 722825 - RNA, 64 nt, Homo Sapiens
cucccucugugggaggcacuuaacuagugacggagggagaaaucgucaaaaaugacuaaaaaua

SEQ ID NO: 722826 - RNA, 64 nt, Homo Sapiens
uauaucagauucuuggcugcugugauaagcaaacgggagaaauuaauuuuuaugaaauacugcg

SEQ ID NO: 722827 - RNA, 64 nt, Homo Sapiens
uuucuuucccaagcuccuagccaacacuauccuugggagaaagaaauuugcagaaacugcuaag

SEQ ID NO: 722828 - RNA, 64 nt, Homo Sapiens
gaaccuugcuguugcucugaggagauauaauucugggagaaagaaucuuuuauaagaacaguac

SEQ ID NO: 722829 - RNA, 64 nt, Homo Sapiens
uaagucagcuagggauucuugcagucucagcugagggagaaagguagggcugugccuucuaaag

SEQ ID NO: 722830 - RNA, 64 nt, Homo Sapiens
cuauguagagaauauucugcuagguggaaaaguugggagaaaggggaauaugcaucuuuauucu

SEQ ID NO: 722831 - RNA, 64 nt, Homo Sapiens
gguggcuaucccuucugcuucacgcagcagucaggggagaaaauccugccuguccugugcccac

SEQ ID NO: 722832 - RNA, 64 nt, Homo Sapiens
acccagccuccucagaccccccccagggcgcuuagggagaaaugccaucgaccagcaagcccag

SEQ ID NO: 722833 - RNA, 64 nt, Homo Sapiens
gucaucaucgauucuacuuuuauggggcugaacggggagaaaagaagaggggaaaaugaguuuu

SEQ ID NO: 722834 - RNA, 64 nt, Homo Sapiens
acuuguaaguugcuaaacgagcuugcucuucagugggagaaaaccugcagaacguauuggucca

SEQ ID NO: 722835 - RNA, 64 nt, Homo Sapiens
ugugggagugaaaugguauucacacuuucaugaugggagaaaaaauagagaaaccaaccugaua

SEQ ID NO: 722836 - RNA, 64 nt, Homo Sapiens
aucauaggacugggaauuguaguucucagaagaagggagaaaugauuaagugccauauauaauu

SEQ ID NO: 722837 - RNA, 64 nt, Homo Sapiens
ggaugucuuucaggauuauuuucaaaucauuggggggagaaaaauuggcaggaaaaaugcagcu

SEQ ID NO: 722838 - RNA, 64 nt, Homo Sapiens
ggaauguuuuaacugcagccaaagauggaaggaagggagaaauuuugagaaucaaucaauaaag

SEQ ID NO: 722839 - RNA, 64 nt, Homo Sapiens
acauguuuucuauuuucuuugaaaggucacuaaagggagaaaugaaaccagguaauugaaugaa

SEQ ID NO: 722840 - RNA, 64 nt, Homo Sapiens
acaaucacuggucuugucuacaggggcuccaacagggagaaaaagccaucuuaaucacagaccu

SEQ ID NO: 722841 - RNA, 64 nt, Homo Sapiens
ccccacaacugaccccugccgagcccaaggguaggggagaaaccaauauugaauccaaggaaga

SEQ ID NO: 722842 - RNA, 64 nt, Homo Sapiens
cgugagaggauguguguggcggcguucagaaggagggagaaaacauuccagggccagcaaagcc

SEQ ID NO: 722843 - RNA, 64 nt, Homo Sapiens
acucagggcacaaaauauuggucgagaagccagggggagaaagaaaauacucaaccaaaagaca

SEQ ID NO: 722844 - RNA, 64 nt, Homo Sapiens
agcccaaguagguuauuuguacagagggaacuuugggagaaagcgaucaaguugucauuuuaga

SEQ ID NO: 722845 - RNA, 64 nt, Homo Sapiens
ucaucccucacucuucaugugagaagucacacaggggagaaacccuaugaauguaauaaaugug

SEQ ID NO: 722846 - RNA, 64 nt, Homo Sapiens
acuggaauuugaaaagccaaacugugaaaccauugggagaaaauagaugauauugucuaugacg

SEQ ID NO: 722847 - RNA, 64 nt, Homo Sapiens
uuucucuccugcagaaggaaagccacgcaaguuggggagaaaacccccaaggaugaaucugcca

SEQ ID NO: 722848 - RNA, 64 nt, Homo Sapiens
ccauuuuuuuuaccccuuggaggaaauaagaugagggagaaaggagaaggggaggaaacuucuc

SEQ ID NO: 722849 - RNA, 64 nt, Homo Sapiens
cuauaaauguaaaugugggaaaggacucacacuagggagaaaauauuggauuucaaagacauga

SEQ ID NO: 722850 - RNA, 64 nt, Homo Sapiens
guaugaauguaagcaguguuaagaacacguacuggggagaaacuaguucuuaucuaagacauga

SEQ ID NO: 722851 - RNA, 64 nt, Homo Sapiens
ugagucucagagcaggggagacucuguuuuccaggggagaaaccucagacaggcugggggccuc

SEQ ID NO: 722852 - RNA, 64 nt, Homo Sapiens
uguacucuguccagacaugaggaaaggggagagggggagaaaacauggaggucagagccacaag

SEQ ID NO: 722853 - RNA, 64 nt, Homo Sapiens
cucccacaggccucucuuucuuucuagguugcuggggagaaauggguacccuaugaucccccuc

SEQ ID NO: 722854 - RNA, 64 nt, Homo Sapiens
uucugauuguuagacuguaaugcuauuccucuaugggagaaaaaaauuaauauaaagaaaaaca

SEQ ID NO: 722855 - RNA, 64 nt, Homo Sapiens
acuugcccacaguuccacagacuaaggcuccuaggggagaaauccaccauuuacugaugaggaa

SEQ ID NO: 722856 - RNA, 64 nt, Homo Sapiens
aacuugcaaaaaaaaaaaauaaggugugacuucagggagaaacaauuuuaaaugguaggaauuu

SEQ ID NO: 722857 - RNA, 64 nt, Homo Sapiens
cacuucaaaugacaaguucauauauagaauuuacgggagaaacuugagaccauuuacggggaga

SEQ ID NO: 722858 - RNA, 64 nt, Homo Sapiens
uagaauuuacgggagaaacuugagaccauuuacggggagaaacuugauucugggaagauagcag

SEQ ID NO: 722859 - RNA, 64 nt, Homo Sapiens
cuagggcuaguacuuaguuucacacccgggagcugggagaaaaaaccuguacaguugucuuucu

SEQ ID NO: 722860 - RNA, 64 nt, Homo Sapiens
uuguaauuuuaaaacuuuaaaauaaauuggaaaagggagaaacugagcgguguauuuuuccuca

SEQ ID NO: 722861 - RNA, 64 nt, Homo Sapiens
gggggauggcuaagaaagcugccccguggggaaggggagaaaguaugaccugcagccaagccca

SEQ ID NO: 722862 - RNA, 64 nt, Homo Sapiens
gaagacaagagccugaugcccaggguucccaggagggagaaagauuucuccccuuuugcuugag

SEQ ID NO: 722863 - RNA, 64 nt, Homo Sapiens; identical to SEQ ID NO: 83374

SEQ ID NO: 722864 - RNA, 64 nt, Homo Sapiens; identical to SEQ ID NO: 83375

SEQ ID NO: 722865 - RNA, 64 nt, Homo Sapiens; identical to SEQ ID NO: 83376

SEQ ID NO: 722866 - RNA, 64 nt, Homo Sapiens; identical to SEQ ID NO: 83377

SEQ ID NO: 722867 - RNA, 64 nt, Homo Sapiens; identical to SEQ ID NO: 83378

SEQ ID NO: 722868 - RNA, 64 nt, Homo Sapiens; identical to SEQ ID NO: 83379

SEQ ID NO: 722869 - RNA, 64 nt, Homo Sapiens; identical to SEQ ID NO: 211561

SEQ ID NO: 722870 - RNA, 64 nt, Homo Sapiens; identical to SEQ ID NO: 211562

SEQ ID NO: 722871 - RNA, 64 nt, Homo Sapiens
aaaugaaugguuuguauauguguauaaacccaauacaggaaauagcauuuguaucuugcaaguu

SEQ ID NO: 722872 - RNA, 64 nt, Homo Sapiens
gauuuuucagggccuuccaugccuuucucccuccacaggaaacaucucucucucuuucucccaa

SEQ ID NO: 722873 - RNA, 64 nt, Homo Sapiens
cauguuugaucuguugucacaaaccaaacaggaaacaggaaaugaccugagaggcagacagauc

SEQ ID NO: 722874 - RNA, 64 nt, Homo Sapiens
ggaaaugcauguuugaucugacagaucaaaccaaacaggaaacaauaagucaccugagaggcag

SEQ ID NO: 722875 - RNA, 64 nt, Homo Sapiens
guuacauaauggaauuaggcauguggaacaccaaacaggaaagaacuaugucugaaauauaaaa

SEQ ID NO: 722876 - RNA, 64 nt, Homo Sapiens
cauaugugugauuuuaaacgaauauucucagaccacaggaaacucuucaucccccuguuguuua

SEQ ID NO: 722877 - RNA, 64 nt, Homo Sapiens
uuguuaggcuugagugaggucuguuugggggaaaacaggaaaucggcaggauggagaacagugc

SEQ ID NO: 722878 - RNA, 64 nt, Homo Sapiens
agggccuggaaagcgcaguggauucuccugugccacaggaaaaguagcucaucucacucacucu

SEQ ID NO: 722879 - RNA, 62 nt, Homo Sapiens
aaagagagggauggagucaaacaaaaaaccacauacaggaaauugucuugaaaaaaaaaaaa

SEQ ID NO: 722880 - RNA, 64 nt, Homo Sapiens
cgaggcaggcagaucacuuuuaacauuagaacauacaggaaaaaggcaaaggggaucccugaaa

SEQ ID NO: 722881 - RNA, 64 nt, Homo Sapiens
cagaucuugugagacuuacuaucacgagaauagcacaggaaagacuggcccccaugauucaauu

SEQ ID NO: 722882 - RNA, 64 nt, Homo Sapiens
cagaucucaugagacuuacuaucaugagaauagcacaggaaagacuggccccccugauucgaug

SEQ ID NO: 722883 - RNA, 64 nt, Homo Sapiens
cuuccagacauacgaaacacaaaccacaacugacacaggaaaccaacacccaaagcauggacua

SEQ ID NO: 722884 - RNA, 64 nt, Homo Sapiens
aaccaacacccaaagcauggacuaaccccaacgcacaggaaaagguagcuuaccugacacaaga

SEQ ID NO: 722885 - RNA, 64 nt, Homo Sapiens
ccuccucauucaacacagggcuggagguucuacaacaggaaaucaggccuacagcauccugugu

SEQ ID NO: 722886 - RNA, 64 nt, Homo Sapiens
cugauucuucaaagucacccuaaaagaagaucugacaggaaagcuguauaaugagauagaaaaa

SEQ ID NO: 722887 - RNA, 64 nt, Homo Sapiens
caucucauccugugggauucugcaaucauaaaacacaggaaaggggaauucugugauggcaaau

SEQ ID NO: 722888 - RNA, 64 nt, Homo Sapiens
gauggauagaaaaaaagcacuuacauuggggcacacaggaaaucccagugucuagcaaugguuu

SEQ ID NO: 722889 - RNA, 64 nt, Homo Sapiens
gguuggagcagugcuuuucacacuguggaucacgacaggaaaaauuaauguugcccacauuaag

SEQ ID NO: 722890 - RNA, 64 nt, Homo Sapiens
gggaaucucauaggaagagccugaccaacgcacaacaggaaacuggaccuccaaacuuauagcg

SEQ ID NO: 722891 - RNA, 64 nt, Homo Sapiens
uagcagauuauccauuucaauuuuuuuuuacuccacaggaaaauguaagcuacuuugucauaga

SEQ ID NO: 722892 - RNA, 64 nt, Homo Sapiens
agaauucacuucuucuuguaaaaauaaguaauuuacaggaaaggcaaaaugcuaauacuaacau

SEQ ID NO: 722893 - RNA, 64 nt, Homo Sapiens
ugacuuggaccuuuucaggaguggcgcggauguuacaggaaaugcugucggagagcgcgcauuc

SEQ ID NO: 722894 - RNA, 64 nt, Homo Sapiens
agcuccccaaaugccuacuggauccuacagccauacaggaaaacagacggacacagcccuuucc

SEQ ID NO: 722895 - RNA, 64 nt, Homo Sapiens
uugguucuuuuccuucugccuuuuugggaaagagacaggaaagauucacuugaaaacauaaaug

SEQ ID NO: 722896 - RNA, 64 nt, Homo Sapiens
uauuuuuauuauuaaaaauguaacaauuuaacccacaggaaaaaaaauuacuuuguaugcuugu

SEQ ID NO: 722897 - RNA, 64 nt, Homo Sapiens
acugguaauggaaaaaaugugaauguaacugugcacaggaaauggaggggggagcagguuuuau

SEQ ID NO: 722898 - RNA, 64 nt, Homo Sapiens
cagcgaaaccugcacccucugacccacugaccacacaggaaaagauagccugaugucccacauu

SEQ ID NO: 722899 - RNA, 64 nt, Homo Sapiens
gaaaagugugcgcuccauucaaauuaauauaggcacaggaaagaacagagauuagggggacuua

SEQ ID NO: 722900 - RNA, 64 nt, Homo Sapiens
ccuaauuuauaaauuaaacuuuagauauguauguacaggaaaaaauguaguauauaguaucgua

SEQ ID NO: 722901 - RNA, 64 nt, Homo Sapiens
ggaaaaaauguaguauauaguaucguauauauguacaggaaaaaaacguacuaucugugguuuc

SEQ ID NO: 722902 - RNA, 64 nt, Homo Sapiens
uuuuuuaaaaauuuuaaucaauauuuuugcagauacaggaaaaacagagaguucauacuaaaac

SEQ ID NO: 722903 - RNA, 64 nt, Homo Sapiens
auuuauacuugagaaauauuaugcucacaccuucacaggaaagcugugacaaaacuuuuaacua

SEQ ID NO: 722904 - RNA, 64 nt, Homo Sapiens
auauauauagauauauagagauauagauauauauacaggaaacaccgcauccuugcacugcugc

SEQ ID NO: 722905 - RNA, 64 nt, Homo Sapiens
cggaugugcuuugaaguuauguauauuacauauaacaggaaaaaauauuaaaauaaacagugcu

SEQ ID NO: 722906 - RNA, 64 nt, Homo Sapiens
ccagggaggccuggccuggaggaggaguccacuaacaggaaacacuucucacccccucacacag

SEQ ID NO: 722907 - RNA, 64 nt, Homo Sapiens
gggagccccuggagggaaauuccuuggcaggggaacaggaaauguggccgccucugccccacug

SEQ ID NO: 722908 - RNA, 64 nt, Homo Sapiens; identical to SEQ ID NO: 97088

SEQ ID NO: 722909 - RNA, 64 nt, Homo Sapiens; identical to SEQ ID NO: 97089

SEQ ID NO: 722910 - RNA, 64 nt, Homo Sapiens; identical to SEQ ID NO: 97090

SEQ ID NO: 722911 - RNA, 52 nt, Homo Sapiens; identical to SEQ ID NO: 97091

SEQ ID NO: 722912 - RNA, 64 nt, Homo Sapiens; identical to SEQ ID NO: 97092

SEQ ID NO: 722913 - RNA, 64 nt, Homo Sapiens; identical to SEQ ID NO: 97093

SEQ ID NO: 722914 - RNA, 64 nt, Homo Sapiens; identical to SEQ ID NO: 97094

SEQ ID NO: 722915 - RNA, 64 nt, Homo Sapiens; identical to SEQ ID NO: 97095

SEQ ID NO: 722916 - RNA, 64 nt, Homo Sapiens; identical to SEQ ID NO: 97096

SEQ ID NO: 722917 - RNA, 64 nt, Homo Sapiens; identical to SEQ ID NO: 97097

SEQ ID NO: 722918 - RNA, 64 nt, Homo Sapiens; identical to SEQ ID NO: 97098

SEQ ID NO: 722919 - RNA, 64 nt, Homo Sapiens; identical to SEQ ID NO: 97099

SEQ ID NO: 722920 - RNA, 64 nt, Homo Sapiens; identical to SEQ ID NO: 97100

SEQ ID NO: 722921 - RNA, 64 nt, Homo Sapiens; identical to SEQ ID NO: 97101

SEQ ID NO: 722922 - RNA, 64 nt, Homo Sapiens; identical to SEQ ID NO: 97102

SEQ ID NO: 722923 - RNA, 64 nt, Homo Sapiens; identical to SEQ ID NO: 97103

SEQ ID NO: 722924 - RNA, 64 nt, Homo Sapiens; identical to SEQ ID NO: 97104

SEQ ID NO: 722925 - RNA, 64 nt, Homo Sapiens; identical to SEQ ID NO: 97105

SEQ ID NO: 722926 - RNA, 64 nt, Homo Sapiens; identical to SEQ ID NO: 97106

SEQ ID NO: 722927 - RNA, 64 nt, Homo Sapiens; identical to SEQ ID NO: 97107

SEQ ID NO: 722928 - RNA, 64 nt, Homo Sapiens; identical to SEQ ID NO: 97108

SEQ ID NO: 722929 - RNA, 64 nt, Homo Sapiens; identical to SEQ ID NO: 97109

SEQ ID NO: 722930 - RNA, 64 nt, Homo Sapiens; identical to SEQ ID NO: 97110

SEQ ID NO: 722931 - RNA, 64 nt, Homo Sapiens; identical to SEQ ID NO: 97111

SEQ ID NO: 722932 - RNA, 64 nt, Homo Sapiens; identical to SEQ ID NO: 97112

SEQ ID NO: 722933 - RNA, 64 nt, Homo Sapiens; identical to SEQ ID NO: 97113

SEQ ID NO: 722934 - RNA, 64 nt, Homo Sapiens; identical to SEQ ID NO: 97114

SEQ ID NO: 722935 - RNA, 64 nt, Homo Sapiens; identical to SEQ ID NO: 97115

SEQ ID NO: 722936 - RNA, 64 nt, Homo Sapiens; identical to SEQ ID NO: 97116

SEQ ID NO: 722937 - RNA, 64 nt, Homo Sapiens; identical to SEQ ID NO: 97117

SEQ ID NO: 722938 - RNA, 64 nt, Homo Sapiens; identical to SEQ ID NO: 97118

SEQ ID NO: 722939 - RNA, 64 nt, Homo Sapiens; identical to SEQ ID NO: 97119

SEQ ID NO: 722940 - RNA, 64 nt, Homo Sapiens; identical to SEQ ID NO: 97120

SEQ ID NO: 722941 - RNA, 64 nt, Homo Sapiens; identical to SEQ ID NO: 97121

SEQ ID NO: 722942 - RNA, 64 nt, Homo Sapiens; identical to SEQ ID NO: 97122

SEQ ID NO: 722943 - RNA, 64 nt, Homo Sapiens; identical to SEQ ID NO: 97123

SEQ ID NO: 722944 - RNA, 64 nt, Homo Sapiens; identical to SEQ ID NO: 97124

SEQ ID NO: 722945 - RNA, 64 nt, Homo Sapiens; identical to SEQ ID NO: 97125

SEQ ID NO: 722946 - RNA, 64 nt, Homo Sapiens; identical to SEQ ID NO: 97126

SEQ ID NO: 722947 - RNA, 64 nt, Homo Sapiens; identical to SEQ ID NO: 97127

SEQ ID NO: 722948 - RNA, 64 nt, Homo Sapiens; identical to SEQ ID NO: 97128

SEQ ID NO: 722949 - RNA, 64 nt, Homo Sapiens; identical to SEQ ID NO: 97129

SEQ ID NO: 722950 - RNA, 64 nt, Homo Sapiens; identical to SEQ ID NO: 97130

SEQ ID NO: 722951 - RNA, 64 nt, Homo Sapiens; identical to SEQ ID NO: 97131

SEQ ID NO: 722952 - RNA, 64 nt, Homo Sapiens; identical to SEQ ID NO: 97132

SEQ ID NO: 722953 - RNA, 64 nt, Homo Sapiens; identical to SEQ ID NO: 97133

SEQ ID NO: 722954 - RNA, 64 nt, Homo Sapiens; identical to SEQ ID NO: 82841

SEQ ID NO: 722955 - RNA, 64 nt, Homo Sapiens; identical to SEQ ID NO: 82842

SEQ ID NO: 722956 - RNA, 64 nt, Homo Sapiens; identical to SEQ ID NO: 82843

SEQ ID NO: 722957 - RNA, 64 nt, Homo Sapiens; identical to SEQ ID NO: 82844

SEQ ID NO: 722958 - RNA, 64 nt, Homo Sapiens; identical to SEQ ID NO: 82845

SEQ ID NO: 722959 - RNA, 64 nt, Homo Sapiens; identical to SEQ ID NO: 82846

SEQ ID NO: 722960 - RNA, 64 nt, Homo Sapiens; identical to SEQ ID NO: 82847

SEQ ID NO: 722961 - RNA, 64 nt, Homo Sapiens; identical to SEQ ID NO: 82848

SEQ ID NO: 722962 - RNA, 64 nt, Homo Sapiens; identical to SEQ ID NO: 82849

SEQ ID NO: 722963 - RNA, 64 nt, Homo Sapiens; identical to SEQ ID NO: 82850

SEQ ID NO: 722964 - RNA, 64 nt, Homo Sapiens; identical to SEQ ID NO: 664057

SEQ ID NO: 722965 - RNA, 64 nt, Homo Sapiens; identical to SEQ ID NO: 664058

SEQ ID NO: 722966 - RNA, 64 nt, Homo Sapiens; identical to SEQ ID NO: 664059

SEQ ID NO: 722967 - RNA, 64 nt, Homo Sapiens; identical to SEQ ID NO: 664060

SEQ ID NO: 722968 - RNA, 64 nt, Homo Sapiens; identical to SEQ ID NO: 664061

SEQ ID NO: 722969 - RNA, 64 nt, Homo Sapiens; identical to SEQ ID NO: 664062

SEQ ID NO: 722970 - RNA, 64 nt, Homo Sapiens; identical to SEQ ID NO: 664063

SEQ ID NO: 722971 - RNA, 64 nt, Homo Sapiens; identical to SEQ ID NO: 664064

SEQ ID NO: 722972 - RNA, 64 nt, Homo Sapiens; identical to SEQ ID NO: 664065

SEQ ID NO: 722973 - RNA, 64 nt, Homo Sapiens; identical to SEQ ID NO: 664066

SEQ ID NO: 722974 - RNA, 64 nt, Homo Sapiens; identical to SEQ ID NO: 664067

SEQ ID NO: 722975 - RNA, 64 nt, Homo Sapiens; identical to SEQ ID NO: 664068

SEQ ID NO: 722976 - RNA, 64 nt, Homo Sapiens; identical to SEQ ID NO: 664069

SEQ ID NO: 722977 - RNA, 64 nt, Homo Sapiens; identical to SEQ ID NO: 664070

SEQ ID NO: 722978 - RNA, 64 nt, Homo Sapiens; identical to SEQ ID NO: 664071

SEQ ID NO: 722979 - RNA, 64 nt, Homo Sapiens; identical to SEQ ID NO: 664072

SEQ ID NO: 722980 - RNA, 64 nt, Homo Sapiens; identical to SEQ ID NO: 664073

SEQ ID NO: 722981 - RNA, 64 nt, Homo Sapiens; identical to SEQ ID NO: 664074

SEQ ID NO: 722982 - RNA, 64 nt, Homo Sapiens; identical to SEQ ID NO: 664075

SEQ ID NO: 722983 - RNA, 64 nt, Homo Sapiens; identical to SEQ ID NO: 664076

SEQ ID NO: 722984 - RNA, 64 nt, Homo Sapiens; identical to SEQ ID NO: 664077

SEQ ID NO: 722985 - RNA, 58 nt, Homo Sapiens; identical to SEQ ID NO: 664078

SEQ ID NO: 722986 - RNA, 64 nt, Homo Sapiens; identical to SEQ ID NO: 664079

SEQ ID NO: 722987 - RNA, 64 nt, Homo Sapiens; identical to SEQ ID NO: 246508

SEQ ID NO: 722988 - RNA, 64 nt, Homo Sapiens; identical to SEQ ID NO: 246509

SEQ ID NO: 722989 - RNA, 64 nt, Homo Sapiens; identical to SEQ ID NO: 246510

SEQ ID NO: 722990 - RNA, 64 nt, Homo Sapiens; identical to SEQ ID NO: 246511

SEQ ID NO: 722991 - RNA, 64 nt, Homo Sapiens; identical to SEQ ID NO: 246512

SEQ ID NO: 722992 - RNA, 64 nt, Homo Sapiens; identical to SEQ ID NO: 246513

SEQ ID NO: 722993 - RNA, 64 nt, Homo Sapiens; identical to SEQ ID NO: 246514

SEQ ID NO: 722994 - RNA, 64 nt, Homo Sapiens; identical to SEQ ID NO: 246515

SEQ ID NO: 722995 - RNA, 64 nt, Homo Sapiens; identical to SEQ ID NO: 246516

SEQ ID NO: 722996 - RNA, 64 nt, Homo Sapiens; identical to SEQ ID NO: 246517

SEQ ID NO: 722997 - RNA, 64 nt, Homo Sapiens; identical to SEQ ID NO: 246518

SEQ ID NO: 722998 - RNA, 64 nt, Homo Sapiens; identical to SEQ ID NO: 246519

SEQ ID NO: 722999 - RNA, 64 nt, Homo Sapiens; identical to SEQ ID NO: 246520

SEQ ID NO: 723000 - RNA, 64 nt, Homo Sapiens; identical to SEQ ID NO: 246521

SEQ ID NO: 723001 - RNA, 64 nt, Homo Sapiens; identical to SEQ ID NO: 246522

SEQ ID NO: 723002 - RNA, 64 nt, Homo Sapiens; identical to SEQ ID NO: 246523

SEQ ID NO: 723003 - RNA, 64 nt, Homo Sapiens; identical to SEQ ID NO: 246524

SEQ ID NO: 723004 - RNA, 64 nt, Homo Sapiens; identical to SEQ ID NO: 246525

SEQ ID NO: 723005 - RNA, 64 nt, Homo Sapiens; identical to SEQ ID NO: 80686

SEQ ID NO: 723006 - RNA, 64 nt, Homo Sapiens; identical to SEQ ID NO: 80687

SEQ ID NO: 723007 - RNA, 64 nt, Homo Sapiens; identical to SEQ ID NO: 80688

SEQ ID NO: 723008 - RNA, 64 nt, Homo Sapiens; identical to SEQ ID NO: 80689

SEQ ID NO: 723009 - RNA, 64 nt, Homo Sapiens; identical to SEQ ID NO: 80690

SEQ ID NO: 723010 - RNA, 64 nt, Homo Sapiens; identical to SEQ ID NO: 80691

SEQ ID NO: 723011 - RNA, 64 nt, Homo Sapiens; identical to SEQ ID NO: 80692

SEQ ID NO: 723012 - RNA, 64 nt, Homo Sapiens; identical to SEQ ID NO: 80693

SEQ ID NO: 723013 - RNA, 64 nt, Homo Sapiens; identical to SEQ ID NO: 80694

SEQ ID NO: 723014 - RNA, 50 nt, Homo Sapiens; identical to SEQ ID NO: 80695

SEQ ID NO: 723015 - RNA, 64 nt, Homo Sapiens; identical to SEQ ID NO: 80696

SEQ ID NO: 723016 - RNA, 64 nt, Homo Sapiens; identical to SEQ ID NO: 80697

SEQ ID NO: 723017 - RNA, 64 nt, Homo Sapiens; identical to SEQ ID NO: 80698

SEQ ID NO: 723018 - RNA, 64 nt, Homo Sapiens; identical to SEQ ID NO: 80699

SEQ ID NO: 723019 - RNA, 64 nt, Homo Sapiens; identical to SEQ ID NO: 80700

SEQ ID NO: 723020 - RNA, 64 nt, Homo Sapiens; identical to SEQ ID NO: 80701

SEQ ID NO: 723021 - RNA, 64 nt, Homo Sapiens; identical to SEQ ID NO: 80702

SEQ ID NO: 723022 - RNA, 64 nt, Homo Sapiens; identical to SEQ ID NO: 80703

SEQ ID NO: 723023 - RNA, 64 nt, Homo Sapiens; identical to SEQ ID NO: 80704

SEQ ID NO: 723024 - RNA, 64 nt, Homo Sapiens; identical to SEQ ID NO: 80705

SEQ ID NO: 723025 - RNA, 64 nt, Homo Sapiens; identical to SEQ ID NO: 80706

SEQ ID NO: 723026 - RNA, 64 nt, Homo Sapiens; identical to SEQ ID NO: 80707

SEQ ID NO: 723027 - RNA, 64 nt, Homo Sapiens; identical to SEQ ID NO: 80708

SEQ ID NO: 723028 - RNA, 64 nt, Homo Sapiens; identical to SEQ ID NO: 80709

SEQ ID NO: 723029 - RNA, 64 nt, Homo Sapiens; identical to SEQ ID NO: 80710

SEQ ID NO: 723030 - RNA, 64 nt, Homo Sapiens; identical to SEQ ID NO: 80711

SEQ ID NO: 723031 - RNA, 64 nt, Homo Sapiens; identical to SEQ ID NO: 80712

SEQ ID NO: 723032 - RNA, 64 nt, Homo Sapiens; identical to SEQ ID NO: 80713

SEQ ID NO: 723033 - RNA, 64 nt, Homo Sapiens; identical to SEQ ID NO: 80714

SEQ ID NO: 723034 - RNA, 64 nt, Homo Sapiens; identical to SEQ ID NO: 80715

SEQ ID NO: 723035 - RNA, 53 nt, Homo Sapiens; identical to SEQ ID NO: 80716

SEQ ID NO: 723036 - RNA, 64 nt, Homo Sapiens; identical to SEQ ID NO: 80717

SEQ ID NO: 723037 - RNA, 64 nt, Homo Sapiens; identical to SEQ ID NO: 80718

SEQ ID NO: 723038 - RNA, 64 nt, Homo Sapiens; identical to SEQ ID NO: 80719

SEQ ID NO: 723039 - RNA, 64 nt, Homo Sapiens; identical to SEQ ID NO: 80720

SEQ ID NO: 723040 - RNA, 64 nt, Homo Sapiens; identical to SEQ ID NO: 80721

SEQ ID NO: 723041 - RNA, 64 nt, Homo Sapiens; identical to SEQ ID NO: 80722

SEQ ID NO: 723042 - RNA, 64 nt, Homo Sapiens; identical to SEQ ID NO: 80723

SEQ ID NO: 723043 - RNA, 64 nt, Homo Sapiens; identical to SEQ ID NO: 80724

SEQ ID NO: 723044 - RNA, 64 nt, Homo Sapiens; identical to SEQ ID NO: 80725

SEQ ID NO: 723045 - RNA, 64 nt, Homo Sapiens; identical to SEQ ID NO: 80726

SEQ ID NO: 723046 - RNA, 52 nt, Homo Sapiens; identical to SEQ ID NO: 80727

SEQ ID NO: 723047 - RNA, 64 nt, Homo Sapiens; identical to SEQ ID NO: 80728

SEQ ID NO: 723048 - RNA, 64 nt, Homo Sapiens; identical to SEQ ID NO: 80729

SEQ ID NO: 723049 - RNA, 64 nt, Homo Sapiens; identical to SEQ ID NO: 80730

SEQ ID NO: 723050 - RNA, 64 nt, Homo Sapiens; identical to SEQ ID NO: 80731

SEQ ID NO: 723051 - RNA, 64 nt, Homo Sapiens; identical to SEQ ID NO: 80732

SEQ ID NO: 723052 - RNA, 64 nt, Homo Sapiens; identical to SEQ ID NO: 80733

SEQ ID NO: 723053 - RNA, 64 nt, Homo Sapiens; identical to SEQ ID NO: 80734

SEQ ID NO: 723054 - RNA, 64 nt, Homo Sapiens; identical to SEQ ID NO: 80735

SEQ ID NO: 723055 - RNA, 64 nt, Homo Sapiens; identical to SEQ ID NO: 80736

SEQ ID NO: 723056 - RNA, 64 nt, Homo Sapiens; identical to SEQ ID NO: 80737

SEQ ID NO: 723057 - RNA, 64 nt, Homo Sapiens; identical to SEQ ID NO: 80738

SEQ ID NO: 723058 - RNA, 64 nt, Homo Sapiens; identical to SEQ ID NO: 80739

SEQ ID NO: 723059 - RNA, 64 nt, Homo Sapiens; identical to SEQ ID NO: 80740

SEQ ID NO: 723060 - RNA, 64 nt, Homo Sapiens; identical to SEQ ID NO: 80741

SEQ ID NO: 723061 - RNA, 64 nt, Homo Sapiens; identical to SEQ ID NO: 80742

SEQ ID NO: 723062 - RNA, 64 nt, Homo Sapiens; identical to SEQ ID NO: 80743

SEQ ID NO: 723063 - RNA, 64 nt, Homo Sapiens; identical to SEQ ID NO: 80744

SEQ ID NO: 723064 - RNA, 64 nt, Homo Sapiens; identical to SEQ ID NO: 80745

SEQ ID NO: 723065 - RNA, 64 nt, Homo Sapiens; identical to SEQ ID NO: 80746

SEQ ID NO: 723066 - RNA, 64 nt, Homo Sapiens; identical to SEQ ID NO: 80747

SEQ ID NO: 723067 - RNA, 64 nt, Homo Sapiens; identical to SEQ ID NO: 80748

SEQ ID NO: 723068 - RNA, 64 nt, Homo Sapiens; identical to SEQ ID NO: 80749

SEQ ID NO: 723069 - RNA, 64 nt, Homo Sapiens; identical to SEQ ID NO: 80750

SEQ ID NO: 723070 - RNA, 64 nt, Homo Sapiens; identical to SEQ ID NO: 80751

SEQ ID NO: 723071 - RNA, 64 nt, Homo Sapiens; identical to SEQ ID NO: 80752

SEQ ID NO: 723072 - RNA, 64 nt, Homo Sapiens; identical to SEQ ID NO: 80753

SEQ ID NO: 723073 - RNA, 64 nt, Homo Sapiens; identical to SEQ ID NO: 80754

SEQ ID NO: 723074 - RNA, 64 nt, Homo Sapiens; identical to SEQ ID NO: 80755

SEQ ID NO: 723075 - RNA, 64 nt, Homo Sapiens; identical to SEQ ID NO: 80756

SEQ ID NO: 723076 - RNA, 64 nt, Homo Sapiens; identical to SEQ ID NO: 80757

SEQ ID NO: 723077 - RNA, 64 nt, Homo Sapiens; identical to SEQ ID NO: 80758

SEQ ID NO: 723078 - RNA, 64 nt, Homo Sapiens; identical to SEQ ID NO: 80759

SEQ ID NO: 723079 - RNA, 64 nt, Homo Sapiens; identical to SEQ ID NO: 80760

SEQ ID NO: 723080 - RNA, 64 nt, Homo Sapiens; identical to SEQ ID NO: 80761

SEQ ID NO: 723081 - RNA, 64 nt, Homo Sapiens; identical to SEQ ID NO: 80762

SEQ ID NO: 723082 - RNA, 64 nt, Homo Sapiens; identical to SEQ ID NO: 80763

SEQ ID NO: 723083 - RNA, 64 nt, Homo Sapiens; identical to SEQ ID NO: 80764

SEQ ID NO: 723084 - RNA, 64 nt, Homo Sapiens; identical to SEQ ID NO: 80765

SEQ ID NO: 723085 - RNA, 64 nt, Homo Sapiens; identical to SEQ ID NO: 80766

SEQ ID NO: 723086 - RNA, 64 nt, Homo Sapiens; identical to SEQ ID NO: 80767

SEQ ID NO: 723087 - RNA, 64 nt, Homo Sapiens; identical to SEQ ID NO: 80768

SEQ ID NO: 723088 - RNA, 64 nt, Homo Sapiens; identical to SEQ ID NO: 80769

SEQ ID NO: 723089 - RNA, 64 nt, Homo Sapiens; identical to SEQ ID NO: 80770

SEQ ID NO: 723090 - RNA, 64 nt, Homo Sapiens; identical to SEQ ID NO: 80771

SEQ ID NO: 723091 - RNA, 64 nt, Homo Sapiens; identical to SEQ ID NO: 80772

SEQ ID NO: 723092 - RNA, 64 nt, Homo Sapiens; identical to SEQ ID NO: 80773

SEQ ID NO: 723093 - RNA, 64 nt, Homo Sapiens; identical to SEQ ID NO: 80774

SEQ ID NO: 723094 - RNA, 59 nt, Homo Sapiens; identical to SEQ ID NO: 80775

SEQ ID NO: 723095 - RNA, 64 nt, Homo Sapiens; identical to SEQ ID NO: 80776

SEQ ID NO: 723096 - RNA, 64 nt, Homo Sapiens; identical to SEQ ID NO: 80777

SEQ ID NO: 723097 - RNA, 64 nt, Homo Sapiens; identical to SEQ ID NO: 80778

SEQ ID NO: 723098 - RNA, 64 nt, Homo Sapiens; identical to SEQ ID NO: 80779

SEQ ID NO: 723099 - RNA, 64 nt, Homo Sapiens; identical to SEQ ID NO: 80780

SEQ ID NO: 723100 - RNA, 64 nt, Homo Sapiens; identical to SEQ ID NO: 80781

SEQ ID NO: 723101 - RNA, 64 nt, Homo Sapiens; identical to SEQ ID NO: 80782

SEQ ID NO: 723102 - RNA, 64 nt, Homo Sapiens; identical to SEQ ID NO: 80783

SEQ ID NO: 723103 - RNA, 64 nt, Homo Sapiens; identical to SEQ ID NO: 80784

SEQ ID NO: 723104 - RNA, 64 nt, Homo Sapiens; identical to SEQ ID NO: 80785

SEQ ID NO: 723105 - RNA, 64 nt, Homo Sapiens; identical to SEQ ID NO: 80786

SEQ ID NO: 723106 - RNA, 64 nt, Homo Sapiens; identical to SEQ ID NO: 80787

SEQ ID NO: 723107 - RNA, 64 nt, Homo Sapiens; identical to SEQ ID NO: 80788

SEQ ID NO: 723108 - RNA, 64 nt, Homo Sapiens; identical to SEQ ID NO: 80789

SEQ ID NO: 723109 - RNA, 64 nt, Homo Sapiens; identical to SEQ ID NO: 80790

SEQ ID NO: 723110 - RNA, 64 nt, Homo Sapiens; identical to SEQ ID NO: 80791

SEQ ID NO: 723111 - RNA, 64 nt, Homo Sapiens; identical to SEQ ID NO: 80792

SEQ ID NO: 723112 - RNA, 64 nt, Homo Sapiens; identical to SEQ ID NO: 80793

SEQ ID NO: 723113 - RNA, 64 nt, Homo Sapiens; identical to SEQ ID NO: 80794

SEQ ID NO: 723114 - RNA, 64 nt, Homo Sapiens; identical to SEQ ID NO: 80795

SEQ ID NO: 723115 - RNA, 64 nt, Homo Sapiens; identical to SEQ ID NO: 80796

SEQ ID NO: 723116 - RNA, 64 nt, Homo Sapiens; identical to SEQ ID NO: 80797

SEQ ID NO: 723117 - RNA, 64 nt, Homo Sapiens; identical to SEQ ID NO: 80798

SEQ ID NO: 723118 - RNA, 64 nt, Homo Sapiens; identical to SEQ ID NO: 80799

SEQ ID NO: 723119 - RNA, 64 nt, Homo Sapiens; identical to SEQ ID NO: 80800

SEQ ID NO: 723120 - RNA, 64 nt, Homo Sapiens; identical to SEQ ID NO: 80801

SEQ ID NO: 723121 - RNA, 64 nt, Homo Sapiens; identical to SEQ ID NO: 80802

SEQ ID NO: 723122 - RNA, 64 nt, Homo Sapiens; identical to SEQ ID NO: 80803

SEQ ID NO: 723123 - RNA, 64 nt, Homo Sapiens; identical to SEQ ID NO: 80804

SEQ ID NO: 723124 - RNA, 64 nt, Homo Sapiens; identical to SEQ ID NO: 80805

SEQ ID NO: 723125 - RNA, 64 nt, Homo Sapiens; identical to SEQ ID NO: 80806

SEQ ID NO: 723126 - RNA, 64 nt, Homo Sapiens; identical to SEQ ID NO: 80807

SEQ ID NO: 723127 - RNA, 64 nt, Homo Sapiens; identical to SEQ ID NO: 80808

SEQ ID NO: 723128 - RNA, 64 nt, Homo Sapiens; identical to SEQ ID NO: 80809

SEQ ID NO: 723129 - RNA, 64 nt, Homo Sapiens; identical to SEQ ID NO: 80810

SEQ ID NO: 723130 - RNA, 64 nt, Homo Sapiens; identical to SEQ ID NO: 80811

SEQ ID NO: 723131 - RNA, 64 nt, Homo Sapiens; identical to SEQ ID NO: 80812

SEQ ID NO: 723132 - RNA, 64 nt, Homo Sapiens; identical to SEQ ID NO: 80813

SEQ ID NO: 723133 - RNA, 64 nt, Homo Sapiens; identical to SEQ ID NO: 80814

SEQ ID NO: 723134 - RNA, 64 nt, Homo Sapiens; identical to SEQ ID NO: 80815

SEQ ID NO: 723135 - RNA, 64 nt, Homo Sapiens; identical to SEQ ID NO: 80816

SEQ ID NO: 723136 - RNA, 64 nt, Homo Sapiens; identical to SEQ ID NO: 80817

SEQ ID NO: 723137 - RNA, 64 nt, Homo Sapiens; identical to SEQ ID NO: 80818

SEQ ID NO: 723138 - RNA, 64 nt, Homo Sapiens; identical to SEQ ID NO: 80819

SEQ ID NO: 723139 - RNA, 64 nt, Homo Sapiens; identical to SEQ ID NO: 80820

SEQ ID NO: 723140 - RNA, 64 nt, Homo Sapiens; identical to SEQ ID NO: 80821

SEQ ID NO: 723141 - RNA, 64 nt, Homo Sapiens; identical to SEQ ID NO: 80822

SEQ ID NO: 723142 - RNA, 64 nt, Homo Sapiens; identical to SEQ ID NO: 80823

SEQ ID NO: 723143 - RNA, 64 nt, Homo Sapiens; identical to SEQ ID NO: 80824

SEQ ID NO: 723144 - RNA, 64 nt, Homo Sapiens; identical to SEQ ID NO: 80825

SEQ ID NO: 723145 - RNA, 64 nt, Homo Sapiens; identical to SEQ ID NO: 80826

SEQ ID NO: 723146 - RNA, 64 nt, Homo Sapiens; identical to SEQ ID NO: 80827

SEQ ID NO: 723147 - RNA, 64 nt, Homo Sapiens; identical to SEQ ID NO: 80828

SEQ ID NO: 723148 - RNA, 64 nt, Homo Sapiens; identical to SEQ ID NO: 80829

SEQ ID NO: 723149 - RNA, 64 nt, Homo Sapiens; identical to SEQ ID NO: 80830

SEQ ID NO: 723150 - RNA, 64 nt, Homo Sapiens; identical to SEQ ID NO: 80831

SEQ ID NO: 723151 - RNA, 64 nt, Homo Sapiens; identical to SEQ ID NO: 80832

SEQ ID NO: 723152 - RNA, 64 nt, Homo Sapiens; identical to SEQ ID NO: 80833

SEQ ID NO: 723153 - RNA, 64 nt, Homo Sapiens; identical to SEQ ID NO: 80834

SEQ ID NO: 723154 - RNA, 64 nt, Homo Sapiens; identical to SEQ ID NO: 80835

SEQ ID NO: 723155 - RNA, 64 nt, Homo Sapiens; identical to SEQ ID NO: 80836

SEQ ID NO: 723156 - RNA, 64 nt, Homo Sapiens; identical to SEQ ID NO: 80837

SEQ ID NO: 723157 - RNA, 64 nt, Homo Sapiens; identical to SEQ ID NO: 80838

SEQ ID NO: 723158 - RNA, 64 nt, Homo Sapiens; identical to SEQ ID NO: 80839

SEQ ID NO: 723159 - RNA, 64 nt, Homo Sapiens; identical to SEQ ID NO: 80839

SEQ ID NO: 723160 - RNA, 64 nt, Homo Sapiens; identical to SEQ ID NO: 80841

SEQ ID NO: 723161 - RNA, 64 nt, Homo Sapiens; identical to SEQ ID NO: 80842

SEQ ID NO: 723162 - RNA, 64 nt, Homo Sapiens; identical to SEQ ID NO: 80843

SEQ ID NO: 723163 - RNA, 64 nt, Homo Sapiens; identical to SEQ ID NO: 80844

SEQ ID NO: 723164 - RNA, 64 nt, Homo Sapiens; identical to SEQ ID NO: 80845

SEQ ID NO: 723165 - RNA, 64 nt, Homo Sapiens; identical to SEQ ID NO: 80846

SEQ ID NO: 723166 - RNA, 64 nt, Homo Sapiens; identical to SEQ ID NO: 80847

SEQ ID NO: 723167 - RNA, 64 nt, Homo Sapiens; identical to SEQ ID NO: 80848

SEQ ID NO: 723168 - RNA, 64 nt, Homo Sapiens; identical to SEQ ID NO: 80849

SEQ ID NO: 723169 - RNA, 64 nt, Homo Sapiens; identical to SEQ ID NO: 80850

SEQ ID NO: 723170 - RNA, 64 nt, Homo Sapiens; identical to SEQ ID NO: 80851

SEQ ID NO: 723171 - RNA, 64 nt, Homo Sapiens; identical to SEQ ID NO: 80852

SEQ ID NO: 723172 - RNA, 64 nt, Homo Sapiens; identical to SEQ ID NO: 80853

SEQ ID NO: 723173 - RNA, 64 nt, Homo Sapiens; identical to SEQ ID NO: 80854

SEQ ID NO: 723174 - RNA, 64 nt, Homo Sapiens; identical to SEQ ID NO: 80855

SEQ ID NO: 723175 - RNA, 64 nt, Homo Sapiens; identical to SEQ ID NO: 80856

SEQ ID NO: 723176 - RNA, 64 nt, Homo Sapiens; identical to SEQ ID NO: 576060

SEQ ID NO: 723177 - RNA, 64 nt, Homo Sapiens; identical to SEQ ID NO: 576061

SEQ ID NO: 723178 - RNA, 64 nt, Homo Sapiens; identical to SEQ ID NO: 576062

SEQ ID NO: 723179 - RNA, 64 nt, Homo Sapiens; identical to SEQ ID NO: 576063

SEQ ID NO: 723180 - RNA, 64 nt, Homo Sapiens; identical to SEQ ID NO: 576064

SEQ ID NO: 723181 - RNA, 64 nt, Homo Sapiens; identical to SEQ ID NO: 576065

SEQ ID NO: 723182 - RNA, 64 nt, Homo Sapiens; identical to SEQ ID NO: 576066

SEQ ID NO: 723183 - RNA, 64 nt, Homo Sapiens; identical to SEQ ID NO: 576067

SEQ ID NO: 723184 - RNA, 64 nt, Homo Sapiens; identical to SEQ ID NO: 576068

SEQ ID NO: 723185 - RNA, 64 nt, Homo Sapiens; identical to SEQ ID NO: 576069

SEQ ID NO: 723186 - RNA, 64 nt, Homo Sapiens; identical to SEQ ID NO: 576070

SEQ ID NO: 723187 - RNA, 64 nt, Homo Sapiens; identical to SEQ ID NO: 576071

SEQ ID NO: 723188 - RNA, 64 nt, Homo Sapiens; identical to SEQ ID NO: 576072

SEQ ID NO: 723189 - RNA, 64 nt, Homo Sapiens; identical to SEQ ID NO: 576073

SEQ ID NO: 723190 - RNA, 64 nt, Homo Sapiens; identical to SEQ ID NO: 576074

SEQ ID NO: 723191 - RNA, 64 nt, Homo Sapiens; identical to SEQ ID NO: 576075

SEQ ID NO: 723192 - RNA, 64 nt, Homo Sapiens; identical to SEQ ID NO: 89734

SEQ ID NO: 723193 - RNA, 64 nt, Homo Sapiens; identical to SEQ ID NO: 89735

SEQ ID NO: 723194 - RNA, 64 nt, Homo Sapiens; identical to SEQ ID NO: 324616

SEQ ID NO: 723195 - RNA, 64 nt, Homo Sapiens; identical to SEQ ID NO: 324617

SEQ ID NO: 723196 - RNA, 64 nt, Homo Sapiens; identical to SEQ ID NO: 71090

SEQ ID NO: 723197 - RNA, 64 nt, Homo Sapiens; identical to SEQ ID NO: 71091

SEQ ID NO: 723198 - RNA, 64 nt, Homo Sapiens; identical to SEQ ID NO: 71092

SEQ ID NO: 723199 - RNA, 64 nt, Homo Sapiens; identical to SEQ ID NO: 71093

SEQ ID NO: 723200 - RNA, 64 nt, Homo Sapiens; identical to SEQ ID NO: 71094

SEQ ID NO: 723201 - RNA, 64 nt, Homo Sapiens; identical to SEQ ID NO: 71095

SEQ ID NO: 723202 - RNA, 64 nt, Homo Sapiens; identical to SEQ ID NO: 71096

SEQ ID NO: 723203 - RNA, 64 nt, Homo Sapiens; identical to SEQ ID NO: 71097

SEQ ID NO: 723204 - RNA, 64 nt, Homo Sapiens; identical to SEQ ID NO: 71098

SEQ ID NO: 723205 - RNA, 64 nt, Homo Sapiens; identical to SEQ ID NO: 71099

SEQ ID NO: 723206 - RNA, 64 nt, Homo Sapiens; identical to SEQ ID NO: 71100

SEQ ID NO: 723207 - RNA, 64 nt, Homo Sapiens; identical to SEQ ID NO: 71101

SEQ ID NO: 723208 - RNA, 64 nt, Homo Sapiens; identical to SEQ ID NO: 71102

SEQ ID NO: 723209 - RNA, 64 nt, Homo Sapiens; identical to SEQ ID NO: 71103

SEQ ID NO: 723210 - RNA, 64 nt, Homo Sapiens; identical to SEQ ID NO: 71104

SEQ ID NO: 723211 - RNA, 64 nt, Homo Sapiens; identical to SEQ ID NO: 71105

SEQ ID NO: 723212 - RNA, 64 nt, Homo Sapiens; identical to SEQ ID NO: 71106

SEQ ID NO: 723213 - RNA, 64 nt, Homo Sapiens; identical to SEQ ID NO: 71107

SEQ ID NO: 723214 - RNA, 64 nt, Homo Sapiens; identical to SEQ ID NO: 71108

SEQ ID NO: 723215 - RNA, 64 nt, Homo Sapiens; identical to SEQ ID NO: 71109

SEQ ID NO: 723216 - RNA, 64 nt, Homo Sapiens; identical to SEQ ID NO: 71110

SEQ ID NO: 723217 - RNA, 64 nt, Homo Sapiens; identical to SEQ ID NO: 71111

SEQ ID NO: 723218 - RNA, 64 nt, Homo Sapiens; identical to SEQ ID NO: 71112

SEQ ID NO: 723219 - RNA, 64 nt, Homo Sapiens; identical to SEQ ID NO: 71113

SEQ ID NO: 723220 - RNA, 64 nt, Homo Sapiens; identical to SEQ ID NO: 71114

SEQ ID NO: 723221 - RNA, 64 nt, Homo Sapiens; identical to SEQ ID NO: 71115

SEQ ID NO: 723222 - RNA, 64 nt, Homo Sapiens; identical to SEQ ID NO: 71116

SEQ ID NO: 723223 - RNA, 64 nt, Homo Sapiens; identical to SEQ ID NO: 71117

SEQ ID NO: 723224 - RNA, 64 nt, Homo Sapiens; identical to SEQ ID NO: 71118

SEQ ID NO: 723225 - RNA, 64 nt, Homo Sapiens; identical to SEQ ID NO: 71119

SEQ ID NO: 723226 - RNA, 64 nt, Homo Sapiens; identical to SEQ ID NO: 581094

SEQ ID NO: 723227 - RNA, 64 nt, Homo Sapiens; identical to SEQ ID NO: 581095

SEQ ID NO: 723228 - RNA, 64 nt, Homo Sapiens; identical to SEQ ID NO: 581096

SEQ ID NO: 723229 - RNA, 64 nt, Homo Sapiens; identical to SEQ ID NO: 581097

SEQ ID NO: 723230 - RNA, 64 nt, Homo Sapiens; identical to SEQ ID NO: 581098

SEQ ID NO: 723231 - RNA, 64 nt, Homo Sapiens; identical to SEQ ID NO: 581099

SEQ ID NO: 723232 - RNA, 64 nt, Homo Sapiens; identical to SEQ ID NO: 581100

SEQ ID NO: 723233 - RNA, 64 nt, Homo Sapiens; identical to SEQ ID NO: 581101

SEQ ID NO: 723234 - RNA, 64 nt, Homo Sapiens; identical to SEQ ID NO: 581102

SEQ ID NO: 723235 - RNA, 64 nt, Homo Sapiens; identical to SEQ ID NO: 581103

SEQ ID NO: 723236 - RNA, 64 nt, Homo Sapiens; identical to SEQ ID NO: 581104

SEQ ID NO: 723237 - RNA, 64 nt, Homo Sapiens; identical to SEQ ID NO: 581105

SEQ ID NO: 723238 - RNA, 64 nt, Homo Sapiens; identical to SEQ ID NO: 538503

SEQ ID NO: 723239 - RNA, 64 nt, Homo Sapiens; identical to SEQ ID NO: 538504

SEQ ID NO: 723240 - RNA, 64 nt, Homo Sapiens; identical to SEQ ID NO: 538505

SEQ ID NO: 723241 - RNA, 64 nt, Homo Sapiens; identical to SEQ ID NO: 538506

SEQ ID NO: 723242 - RNA, 64 nt, Homo Sapiens; identical to SEQ ID NO: 538507

SEQ ID NO: 723243 - RNA, 64 nt, Homo Sapiens; identical to SEQ ID NO: 538508

SEQ ID NO: 723244 - RNA, 64 nt, Homo Sapiens; identical to SEQ ID NO: 538509

SEQ ID NO: 723245 - RNA, 64 nt, Homo Sapiens; identical to SEQ ID NO: 538510

SEQ ID NO: 723246 - RNA, 64 nt, Homo Sapiens; identical to SEQ ID NO: 538511

SEQ ID NO: 723247 - RNA, 64 nt, Homo Sapiens; identical to SEQ ID NO: 538512

SEQ ID NO: 723248 - RNA, 64 nt, Homo Sapiens; identical to SEQ ID NO: 538513

SEQ ID NO: 723249 - RNA, 64 nt, Homo Sapiens; identical to SEQ ID NO: 538514

SEQ ID NO: 723250 - RNA, 64 nt, Homo Sapiens; identical to SEQ ID NO: 538515

SEQ ID NO: 723251 - RNA, 64 nt, Homo Sapiens; identical to SEQ ID NO: 538516

SEQ ID NO: 723252 - RNA, 64 nt, Homo Sapiens; identical to SEQ ID NO: 538517

SEQ ID NO: 723253 - RNA, 64 nt, Homo Sapiens; identical to SEQ ID NO: 538518

SEQ ID NO: 723254 - RNA, 64 nt, Homo Sapiens; identical to SEQ ID NO: 538519

SEQ ID NO: 723255 - RNA, 64 nt, Homo Sapiens; identical to SEQ ID NO: 538520

SEQ ID NO: 723256 - RNA, 64 nt, Homo Sapiens; identical to SEQ ID NO: 538521

SEQ ID NO: 723257 - RNA, 64 nt, Homo Sapiens; identical to SEQ ID NO: 538522

SEQ ID NO: 723258 - RNA, 64 nt, Homo Sapiens; identical to SEQ ID NO: 538523

SEQ ID NO: 723259 - RNA, 64 nt, Homo Sapiens; identical to SEQ ID NO: 538524

SEQ ID NO: 723260 - RNA, 64 nt, Homo Sapiens; identical to SEQ ID NO: 538525

SEQ ID NO: 723261 - RNA, 64 nt, Homo Sapiens; identical to SEQ ID NO: 538526

SEQ ID NO: 723262 - RNA, 64 nt, Homo Sapiens; identical to SEQ ID NO: 538527

SEQ ID NO: 723263 - RNA, 64 nt, Homo Sapiens; identical to SEQ ID NO: 538528

SEQ ID NO: 723264 - RNA, 64 nt, Homo Sapiens; identical to SEQ ID NO: 223145

SEQ ID NO: 723265 - RNA, 64 nt, Homo Sapiens; identical to SEQ ID NO: 223146

SEQ ID NO: 723266 - RNA, 64 nt, Homo Sapiens; identical to SEQ ID NO: 223147

SEQ ID NO: 723267 - RNA, 64 nt, Homo Sapiens; identical to SEQ ID NO: 223148

SEQ ID NO: 723268 - RNA, 64 nt, Homo Sapiens; identical to SEQ ID NO: 223149

SEQ ID NO: 723269 - RNA, 64 nt, Homo Sapiens; identical to SEQ ID NO: 223150

SEQ ID NO: 723270 - RNA, 64 nt, Homo Sapiens; identical to SEQ ID NO: 223151

SEQ ID NO: 723271 - RNA, 64 nt, Homo Sapiens; identical to SEQ ID NO: 223152

SEQ ID NO: 723272 - RNA, 64 nt, Homo Sapiens; identical to SEQ ID NO: 223153

SEQ ID NO: 723273 - RNA, 64 nt, Homo Sapiens; identical to SEQ ID NO: 223154

SEQ ID NO: 723274 - RNA, 64 nt, Homo Sapiens; identical to SEQ ID NO: 223155

SEQ ID NO: 723275 - RNA, 64 nt, Homo Sapiens; identical to SEQ ID NO: 223156

SEQ ID NO: 723276 - RNA, 64 nt, Homo Sapiens; identical to SEQ ID NO: 223157

SEQ ID NO: 723277 - RNA, 64 nt, Homo Sapiens; identical to SEQ ID NO: 223158

SEQ ID NO: 723278 - RNA, 64 nt, Homo Sapiens; identical to SEQ ID NO: 223159

SEQ ID NO: 723279 - RNA, 64 nt, Homo Sapiens; identical to SEQ ID NO: 223160

SEQ ID NO: 723280 - RNA, 64 nt, Homo Sapiens; identical to SEQ ID NO: 223161

SEQ ID NO: 723281 - RNA, 64 nt, Homo Sapiens; identical to SEQ ID NO: 223162

SEQ ID NO: 723282 - RNA, 64 nt, Homo Sapiens; identical to SEQ ID NO: 223163

SEQ ID NO: 723283 - RNA, 64 nt, Homo Sapiens; identical to SEQ ID NO: 223164

SEQ ID NO: 723284 - RNA, 64 nt, Homo Sapiens; identical to SEQ ID NO: 223165

SEQ ID NO: 723285 - RNA, 64 nt, Homo Sapiens; identical to SEQ ID NO: 223166

SEQ ID NO: 723286 - RNA, 64 nt, Homo Sapiens; identical to SEQ ID NO: 223167

SEQ ID NO: 723287 - RNA, 64 nt, Homo Sapiens; identical to SEQ ID NO: 223168

SEQ ID NO: 723288 - RNA, 64 nt, Homo Sapiens; identical to SEQ ID NO: 223169

SEQ ID NO: 723289 - RNA, 64 nt, Homo Sapiens; identical to SEQ ID NO: 223170

SEQ ID NO: 723290 - RNA, 64 nt, Homo Sapiens; identical to SEQ ID NO: 223171

SEQ ID NO: 723291 - RNA, 64 nt, Homo Sapiens; identical to SEQ ID NO: 223172

SEQ ID NO: 723292 - RNA, 64 nt, Homo Sapiens; identical to SEQ ID NO: 223173

SEQ ID NO: 723293 - RNA, 64 nt, Homo Sapiens; identical to SEQ ID NO: 223174

SEQ ID NO: 723294 - RNA, 64 nt, Homo Sapiens; identical to SEQ ID NO: 223175

SEQ ID NO: 723295 - RNA, 64 nt, Homo Sapiens; identical to SEQ ID NO: 223176

SEQ ID NO: 723296 - RNA, 64 nt, Homo Sapiens; identical to SEQ ID NO: 223177

SEQ ID NO: 723297 - RNA, 64 nt, Homo Sapiens; identical to SEQ ID NO: 223178

SEQ ID NO: 723298 - RNA, 64 nt, Homo Sapiens; identical to SEQ ID NO: 223179

SEQ ID NO: 723299 - RNA, 64 nt, Homo Sapiens; identical to SEQ ID NO: 223180

SEQ ID NO: 723300 - RNA, 64 nt, Homo Sapiens; identical to SEQ ID NO: 223181

SEQ ID NO: 723301 - RNA, 64 nt, Homo Sapiens; identical to SEQ ID NO: 223182

SEQ ID NO: 723302 - RNA, 64 nt, Homo Sapiens; identical to SEQ ID NO: 223183

SEQ ID NO: 723303 - RNA, 64 nt, Homo Sapiens; identical to SEQ ID NO: 223184

SEQ ID NO: 723304 - RNA, 64 nt, Homo Sapiens; identical to SEQ ID NO: 223185

SEQ ID NO: 723305 - RNA, 64 nt, Homo Sapiens; identical to SEQ ID NO: 223186

SEQ ID NO: 723306 - RNA, 64 nt, Homo Sapiens; identical to SEQ ID NO: 223187

SEQ ID NO: 723307 - RNA, 64 nt, Homo Sapiens; identical to SEQ ID NO: 223188

SEQ ID NO: 723308 - RNA, 64 nt, Homo Sapiens; identical to SEQ ID NO: 223189

SEQ ID NO: 723309 - RNA, 64 nt, Homo Sapiens; identical to SEQ ID NO: 223190

SEQ ID NO: 723310 - RNA, 64 nt, Homo Sapiens; identical to SEQ ID NO: 223191

SEQ ID NO: 723311 - RNA, 64 nt, Homo Sapiens; identical to SEQ ID NO: 223192

SEQ ID NO: 723312 - RNA, 64 nt, Homo Sapiens; identical to SEQ ID NO: 223193

SEQ ID NO: 723313 - RNA, 64 nt, Homo Sapiens; identical to SEQ ID NO: 223194

SEQ ID NO: 723314 - RNA, 64 nt, Homo Sapiens; identical to SEQ ID NO: 223195

SEQ ID NO: 723315 - RNA, 57 nt, Homo Sapiens; identical to SEQ ID NO: 223196

SEQ ID NO: 723316 - RNA, 64 nt, Homo Sapiens; identical to SEQ ID NO: 223197

SEQ ID NO: 723317 - RNA, 54 nt, Homo Sapiens; identical to SEQ ID NO: 223198

SEQ ID NO: 723318 - RNA, 64 nt, Homo Sapiens; identical to SEQ ID NO: 361536

SEQ ID NO: 723319 - RNA, 64 nt, Homo Sapiens; identical to SEQ ID NO: 361537

SEQ ID NO: 723320 - RNA, 64 nt, Homo Sapiens; identical to SEQ ID NO: 361538

SEQ ID NO: 723321 - RNA, 64 nt, Homo Sapiens; identical to SEQ ID NO: 361539

SEQ ID NO: 723322 - RNA, 64 nt, Homo Sapiens; identical to SEQ ID NO: 361540

SEQ ID NO: 723323 - RNA, 64 nt, Homo Sapiens; identical to SEQ ID NO: 361541

SEQ ID NO: 723324 - RNA, 64 nt, Homo Sapiens; identical to SEQ ID NO: 361542

SEQ ID NO: 723325 - RNA, 64 nt, Homo Sapiens; identical to SEQ ID NO: 361543

SEQ ID NO: 723326 - RNA, 64 nt, Homo Sapiens; identical to SEQ ID NO: 361544

SEQ ID NO: 723327 - RNA, 64 nt, Homo Sapiens; identical to SEQ ID NO: 361545

SEQ ID NO: 723328 - RNA, 64 nt, Homo Sapiens; identical to SEQ ID NO: 361546

SEQ ID NO: 723329 - RNA, 64 nt, Homo Sapiens; identical to SEQ ID NO: 361547

SEQ ID NO: 723330 - RNA, 64 nt, Homo Sapiens; identical to SEQ ID NO: 361548

SEQ ID NO: 723331 - RNA, 64 nt, Homo Sapiens; identical to SEQ ID NO: 361549

SEQ ID NO: 723332 - RNA, 64 nt, Homo Sapiens; identical to SEQ ID NO: 361550

SEQ ID NO: 723333 - RNA, 64 nt, Homo Sapiens; identical to SEQ ID NO: 361551

SEQ ID NO: 723334 - RNA, 64 nt, Homo Sapiens; identical to SEQ ID NO: 361552

SEQ ID NO: 723335 - RNA, 64 nt, Homo Sapiens; identical to SEQ ID NO: 361553

SEQ ID NO: 723336 - RNA, 64 nt, Homo Sapiens; identical to SEQ ID NO: 361554

SEQ ID NO: 723337 - RNA, 64 nt, Homo Sapiens; identical to SEQ ID NO: 361555

SEQ ID NO: 723338 - RNA, 64 nt, Homo Sapiens; identical to SEQ ID NO: 361556

SEQ ID NO: 723339 - RNA, 64 nt, Homo Sapiens
agagggcaagagugagcaagcaugccagaaggcagaaggguaaggccuuugugcuuugucaucc

SEQ ID NO: 723340 - RNA, 64 nt, Homo Sapiens
aggauaauuaaaaauaauguuuauguuuauuuuugaaggguauucaucuguaaaaugggaagag

SEQ ID NO: 723341 - RNA, 64 nt, Homo Sapiens
cccuagcucucugugaaugucccaugccugcucagaaggguagcuccaucacaacaagaaauuu

SEQ ID NO: 723342 - RNA, 64 nt, Homo Sapiens
gaaaacaccauccauuugggagaugacacaaggggaaggguacuuaggggaagccuggagccaa

SEQ ID NO: 723343 - RNA, 64 nt, Homo Sapiens
auuuucuuuccucuggcugaucccagcccuaaaggaaggguagacccgugucuuuccagcccua

SEQ ID NO: 723344 - RNA, 64 nt, Homo Sapiens
ggaaggguagacccgugucuuuccagcccuaaaggaaggguagacccgugucuuuccagcccua

SEQ ID NO: 723345 - RNA, 64 nt, Homo Sapiens
uucucagguguuucuagacccccgacuccgcaagagugaggaugaugggagcuggucaugggag

SEQ ID NO: 723346 - RNA, 64 nt, Homo Sapiens
uaucuuuaacugacuucuguccacucuggagagcagugaggaauuaaucuugcuuuugcuuguc

SEQ ID NO: 723347 - RNA, 64 nt, Homo Sapiens
ccauuuucaagcuggaagaagugagcaguguuggagugaggaccuguaaggcaggcccauucag

SEQ ID NO: 723348 - RNA, 64 nt, Homo Sapiens
gacauagucucugcccucauagaguugauugucuagugaggaagacaagcauuuuuaaaaaaua

SEQ ID NO: 723349 - RNA, 64 nt, Homo Sapiens
ugcagccucugcccggccgccaccccgucugggaagugaggagcgucucugccuggcugcccau

SEQ ID NO: 723350 - RNA, 64 nt, Homo Sapiens
gagcagccccucugccuggcugcccagucuggaaagugaggagcgucucugcccggccgccauc

SEQ ID NO: 723351 - RNA, 64 nt, Homo Sapiens
gagcgucucugcccggccgccaucccaucuaggaagugaggagcgccucuucccacccgccauc

SEQ ID NO: 723352 - RNA, 64 nt, Homo Sapiens
gagcgccucuucccacccgccaucccaucuaggaagugaggagcuucucugccuggccgcccau

SEQ ID NO: 723353 - RNA, 64 nt, Homo Sapiens
gaggagcaacucugcccagccgccccgucugagaagugaggagacccuccgccuggcaaccgcc

SEQ ID NO: 723354 - RNA, 64 nt, Homo Sapiens
gagccccucugcccagcagccgccccgucugagaagugaggagccccucugcccagcagccacc

SEQ ID NO: 723355 - RNA, 64 nt, Homo Sapiens
gagccccucugcccagcagccacccugucugggaagugaggagcgucuccgcccggcagccacc

SEQ ID NO: 723356 - RNA, 64 nt, Homo Sapiens
gaggggcgccucugcccagcugccccuacugggaagugaggagccccucugccccgccagccac

SEQ ID NO: 723357 - RNA, 64 nt, Homo Sapiens
gaggggcgccucugcccggcugccccuacugggaagugaggagccccucugcccggccagccgc

SEQ ID NO: 723358 - RNA, 64 nt, Homo Sapiens
uaggggcgccucugcccggccgccccuacugggaagugaggagccccucugcccggccaccacc

SEQ ID NO: 723359 - RNA, 64 nt, Homo Sapiens
gccuaagccaggacccagaauccgggccugcucuagugaggagugccuccgccgacucccuccu

SEQ ID NO: 723360 - RNA, 64 nt, Homo Sapiens
ugucuggaccaguggggcacccuuggaaggccgcagugaggagcaggcagggcagggacagcca

SEQ ID NO: 723361 - RNA, 64 nt, Homo Sapiens
ugggauuucugugcuauaaacccuaugcugggaaagugaggauucgagcccaucagcaggucaa

SEQ ID NO: 723362 - RNA, 64 nt, Homo Sapiens
cuggauccaagucuugauugugagaugcguaugaagugaggagguucuucaaguuagcuaaaaa

SEQ ID NO: 723363 - RNA, 64 nt, Homo Sapiens
cuucaaaacagaugcagacauguguguugguaguagugaggagauugguauuagcaucaagucu

SEQ ID NO: 723364 - RNA, 64 nt, Homo Sapiens
gugcacaugucaaguacuuagcuaaaaucaacaaagugaggacugugaagauaacuuucaugua

SEQ ID NO: 723365 - RNA, 64 nt, Homo Sapiens
guucauuuuuaaauguuccugagcaggcuguuauagugaggaaugaaauagguuguuggguuuu

SEQ ID NO: 723366 - RNA, 64 nt, Homo Sapiens
agagguuuuaucagaacacaacauggaugugaacagugaggaucugaggggaccgagcccuguu

SEQ ID NO: 723367 - RNA, 64 nt, Homo Sapiens
ccuuaaugcuaaguguagauuauugagguuuguuagugaggaaaagaauaagaguucagaagcc

SEQ ID NO: 723368 - RNA, 64 nt, Homo Sapiens
aagccuuuguuaucagauagcgaaaucagggccuagugaggagcacaggucgacuacauaaugg

SEQ ID NO: 723369 - RNA, 64 nt, Homo Sapiens
gaggauuugggguggggguggcaagacggggguuagugaggaagccugggcuuuacgagaccau

SEQ ID NO: 723370 - RNA, 64 nt, Homo Sapiens
gucccagcugagucccaucgcucugcacccggugagugaggacaaacccucuucauggaccaga

SEQ ID NO: 723371 - RNA, 64 nt, Homo Sapiens
ccuaagcauugacuucucuacccuugugucucccagugaggagcggggacagacuuuuaaaaug

SEQ ID NO: 723372 - RNA, 64 nt, Homo Sapiens
ccuauuugaacuacuuaaacugaagcaaauuaauagugaggaagaguuaagcugaagaguuuac

SEQ ID NO: 723373 - RNA, 64 nt, Homo Sapiens
agugccuaauacaauuagaagucaacaucuaacuagugaggaaaaauggaguuuuagaggaaaa

SEQ ID NO: 723374 - RNA, 64 nt, Homo Sapiens
auaagguuguccaugagauuaaggaaggagguucagugaggaaaacuugaaggcaaaggaaacu

SEQ ID NO: 723375 - RNA, 64 nt, Homo Sapiens
auaucugggucuuuucgucaacagucugacuaugagugaggaaauauguaaggggugagacaca

SEQ ID NO: 723376 - RNA, 64 nt, Homo Sapiens
caguuucucacguugcaaccauauuuuucaaagaagugaggauguucagcuuucuaaaaggcau

SEQ ID NO: 723377 - RNA, 64 nt, Homo Sapiens
guaacccggccccucuggcccuucccucaagcccagugaggagguggguggaggcaugcagggg

SEQ ID NO: 723378 - RNA, 64 nt, Homo Sapiens
ugugggcagagaagggcaucugggacguggugccagugaggagcccaguuggcuggcacugggc

SEQ ID NO: 723379 - RNA, 64 nt, Homo Sapiens
ccgaggcaguggugcuggcccaagugaaggccagagugaggacugaugcagcucuuuacggguc

SEQ ID NO: 723380 - RNA, 64 nt, Homo Sapiens
acagaaagauuaaguuaccggcccaaggugacacagugaggagguggcagagcuaggauuugaa

SEQ ID NO: 723381 - RNA, 64 nt, Homo Sapiens
ugcagccucugcccggccgccaccccgucuggaaagugaggagcgccucugcccggccgccauc

SEQ ID NO: 723382 - RNA, 64 nt, Homo Sapiens
gagcgccucugcccggccgccaucccaucuaggaagugaggagcgccucuucccagccgccauc

SEQ ID NO: 723383 - RNA, 64 nt, Homo Sapiens
gagcgccucuucccagccgccaucccaucuaggaagugaggagcgucucugcccggccgcccau

SEQ ID NO: 723384 - RNA, 64 nt, Homo Sapiens
gaggagcgucucugucuggccaccccgucugagaagugaggagaccuccgcccggcagccgccc

SEQ ID NO: 723385 - RNA, 64 nt, Homo Sapiens
ggagaccuccgcccggcagccgcccugucugagaagugaggagccccuccgcccggcagccacc

SEQ ID NO: 723386 - RNA, 64 nt, Homo Sapiens
gagccccuccgcccggcagccaccccaucugggaagugaggagcgucuacgcccgggcagcugc

SEQ ID NO: 723387 - RNA, 64 nt, Homo Sapiens
cccggccgccccugcccggccgccccuacugggaagugaggagccccucugccuggccaccacc

SEQ ID NO: 723388 - RNA, 64 nt, Homo Sapiens
ggggaagaucugcagcuagcauaguuucaugcucagugaggaugauggucaccguguuuguugu

SEQ ID NO: 723389 - RNA, 64 nt, Homo Sapiens
gcagcagccuccugaccaaugcccgcucuuggggagugaggauucugcacguggaugguacccu

SEQ ID NO: 723390 - RNA, 64 nt, Homo Sapiens
caaaauguucugcuagcuugaggaacaucaccuuagugaggaaaaauauuggcaaaggcaucuc

SEQ ID NO: 723391 - RNA, 64 nt, Homo Sapiens
aagagcuucccugcuuccaaaagagaacuuaucuagugaggaugcaagaaauuagaguccucag

SEQ ID NO: 723392 - RNA, 64 nt, Homo Sapiens
ggacacagcccagagacagagaagcuuaugaggaagugaggagguggcgucacaagggugggga

SEQ ID NO: 723393 - RNA, 64 nt, Homo Sapiens
gggcaggacggcaccugguaugcgggaggaacagagugaggagaggagggcagggcgugcaggg

SEQ ID NO: 723394 - RNA, 64 nt, Homo Sapiens
gugaaucaggacugaaugugaaagggaaguauugagugaggacauucccaaaaccaaaggacaa

SEQ ID NO: 723395 - RNA, 64 nt, Homo Sapiens
acugcccagcacauaaugaauaaauaagaaaaugagugaggaguuauuaacaucauuuggaaaa

SEQ ID NO: 723396 - RNA, 64 nt, Homo Sapiens
gggccugagacuggaccugggccccccuccagagagugaggaggcaaacccugaagacaccccu

SEQ ID NO: 723397 - RNA, 64 nt, Homo Sapiens
cacggggagccugggccccuccauccagggguguagugaggaccugaccgccaggaugcuucug

SEQ ID NO: 723398 - RNA, 64 nt, Homo Sapiens
gagaacuuggaagggugcaggaggaccccaggggagugaggaggguguagugaggaggagccca

SEQ ID NO: 723399 - RNA, 64 nt, Homo Sapiens
agcccagaggaccccagggguuugggggaaguguagugaggaggagccacacgcaccagcucua

SEQ ID NO: 723400 - RNA, 59 nt, Homo Sapiens; identical to SEQ ID NO: 627537

SEQ ID NO: 723401 - RNA, 64 nt, Homo Sapiens
ucuuccuccagcuccagccaccaccaggcugagcagugaggagagaaaguuucugccuggcccu

SEQ ID NO: 723402 - RNA, 64 nt, Homo Sapiens
auuaaccucugagcagugauuugauaggauaguuagugaggauuguaaacugccaguugcaaau

SEQ ID NO: 723403 - RNA, 64 nt, Homo Sapiens
ggcuggugcagggaaagcaaugagggcaaggcaaagugaggaaggguuuaagugguguuagcuu

SEQ ID NO: 723404 - RNA, 64 nt, Homo Sapiens
aaaaggggaaguuggggauaucagacaaauguucagugaggaaaguucagugaggaaaaaacau

SEQ ID NO: 723405 - RNA, 64 nt, Homo Sapiens
aaacauucagacaaauguucaggaaaacauguucagugaggaaaacaaauguucagugugagug

SEQ ID NO: 723406 - RNA, 64 nt, Homo Sapiens
acauguucagugaggaaaaaaaauguucagugugagugaggaaaaagcagccacaguuucagac

SEQ ID NO: 723407 - RNA, 64 nt, Homo Sapiens
auuaaauucagccuaaacuuaaguugucugaaaaugucuucauggcucaaugaucuacauucug

SEQ ID NO: 723408 - RNA, 64 nt, Homo Sapiens
guuggcuuguuuuagcugauaaccucauucuuugugucuucaguacccugguuucaaugaaccu

SEQ ID NO: 723409 - RNA, 64 nt, Homo Sapiens
agaaauacaaaaauacaaucuuuuauaauucugaugucuucauuaguauuaauuuugaguucca

SEQ ID NO: 723410 - RNA, 64 nt, Homo Sapiens
uauuuguauuuuaaccaguaaaucuuuuacaucaugucuucagcuguuacaaaaccaaguacuu

SEQ ID NO: 723411 - RNA, 64 nt, Homo Sapiens
gacuaacauuuaauuuguuuacaaaaauguuuauugucuucaguacaaaaaguuaaaaccauga

SEQ ID NO: 723412 - RNA, 64 nt, Homo Sapiens
ggcuaauauauuuagacaggauuuccaaaaacuuugucuucaaauuuuaauuuucuuccuaaua

SEQ ID NO: 723413 - RNA, 64 nt, Homo Sapiens
aucugagucaccaagaaguauuaaagaaaagccaugucuucaacaaaaguuugaauagcuauua

SEQ ID NO: 723414 - RNA, 64 nt, Homo Sapiens
aaaccagagcguugcuuuauggcugcacugagcuugucuucaggucacuguaugccuguacuug

SEQ ID NO: 723415 - RNA, 64 nt, Homo Sapiens
uuuaaaaaaaaaaaaaaaggauccauuguaccguugucuucaucacugggaaaugauuauuaca

SEQ ID NO: 723416 - RNA, 64 nt, Homo Sapiens
uccaggauacauaaauucaauggaucaauuuauuugucuucaaauggccuuaacuuggauuguc

SEQ ID NO: 723417 - RNA, 64 nt, Homo Sapiens
ugugaagcauaagacacugaggcuaauacaacucugucuucauguguugacugccuggcacaua

SEQ ID NO: 723418 - RNA, 64 nt, Homo Sapiens
ggaauuaagcaaaaguaguuuuugucuuuucuguugucuucaaauuuuaugccuuuuauuuuua

SEQ ID NO: 723419 - RNA, 64 nt, Homo Sapiens
aaugcugacucaccuccucucggaggaggcguccugucuucacgggggggucccgguggccucc

SEQ ID NO: 723420 - RNA, 64 nt, Homo Sapiens
gcaguguguucagauugccccuggggaucuucugugucuucagcgcccagcccugcguguuccu

SEQ ID NO: 723421 - RNA, 64 nt, Homo Sapiens
aaauuuugauuagugaaacuccaaaugcaauuuaugucuucauacgugauuugaggaguuaaaa

SEQ ID NO: 723422 - RNA, 64 nt, Homo Sapiens
gccccgacaucaacuccuucggaaccuuggagaaugucuucacacugugccucagcuggacauu

SEQ ID NO: 723423 - RNA, 64 nt, Homo Sapiens
ccucacuugauuuuuuuaaccuucuuuuugcaaaugucuucagggaacugagcuaauacuuuuu

SEQ ID NO: 723424 - RNA, 64 nt, Homo Sapiens
uugucugucacucacuacaugaauaagcaaauauugucuucaaaagaaugcacaagaaccacaa

SEQ ID NO: 723425 - RNA, 64 nt, Homo Sapiens
uaauccagcuuugauggacaaagccugcguuguuugucuucaucgcaccuucaguuuauccuca

SEQ ID NO: 723426 - RNA, 64 nt, Homo Sapiens
aggguauguccagauuaagugacaggaacaagucugucuucauggcauuucaguagccaaagag

SEQ ID NO: 723427 - RNA, 64 nt, Homo Sapiens
gaaauccuugcuacuucucuguuuguaaucauuaugucuucauugaaaucuguauaguacacug

SEQ ID NO: 723428 - RNA, 64 nt, Homo Sapiens
auguaaaacucugaauacacauagaccagcuuaaugucuucaggcaugcauugguaacuugaaa

SEQ ID NO: 723429 - RNA, 64 nt, Homo Sapiens
uagaacaggggcuucuggucuauggccaccuguuugucuucauagcgguaucccuccacccaag

SEQ ID NO: 723430 - RNA, 64 nt, Homo Sapiens
caccacuggucuaccugauacaaaggaguaucagugucuucaagucugcagguucugggccugg

SEQ ID NO: 723431 - RNA, 64 nt, Homo Sapiens
aauucgcaacacaacaaucauuuggccaagcccuugucuucacaaaacuucccaacagcagggc

SEQ ID NO: 723432 - RNA, 64 nt, Homo Sapiens
uggauucagaaaaauuaacuuucugaauuugaucugucuucagucuugugaaaaaguugaacaa

SEQ ID NO: 723433 - RNA, 64 nt, Homo Sapiens
auuaaguaacauaauuuuuaaaauuuaaagaaugugucuucaacuaaaaacuuuauucuuuagc

SEQ ID NO: 723434 - RNA, 64 nt, Homo Sapiens
ugauguugucaaguuucuagcuucauaaugauccugucuucaucauaucauauucacuuugaga

SEQ ID NO: 723435 - RNA, 64 nt, Homo Sapiens
gaagucuuccccaaaaauauauguauauauuguaugucuucauccuugguagcggcuggcccau

SEQ ID NO: 723436 - RNA, 64 nt, Homo Sapiens
ucugcaauaaacuaaacguaaacuucuaguaugcugucuucaucaacggugugaaauagaagcc

SEQ ID NO: 723437 - RNA, 64 nt, Homo Sapiens
uuaccuuuuuaauugaaaugagucugaugguaaaugucuucauuuuacagaagaggaguuuuau

SEQ ID NO: 723438 - RNA, 64 nt, Homo Sapiens
ggguccauaaacaauaucugccaacucaaccuguugucuucaaaugcuaaaaaaggagaaugga

SEQ ID NO: 723439 - RNA, 64 nt, Homo Sapiens
gugaaagcucuguguucuuuugccuucaaucuguugucuucaaaacaaacaaacaaaaaaagcu

SEQ ID NO: 723440 - RNA, 64 nt, Homo Sapiens
agaauucacuaacagacagaccaucuggaggagcugucuucaaaugcugugcuuacaccuuauc

SEQ ID NO: 723441 - RNA, 64 nt, Homo Sapiens
agcuguccaguucaggccucuccucuuucccuggugucuucauuuuccuccgucucccugcugu

SEQ ID NO: 723442 - RNA, 64 nt, Homo Sapiens
cucuugauauccauaccuucuaguggguauuaauugucuucagcguuuccaggugucuucauug

SEQ ID NO: 723443 - RNA, 64 nt, Homo Sapiens
guaguggguauuaauugucugacagguuuccaggugucuucauugcucacauugccucucaaga

SEQ ID NO: 723444 - RNA, 64 nt, Homo Sapiens
guucuuacaccaguauuugguucaagacaccaaaugucuucagcccauggcugaagaacaacag

SEQ ID NO: 723445 - RNA, 64 nt, Homo Sapiens
gaguuguaucaccuuuuuuguuugucuuuuauaaugucuucagucugagugugcaaagucaauu

SEQ ID NO: 723446 - RNA, 64 nt, Homo Sapiens
cgaaggggacacuaacuguguuuuagaugagcagugucuucauuccaggccccaaugcaguuau

SEQ ID NO: 723447 - RNA, 64 nt, Homo Sapiens
agucauuuaaaaugcacuguugucauacuaugaaugucuucauuuaaugucuccuugugauauu

SEQ ID NO: 723448 - RNA, 64 nt, Homo Sapiens
uagcugccuugucccuggugagggcaagggucacugucuucacagaaaaaguuugcugacuugu

SEQ ID NO: 723449 - RNA, 64 nt, Homo Sapiens
aaauauuuugaucagauggacucaugaucacagaugucuucacaugccuaugacuaauuuguac

SEQ ID NO: 723450 - RNA, 64 nt, Homo Sapiens
uuccuugagcuaagcagaauaauggaauauaauaugucuucauaauauaacaacacuaauacac

SEQ ID NO: 723451 - RNA, 64 nt, Homo Sapiens
ggaagagugaccuggcaucuuggaaaucauugugugucuucaggagaaugugcagugucuugua

SEQ ID NO: 723452 - RNA, 64 nt, Homo Sapiens
cacguggcccacucccggcccaggcugcuuuccgugucuucaguucuguccaagccaucagcuc

SEQ ID NO: 723453 - RNA, 64 nt, Homo Sapiens
guguguguguguguguguguauuuuuuuuuugguugucuucagcugacaguaugaaaaaugaaa

SEQ ID NO: 723454 - RNA, 64 nt, Homo Sapiens
ggaagucuaugguuggucugaguaaguaacuuccugucuucaugaaaaaaguugacuuugaauc

SEQ ID NO: 723455 - RNA, 64 nt, Homo Sapiens
ucucagaaaacaggccacgguguuucauacagaaugucuucauaucaucugaaaugguauggcu

SEQ ID NO: 723456 - RNA, 64 nt, Homo Sapiens
auggcugaaguucauuuguuuacagggucgggaaugucuucaguucuugagagucaacaguaau

SEQ ID NO: 723457 - RNA, 64 nt, Homo Sapiens
agacacacuguguuagguagaaaaaugcuacagaugucuucaucccuguauauguguccuucuu

SEQ ID NO: 723458 - RNA, 64 nt, Homo Sapiens
cuuuguguuucaguuaggauaauuucuauugaucugucuucaaauucacugauguuuuuucucu

SEQ ID NO: 723459 - RNA, 64 nt, Homo Sapiens
agcaagucagguuucauguaagacauguaucacaugucuucagagggaaacauuuucagggaaa

SEQ ID NO: 723460 - RNA, 64 nt, Homo Sapiens
cuuuacuggggaccugcgagcaaccucgggccagugucuucaggagucgagcagcacccaccuc

SEQ ID NO: 723461 - RNA, 64 nt, Homo Sapiens; identical to SEQ ID NO: 147594

SEQ ID NO: 723462 - RNA, 64 nt, Homo Sapiens; identical to SEQ ID NO: 147595

SEQ ID NO: 723463 - RNA, 64 nt, Homo Sapiens; identical to SEQ ID NO: 147767

SEQ ID NO: 723464 - RNA, 64 nt, Homo Sapiens; identical to SEQ ID NO: 147768

SEQ ID NO: 723465 - RNA, 64 nt, Homo Sapiens; identical to SEQ ID NO: 175075

SEQ ID NO: 723466 - RNA, 64 nt, Homo Sapiens; identical to SEQ ID NO: 175076

SEQ ID NO: 723467 - RNA, 64 nt, Homo Sapiens; identical to SEQ ID NO: 175077

SEQ ID NO: 723468 - RNA, 64 nt, Homo Sapiens; identical to SEQ ID NO: 175078

SEQ ID NO: 723469 - RNA, 64 nt, Homo Sapiens; identical to SEQ ID NO: 175079

SEQ ID NO: 723470 - RNA, 64 nt, Homo Sapiens; identical to SEQ ID NO: 175080

SEQ ID NO: 723471 - RNA, 64 nt, Homo Sapiens; identical to SEQ ID NO: 175081

SEQ ID NO: 723472 - RNA, 64 nt, Homo Sapiens; identical to SEQ ID NO: 175082

SEQ ID NO: 723473 - RNA, 64 nt, Homo Sapiens; identical to SEQ ID NO: 175083

SEQ ID NO: 723474 - RNA, 64 nt, Homo Sapiens; identical to SEQ ID NO: 175084

SEQ ID NO: 723475 - RNA, 64 nt, Homo Sapiens; identical to SEQ ID NO: 199877

SEQ ID NO: 723476 - RNA, 64 nt, Homo Sapiens; identical to SEQ ID NO: 199878

SEQ ID NO: 723477 - RNA, 64 nt, Homo Sapiens; identical to SEQ ID NO: 199879

SEQ ID NO: 723478 - RNA, 64 nt, Homo Sapiens; identical to SEQ ID NO: 199880

SEQ ID NO: 723479 - RNA, 64 nt, Homo Sapiens; identical to SEQ ID NO: 199881

SEQ ID NO: 723480 - RNA, 64 nt, Homo Sapiens; identical to SEQ ID NO: 199882

SEQ ID NO: 723481 - RNA, 64 nt, Homo Sapiens; identical to SEQ ID NO: 199883

SEQ ID NO: 723482 - RNA, 64 nt, Homo Sapiens; identical to SEQ ID NO: 199884

SEQ ID NO: 723483 - RNA, 64 nt, Homo Sapiens; identical to SEQ ID NO: 199885

SEQ ID NO: 723484 - RNA, 64 nt, Homo Sapiens; identical to SEQ ID NO: 199886

SEQ ID NO: 723485 - RNA, 64 nt, Homo Sapiens; identical to SEQ ID NO: 199887

SEQ ID NO: 723486 - RNA, 64 nt, Homo Sapiens; identical to SEQ ID NO: 199888

SEQ ID NO: 723487 - RNA, 64 nt, Homo Sapiens; identical to SEQ ID NO: 199889

SEQ ID NO: 723488 - RNA, 64 nt, Homo Sapiens; identical to SEQ ID NO: 199890

SEQ ID NO: 723489 - RNA, 64 nt, Homo Sapiens; identical to SEQ ID NO: 199891

SEQ ID NO: 723490 - RNA, 64 nt, Homo Sapiens; identical to SEQ ID NO: 199892

SEQ ID NO: 723491 - RNA, 64 nt, Homo Sapiens; identical to SEQ ID NO: 199893

SEQ ID NO: 723492 - RNA, 64 nt, Homo Sapiens; identical to SEQ ID NO: 199894

SEQ ID NO: 723493 - RNA, 64 nt, Homo Sapiens; identical to SEQ ID NO: 199895

SEQ ID NO: 723494 - RNA, 64 nt, Homo Sapiens; identical to SEQ ID NO: 199896

SEQ ID NO: 723495 - RNA, 64 nt, Homo Sapiens; identical to SEQ ID NO: 199897

SEQ ID NO: 723496 - RNA, 64 nt, Homo Sapiens; identical to SEQ ID NO: 391203

SEQ ID NO: 723497 - RNA, 64 nt, Homo Sapiens; identical to SEQ ID NO: 391204

SEQ ID NO: 723498 - RNA, 64 nt, Homo Sapiens; identical to SEQ ID NO: 391205

SEQ ID NO: 723499 - RNA, 64 nt, Homo Sapiens; identical to SEQ ID NO: 391206

SEQ ID NO: 723500 - RNA, 64 nt, Homo Sapiens; identical to SEQ ID NO: 391207

SEQ ID NO: 723501 - RNA, 64 nt, Homo Sapiens; identical to SEQ ID NO: 391208

SEQ ID NO: 723502 - RNA, 64 nt, Homo Sapiens; identical to SEQ ID NO: 391209

SEQ ID NO: 723503 - RNA, 64 nt, Homo Sapiens; identical to SEQ ID NO: 391210

SEQ ID NO: 723504 - RNA, 64 nt, Homo Sapiens; identical to SEQ ID NO: 391211

SEQ ID NO: 723505 - RNA, 64 nt, Homo Sapiens; identical to SEQ ID NO: 391212

SEQ ID NO: 723506 - RNA, 64 nt, Homo Sapiens; identical to SEQ ID NO: 391213

SEQ ID NO: 723507 - RNA, 64 nt, Homo Sapiens; identical to SEQ ID NO: 391214

SEQ ID NO: 723508 - RNA, 64 nt, Homo Sapiens; identical to SEQ ID NO: 391215

SEQ ID NO: 723509 - RNA, 64 nt, Homo Sapiens; identical to SEQ ID NO: 391216

SEQ ID NO: 723510 - RNA, 64 nt, Homo Sapiens; identical to SEQ ID NO: 391217

SEQ ID NO: 723511 - RNA, 64 nt, Homo Sapiens; identical to SEQ ID NO: 391218

SEQ ID NO: 723512 - RNA, 64 nt, Homo Sapiens; identical to SEQ ID NO: 391219

SEQ ID NO: 723513 - RNA, 64 nt, Homo Sapiens; identical to SEQ ID NO: 391220

SEQ ID NO: 723514 - RNA, 64 nt, Homo Sapiens; identical to SEQ ID NO: 391221

SEQ ID NO: 723515 - RNA, 64 nt, Homo Sapiens; identical to SEQ ID NO: 391222

SEQ ID NO: 723516 - RNA, 64 nt, Homo Sapiens; identical to SEQ ID NO: 391223

SEQ ID NO: 723517 - RNA, 64 nt, Homo Sapiens; identical to SEQ ID NO: 391224

SEQ ID NO: 723518 - RNA, 64 nt, Homo Sapiens; identical to SEQ ID NO: 391225

SEQ ID NO: 723519 - RNA, 64 nt, Homo Sapiens; identical to SEQ ID NO: 391226

SEQ ID NO: 723520 - RNA, 64 nt, Homo Sapiens; identical to SEQ ID NO: 391227

SEQ ID NO: 723521 - RNA, 64 nt, Homo Sapiens; identical to SEQ ID NO: 391228

SEQ ID NO: 723522 - RNA, 64 nt, Homo Sapiens; identical to SEQ ID NO: 391229

SEQ ID NO: 723523 - RNA, 64 nt, Homo Sapiens; identical to SEQ ID NO: 391230

SEQ ID NO: 723524 - RNA, 64 nt, Homo Sapiens; identical to SEQ ID NO: 391231

SEQ ID NO: 723525 - RNA, 64 nt, Homo Sapiens; identical to SEQ ID NO: 391232

SEQ ID NO: 723526 - RNA, 64 nt, Homo Sapiens; identical to SEQ ID NO: 391233

SEQ ID NO: 723527 - RNA, 64 nt, Homo Sapiens; identical to SEQ ID NO: 391234

SEQ ID NO: 723528 - RNA, 64 nt, Homo Sapiens; identical to SEQ ID NO: 391235

SEQ ID NO: 723529 - RNA, 64 nt, Homo Sapiens; identical to SEQ ID NO: 391236

SEQ ID NO: 723530 - RNA, 64 nt, Homo Sapiens
auuuccuuccaguggaaagaaaggaggaagggagaauugagaaaauauauuagucuauuauuuu

SEQ ID NO: 723531 - RNA, 64 nt, Homo Sapiens
uuuagaguucuaauacacucuaaauuaaagagaaaauugagaguaaaugacugucuuaucacuc

SEQ ID NO: 723532 - RNA, 64 nt, Homo Sapiens
aaaauuauuugggguuuuguuggauuauguugcaaauugagauuguuuauagauauguaaaaug

SEQ ID NO: 723533 - RNA, 64 nt, Homo Sapiens
acauaacaauagaugauaccacuaacuagaucucaauugagagccaaugugagacucuuaggaa

SEQ ID NO: 723534 - RNA, 64 nt, Homo Sapiens
aacauuuuguucaccauuaaaaaugucaaagaaaaauugagauaucugaauuuucaaagcauaa

SEQ ID NO: 723535 - RNA, 64 nt, Homo Sapiens
auacucuggaaaaacaugucccaucaaauuuuauaauugagaugagaaauaugauaauauaaaa

SEQ ID NO: 723536 - RNA, 64 nt, Homo Sapiens
gaucucuuaggccacuaguuuucugaucacacagaauugagaaauccuaaccauucuuuaccgu

SEQ ID NO: 723537 - RNA, 64 nt, Homo Sapiens
uucaugggaauauucagucaacuugagauuuuugaauugagaaugcaagcaguuuaaagauaag

SEQ ID NO: 723538 - RNA, 64 nt, Homo Sapiens
uucuguuguucauccuuacccaagcuuagaauucaauugagaaggggcacagcgugcuuaggcc

SEQ ID NO: 723539 - RNA, 64 nt, Homo Sapiens
acuguagugacaucugagaaauugagacuaccguaauugagacuuaugaacuuuagucuaaaga

SEQ ID NO: 723540 - RNA, 64 nt, Homo Sapiens
accguaauugagacuacuguacuuuagucuaaagaauugagacuauaaguuggaugaccuauga

SEQ ID NO: 723541 - RNA, 64 nt, Homo Sapiens
ugcugucaguauaaaauacaauguagcuuguccaaauugagauggugacuauugagcccuggaa

SEQ ID NO: 723542 - RNA, 64 nt, Homo Sapiens
caugugacuauugagcccugaccucuuugauuacaauugagauucaauggaaggaugcaggcca

SEQ ID NO: 723543 - RNA, 64 nt, Homo Sapiens
aaaauaaaauaaauucccaaauaaauaacaagauaauugagaaagagcaaaauaauugagaaaa

SEQ ID NO: 723544 - RNA, 64 nt, Homo Sapiens
aauaaauaacaagauaauugucugagagcaaaauaauugagaaaacuggccaaacuugagccaa

SEQ ID NO: 723545 - RNA, 64 nt, Homo Sapiens
aacugagcaaucucucagcccagacugcuuccuaaauugagagaaucggccugccaugggucau

SEQ ID NO: 723546 - RNA, 64 nt, Homo Sapiens
gagugagguuucguacaugcccaauccugacgguaauugagaaugggcugccaggugugcaggg

SEQ ID NO: 723547 - RNA, 64 nt, Homo Sapiens
uaucugaaauacagaauacgcauuguuuuucuaaaauugagaaauaugcucuuaacacacugug

SEQ ID NO: 723548 - RNA, 64 nt, Homo Sapiens
ugauagauuuggagaugagcuuuauuuuaagaagaauugagaaugcugaacaugugguuagucu

SEQ ID NO: 723549 - RNA, 64 nt, Homo Sapiens
ccacaaaauaacauuuuauaaauccucaaaguaaaauugagaaaucuuuaaguuuuuuucaagu

SEQ ID NO: 723550 - RNA, 64 nt, Homo Sapiens
gccuccaucccucuuacucauuuguagucuaggaaauugagauuuugauacaccuaaggucacg

SEQ ID NO: 723551 - RNA, 64 nt, Homo Sapiens
cgcccccuggcuccaggcuaauuuuucuggaaugaauugagaagguggcgugcuggccugagcu

SEQ ID NO: 723552 - RNA, 64 nt, Homo Sapiens
gagauuccugccccucuuuugucacagauuaggaaauugagaacuaggguuaaccuugacuaua

SEQ ID NO: 723553 - RNA, 64 nt, Homo Sapiens
gcagccgggggccgguggccagagcgagggcaccagccacgaaggacggaggcgggcggggccc

SEQ ID NO: 723554 - RNA, 64 nt, Homo Sapiens
aggccacgggccacgggaagaaccaagcggugccagccacgagacgucaccaagaaaacaugca

SEQ ID NO: 723555 - RNA, 64 nt, Homo Sapiens
uuuugaggugcaauguuuaauuguuaaaaauaguagccacgacuuuaucaggcagccccaaacu

SEQ ID NO: 723556 - RNA, 64 nt, Homo Sapiens
ugccaagggugcuggugcggauggacacuaaugcagccacgauuggagaauacuuugcuucaua

SEQ ID NO: 723557 - RNA, 64 nt, Homo Sapiens
uggacccacagccuaagcugagugugaccccagaagccacgaugugcucuguauccagaacaca

SEQ ID NO: 723558 - RNA, 64 nt, Homo Sapiens
agugagcuuggugcgguaggugcuggccucaaacagccacgaggugguagcucugagcccuccu

SEQ ID NO: 723559 - RNA, 64 nt, Homo Sapiens
ugcaguaaguacccgacuaagacauaugacaauaagccacgagguuguuuuuuggugcuaauau

SEQ ID NO: 723560 - RNA, 64 nt, Homo Sapiens
acgcaugccucagccagcccaggagcaaccgugcagccacgaacugucugcugggcuacaaacc

SEQ ID NO: 723561 - RNA, 64 nt, Homo Sapiens
auccuuucccugcaguccaucaugguucauguggagccacgaacggccuguggugccaucuccc

SEQ ID NO: 723562 - RNA, 64 nt, Homo Sapiens
cauaggcauuucaggccaaaagaaauagaacauuagccacgagcagcccucgguaaguauguuu

SEQ ID NO: 723563 - RNA, 64 nt, Homo Sapiens
ccaaaggugaggauaauguucacuccagauaggcagccacgacccuuaauccuuaacaagacag

SEQ ID NO: 723564 - RNA, 64 nt, Homo Sapiens
aggaugccagccccugccuggguugggggcacucagccacgaccagccccuuccuggguauuua

SEQ ID NO: 723565 - RNA, 64 nt, Homo Sapiens
uuguuauugcuacaggcuacgcaucugcauucauagccacgaguaguuauucuaugagaacacu

SEQ ID NO: 723566 - RNA, 64 nt, Homo Sapiens
guucucagugauguauaugcaacauuuuguugaaagccacgauggacuuacaagcuuuaaugga

SEQ ID NO: 723567 - RNA, 64 nt, Homo Sapiens
ccaugagcuuccuuuauuucuggcucacagaggcagccacgaggcacuacaccaaguauuauau

SEQ ID NO: 723568 - RNA, 64 nt, Homo Sapiens
caauuaaauaacugagaccuaagucugggaacagagccacgaaucugccuuugagaugcuggca

SEQ ID NO: 723569 - RNA, 64 nt, Homo Sapiens
aaaaaugccaguuuggcaaagugggccggucaugagccacgauaaaagauuccagcacugagcc

SEQ ID NO: 723570 - RNA, 64 nt, Homo Sapiens
cugugccaccagggagugccuauacauccuguccagccacgacauugagcagcacgcccccuau

SEQ ID NO: 723571 - RNA, 64 nt, Homo Sapiens
gcaauaccuccuccuguguuguauuacacauauuagccacgaguuuuugcagugaccagauaaa

SEQ ID NO: 723572 - RNA, 64 nt, Homo Sapiens
gccacagugugugcacucgagccucagccagagcagccacgacaguccaggguggagcgcgcca

SEQ ID NO: 723573 - RNA, 64 nt, Homo Sapiens
ugauaauuacagacaagagaggagagguagagguagccacgagcgaugagacaagagguagagg

SEQ ID NO: 723574 - RNA, 64 nt, Homo Sapiens
gcaggguggaccccaguuuggaagcugagcccccagccacgaacauggaucugaggaggggccc

SEQ ID NO: 723575 - RNA, 64 nt, Homo Sapiens
gucugugcacgucugugcuguuucgcacuguggcagccacgagaagcagugguggcuggcgcgc

SEQ ID NO: 723576 - RNA, 64 nt, Homo Sapiens
ccagcccugcaggugggacuggcucucccuccccagccacgaguaugccacagggggcuuucaa

SEQ ID NO: 723577 - RNA, 64 nt, Homo Sapiens
gauugcuugagcgagggaggucgaggcugcagugagccacgaucacaccacugcacuccagccu

SEQ ID NO: 723578 - RNA, 64 nt, Homo Sapiens
aacaugcagccacugggcccgucgcugcaaacacagccacgaagcaaggccuggagggcccaau

SEQ ID NO: 723579 - RNA, 63 nt, Homo Sapiens
ccucugugauggcagugugagcuggacugugucagccacgacucgagcacucauucugcuccc

SEQ ID NO: 723580 - RNA, 64 nt, Homo Sapiens
ugggugggagcuggcagucucaagaugaacaggcagccacgaggccagcuaggaggaaauggag

SEQ ID NO: 723581 - RNA, 64 nt, Homo Sapiens
ucaggaucgcuuccuugugacacucagcaccuucagccacgauuucauccuuggagagacugag

SEQ ID NO: 723582 - RNA, 64 nt, Homo Sapiens
gugaagccagcauguucaccacuggucguucagcagccacgacagcaccaugugagauggcgag

SEQ ID NO: 723583 - RNA, 64 nt, Homo Sapiens
gguuuguuucuguuuucuuggcagcagccuccacagccacgauguuauacaccagugugugccu

SEQ ID NO: 723584 - RNA, 64 nt, Homo Sapiens
uuuuacagaaaaugagcaaucaggguccgccgagagccacgauucacuuugcaccuccuauccc

SEQ ID NO: 723585 - RNA, 64 nt, Homo Sapiens
uguguaaauaauuugcacugaaacguggauacagagccacgaguuuggauguuguaaauaaaac

SEQ ID NO: 723586 - RNA, 64 nt, Homo Sapiens
agccaaugauccccccucaggacaaaucuacuccagccacgaugagaagugggugagccagggu

SEQ ID NO: 723587 - RNA, 64 nt, Homo Sapiens
acccaaaggauaagaaagaaucacucaaaaucagagccacgaugcccagaguucuucgcuccac

SEQ ID NO: 723588 - RNA, 64 nt, Homo Sapiens
agaagaagcagcagaaggagcaggagcaagugagagccacgagccaaggugggcacuugauguc

SEQ ID NO: 723589 - RNA, 64 nt, Homo Sapiens
gucccccaugccuuggugcgccaguuacuuaagcagccacgagucggagggggcugugcacaua

SEQ ID NO: 723590 - RNA, 64 nt, Homo Sapiens
agugcugggaucacaggcaugagccacugugcccagccacgagcugcuuuuuauccaccuuccg

SEQ ID NO: 723591 - RNA, 64 nt, Homo Sapiens
gaaugaaagagcggagacgguaguuuaguauuugagccacgaguuuaugugcacaaguguuuug

SEQ ID NO: 723592 - RNA, 64 nt, Homo Sapiens
gggaacauuaaaacaguaacugacauccaguuaaagccacgaucgucagcaauucuccuuuuuu

SEQ ID NO: 723593 - RNA, 64 nt, Homo Sapiens
agccacuguccgucuuuaaacagaaagucaaaggagccacgaagcaagcggccguccgggcguc

SEQ ID NO: 723594 - RNA, 64 nt, Homo Sapiens
ugccagcuggaggugaaacugugcuuguauccccagccacgaagagcuggaccagcuucaagua

SEQ ID NO: 723595 - RNA, 64 nt, Homo Sapiens
ccuuccuaagcaucuccuguggagaagaggcaccagccacgauucugggguaugggaugagcau

SEQ ID NO: 723596 - RNA, 64 nt, Homo Sapiens
agcccgccagaggccugaagccagcuacugaaccagccacgaaccagugcaauacgggagugac

SEQ ID NO: 723597 - RNA, 64 nt, Homo Sapiens
ggcagagacgcaguugucucugggcgcuugccagagccacgaaccccagaccuguuuguaucau

SEQ ID NO: 723598 - RNA, 64 nt, Homo Sapiens
ccauugcccacaaccccuccagcauuauugugacagccacgaacggaaaccacagcauuaucac

SEQ ID NO: 723599 - RNA, 64 nt, Homo Sapiens
cucggggugggggugggcagcccccgcacgcgggagccacgaacggcccccgcgcgcucuagug

SEQ ID NO: 723600 - RNA, 64 nt, Homo Sapiens
cuucuuaagacauguaucacacguggagcaugggagccacgacccuccagguaggcccguuuuc

SEQ ID NO: 723601 - RNA, 64 nt, Homo Sapiens
ggcagcaggccccgauaccgggaagagccgacacagccacgaaccagacaagcagacaaucagc

SEQ ID NO: 723602 - RNA, 64 nt, Homo Sapiens
auuacacaucaagcgaugaaacuggaaaacuacaagccacgaaugaaugaauuaggaaagaaaa

SEQ ID NO: 723603 - RNA, 64 nt, Homo Sapiens
ggauggaugugcaucugccccgaguaaauucuucagccacgaagaaaacacaagacccuccgcc

SEQ ID NO: 723604 - RNA, 64 nt, Homo Sapiens
uugcugggugguucucuggggcugcugggccccgagccacgaacucaggggaggccagaggaga

SEQ ID NO: 723605 - RNA, 64 nt, Homo Sapiens
aaugguaugcuguugcugauccucccagugucuaagccacgaaugucucgguuauccaccccua

SEQ ID NO: 723606 - RNA, 64 nt, Homo Sapiens
cuggcaggaugaaucgcaggauggcgcguacugaagccacgauguucauccaggccaaagcagg

SEQ ID NO: 723607 - RNA, 64 nt, Homo Sapiens
uuaacguuuucauuaaaauuuuuuuuguaacuggagccacgacguaacaaauauggggaaaaaa

SEQ ID NO: 723608 - RNA, 64 nt, Homo Sapiens
agguaaaugccugcacccauaauuuucuaguaauagccacgaccaauuuauuaacagucagggc

SEQ ID NO: 723609 - RNA, 64 nt, Homo Sapiens
ggucagggccuacagcuguguuguccaguacaggagccacgagccaaauguggcauuugaauuu

SEQ ID NO: 723610 - RNA, 64 nt, Homo Sapiens
ccagcgcaaaacccuuacucgucucugcgccauaagccacgaucgaaugauuggucauggggaa

SEQ ID NO: 723611 - RNA, 64 nt, Homo Sapiens
auugugcuacuuauacugguucugaagugaaaguagccacgagacacaucaauaaacaugacac

SEQ ID NO: 723612 - RNA, 64 nt, Homo Sapiens
ggugcccacaggccgcccugcgggugaacaaagcagccacgaggugcaacaagguccucuguca

SEQ ID NO: 723613 - RNA, 64 nt, Homo Sapiens
gucuccaucuccugaccucggguuucacuguguuagccacgauguguauuuucacuggagacgg

SEQ ID NO: 723614 - RNA, 64 nt, Homo Sapiens
gccauguaagguugugcaggucauauuccaacccagccacgacuggcagcaagggaccugcuca

SEQ ID NO: 723615 - RNA, 64 nt, Homo Sapiens
gaucgcugguuuccucugcagucuuuugccucgaagccacgaugaaacugcgucucggaugucu

SEQ ID NO: 723616 - RNA, 64 nt, Homo Sapiens
ugaaaaugacaaucccuuucgcugucuucuaaaaagccacgacagaaucagaguagaggacaug

SEQ ID NO: 723617 - RNA, 64 nt, Homo Sapiens
uccguccaccccugcaaagccaagacccuucugcagccacgaauguccacggagcccgccggca

SEQ ID NO: 723618 - RNA, 64 nt, Homo Sapiens
caugauauuugacuuuucauacuaguugaucuggaugaguuauaccaaaaaucagugucuaggg

SEQ ID NO: 723619 - RNA, 64 nt, Homo Sapiens
aaugguauuugacuuuucauacugguugaucuagaugaguuauaccaaaaaucagugucuaggg

SEQ ID NO: 723620 - RNA, 64 nt, Homo Sapiens
cauauucuguuggaagcuugagguagaaugaguuaugaguuauuagcgucccaaaucaauaaga

SEQ ID NO: 723621 - RNA, 64 nt, Homo Sapiens
aguuauucauauucuguuggaauaagaagguagaaugaguuauguggggggagcgucccaaauc

SEQ ID NO: 723622 - RNA, 64 nt, Homo Sapiens
caugguccuggacccagcaauagcuuuuugugccaugaguuagcaauucagaccaaaccaggac

SEQ ID NO: 723623 - RNA, 64 nt, Homo Sapiens
guagccagaaguugggaaacuaguucauugcaccaugaguuauauguacuggucuauagcugua

SEQ ID NO: 723624 - RNA, 64 nt, Homo Sapiens
acaugaaaaaauuaugggaaaaacaaagaauuacaugaguuaguaaucacuucagaucucuaaa

SEQ ID NO: 723625 - RNA, 64 nt, Homo Sapiens
uguggaggucagaguggaaggcuguuagaauuacaugaguuagaaguaguaccuacaguauagu

SEQ ID NO: 723626 - RNA, 64 nt, Homo Sapiens; identical to SEQ ID NO: 161144

SEQ ID NO: 723627 - RNA, 64 nt, Homo Sapiens; identical to SEQ ID NO: 161145

SEQ ID NO: 723628 - RNA, 64 nt, Homo Sapiens; identical to SEQ ID NO: 161146

SEQ ID NO: 723629 - RNA, 64 nt, Homo Sapiens; identical to SEQ ID NO: 161147

SEQ ID NO: 723630 - RNA, 64 nt, Homo Sapiens; identical to SEQ ID NO: 161148

SEQ ID NO: 723631 - RNA, 64 nt, Homo Sapiens; identical to SEQ ID NO: 119680

SEQ ID NO: 723632 - RNA, 64 nt, Homo Sapiens; identical to SEQ ID NO: 119681

SEQ ID NO: 723633 - RNA, 64 nt, Homo Sapiens; identical to SEQ ID NO: 119682

SEQ ID NO: 723634 - RNA, 64 nt, Homo Sapiens; identical to SEQ ID NO: 119683

SEQ ID NO: 723635 - RNA, 64 nt, Homo Sapiens; identical to SEQ ID NO: 119684

SEQ ID NO: 723636 - RNA, 64 nt, Homo Sapiens; identical to SEQ ID NO: 119685

SEQ ID NO: 723637 - RNA, 64 nt, Homo Sapiens; identical to SEQ ID NO: 119686

SEQ ID NO: 723638 - RNA, 64 nt, Homo Sapiens; identical to SEQ ID NO: 119687

SEQ ID NO: 723639 - RNA, 64 nt, Homo Sapiens; identical to SEQ ID NO: 119688

SEQ ID NO: 723640 - RNA, 64 nt, Homo Sapiens; identical to SEQ ID NO: 119689

SEQ ID NO: 723641 - RNA, 64 nt, Homo Sapiens; identical to SEQ ID NO: 119690

SEQ ID NO: 723642 - RNA, 64 nt, Homo Sapiens; identical to SEQ ID NO: 119691

SEQ ID NO: 723643 - RNA, 64 nt, Homo Sapiens; identical to SEQ ID NO: 119692

SEQ ID NO: 723644 - RNA, 64 nt, Homo Sapiens; identical to SEQ ID NO: 119693

SEQ ID NO: 723645 - RNA, 64 nt, Homo Sapiens; identical to SEQ ID NO: 119694

SEQ ID NO: 723646 - RNA, 64 nt, Homo Sapiens; identical to SEQ ID NO: 119695

SEQ ID NO: 723647 - RNA, 64 nt, Homo Sapiens; identical to SEQ ID NO: 119696

SEQ ID NO: 723648 - RNA, 64 nt, Homo Sapiens; identical to SEQ ID NO: 119697

SEQ ID NO: 723649 - RNA, 64 nt, Homo Sapiens; identical to SEQ ID NO: 119698

SEQ ID NO: 723650 - RNA, 64 nt, Homo Sapiens; identical to SEQ ID NO: 119699

SEQ ID NO: 723651 - RNA, 64 nt, Homo Sapiens; identical to SEQ ID NO: 119700

SEQ ID NO: 723652 - RNA, 64 nt, Homo Sapiens; identical to SEQ ID NO: 119701

SEQ ID NO: 723653 - RNA, 64 nt, Homo Sapiens; identical to SEQ ID NO: 119702

SEQ ID NO: 723654 - RNA, 64 nt, Homo Sapiens; identical to SEQ ID NO: 119703

SEQ ID NO: 723655 - RNA, 64 nt, Homo Sapiens; identical to SEQ ID NO: 119704

SEQ ID NO: 723656 - RNA, 64 nt, Homo Sapiens; identical to SEQ ID NO: 119705

SEQ ID NO: 723657 - RNA, 64 nt, Homo Sapiens; identical to SEQ ID NO: 119706

SEQ ID NO: 723658 - RNA, 64 nt, Homo Sapiens; identical to SEQ ID NO: 119707

SEQ ID NO: 723659 - RNA, 64 nt, Homo Sapiens; identical to SEQ ID NO: 119708

SEQ ID NO: 723660 - RNA, 64 nt, Homo Sapiens; identical to SEQ ID NO: 119709

SEQ ID NO: 723661 - RNA, 64 nt, Homo Sapiens; identical to SEQ ID NO: 119710

SEQ ID NO: 723662 - RNA, 64 nt, Homo Sapiens; identical to SEQ ID NO: 119711

SEQ ID NO: 723663 - RNA, 64 nt, Homo Sapiens; identical to SEQ ID NO: 119712

SEQ ID NO: 723664 - RNA, 64 nt, Homo Sapiens; identical to SEQ ID NO: 119713

SEQ ID NO: 723665 - RNA, 64 nt, Homo Sapiens; identical to SEQ ID NO: 119714

SEQ ID NO: 723666 - RNA, 64 nt, Homo Sapiens; identical to SEQ ID NO: 119715

SEQ ID NO: 723667 - RNA, 64 nt, Homo Sapiens; identical to SEQ ID NO: 119716

SEQ ID NO: 723668 - RNA, 64 nt, Homo Sapiens; identical to SEQ ID NO: 260343

SEQ ID NO: 723669 - RNA, 64 nt, Homo Sapiens; identical to SEQ ID NO: 260344

SEQ ID NO: 723670 - RNA, 64 nt, Homo Sapiens; identical to SEQ ID NO: 260345

SEQ ID NO: 723671 - RNA, 64 nt, Homo Sapiens; identical to SEQ ID NO: 260346

SEQ ID NO: 723672 - RNA, 64 nt, Homo Sapiens; identical to SEQ ID NO: 260347

SEQ ID NO: 723673 - RNA, 64 nt, Homo Sapiens; identical to SEQ ID NO: 260348

SEQ ID NO: 723674 - RNA, 64 nt, Homo Sapiens; identical to SEQ ID NO: 260349

SEQ ID NO: 723675 - RNA, 64 nt, Homo Sapiens; identical to SEQ ID NO: 260350

SEQ ID NO: 723676 - RNA, 57 nt, Homo Sapiens; identical to SEQ ID NO: 260351

SEQ ID NO: 723677 - RNA, 64 nt, Homo Sapiens; identical to SEQ ID NO: 260352

SEQ ID NO: 723678 - RNA, 64 nt, Homo Sapiens; identical to SEQ ID NO: 260353

SEQ ID NO: 723679 - RNA, 64 nt, Homo Sapiens; identical to SEQ ID NO: 260354

SEQ ID NO: 723680 - RNA, 64 nt, Homo Sapiens; identical to SEQ ID NO: 260355

SEQ ID NO: 723681 - RNA, 64 nt, Homo Sapiens; identical to SEQ ID NO: 260356

SEQ ID NO: 723682 - RNA, 64 nt, Homo Sapiens; identical to SEQ ID NO: 260357

SEQ ID NO: 723683 - RNA, 64 nt, Homo Sapiens; identical to SEQ ID NO: 260358

SEQ ID NO: 723684 - RNA, 64 nt, Homo Sapiens; identical to SEQ ID NO: 260359

SEQ ID NO: 723685 - RNA, 64 nt, Homo Sapiens; identical to SEQ ID NO: 260360

SEQ ID NO: 723686 - RNA, 64 nt, Homo Sapiens; identical to SEQ ID NO: 260361

SEQ ID NO: 723687 - RNA, 64 nt, Homo Sapiens; identical to SEQ ID NO: 260362

SEQ ID NO: 723688 - RNA, 64 nt, Homo Sapiens; identical to SEQ ID NO: 260363

SEQ ID NO: 723689 - RNA, 64 nt, Homo Sapiens; identical to SEQ ID NO: 260364

SEQ ID NO: 723690 - RNA, 64 nt, Homo Sapiens; identical to SEQ ID NO: 260365

SEQ ID NO: 723691 - RNA, 64 nt, Homo Sapiens; identical to SEQ ID NO: 260366

SEQ ID NO: 723692 - RNA, 64 nt, Homo Sapiens; identical to SEQ ID NO: 260367

SEQ ID NO: 723693 - RNA, 64 nt, Homo Sapiens; identical to SEQ ID NO: 260368

SEQ ID NO: 723694 - RNA, 64 nt, Homo Sapiens; identical to SEQ ID NO: 260369

SEQ ID NO: 723695 - RNA, 64 nt, Homo Sapiens; identical to SEQ ID NO: 260370

SEQ ID NO: 723696 - RNA, 64 nt, Homo Sapiens; identical to SEQ ID NO: 260371

SEQ ID NO: 723697 - RNA, 64 nt, Homo Sapiens; identical to SEQ ID NO: 260372

SEQ ID NO: 723698 - RNA, 64 nt, Homo Sapiens; identical to SEQ ID NO: 260373

SEQ ID NO: 723699 - RNA, 64 nt, Homo Sapiens; identical to SEQ ID NO: 260374

SEQ ID NO: 723700 - RNA, 64 nt, Homo Sapiens; identical to SEQ ID NO: 260375

SEQ ID NO: 723701 - RNA, 64 nt, Homo Sapiens; identical to SEQ ID NO: 260376

SEQ ID NO: 723702 - RNA, 64 nt, Homo Sapiens; identical to SEQ ID NO: 260377

SEQ ID NO: 723703 - RNA, 64 nt, Homo Sapiens; identical to SEQ ID NO: 260378

SEQ ID NO: 723704 - RNA, 64 nt, Homo Sapiens; identical to SEQ ID NO: 260379

SEQ ID NO: 723705 - RNA, 64 nt, Homo Sapiens; identical to SEQ ID NO: 260380

SEQ ID NO: 723706 - RNA, 64 nt, Homo Sapiens; identical to SEQ ID NO: 260381

SEQ ID NO: 723707 - RNA, 64 nt, Homo Sapiens; identical to SEQ ID NO: 260382

SEQ ID NO: 723708 - RNA, 64 nt, Homo Sapiens; identical to SEQ ID NO: 260383

SEQ ID NO: 723709 - RNA, 64 nt, Homo Sapiens; identical to SEQ ID NO: 260384

SEQ ID NO: 723710 - RNA, 64 nt, Homo Sapiens; identical to SEQ ID NO: 260385

SEQ ID NO: 723711 - RNA, 64 nt, Homo Sapiens; identical to SEQ ID NO: 260386

SEQ ID NO: 723712 - RNA, 64 nt, Homo Sapiens; identical to SEQ ID NO: 260387

SEQ ID NO: 723713 - RNA, 64 nt, Homo Sapiens; identical to SEQ ID NO: 260388

SEQ ID NO: 723714 - RNA, 64 nt, Homo Sapiens; identical to SEQ ID NO: 260389

SEQ ID NO: 723715 - RNA, 64 nt, Homo Sapiens; identical to SEQ ID NO: 260390

SEQ ID NO: 723716 - RNA, 64 nt, Homo Sapiens; identical to SEQ ID NO: 260391

SEQ ID NO: 723717 - RNA, 64 nt, Homo Sapiens; identical to SEQ ID NO: 260392

SEQ ID NO: 723718 - RNA, 64 nt, Homo Sapiens; identical to SEQ ID NO: 260393

SEQ ID NO: 723719 - RNA, 64 nt, Homo Sapiens; identical to SEQ ID NO: 260394

SEQ ID NO: 723720 - RNA, 64 nt, Homo Sapiens; identical to SEQ ID NO: 260395

SEQ ID NO: 723721 - RNA, 64 nt, Homo Sapiens; identical to SEQ ID NO: 260396

SEQ ID NO: 723722 - RNA, 64 nt, Homo Sapiens; identical to SEQ ID NO: 260397

SEQ ID NO: 723723 - RNA, 64 nt, Homo Sapiens; identical to SEQ ID NO: 260398

SEQ ID NO: 723724 - RNA, 64 nt, Homo Sapiens; identical to SEQ ID NO: 260399

SEQ ID NO: 723725 - RNA, 64 nt, Homo Sapiens; identical to SEQ ID NO: 260400

SEQ ID NO: 723726 - RNA, 64 nt, Homo Sapiens; identical to SEQ ID NO: 260401

SEQ ID NO: 723727 - RNA, 64 nt, Homo Sapiens; identical to SEQ ID NO: 260402

SEQ ID NO: 723728 - RNA, 64 nt, Homo Sapiens; identical to SEQ ID NO: 260403

SEQ ID NO: 723729 - RNA, 64 nt, Homo Sapiens; identical to SEQ ID NO: 260404

SEQ ID NO: 723730 - RNA, 64 nt, Homo Sapiens; identical to SEQ ID NO: 260405

SEQ ID NO: 723731 - RNA, 64 nt, Homo Sapiens; identical to SEQ ID NO: 260406

SEQ ID NO: 723732 - RNA, 64 nt, Homo Sapiens; identical to SEQ ID NO: 260407

SEQ ID NO: 723733 - RNA, 64 nt, Homo Sapiens; identical to SEQ ID NO: 260408

SEQ ID NO: 723734 - RNA, 64 nt, Homo Sapiens; identical to SEQ ID NO: 260409

SEQ ID NO: 723735 - RNA, 64 nt, Homo Sapiens; identical to SEQ ID NO: 260410

SEQ ID NO: 723736 - RNA, 64 nt, Homo Sapiens; identical to SEQ ID NO: 260411

SEQ ID NO: 723737 - RNA, 64 nt, Homo Sapiens; identical to SEQ ID NO: 260412

SEQ ID NO: 723738 - RNA, 64 nt, Homo Sapiens; identical to SEQ ID NO: 260413

SEQ ID NO: 723739 - RNA, 64 nt, Homo Sapiens; identical to SEQ ID NO: 260414

SEQ ID NO: 723740 - RNA, 64 nt, Homo Sapiens; identical to SEQ ID NO: 260415

SEQ ID NO: 723741 - RNA, 64 nt, Homo Sapiens; identical to SEQ ID NO: 260416

SEQ ID NO: 723742 - RNA, 64 nt, Homo Sapiens; identical to SEQ ID NO: 260417

SEQ ID NO: 723743 - RNA, 64 nt, Homo Sapiens; identical to SEQ ID NO: 260418

SEQ ID NO: 723744 - RNA, 64 nt, Homo Sapiens; identical to SEQ ID NO: 260419

SEQ ID NO: 723745 - RNA, 64 nt, Homo Sapiens; identical to SEQ ID NO: 260420

SEQ ID NO: 723746 - RNA, 64 nt, Homo Sapiens; identical to SEQ ID NO: 260421

SEQ ID NO: 723747 - RNA, 64 nt, Homo Sapiens; identical to SEQ ID NO: 260422

SEQ ID NO: 723748 - RNA, 64 nt, Homo Sapiens; identical to SEQ ID NO: 260423

SEQ ID NO: 723749 - RNA, 64 nt, Homo Sapiens; identical to SEQ ID NO: 260424

SEQ ID NO: 723750 - RNA, 64 nt, Homo Sapiens; identical to SEQ ID NO: 260425

SEQ ID NO: 723751 - RNA, 64 nt, Homo Sapiens; identical to SEQ ID NO: 260426

SEQ ID NO: 723752 - RNA, 64 nt, Homo Sapiens; identical to SEQ ID NO: 260427

SEQ ID NO: 723753 - RNA, 64 nt, Homo Sapiens; identical to SEQ ID NO: 260428

SEQ ID NO: 723754 - RNA, 64 nt, Homo Sapiens; identical to SEQ ID NO: 260429

SEQ ID NO: 723755 - RNA, 64 nt, Homo Sapiens; identical to SEQ ID NO: 260430

SEQ ID NO: 723756 - RNA, 64 nt, Homo Sapiens; identical to SEQ ID NO: 260431

SEQ ID NO: 723757 - RNA, 64 nt, Homo Sapiens; identical to SEQ ID NO: 260432

SEQ ID NO: 723758 - RNA, 64 nt, Homo Sapiens; identical to SEQ ID NO: 260433

SEQ ID NO: 723759 - RNA, 64 nt, Homo Sapiens; identical to SEQ ID NO: 260434

SEQ ID NO: 723760 - RNA, 64 nt, Homo Sapiens; identical to SEQ ID NO: 260435

SEQ ID NO: 723761 - RNA, 64 nt, Homo Sapiens; identical to SEQ ID NO: 260436

SEQ ID NO: 723762 - RNA, 64 nt, Homo Sapiens; identical to SEQ ID NO: 260437

SEQ ID NO: 723763 - RNA, 64 nt, Homo Sapiens; identical to SEQ ID NO: 260438

SEQ ID NO: 723764 - RNA, 64 nt, Homo Sapiens; identical to SEQ ID NO: 260439

SEQ ID NO: 723765 - RNA, 64 nt, Homo Sapiens; identical to SEQ ID NO: 260440

SEQ ID NO: 723766 - RNA, 64 nt, Homo Sapiens; identical to SEQ ID NO: 260441

SEQ ID NO: 723767 - RNA, 64 nt, Homo Sapiens; identical to SEQ ID NO: 260442

SEQ ID NO: 723768 - RNA, 64 nt, Homo Sapiens; identical to SEQ ID NO: 260443

SEQ ID NO: 723769 - RNA, 64 nt, Homo Sapiens; identical to SEQ ID NO: 260444

SEQ ID NO: 723770 - RNA, 64 nt, Homo Sapiens; identical to SEQ ID NO: 260445

SEQ ID NO: 723771 - RNA, 64 nt, Homo Sapiens; identical to SEQ ID NO: 260446

SEQ ID NO: 723772 - RNA, 64 nt, Homo Sapiens; identical to SEQ ID NO: 260447

SEQ ID NO: 723773 - RNA, 64 nt, Homo Sapiens; identical to SEQ ID NO: 260448

SEQ ID NO: 723774 - RNA, 64 nt, Homo Sapiens; identical to SEQ ID NO: 260449

SEQ ID NO: 723775 - RNA, 64 nt, Homo Sapiens; identical to SEQ ID NO: 260450

SEQ ID NO: 723776 - RNA, 64 nt, Homo Sapiens; identical to SEQ ID NO: 260451

SEQ ID NO: 723777 - RNA, 64 nt, Homo Sapiens; identical to SEQ ID NO: 260452

SEQ ID NO: 723778 - RNA, 64 nt, Homo Sapiens; identical to SEQ ID NO: 260453

SEQ ID NO: 723779 - RNA, 64 nt, Homo Sapiens; identical to SEQ ID NO: 260454

SEQ ID NO: 723780 - RNA, 64 nt, Homo Sapiens; identical to SEQ ID NO: 260455

SEQ ID NO: 723781 - RNA, 64 nt, Homo Sapiens; identical to SEQ ID NO: 260456

SEQ ID NO: 723782 - RNA, 64 nt, Homo Sapiens; identical to SEQ ID NO: 260457

SEQ ID NO: 723783 - RNA, 64 nt, Homo Sapiens; identical to SEQ ID NO: 260458

SEQ ID NO: 723784 - RNA, 64 nt, Homo Sapiens; identical to SEQ ID NO: 260459

SEQ ID NO: 723785 - RNA, 64 nt, Homo Sapiens; identical to SEQ ID NO: 260460

SEQ ID NO: 723786 - RNA, 64 nt, Homo Sapiens; identical to SEQ ID NO: 260461

SEQ ID NO: 723787 - RNA, 64 nt, Homo Sapiens; identical to SEQ ID NO: 260462

SEQ ID NO: 723788 - RNA, 64 nt, Homo Sapiens; identical to SEQ ID NO: 260463

SEQ ID NO: 723789 - RNA, 64 nt, Homo Sapiens; identical to SEQ ID NO: 260464

SEQ ID NO: 723790 - RNA, 64 nt, Homo Sapiens; identical to SEQ ID NO: 260465

SEQ ID NO: 723791 - RNA, 64 nt, Homo Sapiens; identical to SEQ ID NO: 260466

SEQ ID NO: 723792 - RNA, 64 nt, Homo Sapiens; identical to SEQ ID NO: 260467

SEQ ID NO: 723793 - RNA, 64 nt, Homo Sapiens; identical to SEQ ID NO: 260468

SEQ ID NO: 723794 - RNA, 64 nt, Homo Sapiens; identical to SEQ ID NO: 260469

SEQ ID NO: 723795 - RNA, 56 nt, Homo Sapiens; identical to SEQ ID NO: 260470

SEQ ID NO: 723796 - RNA, 64 nt, Homo Sapiens; identical to SEQ ID NO: 260471

SEQ ID NO: 723797 - RNA, 64 nt, Homo Sapiens; identical to SEQ ID NO: 260472

SEQ ID NO: 723798 - RNA, 64 nt, Homo Sapiens; identical to SEQ ID NO: 260473

SEQ ID NO: 723799 - RNA, 64 nt, Homo Sapiens; identical to SEQ ID NO: 260474

SEQ ID NO: 723800 - RNA, 64 nt, Homo Sapiens; identical to SEQ ID NO: 260475

SEQ ID NO: 723801 - RNA, 64 nt, Homo Sapiens; identical to SEQ ID NO: 260476

SEQ ID NO: 723802 - RNA, 64 nt, Homo Sapiens; identical to SEQ ID NO: 260477

SEQ ID NO: 723803 - RNA, 64 nt, Homo Sapiens; identical to SEQ ID NO: 260478

SEQ ID NO: 723804 - RNA, 64 nt, Homo Sapiens; identical to SEQ ID NO: 260479

SEQ ID NO: 723805 - RNA, 64 nt, Homo Sapiens; identical to SEQ ID NO: 260480

SEQ ID NO: 723806 - RNA, 64 nt, Homo Sapiens; identical to SEQ ID NO: 260481

SEQ ID NO: 723807 - RNA, 64 nt, Homo Sapiens; identical to SEQ ID NO: 260482

SEQ ID NO: 723808 - RNA, 64 nt, Homo Sapiens; identical to SEQ ID NO: 260483

SEQ ID NO: 723809 - RNA, 64 nt, Homo Sapiens; identical to SEQ ID NO: 260484

SEQ ID NO: 723810 - RNA, 64 nt, Homo Sapiens; identical to SEQ ID NO: 260485

SEQ ID NO: 723811 - RNA, 64 nt, Homo Sapiens; identical to SEQ ID NO: 260486

SEQ ID NO: 723812 - RNA, 64 nt, Homo Sapiens; identical to SEQ ID NO: 260487

SEQ ID NO: 723813 - RNA, 64 nt, Homo Sapiens; identical to SEQ ID NO: 260488

SEQ ID NO: 723814 - RNA, 64 nt, Homo Sapiens; identical to SEQ ID NO: 260489

SEQ ID NO: 723815 - RNA, 64 nt, Homo Sapiens; identical to SEQ ID NO: 260490

SEQ ID NO: 723816 - RNA, 64 nt, Homo Sapiens; identical to SEQ ID NO: 260491

SEQ ID NO: 723817 - RNA, 64 nt, Homo Sapiens; identical to SEQ ID NO: 260492

SEQ ID NO: 723818 - RNA, 64 nt, Homo Sapiens; identical to SEQ ID NO: 260493

SEQ ID NO: 723819 - RNA, 64 nt, Homo Sapiens; identical to SEQ ID NO: 260494

SEQ ID NO: 723820 - RNA, 64 nt, Homo Sapiens; identical to SEQ ID NO: 260495

SEQ ID NO: 723821 - RNA, 64 nt, Homo Sapiens; identical to SEQ ID NO: 260496

SEQ ID NO: 723822 - RNA, 64 nt, Homo Sapiens; identical to SEQ ID NO: 260497

SEQ ID NO: 723823 - RNA, 64 nt, Homo Sapiens; identical to SEQ ID NO: 260498

SEQ ID NO: 723824 - RNA, 64 nt, Homo Sapiens; identical to SEQ ID NO: 260499

SEQ ID NO: 723825 - RNA, 64 nt, Homo Sapiens; identical to SEQ ID NO: 260500

SEQ ID NO: 723826 - RNA, 64 nt, Homo Sapiens; identical to SEQ ID NO: 260501

SEQ ID NO: 723827 - RNA, 64 nt, Homo Sapiens; identical to SEQ ID NO: 260502

SEQ ID NO: 723828 - RNA, 64 nt, Homo Sapiens; identical to SEQ ID NO: 260503

SEQ ID NO: 723829 - RNA, 64 nt, Homo Sapiens; identical to SEQ ID NO: 260504

SEQ ID NO: 723830 - RNA, 64 nt, Homo Sapiens; identical to SEQ ID NO: 260505

SEQ ID NO: 723831 - RNA, 64 nt, Homo Sapiens; identical to SEQ ID NO: 260506

SEQ ID NO: 723832 - RNA, 64 nt, Homo Sapiens; identical to SEQ ID NO: 260507

SEQ ID NO: 723833 - RNA, 64 nt, Homo Sapiens; identical to SEQ ID NO: 260508

SEQ ID NO: 723834 - RNA, 64 nt, Homo Sapiens; identical to SEQ ID NO: 260509

SEQ ID NO: 723835 - RNA, 64 nt, Homo Sapiens; identical to SEQ ID NO: 260510

SEQ ID NO: 723836 - RNA, 64 nt, Homo Sapiens; identical to SEQ ID NO: 260511

SEQ ID NO: 723837 - RNA, 64 nt, Homo Sapiens; identical to SEQ ID NO: 260512

SEQ ID NO: 723838 - RNA, 64 nt, Homo Sapiens; identical to SEQ ID NO: 260513

SEQ ID NO: 723839 - RNA, 64 nt, Homo Sapiens; identical to SEQ ID NO: 260514

SEQ ID NO: 723840 - RNA, 64 nt, Homo Sapiens; identical to SEQ ID NO: 260515

SEQ ID NO: 723841 - RNA, 64 nt, Homo Sapiens; identical to SEQ ID NO: 260516

SEQ ID NO: 723842 - RNA, 64 nt, Homo Sapiens; identical to SEQ ID NO: 260517

SEQ ID NO: 723843 - RNA, 64 nt, Homo Sapiens; identical to SEQ ID NO: 260518

SEQ ID NO: 723844 - RNA, 64 nt, Homo Sapiens; identical to SEQ ID NO: 260519

SEQ ID NO: 723845 - RNA, 64 nt, Homo Sapiens; identical to SEQ ID NO: 260520

SEQ ID NO: 723846 - RNA, 64 nt, Homo Sapiens; identical to SEQ ID NO: 260521

SEQ ID NO: 723847 - RNA, 64 nt, Homo Sapiens; identical to SEQ ID NO: 260522

SEQ ID NO: 723848 - RNA, 64 nt, Homo Sapiens; identical to SEQ ID NO: 260523

SEQ ID NO: 723849 - RNA, 64 nt, Homo Sapiens; identical to SEQ ID NO: 260524

SEQ ID NO: 723850 - RNA, 64 nt, Homo Sapiens; identical to SEQ ID NO: 260525

SEQ ID NO: 723851 - RNA, 64 nt, Homo Sapiens; identical to SEQ ID NO: 260526

SEQ ID NO: 723852 - RNA, 64 nt, Homo Sapiens; identical to SEQ ID NO: 260527

SEQ ID NO: 723853 - RNA, 64 nt, Homo Sapiens; identical to SEQ ID NO: 260528

SEQ ID NO: 723854 - RNA, 64 nt, Homo Sapiens; identical to SEQ ID NO: 260529

SEQ ID NO: 723855 - RNA, 64 nt, Homo Sapiens; identical to SEQ ID NO: 260530

SEQ ID NO: 723856 - RNA, 64 nt, Homo Sapiens; identical to SEQ ID NO: 260531

SEQ ID NO: 723857 - RNA, 64 nt, Homo Sapiens; identical to SEQ ID NO: 260532

SEQ ID NO: 723858 - RNA, 64 nt, Homo Sapiens; identical to SEQ ID NO: 260533

SEQ ID NO: 723859 - RNA, 64 nt, Homo Sapiens; identical to SEQ ID NO: 260534

SEQ ID NO: 723860 - RNA, 64 nt, Homo Sapiens; identical to SEQ ID NO: 260535

SEQ ID NO: 723861 - RNA, 64 nt, Homo Sapiens; identical to SEQ ID NO: 260536

SEQ ID NO: 723862 - RNA, 64 nt, Homo Sapiens; identical to SEQ ID NO: 260537

SEQ ID NO: 723863 - RNA, 64 nt, Homo Sapiens; identical to SEQ ID NO: 260538

SEQ ID NO: 723864 - RNA, 64 nt, Homo Sapiens; identical to SEQ ID NO: 260539

SEQ ID NO: 723865 - RNA, 64 nt, Homo Sapiens; identical to SEQ ID NO: 260540

SEQ ID NO: 723866 - RNA, 64 nt, Homo Sapiens; identical to SEQ ID NO: 260541

SEQ ID NO: 723867 - RNA, 64 nt, Homo Sapiens; identical to SEQ ID NO: 260542

SEQ ID NO: 723868 - RNA, 64 nt, Homo Sapiens
gggaaagcaacuucuugcuggaagaauaucucugccuucuuaccuuaaauuaaaaagagcacua

SEQ ID NO: 723869 - RNA, 64 nt, Homo Sapiens
uuaguaugguuuugucucuaaugaauaaauaauuccuucuuauuaagaagaaguaagggagaaa

SEQ ID NO: 723870 - RNA, 64 nt, Homo Sapiens
uuguuuuauauuguuugauaagggaagagagagaccuucuuauaaaaacuugcagcuagaauug

SEQ ID NO: 723871 - RNA, 64 nt, Homo Sapiens
uugauuuuuguaugcagaguuuuaagucuuuaauccuucuuaaguuauaguuuaauguuuuaua

SEQ ID NO: 723872 - RNA, 64 nt, Homo Sapiens
uucgauucuuuucucuuuuuuuucuucauuggcuccuucuuaguggauucucuucucuacugcc

SEQ ID NO: 723873 - RNA, 64 nt, Homo Sapiens
ucugcuggcaccuucuguaccaugccuucagaaaccuucuuaucccccucaucucuggggcccc

SEQ ID NO: 723874 - RNA, 64 nt, Homo Sapiens
ucuuccucacccuuugcauaccuuuaauauuuuuccuucuuaaauuggccacagcaggggucau

SEQ ID NO: 723875 - RNA, 64 nt, Homo Sapiens
uaaacuccuuuccacaaaaguuuaagucuaaugaccuucuuagagaaguugagcaugccuggca

SEQ ID NO: 723876 - RNA, 64 nt, Homo Sapiens
gcaugauaacaaagcagcaaguaacugaugagaaccuucuuacuauggcacugacaucugccuu

SEQ ID NO: 723877 - RNA, 64 nt, Homo Sapiens
cagagcuacagaauuuagugucagagugaaugugccuucuuaacaagucaaagacaggaagaga

SEQ ID NO: 723878 - RNA, 64 nt, Homo Sapiens
acauucuauuaaaauuuagcccuaaaaugacaagccuucuuaaagccuuauuuuucaaaagcgc

SEQ ID NO: 723879 - RNA, 64 nt, Homo Sapiens
uuuaaaauauuuuagauaauucuuaaacuaugaaccuucuuaacaucacugucuugccagauua

SEQ ID NO: 723880 - RNA, 64 nt, Homo Sapiens
acgaccaugguggaauguuaaggugaaccccaccccuucuuacagauggggacccagagccugc

SEQ ID NO: 723881 - RNA, 64 nt, Homo Sapiens
caucuuuagcucagguccauccuucucaagaucuccuucuuagccccccagccccuggugcugu

SEQ ID NO: 723882 - RNA, 64 nt, Homo Sapiens
cuacagaacaugcauuagugaaagggaagaacugccuucuuauaggaacaagcccccagaaaag

SEQ ID NO: 723883 - RNA, 64 nt, Homo Sapiens
ugugauaaaucuauagaaaguccaaaaacaaccuccuucuuaucgcacaaaugcuuauuuguua

SEQ ID NO: 723884 - RNA, 64 nt, Homo Sapiens
uuaaaggacuggccuuuccagaaaacgcuuuggaucugagcagaguagucaguuucucagacac

SEQ ID NO: 723885 - RNA, 64 nt, Homo Sapiens
agagcugccccccaucaccacgccaucacaccccucugagcagaagcaaaucugaggcugaaga

SEQ ID NO: 723886 - RNA, 64 nt, Homo Sapiens
ucacucuccccggucagcucugcaucagguguuuucugagcaaaccaaggggguuuauagucau

SEQ ID NO: 723887 - RNA, 64 nt, Homo Sapiens
ccacagaguccuuucugcuggugaggacagcauuucugagcagggcuuuguucucuaugugcau

SEQ ID NO: 723888 - RNA, 64 nt, Homo Sapiens
ucagaaacuuggaaucguuuuuuuuaaaaaugccucugagcaacccauauaagucacaaagucu

SEQ ID NO: 723889 - RNA, 64 nt, Homo Sapiens
auaagcaagaugacugggaaaucucugccccuuuucugagcaguaugccucuucuuuuagaauu

SEQ ID NO: 723890 - RNA, 64 nt, Homo Sapiens
uuccugacuugaacaccuucucucaguggucauuucugagcaucagucagcacugaugccaccc

SEQ ID NO: 723891 - RNA, 64 nt, Homo Sapiens
aggaagucaaaauuuauuuagcacuccgacauuuucugagcaaggaacuucacggaacuuuaua

SEQ ID NO: 723892 - RNA, 64 nt, Homo Sapiens
caaaguaagaucaagccaguguuuugaucugggcucugagcacaagucaggaaacaccaacaua

SEQ ID NO: 723893 - RNA, 64 nt, Homo Sapiens
auuguacucagugggccuuggggccuagcccagcucugagcagaggacuguggcauucacuguc

SEQ ID NO: 723894 - RNA, 64 nt, Homo Sapiens
uuucuaugcugcugcuucuuacuccccauuccccucugagcauacucauggcguucccuccaga

SEQ ID NO: 723895 - RNA, 64 nt, Homo Sapiens
ugauaaaguccuggguagacguucaucugaugccucugagcaugaaaagaacacgacugaaaaa

SEQ ID NO: 723896 - RNA, 64 nt, Homo Sapiens
ugagggggucugcgguggcucacagaaagagagcucugagcaggcacugcccuuaccugacccu

SEQ ID NO: 723897 - RNA, 64 nt, Homo Sapiens
gaacagacccauuucugggacuggaccguugcccucugagcagaggcuggucauugacuucggg

SEQ ID NO: 723898 - RNA, 64 nt, Homo Sapiens
acaggaguugaugaacccaucaugcugguuuuucucugagcacaaaguuuuaggcuguacacag

SEQ ID NO: 723899 - RNA, 64 nt, Homo Sapiens
cuagcuuuagucuuucuguucccauuuuuauaaaucugagcauugauaauguucuaucuaaauu

SEQ ID NO: 723900 - RNA, 64 nt, Homo Sapiens
cuucccuagcuguggaacccgggugugcugccugucugagcaagggcgugaguggccgugcccu

SEQ ID NO: 723901 - RNA, 64 nt, Homo Sapiens
cagagacaucuuggccuguccaagagcugguggcucugagcagaugaucccggacagccgaacc

SEQ ID NO: 723902 - RNA, 64 nt, Homo Sapiens
ggggggaagcugggggcacauguggcccuugccuucugagcagcucccagugccagggcuuuga

SEQ ID NO: 723903 - RNA, 64 nt, Homo Sapiens
uugcugguugguaucuguaaauguuuaauaaauaucugagcauguaucuaucaacgccaagaau

SEQ ID NO: 723904 - RNA, 64 nt, Homo Sapiens
uacaucucuugcagguuuucacaaaacauacaagucugagcaaguggggugggggcaaggcagg

SEQ ID NO: 723905 - RNA, 64 nt, Homo Sapiens
cuacugaugauaaauuuguuaauuaaaugugucaucugagcaugggugucagauaguguaugag

SEQ ID NO: 723906 - RNA, 64 nt, Homo Sapiens
gccugcuucuccauaucacagaaauccuagguccucugagcaacucuucaucaaguuuugauaa

SEQ ID NO: 723907 - RNA, 64 nt, Homo Sapiens
agcaguccagccuccgucuucugguccacucugcucugagcagccugggaugcugaacucuuca

SEQ ID NO: 723908 - RNA, 64 nt, Homo Sapiens
uuuaguuggagagauacaggaagccuccuaggguucugagcagaagaggggcaugagcugauuc

SEQ ID NO: 723909 - RNA, 64 nt, Homo Sapiens
aguucuuccagcaaaaugcuuauuagaguuuuugucugagcacaguagccuggcccugcauauc

SEQ ID NO: 723910 - RNA, 64 nt, Homo Sapiens
acacacacacacacacacacacacacacacacacucugagcacauuaucugugauucuuucauc

SEQ ID NO: 723911 - RNA, 64 nt, Homo Sapiens; identical to SEQ ID NO: 190819

SEQ ID NO: 723912 - RNA, 64 nt, Homo Sapiens; identical to SEQ ID NO: 190820

SEQ ID NO: 723913 - RNA, 64 nt, Homo Sapiens; identical to SEQ ID NO: 190821

SEQ ID NO: 723914 - RNA, 64 nt, Homo Sapiens; identical to SEQ ID NO: 190822

SEQ ID NO: 723915 - RNA, 64 nt, Homo Sapiens; identical to SEQ ID NO: 190823

SEQ ID NO: 723916 - RNA, 64 nt, Homo Sapiens; identical to SEQ ID NO: 190824

SEQ ID NO: 723917 - RNA, 64 nt, Homo Sapiens; identical to SEQ ID NO: 190825

SEQ ID NO: 723918 - RNA, 64 nt, Homo Sapiens; identical to SEQ ID NO: 190826

SEQ ID NO: 723919 - RNA, 64 nt, Homo Sapiens; identical to SEQ ID NO: 190827

SEQ ID NO: 723920 - RNA, 64 nt, Homo Sapiens; identical to SEQ ID NO: 190828

SEQ ID NO: 723921 - RNA, 64 nt, Homo Sapiens; identical to SEQ ID NO: 190829

SEQ ID NO: 723922 - RNA, 64 nt, Homo Sapiens; identical to SEQ ID NO: 190830

SEQ ID NO: 723923 - RNA, 64 nt, Homo Sapiens; identical to SEQ ID NO: 190831

SEQ ID NO: 723924 - RNA, 64 nt, Homo Sapiens; identical to SEQ ID NO: 190832

SEQ ID NO: 723925 - RNA, 64 nt, Homo Sapiens
aaggcccugggguuccaacucacugugcgucuccuccacacagaccaguagguucuccuaugcu

SEQ ID NO: 723926 - RNA, 64 nt, Homo Sapiens
cucagcaaacagaaccacagggcccaggaggcauuccacacaggcacugccccaggacaacaca

SEQ ID NO: 723927 - RNA, 64 nt, Homo Sapiens
ucaugcucauuuuuauuguuucaugcucuaauaauccacacauuuuucuaauaauccacacauu

SEQ ID NO: 723928 - RNA, 64 nt, Homo Sapiens
ucaugcucuaauaauccacaugucuuucuaauaauccacacauuauguucauuucacaagugca

SEQ ID NO: 723929 - RNA, 64 nt, Homo Sapiens
uggcauccuccggagagagagagaggaaggagauuccacacagggguggaguuucugacgaagg

SEQ ID NO: 723930 - RNA, 64 nt, Homo Sapiens
ggcgccuggcacauuucagggagaaacuccaaaguccacacaaagauuuucuaaggaaugcaca

SEQ ID NO: 723931 - RNA, 64 nt, Homo Sapiens
ccuccguuccgcuagccuaccccugcuacucuccuccacacaccuucaacuugacccucccacc

SEQ ID NO: 723932 - RNA, 64 nt, Homo Sapiens
aguaagggccuggagauguguccuccacaugcgguccacacaucuugcugucgccacucauguc

SEQ ID NO: 723933 - RNA, 64 nt, Homo Sapiens
cacgcccgucacccacaccuaaggggggcugcccuccacacacauggcagaggcaaauccacag

SEQ ID NO: 723934 - RNA, 64 nt, Homo Sapiens
guuuguucaagcacacuuaagaauggaauucaauuccacacauggcagaaacuaacuccguaau

SEQ ID NO: 723935 - RNA, 64 nt, Homo Sapiens
aagcagaaaaccaaguuaucagaaguugccuugguccacacacuuagaagcauccuuuuuaaag

SEQ ID NO: 723936 - RNA, 64 nt, Homo Sapiens
ucugccuuuauguaguaguugggcauauaauccuuccacacagccccugcagggaaaggcuaau

SEQ ID NO: 723937 - RNA, 64 nt, Homo Sapiens
aaaggcuaaucuuacggauaauccacgugagauuuccacacaagagaaaagcacacgcauagug

SEQ ID NO: 723938 - RNA, 64 nt, Homo Sapiens
caaguucaugggaauuuugucugcagguuaagaauccacacaacucacuuucuuagguaauuca

SEQ ID NO: 723939 - RNA, 64 nt, Homo Sapiens
uggauuauccacauaaucaaaaauaaaugagauguccacacaaaucuuauccuacauuauugga

SEQ ID NO: 723940 - RNA, 64 nt, Homo Sapiens
ggccugguagucagguggcuucaggacuuucccguccacacacagguuuuccagaguccaaucc

SEQ ID NO: 723941 - RNA, 64 nt, Homo Sapiens
guauguuccagugucuguggcugcugcuugacaauccacacaaacagcugugauaucucagaug

SEQ ID NO: 723942 - RNA, 64 nt, Homo Sapiens
aucucugcaaacaggcacugacaggguuucaauuuccacacaugaauuuggucauuccuuaaag

SEQ ID NO: 723943 - RNA, 64 nt, Homo Sapiens
gauuaccugucaucuugcaugcuuuucuagucuguccacacaggaucuauuuuaggggcugucu

SEQ ID NO: 723944 - RNA, 64 nt, Homo Sapiens
gcuacaccacucucccagccugugaccaccgauguccacacacccccaaccacuuguccacaca

SEQ ID NO: 723945 - RNA, 64 nt, Homo Sapiens
ugaccaccgauguccacacacccccaaccacuuguccacacagcuacccacguacgacaucguc

SEQ ID NO: 723946 - RNA, 64 nt, Homo Sapiens
auguaaccacguggaaagcggccccugcugccccuccacacacacauacacacucacugaucua

SEQ ID NO: 723947 - RNA, 64 nt, Homo Sapiens
gaaauuaaaagaacaacacccuagagagaagucauccacacacaauccacacacgcauagcaaa

SEQ ID NO: 723948 - RNA, 64 nt, Homo Sapiens
aacaacacccuagagagaagucauccacacacaauccacacacgcauagcaaaccuccaaugca

SEQ ID NO: 723949 - RNA, 64 nt, Homo Sapiens
cccuguccacaacugcagccccacacacucccuguccacacacuccuguccacacacucccugu

SEQ ID NO: 723950 - RNA, 64 nt, Homo Sapiens
cccuguccacacacucccugccacacacucccuguccacacacuaggccggccacgcucccugu

SEQ ID NO: 723951 - RNA, 64 nt, Homo Sapiens
cccuguccacacacucccugggccacgcucccuguccacacacuacagcugccuaggaaaggcc

SEQ ID NO: 723952 - RNA, 64 nt, Homo Sapiens
cgacuuuugccacccuccugaggaagccccuagguccacacagugaugccaugggggacccuug

SEQ ID NO: 723953 - RNA, 64 nt, Homo Sapiens
cacccucagaaggcuugucucaccuccaccggcauccacacaaaaccaaacaggagcaggcguc

SEQ ID NO: 723954 - RNA, 64 nt, Homo Sapiens
cccaccuggagagaaacuuccagaccagccccucauaccacagccaagaggggccuuucucacc

SEQ ID NO: 723955 - RNA, 64 nt, Homo Sapiens; identical to SEQ ID NO: 723954

SEQ ID NO: 723956 - RNA, 64 nt, Homo Sapiens
caaaaauguccauaugcacuauguuuuauuuuauauaccacauggcacuguguaucuuauauga

SEQ ID NO: 723957 - RNA, 64 nt, Homo Sapiens
cugccuaugggacuucaguucacagaacugaaucauaccacaugaacacacaccacacaucaca

SEQ ID NO: 723958 - RNA, 64 nt, Homo Sapiens
aaaaugccccucgugugaccauagauugagauuuauaccacauaccacacauagccacagaaac

SEQ ID NO: 723959 - RNA, 64 nt, Homo Sapiens
cccucgugugaccauagauugagauuuauaccacauaccacacauagccacagaaacaucaucu

SEQ ID NO: 723960 - RNA, 64 nt, Homo Sapiens
cucauuuuagaaagacauuuaaaauuuuuggaacauaccacauguagaaagguugaacugguuu

SEQ ID NO: 723961 - RNA, 64 nt, Homo Sapiens
agcuauaaugcauauacaacuauaguguguacguauaccacauauacauauacuuguaugaaga

SEQ ID NO: 723962 - RNA, 64 nt, Homo Sapiens; identical to SEQ ID NO: 215478

SEQ ID NO: 723963 - RNA, 64 nt, Homo Sapiens; identical to SEQ ID NO: 215479

SEQ ID NO: 723964 - RNA, 64 nt, Homo Sapiens; identical to SEQ ID NO: 215480

SEQ ID NO: 723965 - RNA, 64 nt, Homo Sapiens; identical to SEQ ID NO: 215481

SEQ ID NO: 723966 - RNA, 64 nt, Homo Sapiens; identical to SEQ ID NO: 215482

SEQ ID NO: 723967 - RNA, 64 nt, Homo Sapiens; identical to SEQ ID NO: 215483

SEQ ID NO: 723968 - RNA, 64 nt, Homo Sapiens; identical to SEQ ID NO: 215484

SEQ ID NO: 723969 - RNA, 64 nt, Homo Sapiens; identical to SEQ ID NO: 215485

SEQ ID NO: 723970 - RNA, 64 nt, Homo Sapiens; identical to SEQ ID NO: 308450

SEQ ID NO: 723971 - RNA, 64 nt, Homo Sapiens; identical to SEQ ID NO: 308451

SEQ ID NO: 723972 - RNA, 64 nt, Homo Sapiens; identical to SEQ ID NO: 308452

SEQ ID NO: 723973 - RNA, 64 nt, Homo Sapiens; identical to SEQ ID NO: 308453

SEQ ID NO: 723974 - RNA, 64 nt, Homo Sapiens; identical to SEQ ID NO: 308454

SEQ ID NO: 723975 - RNA, 64 nt, Homo Sapiens; identical to SEQ ID NO: 308455

SEQ ID NO: 723976 - RNA, 64 nt, Homo Sapiens; identical to SEQ ID NO: 308456

SEQ ID NO: 723977 - RNA, 64 nt, Homo Sapiens; identical to SEQ ID NO: 308457

SEQ ID NO: 723978 - RNA, 64 nt, Homo Sapiens; identical to SEQ ID NO: 308458

SEQ ID NO: 723979 - RNA, 64 nt, Homo Sapiens; identical to SEQ ID NO: 308459

SEQ ID NO: 723980 - RNA, 64 nt, Homo Sapiens; identical to SEQ ID NO: 308460

SEQ ID NO: 723981 - RNA, 64 nt, Homo Sapiens; identical to SEQ ID NO: 308461

SEQ ID NO: 723982 - RNA, 64 nt, Homo Sapiens; identical to SEQ ID NO: 308462

SEQ ID NO: 723983 - RNA, 64 nt, Homo Sapiens; identical to SEQ ID NO: 308463

SEQ ID NO: 723984 - RNA, 64 nt, Homo Sapiens; identical to SEQ ID NO: 308464

SEQ ID NO: 723985 - RNA, 64 nt, Homo Sapiens; identical to SEQ ID NO: 308465

SEQ ID NO: 723986 - RNA, 64 nt, Homo Sapiens; identical to SEQ ID NO: 308466

SEQ ID NO: 723987 - RNA, 64 nt, Homo Sapiens; identical to SEQ ID NO: 244542

SEQ ID NO: 723988 - RNA, 64 nt, Homo Sapiens; identical to SEQ ID NO: 244543

SEQ ID NO: 723989 - RNA, 64 nt, Homo Sapiens; identical to SEQ ID NO: 244544

SEQ ID NO: 723990 - RNA, 64 nt, Homo Sapiens; identical to SEQ ID NO: 244545

SEQ ID NO: 723991 - RNA, 64 nt, Homo Sapiens; identical to SEQ ID NO: 244546

SEQ ID NO: 723992 - RNA, 64 nt, Homo Sapiens; identical to SEQ ID NO: 244547

SEQ ID NO: 723993 - RNA, 64 nt, Homo Sapiens; identical to SEQ ID NO: 244548

SEQ ID NO: 723994 - RNA, 64 nt, Homo Sapiens; identical to SEQ ID NO: 244549

SEQ ID NO: 723995 - RNA, 64 nt, Homo Sapiens; identical to SEQ ID NO: 244550

SEQ ID NO: 723996 - RNA, 64 nt, Homo Sapiens; identical to SEQ ID NO: 244551

SEQ ID NO: 723997 - RNA, 64 nt, Homo Sapiens; identical to SEQ ID NO: 244552

SEQ ID NO: 723998 - RNA, 64 nt, Homo Sapiens; identical to SEQ ID NO: 244553

SEQ ID NO: 723999 - RNA, 64 nt, Homo Sapiens; identical to SEQ ID NO: 244554

SEQ ID NO: 724000 - RNA, 64 nt, Homo Sapiens; identical to SEQ ID NO: 244555

SEQ ID NO: 724001 - RNA, 64 nt, Homo Sapiens; identical to SEQ ID NO: 244556

SEQ ID NO: 724002 - RNA, 64 nt, Homo Sapiens; identical to SEQ ID NO: 244557

SEQ ID NO: 724003 - RNA, 64 nt, Homo Sapiens; identical to SEQ ID NO: 244558

SEQ ID NO: 724004 - RNA, 64 nt, Homo Sapiens; identical to SEQ ID NO: 244559

SEQ ID NO: 724005 - RNA, 64 nt, Homo Sapiens; identical to SEQ ID NO: 244560

SEQ ID NO: 724006 - RNA, 64 nt, Homo Sapiens; identical to SEQ ID NO: 244561

SEQ ID NO: 724007 - RNA, 64 nt, Homo Sapiens; identical to SEQ ID NO: 244562

SEQ ID NO: 724008 - RNA, 64 nt, Homo Sapiens; identical to SEQ ID NO: 244563

SEQ ID NO: 724009 - RNA, 64 nt, Homo Sapiens; identical to SEQ ID NO: 244564

SEQ ID NO: 724010 - RNA, 64 nt, Homo Sapiens; identical to SEQ ID NO: 244565

SEQ ID NO: 724011 - RNA, 64 nt, Homo Sapiens; identical to SEQ ID NO: 244566

SEQ ID NO: 724012 - RNA, 64 nt, Homo Sapiens; identical to SEQ ID NO: 244567

SEQ ID NO: 724013 - RNA, 64 nt, Homo Sapiens; identical to SEQ ID NO: 244568

SEQ ID NO: 724014 - RNA, 64 nt, Homo Sapiens; identical to SEQ ID NO: 244569

SEQ ID NO: 724015 - RNA, 64 nt, Homo Sapiens; identical to SEQ ID NO: 244570

SEQ ID NO: 724016 - RNA, 64 nt, Homo Sapiens; identical to SEQ ID NO: 279561

SEQ ID NO: 724017 - RNA, 64 nt, Homo Sapiens; identical to SEQ ID NO: 279562

SEQ ID NO: 724018 - RNA, 64 nt, Homo Sapiens; identical to SEQ ID NO: 279563

SEQ ID NO: 724019 - RNA, 64 nt, Homo Sapiens; identical to SEQ ID NO: 279564

SEQ ID NO: 724020 - RNA, 64 nt, Homo Sapiens; identical to SEQ ID NO: 279565

SEQ ID NO: 724021 - RNA, 64 nt, Homo Sapiens; identical to SEQ ID NO: 279566

SEQ ID NO: 724022 - RNA, 64 nt, Homo Sapiens; identical to SEQ ID NO: 279567

SEQ ID NO: 724023 - RNA, 64 nt, Homo Sapiens; identical to SEQ ID NO: 279568

SEQ ID NO: 724024 - RNA, 64 nt, Homo Sapiens; identical to SEQ ID NO: 279569

SEQ ID NO: 724025 - RNA, 64 nt, Homo Sapiens; identical to SEQ ID NO: 279570

SEQ ID NO: 724026 - RNA, 64 nt, Homo Sapiens; identical to SEQ ID NO: 279571

SEQ ID NO: 724027 - RNA, 64 nt, Homo Sapiens; identical to SEQ ID NO: 279572

SEQ ID NO: 724028 - RNA, 64 nt, Homo Sapiens; identical to SEQ ID NO: 279573

SEQ ID NO: 724029 - RNA, 61 nt, Homo Sapiens; identical to SEQ ID NO: 279574

SEQ ID NO: 724030 - RNA, 64 nt, Homo Sapiens; identical to SEQ ID NO: 279575

SEQ ID NO: 724031 - RNA, 64 nt, Homo Sapiens; identical to SEQ ID NO: 279576

SEQ ID NO: 724032 - RNA, 64 nt, Homo Sapiens; identical to SEQ ID NO: 279577

SEQ ID NO: 724033 - RNA, 64 nt, Homo Sapiens; identical to SEQ ID NO: 279578

SEQ ID NO: 724034 - RNA, 64 nt, Homo Sapiens; identical to SEQ ID NO: 279579

SEQ ID NO: 724035 - RNA, 63 nt, Homo Sapiens; identical to SEQ ID NO: 279580

SEQ ID NO: 724036 - RNA, 64 nt, Homo Sapiens; identical to SEQ ID NO: 279581

SEQ ID NO: 724037 - RNA, 64 nt, Homo Sapiens; identical to SEQ ID NO: 279582

SEQ ID NO: 724038 - RNA, 64 nt, Homo Sapiens; identical to SEQ ID NO: 279583

SEQ ID NO: 724039 - RNA, 64 nt, Homo Sapiens; identical to SEQ ID NO: 279584

SEQ ID NO: 724040 - RNA, 64 nt, Homo Sapiens; identical to SEQ ID NO: 279585

SEQ ID NO: 724041 - RNA, 64 nt, Homo Sapiens; identical to SEQ ID NO: 279586

SEQ ID NO: 724042 - RNA, 64 nt, Homo Sapiens; identical to SEQ ID NO: 279587

SEQ ID NO: 724043 - RNA, 64 nt, Homo Sapiens; identical to SEQ ID NO: 279588

SEQ ID NO: 724044 - RNA, 64 nt, Homo Sapiens; identical to SEQ ID NO: 279589

SEQ ID NO: 724045 - RNA, 64 nt, Homo Sapiens; identical to SEQ ID NO: 279590

SEQ ID NO: 724046 - RNA, 64 nt, Homo Sapiens
gaaauaaaauugcaguauaucacgcuaacuucguuugugcgauuuguuucauuuaaguuuccua

SEQ ID NO: 724047 - RNA, 64 nt, Homo Sapiens
agggaccauuucuccccgagucucuuacacuuuauugugcgauguccacguuuuugugacucuu

SEQ ID NO: 724048 - RNA, 64 nt, Homo Sapiens
ccaauuuggaguuuuaaguuguuucugguagaaauugugcgaguccgugcuacuaaaguggcag

SEQ ID NO: 724049 - RNA, 64 nt, Homo Sapiens
agcaucccagggucuccagccuacagaugagcuguugugcgauuucuuagccuccauaaucaca

SEQ ID NO: 724050 - RNA, 64 nt, Homo Sapiens
aauuuauuaacugucuuucuucugcaacugaauguugugcgaguggaaaaccugacucugugug

SEQ ID NO: 724051 - RNA, 64 nt, Homo Sapiens
gugugugagaauggcugugucuuugguuuucuuuuugugcgaguuccccaugugcuuuaguggg

SEQ ID NO: 724052 - RNA, 64 nt, Homo Sapiens
ucccuugccacgcggggcccggagggcgggugguuugugcgaguggugaccgggggccagccca

SEQ ID NO: 724053 - RNA, 64 nt, Homo Sapiens
gaaucucaggaugaggaugaugcucuuaaugaaauugugcgauguauuugugagauggaugagg

SEQ ID NO: 724054 - RNA, 64 nt, Homo Sapiens
auuuuauuuuuuaaaaaaaagcaauuuucucccauugugcgaacgcuaagguguaacacuuaaa

SEQ ID NO: 724055 - RNA, 64 nt, Homo Sapiens
cuguuguauuuuuuuuuuucaacuuuucuggauguugugcgaacgaaacacuucauauucccug

SEQ ID NO: 724056 - RNA, 64 nt, Homo Sapiens
ccaacggccuucucauuuacaaggcggaauugaauugugcgaugucagcugauuacaauaacaa

SEQ ID NO: 724057 - RNA, 64 nt, Homo Sapiens
accagaaacgccuugccuucagcugaaccaccguuugugcgagcuggauguccuuuucaguaga

SEQ ID NO: 724058 - RNA, 64 nt, Homo Sapiens
gcuaagcccccuacugagaaacuuccuuugagaauugugcgacuucacaaaaugcaaggugaac

SEQ ID NO: 724059 - RNA, 64 nt, Homo Sapiens
ggaacuaaauggggcuaaccacuucaggugcagcuugugcgaggguagaugguuccugcacaca

SEQ ID NO: 724060 - RNA, 64 nt, Homo Sapiens
acucagcugcaauucugagggggguuugggaggcuugugcgaggucucaggccuguguggggag

SEQ ID NO: 724061 - RNA, 64 nt, Homo Sapiens
uugaucacugaucgaguaaggaaugaccuuuagauugugcgacuuuuguuuuuguuuuuuuaaa

SEQ ID NO: 724062 - RNA, 64 nt, Homo Sapiens
gacugaaugggacagaguugagcaaguucgucuguugugcgaaucucacuaauuuguaggaaaa

SEQ ID NO: 724063 - RNA, 64 nt, Homo Sapiens
ugccuuaugcuaugagaccaagcuuauuacuuauuugugcgaaguccguuuuuuaagccugaag

SEQ ID NO: 724064 - RNA, 64 nt, Homo Sapiens
uccgaagucuccuccguggaccacagguggaucuuugugcgaacaacuugcauuucggaagcca

SEQ ID NO: 724065 - RNA, 64 nt, Homo Sapiens
ucaauucacuuuguaagaaauuacaucaagcuaauugugcgagccuucauauauuuucuuaaga

SEQ ID NO: 724066 - RNA, 64 nt, Homo Sapiens
auggccacuaaagcauaguaugaaaccaguuuccuugugcgaugcucagucuuaaacuucagua

SEQ ID NO: 724067 - RNA, 64 nt, Homo Sapiens
gaaucuucuccgugcagccccuuggggcgcgaccuugugcgaggcccucggggcccacccacag

SEQ ID NO: 724068 - RNA, 64 nt, Homo Sapiens
ugcagccucagaaggaacaaauucaccuguggauuugugcgagaccuguggcccagcccgcccc

SEQ ID NO: 724069 - RNA, 64 nt, Homo Sapiens
cgugagcgccgcccgagcggccaccccaugacuauugugcgauuuccuccgugccgugcgaccc

SEQ ID NO: 724070 - RNA, 64 nt, Homo Sapiens
uucagugucacucuguacccucaacauauaucccuugugcgauaaaaaaaaaaaaaaaaaaaaa

SEQ ID NO: 724071 - RNA, 64 nt, Homo Sapiens
cuucaguuugcuccgcugccuccuacccagagguuugugcgagccuguguugcaggguuguaua

SEQ ID NO: 724072 - RNA, 64 nt, Homo Sapiens
ggacugggagcagaggccccucacucaacgacguuugugcgacauaguauuguauccaccuuag

SEQ ID NO: 724073 - RNA, 64 nt, Homo Sapiens
gauuauaaugagcuggccaugcacuuugaccgccuugugcgaaaacaccaccuggggcgcgucc

SEQ ID NO: 724074 - RNA, 64 nt, Homo Sapiens
cuguccauuuucuuuuaaaguuauaaacacguacuugugcgaauuauuuuuuuaaagugauuug

SEQ ID NO: 724075 - RNA, 64 nt, Homo Sapiens; identical to SEQ ID NO: 72787

SEQ ID NO: 724076 - RNA, 64 nt, Homo Sapiens; identical to SEQ ID NO: 72788

SEQ ID NO: 724077 - RNA, 64 nt, Homo Sapiens; identical to SEQ ID NO: 72789

SEQ ID NO: 724078 - RNA, 64 nt, Homo Sapiens; identical to SEQ ID NO: 72790

SEQ ID NO: 724079 - RNA, 64 nt, Homo Sapiens; identical to SEQ ID NO: 72791

SEQ ID NO: 724080 - RNA, 64 nt, Homo Sapiens; identical to SEQ ID NO: 72792

SEQ ID NO: 724081 - RNA, 64 nt, Homo Sapiens; identical to SEQ ID NO: 72793

SEQ ID NO: 724082 - RNA, 64 nt, Homo Sapiens; identical to SEQ ID NO: 72794

SEQ ID NO: 724083 - RNA, 64 nt, Homo Sapiens; identical to SEQ ID NO: 72795

SEQ ID NO: 724084 - RNA, 64 nt, Homo Sapiens; identical to SEQ ID NO: 72796

SEQ ID NO: 724085 - RNA, 64 nt, Homo Sapiens; identical to SEQ ID NO: 72797

SEQ ID NO: 724086 - RNA, 64 nt, Homo Sapiens; identical to SEQ ID NO: 72798

SEQ ID NO: 724087 - RNA, 64 nt, Homo Sapiens; identical to SEQ ID NO: 72799

SEQ ID NO: 724088 - RNA, 64 nt, Homo Sapiens; identical to SEQ ID NO: 72800

SEQ ID NO: 724089 - RNA, 64 nt, Homo Sapiens; identical to SEQ ID NO: 72801

SEQ ID NO: 724090 - RNA, 64 nt, Homo Sapiens; identical to SEQ ID NO: 72802

SEQ ID NO: 724091 - RNA, 64 nt, Homo Sapiens; identical to SEQ ID NO: 72803

SEQ ID NO: 724092 - RNA, 64 nt, Homo Sapiens; identical to SEQ ID NO: 72804

SEQ ID NO: 724093 - RNA, 64 nt, Homo Sapiens; identical to SEQ ID NO: 72805

SEQ ID NO: 724094 - RNA, 64 nt, Homo Sapiens; identical to SEQ ID NO: 72806

SEQ ID NO: 724095 - RNA, 64 nt, Homo Sapiens; identical to SEQ ID NO: 72807

SEQ ID NO: 724096 - RNA, 64 nt, Homo Sapiens; identical to SEQ ID NO: 72808

SEQ ID NO: 724097 - RNA, 64 nt, Homo Sapiens; identical to SEQ ID NO: 72809

SEQ ID NO: 724098 - RNA, 64 nt, Homo Sapiens; identical to SEQ ID NO: 72810

SEQ ID NO: 724099 - RNA, 64 nt, Homo Sapiens; identical to SEQ ID NO: 72811

SEQ ID NO: 724100 - RNA, 64 nt, Homo Sapiens; identical to SEQ ID NO: 72812

SEQ ID NO: 724101 - RNA, 64 nt, Homo Sapiens; identical to SEQ ID NO: 72813

SEQ ID NO: 724102 - RNA, 64 nt, Homo Sapiens; identical to SEQ ID NO: 72814

SEQ ID NO: 724103 - RNA, 64 nt, Homo Sapiens; identical to SEQ ID NO: 72815

SEQ ID NO: 724104 - RNA, 64 nt, Homo Sapiens; identical to SEQ ID NO: 72816

SEQ ID NO: 724105 - RNA, 64 nt, Homo Sapiens; identical to SEQ ID NO: 72817

SEQ ID NO: 724106 - RNA, 64 nt, Homo Sapiens; identical to SEQ ID NO: 72818

SEQ ID NO: 724107 - RNA, 64 nt, Homo Sapiens; identical to SEQ ID NO: 72819

SEQ ID NO: 724108 - RNA, 64 nt, Homo Sapiens; identical to SEQ ID NO: 72820

SEQ ID NO: 724109 - RNA, 64 nt, Homo Sapiens; identical to SEQ ID NO: 72821

SEQ ID NO: 724110 - RNA, 64 nt, Homo Sapiens; identical to SEQ ID NO: 72822

SEQ ID NO: 724111 - RNA, 64 nt, Homo Sapiens; identical to SEQ ID NO: 72823

SEQ ID NO: 724112 - RNA, 64 nt, Homo Sapiens; identical to SEQ ID NO: 72824

SEQ ID NO: 724113 - RNA, 64 nt, Homo Sapiens; identical to SEQ ID NO: 72825

SEQ ID NO: 724114 - RNA, 64 nt, Homo Sapiens; identical to SEQ ID NO: 72826

SEQ ID NO: 724115 - RNA, 64 nt, Homo Sapiens; identical to SEQ ID NO: 72827

SEQ ID NO: 724116 - RNA, 64 nt, Homo Sapiens; identical to SEQ ID NO: 72828

SEQ ID NO: 724117 - RNA, 64 nt, Homo Sapiens; identical to SEQ ID NO: 72829

SEQ ID NO: 724118 - RNA, 64 nt, Homo Sapiens; identical to SEQ ID NO: 72830

SEQ ID NO: 724119 - RNA, 64 nt, Homo Sapiens; identical to SEQ ID NO: 72831

SEQ ID NO: 724120 - RNA, 64 nt, Homo Sapiens; identical to SEQ ID NO: 72832

SEQ ID NO: 724121 - RNA, 64 nt, Homo Sapiens; identical to SEQ ID NO: 72833

SEQ ID NO: 724122 - RNA, 64 nt, Homo Sapiens; identical to SEQ ID NO: 72834

SEQ ID NO: 724123 - RNA, 64 nt, Homo Sapiens; identical to SEQ ID NO: 72835

SEQ ID NO: 724124 - RNA, 64 nt, Homo Sapiens; identical to SEQ ID NO: 72836

SEQ ID NO: 724125 - RNA, 64 nt, Homo Sapiens; identical to SEQ ID NO: 72837

SEQ ID NO: 724126 - RNA, 64 nt, Homo Sapiens; identical to SEQ ID NO: 72838

SEQ ID NO: 724127 - RNA, 64 nt, Homo Sapiens; identical to SEQ ID NO: 72839

SEQ ID NO: 724128 - RNA, 64 nt, Homo Sapiens; identical to SEQ ID NO: 72840

SEQ ID NO: 724129 - RNA, 64 nt, Homo Sapiens; identical to SEQ ID NO: 72841

SEQ ID NO: 724130 - RNA, 64 nt, Homo Sapiens; identical to SEQ ID NO: 101831

SEQ ID NO: 724131 - RNA, 64 nt, Homo Sapiens; identical to SEQ ID NO: 101832

SEQ ID NO: 724132 - RNA, 64 nt, Homo Sapiens; identical to SEQ ID NO: 101833

SEQ ID NO: 724133 - RNA, 64 nt, Homo Sapiens; identical to SEQ ID NO: 101834

SEQ ID NO: 724134 - RNA, 61 nt, Homo Sapiens; identical to SEQ ID NO: 101835

SEQ ID NO: 724135 - RNA, 64 nt, Homo Sapiens; identical to SEQ ID NO: 101836

SEQ ID NO: 724136 - RNA, 64 nt, Homo Sapiens; identical to SEQ ID NO: 101837

SEQ ID NO: 724137 - RNA, 64 nt, Homo Sapiens; identical to SEQ ID NO: 101838

SEQ ID NO: 724138 - RNA, 64 nt, Homo Sapiens; identical to SEQ ID NO: 101839

SEQ ID NO: 724139 - RNA, 64 nt, Homo Sapiens; identical to SEQ ID NO: 101840

SEQ ID NO: 724140 - RNA, 64 nt, Homo Sapiens; identical to SEQ ID NO: 101841

SEQ ID NO: 724141 - RNA, 64 nt, Homo Sapiens; identical to SEQ ID NO: 101842

SEQ ID NO: 724142 - RNA, 64 nt, Homo Sapiens; identical to SEQ ID NO: 101843

SEQ ID NO: 724143 - RNA, 64 nt, Homo Sapiens; identical to SEQ ID NO: 101844

SEQ ID NO: 724144 - RNA, 64 nt, Homo Sapiens; identical to SEQ ID NO: 101845

SEQ ID NO: 724145 - RNA, 64 nt, Homo Sapiens; identical to SEQ ID NO: 101846

SEQ ID NO: 724146 - RNA, 64 nt, Homo Sapiens; identical to SEQ ID NO: 101847

SEQ ID NO: 724147 - RNA, 64 nt, Homo Sapiens; identical to SEQ ID NO: 101848

SEQ ID NO: 724148 - RNA, 64 nt, Homo Sapiens; identical to SEQ ID NO: 101849

SEQ ID NO: 724149 - RNA, 64 nt, Homo Sapiens; identical to SEQ ID NO: 101850

SEQ ID NO: 724150 - RNA, 64 nt, Homo Sapiens; identical to SEQ ID NO: 101851

SEQ ID NO: 724151 - RNA, 64 nt, Homo Sapiens; identical to SEQ ID NO: 101852

SEQ ID NO: 724152 - RNA, 64 nt, Homo Sapiens; identical to SEQ ID NO: 101853

SEQ ID NO: 724153 - RNA, 64 nt, Homo Sapiens; identical to SEQ ID NO: 101854

SEQ ID NO: 724154 - RNA, 64 nt, Homo Sapiens; identical to SEQ ID NO: 125569

SEQ ID NO: 724155 - RNA, 64 nt, Homo Sapiens; identical to SEQ ID NO: 125570

SEQ ID NO: 724156 - RNA, 64 nt, Homo Sapiens; identical to SEQ ID NO: 125571

SEQ ID NO: 724157 - RNA, 64 nt, Homo Sapiens; identical to SEQ ID NO: 125572

SEQ ID NO: 724158 - RNA, 64 nt, Homo Sapiens; identical to SEQ ID NO: 125573

SEQ ID NO: 724159 - RNA, 64 nt, Homo Sapiens; identical to SEQ ID NO: 125574

SEQ ID NO: 724160 - RNA, 64 nt, Homo Sapiens; identical to SEQ ID NO: 125575

SEQ ID NO: 724161 - RNA, 64 nt, Homo Sapiens; identical to SEQ ID NO: 125576

SEQ ID NO: 724162 - RNA, 64 nt, Homo Sapiens; identical to SEQ ID NO: 125577

SEQ ID NO: 724163 - RNA, 64 nt, Homo Sapiens; identical to SEQ ID NO: 125578

SEQ ID NO: 724164 - RNA, 64 nt, Homo Sapiens; identical to SEQ ID NO: 125579

SEQ ID NO: 724165 - RNA, 64 nt, Homo Sapiens; identical to SEQ ID NO: 125580

SEQ ID NO: 724166 - RNA, 64 nt, Homo Sapiens; identical to SEQ ID NO: 125581

SEQ ID NO: 724167 - RNA, 64 nt, Homo Sapiens; identical to SEQ ID NO: 125582

SEQ ID NO: 724168 - RNA, 64 nt, Homo Sapiens; identical to SEQ ID NO: 125583

SEQ ID NO: 724169 - RNA, 64 nt, Homo Sapiens; identical to SEQ ID NO: 125584

SEQ ID NO: 724170 - RNA, 64 nt, Homo Sapiens; identical to SEQ ID NO: 125585

SEQ ID NO: 724171 - RNA, 64 nt, Homo Sapiens; identical to SEQ ID NO: 125586

SEQ ID NO: 724172 - RNA, 64 nt, Homo Sapiens; identical to SEQ ID NO: 125587

SEQ ID NO: 724173 - RNA, 64 nt, Homo Sapiens; identical to SEQ ID NO: 125588

SEQ ID NO: 724174 - RNA, 64 nt, Homo Sapiens; identical to SEQ ID NO: 125589

SEQ ID NO: 724175 - RNA, 64 nt, Homo Sapiens; identical to SEQ ID NO: 125590

SEQ ID NO: 724176 - RNA, 64 nt, Homo Sapiens; identical to SEQ ID NO: 125591

SEQ ID NO: 724177 - RNA, 64 nt, Homo Sapiens; identical to SEQ ID NO: 125592

SEQ ID NO: 724178 - RNA, 64 nt, Homo Sapiens; identical to SEQ ID NO: 125593

SEQ ID NO: 724179 - RNA, 64 nt, Homo Sapiens; identical to SEQ ID NO: 125594

SEQ ID NO: 724180 - RNA, 64 nt, Homo Sapiens; identical to SEQ ID NO: 125595

SEQ ID NO: 724181 - RNA, 64 nt, Homo Sapiens; identical to SEQ ID NO: 125596

SEQ ID NO: 724182 - RNA, 64 nt, Homo Sapiens; identical to SEQ ID NO: 125597

SEQ ID NO: 724183 - RNA, 64 nt, Homo Sapiens; identical to SEQ ID NO: 125598

SEQ ID NO: 724184 - RNA, 64 nt, Homo Sapiens; identical to SEQ ID NO: 125599

SEQ ID NO: 724185 - RNA, 64 nt, Homo Sapiens; identical to SEQ ID NO: 125600

SEQ ID NO: 724186 - RNA, 64 nt, Homo Sapiens; identical to SEQ ID NO: 125601

SEQ ID NO: 724187 - RNA, 64 nt, Homo Sapiens; identical to SEQ ID NO: 125602

SEQ ID NO: 724188 - RNA, 64 nt, Homo Sapiens; identical to SEQ ID NO: 125603

SEQ ID NO: 724189 - RNA, 64 nt, Homo Sapiens; identical to SEQ ID NO: 125604

SEQ ID NO: 724190 - RNA, 64 nt, Homo Sapiens; identical to SEQ ID NO: 125605

SEQ ID NO: 724191 - RNA, 64 nt, Homo Sapiens; identical to SEQ ID NO: 125606

SEQ ID NO: 724192 - RNA, 64 nt, Homo Sapiens; identical to SEQ ID NO: 125607

SEQ ID NO: 724193 - RNA, 64 nt, Homo Sapiens; identical to SEQ ID NO: 125608

SEQ ID NO: 724194 - RNA, 64 nt, Homo Sapiens; identical to SEQ ID NO: 125609

SEQ ID NO: 724195 - RNA, 64 nt, Homo Sapiens; identical to SEQ ID NO: 125610

SEQ ID NO: 724196 - RNA, 64 nt, Homo Sapiens; identical to SEQ ID NO: 125611

SEQ ID NO: 724197 - RNA, 64 nt, Homo Sapiens; identical to SEQ ID NO: 125612

SEQ ID NO: 724198 - RNA, 64 nt, Homo Sapiens; identical to SEQ ID NO: 125613

SEQ ID NO: 724199 - RNA, 64 nt, Homo Sapiens; identical to SEQ ID NO: 125614

SEQ ID NO: 724200 - RNA, 64 nt, Homo Sapiens; identical to SEQ ID NO: 125615

SEQ ID NO: 724201 - RNA, 64 nt, Homo Sapiens; identical to SEQ ID NO: 125616

SEQ ID NO: 724202 - RNA, 64 nt, Homo Sapiens; identical to SEQ ID NO: 125617

SEQ ID NO: 724203 - RNA, 64 nt, Homo Sapiens; identical to SEQ ID NO: 125618

SEQ ID NO: 724204 - RNA, 64 nt, Homo Sapiens; identical to SEQ ID NO: 125619

SEQ ID NO: 724205 - RNA, 64 nt, Homo Sapiens; identical to SEQ ID NO: 125620

SEQ ID NO: 724206 - RNA, 64 nt, Homo Sapiens; identical to SEQ ID NO: 125621

SEQ ID NO: 724207 - RNA, 64 nt, Homo Sapiens; identical to SEQ ID NO: 125622

SEQ ID NO: 724208 - RNA, 64 nt, Homo Sapiens; identical to SEQ ID NO: 125623

SEQ ID NO: 724209 - RNA, 64 nt, Homo Sapiens; identical to SEQ ID NO: 125624

SEQ ID NO: 724210 - RNA, 64 nt, Homo Sapiens; identical to SEQ ID NO: 125625

SEQ ID NO: 724211 - RNA, 64 nt, Homo Sapiens; identical to SEQ ID NO: 125626

SEQ ID NO: 724212 - RNA, 64 nt, Homo Sapiens; identical to SEQ ID NO: 125627

SEQ ID NO: 724213 - RNA, 64 nt, Homo Sapiens; identical to SEQ ID NO: 125628

SEQ ID NO: 724214 - RNA, 64 nt, Homo Sapiens; identical to SEQ ID NO: 125629

SEQ ID NO: 724215 - RNA, 64 nt, Homo Sapiens; identical to SEQ ID NO: 125630

SEQ ID NO: 724216 - RNA, 64 nt, Homo Sapiens; identical to SEQ ID NO: 125631

SEQ ID NO: 724217 - RNA, 64 nt, Homo Sapiens; identical to SEQ ID NO: 125632

SEQ ID NO: 724218 - RNA, 64 nt, Homo Sapiens; identical to SEQ ID NO: 125633

SEQ ID NO: 724219 - RNA, 64 nt, Homo Sapiens; identical to SEQ ID NO: 125634

SEQ ID NO: 724220 - RNA, 64 nt, Homo Sapiens; identical to SEQ ID NO: 125635

SEQ ID NO: 724221 - RNA, 64 nt, Homo Sapiens; identical to SEQ ID NO: 125636

SEQ ID NO: 724222 - RNA, 64 nt, Homo Sapiens; identical to SEQ ID NO: 125637

SEQ ID NO: 724223 - RNA, 64 nt, Homo Sapiens; identical to SEQ ID NO: 125638

SEQ ID NO: 724224 - RNA, 64 nt, Homo Sapiens; identical to SEQ ID NO: 125639

SEQ ID NO: 724225 - RNA, 64 nt, Homo Sapiens; identical to SEQ ID NO: 125640

SEQ ID NO: 724226 - RNA, 64 nt, Homo Sapiens; identical to SEQ ID NO: 125641

SEQ ID NO: 724227 - RNA, 64 nt, Homo Sapiens; identical to SEQ ID NO: 125642

SEQ ID NO: 724228 - RNA, 64 nt, Homo Sapiens; identical to SEQ ID NO: 259559

SEQ ID NO: 724229 - RNA, 64 nt, Homo Sapiens; identical to SEQ ID NO: 259560

SEQ ID NO: 724230 - RNA, 64 nt, Homo Sapiens; identical to SEQ ID NO: 259561

SEQ ID NO: 724231 - RNA, 64 nt, Homo Sapiens; identical to SEQ ID NO: 259562

SEQ ID NO: 724232 - RNA, 64 nt, Homo Sapiens; identical to SEQ ID NO: 259563

SEQ ID NO: 724233 - RNA, 64 nt, Homo Sapiens; identical to SEQ ID NO: 259564

SEQ ID NO: 724234 - RNA, 64 nt, Homo Sapiens; identical to SEQ ID NO: 259565

SEQ ID NO: 724235 - RNA, 64 nt, Homo Sapiens; identical to SEQ ID NO: 259566

SEQ ID NO: 724236 - RNA, 64 nt, Homo Sapiens; identical to SEQ ID NO: 259567

SEQ ID NO: 724237 - RNA, 64 nt, Homo Sapiens; identical to SEQ ID NO: 259568

SEQ ID NO: 724238 - RNA, 64 nt, Homo Sapiens; identical to SEQ ID NO: 259569

SEQ ID NO: 724239 - RNA, 64 nt, Homo Sapiens; identical to SEQ ID NO: 259570

SEQ ID NO: 724240 - RNA, 64 nt, Homo Sapiens; identical to SEQ ID NO: 259571

SEQ ID NO: 724241 - RNA, 64 nt, Homo Sapiens; identical to SEQ ID NO: 259572

SEQ ID NO: 724242 - RNA, 64 nt, Homo Sapiens; identical to SEQ ID NO: 259573

SEQ ID NO: 724243 - RNA, 64 nt, Homo Sapiens; identical to SEQ ID NO: 259574

SEQ ID NO: 724244 - RNA, 64 nt, Homo Sapiens; identical to SEQ ID NO: 259575

SEQ ID NO: 724245 - RNA, 64 nt, Homo Sapiens; identical to SEQ ID NO: 259576

SEQ ID NO: 724246 - RNA, 64 nt, Homo Sapiens; identical to SEQ ID NO: 259577

SEQ ID NO: 724247 - RNA, 64 nt, Homo Sapiens; identical to SEQ ID NO: 259578

SEQ ID NO: 724248 - RNA, 64 nt, Homo Sapiens; identical to SEQ ID NO: 259579

SEQ ID NO: 724249 - RNA, 64 nt, Homo Sapiens; identical to SEQ ID NO: 259580

SEQ ID NO: 724250 - RNA, 64 nt, Homo Sapiens; identical to SEQ ID NO: 376863

SEQ ID NO: 724251 - RNA, 64 nt, Homo Sapiens; identical to SEQ ID NO: 376864

SEQ ID NO: 724252 - RNA, 64 nt, Homo Sapiens; identical to SEQ ID NO: 376865

SEQ ID NO: 724253 - RNA, 64 nt, Homo Sapiens; identical to SEQ ID NO: 376866

SEQ ID NO: 724254 - RNA, 64 nt, Homo Sapiens; identical to SEQ ID NO: 376867

SEQ ID NO: 724255 - RNA, 64 nt, Homo Sapiens; identical to SEQ ID NO: 376868

SEQ ID NO: 724256 - RNA, 64 nt, Homo Sapiens; identical to SEQ ID NO: 376869

SEQ ID NO: 724257 - RNA, 64 nt, Homo Sapiens; identical to SEQ ID NO: 376870

SEQ ID NO: 724258 - RNA, 64 nt, Homo Sapiens; identical to SEQ ID NO: 376871

SEQ ID NO: 724259 - RNA, 64 nt, Homo Sapiens; identical to SEQ ID NO: 376872

SEQ ID NO: 724260 - RNA, 64 nt, Homo Sapiens; identical to SEQ ID NO: 376873

SEQ ID NO: 724261 - RNA, 64 nt, Homo Sapiens; identical to SEQ ID NO: 376874

SEQ ID NO: 724262 - RNA, 64 nt, Homo Sapiens; identical to SEQ ID NO: 376875

SEQ ID NO: 724263 - RNA, 64 nt, Homo Sapiens; identical to SEQ ID NO: 376876

SEQ ID NO: 724264 - RNA, 64 nt, Homo Sapiens; identical to SEQ ID NO: 376877

SEQ ID NO: 724265 - RNA, 64 nt, Homo Sapiens; identical to SEQ ID NO: 376878

SEQ ID NO: 724266 - RNA, 64 nt, Homo Sapiens; identical to SEQ ID NO: 376879

SEQ ID NO: 724267 - RNA, 64 nt, Homo Sapiens; identical to SEQ ID NO: 376880

SEQ ID NO: 724268 - RNA, 64 nt, Homo Sapiens; identical to SEQ ID NO: 376881

SEQ ID NO: 724269 - RNA, 64 nt, Homo Sapiens
uguuccuccuccccucuccuagcagcccuaaugucugaccuagccuaucaagccuuaggcgcug

SEQ ID NO: 724270 - RNA, 64 nt, Homo Sapiens
uuuccuacccuuuaaagguaacuucucccuucuccugaccuacuuccuccuagcaaccaacuuu

SEQ ID NO: 724271 - RNA, 64 nt, Homo Sapiens
acuuccacugcaccccgucugguaacuugcaccucugaccuaucucccuuuugcggaugggagg

SEQ ID NO: 724272 - RNA, 64 nt, Homo Sapiens
cgagggacuuaagaugcuacagcgaggacauucucugaccuacuugcucaaugacucucuggug

SEQ ID NO: 724273 - RNA, 64 nt, Homo Sapiens
aacugauguuaucuauagauuuaaaauucgaccccugaccuagcgccugaccuaagccugguag

SEQ ID NO: 724274 - RNA, 64 nt, Homo Sapiens
ccugguaguuaaaauucgacaggccugggccggccugaccuaagaaggaaccagacccgaaacc

SEQ ID NO: 724275 - RNA, 64 nt, Homo Sapiens; identical to SEQ ID NO: 571770

SEQ ID NO: 724276 - RNA, 64 nt, Homo Sapiens; identical to SEQ ID NO: 571771

SEQ ID NO: 724277 - RNA, 64 nt, Homo Sapiens; identical to SEQ ID NO: 571772

SEQ ID NO: 724278 - RNA, 64 nt, Homo Sapiens; identical to SEQ ID NO: 571773

SEQ ID NO: 724279 - RNA, 64 nt, Homo Sapiens; identical to SEQ ID NO: 111305

SEQ ID NO: 724280 - RNA, 64 nt, Homo Sapiens; identical to SEQ ID NO: 111306

SEQ ID NO: 724281 - RNA, 64 nt, Homo Sapiens; identical to SEQ ID NO: 111307

SEQ ID NO: 724282 - RNA, 64 nt, Homo Sapiens; identical to SEQ ID NO: 111308

SEQ ID NO: 724283 - RNA, 64 nt, Homo Sapiens; identical to SEQ ID NO: 111309

SEQ ID NO: 724284 - RNA, 64 nt, Homo Sapiens; identical to SEQ ID NO: 111310

SEQ ID NO: 724285 - RNA, 64 nt, Homo Sapiens; identical to SEQ ID NO: 111311

SEQ ID NO: 724286 - RNA, 64 nt, Homo Sapiens; identical to SEQ ID NO: 111312

SEQ ID NO: 724287 - RNA, 64 nt, Homo Sapiens; identical to SEQ ID NO: 111313

SEQ ID NO: 724288 - RNA, 64 nt, Homo Sapiens; identical to SEQ ID NO: 111314

SEQ ID NO: 724289 - RNA, 64 nt, Homo Sapiens; identical to SEQ ID NO: 111315

SEQ ID NO: 724290 - RNA, 64 nt, Homo Sapiens; identical to SEQ ID NO: 111316

SEQ ID NO: 724291 - RNA, 64 nt, Homo Sapiens; identical to SEQ ID NO: 111317

SEQ ID NO: 724292 - RNA, 64 nt, Homo Sapiens; identical to SEQ ID NO: 111318

SEQ ID NO: 724293 - RNA, 64 nt, Homo Sapiens; identical to SEQ ID NO: 111319

SEQ ID NO: 724294 - RNA, 64 nt, Homo Sapiens; identical to SEQ ID NO: 111320

SEQ ID NO: 724295 - RNA, 64 nt, Homo Sapiens; identical to SEQ ID NO: 111321

SEQ ID NO: 724296 - RNA, 64 nt, Homo Sapiens; identical to SEQ ID NO: 111322

SEQ ID NO: 724297 - RNA, 64 nt, Homo Sapiens; identical to SEQ ID NO: 111323

SEQ ID NO: 724298 - RNA, 64 nt, Homo Sapiens; identical to SEQ ID NO: 111324

SEQ ID NO: 724299 - RNA, 64 nt, Homo Sapiens; identical to SEQ ID NO: 111325

SEQ ID NO: 724300 - RNA, 64 nt, Homo Sapiens; identical to SEQ ID NO: 111326

SEQ ID NO: 724301 - RNA, 64 nt, Homo Sapiens; identical to SEQ ID NO: 111327

SEQ ID NO: 724302 - RNA, 64 nt, Homo Sapiens; identical to SEQ ID NO: 111328

SEQ ID NO: 724303 - RNA, 64 nt, Homo Sapiens; identical to SEQ ID NO: 111329

SEQ ID NO: 724304 - RNA, 64 nt, Homo Sapiens; identical to SEQ ID NO: 111330

SEQ ID NO: 724305 - RNA, 64 nt, Homo Sapiens; identical to SEQ ID NO: 111331

SEQ ID NO: 724306 - RNA, 64 nt, Homo Sapiens; identical to SEQ ID NO: 111332

SEQ ID NO: 724307 - RNA, 64 nt, Homo Sapiens; identical to SEQ ID NO: 111333

SEQ ID NO: 724308 - RNA, 64 nt, Homo Sapiens; identical to SEQ ID NO: 111334

SEQ ID NO: 724309 - RNA, 57 nt, Homo Sapiens; identical to SEQ ID NO: 111335

SEQ ID NO: 724310 - RNA, 64 nt, Homo Sapiens; identical to SEQ ID NO: 111336

SEQ ID NO: 724311 - RNA, 64 nt, Homo Sapiens; identical to SEQ ID NO: 111337

SEQ ID NO: 724312 - RNA, 64 nt, Homo Sapiens; identical to SEQ ID NO: 111338

SEQ ID NO: 724313 - RNA, 64 nt, Homo Sapiens; identical to SEQ ID NO: 111339

SEQ ID NO: 724314 - RNA, 64 nt, Homo Sapiens; identical to SEQ ID NO: 111340

SEQ ID NO: 724315 - RNA, 64 nt, Homo Sapiens; identical to SEQ ID NO: 111341

SEQ ID NO: 724316 - RNA, 64 nt, Homo Sapiens; identical to SEQ ID NO: 111342

SEQ ID NO: 724317 - RNA, 64 nt, Homo Sapiens; identical to SEQ ID NO: 111343

SEQ ID NO: 724318 - RNA, 64 nt, Homo Sapiens; identical to SEQ ID NO: 111344

SEQ ID NO: 724319 - RNA, 64 nt, Homo Sapiens; identical to SEQ ID NO: 111345

SEQ ID NO: 724320 - RNA, 64 nt, Homo Sapiens; identical to SEQ ID NO: 111346

SEQ ID NO: 724321 - RNA, 57 nt, Homo Sapiens; identical to SEQ ID NO: 111347

SEQ ID NO: 724322 - RNA, 64 nt, Homo Sapiens; identical to SEQ ID NO: 111348

SEQ ID NO: 724323 - RNA, 64 nt, Homo Sapiens; identical to SEQ ID NO: 111349

SEQ ID NO: 724324 - RNA, 64 nt, Homo Sapiens; identical to SEQ ID NO: 111350

SEQ ID NO: 724325 - RNA, 64 nt, Homo Sapiens; identical to SEQ ID NO: 315746

SEQ ID NO: 724326 - RNA, 64 nt, Homo Sapiens; identical to SEQ ID NO: 315747

SEQ ID NO: 724327 - RNA, 64 nt, Homo Sapiens; identical to SEQ ID NO: 315748

SEQ ID NO: 724328 - RNA, 64 nt, Homo Sapiens; identical to SEQ ID NO: 315749

SEQ ID NO: 724329 - RNA, 64 nt, Homo Sapiens; identical to SEQ ID NO: 218107

SEQ ID NO: 724330 - RNA, 64 nt, Homo Sapiens; identical to SEQ ID NO: 218108

SEQ ID NO: 724331 - RNA, 64 nt, Homo Sapiens; identical to SEQ ID NO: 218109

SEQ ID NO: 724332 - RNA, 64 nt, Homo Sapiens; identical to SEQ ID NO: 218110

SEQ ID NO: 724333 - RNA, 64 nt, Homo Sapiens; identical to SEQ ID NO: 218111

SEQ ID NO: 724334 - RNA, 64 nt, Homo Sapiens; identical to SEQ ID NO: 218112

SEQ ID NO: 724335 - RNA, 64 nt, Homo Sapiens; identical to SEQ ID NO: 218113

SEQ ID NO: 724336 - RNA, 64 nt, Homo Sapiens; identical to SEQ ID NO: 218114

SEQ ID NO: 724337 - RNA, 64 nt, Homo Sapiens; identical to SEQ ID NO: 218115

SEQ ID NO: 724338 - RNA, 64 nt, Homo Sapiens; identical to SEQ ID NO: 218116

SEQ ID NO: 724339 - RNA, 64 nt, Homo Sapiens; identical to SEQ ID NO: 218117

SEQ ID NO: 724340 - RNA, 64 nt, Homo Sapiens; identical to SEQ ID NO: 218118

SEQ ID NO: 724341 - RNA, 64 nt, Homo Sapiens; identical to SEQ ID NO: 218119

SEQ ID NO: 724342 - RNA, 64 nt, Homo Sapiens; identical to SEQ ID NO: 218120

SEQ ID NO: 724343 - RNA, 64 nt, Homo Sapiens; identical to SEQ ID NO: 218121

SEQ ID NO: 724344 - RNA, 64 nt, Homo Sapiens; identical to SEQ ID NO: 218122

SEQ ID NO: 724345 - RNA, 64 nt, Homo Sapiens; identical to SEQ ID NO: 218123

SEQ ID NO: 724346 - RNA, 64 nt, Homo Sapiens; identical to SEQ ID NO: 218124

SEQ ID NO: 724347 - RNA, 64 nt, Homo Sapiens; identical to SEQ ID NO: 218125

SEQ ID NO: 724348 - RNA, 64 nt, Homo Sapiens; identical to SEQ ID NO: 218126

SEQ ID NO: 724349 - RNA, 64 nt, Homo Sapiens
uaccaggcuuucugaaagauaccuguucucucuagccauugauuuuuaaauguucuaacauaag

SEQ ID NO: 724350 - RNA, 64 nt, Homo Sapiens
ccacaaagccgguaaaugccgguucagaaauggugccauugaagcugguaggaauaaagguagg

SEQ ID NO: 724351 - RNA, 64 nt, Homo Sapiens
cuuagccaguuggauaaauauuuggggucaccuagccauugaaagcagaaagcaguagugacac

SEQ ID NO: 724352 - RNA, 64 nt, Homo Sapiens
gaaagcaguagugacacagcuuucccuucaaagagccauugagaaacauuucucaaacaggaaa

SEQ ID NO: 724353 - RNA, 64 nt, Homo Sapiens
ugcacgguguguugccacgaucaugcucaacaaugccauugaagcuggcucuaucagaguuguu

SEQ ID NO: 724354 - RNA, 64 nt, Homo Sapiens
uggcauuuaccuuggguaagugaauuuucauucugccauugacuaccacaccuggccccaagcu

SEQ ID NO: 724355 - RNA, 64 nt, Homo Sapiens; identical to SEQ ID NO: 309788

SEQ ID NO: 724356 - RNA, 64 nt, Homo Sapiens; identical to SEQ ID NO: 309789

SEQ ID NO: 724357 - RNA, 64 nt, Homo Sapiens; identical to SEQ ID NO: 309790

SEQ ID NO: 724358 - RNA, 64 nt, Homo Sapiens; identical to SEQ ID NO: 309791

SEQ ID NO: 724359 - RNA, 64 nt, Homo Sapiens; identical to SEQ ID NO: 309792

SEQ ID NO: 724360 - RNA, 64 nt, Homo Sapiens; identical to SEQ ID NO: 309793

SEQ ID NO: 724361 - RNA, 64 nt, Homo Sapiens; identical to SEQ ID NO: 309794

SEQ ID NO: 724362 - RNA, 64 nt, Homo Sapiens; identical to SEQ ID NO: 309795

SEQ ID NO: 724363 - RNA, 64 nt, Homo Sapiens; identical to SEQ ID NO: 309796

SEQ ID NO: 724364 - RNA, 64 nt, Homo Sapiens; identical to SEQ ID NO: 309797

SEQ ID NO: 724365 - RNA, 64 nt, Homo Sapiens; identical to SEQ ID NO: 309798

SEQ ID NO: 724366 - RNA, 64 nt, Homo Sapiens; identical to SEQ ID NO: 309799

SEQ ID NO: 724367 - RNA, 64 nt, Homo Sapiens; identical to SEQ ID NO: 309800

SEQ ID NO: 724368 - RNA, 64 nt, Homo Sapiens; identical to SEQ ID NO: 309801

SEQ ID NO: 724369 - RNA, 64 nt, Homo Sapiens; identical to SEQ ID NO: 309802

SEQ ID NO: 724370 - RNA, 64 nt, Homo Sapiens; identical to SEQ ID NO: 309803

SEQ ID NO: 724371 - RNA, 64 nt, Homo Sapiens; identical to SEQ ID NO: 309804

SEQ ID NO: 724372 - RNA, 64 nt, Homo Sapiens; identical to SEQ ID NO: 309805

SEQ ID NO: 724373 - RNA, 64 nt, Homo Sapiens; identical to SEQ ID NO: 309806

SEQ ID NO: 724374 - RNA, 64 nt, Homo Sapiens; identical to SEQ ID NO: 309807

SEQ ID NO: 724375 - RNA, 64 nt, Homo Sapiens; identical to SEQ ID NO: 309808

SEQ ID NO: 724376 - RNA, 64 nt, Homo Sapiens; identical to SEQ ID NO: 309809

SEQ ID NO: 724377 - RNA, 64 nt, Homo Sapiens; identical to SEQ ID NO: 309810

SEQ ID NO: 724378 - RNA, 64 nt, Homo Sapiens; identical to SEQ ID NO: 309811

SEQ ID NO: 724379 - RNA, 64 nt, Homo Sapiens; identical to SEQ ID NO: 309812

SEQ ID NO: 724380 - RNA, 64 nt, Homo Sapiens; identical to SEQ ID NO: 309813

SEQ ID NO: 724381 - RNA, 64 nt, Homo Sapiens; identical to SEQ ID NO: 309814

SEQ ID NO: 724382 - RNA, 64 nt, Homo Sapiens; identical to SEQ ID NO: 309815

SEQ ID NO: 724383 - RNA, 64 nt, Homo Sapiens; identical to SEQ ID NO: 309816

SEQ ID NO: 724384 - RNA, 64 nt, Homo Sapiens; identical to SEQ ID NO: 309817

SEQ ID NO: 724385 - RNA, 64 nt, Homo Sapiens; identical to SEQ ID NO: 309818

SEQ ID NO: 724386 - RNA, 64 nt, Homo Sapiens; identical to SEQ ID NO: 309819

SEQ ID NO: 724387 - RNA, 64 nt, Homo Sapiens; identical to SEQ ID NO: 309820

SEQ ID NO: 724388 - RNA, 64 nt, Homo Sapiens; identical to SEQ ID NO: 309821

SEQ ID NO: 724389 - RNA, 64 nt, Homo Sapiens; identical to SEQ ID NO: 309822

SEQ ID NO: 724390 - RNA, 64 nt, Homo Sapiens; identical to SEQ ID NO: 309823

SEQ ID NO: 724391 - RNA, 64 nt, Homo Sapiens; identical to SEQ ID NO: 309824

SEQ ID NO: 724392 - RNA, 64 nt, Homo Sapiens; identical to SEQ ID NO: 309825

SEQ ID NO: 724393 - RNA, 64 nt, Homo Sapiens; identical to SEQ ID NO: 309826

SEQ ID NO: 724394 - RNA, 64 nt, Homo Sapiens; identical to SEQ ID NO: 309827

SEQ ID NO: 724395 - RNA, 64 nt, Homo Sapiens; identical to SEQ ID NO: 309828

SEQ ID NO: 724396 - RNA, 64 nt, Homo Sapiens; identical to SEQ ID NO: 309829

SEQ ID NO: 724397 - RNA, 64 nt, Homo Sapiens; identical to SEQ ID NO: 309830

SEQ ID NO: 724398 - RNA, 64 nt, Homo Sapiens; identical to SEQ ID NO: 309831

SEQ ID NO: 724399 - RNA, 64 nt, Homo Sapiens; identical to SEQ ID NO: 309832

SEQ ID NO: 724400 - RNA, 64 nt, Homo Sapiens; identical to SEQ ID NO: 309833

SEQ ID NO: 724401 - RNA, 64 nt, Homo Sapiens; identical to SEQ ID NO: 309834

SEQ ID NO: 724402 - RNA, 64 nt, Homo Sapiens; identical to SEQ ID NO: 309835

SEQ ID NO: 724403 - RNA, 64 nt, Homo Sapiens; identical to SEQ ID NO: 309836

SEQ ID NO: 724404 - RNA, 64 nt, Homo Sapiens; identical to SEQ ID NO: 309837

SEQ ID NO: 724405 - RNA, 64 nt, Homo Sapiens; identical to SEQ ID NO: 309838

SEQ ID NO: 724406 - RNA, 64 nt, Homo Sapiens; identical to SEQ ID NO: 309839

SEQ ID NO: 724407 - RNA, 64 nt, Homo Sapiens; identical to SEQ ID NO: 309840

SEQ ID NO: 724408 - RNA, 64 nt, Homo Sapiens; identical to SEQ ID NO: 309841

SEQ ID NO: 724409 - RNA, 64 nt, Homo Sapiens; identical to SEQ ID NO: 309842

SEQ ID NO: 724410 - RNA, 64 nt, Homo Sapiens; identical to SEQ ID NO: 309843

SEQ ID NO: 724411 - RNA, 64 nt, Homo Sapiens; identical to SEQ ID NO: 309844

SEQ ID NO: 724412 - RNA, 64 nt, Homo Sapiens; identical to SEQ ID NO: 309845

SEQ ID NO: 724413 - RNA, 64 nt, Homo Sapiens; identical to SEQ ID NO: 309846

SEQ ID NO: 724414 - RNA, 64 nt, Homo Sapiens; identical to SEQ ID NO: 309847

SEQ ID NO: 724415 - RNA, 64 nt, Homo Sapiens; identical to SEQ ID NO: 309848

SEQ ID NO: 724416 - RNA, 64 nt, Homo Sapiens; identical to SEQ ID NO: 309849

SEQ ID NO: 724417 - RNA, 64 nt, Homo Sapiens; identical to SEQ ID NO: 309850

SEQ ID NO: 724418 - RNA, 64 nt, Homo Sapiens; identical to SEQ ID NO: 309851

SEQ ID NO: 724419 - RNA, 64 nt, Homo Sapiens; identical to SEQ ID NO: 309852

SEQ ID NO: 724420 - RNA, 64 nt, Homo Sapiens; identical to SEQ ID NO: 309853

SEQ ID NO: 724421 - RNA, 64 nt, Homo Sapiens; identical to SEQ ID NO: 309854

SEQ ID NO: 724422 - RNA, 64 nt, Homo Sapiens; identical to SEQ ID NO: 309855

SEQ ID NO: 724423 - RNA, 64 nt, Homo Sapiens; identical to SEQ ID NO: 309856

SEQ ID NO: 724424 - RNA, 64 nt, Homo Sapiens; identical to SEQ ID NO: 309857

SEQ ID NO: 724425 - RNA, 64 nt, Homo Sapiens; identical to SEQ ID NO: 309858

SEQ ID NO: 724426 - RNA, 64 nt, Homo Sapiens; identical to SEQ ID NO: 309859

SEQ ID NO: 724427 - RNA, 64 nt, Homo Sapiens; identical to SEQ ID NO: 309860

SEQ ID NO: 724428 - RNA, 64 nt, Homo Sapiens; identical to SEQ ID NO: 309861

SEQ ID NO: 724429 - RNA, 64 nt, Homo Sapiens; identical to SEQ ID NO: 309862

SEQ ID NO: 724430 - RNA, 64 nt, Homo Sapiens; identical to SEQ ID NO: 309863

SEQ ID NO: 724431 - RNA, 64 nt, Homo Sapiens; identical to SEQ ID NO: 309864

SEQ ID NO: 724432 - RNA, 64 nt, Homo Sapiens; identical to SEQ ID NO: 309865

SEQ ID NO: 724433 - RNA, 64 nt, Homo Sapiens; identical to SEQ ID NO: 309866

SEQ ID NO: 724434 - RNA, 64 nt, Homo Sapiens; identical to SEQ ID NO: 309867

SEQ ID NO: 724435 - RNA, 64 nt, Homo Sapiens; identical to SEQ ID NO: 309868

SEQ ID NO: 724436 - RNA, 64 nt, Homo Sapiens; identical to SEQ ID NO: 309869

SEQ ID NO: 724437 - RNA, 64 nt, Homo Sapiens; identical to SEQ ID NO: 309870

SEQ ID NO: 724438 - RNA, 64 nt, Homo Sapiens; identical to SEQ ID NO: 309871

SEQ ID NO: 724439 - RNA, 64 nt, Homo Sapiens; identical to SEQ ID NO: 309872

SEQ ID NO: 724440 - RNA, 64 nt, Homo Sapiens; identical to SEQ ID NO: 309873

SEQ ID NO: 724441 - RNA, 64 nt, Homo Sapiens; identical to SEQ ID NO: 309874

SEQ ID NO: 724442 - RNA, 64 nt, Homo Sapiens; identical to SEQ ID NO: 309875

SEQ ID NO: 724443 - RNA, 64 nt, Homo Sapiens; identical to SEQ ID NO: 309876

SEQ ID NO: 724444 - RNA, 64 nt, Homo Sapiens; identical to SEQ ID NO: 309877

SEQ ID NO: 724445 - RNA, 64 nt, Homo Sapiens; identical to SEQ ID NO: 309878

SEQ ID NO: 724446 - RNA, 64 nt, Homo Sapiens; identical to SEQ ID NO: 309879

SEQ ID NO: 724447 - RNA, 64 nt, Homo Sapiens; identical to SEQ ID NO: 309880

SEQ ID NO: 724448 - RNA, 64 nt, Homo Sapiens; identical to SEQ ID NO: 309881

SEQ ID NO: 724449 - RNA, 64 nt, Homo Sapiens; identical to SEQ ID NO: 309882

SEQ ID NO: 724450 - RNA, 64 nt, Homo Sapiens; identical to SEQ ID NO: 309883

SEQ ID NO: 724451 - RNA, 64 nt, Homo Sapiens; identical to SEQ ID NO: 309884

SEQ ID NO: 724452 - RNA, 64 nt, Homo Sapiens; identical to SEQ ID NO: 309885

SEQ ID NO: 724453 - RNA, 64 nt, Homo Sapiens; identical to SEQ ID NO: 309886

SEQ ID NO: 724454 - RNA, 64 nt, Homo Sapiens; identical to SEQ ID NO: 309887

SEQ ID NO: 724455 - RNA, 64 nt, Homo Sapiens; identical to SEQ ID NO: 309888

SEQ ID NO: 724456 - RNA, 64 nt, Homo Sapiens; identical to SEQ ID NO: 309889

SEQ ID NO: 724457 - RNA, 64 nt, Homo Sapiens; identical to SEQ ID NO: 309890

SEQ ID NO: 724458 - RNA, 64 nt, Homo Sapiens; identical to SEQ ID NO: 309891

SEQ ID NO: 724459 - RNA, 64 nt, Homo Sapiens; identical to SEQ ID NO: 309892

SEQ ID NO: 724460 - RNA, 64 nt, Homo Sapiens; identical to SEQ ID NO: 309893

SEQ ID NO: 724461 - RNA, 64 nt, Homo Sapiens; identical to SEQ ID NO: 309894

SEQ ID NO: 724462 - RNA, 64 nt, Homo Sapiens; identical to SEQ ID NO: 309895

SEQ ID NO: 724463 - RNA, 64 nt, Homo Sapiens; identical to SEQ ID NO: 309896

SEQ ID NO: 724464 - RNA, 64 nt, Homo Sapiens; identical to SEQ ID NO: 309897

SEQ ID NO: 724465 - RNA, 64 nt, Homo Sapiens; identical to SEQ ID NO: 309898

SEQ ID NO: 724466 - RNA, 64 nt, Homo Sapiens; identical to SEQ ID NO: 309899

SEQ ID NO: 724467 - RNA, 64 nt, Homo Sapiens; identical to SEQ ID NO: 309900

SEQ ID NO: 724468 - RNA, 64 nt, Homo Sapiens; identical to SEQ ID NO: 309901

SEQ ID NO: 724469 - RNA, 64 nt, Homo Sapiens; identical to SEQ ID NO: 309902

SEQ ID NO: 724470 - RNA, 64 nt, Homo Sapiens; identical to SEQ ID NO: 309903

SEQ ID NO: 724471 - RNA, 64 nt, Homo Sapiens; identical to SEQ ID NO: 309904

SEQ ID NO: 724472 - RNA, 64 nt, Homo Sapiens; identical to SEQ ID NO: 309905

SEQ ID NO: 724473 - RNA, 64 nt, Homo Sapiens; identical to SEQ ID NO: 309906

SEQ ID NO: 724474 - RNA, 64 nt, Homo Sapiens; identical to SEQ ID NO: 309907

SEQ ID NO: 724475 - RNA, 64 nt, Homo Sapiens; identical to SEQ ID NO: 309908

SEQ ID NO: 724476 - RNA, 64 nt, Homo Sapiens; identical to SEQ ID NO: 309909

SEQ ID NO: 724477 - RNA, 64 nt, Homo Sapiens; identical to SEQ ID NO: 309910

SEQ ID NO: 724478 - RNA, 64 nt, Homo Sapiens; identical to SEQ ID NO: 309911

SEQ ID NO: 724479 - RNA, 64 nt, Homo Sapiens; identical to SEQ ID NO: 309912

SEQ ID NO: 724480 - RNA, 64 nt, Homo Sapiens; identical to SEQ ID NO: 309913

SEQ ID NO: 724481 - RNA, 64 nt, Homo Sapiens; identical to SEQ ID NO: 309914

SEQ ID NO: 724482 - RNA, 64 nt, Homo Sapiens; identical to SEQ ID NO: 90267

SEQ ID NO: 724483 - RNA, 64 nt, Homo Sapiens; identical to SEQ ID NO: 90268

SEQ ID NO: 724484 - RNA, 64 nt, Homo Sapiens; identical to SEQ ID NO: 90269

SEQ ID NO: 724485 - RNA, 64 nt, Homo Sapiens; identical to SEQ ID NO: 90270

SEQ ID NO: 724486 - RNA, 64 nt, Homo Sapiens; identical to SEQ ID NO: 90271

SEQ ID NO: 724487 - RNA, 64 nt, Homo Sapiens; identical to SEQ ID NO: 90272

SEQ ID NO: 724488 - RNA, 64 nt, Homo Sapiens; identical to SEQ ID NO: 90273

SEQ ID NO: 724489 - RNA, 64 nt, Homo Sapiens; identical to SEQ ID NO: 90274

SEQ ID NO: 724490 - RNA, 64 nt, Homo Sapiens; identical to SEQ ID NO: 90275

SEQ ID NO: 724491 - RNA, 64 nt, Homo Sapiens; identical to SEQ ID NO: 90276

SEQ ID NO: 724492 - RNA, 64 nt, Homo Sapiens; identical to SEQ ID NO: 90277

SEQ ID NO: 724493 - RNA, 64 nt, Homo Sapiens; identical to SEQ ID NO: 90278

SEQ ID NO: 724494 - RNA, 64 nt, Homo Sapiens; identical to SEQ ID NO: 90279

SEQ ID NO: 724495 - RNA, 64 nt, Homo Sapiens; identical to SEQ ID NO: 90280

SEQ ID NO: 724496 - RNA, 64 nt, Homo Sapiens; identical to SEQ ID NO: 90281

SEQ ID NO: 724497 - RNA, 64 nt, Homo Sapiens; identical to SEQ ID NO: 90282

SEQ ID NO: 724498 - RNA, 64 nt, Homo Sapiens; identical to SEQ ID NO: 90283

SEQ ID NO: 724499 - RNA, 64 nt, Homo Sapiens; identical to SEQ ID NO: 90284

SEQ ID NO: 724500 - RNA, 64 nt, Homo Sapiens; identical to SEQ ID NO: 90285

SEQ ID NO: 724501 - RNA, 64 nt, Homo Sapiens; identical to SEQ ID NO: 90286

SEQ ID NO: 724502 - RNA, 64 nt, Homo Sapiens; identical to SEQ ID NO: 90287

SEQ ID NO: 724503 - RNA, 64 nt, Homo Sapiens; identical to SEQ ID NO: 318576

SEQ ID NO: 724504 - RNA, 64 nt, Homo Sapiens; identical to SEQ ID NO: 318577

SEQ ID NO: 724505 - RNA, 64 nt, Homo Sapiens; identical to SEQ ID NO: 318578

SEQ ID NO: 724506 - RNA, 64 nt, Homo Sapiens; identical to SEQ ID NO: 318579

SEQ ID NO: 724507 - RNA, 64 nt, Homo Sapiens; identical to SEQ ID NO: 318580

SEQ ID NO: 724508 - RNA, 64 nt, Homo Sapiens; identical to SEQ ID NO: 318581

SEQ ID NO: 724509 - RNA, 64 nt, Homo Sapiens; identical to SEQ ID NO: 318582

SEQ ID NO: 724510 - RNA, 64 nt, Homo Sapiens; identical to SEQ ID NO: 318583

SEQ ID NO: 724511 - RNA, 64 nt, Homo Sapiens; identical to SEQ ID NO: 318584

SEQ ID NO: 724512 - RNA, 64 nt, Homo Sapiens; identical to SEQ ID NO: 318585

SEQ ID NO: 724513 - RNA, 64 nt, Homo Sapiens; identical to SEQ ID NO: 318586

SEQ ID NO: 724514 - RNA, 64 nt, Homo Sapiens; identical to SEQ ID NO: 318587

SEQ ID NO: 724515 - RNA, 64 nt, Homo Sapiens; identical to SEQ ID NO: 318588

SEQ ID NO: 724516 - RNA, 64 nt, Homo Sapiens; identical to SEQ ID NO: 318589

SEQ ID NO: 724517 - RNA, 64 nt, Homo Sapiens; identical to SEQ ID NO: 318590

SEQ ID NO: 724518 - RNA, 64 nt, Homo Sapiens; identical to SEQ ID NO: 318591

SEQ ID NO: 724519 - RNA, 64 nt, Homo Sapiens; identical to SEQ ID NO: 318592

SEQ ID NO: 724520 - RNA, 64 nt, Homo Sapiens; identical to SEQ ID NO: 318593

SEQ ID NO: 724521 - RNA, 64 nt, Homo Sapiens; identical to SEQ ID NO: 133930

SEQ ID NO: 724522 - RNA, 64 nt, Homo Sapiens; identical to SEQ ID NO: 133931

SEQ ID NO: 724523 - RNA, 64 nt, Homo Sapiens; identical to SEQ ID NO: 133932

SEQ ID NO: 724524 - RNA, 64 nt, Homo Sapiens; identical to SEQ ID NO: 133933

SEQ ID NO: 724525 - RNA, 64 nt, Homo Sapiens; identical to SEQ ID NO: 133934

SEQ ID NO: 724526 - RNA, 64 nt, Homo Sapiens; identical to SEQ ID NO: 133935

SEQ ID NO: 724527 - RNA, 64 nt, Homo Sapiens; identical to SEQ ID NO: 133936

SEQ ID NO: 724528 - RNA, 64 nt, Homo Sapiens; identical to SEQ ID NO: 133937

SEQ ID NO: 724529 - RNA, 64 nt, Homo Sapiens; identical to SEQ ID NO: 133938

SEQ ID NO: 724530 - RNA, 64 nt, Homo Sapiens; identical to SEQ ID NO: 133939

SEQ ID NO: 724531 - RNA, 64 nt, Homo Sapiens; identical to SEQ ID NO: 133940

SEQ ID NO: 724532 - RNA, 64 nt, Homo Sapiens; identical to SEQ ID NO: 133941

SEQ ID NO: 724533 - RNA, 64 nt, Homo Sapiens; identical to SEQ ID NO: 133942

SEQ ID NO: 724534 - RNA, 64 nt, Homo Sapiens; identical to SEQ ID NO: 133943

SEQ ID NO: 724535 - RNA, 64 nt, Homo Sapiens; identical to SEQ ID NO: 133944

SEQ ID NO: 724536 - RNA, 64 nt, Homo Sapiens; identical to SEQ ID NO: 133945

SEQ ID NO: 724537 - RNA, 64 nt, Homo Sapiens; identical to SEQ ID NO: 133946

SEQ ID NO: 724538 - RNA, 64 nt, Homo Sapiens; identical to SEQ ID NO: 133947

SEQ ID NO: 724539 - RNA, 64 nt, Homo Sapiens; identical to SEQ ID NO: 133948

SEQ ID NO: 724540 - RNA, 64 nt, Homo Sapiens; identical to SEQ ID NO: 133949

SEQ ID NO: 724541 - RNA, 64 nt, Homo Sapiens; identical to SEQ ID NO: 133950

SEQ ID NO: 724542 - RNA, 64 nt, Homo Sapiens; identical to SEQ ID NO: 133951

SEQ ID NO: 724543 - RNA, 64 nt, Homo Sapiens; identical to SEQ ID NO: 133952

SEQ ID NO: 724544 - RNA, 64 nt, Homo Sapiens; identical to SEQ ID NO: 133953

SEQ ID NO: 724545 - RNA, 64 nt, Homo Sapiens; identical to SEQ ID NO: 133954

SEQ ID NO: 724546 - RNA, 64 nt, Homo Sapiens; identical to SEQ ID NO: 133955

SEQ ID NO: 724547 - RNA, 64 nt, Homo Sapiens; identical to SEQ ID NO: 133956

SEQ ID NO: 724548 - RNA, 64 nt, Homo Sapiens; identical to SEQ ID NO: 133957

SEQ ID NO: 724549 - RNA, 64 nt, Homo Sapiens; identical to SEQ ID NO: 133958

SEQ ID NO: 724550 - RNA, 64 nt, Homo Sapiens; identical to SEQ ID NO: 133959

SEQ ID NO: 724551 - RNA, 64 nt, Homo Sapiens; identical to SEQ ID NO: 133960

SEQ ID NO: 724552 - RNA, 64 nt, Homo Sapiens; identical to SEQ ID NO: 133961

SEQ ID NO: 724553 - RNA, 64 nt, Homo Sapiens; identical to SEQ ID NO: 133962

SEQ ID NO: 724554 - RNA, 64 nt, Homo Sapiens; identical to SEQ ID NO: 133963

SEQ ID NO: 724555 - RNA, 64 nt, Homo Sapiens; identical to SEQ ID NO: 133964

SEQ ID NO: 724556 - RNA, 64 nt, Homo Sapiens; identical to SEQ ID NO: 133965

SEQ ID NO: 724557 - RNA, 64 nt, Homo Sapiens; identical to SEQ ID NO: 133966

SEQ ID NO: 724558 - RNA, 64 nt, Homo Sapiens; identical to SEQ ID NO: 119443

SEQ ID NO: 724559 - RNA, 64 nt, Homo Sapiens; identical to SEQ ID NO: 119444

SEQ ID NO: 724560 - RNA, 64 nt, Homo Sapiens; identical to SEQ ID NO: 119445

SEQ ID NO: 724561 - RNA, 64 nt, Homo Sapiens; identical to SEQ ID NO: 119446

SEQ ID NO: 724562 - RNA, 64 nt, Homo Sapiens; identical to SEQ ID NO: 119447

SEQ ID NO: 724563 - RNA, 64 nt, Homo Sapiens; identical to SEQ ID NO: 119448

SEQ ID NO: 724564 - RNA, 64 nt, Homo Sapiens; identical to SEQ ID NO: 119449

SEQ ID NO: 724565 - RNA, 64 nt, Homo Sapiens; identical to SEQ ID NO: 119450

SEQ ID NO: 724566 - RNA, 64 nt, Homo Sapiens; identical to SEQ ID NO: 119451

SEQ ID NO: 724567 - RNA, 64 nt, Homo Sapiens; identical to SEQ ID NO: 119452

SEQ ID NO: 724568 - RNA, 64 nt, Homo Sapiens; identical to SEQ ID NO: 119453

SEQ ID NO: 724569 - RNA, 64 nt, Homo Sapiens; identical to SEQ ID NO: 119454

SEQ ID NO: 724570 - RNA, 64 nt, Homo Sapiens; identical to SEQ ID NO: 119455

SEQ ID NO: 724571 - RNA, 64 nt, Homo Sapiens; identical to SEQ ID NO: 119456

SEQ ID NO: 724572 - RNA, 64 nt, Homo Sapiens; identical to SEQ ID NO: 119457

SEQ ID NO: 724573 - RNA, 64 nt, Homo Sapiens; identical to SEQ ID NO: 119458

SEQ ID NO: 724574 - RNA, 64 nt, Homo Sapiens; identical to SEQ ID NO: 119459

SEQ ID NO: 724575 - RNA, 64 nt, Homo Sapiens; identical to SEQ ID NO: 119460

SEQ ID NO: 724576 - RNA, 51 nt, Homo Sapiens; identical to SEQ ID NO: 119461

SEQ ID NO: 724577 - RNA, 64 nt, Homo Sapiens; identical to SEQ ID NO: 119462

SEQ ID NO: 724578 - RNA, 64 nt, Homo Sapiens; identical to SEQ ID NO: 119463

SEQ ID NO: 724579 - RNA, 64 nt, Homo Sapiens; identical to SEQ ID NO: 119464

SEQ ID NO: 724580 - RNA, 64 nt, Homo Sapiens; identical to SEQ ID NO: 119465

SEQ ID NO: 724581 - RNA, 64 nt, Homo Sapiens; identical to SEQ ID NO: 119466

SEQ ID NO: 724582 - RNA, 64 nt, Homo Sapiens; identical to SEQ ID NO: 119467

SEQ ID NO: 724583 - RNA, 64 nt, Homo Sapiens; identical to SEQ ID NO: 119468

SEQ ID NO: 724584 - RNA, 64 nt, Homo Sapiens; identical to SEQ ID NO: 119469

SEQ ID NO: 724585 - RNA, 64 nt, Homo Sapiens; identical to SEQ ID NO: 119470

SEQ ID NO: 724586 - RNA, 64 nt, Homo Sapiens; identical to SEQ ID NO: 119471

SEQ ID NO: 724587 - RNA, 64 nt, Homo Sapiens; identical to SEQ ID NO: 119472

SEQ ID NO: 724588 - RNA, 64 nt, Homo Sapiens; identical to SEQ ID NO: 119473

SEQ ID NO: 724589 - RNA, 64 nt, Homo Sapiens; identical to SEQ ID NO: 119474

SEQ ID NO: 724590 - RNA, 64 nt, Homo Sapiens; identical to SEQ ID NO: 119475

SEQ ID NO: 724591 - RNA, 64 nt, Homo Sapiens; identical to SEQ ID NO: 119476

SEQ ID NO: 724592 - RNA, 64 nt, Homo Sapiens; identical to SEQ ID NO: 119477

SEQ ID NO: 724593 - RNA, 64 nt, Homo Sapiens; identical to SEQ ID NO: 119478

SEQ ID NO: 724594 - RNA, 64 nt, Homo Sapiens; identical to SEQ ID NO: 119479

SEQ ID NO: 724595 - RNA, 64 nt, Homo Sapiens; identical to SEQ ID NO: 119480

SEQ ID NO: 724596 - RNA, 64 nt, Homo Sapiens; identical to SEQ ID NO: 119481

SEQ ID NO: 724597 - RNA, 62 nt, Homo Sapiens
acacauuuacuggccuccucuaaugacuuuggggaaaagaugauucugggucuuucccuuga

SEQ ID NO: 724598 - RNA, 62 nt, Homo Sapiens
aaacaaaaacaagcaaacaaacaaaaaacaauggaaaagaugaagcuggagagagaggaacc

SEQ ID NO: 724599 - RNA, 62 nt, Homo Sapiens
cagaaggaggcugggcagaaagaaccaggccuggaaaagaacgugggaagagagccuggaaa

SEQ ID NO: 724600 - RNA, 62 nt, Homo Sapiens
caggccuggaaaagaaccagggaagagagccuggaaaagaacucugucauuguucaaaggug

SEQ ID NO: 724601 - RNA, 62 nt, Homo Sapiens
auggggugggggugggggugaagagguuuuagggaaaagaaaaccugaucauuuucuuuagg

SEQ ID NO: 724602 - RNA, 62 nt, Homo Sapiens
uuccccugaaccccuaaaaacuccuuucacgaggaaaagaccagucagccacagagacccuc

SEQ ID NO: 724603 - RNA, 62 nt, Homo Sapiens
ccagcccucuugcaagaggagaggcacgguagggaaaagaacugcugggugggggccuguuu

SEQ ID NO: 724604 - RNA, 62 nt, Homo Sapiens
guucuuugcagauuuggggcgaggggugauuuggaaaagaagaccuggguggaaagcgguuu

SEQ ID NO: 724605 - RNA, 62 nt, Homo Sapiens
acaaaaaacgaaugaaaauauaguuaaagaaaggaaaagaaauauuuaauaugcuuauaacc

SEQ ID NO: 724606 - RNA, 62 nt, Homo Sapiens
guggagaugaggucaguuguuggaagcuguuuggaaaagacaucagaaucagaagauagucu

SEQ ID NO: 724607 - RNA, 62 nt, Homo Sapiens
aagaccagaaauucccuuuugaaggugauaagggaaaagauaucaguguaaagugugugauu

SEQ ID NO: 724608 - RNA, 62 nt, Homo Sapiens
cuguggaugaacgaugaaugucaaugucagaaggaaaagagaauuuuggccaucaaaaucca

SEQ ID NO: 724609 - RNA, 62 nt, Homo Sapiens
aacccagcagcugaaaagcuucaagagaucuaggaaaagacauuuucauguuaaugagaauu

SEQ ID NO: 724610 - RNA, 62 nt, Homo Sapiens
uccuucauccuugugacauuucauuucaguaaggaaaagauaacaaagugcaauuaucagca

SEQ ID NO: 724611 - RNA, 62 nt, Homo Sapiens
gaauccuccuucuagcugaaggugauugaaaaggaaaagagugagugaacagaaccauagcu

SEQ ID NO: 724612 - RNA, 62 nt, Homo Sapiens
cuuugagguagaccaggauuucuaaucaaaagggaaaagaagauguugaagaauacaguuag

SEQ ID NO: 724613 - RNA, 62 nt, Homo Sapiens
accuucuagaauuauaagucacaaagaguucuggaaaagaacuguuuacugcuugauaggaa

SEQ ID NO: 724614 - RNA, 62 nt, Homo Sapiens
ucggcuguuaggccauucucgaaugaauuaauggaaaagaacugagggauaaauagaaagca

SEQ ID NO: 724615 - RNA, 62 nt, Homo Sapiens
cugucggguuuuuccauucaaagggcccacugggaaaagauauuaaguugcagcauaaaucc

SEQ ID NO: 724616 - RNA, 62 nt, Homo Sapiens
cauauuuuagagguguuaauaaaauccucaucggaaaagauccaaagugcaaggauuugauu

SEQ ID NO: 724617 - RNA, 62 nt, Homo Sapiens
uauaaacauaauuuccuagacugaaaguuuuuggaaaagaugcagggucugagucaggccuu

SEQ ID NO: 724618 - RNA, 62 nt, Homo Sapiens
cagggaggaaugaagagagcucucuaugugugggaaaagaggcuuccuguaaugaaauccac

SEQ ID NO: 724619 - RNA, 62 nt, Homo Sapiens
uaucaaguaaauacugaaacguaagagggaaaggaaaagagguccugacugaaauagacaaa

SEQ ID NO: 724620 - RNA, 62 nt, Homo Sapiens
uucaaauagaaaaacaacaaaacccaugaaauggaaaagagaguuccaaaaaagaagaccug

SEQ ID NO: 724621 - RNA, 62 nt, Homo Sapiens
uuuaccaacuuuacucauuuucccauuuuagaggaaaagagguugccugcuuccuaucaaag

SEQ ID NO: 724622 - RNA, 62 nt, Homo Sapiens
cuuccauccauuguuggcacccccuugcaaaaggaaaagaacagcaaaagucaggagcagua

SEQ ID NO: 724623 - RNA, 62 nt, Homo Sapiens
gggaaaauaacaaccacccuuacugauaguugggaaaagaagauuggguuauuuugccauau

SEQ ID NO: 724624 - RNA, 62 nt, Homo Sapiens
acaauggugagucccggcccacaaaagguuuaggaaaagaaagacacaucaaacaggccuau

SEQ ID NO: 724625 - RNA, 62 nt, Homo Sapiens
cacauaaacucgcuucugagccagcagauagaggaaaagacagguugcaguaccagccacag

SEQ ID NO: 724626 - RNA, 50 nt, Homo Sapiens; identical to SEQ ID NO: 189214

SEQ ID NO: 724627 - RNA, 62 nt, Homo Sapiens
uaaaauugaacuuugaugggggauucaguucuggaaaagaauuugguauuuuccagucugcu

SEQ ID NO: 724628 - RNA, 62 nt, Homo Sapiens
caagaaagcaggaacguggagaaauuggagcaggaaaagaaauuaucaaagcaauagaaaua

SEQ ID NO: 724629 - RNA, 62 nt, Homo Sapiens
augcuauuagcaauuuccauauacuauauuguggaaaagacugaagaauacaauucugagaa

SEQ ID NO: 724630 - RNA, 62 nt, Homo Sapiens
cuguguuuugaauuuuuauuuucuaaugcaguggaaaagaaacagaucauccuaaaugagga

SEQ ID NO: 724631 - RNA, 62 nt, Homo Sapiens
aaucccuucugucuuucuguucucacaaagauggaaaagauacaagagcuugccggaaauaa

SEQ ID NO: 724632 - RNA, 62 nt, Homo Sapiens
ucagagaaaagcccuauacguguagugaauguggaaaagacuucagauugaauucacaucuu

SEQ ID NO: 724633 - RNA, 62 nt, Homo Sapiens
accagacagaaagccuuugauugugauguaugggaaaagaacuccagucagagagcacaucu

SEQ ID NO: 724634 - RNA, 62 nt, Homo Sapiens
ugaugaaaauauuuaaaggcgcaauguagaggggaaaagagacaaagcgaauuuuaaaagau

SEQ ID NO: 724635 - RNA, 62 nt, Homo Sapiens
ucuaugauuccagguggcaucaaauccuugugggaaaagaaauuugagguggaagagggcug

SEQ ID NO: 724636 - RNA, 62 nt, Homo Sapiens
aggacaaaaguccucaacuucaucugauaauaggaaaagaaaaagguagaauagggcugaag

SEQ ID NO: 724637 - RNA, 62 nt, Homo Sapiens
ucagauuggaacuucuuguucaagcacuugcuggaaaagauaacacuuaucagaaucuuccu

SEQ ID NO: 724638 - RNA, 62 nt, Homo Sapiens
gaauggagagaggacucaacugggacccacguggaaaagaccgagcaggccacagaggcucg

SEQ ID NO: 724639 - RNA, 62 nt, Homo Sapiens
ccacccaaagccuagccgcuguucuagggaacggaaaagaguucauggccaagcgucuaacc

SEQ ID NO: 724640 - RNA, 62 nt, Homo Sapiens
agauaaacaaggaauauuuuuuuaaguggaggggaaaagaaguuuuucuuuuuuccuuuuuu

SEQ ID NO: 724641 - RNA, 62 nt, Homo Sapiens
guuugcuggcuagcucuauuguuagauaugcaggaaaagauauuuuacaguuacauccagcu

SEQ ID NO: 724642 - RNA, 62 nt, Homo Sapiens
uucgcuuuucaaguaggaagucaaucauaggaggaaaagaaaaagagcaugauuuuaaaaaa

SEQ ID NO: 724643 - RNA, 62 nt, Homo Sapiens
augauuuuaaaaaaucaaucauguugauguauggaaaagagcuuaguauccaaagacuguuu

SEQ ID NO: 724644 - RNA, 62 nt, Homo Sapiens
caaagcucuaauagagucacgauaaaaggauaggaaaagauuccauucccuguaggaguaaa

SEQ ID NO: 724645 - RNA, 62 nt, Homo Sapiens
aucaaaggcagaaaggagauaaagacaaagaaggaaaagaguugaggugauaggcaaggaug

SEQ ID NO: 724646 - RNA, 62 nt, Homo Sapiens
caauaugcuuuacacucauuucaaaggauuuuggaaaagaaacuuucuuuacuccuuuggcu

SEQ ID NO: 724647 - RNA, 62 nt, Homo Sapiens
gccaggauggggcacagcagcucagguuugggggaaaagacccgaauccagagugcagggga

SEQ ID NO: 724648 - RNA, 62 nt, Homo Sapiens
agagggagcuucacugagacucagagggaaaaggaaaagagccucaaacauuuuuaggaggu

SEQ ID NO: 724649 - RNA, 62 nt, Homo Sapiens
aaaacuugaaguuccucaggccuguaacuucuggaaaagaugauuauucaaaauaauguuuu

SEQ ID NO: 724650 - RNA, 62 nt, Homo Sapiens
ccaacugugaaagcuggcuuuaauuuuuaggaggaaaagaaaagccugcauguguucuuuau

SEQ ID NO: 724651 - RNA, 62 nt, Homo Sapiens
uguccuucaaaagaguuugaaaugucauuuugggaaaagagagccagucaagcuaguaggcu

SEQ ID NO: 724652 - RNA, 62 nt, Homo Sapiens
gaaaugccagcuguuuaaucacaccuaccccuggaaaagagguaaaccuuuugaacaguuga

SEQ ID NO: 724653 - RNA, 62 nt, Homo Sapiens
auuugguuuguggacugggcaugguggcuuauggaaaagaggugagccuuugugaagaacau

SEQ ID NO: 724654 - RNA, 62 nt, Homo Sapiens
aagaacugguuuguuuaaagguuuaaauuguuggaaaagagcauuugccuucuuuaaugaau

SEQ ID NO: 724655 - RNA, 62 nt, Homo Sapiens
uucuugagugauaccuauuacggaugaguucuggaaaagacccagcuaugauucauaaaaac

SEQ ID NO: 724656 - RNA, 62 nt, Homo Sapiens
uucagaaaaacguggagugcuaggggcagccuggaaaagauggggaaccugcuagugaacua

SEQ ID NO: 724657 - RNA, 62 nt, Homo Sapiens
agaaacuuaguucuaccuuguacaugaagucaggaaaagaaaugaggugggucugaaauuca

SEQ ID NO: 724658 - RNA, 62 nt, Homo Sapiens
cacuaguucaguuuuauuccacaggaaauauaggaaaagaaauucagcuaaaauaguacuuc

SEQ ID NO: 724659 - RNA, 62 nt, Homo Sapiens
acaagaaaacucccugugggugcaaugagucuggaaaagaccauugagucuucuagaagaaa

SEQ ID NO: 724660 - RNA, 62 nt, Homo Sapiens
guucuguucaucaaaugaugcuguuaagauagggaaaagacaagaaacaggacuggaagaag

SEQ ID NO: 724661 - RNA, 62 nt, Homo Sapiens
auagaaauaauauucacuucgugaaaagugugggaaaagaaugaaagugucuaugauauaua

SEQ ID NO: 724662 - RNA, 62 nt, Homo Sapiens
gggggaaagucuaugaacgacaaauuuguucuggaaaagaaaccucuguuaauugugugucu

SEQ ID NO: 724663 - RNA, 62 nt, Homo Sapiens
uguguuugguaaccccuauaaacuggggcagaggaaaagaaugaugguucaaggccauacuu

SEQ ID NO: 724664 - RNA, 62 nt, Homo Sapiens
gaagguagauaacuuuuaggaccuugaugugaggaaaagauaaaauuuaaacaauaaauuug

SEQ ID NO: 724665 - RNA, 62 nt, Homo Sapiens
aaaguuaaaaauguauaguaacugauugagggggaaaagaaugaucuuuauuaaugacaagg

SEQ ID NO: 724666 - RNA, 62 nt, Homo Sapiens
ucucagucauccuggcagccaaaaaugugccaggaaaagaaagaauguggagcacgcguggc

SEQ ID NO: 724667 - RNA, 62 nt, Homo Sapiens
gaacacgguuacagcugguucuguagaaagagggaaaagaugauugugacaauucagagcau

SEQ ID NO: 724668 - RNA, 62 nt, Homo Sapiens
cacugugcaaagccccaguagucggauuccggggaaaagaacaaguaucuaguuuugaugac

SEQ ID NO: 724669 - RNA, 62 nt, Homo Sapiens
ugaaauauauggucuaauguuuaagcagaauuggaaaagacuaagaucgguuaacaaauaac

SEQ ID NO: 724670 - RNA, 62 nt, Homo Sapiens
uuacaaaugauugcuuuuaaaauuuuaagcuaggaaaagaaaucuauagaaaguguucuguu

SEQ ID NO: 724671 - RNA, 64 nt, Homo Sapiens; identical to SEQ ID NO: 488598

SEQ ID NO: 724672 - RNA, 64 nt, Homo Sapiens; identical to SEQ ID NO: 488599

SEQ ID NO: 724673 - RNA, 64 nt, Homo Sapiens; identical to SEQ ID NO: 488600

SEQ ID NO: 724674 - RNA, 64 nt, Homo Sapiens; identical to SEQ ID NO: 488601

SEQ ID NO: 724675 - RNA, 64 nt, Homo Sapiens; identical to SEQ ID NO: 488602

SEQ ID NO: 724676 - RNA, 64 nt, Homo Sapiens; identical to SEQ ID NO: 488603

SEQ ID NO: 724677 - RNA, 64 nt, Homo Sapiens; identical to SEQ ID NO: 488604

SEQ ID NO: 724678 - RNA, 64 nt, Homo Sapiens; identical to SEQ ID NO: 488605

SEQ ID NO: 724679 - RNA, 64 nt, Homo Sapiens; identical to SEQ ID NO: 488606

SEQ ID NO: 724680 - RNA, 64 nt, Homo Sapiens; identical to SEQ ID NO: 488607

SEQ ID NO: 724681 - RNA, 64 nt, Homo Sapiens; identical to SEQ ID NO: 488608

SEQ ID NO: 724682 - RNA, 64 nt, Homo Sapiens; identical to SEQ ID NO: 488609

SEQ ID NO: 724683 - RNA, 64 nt, Homo Sapiens; identical to SEQ ID NO: 488610

SEQ ID NO: 724684 - RNA, 64 nt, Homo Sapiens; identical to SEQ ID NO: 488611

SEQ ID NO: 724685 - RNA, 64 nt, Homo Sapiens; identical to SEQ ID NO: 488612

SEQ ID NO: 724686 - RNA, 64 nt, Homo Sapiens; identical to SEQ ID NO: 488613

SEQ ID NO: 724687 - RNA, 64 nt, Homo Sapiens; identical to SEQ ID NO: 488614

SEQ ID NO: 724688 - RNA, 64 nt, Homo Sapiens; identical to SEQ ID NO: 488615

SEQ ID NO: 724689 - RNA, 64 nt, Homo Sapiens; identical to SEQ ID NO: 488616

SEQ ID NO: 724690 - RNA, 64 nt, Homo Sapiens; identical to SEQ ID NO: 488617

SEQ ID NO: 724691 - RNA, 64 nt, Homo Sapiens; identical to SEQ ID NO: 488618

SEQ ID NO: 724692 - RNA, 64 nt, Homo Sapiens; identical to SEQ ID NO: 488619

SEQ ID NO: 724693 - RNA, 64 nt, Homo Sapiens; identical to SEQ ID NO: 488620

SEQ ID NO: 724694 - RNA, 64 nt, Homo Sapiens; identical to SEQ ID NO: 488621

SEQ ID NO: 724695 - RNA, 64 nt, Homo Sapiens; identical to SEQ ID NO: 488622

SEQ ID NO: 724696 - RNA, 64 nt, Homo Sapiens; identical to SEQ ID NO: 488623

SEQ ID NO: 724697 - RNA, 64 nt, Homo Sapiens; identical to SEQ ID NO: 488624

SEQ ID NO: 724698 - RNA, 64 nt, Homo Sapiens; identical to SEQ ID NO: 488625

SEQ ID NO: 724699 - RNA, 64 nt, Homo Sapiens; identical to SEQ ID NO: 488626

SEQ ID NO: 724700 - RNA, 64 nt, Homo Sapiens; identical to SEQ ID NO: 488627

SEQ ID NO: 724701 - RNA, 64 nt, Homo Sapiens; identical to SEQ ID NO: 488628

SEQ ID NO: 724702 - RNA, 64 nt, Homo Sapiens; identical to SEQ ID NO: 488629

SEQ ID NO: 724703 - RNA, 64 nt, Homo Sapiens; identical to SEQ ID NO: 488630

SEQ ID NO: 724704 - RNA, 64 nt, Homo Sapiens; identical to SEQ ID NO: 488631

SEQ ID NO: 724705 - RNA, 64 nt, Homo Sapiens; identical to SEQ ID NO: 488632

SEQ ID NO: 724706 - RNA, 64 nt, Homo Sapiens; identical to SEQ ID NO: 488633

SEQ ID NO: 724707 - RNA, 64 nt, Homo Sapiens; identical to SEQ ID NO: 488634

SEQ ID NO: 724708 - RNA, 64 nt, Homo Sapiens; identical to SEQ ID NO: 488635

SEQ ID NO: 724709 - RNA, 64 nt, Homo Sapiens; identical to SEQ ID NO: 488636

SEQ ID NO: 724710 - RNA, 64 nt, Homo Sapiens; identical to SEQ ID NO: 488637

SEQ ID NO: 724711 - RNA, 64 nt, Homo Sapiens; identical to SEQ ID NO: 488638

SEQ ID NO: 724712 - RNA, 64 nt, Homo Sapiens; identical to SEQ ID NO: 488639

SEQ ID NO: 724713 - RNA, 64 nt, Homo Sapiens; identical to SEQ ID NO: 488640

SEQ ID NO: 724714 - RNA, 64 nt, Homo Sapiens; identical to SEQ ID NO: 488641

SEQ ID NO: 724715 - RNA, 64 nt, Homo Sapiens; identical to SEQ ID NO: 488642

SEQ ID NO: 724716 - RNA, 64 nt, Homo Sapiens; identical to SEQ ID NO: 488643

SEQ ID NO: 724717 - RNA, 64 nt, Homo Sapiens; identical to SEQ ID NO: 488644

SEQ ID NO: 724718 - RNA, 64 nt, Homo Sapiens; identical to SEQ ID NO: 488645

SEQ ID NO: 724719 - RNA, 64 nt, Homo Sapiens; identical to SEQ ID NO: 488646

SEQ ID NO: 724720 - RNA, 64 nt, Homo Sapiens; identical to SEQ ID NO: 488647

SEQ ID NO: 724721 - RNA, 64 nt, Homo Sapiens; identical to SEQ ID NO: 488648

SEQ ID NO: 724722 - RNA, 64 nt, Homo Sapiens; identical to SEQ ID NO: 488649

SEQ ID NO: 724723 - RNA, 64 nt, Homo Sapiens; identical to SEQ ID NO: 488650

SEQ ID NO: 724724 - RNA, 64 nt, Homo Sapiens; identical to SEQ ID NO: 488651

SEQ ID NO: 724725 - RNA, 64 nt, Homo Sapiens; identical to SEQ ID NO: 488652

SEQ ID NO: 724726 - RNA, 64 nt, Homo Sapiens; identical to SEQ ID NO: 488653

SEQ ID NO: 724727 - RNA, 64 nt, Homo Sapiens; identical to SEQ ID NO: 488654

SEQ ID NO: 724728 - RNA, 64 nt, Homo Sapiens; identical to SEQ ID NO: 488655

SEQ ID NO: 724729 - RNA, 64 nt, Homo Sapiens; identical to SEQ ID NO: 488656

SEQ ID NO: 724730 - RNA, 64 nt, Homo Sapiens; identical to SEQ ID NO: 488657

SEQ ID NO: 724731 - RNA, 64 nt, Homo Sapiens; identical to SEQ ID NO: 488658

SEQ ID NO: 724732 - RNA, 64 nt, Homo Sapiens; identical to SEQ ID NO: 488659

SEQ ID NO: 724733 - RNA, 64 nt, Homo Sapiens; identical to SEQ ID NO: 488660

SEQ ID NO: 724734 - RNA, 64 nt, Homo Sapiens; identical to SEQ ID NO: 488661

SEQ ID NO: 724735 - RNA, 64 nt, Homo Sapiens; identical to SEQ ID NO: 488662

SEQ ID NO: 724736 - RNA, 64 nt, Homo Sapiens; identical to SEQ ID NO: 488663

SEQ ID NO: 724737 - RNA, 64 nt, Homo Sapiens; identical to SEQ ID NO: 488664

SEQ ID NO: 724738 - RNA, 64 nt, Homo Sapiens; identical to SEQ ID NO: 488665

SEQ ID NO: 724739 - RNA, 64 nt, Homo Sapiens; identical to SEQ ID NO: 488666

SEQ ID NO: 724740 - RNA, 64 nt, Homo Sapiens; identical to SEQ ID NO: 488667

SEQ ID NO: 724741 - RNA, 64 nt, Homo Sapiens; identical to SEQ ID NO: 488668

SEQ ID NO: 724742 - RNA, 64 nt, Homo Sapiens; identical to SEQ ID NO: 488669

SEQ ID NO: 724743 - RNA, 64 nt, Homo Sapiens; identical to SEQ ID NO: 488670

SEQ ID NO: 724744 - RNA, 64 nt, Homo Sapiens; identical to SEQ ID NO: 488671

SEQ ID NO: 724745 - RNA, 64 nt, Homo Sapiens; identical to SEQ ID NO: 488672

SEQ ID NO: 724746 - RNA, 64 nt, Homo Sapiens; identical to SEQ ID NO: 488673

SEQ ID NO: 724747 - RNA, 64 nt, Homo Sapiens; identical to SEQ ID NO: 488674

SEQ ID NO: 724748 - RNA, 64 nt, Homo Sapiens; identical to SEQ ID NO: 488675

SEQ ID NO: 724749 - RNA, 64 nt, Homo Sapiens; identical to SEQ ID NO: 488676

SEQ ID NO: 724750 - RNA, 64 nt, Homo Sapiens; identical to SEQ ID NO: 488677

SEQ ID NO: 724751 - RNA, 64 nt, Homo Sapiens; identical to SEQ ID NO: 488678

SEQ ID NO: 724752 - RNA, 64 nt, Homo Sapiens; identical to SEQ ID NO: 488679

SEQ ID NO: 724753 - RNA, 64 nt, Homo Sapiens; identical to SEQ ID NO: 488680

SEQ ID NO: 724754 - RNA, 64 nt, Homo Sapiens; identical to SEQ ID NO: 488681

SEQ ID NO: 724755 - RNA, 64 nt, Homo Sapiens; identical to SEQ ID NO: 488682

SEQ ID NO: 724756 - RNA, 64 nt, Homo Sapiens; identical to SEQ ID NO: 488683

SEQ ID NO: 724757 - RNA, 64 nt, Homo Sapiens; identical to SEQ ID NO: 488684

SEQ ID NO: 724758 - RNA, 64 nt, Homo Sapiens; identical to SEQ ID NO: 488685

SEQ ID NO: 724759 - RNA, 64 nt, Homo Sapiens; identical to SEQ ID NO: 488686

SEQ ID NO: 724760 - RNA, 64 nt, Homo Sapiens; identical to SEQ ID NO: 488687

SEQ ID NO: 724761 - RNA, 64 nt, Homo Sapiens; identical to SEQ ID NO: 488688

SEQ ID NO: 724762 - RNA, 64 nt, Homo Sapiens; identical to SEQ ID NO: 488689

SEQ ID NO: 724763 - RNA, 64 nt, Homo Sapiens; identical to SEQ ID NO: 488690

SEQ ID NO: 724764 - RNA, 64 nt, Homo Sapiens; identical to SEQ ID NO: 488691

SEQ ID NO: 724765 - RNA, 64 nt, Homo Sapiens; identical to SEQ ID NO: 488692

SEQ ID NO: 724766 - RNA, 64 nt, Homo Sapiens; identical to SEQ ID NO: 488693

SEQ ID NO: 724767 - RNA, 64 nt, Homo Sapiens; identical to SEQ ID NO: 488694

SEQ ID NO: 724768 - RNA, 64 nt, Homo Sapiens; identical to SEQ ID NO: 488695

SEQ ID NO: 724769 - RNA, 64 nt, Homo Sapiens; identical to SEQ ID NO: 488696

SEQ ID NO: 724770 - RNA, 64 nt, Homo Sapiens; identical to SEQ ID NO: 488697

SEQ ID NO: 724771 - RNA, 64 nt, Homo Sapiens; identical to SEQ ID NO: 488698

SEQ ID NO: 724772 - RNA, 64 nt, Homo Sapiens; identical to SEQ ID NO: 488699

SEQ ID NO: 724773 - RNA, 64 nt, Homo Sapiens; identical to SEQ ID NO: 488700

SEQ ID NO: 724774 - RNA, 64 nt, Homo Sapiens; identical to SEQ ID NO: 488701

SEQ ID NO: 724775 - RNA, 64 nt, Homo Sapiens; identical to SEQ ID NO: 488702

SEQ ID NO: 724776 - RNA, 64 nt, Homo Sapiens; identical to SEQ ID NO: 488703

SEQ ID NO: 724777 - RNA, 64 nt, Homo Sapiens; identical to SEQ ID NO: 488704

SEQ ID NO: 724778 - RNA, 64 nt, Homo Sapiens; identical to SEQ ID NO: 488705

SEQ ID NO: 724779 - RNA, 64 nt, Homo Sapiens; identical to SEQ ID NO: 488706

SEQ ID NO: 724780 - RNA, 64 nt, Homo Sapiens; identical to SEQ ID NO: 488707

SEQ ID NO: 724781 - RNA, 64 nt, Homo Sapiens; identical to SEQ ID NO: 488708

SEQ ID NO: 724782 - RNA, 64 nt, Homo Sapiens; identical to SEQ ID NO: 488709

SEQ ID NO: 724783 - RNA, 64 nt, Homo Sapiens; identical to SEQ ID NO: 488710

SEQ ID NO: 724784 - RNA, 64 nt, Homo Sapiens; identical to SEQ ID NO: 488711

SEQ ID NO: 724785 - RNA, 64 nt, Homo Sapiens; identical to SEQ ID NO: 488712

SEQ ID NO: 724786 - RNA, 64 nt, Homo Sapiens; identical to SEQ ID NO: 488713

SEQ ID NO: 724787 - RNA, 64 nt, Homo Sapiens; identical to SEQ ID NO: 488714

SEQ ID NO: 724788 - RNA, 64 nt, Homo Sapiens; identical to SEQ ID NO: 488715

SEQ ID NO: 724789 - RNA, 64 nt, Homo Sapiens; identical to SEQ ID NO: 488716

SEQ ID NO: 724790 - RNA, 64 nt, Homo Sapiens; identical to SEQ ID NO: 488717

SEQ ID NO: 724791 - RNA, 64 nt, Homo Sapiens; identical to SEQ ID NO: 488718

SEQ ID NO: 724792 - RNA, 64 nt, Homo Sapiens; identical to SEQ ID NO: 488719

SEQ ID NO: 724793 - RNA, 64 nt, Homo Sapiens; identical to SEQ ID NO: 488720

SEQ ID NO: 724794 - RNA, 64 nt, Homo Sapiens; identical to SEQ ID NO: 488721

SEQ ID NO: 724795 - RNA, 64 nt, Homo Sapiens; identical to SEQ ID NO: 488722

SEQ ID NO: 724796 - RNA, 64 nt, Homo Sapiens; identical to SEQ ID NO: 488723

SEQ ID NO: 724797 - RNA, 64 nt, Homo Sapiens; identical to SEQ ID NO: 488724

SEQ ID NO: 724798 - RNA, 64 nt, Homo Sapiens; identical to SEQ ID NO: 488725

SEQ ID NO: 724799 - RNA, 64 nt, Homo Sapiens; identical to SEQ ID NO: 488726

SEQ ID NO: 724800 - RNA, 64 nt, Homo Sapiens; identical to SEQ ID NO: 488727

SEQ ID NO: 724801 - RNA, 64 nt, Homo Sapiens; identical to SEQ ID NO: 488728

SEQ ID NO: 724802 - RNA, 64 nt, Homo Sapiens; identical to SEQ ID NO: 488729

SEQ ID NO: 724803 - RNA, 64 nt, Homo Sapiens; identical to SEQ ID NO: 488730

SEQ ID NO: 724804 - RNA, 64 nt, Homo Sapiens; identical to SEQ ID NO: 488731

SEQ ID NO: 724805 - RNA, 64 nt, Homo Sapiens; identical to SEQ ID NO: 488732

SEQ ID NO: 724806 - RNA, 64 nt, Homo Sapiens; identical to SEQ ID NO: 488733

SEQ ID NO: 724807 - RNA, 64 nt, Homo Sapiens; identical to SEQ ID NO: 488734

SEQ ID NO: 724808 - RNA, 64 nt, Homo Sapiens; identical to SEQ ID NO: 488735

SEQ ID NO: 724809 - RNA, 64 nt, Homo Sapiens; identical to SEQ ID NO: 488736

SEQ ID NO: 724810 - RNA, 64 nt, Homo Sapiens; identical to SEQ ID NO: 488737

SEQ ID NO: 724811 - RNA, 64 nt, Homo Sapiens; identical to SEQ ID NO: 488738

SEQ ID NO: 724812 - RNA, 64 nt, Homo Sapiens; identical to SEQ ID NO: 488739

SEQ ID NO: 724813 - RNA, 64 nt, Homo Sapiens; identical to SEQ ID NO: 488740

SEQ ID NO: 724814 - RNA, 64 nt, Homo Sapiens; identical to SEQ ID NO: 488741

SEQ ID NO: 724815 - RNA, 64 nt, Homo Sapiens; identical to SEQ ID NO: 488742

SEQ ID NO: 724816 - RNA, 64 nt, Homo Sapiens; identical to SEQ ID NO: 488743

SEQ ID NO: 724817 - RNA, 64 nt, Homo Sapiens; identical to SEQ ID NO: 488744

SEQ ID NO: 724818 - RNA, 64 nt, Homo Sapiens; identical to SEQ ID NO: 488745

SEQ ID NO: 724819 - RNA, 64 nt, Homo Sapiens; identical to SEQ ID NO: 488746

SEQ ID NO: 724820 - RNA, 64 nt, Homo Sapiens; identical to SEQ ID NO: 488747

SEQ ID NO: 724821 - RNA, 64 nt, Homo Sapiens; identical to SEQ ID NO: 488748

SEQ ID NO: 724822 - RNA, 64 nt, Homo Sapiens; identical to SEQ ID NO: 488749

SEQ ID NO: 724823 - RNA, 64 nt, Homo Sapiens; identical to SEQ ID NO: 488750

SEQ ID NO: 724824 - RNA, 64 nt, Homo Sapiens; identical to SEQ ID NO: 488751

SEQ ID NO: 724825 - RNA, 64 nt, Homo Sapiens; identical to SEQ ID NO: 488752

SEQ ID NO: 724826 - RNA, 64 nt, Homo Sapiens; identical to SEQ ID NO: 488753

SEQ ID NO: 724827 - RNA, 64 nt, Homo Sapiens; identical to SEQ ID NO: 488754

SEQ ID NO: 724828 - RNA, 64 nt, Homo Sapiens; identical to SEQ ID NO: 488755

SEQ ID NO: 724829 - RNA, 64 nt, Homo Sapiens; identical to SEQ ID NO: 488756

SEQ ID NO: 724830 - RNA, 64 nt, Homo Sapiens; identical to SEQ ID NO: 488757

SEQ ID NO: 724831 - RNA, 64 nt, Homo Sapiens; identical to SEQ ID NO: 488758

SEQ ID NO: 724832 - RNA, 64 nt, Homo Sapiens; identical to SEQ ID NO: 488759

SEQ ID NO: 724833 - RNA, 64 nt, Homo Sapiens; identical to SEQ ID NO: 488760

SEQ ID NO: 724834 - RNA, 64 nt, Homo Sapiens; identical to SEQ ID NO: 488761

SEQ ID NO: 724835 - RNA, 64 nt, Homo Sapiens; identical to SEQ ID NO: 488762

SEQ ID NO: 724836 - RNA, 64 nt, Homo Sapiens; identical to SEQ ID NO: 488763

SEQ ID NO: 724837 - RNA, 64 nt, Homo Sapiens; identical to SEQ ID NO: 488764

SEQ ID NO: 724838 - RNA, 64 nt, Homo Sapiens; identical to SEQ ID NO: 488765

SEQ ID NO: 724839 - RNA, 64 nt, Homo Sapiens; identical to SEQ ID NO: 488766

SEQ ID NO: 724840 - RNA, 64 nt, Homo Sapiens; identical to SEQ ID NO: 488767

SEQ ID NO: 724841 - RNA, 64 nt, Homo Sapiens; identical to SEQ ID NO: 488768

SEQ ID NO: 724842 - RNA, 64 nt, Homo Sapiens; identical to SEQ ID NO: 488769

SEQ ID NO: 724843 - RNA, 64 nt, Homo Sapiens; identical to SEQ ID NO: 488770

SEQ ID NO: 724844 - RNA, 64 nt, Homo Sapiens; identical to SEQ ID NO: 488771

SEQ ID NO: 724845 - RNA, 64 nt, Homo Sapiens; identical to SEQ ID NO: 488772

SEQ ID NO: 724846 - RNA, 64 nt, Homo Sapiens; identical to SEQ ID NO: 488773

SEQ ID NO: 724847 - RNA, 64 nt, Homo Sapiens; identical to SEQ ID NO: 488774

SEQ ID NO: 724848 - RNA, 64 nt, Homo Sapiens; identical to SEQ ID NO: 488775

SEQ ID NO: 724849 - RNA, 64 nt, Homo Sapiens; identical to SEQ ID NO: 488776

SEQ ID NO: 724850 - RNA, 64 nt, Homo Sapiens; identical to SEQ ID NO: 488777

SEQ ID NO: 724851 - RNA, 64 nt, Homo Sapiens; identical to SEQ ID NO: 488778

SEQ ID NO: 724852 - RNA, 64 nt, Homo Sapiens; identical to SEQ ID NO: 488779

SEQ ID NO: 724853 - RNA, 64 nt, Homo Sapiens; identical to SEQ ID NO: 488780

SEQ ID NO: 724854 - RNA, 64 nt, Homo Sapiens; identical to SEQ ID NO: 488781

SEQ ID NO: 724855 - RNA, 64 nt, Homo Sapiens; identical to SEQ ID NO: 488782

SEQ ID NO: 724856 - RNA, 64 nt, Homo Sapiens; identical to SEQ ID NO: 488783

SEQ ID NO: 724857 - RNA, 64 nt, Homo Sapiens; identical to SEQ ID NO: 488784

SEQ ID NO: 724858 - RNA, 64 nt, Homo Sapiens; identical to SEQ ID NO: 488785

SEQ ID NO: 724859 - RNA, 64 nt, Homo Sapiens; identical to SEQ ID NO: 488786

SEQ ID NO: 724860 - RNA, 64 nt, Homo Sapiens; identical to SEQ ID NO: 488787

SEQ ID NO: 724861 - RNA, 64 nt, Homo Sapiens; identical to SEQ ID NO: 488788

SEQ ID NO: 724862 - RNA, 64 nt, Homo Sapiens; identical to SEQ ID NO: 488789

SEQ ID NO: 724863 - RNA, 64 nt, Homo Sapiens; identical to SEQ ID NO: 488790

SEQ ID NO: 724864 - RNA, 64 nt, Homo Sapiens; identical to SEQ ID NO: 488791

SEQ ID NO: 724865 - RNA, 64 nt, Homo Sapiens; identical to SEQ ID NO: 488792

SEQ ID NO: 724866 - RNA, 64 nt, Homo Sapiens; identical to SEQ ID NO: 488793

SEQ ID NO: 724867 - RNA, 64 nt, Homo Sapiens; identical to SEQ ID NO: 488794

SEQ ID NO: 724868 - RNA, 64 nt, Homo Sapiens; identical to SEQ ID NO: 488795

SEQ ID NO: 724869 - RNA, 64 nt, Homo Sapiens; identical to SEQ ID NO: 488796

SEQ ID NO: 724870 - RNA, 64 nt, Homo Sapiens; identical to SEQ ID NO: 488797

SEQ ID NO: 724871 - RNA, 64 nt, Homo Sapiens; identical to SEQ ID NO: 488798

SEQ ID NO: 724872 - RNA, 64 nt, Homo Sapiens; identical to SEQ ID NO: 488799

SEQ ID NO: 724873 - RNA, 64 nt, Homo Sapiens; identical to SEQ ID NO: 488800

SEQ ID NO: 724874 - RNA, 64 nt, Homo Sapiens; identical to SEQ ID NO: 488801

SEQ ID NO: 724875 - RNA, 64 nt, Homo Sapiens; identical to SEQ ID NO: 488802

SEQ ID NO: 724876 - RNA, 64 nt, Homo Sapiens; identical to SEQ ID NO: 488803

SEQ ID NO: 724877 - RNA, 64 nt, Homo Sapiens; identical to SEQ ID NO: 488804

SEQ ID NO: 724878 - RNA, 64 nt, Homo Sapiens; identical to SEQ ID NO: 488805

SEQ ID NO: 724879 - RNA, 64 nt, Homo Sapiens; identical to SEQ ID NO: 488806

SEQ ID NO: 724880 - RNA, 64 nt, Homo Sapiens; identical to SEQ ID NO: 488807

SEQ ID NO: 724881 - RNA, 64 nt, Homo Sapiens; identical to SEQ ID NO: 488808

SEQ ID NO: 724882 - RNA, 64 nt, Homo Sapiens; identical to SEQ ID NO: 488809

SEQ ID NO: 724883 - RNA, 64 nt, Homo Sapiens; identical to SEQ ID NO: 488810

SEQ ID NO: 724884 - RNA, 64 nt, Homo Sapiens; identical to SEQ ID NO: 488811

SEQ ID NO: 724885 - RNA, 64 nt, Homo Sapiens; identical to SEQ ID NO: 488812

SEQ ID NO: 724886 - RNA, 64 nt, Homo Sapiens; identical to SEQ ID NO: 488813

SEQ ID NO: 724887 - RNA, 64 nt, Homo Sapiens; identical to SEQ ID NO: 488814

SEQ ID NO: 724888 - RNA, 64 nt, Homo Sapiens; identical to SEQ ID NO: 488815

SEQ ID NO: 724889 - RNA, 64 nt, Homo Sapiens; identical to SEQ ID NO: 488816

SEQ ID NO: 724890 - RNA, 64 nt, Homo Sapiens; identical to SEQ ID NO: 488817

SEQ ID NO: 724891 - RNA, 64 nt, Homo Sapiens; identical to SEQ ID NO: 488818

SEQ ID NO: 724892 - RNA, 64 nt, Homo Sapiens; identical to SEQ ID NO: 488819

SEQ ID NO: 724893 - RNA, 64 nt, Homo Sapiens; identical to SEQ ID NO: 488820

SEQ ID NO: 724894 - RNA, 64 nt, Homo Sapiens; identical to SEQ ID NO: 488821

SEQ ID NO: 724895 - RNA, 64 nt, Homo Sapiens; identical to SEQ ID NO: 488822

SEQ ID NO: 724896 - RNA, 64 nt, Homo Sapiens; identical to SEQ ID NO: 488823

SEQ ID NO: 724897 - RNA, 64 nt, Homo Sapiens; identical to SEQ ID NO: 488824

SEQ ID NO: 724898 - RNA, 64 nt, Homo Sapiens; identical to SEQ ID NO: 488825

SEQ ID NO: 724899 - RNA, 64 nt, Homo Sapiens; identical to SEQ ID NO: 488826

SEQ ID NO: 724900 - RNA, 64 nt, Homo Sapiens; identical to SEQ ID NO: 488827

SEQ ID NO: 724901 - RNA, 64 nt, Homo Sapiens; identical to SEQ ID NO: 488828

SEQ ID NO: 724902 - RNA, 64 nt, Homo Sapiens; identical to SEQ ID NO: 488829

SEQ ID NO: 724903 - RNA, 64 nt, Homo Sapiens; identical to SEQ ID NO: 488830

SEQ ID NO: 724904 - RNA, 64 nt, Homo Sapiens; identical to SEQ ID NO: 488831

SEQ ID NO: 724905 - RNA, 64 nt, Homo Sapiens; identical to SEQ ID NO: 488832

SEQ ID NO: 724906 - RNA, 64 nt, Homo Sapiens; identical to SEQ ID NO: 488833

SEQ ID NO: 724907 - RNA, 64 nt, Homo Sapiens; identical to SEQ ID NO: 488834

SEQ ID NO: 724908 - RNA, 64 nt, Homo Sapiens; identical to SEQ ID NO: 488835

SEQ ID NO: 724909 - RNA, 64 nt, Homo Sapiens; identical to SEQ ID NO: 488836

SEQ ID NO: 724910 - RNA, 64 nt, Homo Sapiens; identical to SEQ ID NO: 488837

SEQ ID NO: 724911 - RNA, 64 nt, Homo Sapiens; identical to SEQ ID NO: 488838

SEQ ID NO: 724912 - RNA, 64 nt, Homo Sapiens; identical to SEQ ID NO: 488839

SEQ ID NO: 724913 - RNA, 64 nt, Homo Sapiens; identical to SEQ ID NO: 488840

SEQ ID NO: 724914 - RNA, 64 nt, Homo Sapiens; identical to SEQ ID NO: 488841

SEQ ID NO: 724915 - RNA, 64 nt, Homo Sapiens; identical to SEQ ID NO: 488842

SEQ ID NO: 724916 - RNA, 64 nt, Homo Sapiens; identical to SEQ ID NO: 488843

SEQ ID NO: 724917 - RNA, 64 nt, Homo Sapiens; identical to SEQ ID NO: 488844

SEQ ID NO: 724918 - RNA, 64 nt, Homo Sapiens; identical to SEQ ID NO: 488845

SEQ ID NO: 724919 - RNA, 64 nt, Homo Sapiens; identical to SEQ ID NO: 488846

SEQ ID NO: 724920 - RNA, 64 nt, Homo Sapiens; identical to SEQ ID NO: 488847

SEQ ID NO: 724921 - RNA, 64 nt, Homo Sapiens; identical to SEQ ID NO: 488848

SEQ ID NO: 724922 - RNA, 64 nt, Homo Sapiens; identical to SEQ ID NO: 488849

SEQ ID NO: 724923 - RNA, 64 nt, Homo Sapiens; identical to SEQ ID NO: 488850

SEQ ID NO: 724924 - RNA, 64 nt, Homo Sapiens; identical to SEQ ID NO: 488851

SEQ ID NO: 724925 - RNA, 64 nt, Homo Sapiens; identical to SEQ ID NO: 488852

SEQ ID NO: 724926 - RNA, 64 nt, Homo Sapiens; identical to SEQ ID NO: 488853

SEQ ID NO: 724927 - RNA, 64 nt, Homo Sapiens; identical to SEQ ID NO: 488854

SEQ ID NO: 724928 - RNA, 64 nt, Homo Sapiens; identical to SEQ ID NO: 488855

SEQ ID NO: 724929 - RNA, 64 nt, Homo Sapiens; identical to SEQ ID NO: 488856

SEQ ID NO: 724930 - RNA, 64 nt, Homo Sapiens; identical to SEQ ID NO: 488857

SEQ ID NO: 724931 - RNA, 64 nt, Homo Sapiens; identical to SEQ ID NO: 488858

SEQ ID NO: 724932 - RNA, 64 nt, Homo Sapiens; identical to SEQ ID NO: 488859

SEQ ID NO: 724933 - RNA, 64 nt, Homo Sapiens; identical to SEQ ID NO: 488860

SEQ ID NO: 724934 - RNA, 64 nt, Homo Sapiens; identical to SEQ ID NO: 488861

SEQ ID NO: 724935 - RNA, 64 nt, Homo Sapiens; identical to SEQ ID NO: 488862

SEQ ID NO: 724936 - RNA, 64 nt, Homo Sapiens; identical to SEQ ID NO: 488863

SEQ ID NO: 724937 - RNA, 64 nt, Homo Sapiens; identical to SEQ ID NO: 488864

SEQ ID NO: 724938 - RNA, 64 nt, Homo Sapiens; identical to SEQ ID NO: 488865

SEQ ID NO: 724939 - RNA, 64 nt, Homo Sapiens; identical to SEQ ID NO: 488866

SEQ ID NO: 724940 - RNA, 64 nt, Homo Sapiens; identical to SEQ ID NO: 488867

SEQ ID NO: 724941 - RNA, 64 nt, Homo Sapiens; identical to SEQ ID NO: 488868

SEQ ID NO: 724942 - RNA, 64 nt, Homo Sapiens; identical to SEQ ID NO: 488869

SEQ ID NO: 724943 - RNA, 64 nt, Homo Sapiens; identical to SEQ ID NO: 488870

SEQ ID NO: 724944 - RNA, 64 nt, Homo Sapiens; identical to SEQ ID NO: 488871

SEQ ID NO: 724945 - RNA, 64 nt, Homo Sapiens; identical to SEQ ID NO: 488872

SEQ ID NO: 724946 - RNA, 64 nt, Homo Sapiens; identical to SEQ ID NO: 488873

SEQ ID NO: 724947 - RNA, 64 nt, Homo Sapiens; identical to SEQ ID NO: 488874

SEQ ID NO: 724948 - RNA, 64 nt, Homo Sapiens; identical to SEQ ID NO: 488875

SEQ ID NO: 724949 - RNA, 64 nt, Homo Sapiens; identical to SEQ ID NO: 488876

SEQ ID NO: 724950 - RNA, 64 nt, Homo Sapiens; identical to SEQ ID NO: 488877

SEQ ID NO: 724951 - RNA, 64 nt, Homo Sapiens; identical to SEQ ID NO: 488878

SEQ ID NO: 724952 - RNA, 64 nt, Homo Sapiens; identical to SEQ ID NO: 488879

SEQ ID NO: 724953 - RNA, 64 nt, Homo Sapiens; identical to SEQ ID NO: 488880

SEQ ID NO: 724954 - RNA, 64 nt, Homo Sapiens; identical to SEQ ID NO: 488881

SEQ ID NO: 724955 - RNA, 64 nt, Homo Sapiens; identical to SEQ ID NO: 488882

SEQ ID NO: 724956 - RNA, 64 nt, Homo Sapiens; identical to SEQ ID NO: 488883

SEQ ID NO: 724957 - RNA, 64 nt, Homo Sapiens; identical to SEQ ID NO: 488884

SEQ ID NO: 724958 - RNA, 64 nt, Homo Sapiens; identical to SEQ ID NO: 488885

SEQ ID NO: 724959 - RNA, 64 nt, Homo Sapiens; identical to SEQ ID NO: 488886

SEQ ID NO: 724960 - RNA, 64 nt, Homo Sapiens; identical to SEQ ID NO: 488887

SEQ ID NO: 724961 - RNA, 64 nt, Homo Sapiens; identical to SEQ ID NO: 488888

SEQ ID NO: 724962 - RNA, 64 nt, Homo Sapiens; identical to SEQ ID NO: 488889

SEQ ID NO: 724963 - RNA, 64 nt, Homo Sapiens; identical to SEQ ID NO: 488890

SEQ ID NO: 724964 - RNA, 64 nt, Homo Sapiens; identical to SEQ ID NO: 488891

SEQ ID NO: 724965 - RNA, 64 nt, Homo Sapiens; identical to SEQ ID NO: 488892

SEQ ID NO: 724966 - RNA, 64 nt, Homo Sapiens; identical to SEQ ID NO: 488893

SEQ ID NO: 724967 - RNA, 64 nt, Homo Sapiens; identical to SEQ ID NO: 488894

SEQ ID NO: 724968 - RNA, 64 nt, Homo Sapiens; identical to SEQ ID NO: 488895

SEQ ID NO: 724969 - RNA, 64 nt, Homo Sapiens; identical to SEQ ID NO: 488896

SEQ ID NO: 724970 - RNA, 64 nt, Homo Sapiens; identical to SEQ ID NO: 488897

SEQ ID NO: 724971 - RNA, 64 nt, Homo Sapiens; identical to SEQ ID NO: 488898

SEQ ID NO: 724972 - RNA, 64 nt, Homo Sapiens; identical to SEQ ID NO: 488899

SEQ ID NO: 724973 - RNA, 64 nt, Homo Sapiens; identical to SEQ ID NO: 488900

SEQ ID NO: 724974 - RNA, 64 nt, Homo Sapiens; identical to SEQ ID NO: 488901

SEQ ID NO: 724975 - RNA, 64 nt, Homo Sapiens; identical to SEQ ID NO: 488902

SEQ ID NO: 724976 - RNA, 64 nt, Homo Sapiens; identical to SEQ ID NO: 488903

SEQ ID NO: 724977 - RNA, 64 nt, Homo Sapiens; identical to SEQ ID NO: 488904

SEQ ID NO: 724978 - RNA, 64 nt, Homo Sapiens; identical to SEQ ID NO: 488905

SEQ ID NO: 724979 - RNA, 64 nt, Homo Sapiens; identical to SEQ ID NO: 488906

SEQ ID NO: 724980 - RNA, 64 nt, Homo Sapiens; identical to SEQ ID NO: 488907

SEQ ID NO: 724981 - RNA, 64 nt, Homo Sapiens; identical to SEQ ID NO: 488908

SEQ ID NO: 724982 - RNA, 64 nt, Homo Sapiens; identical to SEQ ID NO: 488909

SEQ ID NO: 724983 - RNA, 64 nt, Homo Sapiens; identical to SEQ ID NO: 488910

SEQ ID NO: 724984 - RNA, 64 nt, Homo Sapiens; identical to SEQ ID NO: 488911

SEQ ID NO: 724985 - RNA, 64 nt, Homo Sapiens; identical to SEQ ID NO: 488912

SEQ ID NO: 724986 - RNA, 64 nt, Homo Sapiens; identical to SEQ ID NO: 488913

SEQ ID NO: 724987 - RNA, 64 nt, Homo Sapiens; identical to SEQ ID NO: 488914

SEQ ID NO: 724988 - RNA, 64 nt, Homo Sapiens; identical to SEQ ID NO: 488915

SEQ ID NO: 724989 - RNA, 64 nt, Homo Sapiens; identical to SEQ ID NO: 488916

SEQ ID NO: 724990 - RNA, 64 nt, Homo Sapiens; identical to SEQ ID NO: 488917

SEQ ID NO: 724991 - RNA, 64 nt, Homo Sapiens; identical to SEQ ID NO: 488918

SEQ ID NO: 724992 - RNA, 64 nt, Homo Sapiens; identical to SEQ ID NO: 488919

SEQ ID NO: 724993 - RNA, 64 nt, Homo Sapiens; identical to SEQ ID NO: 488920

SEQ ID NO: 724994 - RNA, 64 nt, Homo Sapiens; identical to SEQ ID NO: 488921

SEQ ID NO: 724995 - RNA, 64 nt, Homo Sapiens; identical to SEQ ID NO: 488922

SEQ ID NO: 724996 - RNA, 64 nt, Homo Sapiens; identical to SEQ ID NO: 488923

SEQ ID NO: 724997 - RNA, 64 nt, Homo Sapiens; identical to SEQ ID NO: 488924

SEQ ID NO: 724998 - RNA, 64 nt, Homo Sapiens; identical to SEQ ID NO: 488925

SEQ ID NO: 724999 - RNA, 64 nt, Homo Sapiens; identical to SEQ ID NO: 488926

SEQ ID NO: 725000 - RNA, 64 nt, Homo Sapiens; identical to SEQ ID NO: 488927

SEQ ID NO: 725001 - RNA, 64 nt, Homo Sapiens; identical to SEQ ID NO: 488928

SEQ ID NO: 725002 - RNA, 64 nt, Homo Sapiens; identical to SEQ ID NO: 488929

SEQ ID NO: 725003 - RNA, 64 nt, Homo Sapiens; identical to SEQ ID NO: 488930

SEQ ID NO: 725004 - RNA, 64 nt, Homo Sapiens; identical to SEQ ID NO: 488931

SEQ ID NO: 725005 - RNA, 64 nt, Homo Sapiens; identical to SEQ ID NO: 488932

SEQ ID NO: 725006 - RNA, 64 nt, Homo Sapiens; identical to SEQ ID NO: 488933

SEQ ID NO: 725007 - RNA, 64 nt, Homo Sapiens; identical to SEQ ID NO: 488934

SEQ ID NO: 725008 - RNA, 64 nt, Homo Sapiens; identical to SEQ ID NO: 488935

SEQ ID NO: 725009 - RNA, 64 nt, Homo Sapiens; identical to SEQ ID NO: 488936

SEQ ID NO: 725010 - RNA, 64 nt, Homo Sapiens; identical to SEQ ID NO: 488937

SEQ ID NO: 725011 - RNA, 64 nt, Homo Sapiens; identical to SEQ ID NO: 488938

SEQ ID NO: 725012 - RNA, 64 nt, Homo Sapiens; identical to SEQ ID NO: 488939

SEQ ID NO: 725013 - RNA, 64 nt, Homo Sapiens; identical to SEQ ID NO: 488940

SEQ ID NO: 725014 - RNA, 64 nt, Homo Sapiens; identical to SEQ ID NO: 488941

SEQ ID NO: 725015 - RNA, 64 nt, Homo Sapiens; identical to SEQ ID NO: 488942

SEQ ID NO: 725016 - RNA, 64 nt, Homo Sapiens; identical to SEQ ID NO: 488943

SEQ ID NO: 725017 - RNA, 64 nt, Homo Sapiens; identical to SEQ ID NO: 488944

SEQ ID NO: 725018 - RNA, 64 nt, Homo Sapiens; identical to SEQ ID NO: 488945

SEQ ID NO: 725019 - RNA, 64 nt, Homo Sapiens; identical to SEQ ID NO: 488946

SEQ ID NO: 725020 - RNA, 64 nt, Homo Sapiens; identical to SEQ ID NO: 488947

SEQ ID NO: 725021 - RNA, 64 nt, Homo Sapiens; identical to SEQ ID NO: 488948

SEQ ID NO: 725022 - RNA, 64 nt, Homo Sapiens; identical to SEQ ID NO: 488949

SEQ ID NO: 725023 - RNA, 64 nt, Homo Sapiens; identical to SEQ ID NO: 488950

SEQ ID NO: 725024 - RNA, 64 nt, Homo Sapiens; identical to SEQ ID NO: 488951

SEQ ID NO: 725025 - RNA, 64 nt, Homo Sapiens; identical to SEQ ID NO: 488952

SEQ ID NO: 725026 - RNA, 64 nt, Homo Sapiens; identical to SEQ ID NO: 488953

SEQ ID NO: 725027 - RNA, 64 nt, Homo Sapiens; identical to SEQ ID NO: 488954

SEQ ID NO: 725028 - RNA, 64 nt, Homo Sapiens; identical to SEQ ID NO: 488955

SEQ ID NO: 725029 - RNA, 64 nt, Homo Sapiens; identical to SEQ ID NO: 488956

SEQ ID NO: 725030 - RNA, 64 nt, Homo Sapiens; identical to SEQ ID NO: 488957

SEQ ID NO: 725031 - RNA, 64 nt, Homo Sapiens; identical to SEQ ID NO: 488958

SEQ ID NO: 725032 - RNA, 64 nt, Homo Sapiens; identical to SEQ ID NO: 488959

SEQ ID NO: 725033 - RNA, 64 nt, Homo Sapiens; identical to SEQ ID NO: 488960

SEQ ID NO: 725034 - RNA, 64 nt, Homo Sapiens; identical to SEQ ID NO: 488961

SEQ ID NO: 725035 - RNA, 64 nt, Homo Sapiens; identical to SEQ ID NO: 488962

SEQ ID NO: 725036 - RNA, 64 nt, Homo Sapiens; identical to SEQ ID NO: 488963

SEQ ID NO: 725037 - RNA, 64 nt, Homo Sapiens; identical to SEQ ID NO: 488964

SEQ ID NO: 725038 - RNA, 64 nt, Homo Sapiens; identical to SEQ ID NO: 488965

SEQ ID NO: 725039 - RNA, 64 nt, Homo Sapiens; identical to SEQ ID NO: 488966

SEQ ID NO: 725040 - RNA, 64 nt, Homo Sapiens; identical to SEQ ID NO: 488967

SEQ ID NO: 725041 - RNA, 64 nt, Homo Sapiens; identical to SEQ ID NO: 488968

SEQ ID NO: 725042 - RNA, 64 nt, Homo Sapiens; identical to SEQ ID NO: 488969

SEQ ID NO: 725043 - RNA, 64 nt, Homo Sapiens; identical to SEQ ID NO: 488970

SEQ ID NO: 725044 - RNA, 64 nt, Homo Sapiens; identical to SEQ ID NO: 488971

SEQ ID NO: 725045 - RNA, 64 nt, Homo Sapiens; identical to SEQ ID NO: 488972

SEQ ID NO: 725046 - RNA, 64 nt, Homo Sapiens; identical to SEQ ID NO: 488973

SEQ ID NO: 725047 - RNA, 64 nt, Homo Sapiens; identical to SEQ ID NO: 488974

SEQ ID NO: 725048 - RNA, 64 nt, Homo Sapiens; identical to SEQ ID NO: 488975

SEQ ID NO: 725049 - RNA, 64 nt, Homo Sapiens; identical to SEQ ID NO: 488976

SEQ ID NO: 725050 - RNA, 64 nt, Homo Sapiens; identical to SEQ ID NO: 488977

SEQ ID NO: 725051 - RNA, 64 nt, Homo Sapiens; identical to SEQ ID NO: 488978

SEQ ID NO: 725052 - RNA, 64 nt, Homo Sapiens; identical to SEQ ID NO: 488979

SEQ ID NO: 725053 - RNA, 64 nt, Homo Sapiens; identical to SEQ ID NO: 488980

SEQ ID NO: 725054 - RNA, 64 nt, Homo Sapiens; identical to SEQ ID NO: 488981

SEQ ID NO: 725055 - RNA, 64 nt, Homo Sapiens; identical to SEQ ID NO: 488982

SEQ ID NO: 725056 - RNA, 64 nt, Homo Sapiens; identical to SEQ ID NO: 488983

SEQ ID NO: 725057 - RNA, 64 nt, Homo Sapiens; identical to SEQ ID NO: 488984

SEQ ID NO: 725058 - RNA, 64 nt, Homo Sapiens; identical to SEQ ID NO: 488985

SEQ ID NO: 725059 - RNA, 64 nt, Homo Sapiens; identical to SEQ ID NO: 488986

SEQ ID NO: 725060 - RNA, 64 nt, Homo Sapiens; identical to SEQ ID NO: 488987

SEQ ID NO: 725061 - RNA, 64 nt, Homo Sapiens; identical to SEQ ID NO: 488988

SEQ ID NO: 725062 - RNA, 64 nt, Homo Sapiens; identical to SEQ ID NO: 488989

SEQ ID NO: 725063 - RNA, 64 nt, Homo Sapiens; identical to SEQ ID NO: 488990

SEQ ID NO: 725064 - RNA, 64 nt, Homo Sapiens; identical to SEQ ID NO: 488991

SEQ ID NO: 725065 - RNA, 64 nt, Homo Sapiens; identical to SEQ ID NO: 488992

SEQ ID NO: 725066 - RNA, 64 nt, Homo Sapiens; identical to SEQ ID NO: 488993

SEQ ID NO: 725067 - RNA, 64 nt, Homo Sapiens; identical to SEQ ID NO: 488994

SEQ ID NO: 725068 - RNA, 64 nt, Homo Sapiens; identical to SEQ ID NO: 488995

SEQ ID NO: 725069 - RNA, 64 nt, Homo Sapiens; identical to SEQ ID NO: 488996

SEQ ID NO: 725070 - RNA, 64 nt, Homo Sapiens; identical to SEQ ID NO: 488997

SEQ ID NO: 725071 - RNA, 64 nt, Homo Sapiens; identical to SEQ ID NO: 488998

SEQ ID NO: 725072 - RNA, 64 nt, Homo Sapiens; identical to SEQ ID NO: 488999

SEQ ID NO: 725073 - RNA, 64 nt, Homo Sapiens; identical to SEQ ID NO: 489000

SEQ ID NO: 725074 - RNA, 64 nt, Homo Sapiens; identical to SEQ ID NO: 489001

SEQ ID NO: 725075 - RNA, 64 nt, Homo Sapiens; identical to SEQ ID NO: 489002

SEQ ID NO: 725076 - RNA, 64 nt, Homo Sapiens; identical to SEQ ID NO: 489003

SEQ ID NO: 725077 - RNA, 64 nt, Homo Sapiens; identical to SEQ ID NO: 489004

SEQ ID NO: 725078 - RNA, 64 nt, Homo Sapiens; identical to SEQ ID NO: 489005

SEQ ID NO: 725079 - RNA, 64 nt, Homo Sapiens; identical to SEQ ID NO: 489006

SEQ ID NO: 725080 - RNA, 64 nt, Homo Sapiens; identical to SEQ ID NO: 489007

SEQ ID NO: 725081 - RNA, 64 nt, Homo Sapiens; identical to SEQ ID NO: 489008

SEQ ID NO: 725082 - RNA, 64 nt, Homo Sapiens; identical to SEQ ID NO: 489009

SEQ ID NO: 725083 - RNA, 64 nt, Homo Sapiens; identical to SEQ ID NO: 489010

SEQ ID NO: 725084 - RNA, 64 nt, Homo Sapiens; identical to SEQ ID NO: 489011

SEQ ID NO: 725085 - RNA, 64 nt, Homo Sapiens; identical to SEQ ID NO: 489012

SEQ ID NO: 725086 - RNA, 64 nt, Homo Sapiens; identical to SEQ ID NO: 489013

SEQ ID NO: 725087 - RNA, 64 nt, Homo Sapiens; identical to SEQ ID NO: 489014

SEQ ID NO: 725088 - RNA, 64 nt, Homo Sapiens; identical to SEQ ID NO: 489015

SEQ ID NO: 725089 - RNA, 64 nt, Homo Sapiens; identical to SEQ ID NO: 489016

SEQ ID NO: 725090 - RNA, 64 nt, Homo Sapiens; identical to SEQ ID NO: 489017

SEQ ID NO: 725091 - RNA, 64 nt, Homo Sapiens; identical to SEQ ID NO: 489018

SEQ ID NO: 725092 - RNA, 64 nt, Homo Sapiens; identical to SEQ ID NO: 489019

SEQ ID NO: 725093 - RNA, 64 nt, Homo Sapiens; identical to SEQ ID NO: 489020

SEQ ID NO: 725094 - RNA, 64 nt, Homo Sapiens; identical to SEQ ID NO: 489021

SEQ ID NO: 725095 - RNA, 64 nt, Homo Sapiens; identical to SEQ ID NO: 489022

SEQ ID NO: 725096 - RNA, 64 nt, Homo Sapiens; identical to SEQ ID NO: 489023

SEQ ID NO: 725097 - RNA, 64 nt, Homo Sapiens; identical to SEQ ID NO: 489024

SEQ ID NO: 725098 - RNA, 64 nt, Homo Sapiens; identical to SEQ ID NO: 489025

SEQ ID NO: 725099 - RNA, 64 nt, Homo Sapiens; identical to SEQ ID NO: 489026

SEQ ID NO: 725100 - RNA, 64 nt, Homo Sapiens; identical to SEQ ID NO: 489027

SEQ ID NO: 725101 - RNA, 64 nt, Homo Sapiens; identical to SEQ ID NO: 489028

SEQ ID NO: 725102 - RNA, 64 nt, Homo Sapiens; identical to SEQ ID NO: 489029

SEQ ID NO: 725103 - RNA, 64 nt, Homo Sapiens; identical to SEQ ID NO: 489030

SEQ ID NO: 725104 - RNA, 64 nt, Homo Sapiens; identical to SEQ ID NO: 489031

SEQ ID NO: 725105 - RNA, 64 nt, Homo Sapiens; identical to SEQ ID NO: 489032

SEQ ID NO: 725106 - RNA, 64 nt, Homo Sapiens; identical to SEQ ID NO: 489033

SEQ ID NO: 725107 - RNA, 64 nt, Homo Sapiens; identical to SEQ ID NO: 489034

SEQ ID NO: 725108 - RNA, 64 nt, Homo Sapiens; identical to SEQ ID NO: 489035

SEQ ID NO: 725109 - RNA, 64 nt, Homo Sapiens; identical to SEQ ID NO: 489036

SEQ ID NO: 725110 - RNA, 64 nt, Homo Sapiens; identical to SEQ ID NO: 489037

SEQ ID NO: 725111 - RNA, 64 nt, Homo Sapiens; identical to SEQ ID NO: 489038

SEQ ID NO: 725112 - RNA, 64 nt, Homo Sapiens; identical to SEQ ID NO: 489039

SEQ ID NO: 725113 - RNA, 64 nt, Homo Sapiens; identical to SEQ ID NO: 489040

SEQ ID NO: 725114 - RNA, 64 nt, Homo Sapiens; identical to SEQ ID NO: 489041

SEQ ID NO: 725115 - RNA, 64 nt, Homo Sapiens; identical to SEQ ID NO: 489042

SEQ ID NO: 725116 - RNA, 64 nt, Homo Sapiens; identical to SEQ ID NO: 489043

SEQ ID NO: 725117 - RNA, 64 nt, Homo Sapiens; identical to SEQ ID NO: 489044

SEQ ID NO: 725118 - RNA, 64 nt, Homo Sapiens; identical to SEQ ID NO: 489045

SEQ ID NO: 725119 - RNA, 64 nt, Homo Sapiens; identical to SEQ ID NO: 489046

SEQ ID NO: 725120 - RNA, 64 nt, Homo Sapiens; identical to SEQ ID NO: 489047

SEQ ID NO: 725121 - RNA, 64 nt, Homo Sapiens; identical to SEQ ID NO: 489048

SEQ ID NO: 725122 - RNA, 64 nt, Homo Sapiens; identical to SEQ ID NO: 489049

SEQ ID NO: 725123 - RNA, 64 nt, Homo Sapiens; identical to SEQ ID NO: 489050

SEQ ID NO: 725124 - RNA, 64 nt, Homo Sapiens; identical to SEQ ID NO: 489051

SEQ ID NO: 725125 - RNA, 64 nt, Homo Sapiens; identical to SEQ ID NO: 489052

SEQ ID NO: 725126 - RNA, 64 nt, Homo Sapiens; identical to SEQ ID NO: 489053

SEQ ID NO: 725127 - RNA, 64 nt, Homo Sapiens; identical to SEQ ID NO: 489054

SEQ ID NO: 725128 - RNA, 64 nt, Homo Sapiens; identical to SEQ ID NO: 489055

SEQ ID NO: 725129 - RNA, 64 nt, Homo Sapiens; identical to SEQ ID NO: 489056

SEQ ID NO: 725130 - RNA, 64 nt, Homo Sapiens; identical to SEQ ID NO: 489057

SEQ ID NO: 725131 - RNA, 64 nt, Homo Sapiens; identical to SEQ ID NO: 555644

SEQ ID NO: 725132 - RNA, 64 nt, Homo Sapiens; identical to SEQ ID NO: 555645

SEQ ID NO: 725133 - RNA, 64 nt, Homo Sapiens; identical to SEQ ID NO: 555646

SEQ ID NO: 725134 - RNA, 64 nt, Homo Sapiens; identical to SEQ ID NO: 555647

SEQ ID NO: 725135 - RNA, 64 nt, Homo Sapiens; identical to SEQ ID NO: 555648

SEQ ID NO: 725136 - RNA, 64 nt, Homo Sapiens; identical to SEQ ID NO: 555649

SEQ ID NO: 725137 - RNA, 64 nt, Homo Sapiens; identical to SEQ ID NO: 555650

SEQ ID NO: 725138 - RNA, 64 nt, Homo Sapiens; identical to SEQ ID NO: 555651

SEQ ID NO: 725139 - RNA, 64 nt, Homo Sapiens; identical to SEQ ID NO: 555652

SEQ ID NO: 725140 - RNA, 64 nt, Homo Sapiens; identical to SEQ ID NO: 555653

SEQ ID NO: 725141 - RNA, 64 nt, Homo Sapiens; identical to SEQ ID NO: 555654

SEQ ID NO: 725142 - RNA, 64 nt, Homo Sapiens; identical to SEQ ID NO: 555655

SEQ ID NO: 725143 - RNA, 64 nt, Homo Sapiens; identical to SEQ ID NO: 555656

SEQ ID NO: 725144 - RNA, 64 nt, Homo Sapiens; identical to SEQ ID NO: 555657

SEQ ID NO: 725145 - RNA, 64 nt, Homo Sapiens; identical to SEQ ID NO: 555658

SEQ ID NO: 725146 - RNA, 64 nt, Homo Sapiens; identical to SEQ ID NO: 555659

SEQ ID NO: 725147 - RNA, 64 nt, Homo Sapiens; identical to SEQ ID NO: 555660

SEQ ID NO: 725148 - RNA, 64 nt, Homo Sapiens; identical to SEQ ID NO: 555661

SEQ ID NO: 725149 - RNA, 64 nt, Homo Sapiens; identical to SEQ ID NO: 555662

SEQ ID NO: 725150 - RNA, 64 nt, Homo Sapiens; identical to SEQ ID NO: 555663

SEQ ID NO: 725151 - RNA, 64 nt, Homo Sapiens; identical to SEQ ID NO: 488598

SEQ ID NO: 725152 - RNA, 64 nt, Homo Sapiens; identical to SEQ ID NO: 488599

SEQ ID NO: 725153 - RNA, 64 nt, Homo Sapiens; identical to SEQ ID NO: 488600

SEQ ID NO: 725154 - RNA, 64 nt, Homo Sapiens; identical to SEQ ID NO: 488601

SEQ ID NO: 725155 - RNA, 64 nt, Homo Sapiens; identical to SEQ ID NO: 488602

SEQ ID NO: 725156 - RNA, 64 nt, Homo Sapiens; identical to SEQ ID NO: 488603

SEQ ID NO: 725157 - RNA, 64 nt, Homo Sapiens; identical to SEQ ID NO: 488604

SEQ ID NO: 725158 - RNA, 64 nt, Homo Sapiens; identical to SEQ ID NO: 488605

SEQ ID NO: 725159 - RNA, 64 nt, Homo Sapiens; identical to SEQ ID NO: 488606

SEQ ID NO: 725160 - RNA, 64 nt, Homo Sapiens; identical to SEQ ID NO: 488607

SEQ ID NO: 725161 - RNA, 64 nt, Homo Sapiens; identical to SEQ ID NO: 488608

SEQ ID NO: 725162 - RNA, 64 nt, Homo Sapiens; identical to SEQ ID NO: 488609

SEQ ID NO: 725163 - RNA, 64 nt, Homo Sapiens; identical to SEQ ID NO: 488610

SEQ ID NO: 725164 - RNA, 64 nt, Homo Sapiens; identical to SEQ ID NO: 488611

SEQ ID NO: 725165 - RNA, 64 nt, Homo Sapiens; identical to SEQ ID NO: 488612

SEQ ID NO: 725166 - RNA, 64 nt, Homo Sapiens; identical to SEQ ID NO: 488613

SEQ ID NO: 725167 - RNA, 64 nt, Homo Sapiens; identical to SEQ ID NO: 488614

SEQ ID NO: 725168 - RNA, 64 nt, Homo Sapiens; identical to SEQ ID NO: 488615

SEQ ID NO: 725169 - RNA, 64 nt, Homo Sapiens; identical to SEQ ID NO: 488616

SEQ ID NO: 725170 - RNA, 64 nt, Homo Sapiens; identical to SEQ ID NO: 488617

SEQ ID NO: 725171 - RNA, 64 nt, Homo Sapiens; identical to SEQ ID NO: 488618

SEQ ID NO: 725172 - RNA, 64 nt, Homo Sapiens; identical to SEQ ID NO: 488619

SEQ ID NO: 725173 - RNA, 64 nt, Homo Sapiens; identical to SEQ ID NO: 488620

SEQ ID NO: 725174 - RNA, 64 nt, Homo Sapiens; identical to SEQ ID NO: 488621

SEQ ID NO: 725175 - RNA, 64 nt, Homo Sapiens; identical to SEQ ID NO: 488622

SEQ ID NO: 725176 - RNA, 64 nt, Homo Sapiens; identical to SEQ ID NO: 488623

SEQ ID NO: 725177 - RNA, 64 nt, Homo Sapiens; identical to SEQ ID NO: 488624

SEQ ID NO: 725178 - RNA, 64 nt, Homo Sapiens; identical to SEQ ID NO: 488625

SEQ ID NO: 725179 - RNA, 64 nt, Homo Sapiens; identical to SEQ ID NO: 488626

SEQ ID NO: 725180 - RNA, 64 nt, Homo Sapiens; identical to SEQ ID NO: 488627

SEQ ID NO: 725181 - RNA, 64 nt, Homo Sapiens; identical to SEQ ID NO: 488628

SEQ ID NO: 725182 - RNA, 64 nt, Homo Sapiens; identical to SEQ ID NO: 488629

SEQ ID NO: 725183 - RNA, 64 nt, Homo Sapiens; identical to SEQ ID NO: 488630

SEQ ID NO: 725184 - RNA, 64 nt, Homo Sapiens; identical to SEQ ID NO: 488631

SEQ ID NO: 725185 - RNA, 64 nt, Homo Sapiens; identical to SEQ ID NO: 488632

SEQ ID NO: 725186 - RNA, 64 nt, Homo Sapiens; identical to SEQ ID NO: 488633

SEQ ID NO: 725187 - RNA, 64 nt, Homo Sapiens; identical to SEQ ID NO: 488634

SEQ ID NO: 725188 - RNA, 64 nt, Homo Sapiens; identical to SEQ ID NO: 488635

SEQ ID NO: 725189 - RNA, 64 nt, Homo Sapiens; identical to SEQ ID NO: 488636

SEQ ID NO: 725190 - RNA, 64 nt, Homo Sapiens; identical to SEQ ID NO: 488637

SEQ ID NO: 725191 - RNA, 64 nt, Homo Sapiens; identical to SEQ ID NO: 488638

SEQ ID NO: 725192 - RNA, 64 nt, Homo Sapiens; identical to SEQ ID NO: 488639

SEQ ID NO: 725193 - RNA, 64 nt, Homo Sapiens; identical to SEQ ID NO: 488640

SEQ ID NO: 725194 - RNA, 64 nt, Homo Sapiens; identical to SEQ ID NO: 488641

SEQ ID NO: 725195 - RNA, 64 nt, Homo Sapiens; identical to SEQ ID NO: 488642

SEQ ID NO: 725196 - RNA, 64 nt, Homo Sapiens; identical to SEQ ID NO: 488643

SEQ ID NO: 725197 - RNA, 64 nt, Homo Sapiens; identical to SEQ ID NO: 488644

SEQ ID NO: 725198 - RNA, 64 nt, Homo Sapiens; identical to SEQ ID NO: 488645

SEQ ID NO: 725199 - RNA, 64 nt, Homo Sapiens; identical to SEQ ID NO: 488646

SEQ ID NO: 725200 - RNA, 64 nt, Homo Sapiens; identical to SEQ ID NO: 488647

SEQ ID NO: 725201 - RNA, 64 nt, Homo Sapiens; identical to SEQ ID NO: 488648

SEQ ID NO: 725202 - RNA, 64 nt, Homo Sapiens; identical to SEQ ID NO: 488649

SEQ ID NO: 725203 - RNA, 64 nt, Homo Sapiens; identical to SEQ ID NO: 488650

SEQ ID NO: 725204 - RNA, 64 nt, Homo Sapiens; identical to SEQ ID NO: 488651

SEQ ID NO: 725205 - RNA, 64 nt, Homo Sapiens; identical to SEQ ID NO: 488652

SEQ ID NO: 725206 - RNA, 64 nt, Homo Sapiens; identical to SEQ ID NO: 488653

SEQ ID NO: 725207 - RNA, 64 nt, Homo Sapiens; identical to SEQ ID NO: 488654

SEQ ID NO: 725208 - RNA, 64 nt, Homo Sapiens; identical to SEQ ID NO: 488655

SEQ ID NO: 725209 - RNA, 64 nt, Homo Sapiens; identical to SEQ ID NO: 488656

SEQ ID NO: 725210 - RNA, 64 nt, Homo Sapiens; identical to SEQ ID NO: 488657

SEQ ID NO: 725211 - RNA, 64 nt, Homo Sapiens; identical to SEQ ID NO: 488658

SEQ ID NO: 725212 - RNA, 64 nt, Homo Sapiens; identical to SEQ ID NO: 488659

SEQ ID NO: 725213 - RNA, 64 nt, Homo Sapiens; identical to SEQ ID NO: 488660

SEQ ID NO: 725214 - RNA, 64 nt, Homo Sapiens; identical to SEQ ID NO: 488661

SEQ ID NO: 725215 - RNA, 64 nt, Homo Sapiens; identical to SEQ ID NO: 488662

SEQ ID NO: 725216 - RNA, 64 nt, Homo Sapiens; identical to SEQ ID NO: 488663

SEQ ID NO: 725217 - RNA, 64 nt, Homo Sapiens; identical to SEQ ID NO: 488664

SEQ ID NO: 725218 - RNA, 64 nt, Homo Sapiens; identical to SEQ ID NO: 488665

SEQ ID NO: 725219 - RNA, 64 nt, Homo Sapiens; identical to SEQ ID NO: 488666

SEQ ID NO: 725220 - RNA, 64 nt, Homo Sapiens; identical to SEQ ID NO: 488667

SEQ ID NO: 725221 - RNA, 64 nt, Homo Sapiens; identical to SEQ ID NO: 488668

SEQ ID NO: 725222 - RNA, 64 nt, Homo Sapiens; identical to SEQ ID NO: 488669

SEQ ID NO: 725223 - RNA, 64 nt, Homo Sapiens; identical to SEQ ID NO: 488670

SEQ ID NO: 725224 - RNA, 64 nt, Homo Sapiens; identical to SEQ ID NO: 488671

SEQ ID NO: 725225 - RNA, 64 nt, Homo Sapiens; identical to SEQ ID NO: 488672

SEQ ID NO: 725226 - RNA, 64 nt, Homo Sapiens; identical to SEQ ID NO: 488673

SEQ ID NO: 725227 - RNA, 64 nt, Homo Sapiens; identical to SEQ ID NO: 488674

SEQ ID NO: 725228 - RNA, 64 nt, Homo Sapiens; identical to SEQ ID NO: 488675

SEQ ID NO: 725229 - RNA, 64 nt, Homo Sapiens; identical to SEQ ID NO: 488676

SEQ ID NO: 725230 - RNA, 64 nt, Homo Sapiens; identical to SEQ ID NO: 488677

SEQ ID NO: 725231 - RNA, 64 nt, Homo Sapiens; identical to SEQ ID NO: 488678

SEQ ID NO: 725232 - RNA, 64 nt, Homo Sapiens; identical to SEQ ID NO: 488679

SEQ ID NO: 725233 - RNA, 64 nt, Homo Sapiens; identical to SEQ ID NO: 488680

SEQ ID NO: 725234 - RNA, 64 nt, Homo Sapiens; identical to SEQ ID NO: 488681

SEQ ID NO: 725235 - RNA, 64 nt, Homo Sapiens; identical to SEQ ID NO: 488682

SEQ ID NO: 725236 - RNA, 64 nt, Homo Sapiens; identical to SEQ ID NO: 488683

SEQ ID NO: 725237 - RNA, 64 nt, Homo Sapiens; identical to SEQ ID NO: 488684

SEQ ID NO: 725238 - RNA, 64 nt, Homo Sapiens; identical to SEQ ID NO: 488685

SEQ ID NO: 725239 - RNA, 64 nt, Homo Sapiens; identical to SEQ ID NO: 488686

SEQ ID NO: 725240 - RNA, 64 nt, Homo Sapiens; identical to SEQ ID NO: 488687

SEQ ID NO: 725241 - RNA, 64 nt, Homo Sapiens; identical to SEQ ID NO: 488688

SEQ ID NO: 725242 - RNA, 64 nt, Homo Sapiens; identical to SEQ ID NO: 488689

SEQ ID NO: 725243 - RNA, 64 nt, Homo Sapiens; identical to SEQ ID NO: 488690

SEQ ID NO: 725244 - RNA, 64 nt, Homo Sapiens; identical to SEQ ID NO: 488691

SEQ ID NO: 725245 - RNA, 64 nt, Homo Sapiens; identical to SEQ ID NO: 488692

SEQ ID NO: 725246 - RNA, 64 nt, Homo Sapiens; identical to SEQ ID NO: 488693

SEQ ID NO: 725247 - RNA, 64 nt, Homo Sapiens; identical to SEQ ID NO: 488694

SEQ ID NO: 725248 - RNA, 64 nt, Homo Sapiens; identical to SEQ ID NO: 488695

SEQ ID NO: 725249 - RNA, 64 nt, Homo Sapiens; identical to SEQ ID NO: 488696

SEQ ID NO: 725250 - RNA, 64 nt, Homo Sapiens; identical to SEQ ID NO: 488697

SEQ ID NO: 725251 - RNA, 64 nt, Homo Sapiens; identical to SEQ ID NO: 488698

SEQ ID NO: 725252 - RNA, 64 nt, Homo Sapiens; identical to SEQ ID NO: 488699

SEQ ID NO: 725253 - RNA, 64 nt, Homo Sapiens; identical to SEQ ID NO: 488700

SEQ ID NO: 725254 - RNA, 64 nt, Homo Sapiens; identical to SEQ ID NO: 488701

SEQ ID NO: 725255 - RNA, 64 nt, Homo Sapiens; identical to SEQ ID NO: 488702

SEQ ID NO: 725256 - RNA, 64 nt, Homo Sapiens; identical to SEQ ID NO: 488703

SEQ ID NO: 725257 - RNA, 64 nt, Homo Sapiens; identical to SEQ ID NO: 488704

SEQ ID NO: 725258 - RNA, 64 nt, Homo Sapiens; identical to SEQ ID NO: 488705

SEQ ID NO: 725259 - RNA, 64 nt, Homo Sapiens; identical to SEQ ID NO: 488706

SEQ ID NO: 725260 - RNA, 64 nt, Homo Sapiens; identical to SEQ ID NO: 488707

SEQ ID NO: 725261 - RNA, 64 nt, Homo Sapiens; identical to SEQ ID NO: 488708

SEQ ID NO: 725262 - RNA, 64 nt, Homo Sapiens; identical to SEQ ID NO: 488709

SEQ ID NO: 725263 - RNA, 64 nt, Homo Sapiens; identical to SEQ ID NO: 488710

SEQ ID NO: 725264 - RNA, 64 nt, Homo Sapiens; identical to SEQ ID NO: 488711

SEQ ID NO: 725265 - RNA, 64 nt, Homo Sapiens; identical to SEQ ID NO: 488712

SEQ ID NO: 725266 - RNA, 64 nt, Homo Sapiens; identical to SEQ ID NO: 488713

SEQ ID NO: 725267 - RNA, 64 nt, Homo Sapiens; identical to SEQ ID NO: 488714

SEQ ID NO: 725268 - RNA, 64 nt, Homo Sapiens; identical to SEQ ID NO: 488715

SEQ ID NO: 725269 - RNA, 64 nt, Homo Sapiens; identical to SEQ ID NO: 488716

SEQ ID NO: 725270 - RNA, 64 nt, Homo Sapiens; identical to SEQ ID NO: 488717

SEQ ID NO: 725271 - RNA, 64 nt, Homo Sapiens; identical to SEQ ID NO: 488718

SEQ ID NO: 725272 - RNA, 64 nt, Homo Sapiens; identical to SEQ ID NO: 488719

SEQ ID NO: 725273 - RNA, 64 nt, Homo Sapiens; identical to SEQ ID NO: 488720

SEQ ID NO: 725274 - RNA, 64 nt, Homo Sapiens; identical to SEQ ID NO: 488721

SEQ ID NO: 725275 - RNA, 64 nt, Homo Sapiens; identical to SEQ ID NO: 488722

SEQ ID NO: 725276 - RNA, 64 nt, Homo Sapiens; identical to SEQ ID NO: 488723

SEQ ID NO: 725277 - RNA, 64 nt, Homo Sapiens; identical to SEQ ID NO: 488724

SEQ ID NO: 725278 - RNA, 64 nt, Homo Sapiens; identical to SEQ ID NO: 488725

SEQ ID NO: 725279 - RNA, 64 nt, Homo Sapiens; identical to SEQ ID NO: 488726

SEQ ID NO: 725280 - RNA, 64 nt, Homo Sapiens; identical to SEQ ID NO: 488727

SEQ ID NO: 725281 - RNA, 64 nt, Homo Sapiens; identical to SEQ ID NO: 488728

SEQ ID NO: 725282 - RNA, 64 nt, Homo Sapiens; identical to SEQ ID NO: 488729

SEQ ID NO: 725283 - RNA, 64 nt, Homo Sapiens; identical to SEQ ID NO: 488730

SEQ ID NO: 725284 - RNA, 64 nt, Homo Sapiens; identical to SEQ ID NO: 488731

SEQ ID NO: 725285 - RNA, 64 nt, Homo Sapiens; identical to SEQ ID NO: 488732

SEQ ID NO: 725286 - RNA, 64 nt, Homo Sapiens; identical to SEQ ID NO: 488733

SEQ ID NO: 725287 - RNA, 64 nt, Homo Sapiens; identical to SEQ ID NO: 488734

SEQ ID NO: 725288 - RNA, 64 nt, Homo Sapiens; identical to SEQ ID NO: 488735

SEQ ID NO: 725289 - RNA, 64 nt, Homo Sapiens; identical to SEQ ID NO: 488736

SEQ ID NO: 725290 - RNA, 64 nt, Homo Sapiens; identical to SEQ ID NO: 488737

SEQ ID NO: 725291 - RNA, 64 nt, Homo Sapiens; identical to SEQ ID NO: 488738

SEQ ID NO: 725292 - RNA, 64 nt, Homo Sapiens; identical to SEQ ID NO: 488739

SEQ ID NO: 725293 - RNA, 64 nt, Homo Sapiens; identical to SEQ ID NO: 488740

SEQ ID NO: 725294 - RNA, 64 nt, Homo Sapiens; identical to SEQ ID NO: 488741

SEQ ID NO: 725295 - RNA, 64 nt, Homo Sapiens; identical to SEQ ID NO: 488742

SEQ ID NO: 725296 - RNA, 64 nt, Homo Sapiens; identical to SEQ ID NO: 488743

SEQ ID NO: 725297 - RNA, 64 nt, Homo Sapiens; identical to SEQ ID NO: 488744

SEQ ID NO: 725298 - RNA, 64 nt, Homo Sapiens; identical to SEQ ID NO: 488745

SEQ ID NO: 725299 - RNA, 64 nt, Homo Sapiens; identical to SEQ ID NO: 488746

SEQ ID NO: 725300 - RNA, 64 nt, Homo Sapiens; identical to SEQ ID NO: 488747

SEQ ID NO: 725301 - RNA, 64 nt, Homo Sapiens; identical to SEQ ID NO: 488748

SEQ ID NO: 725302 - RNA, 64 nt, Homo Sapiens; identical to SEQ ID NO: 488749

SEQ ID NO: 725303 - RNA, 64 nt, Homo Sapiens; identical to SEQ ID NO: 488750

SEQ ID NO: 725304 - RNA, 64 nt, Homo Sapiens; identical to SEQ ID NO: 488751

SEQ ID NO: 725305 - RNA, 64 nt, Homo Sapiens; identical to SEQ ID NO: 488752

SEQ ID NO: 725306 - RNA, 64 nt, Homo Sapiens; identical to SEQ ID NO: 488753

SEQ ID NO: 725307 - RNA, 64 nt, Homo Sapiens; identical to SEQ ID NO: 488754

SEQ ID NO: 725308 - RNA, 64 nt, Homo Sapiens; identical to SEQ ID NO: 488755

SEQ ID NO: 725309 - RNA, 64 nt, Homo Sapiens; identical to SEQ ID NO: 488756

SEQ ID NO: 725310 - RNA, 64 nt, Homo Sapiens; identical to SEQ ID NO: 488757

SEQ ID NO: 725311 - RNA, 64 nt, Homo Sapiens; identical to SEQ ID NO: 488758

SEQ ID NO: 725312 - RNA, 64 nt, Homo Sapiens; identical to SEQ ID NO: 488759

SEQ ID NO: 725313 - RNA, 64 nt, Homo Sapiens; identical to SEQ ID NO: 488760

SEQ ID NO: 725314 - RNA, 64 nt, Homo Sapiens; identical to SEQ ID NO: 488761

SEQ ID NO: 725315 - RNA, 64 nt, Homo Sapiens; identical to SEQ ID NO: 488762

SEQ ID NO: 725316 - RNA, 64 nt, Homo Sapiens; identical to SEQ ID NO: 488763

SEQ ID NO: 725317 - RNA, 64 nt, Homo Sapiens; identical to SEQ ID NO: 488764

SEQ ID NO: 725318 - RNA, 64 nt, Homo Sapiens; identical to SEQ ID NO: 488765

SEQ ID NO: 725319 - RNA, 64 nt, Homo Sapiens; identical to SEQ ID NO: 488766

SEQ ID NO: 725320 - RNA, 64 nt, Homo Sapiens; identical to SEQ ID NO: 488767

SEQ ID NO: 725321 - RNA, 64 nt, Homo Sapiens; identical to SEQ ID NO: 488768

SEQ ID NO: 725322 - RNA, 64 nt, Homo Sapiens; identical to SEQ ID NO: 488769

SEQ ID NO: 725323 - RNA, 64 nt, Homo Sapiens; identical to SEQ ID NO: 488770

SEQ ID NO: 725324 - RNA, 64 nt, Homo Sapiens; identical to SEQ ID NO: 488771

SEQ ID NO: 725325 - RNA, 64 nt, Homo Sapiens; identical to SEQ ID NO: 488772

SEQ ID NO: 725326 - RNA, 64 nt, Homo Sapiens; identical to SEQ ID NO: 488773

SEQ ID NO: 725327 - RNA, 64 nt, Homo Sapiens; identical to SEQ ID NO: 488774

SEQ ID NO: 725328 - RNA, 64 nt, Homo Sapiens; identical to SEQ ID NO: 488775

SEQ ID NO: 725329 - RNA, 64 nt, Homo Sapiens; identical to SEQ ID NO: 488776

SEQ ID NO: 725330 - RNA, 64 nt, Homo Sapiens; identical to SEQ ID NO: 488777

SEQ ID NO: 725331 - RNA, 64 nt, Homo Sapiens; identical to SEQ ID NO: 488778

SEQ ID NO: 725332 - RNA, 64 nt, Homo Sapiens; identical to SEQ ID NO: 488779

SEQ ID NO: 725333 - RNA, 64 nt, Homo Sapiens; identical to SEQ ID NO: 488780

SEQ ID NO: 725334 - RNA, 64 nt, Homo Sapiens; identical to SEQ ID NO: 488781

SEQ ID NO: 725335 - RNA, 64 nt, Homo Sapiens; identical to SEQ ID NO: 488782

SEQ ID NO: 725336 - RNA, 64 nt, Homo Sapiens; identical to SEQ ID NO: 488783

SEQ ID NO: 725337 - RNA, 64 nt, Homo Sapiens; identical to SEQ ID NO: 488784

SEQ ID NO: 725338 - RNA, 64 nt, Homo Sapiens; identical to SEQ ID NO: 488785

SEQ ID NO: 725339 - RNA, 64 nt, Homo Sapiens; identical to SEQ ID NO: 488786

SEQ ID NO: 725340 - RNA, 64 nt, Homo Sapiens; identical to SEQ ID NO: 488787

SEQ ID NO: 725341 - RNA, 64 nt, Homo Sapiens; identical to SEQ ID NO: 488788

SEQ ID NO: 725342 - RNA, 64 nt, Homo Sapiens; identical to SEQ ID NO: 488789

SEQ ID NO: 725343 - RNA, 64 nt, Homo Sapiens; identical to SEQ ID NO: 488790

SEQ ID NO: 725344 - RNA, 64 nt, Homo Sapiens; identical to SEQ ID NO: 488791

SEQ ID NO: 725345 - RNA, 64 nt, Homo Sapiens; identical to SEQ ID NO: 488792

SEQ ID NO: 725346 - RNA, 64 nt, Homo Sapiens; identical to SEQ ID NO: 488793

SEQ ID NO: 725347 - RNA, 64 nt, Homo Sapiens; identical to SEQ ID NO: 488794

SEQ ID NO: 725348 - RNA, 64 nt, Homo Sapiens; identical to SEQ ID NO: 488795

SEQ ID NO: 725349 - RNA, 64 nt, Homo Sapiens; identical to SEQ ID NO: 488796

SEQ ID NO: 725350 - RNA, 64 nt, Homo Sapiens; identical to SEQ ID NO: 488797

SEQ ID NO: 725351 - RNA, 64 nt, Homo Sapiens; identical to SEQ ID NO: 488798

SEQ ID NO: 725352 - RNA, 64 nt, Homo Sapiens; identical to SEQ ID NO: 488799

SEQ ID NO: 725353 - RNA, 64 nt, Homo Sapiens; identical to SEQ ID NO: 488800

SEQ ID NO: 725354 - RNA, 64 nt, Homo Sapiens; identical to SEQ ID NO: 488801

SEQ ID NO: 725355 - RNA, 64 nt, Homo Sapiens; identical to SEQ ID NO: 488802

SEQ ID NO: 725356 - RNA, 64 nt, Homo Sapiens; identical to SEQ ID NO: 488803

SEQ ID NO: 725357 - RNA, 64 nt, Homo Sapiens; identical to SEQ ID NO: 488804

SEQ ID NO: 725358 - RNA, 64 nt, Homo Sapiens; identical to SEQ ID NO: 488805

SEQ ID NO: 725359 - RNA, 64 nt, Homo Sapiens; identical to SEQ ID NO: 488806

SEQ ID NO: 725360 - RNA, 64 nt, Homo Sapiens; identical to SEQ ID NO: 488807

SEQ ID NO: 725361 - RNA, 64 nt, Homo Sapiens; identical to SEQ ID NO: 488808

SEQ ID NO: 725362 - RNA, 64 nt, Homo Sapiens; identical to SEQ ID NO: 488809

SEQ ID NO: 725363 - RNA, 64 nt, Homo Sapiens; identical to SEQ ID NO: 488810

SEQ ID NO: 725364 - RNA, 64 nt, Homo Sapiens; identical to SEQ ID NO: 488811

SEQ ID NO: 725365 - RNA, 64 nt, Homo Sapiens; identical to SEQ ID NO: 488812

SEQ ID NO: 725366 - RNA, 64 nt, Homo Sapiens; identical to SEQ ID NO: 488813

SEQ ID NO: 725367 - RNA, 64 nt, Homo Sapiens; identical to SEQ ID NO: 488814

SEQ ID NO: 725368 - RNA, 64 nt, Homo Sapiens; identical to SEQ ID NO: 488815

SEQ ID NO: 725369 - RNA, 64 nt, Homo Sapiens; identical to SEQ ID NO: 488816

SEQ ID NO: 725370 - RNA, 64 nt, Homo Sapiens; identical to SEQ ID NO: 488817

SEQ ID NO: 725371 - RNA, 64 nt, Homo Sapiens; identical to SEQ ID NO: 488818

SEQ ID NO: 725372 - RNA, 64 nt, Homo Sapiens; identical to SEQ ID NO: 488819

SEQ ID NO: 725373 - RNA, 64 nt, Homo Sapiens; identical to SEQ ID NO: 488820

SEQ ID NO: 725374 - RNA, 64 nt, Homo Sapiens; identical to SEQ ID NO: 488821

SEQ ID NO: 725375 - RNA, 64 nt, Homo Sapiens; identical to SEQ ID NO: 488822

SEQ ID NO: 725376 - RNA, 64 nt, Homo Sapiens; identical to SEQ ID NO: 488823

SEQ ID NO: 725377 - RNA, 64 nt, Homo Sapiens; identical to SEQ ID NO: 488824

SEQ ID NO: 725378 - RNA, 64 nt, Homo Sapiens; identical to SEQ ID NO: 488825

SEQ ID NO: 725379 - RNA, 64 nt, Homo Sapiens; identical to SEQ ID NO: 488826

SEQ ID NO: 725380 - RNA, 64 nt, Homo Sapiens; identical to SEQ ID NO: 488827

SEQ ID NO: 725381 - RNA, 64 nt, Homo Sapiens; identical to SEQ ID NO: 488828

SEQ ID NO: 725382 - RNA, 64 nt, Homo Sapiens; identical to SEQ ID NO: 488829

SEQ ID NO: 725383 - RNA, 64 nt, Homo Sapiens; identical to SEQ ID NO: 488830

SEQ ID NO: 725384 - RNA, 64 nt, Homo Sapiens; identical to SEQ ID NO: 488831

SEQ ID NO: 725385 - RNA, 64 nt, Homo Sapiens; identical to SEQ ID NO: 488832

SEQ ID NO: 725386 - RNA, 64 nt, Homo Sapiens; identical to SEQ ID NO: 488833

SEQ ID NO: 725387 - RNA, 64 nt, Homo Sapiens; identical to SEQ ID NO: 488834

SEQ ID NO: 725388 - RNA, 64 nt, Homo Sapiens; identical to SEQ ID NO: 488835

SEQ ID NO: 725389 - RNA, 64 nt, Homo Sapiens; identical to SEQ ID NO: 488836

SEQ ID NO: 725390 - RNA, 64 nt, Homo Sapiens; identical to SEQ ID NO: 488837

SEQ ID NO: 725391 - RNA, 64 nt, Homo Sapiens; identical to SEQ ID NO: 488838

SEQ ID NO: 725392 - RNA, 64 nt, Homo Sapiens; identical to SEQ ID NO: 488839

SEQ ID NO: 725393 - RNA, 64 nt, Homo Sapiens; identical to SEQ ID NO: 488840

SEQ ID NO: 725394 - RNA, 64 nt, Homo Sapiens; identical to SEQ ID NO: 488841

SEQ ID NO: 725395 - RNA, 64 nt, Homo Sapiens; identical to SEQ ID NO: 488842

SEQ ID NO: 725396 - RNA, 64 nt, Homo Sapiens; identical to SEQ ID NO: 488843

SEQ ID NO: 725397 - RNA, 64 nt, Homo Sapiens; identical to SEQ ID NO: 488844

SEQ ID NO: 725398 - RNA, 64 nt, Homo Sapiens; identical to SEQ ID NO: 488845

SEQ ID NO: 725399 - RNA, 64 nt, Homo Sapiens; identical to SEQ ID NO: 488846

SEQ ID NO: 725400 - RNA, 64 nt, Homo Sapiens; identical to SEQ ID NO: 488847

SEQ ID NO: 725401 - RNA, 64 nt, Homo Sapiens; identical to SEQ ID NO: 488848

SEQ ID NO: 725402 - RNA, 64 nt, Homo Sapiens; identical to SEQ ID NO: 488849

SEQ ID NO: 725403 - RNA, 64 nt, Homo Sapiens; identical to SEQ ID NO: 488850

SEQ ID NO: 725404 - RNA, 64 nt, Homo Sapiens; identical to SEQ ID NO: 488851

SEQ ID NO: 725405 - RNA, 64 nt, Homo Sapiens; identical to SEQ ID NO: 488852

SEQ ID NO: 725406 - RNA, 64 nt, Homo Sapiens; identical to SEQ ID NO: 488853

SEQ ID NO: 725407 - RNA, 64 nt, Homo Sapiens; identical to SEQ ID NO: 488854

SEQ ID NO: 725408 - RNA, 64 nt, Homo Sapiens; identical to SEQ ID NO: 488855

SEQ ID NO: 725409 - RNA, 64 nt, Homo Sapiens; identical to SEQ ID NO: 488856

SEQ ID NO: 725410 - RNA, 64 nt, Homo Sapiens; identical to SEQ ID NO: 488857

SEQ ID NO: 725411 - RNA, 64 nt, Homo Sapiens; identical to SEQ ID NO: 488858

SEQ ID NO: 725412 - RNA, 64 nt, Homo Sapiens; identical to SEQ ID NO: 488859

SEQ ID NO: 725413 - RNA, 64 nt, Homo Sapiens; identical to SEQ ID NO: 488860

SEQ ID NO: 725414 - RNA, 64 nt, Homo Sapiens; identical to SEQ ID NO: 488861

SEQ ID NO: 725415 - RNA, 64 nt, Homo Sapiens; identical to SEQ ID NO: 488862

SEQ ID NO: 725416 - RNA, 64 nt, Homo Sapiens; identical to SEQ ID NO: 488863

SEQ ID NO: 725417 - RNA, 64 nt, Homo Sapiens; identical to SEQ ID NO: 488864

SEQ ID NO: 725418 - RNA, 64 nt, Homo Sapiens; identical to SEQ ID NO: 488865

SEQ ID NO: 725419 - RNA, 64 nt, Homo Sapiens; identical to SEQ ID NO: 488866

SEQ ID NO: 725420 - RNA, 64 nt, Homo Sapiens; identical to SEQ ID NO: 488867

SEQ ID NO: 725421 - RNA, 64 nt, Homo Sapiens; identical to SEQ ID NO: 488868

SEQ ID NO: 725422 - RNA, 64 nt, Homo Sapiens; identical to SEQ ID NO: 488869

SEQ ID NO: 725423 - RNA, 64 nt, Homo Sapiens; identical to SEQ ID NO: 488870

SEQ ID NO: 725424 - RNA, 64 nt, Homo Sapiens; identical to SEQ ID NO: 488871

SEQ ID NO: 725425 - RNA, 64 nt, Homo Sapiens; identical to SEQ ID NO: 488872

SEQ ID NO: 725426 - RNA, 64 nt, Homo Sapiens; identical to SEQ ID NO: 488873

SEQ ID NO: 725427 - RNA, 64 nt, Homo Sapiens; identical to SEQ ID NO: 488874

SEQ ID NO: 725428 - RNA, 64 nt, Homo Sapiens; identical to SEQ ID NO: 488875

SEQ ID NO: 725429 - RNA, 64 nt, Homo Sapiens; identical to SEQ ID NO: 488876

SEQ ID NO: 725430 - RNA, 64 nt, Homo Sapiens; identical to SEQ ID NO: 488877

SEQ ID NO: 725431 - RNA, 64 nt, Homo Sapiens; identical to SEQ ID NO: 488878

SEQ ID NO: 725432 - RNA, 64 nt, Homo Sapiens; identical to SEQ ID NO: 488879

SEQ ID NO: 725433 - RNA, 64 nt, Homo Sapiens; identical to SEQ ID NO: 488880

SEQ ID NO: 725434 - RNA, 64 nt, Homo Sapiens; identical to SEQ ID NO: 488881

SEQ ID NO: 725435 - RNA, 64 nt, Homo Sapiens; identical to SEQ ID NO: 488882

SEQ ID NO: 725436 - RNA, 64 nt, Homo Sapiens; identical to SEQ ID NO: 488883

SEQ ID NO: 725437 - RNA, 64 nt, Homo Sapiens; identical to SEQ ID NO: 488884

SEQ ID NO: 725438 - RNA, 64 nt, Homo Sapiens; identical to SEQ ID NO: 488885

SEQ ID NO: 725439 - RNA, 64 nt, Homo Sapiens; identical to SEQ ID NO: 488886

SEQ ID NO: 725440 - RNA, 64 nt, Homo Sapiens; identical to SEQ ID NO: 488887

SEQ ID NO: 725441 - RNA, 64 nt, Homo Sapiens; identical to SEQ ID NO: 488888

SEQ ID NO: 725442 - RNA, 64 nt, Homo Sapiens; identical to SEQ ID NO: 488889

SEQ ID NO: 725443 - RNA, 64 nt, Homo Sapiens; identical to SEQ ID NO: 488890

SEQ ID NO: 725444 - RNA, 64 nt, Homo Sapiens; identical to SEQ ID NO: 488891

SEQ ID NO: 725445 - RNA, 64 nt, Homo Sapiens; identical to SEQ ID NO: 488892

SEQ ID NO: 725446 - RNA, 64 nt, Homo Sapiens; identical to SEQ ID NO: 488893

SEQ ID NO: 725447 - RNA, 64 nt, Homo Sapiens; identical to SEQ ID NO: 488894

SEQ ID NO: 725448 - RNA, 64 nt, Homo Sapiens; identical to SEQ ID NO: 488895

SEQ ID NO: 725449 - RNA, 64 nt, Homo Sapiens; identical to SEQ ID NO: 488896

SEQ ID NO: 725450 - RNA, 64 nt, Homo Sapiens; identical to SEQ ID NO: 488897

SEQ ID NO: 725451 - RNA, 64 nt, Homo Sapiens; identical to SEQ ID NO: 488898

SEQ ID NO: 725452 - RNA, 64 nt, Homo Sapiens; identical to SEQ ID NO: 488899

SEQ ID NO: 725453 - RNA, 64 nt, Homo Sapiens; identical to SEQ ID NO: 488900

SEQ ID NO: 725454 - RNA, 64 nt, Homo Sapiens; identical to SEQ ID NO: 488901

SEQ ID NO: 725455 - RNA, 64 nt, Homo Sapiens; identical to SEQ ID NO: 488902

SEQ ID NO: 725456 - RNA, 64 nt, Homo Sapiens; identical to SEQ ID NO: 488903

SEQ ID NO: 725457 - RNA, 64 nt, Homo Sapiens; identical to SEQ ID NO: 488904

SEQ ID NO: 725458 - RNA, 64 nt, Homo Sapiens; identical to SEQ ID NO: 488905

SEQ ID NO: 725459 - RNA, 64 nt, Homo Sapiens; identical to SEQ ID NO: 488906

SEQ ID NO: 725460 - RNA, 64 nt, Homo Sapiens; identical to SEQ ID NO: 488907

SEQ ID NO: 725461 - RNA, 64 nt, Homo Sapiens; identical to SEQ ID NO: 488908

SEQ ID NO: 725462 - RNA, 64 nt, Homo Sapiens; identical to SEQ ID NO: 488909

SEQ ID NO: 725463 - RNA, 64 nt, Homo Sapiens; identical to SEQ ID NO: 488910

SEQ ID NO: 725464 - RNA, 64 nt, Homo Sapiens; identical to SEQ ID NO: 488911

SEQ ID NO: 725465 - RNA, 64 nt, Homo Sapiens; identical to SEQ ID NO: 488912

SEQ ID NO: 725466 - RNA, 64 nt, Homo Sapiens; identical to SEQ ID NO: 488913

SEQ ID NO: 725467 - RNA, 64 nt, Homo Sapiens; identical to SEQ ID NO: 488914

SEQ ID NO: 725468 - RNA, 64 nt, Homo Sapiens; identical to SEQ ID NO: 488915

SEQ ID NO: 725469 - RNA, 64 nt, Homo Sapiens; identical to SEQ ID NO: 488916

SEQ ID NO: 725470 - RNA, 64 nt, Homo Sapiens; identical to SEQ ID NO: 488917

SEQ ID NO: 725471 - RNA, 64 nt, Homo Sapiens; identical to SEQ ID NO: 488918

SEQ ID NO: 725472 - RNA, 64 nt, Homo Sapiens; identical to SEQ ID NO: 488919

SEQ ID NO: 725473 - RNA, 64 nt, Homo Sapiens; identical to SEQ ID NO: 488920

SEQ ID NO: 725474 - RNA, 64 nt, Homo Sapiens; identical to SEQ ID NO: 488921

SEQ ID NO: 725475 - RNA, 64 nt, Homo Sapiens; identical to SEQ ID NO: 488922

SEQ ID NO: 725476 - RNA, 64 nt, Homo Sapiens; identical to SEQ ID NO: 488923

SEQ ID NO: 725477 - RNA, 64 nt, Homo Sapiens; identical to SEQ ID NO: 488924

SEQ ID NO: 725478 - RNA, 64 nt, Homo Sapiens; identical to SEQ ID NO: 488925

SEQ ID NO: 725479 - RNA, 64 nt, Homo Sapiens; identical to SEQ ID NO: 488926

SEQ ID NO: 725480 - RNA, 64 nt, Homo Sapiens; identical to SEQ ID NO: 488927

SEQ ID NO: 725481 - RNA, 64 nt, Homo Sapiens; identical to SEQ ID NO: 488928

SEQ ID NO: 725482 - RNA, 64 nt, Homo Sapiens; identical to SEQ ID NO: 488929

SEQ ID NO: 725483 - RNA, 64 nt, Homo Sapiens; identical to SEQ ID NO: 488930

SEQ ID NO: 725484 - RNA, 64 nt, Homo Sapiens; identical to SEQ ID NO: 488931

SEQ ID NO: 725485 - RNA, 64 nt, Homo Sapiens; identical to SEQ ID NO: 488932

SEQ ID NO: 725486 - RNA, 64 nt, Homo Sapiens; identical to SEQ ID NO: 488933

SEQ ID NO: 725487 - RNA, 64 nt, Homo Sapiens; identical to SEQ ID NO: 488934

SEQ ID NO: 725488 - RNA, 64 nt, Homo Sapiens; identical to SEQ ID NO: 488935

SEQ ID NO: 725489 - RNA, 64 nt, Homo Sapiens; identical to SEQ ID NO: 488936

SEQ ID NO: 725490 - RNA, 64 nt, Homo Sapiens; identical to SEQ ID NO: 488937

SEQ ID NO: 725491 - RNA, 64 nt, Homo Sapiens; identical to SEQ ID NO: 488938

SEQ ID NO: 725492 - RNA, 64 nt, Homo Sapiens; identical to SEQ ID NO: 488939

SEQ ID NO: 725493 - RNA, 64 nt, Homo Sapiens; identical to SEQ ID NO: 488940

SEQ ID NO: 725494 - RNA, 64 nt, Homo Sapiens; identical to SEQ ID NO: 488941

SEQ ID NO: 725495 - RNA, 64 nt, Homo Sapiens; identical to SEQ ID NO: 488942

SEQ ID NO: 725496 - RNA, 64 nt, Homo Sapiens; identical to SEQ ID NO: 488943

SEQ ID NO: 725497 - RNA, 64 nt, Homo Sapiens; identical to SEQ ID NO: 488944

SEQ ID NO: 725498 - RNA, 64 nt, Homo Sapiens; identical to SEQ ID NO: 488945

SEQ ID NO: 725499 - RNA, 64 nt, Homo Sapiens; identical to SEQ ID NO: 488946

SEQ ID NO: 725500 - RNA, 64 nt, Homo Sapiens; identical to SEQ ID NO: 488947

SEQ ID NO: 725501 - RNA, 64 nt, Homo Sapiens; identical to SEQ ID NO: 488948

SEQ ID NO: 725502 - RNA, 64 nt, Homo Sapiens; identical to SEQ ID NO: 488949

SEQ ID NO: 725503 - RNA, 64 nt, Homo Sapiens; identical to SEQ ID NO: 488950

SEQ ID NO: 725504 - RNA, 64 nt, Homo Sapiens; identical to SEQ ID NO: 488951

SEQ ID NO: 725505 - RNA, 64 nt, Homo Sapiens; identical to SEQ ID NO: 488952

SEQ ID NO: 725506 - RNA, 64 nt, Homo Sapiens; identical to SEQ ID NO: 488953

SEQ ID NO: 725507 - RNA, 64 nt, Homo Sapiens; identical to SEQ ID NO: 488954

SEQ ID NO: 725508 - RNA, 64 nt, Homo Sapiens; identical to SEQ ID NO: 488955

SEQ ID NO: 725509 - RNA, 64 nt, Homo Sapiens; identical to SEQ ID NO: 488956

SEQ ID NO: 725510 - RNA, 64 nt, Homo Sapiens; identical to SEQ ID NO: 488957

SEQ ID NO: 725511 - RNA, 64 nt, Homo Sapiens; identical to SEQ ID NO: 488958

SEQ ID NO: 725512 - RNA, 64 nt, Homo Sapiens; identical to SEQ ID NO: 488959

SEQ ID NO: 725513 - RNA, 64 nt, Homo Sapiens; identical to SEQ ID NO: 488960

SEQ ID NO: 725514 - RNA, 64 nt, Homo Sapiens; identical to SEQ ID NO: 488961

SEQ ID NO: 725515 - RNA, 64 nt, Homo Sapiens; identical to SEQ ID NO: 488962

SEQ ID NO: 725516 - RNA, 64 nt, Homo Sapiens; identical to SEQ ID NO: 488963

SEQ ID NO: 725517 - RNA, 64 nt, Homo Sapiens; identical to SEQ ID NO: 488964

SEQ ID NO: 725518 - RNA, 64 nt, Homo Sapiens; identical to SEQ ID NO: 488965

SEQ ID NO: 725519 - RNA, 64 nt, Homo Sapiens; identical to SEQ ID NO: 488966

SEQ ID NO: 725520 - RNA, 64 nt, Homo Sapiens; identical to SEQ ID NO: 488967

SEQ ID NO: 725521 - RNA, 64 nt, Homo Sapiens; identical to SEQ ID NO: 488968

SEQ ID NO: 725522 - RNA, 64 nt, Homo Sapiens; identical to SEQ ID NO: 488969

SEQ ID NO: 725523 - RNA, 64 nt, Homo Sapiens; identical to SEQ ID NO: 488970

SEQ ID NO: 725524 - RNA, 64 nt, Homo Sapiens; identical to SEQ ID NO: 488971

SEQ ID NO: 725525 - RNA, 64 nt, Homo Sapiens; identical to SEQ ID NO: 488972

SEQ ID NO: 725526 - RNA, 64 nt, Homo Sapiens; identical to SEQ ID NO: 488973

SEQ ID NO: 725527 - RNA, 64 nt, Homo Sapiens; identical to SEQ ID NO: 488974

SEQ ID NO: 725528 - RNA, 64 nt, Homo Sapiens; identical to SEQ ID NO: 488975

SEQ ID NO: 725529 - RNA, 64 nt, Homo Sapiens; identical to SEQ ID NO: 488976

SEQ ID NO: 725530 - RNA, 64 nt, Homo Sapiens; identical to SEQ ID NO: 488977

SEQ ID NO: 725531 - RNA, 64 nt, Homo Sapiens; identical to SEQ ID NO: 488978

SEQ ID NO: 725532 - RNA, 64 nt, Homo Sapiens; identical to SEQ ID NO: 488979

SEQ ID NO: 725533 - RNA, 64 nt, Homo Sapiens; identical to SEQ ID NO: 488980

SEQ ID NO: 725534 - RNA, 64 nt, Homo Sapiens; identical to SEQ ID NO: 488981

SEQ ID NO: 725535 - RNA, 64 nt, Homo Sapiens; identical to SEQ ID NO: 488982

SEQ ID NO: 725536 - RNA, 64 nt, Homo Sapiens; identical to SEQ ID NO: 488983

SEQ ID NO: 725537 - RNA, 64 nt, Homo Sapiens; identical to SEQ ID NO: 488984

SEQ ID NO: 725538 - RNA, 64 nt, Homo Sapiens; identical to SEQ ID NO: 488985

SEQ ID NO: 725539 - RNA, 64 nt, Homo Sapiens; identical to SEQ ID NO: 488986

SEQ ID NO: 725540 - RNA, 64 nt, Homo Sapiens; identical to SEQ ID NO: 488987

SEQ ID NO: 725541 - RNA, 64 nt, Homo Sapiens; identical to SEQ ID NO: 488988

SEQ ID NO: 725542 - RNA, 64 nt, Homo Sapiens; identical to SEQ ID NO: 488989

SEQ ID NO: 725543 - RNA, 64 nt, Homo Sapiens; identical to SEQ ID NO: 488990

SEQ ID NO: 725544 - RNA, 64 nt, Homo Sapiens; identical to SEQ ID NO: 488991

SEQ ID NO: 725545 - RNA, 64 nt, Homo Sapiens; identical to SEQ ID NO: 488992

SEQ ID NO: 725546 - RNA, 64 nt, Homo Sapiens; identical to SEQ ID NO: 488993

SEQ ID NO: 725547 - RNA, 64 nt, Homo Sapiens; identical to SEQ ID NO: 488994

SEQ ID NO: 725548 - RNA, 64 nt, Homo Sapiens; identical to SEQ ID NO: 488995

SEQ ID NO: 725549 - RNA, 64 nt, Homo Sapiens; identical to SEQ ID NO: 488996

SEQ ID NO: 725550 - RNA, 64 nt, Homo Sapiens; identical to SEQ ID NO: 488997

SEQ ID NO: 725551 - RNA, 64 nt, Homo Sapiens; identical to SEQ ID NO: 488998

SEQ ID NO: 725552 - RNA, 64 nt, Homo Sapiens; identical to SEQ ID NO: 488999

SEQ ID NO: 725553 - RNA, 64 nt, Homo Sapiens; identical to SEQ ID NO: 489000

SEQ ID NO: 725554 - RNA, 64 nt, Homo Sapiens; identical to SEQ ID NO: 489001

SEQ ID NO: 725555 - RNA, 64 nt, Homo Sapiens; identical to SEQ ID NO: 489002

SEQ ID NO: 725556 - RNA, 64 nt, Homo Sapiens; identical to SEQ ID NO: 489003

SEQ ID NO: 725557 - RNA, 64 nt, Homo Sapiens; identical to SEQ ID NO: 489004

SEQ ID NO: 725558 - RNA, 64 nt, Homo Sapiens; identical to SEQ ID NO: 489005

SEQ ID NO: 725559 - RNA, 64 nt, Homo Sapiens; identical to SEQ ID NO: 489006

SEQ ID NO: 725560 - RNA, 64 nt, Homo Sapiens; identical to SEQ ID NO: 489007

SEQ ID NO: 725561 - RNA, 64 nt, Homo Sapiens; identical to SEQ ID NO: 489008

SEQ ID NO: 725562 - RNA, 64 nt, Homo Sapiens; identical to SEQ ID NO: 489009

SEQ ID NO: 725563 - RNA, 64 nt, Homo Sapiens; identical to SEQ ID NO: 489010

SEQ ID NO: 725564 - RNA, 64 nt, Homo Sapiens; identical to SEQ ID NO: 489011

SEQ ID NO: 725565 - RNA, 64 nt, Homo Sapiens; identical to SEQ ID NO: 489012

SEQ ID NO: 725566 - RNA, 64 nt, Homo Sapiens; identical to SEQ ID NO: 489013

SEQ ID NO: 725567 - RNA, 64 nt, Homo Sapiens; identical to SEQ ID NO: 489014

SEQ ID NO: 725568 - RNA, 64 nt, Homo Sapiens; identical to SEQ ID NO: 489015

SEQ ID NO: 725569 - RNA, 64 nt, Homo Sapiens; identical to SEQ ID NO: 489016

SEQ ID NO: 725570 - RNA, 64 nt, Homo Sapiens; identical to SEQ ID NO: 489017

SEQ ID NO: 725571 - RNA, 64 nt, Homo Sapiens; identical to SEQ ID NO: 489018

SEQ ID NO: 725572 - RNA, 64 nt, Homo Sapiens; identical to SEQ ID NO: 489019

SEQ ID NO: 725573 - RNA, 64 nt, Homo Sapiens; identical to SEQ ID NO: 489020

SEQ ID NO: 725574 - RNA, 64 nt, Homo Sapiens; identical to SEQ ID NO: 489021

SEQ ID NO: 725575 - RNA, 64 nt, Homo Sapiens; identical to SEQ ID NO: 489022

SEQ ID NO: 725576 - RNA, 64 nt, Homo Sapiens; identical to SEQ ID NO: 489023

SEQ ID NO: 725577 - RNA, 64 nt, Homo Sapiens; identical to SEQ ID NO: 489024

SEQ ID NO: 725578 - RNA, 64 nt, Homo Sapiens; identical to SEQ ID NO: 489025

SEQ ID NO: 725579 - RNA, 64 nt, Homo Sapiens; identical to SEQ ID NO: 489026

SEQ ID NO: 725580 - RNA, 64 nt, Homo Sapiens; identical to SEQ ID NO: 489027

SEQ ID NO: 725581 - RNA, 64 nt, Homo Sapiens; identical to SEQ ID NO: 489028

SEQ ID NO: 725582 - RNA, 64 nt, Homo Sapiens; identical to SEQ ID NO: 489029

SEQ ID NO: 725583 - RNA, 64 nt, Homo Sapiens; identical to SEQ ID NO: 489030

SEQ ID NO: 725584 - RNA, 64 nt, Homo Sapiens; identical to SEQ ID NO: 489031

SEQ ID NO: 725585 - RNA, 64 nt, Homo Sapiens; identical to SEQ ID NO: 489032

SEQ ID NO: 725586 - RNA, 64 nt, Homo Sapiens; identical to SEQ ID NO: 489033

SEQ ID NO: 725587 - RNA, 64 nt, Homo Sapiens; identical to SEQ ID NO: 489034

SEQ ID NO: 725588 - RNA, 64 nt, Homo Sapiens; identical to SEQ ID NO: 489035

SEQ ID NO: 725589 - RNA, 64 nt, Homo Sapiens; identical to SEQ ID NO: 489036

SEQ ID NO: 725590 - RNA, 64 nt, Homo Sapiens; identical to SEQ ID NO: 489037

SEQ ID NO: 725591 - RNA, 64 nt, Homo Sapiens; identical to SEQ ID NO: 489038

SEQ ID NO: 725592 - RNA, 64 nt, Homo Sapiens; identical to SEQ ID NO: 489039

SEQ ID NO: 725593 - RNA, 64 nt, Homo Sapiens; identical to SEQ ID NO: 489040

SEQ ID NO: 725594 - RNA, 64 nt, Homo Sapiens; identical to SEQ ID NO: 489041

SEQ ID NO: 725595 - RNA, 64 nt, Homo Sapiens; identical to SEQ ID NO: 489042

SEQ ID NO: 725596 - RNA, 64 nt, Homo Sapiens; identical to SEQ ID NO: 489043

SEQ ID NO: 725597 - RNA, 64 nt, Homo Sapiens; identical to SEQ ID NO: 489044

SEQ ID NO: 725598 - RNA, 64 nt, Homo Sapiens; identical to SEQ ID NO: 489045

SEQ ID NO: 725599 - RNA, 64 nt, Homo Sapiens; identical to SEQ ID NO: 489046

SEQ ID NO: 725600 - RNA, 64 nt, Homo Sapiens; identical to SEQ ID NO: 489047

SEQ ID NO: 725601 - RNA, 64 nt, Homo Sapiens; identical to SEQ ID NO: 489048

SEQ ID NO: 725602 - RNA, 64 nt, Homo Sapiens; identical to SEQ ID NO: 489049

SEQ ID NO: 725603 - RNA, 64 nt, Homo Sapiens; identical to SEQ ID NO: 489050

SEQ ID NO: 725604 - RNA, 64 nt, Homo Sapiens; identical to SEQ ID NO: 489051

SEQ ID NO: 725605 - RNA, 64 nt, Homo Sapiens; identical to SEQ ID NO: 489052

SEQ ID NO: 725606 - RNA, 64 nt, Homo Sapiens; identical to SEQ ID NO: 489053

SEQ ID NO: 725607 - RNA, 64 nt, Homo Sapiens; identical to SEQ ID NO: 489054

SEQ ID NO: 725608 - RNA, 64 nt, Homo Sapiens; identical to SEQ ID NO: 489055

SEQ ID NO: 725609 - RNA, 64 nt, Homo Sapiens; identical to SEQ ID NO: 489056

SEQ ID NO: 725610 - RNA, 64 nt, Homo Sapiens; identical to SEQ ID NO: 489057

SEQ ID NO: 725611 - RNA, 64 nt, Homo Sapiens; identical to SEQ ID NO: 555644

SEQ ID NO: 725612 - RNA, 64 nt, Homo Sapiens; identical to SEQ ID NO: 555645

SEQ ID NO: 725613 - RNA, 64 nt, Homo Sapiens; identical to SEQ ID NO: 555646

SEQ ID NO: 725614 - RNA, 64 nt, Homo Sapiens; identical to SEQ ID NO: 555647

SEQ ID NO: 725615 - RNA, 64 nt, Homo Sapiens; identical to SEQ ID NO: 555648

SEQ ID NO: 725616 - RNA, 64 nt, Homo Sapiens; identical to SEQ ID NO: 555649

SEQ ID NO: 725617 - RNA, 64 nt, Homo Sapiens; identical to SEQ ID NO: 555650

SEQ ID NO: 725618 - RNA, 64 nt, Homo Sapiens; identical to SEQ ID NO: 555651

SEQ ID NO: 725619 - RNA, 64 nt, Homo Sapiens; identical to SEQ ID NO: 555652

SEQ ID NO: 725620 - RNA, 64 nt, Homo Sapiens; identical to SEQ ID NO: 555653

SEQ ID NO: 725621 - RNA, 64 nt, Homo Sapiens; identical to SEQ ID NO: 555654

SEQ ID NO: 725622 - RNA, 64 nt, Homo Sapiens; identical to SEQ ID NO: 555655

SEQ ID NO: 725623 - RNA, 64 nt, Homo Sapiens; identical to SEQ ID NO: 555656

SEQ ID NO: 725624 - RNA, 64 nt, Homo Sapiens; identical to SEQ ID NO: 555657

SEQ ID NO: 725625 - RNA, 64 nt, Homo Sapiens; identical to SEQ ID NO: 555658

SEQ ID NO: 725626 - RNA, 64 nt, Homo Sapiens; identical to SEQ ID NO: 555659

SEQ ID NO: 725627 - RNA, 64 nt, Homo Sapiens; identical to SEQ ID NO: 555660

SEQ ID NO: 725628 - RNA, 64 nt, Homo Sapiens; identical to SEQ ID NO: 555661

SEQ ID NO: 725629 - RNA, 64 nt, Homo Sapiens; identical to SEQ ID NO: 555662

SEQ ID NO: 725630 - RNA, 64 nt, Homo Sapiens; identical to SEQ ID NO: 555663

SEQ ID NO: 725631 - RNA, 64 nt, Homo Sapiens; identical to SEQ ID NO: 146945

SEQ ID NO: 725632 - RNA, 64 nt, Homo Sapiens; identical to SEQ ID NO: 146946

SEQ ID NO: 725633 - RNA, 64 nt, Homo Sapiens; identical to SEQ ID NO: 146947

SEQ ID NO: 725634 - RNA, 64 nt, Homo Sapiens; identical to SEQ ID NO: 146948

SEQ ID NO: 725635 - RNA, 64 nt, Homo Sapiens; identical to SEQ ID NO: 146949

SEQ ID NO: 725636 - RNA, 64 nt, Homo Sapiens; identical to SEQ ID NO: 146950

SEQ ID NO: 725637 - RNA, 64 nt, Homo Sapiens; identical to SEQ ID NO: 146951

SEQ ID NO: 725638 - RNA, 64 nt, Homo Sapiens; identical to SEQ ID NO: 146952

SEQ ID NO: 725639 - RNA, 64 nt, Homo Sapiens; identical to SEQ ID NO: 146953

SEQ ID NO: 725640 - RNA, 64 nt, Homo Sapiens; identical to SEQ ID NO: 146954

SEQ ID NO: 725641 - RNA, 64 nt, Homo Sapiens; identical to SEQ ID NO: 146955

SEQ ID NO: 725642 - RNA, 64 nt, Homo Sapiens; identical to SEQ ID NO: 146956

SEQ ID NO: 725643 - RNA, 64 nt, Homo Sapiens; identical to SEQ ID NO: 146957

SEQ ID NO: 725644 - RNA, 64 nt, Homo Sapiens; identical to SEQ ID NO: 146958

SEQ ID NO: 725645 - RNA, 64 nt, Homo Sapiens; identical to SEQ ID NO: 146959

SEQ ID NO: 725646 - RNA, 64 nt, Homo Sapiens; identical to SEQ ID NO: 146960

SEQ ID NO: 725647 - RNA, 64 nt, Homo Sapiens; identical to SEQ ID NO: 146961

SEQ ID NO: 725648 - RNA, 64 nt, Homo Sapiens; identical to SEQ ID NO: 146962

SEQ ID NO: 725649 - RNA, 64 nt, Homo Sapiens; identical to SEQ ID NO: 146963

SEQ ID NO: 725650 - RNA, 64 nt, Homo Sapiens
caggaccagaguuaagcugauaccuuaggcacacagguuggacuuacauagaggaaagaaagca

SEQ ID NO: 725651 - RNA, 64 nt, Homo Sapiens
uuuuuuuuuuucccagagucuugcucugucgcccagguuggagugcaguggcacgaucucggcu

SEQ ID NO: 725652 - RNA, 64 nt, Homo Sapiens
ugugugccggcauccuugauggguucaaagagaaagguuggagaugauagugggugagaagcag

SEQ ID NO: 725653 - RNA, 64 nt, Homo Sapiens
agugggugagaagcaggcuggugagacugggcugagguuggagaaggggcagccgggggcacug

SEQ ID NO: 725654 - RNA, 64 nt, Homo Sapiens
gcagggccuguaaucccagcauuuuaggaggccaagguuggaggaucauuugagcccaggaauu

SEQ ID NO: 725655 - RNA, 64 nt, Homo Sapiens
uuuuugucugagacagaaucucagucugucacccagguuggagugcaguggcgugaucucagcu

SEQ ID NO: 725656 - RNA, 64 nt, Homo Sapiens; identical to SEQ ID NO: 220196

SEQ ID NO: 725657 - RNA, 64 nt, Homo Sapiens; identical to SEQ ID NO: 220197

SEQ ID NO: 725658 - RNA, 64 nt, Homo Sapiens; identical to SEQ ID NO: 220198

SEQ ID NO: 725659 - RNA, 64 nt, Homo Sapiens; identical to SEQ ID NO: 220199

SEQ ID NO: 725660 - RNA, 64 nt, Homo Sapiens; identical to SEQ ID NO: 220200

SEQ ID NO: 725661 - RNA, 64 nt, Homo Sapiens; identical to SEQ ID NO: 220201

SEQ ID NO: 725662 - RNA, 61 nt, Homo Sapiens; identical to SEQ ID NO: 220202

SEQ ID NO: 725663 - RNA, 64 nt, Homo Sapiens; identical to SEQ ID NO: 220203

SEQ ID NO: 725664 - RNA, 64 nt, Homo Sapiens; identical to SEQ ID NO: 220204

SEQ ID NO: 725665 - RNA, 64 nt, Homo Sapiens; identical to SEQ ID NO: 220205

SEQ ID NO: 725666 - RNA, 64 nt, Homo Sapiens; identical to SEQ ID NO: 220206

SEQ ID NO: 725667 - RNA, 64 nt, Homo Sapiens; identical to SEQ ID NO: 220207

SEQ ID NO: 725668 - RNA, 64 nt, Homo Sapiens; identical to SEQ ID NO: 220208

SEQ ID NO: 725669 - RNA, 64 nt, Homo Sapiens; identical to SEQ ID NO: 220209

SEQ ID NO: 725670 - RNA, 64 nt, Homo Sapiens; identical to SEQ ID NO: 220210

SEQ ID NO: 725671 - RNA, 64 nt, Homo Sapiens; identical to SEQ ID NO: 220211

SEQ ID NO: 725672 - RNA, 64 nt, Homo Sapiens; identical to SEQ ID NO: 220212

SEQ ID NO: 725673 - RNA, 64 nt, Homo Sapiens; identical to SEQ ID NO: 220213

SEQ ID NO: 725674 - RNA, 64 nt, Homo Sapiens; identical to SEQ ID NO: 220214

SEQ ID NO: 725675 - RNA, 64 nt, Homo Sapiens; identical to SEQ ID NO: 220215

SEQ ID NO: 725676 - RNA, 64 nt, Homo Sapiens; identical to SEQ ID NO: 220216

SEQ ID NO: 725677 - RNA, 64 nt, Homo Sapiens; identical to SEQ ID NO: 220217

SEQ ID NO: 725678 - RNA, 64 nt, Homo Sapiens
cuucugagguauuuucaugaucccaccauggucauaucuugaaguauggucuagaaaagucccu

SEQ ID NO: 725679 - RNA, 64 nt, Homo Sapiens
cuacuauaaggcuuguuugaucccaaauggugcuuaucuugauugaacauucagaacaaggaua

SEQ ID NO: 725680 - RNA, 64 nt, Homo Sapiens
auauauauuaccuuagugugcauuuucuauauaauaucuugauggacucuuuuauaaaauuauu

SEQ ID NO: 725681 - RNA, 64 nt, Homo Sapiens
guuugugauccugaacccuuggacuuuucucggguaucuugaggacuaggcgacucacauuuga

SEQ ID NO: 725682 - RNA, 64 nt, Homo Sapiens
uucacugaaauuauaugguuuuuaaugguauaacuaucuugauuauuucugaauugauguuuuu

SEQ ID NO: 725683 - RNA, 64 nt, Homo Sapiens
guacucuccagaaaauuuuuuucuaauaauacacuaucuugauucaagcuucuauuaauguuau

SEQ ID NO: 725684 - RNA, 64 nt, Homo Sapiens
guuauuuauuagaugacuauucaggacugagaaauaucuugaagagauaaagugaaaguuuauu

SEQ ID NO: 725685 - RNA, 64 nt, Homo Sapiens
auggacuuaguacccaugcugaagauaaauuugcuaucuugacaguccagcugaagacaaauca

SEQ ID NO: 725686 - RNA, 64 nt, Homo Sapiens
aauuuuaaaauguugacaccucuuuucugguuaauaucuugaguaguuuuaaaggccauaauca

SEQ ID NO: 725687 - RNA, 64 nt, Homo Sapiens
auuagauuuauguuuuuaaaaucuguugucuccauaucuugauggcuuuugggagcauuucaca

SEQ ID NO: 725688 - RNA, 64 nt, Homo Sapiens
ucuguccgaugucuacauucagguucugacuucauaucuugaaaaaggauuuccucccugucuu

SEQ ID NO: 725689 - RNA, 64 nt, Homo Sapiens
cauuaauuuuuggguuuuuucuuuagcaauguaguaucuugagcuuuuuacuuuuuuccccuaa

SEQ ID NO: 725690 - RNA, 64 nt, Homo Sapiens
cucccaacauuuuucuuaugauugaaagccuucguaucuugaacgcuaaagucuguuauacaga

SEQ ID NO: 725691 - RNA, 64 nt, Homo Sapiens
auuccgacguguaacucacauaagguacaucauuuaucuugaacuucugacguguaaaggacca

SEQ ID NO: 725692 - RNA, 64 nt, Homo Sapiens
auucugacguguaaaggaccuaagguacaucaguuaucuugaacagucuuccuuucaaggacca

SEQ ID NO: 725693 - RNA, 64 nt, Homo Sapiens
uucugcaugucuuguaaagaugcauaucuugacauaucuugagaccuucagguauuaaacuugc

SEQ ID NO: 725694 - RNA, 64 nt, Homo Sapiens
uaucuugagauucugcauguuuaaacuugcugcauaucuugacauuuauguuaaccuucaggua

SEQ ID NO: 725695 - RNA, 64 nt, Homo Sapiens
caauaugauuagguauuuugaaaccuaauguuuuuaucuugaguagacucuuuuaaaaaaaaaa

SEQ ID NO: 725696 - RNA, 64 nt, Homo Sapiens
cuaaagaaugcugacuuuuccuauuuaaacuuaauaucuugaaccaugaggccacauucagcug

SEQ ID NO: 725697 - RNA, 64 nt, Homo Sapiens
auuaaauuguaaaauaaauggacuuauugaagcauaucuugauuuuuaagcuuaucuugauuuu

SEQ ID NO: 725698 - RNA, 64 nt, Homo Sapiens
uggacuuauugaagcauaucuugauuuuuaagcuuaucuugauuuucaaacaugcauagcuauu

SEQ ID NO: 725699 - RNA, 64 nt, Homo Sapiens; identical to SEQ ID NO: 220423

SEQ ID NO: 725700 - RNA, 64 nt, Homo Sapiens; identical to SEQ ID NO: 220424

SEQ ID NO: 725701 - RNA, 64 nt, Homo Sapiens
cucccuggggugggguugcuggaccuucaauccaucgcuacaguccagaaggcaauuggccacu

SEQ ID NO: 725702 - RNA, 64 nt, Homo Sapiens
gcugaauaaaaacuuaagcugcaaauugauaacuucgcuacauaacaaggaaaauauaaauguu

SEQ ID NO: 725703 - RNA, 64 nt, Homo Sapiens
ccucuucucuccuauaaggaggcugucacuuuauucgcuacacgccugcggguccagggugggg

SEQ ID NO: 725704 - RNA, 64 nt, Homo Sapiens
caagaccucccuggaacccuccucaucugucacaucgcuacagauguccucugagcugcaguuu

SEQ ID NO: 725705 - RNA, 64 nt, Homo Sapiens
cuggccguggcagaugcuguggcaugaacacugcucgcuacaagaaguggugcgccgcagcgcg

SEQ ID NO: 725706 - RNA, 64 nt, Homo Sapiens
ugcccaggcuggagugcaguggcgugaucuccgcucgcuacaaccuccaccucccagcugccug

SEQ ID NO: 725707 - RNA, 64 nt, Homo Sapiens
gcuggugugugcauucugagaagaaagguugugcucgcuacacuugaaaaacguucuuauuuua

SEQ ID NO: 725708 - RNA, 64 nt, Homo Sapiens
gcaauguuugguuaauguuuguauuacuuggaaaucgcuacagcuuggacuauuuuuuucuaaa

SEQ ID NO: 725709 - RNA, 64 nt, Homo Sapiens
aaggaccugaagugacuuugaggugccaacacugucgcuacaguaaggugagagaggacacaga

SEQ ID NO: 725710 - RNA, 64 nt, Homo Sapiens
gcaccuaucuguuaucgcuggccguuggaggccaucgcuacaggcccagggcuggguguaggua

SEQ ID NO: 725711 - RNA, 64 nt, Homo Sapiens
aaugucuuccacaacucaaaccuucaggccugguucgcuacaacuuacaacccuuacagguggg

SEQ ID NO: 725712 - RNA, 64 nt, Homo Sapiens
cacugccugggcaguggcacaaccaucccccaugucgcuacagaacaugggcccagagcaccuu

SEQ ID NO: 725713 - RNA, 64 nt, Homo Sapiens
guagguaagguggggauugaaagacuuacaggccucgcuacaaggcuuuuagaccaaaauauga

SEQ ID NO: 725714 - RNA, 64 nt, Homo Sapiens
uauuuaggggacaaacuccacacccuuuucuuuaucgcuacauucugaugaaacugauuuggag

SEQ ID NO: 725715 - RNA, 64 nt, Homo Sapiens
ccugcuggccggacacccgacuccaguccaagucucgcuacauuuccgccacaucccucucugc

SEQ ID NO: 725716 - RNA, 64 nt, Homo Sapiens
guuucagaacuucuguuucacaacaauuucucucucgcuacaaguauucuuucacucagcacug

SEQ ID NO: 725717 - RNA, 64 nt, Homo Sapiens
cagugcucauuuugagauacccugcuaucgauggucgcuacaaaccaggaaauacucaaguuau

SEQ ID NO: 725718 - RNA, 64 nt, Homo Sapiens
cacugacaccagcuggcguccagaaacagcaucuucgcuacaacugcuguuugcucaugguaaa

SEQ ID NO: 725719 - RNA, 64 nt, Homo Sapiens
guccuccucaccggccgaaguacacacuugccucucgcuacagcuuagaucggaagccaguuuc

SEQ ID NO: 725720 - RNA, 64 nt, Homo Sapiens
gucugauacucccuuugucuucccucucuacuccucgcuacaccugagccaggcucuugccaac

SEQ ID NO: 725721 - RNA, 64 nt, Homo Sapiens
aaaaaaauuuaaacaaguguuaacuuuaaacaguucgcuacaaguaaaugauuauaaauacuac

SEQ ID NO: 725722 - RNA, 64 nt, Homo Sapiens
uugaagcaguuuucauguaaucauugccaccucuucgcuacaugaacuacuauugauaccagca

SEQ ID NO: 725723 - RNA, 64 nt, Homo Sapiens
aaaugugcuuuauuugauccaaaaaguucagacaucgcuacaauuuuucucuuaacacauagga

SEQ ID NO: 725724 - RNA, 64 nt, Homo Sapiens
gugggcucagaccucauuucaggcaccagauuggucgcuacacccuggacaagugacugcccgu

SEQ ID NO: 725725 - RNA, 64 nt, Homo Sapiens
aaauacaaaaguuagccagguaguaagacccccaucgcuacaaacaagaccagccugggcaaug

SEQ ID NO: 725726 - RNA, 64 nt, Homo Sapiens
ccuugcccccuguccauuuagucacccucuguucucgcuacauccccaggcugcuggccggaca

SEQ ID NO: 725727 - RNA, 64 nt, Homo Sapiens
aaucgaagauugaggacuacuuuccagaauuugcucgcuacacuacuccugaggauggugugua

SEQ ID NO: 725728 - RNA, 64 nt, Homo Sapiens
gggccagcucuuggcuaagaccaggaggcugcaagucuccuagaagcccucugagcuccagagg

SEQ ID NO: 725729 - RNA, 64 nt, Homo Sapiens
ugcaauaugaaaccagccaacugcuuuuugugcggucuccuauaggaaguaucgcaauuguuuu

SEQ ID NO: 725730 - RNA, 64 nt, Homo Sapiens
auauguuucaaaaagaauuagcauagaaauccuggucuccuagccaaaaaaaucaaaggauuuu

SEQ ID NO: 725731 - RNA, 64 nt, Homo Sapiens
caugucuccauucuucucugucucugucuugcaugucuccuaccaugucacugucccugggcca

SEQ ID NO: 725732 - RNA, 64 nt, Homo Sapiens
ugaauaggaauauucaagauuauaaagguaucaggucuccuaaaauugaucuauggauuuaaua

SEQ ID NO: 725733 - RNA, 64 nt, Homo Sapiens
cagccauccccuccugugggacccucaaaaaacagucuccuaacugcuuaaaaugaugaaacca

SEQ ID NO: 725734 - RNA, 64 nt, Homo Sapiens
caaauacucacaagggucuucagaaaugcuuuuggucuccuaccggcuaauuguguacccuuug

SEQ ID NO: 725735 - RNA, 64 nt, Homo Sapiens
cuucauggccuuuguaccugccgggaaaaugccggucuccuacuaggcagucaccuucuuaggc

SEQ ID NO: 725736 - RNA, 64 nt, Homo Sapiens
gugcugggauuauaggugugaucugccugccuuggucuccuaaaugaacuccugggcuuaagug

SEQ ID NO: 725737 - RNA, 64 nt, Homo Sapiens
ggugccugggaaguccuugauuuauagguuucaggucuccuaugcccuuaaaucuagacuucuc

SEQ ID NO: 725738 - RNA, 64 nt, Homo Sapiens
caccuguaucucuuguugggcugcuugucuaccugucuccuaccccuuucuccaggcucccuac

SEQ ID NO: 725739 - RNA, 64 nt, Homo Sapiens
uauuucuauuauuaauugcauguuuccugacauugucuccuauaauuuaaauuacaauuuuauc

SEQ ID NO: 725740 - RNA, 64 nt, Homo Sapiens
uguguguuuucaaauguguaaauagaucuuaacugucuccuacacuagacauuaucacagacug

SEQ ID NO: 725741 - RNA, 64 nt, Homo Sapiens
caugcugacugcauccgaaacuccaaggccucaugucuccuaaguucccucccuuagcccaacc

SEQ ID NO: 725742 - RNA, 64 nt, Homo Sapiens
acuucggagccaugggggcagugugagggaaccugucuccuaccggagcuggaaucugccuccg

SEQ ID NO: 725743 - RNA, 64 nt, Homo Sapiens
ucugcucuuggaggagaugguguuugcuucaacugucuccuaccguaauuuuuacagaauugcu

SEQ ID NO: 725744 - RNA, 64 nt, Homo Sapiens
caguacgcacgaucuggucuaucgaaaagcccaugucuccuaugagaugcaacaagaugagcua

SEQ ID NO: 725745 - RNA, 64 nt, Homo Sapiens
aaaccugauaccaagaagacucgguggacggggcgucuccuaaugugcaaccuccauaaauaug

SEQ ID NO: 725746 - RNA, 64 nt, Homo Sapiens
ugagaaauaucacauugccccugauguuuugacagucuccuagugcuccugguagugccacuaa

SEQ ID NO: 725747 - RNA, 64 nt, Homo Sapiens
agagaauaauguuacauguuuaauuguaauauuugucuccuaucauuuucuucccuuucaguca

SEQ ID NO: 725748 - RNA, 64 nt, Homo Sapiens
cuauauccauucuuuauaucaauguauaguuuuagucuccuaaauugaucuguuauuuuccaaa

SEQ ID NO: 725749 - RNA, 64 nt, Homo Sapiens
ugcaccaaguaugccuaccccuggccagucugaggucuccuagccauagaacugacuccuggaa

SEQ ID NO: 725750 - RNA, 64 nt, Homo Sapiens
uuuuaagaaaaaacuuuuaaaaauauuucuuauagucuccuaacauuugucucuagccuuugcc

SEQ ID NO: 725751 - RNA, 64 nt, Homo Sapiens
agaaauuuucugacacacugauggcaugugacuugucuccuaagucagugaggcaucacuuugu

SEQ ID NO: 725752 - RNA, 64 nt, Homo Sapiens
augaggaaaauuacugaagaauaaguuuccauaagucuccuacauagcaguguuauuuauguac

SEQ ID NO: 725753 - RNA, 64 nt, Homo Sapiens
aaacuauuuaacauucuuuuguuuauauuguuuugucuccuaaauuguuguaauugcauuauaa

SEQ ID NO: 725754 - RNA, 64 nt, Homo Sapiens
uuacuaacuuacuuaccuaaacuuugccuaauaagucuccuaggcacacauacacgcucuauua

SEQ ID NO: 725755 - RNA, 64 nt, Homo Sapiens
uuggaauggguaaaguacaacauauugauuucaagucuccuaaugugucaauuugcaucauuug

SEQ ID NO: 725756 - RNA, 64 nt, Homo Sapiens
ggcagccugaaugccucccucuguucaagaaggugucuccuagguuccuuguaguucucaggac

SEQ ID NO: 725757 - RNA, 64 nt, Homo Sapiens
aauccugggacauuggauccguagugggucccuggucuccuacagaacugccauuaucagugga

SEQ ID NO: 725758 - RNA, 64 nt, Homo Sapiens
cacuccccacgggaaacucacauagcuuucacaagucuccuagagcauuaagucaguggcuuug

SEQ ID NO: 725759 - RNA, 64 nt, Homo Sapiens
caucuucuaguuauauucucagcugucaauuuuugucuccuaaaaucucuuuucccuuuauuca

SEQ ID NO: 725760 - RNA, 64 nt, Homo Sapiens
aucuccuguuuagcaccaaauccugcagguagcagucuccuauucccacugaguguguacuggu

SEQ ID NO: 725761 - RNA, 64 nt, Homo Sapiens
aucuuagagaaaguuuuacaaaaauaggcgcuuugucuccuacaggaauguguccauugaaaag

SEQ ID NO: 725762 - RNA, 64 nt, Homo Sapiens
gaugcuguuucucguuaguggcaguagugccuccgucuccuagugauaaugcuccaagucuaug

SEQ ID NO: 725763 - RNA, 64 nt, Homo Sapiens
aucugaaaccaaaucaagacacagaacaaggucugucuccuauagucacucaagaagucgaucg

SEQ ID NO: 725764 - RNA, 64 nt, Homo Sapiens
uaggggguguggguucaucacaguguugccuuuugucuccuaaagauagggaucuacuuuugaa

SEQ ID NO: 725765 - RNA, 64 nt, Homo Sapiens
gcccagggcacugccaggguucaaugggccagccgucuccuacuccaccuuggauuuuucucuc

SEQ ID NO: 725766 - RNA, 64 nt, Homo Sapiens
ucuccuccuauuuaugaaaaccauaugauauuuugucuccuaccugcugcugcuauuauguaac

SEQ ID NO: 725767 - RNA, 64 nt, Homo Sapiens
aguccucuguguaguuucagaccagaccugaauagucuccuaugcccuccaaaagucggguccu

SEQ ID NO: 725768 - RNA, 64 nt, Homo Sapiens
acccucccaccagcugcugcgaaaagcacuuucagucuccuauauaauccaccacgguuaacug

SEQ ID NO: 725769 - RNA, 64 nt, Homo Sapiens
uggcguguacugcaagaccuaaaggaauuuuauagucuccuaaauuguucacauggcauaaaug

SEQ ID NO: 725770 - RNA, 64 nt, Homo Sapiens
uagagauauucuagaaaaugguuuuuuuuccuuagucuccuacucuucuuuuacuuuuuauaaa

SEQ ID NO: 725771 - RNA, 64 nt, Homo Sapiens
aacugugccucggguuuuucgaaucacugggggugucuccuaagugcaguugcugucugcuucu

SEQ ID NO: 725772 - RNA, 64 nt, Homo Sapiens
ugaaacauuauuucuaaauacuauuuaagccuuugucuccuaaccauaacuagagcacuucaau

SEQ ID NO: 725773 - RNA, 64 nt, Homo Sapiens
aaugcuuuaguaagaauaugaacaauuuccugaugucuccuauaaauugugauuguuuauucua

SEQ ID NO: 725774 - RNA, 64 nt, Homo Sapiens
uaccagucucuucaaaaacuucucgaaccgcugugucuccuacguaaaaaaagagauguacaaa

SEQ ID NO: 725775 - RNA, 64 nt, Homo Sapiens
aaguuccucugaagacugcucagugucauuauuagucuccuaauuuuuaacagcaugugggugu

SEQ ID NO: 725776 - RNA, 64 nt, Homo Sapiens
ucacuagaucagcgcacaagauaagaucaaaaaggucuccuaaccugagcaugucaagaaacug

SEQ ID NO: 725777 - RNA, 64 nt, Homo Sapiens
cuaggguugagcaauuuuaagguugagacuccaagucuccuaaaauucuaggagagaaauaaag

SEQ ID NO: 725778 - RNA, 64 nt, Homo Sapiens
caaagcuaaauauucuagcaucuuaccugcuuaugucuccuacaaaaauuauuugguguggcca

SEQ ID NO: 725779 - RNA, 64 nt, Homo Sapiens
auccaaaaugugcaucacaguuuuggggcucaaugucuccuacuaccaugcuuuauguuaaaca

SEQ ID NO: 725780 - RNA, 64 nt, Homo Sapiens
cucuauuucugacucucauuuuuggucucugugugucuccuagucacuuucuuucucacucugu

SEQ ID NO: 725781 - RNA, 64 nt, Homo Sapiens
aguccccagguccucagggccccagagcgggagggucuccuaccuggaagucccccugagcucc

SEQ ID NO: 725782 - RNA, 64 nt, Homo Sapiens
aagaagucaccgacgguagcuucagugcucaguggucuccuaguaaacauauuagaaaccuuga

SEQ ID NO: 725783 - RNA, 64 nt, Homo Sapiens
uaaugacagcuugacuuaacuuagcaacacagcagucuccuaauaguuaaaaaugcauauaacg

SEQ ID NO: 725784 - RNA, 64 nt, Homo Sapiens
aaaauagcacugaacagggagucaggagacuauugucuccuaaacccaggacuagaguucccuc

SEQ ID NO: 725785 - RNA, 64 nt, Homo Sapiens
acauucuggauuucagaguagagauuucuguguugucuccuagaaagcauuacauguaguuuau

SEQ ID NO: 725786 - RNA, 64 nt, Homo Sapiens
uucagacucauggauuggucugaggggucugaacgucuccuagccaaucagaacuggcugugga

SEQ ID NO: 725787 - RNA, 64 nt, Homo Sapiens
aauuuaauauacuuuauaaauaaguaucuaaaaugucuccuacuuuuuuccuauuucuuugcca

SEQ ID NO: 725788 - RNA, 64 nt, Homo Sapiens
aaaacaaaucacuuucauuaauaaaggguuaaaagucuccuagucauucaacauagugucacaa

SEQ ID NO: 725789 - RNA, 64 nt, Homo Sapiens
cuaaaugagaaugaaagcgauuugcuguugaucggucuccuaggucagccuuauccagguuggu

SEQ ID NO: 725790 - RNA, 64 nt, Homo Sapiens
gcggguccuccagggcaaggggaacgggaaauaggucuccuaggugccugaagcgcugagcaac

SEQ ID NO: 725791 - RNA, 64 nt, Homo Sapiens
uacaauaaauaaaauacuugaaauucucuuuugugucuccuaguagcuuccuacucaacuauuu

SEQ ID NO: 725792 - RNA, 64 nt, Homo Sapiens
uuacuugucuaaaaguaaaaaaaaauaucagccugucuccuaggucaguccccuccuggaccca

SEQ ID NO: 725793 - RNA, 64 nt, Homo Sapiens
ccgccgcugcuccccuccccagacaccucuccacgucuccuacccagggggucgcaucccuagc

SEQ ID NO: 725794 - RNA, 64 nt, Homo Sapiens
gguguuuuguaaaggauaucaucuucauagcaaugucuccuaaaacuucaguauuaaauuagau

SEQ ID NO: 725795 - RNA, 64 nt, Homo Sapiens
uugaaaacugaaugucagggauacuguagaaccugucuccuacuguguuggaaacuguaaaaug

SEQ ID NO: 725796 - RNA, 64 nt, Homo Sapiens
gucuuugagucagcuuuaugcacuuucuacaaaagucuccuaggauguagugccuuuacuauuu

SEQ ID NO: 725797 - RNA, 64 nt, Homo Sapiens
caccauuuugucaggugggagacugcuuuggauagucuccuacguccaaagaagauagcucucu

SEQ ID NO: 725798 - RNA, 64 nt, Homo Sapiens
gcuccuucuccccuugcacaccuccugcaugagggucuccuacucugaggacugcggcucccuc

SEQ ID NO: 725799 - RNA, 64 nt, Homo Sapiens
uucagcugaacacaagcaaaccuucucaggaggugucuccuacccucuuauuguuccucuuacg

SEQ ID NO: 725800 - RNA, 64 nt, Homo Sapiens
ccaauaaagguucuggcacuucaaugccaggcaggucuccuaaaugaacagaaugaucugugug

SEQ ID NO: 725801 - RNA, 64 nt, Homo Sapiens
uuuugagcgguuuuguaauuugacauuuaggagagucuccuauuuauucucauacuuuacauuc

SEQ ID NO: 725802 - RNA, 64 nt, Homo Sapiens
cauuagaguuuuucuauuacaaaaguuauuuuaugucuccuaagucuggcuugacuuuuauggg

SEQ ID NO: 725803 - RNA, 64 nt, Homo Sapiens
cuacucugaaccauaaacccccaggcugccugaggucuccuauuucccacgaggccagagguug

SEQ ID NO: 725804 - RNA, 64 nt, Homo Sapiens
cugaaaugcugcauuuuaauuuuaaccaaaacaugucuccuauccugguuuuuguagccuuccu

SEQ ID NO: 725805 - RNA, 64 nt, Homo Sapiens
uugucuucagaauaacuaucucccuuucugaucugucuccuacucuuuagauguucucagucaa

SEQ ID NO: 725806 - RNA, 64 nt, Homo Sapiens
auggccccaaaggcugagggccccaaagccacuugucuccuaggauccaggccucugggcuucu

SEQ ID NO: 725807 - RNA, 64 nt, Homo Sapiens
uuuguacaugucccuuggcaaaauucuuucuggugucuccuaacuucagagacagggacucuuu

SEQ ID NO: 725808 - RNA, 64 nt, Homo Sapiens
gauagcauaggaaaauguucuggugauugucagggucuccuaauauuuaucucaauucuuuuau

SEQ ID NO: 725809 - RNA, 64 nt, Homo Sapiens
gaagccuuaaugugguauucaggcaaaggugccugucuccuaggaauacaggaugggcccauga

SEQ ID NO: 725810 - RNA, 64 nt, Homo Sapiens
auuuuaagcuucacguaauauauuugaggaauaagucuccuaaaugagcauaaaagucaauaca

SEQ ID NO: 725811 - RNA, 64 nt, Homo Sapiens
aaaccuuccugugggccaggcuaaacccuccuuagucuccuagauuauaguggcuucucuuuuu

SEQ ID NO: 725812 - RNA, 64 nt, Homo Sapiens
agccuacacuggcucugcugcagccugggcauuugucuccuagcguacuguggagagcauaguc

SEQ ID NO: 725813 - RNA, 64 nt, Homo Sapiens
caccuguaaugugcgagggaagagcaggacugaugucuccuaagccaggcauguggcagggguu

SEQ ID NO: 725814 - RNA, 63 nt, Homo Sapiens
guccaugcagaauuuucuguaggauccagaguugucuccuaugucaaccuaggauuucucuga

SEQ ID NO: 725815 - RNA, 64 nt, Homo Sapiens
uaucauuuauaccagacauuaugaaguuauuaaagucuccuauacucuguacaccagaacugug

SEQ ID NO: 725816 - RNA, 64 nt, Homo Sapiens
ugccaccuggcaaaggacccuugaguaagugaaggucuccuaaaacugggauuaagaaaccuug

SEQ ID NO: 725817 - RNA, 64 nt, Homo Sapiens
cucucgaucacggggugggugcccccgacaccgggucuccuagcuugaguucccuagaagcgaa

SEQ ID NO: 725818 - RNA, 64 nt, Homo Sapiens
cuagaggaauugagcaaaacagaagaaucaugaagucuccuaccuucuacagccuuguaguucu

SEQ ID NO: 725819 - RNA, 64 nt, Homo Sapiens
ggugcugaaguacuguaaguagaauucaucaacggucuccuaauuuuugcaucuacaucugggg

SEQ ID NO: 725820 - RNA, 64 nt, Homo Sapiens
gugacuaucugacuguugauggccacagaugauggucuccuaugguauaguucacucuguagaa

SEQ ID NO: 725821 - RNA, 64 nt, Homo Sapiens
auuccaugggccaguaugccaguuugaauucucagucuccuagcaucuugugaguugcauauua

SEQ ID NO: 725822 - RNA, 64 nt, Homo Sapiens
gaggacguggccccugcugcguggcucugugggugucuccuagaacugccacacgcgugcacau

SEQ ID NO: 725823 - RNA, 64 nt, Homo Sapiens
gaugagugcuugggauuucuuguuuugacaucuggucuccuagaaauguugccagaggugguug

SEQ ID NO: 725824 - RNA, 64 nt, Homo Sapiens
cccuagugauuuuuggauaauuccaguuguuuuugucuccuaaaaacauacaagagacaugaga

SEQ ID NO: 725825 - RNA, 64 nt, Homo Sapiens
gaaacaccaucugauucagagauagguaccuaaugucuccuacaggauuuugagcuuuacaggu

SEQ ID NO: 725826 - RNA, 64 nt, Homo Sapiens
gcuuuauccaucaccaccugccugacacuugauugucuccuaaugccguucuuauugaccaauu

SEQ ID NO: 725827 - RNA, 64 nt, Homo Sapiens
cuccagcucugauucgccauuccuugcaucccuagucuccuaaacuccuuaaugccuccaaggg

SEQ ID NO: 725828 - RNA, 64 nt, Homo Sapiens
uuggggagaugaaccaaccacucauggaaaaauugucuccuaauacuuuuaauguggacuuuua

SEQ ID NO: 725829 - RNA, 64 nt, Homo Sapiens
gcguccucaguagguguuugggaauaugggaagggucuccuauuuauucaauagaguuuucuca

SEQ ID NO: 725830 - RNA, 64 nt, Homo Sapiens
ggugagcgcugugagauggauguauuuguagccagucuccuauacccagcagagggauaaccca

SEQ ID NO: 725831 - RNA, 64 nt, Homo Sapiens
ucuggagcagcauucauuuaucuucgucugccuugucuccuaccuaagugugugucgccacccg

SEQ ID NO: 725832 - RNA, 64 nt, Homo Sapiens
ccgcauuuacggcugcauucuguaagugggcauggucuccuaauggaggaguguucauuguaua

SEQ ID NO: 725833 - RNA, 64 nt, Homo Sapiens
agugggcccuguucaugcgaaauccacauccauggucuccuagaccugcuacccugguacuucc

SEQ ID NO: 725834 - RNA, 64 nt, Homo Sapiens
uguucucuucuguccugucuuauacugcaacugugucuccuaggggacagauggccuucuuugu

SEQ ID NO: 725835 - RNA, 64 nt, Homo Sapiens
gagagaugauuggcugugacgccuuugucaccaggucuccuaugucccaacgaacccaccuauu

SEQ ID NO: 725836 - RNA, 64 nt, Homo Sapiens
ucguauuauuucuccacgucuguuuuaguuuaaugucuccuaagcuuuucucucauagcguaga

SEQ ID NO: 725837 - RNA, 64 nt, Homo Sapiens
aaaccugacggauuaacuaagcacacugggaugugucuccuacaguuggcuucucucuuugaug

SEQ ID NO: 725838 - RNA, 64 nt, Homo Sapiens
auucaacaucauucugaaccgauuacaaguuugagucuccuaguaacuagcugucaguuucaag

SEQ ID NO: 725839 - RNA, 64 nt, Homo Sapiens
cuuaaugugggaggguaguuaggggugagagugcgucuccuagcuuuguuuagacagcacaaga

SEQ ID NO: 725840 - RNA, 64 nt, Homo Sapiens
aagaucaggaugaaagaccuagguuaccuauauagucuccuaggacaauuccaugugcaccuuu

SEQ ID NO: 725841 - RNA, 64 nt, Homo Sapiens
auaccagggaauuugagcuuauugagaucuuuuugucuccuauauuguaaaguaaaugaaagcu

SEQ ID NO: 725842 - RNA, 64 nt, Homo Sapiens
aaagguguaaauguuuucaucucuuaggcuugcugucuccuaaggucacccaagcagugguugg

SEQ ID NO: 725843 - RNA, 64 nt, Homo Sapiens
agcccaggccacccuaucgcccccuacgcgccuugucuccuacuccugacuccuaccugcccug

SEQ ID NO: 725844 - RNA, 64 nt, Homo Sapiens
uuagcauucuaaugguuugaguugaauaaacucagucuccuacauaagggcucaguaaauacuu

SEQ ID NO: 725845 - RNA, 64 nt, Homo Sapiens
ucgauuggacaggagccuucccugggagggagaggucuccuaacuggagauuucuggauccuuc

SEQ ID NO: 725846 - RNA, 64 nt, Homo Sapiens
gguguaauugacuaggaaggugugccuauuuaaagucuccuaaauauaagcccuuugucguuuc

SEQ ID NO: 725847 - RNA, 64 nt, Homo Sapiens
uguuuuuuuuuuuuuugagacagagucuuccucugucuccuaagcuggagugcaguggcaucau

SEQ ID NO: 725848 - RNA, 64 nt, Homo Sapiens
gagcaacaucuauagagaucuacuuuucuccuaugucuccuaggcuuuccaugauaauuaggua

SEQ ID NO: 725849 - RNA, 64 nt, Homo Sapiens
uaccccaguuuguaaggaaaaaagcuauuaucaggucuccuaacuuuggugccaagaaaauaaa

SEQ ID NO: 725850 - RNA, 64 nt, Homo Sapiens
ugguccuaagcauggaauccuaacuccugauuccgucuccuauuucuugcuuggcuacgccagu

SEQ ID NO: 725851 - RNA, 64 nt, Homo Sapiens
ccugaggagcggaggcugagccuguccggaucuugucuccuaguucggcuugcugccuguccug

SEQ ID NO: 725852 - RNA, 64 nt, Homo Sapiens
guacugggauuacaggcgugaucugcccgccugggucuccuaaacaaacuccugaccucaggca

SEQ ID NO: 725853 - RNA, 64 nt, Homo Sapiens
cccgucagcuguguaguggcaaagccgagaccgagucuccuaaguccccgucagugugguuuuc

SEQ ID NO: 725854 - RNA, 64 nt, Homo Sapiens
agccauuuuauaguugaguaaacugagaucuuaagucuccuagucuacugaauuucauauggug

SEQ ID NO: 725855 - RNA, 64 nt, Homo Sapiens
ucccuggcaaaauuuuccacucugaguaaaacaagucuccuaaguauuguguauguuuaaaacg

SEQ ID NO: 725856 - RNA, 64 nt, Homo Sapiens
cucucagccaggcagagagcggccuccccaggaagucuccuaccggucccagccagggcagagg

SEQ ID NO: 725857 - RNA, 64 nt, Homo Sapiens
ccacuguggacucuaaacugcucagccacaucaagucuccuagaguucacguggcccccgacuc

SEQ ID NO: 725858 - RNA, 61 nt, Homo Sapiens
acuccaugagcagcgccagcugccaccuucugucuccuacgucagcccgcuggacuuauaa

SEQ ID NO: 725859 - RNA, 64 nt, Homo Sapiens
ggcuugguccuagggugggacucccuaggcccaagucuccuaggcuccuccuccucccuccuca

SEQ ID NO: 725860 - RNA, 64 nt, Homo Sapiens
cccccagggagccagugaacucagccaagcccaagucuccuagacccugagugucugucccucu

SEQ ID NO: 725861 - RNA, 64 nt, Homo Sapiens
cauuuugguggccuagugacagcuaccaaaagacgucuccuaagcaaggucaccuauagaagcg

SEQ ID NO: 725862 - RNA, 64 nt, Homo Sapiens
cuguguaaauauuuuucccuuuuucagccaauuugucuccuacuaguuaaaggcaguccagagc

SEQ ID NO: 725863 - RNA, 64 nt, Homo Sapiens
cgucaccugcaacacucgcuugacccagcgaguggucuccuacauggccacuucuuggacaucu

SEQ ID NO: 725864 - RNA, 64 nt, Homo Sapiens
ugagacaccuugaccaauaugcuuuggguggacggucuccuacauguucaguggaggccaccag

SEQ ID NO: 725865 - RNA, 61 nt, Homo Sapiens
acuauugccacaaacacugagggacgcucaggucuccuaagaccucauccugcuggggacc

SEQ ID NO: 725866 - RNA, 64 nt, Homo Sapiens
gcugcugaggggcaggaagcgggggagugggcucgucuccuaaauuuaagaucaccuccucagc

SEQ ID NO: 725867 - RNA, 64 nt, Homo Sapiens
uuuaucccucuccacgcggggcagacucuggcgggucuccuagcguccgagagauggcuuauuu

SEQ ID NO: 725868 - RNA, 64 nt, Homo Sapiens
gaugaugaagcuggagccagggcugccgguccgagucuccuaccucccccaacccugcccgccc

SEQ ID NO: 725869 - RNA, 64 nt, Homo Sapiens
aacccucucccccaccucuucccugcccaaaucugucuccuagaaucuuaugugcugugaauaa

SEQ ID NO: 725870 - RNA, 64 nt, Homo Sapiens
cuagggugugcugguuuguccuuuucauaccuuugucuccuaauugugcuacaauuggaagacc

SEQ ID NO: 725871 - RNA, 64 nt, Homo Sapiens
ccagacucaagauauggucugggcgcugucuugugucuccuacccugaucccuggguucaacuc

SEQ ID NO: 725872 - RNA, 64 nt, Homo Sapiens
guccuguuugucuuaauuuuuauugguuuccaaggucuccuaggaaggagagcagagcugugug

SEQ ID NO: 725873 - RNA, 64 nt, Homo Sapiens
cugggaucccauccaguuccguuuaaaacugcaagucuccuacccuggcuggggacugucuugg

SEQ ID NO: 725874 - RNA, 64 nt, Homo Sapiens
gugcucgcuucagucagcacgcaguggccacugugucuccuaaggcugcuaccagcugcucagu

SEQ ID NO: 725875 - RNA, 64 nt, Homo Sapiens
cucccaaguggcauagccccuuuuccgguauggggucuccuacacccacgcgcaccaccucucc

SEQ ID NO: 725876 - RNA, 64 nt, Homo Sapiens
uccuccaagaucucagcuccuuaacauaucaguugucuccuagccuagaaaaccaguguuugga

SEQ ID NO: 725877 - RNA, 64 nt, Homo Sapiens
augcugggaugaggacagaggaagaccugauggggucuccuauuccagggaauaagccaaauua

SEQ ID NO: 725878 - RNA, 64 nt, Homo Sapiens
uguccuuaaacuaccuccuuagagcucugaaggggucuccuaguuccagauuuuaauuugggga

SEQ ID NO: 725879 - RNA, 64 nt, Homo Sapiens
ugcaauuuccacggacccagugggagucuggugugucuccuacaaucccaaaagggcucugucc

SEQ ID NO: 725880 - RNA, 64 nt, Homo Sapiens
ucugagccccagugccuucuccuguccuugcacagucuccuaugagcugcugucccugcccugu

SEQ ID NO: 725881 - RNA, 64 nt, Homo Sapiens
uuaacagcuggggaggagggugguuaggcugugugucuccuacaccugggcauugagacugucc

SEQ ID NO: 725882 - RNA, 64 nt, Homo Sapiens
agaggccacaggaagauaggauggaacgugacuggucuccuaaccaaggugcacugagaagcaa

SEQ ID NO: 725883 - RNA, 64 nt, Homo Sapiens
caggcuggcuccagaugcagggcagucauuggcugucuccuaggaaacccauauccuuacccuc

SEQ ID NO: 725884 - RNA, 64 nt, Homo Sapiens
guccguggugucccccaaaggugccaccgugcgggucuccuagcucccugccagcuuccugucc

SEQ ID NO: 725885 - RNA, 64 nt, Homo Sapiens
cugcuucucuuacuauacucgcauaaauguaguugucuccuacuaacauuaaaaaauacucgag

SEQ ID NO: 725886 - RNA, 64 nt, Homo Sapiens
acaaugaagucuuuucuugcggacacucccuccugucuccuauuuucuguaaauaauuuucucc

SEQ ID NO: 725887 - RNA, 64 nt, Homo Sapiens
gucacuucaugcugauuagaaugacaucucuuucgucuccuauuuuguuacccaacucuuccua

SEQ ID NO: 725888 - RNA, 64 nt, Homo Sapiens
uugugccaaaccagccuacagggccaggacaggcgucuccuaggucaccagauuucggcugcug

SEQ ID NO: 725889 - RNA, 64 nt, Homo Sapiens
cgacuggcccccuuuugaacaaagcuccaacccagucuccuaaguccgcccugauuggaugagg

SEQ ID NO: 725890 - RNA, 64 nt, Homo Sapiens
ccaagauggaagagccagaggagaaggcaucugagucuccuaacaaugacauccaggaagguag

SEQ ID NO: 725891 - RNA, 64 nt, Homo Sapiens
uaggcagaaacuagaagucuggacagucuccauggucuccuacuaucagaauaugugcccuuuu

SEQ ID NO: 725892 - RNA, 64 nt, Homo Sapiens
ccuucccugagcugccuccugcuucucccucaaagucuccuacccuucucuuccucuuuuaagc

SEQ ID NO: 725893 - RNA, 64 nt, Homo Sapiens
uuugacaauguuguaaguguuuaccaagccguuggucuccuaagggccuccugauggaagaaca

SEQ ID NO: 725894 - RNA, 64 nt, Homo Sapiens
ugugcccuguccuggaugaacgccucuuuccgaggucuccuauuuucuuuuuaacuuuuuaaag

SEQ ID NO: 725895 - RNA, 64 nt, Homo Sapiens
ucaaugguaggggcgguuuaggccgcccuuacacgucuccuacuuuuucugucagucccccagu

SEQ ID NO: 725896 - RNA, 64 nt, Homo Sapiens
uaaugugauggaagcacaaccccaaccccacgaagucuccuauucugaugugaaacaacccuug

SEQ ID NO: 725897 - RNA, 64 nt, Homo Sapiens
gaggauauggacacuggugcgagaaucucaacaugucuccuacugaaauguuugcugaacauug

SEQ ID NO: 725898 - RNA, 64 nt, Homo Sapiens
cccaucacuguggcacacugcuaaguguauaacugucuccuaagaacacuaagguuaggaucuu

SEQ ID NO: 725899 - RNA, 64 nt, Homo Sapiens
accagcuucuaaaugaauguccuauuucuugugggucuccuauuucguaaacguuuugauguua

SEQ ID NO: 725900 - RNA, 64 nt, Homo Sapiens
aucucaauugcuuaugugcacuguuagcuacacagucuccuauugaucaauuauauucucauau

SEQ ID NO: 725901 - RNA, 64 nt, Homo Sapiens
ugcacagccuggggaucgugagguccuuggcgccgucuccuaccugccagccaucugguggguc

SEQ ID NO: 725902 - RNA, 64 nt, Homo Sapiens; identical to SEQ ID NO: 111844

SEQ ID NO: 725903 - RNA, 64 nt, Homo Sapiens; identical to SEQ ID NO: 111845

SEQ ID NO: 725904 - RNA, 62 nt, Homo Sapiens; identical to SEQ ID NO: 111846

SEQ ID NO: 725905 - RNA, 64 nt, Homo Sapiens; identical to SEQ ID NO: 111847

SEQ ID NO: 725906 - RNA, 64 nt, Homo Sapiens; identical to SEQ ID NO: 111848

SEQ ID NO: 725907 - RNA, 64 nt, Homo Sapiens; identical to SEQ ID NO: 111849

SEQ ID NO: 725908 - RNA, 64 nt, Homo Sapiens; identical to SEQ ID NO: 111850

SEQ ID NO: 725909 - RNA, 64 nt, Homo Sapiens; identical to SEQ ID NO: 111851

SEQ ID NO: 725910 - RNA, 64 nt, Homo Sapiens; identical to SEQ ID NO: 111852

SEQ ID NO: 725911 - RNA, 64 nt, Homo Sapiens; identical to SEQ ID NO: 111853

SEQ ID NO: 725912 - RNA, 64 nt, Homo Sapiens; identical to SEQ ID NO: 111854

SEQ ID NO: 725913 - RNA, 64 nt, Homo Sapiens; identical to SEQ ID NO: 111855

SEQ ID NO: 725914 - RNA, 64 nt, Homo Sapiens; identical to SEQ ID NO: 111856

SEQ ID NO: 725915 - RNA, 64 nt, Homo Sapiens; identical to SEQ ID NO: 111857

SEQ ID NO: 725916 - RNA, 64 nt, Homo Sapiens; identical to SEQ ID NO: 111858

SEQ ID NO: 725917 - RNA, 64 nt, Homo Sapiens; identical to SEQ ID NO: 111859

SEQ ID NO: 725918 - RNA, 64 nt, Homo Sapiens; identical to SEQ ID NO: 449768

SEQ ID NO: 725919 - RNA, 64 nt, Homo Sapiens; identical to SEQ ID NO: 449769

SEQ ID NO: 725920 - RNA, 64 nt, Homo Sapiens; identical to SEQ ID NO: 449770

SEQ ID NO: 725921 - RNA, 64 nt, Homo Sapiens; identical to SEQ ID NO: 449771

SEQ ID NO: 725922 - RNA, 64 nt, Homo Sapiens; identical to SEQ ID NO: 449772

SEQ ID NO: 725923 - RNA, 64 nt, Homo Sapiens; identical to SEQ ID NO: 449773

SEQ ID NO: 725924 - RNA, 64 nt, Homo Sapiens; identical to SEQ ID NO: 449774

SEQ ID NO: 725925 - RNA, 64 nt, Homo Sapiens; identical to SEQ ID NO: 449775

SEQ ID NO: 725926 - RNA, 64 nt, Homo Sapiens; identical to SEQ ID NO: 449776

SEQ ID NO: 725927 - RNA, 64 nt, Homo Sapiens; identical to SEQ ID NO: 449777

SEQ ID NO: 725928 - RNA, 64 nt, Homo Sapiens; identical to SEQ ID NO: 449778

SEQ ID NO: 725929 - RNA, 64 nt, Homo Sapiens; identical to SEQ ID NO: 449779

SEQ ID NO: 725930 - RNA, 64 nt, Homo Sapiens; identical to SEQ ID NO: 449780

SEQ ID NO: 725931 - RNA, 64 nt, Homo Sapiens; identical to SEQ ID NO: 449781

SEQ ID NO: 725932 - RNA, 64 nt, Homo Sapiens; identical to SEQ ID NO: 449782

SEQ ID NO: 725933 - RNA, 64 nt, Homo Sapiens; identical to SEQ ID NO: 449783

SEQ ID NO: 725934 - RNA, 64 nt, Homo Sapiens; identical to SEQ ID NO: 449784

SEQ ID NO: 725935 - RNA, 64 nt, Homo Sapiens; identical to SEQ ID NO: 449785

SEQ ID NO: 725936 - RNA, 64 nt, Homo Sapiens; identical to SEQ ID NO: 449786

SEQ ID NO: 725937 - RNA, 64 nt, Homo Sapiens; identical to SEQ ID NO: 449787

SEQ ID NO: 725938 - RNA, 64 nt, Homo Sapiens; identical to SEQ ID NO: 449788

SEQ ID NO: 725939 - RNA, 64 nt, Homo Sapiens; identical to SEQ ID NO: 449789

SEQ ID NO: 725940 - RNA, 64 nt, Homo Sapiens; identical to SEQ ID NO: 449790

SEQ ID NO: 725941 - RNA, 64 nt, Homo Sapiens; identical to SEQ ID NO: 449791

SEQ ID NO: 725942 - RNA, 64 nt, Homo Sapiens; identical to SEQ ID NO: 449792

SEQ ID NO: 725943 - RNA, 64 nt, Homo Sapiens; identical to SEQ ID NO: 449793

SEQ ID NO: 725944 - RNA, 64 nt, Homo Sapiens; identical to SEQ ID NO: 449794

SEQ ID NO: 725945 - RNA, 64 nt, Homo Sapiens; identical to SEQ ID NO: 449795

SEQ ID NO: 725946 - RNA, 64 nt, Homo Sapiens; identical to SEQ ID NO: 449796

SEQ ID NO: 725947 - RNA, 64 nt, Homo Sapiens; identical to SEQ ID NO: 449797

SEQ ID NO: 725948 - RNA, 64 nt, Homo Sapiens; identical to SEQ ID NO: 449798

SEQ ID NO: 725949 - RNA, 64 nt, Homo Sapiens; identical to SEQ ID NO: 449799

SEQ ID NO: 725950 - RNA, 64 nt, Homo Sapiens; identical to SEQ ID NO: 449800

SEQ ID NO: 725951 - RNA, 64 nt, Homo Sapiens; identical to SEQ ID NO: 449801

SEQ ID NO: 725952 - RNA, 64 nt, Homo Sapiens; identical to SEQ ID NO: 449802

SEQ ID NO: 725953 - RNA, 64 nt, Homo Sapiens; identical to SEQ ID NO: 449803

SEQ ID NO: 725954 - RNA, 64 nt, Homo Sapiens; identical to SEQ ID NO: 449804

SEQ ID NO: 725955 - RNA, 64 nt, Homo Sapiens; identical to SEQ ID NO: 449805

SEQ ID NO: 725956 - RNA, 64 nt, Homo Sapiens; identical to SEQ ID NO: 449806

SEQ ID NO: 725957 - RNA, 64 nt, Homo Sapiens; identical to SEQ ID NO: 449807

SEQ ID NO: 725958 - RNA, 64 nt, Homo Sapiens; identical to SEQ ID NO: 449808

SEQ ID NO: 725959 - RNA, 64 nt, Homo Sapiens; identical to SEQ ID NO: 449809

SEQ ID NO: 725960 - RNA, 64 nt, Homo Sapiens; identical to SEQ ID NO: 449810

SEQ ID NO: 725961 - RNA, 64 nt, Homo Sapiens; identical to SEQ ID NO: 449811

SEQ ID NO: 725962 - RNA, 64 nt, Homo Sapiens; identical to SEQ ID NO: 449812

SEQ ID NO: 725963 - RNA, 64 nt, Homo Sapiens; identical to SEQ ID NO: 449813

SEQ ID NO: 725964 - RNA, 64 nt, Homo Sapiens; identical to SEQ ID NO: 449814

SEQ ID NO: 725965 - RNA, 64 nt, Homo Sapiens; identical to SEQ ID NO: 449815

SEQ ID NO: 725966 - RNA, 64 nt, Homo Sapiens; identical to SEQ ID NO: 449816

SEQ ID NO: 725967 - RNA, 64 nt, Homo Sapiens; identical to SEQ ID NO: 449817

SEQ ID NO: 725968 - RNA, 64 nt, Homo Sapiens; identical to SEQ ID NO: 449818

SEQ ID NO: 725969 - RNA, 64 nt, Homo Sapiens; identical to SEQ ID NO: 449819

SEQ ID NO: 725970 - RNA, 64 nt, Homo Sapiens; identical to SEQ ID NO: 449820

SEQ ID NO: 725971 - RNA, 64 nt, Homo Sapiens; identical to SEQ ID NO: 449821

SEQ ID NO: 725972 - RNA, 64 nt, Homo Sapiens; identical to SEQ ID NO: 449822

SEQ ID NO: 725973 - RNA, 64 nt, Homo Sapiens; identical to SEQ ID NO: 449823

SEQ ID NO: 725974 - RNA, 64 nt, Homo Sapiens; identical to SEQ ID NO: 449824

SEQ ID NO: 725975 - RNA, 64 nt, Homo Sapiens; identical to SEQ ID NO: 449825

SEQ ID NO: 725976 - RNA, 64 nt, Homo Sapiens; identical to SEQ ID NO: 449826

SEQ ID NO: 725977 - RNA, 64 nt, Homo Sapiens; identical to SEQ ID NO: 449827

SEQ ID NO: 725978 - RNA, 64 nt, Homo Sapiens; identical to SEQ ID NO: 449828

SEQ ID NO: 725979 - RNA, 64 nt, Homo Sapiens; identical to SEQ ID NO: 449829

SEQ ID NO: 725980 - RNA, 64 nt, Homo Sapiens; identical to SEQ ID NO: 449830

SEQ ID NO: 725981 - RNA, 64 nt, Homo Sapiens; identical to SEQ ID NO: 449831

SEQ ID NO: 725982 - RNA, 64 nt, Homo Sapiens; identical to SEQ ID NO: 449832

SEQ ID NO: 725983 - RNA, 64 nt, Homo Sapiens; identical to SEQ ID NO: 449833

SEQ ID NO: 725984 - RNA, 64 nt, Homo Sapiens; identical to SEQ ID NO: 449834

SEQ ID NO: 725985 - RNA, 64 nt, Homo Sapiens; identical to SEQ ID NO: 449835

SEQ ID NO: 725986 - RNA, 64 nt, Homo Sapiens; identical to SEQ ID NO: 449836

SEQ ID NO: 725987 - RNA, 64 nt, Homo Sapiens; identical to SEQ ID NO: 449837

SEQ ID NO: 725988 - RNA, 64 nt, Homo Sapiens; identical to SEQ ID NO: 449838

SEQ ID NO: 725989 - RNA, 64 nt, Homo Sapiens; identical to SEQ ID NO: 449839

SEQ ID NO: 725990 - RNA, 64 nt, Homo Sapiens; identical to SEQ ID NO: 449840

SEQ ID NO: 725991 - RNA, 64 nt, Homo Sapiens; identical to SEQ ID NO: 449841

SEQ ID NO: 725992 - RNA, 64 nt, Homo Sapiens; identical to SEQ ID NO: 449842

SEQ ID NO: 725993 - RNA, 64 nt, Homo Sapiens; identical to SEQ ID NO: 449843

SEQ ID NO: 725994 - RNA, 64 nt, Homo Sapiens; identical to SEQ ID NO: 449844

SEQ ID NO: 725995 - RNA, 64 nt, Homo Sapiens; identical to SEQ ID NO: 449845

SEQ ID NO: 725996 - RNA, 64 nt, Homo Sapiens; identical to SEQ ID NO: 449846

SEQ ID NO: 725997 - RNA, 64 nt, Homo Sapiens; identical to SEQ ID NO: 449847

SEQ ID NO: 725998 - RNA, 64 nt, Homo Sapiens; identical to SEQ ID NO: 449848

SEQ ID NO: 725999 - RNA, 64 nt, Homo Sapiens; identical to SEQ ID NO: 449849

SEQ ID NO: 726000 - RNA, 64 nt, Homo Sapiens; identical to SEQ ID NO: 449850

SEQ ID NO: 726001 - RNA, 64 nt, Homo Sapiens; identical to SEQ ID NO: 449851

SEQ ID NO: 726002 - RNA, 64 nt, Homo Sapiens; identical to SEQ ID NO: 449852

SEQ ID NO: 726003 - RNA, 64 nt, Homo Sapiens; identical to SEQ ID NO: 449853

SEQ ID NO: 726004 - RNA, 64 nt, Homo Sapiens; identical to SEQ ID NO: 449854

SEQ ID NO: 726005 - RNA, 64 nt, Homo Sapiens; identical to SEQ ID NO: 449855

SEQ ID NO: 726006 - RNA, 64 nt, Homo Sapiens; identical to SEQ ID NO: 449856

SEQ ID NO: 726007 - RNA, 64 nt, Homo Sapiens; identical to SEQ ID NO: 449857

SEQ ID NO: 726008 - RNA, 64 nt, Homo Sapiens; identical to SEQ ID NO: 449858

SEQ ID NO: 726009 - RNA, 64 nt, Homo Sapiens; identical to SEQ ID NO: 449859

SEQ ID NO: 726010 - RNA, 64 nt, Homo Sapiens; identical to SEQ ID NO: 449860

SEQ ID NO: 726011 - RNA, 64 nt, Homo Sapiens; identical to SEQ ID NO: 449861

SEQ ID NO: 726012 - RNA, 64 nt, Homo Sapiens; identical to SEQ ID NO: 449862

SEQ ID NO: 726013 - RNA, 64 nt, Homo Sapiens; identical to SEQ ID NO: 449863

SEQ ID NO: 726014 - RNA, 64 nt, Homo Sapiens; identical to SEQ ID NO: 449864

SEQ ID NO: 726015 - RNA, 64 nt, Homo Sapiens; identical to SEQ ID NO: 449865

SEQ ID NO: 726016 - RNA, 64 nt, Homo Sapiens; identical to SEQ ID NO: 449866

SEQ ID NO: 726017 - RNA, 64 nt, Homo Sapiens; identical to SEQ ID NO: 449867

SEQ ID NO: 726018 - RNA, 64 nt, Homo Sapiens; identical to SEQ ID NO: 449868

SEQ ID NO: 726019 - RNA, 64 nt, Homo Sapiens; identical to SEQ ID NO: 449869

SEQ ID NO: 726020 - RNA, 64 nt, Homo Sapiens; identical to SEQ ID NO: 449870

SEQ ID NO: 726021 - RNA, 64 nt, Homo Sapiens; identical to SEQ ID NO: 449871

SEQ ID NO: 726022 - RNA, 64 nt, Homo Sapiens; identical to SEQ ID NO: 449872

SEQ ID NO: 726023 - RNA, 64 nt, Homo Sapiens; identical to SEQ ID NO: 449873

SEQ ID NO: 726024 - RNA, 64 nt, Homo Sapiens; identical to SEQ ID NO: 449874

SEQ ID NO: 726025 - RNA, 64 nt, Homo Sapiens
cacagacacacacagaaagagccacagagacacaccauuacauaaucacacgcagccccucccc

SEQ ID NO: 726026 - RNA, 64 nt, Homo Sapiens
cacauacacagaaagacacagccacagaaacacaccauuacacaaucgcagauacgcccuuccg

SEQ ID NO: 726027 - RNA, 64 nt, Homo Sapiens
cacagacacgcaaucgcagagccacagagacacaccauuacauaaucacacacacacccucccc

SEQ ID NO: 726028 - RNA, 64 nt, Homo Sapiens
cacagacacacacagaaagaccgccacagagacaccauuacauaaaaucacacacacacccucc

SEQ ID NO: 726029 - RNA, 64 nt, Homo Sapiens
cacagacacacacagaaagaccaccacagagacaccauuacauaaaaucacacacacccccucc

SEQ ID NO: 726030 - RNA, 64 nt, Homo Sapiens
auauaauccgaccacagugggaggugugauuuacccauuacacaaugagaaaccagaggagccg

SEQ ID NO: 726031 - RNA, 64 nt, Homo Sapiens
ucuaaaaucuaaguauuuuagucuagaauuuucuccauuacaucauccuaagagauaaugcucu

SEQ ID NO: 726032 - RNA, 64 nt, Homo Sapiens; identical to SEQ ID NO: 173405

SEQ ID NO: 726033 - RNA, 64 nt, Homo Sapiens; identical to SEQ ID NO: 173406

SEQ ID NO: 726034 - RNA, 64 nt, Homo Sapiens; identical to SEQ ID NO: 173407

SEQ ID NO: 726035 - RNA, 64 nt, Homo Sapiens; identical to SEQ ID NO: 173408

SEQ ID NO: 726036 - RNA, 64 nt, Homo Sapiens; identical to SEQ ID NO: 173409

SEQ ID NO: 726037 - RNA, 64 nt, Homo Sapiens; identical to SEQ ID NO: 173410

SEQ ID NO: 726038 - RNA, 64 nt, Homo Sapiens
uugugggggagggcaaggcucuccucccagccagggacgccaggacauagcugcuccuggucag

SEQ ID NO: 726039 - RNA, 64 nt, Homo Sapiens
acugauguggacucaguaugauaacugagaugggggacgccagacaugugaggacgcuguccuc

SEQ ID NO: 726040 - RNA, 64 nt, Homo Sapiens
cugauccuggaaccccucccucugcgccgcagcuggacgccaccuccgacggacacagccagcc

SEQ ID NO: 726041 - RNA, 64 nt, Homo Sapiens
ggcaucaugcagcugguggguucagcgcacacgcggacgccaagugcagguggaguacauguca

SEQ ID NO: 726042 - RNA, 64 nt, Homo Sapiens
ugccauucccaugggccaguugggguagagcuggggacgccacggggagagguggggccccugc

SEQ ID NO: 726043 - RNA, 64 nt, Homo Sapiens
caggccaggccgcucuccggcggcgccuccccacggacgccagggcuccgcguccuaggaccgc

SEQ ID NO: 726044 - RNA, 64 nt, Homo Sapiens
ugugaccuggaucugaggucucugauagaaaucuggacgccaccggguccaggccuggccucag

SEQ ID NO: 726045 - RNA, 64 nt, Homo Sapiens
uuauagguagcugauuuugccuguaaacaguaauggacgccaaagacuacaauccauagugaaa

SEQ ID NO: 726046 - RNA, 64 nt, Homo Sapiens
uuaggguuggacgugggcaccaugcuucauaagcggacgccacgcaagaguugauuacaaccuc

SEQ ID NO: 726047 - RNA, 64 nt, Homo Sapiens
cauuucaucucauuuaagggcucccuccaccccaggacgccacugccccgacuccagccagcgc

SEQ ID NO: 726048 - RNA, 64 nt, Homo Sapiens
uagcuuuaagaucgggggagagccgcacucuccuggacgccauaagugauggccaagcugcauc

SEQ ID NO: 726049 - RNA, 64 nt, Homo Sapiens
gggcugaccccagcuuccaggggacugucacuguggacgccaaaauggcauaacugagauaagg

SEQ ID NO: 726050 - RNA, 64 nt, Homo Sapiens
aagccucagacucuuaccaucauccccacgguggggacgccaccucuagucccuguguucugca

SEQ ID NO: 726051 - RNA, 64 nt, Homo Sapiens
caccucagggccguccgcugggcaggucgggcggggacgccacagcuucccacuaggacaucca

SEQ ID NO: 726052 - RNA, 64 nt, Homo Sapiens
ugcuuuuguuucaacugcaggcaggggagcaaaaggacgccaugugagcauuaggaaaaaaaau

SEQ ID NO: 726053 - RNA, 56 nt, Homo Sapiens
ggcacugcagggacagucagggcacgggacgccaugugagagaggagaaugaauaa

SEQ ID NO: 726054 - RNA, 64 nt, Homo Sapiens
auccugaggccuccuagaggcaauaucauaagauggacgccauacaagacugucuccuuuuggc

SEQ ID NO: 726055 - RNA, 64 nt, Homo Sapiens
gcaggauggagaggacuuggguccucacaggccaggacgccaugcccgcucccaggcgccccau

SEQ ID NO: 726056 - RNA, 64 nt, Homo Sapiens
cucacugacaucuuugaauaacugccacuucuaaggacgccauucagagcagagcauuagcaga

SEQ ID NO: 726057 - RNA, 64 nt, Homo Sapiens
agccucgcuccucgcuccucgcuccucgccccuaggacgccaagggggaaaggagagggcggaa

SEQ ID NO: 726058 - RNA, 64 nt, Homo Sapiens
ccugucaccccaccccaggccacccucucccagaggacgccaucucccuuacuguugcugggag

SEQ ID NO: 726059 - RNA, 64 nt, Homo Sapiens
gccacaccaggucgcagcaaauggcuucagccugggacgccaguguuuuaugcucuuaguucag

SEQ ID NO: 726060 - RNA, 64 nt, Homo Sapiens
ccugccccgcuacagaagccagacugggucccgcggacgccagcaggggcagccccagccuagg

SEQ ID NO: 726061 - RNA, 64 nt, Homo Sapiens
uaaaggaauaauaaaugcauaauaugaggucaguggacgccauuuucuguuauaaucauuuuug

SEQ ID NO: 726062 - RNA, 64 nt, Homo Sapiens
caacaucucagcaccuggugccgaaggaggacuuggacgccauaguggcccgggaccgagaccu

SEQ ID NO: 726063 - RNA, 64 nt, Homo Sapiens
uccauucaagagggcacugcgaccucuuuuauaaggacgccaguagggcaagacagcucacaga

SEQ ID NO: 726064 - RNA, 64 nt, Homo Sapiens
uccuuugugcccacccguucuggccacccugccuggacgccagcuguucuucucagccugagcc

SEQ ID NO: 726065 - RNA, 64 nt, Homo Sapiens
agacuugucuccaaaaaucaaggucacuugggacggacgccaccagugaaaccaggggcucugc

SEQ ID NO: 726066 - RNA, 64 nt, Homo Sapiens
agcaaaagguggcaacccauggaggcagaaagaaggacgccagccugacccuuaucugaaacgu

SEQ ID NO: 726067 - RNA, 64 nt, Homo Sapiens
aaaaaaacaaaaacaaaaacaauguuugaauggaggacgccaguaagaaaucccuaccuaugua

SEQ ID NO: 726068 - RNA, 64 nt, Homo Sapiens
gccggggaaggccaggguggaagggcggcuugagggacgccaggagaagacugaaugccaggcu

SEQ ID NO: 726069 - RNA, 64 nt, Homo Sapiens
ugggcgucagaccccaccggccaccccggcucccggacgccagccuucgccucccuccaggacu

SEQ ID NO: 726070 - RNA, 64 nt, Homo Sapiens
guguucccugcacuugggugagguguucuucccuggacgccaugauguguuuccuugaugcagg

SEQ ID NO: 726071 - RNA, 64 nt, Homo Sapiens
cugguaaacauuccuccagccuccccuccccuggggacgccaaggaggugggccacacccagga

SEQ ID NO: 726072 - RNA, 64 nt, Homo Sapiens
cccugugggaaggcaccaucgacgugccauguugggacgccacugcugauaacaccaccacugg

SEQ ID NO: 726073 - RNA, 64 nt, Homo Sapiens
aagugucuguuuauauuuuuaaacuugaaaugcaggacgccauugauaaauuuguuguauucaa

SEQ ID NO: 726074 - RNA, 64 nt, Homo Sapiens
gcacagacuaugaaaagcugaguuagugcgcccgggacgccaggcaagcagcuuuuacaguuug

SEQ ID NO: 726075 - RNA, 64 nt, Homo Sapiens
cgaagacagcacuugaccucgcaggcgugugaguggacgccauccccagugggcuccuaagggg

SEQ ID NO: 726076 - RNA, 64 nt, Homo Sapiens
ucccagagcuaaggaccaaguucgguucuccucaggacgccaacccagggcucccuguccagaa

SEQ ID NO: 726077 - RNA, 64 nt, Homo Sapiens
augggcccaccaauugggcuucccccugcucgagggacgccaauaggcaugccgccuccgggaa

SEQ ID NO: 726078 - RNA, 64 nt, Homo Sapiens
gggagcgaacguggaugaaaaccacagggauuccggacgccagaccccauuuuauacuucacuu

SEQ ID NO: 726079 - RNA, 64 nt, Homo Sapiens
ucccaguggcugcugcccaggcccagaccuucuaggacgccacccagcaaaagguuguuccuaa

SEQ ID NO: 726080 - RNA, 64 nt, Homo Sapiens
augccaggagggcucgagcuggacacuccuggcuggacgccaggccagugccgccuacguggag

SEQ ID NO: 726081 - RNA, 64 nt, Homo Sapiens
ggggugagacagcaggaaggggcccugcacgccgggacgccaccuccgccagccgccuccaccc

SEQ ID NO: 726082 - RNA, 64 nt, Homo Sapiens
cacucaccuggguguccuggagcugggaacugagggacgccacguccuuggccagcuuaauggc

SEQ ID NO: 726083 - RNA, 64 nt, Homo Sapiens
uuagcuguacugugugauauuuuucauuauuuuaggacgccaacaugagaccuguaauaaaaua

SEQ ID NO: 726084 - RNA, 64 nt, Homo Sapiens
uagggcagggaaccucaguagcuccccuggaccaggacgccagggccgggggcuucugcccagg

SEQ ID NO: 726085 - RNA, 64 nt, Homo Sapiens
gggaauacacuugcauguacagagccuggggccuggacgccacggccucucaucuuaggaccua

SEQ ID NO: 726086 - RNA, 64 nt, Homo Sapiens
cugccugggugucgggccaccagaaggcucugccggacgccaagaagacggucucugggcucuu

SEQ ID NO: 726087 - RNA, 64 nt, Homo Sapiens
auacaaauuugacccaagaaacucuucucucugaggacgccaaauucaauuccagaaagaccuu

SEQ ID NO: 726088 - RNA, 64 nt, Homo Sapiens
agcugcagcagcugugccgccgcggguccaccgaggacgccaaucaaucaacccaacaccacaa

SEQ ID NO: 726089 - RNA, 64 nt, Homo Sapiens
acaaaagguaaagacgcaacguuuccaacucucgggacgccaaggccgcaggacuggagggcca

SEQ ID NO: 726090 - RNA, 64 nt, Homo Sapiens
ugacugacgcuguccgacgaaggcggccacggacggacgccagcacacgaagucacgugcaagu

SEQ ID NO: 726091 - RNA, 64 nt, Homo Sapiens
gccagggagacuugaauguggcugucacucuuccggacgccaagggcugcaggaggcugcuuuu

SEQ ID NO: 726092 - RNA, 64 nt, Homo Sapiens
uuucuuuaaggucccccgaccaauccccagccuaggacgccaacuucucccaccccuuggcccc

SEQ ID NO: 726093 - RNA, 64 nt, Homo Sapiens
ucugugcagggcucucacuggcggugcccaggacggacgccagauggcugcgcgcuuugucagc

SEQ ID NO: 726094 - RNA, 64 nt, Homo Sapiens
gagagguugcagucagaacccagggcggggccagggacgccaaacgcgccagccaggcuguggg

SEQ ID NO: 726095 - RNA, 64 nt, Homo Sapiens
cagacacaccugcccuccccccccugcagcugagggacgccaagaacuucguggaagccagggu

SEQ ID NO: 726096 - RNA, 64 nt, Homo Sapiens
gcagcuggcucugcucugagaaacucuggcaaguggacgccauucucuugcccuuaggauucac

SEQ ID NO: 726097 - RNA, 64 nt, Homo Sapiens
uuggcgggucacugaggugcauucugggcuccagggacgccacugcggggcaaaggcgccguua

SEQ ID NO: 726098 - RNA, 64 nt, Homo Sapiens
ugugcacacccagccacaccgcauggcugucgcuggacgccagcucgcuauaggcauaggcccg

SEQ ID NO: 726099 - RNA, 64 nt, Homo Sapiens
uguaaucacucuggaugguggcccuuugaccuuuggacgccaccaaggaaacccuguggaggcu

SEQ ID NO: 726100 - RNA, 64 nt, Homo Sapiens
ggucugugggggccgugcucucagggcgugugcgggacgccaccugugcacaccugcucagagc

SEQ ID NO: 726101 - RNA, 64 nt, Homo Sapiens
ccccggucaccuuccuccgcacggaagaggggccggacgccaccuuccccaggaccauuccccu

SEQ ID NO: 726102 - RNA, 64 nt, Homo Sapiens
agcacccucuaaguugugagagucuccacccacaggacgccagugaaugccgagcagcacuucc

SEQ ID NO: 726103 - RNA, 64 nt, Homo Sapiens
agccugaugaaauaaagauuaaaguugaggccguggacgccacccccucuuccaucacggaggu

SEQ ID NO: 726104 - RNA, 64 nt, Homo Sapiens
cacugccgcacgucacuggccccugucccagccuggacgccacgccuggggagacuugaaaggc

SEQ ID NO: 726105 - RNA, 64 nt, Homo Sapiens
ccggcccuucacccuugccaaagccacaucaggaggacgccacugggugguagaggcuggaagg

SEQ ID NO: 726106 - RNA, 64 nt, Homo Sapiens
ccgugguuuccguaucgucagacaccucucccccacccccgacucacaacucgggcgggggugu

SEQ ID NO: 726107 - RNA, 64 nt, Homo Sapiens
ccccuuggagacacccccccgggggggccgucucacccccgagcuuucccucuccccuagaaaa

SEQ ID NO: 726108 - RNA, 64 nt, Homo Sapiens
uuagcuauaguuaaguugcccugagaauugcaaaacccccgacuacucagcggccccaucggaa

SEQ ID NO: 726109 - RNA, 64 nt, Homo Sapiens
ggauggcuuggggggcuccaccccacccucgaccacccccgaugaugcagagaugugcccccac

SEQ ID NO: 726110 - RNA, 64 nt, Homo Sapiens; identical to SEQ ID NO: 618953

SEQ ID NO: 726111 - RNA, 64 nt, Homo Sapiens; identical to SEQ ID NO: 618954

SEQ ID NO: 726112 - RNA, 64 nt, Homo Sapiens; identical to SEQ ID NO: 140704

SEQ ID NO: 726113 - RNA, 64 nt, Homo Sapiens; identical to SEQ ID NO: 140705

SEQ ID NO: 726114 - RNA, 64 nt, Homo Sapiens; identical to SEQ ID NO: 140706

SEQ ID NO: 726115 - RNA, 64 nt, Homo Sapiens; identical to SEQ ID NO: 140707

SEQ ID NO: 726116 - RNA, 64 nt, Homo Sapiens; identical to SEQ ID NO: 140708

SEQ ID NO: 726117 - RNA, 64 nt, Homo Sapiens; identical to SEQ ID NO: 140709

SEQ ID NO: 726118 - RNA, 64 nt, Homo Sapiens; identical to SEQ ID NO: 140710

SEQ ID NO: 726119 - RNA, 64 nt, Homo Sapiens; identical to SEQ ID NO: 140711

SEQ ID NO: 726120 - RNA, 64 nt, Homo Sapiens; identical to SEQ ID NO: 140712

SEQ ID NO: 726121 - RNA, 64 nt, Homo Sapiens; identical to SEQ ID NO: 140713

SEQ ID NO: 726122 - RNA, 64 nt, Homo Sapiens; identical to SEQ ID NO: 140714

SEQ ID NO: 726123 - RNA, 64 nt, Homo Sapiens; identical to SEQ ID NO: 140715

SEQ ID NO: 726124 - RNA, 64 nt, Homo Sapiens; identical to SEQ ID NO: 140716

SEQ ID NO: 726125 - RNA, 64 nt, Homo Sapiens; identical to SEQ ID NO: 140717

SEQ ID NO: 726126 - RNA, 64 nt, Homo Sapiens; identical to SEQ ID NO: 140718

SEQ ID NO: 726127 - RNA, 64 nt, Homo Sapiens; identical to SEQ ID NO: 140719

SEQ ID NO: 726128 - RNA, 64 nt, Homo Sapiens; identical to SEQ ID NO: 140720

SEQ ID NO: 726129 - RNA, 64 nt, Homo Sapiens; identical to SEQ ID NO: 140721

SEQ ID NO: 726130 - RNA, 64 nt, Homo Sapiens; identical to SEQ ID NO: 140722

SEQ ID NO: 726131 - RNA, 64 nt, Homo Sapiens; identical to SEQ ID NO: 140723

SEQ ID NO: 726132 - RNA, 64 nt, Homo Sapiens; identical to SEQ ID NO: 210736

SEQ ID NO: 726133 - RNA, 64 nt, Homo Sapiens; identical to SEQ ID NO: 210737

SEQ ID NO: 726134 - RNA, 64 nt, Homo Sapiens; identical to SEQ ID NO: 210738

SEQ ID NO: 726135 - RNA, 64 nt, Homo Sapiens; identical to SEQ ID NO: 210739

SEQ ID NO: 726136 - RNA, 64 nt, Homo Sapiens; identical to SEQ ID NO: 210740

SEQ ID NO: 726137 - RNA, 64 nt, Homo Sapiens; identical to SEQ ID NO: 210741

SEQ ID NO: 726138 - RNA, 64 nt, Homo Sapiens; identical to SEQ ID NO: 210742

SEQ ID NO: 726139 - RNA, 64 nt, Homo Sapiens; identical to SEQ ID NO: 210743

SEQ ID NO: 726140 - RNA, 64 nt, Homo Sapiens; identical to SEQ ID NO: 210744

SEQ ID NO: 726141 - RNA, 64 nt, Homo Sapiens; identical to SEQ ID NO: 210745

SEQ ID NO: 726142 - RNA, 64 nt, Homo Sapiens; identical to SEQ ID NO: 210746

SEQ ID NO: 726143 - RNA, 64 nt, Homo Sapiens; identical to SEQ ID NO: 210747

SEQ ID NO: 726144 - RNA, 64 nt, Homo Sapiens; identical to SEQ ID NO: 210748

SEQ ID NO: 726145 - RNA, 64 nt, Homo Sapiens; identical to SEQ ID NO: 210749

SEQ ID NO: 726146 - RNA, 64 nt, Homo Sapiens; identical to SEQ ID NO: 210750

SEQ ID NO: 726147 - RNA, 64 nt, Homo Sapiens; identical to SEQ ID NO: 210751

SEQ ID NO: 726148 - RNA, 64 nt, Homo Sapiens; identical to SEQ ID NO: 210752

SEQ ID NO: 726149 - RNA, 64 nt, Homo Sapiens; identical to SEQ ID NO: 210753

SEQ ID NO: 726150 - RNA, 64 nt, Homo Sapiens; identical to SEQ ID NO: 210754

SEQ ID NO: 726151 - RNA, 64 nt, Homo Sapiens; identical to SEQ ID NO: 210755

SEQ ID NO: 726152 - RNA, 64 nt, Homo Sapiens; identical to SEQ ID NO: 210756

SEQ ID NO: 726153 - RNA, 64 nt, Homo Sapiens; identical to SEQ ID NO: 210757

SEQ ID NO: 726154 - RNA, 64 nt, Homo Sapiens; identical to SEQ ID NO: 210758

SEQ ID NO: 726155 - RNA, 64 nt, Homo Sapiens; identical to SEQ ID NO: 210759

SEQ ID NO: 726156 - RNA, 64 nt, Homo Sapiens; identical to SEQ ID NO: 210760

SEQ ID NO: 726157 - RNA, 64 nt, Homo Sapiens; identical to SEQ ID NO: 210761

SEQ ID NO: 726158 - RNA, 64 nt, Homo Sapiens; identical to SEQ ID NO: 210762

SEQ ID NO: 726159 - RNA, 64 nt, Homo Sapiens; identical to SEQ ID NO: 210763

SEQ ID NO: 726160 - RNA, 64 nt, Homo Sapiens; identical to SEQ ID NO: 210764

SEQ ID NO: 726161 - RNA, 64 nt, Homo Sapiens; identical to SEQ ID NO: 210765

SEQ ID NO: 726162 - RNA, 64 nt, Homo Sapiens; identical to SEQ ID NO: 210766

SEQ ID NO: 726163 - RNA, 64 nt, Homo Sapiens; identical to SEQ ID NO: 210767

SEQ ID NO: 726164 - RNA, 64 nt, Homo Sapiens; identical to SEQ ID NO: 236246

SEQ ID NO: 726165 - RNA, 64 nt, Homo Sapiens; identical to SEQ ID NO: 236247

SEQ ID NO: 726166 - RNA, 64 nt, Homo Sapiens; identical to SEQ ID NO: 236248

SEQ ID NO: 726167 - RNA, 64 nt, Homo Sapiens; identical to SEQ ID NO: 236249

SEQ ID NO: 726168 - RNA, 64 nt, Homo Sapiens; identical to SEQ ID NO: 236250

SEQ ID NO: 726169 - RNA, 64 nt, Homo Sapiens; identical to SEQ ID NO: 236251

SEQ ID NO: 726170 - RNA, 64 nt, Homo Sapiens; identical to SEQ ID NO: 236252

SEQ ID NO: 726171 - RNA, 64 nt, Homo Sapiens; identical to SEQ ID NO: 236253

SEQ ID NO: 726172 - RNA, 64 nt, Homo Sapiens; identical to SEQ ID NO: 236254

SEQ ID NO: 726173 - RNA, 64 nt, Homo Sapiens; identical to SEQ ID NO: 236255

SEQ ID NO: 726174 - RNA, 64 nt, Homo Sapiens; identical to SEQ ID NO: 236256

SEQ ID NO: 726175 - RNA, 64 nt, Homo Sapiens; identical to SEQ ID NO: 236257

SEQ ID NO: 726176 - RNA, 64 nt, Homo Sapiens; identical to SEQ ID NO: 236258

SEQ ID NO: 726177 - RNA, 64 nt, Homo Sapiens; identical to SEQ ID NO: 236259

SEQ ID NO: 726178 - RNA, 64 nt, Homo Sapiens; identical to SEQ ID NO: 236260

SEQ ID NO: 726179 - RNA, 64 nt, Homo Sapiens; identical to SEQ ID NO: 236261

SEQ ID NO: 726180 - RNA, 64 nt, Homo Sapiens; identical to SEQ ID NO: 60331

SEQ ID NO: 726181 - RNA, 64 nt, Homo Sapiens; identical to SEQ ID NO: 60332

SEQ ID NO: 726182 - RNA, 64 nt, Homo Sapiens; identical to SEQ ID NO: 60333

SEQ ID NO: 726183 - RNA, 64 nt, Homo Sapiens; identical to SEQ ID NO: 60334

SEQ ID NO: 726184 - RNA, 64 nt, Homo Sapiens; identical to SEQ ID NO: 60335

SEQ ID NO: 726185 - RNA, 64 nt, Homo Sapiens; identical to SEQ ID NO: 60336

SEQ ID NO: 726186 - RNA, 64 nt, Homo Sapiens; identical to SEQ ID NO: 60337

SEQ ID NO: 726187 - RNA, 64 nt, Homo Sapiens; identical to SEQ ID NO: 60338

SEQ ID NO: 726188 - RNA, 64 nt, Homo Sapiens; identical to SEQ ID NO: 60339

SEQ ID NO: 726189 - RNA, 64 nt, Homo Sapiens; identical to SEQ ID NO: 60340

SEQ ID NO: 726190 - RNA, 64 nt, Homo Sapiens
aauuuuuuggugcauagcauaaguaaaauaacaauacccuuacgauuuggauuauuuuugaaaa

SEQ ID NO: 726191 - RNA, 64 nt, Homo Sapiens
uauuuuuucuuucucugacuaaaauacauaacuuuacccuuaaaccauucaguaugcaaaacuu

SEQ ID NO: 726192 - RNA, 64 nt, Homo Sapiens
gucuuuaagggaggaagugugugagaaguuaaaauacccuuaagcuuaaggagguucaagcaga

SEQ ID NO: 726193 - RNA, 64 nt, Homo Sapiens
gagguucaagcagagugagagugagaaguuaaaauacccuuaagaggacggagguucaagcaga

SEQ ID NO: 726194 - RNA, 64 nt, Homo Sapiens; identical to SEQ ID NO: 132800

SEQ ID NO: 726195 - RNA, 64 nt, Homo Sapiens; identical to SEQ ID NO: 132801

SEQ ID NO: 726196 - RNA, 64 nt, Homo Sapiens; identical to SEQ ID NO: 132802

SEQ ID NO: 726197 - RNA, 64 nt, Homo Sapiens; identical to SEQ ID NO: 132803

SEQ ID NO: 726198 - RNA, 64 nt, Homo Sapiens; identical to SEQ ID NO: 132804

SEQ ID NO: 726199 - RNA, 64 nt, Homo Sapiens; identical to SEQ ID NO: 132805

SEQ ID NO: 726200 - RNA, 64 nt, Homo Sapiens; identical to SEQ ID NO: 132806

SEQ ID NO: 726201 - RNA, 64 nt, Homo Sapiens; identical to SEQ ID NO: 132807

SEQ ID NO: 726202 - RNA, 64 nt, Homo Sapiens; identical to SEQ ID NO: 132808

SEQ ID NO: 726203 - RNA, 64 nt, Homo Sapiens; identical to SEQ ID NO: 132809

SEQ ID NO: 726204 - RNA, 64 nt, Homo Sapiens; identical to SEQ ID NO: 132810

SEQ ID NO: 726205 - RNA, 64 nt, Homo Sapiens; identical to SEQ ID NO: 132811

SEQ ID NO: 726206 - RNA, 64 nt, Homo Sapiens; identical to SEQ ID NO: 132812

SEQ ID NO: 726207 - RNA, 64 nt, Homo Sapiens; identical to SEQ ID NO: 132813

SEQ ID NO: 726208 - RNA, 64 nt, Homo Sapiens; identical to SEQ ID NO: 132814

SEQ ID NO: 726209 - RNA, 64 nt, Homo Sapiens; identical to SEQ ID NO: 132815

SEQ ID NO: 726210 - RNA, 64 nt, Homo Sapiens; identical to SEQ ID NO: 132816

SEQ ID NO: 726211 - RNA, 64 nt, Homo Sapiens; identical to SEQ ID NO: 132817

SEQ ID NO: 726212 - RNA, 64 nt, Homo Sapiens; identical to SEQ ID NO: 132818

SEQ ID NO: 726213 - RNA, 64 nt, Homo Sapiens; identical to SEQ ID NO: 132819

SEQ ID NO: 726214 - RNA, 64 nt, Homo Sapiens; identical to SEQ ID NO: 132820

SEQ ID NO: 726215 - RNA, 64 nt, Homo Sapiens; identical to SEQ ID NO: 132821

SEQ ID NO: 726216 - RNA, 64 nt, Homo Sapiens; identical to SEQ ID NO: 132822

SEQ ID NO: 726217 - RNA, 64 nt, Homo Sapiens; identical to SEQ ID NO: 132823

SEQ ID NO: 726218 - RNA, 64 nt, Homo Sapiens; identical to SEQ ID NO: 132824

SEQ ID NO: 726219 - RNA, 64 nt, Homo Sapiens; identical to SEQ ID NO: 132825

SEQ ID NO: 726220 - RNA, 64 nt, Homo Sapiens; identical to SEQ ID NO: 132826

SEQ ID NO: 726221 - RNA, 64 nt, Homo Sapiens; identical to SEQ ID NO: 132827

SEQ ID NO: 726222 - RNA, 64 nt, Homo Sapiens; identical to SEQ ID NO: 132828

SEQ ID NO: 726223 - RNA, 64 nt, Homo Sapiens; identical to SEQ ID NO: 132829

SEQ ID NO: 726224 - RNA, 64 nt, Homo Sapiens; identical to SEQ ID NO: 132830

SEQ ID NO: 726225 - RNA, 64 nt, Homo Sapiens; identical to SEQ ID NO: 132831

SEQ ID NO: 726226 - RNA, 64 nt, Homo Sapiens; identical to SEQ ID NO: 132832

SEQ ID NO: 726227 - RNA, 64 nt, Homo Sapiens; identical to SEQ ID NO: 132833

SEQ ID NO: 726228 - RNA, 64 nt, Homo Sapiens; identical to SEQ ID NO: 132834

SEQ ID NO: 726229 - RNA, 64 nt, Homo Sapiens; identical to SEQ ID NO: 132835

SEQ ID NO: 726230 - RNA, 64 nt, Homo Sapiens; identical to SEQ ID NO: 132836

SEQ ID NO: 726231 - RNA, 64 nt, Homo Sapiens; identical to SEQ ID NO: 132837

SEQ ID NO: 726232 - RNA, 64 nt, Homo Sapiens; identical to SEQ ID NO: 132838

SEQ ID NO: 726233 - RNA, 64 nt, Homo Sapiens; identical to SEQ ID NO: 132839

SEQ ID NO: 726234 - RNA, 64 nt, Homo Sapiens; identical to SEQ ID NO: 132840

SEQ ID NO: 726235 - RNA, 64 nt, Homo Sapiens; identical to SEQ ID NO: 132841

SEQ ID NO: 726236 - RNA, 64 nt, Homo Sapiens; identical to SEQ ID NO: 132842

SEQ ID NO: 726237 - RNA, 64 nt, Homo Sapiens; identical to SEQ ID NO: 132843

SEQ ID NO: 726238 - RNA, 64 nt, Homo Sapiens; identical to SEQ ID NO: 132844

SEQ ID NO: 726239 - RNA, 58 nt, Homo Sapiens; identical to SEQ ID NO: 132845

SEQ ID NO: 726240 - RNA, 64 nt, Homo Sapiens; identical to SEQ ID NO: 132846

SEQ ID NO: 726241 - RNA, 64 nt, Homo Sapiens; identical to SEQ ID NO: 132847

SEQ ID NO: 726242 - RNA, 64 nt, Homo Sapiens; identical to SEQ ID NO: 132848

SEQ ID NO: 726243 - RNA, 64 nt, Homo Sapiens; identical to SEQ ID NO: 132849

SEQ ID NO: 726244 - RNA, 64 nt, Homo Sapiens; identical to SEQ ID NO: 132850

SEQ ID NO: 726245 - RNA, 64 nt, Homo Sapiens; identical to SEQ ID NO: 132851

SEQ ID NO: 726246 - RNA, 64 nt, Homo Sapiens; identical to SEQ ID NO: 132852

SEQ ID NO: 726247 - RNA, 64 nt, Homo Sapiens; identical to SEQ ID NO: 132853

SEQ ID NO: 726248 - RNA, 64 nt, Homo Sapiens; identical to SEQ ID NO: 132854

SEQ ID NO: 726249 - RNA, 64 nt, Homo Sapiens; identical to SEQ ID NO: 132855

SEQ ID NO: 726250 - RNA, 64 nt, Homo Sapiens; identical to SEQ ID NO: 132856

SEQ ID NO: 726251 - RNA, 64 nt, Homo Sapiens; identical to SEQ ID NO: 132857

SEQ ID NO: 726252 - RNA, 64 nt, Homo Sapiens; identical to SEQ ID NO: 132858

SEQ ID NO: 726253 - RNA, 64 nt, Homo Sapiens; identical to SEQ ID NO: 132859

SEQ ID NO: 726254 - RNA, 64 nt, Homo Sapiens; identical to SEQ ID NO: 132860

SEQ ID NO: 726255 - RNA, 64 nt, Homo Sapiens; identical to SEQ ID NO: 132861

SEQ ID NO: 726256 - RNA, 64 nt, Homo Sapiens; identical to SEQ ID NO: 132862

SEQ ID NO: 726257 - RNA, 64 nt, Homo Sapiens; identical to SEQ ID NO: 132863

SEQ ID NO: 726258 - RNA, 64 nt, Homo Sapiens; identical to SEQ ID NO: 132864

SEQ ID NO: 726259 - RNA, 64 nt, Homo Sapiens; identical to SEQ ID NO: 132865

SEQ ID NO: 726260 - RNA, 64 nt, Homo Sapiens; identical to SEQ ID NO: 132866

SEQ ID NO: 726261 - RNA, 64 nt, Homo Sapiens; identical to SEQ ID NO: 132867

SEQ ID NO: 726262 - RNA, 64 nt, Homo Sapiens; identical to SEQ ID NO: 132868

SEQ ID NO: 726263 - RNA, 64 nt, Homo Sapiens; identical to SEQ ID NO: 132869

SEQ ID NO: 726264 - RNA, 64 nt, Homo Sapiens; identical to SEQ ID NO: 132870

SEQ ID NO: 726265 - RNA, 64 nt, Homo Sapiens; identical to SEQ ID NO: 132871

SEQ ID NO: 726266 - RNA, 64 nt, Homo Sapiens; identical to SEQ ID NO: 132872

SEQ ID NO: 726267 - RNA, 64 nt, Homo Sapiens; identical to SEQ ID NO: 132873

SEQ ID NO: 726268 - RNA, 64 nt, Homo Sapiens; identical to SEQ ID NO: 132874

SEQ ID NO: 726269 - RNA, 64 nt, Homo Sapiens; identical to SEQ ID NO: 132875

SEQ ID NO: 726270 - RNA, 64 nt, Homo Sapiens; identical to SEQ ID NO: 132876

SEQ ID NO: 726271 - RNA, 64 nt, Homo Sapiens; identical to SEQ ID NO: 132877

SEQ ID NO: 726272 - RNA, 64 nt, Homo Sapiens; identical to SEQ ID NO: 132878

SEQ ID NO: 726273 - RNA, 64 nt, Homo Sapiens; identical to SEQ ID NO: 132879

SEQ ID NO: 726274 - RNA, 64 nt, Homo Sapiens; identical to SEQ ID NO: 132880

SEQ ID NO: 726275 - RNA, 64 nt, Homo Sapiens; identical to SEQ ID NO: 132881

SEQ ID NO: 726276 - RNA, 64 nt, Homo Sapiens; identical to SEQ ID NO: 132882

SEQ ID NO: 726277 - RNA, 64 nt, Homo Sapiens; identical to SEQ ID NO: 132883

SEQ ID NO: 726278 - RNA, 64 nt, Homo Sapiens; identical to SEQ ID NO: 132884

SEQ ID NO: 726279 - RNA, 64 nt, Homo Sapiens; identical to SEQ ID NO: 132885

SEQ ID NO: 726280 - RNA, 64 nt, Homo Sapiens; identical to SEQ ID NO: 132886

SEQ ID NO: 726281 - RNA, 64 nt, Homo Sapiens; identical to SEQ ID NO: 132887

SEQ ID NO: 726282 - RNA, 64 nt, Homo Sapiens; identical to SEQ ID NO: 132888

SEQ ID NO: 726283 - RNA, 64 nt, Homo Sapiens; identical to SEQ ID NO: 132889

SEQ ID NO: 726284 - RNA, 63 nt, Homo Sapiens
gugaucuaaugcccagcuggauuauuucaggguggggcccaauucugaaguuugagacgaggg

SEQ ID NO: 726285 - RNA, 63 nt, Homo Sapiens
cuacauccuugguuuccccagguuuccaagggaggggcccaggcauguuccagggcaggucug

SEQ ID NO: 726286 - RNA, 63 nt, Homo Sapiens
caggacaggaacaaggacaaccguuaucaugaaggggcccacugaaggcaaaggccaguuucc

SEQ ID NO: 726287 - RNA, 63 nt, Homo Sapiens
agagccugcucccacccuccggccuggagacugggggcccagcccuuucuccaccacagccaa

SEQ ID NO: 726288 - RNA, 63 nt, Homo Sapiens
ggcagccgaagcacggggucgggcagugggcaaggggcccaggucccugcugccuccucagug

SEQ ID NO: 726289 - RNA, 63 nt, Homo Sapiens
aaggccuuugggaaaggacaaggaaggggguggggggcccaauacguuguacacauaugcugc

SEQ ID NO: 726290 - RNA, 63 nt, Homo Sapiens
gaagucagggucaacucccaggccucagaugcaggggcccagaacaccugcucucaccugagc

SEQ ID NO: 726291 - RNA, 63 nt, Homo Sapiens
ggaacaccugcucucaccugaaccccaggugaaggggcccagaacaccugcucucaccugagc

SEQ ID NO: 726292 - RNA, 63 nt, Homo Sapiens
caccagccuagccuggcucuagcugcuguggguggggcccagaaaggguccucuuuuccuggc

SEQ ID NO: 726293 - RNA, 54 nt, Homo Sapiens
cagccuccgggcgugugaagcggcggggcccaggucacugagagggucccauga

SEQ ID NO: 726294 - RNA, 63 nt, Homo Sapiens
cucugauaaauccaagcccgcccaggcccacggggggcccacgggaccccccgggacuccccg

SEQ ID NO: 726295 - RNA, 63 nt, Homo Sapiens
cagggacagacauggcgagcacagugcaggcccggggcccacgggcaacauggaacccuggga

SEQ ID NO: 726296 - RNA, 63 nt, Homo Sapiens
cugccaucacuggaggcugccugcucccugucaggggcccaggccacaugcuccaaccuccca

SEQ ID NO: 726297 - RNA, 63 nt, Homo Sapiens
guggcggaagggggucccugcgccccaggauggggggcccacuuuuucagucguacgcauaga

SEQ ID NO: 726298 - RNA, 63 nt, Homo Sapiens
guggggccugggaggguuccccuggccuuaaaaggggcccaagccccaucucauccuggcacg

SEQ ID NO: 726299 - RNA, 63 nt, Homo Sapiens
cugccccuaggaugcugcagcagagugagcaagggggcccaaaucgaccauaaaggguguagg

SEQ ID NO: 726300 - RNA, 63 nt, Homo Sapiens
aucaucucacuccuuugccugcacugccaggguggggcccaccaagauuccugaucaugacgg

SEQ ID NO: 726301 - RNA, 63 nt, Homo Sapiens
acuugcaagcaacaucugcucuguuccucagguggggcccagagcccuuccccgagacugcug

SEQ ID NO: 726302 - RNA, 63 nt, Homo Sapiens
gucugcccgccccugcagccaaagcguagacccggggcccaggucaggaaguguggcgaccag

SEQ ID NO: 726303 - RNA, 63 nt, Homo Sapiens
ggcuggggccacagccuugcgccguccacccguggggcccaggccaccaaacugccaggggcu

SEQ ID NO: 726304 - RNA, 63 nt, Homo Sapiens
acagguugacuguguacccccaaccaaggagcuggggcccaaggccaguccugccccagagac

SEQ ID NO: 726305 - RNA, 63 nt, Homo Sapiens
cccagcccagccccaccacagaucccagagauaggggcccagucuccaugggggcaaggagca

SEQ ID NO: 726306 - RNA, 63 nt, Homo Sapiens
gaaaugagcacaaagacacgaagucaugggccuggggcccagggccaggguggggcccaggcc

SEQ ID NO: 726307 - RNA, 63 nt, Homo Sapiens
cgaagucaugggccuggggcccagggccaggguggggcccaggccacuggcuccagagcccug

SEQ ID NO: 726308 - RNA, 63 nt, Homo Sapiens
aaggccugggcagagacccucagugcucccggaggggcccaggcaguuggcccaggccccugg

SEQ ID NO: 726309 - RNA, 63 nt, Homo Sapiens
ugcaacgccuccugcccagcgugccggcuacugggggcccagcgacaggggacugugucugca

SEQ ID NO: 726310 - RNA, 63 nt, Homo Sapiens
cuucuguaaagcacacagauguuucuuuucuguggggcccagaggccuuucaccggguugcug

SEQ ID NO: 726311 - RNA, 63 nt, Homo Sapiens
gggcaccgcccuuucuuccuggcagagugggugggggcccaccugcugcggguggugcuucca

SEQ ID NO: 726312 - RNA, 63 nt, Homo Sapiens
gagcagggcuuaggggcuagggcggggguggggggggcccaggagguuauguuuaccaacugg

SEQ ID NO: 726313 - RNA, 63 nt, Homo Sapiens
agagacagcacaggcagcccgagagagagagaaggggcccaaggagagagagagaaagagaga

SEQ ID NO: 726314 - RNA, 63 nt, Homo Sapiens
aggcggggagggaggaggaguagggccaaguugggggcccaggggccaaggucucaugggggc

SEQ ID NO: 726315 - RNA, 63 nt, Homo Sapiens
ucuuccuugggccaaggucuacccuccaacuuuggggcccaugaugcuguacucaccuccauc

SEQ ID NO: 726316 - RNA, 63 nt, Homo Sapiens
ggcagggguaugagugcgucgggaauccauagcggggcccacaugccgucccgucauggggca

SEQ ID NO: 726317 - RNA, 63 nt, Homo Sapiens
ugggcugaaggaugggggcuggugggcccuggaggggcccauguaacugaguguggcgggaag

SEQ ID NO: 726318 - RNA, 63 nt, Homo Sapiens
uccaaggaggggcacgugcaccugauucuccuuggggcccagaggaagcugaugucauggcug

SEQ ID NO: 726319 - RNA, 63 nt, Homo Sapiens
agaacccugcugcccuuucuaggcagccuccuuggggcccaagcucugcucccuggaucugcc

SEQ ID NO: 726320 - RNA, 63 nt, Homo Sapiens
cugcucccuguuccugcuagcugaugcuagguuggggcccaccgguaguugcuuuucucucuc

SEQ ID NO: 726321 - RNA, 63 nt, Homo Sapiens
gccaacccuguaggcuucccugugaucuucuaaggggcccaggcccuaaaggggacuggcugc

SEQ ID NO: 726322 - RNA, 64 nt, Homo Sapiens; identical to SEQ ID NO: 311016

SEQ ID NO: 726323 - RNA, 64 nt, Homo Sapiens; identical to SEQ ID NO: 311017

SEQ ID NO: 726324 - RNA, 64 nt, Homo Sapiens; identical to SEQ ID NO: 311018

SEQ ID NO: 726325 - RNA, 64 nt, Homo Sapiens; identical to SEQ ID NO: 311019

SEQ ID NO: 726326 - RNA, 64 nt, Homo Sapiens; identical to SEQ ID NO: 311020

SEQ ID NO: 726327 - RNA, 64 nt, Homo Sapiens; identical to SEQ ID NO: 311021

SEQ ID NO: 726328 - RNA, 64 nt, Homo Sapiens; identical to SEQ ID NO: 311022

SEQ ID NO: 726329 - RNA, 64 nt, Homo Sapiens; identical to SEQ ID NO: 311023

SEQ ID NO: 726330 - RNA, 64 nt, Homo Sapiens; identical to SEQ ID NO: 311024

SEQ ID NO: 726331 - RNA, 64 nt, Homo Sapiens; identical to SEQ ID NO: 311025

SEQ ID NO: 726332 - RNA, 64 nt, Homo Sapiens; identical to SEQ ID NO: 311026

SEQ ID NO: 726333 - RNA, 64 nt, Homo Sapiens; identical to SEQ ID NO: 311027

SEQ ID NO: 726334 - RNA, 64 nt, Homo Sapiens; identical to SEQ ID NO: 311028

SEQ ID NO: 726335 - RNA, 64 nt, Homo Sapiens; identical to SEQ ID NO: 311029

SEQ ID NO: 726336 - RNA, 64 nt, Homo Sapiens; identical to SEQ ID NO: 311030

SEQ ID NO: 726337 - RNA, 64 nt, Homo Sapiens; identical to SEQ ID NO: 311031

SEQ ID NO: 726338 - RNA, 64 nt, Homo Sapiens; identical to SEQ ID NO: 311032

SEQ ID NO: 726339 - RNA, 64 nt, Homo Sapiens; identical to SEQ ID NO: 311033

SEQ ID NO: 726340 - RNA, 64 nt, Homo Sapiens; identical to SEQ ID NO: 311034

SEQ ID NO: 726341 - RNA, 64 nt, Homo Sapiens; identical to SEQ ID NO: 695788

SEQ ID NO: 726342 - RNA, 64 nt, Homo Sapiens; identical to SEQ ID NO: 695789

SEQ ID NO: 726343 - RNA, 64 nt, Homo Sapiens; identical to SEQ ID NO: 695790

SEQ ID NO: 726344 - RNA, 64 nt, Homo Sapiens; identical to SEQ ID NO: 695791

SEQ ID NO: 726345 - RNA, 64 nt, Homo Sapiens; identical to SEQ ID NO: 695792

SEQ ID NO: 726346 - RNA, 64 nt, Homo Sapiens; identical to SEQ ID NO: 695793

SEQ ID NO: 726347 - RNA, 64 nt, Homo Sapiens; identical to SEQ ID NO: 695794

SEQ ID NO: 726348 - RNA, 64 nt, Homo Sapiens; identical to SEQ ID NO: 695795

SEQ ID NO: 726349 - RNA, 64 nt, Homo Sapiens; identical to SEQ ID NO: 695796

SEQ ID NO: 726350 - RNA, 64 nt, Homo Sapiens; identical to SEQ ID NO: 695797

SEQ ID NO: 726351 - RNA, 64 nt, Homo Sapiens
aaucugacaggaagaagcgcuauuucucuuaauacuuagggaagcgugcucuguggcuuucccc

SEQ ID NO: 726352 - RNA, 64 nt, Homo Sapiens
agggggcauaccagguggggggaggguaaaggggcuuagggaaaugagggugggaacaugugag

SEQ ID NO: 726353 - RNA, 64 nt, Homo Sapiens
gcuuuaaguaccuuaaagcuucuccugugaacuucuuagggaaauguuagguucagaacuaaag

SEQ ID NO: 726354 - RNA, 64 nt, Homo Sapiens
uaaaaagcaaguguaguauuccauuacuauguggcuuagggauuuauuuguuuuuuaaaaucaa

SEQ ID NO: 726355 - RNA, 64 nt, Homo Sapiens
gcuucuguugagauaaucuucauuagguauauaucuuagggauacagccuuuucuuuaucuuau

SEQ ID NO: 726356 - RNA, 64 nt, Homo Sapiens
uuucuuauuucuguguuacugaggacccuaaucacuuagggauguaauuuuauaguauaaacuu

SEQ ID NO: 726357 - RNA, 64 nt, Homo Sapiens
uuuguuuccuaaaacuuuuaaaaacaguucacuacuuagggauuacauuaggagcucugcuugg

SEQ ID NO: 726358 - RNA, 64 nt, Homo Sapiens
cuugguuaguaaauuauaauuauccuguuauuuucuuagggauaggcuugaacauaaaugaaaa

SEQ ID NO: 726359 - RNA, 64 nt, Homo Sapiens
gagagaccuuauuccaaagccaaauaaaucugggcuuagggaagcuguuuugaggugucaaaua

SEQ ID NO: 726360 - RNA, 64 nt, Homo Sapiens
ccagcuauuuacaaaguacaaggugagguuuccccuuagggagcccuuacucuaagcuaaaucu

SEQ ID NO: 726361 - RNA, 64 nt, Homo Sapiens
auucaagucauggggagauugaauaugagaaaggcuuagggaaacuccuggauuuagacucaug

SEQ ID NO: 726362 - RNA, 64 nt, Homo Sapiens
ucugacaauuuaucuuccauaagcaaauaccugucuuagggaaucuugcacauggauugauuaa

SEQ ID NO: 726363 - RNA, 64 nt, Homo Sapiens
uagaccaucagaggccuugagcaacuuccucucucuuagggaauguacauuaacugagugaugc

SEQ ID NO: 726364 - RNA, 64 nt, Homo Sapiens
accucuaaagacagauuaauucuauuuugguaugcuuagggaguuaauaccaugugaacaccag

SEQ ID NO: 726365 - RNA, 64 nt, Homo Sapiens; identical to SEQ ID NO: 38255

SEQ ID NO: 726366 - RNA, 64 nt, Homo Sapiens; identical to SEQ ID NO: 38256

SEQ ID NO: 726367 - RNA, 64 nt, Homo Sapiens; identical to SEQ ID NO: 38257

SEQ ID NO: 726368 - RNA, 64 nt, Homo Sapiens; identical to SEQ ID NO: 38258

SEQ ID NO: 726369 - RNA, 64 nt, Homo Sapiens; identical to SEQ ID NO: 38259

SEQ ID NO: 726370 - RNA, 64 nt, Homo Sapiens; identical to SEQ ID NO: 38260

SEQ ID NO: 726371 - RNA, 64 nt, Homo Sapiens; identical to SEQ ID NO: 38261

SEQ ID NO: 726372 - RNA, 64 nt, Homo Sapiens; identical to SEQ ID NO: 38262

SEQ ID NO: 726373 - RNA, 64 nt, Homo Sapiens; identical to SEQ ID NO: 38263

SEQ ID NO: 726374 - RNA, 64 nt, Homo Sapiens; identical to SEQ ID NO: 38264

SEQ ID NO: 726375 - RNA, 64 nt, Homo Sapiens; identical to SEQ ID NO: 38265

SEQ ID NO: 726376 - RNA, 64 nt, Homo Sapiens; identical to SEQ ID NO: 38266

SEQ ID NO: 726377 - RNA, 64 nt, Homo Sapiens; identical to SEQ ID NO: 38267

SEQ ID NO: 726378 - RNA, 64 nt, Homo Sapiens; identical to SEQ ID NO: 38268

SEQ ID NO: 726379 - RNA, 64 nt, Homo Sapiens; identical to SEQ ID NO: 38269

SEQ ID NO: 726380 - RNA, 64 nt, Homo Sapiens; identical to SEQ ID NO: 38270

SEQ ID NO: 726381 - RNA, 64 nt, Homo Sapiens; identical to SEQ ID NO: 38271

SEQ ID NO: 726382 - RNA, 64 nt, Homo Sapiens; identical to SEQ ID NO: 38272

SEQ ID NO: 726383 - RNA, 64 nt, Homo Sapiens; identical to SEQ ID NO: 38273

SEQ ID NO: 726384 - RNA, 64 nt, Homo Sapiens; identical to SEQ ID NO: 38274

SEQ ID NO: 726385 - RNA, 64 nt, Homo Sapiens; identical to SEQ ID NO: 38275

SEQ ID NO: 726386 - RNA, 64 nt, Homo Sapiens; identical to SEQ ID NO: 38276

SEQ ID NO: 726387 - RNA, 64 nt, Homo Sapiens; identical to SEQ ID NO: 38277

SEQ ID NO: 726388 - RNA, 64 nt, Homo Sapiens; identical to SEQ ID NO: 38278

SEQ ID NO: 726389 - RNA, 64 nt, Homo Sapiens; identical to SEQ ID NO: 38279

SEQ ID NO: 726390 - RNA, 64 nt, Homo Sapiens; identical to SEQ ID NO: 38280

SEQ ID NO: 726391 - RNA, 64 nt, Homo Sapiens; identical to SEQ ID NO: 38281

SEQ ID NO: 726392 - RNA, 64 nt, Homo Sapiens; identical to SEQ ID NO: 38282

SEQ ID NO: 726393 - RNA, 64 nt, Homo Sapiens; identical to SEQ ID NO: 38283

SEQ ID NO: 726394 - RNA, 64 nt, Homo Sapiens; identical to SEQ ID NO: 38284

SEQ ID NO: 726395 - RNA, 62 nt, Homo Sapiens; identical to SEQ ID NO: 38285

SEQ ID NO: 726396 - RNA, 64 nt, Homo Sapiens; identical to SEQ ID NO: 38286

SEQ ID NO: 726397 - RNA, 64 nt, Homo Sapiens; identical to SEQ ID NO: 38287

SEQ ID NO: 726398 - RNA, 64 nt, Homo Sapiens; identical to SEQ ID NO: 38288

SEQ ID NO: 726399 - RNA, 64 nt, Homo Sapiens; identical to SEQ ID NO: 38289

SEQ ID NO: 726400 - RNA, 64 nt, Homo Sapiens; identical to SEQ ID NO: 38290

SEQ ID NO: 726401 - RNA, 64 nt, Homo Sapiens; identical to SEQ ID NO: 38291

SEQ ID NO: 726402 - RNA, 64 nt, Homo Sapiens; identical to SEQ ID NO: 38292

SEQ ID NO: 726403 - RNA, 64 nt, Homo Sapiens; identical to SEQ ID NO: 38293

SEQ ID NO: 726404 - RNA, 64 nt, Homo Sapiens; identical to SEQ ID NO: 38294

SEQ ID NO: 726405 - RNA, 64 nt, Homo Sapiens; identical to SEQ ID NO: 38295

SEQ ID NO: 726406 - RNA, 64 nt, Homo Sapiens; identical to SEQ ID NO: 38296

SEQ ID NO: 726407 - RNA, 64 nt, Homo Sapiens; identical to SEQ ID NO: 38297

SEQ ID NO: 726408 - RNA, 64 nt, Homo Sapiens; identical to SEQ ID NO: 38298

SEQ ID NO: 726409 - RNA, 64 nt, Homo Sapiens; identical to SEQ ID NO: 38299

SEQ ID NO: 726410 - RNA, 64 nt, Homo Sapiens; identical to SEQ ID NO: 38300

SEQ ID NO: 726411 - RNA, 64 nt, Homo Sapiens; identical to SEQ ID NO: 38301

SEQ ID NO: 726412 - RNA, 64 nt, Homo Sapiens; identical to SEQ ID NO: 38302

SEQ ID NO: 726413 - RNA, 64 nt, Homo Sapiens; identical to SEQ ID NO: 38303

SEQ ID NO: 726414 - RNA, 64 nt, Homo Sapiens; identical to SEQ ID NO: 38304

SEQ ID NO: 726415 - RNA, 64 nt, Homo Sapiens; identical to SEQ ID NO: 38305

SEQ ID NO: 726416 - RNA, 64 nt, Homo Sapiens; identical to SEQ ID NO: 38306

SEQ ID NO: 726417 - RNA, 64 nt, Homo Sapiens; identical to SEQ ID NO: 38307

SEQ ID NO: 726418 - RNA, 64 nt, Homo Sapiens; identical to SEQ ID NO: 38308

SEQ ID NO: 726419 - RNA, 64 nt, Homo Sapiens; identical to SEQ ID NO: 38309

SEQ ID NO: 726420 - RNA, 64 nt, Homo Sapiens; identical to SEQ ID NO: 38310

SEQ ID NO: 726421 - RNA, 64 nt, Homo Sapiens; identical to SEQ ID NO: 38311

SEQ ID NO: 726422 - RNA, 64 nt, Homo Sapiens; identical to SEQ ID NO: 38312

SEQ ID NO: 726423 - RNA, 64 nt, Homo Sapiens; identical to SEQ ID NO: 38313

SEQ ID NO: 726424 - RNA, 64 nt, Homo Sapiens; identical to SEQ ID NO: 38314

SEQ ID NO: 726425 - RNA, 64 nt, Homo Sapiens; identical to SEQ ID NO: 38315

SEQ ID NO: 726426 - RNA, 64 nt, Homo Sapiens; identical to SEQ ID NO: 38316

SEQ ID NO: 726427 - RNA, 64 nt, Homo Sapiens; identical to SEQ ID NO: 38317

SEQ ID NO: 726428 - RNA, 64 nt, Homo Sapiens; identical to SEQ ID NO: 38318

SEQ ID NO: 726429 - RNA, 64 nt, Homo Sapiens
agugucccaccuccuucaccaccccacuuggcuccuuugccaucuugaugcugagguuuccugu

SEQ ID NO: 726430 - RNA, 64 nt, Homo Sapiens
uuugugguaaaagaaaggaaagggcuucugauggcuuugccacaagcuuaccuguggguuucag

SEQ ID NO: 726431 - RNA, 64 nt, Homo Sapiens
guggguccauagacuuuuuaaugaagauuucugacuuugccacuguaaaugccuuuaaugagca

SEQ ID NO: 726432 - RNA, 64 nt, Homo Sapiens
aagcuagaaccaggaugcuuccuuauuggaaaggcuuugccaguccuuaagguacaaugaguga

SEQ ID NO: 726433 - RNA, 64 nt, Homo Sapiens
guaccccaucaagcuuacucgggaaugucaccuccuuugccacucaacuaauuccacuaggcau

SEQ ID NO: 726434 - RNA, 64 nt, Homo Sapiens
ggcaggugagaaaggcaggggucuuacugccagccuuugccacaccuuaugaggcuuagcccuu

SEQ ID NO: 726435 - RNA, 64 nt, Homo Sapiens
agcacagccuuccugaaaugcccucaccccaugccuuugccauugugugcucucagauuucuuc

SEQ ID NO: 726436 - RNA, 64 nt, Homo Sapiens
cggcuggggacaauggccacuuacuaccugugcacuuugccacucgggacaccuggaugguuuc

SEQ ID NO: 726437 - RNA, 64 nt, Homo Sapiens
guacuuuuuuauuuaaaaaaugaauaucugcaaucuuugccaaguuuaucacuguuuaaagcuu

SEQ ID NO: 726438 - RNA, 64 nt, Homo Sapiens
ucagguucacagcagcuuugggcuuccaucaaaccuuugccaacagauaucuaugaaaaccagu

SEQ ID NO: 726439 - RNA, 64 nt, Homo Sapiens
auccuaaaucuggaguuuuauuugccagcacugccuuugccagcuuuccaugugcauuaaauac

SEQ ID NO: 726440 - RNA, 64 nt, Homo Sapiens
acugccuuugccagcauccuaugugcauuaaauacuuugccagccaaaauagaauagcauuucc

SEQ ID NO: 726441 - RNA, 64 nt, Homo Sapiens
uauuuucccaaacacuacaaaaaaacuuuuaaaacuuugccauuucaucuguuuacacucuuug

SEQ ID NO: 726442 - RNA, 64 nt, Homo Sapiens
cuuuuaaaacuuugccauuucaucuguuuacacucuuugccacugauuagcaguauuuaaaucu

SEQ ID NO: 726443 - RNA, 64 nt, Homo Sapiens
caggugaggugcuguguucaauuuugcccacagacuuugccacccacuauuuggggggauguaa

SEQ ID NO: 726444 - RNA, 64 nt, Homo Sapiens
gagaacugugugagguuuugugauuggcagccugcuuugccaaauugacacucuugggccacuc

SEQ ID NO: 726445 - RNA, 64 nt, Homo Sapiens
aagcuaggaugguucugugauuagugccacccaccuuugccacaccucauccccacaaucuggc

SEQ ID NO: 726446 - RNA, 64 nt, Homo Sapiens
auaccagagccuucaagugcgccucccauaauugcuuugccaaacaguugccgucuaggauugg

SEQ ID NO: 726447 - RNA, 64 nt, Homo Sapiens
guagauguugcacaccagccuuacagcugggagccuuugccaugguacuuagguagggugugug

SEQ ID NO: 726448 - RNA, 64 nt, Homo Sapiens
uauuacacaugggcauauucugauguuucucauccuuugccagaagacuaccuuacauccaucg

SEQ ID NO: 726449 - RNA, 64 nt, Homo Sapiens
aauuaaaaaagaaagaaauuugaaaaaacuuucucuuugccauuucuucuucuucuuuuuuaac

SEQ ID NO: 726450 - RNA, 64 nt, Homo Sapiens
uuugcccaaaucuucuucagauucagcauuuguucuuugccagucucauuuucaucuucuucca

SEQ ID NO: 726451 - RNA, 64 nt, Homo Sapiens
aaauauauuuaguguuuugccagaaucucucuugcuuugccauuaagcagaagaacuaguuucc

SEQ ID NO: 726452 - RNA, 64 nt, Homo Sapiens
ucaucagggccugugaauacccaggugccuguaucuuugccaagaccgugaucaagguagcuua

SEQ ID NO: 726453 - RNA, 64 nt, Homo Sapiens
uguucuuuucccguaucaauucauuccuucaucucuuugccaaguuguuuuccuuucagggccu

SEQ ID NO: 726454 - RNA, 64 nt, Homo Sapiens
gguuaugauuuugaaggcuguggguucagggagucuuugccaauccuguuggcccuaaacuauc

SEQ ID NO: 726455 - RNA, 64 nt, Homo Sapiens
ggaguacuucagggguggccucuggccccagagccuuugccacagugcucccaccagcccccac

SEQ ID NO: 726456 - RNA, 64 nt, Homo Sapiens
auuccccugagagaauucccucacucacggcucccuuugccagagucaguucaaucaggucuga

SEQ ID NO: 726457 - RNA, 64 nt, Homo Sapiens
ggaugacuuuggaugggucauaaggaucuucccacuuugccacuucaaagaagccugguggcaa

SEQ ID NO: 726458 - RNA, 64 nt, Homo Sapiens
uccauugacugacccccucccuagaaucacuugacuuugccacacccaaacccacccauaccag

SEQ ID NO: 726459 - RNA, 64 nt, Homo Sapiens
accuuuuuuuucacauuuuacauaaauaauaaugcuuugccagcaguacgugguagccacaauu

SEQ ID NO: 726460 - RNA, 64 nt, Homo Sapiens
aauucagagaaaucaucugauguuucuauagucacuuugccagcucaaaagaaaacaauacccu

SEQ ID NO: 726461 - RNA, 64 nt, Homo Sapiens
acacccuucucagauggccacgauguaggcuccacuuugccaacuucccgagaacaaacaggcc

SEQ ID NO: 726462 - RNA, 64 nt, Homo Sapiens
gugucaccugcuguggcaaaauggguuuagaaaucuuugccaggucauggcccacuggauucug

SEQ ID NO: 726463 - RNA, 64 nt, Homo Sapiens
gcacggcuccguuucuuaaauggagaaugcaagucuuugccaugcugugagugacaugggccuc

SEQ ID NO: 726464 - RNA, 64 nt, Homo Sapiens
ggaaaggacaaauacauuucaaagcuuguauauacuuugccacuuuaaaaacagaaaacaaaga

SEQ ID NO: 726465 - RNA, 64 nt, Homo Sapiens
augcugugugcuagccagggccagcugguaccuucuuugccaugagcauucaagggacggcuaa

SEQ ID NO: 726466 - RNA, 64 nt, Homo Sapiens
uugcagugguuguguuuugcauaaaaugucuagucuuugccacagauagugagcuacccacuaa

SEQ ID NO: 726467 - RNA, 64 nt, Homo Sapiens
caauuugugaguauuaaugucaguacuaccagcacuuugccaaaacugucagagggacccguuu

SEQ ID NO: 726468 - RNA, 64 nt, Homo Sapiens
ugagugguuccuucaagcugggugucuuuccagccuuugccagucuagccccagcagggcaccg

SEQ ID NO: 726469 - RNA, 64 nt, Homo Sapiens
gccauucaugacccuuaaguuggaacagcugggcaugggucaugcucugucuccccauguccuc

SEQ ID NO: 726470 - RNA, 64 nt, Homo Sapiens
uaagugcuguccauaugaacgagaaaccccaaggaugggucauccaggcaccagagcagggacu

SEQ ID NO: 726471 - RNA, 64 nt, Homo Sapiens
aaguacagauuuaauaaagucuaaacuuggauaaaugggucagacaguuuagagcaaacuguca

SEQ ID NO: 726472 - RNA, 64 nt, Homo Sapiens
caacugauuagaaaaucaaauuuaacucauccauaugggucaauauaagacauugccaucucua

SEQ ID NO: 726473 - RNA, 64 nt, Homo Sapiens
ccucuucacagggccaagaauucagcaugccagcaugggucagggcuacaggccucucacaacc

SEQ ID NO: 726474 - RNA, 64 nt, Homo Sapiens
uuguguaaaggucucugguggaagcagaaggcuaaugggucacaggcuuucugcacugaaagug

SEQ ID NO: 726475 - RNA, 64 nt, Homo Sapiens
aacccaggccagcugggcucgcacggcagucucaaugggucagaggaggugacggagcaucgug

SEQ ID NO: 726476 - RNA, 64 nt, Homo Sapiens
agcccuuccuguucucuccauugcuucuauaaaaaugggucagucauugcucaaaucguuaggg

SEQ ID NO: 726477 - RNA, 64 nt, Homo Sapiens
gugcuggacuucuaauauauagaacugugagauaaugggucacauuggcuggaugugguggcuc

SEQ ID NO: 726478 - RNA, 64 nt, Homo Sapiens
agugagacuccaucauaaauaaauaaauaaauaaaugggucacauuaagccuuuaaguuugugg

SEQ ID NO: 726479 - RNA, 64 nt, Homo Sapiens; identical to SEQ ID NO: 56583

SEQ ID NO: 726480 - RNA, 64 nt, Homo Sapiens; identical to SEQ ID NO: 56584

SEQ ID NO: 726481 - RNA, 64 nt, Homo Sapiens; identical to SEQ ID NO: 56585

SEQ ID NO: 726482 - RNA, 64 nt, Homo Sapiens; identical to SEQ ID NO: 56586

SEQ ID NO: 726483 - RNA, 64 nt, Homo Sapiens; identical to SEQ ID NO: 56587

SEQ ID NO: 726484 - RNA, 64 nt, Homo Sapiens; identical to SEQ ID NO: 56588

SEQ ID NO: 726485 - RNA, 64 nt, Homo Sapiens; identical to SEQ ID NO: 56589

SEQ ID NO: 726486 - RNA, 64 nt, Homo Sapiens; identical to SEQ ID NO: 56590

SEQ ID NO: 726487 - RNA, 64 nt, Homo Sapiens; identical to SEQ ID NO: 56591

SEQ ID NO: 726488 - RNA, 64 nt, Homo Sapiens; identical to SEQ ID NO: 56592

SEQ ID NO: 726489 - RNA, 64 nt, Homo Sapiens; identical to SEQ ID NO: 56593

SEQ ID NO: 726490 - RNA, 64 nt, Homo Sapiens; identical to SEQ ID NO: 56594

SEQ ID NO: 726491 - RNA, 64 nt, Homo Sapiens; identical to SEQ ID NO: 56595

SEQ ID NO: 726492 - RNA, 64 nt, Homo Sapiens; identical to SEQ ID NO: 56596

SEQ ID NO: 726493 - RNA, 64 nt, Homo Sapiens; identical to SEQ ID NO: 56597

SEQ ID NO: 726494 - RNA, 64 nt, Homo Sapiens; identical to SEQ ID NO: 56598

SEQ ID NO: 726495 - RNA, 64 nt, Homo Sapiens; identical to SEQ ID NO: 296072

SEQ ID NO: 726496 - RNA, 64 nt, Homo Sapiens; identical to SEQ ID NO: 296072

SEQ ID NO: 726497 - RNA, 64 nt, Homo Sapiens; identical to SEQ ID NO: 296074

SEQ ID NO: 726498 - RNA, 64 nt, Homo Sapiens; identical to SEQ ID NO: 296075

SEQ ID NO: 726499 - RNA, 64 nt, Homo Sapiens; identical to SEQ ID NO: 296076

SEQ ID NO: 726500 - RNA, 64 nt, Homo Sapiens; identical to SEQ ID NO: 296077

SEQ ID NO: 726501 - RNA, 64 nt, Homo Sapiens; identical to SEQ ID NO: 291116

SEQ ID NO: 726502 - RNA, 64 nt, Homo Sapiens; identical to SEQ ID NO: 291117

SEQ ID NO: 726503 - RNA, 64 nt, Homo Sapiens; identical to SEQ ID NO: 291118

SEQ ID NO: 726504 - RNA, 64 nt, Homo Sapiens; identical to SEQ ID NO: 291119

SEQ ID NO: 726505 - RNA, 62 nt, Homo Sapiens; identical to SEQ ID NO: 291120

SEQ ID NO: 726506 - RNA, 64 nt, Homo Sapiens; identical to SEQ ID NO: 291121

SEQ ID NO: 726507 - RNA, 64 nt, Homo Sapiens; identical to SEQ ID NO: 291122

SEQ ID NO: 726508 - RNA, 64 nt, Homo Sapiens; identical to SEQ ID NO: 291123

SEQ ID NO: 726509 - RNA, 64 nt, Homo Sapiens; identical to SEQ ID NO: 291124

SEQ ID NO: 726510 - RNA, 64 nt, Homo Sapiens; identical to SEQ ID NO: 291125

SEQ ID NO: 726511 - RNA, 64 nt, Homo Sapiens; identical to SEQ ID NO: 291126

SEQ ID NO: 726512 - RNA, 64 nt, Homo Sapiens; identical to SEQ ID NO: 291127

SEQ ID NO: 726513 - RNA, 64 nt, Homo Sapiens; identical to SEQ ID NO: 291128

SEQ ID NO: 726514 - RNA, 64 nt, Homo Sapiens; identical to SEQ ID NO: 291129

SEQ ID NO: 726515 - RNA, 64 nt, Homo Sapiens; identical to SEQ ID NO: 291130

SEQ ID NO: 726516 - RNA, 64 nt, Homo Sapiens; identical to SEQ ID NO: 291131

SEQ ID NO: 726517 - RNA, 64 nt, Homo Sapiens; identical to SEQ ID NO: 291132

SEQ ID NO: 726518 - RNA, 64 nt, Homo Sapiens; identical to SEQ ID NO: 291133

SEQ ID NO: 726519 - RNA, 64 nt, Homo Sapiens; identical to SEQ ID NO: 291134

SEQ ID NO: 726520 - RNA, 64 nt, Homo Sapiens; identical to SEQ ID NO: 291135

SEQ ID NO: 726521 - RNA, 64 nt, Homo Sapiens; identical to SEQ ID NO: 291136

SEQ ID NO: 726522 - RNA, 64 nt, Homo Sapiens; identical to SEQ ID NO: 291137

SEQ ID NO: 726523 - RNA, 64 nt, Homo Sapiens; identical to SEQ ID NO: 291138

SEQ ID NO: 726524 - RNA, 64 nt, Homo Sapiens; identical to SEQ ID NO: 291139

SEQ ID NO: 726525 - RNA, 64 nt, Homo Sapiens; identical to SEQ ID NO: 291140

SEQ ID NO: 726526 - RNA, 64 nt, Homo Sapiens; identical to SEQ ID NO: 291141

SEQ ID NO: 726527 - RNA, 64 nt, Homo Sapiens; identical to SEQ ID NO: 291142

SEQ ID NO: 726528 - RNA, 64 nt, Homo Sapiens; identical to SEQ ID NO: 291143

SEQ ID NO: 726529 - RNA, 64 nt, Homo Sapiens; identical to SEQ ID NO: 291144

SEQ ID NO: 726530 - RNA, 64 nt, Homo Sapiens; identical to SEQ ID NO: 291145

SEQ ID NO: 726531 - RNA, 64 nt, Homo Sapiens; identical to SEQ ID NO: 291146

SEQ ID NO: 726532 - RNA, 64 nt, Homo Sapiens; identical to SEQ ID NO: 291147

SEQ ID NO: 726533 - RNA, 64 nt, Homo Sapiens; identical to SEQ ID NO: 291148

SEQ ID NO: 726534 - RNA, 64 nt, Homo Sapiens; identical to SEQ ID NO: 291149

SEQ ID NO: 726535 - RNA, 64 nt, Homo Sapiens
guaacuugaaagcacuugcuguauuagugagaauacuugguacaccccauuuagauacacuacu

SEQ ID NO: 726536 - RNA, 64 nt, Homo Sapiens
acuacuaaaucuacuauaucaguggacuuuuaaaacuugguacuuaugcaguuaaaucuguauc

SEQ ID NO: 726537 - RNA, 64 nt, Homo Sapiens
aggcauacucagccagaaaucugaguuuugugagacuugguaauacagagauggacaaucguac

SEQ ID NO: 726538 - RNA, 64 nt, Homo Sapiens
ggaaaauguuaucagugaauaggugguguacuuuacuugguauaauuuaaaguugcacaguaag

SEQ ID NO: 726539 - RNA, 64 nt, Homo Sapiens
ucuacuguauauaacaucuaugcuuaaacuauugacuugguaaggaacagugaaguggcuugau

SEQ ID NO: 726540 - RNA, 64 nt, Homo Sapiens; identical to SEQ ID NO: 726539

SEQ ID NO: 726541 - RNA, 64 nt, Homo Sapiens
uuaaauguuuuuaucuuacucuuucuguacagauauaucaaaucacaugaaauauuuaaaguuu

SEQ ID NO: 726542 - RNA, 64 nt, Homo Sapiens
auuaauauucugggucugaucugucagagaauaaauaucaaaucuaaauuuaauguagagauac

SEQ ID NO: 726543 - RNA, 64 nt, Homo Sapiens
agaaaauggugggauuuuuuuuuaucaugauuaaauaucaaaaaauugcccuaugaaaacuuua

SEQ ID NO: 726544 - RNA, 64 nt, Homo Sapiens
gaaauauccuaagguaacuuggaagcuguguaguauaucaaauuaauuugcuaccuaauaacau

SEQ ID NO: 726545 - RNA, 64 nt, Homo Sapiens
guggucuuuuuaaaaaauuguaacccucuagaaaauaucaaagaaaugaaccagacgugguuua

SEQ ID NO: 726546 - RNA, 64 nt, Homo Sapiens
aacugaaucauuuuuuaacuuaaaaagcuggaaaauaucaaaugcuguuuuuuuuuuuucauug

SEQ ID NO: 726547 - RNA, 64 nt, Homo Sapiens
ucaguaucuugaaaucaucuccaauauucuagaaauaucaaaugagaauacuuuaugauuuaga

SEQ ID NO: 726548 - RNA, 64 nt, Homo Sapiens
ucaguaacaguguucuuucuaauuuacugccauaauaucaaaggauuaagguauuuuaguaugc

SEQ ID NO: 726549 - RNA, 64 nt, Homo Sapiens
aauaaucaauuuaguuaccuaauaucuuaguaugauaucaaaaguagugaacaggccuguuuua

SEQ ID NO: 726550 - RNA, 64 nt, Homo Sapiens
ucagauugcugguaggugugucugaaacauuuuuauaucaaaaagaggcauuucuguuguuauc

SEQ ID NO: 726551 - RNA, 64 nt, Homo Sapiens
uucuucucucuuuuauauuaugauuugcucucaaauaucaaauuuugugaaaaaaauauuaaag

SEQ ID NO: 726552 - RNA, 64 nt, Homo Sapiens
ucagaaagaaugucaaaucaaacuucucagaaagauaucaaaucguggaaauaaaaacuaaggu

SEQ ID NO: 726553 - RNA, 64 nt, Homo Sapiens
guaaauaaccucagcugggaugaggagugacagaauaucaaaauaauuuguggcuguggauuuu

SEQ ID NO: 726554 - RNA, 64 nt, Homo Sapiens
gaggugguauugugggguaauugcuuaaauuuacauaucaaaguaaaaaaguagugccuguauu

SEQ ID NO: 726555 - RNA, 64 nt, Homo Sapiens
uuauuggccauaauugcuacucuucauacacaguauaucaaagagcuugauaauuuaguuguca

SEQ ID NO: 726556 - RNA, 64 nt, Homo Sapiens
aacacagcaguuuuccuugcuuuuuauaugcagaauaucaaagucauuucuaauuuaguuguca

SEQ ID NO: 726557 - RNA, 64 nt, Homo Sapiens
ggcuguagauguuggaggcuagggaggcuaguaaauaucaaaaggaaaagggagugggaauugc

SEQ ID NO: 726558 - RNA, 64 nt, Homo Sapiens
aaggaaaagggagugggaauugcuaucauguaaaauaucaaaguuaaaauacuaaggugcauuu

SEQ ID NO: 726559 - RNA, 64 nt, Homo Sapiens
agagucaacauugauccagugcauuuuauaaaugauaucaaagaacuuaguaaguaauaucaaa

SEQ ID NO: 726560 - RNA, 64 nt, Homo Sapiens
auuuuauaaaugauaucaaagaacuuaguaaguaauaucaaagcaccuuguuugaguuaucagg

SEQ ID NO: 726561 - RNA, 64 nt, Homo Sapiens
ucugguuguauugggaaccaaugcaguccaaggaauaucaaaauuuaaucuuccucuagcaggc

SEQ ID NO: 726562 - RNA, 64 nt, Homo Sapiens
ucugauuguaugggaaccaaaugcaguccaaggaauaucaaaauuuaauuuuccucuagcaggc

SEQ ID NO: 726563 - RNA, 64 nt, Homo Sapiens; identical to SEQ ID NO: 723868

SEQ ID NO: 726564 - RNA, 64 nt, Homo Sapiens; identical to SEQ ID NO: 723869

SEQ ID NO: 726565 - RNA, 64 nt, Homo Sapiens; identical to SEQ ID NO: 723870

SEQ ID NO: 726566 - RNA, 64 nt, Homo Sapiens; identical to SEQ ID NO: 723871

SEQ ID NO: 726567 - RNA, 64 nt, Homo Sapiens; identical to SEQ ID NO: 723872

SEQ ID NO: 726568 - RNA, 64 nt, Homo Sapiens; identical to SEQ ID NO: 723873

SEQ ID NO: 726569 - RNA, 64 nt, Homo Sapiens; identical to SEQ ID NO: 723874

SEQ ID NO: 726570 - RNA, 64 nt, Homo Sapiens; identical to SEQ ID NO: 723875

SEQ ID NO: 726571 - RNA, 64 nt, Homo Sapiens; identical to SEQ ID NO: 723876

SEQ ID NO: 726572 - RNA, 64 nt, Homo Sapiens; identical to SEQ ID NO: 723877

SEQ ID NO: 726573 - RNA, 64 nt, Homo Sapiens; identical to SEQ ID NO: 723878

SEQ ID NO: 726574 - RNA, 64 nt, Homo Sapiens; identical to SEQ ID NO: 723879

SEQ ID NO: 726575 - RNA, 64 nt, Homo Sapiens; identical to SEQ ID NO: 723880

SEQ ID NO: 726576 - RNA, 64 nt, Homo Sapiens; identical to SEQ ID NO: 723881

SEQ ID NO: 726577 - RNA, 64 nt, Homo Sapiens; identical to SEQ ID NO: 723882

SEQ ID NO: 726578 - RNA, 64 nt, Homo Sapiens; identical to SEQ ID NO: 723883

SEQ ID NO: 726579 - RNA, 64 nt, Homo Sapiens; identical to SEQ ID NO: 582838

SEQ ID NO: 726580 - RNA, 64 nt, Homo Sapiens; identical to SEQ ID NO: 582839

SEQ ID NO: 726581 - RNA, 64 nt, Homo Sapiens; identical to SEQ ID NO: 582840

SEQ ID NO: 726582 - RNA, 64 nt, Homo Sapiens; identical to SEQ ID NO: 582841

SEQ ID NO: 726583 - RNA, 64 nt, Homo Sapiens; identical to SEQ ID NO: 582842

SEQ ID NO: 726584 - RNA, 64 nt, Homo Sapiens; identical to SEQ ID NO: 582843

SEQ ID NO: 726585 - RNA, 64 nt, Homo Sapiens; identical to SEQ ID NO: 582844

SEQ ID NO: 726586 - RNA, 64 nt, Homo Sapiens; identical to SEQ ID NO: 582845

SEQ ID NO: 726587 - RNA, 64 nt, Homo Sapiens; identical to SEQ ID NO: 582846

SEQ ID NO: 726588 - RNA, 64 nt, Homo Sapiens; identical to SEQ ID NO: 582847

SEQ ID NO: 726589 - RNA, 64 nt, Homo Sapiens; identical to SEQ ID NO: 582848

SEQ ID NO: 726590 - RNA, 64 nt, Homo Sapiens; identical to SEQ ID NO: 582849

SEQ ID NO: 726591 - RNA, 64 nt, Homo Sapiens; identical to SEQ ID NO: 582850

SEQ ID NO: 726592 - RNA, 64 nt, Homo Sapiens; identical to SEQ ID NO: 582851

SEQ ID NO: 726593 - RNA, 64 nt, Homo Sapiens; identical to SEQ ID NO: 582852

SEQ ID NO: 726594 - RNA, 64 nt, Homo Sapiens; identical to SEQ ID NO: 362209

SEQ ID NO: 726595 - RNA, 64 nt, Homo Sapiens; identical to SEQ ID NO: 362210

SEQ ID NO: 726596 - RNA, 64 nt, Homo Sapiens; identical to SEQ ID NO: 362211

SEQ ID NO: 726597 - RNA, 64 nt, Homo Sapiens; identical to SEQ ID NO: 362212

SEQ ID NO: 726598 - RNA, 64 nt, Homo Sapiens; identical to SEQ ID NO: 362213

SEQ ID NO: 726599 - RNA, 64 nt, Homo Sapiens; identical to SEQ ID NO: 362214

SEQ ID NO: 726600 - RNA, 64 nt, Homo Sapiens; identical to SEQ ID NO: 362215

SEQ ID NO: 726601 - RNA, 64 nt, Homo Sapiens; identical to SEQ ID NO: 362216

SEQ ID NO: 726602 - RNA, 64 nt, Homo Sapiens; identical to SEQ ID NO: 362217

SEQ ID NO: 726603 - RNA, 64 nt, Homo Sapiens; identical to SEQ ID NO: 362218

SEQ ID NO: 726604 - RNA, 64 nt, Homo Sapiens; identical to SEQ ID NO: 235742

SEQ ID NO: 726605 - RNA, 64 nt, Homo Sapiens; identical to SEQ ID NO: 235743

SEQ ID NO: 726606 - RNA, 64 nt, Homo Sapiens; identical to SEQ ID NO: 235744

SEQ ID NO: 726607 - RNA, 64 nt, Homo Sapiens; identical to SEQ ID NO: 235745

SEQ ID NO: 726608 - RNA, 64 nt, Homo Sapiens; identical to SEQ ID NO: 160193

SEQ ID NO: 726609 - RNA, 64 nt, Homo Sapiens; identical to SEQ ID NO: 160194

SEQ ID NO: 726610 - RNA, 64 nt, Homo Sapiens; identical to SEQ ID NO: 160195

SEQ ID NO: 726611 - RNA, 64 nt, Homo Sapiens; identical to SEQ ID NO: 160196

SEQ ID NO: 726612 - RNA, 64 nt, Homo Sapiens; identical to SEQ ID NO: 160197

SEQ ID NO: 726613 - RNA, 64 nt, Homo Sapiens; identical to SEQ ID NO: 160198

SEQ ID NO: 726614 - RNA, 59 nt, Homo Sapiens; identical to SEQ ID NO: 160199

SEQ ID NO: 726615 - RNA, 64 nt, Homo Sapiens; identical to SEQ ID NO: 160200

SEQ ID NO: 726616 - RNA, 64 nt, Homo Sapiens; identical to SEQ ID NO: 160201

SEQ ID NO: 726617 - RNA, 64 nt, Homo Sapiens; identical to SEQ ID NO: 160202

SEQ ID NO: 726618 - RNA, 64 nt, Homo Sapiens; identical to SEQ ID NO: 160203

SEQ ID NO: 726619 - RNA, 64 nt, Homo Sapiens; identical to SEQ ID NO: 160204

SEQ ID NO: 726620 - RNA, 64 nt, Homo Sapiens; identical to SEQ ID NO: 160205

SEQ ID NO: 726621 - RNA, 64 nt, Homo Sapiens; identical to SEQ ID NO: 160206

SEQ ID NO: 726622 - RNA, 64 nt, Homo Sapiens; identical to SEQ ID NO: 160207

SEQ ID NO: 726623 - RNA, 64 nt, Homo Sapiens; identical to SEQ ID NO: 160208

SEQ ID NO: 726624 - RNA, 64 nt, Homo Sapiens; identical to SEQ ID NO: 160209

SEQ ID NO: 726625 - RNA, 64 nt, Homo Sapiens; identical to SEQ ID NO: 160210

SEQ ID NO: 726626 - RNA, 64 nt, Homo Sapiens; identical to SEQ ID NO: 160211

SEQ ID NO: 726627 - RNA, 64 nt, Homo Sapiens; identical to SEQ ID NO: 160212

SEQ ID NO: 726628 - RNA, 64 nt, Homo Sapiens; identical to SEQ ID NO: 160213

SEQ ID NO: 726629 - RNA, 64 nt, Homo Sapiens; identical to SEQ ID NO: 160214

SEQ ID NO: 726630 - RNA, 64 nt, Homo Sapiens; identical to SEQ ID NO: 160215

SEQ ID NO: 726631 - RNA, 64 nt, Homo Sapiens; identical to SEQ ID NO: 160216

SEQ ID NO: 726632 - RNA, 64 nt, Homo Sapiens; identical to SEQ ID NO: 160217

SEQ ID NO: 726633 - RNA, 64 nt, Homo Sapiens; identical to SEQ ID NO: 160218

SEQ ID NO: 726634 - RNA, 64 nt, Homo Sapiens; identical to SEQ ID NO: 160219

SEQ ID NO: 726635 - RNA, 64 nt, Homo Sapiens; identical to SEQ ID NO: 160220

SEQ ID NO: 726636 - RNA, 64 nt, Homo Sapiens; identical to SEQ ID NO: 160221

SEQ ID NO: 726637 - RNA, 64 nt, Homo Sapiens; identical to SEQ ID NO: 160222

SEQ ID NO: 726638 - RNA, 64 nt, Homo Sapiens; identical to SEQ ID NO: 160223

SEQ ID NO: 726639 - RNA, 64 nt, Homo Sapiens; identical to SEQ ID NO: 160224

SEQ ID NO: 726640 - RNA, 64 nt, Homo Sapiens; identical to SEQ ID NO: 160225

SEQ ID NO: 726641 - RNA, 64 nt, Homo Sapiens; identical to SEQ ID NO: 160226

SEQ ID NO: 726642 - RNA, 64 nt, Homo Sapiens; identical to SEQ ID NO: 160227

SEQ ID NO: 726643 - RNA, 64 nt, Homo Sapiens; identical to SEQ ID NO: 160228

SEQ ID NO: 726644 - RNA, 64 nt, Homo Sapiens; identical to SEQ ID NO: 160229

SEQ ID NO: 726645 - RNA, 64 nt, Homo Sapiens; identical to SEQ ID NO: 160230

SEQ ID NO: 726646 - RNA, 64 nt, Homo Sapiens; identical to SEQ ID NO: 160231

SEQ ID NO: 726647 - RNA, 64 nt, Homo Sapiens; identical to SEQ ID NO: 160232

SEQ ID NO: 726648 - RNA, 64 nt, Homo Sapiens; identical to SEQ ID NO: 160233

SEQ ID NO: 726649 - RNA, 64 nt, Homo Sapiens; identical to SEQ ID NO: 160234

SEQ ID NO: 726650 - RNA, 64 nt, Homo Sapiens; identical to SEQ ID NO: 160235

SEQ ID NO: 726651 - RNA, 64 nt, Homo Sapiens; identical to SEQ ID NO: 160236

SEQ ID NO: 726652 - RNA, 64 nt, Homo Sapiens
uccccauguucauagcugccuuucuuaccauuuugguuugaagggcagucuucucuggcuuguu

SEQ ID NO: 726653 - RNA, 64 nt, Homo Sapiens
uggcuucugcuaagugagaugggaaccacuggaggguuugaacagaggagugccuugauugauu

SEQ ID NO: 726654 - RNA, 64 nt, Homo Sapiens
cuaaaauucaaaacaggcauccuauguagcacuagguuugaauuucuuuccaauaaaaaugagc

SEQ ID NO: 726655 - RNA, 64 nt, Homo Sapiens
uuagacuguuagucaucuguucagaaucagcacagguuugaagacauuuuuguccauuuguguu

SEQ ID NO: 726656 - RNA, 64 nt, Homo Sapiens
gugaacaaaacuguguuuuggugaagagcuguuugguuugaacccugugaggcagcucuggaac

SEQ ID NO: 726657 - RNA, 64 nt, Homo Sapiens
aguugaagaccagagaaaagugucucugacugcagguuugaauaaauugcuuaggagaaaccau

SEQ ID NO: 726658 - RNA, 64 nt, Homo Sapiens
ucauugucaucaauaucuacagaagcucuuugacgguuugaauacuauggcucaagguuuucau

SEQ ID NO: 726659 - RNA, 64 nt, Homo Sapiens
auuuucugauguggagauauguuauuaaugaagugguuugaaaauuuguuauauuaaaagugca

SEQ ID NO: 726660 - RNA, 64 nt, Homo Sapiens
gcuuuuuuaaaaaaaaagaaaaagggaagaauuagguuugaauugguugggugggaggaggaag

SEQ ID NO: 726661 - RNA, 64 nt, Homo Sapiens
gcuuuuuaaaaaaaaaagaaaaagggaagaauuagguuugaauugguugggugggaggaggaag

SEQ ID NO: 726662 - RNA, 64 nt, Homo Sapiens
aaugguauuuucacuuuucuuuguaacauugaaugguuugaaguacucaaaaucuguuacgcua

SEQ ID NO: 726663 - RNA, 64 nt, Homo Sapiens
ccucuguugcuuuaguauuuauuacaauaaaaaggguuugaaauauagcuguucuuuaugcaua

SEQ ID NO: 726664 - RNA, 64 nt, Homo Sapiens
cuggcucagcaaguggagguuuucuguggaguuugguuugaagacuaguugcauuaguacuguc

SEQ ID NO: 726665 - RNA, 64 nt, Homo Sapiens
gaggaucuucuucaguuguaguccaauuuuagcagguuugaaggugaaugccggggagaaaccu

SEQ ID NO: 726666 - RNA, 64 nt, Homo Sapiens
cacacacuggggauagauaagcuaccugguaaaggguuugaacauuuacaaaaugucacacuuu

SEQ ID NO: 726667 - RNA, 64 nt, Homo Sapiens
ugucacacuuuuucuuaaaagaaaaauauuuugggguuugaauaaaauggaccaccauuucuca

SEQ ID NO: 726668 - RNA, 64 nt, Homo Sapiens
caagcuauucuccugccucagccuucugaguagcugcgacuaugggcgugugccaccaugccca

SEQ ID NO: 726669 - RNA, 64 nt, Homo Sapiens
aaaauuacuagauugcacuauaggccucaguuucugcgacuaugucacauguacaaaucacuuc

SEQ ID NO: 726670 - RNA, 64 nt, Homo Sapiens
uacaaagauucucuauguaucaaauguaacuuacugcgacuaaacuuaauuuaauauuuacucu

SEQ ID NO: 726671 - RNA, 64 nt, Homo Sapiens
auaaccuguaccuauaaaucgugcaauaaccauaugcgacuauuuugccauggagaaaucugac

SEQ ID NO: 726672 - RNA, 64 nt, Homo Sapiens
aaggcucgcagcaagagcacgcugugcccaacccugcgacuagcacagaaugguaacuaagggu

SEQ ID NO: 726673 - RNA, 64 nt, Homo Sapiens
aaguagaauaaaugcaagaggugcaguuacuugaugcgacuaaaagcaauuauuuauuuuaaau

SEQ ID NO: 726674 - RNA, 64 nt, Homo Sapiens
gcgccagcuccggggcgaguucagcacugcggggugcgacuagggcugcgcugccagggucacu

SEQ ID NO: 726675 - RNA, 64 nt, Homo Sapiens
cccacacgcccucucugggcccaccaccugcaucugcgacuagagagcacccggcccacguugg

SEQ ID NO: 726676 - RNA, 64 nt, Homo Sapiens
uugacaauguguauauguaaauuaugcaaaugaaugcgacuauguuuucuguuauuaauauaua

SEQ ID NO: 726677 - RNA, 64 nt, Homo Sapiens
agcagggcugccucuucuccugacgcacgcuggcugcgacuaggacccuuguggggccuggaca

SEQ ID NO: 726678 - RNA, 64 nt, Homo Sapiens
uggcuguaucagccgaaccaggagaggccugggcugcgacuaaggagaaagaaaucggggguuu

SEQ ID NO: 726679 - RNA, 64 nt, Homo Sapiens; identical to SEQ ID NO: 664045

SEQ ID NO: 726680 - RNA, 64 nt, Homo Sapiens; identical to SEQ ID NO: 664046

SEQ ID NO: 726681 - RNA, 64 nt, Homo Sapiens; identical to SEQ ID NO: 664047

SEQ ID NO: 726682 - RNA, 64 nt, Homo Sapiens; identical to SEQ ID NO: 664048

SEQ ID NO: 726683 - RNA, 64 nt, Homo Sapiens; identical to SEQ ID NO: 664049

SEQ ID NO: 726684 - RNA, 64 nt, Homo Sapiens; identical to SEQ ID NO: 664050

SEQ ID NO: 726685 - RNA, 64 nt, Homo Sapiens; identical to SEQ ID NO: 664051

SEQ ID NO: 726686 - RNA, 64 nt, Homo Sapiens; identical to SEQ ID NO: 664052

SEQ ID NO: 726687 - RNA, 64 nt, Homo Sapiens; identical to SEQ ID NO: 111305

SEQ ID NO: 726688 - RNA, 64 nt, Homo Sapiens; identical to SEQ ID NO: 111306

SEQ ID NO: 726689 - RNA, 64 nt, Homo Sapiens; identical to SEQ ID NO: 111307

SEQ ID NO: 726690 - RNA, 64 nt, Homo Sapiens; identical to SEQ ID NO: 111308

SEQ ID NO: 726691 - RNA, 64 nt, Homo Sapiens; identical to SEQ ID NO: 111309

SEQ ID NO: 726692 - RNA, 64 nt, Homo Sapiens; identical to SEQ ID NO: 111310

SEQ ID NO: 726693 - RNA, 64 nt, Homo Sapiens; identical to SEQ ID NO: 111311

SEQ ID NO: 726694 - RNA, 64 nt, Homo Sapiens; identical to SEQ ID NO: 111312

SEQ ID NO: 726695 - RNA, 64 nt, Homo Sapiens; identical to SEQ ID NO: 111313

SEQ ID NO: 726696 - RNA, 64 nt, Homo Sapiens; identical to SEQ ID NO: 111314

SEQ ID NO: 726697 - RNA, 64 nt, Homo Sapiens; identical to SEQ ID NO: 111315

SEQ ID NO: 726698 - RNA, 64 nt, Homo Sapiens; identical to SEQ ID NO: 111316

SEQ ID NO: 726699 - RNA, 64 nt, Homo Sapiens; identical to SEQ ID NO: 111317

SEQ ID NO: 726700 - RNA, 64 nt, Homo Sapiens; identical to SEQ ID NO: 111318

SEQ ID NO: 726701 - RNA, 64 nt, Homo Sapiens; identical to SEQ ID NO: 111319

SEQ ID NO: 726702 - RNA, 64 nt, Homo Sapiens; identical to SEQ ID NO: 111320

SEQ ID NO: 726703 - RNA, 64 nt, Homo Sapiens; identical to SEQ ID NO: 111321

SEQ ID NO: 726704 - RNA, 64 nt, Homo Sapiens; identical to SEQ ID NO: 111322

SEQ ID NO: 726705 - RNA, 64 nt, Homo Sapiens; identical to SEQ ID NO: 111323

SEQ ID NO: 726706 - RNA, 64 nt, Homo Sapiens; identical to SEQ ID NO: 111324

SEQ ID NO: 726707 - RNA, 64 nt, Homo Sapiens; identical to SEQ ID NO: 111325

SEQ ID NO: 726708 - RNA, 64 nt, Homo Sapiens; identical to SEQ ID NO: 111326

SEQ ID NO: 726709 - RNA, 64 nt, Homo Sapiens; identical to SEQ ID NO: 111327

SEQ ID NO: 726710 - RNA, 64 nt, Homo Sapiens; identical to SEQ ID NO: 111328

SEQ ID NO: 726711 - RNA, 64 nt, Homo Sapiens; identical to SEQ ID NO: 111329

SEQ ID NO: 726712 - RNA, 64 nt, Homo Sapiens; identical to SEQ ID NO: 111330

SEQ ID NO: 726713 - RNA, 64 nt, Homo Sapiens; identical to SEQ ID NO: 111331

SEQ ID NO: 726714 - RNA, 64 nt, Homo Sapiens; identical to SEQ ID NO: 111332

SEQ ID NO: 726715 - RNA, 64 nt, Homo Sapiens; identical to SEQ ID NO: 111333

SEQ ID NO: 726716 - RNA, 64 nt, Homo Sapiens; identical to SEQ ID NO: 111334

SEQ ID NO: 726717 - RNA, 57 nt, Homo Sapiens; identical to SEQ ID NO: 111335

SEQ ID NO: 726718 - RNA, 64 nt, Homo Sapiens; identical to SEQ ID NO: 111336

SEQ ID NO: 726719 - RNA, 64 nt, Homo Sapiens; identical to SEQ ID NO: 111337

SEQ ID NO: 726720 - RNA, 64 nt, Homo Sapiens; identical to SEQ ID NO: 111338

SEQ ID NO: 726721 - RNA, 64 nt, Homo Sapiens; identical to SEQ ID NO: 111339

SEQ ID NO: 726722 - RNA, 64 nt, Homo Sapiens; identical to SEQ ID NO: 111340

SEQ ID NO: 726723 - RNA, 64 nt, Homo Sapiens; identical to SEQ ID NO: 111341

SEQ ID NO: 726724 - RNA, 64 nt, Homo Sapiens; identical to SEQ ID NO: 111342

SEQ ID NO: 726725 - RNA, 64 nt, Homo Sapiens; identical to SEQ ID NO: 111343

SEQ ID NO: 726726 - RNA, 64 nt, Homo Sapiens; identical to SEQ ID NO: 111344

SEQ ID NO: 726727 - RNA, 64 nt, Homo Sapiens; identical to SEQ ID NO: 111345

SEQ ID NO: 726728 - RNA, 64 nt, Homo Sapiens; identical to SEQ ID NO: 111346

SEQ ID NO: 726729 - RNA, 57 nt, Homo Sapiens; identical to SEQ ID NO: 111347

SEQ ID NO: 726730 - RNA, 64 nt, Homo Sapiens; identical to SEQ ID NO: 111348

SEQ ID NO: 726731 - RNA, 64 nt, Homo Sapiens; identical to SEQ ID NO: 111349

SEQ ID NO: 726732 - RNA, 64 nt, Homo Sapiens; identical to SEQ ID NO: 111350

SEQ ID NO: 726733 - RNA, 64 nt, Homo Sapiens; identical to SEQ ID NO: 101831

SEQ ID NO: 726734 - RNA, 64 nt, Homo Sapiens; identical to SEQ ID NO: 101832

SEQ ID NO: 726735 - RNA, 64 nt, Homo Sapiens; identical to SEQ ID NO: 101833

SEQ ID NO: 726736 - RNA, 64 nt, Homo Sapiens; identical to SEQ ID NO: 101834

SEQ ID NO: 726737 - RNA, 61 nt, Homo Sapiens; identical to SEQ ID NO: 101835

SEQ ID NO: 726738 - RNA, 64 nt, Homo Sapiens; identical to SEQ ID NO: 101836

SEQ ID NO: 726739 - RNA, 64 nt, Homo Sapiens; identical to SEQ ID NO: 101837

SEQ ID NO: 726740 - RNA, 64 nt, Homo Sapiens; identical to SEQ ID NO: 101838

SEQ ID NO: 726741 - RNA, 64 nt, Homo Sapiens; identical to SEQ ID NO: 101839

SEQ ID NO: 726742 - RNA, 64 nt, Homo Sapiens; identical to SEQ ID NO: 101840

SEQ ID NO: 726743 - RNA, 64 nt, Homo Sapiens; identical to SEQ ID NO: 101841

SEQ ID NO: 726744 - RNA, 64 nt, Homo Sapiens; identical to SEQ ID NO: 101842

SEQ ID NO: 726745 - RNA, 64 nt, Homo Sapiens; identical to SEQ ID NO: 101843

SEQ ID NO: 726746 - RNA, 64 nt, Homo Sapiens; identical to SEQ ID NO: 101844

SEQ ID NO: 726747 - RNA, 64 nt, Homo Sapiens; identical to SEQ ID NO: 101845

SEQ ID NO: 726748 - RNA, 64 nt, Homo Sapiens; identical to SEQ ID NO: 101846

SEQ ID NO: 726749 - RNA, 64 nt, Homo Sapiens; identical to SEQ ID NO: 101847

SEQ ID NO: 726750 - RNA, 64 nt, Homo Sapiens; identical to SEQ ID NO: 101848

SEQ ID NO: 726751 - RNA, 64 nt, Homo Sapiens; identical to SEQ ID NO: 101849

SEQ ID NO: 726752 - RNA, 64 nt, Homo Sapiens; identical to SEQ ID NO: 101850

SEQ ID NO: 726753 - RNA, 64 nt, Homo Sapiens; identical to SEQ ID NO: 101851

SEQ ID NO: 726754 - RNA, 64 nt, Homo Sapiens; identical to SEQ ID NO: 101852

SEQ ID NO: 726755 - RNA, 64 nt, Homo Sapiens; identical to SEQ ID NO: 101853

SEQ ID NO: 726756 - RNA, 64 nt, Homo Sapiens; identical to SEQ ID NO: 101854

SEQ ID NO: 726757 - RNA, 64 nt, Homo Sapiens; identical to SEQ ID NO: 199943

SEQ ID NO: 726758 - RNA, 64 nt, Homo Sapiens; identical to SEQ ID NO: 199944

SEQ ID NO: 726759 - RNA, 64 nt, Homo Sapiens; identical to SEQ ID NO: 199945

SEQ ID NO: 726760 - RNA, 64 nt, Homo Sapiens; identical to SEQ ID NO: 199946

SEQ ID NO: 726761 - RNA, 64 nt, Homo Sapiens
uaaugcuagacauuuuucauuguuaauagugcagaguuuauauguguauaauaauucaaaauua

SEQ ID NO: 726762 - RNA, 64 nt, Homo Sapiens
agguggggaaauucaggaaauuucauccuggacgaguuuauaauuuuaauuuugaaaaggcuua

SEQ ID NO: 726763 - RNA, 64 nt, Homo Sapiens
aagacagugagaguuagagguauuacaaguugcuaguuuauaaugucuuacuaaugcagaaaca

SEQ ID NO: 726764 - RNA, 64 nt, Homo Sapiens
gaaagagaauauucaggcuuuauuucugguaugaaguuuauauuuuuuaaaaaaauccuauauu

SEQ ID NO: 726765 - RNA, 64 nt, Homo Sapiens
gaguuuaucagacaucucuaauuuggccauguccaguuuauacaguuuacaaaauauagcagau

SEQ ID NO: 726766 - RNA, 64 nt, Homo Sapiens
uuuauuaguuacuuguaaauuacuguggcuguguaguuuauaaaugucugugcacuauauuaau

SEQ ID NO: 726767 - RNA, 64 nt, Homo Sapiens
aaaaguuucaggaaaaaacgaguuuguuggaguuaguuuauacuuucacauaucaccacaaaga

SEQ ID NO: 726768 - RNA, 64 nt, Homo Sapiens
cuagcagaaaguaucugaagauauucaggaauaaaguuuauacuuaaaauagcuuauguuaaag

SEQ ID NO: 726769 - RNA, 64 nt, Homo Sapiens
auuaguaaauuauaaaacucauguguacuacuuaaguuuauaucuuaugcuaguuuauaagaac

SEQ ID NO: 726770 - RNA, 64 nt, Homo Sapiens
cucauguguacuacuuaaguuuauaucuuaugcuaguuuauaagaacaauuaaaaggacuuaga

SEQ ID NO: 726771 - RNA, 64 nt, Homo Sapiens
aguuuuauaauucucuggcaguuccuuaugauagaguuuauaaaacaguccuguguaaacugcu

SEQ ID NO: 726772 - RNA, 64 nt, Homo Sapiens
uguuuuguuuaguuacaggacaauaaugaaauggaguuuauauuuguuauuucuauuuuguuau

SEQ ID NO: 726773 - RNA, 64 nt, Homo Sapiens
uaaaaauguuaauagugcguaaaaaauuucuggaaguuuauaucuauaccuaaauaaaacugga

SEQ ID NO: 726774 - RNA, 64 nt, Homo Sapiens
gcaaacccuccauuguccauaaacccuucaaucaaguuuauacaaauccaccccagcuaaaggc

SEQ ID NO: 726775 - RNA, 64 nt, Homo Sapiens
aaaauuucaacugugugaagcaacuugauauacaaguuuauacuguagaauaaauaauggaaag

SEQ ID NO: 726776 - RNA, 64 nt, Homo Sapiens
ggccuuaaauaucagacuuucaguaguguaaaagaguuuauacauacacagaaaacaguaguuu

SEQ ID NO: 726777 - RNA, 64 nt, Homo Sapiens
uuugucaaaacuccucaaauuauauauugacaagaguuuauauaucuauauauugacaagaguu

SEQ ID NO: 726778 - RNA, 64 nt, Homo Sapiens
uugacaagaguuuauauauuuauauauugacaagaguuuauauauuuggggugguggaauacuc

SEQ ID NO: 726779 - RNA, 64 nt, Homo Sapiens
gccaagaauugcuaugauuugaacguaucaauacaguuuauaaaauugggacuaguuuauagga

SEQ ID NO: 726780 - RNA, 64 nt, Homo Sapiens
agaacguaucaauacaguuuaggaaauugggacuaguuuauaggaacucagugaaggcccauga

SEQ ID NO: 726781 - RNA, 64 nt, Homo Sapiens
aguguacuggcuguaaaugaagguaaugauaauuaguuuauauauuucuuuugcagaauguaaa

SEQ ID NO: 726782 - RNA, 64 nt, Homo Sapiens
uaucggcuuauauuuccccauuguguuaucuaguaguuuauaauaucaaaaauuguuaaaauca

SEQ ID NO: 726783 - RNA, 64 nt, Homo Sapiens
gaaaguucuggugggccggcaggauugccgcacaaguuuauaugauggucguauauauaucccu

SEQ ID NO: 726784 - RNA, 64 nt, Homo Sapiens
caguuuucauucuuucaaggguagacuaaaauauaguuuauaaaucggcaguacgguauuauga

SEQ ID NO: 726785 - RNA, 64 nt, Homo Sapiens
auauuaagcuuagggauuuuugaauuuuuacgucaguuuauauuuuaauucuuacuguacuugg

SEQ ID NO: 726786 - RNA, 64 nt, Homo Sapiens
gaacuuugaaguuauagaaaaucagagagggguaaguuuauagggcauuuuguucugaugguuc

SEQ ID NO: 726787 - RNA, 64 nt, Homo Sapiens
aaaggagaauucauugagcugagugaaugguacuaguuuauauaaguuauguagguauccuaau

SEQ ID NO: 726788 - RNA, 64 nt, Homo Sapiens
uuuuaagacauuuaugggauaaccuaaccauuauaguuuauaagucccuuauaaacaauuguug

SEQ ID NO: 726789 - RNA, 64 nt, Homo Sapiens
uauuuuucaaaggacuaguaaucuaauagccuauaguuuauauuauuauuuuguauuauuugca

SEQ ID NO: 726790 - RNA, 64 nt, Homo Sapiens
ucuuugcaaggcaggugauuaacuuaaauaucucaguuuauacagugguuuaaaagacuuuugu

SEQ ID NO: 726791 - RNA, 64 nt, Homo Sapiens
cugaacuauguccauauuuuacagcuuagauaauaguuuauauggaaacuauuauacaucugcu

SEQ ID NO: 726792 - RNA, 64 nt, Homo Sapiens
uugaauacugaaagagauuuuuugaguugcaaaaaguuuauaaaugcaaagcaaaaagaaaaca

SEQ ID NO: 726793 - RNA, 64 nt, Homo Sapiens
aucccaggcuuaaaaucuuguguuucagaaagacaguuuauaccaugacugcuuaauuaucccc

SEQ ID NO: 726794 - RNA, 64 nt, Homo Sapiens
cucaggauuguuccacuuuagagauucuauguaaaguuuauauaacuauacuugucaaauagca

SEQ ID NO: 726795 - RNA, 64 nt, Homo Sapiens; identical to SEQ ID NO: 173300

SEQ ID NO: 726796 - RNA, 64 nt, Homo Sapiens; identical to SEQ ID NO: 173301

SEQ ID NO: 726797 - RNA, 64 nt, Homo Sapiens; identical to SEQ ID NO: 173302

SEQ ID NO: 726798 - RNA, 64 nt, Homo Sapiens; identical to SEQ ID NO: 173303

SEQ ID NO: 726799 - RNA, 64 nt, Homo Sapiens; identical to SEQ ID NO: 173304

SEQ ID NO: 726800 - RNA, 64 nt, Homo Sapiens; identical to SEQ ID NO: 173305

SEQ ID NO: 726801 - RNA, 64 nt, Homo Sapiens; identical to SEQ ID NO: 173306

SEQ ID NO: 726802 - RNA, 64 nt, Homo Sapiens; identical to SEQ ID NO: 173307

SEQ ID NO: 726803 - RNA, 64 nt, Homo Sapiens; identical to SEQ ID NO: 570311

SEQ ID NO: 726804 - RNA, 64 nt, Homo Sapiens; identical to SEQ ID NO: 570312

SEQ ID NO: 726805 - RNA, 64 nt, Homo Sapiens; identical to SEQ ID NO: 570313

SEQ ID NO: 726806 - RNA, 64 nt, Homo Sapiens; identical to SEQ ID NO: 570314

SEQ ID NO: 726807 - RNA, 56 nt, Homo Sapiens; identical to SEQ ID NO: 570315

SEQ ID NO: 726808 - RNA, 64 nt, Homo Sapiens; identical to SEQ ID NO: 570316

SEQ ID NO: 726809 - RNA, 64 nt, Homo Sapiens; identical to SEQ ID NO: 570317

SEQ ID NO: 726810 - RNA, 64 nt, Homo Sapiens; identical to SEQ ID NO: 570318

SEQ ID NO: 726811 - RNA, 64 nt, Homo Sapiens; identical to SEQ ID NO: 570319

SEQ ID NO: 726812 - RNA, 64 nt, Homo Sapiens; identical to SEQ ID NO: 570320

SEQ ID NO: 726813 - RNA, 64 nt, Homo Sapiens; identical to SEQ ID NO: 570321

SEQ ID NO: 726814 - RNA, 64 nt, Homo Sapiens; identical to SEQ ID NO: 570322

SEQ ID NO: 726815 - RNA, 64 nt, Homo Sapiens; identical to SEQ ID NO: 570323

SEQ ID NO: 726816 - RNA, 64 nt, Homo Sapiens; identical to SEQ ID NO: 570324

SEQ ID NO: 726817 - RNA, 61 nt, Homo Sapiens
augaacuccauugcuuaagaaacacauaaacaccauuuagucacugaacauagcuauaugu

SEQ ID NO: 726818 - RNA, 61 nt, Homo Sapiens
ggaaugaauuuaacuguccuuggguuacacuaccauuuauuggaacaagccccagaggcag

SEQ ID NO: 726819 - RNA, 61 nt, Homo Sapiens
ccuacugcaaaccaccccuccauauuuccguaccauuuacaauucaguuucugugacaucu

SEQ ID NO: 726820 - RNA, 61 nt, Homo Sapiens
auucagugaaaagauuuuauuuauggaauuaaccauuuaauaaagaaauauuuaccuaaua

SEQ ID NO: 726821 - RNA, 61 nt, Homo Sapiens
aaaguaaccugucuuugaugaugcuucucuuaccauuuaguuuuuguauauuacccugggg

SEQ ID NO: 726822 - RNA, 61 nt, Homo Sapiens
ucaguuuugccgacugcuuuucaucugagucaccauuuacuccaagcauguauuccagacu

SEQ ID NO: 726823 - RNA, 61 nt, Homo Sapiens
aagagacuuguuucaucuccggaaaugcaaaaccauuuauagcaugaagcccuacaugauc

SEQ ID NO: 726824 - RNA, 61 nt, Homo Sapiens
ucaguguaucauuuaguauuuguaucacuguaccauuuaguguuguauaucacucagucau

SEQ ID NO: 726825 - RNA, 61 nt, Homo Sapiens
gauuaucagcucggugacuuuucuuucugccaccauuuaggugaugguguuugauucagag

SEQ ID NO: 726826 - RNA, 61 nt, Homo Sapiens
ccuuccaaaaauauugauggugauuugugcuaccauuuacucguuuauuuaauaaagacau

SEQ ID NO: 726827 - RNA, 61 nt, Homo Sapiens
uacccaggguggccuuuagcacaguaucaguaccauuuauuugucugccgcuuuuaaaaaa

SEQ ID NO: 726828 - RNA, 61 nt, Homo Sapiens
augggaauugcaguuagagagaguaaggaauaccauuuagucaucuauccguucuucacuu

SEQ ID NO: 726829 - RNA, 61 nt, Homo Sapiens
aaaucucacuuggcuggaaacaucaaucuuaaccauuuauucagaaccauuaaaccaauga

SEQ ID NO: 726830 - RNA, 61 nt, Homo Sapiens
aauauugcaugcauauugacuaauuggaauaaccauuuacucaauuauggacagcuuauug

SEQ ID NO: 726831 - RNA, 61 nt, Homo Sapiens
aacauguuucuuuuugaaagggagagaauugaccauuuauuguugugauguuuaaguuaua

SEQ ID NO: 726832 - RNA, 61 nt, Homo Sapiens
ccagggauuuucccauuauguucccuuuuauaccauuuaggugugaguuccuuagcuucug

SEQ ID NO: 726833 - RNA, 61 nt, Homo Sapiens
uaaucuuauucacaguuguuauuguuuacagaccauuuaauuaauauuuccucuguuuauu

SEQ ID NO: 726834 - RNA, 61 nt, Homo Sapiens
auguguuuccccaaagggaagccagucauugaccauuuaaaaagucuccugcuaaguaugg

SEQ ID NO: 726835 - RNA, 61 nt, Homo Sapiens
uaauacaaaaguuuugagcucuuccaaguauaccauuuauauacaaacaaauagguuuauu

SEQ ID NO: 726836 - RNA, 61 nt, Homo Sapiens
ucagggucuaccuaacugagccuagauauggaccauuuauggaugacaacaauuuuuuuuu

SEQ ID NO: 726837 - RNA, 61 nt, Homo Sapiens
augcccaggugagugcagaggcuggguggacaccauuuacauggccaggccuugugccgug

SEQ ID NO: 726838 - RNA, 61 nt, Homo Sapiens
aaaaauaauuaacacuauuuuuuauuucuguaccauuuaaacaguuuaguaucuuuugaau

SEQ ID NO: 726839 - RNA, 61 nt, Homo Sapiens
auuucuaguauuucucugaaaauacccuuaaaccauuuauauaccugacuaaaaaugaagu

SEQ ID NO: 726840 - RNA, 61 nt, Homo Sapiens
ucaaaugaacccaucaacuguuagccuccaaaccauuuaauauucaauuuaaaaaaucacg

SEQ ID NO: 726841 - RNA, 61 nt, Homo Sapiens
uuuauuuaacaguuaucuuguguagacacccaccauuuaaauugcaggacuauccuguaau

SEQ ID NO: 726842 - RNA, 61 nt, Homo Sapiens
auguuaguagaaauuuuacacaugugcugugaccauuuauaguuuggauuguaucaagugg

SEQ ID NO: 726843 - RNA, 61 nt, Homo Sapiens
gauucauuuuggaaccauuuuaauuuauauuaccauuuauacacuuuaaguucguauuuuu

SEQ ID NO: 726844 - RNA, 61 nt, Homo Sapiens
ccuuccuuguucuaaaacaacauaaucagccaccauuuaaccaaaaucaaaaugguacauc

SEQ ID NO: 726845 - RNA, 61 nt, Homo Sapiens
ugugugcuaaacaacuacggcccacaauaagaccauuuaagaagaaccuccccuuuccccu

SEQ ID NO: 726846 - RNA, 61 nt, Homo Sapiens
aaauggggacuucuuuccccguaaucccagcaccauuuauucuucugcauauggcuagcca

SEQ ID NO: 726847 - RNA, 61 nt, Homo Sapiens
agguggacaaaugcuaauaugaggaggaaucaccauuuacaccccagauauuuguguggaa

SEQ ID NO: 726848 - RNA, 61 nt, Homo Sapiens
aaauaccgaugccuuuguggcauauacagguaccauuuaggugguauagaaaacaacgcug

SEQ ID NO: 726849 - RNA, 61 nt, Homo Sapiens
ucuuuguauauguguaaauguauuugcuaaaaccauuuaaguuguguuuuagaaaaauuau

SEQ ID NO: 726850 - RNA, 61 nt, Homo Sapiens
aauuggaagugauguuggcuuuucaauguaaaccauuuaugugaagacaaauagggauaca

SEQ ID NO: 726851 - RNA, 61 nt, Homo Sapiens
gaagguuuuacaaauuggaugcuggacaaggaccauuuagacgugaaauugaaaaacugaa

SEQ ID NO: 726852 - RNA, 61 nt, Homo Sapiens
uggcucuuuugucauugugcguuaaaauuauaccauuuaacuggauucacuuuuuacuuau

SEQ ID NO: 726853 - RNA, 61 nt, Homo Sapiens
cugaaggacccuauauuauagaguucuucucaccauuuaaauuuuguucugcaggcuugca

SEQ ID NO: 726854 - RNA, 61 nt, Homo Sapiens
ucugggccacuuaauggcugucuucuguaggaccauuuaagacuuuuuucucacuguugca

SEQ ID NO: 726855 - RNA, 61 nt, Homo Sapiens
augggcaauguauuuuacgcuaagaccucaaaccauuuagaaaccccuggaagagacucuu

SEQ ID NO: 726856 - RNA, 61 nt, Homo Sapiens
augccccguaaaugucuucaguauuuaagauaccauuuaaucauuaugagguauacaacua

SEQ ID NO: 726857 - RNA, 61 nt, Homo Sapiens
cagaaauuaaaauaucaccccacacaguucaaccauuuaacucuuuagagcauuugcuuca

SEQ ID NO: 726858 - RNA, 61 nt, Homo Sapiens
cagugggaggauucgauggccuguagggaacaccauuuauggagcaaugcugggauugcaa

SEQ ID NO: 726859 - RNA, 61 nt, Homo Sapiens
uucauguauaucuaacuucguaaacagcaccaccauuuaauuagaccaauuacugcacucu

SEQ ID NO: 726860 - RNA, 61 nt, Homo Sapiens
uuguuaaauuaucucuaggaaucacuacuagaccauuuaaugcagggcuuuuuaguaucaa

SEQ ID NO: 726861 - RNA, 61 nt, Homo Sapiens
uaaugugaaguuuuggaaaguuucaagcaagaccauuuacuuagagggaagucuucucaag

SEQ ID NO: 726862 - RNA, 61 nt, Homo Sapiens
gaguguuauuuaaugcuaaguucauagguguaccauuuaaagguuuauauuuaacucuugc

SEQ ID NO: 726863 - RNA, 61 nt, Homo Sapiens
accaauaacuuuuaguuaauguaaaacagucaccauuuacugucaauaacgaaaccuaauu

SEQ ID NO: 726864 - RNA, 61 nt, Homo Sapiens
uaaagucauuauauuaauuaaaagaaaaaacaccauuuaauauguucugaaaacauuacuc

SEQ ID NO: 726865 - RNA, 61 nt, Homo Sapiens
uguacaaaaacuaauucuuuugguaaaaugaaccauuuacaguucgguuuuggacucugag

SEQ ID NO: 726866 - RNA, 61 nt, Homo Sapiens
caguacuuuuuucucauguaucuuucucuagaccauuuauauacgggugaaaugaaagcuu

SEQ ID NO: 726867 - RNA, 61 nt, Homo Sapiens
augaagucuugugaauuuguaauagaucaguaccauuuauugguuuggggaccaucuuaau

SEQ ID NO: 726868 - RNA, 61 nt, Homo Sapiens
auguuauuuggcgagacaucaaauaaaguuaaccauuuaaaaauuauuuucauauacuguu

SEQ ID NO: 726869 - RNA, 61 nt, Homo Sapiens
ucuguggucgcccgcccccccccaaaaaaauaccauuuaugguucucuccgcaaguauaaa

SEQ ID NO: 726870 - RNA, 61 nt, Homo Sapiens
gagcauggauguauaaggcagguuuuauacaaccauuuagauucaacauuaaugguagagu

SEQ ID NO: 726871 - RNA, 61 nt, Homo Sapiens
aaaugagcuugcaauguguuaaagaagauuaaccauuuaaaggcauguguuccauagccaa

SEQ ID NO: 726872 - RNA, 61 nt, Homo Sapiens
ccauuuugaaauugccuauacagucuuagugaccauuuaaaccggacgaacuagguguuua

SEQ ID NO: 726873 - RNA, 61 nt, Homo Sapiens
uuucuacauauggcuagccaguuuucccagcaccauuuauuaaauagggaauccuuucccc

SEQ ID NO: 726874 - RNA, 61 nt, Homo Sapiens
gugaucuuacaaguuagauguuacuauaccuaccauuuauucagcuggauugcugaacaca

SEQ ID NO: 726875 - RNA, 61 nt, Homo Sapiens
aaaaucauuguuaaauugauugaggaaaacaaccauuuaaaaaaaaucuauguugaauccu

SEQ ID NO: 726876 - RNA, 61 nt, Homo Sapiens
gagucuccaccuuuggacacaacacuuacucaccauuuacucuuuaucacucugcaacaaa

SEQ ID NO: 726877 - RNA, 61 nt, Homo Sapiens
uuaaauauuaaaauaucuauuuauuauuaaaaccauuuauaaggcuuuuucauaaauguau

SEQ ID NO: 726878 - RNA, 61 nt, Homo Sapiens
auggcuuuguaacaauugcaacauuuuauaaaccauuuacugaguaacauaaaauaaaagu

SEQ ID NO: 726879 - RNA, 61 nt, Homo Sapiens
uguguuuugcuuaaaguauuucauaugaauaaccauuuauauuacuacuaggaaaccuucc

SEQ ID NO: 726880 - RNA, 61 nt, Homo Sapiens
aauauucuucugaacucaucuaguuuucucaaccauuuaaaguuauuccaguaaaaggaaa

SEQ ID NO: 726881 - RNA, 61 nt, Homo Sapiens
auuguguuuuagaucuacaguacaucuuuauaccauuuacacuuuaucacaauaugauucu

SEQ ID NO: 726882 - RNA, 61 nt, Homo Sapiens
uuaugacauuuuacaauguauaaaguuuuguaccauuuauuuauagccggauuaacgguua

SEQ ID NO: 726883 - RNA, 61 nt, Homo Sapiens
ucauaauuagaacaauagcuaauaaauucaaaccauuuaauucaauuaguacaguagcuua

SEQ ID NO: 726884 - RNA, 61 nt, Homo Sapiens
acauuuacacuuucuuauuucacuaguauauaccauuuaauaucaauauugauagaaguca

SEQ ID NO: 726885 - RNA, 61 nt, Homo Sapiens
uacuauuugaaaaaagaagaguuccaaaaauaccauuuauccaguucuuggccuaugauaa

SEQ ID NO: 726886 - RNA, 61 nt, Homo Sapiens
gacucuaagccagaauggaaaacaccugaccaccauuuaagguccacuggacaguugggaa

SEQ ID NO: 726887 - RNA, 61 nt, Homo Sapiens
gucuggcuuugcccuuaaaauugggcauuuaaccauuuacucuugagcuguaggacaaacc

SEQ ID NO: 726888 - RNA, 61 nt, Homo Sapiens
guugaauaaguagagaaaauauagauucugaaccauuuauugggaaaaaugaggaaaaaaa

SEQ ID NO: 726889 - RNA, 61 nt, Homo Sapiens
aauuuucugaaugguaauaacauuuuuccucaccauuuagcgcauuguuuuaugaauuuua

SEQ ID NO: 726890 - RNA, 61 nt, Homo Sapiens
uauuuucugaguguugagaagaaugaguuaaaccauuuaaacacauuugaaacauacaaaa

SEQ ID NO: 726891 - RNA, 61 nt, Homo Sapiens
uccuaaaucaaggaaaggaaaucauccccagaccauuuaugcugagcuuuggaauacuauu

SEQ ID NO: 726892 - RNA, 61 nt, Homo Sapiens
uauggugcucacuuuaggaucagcaguguugaccauuuaugcugcauagcuguauuauagc

SEQ ID NO: 726893 - RNA, 61 nt, Homo Sapiens
cuucucuauucuauucuacuuccuccauuucaccauuuauacaaagucauucaaaaaggcu

SEQ ID NO: 726894 - RNA, 61 nt, Homo Sapiens
uguggggaggggggcugguuuacaauauuaaaccauuuaaaguauuuuauucuacaaaugg

SEQ ID NO: 726895 - RNA, 61 nt, Homo Sapiens
gcugacaaucaguuaaacacaccggagaagaaccauuuacaugcaccuuauauuucugugu

SEQ ID NO: 726896 - RNA, 61 nt, Homo Sapiens
gaagcagaggcacuuaaaacauguaccaggaaccauuuaacaaagaauauaaaaugucaca

SEQ ID NO: 726897 - RNA, 61 nt, Homo Sapiens
ugcccacacuuaaugucaaucuauaauuuuaaccauuuauccaagauucuacuaaguguaa

SEQ ID NO: 726898 - RNA, 61 nt, Homo Sapiens
caaguuugggucugugcugcuguuacuguuaaccauuuaaguggggcaaaaccuugcuaau

SEQ ID NO: 726899 - RNA, 61 nt, Homo Sapiens
aaauauaugcuuuucuagaauuugauguuugaccauuuaugacuuaauuaccagagagcca

SEQ ID NO: 726900 - RNA, 61 nt, Homo Sapiens
cauucucucguuuccccuuuagcucccuuucaccauuuauucagcuacaucaucccucuau

SEQ ID NO: 726901 - RNA, 61 nt, Homo Sapiens
uuuuuuaucguuuuuguauuuucaugaaaauaccauuuaguaagaauaccacaucaaauaa

SEQ ID NO: 726902 - RNA, 61 nt, Homo Sapiens
ugauuuguaaauuuacuuauguuaaaaauaaaccauuuauuuucagcuuugaauuuuauuu

SEQ ID NO: 726903 - RNA, 61 nt, Homo Sapiens
auuugcuguucuguaagaguucacagagacaaccauuuaugcgaaugcaaagcuacuggcu

SEQ ID NO: 726904 - RNA, 61 nt, Homo Sapiens
acuucugaauuuaaaaaguuuaagcacccauaccauuuauaauugcaggugauuugauaau

SEQ ID NO: 726905 - RNA, 61 nt, Homo Sapiens
ugcaaaugacugucagauucaugguuuccuuaccauuuauaagcugaucucauuuccuucc

SEQ ID NO: 726906 - RNA, 61 nt, Homo Sapiens
uuacauauucguuuucaauagucagggcaaaaccauuuacuaaaauacugaggcugauuua

SEQ ID NO: 726907 - RNA, 61 nt, Homo Sapiens
aacucagacaagauuauauuaagaaaaacagaccauuuaaaucuaauccuacauaaugaaa

SEQ ID NO: 726908 - RNA, 61 nt, Homo Sapiens
cugaacaacaccauuugagaucuaaagaucaaccauuuaucuuagcacgcaaaagccaaaa

SEQ ID NO: 726909 - RNA, 61 nt, Homo Sapiens
cagcaccuguuaugcaccaguaacugcagccaccauuuauucucucccagcucucgaaucc

SEQ ID NO: 726910 - RNA, 61 nt, Homo Sapiens
aauuauuccuucaguuggcuuaaagguaaugaccauuuauaauuguauucagcuagccccu

SEQ ID NO: 726911 - RNA, 61 nt, Homo Sapiens
aucaagaaaaguguaagaaauauagccaggaaccauuuaucauguuaauaccuauaaaaua

SEQ ID NO: 726912 - RNA, 61 nt, Homo Sapiens
ugguuucuuaagagccgucagaagacuucaaaccauuuaacgggugaguucucuccucaaa

SEQ ID NO: 726913 - RNA, 61 nt, Homo Sapiens
ugcuacaaauuagucugauuggauaaacauuaccauuuauaccugaauuccaaaauauuau

SEQ ID NO: 726914 - RNA, 61 nt, Homo Sapiens
cacuagauacaguaaauuuuuagaaaaaaauaccauuuacaguauuauugugaaccauuua

SEQ ID NO: 726915 - RNA, 61 nt, Homo Sapiens
gaaaaaaauaccauuuacaguauuauugugaaccauuuaacccuuuugauccaaggccccg

SEQ ID NO: 726916 - RNA, 61 nt, Homo Sapiens
cuaguccacauauaaggguaggguugggauuaccauuuacugaccacaucugugaggugcc

SEQ ID NO: 726917 - RNA, 61 nt, Homo Sapiens
auacaaccaugauuugcaacuguaacaggagaccauuuauuauaagcguaccuguuuguga

SEQ ID NO: 726918 - RNA, 61 nt, Homo Sapiens
agauaaagagagaauauuguaugggccaucaaccauuuacuuuucccugaauguuagaaac

SEQ ID NO: 726919 - RNA, 61 nt, Homo Sapiens
cauagaauugcagucauuuggugcucugcuaaccauuuauauaaaacuuaaaaacaagaga

SEQ ID NO: 726920 - RNA, 61 nt, Homo Sapiens
ggucagucaaguugguaaugccuguccauuaaccauuuaugcauacuaauaaaauuauaag

SEQ ID NO: 726921 - RNA, 61 nt, Homo Sapiens
aaaaaaucuuaaagccuguaaugcccauucuaccauuuaaauuauuggcuaacugcaugac

SEQ ID NO: 726922 - RNA, 61 nt, Homo Sapiens
ugugguauuaaaaauuaaugggucgcaguucaccauuuauagguaaaaauauauaccuucg

SEQ ID NO: 726923 - RNA, 61 nt, Homo Sapiens
aagcauuuaccaugugcuaaauaauaaagcuaccauuuaucaggucuuaggaauugaauua

SEQ ID NO: 726924 - RNA, 61 nt, Homo Sapiens
gucaucuaccugaaaacaguaauuaaccuuuaccauuuaauaucaugucagaacugcuuaa

SEQ ID NO: 726925 - RNA, 61 nt, Homo Sapiens
uacaauuuuuagccagaaaacagaguaacauaccauuuaauuuuuguuuguuuaguuauaa

SEQ ID NO: 726926 - RNA, 61 nt, Homo Sapiens
ggaaauuucuagauauagaaaauugcuuuaaaccauuuaaacuuauuaauaaaacuuugga

SEQ ID NO: 726927 - RNA, 61 nt, Homo Sapiens
auuuuuaaaacaucaaaauuaaguccuuuaaaccauuuagguggguuaaucaagucucggu

SEQ ID NO: 726928 - RNA, 61 nt, Homo Sapiens
ugggauuaugguuuugugauugcauuuuuagaccauuuaucauauacacggaugacuuaac

SEQ ID NO: 726929 - RNA, 61 nt, Homo Sapiens
uuuuaaacuuuuuuaugaauuccuaaacauuaccauuuauguggcagaaguucuguucccu

SEQ ID NO: 726930 - RNA, 61 nt, Homo Sapiens
auaaaaguuaacauuaggcuguggugcaguaaccauuuaaugucgaggcucuauuucggaa

SEQ ID NO: 726931 - RNA, 56 nt, Homo Sapiens; identical to SEQ ID NO: 277656

SEQ ID NO: 726932 - RNA, 61 nt, Homo Sapiens
auaauuuucacucauuuauugucuucuggaaaccauuuaacuuuuacuguuuuuuauuuuu

SEQ ID NO: 726933 - RNA, 61 nt, Homo Sapiens
caaaaugaacacugcuugucuucuuccauugaccauuuaguguugaguacuguauguguuu

SEQ ID NO: 726934 - RNA, 61 nt, Homo Sapiens
aaugcuauuuuucaaugcauuuggacugcugaccauuuaaaagcagccuaugauugcuucu

SEQ ID NO: 726935 - RNA, 61 nt, Homo Sapiens
uguauuaaucuguuugugcaaacauaauaccaccauuuaaaaauguuagggagaugaguug

SEQ ID NO: 726936 - RNA, 61 nt, Homo Sapiens
uugcccauauuaaaaagccauagcuuccuagaccauuuacugagaauccccgugcucacag

SEQ ID NO: 726937 - RNA, 61 nt, Homo Sapiens
uuguuuaaaaugcuguacuggcugaaaugagaccauuuacugauuaugcuuaacagugaga

SEQ ID NO: 726938 - RNA, 61 nt, Homo Sapiens
aucucccuccagccccaacggugcucccuuuaccauuuacuuacacaaaagugcacacugu

SEQ ID NO: 726939 - RNA, 61 nt, Homo Sapiens
gaaagaaugcauuccagaacacccaaauauaaccauuuaaaucguccauuuuauuaggauu

SEQ ID NO: 726940 - RNA, 61 nt, Homo Sapiens
uugaauuaaugcuugguagcguuguagugacaccauuuacacuagcacugcucuuuuugau

SEQ ID NO: 726941 - RNA, 61 nt, Homo Sapiens
uucagcaguuguuaauguuucauguauaucuaccauuuagagaaaaacuguuugguaagca

SEQ ID NO: 726942 - RNA, 61 nt, Homo Sapiens
auucugaauuuuaaaguuggcuacuguugucaccauuuaugcuauuuuugguucaauacua

SEQ ID NO: 726943 - RNA, 61 nt, Homo Sapiens
auaucagaaaguauauguacugcuugugguaaccauuuauaucugaauauguuacugagcu

SEQ ID NO: 726944 - RNA, 61 nt, Homo Sapiens
uguagaauuugaaaugguugccaugggccccaccauuuaugccauauucagcauuugauuu

SEQ ID NO: 726945 - RNA, 61 nt, Homo Sapiens
agacauucuugcuauaacuacucuaucagauaccauuuauguuauuccccacuacucuugu

SEQ ID NO: 726946 - RNA, 61 nt, Homo Sapiens
aaaucagaauguuuauacaauauauauucauaccauuuauuuuauuguaaaguaugcaaaa

SEQ ID NO: 726947 - RNA, 61 nt, Homo Sapiens
guuuuuuucuguagcaccagacacuugaaggaccauuuacuucucucaguucuacacugau

SEQ ID NO: 726948 - RNA, 61 nt, Homo Sapiens
cuccuuucaucguccccgggccaccuugggcaccauuuauccagcaggaaggcaccgcugu

SEQ ID NO: 726949 - RNA, 61 nt, Homo Sapiens
acuacuuuucuuauagguaggauuccuuuuaaccauuuaagacacuaaacuuugguauuuu

SEQ ID NO: 726950 - RNA, 61 nt, Homo Sapiens
uguaccaacucaccuuaaauaucccaaauugaccauuuagauggcagcugaccaauccccc

SEQ ID NO: 726951 - RNA, 61 nt, Homo Sapiens
ugguguaaagaacuuaauuugguuguggacaaccauuuacuucauauguacacuagccagu

SEQ ID NO: 726952 - RNA, 61 nt, Homo Sapiens
uuagaacacucaacaacuauagaaauagauaaccauuuauuucuaauuugaaaggcaguua

SEQ ID NO: 726953 - RNA, 61 nt, Homo Sapiens
augcacugugggguuuuuuccuguaugggaaaccauuuaugccaagcuuuuccccauuucc

SEQ ID NO: 726954 - RNA, 61 nt, Homo Sapiens
aucagcaacuuuugaaaacuucacacuuguuaccauuuagaaguuuccuggaaaauauaug

SEQ ID NO: 726955 - RNA, 61 nt, Homo Sapiens
gauaucaggaaugucucaugauaucacguuuaccauuuacaccaucugcaaccauaugcua

SEQ ID NO: 726956 - RNA, 61 nt, Homo Sapiens
ccuuacccagaaaugaaaauacucaauauggaccauuuaggaauuauaagcagcaacugug

SEQ ID NO: 726957 - RNA, 61 nt, Homo Sapiens
uagauguccguacaaguagcgcauauauuuaaccauuuaguuuggggcucuauauuacuug

SEQ ID NO: 726958 - RNA, 61 nt, Homo Sapiens
uuccagcaccaagcaaacuaguaacaguuccaccauuuaggacccauuggauuugcugcug

SEQ ID NO: 726959 - RNA, 61 nt, Homo Sapiens
agaacauuuuucucuccaacuuggaaaguuaaccauuuaaaagacgcgucagauggcagau

SEQ ID NO: 726960 - RNA, 61 nt, Homo Sapiens
gaaugcauacucugugcaaggagauuaaucuaccauuuauuaaagcuugggacaguuauug

SEQ ID NO: 726961 - RNA, 61 nt, Homo Sapiens
uuguguuaacuaugaaccaacauucucuagaaccauuuaguuguuagaguucauguaauca

SEQ ID NO: 726962 - RNA, 61 nt, Homo Sapiens
gaguuuuaaugggaguaggaugguaacagcuaccauuuauaaacaguauuaauagcgacau

SEQ ID NO: 726963 - RNA, 61 nt, Homo Sapiens
uauuguguauauguuuuuauucacuuauaaaaccauuuacaaaauguacauucuaauuaau

SEQ ID NO: 726964 - RNA, 61 nt, Homo Sapiens
agugguuguaucugaauuuaagauguaugguaccauuuaaauauuuuucaaauuauuuaau

SEQ ID NO: 726965 - RNA, 61 nt, Homo Sapiens
cacaaauuugcugcacagaaucacaauuuucaccauuuaaaaagcaugauaaaggggcagu

SEQ ID NO: 726966 - RNA, 61 nt, Homo Sapiens
auuuaaaaaauuauguuccauaaccuauauaaccauuuaaaugaaaagcaaaaaauacuau

SEQ ID NO: 726967 - RNA, 61 nt, Homo Sapiens
gaaauucacuucauuguaccgauguauuugaaccauuuagauccaagagccaucuccuuau

SEQ ID NO: 726968 - RNA, 61 nt, Homo Sapiens
gcuggcaccagagacccgauaagaaaguuauaccauuuaaaggugguguucuguugguuac

SEQ ID NO: 726969 - RNA, 61 nt, Homo Sapiens
uauguacaaauaaguuaauauucacacugaaaccauuuaaggcuaggucagaagcugcuuu

SEQ ID NO: 726970 - RNA, 61 nt, Homo Sapiens
uagcagaaccacauauuuuagcuguuugagaaccauuuacuuaugagcaggaagagggaag

SEQ ID NO: 726971 - RNA, 61 nt, Homo Sapiens
ucuaaucaucuauguguguaugauggaugugaccauuuauaugucauguguugaaauuaaa

SEQ ID NO: 726972 - RNA, 61 nt, Homo Sapiens
ggaaguaauguuaccuauccuugauaccaugaccauuuauuagauguuuugcuauauaaau

SEQ ID NO: 726973 - RNA, 61 nt, Homo Sapiens
augccaagugaauauaagagcuuguacugaaaccauuuauuucuuucuauuuugcuauuug

SEQ ID NO: 726974 - RNA, 61 nt, Homo Sapiens
uuuuauucaaaggaauuguaaaccuuaaaccaccauuuauuuccaugugaaaaaguguuau

SEQ ID NO: 726975 - RNA, 61 nt, Homo Sapiens
agauuaagcaagugaaauucugcugcccuccaccauuuauuuuuacagugcuuuguaauuu

SEQ ID NO: 726976 - RNA, 61 nt, Homo Sapiens
ggcugcuaccuaacuuuuagucccuuccaaaaccauuuaguaggguucuauuacauaaaca

SEQ ID NO: 726977 - RNA, 61 nt, Homo Sapiens
agauuacacaaaaauuauuuccagaaaggcuaccauuuaucaucauuauauuucaagccuc

SEQ ID NO: 726978 - RNA, 61 nt, Homo Sapiens
cuuguucuguucucuggaacuaaacagaacaaccauuuaccccuccuuuucaaacuagaga

SEQ ID NO: 726979 - RNA, 61 nt, Homo Sapiens
cuuucauuuauaguugggaaagagcagcacuaccauuuauugagcagugccuaguaucugg

SEQ ID NO: 726980 - RNA, 61 nt, Homo Sapiens
cauaaaauggacaacugagaaccuuaguaaaaccauuuaacguuagaaaugaauuuuuuag

SEQ ID NO: 726981 - RNA, 61 nt, Homo Sapiens
acuuuccugagccauuaucauagucuguuacaccauuuagauuuggaacuuuaauaagauc

SEQ ID NO: 726982 - RNA, 61 nt, Homo Sapiens
cuguuuucuuauagucuuaauauugaauuauaccauuuacuugucauuuuauuuuagucau

SEQ ID NO: 726983 - RNA, 61 nt, Homo Sapiens
acauaaucucuagugaucaucuugaauuuuaaccauuuauugcuggaccugcaagaugugg

SEQ ID NO: 726984 - RNA, 61 nt, Homo Sapiens
aauacgacacccaguauuuucuuuaaguuucaccauuuacgcuacaugugauuuuuuuaau

SEQ ID NO: 726985 - RNA, 61 nt, Homo Sapiens
aaaagugaacaauccugugauaaguuggaguaccauuuaguaauacagcaacauuguguca

SEQ ID NO: 726986 - RNA, 61 nt, Homo Sapiens
ugucacuugugcuuuaaaauuagucuguaucaccauuuauuacaguuauaauuuuggaguu

SEQ ID NO: 726987 - RNA, 61 nt, Homo Sapiens
uuucaugugucaugaaauacuguuuucuccaaccauuuaauaauguaaauacuugcuagcu

SEQ ID NO: 726988 - RNA, 61 nt, Homo Sapiens
cuuuuuuuuuuuuuaaauuuuuuauuccaucaccauuuacccuucccuugaucugcuuauu

SEQ ID NO: 726989 - RNA, 61 nt, Homo Sapiens
uauaugugcuaggcaaaucuugcagaugagcaccauuuaguacguaagugugugagugcag

SEQ ID NO: 726990 - RNA, 61 nt, Homo Sapiens
guaaaauagcuuggauucaaaaagcaaaaggaccauuuaaaccaagcgaggucucaggugc

SEQ ID NO: 726991 - RNA, 61 nt, Homo Sapiens
uuacacugaucaauuucaacgccuaaaaaccaccauuuaaccagcuuaaaucaugggucca

SEQ ID NO: 726992 - RNA, 61 nt, Homo Sapiens
ggucauuuaaauaacaaaauauugcacauuaaccauuuagauuucagaacaaaagauauuc

SEQ ID NO: 726993 - RNA, 61 nt, Homo Sapiens
auaauaauagcgccauauucaauuaaaaaccaccauuuauaauuccaccuaucuuaaugug

SEQ ID NO: 726994 - RNA, 61 nt, Homo Sapiens
uauccuuuauaaggaaugugauccuaaguauaccauuuauguuaaauucuuaauauuaguc

SEQ ID NO: 726995 - RNA, 61 nt, Homo Sapiens
cauagaggaagggcuuaugggcuggccgagaaccauuuauacagaacaaagauuggaaaaa

SEQ ID NO: 726996 - RNA, 61 nt, Homo Sapiens
uagugaauuauuaaaaaucuugaaacaaaagaccauuuaaaaguauuguuguaaaacuuca

SEQ ID NO: 726997 - RNA, 61 nt, Homo Sapiens
aaggaucagacaauaaaaugaguuagugcaaaccauuuaguaaaaauaacuaucagcagag

SEQ ID NO: 726998 - RNA, 61 nt, Homo Sapiens
ucucagaacauuuagccugcaguugggcaaaaccauuuaacacaaagccuauuuuauaaug

SEQ ID NO: 726999 - RNA, 61 nt, Homo Sapiens
ucugugguagcuuuuaggcugcuccuaacccaccauuuauugccuucugagagguggguga

SEQ ID NO: 727000 - RNA, 61 nt, Homo Sapiens
aaucauguuuuuauauaaauuauacuagacuaccauuuaaaagcauuacaaaauccuaguu

SEQ ID NO: 727001 - RNA, 61 nt, Homo Sapiens
acaagacuuccuuauuuauccaccccugggcaccauuuagguccuucaacauccucacccc

SEQ ID NO: 727002 - RNA, 61 nt, Homo Sapiens
aaaaauguauacuaccuuaaauuuguuuuucaccauuuagcgccauuuagaugauuaguua

SEQ ID NO: 727003 - RNA, 61 nt, Homo Sapiens
aaaauugugugaugaaugaaauauacuuuguaccauuuauacuucuguauuuuaaaaugua

SEQ ID NO: 727004 - RNA, 61 nt, Homo Sapiens
aaaacaaccaucugagacacaguauggcccgaccauuuaagauuuccauaaaccaaguuaa

SEQ ID NO: 727005 - RNA, 61 nt, Homo Sapiens
gguaaacaaaaaacuaaaacuuauacaagauaccauuuacacugaacauagaauucccuag

SEQ ID NO: 727006 - RNA, 61 nt, Homo Sapiens
ccagaucgugaggcuggggagcauucuagguaccauuuauuaucuacugcguuucggucag

SEQ ID NO: 727007 - RNA, 61 nt, Homo Sapiens
ccucccacaacacaugggaauucugagagauaccauuuaaguugagauuucaguggggaca

SEQ ID NO: 727008 - RNA, 61 nt, Homo Sapiens
cacagauguauaggggauguaagagaccauuaccauuuauuucacaaaaaguagaaacucu

SEQ ID NO: 727009 - RNA, 61 nt, Homo Sapiens
ugucacuguuaacacuuuucaaaaucauguaaccauuuaaauuauuaucaaaagaauaauu

SEQ ID NO: 727010 - RNA, 61 nt, Homo Sapiens
auacaaaauccuauuuuggauuuuuugguaaaccauuuaaaacccaaaaguauaagauaca

SEQ ID NO: 727011 - RNA, 61 nt, Homo Sapiens
uucuaguagccaucuucacuuuuaacugaugaccauuuauauuauugaauaguaauuaaac

SEQ ID NO: 727012 - RNA, 61 nt, Homo Sapiens
agccugagcaaggaccaccauuuuaccuagaaccauuuaaaugaaacaggacugaagcccu

SEQ ID NO: 727013 - RNA, 61 nt, Homo Sapiens
augagggugcaagagccacaguucccuaguuaccauuuaauugaaaggagaaaaagcacaa

SEQ ID NO: 727014 - RNA, 61 nt, Homo Sapiens
ucugccuuuuucuuccguuccaaaugacccuaccauuuauuccagcuuucuuuucuacuag

SEQ ID NO: 727015 - RNA, 61 nt, Homo Sapiens
uggcaggcagucugcucucuaaauaauauggaccauuuaccugucagggccucugccaagg

SEQ ID NO: 727016 - RNA, 61 nt, Homo Sapiens
gcgauuuagcuugaaauuaacuaucuucauaaccauuuaaagguuuuuuuguuuuuacuuu

SEQ ID NO: 727017 - RNA, 61 nt, Homo Sapiens
gcuaacugggucuuagcaucucuuucuaaaaaccauuuaaaaccacuuuugacuagguaag

SEQ ID NO: 727018 - RNA, 61 nt, Homo Sapiens
uggaaaccagaaaugcaacaguuacuaaaacaccauuuaauaguuauaacgucguuacuug

SEQ ID NO: 727019 - RNA, 61 nt, Homo Sapiens
uguagaauaaauuaaaaggauaaucuaaaucaccauuuagauuaagcuugacuugcaaacu

SEQ ID NO: 727020 - RNA, 61 nt, Homo Sapiens
aauauucaaagaaagaaccacagauguguuaaccauuuaagcagaucaucugccaaacauu

SEQ ID NO: 727021 - RNA, 61 nt, Homo Sapiens
auucuguuauuuuagucuccauuuuauacuuaccauuuauugaaauaacauuuuaaaaucu

SEQ ID NO: 727022 - RNA, 61 nt, Homo Sapiens
uuccacggaugagucacaauuuaggugcuaaaccauuuauuacugaugggaauauacagau

SEQ ID NO: 727023 - RNA, 61 nt, Homo Sapiens
agauuagccaaauagucugaggcuguaaauuaccauuuacuugacuucagcaaaagcacgg

SEQ ID NO: 727024 - RNA, 61 nt, Homo Sapiens
aauguaaaaacgaccugacuugaccuuuguaaccauuuaaauuauuauguggguauuuaua

SEQ ID NO: 727025 - RNA, 61 nt, Homo Sapiens
ccugacugggguaagaaaugcuccucaggccaccauuuaggcugagaagucagccucuugg

SEQ ID NO: 727026 - RNA, 61 nt, Homo Sapiens
auugacauuuaauuuucaaacuugucuuguuaccauuuaaauggaagcccagucuugaguu

SEQ ID NO: 727027 - RNA, 61 nt, Homo Sapiens
cuacuuaucccucaaugcacgcuguuuaaacaccauuuaccuuuaauccuuucuuuagaau

SEQ ID NO: 727028 - RNA, 61 nt, Homo Sapiens
gaauguucugaucuuucauugaauuuuguaaaccauuuauuuucucuuuguuuuaaagaga

SEQ ID NO: 727029 - RNA, 61 nt, Homo Sapiens
uccaccuccucuuuuuugcucuggcccaaagaccauuuaggaacagucaauagggcuacug

SEQ ID NO: 727030 - RNA, 61 nt, Homo Sapiens
uguuuuaaagaaagaaguguggagucacguuaccauuuacagagccucgggaaaagguaga

SEQ ID NO: 727031 - RNA, 61 nt, Homo Sapiens
gagcaucuauuaugugccagucaauucagcaaccauuuauugagauucagcuuaauuugcu

SEQ ID NO: 727032 - RNA, 61 nt, Homo Sapiens
auuugccuacagaauuucaucuggcccagcuaccauuuaccuccacccaugcaaauagcua

SEQ ID NO: 727033 - RNA, 61 nt, Homo Sapiens
uuugucauuaucaagagagauggcaguauugaccauuuaguuuaguuaaaaaaaaaaaaaa

SEQ ID NO: 727034 - RNA, 61 nt, Homo Sapiens
aguauggaugucacucaacuaagaucaaaucaccauuuaaggggauggcauucuuuauacc

SEQ ID NO: 727035 - RNA, 61 nt, Homo Sapiens
cuccaaggcagaaauuguaucuuuauagcuaaccauuuaguaaauaaauacauuacauuuu

SEQ ID NO: 727036 - RNA, 61 nt, Homo Sapiens
guugacuaccuuuugauaagcaaaauuugaaaccauuuaaagaccacuguauuuuaacuca

SEQ ID NO: 727037 - RNA, 61 nt, Homo Sapiens
uuguguuuuaaaaaucuacuagugcucauguaccauuuagcgacacaagccaccgccccug

SEQ ID NO: 727038 - RNA, 61 nt, Homo Sapiens
acacugcuugugaaaggaaaaucuaugugagaccauuuagcuuaggugaggaagcaaaagc

SEQ ID NO: 727039 - RNA, 61 nt, Homo Sapiens
aaauaucacagagccacuagcagccuugcccaccauuuaagaguuacauuaucagccagcc

SEQ ID NO: 727040 - RNA, 61 nt, Homo Sapiens
uuuguuuuuauuuaauaguauuucuauuaugaccauuuaauucuauuuuccuauggaguug

SEQ ID NO: 727041 - RNA, 61 nt, Homo Sapiens
auuauuaguggcaacagaguuuuuuccuaagaccauuuauaagugacuucagugguauccu

SEQ ID NO: 727042 - RNA, 61 nt, Homo Sapiens
gucuucucucagucuugcacgcaaagcuaucaccauuuaaucaaacaaaaaugcccuggug

SEQ ID NO: 727043 - RNA, 61 nt, Homo Sapiens
cuguagauuuauuuccauuuugaauguguucaccauuuagcaugcuuuuuuuuuuaaagac

SEQ ID NO: 727044 - RNA, 61 nt, Homo Sapiens
cguauguaaacuugguuucuagcuuuuaguaaccauuuaacguuaggagugguuacaacug

SEQ ID NO: 727045 - RNA, 61 nt, Homo Sapiens
uucucugcccaagcccugucuuuuuugucccaccauuuauccagguggcaauguaacucau

SEQ ID NO: 727046 - RNA, 61 nt, Homo Sapiens
aaaauguagcuggcccaggaugccaucauccaccauuuaguuuuagcuguuaaauguacua

SEQ ID NO: 727047 - RNA, 61 nt, Homo Sapiens
cucagaauucauaauuccugaucaugauaugaccauuuaacuaucuuuuuuuauuauucug

SEQ ID NO: 727048 - RNA, 61 nt, Homo Sapiens
caagagauggcuuuuuccuuugaauuggaucaccauuuacaaaauucagucuuaaguaggg

SEQ ID NO: 727049 - RNA, 61 nt, Homo Sapiens
uuauucugauuuuuaaaaaugcaguuaauguaccauuuauuugcuugaugaagggagcucu

SEQ ID NO: 727050 - RNA, 61 nt, Homo Sapiens
cacaguuaauuguugcgcucuaauacaacugaccauuuaaaauugaacaaguuuauuguuu

SEQ ID NO: 727051 - RNA, 61 nt, Homo Sapiens
augucaauguauuuuuggcacugcgauuuuaaccauuuauuaaauaaaaauuuuguuaaag

SEQ ID NO: 727052 - RNA, 61 nt, Homo Sapiens
ggggaggacaaaauggggcaauugacacaguaccauuuaauagaggucgcuugggaauuuu

SEQ ID NO: 727053 - RNA, 61 nt, Homo Sapiens
ugguguaaaaaacuuuauuuggcugugaacaaccauuuaguucauauguacaccagcuagu

SEQ ID NO: 727054 - RNA, 61 nt, Homo Sapiens
augccaucugaaggggauucaaugucuguuaaccauuuaagucauuuuacuuuaacuauau

SEQ ID NO: 727055 - RNA, 61 nt, Homo Sapiens
aaaguuugccggcuaggugccacccccgccaaccauuuaaaauuacucauuugauuucccc

SEQ ID NO: 727056 - RNA, 52 nt, Homo Sapiens; identical to SEQ ID NO: 277781

SEQ ID NO: 727057 - RNA, 61 nt, Homo Sapiens
uuaaaaaagugugccuugcuguauuucuuauaccauuuauuaaaaagcugcuuucacggua

SEQ ID NO: 727058 - RNA, 61 nt, Homo Sapiens
aauuaguagcuuaccacagauacuguuuccuaccauuuauaaaauuuacuuuuuauugaaa

SEQ ID NO: 727059 - RNA, 61 nt, Homo Sapiens
ugacuggagaccccagugugggggaggucuuaccauuuaauauagaaaugauaucaauaac

SEQ ID NO: 727060 - RNA, 61 nt, Homo Sapiens
aauagaagaguguguugggcagguaguuuguaccauuuaugaagguuuguuccuuuguuaa

SEQ ID NO: 727061 - RNA, 61 nt, Homo Sapiens
caacuuuuuaaaauccagacccaguguuaaaaccauuuauuccuuuuuucauaagaauaau

SEQ ID NO: 727062 - RNA, 61 nt, Homo Sapiens
aaauauauauuuaaaagauuuaugaauacaaaccauuuaugguuuaugauuucuaaaaaga

SEQ ID NO: 727063 - RNA, 61 nt, Homo Sapiens
aggaagaaaacaggugaaagaagaaguaaaaaccauuuaguauuaguauuagaaugaaguc

SEQ ID NO: 727064 - RNA, 61 nt, Homo Sapiens
augacaauuugcacagcccaguggcuuaaacaccauuuauaccacagguccagaugaaucc

SEQ ID NO: 727065 - RNA, 61 nt, Homo Sapiens
gaauuuuuuuuucaguaaaauaugaguguauaccauuuaaauaacacauaaaauuaguuuc

SEQ ID NO: 727066 - RNA, 61 nt, Homo Sapiens
uaagagaaggugagaaggauaaaauuuugcuaccauuuaagagauuuuuuuuuauuucaag

SEQ ID NO: 727067 - RNA, 61 nt, Homo Sapiens
ugaggggaaacacuagccagauaaauauaucaccauuuacaaauguaauaaauuuuauugu

SEQ ID NO: 727068 - RNA, 61 nt, Homo Sapiens
agacucuuuauuuuucucuugagcccucagaaccauuuaagcuccuuucaguucguuggua

SEQ ID NO: 727069 - RNA, 61 nt, Homo Sapiens
auggaugaaagagaucuguaauaauuuagcaaccauuuaucgggauuacuuuugcagaauc

SEQ ID NO: 727070 - RNA, 61 nt, Homo Sapiens
uuuuuuaauaaguuuuuuacaacuuuaacugaccauuuaaguugugcagcaauagauuuuu

SEQ ID NO: 727071 - RNA, 61 nt, Homo Sapiens
acaaguauugcaguaaucaucacuuacagguaccauuuauuucaaaacaacuuuuuuaguc

SEQ ID NO: 727072 - RNA, 61 nt, Homo Sapiens
uuugagaagccaaauggaauuuuuaauggaaaccauuuaucagauuaaucucuugcucucc

SEQ ID NO: 727073 - RNA, 61 nt, Homo Sapiens
aaacgauuuuuuguguccuuaaaauggcaugaccauuuauuugccccuuucuccauccugu

SEQ ID NO: 727074 - RNA, 61 nt, Homo Sapiens
gucaauaaugaaacccaauuguaaaacagucaccauuuacuaccaguaacuuuuaguuaau

SEQ ID NO: 727075 - RNA, 61 nt, Homo Sapiens
gugauuuuagcuguggguuuauaagucucucaccauuuaguccugacucugacaagaaagc

SEQ ID NO: 727076 - RNA, 61 nt, Homo Sapiens
acuucccucacugcccuaccuuuucuuucucaccauuuaucccuguuaguuuucagucucc

SEQ ID NO: 727077 - RNA, 61 nt, Homo Sapiens
auguucuacuuuagugauaucauguauauauaccauuuauuuuaagcuauaaauguguuaa

SEQ ID NO: 727078 - RNA, 61 nt, Homo Sapiens
aaguaaugcugauauuuauucauaaaauaaaaccauuuaaaacguauguucauuauuugua

SEQ ID NO: 727079 - RNA, 61 nt, Homo Sapiens
aaaaaaaaaucuuugaaggggaucuuaaaaaaccauuuaaugggaaacugggagacuuuag

SEQ ID NO: 727080 - RNA, 61 nt, Homo Sapiens
aaaggaaacaguuuaaugguggaaaugaacuaccauuuauaacuucuguuuuuuuauugag

SEQ ID NO: 727081 - RNA, 61 nt, Homo Sapiens
gcuauuaaaugucacaauccuuuaauuagaaaccauuuauuggccggacgcgguggcucac

SEQ ID NO: 727082 - RNA, 61 nt, Homo Sapiens
cuccgucucaaaaaaaaaaaaaaaaaaagaaaccauuuauuuuaaaaaugauuagauugcu

SEQ ID NO: 727083 - RNA, 61 nt, Homo Sapiens
ggagaauuuagguuuuuauuaguaccauaguaccauuuauacaaauuagaaaauguuauuu

SEQ ID NO: 727084 - RNA, 61 nt, Homo Sapiens
aacugaaaggacacgaagucuucuauagaaaaccauuuaccaaagaaagaaauauuauuga

SEQ ID NO: 727085 - RNA, 61 nt, Homo Sapiens
acuaguauuuguuaaauggguaagccaaauaaccauuuaacgauuuucuuaacucagauuu

SEQ ID NO: 727086 - RNA, 61 nt, Homo Sapiens
cuacauauaacuggggaaaauuuaugauuaaaccauuuauguaucaugccuaagggagaca

SEQ ID NO: 727087 - RNA, 61 nt, Homo Sapiens
uaagugguucucaucucuaauuaacugugaaaccauuuaauccaaacauguaagcacacac

SEQ ID NO: 727088 - RNA, 61 nt, Homo Sapiens
agcuccacucggguggaguggaaguggccagaccauuuagacggacaggguccucacccua

SEQ ID NO: 727089 - RNA, 61 nt, Homo Sapiens
gucagguacaaauacacuauagagucaaaauaccauuuacaaagaaaaucaaaagcauuuc

SEQ ID NO: 727090 - RNA, 61 nt, Homo Sapiens
uguuagaauagugcuauauaucagguaugugaccauuuauuucagaaggcugaacauaaga

SEQ ID NO: 727091 - RNA, 61 nt, Homo Sapiens
ugcaagaaacucuuuuauuaaacuuggaacaaccauuuaaaugaaggauuuugugagauag

SEQ ID NO: 727092 - RNA, 61 nt, Homo Sapiens
aucaugagccuaauggcucaaaggcuuuuggaccauuuagcuuguccauaucacaccacca

SEQ ID NO: 727093 - RNA, 61 nt, Homo Sapiens
ugcucccaauguuuaugauagcccuuucuguaccauuuauugaagaggaacugggccuguu

SEQ ID NO: 727094 - RNA, 61 nt, Homo Sapiens
cuaaacuuagucauuuauuuuuccuaaugcaaccauuuaguauauaauuuugguugucaaa

SEQ ID NO: 727095 - RNA, 61 nt, Homo Sapiens
aaaacgaagggaaaagggaccacugaauugcaccauuuaagaugcugcuugaacaaauggg

SEQ ID NO: 727096 - RNA, 61 nt, Homo Sapiens
uguauuaacuuuggaauguauugcauuauauaccauuuaucggaauaacucuguggcauua

SEQ ID NO: 727097 - RNA, 61 nt, Homo Sapiens
uccucccuucuuucuuaaaguaauaaaauuuaccauuuaguucaagcuggcaauguggaca

SEQ ID NO: 727098 - RNA, 61 nt, Homo Sapiens
uauccuuuuuuucuuuccugauuauccuaacaccauuuauucaauaaccuuguccauuuuc

SEQ ID NO: 727099 - RNA, 61 nt, Homo Sapiens
uguggaagugaccacugggaugucaucauucaccauuuauccaggauggccgcucaccagg

SEQ ID NO: 727100 - RNA, 61 nt, Homo Sapiens
ccacacuccauggagacucaguucuccuaggaccauuuauucaaaaggacugcccucucuu

SEQ ID NO: 727101 - RNA, 61 nt, Homo Sapiens
aaggagagguagaugcauauuuuuguguggaaccauuuaucuuaaaacauugaggugcagu

SEQ ID NO: 727102 - RNA, 61 nt, Homo Sapiens
cuuuuguacaucaaccgugcuuuuggggcuaaccauuuauggggugacauuuuuacucccu

SEQ ID NO: 727103 - RNA, 61 nt, Homo Sapiens
ccauugguugccaucuuuaaugaguguuguuaccauuuagcauacuaugaauguaaggaua

SEQ ID NO: 727104 - RNA, 61 nt, Homo Sapiens
uaccuacacgcacgcaagagcaagccuauacaccauuuauaugucuaugcaugcacaccca

SEQ ID NO: 727105 - RNA, 61 nt, Homo Sapiens
caugguuuaucuucagcaaaagccuuccaacaccauuuaaaaaagaauauguugauuuaaa

SEQ ID NO: 727106 - RNA, 61 nt, Homo Sapiens
uccuauuaccuuuucucaucggcacuuuaucaccauuuagaaccacuuaaaguggaaucua

SEQ ID NO: 727107 - RNA, 61 nt, Homo Sapiens
auuucauagucauuuauguuuuuuuuccuucaccauuuaucccagucuuccuucacuauuu

SEQ ID NO: 727108 - RNA, 61 nt, Homo Sapiens
ugaucuguuuuucaccacuucacugaaagacaccauuuaucuacccaagggcagaaaguag

SEQ ID NO: 727109 - RNA, 61 nt, Homo Sapiens
gaauuuuaaaaaagauggauuugacacacucaccauuuaaucauuuccagcaaaauauaug

SEQ ID NO: 727110 - RNA, 61 nt, Homo Sapiens
ucaccuucucggcaacuaagcagucccugagaccauuuaacaugcaacccgaagguuaugg

SEQ ID NO: 727111 - RNA, 61 nt, Homo Sapiens
cuggaaaccguuauuugcaaacauugcuguuaccauuuagaaauaugugcacuaucagcug

SEQ ID NO: 727112 - RNA, 61 nt, Homo Sapiens
auuuagcaccugccagaugccagaaauuuauaccauuuaaaacucaguaagucuuuuaaau

SEQ ID NO: 727113 - RNA, 61 nt, Homo Sapiens
agucucaaguuuuauuauugcuucccccagcaccauuuaugugagaaaucguugcugcacc

SEQ ID NO: 727114 - RNA, 61 nt, Homo Sapiens
aaaagauaccaaaguagaagggacagagggaaccauuuaagccauucugugugugucgggg

SEQ ID NO: 727115 - RNA, 61 nt, Homo Sapiens
uuguguucuacugaguaagauggaguuauaaaccauuuacuuguauuuuccuugcaaauau

SEQ ID NO: 727116 - RNA, 61 nt, Homo Sapiens
gaugaggaaacuaaggcuccuugugauugucaccauuuacuccagcauucuaaaggagggu

SEQ ID NO: 727117 - RNA, 61 nt, Homo Sapiens
uaauguuuucuuuaaauggccugccuguaccaccauuuacugcaccaugauagguugcacg

SEQ ID NO: 727118 - RNA, 61 nt, Homo Sapiens
aaaaauuuccaaguuguuagaguuuuuaauaaccauuuaauucaugaaaauaucauuaauc

SEQ ID NO: 727119 - RNA, 61 nt, Homo Sapiens
ucauauauagaauuuacgggagaaacuugagaccauuuacggggagaaacuugauucuggg

SEQ ID NO: 727120 - RNA, 61 nt, Homo Sapiens
uccagauagagcagaggagaaauucuaaauuaccauuuacuaauuagcacagcugauguaa

SEQ ID NO: 727121 - RNA, 61 nt, Homo Sapiens
ugucagucucccaguuuuuccaugcagauaaaccauuuaaaggaaaugugauuaauuuaau

SEQ ID NO: 727122 - RNA, 61 nt, Homo Sapiens
uuguucugugucacucggcccuggguagucuaccauuuacuucaccccaaguccugcugcc

SEQ ID NO: 727123 - RNA, 61 nt, Homo Sapiens
ugcacauugcuuuagaucacauucgugauuuaccauuuaauuaacugguaaccucaaaauu

SEQ ID NO: 727124 - RNA, 61 nt, Homo Sapiens
uguuaaugauucccacauuuugcuuuuucauaccauuuauugguggucucauccauuccuu

SEQ ID NO: 727125 - RNA, 61 nt, Homo Sapiens
gguugguggcaacaauuuuagguguaguguaaccauuuagucccugccauuuuagugucuu

SEQ ID NO: 727126 - RNA, 61 nt, Homo Sapiens
ucagcaaauaccuaugucaacaguauaaguuaccauuuacucuauaaucugcagugaugca

SEQ ID NO: 727127 - RNA, 61 nt, Homo Sapiens
uugugguaacuguagucaucuuaaauuucaaaccauuuaccaucugaaaguuuugauuuga

SEQ ID NO: 727128 - RNA, 61 nt, Homo Sapiens
cuauguuauaguccagucuacuucuuuaaaaaccauuuaaacugcuagauaguauuagaau

SEQ ID NO: 727129 - RNA, 61 nt, Homo Sapiens
auuauauuuuauuuaucuuuguagccuaaagaccauuuaaucuugaaggaacacaaagauc

SEQ ID NO: 727130 - RNA, 61 nt, Homo Sapiens
guuggccauauuacugccacacaugagaagcaccauuuaugcagauuuucuucagaauauu

SEQ ID NO: 727131 - RNA, 61 nt, Homo Sapiens
ucauaccuuaauuuuuuuuuuuuuuuuuuuuaccauuuaugauuuauucuccuauguguca

SEQ ID NO: 727132 - RNA, 61 nt, Homo Sapiens
gaacuuauuaaauggaaacugaaacuacugcaccauuuaaaaacaggcagcucauaagagc

SEQ ID NO: 727133 - RNA, 61 nt, Homo Sapiens
acauguaucauuuuacaaaugagcuuucaagaccauuuaaggaaacagaugcuucauuugc

SEQ ID NO: 727134 - RNA, 61 nt, Homo Sapiens
aauugguaugaacaugagacguuccccagaaaccauuuauuagagaacauguugcuauaau

SEQ ID NO: 727135 - RNA, 61 nt, Homo Sapiens
ugaucauacaggacaggcugugucuguggucaccauuuaggccauuccagcaaauuccccg

SEQ ID NO: 727136 - RNA, 61 nt, Homo Sapiens
ccucaccuucuguuuuagagagacaguaaagaccauuuaguacuguauuguuacagcugaa

SEQ ID NO: 727137 - RNA, 61 nt, Homo Sapiens
ggguugggagucuuggccaagaagaauuuguaccauuuaauggccauacucagggguccag

SEQ ID NO: 727138 - RNA, 61 nt, Homo Sapiens
uagugaugugggauaaccuuagaacuuggaaaccauuuaugacaacaaugaauaaauaagg

SEQ ID NO: 727139 - RNA, 61 nt, Homo Sapiens
uaaaacacagagcuuagacagcgaugaggggaccauuuacaguaagaaauaaacaaugaaa

SEQ ID NO: 727140 - RNA, 61 nt, Homo Sapiens
uugaaggaaaaauucaauagauucucuuccaaccauuuaucaagugcugcagggcuuuaaa

SEQ ID NO: 727141 - RNA, 61 nt, Homo Sapiens
uuauggcuaagaaauggacucauaaaaugugaccauuuaacuuauggagacaaagugaaaa

SEQ ID NO: 727142 - RNA, 61 nt, Homo Sapiens
uguguguuaaacaacuacagcccccaauaagaccauuuaagaagaaccuccccuuucccuu

SEQ ID NO: 727143 - RNA, 61 nt, Homo Sapiens
uugcuuguugauuggaaagaguguuuuauucaccauuuaaacguuugcaaaguggcgugcc

SEQ ID NO: 727144 - RNA, 61 nt, Homo Sapiens
acauauagaauuaauacaaaacaguuuaacaaccauuuaacugcaguguaagaaaauugga

SEQ ID NO: 727145 - RNA, 65 nt, Homo Sapiens; identical to SEQ ID NO: 277870

SEQ ID NO: 727146 - RNA, 65 nt, Homo Sapiens; identical to SEQ ID NO: 277871

SEQ ID NO: 727147 - RNA, 65 nt, Homo Sapiens; identical to SEQ ID NO: 277872

SEQ ID NO: 727148 - RNA, 65 nt, Homo Sapiens; identical to SEQ ID NO: 277873

SEQ ID NO: 727149 - RNA, 65 nt, Homo Sapiens; identical to SEQ ID NO: 277874

SEQ ID NO: 727150 - RNA, 65 nt, Homo Sapiens; identical to SEQ ID NO: 277875

SEQ ID NO: 727151 - RNA, 65 nt, Homo Sapiens; identical to SEQ ID NO: 277876

SEQ ID NO: 727152 - RNA, 65 nt, Homo Sapiens; identical to SEQ ID NO: 277877

SEQ ID NO: 727153 - RNA, 65 nt, Homo Sapiens; identical to SEQ ID NO: 277878

SEQ ID NO: 727154 - RNA, 65 nt, Homo Sapiens; identical to SEQ ID NO: 277879

SEQ ID NO: 727155 - RNA, 65 nt, Homo Sapiens; identical to SEQ ID NO: 277880

SEQ ID NO: 727156 - RNA, 65 nt, Homo Sapiens; identical to SEQ ID NO: 277881

SEQ ID NO: 727157 - RNA, 65 nt, Homo Sapiens; identical to SEQ ID NO: 277882

SEQ ID NO: 727158 - RNA, 65 nt, Homo Sapiens; identical to SEQ ID NO: 277883

SEQ ID NO: 727159 - RNA, 65 nt, Homo Sapiens; identical to SEQ ID NO: 277884

SEQ ID NO: 727160 - RNA, 65 nt, Homo Sapiens; identical to SEQ ID NO: 277885

SEQ ID NO: 727161 - RNA, 65 nt, Homo Sapiens; identical to SEQ ID NO: 277886

SEQ ID NO: 727162 - RNA, 65 nt, Homo Sapiens; identical to SEQ ID NO: 277887

SEQ ID NO: 727163 - RNA, 65 nt, Homo Sapiens; identical to SEQ ID NO: 277888

SEQ ID NO: 727164 - RNA, 65 nt, Homo Sapiens; identical to SEQ ID NO: 277889

SEQ ID NO: 727165 - RNA, 65 nt, Homo Sapiens; identical to SEQ ID NO: 277890

SEQ ID NO: 727166 - RNA, 65 nt, Homo Sapiens; identical to SEQ ID NO: 277891

SEQ ID NO: 727167 - RNA, 65 nt, Homo Sapiens; identical to SEQ ID NO: 277892

SEQ ID NO: 727168 - RNA, 65 nt, Homo Sapiens; identical to SEQ ID NO: 277893

SEQ ID NO: 727169 - RNA, 65 nt, Homo Sapiens; identical to SEQ ID NO: 277894

SEQ ID NO: 727170 - RNA, 65 nt, Homo Sapiens; identical to SEQ ID NO: 277895

SEQ ID NO: 727171 - RNA, 65 nt, Homo Sapiens; identical to SEQ ID NO: 277896

SEQ ID NO: 727172 - RNA, 65 nt, Homo Sapiens; identical to SEQ ID NO: 277897

SEQ ID NO: 727173 - RNA, 65 nt, Homo Sapiens; identical to SEQ ID NO: 277898

SEQ ID NO: 727174 - RNA, 65 nt, Homo Sapiens; identical to SEQ ID NO: 277899

SEQ ID NO: 727175 - RNA, 65 nt, Homo Sapiens; identical to SEQ ID NO: 277900

SEQ ID NO: 727176 - RNA, 65 nt, Homo Sapiens; identical to SEQ ID NO: 277901

SEQ ID NO: 727177 - RNA, 65 nt, Homo Sapiens; identical to SEQ ID NO: 277902

SEQ ID NO: 727178 - RNA, 65 nt, Homo Sapiens; identical to SEQ ID NO: 277903

SEQ ID NO: 727179 - RNA, 65 nt, Homo Sapiens; identical to SEQ ID NO: 277904

SEQ ID NO: 727180 - RNA, 65 nt, Homo Sapiens; identical to SEQ ID NO: 277905

SEQ ID NO: 727181 - RNA, 65 nt, Homo Sapiens; identical to SEQ ID NO: 277906

SEQ ID NO: 727182 - RNA, 65 nt, Homo Sapiens; identical to SEQ ID NO: 277907

SEQ ID NO: 727183 - RNA, 65 nt, Homo Sapiens; identical to SEQ ID NO: 277908

SEQ ID NO: 727184 - RNA, 65 nt, Homo Sapiens; identical to SEQ ID NO: 277909

SEQ ID NO: 727185 - RNA, 65 nt, Homo Sapiens; identical to SEQ ID NO: 277910

SEQ ID NO: 727186 - RNA, 65 nt, Homo Sapiens; identical to SEQ ID NO: 277911

SEQ ID NO: 727187 - RNA, 65 nt, Homo Sapiens; identical to SEQ ID NO: 277912

SEQ ID NO: 727188 - RNA, 65 nt, Homo Sapiens; identical to SEQ ID NO: 277913

SEQ ID NO: 727189 - RNA, 65 nt, Homo Sapiens; identical to SEQ ID NO: 277914

SEQ ID NO: 727190 - RNA, 65 nt, Homo Sapiens; identical to SEQ ID NO: 277915

SEQ ID NO: 727191 - RNA, 65 nt, Homo Sapiens; identical to SEQ ID NO: 277916

SEQ ID NO: 727192 - RNA, 65 nt, Homo Sapiens; identical to SEQ ID NO: 277917

SEQ ID NO: 727193 - RNA, 65 nt, Homo Sapiens; identical to SEQ ID NO: 277918

SEQ ID NO: 727194 - RNA, 65 nt, Homo Sapiens; identical to SEQ ID NO: 277919

SEQ ID NO: 727195 - RNA, 65 nt, Homo Sapiens; identical to SEQ ID NO: 277920

SEQ ID NO: 727196 - RNA, 65 nt, Homo Sapiens; identical to SEQ ID NO: 277921

SEQ ID NO: 727197 - RNA, 65 nt, Homo Sapiens; identical to SEQ ID NO: 277922

SEQ ID NO: 727198 - RNA, 65 nt, Homo Sapiens; identical to SEQ ID NO: 277923

SEQ ID NO: 727199 - RNA, 65 nt, Homo Sapiens; identical to SEQ ID NO: 277924

SEQ ID NO: 727200 - RNA, 65 nt, Homo Sapiens; identical to SEQ ID NO: 277925

SEQ ID NO: 727201 - RNA, 65 nt, Homo Sapiens; identical to SEQ ID NO: 277926

SEQ ID NO: 727202 - RNA, 65 nt, Homo Sapiens; identical to SEQ ID NO: 277927

SEQ ID NO: 727203 - RNA, 65 nt, Homo Sapiens; identical to SEQ ID NO: 277928

SEQ ID NO: 727204 - RNA, 65 nt, Homo Sapiens; identical to SEQ ID NO: 277929

SEQ ID NO: 727205 - RNA, 65 nt, Homo Sapiens; identical to SEQ ID NO: 277930

SEQ ID NO: 727206 - RNA, 65 nt, Homo Sapiens; identical to SEQ ID NO: 277931

SEQ ID NO: 727207 - RNA, 65 nt, Homo Sapiens; identical to SEQ ID NO: 277932

SEQ ID NO: 727208 - RNA, 65 nt, Homo Sapiens; identical to SEQ ID NO: 277933

SEQ ID NO: 727209 - RNA, 65 nt, Homo Sapiens; identical to SEQ ID NO: 277934

SEQ ID NO: 727210 - RNA, 65 nt, Homo Sapiens; identical to SEQ ID NO: 277935

SEQ ID NO: 727211 - RNA, 65 nt, Homo Sapiens; identical to SEQ ID NO: 277936

SEQ ID NO: 727212 - RNA, 65 nt, Homo Sapiens; identical to SEQ ID NO: 277937

SEQ ID NO: 727213 - RNA, 65 nt, Homo Sapiens; identical to SEQ ID NO: 277938

SEQ ID NO: 727214 - RNA, 65 nt, Homo Sapiens; identical to SEQ ID NO: 277939

SEQ ID NO: 727215 - RNA, 65 nt, Homo Sapiens; identical to SEQ ID NO: 277940

SEQ ID NO: 727216 - RNA, 65 nt, Homo Sapiens; identical to SEQ ID NO: 277941

SEQ ID NO: 727217 - RNA, 65 nt, Homo Sapiens; identical to SEQ ID NO: 277942

SEQ ID NO: 727218 - RNA, 65 nt, Homo Sapiens; identical to SEQ ID NO: 277943

SEQ ID NO: 727219 - RNA, 65 nt, Homo Sapiens; identical to SEQ ID NO: 277944

SEQ ID NO: 727220 - RNA, 65 nt, Homo Sapiens; identical to SEQ ID NO: 277945

SEQ ID NO: 727221 - RNA, 65 nt, Homo Sapiens; identical to SEQ ID NO: 277946

SEQ ID NO: 727222 - RNA, 65 nt, Homo Sapiens; identical to SEQ ID NO: 277947

SEQ ID NO: 727223 - RNA, 65 nt, Homo Sapiens; identical to SEQ ID NO: 277948

SEQ ID NO: 727224 - RNA, 65 nt, Homo Sapiens; identical to SEQ ID NO: 277949

SEQ ID NO: 727225 - RNA, 65 nt, Homo Sapiens; identical to SEQ ID NO: 277950

SEQ ID NO: 727226 - RNA, 65 nt, Homo Sapiens; identical to SEQ ID NO: 277951

SEQ ID NO: 727227 - RNA, 65 nt, Homo Sapiens; identical to SEQ ID NO: 277952

SEQ ID NO: 727228 - RNA, 65 nt, Homo Sapiens; identical to SEQ ID NO: 277953

SEQ ID NO: 727229 - RNA, 65 nt, Homo Sapiens; identical to SEQ ID NO: 277954

SEQ ID NO: 727230 - RNA, 65 nt, Homo Sapiens; identical to SEQ ID NO: 277955

SEQ ID NO: 727231 - RNA, 65 nt, Homo Sapiens; identical to SEQ ID NO: 277956

SEQ ID NO: 727232 - RNA, 65 nt, Homo Sapiens; identical to SEQ ID NO: 277957

SEQ ID NO: 727233 - RNA, 65 nt, Homo Sapiens; identical to SEQ ID NO: 277958

SEQ ID NO: 727234 - RNA, 65 nt, Homo Sapiens; identical to SEQ ID NO: 277959

SEQ ID NO: 727235 - RNA, 65 nt, Homo Sapiens; identical to SEQ ID NO: 277960

SEQ ID NO: 727236 - RNA, 65 nt, Homo Sapiens; identical to SEQ ID NO: 277961

SEQ ID NO: 727237 - RNA, 65 nt, Homo Sapiens; identical to SEQ ID NO: 277962

SEQ ID NO: 727238 - RNA, 65 nt, Homo Sapiens; identical to SEQ ID NO: 277963

SEQ ID NO: 727239 - RNA, 65 nt, Homo Sapiens; identical to SEQ ID NO: 277964

SEQ ID NO: 727240 - RNA, 65 nt, Homo Sapiens; identical to SEQ ID NO: 277965

SEQ ID NO: 727241 - RNA, 65 nt, Homo Sapiens; identical to SEQ ID NO: 277966

SEQ ID NO: 727242 - RNA, 65 nt, Homo Sapiens; identical to SEQ ID NO: 277967

SEQ ID NO: 727243 - RNA, 65 nt, Homo Sapiens; identical to SEQ ID NO: 277968

SEQ ID NO: 727244 - RNA, 65 nt, Homo Sapiens; identical to SEQ ID NO: 277969

SEQ ID NO: 727245 - RNA, 65 nt, Homo Sapiens; identical to SEQ ID NO: 277970

SEQ ID NO: 727246 - RNA, 65 nt, Homo Sapiens; identical to SEQ ID NO: 277971

SEQ ID NO: 727247 - RNA, 65 nt, Homo Sapiens; identical to SEQ ID NO: 277972

SEQ ID NO: 727248 - RNA, 65 nt, Homo Sapiens; identical to SEQ ID NO: 277973

SEQ ID NO: 727249 - RNA, 65 nt, Homo Sapiens; identical to SEQ ID NO: 277974

SEQ ID NO: 727250 - RNA, 65 nt, Homo Sapiens; identical to SEQ ID NO: 277975

SEQ ID NO: 727251 - RNA, 65 nt, Homo Sapiens; identical to SEQ ID NO: 277976

SEQ ID NO: 727252 - RNA, 65 nt, Homo Sapiens; identical to SEQ ID NO: 277977

SEQ ID NO: 727253 - RNA, 65 nt, Homo Sapiens; identical to SEQ ID NO: 277978

SEQ ID NO: 727254 - RNA, 65 nt, Homo Sapiens; identical to SEQ ID NO: 277979

SEQ ID NO: 727255 - RNA, 65 nt, Homo Sapiens; identical to SEQ ID NO: 277980

SEQ ID NO: 727256 - RNA, 65 nt, Homo Sapiens; identical to SEQ ID NO: 277981

SEQ ID NO: 727257 - RNA, 65 nt, Homo Sapiens; identical to SEQ ID NO: 277982

SEQ ID NO: 727258 - RNA, 65 nt, Homo Sapiens; identical to SEQ ID NO: 277983

SEQ ID NO: 727259 - RNA, 56 nt, Homo Sapiens; identical to SEQ ID NO: 277656

SEQ ID NO: 727260 - RNA, 65 nt, Homo Sapiens; identical to SEQ ID NO: 277985

SEQ ID NO: 727261 - RNA, 65 nt, Homo Sapiens; identical to SEQ ID NO: 277986

SEQ ID NO: 727262 - RNA, 65 nt, Homo Sapiens; identical to SEQ ID NO: 277987

SEQ ID NO: 727263 - RNA, 65 nt, Homo Sapiens; identical to SEQ ID NO: 277988

SEQ ID NO: 727264 - RNA, 65 nt, Homo Sapiens; identical to SEQ ID NO: 277989

SEQ ID NO: 727265 - RNA, 65 nt, Homo Sapiens; identical to SEQ ID NO: 277990

SEQ ID NO: 727266 - RNA, 65 nt, Homo Sapiens; identical to SEQ ID NO: 277991

SEQ ID NO: 727267 - RNA, 65 nt, Homo Sapiens; identical to SEQ ID NO: 277992

SEQ ID NO: 727268 - RNA, 65 nt, Homo Sapiens; identical to SEQ ID NO: 277993

SEQ ID NO: 727269 - RNA, 65 nt, Homo Sapiens; identical to SEQ ID NO: 277994

SEQ ID NO: 727270 - RNA, 65 nt, Homo Sapiens; identical to SEQ ID NO: 277995

SEQ ID NO: 727271 - RNA, 65 nt, Homo Sapiens; identical to SEQ ID NO: 277996

SEQ ID NO: 727272 - RNA, 65 nt, Homo Sapiens; identical to SEQ ID NO: 277997

SEQ ID NO: 727273 - RNA, 65 nt, Homo Sapiens; identical to SEQ ID NO: 277998

SEQ ID NO: 727274 - RNA, 65 nt, Homo Sapiens; identical to SEQ ID NO: 277999

SEQ ID NO: 727275 - RNA, 65 nt, Homo Sapiens; identical to SEQ ID NO: 278000

SEQ ID NO: 727276 - RNA, 65 nt, Homo Sapiens; identical to SEQ ID NO: 278001

SEQ ID NO: 727277 - RNA, 65 nt, Homo Sapiens; identical to SEQ ID NO: 278002

SEQ ID NO: 727278 - RNA, 65 nt, Homo Sapiens; identical to SEQ ID NO: 278003

SEQ ID NO: 727279 - RNA, 65 nt, Homo Sapiens; identical to SEQ ID NO: 278004

SEQ ID NO: 727280 - RNA, 65 nt, Homo Sapiens; identical to SEQ ID NO: 278005

SEQ ID NO: 727281 - RNA, 65 nt, Homo Sapiens; identical to SEQ ID NO: 278006

SEQ ID NO: 727282 - RNA, 65 nt, Homo Sapiens; identical to SEQ ID NO: 278007

SEQ ID NO: 727283 - RNA, 65 nt, Homo Sapiens; identical to SEQ ID NO: 278008

SEQ ID NO: 727284 - RNA, 65 nt, Homo Sapiens; identical to SEQ ID NO: 278009

SEQ ID NO: 727285 - RNA, 65 nt, Homo Sapiens; identical to SEQ ID NO: 278010

SEQ ID NO: 727286 - RNA, 65 nt, Homo Sapiens; identical to SEQ ID NO: 278011

SEQ ID NO: 727287 - RNA, 65 nt, Homo Sapiens; identical to SEQ ID NO: 278012

SEQ ID NO: 727288 - RNA, 65 nt, Homo Sapiens; identical to SEQ ID NO: 278013

SEQ ID NO: 727289 - RNA, 65 nt, Homo Sapiens; identical to SEQ ID NO: 278014

SEQ ID NO: 727290 - RNA, 65 nt, Homo Sapiens; identical to SEQ ID NO: 278015

SEQ ID NO: 727291 - RNA, 65 nt, Homo Sapiens; identical to SEQ ID NO: 278016

SEQ ID NO: 727292 - RNA, 65 nt, Homo Sapiens; identical to SEQ ID NO: 278017

SEQ ID NO: 727293 - RNA, 65 nt, Homo Sapiens; identical to SEQ ID NO: 278018

SEQ ID NO: 727294 - RNA, 65 nt, Homo Sapiens; identical to SEQ ID NO: 278019

SEQ ID NO: 727295 - RNA, 65 nt, Homo Sapiens; identical to SEQ ID NO: 278020

SEQ ID NO: 727296 - RNA, 65 nt, Homo Sapiens; identical to SEQ ID NO: 278021

SEQ ID NO: 727297 - RNA, 65 nt, Homo Sapiens; identical to SEQ ID NO: 278022

SEQ ID NO: 727298 - RNA, 65 nt, Homo Sapiens; identical to SEQ ID NO: 278023

SEQ ID NO: 727299 - RNA, 65 nt, Homo Sapiens; identical to SEQ ID NO: 278024

SEQ ID NO: 727300 - RNA, 65 nt, Homo Sapiens; identical to SEQ ID NO: 278025
